United States Patent 7,323,308 (METHODS OF GENETIC ANALYSIS OF E. COLI) - sequence listing, part 3

SEQ ID NO: 81856 - DNA, 25 bp, E. coli
ttcatacgccgaagccgagaaggat

SEQ ID NO: 81857 - DNA, 25 bp, E. coli
tgagccgaagcaccctttgtatatg

SEQ ID NO: 81858 - DNA, 25 bp, E. coli
tgagccgaagcagcctttgtatatg

SEQ ID NO: 81859 - DNA, 25 bp, E. coli
tcccattggcaatgataacgatagc

SEQ ID NO: 81860 - DNA, 25 bp, E. coli
tcccattggcaaagataacgatagc

SEQ ID NO: 81861 - DNA, 25 bp, E. coli
gctacggtggcgtatacatggccaa

SEQ ID NO: 81862 - DNA, 25 bp, E. coli
gctacggtggcgaatacatggccaa

SEQ ID NO: 81863 - DNA, 25 bp, E. coli
gaaggatgatcgcaccttgagccgc

SEQ ID NO: 81864 - DNA, 25 bp, E. coli
gaaggatgatcggaccttgagccgc

SEQ ID NO: 81865 - DNA, 25 bp, E. coli
gatacgtcttgttagcggtgccgga

SEQ ID NO: 81866 - DNA, 25 bp, E. coli
gtcttaaacgctacaggtgagccga

SEQ ID NO: 81867 - DNA, 25 bp, E. coli
gatacgtcttgtaagcggtgccgga

SEQ ID NO: 81868 - DNA, 25 bp, E. coli
gtcttaaacgcttcaggtgagccga

SEQ ID NO: 81869 - DNA, 25 bp, E. coli
gagtctgggacgtatcaaaaccgta

SEQ ID NO: 81870 - DNA, 25 bp, E. coli
gatgaaagcgtcagatcccattggc

SEQ ID NO: 81871 - DNA, 25 bp, E. coli
gagtctgggacgaatcaaaaccgta

SEQ ID NO: 81872 - DNA, 25 bp, E. coli
gatgaaagcgtctgatcccattggc

SEQ ID NO: 81873 - DNA, 25 bp, E. coli
aattgatcgacaagattgctgcagg

SEQ ID NO: 81874 - DNA, 25 bp, E. coli
aattgatcgacatgattgctgcagg

SEQ ID NO: 81875 - DNA, 25 bp, E. coli
taaagtaccgagcttccgtgcaggt

SEQ ID NO: 81876 - DNA, 25 bp, E. coli
taaagtaccgaggttccgtgcaggt

SEQ ID NO: 81877 - DNA, 25 bp, E. coli
ttttgccgttaatgagcgtgctgcc

SEQ ID NO: 81878 - DNA, 25 bp, E. coli
ttttgccgttaaagagcgtgctgcc

SEQ ID NO: 81879 - DNA, 25 bp, E. coli
ttaaagagcgtgctgcccgtactgg

SEQ ID NO: 81880 - DNA, 25 bp, E. coli
ttaaagagcgtggtgcccgtactgg

SEQ ID NO: 81881 - DNA, 25 bp, E. coli
gctggccgtgcgttagatgctatta

SEQ ID NO: 81882 - DNA, 25 bp, E. coli
gcttccgtgcaggtaaagcactgaa

SEQ ID NO: 81883 - DNA, 25 bp, E. coli
gcttccgtgcagctaaagcactgaa

SEQ ID NO: 81884 - DNA, 25 bp, E. coli
gctggccgtgcgatagatgctatta

SEQ ID NO: 81885 - DNA, 25 bp, E. coli
cgtaactgaatcactgaaagaaggg

SEQ ID NO: 81886 - DNA, 25 bp, E. coli
cgtaactgaatctctgaaagaaggg

SEQ ID NO: 81887 - DNA, 25 bp, E. coli
gatatctctaaacctgcggctggcc

SEQ ID NO: 81888 - DNA, 25 bp, E. coli
gatatctctaaagctgcggctggcc

SEQ ID NO: 81889 - DNA, 25 bp, E. coli
taaagcactgaatgacgcggtaaac

SEQ ID NO: 81890 - DNA, 25 bp, E. coli
taaagcactgaaagacgcggtaaac

SEQ ID NO: 81891 - DNA, 25 bp, E. coli
gatgtagcactgctaggttttggta

SEQ ID NO: 81892 - DNA, 25 bp, E. coli
gaccggtaaagagatcaccatcgct

SEQ ID NO: 81893 - DNA, 25 bp, E. coli
gaccggtaaagacatcaccatcgct

SEQ ID NO: 81894 - DNA, 25 bp, E. coli
gatgtagcactggtaggttttggta

SEQ ID NO: 81895 - DNA, 25 bp, E. coli
aatccacgcgcgcaaagtaaactgg

SEQ ID NO: 81896 - DNA, 25 bp, E. coli
aatccacgcgcggaaagtaaactgg

SEQ ID NO: 81897 - DNA, 25 bp, E. coli
tactggtatgaggaatcagcggaac

SEQ ID NO: 81898 - DNA, 25 bp, E. coli
tactggtatgagcaatcagcggaac

SEQ ID NO: 81899 - DNA, 25 bp, E. coli
tatcttcatggtagcgacggtaaac

SEQ ID NO: 81900 - DNA, 25 bp, E. coli
tattagccaaccgaagaaaacgacg

SEQ ID NO: 81901 - DNA, 25 bp, E. coli
tattagccaacccaagaaaacgacg

SEQ ID NO: 81902 - DNA, 25 bp, E. coli
tatcttcatggttgcgacggtaaac

SEQ ID NO: 81903 - DNA, 25 bp, E. coli
gaaagattacttgccgggcttcccg

SEQ ID NO: 81904 - DNA, 25 bp, E. coli
gaacaagggtatcctcatgctcaat

SEQ ID NO: 81905 - DNA, 25 bp, E. coli
gaacaagggtatgctcatgctcaat

SEQ ID NO: 81906 - DNA, 25 bp, E. coli
gaaagattacttcccgggcttcccg

SEQ ID NO: 81907 - DNA, 25 bp, E. coli
cgttgcgtgataaagccatggtgaa

SEQ ID NO: 81908 - DNA, 25 bp, E. coli
cgttgcgtgatatagccatggtgaa

SEQ ID NO: 81909 - DNA, 25 bp, E. coli
ggtggatctacctcaaaggtctggg

SEQ ID NO: 81910 - DNA, 25 bp, E. coli
ggtggatctaccacaaaggtctggg

SEQ ID NO: 81911 - DNA, 25 bp, E. coli
gattcatggtcactcaacgtcgcaa

SEQ ID NO: 81912 - DNA, 25 bp, E. coli
gattatttaagcacaccgggcagtc

SEQ ID NO: 81913 - DNA, 25 bp, E. coli
gattcatggtcagtcaacgtcgcaa

SEQ ID NO: 81914 - DNA, 25 bp, E. coli
gattatttaagctcaccgggcagtc

SEQ ID NO: 81915 - DNA, 25 bp, E. coli
tcagcggaacagcaaaatccacgcg

SEQ ID NO: 81916 - DNA, 25 bp, E. coli
tcagcggaacaggaaaatccacgcg

SEQ ID NO: 81917 - DNA, 25 bp, E. coli
tacgcgtttgagaggcaggatcacg

SEQ ID NO: 81918 - DNA, 25 bp, E. coli
tacgcgtttgagtggcaggatcacg

SEQ ID NO: 81919 - DNA, 25 bp, E. coli
taacggtgagttatccacgcaagaa

SEQ ID NO: 81920 - DNA, 25 bp, E. coli
tatacgcgcattcggctggatcgct

SEQ ID NO: 81921 - DNA, 25 bp, E. coli
tatagcgcgggttaacgtggaacgt

SEQ ID NO: 81922 - DNA, 25 bp, E. coli
tatacgcgcattgggctggatcgct

SEQ ID NO: 81923 - DNA, 25 bp, E. coli
tatagcgcgggtaaacgtggaacgt

SEQ ID NO: 81924 - DNA, 25 bp, E. coli
tgatgaaccgggaaaagacacggcg

SEQ ID NO: 81925 - DNA, 25 bp, E. coli
tgatgaaccgggtaaagacacggcg

SEQ ID NO: 81926 - DNA, 25 bp, E. coli
cctattatcaggtagggccggtaga

SEQ ID NO: 81927 - DNA, 25 bp, E. coli
cctattatcaggaagggccggtaga

SEQ ID NO: 81928 - DNA, 25 bp, E. coli
gacacggcgaatatgcagcgctgga

SEQ ID NO: 81929 - DNA, 25 bp, E. coli
gacacggcgaatttgcagcgctgga

SEQ ID NO: 81930 - DNA, 25 bp, E. coli
cgaaacggttgccttgcgagtgaac

SEQ ID NO: 81931 - DNA, 25 bp, E. coli
cgaaacggttgcgttgcgagtgaac

SEQ ID NO: 81932 - DNA, 25 bp, E. coli
gtctattttaatgccgccaacgggc

SEQ ID NO: 81933 - DNA, 25 bp, E. coli
gtctattttaatcccgccaacgggc

SEQ ID NO: 81934 - DNA, 25 bp, E. coli
ggttacgctgatacccgtgtcgaaa

SEQ ID NO: 81935 - DNA, 25 bp, E. coli
ggttacgctgattcccgtgtcgaaa

SEQ ID NO: 81936 - DNA, 25 bp, E. coli
taacggtgagttttccacgcaagaa

SEQ ID NO: 81937 - DNA, 25 bp, E. coli
gactggcacttttatatcggcgcga

SEQ ID NO: 81938 - DNA, 25 bp, E. coli
gactggcactttaatatcggcgcga

SEQ ID NO: 81939 - DNA, 25 bp, E. coli
taaagacataagtgttcagatgccg

SEQ ID NO: 81940 - DNA, 25 bp, E. coli
taaagacataagagttcagatgccg

SEQ ID NO: 81941 - DNA, 25 bp, E. coli
aaaatccatagagccatagtctggg

SEQ ID NO: 81942 - DNA, 25 bp, E. coli
aaaatccatagacccatagtctggg

SEQ ID NO: 81943 - DNA, 25 bp, E. coli
tgcagatacatcaagcgaaattccc

SEQ ID NO: 81944 - DNA, 25 bp, E. coli
tgcagatacatctagcgaaattccc

SEQ ID NO: 81945 - DNA, 25 bp, E. coli
gctaaatctcatcaagagcgcaaaa

SEQ ID NO: 81946 - DNA, 25 bp, E. coli
gcttattgcctatagtgaaccacga

SEQ ID NO: 81947 - DNA, 25 bp, E. coli
gctaaatctcatgaagagcgcaaaa

SEQ ID NO: 81948 - DNA, 25 bp, E. coli
gcttattgcctaaagtgaaccacga

SEQ ID NO: 81949 - DNA, 25 bp, E. coli
cgatataaactctcctttgtaaggg

SEQ ID NO: 81950 - DNA, 25 bp, E. coli
cgatataaactcacctttgtaaggg

SEQ ID NO: 81951 - DNA, 25 bp, E. coli
gatcacgctccaatatgctggcaag

SEQ ID NO: 81952 - DNA, 25 bp, E. coli
gatgccggatatgtcattagcagtg

SEQ ID NO: 81953 - DNA, 25 bp, E. coli
gattttgcccggaaatagagaatta

SEQ ID NO: 81954 - DNA, 25 bp, E. coli
gatcacgctccattatgctggcaag

SEQ ID NO: 81955 - DNA, 25 bp, E. coli
gattttgcccggtaatagagaatta

SEQ ID NO: 81956 - DNA, 25 bp, E. coli
taacgacaactttgggaataactcg

SEQ ID NO: 81957 - DNA, 25 bp, E. coli
taacgacaacttagggaataactcg

SEQ ID NO: 81958 - DNA, 25 bp, E. coli
gatttttcatttgaccgagtcctaa

SEQ ID NO: 81959 - DNA, 25 bp, E. coli
gatgccggatatctcattagcagtg

SEQ ID NO: 81960 - DNA, 25 bp, E. coli
gatttttcatttcaccgagtcctaa

SEQ ID NO: 81961 - DNA, 25 bp, E. coli
tactccaacagatcgctgccgttcg

SEQ ID NO: 81962 - DNA, 25 bp, E. coli
tactccaacagaacgctgccgttcg

SEQ ID NO: 81963 - DNA, 25 bp, E. coli
tgatgaggtgcgaaatgcccagtac

SEQ ID NO: 81964 - DNA, 25 bp, E. coli
tgatgaggtgcgtaatgcccagtac

SEQ ID NO: 81965 - DNA, 25 bp, E. coli
tccgttgacgacactattgaactgg

SEQ ID NO: 81966 - DNA, 25 bp, E. coli
tccgttgacgactctattgaactgg

SEQ ID NO: 81967 - DNA, 25 bp, E. coli
gcgaagtcagccaatccgttgacga

SEQ ID NO: 81968 - DNA, 25 bp, E. coli
gcttgaaagccatatccgggaaacg

SEQ ID NO: 81969 - DNA, 25 bp, E. coli
gcttgaaagccaaatccgggaaacg

SEQ ID NO: 81970 - DNA, 25 bp, E. coli
gcgaagtcagcctatccgttgacga

SEQ ID NO: 81971 - DNA, 25 bp, E. coli
gaactggttcgtccctatcttaaat

SEQ ID NO: 81972 - DNA, 25 bp, E. coli
gaactggttcgtgcctatcttaaat

SEQ ID NO: 81973 - DNA, 25 bp, E. coli
gaaatgcccagttctccggaagaga

SEQ ID NO: 81974 - DNA, 25 bp, E. coli
gaaatgactgctacagccgcgaagt

SEQ ID NO: 81975 - DNA, 25 bp, E. coli
gaaatgcccagtactccggaagaga

SEQ ID NO: 81976 - DNA, 25 bp, E. coli
gaaatgactgcttcagccgcgaagt

SEQ ID NO: 81977 - DNA, 25 bp, E. coli
gattgatgctctggaacggtcgctg

SEQ ID NO: 81978 - DNA, 25 bp, E. coli
gattgatgctctcgaacggtcgctg

SEQ ID NO: 81979 - DNA, 25 bp, E. coli
gggaaacgtttgaccgaaatgactg

SEQ ID NO: 81980 - DNA, 25 bp, E. coli
ggtgatgccgaatgccgtgccatac

SEQ ID NO: 81981 - DNA, 25 bp, E. coli
ggtgatgccgaaagccgtgccatac

SEQ ID NO: 81982 - DNA, 25 bp, E. coli
gggaaacgtttgtccgaaatgactg

SEQ ID NO: 81983 - DNA, 25 bp, E. coli
gcgaagttcacagccagaaactcag

SEQ ID NO: 81984 - DNA, 25 bp, E. coli
gcgaagttcacacccagaaactcag

SEQ ID NO: 81985 - DNA, 25 bp, E. coli
cagaaactcagctaagaagcgcaga

SEQ ID NO: 81986 - DNA, 25 bp, E. coli
cagaaactcagcaaagaagcgcaga

SEQ ID NO: 81987 - DNA, 25 bp, E. coli
agatgccgttcctgcgtgcaatcac

SEQ ID NO: 81988 - DNA, 25 bp, E. coli
agatgccgttccagcgtgcaatcac

SEQ ID NO: 81989 - DNA, 25 bp, E. coli
tgcgcgaagttctcagccagaaact

SEQ ID NO: 81990 - DNA, 25 bp, E. coli
tcgcctgcgcgatgttcacagccag

SEQ ID NO: 81991 - DNA, 25 bp, E. coli
tcgcctgcgcgaagttcacagccag

SEQ ID NO: 81992 - DNA, 25 bp, E. coli
tgcgcgaagttcacagccagaaact

SEQ ID NO: 81993 - DNA, 25 bp, E. coli
gccgttccagcgtgcaatcaccaaa

SEQ ID NO: 81994 - DNA, 25 bp, E. coli
gccagaaactcaccaaagaagcgca

SEQ ID NO: 81995 - DNA, 25 bp, E. coli
gccgttccagcgagcaatcaccaaa

SEQ ID NO: 81996 - DNA, 25 bp, E. coli
gccagaaactcagcaaagaagcgca

SEQ ID NO: 81997 - DNA, 25 bp, E. coli
gaagatgccgttccagcgtgcaatc

SEQ ID NO: 81998 - DNA, 25 bp, E. coli
gaagatgccgttgcagcgtgcaatc

SEQ ID NO: 81999 - DNA, 25 bp, E. coli
gaaactcagcaatgaagcgcagaaa

SEQ ID NO: 82000 - DNA, 25 bp, E. coli
gaaactcagcaaagaagcgcagaaa

SEQ ID NO: 82001 - DNA, 25 bp, E. coli
ctcagcaaagaaccgcagaaactga

SEQ ID NO: 82002 - DNA, 25 bp, E. coli
ctcagcaaagaagcgcagaaactga

SEQ ID NO: 82003 - DNA, 25 bp, E. coli
gttccagcgtgctatcaccaaaaaa

SEQ ID NO: 82004 - DNA, 25 bp, E. coli
gttccagcgtgcaatcaccaaaaaa

SEQ ID NO: 82005 - DNA, 25 bp, E. coli
caccaacagaaggatcgataaaagt

SEQ ID NO: 82006 - DNA, 25 bp, E. coli
caccaacagaagcatcgataaaagt

SEQ ID NO: 82007 - DNA, 25 bp, E. coli
catatcattctggaaaaaacctctt

SEQ ID NO: 82008 - DNA, 25 bp, E. coli
catatcattctgcaaaaaacctctt

SEQ ID NO: 82009 - DNA, 25 bp, E. coli
agtggcctggccgttccttgttcaa

SEQ ID NO: 82010 - DNA, 25 bp, E. coli
agtggcctggcccttccttgttcaa

SEQ ID NO: 82011 - DNA, 25 bp, E. coli
tattgcatctgaaatatgacacacc

SEQ ID NO: 82012 - DNA, 25 bp, E. coli
tatttctgatacacagtggcctggc

SEQ ID NO: 82013 - DNA, 25 bp, E. coli
tattgcatctgatatatgacacacc

SEQ ID NO: 82014 - DNA, 25 bp, E. coli
tatacctgacaataacaatcacact

SEQ ID NO: 82015 - DNA, 25 bp, E. coli
tatttctgatactcagtggcctggc

SEQ ID NO: 82016 - DNA, 25 bp, E. coli
tatacctgacaaaaacaatcacact

SEQ ID NO: 82017 - DNA, 25 bp, E. coli
ttctatttcaaaaatatcctgtggg

SEQ ID NO: 82018 - DNA, 25 bp, E. coli
ttctatttcaaatatatcctgtggg

SEQ ID NO: 82019 - DNA, 25 bp, E. coli
gcccttccttgtacaatatacctga

SEQ ID NO: 82020 - DNA, 25 bp, E. coli
gcccttccttgttcaatatacctga

SEQ ID NO: 82021 - DNA, 25 bp, E. coli
cctcttttctggtcttatggtatat

SEQ ID NO: 82022 - DNA, 25 bp, E. coli
cctcttttctggacttatggtatat

SEQ ID NO: 82023 - DNA, 25 bp, E. coli
gatatatgacactccaacagaagca

SEQ ID NO: 82024 - DNA, 25 bp, E. coli
gatatatgacacaccaacagaagca

SEQ ID NO: 82025 - DNA, 25 bp, E. coli
gggaatgtgcccgattataatatcc

SEQ ID NO: 82026 - DNA, 25 bp, E. coli
gggaatgtgccccattataatatcc

SEQ ID NO: 82027 - DNA, 25 bp, E. coli
caacaggtttttgcgaccgacgcca

SEQ ID NO: 82028 - DNA, 25 bp, E. coli
caacaggtttttccgaccgacgcca

SEQ ID NO: 82029 - DNA, 25 bp, E. coli
caggagtttacacgcttcagtcagg

SEQ ID NO: 82030 - DNA, 25 bp, E. coli
caggagtttacaggcttcagtcagg

SEQ ID NO: 82031 - DNA, 25 bp, E. coli
agtatgagcaggttttccacgcgga

SEQ ID NO: 82032 - DNA, 25 bp, E. coli
agtatgagcaggatttccacgcgga

SEQ ID NO: 82033 - DNA, 25 bp, E. coli
aaatcattcgcgtggtgctgaaccc

SEQ ID NO: 82034 - DNA, 25 bp, E. coli
aaatcattcgcgaggtgctgaaccc

SEQ ID NO: 82035 - DNA, 25 bp, E. coli
tatgtgtcccatgaaggctatgccg

SEQ ID NO: 82036 - DNA, 25 bp, E. coli
tatgtgtcccatcaaggctatgccg

SEQ ID NO: 82037 - DNA, 25 bp, E. coli
ttaacctgccggcagcacaatggcg

SEQ ID NO: 82038 - DNA, 25 bp, E. coli
ttaacctgccgggagcacaatggcg

SEQ ID NO: 82039 - DNA, 25 bp, E. coli
tgagaatctgcataatccgctgtgg

SEQ ID NO: 82040 - DNA, 25 bp, E. coli
tgagaatctgcaaaatccgctgtgg

SEQ ID NO: 82041 - DNA, 25 bp, E. coli
gaaatggactctttgcctcaggagg

SEQ ID NO: 82042 - DNA, 25 bp, E. coli
gaacatatgatctggcgctgcgaca

SEQ ID NO: 82043 - DNA, 25 bp, E. coli
gaacatatgatcaggcgctgcgaca

SEQ ID NO: 82044 - DNA, 25 bp, E. coli
gaaatggactctatgcctcaggagg

SEQ ID NO: 82045 - DNA, 25 bp, E. coli
ggactggacgctgaaacctggctta

SEQ ID NO: 82046 - DNA, 25 bp, E. coli
ggactggacgctcaaacctggctta

SEQ ID NO: 82047 - DNA, 25 bp, E. coli
taaccgtcggctggtggcaaaaatg

SEQ ID NO: 82048 - DNA, 25 bp, E. coli
taaccgtcggctcgtggcaaaaatg

SEQ ID NO: 82049 - DNA, 25 bp, E. coli
cataatgcacttcatgacgcccgtt

SEQ ID NO: 82050 - DNA, 25 bp, E. coli
cataatgcacttgatgacgcccgtt

SEQ ID NO: 82051 - DNA, 25 bp, E. coli
tacaacgatcgcgatgtacgcacaa

SEQ ID NO: 82052 - DNA, 25 bp, E. coli
tacaacgatcgccatgtacgcacaa

SEQ ID NO: 82053 - DNA, 25 bp, E. coli
atgaccgatgaattcccgttagatg

SEQ ID NO: 82054 - DNA, 25 bp, E. coli
atgaccgatgaaatcccgttagatg

SEQ ID NO: 82055 - DNA, 25 bp, E. coli
aaatggagccaacttcgacaacacg

SEQ ID NO: 82056 - DNA, 25 bp, E. coli
aaatggagccaagttcgacaacacg

SEQ ID NO: 82057 - DNA, 25 bp, E. coli
tgatgacgcccgataccaggcaaaa

SEQ ID NO: 82058 - DNA, 25 bp, E. coli
tgatgacgcccgttaccaggcaaaa

SEQ ID NO: 82059 - DNA, 25 bp, E. coli
tgcccgtggcgttactacaacgatc

SEQ ID NO: 82060 - DNA, 25 bp, E. coli
tgccagaacggcaattccattcgaa

SEQ ID NO: 82061 - DNA, 25 bp, E. coli
tgcccgtggcgtaactacaacgatc

SEQ ID NO: 82062 - DNA, 25 bp, E. coli
tgccagaacggctattccattcgaa

SEQ ID NO: 82063 - DNA, 25 bp, E. coli
gaaggtgagcgcgataatgcacttg

SEQ ID NO: 82064 - DNA, 25 bp, E. coli
gaaggtgagcgccataatgcacttg

SEQ ID NO: 82065 - DNA, 25 bp, E. coli
gaaagccatagacttcgatgccaga

SEQ ID NO: 82066 - DNA, 25 bp, E. coli
gaaagccatagagttcgatgccaga

SEQ ID NO: 82067 - DNA, 25 bp, E. coli
cgacaacacgatattgcgccgttca

SEQ ID NO: 82068 - DNA, 25 bp, E. coli
cgacaacacgattttgcgccgttca

SEQ ID NO: 82069 - DNA, 25 bp, E. coli
gatgtacgcacattcgttgagctgg

SEQ ID NO: 82070 - DNA, 25 bp, E. coli
gatgtacgcacaatcgttgagctgg

SEQ ID NO: 82071 - DNA, 25 bp, E. coli
catccgcattgcatctttgaattcg

SEQ ID NO: 82072 - DNA, 25 bp, E. coli
cataacctgccagggatgcagtgtt

SEQ ID NO: 82073 - DNA, 25 bp, E. coli
catccgcattgcttctttgaattcg

SEQ ID NO: 82074 - DNA, 25 bp, E. coli
cataacctgccacggatgcagtgtt

SEQ ID NO: 82075 - DNA, 25 bp, E. coli
agggatgcagtgttatttcattacc

SEQ ID NO: 82076 - DNA, 25 bp, E. coli
agggatgcagtgatatttcattacc

SEQ ID NO: 82077 - DNA, 25 bp, E. coli
tccgcattgcttctttgaattcgca

SEQ ID NO: 82078 - DNA, 25 bp, E. coli
tcgccatccgcaatgcttctttgaa

SEQ ID NO: 82079 - DNA, 25 bp, E. coli
tcgccatccgcattgcttctttgaa

SEQ ID NO: 82080 - DNA, 25 bp, E. coli
tccgcattgcttgtttgaattcgca

SEQ ID NO: 82081 - DNA, 25 bp, E. coli
tcaggcaatcgcgatccgcattgct

SEQ ID NO: 82082 - DNA, 25 bp, E. coli
tcaggcaatcgccatccgcattgct

SEQ ID NO: 82083 - DNA, 25 bp, E. coli
gccagggatgcagtgttatttcatt

SEQ ID NO: 82084 - DNA, 25 bp, E. coli
gccagggatgcactgttatttcatt

SEQ ID NO: 82085 - DNA, 25 bp, E. coli
cctgccagggatccagtgttatttc

SEQ ID NO: 82086 - DNA, 25 bp, E. coli
cctgccagggatgcagtgttatttc

SEQ ID NO: 82087 - DNA, 25 bp, E. coli
gcattgcttctttgaattcgcatta

SEQ ID NO: 82088 - DNA, 25 bp, E. coli
gcttctttgaatacgcattacaaat

SEQ ID NO: 82089 - DNA, 25 bp, E. coli
gcattgcttcttagaattcgcatta

SEQ ID NO: 82090 - DNA, 25 bp, E. coli
gcttctttgaattcgcattacaaat

SEQ ID NO: 82091 - DNA, 25 bp, E. coli
ggcaatcgccatgcgcattgcttct

SEQ ID NO: 82092 - DNA, 25 bp, E. coli
ggcaatcgccatccgcattgcttct

SEQ ID NO: 82093 - DNA, 25 bp, E. coli
aagacccgtgcggtcaatgaagaag

SEQ ID NO: 82094 - DNA, 25 bp, E. coli
aagacccgtgcgctcaatgaagaag

SEQ ID NO: 82095 - DNA, 25 bp, E. coli
tatgacctgctggaaaactgcgatg

SEQ ID NO: 82096 - DNA, 25 bp, E. coli
tatgacctgctgcaaaactgcgatg

SEQ ID NO: 82097 - DNA, 25 bp, E. coli
tgccgcaccggaggtttatcacctg

SEQ ID NO: 82098 - DNA, 25 bp, E. coli
tgcgatgtgccgatcagcaagctgc

SEQ ID NO: 82099 - DNA, 25 bp, E. coli
tgcgatgtgccgttcagcaagctgc

SEQ ID NO: 82100 - DNA, 25 bp, E. coli
tgccgcaccggacgtttatcacctg

SEQ ID NO: 82101 - DNA, 25 bp, E. coli
tcaccagtagcgtagccggtttcct

SEQ ID NO: 82102 - DNA, 25 bp, E. coli
cctgaccgggaaaggcgaaattctg

SEQ ID NO: 82103 - DNA, 25 bp, E. coli
cctgaccgggaatggcgaaattctg

SEQ ID NO: 82104 - DNA, 25 bp, E. coli
ccctgctgcaggcagcgcatttgta

SEQ ID NO: 82105 - DNA, 25 bp, E. coli
ccctgctgcagggagcgcatttgta

SEQ ID NO: 82106 - DNA, 25 bp, E. coli
cgctcgcggcaaactgatggtcaaa

SEQ ID NO: 82107 - DNA, 25 bp, E. coli
cgctcgcggcaatctgatggtcaaa

SEQ ID NO: 82108 - DNA, 25 bp, E. coli
cattgagcaggtttacgctcgcggc

SEQ ID NO: 82109 - DNA, 25 bp, E. coli
cattgagcaggtatacgctcgcggc

SEQ ID NO: 82110 - DNA, 25 bp, E. coli
gttccgtggaaaaagacgtggcgat

SEQ ID NO: 82111 - DNA, 25 bp, E. coli
gttccgtggaaatagacgtggcgat

SEQ ID NO: 82112 - DNA, 25 bp, E. coli
tcaccagtagcgaagccggtttcct

SEQ ID NO: 82113 - DNA, 25 bp, E. coli
gatggtcaaagacggcaaagcctgc

SEQ ID NO: 82114 - DNA, 25 bp, E. coli
gatggtcaaagagggcaaagcctgc

SEQ ID NO: 82115 - DNA, 25 bp, E. coli
caatcacggcgaagagagtcagcgt

SEQ ID NO: 82116 - DNA, 25 bp, E. coli
caatcacggcgatgagagtcagcgt

SEQ ID NO: 82117 - DNA, 25 bp, E. coli
catttcccggtggaaggtagcggca

SEQ ID NO: 82118 - DNA, 25 bp, E. coli
catttcccggtgcaaggtagcggca

SEQ ID NO: 82119 - DNA, 25 bp, E. coli
taaaggtcacatcatgcagattggc

SEQ ID NO: 82120 - DNA, 25 bp, E. coli
tacagcccgatattggtgagcacta

SEQ ID NO: 82121 - DNA, 25 bp, E. coli
taaaggtcacatgatgcagattggc

SEQ ID NO: 82122 - DNA, 25 bp, E. coli
tacagcccgataatggtgagcacta

SEQ ID NO: 82123 - DNA, 25 bp, E. coli
tgtcgctgggcgtaaacgtcggcta

SEQ ID NO: 82124 - DNA, 25 bp, E. coli
tgtcgctgggcgaaaacgtcggcta

SEQ ID NO: 82125 - DNA, 25 bp, E. coli
gcaggatctctatcgtcagccagcc

SEQ ID NO: 82126 - DNA, 25 bp, E. coli
gcaggatctctaacgtcagccagcc

SEQ ID NO: 82127 - DNA, 25 bp, E. coli
cgtcggctacgggttaaagatgctc

SEQ ID NO: 82128 - DNA, 25 bp, E. coli
cgtcggctacggcttaaagatgctc

SEQ ID NO: 82129 - DNA, 25 bp, E. coli
gatcctcaaacctaaggtgctgctg

SEQ ID NO: 82130 - DNA, 25 bp, E. coli
gatatctacggttatcgcctgccgc

SEQ ID NO: 82131 - DNA, 25 bp, E. coli
gatatctacggtaatcgcctgccgc

SEQ ID NO: 82132 - DNA, 25 bp, E. coli
ggcaagttttatgggcgacgccaac

SEQ ID NO: 82133 - DNA, 25 bp, E. coli
ggcaagttttatcggcgacgccaac

SEQ ID NO: 82134 - DNA, 25 bp, E. coli
tcacgatcaaagtgaggccttcgcg

SEQ ID NO: 82135 - DNA, 25 bp, E. coli
tcacgatcaaagagaggccttcgcg

SEQ ID NO: 82136 - DNA, 25 bp, E. coli
gatcctcaaaccaaaggtgctgctg

SEQ ID NO: 82137 - DNA, 25 bp, E. coli
attgacgatgcgatgcctcgggcat

SEQ ID NO: 82138 - DNA, 25 bp, E. coli
acgatgcgttgcgtcgggcatgaaa

SEQ ID NO: 82139 - DNA, 25 bp, E. coli
attgacgatgcgttgcctcgggcat

SEQ ID NO: 82140 - DNA, 25 bp, E. coli
acgatgcgttgcctcgggcatgaaa

SEQ ID NO: 82141 - DNA, 25 bp, E. coli
tttgccagcatcgctggcgagtaac

SEQ ID NO: 82142 - DNA, 25 bp, E. coli
tttgccagcatccctggcgagtaac

SEQ ID NO: 82143 - DNA, 25 bp, E. coli
ttgacgatgcgttgcctcgggcatg

SEQ ID NO: 82144 - DNA, 25 bp, E. coli
ttgacgatgcgtagcctcgggcatg

SEQ ID NO: 82145 - DNA, 25 bp, E. coli
ttgcctcgggcatgaaaaggtcgcg

SEQ ID NO: 82146 - DNA, 25 bp, E. coli
ttgcctcgggcaagaaaaggtcgcg

SEQ ID NO: 82147 - DNA, 25 bp, E. coli
tgacgatgcgttccctcgggcatga

SEQ ID NO: 82148 - DNA, 25 bp, E. coli
tgacgatgcgttgcctcgggcatga

SEQ ID NO: 82149 - DNA, 25 bp, E. coli
gctgctttacttatgccagcatcgc

SEQ ID NO: 82150 - DNA, 25 bp, E. coli
gctgctttacttttgccagcatcgc

SEQ ID NO: 82151 - DNA, 25 bp, E. coli
cgctgctttactattgccagcatcg

SEQ ID NO: 82152 - DNA, 25 bp, E. coli
cccgctgctttagttttgccagcat

SEQ ID NO: 82153 - DNA, 25 bp, E. coli
cgatgcgttgcctcgggcatgaaaa

SEQ ID NO: 82154 - DNA, 25 bp, E. coli
cgctgctttacttttgccagcatcg

SEQ ID NO: 82155 - DNA, 25 bp, E. coli
cgatgcgttgccacgggcatgaaaa

SEQ ID NO: 82156 - DNA, 25 bp, E. coli
cccgctgctttacttttgccagcat

SEQ ID NO: 82157 - DNA, 25 bp, E. coli
gttgcctcgggcttgaaaaggtcgc

SEQ ID NO: 82158 - DNA, 25 bp, E. coli
gttgcctcgggcatgaaaaggtcgc

SEQ ID NO: 82159 - DNA, 25 bp, E. coli
ctcgcaattaatagattaccaacac

SEQ ID NO: 82160 - DNA, 25 bp, E. coli
ctcgcaattaattgattaccaacac

SEQ ID NO: 82161 - DNA, 25 bp, E. coli
actcgcaattaattgattaccaaca

SEQ ID NO: 82162 - DNA, 25 bp, E. coli
actcgcaattaaatgattaccaaca

SEQ ID NO: 82163 - DNA, 25 bp, E. coli
tgactcgcaattaattgattaccaa

SEQ ID NO: 82164 - DNA, 25 bp, E. coli
tgactcgcaatttattgattaccaa

SEQ ID NO: 82165 - DNA, 25 bp, E. coli
tgccgctggcgagaggcggcaccgt

SEQ ID NO: 82166 - DNA, 25 bp, E. coli
tgccgctggcgacaggcggcaccgt

SEQ ID NO: 82167 - DNA, 25 bp, E. coli
tcgcaattaattgattaccaacaca

SEQ ID NO: 82168 - DNA, 25 bp, E. coli
tcgcaattaattcattaccaacaca

SEQ ID NO: 82169 - DNA, 25 bp, E. coli
gccgctggcgactggcggcaccgtg

SEQ ID NO: 82170 - DNA, 25 bp, E. coli
gccgctggcgacaggcggcaccgtg

SEQ ID NO: 82171 - DNA, 25 bp, E. coli
gcaattaattgattaccaacacaaa

SEQ ID NO: 82172 - DNA, 25 bp, E. coli
gcaattaattgaataccaacacaaa

SEQ ID NO: 82173 - DNA, 25 bp, E. coli
gactcgcaattatttgattaccaac

SEQ ID NO: 82174 - DNA, 25 bp, E. coli
gactcgcaattaattgattaccaac

SEQ ID NO: 82175 - DNA, 25 bp, E. coli
cgcaattaattgattaccaacacaa

SEQ ID NO: 82176 - DNA, 25 bp, E. coli
cgcaattaattgtttaccaacacaa

SEQ ID NO: 82177 - DNA, 25 bp, E. coli
ggtgctgccgctcgcgacaggcggc

SEQ ID NO: 82178 - DNA, 25 bp, E. coli
gtgctgccgctgccgacaggcggca

SEQ ID NO: 82179 - DNA, 25 bp, E. coli
ggtgctgccgctggcgacaggcggc

SEQ ID NO: 82180 - DNA, 25 bp, E. coli
gtgctgccgctggcgacaggcggca

SEQ ID NO: 82181 - DNA, 25 bp, E. coli
cacatctgctggctaaagaaggcga

SEQ ID NO: 82182 - DNA, 25 bp, E. coli
cacatctgctgggtaaagaaggcga

SEQ ID NO: 82183 - DNA, 25 bp, E. coli
cacttattacgacggcattggcttc

SEQ ID NO: 82184 - DNA, 25 bp, E. coli
cacttattacgagggcattggcttc

SEQ ID NO: 82185 - DNA, 25 bp, E. coli
catcaaacaggtgggtaactactcg

SEQ ID NO: 82186 - DNA, 25 bp, E. coli
catcaaacaggtcggtaactactcg

SEQ ID NO: 82187 - DNA, 25 bp, E. coli
taacgtaggttctgaaagcccgctg

SEQ ID NO: 82188 - DNA, 25 bp, E. coli
tggatttgctctgccgtaatacgac

SEQ ID NO: 82189 - DNA, 25 bp, E. coli
ccagaacgtcgatgaaaaagcggct

SEQ ID NO: 82190 - DNA, 25 bp, E. coli
ccagaacgtcgaagaaaaagcggct

SEQ ID NO: 82191 - DNA, 25 bp, E. coli
gaaagaactggaaggcgctaccgtc

SEQ ID NO: 82192 - DNA, 25 bp, E. coli
gaaagaactggatggcgctaccgtc

SEQ ID NO: 82193 - DNA, 25 bp, E. coli
cattggcttcctgacgcacgataaa

SEQ ID NO: 82194 - DNA, 25 bp, E. coli
cattggcttcctcacgcacgataaa

SEQ ID NO: 82195 - DNA, 25 bp, E. coli
gattgtacgctggacgcttttcgcc

SEQ ID NO: 82196 - DNA, 25 bp, E. coli
gattacctgggtactcttatgccga

SEQ ID NO: 82197 - DNA, 25 bp, E. coli
gattacctgggttctcttatgccga

SEQ ID NO: 82198 - DNA, 25 bp, E. coli
gattgtacgctgcacgcttttcgcc

SEQ ID NO: 82199 - DNA, 25 bp, E. coli
tggatttgctctcccgtaatacgac

SEQ ID NO: 82200 - DNA, 25 bp, E. coli
tggacttcatctggcgatgccggga

SEQ ID NO: 82201 - DNA, 25 bp, E. coli
tggacttcatctcgcgatgccggga

SEQ ID NO: 82202 - DNA, 25 bp, E. coli
taacgtaggttcagaaagcccgctg

SEQ ID NO: 82203 - DNA, 25 bp, E. coli
cagctttacactatattgttttgtc

SEQ ID NO: 82204 - DNA, 25 bp, E. coli
cagctttacactttattgttttgtc

SEQ ID NO: 82205 - DNA, 25 bp, E. coli
tctgtggttttttgtgctgggcgct

SEQ ID NO: 82206 - DNA, 25 bp, E. coli
tctgtggtttttagtgctgggcgct

SEQ ID NO: 82207 - DNA, 25 bp, E. coli
gctttatctggcgacgctggttctc

SEQ ID NO: 82208 - DNA, 25 bp, E. coli
gcaggcattttggtgatggctttcc

SEQ ID NO: 82209 - DNA, 25 bp, E. coli
gctttatctggccacgctggttctc

SEQ ID NO: 82210 - DNA, 25 bp, E. coli
gcaggcattttgctgatggctttcc

SEQ ID NO: 82211 - DNA, 25 bp, E. coli
gaaaccttgaccaccgcagcaggca

SEQ ID NO: 82212 - DNA, 25 bp, E. coli
gaaaccttgacctccgcagcaggca

SEQ ID NO: 82213 - DNA, 25 bp, E. coli
cctttagaaaccatgaccaccgcag

SEQ ID NO: 82214 - DNA, 25 bp, E. coli
cgacgctggttcacgctggcggatt

SEQ ID NO: 82215 - DNA, 25 bp, E. coli
cctttagaaaccttgaccaccgcag

SEQ ID NO: 82216 - DNA, 25 bp, E. coli
cgacgctggttctcgctggcggatt

SEQ ID NO: 82217 - DNA, 25 bp, E. coli
ctgggcgctattcagtattttgttc

SEQ ID NO: 82218 - DNA, 25 bp, E. coli
ctgggcgctattgagtattttgttc

SEQ ID NO: 82219 - DNA, 25 bp, E. coli
gtttttagtgctgggcgctattgag

SEQ ID NO: 82220 - DNA, 25 bp, E. coli
gtttttagtgctcggcgctattgag

SEQ ID NO: 82221 - DNA, 25 bp, E. coli
ggctttcctctcatgcctgctgctg

SEQ ID NO: 82222 - DNA, 25 bp, E. coli
ggctttcctctcttgcctgctgctg

SEQ ID NO: 82223 - DNA, 25 bp, E. coli
gatggctttcctgtcttgcctgctg

SEQ ID NO: 82224 - DNA, 25 bp, E. coli
gatggctttcctctcttgcctgctg

SEQ ID NO: 82225 - DNA, 25 bp, E. coli
caagattagaggaaattacacgccg

SEQ ID NO: 82226 - DNA, 25 bp, E. coli
caagattagaggtaattacacgccg

SEQ ID NO: 82227 - DNA, 25 bp, E. coli
caggatatctctaaagtgccagcgc

SEQ ID NO: 82228 - DNA, 25 bp, E. coli
caggatatctcttaagtgccagcgc

SEQ ID NO: 82229 - DNA, 25 bp, E. coli
actttattgatcaaccggttgcggt

SEQ ID NO: 82230 - DNA, 25 bp, E. coli
aaaagcccataaaggcgcgcttccg

SEQ ID NO: 82231 - DNA, 25 bp, E. coli
actttattgatctaccggttgcggt

SEQ ID NO: 82232 - DNA, 25 bp, E. coli
aaaagcccataatggcgcgcttccg

SEQ ID NO: 82233 - DNA, 25 bp, E. coli
tatgacggatgatgatttcaatgac

SEQ ID NO: 82234 - DNA, 25 bp, E. coli
tatgacggatgaagatttcaatgac

SEQ ID NO: 82235 - DNA, 25 bp, E. coli
ttctttctaatattcgccccgcagg

SEQ ID NO: 82236 - DNA, 25 bp, E. coli
ttctttctaataatcgccccgcagg

SEQ ID NO: 82237 - DNA, 25 bp, E. coli
tgctgaacaagaggagaaaaagccc

SEQ ID NO: 82238 - DNA, 25 bp, E. coli
tgctgaacaagacgagaaaaagccc

SEQ ID NO: 82239 - DNA, 25 bp, E. coli
tgccagcgcattggaagcgttaatg

SEQ ID NO: 82240 - DNA, 25 bp, E. coli
tgccagcgcattcgaagcgttaatg

SEQ ID NO: 82241 - DNA, 25 bp, E. coli
gcgcttccgtccaagtgctgcaaga

SEQ ID NO: 82242 - DNA, 25 bp, E. coli
gcgcttccgtcctagtgctgcaaga

SEQ ID NO: 82243 - DNA, 25 bp, E. coli
cgaattctcgctcaaaaatcggtca

SEQ ID NO: 82244 - DNA, 25 bp, E. coli
cgttaatggacatgcttgctgaaca

SEQ ID NO: 82245 - DNA, 25 bp, E. coli
cgttaatggacaagcttgctgaaca

SEQ ID NO: 82246 - DNA, 25 bp, E. coli
cgaattctcgctgaaaaatcggtca

SEQ ID NO: 82247 - DNA, 25 bp, E. coli
cacgctgggcaacgctaataccttc

SEQ ID NO: 82248 - DNA, 25 bp, E. coli
cacgctgggcaaggctaataccttc

SEQ ID NO: 82249 - DNA, 25 bp, E. coli
taccttctgggtatacgcgggtctg

SEQ ID NO: 82250 - DNA, 25 bp, E. coli
taccttctgggtttacgcgggtctg

SEQ ID NO: 82251 - DNA, 25 bp, E. coli
actgtggctggtcccagaaaccaaa

SEQ ID NO: 82252 - DNA, 25 bp, E. coli
actgtggctggtgccagaaaccaaa

SEQ ID NO: 82253 - DNA, 25 bp, E. coli
tgggcaacgctattaccttctgggt

SEQ ID NO: 82254 - DNA, 25 bp, E. coli
tgggcaacgctaataccttctgggt

SEQ ID NO: 82255 - DNA, 25 bp, E. coli
cctgctgacactctggctggtgcca

SEQ ID NO: 82256 - DNA, 25 bp, E. coli
cctgctgacactgtggctggtgcca

SEQ ID NO: 82257 - DNA, 25 bp, E. coli
gctcaacacgctcggcaacgctaat

SEQ ID NO: 82258 - DNA, 25 bp, E. coli
gctaataccttcagggtttacgcgg

SEQ ID NO: 82259 - DNA, 25 bp, E. coli
gctgggcaacgcaaataccttctgg

SEQ ID NO: 82260 - DNA, 25 bp, E. coli
gctaataccttctgggtttacgcgg

SEQ ID NO: 82261 - DNA, 25 bp, E. coli
gctgggcaacgctaataccttctgg

SEQ ID NO: 82262 - DNA, 25 bp, E. coli
gctcaacacgctgggcaacgctaat

SEQ ID NO: 82263 - DNA, 25 bp, E. coli
gacactgtggctggtgccagaaacc

SEQ ID NO: 82264 - DNA, 25 bp, E. coli
gacactgtggctcgtgccagaaacc

SEQ ID NO: 82265 - DNA, 25 bp, E. coli
cgcgggtctgaaggtcctgtttatc

SEQ ID NO: 82266 - DNA, 25 bp, E. coli
cgcgggtctgaacgtcctgtttatc

SEQ ID NO: 82267 - DNA, 25 bp, E. coli
ggtttacgcgggtctgaacgtcctg

SEQ ID NO: 82268 - DNA, 25 bp, E. coli
ggtttacgcgggactgaacgtcctg

SEQ ID NO: 82269 - DNA, 25 bp, E. coli
tcttgccagcacagcgatcatgcgc

SEQ ID NO: 82270 - DNA, 25 bp, E. coli
tcttgccagcactgcgatcatgcgc

SEQ ID NO: 82271 - DNA, 25 bp, E. coli
gctgggaaccaatccgaagctgtac

SEQ ID NO: 82272 - DNA, 25 bp, E. coli
gctgggaaccaaaccgaagctgtac

SEQ ID NO: 82273 - DNA, 25 bp, E. coli
gaagcccacttagcgctacaagctg

SEQ ID NO: 82274 - DNA, 25 bp, E. coli
gaagcccacttaccgctacaagctg

SEQ ID NO: 82275 - DNA, 25 bp, E. coli
gacgtttggcaatctggacgatccc

SEQ ID NO: 82276 - DNA, 25 bp, E. coli
gacgtttggcaaactggacgatccc

SEQ ID NO: 82277 - DNA, 25 bp, E. coli
gacgattattcgtagcgagccgcag

SEQ ID NO: 82278 - DNA, 25 bp, E. coli
gacaaatgcgatttctgccgtaaga

SEQ ID NO: 82279 - DNA, 25 bp, E. coli
gacgattattcgaagcgagccgcag

SEQ ID NO: 82280 - DNA, 25 bp, E. coli
gacaaatgcgatatctgccgtaaga

SEQ ID NO: 82281 - DNA, 25 bp, E. coli
cgcctgtatggatgcttgtcgggaa

SEQ ID NO: 82282 - DNA, 25 bp, E. coli
cgcctgtatggaagcttgtcgggaa

SEQ ID NO: 82283 - DNA, 25 bp, E. coli
gttgtcagtactccatcgccgcctg

SEQ ID NO: 82284 - DNA, 25 bp, E. coli
gttgtcagtactgcatcgccgcctg

SEQ ID NO: 82285 - DNA, 25 bp, E. coli
gagatttcgcaagtgctgcgccaga

SEQ ID NO: 82286 - DNA, 25 bp, E. coli
gagtcgttatgcttcggctgtaccg

SEQ ID NO: 82287 - DNA, 25 bp, E. coli
gatgttaatccgcatctctgcgtcg

SEQ ID NO: 82288 - DNA, 25 bp, E. coli
gatgttaatccggatctctgcgtcg

SEQ ID NO: 82289 - DNA, 25 bp, E. coli
gagtcgttatgcatcggctgtaccg

SEQ ID NO: 82290 - DNA, 25 bp, E. coli
gagatttcgcaactgctgcgccaga

SEQ ID NO: 82291 - DNA, 25 bp, E. coli
caaatcagaggcagttccggctttc

SEQ ID NO: 82292 - DNA, 25 bp, E. coli
caaaaaaggctgtcaaatcagaggc

SEQ ID NO: 82293 - DNA, 25 bp, E. coli
caaatcagaggctgttccggctttc

SEQ ID NO: 82294 - DNA, 25 bp, E. coli
caaaaaaggctgacaaatcagaggc

SEQ ID NO: 82295 - DNA, 25 bp, E. coli
accgagagggctttttcaattccat

SEQ ID NO: 82296 - DNA, 25 bp, E. coli
accgagagggctatttcaattccat

SEQ ID NO: 82297 - DNA, 25 bp, E. coli
aaaaataagtccaccgcgatgctgc

SEQ ID NO: 82298 - DNA, 25 bp, E. coli
aaaaataagtcctccgcgatgctgc

SEQ ID NO: 82299 - DNA, 25 bp, E. coli
tatcgtttgcattatcgttacgccg

SEQ ID NO: 82300 - DNA, 25 bp, E. coli
tatcgtttgcataatcgttacgccg

SEQ ID NO: 82301 - DNA, 25 bp, E. coli
tcgttacgccgcaatcaaaaaaggc

SEQ ID NO: 82302 - DNA, 25 bp, E. coli
tcgttacgccgctatcaaaaaaggc

SEQ ID NO: 82303 - DNA, 25 bp, E. coli
tccatttccctgtcaaatcatgcgg

SEQ ID NO: 82304 - DNA, 25 bp, E. coli
tccatttccctgacaaatcatgcgg

SEQ ID NO: 82305 - DNA, 25 bp, E. coli
ccctgacaaatcatgcggatataaa

SEQ ID NO: 82306 - DNA, 25 bp, E. coli
ccctgacaaatcttgcggatataaa

SEQ ID NO: 82307 - DNA, 25 bp, E. coli
cttgctaagccctctcaaccgagag

SEQ ID NO: 82308 - DNA, 25 bp, E. coli
cggctttctgggatgatcacctgca

SEQ ID NO: 82309 - DNA, 25 bp, E. coli
cttgctaagcccactcaaccgagag

SEQ ID NO: 82310 - DNA, 25 bp, E. coli
cggctttctgggttgatcacctgca

SEQ ID NO: 82311 - DNA, 25 bp, E. coli
gatcacctgcataaaaaataagtcc

SEQ ID NO: 82312 - DNA, 25 bp, E. coli
gatcacctgcattaaaaataagtcc

SEQ ID NO: 82313 - DNA, 25 bp, E. coli
catggtcatggtaagcatattttga

SEQ ID NO: 82314 - DNA, 25 bp, E. coli
catggtcatggttagcatattttga

SEQ ID NO: 82315 - DNA, 25 bp, E. coli
ttttgaggcgaagaagttacgccgt

SEQ ID NO: 82316 - DNA, 25 bp, E. coli
ttttgaggcgaacaagttacgccgt

SEQ ID NO: 82317 - DNA, 25 bp, E. coli
agctacaagccaaacaggaactggg

SEQ ID NO: 82318 - DNA, 25 bp, E. coli
agctacaagccatacaggaactggg

SEQ ID NO: 82319 - DNA, 25 bp, E. coli
aaacgccactgtcgctggcgcaaca

SEQ ID NO: 82320 - DNA, 25 bp, E. coli
aaacgccactgtggctggcgcaaca

SEQ ID NO: 82321 - DNA, 25 bp, E. coli
tattccccggagttgtttcttgatt

SEQ ID NO: 82322 - DNA, 25 bp, E. coli
tattttgaagcaccaaacgccactg

SEQ ID NO: 82323 - DNA, 25 bp, E. coli
tattccccggagatgtttcttgatt

SEQ ID NO: 82324 - DNA, 25 bp, E. coli
tattttgaagcagcaaacgccactg

SEQ ID NO: 82325 - DNA, 25 bp, E. coli
gaatttcagccaatattgaataccg

SEQ ID NO: 82326 - DNA, 25 bp, E. coli
gaatttcagccattattgaataccg

SEQ ID NO: 82327 - DNA, 25 bp, E. coli
cgcctgtgtgatccatggtcatggt

SEQ ID NO: 82328 - DNA, 25 bp, E. coli
cgcctgtgtgatgcatggtcatggt

SEQ ID NO: 82329 - DNA, 25 bp, E. coli
cggtctgacgcacctacaagccaaa

SEQ ID NO: 82330 - DNA, 25 bp, E. coli
ctatttttcggaggaatttcagcca

SEQ ID NO: 82331 - DNA, 25 bp, E. coli
ctatttttcggacgaatttcagcca

SEQ ID NO: 82332 - DNA, 25 bp, E. coli
cggtctgacgcagctacaagccaaa

SEQ ID NO: 82333 - DNA, 25 bp, E. coli
gatgccagccacaatttttcggacg

SEQ ID NO: 82334 - DNA, 25 bp, E. coli
gatgccagccactatttttcggacg

SEQ ID NO: 82335 - DNA, 25 bp, E. coli
cactgcatatccatgtaaaagaaga

SEQ ID NO: 82336 - DNA, 25 bp, E. coli
cactgcatatccttgtaaaagaaga

SEQ ID NO: 82337 - DNA, 25 bp, E. coli
taaaagaagagaaactggctctgga

SEQ ID NO: 82338 - DNA, 25 bp, E. coli
taaaagaagagatactggctctgga

SEQ ID NO: 82339 - DNA, 25 bp, E. coli
agctggcgaagatacactccatttg

SEQ ID NO: 82340 - DNA, 25 bp, E. coli
agctggcgaagaaacactccatttg

SEQ ID NO: 82341 - DNA, 25 bp, E. coli
ccttgtaaaagaagagaaactggct

SEQ ID NO: 82342 - DNA, 25 bp, E. coli
ccttgtaaaagatgagaaactggct

SEQ ID NO: 82343 - DNA, 25 bp, E. coli
gcagcactgcatatccttgtaaaag

SEQ ID NO: 82344 - DNA, 25 bp, E. coli
gcagcagcactggatatccttgtaa

SEQ ID NO: 82345 - DNA, 25 bp, E. coli
gcagcactgcatttccttgtaaaag

SEQ ID NO: 82346 - DNA, 25 bp, E. coli
gcagcagcactgcatatccttgtaa

SEQ ID NO: 82347 - DNA, 25 bp, E. coli
gaaactggctctggatcttctcgag

SEQ ID NO: 82348 - DNA, 25 bp, E. coli
gaaactggctctcgatcttctcgag

SEQ ID NO: 82349 - DNA, 25 bp, E. coli
tggcaaaaacagcagcagcactgca

SEQ ID NO: 82350 - DNA, 25 bp, E. coli
tggcgaagaaacactccatttgccc

SEQ ID NO: 82351 - DNA, 25 bp, E. coli
tggctctggatcttctcgagcagat

SEQ ID NO: 82352 - DNA, 25 bp, E. coli
tggcaaaaacaggagcagcactgca

SEQ ID NO: 82353 - DNA, 25 bp, E. coli
tggcgaagaaactctccatttgccc

SEQ ID NO: 82354 - DNA, 25 bp, E. coli
ggcaagctggcgtagaaacactcca

SEQ ID NO: 82355 - DNA, 25 bp, E. coli
ggcaagctggcgaagaaacactcca

SEQ ID NO: 82356 - DNA, 25 bp, E. coli
tggctctggatcatctcgagcagat

SEQ ID NO: 82357 - DNA, 25 bp, E. coli
aagaaccaaatgttcaaatcgaggg

SEQ ID NO: 82358 - DNA, 25 bp, E. coli
aagaaccaaatgatcaaatcgaggg

SEQ ID NO: 82359 - DNA, 25 bp, E. coli
agcagccagcctcttgatacccaat

SEQ ID NO: 82360 - DNA, 25 bp, E. coli
agcagccagcctgttgatacccaat

SEQ ID NO: 82361 - DNA, 25 bp, E. coli
tcatttggcaaagggaagtatcatc

SEQ ID NO: 82362 - DNA, 25 bp, E. coli
tctcttgcttctggaaaaacgtggt

SEQ ID NO: 82363 - DNA, 25 bp, E. coli
tctcttgcttctcgaaaaacgtggt

SEQ ID NO: 82364 - DNA, 25 bp, E. coli
tcatttggcaaacggaagtatcatc

SEQ ID NO: 82365 - DNA, 25 bp, E. coli
ccatcctgatgcgtaataatcccaa

SEQ ID NO: 82366 - DNA, 25 bp, E. coli
ccatcctgatgcctaataatcccaa

SEQ ID NO: 82367 - DNA, 25 bp, E. coli
gctgtagaggtaacgaacttcctga

SEQ ID NO: 82368 - DNA, 25 bp, E. coli
gctgtagaggtatcgaacttcctga

SEQ ID NO: 82369 - DNA, 25 bp, E. coli
gagtcctgtttcctatcatatctgt

SEQ ID NO: 82370 - DNA, 25 bp, E. coli
gagtcctgtttcgtatcatatctgt

SEQ ID NO: 82371 - DNA, 25 bp, E. coli
cgcttatcgtcgattctggcgtaaa

SEQ ID NO: 82372 - DNA, 25 bp, E. coli
cgcttatcgtcgtttctggcgtaaa

SEQ ID NO: 82373 - DNA, 25 bp, E. coli
gatacgtatcacagcccctattcag

SEQ ID NO: 82374 - DNA, 25 bp, E. coli
gatacgtatcactgcccctattcag

SEQ ID NO: 82375 - DNA, 25 bp, E. coli
tggcgtaaatcttgcctgcttagac

SEQ ID NO: 82376 - DNA, 25 bp, E. coli
tggcgtaaatctagcctgcttagac

SEQ ID NO: 82377 - DNA, 25 bp, E. coli
gacgccttatcatagcagccagcct

SEQ ID NO: 82378 - DNA, 25 bp, E. coli
gacgccttatcaaagcagccagcct

SEQ ID NO: 82379 - DNA, 25 bp, E. coli
catgagttatcacagccatcagtag

SEQ ID NO: 82380 - DNA, 25 bp, E. coli
catgagttatcagagccatcagtag

SEQ ID NO: 82381 - DNA, 25 bp, E. coli
catcagtagttatctggtggctttt

SEQ ID NO: 82382 - DNA, 25 bp, E. coli
catcagtagttaactggtggctttt

SEQ ID NO: 82383 - DNA, 25 bp, E. coli
actggtggcttttttattgttgtca

SEQ ID NO: 82384 - DNA, 25 bp, E. coli
actggtggctttattattgttgtca

SEQ ID NO: 82385 - DNA, 25 bp, E. coli
tatcagagccatcagtagttaactg

SEQ ID NO: 82386 - DNA, 25 bp, E. coli
tattgttgtcaggttccggataacg

SEQ ID NO: 82387 - DNA, 25 bp, E. coli
tatcagagccatgagtagttaactg

SEQ ID NO: 82388 - DNA, 25 bp, E. coli
tattgttgtcagcttccggataacg

SEQ ID NO: 82389 - DNA, 25 bp, E. coli
tgtcagcttccggataacgggagac

SEQ ID NO: 82390 - DNA, 25 bp, E. coli
tgtcagcttccgcataacgggagac

SEQ ID NO: 82391 - DNA, 25 bp, E. coli
tgttgtcagcttgcggataacggga

SEQ ID NO: 82392 - DNA, 25 bp, E. coli
tgttgtcagcttccggataacggga

SEQ ID NO: 82393 - DNA, 25 bp, E. coli
tgagttatcagagccatcagtagtt

SEQ ID NO: 82394 - DNA, 25 bp, E. coli
tgcatgagttatgagagccatcagt

SEQ ID NO: 82395 - DNA, 25 bp, E. coli
tgcatgagttatcagagccatcagt

SEQ ID NO: 82396 - DNA, 25 bp, E. coli
tgagttatcagacccatcagtagtt

SEQ ID NO: 82397 - DNA, 25 bp, E. coli
tcagagccatcagtagttaactggt

SEQ ID NO: 82398 - DNA, 25 bp, E. coli
tcagagccatcactagttaactggt

SEQ ID NO: 82399 - DNA, 25 bp, E. coli
gagccatcagtagttaactggtggc

SEQ ID NO: 82400 - DNA, 25 bp, E. coli
gagccatcagtacttaactggtggc

SEQ ID NO: 82401 - DNA, 25 bp, E. coli
cacgttatatctcgtaagtggcggg

SEQ ID NO: 82402 - DNA, 25 bp, E. coli
cacgttatatctggtaagtggcggg

SEQ ID NO: 82403 - DNA, 25 bp, E. coli
cacggtggtgtgcacgttatatctg

SEQ ID NO: 82404 - DNA, 25 bp, E. coli
cacggtggtgtggacgttatatctg

SEQ ID NO: 82405 - DNA, 25 bp, E. coli
tatccggaactatatacgcaaaaag

SEQ ID NO: 82406 - DNA, 25 bp, E. coli
tatccggaactaaatacgcaaaaag

SEQ ID NO: 82407 - DNA, 25 bp, E. coli
acccgaagagcctctcatttcgtag

SEQ ID NO: 82408 - DNA, 25 bp, E. coli
acccgaagagccactcatttcgtag

SEQ ID NO: 82409 - DNA, 25 bp, E. coli
tattgtatttctgcacggtggtgtg

SEQ ID NO: 82410 - DNA, 25 bp, E. coli
tattgtatttctccacggtggtgtg

SEQ ID NO: 82411 - DNA, 25 bp, E. coli
tatacgcaaaaacattgatgccgcg

SEQ ID NO: 82412 - DNA, 25 bp, E. coli
tatacgcaaaaagattgatgccgcg

SEQ ID NO: 82413 - DNA, 25 bp, E. coli
gcaaaaagattgatgccgcggcggc

SEQ ID NO: 82414 - DNA, 25 bp, E. coli
gcaaaaagattgttgccgcggcggc

SEQ ID NO: 82415 - DNA, 25 bp, E. coli
gaacaaaacccgtagagcctctcat

SEQ ID NO: 82416 - DNA, 25 bp, E. coli
gaacaaaacccgaagagcctctcat

SEQ ID NO: 82417 - DNA, 25 bp, E. coli
taagtggcgggtataaggttatccg

SEQ ID NO: 82418 - DNA, 25 bp, E. coli
taagtggcgggtttaaggttatccg

SEQ ID NO: 82419 - DNA, 25 bp, E. coli
taaggttatccgcaactatatacgc

SEQ ID NO: 82420 - DNA, 25 bp, E. coli
taaggttatccggaactatatacgc

SEQ ID NO: 82421 - DNA, 25 bp, E. coli
gagatttgtacagcttattttattg

SEQ ID NO: 82422 - DNA, 25 bp, E. coli
gagatttgtacaccttattttattg

SEQ ID NO: 82423 - DNA, 25 bp, E. coli
taaaagatatgtcaggcttgcggag

SEQ ID NO: 82424 - DNA, 25 bp, E. coli
taaaagatatgtgaggcttgcggag

SEQ ID NO: 82425 - DNA, 25 bp, E. coli
tatctcacgcagtattcttaaggga

SEQ ID NO: 82426 - DNA, 25 bp, E. coli
tatctcacgcagaattcttaaggga

SEQ ID NO: 82427 - DNA, 25 bp, E. coli
tttcagagtgctccgcttctcacta

SEQ ID NO: 82428 - DNA, 25 bp, E. coli
tttcagagtgctgcgcttctcacta

SEQ ID NO: 82429 - DNA, 25 bp, E. coli
tctgctgcaagaagaataatgttta

SEQ ID NO: 82430 - DNA, 25 bp, E. coli
tctgctgcaagatgaataatgttta

SEQ ID NO: 82431 - DNA, 25 bp, E. coli
cctgctatttgcgtgataaagaaaa

SEQ ID NO: 82432 - DNA, 25 bp, E. coli
cctgctatttgcctgataaagaaaa

SEQ ID NO: 82433 - DNA, 25 bp, E. coli
gacatacgatttcctcctttcagag

SEQ ID NO: 82434 - DNA, 25 bp, E. coli
gacatacgatttgctcctttcagag

SEQ ID NO: 82435 - DNA, 25 bp, E. coli
gaaaaatacaatactctgctgcaag

SEQ ID NO: 82436 - DNA, 25 bp, E. coli
gaaaaatacaattctctgctgcaag

SEQ ID NO: 82437 - DNA, 25 bp, E. coli
cgcttctcactattatctcacgcag

SEQ ID NO: 82438 - DNA, 25 bp, E. coli
cgcttctcactaatatctcacgcag

SEQ ID NO: 82439 - DNA, 25 bp, E. coli
tattcttaagggtacgataaggagg

SEQ ID NO: 82440 - DNA, 25 bp, E. coli
tattcttaagggaacgataaggagg

SEQ ID NO: 82441 - DNA, 25 bp, E. coli
taagggtaaaaattcaggaattcag

SEQ ID NO: 82442 - DNA, 25 bp, E. coli
taagggtaaaaaatcaggaattcag

SEQ ID NO: 82443 - DNA, 25 bp, E. coli
gagtggcggttaaggacatacgatt

SEQ ID NO: 82444 - DNA, 25 bp, E. coli
gagtggcggttatggacatacgatt

SEQ ID NO: 82445 - DNA, 25 bp, E. coli
cagttcgcaggtaatagttagagcc

SEQ ID NO: 82446 - DNA, 25 bp, E. coli
cagttcgcaggttatagttagagcc

SEQ ID NO: 82447 - DNA, 25 bp, E. coli
tagttggtcacttcgacgtatcgtc

SEQ ID NO: 82448 - DNA, 25 bp, E. coli
taccgattccgcgtagttggtcact

SEQ ID NO: 82449 - DNA, 25 bp, E. coli
tagttggtcactacgacgtatcgtc

SEQ ID NO: 82450 - DNA, 25 bp, E. coli
taccgattccgcctagttggtcact

SEQ ID NO: 82451 - DNA, 25 bp, E. coli
ttagagcctgcataacggtttcggg

SEQ ID NO: 82452 - DNA, 25 bp, E. coli
ttagagcctgcaaaacggtttcggg

SEQ ID NO: 82453 - DNA, 25 bp, E. coli
tgagatgaaaagaggcggcgcttac

SEQ ID NO: 82454 - DNA, 25 bp, E. coli
tgcaatcccgaatcagttcgcaggt

SEQ ID NO: 82455 - DNA, 25 bp, E. coli
tgcaatcccgaaacagttcgcaggt

SEQ ID NO: 82456 - DNA, 25 bp, E. coli
tgagatgaaaagtggcggcgcttac

SEQ ID NO: 82457 - DNA, 25 bp, E. coli
tccaaccatcgcaggcagagaggtc

SEQ ID NO: 82458 - DNA, 25 bp, E. coli
tccaaccatcgctggcagagaggtc

SEQ ID NO: 82459 - DNA, 25 bp, E. coli
gacgtatcgtctggaactccaacca

SEQ ID NO: 82460 - DNA, 25 bp, E. coli
gacgtatcgtctcgaactccaacca

SEQ ID NO: 82461 - DNA, 25 bp, E. coli
taattcgctcgtagtggtagtgaga

SEQ ID NO: 82462 - DNA, 25 bp, E. coli
taattcgctcgttgtggtagtgaga

SEQ ID NO: 82463 - DNA, 25 bp, E. coli
gaggcggcgctttctaccgattccg

SEQ ID NO: 82464 - DNA, 25 bp, E. coli
gagaggtctgcataatgcaatcccg

SEQ ID NO: 82465 - DNA, 25 bp, E. coli
gagaggtctgcaaaatgcaatcccg

SEQ ID NO: 82466 - DNA, 25 bp, E. coli
gaggcggcgcttactaccgattccg

SEQ ID NO: 82467 - DNA, 25 bp, E. coli
caataagggcataccaaaaatctgg

SEQ ID NO: 82468 - DNA, 25 bp, E. coli
caataagggcattccaaaaatctgg

SEQ ID NO: 82469 - DNA, 25 bp, E. coli
caaatgcacggtttagattatacag

SEQ ID NO: 82470 - DNA, 25 bp, E. coli
caaatgcacggtatagattatacag

SEQ ID NO: 82471 - DNA, 25 bp, E. coli
tacacgagggcataaaagaagattg

SEQ ID NO: 82472 - DNA, 25 bp, E. coli
tacacgagggcaaaaaagaagattg

SEQ ID NO: 82473 - DNA, 25 bp, E. coli
aaaacattatacagagccttgggaa

SEQ ID NO: 82474 - DNA, 25 bp, E. coli
aaaataatccaacagcaataagggc

SEQ ID NO: 82475 - DNA, 25 bp, E. coli
aaaacattatactgagccttgggaa

SEQ ID NO: 82476 - DNA, 25 bp, E. coli
aaaataatccaagagcaataagggc

SEQ ID NO: 82477 - DNA, 25 bp, E. coli
tatggatcaattaataggagagcca

SEQ ID NO: 82478 - DNA, 25 bp, E. coli
tatggatcaatttataggagagcca

SEQ ID NO: 82479 - DNA, 25 bp, E. coli
tgccagaacatgtattacacgaggg

SEQ ID NO: 82480 - DNA, 25 bp, E. coli
tgccagaacatgaattacacgaggg

SEQ ID NO: 82481 - DNA, 25 bp, E. coli
gccagttttttatgacaaatgcacg

SEQ ID NO: 82482 - DNA, 25 bp, E. coli
gccagttttttaagacaaatgcacg

SEQ ID NO: 82483 - DNA, 25 bp, E. coli
gaattattgaagttttgccagaaca

SEQ ID NO: 82484 - DNA, 25 bp, E. coli
gaattattgaagatttgccagaaca

SEQ ID NO: 82485 - DNA, 25 bp, E. coli
taaatgcaacaacagtttttgaggg

SEQ ID NO: 82486 - DNA, 25 bp, E. coli
taaatgcaacaagagtttttgaggg

SEQ ID NO: 82487 - DNA, 25 bp, E. coli
gatgataatgccacaaatgttaagg

SEQ ID NO: 82488 - DNA, 25 bp, E. coli
gatgataatgcctcaaatgttaagg

SEQ ID NO: 82489 - DNA, 25 bp, E. coli
caatagatcttctggctgcagggcg

SEQ ID NO: 82490 - DNA, 25 bp, E. coli
caatagatcttcaggctgcagggcg

SEQ ID NO: 82491 - DNA, 25 bp, E. coli
cagacgtttgggtgtacagcttcca

SEQ ID NO: 82492 - DNA, 25 bp, E. coli
cagacgtttgggagtacagcttcca

SEQ ID NO: 82493 - DNA, 25 bp, E. coli
caaaagatctttcatgcgctcggta

SEQ ID NO: 82494 - DNA, 25 bp, E. coli
caaaagatctttgatgcgctcggta

SEQ ID NO: 82495 - DNA, 25 bp, E. coli
cagatcgctgaaaaattaagtggcc

SEQ ID NO: 82496 - DNA, 25 bp, E. coli
cagatcgctgaataattaagtggcc

SEQ ID NO: 82497 - DNA, 25 bp, E. coli
tacaagcaagtaattaaggatggcc

SEQ ID NO: 82498 - DNA, 25 bp, E. coli
tacaagcaagtatttaaggatggcc

SEQ ID NO: 82499 - DNA, 25 bp, E. coli
tactccacggcgcataggttcgctg

SEQ ID NO: 82500 - DNA, 25 bp, E. coli
tactccacggcggataggttcgctg

SEQ ID NO: 82501 - DNA, 25 bp, E. coli
aaaagtggccctttgcctacggcag

SEQ ID NO: 82502 - DNA, 25 bp, E. coli
aaaagtggccctatgcctacggcag

SEQ ID NO: 82503 - DNA, 25 bp, E. coli
tgaaatagatcggagggacgacctg

SEQ ID NO: 82504 - DNA, 25 bp, E. coli
tgaaatagatcgcagggacgacctg

SEQ ID NO: 82505 - DNA, 25 bp, E. coli
cgccagcaagtgagaaagtgttacc

SEQ ID NO: 82506 - DNA, 25 bp, E. coli
cgccagcaagtgtgaaagtgttacc

SEQ ID NO: 82507 - DNA, 25 bp, E. coli
gtgacgatggttatgcaccgccaga

SEQ ID NO: 82508 - DNA, 25 bp, E. coli
gtgacgatggttttgcaccgccaga

SEQ ID NO: 82509 - DNA, 25 bp, E. coli
ggccgtaggtgcatgtgccgtacaa

SEQ ID NO: 82510 - DNA, 25 bp, E. coli
ggccgtaggtgcttgtgccgtacaa

SEQ ID NO: 82511 - DNA, 25 bp, E. coli
aaccctttctccgtgttaatcatga

SEQ ID NO: 82512 - DNA, 25 bp, E. coli
caggaattctcccaaaacctgtggt

SEQ ID NO: 82513 - DNA, 25 bp, E. coli
caggaattctccgaaaacctgtggt

SEQ ID NO: 82514 - DNA, 25 bp, E. coli
tagctacccttatagactgactctt

SEQ ID NO: 82515 - DNA, 25 bp, E. coli
tagctacccttaaagactgactctt

SEQ ID NO: 82516 - DNA, 25 bp, E. coli
gtaccgcccgttatcccgctgtgat

SEQ ID NO: 82517 - DNA, 25 bp, E. coli
gtaccgcccgttttcccgctgtgat

SEQ ID NO: 82518 - DNA, 25 bp, E. coli
aaccctttctccctgttaatcatga

SEQ ID NO: 82519 - DNA, 25 bp, E. coli
tatccctgatatatgtctggttctt

SEQ ID NO: 82520 - DNA, 25 bp, E. coli
tatccctgatatttgtctggttctt

SEQ ID NO: 82521 - DNA, 25 bp, E. coli
ccttacgaactgtttctgtgatgaa

SEQ ID NO: 82522 - DNA, 25 bp, E. coli
ccttacgaactgattctgtgatgaa

SEQ ID NO: 82523 - DNA, 25 bp, E. coli
gaatatattctctctgaacaccagg

SEQ ID NO: 82524 - DNA, 25 bp, E. coli
gaatatattctcactgaacaccagg

SEQ ID NO: 82525 - DNA, 25 bp, E. coli
gactcttttttgtactgtctctgga

SEQ ID NO: 82526 - DNA, 25 bp, E. coli
gactcttttttgaactgtctctgga

SEQ ID NO: 82527 - DNA, 25 bp, E. coli
tctggttcttttaccttacgaactg

SEQ ID NO: 82528 - DNA, 25 bp, E. coli
cccgctgtgatagctacccttaaag

SEQ ID NO: 82529 - DNA, 25 bp, E. coli
tctggttctttttccttacgaactg

SEQ ID NO: 82530 - DNA, 25 bp, E. coli
cccgctgtgatacctacccttaaag

SEQ ID NO: 82531 - DNA, 25 bp, E. coli
gttaatcatgaagaaatcattcgcc

SEQ ID NO: 82532 - DNA, 25 bp, E. coli
gttaatcatgaacaaatcattcgcc

SEQ ID NO: 82533 - DNA, 25 bp, E. coli
gacaacggagttctcgccaatgggc

SEQ ID NO: 82534 - DNA, 25 bp, E. coli
gacaacggagttgtcgccaatgggc

SEQ ID NO: 82535 - DNA, 25 bp, E. coli
cagctgctggtggtgcggtaatttc

SEQ ID NO: 82536 - DNA, 25 bp, E. coli
cagctgctggtgctgcggtaatttc

SEQ ID NO: 82537 - DNA, 25 bp, E. coli
ttaactatccgttgctggcgctggc

SEQ ID NO: 82538 - DNA, 25 bp, E. coli
ttaactatccgtagctggcgctggc

SEQ ID NO: 82539 - DNA, 25 bp, E. coli
tcccgctgccggaatgttaatcagt

SEQ ID NO: 82540 - DNA, 25 bp, E. coli
tcccgctgccggtatgttaatcagt

SEQ ID NO: 82541 - DNA, 25 bp, E. coli
tctatcggtaacaatctcggcggca

SEQ ID NO: 82542 - DNA, 25 bp, E. coli
tctcggcggcaatctggcagatcgt

SEQ ID NO: 82543 - DNA, 25 bp, E. coli
tcattgcgcgcggtgtggatgtctc

SEQ ID NO: 82544 - DNA, 25 bp, E. coli
tctatcggtaactatctcggcggca

SEQ ID NO: 82545 - DNA, 25 bp, E. coli
tcattgcgcgcgctgtggatgtctc

SEQ ID NO: 82546 - DNA, 25 bp, E. coli
tctcggcggcaaactggcagatcgt

SEQ ID NO: 82547 - DNA, 25 bp, E. coli
gccgttacagatgcgcgtgatgcgt

SEQ ID NO: 82548 - DNA, 25 bp, E. coli
gccgttacagatccgcgtgatgcgt

SEQ ID NO: 82549 - DNA, 25 bp, E. coli
gcgccggattatatgaccctgatgc

SEQ ID NO: 82550 - DNA, 25 bp, E. coli
gcattttgaccagcctgaatcacgg

SEQ ID NO: 82551 - DNA, 25 bp, E. coli
gcattttgaccaccctgaatcacgg

SEQ ID NO: 82552 - DNA, 25 bp, E. coli
gcgccggattatttgaccctgatgc

SEQ ID NO: 82553 - DNA, 25 bp, E. coli
taatcttggaaaagcgctgggagca

SEQ ID NO: 82554 - DNA, 25 bp, E. coli
taatcttggaaatgcgctgggagca

SEQ ID NO: 82555 - DNA, 25 bp, E. coli
cagtgaagaccgagctattcataaa

SEQ ID NO: 82556 - DNA, 25 bp, E. coli
cagtgaagaccgtgctattcataaa

SEQ ID NO: 82557 - DNA, 25 bp, E. coli
tatcgattctgcagttggcatactg

SEQ ID NO: 82558 - DNA, 25 bp, E. coli
tatcgattctgctgttggcatactg

SEQ ID NO: 82559 - DNA, 25 bp, E. coli
tgattttgaaagcacctcgacctgg

SEQ ID NO: 82560 - DNA, 25 bp, E. coli
tgattttgaaaggacctcgacctgg

SEQ ID NO: 82561 - DNA, 25 bp, E. coli
tgctttgcggcactgaagaccgtgc

SEQ ID NO: 82562 - DNA, 25 bp, E. coli
tgctttgcggcagtgaagaccgtgc

SEQ ID NO: 82563 - DNA, 25 bp, E. coli
tgcggcagtgaagaccgtgctattc

SEQ ID NO: 82564 - DNA, 25 bp, E. coli
tgccggtcgcggtatcgattctgct

SEQ ID NO: 82565 - DNA, 25 bp, E. coli
tgccggtcgcggaatcgattctgct

SEQ ID NO: 82566 - DNA, 25 bp, E. coli
tgcggcagtgaacaccgtgctattc

SEQ ID NO: 82567 - DNA, 25 bp, E. coli
gctgttggcatactgctttgcggca

SEQ ID NO: 82568 - DNA, 25 bp, E. coli
gcatactgctttccggcagtgaaga

SEQ ID NO: 82569 - DNA, 25 bp, E. coli
gctgttggcatagtgctttgcggca

SEQ ID NO: 82570 - DNA, 25 bp, E. coli
gcatactgctttgcggcagtgaaga

SEQ ID NO: 82571 - DNA, 25 bp, E. coli
cgcggtatcgattctgctgttggca

SEQ ID NO: 82572 - DNA, 25 bp, E. coli
cgcggtatcgatactgctgttggca

SEQ ID NO: 82573 - DNA, 25 bp, E. coli
gattttgaaagcacctcgacctggt

SEQ ID NO: 82574 - DNA, 25 bp, E. coli
gattttgaaagctcctcgacctggt

SEQ ID NO: 82575 - DNA, 25 bp, E. coli
ggttcctgatttagaaagcacctcg

SEQ ID NO: 82576 - DNA, 25 bp, E. coli
ggttcctgattttgaaagcacctcg

SEQ ID NO: 82577 - DNA, 25 bp, E. coli
caaagaagtagatgcgaaagaactg

SEQ ID NO: 82578 - DNA, 25 bp, E. coli
caaagaagtagaagcgaaagaactg

SEQ ID NO: 82579 - DNA, 25 bp, E. coli
tacgcgtcgcgggttcaaagaagta

SEQ ID NO: 82580 - DNA, 25 bp, E. coli
tacgcgtcgcggcttcaaagaagta

SEQ ID NO: 82581 - DNA, 25 bp, E. coli
tattcgcgtgggtactccggcaatt

SEQ ID NO: 82582 - DNA, 25 bp, E. coli
tattcgcgtgggaactccggcaatt

SEQ ID NO: 82583 - DNA, 25 bp, E. coli
tcgcgtgggtacaccggcaattacg

SEQ ID NO: 82584 - DNA, 25 bp, E. coli
tcgcgtgggtactccggcaattacg

SEQ ID NO: 82585 - DNA, 25 bp, E. coli
tcgcggcttcaaagaagtagaagcg

SEQ ID NO: 82586 - DNA, 25 bp, E. coli
tcgcggcttcaatgaagtagaagcg

SEQ ID NO: 82587 - DNA, 25 bp, E. coli
gcgtcgcggcttgaaagaagtagaa

SEQ ID NO: 82588 - DNA, 25 bp, E. coli
gcgtcgcggcttcaaagaagtagaa

SEQ ID NO: 82589 - DNA, 25 bp, E. coli
cggtattcgcgtgggtactccggca

SEQ ID NO: 82590 - DNA, 25 bp, E. coli
cggtattcgcgtcggtactccggca

SEQ ID NO: 82591 - DNA, 25 bp, E. coli
gggtactccggcaattacgcgtcgc

SEQ ID NO: 82592 - DNA, 25 bp, E. coli
gggtactccggctattacgcgtcgc

SEQ ID NO: 82593 - DNA, 25 bp, E. coli
tgggtactccgggaattacgcgtcg

SEQ ID NO: 82594 - DNA, 25 bp, E. coli
tgggtactccggcaattacgcgtcg

SEQ ID NO: 82595 - DNA, 25 bp, E. coli
ggcaattacgcgacgcggcttcaaa

SEQ ID NO: 82596 - DNA, 25 bp, E. coli
ggcaattacgcgtcgcggcttcaaa

SEQ ID NO: 82597 - DNA, 25 bp, E. coli
tcaaagaagtagaagcgaaagaact

SEQ ID NO: 82598 - DNA, 25 bp, E. coli
tcaaagaagtagtagcgaaagaact

SEQ ID NO: 82599 - DNA, 25 bp, E. coli
cacgctatgcctccctgatgatgta

SEQ ID NO: 82600 - DNA, 25 bp, E. coli
cacgctatgcctgcctgatgatgta

SEQ ID NO: 82601 - DNA, 25 bp, E. coli
catgattacatagcgaaagtgtgga

SEQ ID NO: 82602 - DNA, 25 bp, E. coli
catgattacataccgaaagtgtgga

SEQ ID NO: 82603 - DNA, 25 bp, E. coli
tacacgctagtatcggcataaccac

SEQ ID NO: 82604 - DNA, 25 bp, E. coli
tacacgctagtaacggcataaccac

SEQ ID NO: 82605 - DNA, 25 bp, E. coli
tgtagcgaaatagcacgatcatgac

SEQ ID NO: 82606 - DNA, 25 bp, E. coli
tgtagcgaaataccacgatcatgac

SEQ ID NO: 82607 - DNA, 25 bp, E. coli
tctgcacctgggacaactgatacgg

SEQ ID NO: 82608 - DNA, 25 bp, E. coli
tctaaaggacgatgcacgctatgcc

SEQ ID NO: 82609 - DNA, 25 bp, E. coli
tctaaaggacgaagcacgctatgcc

SEQ ID NO: 82610 - DNA, 25 bp, E. coli
tctgcacctgggtcaactgatacgg

SEQ ID NO: 82611 - DNA, 25 bp, E. coli
cctgccaatattgaggatacaaact

SEQ ID NO: 82612 - DNA, 25 bp, E. coli
gccattttccctaattctgtagcga

SEQ ID NO: 82613 - DNA, 25 bp, E. coli
cctgccaatattcaggatacaaact

SEQ ID NO: 82614 - DNA, 25 bp, E. coli
gccattttcccttattctgtagcga

SEQ ID NO: 82615 - DNA, 25 bp, E. coli
gatacggtgcttaggccgtgacaat

SEQ ID NO: 82616 - DNA, 25 bp, E. coli
gatacggtgctttggccgtgacaat

SEQ ID NO: 82617 - DNA, 25 bp, E. coli
gggaaacagcaattaacctgccaat

SEQ ID NO: 82618 - DNA, 25 bp, E. coli
gggaaacagcaaataacctgccaat

SEQ ID NO: 82619 - DNA, 25 bp, E. coli
gatgtatatcaaagtaaaaccgcca

SEQ ID NO: 82620 - DNA, 25 bp, E. coli
gatgtatatcaatgtaaaaccgcca

SEQ ID NO: 82621 - DNA, 25 bp, E. coli
taacatatcattgaaccacgacggg

SEQ ID NO: 82622 - DNA, 25 bp, E. coli
agccgaagagcttggtatgacgcag

SEQ ID NO: 82623 - DNA, 25 bp, E. coli
agccgaagagctaggtatgacgcag

SEQ ID NO: 82624 - DNA, 25 bp, E. coli
tatgacgcagggtggaattggacac

SEQ ID NO: 82625 - DNA, 25 bp, E. coli
tatgacgcagggaggaattggacac

SEQ ID NO: 82626 - DNA, 25 bp, E. coli
tgttggcgaatagtcatcggcccca

SEQ ID NO: 82627 - DNA, 25 bp, E. coli
tgttggcgaatactcatcggcccca

SEQ ID NO: 82628 - DNA, 25 bp, E. coli
tcggccccagttaaaaaacaatatg

SEQ ID NO: 82629 - DNA, 25 bp, E. coli
tctacaaccacttaacccgcaatat

SEQ ID NO: 82630 - DNA, 25 bp, E. coli
tcggccccagtttaaaaacaatatg

SEQ ID NO: 82631 - DNA, 25 bp, E. coli
tctacaaccactaaacccgcaatat

SEQ ID NO: 82632 - DNA, 25 bp, E. coli
gaaagagctcgggataactcaagag

SEQ ID NO: 82633 - DNA, 25 bp, E. coli
gaaagagctcggcataactcaagag

SEQ ID NO: 82634 - DNA, 25 bp, E. coli
ctcaagagaagttagccgaagagct

SEQ ID NO: 82635 - DNA, 25 bp, E. coli
cgggacattttctcctgttggcgaa

SEQ ID NO: 82636 - DNA, 25 bp, E. coli
ctcaagagaagtaagccgaagagct

SEQ ID NO: 82637 - DNA, 25 bp, E. coli
cgggacattttcacctgttggcgaa

SEQ ID NO: 82638 - DNA, 25 bp, E. coli
gatctcgtcatcgatctcttagtga

SEQ ID NO: 82639 - DNA, 25 bp, E. coli
tggacactggttgcgcggatctcgt

SEQ ID NO: 82640 - DNA, 25 bp, E. coli
tggacactggttccgcggatctcgt

SEQ ID NO: 82641 - DNA, 25 bp, E. coli
taacatatcattcaaccacgacggg

SEQ ID NO: 82642 - DNA, 25 bp, E. coli
gatctcgtcatccatctcttagtga

SEQ ID NO: 82643 - DNA, 25 bp, E. coli
aacattatgcgttccagaaaaaggg

SEQ ID NO: 82644 - DNA, 25 bp, E. coli
aacattatgcgtaccagaaaaaggg

SEQ ID NO: 82645 - DNA, 25 bp, E. coli
ttttgtcaagaatgcactgaactcc

SEQ ID NO: 82646 - DNA, 25 bp, E. coli
ttttgtcaagaaagcactgaactcc

SEQ ID NO: 82647 - DNA, 25 bp, E. coli
tgaatctcacaagagaacatctacc

SEQ ID NO: 82648 - DNA, 25 bp, E. coli
tgaactccaacaaatgcactcttta

SEQ ID NO: 82649 - DNA, 25 bp, E. coli
tgaactccaacatatgcactcttta

SEQ ID NO: 82650 - DNA, 25 bp, E. coli
tgaatctcacaacagaacatctacc

SEQ ID NO: 82651 - DNA, 25 bp, E. coli
tgcgacacacaatttcttaagtgcc

SEQ ID NO: 82652 - DNA, 25 bp, E. coli
tgcgacacacaaattcttaagtgcc

SEQ ID NO: 82653 - DNA, 25 bp, E. coli
tcctgatgaattctcttgcgacaca

SEQ ID NO: 82654 - DNA, 25 bp, E. coli
tcctgatgaattgtcttgcgacaca

SEQ ID NO: 82655 - DNA, 25 bp, E. coli
tcataattatggttgcagaccaaca

SEQ ID NO: 82656 - DNA, 25 bp, E. coli
tcataattatggatgcagaccaaca

SEQ ID NO: 82657 - DNA, 25 bp, E. coli
cctctcagcagggaaaagatagtaa

SEQ ID NO: 82658 - DNA, 25 bp, E. coli
cctctcagcaggcaaaagatagtaa

SEQ ID NO: 82659 - DNA, 25 bp, E. coli
cttaagtgcccaataacattatgcg

SEQ ID NO: 82660 - DNA, 25 bp, E. coli
cttaagtgcccattaacattatgcg

SEQ ID NO: 82661 - DNA, 25 bp, E. coli
gttattttgacaccataagtcagca

SEQ ID NO: 82662 - DNA, 25 bp, E. coli
gataagtctgcgttcatgaatctca

SEQ ID NO: 82663 - DNA, 25 bp, E. coli
gttattttgacagcataagtcagca

SEQ ID NO: 82664 - DNA, 25 bp, E. coli
gataagtctgcgatcatgaatctca

SEQ ID NO: 82665 - DNA, 25 bp, E. coli
catcctgcgtgatatcatggtggaa

SEQ ID NO: 82666 - DNA, 25 bp, E. coli
catcctgcgtgaaatcatggtggaa

SEQ ID NO: 82667 - DNA, 25 bp, E. coli
tagctatcagaacggcaccaacatg

SEQ ID NO: 82668 - DNA, 25 bp, E. coli
tagctatcagaagggcaccaacatg

SEQ ID NO: 82669 - DNA, 25 bp, E. coli
tatcggtaaacatcgcgttcactgg

SEQ ID NO: 82670 - DNA, 25 bp, E. coli
tatcggtaaacaacgcgttcactgg

SEQ ID NO: 82671 - DNA, 25 bp, E. coli
tgaaaaccggctacaacatcctgcg

SEQ ID NO: 82672 - DNA, 25 bp, E. coli
tgaaaaccggcttcaacatcctgcg

SEQ ID NO: 82673 - DNA, 25 bp, E. coli
tcaaaaccggcatcatgggctttac

SEQ ID NO: 82674 - DNA, 25 bp, E. coli
tcaaaaccggcaacatgggctttac

SEQ ID NO: 82675 - DNA, 25 bp, E. coli
gcaagctgatcgaaacctggtttaa

SEQ ID NO: 82676 - DNA, 25 bp, E. coli
gaacgtgtgcagttcctcaaaaccg

SEQ ID NO: 82677 - DNA, 25 bp, E. coli
gaccggataaagtggctgccgaacg

SEQ ID NO: 82678 - DNA, 25 bp, E. coli
gaacgtgtgcagatcctcaaaaccg

SEQ ID NO: 82679 - DNA, 25 bp, E. coli
gaccggataaagaggctgccgaacg

SEQ ID NO: 82680 - DNA, 25 bp, E. coli
gcaagctgatcgtaacctggtttaa

SEQ ID NO: 82681 - DNA, 25 bp, E. coli
cgacgacatcacgatgctgggcggt

SEQ ID NO: 82682 - DNA, 25 bp, E. coli
cgacgacatcaccatgctgggcggt

SEQ ID NO: 82683 - DNA, 25 bp, E. coli
ctgtaagccggaagaggaaatcgac

SEQ ID NO: 82684 - DNA, 25 bp, E. coli
ctgtaagccggatgaggaaatcgac

SEQ ID NO: 82685 - DNA, 25 bp, E. coli
ggtgcaccaccagggtatcggtaaa

SEQ ID NO: 82686 - DNA, 25 bp, E. coli
ggtgcaccaccacggtatcggtaaa

SEQ ID NO: 82687 - DNA, 25 bp, E. coli
cacatgcagcagaaggagagcatac

SEQ ID NO: 82688 - DNA, 25 bp, E. coli
cacatgcagcagtaggagagcatac

SEQ ID NO: 82689 - DNA, 25 bp, E. coli
aaaacctcccttccgtgggctgcag

SEQ ID NO: 82690 - DNA, 25 bp, E. coli
aaaacctcccttgcgtgggctgcag

SEQ ID NO: 82691 - DNA, 25 bp, E. coli
tatgcgcactttgagtttccgggac

SEQ ID NO: 82692 - DNA, 25 bp, E. coli
tatgcgcactttcagtttccgggac

SEQ ID NO: 82693 - DNA, 25 bp, E. coli
tatcagggcgaaatactggagtctg

SEQ ID NO: 82694 - DNA, 25 bp, E. coli
tatcagggcgaattactggagtctg

SEQ ID NO: 82695 - DNA, 25 bp, E. coli
tgcagtcagccgatcataccaggaa

SEQ ID NO: 82696 - DNA, 25 bp, E. coli
tgcagtcagccgttcataccaggaa

SEQ ID NO: 82697 - DNA, 25 bp, E. coli
tgcgactgctcataacagggagact

SEQ ID NO: 82698 - DNA, 25 bp, E. coli
tgcgactgctcaaaacagggagact

SEQ ID NO: 82699 - DNA, 25 bp, E. coli
ccttcatggcggcttaatcagtaca

SEQ ID NO: 82700 - DNA, 25 bp, E. coli
ccttcatggcgggttaatcagtaca

SEQ ID NO: 82701 - DNA, 25 bp, E. coli
gcttctgccagatcggatatcaggg

SEQ ID NO: 82702 - DNA, 25 bp, E. coli
gcttctgccagaacggatatcaggg

SEQ ID NO: 82703 - DNA, 25 bp, E. coli
gaaactacttttcttcattgggcga

SEQ ID NO: 82704 - DNA, 25 bp, E. coli
gaaactacttttgttcattgggcga

SEQ ID NO: 82705 - DNA, 25 bp, E. coli
cattgggcgaatatacagatggtcg

SEQ ID NO: 82706 - DNA, 25 bp, E. coli
cttacgaaggttgcggctctggcga

SEQ ID NO: 82707 - DNA, 25 bp, E. coli
cattgggcgaatttacagatggtcg

SEQ ID NO: 82708 - DNA, 25 bp, E. coli
cttacgaaggttccggctctggcga

SEQ ID NO: 82709 - DNA, 25 bp, E. coli
caacggcgcttttttctgtttatct

SEQ ID NO: 82710 - DNA, 25 bp, E. coli
caacggcgctttattctgtttatct

SEQ ID NO: 82711 - DNA, 25 bp, E. coli
ctaaatggtagtgaattattctgcc

SEQ ID NO: 82712 - DNA, 25 bp, E. coli
ctaaatggtagtcaattattctgcc

SEQ ID NO: 82713 - DNA, 25 bp, E. coli
taaatggtagtgaattattctgccc

SEQ ID NO: 82714 - DNA, 25 bp, E. coli
taaatggtagtgtattattctgccc

SEQ ID NO: 82715 - DNA, 25 bp, E. coli
aaatggtagtgatttattctgccct

SEQ ID NO: 82716 - DNA, 25 bp, E. coli
aaatggtagtgaattattctgccct

SEQ ID NO: 82717 - DNA, 25 bp, E. coli
tgaaaaatatcctgcataatcccct

SEQ ID NO: 82718 - DNA, 25 bp, E. coli
tgaaaaatatccagcataatcccct

SEQ ID NO: 82719 - DNA, 25 bp, E. coli
tctgccctttgtaccgttattttat

SEQ ID NO: 82720 - DNA, 25 bp, E. coli
tctgccctttgttccgttattttat

SEQ ID NO: 82721 - DNA, 25 bp, E. coli
cctaaatggtagtgaattattctgc

SEQ ID NO: 82722 - DNA, 25 bp, E. coli
ccctaaatggtagtgaattattctg

SEQ ID NO: 82723 - DNA, 25 bp, E. coli
cccctaaatggtagtgaattattct

SEQ ID NO: 82724 - DNA, 25 bp, E. coli
cctaaatggtagagaattattctgc

SEQ ID NO: 82725 - DNA, 25 bp, E. coli
cccctaaatggttgtgaattattct

SEQ ID NO: 82726 - DNA, 25 bp, E. coli
ccctaaatggtactgaattattctg

SEQ ID NO: 82727 - DNA, 25 bp, E. coli
gttattttatgctgacaacggcgct

SEQ ID NO: 82728 - DNA, 25 bp, E. coli
gttattttatgcagacaacggcgct

SEQ ID NO: 82729 - DNA, 25 bp, E. coli
gtgaattattctgccctttgtaccg

SEQ ID NO: 82730 - DNA, 25 bp, E. coli
gtgaattattctcccctttgtaccg

SEQ ID NO: 82731 - DNA, 25 bp, E. coli
aagtcaggaacacctacagcacgcc

SEQ ID NO: 82732 - DNA, 25 bp, E. coli
aagtcaggaacagctacagcacgcc

SEQ ID NO: 82733 - DNA, 25 bp, E. coli
aggaacagctactgcacgcccagca

SEQ ID NO: 82734 - DNA, 25 bp, E. coli
agtcaggaacagctacagcacgccc

SEQ ID NO: 82735 - DNA, 25 bp, E. coli
aggaacagctacagcacgcccagca

SEQ ID NO: 82736 - DNA, 25 bp, E. coli
agtcaggaacaggtacagcacgccc

SEQ ID NO: 82737 - DNA, 25 bp, E. coli
acgcccagcaggatgctgcccgtga

SEQ ID NO: 82738 - DNA, 25 bp, E. coli
acgcccagcaggttgctgcccgtga

SEQ ID NO: 82739 - DNA, 25 bp, E. coli
ttaagtcaggaagagctacagcacg

SEQ ID NO: 82740 - DNA, 25 bp, E. coli
ttaagtcaggaacagctacagcacg

SEQ ID NO: 82741 - DNA, 25 bp, E. coli
tcaggaacagcttcagcacgcccag

SEQ ID NO: 82742 - DNA, 25 bp, E. coli
tcaggaacagctacagcacgcccag

SEQ ID NO: 82743 - DNA, 25 bp, E. coli
cgcccagcaggttgctgcccgtgat

SEQ ID NO: 82744 - DNA, 25 bp, E. coli
cgcccagcaggtagctgcccgtgat

SEQ ID NO: 82745 - DNA, 25 bp, E. coli
cttaagtcaggatcagctacagcac

SEQ ID NO: 82746 - DNA, 25 bp, E. coli
cttaagtcaggaacagctacagcac

SEQ ID NO: 82747 - DNA, 25 bp, E. coli
gtcaggaacagctacagcacgccca

SEQ ID NO: 82748 - DNA, 25 bp, E. coli
gtcaggaacagcaacagcacgccca

SEQ ID NO: 82749 - DNA, 25 bp, E. coli
ggaacagctacaccacgcccagcag

SEQ ID NO: 82750 - DNA, 25 bp, E. coli
ggaacagctacagcacgcccagcag

SEQ ID NO: 82751 - DNA, 25 bp, E. coli
taagtcaggaacagctacagcacgc

SEQ ID NO: 82752 - DNA, 25 bp, E. coli
taagtcaggaactgctacagcacgc

SEQ ID NO: 82753 - DNA, 25 bp, E. coli
catttggatcaagaatagctgacgt

SEQ ID NO: 82754 - DNA, 25 bp, E. coli
catttggatcaacaatagctgacgt

SEQ ID NO: 82755 - DNA, 25 bp, E. coli
taacactgtcggaattgcttgtggc

SEQ ID NO: 82756 - DNA, 25 bp, E. coli
tactaacagtgcttaccagttcggt

SEQ ID NO: 82757 - DNA, 25 bp, E. coli
taaaagcaaagcaagggagttcaga

SEQ ID NO: 82758 - DNA, 25 bp, E. coli
taacactgtcggtattgcttgtggc

SEQ ID NO: 82759 - DNA, 25 bp, E. coli
tactaacagtgcataccagttcggt

SEQ ID NO: 82760 - DNA, 25 bp, E. coli
taaaagcaaagctagggagttcaga

SEQ ID NO: 82761 - DNA, 25 bp, E. coli
acatcaggtggactaatttatgccg

SEQ ID NO: 82762 - DNA, 25 bp, E. coli
acatcaggtggagtaatttatgccg

SEQ ID NO: 82763 - DNA, 25 bp, E. coli
tatatcaccccggacccgattgggt

SEQ ID NO: 82764 - DNA, 25 bp, E. coli
tatatcaccccgcacccgattgggt

SEQ ID NO: 82765 - DNA, 25 bp, E. coli
ttatgccgtatctggtgtacctgga

SEQ ID NO: 82766 - DNA, 25 bp, E. coli
ttatgccgtatcaggtgtacctgga

SEQ ID NO: 82767 - DNA, 25 bp, E. coli
tgataggtaaaaatcatgaggcggc

SEQ ID NO: 82768 - DNA, 25 bp, E. coli
tgataggtaaaattcatgaggcggc

SEQ ID NO: 82769 - DNA, 25 bp, E. coli
tcccatacaagtcatagacccaatg

SEQ ID NO: 82770 - DNA, 25 bp, E. coli
tcccatacaagtgatagacccaatg

SEQ ID NO: 82771 - DNA, 25 bp, E. coli
ggtcagccagcttaagaaagaatca

SEQ ID NO: 82772 - DNA, 25 bp, E. coli
ggtcagccagctaaagaaagaatca

SEQ ID NO: 82773 - DNA, 25 bp, E. coli
gatgctattgttcgcggagctcata

SEQ ID NO: 82774 - DNA, 25 bp, E. coli
gatgctattgttggcggagctcata

SEQ ID NO: 82775 - DNA, 25 bp, E. coli
tagctcgctgcctggaaataccggg

SEQ ID NO: 82776 - DNA, 25 bp, E. coli
tagctcgctgccaggaaataccggg

SEQ ID NO: 82777 - DNA, 25 bp, E. coli
tattggcttcctggctttacatctc

SEQ ID NO: 82778 - DNA, 25 bp, E. coli
tattggcttcctcgctttacatctc

SEQ ID NO: 82779 - DNA, 25 bp, E. coli
ttcagtatgcgccgagtcactctgc

SEQ ID NO: 82780 - DNA, 25 bp, E. coli
ttcagtatgcgcggagtcactctgc

SEQ ID NO: 82781 - DNA, 25 bp, E. coli
tgttatgtgttctgtcaattctcct

SEQ ID NO: 82782 - DNA, 25 bp, E. coli
tgttatgtgttcagtcaattctcct

SEQ ID NO: 82783 - DNA, 25 bp, E. coli
gcaaatattactccgggcattgcgc

SEQ ID NO: 82784 - DNA, 25 bp, E. coli
gcaaatattactgcgggcattgcgc

SEQ ID NO: 82785 - DNA, 25 bp, E. coli
cgaagaatgcctgtattgcagtggg

SEQ ID NO: 82786 - DNA, 25 bp, E. coli
cgaagaatgcctctattgcagtggg

SEQ ID NO: 82787 - DNA, 25 bp, E. coli
cgggatgcttgcaacgtcttccttc

SEQ ID NO: 82788 - DNA, 25 bp, E. coli
cgggatgcttgctacgtcttccttc

SEQ ID NO: 82789 - DNA, 25 bp, E. coli
cggcactcctgcatggcccgatgat

SEQ ID NO: 82790 - DNA, 25 bp, E. coli
cggcactcctgcttggcccgatgat

SEQ ID NO: 82791 - DNA, 25 bp, E. coli
gataagcaaatattactgcgggcat

SEQ ID NO: 82792 - DNA, 25 bp, E. coli
gataagcaaataatactgcgggcat

SEQ ID NO: 82793 - DNA, 25 bp, E. coli
gtacggcgggatgcttgctacgtct

SEQ ID NO: 82794 - DNA, 25 bp, E. coli
gtacggcgggatccttgctacgtct

SEQ ID NO: 82795 - DNA, 25 bp, E. coli
taatgaggaagccaagaatgcctgt

SEQ ID NO: 82796 - DNA, 25 bp, E. coli
taatgaggaagcgaagaatgcctgt

SEQ ID NO: 82797 - DNA, 25 bp, E. coli
caaggactggccaatgaaatcgtca

SEQ ID NO: 82798 - DNA, 25 bp, E. coli
caaggactggcctatgaaatcgtca

SEQ ID NO: 82799 - DNA, 25 bp, E. coli
taaacggatttgacagtcgccaacg

SEQ ID NO: 82800 - DNA, 25 bp, E. coli
tacttattccgttgctggaccgacg

SEQ ID NO: 82801 - DNA, 25 bp, E. coli
tacttattccgtagctggaccgacg

SEQ ID NO: 82802 - DNA, 25 bp, E. coli
taaacggatttgtcagtcgccaacg

SEQ ID NO: 82803 - DNA, 25 bp, E. coli
aataaggacaccacacgtttgagcg

SEQ ID NO: 82804 - DNA, 25 bp, E. coli
aataaggacacctcacgtttgagcg

SEQ ID NO: 82805 - DNA, 25 bp, E. coli
tatggagaaaaaagcgccactgctg

SEQ ID NO: 82806 - DNA, 25 bp, E. coli
tatggagaaaaatgcgccactgctg

SEQ ID NO: 82807 - DNA, 25 bp, E. coli
tataagcacggtgagcaaggactgg

SEQ ID NO: 82808 - DNA, 25 bp, E. coli
tataagcacggtcagcaaggactgg

SEQ ID NO: 82809 - DNA, 25 bp, E. coli
tataacagcccgaggtacagcggca

SEQ ID NO: 82810 - DNA, 25 bp, E. coli
tataacagcccgtggtacagcggca

SEQ ID NO: 82811 - DNA, 25 bp, E. coli
tccgcaaaaacagactcaggtgatg

SEQ ID NO: 82812 - DNA, 25 bp, E. coli
tccgcaaaaacacactcaggtgatg

SEQ ID NO: 82813 - DNA, 25 bp, E. coli
gaagacaaatacaggttcccggata

SEQ ID NO: 82814 - DNA, 25 bp, E. coli
gaagacaaatactggttcccggata

SEQ ID NO: 82815 - DNA, 25 bp, E. coli
gactggacgttccacctgctggatg

SEQ ID NO: 82816 - DNA, 25 bp, E. coli
gactggacgttcgacctgctggatg

SEQ ID NO: 82817 - DNA, 25 bp, E. coli
tggcgaaactctaccggctggatac

SEQ ID NO: 82818 - DNA, 25 bp, E. coli
tggcgaaactcttccggctggatac

SEQ ID NO: 82819 - DNA, 25 bp, E. coli
caagtggttctggtaacttcatgac

SEQ ID NO: 82820 - DNA, 25 bp, E. coli
caagtggttctgctaacttcatgac

SEQ ID NO: 82821 - DNA, 25 bp, E. coli
caggcgcttccggtacgctgtttgg

SEQ ID NO: 82822 - DNA, 25 bp, E. coli
caggcgcttccgctacgctgtttgg

SEQ ID NO: 82823 - DNA, 25 bp, E. coli
taaaggcgctgatatgggagcctcc

SEQ ID NO: 82824 - DNA, 25 bp, E. coli
taaaggcgctgaaatgggagcctcc

SEQ ID NO: 82825 - DNA, 25 bp, E. coli
acgctgtttggtacaagtggttctg

SEQ ID NO: 82826 - DNA, 25 bp, E. coli
acgctgtttggttcaagtggttctg

SEQ ID NO: 82827 - DNA, 25 bp, E. coli
tgctggcaacgttattcttcatcat

SEQ ID NO: 82828 - DNA, 25 bp, E. coli
tgctggcaacgtaattcttcatcat

SEQ ID NO: 82829 - DNA, 25 bp, E. coli
tcttcatcatcagtctggtgctggg

SEQ ID NO: 82830 - DNA, 25 bp, E. coli
tcttcatcatcactctggtgctggg

SEQ ID NO: 82831 - DNA, 25 bp, E. coli
gccgaccagcgatatcccgaactaa

SEQ ID NO: 82832 - DNA, 25 bp, E. coli
gccgaccagcgaaatcccgaactaa

SEQ ID NO: 82833 - DNA, 25 bp, E. coli
gaaaaccgaacatactcagccagct

SEQ ID NO: 82834 - DNA, 25 bp, E. coli
gaaaaccgaacaaactcagccagct

SEQ ID NO: 82835 - DNA, 25 bp, E. coli
gttttccttattgtggcaattggcc

SEQ ID NO: 82836 - DNA, 25 bp, E. coli
gatatgggagcctccttcggagcag

SEQ ID NO: 82837 - DNA, 25 bp, E. coli
gttttccttattctggcaattggcc

SEQ ID NO: 82838 - DNA, 25 bp, E. coli
gatatgggagccaccttcggagcag

SEQ ID NO: 82839 - DNA, 25 bp, E. coli
ggtaacttcatgacccgcatgacgg

SEQ ID NO: 82840 - DNA, 25 bp, E. coli
ggtaacttcatgtcccgcatgacgg

SEQ ID NO: 82841 - DNA, 25 bp, E. coli
caaacagcaagaaccagtgttcctg

SEQ ID NO: 82842 - DNA, 25 bp, E. coli
caaacagcaagatccagtgttcctg

SEQ ID NO: 82843 - DNA, 25 bp, E. coli
aatcttcctcgtccggacctattaa

SEQ ID NO: 82844 - DNA, 25 bp, E. coli
agtgttcctggcttctggcaagggt

SEQ ID NO: 82845 - DNA, 25 bp, E. coli
agtgttcctggcatctggcaagggt

SEQ ID NO: 82846 - DNA, 25 bp, E. coli
aatcttcctcgtgcggacctattaa

SEQ ID NO: 82847 - DNA, 25 bp, E. coli
acagcaagaaccagtgttcctggca

SEQ ID NO: 82848 - DNA, 25 bp, E. coli
acagcaagaacctgtgttcctggca

SEQ ID NO: 82849 - DNA, 25 bp, E. coli
ttcctggcatctcgcaagggtgtga

SEQ ID NO: 82850 - DNA, 25 bp, E. coli
ttcctggcatctggcaagggtgtga

SEQ ID NO: 82851 - DNA, 25 bp, E. coli
tcgcaaacagcatgaaccagtgttc

SEQ ID NO: 82852 - DNA, 25 bp, E. coli
tcgcaaacagcaagaaccagtgttc

SEQ ID NO: 82853 - DNA, 25 bp, E. coli
tcctcgtgcggacctattaagggaa

SEQ ID NO: 82854 - DNA, 25 bp, E. coli
tcctcgtgcggagctattaagggaa

SEQ ID NO: 82855 - DNA, 25 bp, E. coli
tgcggacctatttagggaagcggta

SEQ ID NO: 82856 - DNA, 25 bp, E. coli
tgcggacctattaagggaagcggta

SEQ ID NO: 82857 - DNA, 25 bp, E. coli
tcgtgcggacctattaagggaagcg

SEQ ID NO: 82858 - DNA, 25 bp, E. coli
tcgtgcggaccttttaagggaagcg

SEQ ID NO: 82859 - DNA, 25 bp, E. coli
gcaagaaccagtgttcctggcatct

SEQ ID NO: 82860 - DNA, 25 bp, E. coli
gcaagaaccagtcttcctggcatct

SEQ ID NO: 82861 - DNA, 25 bp, E. coli
gaaccagtgttcctggcatctggca

SEQ ID NO: 82862 - DNA, 25 bp, E. coli
gaaccagtgttcgtggcatctggca

SEQ ID NO: 82863 - DNA, 25 bp, E. coli
caaggtggcctcgtcgtcatcgatt

SEQ ID NO: 82864 - DNA, 25 bp, E. coli
aatacccgtaatcgcattgatacag

SEQ ID NO: 82865 - DNA, 25 bp, E. coli
caaggtggcctcctcgtcatcgatt

SEQ ID NO: 82866 - DNA, 25 bp, E. coli
aatacccgtaatggcattgatacag

SEQ ID NO: 82867 - DNA, 25 bp, E. coli
atcatttgtctggtcgttacgctgc

SEQ ID NO: 82868 - DNA, 25 bp, E. coli
atcatttgtctgctcgttacgctgc

SEQ ID NO: 82869 - DNA, 25 bp, E. coli
atcgcattgatacagccgagcagtt

SEQ ID NO: 82870 - DNA, 25 bp, E. coli
atcgcattgatagagccgagcagtt

SEQ ID NO: 82871 - DNA, 25 bp, E. coli
tattgacaaggtggcctcgtcgtca

SEQ ID NO: 82872 - DNA, 25 bp, E. coli
tattgacaaggtcgcctcgtcgtca

SEQ ID NO: 82873 - DNA, 25 bp, E. coli
tgtctggtcgtttcgctgctaatga

SEQ ID NO: 82874 - DNA, 25 bp, E. coli
tgtctggtcgttacgctgctaatga

SEQ ID NO: 82875 - DNA, 25 bp, E. coli
tcgttacgctgctaatgacactccc

SEQ ID NO: 82876 - DNA, 25 bp, E. coli
tcgttacgctgcaaatgacactccc

SEQ ID NO: 82877 - DNA, 25 bp, E. coli
gcagtttattgacaaggtggcctcg

SEQ ID NO: 82878 - DNA, 25 bp, E. coli
gcagtttattgagaaggtggcctcg

SEQ ID NO: 82879 - DNA, 25 bp, E. coli
cgagcagtttatagacaaggtggcc

SEQ ID NO: 82880 - DNA, 25 bp, E. coli
cgagcagtttattgacaaggtggcc

SEQ ID NO: 82881 - DNA, 25 bp, E. coli
gtttattgacaacgtggcctcgtcg

SEQ ID NO: 82882 - DNA, 25 bp, E. coli
gtttattgacaaggtggcctcgtcg

SEQ ID NO: 82883 - DNA, 25 bp, E. coli
taatcgcattgaaacagccgagcag

SEQ ID NO: 82884 - DNA, 25 bp, E. coli
taatcgcattgatacagccgagcag

SEQ ID NO: 82885 - DNA, 25 bp, E. coli
aatgtatgagaacgatgcctgcgcc

SEQ ID NO: 82886 - DNA, 25 bp, E. coli
caaaaaacggttccgctgtttcgcg

SEQ ID NO: 82887 - DNA, 25 bp, E. coli
aatgtatgagaaggatgcctgcgcc

SEQ ID NO: 82888 - DNA, 25 bp, E. coli
caaaaaacggttgcgctgtttcgcg

SEQ ID NO: 82889 - DNA, 25 bp, E. coli
tcggcggcaccaatacaggagaagc

SEQ ID NO: 82890 - DNA, 25 bp, E. coli
tcggcggcaccattacaggagaagc

SEQ ID NO: 82891 - DNA, 25 bp, E. coli
gccacggcgggctgctattttcact

SEQ ID NO: 82892 - DNA, 25 bp, E. coli
gccacggcgggcagctattttcact

SEQ ID NO: 82893 - DNA, 25 bp, E. coli
gcaggtacgtcatcagggcaagcaa

SEQ ID NO: 82894 - DNA, 25 bp, E. coli
gaaggctttgctgtagtgaccatga

SEQ ID NO: 82895 - DNA, 25 bp, E. coli
gcaaaccggtgtttacgacatcgaa

SEQ ID NO: 82896 - DNA, 25 bp, E. coli
gcaaaccggtgtatacgacatcgaa

SEQ ID NO: 82897 - DNA, 25 bp, E. coli
gcaggtacgtcaacagggcaagcaa

SEQ ID NO: 82898 - DNA, 25 bp, E. coli
gaaggctttgctctagtgaccatga

SEQ ID NO: 82899 - DNA, 25 bp, E. coli
gattttttgcgtccaggctttgccg

SEQ ID NO: 82900 - DNA, 25 bp, E. coli
gtcataaggcctggcaaaatgccca

SEQ ID NO: 82901 - DNA, 25 bp, E. coli
gattttttgcgtgcaggctttgccg

SEQ ID NO: 82902 - DNA, 25 bp, E. coli
gtcataaggcctcgcaaaatgccca

SEQ ID NO: 82903 - DNA, 25 bp, E. coli
taacggtcatcatagttgccacggc

SEQ ID NO: 82904 - DNA, 25 bp, E. coli
taacggtcatcaaagttgccacggc

SEQ ID NO: 82905 - DNA, 25 bp, E. coli
gagacaccttaactgctactgcgca

SEQ ID NO: 82906 - DNA, 25 bp, E. coli
gagacaccttaagtgctactgcgca

SEQ ID NO: 82907 - DNA, 25 bp, E. coli
tacaggcggctgttggaacagtcca

SEQ ID NO: 82908 - DNA, 25 bp, E. coli
tacaggcggctgatggaacagtcca

SEQ ID NO: 82909 - DNA, 25 bp, E. coli
tattagcccgagagataacagtggg

SEQ ID NO: 82910 - DNA, 25 bp, E. coli
tattagcccgagtgataacagtggg

SEQ ID NO: 82911 - DNA, 25 bp, E. coli
tataaccgtgcagataacactcagg

SEQ ID NO: 82912 - DNA, 25 bp, E. coli
tataaccgtgcacataacactcagg

SEQ ID NO: 82913 - DNA, 25 bp, E. coli
tttatggcaggtgacctacaggcgg

SEQ ID NO: 82914 - DNA, 25 bp, E. coli
tttatggcaggtcacctacaggcgg

SEQ ID NO: 82915 - DNA, 25 bp, E. coli
gctggataactctaacgatgctgcc

SEQ ID NO: 82916 - DNA, 25 bp, E. coli
gctggataactcaaacgatgctgcc

SEQ ID NO: 82917 - DNA, 25 bp, E. coli
gaaacgactattgaccctggtacag

SEQ ID NO: 82918 - DNA, 25 bp, E. coli
gaaacgactattcaccctggtacag

SEQ ID NO: 82919 - DNA, 25 bp, E. coli
cgccgactcgcagtttacagttgaa

SEQ ID NO: 82920 - DNA, 25 bp, E. coli
cgccgactcgcactttacagttgaa

SEQ ID NO: 82921 - DNA, 25 bp, E. coli
gatctgactcaatgcccggaaacct

SEQ ID NO: 82922 - DNA, 25 bp, E. coli
gatctgactcaaagcccggaaacct

SEQ ID NO: 82923 - DNA, 25 bp, E. coli
tggcaattggtagcccgctggataa

SEQ ID NO: 82924 - DNA, 25 bp, E. coli
tggcaattggtaccccgctggataa

SEQ ID NO: 82925 - DNA, 25 bp, E. coli
gatgctgccgctggtattagcccga

SEQ ID NO: 82926 - DNA, 25 bp, E. coli
gatgctgccgctcgtattagcccga

SEQ ID NO: 82927 - DNA, 25 bp, E. coli
gatgctcatggtaatggcaacctgg

SEQ ID NO: 82928 - DNA, 25 bp, E. coli
gatgctcatggttatggcaacctgg

SEQ ID NO: 82929 - DNA, 25 bp, E. coli
caataacatattgtgtgttggcata

SEQ ID NO: 82930 - DNA, 25 bp, E. coli
caataacatattctgtgttggcata

SEQ ID NO: 82931 - DNA, 25 bp, E. coli
cacttataggagataccttacaggg

SEQ ID NO: 82932 - DNA, 25 bp, E. coli
cacttataggagttaccttacaggg

SEQ ID NO: 82933 - DNA, 25 bp, E. coli
aaatcgctcaccgtttttcacctgt

SEQ ID NO: 82934 - DNA, 25 bp, E. coli
aaatcgctcaccctttttcacctgt

SEQ ID NO: 82935 - DNA, 25 bp, E. coli
tatgttcagcaagccatcttgatgg

SEQ ID NO: 82936 - DNA, 25 bp, E. coli
tatgttcagcaacccatcttgatgg

SEQ ID NO: 82937 - DNA, 25 bp, E. coli
tttaataaataaagacgccctagtt

SEQ ID NO: 82938 - DNA, 25 bp, E. coli
tttaataaataatgacgccctagtt

SEQ ID NO: 82939 - DNA, 25 bp, E. coli
tgtgttgatttacgcgagataacgc

SEQ ID NO: 82940 - DNA, 25 bp, E. coli
tgtgttgatttaggcgagataacgc

SEQ ID NO: 82941 - DNA, 25 bp, E. coli
tgcctggttcaagtatcaaaaatcg

SEQ ID NO: 82942 - DNA, 25 bp, E. coli
tgcctggttcaactatcaaaaatcg

SEQ ID NO: 82943 - DNA, 25 bp, E. coli
gccctagttaaacttaaagtgcctg

SEQ ID NO: 82944 - DNA, 25 bp, E. coli
gccctagttaaagttaaagtgcctg

SEQ ID NO: 82945 - DNA, 25 bp, E. coli
gcatatgaaattttgaggattaccc

SEQ ID NO: 82946 - DNA, 25 bp, E. coli
gcatatgaaattatgaggattaccc

SEQ ID NO: 82947 - DNA, 25 bp, E. coli
tggcgacctcctctccgcgatgatt

SEQ ID NO: 82948 - DNA, 25 bp, E. coli
tggcgacctcctgtccgcgatgatt

SEQ ID NO: 82949 - DNA, 25 bp, E. coli
gaggattacccttcacttataggag

SEQ ID NO: 82950 - DNA, 25 bp, E. coli
gaggattaccctacacttataggag

SEQ ID NO: 82951 - DNA, 25 bp, E. coli
aatactgatgagcttgtcggagcgc

SEQ ID NO: 82952 - DNA, 25 bp, E. coli
aagtttataatcagctatgtccgca

SEQ ID NO: 82953 - DNA, 25 bp, E. coli
aatactgatgaggttgtcggagcgc

SEQ ID NO: 82954 - DNA, 25 bp, E. coli
aagtttataatctgctatgtccgca

SEQ ID NO: 82955 - DNA, 25 bp, E. coli
cagagctatatggtgatctacgagc

SEQ ID NO: 82956 - DNA, 25 bp, E. coli
cagagctatatgctgatctacgagc

SEQ ID NO: 82957 - DNA, 25 bp, E. coli
agtagacaaggctaagaagattcga

SEQ ID NO: 82958 - DNA, 25 bp, E. coli
agtagacaaggcaaagaagattcga

SEQ ID NO: 82959 - DNA, 25 bp, E. coli
tatgtccgcatcactcttcagagct

SEQ ID NO: 82960 - DNA, 25 bp, E. coli
tatgtccgcatctctcttcagagct

SEQ ID NO: 82961 - DNA, 25 bp, E. coli
tagggtaccagaacttacttacaac

SEQ ID NO: 82962 - DNA, 25 bp, E. coli
tgtatgtatcaggaagaggtaaccc

SEQ ID NO: 82963 - DNA, 25 bp, E. coli
tgtatgtatcagcaagaggtaaccc

SEQ ID NO: 82964 - DNA, 25 bp, E. coli
ccaacaagtggtacttcagcaaatc

SEQ ID NO: 82965 - DNA, 25 bp, E. coli
ccaacaagtggttcttcagcaaatc

SEQ ID NO: 82966 - DNA, 25 bp, E. coli
cctcgtggaaggttgcagtgatgat

SEQ ID NO: 82967 - DNA, 25 bp, E. coli
cctcgtggaaggatgcagtgatgat

SEQ ID NO: 82968 - DNA, 25 bp, E. coli
gatctacgagcattgaaatgcctcg

SEQ ID NO: 82969 - DNA, 25 bp, E. coli
ggtaacccttcgactccggaatcag

SEQ ID NO: 82970 - DNA, 25 bp, E. coli
ggtaacccttcgtctccggaatcag

SEQ ID NO: 82971 - DNA, 25 bp, E. coli
tagggtaccagatcttacttacaac

SEQ ID NO: 82972 - DNA, 25 bp, E. coli
gatctacgagcaatgaaatgcctcg

SEQ ID NO: 82973 - DNA, 25 bp, E. coli
aataccgtgggataagacataacaa

SEQ ID NO: 82974 - DNA, 25 bp, E. coli
aattggcacaaagtagcataaaggc

SEQ ID NO: 82975 - DNA, 25 bp, E. coli
aataccgtgggaaaagacataacaa

SEQ ID NO: 82976 - DNA, 25 bp, E. coli
aattggcacaaactagcataaaggc

SEQ ID NO: 82977 - DNA, 25 bp, E. coli
catatttataaaaacaacggccgtg

SEQ ID NO: 82978 - DNA, 25 bp, E. coli
catatttataaatacaacggccgtg

SEQ ID NO: 82979 - DNA, 25 bp, E. coli
tagccaggaacacgttaaatcattc

SEQ ID NO: 82980 - DNA, 25 bp, E. coli
tagccaggaacaggttaaatcattc

SEQ ID NO: 82981 - DNA, 25 bp, E. coli
tatatgtatttttgccaggaacagg

SEQ ID NO: 82982 - DNA, 25 bp, E. coli
tatatgtattttagccaggaacagg

SEQ ID NO: 82983 - DNA, 25 bp, E. coli
ccataatgtttagcaaattggcaca

SEQ ID NO: 82984 - DNA, 25 bp, E. coli
ccataatgtttaccaaattggcaca

SEQ ID NO: 82985 - DNA, 25 bp, E. coli
gaaatgcttcattattcagtaaggc

SEQ ID NO: 82986 - DNA, 25 bp, E. coli
gaaatgcttcataattcagtaaggc

SEQ ID NO: 82987 - DNA, 25 bp, E. coli
gtattttggttttgtcatcatccgg

SEQ ID NO: 82988 - DNA, 25 bp, E. coli
gtattttggtttagtcatcatccgg

SEQ ID NO: 82989 - DNA, 25 bp, E. coli
ggccgtgccacaggtccgtttcaat

SEQ ID NO: 82990 - DNA, 25 bp, E. coli
ggccgtgccacacgtccgtttcaat

SEQ ID NO: 82991 - DNA, 25 bp, E. coli
taatggaaataaaagtgcagagact

SEQ ID NO: 82992 - DNA, 25 bp, E. coli
taatggaaataatagtgcagagact

SEQ ID NO: 82993 - DNA, 25 bp, E. coli
taatgaaccatattaaataccgtgg

SEQ ID NO: 82994 - DNA, 25 bp, E. coli
taatgaaccataataaataccgtgg

SEQ ID NO: 82995 - DNA, 25 bp, E. coli
aatgtggaaatcctgaccctgcggg

SEQ ID NO: 82996 - DNA, 25 bp, E. coli
aaccgctggcgggatattcatggcg

SEQ ID NO: 82997 - DNA, 25 bp, E. coli
aaccgctggcggcatattcatggcg

SEQ ID NO: 82998 - DNA, 25 bp, E. coli
aatgtggaaatcgtgaccctgcggg

SEQ ID NO: 82999 - DNA, 25 bp, E. coli
aactgctgctggagcaggctgtaag

SEQ ID NO: 83000 - DNA, 25 bp, E. coli
aactgctgctggtgcaggctgtaag

SEQ ID NO: 83001 - DNA, 25 bp, E. coli
tatgttgtgccgatcctttcggcga

SEQ ID NO: 83002 - DNA, 25 bp, E. coli
tatgttgtgccgttcctttcggcga

SEQ ID NO: 83003 - DNA, 25 bp, E. coli
tttgaaaaactctccgaccgcgttg

SEQ ID NO: 83004 - DNA, 25 bp, E. coli
tattcatggcgctgatgcgcaaaac

SEQ ID NO: 83005 - DNA, 25 bp, E. coli
tattcatggcgcagatgcgcaaaac

SEQ ID NO: 83006 - DNA, 25 bp, E. coli
tttgaaaaactcaccgaccgcgttg

SEQ ID NO: 83007 - DNA, 25 bp, E. coli
tgtctcctatcagaacgaactgctg

SEQ ID NO: 83008 - DNA, 25 bp, E. coli
tgtctcctatcacaacgaactgctg

SEQ ID NO: 83009 - DNA, 25 bp, E. coli
gaagccgaggtcaaccgtctgaatg

SEQ ID NO: 83010 - DNA, 25 bp, E. coli
gaagccgaggtctaccgtctgaatg

SEQ ID NO: 83011 - DNA, 25 bp, E. coli
gcgttgagaaggaggaaacccgcct

SEQ ID NO: 83012 - DNA, 25 bp, E. coli
gcgttgagaaggtggaaacccgcct

SEQ ID NO: 83013 - DNA, 25 bp, E. coli
gtcgtcactgcccacagaagccgag

SEQ ID NO: 83014 - DNA, 25 bp, E. coli
gtcgtcactgccgacagaagccgag

SEQ ID NO: 83015 - DNA, 25 bp, E. coli
ggtgaactgaaatccacgaacgcca

SEQ ID NO: 83016 - DNA, 25 bp, E. coli
ggtgaactgaaaaccacgaacgcca

SEQ ID NO: 83017 - DNA, 25 bp, E. coli
aatcaggaccgcgaagcgtttaacg

SEQ ID NO: 83018 - DNA, 25 bp, E. coli
aatcaggaccgccaagcgtttaacg

SEQ ID NO: 83019 - DNA, 25 bp, E. coli
caaacgctccagcaacataaggcgc

SEQ ID NO: 83020 - DNA, 25 bp, E. coli
caaacgctccaggaacataaggcgc

SEQ ID NO: 83021 - DNA, 25 bp, E. coli
cacgaaggttaatggaaatcacatg

SEQ ID NO: 83022 - DNA, 25 bp, E. coli
cacgaaggttaaaggaaatcacatg

SEQ ID NO: 83023 - DNA, 25 bp, E. coli
agcaggcggcgcataccatgatcgc

SEQ ID NO: 83024 - DNA, 25 bp, E. coli
agcaggcggcgcttaccatgatcgc

SEQ ID NO: 83025 - DNA, 25 bp, E. coli
aacataaggcgctgttcgatgcgat

SEQ ID NO: 83026 - DNA, 25 bp, E. coli
aacataaggcgcagttcgatgcgat

SEQ ID NO: 83027 - DNA, 25 bp, E. coli
tttgaacgaacctggatgggcgatg

SEQ ID NO: 83028 - DNA, 25 bp, E. coli
tttgaacgaaccaggatgggcgatg

SEQ ID NO: 83029 - DNA, 25 bp, E. coli
tgatcgccagctggacacgaaggtt

SEQ ID NO: 83030 - DNA, 25 bp, E. coli
tgcagcgggcggattttgaacgaac

SEQ ID NO: 83031 - DNA, 25 bp, E. coli
tgcagcgggcggtttttgaacgaac

SEQ ID NO: 83032 - DNA, 25 bp, E. coli
tgatcgccagctcgacacgaaggtt

SEQ ID NO: 83033 - DNA, 25 bp, E. coli
gcgatgaggccaacatgccgcaaac

SEQ ID NO: 83034 - DNA, 25 bp, E. coli
gcgatgaggccatcatgccgcaaac

SEQ ID NO: 83035 - DNA, 25 bp, E. coli
gaagcggatattcgctaccacgagg

SEQ ID NO: 83036 - DNA, 25 bp, E. coli
gaagcggatattggctaccacgagg

SEQ ID NO: 83037 - DNA, 25 bp, E. coli
cattgcgatcagttcgctgcagcgg

SEQ ID NO: 83038 - DNA, 25 bp, E. coli
cattgcgatcagatcgctgcagcgg

SEQ ID NO: 83039 - DNA, 25 bp, E. coli
cacggactggcggatgacaaattgc

SEQ ID NO: 83040 - DNA, 25 bp, E. coli
cacggactggcgcatgacaaattgc

SEQ ID NO: 83041 - DNA, 25 bp, E. coli
cagtcgtcactgcacaaattgtttg

SEQ ID NO: 83042 - DNA, 25 bp, E. coli
catcgacaatattggcgcgggaacc

SEQ ID NO: 83043 - DNA, 25 bp, E. coli
cataaaagcgaatcgtcaccggtcg

SEQ ID NO: 83044 - DNA, 25 bp, E. coli
catcgacaatataggcgcgggaacc

SEQ ID NO: 83045 - DNA, 25 bp, E. coli
cagtcgtcactggacaaattgtttg

SEQ ID NO: 83046 - DNA, 25 bp, E. coli
cataaaagcgaaacgtcaccggtcg

SEQ ID NO: 83047 - DNA, 25 bp, E. coli
tggtgagtggcagttccgcccgcca

SEQ ID NO: 83048 - DNA, 25 bp, E. coli
tggtgagtggcacttccgcccgcca

SEQ ID NO: 83049 - DNA, 25 bp, E. coli
tgtaccgtacgcgatcacggactgg

SEQ ID NO: 83050 - DNA, 25 bp, E. coli
tgtaccgtacgccatcacggactgg

SEQ ID NO: 83051 - DNA, 25 bp, E. coli
tgaaactggcagtcgtcactggaca

SEQ ID NO: 83052 - DNA, 25 bp, E. coli
tgaaactggcagacgtcactggaca

SEQ ID NO: 83053 - DNA, 25 bp, E. coli
gcccgccaggcggataaaagcgaaa

SEQ ID NO: 83054 - DNA, 25 bp, E. coli
gcccgccaggcgcataaaagcgaaa

SEQ ID NO: 83055 - DNA, 25 bp, E. coli
gaaacgtcaccgctcgatctgtgcg

SEQ ID NO: 83056 - DNA, 25 bp, E. coli
gaaacgtcaccggtcgatctgtgcg

SEQ ID NO: 83057 - DNA, 25 bp, E. coli
gacaaattgtttgtaccgtacgcca

SEQ ID NO: 83058 - DNA, 25 bp, E. coli
gacaaattgtttctaccgtacgcca

SEQ ID NO: 83059 - DNA, 25 bp, E. coli
cggtcgatctgtccgtgattggcat

SEQ ID NO: 83060 - DNA, 25 bp, E. coli
cggtcgatctgtgcgtgattggcat

SEQ ID NO: 83061 - DNA, 25 bp, E. coli
cacattgttttatatgcattagcac

SEQ ID NO: 83062 - DNA, 25 bp, E. coli
cataaccgtttctttacattgataa

SEQ ID NO: 83063 - DNA, 25 bp, E. coli
cactagttggcgtaaaatcttgtat

SEQ ID NO: 83064 - DNA, 25 bp, E. coli
cactagttggcgaaaaatcttgtat

SEQ ID NO: 83065 - DNA, 25 bp, E. coli
cacatatttcgtacaagtttgctat

SEQ ID NO: 83066 - DNA, 25 bp, E. coli
cacattgttttaaatgcattagcac

SEQ ID NO: 83067 - DNA, 25 bp, E. coli
cacatatttcgttcaagtttgctat

SEQ ID NO: 83068 - DNA, 25 bp, E. coli
cataaccgtttcattacattgataa

SEQ ID NO: 83069 - DNA, 25 bp, E. coli
tacaagtttgcttttgttacttcac

SEQ ID NO: 83070 - DNA, 25 bp, E. coli
tatagattgtcagttaaatgatgca

SEQ ID NO: 83071 - DNA, 25 bp, E. coli
tatagattgtcacttaaatgatgca

SEQ ID NO: 83072 - DNA, 25 bp, E. coli
ttaacatttttatcagaggcgtagc

SEQ ID NO: 83073 - DNA, 25 bp, E. coli
ttaacatttttaacagaggcgtagc

SEQ ID NO: 83074 - DNA, 25 bp, E. coli
tttatcattctgaacacatatttcg

SEQ ID NO: 83075 - DNA, 25 bp, E. coli
tttatcattctgtacacatatttcg

SEQ ID NO: 83076 - DNA, 25 bp, E. coli
gcattagcactatttgcaaaaaatt

SEQ ID NO: 83077 - DNA, 25 bp, E. coli
gcattagcactaattgcaaaaaatt

SEQ ID NO: 83078 - DNA, 25 bp, E. coli
tggaaaaagttgaacactagttggc

SEQ ID NO: 83079 - DNA, 25 bp, E. coli
tggaaaaagttgtacactagttggc

SEQ ID NO: 83080 - DNA, 25 bp, E. coli
tacaagtttgctattgttacttcac

SEQ ID NO: 83081 - DNA, 25 bp, E. coli
gatgcaatatgtattatcataacac

SEQ ID NO: 83082 - DNA, 25 bp, E. coli
gatgcaatatgttttatcataacac

SEQ ID NO: 83083 - DNA, 25 bp, E. coli
caggcaatcactttaaacttctcgg

SEQ ID NO: 83084 - DNA, 25 bp, E. coli
caggcaatcactataaacttctcgg

SEQ ID NO: 83085 - DNA, 25 bp, E. coli
atattaaaacattaccggcgaagcg

SEQ ID NO: 83086 - DNA, 25 bp, E. coli
atattaaaacataaccggcgaagcg

SEQ ID NO: 83087 - DNA, 25 bp, E. coli
ttgactggcatgttgtttcggtgga

SEQ ID NO: 83088 - DNA, 25 bp, E. coli
ttgactggcatgatgtttcggtgga

SEQ ID NO: 83089 - DNA, 25 bp, E. coli
gctggcaatcctcaccacttcgttg

SEQ ID NO: 83090 - DNA, 25 bp, E. coli
gctggcaatcctgaccacttcgttg

SEQ ID NO: 83091 - DNA, 25 bp, E. coli
gattcagtggtggaaaaatcacggg

SEQ ID NO: 83092 - DNA, 25 bp, E. coli
gttggtgacaccatccgtctgggca

SEQ ID NO: 83093 - DNA, 25 bp, E. coli
gattcgctgaaagccggaacctaca

SEQ ID NO: 83094 - DNA, 25 bp, E. coli
gattgttccactcgccgattcgctg

SEQ ID NO: 83095 - DNA, 25 bp, E. coli
gtctgggcacatgcgcatttaacgc

SEQ ID NO: 83096 - DNA, 25 bp, E. coli
gattgttccactggccgattcgctg

SEQ ID NO: 83097 - DNA, 25 bp, E. coli
gttggtgacaccttccgtctgggca

SEQ ID NO: 83098 - DNA, 25 bp, E. coli
gattcgctgaaacccggaacctaca

SEQ ID NO: 83099 - DNA, 25 bp, E. coli
gattcagtggtgcaaaaatcacggg

SEQ ID NO: 83100 - DNA, 25 bp, E. coli
gtctgggcacatccgcatttaacgc

SEQ ID NO: 83101 - DNA, 25 bp, E. coli
ggaacctacaccgttgactggcatg

SEQ ID NO: 83102 - DNA, 25 bp, E. coli
ggaacctacacccttgactggcatg

SEQ ID NO: 83103 - DNA, 25 bp, E. coli
taacgcatcagtttcctgcggcaaa

SEQ ID NO: 83104 - DNA, 25 bp, E. coli
taacgcatcagtatcctgcggcaaa

SEQ ID NO: 83105 - DNA, 25 bp, E. coli
atttctgttttctctccctctgatt

SEQ ID NO: 83106 - DNA, 25 bp, E. coli
attatttctgttttcactccctctg

SEQ ID NO: 83107 - DNA, 25 bp, E. coli
attatttctgttatcactccctctg

SEQ ID NO: 83108 - DNA, 25 bp, E. coli
atattatttctgatttcactccctc

SEQ ID NO: 83109 - DNA, 25 bp, E. coli
atttctgttttcactccctctgatt

SEQ ID NO: 83110 - DNA, 25 bp, E. coli
atattatttctgttttcactccctc

SEQ ID NO: 83111 - DNA, 25 bp, E. coli
ttctgttttcacaccctctgattat

SEQ ID NO: 83112 - DNA, 25 bp, E. coli
ttctgttttcactccctctgattat

SEQ ID NO: 83113 - DNA, 25 bp, E. coli
tattatttctgttttcactccctct

SEQ ID NO: 83114 - DNA, 25 bp, E. coli
tatttctgttttgactccctctgat

SEQ ID NO: 83115 - DNA, 25 bp, E. coli
tatttctgttttcactccctctgat

SEQ ID NO: 83116 - DNA, 25 bp, E. coli
tattatttctgtattcactccctct

SEQ ID NO: 83117 - DNA, 25 bp, E. coli
ttatttctgtttacactccctctga

SEQ ID NO: 83118 - DNA, 25 bp, E. coli
tttctgttttcactccctctgatta

SEQ ID NO: 83119 - DNA, 25 bp, E. coli
ttatttctgttttcactccctctga

SEQ ID NO: 83120 - DNA, 25 bp, E. coli
tttctgttttcagtccctctgatta

SEQ ID NO: 83121 - DNA, 25 bp, E. coli
tctgttttcactgcctctgattatt

SEQ ID NO: 83122 - DNA, 25 bp, E. coli
tctgttttcactccctctgattatt

SEQ ID NO: 83123 - DNA, 25 bp, E. coli
ctgttttcactccctctgattattt

SEQ ID NO: 83124 - DNA, 25 bp, E. coli
ctgttttcactcgctctgattattt

SEQ ID NO: 83125 - DNA, 25 bp, E. coli
caaaggcagcgtagaaaacggtgca

SEQ ID NO: 83126 - DNA, 25 bp, E. coli
caaaggcagcgttgaaaacggtgca

SEQ ID NO: 83127 - DNA, 25 bp, E. coli
tatggtaaaaacgacgacaccggcg

SEQ ID NO: 83128 - DNA, 25 bp, E. coli
tatggtaaaaaccacgacaccggcg

SEQ ID NO: 83129 - DNA, 25 bp, E. coli
tttcatcaacaacaatggcccgacc

SEQ ID NO: 83130 - DNA, 25 bp, E. coli
tttcatcaacaagaatggcccgacc

SEQ ID NO: 83131 - DNA, 25 bp, E. coli
ttacaaccagggtctgtccgagcgc

SEQ ID NO: 83132 - DNA, 25 bp, E. coli
ttacaaccagggactgtccgagcgc

SEQ ID NO: 83133 - DNA, 25 bp, E. coli
tggtttcatcaagaacaatggcccg

SEQ ID NO: 83134 - DNA, 25 bp, E. coli
tgaaaacggtgcatacaaagctcag

SEQ ID NO: 83135 - DNA, 25 bp, E. coli
tgaaaacggtgcttacaaagctcag

SEQ ID NO: 83136 - DNA, 25 bp, E. coli
tgaaaaccaactgggcgctggtgct

SEQ ID NO: 83137 - DNA, 25 bp, E. coli
tgaaaaccaactcggcgctggtgct

SEQ ID NO: 83138 - DNA, 25 bp, E. coli
gacactaaatccaacgtttatggta

SEQ ID NO: 83139 - DNA, 25 bp, E. coli
gacactaaatcctacgtttatggta

SEQ ID NO: 83140 - DNA, 25 bp, E. coli
gccgtacaaagggagcgttgaaaac

SEQ ID NO: 83141 - DNA, 25 bp, E. coli
gccgtacaaaggcagcgttgaaaac

SEQ ID NO: 83142 - DNA, 25 bp, E. coli
tggcgtgcagactctaaatccaacg

SEQ ID NO: 83143 - DNA, 25 bp, E. coli
tggtttcatcaacaacaatggcccg

SEQ ID NO: 83144 - DNA, 25 bp, E. coli
tggcgtgcagacactaaatccaacg

SEQ ID NO: 83145 - DNA, 25 bp, E. coli
gacccatgaaaaccaactgggcgct

SEQ ID NO: 83146 - DNA, 25 bp, E. coli
gacccatgaaaagcaactgggcgct

SEQ ID NO: 83147 - DNA, 25 bp, E. coli
aagaagagcgttcggcgattcaccg

SEQ ID NO: 83148 - DNA, 25 bp, E. coli
aagaagagcgttgggcgattcaccg

SEQ ID NO: 83149 - DNA, 25 bp, E. coli
catgaacgtactcggtgaaccggtc

SEQ ID NO: 83150 - DNA, 25 bp, E. coli
catgaacgtactgggtgaaccggtc

SEQ ID NO: 83151 - DNA, 25 bp, E. coli
tacctgcggatgacttgactgaccc

SEQ ID NO: 83152 - DNA, 25 bp, E. coli
taaagcgactctcggccgtatcatg

SEQ ID NO: 83153 - DNA, 25 bp, E. coli
tacctgcggatgtcttgactgaccc

SEQ ID NO: 83154 - DNA, 25 bp, E. coli
taaagcgactctgggccgtatcatg

SEQ ID NO: 83155 - DNA, 25 bp, E. coli
tagttgacgtcgtattccctcagga

SEQ ID NO: 83156 - DNA, 25 bp, E. coli
tagttgacgtcgaattccctcagga

SEQ ID NO: 83157 - DNA, 25 bp, E. coli
tgtatggccagaagaacgagccgcc

SEQ ID NO: 83158 - DNA, 25 bp, E. coli
tgtatggccagatgaacgagccgcc

SEQ ID NO: 83159 - DNA, 25 bp, E. coli
gaatacgatcacgtgccggagcagg

SEQ ID NO: 83160 - DNA, 25 bp, E. coli
gcaaccgtggtactgagccgtcaga

SEQ ID NO: 83161 - DNA, 25 bp, E. coli
gaatacgatcacctgccggagcagg

SEQ ID NO: 83162 - DNA, 25 bp, E. coli
gcaaccgtggtagtgagccgtcaga

SEQ ID NO: 83163 - DNA, 25 bp, E. coli
gacaaactggtgctagcgcgtgctc

SEQ ID NO: 83164 - DNA, 25 bp, E. coli
gacaaactggtggtagcgcgtgctc

SEQ ID NO: 83165 - DNA, 25 bp, E. coli
gattgtccaggttatcggcgccgta

SEQ ID NO: 83166 - DNA, 25 bp, E. coli
gattgtccaggtaatcggcgccgta

SEQ ID NO: 83167 - DNA, 25 bp, E. coli
tcagcggtaggtaatcagccgaccc

SEQ ID NO: 83168 - DNA, 25 bp, E. coli
tcagcggtaggttatcagccgaccc

SEQ ID NO: 83169 - DNA, 25 bp, E. coli
attgctggaccgcaagcaaggtaag

SEQ ID NO: 83170 - DNA, 25 bp, E. coli
attgctggaccggaagcaaggtaag

SEQ ID NO: 83171 - DNA, 25 bp, E. coli
agcatgggcggccaaaattattgat

SEQ ID NO: 83172 - DNA, 25 bp, E. coli
agcatgggcggcgaaaattattgat

SEQ ID NO: 83173 - DNA, 25 bp, E. coli
ttgatgaggcctcgcgatgtgaaca

SEQ ID NO: 83174 - DNA, 25 bp, E. coli
ttgatgaggcctggcgatgtgaaca

SEQ ID NO: 83175 - DNA, 25 bp, E. coli
cctggctcgacataactgttccggg

SEQ ID NO: 83176 - DNA, 25 bp, E. coli
cctggctcgacaaaactgttccggg

SEQ ID NO: 83177 - DNA, 25 bp, E. coli
gcggcgaaaatttttgatgaggcct

SEQ ID NO: 83178 - DNA, 25 bp, E. coli
gctattgctggagcgcaagcaaggt

SEQ ID NO: 83179 - DNA, 25 bp, E. coli
gcattgctgcgtcaaagcgggctat

SEQ ID NO: 83180 - DNA, 25 bp, E. coli
gctattgctggaccgcaagcaaggt

SEQ ID NO: 83181 - DNA, 25 bp, E. coli
gcggcgaaaattattgatgaggcct

SEQ ID NO: 83182 - DNA, 25 bp, E. coli
gcattgctgcgtgaaagcgggctat

SEQ ID NO: 83183 - DNA, 25 bp, E. coli
gaaagcgggctaatgctggaccgca

SEQ ID NO: 83184 - DNA, 25 bp, E. coli
gaaagcgggctattgctggaccgca

SEQ ID NO: 83185 - DNA, 25 bp, E. coli
cgccacctggcattgctgcgtgaaa

SEQ ID NO: 83186 - DNA, 25 bp, E. coli
cgcaacctggctcgacaaaactgtt

SEQ ID NO: 83187 - DNA, 25 bp, E. coli
cgcaacctggctggacaaaactgtt

SEQ ID NO: 83188 - DNA, 25 bp, E. coli
cgccacctggcaatgctgcgtgaaa

SEQ ID NO: 83189 - DNA, 25 bp, E. coli
gggacagtaagatcatttgcagtta

SEQ ID NO: 83190 - DNA, 25 bp, E. coli
gggacagtaagaacatttgcagtta

SEQ ID NO: 83191 - DNA, 25 bp, E. coli
catcaatgaatctggcagccgtgga

SEQ ID NO: 83192 - DNA, 25 bp, E. coli
catcaatgaatcaggcagccgtgga

SEQ ID NO: 83193 - DNA, 25 bp, E. coli
taaaactgacctagcaccatacgtg

SEQ ID NO: 83194 - DNA, 25 bp, E. coli
tactttacgtatgcgcggagaacgc

SEQ ID NO: 83195 - DNA, 25 bp, E. coli
tactttacgtatccgcggagaacgc

SEQ ID NO: 83196 - DNA, 25 bp, E. coli
taaaactgaccttgcaccatacgtg

SEQ ID NO: 83197 - DNA, 25 bp, E. coli
tgaaggtctgcaaaacatcatcgcc

SEQ ID NO: 83198 - DNA, 25 bp, E. coli
tgaacataatcatgcaaccgctgcg

SEQ ID NO: 83199 - DNA, 25 bp, E. coli
tgaacataatcaagcaaccgctgcg

SEQ ID NO: 83200 - DNA, 25 bp, E. coli
tgaaggtctgcataacatcatcgcc

SEQ ID NO: 83201 - DNA, 25 bp, E. coli
tctttgtggaaaccggcggcgacaa

SEQ ID NO: 83202 - DNA, 25 bp, E. coli
tcatacagccatacgtgaagacgca

SEQ ID NO: 83203 - DNA, 25 bp, E. coli
tcatacagccattcgtgaagacgca

SEQ ID NO: 83204 - DNA, 25 bp, E. coli
tctttgtggaaagcggcggcgacaa

SEQ ID NO: 83205 - DNA, 25 bp, E. coli
cctttatcgaagtgcagggcatgct

SEQ ID NO: 83206 - DNA, 25 bp, E. coli
cctttatcgaagagcagggcatgct

SEQ ID NO: 83207 - DNA, 25 bp, E. coli
gctcaggtaaaagcgcgcttctgga

SEQ ID NO: 83208 - DNA, 25 bp, E. coli
gctcaggtaaaaccgcgcttctgga

SEQ ID NO: 83209 - DNA, 25 bp, E. coli
gaagatcaacgcattctcactgagg

SEQ ID NO: 83210 - DNA, 25 bp, E. coli
gaagatcaacgctttctcactgagg

SEQ ID NO: 83211 - DNA, 25 bp, E. coli
gaagccctctgcaaatccatgcgtg

SEQ ID NO: 83212 - DNA, 25 bp, E. coli
gaagccctctgctaatccatgcgtg

SEQ ID NO: 83213 - DNA, 25 bp, E. coli
taaagatgtcgcgaaaagtcgcctg

SEQ ID NO: 83214 - DNA, 25 bp, E. coli
taaagatgtcgccaaaagtcgcctg

SEQ ID NO: 83215 - DNA, 25 bp, E. coli
agccgtggccgatccgctggtttga

SEQ ID NO: 83216 - DNA, 25 bp, E. coli
agccgtggccgaaccgctggtttga

SEQ ID NO: 83217 - DNA, 25 bp, E. coli
tatcggtcatcactggccgctgggt

SEQ ID NO: 83218 - DNA, 25 bp, E. coli
tatcggtcatcagtggccgctgggt

SEQ ID NO: 83219 - DNA, 25 bp, E. coli
tttgccacgccaaaaagatgtcgcg

SEQ ID NO: 83220 - DNA, 25 bp, E. coli
ttctggatatgtggaagccgtggcc

SEQ ID NO: 83221 - DNA, 25 bp, E. coli
tttgccacgccataaagatgtcgcg

SEQ ID NO: 83222 - DNA, 25 bp, E. coli
ttctggatatgtcgaagccgtggcc

SEQ ID NO: 83223 - DNA, 25 bp, E. coli
tgccgaccaatgactggcagtgggt

SEQ ID NO: 83224 - DNA, 25 bp, E. coli
tgccgaccaatgtctggcagtgggt

SEQ ID NO: 83225 - DNA, 25 bp, E. coli
tcggattcggaactggattaagccc

SEQ ID NO: 83226 - DNA, 25 bp, E. coli
tcggattcggaagtggattaagccc

SEQ ID NO: 83227 - DNA, 25 bp, E. coli
cgatccgctggtttgatcgcaatgt

SEQ ID NO: 83228 - DNA, 25 bp, E. coli
cgatccgctggtatgatcgcaatgt

SEQ ID NO: 83229 - DNA, 25 bp, E. coli
ctttgtcatcaatcggcgaaagaca

SEQ ID NO: 83230 - DNA, 25 bp, E. coli
ctttgtcatcaaacggcgaaagaca

SEQ ID NO: 83231 - DNA, 25 bp, E. coli
gtatcggcgtctttctttgtcatca

SEQ ID NO: 83232 - DNA, 25 bp, E. coli
gtatcggcgtctatctttgtcatca

SEQ ID NO: 83233 - DNA, 25 bp, E. coli
tggcgctgccgaccaatgactggca

SEQ ID NO: 83234 - DNA, 25 bp, E. coli
tggcgctgccgagcaatgactggca

SEQ ID NO: 83235 - DNA, 25 bp, E. coli
aatgcaagacccgaatccgcaggtc

SEQ ID NO: 83236 - DNA, 25 bp, E. coli
aatgcaagaccccaatccgcaggtc

SEQ ID NO: 83237 - DNA, 25 bp, E. coli
catggccggcgataaagccaaaggc

SEQ ID NO: 83238 - DNA, 25 bp, E. coli
catggccggcgaaaaagccaaaggc

SEQ ID NO: 83239 - DNA, 25 bp, E. coli
aggttaccatcatcgcgcgggtgag

SEQ ID NO: 83240 - DNA, 25 bp, E. coli
agccgcatgccgtggtacacgcgtt

SEQ ID NO: 83241 - DNA, 25 bp, E. coli
agccgcatgccgaggtacacgcgtt

SEQ ID NO: 83242 - DNA, 25 bp, E. coli
aggttaccatcaacgcgcgggtgag

SEQ ID NO: 83243 - DNA, 25 bp, E. coli
tgatgcattaatagctgcgggcgtg

SEQ ID NO: 83244 - DNA, 25 bp, E. coli
tgatgcattaattgctgcgggcgtg

SEQ ID NO: 83245 - DNA, 25 bp, E. coli
ccaatccgcaggtcgctggacgtgg

SEQ ID NO: 83246 - DNA, 25 bp, E. coli
ccaatccgcaggacgctggacgtgg

SEQ ID NO: 83247 - DNA, 25 bp, E. coli
gaaaaagccaaaggcgcaacggcgt

SEQ ID NO: 83248 - DNA, 25 bp, E. coli
gaaaaagccaaacgcgcaacggcgt

SEQ ID NO: 83249 - DNA, 25 bp, E. coli
cgcgtggttgctccaatgcaagacc

SEQ ID NO: 83250 - DNA, 25 bp, E. coli
cgaggtacacgccttgcgcatggcc

SEQ ID NO: 83251 - DNA, 25 bp, E. coli
cgcaacggcgtaagtcacactcgaa

SEQ ID NO: 83252 - DNA, 25 bp, E. coli
cgcaacggcgtatgtcacactcgaa

SEQ ID NO: 83253 - DNA, 25 bp, E. coli
cgaggtacacgcgttgcgcatggcc

SEQ ID NO: 83254 - DNA, 25 bp, E. coli
cgcgtggttgctgcaatgcaagacc

SEQ ID NO: 83255 - DNA, 25 bp, E. coli
cgtacgccaccgagttgtgatgcat

SEQ ID NO: 83256 - DNA, 25 bp, E. coli
cgtacgccaccgtgttgtgatgcat

SEQ ID NO: 83257 - DNA, 25 bp, E. coli
caaatacatcctccctggtatcggc

SEQ ID NO: 83258 - DNA, 25 bp, E. coli
caaagcaatatggaagggcaaaacg

SEQ ID NO: 83259 - DNA, 25 bp, E. coli
caaatacatcctgcctggtatcggc

SEQ ID NO: 83260 - DNA, 25 bp, E. coli
caaagcaatatgcaagggcaaaacg

SEQ ID NO: 83261 - DNA, 25 bp, E. coli
catcctgcctggaatcggcattgtg

SEQ ID NO: 83262 - DNA, 25 bp, E. coli
catcctgcctggtatcggcattgtg

SEQ ID NO: 83263 - DNA, 25 bp, E. coli
agcaatatggaacggcaaaacggca

SEQ ID NO: 83264 - DNA, 25 bp, E. coli
agcaatatggaagggcaaaacggca

SEQ ID NO: 83265 - DNA, 25 bp, E. coli
tttcgcccttttactcgcctctgtg

SEQ ID NO: 83266 - DNA, 25 bp, E. coli
tttcgccctttttctcgcctctgtg

SEQ ID NO: 83267 - DNA, 25 bp, E. coli
tggtgtcagcaaatacatcctgcct

SEQ ID NO: 83268 - DNA, 25 bp, E. coli
tgtcagaactacactctttcgccct

SEQ ID NO: 83269 - DNA, 25 bp, E. coli
tgtcagcaaatacatcctgcctggt

SEQ ID NO: 83270 - DNA, 25 bp, E. coli
tgtcagaactactctctttcgccct

SEQ ID NO: 83271 - DNA, 25 bp, E. coli
tgttgacaaagctatatggaagggc

SEQ ID NO: 83272 - DNA, 25 bp, E. coli
tgtcagcaaatagatcctgcctggt

SEQ ID NO: 83273 - DNA, 25 bp, E. coli
tgttgacaaagcaatatggaagggc

SEQ ID NO: 83274 - DNA, 25 bp, E. coli
tggtgtcagcaattacatcctgcct

SEQ ID NO: 83275 - DNA, 25 bp, E. coli
tgctggtgtcagcaaatacatcctg

SEQ ID NO: 83276 - DNA, 25 bp, E. coli
tgctggtgtcaggaaatacatcctg

SEQ ID NO: 83277 - DNA, 25 bp, E. coli
tctcgcctctgtgctgatttacgca

SEQ ID NO: 83278 - DNA, 25 bp, E. coli
tctcgcctctgtcctgatttacgca

SEQ ID NO: 83279 - DNA, 25 bp, E. coli
aatgttcccgtttgtgatgccgtcc

SEQ ID NO: 83280 - DNA, 25 bp, E. coli
aatgttcccgttagtgatgccgtcc

SEQ ID NO: 83281 - DNA, 25 bp, E. coli
caatgtgggatgcaacttccagcca

SEQ ID NO: 83282 - DNA, 25 bp, E. coli
caatgtgggatggaacttccagcca

SEQ ID NO: 83283 - DNA, 25 bp, E. coli
caagattgaagatacccgctggcgt

SEQ ID NO: 83284 - DNA, 25 bp, E. coli
caagattgaagaaacccgctggcgt

SEQ ID NO: 83285 - DNA, 25 bp, E. coli
caccatgatgaaggcaagtctgaca

SEQ ID NO: 83286 - DNA, 25 bp, E. coli
caccatgatgaacgcaagtctgaca

SEQ ID NO: 83287 - DNA, 25 bp, E. coli
acgccaattctgtgggctattccgg

SEQ ID NO: 83288 - DNA, 25 bp, E. coli
acgccaattctgagggctattccgg

SEQ ID NO: 83289 - DNA, 25 bp, E. coli
tgcaaatgcgtagcgtgggcgaact

SEQ ID NO: 83290 - DNA, 25 bp, E. coli
tgcaaatgcgtaccgtgggcgaact

SEQ ID NO: 83291 - DNA, 25 bp, E. coli
gaatatctgcgtctgtactacaccg

SEQ ID NO: 83292 - DNA, 25 bp, E. coli
gaatatctgcgtgtgtactacaccg

SEQ ID NO: 83293 - DNA, 25 bp, E. coli
gactgcacgtatggataaagccgcg

SEQ ID NO: 83294 - DNA, 25 bp, E. coli
gtaaccaggtttggctgatcaccgc

SEQ ID NO: 83295 - DNA, 25 bp, E. coli
gtaaccaggtttcgctgatcaccgc

SEQ ID NO: 83296 - DNA, 25 bp, E. coli
ggcgcatggctgcttaacttcaaca

SEQ ID NO: 83297 - DNA, 25 bp, E. coli
ggcgcatggctggttaacttcaaca

SEQ ID NO: 83298 - DNA, 25 bp, E. coli
gactgcacgtatcgataaagccgcg

SEQ ID NO: 83299 - DNA, 25 bp, E. coli
gatgatcattacacagggcgcaacc

SEQ ID NO: 83300 - DNA, 25 bp, E. coli
gatgatcattactcagggcgcaacc

SEQ ID NO: 83301 - DNA, 25 bp, E. coli
cacggcgtttaatgtcaaggtgacc

SEQ ID NO: 83302 - DNA, 25 bp, E. coli
cacggcgtttaaagtcaaggtgacc

SEQ ID NO: 83303 - DNA, 25 bp, E. coli
tgatttcaccgcgacaatgacggta

SEQ ID NO: 83304 - DNA, 25 bp, E. coli
tgatattgttcaccggaacggcccc

SEQ ID NO: 83305 - DNA, 25 bp, E. coli
tgatattgttcagcggaacggcccc

SEQ ID NO: 83306 - DNA, 25 bp, E. coli
tgatttcaccgccacaatgacggta

SEQ ID NO: 83307 - DNA, 25 bp, E. coli
tgaagaataaccctgcgtgggcgct

SEQ ID NO: 83308 - DNA, 25 bp, E. coli
tgaagaataaccgtgcgtgggcgct

SEQ ID NO: 83309 - DNA, 25 bp, E. coli
tcatcttctgcaacgggtgttggga

SEQ ID NO: 83310 - DNA, 25 bp, E. coli
tcatcttctgcatcgggtgttggga

SEQ ID NO: 83311 - DNA, 25 bp, E. coli
ccttgatgggaacagaagataccga

SEQ ID NO: 83312 - DNA, 25 bp, E. coli
ccttgatgggaagagaagataccga

SEQ ID NO: 83313 - DNA, 25 bp, E. coli
gaaagattgcaatagcaccacggcg

SEQ ID NO: 83314 - DNA, 25 bp, E. coli
gaaagattgcaaaagcaccacggcg

SEQ ID NO: 83315 - DNA, 25 bp, E. coli
cctggttacagaccgtaaatggacg

SEQ ID NO: 83316 - DNA, 25 bp, E. coli
cctggttacagagcgtaaatggacg

SEQ ID NO: 83317 - DNA, 25 bp, E. coli
gataccgacttaccaggatttctgt

SEQ ID NO: 83318 - DNA, 25 bp, E. coli
gatttaatgcaaggtggtcagtcag

SEQ ID NO: 83319 - DNA, 25 bp, E. coli
gatttaatgcaacgtggtcagtcag

SEQ ID NO: 83320 - DNA, 25 bp, E. coli
gataccgacttagcaggatttctgt

SEQ ID NO: 83321 - DNA, 25 bp, E. coli
ggtcagtcagatcgcgtaccgttag

SEQ ID NO: 83322 - DNA, 25 bp, E. coli
ggtcagtcagatggcgtaccgttag

SEQ ID NO: 83323 - DNA, 25 bp, E. coli
aagctgggccgcagttcccgatggc

SEQ ID NO: 83324 - DNA, 25 bp, E. coli
caacgccggttgagattaacaacat

SEQ ID NO: 83325 - DNA, 25 bp, E. coli
aagctgggccgctgttcccgatggc

SEQ ID NO: 83326 - DNA, 25 bp, E. coli
caacgccggttgtgattaacaacat

SEQ ID NO: 83327 - DNA, 25 bp, E. coli
agctgggccgcagttcccgatggct

SEQ ID NO: 83328 - DNA, 25 bp, E. coli
agctgggccgcacttcccgatggct

SEQ ID NO: 83329 - DNA, 25 bp, E. coli
aacgccggttgacattaacaacatc

SEQ ID NO: 83330 - DNA, 25 bp, E. coli
aacgccggttgagattaacaacatc

SEQ ID NO: 83331 - DNA, 25 bp, E. coli
tttccggcccccatcaagctgggcc

SEQ ID NO: 83332 - DNA, 25 bp, E. coli
tttccggcccccttcaagctgggcc

SEQ ID NO: 83333 - DNA, 25 bp, E. coli
ttgttttcatcaccaacgccggttg

SEQ ID NO: 83334 - DNA, 25 bp, E. coli
ttgttttcatcagcaacgccggttg

SEQ ID NO: 83335 - DNA, 25 bp, E. coli
tgttttcatcaccaacgccggttga

SEQ ID NO: 83336 - DNA, 25 bp, E. coli
tgttttcatcacgaacgccggttga

SEQ ID NO: 83337 - DNA, 25 bp, E. coli
ccggttgagattaacaacatccgga

SEQ ID NO: 83338 - DNA, 25 bp, E. coli
ccaacgccggttgagattaacaaca

SEQ ID NO: 83339 - DNA, 25 bp, E. coli
ccaacgccggttcagattaacaaca

SEQ ID NO: 83340 - DNA, 25 bp, E. coli
ccggttgagatttacaacatccgga

SEQ ID NO: 83341 - DNA, 25 bp, E. coli
cgccggttgagaataacaacatccg

SEQ ID NO: 83342 - DNA, 25 bp, E. coli
cgccggttgagattaacaacatccg

SEQ ID NO: 83343 - DNA, 25 bp, E. coli
ctgggccgcagttcccgatggctga

SEQ ID NO: 83344 - DNA, 25 bp, E. coli
ctgggccgcagtacccgatggctga

SEQ ID NO: 83345 - DNA, 25 bp, E. coli
aaggctatatcagcacgcgggagga

SEQ ID NO: 83346 - DNA, 25 bp, E. coli
aaggctatatcaccacgcgggagga

SEQ ID NO: 83347 - DNA, 25 bp, E. coli
taaagcatattaaggcaggcgatcg

SEQ ID NO: 83348 - DNA, 25 bp, E. coli
taaagcatattatggcaggcgatcg

SEQ ID NO: 83349 - DNA, 25 bp, E. coli
agttttggcaacacatcaggtgcgg

SEQ ID NO: 83350 - DNA, 25 bp, E. coli
agttttggcaactcatcaggtgcgg

SEQ ID NO: 83351 - DNA, 25 bp, E. coli
tgtcgccgagcagcagaaatatccg

SEQ ID NO: 83352 - DNA, 25 bp, E. coli
tgtcgccgagcaccagaaatatccg

SEQ ID NO: 83353 - DNA, 25 bp, E. coli
tgaatttcacaagcacggtggcccg

SEQ ID NO: 83354 - DNA, 25 bp, E. coli
tgaatttcacaaccacggtggcccg

SEQ ID NO: 83355 - DNA, 25 bp, E. coli
tccggcggagaaagaaatccaggtc

SEQ ID NO: 83356 - DNA, 25 bp, E. coli
tccggcggagaatgaaatccaggtc

SEQ ID NO: 83357 - DNA, 25 bp, E. coli
gcaggcatcgtgagtaaagtcggca

SEQ ID NO: 83358 - DNA, 25 bp, E. coli
gcgcgaaacttaacggcaccgtagg

SEQ ID NO: 83359 - DNA, 25 bp, E. coli
gcaggcatcgtgtgtaaagtcggca

SEQ ID NO: 83360 - DNA, 25 bp, E. coli
gcgcgaaacttatcggcaccgtagg

SEQ ID NO: 83361 - DNA, 25 bp, E. coli
gataaagcggcgattctgcctgcgg

SEQ ID NO: 83362 - DNA, 25 bp, E. coli
gtagagttcactcctgccgatccgg

SEQ ID NO: 83363 - DNA, 25 bp, E. coli
gataaagcggcgtttctgcctgcgg

SEQ ID NO: 83364 - DNA, 25 bp, E. coli
gtagagttcactgctgccgatccgg

SEQ ID NO: 83365 - DNA, 25 bp, E. coli
taacggtttattttctgctgcgcaa

SEQ ID NO: 83366 - DNA, 25 bp, E. coli
taacggtttattatctgctgcgcaa

SEQ ID NO: 83367 - DNA, 25 bp, E. coli
cacaaatggcgacatatgagcataa

SEQ ID NO: 83368 - DNA, 25 bp, E. coli
cacaaatggcgagatatgagcataa

SEQ ID NO: 83369 - DNA, 25 bp, E. coli
taaatagctacagaaatgcattggc

SEQ ID NO: 83370 - DNA, 25 bp, E. coli
taaatagctacacaaatgcattggc

SEQ ID NO: 83371 - DNA, 25 bp, E. coli
tgcgacattatcgagtgcttcatca

SEQ ID NO: 83372 - DNA, 25 bp, E. coli
tgcacttactcaaacacaaatggcg

SEQ ID NO: 83373 - DNA, 25 bp, E. coli
tgcacttactcatacacaaatggcg

SEQ ID NO: 83374 - DNA, 25 bp, E. coli
tgcgacattatccagtgcttcatca

SEQ ID NO: 83375 - DNA, 25 bp, E. coli
gcttcatcatcgacacgcgggagtg

SEQ ID NO: 83376 - DNA, 25 bp, E. coli
gcttcatcatcgtcacgcgggagtg

SEQ ID NO: 83377 - DNA, 25 bp, E. coli
gacacctgcggcgagtaatgcaaaa

SEQ ID NO: 83378 - DNA, 25 bp, E. coli
gacacctgcggccagtaatgcaaaa

SEQ ID NO: 83379 - DNA, 25 bp, E. coli
cgataaccacaacctgcaaaccgga

SEQ ID NO: 83380 - DNA, 25 bp, E. coli
cgataaccacaagctgcaaaccgga

SEQ ID NO: 83381 - DNA, 25 bp, E. coli
cattggcacaaaatgcaggtgtcta

SEQ ID NO: 83382 - DNA, 25 bp, E. coli
cattggcacaaattgcaggtgtcta

SEQ ID NO: 83383 - DNA, 25 bp, E. coli
gggagtgccgcagtacaatttctac

SEQ ID NO: 83384 - DNA, 25 bp, E. coli
gggagtgccgcactacaatttctac

SEQ ID NO: 83385 - DNA, 25 bp, E. coli
tcaaacatcacggaaaatgcaggtg

SEQ ID NO: 83386 - DNA, 25 bp, E. coli
tcaaacatcacgcaaaatgcaggtg

SEQ ID NO: 83387 - DNA, 25 bp, E. coli
gatggttatgccagtgagctatgcg

SEQ ID NO: 83388 - DNA, 25 bp, E. coli
gatggttatgcctgtgagctatgcg

SEQ ID NO: 83389 - DNA, 25 bp, E. coli
aaccggcgagcgactatgtgcaaca

SEQ ID NO: 83390 - DNA, 25 bp, E. coli
catttgcgtcaaaagcagactggcg

SEQ ID NO: 83391 - DNA, 25 bp, E. coli
cagactggatgaataacggcggcgt

SEQ ID NO: 83392 - DNA, 25 bp, E. coli
cagactggatgattaacggcggcgt

SEQ ID NO: 83393 - DNA, 25 bp, E. coli
aaccggcgagcgtctatgtgcaaca

SEQ ID NO: 83394 - DNA, 25 bp, E. coli
tgtgtagttgtaaaagcacgcctcc

SEQ ID NO: 83395 - DNA, 25 bp, E. coli
tgtgtagttgtataagcacgcctcc

SEQ ID NO: 83396 - DNA, 25 bp, E. coli
tgaaaatccgggatacgatccgctg

SEQ ID NO: 83397 - DNA, 25 bp, E. coli
tgaaaatccgggttacgatccgctg

SEQ ID NO: 83398 - DNA, 25 bp, E. coli
tgcaatttatgctcgacgaagccca

SEQ ID NO: 83399 - DNA, 25 bp, E. coli
tgcaatttatgcacgacgaagccca

SEQ ID NO: 83400 - DNA, 25 bp, E. coli
ccttcaaagatagagccagactgga

SEQ ID NO: 83401 - DNA, 25 bp, E. coli
ccttcaaagatacagccagactgga

SEQ ID NO: 83402 - DNA, 25 bp, E. coli
ccacaagcgtgggatgaaagtacac

SEQ ID NO: 83403 - DNA, 25 bp, E. coli
ccacaagcgtggcatgaaagtacac

SEQ ID NO: 83404 - DNA, 25 bp, E. coli
gcggcagcctatgacgaatcctacg

SEQ ID NO: 83405 - DNA, 25 bp, E. coli
gcggcagcctatcacgaatcctacg

SEQ ID NO: 83406 - DNA, 25 bp, E. coli
catttgcgtcaatagcagactggcg

SEQ ID NO: 83407 - DNA, 25 bp, E. coli
tggtttaaccccaatcgcgtatcgg

SEQ ID NO: 83408 - DNA, 25 bp, E. coli
ggcggcgcaacaatactcagcagtt

SEQ ID NO: 83409 - DNA, 25 bp, E. coli
ggcggcgcaacattactcagcagtt

SEQ ID NO: 83410 - DNA, 25 bp, E. coli
tggtttaacccctatcgcgtatcgg

SEQ ID NO: 83411 - DNA, 25 bp, E. coli
tacatcgtggtctatggcctgcgca

SEQ ID NO: 83412 - DNA, 25 bp, E. coli
tacatcgtggtcaatggcctgcgca

SEQ ID NO: 83413 - DNA, 25 bp, E. coli
aaagaggtcattcgatcaacaccgg

SEQ ID NO: 83414 - DNA, 25 bp, E. coli
aaagaggtcattggatcaacaccgg

SEQ ID NO: 83415 - DNA, 25 bp, E. coli
tacctgtctggcgtgctgaatctgc

SEQ ID NO: 83416 - DNA, 25 bp, E. coli
tacctgtctggcctgctgaatctgc

SEQ ID NO: 83417 - DNA, 25 bp, E. coli
tgctgtttgtcactctggccgcgct

SEQ ID NO: 83418 - DNA, 25 bp, E. coli
tgctgtttgtcagtctggccgcgct

SEQ ID NO: 83419 - DNA, 25 bp, E. coli
gcgcaatgcaggcttcacggagtac

SEQ ID NO: 83420 - DNA, 25 bp, E. coli
gcgcaatgcagggttcacggagtac

SEQ ID NO: 83421 - DNA, 25 bp, E. coli
gacggcatttctctcatcagtgatg

SEQ ID NO: 83422 - DNA, 25 bp, E. coli
gacggcatttctgtcatcagtgatg

SEQ ID NO: 83423 - DNA, 25 bp, E. coli
cgactggcgtcgacaaagaggcaat

SEQ ID NO: 83424 - DNA, 25 bp, E. coli
cgactggcgtcgtcaaagaggcaat

SEQ ID NO: 83425 - DNA, 25 bp, E. coli
cattgtcatgacagtgccggtgctg

SEQ ID NO: 83426 - DNA, 25 bp, E. coli
cattgtcatgactgtgccggtgctg

SEQ ID NO: 83427 - DNA, 25 bp, E. coli
gatcgttattttgtcactgggcatg

SEQ ID NO: 83428 - DNA, 25 bp, E. coli
ggctgcatgtgcttgcccagaaaaa

SEQ ID NO: 83429 - DNA, 25 bp, E. coli
ggctgcatgtgcatgcccagaaaaa

SEQ ID NO: 83430 - DNA, 25 bp, E. coli
tcaacaccggaatagtcctgcgcgg

SEQ ID NO: 83431 - DNA, 25 bp, E. coli
tcaacaccggaaaagtcctgcgcgg

SEQ ID NO: 83432 - DNA, 25 bp, E. coli
gatcgttattttctcactgggcatg

SEQ ID NO: 83433 - DNA, 25 bp, E. coli
caaagaatcatttgtccagatgggc

SEQ ID NO: 83434 - DNA, 25 bp, E. coli
caaagaatcattagtccagatgggc

SEQ ID NO: 83435 - DNA, 25 bp, E. coli
catcagcgggcaatggagcggaaaa

SEQ ID NO: 83436 - DNA, 25 bp, E. coli
catcagcgggcattggagcggaaaa

SEQ ID NO: 83437 - DNA, 25 bp, E. coli
caggtacgggatttggtagatgcac

SEQ ID NO: 83438 - DNA, 25 bp, E. coli
caggtacgggatatggtagatgcac

SEQ ID NO: 83439 - DNA, 25 bp, E. coli
tcagagctgcttcaacatgacacgt

SEQ ID NO: 83440 - DNA, 25 bp, E. coli
tcagagctgcttgaacatgacacgt

SEQ ID NO: 83441 - DNA, 25 bp, E. coli
gctggcttatggtgatgggcacaaa

SEQ ID NO: 83442 - DNA, 25 bp, E. coli
gctggcttatggagatgggcacaaa

SEQ ID NO: 83443 - DNA, 25 bp, E. coli
ggtatgggcccaacctcgtcatgat

SEQ ID NO: 83444 - DNA, 25 bp, E. coli
gggaagaacttcacgcgagctatta

SEQ ID NO: 83445 - DNA, 25 bp, E. coli
gggaagaacttctcgcgagctatta

SEQ ID NO: 83446 - DNA, 25 bp, E. coli
ggtggtacagctacccggcaatgct

SEQ ID NO: 83447 - DNA, 25 bp, E. coli
ggaaaatacaggtgacggaactcga

SEQ ID NO: 83448 - DNA, 25 bp, E. coli
ggtatgggcccatcctcgtcatgat

SEQ ID NO: 83449 - DNA, 25 bp, E. coli
ggaaaatacaggagacggaactcga

SEQ ID NO: 83450 - DNA, 25 bp, E. coli
ggtggtacagcttcccggcaatgct

SEQ ID NO: 83451 - DNA, 25 bp, E. coli
taatttcaaccctgtgatgacgccg

SEQ ID NO: 83452 - DNA, 25 bp, E. coli
tcaataaagttcgttgggtggcgct

SEQ ID NO: 83453 - DNA, 25 bp, E. coli
taatttcaacccagtgatgacgccg

SEQ ID NO: 83454 - DNA, 25 bp, E. coli
tcaataaagttccttgggtggcgct

SEQ ID NO: 83455 - DNA, 25 bp, E. coli
caactggccaatattctggacggag

SEQ ID NO: 83456 - DNA, 25 bp, E. coli
caactattgtctcttcagtcggcag

SEQ ID NO: 83457 - DNA, 25 bp, E. coli
caactggccaattttctggacggag

SEQ ID NO: 83458 - DNA, 25 bp, E. coli
caactattgtctgttcagtcggcag

SEQ ID NO: 83459 - DNA, 25 bp, E. coli
tgatcccgcaggtaaagaagctcgg

SEQ ID NO: 83460 - DNA, 25 bp, E. coli
tgatcccgcaggaaaagaagctcgg

SEQ ID NO: 83461 - DNA, 25 bp, E. coli
tgcctaaaatgacggatgatcccgc

SEQ ID NO: 83462 - DNA, 25 bp, E. coli
tgcctaaaatgagggatgatcccgc

SEQ ID NO: 83463 - DNA, 25 bp, E. coli
cctgagactgcacaggaactcctga

SEQ ID NO: 83464 - DNA, 25 bp, E. coli
cctgagactgcagaggaactcctga

SEQ ID NO: 83465 - DNA, 25 bp, E. coli
gcgcttaaggctgcaactacccatg

SEQ ID NO: 83466 - DNA, 25 bp, E. coli
gcgcttaaggctccaactacccatg

SEQ ID NO: 83467 - DNA, 25 bp, E. coli
gcaaagttatttggccaggcgctgt

SEQ ID NO: 83468 - DNA, 25 bp, E. coli
gcaaagttatttcgccaggcgctgt

SEQ ID NO: 83469 - DNA, 25 bp, E. coli
gacaaaacgttactcctgaaggcga

SEQ ID NO: 83470 - DNA, 25 bp, E. coli
gacaaaacgttagtcctgaaggcga

SEQ ID NO: 83471 - DNA, 25 bp, E. coli
gaaaatgtccgggtaaacgctgaag

SEQ ID NO: 83472 - DNA, 25 bp, E. coli
gaactcctgaacaatgcactggtga

SEQ ID NO: 83473 - DNA, 25 bp, E. coli
gaactcctgaactatgcactggtga

SEQ ID NO: 83474 - DNA, 25 bp, E. coli
gaaaatgtccggctaaacgctgaag

SEQ ID NO: 83475 - DNA, 25 bp, E. coli
ccgacaaagttaaggaggcgcttaa

SEQ ID NO: 83476 - DNA, 25 bp, E. coli
ccgacaaagttatggaggcgcttaa

SEQ ID NO: 83477 - DNA, 25 bp, E. coli
caaaacgacgacatggatcactgga

SEQ ID NO: 83478 - DNA, 25 bp, E. coli
cacagtcctgcgatgttgcgggcaa

SEQ ID NO: 83479 - DNA, 25 bp, E. coli
cacagtcctgcgttgttgcgggcaa

SEQ ID NO: 83480 - DNA, 25 bp, E. coli
caaaacgacgacttggatcactgga

SEQ ID NO: 83481 - DNA, 25 bp, E. coli
cattagtacaaataacccgaggtgg

SEQ ID NO: 83482 - DNA, 25 bp, E. coli
cattagtacaaaaaacccgaggtgg

SEQ ID NO: 83483 - DNA, 25 bp, E. coli
tacatgaagggctaacggtagccat

SEQ ID NO: 83484 - DNA, 25 bp, E. coli
tacatgaagggcaaacggtagccat

SEQ ID NO: 83485 - DNA, 25 bp, E. coli
taaaacccaggctgcaaaagtccag

SEQ ID NO: 83486 - DNA, 25 bp, E. coli
tacctgtctggacgtcactcgtgca

SEQ ID NO: 83487 - DNA, 25 bp, E. coli
tacctgtctggaggtcactcgtgca

SEQ ID NO: 83488 - DNA, 25 bp, E. coli
tccggccaaagctgacgaaaaggtt

SEQ ID NO: 83489 - DNA, 25 bp, E. coli
tccggccaaagcagacgaaaaggtt

SEQ ID NO: 83490 - DNA, 25 bp, E. coli
tcagctttgaagtgtccggtcatcc

SEQ ID NO: 83491 - DNA, 25 bp, E. coli
tcagctttgaagagtccggtcatcc

SEQ ID NO: 83492 - DNA, 25 bp, E. coli
gcaatgtgtcccttatccggccaaa

SEQ ID NO: 83493 - DNA, 25 bp, E. coli
gcaatgtgtcccatatccggccaaa

SEQ ID NO: 83494 - DNA, 25 bp, E. coli
cattaatccgtcaaaaccgtgcggt

SEQ ID NO: 83495 - DNA, 25 bp, E. coli
cattaatccgtctaaaccgtgcggt

SEQ ID NO: 83496 - DNA, 25 bp, E. coli
taataccgcagtgtcatggctggcg

SEQ ID NO: 83497 - DNA, 25 bp, E. coli
taaaacccaggcagcaaaagtccag

SEQ ID NO: 83498 - DNA, 25 bp, E. coli
taataccgcagtctcatggctggcg

SEQ ID NO: 83499 - DNA, 25 bp, E. coli
cggtagtccgatcaacgtgctggaa

SEQ ID NO: 83500 - DNA, 25 bp, E. coli
cggtagtccgatgaacgtgctggaa

SEQ ID NO: 83501 - DNA, 25 bp, E. coli
tatgtgaaagcgaatctgacgtggc

SEQ ID NO: 83502 - DNA, 25 bp, E. coli
tatgtgaaagcgtatctgacgtggc

SEQ ID NO: 83503 - DNA, 25 bp, E. coli
tttacccgtggaacaggagtgaccg

SEQ ID NO: 83504 - DNA, 25 bp, E. coli
tttacccgtggatcaggagtgaccg

SEQ ID NO: 83505 - DNA, 25 bp, E. coli
tgggcaggagcctattaccattccg

SEQ ID NO: 83506 - DNA, 25 bp, E. coli
tcatgactttggtggcttcccgcag

SEQ ID NO: 83507 - DNA, 25 bp, E. coli
tcatgactttggaggcttcccgcag

SEQ ID NO: 83508 - DNA, 25 bp, E. coli
ccagcattgtttataggtcacggta

SEQ ID NO: 83509 - DNA, 25 bp, E. coli
ccagcattgtttttaggtcacggta

SEQ ID NO: 83510 - DNA, 25 bp, E. coli
cgcaggcgctgtacgatacgcatta

SEQ ID NO: 83511 - DNA, 25 bp, E. coli
cgttatcgaacccaacgccagagca

SEQ ID NO: 83512 - DNA, 25 bp, E. coli
cgcaggcgctgttcgatacgcatta

SEQ ID NO: 83513 - DNA, 25 bp, E. coli
cgttatcgaaccgaacgccagagca

SEQ ID NO: 83514 - DNA, 25 bp, E. coli
gtatcgacagtagcaaacctgccgc

SEQ ID NO: 83515 - DNA, 25 bp, E. coli
gatatcccgatggtgcagttgagta

SEQ ID NO: 83516 - DNA, 25 bp, E. coli
gatatcccgatgctgcagttgagta

SEQ ID NO: 83517 - DNA, 25 bp, E. coli
gataatttgtatacccgcagctggc

SEQ ID NO: 83518 - DNA, 25 bp, E. coli
gtatcgacagtaccaaacctgccgc

SEQ ID NO: 83519 - DNA, 25 bp, E. coli
gataatttgtattcccgcagctggc

SEQ ID NO: 83520 - DNA, 25 bp, E. coli
tgggcaggagccaattaccattccg

SEQ ID NO: 83521 - DNA, 25 bp, E. coli
cagcgagagagcgttgccgcaggca

SEQ ID NO: 83522 - DNA, 25 bp, E. coli
cagcgagagagccttgccgcaggca

SEQ ID NO: 83523 - DNA, 25 bp, E. coli
agagagcgttgcggcaggcaacgac

SEQ ID NO: 83524 - DNA, 25 bp, E. coli
agcgccagcgagagagcgttgccgc

SEQ ID NO: 83525 - DNA, 25 bp, E. coli
agcgccagcgagtgagcgttgccgc

SEQ ID NO: 83526 - DNA, 25 bp, E. coli
agagagcgttgccgcaggcaacgac

SEQ ID NO: 83527 - DNA, 25 bp, E. coli
gccagcgagagagcgttgccgcagg

SEQ ID NO: 83528 - DNA, 25 bp, E. coli
gcgccagcgagacagcgttgccgca

SEQ ID NO: 83529 - DNA, 25 bp, E. coli
ccagcgagagagcgttgccgcaggc

SEQ ID NO: 83530 - DNA, 25 bp, E. coli
ccagcgagagagggttgccgcaggc

SEQ ID NO: 83531 - DNA, 25 bp, E. coli
gcgccagcgagagagcgttgccgca

SEQ ID NO: 83532 - DNA, 25 bp, E. coli
gccagcgagagaccgttgccgcagg

SEQ ID NO: 83533 - DNA, 25 bp, E. coli
gagagcgttgccccaggcaacgacc

SEQ ID NO: 83534 - DNA, 25 bp, E. coli
gagagcgttgccgcaggcaacgacc

SEQ ID NO: 83535 - DNA, 25 bp, E. coli
cgccagcgagagtgcgttgccgcag

SEQ ID NO: 83536 - DNA, 25 bp, E. coli
cgccagcgagagagcgttgccgcag

SEQ ID NO: 83537 - DNA, 25 bp, E. coli
gagagagcgttgccgcaggcaacga

SEQ ID NO: 83538 - DNA, 25 bp, E. coli
gagcgccagcgacagagcgttgccg

SEQ ID NO: 83539 - DNA, 25 bp, E. coli
gagcgccagcgagagagcgttgccg

SEQ ID NO: 83540 - DNA, 25 bp, E. coli
gagagagcgttggcgcaggcaacga

SEQ ID NO: 83541 - DNA, 25 bp, E. coli
aattcgttgctggagctacaacccg

SEQ ID NO: 83542 - DNA, 25 bp, E. coli
aattcgttgctgcagctacaacccg

SEQ ID NO: 83543 - DNA, 25 bp, E. coli
cagccgcctggttgcgcagatcgtt

SEQ ID NO: 83544 - DNA, 25 bp, E. coli
cagccgcctggtagcgcagatcgtt

SEQ ID NO: 83545 - DNA, 25 bp, E. coli
taaatcacgttaccgcccattgcag

SEQ ID NO: 83546 - DNA, 25 bp, E. coli
taaatcacgttagcgcccattgcag

SEQ ID NO: 83547 - DNA, 25 bp, E. coli
actggacaacattccctgcgacggg

SEQ ID NO: 83548 - DNA, 25 bp, E. coli
actggacaacataccctgcgacggg

SEQ ID NO: 83549 - DNA, 25 bp, E. coli
tacctgtcgcagtaccaatcagctg

SEQ ID NO: 83550 - DNA, 25 bp, E. coli
tacctgtcgcagaaccaatcagctg

SEQ ID NO: 83551 - DNA, 25 bp, E. coli
tgaccggcagcactcaattcgttgc

SEQ ID NO: 83552 - DNA, 25 bp, E. coli
tgaccggcagcagtcaattcgttgc

SEQ ID NO: 83553 - DNA, 25 bp, E. coli
tccgtcgggacaaaactggacaaca

SEQ ID NO: 83554 - DNA, 25 bp, E. coli
tccacaatgcgttcactctgaccgg

SEQ ID NO: 83555 - DNA, 25 bp, E. coli
tccacaatgcgtacactctgaccgg

SEQ ID NO: 83556 - DNA, 25 bp, E. coli
tccgtcgggacataactggacaaca

SEQ ID NO: 83557 - DNA, 25 bp, E. coli
gcagatcgtttgctgcgccgcgcat

SEQ ID NO: 83558 - DNA, 25 bp, E. coli
gcagatcgtttggtgcgccgcgcat

SEQ ID NO: 83559 - DNA, 25 bp, E. coli
cgtgttgcccggtaagccagttgct

SEQ ID NO: 83560 - DNA, 25 bp, E. coli
cgtgttgcccggaaagccagttgct

SEQ ID NO: 83561 - DNA, 25 bp, E. coli
gataatctggctatccgtcgggaca

SEQ ID NO: 83562 - DNA, 25 bp, E. coli
gataatctggctttccgtcgggaca

SEQ ID NO: 83563 - DNA, 25 bp, E. coli
caggaaactccggtatggtttatcg

SEQ ID NO: 83564 - DNA, 25 bp, E. coli
caggaaactccgctatggtttatcg

SEQ ID NO: 83565 - DNA, 25 bp, E. coli
atgagcaggaaagtccgctatggtt

SEQ ID NO: 83566 - DNA, 25 bp, E. coli
atgagcaggaaactccgctatggtt

SEQ ID NO: 83567 - DNA, 25 bp, E. coli
aactccgctatgctttatcggctgc

SEQ ID NO: 83568 - DNA, 25 bp, E. coli
actccgctatggtttatcggctgcc

SEQ ID NO: 83569 - DNA, 25 bp, E. coli
aaactccgctatcgtttatcggctg

SEQ ID NO: 83570 - DNA, 25 bp, E. coli
aactccgctatggtttatcggctgc

SEQ ID NO: 83571 - DNA, 25 bp, E. coli
actccgctatggattatcggctgcc

SEQ ID NO: 83572 - DNA, 25 bp, E. coli
aaactccgctatggtttatcggctg

SEQ ID NO: 83573 - DNA, 25 bp, E. coli
tccgctatggttaatcggctgccgt

SEQ ID NO: 83574 - DNA, 25 bp, E. coli
tccgctatggtttatcggctgccgt

SEQ ID NO: 83575 - DNA, 25 bp, E. coli
gctatggtttatgggctgccgttct

SEQ ID NO: 83576 - DNA, 25 bp, E. coli
gctatggtttatcggctgccgttct

SEQ ID NO: 83577 - DNA, 25 bp, E. coli
gaaactccgctatggtttatcggct

SEQ ID NO: 83578 - DNA, 25 bp, E. coli
gaaactccgctaaggtttatcggct

SEQ ID NO: 83579 - DNA, 25 bp, E. coli
cgctatggtttaacggctgccgttc

SEQ ID NO: 83580 - DNA, 25 bp, E. coli
cgctatggtttatcggctgccgttc

SEQ ID NO: 83581 - DNA, 25 bp, E. coli
ggaaactccgctatggtttatcggc

SEQ ID NO: 83582 - DNA, 25 bp, E. coli
ggaaactccgctttggtttatcggc

SEQ ID NO: 83583 - DNA, 25 bp, E. coli
gagcaggaaactgcgctatggttta

SEQ ID NO: 83584 - DNA, 25 bp, E. coli
gagcaggaaactccgctatggttta

SEQ ID NO: 83585 - DNA, 25 bp, E. coli
catctccaggcggtactcgcttgat

SEQ ID NO: 83586 - DNA, 25 bp, E. coli
catctccaggcgctactcgcttgat

SEQ ID NO: 83587 - DNA, 25 bp, E. coli
tactcgcttgatgaactgctggcac

SEQ ID NO: 83588 - DNA, 25 bp, E. coli
tactcgcttgatcaactgctggcac

SEQ ID NO: 83589 - DNA, 25 bp, E. coli
actgattctgacacccatctccagg

SEQ ID NO: 83590 - DNA, 25 bp, E. coli
actgattctgactcccatctccagg

SEQ ID NO: 83591 - DNA, 25 bp, E. coli
tgcagatgcgtaataccataaaaag

SEQ ID NO: 83592 - DNA, 25 bp, E. coli
tgaacgccgcggaacttagcgagca

SEQ ID NO: 83593 - DNA, 25 bp, E. coli
tgaaagaacttatcttacagccggg

SEQ ID NO: 83594 - DNA, 25 bp, E. coli
tgaacgccgcggtacttagcgagca

SEQ ID NO: 83595 - DNA, 25 bp, E. coli
tgcagatgcgtattaccataaaaag

SEQ ID NO: 83596 - DNA, 25 bp, E. coli
tgaaagaacttaacttacagccggg

SEQ ID NO: 83597 - DNA, 25 bp, E. coli
gaacagtgcaggtatggtcattccc

SEQ ID NO: 83598 - DNA, 25 bp, E. coli
gaacagtgcaggaatggtcattccc

SEQ ID NO: 83599 - DNA, 25 bp, E. coli
cccctgcgggtgtcgaaatatggta

SEQ ID NO: 83600 - DNA, 25 bp, E. coli
cccctgcgggtgacgaaatatggta

SEQ ID NO: 83601 - DNA, 25 bp, E. coli
cggaacttagcgtgcaggatgtctg

SEQ ID NO: 83602 - DNA, 25 bp, E. coli
cggaacttagcgagcaggatgtctg

SEQ ID NO: 83603 - DNA, 25 bp, E. coli
ggtatggtcattgccaatatcgtaa

SEQ ID NO: 83604 - DNA, 25 bp, E. coli
ggtatggtcattcccaatatcgtaa

SEQ ID NO: 83605 - DNA, 25 bp, E. coli
tggcacagtgtgtcatgaacgccgc

SEQ ID NO: 83606 - DNA, 25 bp, E. coli
tggcacagtgtgacatgaacgccgc

SEQ ID NO: 83607 - DNA, 25 bp, E. coli
aaagatccggtctatcgcaagatgg

SEQ ID NO: 83608 - DNA, 25 bp, E. coli
aaagatccggtcaatcgcaagatgg

SEQ ID NO: 83609 - DNA, 25 bp, E. coli
tatgtacagccactggaatggcggt

SEQ ID NO: 83610 - DNA, 25 bp, E. coli
tatgtacagccagtggaatggcggt

SEQ ID NO: 83611 - DNA, 25 bp, E. coli
gacgcgcccggttcgttttattgcg

SEQ ID NO: 83612 - DNA, 25 bp, E. coli
gacgcgcccggtacgttttattgcg

SEQ ID NO: 83613 - DNA, 25 bp, E. coli
gcgatcgcggcaactttatgtacag

SEQ ID NO: 83614 - DNA, 25 bp, E. coli
gcgatcgcggcatctttatgtacag

SEQ ID NO: 83615 - DNA, 25 bp, E. coli
ccgcggcggtaaaagtccacgctga

SEQ ID NO: 83616 - DNA, 25 bp, E. coli
ccgcggcggtaatagtccacgctga

SEQ ID NO: 83617 - DNA, 25 bp, E. coli
cggtgaaggccagtacggtcaatgc

SEQ ID NO: 83618 - DNA, 25 bp, E. coli
cggtgaaggccactacggtcaatgc

SEQ ID NO: 83619 - DNA, 25 bp, E. coli
cggtcaatgcgccatgaaggtcgat

SEQ ID NO: 83620 - DNA, 25 bp, E. coli
cggtcaatgcgcgatgaaggtcgat

SEQ ID NO: 83621 - DNA, 25 bp, E. coli
taacccgtatgtgcaacgcgcttgc

SEQ ID NO: 83622 - DNA, 25 bp, E. coli
taacccgtatgtccaacgcgcttgc

SEQ ID NO: 83623 - DNA, 25 bp, E. coli
gatggaaagcgaaatgcataacctg

SEQ ID NO: 83624 - DNA, 25 bp, E. coli
gatggaaagcgatatgcataacctg

SEQ ID NO: 83625 - DNA, 25 bp, E. coli
gatgtaaaattatctggcagggcaa

SEQ ID NO: 83626 - DNA, 25 bp, E. coli
gatgtaaaattaactggcagggcaa

SEQ ID NO: 83627 - DNA, 25 bp, E. coli
gatctgcaatcgtgcggctatcagg

SEQ ID NO: 83628 - DNA, 25 bp, E. coli
gatctgcaatcgagcggctatcagg

SEQ ID NO: 83629 - DNA, 25 bp, E. coli
cacgaatagtgtaaggcgcaggctt

SEQ ID NO: 83630 - DNA, 25 bp, E. coli
cacgaatagtgttaggcgcaggctt

SEQ ID NO: 83631 - DNA, 25 bp, E. coli
catttcgcgggaacatctgcatggg

SEQ ID NO: 83632 - DNA, 25 bp, E. coli
catttcgcgggatcatctgcatggg

SEQ ID NO: 83633 - DNA, 25 bp, E. coli
acaaaagtggctaccatcgccggga

SEQ ID NO: 83634 - DNA, 25 bp, E. coli
acaaaagtggcttccatcgccggga

SEQ ID NO: 83635 - DNA, 25 bp, E. coli
taccggttggctctacatcgcgtgg

SEQ ID NO: 83636 - DNA, 25 bp, E. coli
tatgcgcaaaaacaacgcggcacgg

SEQ ID NO: 83637 - DNA, 25 bp, E. coli
tatgcctgcgggagtaaagtcgatc

SEQ ID NO: 83638 - DNA, 25 bp, E. coli
taccggttggctgtacatcgcgtgg

SEQ ID NO: 83639 - DNA, 25 bp, E. coli
tatgcgcaaaaagaacgcggcacgg

SEQ ID NO: 83640 - DNA, 25 bp, E. coli
tatgcctgcgggtgtaaagtcgatc

SEQ ID NO: 83641 - DNA, 25 bp, E. coli
tattttgctagagcgctttggccca

SEQ ID NO: 83642 - DNA, 25 bp, E. coli
tattttgctagaccgctttggccca

SEQ ID NO: 83643 - DNA, 25 bp, E. coli
tcggctggcgaataaaggctatgac

SEQ ID NO: 83644 - DNA, 25 bp, E. coli
tcagtctggcgaaaaccggttgggt

SEQ ID NO: 83645 - DNA, 25 bp, E. coli
tcagtctggcgataaccggttgggt

SEQ ID NO: 83646 - DNA, 25 bp, E. coli
tcggctggcgaaaaaaggctatgac

SEQ ID NO: 83647 - DNA, 25 bp, E. coli
gcccaggcggtaccgtttatctcaa

SEQ ID NO: 83648 - DNA, 25 bp, E. coli
gcccaggcggtagcgtttatctcaa

SEQ ID NO: 83649 - DNA, 25 bp, E. coli
taatctggcgctcgttatcgcggcc

SEQ ID NO: 83650 - DNA, 25 bp, E. coli
taatctggcgctggttatcgcggcc

SEQ ID NO: 83651 - DNA, 25 bp, E. coli
cacccggcaagcaggccgatatcgt

SEQ ID NO: 83652 - DNA, 25 bp, E. coli
cacccggcaagctggccgatatcgt

SEQ ID NO: 83653 - DNA, 25 bp, E. coli
actggcacccggcaagcaggccgat

SEQ ID NO: 83654 - DNA, 25 bp, E. coli
actggcacccgggaagcaggccgat

SEQ ID NO: 83655 - DNA, 25 bp, E. coli
tgacgaccgttatttgcgaccctca

SEQ ID NO: 83656 - DNA, 25 bp, E. coli
tgacgaccgttaattgcgaccctca

SEQ ID NO: 83657 - DNA, 25 bp, E. coli
ccggcaagcagggcgatatcgtcct

SEQ ID NO: 83658 - DNA, 25 bp, E. coli
ccggcaagcaggccgatatcgtcct

SEQ ID NO: 83659 - DNA, 25 bp, E. coli
gcgcggcctgaccaccgttatttgc

SEQ ID NO: 83660 - DNA, 25 bp, E. coli
gcgcggcctgacgaccgttatttgc

SEQ ID NO: 83661 - DNA, 25 bp, E. coli
cctgacgaccgttatttgcgaccct

SEQ ID NO: 83662 - DNA, 25 bp, E. coli
cgaccgttatttccgaccctcatga

SEQ ID NO: 83663 - DNA, 25 bp, E. coli
cctgacgaccgtaatttgcgaccct

SEQ ID NO: 83664 - DNA, 25 bp, E. coli
ccgcgcggcctgacgaccgttattt

SEQ ID NO: 83665 - DNA, 25 bp, E. coli
cgaccgttatttgcgaccctcatga

SEQ ID NO: 83666 - DNA, 25 bp, E. coli
ccgcgcggcctgtcgaccgttattt

SEQ ID NO: 83667 - DNA, 25 bp, E. coli
ggcctgacgacccttatttgcgacc

SEQ ID NO: 83668 - DNA, 25 bp, E. coli
tggcacccggcatgcaggccgatat

SEQ ID NO: 83669 - DNA, 25 bp, E. coli
tggcacccggcaagcaggccgatat

SEQ ID NO: 83670 - DNA, 25 bp, E. coli
ggcctgacgaccgttatttgcgacc

SEQ ID NO: 83671 - DNA, 25 bp, E. coli
gacgaccgttatatgcgaccctcat

SEQ ID NO: 83672 - DNA, 25 bp, E. coli
gacgaccgttatttgcgaccctcat

SEQ ID NO: 83673 - DNA, 25 bp, E. coli
caccttatgaaccactaatcgcaga

SEQ ID NO: 83674 - DNA, 25 bp, E. coli
caccttatgaacgactaatcgcaga

SEQ ID NO: 83675 - DNA, 25 bp, E. coli
catattgactatcgaaaacaagcgc

SEQ ID NO: 83676 - DNA, 25 bp, E. coli
cagttatgccattcaatcaggagac

SEQ ID NO: 83677 - DNA, 25 bp, E. coli
catattgactatggaaaacaagcgc

SEQ ID NO: 83678 - DNA, 25 bp, E. coli
cagttatgccatacaatcaggagac

SEQ ID NO: 83679 - DNA, 25 bp, E. coli
tacaatcaggagtccgcatagaggg

SEQ ID NO: 83680 - DNA, 25 bp, E. coli
tacaagctggcggaccttatgaacc

SEQ ID NO: 83681 - DNA, 25 bp, E. coli
tacaatcaggagaccgcatagaggg

SEQ ID NO: 83682 - DNA, 25 bp, E. coli
ccgcatagagggtgatttacctaag

SEQ ID NO: 83683 - DNA, 25 bp, E. coli
ccgcatagagggagatttacctaag

SEQ ID NO: 83684 - DNA, 25 bp, E. coli
tctggaatgcactacaagctggcgc

SEQ ID NO: 83685 - DNA, 25 bp, E. coli
tcttggtgaagagacagaacatgaa

SEQ ID NO: 83686 - DNA, 25 bp, E. coli
tctggaatgcacaacaagctggcgc

SEQ ID NO: 83687 - DNA, 25 bp, E. coli
tcttggtgaagacacagaacatgaa

SEQ ID NO: 83688 - DNA, 25 bp, E. coli
gaaaaaggacatcaacttccccata

SEQ ID NO: 83689 - DNA, 25 bp, E. coli
gaaaacaagcgcatgctgccagtta

SEQ ID NO: 83690 - DNA, 25 bp, E. coli
gaaaaaggacatgaacttccccata

SEQ ID NO: 83691 - DNA, 25 bp, E. coli
gaaaacaagcgcttgctgccagtta

SEQ ID NO: 83692 - DNA, 25 bp, E. coli
taatcgcagaattgactggcggagt

SEQ ID NO: 83693 - DNA, 25 bp, E. coli
taatcgcagaatagactggcggagt

SEQ ID NO: 83694 - DNA, 25 bp, E. coli
tacaagctggcgcaccttatgaacc

SEQ ID NO: 83695 - DNA, 25 bp, E. coli
caataccatggtcggcattgccgtc

SEQ ID NO: 83696 - DNA, 25 bp, E. coli
caataccatggtgggcattgccgtc

SEQ ID NO: 83697 - DNA, 25 bp, E. coli
taggtctggcacaacaaggcgttgg

SEQ ID NO: 83698 - DNA, 25 bp, E. coli
taggtctggcactacaaggcgttgg

SEQ ID NO: 83699 - DNA, 25 bp, E. coli
tttacggtgccctcgctgttggtgc

SEQ ID NO: 83700 - DNA, 25 bp, E. coli
tttacggtgcccacgctgttggtgc

SEQ ID NO: 83701 - DNA, 25 bp, E. coli
tgaaagccagttactgacaggcgct

SEQ ID NO: 83702 - DNA, 25 bp, E. coli
tgaaagccagtttctgacaggcgct

SEQ ID NO: 83703 - DNA, 25 bp, E. coli
tctctgcttgtagaaacggtgggct

SEQ ID NO: 83704 - DNA, 25 bp, E. coli
tctctgcttgtacaaacggtgggct

SEQ ID NO: 83705 - DNA, 25 bp, E. coli
tcatgtttggctggatgccggaccg

SEQ ID NO: 83706 - DNA, 25 bp, E. coli
tcatgtttggctcgatgccggaccg

SEQ ID NO: 83707 - DNA, 25 bp, E. coli
gcttatctttccagcgctgggcgtg

SEQ ID NO: 83708 - DNA, 25 bp, E. coli
gcatcgtagggccaaaacactctgg

SEQ ID NO: 83709 - DNA, 25 bp, E. coli
gcatcgtagggcgaaaacactctgg

SEQ ID NO: 83710 - DNA, 25 bp, E. coli
gcttatctttcctgcgctgggcgtg

SEQ ID NO: 83711 - DNA, 25 bp, E. coli
ggttacgccgcgtttcaggatatcg

SEQ ID NO: 83712 - DNA, 25 bp, E. coli
ggttacgccgcgattcaggatatcg

SEQ ID NO: 83713 - DNA, 25 bp, E. coli
tactcttaccgcgtttggcggcgca

SEQ ID NO: 83714 - DNA, 25 bp, E. coli
tactcttaccgcctttggcggcgca

SEQ ID NO: 83715 - DNA, 25 bp, E. coli
gtggttaaacgcctcccctcacaag

SEQ ID NO: 83716 - DNA, 25 bp, E. coli
gtggttaaacgcgtcccctcacaag

SEQ ID NO: 83717 - DNA, 25 bp, E. coli
cactcggtgtaagcactgatgacat

SEQ ID NO: 83718 - DNA, 25 bp, E. coli
cactgatgacatcgttgctgtaggt

SEQ ID NO: 83719 - DNA, 25 bp, E. coli
caacatataagtcgctccctcaagc

SEQ ID NO: 83720 - DNA, 25 bp, E. coli
caacatataagtggctccctcaagc

SEQ ID NO: 83721 - DNA, 25 bp, E. coli
cactgatgacatggttgctgtaggt

SEQ ID NO: 83722 - DNA, 25 bp, E. coli
cactcggtgtaaccactgatgacat

SEQ ID NO: 83723 - DNA, 25 bp, E. coli
atatgttgcgggtggcgttgcctcc

SEQ ID NO: 83724 - DNA, 25 bp, E. coli
atatgttgcgggaggcgttgcctcc

SEQ ID NO: 83725 - DNA, 25 bp, E. coli
tgcttctaactaaataaaccttctg

SEQ ID NO: 83726 - DNA, 25 bp, E. coli
tgcttctaactatataaaccttctg

SEQ ID NO: 83727 - DNA, 25 bp, E. coli
tccctcaagccacttcctttagaag

SEQ ID NO: 83728 - DNA, 25 bp, E. coli
tccctcaagccagttcctttagaag

SEQ ID NO: 83729 - DNA, 25 bp, E. coli
ttcctttagaagcacaaccttgctt

SEQ ID NO: 83730 - DNA, 25 bp, E. coli
ttcctttagaaggacaaccttgctt

SEQ ID NO: 83731 - DNA, 25 bp, E. coli
gcaccttccctaaagcactcggtgt

SEQ ID NO: 83732 - DNA, 25 bp, E. coli
gcaccttccctatagcactcggtgt

SEQ ID NO: 83733 - DNA, 25 bp, E. coli
gattacgaaaaagatatgttgcggg

SEQ ID NO: 83734 - DNA, 25 bp, E. coli
gtctcaacgcccgatttttaataat

SEQ ID NO: 83735 - DNA, 25 bp, E. coli
gattacgaaaaacatatgttgcggg

SEQ ID NO: 83736 - DNA, 25 bp, E. coli
gtctcaacgccccatttttaataat

SEQ ID NO: 83737 - DNA, 25 bp, E. coli
gaggcgttgcctgcccaacatataa

SEQ ID NO: 83738 - DNA, 25 bp, E. coli
gaggcgttgcctccccaacatataa

SEQ ID NO: 83739 - DNA, 25 bp, E. coli
cagactgcgtgttggctctgtcaca

SEQ ID NO: 83740 - DNA, 25 bp, E. coli
cagactgcgtgtaggctctgtcaca

SEQ ID NO: 83741 - DNA, 25 bp, E. coli
tacatgtcacaacgtgcatctacgc

SEQ ID NO: 83742 - DNA, 25 bp, E. coli
tacatgtcacaaggtgcatctacgc

SEQ ID NO: 83743 - DNA, 25 bp, E. coli
tgatgaagaatgtacatcccgcgtt

SEQ ID NO: 83744 - DNA, 25 bp, E. coli
tgatgaagaatgaacatcccgcgtt

SEQ ID NO: 83745 - DNA, 25 bp, E. coli
gcgttcttccctgcgaacaggacga

SEQ ID NO: 83746 - DNA, 25 bp, E. coli
gctctgtcacagcttaagtagtttg

SEQ ID NO: 83747 - DNA, 25 bp, E. coli
gcgttcttccctccgaacaggacga

SEQ ID NO: 83748 - DNA, 25 bp, E. coli
gctctgtcacaggttaagtagtttg

SEQ ID NO: 83749 - DNA, 25 bp, E. coli
gaacaggacgatattgtaaattcac

SEQ ID NO: 83750 - DNA, 25 bp, E. coli
gaacaggacgattttgtaaattcac

SEQ ID NO: 83751 - DNA, 25 bp, E. coli
ctttcctgacagagacagactgcgt

SEQ ID NO: 83752 - DNA, 25 bp, E. coli
ctttcctgacagtgacagactgcgt

SEQ ID NO: 83753 - DNA, 25 bp, E. coli
gtgcatctacgccatcaaaccacgt

SEQ ID NO: 83754 - DNA, 25 bp, E. coli
gtgcatctacgcgatcaaaccacgt

SEQ ID NO: 83755 - DNA, 25 bp, E. coli
ggcattgcagtaattgagttgcagt

SEQ ID NO: 83756 - DNA, 25 bp, E. coli
ggcattgcagtatttgagttgcagt

SEQ ID NO: 83757 - DNA, 25 bp, E. coli
tcacttaattaccagggcattgcag

SEQ ID NO: 83758 - DNA, 25 bp, E. coli
tcacttaattacgagggcattgcag

SEQ ID NO: 83759 - DNA, 25 bp, E. coli
gagttgcagttttaccactttcctg

SEQ ID NO: 83760 - DNA, 25 bp, E. coli
gagttgcagtttaaccactttcctg

SEQ ID NO: 83761 - DNA, 25 bp, E. coli
cagatggtggcatatcaggctttca

SEQ ID NO: 83762 - DNA, 25 bp, E. coli
catccgcgagcctgaaccatgttgt

SEQ ID NO: 83763 - DNA, 25 bp, E. coli
catccgcgagccagaaccatgttgt

SEQ ID NO: 83764 - DNA, 25 bp, E. coli
cagatggtggcaaatcaggctttca

SEQ ID NO: 83765 - DNA, 25 bp, E. coli
tattctcagcggtgcaattgtcgcg

SEQ ID NO: 83766 - DNA, 25 bp, E. coli
tattctcagcggagcaattgtcgcg

SEQ ID NO: 83767 - DNA, 25 bp, E. coli
ttaattctcggtgttgctggcggcg

SEQ ID NO: 83768 - DNA, 25 bp, E. coli
ttaccgcgcgtctaccgaatggagt

SEQ ID NO: 83769 - DNA, 25 bp, E. coli
ttaattctcggtcttgctggcggcg

SEQ ID NO: 83770 - DNA, 25 bp, E. coli
ttaccgcgcgtcaaccgaatggagt

SEQ ID NO: 83771 - DNA, 25 bp, E. coli
tgttgttattatggctccccgccgt

SEQ ID NO: 83772 - DNA, 25 bp, E. coli
tgttgttattatcgctccccgccgt

SEQ ID NO: 83773 - DNA, 25 bp, E. coli
tgcttaccacggatgcacgcgatga

SEQ ID NO: 83774 - DNA, 25 bp, E. coli
tgcttaccacggttgcacgcgatga

SEQ ID NO: 83775 - DNA, 25 bp, E. coli
tcatcggtgtataaacgctaacggg

SEQ ID NO: 83776 - DNA, 25 bp, E. coli
tcatcggtgtattaacgctaacggg

SEQ ID NO: 83777 - DNA, 25 bp, E. coli
gcggcagtcgttgtacccaatacca

SEQ ID NO: 83778 - DNA, 25 bp, E. coli
gcggcagtcgttctacccaatacca

SEQ ID NO: 83779 - DNA, 25 bp, E. coli
gactattttagcctctgccggaacc

SEQ ID NO: 83780 - DNA, 25 bp, E. coli
gactattttagcgtctgccggaacc

SEQ ID NO: 83781 - DNA, 25 bp, E. coli
ggttatccgtttcagccagggtcat

SEQ ID NO: 83782 - DNA, 25 bp, E. coli
ggttatccgtttgagccagggtcat

SEQ ID NO: 83783 - DNA, 25 bp, E. coli
caagagttctggatggtgctaccga

SEQ ID NO: 83784 - DNA, 25 bp, E. coli
caagagttctggttggtgctaccga

SEQ ID NO: 83785 - DNA, 25 bp, E. coli
aattagcgcccatcagcgggtaggg

SEQ ID NO: 83786 - DNA, 25 bp, E. coli
aattagcgcccaacagcgggtaggg

SEQ ID NO: 83787 - DNA, 25 bp, E. coli
taaaaccatgaatgttgacggcctg

SEQ ID NO: 83788 - DNA, 25 bp, E. coli
taaaaccatgaaagttgacggcctg

SEQ ID NO: 83789 - DNA, 25 bp, E. coli
tatcacccagcaaaaccgtaacggg

SEQ ID NO: 83790 - DNA, 25 bp, E. coli
tattgatggattacaccaccggtca

SEQ ID NO: 83791 - DNA, 25 bp, E. coli
tatcacccagcataaccgtaacggg

SEQ ID NO: 83792 - DNA, 25 bp, E. coli
tattgatggatttcaccaccggtca

SEQ ID NO: 83793 - DNA, 25 bp, E. coli
tgtttttgaaagagggcgatcgcgt

SEQ ID NO: 83794 - DNA, 25 bp, E. coli
tgataaacaggtcgcgcactggccg

SEQ ID NO: 83795 - DNA, 25 bp, E. coli
tgataaacaggtggcgcactggccg

SEQ ID NO: 83796 - DNA, 25 bp, E. coli
tgtttttgaaagtgggcgatcgcgt

SEQ ID NO: 83797 - DNA, 25 bp, E. coli
gaaaacgggtcatacttctggtgcc

SEQ ID NO: 83798 - DNA, 25 bp, E. coli
gaaaacgggtcaaacttctggtgcc

SEQ ID NO: 83799 - DNA, 25 bp, E. coli
gatagtcatcgctttacgccagacg

SEQ ID NO: 83800 - DNA, 25 bp, E. coli
gatagtcatcgcattacgccagacg

SEQ ID NO: 83801 - DNA, 25 bp, E. coli
tcaccgcgggtattgagcatcaaca

SEQ ID NO: 83802 - DNA, 25 bp, E. coli
tcaccgcgggtaatgagcatcaaca

SEQ ID NO: 83803 - DNA, 25 bp, E. coli
gatgaacaactatgccgagaagctg

SEQ ID NO: 83804 - DNA, 25 bp, E. coli
gatgaacaactaagccgagaagctg

SEQ ID NO: 83805 - DNA, 25 bp, E. coli
aatttctggagcaattcccggcagc

SEQ ID NO: 83806 - DNA, 25 bp, E. coli
aatttctggagctattcccggcagc

SEQ ID NO: 83807 - DNA, 25 bp, E. coli
ttaccgcaaaatctggataccgctg

SEQ ID NO: 83808 - DNA, 25 bp, E. coli
ttaccgcaaaatgtggataccgctg

SEQ ID NO: 83809 - DNA, 25 bp, E. coli
tgtaccggtcgatccagaatccgat

SEQ ID NO: 83810 - DNA, 25 bp, E. coli
tgtaccggtcgaaccagaatccgat

SEQ ID NO: 83811 - DNA, 25 bp, E. coli
tgaacttaaactccatgccatcggg

SEQ ID NO: 83812 - DNA, 25 bp, E. coli
tgaacttaaactgcatgccatcggg

SEQ ID NO: 83813 - DNA, 25 bp, E. coli
tcgctgggcgacaaatgaggttatc

SEQ ID NO: 83814 - DNA, 25 bp, E. coli
tcgctgggcgactaatgaggttatc

SEQ ID NO: 83815 - DNA, 25 bp, E. coli
gaagattccgaacaatcagagccgg

SEQ ID NO: 83816 - DNA, 25 bp, E. coli
gaagcacttggctatgaccgtcaga

SEQ ID NO: 83817 - DNA, 25 bp, E. coli
gaagattccgaagaatcagagccgg

SEQ ID NO: 83818 - DNA, 25 bp, E. coli
gaagcacttggcaatgaccgtcaga

SEQ ID NO: 83819 - DNA, 25 bp, E. coli
gatacgcaacaatacgggccagaag

SEQ ID NO: 83820 - DNA, 25 bp, E. coli
gatacgcaacaaaacgggccagaag

SEQ ID NO: 83821 - DNA, 25 bp, E. coli
taagtggtggctgaaacagtcacgc

SEQ ID NO: 83822 - DNA, 25 bp, E. coli
taagcataaatgtgagcctggcgct

SEQ ID NO: 83823 - DNA, 25 bp, E. coli
taagcataaatgagagcctggcgct

SEQ ID NO: 83824 - DNA, 25 bp, E. coli
taagtggtggctcaaacagtcacgc

SEQ ID NO: 83825 - DNA, 25 bp, E. coli
gatgcaggaaacattgacggtacca

SEQ ID NO: 83826 - DNA, 25 bp, E. coli
gatgcaggaaactttgacggtacca

SEQ ID NO: 83827 - DNA, 25 bp, E. coli
ctcgaagaacaacaggccgaatgct

SEQ ID NO: 83828 - DNA, 25 bp, E. coli
ctcgaagaacaagaggccgaatgct

SEQ ID NO: 83829 - DNA, 25 bp, E. coli
cagattcggcggatagaaatagacc

SEQ ID NO: 83830 - DNA, 25 bp, E. coli
cagattgtggcacacgacggtttac

SEQ ID NO: 83831 - DNA, 25 bp, E. coli
cagattgtggcagacgacggtttac

SEQ ID NO: 83832 - DNA, 25 bp, E. coli
cagattcggcggttagaaatagacc

SEQ ID NO: 83833 - DNA, 25 bp, E. coli
agtatgtgacgcaactgacccagcg

SEQ ID NO: 83834 - DNA, 25 bp, E. coli
agtatgtgacgctactgacccagcg

SEQ ID NO: 83835 - DNA, 25 bp, E. coli
tttgatctggtttgccgcggcagcg

SEQ ID NO: 83836 - DNA, 25 bp, E. coli
tttgatctggttagccgcggcagcg

SEQ ID NO: 83837 - DNA, 25 bp, E. coli
tgccaacgggcactggaattgatcg

SEQ ID NO: 83838 - DNA, 25 bp, E. coli
tgccaacgggcagtggaattgatcg

SEQ ID NO: 83839 - DNA, 25 bp, E. coli
tcttgtgtcgaaaccagctctcttg

SEQ ID NO: 83840 - DNA, 25 bp, E. coli
tcttgtgtcgaatccagctctcttg

SEQ ID NO: 83841 - DNA, 25 bp, E. coli
cgaatgctggtgtgaaacatgccaa

SEQ ID NO: 83842 - DNA, 25 bp, E. coli
cgaatgctggtgagaaacatgccaa

SEQ ID NO: 83843 - DNA, 25 bp, E. coli
gggtctggctcaaaattggcgcatt

SEQ ID NO: 83844 - DNA, 25 bp, E. coli
ggttgtaaactggacctcgaagaac

SEQ ID NO: 83845 - DNA, 25 bp, E. coli
ggttgtaaactgcacctcgaagaac

SEQ ID NO: 83846 - DNA, 25 bp, E. coli
gggtctggctcataattggcgcatt

SEQ ID NO: 83847 - DNA, 25 bp, E. coli
ggaattgatcgatcagcaggccgca

SEQ ID NO: 83848 - DNA, 25 bp, E. coli
ggaattgatcgaacagcaggccgca

SEQ ID NO: 83849 - DNA, 25 bp, E. coli
caggttgtcatagccgaagttagca

SEQ ID NO: 83850 - DNA, 25 bp, E. coli
caggttgtcatacccgaagttagca

SEQ ID NO: 83851 - DNA, 25 bp, E. coli
tacgaacggcagctcatttgctacg

SEQ ID NO: 83852 - DNA, 25 bp, E. coli
tacgaacggcaggtcatttgctacg

SEQ ID NO: 83853 - DNA, 25 bp, E. coli
acatttcgcatgttccggatccgga

SEQ ID NO: 83854 - DNA, 25 bp, E. coli
acatttcgcatgatccggatccgga

SEQ ID NO: 83855 - DNA, 25 bp, E. coli
tcataccgccaatcagtacgaacgg

SEQ ID NO: 83856 - DNA, 25 bp, E. coli
tcttgacgttaattaccgcaccggt

SEQ ID NO: 83857 - DNA, 25 bp, E. coli
tcataccgccaaacagtacgaacgg

SEQ ID NO: 83858 - DNA, 25 bp, E. coli
tcttgacgttaaataccgcaccggt

SEQ ID NO: 83859 - DNA, 25 bp, E. coli
gctttgaacacgaaagggataccca

SEQ ID NO: 83860 - DNA, 25 bp, E. coli
gctttgaacacgtaagggataccca

SEQ ID NO: 83861 - DNA, 25 bp, E. coli
gaacggttccagtttagccagcggc

SEQ ID NO: 83862 - DNA, 25 bp, E. coli
gaacggttccagattagccagcggc

SEQ ID NO: 83863 - DNA, 25 bp, E. coli
gaaacgccggcaactgaatcacatc

SEQ ID NO: 83864 - DNA, 25 bp, E. coli
gaaacgccggcatctgaatcacatc

SEQ ID NO: 83865 - DNA, 25 bp, E. coli
gttacgtagtgctcgcaaatgcgca

SEQ ID NO: 83866 - DNA, 25 bp, E. coli
gatattacccatgtgtcccgggctg

SEQ ID NO: 83867 - DNA, 25 bp, E. coli
gatattacccatctgtcccgggctg

SEQ ID NO: 83868 - DNA, 25 bp, E. coli
gttacgtagtgcacgcaaatgcgca

SEQ ID NO: 83869 - DNA, 25 bp, E. coli
tcaaccaggtcactctggcgagcaa

SEQ ID NO: 83870 - DNA, 25 bp, E. coli
tcaaccaggtcagtctggcgagcaa

SEQ ID NO: 83871 - DNA, 25 bp, E. coli
cacgaagtgagcatccaggttcaca

SEQ ID NO: 83872 - DNA, 25 bp, E. coli
caaacctgggtaccctgggtgatca

SEQ ID NO: 83873 - DNA, 25 bp, E. coli
caaacctgggtagcctgggtgatca

SEQ ID NO: 83874 - DNA, 25 bp, E. coli
cacgaagtgagcttccaggttcaca

SEQ ID NO: 83875 - DNA, 25 bp, E. coli
taaagcgggctatgctcgtaacttc

SEQ ID NO: 83876 - DNA, 25 bp, E. coli
taaagctggcgaggaaggtaaactg

SEQ ID NO: 83877 - DNA, 25 bp, E. coli
taaagctggcgacgaaggtaaactg

SEQ ID NO: 83878 - DNA, 25 bp, E. coli
taaagcgggctaagctcgtaacttc

SEQ ID NO: 83879 - DNA, 25 bp, E. coli
aactgttcggttgcatcggtactcg

SEQ ID NO: 83880 - DNA, 25 bp, E. coli
aactgttcggttccatcggtactcg

SEQ ID NO: 83881 - DNA, 25 bp, E. coli
tgttaccatcgcgtctaaagctggc

SEQ ID NO: 83882 - DNA, 25 bp, E. coli
tgttaccatcgcctctaaagctggc

SEQ ID NO: 83883 - DNA, 25 bp, E. coli
tgctcgcgctgagaaaatcaatgca

SEQ ID NO: 83884 - DNA, 25 bp, E. coli
tcgcgacatcgcagacgctgtaact

SEQ ID NO: 83885 - DNA, 25 bp, E. coli
tgctcgcgctgacaaaatcaatgca

SEQ ID NO: 83886 - DNA, 25 bp, E. coli
tcgcgacatcgctgacgctgtaact

SEQ ID NO: 83887 - DNA, 25 bp, E. coli
gctgaactggaacctaaactggctg

SEQ ID NO: 83888 - DNA, 25 bp, E. coli
gctgaactggaagctaaactggctg

SEQ ID NO: 83889 - DNA, 25 bp, E. coli
gcttgataaagttgcaaacctgggt

SEQ ID NO: 83890 - DNA, 25 bp, E. coli
gcttgataaagtagcaaacctgggt

SEQ ID NO: 83891 - DNA, 25 bp, E. coli
tgatcaggtaaaggttaaagcgggc

SEQ ID NO: 83892 - DNA, 25 bp, E. coli
tgatcaggtaaacgttaaagcgggc

SEQ ID NO: 83893 - DNA, 25 bp, E. coli
aattcgacgtcaggcggatttaccg

SEQ ID NO: 83894 - DNA, 25 bp, E. coli
aattcgacgtcacgcggatttaccg

SEQ ID NO: 83895 - DNA, 25 bp, E. coli
cagcggttccgcaatctggtcgatt

SEQ ID NO: 83896 - DNA, 25 bp, E. coli
cagcggttccgctatctggtcgatt

SEQ ID NO: 83897 - DNA, 25 bp, E. coli
agacgcgaaactcggtacttactat

SEQ ID NO: 83898 - DNA, 25 bp, E. coli
agacgcgaaactgggtacttactat

SEQ ID NO: 83899 - DNA, 25 bp, E. coli
aaagttcagggcttagcggcatccc

SEQ ID NO: 83900 - DNA, 25 bp, E. coli
aaagttcagggcatagcggcatccc

SEQ ID NO: 83901 - DNA, 25 bp, E. coli
tatcgtgatggtttttcccctcgcc

SEQ ID NO: 83902 - DNA, 25 bp, E. coli
tatcgtgatggtatttcccctcgcc

SEQ ID NO: 83903 - DNA, 25 bp, E. coli
ttatggcatcgcaacccgcacaatt

SEQ ID NO: 83904 - DNA, 25 bp, E. coli
ttatggcatcgctacccgcacaatt

SEQ ID NO: 83905 - DNA, 25 bp, E. coli
tgttgtctcgctcgcttatggcatc

SEQ ID NO: 83906 - DNA, 25 bp, E. coli
tgttgtctcgctggcttatggcatc

SEQ ID NO: 83907 - DNA, 25 bp, E. coli
tacttggctttcacccggcatttgc

SEQ ID NO: 83908 - DNA, 25 bp, E. coli
tacttggctttctcccggcatttgc

SEQ ID NO: 83909 - DNA, 25 bp, E. coli
gactcatccgtattgcctttagcgc

SEQ ID NO: 83910 - DNA, 25 bp, E. coli
gactcatccgtaatgcctttagcgc

SEQ ID NO: 83911 - DNA, 25 bp, E. coli
gattgaaccgatgaaagagatggcg

SEQ ID NO: 83912 - DNA, 25 bp, E. coli
gattgaaccgatcaaagagatggcg

SEQ ID NO: 83913 - DNA, 25 bp, E. coli
ggattcctgcaaggctacaaaccag

SEQ ID NO: 83914 - DNA, 25 bp, E. coli
ggattcctgcaacgctacaaaccag

SEQ ID NO: 83915 - DNA, 25 bp, E. coli
caatggcactctattggttctcgca

SEQ ID NO: 83916 - DNA, 25 bp, E. coli
caatggcactcttttggttctcgca

SEQ ID NO: 83917 - DNA, 25 bp, E. coli
tatactgatgattaatataaatgca

SEQ ID NO: 83918 - DNA, 25 bp, E. coli
tatactgatgataaatataaatgca

SEQ ID NO: 83919 - DNA, 25 bp, E. coli
tataaatgcattgaatggatgatga

SEQ ID NO: 83920 - DNA, 25 bp, E. coli
tataaatgcattcaatggatgatga

SEQ ID NO: 83921 - DNA, 25 bp, E. coli
ttgccacggttaatctgcttacaca

SEQ ID NO: 83922 - DNA, 25 bp, E. coli
ttgccacggttattctgcttacaca

SEQ ID NO: 83923 - DNA, 25 bp, E. coli
ttggttctcgcatacattgttcagg

SEQ ID NO: 83924 - DNA, 25 bp, E. coli
ttggttctcgcaaacattgttcagg

SEQ ID NO: 83925 - DNA, 25 bp, E. coli
tctgcttacacattcacacaatggc

SEQ ID NO: 83926 - DNA, 25 bp, E. coli
tctgcttacacaatcacacaatggc

SEQ ID NO: 83927 - DNA, 25 bp, E. coli
cgcaaacattgtacagggaatatac

SEQ ID NO: 83928 - DNA, 25 bp, E. coli
cgcaaacattgttcagggaatatac

SEQ ID NO: 83929 - DNA, 25 bp, E. coli
cattgttcagggtatatactgatga

SEQ ID NO: 83930 - DNA, 25 bp, E. coli
cattcacacaatggcactcttttgg

SEQ ID NO: 83931 - DNA, 25 bp, E. coli
cattcacacaatcgcactcttttgg

SEQ ID NO: 83932 - DNA, 25 bp, E. coli
cattgttcagggaatatactgatga

SEQ ID NO: 83933 - DNA, 25 bp, E. coli
ggcactcttttggttctcgcaaaca

SEQ ID NO: 83934 - DNA, 25 bp, E. coli
tggatgatgaatcaaaatatcgtgg

SEQ ID NO: 83935 - DNA, 25 bp, E. coli
tggatgatgaatgaaaatatcgtgg

SEQ ID NO: 83936 - DNA, 25 bp, E. coli
ggcactcttttgcttctcgcaaaca

SEQ ID NO: 83937 - DNA, 25 bp, E. coli
aatggagtggctggcccggcattcc

SEQ ID NO: 83938 - DNA, 25 bp, E. coli
aatggagtggctcgcccggcattcc

SEQ ID NO: 83939 - DNA, 25 bp, E. coli
acactgggactgtatgcgctgacgc

SEQ ID NO: 83940 - DNA, 25 bp, E. coli
acactgggactgaatgcgctgacgc

SEQ ID NO: 83941 - DNA, 25 bp, E. coli
tgacactgggactgaatgcgctgac

SEQ ID NO: 83942 - DNA, 25 bp, E. coli
tgacactgggacagaatgcgctgac

SEQ ID NO: 83943 - DNA, 25 bp, E. coli
tgcgctgacgctgacggatgttaca

SEQ ID NO: 83944 - DNA, 25 bp, E. coli
tgcgctgacgctcacggatgttaca

SEQ ID NO: 83945 - DNA, 25 bp, E. coli
cgaaactgaatggagtggctggccc

SEQ ID NO: 83946 - DNA, 25 bp, E. coli
cgctgacgctgacggatgttacaaa

SEQ ID NO: 83947 - DNA, 25 bp, E. coli
cgctgacgctgagggatgttacaaa

SEQ ID NO: 83948 - DNA, 25 bp, E. coli
cgaaactgaatgcagtggctggccc

SEQ ID NO: 83949 - DNA, 25 bp, E. coli
ctgaatgcgctgacgctgacggatg

SEQ ID NO: 83950 - DNA, 25 bp, E. coli
ctgaatgcgctgtcgctgacggatg

SEQ ID NO: 83951 - DNA, 25 bp, E. coli
ctgggactgaatgcgctgacgctga

SEQ ID NO: 83952 - DNA, 25 bp, E. coli
ctgggactgaatccgctgacgctga

SEQ ID NO: 83953 - DNA, 25 bp, E. coli
gttacaaaaaatccagcgtatggcg

SEQ ID NO: 83954 - DNA, 25 bp, E. coli
gttacaaaaaatgcagcgtatggcg

SEQ ID NO: 83955 - DNA, 25 bp, E. coli
ggttactccgaatctgaatggagtg

SEQ ID NO: 83956 - DNA, 25 bp, E. coli
ggttactccgaaactgaatggagtg

SEQ ID NO: 83957 - DNA, 25 bp, E. coli
gacggatgttactaaaaatgcagcg

SEQ ID NO: 83958 - DNA, 25 bp, E. coli
gacggatgttacaaaaaatgcagcg

SEQ ID NO: 83959 - DNA, 25 bp, E. coli
aactgatgaatcagggaaaccgctc

SEQ ID NO: 83960 - DNA, 25 bp, E. coli
aaatgactcgccaaattgggtaacg

SEQ ID NO: 83961 - DNA, 25 bp, E. coli
aaatgactcgcctaattgggtaacg

SEQ ID NO: 83962 - DNA, 25 bp, E. coli
aactgatgaatctgggaaaccgctc

SEQ ID NO: 83963 - DNA, 25 bp, E. coli
tagcggccaattgtgggcaacaaat

SEQ ID NO: 83964 - DNA, 25 bp, E. coli
tagcggccaattctgggcaacaaat

SEQ ID NO: 83965 - DNA, 25 bp, E. coli
tattccaccgaatagcccagaagat

SEQ ID NO: 83966 - DNA, 25 bp, E. coli
tattccaccgaaaagcccagaagat

SEQ ID NO: 83967 - DNA, 25 bp, E. coli
tgatgatggcgacacgtctctgccg

SEQ ID NO: 83968 - DNA, 25 bp, E. coli
tgatgatggcgagacgtctctgccg

SEQ ID NO: 83969 - DNA, 25 bp, E. coli
tctgccgccagataagattcaggtt

SEQ ID NO: 83970 - DNA, 25 bp, E. coli
tctgccgccagaaaagattcaggtt

SEQ ID NO: 83971 - DNA, 25 bp, E. coli
tcatgattgcacgacaagaaagtca

SEQ ID NO: 83972 - DNA, 25 bp, E. coli
tcatgattgcaccacaagaaagtca

SEQ ID NO: 83973 - DNA, 25 bp, E. coli
ccaccagtagtgtaagtagcggcca

SEQ ID NO: 83974 - DNA, 25 bp, E. coli
ccaccagtagtgaaagtagcggcca

SEQ ID NO: 83975 - DNA, 25 bp, E. coli
cccagaagatgaaggaaagaatgcg

SEQ ID NO: 83976 - DNA, 25 bp, E. coli
cccggcagagcagaaagaggtcatg

SEQ ID NO: 83977 - DNA, 25 bp, E. coli
cccagaagatgatggaaagaatgcg

SEQ ID NO: 83978 - DNA, 25 bp, E. coli
cccggcagagcacaaagaggtcatg

SEQ ID NO: 83979 - DNA, 25 bp, E. coli
taatgcgaatggctggcaactgacc

SEQ ID NO: 83980 - DNA, 25 bp, E. coli
taatgcgaatgggtggcaactgacc

SEQ ID NO: 83981 - DNA, 25 bp, E. coli
caacgctgcaagctgtgccggtgaa

SEQ ID NO: 83982 - DNA, 25 bp, E. coli
caacgctgcaaggtgtgccggtgaa

SEQ ID NO: 83983 - DNA, 25 bp, E. coli
tactatcagcgatggtaagacgatc

SEQ ID NO: 83984 - DNA, 25 bp, E. coli
tactatcagcgaaggtaagacgatc

SEQ ID NO: 83985 - DNA, 25 bp, E. coli
gccgtttaagctgggaacaccgttg

SEQ ID NO: 83986 - DNA, 25 bp, E. coli
gccgtttaagctcggaacaccgttg

SEQ ID NO: 83987 - DNA, 25 bp, E. coli
gacgggcagccaaaccccttatgat

SEQ ID NO: 83988 - DNA, 25 bp, E. coli
gacgttacttttgacggcacgctgg

SEQ ID NO: 83989 - DNA, 25 bp, E. coli
gacgttacttttcacggcacgctgg

SEQ ID NO: 83990 - DNA, 25 bp, E. coli
gacggaaccttttctgcctacgcaa

SEQ ID NO: 83991 - DNA, 25 bp, E. coli
gacggaacctttactgcctacgcaa

SEQ ID NO: 83992 - DNA, 25 bp, E. coli
gacgggcagccataccccttatgat

SEQ ID NO: 83993 - DNA, 25 bp, E. coli
gaaagccaatgatgcggcgctcagc

SEQ ID NO: 83994 - DNA, 25 bp, E. coli
gaaagccaatgaagcggcgctcagc

SEQ ID NO: 83995 - DNA, 25 bp, E. coli
gattgagctacaccaaaacggccag

SEQ ID NO: 83996 - DNA, 25 bp, E. coli
gattgagctacagcaaaacggccag

SEQ ID NO: 83997 - DNA, 25 bp, E. coli
gtcattatcgactacattaacggcg

SEQ ID NO: 83998 - DNA, 25 bp, E. coli
gtcattatcgacaacattaacggcg

SEQ ID NO: 83999 - DNA, 25 bp, E. coli
taatttacggttatgctggcctggc

SEQ ID NO: 84000 - DNA, 25 bp, E. coli
taatttacggttttgctggcctggc

SEQ ID NO: 84001 - DNA, 25 bp, E. coli
gatgattccgccattgaaacggacg

SEQ ID NO: 84002 - DNA, 25 bp, E. coli
gatgattccgcctttgaaacggacg

SEQ ID NO: 84003 - DNA, 25 bp, E. coli
cactcttgccaggtttggcgggaaa

SEQ ID NO: 84004 - DNA, 25 bp, E. coli
cactcttgccagctttggcgggaaa

SEQ ID NO: 84005 - DNA, 25 bp, E. coli
taaatgagaatttaaatcactcctg

SEQ ID NO: 84006 - DNA, 25 bp, E. coli
taaatgagaattaaaatcactcctg

SEQ ID NO: 84007 - DNA, 25 bp, E. coli
tatacagatatcattgagtgaccgg

SEQ ID NO: 84008 - DNA, 25 bp, E. coli
tatacagatatctttgagtgaccgg

SEQ ID NO: 84009 - DNA, 25 bp, E. coli
tgaaaattattaatgccagcccatt

SEQ ID NO: 84010 - DNA, 25 bp, E. coli
tgaggcggctcgaaacttaagggct

SEQ ID NO: 84011 - DNA, 25 bp, E. coli
tgaaaattattattgccagcccatt

SEQ ID NO: 84012 - DNA, 25 bp, E. coli
tgaggcggctcgtaacttaagggct

SEQ ID NO: 84013 - DNA, 25 bp, E. coli
tgagtgaccggtcttgagaaatccg

SEQ ID NO: 84014 - DNA, 25 bp, E. coli
tgagtgaccggtgttgagaaatccg

SEQ ID NO: 84015 - DNA, 25 bp, E. coli
gccggaaggattaaatatttgaacg

SEQ ID NO: 84016 - DNA, 25 bp, E. coli
gccggaaggatttaatatttgaacg

SEQ ID NO: 84017 - DNA, 25 bp, E. coli
gaatgaactcactggtgctaaatga

SEQ ID NO: 84018 - DNA, 25 bp, E. coli
gaatgaactcacaggtgctaaatga

SEQ ID NO: 84019 - DNA, 25 bp, E. coli
cattatgataatcagtgccggaagg

SEQ ID NO: 84020 - DNA, 25 bp, E. coli
cattatgataatgagtgccggaagg

SEQ ID NO: 84021 - DNA, 25 bp, E. coli
gggatagagcaagaatcgcaccact

SEQ ID NO: 84022 - DNA, 25 bp, E. coli
gggatagagcaacaatcgcaccact

SEQ ID NO: 84023 - DNA, 25 bp, E. coli
taagggctttttgtgaatgaactca

SEQ ID NO: 84024 - DNA, 25 bp, E. coli
taagggctttttctgaatgaactca

SEQ ID NO: 84025 - DNA, 25 bp, E. coli
cacaggatcttatgggcgcaatggt

SEQ ID NO: 84026 - DNA, 25 bp, E. coli
cacaggatcttaagggcgcaatggt

SEQ ID NO: 84027 - DNA, 25 bp, E. coli
taacaaggtggcgatcgtaactggg

SEQ ID NO: 84028 - DNA, 25 bp, E. coli
tattctggtcaataacgcgggcgtg

SEQ ID NO: 84029 - DNA, 25 bp, E. coli
tattctggtcaaaaacgcgggcgtg

SEQ ID NO: 84030 - DNA, 25 bp, E. coli
tttcaatcgaaacgactgggatccg

SEQ ID NO: 84031 - DNA, 25 bp, E. coli
tttcaatcgaaaggactgggatccg

SEQ ID NO: 84032 - DNA, 25 bp, E. coli
tcagattaatggtatcgccccagga

SEQ ID NO: 84033 - DNA, 25 bp, E. coli
tcagattaatggaatcgccccagga

SEQ ID NO: 84034 - DNA, 25 bp, E. coli
gccagtgccgcttcagattatgtca

SEQ ID NO: 84035 - DNA, 25 bp, E. coli
gccagtgccgctacagattatgtca

SEQ ID NO: 84036 - DNA, 25 bp, E. coli
gctgaccaaagcgtatgccgatgat

SEQ ID NO: 84037 - DNA, 25 bp, E. coli
gctgaccaaagcctatgccgatgat

SEQ ID NO: 84038 - DNA, 25 bp, E. coli
gcattcgatatgagccaggccgcat

SEQ ID NO: 84039 - DNA, 25 bp, E. coli
gcattcgatatgtgccaggccgcat

SEQ ID NO: 84040 - DNA, 25 bp, E. coli
ggtatgcggcgagtaaacatgcttt

SEQ ID NO: 84041 - DNA, 25 bp, E. coli
ggtatgcggcgactaaacatgcttt

SEQ ID NO: 84042 - DNA, 25 bp, E. coli
taacaaggtggccatcgtaactggg

SEQ ID NO: 84043 - DNA, 25 bp, E. coli
taataaaagggcgtataccggctca

SEQ ID NO: 84044 - DNA, 25 bp, E. coli
taataaaagggcctataccggctca

SEQ ID NO: 84045 - DNA, 25 bp, E. coli
gaggcttatgctcggctctggccaa

SEQ ID NO: 84046 - DNA, 25 bp, E. coli
gaggcttatgctgggctctggccaa

SEQ ID NO: 84047 - DNA, 25 bp, E. coli
catgaagaactgagggtacgcggca

SEQ ID NO: 84048 - DNA, 25 bp, E. coli
catgaagaactgtgggtacgcggca

SEQ ID NO: 84049 - DNA, 25 bp, E. coli
tatcgcaaaccggattacgccaggg

SEQ ID NO: 84050 - DNA, 25 bp, E. coli
taccgaaacggcaatggcgaagctg

SEQ ID NO: 84051 - DNA, 25 bp, E. coli
tatcgcaaaccgcattacgccaggg

SEQ ID NO: 84052 - DNA, 25 bp, E. coli
taccgaaacggctatggcgaagctg

SEQ ID NO: 84053 - DNA, 25 bp, E. coli
tattcgtggcgaaaacggtcgctat

SEQ ID NO: 84054 - DNA, 25 bp, E. coli
tattcgtggcgataacggtcgctat

SEQ ID NO: 84055 - DNA, 25 bp, E. coli
tataacgtggcgttgagcgaaccga

SEQ ID NO: 84056 - DNA, 25 bp, E. coli
tataacgtggcgatgagcgaaccga

SEQ ID NO: 84057 - DNA, 25 bp, E. coli
tgaacctatctgtgagctggaactg

SEQ ID NO: 84058 - DNA, 25 bp, E. coli
tgaacctatctgagagctggaactg

SEQ ID NO: 84059 - DNA, 25 bp, E. coli
gccgttgaggcgttgcgtgaccatc

SEQ ID NO: 84060 - DNA, 25 bp, E. coli
gccgttgaggcgatgcgtgaccatc

SEQ ID NO: 84061 - DNA, 25 bp, E. coli
gctgaaactggccaaccaactggta

SEQ ID NO: 84062 - DNA, 25 bp, E. coli
gctgaaactggcgaaccaactggta

SEQ ID NO: 84063 - DNA, 25 bp, E. coli
gcaatccggcgcgtgaaatcaaacc

SEQ ID NO: 84064 - DNA, 25 bp, E. coli
gcaatccggcgcctgaaatcaaacc

SEQ ID NO: 84065 - DNA, 25 bp, E. coli
gaatatttactacgaaacgccggat

SEQ ID NO: 84066 - DNA, 25 bp, E. coli
gaatatttactaggaaacgccggat

SEQ ID NO: 84067 - DNA, 25 bp, E. coli
gaccatctcaattcgctgggcggcg

SEQ ID NO: 84068 - DNA, 25 bp, E. coli
gaccatctcaatacgctgggcggcg

SEQ ID NO: 84069 - DNA, 25 bp, E. coli
catgattgcccgactgttattaccg

SEQ ID NO: 84070 - DNA, 25 bp, E. coli
cagtatgtttgatgagtgggcacca

SEQ ID NO: 84071 - DNA, 25 bp, E. coli
cagtatgtttgaagagtgggcacca

SEQ ID NO: 84072 - DNA, 25 bp, E. coli
catgattgcccgtctgttattaccg

SEQ ID NO: 84073 - DNA, 25 bp, E. coli
aaatcgctgcggttgaatcttcatc

SEQ ID NO: 84074 - DNA, 25 bp, E. coli
aaatcgctgcggatgaatcttcatc

SEQ ID NO: 84075 - DNA, 25 bp, E. coli
tttaaactgaatggcgaactgcacg

SEQ ID NO: 84076 - DNA, 25 bp, E. coli
tttaaactgaatcgcgaactgcacg

SEQ ID NO: 84077 - DNA, 25 bp, E. coli
tgaagaagcatttgcgacagccgca

SEQ ID NO: 84078 - DNA, 25 bp, E. coli
tgctgaaccggttgatcgacgcacg

SEQ ID NO: 84079 - DNA, 25 bp, E. coli
tgctgaaccggtagatcgacgcacg

SEQ ID NO: 84080 - DNA, 25 bp, E. coli
tgaagaagcattagcgacagccgca

SEQ ID NO: 84081 - DNA, 25 bp, E. coli
tcgccgcatacgagcaactgaggaa

SEQ ID NO: 84082 - DNA, 25 bp, E. coli
tcgccgcatacgtgcaactgaggaa

SEQ ID NO: 84083 - DNA, 25 bp, E. coli
gaagcacgccatccttgagaaggcc

SEQ ID NO: 84084 - DNA, 25 bp, E. coli
gaagcacgccatgcttgagaaggcc

SEQ ID NO: 84085 - DNA, 25 bp, E. coli
gaaaattgtctgatgagcttaacgc

SEQ ID NO: 84086 - DNA, 25 bp, E. coli
gaaaattgtctgttgagcttaacgc

SEQ ID NO: 84087 - DNA, 25 bp, E. coli
gatacatgtccgtcagcgaaagcaa

SEQ ID NO: 84088 - DNA, 25 bp, E. coli
gatacatgtccgacagcgaaagcaa

SEQ ID NO: 84089 - DNA, 25 bp, E. coli
taacgctgagtatccagagcctgca

SEQ ID NO: 84090 - DNA, 25 bp, E. coli
taacgctgagtaaccagagcctgca

SEQ ID NO: 84091 - DNA, 25 bp, E. coli
catggactgatgtggtgcggcaact

SEQ ID NO: 84092 - DNA, 25 bp, E. coli
catggactgatgaggtgcggcaact

SEQ ID NO: 84093 - DNA, 25 bp, E. coli
catatcatctggtactgctgcagga

SEQ ID NO: 84094 - DNA, 25 bp, E. coli
catatcatctggaactgctgcagga

SEQ ID NO: 84095 - DNA, 25 bp, E. coli
tatggagcctccaaccgctatggca

SEQ ID NO: 84096 - DNA, 25 bp, E. coli
tatggagcctcctaccgctatggca

SEQ ID NO: 84097 - DNA, 25 bp, E. coli
tatcagtgagcaggcactctgcgga

SEQ ID NO: 84098 - DNA, 25 bp, E. coli
tatcagtgagcacgcactctgcgga

SEQ ID NO: 84099 - DNA, 25 bp, E. coli
tttgaaaccagactgaagcccacgg

SEQ ID NO: 84100 - DNA, 25 bp, E. coli
tatattgtgtgatggagctggctgc

SEQ ID NO: 84101 - DNA, 25 bp, E. coli
tatattgtgtgaaggagctggctgc

SEQ ID NO: 84102 - DNA, 25 bp, E. coli
tttaatgcccggttcgacatccgca

SEQ ID NO: 84103 - DNA, 25 bp, E. coli
tttaatgcccggatcgacatccgca

SEQ ID NO: 84104 - DNA, 25 bp, E. coli
tttgaaaccagagtgaagcccacgg

SEQ ID NO: 84105 - DNA, 25 bp, E. coli
tgcaggaacaggcacggctgaaaac

SEQ ID NO: 84106 - DNA, 25 bp, E. coli
tgcaggaacagggacggctgaaaac

SEQ ID NO: 84107 - DNA, 25 bp, E. coli
tgcggcaactgcctcatgcaatcgg

SEQ ID NO: 84108 - DNA, 25 bp, E. coli
tgcggcaactgcgtcatgcaatcgg

SEQ ID NO: 84109 - DNA, 25 bp, E. coli
gcattctgaaaaagactgctgccgc

SEQ ID NO: 84110 - DNA, 25 bp, E. coli
gcattctgaaaatgactgctgccgc

SEQ ID NO: 84111 - DNA, 25 bp, E. coli
ccgccgccgtgcatggtatcagtga

SEQ ID NO: 84112 - DNA, 25 bp, E. coli
ccgccgccgtgcttggtatcagtga

SEQ ID NO: 84113 - DNA, 25 bp, E. coli
tatctggttgtatagtgcgttccgc

SEQ ID NO: 84114 - DNA, 25 bp, E. coli
tattcggcgttcagggtgctgcgct

SEQ ID NO: 84115 - DNA, 25 bp, E. coli
tattcggcgttctgggtgctgcgct

SEQ ID NO: 84116 - DNA, 25 bp, E. coli
tatctggttgtaaagtgcgttccgc

SEQ ID NO: 84117 - DNA, 25 bp, E. coli
ttaggtctggaattgccgcagtggc

SEQ ID NO: 84118 - DNA, 25 bp, E. coli
ttgaaccaatgttcacaaggccggg

SEQ ID NO: 84119 - DNA, 25 bp, E. coli
ttgaaccaatgtacacaaggccggg

SEQ ID NO: 84120 - DNA, 25 bp, E. coli
ttaggtctggaaatgccgcagtggc

SEQ ID NO: 84121 - DNA, 25 bp, E. coli
tgttactgaaaccttgcgtgctctg

SEQ ID NO: 84122 - DNA, 25 bp, E. coli
tgttactgaaacgttgcgtgctctg

SEQ ID NO: 84123 - DNA, 25 bp, E. coli
tgctctgtatttatgaacgctgcgc

SEQ ID NO: 84124 - DNA, 25 bp, E. coli
tgatggcgtttactgctctggcact

SEQ ID NO: 84125 - DNA, 25 bp, E. coli
tgatggcgtttagtgctctggcact

SEQ ID NO: 84126 - DNA, 25 bp, E. coli
tgctctgtatttttgaacgctgcgc

SEQ ID NO: 84127 - DNA, 25 bp, E. coli
tgcgttccgcggtgtgcagttaact

SEQ ID NO: 84128 - DNA, 25 bp, E. coli
tgcgttccgcggagtgcagttaact

SEQ ID NO: 84129 - DNA, 25 bp, E. coli
tcccggaatggcagccgctggataa

SEQ ID NO: 84130 - DNA, 25 bp, E. coli
tcccggaatggctgccgctggataa

SEQ ID NO: 84131 - DNA, 25 bp, E. coli
gcagttaacttacgagcacaccatg

SEQ ID NO: 84132 - DNA, 25 bp, E. coli
gcagttaacttaggagcacaccatg

SEQ ID NO: 84133 - DNA, 25 bp, E. coli
ggtgatttcccacccgtttaaagcg

SEQ ID NO: 84134 - DNA, 25 bp, E. coli
ggtgatttcccagccgtttaaagcg

SEQ ID NO: 84135 - DNA, 25 bp, E. coli
tacagaaagtcagtggcgaacgtgg

SEQ ID NO: 84136 - DNA, 25 bp, E. coli
tacagaaagtcactggcgaacgtgg

SEQ ID NO: 84137 - DNA, 25 bp, E. coli
taaaggccatgatatcgacgcgccg

SEQ ID NO: 84138 - DNA, 25 bp, E. coli
taaaggccatgaaatcgacgcgccg

SEQ ID NO: 84139 - DNA, 25 bp, E. coli
tgggtaaataccttccgcacggcga

SEQ ID NO: 84140 - DNA, 25 bp, E. coli
gcatcaggtttcaggtgcgcgcgta

SEQ ID NO: 84141 - DNA, 25 bp, E. coli
gcatcaggtttctggtgcgcgcgta

SEQ ID NO: 84142 - DNA, 25 bp, E. coli
gaaattatcactacgcgcgccgaga

SEQ ID NO: 84143 - DNA, 25 bp, E. coli
gaaactgctgatcgcttccgatgcg

SEQ ID NO: 84144 - DNA, 25 bp, E. coli
gaaaatgcccatgttatgccgccgg

SEQ ID NO: 84145 - DNA, 25 bp, E. coli
gaaactgctgatggcttccgatgcg

SEQ ID NO: 84146 - DNA, 25 bp, E. coli
gaaaatgcccatcttatgccgccgg

SEQ ID NO: 84147 - DNA, 25 bp, E. coli
gaaattatcacttcgcgcgccgaga

SEQ ID NO: 84148 - DNA, 25 bp, E. coli
gattccaccggtcgtagctatgcca

SEQ ID NO: 84149 - DNA, 25 bp, E. coli
gattccaccggtggtagctatgcca

SEQ ID NO: 84150 - DNA, 25 bp, E. coli
tgggtaaataccatccgcacggcga

SEQ ID NO: 84151 - DNA, 25 bp, E. coli
taatgaagatgaaccgaaaccggcg

SEQ ID NO: 84152 - DNA, 25 bp, E. coli
taatgaagatgatccgaaaccggcg

SEQ ID NO: 84153 - DNA, 25 bp, E. coli
gacgcgccgggcgtgaattataaag

SEQ ID NO: 84154 - DNA, 25 bp, E. coli
gatgaatctgacgacgagaacccga

SEQ ID NO: 84155 - DNA, 25 bp, E. coli
gatgaatctgaccacgagaacccga

SEQ ID NO: 84156 - DNA, 25 bp, E. coli
gacgcgccgggcctgaattataaag

SEQ ID NO: 84157 - DNA, 25 bp, E. coli
cacttatcagcaagacgttgaacga

SEQ ID NO: 84158 - DNA, 25 bp, E. coli
cacttatcagcatgacgttgaacga

SEQ ID NO: 84159 - DNA, 25 bp, E. coli
agagcatcgacacagaaaacgcgcc

SEQ ID NO: 84160 - DNA, 25 bp, E. coli
aatatattccgggaccttcgctaca

SEQ ID NO: 84161 - DNA, 25 bp, E. coli
aatatattccggcaccttcgctaca

SEQ ID NO: 84162 - DNA, 25 bp, E. coli
agagcatcgacagagaaaacgcgcc

SEQ ID NO: 84163 - DNA, 25 bp, E. coli
taaaaggtgccgaaaataacgcaag

SEQ ID NO: 84164 - DNA, 25 bp, E. coli
taaaaggtgccgtaaataacgcaag

SEQ ID NO: 84165 - DNA, 25 bp, E. coli
tttgcgaggcggctaattagacact

SEQ ID NO: 84166 - DNA, 25 bp, E. coli
tttgcgaggcgggtaattagacact

SEQ ID NO: 84167 - DNA, 25 bp, E. coli
tattgctgcggtgtattaaaagccc

SEQ ID NO: 84168 - DNA, 25 bp, E. coli
tattgctgcggtctattaaaagccc

SEQ ID NO: 84169 - DNA, 25 bp, E. coli
tgatcataggcttcacccttaacgg

SEQ ID NO: 84170 - DNA, 25 bp, E. coli
tgatcataggctacacccttaacgg

SEQ ID NO: 84171 - DNA, 25 bp, E. coli
tgtggcaaagcaaatgacaaccccg

SEQ ID NO: 84172 - DNA, 25 bp, E. coli
tgtggcaaagcatatgacaaccccg

SEQ ID NO: 84173 - DNA, 25 bp, E. coli
tccttaatgacagggttgcgaagcc

SEQ ID NO: 84174 - DNA, 25 bp, E. coli
tccttaatgacacggttgcgaagcc

SEQ ID NO: 84175 - DNA, 25 bp, E. coli
gaaactttagtctaaaatccagcga

SEQ ID NO: 84176 - DNA, 25 bp, E. coli
gaaactttagtcaaaaatccagcga

SEQ ID NO: 84177 - DNA, 25 bp, E. coli
taatgatccagaggagttcggccca

SEQ ID NO: 84178 - DNA, 25 bp, E. coli
taatgatccagacgagttcggccca

SEQ ID NO: 84179 - DNA, 25 bp, E. coli
cattaacccggatgaagggggctgc

SEQ ID NO: 84180 - DNA, 25 bp, E. coli
cattaacccggaagaagggggctgc

SEQ ID NO: 84181 - DNA, 25 bp, E. coli
tttgcgttgtcccacggtgttatga

SEQ ID NO: 84182 - DNA, 25 bp, E. coli
tttgcgttgtccgacggtgttatga

SEQ ID NO: 84183 - DNA, 25 bp, E. coli
ttcgtcaggctaccgccgtgctgct

SEQ ID NO: 84184 - DNA, 25 bp, E. coli
ttcgtcaggctagcgccgtgctgct

SEQ ID NO: 84185 - DNA, 25 bp, E. coli
tgctgatggacaaggttcgtcaggc

SEQ ID NO: 84186 - DNA, 25 bp, E. coli
tgctgtaccggattccggatcttgc

SEQ ID NO: 84187 - DNA, 25 bp, E. coli
tgctgtaccggaatccggatcttgc

SEQ ID NO: 84188 - DNA, 25 bp, E. coli
tccgtgctgattaacgatttgcgtt

SEQ ID NO: 84189 - DNA, 25 bp, E. coli
tgctgatggacatggttcgtcaggc

SEQ ID NO: 84190 - DNA, 25 bp, E. coli
tccgtgctgatttacgatttgcgtt

SEQ ID NO: 84191 - DNA, 25 bp, E. coli
gatttacgatttccgttgtccgacg

SEQ ID NO: 84192 - DNA, 25 bp, E. coli
gatttacgatttgcgttgtccgacg

SEQ ID NO: 84193 - DNA, 25 bp, E. coli
gactgaccgggatgctgtaccggaa

SEQ ID NO: 84194 - DNA, 25 bp, E. coli
gactgaccgggaagctgtaccggaa

SEQ ID NO: 84195 - DNA, 25 bp, E. coli
ccgggatgctgtaccggaatccgga

SEQ ID NO: 84196 - DNA, 25 bp, E. coli
ccgggatgctgttccggaatccgga

SEQ ID NO: 84197 - DNA, 25 bp, E. coli
ctgccatgcgacagaccgggatgct

SEQ ID NO: 84198 - DNA, 25 bp, E. coli
ctgccatgcgactgaccgggatgct

SEQ ID NO: 84199 - DNA, 25 bp, E. coli
tggacaaggttcctcaggctaccgc

SEQ ID NO: 84200 - DNA, 25 bp, E. coli
tggacaaggttcgtcaggctaccgc

SEQ ID NO: 84201 - DNA, 25 bp, E. coli
caacgtcggtgcttaagagccctgt

SEQ ID NO: 84202 - DNA, 25 bp, E. coli
aactgccgagaacggtatatagccc

SEQ ID NO: 84203 - DNA, 25 bp, E. coli
caacgtcggtgcataagagccctgt

SEQ ID NO: 84204 - DNA, 25 bp, E. coli
tttccataaacccacagcattagcc

SEQ ID NO: 84205 - DNA, 25 bp, E. coli
tttccataaaccgacagcattagcc

SEQ ID NO: 84206 - DNA, 25 bp, E. coli
aactgccgagaagggtatatagccc

SEQ ID NO: 84207 - DNA, 25 bp, E. coli
acaggtcacaagacaacgtcggtgc

SEQ ID NO: 84208 - DNA, 25 bp, E. coli
acaggtcacaagtcaacgtcggtgc

SEQ ID NO: 84209 - DNA, 25 bp, E. coli
tatatagcccggtagaagtgcgtaa

SEQ ID NO: 84210 - DNA, 25 bp, E. coli
tatatagcccggaagaagtgcgtaa

SEQ ID NO: 84211 - DNA, 25 bp, E. coli
cctgctcaccctgtcagtaaagaaa

SEQ ID NO: 84212 - DNA, 25 bp, E. coli
cctgctcaccctctcagtaaagaaa

SEQ ID NO: 84213 - DNA, 25 bp, E. coli
gaagtgcgtaaaacgaactgacagg

SEQ ID NO: 84214 - DNA, 25 bp, E. coli
gaagtgcgtaaatcgaactgacagg

SEQ ID NO: 84215 - DNA, 25 bp, E. coli
gacagcattagcgttcatcatattt

SEQ ID NO: 84216 - DNA, 25 bp, E. coli
gacagcattagccttcatcatattt

SEQ ID NO: 84217 - DNA, 25 bp, E. coli
ccctgtgaggcgaatagcggcgtta

SEQ ID NO: 84218 - DNA, 25 bp, E. coli
cgaactgacaggataaaagtgccct

SEQ ID NO: 84219 - DNA, 25 bp, E. coli
cgaactgacaggttaaaagtgccct

SEQ ID NO: 84220 - DNA, 25 bp, E. coli
ccctgtgaggcgtatagcggcgtta

SEQ ID NO: 84221 - DNA, 25 bp, E. coli
gataaaagtgccctgctcaccctgt

SEQ ID NO: 84222 - DNA, 25 bp, E. coli
gataaaagtgccgtgctcaccctgt

SEQ ID NO: 84223 - DNA, 25 bp, E. coli
aataacatgctgttgtgggcgacgc

SEQ ID NO: 84224 - DNA, 25 bp, E. coli
caatgaaagcgttcgtcgtgacccg

SEQ ID NO: 84225 - DNA, 25 bp, E. coli
caatgaaagcgtacgtcgtgacccg

SEQ ID NO: 84226 - DNA, 25 bp, E. coli
aataacatgctgatgtgggcgacgc

SEQ ID NO: 84227 - DNA, 25 bp, E. coli
taaagcgctgctgttcctggcatcc

SEQ ID NO: 84228 - DNA, 25 bp, E. coli
taaagcgctgctcttcctggcatcc

SEQ ID NO: 84229 - DNA, 25 bp, E. coli
tatgcgcggtgatgagggctactct

SEQ ID NO: 84230 - DNA, 25 bp, E. coli
tatgcgcggtgaagagggctactct

SEQ ID NO: 84231 - DNA, 25 bp, E. coli
tattacaccgatccgaagaatggcg

SEQ ID NO: 84232 - DNA, 25 bp, E. coli
tattacaccgatgcgaagaatggcg

SEQ ID NO: 84233 - DNA, 25 bp, E. coli
ttttaacctggtgctggacggcctg

SEQ ID NO: 84234 - DNA, 25 bp, E. coli
ttttaacctggtcctggacggcctg

SEQ ID NO: 84235 - DNA, 25 bp, E. coli
tctttacaacgaactgggcaccctg

SEQ ID NO: 84236 - DNA, 25 bp, E. coli
tctttacaacgatctgggcaccctg

SEQ ID NO: 84237 - DNA, 25 bp, E. coli
gaaattacctctcgcgtggtcgcgg

SEQ ID NO: 84238 - DNA, 25 bp, E. coli
gaaattacctctggcgtggtcgcgg

SEQ ID NO: 84239 - DNA, 25 bp, E. coli
tggtctgaaaacctctcggcgatcg

SEQ ID NO: 84240 - DNA, 25 bp, E. coli
tggttgctgaaaggcgatccgctga

SEQ ID NO: 84241 - DNA, 25 bp, E. coli
tggtacagaccgtcatcaaacgtgt

SEQ ID NO: 84242 - DNA, 25 bp, E. coli
tggttgctgaaacgcgatccgctga

SEQ ID NO: 84243 - DNA, 25 bp, E. coli
tggtctgaaaacgtctcggcgatcg

SEQ ID NO: 84244 - DNA, 25 bp, E. coli
tggtacagaccgacatcaaacgtgt

SEQ ID NO: 84245 - DNA, 25 bp, E. coli
caagtgcgtgatttctgcgtaatca

SEQ ID NO: 84246 - DNA, 25 bp, E. coli
caagtgcgtgatatctgcgtaatca

SEQ ID NO: 84247 - DNA, 25 bp, E. coli
caaaataattcgcaagtgcgtgatt

SEQ ID NO: 84248 - DNA, 25 bp, E. coli
caaaataattcggaagtgcgtgatt

SEQ ID NO: 84249 - DNA, 25 bp, E. coli
cagtgccaacgcgattggtttgagt

SEQ ID NO: 84250 - DNA, 25 bp, E. coli
cagtgccaacgccattggtttgagt

SEQ ID NO: 84251 - DNA, 25 bp, E. coli
tattgagtgtcacgtcgctaacgcc

SEQ ID NO: 84252 - DNA, 25 bp, E. coli
tattgagtgtcaggtcgctaacgcc

SEQ ID NO: 84253 - DNA, 25 bp, E. coli
tgcgtgatttctccgtaatcaacgt

SEQ ID NO: 84254 - DNA, 25 bp, E. coli
tgcgtgatttctgcgtaatcaacgt

SEQ ID NO: 84255 - DNA, 25 bp, E. coli
ccagttgggttgtccacagtgccaa

SEQ ID NO: 84256 - DNA, 25 bp, E. coli
ccagttgggttgaccacagtgccaa

SEQ ID NO: 84257 - DNA, 25 bp, E. coli
tcgctaacgcctctttaagtccgaa

SEQ ID NO: 84258 - DNA, 25 bp, E. coli
tcgctaacgcctgtttaagtccgaa

SEQ ID NO: 84259 - DNA, 25 bp, E. coli
cggtgactggtgagtcgcaaaccat

SEQ ID NO: 84260 - DNA, 25 bp, E. coli
cggtgactggtgtgtcgcaaaccat

SEQ ID NO: 84261 - DNA, 25 bp, E. coli
gttgaccacagtgccaacgccattg

SEQ ID NO: 84262 - DNA, 25 bp, E. coli
gttgaccacagtcccaacgccattg

SEQ ID NO: 84263 - DNA, 25 bp, E. coli
tggatcaccagttgggttgaccaca

SEQ ID NO: 84264 - DNA, 25 bp, E. coli
tggatcaccagtagggttgaccaca

SEQ ID NO: 84265 - DNA, 25 bp, E. coli
gatccggtgactggtgtgtcgcaaa

SEQ ID NO: 84266 - DNA, 25 bp, E. coli
gatccggtgactcgtgtgtcgcaaa

SEQ ID NO: 84267 - DNA, 25 bp, E. coli
cagcaaaaaacacgcgcgttgcagg

SEQ ID NO: 84268 - DNA, 25 bp, E. coli
cagcaaaaaacaggcgcgttgcagg

SEQ ID NO: 84269 - DNA, 25 bp, E. coli
catggagggaaaatacgtatctggt

SEQ ID NO: 84270 - DNA, 25 bp, E. coli
catggagggaaattacgtatctggt

SEQ ID NO: 84271 - DNA, 25 bp, E. coli
cgtatctggtttgtttataaaggcg

SEQ ID NO: 84272 - DNA, 25 bp, E. coli
cgtatctggtttctttataaaggcg

SEQ ID NO: 84273 - DNA, 25 bp, E. coli
tgaaatgaaataaccgacaggcgtg

SEQ ID NO: 84274 - DNA, 25 bp, E. coli
tgaaatgaaatatccgacaggcgtg

SEQ ID NO: 84275 - DNA, 25 bp, E. coli
tccgacaggcgtggaaaaccatgga

SEQ ID NO: 84276 - DNA, 25 bp, E. coli
tccgacaggcgtcgaaaaccatgga

SEQ ID NO: 84277 - DNA, 25 bp, E. coli
gcgttgcaggtgtgctacgcgcctc

SEQ ID NO: 84278 - DNA, 25 bp, E. coli
gcgttgcaggtgagctacgcgcctc

SEQ ID NO: 84279 - DNA, 25 bp, E. coli
gcaggtgagctaggcgcctctgttt

SEQ ID NO: 84280 - DNA, 25 bp, E. coli
gcaggtgagctacgcgcctctgttt

SEQ ID NO: 84281 - DNA, 25 bp, E. coli
tggaaaaccatggagggaaattacg

SEQ ID NO: 84282 - DNA, 25 bp, E. coli
tggaaaaccatgcagggaaattacg

SEQ ID NO: 84283 - DNA, 25 bp, E. coli
tataaaggcgtatgagtcagggaaa

SEQ ID NO: 84284 - DNA, 25 bp, E. coli
tataaaggcgtaagagtcagggaaa

SEQ ID NO: 84285 - DNA, 25 bp, E. coli
gggttcctgacacagcaaaaaacag

SEQ ID NO: 84286 - DNA, 25 bp, E. coli
gagaagttgaaatgaaatatccgac

SEQ ID NO: 84287 - DNA, 25 bp, E. coli
gggttcctgacagagcaaaaaacag

SEQ ID NO: 84288 - DNA, 25 bp, E. coli
gagaagttgaaaagaaatatccgac

SEQ ID NO: 84289 - DNA, 25 bp, E. coli
aagtacttaagctgactggcgcacg

SEQ ID NO: 84290 - DNA, 25 bp, E. coli
aagtacttaagcagactggcgcacg

SEQ ID NO: 84291 - DNA, 25 bp, E. coli
tacttaagctgagtggcgcacgcgg

SEQ ID NO: 84292 - DNA, 25 bp, E. coli
tacttaagctgactggcgcacgcgg

SEQ ID NO: 84293 - DNA, 25 bp, E. coli
aaaaagtacttaagctgactggcgc

SEQ ID NO: 84294 - DNA, 25 bp, E. coli
aaaaagtacttatgctgactggcgc

SEQ ID NO: 84295 - DNA, 25 bp, E. coli
tatcggtcctggtgcaggtgtacat

SEQ ID NO: 84296 - DNA, 25 bp, E. coli
tatcggtcctggagcaggtgtacat

SEQ ID NO: 84297 - DNA, 25 bp, E. coli
ttggtctgacgtacattcgcttggg

SEQ ID NO: 84298 - DNA, 25 bp, E. coli
ttgttgtacgccggcgtcggcgaac

SEQ ID NO: 84299 - DNA, 25 bp, E. coli
ttggtctgacgttcattcgcttggg

SEQ ID NO: 84300 - DNA, 25 bp, E. coli
ttgttgtacgcccgcgtcggcgaac

SEQ ID NO: 84301 - DNA, 25 bp, E. coli
tgcgtttgttgtacgcccgcgtcgg

SEQ ID NO: 84302 - DNA, 25 bp, E. coli
tgcgtttgttgttcgcccgcgtcgg

SEQ ID NO: 84303 - DNA, 25 bp, E. coli
ccggaaaaagtacttaagctgactg

SEQ ID NO: 84304 - DNA, 25 bp, E. coli
ccggaaaaagtagttaagctgactg

SEQ ID NO: 84305 - DNA, 25 bp, E. coli
cgatatcggtcctggtgcaggtgta

SEQ ID NO: 84306 - DNA, 25 bp, E. coli
cgatatcggtccaggtgcaggtgta

SEQ ID NO: 84307 - DNA, 25 bp, E. coli
cgttggtctgacctacattcgcttg

SEQ ID NO: 84308 - DNA, 25 bp, E. coli
cgttggtctgacgtacattcgcttg

SEQ ID NO: 84309 - DNA, 25 bp, E. coli
gtgcaggtgtacttggcggtgaagt

SEQ ID NO: 84310 - DNA, 25 bp, E. coli
gtgcaggtgtacatggcggtgaagt

SEQ ID NO: 84311 - DNA, 25 bp, E. coli
cagatgccgctgctactggtagcaa

SEQ ID NO: 84312 - DNA, 25 bp, E. coli
cagatgccgctggtactggtagcaa

SEQ ID NO: 84313 - DNA, 25 bp, E. coli
taaagagattttctatcgcgcggcg

SEQ ID NO: 84314 - DNA, 25 bp, E. coli
taaagagattttgtatcgcgcggcg

SEQ ID NO: 84315 - DNA, 25 bp, E. coli
ttacgtgccagtcggatccagaccg

SEQ ID NO: 84316 - DNA, 25 bp, E. coli
ttacgtgccagtgggatccagaccg

SEQ ID NO: 84317 - DNA, 25 bp, E. coli
ttattcgtacgctgcgcgtcgcggc

SEQ ID NO: 84318 - DNA, 25 bp, E. coli
ttattcgtacgcagcgcgtcgcggc

SEQ ID NO: 84319 - DNA, 25 bp, E. coli
tgatcaccgcagatatacctttggc

SEQ ID NO: 84320 - DNA, 25 bp, E. coli
tgatcaccgcagttatacctttggc

SEQ ID NO: 84321 - DNA, 25 bp, E. coli
gcaaaccagagtttacgcgtgccgc

SEQ ID NO: 84322 - DNA, 25 bp, E. coli
gcaaaccagagtatacgcgtgccgc

SEQ ID NO: 84323 - DNA, 25 bp, E. coli
tgacaatttgggtggatgccgacgc

SEQ ID NO: 84324 - DNA, 25 bp, E. coli
tgacaatttgggaggatgccgacgc

SEQ ID NO: 84325 - DNA, 25 bp, E. coli
gataacgaaattctccggcagtgtg

SEQ ID NO: 84326 - DNA, 25 bp, E. coli
ggattacccaacaaaggatgacttt

SEQ ID NO: 84327 - DNA, 25 bp, E. coli
ggattacccaactaaggatgacttt

SEQ ID NO: 84328 - DNA, 25 bp, E. coli
gatgccgacgcgtgtcccaatgtaa

SEQ ID NO: 84329 - DNA, 25 bp, E. coli
gacgatgcgcgattttatggatacc

SEQ ID NO: 84330 - DNA, 25 bp, E. coli
gacgatgcgcgaatttatggatacc

SEQ ID NO: 84331 - DNA, 25 bp, E. coli
gataacgaaattgtccggcagtgtg

SEQ ID NO: 84332 - DNA, 25 bp, E. coli
gatgccgacgcgagtcccaatgtaa

SEQ ID NO: 84333 - DNA, 25 bp, E. coli
taaacaaccgttcgatttcagcgtt

SEQ ID NO: 84334 - DNA, 25 bp, E. coli
taaacaaccgttggatttcagcgtt

SEQ ID NO: 84335 - DNA, 25 bp, E. coli
agtacgccctcgtaattatcgttgg

SEQ ID NO: 84336 - DNA, 25 bp, E. coli
agtacgccctcgaaattatcgttgg

SEQ ID NO: 84337 - DNA, 25 bp, E. coli
acagccgcactgagaggcagcggca

SEQ ID NO: 84338 - DNA, 25 bp, E. coli
acagccgcactgtgaggcagcggca

SEQ ID NO: 84339 - DNA, 25 bp, E. coli
tatcgttggcggtaaacaaccgttg

SEQ ID NO: 84340 - DNA, 25 bp, E. coli
tatcgttggcggaaaacaaccgttg

SEQ ID NO: 84341 - DNA, 25 bp, E. coli
tcgtaattatcgatggcggtaaaca

SEQ ID NO: 84342 - DNA, 25 bp, E. coli
tcgtaattatcgttggcggtaaaca

SEQ ID NO: 84343 - DNA, 25 bp, E. coli
tgccgaagagcgatcgggaagcccc

SEQ ID NO: 84344 - DNA, 25 bp, E. coli
tgccgaagagcgttcgggaagcccc

SEQ ID NO: 84345 - DNA, 25 bp, E. coli
gcaaatatataactacgccctcgta

SEQ ID NO: 84346 - DNA, 25 bp, E. coli
gcaaatatataagtacgccctcgta

SEQ ID NO: 84347 - DNA, 25 bp, E. coli
gcagcggcaaatatataagtacgcc

SEQ ID NO: 84348 - DNA, 25 bp, E. coli
gcactgagaggcagcggcaaatata

SEQ ID NO: 84349 - DNA, 25 bp, E. coli
gcagcggcaaatttataagtacgcc

SEQ ID NO: 84350 - DNA, 25 bp, E. coli
gcactgagaggctgcggcaaatata

SEQ ID NO: 84351 - DNA, 25 bp, E. coli
gccctcgtaattttcgttggcggta

SEQ ID NO: 84352 - DNA, 25 bp, E. coli
gccctcgtaattatcgttggcggta

SEQ ID NO: 84353 - DNA, 25 bp, E. coli
gaggcagcggcatatatataagtac

SEQ ID NO: 84354 - DNA, 25 bp, E. coli
gaggcagcggcaaatatataagtac

SEQ ID NO: 84355 - DNA, 25 bp, E. coli
taaattcgctgaggttgcgtgcgca

SEQ ID NO: 84356 - DNA, 25 bp, E. coli
taaagattacctcgacggcgttgac

SEQ ID NO: 84357 - DNA, 25 bp, E. coli
taaagattacctggacggcgttgac

SEQ ID NO: 84358 - DNA, 25 bp, E. coli
taaattcgctgacgttgcgtgcgca

SEQ ID NO: 84359 - DNA, 25 bp, E. coli
taaatccctgtaggaagctgacctg

SEQ ID NO: 84360 - DNA, 25 bp, E. coli
taaatccctgtacgaagctgacctg

SEQ ID NO: 84361 - DNA, 25 bp, E. coli
tatccgtgcggatctgaacgtacca

SEQ ID NO: 84362 - DNA, 25 bp, E. coli
tatccgtgcggaactgaacgtacca

SEQ ID NO: 84363 - DNA, 25 bp, E. coli
tgtccaaaaaattcgctgcactgtg

SEQ ID NO: 84364 - DNA, 25 bp, E. coli
tgtccaaaaaatacgctgcactgtg

SEQ ID NO: 84365 - DNA, 25 bp, E. coli
tccgcaaaggtactgaaatcgtggc

SEQ ID NO: 84366 - DNA, 25 bp, E. coli
tccgcaaaggtagtgaaatcgtggc

SEQ ID NO: 84367 - DNA, 25 bp, E. coli
tcgtggctaacggtatcgcagacag

SEQ ID NO: 84368 - DNA, 25 bp, E. coli
tcgtggctaacgctatcgcagacag

SEQ ID NO: 84369 - DNA, 25 bp, E. coli
gcgcgcaggcttgtactcacggtat

SEQ ID NO: 84370 - DNA, 25 bp, E. coli
ccgatctggatcatgctgggaaacg

SEQ ID NO: 84371 - DNA, 25 bp, E. coli
gcgcgcaggcttctactcacggtat

SEQ ID NO: 84372 - DNA, 25 bp, E. coli
gaagaattctctgtgctgccggttg

SEQ ID NO: 84373 - DNA, 25 bp, E. coli
gaagaattctctctgctgccggttg

SEQ ID NO: 84374 - DNA, 25 bp, E. coli
ccgatctggatcttgctgggaaacg

SEQ ID NO: 84375 - DNA, 25 bp, E. coli
gatatcggtgatgcttccgctcagg

SEQ ID NO: 84376 - DNA, 25 bp, E. coli
gatatcggtgatccttccgctcagg

SEQ ID NO: 84377 - DNA, 25 bp, E. coli
taaaggtggttttaagcacaagcac

SEQ ID NO: 84378 - DNA, 25 bp, E. coli
taaaggtggtttaaagcacaagcac

SEQ ID NO: 84379 - DNA, 25 bp, E. coli
aaattaagaccgtacgcggtgctgc

SEQ ID NO: 84380 - DNA, 25 bp, E. coli
aaattaagaccgaacgcggtgctgc

SEQ ID NO: 84381 - DNA, 25 bp, E. coli
tacgcggtgctggtaagcgcttcaa

SEQ ID NO: 84382 - DNA, 25 bp, E. coli
tacgcggtgctgctaagcgcttcaa

SEQ ID NO: 84383 - DNA, 25 bp, E. coli
ttaagcacaagcacgctaacctgcg

SEQ ID NO: 84384 - DNA, 25 bp, E. coli
ttaagcacaagctcgctaacctgcg

SEQ ID NO: 84385 - DNA, 25 bp, E. coli
tgctaagcgcttcaaaaaaaccggt

SEQ ID NO: 84386 - DNA, 25 bp, E. coli
tgctaagcgcttgaaaaaaaccggt

SEQ ID NO: 84387 - DNA, 25 bp, E. coli
tgccaaaaattaagaccgtacgcgg

SEQ ID NO: 84388 - DNA, 25 bp, E. coli
tgccaaaaattatgaccgtacgcgg

SEQ ID NO: 84389 - DNA, 25 bp, E. coli
gctaacctgcgtgacattctgacca

SEQ ID NO: 84390 - DNA, 25 bp, E. coli
gctaacctgcgtcacattctgacca

SEQ ID NO: 84391 - DNA, 25 bp, E. coli
cggtgctgctaaccgcttcaaaaaa

SEQ ID NO: 84392 - DNA, 25 bp, E. coli
cggtgctgctaagcgcttcaaaaaa

SEQ ID NO: 84393 - DNA, 25 bp, E. coli
tctgaccaaaaatgcgaccaaacgt

SEQ ID NO: 84394 - DNA, 25 bp, E. coli
tctgaccaaaaaagcgaccaaacgt

SEQ ID NO: 84395 - DNA, 25 bp, E. coli
tggttttaagcagaagcacgctaac

SEQ ID NO: 84396 - DNA, 25 bp, E. coli
tggttttaagcacaagcacgctaac

SEQ ID NO: 84397 - DNA, 25 bp, E. coli
tcacattctgaccaaaaaagcgacc

SEQ ID NO: 84398 - DNA, 25 bp, E. coli
tcacattctgacgaaaaaagcgacc

SEQ ID NO: 84399 - DNA, 25 bp, E. coli
cactgccaggacagataacagaaaa

SEQ ID NO: 84400 - DNA, 25 bp, E. coli
cactgccaggactgataacagaaaa

SEQ ID NO: 84401 - DNA, 25 bp, E. coli
tattccggatatcgtggatacaccg

SEQ ID NO: 84402 - DNA, 25 bp, E. coli
tattccggatatggtggatacaccg

SEQ ID NO: 84403 - DNA, 25 bp, E. coli
ttgctgcagcattttccggatatcg

SEQ ID NO: 84404 - DNA, 25 bp, E. coli
ttttgctgcgaggatcccactgcca

SEQ ID NO: 84405 - DNA, 25 bp, E. coli
ttttgctgcgagcatcccactgcca

SEQ ID NO: 84406 - DNA, 25 bp, E. coli
ttgctgcagcatattccggatatcg

SEQ ID NO: 84407 - DNA, 25 bp, E. coli
tcatttttattcctacgggtcttat

SEQ ID NO: 84408 - DNA, 25 bp, E. coli
tcatttttattcgtacgggtcttat

SEQ ID NO: 84409 - DNA, 25 bp, E. coli
gcgtcttttcatttttattcctacg

SEQ ID NO: 84410 - DNA, 25 bp, E. coli
gcgtcttttcatatttattcctacg

SEQ ID NO: 84411 - DNA, 25 bp, E. coli
gatatcgtggatacaccgtcactaa

SEQ ID NO: 84412 - DNA, 25 bp, E. coli
gatatcgtggattcaccgtcactaa

SEQ ID NO: 84413 - DNA, 25 bp, E. coli
ggatacaccgtcactaattgccggg

SEQ ID NO: 84414 - DNA, 25 bp, E. coli
gggctcatcagctttttgctgcgag

SEQ ID NO: 84415 - DNA, 25 bp, E. coli
ggatacaccgtctctaattgccggg

SEQ ID NO: 84416 - DNA, 25 bp, E. coli
gggctcatcagcattttgctgcgag

SEQ ID NO: 84417 - DNA, 25 bp, E. coli
tcagctttttgcagcgagcatccca

SEQ ID NO: 84418 - DNA, 25 bp, E. coli
tcagctttttgctgcgagcatccca

SEQ ID NO: 84419 - DNA, 25 bp, E. coli
gagcatcccactgccaggacagata

SEQ ID NO: 84420 - DNA, 25 bp, E. coli
gagcatcccactcccaggacagata

SEQ ID NO: 84421 - DNA, 25 bp, E. coli
caattcgcgggcaggtgctggcttc

SEQ ID NO: 84422 - DNA, 25 bp, E. coli
caattcgcgggctggtgctggcttc

SEQ ID NO: 84423 - DNA, 25 bp, E. coli
cactcgtgcgtgatgccggatttga

SEQ ID NO: 84424 - DNA, 25 bp, E. coli
cactcgtgcgtgttgccggatttga

SEQ ID NO: 84425 - DNA, 25 bp, E. coli
tacagcgagttaaatgttgcacagg

SEQ ID NO: 84426 - DNA, 25 bp, E. coli
tacagcgagttatatgttgcacagg

SEQ ID NO: 84427 - DNA, 25 bp, E. coli
agcctgccgtaagcgatattttgtt

SEQ ID NO: 84428 - DNA, 25 bp, E. coli
agcctgccgtaaccgatattttgtt

SEQ ID NO: 84429 - DNA, 25 bp, E. coli
tatgtgaaaggacgctatttgaccc

SEQ ID NO: 84430 - DNA, 25 bp, E. coli
tatgtgaaaggaggctatttgaccc

SEQ ID NO: 84431 - DNA, 25 bp, E. coli
ttcgcgggctggagctggcttctcc

SEQ ID NO: 84432 - DNA, 25 bp, E. coli
ttcgcgggctggtgctggcttctcc

SEQ ID NO: 84433 - DNA, 25 bp, E. coli
gcaaacgagcctgccgtaagcgata

SEQ ID NO: 84434 - DNA, 25 bp, E. coli
gcaaacgagcctcccgtaagcgata

SEQ ID NO: 84435 - DNA, 25 bp, E. coli
gaaaggacgctaattgacccacgat

SEQ ID NO: 84436 - DNA, 25 bp, E. coli
gaaaggacgctatttgacccacgat

SEQ ID NO: 84437 - DNA, 25 bp, E. coli
cgagcctgccgttagcgatattttg

SEQ ID NO: 84438 - DNA, 25 bp, E. coli
cgagcctgccgtaagcgatattttg

SEQ ID NO: 84439 - DNA, 25 bp, E. coli
ggctggtgctgggttctccggcctt

SEQ ID NO: 84440 - DNA, 25 bp, E. coli
ggacgctatttgtcccacgatcggc

SEQ ID NO: 84441 - DNA, 25 bp, E. coli
ggacgctatttgacccacgatcggc

SEQ ID NO: 84442 - DNA, 25 bp, E. coli
ggctggtgctggcttctccggcctt

SEQ ID NO: 84443 - DNA, 25 bp, E. coli
catgggccaatgtcgtgcggacaat

SEQ ID NO: 84444 - DNA, 25 bp, E. coli
catgggccaatgacgtgcggacaat

SEQ ID NO: 84445 - DNA, 25 bp, E. coli
aaatgtttgggcctctccagcggga

SEQ ID NO: 84446 - DNA, 25 bp, E. coli
aaatgtttgggcgtctccagcggga

SEQ ID NO: 84447 - DNA, 25 bp, E. coli
tgttcagtgcgataaaacgccagtg

SEQ ID NO: 84448 - DNA, 25 bp, E. coli
tgttcagtgcgaaaaaacgccagtg

SEQ ID NO: 84449 - DNA, 25 bp, E. coli
tgtggaaaaactcgaagcagctgct

SEQ ID NO: 84450 - DNA, 25 bp, E. coli
tgtggaaaaactggaagcagctgct

SEQ ID NO: 84451 - DNA, 25 bp, E. coli
gccattgaaactttccggcgtcaga

SEQ ID NO: 84452 - DNA, 25 bp, E. coli
gccattgaaactatccggcgtcaga

SEQ ID NO: 84453 - DNA, 25 bp, E. coli
gcggcggcgcgtgagtcatataaac

SEQ ID NO: 84454 - DNA, 25 bp, E. coli
gcggcggcgcgtcagtcatataaac

SEQ ID NO: 84455 - DNA, 25 bp, E. coli
gaaatcggctatagcagaactggcg

SEQ ID NO: 84456 - DNA, 25 bp, E. coli
gaaatcggctattgcagaactggcg

SEQ ID NO: 84457 - DNA, 25 bp, E. coli
gaaagaacccaagtggactgcatgg

SEQ ID NO: 84458 - DNA, 25 bp, E. coli
gaaagaacccaactggactgcatgg

SEQ ID NO: 84459 - DNA, 25 bp, E. coli
ggacactgaaattccgccgggattc

SEQ ID NO: 84460 - DNA, 25 bp, E. coli
gtgagtctttaccagcaggcggcca

SEQ ID NO: 84461 - DNA, 25 bp, E. coli
gtgagtctttacgagcaggcggcca

SEQ ID NO: 84462 - DNA, 25 bp, E. coli
ggacactgaaataccgccgggattc

SEQ ID NO: 84463 - DNA, 25 bp, E. coli
gatgatggcgagatcacgagaccga

SEQ ID NO: 84464 - DNA, 25 bp, E. coli
gatgatggcgagttcacgagaccga

SEQ ID NO: 84465 - DNA, 25 bp, E. coli
caataccagtagtaacagacgaaga

SEQ ID NO: 84466 - DNA, 25 bp, E. coli
caataccagtagaaacagacgaaga

SEQ ID NO: 84467 - DNA, 25 bp, E. coli
agacgaagaatttcatacgttagcc

SEQ ID NO: 84468 - DNA, 25 bp, E. coli
agacgaagaattacatacgttagcc

SEQ ID NO: 84469 - DNA, 25 bp, E. coli
taccagtagaaacagacgaagaatt

SEQ ID NO: 84470 - DNA, 25 bp, E. coli
taccagtagaaagagacgaagaatt

SEQ ID NO: 84471 - DNA, 25 bp, E. coli
tttgtgccaatagcagtagaaacag

SEQ ID NO: 84472 - DNA, 25 bp, E. coli
tttgtgccaataccagtagaaacag

SEQ ID NO: 84473 - DNA, 25 bp, E. coli
tgtgccaatacctgtagaaacagac

SEQ ID NO: 84474 - DNA, 25 bp, E. coli
tgtgccaataccagtagaaacagac

SEQ ID NO: 84475 - DNA, 25 bp, E. coli
tgccaataccagtagaaacagacga

SEQ ID NO: 84476 - DNA, 25 bp, E. coli
tgccaataccagaagaaacagacga

SEQ ID NO: 84477 - DNA, 25 bp, E. coli
tcaggtttgtgcgaataccagtaga

SEQ ID NO: 84478 - DNA, 25 bp, E. coli
tcaggtttgtgccaataccagtaga

SEQ ID NO: 84479 - DNA, 25 bp, E. coli
gaaacagacgaacaatttcatacgt

SEQ ID NO: 84480 - DNA, 25 bp, E. coli
gaaacagacgaagaatttcatacgt

SEQ ID NO: 84481 - DNA, 25 bp, E. coli
ccagtagaaacagacgaagaatttc

SEQ ID NO: 84482 - DNA, 25 bp, E. coli
ccaataccagtagaaacagacgaag

SEQ ID NO: 84483 - DNA, 25 bp, E. coli
ccagtagaaacacacgaagaatttc

SEQ ID NO: 84484 - DNA, 25 bp, E. coli
ccaataccagtacaaacagacgaag

SEQ ID NO: 84485 - DNA, 25 bp, E. coli
ggtttgtgccaaaaccagtagaaac

SEQ ID NO: 84486 - DNA, 25 bp, E. coli
ggtttgtgccaataccagtagaaac

SEQ ID NO: 84487 - DNA, 25 bp, E. coli
accgattcggtttccagcgtgcaga

SEQ ID NO: 84488 - DNA, 25 bp, E. coli
accgattcggttaccagcgtgcaga

SEQ ID NO: 84489 - DNA, 25 bp, E. coli
aactggtggatgctcgcttcccgga

SEQ ID NO: 84490 - DNA, 25 bp, E. coli
aactggtggatggtcgcttcccgga

SEQ ID NO: 84491 - DNA, 25 bp, E. coli
aactgatgcgtatgctcgacggcgg

SEQ ID NO: 84492 - DNA, 25 bp, E. coli
aactgatgcgtaagctcgacggcgg

SEQ ID NO: 84493 - DNA, 25 bp, E. coli
tttctatggcgcttcaggacgttcg

SEQ ID NO: 84494 - DNA, 25 bp, E. coli
tttctatggcgcatcaggacgttcg

SEQ ID NO: 84495 - DNA, 25 bp, E. coli
tttcccgaacctggatgactggcag

SEQ ID NO: 84496 - DNA, 25 bp, E. coli
tttcccgaacctcgatgactggcag

SEQ ID NO: 84497 - DNA, 25 bp, E. coli
tctttgccaagccattcggtgatcg

SEQ ID NO: 84498 - DNA, 25 bp, E. coli
tctttgccaagcgattcggtgatcg

SEQ ID NO: 84499 - DNA, 25 bp, E. coli
gctacaacaggtgagcggtccgtta

SEQ ID NO: 84500 - DNA, 25 bp, E. coli
gctacaacaggtcagcggtccgtta

SEQ ID NO: 84501 - DNA, 25 bp, E. coli
gaagtcgaattttccctgccgcagg

SEQ ID NO: 84502 - DNA, 25 bp, E. coli
gaagtcgaatttaccctgccgcagg

SEQ ID NO: 84503 - DNA, 25 bp, E. coli
cgctgaccggtagtgatctcgagat

SEQ ID NO: 84504 - DNA, 25 bp, E. coli
cgctgaccggtactgatctcgagat

SEQ ID NO: 84505 - DNA, 25 bp, E. coli
gatatctgccgtcgtctgcctgaag

SEQ ID NO: 84506 - DNA, 25 bp, E. coli
gatatctgccgtggtctgcctgaag

SEQ ID NO: 84507 - DNA, 25 bp, E. coli
gagatcctcgaccttacctatagcg

SEQ ID NO: 84508 - DNA, 25 bp, E. coli
gagatcctcgacgttacctatagcg

SEQ ID NO: 84509 - DNA, 25 bp, E. coli
caaattgggtgcaatgacgctggcg

SEQ ID NO: 84510 - DNA, 25 bp, E. coli
caaattgggtgctatgacgctggcg

SEQ ID NO: 84511 - DNA, 25 bp, E. coli
ctactttaacgtccgcgagatcccg

SEQ ID NO: 84512 - DNA, 25 bp, E. coli
cagtgcgcagaaaaacggtaatcca

SEQ ID NO: 84513 - DNA, 25 bp, E. coli
cagtgcgcagaataacggtaatcca

SEQ ID NO: 84514 - DNA, 25 bp, E. coli
ctactttaacgtgcgcgagatcccg

SEQ ID NO: 84515 - DNA, 25 bp, E. coli
tacgtcaacgactttggcgcacgga

SEQ ID NO: 84516 - DNA, 25 bp, E. coli
tacgtcaacgacattggcgcacgga

SEQ ID NO: 84517 - DNA, 25 bp, E. coli
tacgtgattatcagcaacgccagtg

SEQ ID NO: 84518 - DNA, 25 bp, E. coli
cattgagccgaaaaccacggtaccg

SEQ ID NO: 84519 - DNA, 25 bp, E. coli
cattgagccgaataccacggtaccg

SEQ ID NO: 84520 - DNA, 25 bp, E. coli
aaagggtaacaagatcacctcgccg

SEQ ID NO: 84521 - DNA, 25 bp, E. coli
aaagggtaacaacatcacctcgccg

SEQ ID NO: 84522 - DNA, 25 bp, E. coli
tacgtgattatctgcaacgccagtg

SEQ ID NO: 84523 - DNA, 25 bp, E. coli
tcagtatgaaaagtccgtggcagca

SEQ ID NO: 84524 - DNA, 25 bp, E. coli
gccagccgatcgtgaaagcatgttc

SEQ ID NO: 84525 - DNA, 25 bp, E. coli
gccagccgatcgagaaagcatgttc

SEQ ID NO: 84526 - DNA, 25 bp, E. coli
ggatgccgctgttcttccagtgcaa

SEQ ID NO: 84527 - DNA, 25 bp, E. coli
ggatgccgctgtacttccagtgcaa

SEQ ID NO: 84528 - DNA, 25 bp, E. coli
tcagtatgaaaactccgtggcagca

SEQ ID NO: 84529 - DNA, 25 bp, E. coli
taatccagctgcagggttctcgcct

SEQ ID NO: 84530 - DNA, 25 bp, E. coli
taatccagctgctgggttctcgcct

SEQ ID NO: 84531 - DNA, 25 bp, E. coli
taaacgggccgaaagacagtcatca

SEQ ID NO: 84532 - DNA, 25 bp, E. coli
taaagctcagaggattgttgcagac

SEQ ID NO: 84533 - DNA, 25 bp, E. coli
taaacgggccgatagacagtcatca

SEQ ID NO: 84534 - DNA, 25 bp, E. coli
tacggaaatgctaaaatcgagagcc

SEQ ID NO: 84535 - DNA, 25 bp, E. coli
taaagctcagagcattgttgcagac

SEQ ID NO: 84536 - DNA, 25 bp, E. coli
tacggaaatgcttaaatcgagagcc

SEQ ID NO: 84537 - DNA, 25 bp, E. coli
tatagcaagatcctactatggcgct

SEQ ID NO: 84538 - DNA, 25 bp, E. coli
tatagcaagatcgtactatggcgct

SEQ ID NO: 84539 - DNA, 25 bp, E. coli
tgcgattctaactactgagaggctc

SEQ ID NO: 84540 - DNA, 25 bp, E. coli
tgcgattctaacaactgagaggctc

SEQ ID NO: 84541 - DNA, 25 bp, E. coli
tcatcaacgtaaagacgaaatcggc

SEQ ID NO: 84542 - DNA, 25 bp, E. coli
tcttgccttgtatggtaaacgggcc

SEQ ID NO: 84543 - DNA, 25 bp, E. coli
tcttgccttgtaaggtaaacgggcc

SEQ ID NO: 84544 - DNA, 25 bp, E. coli
tcatcaacgtaatgacgaaatcggc

SEQ ID NO: 84545 - DNA, 25 bp, E. coli
gcacatgccggttaatagtcaagat

SEQ ID NO: 84546 - DNA, 25 bp, E. coli
gcacatgccggtaaatagtcaagat

SEQ ID NO: 84547 - DNA, 25 bp, E. coli
cgaaatcggctatcgaaatgctata

SEQ ID NO: 84548 - DNA, 25 bp, E. coli
cgaaatcggctaacgaaatgctata

SEQ ID NO: 84549 - DNA, 25 bp, E. coli
gatcaatcggtcacttctaaacagt

SEQ ID NO: 84550 - DNA, 25 bp, E. coli
gatcaatcggtctcttctaaacagt

SEQ ID NO: 84551 - DNA, 25 bp, E. coli
gaggctctttgctaagtgtacggaa

SEQ ID NO: 84552 - DNA, 25 bp, E. coli
gaggctctttgcaaagtgtacggaa

SEQ ID NO: 84553 - DNA, 25 bp, E. coli
cactggctttcaagctgtaagacgc

SEQ ID NO: 84554 - DNA, 25 bp, E. coli
cactggctttcatgctgtaagacgc

SEQ ID NO: 84555 - DNA, 25 bp, E. coli
cagattgattacatggcaaagcccg

SEQ ID NO: 84556 - DNA, 25 bp, E. coli
catcaaatgttcgtccccagtggga

SEQ ID NO: 84557 - DNA, 25 bp, E. coli
cagattgattacttggcaaagcccg

SEQ ID NO: 84558 - DNA, 25 bp, E. coli
catccagagccaaaagagaaagcgg

SEQ ID NO: 84559 - DNA, 25 bp, E. coli
catcaaatgttcctccccagtggga

SEQ ID NO: 84560 - DNA, 25 bp, E. coli
catccagagccataagagaaagcgg

SEQ ID NO: 84561 - DNA, 25 bp, E. coli
agagcacgagtgagagcatccagag

SEQ ID NO: 84562 - DNA, 25 bp, E. coli
agagcacgagtgtgagcatccagag

SEQ ID NO: 84563 - DNA, 25 bp, E. coli
ttgtcagcaaatgggtaacactggc

SEQ ID NO: 84564 - DNA, 25 bp, E. coli
ttgtcagcaaatcggtaacactggc

SEQ ID NO: 84565 - DNA, 25 bp, E. coli
tcagagccgcatgtacacgcaataa

SEQ ID NO: 84566 - DNA, 25 bp, E. coli
gccgttcaggcaacaaggaaagaca

SEQ ID NO: 84567 - DNA, 25 bp, E. coli
gccgttcaggcatcaaggaaagaca

SEQ ID NO: 84568 - DNA, 25 bp, E. coli
taagcgacagatacagcgtacattg

SEQ ID NO: 84569 - DNA, 25 bp, E. coli
taagcgacagattcagcgtacattg

SEQ ID NO: 84570 - DNA, 25 bp, E. coli
tcagagccgcatctacacgcaataa

SEQ ID NO: 84571 - DNA, 25 bp, E. coli
taatgggcaagcaggcaaaattgtc

SEQ ID NO: 84572 - DNA, 25 bp, E. coli
taatgggcaagctggcaaaattgtc

SEQ ID NO: 84573 - DNA, 25 bp, E. coli
tcaccaaagagggagagacagagcg

SEQ ID NO: 84574 - DNA, 25 bp, E. coli
tcaccaaagaggcagagacagagcg

SEQ ID NO: 84575 - DNA, 25 bp, E. coli
caattagggcaaccaaactcagcgg

SEQ ID NO: 84576 - DNA, 25 bp, E. coli
caattttgcaggagatggcagcggc

SEQ ID NO: 84577 - DNA, 25 bp, E. coli
caattagggcaagcaaactcagcgg

SEQ ID NO: 84578 - DNA, 25 bp, E. coli
caattttgcaggtgatggcagcggc

SEQ ID NO: 84579 - DNA, 25 bp, E. coli
caacgggattgcctgtttgtccgac

SEQ ID NO: 84580 - DNA, 25 bp, E. coli
caacgggattgcgtgtttgtccgac

SEQ ID NO: 84581 - DNA, 25 bp, E. coli
catgtaaaaacacctcccggaggag

SEQ ID NO: 84582 - DNA, 25 bp, E. coli
catgtaaaaacagctcccggaggag

SEQ ID NO: 84583 - DNA, 25 bp, E. coli
taacggattccaccttacgtgccag

SEQ ID NO: 84584 - DNA, 25 bp, E. coli
tgaaagccacgtgggaagaactcgc

SEQ ID NO: 84585 - DNA, 25 bp, E. coli
tgaaagccacgtcggaagaactcgc

SEQ ID NO: 84586 - DNA, 25 bp, E. coli
cctgacggaagatggcgagcgttat

SEQ ID NO: 84587 - DNA, 25 bp, E. coli
cctgacggaagaaggcgagcgttat

SEQ ID NO: 84588 - DNA, 25 bp, E. coli
gaaaagtggatgacgcgatacgcgc

SEQ ID NO: 84589 - DNA, 25 bp, E. coli
gaaaagtggatgtcgcgatacgcgc

SEQ ID NO: 84590 - DNA, 25 bp, E. coli
ctacgggaagcctgaaacgatcgac

SEQ ID NO: 84591 - DNA, 25 bp, E. coli
ctacgggaagccagaaacgatcgac

SEQ ID NO: 84592 - DNA, 25 bp, E. coli
gttagcctgcttaatcggaccacgc

SEQ ID NO: 84593 - DNA, 25 bp, E. coli
gttagcctgctttatcggaccacgc

SEQ ID NO: 84594 - DNA, 25 bp, E. coli
ggtaagtacgcgcatccgggctttt

SEQ ID NO: 84595 - DNA, 25 bp, E. coli
ggtaagtacgcggatccgggctttt

SEQ ID NO: 84596 - DNA, 25 bp, E. coli
taacggattccagcttacgtgccag

SEQ ID NO: 84597 - DNA, 25 bp, E. coli
caaaaatcgttgctgttgtgggcat

SEQ ID NO: 84598 - DNA, 25 bp, E. coli
caaaaatcgttggtgttgtgggcat

SEQ ID NO: 84599 - DNA, 25 bp, E. coli
aacatgcccttgaggacagcctgga

SEQ ID NO: 84600 - DNA, 25 bp, E. coli
aacatgcccttgtggacagcctgga

SEQ ID NO: 84601 - DNA, 25 bp, E. coli
taccaccttgtatggcaacatgccc

SEQ ID NO: 84602 - DNA, 25 bp, E. coli
taggtttggtgcataacagcctgca

SEQ ID NO: 84603 - DNA, 25 bp, E. coli
taccaccttgtaaggcaacatgccc

SEQ ID NO: 84604 - DNA, 25 bp, E. coli
taggtttggtgcttaacagcctgca

SEQ ID NO: 84605 - DNA, 25 bp, E. coli
tgttgcttttattgcgcctgcgcca

SEQ ID NO: 84606 - DNA, 25 bp, E. coli
tgttgcttttatagcgcctgcgcca

SEQ ID NO: 84607 - DNA, 25 bp, E. coli
tctgataggtttcctgactgcaggg

SEQ ID NO: 84608 - DNA, 25 bp, E. coli
tctgataggtttgctgactgcaggg

SEQ ID NO: 84609 - DNA, 25 bp, E. coli
gccgcgtaacgcaggtctggtgcct

SEQ ID NO: 84610 - DNA, 25 bp, E. coli
gccgcgtaacgctggtctggtgcct

SEQ ID NO: 84611 - DNA, 25 bp, E. coli
gctccaggtcgtgacaaaaatcgtt

SEQ ID NO: 84612 - DNA, 25 bp, E. coli
gctccaggtcgtcacaaaaatcgtt

SEQ ID NO: 84613 - DNA, 25 bp, E. coli
gacagcctggaagggtatcattgct

SEQ ID NO: 84614 - DNA, 25 bp, E. coli
gacagcctggaacggtatcattgct

SEQ ID NO: 84615 - DNA, 25 bp, E. coli
tggcagtattgccttatttaccacc

SEQ ID NO: 84616 - DNA, 25 bp, E. coli
tggcagtattgcgttatttaccacc

SEQ ID NO: 84617 - DNA, 25 bp, E. coli
gatgatcaaacgcaaaacaccatga

SEQ ID NO: 84618 - DNA, 25 bp, E. coli
gatgatcaaacggaaaacaccatga

SEQ ID NO: 84619 - DNA, 25 bp, E. coli
caaagccaacaatctcaaacgcaac

SEQ ID NO: 84620 - DNA, 25 bp, E. coli
caaagccaacaaactcaaacgcaac

SEQ ID NO: 84621 - DNA, 25 bp, E. coli
catagcgattctccatgaggaaaat

SEQ ID NO: 84622 - DNA, 25 bp, E. coli
catagcgattctgcatgaggaaaat

SEQ ID NO: 84623 - DNA, 25 bp, E. coli
aaataaaaaatggtggctgcctggg

SEQ ID NO: 84624 - DNA, 25 bp, E. coli
aaaaaatgctgggtgcctgggttaa

SEQ ID NO: 84625 - DNA, 25 bp, E. coli
aaataaaaaatgctggctgcctggg

SEQ ID NO: 84626 - DNA, 25 bp, E. coli
aaaaaatgctggctgcctgggttaa

SEQ ID NO: 84627 - DNA, 25 bp, E. coli
ttgcggacgtgagatagcgattctc

SEQ ID NO: 84628 - DNA, 25 bp, E. coli
ttgcggacgtgacatagcgattctc

SEQ ID NO: 84629 - DNA, 25 bp, E. coli
tgacatagcgatactccatgaggaa

SEQ ID NO: 84630 - DNA, 25 bp, E. coli
tgacatagcgattctccatgaggaa

SEQ ID NO: 84631 - DNA, 25 bp, E. coli
tgctggctgcctcggttaataccgg

SEQ ID NO: 84632 - DNA, 25 bp, E. coli
tgctggctgcctgggttaataccgg

SEQ ID NO: 84633 - DNA, 25 bp, E. coli
tctccatgaggaaaataaaaaatgc

SEQ ID NO: 84634 - DNA, 25 bp, E. coli
tctccatgaggataataaaaaatgc

SEQ ID NO: 84635 - DNA, 25 bp, E. coli
gccaaagccaactaactcaaacgca

SEQ ID NO: 84636 - DNA, 25 bp, E. coli
gccaaagccaacaaactcaaacgca

SEQ ID NO: 84637 - DNA, 25 bp, E. coli
ggacgtgacatagcgattctccatg

SEQ ID NO: 84638 - DNA, 25 bp, E. coli
ggtggctggcgaaaaataaatttat

SEQ ID NO: 84639 - DNA, 25 bp, E. coli
ggtggctggcgataaataaatttat

SEQ ID NO: 84640 - DNA, 25 bp, E. coli
ggacgtgacataccgattctccatg

SEQ ID NO: 84641 - DNA, 25 bp, E. coli
cacatttatgtctgcggcgacgcta

SEQ ID NO: 84642 - DNA, 25 bp, E. coli
cacatttatgtcagcggcgacgcta

SEQ ID NO: 84643 - DNA, 25 bp, E. coli
tatcagaacgatccggcactggtga

SEQ ID NO: 84644 - DNA, 25 bp, E. coli
tatcagaacgatgcggcactggtga

SEQ ID NO: 84645 - DNA, 25 bp, E. coli
tttacgtacaagacaaactgcgcga

SEQ ID NO: 84646 - DNA, 25 bp, E. coli
tttaagtgagctgcgcgtagagcgc

SEQ ID NO: 84647 - DNA, 25 bp, E. coli
tttacgtacaagtcaaactgcgcga

SEQ ID NO: 84648 - DNA, 25 bp, E. coli
tttaagtgagctccgcgtagagcgc

SEQ ID NO: 84649 - DNA, 25 bp, E. coli
tgtcaccgtcgacggcaaaacgttg

SEQ ID NO: 84650 - DNA, 25 bp, E. coli
tgtcaccgtcgagggcaaaacgttg

SEQ ID NO: 84651 - DNA, 25 bp, E. coli
tgaataccaggcagctgccagcgag

SEQ ID NO: 84652 - DNA, 25 bp, E. coli
tgaataccaggctgctgccagcgag

SEQ ID NO: 84653 - DNA, 25 bp, E. coli
tgaaaggcgatgaacctgtcaccgt

SEQ ID NO: 84654 - DNA, 25 bp, E. coli
tgaacgaagcgctacagtggcactt

SEQ ID NO: 84655 - DNA, 25 bp, E. coli
tgaacgaagcgcaacagtggcactt

SEQ ID NO: 84656 - DNA, 25 bp, E. coli
tgaaaggcgatgtacctgtcaccgt

SEQ ID NO: 84657 - DNA, 25 bp, E. coli
gaaagacgttgaccaggcacttctg

SEQ ID NO: 84658 - DNA, 25 bp, E. coli
gaacttgtcgaagtgctgtggctga

SEQ ID NO: 84659 - DNA, 25 bp, E. coli
gaacttgtcgaactgctgtggctga

SEQ ID NO: 84660 - DNA, 25 bp, E. coli
gaaagacgttgagcaggcacttctg

SEQ ID NO: 84661 - DNA, 25 bp, E. coli
gtaaatgaaatccacaccagcccgt

SEQ ID NO: 84662 - DNA, 25 bp, E. coli
gtaaatgaaatcgacaccagcccgt

SEQ ID NO: 84663 - DNA, 25 bp, E. coli
acgccggaggccgacggcattaacg

SEQ ID NO: 84664 - DNA, 25 bp, E. coli
acgccggaggcccacggcattaacg

SEQ ID NO: 84665 - DNA, 25 bp, E. coli
aactgattaacgaggcctgcggcaa

SEQ ID NO: 84666 - DNA, 25 bp, E. coli
aactgattaacgtggcctgcggcaa

SEQ ID NO: 84667 - DNA, 25 bp, E. coli
tatacgctgcagcacctcacatatc

SEQ ID NO: 84668 - DNA, 25 bp, E. coli
tatacgctgcaggacctcacatatc

SEQ ID NO: 84669 - DNA, 25 bp, E. coli
tgaccggaccgcaactgacagcatg

SEQ ID NO: 84670 - DNA, 25 bp, E. coli
tgaccggaccgctactgacagcatg

SEQ ID NO: 84671 - DNA, 25 bp, E. coli
tcattcatctggtcgccggcgcaga

SEQ ID NO: 84672 - DNA, 25 bp, E. coli
tcattcatctggacgccggcgcaga

SEQ ID NO: 84673 - DNA, 25 bp, E. coli
ccgacggcattatcgtacaggcgat

SEQ ID NO: 84674 - DNA, 25 bp, E. coli
ccgacggcattaacgtacaggcgat

SEQ ID NO: 84675 - DNA, 25 bp, E. coli
gcattaacgtacaggcgatgaacat

SEQ ID NO: 84676 - DNA, 25 bp, E. coli
gcattaacgtactggcgatgaacat

SEQ ID NO: 84677 - DNA, 25 bp, E. coli
gtcgatggtgttaattttgctgaac

SEQ ID NO: 84678 - DNA, 25 bp, E. coli
gtcgatggtgtttattttgctgaac

SEQ ID NO: 84679 - DNA, 25 bp, E. coli
ggcctgcggcaatggctactccctt

SEQ ID NO: 84680 - DNA, 25 bp, E. coli
ggcctgcggcaaaggctactccctt

SEQ ID NO: 84681 - DNA, 25 bp, E. coli
taattttgctgaactgattaacgtg

SEQ ID NO: 84682 - DNA, 25 bp, E. coli
taattttgctgatctgattaacgtg

SEQ ID NO: 84683 - DNA, 25 bp, E. coli
gagcggtatacgctgcagcacctca

SEQ ID NO: 84684 - DNA, 25 bp, E. coli
gagcggtatacggtgcagcacctca

SEQ ID NO: 84685 - DNA, 25 bp, E. coli
cagcacggcaatttaacaggagttt

SEQ ID NO: 84686 - DNA, 25 bp, E. coli
caggagtttttgtttgccaaaaatg

SEQ ID NO: 84687 - DNA, 25 bp, E. coli
caggagtttttgattgccaaaaatg

SEQ ID NO: 84688 - DNA, 25 bp, E. coli
catcgtagggcatacatctgttaac

SEQ ID NO: 84689 - DNA, 25 bp, E. coli
cagcacggcaatataacaggagttt

SEQ ID NO: 84690 - DNA, 25 bp, E. coli
catcgtagggcaaacatctgttaac

SEQ ID NO: 84691 - DNA, 25 bp, E. coli
taaaggaagctagatcgtagggcat

SEQ ID NO: 84692 - DNA, 25 bp, E. coli
taaaggaagctacatcgtagggcat

SEQ ID NO: 84693 - DNA, 25 bp, E. coli
tacatctgttaagcagcacggcaat

SEQ ID NO: 84694 - DNA, 25 bp, E. coli
tacatctgttaaccagcacggcaat

SEQ ID NO: 84695 - DNA, 25 bp, E. coli
aggcactgcgtgaaaaggcagagaa

SEQ ID NO: 84696 - DNA, 25 bp, E. coli
aggcactgcgtgtaaaggcagagaa

SEQ ID NO: 84697 - DNA, 25 bp, E. coli
tgccaaaaatggaaaggagaacccg

SEQ ID NO: 84698 - DNA, 25 bp, E. coli
tgccaaaaatggtaaggagaacccg

SEQ ID NO: 84699 - DNA, 25 bp, E. coli
gcgtgaaaaggctgagaaagcaact

SEQ ID NO: 84700 - DNA, 25 bp, E. coli
gcgtgaaaaggcagagaaagcaact

SEQ ID NO: 84701 - DNA, 25 bp, E. coli
ggcatacatctgataaccagcacgg

SEQ ID NO: 84702 - DNA, 25 bp, E. coli
ggcatacatctgttaaccagcacgg

SEQ ID NO: 84703 - DNA, 25 bp, E. coli
ggcagagaaagcaactaaaggaagc

SEQ ID NO: 84704 - DNA, 25 bp, E. coli
ggcagagaaagctactaaaggaagc

SEQ ID NO: 84705 - DNA, 25 bp, E. coli
taaccagcacgggaatttaacagga

SEQ ID NO: 84706 - DNA, 25 bp, E. coli
taaccagcacggcaatttaacagga

SEQ ID NO: 84707 - DNA, 25 bp, E. coli
aatgtggtaagtgcattcgcgccgc

SEQ ID NO: 84708 - DNA, 25 bp, E. coli
caatctttccaacaattgcgtaagt

SEQ ID NO: 84709 - DNA, 25 bp, E. coli
aatgtggtaagtccattcgcgccgc

SEQ ID NO: 84710 - DNA, 25 bp, E. coli
caatctttccaagaattgcgtaagt

SEQ ID NO: 84711 - DNA, 25 bp, E. coli
aaaaattcgccacgcagtccgtcag

SEQ ID NO: 84712 - DNA, 25 bp, E. coli
aaaaattcgccaggcagtccgtcag

SEQ ID NO: 84713 - DNA, 25 bp, E. coli
tgtttgtgtaatcgtgtaagtgaca

SEQ ID NO: 84714 - DNA, 25 bp, E. coli
tgcgtaagtttaatcctgtgggaaa

SEQ ID NO: 84715 - DNA, 25 bp, E. coli
tgcgtaagtttattcctgtgggaaa

SEQ ID NO: 84716 - DNA, 25 bp, E. coli
tgtttgtgtaatggtgtaagtgaca

SEQ ID NO: 84717 - DNA, 25 bp, E. coli
tcctgtgggaaaacaatgtggtaag

SEQ ID NO: 84718 - DNA, 25 bp, E. coli
tcctgtgggaaatcaatgtggtaag

SEQ ID NO: 84719 - DNA, 25 bp, E. coli
gccagaatttaatgagattgcctga

SEQ ID NO: 84720 - DNA, 25 bp, E. coli
gccagaatttaaagagattgcctga

SEQ ID NO: 84721 - DNA, 25 bp, E. coli
gcaggacgagttcatgcagatgcca

SEQ ID NO: 84722 - DNA, 25 bp, E. coli
gcaggacgagttgatgcagatgcca

SEQ ID NO: 84723 - DNA, 25 bp, E. coli
cgtcagtttcatccgcaatctttcc

SEQ ID NO: 84724 - DNA, 25 bp, E. coli
cgtcagtttcatgcgcaatctttcc

SEQ ID NO: 84725 - DNA, 25 bp, E. coli
ggcagtccgtcagtttcatccgcaa

SEQ ID NO: 84726 - DNA, 25 bp, E. coli
ggcagtccgtcactttcatccgcaa

SEQ ID NO: 84727 - DNA, 25 bp, E. coli
gatgcagatgcctgaatttaaagag

SEQ ID NO: 84728 - DNA, 25 bp, E. coli
gatgcagatgccagaatttaaagag

SEQ ID NO: 84729 - DNA, 25 bp, E. coli
caagtcaagcgaggttattggctgc

SEQ ID NO: 84730 - DNA, 25 bp, E. coli
caagtcaagcgacgttattggctgc

SEQ ID NO: 84731 - DNA, 25 bp, E. coli
caaagcgggatgaacaattatcgtc

SEQ ID NO: 84732 - DNA, 25 bp, E. coli
caaagcgggatgtacaattatcgtc

SEQ ID NO: 84733 - DNA, 25 bp, E. coli
catgcatttgcttttgggaaagaac

SEQ ID NO: 84734 - DNA, 25 bp, E. coli
catgcatttgctattgggaaagaac

SEQ ID NO: 84735 - DNA, 25 bp, E. coli
tatgtgtgcaccgagtaggatatcg

SEQ ID NO: 84736 - DNA, 25 bp, E. coli
tatgtgtgcacccagtaggatatcg

SEQ ID NO: 84737 - DNA, 25 bp, E. coli
tattgctcgctggtctggacgtaag

SEQ ID NO: 84738 - DNA, 25 bp, E. coli
tattgctcgctgctctggacgtaag

SEQ ID NO: 84739 - DNA, 25 bp, E. coli
tgatgaatgcataaggatagcctct

SEQ ID NO: 84740 - DNA, 25 bp, E. coli
tgatgaatgcattaggatagcctct

SEQ ID NO: 84741 - DNA, 25 bp, E. coli
tcactggaaggcgattctagattgc

SEQ ID NO: 84742 - DNA, 25 bp, E. coli
tcactggaaggccattctagattgc

SEQ ID NO: 84743 - DNA, 25 bp, E. coli
gactggttatgattcttcactggaa

SEQ ID NO: 84744 - DNA, 25 bp, E. coli
cgctttgcttgtaaactgaaggaca

SEQ ID NO: 84745 - DNA, 25 bp, E. coli
cgctttgcttgttaactgaaggaca

SEQ ID NO: 84746 - DNA, 25 bp, E. coli
ggaaattttagctttgccagcggat

SEQ ID NO: 84747 - DNA, 25 bp, E. coli
ggaaattttagcattgccagcggat

SEQ ID NO: 84748 - DNA, 25 bp, E. coli
tggaaagggcatacaaagatacggt

SEQ ID NO: 84749 - DNA, 25 bp, E. coli
tggaaagggcattcaaagatacggt

SEQ ID NO: 84750 - DNA, 25 bp, E. coli
gactggttatgaatcttcactggaa

SEQ ID NO: 84751 - DNA, 25 bp, E. coli
aagatgcataacttagattcgcaag

SEQ ID NO: 84752 - DNA, 25 bp, E. coli
aagatgcataacatagattcgcaag

SEQ ID NO: 84753 - DNA, 25 bp, E. coli
catgagatagttatctggaccgctc

SEQ ID NO: 84754 - DNA, 25 bp, E. coli
catgagatagttttctggaccgctc

SEQ ID NO: 84755 - DNA, 25 bp, E. coli
taaatgccttacacagaattatagc

SEQ ID NO: 84756 - DNA, 25 bp, E. coli
taaatgccttactcagaattatagc

SEQ ID NO: 84757 - DNA, 25 bp, E. coli
tatcacttctctcgtcatatcctag

SEQ ID NO: 84758 - DNA, 25 bp, E. coli
tatcacttctctggtcatatcctag

SEQ ID NO: 84759 - DNA, 25 bp, E. coli
ttagttaaacactcaaagagatctg

SEQ ID NO: 84760 - DNA, 25 bp, E. coli
ttagttaaacacacaaagagatctg

SEQ ID NO: 84761 - DNA, 25 bp, E. coli
tcccggcaaaataacaaaatcatgg

SEQ ID NO: 84762 - DNA, 25 bp, E. coli
tcccggcaaaattacaaaatcatgg

SEQ ID NO: 84763 - DNA, 25 bp, E. coli
tctggtcattcaaaaacaatttgcg

SEQ ID NO: 84764 - DNA, 25 bp, E. coli
tcagttgtggatggttcaaaattgc

SEQ ID NO: 84765 - DNA, 25 bp, E. coli
tctggtcattcataaacaatttgcg

SEQ ID NO: 84766 - DNA, 25 bp, E. coli
tcagttgtggatcgttcaaaattgc

SEQ ID NO: 84767 - DNA, 25 bp, E. coli
gattcgcaagatatcttctggtcat

SEQ ID NO: 84768 - DNA, 25 bp, E. coli
gattcgcaagatttcttctggtcat

SEQ ID NO: 84769 - DNA, 25 bp, E. coli
gattaatcgcaatttttcccggcaa

SEQ ID NO: 84770 - DNA, 25 bp, E. coli
gattaatcgcaaattttcccggcaa

SEQ ID NO: 84771 - DNA, 25 bp, E. coli
tggaccgctctctaccatgcaagat

SEQ ID NO: 84772 - DNA, 25 bp, E. coli
tggaccgctctcaaccatgcaagat

SEQ ID NO: 84773 - DNA, 25 bp, E. coli
caaatcgaccagagtaaacagtggg

SEQ ID NO: 84774 - DNA, 25 bp, E. coli
caaatcgaccagtgtaaacagtggg

SEQ ID NO: 84775 - DNA, 25 bp, E. coli
cattttcggctgataacctgttgcg

SEQ ID NO: 84776 - DNA, 25 bp, E. coli
cgccgctacggtgtggatttaaaag

SEQ ID NO: 84777 - DNA, 25 bp, E. coli
cgccgctacggtctggatttaaaag

SEQ ID NO: 84778 - DNA, 25 bp, E. coli
cagaaatcgacgtcgttgccggaac

SEQ ID NO: 84779 - DNA, 25 bp, E. coli
cagaaatcgacgacgttgccggaac

SEQ ID NO: 84780 - DNA, 25 bp, E. coli
tttcacatcaggtgtatcgcgggct

SEQ ID NO: 84781 - DNA, 25 bp, E. coli
ttctgacgccgataaatgccgaccg

SEQ ID NO: 84782 - DNA, 25 bp, E. coli
ttctgacgccgaaaaatgccgaccg

SEQ ID NO: 84783 - DNA, 25 bp, E. coli
tttcacatcaggagtatcgcgggct

SEQ ID NO: 84784 - DNA, 25 bp, E. coli
tgtgcgcgctttttcccagcctgaa

SEQ ID NO: 84785 - DNA, 25 bp, E. coli
tgtgcgcgctttatcccagcctgaa

SEQ ID NO: 84786 - DNA, 25 bp, E. coli
tgaactatggtatgcaggaggctgc

SEQ ID NO: 84787 - DNA, 25 bp, E. coli
tgaaaagccgcgatggtgtgccctg

SEQ ID NO: 84788 - DNA, 25 bp, E. coli
tgaaaagccgcgttggtgtgccctg

SEQ ID NO: 84789 - DNA, 25 bp, E. coli
tgaactatggtaagcaggaggctgc

SEQ ID NO: 84790 - DNA, 25 bp, E. coli
gaaatccagcgttacctgttgcagg

SEQ ID NO: 84791 - DNA, 25 bp, E. coli
gaaatccagcgtaacctgttgcagg

SEQ ID NO: 84792 - DNA, 25 bp, E. coli
cattttcggctgttaacctgttgcg

SEQ ID NO: 84793 - DNA, 25 bp, E. coli
tggctgccagcgttcaaatggtctg

SEQ ID NO: 84794 - DNA, 25 bp, E. coli
tggctgccagcgatcaaatggtctg

SEQ ID NO: 84795 - DNA, 25 bp, E. coli
cagtaccttcttgatcgtatcggag

SEQ ID NO: 84796 - DNA, 25 bp, E. coli
cagtaccttcttcatcgtatcggag

SEQ ID NO: 84797 - DNA, 25 bp, E. coli
atacagcctgcctgagcctatccag

SEQ ID NO: 84798 - DNA, 25 bp, E. coli
atacagcctgccagagcctatccag

SEQ ID NO: 84799 - DNA, 25 bp, E. coli
aaaggatacagcgtgcctgagccta

SEQ ID NO: 84800 - DNA, 25 bp, E. coli
aaaggatacagcctgcctgagccta

SEQ ID NO: 84801 - DNA, 25 bp, E. coli
taccttcttgatggtatcggagagc

SEQ ID NO: 84802 - DNA, 25 bp, E. coli
taccttcttgatcgtatcggagagc

SEQ ID NO: 84803 - DNA, 25 bp, E. coli
tattgggtcagctggatggcggtag

SEQ ID NO: 84804 - DNA, 25 bp, E. coli
tattgggtcagcaggatggcggtag

SEQ ID NO: 84805 - DNA, 25 bp, E. coli
tcttgatcgtatcggagagcttaaa

SEQ ID NO: 84806 - DNA, 25 bp, E. coli
tctcgatcgtaatacgttggcggcc

SEQ ID NO: 84807 - DNA, 25 bp, E. coli
tctcgatcgtaaaacgttggcggcc

SEQ ID NO: 84808 - DNA, 25 bp, E. coli
tcttgatcgtatgggagagcttaaa

SEQ ID NO: 84809 - DNA, 25 bp, E. coli
ccacgaatcagttccttcttgatcg

SEQ ID NO: 84810 - DNA, 25 bp, E. coli
ccacgaatcagtaccttcttgatcg

SEQ ID NO: 84811 - DNA, 25 bp, E. coli
ctgcctgagcctatccagttactta

SEQ ID NO: 84812 - DNA, 25 bp, E. coli
ctgcctgagcctttccagttactta

SEQ ID NO: 84813 - DNA, 25 bp, E. coli
gttggcggccatgctaatacgtgaa

SEQ ID NO: 84814 - DNA, 25 bp, E. coli
gttggcggccatcctaatacgtgaa

SEQ ID NO: 84815 - DNA, 25 bp, E. coli
gatcgtaatacgatggcggccatgc

SEQ ID NO: 84816 - DNA, 25 bp, E. coli
gatcgtaatacgttggcggccatgc

SEQ ID NO: 84817 - DNA, 25 bp, E. coli
aacgtgccgcgtagttaatccatga

SEQ ID NO: 84818 - DNA, 25 bp, E. coli
cacattggctgtatgaccaccgcaa

SEQ ID NO: 84819 - DNA, 25 bp, E. coli
cacattggctgtttgaccaccgcaa

SEQ ID NO: 84820 - DNA, 25 bp, E. coli
cagatgccgacgacacggtgctggt

SEQ ID NO: 84821 - DNA, 25 bp, E. coli
cagatgccgacgtcacggtgctggt

SEQ ID NO: 84822 - DNA, 25 bp, E. coli
tactgcaaacaggacaatatcccgg

SEQ ID NO: 84823 - DNA, 25 bp, E. coli
taaaccgtttatcgtggcggatgcg

SEQ ID NO: 84824 - DNA, 25 bp, E. coli
tactgcaaacagcacaatatcccgg

SEQ ID NO: 84825 - DNA, 25 bp, E. coli
taaaccgtttatggtggcggatgcg

SEQ ID NO: 84826 - DNA, 25 bp, E. coli
aacgtgccgcgttgttaatccatga

SEQ ID NO: 84827 - DNA, 25 bp, E. coli
aaattacaggcttacgcactgccgg

SEQ ID NO: 84828 - DNA, 25 bp, E. coli
aaattacaggctaacgcactgccgg

SEQ ID NO: 84829 - DNA, 25 bp, E. coli
tgaggtgatcctgccgttgctggac

SEQ ID NO: 84830 - DNA, 25 bp, E. coli
tgaggtgatcctcccgttgctggac

SEQ ID NO: 84831 - DNA, 25 bp, E. coli
ccggaacagcaataggtggtggatc

SEQ ID NO: 84832 - DNA, 25 bp, E. coli
ccatcgacgcctggtggaagctact

SEQ ID NO: 84833 - DNA, 25 bp, E. coli
ccatcgacgcctcgtggaagctact

SEQ ID NO: 84834 - DNA, 25 bp, E. coli
ccggaacagcaaaaggtggtggatc

SEQ ID NO: 84835 - DNA, 25 bp, E. coli
gactacggtctggattcggtgcgca

SEQ ID NO: 84836 - DNA, 25 bp, E. coli
gactacggtctgcattcggtgcgca

SEQ ID NO: 84837 - DNA, 25 bp, E. coli
gatgtcgctgaattatgtggccgga

SEQ ID NO: 84838 - DNA, 25 bp, E. coli
gatgtcgctgaaatatgtggccgga

SEQ ID NO: 84839 - DNA, 25 bp, E. coli
tatgaccagcgatgctgcacgagag

SEQ ID NO: 84840 - DNA, 25 bp, E. coli
tatgaccagcgaagctgcacgagag

SEQ ID NO: 84841 - DNA, 25 bp, E. coli
tgtgtgtgcacagcattaaccagct

SEQ ID NO: 84842 - DNA, 25 bp, E. coli
tgtgtgtgcacaccattaaccagct

SEQ ID NO: 84843 - DNA, 25 bp, E. coli
tgcacgagagtggaacaaggactca

SEQ ID NO: 84844 - DNA, 25 bp, E. coli
tgcacgagagtgcaacaaggactca

SEQ ID NO: 84845 - DNA, 25 bp, E. coli
tccgggttccggttgaaactgccag

SEQ ID NO: 84846 - DNA, 25 bp, E. coli
tccgggttccggatgaaactgccag

SEQ ID NO: 84847 - DNA, 25 bp, E. coli
tgccagggaggcacattacaaatgg

SEQ ID NO: 84848 - DNA, 25 bp, E. coli
tgccagggaggctcattacaaatgg

SEQ ID NO: 84849 - DNA, 25 bp, E. coli
cctcattacggacagtttaactgcg

SEQ ID NO: 84850 - DNA, 25 bp, E. coli
ccctgccgtggatgtcagcttagaa

SEQ ID NO: 84851 - DNA, 25 bp, E. coli
cctcattacggagagtttaactgcg

SEQ ID NO: 84852 - DNA, 25 bp, E. coli
ccctgccgtggaagtcagcttagaa

SEQ ID NO: 84853 - DNA, 25 bp, E. coli
gataaatgacggttccctgctcttg

SEQ ID NO: 84854 - DNA, 25 bp, E. coli
gataaatgacggatccctgctcttg

SEQ ID NO: 84855 - DNA, 25 bp, E. coli
taaccagctcagaatgagccgccag

SEQ ID NO: 84856 - DNA, 25 bp, E. coli
taaccagctcagtatgagccgccag

SEQ ID NO: 84857 - DNA, 25 bp, E. coli
gatgccgcctcagcattgctgttgg

SEQ ID NO: 84858 - DNA, 25 bp, E. coli
gatgccgcctcaccattgctgttgg

SEQ ID NO: 84859 - DNA, 25 bp, E. coli
gatgatttccgacgtgtcgcaatgg

SEQ ID NO: 84860 - DNA, 25 bp, E. coli
gatgatttccgaggtgtcgcaatgg

SEQ ID NO: 84861 - DNA, 25 bp, E. coli
caacgtgcgcgtacccatgagggta

SEQ ID NO: 84862 - DNA, 25 bp, E. coli
caacgtgcgcgttcccatgagggta

SEQ ID NO: 84863 - DNA, 25 bp, E. coli
taaagccacgtttcaagagacgcgg

SEQ ID NO: 84864 - DNA, 25 bp, E. coli
taaagccacgttacaagagacgcgg

SEQ ID NO: 84865 - DNA, 25 bp, E. coli
tatgccgatcgttgactggcgtcgc

SEQ ID NO: 84866 - DNA, 25 bp, E. coli
tatgccgatcgtagactggcgtcgc

SEQ ID NO: 84867 - DNA, 25 bp, E. coli
ttccgccggtgtcgaagcattgcag

SEQ ID NO: 84868 - DNA, 25 bp, E. coli
ttccgccggtgtggaagcattgcag

SEQ ID NO: 84869 - DNA, 25 bp, E. coli
tgattaccggtagccgtaaagcgcc

SEQ ID NO: 84870 - DNA, 25 bp, E. coli
tgattaccggtacccgtaaagcgcc

SEQ ID NO: 84871 - DNA, 25 bp, E. coli
tcgcgcctggaaagagttgaaaagc

SEQ ID NO: 84872 - DNA, 25 bp, E. coli
tcgcgcctggaatgagttgaaaagc

SEQ ID NO: 84873 - DNA, 25 bp, E. coli
gaaccggcgttgatcgattacctga

SEQ ID NO: 84874 - DNA, 25 bp, E. coli
gcatcgtgcagaaacagtcgcgcct

SEQ ID NO: 84875 - DNA, 25 bp, E. coli
gaaccggcgttgttcgattacctga

SEQ ID NO: 84876 - DNA, 25 bp, E. coli
gcatcgtgcagatacagtcgcgcct

SEQ ID NO: 84877 - DNA, 25 bp, E. coli
gaccgtcgtttgatgcgtaatcgca

SEQ ID NO: 84878 - DNA, 25 bp, E. coli
gaccgtcgtttgttgcgtaatcgca

SEQ ID NO: 84879 - DNA, 25 bp, E. coli
tggctggacccagcttgaaagacag

SEQ ID NO: 84880 - DNA, 25 bp, E. coli
tggctggacccaccttgaaagacag

SEQ ID NO: 84881 - DNA, 25 bp, E. coli
gaccgcaccggccttattttagata

SEQ ID NO: 84882 - DNA, 25 bp, E. coli
gaccgcaccggcgttattttagata

SEQ ID NO: 84883 - DNA, 25 bp, E. coli
tacgccagatggtttaacattagtg

SEQ ID NO: 84884 - DNA, 25 bp, E. coli
taacattagtggcatttgccatcgg

SEQ ID NO: 84885 - DNA, 25 bp, E. coli
taaaccgggcataacgccagatggt

SEQ ID NO: 84886 - DNA, 25 bp, E. coli
taaaccgggcattacgccagatggt

SEQ ID NO: 84887 - DNA, 25 bp, E. coli
taacattagtgggatttgccatcgg

SEQ ID NO: 84888 - DNA, 25 bp, E. coli
agtgggtatctgacgctgaagtcgc

SEQ ID NO: 84889 - DNA, 25 bp, E. coli
agtgggtatctgtcgctgaagtcgc

SEQ ID NO: 84890 - DNA, 25 bp, E. coli
aacaggctgcttcatggtctggacg

SEQ ID NO: 84891 - DNA, 25 bp, E. coli
aacaggctgcttgatggtctggacg

SEQ ID NO: 84892 - DNA, 25 bp, E. coli
tacgccagatggattaacattagtg

SEQ ID NO: 84893 - DNA, 25 bp, E. coli
tgctggatgacgacctttacgcggg

SEQ ID NO: 84894 - DNA, 25 bp, E. coli
tgctggatgacgtcctttacgcggg

SEQ ID NO: 84895 - DNA, 25 bp, E. coli
tcttcatccccgcattaaaccgttg

SEQ ID NO: 84896 - DNA, 25 bp, E. coli
tcttcatccccggattaaaccgttg

SEQ ID NO: 84897 - DNA, 25 bp, E. coli
gcctgtgctagagcgccatcttcat

SEQ ID NO: 84898 - DNA, 25 bp, E. coli
gcctgtgctagaccgccatcttcat

SEQ ID NO: 84899 - DNA, 25 bp, E. coli
gctgaagtcgctgcagcgtcagtaa

SEQ ID NO: 84900 - DNA, 25 bp, E. coli
gctgaagtcgctccagcgtcagtaa

SEQ ID NO: 84901 - DNA, 25 bp, E. coli
ggattaaaccgtagttgcatcagtg

SEQ ID NO: 84902 - DNA, 25 bp, E. coli
ggattaaaccgttgttgcatcagtg

SEQ ID NO: 84903 - DNA, 25 bp, E. coli
gtgcgggttcttgataaaccgggca

SEQ ID NO: 84904 - DNA, 25 bp, E. coli
gtgcgggttcttcataaaccgggca

SEQ ID NO: 84905 - DNA, 25 bp, E. coli
agacactcctgaagcggttaaaaaa

SEQ ID NO: 84906 - DNA, 25 bp, E. coli
agacactcctgatgcggttaaaaaa

SEQ ID NO: 84907 - DNA, 25 bp, E. coli
tattttcgggagttggtagagacga

SEQ ID NO: 84908 - DNA, 25 bp, E. coli
tattttcgggagatggtagagacga

SEQ ID NO: 84909 - DNA, 25 bp, E. coli
ttgttaccagcgatcgaaaaagcga

SEQ ID NO: 84910 - DNA, 25 bp, E. coli
ttgttaccagcgttcgaaaaagcga

SEQ ID NO: 84911 - DNA, 25 bp, E. coli
tcgaaaaagcgatgccgcctccgct

SEQ ID NO: 84912 - DNA, 25 bp, E. coli
tcgaaaaagcgaagccgcctccgct

SEQ ID NO: 84913 - DNA, 25 bp, E. coli
tctgttcgatcagatgaatcgtggt

SEQ ID NO: 84914 - DNA, 25 bp, E. coli
tcagcgatcgttctgttcgatcaga

SEQ ID NO: 84915 - DNA, 25 bp, E. coli
tctgttcgatcacatgaatcgtggt

SEQ ID NO: 84916 - DNA, 25 bp, E. coli
ccacagttccgcatattttcgggag

SEQ ID NO: 84917 - DNA, 25 bp, E. coli
ccacagttccgcttattttcgggag

SEQ ID NO: 84918 - DNA, 25 bp, E. coli
gcgcagccacagatccgcttatttt

SEQ ID NO: 84919 - DNA, 25 bp, E. coli
gcgcagccacagttccgcttatttt

SEQ ID NO: 84920 - DNA, 25 bp, E. coli
cgaaggaacggcaggtgaaagatat

SEQ ID NO: 84921 - DNA, 25 bp, E. coli
cgaaggaacggctggtgaaagatat

SEQ ID NO: 84922 - DNA, 25 bp, E. coli
tggagaaagacactcctgatgcggt

SEQ ID NO: 84923 - DNA, 25 bp, E. coli
tggagaaagacagtcctgatgcggt

SEQ ID NO: 84924 - DNA, 25 bp, E. coli
tcagcgatcgttgtgttcgatcaga

SEQ ID NO: 84925 - DNA, 25 bp, E. coli
gatgatttcgttccatcagcgatcg

SEQ ID NO: 84926 - DNA, 25 bp, E. coli
gatgatttcgttgcatcagcgatcg

SEQ ID NO: 84927 - DNA, 25 bp, E. coli
caaacagtggttctggcaaccgccg

SEQ ID NO: 84928 - DNA, 25 bp, E. coli
caaacagtggttgtggcaaccgccg

SEQ ID NO: 84929 - DNA, 25 bp, E. coli
tacaccagggcaatgatgtcggcag

SEQ ID NO: 84930 - DNA, 25 bp, E. coli
tacaccagggcattgatgtcggcag

SEQ ID NO: 84931 - DNA, 25 bp, E. coli
tatctcggccatgcggtagaactgg

SEQ ID NO: 84932 - DNA, 25 bp, E. coli
tatctcggccatccggtagaactgg

SEQ ID NO: 84933 - DNA, 25 bp, E. coli
ttcttgcctgaaagtcgatccgctt

SEQ ID NO: 84934 - DNA, 25 bp, E. coli
ttatctgtgatgtgccggtgtcggc

SEQ ID NO: 84935 - DNA, 25 bp, E. coli
ttatctgtgatgagccggtgtcggc

SEQ ID NO: 84936 - DNA, 25 bp, E. coli
ttcttgcctgaatgtcgatccgctt

SEQ ID NO: 84937 - DNA, 25 bp, E. coli
tgattaaccgctttccgcatgagtt

SEQ ID NO: 84938 - DNA, 25 bp, E. coli
tgtcggcgctggacgtgtcaattca

SEQ ID NO: 84939 - DNA, 25 bp, E. coli
tgtcggcgctggtcgtgtcaattca

SEQ ID NO: 84940 - DNA, 25 bp, E. coli
tgattaaccgctatccgcatgagtt

SEQ ID NO: 84941 - DNA, 25 bp, E. coli
tccggatctggagaagaacaaaacc

SEQ ID NO: 84942 - DNA, 25 bp, E. coli
tccggatctggacaagaacaaaacc

SEQ ID NO: 84943 - DNA, 25 bp, E. coli
gaaccactgcgttcttatcatccga

SEQ ID NO: 84944 - DNA, 25 bp, E. coli
gaaccactgcgtacttatcatccga

SEQ ID NO: 84945 - DNA, 25 bp, E. coli
gacctggccgtggtaaaacacattt

SEQ ID NO: 84946 - DNA, 25 bp, E. coli
gacctggccgtgctaaaacacattt

SEQ ID NO: 84947 - DNA, 25 bp, E. coli
gaccatcggcgacatcatcgctgaa

SEQ ID NO: 84948 - DNA, 25 bp, E. coli
gaccatcggcgagatcatcgctgaa

SEQ ID NO: 84949 - DNA, 25 bp, E. coli
cacagctacgcaaggtcgatctcaa

SEQ ID NO: 84950 - DNA, 25 bp, E. coli
caaacagatcatgcagagacggcgg

SEQ ID NO: 84951 - DNA, 25 bp, E. coli
cacagctacgcatggtcgatctcaa

SEQ ID NO: 84952 - DNA, 25 bp, E. coli
caaacagatcatccagagacggcgg

SEQ ID NO: 84953 - DNA, 25 bp, E. coli
cagtatcgcgtaacagggcatggca

SEQ ID NO: 84954 - DNA, 25 bp, E. coli
catcagctgcgttatcaggaaacgg

SEQ ID NO: 84955 - DNA, 25 bp, E. coli
catcagctgcgtaatcaggaaacgg

SEQ ID NO: 84956 - DNA, 25 bp, E. coli
cagtatcgcgtatcagggcatggca

SEQ ID NO: 84957 - DNA, 25 bp, E. coli
tacttagcgtggagtcgcaaacgca

SEQ ID NO: 84958 - DNA, 25 bp, E. coli
tacttagcgtggtgtcgcaaacgca

SEQ ID NO: 84959 - DNA, 25 bp, E. coli
tatggccgtggtattcaaccgactg

SEQ ID NO: 84960 - DNA, 25 bp, E. coli
agtaacgctgttgcacgcctgaagg

SEQ ID NO: 84961 - DNA, 25 bp, E. coli
agtaacgctgttccacgcctgaagg

SEQ ID NO: 84962 - DNA, 25 bp, E. coli
tatggccgtggttttcaaccgactg

SEQ ID NO: 84963 - DNA, 25 bp, E. coli
tatgacacggtacataagcaagcca

SEQ ID NO: 84964 - DNA, 25 bp, E. coli
tatgacacggtagataagcaagcca

SEQ ID NO: 84965 - DNA, 25 bp, E. coli
tttgaacccgcgagcagtgaacgtg

SEQ ID NO: 84966 - DNA, 25 bp, E. coli
tttgaacccgcgtgcagtgaacgtg

SEQ ID NO: 84967 - DNA, 25 bp, E. coli
gaatgtcgcaacctgcggtcagtaa

SEQ ID NO: 84968 - DNA, 25 bp, E. coli
gaatgtcgcaacgtgcggtcagtaa

SEQ ID NO: 84969 - DNA, 25 bp, E. coli
taaccgttttcgatgccgtgatgca

SEQ ID NO: 84970 - DNA, 25 bp, E. coli
taaccgttttcgttgccgtgatgca

SEQ ID NO: 84971 - DNA, 25 bp, E. coli
caatgtcgatgatgagcatccgcac

SEQ ID NO: 84972 - DNA, 25 bp, E. coli
caatgtcgatgaagagcatccgcac

SEQ ID NO: 84973 - DNA, 25 bp, E. coli
cagtgtgcgcttggattacgccgga

SEQ ID NO: 84974 - DNA, 25 bp, E. coli
cagtgtgcgcttcgattacgccgga

SEQ ID NO: 84975 - DNA, 25 bp, E. coli
tacaagaagcagcatgacggcagtg

SEQ ID NO: 84976 - DNA, 25 bp, E. coli
tacaagaagcaggatgacggcagtg

SEQ ID NO: 84977 - DNA, 25 bp, E. coli
atgacttctcccctcaatgtggacg

SEQ ID NO: 84978 - DNA, 25 bp, E. coli
agctgctggtgaaagcgtgccccgc

SEQ ID NO: 84979 - DNA, 25 bp, E. coli
atgacttctcccgtcaatgtggacg

SEQ ID NO: 84980 - DNA, 25 bp, E. coli
agctgctggtgatagcgtgccccgc

SEQ ID NO: 84981 - DNA, 25 bp, E. coli
tttggtgtggagttccgttacggct

SEQ ID NO: 84982 - DNA, 25 bp, E. coli
tttggtgtggagatccgttacggct

SEQ ID NO: 84983 - DNA, 25 bp, E. coli
ctgggcgtcaataaattcaatgtcg

SEQ ID NO: 84984 - DNA, 25 bp, E. coli
cgtgccccgcagctctgtacaagaa

SEQ ID NO: 84985 - DNA, 25 bp, E. coli
cgtgccccgcaggtctgtacaagaa

SEQ ID NO: 84986 - DNA, 25 bp, E. coli
ctggaacagtgggaatacccgcgcg

SEQ ID NO: 84987 - DNA, 25 bp, E. coli
ctggaacagtggcaatacccgcgcg

SEQ ID NO: 84988 - DNA, 25 bp, E. coli
ctgggcgtcaattaattcaatgtcg

SEQ ID NO: 84989 - DNA, 25 bp, E. coli
tacccgcgcggcacctttggtgtgg

SEQ ID NO: 84990 - DNA, 25 bp, E. coli
tcaatgtggacgacaaactgggcgt

SEQ ID NO: 84991 - DNA, 25 bp, E. coli
tacccgcgcggctcctttggtgtgg

SEQ ID NO: 84992 - DNA, 25 bp, E. coli
tcaatgtggacgtcaaactgggcgt

SEQ ID NO: 84993 - DNA, 25 bp, E. coli
caagctggcatggactgagaacggc

SEQ ID NO: 84994 - DNA, 25 bp, E. coli
caagctggcatgcactgagaacggc

SEQ ID NO: 84995 - DNA, 25 bp, E. coli
aaaaaagcgaacctcatgcgcccgg

SEQ ID NO: 84996 - DNA, 25 bp, E. coli
aaaaaagcgaacgtcatgcgcccgg

SEQ ID NO: 84997 - DNA, 25 bp, E. coli
tatttcgatacatacgcacagccgg

SEQ ID NO: 84998 - DNA, 25 bp, E. coli
tatttcgatacaaacgcacagccgg

SEQ ID NO: 84999 - DNA, 25 bp, E. coli
ttaaggcaccgggtgacatgagtcc

SEQ ID NO: 85000 - DNA, 25 bp, E. coli
ttaaggcaccggctgacatgagtcc

SEQ ID NO: 85001 - DNA, 25 bp, E. coli
tgttttgcgatcgacacgtaggcgt

SEQ ID NO: 85002 - DNA, 25 bp, E. coli
tgttttgcgatccacacgtaggcgt

SEQ ID NO: 85003 - DNA, 25 bp, E. coli
tcatcacgcgctcgtcaaatcaggc

SEQ ID NO: 85004 - DNA, 25 bp, E. coli
tcaggcatcacagcacaggaagtgg

SEQ ID NO: 85005 - DNA, 25 bp, E. coli
tcaggcatcacaccacaggaagtgg

SEQ ID NO: 85006 - DNA, 25 bp, E. coli
tcatcacgcgctggtcaaatcaggc

SEQ ID NO: 85007 - DNA, 25 bp, E. coli
gaactacatgcttgatggcgtgcgc

SEQ ID NO: 85008 - DNA, 25 bp, E. coli
gaaaatttgtatcgacgacggctcc

SEQ ID NO: 85009 - DNA, 25 bp, E. coli
gaaaatttgtatggacgacggctcc

SEQ ID NO: 85010 - DNA, 25 bp, E. coli
gaactacatgctagatggcgtgcgc

SEQ ID NO: 85011 - DNA, 25 bp, E. coli
cttcaagtcggaatggtctgcgcca

SEQ ID NO: 85012 - DNA, 25 bp, E. coli
cttcaagtcggattggtctgcgcca

SEQ ID NO: 85013 - DNA, 25 bp, E. coli
taatgcgactttgatcgcggacggg

SEQ ID NO: 85014 - DNA, 25 bp, E. coli
taatgcgactttcatcgcggacggg

SEQ ID NO: 85015 - DNA, 25 bp, E. coli
aacagaccgagcgtcgtcatattct

SEQ ID NO: 85016 - DNA, 25 bp, E. coli
aacgcacggctgctgcgcgccagta

SEQ ID NO: 85017 - DNA, 25 bp, E. coli
aacagaccgagcctcgtcatattct

SEQ ID NO: 85018 - DNA, 25 bp, E. coli
aacgcacggctggtgcgcgccagta

SEQ ID NO: 85019 - DNA, 25 bp, E. coli
tcggcatctcatttgccacgcagcg

SEQ ID NO: 85020 - DNA, 25 bp, E. coli
tcggcatctcatatgccacgcagcg

SEQ ID NO: 85021 - DNA, 25 bp, E. coli
gctggcgattaacgcacggctgctg

SEQ ID NO: 85022 - DNA, 25 bp, E. coli
gctgcatcttgatttcggcatctca

SEQ ID NO: 85023 - DNA, 25 bp, E. coli
gctgcatcttgaattcggcatctca

SEQ ID NO: 85024 - DNA, 25 bp, E. coli
gctggcgattaaggcacggctgctg

SEQ ID NO: 85025 - DNA, 25 bp, E. coli
gaatgacaaacagaccgagcgtcgt

SEQ ID NO: 85026 - DNA, 25 bp, E. coli
gaatgacaaacacaccgagcgtcgt

SEQ ID NO: 85027 - DNA, 25 bp, E. coli
gacaaacagaccgagcgtcgtcata

SEQ ID NO: 85028 - DNA, 25 bp, E. coli
gacaaacagacccagcgtcgtcata

SEQ ID NO: 85029 - DNA, 25 bp, E. coli
cggctacgcggcgtgaatgacaaac

SEQ ID NO: 85030 - DNA, 25 bp, E. coli
cggctacgcggcctgaatgacaaac

SEQ ID NO: 85031 - DNA, 25 bp, E. coli
gatttcggcatctcatttgccacgc

SEQ ID NO: 85032 - DNA, 25 bp, E. coli
gatttcggcatcacatttgccacgc

SEQ ID NO: 85033 - DNA, 25 bp, E. coli
ggcgctgcatctagatttcggcatc

SEQ ID NO: 85034 - DNA, 25 bp, E. coli
ggcgctgcatcttgatttcggcatc

SEQ ID NO: 85035 - DNA, 25 bp, E. coli
gaccgagcgtcgacatattctgcgc

SEQ ID NO: 85036 - DNA, 25 bp, E. coli
gaccgagcgtcgtcatattctgcgc

SEQ ID NO: 85037 - DNA, 25 bp, E. coli
gaatattccttctgaaataaaagaa

SEQ ID NO: 85038 - DNA, 25 bp, E. coli
gaatattccttcagaaataaaagaa

SEQ ID NO: 85039 - DNA, 25 bp, E. coli
cacggcgcaggcaaacgaccataaa

SEQ ID NO: 85040 - DNA, 25 bp, E. coli
cacggcgcaggctaacgaccataaa

SEQ ID NO: 85041 - DNA, 25 bp, E. coli
atgctgtgctgctcggcgcaggcaa

SEQ ID NO: 85042 - DNA, 25 bp, E. coli
atgctgtgctgcacggcgcaggcaa

SEQ ID NO: 85043 - DNA, 25 bp, E. coli
aaacgctgcgtcacaaaaatcacct

SEQ ID NO: 85044 - DNA, 25 bp, E. coli
aaacgctgcgtctcaaaaatcacct

SEQ ID NO: 85045 - DNA, 25 bp, E. coli
tatggccacgctcaaaattatcggc

SEQ ID NO: 85046 - DNA, 25 bp, E. coli
tatggccacgctgaaaattatcggc

SEQ ID NO: 85047 - DNA, 25 bp, E. coli
tgaactcatcggatatggccacgct

SEQ ID NO: 85048 - DNA, 25 bp, E. coli
tgaaacttcctgtttgtcgcattgt

SEQ ID NO: 85049 - DNA, 25 bp, E. coli
tgaactcatcggttatggccacgct

SEQ ID NO: 85050 - DNA, 25 bp, E. coli
tgaaacttcctgattgtcgcattgt

SEQ ID NO: 85051 - DNA, 25 bp, E. coli
tctggcgctgaatcttcctgtttgt

SEQ ID NO: 85052 - DNA, 25 bp, E. coli
tctggcgctgaaacttcctgtttgt

SEQ ID NO: 85053 - DNA, 25 bp, E. coli
gccagcctggcgattagcctgatgc

SEQ ID NO: 85054 - DNA, 25 bp, E. coli
gccagcctggcgtttagcctgatgc

SEQ ID NO: 85055 - DNA, 25 bp, E. coli
gcaaaccactgactggatcaacatt

SEQ ID NO: 85056 - DNA, 25 bp, E. coli
gcaaaccactgagtggatcaacatt

SEQ ID NO: 85057 - DNA, 25 bp, E. coli
tcaacattaacaccgataacgacaa

SEQ ID NO: 85058 - DNA, 25 bp, E. coli
tcaacattaacagcgataacgacaa

SEQ ID NO: 85059 - DNA, 25 bp, E. coli
cagctctgcgctcgctctttcagga

SEQ ID NO: 85060 - DNA, 25 bp, E. coli
cagctctgcgctggctctttcagga

SEQ ID NO: 85061 - DNA, 25 bp, E. coli
taaaaacccagatgagtgaaacctg

SEQ ID NO: 85062 - DNA, 25 bp, E. coli
taaaaacccagaagagtgaaacctg

SEQ ID NO: 85063 - DNA, 25 bp, E. coli
tttcaggatgtggagccatgggcac

SEQ ID NO: 85064 - DNA, 25 bp, E. coli
tttcaggatgtgcagccatgggcac

SEQ ID NO: 85065 - DNA, 25 bp, E. coli
ttatgatgattggactggtcagctc

SEQ ID NO: 85066 - DNA, 25 bp, E. coli
ttatgatgattgcactggtcagctc

SEQ ID NO: 85067 - DNA, 25 bp, E. coli
tgggcacagcgatcaaaaaacgaaa

SEQ ID NO: 85068 - DNA, 25 bp, E. coli
tgggcacagcgaacaaaaaacgaaa

SEQ ID NO: 85069 - DNA, 25 bp, E. coli
tgaaaaccaaaatagttatgatgat

SEQ ID NO: 85070 - DNA, 25 bp, E. coli
tgaaaaccaaaaaagttatgatgat

SEQ ID NO: 85071 - DNA, 25 bp, E. coli
tgcgctggctctatcaggatgtgga

SEQ ID NO: 85072 - DNA, 25 bp, E. coli
tgcgctggctctttcaggatgtgga

SEQ ID NO: 85073 - DNA, 25 bp, E. coli
cgatcaaaaaaccaaatctggaagt

SEQ ID NO: 85074 - DNA, 25 bp, E. coli
cgatcaaaaaacgaaatctggaagt

SEQ ID NO: 85075 - DNA, 25 bp, E. coli
gattgcactggtgagctctgcgctg

SEQ ID NO: 85076 - DNA, 25 bp, E. coli
gattgcactggtcagctctgcgctg

SEQ ID NO: 85077 - DNA, 25 bp, E. coli
tggaagtaaaaagccagatgagtga

SEQ ID NO: 85078 - DNA, 25 bp, E. coli
tggaagtaaaaacccagatgagtga

SEQ ID NO: 85079 - DNA, 25 bp, E. coli
gagccatgggcagagcgatcaaaaa

SEQ ID NO: 85080 - DNA, 25 bp, E. coli
gagccatgggcacagcgatcaaaaa

SEQ ID NO: 85081 - DNA, 25 bp, E. coli
aaagctgtttctggtggcgctgctg

SEQ ID NO: 85082 - DNA, 25 bp, E. coli
aaagctgtttctcgtggcgctgctg

SEQ ID NO: 85083 - DNA, 25 bp, E. coli
tttcggccttgacttcagccgtacc

SEQ ID NO: 85084 - DNA, 25 bp, E. coli
tttcggccttgagttcagccgtacc

SEQ ID NO: 85085 - DNA, 25 bp, E. coli
tgaagcaaaagctgtttctcgtggc

SEQ ID NO: 85086 - DNA, 25 bp, E. coli
tgaagcaaaagcagtttctcgtggc

SEQ ID NO: 85087 - DNA, 25 bp, E. coli
tcggcttcccggtgcttcgcttgcg

SEQ ID NO: 85088 - DNA, 25 bp, E. coli
tcggcttcccggagcttcgcttgcg

SEQ ID NO: 85089 - DNA, 25 bp, E. coli
gcggatgccgctgggtcgcgcctgg

SEQ ID NO: 85090 - DNA, 25 bp, E. coli
gcggatgccgctcggtcgcgcctgg

SEQ ID NO: 85091 - DNA, 25 bp, E. coli
gcaaaagctgttactcgtggcgctg

SEQ ID NO: 85092 - DNA, 25 bp, E. coli
gcaaaagctgtttctcgtggcgctg

SEQ ID NO: 85093 - DNA, 25 bp, E. coli
cttcccggtgcttcgcttgcgcggt

SEQ ID NO: 85094 - DNA, 25 bp, E. coli
ctgggtcgcgcctgggaagcgttgc

SEQ ID NO: 85095 - DNA, 25 bp, E. coli
cgggctgaacgtcgtggtagggctt

SEQ ID NO: 85096 - DNA, 25 bp, E. coli
cttcccggtgctacgcttgcgcggt

SEQ ID NO: 85097 - DNA, 25 bp, E. coli
cttttttcggccttgagttcagccg

SEQ ID NO: 85098 - DNA, 25 bp, E. coli
cttttttcggccatgagttcagccg

SEQ ID NO: 85099 - DNA, 25 bp, E. coli
ctgggtcgcgccagggaagcgttgc

SEQ ID NO: 85100 - DNA, 25 bp, E. coli
cgggctgaacgtggtggtagggctt

SEQ ID NO: 85101 - DNA, 25 bp, E. coli
ggtggtagggctatctggtctgctg

SEQ ID NO: 85102 - DNA, 25 bp, E. coli
ggtggtagggctttctggtctgctg

SEQ ID NO: 85103 - DNA, 25 bp, E. coli
cagcgtctggcgaaacaaaggtttc

SEQ ID NO: 85104 - DNA, 25 bp, E. coli
cagcggctggccaattttcgtgaca

SEQ ID NO: 85105 - DNA, 25 bp, E. coli
cagcgtctggcgtaacaaaggtttc

SEQ ID NO: 85106 - DNA, 25 bp, E. coli
cagcggctggcctattttcgtgaca

SEQ ID NO: 85107 - DNA, 25 bp, E. coli
catcagatagttccctgccagcagg

SEQ ID NO: 85108 - DNA, 25 bp, E. coli
caggccaggtccagcgcttgatgat

SEQ ID NO: 85109 - DNA, 25 bp, E. coli
caggccaggtcctgcgcttgatgat

SEQ ID NO: 85110 - DNA, 25 bp, E. coli
catcagatagttgcctgccagcagg

SEQ ID NO: 85111 - DNA, 25 bp, E. coli
ttcgttacgggctaacagattcggc

SEQ ID NO: 85112 - DNA, 25 bp, E. coli
ttcgttacgggcaaacagattcggc

SEQ ID NO: 85113 - DNA, 25 bp, E. coli
tcgtcaaccaatcggctggcgtcgt

SEQ ID NO: 85114 - DNA, 25 bp, E. coli
tcgtcaaccaatgggctggcgtcgt

SEQ ID NO: 85115 - DNA, 25 bp, E. coli
gacaggctttcctgttgctcaacca

SEQ ID NO: 85116 - DNA, 25 bp, E. coli
gacaggctttccagttgctcaacca

SEQ ID NO: 85117 - DNA, 25 bp, E. coli
gtttcggtagattctgccagcggct

SEQ ID NO: 85118 - DNA, 25 bp, E. coli
gtttcggtagatactgccagcggct

SEQ ID NO: 85119 - DNA, 25 bp, E. coli
tggttaacggagaagagatcgcccg

SEQ ID NO: 85120 - DNA, 25 bp, E. coli
tggttaacggagtagagatcgcccg

SEQ ID NO: 85121 - DNA, 25 bp, E. coli
taagtggtcacaaacgtaccgttgc

SEQ ID NO: 85122 - DNA, 25 bp, E. coli
tcacgcagcggagggacaaagaatt

SEQ ID NO: 85123 - DNA, 25 bp, E. coli
tcacgcagcggacggacaaagaatt

SEQ ID NO: 85124 - DNA, 25 bp, E. coli
taagtggtcacatacgtaccgttgc

SEQ ID NO: 85125 - DNA, 25 bp, E. coli
caaagccggtgtcgtagccagtcag

SEQ ID NO: 85126 - DNA, 25 bp, E. coli
caaagccggtgtggtagccagtcag

SEQ ID NO: 85127 - DNA, 25 bp, E. coli
tactatgttgtgcagatgaccgccc

SEQ ID NO: 85128 - DNA, 25 bp, E. coli
tactatgttgtggagatgaccgccc

SEQ ID NO: 85129 - DNA, 25 bp, E. coli
agtttgcttaatcgacctcaggtcg

SEQ ID NO: 85130 - DNA, 25 bp, E. coli
agtttgcttaatggacctcaggtcg

SEQ ID NO: 85131 - DNA, 25 bp, E. coli
aaaacatcccggtacaggagtcgcg

SEQ ID NO: 85132 - DNA, 25 bp, E. coli
aaaacatcccggaacaggagtcgcg

SEQ ID NO: 85133 - DNA, 25 bp, E. coli
tttgccgatccgattgaccttgccg

SEQ ID NO: 85134 - DNA, 25 bp, E. coli
tttgccgatccgtttgaccttgccg

SEQ ID NO: 85135 - DNA, 25 bp, E. coli
tgttgaggcgtcacaaccgcatcag

SEQ ID NO: 85136 - DNA, 25 bp, E. coli
tgttgaggcgtctcaaccgcatcag

SEQ ID NO: 85137 - DNA, 25 bp, E. coli
tcaggtcgatacgagcaaagccggt

SEQ ID NO: 85138 - DNA, 25 bp, E. coli
tcaggtcgataccagcaaagccggt

SEQ ID NO: 85139 - DNA, 25 bp, E. coli
ccaacgttgggatgactggtttgcc

SEQ ID NO: 85140 - DNA, 25 bp, E. coli
ccaacgttgggaagactggtttgcc

SEQ ID NO: 85141 - DNA, 25 bp, E. coli
gcgtccaaaacgtgaaaaccagagt

SEQ ID NO: 85142 - DNA, 25 bp, E. coli
gcgtccaaaacgagaaaaccagagt

SEQ ID NO: 85143 - DNA, 25 bp, E. coli
cgcaggattttctggatctcaccgg

SEQ ID NO: 85144 - DNA, 25 bp, E. coli
cgcaggattttcaggatctcaccgg

SEQ ID NO: 85145 - DNA, 25 bp, E. coli
ggcgatatcattgcgcgcatcggca

SEQ ID NO: 85146 - DNA, 25 bp, E. coli
ggcgatatcattccgcgcatcggca

SEQ ID NO: 85147 - DNA, 25 bp, E. coli
cacagcctccagttatgaaacaagg

SEQ ID NO: 85148 - DNA, 25 bp, E. coli
cacagcctccagatatgaaacaagg

SEQ ID NO: 85149 - DNA, 25 bp, E. coli
taaagcggttaaggtggccagaaag

SEQ ID NO: 85150 - DNA, 25 bp, E. coli
taaagcggttaacgtggccagaaag

SEQ ID NO: 85151 - DNA, 25 bp, E. coli
tatggtggagataatcgaagagtcc

SEQ ID NO: 85152 - DNA, 25 bp, E. coli
tagatctcttagtcgaactgccaga

SEQ ID NO: 85153 - DNA, 25 bp, E. coli
tatggtggagattatcgaagagtcc

SEQ ID NO: 85154 - DNA, 25 bp, E. coli
tagatctcttagacgaactgccaga

SEQ ID NO: 85155 - DNA, 25 bp, E. coli
tatcaagaatgtagtacccagaggg

SEQ ID NO: 85156 - DNA, 25 bp, E. coli
tatcaagaatgttgtacccagaggg

SEQ ID NO: 85157 - DNA, 25 bp, E. coli
tgagaaatgcgaaggtaaagcggtt

SEQ ID NO: 85158 - DNA, 25 bp, E. coli
tgagaaatgcgatggtaaagcggtt

SEQ ID NO: 85159 - DNA, 25 bp, E. coli
tgaaacaagggttctaacgccacga

SEQ ID NO: 85160 - DNA, 25 bp, E. coli
tgaaacaagggtactaacgccacga

SEQ ID NO: 85161 - DNA, 25 bp, E. coli
gaatttagacgacagcaactcatca

SEQ ID NO: 85162 - DNA, 25 bp, E. coli
gaatttagacgagagcaactcatca

SEQ ID NO: 85163 - DNA, 25 bp, E. coli
ctgccagaaagtgaagcggataact

SEQ ID NO: 85164 - DNA, 25 bp, E. coli
cgggcgcgagccttcttatgtatca

SEQ ID NO: 85165 - DNA, 25 bp, E. coli
ctgccagaaagtcaagcggataact

SEQ ID NO: 85166 - DNA, 25 bp, E. coli
cgggcgcgagccatcttatgtatca

SEQ ID NO: 85167 - DNA, 25 bp, E. coli
taacgtggccagtaagatcgggcgc

SEQ ID NO: 85168 - DNA, 25 bp, E. coli
taacgtggccagaaagatcgggcgc

SEQ ID NO: 85169 - DNA, 25 bp, E. coli
caggcgaatattgtgcaggagattg

SEQ ID NO: 85170 - DNA, 25 bp, E. coli
caggcgaatattctgcaggagattg

SEQ ID NO: 85171 - DNA, 25 bp, E. coli
caggcatcggcaacagtattcttcc

SEQ ID NO: 85172 - DNA, 25 bp, E. coli
caggcatcggcatcagtattcttcc

SEQ ID NO: 85173 - DNA, 25 bp, E. coli
atcagtattcttgccgcactggcgc

SEQ ID NO: 85174 - DNA, 25 bp, E. coli
atcagtattcttcccgcactggcgc

SEQ ID NO: 85175 - DNA, 25 bp, E. coli
acgctgttcccgttggtagccgcag

SEQ ID NO: 85176 - DNA, 25 bp, E. coli
acgctgttcccgatggtagccgcag

SEQ ID NO: 85177 - DNA, 25 bp, E. coli
tattcaggcgaatattgtgcaggag

SEQ ID NO: 85178 - DNA, 25 bp, E. coli
tattcaggcgaaaattgtgcaggag

SEQ ID NO: 85179 - DNA, 25 bp, E. coli
ttcccgatggtacccgcaggcatcg

SEQ ID NO: 85180 - DNA, 25 bp, E. coli
ttcccgatggtagccgcaggcatcg

SEQ ID NO: 85181 - DNA, 25 bp, E. coli
tccggcgacgctgttcccgatggta

SEQ ID NO: 85182 - DNA, 25 bp, E. coli
tccggcgacgctcttcccgatggta

SEQ ID NO: 85183 - DNA, 25 bp, E. coli
gcactggcgctagcattgcctgaag

SEQ ID NO: 85184 - DNA, 25 bp, E. coli
gcactggcgctaccattgcctgaag

SEQ ID NO: 85185 - DNA, 25 bp, E. coli
cgctaccattgcgtgaaggtagccc

SEQ ID NO: 85186 - DNA, 25 bp, E. coli
cgctaccattgcctgaaggtagccc

SEQ ID NO: 85187 - DNA, 25 bp, E. coli
cgtcaggcagcccaccgctgattga

SEQ ID NO: 85188 - DNA, 25 bp, E. coli
cgtcaggcagccgaccgctgattga

SEQ ID NO: 85189 - DNA, 25 bp, E. coli
gaccgctgattgacgcagcgctggc

SEQ ID NO: 85190 - DNA, 25 bp, E. coli
gaccgctgattgtcgcagcgctggc

SEQ ID NO: 85191 - DNA, 25 bp, E. coli
caggcgttagttctcattaatgaag

SEQ ID NO: 85192 - DNA, 25 bp, E. coli
caggcgttagttgtcattaatgaag

SEQ ID NO: 85193 - DNA, 25 bp, E. coli
aacggctaaagctttactgtcacaa

SEQ ID NO: 85194 - DNA, 25 bp, E. coli
aacggctaaagcattactgtcacaa

SEQ ID NO: 85195 - DNA, 25 bp, E. coli
aaaccctgttgtatctgccgaaacg

SEQ ID NO: 85196 - DNA, 25 bp, E. coli
aaaccctgttgtttctgccgaaacg

SEQ ID NO: 85197 - DNA, 25 bp, E. coli
ttaactcgtctggatcctacaacag

SEQ ID NO: 85198 - DNA, 25 bp, E. coli
ttaatgaagacaatgcaaaaagcga

SEQ ID NO: 85199 - DNA, 25 bp, E. coli
ttaatgaagacattgcaaaaagcga

SEQ ID NO: 85200 - DNA, 25 bp, E. coli
ttaactcgtctgcatcctacaacag

SEQ ID NO: 85201 - DNA, 25 bp, E. coli
tcgatcagtgccagctaaaagggat

SEQ ID NO: 85202 - DNA, 25 bp, E. coli
tgccgaaacggcaaaagcattactg

SEQ ID NO: 85203 - DNA, 25 bp, E. coli
tgccgaaacggctaaagcattactg

SEQ ID NO: 85204 - DNA, 25 bp, E. coli
tccaaaagtgaaaggcaatgccggt

SEQ ID NO: 85205 - DNA, 25 bp, E. coli
tcgatcagtgcctgctaaaagggat

SEQ ID NO: 85206 - DNA, 25 bp, E. coli
tccaaaagtgaatggcaatgccggt

SEQ ID NO: 85207 - DNA, 25 bp, E. coli
tctggatcctactacagtaacgcca

SEQ ID NO: 85208 - DNA, 25 bp, E. coli
tctggatcctacaacagtaacgcca

SEQ ID NO: 85209 - DNA, 25 bp, E. coli
gcattactgtcacaatttccaacag

SEQ ID NO: 85210 - DNA, 25 bp, E. coli
gcattactgtcagaatttccaacag

SEQ ID NO: 85211 - DNA, 25 bp, E. coli
ggtgcaccgtcaacaggcgttagtt

SEQ ID NO: 85212 - DNA, 25 bp, E. coli
ggtgcaccgtcatcaggcgttagtt

SEQ ID NO: 85213 - DNA, 25 bp, E. coli
caactgaaattgcaggccggacgta

SEQ ID NO: 85214 - DNA, 25 bp, E. coli
caactgaaattggaggccggacgta

SEQ ID NO: 85215 - DNA, 25 bp, E. coli
catcgcggtgaaacggtctatagca

SEQ ID NO: 85216 - DNA, 25 bp, E. coli
catgttcctgttaagatgcccctgg

SEQ ID NO: 85217 - DNA, 25 bp, E. coli
catcgcggtgaatcggtctatagca

SEQ ID NO: 85218 - DNA, 25 bp, E. coli
catgttcctgtttagatgcccctgg

SEQ ID NO: 85219 - DNA, 25 bp, E. coli
ataaggctggttttgcaatctgccg

SEQ ID NO: 85220 - DNA, 25 bp, E. coli
ataaggctggttatgcaatctgccg

SEQ ID NO: 85221 - DNA, 25 bp, E. coli
aaatgaatatctagccgttggtgtc

SEQ ID NO: 85222 - DNA, 25 bp, E. coli
aaatgaatatcttgccgttggtgtc

SEQ ID NO: 85223 - DNA, 25 bp, E. coli
tataactacgatcgtgaaacacggg

SEQ ID NO: 85224 - DNA, 25 bp, E. coli
tataactacgatggtgaaacacggg

SEQ ID NO: 85225 - DNA, 25 bp, E. coli
tgaccttattgctacaaaggcaggg

SEQ ID NO: 85226 - DNA, 25 bp, E. coli
tgaccttattgcaacaaaggcaggg

SEQ ID NO: 85227 - DNA, 25 bp, E. coli
gaatatgtgccagaccatcgcggtg

SEQ ID NO: 85228 - DNA, 25 bp, E. coli
gaatatgtgccacaccatcgcggtg

SEQ ID NO: 85229 - DNA, 25 bp, E. coli
gatactgaagcacagcatagcgccg

SEQ ID NO: 85230 - DNA, 25 bp, E. coli
gatactgaagcagagcatagcgccg

SEQ ID NO: 85231 - DNA, 25 bp, E. coli
tcaaaagaaatctaagctccgggtg

SEQ ID NO: 85232 - DNA, 25 bp, E. coli
tcaaaagaaatcaaagctccgggtg

SEQ ID NO: 85233 - DNA, 25 bp, E. coli
gatgcccctggttcacataaggctg

SEQ ID NO: 85234 - DNA, 25 bp, E. coli
gatgcccctggtacacataaggctg

SEQ ID NO: 85235 - DNA, 25 bp, E. coli
caattgctcacctggcaggttgcca

SEQ ID NO: 85236 - DNA, 25 bp, E. coli
caatatttttgcagacgagagccac

SEQ ID NO: 85237 - DNA, 25 bp, E. coli
caatatttttgctgacgagagccac

SEQ ID NO: 85238 - DNA, 25 bp, E. coli
caattgctcaccaggcaggttgcca

SEQ ID NO: 85239 - DNA, 25 bp, E. coli
caaacatgacaacatcaaggcgggc

SEQ ID NO: 85240 - DNA, 25 bp, E. coli
caaacatgacaagatcaaggcgggc

SEQ ID NO: 85241 - DNA, 25 bp, E. coli
taccttcacaggtggaggcaactgc

SEQ ID NO: 85242 - DNA, 25 bp, E. coli
taccttcacaggaggaggcaactgc

SEQ ID NO: 85243 - DNA, 25 bp, E. coli
tagagaatgcgatgacggtccatgc

SEQ ID NO: 85244 - DNA, 25 bp, E. coli
tagagaatgcgaagacggtccatgc

SEQ ID NO: 85245 - DNA, 25 bp, E. coli
tgatgtaaacaaaattggcgcggct

SEQ ID NO: 85246 - DNA, 25 bp, E. coli
tgatgtaaacaatattggcgcggct

SEQ ID NO: 85247 - DNA, 25 bp, E. coli
gcagagatgcttttcaaccgcccga

SEQ ID NO: 85248 - DNA, 25 bp, E. coli
gaagtgatcatgtctccgcagcaag

SEQ ID NO: 85249 - DNA, 25 bp, E. coli
gaattatctctacaggacgcacgcc

SEQ ID NO: 85250 - DNA, 25 bp, E. coli
gcagagatgcttatcaaccgcccga

SEQ ID NO: 85251 - DNA, 25 bp, E. coli
gcaatattgcgcgagaaggttcggt

SEQ ID NO: 85252 - DNA, 25 bp, E. coli
gaagtgatcatgactccgcagcaag

SEQ ID NO: 85253 - DNA, 25 bp, E. coli
gcaatattgcgccagaaggttcggt

SEQ ID NO: 85254 - DNA, 25 bp, E. coli
gaattatctctagaggacgcacgcc

SEQ ID NO: 85255 - DNA, 25 bp, E. coli
gaaaacctcgactggtgggagcact

SEQ ID NO: 85256 - DNA, 25 bp, E. coli
gaaaacctcgacaggtgggagcact

SEQ ID NO: 85257 - DNA, 25 bp, E. coli
aagtcggcgtcaacatgcaggacaa

SEQ ID NO: 85258 - DNA, 25 bp, E. coli
aagtcggcgtcatcatgcaggacaa

SEQ ID NO: 85259 - DNA, 25 bp, E. coli
taaataccctggtactgatggcgct

SEQ ID NO: 85260 - DNA, 25 bp, E. coli
taaataccctggaactgatggcgct

SEQ ID NO: 85261 - DNA, 25 bp, E. coli
tttaaagtcggcctcatcatgcagg

SEQ ID NO: 85262 - DNA, 25 bp, E. coli
tttaaagtcggcgtcatcatgcagg

SEQ ID NO: 85263 - DNA, 25 bp, E. coli
tcatgcaggacataggtgacaccgc

SEQ ID NO: 85264 - DNA, 25 bp, E. coli
tcatgcaggacaaaggtgacaccgc

SEQ ID NO: 85265 - DNA, 25 bp, E. coli
gccgtataccaggaggttatcagta

SEQ ID NO: 85266 - DNA, 25 bp, E. coli
gccgtataccagcaggttatcagta

SEQ ID NO: 85267 - DNA, 25 bp, E. coli
gcgaaagccgtaaaccagcaggtta

SEQ ID NO: 85268 - DNA, 25 bp, E. coli
gcgaaagccgtataccagcaggtta

SEQ ID NO: 85269 - DNA, 25 bp, E. coli
gcaggttatcagtaaataccctggt

SEQ ID NO: 85270 - DNA, 25 bp, E. coli
gcaggttatcagaaaataccctggt

SEQ ID NO: 85271 - DNA, 25 bp, E. coli
gacaaaggtgactccgcaaaagcga

SEQ ID NO: 85272 - DNA, 25 bp, E. coli
gacaaaggtgacaccgcaaaagcga

SEQ ID NO: 85273 - DNA, 25 bp, E. coli
ccctggtactgatggcgctaaacag

SEQ ID NO: 85274 - DNA, 25 bp, E. coli
ccctggtactgaaggcgctaaacag

SEQ ID NO: 85275 - DNA, 25 bp, E. coli
cgcaaaagcgaatgccgtataccag

SEQ ID NO: 85276 - DNA, 25 bp, E. coli
cgcaaaagcgaaagccgtataccag

SEQ ID NO: 85277 - DNA, 25 bp, E. coli
gatgcgatgtttaaagtcggcgtca

SEQ ID NO: 85278 - DNA, 25 bp, E. coli
gatgcgatgttttaagtcggcgtca

SEQ ID NO: 85279 - DNA, 25 bp, E. coli
aattgctttgctggaaaatatgcgc

SEQ ID NO: 85280 - DNA, 25 bp, E. coli
aattgctttgctcgaaaatatgcgc

SEQ ID NO: 85281 - DNA, 25 bp, E. coli
aaaagcagactgcattgttggctgg

SEQ ID NO: 85282 - DNA, 25 bp, E. coli
aaaagcagactggattgttggctgg

SEQ ID NO: 85283 - DNA, 25 bp, E. coli
tatggttatcgggtgaatatgcgct

SEQ ID NO: 85284 - DNA, 25 bp, E. coli
tatggttatcggctgaatatgcgct

SEQ ID NO: 85285 - DNA, 25 bp, E. coli
tgacagttgtctcgctcccactgaa

SEQ ID NO: 85286 - DNA, 25 bp, E. coli
tgacagttgtctggctcccactgaa

SEQ ID NO: 85287 - DNA, 25 bp, E. coli
tcggtccgataactgcacagcttgg

SEQ ID NO: 85288 - DNA, 25 bp, E. coli
tcattttttatgtcgcgccagcgca

SEQ ID NO: 85289 - DNA, 25 bp, E. coli
tcattttttatgacgcgccagcgca

SEQ ID NO: 85290 - DNA, 25 bp, E. coli
tcggtccgataagtgcacagcttgg

SEQ ID NO: 85291 - DNA, 25 bp, E. coli
gctggctgcctgtgtaatcacgctg

SEQ ID NO: 85292 - DNA, 25 bp, E. coli
gctggctgcctgagtaatcacgctg

SEQ ID NO: 85293 - DNA, 25 bp, E. coli
gaaatactgttctcaatcccgctca

SEQ ID NO: 85294 - DNA, 25 bp, E. coli
gaaatactgttcacaatcccgctca

SEQ ID NO: 85295 - DNA, 25 bp, E. coli
cgcgcagaacgcgacctgaattgaa

SEQ ID NO: 85296 - DNA, 25 bp, E. coli
cgcgcagaacgccacctgaattgaa

SEQ ID NO: 85297 - DNA, 25 bp, E. coli
cattttggtctctacagtggatcga

SEQ ID NO: 85298 - DNA, 25 bp, E. coli
cattttggtctcaacagtggatcga

SEQ ID NO: 85299 - DNA, 25 bp, E. coli
cttttcttctgtccaatggtgggcg

SEQ ID NO: 85300 - DNA, 25 bp, E. coli
cttttcttctgtgcaatggtgggcg

SEQ ID NO: 85301 - DNA, 25 bp, E. coli
atcatcattaaaccggataaggacg

SEQ ID NO: 85302 - DNA, 25 bp, E. coli
atcatcattaaagcggataaggacg

SEQ ID NO: 85303 - DNA, 25 bp, E. coli
ttggttggttgcacgcctcgcattg

SEQ ID NO: 85304 - DNA, 25 bp, E. coli
ttggttggttgctcgcctcgcattg

SEQ ID NO: 85305 - DNA, 25 bp, E. coli
tcgcattgaagtggctgcgccgaaa

SEQ ID NO: 85306 - DNA, 25 bp, E. coli
tgcgccgaaagacccaatcaccatt

SEQ ID NO: 85307 - DNA, 25 bp, E. coli
tgcgccgaaagagccaatcaccatt

SEQ ID NO: 85308 - DNA, 25 bp, E. coli
tcgcattgaagtcgctgcgccgaaa

SEQ ID NO: 85309 - DNA, 25 bp, E. coli
tcttttatgttggttggttgcacgc

SEQ ID NO: 85310 - DNA, 25 bp, E. coli
tcttttatgttgcttggttgcacgc

SEQ ID NO: 85311 - DNA, 25 bp, E. coli
gccgcgtttgcgtcctcttttatgt

SEQ ID NO: 85312 - DNA, 25 bp, E. coli
gccgcgtttgcgacctcttttatgt

SEQ ID NO: 85313 - DNA, 25 bp, E. coli
gctcaaaacccgaagcgatctattt

SEQ ID NO: 85314 - DNA, 25 bp, E. coli
gctcaaaacccgtagcgatctattt

SEQ ID NO: 85315 - DNA, 25 bp, E. coli
gaagacctgctcaaaacccgtagcg

SEQ ID NO: 85316 - DNA, 25 bp, E. coli
gaagacctgctctaaacccgtagcg

SEQ ID NO: 85317 - DNA, 25 bp, E. coli
gaaaatagtgattgccgcgtttgcg

SEQ ID NO: 85318 - DNA, 25 bp, E. coli
gaaaatagtgatagccgcgtttgcg

SEQ ID NO: 85319 - DNA, 25 bp, E. coli
gataaggacgttgaagacctgctca

SEQ ID NO: 85320 - DNA, 25 bp, E. coli
gataaggacgttcaagacctgctca

SEQ ID NO: 85321 - DNA, 25 bp, E. coli
gagccaatcaccattaatatgaacg

SEQ ID NO: 85322 - DNA, 25 bp, E. coli
gagccaatcacctttaatatgaacg

SEQ ID NO: 85323 - DNA, 25 bp, E. coli
cactgggtgaatgggtgaaaaatac

SEQ ID NO: 85324 - DNA, 25 bp, E. coli
cactgggtgaatcggtgaaaaatac

SEQ ID NO: 85325 - DNA, 25 bp, E. coli
agcgaacggcgcatgaaaacactgg

SEQ ID NO: 85326 - DNA, 25 bp, E. coli
agcgaacggcgcttgaaaacactgg

SEQ ID NO: 85327 - DNA, 25 bp, E. coli
gcatgaaaacacagggtgaatcggt

SEQ ID NO: 85328 - DNA, 25 bp, E. coli
gcatgaaaacactgggtgaatcggt

SEQ ID NO: 85329 - DNA, 25 bp, E. coli
gaaaacgagagctcggagtttgacg

SEQ ID NO: 85330 - DNA, 25 bp, E. coli
gaacggcgcatgtaaacactgggtg

SEQ ID NO: 85331 - DNA, 25 bp, E. coli
gaaaacgagagcacggagtttgacg

SEQ ID NO: 85332 - DNA, 25 bp, E. coli
gaacggcgcatgaaaacactgggtg

SEQ ID NO: 85333 - DNA, 25 bp, E. coli
gaaaacactgggagaatcggtgaaa

SEQ ID NO: 85334 - DNA, 25 bp, E. coli
gaaaacactgggtgaatcggtgaaa

SEQ ID NO: 85335 - DNA, 25 bp, E. coli
cgagagcacggagtttgacgtcacc

SEQ ID NO: 85336 - DNA, 25 bp, E. coli
cgagagcacggactttgacgtcacc

SEQ ID NO: 85337 - DNA, 25 bp, E. coli
cggcgcatgaaaacactgggtgaat

SEQ ID NO: 85338 - DNA, 25 bp, E. coli
ctgggtgaatcgctgaaaaatacgc

SEQ ID NO: 85339 - DNA, 25 bp, E. coli
cggcgcatgaaatcactgggtgaat

SEQ ID NO: 85340 - DNA, 25 bp, E. coli
ctgggtgaatcggtgaaaaatacgc

SEQ ID NO: 85341 - DNA, 25 bp, E. coli
ggagtttgacgtcaccacgctgctg

SEQ ID NO: 85342 - DNA, 25 bp, E. coli
ggagtttgacgtgaccacgctgctg

SEQ ID NO: 85343 - DNA, 25 bp, E. coli
gagcacggagtttgacgtcaccacg

SEQ ID NO: 85344 - DNA, 25 bp, E. coli
gagcacggagttagacgtcaccacg

SEQ ID NO: 85345 - DNA, 25 bp, E. coli
caaatttttccgcacgttagagaca

SEQ ID NO: 85346 - DNA, 25 bp, E. coli
caaatttttccggacgttagagaca

SEQ ID NO: 85347 - DNA, 25 bp, E. coli
tacacgggcatgtcggttgtacaaa

SEQ ID NO: 85348 - DNA, 25 bp, E. coli
tacacgggcatgacggttgtacaaa

SEQ ID NO: 85349 - DNA, 25 bp, E. coli
aaaaaccgcctctggcaacataccg

SEQ ID NO: 85350 - DNA, 25 bp, E. coli
aaaaaccgcctcaggcaacataccg

SEQ ID NO: 85351 - DNA, 25 bp, E. coli
taccgcgaatcaaaactgccgtcaa

SEQ ID NO: 85352 - DNA, 25 bp, E. coli
taccgcgaatcataactgccgtcaa

SEQ ID NO: 85353 - DNA, 25 bp, E. coli
tgtcggttgtacaaaaaatgtgaag

SEQ ID NO: 85354 - DNA, 25 bp, E. coli
tgtgaagaggaacaaatttttccgc

SEQ ID NO: 85355 - DNA, 25 bp, E. coli
tgtgaagaggaagaaatttttccgc

SEQ ID NO: 85356 - DNA, 25 bp, E. coli
tgtcggttgtactaaaaatgtgaag

SEQ ID NO: 85357 - DNA, 25 bp, E. coli
gcgcaaaattcacgccactgtcata

SEQ ID NO: 85358 - DNA, 25 bp, E. coli
gcgcaaaattcaggccactgtcata

SEQ ID NO: 85359 - DNA, 25 bp, E. coli
cggagacggttatatttacaaatct

SEQ ID NO: 85360 - DNA, 25 bp, E. coli
ctcaggcaacattccggagacggtt

SEQ ID NO: 85361 - DNA, 25 bp, E. coli
ctcaggcaacataccggagacggtt

SEQ ID NO: 85362 - DNA, 25 bp, E. coli
cggagacggttaaatttacaaatct

SEQ ID NO: 85363 - DNA, 25 bp, E. coli
gtcatatttgtgagctacacgggca

SEQ ID NO: 85364 - DNA, 25 bp, E. coli
gtcatatttgtgtgctacacgggca

SEQ ID NO: 85365 - DNA, 25 bp, E. coli
taactgccgtcaatgcgcaaaattc

SEQ ID NO: 85366 - DNA, 25 bp, E. coli
taactgccgtcattgcgcaaaattc

SEQ ID NO: 85367 - DNA, 25 bp, E. coli
aatgaatgcggatttaaatctggcc

SEQ ID NO: 85368 - DNA, 25 bp, E. coli
aatgaatgcggaattaaatctggcc

SEQ ID NO: 85369 - DNA, 25 bp, E. coli
atctggccggatagtatttttgcta

SEQ ID NO: 85370 - DNA, 25 bp, E. coli
agtgatatgatagttgtggtgttga

SEQ ID NO: 85371 - DNA, 25 bp, E. coli
atctggccggattgtatttttgcta

SEQ ID NO: 85372 - DNA, 25 bp, E. coli
agtgatatgatacttgtggtgttga

SEQ ID NO: 85373 - DNA, 25 bp, E. coli
aaataacaatggagattatctccgg

SEQ ID NO: 85374 - DNA, 25 bp, E. coli
aacaatggtgataatctccggttga

SEQ ID NO: 85375 - DNA, 25 bp, E. coli
aacaatggtgattatctccggttga

SEQ ID NO: 85376 - DNA, 25 bp, E. coli
aaataacaatggtgattatctccgg

SEQ ID NO: 85377 - DNA, 25 bp, E. coli
tagttgtggtgttgattatttctgg

SEQ ID NO: 85378 - DNA, 25 bp, E. coli
tagttgtggtgtagattatttctgg

SEQ ID NO: 85379 - DNA, 25 bp, E. coli
tgctatatctatttttcaggagatt

SEQ ID NO: 85380 - DNA, 25 bp, E. coli
tgctatatctatatttcaggagatt

SEQ ID NO: 85381 - DNA, 25 bp, E. coli
tcaggagattataattaaatagaaa

SEQ ID NO: 85382 - DNA, 25 bp, E. coli
tcaggagattattattaaatagaaa

SEQ ID NO: 85383 - DNA, 25 bp, E. coli
gcggaattaaatgtggccggattgt

SEQ ID NO: 85384 - DNA, 25 bp, E. coli
gcggaattaaatctggccggattgt

SEQ ID NO: 85385 - DNA, 25 bp, E. coli
gattatttctggtaatgaatgcgga

SEQ ID NO: 85386 - DNA, 25 bp, E. coli
gattatttctggaaatgaatgcgga

SEQ ID NO: 85387 - DNA, 25 bp, E. coli
ggccggattgtatttttgctatatc

SEQ ID NO: 85388 - DNA, 25 bp, E. coli
ggccggattgtaattttgctatatc

SEQ ID NO: 85389 - DNA, 25 bp, E. coli
aatcgcgtaagtgtacgttgctgcg

SEQ ID NO: 85390 - DNA, 25 bp, E. coli
aatcgcgtaagtctacgttgctgcg

SEQ ID NO: 85391 - DNA, 25 bp, E. coli
taaatcgcgtaactctacgttgctg

SEQ ID NO: 85392 - DNA, 25 bp, E. coli
taaatcgcgtaagtctacgttgctg

SEQ ID NO: 85393 - DNA, 25 bp, E. coli
atcgcgtaagtcaacgttgctgcgc

SEQ ID NO: 85394 - DNA, 25 bp, E. coli
acgtaaatcgcgtaagtctacgttg

SEQ ID NO: 85395 - DNA, 25 bp, E. coli
atcgcgtaagtctacgttgctgcgc

SEQ ID NO: 85396 - DNA, 25 bp, E. coli
acgtaaatcgcgaaagtctacgttg

SEQ ID NO: 85397 - DNA, 25 bp, E. coli
aaatcgcgtaagactacgttgctgc

SEQ ID NO: 85398 - DNA, 25 bp, E. coli
aaatcgcgtaagtctacgttgctgc

SEQ ID NO: 85399 - DNA, 25 bp, E. coli
tcgcgtaagtctacgttgctgcgcc

SEQ ID NO: 85400 - DNA, 25 bp, E. coli
tcgcgtaagtcttcgttgctgcgcc

SEQ ID NO: 85401 - DNA, 25 bp, E. coli
cgcgtaagtctaggttgctgcgcca

SEQ ID NO: 85402 - DNA, 25 bp, E. coli
cgtaaatcgcgtaagtctacgttgc

SEQ ID NO: 85403 - DNA, 25 bp, E. coli
cgtaaatcgcgttagtctacgttgc

SEQ ID NO: 85404 - DNA, 25 bp, E. coli
cgcgtaagtctacgttgctgcgcca

SEQ ID NO: 85405 - DNA, 25 bp, E. coli
gtaaatcgcgtaagtctacgttgct

SEQ ID NO: 85406 - DNA, 25 bp, E. coli
gtaaatcgcgtatgtctacgttgct

SEQ ID NO: 85407 - DNA, 25 bp, E. coli
acgcactgtgctccgcctgctggat

SEQ ID NO: 85408 - DNA, 25 bp, E. coli
atctatggtgaacgcactgtgctcc

SEQ ID NO: 85409 - DNA, 25 bp, E. coli
atctatggtgaaggcactgtgctcc

SEQ ID NO: 85410 - DNA, 25 bp, E. coli
aactggaaggcataggacaaacgca

SEQ ID NO: 85411 - DNA, 25 bp, E. coli
acgcactgtgctgcgcctgctggat

SEQ ID NO: 85412 - DNA, 25 bp, E. coli
aactggaaggcaaaggacaaacgca

SEQ ID NO: 85413 - DNA, 25 bp, E. coli
tacccctggccgaaatattctgacg

SEQ ID NO: 85414 - DNA, 25 bp, E. coli
tacccctggccgtaatattctgacg

SEQ ID NO: 85415 - DNA, 25 bp, E. coli
ttctttcggcgcttaatacccctgg

SEQ ID NO: 85416 - DNA, 25 bp, E. coli
ttctttcggcgcataatacccctgg

SEQ ID NO: 85417 - DNA, 25 bp, E. coli
tggtgaacgcacagtgctccgcctg

SEQ ID NO: 85418 - DNA, 25 bp, E. coli
tcggcgcttaattcccctggccgta

SEQ ID NO: 85419 - DNA, 25 bp, E. coli
tcggcgcttaatacccctggccgta

SEQ ID NO: 85420 - DNA, 25 bp, E. coli
ccgtatcgccgctacaatcgcagat

SEQ ID NO: 85421 - DNA, 25 bp, E. coli
gaatatgaactggaaggcataggac

SEQ ID NO: 85422 - DNA, 25 bp, E. coli
gaatatgaactgcaaggcataggac

SEQ ID NO: 85423 - DNA, 25 bp, E. coli
cgccgcaacaatggcagatgtttaa

SEQ ID NO: 85424 - DNA, 25 bp, E. coli
ccctggccgtaaaattctgacggta

SEQ ID NO: 85425 - DNA, 25 bp, E. coli
ccgtatcgccgcaacaatcgcagat

SEQ ID NO: 85426 - DNA, 25 bp, E. coli
ccctggccgtaatattctgacggta

SEQ ID NO: 85427 - DNA, 25 bp, E. coli
cgccgcaacaatcgcagatgtttaa

SEQ ID NO: 85428 - DNA, 25 bp, E. coli
tggtgaacgcactgtgctccgcctg

SEQ ID NO: 85429 - DNA, 25 bp, E. coli
cactgatggcgcttataaaccggta

SEQ ID NO: 85430 - DNA, 25 bp, E. coli
cactgatggcgcatataaaccggta

SEQ ID NO: 85431 - DNA, 25 bp, E. coli
tactggaagcccctaagcagcgtga

SEQ ID NO: 85432 - DNA, 25 bp, E. coli
tactggaagcccgtaagcagcgtga

SEQ ID NO: 85433 - DNA, 25 bp, E. coli
tattgccaaaatcgtagcggcccca

SEQ ID NO: 85434 - DNA, 25 bp, E. coli
tattgccaaaatggtagcggcccca

SEQ ID NO: 85435 - DNA, 25 bp, E. coli
tttgaaggcaaggagacgatcggca

SEQ ID NO: 85436 - DNA, 25 bp, E. coli
ttagtggagatatcgcgacctggct

SEQ ID NO: 85437 - DNA, 25 bp, E. coli
ttaacctgctggtgcaagcctgggc

SEQ ID NO: 85438 - DNA, 25 bp, E. coli
tttgaaggcaagcagacgatcggca

SEQ ID NO: 85439 - DNA, 25 bp, E. coli
ttatggtgaatcacttgcccgccgc

SEQ ID NO: 85440 - DNA, 25 bp, E. coli
ttagtggagataacgcgacctggct

SEQ ID NO: 85441 - DNA, 25 bp, E. coli
ttaacctgctggagcaagcctgggc

SEQ ID NO: 85442 - DNA, 25 bp, E. coli
ttatggtgaatctcttgcccgccgc

SEQ ID NO: 85443 - DNA, 25 bp, E. coli
tcagtcccagaatgttaagcgcgtt

SEQ ID NO: 85444 - DNA, 25 bp, E. coli
tcagtcccagaaagttaagcgcgtt

SEQ ID NO: 85445 - DNA, 25 bp, E. coli
gaaaccaagtgggatcgctatagcg

SEQ ID NO: 85446 - DNA, 25 bp, E. coli
gaaaccaagtggcatcgctatagcg

SEQ ID NO: 85447 - DNA, 25 bp, E. coli
gatagctgccagaaacgtgaaccgc

SEQ ID NO: 85448 - DNA, 25 bp, E. coli
gatagctgccagtaacgtgaaccgc

SEQ ID NO: 85449 - DNA, 25 bp, E. coli
taatacaactgatcaatgcctggcg

SEQ ID NO: 85450 - DNA, 25 bp, E. coli
taatacaactgaacaatgcctggcg

SEQ ID NO: 85451 - DNA, 25 bp, E. coli
tactttacactcaaagacgacaccg

SEQ ID NO: 85452 - DNA, 25 bp, E. coli
tactttacactctaagacgacaccg

SEQ ID NO: 85453 - DNA, 25 bp, E. coli
ttttaacgacgaacgcgtagcgcgg

SEQ ID NO: 85454 - DNA, 25 bp, E. coli
ttaaagcgggtgtaatgctaaccac

SEQ ID NO: 85455 - DNA, 25 bp, E. coli
ttttaacgacgatcgcgtagcgcgg

SEQ ID NO: 85456 - DNA, 25 bp, E. coli
ttaaagcgggtgaaatgctaaccac

SEQ ID NO: 85457 - DNA, 25 bp, E. coli
tgaccattgccgtttttgttgccga

SEQ ID NO: 85458 - DNA, 25 bp, E. coli
tgaccattgccgattttgttgccga

SEQ ID NO: 85459 - DNA, 25 bp, E. coli
tgctaaccacacgtctggaagacgg

SEQ ID NO: 85460 - DNA, 25 bp, E. coli
tgctaaccacacctctggaagacgg

SEQ ID NO: 85461 - DNA, 25 bp, E. coli
gcatgagacggatgtgaccattgcc

SEQ ID NO: 85462 - DNA, 25 bp, E. coli
gcaagagttactccgccaggtgcaa

SEQ ID NO: 85463 - DNA, 25 bp, E. coli
gcaagagttactgcgccaggtgcaa

SEQ ID NO: 85464 - DNA, 25 bp, E. coli
gcatgagacggaagtgaccattgcc

SEQ ID NO: 85465 - DNA, 25 bp, E. coli
gaatcagcaaaatccacagccgaag

SEQ ID NO: 85466 - DNA, 25 bp, E. coli
gaatcagcaaaaaccacagccgaag

SEQ ID NO: 85467 - DNA, 25 bp, E. coli
ggattattatctggccaaccgcaca

SEQ ID NO: 85468 - DNA, 25 bp, E. coli
ggattattatctcgccaaccgcaca

SEQ ID NO: 85469 - DNA, 25 bp, E. coli
tggcgcgtggatacagcgttactac

SEQ ID NO: 85470 - DNA, 25 bp, E. coli
tggcgcgtggattcagcgttactac

SEQ ID NO: 85471 - DNA, 25 bp, E. coli
taatcgttgagactatgcagccggc

SEQ ID NO: 85472 - DNA, 25 bp, E. coli
taatcgttgagagtatgcagccggc

SEQ ID NO: 85473 - DNA, 25 bp, E. coli
caattgcatggtgctgatgtgaaaa

SEQ ID NO: 85474 - DNA, 25 bp, E. coli
caattgcatggtcctgatgtgaaaa

SEQ ID NO: 85475 - DNA, 25 bp, E. coli
cagcaatgacctatgatttaagtga

SEQ ID NO: 85476 - DNA, 25 bp, E. coli
cagaggcatcatttcgactatatca

SEQ ID NO: 85477 - DNA, 25 bp, E. coli
cagaggcatcatatcgactatatca

SEQ ID NO: 85478 - DNA, 25 bp, E. coli
cagcaatgacctttgatttaagtga

SEQ ID NO: 85479 - DNA, 25 bp, E. coli
taacggtaatatagatgcaaagagc

SEQ ID NO: 85480 - DNA, 25 bp, E. coli
tagaaggaagaaaaaggagaatccg

SEQ ID NO: 85481 - DNA, 25 bp, E. coli
tagaaggaagaataaggagaatccg

SEQ ID NO: 85482 - DNA, 25 bp, E. coli
ttcaagagctcaaaaagctaaagcg

SEQ ID NO: 85483 - DNA, 25 bp, E. coli
ttcaagagctcataaagctaaagcg

SEQ ID NO: 85484 - DNA, 25 bp, E. coli
tgttacagcgcactttaattatggg

SEQ ID NO: 85485 - DNA, 25 bp, E. coli
tgttacagcgcagtttaattatggg

SEQ ID NO: 85486 - DNA, 25 bp, E. coli
gctaaagcgaatggatagaaggaag

SEQ ID NO: 85487 - DNA, 25 bp, E. coli
gctaaagcgaatcgatagaaggaag

SEQ ID NO: 85488 - DNA, 25 bp, E. coli
ctgaagtataaaacacaacatggtg

SEQ ID NO: 85489 - DNA, 25 bp, E. coli
ctgaagtataaatcacaacatggtg

SEQ ID NO: 85490 - DNA, 25 bp, E. coli
taacggtaatattgatgcaaagagc

SEQ ID NO: 85491 - DNA, 25 bp, E. coli
gatggaattcgcagtaaataacggt

SEQ ID NO: 85492 - DNA, 25 bp, E. coli
gatgcaaagagcaaacttcaagagc

SEQ ID NO: 85493 - DNA, 25 bp, E. coli
gatgcaaagagctaacttcaagagc

SEQ ID NO: 85494 - DNA, 25 bp, E. coli
gatggaattcgctgtaaataacggt

SEQ ID NO: 85495 - DNA, 25 bp, E. coli
caatcccacagtcggcggcagaaga

SEQ ID NO: 85496 - DNA, 25 bp, E. coli
caatcccacagtgggcggcagaaga

SEQ ID NO: 85497 - DNA, 25 bp, E. coli
catgccatcaccgattatcagcaga

SEQ ID NO: 85498 - DNA, 25 bp, E. coli
catgccatcacccattatcagcaga

SEQ ID NO: 85499 - DNA, 25 bp, E. coli
aactgaagcaatcccacagtgggcg

SEQ ID NO: 85500 - DNA, 25 bp, E. coli
aactgaagcaatgccacagtgggcg

SEQ ID NO: 85501 - DNA, 25 bp, E. coli
tatcagcagattcgcgatgcagcgt

SEQ ID NO: 85502 - DNA, 25 bp, E. coli
tatcagcagattggcgatgcagcgt

SEQ ID NO: 85503 - DNA, 25 bp, E. coli
ttccactcatagaagcaaaagcagc

SEQ ID NO: 85504 - DNA, 25 bp, E. coli
ttgagtttgattgcacccaggcaac

SEQ ID NO: 85505 - DNA, 25 bp, E. coli
ttccactcatagtagcaaaagcagc

SEQ ID NO: 85506 - DNA, 25 bp, E. coli
ttgagtttgattccacccaggcaac

SEQ ID NO: 85507 - DNA, 25 bp, E. coli
tgtggtgacgcacgtctgtccgttt

SEQ ID NO: 85508 - DNA, 25 bp, E. coli
tgtggtgacgcaggtctgtccgttt

SEQ ID NO: 85509 - DNA, 25 bp, E. coli
tgattgcacccaggcaactgaagca

SEQ ID NO: 85510 - DNA, 25 bp, E. coli
tgattgcacccacgcaactgaagca

SEQ ID NO: 85511 - DNA, 25 bp, E. coli
tgcagcgtggaggatcaccgttcaa

SEQ ID NO: 85512 - DNA, 25 bp, E. coli
tgcagcgtggagcatcaccgttcaa

SEQ ID NO: 85513 - DNA, 25 bp, E. coli
gcaggtctgtccgtttccactcata

SEQ ID NO: 85514 - DNA, 25 bp, E. coli
gcaggtctgtccctttccactcata

SEQ ID NO: 85515 - DNA, 25 bp, E. coli
gagcatcaccgtacaaaaagcctga

SEQ ID NO: 85516 - DNA, 25 bp, E. coli
gagcatcaccgttcaaaaagcctga

SEQ ID NO: 85517 - DNA, 25 bp, E. coli
caaacggtgctgaggatgcgttaaa

SEQ ID NO: 85518 - DNA, 25 bp, E. coli
caaacggtgctgtggatgcgttaaa

SEQ ID NO: 85519 - DNA, 25 bp, E. coli
atgccaaacggtcctgtggatgcgt

SEQ ID NO: 85520 - DNA, 25 bp, E. coli
atgccaaacggtgctgtggatgcgt

SEQ ID NO: 85521 - DNA, 25 bp, E. coli
tagaggtgatcgaaaaagccaccag

SEQ ID NO: 85522 - DNA, 25 bp, E. coli
tagaggtgatcgtaaaagccaccag

SEQ ID NO: 85523 - DNA, 25 bp, E. coli
ttatgacgatgtagaggtgatcgta

SEQ ID NO: 85524 - DNA, 25 bp, E. coli
ttatgacgatgttgaggtgatcgta

SEQ ID NO: 85525 - DNA, 25 bp, E. coli
gccaaacggtgctgtggatgcgtta

SEQ ID NO: 85526 - DNA, 25 bp, E. coli
gccaaacggtgcagtggatgcgtta

SEQ ID NO: 85527 - DNA, 25 bp, E. coli
gctgtggatgcgttaaaggaagaat

SEQ ID NO: 85528 - DNA, 25 bp, E. coli
gctgtggatgcgataaaggaagaat

SEQ ID NO: 85529 - DNA, 25 bp, E. coli
gatgtagaggtgttcgtaaaagcca

SEQ ID NO: 85530 - DNA, 25 bp, E. coli
gatgtagaggtgatcgtaaaagcca

SEQ ID NO: 85531 - DNA, 25 bp, E. coli
gtgatcgtaaaagccaccagcaacg

SEQ ID NO: 85532 - DNA, 25 bp, E. coli
gtgatcgtaaaacccaccagcaacg

SEQ ID NO: 85533 - DNA, 25 bp, E. coli
tggatgcgttaatggaagaattaac

SEQ ID NO: 85534 - DNA, 25 bp, E. coli
tggatgcgttaaaggaagaattaac

SEQ ID NO: 85535 - DNA, 25 bp, E. coli
gatcgtaaaagccaccagcaacgat

SEQ ID NO: 85536 - DNA, 25 bp, E. coli
gaggtgatcgtataagccaccagca

SEQ ID NO: 85537 - DNA, 25 bp, E. coli
gatcgtaaaagcgaccagcaacgat

SEQ ID NO: 85538 - DNA, 25 bp, E. coli
gaggtgatcgtaaaagccaccagca

SEQ ID NO: 85539 - DNA, 25 bp, E. coli
caacggaaaaattaatggcaacgca

SEQ ID NO: 85540 - DNA, 25 bp, E. coli
caacggaaaaataaatggcaacgca

SEQ ID NO: 85541 - DNA, 25 bp, E. coli
caaaatggaccgatcagcacgacgt

SEQ ID NO: 85542 - DNA, 25 bp, E. coli
caaaatggaccgttcagcacgacgt

SEQ ID NO: 85543 - DNA, 25 bp, E. coli
agcacgacgtattacgatggccgca

SEQ ID NO: 85544 - DNA, 25 bp, E. coli
agcacgacgtataacgatggccgca

SEQ ID NO: 85545 - DNA, 25 bp, E. coli
aaaacaggttagttgtcgtgctcaa

SEQ ID NO: 85546 - DNA, 25 bp, E. coli
aactatcctgttagccaaaatggac

SEQ ID NO: 85547 - DNA, 25 bp, E. coli
aaaacaggttagatgtcgtgctcaa

SEQ ID NO: 85548 - DNA, 25 bp, E. coli
aactatcctgtttgccaaaatggac

SEQ ID NO: 85549 - DNA, 25 bp, E. coli
gccctaaggttgctgaaatactgga

SEQ ID NO: 85550 - DNA, 25 bp, E. coli
gccctaaggttggtgaaatactgga

SEQ ID NO: 85551 - DNA, 25 bp, E. coli
gaatgcaactttcgtaactatcctg

SEQ ID NO: 85552 - DNA, 25 bp, E. coli
gaatgcaactttggtaactatcctg

SEQ ID NO: 85553 - DNA, 25 bp, E. coli
cgattaatttcacccctaaggttgg

SEQ ID NO: 85554 - DNA, 25 bp, E. coli
cgattaatttcagccctaaggttgg

SEQ ID NO: 85555 - DNA, 25 bp, E. coli
cgtgctcaacggtaaaattaatggc

SEQ ID NO: 85556 - DNA, 25 bp, E. coli
cgtgctcaacggaaaaattaatggc

SEQ ID NO: 85557 - DNA, 25 bp, E. coli
ggtgaaatactggaatgcaactttg

SEQ ID NO: 85558 - DNA, 25 bp, E. coli
ggtgaaatactgcaatgcaactttg

SEQ ID NO: 85559 - DNA, 25 bp, E. coli
gatggccgcattgctcctgaaatga

SEQ ID NO: 85560 - DNA, 25 bp, E. coli
gatggccgcattcctcctgaaatga

SEQ ID NO: 85561 - DNA, 25 bp, E. coli
aattcctcgccagaaggtagcgatc

SEQ ID NO: 85562 - DNA, 25 bp, E. coli
aattcctcgccacaaggtagcgatc

SEQ ID NO: 85563 - DNA, 25 bp, E. coli
cagcctgacggatgctattgatacc

SEQ ID NO: 85564 - DNA, 25 bp, E. coli
cagcctgacggaagctattgatacc

SEQ ID NO: 85565 - DNA, 25 bp, E. coli
agttgcgcgaacctggcgttaattt

SEQ ID NO: 85566 - DNA, 25 bp, E. coli
agttgcgcgaacgtggcgttaattt

SEQ ID NO: 85567 - DNA, 25 bp, E. coli
tatgatgttggtgtatcgacactgt

SEQ ID NO: 85568 - DNA, 25 bp, E. coli
tatgcggcatctcgtcattctggtt

SEQ ID NO: 85569 - DNA, 25 bp, E. coli
tatgcggcatctggtcattctggtt

SEQ ID NO: 85570 - DNA, 25 bp, E. coli
tatgatgttggtctatcgacactgt

SEQ ID NO: 85571 - DNA, 25 bp, E. coli
tgtataagaagtttccggccggaga

SEQ ID NO: 85572 - DNA, 25 bp, E. coli
tgtataagaagtatccggccggaga

SEQ ID NO: 85573 - DNA, 25 bp, E. coli
tcgacactgtattagaagtttccgg

SEQ ID NO: 85574 - DNA, 25 bp, E. coli
tcgacactgtataagaagtttccgg

SEQ ID NO: 85575 - DNA, 25 bp, E. coli
tcattctggttgaggagttgcgcga

SEQ ID NO: 85576 - DNA, 25 bp, E. coli
tcattctggttgtggagttgcgcga

SEQ ID NO: 85577 - DNA, 25 bp, E. coli
ctattgataccactaccccaatggg

SEQ ID NO: 85578 - DNA, 25 bp, E. coli
ctattgataccagtaccccaatggg

SEQ ID NO: 85579 - DNA, 25 bp, E. coli
ggcgcaggccggacgattaattgca

SEQ ID NO: 85580 - DNA, 25 bp, E. coli
ggcgttaattttcgcagcctgacgg

SEQ ID NO: 85581 - DNA, 25 bp, E. coli
ggcgttaattttggcagcctgacgg

SEQ ID NO: 85582 - DNA, 25 bp, E. coli
ggcgcaggccggtcgattaattgca

SEQ ID NO: 85583 - DNA, 25 bp, E. coli
aacagactgttaatttagatattac

SEQ ID NO: 85584 - DNA, 25 bp, E. coli
aaaaaatatgttgatcatttgatgg

SEQ ID NO: 85585 - DNA, 25 bp, E. coli
aacagactgttattttagatattac

SEQ ID NO: 85586 - DNA, 25 bp, E. coli
aaaaaatatgttcatcatttgatgg

SEQ ID NO: 85587 - DNA, 25 bp, E. coli
tagcatctctgaacagactgttatt

SEQ ID NO: 85588 - DNA, 25 bp, E. coli
tagatattactaggttacgagattc

SEQ ID NO: 85589 - DNA, 25 bp, E. coli
tagatattactacgttacgagattc

SEQ ID NO: 85590 - DNA, 25 bp, E. coli
tagcatctctgatcagactgttatt

SEQ ID NO: 85591 - DNA, 25 bp, E. coli
tgttgttgatttttagcatctctga

SEQ ID NO: 85592 - DNA, 25 bp, E. coli
tgttgttgatttatagcatctctga

SEQ ID NO: 85593 - DNA, 25 bp, E. coli
tactacgttacgtgattcatttttc

SEQ ID NO: 85594 - DNA, 25 bp, E. coli
tactacgttacgagattcatttttc

SEQ ID NO: 85595 - DNA, 25 bp, E. coli
tctcattcaaaatatatgttcatca

SEQ ID NO: 85596 - DNA, 25 bp, E. coli
tctcattcaaaaaatatgttcatca

SEQ ID NO: 85597 - DNA, 25 bp, E. coli
cgaatattatgtatatctcattcaa

SEQ ID NO: 85598 - DNA, 25 bp, E. coli
cgttacgagattgatttttcttcga

SEQ ID NO: 85599 - DNA, 25 bp, E. coli
cgaatattatgtttatctcattcaa

SEQ ID NO: 85600 - DNA, 25 bp, E. coli
cgttacgagattcatttttcttcga

SEQ ID NO: 85601 - DNA, 25 bp, E. coli
gatttatagcatctctgaacagact

SEQ ID NO: 85602 - DNA, 25 bp, E. coli
gatttatagcatgtctgaacagact

SEQ ID NO: 85603 - DNA, 25 bp, E. coli
ggtttaaataatatctgcaaggcat

SEQ ID NO: 85604 - DNA, 25 bp, E. coli
ggtttaaataatttctgcaaggcat

SEQ ID NO: 85605 - DNA, 25 bp, E. coli
cactgcgcggtattaaagcgaggta

SEQ ID NO: 85606 - DNA, 25 bp, E. coli
cactgcgcggtaataaagcgaggta

SEQ ID NO: 85607 - DNA, 25 bp, E. coli
aaagttttacatcaacccgcattgg

SEQ ID NO: 85608 - DNA, 25 bp, E. coli
aaagttttacatgaacccgcattgg

SEQ ID NO: 85609 - DNA, 25 bp, E. coli
tttataagggtgtggagtatacacg

SEQ ID NO: 85610 - DNA, 25 bp, E. coli
tttataagggtgaggagtatacacg

SEQ ID NO: 85611 - DNA, 25 bp, E. coli
ttgccgctggcaacaacgccagctt

SEQ ID NO: 85612 - DNA, 25 bp, E. coli
ttgccgctggcatcaacgccagctt

SEQ ID NO: 85613 - DNA, 25 bp, E. coli
ttgattaattcgctttgccgctggc

SEQ ID NO: 85614 - DNA, 25 bp, E. coli
ttgattaattcggtttgccgctggc

SEQ ID NO: 85615 - DNA, 25 bp, E. coli
tggtgcggaattttactgcaattgc

SEQ ID NO: 85616 - DNA, 25 bp, E. coli
tggtgcggaattatactgcaattgc

SEQ ID NO: 85617 - DNA, 25 bp, E. coli
tgcaattgctgctgctttgtaaagc

SEQ ID NO: 85618 - DNA, 25 bp, E. coli
tgcaattgctgcagctttgtaaagc

SEQ ID NO: 85619 - DNA, 25 bp, E. coli
gccagcttatttgaaaatggtgcgg

SEQ ID NO: 85620 - DNA, 25 bp, E. coli
gccagcttatttcaaaatggtgcgg

SEQ ID NO: 85621 - DNA, 25 bp, E. coli
gcattggtcctacactgcgcggtaa

SEQ ID NO: 85622 - DNA, 25 bp, E. coli
gctttgtaaagctccgcggcctttt

SEQ ID NO: 85623 - DNA, 25 bp, E. coli
gctttgtaaagcaccgcggcctttt

SEQ ID NO: 85624 - DNA, 25 bp, E. coli
gcattggtcctagactgcgcggtaa

SEQ ID NO: 85625 - DNA, 25 bp, E. coli
gagtatacacgaggctttctccagg

SEQ ID NO: 85626 - DNA, 25 bp, E. coli
gagtatacacgacgctttctccagg

SEQ ID NO: 85627 - DNA, 25 bp, E. coli
catccggtgttaacaggctaccccg

SEQ ID NO: 85628 - DNA, 25 bp, E. coli
catccggtgttatcaggctaccccg

SEQ ID NO: 85629 - DNA, 25 bp, E. coli
caggctgtggcatccggtgttatca

SEQ ID NO: 85630 - DNA, 25 bp, E. coli
caggctgtggcaaccggtgttatca

SEQ ID NO: 85631 - DNA, 25 bp, E. coli
tataccgcggtgtattccggaccgg

SEQ ID NO: 85632 - DNA, 25 bp, E. coli
tataccgcggtgaattccggaccgg

SEQ ID NO: 85633 - DNA, 25 bp, E. coli
tgtatcgtgcctggctgaaacaggc

SEQ ID NO: 85634 - DNA, 25 bp, E. coli
tgtatcgtgcctcgctgaaacaggc

SEQ ID NO: 85635 - DNA, 25 bp, E. coli
tgtggcatccggtgttatcaggcta

SEQ ID NO: 85636 - DNA, 25 bp, E. coli
tgtggcatccggagttatcaggcta

SEQ ID NO: 85637 - DNA, 25 bp, E. coli
tgaccgttcttcactgtataccgcg

SEQ ID NO: 85638 - DNA, 25 bp, E. coli
tgaaacaggctgtggcatccggtgt

SEQ ID NO: 85639 - DNA, 25 bp, E. coli
tgaaacaggctgaggcatccggtgt

SEQ ID NO: 85640 - DNA, 25 bp, E. coli
tgaccgttcttctctgtataccgcg

SEQ ID NO: 85641 - DNA, 25 bp, E. coli
cctggctgaaactggctgtggcatc

SEQ ID NO: 85642 - DNA, 25 bp, E. coli
cctggctgaaacaggctgtggcatc

SEQ ID NO: 85643 - DNA, 25 bp, E. coli
cggtgtattccggaccggtgatgcc

SEQ ID NO: 85644 - DNA, 25 bp, E. coli
cggtgtattccgcaccggtgatgcc

SEQ ID NO: 85645 - DNA, 25 bp, E. coli
gttcttcactgtataccgcggtgta

SEQ ID NO: 85646 - DNA, 25 bp, E. coli
gttcttcactgtttaccgcggtgta

SEQ ID NO: 85647 - DNA, 25 bp, E. coli
gttatcaggctaccccgcgatcttg

SEQ ID NO: 85648 - DNA, 25 bp, E. coli
gttatcaggctagcccgcgatcttg

SEQ ID NO: 85649 - DNA, 25 bp, E. coli
caatggcgctctcctgtgaatacac

SEQ ID NO: 85650 - DNA, 25 bp, E. coli
caatggcgctctgctgtgaatacac

SEQ ID NO: 85651 - DNA, 25 bp, E. coli
aaccctgagtggcattgcgctgtca

SEQ ID NO: 85652 - DNA, 25 bp, E. coli
caaaggtcattgacgcggactgtaa

SEQ ID NO: 85653 - DNA, 25 bp, E. coli
caaaggtcattgtcgcggactgtaa

SEQ ID NO: 85654 - DNA, 25 bp, E. coli
taaatgcctgatagtgccgggagaa

SEQ ID NO: 85655 - DNA, 25 bp, E. coli
taaatgcctgattgtgccgggagaa

SEQ ID NO: 85656 - DNA, 25 bp, E. coli
aaagcctggctagtgagcgccgtag

SEQ ID NO: 85657 - DNA, 25 bp, E. coli
aaagcctggctactgagcgccgtag

SEQ ID NO: 85658 - DNA, 25 bp, E. coli
aaccctgagtgggattgcgctgtca

SEQ ID NO: 85659 - DNA, 25 bp, E. coli
tattgcacaaaacctggcgttgctg

SEQ ID NO: 85660 - DNA, 25 bp, E. coli
tattgcacaaaagctggcgttgctg

SEQ ID NO: 85661 - DNA, 25 bp, E. coli
tgttattaatgtaaccggagcgggc

SEQ ID NO: 85662 - DNA, 25 bp, E. coli
tgttattaatgttaccggagcgggc

SEQ ID NO: 85663 - DNA, 25 bp, E. coli
tcgtttcgcacacggatgttcgtca

SEQ ID NO: 85664 - DNA, 25 bp, E. coli
tcgtttcgcacagggatgttcgtca

SEQ ID NO: 85665 - DNA, 25 bp, E. coli
gtctgcgccgatgaaaaccaatgtt

SEQ ID NO: 85666 - DNA, 25 bp, E. coli
gtctgcgccgatcaaaaccaatgtt

SEQ ID NO: 85667 - DNA, 25 bp, E. coli
tcaacatggcctcaaccgactggta

SEQ ID NO: 85668 - DNA, 25 bp, E. coli
tcaacatggcctgaaccgactggta

SEQ ID NO: 85669 - DNA, 25 bp, E. coli
gaggcactggcaaggattctggata

SEQ ID NO: 85670 - DNA, 25 bp, E. coli
gaggcactggcatggattctggata

SEQ ID NO: 85671 - DNA, 25 bp, E. coli
accacagcctgtccaacatcgtgtt

SEQ ID NO: 85672 - DNA, 25 bp, E. coli
accacagcctgtgcaacatcgtgtt

SEQ ID NO: 85673 - DNA, 25 bp, E. coli
tattttcaggccaaacaccacagcc

SEQ ID NO: 85674 - DNA, 25 bp, E. coli
tattttcaggcctaacaccacagcc

SEQ ID NO: 85675 - DNA, 25 bp, E. coli
tctggaaagcagttcacagtaaata

SEQ ID NO: 85676 - DNA, 25 bp, E. coli
tctggaaagcagatcacagtaaata

SEQ ID NO: 85677 - DNA, 25 bp, E. coli
gcgccggatcggaccaatttgaatt

SEQ ID NO: 85678 - DNA, 25 bp, E. coli
gcgccggatcggtccaatttgaatt

SEQ ID NO: 85679 - DNA, 25 bp, E. coli
gcaacatcgtgtaccaacgaacgaa

SEQ ID NO: 85680 - DNA, 25 bp, E. coli
gcaacatcgtgttccaacgaacgaa

SEQ ID NO: 85681 - DNA, 25 bp, E. coli
gaacgaattatatccacggctggac

SEQ ID NO: 85682 - DNA, 25 bp, E. coli
gaacgaattataaccacggctggac

SEQ ID NO: 85683 - DNA, 25 bp, E. coli
cccgctggtaagacgtgttgataac

SEQ ID NO: 85684 - DNA, 25 bp, E. coli
cccgctggtaagtcgtgttgataac

SEQ ID NO: 85685 - DNA, 25 bp, E. coli
gatcatcgctttgcccgctggtaag

SEQ ID NO: 85686 - DNA, 25 bp, E. coli
gataacgggcagttgcatcactgcc

SEQ ID NO: 85687 - DNA, 25 bp, E. coli
gatcatcgctttccccgctggtaag

SEQ ID NO: 85688 - DNA, 25 bp, E. coli
gataacgggcagatgcatcactgcc

SEQ ID NO: 85689 - DNA, 25 bp, E. coli
ggctggaccccgatgcaattaagat

SEQ ID NO: 85690 - DNA, 25 bp, E. coli
ggctggaccccgttgcaattaagat

SEQ ID NO: 85691 - DNA, 25 bp, E. coli
gagatttataatgcaggccattggg

SEQ ID NO: 85692 - DNA, 25 bp, E. coli
gagatttataatccaggccattggg

SEQ ID NO: 85693 - DNA, 25 bp, E. coli
caaagcttgcatgtattcagcgcga

SEQ ID NO: 85694 - DNA, 25 bp, E. coli
caaagcttgcatctattcagcgcga

SEQ ID NO: 85695 - DNA, 25 bp, E. coli
tactcgaaggaggtaaccgtgaacg

SEQ ID NO: 85696 - DNA, 25 bp, E. coli
tactcgaaggagctaaccgtgaacg

SEQ ID NO: 85697 - DNA, 25 bp, E. coli
aaatgcggctataggtgaactgaac

SEQ ID NO: 85698 - DNA, 25 bp, E. coli
aaactcaagctgtagtaaatgcggc

SEQ ID NO: 85699 - DNA, 25 bp, E. coli
aaatgcggctattggtgaactgaac

SEQ ID NO: 85700 - DNA, 25 bp, E. coli
aaactcaagctgaagtaaatgcggc

SEQ ID NO: 85701 - DNA, 25 bp, E. coli
tatccttagccatcttgagtcggga

SEQ ID NO: 85702 - DNA, 25 bp, E. coli
tatccttagccaacttgagtcggga

SEQ ID NO: 85703 - DNA, 25 bp, E. coli
tgaattaacggctgcaatgacggct

SEQ ID NO: 85704 - DNA, 25 bp, E. coli
tgaattaacggcagcaatgacggct

SEQ ID NO: 85705 - DNA, 25 bp, E. coli
gctattcgtgaaaccgcccagattg

SEQ ID NO: 85706 - DNA, 25 bp, E. coli
gctattcgtgaatccgcccagattg

SEQ ID NO: 85707 - DNA, 25 bp, E. coli
gatacttcagcctttcccggttaga

SEQ ID NO: 85708 - DNA, 25 bp, E. coli
gatacttcagccattcccggttaga

SEQ ID NO: 85709 - DNA, 25 bp, E. coli
ggatatccccaacaacaataagagt

SEQ ID NO: 85710 - DNA, 25 bp, E. coli
ggatatccccaagaacaataagagt

SEQ ID NO: 85711 - DNA, 25 bp, E. coli
tggccagaaaactgaacggcaatct

SEQ ID NO: 85712 - DNA, 25 bp, E. coli
tggccagaaaacagaacggcaatct

SEQ ID NO: 85713 - DNA, 25 bp, E. coli
gaggctcagacggaaggttatatcc

SEQ ID NO: 85714 - DNA, 25 bp, E. coli
gaggctcagacgcaaggttatatcc

SEQ ID NO: 85715 - DNA, 25 bp, E. coli
aatcgcaccgtgacatgtcgcctgg

SEQ ID NO: 85716 - DNA, 25 bp, E. coli
aatcgcaccgtgtcatgtcgcctgg

SEQ ID NO: 85717 - DNA, 25 bp, E. coli
taaaagccagcgtcagacaagctgg

SEQ ID NO: 85718 - DNA, 25 bp, E. coli
taaaagccagcgacagacaagctgg

SEQ ID NO: 85719 - DNA, 25 bp, E. coli
attacggcgggttgagtgcaaagaa

SEQ ID NO: 85720 - DNA, 25 bp, E. coli
attacggcgggtagagtgcaaagaa

SEQ ID NO: 85721 - DNA, 25 bp, E. coli
tgcaaagaaggaccaaaatctgccc

SEQ ID NO: 85722 - DNA, 25 bp, E. coli
tgcaaagaaggagcaaaatctgccc

SEQ ID NO: 85723 - DNA, 25 bp, E. coli
tacattaacctgtttcaggtgagtg

SEQ ID NO: 85724 - DNA, 25 bp, E. coli
tacattaacctgattcaggtgagtg

SEQ ID NO: 85725 - DNA, 25 bp, E. coli
tcaggtgagtgttaatggtaaagcg

SEQ ID NO: 85726 - DNA, 25 bp, E. coli
tcaggtgagtgtaaatggtaaagcg

SEQ ID NO: 85727 - DNA, 25 bp, E. coli
gcctggcgggcgataaatgattacg

SEQ ID NO: 85728 - DNA, 25 bp, E. coli
gcctggcgggcgttaaatgattacg

SEQ ID NO: 85729 - DNA, 25 bp, E. coli
gacaagctggtgacaggcaatcgca

SEQ ID NO: 85730 - DNA, 25 bp, E. coli
gacaagctggtgtcaggcaatcgca

SEQ ID NO: 85731 - DNA, 25 bp, E. coli
cgataaatgattacggcgggttgag

SEQ ID NO: 85732 - DNA, 25 bp, E. coli
cgataaatgatttcggcgggttgag

SEQ ID NO: 85733 - DNA, 25 bp, E. coli
taagtaatgtggcagttgtgccgcc

SEQ ID NO: 85734 - DNA, 25 bp, E. coli
taagtaatgtgggagttgtgccgcc

SEQ ID NO: 85735 - DNA, 25 bp, E. coli
gagttgtgccgcctaaaagccagcg

SEQ ID NO: 85736 - DNA, 25 bp, E. coli
gagttgtgccgcgtaaaagccagcg

SEQ ID NO: 85737 - DNA, 25 bp, E. coli
caagagcatgtcaactggctgcata

SEQ ID NO: 85738 - DNA, 25 bp, E. coli
aatagattccaacctcaagagcatg

SEQ ID NO: 85739 - DNA, 25 bp, E. coli
aatagattccaagctcaagagcatg

SEQ ID NO: 85740 - DNA, 25 bp, E. coli
caagagcatgtctactggctgcata

SEQ ID NO: 85741 - DNA, 25 bp, E. coli
taaaccaacatggagataattcagg

SEQ ID NO: 85742 - DNA, 25 bp, E. coli
taaaccaacatgcagataattcagg

SEQ ID NO: 85743 - DNA, 25 bp, E. coli
gaatcgaatggctcgtacagaagat

SEQ ID NO: 85744 - DNA, 25 bp, E. coli
gaatcgaatggcacgtacagaagat

SEQ ID NO: 85745 - DNA, 25 bp, E. coli
tatggagcaacatgatgagagcgtg

SEQ ID NO: 85746 - DNA, 25 bp, E. coli
tagcaacgctgatacaattagagat

SEQ ID NO: 85747 - DNA, 25 bp, E. coli
tatggagcaacaagatgagagcgtg

SEQ ID NO: 85748 - DNA, 25 bp, E. coli
tagcaacgctgaaacaattagagat

SEQ ID NO: 85749 - DNA, 25 bp, E. coli
tgagtggattccaccggttatggca

SEQ ID NO: 85750 - DNA, 25 bp, E. coli
tgagtggattcctccggttatggca

SEQ ID NO: 85751 - DNA, 25 bp, E. coli
tgagcctcgtcccaatcaagtgaac

SEQ ID NO: 85752 - DNA, 25 bp, E. coli
tgagcctcgtccgaatcaagtgaac

SEQ ID NO: 85753 - DNA, 25 bp, E. coli
gctttccgagaaaaaagatcgtgac

SEQ ID NO: 85754 - DNA, 25 bp, E. coli
gctttccgagaataaagatcgtgac

SEQ ID NO: 85755 - DNA, 25 bp, E. coli
gattggctgaacagaaaatgagaca

SEQ ID NO: 85756 - DNA, 25 bp, E. coli
gattggctgaactgaaaatgagaca

SEQ ID NO: 85757 - DNA, 25 bp, E. coli
gagcaaatagaaacagcatggtcgc

SEQ ID NO: 85758 - DNA, 25 bp, E. coli
gagcaaatagaatcagcatggtcgc

SEQ ID NO: 85759 - DNA, 25 bp, E. coli
taaattgcgtcagaaagtacccggt

SEQ ID NO: 85760 - DNA, 25 bp, E. coli
taaattgcgtcacaaagtacccggt

SEQ ID NO: 85761 - DNA, 25 bp, E. coli
tatcaggtaggctaagagctgccgc

SEQ ID NO: 85762 - DNA, 25 bp, E. coli
tatcaggtaggcaaagagctgccgc

SEQ ID NO: 85763 - DNA, 25 bp, E. coli
tctgggatggtcctgcggcaacatt

SEQ ID NO: 85764 - DNA, 25 bp, E. coli
tctgggatggtcgtgcggcaacatt

SEQ ID NO: 85765 - DNA, 25 bp, E. coli
tctatccgcaagctttcagtggcga

SEQ ID NO: 85766 - DNA, 25 bp, E. coli
tctatccgcaaggtttcagtggcga

SEQ ID NO: 85767 - DNA, 25 bp, E. coli
cctggattgcaatacagcgcgcgga

SEQ ID NO: 85768 - DNA, 25 bp, E. coli
cctggattgcaaaacagcgcgcgga

SEQ ID NO: 85769 - DNA, 25 bp, E. coli
gctttctccgcgtaaaaggatgcga

SEQ ID NO: 85770 - DNA, 25 bp, E. coli
gctttctccgcgaaaaaggatgcga

SEQ ID NO: 85771 - DNA, 25 bp, E. coli
gaaaatggtctcacgtattaccgcg

SEQ ID NO: 85772 - DNA, 25 bp, E. coli
gaaaatggtctctcgtattaccgcg

SEQ ID NO: 85773 - DNA, 25 bp, E. coli
cgcgccgacggtatttaactcagta

SEQ ID NO: 85774 - DNA, 25 bp, E. coli
cgcgccgacggtttttaactcagta

SEQ ID NO: 85775 - DNA, 25 bp, E. coli
cattgcaggatcaggctggtggacc

SEQ ID NO: 85776 - DNA, 25 bp, E. coli
cattgcaggatctggctggtggacc

SEQ ID NO: 85777 - DNA, 25 bp, E. coli
tggaccgccgttgaacccgattgaa

SEQ ID NO: 85778 - DNA, 25 bp, E. coli
tggaccgccgttcaacccgattgaa

SEQ ID NO: 85779 - DNA, 25 bp, E. coli
gataataaacgctgtaaacaggccg

SEQ ID NO: 85780 - DNA, 25 bp, E. coli
gataataaacgcagtaaacaggccg

SEQ ID NO: 85781 - DNA, 25 bp, E. coli
cttgaaaatcttgaaagcggttgga

SEQ ID NO: 85782 - DNA, 25 bp, E. coli
cttgaaaatcttcaaagcggttgga

SEQ ID NO: 85783 - DNA, 25 bp, E. coli
tacgcgcaaaaaatcgatcgatctg

SEQ ID NO: 85784 - DNA, 25 bp, E. coli
tacgcgcaaaaattcgatcgatctg

SEQ ID NO: 85785 - DNA, 25 bp, E. coli
tgaagcaggatcagcaggcattgct

SEQ ID NO: 85786 - DNA, 25 bp, E. coli
tgctctcgctggtaaatgaacccgt

SEQ ID NO: 85787 - DNA, 25 bp, E. coli
tgctctcgctggaaaatgaacccgt

SEQ ID NO: 85788 - DNA, 25 bp, E. coli
tgaagcaggatctgcaggcattgct

SEQ ID NO: 85789 - DNA, 25 bp, E. coli
tgcggaaaacaaagagaaatacgcg

SEQ ID NO: 85790 - DNA, 25 bp, E. coli
tgcggaaaacaatgagaaatacgcg

SEQ ID NO: 85791 - DNA, 25 bp, E. coli
ccggaactggtcaatcgcatgaagc

SEQ ID NO: 85792 - DNA, 25 bp, E. coli
ccggaactggtctatcgcatgaagc

SEQ ID NO: 85793 - DNA, 25 bp, E. coli
gcgtcgcggtaatacgctttctgaa

SEQ ID NO: 85794 - DNA, 25 bp, E. coli
gcgtcgcggtaaaacgctttctgaa

SEQ ID NO: 85795 - DNA, 25 bp, E. coli
gcaggcattgctgggtaaggaataa

SEQ ID NO: 85796 - DNA, 25 bp, E. coli
gcaggcattgctcggtaaggaataa

SEQ ID NO: 85797 - DNA, 25 bp, E. coli
gacaagcatatgtatccggaactgg

SEQ ID NO: 85798 - DNA, 25 bp, E. coli
gaaacgattgttcagctgattgaag

SEQ ID NO: 85799 - DNA, 25 bp, E. coli
gacaagcatatgaatccggaactgg

SEQ ID NO: 85800 - DNA, 25 bp, E. coli
gaaacgattgttgagctgattgaag

SEQ ID NO: 85801 - DNA, 25 bp, E. coli
taatcacccgttacatagaagccag

SEQ ID NO: 85802 - DNA, 25 bp, E. coli
taatcacccgtttcatagaagccag

SEQ ID NO: 85803 - DNA, 25 bp, E. coli
taacgaactggaagatgtcagcccg

SEQ ID NO: 85804 - DNA, 25 bp, E. coli
tatcgaaaaacagtgagcttaccgc

SEQ ID NO: 85805 - DNA, 25 bp, E. coli
tatcgaaaaacactgagcttaccgc

SEQ ID NO: 85806 - DNA, 25 bp, E. coli
tatttgcaggaaaccgggcaaccca

SEQ ID NO: 85807 - DNA, 25 bp, E. coli
tatcttccgtatagcactggtggcg

SEQ ID NO: 85808 - DNA, 25 bp, E. coli
tatttgcaggaatccgggcaaccca

SEQ ID NO: 85809 - DNA, 25 bp, E. coli
tatcttccgtattgcactggtggcg

SEQ ID NO: 85810 - DNA, 25 bp, E. coli
tgaaatcgctgaacgagcagggcca

SEQ ID NO: 85811 - DNA, 25 bp, E. coli
tgaaatcgctgatcgagcagggcca

SEQ ID NO: 85812 - DNA, 25 bp, E. coli
gaagagttatcattgccgggcaata

SEQ ID NO: 85813 - DNA, 25 bp, E. coli
gaagagttatcaatgccgggcaata

SEQ ID NO: 85814 - DNA, 25 bp, E. coli
gaataccgccttgcactgtgggaaa

SEQ ID NO: 85815 - DNA, 25 bp, E. coli
gaataccgccttccactgtgggaaa

SEQ ID NO: 85816 - DNA, 25 bp, E. coli
gacaaaacgtggatcctgcatggtg

SEQ ID NO: 85817 - DNA, 25 bp, E. coli
gacaaaacgtggttcctgcatggtg

SEQ ID NO: 85818 - DNA, 25 bp, E. coli
cattaccggcaaaatgctgtgggcc

SEQ ID NO: 85819 - DNA, 25 bp, E. coli
cattaccggcaatatgctgtgggcc

SEQ ID NO: 85820 - DNA, 25 bp, E. coli
ggtagcgtcgcctttacagcaacag

SEQ ID NO: 85821 - DNA, 25 bp, E. coli
ggtagcgtcgccattacagcaacag

SEQ ID NO: 85822 - DNA, 25 bp, E. coli
ggcaatcggcctacaccagtatgga

SEQ ID NO: 85823 - DNA, 25 bp, E. coli
ggcaatcggccttcaccagtatgga

SEQ ID NO: 85824 - DNA, 25 bp, E. coli
taacgaactggatgatgtcagcccg

SEQ ID NO: 85825 - DNA, 25 bp, E. coli
catcagcagggggaaatcgttcgct

SEQ ID NO: 85826 - DNA, 25 bp, E. coli
cagacttatctgcaagacggcaaat

SEQ ID NO: 85827 - DNA, 25 bp, E. coli
catcagcaggggcaaatcgttcgct

SEQ ID NO: 85828 - DNA, 25 bp, E. coli
cagacttatctggaagacggcaaat

SEQ ID NO: 85829 - DNA, 25 bp, E. coli
acttatctggaacacggcaaatgct

SEQ ID NO: 85830 - DNA, 25 bp, E. coli
acttatctggaagacggcaaatgct

SEQ ID NO: 85831 - DNA, 25 bp, E. coli
accgctgtcggtcagcagatccaga

SEQ ID NO: 85832 - DNA, 25 bp, E. coli
accgctgtcggtgagcagatccaga

SEQ ID NO: 85833 - DNA, 25 bp, E. coli
gcggtaacttcagcgctgtcggtca

SEQ ID NO: 85834 - DNA, 25 bp, E. coli
gcggtaacttcaccgctgtcggtca

SEQ ID NO: 85835 - DNA, 25 bp, E. coli
gaaatcgttcgctacttcagcatgg

SEQ ID NO: 85836 - DNA, 25 bp, E. coli
gaaatcgttcgcaacttcagcatgg

SEQ ID NO: 85837 - DNA, 25 bp, E. coli
ctacttcagcatgggtaaaagatgc

SEQ ID NO: 85838 - DNA, 25 bp, E. coli
cgttcgctacttgagcatgggtaaa

SEQ ID NO: 85839 - DNA, 25 bp, E. coli
cgttcgctacttcagcatgggtaaa

SEQ ID NO: 85840 - DNA, 25 bp, E. coli
ctacttcagcatcggtaaaagatgc

SEQ ID NO: 85841 - DNA, 25 bp, E. coli
gtcggtcagcagatccagacttatc

SEQ ID NO: 85842 - DNA, 25 bp, E. coli
gtcgtaaccggcgaaatcactacta

SEQ ID NO: 85843 - DNA, 25 bp, E. coli
gtcgtaaccggccaaatcactacta

SEQ ID NO: 85844 - DNA, 25 bp, E. coli
gtcggtcagcagttccagacttatc

SEQ ID NO: 85845 - DNA, 25 bp, E. coli
ggcgaaatcacttctatccagtcgt

SEQ ID NO: 85846 - DNA, 25 bp, E. coli
ggcgaaatcactactatccagtcgt

SEQ ID NO: 85847 - DNA, 25 bp, E. coli
cataagagcttctgtgcacaggacg

SEQ ID NO: 85848 - DNA, 25 bp, E. coli
cataagagcttcagtgcacaggacg

SEQ ID NO: 85849 - DNA, 25 bp, E. coli
tgtgcacaggaccttgccgcggtaa

SEQ ID NO: 85850 - DNA, 25 bp, E. coli
tgtgcacaggacgttgccgcggtaa

SEQ ID NO: 85851 - DNA, 25 bp, E. coli
tgcacaggacgttgccgcggtaaca

SEQ ID NO: 85852 - DNA, 25 bp, E. coli
tgcacaggacgtagccgcggtaaca

SEQ ID NO: 85853 - DNA, 25 bp, E. coli
tctgtgcacaggacgttgccgcggt

SEQ ID NO: 85854 - DNA, 25 bp, E. coli
tctgtgcacaggtcgttgccgcggt

SEQ ID NO: 85855 - DNA, 25 bp, E. coli
gcataagagcttgtgtgcacaggac

SEQ ID NO: 85856 - DNA, 25 bp, E. coli
gcataagagcttctgtgcacaggac

SEQ ID NO: 85857 - DNA, 25 bp, E. coli
gcacaggacgttcccgcggtaacag

SEQ ID NO: 85858 - DNA, 25 bp, E. coli
gcacaggacgttgccgcggtaacag

SEQ ID NO: 85859 - DNA, 25 bp, E. coli
cgcataagagctactgtgcacagga

SEQ ID NO: 85860 - DNA, 25 bp, E. coli
cgcataagagcttctgtgcacagga

SEQ ID NO: 85861 - DNA, 25 bp, E. coli
ggacgcataagagcttctgtgcaca

SEQ ID NO: 85862 - DNA, 25 bp, E. coli
ggacgcataagaccttctgtgcaca

SEQ ID NO: 85863 - DNA, 25 bp, E. coli
taagagcttctgagcacaggacgtt

SEQ ID NO: 85864 - DNA, 25 bp, E. coli
taagagcttctgtgcacaggacgtt

SEQ ID NO: 85865 - DNA, 25 bp, E. coli
gagcttctgtgcacaggacgttgcc

SEQ ID NO: 85866 - DNA, 25 bp, E. coli
gacgcataagaggttctgtgcacag

SEQ ID NO: 85867 - DNA, 25 bp, E. coli
gacgcataagagcttctgtgcacag

SEQ ID NO: 85868 - DNA, 25 bp, E. coli
gagcttctgtgctcaggacgttgcc

SEQ ID NO: 85869 - DNA, 25 bp, E. coli
catacgtgacaagggcactgacgat

SEQ ID NO: 85870 - DNA, 25 bp, E. coli
catacgtgacaacggcactgacgat

SEQ ID NO: 85871 - DNA, 25 bp, E. coli
acgttccggcaatcccggtacatca

SEQ ID NO: 85872 - DNA, 25 bp, E. coli
cttttctggtctgaaaaccttcgcg

SEQ ID NO: 85873 - DNA, 25 bp, E. coli
agtgctaaccgctcactgcgggcga

SEQ ID NO: 85874 - DNA, 25 bp, E. coli
agtgctaaccgcacactgcgggcga

SEQ ID NO: 85875 - DNA, 25 bp, E. coli
acgttccggcaaacccggtacatca

SEQ ID NO: 85876 - DNA, 25 bp, E. coli
cttttctggtctcaaaaccttcgcg

SEQ ID NO: 85877 - DNA, 25 bp, E. coli
ttaagtgtaagccagcactggatca

SEQ ID NO: 85878 - DNA, 25 bp, E. coli
ttaagtgtaagcgagcactggatca

SEQ ID NO: 85879 - DNA, 25 bp, E. coli
gctggatttcagcttttctggtctg

SEQ ID NO: 85880 - DNA, 25 bp, E. coli
gctggatttcaggttttctggtctg

SEQ ID NO: 85881 - DNA, 25 bp, E. coli
ctaaccgcacactgcgggcgaagct

SEQ ID NO: 85882 - DNA, 25 bp, E. coli
ctgacgatcagaggcgtgccgatat

SEQ ID NO: 85883 - DNA, 25 bp, E. coli
ctgacgatcagacgcgtgccgatat

SEQ ID NO: 85884 - DNA, 25 bp, E. coli
ctaaccgcacacagcgggcgaagct

SEQ ID NO: 85885 - DNA, 25 bp, E. coli
ggtacatcatatggaaggacatctg

SEQ ID NO: 85886 - DNA, 25 bp, E. coli
ggtacatcatatcgaaggacatctg

SEQ ID NO: 85887 - DNA, 25 bp, E. coli
ggcaatcccggtacatcatatggaa

SEQ ID NO: 85888 - DNA, 25 bp, E. coli
ggcaatcccggttcatcatatggaa

SEQ ID NO: 85889 - DNA, 25 bp, E. coli
taagcgagcactcgatcagacgggc

SEQ ID NO: 85890 - DNA, 25 bp, E. coli
taagcgagcactggatcagacgggc

SEQ ID NO: 85891 - DNA, 25 bp, E. coli
caagacgcacttcaagccttgcgca

SEQ ID NO: 85892 - DNA, 25 bp, E. coli
caagacgcacttgaagccttgcgca

SEQ ID NO: 85893 - DNA, 25 bp, E. coli
tacgatgttcttgcgcagttcaccg

SEQ ID NO: 85894 - DNA, 25 bp, E. coli
tacgatgttcttccgcagttcaccg

SEQ ID NO: 85895 - DNA, 25 bp, E. coli
taaaagaattcaacccggttcaggg

SEQ ID NO: 85896 - DNA, 25 bp, E. coli
agttcaccgatgtagccggacgcaa

SEQ ID NO: 85897 - DNA, 25 bp, E. coli
agttcaccgatgaagccggacgcaa

SEQ ID NO: 85898 - DNA, 25 bp, E. coli
ttgcaggcgcgtttaacccagccgg

SEQ ID NO: 85899 - DNA, 25 bp, E. coli
ttgcaggcgcgtataacccagccgg

SEQ ID NO: 85900 - DNA, 25 bp, E. coli
tggtgctgaccaataacggcgcgtt

SEQ ID NO: 85901 - DNA, 25 bp, E. coli
tggtgctgaccattaacggcgcgtt

SEQ ID NO: 85902 - DNA, 25 bp, E. coli
taaccttaaatgatggccctaccct

SEQ ID NO: 85903 - DNA, 25 bp, E. coli
taaccttaaatgttggccctaccct

SEQ ID NO: 85904 - DNA, 25 bp, E. coli
gccggacgcaaaacattaaaagaat

SEQ ID NO: 85905 - DNA, 25 bp, E. coli
gccggacgcaaatcattaaaagaat

SEQ ID NO: 85906 - DNA, 25 bp, E. coli
gaaaaatctattttgtgcaggtgga

SEQ ID NO: 85907 - DNA, 25 bp, E. coli
gaaaaatctattatgtgcaggtgga

SEQ ID NO: 85908 - DNA, 25 bp, E. coli
gtgatcctgttctataaaccctacg

SEQ ID NO: 85909 - DNA, 25 bp, E. coli
gtgatcctgttcaataaaccctacg

SEQ ID NO: 85910 - DNA, 25 bp, E. coli
ggaaggtattcccacacaagacgca

SEQ ID NO: 85911 - DNA, 25 bp, E. coli
ggaaggtattccgacacaagacgca

SEQ ID NO: 85912 - DNA, 25 bp, E. coli
taaaagaattcatcccggttcaggg

SEQ ID NO: 85913 - DNA, 25 bp, E. coli
taaattgagggaatactacgaaacg

SEQ ID NO: 85914 - DNA, 25 bp, E. coli
taaattgagggattactacgaaacg

SEQ ID NO: 85915 - DNA, 25 bp, E. coli
tatttttattcagccaagagccatg

SEQ ID NO: 85916 - DNA, 25 bp, E. coli
tatttttattcacccaagagccatg

SEQ ID NO: 85917 - DNA, 25 bp, E. coli
tgatatttgagacaatgctaccgag

SEQ ID NO: 85918 - DNA, 25 bp, E. coli
tgatatttgagagaatgctaccgag

SEQ ID NO: 85919 - DNA, 25 bp, E. coli
tgctaccgagtaatgaaaacaccac

SEQ ID NO: 85920 - DNA, 25 bp, E. coli
tgctaccgagtattgaaaacaccac

SEQ ID NO: 85921 - DNA, 25 bp, E. coli
tacgaaacgtaagagactcggagtc

SEQ ID NO: 85922 - DNA, 25 bp, E. coli
tacgaaacgtaacagactcggagtc

SEQ ID NO: 85923 - DNA, 25 bp, E. coli
ccacctcgcagagaaagcgggtgta

SEQ ID NO: 85924 - DNA, 25 bp, E. coli
ccacctcgcagacaaagcgggtgta

SEQ ID NO: 85925 - DNA, 25 bp, E. coli
gccaagagccatgaataggattcga

SEQ ID NO: 85926 - DNA, 25 bp, E. coli
gccaagagccatcaataggattcga

SEQ ID NO: 85927 - DNA, 25 bp, E. coli
gctgtgtgacgaagtaaccactctt

SEQ ID NO: 85928 - DNA, 25 bp, E. coli
gctgtgtgacgatgtaaccactctt

SEQ ID NO: 85929 - DNA, 25 bp, E. coli
gactcggagtcagtgaataactcag

SEQ ID NO: 85930 - DNA, 25 bp, E. coli
gactcggagtcactgaataactcag

SEQ ID NO: 85931 - DNA, 25 bp, E. coli
ggttatcagctaatatcgagactca

SEQ ID NO: 85932 - DNA, 25 bp, E. coli
ggttatcagctattatcgagactca

SEQ ID NO: 85933 - DNA, 25 bp, E. coli
taactcaggtattgggttatcagct

SEQ ID NO: 85934 - DNA, 25 bp, E. coli
taactcaggtatagggttatcagct

SEQ ID NO: 85935 - DNA, 25 bp, E. coli
cactatacgtttgagaaggcagcta

SEQ ID NO: 85936 - DNA, 25 bp, E. coli
cactatacgtttcagaaggcagcta

SEQ ID NO: 85937 - DNA, 25 bp, E. coli
tattacttcccgagcttgtgtcagg

SEQ ID NO: 85938 - DNA, 25 bp, E. coli
tattacttcccgtgcttgtgtcagg

SEQ ID NO: 85939 - DNA, 25 bp, E. coli
ttgcattaatggtgccagatacggc

SEQ ID NO: 85940 - DNA, 25 bp, E. coli
ttgcattaatggagccagatacggc

SEQ ID NO: 85941 - DNA, 25 bp, E. coli
tacgtttcgtctgttcaccccgtgg

SEQ ID NO: 85942 - DNA, 25 bp, E. coli
tacgtttcgtctcttcaccccgtgg

SEQ ID NO: 85943 - DNA, 25 bp, E. coli
tgactgtcccaaaccgacactggaa

SEQ ID NO: 85944 - DNA, 25 bp, E. coli
tgactgtcccaatccgacactggaa

SEQ ID NO: 85945 - DNA, 25 bp, E. coli
cgccaacaggcgttggagattatgt

SEQ ID NO: 85946 - DNA, 25 bp, E. coli
cgccaacaggcgatggagattatgt

SEQ ID NO: 85947 - DNA, 25 bp, E. coli
gtcagcagaaaagaaccatcagtgt

SEQ ID NO: 85948 - DNA, 25 bp, E. coli
gtcagcagaaaacaaccatcagtgt

SEQ ID NO: 85949 - DNA, 25 bp, E. coli
taacttgcttactggagatccaggg

SEQ ID NO: 85950 - DNA, 25 bp, E. coli
taacttgcttacaggagatccaggg

SEQ ID NO: 85951 - DNA, 25 bp, E. coli
gacgtagcgccgttgactcgctgga

SEQ ID NO: 85952 - DNA, 25 bp, E. coli
gagttaaagaagttgcagcgagaca

SEQ ID NO: 85953 - DNA, 25 bp, E. coli
gagtcctgctttaatccaacgtcgg

SEQ ID NO: 85954 - DNA, 25 bp, E. coli
gagttaaagaagatgcagcgagaca

SEQ ID NO: 85955 - DNA, 25 bp, E. coli
gacgtagcgccgatgactcgctgga

SEQ ID NO: 85956 - DNA, 25 bp, E. coli
gagtcctgcttttatccaacgtcgg

SEQ ID NO: 85957 - DNA, 25 bp, E. coli
caccatcgacattttccggtggcga

SEQ ID NO: 85958 - DNA, 25 bp, E. coli
caccatcgacatattccggtggcga

SEQ ID NO: 85959 - DNA, 25 bp, E. coli
attcgcgaagccaaaacccgtggcg

SEQ ID NO: 85960 - DNA, 25 bp, E. coli
aggcatcttccaagacgaagctgta

SEQ ID NO: 85961 - DNA, 25 bp, E. coli
aggcatcttccatgacgaagctgta

SEQ ID NO: 85962 - DNA, 25 bp, E. coli
agcgccgcggtgctggaactgattc

SEQ ID NO: 85963 - DNA, 25 bp, E. coli
agcgccgcggtggtggaactgattc

SEQ ID NO: 85964 - DNA, 25 bp, E. coli
attcgcgaagcctaaacccgtggcg

SEQ ID NO: 85965 - DNA, 25 bp, E. coli
aaacccgtggcgcagccatcgtagg

SEQ ID NO: 85966 - DNA, 25 bp, E. coli
aaacccgtggcggagccatcgtagg

SEQ ID NO: 85967 - DNA, 25 bp, E. coli
tgtggcacctgggaccatcgacatt

SEQ ID NO: 85968 - DNA, 25 bp, E. coli
tgtggcacctggcaccatcgacatt

SEQ ID NO: 85969 - DNA, 25 bp, E. coli
gcgtatctcagctctggaagtggtg

SEQ ID NO: 85970 - DNA, 25 bp, E. coli
gcgtatctcagcactggaagtggtg

SEQ ID NO: 85971 - DNA, 25 bp, E. coli
cgtaggcatcttccatgacgaagct

SEQ ID NO: 85972 - DNA, 25 bp, E. coli
cgtaggcatcttgcatgacgaagct

SEQ ID NO: 85973 - DNA, 25 bp, E. coli
ctgattcgcgaagccaaaacccgtg

SEQ ID NO: 85974 - DNA, 25 bp, E. coli
ctgattcgcgaacccaaaacccgtg

SEQ ID NO: 85975 - DNA, 25 bp, E. coli
gtcatcccgcgtttctcagcactgg

SEQ ID NO: 85976 - DNA, 25 bp, E. coli
gtcatcccgcgtatctcagcactgg

SEQ ID NO: 85977 - DNA, 25 bp, E. coli
tggcgcagccatcgtaggcatcttc

SEQ ID NO: 85978 - DNA, 25 bp, E. coli
tggcgcagccatggtaggcatcttc

SEQ ID NO: 85979 - DNA, 25 bp, E. coli
cacaacattggccatgctgcgcgta

SEQ ID NO: 85980 - DNA, 25 bp, E. coli
cacaacattggcgatgctgcgcgta

SEQ ID NO: 85981 - DNA, 25 bp, E. coli
catctctgatgatcggtggtccacg

SEQ ID NO: 85982 - DNA, 25 bp, E. coli
catctctgatgaacggtggtccacg

SEQ ID NO: 85983 - DNA, 25 bp, E. coli
tacttgaagagttcgaacacgcgaa

SEQ ID NO: 85984 - DNA, 25 bp, E. coli
tacttgaagagtacgaacacgcgaa

SEQ ID NO: 85985 - DNA, 25 bp, E. coli
gcggcgggtgcactagaatctatct

SEQ ID NO: 85986 - DNA, 25 bp, E. coli
gcggcgggtgcagtagaatctatct

SEQ ID NO: 85987 - DNA, 25 bp, E. coli
gaaaatttacgcagaactcgtcggc

SEQ ID NO: 85988 - DNA, 25 bp, E. coli
gaaaatttacgctgaactcgtcggc

SEQ ID NO: 85989 - DNA, 25 bp, E. coli
gaagagaacgcatcccgcattggtg

SEQ ID NO: 85990 - DNA, 25 bp, E. coli
gaagagaacgcaacccgcattggtg

SEQ ID NO: 85991 - DNA, 25 bp, E. coli
gactatcatgtatggcctgcgtggc

SEQ ID NO: 85992 - DNA, 25 bp, E. coli
gactatcatgtaaggcctgcgtggc

SEQ ID NO: 85993 - DNA, 25 bp, E. coli
cattggtgccgcaattggctccggg

SEQ ID NO: 85994 - DNA, 25 bp, E. coli
cattggtgccgctattggctccggg

SEQ ID NO: 85995 - DNA, 25 bp, E. coli
gtcagattggcttcgttaacgcgca

SEQ ID NO: 85996 - DNA, 25 bp, E. coli
gtcagattggctacgttaacgcgca

SEQ ID NO: 85997 - DNA, 25 bp, E. coli
taactgtgaggagattatctcgcgc

SEQ ID NO: 85998 - DNA, 25 bp, E. coli
taagctccacgatatctatgaccgg

SEQ ID NO: 85999 - DNA, 25 bp, E. coli
taagctccacgaaatctatgaccgg

SEQ ID NO: 86000 - DNA, 25 bp, E. coli
taactgtgaggacattatctcgcgc

SEQ ID NO: 86001 - DNA, 25 bp, E. coli
taaaaaacgtaatggtgattgtcga

SEQ ID NO: 86002 - DNA, 25 bp, E. coli
tacgggggccaaattgctgacaaag

SEQ ID NO: 86003 - DNA, 25 bp, E. coli
taaaaaacgtaaaggtgattgtcga

SEQ ID NO: 86004 - DNA, 25 bp, E. coli
tacgggggccaatttgctgacaaag

SEQ ID NO: 86005 - DNA, 25 bp, E. coli
tgaaaaaaggtcaggtgtgaggata

SEQ ID NO: 86006 - DNA, 25 bp, E. coli
tgaaaaaaggtctggtgtgaggata

SEQ ID NO: 86007 - DNA, 25 bp, E. coli
cctggtatttgtagcttgttgtgtt

SEQ ID NO: 86008 - DNA, 25 bp, E. coli
ccacgtccgcagacgtggttgctat

SEQ ID NO: 86009 - DNA, 25 bp, E. coli
ccacgtccgcagtcgtggttgctat

SEQ ID NO: 86010 - DNA, 25 bp, E. coli
cctggtatttgttgcttgttgtgtt

SEQ ID NO: 86011 - DNA, 25 bp, E. coli
gcgtttgtcatcagagccaaccacg

SEQ ID NO: 86012 - DNA, 25 bp, E. coli
gcgtttgtcatctgagccaaccacg

SEQ ID NO: 86013 - DNA, 25 bp, E. coli
ctccgttaacctcgtatttgttgct

SEQ ID NO: 86014 - DNA, 25 bp, E. coli
ctccgttaacctggtatttgttgct

SEQ ID NO: 86015 - DNA, 25 bp, E. coli
gtgattgtcgataggtgaaaaaagg

SEQ ID NO: 86016 - DNA, 25 bp, E. coli
gtgattgtcgattggtgaaaaaagg

SEQ ID NO: 86017 - DNA, 25 bp, E. coli
gatgaatcgataatttttagcgggt

SEQ ID NO: 86018 - DNA, 25 bp, E. coli
gaggatatatttattgatgaatcga

SEQ ID NO: 86019 - DNA, 25 bp, E. coli
gagccaaccacgaccgcagacgtgg

SEQ ID NO: 86020 - DNA, 25 bp, E. coli
gagccaaccacgtccgcagacgtgg

SEQ ID NO: 86021 - DNA, 25 bp, E. coli
gaggatatattttttgatgaatcga

SEQ ID NO: 86022 - DNA, 25 bp, E. coli
gatgaatcgatattttttagcgggt

SEQ ID NO: 86023 - DNA, 25 bp, E. coli
tatggtctgacattaaacgacacgc

SEQ ID NO: 86024 - DNA, 25 bp, E. coli
tatggtctgacaataaacgacacgc

SEQ ID NO: 86025 - DNA, 25 bp, E. coli
ttacctgcaatatctcagcgggcgg

SEQ ID NO: 86026 - DNA, 25 bp, E. coli
ttactgacacgtgtgctggaacagc

SEQ ID NO: 86027 - DNA, 25 bp, E. coli
ttacctgcaataactcagcgggcgg

SEQ ID NO: 86028 - DNA, 25 bp, E. coli
ttactgacacgtctgctggaacagc

SEQ ID NO: 86029 - DNA, 25 bp, E. coli
tgattaaggaacacatcgatgccgg

SEQ ID NO: 86030 - DNA, 25 bp, E. coli
tgattaaggaactcatcgatgccgg

SEQ ID NO: 86031 - DNA, 25 bp, E. coli
tgcagacattctgcgagcgcggcag

SEQ ID NO: 86032 - DNA, 25 bp, E. coli
tgcagacattctccgagcgcggcag

SEQ ID NO: 86033 - DNA, 25 bp, E. coli
tcgtatcgacaggaagggatttagc

SEQ ID NO: 86034 - DNA, 25 bp, E. coli
tcgtatcgacagcaagggatttagc

SEQ ID NO: 86035 - DNA, 25 bp, E. coli
gcggcaaagccgaaacaacgtagta

SEQ ID NO: 86036 - DNA, 25 bp, E. coli
gcggcaaagccgtaacaacgtagta

SEQ ID NO: 86037 - DNA, 25 bp, E. coli
gacacgccattcagcaatgaggctg

SEQ ID NO: 86038 - DNA, 25 bp, E. coli
gacacgccattctgcaatgaggctg

SEQ ID NO: 86039 - DNA, 25 bp, E. coli
gaacaatctcctaatctccgggctg

SEQ ID NO: 86040 - DNA, 25 bp, E. coli
gaacaatctccttatctccgggctg

SEQ ID NO: 86041 - DNA, 25 bp, E. coli
gatttagctggctggaacaatctcc

SEQ ID NO: 86042 - DNA, 25 bp, E. coli
gatttagctggcaggaacaatctcc

SEQ ID NO: 86043 - DNA, 25 bp, E. coli
ggtatcaccctacccgatgccgtga

SEQ ID NO: 86044 - DNA, 25 bp, E. coli
ggtatcaccctagccgatgccgtga

SEQ ID NO: 86045 - DNA, 25 bp, E. coli
tacgtaaccagtaatggcggccatt

SEQ ID NO: 86046 - DNA, 25 bp, E. coli
tacgtaaccagttatggcggccatt

SEQ ID NO: 86047 - DNA, 25 bp, E. coli
aatcgaggacatgtttacgtaacca

SEQ ID NO: 86048 - DNA, 25 bp, E. coli
aatcgaggacatctttacgtaacca

SEQ ID NO: 86049 - DNA, 25 bp, E. coli
ttgatttgttttgggcgaggtagcc

SEQ ID NO: 86050 - DNA, 25 bp, E. coli
ttgatttgttttcggcgaggtagcc

SEQ ID NO: 86051 - DNA, 25 bp, E. coli
ttgtcctgacaaagccatttacgaa

SEQ ID NO: 86052 - DNA, 25 bp, E. coli
ttgtcctgacaatgccatttacgaa

SEQ ID NO: 86053 - DNA, 25 bp, E. coli
tgagctgtgattcagatgtatccgg

SEQ ID NO: 86054 - DNA, 25 bp, E. coli
tgagctgtgattgagatgtatccgg

SEQ ID NO: 86055 - DNA, 25 bp, E. coli
tcagtgttgccccatttttctcggg

SEQ ID NO: 86056 - DNA, 25 bp, E. coli
tcagtgttgcccgatttttctcggg

SEQ ID NO: 86057 - DNA, 25 bp, E. coli
gctaactcagctcttgaaatgagct

SEQ ID NO: 86058 - DNA, 25 bp, E. coli
gctaactcagctgttgaaatgagct

SEQ ID NO: 86059 - DNA, 25 bp, E. coli
cgaatggtttgacatttgtagctaa

SEQ ID NO: 86060 - DNA, 25 bp, E. coli
cgaatggtttgagatttgtagctaa

SEQ ID NO: 86061 - DNA, 25 bp, E. coli
gggcaacatcgctataaatcaataa

SEQ ID NO: 86062 - DNA, 25 bp, E. coli
gggcaacatcgcaataaatcaataa

SEQ ID NO: 86063 - DNA, 25 bp, E. coli
gaggtagcccctcaggcaatttgtc

SEQ ID NO: 86064 - DNA, 25 bp, E. coli
gaggtagcccctgaggcaatttgtc

SEQ ID NO: 86065 - DNA, 25 bp, E. coli
gatgtatccgggagtttgaatgcgc

SEQ ID NO: 86066 - DNA, 25 bp, E. coli
gatgtatccgggtgtttgaatgcgc

SEQ ID NO: 86067 - DNA, 25 bp, E. coli
aagtacacttagttttgacaaccgc

SEQ ID NO: 86068 - DNA, 25 bp, E. coli
aagtacacttagatttgacaaccgc

SEQ ID NO: 86069 - DNA, 25 bp, E. coli
cagagcaaacattcattagccgata

SEQ ID NO: 86070 - DNA, 25 bp, E. coli
cagagcaaacatacattagccgata

SEQ ID NO: 86071 - DNA, 25 bp, E. coli
caggcaggtgactctgacaaggtat

SEQ ID NO: 86072 - DNA, 25 bp, E. coli
caggcaggtgacactgacaaggtat

SEQ ID NO: 86073 - DNA, 25 bp, E. coli
taaagaccagcatgtcaggcaggtg

SEQ ID NO: 86074 - DNA, 25 bp, E. coli
taaagaccagcaagtcaggcaggtg

SEQ ID NO: 86075 - DNA, 25 bp, E. coli
aaaacgtacttcatgtcgcagtgga

SEQ ID NO: 86076 - DNA, 25 bp, E. coli
aaaacgtacttcttgtcgcagtgga

SEQ ID NO: 86077 - DNA, 25 bp, E. coli
tattgcacaccctgctaaaaaagga

SEQ ID NO: 86078 - DNA, 25 bp, E. coli
tatacagttaaggagatttaccggt

SEQ ID NO: 86079 - DNA, 25 bp, E. coli
tattgcacacccagctaaaaaagga

SEQ ID NO: 86080 - DNA, 25 bp, E. coli
tatacagttaagcagatttaccggt

SEQ ID NO: 86081 - DNA, 25 bp, E. coli
tcgcagtggatgacgtaagtatact

SEQ ID NO: 86082 - DNA, 25 bp, E. coli
tcgcagtggatgtcgtaagtatact

SEQ ID NO: 86083 - DNA, 25 bp, E. coli
gattaagtgcaatactaggtcacca

SEQ ID NO: 86084 - DNA, 25 bp, E. coli
gattaagtgcaaaactaggtcacca

SEQ ID NO: 86085 - DNA, 25 bp, E. coli
ggatgatctatattaccttcaggga

SEQ ID NO: 86086 - DNA, 25 bp, E. coli
ggatgatctataataccttcaggga

SEQ ID NO: 86087 - DNA, 25 bp, E. coli
taagtatacttgcaaaactgccaga

SEQ ID NO: 86088 - DNA, 25 bp, E. coli
taagtatacttggaaaactgccaga

SEQ ID NO: 86089 - DNA, 25 bp, E. coli
cataatgaacggctatctgcgggtg

SEQ ID NO: 86090 - DNA, 25 bp, E. coli
cataatgaacgggtatctgcgggtg

SEQ ID NO: 86091 - DNA, 25 bp, E. coli
tactgagtgcaatgtaccgcttcgg

SEQ ID NO: 86092 - DNA, 25 bp, E. coli
tactgagtgcaaagtaccgcttcgg

SEQ ID NO: 86093 - DNA, 25 bp, E. coli
aaaacgctgtttcttggacgcatcc

SEQ ID NO: 86094 - DNA, 25 bp, E. coli
aaacatctggtaggtctggtggaac

SEQ ID NO: 86095 - DNA, 25 bp, E. coli
aaacatctggtacgtctggtggaac

SEQ ID NO: 86096 - DNA, 25 bp, E. coli
aaaacgctgtttgttggacgcatcc

SEQ ID NO: 86097 - DNA, 25 bp, E. coli
ttctatcaacgttccgatggcggcg

SEQ ID NO: 86098 - DNA, 25 bp, E. coli
ttctatcaacgtaccgatggcggcg

SEQ ID NO: 86099 - DNA, 25 bp, E. coli
tgatgaaaatcttcgatggcgcggg

SEQ ID NO: 86100 - DNA, 25 bp, E. coli
tgatgaaaatctacgatggcgcggg

SEQ ID NO: 86101 - DNA, 25 bp, E. coli
tctacgctatgtggtggcaggcgca

SEQ ID NO: 86102 - DNA, 25 bp, E. coli
tctacgctatgtcgtggcaggcgca

SEQ ID NO: 86103 - DNA, 25 bp, E. coli
cgctggaaatggaggaacaactggc

SEQ ID NO: 86104 - DNA, 25 bp, E. coli
cgctggaaatggtggaacaactggc

SEQ ID NO: 86105 - DNA, 25 bp, E. coli
ctttgtgcagattcagggccgcgca

SEQ ID NO: 86106 - DNA, 25 bp, E. coli
ctttgtgcagatacagggccgcgca

SEQ ID NO: 86107 - DNA, 25 bp, E. coli
gaccagtgctataacggcggctgaa

SEQ ID NO: 86108 - DNA, 25 bp, E. coli
gacgcctgcaactgaaagggccgaa

SEQ ID NO: 86109 - DNA, 25 bp, E. coli
gaccagtgctattacggcggctgaa

SEQ ID NO: 86110 - DNA, 25 bp, E. coli
gacgcctgcaacagaaagggccgaa

SEQ ID NO: 86111 - DNA, 25 bp, E. coli
cacaaggtgcgctagttaagaacaa

SEQ ID NO: 86112 - DNA, 25 bp, E. coli
cacaaggtgcgcaagttaagaacaa

SEQ ID NO: 86113 - DNA, 25 bp, E. coli
agcctgcattgcgtgacacccgtaa

SEQ ID NO: 86114 - DNA, 25 bp, E. coli
agcctgcattgcctgacacccgtaa

SEQ ID NO: 86115 - DNA, 25 bp, E. coli
tacgccgccctggaaaatgaggtgc

SEQ ID NO: 86116 - DNA, 25 bp, E. coli
tacgccgccctgcaaaatgaggtgc

SEQ ID NO: 86117 - DNA, 25 bp, E. coli
tgatgtaccacattcccggcgtgtt

SEQ ID NO: 86118 - DNA, 25 bp, E. coli
tgatgtaccacaatcccggcgtgtt

SEQ ID NO: 86119 - DNA, 25 bp, E. coli
tgctgaacgcggttaaccaacatgc

SEQ ID NO: 86120 - DNA, 25 bp, E. coli
tgctgaacgcggataaccaacatgc

SEQ ID NO: 86121 - DNA, 25 bp, E. coli
tcataatctgctgcgggaatggtcg

SEQ ID NO: 86122 - DNA, 25 bp, E. coli
tcataatctgctccgggaatggtcg

SEQ ID NO: 86123 - DNA, 25 bp, E. coli
gcgtgttatcgcgacaggacgtcgc

SEQ ID NO: 86124 - DNA, 25 bp, E. coli
gcgtgttatcgccacaggacgtcgc

SEQ ID NO: 86125 - DNA, 25 bp, E. coli
cgcgccatgctgtttgaactggaca

SEQ ID NO: 86126 - DNA, 25 bp, E. coli
cgcgccatgctgattgaactggaca

SEQ ID NO: 86127 - DNA, 25 bp, E. coli
gttgtatccctccagcagcctgcat

SEQ ID NO: 86128 - DNA, 25 bp, E. coli
gttgtatccctcgagcagcctgcat

SEQ ID NO: 86129 - DNA, 25 bp, E. coli
ggcgaactggtcgttaatgacacct

SEQ ID NO: 86130 - DNA, 25 bp, E. coli
ggcgaactggtccttaatgacacct

SEQ ID NO: 86131 - DNA, 25 bp, E. coli
gatgatccgcgatgataaaaagcgc

SEQ ID NO: 86132 - DNA, 25 bp, E. coli
gatgatccgcgaagataaaaagcgc

SEQ ID NO: 86133 - DNA, 25 bp, E. coli
caggcatctgcggatggtgtcggat

SEQ ID NO: 86134 - DNA, 25 bp, E. coli
caggcatctgcgcatggtgtcggat

SEQ ID NO: 86135 - DNA, 25 bp, E. coli
catctgcgcatgctgtcggatgcgg

SEQ ID NO: 86136 - DNA, 25 bp, E. coli
catctgcgcatggtgtcggatgcgg

SEQ ID NO: 86137 - DNA, 25 bp, E. coli
tacggttcaggcctgtaggcatgat

SEQ ID NO: 86138 - DNA, 25 bp, E. coli
acctacggttcaggcctgtaggcat

SEQ ID NO: 86139 - DNA, 25 bp, E. coli
acctacggttcacgcctgtaggcat

SEQ ID NO: 86140 - DNA, 25 bp, E. coli
acggttcaggccagtaggcatgata

SEQ ID NO: 86141 - DNA, 25 bp, E. coli
acggttcaggcctgtaggcatgata

SEQ ID NO: 86142 - DNA, 25 bp, E. coli
tacggttcaggcgtgtaggcatgat

SEQ ID NO: 86143 - DNA, 25 bp, E. coli
tccgacctacggatcaggcctgtag

SEQ ID NO: 86144 - DNA, 25 bp, E. coli
tccgacctacggttcaggcctgtag

SEQ ID NO: 86145 - DNA, 25 bp, E. coli
tctgcgcatggtctcggatgcggcg

SEQ ID NO: 86146 - DNA, 25 bp, E. coli
tctgcgcatggtgtcggatgcggcg

SEQ ID NO: 86147 - DNA, 25 bp, E. coli
ccgacctacggttcaggcctgtagg

SEQ ID NO: 86148 - DNA, 25 bp, E. coli
ccgacctacggtacaggcctgtagg

SEQ ID NO: 86149 - DNA, 25 bp, E. coli
ctgcgcatggtgacggatgcggcgc

SEQ ID NO: 86150 - DNA, 25 bp, E. coli
cggttcaggcctctaggcatgataa

SEQ ID NO: 86151 - DNA, 25 bp, E. coli
cggttcaggcctgtaggcatgataa

SEQ ID NO: 86152 - DNA, 25 bp, E. coli
ctgcgcatggtgtcggatgcggcgc

SEQ ID NO: 86153 - DNA, 25 bp, E. coli
ggttcaggcctgaaggcatgataag

SEQ ID NO: 86154 - DNA, 25 bp, E. coli
ggttcaggcctgtaggcatgataag

SEQ ID NO: 86155 - DNA, 25 bp, E. coli
caatgtcgctactggtggagtcagc

SEQ ID NO: 86156 - DNA, 25 bp, E. coli
caatgtcgctacaggtggagtcagc

SEQ ID NO: 86157 - DNA, 25 bp, E. coli
tactcgctattggtagcacggtcgc

SEQ ID NO: 86158 - DNA, 25 bp, E. coli
tactcgctattgctagcacggtcgc

SEQ ID NO: 86159 - DNA, 25 bp, E. coli
tgacgtacctgagccagtgcgcaat

SEQ ID NO: 86160 - DNA, 25 bp, E. coli
tgacgtacctgacccagtgcgcaat

SEQ ID NO: 86161 - DNA, 25 bp, E. coli
tgctaccagcgatagcgcgttttct

SEQ ID NO: 86162 - DNA, 25 bp, E. coli
taccgttcgccagaggttcagaaac

SEQ ID NO: 86163 - DNA, 25 bp, E. coli
taccgttcgccacaggttcagaaac

SEQ ID NO: 86164 - DNA, 25 bp, E. coli
tgctaccagcgaaagcgcgttttct

SEQ ID NO: 86165 - DNA, 25 bp, E. coli
tctctgctcctgcaacataaggcga

SEQ ID NO: 86166 - DNA, 25 bp, E. coli
tctctgctcctggaacataaggcga

SEQ ID NO: 86167 - DNA, 25 bp, E. coli
tctgagcctggaaaatgacgtacct

SEQ ID NO: 86168 - DNA, 25 bp, E. coli
tctgagcctggataatgacgtacct

SEQ ID NO: 86169 - DNA, 25 bp, E. coli
cctatcggttgcaggttgcgtctga

SEQ ID NO: 86170 - DNA, 25 bp, E. coli
cctatcggttgctggttgcgtctga

SEQ ID NO: 86171 - DNA, 25 bp, E. coli
gctctgatgagcgtcggtacgctga

SEQ ID NO: 86172 - DNA, 25 bp, E. coli
gctctgatgagcctcggtacgctga

SEQ ID NO: 86173 - DNA, 25 bp, E. coli
ctttaggtctgagcgcatggctacc

SEQ ID NO: 86174 - DNA, 25 bp, E. coli
ctttaggtctgaccgcatggctacc

SEQ ID NO: 86175 - DNA, 25 bp, E. coli
gattatcgttggtgcctgggccgat

SEQ ID NO: 86176 - DNA, 25 bp, E. coli
gattatcgttggagcctgggccgat

SEQ ID NO: 86177 - DNA, 25 bp, E. coli
caaagcattatacatgagaaattga

SEQ ID NO: 86178 - DNA, 25 bp, E. coli
caaagcattatagatgagaaattga

SEQ ID NO: 86179 - DNA, 25 bp, E. coli
catggtttttatgcaaatacggagt

SEQ ID NO: 86180 - DNA, 25 bp, E. coli
catggtttttatccaaatacggagt

SEQ ID NO: 86181 - DNA, 25 bp, E. coli
tataggcccgtatctcgcatggttt

SEQ ID NO: 86182 - DNA, 25 bp, E. coli
tatctcgcctgggttataggcccgt

SEQ ID NO: 86183 - DNA, 25 bp, E. coli
tatctcgcctggcttataggcccgt

SEQ ID NO: 86184 - DNA, 25 bp, E. coli
tgatatagatcaaatctcgcctggc

SEQ ID NO: 86185 - DNA, 25 bp, E. coli
tgatatagatcatatctcgcctggc

SEQ ID NO: 86186 - DNA, 25 bp, E. coli
taagtcggcgaccagatactaacaa

SEQ ID NO: 86187 - DNA, 25 bp, E. coli
taagtcggcgacgagatactaacaa

SEQ ID NO: 86188 - DNA, 25 bp, E. coli
gcgaataaagtaacaatatcgatcg

SEQ ID NO: 86189 - DNA, 25 bp, E. coli
gcgaataaagtatcaatatcgatcg

SEQ ID NO: 86190 - DNA, 25 bp, E. coli
gcgacgagatactaacaaagcatta

SEQ ID NO: 86191 - DNA, 25 bp, E. coli
gcgacgagatacaaacaaagcatta

SEQ ID NO: 86192 - DNA, 25 bp, E. coli
gcatcctccgcttaaacagttaatt

SEQ ID NO: 86193 - DNA, 25 bp, E. coli
gcatcctccgctaaaacagttaatt

SEQ ID NO: 86194 - DNA, 25 bp, E. coli
gaattttttccggatcctccgctaa

SEQ ID NO: 86195 - DNA, 25 bp, E. coli
gaattttttccgcatcctccgctaa

SEQ ID NO: 86196 - DNA, 25 bp, E. coli
taactctctctttattaagtcggcg

SEQ ID NO: 86197 - DNA, 25 bp, E. coli
tataggcccgtaactcgcatggttt

SEQ ID NO: 86198 - DNA, 25 bp, E. coli
taactctctcttaattaagtcggcg

SEQ ID NO: 86199 - DNA, 25 bp, E. coli
tactggatctggcatcacctatcgg

SEQ ID NO: 86200 - DNA, 25 bp, E. coli
tactggatctgggatcacctatcgg

SEQ ID NO: 86201 - DNA, 25 bp, E. coli
tcctgaagcagcacgcaaagagtgg

SEQ ID NO: 86202 - DNA, 25 bp, E. coli
tcctgaagcagctcgcaaagagtgg

SEQ ID NO: 86203 - DNA, 25 bp, E. coli
tctttgagaacttaaccccgctgca

SEQ ID NO: 86204 - DNA, 25 bp, E. coli
tctgagctgatcactctcggcgaaa

SEQ ID NO: 86205 - DNA, 25 bp, E. coli
tctgagctgatctctctcggcgaaa

SEQ ID NO: 86206 - DNA, 25 bp, E. coli
tctttgagaactaaaccccgctgca

SEQ ID NO: 86207 - DNA, 25 bp, E. coli
gccggtaaaaccatgctgctgcaga

SEQ ID NO: 86208 - DNA, 25 bp, E. coli
gccggtaaaaccttgctgctgcaga

SEQ ID NO: 86209 - DNA, 25 bp, E. coli
gcaaaatcattctcccgatgggcga

SEQ ID NO: 86210 - DNA, 25 bp, E. coli
gatttggtttcctccgttccgcaga

SEQ ID NO: 86211 - DNA, 25 bp, E. coli
gcaaaatcattcacccgatgggcga

SEQ ID NO: 86212 - DNA, 25 bp, E. coli
gatttggtttccaccgttccgcaga

SEQ ID NO: 86213 - DNA, 25 bp, E. coli
cccgccgaaagaaggtgaacgctat

SEQ ID NO: 86214 - DNA, 25 bp, E. coli
cccgccgaaagatggtgaacgctat

SEQ ID NO: 86215 - DNA, 25 bp, E. coli
ggtacccgtaaacaagagctgctca

SEQ ID NO: 86216 - DNA, 25 bp, E. coli
ggtacccgtaaagaagagctgctca

SEQ ID NO: 86217 - DNA, 25 bp, E. coli
ggaaaacctggctcgtatgcgtaag

SEQ ID NO: 86218 - DNA, 25 bp, E. coli
ggaaaacctggcacgtatgcgtaag

SEQ ID NO: 86219 - DNA, 25 bp, E. coli
gagcattgcttacaaccacccggat

SEQ ID NO: 86220 - DNA, 25 bp, E. coli
gagcattgcttagaaccacccggat

SEQ ID NO: 86221 - DNA, 25 bp, E. coli
caaagattgcctgggcgctggagaa

SEQ ID NO: 86222 - DNA, 25 bp, E. coli
caaatattgtagactggctgccacg

SEQ ID NO: 86223 - DNA, 25 bp, E. coli
caaaatgggctggaaagggcctacc

SEQ ID NO: 86224 - DNA, 25 bp, E. coli
caaagattgcctcggcgctggagaa

SEQ ID NO: 86225 - DNA, 25 bp, E. coli
caaaatgggctgcaaagggcctacc

SEQ ID NO: 86226 - DNA, 25 bp, E. coli
caaatattgtagtctggctgccacg

SEQ ID NO: 86227 - DNA, 25 bp, E. coli
tacagaaaccgatcatcagccaggc

SEQ ID NO: 86228 - DNA, 25 bp, E. coli
tacagaaaccgaacatcagccaggc

SEQ ID NO: 86229 - DNA, 25 bp, E. coli
aaacattttaccaggccatgcggcg

SEQ ID NO: 86230 - DNA, 25 bp, E. coli
aaacattttacctggccatgcggcg

SEQ ID NO: 86231 - DNA, 25 bp, E. coli
ttacgacgatacattgatggctgcc

SEQ ID NO: 86232 - DNA, 25 bp, E. coli
ttgagaaactcatacgtgccgctgc

SEQ ID NO: 86233 - DNA, 25 bp, E. coli
ttacgacgatactttgatggctgcc

SEQ ID NO: 86234 - DNA, 25 bp, E. coli
ttgagaaactcaaacgtgccgctgc

SEQ ID NO: 86235 - DNA, 25 bp, E. coli
tctacagccgcgaggtcgatattcc

SEQ ID NO: 86236 - DNA, 25 bp, E. coli
tctacagccgcgtggtcgatattcc

SEQ ID NO: 86237 - DNA, 25 bp, E. coli
gaacccaggcggtagaagtctttga

SEQ ID NO: 86238 - DNA, 25 bp, E. coli
gaacccaggcggaagaagtctttga

SEQ ID NO: 86239 - DNA, 25 bp, E. coli
cgatcccggatgtgatgagcgccat

SEQ ID NO: 86240 - DNA, 25 bp, E. coli
cgatcccggatgagatgagcgccat

SEQ ID NO: 86241 - DNA, 25 bp, E. coli
ggtgacctttgatcgcttgccagat

SEQ ID NO: 86242 - DNA, 25 bp, E. coli
ggtgacctttgaacgcttgccagat

SEQ ID NO: 86243 - DNA, 25 bp, E. coli
caggtagcgggaacactttactgcc

SEQ ID NO: 86244 - DNA, 25 bp, E. coli
caggtagcgggatcactttactgcc

SEQ ID NO: 86245 - DNA, 25 bp, E. coli
taaagtgttgttcacccaggcggga

SEQ ID NO: 86246 - DNA, 25 bp, E. coli
taaagtgttgttgacccaggcggga

SEQ ID NO: 86247 - DNA, 25 bp, E. coli
tatctgccgtgcattaagccggaac

SEQ ID NO: 86248 - DNA, 25 bp, E. coli
tatctgccgtgctttaagccggaac

SEQ ID NO: 86249 - DNA, 25 bp, E. coli
ttactggcgcaagtggacagcggca

SEQ ID NO: 86250 - DNA, 25 bp, E. coli
ttactggcgcaactggacagcggca

SEQ ID NO: 86251 - DNA, 25 bp, E. coli
tggtcactgtttccgcgatcaggca

SEQ ID NO: 86252 - DNA, 25 bp, E. coli
tgatcctcgcgctggtgaaagagag

SEQ ID NO: 86253 - DNA, 25 bp, E. coli
tgatcctcgcgcaggtgaaagagag

SEQ ID NO: 86254 - DNA, 25 bp, E. coli
tccttaaagagaaggcaagccagca

SEQ ID NO: 86255 - DNA, 25 bp, E. coli
tccttaaagagatggcaagccagca

SEQ ID NO: 86256 - DNA, 25 bp, E. coli
tcgtgatcttgagtacctggtggca

SEQ ID NO: 86257 - DNA, 25 bp, E. coli
tcgtgatcttgactacctggtggca

SEQ ID NO: 86258 - DNA, 25 bp, E. coli
ccattttcggcgtgcggcagattcc

SEQ ID NO: 86259 - DNA, 25 bp, E. coli
ccattttcggcgagcggcagattcc

SEQ ID NO: 86260 - DNA, 25 bp, E. coli
gctatgagcagcaggcagaggccat

SEQ ID NO: 86261 - DNA, 25 bp, E. coli
gctatgagcagctggcagaggccat

SEQ ID NO: 86262 - DNA, 25 bp, E. coli
tggtcactgtttgcgcgatcaggca

SEQ ID NO: 86263 - DNA, 25 bp, E. coli
gatgaagatacagacttccgcgcga

SEQ ID NO: 86264 - DNA, 25 bp, E. coli
gatgaagatacacacttccgcgcga

SEQ ID NO: 86265 - DNA, 25 bp, E. coli
taaacgacaaagagtataccctggc

SEQ ID NO: 86266 - DNA, 25 bp, E. coli
taaacgacaaagtgtataccctggc

SEQ ID NO: 86267 - DNA, 25 bp, E. coli
atctggcgaaaaagcagggcaacaa

SEQ ID NO: 86268 - DNA, 25 bp, E. coli
atctggcgaaaatgcagggcaacaa

SEQ ID NO: 86269 - DNA, 25 bp, E. coli
tatccggagagctggatcaggacgt

SEQ ID NO: 86270 - DNA, 25 bp, E. coli
tatccggagagcaggatcaggacgt

SEQ ID NO: 86271 - DNA, 25 bp, E. coli
tataatttgcctgctgatgttctgc

SEQ ID NO: 86272 - DNA, 25 bp, E. coli
tataatttgcctcctgatgttctgc

SEQ ID NO: 86273 - DNA, 25 bp, E. coli
tgagcgagtcacagagctggatgca

SEQ ID NO: 86274 - DNA, 25 bp, E. coli
tgagcgagtcactgagctggatgca

SEQ ID NO: 86275 - DNA, 25 bp, E. coli
gcctgctgatgtactgcctcgttaa

SEQ ID NO: 86276 - DNA, 25 bp, E. coli
gcctgctgatgttctgcctcgttaa

SEQ ID NO: 86277 - DNA, 25 bp, E. coli
gctccatcttatcgatctggcgaaa

SEQ ID NO: 86278 - DNA, 25 bp, E. coli
gctccatcttatggatctggcgaaa

SEQ ID NO: 86279 - DNA, 25 bp, E. coli
gacaaagtgtattccctggcgaaat

SEQ ID NO: 86280 - DNA, 25 bp, E. coli
gacaaagtgtataccctggcgaaat

SEQ ID NO: 86281 - DNA, 25 bp, E. coli
ccctggcgaaattgtataatttgcc

SEQ ID NO: 86282 - DNA, 25 bp, E. coli
ccctggcgaaatagtataatttgcc

SEQ ID NO: 86283 - DNA, 25 bp, E. coli
ggactggcactggtgctccatctta

SEQ ID NO: 86284 - DNA, 25 bp, E. coli
ggactggcactgctgctccatctta

SEQ ID NO: 86285 - DNA, 25 bp, E. coli
tggcgttatccggagagctggatca

SEQ ID NO: 86286 - DNA, 25 bp, E. coli
tggcgttatccgcagagctggatca

SEQ ID NO: 86287 - DNA, 25 bp, E. coli
acggaaccgccgaccagatattgca

SEQ ID NO: 86288 - DNA, 25 bp, E. coli
aggccaacgcccagtttttcgatgg

SEQ ID NO: 86289 - DNA, 25 bp, E. coli
aggccaacgccctgtttttcgatgg

SEQ ID NO: 86290 - DNA, 25 bp, E. coli
acggaaccgccgtccagatattgca

SEQ ID NO: 86291 - DNA, 25 bp, E. coli
tattgcaggctcttcggatcaacca

SEQ ID NO: 86292 - DNA, 25 bp, E. coli
tattgcaggctcatcggatcaacca

SEQ ID NO: 86293 - DNA, 25 bp, E. coli
ttttcgatggtcatatcgccttcgt

SEQ ID NO: 86294 - DNA, 25 bp, E. coli
ttttcgatggtcttatcgccttcgt

SEQ ID NO: 86295 - DNA, 25 bp, E. coli
tgcttttcgcgttcgggttggtcac

SEQ ID NO: 86296 - DNA, 25 bp, E. coli
tgcttttcgcgtacgggttggtcac

SEQ ID NO: 86297 - DNA, 25 bp, E. coli
gaaaccatactgcaagccgctgcaa

SEQ ID NO: 86298 - DNA, 25 bp, E. coli
gaaaccatactggaagccgctgcaa

SEQ ID NO: 86299 - DNA, 25 bp, E. coli
cgcgttcgggttcgtcacgatgaaa

SEQ ID NO: 86300 - DNA, 25 bp, E. coli
cgccaccggtgatatacacgcgtaa

SEQ ID NO: 86301 - DNA, 25 bp, E. coli
cgccaccggtgaaatacacgcgtaa

SEQ ID NO: 86302 - DNA, 25 bp, E. coli
cgcgttcgggttggtcacgatgaaa

SEQ ID NO: 86303 - DNA, 25 bp, E. coli
gatcatcaaaggagaaaccatactg

SEQ ID NO: 86304 - DNA, 25 bp, E. coli
gatcatcaaaggtgaaaccatactg

SEQ ID NO: 86305 - DNA, 25 bp, E. coli
tcacgatgaaacgagaaccttccag

SEQ ID NO: 86306 - DNA, 25 bp, E. coli
tcacgatgaaaccagaaccttccag

SEQ ID NO: 86307 - DNA, 25 bp, E. coli
gaccagatattgcaggctcatcgga

SEQ ID NO: 86308 - DNA, 25 bp, E. coli
gaccagatattggaggctcatcgga

SEQ ID NO: 86309 - DNA, 25 bp, E. coli
taactacgccgcgacaaactttagc

SEQ ID NO: 86310 - DNA, 25 bp, E. coli
acagggctgtttgctaaaagcggtg

SEQ ID NO: 86311 - DNA, 25 bp, E. coli
ctagagttcacacccgccgaagtgg

SEQ ID NO: 86312 - DNA, 25 bp, E. coli
ctagagttcacagccgccgaagtgg

SEQ ID NO: 86313 - DNA, 25 bp, E. coli
aaaccagccaccacgctagagttca

SEQ ID NO: 86314 - DNA, 25 bp, E. coli
acagggctgtttcctaaaagcggtg

SEQ ID NO: 86315 - DNA, 25 bp, E. coli
aaaccagccacctcgctagagttca

SEQ ID NO: 86316 - DNA, 25 bp, E. coli
tagcaaacgtcactctgcctgcagg

SEQ ID NO: 86317 - DNA, 25 bp, E. coli
tagcaaacgtcagtctgcctgcagg

SEQ ID NO: 86318 - DNA, 25 bp, E. coli
tgattacggctatttcgccttcgtc

SEQ ID NO: 86319 - DNA, 25 bp, E. coli
tgattacggctaattcgccttcgtc

SEQ ID NO: 86320 - DNA, 25 bp, E. coli
ccacaaactttagcgaaggtcacta

SEQ ID NO: 86321 - DNA, 25 bp, E. coli
gcctgcaggatttgaacaattgacc

SEQ ID NO: 86322 - DNA, 25 bp, E. coli
ccacaaactttaccgaaggtcacta

SEQ ID NO: 86323 - DNA, 25 bp, E. coli
gcctgcaggattagaacaattgacc

SEQ ID NO: 86324 - DNA, 25 bp, E. coli
gaagatccacgttccagtacgccgg

SEQ ID NO: 86325 - DNA, 25 bp, E. coli
gaagatccacgtaccagtacgccgg

SEQ ID NO: 86326 - DNA, 25 bp, E. coli
tggcgggtgatttatgaagatccac

SEQ ID NO: 86327 - DNA, 25 bp, E. coli
tggcgggtgattaatgaagatccac

SEQ ID NO: 86328 - DNA, 25 bp, E. coli
taactacgccgccacaaactttagc

SEQ ID NO: 86329 - DNA, 25 bp, E. coli
gacgccgccagctaaacagggctgt

SEQ ID NO: 86330 - DNA, 25 bp, E. coli
gacgccgccagcaaaacagggctgt

SEQ ID NO: 86331 - DNA, 25 bp, E. coli
catttacgctatgcacgctttcggt

SEQ ID NO: 86332 - DNA, 25 bp, E. coli
catttacgctatccacgctttcggt

SEQ ID NO: 86333 - DNA, 25 bp, E. coli
tactgctgaaatacgttggccatag

SEQ ID NO: 86334 - DNA, 25 bp, E. coli
tactgctgaaattcgttggccatag

SEQ ID NO: 86335 - DNA, 25 bp, E. coli
taccttccaggcgattgaaaaaggc

SEQ ID NO: 86336 - DNA, 25 bp, E. coli
taccgtgatggctagcgatctcgcc

SEQ ID NO: 86337 - DNA, 25 bp, E. coli
taccgtgatggcaagcgatctcgcc

SEQ ID NO: 86338 - DNA, 25 bp, E. coli
taccttccaggccattgaaaaaggc

SEQ ID NO: 86339 - DNA, 25 bp, E. coli
gaaaaaggcattccgcgtaacggta

SEQ ID NO: 86340 - DNA, 25 bp, E. coli
gaaaaaggcattgcgcgtaacggta

SEQ ID NO: 86341 - DNA, 25 bp, E. coli
gatctcgccaatgaaggcattacgc

SEQ ID NO: 86342 - DNA, 25 bp, E. coli
gatctcgccaatcaaggcattacgc

SEQ ID NO: 86343 - DNA, 25 bp, E. coli
gatttaccccacatacagacactca

SEQ ID NO: 86344 - DNA, 25 bp, E. coli
gattttcttattgtgacccgcttaa

SEQ ID NO: 86345 - DNA, 25 bp, E. coli
gattttcttattctgacccgcttaa

SEQ ID NO: 86346 - DNA, 25 bp, E. coli
gatttaccccacttacagacactca

SEQ ID NO: 86347 - DNA, 25 bp, E. coli
ggattaaccacattcgccttctggc

SEQ ID NO: 86348 - DNA, 25 bp, E. coli
ggattaaccacaatcgccttctggc

SEQ ID NO: 86349 - DNA, 25 bp, E. coli
ggtttattcgatgtgctcaccgatt

SEQ ID NO: 86350 - DNA, 25 bp, E. coli
ggtttattcgatctgctcaccgatt

SEQ ID NO: 86351 - DNA, 25 bp, E. coli
tatacccttatttcggcactcacga

SEQ ID NO: 86352 - DNA, 25 bp, E. coli
tatacccttattacggcactcacga

SEQ ID NO: 86353 - DNA, 25 bp, E. coli
caatatcccgcaagtgattggcggc

SEQ ID NO: 86354 - DNA, 25 bp, E. coli
caatatcccgcatgtgattggcggc

SEQ ID NO: 86355 - DNA, 25 bp, E. coli
cacgctgtttttgcagaccggaacg

SEQ ID NO: 86356 - DNA, 25 bp, E. coli
cacgctgtttttccagaccggaacg

SEQ ID NO: 86357 - DNA, 25 bp, E. coli
taaagcgcagcgttcagcactaaaa

SEQ ID NO: 86358 - DNA, 25 bp, E. coli
taaagcgcagcgatcagcactaaaa

SEQ ID NO: 86359 - DNA, 25 bp, E. coli
tttgccacagcacgatatgaagcgg

SEQ ID NO: 86360 - DNA, 25 bp, E. coli
tttgccacagcaggatatgaagcgg

SEQ ID NO: 86361 - DNA, 25 bp, E. coli
tgatctccgcgttttatcaggccga

SEQ ID NO: 86362 - DNA, 25 bp, E. coli
tgatctccgcgtattatcaggccga

SEQ ID NO: 86363 - DNA, 25 bp, E. coli
ccagctaccgatccaagcgtggcta

SEQ ID NO: 86364 - DNA, 25 bp, E. coli
ccagctaccgatgcaagcgtggcta

SEQ ID NO: 86365 - DNA, 25 bp, E. coli
gattgaatcggtggccagtttcgcc

SEQ ID NO: 86366 - DNA, 25 bp, E. coli
gattgaatcggtcgccagtttcgcc

SEQ ID NO: 86367 - DNA, 25 bp, E. coli
ggtcacgatctagtccacgggttat

SEQ ID NO: 86368 - DNA, 25 bp, E. coli
ggtcacgatctactccacgggttat

SEQ ID NO: 86369 - DNA, 25 bp, E. coli
taatcgccgcgacctggttgcagta

SEQ ID NO: 86370 - DNA, 25 bp, E. coli
taatcgccgcgagctggttgcagta

SEQ ID NO: 86371 - DNA, 25 bp, E. coli
gatgagcgagttacacggcgacgca

SEQ ID NO: 86372 - DNA, 25 bp, E. coli
gaccggaacgttagcgcttagcgcg

SEQ ID NO: 86373 - DNA, 25 bp, E. coli
gatgagcgagtttcacggcgacgca

SEQ ID NO: 86374 - DNA, 25 bp, E. coli
gaccggaacgtttgcgcttagcgcg

SEQ ID NO: 86375 - DNA, 25 bp, E. coli
cacacagccagaatacgtacggtca

SEQ ID NO: 86376 - DNA, 25 bp, E. coli
cacacagccagattacgtacggtca

SEQ ID NO: 86377 - DNA, 25 bp, E. coli
cttccagcagtttcgggccaaagtc

SEQ ID NO: 86378 - DNA, 25 bp, E. coli
cttccagcagttacgggccaaagtc

SEQ ID NO: 86379 - DNA, 25 bp, E. coli
aggagagagcatgttgcgcacgcca

SEQ ID NO: 86380 - DNA, 25 bp, E. coli
aggagagagcatcttgcgcacgcca

SEQ ID NO: 86381 - DNA, 25 bp, E. coli
aactggtccactttcatcttcatga

SEQ ID NO: 86382 - DNA, 25 bp, E. coli
aactggtccactatcatcttcatga

SEQ ID NO: 86383 - DNA, 25 bp, E. coli
tagaagcgatgatgatatccgcgcc

SEQ ID NO: 86384 - DNA, 25 bp, E. coli
tagaagcgatgaagatatccgcgcc

SEQ ID NO: 86385 - DNA, 25 bp, E. coli
tgttgccggtcacggtgatttcgcc

SEQ ID NO: 86386 - DNA, 25 bp, E. coli
tgatttcgcccgcaatgtgcgtaga

SEQ ID NO: 86387 - DNA, 25 bp, E. coli
tgttgccggtcagggtgatttcgcc

SEQ ID NO: 86388 - DNA, 25 bp, E. coli
tgattgggttaaaaactggtccact

SEQ ID NO: 86389 - DNA, 25 bp, E. coli
tgattgggttaataactggtccact

SEQ ID NO: 86390 - DNA, 25 bp, E. coli
tgatttcgcccggaatgtgcgtaga

SEQ ID NO: 86391 - DNA, 25 bp, E. coli
tcttcatgatcaaggaactgccttg

SEQ ID NO: 86392 - DNA, 25 bp, E. coli
tcttcatgatcatggaactgccttg

SEQ ID NO: 86393 - DNA, 25 bp, E. coli
gttgccacacactgccagaatacgt

SEQ ID NO: 86394 - DNA, 25 bp, E. coli
gttgccacacacagccagaatacgt

SEQ ID NO: 86395 - DNA, 25 bp, E. coli
tggaactgccttctccgttgccaca

SEQ ID NO: 86396 - DNA, 25 bp, E. coli
tggaactgccttgtccgttgccaca

SEQ ID NO: 86397 - DNA, 25 bp, E. coli
aattatgcgatggatcgaaaaccag

SEQ ID NO: 86398 - DNA, 25 bp, E. coli
aattatgcgatgcatcgaaaaccag

SEQ ID NO: 86399 - DNA, 25 bp, E. coli
caggtgccaaaaatgcaagttccgg

SEQ ID NO: 86400 - DNA, 25 bp, E. coli
caggtgccaaaattgcaagttccgg

SEQ ID NO: 86401 - DNA, 25 bp, E. coli
tacggagagagtccttattgcatca

SEQ ID NO: 86402 - DNA, 25 bp, E. coli
tacggagagagtgcttattgcatca

SEQ ID NO: 86403 - DNA, 25 bp, E. coli
tattgcatcaacagggctaaagccc

SEQ ID NO: 86404 - DNA, 25 bp, E. coli
tattgcatcaactgggctaaagccc

SEQ ID NO: 86405 - DNA, 25 bp, E. coli
tcgagcgggccacaagaaagtcatg

SEQ ID NO: 86406 - DNA, 25 bp, E. coli
tcgagcgggccagaagaaagtcatg

SEQ ID NO: 86407 - DNA, 25 bp, E. coli
gaatgcctgtactacatcgaagaaa

SEQ ID NO: 86408 - DNA, 25 bp, E. coli
gaaggtgatcctgggcattacagtg

SEQ ID NO: 86409 - DNA, 25 bp, E. coli
gaatgcctgtacaacatcgaagaaa

SEQ ID NO: 86410 - DNA, 25 bp, E. coli
gaaggtgatcctcggcattacagtg

SEQ ID NO: 86411 - DNA, 25 bp, E. coli
gaaaaccagaaacaaccaggtgcca

SEQ ID NO: 86412 - DNA, 25 bp, E. coli
gaaaaccagaaagaaccaggtgcca

SEQ ID NO: 86413 - DNA, 25 bp, E. coli
cccagcaaatggagtacggagagag

SEQ ID NO: 86414 - DNA, 25 bp, E. coli
ccgccattacgctgtagaaggtgat

SEQ ID NO: 86415 - DNA, 25 bp, E. coli
cccagcaaatggtgtacggagagag

SEQ ID NO: 86416 - DNA, 25 bp, E. coli
ccgccattacgcagtagaaggtgat

SEQ ID NO: 86417 - DNA, 25 bp, E. coli
tggatgcagggaaaagaataccgcc

SEQ ID NO: 86418 - DNA, 25 bp, E. coli
tggatgcagggataagaataccgcc

SEQ ID NO: 86419 - DNA, 25 bp, E. coli
ttgtgcagcacaacaaacttttgct

SEQ ID NO: 86420 - DNA, 25 bp, E. coli
ttgtgcagcacatcaaacttttgct

SEQ ID NO: 86421 - DNA, 25 bp, E. coli
ttctcatagagggtgaatcgtttca

SEQ ID NO: 86422 - DNA, 25 bp, E. coli
ttctcatagaggctgaatcgtttca

SEQ ID NO: 86423 - DNA, 25 bp, E. coli
tgaaacgtttcaccgcgatcttgtc

SEQ ID NO: 86424 - DNA, 25 bp, E. coli
tgaaacgtttcagcgcgatcttgtc

SEQ ID NO: 86425 - DNA, 25 bp, E. coli
tcgatcactggaagaggaagacgcg

SEQ ID NO: 86426 - DNA, 25 bp, E. coli
tcgatcactggatgaggaagacgcg

SEQ ID NO: 86427 - DNA, 25 bp, E. coli
tcgtttcaattctgcaagagaggag

SEQ ID NO: 86428 - DNA, 25 bp, E. coli
tcgtttcaattcagcaagagaggag

SEQ ID NO: 86429 - DNA, 25 bp, E. coli
tctttaaccctaagccaggttggcg

SEQ ID NO: 86430 - DNA, 25 bp, E. coli
tctttaaccctatgccaggttggcg

SEQ ID NO: 86431 - DNA, 25 bp, E. coli
ccttgcgtgctgtaacagaagtatt

SEQ ID NO: 86432 - DNA, 25 bp, E. coli
ccttgcgtgctgaaacagaagtatt

SEQ ID NO: 86433 - DNA, 25 bp, E. coli
gaagacgcggagattacgctgcttg

SEQ ID NO: 86434 - DNA, 25 bp, E. coli
gaagacgcggagtttacgctgcttg

SEQ ID NO: 86435 - DNA, 25 bp, E. coli
gacagcgaaatctaaagcgccacga

SEQ ID NO: 86436 - DNA, 25 bp, E. coli
gacagcgaaatcaaaagcgccacga

SEQ ID NO: 86437 - DNA, 25 bp, E. coli
cgctgcttgtcagaaaataaacaga

SEQ ID NO: 86438 - DNA, 25 bp, E. coli
cgctgcttgtcacaaaataaacaga

SEQ ID NO: 86439 - DNA, 25 bp, E. coli
taactttacggctttccttgcgtgc

SEQ ID NO: 86440 - DNA, 25 bp, E. coli
taactttacggcattccttgcgtgc

SEQ ID NO: 86441 - DNA, 25 bp, E. coli
aagacgttcagacagcattgcagca

SEQ ID NO: 86442 - DNA, 25 bp, E. coli
aagacgttcagagagcattgcagca

SEQ ID NO: 86443 - DNA, 25 bp, E. coli
caaagaagggctgtctcaggcgaag

SEQ ID NO: 86444 - DNA, 25 bp, E. coli
caaagaagggctctctcaggcgaag

SEQ ID NO: 86445 - DNA, 25 bp, E. coli
aaaacgctttgtgctgttggcgacg

SEQ ID NO: 86446 - DNA, 25 bp, E. coli
aaaacgctttgtcctgttggcgacg

SEQ ID NO: 86447 - DNA, 25 bp, E. coli
ttagtcacggacgaggagatcagcg

SEQ ID NO: 86448 - DNA, 25 bp, E. coli
ttgatcagcatatcaacgggcgtga

SEQ ID NO: 86449 - DNA, 25 bp, E. coli
ttgatcagcataacaacgggcgtga

SEQ ID NO: 86450 - DNA, 25 bp, E. coli
ttagtcacggaccaggagatcagcg

SEQ ID NO: 86451 - DNA, 25 bp, E. coli
tctgccatcttagagaacgtagggt

SEQ ID NO: 86452 - DNA, 25 bp, E. coli
tctgccatcttacagaacgtagggt

SEQ ID NO: 86453 - DNA, 25 bp, E. coli
gaagcctcactagtcacggataaag

SEQ ID NO: 86454 - DNA, 25 bp, E. coli
gaagcctcactactcacggataaag

SEQ ID NO: 86455 - DNA, 25 bp, E. coli
gaagcgcgtgaatggccgtgcattt

SEQ ID NO: 86456 - DNA, 25 bp, E. coli
gaagcgcgtgaaaggccgtgcattt

SEQ ID NO: 86457 - DNA, 25 bp, E. coli
cgatcgagtcgaccaggtattcaag

SEQ ID NO: 86458 - DNA, 25 bp, E. coli
cgatcgagtcgagcaggtattcaag

SEQ ID NO: 86459 - DNA, 25 bp, E. coli
ggtcgccaggccacatttattgaag

SEQ ID NO: 86460 - DNA, 25 bp, E. coli
ggtcgccaggcctcatttattgaag

SEQ ID NO: 86461 - DNA, 25 bp, E. coli
gagtgctccggatgaattagtcgcc

SEQ ID NO: 86462 - DNA, 25 bp, E. coli
gagtgctccggaagaattagtcgcc

SEQ ID NO: 86463 - DNA, 25 bp, E. coli
caggtgtactgaaagacggcacagg

SEQ ID NO: 86464 - DNA, 25 bp, E. coli
caggtgtactgatagacggcacagg

SEQ ID NO: 86465 - DNA, 25 bp, E. coli
atggcagtaaagttttcaggtgtac

SEQ ID NO: 86466 - DNA, 25 bp, E. coli
actgaaagacggcacaggaaaaccg

SEQ ID NO: 86467 - DNA, 25 bp, E. coli
atggcagtaaagatttcaggtgtac

SEQ ID NO: 86468 - DNA, 25 bp, E. coli
actgaaagacgggacaggaaaaccg

SEQ ID NO: 86469 - DNA, 25 bp, E. coli
tttcaggtgtacagaaagacggcac

SEQ ID NO: 86470 - DNA, 25 bp, E. coli
tttcaggtgtactgaaagacggcac

SEQ ID NO: 86471 - DNA, 25 bp, E. coli
tgaaagacggcacaggaaaaccggt

SEQ ID NO: 86472 - DNA, 25 bp, E. coli
tgaaagacggcagaggaaaaccggt

SEQ ID NO: 86473 - DNA, 25 bp, E. coli
tcaggtgtactgaaagacggcacag

SEQ ID NO: 86474 - DNA, 25 bp, E. coli
tcaggtgtactgtaagacggcacag

SEQ ID NO: 86475 - DNA, 25 bp, E. coli
gcagtaaagatttcaggtgtactga

SEQ ID NO: 86476 - DNA, 25 bp, E. coli
gcagtaaagattacaggtgtactga

SEQ ID NO: 86477 - DNA, 25 bp, E. coli
ctgaaagacggcacaggaaaaccgg

SEQ ID NO: 86478 - DNA, 25 bp, E. coli
ctgaaagacggctcaggaaaaccgg

SEQ ID NO: 86479 - DNA, 25 bp, E. coli
gatttcaggtgtactgaaagacggc

SEQ ID NO: 86480 - DNA, 25 bp, E. coli
gatttcaggtgttctgaaagacggc

SEQ ID NO: 86481 - DNA, 25 bp, E. coli
tgtactgaaagacggcacaggaaaa

SEQ ID NO: 86482 - DNA, 25 bp, E. coli
ggtgtactgaaagacggcacaggaa

SEQ ID NO: 86483 - DNA, 25 bp, E. coli
ggtgtactgaaacacggcacaggaa

SEQ ID NO: 86484 - DNA, 25 bp, E. coli
tgtactgaaagagggcacaggaaaa

SEQ ID NO: 86485 - DNA, 25 bp, E. coli
aatcgtgatgcaaagcaactccggc

SEQ ID NO: 86486 - DNA, 25 bp, E. coli
aatcgtgatgcatagcaactccggc

SEQ ID NO: 86487 - DNA, 25 bp, E. coli
tatgccgcgacaccacaagcaattt

SEQ ID NO: 86488 - DNA, 25 bp, E. coli
tatgccgcgacagcacaagcaattt

SEQ ID NO: 86489 - DNA, 25 bp, E. coli
tattccccgcagcaaatgcagcagt

SEQ ID NO: 86490 - DNA, 25 bp, E. coli
tattccccgcaggaaatgcagcagt

SEQ ID NO: 86491 - DNA, 25 bp, E. coli
ttactggaagaattggccgggcagc

SEQ ID NO: 86492 - DNA, 25 bp, E. coli
ttactggaagaaatggccgggcagc

SEQ ID NO: 86493 - DNA, 25 bp, E. coli
tgctgctggaatccaccggatgcgc

SEQ ID NO: 86494 - DNA, 25 bp, E. coli
tgctgctggaatgcaccggatgcgc

SEQ ID NO: 86495 - DNA, 25 bp, E. coli
ccggatgcgccaaatgcagcagtat

SEQ ID NO: 86496 - DNA, 25 bp, E. coli
gaaatgcagcagttacatccgggag

SEQ ID NO: 86497 - DNA, 25 bp, E. coli
gaaatgcagcagatacatccgggag

SEQ ID NO: 86498 - DNA, 25 bp, E. coli
cgttggtttgcgctcacggatgaac

SEQ ID NO: 86499 - DNA, 25 bp, E. coli
ccggatgcgccatatgcagcagtat

SEQ ID NO: 86500 - DNA, 25 bp, E. coli
cgttggtttgcggtcacggatgaac

SEQ ID NO: 86501 - DNA, 25 bp, E. coli
gtttcaaccgatctttgctgctgga

SEQ ID NO: 86502 - DNA, 25 bp, E. coli
gatcgtgagcagtgaaacaccctga

SEQ ID NO: 86503 - DNA, 25 bp, E. coli
gtttcaaccgatgtttgctgctgga

SEQ ID NO: 86504 - DNA, 25 bp, E. coli
gacggcgagcctcttctggaaattt

SEQ ID NO: 86505 - DNA, 25 bp, E. coli
gacggcgagcctgttctggaaattt

SEQ ID NO: 86506 - DNA, 25 bp, E. coli
gatcgtgagcagagaaacaccctga

SEQ ID NO: 86507 - DNA, 25 bp, E. coli
caagcggttgttgcacctctgcgag

SEQ ID NO: 86508 - DNA, 25 bp, E. coli
caagcggttgttccacctctgcgag

SEQ ID NO: 86509 - DNA, 25 bp, E. coli
tacggtgggattttgatgcagcgcc

SEQ ID NO: 86510 - DNA, 25 bp, E. coli
tatgcctttgccttgtggacactgg

SEQ ID NO: 86511 - DNA, 25 bp, E. coli
tacggtgggattatgatgcagcgcc

SEQ ID NO: 86512 - DNA, 25 bp, E. coli
tagccctgtggctggcagataaatg

SEQ ID NO: 86513 - DNA, 25 bp, E. coli
tagccctgtggcaggcagataaatg

SEQ ID NO: 86514 - DNA, 25 bp, E. coli
tatgcctttgccatgtggacactgg

SEQ ID NO: 86515 - DNA, 25 bp, E. coli
ttcgaaaacctctgtggcgggatgg

SEQ ID NO: 86516 - DNA, 25 bp, E. coli
tatcgtgctgtaaaagctgggcgac

SEQ ID NO: 86517 - DNA, 25 bp, E. coli
tattatcgcgacgttgcttgcacca

SEQ ID NO: 86518 - DNA, 25 bp, E. coli
tatcgtgctgtataagctgggcgac

SEQ ID NO: 86519 - DNA, 25 bp, E. coli
tattatcgcgaccttgcttgcacca

SEQ ID NO: 86520 - DNA, 25 bp, E. coli
ttcgaaaacctcagtggcgggatgg

SEQ ID NO: 86521 - DNA, 25 bp, E. coli
tgctggattatctggcgctacgaaa

SEQ ID NO: 86522 - DNA, 25 bp, E. coli
tgctggattatcaggcgctacgaaa

SEQ ID NO: 86523 - DNA, 25 bp, E. coli
ccttacaggcctcgatgacggtcga

SEQ ID NO: 86524 - DNA, 25 bp, E. coli
ccttacaggcctggatgacggtcga

SEQ ID NO: 86525 - DNA, 25 bp, E. coli
gacaaccacgttattgattcgcggc

SEQ ID NO: 86526 - DNA, 25 bp, E. coli
gacaaccacgtttttgattcgcggc

SEQ ID NO: 86527 - DNA, 25 bp, E. coli
gatcctgggttttgcttccgggcta

SEQ ID NO: 86528 - DNA, 25 bp, E. coli
gatcctgggtttagcttccgggcta

SEQ ID NO: 86529 - DNA, 25 bp, E. coli
cagacgcttgaggtacagttccggc

SEQ ID NO: 86530 - DNA, 25 bp, E. coli
cagagtacggaagagcgattcggtc

SEQ ID NO: 86531 - DNA, 25 bp, E. coli
cagagtacggaacagcgattcggtc

SEQ ID NO: 86532 - DNA, 25 bp, E. coli
cagacgcttgagctacagttccggc

SEQ ID NO: 86533 - DNA, 25 bp, E. coli
tacgcaggtacatgtcgagatccag

SEQ ID NO: 86534 - DNA, 25 bp, E. coli
tacgcaggtacaagtcgagatccag

SEQ ID NO: 86535 - DNA, 25 bp, E. coli
taccagagaggaactgcgagcgcac

SEQ ID NO: 86536 - DNA, 25 bp, E. coli
taccagagaggatctgcgagcgcac

SEQ ID NO: 86537 - DNA, 25 bp, E. coli
tcacgcatggtcagtttttcgaacg

SEQ ID NO: 86538 - DNA, 25 bp, E. coli
tcttaccgagaaaatcctgtgccag

SEQ ID NO: 86539 - DNA, 25 bp, E. coli
tcttaccgagaatatcctgtgccag

SEQ ID NO: 86540 - DNA, 25 bp, E. coli
gaagatctcggtaacgatacggccc

SEQ ID NO: 86541 - DNA, 25 bp, E. coli
gaagatctcggttacgatacggccc

SEQ ID NO: 86542 - DNA, 25 bp, E. coli
gaatttatccggcagcggacgcagt

SEQ ID NO: 86543 - DNA, 25 bp, E. coli
gaatttatccgggagcggacgcagt

SEQ ID NO: 86544 - DNA, 25 bp, E. coli
gaactctgggttatgacgtacggaa

SEQ ID NO: 86545 - DNA, 25 bp, E. coli
gaactctgggttttgacgtacggaa

SEQ ID NO: 86546 - DNA, 25 bp, E. coli
cattgttaagatggactaccgcgtc

SEQ ID NO: 86547 - DNA, 25 bp, E. coli
cattgttaagatcgactaccgcgtc

SEQ ID NO: 86548 - DNA, 25 bp, E. coli
tcacgcatggtctgtttttcgaacg

SEQ ID NO: 86549 - DNA, 25 bp, E. coli
gagtcgaagttgtccagatccgcca

SEQ ID NO: 86550 - DNA, 25 bp, E. coli
gagtcgaagttgaccagatccgcca

SEQ ID NO: 86551 - DNA, 25 bp, E. coli
aatctgttgaataatgatggctggc

SEQ ID NO: 86552 - DNA, 25 bp, E. coli
aatctgttgaattatgatggctggc

SEQ ID NO: 86553 - DNA, 25 bp, E. coli
ttcacgcttcacagattatcggagg

SEQ ID NO: 86554 - DNA, 25 bp, E. coli
ttcacgcttcactgattatcggagg

SEQ ID NO: 86555 - DNA, 25 bp, E. coli
tatctgccgtcaataatctgttgaa

SEQ ID NO: 86556 - DNA, 25 bp, E. coli
tatctgccgtcattaatctgttgaa

SEQ ID NO: 86557 - DNA, 25 bp, E. coli
tgggcatatcatccctttatagaga

SEQ ID NO: 86558 - DNA, 25 bp, E. coli
tgggcatatcatgcctttatagaga

SEQ ID NO: 86559 - DNA, 25 bp, E. coli
tctgcatttcctccttaccgataaa

SEQ ID NO: 86560 - DNA, 25 bp, E. coli
tctgcatttcctgcttaccgataaa

SEQ ID NO: 86561 - DNA, 25 bp, E. coli
cctttatagagaaaacgaaacagtg

SEQ ID NO: 86562 - DNA, 25 bp, E. coli
cctttatagagataacgaaacagtg

SEQ ID NO: 86563 - DNA, 25 bp, E. coli
gacatattcgtgatcgacactgcac

SEQ ID NO: 86564 - DNA, 25 bp, E. coli
gacatacattttgtgggctccctca

SEQ ID NO: 86565 - DNA, 25 bp, E. coli
gacatattcgtgttcgacactgcac

SEQ ID NO: 86566 - DNA, 25 bp, E. coli
gacatacattttctgggctccctca

SEQ ID NO: 86567 - DNA, 25 bp, E. coli
gggctccctcatttttccattctca

SEQ ID NO: 86568 - DNA, 25 bp, E. coli
gggctccctcatatttccattctca

SEQ ID NO: 86569 - DNA, 25 bp, E. coli
taattgaaaaccctagcccatgggc

SEQ ID NO: 86570 - DNA, 25 bp, E. coli
taattgaaaaccgtagcccatgggc

SEQ ID NO: 86571 - DNA, 25 bp, E. coli
gatggctggcaagtcgacatacatt

SEQ ID NO: 86572 - DNA, 25 bp, E. coli
gatggctggcaactcgacatacatt

SEQ ID NO: 86573 - DNA, 25 bp, E. coli
caagcctgacaactatgcggacgtt

SEQ ID NO: 86574 - DNA, 25 bp, E. coli
caagcctgacaagtatgcggacgtt

SEQ ID NO: 86575 - DNA, 25 bp, E. coli
taaagctgttcaccgcctgatggga

SEQ ID NO: 86576 - DNA, 25 bp, E. coli
taaagctgttcagcgcctgatggga

SEQ ID NO: 86577 - DNA, 25 bp, E. coli
aaagagatttcaaggctacgcggcc

SEQ ID NO: 86578 - DNA, 25 bp, E. coli
aaagagatttcatggctacgcggcc

SEQ ID NO: 86579 - DNA, 25 bp, E. coli
ttacagaggagaggtagggcaaacc

SEQ ID NO: 86580 - DNA, 25 bp, E. coli
ttacagaggagacgtagggcaaacc

SEQ ID NO: 86581 - DNA, 25 bp, E. coli
tgttctgcactcagaccagggatgg

SEQ ID NO: 86582 - DNA, 25 bp, E. coli
tgttctgcactctgaccagggatgg

SEQ ID NO: 86583 - DNA, 25 bp, E. coli
gcctttcggaaacaccagtgatgaa

SEQ ID NO: 86584 - DNA, 25 bp, E. coli
gcctttcggaaagaccagtgatgaa

SEQ ID NO: 86585 - DNA, 25 bp, E. coli
cgattaaggtcatgcgataccgctc

SEQ ID NO: 86586 - DNA, 25 bp, E. coli
cgattaaggtcaagcgataccgctc

SEQ ID NO: 86587 - DNA, 25 bp, E. coli
ctacgcggccaatcgagaagtgggt

SEQ ID NO: 86588 - DNA, 25 bp, E. coli
ctacgcggccaaacgagaagtgggt

SEQ ID NO: 86589 - DNA, 25 bp, E. coli
gatttatcacgacaatagaggccga

SEQ ID NO: 86590 - DNA, 25 bp, E. coli
gatttatcacgagaatagaggccga

SEQ ID NO: 86591 - DNA, 25 bp, E. coli
gggaaccctctcacttaaagcagcg

SEQ ID NO: 86592 - DNA, 25 bp, E. coli
gggaaccctctctcttaaagcagcg

SEQ ID NO: 86593 - DNA, 25 bp, E. coli
ggaatcagacctatatgcctcgtgt

SEQ ID NO: 86594 - DNA, 25 bp, E. coli
ggaatcagacctttatgcctcgtgt

SEQ ID NO: 86595 - DNA, 25 bp, E. coli
attattctgccggaggcgttccgcg

SEQ ID NO: 86596 - DNA, 25 bp, E. coli
attattctgccgcaggcgttccgcg

SEQ ID NO: 86597 - DNA, 25 bp, E. coli
actcactggcagtcgatgaaactga

SEQ ID NO: 86598 - DNA, 25 bp, E. coli
actcactggcagacgatgaaactga

SEQ ID NO: 86599 - DNA, 25 bp, E. coli
tccgtaccgcctcaaccattggtga

SEQ ID NO: 86600 - DNA, 25 bp, E. coli
tccgtaccgcctgaaccattggtga

SEQ ID NO: 86601 - DNA, 25 bp, E. coli
tcagctacttgataagaaggacagc

SEQ ID NO: 86602 - DNA, 25 bp, E. coli
tcagctacttgaaaagaaggacagc

SEQ ID NO: 86603 - DNA, 25 bp, E. coli
gcgcgtcgttgtaggtcagctactt

SEQ ID NO: 86604 - DNA, 25 bp, E. coli
ccatatctgctcgacgggctggtga

SEQ ID NO: 86605 - DNA, 25 bp, E. coli
gcgcgtcgttgttggtcagctactt

SEQ ID NO: 86606 - DNA, 25 bp, E. coli
ccatatctgctccacgggctggtga

SEQ ID NO: 86607 - DNA, 25 bp, E. coli
gaagcggcctacaattcagagatta

SEQ ID NO: 86608 - DNA, 25 bp, E. coli
gaagcggcctactattcagagatta

SEQ ID NO: 86609 - DNA, 25 bp, E. coli
cgttttcgatgtttgaagcggccta

SEQ ID NO: 86610 - DNA, 25 bp, E. coli
cgttttcgatgtatgaagcggccta

SEQ ID NO: 86611 - DNA, 25 bp, E. coli
ctggcgttgggaatgactcactggc

SEQ ID NO: 86612 - DNA, 25 bp, E. coli
ctggcgttgggattgactcactggc

SEQ ID NO: 86613 - DNA, 25 bp, E. coli
gggttttctgcataacgtgctggga

SEQ ID NO: 86614 - DNA, 25 bp, E. coli
gggttttctgcaaaacgtgctggga

SEQ ID NO: 86615 - DNA, 25 bp, E. coli
taatttcggcgatggtggcgttttc

SEQ ID NO: 86616 - DNA, 25 bp, E. coli
taatttcggcgaaggtggcgttttc

SEQ ID NO: 86617 - DNA, 25 bp, E. coli
aatgtatttttgagatgtctgttac

SEQ ID NO: 86618 - DNA, 25 bp, E. coli
caaaattaccgctcctgcaattttt

SEQ ID NO: 86619 - DNA, 25 bp, E. coli
aatgtatttttgtgatgtctgttac

SEQ ID NO: 86620 - DNA, 25 bp, E. coli
caaaattaccgcacctgcaattttt

SEQ ID NO: 86621 - DNA, 25 bp, E. coli
acatagtgaaatacttttcgtttgc

SEQ ID NO: 86622 - DNA, 25 bp, E. coli
acatagtgaaattcttttcgtttgc

SEQ ID NO: 86623 - DNA, 25 bp, E. coli
tatatgtttttaatactgccaccat

SEQ ID NO: 86624 - DNA, 25 bp, E. coli
tatatgtttttattactgccaccat

SEQ ID NO: 86625 - DNA, 25 bp, E. coli
tttgcttacaaatttaccgctcctg

SEQ ID NO: 86626 - DNA, 25 bp, E. coli
tttgcttacaaaattaccgctcctg

SEQ ID NO: 86627 - DNA, 25 bp, E. coli
tgatgtctgttagatagtgaaatac

SEQ ID NO: 86628 - DNA, 25 bp, E. coli
tgatgtctgttacatagtgaaatac

SEQ ID NO: 86629 - DNA, 25 bp, E. coli
cctgcaatttttttcacatatgcgg

SEQ ID NO: 86630 - DNA, 25 bp, E. coli
gccaccattaataatactcgtgatt

SEQ ID NO: 86631 - DNA, 25 bp, E. coli
cctgcaatttttatcacatatgcgg

SEQ ID NO: 86632 - DNA, 25 bp, E. coli
gccaccattaattatactcgtgatt

SEQ ID NO: 86633 - DNA, 25 bp, E. coli
gcttacaaaatttccgctcctgcaa

SEQ ID NO: 86634 - DNA, 25 bp, E. coli
gcttacaaaattaccgctcctgcaa

SEQ ID NO: 86635 - DNA, 25 bp, E. coli
gtgactgcattattgtatttttgtg

SEQ ID NO: 86636 - DNA, 25 bp, E. coli
gtgactgcattaatgtatttttgtg

SEQ ID NO: 86637 - DNA, 25 bp, E. coli
tcacatatgcggtattgtttttata

SEQ ID NO: 86638 - DNA, 25 bp, E. coli
tcacatatgcggaattgtttttata

SEQ ID NO: 86639 - DNA, 25 bp, E. coli
tagtctttgcccttctcccacgatg

SEQ ID NO: 86640 - DNA, 25 bp, E. coli
tagtctttgcccatctcccacgatg

SEQ ID NO: 86641 - DNA, 25 bp, E. coli
tttataagcatgcaaatcccctgag

SEQ ID NO: 86642 - DNA, 25 bp, E. coli
tttataagcatggaaatcccctgag

SEQ ID NO: 86643 - DNA, 25 bp, E. coli
tcccctgagtgaaacaacgaattgc

SEQ ID NO: 86644 - DNA, 25 bp, E. coli
tgcccatctccctcgatgggctttt

SEQ ID NO: 86645 - DNA, 25 bp, E. coli
tcccctgagtgatacaacgaattgc

SEQ ID NO: 86646 - DNA, 25 bp, E. coli
tgcccatctcccacgatgggctttt

SEQ ID NO: 86647 - DNA, 25 bp, E. coli
cctgagtgaaacaacgaattgctgt

SEQ ID NO: 86648 - DNA, 25 bp, E. coli
cctgagtgaaactacgaattgctgt

SEQ ID NO: 86649 - DNA, 25 bp, E. coli
gctgtgtgtagtgtttgcccatctc

SEQ ID NO: 86650 - DNA, 25 bp, E. coli
gctgtgtgtagtctttgcccatctc

SEQ ID NO: 86651 - DNA, 25 bp, E. coli
gaaacaacgaatagctgtgtgtagt

SEQ ID NO: 86652 - DNA, 25 bp, E. coli
gaaacaacgaattgctgtgtgtagt

SEQ ID NO: 86653 - DNA, 25 bp, E. coli
gtgtgtagtcttagcccatctccca

SEQ ID NO: 86654 - DNA, 25 bp, E. coli
gtgtgtagtctttgcccatctccca

SEQ ID NO: 86655 - DNA, 25 bp, E. coli
tggaaatcccctcagtgaaacaacg

SEQ ID NO: 86656 - DNA, 25 bp, E. coli
tggaaatcccctgagtgaaacaacg

SEQ ID NO: 86657 - DNA, 25 bp, E. coli
taagcatggaaatcccctgagtgaa

SEQ ID NO: 86658 - DNA, 25 bp, E. coli
tcaacatattgaattataagcatgg

SEQ ID NO: 86659 - DNA, 25 bp, E. coli
tcaacatattgatttataagcatgg

SEQ ID NO: 86660 - DNA, 25 bp, E. coli
taagcatggaaaacccctgagtgaa

SEQ ID NO: 86661 - DNA, 25 bp, E. coli
aagcgcctgcaaagaccccgctgat

SEQ ID NO: 86662 - DNA, 25 bp, E. coli
cacgttccgttatgaggatgtgctc

SEQ ID NO: 86663 - DNA, 25 bp, E. coli
cacgttccgttaagaggatgtgctc

SEQ ID NO: 86664 - DNA, 25 bp, E. coli
aagcgcctgcaatgaccccgctgat

SEQ ID NO: 86665 - DNA, 25 bp, E. coli
agaccagcaccacgctgacgttcta

SEQ ID NO: 86666 - DNA, 25 bp, E. coli
agaccagcaccaggctgacgttcta

SEQ ID NO: 86667 - DNA, 25 bp, E. coli
ccgacggtgctggcgttggcattct

SEQ ID NO: 86668 - DNA, 25 bp, E. coli
gcaccacgctgaggttctacaagtc

SEQ ID NO: 86669 - DNA, 25 bp, E. coli
gcaccacgctgacgttctacaagtc

SEQ ID NO: 86670 - DNA, 25 bp, E. coli
gacgagcaaagaaacctttacccat

SEQ ID NO: 86671 - DNA, 25 bp, E. coli
gacgagcaaagatacctttacccat

SEQ ID NO: 86672 - DNA, 25 bp, E. coli
ccgacggtgctgccgttggcattct

SEQ ID NO: 86673 - DNA, 25 bp, E. coli
ccgcgtttgccgcaacggcaatcag

SEQ ID NO: 86674 - DNA, 25 bp, E. coli
ccgttatgaggaagtgctctggccg

SEQ ID NO: 86675 - DNA, 25 bp, E. coli
ccgcgtttgccggaacggcaatcag

SEQ ID NO: 86676 - DNA, 25 bp, E. coli
ccgttatgaggatgtgctctggccg

SEQ ID NO: 86677 - DNA, 25 bp, E. coli
cgtaagctggttccgtgggatggca

SEQ ID NO: 86678 - DNA, 25 bp, E. coli
cgtaagctggttgcgtgggatggca

SEQ ID NO: 86679 - DNA, 25 bp, E. coli
cggattgagtgccaaagcgcctgca

SEQ ID NO: 86680 - DNA, 25 bp, E. coli
cggaacggcaatgagcatcgtttaa

SEQ ID NO: 86681 - DNA, 25 bp, E. coli
cggattgagtgcgaaagcgcctgca

SEQ ID NO: 86682 - DNA, 25 bp, E. coli
cggaacggcaatcagcatcgtttaa

SEQ ID NO: 86683 - DNA, 25 bp, E. coli
cacccgtggtaaggagcaaggctat

SEQ ID NO: 86684 - DNA, 25 bp, E. coli
cacccgtggtaacgagcaaggctat

SEQ ID NO: 86685 - DNA, 25 bp, E. coli
catgtacatgcgtgaaatgggcacc

SEQ ID NO: 86686 - DNA, 25 bp, E. coli
catgtacatgcgagaaatgggcacc

SEQ ID NO: 86687 - DNA, 25 bp, E. coli
tatctgctggaacagtacgatcgtg

SEQ ID NO: 86688 - DNA, 25 bp, E. coli
tatctgctggaagagtacgatcgtg

SEQ ID NO: 86689 - DNA, 25 bp, E. coli
ttgaactgttgacccgcgaaggcga

SEQ ID NO: 86690 - DNA, 25 bp, E. coli
ttgaactgttgagccgcgaaggcga

SEQ ID NO: 86691 - DNA, 25 bp, E. coli
tgatgacaacaggatcgacccggaa

SEQ ID NO: 86692 - DNA, 25 bp, E. coli
tgatgacaacagcatcgacccggaa

SEQ ID NO: 86693 - DNA, 25 bp, E. coli
tctgatgctggctgaaaacaccgcg

SEQ ID NO: 86694 - DNA, 25 bp, E. coli
tctgatgctggcagaaaacaccgcg

SEQ ID NO: 86695 - DNA, 25 bp, E. coli
gctgaatatccgcaagcgatcacct

SEQ ID NO: 86696 - DNA, 25 bp, E. coli
gctgaatatccggaagcgatcacct

SEQ ID NO: 86697 - DNA, 25 bp, E. coli
gaagcaccggatgccgatgatctga

SEQ ID NO: 86698 - DNA, 25 bp, E. coli
gaagaagcgcgtgtgtccgatctga

SEQ ID NO: 86699 - DNA, 25 bp, E. coli
gaagaagcgcgtctgtccgatctga

SEQ ID NO: 86700 - DNA, 25 bp, E. coli
gaagtattcaaagagttccgcctgg

SEQ ID NO: 86701 - DNA, 25 bp, E. coli
gaagcaccggatcccgatgatctga

SEQ ID NO: 86702 - DNA, 25 bp, E. coli
gaagtattcaaacagttccgcctgg

SEQ ID NO: 86703 - DNA, 25 bp, E. coli
tggaatctgaaaacgggcgcacgac

SEQ ID NO: 86704 - DNA, 25 bp, E. coli
tggaatctgaaatcgggcgcacgac

SEQ ID NO: 86705 - DNA, 25 bp, E. coli
aatgtgaggacgatatgccaacacc

SEQ ID NO: 86706 - DNA, 25 bp, E. coli
aatgtgaggacgttatgccaacacc

SEQ ID NO: 86707 - DNA, 25 bp, E. coli
atgtgaggacgatatgccaacacca

SEQ ID NO: 86708 - DNA, 25 bp, E. coli
atgtgaggacgaaatgccaacacca

SEQ ID NO: 86709 - DNA, 25 bp, E. coli
aaatgtgaggacgatatgccaacac

SEQ ID NO: 86710 - DNA, 25 bp, E. coli
aaatgtgaggaccatatgccaacac

SEQ ID NO: 86711 - DNA, 25 bp, E. coli
tatgaaatgtgaggacgatatgcca

SEQ ID NO: 86712 - DNA, 25 bp, E. coli
tatgaaatgtgacgacgatatgcca

SEQ ID NO: 86713 - DNA, 25 bp, E. coli
tgtgaggacgatatgccaacaccaa

SEQ ID NO: 86714 - DNA, 25 bp, E. coli
tgtgaggacgatttgccaacaccaa

SEQ ID NO: 86715 - DNA, 25 bp, E. coli
tgaaatgtgaggtcgatatgccaac

SEQ ID NO: 86716 - DNA, 25 bp, E. coli
tgaggacgatatcccaacaccaaat

SEQ ID NO: 86717 - DNA, 25 bp, E. coli
tgaaatgtgaggacgatatgccaac

SEQ ID NO: 86718 - DNA, 25 bp, E. coli
tgaggacgatatgccaacaccaaat

SEQ ID NO: 86719 - DNA, 25 bp, E. coli
cctatgaaatgtcaggacgatatgc

SEQ ID NO: 86720 - DNA, 25 bp, E. coli
cctatgaaatgtgaggacgatatgc

SEQ ID NO: 86721 - DNA, 25 bp, E. coli
gaaatgtgaggaggatatgccaaca

SEQ ID NO: 86722 - DNA, 25 bp, E. coli
gaaatgtgaggacgatatgccaaca

SEQ ID NO: 86723 - DNA, 25 bp, E. coli
ctatgaaatgtgaggacgatatgcc

SEQ ID NO: 86724 - DNA, 25 bp, E. coli
ctatgaaatgtgtggacgatatgcc

SEQ ID NO: 86725 - DNA, 25 bp, E. coli
gtgaggacgatatgccaacaccaaa

SEQ ID NO: 86726 - DNA, 25 bp, E. coli
gtgaggacgataagccaacaccaaa

SEQ ID NO: 86727 - DNA, 25 bp, E. coli
cactttgcatcaccatggtgataca

SEQ ID NO: 86728 - DNA, 25 bp, E. coli
cactttgcatcagcatggtgataca

SEQ ID NO: 86729 - DNA, 25 bp, E. coli
cataataagaaagcataacgcctga

SEQ ID NO: 86730 - DNA, 25 bp, E. coli
cataataagaaaccataacgcctga

SEQ ID NO: 86731 - DNA, 25 bp, E. coli
taggcagtacaatataagttaggcg

SEQ ID NO: 86732 - DNA, 25 bp, E. coli
taggcagtacaaaataagttaggcg

SEQ ID NO: 86733 - DNA, 25 bp, E. coli
tattgagcataatgtaggcagtaca

SEQ ID NO: 86734 - DNA, 25 bp, E. coli
tattgagcataaagtaggcagtaca

SEQ ID NO: 86735 - DNA, 25 bp, E. coli
tatcaggcgtcatgaatggagagcg

SEQ ID NO: 86736 - DNA, 25 bp, E. coli
tatcaggcgtcaagaatggagagcg

SEQ ID NO: 86737 - DNA, 25 bp, E. coli
tcttgacacctgttattgcggacat

SEQ ID NO: 86738 - DNA, 25 bp, E. coli
tcttgacacctgatattgcggacat

SEQ ID NO: 86739 - DNA, 25 bp, E. coli
gctggcatctacagagagcatggta

SEQ ID NO: 86740 - DNA, 25 bp, E. coli
gctggcatctactgagagcatggta

SEQ ID NO: 86741 - DNA, 25 bp, E. coli
taacgcctgaaaagctcactttgca

SEQ ID NO: 86742 - DNA, 25 bp, E. coli
taagttaggcgggatatcaggcgtc

SEQ ID NO: 86743 - DNA, 25 bp, E. coli
taacgcctgaaatgctcactttgca

SEQ ID NO: 86744 - DNA, 25 bp, E. coli
taagttaggcggcatatcaggcgtc

SEQ ID NO: 86745 - DNA, 25 bp, E. coli
gagcgagaactctccattcttgaca

SEQ ID NO: 86746 - DNA, 25 bp, E. coli
gagagcataagaaatatccacgccg

SEQ ID NO: 86747 - DNA, 25 bp, E. coli
gagagcataagatatatccacgccg

SEQ ID NO: 86748 - DNA, 25 bp, E. coli
gagcgagaactcaccattcttgaca

SEQ ID NO: 86749 - DNA, 25 bp, E. coli
aacgcaatgatgctgggcctgaaat

SEQ ID NO: 86750 - DNA, 25 bp, E. coli
caatgacaacgctatgatggtgggc

SEQ ID NO: 86751 - DNA, 25 bp, E. coli
caatgacaacgcaatgatggtgggc

SEQ ID NO: 86752 - DNA, 25 bp, E. coli
taaacggtgtgatagttgaacaagc

SEQ ID NO: 86753 - DNA, 25 bp, E. coli
taacaatatccacacccgacttggt

SEQ ID NO: 86754 - DNA, 25 bp, E. coli
taaacggtgtgaaagttgaacaagc

SEQ ID NO: 86755 - DNA, 25 bp, E. coli
gacttggtttcctcacctttattcg

SEQ ID NO: 86756 - DNA, 25 bp, E. coli
gacttggtttccacacctttattcg

SEQ ID NO: 86757 - DNA, 25 bp, E. coli
aacgcaatgatggtgggcctgaaat

SEQ ID NO: 86758 - DNA, 25 bp, E. coli
tatccagacccgacttggtttccac

SEQ ID NO: 86759 - DNA, 25 bp, E. coli
tatccagacccgtcttggtttccac

SEQ ID NO: 86760 - DNA, 25 bp, E. coli
ttgagaacgaccacggcacaggcca

SEQ ID NO: 86761 - DNA, 25 bp, E. coli
ttgagaacgacctcggcacaggcca

SEQ ID NO: 86762 - DNA, 25 bp, E. coli
tcgtgcaggtgatacgcgctatatc

SEQ ID NO: 86763 - DNA, 25 bp, E. coli
tcgtgcaggtgaaacgcgctatatc

SEQ ID NO: 86764 - DNA, 25 bp, E. coli
cgatcgtgcaggagaaacgcgctat

SEQ ID NO: 86765 - DNA, 25 bp, E. coli
cgatcgtgcaggtgaaacgcgctat

SEQ ID NO: 86766 - DNA, 25 bp, E. coli
tggctacaatgagaacgcaatgatg

SEQ ID NO: 86767 - DNA, 25 bp, E. coli
tggctacaatgacaacgcaatgatg

SEQ ID NO: 86768 - DNA, 25 bp, E. coli
taacaatatccagacccgacttggt

SEQ ID NO: 86769 - DNA, 25 bp, E. coli
gacctcggcacaggccatctggatg

SEQ ID NO: 86770 - DNA, 25 bp, E. coli
gacctcggcacacgccatctggatg

SEQ ID NO: 86771 - DNA, 25 bp, E. coli
atttatgcgccagtaagcggtgaaa

SEQ ID NO: 86772 - DNA, 25 bp, E. coli
accgcatacgaagcattgttagaag

SEQ ID NO: 86773 - DNA, 25 bp, E. coli
atttatgcgccactaagcggtgaaa

SEQ ID NO: 86774 - DNA, 25 bp, E. coli
accgcatacgaaccattgttagaag

SEQ ID NO: 86775 - DNA, 25 bp, E. coli
taccagcagaactgaaatacagcaa

SEQ ID NO: 86776 - DNA, 25 bp, E. coli
taggcgatatggagtttgttgacct

SEQ ID NO: 86777 - DNA, 25 bp, E. coli
taggcgatatggtgtttgttgacct

SEQ ID NO: 86778 - DNA, 25 bp, E. coli
taccagcagaacagaaatacagcaa

SEQ ID NO: 86779 - DNA, 25 bp, E. coli
gaagccgacggctcttacaccgttg

SEQ ID NO: 86780 - DNA, 25 bp, E. coli
gaagccgacggcacttacaccgttg

SEQ ID NO: 86781 - DNA, 25 bp, E. coli
gaaagcgaactgcaatcactgctgg

SEQ ID NO: 86782 - DNA, 25 bp, E. coli
gaaatacagcaaagaacacgaatgg

SEQ ID NO: 86783 - DNA, 25 bp, E. coli
gaaagcgaactggaatcactgctgg

SEQ ID NO: 86784 - DNA, 25 bp, E. coli
gaaatacagcaatgaacacgaatgg

SEQ ID NO: 86785 - DNA, 25 bp, E. coli
cgaagcattgttagaagacgagtaa

SEQ ID NO: 86786 - DNA, 25 bp, E. coli
cgaagcattgtttgaagacgagtaa

SEQ ID NO: 86787 - DNA, 25 bp, E. coli
ctcaggagctgttaggcgatatggt

SEQ ID NO: 86788 - DNA, 25 bp, E. coli
ctcaggagctgtaaggcgatatggt

SEQ ID NO: 86789 - DNA, 25 bp, E. coli
tcaaagccagcgatgaaagcgaact

SEQ ID NO: 86790 - DNA, 25 bp, E. coli
tcaaagccagcgttgaaagcgaact

SEQ ID NO: 86791 - DNA, 25 bp, E. coli
taagcggtgaaatcgtggcggtaaa

SEQ ID NO: 86792 - DNA, 25 bp, E. coli
taagcggtgaaaacgtggcggtaaa

SEQ ID NO: 86793 - DNA, 25 bp, E. coli
caacccaattatgggcgtgaagttt

SEQ ID NO: 86794 - DNA, 25 bp, E. coli
caacccaattatcggcgtgaagttt

SEQ ID NO: 86795 - DNA, 25 bp, E. coli
taacaccactggaggactgacctat

SEQ ID NO: 86796 - DNA, 25 bp, E. coli
aattatgggcgtgaagttttgggat

SEQ ID NO: 86797 - DNA, 25 bp, E. coli
aattatgggcgtcaagttttgggat

SEQ ID NO: 86798 - DNA, 25 bp, E. coli
aaaagccgcggcttttatgaagccc

SEQ ID NO: 86799 - DNA, 25 bp, E. coli
aaaagccgcggcatttatgaagccc

SEQ ID NO: 86800 - DNA, 25 bp, E. coli
cactggtggactgacctatttcaac

SEQ ID NO: 86801 - DNA, 25 bp, E. coli
cactggtggactcacctatttcaac

SEQ ID NO: 86802 - DNA, 25 bp, E. coli
tatgaagcccctgggatggcactgc

SEQ ID NO: 86803 - DNA, 25 bp, E. coli
tatgaagcccctcggatggcactgc

SEQ ID NO: 86804 - DNA, 25 bp, E. coli
tgaagcccctgggatggcactgctg

SEQ ID NO: 86805 - DNA, 25 bp, E. coli
tgaagcccctggcatggcactgctg

SEQ ID NO: 86806 - DNA, 25 bp, E. coli
tcgaagcaaaaagccgcggcattta

SEQ ID NO: 86807 - DNA, 25 bp, E. coli
tcgaagcaaaaacccgcggcattta

SEQ ID NO: 86808 - DNA, 25 bp, E. coli
tcatcgaagcaataagccgcggcat

SEQ ID NO: 86809 - DNA, 25 bp, E. coli
tcatcgaagcaaaaagccgcggcat

SEQ ID NO: 86810 - DNA, 25 bp, E. coli
gccgcggcatttatgaagcccctgg

SEQ ID NO: 86811 - DNA, 25 bp, E. coli
gccgcggcatttttgaagcccctgg

SEQ ID NO: 86812 - DNA, 25 bp, E. coli
cggcatttatgatgcccctgggatg

SEQ ID NO: 86813 - DNA, 25 bp, E. coli
cggcatttatgaagcccctgggatg

SEQ ID NO: 86814 - DNA, 25 bp, E. coli
taacaccactggtggactgacctat

SEQ ID NO: 86815 - DNA, 25 bp, E. coli
tacacttctccggtatccagggtaa

SEQ ID NO: 86816 - DNA, 25 bp, E. coli
tacacttctccgctatccagggtaa

SEQ ID NO: 86817 - DNA, 25 bp, E. coli
ttcaacgagtcttaaggttttggct

SEQ ID NO: 86818 - DNA, 25 bp, E. coli
ttcaacgagtctaaaggttttggct

SEQ ID NO: 86819 - DNA, 25 bp, E. coli
tcaggttaagtgcttcaacgagtct

SEQ ID NO: 86820 - DNA, 25 bp, E. coli
tcaggttaagtggttcaacgagtct

SEQ ID NO: 86821 - DNA, 25 bp, E. coli
tctaaaggttttcgcttcattactc

SEQ ID NO: 86822 - DNA, 25 bp, E. coli
tctaaaggttttggcttcattactc

SEQ ID NO: 86823 - DNA, 25 bp, E. coli
gaaaggtccggcagctgttaacgta

SEQ ID NO: 86824 - DNA, 25 bp, E. coli
gtcagaacgttgtgttcgaaattca

SEQ ID NO: 86825 - DNA, 25 bp, E. coli
gaaaggtccggctgctgttaacgta

SEQ ID NO: 86826 - DNA, 25 bp, E. coli
gtcagaacgttgagttcgaaattca

SEQ ID NO: 86827 - DNA, 25 bp, E. coli
ccgctatccagggtaatggcttcaa

SEQ ID NO: 86828 - DNA, 25 bp, E. coli
ccgctatccaggctaatggcttcaa

SEQ ID NO: 86829 - DNA, 25 bp, E. coli
ctctggctgaagctcagaacgttga

SEQ ID NO: 86830 - DNA, 25 bp, E. coli
ctctggctgaaggtcagaacgttga

SEQ ID NO: 86831 - DNA, 25 bp, E. coli
ggtaatggcttctaaactctggctg

SEQ ID NO: 86832 - DNA, 25 bp, E. coli
ggtaatggcttcaaaactctggctg

SEQ ID NO: 86833 - DNA, 25 bp, E. coli
ggtccggcagctcttaacgtaacag

SEQ ID NO: 86834 - DNA, 25 bp, E. coli
ggtccggcagctgttaacgtaacag

SEQ ID NO: 86835 - DNA, 25 bp, E. coli
tggcaaagattaaaggtcaggttaa

SEQ ID NO: 86836 - DNA, 25 bp, E. coli
tggcaaagattataggtcaggttaa

SEQ ID NO: 86837 - DNA, 25 bp, E. coli
atttagcggcaaacatcaacaccag

SEQ ID NO: 86838 - DNA, 25 bp, E. coli
accgttggcgaacctcaatcgcgcg

SEQ ID NO: 86839 - DNA, 25 bp, E. coli
accgttggcgaagctcaatcgcgcg

SEQ ID NO: 86840 - DNA, 25 bp, E. coli
atttagcggcaatcatcaacaccag

SEQ ID NO: 86841 - DNA, 25 bp, E. coli
aacgcttctgtctgcgggtgatggt

SEQ ID NO: 86842 - DNA, 25 bp, E. coli
aacgcttctgtcagcgggtgatggt

SEQ ID NO: 86843 - DNA, 25 bp, E. coli
tgctggtagggttagagtcgccctc

SEQ ID NO: 86844 - DNA, 25 bp, E. coli
tgctggtagggtaagagtcgccctc

SEQ ID NO: 86845 - DNA, 25 bp, E. coli
gccgtgatattctaatggtgtttca

SEQ ID NO: 86846 - DNA, 25 bp, E. coli
cctcgcgcggctgctggtagggtta

SEQ ID NO: 86847 - DNA, 25 bp, E. coli
cctcgcgcggctcctggtagggtta

SEQ ID NO: 86848 - DNA, 25 bp, E. coli
gccgtgatattcaaatggtgtttca

SEQ ID NO: 86849 - DNA, 25 bp, E. coli
gcgaagctcaatggcgcgcaacgta

SEQ ID NO: 86850 - DNA, 25 bp, E. coli
gcgaagctcaatcgcgcgcaacgta

SEQ ID NO: 86851 - DNA, 25 bp, E. coli
cggcgaaccgttcgcgaagctcaat

SEQ ID NO: 86852 - DNA, 25 bp, E. coli
cggcgaaccgttggcgaagctcaat

SEQ ID NO: 86853 - DNA, 25 bp, E. coli
gttccgccgtgaaattcaaatggtg

SEQ ID NO: 86854 - DNA, 25 bp, E. coli
gttccgccgtgatattcaaatggtg

SEQ ID NO: 86855 - DNA, 25 bp, E. coli
tggaacgcttctctcagcgggtgat

SEQ ID NO: 86856 - DNA, 25 bp, E. coli
tggatttagcgggaaacatcaacac

SEQ ID NO: 86857 - DNA, 25 bp, E. coli
tggatttagcggcaaacatcaacac

SEQ ID NO: 86858 - DNA, 25 bp, E. coli
tggaacgcttctgtcagcgggtgat

SEQ ID NO: 86859 - DNA, 25 bp, E. coli
aggagcactgttctacgggctgatc

SEQ ID NO: 86860 - DNA, 25 bp, E. coli
aggagcactgttgtacgggctgatc

SEQ ID NO: 86861 - DNA, 25 bp, E. coli
acggcggcgagcgaggagcactgtt

SEQ ID NO: 86862 - DNA, 25 bp, E. coli
acggcggcgagccaggagcactgtt

SEQ ID NO: 86863 - DNA, 25 bp, E. coli
ttcttcggcagcgatcacggcggcg

SEQ ID NO: 86864 - DNA, 25 bp, E. coli
ttccaaccgagtagacgaactcctg

SEQ ID NO: 86865 - DNA, 25 bp, E. coli
ttccaaccgagttgacgaactcctg

SEQ ID NO: 86866 - DNA, 25 bp, E. coli
ttcttcggcagccatcacggcggcg

SEQ ID NO: 86867 - DNA, 25 bp, E. coli
tcggcacctgcccactgaacgatat

SEQ ID NO: 86868 - DNA, 25 bp, E. coli
tcggcacctgccgactgaacgatat

SEQ ID NO: 86869 - DNA, 25 bp, E. coli
gcgagcgaggaggactgttgtacgg

SEQ ID NO: 86870 - DNA, 25 bp, E. coli
gcgagcgaggagcactgttgtacgg

SEQ ID NO: 86871 - DNA, 25 bp, E. coli
gcggcgagcgaggagcactgttgta

SEQ ID NO: 86872 - DNA, 25 bp, E. coli
gcggcgagcgagcagcactgttgta

SEQ ID NO: 86873 - DNA, 25 bp, E. coli
cggcgagcgaggagcactgttgtac

SEQ ID NO: 86874 - DNA, 25 bp, E. coli
cggcgagcgaggtgcactgttgtac

SEQ ID NO: 86875 - DNA, 25 bp, E. coli
ggcggcgagcgacgagcactgttgt

SEQ ID NO: 86876 - DNA, 25 bp, E. coli
ggcggcgagcgaggagcactgttgt

SEQ ID NO: 86877 - DNA, 25 bp, E. coli
ggaatggccttcgaaccgagttgac

SEQ ID NO: 86878 - DNA, 25 bp, E. coli
ggaatggccttccaaccgagttgac

SEQ ID NO: 86879 - DNA, 25 bp, E. coli
gagcgaggagcactgttgtacgggc

SEQ ID NO: 86880 - DNA, 25 bp, E. coli
gagcgaggagcagtgttgtacgggc

SEQ ID NO: 86881 - DNA, 25 bp, E. coli
aatcgattctacatgccggttccag

SEQ ID NO: 86882 - DNA, 25 bp, E. coli
caaaatgtgagcaggagtggtcctc

SEQ ID NO: 86883 - DNA, 25 bp, E. coli
caaaatgtgagctggagtggtcctc

SEQ ID NO: 86884 - DNA, 25 bp, E. coli
tactacagaagctatggctgccggg

SEQ ID NO: 86885 - DNA, 25 bp, E. coli
tactgccgctggcttgcacagatga

SEQ ID NO: 86886 - DNA, 25 bp, E. coli
tactacagaagcaatggctgccggg

SEQ ID NO: 86887 - DNA, 25 bp, E. coli
tactgccgctgggttgcacagatga

SEQ ID NO: 86888 - DNA, 25 bp, E. coli
tactacggttactacggtgattcgc

SEQ ID NO: 86889 - DNA, 25 bp, E. coli
tactacggttacaacggtgattcgc

SEQ ID NO: 86890 - DNA, 25 bp, E. coli
aatcgattctacttgccggttccag

SEQ ID NO: 86891 - DNA, 25 bp, E. coli
taatgatgccatccgcagtgtacgt

SEQ ID NO: 86892 - DNA, 25 bp, E. coli
gaatgactctgatgcctctccaggg

SEQ ID NO: 86893 - DNA, 25 bp, E. coli
gaatgactctgaagcctctccaggg

SEQ ID NO: 86894 - DNA, 25 bp, E. coli
gaatgaaacaggtggttactgccgc

SEQ ID NO: 86895 - DNA, 25 bp, E. coli
gaatgaaacaggaggttactgccgc

SEQ ID NO: 86896 - DNA, 25 bp, E. coli
gataccagcagtatgcagccaatcg

SEQ ID NO: 86897 - DNA, 25 bp, E. coli
gataccagcagtttgcagccaatcg

SEQ ID NO: 86898 - DNA, 25 bp, E. coli
ggaagtctcggtcacgccaaatcga

SEQ ID NO: 86899 - DNA, 25 bp, E. coli
ggaagtctcggtgacgccaaatcga

SEQ ID NO: 86900 - DNA, 25 bp, E. coli
taatgatgccatgcgcagtgtacgt

SEQ ID NO: 86901 - DNA, 25 bp, E. coli
gatgataactttaaccgcgtcggga

SEQ ID NO: 86902 - DNA, 25 bp, E. coli
gatgataacttttaccgcgtcggga

SEQ ID NO: 86903 - DNA, 25 bp, E. coli
atcgcgccggatgcggatgtgccag

SEQ ID NO: 86904 - DNA, 25 bp, E. coli
atcgcgccggatccggatgtgccag

SEQ ID NO: 86905 - DNA, 25 bp, E. coli
accgtagagcctggtctgtatatcg

SEQ ID NO: 86906 - DNA, 25 bp, E. coli
acgcaggcgatatcacccgtacctt

SEQ ID NO: 86907 - DNA, 25 bp, E. coli
acgcaggcgataacacccgtacctt

SEQ ID NO: 86908 - DNA, 25 bp, E. coli
accgtagagcctcgtctgtatatcg

SEQ ID NO: 86909 - DNA, 25 bp, E. coli
tagagcctggtcagtatatcgcgcc

SEQ ID NO: 86910 - DNA, 25 bp, E. coli
tagagcctggtctgtatatcgcgcc

SEQ ID NO: 86911 - DNA, 25 bp, E. coli
tgttgattgacggaggctgcgaata

SEQ ID NO: 86912 - DNA, 25 bp, E. coli
tgttgattgacgcaggctgcgaata

SEQ ID NO: 86913 - DNA, 25 bp, E. coli
gcctggtctgtatatcgcgccggat

SEQ ID NO: 86914 - DNA, 25 bp, E. coli
gcctggtctgtaaatcgcgccggat

SEQ ID NO: 86915 - DNA, 25 bp, E. coli
cgcaggctgcgaatacaaaggttac

SEQ ID NO: 86916 - DNA, 25 bp, E. coli
cgcaggctgcgattacaaaggttac

SEQ ID NO: 86917 - DNA, 25 bp, E. coli
ctggtctgtataacgcgccggatgc

SEQ ID NO: 86918 - DNA, 25 bp, E. coli
ctggtctgtatatcgcgccggatgc

SEQ ID NO: 86919 - DNA, 25 bp, E. coli
ggttacgcaggccatatcacccgta

SEQ ID NO: 86920 - DNA, 25 bp, E. coli
ggttacgcaggcgatatcacccgta

SEQ ID NO: 86921 - DNA, 25 bp, E. coli
gagcctggtctgtatatcgcgccgg

SEQ ID NO: 86922 - DNA, 25 bp, E. coli
gacgcaggctgccaatacaaaggtt

SEQ ID NO: 86923 - DNA, 25 bp, E. coli
gagcctggtctgaatatcgcgccgg

SEQ ID NO: 86924 - DNA, 25 bp, E. coli
gacgcaggctgcgaatacaaaggtt

SEQ ID NO: 86925 - DNA, 25 bp, E. coli
cactggatacgcagaacgaactggc

SEQ ID NO: 86926 - DNA, 25 bp, E. coli
cactggtaaatgagaaacgccgggc

SEQ ID NO: 86927 - DNA, 25 bp, E. coli
cactggatacgctgaacgaactggc

SEQ ID NO: 86928 - DNA, 25 bp, E. coli
cactggtaaatgtgaaacgccgggc

SEQ ID NO: 86929 - DNA, 25 bp, E. coli
taaacaaccgctggacaatacgctg

SEQ ID NO: 86930 - DNA, 25 bp, E. coli
taaacaaccgctcgacaatacgctg

SEQ ID NO: 86931 - DNA, 25 bp, E. coli
tattggcgcggccaaacttgccagc

SEQ ID NO: 86932 - DNA, 25 bp, E. coli
tataccctgctgacggatattggcg

SEQ ID NO: 86933 - DNA, 25 bp, E. coli
tattggcgcggcgaaacttgccagc

SEQ ID NO: 86934 - DNA, 25 bp, E. coli
tataccctgctgtcggatattggcg

SEQ ID NO: 86935 - DNA, 25 bp, E. coli
ccttattaatggagcgccagccacg

SEQ ID NO: 86936 - DNA, 25 bp, E. coli
ccttattaatggtgcgccagccacg

SEQ ID NO: 86937 - DNA, 25 bp, E. coli
gaatgacccgaagtttgccacgaca

SEQ ID NO: 86938 - DNA, 25 bp, E. coli
gaatgacccgaactttgccacgaca

SEQ ID NO: 86939 - DNA, 25 bp, E. coli
gaatatgctctaaatcgacccgcag

SEQ ID NO: 86940 - DNA, 25 bp, E. coli
gaatatgctctatatcgacccgcag

SEQ ID NO: 86941 - DNA, 25 bp, E. coli
gaaaatcgatcctgccatagtactg

SEQ ID NO: 86942 - DNA, 25 bp, E. coli
gaaaatcgatccagccatagtactg

SEQ ID NO: 86943 - DNA, 25 bp, E. coli
ggcgcagtcggtcaacaatacacag

SEQ ID NO: 86944 - DNA, 25 bp, E. coli
ggcgcagtcggtgaacaatacacag

SEQ ID NO: 86945 - DNA, 25 bp, E. coli
gaccactgcgtttgtacaggcggca

SEQ ID NO: 86946 - DNA, 25 bp, E. coli
gaccactgcgttagtacaggcggca

SEQ ID NO: 86947 - DNA, 25 bp, E. coli
catttcagcatcaggccttttaacg

SEQ ID NO: 86948 - DNA, 25 bp, E. coli
catttcagcatctggccttttaacg

SEQ ID NO: 86949 - DNA, 25 bp, E. coli
ccttttaacgcctgcctttctggca

SEQ ID NO: 86950 - DNA, 25 bp, E. coli
ccttttaacgccagcctttctggca

SEQ ID NO: 86951 - DNA, 25 bp, E. coli
agcccgcagtatcgatcgtcaccga

SEQ ID NO: 86952 - DNA, 25 bp, E. coli
agcccgcagtatggatcgtcaccga

SEQ ID NO: 86953 - DNA, 25 bp, E. coli
tttctggcactctatgccgcacctt

SEQ ID NO: 86954 - DNA, 25 bp, E. coli
tttctggcactcaatgccgcacctt

SEQ ID NO: 86955 - DNA, 25 bp, E. coli
tctggcgtcgaatagctattcctta

SEQ ID NO: 86956 - DNA, 25 bp, E. coli
tctggcgtcgaaaagctattcctta

SEQ ID NO: 86957 - DNA, 25 bp, E. coli
gcctgcattatttctggcgtcgaat

SEQ ID NO: 86958 - DNA, 25 bp, E. coli
gccgcacctttcctttgcattttgt

SEQ ID NO: 86959 - DNA, 25 bp, E. coli
gcctgcattattactggcgtcgaat

SEQ ID NO: 86960 - DNA, 25 bp, E. coli
gccgcacctttcgtttgcattttgt

SEQ ID NO: 86961 - DNA, 25 bp, E. coli
gcattttgtcgttacgcctgcatta

SEQ ID NO: 86962 - DNA, 25 bp, E. coli
gcattttgtcgtaacgcctgcatta

SEQ ID NO: 86963 - DNA, 25 bp, E. coli
gctattccttaagcaggagcttgtc

SEQ ID NO: 86964 - DNA, 25 bp, E. coli
gctattccttaaccaggagcttgtc

SEQ ID NO: 86965 - DNA, 25 bp, E. coli
gtcaccgacgtcatttcagcatcag

SEQ ID NO: 86966 - DNA, 25 bp, E. coli
gtcaccgacgtcttttcagcatcag

SEQ ID NO: 86967 - DNA, 25 bp, E. coli
gagtatagggcagtagcccgcagta

SEQ ID NO: 86968 - DNA, 25 bp, E. coli
gagtatagggcactagcccgcagta

SEQ ID NO: 86969 - DNA, 25 bp, E. coli
tacggatggcgtcagcaaagtgctt

SEQ ID NO: 86970 - DNA, 25 bp, E. coli
tacggatggcgtgagcaaagtgctt

SEQ ID NO: 86971 - DNA, 25 bp, E. coli
atgaacattgttgagcgcacccgtg

SEQ ID NO: 86972 - DNA, 25 bp, E. coli
atgaacattgttcagcgcacccgtg

SEQ ID NO: 86973 - DNA, 25 bp, E. coli
tgcgaaatatgacgactggctggat

SEQ ID NO: 86974 - DNA, 25 bp, E. coli
tgcgaaatatgaggactggctggat

SEQ ID NO: 86975 - DNA, 25 bp, E. coli
tgacgatgtcgcgatgaagatcccg

SEQ ID NO: 86976 - DNA, 25 bp, E. coli
tgacaccgcggcgtttagcgcaaag

SEQ ID NO: 86977 - DNA, 25 bp, E. coli
tgaaatcaccctgggcagcggtctg

SEQ ID NO: 86978 - DNA, 25 bp, E. coli
tgaaatcaccctcggcagcggtctg

SEQ ID NO: 86979 - DNA, 25 bp, E. coli
tgacaccgcggcctttagcgcaaag

SEQ ID NO: 86980 - DNA, 25 bp, E. coli
tgacgatgtcgccatgaagatcccg

SEQ ID NO: 86981 - DNA, 25 bp, E. coli
tctttatggtatagcgatgccgcca

SEQ ID NO: 86982 - DNA, 25 bp, E. coli
tctgcttaaagaggatgacaccgcg

SEQ ID NO: 86983 - DNA, 25 bp, E. coli
tctttatggtattgcgatgccgcca

SEQ ID NO: 86984 - DNA, 25 bp, E. coli
tctgcttaaagacgatgacaccgcg

SEQ ID NO: 86985 - DNA, 25 bp, E. coli
gaaagctattttgtcggacccgacg

SEQ ID NO: 86986 - DNA, 25 bp, E. coli
gaaattaccactctgcgtgccatag

SEQ ID NO: 86987 - DNA, 25 bp, E. coli
gaaattaccactgtgcgtgccatag

SEQ ID NO: 86988 - DNA, 25 bp, E. coli
gaaagctattttctcggacccgacg

SEQ ID NO: 86989 - DNA, 25 bp, E. coli
taagagcctgattgccgattatgcg

SEQ ID NO: 86990 - DNA, 25 bp, E. coli
taagagcctgatagccgattatgcg

SEQ ID NO: 86991 - DNA, 25 bp, E. coli
cacgctatttgtaggagaacaaaca

SEQ ID NO: 86992 - DNA, 25 bp, E. coli
cacgctatttgttggagaacaaaca

SEQ ID NO: 86993 - DNA, 25 bp, E. coli
catctcgaacaattgattaacgtca

SEQ ID NO: 86994 - DNA, 25 bp, E. coli
catctcgaacaaatgattaacgtca

SEQ ID NO: 86995 - DNA, 25 bp, E. coli
cattttgtgaatccaatcgttttcc

SEQ ID NO: 86996 - DNA, 25 bp, E. coli
cattttgtgaatgcaatcgttttcc

SEQ ID NO: 86997 - DNA, 25 bp, E. coli
cattttttcacgctatttgttggag

SEQ ID NO: 86998 - DNA, 25 bp, E. coli
atatttcaagcaattaccggataat

SEQ ID NO: 86999 - DNA, 25 bp, E. coli
cattttttcacggtatttgttggag

SEQ ID NO: 87000 - DNA, 25 bp, E. coli
atatttcaagcatttaccggataat

SEQ ID NO: 87001 - DNA, 25 bp, E. coli
gcaattaccggaaaattaccaggca

SEQ ID NO: 87002 - DNA, 25 bp, E. coli
gcaattaccggataattaccaggca

SEQ ID NO: 87003 - DNA, 25 bp, E. coli
gattaacgtcaagtttttctcttct

SEQ ID NO: 87004 - DNA, 25 bp, E. coli
gattaacgtcaactttttctcttct

SEQ ID NO: 87005 - DNA, 25 bp, E. coli
gtattgatcatctcgaacaattgat

SEQ ID NO: 87006 - DNA, 25 bp, E. coli
gggataaccatattttatggcgata

SEQ ID NO: 87007 - DNA, 25 bp, E. coli
ggagaacaaacaattattttatcaa

SEQ ID NO: 87008 - DNA, 25 bp, E. coli
gtattgatcatcacgaacaattgat

SEQ ID NO: 87009 - DNA, 25 bp, E. coli
ggataattaccaggcaaaatttgag

SEQ ID NO: 87010 - DNA, 25 bp, E. coli
ggagaacaaacatttattttatcaa

SEQ ID NO: 87011 - DNA, 25 bp, E. coli
ggataattaccacgcaaaatttgag

SEQ ID NO: 87012 - DNA, 25 bp, E. coli
gggataaccataatttatggcgata

SEQ ID NO: 87013 - DNA, 25 bp, E. coli
taaaactgccaatggctgcgaagcg

SEQ ID NO: 87014 - DNA, 25 bp, E. coli
taaaactgccaaaggctgcgaagcg

SEQ ID NO: 87015 - DNA, 25 bp, E. coli
tatgcgtctgctggcgttcgatccg

SEQ ID NO: 87016 - DNA, 25 bp, E. coli
tatgcgtctgctcgcgttcgatccg

SEQ ID NO: 87017 - DNA, 25 bp, E. coli
tatgtatggcaaaacggcaggcgtt

SEQ ID NO: 87018 - DNA, 25 bp, E. coli
tatgtatggcaatacggcaggcgtt

SEQ ID NO: 87019 - DNA, 25 bp, E. coli
tttctgctgacgcaaaaaaccgcta

SEQ ID NO: 87020 - DNA, 25 bp, E. coli
tttctgctgacggaaaaaaccgcta

SEQ ID NO: 87021 - DNA, 25 bp, E. coli
tttcgtaaacgaagacggcagccgc

SEQ ID NO: 87022 - DNA, 25 bp, E. coli
tttcgtaaacgatgacggcagccgc

SEQ ID NO: 87023 - DNA, 25 bp, E. coli
ttctctctggaacgtctgaccggct

SEQ ID NO: 87024 - DNA, 25 bp, E. coli
ttctctctggaaggtctgaccggct

SEQ ID NO: 87025 - DNA, 25 bp, E. coli
tgatgatcgtcattaccagtcgcgg

SEQ ID NO: 87026 - DNA, 25 bp, E. coli
tgatgatcgtcaataccagtcgcgg

SEQ ID NO: 87027 - DNA, 25 bp, E. coli
tccaacgacgtgttccaggatgacg

SEQ ID NO: 87028 - DNA, 25 bp, E. coli
tccaacgacgtgatccaggatgacg

SEQ ID NO: 87029 - DNA, 25 bp, E. coli
taacgtcgacctagacgcggcaaaa

SEQ ID NO: 87030 - DNA, 25 bp, E. coli
taacgtcgaccttgacgcggcaaaa

SEQ ID NO: 87031 - DNA, 25 bp, E. coli
gatccagaggccgttgctgaacacg

SEQ ID NO: 87032 - DNA, 25 bp, E. coli
gagtatgtcgatgtgccaaccctgt

SEQ ID NO: 87033 - DNA, 25 bp, E. coli
gagtatgtcgatctgccaaccctgt

SEQ ID NO: 87034 - DNA, 25 bp, E. coli
gatccagaggcccttgctgaacacg

SEQ ID NO: 87035 - DNA, 25 bp, E. coli
cagtattcaggaataaaaacattca

SEQ ID NO: 87036 - DNA, 25 bp, E. coli
cagtattcaggattaaaaacattca

SEQ ID NO: 87037 - DNA, 25 bp, E. coli
cttgttatgggaccagtattcagga

SEQ ID NO: 87038 - DNA, 25 bp, E. coli
cttgttatgggagcagtattcagga

SEQ ID NO: 87039 - DNA, 25 bp, E. coli
tatgggagcagtattcaggaataaa

SEQ ID NO: 87040 - DNA, 25 bp, E. coli
tatgggagcagttttcaggaataaa

SEQ ID NO: 87041 - DNA, 25 bp, E. coli
ttgttatgggagcagtattcaggaa

SEQ ID NO: 87042 - DNA, 25 bp, E. coli
ttgttatgggaggagtattcaggaa

SEQ ID NO: 87043 - DNA, 25 bp, E. coli
tgttatgggagcagtattcaggaat

SEQ ID NO: 87044 - DNA, 25 bp, E. coli
tgggagcagtatacaggaataaaaa

SEQ ID NO: 87045 - DNA, 25 bp, E. coli
tgttatgggagctgtattcaggaat

SEQ ID NO: 87046 - DNA, 25 bp, E. coli
tcttgttatgggagcagtattcagg

SEQ ID NO: 87047 - DNA, 25 bp, E. coli
tcttgttatgggtgcagtattcagg

SEQ ID NO: 87048 - DNA, 25 bp, E. coli
gcagtattcaggaataaaaacattc

SEQ ID NO: 87049 - DNA, 25 bp, E. coli
gcagtattcaggtataaaaacattc

SEQ ID NO: 87050 - DNA, 25 bp, E. coli
gttatgggagcagtattcaggaata

SEQ ID NO: 87051 - DNA, 25 bp, E. coli
gttatgggagcactattcaggaata

SEQ ID NO: 87052 - DNA, 25 bp, E. coli
gtcttgttatgggagcagtattcag

SEQ ID NO: 87053 - DNA, 25 bp, E. coli
gtcttgttatggcagcagtattcag

SEQ ID NO: 87054 - DNA, 25 bp, E. coli
ggagcagtattcaggaataaaaaca

SEQ ID NO: 87055 - DNA, 25 bp, E. coli
ggagcagtattctggaataaaaaca

SEQ ID NO: 87056 - DNA, 25 bp, E. coli
tgggagcagtattcaggaataaaaa

SEQ ID NO: 87057 - DNA, 25 bp, E. coli
aaccctggttgggtggataatcacg

SEQ ID NO: 87058 - DNA, 25 bp, E. coli
aataatcgactgacgccgctgcgtg

SEQ ID NO: 87059 - DNA, 25 bp, E. coli
aataatcgactgtcgccgctgcgtg

SEQ ID NO: 87060 - DNA, 25 bp, E. coli
caaaatcctggtgtcggtgtacgcg

SEQ ID NO: 87061 - DNA, 25 bp, E. coli
caaaatcctggtctcggtgtacgcg

SEQ ID NO: 87062 - DNA, 25 bp, E. coli
aaaatattgataacagggcctggcg

SEQ ID NO: 87063 - DNA, 25 bp, E. coli
aaaatattgatatcagggcctggcg

SEQ ID NO: 87064 - DNA, 25 bp, E. coli
aaccctggttggctggataatcacg

SEQ ID NO: 87065 - DNA, 25 bp, E. coli
tattgtcgccggctatcaggcccat

SEQ ID NO: 87066 - DNA, 25 bp, E. coli
tattgtcgccgggtatcaggcccat

SEQ ID NO: 87067 - DNA, 25 bp, E. coli
gcctggcgaccccataaactcaata

SEQ ID NO: 87068 - DNA, 25 bp, E. coli
gcctggcgacccgataaactcaata

SEQ ID NO: 87069 - DNA, 25 bp, E. coli
gaaaaaacgcgctgaggaatcgggc

SEQ ID NO: 87070 - DNA, 25 bp, E. coli
gaaaaaagtccgcatgatctcgccg

SEQ ID NO: 87071 - DNA, 25 bp, E. coli
gaaaaaagtccggatgatctcgccg

SEQ ID NO: 87072 - DNA, 25 bp, E. coli
gaaaaaacgcgcagaggaatcgggc

SEQ ID NO: 87073 - DNA, 25 bp, E. coli
gatagcgcgccacaaaacagagaaa

SEQ ID NO: 87074 - DNA, 25 bp, E. coli
gatagcgcgccagaaaacagagaaa

SEQ ID NO: 87075 - DNA, 25 bp, E. coli
gatatcctttatccggcacgtccgg

SEQ ID NO: 87076 - DNA, 25 bp, E. coli
gtttttcgctgggatacgcctggcc

SEQ ID NO: 87077 - DNA, 25 bp, E. coli
gatatcctttatgcggcacgtccgg

SEQ ID NO: 87078 - DNA, 25 bp, E. coli
gtttttcgctggcatacgcctggcc

SEQ ID NO: 87079 - DNA, 25 bp, E. coli
catcaggtggcggtggaaatcaata

SEQ ID NO: 87080 - DNA, 25 bp, E. coli
catcaggtggcgctggaaatcaata

SEQ ID NO: 87081 - DNA, 25 bp, E. coli
tactgaacttccttgaatctcgcgg

SEQ ID NO: 87082 - DNA, 25 bp, E. coli
tactgaacttccatgaatctcgcgg

SEQ ID NO: 87083 - DNA, 25 bp, E. coli
tgtcttaaaatcctcgacgcggtag

SEQ ID NO: 87084 - DNA, 25 bp, E. coli
tgtcttaaaatcgtcgacgcggtag

SEQ ID NO: 87085 - DNA, 25 bp, E. coli
tgaagcagccgcgaaacatcaggtg

SEQ ID NO: 87086 - DNA, 25 bp, E. coli
tgaagcagccgccaaacatcaggtg

SEQ ID NO: 87087 - DNA, 25 bp, E. coli
tcattaacatgcgtatctggccgcg

SEQ ID NO: 87088 - DNA, 25 bp, E. coli
tcattaacatgcctatctggccgcg

SEQ ID NO: 87089 - DNA, 25 bp, E. coli
gcaccgattgcgcaatttgcagacc

SEQ ID NO: 87090 - DNA, 25 bp, E. coli
gcaccgattgcggaatttgcagacc

SEQ ID NO: 87091 - DNA, 25 bp, E. coli
cgcggcatcgaagctaacattaaaa

SEQ ID NO: 87092 - DNA, 25 bp, E. coli
cgcggcatcgaacctaacattaaaa

SEQ ID NO: 87093 - DNA, 25 bp, E. coli
cattttgaatgtttctccgcgccgc

SEQ ID NO: 87094 - DNA, 25 bp, E. coli
cattttgaatgtatctccgcgccgc

SEQ ID NO: 87095 - DNA, 25 bp, E. coli
gattttccgccagagcgcattttga

SEQ ID NO: 87096 - DNA, 25 bp, E. coli
gattttccgccacagcgcattttga

SEQ ID NO: 87097 - DNA, 25 bp, E. coli
gtgcatataatatgccatcccggaa

SEQ ID NO: 87098 - DNA, 25 bp, E. coli
gtgcatataataagccatcccggaa

SEQ ID NO: 87099 - DNA, 25 bp, E. coli
tggcattaggctcggattctcacac

SEQ ID NO: 87100 - DNA, 25 bp, E. coli
tggcattaggctgggattctcacac

SEQ ID NO: 87101 - DNA, 25 bp, E. coli
aaccaggctgtggaggctttacgca

SEQ ID NO: 87102 - DNA, 25 bp, E. coli
aaccaggctgtgcaggctttacgca

SEQ ID NO: 87103 - DNA, 25 bp, E. coli
cagtatttgatgcattgttgcggta

SEQ ID NO: 87104 - DNA, 25 bp, E. coli
cagtatttgatggattgttgcggta

SEQ ID NO: 87105 - DNA, 25 bp, E. coli
agcaacgactggcatctctggcagg

SEQ ID NO: 87106 - DNA, 25 bp, E. coli
agcaacgactgggatctctggcagg

SEQ ID NO: 87107 - DNA, 25 bp, E. coli
tatcacttacaaccaggctgtgcag

SEQ ID NO: 87108 - DNA, 25 bp, E. coli
tatcacttacaagcaggctgtgcag

SEQ ID NO: 87109 - DNA, 25 bp, E. coli
tgcagcagttagatccgccacccgg

SEQ ID NO: 87110 - DNA, 25 bp, E. coli
tgcagcagttagttccgccacccgg

SEQ ID NO: 87111 - DNA, 25 bp, E. coli
tctggcaggcagaagtcgctatacg

SEQ ID NO: 87112 - DNA, 25 bp, E. coli
tctggcaggcagtagtcgctatacg

SEQ ID NO: 87113 - DNA, 25 bp, E. coli
gcagaagtcgctatacgtagcaaca

SEQ ID NO: 87114 - DNA, 25 bp, E. coli
gcagaagtcgctttacgtagcaaca

SEQ ID NO: 87115 - DNA, 25 bp, E. coli
gataagatggtggattacgaagtag

SEQ ID NO: 87116 - DNA, 25 bp, E. coli
gataagatggtgcattacgaagtag

SEQ ID NO: 87117 - DNA, 25 bp, E. coli
tgttgcggtatctcttacaaccagg

SEQ ID NO: 87118 - DNA, 25 bp, E. coli
ggctttacgcaggaacgactgggat

SEQ ID NO: 87119 - DNA, 25 bp, E. coli
ggctttacgcagcaacgactgggat

SEQ ID NO: 87120 - DNA, 25 bp, E. coli
tgttgcggtatcacttacaaccagg

SEQ ID NO: 87121 - DNA, 25 bp, E. coli
tacgaagtagttgagtatttgatgg

SEQ ID NO: 87122 - DNA, 25 bp, E. coli
tacgaagtagttcagtatttgatgg

SEQ ID NO: 87123 - DNA, 25 bp, E. coli
cacggtaaaatgatgccggacgact

SEQ ID NO: 87124 - DNA, 25 bp, E. coli
catctattttggtgccgtcggctgg

SEQ ID NO: 87125 - DNA, 25 bp, E. coli
catctattttggagccgtcggctgg

SEQ ID NO: 87126 - DNA, 25 bp, E. coli
cacggtaaaatgttgccggacgact

SEQ ID NO: 87127 - DNA, 25 bp, E. coli
aaacgatgcgtattgctgcgatccc

SEQ ID NO: 87128 - DNA, 25 bp, E. coli
aaacgatgcgtaatgctgcgatccc

SEQ ID NO: 87129 - DNA, 25 bp, E. coli
tagccatcagcaagccgtactggga

SEQ ID NO: 87130 - DNA, 25 bp, E. coli
tagccatcagcatgccgtactggga

SEQ ID NO: 87131 - DNA, 25 bp, E. coli
tgcgagtattactgccatcacggta

SEQ ID NO: 87132 - DNA, 25 bp, E. coli
tgcgagtattacagccatcacggta

SEQ ID NO: 87133 - DNA, 25 bp, E. coli
ccggacgactgggatgagcaactta

SEQ ID NO: 87134 - DNA, 25 bp, E. coli
gaagcaatggcccagaattacccgg

SEQ ID NO: 87135 - DNA, 25 bp, E. coli
gaagaagtgattgctcacgggccga

SEQ ID NO: 87136 - DNA, 25 bp, E. coli
gaagcaatggccgagaattacccgg

SEQ ID NO: 87137 - DNA, 25 bp, E. coli
gaagaagtgattcctcacgggccga

SEQ ID NO: 87138 - DNA, 25 bp, E. coli
ccggacgactggcatgagcaactta

SEQ ID NO: 87139 - DNA, 25 bp, E. coli
cgcgcgttttgtgatgcagccggaa

SEQ ID NO: 87140 - DNA, 25 bp, E. coli
cgcgcgttttgtcatgcagccggaa

SEQ ID NO: 87141 - DNA, 25 bp, E. coli
gatatcctttccgatcttggcccgg

SEQ ID NO: 87142 - DNA, 25 bp, E. coli
gatatcctttcccatcttggcccgg

SEQ ID NO: 87143 - DNA, 25 bp, E. coli
tggcgatgagcgtttccagcaagcg

SEQ ID NO: 87144 - DNA, 25 bp, E. coli
tggcgatgagcgattccagcaagcg

SEQ ID NO: 87145 - DNA, 25 bp, E. coli
aattgcccttatgaggatatcgatg

SEQ ID NO: 87146 - DNA, 25 bp, E. coli
aattgcccttatcaggatatcgatg

SEQ ID NO: 87147 - DNA, 25 bp, E. coli
cagtgaagcgttccgtggcgaaaaa

SEQ ID NO: 87148 - DNA, 25 bp, E. coli
cagtgaagcgttgcgtggcgaaaaa

SEQ ID NO: 87149 - DNA, 25 bp, E. coli
tgatgatgatcttgagccggtcgtt

SEQ ID NO: 87150 - DNA, 25 bp, E. coli
tgatgatgatctagagccggtcgtt

SEQ ID NO: 87151 - DNA, 25 bp, E. coli
tctcggttggaaaaatgatgaactg

SEQ ID NO: 87152 - DNA, 25 bp, E. coli
tctcggttggaataatgatgaactg

SEQ ID NO: 87153 - DNA, 25 bp, E. coli
gcaaaacttctaccagagtttcggt

SEQ ID NO: 87154 - DNA, 25 bp, E. coli
gcaaaacttctagcagagtttcggt

SEQ ID NO: 87155 - DNA, 25 bp, E. coli
gaattatcggttacccagctttatg

SEQ ID NO: 87156 - DNA, 25 bp, E. coli
gaattatcggtttcccagctttatg

SEQ ID NO: 87157 - DNA, 25 bp, E. coli
gagtttcggtttaatccctgtgacg

SEQ ID NO: 87158 - DNA, 25 bp, E. coli
gagtttcggttttatccctgtgacg

SEQ ID NO: 87159 - DNA, 25 bp, E. coli
cgcaggcgcatcagcaaaacttcta

SEQ ID NO: 87160 - DNA, 25 bp, E. coli
cgcaggcgcatctgcaaaacttcta

SEQ ID NO: 87161 - DNA, 25 bp, E. coli
cgcatcactggcgtgataagcctgt

SEQ ID NO: 87162 - DNA, 25 bp, E. coli
cgcatcactggcctgataagcctgt

SEQ ID NO: 87163 - DNA, 25 bp, E. coli
gatctgcatcacactgaattatcgg

SEQ ID NO: 87164 - DNA, 25 bp, E. coli
gatctgcatcactctgaattatcgg

SEQ ID NO: 87165 - DNA, 25 bp, E. coli
gggataatcgccatattctcggttg

SEQ ID NO: 87166 - DNA, 25 bp, E. coli
gggataatcgccttattctcggttg

SEQ ID NO: 87167 - DNA, 25 bp, E. coli
aaccagctgcgggagcagacatctg

SEQ ID NO: 87168 - DNA, 25 bp, E. coli
aaccagctgcggcagcagacatctg

SEQ ID NO: 87169 - DNA, 25 bp, E. coli
ttcactggatcatcttgctcaacag

SEQ ID NO: 87170 - DNA, 25 bp, E. coli
ttcactggatcaacttgctcaacag

SEQ ID NO: 87171 - DNA, 25 bp, E. coli
tgcgggagcagagatctgattcact

SEQ ID NO: 87172 - DNA, 25 bp, E. coli
tgcgggagcagacatctgattcact

SEQ ID NO: 87173 - DNA, 25 bp, E. coli
tctgattcactgcatcaacttgctc

SEQ ID NO: 87174 - DNA, 25 bp, E. coli
tctgattcactggatcaacttgctc

SEQ ID NO: 87175 - DNA, 25 bp, E. coli
ccagctgcgggaccagacatctgat

SEQ ID NO: 87176 - DNA, 25 bp, E. coli
ccagctgcgggagcagacatctgat

SEQ ID NO: 87177 - DNA, 25 bp, E. coli
gctgcgggagcagacatctgattca

SEQ ID NO: 87178 - DNA, 25 bp, E. coli
gctgcgggagcacacatctgattca

SEQ ID NO: 87179 - DNA, 25 bp, E. coli
gcagacatctgaatcactggatcaa

SEQ ID NO: 87180 - DNA, 25 bp, E. coli
gcagacatctgattcactggatcaa

SEQ ID NO: 87181 - DNA, 25 bp, E. coli
gacatctgattcactggatcaactt

SEQ ID NO: 87182 - DNA, 25 bp, E. coli
gacatctgattctctggatcaactt

SEQ ID NO: 87183 - DNA, 25 bp, E. coli
gattcactggatgaacttgctcaac

SEQ ID NO: 87184 - DNA, 25 bp, E. coli
gattcactggatcaacttgctcaac

SEQ ID NO: 87185 - DNA, 25 bp, E. coli
gggagcagacatctgattcactgga

SEQ ID NO: 87186 - DNA, 25 bp, E. coli
gggagcagacatgtgattcactgga

SEQ ID NO: 87187 - DNA, 25 bp, E. coli
gagcagacatctcattcactggatc

SEQ ID NO: 87188 - DNA, 25 bp, E. coli
gagcagacatctgattcactggatc

SEQ ID NO: 87189 - DNA, 25 bp, E. coli
agattcttaattatgcgcgcccttg

SEQ ID NO: 87190 - DNA, 25 bp, E. coli
agattcttaattttgcgcgcccttg

SEQ ID NO: 87191 - DNA, 25 bp, E. coli
aaagggcgcagattcttaattttgc

SEQ ID NO: 87192 - DNA, 25 bp, E. coli
aaagggcgcagaatcttaattttgc

SEQ ID NO: 87193 - DNA, 25 bp, E. coli
tttgaaagggcgcagattcttaatt

SEQ ID NO: 87194 - DNA, 25 bp, E. coli
tttgaaagggcggagattcttaatt

SEQ ID NO: 87195 - DNA, 25 bp, E. coli
tgcgcgcccttgattgtcattcagg

SEQ ID NO: 87196 - DNA, 25 bp, E. coli
tgcgctacgcctctcgggctttgaa

SEQ ID NO: 87197 - DNA, 25 bp, E. coli
tgcgcgcccttgtttgtcattcagg

SEQ ID NO: 87198 - DNA, 25 bp, E. coli
tgcgctacgcctgtcgggctttgaa

SEQ ID NO: 87199 - DNA, 25 bp, E. coli
gcagattcttaaatttgcgcgccct

SEQ ID NO: 87200 - DNA, 25 bp, E. coli
gcagattcttaattttgcgcgccct

SEQ ID NO: 87201 - DNA, 25 bp, E. coli
gcgctacgcctgtcgggctttgaaa

SEQ ID NO: 87202 - DNA, 25 bp, E. coli
gcgctacgcctgacgggctttgaaa

SEQ ID NO: 87203 - DNA, 25 bp, E. coli
cgggctttgaaagggcgcagattct

SEQ ID NO: 87204 - DNA, 25 bp, E. coli
cgggctttgaaacggcgcagattct

SEQ ID NO: 87205 - DNA, 25 bp, E. coli
gattcttaatttagcgcgcccttgt

SEQ ID NO: 87206 - DNA, 25 bp, E. coli
gattcttaattttgcgcgcccttgt

SEQ ID NO: 87207 - DNA, 25 bp, E. coli
tggcagacgctatatcgcctgatgc

SEQ ID NO: 87208 - DNA, 25 bp, E. coli
ggcagacgctaattcgcctgatgcg

SEQ ID NO: 87209 - DNA, 25 bp, E. coli
tggcagacgctaaatcgcctgatgc

SEQ ID NO: 87210 - DNA, 25 bp, E. coli
ggcagacgctaaatcgcctgatgcg

SEQ ID NO: 87211 - DNA, 25 bp, E. coli
aatcccttccgaccagtctgatgcg

SEQ ID NO: 87212 - DNA, 25 bp, E. coli
aatcccttccgagcagtctgatgcg

SEQ ID NO: 87213 - DNA, 25 bp, E. coli
caccactgctgagacttacttgtgc

SEQ ID NO: 87214 - DNA, 25 bp, E. coli
caccactgctgacacttacttgtgc

SEQ ID NO: 87215 - DNA, 25 bp, E. coli
tacaaatgacaataagcgtagcagc

SEQ ID NO: 87216 - DNA, 25 bp, E. coli
tacaaatgacaaaaagcgtagcagc

SEQ ID NO: 87217 - DNA, 25 bp, E. coli
tagcagcagacgtgcacggcataat

SEQ ID NO: 87218 - DNA, 25 bp, E. coli
tagcagcagacgagcacggcataat

SEQ ID NO: 87219 - DNA, 25 bp, E. coli
ttatgaaaaatgagacgcagatccc

SEQ ID NO: 87220 - DNA, 25 bp, E. coli
ttatgaaaaatgtgacgcagatccc

SEQ ID NO: 87221 - DNA, 25 bp, E. coli
tgtaaagattcctaatgattccagt

SEQ ID NO: 87222 - DNA, 25 bp, E. coli
tgtaaagattccaaatgattccagt

SEQ ID NO: 87223 - DNA, 25 bp, E. coli
tgcacggcataaagtaaagattcca

SEQ ID NO: 87224 - DNA, 25 bp, E. coli
tgcacggcataatgtaaagattcca

SEQ ID NO: 87225 - DNA, 25 bp, E. coli
tagtggcactcagaatcccttccga

SEQ ID NO: 87226 - DNA, 25 bp, E. coli
ccaaatgattcctgtaatggattgt

SEQ ID NO: 87227 - DNA, 25 bp, E. coli
ccaaatgattccagtaatggattgt

SEQ ID NO: 87228 - DNA, 25 bp, E. coli
gacacttacttgtgctacaaatgac

SEQ ID NO: 87229 - DNA, 25 bp, E. coli
gacacttacttgagctacaaatgac

SEQ ID NO: 87230 - DNA, 25 bp, E. coli
tagtggcactcacaatcccttccga

SEQ ID NO: 87231 - DNA, 25 bp, E. coli
gacgcagatcccatgtagtggcact

SEQ ID NO: 87232 - DNA, 25 bp, E. coli
gacgcagatcccttgtagtggcact

SEQ ID NO: 87233 - DNA, 25 bp, E. coli
caacgtgctggcttttggttcacga

SEQ ID NO: 87234 - DNA, 25 bp, E. coli
caagtttgccggtattcgcgcggtc

SEQ ID NO: 87235 - DNA, 25 bp, E. coli
caagtttgccggaattcgcgcggtc

SEQ ID NO: 87236 - DNA, 25 bp, E. coli
cacatttagttgagcgtggcgttga

SEQ ID NO: 87237 - DNA, 25 bp, E. coli
cacatttagttgtgcgtggcgttga

SEQ ID NO: 87238 - DNA, 25 bp, E. coli
caacgtgctggcatttggttcacga

SEQ ID NO: 87239 - DNA, 25 bp, E. coli
taaaggaacctgctcgtcagagcgt

SEQ ID NO: 87240 - DNA, 25 bp, E. coli
taaaggaacctggtcgtcagagcgt

SEQ ID NO: 87241 - DNA, 25 bp, E. coli
tacgaaggcggtcgtcatcaacaac

SEQ ID NO: 87242 - DNA, 25 bp, E. coli
tacgaaggcggtggtcatcaacaac

SEQ ID NO: 87243 - DNA, 25 bp, E. coli
ttcgatagcggccaacaagtttgcc

SEQ ID NO: 87244 - DNA, 25 bp, E. coli
ttcgatagcggcgaacaagtttgcc

SEQ ID NO: 87245 - DNA, 25 bp, E. coli
tgtagcgaaccttattccgcgcaac

SEQ ID NO: 87246 - DNA, 25 bp, E. coli
tgtagcgaacctaattccgcgcaac

SEQ ID NO: 87247 - DNA, 25 bp, E. coli
tgcatttggctgtgatcatgtcggt

SEQ ID NO: 87248 - DNA, 25 bp, E. coli
tgcatttggctgagatcatgtcggt

SEQ ID NO: 87249 - DNA, 25 bp, E. coli
cattacgccagtcaagtcgcactgg

SEQ ID NO: 87250 - DNA, 25 bp, E. coli
cattacgccagtgaagtcgcactgg

SEQ ID NO: 87251 - DNA, 25 bp, E. coli
tcaacaacgcgtcgaggcgattacg

SEQ ID NO: 87252 - DNA, 25 bp, E. coli
tcaacaacgcgtggaggcgattacg

SEQ ID NO: 87253 - DNA, 25 bp, E. coli
gagtggttggccacgaactggcaaa

SEQ ID NO: 87254 - DNA, 25 bp, E. coli
gagtggttggcctcgaactggcaaa

SEQ ID NO: 87255 - DNA, 25 bp, E. coli
cacagcgggaaacgtggctcgtctt

SEQ ID NO: 87256 - DNA, 25 bp, E. coli
cacagcgggaaaggtggctcgtctt

SEQ ID NO: 87257 - DNA, 25 bp, E. coli
tatatccactttgccgactggctgg

SEQ ID NO: 87258 - DNA, 25 bp, E. coli
tatatccactttcccgactggctgg

SEQ ID NO: 87259 - DNA, 25 bp, E. coli
tgacctatgaagtgcgcggcagtga

SEQ ID NO: 87260 - DNA, 25 bp, E. coli
tgacctatgaagagcgcggcagtga

SEQ ID NO: 87261 - DNA, 25 bp, E. coli
tcgtcttcccgcaggagcgttctgg

SEQ ID NO: 87262 - DNA, 25 bp, E. coli
tgccgttctgcatggttacgaaaag

SEQ ID NO: 87263 - DNA, 25 bp, E. coli
tcgtcttcccgctggagcgttctgg

SEQ ID NO: 87264 - DNA, 25 bp, E. coli
tgccgttctgcaaggttacgaaaag

SEQ ID NO: 87265 - DNA, 25 bp, E. coli
gaagaaaaaactgcggacggagcgt

SEQ ID NO: 87266 - DNA, 25 bp, E. coli
gaagaaaaaactccggacggagcgt

SEQ ID NO: 87267 - DNA, 25 bp, E. coli
gcagtgacggaatatggcgaaaacc

SEQ ID NO: 87268 - DNA, 25 bp, E. coli
gcagtgacggaaaatggcgaaaacc

SEQ ID NO: 87269 - DNA, 25 bp, E. coli
cgtgacaggctgattaaccgaacct

SEQ ID NO: 87270 - DNA, 25 bp, E. coli
cgtgacaggctgtttaaccgaacct

SEQ ID NO: 87271 - DNA, 25 bp, E. coli
gataataccggctgaagtgcccgcc

SEQ ID NO: 87272 - DNA, 25 bp, E. coli
gatcgtgtaaattatgccctgtggc

SEQ ID NO: 87273 - DNA, 25 bp, E. coli
tggtgaaacggtttccccggaactg

SEQ ID NO: 87274 - DNA, 25 bp, E. coli
tggtgaaacggtatccccggaactg

SEQ ID NO: 87275 - DNA, 25 bp, E. coli
gataataccggcagaagtgcccgcc

SEQ ID NO: 87276 - DNA, 25 bp, E. coli
gatcgtgtaaataatgccctgtggc

SEQ ID NO: 87277 - DNA, 25 bp, E. coli
aatacttaagtagcgcgcagggata

SEQ ID NO: 87278 - DNA, 25 bp, E. coli
aatacttaagtaccgcgcagggata

SEQ ID NO: 87279 - DNA, 25 bp, E. coli
caaaaatacttatgtagcgcgcagg

SEQ ID NO: 87280 - DNA, 25 bp, E. coli
caaaaatacttaagtagcgcgcagg

SEQ ID NO: 87281 - DNA, 25 bp, E. coli
tttgaagttctggacggtgccggaa

SEQ ID NO: 87282 - DNA, 25 bp, E. coli
tttgaagttctgcacggtgccggaa

SEQ ID NO: 87283 - DNA, 25 bp, E. coli
tctgatgtggcaggcatcctcaacg

SEQ ID NO: 87284 - DNA, 25 bp, E. coli
tctgatgtggcacgcatcctcaacg

SEQ ID NO: 87285 - DNA, 25 bp, E. coli
ccacctctgatgtggcaggcatcct

SEQ ID NO: 87286 - DNA, 25 bp, E. coli
ccacctctgatgaggcaggcatcct

SEQ ID NO: 87287 - DNA, 25 bp, E. coli
gaaatccctcgccacctctgatgtg

SEQ ID NO: 87288 - DNA, 25 bp, E. coli
gaaatccctcgcgacctctgatgtg

SEQ ID NO: 87289 - DNA, 25 bp, E. coli
gataagagggatggtcccttaaagg

SEQ ID NO: 87290 - DNA, 25 bp, E. coli
gataagagggatcgtcccttaaagg

SEQ ID NO: 87291 - DNA, 25 bp, E. coli
ggtgccggaatacaatcaaaaatac

SEQ ID NO: 87292 - DNA, 25 bp, E. coli
gggagagctaataatccggaaggat

SEQ ID NO: 87293 - DNA, 25 bp, E. coli
ggtgccggaatagaatcaaaaatac

SEQ ID NO: 87294 - DNA, 25 bp, E. coli
gggagagctaattatccggaaggat

SEQ ID NO: 87295 - DNA, 25 bp, E. coli
tggacggtgccggaatagaatcaaa

SEQ ID NO: 87296 - DNA, 25 bp, E. coli
tggacggtgccgcaatagaatcaaa

SEQ ID NO: 87297 - DNA, 25 bp, E. coli
tcaacgcgtttgtagttctggacgg

SEQ ID NO: 87298 - DNA, 25 bp, E. coli
tcaacgcgtttgaagttctggacgg

SEQ ID NO: 87299 - DNA, 25 bp, E. coli
cagactccagggattggcgtccaac

SEQ ID NO: 87300 - DNA, 25 bp, E. coli
cagactccagggtttggcgtccaac

SEQ ID NO: 87301 - DNA, 25 bp, E. coli
cagggattggcgaccaactggtcgc

SEQ ID NO: 87302 - DNA, 25 bp, E. coli
cagggattggcgtccaactggtcgc

SEQ ID NO: 87303 - DNA, 25 bp, E. coli
tagtggatggagttacaaccttgtt

SEQ ID NO: 87304 - DNA, 25 bp, E. coli
tagtggatggagatacaaccttgtt

SEQ ID NO: 87305 - DNA, 25 bp, E. coli
tttgttacagcaccagactccaggg

SEQ ID NO: 87306 - DNA, 25 bp, E. coli
ttacagcagcagactccagggattg

SEQ ID NO: 87307 - DNA, 25 bp, E. coli
ttacagcagcagtctccagggattg

SEQ ID NO: 87308 - DNA, 25 bp, E. coli
tttgttacagcagcagactccaggg

SEQ ID NO: 87309 - DNA, 25 bp, E. coli
tggtgcgcactaagactctgtcagt

SEQ ID NO: 87310 - DNA, 25 bp, E. coli
tggtgcgcactatgactctgtcagt

SEQ ID NO: 87311 - DNA, 25 bp, E. coli
tcaggtagtggaaggagttacaacc

SEQ ID NO: 87312 - DNA, 25 bp, E. coli
tcaggtagtggatggagttacaacc

SEQ ID NO: 87313 - DNA, 25 bp, E. coli
ctatgactctgtcagtagttatgaa

SEQ ID NO: 87314 - DNA, 25 bp, E. coli
ctatgactctgtgagtagttatgaa

SEQ ID NO: 87315 - DNA, 25 bp, E. coli
ggcacgtttgtttcagcagcagact

SEQ ID NO: 87316 - DNA, 25 bp, E. coli
tggcgtccaactcgtcgcctatgcg

SEQ ID NO: 87317 - DNA, 25 bp, E. coli
tggcgtccaactggtcgcctatgcg

SEQ ID NO: 87318 - DNA, 25 bp, E. coli
ggcacgtttgttacagcagcagact

SEQ ID NO: 87319 - DNA, 25 bp, E. coli
gagttacaacctagttatacaacag

SEQ ID NO: 87320 - DNA, 25 bp, E. coli
gagttacaaccttgttatacaacag

SEQ ID NO: 87321 - DNA, 25 bp, E. coli
cacccttgatacaccagagatgatg

SEQ ID NO: 87322 - DNA, 25 bp, E. coli
cacccttgatactccagagatgatg

SEQ ID NO: 87323 - DNA, 25 bp, E. coli
caggctaacgtcattaacgccgaag

SEQ ID NO: 87324 - DNA, 25 bp, E. coli
caggctaacgtctttaacgccgaag

SEQ ID NO: 87325 - DNA, 25 bp, E. coli
aaagcggtggtgtctaccgccacct

SEQ ID NO: 87326 - DNA, 25 bp, E. coli
aaagcggtggtgactaccgccacct

SEQ ID NO: 87327 - DNA, 25 bp, E. coli
ttgatacaccagtgatgatgcaggc

SEQ ID NO: 87328 - DNA, 25 bp, E. coli
ttgatacaccagagatgatgcaggc

SEQ ID NO: 87329 - DNA, 25 bp, E. coli
tctttaacgccgaaggcaaaatcac

SEQ ID NO: 87330 - DNA, 25 bp, E. coli
tctttaacgccgtaggcaaaatcac

SEQ ID NO: 87331 - DNA, 25 bp, E. coli
gccgaaggcaaattcacccttgata

SEQ ID NO: 87332 - DNA, 25 bp, E. coli
gccgaaggcaaaatcacccttgata

SEQ ID NO: 87333 - DNA, 25 bp, E. coli
gctaacgtctttaacgccgaaggca

SEQ ID NO: 87334 - DNA, 25 bp, E. coli
gcgtggtgagttgaatggtgcataa

SEQ ID NO: 87335 - DNA, 25 bp, E. coli
gcgtggtgagttcaatggtgcataa

SEQ ID NO: 87336 - DNA, 25 bp, E. coli
gctaacgtcttttacgccgaaggca

SEQ ID NO: 87337 - DNA, 25 bp, E. coli
gagacggaagcagcagaaaaatttg

SEQ ID NO: 87338 - DNA, 25 bp, E. coli
ccgaagagacggtagcagcagaaaa

SEQ ID NO: 87339 - DNA, 25 bp, E. coli
ccgaagagacggaagcagcagaaaa

SEQ ID NO: 87340 - DNA, 25 bp, E. coli
gtgactaccgccacctggaaagaca

SEQ ID NO: 87341 - DNA, 25 bp, E. coli
gtgactaccgcctcctggaaagaca

SEQ ID NO: 87342 - DNA, 25 bp, E. coli
gagacggaagcaccagaaaaatttg

SEQ ID NO: 87343 - DNA, 25 bp, E. coli
taaaaaagccagcagtgcttctgcg

SEQ ID NO: 87344 - DNA, 25 bp, E. coli
taaaaaagccaggagtgcttctgcg

SEQ ID NO: 87345 - DNA, 25 bp, E. coli
aaagtcggccaatccatcatcaatg

SEQ ID NO: 87346 - DNA, 25 bp, E. coli
aaagtcggccaaaccatcatcaatg

SEQ ID NO: 87347 - DNA, 25 bp, E. coli
aaatcacccgcgtacgatgaaaaca

SEQ ID NO: 87348 - DNA, 25 bp, E. coli
aaatcacccgcgaacgatgaaaaca

SEQ ID NO: 87349 - DNA, 25 bp, E. coli
tgcttctgcgtgctttgaacacagt

SEQ ID NO: 87350 - DNA, 25 bp, E. coli
tgcttctgcgtggtttgaacacagt

SEQ ID NO: 87351 - DNA, 25 bp, E. coli
ccttcaaatctagcaagaggatatg

SEQ ID NO: 87352 - DNA, 25 bp, E. coli
ccttcaaatctaccaagaggatatg

SEQ ID NO: 87353 - DNA, 25 bp, E. coli
gaacacagtaaagcaatcattgcag

SEQ ID NO: 87354 - DNA, 25 bp, E. coli
gactgagagaacttaacgaagcttt

SEQ ID NO: 87355 - DNA, 25 bp, E. coli
gaacacagtaaaccaatcattgcag

SEQ ID NO: 87356 - DNA, 25 bp, E. coli
gaaacgacgatcctgatagaataaa

SEQ ID NO: 87357 - DNA, 25 bp, E. coli
gaaacgacgatcgtgatagaataaa

SEQ ID NO: 87358 - DNA, 25 bp, E. coli
cgtagtgatattggcattgactcca

SEQ ID NO: 87359 - DNA, 25 bp, E. coli
cgtagtgatattcgcattgactcca

SEQ ID NO: 87360 - DNA, 25 bp, E. coli
ggatggctaccagattcaaaaagga

SEQ ID NO: 87361 - DNA, 25 bp, E. coli
ggatggctaccacattcaaaaagga

SEQ ID NO: 87362 - DNA, 25 bp, E. coli
tcaagttgtaaacgaactcaaaggg

SEQ ID NO: 87363 - DNA, 25 bp, E. coli
tcaagttgtaaaggaactcaaaggg

SEQ ID NO: 87364 - DNA, 25 bp, E. coli
gactgagagaacataacgaagcttt

SEQ ID NO: 87365 - DNA, 25 bp, E. coli
caattgacgtttgttctaagtcgca

SEQ ID NO: 87366 - DNA, 25 bp, E. coli
caggtaaactgacaactgtcgcttc

SEQ ID NO: 87367 - DNA, 25 bp, E. coli
caggtaaactgagaactgtcgcttc

SEQ ID NO: 87368 - DNA, 25 bp, E. coli
cacgctttacccagcgttttgggcg

SEQ ID NO: 87369 - DNA, 25 bp, E. coli
cacgctttaccctgcgttttgggcg

SEQ ID NO: 87370 - DNA, 25 bp, E. coli
aactgaccgggtaattgaactggat

SEQ ID NO: 87371 - DNA, 25 bp, E. coli
aactgaccgggttattgaactggat

SEQ ID NO: 87372 - DNA, 25 bp, E. coli
caattgacgtttcttctaagtcgca

SEQ ID NO: 87373 - DNA, 25 bp, E. coli
tgttgatgcgaaaaaaggtggctga

SEQ ID NO: 87374 - DNA, 25 bp, E. coli
tgttgatgcgaataaaggtggctga

SEQ ID NO: 87375 - DNA, 25 bp, E. coli
tgaactggatggtgtaacttaccca

SEQ ID NO: 87376 - DNA, 25 bp, E. coli
tgaactggatggagtaacttaccca

SEQ ID NO: 87377 - DNA, 25 bp, E. coli
tccatccggaataccgtacagtagt

SEQ ID NO: 87378 - DNA, 25 bp, E. coli
tccatccggaattccgtacagtagt

SEQ ID NO: 87379 - DNA, 25 bp, E. coli
cgcttcagaaggaaatgttgcacgc

SEQ ID NO: 87380 - DNA, 25 bp, E. coli
cgcttcagaaggtaatgttgcacgc

SEQ ID NO: 87381 - DNA, 25 bp, E. coli
ggttcgacgatctaaactgaccggg

SEQ ID NO: 87382 - DNA, 25 bp, E. coli
ggttcgacgatcaaaactgaccggg

SEQ ID NO: 87383 - DNA, 25 bp, E. coli
taagtcgcatcccttttatacaggt

SEQ ID NO: 87384 - DNA, 25 bp, E. coli
taagtcgcatccgttttatacaggt

SEQ ID NO: 87385 - DNA, 25 bp, E. coli
gagtacttcaggatcggttcgacga

SEQ ID NO: 87386 - DNA, 25 bp, E. coli
gagtacttcaggttcggttcgacga

SEQ ID NO: 87387 - DNA, 25 bp, E. coli
tatattccctgcctcaggtctcgtg

SEQ ID NO: 87388 - DNA, 25 bp, E. coli
tatattccctgcgtcaggtctcgtg

SEQ ID NO: 87389 - DNA, 25 bp, E. coli
tgtgctggacaagaatggtcaatga

SEQ ID NO: 87390 - DNA, 25 bp, E. coli
tgtgctggacaacaatggtcaatga

SEQ ID NO: 87391 - DNA, 25 bp, E. coli
tccctgcgtcaggtctcgtgatgta

SEQ ID NO: 87392 - DNA, 25 bp, E. coli
tccctgcgtcagctctcgtgatgta

SEQ ID NO: 87393 - DNA, 25 bp, E. coli
gcatcgctatcatctgcaaggatat

SEQ ID NO: 87394 - DNA, 25 bp, E. coli
gcatcgctatcaactgcaaggatat

SEQ ID NO: 87395 - DNA, 25 bp, E. coli
gcaagcggtttgagctggacaacaa

SEQ ID NO: 87396 - DNA, 25 bp, E. coli
gcaagcggtttgtgctggacaacaa

SEQ ID NO: 87397 - DNA, 25 bp, E. coli
ctggacaacaatggtcaatgaaact

SEQ ID NO: 87398 - DNA, 25 bp, E. coli
ctggacaacaatcgtcaatgaaact

SEQ ID NO: 87399 - DNA, 25 bp, E. coli
cggtttgtgctgcacaacaatggtc

SEQ ID NO: 87400 - DNA, 25 bp, E. coli
cgtcaggtctcgagatgtatggcga

SEQ ID NO: 87401 - DNA, 25 bp, E. coli
cggtttgtgctggacaacaatggtc

SEQ ID NO: 87402 - DNA, 25 bp, E. coli
cgtcaggtctcgtgatgtatggcga

SEQ ID NO: 87403 - DNA, 25 bp, E. coli
ggtctcgtgatgtatggcgaatatc

SEQ ID NO: 87404 - DNA, 25 bp, E. coli
ggtctcgtgatgaatggcgaatatc

SEQ ID NO: 87405 - DNA, 25 bp, E. coli
ggatatcaatggattgatactccac

SEQ ID NO: 87406 - DNA, 25 bp, E. coli
ggatatcaatggtttgatactccac

SEQ ID NO: 87407 - DNA, 25 bp, E. coli
tcaactgcaaggatatcaatggatt

SEQ ID NO: 87408 - DNA, 25 bp, E. coli
tcaactgcaaggttatcaatggatt

SEQ ID NO: 87409 - DNA, 25 bp, E. coli
catactgcagggttaaatcaccgcg

SEQ ID NO: 87410 - DNA, 25 bp, E. coli
catactgcagggataaatcaccgcg

SEQ ID NO: 87411 - DNA, 25 bp, E. coli
cagttatcgatctgcatcgggcaca

SEQ ID NO: 87412 - DNA, 25 bp, E. coli
cagttatcgatcagcatcgggcaca

SEQ ID NO: 87413 - DNA, 25 bp, E. coli
tacattacgcttagaactgtccggg

SEQ ID NO: 87414 - DNA, 25 bp, E. coli
tacattacgctttgaactgtccggg

SEQ ID NO: 87415 - DNA, 25 bp, E. coli
agatacgtgcaaaagtaccgcgccg

SEQ ID NO: 87416 - DNA, 25 bp, E. coli
agatacgtgcaatagtaccgcgccg

SEQ ID NO: 87417 - DNA, 25 bp, E. coli
tgaacatggcaagcgttaaggccga

SEQ ID NO: 87418 - DNA, 25 bp, E. coli
tgaacatggcaaccgttaaggccga

SEQ ID NO: 87419 - DNA, 25 bp, E. coli
tctttcgtgaacaggagactcgtcg

SEQ ID NO: 87420 - DNA, 25 bp, E. coli
tctttcgtgaactggagactcgtcg

SEQ ID NO: 87421 - DNA, 25 bp, E. coli
ccgctggcgcgataaagacctgatt

SEQ ID NO: 87422 - DNA, 25 bp, E. coli
ccgctggcgcgaaaaagacctgatt

SEQ ID NO: 87423 - DNA, 25 bp, E. coli
ggttgaattaaaagagccgcttgcc

SEQ ID NO: 87424 - DNA, 25 bp, E. coli
ggttgaattaaatgagccgcttgcc

SEQ ID NO: 87425 - DNA, 25 bp, E. coli
tggcctgacgcaaagagatatctgg

SEQ ID NO: 87426 - DNA, 25 bp, E. coli
tggcctgacgcatagagatatctgg

SEQ ID NO: 87427 - DNA, 25 bp, E. coli
taaggccgagcgtattaaagagcga

SEQ ID NO: 87428 - DNA, 25 bp, E. coli
taaggccgagcgaattaaagagcga

SEQ ID NO: 87429 - DNA, 25 bp, E. coli
gagtggcacgcttttcatcgcctga

SEQ ID NO: 87430 - DNA, 25 bp, E. coli
gagtggcacgctattcatcgcctga

SEQ ID NO: 87431 - DNA, 25 bp, E. coli
cactttaccgaatgatggcccgcag

SEQ ID NO: 87432 - DNA, 25 bp, E. coli
cactttaccgaaagatggcccgcag

SEQ ID NO: 87433 - DNA, 25 bp, E. coli
aaagatggcccggagatgaccaccg

SEQ ID NO: 87434 - DNA, 25 bp, E. coli
aaagatggcccgcagatgaccaccg

SEQ ID NO: 87435 - DNA, 25 bp, E. coli
ttaccgaaagatggcccgcagatga

SEQ ID NO: 87436 - DNA, 25 bp, E. coli
ttaccgaaagatcgcccgcagatga

SEQ ID NO: 87437 - DNA, 25 bp, E. coli
ttaccgtgctgaagcatggtatgca

SEQ ID NO: 87438 - DNA, 25 bp, E. coli
ttaccgtgctgatgcatggtatgca

SEQ ID NO: 87439 - DNA, 25 bp, E. coli
taatattggtcgtttgttaatgctc

SEQ ID NO: 87440 - DNA, 25 bp, E. coli
taatattggtcgattgttaatgctc

SEQ ID NO: 87441 - DNA, 25 bp, E. coli
ccttttcggcgtctttgaactgctg

SEQ ID NO: 87442 - DNA, 25 bp, E. coli
cgctgatttttagcgtgctgatgca

SEQ ID NO: 87443 - DNA, 25 bp, E. coli
ccttttcggcgtgtttgaactgctg

SEQ ID NO: 87444 - DNA, 25 bp, E. coli
cgctgatttttaccgtgctgatgca

SEQ ID NO: 87445 - DNA, 25 bp, E. coli
cgcagatgaccaccgccgaaaaggt

SEQ ID NO: 87446 - DNA, 25 bp, E. coli
cgcagatgaccagcgccgaaaaggt

SEQ ID NO: 87447 - DNA, 25 bp, E. coli
gatttttaatccacaacctggtgca

SEQ ID NO: 87448 - DNA, 25 bp, E. coli
gatttttaatcctcaacctggtgca

SEQ ID NO: 87449 - DNA, 25 bp, E. coli
ggcgctattgaaatccactttaccg

SEQ ID NO: 87450 - DNA, 25 bp, E. coli
ggcgctattgaattccactttaccg

SEQ ID NO: 87451 - DNA, 25 bp, E. coli
taatcctcaacctggtgcatccctt

SEQ ID NO: 87452 - DNA, 25 bp, E. coli
taatcctcaaccaggtgcatccctt

SEQ ID NO: 87453 - DNA, 25 bp, E. coli
tatggagaagcctgaaacagcgatg

SEQ ID NO: 87454 - DNA, 25 bp, E. coli
tatggagaagccagaaacagcgatg

SEQ ID NO: 87455 - DNA, 25 bp, E. coli
tattgaacgcatggtcaccggacgt

SEQ ID NO: 87456 - DNA, 25 bp, E. coli
tattgaacgcatcgtcaccggacgt

SEQ ID NO: 87457 - DNA, 25 bp, E. coli
tgtcgattatggtcgctcaggcccg

SEQ ID NO: 87458 - DNA, 25 bp, E. coli
tgtcgattatggacgctcaggcccg

SEQ ID NO: 87459 - DNA, 25 bp, E. coli
tgcggcgctgactcagattgaagca

SEQ ID NO: 87460 - DNA, 25 bp, E. coli
tgcggcgctgacacagattgaagca

SEQ ID NO: 87461 - DNA, 25 bp, E. coli
tctcgatcgcggaaaatggcgggat

SEQ ID NO: 87462 - DNA, 25 bp, E. coli
tctcgatcgcggtaaatggcgggat

SEQ ID NO: 87463 - DNA, 25 bp, E. coli
gaagcattgctcgaccagattaacg

SEQ ID NO: 87464 - DNA, 25 bp, E. coli
gaagcattgctccaccagattaacg

SEQ ID NO: 87465 - DNA, 25 bp, E. coli
gaaaaaccgcccaggactgggtcat

SEQ ID NO: 87466 - DNA, 25 bp, E. coli
gacacaaaccctgagtatcggcgga

SEQ ID NO: 87467 - DNA, 25 bp, E. coli
gaaaaaccgccctggactgggtcat

SEQ ID NO: 87468 - DNA, 25 bp, E. coli
gacacaaaccctcagtatcggcgga

SEQ ID NO: 87469 - DNA, 25 bp, E. coli
gatttgctccaccagtattgaacgc

SEQ ID NO: 87470 - DNA, 25 bp, E. coli
gatttgctccacgagtattgaacgc

SEQ ID NO: 87471 - DNA, 25 bp, E. coli
taatgaaacgctcagggatgctgtc

SEQ ID NO: 87472 - DNA, 25 bp, E. coli
taaccagtggtagaacagcctagaa

SEQ ID NO: 87473 - DNA, 25 bp, E. coli
taatgaaacgctgagggatgctgtc

SEQ ID NO: 87474 - DNA, 25 bp, E. coli
taaccagtggtacaacagcctagaa

SEQ ID NO: 87475 - DNA, 25 bp, E. coli
aattcttgctcatttaaccccggag

SEQ ID NO: 87476 - DNA, 25 bp, E. coli
aatgccagcagtggccagggcttaa

SEQ ID NO: 87477 - DNA, 25 bp, E. coli
aattcttgctcaattaaccccggag

SEQ ID NO: 87478 - DNA, 25 bp, E. coli
aatgccagcagtcgccagggcttaa

SEQ ID NO: 87479 - DNA, 25 bp, E. coli
tacagtccgaaaggctgatgagcgc

SEQ ID NO: 87480 - DNA, 25 bp, E. coli
tacagtccgaaacgctgatgagcgc

SEQ ID NO: 87481 - DNA, 25 bp, E. coli
tttttggcggtagcgaagccaacct

SEQ ID NO: 87482 - DNA, 25 bp, E. coli
tttttggcggtaccgaagccaacct

SEQ ID NO: 87483 - DNA, 25 bp, E. coli
tgctgtactgcatagcccacaagtg

SEQ ID NO: 87484 - DNA, 25 bp, E. coli
tgctgtactgcaaagcccacaagtg

SEQ ID NO: 87485 - DNA, 25 bp, E. coli
tgcgctacacgtgtcactcaacagt

SEQ ID NO: 87486 - DNA, 25 bp, E. coli
tgcgctacacgtctcactcaacagt

SEQ ID NO: 87487 - DNA, 25 bp, E. coli
gcggcggacgtctgcaactgatgtt

SEQ ID NO: 87488 - DNA, 25 bp, E. coli
gcggcggacgtcagcaactgatgtt

SEQ ID NO: 87489 - DNA, 25 bp, E. coli
gaattactatgacatcaccctcgcc

SEQ ID NO: 87490 - DNA, 25 bp, E. coli
gaattactatgagatcaccctcgcc

SEQ ID NO: 87491 - DNA, 25 bp, E. coli
cccacaagtgcaggcgaaagttcgc

SEQ ID NO: 87492 - DNA, 25 bp, E. coli
cccacaagtgcacgcgaaagttcgc

SEQ ID NO: 87493 - DNA, 25 bp, E. coli
ggtatttgtcagtcggcacgcctgg

SEQ ID NO: 87494 - DNA, 25 bp, E. coli
ggtatttgtcagacggcacgcctgg

SEQ ID NO: 87495 - DNA, 25 bp, E. coli
gatgttttctcgtaatcgcctgacc

SEQ ID NO: 87496 - DNA, 25 bp, E. coli
gatgttttctcgaaatcgcctgacc

SEQ ID NO: 87497 - DNA, 25 bp, E. coli
cactaagccggtttgtactggcaag

SEQ ID NO: 87498 - DNA, 25 bp, E. coli
cactaagccggtatgtactggcaag

SEQ ID NO: 87499 - DNA, 25 bp, E. coli
cattagcggactgcactaacgactg

SEQ ID NO: 87500 - DNA, 25 bp, E. coli
cattagcggactccactaacgactg

SEQ ID NO: 87501 - DNA, 25 bp, E. coli
taccatcaactggacgggaaatccg

SEQ ID NO: 87502 - DNA, 25 bp, E. coli
taccatcaactgcacgggaaatccg

SEQ ID NO: 87503 - DNA, 25 bp, E. coli
ttcggaatgcacaaaaggtcctgcc

SEQ ID NO: 87504 - DNA, 25 bp, E. coli
ttcggaatgcactaaaggtcctgcc

SEQ ID NO: 87505 - DNA, 25 bp, E. coli
tcatggatatccgtaaggcccggca

SEQ ID NO: 87506 - DNA, 25 bp, E. coli
tcatggatatccctaaggcccggca

SEQ ID NO: 87507 - DNA, 25 bp, E. coli
gcctggttcagcttcatcatggata

SEQ ID NO: 87508 - DNA, 25 bp, E. coli
gcctggttcagcatcatcatggata

SEQ ID NO: 87509 - DNA, 25 bp, E. coli
gacagtaccggcatcacagtggtga

SEQ ID NO: 87510 - DNA, 25 bp, E. coli
gacagtaccggcttcacagtggtga

SEQ ID NO: 87511 - DNA, 25 bp, E. coli
cggatgccagcggaaagatgtttac

SEQ ID NO: 87512 - DNA, 25 bp, E. coli
cggatgccagcgcaaagatgtttac

SEQ ID NO: 87513 - DNA, 25 bp, E. coli
ctcaacccttggctggcgtaacgga

SEQ ID NO: 87514 - DNA, 25 bp, E. coli
ctcaacccttgggtggcgtaacgga

SEQ ID NO: 87515 - DNA, 25 bp, E. coli
gataaaacggtctgctcgcatgatg

SEQ ID NO: 87516 - DNA, 25 bp, E. coli
gataaaacggtcagctcgcatgatg

SEQ ID NO: 87517 - DNA, 25 bp, E. coli
ggaatacagtgtgacggatgccagc

SEQ ID NO: 87518 - DNA, 25 bp, E. coli
ggaatacagtgtcacggatgccagc

SEQ ID NO: 87519 - DNA, 25 bp, E. coli
taaatccattcatgctgttgttgcg

SEQ ID NO: 87520 - DNA, 25 bp, E. coli
taaatccattcaagctgttgttgcg

SEQ ID NO: 87521 - DNA, 25 bp, E. coli
tgtggatcctttacccttcaggctt

SEQ ID NO: 87522 - DNA, 25 bp, E. coli
tgttgcgtgtttagctgctgtgtgc

SEQ ID NO: 87523 - DNA, 25 bp, E. coli
tgtggatccttttcccttcaggctt

SEQ ID NO: 87524 - DNA, 25 bp, E. coli
tgttgcgtgttttgctgctgtgtgc

SEQ ID NO: 87525 - DNA, 25 bp, E. coli
tgctgtgtgcagcattatcttttcg

SEQ ID NO: 87526 - DNA, 25 bp, E. coli
tgctgtgtgcaggattatcttttcg

SEQ ID NO: 87527 - DNA, 25 bp, E. coli
tctggtgttttgatcgaatgttctg

SEQ ID NO: 87528 - DNA, 25 bp, E. coli
tctggtgttttgttcgaatgttctg

SEQ ID NO: 87529 - DNA, 25 bp, E. coli
gaagcgttctggatgcgtttctggt

SEQ ID NO: 87530 - DNA, 25 bp, E. coli
gaagcgttctggttgcgtttctggt

SEQ ID NO: 87531 - DNA, 25 bp, E. coli
cgaatgttctgtcgatccttttccc

SEQ ID NO: 87532 - DNA, 25 bp, E. coli
cgaatgttctgtggatccttttccc

SEQ ID NO: 87533 - DNA, 25 bp, E. coli
gatttgcattgcgaggaagcgttct

SEQ ID NO: 87534 - DNA, 25 bp, E. coli
gatttgcattgccaggaagcgttct

SEQ ID NO: 87535 - DNA, 25 bp, E. coli
ggatggtttgttccgtttcaatcac

SEQ ID NO: 87536 - DNA, 25 bp, E. coli
ggattatcttttcgttccgggatgg

SEQ ID NO: 87537 - DNA, 25 bp, E. coli
ggattatcttttggttccgggatgg

SEQ ID NO: 87538 - DNA, 25 bp, E. coli
ggtgttgttgttcatttgcattgcc

SEQ ID NO: 87539 - DNA, 25 bp, E. coli
ggtgttgttgttgatttgcattgcc

SEQ ID NO: 87540 - DNA, 25 bp, E. coli
ggatggtttgttgcgtttcaatcac

SEQ ID NO: 87541 - DNA, 25 bp, E. coli
cactccgcaagcgtgacatatcttt

SEQ ID NO: 87542 - DNA, 25 bp, E. coli
cactccgcaagcctgacatatcttt

SEQ ID NO: 87543 - DNA, 25 bp, E. coli
catatcttttaaggaaatgctgtag

SEQ ID NO: 87544 - DNA, 25 bp, E. coli
catcttgcagcacagaattgtattt

SEQ ID NO: 87545 - DNA, 25 bp, E. coli
catcttgcagcagagaattgtattt

SEQ ID NO: 87546 - DNA, 25 bp, E. coli
catatcttttaacgaaatgctgtag

SEQ ID NO: 87547 - DNA, 25 bp, E. coli
taaacattattcttcttgcagcaga

SEQ ID NO: 87548 - DNA, 25 bp, E. coli
taaacattattcatcttgcagcaga

SEQ ID NO: 87549 - DNA, 25 bp, E. coli
agcggagcactcagaaaggaggaaa

SEQ ID NO: 87550 - DNA, 25 bp, E. coli
agcggagcactctgaaaggaggaaa

SEQ ID NO: 87551 - DNA, 25 bp, E. coli
ttttctttatcacgcaaatagcagg

SEQ ID NO: 87552 - DNA, 25 bp, E. coli
ttatcgttcccttaagaatactgcg

SEQ ID NO: 87553 - DNA, 25 bp, E. coli
ttttctttatcaggcaaatagcagg

SEQ ID NO: 87554 - DNA, 25 bp, E. coli
ttatcgttccctaaagaatactgcg

SEQ ID NO: 87555 - DNA, 25 bp, E. coli
tctgaaaggaggtaatcgtatgtcc

SEQ ID NO: 87556 - DNA, 25 bp, E. coli
tctgaaaggaggaaatcgtatgtcc

SEQ ID NO: 87557 - DNA, 25 bp, E. coli
gaatactgcgtgtgataatagtgag

SEQ ID NO: 87558 - DNA, 25 bp, E. coli
gaatactgcgtgagataatagtgag

SEQ ID NO: 87559 - DNA, 25 bp, E. coli
gaaatcgtatgtccttaaccgccac

SEQ ID NO: 87560 - DNA, 25 bp, E. coli
gaaatcgtatgtgcttaaccgccac

SEQ ID NO: 87561 - DNA, 25 bp, E. coli
taatagtgagaagcggagcactctg

SEQ ID NO: 87562 - DNA, 25 bp, E. coli
taatagtgagaaccggagcactctg

SEQ ID NO: 87563 - DNA, 25 bp, E. coli
caactgtggtcaggctggtccgtta

SEQ ID NO: 87564 - DNA, 25 bp, E. coli
caactgtggtcacgctggtccgtta

SEQ ID NO: 87565 - DNA, 25 bp, E. coli
tttgacatggactactgcgtgcaac

SEQ ID NO: 87566 - DNA, 25 bp, E. coli
tttgacatggacaactgcgtgcaac

SEQ ID NO: 87567 - DNA, 25 bp, E. coli
ttgtgccgctgaaccgaaacgcaat

SEQ ID NO: 87568 - DNA, 25 bp, E. coli
ttgtgccgctgatccgaaacgcaat

SEQ ID NO: 87569 - DNA, 25 bp, E. coli
tcgctttcgagaatatcaactccag

SEQ ID NO: 87570 - DNA, 25 bp, E. coli
tcgctttcgagattatcaactccag

SEQ ID NO: 87571 - DNA, 25 bp, E. coli
gcgtgcaactcgctttcgagaatat

SEQ ID NO: 87572 - DNA, 25 bp, E. coli
gcgtgcaactcggtttcgagaatat

SEQ ID NO: 87573 - DNA, 25 bp, E. coli
gctggtccgttacgctggacgattc

SEQ ID NO: 87574 - DNA, 25 bp, E. coli
gctggtccgttaggctggacgattc

SEQ ID NO: 87575 - DNA, 25 bp, E. coli
gactactgcgtgcaactcgctttcg

SEQ ID NO: 87576 - DNA, 25 bp, E. coli
gacatggactactgcgtgcaactcg

SEQ ID NO: 87577 - DNA, 25 bp, E. coli
gactactgcgtggaactcgctttcg

SEQ ID NO: 87578 - DNA, 25 bp, E. coli
gacatggactacagcgtgcaactcg

SEQ ID NO: 87579 - DNA, 25 bp, E. coli
ccgctgatccgaaacgcaatgtggt

SEQ ID NO: 87580 - DNA, 25 bp, E. coli
ccgctgatccgatacgcaatgtggt

SEQ ID NO: 87581 - DNA, 25 bp, E. coli
ctggatcaactgtggtcaggctggt

SEQ ID NO: 87582 - DNA, 25 bp, E. coli
ctggatcaactgaggtcaggctggt

SEQ ID NO: 87583 - DNA, 25 bp, E. coli
gatcaactgtggtcaggctggtccg

SEQ ID NO: 87584 - DNA, 25 bp, E. coli
gatcaactgtggacaggctggtccg

SEQ ID NO: 87585 - DNA, 25 bp, E. coli
cacaggcatttggtcgctggacgcg

SEQ ID NO: 87586 - DNA, 25 bp, E. coli
cacaggcatttgctcgctggacgcg

SEQ ID NO: 87587 - DNA, 25 bp, E. coli
cagtggctgactcaaaagctgtttg

SEQ ID NO: 87588 - DNA, 25 bp, E. coli
cagtggctgactgaaaagctgtttg

SEQ ID NO: 87589 - DNA, 25 bp, E. coli
taaactcgccacgacaaaagtaccg

SEQ ID NO: 87590 - DNA, 25 bp, E. coli
taaactcgccaccacaaaagtaccg

SEQ ID NO: 87591 - DNA, 25 bp, E. coli
attttccgggcaggcacagtggctg

SEQ ID NO: 87592 - DNA, 25 bp, E. coli
attttccgggcacgcacagtggctg

SEQ ID NO: 87593 - DNA, 25 bp, E. coli
tagtatcgcgctttctgttgggcta

SEQ ID NO: 87594 - DNA, 25 bp, E. coli
tagtatcgcgctatctgttgggcta

SEQ ID NO: 87595 - DNA, 25 bp, E. coli
tgggttttattggactcgattatcg

SEQ ID NO: 87596 - DNA, 25 bp, E. coli
gcacagtcagcaggcgcgcattatt

SEQ ID NO: 87597 - DNA, 25 bp, E. coli
gcacagtcagcacgcgcgcattatt

SEQ ID NO: 87598 - DNA, 25 bp, E. coli
cgttatcagaaggatccacaggcat

SEQ ID NO: 87599 - DNA, 25 bp, E. coli
cgttatcagaagcatccacaggcat

SEQ ID NO: 87600 - DNA, 25 bp, E. coli
cgttggtggtgctgtacatcatcat

SEQ ID NO: 87601 - DNA, 25 bp, E. coli
cgttggtggtgcagtacatcatcat

SEQ ID NO: 87602 - DNA, 25 bp, E. coli
cattgcgttgatggctaaagcgcac

SEQ ID NO: 87603 - DNA, 25 bp, E. coli
cattgcgttgatcgctaaagcgcac

SEQ ID NO: 87604 - DNA, 25 bp, E. coli
gattatcgtcgtttgcacagtcagc

SEQ ID NO: 87605 - DNA, 25 bp, E. coli
gattatcgtcgtatgcacagtcagc

SEQ ID NO: 87606 - DNA, 25 bp, E. coli
tgggttttattgcactcgattatcg

SEQ ID NO: 87607 - DNA, 25 bp, E. coli
cacgcggctggagcgatttttgtcc

SEQ ID NO: 87608 - DNA, 25 bp, E. coli
cacgcggctggaccgatttttgtcc

SEQ ID NO: 87609 - DNA, 25 bp, E. coli
ttatgaaggcgtttcgttgtggcga

SEQ ID NO: 87610 - DNA, 25 bp, E. coli
ttgttttttcgcgacgcggctggag

SEQ ID NO: 87611 - DNA, 25 bp, E. coli
ttatgaaggcgtatcgttgtggcga

SEQ ID NO: 87612 - DNA, 25 bp, E. coli
ttgttttttcgccacgcggctggag

SEQ ID NO: 87613 - DNA, 25 bp, E. coli
tgaaggcgtttcgttgtggcgaaca

SEQ ID NO: 87614 - DNA, 25 bp, E. coli
tgaaggcgtttccttgtggcgaaca

SEQ ID NO: 87615 - DNA, 25 bp, E. coli
tcgttgtggcgaacaggcgaagtca

SEQ ID NO: 87616 - DNA, 25 bp, E. coli
tcgcgtgagcatcgaaagtcagtca

SEQ ID NO: 87617 - DNA, 25 bp, E. coli
tcgcgtgagcatggaaagtcagtca

SEQ ID NO: 87618 - DNA, 25 bp, E. coli
tctcgcgtgagcatggaaagtcagt

SEQ ID NO: 87619 - DNA, 25 bp, E. coli
tctcgcgtgagcttggaaagtcagt

SEQ ID NO: 87620 - DNA, 25 bp, E. coli
tcgttgtggcgatcaggcgaagtca

SEQ ID NO: 87621 - DNA, 25 bp, E. coli
gccgccaggccatcgttcagtcggc

SEQ ID NO: 87622 - DNA, 25 bp, E. coli
gccgccaggccaacgttcagtcggc

SEQ ID NO: 87623 - DNA, 25 bp, E. coli
gctggagcgatttttgtccgctgaa

SEQ ID NO: 87624 - DNA, 25 bp, E. coli
gctggagcgattattgtccgctgaa

SEQ ID NO: 87625 - DNA, 25 bp, E. coli
cgccacgcggctggagcgatttttg

SEQ ID NO: 87626 - DNA, 25 bp, E. coli
cgccacgcggctcgagcgatttttg

SEQ ID NO: 87627 - DNA, 25 bp, E. coli
gagcgatttttgtccgctgaaagag

SEQ ID NO: 87628 - DNA, 25 bp, E. coli
gagcgatttttgaccgctgaaagag

SEQ ID NO: 87629 - DNA, 25 bp, E. coli
aagagatgccgcagtgtcactaccg

SEQ ID NO: 87630 - DNA, 25 bp, E. coli
aagagatgccgctgtgtcactaccg

SEQ ID NO: 87631 - DNA, 25 bp, E. coli
catgaaagacgtagccctcaaggca

SEQ ID NO: 87632 - DNA, 25 bp, E. coli
catgaaagacgttgccctcaaggca

SEQ ID NO: 87633 - DNA, 25 bp, E. coli
tacggcggcaaatcacggatatctg

SEQ ID NO: 87634 - DNA, 25 bp, E. coli
tacggcggcaaaacacggatatctg

SEQ ID NO: 87635 - DNA, 25 bp, E. coli
tattcgcggtatcgaagttacggcg

SEQ ID NO: 87636 - DNA, 25 bp, E. coli
tattcgcggtatggaagttacggcg

SEQ ID NO: 87637 - DNA, 25 bp, E. coli
ttgatccgcaatacatcgcccgtgg

SEQ ID NO: 87638 - DNA, 25 bp, E. coli
ttgatccgcaattcatcgcccgtgg

SEQ ID NO: 87639 - DNA, 25 bp, E. coli
tgtatagccggtgccgaagagatgc

SEQ ID NO: 87640 - DNA, 25 bp, E. coli
tgtatagccggtcccgaagagatgc

SEQ ID NO: 87641 - DNA, 25 bp, E. coli
tcgaagccggaagcaaagcgatgca

SEQ ID NO: 87642 - DNA, 25 bp, E. coli
tcgaagccggaaccaaagcgatgca

SEQ ID NO: 87643 - DNA, 25 bp, E. coli
gctcggcgcactatctcaggcaaaa

SEQ ID NO: 87644 - DNA, 25 bp, E. coli
gctcggcgcactttctcaggcaaaa

SEQ ID NO: 87645 - DNA, 25 bp, E. coli
gactgtgcgcatgaaaatcagcagg

SEQ ID NO: 87646 - DNA, 25 bp, E. coli
gactgtgcgcatcaaaatcagcagg

SEQ ID NO: 87647 - DNA, 25 bp, E. coli
gaacagcgtaatgtgccgccgatgg

SEQ ID NO: 87648 - DNA, 25 bp, E. coli
gaacagcgtaatctgccgccgatgg

SEQ ID NO: 87649 - DNA, 25 bp, E. coli
gacgcaattttgagatccgccgctg

SEQ ID NO: 87650 - DNA, 25 bp, E. coli
gacgcaattttgtgatccgccgctg

SEQ ID NO: 87651 - DNA, 25 bp, E. coli
gaacagcgttcgattatttaacgat

SEQ ID NO: 87652 - DNA, 25 bp, E. coli
gaacagcgttcgtttatttaacgat

SEQ ID NO: 87653 - DNA, 25 bp, E. coli
cagaacaaggagaggtaaatcggaa

SEQ ID NO: 87654 - DNA, 25 bp, E. coli
cagaacaaggagtggtaaatcggaa

SEQ ID NO: 87655 - DNA, 25 bp, E. coli
tactatgacgcagaacaaggagagg

SEQ ID NO: 87656 - DNA, 25 bp, E. coli
tactatgacgcacaacaaggagagg

SEQ ID NO: 87657 - DNA, 25 bp, E. coli
tatttaacgatcttactatgacgca

SEQ ID NO: 87658 - DNA, 25 bp, E. coli
tatttaacgatcatactatgacgca

SEQ ID NO: 87659 - DNA, 25 bp, E. coli
ttacaactaaggcataagaacccgt

SEQ ID NO: 87660 - DNA, 25 bp, E. coli
ttacaactaagggataagaacccgt

SEQ ID NO: 87661 - DNA, 25 bp, E. coli
tgcgggaaatttaagctggatcaca

SEQ ID NO: 87662 - DNA, 25 bp, E. coli
tgcgggaaattttagctggatcaca

SEQ ID NO: 87663 - DNA, 25 bp, E. coli
tctacattatagtacagcgttcgtt

SEQ ID NO: 87664 - DNA, 25 bp, E. coli
tctacattatagaacagcgttcgtt

SEQ ID NO: 87665 - DNA, 25 bp, E. coli
gggacatggtagacacttacaacta

SEQ ID NO: 87666 - DNA, 25 bp, E. coli
gggacatagtgatcacttgttcggg

SEQ ID NO: 87667 - DNA, 25 bp, E. coli
gggacatggtagtcacttacaacta

SEQ ID NO: 87668 - DNA, 25 bp, E. coli
gggacatagtgaacacttgttcggg

SEQ ID NO: 87669 - DNA, 25 bp, E. coli
ggaaaagatggctcggtgcagtccc

SEQ ID NO: 87670 - DNA, 25 bp, E. coli
ggaaaagatggcacggtgcagtccc

SEQ ID NO: 87671 - DNA, 25 bp, E. coli
taagctggatcagatattgcccctc

SEQ ID NO: 87672 - DNA, 25 bp, E. coli
taagctggatcacatattgcccctc

SEQ ID NO: 87673 - DNA, 25 bp, E. coli
taaaaagagtcattaagaaggccag

SEQ ID NO: 87674 - DNA, 25 bp, E. coli
taaaaagagtcaataagaaggccag

SEQ ID NO: 87675 - DNA, 25 bp, E. coli
tatatgaatataagcagactgctcg

SEQ ID NO: 87676 - DNA, 25 bp, E. coli
tatatgaatatatgcagactgctcg

SEQ ID NO: 87677 - DNA, 25 bp, E. coli
gccagaattctcaggcccgggttaa

SEQ ID NO: 87678 - DNA, 25 bp, E. coli
gccagaattctctggcccgggttaa

SEQ ID NO: 87679 - DNA, 25 bp, E. coli
gcgtcagtgagccaatgacttaatt

SEQ ID NO: 87680 - DNA, 25 bp, E. coli
gcgtcagtgagcgaatgacttaatt

SEQ ID NO: 87681 - DNA, 25 bp, E. coli
gaatatttaattcgcgtcagtgagc

SEQ ID NO: 87682 - DNA, 25 bp, E. coli
gaatatttaattggcgtcagtgagc

SEQ ID NO: 87683 - DNA, 25 bp, E. coli
cgctgtaacggtcaatataacccat

SEQ ID NO: 87684 - DNA, 25 bp, E. coli
cgttaagaacgatacaggaatattt

SEQ ID NO: 87685 - DNA, 25 bp, E. coli
cgctgtaacggtgaatataacccat

SEQ ID NO: 87686 - DNA, 25 bp, E. coli
cgttaagaacgaaacaggaatattt

SEQ ID NO: 87687 - DNA, 25 bp, E. coli
cggtgaatataagccattagcagat

SEQ ID NO: 87688 - DNA, 25 bp, E. coli
cggtgaatataacccattagcagat

SEQ ID NO: 87689 - DNA, 25 bp, E. coli
cattaagaaggcgagaattctctgg

SEQ ID NO: 87690 - DNA, 25 bp, E. coli
cattaagaaggccagaattctctgg

SEQ ID NO: 87691 - DNA, 25 bp, E. coli
taagcagactgctcgttaagaacga

SEQ ID NO: 87692 - DNA, 25 bp, E. coli
taattttgtaagtcgctgtaacggt

SEQ ID NO: 87693 - DNA, 25 bp, E. coli
taagcagactgcacgttaagaacga

SEQ ID NO: 87694 - DNA, 25 bp, E. coli
taattttgtaagacgctgtaacggt

SEQ ID NO: 87695 - DNA, 25 bp, E. coli
cagaacaatcgttagcccggaaggt

SEQ ID NO: 87696 - DNA, 25 bp, E. coli
cacggacgaaactgatgaaagcttc

SEQ ID NO: 87697 - DNA, 25 bp, E. coli
cacggacgaaacagatgaaagcttc

SEQ ID NO: 87698 - DNA, 25 bp, E. coli
cagaacaatcgtaagcccggaaggt

SEQ ID NO: 87699 - DNA, 25 bp, E. coli
gactcttattttgacggacgaaaca

SEQ ID NO: 87700 - DNA, 25 bp, E. coli
gactcttattttcacggacgaaaca

SEQ ID NO: 87701 - DNA, 25 bp, E. coli
tatccgcttctggacattttctcca

SEQ ID NO: 87702 - DNA, 25 bp, E. coli
tatccgcttctgcacattttctcca

SEQ ID NO: 87703 - DNA, 25 bp, E. coli
tattttcacggaggaaacagatgaa

SEQ ID NO: 87704 - DNA, 25 bp, E. coli
ttagcccggaaggtcgaatctgtga

SEQ ID NO: 87705 - DNA, 25 bp, E. coli
tattttcacggacgaaacagatgaa

SEQ ID NO: 87706 - DNA, 25 bp, E. coli
ttagcccggaagctcgaatctgtga

SEQ ID NO: 87707 - DNA, 25 bp, E. coli
tctccacagaactatcgttagcccg

SEQ ID NO: 87708 - DNA, 25 bp, E. coli
tctccacagaacaatcgttagcccg

SEQ ID NO: 87709 - DNA, 25 bp, E. coli
gaatctgtgactcttattttcacgg

SEQ ID NO: 87710 - DNA, 25 bp, E. coli
gaatctgtgactgttattttcacgg

SEQ ID NO: 87711 - DNA, 25 bp, E. coli
gacgaaacagatcaaagcttcactg

SEQ ID NO: 87712 - DNA, 25 bp, E. coli
gacgaaacagatgaaagcttcactg

SEQ ID NO: 87713 - DNA, 25 bp, E. coli
cccggaaggtcgtatctgtgactct

SEQ ID NO: 87714 - DNA, 25 bp, E. coli
cccggaaggtcgaatctgtgactct

SEQ ID NO: 87715 - DNA, 25 bp, E. coli
ggacattttctcgacagaacaatcg

SEQ ID NO: 87716 - DNA, 25 bp, E. coli
ggacattttctccacagaacaatcg

SEQ ID NO: 87717 - DNA, 25 bp, E. coli
aatttctgctaataaacatcgcggg

SEQ ID NO: 87718 - DNA, 25 bp, E. coli
aatttctgctaaaaaacatcgcggg

SEQ ID NO: 87719 - DNA, 25 bp, E. coli
catttgataaggcaagtgcagggct

SEQ ID NO: 87720 - DNA, 25 bp, E. coli
tagtgcatctcttgagcaaaccagc

SEQ ID NO: 87721 - DNA, 25 bp, E. coli
tagtgcatctctagagcaaaccagc

SEQ ID NO: 87722 - DNA, 25 bp, E. coli
tatcaacaaagtgtcgagtccctgg

SEQ ID NO: 87723 - DNA, 25 bp, E. coli
tatcaacaaagtctcgagtccctgg

SEQ ID NO: 87724 - DNA, 25 bp, E. coli
ttagaaacctttctcgccatccgcg

SEQ ID NO: 87725 - DNA, 25 bp, E. coli
ttagaaacctttgtcgccatccgcg

SEQ ID NO: 87726 - DNA, 25 bp, E. coli
tgagattagcgattcctcgcaggca

SEQ ID NO: 87727 - DNA, 25 bp, E. coli
tgagattagcgaatcctcgcaggca

SEQ ID NO: 87728 - DNA, 25 bp, E. coli
tgcagattcaatccgcgttgccctg

SEQ ID NO: 87729 - DNA, 25 bp, E. coli
tgcagattcaatgcgcgttgccctg

SEQ ID NO: 87730 - DNA, 25 bp, E. coli
tccctggttgaatcaaaaactgcgg

SEQ ID NO: 87731 - DNA, 25 bp, E. coli
tccctggttgaaacaaaaactgcgg

SEQ ID NO: 87732 - DNA, 25 bp, E. coli
gaaagtattgattccagcatccccg

SEQ ID NO: 87733 - DNA, 25 bp, E. coli
gaactgctgaaaaccggagctgcaa

SEQ ID NO: 87734 - DNA, 25 bp, E. coli
gaactgctgaaatccggagctgcaa

SEQ ID NO: 87735 - DNA, 25 bp, E. coli
gaaagtattgataccagcatccccg

SEQ ID NO: 87736 - DNA, 25 bp, E. coli
cgttgccctggaagaaggtaccgaa

SEQ ID NO: 87737 - DNA, 25 bp, E. coli
cgttgccctggatgaaggtaccgaa

SEQ ID NO: 87738 - DNA, 25 bp, E. coli
catttgataagggaagtgcagggct

SEQ ID NO: 87739 - DNA, 25 bp, E. coli
aacgtggcctggtgcgatttaccgc

SEQ ID NO: 87740 - DNA, 25 bp, E. coli
cactctaatgtacagggcgaccgaa

SEQ ID NO: 87741 - DNA, 25 bp, E. coli
cactctaatgtagagggcgaccgaa

SEQ ID NO: 87742 - DNA, 25 bp, E. coli
taacagtaagctcgtcatggcgaca

SEQ ID NO: 87743 - DNA, 25 bp, E. coli
aaagcaatcgcctgggaagtcacgg

SEQ ID NO: 87744 - DNA, 25 bp, E. coli
aacgtggcctggagcgatttaccgc

SEQ ID NO: 87745 - DNA, 25 bp, E. coli
aaagcaatcgccagggaagtcacgg

SEQ ID NO: 87746 - DNA, 25 bp, E. coli
tttgacatgaataagccagagggct

SEQ ID NO: 87747 - DNA, 25 bp, E. coli
tttgacatgaattagccagagggct

SEQ ID NO: 87748 - DNA, 25 bp, E. coli
tctgagactcagatggccagtgcct

SEQ ID NO: 87749 - DNA, 25 bp, E. coli
tctgagactcagttggccagtgcct

SEQ ID NO: 87750 - DNA, 25 bp, E. coli
gctcacgccgcatggatagattaaa

SEQ ID NO: 87751 - DNA, 25 bp, E. coli
gctcacgccgcaaggatagattaaa

SEQ ID NO: 87752 - DNA, 25 bp, E. coli
cattcgacatttctgaaaacggcgc

SEQ ID NO: 87753 - DNA, 25 bp, E. coli
cattcgacatttgtgaaaacggcgc

SEQ ID NO: 87754 - DNA, 25 bp, E. coli
gggatcactcagcacgaacatggta

SEQ ID NO: 87755 - DNA, 25 bp, E. coli
gggatcactcaggacgaacatggta

SEQ ID NO: 87756 - DNA, 25 bp, E. coli
tggccagatccttagcacagtgcgt

SEQ ID NO: 87757 - DNA, 25 bp, E. coli
tggccagatcctaagcacagtgcgt

SEQ ID NO: 87758 - DNA, 25 bp, E. coli
taacagtaagctggtcatggcgaca

SEQ ID NO: 87759 - DNA, 25 bp, E. coli
taaagggaccgtgttgctggaagac

SEQ ID NO: 87760 - DNA, 25 bp, E. coli
taaagggaccgtcttgctggaagac

SEQ ID NO: 87761 - DNA, 25 bp, E. coli
catgggcaactcgatgctggaagcg

SEQ ID NO: 87762 - DNA, 25 bp, E. coli
catgggcaactccatgctggaagcg

SEQ ID NO: 87763 - DNA, 25 bp, E. coli
tactctgacggatgacgtggcggca

SEQ ID NO: 87764 - DNA, 25 bp, E. coli
tactctgacggaagacgtggcggca

SEQ ID NO: 87765 - DNA, 25 bp, E. coli
agcatcgtgttccaccaggcggaaa

SEQ ID NO: 87766 - DNA, 25 bp, E. coli
agcatcgtgttcgaccaggcggaaa

SEQ ID NO: 87767 - DNA, 25 bp, E. coli
acggcattcagtatcgcggtcacgg

SEQ ID NO: 87768 - DNA, 25 bp, E. coli
acggcattcagtttcgcggtcacgg

SEQ ID NO: 87769 - DNA, 25 bp, E. coli
tgtggaacgggctgaccaacgagtt

SEQ ID NO: 87770 - DNA, 25 bp, E. coli
tgtggaacgggcagaccaacgagtt

SEQ ID NO: 87771 - DNA, 25 bp, E. coli
tcacggccaggatgtggtcgaaacg

SEQ ID NO: 87772 - DNA, 25 bp, E. coli
tcacggccaggaagtggtcgaaacg

SEQ ID NO: 87773 - DNA, 25 bp, E. coli
gcgatgcgcgcaacaacatgggcaa

SEQ ID NO: 87774 - DNA, 25 bp, E. coli
gcgatgcgcgcatcaacatgggcaa

SEQ ID NO: 87775 - DNA, 25 bp, E. coli
gaagcacggcgggaaaattactctg

SEQ ID NO: 87776 - DNA, 25 bp, E. coli
gaagcacggcggcaaaattactctg

SEQ ID NO: 87777 - DNA, 25 bp, E. coli
gttacctatttacggccgagcggca

SEQ ID NO: 87778 - DNA, 25 bp, E. coli
gttacctatttagggccgagcggca

SEQ ID NO: 87779 - DNA, 25 bp, E. coli
taagggcgcggactttatctatacc

SEQ ID NO: 87780 - DNA, 25 bp, E. coli
tcaattaaggacaccgcgcgggttc

SEQ ID NO: 87781 - DNA, 25 bp, E. coli
taagggcgcggagtttatctatacc

SEQ ID NO: 87782 - DNA, 25 bp, E. coli
tcaattaaggactccgcgcgggttc

SEQ ID NO: 87783 - DNA, 25 bp, E. coli
cagcaggatatgacagaaaccgcca

SEQ ID NO: 87784 - DNA, 25 bp, E. coli
cagttaatactgacccagctggtta

SEQ ID NO: 87785 - DNA, 25 bp, E. coli
cagttaatactgtcccagctggtta

SEQ ID NO: 87786 - DNA, 25 bp, E. coli
cagcaggatatgtcagaaaccgcca

SEQ ID NO: 87787 - DNA, 25 bp, E. coli
caggatatgacagaaaccgccagag

SEQ ID NO: 87788 - DNA, 25 bp, E. coli
caggatatgacacaaaccgccagag

SEQ ID NO: 87789 - DNA, 25 bp, E. coli
aggatatgacagaaaccgccagagt

SEQ ID NO: 87790 - DNA, 25 bp, E. coli
aggatatgacagtaaccgccagagt

SEQ ID NO: 87791 - DNA, 25 bp, E. coli
agttaatactgacccagctggttat

SEQ ID NO: 87792 - DNA, 25 bp, E. coli
agttaatactgagccagctggttat

SEQ ID NO: 87793 - DNA, 25 bp, E. coli
aaacagcaggatttgacagaaaccg

SEQ ID NO: 87794 - DNA, 25 bp, E. coli
aaacagcaggatatgacagaaaccg

SEQ ID NO: 87795 - DNA, 25 bp, E. coli
acagcaggatatgacagaaaccgcc

SEQ ID NO: 87796 - DNA, 25 bp, E. coli
acagcaggatatcacagaaaccgcc

SEQ ID NO: 87797 - DNA, 25 bp, E. coli
tgccagttaatagtgacccagctgg

SEQ ID NO: 87798 - DNA, 25 bp, E. coli
tgccagttaatactgacccagctgg

SEQ ID NO: 87799 - DNA, 25 bp, E. coli
gccagttaatactgacccagctggt

SEQ ID NO: 87800 - DNA, 25 bp, E. coli
gccagttaatacagacccagctggt

SEQ ID NO: 87801 - DNA, 25 bp, E. coli
gcaggatatgactgaaaccgccaga

SEQ ID NO: 87802 - DNA, 25 bp, E. coli
gcaggatatgacagaaaccgccaga

SEQ ID NO: 87803 - DNA, 25 bp, E. coli
cgctgccagttattactgacccagc

SEQ ID NO: 87804 - DNA, 25 bp, E. coli
cgctgccagttaatactgacccagc

SEQ ID NO: 87805 - DNA, 25 bp, E. coli
caagaaatggcctcgaggttgtcct

SEQ ID NO: 87806 - DNA, 25 bp, E. coli
caagaaatggccacgaggttgtcct

SEQ ID NO: 87807 - DNA, 25 bp, E. coli
caacgtttgcgaaagaactggcggc

SEQ ID NO: 87808 - DNA, 25 bp, E. coli
caatgactgtgatcggtgccggctc

SEQ ID NO: 87809 - DNA, 25 bp, E. coli
caatgactgtgaacggtgccggctc

SEQ ID NO: 87810 - DNA, 25 bp, E. coli
caacgtttgcgatagaactggcggc

SEQ ID NO: 87811 - DNA, 25 bp, E. coli
catgtctttggtcaagtgctgcgcc

SEQ ID NO: 87812 - DNA, 25 bp, E. coli
catgtctttggtgaagtgctgcgcc

SEQ ID NO: 87813 - DNA, 25 bp, E. coli
taccgcaatacgaaagaagtccgcg

SEQ ID NO: 87814 - DNA, 25 bp, E. coli
taccgcaatacgtaagaagtccgcg

SEQ ID NO: 87815 - DNA, 25 bp, E. coli
tatattgcggaaaaaacgcgcgcga

SEQ ID NO: 87816 - DNA, 25 bp, E. coli
tatattgcggaataaacgcgcgcga

SEQ ID NO: 87817 - DNA, 25 bp, E. coli
ttaggcgatcaaattccgctggcgg

SEQ ID NO: 87818 - DNA, 25 bp, E. coli
ttaggcgatcaatttccgctggcgg

SEQ ID NO: 87819 - DNA, 25 bp, E. coli
tgaaagcgatctcgccactgcgctg

SEQ ID NO: 87820 - DNA, 25 bp, E. coli
tgaaagcgatctggccactgcgctg

SEQ ID NO: 87821 - DNA, 25 bp, E. coli
gcatggatgtactaagcgcgcagga

SEQ ID NO: 87822 - DNA, 25 bp, E. coli
gcatggatgtacaaagcgcgcagga

SEQ ID NO: 87823 - DNA, 25 bp, E. coli
gaccctgaacatatcgcaacgcttg

SEQ ID NO: 87824 - DNA, 25 bp, E. coli
gaccctgaacatttcgcaacgcttg

SEQ ID NO: 87825 - DNA, 25 bp, E. coli
taatattctcgtggtcgtacccagc

SEQ ID NO: 87826 - DNA, 25 bp, E. coli
taatattctcgtcgtcgtacccagc

SEQ ID NO: 87827 - DNA, 25 bp, E. coli
aaggttgtttcaacaccgcgtcacg

SEQ ID NO: 87828 - DNA, 25 bp, E. coli
aaggttgtttcatcaccgcgtcacg

SEQ ID NO: 87829 - DNA, 25 bp, E. coli
tatcgccattgagcgagaagcgcgg

SEQ ID NO: 87830 - DNA, 25 bp, E. coli
tatgcaaccgttctggccgcagatc

SEQ ID NO: 87831 - DNA, 25 bp, E. coli
tatgcaaccgttgtggccgcagatc

SEQ ID NO: 87832 - DNA, 25 bp, E. coli
tatcgccattgaccgagaagcgcgg

SEQ ID NO: 87833 - DNA, 25 bp, E. coli
ttaacacctggtagcgcgatgccga

SEQ ID NO: 87834 - DNA, 25 bp, E. coli
ttatcgcgtcgattgcggcggctgc

SEQ ID NO: 87835 - DNA, 25 bp, E. coli
ttatcgcgtcgaatgcggcggctgc

SEQ ID NO: 87836 - DNA, 25 bp, E. coli
ttaacacctggttgcgcgatgccga

SEQ ID NO: 87837 - DNA, 25 bp, E. coli
gacgcagaacgttttggcattaagg

SEQ ID NO: 87838 - DNA, 25 bp, E. coli
gaaatttgcgatcggctcctgcgcc

SEQ ID NO: 87839 - DNA, 25 bp, E. coli
gaaatttgcgatgggctcctgcgcc

SEQ ID NO: 87840 - DNA, 25 bp, E. coli
cattgatgtttgcatccccggctgc

SEQ ID NO: 87841 - DNA, 25 bp, E. coli
cattgatgtttggatccccggctgc

SEQ ID NO: 87842 - DNA, 25 bp, E. coli
ggtattttccaccatctctacagcg

SEQ ID NO: 87843 - DNA, 25 bp, E. coli
ggtattttccacgatctctacagcg

SEQ ID NO: 87844 - DNA, 25 bp, E. coli
ggcatttgctactggatatccgtcg

SEQ ID NO: 87845 - DNA, 25 bp, E. coli
ggcatttgctacaggatatccgtcg

SEQ ID NO: 87846 - DNA, 25 bp, E. coli
gatgcgtatgcctgcacttcgggcg

SEQ ID NO: 87847 - DNA, 25 bp, E. coli
gacgcagaacgtattggcattaagg

SEQ ID NO: 87848 - DNA, 25 bp, E. coli
gatgcgtatgccagcacttcgggcg

SEQ ID NO: 87849 - DNA, 25 bp, E. coli
tttatctagccgtagaaggaggccg

SEQ ID NO: 87850 - DNA, 25 bp, E. coli
tttatctagccgaagaaggaggccg

SEQ ID NO: 87851 - DNA, 25 bp, E. coli
tctgagcggaaatacaaaagagcgt

SEQ ID NO: 87852 - DNA, 25 bp, E. coli
tcatggccggatatcaggaaagccg

SEQ ID NO: 87853 - DNA, 25 bp, E. coli
tcatggccggatttcaggaaagccg

SEQ ID NO: 87854 - DNA, 25 bp, E. coli
tctgagcggaaaaacaaaagagcgt

SEQ ID NO: 87855 - DNA, 25 bp, E. coli
cctggacggatgtaagtagacaccc

SEQ ID NO: 87856 - DNA, 25 bp, E. coli
cctggacggatgaaagtagacaccc

SEQ ID NO: 87857 - DNA, 25 bp, E. coli
gaaggaggccgaaaagtcagtcaac

SEQ ID NO: 87858 - DNA, 25 bp, E. coli
gaaggaggccgataagtcagtcaac

SEQ ID NO: 87859 - DNA, 25 bp, E. coli
gaaacttctgggaatagtcctgaca

SEQ ID NO: 87860 - DNA, 25 bp, E. coli
gaaacttctgggtatagtcctgaca

SEQ ID NO: 87861 - DNA, 25 bp, E. coli
cattagtcttggtactctgagcgga

SEQ ID NO: 87862 - DNA, 25 bp, E. coli
cattagtcttggaactctgagcgga

SEQ ID NO: 87863 - DNA, 25 bp, E. coli
gatcagctcttttgcttctaccgag

SEQ ID NO: 87864 - DNA, 25 bp, E. coli
gatctgaatatcaaaggctggctcc

SEQ ID NO: 87865 - DNA, 25 bp, E. coli
gatctgaatatctaaggctggctcc

SEQ ID NO: 87866 - DNA, 25 bp, E. coli
gatcagctctttagcttctaccgag

SEQ ID NO: 87867 - DNA, 25 bp, E. coli
gatatcggctccatcccgaatggag

SEQ ID NO: 87868 - DNA, 25 bp, E. coli
gatatcggctccttcccgaatggag

SEQ ID NO: 87869 - DNA, 25 bp, E. coli
tggatggattccagtaaccccggaa

SEQ ID NO: 87870 - DNA, 25 bp, E. coli
tggatggattcctgtaaccccggaa

SEQ ID NO: 87871 - DNA, 25 bp, E. coli
caaatgctgattcgacttgcggcgg

SEQ ID NO: 87872 - DNA, 25 bp, E. coli
caaatgctgattggacttgcggcgg

SEQ ID NO: 87873 - DNA, 25 bp, E. coli
gacagccacggagaacgcggtttta

SEQ ID NO: 87874 - DNA, 25 bp, E. coli
gacagccacggacaacgcggtttta

SEQ ID NO: 87875 - DNA, 25 bp, E. coli
aaatccgctgatgtggctactgggc

SEQ ID NO: 87876 - DNA, 25 bp, E. coli
aaatccgctgatctggctactgggc

SEQ ID NO: 87877 - DNA, 25 bp, E. coli
tatgtcgatcaagattggcggagcg

SEQ ID NO: 87878 - DNA, 25 bp, E. coli
tatgtcgatcaacattggcggagcg

SEQ ID NO: 87879 - DNA, 25 bp, E. coli
ttcagtttactcacggtcgccgcag

SEQ ID NO: 87880 - DNA, 25 bp, E. coli
ttcagtttactctcggtcgccgcag

SEQ ID NO: 87881 - DNA, 25 bp, E. coli
tgtcgctggtcatcgaacgctacgg

SEQ ID NO: 87882 - DNA, 25 bp, E. coli
tgtttagcgggcaacgagcgccaat

SEQ ID NO: 87883 - DNA, 25 bp, E. coli
tgtgatccggatagcgcttaacgac

SEQ ID NO: 87884 - DNA, 25 bp, E. coli
tgtgcatgattaatggctacgccgc

SEQ ID NO: 87885 - DNA, 25 bp, E. coli
tgtcgctggtcaacgaacgctacgg

SEQ ID NO: 87886 - DNA, 25 bp, E. coli
tgtgatccggattgcgcttaacgac

SEQ ID NO: 87887 - DNA, 25 bp, E. coli
tgtgcatgattattggctacgccgc

SEQ ID NO: 87888 - DNA, 25 bp, E. coli
tgtttagcgggctacgagcgccaat

SEQ ID NO: 87889 - DNA, 25 bp, E. coli
cgtgaattacgtccttccggcgcta

SEQ ID NO: 87890 - DNA, 25 bp, E. coli
cgtgaattacgtgcttccggcgcta

SEQ ID NO: 87891 - DNA, 25 bp, E. coli
gacctcggactggataaaggcgaca

SEQ ID NO: 87892 - DNA, 25 bp, E. coli
gacctcggactgcataaaggcgaca

SEQ ID NO: 87893 - DNA, 25 bp, E. coli
caagcacttgtcagcaatttgagaa

SEQ ID NO: 87894 - DNA, 25 bp, E. coli
cagcaatttgagtacacgggaaaaa

SEQ ID NO: 87895 - DNA, 25 bp, E. coli
cagcaatttgagaacacgggaaaaa

SEQ ID NO: 87896 - DNA, 25 bp, E. coli
caagcacttgtctgcaatttgagaa

SEQ ID NO: 87897 - DNA, 25 bp, E. coli
cacttgtcagcaatttgagaacacg

SEQ ID NO: 87898 - DNA, 25 bp, E. coli
cacttgtcagcattttgagaacacg

SEQ ID NO: 87899 - DNA, 25 bp, E. coli
aggctgatgaacaaacgcaaaactg

SEQ ID NO: 87900 - DNA, 25 bp, E. coli
aggctgatgaactaacgcaaaactg

SEQ ID NO: 87901 - DNA, 25 bp, E. coli
ttatctgttttaccgcccataagcc

SEQ ID NO: 87902 - DNA, 25 bp, E. coli
tttatgccgggcaatgcccggcatc

SEQ ID NO: 87903 - DNA, 25 bp, E. coli
tttatgccgggctatgcccggcatc

SEQ ID NO: 87904 - DNA, 25 bp, E. coli
ttatctgttttagcgcccataagcc

SEQ ID NO: 87905 - DNA, 25 bp, E. coli
tgtcagcaatttcagaacacgggaa

SEQ ID NO: 87906 - DNA, 25 bp, E. coli
tgtcagcaatttgagaacacgggaa

SEQ ID NO: 87907 - DNA, 25 bp, E. coli
tcaggctgatgaacaaacgcaaaac

SEQ ID NO: 87908 - DNA, 25 bp, E. coli
tcaggctgatgatcaaacgcaaaac

SEQ ID NO: 87909 - DNA, 25 bp, E. coli
gctatgcccggcttcaggctgatga

SEQ ID NO: 87910 - DNA, 25 bp, E. coli
gctatgcccggcatcaggctgatga

SEQ ID NO: 87911 - DNA, 25 bp, E. coli
gcatcaggctgatgaacaaacgcaa

SEQ ID NO: 87912 - DNA, 25 bp, E. coli
gcatcaggctgaagaacaaacgcaa

SEQ ID NO: 87913 - DNA, 25 bp, E. coli
gagaacacgggaaaaaatttatctg

SEQ ID NO: 87914 - DNA, 25 bp, E. coli
gagaacacgggataaaatttatctg

SEQ ID NO: 87915 - DNA, 25 bp, E. coli
aataccgacggcgtagcgctggttg

SEQ ID NO: 87916 - DNA, 25 bp, E. coli
aataccgacggcctagcgctggttg

SEQ ID NO: 87917 - DNA, 25 bp, E. coli
catggagtattgcaaagagcacggc

SEQ ID NO: 87918 - DNA, 25 bp, E. coli
catggagtattggaaagagcacggc

SEQ ID NO: 87919 - DNA, 25 bp, E. coli
agcgctggttgtatcaacgactaaa

SEQ ID NO: 87920 - DNA, 25 bp, E. coli
agcgctggttgtttcaacgactaaa

SEQ ID NO: 87921 - DNA, 25 bp, E. coli
taccgacggcgttgcgctggttgtt

SEQ ID NO: 87922 - DNA, 25 bp, E. coli
taccgacggcgtagcgctggttgtt

SEQ ID NO: 87923 - DNA, 25 bp, E. coli
tgccggtggttaacggcttacccat

SEQ ID NO: 87924 - DNA, 25 bp, E. coli
tgccggtggttatcggcttacccat

SEQ ID NO: 87925 - DNA, 25 bp, E. coli
gctggttgtttcaacgactaaagtg

SEQ ID NO: 87926 - DNA, 25 bp, E. coli
gctggttgtttctacgactaaagtg

SEQ ID NO: 87927 - DNA, 25 bp, E. coli
cgtagcgctggtagtttcaacgact

SEQ ID NO: 87928 - DNA, 25 bp, E. coli
cgtagcgctggttgtttcaacgact

SEQ ID NO: 87929 - DNA, 25 bp, E. coli
gtattgcaaagaccacggccttaac

SEQ ID NO: 87930 - DNA, 25 bp, E. coli
gtattgcaaagagcacggccttaac

SEQ ID NO: 87931 - DNA, 25 bp, E. coli
ggcgtagcgctggttgtttcaacga

SEQ ID NO: 87932 - DNA, 25 bp, E. coli
tggagtattgcaaagagcacggcct

SEQ ID NO: 87933 - DNA, 25 bp, E. coli
tggagtattgcatagagcacggcct

SEQ ID NO: 87934 - DNA, 25 bp, E. coli
ggcgtagcgctgcttgtttcaacga

SEQ ID NO: 87935 - DNA, 25 bp, E. coli
gagtattgcaaagagcacggcctta

SEQ ID NO: 87936 - DNA, 25 bp, E. coli
gagtattgcaaacagcacggcctta

SEQ ID NO: 87937 - DNA, 25 bp, E. coli
aattcagtgcctctacccgttctca

SEQ ID NO: 87938 - DNA, 25 bp, E. coli
aattcagtgcctgtacccgttctca

SEQ ID NO: 87939 - DNA, 25 bp, E. coli
ccggaattcagtgcctgtacccgtt

SEQ ID NO: 87940 - DNA, 25 bp, E. coli
ccggaattcagtccctgtacccgtt

SEQ ID NO: 87941 - DNA, 25 bp, E. coli
tactgggccagcattacggccttac

SEQ ID NO: 87942 - DNA, 25 bp, E. coli
tactgggccagctttacggccttac

SEQ ID NO: 87943 - DNA, 25 bp, E. coli
agactctgctctgccgactactggg

SEQ ID NO: 87944 - DNA, 25 bp, E. coli
agactctgctctcccgactactggg

SEQ ID NO: 87945 - DNA, 25 bp, E. coli
actgggccagcaatacggccttacc

SEQ ID NO: 87946 - DNA, 25 bp, E. coli
actgggccagcattacggccttacc

SEQ ID NO: 87947 - DNA, 25 bp, E. coli
gccggaattcagtgcctgtacccgt

SEQ ID NO: 87948 - DNA, 25 bp, E. coli
gccggaattcagagcctgtacccgt

SEQ ID NO: 87949 - DNA, 25 bp, E. coli
tctcccgactactgggccagcatta

SEQ ID NO: 87950 - DNA, 25 bp, E. coli
tctcccgactacagggccagcatta

SEQ ID NO: 87951 - DNA, 25 bp, E. coli
gactactgggccagcattacggcct

SEQ ID NO: 87952 - DNA, 25 bp, E. coli
gactactgggcctgcattacggcct

SEQ ID NO: 87953 - DNA, 25 bp, E. coli
gggccagcattagggccttaccctg

SEQ ID NO: 87954 - DNA, 25 bp, E. coli
gggccagcattacggccttaccctg

SEQ ID NO: 87955 - DNA, 25 bp, E. coli
tgggccagcatttcggccttaccct

SEQ ID NO: 87956 - DNA, 25 bp, E. coli
ggaattcagtgcctgtacccgttct

SEQ ID NO: 87957 - DNA, 25 bp, E. coli
ggaattcagtgcgtgtacccgttct

SEQ ID NO: 87958 - DNA, 25 bp, E. coli
tgggccagcattacggccttaccct

SEQ ID NO: 87959 - DNA, 25 bp, E. coli
caatgaagtgatctcctgccagtcc

SEQ ID NO: 87960 - DNA, 25 bp, E. coli
caatgaagtgatgtcctgccagtcc

SEQ ID NO: 87961 - DNA, 25 bp, E. coli
tacgtcttacaacgcagcacgggct

SEQ ID NO: 87962 - DNA, 25 bp, E. coli
tacgtcttacaaggcagcacgggct

SEQ ID NO: 87963 - DNA, 25 bp, E. coli
ttaacgtctttatcattcgcggcgg

SEQ ID NO: 87964 - DNA, 25 bp, E. coli
ttttcatcaagcaggcctgggcctc

SEQ ID NO: 87965 - DNA, 25 bp, E. coli
ttaacgtctttaacattcgcggcgg

SEQ ID NO: 87966 - DNA, 25 bp, E. coli
ttttcatcaagctggcctgggcctc

SEQ ID NO: 87967 - DNA, 25 bp, E. coli
tggtagctctctacggtcagggcaa

SEQ ID NO: 87968 - DNA, 25 bp, E. coli
tgactacggcgactggaaaacccac

SEQ ID NO: 87969 - DNA, 25 bp, E. coli
tgactacggcgagtggaaaacccac

SEQ ID NO: 87970 - DNA, 25 bp, E. coli
tgccagcatgggtgtaaaaatcgcc

SEQ ID NO: 87971 - DNA, 25 bp, E. coli
tgccagcatgggagtaaaaatcgcc

SEQ ID NO: 87972 - DNA, 25 bp, E. coli
gaacaacgaccaactgctgctgatg

SEQ ID NO: 87973 - DNA, 25 bp, E. coli
gaacaacgaccatctgctgctgatg

SEQ ID NO: 87974 - DNA, 25 bp, E. coli
cggcttatcaaacgctgtggctggc

SEQ ID NO: 87975 - DNA, 25 bp, E. coli
cggcttatcaaaggctgtggctggc

SEQ ID NO: 87976 - DNA, 25 bp, E. coli
gatcgcggcgatcgaaacattactg

SEQ ID NO: 87977 - DNA, 25 bp, E. coli
tggtagctctcttcggtcagggcaa

SEQ ID NO: 87978 - DNA, 25 bp, E. coli
taacgcggcgtttcgataccgtcaa

SEQ ID NO: 87979 - DNA, 25 bp, E. coli
taacgcggcgttacgataccgtcaa

SEQ ID NO: 87980 - DNA, 25 bp, E. coli
gatcgcggcgatggaaacattactg

SEQ ID NO: 87981 - DNA, 25 bp, E. coli
agggatgaaggttaaactcgcaggc

SEQ ID NO: 87982 - DNA, 25 bp, E. coli
agggatgaaggtaaaactcgcaggc

SEQ ID NO: 87983 - DNA, 25 bp, E. coli
aaagggatgaagctaaaactcgcag

SEQ ID NO: 87984 - DNA, 25 bp, E. coli
aaaaaatgcggcagcggcggagcag

SEQ ID NO: 87985 - DNA, 25 bp, E. coli
aaagggatgaaggtaaaactcgcag

SEQ ID NO: 87986 - DNA, 25 bp, E. coli
aaaaaatgcggctgcggcggagcag

SEQ ID NO: 87987 - DNA, 25 bp, E. coli
tcgatctcgatgatgccgaactgac

SEQ ID NO: 87988 - DNA, 25 bp, E. coli
tcgatctcgatgttgccgaactgac

SEQ ID NO: 87989 - DNA, 25 bp, E. coli
gcgataagcgtgatttattaaaatc

SEQ ID NO: 87990 - DNA, 25 bp, E. coli
gcgataagcgtgttttattaaaatc

SEQ ID NO: 87991 - DNA, 25 bp, E. coli
gaaagggatgaacgtaaaactcgca

SEQ ID NO: 87992 - DNA, 25 bp, E. coli
gaaagggatgaaggtaaaactcgca

SEQ ID NO: 87993 - DNA, 25 bp, E. coli
ctgcggcggagctgttaaagatgga

SEQ ID NO: 87994 - DNA, 25 bp, E. coli
ctgcggcggagcagttaaagatgga

SEQ ID NO: 87995 - DNA, 25 bp, E. coli
gtaagggcgtttccctgattaccgg

SEQ ID NO: 87996 - DNA, 25 bp, E. coli
gtaagggcgtttgcctgattaccgg

SEQ ID NO: 87997 - DNA, 25 bp, E. coli
gggcgataagcgagatttattaaaa

SEQ ID NO: 87998 - DNA, 25 bp, E. coli
gtgtggtgcgtaatcagcgtcagac

SEQ ID NO: 87999 - DNA, 25 bp, E. coli
ggatgaaggtaatactcgcaggcgg

SEQ ID NO: 88000 - DNA, 25 bp, E. coli
gggcgataagcgtgatttattaaaa

SEQ ID NO: 88001 - DNA, 25 bp, E. coli
ggatgaaggtaaaactcgcaggcgg

SEQ ID NO: 88002 - DNA, 25 bp, E. coli
gtgtggtgcgtattcagcgtcagac

SEQ ID NO: 88003 - DNA, 25 bp, E. coli
cagcctgtggtgaaagacgtcaaaa

SEQ ID NO: 88004 - DNA, 25 bp, E. coli
cagcctgtggtgtaagacgtcaaaa

SEQ ID NO: 88005 - DNA, 25 bp, E. coli
tactttgtcgcgttagatgataccg

SEQ ID NO: 88006 - DNA, 25 bp, E. coli
tactttgtcgcgatagatgataccg

SEQ ID NO: 88007 - DNA, 25 bp, E. coli
aaagaccagtttctacagcctgtgg

SEQ ID NO: 88008 - DNA, 25 bp, E. coli
aaagaccagtttgtacagcctgtgg

SEQ ID NO: 88009 - DNA, 25 bp, E. coli
tatggcaggaatactgagtgcagcg

SEQ ID NO: 88010 - DNA, 25 bp, E. coli
tatggcaggaattctgagtgcagcg

SEQ ID NO: 88011 - DNA, 25 bp, E. coli
tgaatacgacactgatccacaggct

SEQ ID NO: 88012 - DNA, 25 bp, E. coli
tgaatacgacacagatccacaggct

SEQ ID NO: 88013 - DNA, 25 bp, E. coli
tcctgggtcaacgtgatggtaaagc

SEQ ID NO: 88014 - DNA, 25 bp, E. coli
tcctgggtcaacctgatggtaaagc

SEQ ID NO: 88015 - DNA, 25 bp, E. coli
ccatgctggcgggttgtacggctta

SEQ ID NO: 88016 - DNA, 25 bp, E. coli
ccttcgtctgaactgagcatgatcc

SEQ ID NO: 88017 - DNA, 25 bp, E. coli
ccttcgtctgaagtgagcatgatcc

SEQ ID NO: 88018 - DNA, 25 bp, E. coli
ccatgctggcggcttgtacggctta

SEQ ID NO: 88019 - DNA, 25 bp, E. coli
gcttatgatcgtaccaaagaccagt

SEQ ID NO: 88020 - DNA, 25 bp, E. coli
gcttatgatcgttccaaagaccagt

SEQ ID NO: 88021 - DNA, 25 bp, E. coli
tcaaaaaaggcatgagccgggcgca

SEQ ID NO: 88022 - DNA, 25 bp, E. coli
tcaaaaaaggcaagagccgggcgca

SEQ ID NO: 88023 - DNA, 25 bp, E. coli
tcaactccggttttcagacctgtgc

SEQ ID NO: 88024 - DNA, 25 bp, E. coli
tcaactccggttatcagacctgtgc

SEQ ID NO: 88025 - DNA, 25 bp, E. coli
cagcgctgttcgatggtcatcgcaa

SEQ ID NO: 88026 - DNA, 25 bp, E. coli
cagcgctgttcgttggtcatcgcaa

SEQ ID NO: 88027 - DNA, 25 bp, E. coli
atacttgccgatttgctgacacccg

SEQ ID NO: 88028 - DNA, 25 bp, E. coli
atacttgccgatatgctgacacccg

SEQ ID NO: 88029 - DNA, 25 bp, E. coli
caatcctgacgtgtttgttaccgga

SEQ ID NO: 88030 - DNA, 25 bp, E. coli
aactggaacgttttatctgcatggc

SEQ ID NO: 88031 - DNA, 25 bp, E. coli
caatcctgacgtctttgttaccgga

SEQ ID NO: 88032 - DNA, 25 bp, E. coli
aactggaacgttatatctgcatggc

SEQ ID NO: 88033 - DNA, 25 bp, E. coli
tatttgtctggtcggtatggatgcc

SEQ ID NO: 88034 - DNA, 25 bp, E. coli
tatttgtctggtgggtatggatgcc

SEQ ID NO: 88035 - DNA, 25 bp, E. coli
tggatatcaaaagcgatcgcccgcg

SEQ ID NO: 88036 - DNA, 25 bp, E. coli
tgtgcggtatttcccaaaaatgccg

SEQ ID NO: 88037 - DNA, 25 bp, E. coli
tgtgcggtatttgccaaaaatgccg

SEQ ID NO: 88038 - DNA, 25 bp, E. coli
gcgtttccgcttgcctatcctggtt

SEQ ID NO: 88039 - DNA, 25 bp, E. coli
gcgtttccgcttccctatcctggtt

SEQ ID NO: 88040 - DNA, 25 bp, E. coli
gttaccggacatcgatcacccaaag

SEQ ID NO: 88041 - DNA, 25 bp, E. coli
gttaccggacatggatcacccaaag

SEQ ID NO: 88042 - DNA, 25 bp, E. coli
ggttttacccacagtctgctggcgg

SEQ ID NO: 88043 - DNA, 25 bp, E. coli
ggttttacccactgtctgctggcgg

SEQ ID NO: 88044 - DNA, 25 bp, E. coli
tggtggcatattctcccttccgcaa

SEQ ID NO: 88045 - DNA, 25 bp, E. coli
tggtggcatattgtcccttccgcaa

SEQ ID NO: 88046 - DNA, 25 bp, E. coli
tggatatcaaaaccgatcgcccgcg

SEQ ID NO: 88047 - DNA, 25 bp, E. coli
cagcggaatttgagccattaaccag

SEQ ID NO: 88048 - DNA, 25 bp, E. coli
cagcggaatttgtgccattaaccag

SEQ ID NO: 88049 - DNA, 25 bp, E. coli
caggatgtacaatttttcagcggaa

SEQ ID NO: 88050 - DNA, 25 bp, E. coli
catgatgtgcgaacaggatgtacaa

SEQ ID NO: 88051 - DNA, 25 bp, E. coli
caggatgtacaaattttcagcggaa

SEQ ID NO: 88052 - DNA, 25 bp, E. coli
catgatgtgcgatcaggatgtacaa

SEQ ID NO: 88053 - DNA, 25 bp, E. coli
ggaatttgtgccattaaccagttta

SEQ ID NO: 88054 - DNA, 25 bp, E. coli
ggaatttgtgcctttaaccagttta

SEQ ID NO: 88055 - DNA, 25 bp, E. coli
tattcaacatgaagtgcgatcagga

SEQ ID NO: 88056 - DNA, 25 bp, E. coli
tattcaacatgatgtgcgatcagga

SEQ ID NO: 88057 - DNA, 25 bp, E. coli
tgcttgctgctttgggcgcaggtat

SEQ ID NO: 88058 - DNA, 25 bp, E. coli
tacaatttttcaccggaatttgtgc

SEQ ID NO: 88059 - DNA, 25 bp, E. coli
tacaatttttcagcggaatttgtgc

SEQ ID NO: 88060 - DNA, 25 bp, E. coli
tgcttgctgcttagggcgcaggtat

SEQ ID NO: 88061 - DNA, 25 bp, E. coli
tgccattaaccagtttatcccgtgg

SEQ ID NO: 88062 - DNA, 25 bp, E. coli
tgccattaaccactttatcccgtgg

SEQ ID NO: 88063 - DNA, 25 bp, E. coli
gcgcaggtattctacatgatgtgcg

SEQ ID NO: 88064 - DNA, 25 bp, E. coli
gcgcaggtattcaacatgatgtgcg

SEQ ID NO: 88065 - DNA, 25 bp, E. coli
cgatcaggatgttcaatttttcagc

SEQ ID NO: 88066 - DNA, 25 bp, E. coli
cgatcaggatgtacaatttttcagc

SEQ ID NO: 88067 - DNA, 25 bp, E. coli
cattaaccagtttatcccgtggtga

SEQ ID NO: 88068 - DNA, 25 bp, E. coli
cattaaccagttaatcccgtggtga

SEQ ID NO: 88069 - DNA, 25 bp, E. coli
catctgatttcactgtgagctggaa

SEQ ID NO: 88070 - DNA, 25 bp, E. coli
catctgatttcagtgtgagctggaa

SEQ ID NO: 88071 - DNA, 25 bp, E. coli
tataatgcgcttgcaatactctaat

SEQ ID NO: 88072 - DNA, 25 bp, E. coli
tataatgcgcttccaatactctaat

SEQ ID NO: 88073 - DNA, 25 bp, E. coli
gccaaaggcaaataatgtgatttcg

SEQ ID NO: 88074 - DNA, 25 bp, E. coli
cctgaaaagagaaatgacaaaccgc

SEQ ID NO: 88075 - DNA, 25 bp, E. coli
cctgaaaagagatatgacaaaccgc

SEQ ID NO: 88076 - DNA, 25 bp, E. coli
gccataagtctgtaagaagatcctg

SEQ ID NO: 88077 - DNA, 25 bp, E. coli
gccaaaggcaaaaaatgtgatttcg

SEQ ID NO: 88078 - DNA, 25 bp, E. coli
gccataagtctgaaagaagatcctg

SEQ ID NO: 88079 - DNA, 25 bp, E. coli
gaagatcctgctcctcgcttaaggt

SEQ ID NO: 88080 - DNA, 25 bp, E. coli
gaagatcctgctgctcgcttaaggt

SEQ ID NO: 88081 - DNA, 25 bp, E. coli
gacaaaccgcgcattatgccataag

SEQ ID NO: 88082 - DNA, 25 bp, E. coli
gacaaaccgcgctttatgccataag

SEQ ID NO: 88083 - DNA, 25 bp, E. coli
ggcctgccaggcacaaaatctcgct

SEQ ID NO: 88084 - DNA, 25 bp, E. coli
ggcctgccaggctcaaaatctcgct

SEQ ID NO: 88085 - DNA, 25 bp, E. coli
taaggtctacacacaagccaaaggc

SEQ ID NO: 88086 - DNA, 25 bp, E. coli
taaggtctacactcaagccaaaggc

SEQ ID NO: 88087 - DNA, 25 bp, E. coli
taatattctcaacccaatggcctgc

SEQ ID NO: 88088 - DNA, 25 bp, E. coli
taatattctcaagccaatggcctgc

SEQ ID NO: 88089 - DNA, 25 bp, E. coli
gagctggaatgaacttataatgcgc

SEQ ID NO: 88090 - DNA, 25 bp, E. coli
gagctggaatgatcttataatgcgc

SEQ ID NO: 88091 - DNA, 25 bp, E. coli
caatgttgcgttcattgggtgtgca

SEQ ID NO: 88092 - DNA, 25 bp, E. coli
caatgttgcgttgattgggtgtgca

SEQ ID NO: 88093 - DNA, 25 bp, E. coli
agcgggcagcgtcttcttttgcgca

SEQ ID NO: 88094 - DNA, 25 bp, E. coli
agtgaacgcggtcgcctcaatgttg

SEQ ID NO: 88095 - DNA, 25 bp, E. coli
atgttgcgttcattgggtgtgcagc

SEQ ID NO: 88096 - DNA, 25 bp, E. coli
agcgtgttcttttgcgcatcggata

SEQ ID NO: 88097 - DNA, 25 bp, E. coli
agcgggcagcgtgttcttttgcgca

SEQ ID NO: 88098 - DNA, 25 bp, E. coli
agcgtgttctttagcgcatcggata

SEQ ID NO: 88099 - DNA, 25 bp, E. coli
attgggtgtgcaccgcggcgatcgg

SEQ ID NO: 88100 - DNA, 25 bp, E. coli
agtgaacgcggtggcctcaatgttg

SEQ ID NO: 88101 - DNA, 25 bp, E. coli
atgttgcgttcaatgggtgtgcagc

SEQ ID NO: 88102 - DNA, 25 bp, E. coli
attgggtgtgcagcgcggcgatcgg

SEQ ID NO: 88103 - DNA, 25 bp, E. coli
gcggtggcctcaatgttgcgttcat

SEQ ID NO: 88104 - DNA, 25 bp, E. coli
gcggtggcctcattgttgcgttcat

SEQ ID NO: 88105 - DNA, 25 bp, E. coli
gcagcgtgttcttttgcgcatcgga

SEQ ID NO: 88106 - DNA, 25 bp, E. coli
gaagtgaacgcgctggcctcaatgt

SEQ ID NO: 88107 - DNA, 25 bp, E. coli
gaagtgaacgcggtggcctcaatgt

SEQ ID NO: 88108 - DNA, 25 bp, E. coli
gcagcgtgttctattgcgcatcgga

SEQ ID NO: 88109 - DNA, 25 bp, E. coli
ctttcgtcagctccatgacgaagtg

SEQ ID NO: 88110 - DNA, 25 bp, E. coli
ctttcgtcagctgcatgacgaagtg

SEQ ID NO: 88111 - DNA, 25 bp, E. coli
tcagctgcatgaggaagtgaacgcg

SEQ ID NO: 88112 - DNA, 25 bp, E. coli
tcagctgcatgacgaagtgaacgcg

SEQ ID NO: 88113 - DNA, 25 bp, E. coli
aaccggctctgataccaccaatgta

SEQ ID NO: 88114 - DNA, 25 bp, E. coli
aaccggctctgaaaccaccaatgta

SEQ ID NO: 88115 - DNA, 25 bp, E. coli
ttgcagaccgcgctctttcaggcgt

SEQ ID NO: 88116 - DNA, 25 bp, E. coli
ttgcagaccgcggtctttcaggcgt

SEQ ID NO: 88117 - DNA, 25 bp, E. coli
tcgacgccgcatagaccgaaggtgt

SEQ ID NO: 88118 - DNA, 25 bp, E. coli
tcgacgccgcattgaccgaaggtgt

SEQ ID NO: 88119 - DNA, 25 bp, E. coli
tctgcaaccgcggttgccgctgatt

SEQ ID NO: 88120 - DNA, 25 bp, E. coli
tctgcaaccgcgcttgccgctgatt

SEQ ID NO: 88121 - DNA, 25 bp, E. coli
ccagtgcgggtcttgggttgtgcca

SEQ ID NO: 88122 - DNA, 25 bp, E. coli
ccagtgcgggtcatgggttgtgcca

SEQ ID NO: 88123 - DNA, 25 bp, E. coli
gcattgaccgaacgtgtgccgtcgc

SEQ ID NO: 88124 - DNA, 25 bp, E. coli
gcattgaccgaaggtgtgccgtcgc

SEQ ID NO: 88125 - DNA, 25 bp, E. coli
gcaaaatgaattgcagaccgcgctc

SEQ ID NO: 88126 - DNA, 25 bp, E. coli
gcaaaatgaattccagaccgcgctc

SEQ ID NO: 88127 - DNA, 25 bp, E. coli
ctcggtgagcagatgcggacagcaa

SEQ ID NO: 88128 - DNA, 25 bp, E. coli
ctcggtgagcagttgcggacagcaa

SEQ ID NO: 88129 - DNA, 25 bp, E. coli
ctgaaaccaccattgtaacggtgat

SEQ ID NO: 88130 - DNA, 25 bp, E. coli
ctgaaaccaccaatgtaacggtgat

SEQ ID NO: 88131 - DNA, 25 bp, E. coli
taacggtgattatcgacgcggtgag

SEQ ID NO: 88132 - DNA, 25 bp, E. coli
taacggtgattaacgacgcggtgag

SEQ ID NO: 88133 - DNA, 25 bp, E. coli
gaccgcgctctttcaggcgttcgat

SEQ ID NO: 88134 - DNA, 25 bp, E. coli
gaccgcgctcttacaggcgttcgat

SEQ ID NO: 88135 - DNA, 25 bp, E. coli
caatacgaacgacggcaatgattgc

SEQ ID NO: 88136 - DNA, 25 bp, E. coli
caatacgaacgagggcaatgattgc

SEQ ID NO: 88137 - DNA, 25 bp, E. coli
caatcggaatgcatggttaagcctg

SEQ ID NO: 88138 - DNA, 25 bp, E. coli
caatcggaatgcttggttaagcctg

SEQ ID NO: 88139 - DNA, 25 bp, E. coli
taaatgggcaattcgaacgacggca

SEQ ID NO: 88140 - DNA, 25 bp, E. coli
taaatgggcaatacgaacgacggca

SEQ ID NO: 88141 - DNA, 25 bp, E. coli
tgggaaatatgtcgataaatgggca

SEQ ID NO: 88142 - DNA, 25 bp, E. coli
tgggaaatatgtggataaatgggca

SEQ ID NO: 88143 - DNA, 25 bp, E. coli
gccagagaacttggtaaacagaaca

SEQ ID NO: 88144 - DNA, 25 bp, E. coli
gccagagaacttcgtaaacagaaca

SEQ ID NO: 88145 - DNA, 25 bp, E. coli
cctgtaatggaacatgggaaatatg

SEQ ID NO: 88146 - DNA, 25 bp, E. coli
cctgtaatggaagatgggaaatatg

SEQ ID NO: 88147 - DNA, 25 bp, E. coli
gcaatgattgcctgagaacttggta

SEQ ID NO: 88148 - DNA, 25 bp, E. coli
gcaatgattgccagagaacttggta

SEQ ID NO: 88149 - DNA, 25 bp, E. coli
cgatgcaatggatgcaagctgcaat

SEQ ID NO: 88150 - DNA, 25 bp, E. coli
cgatgcaatggaagcaagctgcaat

SEQ ID NO: 88151 - DNA, 25 bp, E. coli
gttaagcctgaacaaatgtttcctg

SEQ ID NO: 88152 - DNA, 25 bp, E. coli
gtaaacagaacaacaaagctgcctg

SEQ ID NO: 88153 - DNA, 25 bp, E. coli
gttaagcctgaagaaatgtttcctg

SEQ ID NO: 88154 - DNA, 25 bp, E. coli
ggatgcaagctggaatcggaatgca

SEQ ID NO: 88155 - DNA, 25 bp, E. coli
gtaaacagaacatcaaagctgcctg

SEQ ID NO: 88156 - DNA, 25 bp, E. coli
ggatgcaagctgcaatcggaatgca

SEQ ID NO: 88157 - DNA, 25 bp, E. coli
tatcagtgacagcatcgcaaccagc

SEQ ID NO: 88158 - DNA, 25 bp, E. coli
tatcagtgacaggatcgcaaccagc

SEQ ID NO: 88159 - DNA, 25 bp, E. coli
tgttttcaaagacgcgcagcactac

SEQ ID NO: 88160 - DNA, 25 bp, E. coli
tgttttcaaagaggcgcagcactac

SEQ ID NO: 88161 - DNA, 25 bp, E. coli
tcattcaggaaatgaccgggagcaa

SEQ ID NO: 88162 - DNA, 25 bp, E. coli
tcattcaggaaaagaccgggagcaa

SEQ ID NO: 88163 - DNA, 25 bp, E. coli
gctaaaccagtatccttgctcagag

SEQ ID NO: 88164 - DNA, 25 bp, E. coli
gctaaaccagtaaccttgctcagag

SEQ ID NO: 88165 - DNA, 25 bp, E. coli
gcacaagtagttcgctccgtcctga

SEQ ID NO: 88166 - DNA, 25 bp, E. coli
gaagctatcgctattgccactgagg

SEQ ID NO: 88167 - DNA, 25 bp, E. coli
gaagctatcgcttttgccactgagg

SEQ ID NO: 88168 - DNA, 25 bp, E. coli
gcacaagtagttggctccgtcctga

SEQ ID NO: 88169 - DNA, 25 bp, E. coli
gaaaaattaccccacaacggctgag

SEQ ID NO: 88170 - DNA, 25 bp, E. coli
gaaaaattacccgacaacggctgag

SEQ ID NO: 88171 - DNA, 25 bp, E. coli
cttgatgagtatatcgccgctgggc

SEQ ID NO: 88172 - DNA, 25 bp, E. coli
cttgatgagtatttcgccgctgggc

SEQ ID NO: 88173 - DNA, 25 bp, E. coli
tcaacttcacaagcagagcgcggag

SEQ ID NO: 88174 - DNA, 25 bp, E. coli
tcaacttcacaaccagagcgcggag

SEQ ID NO: 88175 - DNA, 25 bp, E. coli
gagtttacgcgaagtagtagcccgc

SEQ ID NO: 88176 - DNA, 25 bp, E. coli
gagtttacgcgatgtagtagcccgc

SEQ ID NO: 88177 - DNA, 25 bp, E. coli
gagggttcacctccgacattccatg

SEQ ID NO: 88178 - DNA, 25 bp, E. coli
gagggttcacctgcgacattccatg

SEQ ID NO: 88179 - DNA, 25 bp, E. coli
aatcagtcgcggcaaagccgaacct

SEQ ID NO: 88180 - DNA, 25 bp, E. coli
aatcagtcgcgggaaagccgaacct

SEQ ID NO: 88181 - DNA, 25 bp, E. coli
caaaggccgcgcgagttatctcggt

SEQ ID NO: 88182 - DNA, 25 bp, E. coli
caaaggccgcgccagttatctcggt

SEQ ID NO: 88183 - DNA, 25 bp, E. coli
taactggctcacacgttgtggcgat

SEQ ID NO: 88184 - DNA, 25 bp, E. coli
aaaccatgtgtgatgtgtgggtgcc

SEQ ID NO: 88185 - DNA, 25 bp, E. coli
aaaccatgtgtgttgtgtgggtgcc

SEQ ID NO: 88186 - DNA, 25 bp, E. coli
ttatcagatgttccgcgatggcgcg

SEQ ID NO: 88187 - DNA, 25 bp, E. coli
ttatcagatgttgcgcgatggcgcg

SEQ ID NO: 88188 - DNA, 25 bp, E. coli
tgaacgcagtattggtcaccaggat

SEQ ID NO: 88189 - DNA, 25 bp, E. coli
tgaacgcagtataggtcaccaggat

SEQ ID NO: 88190 - DNA, 25 bp, E. coli
tgccggtggtggtatcgttacgtca

SEQ ID NO: 88191 - DNA, 25 bp, E. coli
tgccggtggtggaatcgttacgtca

SEQ ID NO: 88192 - DNA, 25 bp, E. coli
gccgaacctggcgataaaaccatgt

SEQ ID NO: 88193 - DNA, 25 bp, E. coli
gccgaacctggccataaaaccatgt

SEQ ID NO: 88194 - DNA, 25 bp, E. coli
cgctgcacaaagtacgattacgatg

SEQ ID NO: 88195 - DNA, 25 bp, E. coli
cgctgcacaaagaacgattacgatg

SEQ ID NO: 88196 - DNA, 25 bp, E. coli
gattacgatgcatgcccgcaaaggc

SEQ ID NO: 88197 - DNA, 25 bp, E. coli
gattacgatgcaagcccgcaaaggc

SEQ ID NO: 88198 - DNA, 25 bp, E. coli
taactggctcactcgttgtggcgat

SEQ ID NO: 88199 - DNA, 25 bp, E. coli
gatgcaaatgttggcgttagccgca

SEQ ID NO: 88200 - DNA, 25 bp, E. coli
gatgcaaatgttcgcgttagccgca

SEQ ID NO: 88201 - DNA, 25 bp, E. coli
tacgcagactgaagttgccaggcat

SEQ ID NO: 88202 - DNA, 25 bp, E. coli
agtaaaaacgatctgcctgatggcg

SEQ ID NO: 88203 - DNA, 25 bp, E. coli
agtaaaaacgatgtgcctgatggcg

SEQ ID NO: 88204 - DNA, 25 bp, E. coli
tacgcagactgatgttgccaggcat

SEQ ID NO: 88205 - DNA, 25 bp, E. coli
tgcctggcgcgatttttacatatcg

SEQ ID NO: 88206 - DNA, 25 bp, E. coli
tgcctggcgcgaattttacatatcg

SEQ ID NO: 88207 - DNA, 25 bp, E. coli
ccagatgggaacagacagcagaaca

SEQ ID NO: 88208 - DNA, 25 bp, E. coli
cctgatggcgattgcgaagacgact

SEQ ID NO: 88209 - DNA, 25 bp, E. coli
cctgatggcgatagcgaagacgact

SEQ ID NO: 88210 - DNA, 25 bp, E. coli
ccagatgggaactgacagcagaaca

SEQ ID NO: 88211 - DNA, 25 bp, E. coli
gcatttaagtctcaccgatcgccag

SEQ ID NO: 88212 - DNA, 25 bp, E. coli
gcttcgcagattgcagaaattgccg

SEQ ID NO: 88213 - DNA, 25 bp, E. coli
gcttcgcagattccagaaattgccg

SEQ ID NO: 88214 - DNA, 25 bp, E. coli
gcatttaagtctgaccgatcgccag

SEQ ID NO: 88215 - DNA, 25 bp, E. coli
gaagacgactatgaggagaaattgc

SEQ ID NO: 88216 - DNA, 25 bp, E. coli
gaagacgactatcaggagaaattgc

SEQ ID NO: 88217 - DNA, 25 bp, E. coli
ggtgccccgatatcgaataagcgag

SEQ ID NO: 88218 - DNA, 25 bp, E. coli
ggtgccccgataacgaataagcgag

SEQ ID NO: 88219 - DNA, 25 bp, E. coli
taagcgagggcatctggatctggat

SEQ ID NO: 88220 - DNA, 25 bp, E. coli
taagcgagggcaactggatctggat

SEQ ID NO: 88221 - DNA, 25 bp, E. coli
gagaaattgcttattgccagatggg

SEQ ID NO: 88222 - DNA, 25 bp, E. coli
gagaaattgctttttgccagatggg

SEQ ID NO: 88223 - DNA, 25 bp, E. coli
catgatggatgttccggtaggccgt

SEQ ID NO: 88224 - DNA, 25 bp, E. coli
catgatggatgtaccggtaggccgt

SEQ ID NO: 88225 - DNA, 25 bp, E. coli
cagtgccgggatgactgccaaagta

SEQ ID NO: 88226 - DNA, 25 bp, E. coli
cagtgccgggatcactgccaaagta

SEQ ID NO: 88227 - DNA, 25 bp, E. coli
gactggtccgccattctggaacagg

SEQ ID NO: 88228 - DNA, 25 bp, E. coli
gactggtccgcctttctggaacagg

SEQ ID NO: 88229 - DNA, 25 bp, E. coli
tgatgtcgccaaccagctgcatgtg

SEQ ID NO: 88230 - DNA, 25 bp, E. coli
tgatgtcgccaagcagctgcatgtg

SEQ ID NO: 88231 - DNA, 25 bp, E. coli
tcatgatcgatcatgcccataagga

SEQ ID NO: 88232 - DNA, 25 bp, E. coli
tcatgatcgatcttgcccataagga

SEQ ID NO: 88233 - DNA, 25 bp, E. coli
gccgttttgtgcgaagccctgaatc

SEQ ID NO: 88234 - DNA, 25 bp, E. coli
gccgttttgtgccaagccctgaatc

SEQ ID NO: 88235 - DNA, 25 bp, E. coli
gattgccgatatgcaagccaaaggc

SEQ ID NO: 88236 - DNA, 25 bp, E. coli
gattgccgatatccaagccaaaggc

SEQ ID NO: 88237 - DNA, 25 bp, E. coli
gggatccgcgttaagctcatcaaca

SEQ ID NO: 88238 - DNA, 25 bp, E. coli
gggatccgcgtttagctcatcaaca

SEQ ID NO: 88239 - DNA, 25 bp, E. coli
tggcggcaccgcagaacaagttgaa

SEQ ID NO: 88240 - DNA, 25 bp, E. coli
tggcggcaccgctgaacaagttgaa

SEQ ID NO: 88241 - DNA, 25 bp, E. coli
tcaaagtgatgaccggtaccgccgc

SEQ ID NO: 88242 - DNA, 25 bp, E. coli
tcacgggaggtttatagccaggcgc

SEQ ID NO: 88243 - DNA, 25 bp, E. coli
tcaaagtgatgagcggtaccgccgc

SEQ ID NO: 88244 - DNA, 25 bp, E. coli
tcacgggaggttaatagccaggcgc

SEQ ID NO: 88245 - DNA, 25 bp, E. coli
cacactgggtcagtcgctgatgaaa

SEQ ID NO: 88246 - DNA, 25 bp, E. coli
cacgggcctcgcgattattttgatt

SEQ ID NO: 88247 - DNA, 25 bp, E. coli
cacgggcctcgccattattttgatt

SEQ ID NO: 88248 - DNA, 25 bp, E. coli
cacactgggtcactcgctgatgaaa

SEQ ID NO: 88249 - DNA, 25 bp, E. coli
agcgtcacgggcgtcgcgattattt

SEQ ID NO: 88250 - DNA, 25 bp, E. coli
agcgtcacgggcctcgcgattattt

SEQ ID NO: 88251 - DNA, 25 bp, E. coli
acagatcaaaaacgtgggcgatcgc

SEQ ID NO: 88252 - DNA, 25 bp, E. coli
acagatcaaaaaggtgggcgatcgc

SEQ ID NO: 88253 - DNA, 25 bp, E. coli
tgctgctgccgatcccgcgtctgaa

SEQ ID NO: 88254 - DNA, 25 bp, E. coli
tgctgctgccgaacccgcgtctgaa

SEQ ID NO: 88255 - DNA, 25 bp, E. coli
tcagtcgctgatgaaacacggagaa

SEQ ID NO: 88256 - DNA, 25 bp, E. coli
tcagtcgctgatcaaacacggagaa

SEQ ID NO: 88257 - DNA, 25 bp, E. coli
ccaacagatcaaaaacgtgggcgat

SEQ ID NO: 88258 - DNA, 25 bp, E. coli
ccaacagatcaataacgtgggcgat

SEQ ID NO: 88259 - DNA, 25 bp, E. coli
gctgcgccaacacatcaaaaacgtg

SEQ ID NO: 88260 - DNA, 25 bp, E. coli
gctgcgccaacagatcaaaaacgtg

SEQ ID NO: 88261 - DNA, 25 bp, E. coli
gaaaaccaataagccggaacagctg

SEQ ID NO: 88262 - DNA, 25 bp, E. coli
gaaaaccaataacccggaacagctg

SEQ ID NO: 88263 - DNA, 25 bp, E. coli
cgcgattattttgattctggcgatg

SEQ ID NO: 88264 - DNA, 25 bp, E. coli
cgatcccgcgtcagaaaaccaataa

SEQ ID NO: 88265 - DNA, 25 bp, E. coli
cgatcccgcgtctgaaaaccaataa

SEQ ID NO: 88266 - DNA, 25 bp, E. coli
cgcgattattttcattctggcgatg

SEQ ID NO: 88267 - DNA, 25 bp, E. coli
aatcactatcgatggacgggtattg

SEQ ID NO: 88268 - DNA, 25 bp, E. coli
aatcactatcgaaggacgggtattg

SEQ ID NO: 88269 - DNA, 25 bp, E. coli
cataccttgcagacaggtgttgaaa

SEQ ID NO: 88270 - DNA, 25 bp, E. coli
cataccttgcagtcaggtgttgaaa

SEQ ID NO: 88271 - DNA, 25 bp, E. coli
ttaagtcgcgatccttcaacttgcc

SEQ ID NO: 88272 - DNA, 25 bp, E. coli
ttaagtcgcgatgcttcaacttgcc

SEQ ID NO: 88273 - DNA, 25 bp, E. coli
tgcagtcaggtgatgaaacagcgcg

SEQ ID NO: 88274 - DNA, 25 bp, E. coli
tgcagtcaggtgttgaaacagcgcg

SEQ ID NO: 88275 - DNA, 25 bp, E. coli
gccagcgattatccgtgaaaaacca

SEQ ID NO: 88276 - DNA, 25 bp, E. coli
gccagcgattatgcgtgaaaaacca

SEQ ID NO: 88277 - DNA, 25 bp, E. coli
cctgcggctgactaatgaaggtcgt

SEQ ID NO: 88278 - DNA, 25 bp, E. coli
cctgcggctgacaaatgaaggtcgt

SEQ ID NO: 88279 - DNA, 25 bp, E. coli
gaaatcactatccaaggacgggtat

SEQ ID NO: 88280 - DNA, 25 bp, E. coli
gaaatcactatcgaaggacgggtat

SEQ ID NO: 88281 - DNA, 25 bp, E. coli
cgcgtaccgctggatgaacttacgc

SEQ ID NO: 88282 - DNA, 25 bp, E. coli
cgcgtaccgctgcatgaacttacgc

SEQ ID NO: 88283 - DNA, 25 bp, E. coli
cttaatgcgccagcgattatgcgtg

SEQ ID NO: 88284 - DNA, 25 bp, E. coli
cttaatgcgccaccgattatgcgtg

SEQ ID NO: 88285 - DNA, 25 bp, E. coli
ggtgttgaaacaccgcgcgtaccgc

SEQ ID NO: 88286 - DNA, 25 bp, E. coli
ggtgttgaaacagcgcgcgtaccgc

SEQ ID NO: 88287 - DNA, 25 bp, E. coli
gatgcttcaacttgcctgcggctga

SEQ ID NO: 88288 - DNA, 25 bp, E. coli
gatgcttcaactagcctgcggctga

SEQ ID NO: 88289 - DNA, 25 bp, E. coli
taaaaatgtggagcaaaggcgtgcc

SEQ ID NO: 88290 - DNA, 25 bp, E. coli
taaaaatgtggaccaaaggcgtgcc

SEQ ID NO: 88291 - DNA, 25 bp, E. coli
aaaagctttatcgtccgtgggctgg

SEQ ID NO: 88292 - DNA, 25 bp, E. coli
aaaagctttatcctccgtgggctgg

SEQ ID NO: 88293 - DNA, 25 bp, E. coli
actataaacacctgggaacgctggg

SEQ ID NO: 88294 - DNA, 25 bp, E. coli
actataaacaccagggaacgctggg

SEQ ID NO: 88295 - DNA, 25 bp, E. coli
ttatgctgcactccggttcacgcgg

SEQ ID NO: 88296 - DNA, 25 bp, E. coli
ttatgctgcactgcggttcacgcgg

SEQ ID NO: 88297 - DNA, 25 bp, E. coli
tgattacctgaaagccgtggcctgg

SEQ ID NO: 88298 - DNA, 25 bp, E. coli
tgattacctgaatgccgtggcctgg

SEQ ID NO: 88299 - DNA, 25 bp, E. coli
tgatggcggcactaagcgatctggt

SEQ ID NO: 88300 - DNA, 25 bp, E. coli
tgatggcggcacaaagcgatctggt

SEQ ID NO: 88301 - DNA, 25 bp, E. coli
tccaccattggtagcgtgatcccga

SEQ ID NO: 88302 - DNA, 25 bp, E. coli
tccaccattggttgcgtgatcccga

SEQ ID NO: 88303 - DNA, 25 bp, E. coli
gccgatgcgcgtcagcaacttatta

SEQ ID NO: 88304 - DNA, 25 bp, E. coli
gccgatgcgcgtgagcaacttatta

SEQ ID NO: 88305 - DNA, 25 bp, E. coli
gaagagtcgttcagttcgtgcagcc

SEQ ID NO: 88306 - DNA, 25 bp, E. coli
gaagagtcgttctgttcgtgcagcc

SEQ ID NO: 88307 - DNA, 25 bp, E. coli
ctttttgccagcgttaaccgcgatg

SEQ ID NO: 88308 - DNA, 25 bp, E. coli
ctttttgccagccttaaccgcgatg

SEQ ID NO: 88309 - DNA, 25 bp, E. coli
taatgcctgatgtacacctgggtaa

SEQ ID NO: 88310 - DNA, 25 bp, E. coli
taatgcctgatgaacacctgggtaa

SEQ ID NO: 88311 - DNA, 25 bp, E. coli
tacagatgctcagttccttcatcac

SEQ ID NO: 88312 - DNA, 25 bp, E. coli
tagtcgacagtgagtttacacgtaa

SEQ ID NO: 88313 - DNA, 25 bp, E. coli
tacacgtaaattaaaatatgcacgc

SEQ ID NO: 88314 - DNA, 25 bp, E. coli
tacagatgctcacttccttcatcac

SEQ ID NO: 88315 - DNA, 25 bp, E. coli
tagtcgacagtgtgtttacacgtaa

SEQ ID NO: 88316 - DNA, 25 bp, E. coli
tacacgtaaatttaaatatgcacgc

SEQ ID NO: 88317 - DNA, 25 bp, E. coli
tatgcacgcatgcattcggaaaaca

SEQ ID NO: 88318 - DNA, 25 bp, E. coli
tatgcacgcatggattcggaaaaca

SEQ ID NO: 88319 - DNA, 25 bp, E. coli
ttatcccgggtgatgaaaatgcacc

SEQ ID NO: 88320 - DNA, 25 bp, E. coli
ttatcccgggtgttgaaaatgcacc

SEQ ID NO: 88321 - DNA, 25 bp, E. coli
tgatattagtaatgagccttggcca

SEQ ID NO: 88322 - DNA, 25 bp, E. coli
tgatattagtaaagagccttggcca

SEQ ID NO: 88323 - DNA, 25 bp, E. coli
tccttcatcacccaatagtcgacag

SEQ ID NO: 88324 - DNA, 25 bp, E. coli
tccttcatcaccgaatagtcgacag

SEQ ID NO: 88325 - DNA, 25 bp, E. coli
gaaaatgcaccagtcaaacgtatga

SEQ ID NO: 88326 - DNA, 25 bp, E. coli
gaaaacatctatgttccgcctctta

SEQ ID NO: 88327 - DNA, 25 bp, E. coli
gaaaacatctatcttccgcctctta

SEQ ID NO: 88328 - DNA, 25 bp, E. coli
gaaaatgcaccactcaaacgtatga

SEQ ID NO: 88329 - DNA, 25 bp, E. coli
cgcatggattcgcaaaacatctatc

SEQ ID NO: 88330 - DNA, 25 bp, E. coli
cgcatggattcggaaaacatctatc

SEQ ID NO: 88331 - DNA, 25 bp, E. coli
gtaaagagccttggccatttaatta

SEQ ID NO: 88332 - DNA, 25 bp, E. coli
gtaaagagccttcgccatttaatta

SEQ ID NO: 88333 - DNA, 25 bp, E. coli
aatgaagatgccgtcggtgaagccg

SEQ ID NO: 88334 - DNA, 25 bp, E. coli
aatgaagatgccctcggtgaagccg

SEQ ID NO: 88335 - DNA, 25 bp, E. coli
taaaccgatggtcaaccaggtcgag

SEQ ID NO: 88336 - DNA, 25 bp, E. coli
taaaccgatggtgaaccaggtcgag

SEQ ID NO: 88337 - DNA, 25 bp, E. coli
taggtggtggacgacataaaccctt

SEQ ID NO: 88338 - DNA, 25 bp, E. coli
taggtggtggaccacataaaccctt

SEQ ID NO: 88339 - DNA, 25 bp, E. coli
tataacgtctaatttgtgggtgcag

SEQ ID NO: 88340 - DNA, 25 bp, E. coli
tataacgtctaaattgtgggtgcag

SEQ ID NO: 88341 - DNA, 25 bp, E. coli
tgcgtggcgtgctctcgaagatgcc

SEQ ID NO: 88342 - DNA, 25 bp, E. coli
tgcgtggcgtgcactcgaagatgcc

SEQ ID NO: 88343 - DNA, 25 bp, E. coli
tccgaaatcgacacatcaacagcgt

SEQ ID NO: 88344 - DNA, 25 bp, E. coli
tccgaaatcgactcatcaacagcgt

SEQ ID NO: 88345 - DNA, 25 bp, E. coli
gcagcagcaggttttgaagcatcat

SEQ ID NO: 88346 - DNA, 25 bp, E. coli
gcagcagcaggtattgaagcatcat

SEQ ID NO: 88347 - DNA, 25 bp, E. coli
gaagtattataaggtgcagcctgaa

SEQ ID NO: 88348 - DNA, 25 bp, E. coli
gaagtattataacgtgcagcctgaa

SEQ ID NO: 88349 - DNA, 25 bp, E. coli
gactcatcgacactgcagcggtata

SEQ ID NO: 88350 - DNA, 25 bp, E. coli
gactcatcgacagtgcagcggtata

SEQ ID NO: 88351 - DNA, 25 bp, E. coli
ctattttgcccatccagaggcgctg

SEQ ID NO: 88352 - DNA, 25 bp, E. coli
ctattttgcccaaccagaggcgctg

SEQ ID NO: 88353 - DNA, 25 bp, E. coli
gaggcgctggcaaccatgaagtatt

SEQ ID NO: 88354 - DNA, 25 bp, E. coli
gaggcgctggcatccatgaagtatt

SEQ ID NO: 88355 - DNA, 25 bp, E. coli
aagatagagcgagccgccgttcagg

SEQ ID NO: 88356 - DNA, 25 bp, E. coli
aagatagagcgacccgccgttcagg

SEQ ID NO: 88357 - DNA, 25 bp, E. coli
tatacgcagggctgcaagaagatag

SEQ ID NO: 88358 - DNA, 25 bp, E. coli
tatacgcagggcagcaagaagatag

SEQ ID NO: 88359 - DNA, 25 bp, E. coli
ttttcagaccaatacgcgttatgcc

SEQ ID NO: 88360 - DNA, 25 bp, E. coli
ttttcagaccaaaacgcgttatgcc

SEQ ID NO: 88361 - DNA, 25 bp, E. coli
tccgcgagccgctatatacgcaggg

SEQ ID NO: 88362 - DNA, 25 bp, E. coli
tccgcgagccgcaatatacgcaggg

SEQ ID NO: 88363 - DNA, 25 bp, E. coli
gccgttcaggtctactactgacgaa

SEQ ID NO: 88364 - DNA, 25 bp, E. coli
gccgttcaggtcaactactgacgaa

SEQ ID NO: 88365 - DNA, 25 bp, E. coli
cgttatgcctgcatgaaagcaggag

SEQ ID NO: 88366 - DNA, 25 bp, E. coli
cgttatgcctgcttgaaagcaggag

SEQ ID NO: 88367 - DNA, 25 bp, E. coli
ctgcaagaagatagagcgagccgcc

SEQ ID NO: 88368 - DNA, 25 bp, E. coli
ctgcaagaagattgagcgagccgcc

SEQ ID NO: 88369 - DNA, 25 bp, E. coli
gattgcaaatccgacaaaaagtggg

SEQ ID NO: 88370 - DNA, 25 bp, E. coli
gattgcaaatcccacaaaaagtggg

SEQ ID NO: 88371 - DNA, 25 bp, E. coli
ggtcaactactgacgaacaaatctt

SEQ ID NO: 88372 - DNA, 25 bp, E. coli
ggtcaactactgtcgaacaaatctt

SEQ ID NO: 88373 - DNA, 25 bp, E. coli
gagccgcaatatacgcagggctgca

SEQ ID NO: 88374 - DNA, 25 bp, E. coli
gagccgcaatattcgcagggctgca

SEQ ID NO: 88375 - DNA, 25 bp, E. coli
tgacgaacaaatgttttgcgaaggg

SEQ ID NO: 88376 - DNA, 25 bp, E. coli
tgacgaacaaatcttttgcgaaggg

SEQ ID NO: 88377 - DNA, 25 bp, E. coli
taccggacgtaatccgaagactggc

SEQ ID NO: 88378 - DNA, 25 bp, E. coli
atatggcctcgagtcttgcgcaggg

SEQ ID NO: 88379 - DNA, 25 bp, E. coli
atatggcctcgactcttgcgcaggg

SEQ ID NO: 88380 - DNA, 25 bp, E. coli
taccggacgtaaaccgaagactggc

SEQ ID NO: 88381 - DNA, 25 bp, E. coli
tgatagaaagacttgccacccagca

SEQ ID NO: 88382 - DNA, 25 bp, E. coli
tgatagaaagacatgccacccagca

SEQ ID NO: 88383 - DNA, 25 bp, E. coli
tgaaatccgcggtttcggcagtttc

SEQ ID NO: 88384 - DNA, 25 bp, E. coli
tgaaatccgcggattcggcagtttc

SEQ ID NO: 88385 - DNA, 25 bp, E. coli
tgcgcagggcgaccgtattgaaatc

SEQ ID NO: 88386 - DNA, 25 bp, E. coli
tgcgcagggcgagcgtattgaaatc

SEQ ID NO: 88387 - DNA, 25 bp, E. coli
gcgcgatcgcgccaatatttacggt

SEQ ID NO: 88388 - DNA, 25 bp, E. coli
ccaagacggttgaagatgcagtaaa

SEQ ID NO: 88389 - DNA, 25 bp, E. coli
gcgcgatcgcgcgaatatttacggt

SEQ ID NO: 88390 - DNA, 25 bp, E. coli
ccaagacggttgtagatgcagtaaa

SEQ ID NO: 88391 - DNA, 25 bp, E. coli
gcacattcccgcgaagacggttgaa

SEQ ID NO: 88392 - DNA, 25 bp, E. coli
gcacattcccgccaagacggttgaa

SEQ ID NO: 88393 - DNA, 25 bp, E. coli
gactggcgataatgtagaactggaa

SEQ ID NO: 88394 - DNA, 25 bp, E. coli
gactggcgataaagtagaactggaa

SEQ ID NO: 88395 - DNA, 25 bp, E. coli
ggcagtttctctatgcactaccgcg

SEQ ID NO: 88396 - DNA, 25 bp, E. coli
ggcagtttctctttgcactaccgcg

SEQ ID NO: 88397 - DNA, 25 bp, E. coli
gatgctggagcaaatggcctcgact

SEQ ID NO: 88398 - DNA, 25 bp, E. coli
gatgctggagcatatggcctcgact

SEQ ID NO: 88399 - DNA, 25 bp, E. coli
caaacaggcgttgatgacgtcggca

SEQ ID NO: 88400 - DNA, 25 bp, E. coli
caaacaggcgttcatgacgtcggca

SEQ ID NO: 88401 - DNA, 25 bp, E. coli
tactatagtcgttgccgaaggtgct

SEQ ID NO: 88402 - DNA, 25 bp, E. coli
tactatagtcgtagccgaaggtgct

SEQ ID NO: 88403 - DNA, 25 bp, E. coli
tagatgaggtaacaaaaccgtccgg

SEQ ID NO: 88404 - DNA, 25 bp, E. coli
tattttaatcgtcagcggttcccga

SEQ ID NO: 88405 - DNA, 25 bp, E. coli
tagatgaggtaagaaaaccgtccgg

SEQ ID NO: 88406 - DNA, 25 bp, E. coli
tattttaatcgtgagcggttcccga

SEQ ID NO: 88407 - DNA, 25 bp, E. coli
tgattcggtcgctgctcacatggaa

SEQ ID NO: 88408 - DNA, 25 bp, E. coli
tgattcggtcgcagctcacatggaa

SEQ ID NO: 88409 - DNA, 25 bp, E. coli
tctattaagaacctgtgccaacgag

SEQ ID NO: 88410 - DNA, 25 bp, E. coli
tctattaagaacgtgtgccaacgag

SEQ ID NO: 88411 - DNA, 25 bp, E. coli
cgagaaggtgaggtgcccatacgta

SEQ ID NO: 88412 - DNA, 25 bp, E. coli
cgattacgatgaaacctcggcggtt

SEQ ID NO: 88413 - DNA, 25 bp, E. coli
cgagaaggtgagctgcccatacgta

SEQ ID NO: 88414 - DNA, 25 bp, E. coli
cgattacgatgatacctcggcggtt

SEQ ID NO: 88415 - DNA, 25 bp, E. coli
cgtccgggccaacgacatgggatat

SEQ ID NO: 88416 - DNA, 25 bp, E. coli
cgtccgggccaaggacatgggatat

SEQ ID NO: 88417 - DNA, 25 bp, E. coli
gattgaagaaggaacatcgctggca

SEQ ID NO: 88418 - DNA, 25 bp, E. coli
gattgaagaaggtacatcgctggca

SEQ ID NO: 88419 - DNA, 25 bp, E. coli
gacgccgccagtagtcttgatgaac

SEQ ID NO: 88420 - DNA, 25 bp, E. coli
gacgccgccagttgtcttgatgaac

SEQ ID NO: 88421 - DNA, 25 bp, E. coli
caagtgtaagggtgtttgcccggct

SEQ ID NO: 88422 - DNA, 25 bp, E. coli
caagtgtaagggagtttgcccggct

SEQ ID NO: 88423 - DNA, 25 bp, E. coli
taaaaacgacatagccggattcggc

SEQ ID NO: 88424 - DNA, 25 bp, E. coli
taaaaacgacattgccggattcggc

SEQ ID NO: 88425 - DNA, 25 bp, E. coli
tacgcatgacattacgcaaacagcc

SEQ ID NO: 88426 - DNA, 25 bp, E. coli
tacgcatgacataacgcaaacagcc

SEQ ID NO: 88427 - DNA, 25 bp, E. coli
tattttcatgctgccctggtacacg

SEQ ID NO: 88428 - DNA, 25 bp, E. coli
tattttcatgctcccctggtacacg

SEQ ID NO: 88429 - DNA, 25 bp, E. coli
tttccacgcctgtagataaccatga

SEQ ID NO: 88430 - DNA, 25 bp, E. coli
tttccacgcctgaagataaccatga

SEQ ID NO: 88431 - DNA, 25 bp, E. coli
tgttcgtccacaacaacactggctg

SEQ ID NO: 88432 - DNA, 25 bp, E. coli
tgttcgtccacatcaacactggctg

SEQ ID NO: 88433 - DNA, 25 bp, E. coli
tcgtggacctgcattacatgacgcc

SEQ ID NO: 88434 - DNA, 25 bp, E. coli
tcgtggacctgctttacatgacgcc

SEQ ID NO: 88435 - DNA, 25 bp, E. coli
gaagtgctggctcattatctcaaga

SEQ ID NO: 88436 - DNA, 25 bp, E. coli
gaagtgctggctgattatctcaaga

SEQ ID NO: 88437 - DNA, 25 bp, E. coli
cgttcagcattctcggtgtcgccat

SEQ ID NO: 88438 - DNA, 25 bp, E. coli
cgttcagcattcacggtgtcgccat

SEQ ID NO: 88439 - DNA, 25 bp, E. coli
cgtaatcacgtttaatagggcgact

SEQ ID NO: 88440 - DNA, 25 bp, E. coli
cgtaatcacgttaaatagggcgact

SEQ ID NO: 88441 - DNA, 25 bp, E. coli
gatatcctcgcggttactactcaat

SEQ ID NO: 88442 - DNA, 25 bp, E. coli
gatatcctcgcgcttactactcaat

SEQ ID NO: 88443 - DNA, 25 bp, E. coli
aagtccggcaagtgtgaggagcaca

SEQ ID NO: 88444 - DNA, 25 bp, E. coli
aagtccggcaagagtgaggagcaca

SEQ ID NO: 88445 - DNA, 25 bp, E. coli
catcaaccattgtgtcaggcgtgcc

SEQ ID NO: 88446 - DNA, 25 bp, E. coli
catcaaccattgagtcaggcgtgcc

SEQ ID NO: 88447 - DNA, 25 bp, E. coli
taaaaacccgttatgcgtgcgatgc

SEQ ID NO: 88448 - DNA, 25 bp, E. coli
taaaaacccgttttgcgtgcgatgc

SEQ ID NO: 88449 - DNA, 25 bp, E. coli
aaaacgaaatgggttgatccggcaa

SEQ ID NO: 88450 - DNA, 25 bp, E. coli
aaaacgaaatggcttgatccggcaa

SEQ ID NO: 88451 - DNA, 25 bp, E. coli
tgatgatgttctcttctggcccgaa

SEQ ID NO: 88452 - DNA, 25 bp, E. coli
tgatgatgttctgttctggcccgaa

SEQ ID NO: 88453 - DNA, 25 bp, E. coli
tccagacagtggcacaaataccgcg

SEQ ID NO: 88454 - DNA, 25 bp, E. coli
tccagacagtgggacaaataccgcg

SEQ ID NO: 88455 - DNA, 25 bp, E. coli
tcaggcgtgccaaaaccagaaaacg

SEQ ID NO: 88456 - DNA, 25 bp, E. coli
tcaggcgtgccataaccagaaaacg

SEQ ID NO: 88457 - DNA, 25 bp, E. coli
gccatgtatctgtgtaaaaacccgt

SEQ ID NO: 88458 - DNA, 25 bp, E. coli
gccatgtatctgagtaaaaacccgt

SEQ ID NO: 88459 - DNA, 25 bp, E. coli
cccgccgtggtgctggatcacatta

SEQ ID NO: 88460 - DNA, 25 bp, E. coli
cccgccgtggtggtggatcacatta

SEQ ID NO: 88461 - DNA, 25 bp, E. coli
ggccgctaaccgcaataactggatg

SEQ ID NO: 88462 - DNA, 25 bp, E. coli
ggccgctaaccggaataactggatg

SEQ ID NO: 88463 - DNA, 25 bp, E. coli
gatccggcaacaaaaagcaagcgtg

SEQ ID NO: 88464 - DNA, 25 bp, E. coli
gatccggcaacataaagcaagcgtg

SEQ ID NO: 88465 - DNA, 25 bp, E. coli
cacttccgtagcaccagatatcgag

SEQ ID NO: 88466 - DNA, 25 bp, E. coli
cacttccgtagctccagatatcgag

SEQ ID NO: 88467 - DNA, 25 bp, E. coli
cagatatcgagtggcttattcaacc

SEQ ID NO: 88468 - DNA, 25 bp, E. coli
cagatatcgagtcgcttattcaacc

SEQ ID NO: 88469 - DNA, 25 bp, E. coli
catagtaagcgtagaaaaatgtaac

SEQ ID NO: 88470 - DNA, 25 bp, E. coli
catagtaagcgttgaaaaatgtaac

SEQ ID NO: 88471 - DNA, 25 bp, E. coli
taaaccgtgtggtcacttccgtagc

SEQ ID NO: 88472 - DNA, 25 bp, E. coli
taaaccgtgtggacacttccgtagc

SEQ ID NO: 88473 - DNA, 25 bp, E. coli
taaagaaaaattaagcaagctggat

SEQ ID NO: 88474 - DNA, 25 bp, E. coli
taaagaaaaatttagcaagctggat

SEQ ID NO: 88475 - DNA, 25 bp, E. coli
tatatagcaagacgtttcaggtgcg

SEQ ID NO: 88476 - DNA, 25 bp, E. coli
tatatagcaagaggtttcaggtgcg

SEQ ID NO: 88477 - DNA, 25 bp, E. coli
tgatgttatgcttttgcgccccaaa

SEQ ID NO: 88478 - DNA, 25 bp, E. coli
tgatgttatgctattgcgccccaaa

SEQ ID NO: 88479 - DNA, 25 bp, E. coli
tgcgccccaaaaggttgtttagatg

SEQ ID NO: 88480 - DNA, 25 bp, E. coli
tgcgccccaaaacgttgtttagatg

SEQ ID NO: 88481 - DNA, 25 bp, E. coli
gaatgtgacttgttaagaaatgcaa

SEQ ID NO: 88482 - DNA, 25 bp, E. coli
gaatgtgacttgataagaaatgcaa

SEQ ID NO: 88483 - DNA, 25 bp, E. coli
gtatcgggtgctcctaaaccgtgtg

SEQ ID NO: 88484 - DNA, 25 bp, E. coli
gtatcgggtgctgctaaaccgtgtg

SEQ ID NO: 88485 - DNA, 25 bp, E. coli
tcaaacggttgacatatatatagca

SEQ ID NO: 88486 - DNA, 25 bp, E. coli
tcaaacggttgagatatatatagca

SEQ ID NO: 88487 - DNA, 25 bp, E. coli
cgttaaaacggtgcaatcatagcta

SEQ ID NO: 88488 - DNA, 25 bp, E. coli
cgttaaaacggtccaatcatagcta

SEQ ID NO: 88489 - DNA, 25 bp, E. coli
taaaattcgttcttccatgcccggt

SEQ ID NO: 88490 - DNA, 25 bp, E. coli
taaaattcgttcatccatgcccggt

SEQ ID NO: 88491 - DNA, 25 bp, E. coli
tagtgcttgagaaaaatgctcggcg

SEQ ID NO: 88492 - DNA, 25 bp, E. coli
tagtgcttgagataaatgctcggcg

SEQ ID NO: 88493 - DNA, 25 bp, E. coli
tacctcggcaaaagtgattattcac

SEQ ID NO: 88494 - DNA, 25 bp, E. coli
tacctcggcaaatgtgattattcac

SEQ ID NO: 88495 - DNA, 25 bp, E. coli
tatctccggtttttcttatgcaggg

SEQ ID NO: 88496 - DNA, 25 bp, E. coli
tatctccggtttatcttatgcaggg

SEQ ID NO: 88497 - DNA, 25 bp, E. coli
tgttatgacgctgttacctcggcaa

SEQ ID NO: 88498 - DNA, 25 bp, E. coli
tgttatgacgctcttacctcggcaa

SEQ ID NO: 88499 - DNA, 25 bp, E. coli
tgaacgccgaaggtcactttttaaa

SEQ ID NO: 88500 - DNA, 25 bp, E. coli
tgaacgccgaagctcactttttaaa

SEQ ID NO: 88501 - DNA, 25 bp, E. coli
tgaagtgttactcaacgccgaagct

SEQ ID NO: 88502 - DNA, 25 bp, E. coli
tgaagtgttactgaacgccgaagct

SEQ ID NO: 88503 - DNA, 25 bp, E. coli
taacgctccagaaaacggctttaat

SEQ ID NO: 88504 - DNA, 25 bp, E. coli
taacgctccagataacggctttaat

SEQ ID NO: 88505 - DNA, 25 bp, E. coli
gaaatcactcactgattgaaagcgg

SEQ ID NO: 88506 - DNA, 25 bp, E. coli
gaaatcactcacagattgaaagcgg

SEQ ID NO: 88507 - DNA, 25 bp, E. coli
tcactgttacatacgggttacaacg

SEQ ID NO: 88508 - DNA, 25 bp, E. coli
tcactgttacattcgggttacaacg

SEQ ID NO: 88509 - DNA, 25 bp, E. coli
aaccccttgataacaatgagaaaac

SEQ ID NO: 88510 - DNA, 25 bp, E. coli
taaaaccccttgatatcaatgagaa

SEQ ID NO: 88511 - DNA, 25 bp, E. coli
taaaaccccttgttatcaatgagaa

SEQ ID NO: 88512 - DNA, 25 bp, E. coli
agcaatttaaaagcccttgatatca

SEQ ID NO: 88513 - DNA, 25 bp, E. coli
atatggcccgctgggtgcaaagcaa

SEQ ID NO: 88514 - DNA, 25 bp, E. coli
atatggcccgctcggtgcaaagcaa

SEQ ID NO: 88515 - DNA, 25 bp, E. coli
agcaatttaaaaccccttgatatca

SEQ ID NO: 88516 - DNA, 25 bp, E. coli
aaccccttgatatcaatgagaaaac

SEQ ID NO: 88517 - DNA, 25 bp, E. coli
gcccgctgggtgcaaagcaatttaa

SEQ ID NO: 88518 - DNA, 25 bp, E. coli
gcccgctgggtggaaagcaatttaa

SEQ ID NO: 88519 - DNA, 25 bp, E. coli
gctgggtgcaaagcaatttaaaacc

SEQ ID NO: 88520 - DNA, 25 bp, E. coli
gctgggtgcaaaccaatttaaaacc

SEQ ID NO: 88521 - DNA, 25 bp, E. coli
gcaaagcaattttaaaccccttgat

SEQ ID NO: 88522 - DNA, 25 bp, E. coli
gcaaagcaatttaaaaccccttgat

SEQ ID NO: 88523 - DNA, 25 bp, E. coli
ccgctgggtgcaaagcaatttaaaa

SEQ ID NO: 88524 - DNA, 25 bp, E. coli
ccgctgggtgcatagcaatttaaaa

SEQ ID NO: 88525 - DNA, 25 bp, E. coli
gatatggcccgctgggtgcaaagca

SEQ ID NO: 88526 - DNA, 25 bp, E. coli
gatatggcccgcagggtgcaaagca

SEQ ID NO: 88527 - DNA, 25 bp, E. coli
gtgcaaagcaatataaaaccccttg

SEQ ID NO: 88528 - DNA, 25 bp, E. coli
gtgcaaagcaatttaaaaccccttg

SEQ ID NO: 88529 - DNA, 25 bp, E. coli
tggcccgctgggagcaaagcaattt

SEQ ID NO: 88530 - DNA, 25 bp, E. coli
tggcccgctgggtgcaaagcaattt

SEQ ID NO: 88531 - DNA, 25 bp, E. coli
taaatcgactctcctcggagaggcc

SEQ ID NO: 88532 - DNA, 25 bp, E. coli
taaatcgactctgctcggagaggcc

SEQ ID NO: 88533 - DNA, 25 bp, E. coli
agttcacgagtggagaatgccgccg

SEQ ID NO: 88534 - DNA, 25 bp, E. coli
agttcacgagtgcagaatgccgccg

SEQ ID NO: 88535 - DNA, 25 bp, E. coli
actctgctcggagaggccgttgcca

SEQ ID NO: 88536 - DNA, 25 bp, E. coli
actctgctcggacaggccgttgcca

SEQ ID NO: 88537 - DNA, 25 bp, E. coli
tctgctcggagacgccgttgccaaa

SEQ ID NO: 88538 - DNA, 25 bp, E. coli
tctgctcggagaggccgttgccaaa

SEQ ID NO: 88539 - DNA, 25 bp, E. coli
ccacaagccggagctggtttttgcg

SEQ ID NO: 88540 - DNA, 25 bp, E. coli
ccacaagccggacctggtttttgcg

SEQ ID NO: 88541 - DNA, 25 bp, E. coli
ccgaaaagcagtacacgagtgcaga

SEQ ID NO: 88542 - DNA, 25 bp, E. coli
gaatgccgccggagatatcgtttca

SEQ ID NO: 88543 - DNA, 25 bp, E. coli
gaatgccgccggtgatatcgtttca

SEQ ID NO: 88544 - DNA, 25 bp, E. coli
gcacatccgaaaagcagttcacgag

SEQ ID NO: 88545 - DNA, 25 bp, E. coli
gcacatccgaaatgcagttcacgag

SEQ ID NO: 88546 - DNA, 25 bp, E. coli
ccgaaaagcagttcacgagtgcaga

SEQ ID NO: 88547 - DNA, 25 bp, E. coli
gggcgcacatccgaaaagcagttca

SEQ ID NO: 88548 - DNA, 25 bp, E. coli
gggcgcacatcccaaaagcagttca

SEQ ID NO: 88549 - DNA, 25 bp, E. coli
tggatgggcgcacatccgaaaagca

SEQ ID NO: 88550 - DNA, 25 bp, E. coli
tggatgggcgcagatccgaaaagca

SEQ ID NO: 88551 - DNA, 25 bp, E. coli
gagtgataaatccactctgctcgga

SEQ ID NO: 88552 - DNA, 25 bp, E. coli
gagtgataaatcgactctgctcgga

SEQ ID NO: 88553 - DNA, 25 bp, E. coli
cactttccgtggtggatcgtcagag

SEQ ID NO: 88554 - DNA, 25 bp, E. coli
acaaatcagcgcgtgcgtgccactt

SEQ ID NO: 88555 - DNA, 25 bp, E. coli
acggtgtttttcgtcggcagctggc

SEQ ID NO: 88556 - DNA, 25 bp, E. coli
cactttccgtggaggatcgtcagag

SEQ ID NO: 88557 - DNA, 25 bp, E. coli
acggtgtttttcctcggcagctggc

SEQ ID NO: 88558 - DNA, 25 bp, E. coli
acaaatcagcgcctgcgtgccactt

SEQ ID NO: 88559 - DNA, 25 bp, E. coli
tacgcgtggtttttgccagtggcag

SEQ ID NO: 88560 - DNA, 25 bp, E. coli
tagcgttcgtctaccgcctgcatct

SEQ ID NO: 88561 - DNA, 25 bp, E. coli
tacgcgtggtttatgccagtggcag

SEQ ID NO: 88562 - DNA, 25 bp, E. coli
tatctacccgtacatttgtgcgacg

SEQ ID NO: 88563 - DNA, 25 bp, E. coli
tatctacccgtagatttgtgcgacg

SEQ ID NO: 88564 - DNA, 25 bp, E. coli
tagcgttcgtcttccgcctgcatct

SEQ ID NO: 88565 - DNA, 25 bp, E. coli
tgctgtggcgcaggctgacaaatca

SEQ ID NO: 88566 - DNA, 25 bp, E. coli
tgctgtggcgcacgctgacaaatca

SEQ ID NO: 88567 - DNA, 25 bp, E. coli
cctgatggtagccaaatgatgaagc

SEQ ID NO: 88568 - DNA, 25 bp, E. coli
cctgcatctggtcttgggaatgacc

SEQ ID NO: 88569 - DNA, 25 bp, E. coli
cctgcatctggtgttgggaatgacc

SEQ ID NO: 88570 - DNA, 25 bp, E. coli
cctgatggtagcgaaatgatgaagc

SEQ ID NO: 88571 - DNA, 25 bp, E. coli
gtgccacttccagtacgccggatat

SEQ ID NO: 88572 - DNA, 25 bp, E. coli
gtgccacttccactacgccggatat

SEQ ID NO: 88573 - DNA, 25 bp, E. coli
gagcattttgctgatccagtgtctg

SEQ ID NO: 88574 - DNA, 25 bp, E. coli
gagcattttgctcatccagtgtctg

SEQ ID NO: 88575 - DNA, 25 bp, E. coli
aatgcatttacaggaaaccttccgc

SEQ ID NO: 88576 - DNA, 25 bp, E. coli
aatgcatttacacgaaaccttccgc

SEQ ID NO: 88577 - DNA, 25 bp, E. coli
atggttccggtagcgtctgacgcct

SEQ ID NO: 88578 - DNA, 25 bp, E. coli
atggttccggtaccgtctgacgcct

SEQ ID NO: 88579 - DNA, 25 bp, E. coli
tgaagatttcttccccgttagcgcg

SEQ ID NO: 88580 - DNA, 25 bp, E. coli
tgagtttttaatgcgtcagcaaggg

SEQ ID NO: 88581 - DNA, 25 bp, E. coli
tgaagatttcttgcccgttagcgcg

SEQ ID NO: 88582 - DNA, 25 bp, E. coli
tgagtttttaatccgtcagcaaggg

SEQ ID NO: 88583 - DNA, 25 bp, E. coli
tccggttttggatgagttccagctt

SEQ ID NO: 88584 - DNA, 25 bp, E. coli
tccggttttggaagagttccagctt

SEQ ID NO: 88585 - DNA, 25 bp, E. coli
gcgcgctttggtgaaattgagcagc

SEQ ID NO: 88586 - DNA, 25 bp, E. coli
gcgcgctttggtcaaattgagcagc

SEQ ID NO: 88587 - DNA, 25 bp, E. coli
ccagtcgcgaaggatttgagcaggc

SEQ ID NO: 88588 - DNA, 25 bp, E. coli
ccagtcgcgaagcatttgagcaggc

SEQ ID NO: 88589 - DNA, 25 bp, E. coli
gaagaacgcagtaaacgtcgctgtg

SEQ ID NO: 88590 - DNA, 25 bp, E. coli
gaagaacgcagttaacgtcgctgtg

SEQ ID NO: 88591 - DNA, 25 bp, E. coli
gacaactgtatgttgatcttctgcg

SEQ ID NO: 88592 - DNA, 25 bp, E. coli
gacaactgtatgatgatcttctgcg

SEQ ID NO: 88593 - DNA, 25 bp, E. coli
gtcaaatctgggtaatgaaacgcag

SEQ ID NO: 88594 - DNA, 25 bp, E. coli
gtcaaatctgggaaatgaaacgcag

SEQ ID NO: 88595 - DNA, 25 bp, E. coli
tggaaccgggcaggataatctcact

SEQ ID NO: 88596 - DNA, 25 bp, E. coli
tggaaccgggcacgataatctcact

SEQ ID NO: 88597 - DNA, 25 bp, E. coli
aaaacttcgttatttcgcatggtga

SEQ ID NO: 88598 - DNA, 25 bp, E. coli
aaaacttcgttaattcgcatggtga

SEQ ID NO: 88599 - DNA, 25 bp, E. coli
tatactcggattgacagcacctgcg

SEQ ID NO: 88600 - DNA, 25 bp, E. coli
tatactcggattcacagcacctgcg

SEQ ID NO: 88601 - DNA, 25 bp, E. coli
ttcacagcacctccgggtggcagtt

SEQ ID NO: 88602 - DNA, 25 bp, E. coli
ttcacagcacctgcgggtggcagtt

SEQ ID NO: 88603 - DNA, 25 bp, E. coli
ggtctagagattctttccctccgta

SEQ ID NO: 88604 - DNA, 25 bp, E. coli
gctgaatcgttaaggatggtctaga

SEQ ID NO: 88605 - DNA, 25 bp, E. coli
ggtctagagattgtttccctccgta

SEQ ID NO: 88606 - DNA, 25 bp, E. coli
gctgaatcgttatggatggtctaga

SEQ ID NO: 88607 - DNA, 25 bp, E. coli
gcaacataaaaatgtggctgaatcg

SEQ ID NO: 88608 - DNA, 25 bp, E. coli
gcaacataaaaaagtggctgaatcg

SEQ ID NO: 88609 - DNA, 25 bp, E. coli
taaactaccgccactttatactcgg

SEQ ID NO: 88610 - DNA, 25 bp, E. coli
taaactaccgcctctttatactcgg

SEQ ID NO: 88611 - DNA, 25 bp, E. coli
cattgcgatttccttgagatccgaa

SEQ ID NO: 88612 - DNA, 25 bp, E. coli
cattgcgatttcgttgagatccgaa

SEQ ID NO: 88613 - DNA, 25 bp, E. coli
ggtgataatcacgtttctcaacgaa

SEQ ID NO: 88614 - DNA, 25 bp, E. coli
ggtgataatcacctttctcaacgaa

SEQ ID NO: 88615 - DNA, 25 bp, E. coli
tggcagttcgccgaccattgcgatt

SEQ ID NO: 88616 - DNA, 25 bp, E. coli
tggcagttcgcccaccattgcgatt

SEQ ID NO: 88617 - DNA, 25 bp, E. coli
tcaacgaatccctagattagtcaaa

SEQ ID NO: 88618 - DNA, 25 bp, E. coli
tcaacgaatcccaagattagtcaaa

SEQ ID NO: 88619 - DNA, 25 bp, E. coli
agcggtatacgcagtagtaccgcgc

SEQ ID NO: 88620 - DNA, 25 bp, E. coli
agcggtatacgctgtagtaccgcgc

SEQ ID NO: 88621 - DNA, 25 bp, E. coli
acgtcgatggtgatgagcttgccga

SEQ ID NO: 88622 - DNA, 25 bp, E. coli
acgtcgatggtgttgagcttgccga

SEQ ID NO: 88623 - DNA, 25 bp, E. coli
tatacgctgtagaaccgcgcatatc

SEQ ID NO: 88624 - DNA, 25 bp, E. coli
tatacgctgtagtaccgcgcatatc

SEQ ID NO: 88625 - DNA, 25 bp, E. coli
tggtgttgagcttgccgaactgatt

SEQ ID NO: 88626 - DNA, 25 bp, E. coli
tggtgttgagctagccgaactgatt

SEQ ID NO: 88627 - DNA, 25 bp, E. coli
tgagcttgccgatctgattaacgtg

SEQ ID NO: 88628 - DNA, 25 bp, E. coli
tgagcttgccgaactgattaacgtg

SEQ ID NO: 88629 - DNA, 25 bp, E. coli
tcgatggtgttgagcttgccgaact

SEQ ID NO: 88630 - DNA, 25 bp, E. coli
tcgatggtgttgtgcttgccgaact

SEQ ID NO: 88631 - DNA, 25 bp, E. coli
cgatggtgttgagcttgccgaactg

SEQ ID NO: 88632 - DNA, 25 bp, E. coli
cgatggtgttgaccttgccgaactg

SEQ ID NO: 88633 - DNA, 25 bp, E. coli
cgtcgatggtgttgagcttgccgaa

SEQ ID NO: 88634 - DNA, 25 bp, E. coli
cgtcgatggtgtagagcttgccgaa

SEQ ID NO: 88635 - DNA, 25 bp, E. coli
gttgagcttgccgaactgattaacg

SEQ ID NO: 88636 - DNA, 25 bp, E. coli
gttgagcttgcccaactgattaacg

SEQ ID NO: 88637 - DNA, 25 bp, E. coli
ggtatacgctgtagtaccgcgcata

SEQ ID NO: 88638 - DNA, 25 bp, E. coli
ggtatacgctgttgtaccgcgcata

SEQ ID NO: 88639 - DNA, 25 bp, E. coli
ggtgttgagcttgccgaactgatta

SEQ ID NO: 88640 - DNA, 25 bp, E. coli
ggtgttgagcttcccgaactgatta

SEQ ID NO: 88641 - DNA, 25 bp, E. coli
aacgcgaacggatactggcagaagc

SEQ ID NO: 88642 - DNA, 25 bp, E. coli
aacgcgaacggaaactggcagaagc

SEQ ID NO: 88643 - DNA, 25 bp, E. coli
tgaaataccgcaacgctttagctgt

SEQ ID NO: 88644 - DNA, 25 bp, E. coli
tgaataaagcccagagtgaagtccg

SEQ ID NO: 88645 - DNA, 25 bp, E. coli
tgaaataccgcatcgctttagctgt

SEQ ID NO: 88646 - DNA, 25 bp, E. coli
tgaataaagccctgagtgaagtccg

SEQ ID NO: 88647 - DNA, 25 bp, E. coli
tcgcaaagcagaaagatgaggtggc

SEQ ID NO: 88648 - DNA, 25 bp, E. coli
tcgcaaagcagatagatgaggtggc

SEQ ID NO: 88649 - DNA, 25 bp, E. coli
ccttaaggagatcagctatgccgaa

SEQ ID NO: 88650 - DNA, 25 bp, E. coli
ccttaaggagatgagctatgccgaa

SEQ ID NO: 88651 - DNA, 25 bp, E. coli
ccgaggcgaagctaaaaggcgatgc

SEQ ID NO: 88652 - DNA, 25 bp, E. coli
ccgaggcgaagcaaaaaggcgatgc

SEQ ID NO: 88653 - DNA, 25 bp, E. coli
gaagtccgggccaactgttcagata

SEQ ID NO: 88654 - DNA, 25 bp, E. coli
gaagtccgggcctactgttcagata

SEQ ID NO: 88655 - DNA, 25 bp, E. coli
ctcttagtgccggtagttatgccac

SEQ ID NO: 88656 - DNA, 25 bp, E. coli
ctcttagtgccgctagttatgccac

SEQ ID NO: 88657 - DNA, 25 bp, E. coli
gataagattgcctaacgcgaacgga

SEQ ID NO: 88658 - DNA, 25 bp, E. coli
gttatgccactaccctgtgtcagga

SEQ ID NO: 88659 - DNA, 25 bp, E. coli
gttatgccactagcctgtgtcagga

SEQ ID NO: 88660 - DNA, 25 bp, E. coli
gataagattgccaaacgcgaacgga

SEQ ID NO: 88661 - DNA, 25 bp, E. coli
ggaacgccagcatgatttagccgag

SEQ ID NO: 88662 - DNA, 25 bp, E. coli
ggaacgccagcaagatttagccgag

SEQ ID NO: 88663 - DNA, 25 bp, E. coli
aatgatcgccgaagtgaagagtgac

SEQ ID NO: 88664 - DNA, 25 bp, E. coli
aatgatcgccgatgtgaagagtgac

SEQ ID NO: 88665 - DNA, 25 bp, E. coli
agtgaagagtgagttcgccgtgaaa

SEQ ID NO: 88666 - DNA, 25 bp, E. coli
agtgaagagtgacttcgccgtgaaa

SEQ ID NO: 88667 - DNA, 25 bp, E. coli
tatagccccgatcagtgggaacggc

SEQ ID NO: 88668 - DNA, 25 bp, E. coli
tatagccccgatgagtgggaacggc

SEQ ID NO: 88669 - DNA, 25 bp, E. coli
ttatgctctgcgttgctggcggcgc

SEQ ID NO: 88670 - DNA, 25 bp, E. coli
ttatgctctgcgatgctggcggcgc

SEQ ID NO: 88671 - DNA, 25 bp, E. coli
tgcaataaacaagataacagacatg

SEQ ID NO: 88672 - DNA, 25 bp, E. coli
tgcaataaacaacataacagacatg

SEQ ID NO: 88673 - DNA, 25 bp, E. coli
tcgtgctgcaataaacaagataaca

SEQ ID NO: 88674 - DNA, 25 bp, E. coli
tcgtgctgcaattaacaagataaca

SEQ ID NO: 88675 - DNA, 25 bp, E. coli
tctcgcctttgctgaatgcgcttta

SEQ ID NO: 88676 - DNA, 25 bp, E. coli
tctcgcctttgcagaatgcgcttta

SEQ ID NO: 88677 - DNA, 25 bp, E. coli
gggatttactctcgcctttgcagaa

SEQ ID NO: 88678 - DNA, 25 bp, E. coli
gggatttactctggcctttgcagaa

SEQ ID NO: 88679 - DNA, 25 bp, E. coli
tggaatggctggtcaaaaaatcgtg

SEQ ID NO: 88680 - DNA, 25 bp, E. coli
ggctggtcaaaaaatcgtgctgcaa

SEQ ID NO: 88681 - DNA, 25 bp, E. coli
tggaatggctggacaaaaaatcgtg

SEQ ID NO: 88682 - DNA, 25 bp, E. coli
tggcggcgcgattaaaatgatcgcc

SEQ ID NO: 88683 - DNA, 25 bp, E. coli
ggctggtcaaaatatcgtgctgcaa

SEQ ID NO: 88684 - DNA, 25 bp, E. coli
tggcggcgcgataaaaatgatcgcc

SEQ ID NO: 88685 - DNA, 25 bp, E. coli
cactttatgggctagctgagcggca

SEQ ID NO: 88686 - DNA, 25 bp, E. coli
cactttatgggcaagctgagcggca

SEQ ID NO: 88687 - DNA, 25 bp, E. coli
catgggcattatggcaaacggtcgc

SEQ ID NO: 88688 - DNA, 25 bp, E. coli
catgggcattatcgcaaacggtcgc

SEQ ID NO: 88689 - DNA, 25 bp, E. coli
tatgaagatgactgcgtgacgcggc

SEQ ID NO: 88690 - DNA, 25 bp, E. coli
tatgaagatgacagcgtgacgcggc

SEQ ID NO: 88691 - DNA, 25 bp, E. coli
tatcgccgcgcaaatctacgaaggg

SEQ ID NO: 88692 - DNA, 25 bp, E. coli
tatcgccgcgcatatctacgaaggg

SEQ ID NO: 88693 - DNA, 25 bp, E. coli
tttacccgcaaacggctgacctcgg

SEQ ID NO: 88694 - DNA, 25 bp, E. coli
tttacccgcaaagggctgacctcgg

SEQ ID NO: 88695 - DNA, 25 bp, E. coli
gaagatttgctcgaacgcggacctg

SEQ ID NO: 88696 - DNA, 25 bp, E. coli
gaagatttgctccaacgcggacctg

SEQ ID NO: 88697 - DNA, 25 bp, E. coli
gaaaacctgatgatcctgctcgcca

SEQ ID NO: 88698 - DNA, 25 bp, E. coli
gacgacgtggaaaacttaagccgcg

SEQ ID NO: 88699 - DNA, 25 bp, E. coli
gaaatgaccgtagcggacatccgca

SEQ ID NO: 88700 - DNA, 25 bp, E. coli
gacgacgtggaatacttaagccgcg

SEQ ID NO: 88701 - DNA, 25 bp, E. coli
gaaatgaccgtaccggacatccgca

SEQ ID NO: 88702 - DNA, 25 bp, E. coli
gaaaacctgatgttcctgctcgcca

SEQ ID NO: 88703 - DNA, 25 bp, E. coli
ggagtatctctagaacgaccgccag

SEQ ID NO: 88704 - DNA, 25 bp, E. coli
ggagtatctctacaacgaccgccag

SEQ ID NO: 88705 - DNA, 25 bp, E. coli
ggacctgatctagggcgcgaagaaa

SEQ ID NO: 88706 - DNA, 25 bp, E. coli
ggacctgatctacggcgcgaagaaa

SEQ ID NO: 88707 - DNA, 25 bp, E. coli
aaaacgtccgagagccgatataggc

SEQ ID NO: 88708 - DNA, 25 bp, E. coli
aaaacgtccgagtgccgatataggc

SEQ ID NO: 88709 - DNA, 25 bp, E. coli
tatgggctacatcaggttaattcac

SEQ ID NO: 88710 - DNA, 25 bp, E. coli
tatgcatggcggagttgatggtcac

SEQ ID NO: 88711 - DNA, 25 bp, E. coli
tatgcatggcggtgttgatggtcac

SEQ ID NO: 88712 - DNA, 25 bp, E. coli
tatgggctacatgaggttaattcac

SEQ ID NO: 88713 - DNA, 25 bp, E. coli
tgtacagcgaacacagccagtacgc

SEQ ID NO: 88714 - DNA, 25 bp, E. coli
tgtacagcgaactcagccagtacgc

SEQ ID NO: 88715 - DNA, 25 bp, E. coli
gctgatgcggatgtactgggctttt

SEQ ID NO: 88716 - DNA, 25 bp, E. coli
gctgatgcggatctactgggctttt

SEQ ID NO: 88717 - DNA, 25 bp, E. coli
gaagacatcatgtccgacgacacgg

SEQ ID NO: 88718 - DNA, 25 bp, E. coli
gaagacatcatgaccgacgacacgg

SEQ ID NO: 88719 - DNA, 25 bp, E. coli
ccgctggtatctctttctggcaaaa

SEQ ID NO: 88720 - DNA, 25 bp, E. coli
ccgctggtatctgtttctggcaaaa

SEQ ID NO: 88721 - DNA, 25 bp, E. coli
cgtgtggtatgatatccgctggtat

SEQ ID NO: 88722 - DNA, 25 bp, E. coli
cgtgtggtatgaaatccgctggtat

SEQ ID NO: 88723 - DNA, 25 bp, E. coli
ggctaccgtagccacaaatttggca

SEQ ID NO: 88724 - DNA, 25 bp, E. coli
ggcgaggcgacgaatctgttctata

SEQ ID NO: 88725 - DNA, 25 bp, E. coli
ggctaccgtagcgacaaatttggca

SEQ ID NO: 88726 - DNA, 25 bp, E. coli
ggcgaggcgacgtatctgttctata

SEQ ID NO: 88727 - DNA, 25 bp, E. coli
tggacattcacacctggcatcggct

SEQ ID NO: 88728 - DNA, 25 bp, E. coli
tggacattcacagctggcatcggct

SEQ ID NO: 88729 - DNA, 25 bp, E. coli
caatgctaaagcgtccggtggtagc

SEQ ID NO: 88730 - DNA, 25 bp, E. coli
caatgctaaagcctccggtggtagc

SEQ ID NO: 88731 - DNA, 25 bp, E. coli
aagagcgtactgtattgctgcgtgc

SEQ ID NO: 88732 - DNA, 25 bp, E. coli
aagagcgtactgaattgctgcgtgc

SEQ ID NO: 88733 - DNA, 25 bp, E. coli
tactgaattgctgcgtgcgaacgat

SEQ ID NO: 88734 - DNA, 25 bp, E. coli
tactgaattgctccgtgcgaacgat

SEQ ID NO: 88735 - DNA, 25 bp, E. coli
taaagcctccggaggtagcttccgt

SEQ ID NO: 88736 - DNA, 25 bp, E. coli
taaagcctccggtggtagcttccgt

SEQ ID NO: 88737 - DNA, 25 bp, E. coli
agcctccggtggaagcttccgtcag

SEQ ID NO: 88738 - DNA, 25 bp, E. coli
agcctccggtggtagcttccgtcag

SEQ ID NO: 88739 - DNA, 25 bp, E. coli
aatgctaaagccaccggtggtagct

SEQ ID NO: 88740 - DNA, 25 bp, E. coli
aaacaatgctaatgcctccggtggt

SEQ ID NO: 88741 - DNA, 25 bp, E. coli
aaacaatgctaaagcctccggtggt

SEQ ID NO: 88742 - DNA, 25 bp, E. coli
aatgctaaagcctccggtggtagct

SEQ ID NO: 88743 - DNA, 25 bp, E. coli
tgaattgctgcgtgcgaacgatcac

SEQ ID NO: 88744 - DNA, 25 bp, E. coli
tgaattgctgcgagcgaacgatcac

SEQ ID NO: 88745 - DNA, 25 bp, E. coli
gcgtactgaattcctgcgtgcgaac

SEQ ID NO: 88746 - DNA, 25 bp, E. coli
gcgtactgaattgctgcgtgcgaac

SEQ ID NO: 88747 - DNA, 25 bp, E. coli
ggaagagcgtacagaattgctgcgt

SEQ ID NO: 88748 - DNA, 25 bp, E. coli
ggaagagcgtactgaattgctgcgt

SEQ ID NO: 88749 - DNA, 25 bp, E. coli
gagcgtactgaaatgctgcgtgcga

SEQ ID NO: 88750 - DNA, 25 bp, E. coli
gagcgtactgaattgctgcgtgcga

SEQ ID NO: 88751 - DNA, 25 bp, E. coli
aagcagatatttctgaatatataac

SEQ ID NO: 88752 - DNA, 25 bp, E. coli
aagcagatatttgtgaatatataac

SEQ ID NO: 88753 - DNA, 25 bp, E. coli
cagatatttctgaatatataacaaa

SEQ ID NO: 88754 - DNA, 25 bp, E. coli
cagatatttctgtatatataacaaa

SEQ ID NO: 88755 - DNA, 25 bp, E. coli
agcagatatttctgaatatataaca

SEQ ID NO: 88756 - DNA, 25 bp, E. coli
agcagatatttcagaatatataaca

SEQ ID NO: 88757 - DNA, 25 bp, E. coli
agatatttctgattatataacaaaa

SEQ ID NO: 88758 - DNA, 25 bp, E. coli
agatatttctgaatatataacaaaa

SEQ ID NO: 88759 - DNA, 25 bp, E. coli
tatttctgaatatataacaaaaaaa

SEQ ID NO: 88760 - DNA, 25 bp, E. coli
tatttctgaataaataacaaaaaaa

SEQ ID NO: 88761 - DNA, 25 bp, E. coli
tttctgaatataaaacaaaaaaaat

SEQ ID NO: 88762 - DNA, 25 bp, E. coli
tttctgaatatataacaaaaaaaat

SEQ ID NO: 88763 - DNA, 25 bp, E. coli
gcagatatttctgaatatataacaa

SEQ ID NO: 88764 - DNA, 25 bp, E. coli
gcagatatttctcaatatataacaa

SEQ ID NO: 88765 - DNA, 25 bp, E. coli
gatatttctgaatatataacaaaaa

SEQ ID NO: 88766 - DNA, 25 bp, E. coli
gatatttctgaaaatataacaaaaa

SEQ ID NO: 88767 - DNA, 25 bp, E. coli
caacggcctttatggtgcaatggag

SEQ ID NO: 88768 - DNA, 25 bp, E. coli
caacggcctttaaggtgcaatggag

SEQ ID NO: 88769 - DNA, 25 bp, E. coli
taaactctatcgacgaaccagcggc

SEQ ID NO: 88770 - DNA, 25 bp, E. coli
taaactctatcgtcgaaccagcggc

SEQ ID NO: 88771 - DNA, 25 bp, E. coli
tacccggcgtagatataactgctga

SEQ ID NO: 88772 - DNA, 25 bp, E. coli
tacccggcgtagttataactgctga

SEQ ID NO: 88773 - DNA, 25 bp, E. coli
tttaatgcagtagagcgggaaccgg

SEQ ID NO: 88774 - DNA, 25 bp, E. coli
tttaatgcagtacagcgggaaccgg

SEQ ID NO: 88775 - DNA, 25 bp, E. coli
tctgttgagcgctggagtatccgaa

SEQ ID NO: 88776 - DNA, 25 bp, E. coli
tctgttgagcgcaggagtatccgaa

SEQ ID NO: 88777 - DNA, 25 bp, E. coli
tctttgcccgagatagcgagattca

SEQ ID NO: 88778 - DNA, 25 bp, E. coli
tcatgaagcaaagcagaagtccgcg

SEQ ID NO: 88779 - DNA, 25 bp, E. coli
tctttgcccgagttagcgagattca

SEQ ID NO: 88780 - DNA, 25 bp, E. coli
tcatgaagcaaaccagaagtccgcg

SEQ ID NO: 88781 - DNA, 25 bp, E. coli
gcaaccgtggtttgtcgctggaact

SEQ ID NO: 88782 - DNA, 25 bp, E. coli
gcaaccgtggttagtcgctggaact

SEQ ID NO: 88783 - DNA, 25 bp, E. coli
taagtttctgaattcgccatgcgac

SEQ ID NO: 88784 - DNA, 25 bp, E. coli
taacctcccggtattctggctggcg

SEQ ID NO: 88785 - DNA, 25 bp, E. coli
taaggcaattttttcgcaaccgtgg

SEQ ID NO: 88786 - DNA, 25 bp, E. coli
taagtttctgaaatcgccatgcgac

SEQ ID NO: 88787 - DNA, 25 bp, E. coli
taacctcccggttttctggctggcg

SEQ ID NO: 88788 - DNA, 25 bp, E. coli
taaggcaattttatcgcaaccgtgg

SEQ ID NO: 88789 - DNA, 25 bp, E. coli
cacttggcaagcaatggcaggagaa

SEQ ID NO: 88790 - DNA, 25 bp, E. coli
cacttggcaagctatggcaggagaa

SEQ ID NO: 88791 - DNA, 25 bp, E. coli
agtggctggcgccattaaccgttgc

SEQ ID NO: 88792 - DNA, 25 bp, E. coli
agtggctggcgcgattaaccgttgc

SEQ ID NO: 88793 - DNA, 25 bp, E. coli
aacgacgcttctggctgcattccgg

SEQ ID NO: 88794 - DNA, 25 bp, E. coli
aacgacgcttctcgctgcattccgg

SEQ ID NO: 88795 - DNA, 25 bp, E. coli
tattactgggcaatgcagtggcgtc

SEQ ID NO: 88796 - DNA, 25 bp, E. coli
tattactgggcattgcagtggcgtc

SEQ ID NO: 88797 - DNA, 25 bp, E. coli
tgattgtgcgcctacgcgcgaggaa

SEQ ID NO: 88798 - DNA, 25 bp, E. coli
tgattgtgcgccaacgcgcgaggaa

SEQ ID NO: 88799 - DNA, 25 bp, E. coli
tccgcagagatatcaacacttggca

SEQ ID NO: 88800 - DNA, 25 bp, E. coli
tccgcagagataacaacacttggca

SEQ ID NO: 88801 - DNA, 25 bp, E. coli
cctggcgtgggtgcgatatcgaact

SEQ ID NO: 88802 - DNA, 25 bp, E. coli
cctggcgtgggtccgatatcgaact

SEQ ID NO: 88803 - DNA, 25 bp, E. coli
gattttggcccaggtattggcgata

SEQ ID NO: 88804 - DNA, 25 bp, E. coli
gattttggcccacgtattggcgata

SEQ ID NO: 88805 - DNA, 25 bp, E. coli
gatcatggcctgacgacctttagtg

SEQ ID NO: 88806 - DNA, 25 bp, E. coli
taatcagcctgaacgataacgccga

SEQ ID NO: 88807 - DNA, 25 bp, E. coli
taatcagcctgatcgataacgccga

SEQ ID NO: 88808 - DNA, 25 bp, E. coli
gagccggatggccaacgcactttta

SEQ ID NO: 88809 - DNA, 25 bp, E. coli
gagccggatggcgaacgcactttta

SEQ ID NO: 88810 - DNA, 25 bp, E. coli
gatcatggcctgtcgacctttagtg

SEQ ID NO: 88811 - DNA, 25 bp, E. coli
ttttgtcgtagtggcgttaataccg

SEQ ID NO: 88812 - DNA, 25 bp, E. coli
ttttgtcgtagtcgcgttaataccg

SEQ ID NO: 88813 - DNA, 25 bp, E. coli
agtggcgttaataccgtggaatatg

SEQ ID NO: 88814 - DNA, 25 bp, E. coli
agtggcgttaattccgtggaatatg

SEQ ID NO: 88815 - DNA, 25 bp, E. coli
tgtcgtagtggccttaataccgtgg

SEQ ID NO: 88816 - DNA, 25 bp, E. coli
tgtcgtagtggcgttaataccgtgg

SEQ ID NO: 88817 - DNA, 25 bp, E. coli
tcgtagtggcgtaaataccgtggaa

SEQ ID NO: 88818 - DNA, 25 bp, E. coli
tcgtagtggcgttaataccgtggaa

SEQ ID NO: 88819 - DNA, 25 bp, E. coli
tagtggcgttaaaaccgtggaatat

SEQ ID NO: 88820 - DNA, 25 bp, E. coli
tagtggcgttaataccgtggaatat

SEQ ID NO: 88821 - DNA, 25 bp, E. coli
gcgttaataccgaggaatatgccgg

SEQ ID NO: 88822 - DNA, 25 bp, E. coli
gcgttaataccgtggaatatgccgg

SEQ ID NO: 88823 - DNA, 25 bp, E. coli
cgtagtggcgttaataccgtggaat

SEQ ID NO: 88824 - DNA, 25 bp, E. coli
ctctatttttgtcgtagtggcgtta

SEQ ID NO: 88825 - DNA, 25 bp, E. coli
cgttaataccgtcgaatatgccggg

SEQ ID NO: 88826 - DNA, 25 bp, E. coli
cgttaataccgtggaatatgccggg

SEQ ID NO: 88827 - DNA, 25 bp, E. coli
ctctatttttgtggtagtggcgtta

SEQ ID NO: 88828 - DNA, 25 bp, E. coli
cgtagtggcgtttataccgtggaat

SEQ ID NO: 88829 - DNA, 25 bp, E. coli
gtcgtagtggcgttaataccgtgga

SEQ ID NO: 88830 - DNA, 25 bp, E. coli
gtcgtagtggcgataataccgtgga

SEQ ID NO: 88831 - DNA, 25 bp, E. coli
ggcgttaataccctggaatatgccg

SEQ ID NO: 88832 - DNA, 25 bp, E. coli
ggcgttaataccgtggaatatgccg

SEQ ID NO: 88833 - DNA, 25 bp, E. coli
caatgcttccgtgattccgagtggg

SEQ ID NO: 88834 - DNA, 25 bp, E. coli
caatgcttccgtcattccgagtggg

SEQ ID NO: 88835 - DNA, 25 bp, E. coli
catcatcatgctcgaagttgaaggc

SEQ ID NO: 88836 - DNA, 25 bp, E. coli
catcatcatgctggaagttgaaggc

SEQ ID NO: 88837 - DNA, 25 bp, E. coli
tactggaaaaaagtgcacgaacaca

SEQ ID NO: 88838 - DNA, 25 bp, E. coli
tactggaaaaaactgcacgaacaca

SEQ ID NO: 88839 - DNA, 25 bp, E. coli
tatggaattcgccaattacggtccg

SEQ ID NO: 88840 - DNA, 25 bp, E. coli
tatggaattcgcgaattacggtccg

SEQ ID NO: 88841 - DNA, 25 bp, E. coli
tctatctggtgggtgataaactgcc

SEQ ID NO: 88842 - DNA, 25 bp, E. coli
tctatctggtggctgataaactgcc

SEQ ID NO: 88843 - DNA, 25 bp, E. coli
gcctggagcgcatatggaaatcact

SEQ ID NO: 88844 - DNA, 25 bp, E. coli
gcctggagcgcaaatggaaatcact

SEQ ID NO: 88845 - DNA, 25 bp, E. coli
gcgctgattcgcaaagatcctcatg

SEQ ID NO: 88846 - DNA, 25 bp, E. coli
gcgctgattcgctaagatcctcatg

SEQ ID NO: 88847 - DNA, 25 bp, E. coli
ctgacctgaaagagcgcatcgaaca

SEQ ID NO: 88848 - DNA, 25 bp, E. coli
ctgacctgaaagtgcgcatcgaaca

SEQ ID NO: 88849 - DNA, 25 bp, E. coli
gatcctcatgctcctaagctggcaa

SEQ ID NO: 88850 - DNA, 25 bp, E. coli
ggaaatcactgaaccacgccgtttg

SEQ ID NO: 88851 - DNA, 25 bp, E. coli
ggaaatcactgatccacgccgtttg

SEQ ID NO: 88852 - DNA, 25 bp, E. coli
gatcctcatgctgctaagctggcaa

SEQ ID NO: 88853 - DNA, 25 bp, E. coli
gatgaccacgatgaaatcctcaagg

SEQ ID NO: 88854 - DNA, 25 bp, E. coli
gatgaccacgatcaaatcctcaagg

SEQ ID NO: 88855 - DNA, 25 bp, E. coli
caacaagtgatgatggaggcgacga

SEQ ID NO: 88856 - DNA, 25 bp, E. coli
caacaagtgatgttggaggcgacga

SEQ ID NO: 88857 - DNA, 25 bp, E. coli
aaccatcggttgtctactttgaagc

SEQ ID NO: 88858 - DNA, 25 bp, E. coli
aaccatcggttgactactttgaagc

SEQ ID NO: 88859 - DNA, 25 bp, E. coli
tgaatgcagctctatcatctttgga

SEQ ID NO: 88860 - DNA, 25 bp, E. coli
tgacgccaaaagagacaccgctgta

SEQ ID NO: 88861 - DNA, 25 bp, E. coli
tgaagttgcgcagatcaagagcagc

SEQ ID NO: 88862 - DNA, 25 bp, E. coli
tgacgccaaaagtgacaccgctgta

SEQ ID NO: 88863 - DNA, 25 bp, E. coli
tgaatgcagctcaatcatctttgga

SEQ ID NO: 88864 - DNA, 25 bp, E. coli
tgaagttgcgcacatcaagagcagc

SEQ ID NO: 88865 - DNA, 25 bp, E. coli
tctgtagcatcaagccaagcaacgc

SEQ ID NO: 88866 - DNA, 25 bp, E. coli
tctgtagcatcatgccaagcaacgc

SEQ ID NO: 88867 - DNA, 25 bp, E. coli
gcaggaattaaagaggatacccgga

SEQ ID NO: 88868 - DNA, 25 bp, E. coli
gcaggaattaaacaggatacccgga

SEQ ID NO: 88869 - DNA, 25 bp, E. coli
gaaaaacggattctcacatcggttg

SEQ ID NO: 88870 - DNA, 25 bp, E. coli
gaaaaacggattgtcacatcggttg

SEQ ID NO: 88871 - DNA, 25 bp, E. coli
cgacgacatggaaaagcgattagca

SEQ ID NO: 88872 - DNA, 25 bp, E. coli
cgacgacatggataagcgattagca

SEQ ID NO: 88873 - DNA, 25 bp, E. coli
gataagaatggcactacagtagggc

SEQ ID NO: 88874 - DNA, 25 bp, E. coli
gataagaatggctctacagtagggc

SEQ ID NO: 88875 - DNA, 25 bp, E. coli
ggttctcttggcgtcgcttgctatg

SEQ ID NO: 88876 - DNA, 25 bp, E. coli
ggttctcttggcctcgcttgctatg

SEQ ID NO: 88877 - DNA, 25 bp, E. coli
aaccatagaagatgcgctgccctgg

SEQ ID NO: 88878 - DNA, 25 bp, E. coli
caccgctgcgtacggttgaagtggt

SEQ ID NO: 88879 - DNA, 25 bp, E. coli
cacattttcgtctaaccatagaaga

SEQ ID NO: 88880 - DNA, 25 bp, E. coli
caccgctgcgtagggttgaagtggt

SEQ ID NO: 88881 - DNA, 25 bp, E. coli
cacattttcgtcaaaccatagaaga

SEQ ID NO: 88882 - DNA, 25 bp, E. coli
taaaaaaaagaaaggccgcaagtgg

SEQ ID NO: 88883 - DNA, 25 bp, E. coli
aaccatagaagaagcgctgccctgg

SEQ ID NO: 88884 - DNA, 25 bp, E. coli
gcgcaccgctgcctacggttgaagt

SEQ ID NO: 88885 - DNA, 25 bp, E. coli
gcgcaccgctgcgtacggttgaagt

SEQ ID NO: 88886 - DNA, 25 bp, E. coli
gaaaactcaatagggcgcaccgctg

SEQ ID NO: 88887 - DNA, 25 bp, E. coli
gaaaactcaatacggcgcaccgctg

SEQ ID NO: 88888 - DNA, 25 bp, E. coli
cgcaccgctgcgtacggttgaagtg

SEQ ID NO: 88889 - DNA, 25 bp, E. coli
cgcaccgctgcgaacggttgaagtg

SEQ ID NO: 88890 - DNA, 25 bp, E. coli
cggcgcaccgctccgtacggttgaa

SEQ ID NO: 88891 - DNA, 25 bp, E. coli
cggcgcaccgctgcgtacggttgaa

SEQ ID NO: 88892 - DNA, 25 bp, E. coli
gattacacatttacgtcaaaccata

SEQ ID NO: 88893 - DNA, 25 bp, E. coli
gattacacattttcgtcaaaccata

SEQ ID NO: 88894 - DNA, 25 bp, E. coli
tacacattttcgtcaaaccatagaa

SEQ ID NO: 88895 - DNA, 25 bp, E. coli
tacacattttcgacaaaccatagaa

SEQ ID NO: 88896 - DNA, 25 bp, E. coli
taaaaaaaagaatggccgcaagtgg

SEQ ID NO: 88897 - DNA, 25 bp, E. coli
tcaatacggcgctccgctgcgtacg

SEQ ID NO: 88898 - DNA, 25 bp, E. coli
tcaatacggcgcaccgctgcgtacg

SEQ ID NO: 88899 - DNA, 25 bp, E. coli
cagttgatattgcagtcagtgttca

SEQ ID NO: 88900 - DNA, 25 bp, E. coli
cagttgatattggagtcagtgttca

SEQ ID NO: 88901 - DNA, 25 bp, E. coli
cttgtttccggagagccagttgata

SEQ ID NO: 88902 - DNA, 25 bp, E. coli
cttgtttccggacagccagttgata

SEQ ID NO: 88903 - DNA, 25 bp, E. coli
tttccggagagcgagttgatattgc

SEQ ID NO: 88904 - DNA, 25 bp, E. coli
tttccggagagccagttgatattgc

SEQ ID NO: 88905 - DNA, 25 bp, E. coli
ttcttgtttccgcagagccagttga

SEQ ID NO: 88906 - DNA, 25 bp, E. coli
ttcttgtttccggagagccagttga

SEQ ID NO: 88907 - DNA, 25 bp, E. coli
ttgatattgcagacagtgttcacag

SEQ ID NO: 88908 - DNA, 25 bp, E. coli
ttgatattgcagtcagtgttcacag

SEQ ID NO: 88909 - DNA, 25 bp, E. coli
tgtttccggagagccagttgatatt

SEQ ID NO: 88910 - DNA, 25 bp, E. coli
tgtttccggagacccagttgatatt

SEQ ID NO: 88911 - DNA, 25 bp, E. coli
tccggagagccacttgatattgcag

SEQ ID NO: 88912 - DNA, 25 bp, E. coli
tccggagagccagttgatattgcag

SEQ ID NO: 88913 - DNA, 25 bp, E. coli
cggagagccagttgatattgcagtc

SEQ ID NO: 88914 - DNA, 25 bp, E. coli
cggagagccagtagatattgcagtc

SEQ ID NO: 88915 - DNA, 25 bp, E. coli
gtttttcttgttaccggagagccag

SEQ ID NO: 88916 - DNA, 25 bp, E. coli
gtttttcttgtttccggagagccag

SEQ ID NO: 88917 - DNA, 25 bp, E. coli
gagagccagttgttattgcagtcag

SEQ ID NO: 88918 - DNA, 25 bp, E. coli
gagccagttgatattgcagtcagtg

SEQ ID NO: 88919 - DNA, 25 bp, E. coli
gagagccagttgatattgcagtcag

SEQ ID NO: 88920 - DNA, 25 bp, E. coli
gagccagttgattttgcagtcagtg

SEQ ID NO: 88921 - DNA, 25 bp, E. coli
tacaattaaaaagacgacatccgca

SEQ ID NO: 88922 - DNA, 25 bp, E. coli
tacaattaaaaacacgacatccgca

SEQ ID NO: 88923 - DNA, 25 bp, E. coli
aaatggcagggttttctctttgtgc

SEQ ID NO: 88924 - DNA, 25 bp, E. coli
aaatggcagggtattctctttgtgc

SEQ ID NO: 88925 - DNA, 25 bp, E. coli
tgtaacgcagattaaaacatcccgt

SEQ ID NO: 88926 - DNA, 25 bp, E. coli
tgtaacgcagataaaaacatcccgt

SEQ ID NO: 88927 - DNA, 25 bp, E. coli
tgaccgttttctattgacacggagt

SEQ ID NO: 88928 - DNA, 25 bp, E. coli
tgaccgttttcttttgacacggagt

SEQ ID NO: 88929 - DNA, 25 bp, E. coli
taaggtcagtgtgattaacatcatc

SEQ ID NO: 88930 - DNA, 25 bp, E. coli
taaggtcagtgtcattaacatcatc

SEQ ID NO: 88931 - DNA, 25 bp, E. coli
tctgccgtttatcggattgaccgtt

SEQ ID NO: 88932 - DNA, 25 bp, E. coli
tcatcagtgacatcctatcacagga

SEQ ID NO: 88933 - DNA, 25 bp, E. coli
tcatcagtgacaacctatcacagga

SEQ ID NO: 88934 - DNA, 25 bp, E. coli
tctgccgtttatgggattgaccgtt

SEQ ID NO: 88935 - DNA, 25 bp, E. coli
gccttgcaaaaattataacatcgtt

SEQ ID NO: 88936 - DNA, 25 bp, E. coli
gccttgcaaaaaatataacatcgtt

SEQ ID NO: 88937 - DNA, 25 bp, E. coli
gacatccgcaccataaatagccttg

SEQ ID NO: 88938 - DNA, 25 bp, E. coli
gacatccgcaccttaaatagccttg

SEQ ID NO: 88939 - DNA, 25 bp, E. coli
taagactattcaggagcattatgaa

SEQ ID NO: 88940 - DNA, 25 bp, E. coli
taacatcgttgttttcaatctgccg

SEQ ID NO: 88941 - DNA, 25 bp, E. coli
taacatcgttgtattcaatctgccg

SEQ ID NO: 88942 - DNA, 25 bp, E. coli
taagactattcacgagcattatgaa

SEQ ID NO: 88943 - DNA, 25 bp, E. coli
tatagaacagtacaatattccgctg

SEQ ID NO: 88944 - DNA, 25 bp, E. coli
tatagaacagtagaatattccgctg

SEQ ID NO: 88945 - DNA, 25 bp, E. coli
tgttggcggtttacattattgcggc

SEQ ID NO: 88946 - DNA, 25 bp, E. coli
tgttggcggttttcattattgcggc

SEQ ID NO: 88947 - DNA, 25 bp, E. coli
tcggcggcgttatagaacagtacaa

SEQ ID NO: 88948 - DNA, 25 bp, E. coli
tcggcggcgttaaagaacagtacaa

SEQ ID NO: 88949 - DNA, 25 bp, E. coli
gctggcaatccccttgggaatttat

SEQ ID NO: 88950 - DNA, 25 bp, E. coli
gctggcaatcccgttgggaatttat

SEQ ID NO: 88951 - DNA, 25 bp, E. coli
gaatttatttccttggcggcgaaga

SEQ ID NO: 88952 - DNA, 25 bp, E. coli
gaatttatttccatggcggcgaaga

SEQ ID NO: 88953 - DNA, 25 bp, E. coli
gaaatttctcttaggtttgttggcg

SEQ ID NO: 88954 - DNA, 25 bp, E. coli
gaaatttctctttggtttgttggcg

SEQ ID NO: 88955 - DNA, 25 bp, E. coli
cattattgcggcctcggttgtgact

SEQ ID NO: 88956 - DNA, 25 bp, E. coli
cattattgcggcgtcggttgtgact

SEQ ID NO: 88957 - DNA, 25 bp, E. coli
ctgaagtcagcgtaagggaagaaat

SEQ ID NO: 88958 - DNA, 25 bp, E. coli
ctgaagtcagcgaaagggaagaaat

SEQ ID NO: 88959 - DNA, 25 bp, E. coli
ggtctttactgtgttgctggcaatc

SEQ ID NO: 88960 - DNA, 25 bp, E. coli
gattatggcgaatctgaagtcagcg

SEQ ID NO: 88961 - DNA, 25 bp, E. coli
ggtctttactgtcttgctggcaatc

SEQ ID NO: 88962 - DNA, 25 bp, E. coli
gattatggcgaaactgaagtcagcg

SEQ ID NO: 88963 - DNA, 25 bp, E. coli
gagtggacgacaacaatgtatgtga

SEQ ID NO: 88964 - DNA, 25 bp, E. coli
gagtggacgacatcaatgtatgtga

SEQ ID NO: 88965 - DNA, 25 bp, E. coli
aagccgcgtcgcaactgctctttaa

SEQ ID NO: 88966 - DNA, 25 bp, E. coli
aagccgcgtcgctactgctctttaa

SEQ ID NO: 88967 - DNA, 25 bp, E. coli
cacctcgcgacactgagctgaaagc

SEQ ID NO: 88968 - DNA, 25 bp, E. coli
cacctcgcgacagtgagctgaaagc

SEQ ID NO: 88969 - DNA, 25 bp, E. coli
atatacgccacctcgcgacagtgag

SEQ ID NO: 88970 - DNA, 25 bp, E. coli
agtgagctgaaacccgcgtcgcaac

SEQ ID NO: 88971 - DNA, 25 bp, E. coli
atatacgccaccacgcgacagtgag

SEQ ID NO: 88972 - DNA, 25 bp, E. coli
agtgagctgaaagccgcgtcgcaac

SEQ ID NO: 88973 - DNA, 25 bp, E. coli
tgaaagccgcgtcgcaactgctctt

SEQ ID NO: 88974 - DNA, 25 bp, E. coli
tgaaagccgcgtggcaactgctctt

SEQ ID NO: 88975 - DNA, 25 bp, E. coli
gccacctcgcgacagtgagctgaaa

SEQ ID NO: 88976 - DNA, 25 bp, E. coli
gccacctcgcgagagtgagctgaaa

SEQ ID NO: 88977 - DNA, 25 bp, E. coli
gcgacagtgagcagaaagccgcgtc

SEQ ID NO: 88978 - DNA, 25 bp, E. coli
gcgacagtgagctgaaagccgcgtc

SEQ ID NO: 88979 - DNA, 25 bp, E. coli
cgtaatatacgccacctcgcgacag

SEQ ID NO: 88980 - DNA, 25 bp, E. coli
ccgcgtcgcaacagctctttaacaa

SEQ ID NO: 88981 - DNA, 25 bp, E. coli
ccgcgtcgcaactgctctttaacaa

SEQ ID NO: 88982 - DNA, 25 bp, E. coli
cgtaatatacgcgacctcgcgacag

SEQ ID NO: 88983 - DNA, 25 bp, E. coli
ctcgcgacagtgtgctgaaagccgc

SEQ ID NO: 88984 - DNA, 25 bp, E. coli
ctcgcgacagtgagctgaaagccgc

SEQ ID NO: 88985 - DNA, 25 bp, E. coli
taatatacgccagctcgcgacagtg

SEQ ID NO: 88986 - DNA, 25 bp, E. coli
taatatacgccacctcgcgacagtg

SEQ ID NO: 88987 - DNA, 25 bp, E. coli
cagcagtcagagacataactggcac

SEQ ID NO: 88988 - DNA, 25 bp, E. coli
cagcagtcagagtcataactggcac

SEQ ID NO: 88989 - DNA, 25 bp, E. coli
tagatagggcgttaatctcccatac

SEQ ID NO: 88990 - DNA, 25 bp, E. coli
tagatagggcgtaaatctcccatac

SEQ ID NO: 88991 - DNA, 25 bp, E. coli
tatcacaaaggaaatatgcctgagc

SEQ ID NO: 88992 - DNA, 25 bp, E. coli
tatcacaaaggatatatgcctgagc

SEQ ID NO: 88993 - DNA, 25 bp, E. coli
tgcaaccactaagccaccaatagag

SEQ ID NO: 88994 - DNA, 25 bp, E. coli
tgcaaccactaacccaccaatagag

SEQ ID NO: 88995 - DNA, 25 bp, E. coli
tcgcaccaattatcagtgcaatagt

SEQ ID NO: 88996 - DNA, 25 bp, E. coli
tcgcaccaattaacagtgcaatagt

SEQ ID NO: 88997 - DNA, 25 bp, E. coli
tctcccatacttaacctggtttatg

SEQ ID NO: 88998 - DNA, 25 bp, E. coli
gccctccattttctttaatttgtag

SEQ ID NO: 88999 - DNA, 25 bp, E. coli
gccctccattttgtttaatttgtag

SEQ ID NO: 89000 - DNA, 25 bp, E. coli
tctcccatactttacctggtttatg

SEQ ID NO: 89001 - DNA, 25 bp, E. coli
gaaatatgcctgtgcagcagtcaga

SEQ ID NO: 89002 - DNA, 25 bp, E. coli
gaaatatgcctgagcagcagtcaga

SEQ ID NO: 89003 - DNA, 25 bp, E. coli
ctggtttatggttaattgccctcca

SEQ ID NO: 89004 - DNA, 25 bp, E. coli
ctggtttatggtaaattgccctcca

SEQ ID NO: 89005 - DNA, 25 bp, E. coli
taactggcacgtaaggtttgcaacc

SEQ ID NO: 89006 - DNA, 25 bp, E. coli
taatttgtagatcatacgttcagat

SEQ ID NO: 89007 - DNA, 25 bp, E. coli
taactggcacgttaggtttgcaacc

SEQ ID NO: 89008 - DNA, 25 bp, E. coli
taatttgtagatgatacgttcagat

SEQ ID NO: 89009 - DNA, 25 bp, E. coli
cagtcgatcgatacttcggcactgg

SEQ ID NO: 89010 - DNA, 25 bp, E. coli
cagtcgatcgattcttcggcactgg

SEQ ID NO: 89011 - DNA, 25 bp, E. coli
actggctgaacactcgatcgatact

SEQ ID NO: 89012 - DNA, 25 bp, E. coli
actggctgaacagtcgatcgatact

SEQ ID NO: 89013 - DNA, 25 bp, E. coli
tgatatgccagaagtgtcggatcgc

SEQ ID NO: 89014 - DNA, 25 bp, E. coli
tgatatgccagatgtgtcggatcgc

SEQ ID NO: 89015 - DNA, 25 bp, E. coli
tgctgatatgcctgaagtgtcggat

SEQ ID NO: 89016 - DNA, 25 bp, E. coli
tgctgatatgccagaagtgtcggat

SEQ ID NO: 89017 - DNA, 25 bp, E. coli
gctgaacagtcgttcgatacttcgg

SEQ ID NO: 89018 - DNA, 25 bp, E. coli
gctgaacagtcgatcgatacttcgg

SEQ ID NO: 89019 - DNA, 25 bp, E. coli
gaacagtcgatcgatacttcggcac

SEQ ID NO: 89020 - DNA, 25 bp, E. coli
gaacagtcgatccatacttcggcac

SEQ ID NO: 89021 - DNA, 25 bp, E. coli
cgatcgatacttcggcactggaagc

SEQ ID NO: 89022 - DNA, 25 bp, E. coli
cgatcgatacttgggcactggaagc

SEQ ID NO: 89023 - DNA, 25 bp, E. coli
cggaatgtgtggtggtcaggcgttg

SEQ ID NO: 89024 - DNA, 25 bp, E. coli
cggaatgtgtggaggtcaggcgttg

SEQ ID NO: 89025 - DNA, 25 bp, E. coli
gtcgatcgatacatcggcactggaa

SEQ ID NO: 89026 - DNA, 25 bp, E. coli
gtcgatcgatacttcggcactggaa

SEQ ID NO: 89027 - DNA, 25 bp, E. coli
gtgtggtggtcacgcgttggattta

SEQ ID NO: 89028 - DNA, 25 bp, E. coli
gtgtggtggtcaggcgttggattta

SEQ ID NO: 89029 - DNA, 25 bp, E. coli
tggctgaacagtcgatcgatacttc

SEQ ID NO: 89030 - DNA, 25 bp, E. coli
tggctgaacagtggatcgatacttc

SEQ ID NO: 89031 - DNA, 25 bp, E. coli
caacaaagataatccagaagatgcg

SEQ ID NO: 89032 - DNA, 25 bp, E. coli
caacaaagataaaccagaagatgcg

SEQ ID NO: 89033 - DNA, 25 bp, E. coli
aaaccggtcaacacctggacctgtg

SEQ ID NO: 89034 - DNA, 25 bp, E. coli
aaaccggtcaactcctggacctgtg

SEQ ID NO: 89035 - DNA, 25 bp, E. coli
tttagatgttcacggtattgcaacc

SEQ ID NO: 89036 - DNA, 25 bp, E. coli
tttagatgttcagggtattgcaacc

SEQ ID NO: 89037 - DNA, 25 bp, E. coli
ttcctggctgtggacgaatccttcc

SEQ ID NO: 89038 - DNA, 25 bp, E. coli
ttcctggctgtgcacgaatccttcc

SEQ ID NO: 89039 - DNA, 25 bp, E. coli
tcttggtggtctgcttcttctgcca

SEQ ID NO: 89040 - DNA, 25 bp, E. coli
tcttggtggtctccttcttctgcca

SEQ ID NO: 89041 - DNA, 25 bp, E. coli
gcagctgataacaaaaaaccggtca

SEQ ID NO: 89042 - DNA, 25 bp, E. coli
gcagctgataactaaaaaccggtca

SEQ ID NO: 89043 - DNA, 25 bp, E. coli
cgttcaggcttgaactcaggataaa

SEQ ID NO: 89044 - DNA, 25 bp, E. coli
cgttcaggcttgtactcaggataaa

SEQ ID NO: 89045 - DNA, 25 bp, E. coli
ggacgaatccttccagccaactgca

SEQ ID NO: 89046 - DNA, 25 bp, E. coli
ggacgaatccttgcagccaactgca

SEQ ID NO: 89047 - DNA, 25 bp, E. coli
ggtattgcaaccgtaaccccagcta

SEQ ID NO: 89048 - DNA, 25 bp, E. coli
ggtattgcaaccctaaccccagcta

SEQ ID NO: 89049 - DNA, 25 bp, E. coli
tggacctgtgaagatttcctggctg

SEQ ID NO: 89050 - DNA, 25 bp, E. coli
tggacctgtgaacatttcctggctg

SEQ ID NO: 89051 - DNA, 25 bp, E. coli
taaccccagctatcgttcaggcttg

SEQ ID NO: 89052 - DNA, 25 bp, E. coli
taaccccagctaacgttcaggcttg

SEQ ID NO: 89053 - DNA, 25 bp, E. coli
aatttgccactgatgatcaccatcg

SEQ ID NO: 89054 - DNA, 25 bp, E. coli
aatttgccactgttgatcaccatcg

SEQ ID NO: 89055 - DNA, 25 bp, E. coli
aacgtaatttgcgactgatgatcac

SEQ ID NO: 89056 - DNA, 25 bp, E. coli
aaaacgtaatttcccactgatgatc

SEQ ID NO: 89057 - DNA, 25 bp, E. coli
aaaacgtaatttgccactgatgatc

SEQ ID NO: 89058 - DNA, 25 bp, E. coli
aacgtaatttgccactgatgatcac

SEQ ID NO: 89059 - DNA, 25 bp, E. coli
ttgggttatatctactgtctgaccc

SEQ ID NO: 89060 - DNA, 25 bp, E. coli
ttgggttatatcaactgtctgaccc

SEQ ID NO: 89061 - DNA, 25 bp, E. coli
tttgtgttgggttatatctactgtc

SEQ ID NO: 89062 - DNA, 25 bp, E. coli
tttgtgttgggtaatatctactgtc

SEQ ID NO: 89063 - DNA, 25 bp, E. coli
tttgccactgatgatcaccatcggc

SEQ ID NO: 89064 - DNA, 25 bp, E. coli
tttgccactgatcatcaccatcggc

SEQ ID NO: 89065 - DNA, 25 bp, E. coli
tgttgggttatatctactgtctgac

SEQ ID NO: 89066 - DNA, 25 bp, E. coli
tgttgggttataactactgtctgac

SEQ ID NO: 89067 - DNA, 25 bp, E. coli
cgtaatttgccactgatgatcacca

SEQ ID NO: 89068 - DNA, 25 bp, E. coli
cgtaatttgccagtgatgatcacca

SEQ ID NO: 89069 - DNA, 25 bp, E. coli
gataaaacgtaatttgccactgatg

SEQ ID NO: 89070 - DNA, 25 bp, E. coli
gtaatttgccactgatgatcaccat

SEQ ID NO: 89071 - DNA, 25 bp, E. coli
gataaaacgtaaattgccactgatg

SEQ ID NO: 89072 - DNA, 25 bp, E. coli
gtaatttgccacagatgatcaccat

SEQ ID NO: 89073 - DNA, 25 bp, E. coli
gtgataaaacgtaatttgccactga

SEQ ID NO: 89074 - DNA, 25 bp, E. coli
gtgataaaacgttatttgccactga

SEQ ID NO: 89075 - DNA, 25 bp, E. coli
caaccgtggcagtgtattttcgaga

SEQ ID NO: 89076 - DNA, 25 bp, E. coli
caaccgtggcagagtattttcgaga

SEQ ID NO: 89077 - DNA, 25 bp, E. coli
cactacgtgataagaaactggcagc

SEQ ID NO: 89078 - DNA, 25 bp, E. coli
cactacgtgatatgaaactggcagc

SEQ ID NO: 89079 - DNA, 25 bp, E. coli
cagttttgaaacgaacgggagagca

SEQ ID NO: 89080 - DNA, 25 bp, E. coli
cagttttgaaaccaacgggagagca

SEQ ID NO: 89081 - DNA, 25 bp, E. coli
gacccactgggtcacgaaattcgct

SEQ ID NO: 89082 - DNA, 25 bp, E. coli
gacccactgggtgacgaaattcgct

SEQ ID NO: 89083 - DNA, 25 bp, E. coli
tatctaagtcgctaactcgcgggtc

SEQ ID NO: 89084 - DNA, 25 bp, E. coli
tatctaagtcgcaaactcgcgggtc

SEQ ID NO: 89085 - DNA, 25 bp, E. coli
tgattgatgaactgccaccgtcgta

SEQ ID NO: 89086 - DNA, 25 bp, E. coli
tgattgatgaacagccaccgtcgta

SEQ ID NO: 89087 - DNA, 25 bp, E. coli
tcagtagaccggtgtaatgccgccc

SEQ ID NO: 89088 - DNA, 25 bp, E. coli
tcagtagaccggagtaatgccgccc

SEQ ID NO: 89089 - DNA, 25 bp, E. coli
tgctgcacgggttaggaagaacctc

SEQ ID NO: 89090 - DNA, 25 bp, E. coli
tgctgcacgggtaaggaagaacctc

SEQ ID NO: 89091 - DNA, 25 bp, E. coli
gcgcggaatcgctcaaaaaatcagt

SEQ ID NO: 89092 - DNA, 25 bp, E. coli
gcgcggaatcgcacaaaaaatcagt

SEQ ID NO: 89093 - DNA, 25 bp, E. coli
gcaaatgaacgtttagccagggctc

SEQ ID NO: 89094 - DNA, 25 bp, E. coli
gcaaatgaacgtatagccagggctc

SEQ ID NO: 89095 - DNA, 25 bp, E. coli
gattttgctatgtatgcccggccta

SEQ ID NO: 89096 - DNA, 25 bp, E. coli
gattttgctatgaatgcccggccta

SEQ ID NO: 89097 - DNA, 25 bp, E. coli
caaaataccgggatcgctacagcga

SEQ ID NO: 89098 - DNA, 25 bp, E. coli
caaaataccgggttcgctacagcga

SEQ ID NO: 89099 - DNA, 25 bp, E. coli
catccgattggacagagctgtgcaa

SEQ ID NO: 89100 - DNA, 25 bp, E. coli
catccgattggagagagctgtgcaa

SEQ ID NO: 89101 - DNA, 25 bp, E. coli
catatatgaacatcgcggagtgcca

SEQ ID NO: 89102 - DNA, 25 bp, E. coli
catatatgaacaacgcggagtgcca

SEQ ID NO: 89103 - DNA, 25 bp, E. coli
tttaccaggtctatgcgaaagcggc

SEQ ID NO: 89104 - DNA, 25 bp, E. coli
tttaccaggtctttgcgaaagcggc

SEQ ID NO: 89105 - DNA, 25 bp, E. coli
tgtgcaatgagcttctaccgggtca

SEQ ID NO: 89106 - DNA, 25 bp, E. coli
tgttttcgataatcgccctgctggc

SEQ ID NO: 89107 - DNA, 25 bp, E. coli
tgttttcgataaacgccctgctggc

SEQ ID NO: 89108 - DNA, 25 bp, E. coli
tgtgcaatgagcatctaccgggtca

SEQ ID NO: 89109 - DNA, 25 bp, E. coli
tgcattgaagaaggcgcgaattgcc

SEQ ID NO: 89110 - DNA, 25 bp, E. coli
tgcattgaagaacgcgcgaattgcc

SEQ ID NO: 89111 - DNA, 25 bp, E. coli
tcgacggtttctctggcgcatgcaa

SEQ ID NO: 89112 - DNA, 25 bp, E. coli
tcgacggtttctgtggcgcatgcaa

SEQ ID NO: 89113 - DNA, 25 bp, E. coli
ctgaaaaatgctttggcctcggcca

SEQ ID NO: 89114 - DNA, 25 bp, E. coli
ctgaaaaatgctatggcctcggcca

SEQ ID NO: 89115 - DNA, 25 bp, E. coli
gttgcaaaaggaagagctacacgcg

SEQ ID NO: 89116 - DNA, 25 bp, E. coli
gattccagccagcttcacaaggttg

SEQ ID NO: 89117 - DNA, 25 bp, E. coli
gattccagccaggttcacaaggttg

SEQ ID NO: 89118 - DNA, 25 bp, E. coli
gttgcaaaaggatgagctacacgcg

SEQ ID NO: 89119 - DNA, 25 bp, E. coli
tcgctggctggatagaaactcaggt

SEQ ID NO: 89120 - DNA, 25 bp, E. coli
tcgctggctggaaagaaactcaggt

SEQ ID NO: 89121 - DNA, 25 bp, E. coli
ccgtcgctggctcgaaagaaactca

SEQ ID NO: 89122 - DNA, 25 bp, E. coli
gctggctggaaacaaactcaggtga

SEQ ID NO: 89123 - DNA, 25 bp, E. coli
gctggaaagaaactcaggtgagtga

SEQ ID NO: 89124 - DNA, 25 bp, E. coli
gctggctggaaagaaactcaggtga

SEQ ID NO: 89125 - DNA, 25 bp, E. coli
gctggaaagaaagtcaggtgagtga

SEQ ID NO: 89126 - DNA, 25 bp, E. coli
ccgtcgctggctggaaagaaactca

SEQ ID NO: 89127 - DNA, 25 bp, E. coli
cccgtcgctggctggaaagaaactc

SEQ ID NO: 89128 - DNA, 25 bp, E. coli
cgctggctggaatgaaactcaggtg

SEQ ID NO: 89129 - DNA, 25 bp, E. coli
cccgtcgctggcaggaaagaaactc

SEQ ID NO: 89130 - DNA, 25 bp, E. coli
cgctggctggaaagaaactcaggtg

SEQ ID NO: 89131 - DNA, 25 bp, E. coli
ctggctggaaagtaactcaggtgag

SEQ ID NO: 89132 - DNA, 25 bp, E. coli
cgtcgctggctgcaaagaaactcag

SEQ ID NO: 89133 - DNA, 25 bp, E. coli
cgtcgctggctggaaagaaactcag

SEQ ID NO: 89134 - DNA, 25 bp, E. coli
ctggctggaaagaaactcaggtgag

SEQ ID NO: 89135 - DNA, 25 bp, E. coli
gtcgctggctggtaagaaactcagg

SEQ ID NO: 89136 - DNA, 25 bp, E. coli
gtcgctggctggaaagaaactcagg

SEQ ID NO: 89137 - DNA, 25 bp, E. coli
ggctggaaagaaactcaggtgagtg

SEQ ID NO: 89138 - DNA, 25 bp, E. coli
tggctggaaagatactcaggtgagt

SEQ ID NO: 89139 - DNA, 25 bp, E. coli
ggctggaaagaatctcaggtgagtg

SEQ ID NO: 89140 - DNA, 25 bp, E. coli
tggctggaaagaaactcaggtgagt

SEQ ID NO: 89141 - DNA, 25 bp, E. coli
cacgatcgacctcttgattcgcggc

SEQ ID NO: 89142 - DNA, 25 bp, E. coli
cacgatcgacctgttgattcgcggc

SEQ ID NO: 89143 - DNA, 25 bp, E. coli
accacgatcgacctcttgattcgcg

SEQ ID NO: 89144 - DNA, 25 bp, E. coli
atcgacctcttgattcgcggcggta

SEQ ID NO: 89145 - DNA, 25 bp, E. coli
accacgatcgacgtcttgattcgcg

SEQ ID NO: 89146 - DNA, 25 bp, E. coli
atcgacctcttgtttcgcggcggta

SEQ ID NO: 89147 - DNA, 25 bp, E. coli
acgatcgacctcatgattcgcggcg

SEQ ID NO: 89148 - DNA, 25 bp, E. coli
acgatcgacctcttgattcgcggcg

SEQ ID NO: 89149 - DNA, 25 bp, E. coli
tcgacctcttgaatcgcggcggtat

SEQ ID NO: 89150 - DNA, 25 bp, E. coli
tcgacctcttgattcgcggcggtat

SEQ ID NO: 89151 - DNA, 25 bp, E. coli
tcaccacgatcgacctcttgattcg

SEQ ID NO: 89152 - DNA, 25 bp, E. coli
tcaccacgatcgtcctcttgattcg

SEQ ID NO: 89153 - DNA, 25 bp, E. coli
cgatcgacctcttgattcgcggcgg

SEQ ID NO: 89154 - DNA, 25 bp, E. coli
cgacctcttgattcgcggcggtatc

SEQ ID NO: 89155 - DNA, 25 bp, E. coli
cgacctcttgatacgcggcggtatc

SEQ ID NO: 89156 - DNA, 25 bp, E. coli
cgatcgacctctagattcgcggcgg

SEQ ID NO: 89157 - DNA, 25 bp, E. coli
cgtcaccacgatcgacctcttgatt

SEQ ID NO: 89158 - DNA, 25 bp, E. coli
cgtcaccacgatggacctcttgatt

SEQ ID NO: 89159 - DNA, 25 bp, E. coli
gatcgacctcttcattcgcggcggt

SEQ ID NO: 89160 - DNA, 25 bp, E. coli
gacctcttgattcgcggcggtatca

SEQ ID NO: 89161 - DNA, 25 bp, E. coli
gacctcttgattggcggcggtatca

SEQ ID NO: 89162 - DNA, 25 bp, E. coli
gatcgacctcttgattcgcggcggt

SEQ ID NO: 89163 - DNA, 25 bp, E. coli
catcatgagagctatattagctgga

SEQ ID NO: 89164 - DNA, 25 bp, E. coli
catcatgagagcaatattagctgga

SEQ ID NO: 89165 - DNA, 25 bp, E. coli
tattagctggatgttcattgtcgat

SEQ ID NO: 89166 - DNA, 25 bp, E. coli
tattctgcaacattttggtctgggc

SEQ ID NO: 89167 - DNA, 25 bp, E. coli
tatttgctggatagctccccttccg

SEQ ID NO: 89168 - DNA, 25 bp, E. coli
tattctgcaacaatttggtctgggc

SEQ ID NO: 89169 - DNA, 25 bp, E. coli
tattagctggatcttcattgtcgat

SEQ ID NO: 89170 - DNA, 25 bp, E. coli
tatttgctggattgctccccttccg

SEQ ID NO: 89171 - DNA, 25 bp, E. coli
tttactactgcaaatgatcaaccgc

SEQ ID NO: 89172 - DNA, 25 bp, E. coli
tttactactgcatatgatcaaccgc

SEQ ID NO: 89173 - DNA, 25 bp, E. coli
tctcattaactactgcgctggaagg

SEQ ID NO: 89174 - DNA, 25 bp, E. coli
tctcattaactagtgcgctggaagg

SEQ ID NO: 89175 - DNA, 25 bp, E. coli
ccttccgcggtttcaatctgcgtga

SEQ ID NO: 89176 - DNA, 25 bp, E. coli
ccttccgcggttacaatctgcgtga

SEQ ID NO: 89177 - DNA, 25 bp, E. coli
gcggtgccaatcttcctggccgtgt

SEQ ID NO: 89178 - DNA, 25 bp, E. coli
gcggtgccaatcatcctggccgtgt

SEQ ID NO: 89179 - DNA, 25 bp, E. coli
cgatgatccagcatcatgagagcaa

SEQ ID NO: 89180 - DNA, 25 bp, E. coli
cgatgatccagcttcatgagagcaa

SEQ ID NO: 89181 - DNA, 25 bp, E. coli
cattgtaataggacttggcggcggt

SEQ ID NO: 89182 - DNA, 25 bp, E. coli
ctggcattaagtggcggtattctga

SEQ ID NO: 89183 - DNA, 25 bp, E. coli
ctggcattaagtcgcggtattctga

SEQ ID NO: 89184 - DNA, 25 bp, E. coli
cattgtaataggtcttggcggcggt

SEQ ID NO: 89185 - DNA, 25 bp, E. coli
aacacgctgaacctttcggcatcga

SEQ ID NO: 89186 - DNA, 25 bp, E. coli
aacacgctgaacgtttcggcatcga

SEQ ID NO: 89187 - DNA, 25 bp, E. coli
tatctgctggcgaacgatgtggcga

SEQ ID NO: 89188 - DNA, 25 bp, E. coli
tatctgctggcgtacgatgtggcga

SEQ ID NO: 89189 - DNA, 25 bp, E. coli
tttttgtgcgtatcggcaaagccgt

SEQ ID NO: 89190 - DNA, 25 bp, E. coli
tttttgtgcgtaacggcaaagccgt

SEQ ID NO: 89191 - DNA, 25 bp, E. coli
tgtggcgaagctgaccaaaagcggc

SEQ ID NO: 89192 - DNA, 25 bp, E. coli
tgatgaccgaaaaaggcgtgctgcg

SEQ ID NO: 89193 - DNA, 25 bp, E. coli
tgtggcgaagctcaccaaaagcggc

SEQ ID NO: 89194 - DNA, 25 bp, E. coli
tgatgaccgaaataggcgtgctgcg

SEQ ID NO: 89195 - DNA, 25 bp, E. coli
tgaaaccgttctttggcgtgcaggc

SEQ ID NO: 89196 - DNA, 25 bp, E. coli
tgcccaatgaaaaagcggccgattt

SEQ ID NO: 89197 - DNA, 25 bp, E. coli
tgcccaatgaaatagcggccgattt

SEQ ID NO: 89198 - DNA, 25 bp, E. coli
tgaaaccgttctatggcgtgcaggc

SEQ ID NO: 89199 - DNA, 25 bp, E. coli
cctgggaaccggcagatcgtgactt

SEQ ID NO: 89200 - DNA, 25 bp, E. coli
cctgggaaccgggagatcgtgactt

SEQ ID NO: 89201 - DNA, 25 bp, E. coli
gcggcgctcgcaaggtggatttcca

SEQ ID NO: 89202 - DNA, 25 bp, E. coli
gcggcgctcgcatggtggatttcca

SEQ ID NO: 89203 - DNA, 25 bp, E. coli
gcagggcaaccagcatgaaggcatt

SEQ ID NO: 89204 - DNA, 25 bp, E. coli
gcagggcaaccaccatgaaggcatt

SEQ ID NO: 89205 - DNA, 25 bp, E. coli
gatgccgctgcaatacggttcgcaa

SEQ ID NO: 89206 - DNA, 25 bp, E. coli
gatgccgctgcattacggttcgcaa

SEQ ID NO: 89207 - DNA, 25 bp, E. coli
caaaatattggcgttttccagttcg

SEQ ID NO: 89208 - DNA, 25 bp, E. coli
caaaatattggccttttccagttcg

SEQ ID NO: 89209 - DNA, 25 bp, E. coli
cactgtggcatgttaaacaaggtca

SEQ ID NO: 89210 - DNA, 25 bp, E. coli
cactgtggcatgataaacaaggtca

SEQ ID NO: 89211 - DNA, 25 bp, E. coli
ctggcggttttatggccttgttggt

SEQ ID NO: 89212 - DNA, 25 bp, E. coli
acgctgggaaacccgctttggcctg

SEQ ID NO: 89213 - DNA, 25 bp, E. coli
acgctgggaaacgcgctttggcctg

SEQ ID NO: 89214 - DNA, 25 bp, E. coli
ctggcggttttaaggccttgttggt

SEQ ID NO: 89215 - DNA, 25 bp, E. coli
acaaaccccgctttttgttggtcag

SEQ ID NO: 89216 - DNA, 25 bp, E. coli
acaaaccccgctatttgttggtcag

SEQ ID NO: 89217 - DNA, 25 bp, E. coli
gacttatcaggacaaaatattggcg

SEQ ID NO: 89218 - DNA, 25 bp, E. coli
gacttatcaggagaaaatattggcg

SEQ ID NO: 89219 - DNA, 25 bp, E. coli
cgcaggcggcacagtggcatgataa

SEQ ID NO: 89220 - DNA, 25 bp, E. coli
cgcaggcggcactgtggcatgataa

SEQ ID NO: 89221 - DNA, 25 bp, E. coli
ggcaatagcgctgctatccgctggc

SEQ ID NO: 89222 - DNA, 25 bp, E. coli
ggcaatagcgctcctatccgctggc

SEQ ID NO: 89223 - DNA, 25 bp, E. coli
ggcgttttccagttcggatatgctg

SEQ ID NO: 89224 - DNA, 25 bp, E. coli
ggcgttttccagatcggatatgctg

SEQ ID NO: 89225 - DNA, 25 bp, E. coli
gaccaacaggattccgaagctacgg

SEQ ID NO: 89226 - DNA, 25 bp, E. coli
gatgaccaacagcataccgaagcta

SEQ ID NO: 89227 - DNA, 25 bp, E. coli
gatgaccaacaggataccgaagcta

SEQ ID NO: 89228 - DNA, 25 bp, E. coli
gaccaacaggataccgaagctacgg

SEQ ID NO: 89229 - DNA, 25 bp, E. coli
cacgatctgccgaagctaatggagg

SEQ ID NO: 89230 - DNA, 25 bp, E. coli
cacgatctgccgtagctaatggagg

SEQ ID NO: 89231 - DNA, 25 bp, E. coli
tacaaagtgcaacctagcccagatg

SEQ ID NO: 89232 - DNA, 25 bp, E. coli
tacaaagtgcaagctagcccagatg

SEQ ID NO: 89233 - DNA, 25 bp, E. coli
aaaacggtacggcaatcagtctgga

SEQ ID NO: 89234 - DNA, 25 bp, E. coli
aaaacggtacgggaatcagtctgga

SEQ ID NO: 89235 - DNA, 25 bp, E. coli
tatttatcttgaccagggacgtctg

SEQ ID NO: 89236 - DNA, 25 bp, E. coli
tatttatcttgagcagggacgtctg

SEQ ID NO: 89237 - DNA, 25 bp, E. coli
gaaaaacttgaacccgtctgcacgt

SEQ ID NO: 89238 - DNA, 25 bp, E. coli
gaaaaacttgaagccgtctgcacgt

SEQ ID NO: 89239 - DNA, 25 bp, E. coli
cgacaattgaagtgcgccagggatt

SEQ ID NO: 89240 - DNA, 25 bp, E. coli
cgacaattgaagagcgccagggatt

SEQ ID NO: 89241 - DNA, 25 bp, E. coli
tacactgatgttggcgggtattcgc

SEQ ID NO: 89242 - DNA, 25 bp, E. coli
taacgacgtggttcagatggcgaaa

SEQ ID NO: 89243 - DNA, 25 bp, E. coli
tcaacaattgctcggtgacggtagc

SEQ ID NO: 89244 - DNA, 25 bp, E. coli
taatgatccagaacgctatggtgtc

SEQ ID NO: 89245 - DNA, 25 bp, E. coli
taatgatccagatcgctatggtgtc

SEQ ID NO: 89246 - DNA, 25 bp, E. coli
taatggaggccgctgttaacaaaga

SEQ ID NO: 89247 - DNA, 25 bp, E. coli
tacactgatgttcgcgggtattcgc

SEQ ID NO: 89248 - DNA, 25 bp, E. coli
taacgacgtggtacagatggcgaaa

SEQ ID NO: 89249 - DNA, 25 bp, E. coli
taatggaggccggtgttaacaaaga

SEQ ID NO: 89250 - DNA, 25 bp, E. coli
tcaacaattgctgggtgacggtagc

SEQ ID NO: 89251 - DNA, 25 bp, E. coli
aacgggtacacacgctggatttacg

SEQ ID NO: 89252 - DNA, 25 bp, E. coli
caactttatttgaagcatggtttcg

SEQ ID NO: 89253 - DNA, 25 bp, E. coli
caactttatttgtagcatggtttcg

SEQ ID NO: 89254 - DNA, 25 bp, E. coli
tacgccacattttgcaggtcgccca

SEQ ID NO: 89255 - DNA, 25 bp, E. coli
tacgccacatttagcaggtcgccca

SEQ ID NO: 89256 - DNA, 25 bp, E. coli
tacacaggctggttttacggcctgc

SEQ ID NO: 89257 - DNA, 25 bp, E. coli
tacggcctgccatcaactttatttg

SEQ ID NO: 89258 - DNA, 25 bp, E. coli
tacggcctgccaacaactttatttg

SEQ ID NO: 89259 - DNA, 25 bp, E. coli
tacacaggctggatttacggcctgc

SEQ ID NO: 89260 - DNA, 25 bp, E. coli
aggctggatttacggcctgccatca

SEQ ID NO: 89261 - DNA, 25 bp, E. coli
aggctggatttagggcctgccatca

SEQ ID NO: 89262 - DNA, 25 bp, E. coli
aacgggtacacaggctggatttacg

SEQ ID NO: 89263 - DNA, 25 bp, E. coli
ttagaaacgggttcacaggctggat

SEQ ID NO: 89264 - DNA, 25 bp, E. coli
ttagaaacgggtacacaggctggat

SEQ ID NO: 89265 - DNA, 25 bp, E. coli
tcgccagtctgattttacgccacat

SEQ ID NO: 89266 - DNA, 25 bp, E. coli
tcgccagtctgaatttacgccacat

SEQ ID NO: 89267 - DNA, 25 bp, E. coli
gattttacgccagattttgcaggtc

SEQ ID NO: 89268 - DNA, 25 bp, E. coli
gattttacgccacattttgcaggtc

SEQ ID NO: 89269 - DNA, 25 bp, E. coli
ggtgtcgccagtctgattttacgcc

SEQ ID NO: 89270 - DNA, 25 bp, E. coli
ggtgtcgccagtgtgattttacgcc

SEQ ID NO: 89271 - DNA, 25 bp, E. coli
tggatttacggcgtgccatcaactt

SEQ ID NO: 89272 - DNA, 25 bp, E. coli
tggatttacggcctgccatcaactt

SEQ ID NO: 89273 - DNA, 25 bp, E. coli
aaggtaaagcctgcctgcgtgcgaa

SEQ ID NO: 89274 - DNA, 25 bp, E. coli
aagatctcaacgaaaatgcgccgcg

SEQ ID NO: 89275 - DNA, 25 bp, E. coli
aagatctcaacgtaaatgcgccgcg

SEQ ID NO: 89276 - DNA, 25 bp, E. coli
aaggtaaagcctccctgcgtgcgaa

SEQ ID NO: 89277 - DNA, 25 bp, E. coli
tacgactgggtactggacaacatca

SEQ ID NO: 89278 - DNA, 25 bp, E. coli
tacgttgatgaactgacgccggaac

SEQ ID NO: 89279 - DNA, 25 bp, E. coli
tacgactgggtagtggacaacatca

SEQ ID NO: 89280 - DNA, 25 bp, E. coli
tacgttgatgaagtgacgccggaac

SEQ ID NO: 89281 - DNA, 25 bp, E. coli
tatttaaccgcagcgttgggctgcg

SEQ ID NO: 89282 - DNA, 25 bp, E. coli
tataaaggccagagcaacctgcgtt

SEQ ID NO: 89283 - DNA, 25 bp, E. coli
tatttaaccgcaccgttgggctgcg

SEQ ID NO: 89284 - DNA, 25 bp, E. coli
tataaaggccagtgcaacctgcgtt

SEQ ID NO: 89285 - DNA, 25 bp, E. coli
tcgggatcgcccaggactataaagg

SEQ ID NO: 89286 - DNA, 25 bp, E. coli
tccggcagatggtcgtaaagtcaaa

SEQ ID NO: 89287 - DNA, 25 bp, E. coli
tcgaactgatcaataaaggcctggc

SEQ ID NO: 89288 - DNA, 25 bp, E. coli
tcgggatcgccctggactataaagg

SEQ ID NO: 89289 - DNA, 25 bp, E. coli
tcgaactgatcattaaaggcctggc

SEQ ID NO: 89290 - DNA, 25 bp, E. coli
tccggcagatggacgtaaagtcaaa

SEQ ID NO: 89291 - DNA, 25 bp, E. coli
gctggtgaccgacaagcacgttgaa

SEQ ID NO: 89292 - DNA, 25 bp, E. coli
gctggtgaccgagaagcacgttgaa

SEQ ID NO: 89293 - DNA, 25 bp, E. coli
gatttccgcgaagaagctaacaagc

SEQ ID NO: 89294 - DNA, 25 bp, E. coli
gatttccgcgaacaagctaacaagc

SEQ ID NO: 89295 - DNA, 25 bp, E. coli
aatctacgccagacatcccgaaggc

SEQ ID NO: 89296 - DNA, 25 bp, E. coli
aatctacgccagtcatcccgaaggc

SEQ ID NO: 89297 - DNA, 25 bp, E. coli
cagcgcgttgcccaacgtattgata

SEQ ID NO: 89298 - DNA, 25 bp, E. coli
cagcgcgttgccgaacgtattgata

SEQ ID NO: 89299 - DNA, 25 bp, E. coli
attgtgttagatatccttgtggcag

SEQ ID NO: 89300 - DNA, 25 bp, E. coli
attgtgttagatttccttgtggcag

SEQ ID NO: 89301 - DNA, 25 bp, E. coli
acatcccgaaggcaccgtgggagat

SEQ ID NO: 89302 - DNA, 25 bp, E. coli
acatcccgaagggaccgtgggagat

SEQ ID NO: 89303 - DNA, 25 bp, E. coli
ttaaagcagaacacttgcgccaggt

SEQ ID NO: 89304 - DNA, 25 bp, E. coli
ttaaagcagaactcttgcgccaggt

SEQ ID NO: 89305 - DNA, 25 bp, E. coli
tctcgagatacttaaagcagaactc

SEQ ID NO: 89306 - DNA, 25 bp, E. coli
tctcgagatactaaaagcagaactc

SEQ ID NO: 89307 - DNA, 25 bp, E. coli
gccaggttgctgaatctacgccaga

SEQ ID NO: 89308 - DNA, 25 bp, E. coli
gccgaacgtattcatattgtgttag

SEQ ID NO: 89309 - DNA, 25 bp, E. coli
gcgatccataatctcgagatactta

SEQ ID NO: 89310 - DNA, 25 bp, E. coli
gccaggttgctgtatctacgccaga

SEQ ID NO: 89311 - DNA, 25 bp, E. coli
gccgaacgtattgatattgtgttag

SEQ ID NO: 89312 - DNA, 25 bp, E. coli
gcgatccataatgtcgagatactta

SEQ ID NO: 89313 - DNA, 25 bp, E. coli
gaactcttgcgcgaggttgctgaat

SEQ ID NO: 89314 - DNA, 25 bp, E. coli
gaactcttgcgccaggttgctgaat

SEQ ID NO: 89315 - DNA, 25 bp, E. coli
cgattaccactcagcgatccataat

SEQ ID NO: 89316 - DNA, 25 bp, E. coli
cgattaccactctgcgatccataat

SEQ ID NO: 89317 - DNA, 25 bp, E. coli
tacttccgtgaatcataaattcagg

SEQ ID NO: 89318 - DNA, 25 bp, E. coli
tacttccgtgaaacataaattcagg

SEQ ID NO: 89319 - DNA, 25 bp, E. coli
aggaagtcattatcacctgcgtgat

SEQ ID NO: 89320 - DNA, 25 bp, E. coli
aggaagtcattaacacctgcgtgat

SEQ ID NO: 89321 - DNA, 25 bp, E. coli
tagttatagagaccttacttccgtg

SEQ ID NO: 89322 - DNA, 25 bp, E. coli
tagttatagagagcttacttccgtg

SEQ ID NO: 89323 - DNA, 25 bp, E. coli
tatcagcgatataacaggaagtcat

SEQ ID NO: 89324 - DNA, 25 bp, E. coli
tatcagcgatattacaggaagtcat

SEQ ID NO: 89325 - DNA, 25 bp, E. coli
ttcccttctctacggatgatttgca

SEQ ID NO: 89326 - DNA, 25 bp, E. coli
ttcccttctctagggatgatttgca

SEQ ID NO: 89327 - DNA, 25 bp, E. coli
tgcgcgcgagcacatttcacggaat

SEQ ID NO: 89328 - DNA, 25 bp, E. coli
tgcgtgatataaccctgcgcgcgag

SEQ ID NO: 89329 - DNA, 25 bp, E. coli
tgcgcgcgagcagatttcacggaat

SEQ ID NO: 89330 - DNA, 25 bp, E. coli
tccgctctaagaagattcctggttg

SEQ ID NO: 89331 - DNA, 25 bp, E. coli
tccgctctaagatgattcctggttg

SEQ ID NO: 89332 - DNA, 25 bp, E. coli
tgcgtgatataagcctgcgcgcgag

SEQ ID NO: 89333 - DNA, 25 bp, E. coli
gcagtttggcaattcatccgctcta

SEQ ID NO: 89334 - DNA, 25 bp, E. coli
gcagtttggcaaatcatccgctcta

SEQ ID NO: 89335 - DNA, 25 bp, E. coli
gattcctggttgataattaagacta

SEQ ID NO: 89336 - DNA, 25 bp, E. coli
gatttcacggaataatttcaccaga

SEQ ID NO: 89337 - DNA, 25 bp, E. coli
gatttcacggaaaaatttcaccaga

SEQ ID NO: 89338 - DNA, 25 bp, E. coli
gattcctggttgttaattaagacta

SEQ ID NO: 89339 - DNA, 25 bp, E. coli
aactgggttatccacaaagcctggg

SEQ ID NO: 89340 - DNA, 25 bp, E. coli
aaaaagcggtcatcgccatgtgcca

SEQ ID NO: 89341 - DNA, 25 bp, E. coli
aactgggttatcgacaaagcctggg

SEQ ID NO: 89342 - DNA, 25 bp, E. coli
aaaaagcggtcaacgccatgtgcca

SEQ ID NO: 89343 - DNA, 25 bp, E. coli
tgttcaatatcgacccagaggccgc

SEQ ID NO: 89344 - DNA, 25 bp, E. coli
tgttcaatatcgtcccagaggccgc

SEQ ID NO: 89345 - DNA, 25 bp, E. coli
tgaatgttctgtcggatccggtcgc

SEQ ID NO: 89346 - DNA, 25 bp, E. coli
tgaatgttctgtgggatccggtcgc

SEQ ID NO: 89347 - DNA, 25 bp, E. coli
tctgcctggaaatcgtggaggaaca

SEQ ID NO: 89348 - DNA, 25 bp, E. coli
tctgcctggaaaacgtggaggaaca

SEQ ID NO: 89349 - DNA, 25 bp, E. coli
gccaatttcgttgaccaggcgcgag

SEQ ID NO: 89350 - DNA, 25 bp, E. coli
gccaatttcgttcaccaggcgcgag

SEQ ID NO: 89351 - DNA, 25 bp, E. coli
cctatctcacgaaggtgcgtccgga

SEQ ID NO: 89352 - DNA, 25 bp, E. coli
cctatctcacgatggtgcgtccgga

SEQ ID NO: 89353 - DNA, 25 bp, E. coli
gaacaactcagtttcgccgatggct

SEQ ID NO: 89354 - DNA, 25 bp, E. coli
gaacaactcagtatcgccgatggct

SEQ ID NO: 89355 - DNA, 25 bp, E. coli
cggcaatggcaccaatcatcgggca

SEQ ID NO: 89356 - DNA, 25 bp, E. coli
cggcaatggcacgaatcatcgggca

SEQ ID NO: 89357 - DNA, 25 bp, E. coli
gatatttaccggtgcctatgccagc

SEQ ID NO: 89358 - DNA, 25 bp, E. coli
gatatttaccggagcctatgccagc

SEQ ID NO: 89359 - DNA, 25 bp, E. coli
gatctgatggcgctccaaaatggtg

SEQ ID NO: 89360 - DNA, 25 bp, E. coli
gatctgatggcggtccaaaatggtg

SEQ ID NO: 89361 - DNA, 25 bp, E. coli
aagttccggcaggtggaataaccca

SEQ ID NO: 89362 - DNA, 25 bp, E. coli
aagttccggcagctggaataaccca

SEQ ID NO: 89363 - DNA, 25 bp, E. coli
cccaggcttattttgagttgggtat

SEQ ID NO: 89364 - DNA, 25 bp, E. coli
cccaggcttattatgagttgggtat

SEQ ID NO: 89365 - DNA, 25 bp, E. coli
ataacccaggcttattttgagttgg

SEQ ID NO: 89366 - DNA, 25 bp, E. coli
ataacccaggctaattttgagttgg

SEQ ID NO: 89367 - DNA, 25 bp, E. coli
tccggcagctggtataacccaggct

SEQ ID NO: 89368 - DNA, 25 bp, E. coli
tcctgatggcgataaagttccggca

SEQ ID NO: 89369 - DNA, 25 bp, E. coli
tccggcagctggaataacccaggct

SEQ ID NO: 89370 - DNA, 25 bp, E. coli
tcctgatggcgaaaaagttccggca

SEQ ID NO: 89371 - DNA, 25 bp, E. coli
gcagctggaataacccaggcttatt

SEQ ID NO: 89372 - DNA, 25 bp, E. coli
gcagctggaatatcccaggcttatt

SEQ ID NO: 89373 - DNA, 25 bp, E. coli
cgtcctgatggccaaaaagttccgg

SEQ ID NO: 89374 - DNA, 25 bp, E. coli
ctgggcgcgtcctgatggcgaaaaa

SEQ ID NO: 89375 - DNA, 25 bp, E. coli
cgtcctgatggcgaaaaagttccgg

SEQ ID NO: 89376 - DNA, 25 bp, E. coli
ctgggcgcgtccagatggcgaaaaa

SEQ ID NO: 89377 - DNA, 25 bp, E. coli
ggcgcgtcctgaaggcgaaaaagtt

SEQ ID NO: 89378 - DNA, 25 bp, E. coli
ggcgcgtcctgatggcgaaaaagtt

SEQ ID NO: 89379 - DNA, 25 bp, E. coli
gtatgacgtttcgtgaactgtacga

SEQ ID NO: 89380 - DNA, 25 bp, E. coli
gagttgggtatgtcgtttcctgaac

SEQ ID NO: 89381 - DNA, 25 bp, E. coli
gtatgacgtttcctgaactgtacga

SEQ ID NO: 89382 - DNA, 25 bp, E. coli
gagttgggtatgacgtttcctgaac

SEQ ID NO: 89383 - DNA, 25 bp, E. coli
caattaacaggaacacagaacatgc

SEQ ID NO: 89384 - DNA, 25 bp, E. coli
caattaacaggatcacagaacatgc

SEQ ID NO: 89385 - DNA, 25 bp, E. coli
caggaacacagaacatgcaaaacat

SEQ ID NO: 89386 - DNA, 25 bp, E. coli
caggaacacagatcatgcaaaacat

SEQ ID NO: 89387 - DNA, 25 bp, E. coli
tacagatcgtacttccggcaacagg

SEQ ID NO: 89388 - DNA, 25 bp, E. coli
tacagatcgtacatccggcaacagg

SEQ ID NO: 89389 - DNA, 25 bp, E. coli
acatgcaaaacataacccagtcctg

SEQ ID NO: 89390 - DNA, 25 bp, E. coli
acatgcaaaacaaaacccagtcctg

SEQ ID NO: 89391 - DNA, 25 bp, E. coli
tcgctctcacctacgtgctggaaaa

SEQ ID NO: 89392 - DNA, 25 bp, E. coli
tcgctctcaccttcgtgctggaaaa

SEQ ID NO: 89393 - DNA, 25 bp, E. coli
tcgtacatccggcaacaggcacgga

SEQ ID NO: 89394 - DNA, 25 bp, E. coli
tcgtacatccgggaacaggcacgga

SEQ ID NO: 89395 - DNA, 25 bp, E. coli
gcaacaggcacggacgtccaattaa

SEQ ID NO: 89396 - DNA, 25 bp, E. coli
gcaacaggcacgcacgtccaattaa

SEQ ID NO: 89397 - DNA, 25 bp, E. coli
cggcctacagatggtacatccggca

SEQ ID NO: 89398 - DNA, 25 bp, E. coli
cggcctacagatcgtacatccggca

SEQ ID NO: 89399 - DNA, 25 bp, E. coli
ggacgtccaatttacaggaacacag

SEQ ID NO: 89400 - DNA, 25 bp, E. coli
ggacgtccaattaacaggaacacag

SEQ ID NO: 89401 - DNA, 25 bp, E. coli
ggcacggacgtccaattaacaggaa

SEQ ID NO: 89402 - DNA, 25 bp, E. coli
ggcacggacgtcgaattaacaggaa

SEQ ID NO: 89403 - DNA, 25 bp, E. coli
taacctgatcgcactcacctacgtg

SEQ ID NO: 89404 - DNA, 25 bp, E. coli
taacctgatcgctctcacctacgtg

SEQ ID NO: 89405 - DNA, 25 bp, E. coli
catggtgattttactcgtgttgtca

SEQ ID NO: 89406 - DNA, 25 bp, E. coli
cattatcacaagtggtaaatgctca

SEQ ID NO: 89407 - DNA, 25 bp, E. coli
cattatcacaagaggtaaatgctca

SEQ ID NO: 89408 - DNA, 25 bp, E. coli
catggtgatttttctcgtgttgtca

SEQ ID NO: 89409 - DNA, 25 bp, E. coli
ttaaagatgcgctacagaaatctgc

SEQ ID NO: 89410 - DNA, 25 bp, E. coli
ttaagagataaaaagcatcaaatgt

SEQ ID NO: 89411 - DNA, 25 bp, E. coli
ttaagagataaatagcatcaaatgt

SEQ ID NO: 89412 - DNA, 25 bp, E. coli
tttatcgtcggatatgtctggagcg

SEQ ID NO: 89413 - DNA, 25 bp, E. coli
tttatcgtcggaaatgtctggagcg

SEQ ID NO: 89414 - DNA, 25 bp, E. coli
ttaaagatgcgcaacagaaatctgc

SEQ ID NO: 89415 - DNA, 25 bp, E. coli
tcgtcggaaatgtctggagcgaccg

SEQ ID NO: 89416 - DNA, 25 bp, E. coli
tcgtcggaaatgactggagcgaccg

SEQ ID NO: 89417 - DNA, 25 bp, E. coli
tcacaagaggtaaatgctcaatttg

SEQ ID NO: 89418 - DNA, 25 bp, E. coli
cgcaacagaaatctgctgaaatttc

SEQ ID NO: 89419 - DNA, 25 bp, E. coli
cgtgttgtcaggttttatcgtcgga

SEQ ID NO: 89420 - DNA, 25 bp, E. coli
cgcaacagaaatgtgctgaaatttc

SEQ ID NO: 89421 - DNA, 25 bp, E. coli
cgtgttgtcaggatttatcgtcgga

SEQ ID NO: 89422 - DNA, 25 bp, E. coli
ggaacgtgatgctgccgcattatca

SEQ ID NO: 89423 - DNA, 25 bp, E. coli
ggaacgtgatgcagccgcattatca

SEQ ID NO: 89424 - DNA, 25 bp, E. coli
tcacaagaggtatatgctcaatttg

SEQ ID NO: 89425 - DNA, 25 bp, E. coli
gatgcgcaacagaaatctgctgaaa

SEQ ID NO: 89426 - DNA, 25 bp, E. coli
gatgcgcaacagtaatctgctgaaa

SEQ ID NO: 89427 - DNA, 25 bp, E. coli
cacaccacggcggtgatagttttta

SEQ ID NO: 89428 - DNA, 25 bp, E. coli
caagtggtcaccaattgaattagcc

SEQ ID NO: 89429 - DNA, 25 bp, E. coli
cacaccacggcgctgatagttttta

SEQ ID NO: 89430 - DNA, 25 bp, E. coli
caagtggtcacctattgaattagcc

SEQ ID NO: 89431 - DNA, 25 bp, E. coli
aaatggagccgcgtttctgaacaga

SEQ ID NO: 89432 - DNA, 25 bp, E. coli
aaatggagccgcctttctgaacaga

SEQ ID NO: 89433 - DNA, 25 bp, E. coli
tagcaatgcgccgtaatacctcaca

SEQ ID NO: 89434 - DNA, 25 bp, E. coli
taggtggtcaccttaacacaagagc

SEQ ID NO: 89435 - DNA, 25 bp, E. coli
tagcaatgcgccctaatacctcaca

SEQ ID NO: 89436 - DNA, 25 bp, E. coli
taggtggtcaccataacacaagagc

SEQ ID NO: 89437 - DNA, 25 bp, E. coli
tgtgtgatcccaaacataagcacgg

SEQ ID NO: 89438 - DNA, 25 bp, E. coli
tgtgtgatcccatacataagcacgg

SEQ ID NO: 89439 - DNA, 25 bp, E. coli
tgaatatacgccagaacgtgggcgg

SEQ ID NO: 89440 - DNA, 25 bp, E. coli
tgaatatacgcctgaacgtgggcgg

SEQ ID NO: 89441 - DNA, 25 bp, E. coli
tcgccctggtgatactgaaaaacaa

SEQ ID NO: 89442 - DNA, 25 bp, E. coli
tcgccctggtgaaactgaaaaacaa

SEQ ID NO: 89443 - DNA, 25 bp, E. coli
gctgcgccgtttgtgtgtgtgatcc

SEQ ID NO: 89444 - DNA, 25 bp, E. coli
gctgcgccgtttctgtgtgtgatcc

SEQ ID NO: 89445 - DNA, 25 bp, E. coli
gagcacttaaaatagcaaagccccg

SEQ ID NO: 89446 - DNA, 25 bp, E. coli
gagcacttaaaaaagcaaagccccg

SEQ ID NO: 89447 - DNA, 25 bp, E. coli
ctttctgaacagttaacccgctgcg

SEQ ID NO: 89448 - DNA, 25 bp, E. coli
ctttctgaacagataacccgctgcg

SEQ ID NO: 89449 - DNA, 25 bp, E. coli
caatccttatgactccggcgagaaa

SEQ ID NO: 89450 - DNA, 25 bp, E. coli
caatccttatgagtccggcgagaaa

SEQ ID NO: 89451 - DNA, 25 bp, E. coli
taaattactgctgaccgagactgat

SEQ ID NO: 89452 - DNA, 25 bp, E. coli
taaattactgctcaccgagactgat

SEQ ID NO: 89453 - DNA, 25 bp, E. coli
tatcaacggactaattcatggacag

SEQ ID NO: 89454 - DNA, 25 bp, E. coli
tatcaacggacttattcatggacag

SEQ ID NO: 89455 - DNA, 25 bp, E. coli
tcaaacccggttgtatgaagatcac

SEQ ID NO: 89456 - DNA, 25 bp, E. coli
tcaaacccggttctatgaagatcac

SEQ ID NO: 89457 - DNA, 25 bp, E. coli
tcatggacagaacaacaatgtcggc

SEQ ID NO: 89458 - DNA, 25 bp, E. coli
tcatggacagaagaacaatgtcggc

SEQ ID NO: 89459 - DNA, 25 bp, E. coli
gcaattttattctgatgggcctcga

SEQ ID NO: 89460 - DNA, 25 bp, E. coli
gcaattttattcagatgggcctcga

SEQ ID NO: 89461 - DNA, 25 bp, E. coli
gaaagcgtgacgatatatcagcgca

SEQ ID NO: 89462 - DNA, 25 bp, E. coli
gaaagcgtgacgttatatcagcgca

SEQ ID NO: 89463 - DNA, 25 bp, E. coli
ggagatccctcgcacagatgaagtc

SEQ ID NO: 89464 - DNA, 25 bp, E. coli
ggagatccctcggacagatgaagtc

SEQ ID NO: 89465 - DNA, 25 bp, E. coli
ggcaactttgggacgacatcattcg

SEQ ID NO: 89466 - DNA, 25 bp, E. coli
ggcaactttgggtcgacatcattcg

SEQ ID NO: 89467 - DNA, 25 bp, E. coli
taagtcaggccgttctggtgcgcaa

SEQ ID NO: 89468 - DNA, 25 bp, E. coli
taatcgtggtcaggataatccgcaa

SEQ ID NO: 89469 - DNA, 25 bp, E. coli
taagtcaggccgatctggtgcgcaa

SEQ ID NO: 89470 - DNA, 25 bp, E. coli
taatcgtggtcacgataatccgcaa

SEQ ID NO: 89471 - DNA, 25 bp, E. coli
tacaaaaatgatttacctgaccagg

SEQ ID NO: 89472 - DNA, 25 bp, E. coli
tacaaaaatgatatacctgaccagg

SEQ ID NO: 89473 - DNA, 25 bp, E. coli
aacgccttcagctattaacagtgag

SEQ ID NO: 89474 - DNA, 25 bp, E. coli
aaataccctgctgccatttgcctgg

SEQ ID NO: 89475 - DNA, 25 bp, E. coli
aaataccctgctcccatttgcctgg

SEQ ID NO: 89476 - DNA, 25 bp, E. coli
aacgccttcagcaattaacagtgag

SEQ ID NO: 89477 - DNA, 25 bp, E. coli
tgtatccgaacggtgatggctgtgt

SEQ ID NO: 89478 - DNA, 25 bp, E. coli
tgtatccgaacgctgatggctgtgt

SEQ ID NO: 89479 - DNA, 25 bp, E. coli
tgatatacctgaccaggaactggtc

SEQ ID NO: 89480 - DNA, 25 bp, E. coli
tgatatacctgagcaggaactggtc

SEQ ID NO: 89481 - DNA, 25 bp, E. coli
tctcgatgagattcaaacgccttca

SEQ ID NO: 89482 - DNA, 25 bp, E. coli
tctcgatgagatacaaacgccttca

SEQ ID NO: 89483 - DNA, 25 bp, E. coli
gcctggctctgggattttttctaag

SEQ ID NO: 89484 - DNA, 25 bp, E. coli
gcctggctctggcattttttctaag

SEQ ID NO: 89485 - DNA, 25 bp, E. coli
gaaataaaaaataaataccctgctg

SEQ ID NO: 89486 - DNA, 25 bp, E. coli
gaaataaaaaattaataccctgctg

SEQ ID NO: 89487 - DNA, 25 bp, E. coli
taacagtgagctatatacaaaaatg

SEQ ID NO: 89488 - DNA, 25 bp, E. coli
taatggcaggcatgttctcgatgag

SEQ ID NO: 89489 - DNA, 25 bp, E. coli
taatggcaggcaagttctcgatgag

SEQ ID NO: 89490 - DNA, 25 bp, E. coli
taacagtgagctttatacaaaaatg

SEQ ID NO: 89491 - DNA, 25 bp, E. coli
gatgaataccaacaaaactctgggc

SEQ ID NO: 89492 - DNA, 25 bp, E. coli
gatgaataccaagaaaactctgggc

SEQ ID NO: 89493 - DNA, 25 bp, E. coli
caaactggaaaacctggcgtcgtca

SEQ ID NO: 89494 - DNA, 25 bp, E. coli
caaactggaaaagctggcgtcgtca

SEQ ID NO: 89495 - DNA, 25 bp, E. coli
actggaaaacctggcgtcgtcatct

SEQ ID NO: 89496 - DNA, 25 bp, E. coli
actggaaaacctcgcgtcgtcatct

SEQ ID NO: 89497 - DNA, 25 bp, E. coli
acctggcgtcgtgatctattcttaa

SEQ ID NO: 89498 - DNA, 25 bp, E. coli
acctggcgtcgtcatctattcttaa

SEQ ID NO: 89499 - DNA, 25 bp, E. coli
tattgaccattttgcacgcaaactg

SEQ ID NO: 89500 - DNA, 25 bp, E. coli
tattgaccatttagcacgcaaactg

SEQ ID NO: 89501 - DNA, 25 bp, E. coli
tttgcacgcaaactggaaaacctgg

SEQ ID NO: 89502 - DNA, 25 bp, E. coli
tttgcacgcaaagtggaaaacctgg

SEQ ID NO: 89503 - DNA, 25 bp, E. coli
tgcacgcaaactcgaaaacctggcg

SEQ ID NO: 89504 - DNA, 25 bp, E. coli
tgcacgcaaactggaaaacctggcg

SEQ ID NO: 89505 - DNA, 25 bp, E. coli
gctgatgaccaccacgctttttatt

SEQ ID NO: 89506 - DNA, 25 bp, E. coli
gctttttattgagcattttgcacgc

SEQ ID NO: 89507 - DNA, 25 bp, E. coli
gctgatgaccacgacgctttttatt

SEQ ID NO: 89508 - DNA, 25 bp, E. coli
gctttttattgaccattttgcacgc

SEQ ID NO: 89509 - DNA, 25 bp, E. coli
gaccaccacgctatttattgaccat

SEQ ID NO: 89510 - DNA, 25 bp, E. coli
gaccaccacgctttttattgaccat

SEQ ID NO: 89511 - DNA, 25 bp, E. coli
ctggcgtcgtcatctattcttaaag

SEQ ID NO: 89512 - DNA, 25 bp, E. coli
ctggcgtcgtcaactattcttaaag

SEQ ID NO: 89513 - DNA, 25 bp, E. coli
ggaaaacctggcctcgtcatctatt

SEQ ID NO: 89514 - DNA, 25 bp, E. coli
ggaaaacctggcgtcgtcatctatt

SEQ ID NO: 89515 - DNA, 25 bp, E. coli
caacgaatcttaccgatggtgcagg

SEQ ID NO: 89516 - DNA, 25 bp, E. coli
caacgaatcttagcgatggtgcagg

SEQ ID NO: 89517 - DNA, 25 bp, E. coli
tactgggccgaatatcagcgtgatg

SEQ ID NO: 89518 - DNA, 25 bp, E. coli
tactgggccgaaaatcagcgtgatg

SEQ ID NO: 89519 - DNA, 25 bp, E. coli
aggcctgctctgtcgccctgtggaa

SEQ ID NO: 89520 - DNA, 25 bp, E. coli
aggcctgctctgacgccctgtggaa

SEQ ID NO: 89521 - DNA, 25 bp, E. coli
tgcaggatatcctgaccaccagcgg

SEQ ID NO: 89522 - DNA, 25 bp, E. coli
tgcaggatatccagaccaccagcgg

SEQ ID NO: 89523 - DNA, 25 bp, E. coli
tccacgctaatgtcgatggcgcaag

SEQ ID NO: 89524 - DNA, 25 bp, E. coli
tccacgctaatgacgatggcgcaag

SEQ ID NO: 89525 - DNA, 25 bp, E. coli
gctttgccctcgtgaacatactcaa

SEQ ID NO: 89526 - DNA, 25 bp, E. coli
gctttgccctcgagaacatactcaa

SEQ ID NO: 89527 - DNA, 25 bp, E. coli
gaaaacggtatctggcacggtgaag

SEQ ID NO: 89528 - DNA, 25 bp, E. coli
gaaaacggtatcaggcacggtgaag

SEQ ID NO: 89529 - DNA, 25 bp, E. coli
ggtgaagaaacccaagccgtactca

SEQ ID NO: 89530 - DNA, 25 bp, E. coli
ggtgaagaaaccgaagccgtactca

SEQ ID NO: 89531 - DNA, 25 bp, E. coli
ggaacgacggtactgtcaacgctca

SEQ ID NO: 89532 - DNA, 25 bp, E. coli
ggaacgacggtagtgtcaacgctca

SEQ ID NO: 89533 - DNA, 25 bp, E. coli
tggctatcgatagcgcgacagaggc

SEQ ID NO: 89534 - DNA, 25 bp, E. coli
tggctatcgataccgcgacagaggc

SEQ ID NO: 89535 - DNA, 25 bp, E. coli
taacaacgtcgcttggaagaaactt

SEQ ID NO: 89536 - DNA, 25 bp, E. coli
taacaacgtcgcatggaagaaactt

SEQ ID NO: 89537 - DNA, 25 bp, E. coli
tatctggtgtataaaagccgtcccg

SEQ ID NO: 89538 - DNA, 25 bp, E. coli
tatttacgacgaactgaaacccggc

SEQ ID NO: 89539 - DNA, 25 bp, E. coli
tatttacgacgatctgaaacccggc

SEQ ID NO: 89540 - DNA, 25 bp, E. coli
tatctggtgtattaaagccgtcccg

SEQ ID NO: 89541 - DNA, 25 bp, E. coli
ttatgaggccgtaaaaacgacgcgg

SEQ ID NO: 89542 - DNA, 25 bp, E. coli
ttatgaggccgttaaaacgacgcgg

SEQ ID NO: 89543 - DNA, 25 bp, E. coli
tgaccagtgatgtgagcaacaggct

SEQ ID NO: 89544 - DNA, 25 bp, E. coli
tgaccagtgatgagagcaacaggct

SEQ ID NO: 89545 - DNA, 25 bp, E. coli
tcggaatggtgatgtcggatcgccc

SEQ ID NO: 89546 - DNA, 25 bp, E. coli
tcggaatggtgaagtcggatcgccc

SEQ ID NO: 89547 - DNA, 25 bp, E. coli
gaacgtctgatggtgcgtacctggc

SEQ ID NO: 89548 - DNA, 25 bp, E. coli
gaattttttccactacagcgcgcaa

SEQ ID NO: 89549 - DNA, 25 bp, E. coli
gaacgtctgatgctgcgtacctggc

SEQ ID NO: 89550 - DNA, 25 bp, E. coli
gaattttttccagtacagcgcgcaa

SEQ ID NO: 89551 - DNA, 25 bp, E. coli
cccagatggtttgcgggcgcataaa

SEQ ID NO: 89552 - DNA, 25 bp, E. coli
cccagatggtttccgggcgcataaa

SEQ ID NO: 89553 - DNA, 25 bp, E. coli
gattattgtcgacccacatccggta

SEQ ID NO: 89554 - DNA, 25 bp, E. coli
gattattgtcgagccacatccggta

SEQ ID NO: 89555 - DNA, 25 bp, E. coli
ggcagtttacccctccgatgctgga

SEQ ID NO: 89556 - DNA, 25 bp, E. coli
ggcagtttacccgtccgatgctgga

SEQ ID NO: 89557 - DNA, 25 bp, E. coli
taatggcagcaacgataaggaacgc

SEQ ID NO: 89558 - DNA, 25 bp, E. coli
taatggcagcaaggataaggaacgc

SEQ ID NO: 89559 - DNA, 25 bp, E. coli
tacctttgcagagccggctgctgcg

SEQ ID NO: 89560 - DNA, 25 bp, E. coli
tacctttgcagacccggctgctgcg

SEQ ID NO: 89561 - DNA, 25 bp, E. coli
tgaaactgtgctcctgcactacgac

SEQ ID NO: 89562 - DNA, 25 bp, E. coli
tgaaactgtgctgctgcactacgac

SEQ ID NO: 89563 - DNA, 25 bp, E. coli
tgcagcaaggaccttttcgccgtga

SEQ ID NO: 89564 - DNA, 25 bp, E. coli
tgcagcaaggacgttttcgccgtga

SEQ ID NO: 89565 - DNA, 25 bp, E. coli
tcaggaaaccattccagcgctggtg

SEQ ID NO: 89566 - DNA, 25 bp, E. coli
tcaggaaaccataccagcgctggtg

SEQ ID NO: 89567 - DNA, 25 bp, E. coli
gcaaggacgttttcgccgtgatctg

SEQ ID NO: 89568 - DNA, 25 bp, E. coli
gcaaggacgtttacgccgtgatctg

SEQ ID NO: 89569 - DNA, 25 bp, E. coli
gaaaccattccaccgctggtggcgt

SEQ ID NO: 89570 - DNA, 25 bp, E. coli
gaaaccattccagcgctggtggcgt

SEQ ID NO: 89571 - DNA, 25 bp, E. coli
cattccagcgctcgtggcgtttcaa

SEQ ID NO: 89572 - DNA, 25 bp, E. coli
cattccagcgctggtggcgtttcaa

SEQ ID NO: 89573 - DNA, 25 bp, E. coli
gatatgcagcaacgacgttttcgcc

SEQ ID NO: 89574 - DNA, 25 bp, E. coli
gatatgcagcaaggacgttttcgcc

SEQ ID NO: 89575 - DNA, 25 bp, E. coli
gggttacaggcaagtgaaactgtgc

SEQ ID NO: 89576 - DNA, 25 bp, E. coli
gggttacaggcatgtgaaactgtgc

SEQ ID NO: 89577 - DNA, 25 bp, E. coli
ggcaagtgaaactgtgctgctgcac

SEQ ID NO: 89578 - DNA, 25 bp, E. coli
ggcaagtgaaacagtgctgctgcac

SEQ ID NO: 89579 - DNA, 25 bp, E. coli
gacccggctgctgcgggtgctggaa

SEQ ID NO: 89580 - DNA, 25 bp, E. coli
gacccggctgctccgggtgctggaa

SEQ ID NO: 89581 - DNA, 25 bp, E. coli
cctgaagttccccaagggtcatcgt

SEQ ID NO: 89582 - DNA, 25 bp, E. coli
cctgaagttcccgaagggtcatcgt

SEQ ID NO: 89583 - DNA, 25 bp, E. coli
tgatagggcaagacttcacccaccc

SEQ ID NO: 89584 - DNA, 25 bp, E. coli
tgatagggcaagtcttcacccaccc

SEQ ID NO: 89585 - DNA, 25 bp, E. coli
cctcttgaatatacctgatagggca

SEQ ID NO: 89586 - DNA, 25 bp, E. coli
cctcttgaatattcctgatagggca

SEQ ID NO: 89587 - DNA, 25 bp, E. coli
cgattccaggttcttagcgcgagat

SEQ ID NO: 89588 - DNA, 25 bp, E. coli
cgattccaggttgttagcgcgagat

SEQ ID NO: 89589 - DNA, 25 bp, E. coli
cggaatagcttgcatttgttatacc

SEQ ID NO: 89590 - DNA, 25 bp, E. coli
cggaatagcttggatttgttatacc

SEQ ID NO: 89591 - DNA, 25 bp, E. coli
gatagtcatttttccctgaagttcc

SEQ ID NO: 89592 - DNA, 25 bp, E. coli
gtagtatgacggctcgattccaggt

SEQ ID NO: 89593 - DNA, 25 bp, E. coli
gtttactttatacggcgttgcgccg

SEQ ID NO: 89594 - DNA, 25 bp, E. coli
gatagtcattttaccctgaagttcc

SEQ ID NO: 89595 - DNA, 25 bp, E. coli
gtttactttatagggcgttgcgccg

SEQ ID NO: 89596 - DNA, 25 bp, E. coli
gtagtatgacgggtcgattccaggt

SEQ ID NO: 89597 - DNA, 25 bp, E. coli
gggtacaagtcccaggtcagctaca

SEQ ID NO: 89598 - DNA, 25 bp, E. coli
gggtacaagtccgaggtcagctaca

SEQ ID NO: 89599 - DNA, 25 bp, E. coli
ggctgttcggccagcccggcataac

SEQ ID NO: 89600 - DNA, 25 bp, E. coli
ggcataactccttaccgggaccaga

SEQ ID NO: 89601 - DNA, 25 bp, E. coli
ggcataactcctaaccgggaccaga

SEQ ID NO: 89602 - DNA, 25 bp, E. coli
ggctgttcggcctgcccggcataac

SEQ ID NO: 89603 - DNA, 25 bp, E. coli
caattacactagagagacccgaaga

SEQ ID NO: 89604 - DNA, 25 bp, E. coli
caattacactagtgagacccgaaga

SEQ ID NO: 89605 - DNA, 25 bp, E. coli
caaaaattcagaaagttcggcagta

SEQ ID NO: 89606 - DNA, 25 bp, E. coli
caaaaattcagatagttcggcagta

SEQ ID NO: 89607 - DNA, 25 bp, E. coli
agtgcccgccagtgtctattcagtg

SEQ ID NO: 89608 - DNA, 25 bp, E. coli
agtgcccgccagagtctattcagtg

SEQ ID NO: 89609 - DNA, 25 bp, E. coli
tagttcaggaaatttccagtgcccg

SEQ ID NO: 89610 - DNA, 25 bp, E. coli
taggatgctcagaatgctttcggac

SEQ ID NO: 89611 - DNA, 25 bp, E. coli
taggatgctcagtatgctttcggac

SEQ ID NO: 89612 - DNA, 25 bp, E. coli
tagttcaggaaaattccagtgcccg

SEQ ID NO: 89613 - DNA, 25 bp, E. coli
ttgtatttaatgaaaccgatgggcg

SEQ ID NO: 89614 - DNA, 25 bp, E. coli
ttgtatttaatgtaaccgatgggcg

SEQ ID NO: 89615 - DNA, 25 bp, E. coli
tgaatgtccttcgagctcaagtagc

SEQ ID NO: 89616 - DNA, 25 bp, E. coli
tgaatgtccttccagctcaagtagc

SEQ ID NO: 89617 - DNA, 25 bp, E. coli
gggcgttttctaaccagcggcagta

SEQ ID NO: 89618 - DNA, 25 bp, E. coli
gggcgttttctatccagcggcagta

SEQ ID NO: 89619 - DNA, 25 bp, E. coli
gtgaaggctcatatcatccactgac

SEQ ID NO: 89620 - DNA, 25 bp, E. coli
gtgaaggctcatttcatccactgac

SEQ ID NO: 89621 - DNA, 25 bp, E. coli
taataacggccctgaagctcttcgc

SEQ ID NO: 89622 - DNA, 25 bp, E. coli
taataacggcccagaagctcttcgc

SEQ ID NO: 89623 - DNA, 25 bp, E. coli
tcaagtagcatctagcggtcgaggg

SEQ ID NO: 89624 - DNA, 25 bp, E. coli
tcaagtagcatcaagcggtcgaggg

SEQ ID NO: 89625 - DNA, 25 bp, E. coli
caacgtctgcttttacgctgtttaa

SEQ ID NO: 89626 - DNA, 25 bp, E. coli
caacgtctgcttatacgctgtttaa

SEQ ID NO: 89627 - DNA, 25 bp, E. coli
cagtcatcggcacgtaagaccacca

SEQ ID NO: 89628 - DNA, 25 bp, E. coli
caggtaagaccagcacgcagaacat

SEQ ID NO: 89629 - DNA, 25 bp, E. coli
cagaacatcgcatcaagtttatggg

SEQ ID NO: 89630 - DNA, 25 bp, E. coli
cagaacatcgcaacaagtttatggg

SEQ ID NO: 89631 - DNA, 25 bp, E. coli
cagtcatcggcaggtaagaccacca

SEQ ID NO: 89632 - DNA, 25 bp, E. coli
caggtaagaccaccacgcagaacat

SEQ ID NO: 89633 - DNA, 25 bp, E. coli
taccactggatgtgataggccaggc

SEQ ID NO: 89634 - DNA, 25 bp, E. coli
taccactggatgagataggccaggc

SEQ ID NO: 89635 - DNA, 25 bp, E. coli
tattgccaatgaggccgaggcccat

SEQ ID NO: 89636 - DNA, 25 bp, E. coli
tattgccaatgacgccgaggcccat

SEQ ID NO: 89637 - DNA, 25 bp, E. coli
gccgaggcccattatgacgggcttt

SEQ ID NO: 89638 - DNA, 25 bp, E. coli
gccgaggcccataatgacgggcttt

SEQ ID NO: 89639 - DNA, 25 bp, E. coli
gcatcttttcgaacagtcatcggca

SEQ ID NO: 89640 - DNA, 25 bp, E. coli
gcatcttttcgatcagtcatcggca

SEQ ID NO: 89641 - DNA, 25 bp, E. coli
cgcgggaagtgtcaacgtctgctta

SEQ ID NO: 89642 - DNA, 25 bp, E. coli
cgcgggaagtgtgaacgtctgctta

SEQ ID NO: 89643 - DNA, 25 bp, E. coli
ggcgttaggtattgccaatgaggcc

SEQ ID NO: 89644 - DNA, 25 bp, E. coli
ggcgttaggtatagccaatgaggcc

SEQ ID NO: 89645 - DNA, 25 bp, E. coli
taatgacgggctattaccactggat

SEQ ID NO: 89646 - DNA, 25 bp, E. coli
taatgacgggcttttaccactggat

SEQ ID NO: 89647 - DNA, 25 bp, E. coli
cagtgaagagcagcatccggtgatc

SEQ ID NO: 89648 - DNA, 25 bp, E. coli
cagtgaagagcaccatccggtgatc

SEQ ID NO: 89649 - DNA, 25 bp, E. coli
cagatattctcaaggtggagcgccg

SEQ ID NO: 89650 - DNA, 25 bp, E. coli
cagataacgagtggcatgacgcgat

SEQ ID NO: 89651 - DNA, 25 bp, E. coli
cagatattctcatggtggagcgccg

SEQ ID NO: 89652 - DNA, 25 bp, E. coli
cagataacgagtcgcatgacgcgat

SEQ ID NO: 89653 - DNA, 25 bp, E. coli
taaacgacagggtcagttcactggt

SEQ ID NO: 89654 - DNA, 25 bp, E. coli
taaacgacagggacagttcactggt

SEQ ID NO: 89655 - DNA, 25 bp, E. coli
tgttgcacaggaccatatccgcacg

SEQ ID NO: 89656 - DNA, 25 bp, E. coli
tgttgcacaggagcatatccgcacg

SEQ ID NO: 89657 - DNA, 25 bp, E. coli
tcagcgggcgcagttacatcttgag

SEQ ID NO: 89658 - DNA, 25 bp, E. coli
tctgaacactctggactggcttggt

SEQ ID NO: 89659 - DNA, 25 bp, E. coli
tcagcgggcgcacttacatcttgag

SEQ ID NO: 89660 - DNA, 25 bp, E. coli
tctgaacactctcgactggcttggt

SEQ ID NO: 89661 - DNA, 25 bp, E. coli
gcaggctgcagatcacttaccggtt

SEQ ID NO: 89662 - DNA, 25 bp, E. coli
gcaggctgcagaacacttaccggtt

SEQ ID NO: 89663 - DNA, 25 bp, E. coli
gacgcgattaacaggctgggagact

SEQ ID NO: 89664 - DNA, 25 bp, E. coli
gacgcgattaactggctgggagact

SEQ ID NO: 89665 - DNA, 25 bp, E. coli
gaacgcctctctgaaagtatggtcg

SEQ ID NO: 89666 - DNA, 25 bp, E. coli
gaacgcctctctcaaagtatggtcg

SEQ ID NO: 89667 - DNA, 25 bp, E. coli
taaccgggtatgacaggtactcacc

SEQ ID NO: 89668 - DNA, 25 bp, E. coli
taaccgggtatgtcaggtactcacc

SEQ ID NO: 89669 - DNA, 25 bp, E. coli
cacgatatgcggaattgacatttgt

SEQ ID NO: 89670 - DNA, 25 bp, E. coli
cacgatatgcggtattgacatttgt

SEQ ID NO: 89671 - DNA, 25 bp, E. coli
aaacaccggtttgcctgctcaattg

SEQ ID NO: 89672 - DNA, 25 bp, E. coli
aaacaccggtttccctgctcaattg

SEQ ID NO: 89673 - DNA, 25 bp, E. coli
tatgtaatatgcatcacgatatgcg

SEQ ID NO: 89674 - DNA, 25 bp, E. coli
tatgtaatatgcttcacgatatgcg

SEQ ID NO: 89675 - DNA, 25 bp, E. coli
tattaccttgatttgtccgtttgcg

SEQ ID NO: 89676 - DNA, 25 bp, E. coli
tattaccttgatatgtccgtttgcg

SEQ ID NO: 89677 - DNA, 25 bp, E. coli
tgcggacaagcattagataaggcgt

SEQ ID NO: 89678 - DNA, 25 bp, E. coli
tgcggacaagcaatagataaggcgt

SEQ ID NO: 89679 - DNA, 25 bp, E. coli
gcatttcgggtaaaaaggtgcttcg

SEQ ID NO: 89680 - DNA, 25 bp, E. coli
gctttcattaaaccgcacgagtatt

SEQ ID NO: 89681 - DNA, 25 bp, E. coli
gcatttcgggtataaaggtgcttcg

SEQ ID NO: 89682 - DNA, 25 bp, E. coli
gctttcattaaagcgcacgagtatt

SEQ ID NO: 89683 - DNA, 25 bp, E. coli
gatatgtccgttagcggacaagcaa

SEQ ID NO: 89684 - DNA, 25 bp, E. coli
gataaggcgtgttgtagatcacaaa

SEQ ID NO: 89685 - DNA, 25 bp, E. coli
gataaggcgtgtagtagatcacaaa

SEQ ID NO: 89686 - DNA, 25 bp, E. coli
gatatgtccgtttgcggacaagcaa

SEQ ID NO: 89687 - DNA, 25 bp, E. coli
ggtttccctgctcaattgctttcat

SEQ ID NO: 89688 - DNA, 25 bp, E. coli
ggtttccctgctgaattgctttcat

SEQ ID NO: 89689 - DNA, 25 bp, E. coli
taattcactgttttcaaaacaccgg

SEQ ID NO: 89690 - DNA, 25 bp, E. coli
taattcactgttatcaaaacaccgg

SEQ ID NO: 89691 - DNA, 25 bp, E. coli
caatggtaatgtttacaagaacgcc

SEQ ID NO: 89692 - DNA, 25 bp, E. coli
caatggtaatgtatacaagaacgcc

SEQ ID NO: 89693 - DNA, 25 bp, E. coli
tactcattgcaaccgtggagcggcc

SEQ ID NO: 89694 - DNA, 25 bp, E. coli
tactcattgcaagcgtggagcggcc

SEQ ID NO: 89695 - DNA, 25 bp, E. coli
ataacggcggcgtcattgttgcgga

SEQ ID NO: 89696 - DNA, 25 bp, E. coli
ataacggcggcgacattgttgcgga

SEQ ID NO: 89697 - DNA, 25 bp, E. coli
acgctccgctggctgcttcctgtaa

SEQ ID NO: 89698 - DNA, 25 bp, E. coli
acgctccgctgggtgcttcctgtaa

SEQ ID NO: 89699 - DNA, 25 bp, E. coli
aaatacgcctgcatccaatacgccg

SEQ ID NO: 89700 - DNA, 25 bp, E. coli
aaatacgcctgcttccaatacgccg

SEQ ID NO: 89701 - DNA, 25 bp, E. coli
tatcggtggtgctaacaacgctccg

SEQ ID NO: 89702 - DNA, 25 bp, E. coli
tatcggtggtgcaaacaacgctccg

SEQ ID NO: 89703 - DNA, 25 bp, E. coli
tgtttacaagaacgcctggtgggtt

SEQ ID NO: 89704 - DNA, 25 bp, E. coli
tgtttacaagaaggcctggtgggtt

SEQ ID NO: 89705 - DNA, 25 bp, E. coli
gaaatcagccagtatggtaaccctg

SEQ ID NO: 89706 - DNA, 25 bp, E. coli
gaaatcagccagaatggtaaccctg

SEQ ID NO: 89707 - DNA, 25 bp, E. coli
gatagcgttaacgattactcattgc

SEQ ID NO: 89708 - DNA, 25 bp, E. coli
gtaccagcgctgaaaactccaataa

SEQ ID NO: 89709 - DNA, 25 bp, E. coli
gatagcgttaaccattactcattgc

SEQ ID NO: 89710 - DNA, 25 bp, E. coli
ggttgggtctaatgattgcccacgg

SEQ ID NO: 89711 - DNA, 25 bp, E. coli
gtaccagcgctgtaaactccaataa

SEQ ID NO: 89712 - DNA, 25 bp, E. coli
ggttgggtctaaagattgcccacgg

SEQ ID NO: 89713 - DNA, 25 bp, E. coli
aacctgcaagcaccgtctcgcggta

SEQ ID NO: 89714 - DNA, 25 bp, E. coli
catcgttgtcctctggctatttgcc

SEQ ID NO: 89715 - DNA, 25 bp, E. coli
catcgttgtcctgtggctatttgcc

SEQ ID NO: 89716 - DNA, 25 bp, E. coli
aacctgcaagcagcgtctcgcggta

SEQ ID NO: 89717 - DNA, 25 bp, E. coli
tatcgatgattacccctatggtctg

SEQ ID NO: 89718 - DNA, 25 bp, E. coli
tagtttattgttagcaacaacctgc

SEQ ID NO: 89719 - DNA, 25 bp, E. coli
tagtttattgtttgcaacaacctgc

SEQ ID NO: 89720 - DNA, 25 bp, E. coli
tattgttagcaacaacctgcaagca

SEQ ID NO: 89721 - DNA, 25 bp, E. coli
tatcgatgattagccctatggtctg

SEQ ID NO: 89722 - DNA, 25 bp, E. coli
tattgttagcaagaacctgcaagca

SEQ ID NO: 89723 - DNA, 25 bp, E. coli
tgatatcgatgattacccctatggt

SEQ ID NO: 89724 - DNA, 25 bp, E. coli
tgtcctctggctttttgccagccgc

SEQ ID NO: 89725 - DNA, 25 bp, E. coli
tgatatcgatgaatacccctatggt

SEQ ID NO: 89726 - DNA, 25 bp, E. coli
tgtcctctggctatttgccagccgc

SEQ ID NO: 89727 - DNA, 25 bp, E. coli
tgcaagcagcgtgtcgcggtagttt

SEQ ID NO: 89728 - DNA, 25 bp, E. coli
tgcaagcagcgtctcgcggtagttt

SEQ ID NO: 89729 - DNA, 25 bp, E. coli
gcaacaacctgctagcagcgtctcg

SEQ ID NO: 89730 - DNA, 25 bp, E. coli
gcaacaacctgcaagcagcgtctcg

SEQ ID NO: 89731 - DNA, 25 bp, E. coli
gttagcaacaacctgcaagcagcgt

SEQ ID NO: 89732 - DNA, 25 bp, E. coli
gttagcaacaacgtgcaagcagcgt

SEQ ID NO: 89733 - DNA, 25 bp, E. coli
gatgattaccccaatggtctggttt

SEQ ID NO: 89734 - DNA, 25 bp, E. coli
gatgattacccctatggtctggttt

SEQ ID NO: 89735 - DNA, 25 bp, E. coli
aattctttgagaaggttgtggcgct

SEQ ID NO: 89736 - DNA, 25 bp, E. coli
aattctttgagatggttgtggcgct

SEQ ID NO: 89737 - DNA, 25 bp, E. coli
acgccgccgtgatgtgctggtgaaa

SEQ ID NO: 89738 - DNA, 25 bp, E. coli
acgccgccgtgaagtgctggtgaaa

SEQ ID NO: 89739 - DNA, 25 bp, E. coli
tgcaggtgccaggtgcacgcgacat

SEQ ID NO: 89740 - DNA, 25 bp, E. coli
tgcaggtgccagctgcacgcgacat

SEQ ID NO: 89741 - DNA, 25 bp, E. coli
tgcgtggaactgcaattctttgaga

SEQ ID NO: 89742 - DNA, 25 bp, E. coli
tgcgtggaactggaattctttgaga

SEQ ID NO: 89743 - DNA, 25 bp, E. coli
ccggaaccgtatcctgccatgggct

SEQ ID NO: 89744 - DNA, 25 bp, E. coli
ccaagaaattgcttaacgaagcgaa

SEQ ID NO: 89745 - DNA, 25 bp, E. coli
ccggaaccgtatgctgccatgggct

SEQ ID NO: 89746 - DNA, 25 bp, E. coli
ccaagaaattgcataacgaagcgaa

SEQ ID NO: 89747 - DNA, 25 bp, E. coli
gcgactacggcgatacgcatgtgcg

SEQ ID NO: 89748 - DNA, 25 bp, E. coli
gcgactacggcgttacgcatgtgcg

SEQ ID NO: 89749 - DNA, 25 bp, E. coli
cgcgacatggcggtcgagttcttta

SEQ ID NO: 89750 - DNA, 25 bp, E. coli
cccattcatatttacggcgcggtga

SEQ ID NO: 89751 - DNA, 25 bp, E. coli
cccattcatattaacggcgcggtga

SEQ ID NO: 89752 - DNA, 25 bp, E. coli
cgcgacatggcgctcgagttcttta

SEQ ID NO: 89753 - DNA, 25 bp, E. coli
gtatgctgccatgggctcgctggaa

SEQ ID NO: 89754 - DNA, 25 bp, E. coli
gtatgctgccatcggctcgctggaa

SEQ ID NO: 89755 - DNA, 25 bp, E. coli
ggtcagcgcgttcgcacgtattaaa

SEQ ID NO: 89756 - DNA, 25 bp, E. coli
ggtcagcgcgttggcacgtattaaa

SEQ ID NO: 89757 - DNA, 25 bp, E. coli
caatcaaatctggtgtaatacacac

SEQ ID NO: 89758 - DNA, 25 bp, E. coli
caatcaaatctgctgtaatacacac

SEQ ID NO: 89759 - DNA, 25 bp, E. coli
agctttgaaggctttaaatgaacgc

SEQ ID NO: 89760 - DNA, 25 bp, E. coli
agctttgaaggcattaaatgaacgc

SEQ ID NO: 89761 - DNA, 25 bp, E. coli
aaagtatggctttataatgctcacc

SEQ ID NO: 89762 - DNA, 25 bp, E. coli
aaagtatggcttaataatgctcacc

SEQ ID NO: 89763 - DNA, 25 bp, E. coli
tatttagagcagatcaaagtatggc

SEQ ID NO: 89764 - DNA, 25 bp, E. coli
tatttagagcagttcaaagtatggc

SEQ ID NO: 89765 - DNA, 25 bp, E. coli
tgtaatacacacagtaaaacctgct

SEQ ID NO: 89766 - DNA, 25 bp, E. coli
tgtaatacacactgtaaaacctgct

SEQ ID NO: 89767 - DNA, 25 bp, E. coli
taatccgttaccagcaaaatacctt

SEQ ID NO: 89768 - DNA, 25 bp, E. coli
taatccgttacctgcaaaatacctt

SEQ ID NO: 89769 - DNA, 25 bp, E. coli
cctgctaatttaaaagtggcttctc

SEQ ID NO: 89770 - DNA, 25 bp, E. coli
gctcaccttaaacaaataacgattg

SEQ ID NO: 89771 - DNA, 25 bp, E. coli
cctgctaatttataagtggcttctc

SEQ ID NO: 89772 - DNA, 25 bp, E. coli
gctcaccttaaagaaataacgattg

SEQ ID NO: 89773 - DNA, 25 bp, E. coli
gcttctcaacgaattaaaagacttg

SEQ ID NO: 89774 - DNA, 25 bp, E. coli
gcttctcaacgatttaaaagacttg

SEQ ID NO: 89775 - DNA, 25 bp, E. coli
gaagaacttaataatccgttacctg

SEQ ID NO: 89776 - DNA, 25 bp, E. coli
gaagaacttaattatccgttacctg

SEQ ID NO: 89777 - DNA, 25 bp, E. coli
gacttgaagcagtaaatgaagcttt

SEQ ID NO: 89778 - DNA, 25 bp, E. coli
gacttgaagcagaaaatgaagcttt

SEQ ID NO: 89779 - DNA, 25 bp, E. coli
caacaggtgaatcatggcgtggaac

SEQ ID NO: 89780 - DNA, 25 bp, E. coli
caacaggtgaatgatggcgtggaac

SEQ ID NO: 89781 - DNA, 25 bp, E. coli
catccgctggcgaacgttgaagagc

SEQ ID NO: 89782 - DNA, 25 bp, E. coli
catccgctggcgtacgttgaagagc

SEQ ID NO: 89783 - DNA, 25 bp, E. coli
agaaattttcgggaacccacgcagt

SEQ ID NO: 89784 - DNA, 25 bp, E. coli
agaaattttcggcaacccacgcagt

SEQ ID NO: 89785 - DNA, 25 bp, E. coli
acaaatctatatcggcgtctgggac

SEQ ID NO: 89786 - DNA, 25 bp, E. coli
acaaatctatatgggcgtctgggac

SEQ ID NO: 89787 - DNA, 25 bp, E. coli
tattgtgaccttctttacccagcgc

SEQ ID NO: 89788 - DNA, 25 bp, E. coli
tattgtgaccttgtttacccagcgc

SEQ ID NO: 89789 - DNA, 25 bp, E. coli
ttaaccaaacgcgtcgcctggcgat

SEQ ID NO: 89790 - DNA, 25 bp, E. coli
ttaaccaaacgcctcgcctggcgat

SEQ ID NO: 89791 - DNA, 25 bp, E. coli
gcgcaggccggaaatcagcggattt

SEQ ID NO: 89792 - DNA, 25 bp, E. coli
gcgcaggccggatatcagcggattt

SEQ ID NO: 89793 - DNA, 25 bp, E. coli
gaaaccttgcggtctttcattgcgg

SEQ ID NO: 89794 - DNA, 25 bp, E. coli
gaaaccttgcggactttcattgcgg

SEQ ID NO: 89795 - DNA, 25 bp, E. coli
cgattatgtaaatccacggcgacga

SEQ ID NO: 89796 - DNA, 25 bp, E. coli
cgattatgtaaaaccacggcgacga

SEQ ID NO: 89797 - DNA, 25 bp, E. coli
gataatcaacaactggtcagccggg

SEQ ID NO: 89798 - DNA, 25 bp, E. coli
gataatcaacaagtggtcagccggg

SEQ ID NO: 89799 - DNA, 25 bp, E. coli
gtcaatattgaagacagcgcccgca

SEQ ID NO: 89800 - DNA, 25 bp, E. coli
gtcaatattgaacacagcgcccgca

SEQ ID NO: 89801 - DNA, 25 bp, E. coli
caataaactgcagcacaaaggcgaa

SEQ ID NO: 89802 - DNA, 25 bp, E. coli
caataaactgcaccacaaaggcgaa

SEQ ID NO: 89803 - DNA, 25 bp, E. coli
cacaagggtttgttgctgacgccac

SEQ ID NO: 89804 - DNA, 25 bp, E. coli
cacaatcaatactcctaacggcgtt

SEQ ID NO: 89805 - DNA, 25 bp, E. coli
cacaagggtttgatgctgacgccac

SEQ ID NO: 89806 - DNA, 25 bp, E. coli
cacaatcaatacacctaacggcgtt

SEQ ID NO: 89807 - DNA, 25 bp, E. coli
aaatggaaattagtccggccatccg

SEQ ID NO: 89808 - DNA, 25 bp, E. coli
acaaaggcgaagcacgtcgtgccgc

SEQ ID NO: 89809 - DNA, 25 bp, E. coli
acaaaggcgaaggacgtcgtgccgc

SEQ ID NO: 89810 - DNA, 25 bp, E. coli
aaatggaaattactccggccatccg

SEQ ID NO: 89811 - DNA, 25 bp, E. coli
gctggaacggcacctcaataaactg

SEQ ID NO: 89812 - DNA, 25 bp, E. coli
gctggaacggcagctcaataaactg

SEQ ID NO: 89813 - DNA, 25 bp, E. coli
gcaacatcggtgaaagacgccaact

SEQ ID NO: 89814 - DNA, 25 bp, E. coli
gaagatatgtactccgcaattaacg

SEQ ID NO: 89815 - DNA, 25 bp, E. coli
gcaacatcggtgtaagacgccaact

SEQ ID NO: 89816 - DNA, 25 bp, E. coli
gaagatatgtacaccgcaattaacg

SEQ ID NO: 89817 - DNA, 25 bp, E. coli
gaattgatcaactagctggaacggc

SEQ ID NO: 89818 - DNA, 25 bp, E. coli
gaattgatcaacaagctggaacggc

SEQ ID NO: 89819 - DNA, 25 bp, E. coli
cattctgtccaaagagccacaaggg

SEQ ID NO: 89820 - DNA, 25 bp, E. coli
cattctgtccaatgagccacaaggg

SEQ ID NO: 89821 - DNA, 25 bp, E. coli
taacggcgttctcgttgccagtggt

SEQ ID NO: 89822 - DNA, 25 bp, E. coli
taacggcgttctggttgccagtggt

SEQ ID NO: 89823 - DNA, 25 bp, E. coli
taaagatgggcagtgtacgctcaac

SEQ ID NO: 89824 - DNA, 25 bp, E. coli
taaacctggcgacgacgttacttgc

SEQ ID NO: 89825 - DNA, 25 bp, E. coli
tactacaccaatacaggccgtggcg

SEQ ID NO: 89826 - DNA, 25 bp, E. coli
tactacaccaattcaggccgtggcg

SEQ ID NO: 89827 - DNA, 25 bp, E. coli
tacgggtcaggccaaagagatcgat

SEQ ID NO: 89828 - DNA, 25 bp, E. coli
taaacctggcgaggacgttacttgc

SEQ ID NO: 89829 - DNA, 25 bp, E. coli
taaagatgggcactgtacgctcaac

SEQ ID NO: 89830 - DNA, 25 bp, E. coli
tacgggtcaggcgaaagagatcgat

SEQ ID NO: 89831 - DNA, 25 bp, E. coli
tataagcaaatcgatctggcaccgg

SEQ ID NO: 89832 - DNA, 25 bp, E. coli
tattcatcgctattcgacgaccggg

SEQ ID NO: 89833 - DNA, 25 bp, E. coli
tattcatcgctaatcgacgaccggg

SEQ ID NO: 89834 - DNA, 25 bp, E. coli
tataagcaaatccatctggcaccgg

SEQ ID NO: 89835 - DNA, 25 bp, E. coli
ttttgagcgcaaccctgttagccgg

SEQ ID NO: 89836 - DNA, 25 bp, E. coli
ttcagtgcgcgggaataagtcgacc

SEQ ID NO: 89837 - DNA, 25 bp, E. coli
ttttgagcgcaagcctgttagccgg

SEQ ID NO: 89838 - DNA, 25 bp, E. coli
ttcagtgcgcggcaataagtcgacc

SEQ ID NO: 89839 - DNA, 25 bp, E. coli
tgttgagccggaaaacgttacgcgc

SEQ ID NO: 89840 - DNA, 25 bp, E. coli
tgttgagccggataacgttacgcgc

SEQ ID NO: 89841 - DNA, 25 bp, E. coli
gatacgccgcctctagattctggaa

SEQ ID NO: 89842 - DNA, 25 bp, E. coli
gatacgccgcctgtagattctggaa

SEQ ID NO: 89843 - DNA, 25 bp, E. coli
taatgataaaaagtactggctggcc

SEQ ID NO: 89844 - DNA, 25 bp, E. coli
taatgataaaaactactggctggcc

SEQ ID NO: 89845 - DNA, 25 bp, E. coli
aacgcagtaaaacagatagccgagc

SEQ ID NO: 89846 - DNA, 25 bp, E. coli
catctgcgcgccattaatcgggaag

SEQ ID NO: 89847 - DNA, 25 bp, E. coli
catctgcgcgcctttaatcgggaag

SEQ ID NO: 89848 - DNA, 25 bp, E. coli
tactgaagccaggaagcgattgttc

SEQ ID NO: 89849 - DNA, 25 bp, E. coli
tactgaagccagcaagcgattgttc

SEQ ID NO: 89850 - DNA, 25 bp, E. coli
taaattctttactcgccgtgctgga

SEQ ID NO: 89851 - DNA, 25 bp, E. coli
taaattctttacacgccgtgctgga

SEQ ID NO: 89852 - DNA, 25 bp, E. coli
agcgtctgcgcctgtatcttaccgg

SEQ ID NO: 89853 - DNA, 25 bp, E. coli
agcgtctgcgccagtatcttaccgg

SEQ ID NO: 89854 - DNA, 25 bp, E. coli
aacgcagtaaaagagatagccgagc

SEQ ID NO: 89855 - DNA, 25 bp, E. coli
tgaatatactgtaacgcgatcgccg

SEQ ID NO: 89856 - DNA, 25 bp, E. coli
tgctgccctcgaacaagaacttggt

SEQ ID NO: 89857 - DNA, 25 bp, E. coli
tgctgccctcgatcaagaacttggt

SEQ ID NO: 89858 - DNA, 25 bp, E. coli
tgaatatactgttacgcgatcgccg

SEQ ID NO: 89859 - DNA, 25 bp, E. coli
tccttttgaggataatagcacagcg

SEQ ID NO: 89860 - DNA, 25 bp, E. coli
tccttttgaggaaaatagcacagcg

SEQ ID NO: 89861 - DNA, 25 bp, E. coli
gccgagcaggaatagcagaaccctc

SEQ ID NO: 89862 - DNA, 25 bp, E. coli
gccgagcaggaaaagcagaaccctc

SEQ ID NO: 89863 - DNA, 25 bp, E. coli
cgattgttcatgacgcagtcggcgg

SEQ ID NO: 89864 - DNA, 25 bp, E. coli
cgattgttcatgtcgcagtcggcgg

SEQ ID NO: 89865 - DNA, 25 bp, E. coli
taatcacccggatacagcgatcagt

SEQ ID NO: 89866 - DNA, 25 bp, E. coli
taatcacccggaaacagcgatcagt

SEQ ID NO: 89867 - DNA, 25 bp, E. coli
aacgttggcggccagttttatgcca

SEQ ID NO: 89868 - DNA, 25 bp, E. coli
tacacgccgccagtttttgcctgaa

SEQ ID NO: 89869 - DNA, 25 bp, E. coli
tacacgccgccactttttgcctgaa

SEQ ID NO: 89870 - DNA, 25 bp, E. coli
agggtgaggctctccggatcgatac

SEQ ID NO: 89871 - DNA, 25 bp, E. coli
agggtgaggctcaccggatcgatac

SEQ ID NO: 89872 - DNA, 25 bp, E. coli
aacgttggcggcgagttttatgcca

SEQ ID NO: 89873 - DNA, 25 bp, E. coli
tatgccattaaccatcgttgcagcc

SEQ ID NO: 89874 - DNA, 25 bp, E. coli
tatgccattaacgatcgttgcagcc

SEQ ID NO: 89875 - DNA, 25 bp, E. coli
tttcatcgacttaccggaggcgcag

SEQ ID NO: 89876 - DNA, 25 bp, E. coli
tttcatcgactttccggaggcgcag

SEQ ID NO: 89877 - DNA, 25 bp, E. coli
tgaaggtggtgagattttcatcgac

SEQ ID NO: 89878 - DNA, 25 bp, E. coli
tgaaggtggtgacattttcatcgac

SEQ ID NO: 89879 - DNA, 25 bp, E. coli
gaatttatgcgtgtcccgttgcgga

SEQ ID NO: 89880 - DNA, 25 bp, E. coli
gaatttatgcgtctcccgttgcgga

SEQ ID NO: 89881 - DNA, 25 bp, E. coli
cttatccagtactcgttgaaggtgg

SEQ ID NO: 89882 - DNA, 25 bp, E. coli
cttatccagtacacgttgaaggtgg

SEQ ID NO: 89883 - DNA, 25 bp, E. coli
ggtatctggaagatgacgccacggt

SEQ ID NO: 89884 - DNA, 25 bp, E. coli
ggtatctggaagttgacgccacggt

SEQ ID NO: 89885 - DNA, 25 bp, E. coli
gggaaagcgttatgcctgcccgcca

SEQ ID NO: 89886 - DNA, 25 bp, E. coli
gggaaagcgttaagcctgcccgcca

SEQ ID NO: 89887 - DNA, 25 bp, E. coli
gatcgttgcagcgatggtaatgcgt

SEQ ID NO: 89888 - DNA, 25 bp, E. coli
gatcgttgcagccatggtaatgcgt

SEQ ID NO: 89889 - DNA, 25 bp, E. coli
attgccagaaaggaaggttccgacg

SEQ ID NO: 89890 - DNA, 25 bp, E. coli
attgccagaaagcaaggttccgacg

SEQ ID NO: 89891 - DNA, 25 bp, E. coli
tggtccgcatgaaaaaacaaaagct

SEQ ID NO: 89892 - DNA, 25 bp, E. coli
tgtccttgttcgataaacacaataa

SEQ ID NO: 89893 - DNA, 25 bp, E. coli
tggtccgcatgataaaacaaaagct

SEQ ID NO: 89894 - DNA, 25 bp, E. coli
tgtccttgttcgttaaacacaataa

SEQ ID NO: 89895 - DNA, 25 bp, E. coli
tgaaattgccagaaaggaaggttcc

SEQ ID NO: 89896 - DNA, 25 bp, E. coli
tgaaattgccagtaaggaaggttcc

SEQ ID NO: 89897 - DNA, 25 bp, E. coli
gctacagttaaaagatgagatgctc

SEQ ID NO: 89898 - DNA, 25 bp, E. coli
gctacagttaaatgatgagatgctc

SEQ ID NO: 89899 - DNA, 25 bp, E. coli
cgcatgaaaaaacaaaagctacagt

SEQ ID NO: 89900 - DNA, 25 bp, E. coli
cgcatgaaaaaagaaaagctacagt

SEQ ID NO: 89901 - DNA, 25 bp, E. coli
gttcgataaacagaataaacttgat

SEQ ID NO: 89902 - DNA, 25 bp, E. coli
gttcgataaacacaataaacttgat

SEQ ID NO: 89903 - DNA, 25 bp, E. coli
ggtacaatgcggaagtggtccgcat

SEQ ID NO: 89904 - DNA, 25 bp, E. coli
ggtacaatgcggtagtggtccgcat

SEQ ID NO: 89905 - DNA, 25 bp, E. coli
ggaagtggtccggatgaaaaaacaa

SEQ ID NO: 89906 - DNA, 25 bp, E. coli
ggaagtggtccgcatgaaaaaacaa

SEQ ID NO: 89907 - DNA, 25 bp, E. coli
taaacttgatcatgaaattgccaga

SEQ ID NO: 89908 - DNA, 25 bp, E. coli
taaacttgatcaagaaattgccaga

SEQ ID NO: 89909 - DNA, 25 bp, E. coli
gatgagatgctcaaaatcctgcagc

SEQ ID NO: 89910 - DNA, 25 bp, E. coli
gatgagatgctctaaatcctgcagc

SEQ ID NO: 89911 - DNA, 25 bp, E. coli
cagtatggtgctcggtggtgtggcg

SEQ ID NO: 89912 - DNA, 25 bp, E. coli
cagtatggtgctgggtggtgtggcg

SEQ ID NO: 89913 - DNA, 25 bp, E. coli
tacatgagactctgcctgatggcgc

SEQ ID NO: 89914 - DNA, 25 bp, E. coli
tacatgagactcagcctgatggcgc

SEQ ID NO: 89915 - DNA, 25 bp, E. coli
atgagactctgcgtgatggcgctgt

SEQ ID NO: 89916 - DNA, 25 bp, E. coli
attcatattgttcccagagtcgccg

SEQ ID NO: 89917 - DNA, 25 bp, E. coli
attcatattgttgccagagtcgccg

SEQ ID NO: 89918 - DNA, 25 bp, E. coli
atgagactctgcctgatggcgctgt

SEQ ID NO: 89919 - DNA, 25 bp, E. coli
ttaacggcgcagatacatgagactc

SEQ ID NO: 89920 - DNA, 25 bp, E. coli
ttaacggcgcagttacatgagactc

SEQ ID NO: 89921 - DNA, 25 bp, E. coli
tgttttctctcggtgccagtatggt

SEQ ID NO: 89922 - DNA, 25 bp, E. coli
tgttttctctcgctgccagtatggt

SEQ ID NO: 89923 - DNA, 25 bp, E. coli
tctcggtgccagaatggtgctcggt

SEQ ID NO: 89924 - DNA, 25 bp, E. coli
tcatattgttcccagagtcgccggg

SEQ ID NO: 89925 - DNA, 25 bp, E. coli
tcatattgttccgagagtcgccggg

SEQ ID NO: 89926 - DNA, 25 bp, E. coli
tctcggtgccagtatggtgctcggt

SEQ ID NO: 89927 - DNA, 25 bp, E. coli
cccttgcagcatggggggcagccat

SEQ ID NO: 89928 - DNA, 25 bp, E. coli
cccttgcagcatcgggggcagccat

SEQ ID NO: 89929 - DNA, 25 bp, E. coli
cattgccggatctttctttaccgcc

SEQ ID NO: 89930 - DNA, 25 bp, E. coli
cattgccggatcattctttaccgcc

SEQ ID NO: 89931 - DNA, 25 bp, E. coli
ggatcattcttttccgccggagcca

SEQ ID NO: 89932 - DNA, 25 bp, E. coli
ggatcattctttaccgccggagcca

SEQ ID NO: 89933 - DNA, 25 bp, E. coli
catttaaccgacaaaccgacgctga

SEQ ID NO: 89934 - DNA, 25 bp, E. coli
catttaaccgactaaccgacgctga

SEQ ID NO: 89935 - DNA, 25 bp, E. coli
aacggatacgcgcaaagaagttgtc

SEQ ID NO: 89936 - DNA, 25 bp, E. coli
aacggatacgcggaaagaagttgtc

SEQ ID NO: 89937 - DNA, 25 bp, E. coli
tatgaagatgtcaggcggtgaaacg

SEQ ID NO: 89938 - DNA, 25 bp, E. coli
tatgaagatgtctggcggtgaaacg

SEQ ID NO: 89939 - DNA, 25 bp, E. coli
tttctgatgaacacgcaatggcgtc

SEQ ID NO: 89940 - DNA, 25 bp, E. coli
tttctgatgaactcgcaatggcgtc

SEQ ID NO: 89941 - DNA, 25 bp, E. coli
ttctcaacaagggacggacaaacgc

SEQ ID NO: 89942 - DNA, 25 bp, E. coli
ttctcaacaaggcacggacaaacgc

SEQ ID NO: 89943 - DNA, 25 bp, E. coli
tctataccgattgggagcaggtggc

SEQ ID NO: 89944 - DNA, 25 bp, E. coli
tctataccgattcggagcaggtggc

SEQ ID NO: 89945 - DNA, 25 bp, E. coli
gaatttcgcccgtgaaatcgcccat

SEQ ID NO: 89946 - DNA, 25 bp, E. coli
gaatttcgcccgagaaatcgcccat

SEQ ID NO: 89947 - DNA, 25 bp, E. coli
gacaaacgcgcgtgattgcctccta

SEQ ID NO: 89948 - DNA, 25 bp, E. coli
gacaaacgcgcgagattgcctccta

SEQ ID NO: 89949 - DNA, 25 bp, E. coli
ggatgtcgccaatgtgcaccgcatt

SEQ ID NO: 89950 - DNA, 25 bp, E. coli
ggtacgaccgttatatgatcaagct

SEQ ID NO: 89951 - DNA, 25 bp, E. coli
ggatgtcgccaaagtgcaccgcatt

SEQ ID NO: 89952 - DNA, 25 bp, E. coli
ggtacgaccgttttatgatcaagct

SEQ ID NO: 89953 - DNA, 25 bp, E. coli
tggcttcggaactgaaagaactggg

SEQ ID NO: 89954 - DNA, 25 bp, E. coli
tggcttcggaacagaaagaactggg

SEQ ID NO: 89955 - DNA, 25 bp, E. coli
caactgggattcgattactggactc

SEQ ID NO: 89956 - DNA, 25 bp, E. coli
caactgggattccattactggactc

SEQ ID NO: 89957 - DNA, 25 bp, E. coli
ttctggtttacttctcccggcgacg

SEQ ID NO: 89958 - DNA, 25 bp, E. coli
ttctggtttactactcccggcgacg

SEQ ID NO: 89959 - DNA, 25 bp, E. coli
tgggcgtcgggcaaaatccatcgct

SEQ ID NO: 89960 - DNA, 25 bp, E. coli
tgggcgtcgggctaaatccatcgct

SEQ ID NO: 89961 - DNA, 25 bp, E. coli
tgtggccgcacaactactggagttt

SEQ ID NO: 89962 - DNA, 25 bp, E. coli
tgtggccgcacatctactggagttt

SEQ ID NO: 89963 - DNA, 25 bp, E. coli
tgcgaatcagttggtcgggaacaca

SEQ ID NO: 89964 - DNA, 25 bp, E. coli
tgagtgatgccggagagcaatacct

SEQ ID NO: 89965 - DNA, 25 bp, E. coli
tgagtgatgccgcagagcaatacct

SEQ ID NO: 89966 - DNA, 25 bp, E. coli
tgcgaatcagttcgtcgggaacaca

SEQ ID NO: 89967 - DNA, 25 bp, E. coli
cgagcatatttatccggacggtagc

SEQ ID NO: 89968 - DNA, 25 bp, E. coli
cgagcatatttaaccggacggtagc

SEQ ID NO: 89969 - DNA, 25 bp, E. coli
cattcaggccggtttttacaccgag

SEQ ID NO: 89970 - DNA, 25 bp, E. coli
cgttgcgactcgtagaacccgggat

SEQ ID NO: 89971 - DNA, 25 bp, E. coli
cattcaggccggattttacaccgag

SEQ ID NO: 89972 - DNA, 25 bp, E. coli
cgttgcgactcgaagaacccgggat

SEQ ID NO: 89973 - DNA, 25 bp, E. coli
tcaaaataggtgtgtggatacacgc

SEQ ID NO: 89974 - DNA, 25 bp, E. coli
tcaaaataggtgagtggatacacgc

SEQ ID NO: 89975 - DNA, 25 bp, E. coli
gaggctttccgccagtgggtaacca

SEQ ID NO: 89976 - DNA, 25 bp, E. coli
gaggctttccgcgagtgggtaacca

SEQ ID NO: 89977 - DNA, 25 bp, E. coli
accggcaccggaaaagatctctttg

SEQ ID NO: 89978 - DNA, 25 bp, E. coli
accggcaccggataagatctctttg

SEQ ID NO: 89979 - DNA, 25 bp, E. coli
tgcgtatgcctgtcatcaggcaagc

SEQ ID NO: 89980 - DNA, 25 bp, E. coli
tgcgtatgcctgacatcaggcaagc

SEQ ID NO: 89981 - DNA, 25 bp, E. coli
gcaccggaaaagttctctttgcgta

SEQ ID NO: 89982 - DNA, 25 bp, E. coli
gcaccggaaaagatctctttgcgta

SEQ ID NO: 89983 - DNA, 25 bp, E. coli
gctgattacgggtgataccggcacc

SEQ ID NO: 89984 - DNA, 25 bp, E. coli
gctgattacgggagataccggcacc

SEQ ID NO: 89985 - DNA, 25 bp, E. coli
gaaggttcccatgcgtctggaagtc

SEQ ID NO: 89986 - DNA, 25 bp, E. coli
gaaggttcccatccgtctggaagtc

SEQ ID NO: 89987 - DNA, 25 bp, E. coli
gaaaagatctctatgcgtatgcctg

SEQ ID NO: 89988 - DNA, 25 bp, E. coli
gaaaagatctctttgcgtatgcctg

SEQ ID NO: 89989 - DNA, 25 bp, E. coli
ctctttgcgtatgcctgtcatcagg

SEQ ID NO: 89990 - DNA, 25 bp, E. coli
ctctttgcgtatccctgtcatcagg

SEQ ID NO: 89991 - DNA, 25 bp, E. coli
gattacgggtgaaaccggcaccgga

SEQ ID NO: 89992 - DNA, 25 bp, E. coli
gattacgggtgataccggcaccgga

SEQ ID NO: 89993 - DNA, 25 bp, E. coli
gtatgcctgtcatcaggcaagcccc

SEQ ID NO: 89994 - DNA, 25 bp, E. coli
gatctctttgcgaatgcctgtcatc

SEQ ID NO: 89995 - DNA, 25 bp, E. coli
gtgaaggttcccttgcgtctggaag

SEQ ID NO: 89996 - DNA, 25 bp, E. coli
gtatgcctgtcaacaggcaagcccc

SEQ ID NO: 89997 - DNA, 25 bp, E. coli
gtgaaggttcccatgcgtctggaag

SEQ ID NO: 89998 - DNA, 25 bp, E. coli
gatctctttgcgtatgcctgtcatc

SEQ ID NO: 89999 - DNA, 25 bp, E. coli
caagtgccaggaccatcagcttacc

SEQ ID NO: 90000 - DNA, 25 bp, E. coli
caagtgccaggagcatcagcttacc

SEQ ID NO: 90001 - DNA, 25 bp, E. coli
caccttcccctaccgctgcaagtgc

SEQ ID NO: 90002 - DNA, 25 bp, E. coli
caccttcccctagcgctgcaagtgc

SEQ ID NO: 90003 - DNA, 25 bp, E. coli
caggccaacctgtagctagggcgta

SEQ ID NO: 90004 - DNA, 25 bp, E. coli
ccaggccaacctcaagctagggcgt

SEQ ID NO: 90005 - DNA, 25 bp, E. coli
ccaggccaacctgaagctagggcgt

SEQ ID NO: 90006 - DNA, 25 bp, E. coli
caggccaacctgaagctagggcgta

SEQ ID NO: 90007 - DNA, 25 bp, E. coli
tgcaagtgccaggagcatcagctta

SEQ ID NO: 90008 - DNA, 25 bp, E. coli
tgcaagtgccagcagcatcagctta

SEQ ID NO: 90009 - DNA, 25 bp, E. coli
gccaacctgaaggtagggcgtaact

SEQ ID NO: 90010 - DNA, 25 bp, E. coli
gccaacctgaagctagggcgtaact

SEQ ID NO: 90011 - DNA, 25 bp, E. coli
cctgaagctagggcgtaactacccg

SEQ ID NO: 90012 - DNA, 25 bp, E. coli
cctgaagctaggccgtaactacccg

SEQ ID NO: 90013 - DNA, 25 bp, E. coli
ccaacctgaagctagggcgtaacta

SEQ ID NO: 90014 - DNA, 25 bp, E. coli
ccaacctgaagcaagggcgtaacta

SEQ ID NO: 90015 - DNA, 25 bp, E. coli
gcaagtgccaggtgcatcagcttac

SEQ ID NO: 90016 - DNA, 25 bp, E. coli
gcaagtgccaggagcatcagcttac

SEQ ID NO: 90017 - DNA, 25 bp, E. coli
cgctgcaagtgcgaggagcatcagc

SEQ ID NO: 90018 - DNA, 25 bp, E. coli
cgctgcaagtgccaggagcatcagc

SEQ ID NO: 90019 - DNA, 25 bp, E. coli
ctgcaagtgccacgagcatcagctt

SEQ ID NO: 90020 - DNA, 25 bp, E. coli
ctgcaagtgccaggagcatcagctt

SEQ ID NO: 90021 - DNA, 25 bp, E. coli
caaagagaaagcgttgagctggagt

SEQ ID NO: 90022 - DNA, 25 bp, E. coli
caaagagaaagccttgagctggagt

SEQ ID NO: 90023 - DNA, 25 bp, E. coli
catgcgaccatgctggcgatgcagc

SEQ ID NO: 90024 - DNA, 25 bp, E. coli
catgcgaccatggtggcgatgcagc

SEQ ID NO: 90025 - DNA, 25 bp, E. coli
acgcgcactgggacttgcgtcctga

SEQ ID NO: 90026 - DNA, 25 bp, E. coli
acgcgcactgggtcttgcgtcctga

SEQ ID NO: 90027 - DNA, 25 bp, E. coli
ttagttggcgcggtcgtcaccgctg

SEQ ID NO: 90028 - DNA, 25 bp, E. coli
ttagttggcgcgctcgtcaccgctg

SEQ ID NO: 90029 - DNA, 25 bp, E. coli
tgaatgattccaaaaagctgagcga

SEQ ID NO: 90030 - DNA, 25 bp, E. coli
tgaatgattccataaagctgagcga

SEQ ID NO: 90031 - DNA, 25 bp, E. coli
tatggttttgcccaacacaaagggt

SEQ ID NO: 90032 - DNA, 25 bp, E. coli
tatggttttgccgaacacaaagggt

SEQ ID NO: 90033 - DNA, 25 bp, E. coli
gctttgggcctgacaaacgcgcact

SEQ ID NO: 90034 - DNA, 25 bp, E. coli
gctttgggcctgtcaaacgcgcact

SEQ ID NO: 90035 - DNA, 25 bp, E. coli
cgcttttcatctggaaaaactggct

SEQ ID NO: 90036 - DNA, 25 bp, E. coli
cgcttttcatctcgaaaaactggct

SEQ ID NO: 90037 - DNA, 25 bp, E. coli
gatagccgcgtagcggaaatcagtg

SEQ ID NO: 90038 - DNA, 25 bp, E. coli
gatagccgcgtaccggaaatcagtg

SEQ ID NO: 90039 - DNA, 25 bp, E. coli
ggcgctggatattgttttcccgcaa

SEQ ID NO: 90040 - DNA, 25 bp, E. coli
tggtgaaaggcgttagccgcgtacc

SEQ ID NO: 90041 - DNA, 25 bp, E. coli
ggcgctggatatagttttcccgcaa

SEQ ID NO: 90042 - DNA, 25 bp, E. coli
tggtgaaaggcgatagccgcgtacc

SEQ ID NO: 90043 - DNA, 25 bp, E. coli
caatcaagaaaaatgaagcggcgct

SEQ ID NO: 90044 - DNA, 25 bp, E. coli
caatcaagaaaattgaagcggcgct

SEQ ID NO: 90045 - DNA, 25 bp, E. coli
acgacgatcgcccttctcaggacga

SEQ ID NO: 90046 - DNA, 25 bp, E. coli
aaatcagcaaaaaacgcacgggtcg

SEQ ID NO: 90047 - DNA, 25 bp, E. coli
acgacgatcgccgttctcaggacga

SEQ ID NO: 90048 - DNA, 25 bp, E. coli
aaatcagcaaaatacgcacgggtcg

SEQ ID NO: 90049 - DNA, 25 bp, E. coli
tatggcgtccgatcttggcctgaac

SEQ ID NO: 90050 - DNA, 25 bp, E. coli
tatggcgtccgaacttggcctgaac

SEQ ID NO: 90051 - DNA, 25 bp, E. coli
tttgatcgttcattgtctccggccg

SEQ ID NO: 90052 - DNA, 25 bp, E. coli
tttgatcgttcaatgtctccggccg

SEQ ID NO: 90053 - DNA, 25 bp, E. coli
tctccggccgttcaaaaagcgatta

SEQ ID NO: 90054 - DNA, 25 bp, E. coli
tctccggccgttgaaaaagcgatta

SEQ ID NO: 90055 - DNA, 25 bp, E. coli
ccaaaatcgttcctggtgaagcaga

SEQ ID NO: 90056 - DNA, 25 bp, E. coli
ccaaaatcgttcgtggtgaagcaga

SEQ ID NO: 90057 - DNA, 25 bp, E. coli
gcaagcgtaacgctagaagattccc

SEQ ID NO: 90058 - DNA, 25 bp, E. coli
gcaagcgtaacggtagaagattccc

SEQ ID NO: 90059 - DNA, 25 bp, E. coli
gaactctgcgggtagcgacatccgt

SEQ ID NO: 90060 - DNA, 25 bp, E. coli
gaacaagcgcgtcttgcagtacgta

SEQ ID NO: 90061 - DNA, 25 bp, E. coli
gaactctgcgggaagcgacatccgt

SEQ ID NO: 90062 - DNA, 25 bp, E. coli
gaacaagcgcgtgttgcagtacgta

SEQ ID NO: 90063 - DNA, 25 bp, E. coli
cgtggaatattacggcacgccgacg

SEQ ID NO: 90064 - DNA, 25 bp, E. coli
cgtggaatattagggcacgccgacg

SEQ ID NO: 90065 - DNA, 25 bp, E. coli
aatgctggagatgcttaccgctcag

SEQ ID NO: 90066 - DNA, 25 bp, E. coli
aatgctggagatccttaccgctcag

SEQ ID NO: 90067 - DNA, 25 bp, E. coli
aaaatcgtgatcgttgccaatggcg

SEQ ID NO: 90068 - DNA, 25 bp, E. coli
aaaatcgtgatccttgccaatggcg

SEQ ID NO: 90069 - DNA, 25 bp, E. coli
tagtacacttccactgattgatggg

SEQ ID NO: 90070 - DNA, 25 bp, E. coli
tagtacacttcctctgattgatggg

SEQ ID NO: 90071 - DNA, 25 bp, E. coli
ttgtgcaaaaccagtaccgacgggc

SEQ ID NO: 90072 - DNA, 25 bp, E. coli
ttgtgcaaaacctgtaccgacgggc

SEQ ID NO: 90073 - DNA, 25 bp, E. coli
tgcggctggccaatgcgttacgaga

SEQ ID NO: 90074 - DNA, 25 bp, E. coli
tgcggctggccattgcgttacgaga

SEQ ID NO: 90075 - DNA, 25 bp, E. coli
gcaccttacgggagcgaatccttgt

SEQ ID NO: 90076 - DNA, 25 bp, E. coli
gctgtcagccgaaaaagtgctcaca

SEQ ID NO: 90077 - DNA, 25 bp, E. coli
gcaccttacgggtgcgaatccttgt

SEQ ID NO: 90078 - DNA, 25 bp, E. coli
gctgtcagccgataaagtgctcaca

SEQ ID NO: 90079 - DNA, 25 bp, E. coli
gaactggcgcaatggacgctgtcag

SEQ ID NO: 90080 - DNA, 25 bp, E. coli
gaactggcgcaaaggacgctgtcag

SEQ ID NO: 90081 - DNA, 25 bp, E. coli
ccttgtttaacagcttgcggctggc

SEQ ID NO: 90082 - DNA, 25 bp, E. coli
ccgctcagaatgaaccggtgaaatt

SEQ ID NO: 90083 - DNA, 25 bp, E. coli
ccttgtttaacaccttgcggctggc

SEQ ID NO: 90084 - DNA, 25 bp, E. coli
ccgctcagaatgtaccggtgaaatt

SEQ ID NO: 90085 - DNA, 25 bp, E. coli
cgacgggcgcgggattagtacactt

SEQ ID NO: 90086 - DNA, 25 bp, E. coli
cgacgggcgcggcattagtacactt

SEQ ID NO: 90087 - DNA, 25 bp, E. coli
cacacgatctggtgcggctttgtta

SEQ ID NO: 90088 - DNA, 25 bp, E. coli
cacacgatctggagcggctttgtta

SEQ ID NO: 90089 - DNA, 25 bp, E. coli
catgactattgaagaatgcgcgacc

SEQ ID NO: 90090 - DNA, 25 bp, E. coli
catgactattgatgaatgcgcgacc

SEQ ID NO: 90091 - DNA, 25 bp, E. coli
catgcagccatttcacgatgaacgc

SEQ ID NO: 90092 - DNA, 25 bp, E. coli
catgcagccattacacgatgaacgc

SEQ ID NO: 90093 - DNA, 25 bp, E. coli
gctgaattatatccacacgatctgg

SEQ ID NO: 90094 - DNA, 25 bp, E. coli
gctgaattatatgcacacgatctgg

SEQ ID NO: 90095 - DNA, 25 bp, E. coli
gcaactgttggcaatgcgtcagcaa

SEQ ID NO: 90096 - DNA, 25 bp, E. coli
gaatgcgcgacctggattgcccaga

SEQ ID NO: 90097 - DNA, 25 bp, E. coli
gcatcggcaacaacaccatgcgttt

SEQ ID NO: 90098 - DNA, 25 bp, E. coli
gaatgcgcgaccaggattgcccaga

SEQ ID NO: 90099 - DNA, 25 bp, E. coli
gcaactgttggctatgcgtcagcaa

SEQ ID NO: 90100 - DNA, 25 bp, E. coli
gcatcggcaacatcaccatgcgttt

SEQ ID NO: 90101 - DNA, 25 bp, E. coli
gactggaagatcaatcaatcggtag

SEQ ID NO: 90102 - DNA, 25 bp, E. coli
gactggaagatctatcaatcggtag

SEQ ID NO: 90103 - DNA, 25 bp, E. coli
ctaccctgatggcaattttattgac

SEQ ID NO: 90104 - DNA, 25 bp, E. coli
ctaccctgatgggaattttattgac

SEQ ID NO: 90105 - DNA, 25 bp, E. coli
gagaaaataaattaccgcatcggca

SEQ ID NO: 90106 - DNA, 25 bp, E. coli
gatgaacgcttatgaactccaggca

SEQ ID NO: 90107 - DNA, 25 bp, E. coli
gagaaaataaataaccgcatcggca

SEQ ID NO: 90108 - DNA, 25 bp, E. coli
gatgaacgcttaagaactccaggca

SEQ ID NO: 90109 - DNA, 25 bp, E. coli
catgcgccgccacgaaattaaagcg

SEQ ID NO: 90110 - DNA, 25 bp, E. coli
catgcgccgccaggaaattaaagcg

SEQ ID NO: 90111 - DNA, 25 bp, E. coli
aaattatcgtctcatcgacgccacg

SEQ ID NO: 90112 - DNA, 25 bp, E. coli
aaattatcgtctgatcgacgccacg

SEQ ID NO: 90113 - DNA, 25 bp, E. coli
tttagccacgaaaactggatgcgtc

SEQ ID NO: 90114 - DNA, 25 bp, E. coli
tttagccacgaatactggatgcgtc

SEQ ID NO: 90115 - DNA, 25 bp, E. coli
tgcgcgtgacgcgaaaactggcgct

SEQ ID NO: 90116 - DNA, 25 bp, E. coli
tgcgcgtgacgccaaaactggcgct

SEQ ID NO: 90117 - DNA, 25 bp, E. coli
tcagtgacttctttcgcatgcgccg

SEQ ID NO: 90118 - DNA, 25 bp, E. coli
tcagtgacttctatcgcatgcgccg

SEQ ID NO: 90119 - DNA, 25 bp, E. coli
gaaattacggaaggaatactggcgg

SEQ ID NO: 90120 - DNA, 25 bp, E. coli
gaaattacggaacgaatactggcgg

SEQ ID NO: 90121 - DNA, 25 bp, E. coli
cggtcggcgcggtattagtgcataa

SEQ ID NO: 90122 - DNA, 25 bp, E. coli
ctggcgctgcggcatctttaatgga

SEQ ID NO: 90123 - DNA, 25 bp, E. coli
cggtcggcgcggaattagtgcataa

SEQ ID NO: 90124 - DNA, 25 bp, E. coli
ctggcgctgcgggatctttaatgga

SEQ ID NO: 90125 - DNA, 25 bp, E. coli
gatccacagtcggattggtcgcgtg

SEQ ID NO: 90126 - DNA, 25 bp, E. coli
gacgccacgttgaatgtcacgcttg

SEQ ID NO: 90127 - DNA, 25 bp, E. coli
gatgtgctgcatcatccgggtatga

SEQ ID NO: 90128 - DNA, 25 bp, E. coli
gacgccacgttgtatgtcacgcttg

SEQ ID NO: 90129 - DNA, 25 bp, E. coli
gatccacagtcgcattggtcgcgtg

SEQ ID NO: 90130 - DNA, 25 bp, E. coli
gatgtgctgcatgatccgggtatga

SEQ ID NO: 90131 - DNA, 25 bp, E. coli
cacgaaagagatcagtcgtcagaca

SEQ ID NO: 90132 - DNA, 25 bp, E. coli
cacgaaagagatgagtcgtcagaca

SEQ ID NO: 90133 - DNA, 25 bp, E. coli
taacagccacggtcatcatgatgtg

SEQ ID NO: 90134 - DNA, 25 bp, E. coli
taacaagccagctctaaaagaaggg

SEQ ID NO: 90135 - DNA, 25 bp, E. coli
taacagccacggacatcatgatgtg

SEQ ID NO: 90136 - DNA, 25 bp, E. coli
tacaaacaatacagccacgaaagag

SEQ ID NO: 90137 - DNA, 25 bp, E. coli
tacaaacaatactgccacgaaagag

SEQ ID NO: 90138 - DNA, 25 bp, E. coli
taacaagccagcactaaaagaaggg

SEQ ID NO: 90139 - DNA, 25 bp, E. coli
attcgctataaattaagggttgtgc

SEQ ID NO: 90140 - DNA, 25 bp, E. coli
attcgctataaaataagggttgtgc

SEQ ID NO: 90141 - DNA, 25 bp, E. coli
actggtgatggaacgatgaatctgc

SEQ ID NO: 90142 - DNA, 25 bp, E. coli
actggtgatggatcgatgaatctgc

SEQ ID NO: 90143 - DNA, 25 bp, E. coli
tatactcaaaaagtaacagccacgg

SEQ ID NO: 90144 - DNA, 25 bp, E. coli
tatactcaaaaactaacagccacgg

SEQ ID NO: 90145 - DNA, 25 bp, E. coli
cgatgaatctgcaagctggctttta

SEQ ID NO: 90146 - DNA, 25 bp, E. coli
cccttgaatatcgtactggtgatgg

SEQ ID NO: 90147 - DNA, 25 bp, E. coli
cccttgaatatcctactggtgatgg

SEQ ID NO: 90148 - DNA, 25 bp, E. coli
cgatgaatctgctagctggctttta

SEQ ID NO: 90149 - DNA, 25 bp, E. coli
tggctaatttgcaaatgctttcgaa

SEQ ID NO: 90150 - DNA, 25 bp, E. coli
tggctaatttgctaatgctttcgaa

SEQ ID NO: 90151 - DNA, 25 bp, E. coli
taaaccccttttgcatccattagtg

SEQ ID NO: 90152 - DNA, 25 bp, E. coli
taaaccccttttccatccattagtg

SEQ ID NO: 90153 - DNA, 25 bp, E. coli
catggaaagcgttacatcgctggcg

SEQ ID NO: 90154 - DNA, 25 bp, E. coli
catggaaagcgtaacatcgctggcg

SEQ ID NO: 90155 - DNA, 25 bp, E. coli
tacgccgttcgatcccggcgcattt

SEQ ID NO: 90156 - DNA, 25 bp, E. coli
agataccgacgttacgccgttcgat

SEQ ID NO: 90157 - DNA, 25 bp, E. coli
agataccgacgtaacgccgttcgat

SEQ ID NO: 90158 - DNA, 25 bp, E. coli
accaataattcctgttgccgctgct

SEQ ID NO: 90159 - DNA, 25 bp, E. coli
accaataattccagttgccgctgct

SEQ ID NO: 90160 - DNA, 25 bp, E. coli
tacgccgttcgaacccggcgcattt

SEQ ID NO: 90161 - DNA, 25 bp, E. coli
tgctggttgaaccaccggaagagcc

SEQ ID NO: 90162 - DNA, 25 bp, E. coli
tgctggttgaacgaccggaagagcc

SEQ ID NO: 90163 - DNA, 25 bp, E. coli
gcactgctaactcgccatgttcgtc

SEQ ID NO: 90164 - DNA, 25 bp, E. coli
gcactgctaactggccatgttcgtc

SEQ ID NO: 90165 - DNA, 25 bp, E. coli
gacgttacgccgatcgatcccggcg

SEQ ID NO: 90166 - DNA, 25 bp, E. coli
gacgttacgccgttcgatcccggcg

SEQ ID NO: 90167 - DNA, 25 bp, E. coli
gatcgcgcactggtaactcgccatg

SEQ ID NO: 90168 - DNA, 25 bp, E. coli
gatcgcgcactgctaactcgccatg

SEQ ID NO: 90169 - DNA, 25 bp, E. coli
gggtgagccacctataattcctgtt

SEQ ID NO: 90170 - DNA, 25 bp, E. coli
gggtgagccaccaataattcctgtt

SEQ ID NO: 90171 - DNA, 25 bp, E. coli
gggttccggtcagcgacgttcgcgt

SEQ ID NO: 90172 - DNA, 25 bp, E. coli
gggttccggtcaccgacgttcgcgt

SEQ ID NO: 90173 - DNA, 25 bp, E. coli
gacgccaaaacgcttatatgaagag

SEQ ID NO: 90174 - DNA, 25 bp, E. coli
gacgccaaaacggttatatgaagag

SEQ ID NO: 90175 - DNA, 25 bp, E. coli
caatgagtgatatcagcctgcgtca

SEQ ID NO: 90176 - DNA, 25 bp, E. coli
caatgagtgataacagcctgcgtca

SEQ ID NO: 90177 - DNA, 25 bp, E. coli
tactggctggaatcctatctggaac

SEQ ID NO: 90178 - DNA, 25 bp, E. coli
tactggctggaaacctatctggaac

SEQ ID NO: 90179 - DNA, 25 bp, E. coli
tatctggaacatcggcgtccgtggc

SEQ ID NO: 90180 - DNA, 25 bp, E. coli
tatctggaacatgggcgtccgtggc

SEQ ID NO: 90181 - DNA, 25 bp, E. coli
ttgacgtgttgtttcccagccagcg

SEQ ID NO: 90182 - DNA, 25 bp, E. coli
tttatacgcatgacgctaccgagcg

SEQ ID NO: 90183 - DNA, 25 bp, E. coli
tttatacgcatgtcgctaccgagcg

SEQ ID NO: 90184 - DNA, 25 bp, E. coli
ttgacgtgttgtatcccagccagcg

SEQ ID NO: 90185 - DNA, 25 bp, E. coli
tctggctgaaaaaacgttgaacgct

SEQ ID NO: 90186 - DNA, 25 bp, E. coli
tctggctgaaaatacgttgaacgct

SEQ ID NO: 90187 - DNA, 25 bp, E. coli
ccaaaagatttatgcgaagcgcagg

SEQ ID NO: 90188 - DNA, 25 bp, E. coli
ccaaaagatttaagcgaagcgcagg

SEQ ID NO: 90189 - DNA, 25 bp, E. coli
gaaacaggatctggcacgcatcgag

SEQ ID NO: 90190 - DNA, 25 bp, E. coli
gaaacaggatctcgcacgcatcgag

SEQ ID NO: 90191 - DNA, 25 bp, E. coli
cgtttgctgagtgcagtgcgccgat

SEQ ID NO: 90192 - DNA, 25 bp, E. coli
cgtttgctgagtccagtgcgccgat

SEQ ID NO: 90193 - DNA, 25 bp, E. coli
gatcagccactgcagctacgcgata

SEQ ID NO: 90194 - DNA, 25 bp, E. coli
gatcagccactggagctacgcgata

SEQ ID NO: 90195 - DNA, 25 bp, E. coli
tggcgacggcgctaagtgacgattt

SEQ ID NO: 90196 - DNA, 25 bp, E. coli
tggcgacggcgcaaagtgacgattt

SEQ ID NO: 90197 - DNA, 25 bp, E. coli
caacttagcgaggagcagagcggta

SEQ ID NO: 90198 - DNA, 25 bp, E. coli
caacttagcgagcagcagagcggta

SEQ ID NO: 90199 - DNA, 25 bp, E. coli
tataactcacagtacaacttagcga

SEQ ID NO: 90200 - DNA, 25 bp, E. coli
tataactcacagaacaacttagcga

SEQ ID NO: 90201 - DNA, 25 bp, E. coli
ttgccattaccgtttgtgttcaggg

SEQ ID NO: 90202 - DNA, 25 bp, E. coli
ttgccattaccgattgtgttcaggg

SEQ ID NO: 90203 - DNA, 25 bp, E. coli
tggtcgttgaactggtgacgtcgcc

SEQ ID NO: 90204 - DNA, 25 bp, E. coli
tgaccgatcgtctgcaattaaatca

SEQ ID NO: 90205 - DNA, 25 bp, E. coli
tgaccgatcgtcagcaattaaatca

SEQ ID NO: 90206 - DNA, 25 bp, E. coli
tccggacaacgaaactgaccgatcg

SEQ ID NO: 90207 - DNA, 25 bp, E. coli
tccggacaacgatactgaccgatcg

SEQ ID NO: 90208 - DNA, 25 bp, E. coli
gcagtgcgtgtctttgttagccaga

SEQ ID NO: 90209 - DNA, 25 bp, E. coli
gcagtgcgtgtcattgttagccaga

SEQ ID NO: 90210 - DNA, 25 bp, E. coli
gacgtcgccatcagttcaacattcg

SEQ ID NO: 90211 - DNA, 25 bp, E. coli
gacgtcgccatctgttcaacattcg

SEQ ID NO: 90212 - DNA, 25 bp, E. coli
ggcgtgaacgctatatccggacaac

SEQ ID NO: 90213 - DNA, 25 bp, E. coli
ggcgtgaacgctttatccggacaac

SEQ ID NO: 90214 - DNA, 25 bp, E. coli
tggtcgttgaacaggtgacgtcgcc

SEQ ID NO: 90215 - DNA, 25 bp, E. coli
gagaaacccatttaagcacgctgca

SEQ ID NO: 90216 - DNA, 25 bp, E. coli
gagcggtacgatcgtgagaaaccca

SEQ ID NO: 90217 - DNA, 25 bp, E. coli
gagaaacccattaaagcacgctgca

SEQ ID NO: 90218 - DNA, 25 bp, E. coli
gagcggtacgatggtgagaaaccca

SEQ ID NO: 90219 - DNA, 25 bp, E. coli
cagaacaggctgtaggttatcagca

SEQ ID NO: 90220 - DNA, 25 bp, E. coli
cagaacaggctgaaggttatcagca

SEQ ID NO: 90221 - DNA, 25 bp, E. coli
accgcttctttgttgcttctgacgt

SEQ ID NO: 90222 - DNA, 25 bp, E. coli
accgcttctttgatgcttctgacgt

SEQ ID NO: 90223 - DNA, 25 bp, E. coli
actaacccggctaccgcgcatatgt

SEQ ID NO: 90224 - DNA, 25 bp, E. coli
actaacccggcttccgcgcatatgt

SEQ ID NO: 90225 - DNA, 25 bp, E. coli
tatggcttcggcttctcttctggat

SEQ ID NO: 90226 - DNA, 25 bp, E. coli
tatggcttcggcatctcttctggat

SEQ ID NO: 90227 - DNA, 25 bp, E. coli
ttctgcccgccagaacaggctgaag

SEQ ID NO: 90228 - DNA, 25 bp, E. coli
ttcggcttctctactggatgaggcc

SEQ ID NO: 90229 - DNA, 25 bp, E. coli
ttcggcttctcttctggatgaggcc

SEQ ID NO: 90230 - DNA, 25 bp, E. coli
ttctgcccgccacaacaggctgaag

SEQ ID NO: 90231 - DNA, 25 bp, E. coli
tgcttctgacgtacatccgcaaacg

SEQ ID NO: 90232 - DNA, 25 bp, E. coli
tgcttctgacgttcatccgcaaacg

SEQ ID NO: 90233 - DNA, 25 bp, E. coli
tcgctctattcacgctgcgatgctg

SEQ ID NO: 90234 - DNA, 25 bp, E. coli
tcgctctattcaggctgcgatgctg

SEQ ID NO: 90235 - DNA, 25 bp, E. coli
ccggcttccgcggatatgtcaggaa

SEQ ID NO: 90236 - DNA, 25 bp, E. coli
ccggcttccgcgcatatgtcaggaa

SEQ ID NO: 90237 - DNA, 25 bp, E. coli
cgcgcatatgtcaggaatgcaggtg

SEQ ID NO: 90238 - DNA, 25 bp, E. coli
cgcgcatatgtctggaatgcaggtg

SEQ ID NO: 90239 - DNA, 25 bp, E. coli
tcacgacagtcggtctattcaggct

SEQ ID NO: 90240 - DNA, 25 bp, E. coli
tcacgacagtcgctctattcaggct

SEQ ID NO: 90241 - DNA, 25 bp, E. coli
taaaacgccaggatcttgagcaggt

SEQ ID NO: 90242 - DNA, 25 bp, E. coli
taaaacgccaggttcttgagcaggt

SEQ ID NO: 90243 - DNA, 25 bp, E. coli
tatgtgaaaaacgtgatggacgcca

SEQ ID NO: 90244 - DNA, 25 bp, E. coli
tacctcggtggtcaatggcaaactg

SEQ ID NO: 90245 - DNA, 25 bp, E. coli
tatgtgaaaaacctgatggacgcca

SEQ ID NO: 90246 - DNA, 25 bp, E. coli
tacctcggtggtgaatggcaaactg

SEQ ID NO: 90247 - DNA, 25 bp, E. coli
tgattgcggcgcgtaaacaagatcc

SEQ ID NO: 90248 - DNA, 25 bp, E. coli
tgattgcggcgcctaaacaagatcc

SEQ ID NO: 90249 - DNA, 25 bp, E. coli
tgaactggagcaaatgccgaaagcc

SEQ ID NO: 90250 - DNA, 25 bp, E. coli
tgaactggagcatatgccgaaagcc

SEQ ID NO: 90251 - DNA, 25 bp, E. coli
taccggtaaaactgacgccatttgc

SEQ ID NO: 90252 - DNA, 25 bp, E. coli
taccggtaaaacagacgccatttgc

SEQ ID NO: 90253 - DNA, 25 bp, E. coli
ccatctctgttgagtgtaccggtaa

SEQ ID NO: 90254 - DNA, 25 bp, E. coli
ccaaacagacatgggtaggtgaacc

SEQ ID NO: 90255 - DNA, 25 bp, E. coli
ccaaacagacatcggtaggtgaacc

SEQ ID NO: 90256 - DNA, 25 bp, E. coli
ccagaacgcgcaagctgatgtgagt

SEQ ID NO: 90257 - DNA, 25 bp, E. coli
gccgaaagccttacgcatgatgctg

SEQ ID NO: 90258 - DNA, 25 bp, E. coli
ccatctctgttgtgtgtaccggtaa

SEQ ID NO: 90259 - DNA, 25 bp, E. coli
gccgaaagcctttcgcatgatgctg

SEQ ID NO: 90260 - DNA, 25 bp, E. coli
ccagaacgcgcatgctgatgtgagt

SEQ ID NO: 90261 - DNA, 25 bp, E. coli
gatgtgagttttagtgccgacgcca

SEQ ID NO: 90262 - DNA, 25 bp, E. coli
gatgtgagtttttgtgccgacgcca

SEQ ID NO: 90263 - DNA, 25 bp, E. coli
aatggccgtgaatccgaagtccagg

SEQ ID NO: 90264 - DNA, 25 bp, E. coli
aatggccgtgaaaccgaagtccagg

SEQ ID NO: 90265 - DNA, 25 bp, E. coli
aaatggcgtcccattcagcatcgac

SEQ ID NO: 90266 - DNA, 25 bp, E. coli
aaatggcgtccctttcagcatcgac

SEQ ID NO: 90267 - DNA, 25 bp, E. coli
aaatgatcgatgaaaatggcgtccc

SEQ ID NO: 90268 - DNA, 25 bp, E. coli
aaatgatcgatgtaaatggcgtccc

SEQ ID NO: 90269 - DNA, 25 bp, E. coli
tataccgtaaccttacgcaatctgg

SEQ ID NO: 90270 - DNA, 25 bp, E. coli
tataccgtaaccatacgcaatctgg

SEQ ID NO: 90271 - DNA, 25 bp, E. coli
tgcagggtcactacgaaatgatcga

SEQ ID NO: 90272 - DNA, 25 bp, E. coli
tgcagggtcacttcgaaatgatcga

SEQ ID NO: 90273 - DNA, 25 bp, E. coli
tcagcatcgacaatcccgtattccg

SEQ ID NO: 90274 - DNA, 25 bp, E. coli
tcagcatcgacattcccgtattccg

SEQ ID NO: 90275 - DNA, 25 bp, E. coli
gctgatcaccaaaggcaatggccgt

SEQ ID NO: 90276 - DNA, 25 bp, E. coli
gctgatcaccaatggcaatggccgt

SEQ ID NO: 90277 - DNA, 25 bp, E. coli
gaagagtaccagaacaccagcggtg

SEQ ID NO: 90278 - DNA, 25 bp, E. coli
gaagagtaccagtacaccagcggtg

SEQ ID NO: 90279 - DNA, 25 bp, E. coli
cttatcgcgcctcgcgaagagtacc

SEQ ID NO: 90280 - DNA, 25 bp, E. coli
cttatcgcgcctggcgaagagtacc

SEQ ID NO: 90281 - DNA, 25 bp, E. coli
gtgcaatcattgaaaccccgctggg

SEQ ID NO: 90282 - DNA, 25 bp, E. coli
ggttggcgtccagccacttatcgcg

SEQ ID NO: 90283 - DNA, 25 bp, E. coli
ggttggcgtccacccacttatcgcg

SEQ ID NO: 90284 - DNA, 25 bp, E. coli
gtgcaatcattgtaaccccgctggg

SEQ ID NO: 90285 - DNA, 25 bp, E. coli
aaaaacgcctgtcgatcgactcacc

SEQ ID NO: 90286 - DNA, 25 bp, E. coli
aaaaacgcctgtggatcgactcacc

SEQ ID NO: 90287 - DNA, 25 bp, E. coli
tatgagcaaattctcgcgggccgtg

SEQ ID NO: 90288 - DNA, 25 bp, E. coli
tatgagcaaattgtcgcgggccgtg

SEQ ID NO: 90289 - DNA, 25 bp, E. coli
tttgccctgctccatgcggaactgg

SEQ ID NO: 90290 - DNA, 25 bp, E. coli
tttgccctgctcgatgcggaactgg

SEQ ID NO: 90291 - DNA, 25 bp, E. coli
tttctggcgatgtaccctaacgggc

SEQ ID NO: 90292 - DNA, 25 bp, E. coli
tttctggcgatgaaccctaacgggc

SEQ ID NO: 90293 - DNA, 25 bp, E. coli
tgcgcaaagtggagatgattcccgt

SEQ ID NO: 90294 - DNA, 25 bp, E. coli
tgctgacgctcgtagaactggaact

SEQ ID NO: 90295 - DNA, 25 bp, E. coli
tgcgcaaagtggtgatgattcccgt

SEQ ID NO: 90296 - DNA, 25 bp, E. coli
tgctgacgctcgaagaactggaact

SEQ ID NO: 90297 - DNA, 25 bp, E. coli
tctggcggcacagtacgggcaaaaa

SEQ ID NO: 90298 - DNA, 25 bp, E. coli
tcagtaatgctcttcgcgggatcct

SEQ ID NO: 90299 - DNA, 25 bp, E. coli
tctggcggcacactacgggcaaaaa

SEQ ID NO: 90300 - DNA, 25 bp, E. coli
tcagtaatgctcatcgcgggatcct

SEQ ID NO: 90301 - DNA, 25 bp, E. coli
ccagttgcaaagagtgcgacgccct

SEQ ID NO: 90302 - DNA, 25 bp, E. coli
ccagttgcaaagtgtgcgacgccct

SEQ ID NO: 90303 - DNA, 25 bp, E. coli
gaaaaatggatggactgggcaaacc

SEQ ID NO: 90304 - DNA, 25 bp, E. coli
gaaaaatggatgcactgggcaaacc

SEQ ID NO: 90305 - DNA, 25 bp, E. coli
gatcaggccgcctttgatgccagtt

SEQ ID NO: 90306 - DNA, 25 bp, E. coli
gatcaggccgccattgatgccagtt

SEQ ID NO: 90307 - DNA, 25 bp, E. coli
aagggcgaacgtcagtgagtcatcc

SEQ ID NO: 90308 - DNA, 25 bp, E. coli
aagggcgaacgtgagtgagtcatcc

SEQ ID NO: 90309 - DNA, 25 bp, E. coli
atatttttcgacttgcgagaagacc

SEQ ID NO: 90310 - DNA, 25 bp, E. coli
atatttttcgacatgcgagaagacc

SEQ ID NO: 90311 - DNA, 25 bp, E. coli
tcagtgagtcatgctcccggatgca

SEQ ID NO: 90312 - DNA, 25 bp, E. coli
tcagtgagtcatcctcccggatgca

SEQ ID NO: 90313 - DNA, 25 bp, E. coli
gctaaagtagcgtcatatttttcga

SEQ ID NO: 90314 - DNA, 25 bp, E. coli
gctaaagtagcgacatatttttcga

SEQ ID NO: 90315 - DNA, 25 bp, E. coli
ccggatgcaccatcttctccaaaaa

SEQ ID NO: 90316 - DNA, 25 bp, E. coli
ccggatgcaccaacttctccaaaaa

SEQ ID NO: 90317 - DNA, 25 bp, E. coli
gaacgtcagtgactcatcctcccgg

SEQ ID NO: 90318 - DNA, 25 bp, E. coli
gaacgtcagtgagtcatcctcccgg

SEQ ID NO: 90319 - DNA, 25 bp, E. coli
cgaagggcgaacctcagtgagtcat

SEQ ID NO: 90320 - DNA, 25 bp, E. coli
cccgaagggcgaacgtcagtgagtc

SEQ ID NO: 90321 - DNA, 25 bp, E. coli
cccgaagggcgatcgtcagtgagtc

SEQ ID NO: 90322 - DNA, 25 bp, E. coli
cgaagggcgaacgtcagtgagtcat

SEQ ID NO: 90323 - DNA, 25 bp, E. coli
cgtcatatttttggacttgcgagaa

SEQ ID NO: 90324 - DNA, 25 bp, E. coli
cgtcatatttttcgacttgcgagaa

SEQ ID NO: 90325 - DNA, 25 bp, E. coli
gatagcggtattaaccgcaggcacc

SEQ ID NO: 90326 - DNA, 25 bp, E. coli
gtagcgtcatatttttcgacttgcg

SEQ ID NO: 90327 - DNA, 25 bp, E. coli
gtagcgtcatatatttcgacttgcg

SEQ ID NO: 90328 - DNA, 25 bp, E. coli
gatagcggtatttaccgcaggcacc

SEQ ID NO: 90329 - DNA, 25 bp, E. coli
tattttccctctatcttctcgttgc

SEQ ID NO: 90330 - DNA, 25 bp, E. coli
ttacgtcattttaccgcccaacagt

SEQ ID NO: 90331 - DNA, 25 bp, E. coli
tattttccctctttcttctcgttgc

SEQ ID NO: 90332 - DNA, 25 bp, E. coli
ttacgtcatttttccgcccaacagt

SEQ ID NO: 90333 - DNA, 25 bp, E. coli
ttctcgttgcgcataatttgactaa

SEQ ID NO: 90334 - DNA, 25 bp, E. coli
ttctcgttgcgcttaatttgactaa

SEQ ID NO: 90335 - DNA, 25 bp, E. coli
tgactaattctctttagcgactaat

SEQ ID NO: 90336 - DNA, 25 bp, E. coli
tgactaattctcattagcgactaat

SEQ ID NO: 90337 - DNA, 25 bp, E. coli
ccggtcgaacgtgaacttacgtcat

SEQ ID NO: 90338 - DNA, 25 bp, E. coli
gccagttccgctcgcggcattttaa

SEQ ID NO: 90339 - DNA, 25 bp, E. coli
gccagttccgctggcggcattttaa

SEQ ID NO: 90340 - DNA, 25 bp, E. coli
ccggtcgaacgtcaacttacgtcat

SEQ ID NO: 90341 - DNA, 25 bp, E. coli
tctaagtcactttttcctcaggtaa

SEQ ID NO: 90342 - DNA, 25 bp, E. coli
tctaagtcacttattcctcaggtaa

SEQ ID NO: 90343 - DNA, 25 bp, E. coli
cgcccaacagtattataatcaaaca

SEQ ID NO: 90344 - DNA, 25 bp, E. coli
cgcccaacagtaatataatcaaaca

SEQ ID NO: 90345 - DNA, 25 bp, E. coli
gttaatatatccagaatgttcctca

SEQ ID NO: 90346 - DNA, 25 bp, E. coli
gttaatatatcctgaatgttcctca

SEQ ID NO: 90347 - DNA, 25 bp, E. coli
taatcccgcaacataacaccagtaa

SEQ ID NO: 90348 - DNA, 25 bp, E. coli
taatcccgcaacttaacaccagtaa

SEQ ID NO: 90349 - DNA, 25 bp, E. coli
taatgaagccggaaaaatcctaaat

SEQ ID NO: 90350 - DNA, 25 bp, E. coli
taatgaagccggtaaaatcctaaat

SEQ ID NO: 90351 - DNA, 25 bp, E. coli
caatagtgttatctgggatctcgac

SEQ ID NO: 90352 - DNA, 25 bp, E. coli
caatagtgttatgtgggatctcgac

SEQ ID NO: 90353 - DNA, 25 bp, E. coli
tacggtacggatgtggagttgcaat

SEQ ID NO: 90354 - DNA, 25 bp, E. coli
tacggtacggatctggagttgcaat

SEQ ID NO: 90355 - DNA, 25 bp, E. coli
agcggtcagcccgtgtttctggtgc

SEQ ID NO: 90356 - DNA, 25 bp, E. coli
agcggtcagcccctgtttctggtgc

SEQ ID NO: 90357 - DNA, 25 bp, E. coli
tatcgatacaatagtgttatgtggg

SEQ ID NO: 90358 - DNA, 25 bp, E. coli
tatgtgggatctcgaccaatatcgg

SEQ ID NO: 90359 - DNA, 25 bp, E. coli
tatcgatacaattgtgttatgtggg

SEQ ID NO: 90360 - DNA, 25 bp, E. coli
tatgtgggatctggaccaatatcgg

SEQ ID NO: 90361 - DNA, 25 bp, E. coli
tgcttgaacttattgctaaaaccac

SEQ ID NO: 90362 - DNA, 25 bp, E. coli
tgcttgaacttaatgctaaaaccac

SEQ ID NO: 90363 - DNA, 25 bp, E. coli
tgcgcgttggctggtctgccgatta

SEQ ID NO: 90364 - DNA, 25 bp, E. coli
tgcgttttacggtacggatctggag

SEQ ID NO: 90365 - DNA, 25 bp, E. coli
tgcgcgttggctcgtctgccgatta

SEQ ID NO: 90366 - DNA, 25 bp, E. coli
tgcgttttacggaacggatctggag

SEQ ID NO: 90367 - DNA, 25 bp, E. coli
gaaatttcgcgcgagcggtcagccc

SEQ ID NO: 90368 - DNA, 25 bp, E. coli
gaaatttcgcgccagcggtcagccc

SEQ ID NO: 90369 - DNA, 25 bp, E. coli
cccgtgtttctgctgcgcgttggct

SEQ ID NO: 90370 - DNA, 25 bp, E. coli
cccgtgtttctggtgcgcgttggct

SEQ ID NO: 90371 - DNA, 25 bp, E. coli
gatctggagttggaattacgccgcc

SEQ ID NO: 90372 - DNA, 25 bp, E. coli
gatctggagttgcaattacgccgcc

SEQ ID NO: 90373 - DNA, 25 bp, E. coli
atctggcgcatcatgccggcgggca

SEQ ID NO: 90374 - DNA, 25 bp, E. coli
cttccgtgggtgcttttcagcctga

SEQ ID NO: 90375 - DNA, 25 bp, E. coli
atctggcgcatcttgccggcgggca

SEQ ID NO: 90376 - DNA, 25 bp, E. coli
cttccgtgggtggttttcagcctga

SEQ ID NO: 90377 - DNA, 25 bp, E. coli
ccataatgctgctggccccgggatc

SEQ ID NO: 90378 - DNA, 25 bp, E. coli
ccataatgctgcaggccccgggatc

SEQ ID NO: 90379 - DNA, 25 bp, E. coli
ttttcagcctgaattcatcggtgtc

SEQ ID NO: 90380 - DNA, 25 bp, E. coli
ttttcagcctgatttcatcggtgtc

SEQ ID NO: 90381 - DNA, 25 bp, E. coli
tcagatacgtcaggacgcccgtgaa

SEQ ID NO: 90382 - DNA, 25 bp, E. coli
tcagatacgtcacgacgcccgtgaa

SEQ ID NO: 90383 - DNA, 25 bp, E. coli
gcaggtgtacccctatgtggtcccc

SEQ ID NO: 90384 - DNA, 25 bp, E. coli
gcaggtgtacccgtatgtggtcccc

SEQ ID NO: 90385 - DNA, 25 bp, E. coli
cgtttatgccggcactgtgacgcag

SEQ ID NO: 90386 - DNA, 25 bp, E. coli
cgtttatgccgggactgtgacgcag

SEQ ID NO: 90387 - DNA, 25 bp, E. coli
cggagtcctcagtgtcggtgcagat

SEQ ID NO: 90388 - DNA, 25 bp, E. coli
cggagtcctcagagtcggtgcagat

SEQ ID NO: 90389 - DNA, 25 bp, E. coli
ggatccgtcagtgaaatgcaggact

SEQ ID NO: 90390 - DNA, 25 bp, E. coli
ggatccgtcagtcaaatgcaggact

SEQ ID NO: 90391 - DNA, 25 bp, E. coli
tggccccgggatccgtcagtgaaat

SEQ ID NO: 90392 - DNA, 25 bp, E. coli
tggccccgggatgcgtcagtgaaat

SEQ ID NO: 90393 - DNA, 25 bp, E. coli
gacgcaggcgcgtcagatacgtcag

SEQ ID NO: 90394 - DNA, 25 bp, E. coli
gacgcaggcgcgacagatacgtcag

SEQ ID NO: 90395 - DNA, 25 bp, E. coli
caaacgcacaattataagtttcaac

SEQ ID NO: 90396 - DNA, 25 bp, E. coli
caaacgcacaataataagtttcaac

SEQ ID NO: 90397 - DNA, 25 bp, E. coli
aagtttcaacttactgactatttag

SEQ ID NO: 90398 - DNA, 25 bp, E. coli
aagtttcaactttctgactatttag

SEQ ID NO: 90399 - DNA, 25 bp, E. coli
tatgtgacaaatccgcagataatcc

SEQ ID NO: 90400 - DNA, 25 bp, E. coli
tatgtgacaaatgcgcagataatcc

SEQ ID NO: 90401 - DNA, 25 bp, E. coli
gctctttttatgtgacaaatccgca

SEQ ID NO: 90402 - DNA, 25 bp, E. coli
gctctttttatgagacaaatccgca

SEQ ID NO: 90403 - DNA, 25 bp, E. coli
gacaaatccgcacataatccttcct

SEQ ID NO: 90404 - DNA, 25 bp, E. coli
gacaaatccgcagataatccttcct

SEQ ID NO: 90405 - DNA, 25 bp, E. coli
cccgcggttggcgttatggtcagat

SEQ ID NO: 90406 - DNA, 25 bp, E. coli
cccgcggttggccttatggtcagat

SEQ ID NO: 90407 - DNA, 25 bp, E. coli
gcgttatggtcacatggttttttca

SEQ ID NO: 90408 - DNA, 25 bp, E. coli
gcgttatggtcagatggttttttca

SEQ ID NO: 90409 - DNA, 25 bp, E. coli
gatcatgctctttttatgtgacaaa

SEQ ID NO: 90410 - DNA, 25 bp, E. coli
gatcatgctcttattatgtgacaaa

SEQ ID NO: 90411 - DNA, 25 bp, E. coli
ggtattccaaatgtgatcatgctct

SEQ ID NO: 90412 - DNA, 25 bp, E. coli
ggtattccaaatctgatcatgctct

SEQ ID NO: 90413 - DNA, 25 bp, E. coli
tggtttatcgcacaggtattccaaa

SEQ ID NO: 90414 - DNA, 25 bp, E. coli
tggtttatcgcagaggtattccaaa

SEQ ID NO: 90415 - DNA, 25 bp, E. coli
gatggttttttctacaaacgcacaa

SEQ ID NO: 90416 - DNA, 25 bp, E. coli
gatggttttttcaacaaacgcacaa

SEQ ID NO: 90417 - DNA, 25 bp, E. coli
agttgagcgcccctgatcttctgag

SEQ ID NO: 90418 - DNA, 25 bp, E. coli
agttgagcgcccgtgatcttctgag

SEQ ID NO: 90419 - DNA, 25 bp, E. coli
tattcactggtggtttgcgccagcc

SEQ ID NO: 90420 - DNA, 25 bp, E. coli
tattcactggtgctttgcgccagcc

SEQ ID NO: 90421 - DNA, 25 bp, E. coli
ttactgctcgaacgcaacgcgtctg

SEQ ID NO: 90422 - DNA, 25 bp, E. coli
ttactgctcgaaggcaacgcgtctg

SEQ ID NO: 90423 - DNA, 25 bp, E. coli
tgatgataccgaacgattaaacgcg

SEQ ID NO: 90424 - DNA, 25 bp, E. coli
tgatgataccgatcgattaaacgcg

SEQ ID NO: 90425 - DNA, 25 bp, E. coli
tcctttaaatcgtcagcagtggctg

SEQ ID NO: 90426 - DNA, 25 bp, E. coli
tcctttaaatcgacagcagtggctg

SEQ ID NO: 90427 - DNA, 25 bp, E. coli
gctgggcacgggattatcacacggt

SEQ ID NO: 90428 - DNA, 25 bp, E. coli
gctgggcacgggtttatcacacggt

SEQ ID NO: 90429 - DNA, 25 bp, E. coli
gcaaaatattacctcgccgggatgt

SEQ ID NO: 90430 - DNA, 25 bp, E. coli
gcaaaatattacgtcgccgggatgt

SEQ ID NO: 90431 - DNA, 25 bp, E. coli
cgaaaaagtcatgcgctggcgttac

SEQ ID NO: 90432 - DNA, 25 bp, E. coli
cgaaaaagtcatccgctggcgttac

SEQ ID NO: 90433 - DNA, 25 bp, E. coli
cggcctggtcgccagcaaaatatta

SEQ ID NO: 90434 - DNA, 25 bp, E. coli
cggcctggtcgcgagcaaaatatta

SEQ ID NO: 90435 - DNA, 25 bp, E. coli
gtaaagcgcgttatttcagccgtcg

SEQ ID NO: 90436 - DNA, 25 bp, E. coli
gtaaagcgcgttttttcagccgtcg

SEQ ID NO: 90437 - DNA, 25 bp, E. coli
ggtccagatgccaaaagaggtgcgt

SEQ ID NO: 90438 - DNA, 25 bp, E. coli
ggtccagatgcctaaagaggtgcgt

SEQ ID NO: 90439 - DNA, 25 bp, E. coli
aacccgcaatgattatcgctggtaa

SEQ ID NO: 90440 - DNA, 25 bp, E. coli
taaacgtgatcatctggtcggtaaa

SEQ ID NO: 90441 - DNA, 25 bp, E. coli
taaacgtgatcaactggtcggtaaa

SEQ ID NO: 90442 - DNA, 25 bp, E. coli
aacccgcaatgaatatcgctggtaa

SEQ ID NO: 90443 - DNA, 25 bp, E. coli
tgatcaactggtgggtaaaatccag

SEQ ID NO: 90444 - DNA, 25 bp, E. coli
tgatcaactggtcggtaaaatccag

SEQ ID NO: 90445 - DNA, 25 bp, E. coli
tcgtggattgggtaacccgcaatga

SEQ ID NO: 90446 - DNA, 25 bp, E. coli
tcattgaaggtatacgtgatcaact

SEQ ID NO: 90447 - DNA, 25 bp, E. coli
tcattgaaggtaaacgtgatcaact

SEQ ID NO: 90448 - DNA, 25 bp, E. coli
tcgtggattgggaaacccgcaatga

SEQ ID NO: 90449 - DNA, 25 bp, E. coli
gaaggtaaacgtcatcaactggtcg

SEQ ID NO: 90450 - DNA, 25 bp, E. coli
gaaggtaaacgtgatcaactggtcg

SEQ ID NO: 90451 - DNA, 25 bp, E. coli
gaaacccgcaatcaatatcgctggt

SEQ ID NO: 90452 - DNA, 25 bp, E. coli
gaaacccgcaatgaatatcgctggt

SEQ ID NO: 90453 - DNA, 25 bp, E. coli
cgtgatcaactggtcggtaaaatcc

SEQ ID NO: 90454 - DNA, 25 bp, E. coli
cgtgatcaactgctcggtaaaatcc

SEQ ID NO: 90455 - DNA, 25 bp, E. coli
ggtaaacgtgatcaactggtcggta

SEQ ID NO: 90456 - DNA, 25 bp, E. coli
ggtaaacgtgatgaactggtcggta

SEQ ID NO: 90457 - DNA, 25 bp, E. coli
tcaactggtcggaaaaatccaggaa

SEQ ID NO: 90458 - DNA, 25 bp, E. coli
tcaactggtcggtaaaatccaggaa

SEQ ID NO: 90459 - DNA, 25 bp, E. coli
ggcagaaaaagacgtcgtggattgg

SEQ ID NO: 90460 - DNA, 25 bp, E. coli
ggcagaaaaagaggtcgtggattgg

SEQ ID NO: 90461 - DNA, 25 bp, E. coli
aatagcgcggtgttgcactgtcccg

SEQ ID NO: 90462 - DNA, 25 bp, E. coli
aatagcgcggtgatgcactgtcccg

SEQ ID NO: 90463 - DNA, 25 bp, E. coli
tatggttgagttgaccggcaaaccg

SEQ ID NO: 90464 - DNA, 25 bp, E. coli
tatggactgcgcagtgaaaaactcg

SEQ ID NO: 90465 - DNA, 25 bp, E. coli
tatggttgagttcaccggcaaaccg

SEQ ID NO: 90466 - DNA, 25 bp, E. coli
tatggactgcgctgtgaaaaactcg

SEQ ID NO: 90467 - DNA, 25 bp, E. coli
tattttgaaatcaactgggcggcgg

SEQ ID NO: 90468 - DNA, 25 bp, E. coli
tttgaccgtggcctgcatctgctgg

SEQ ID NO: 90469 - DNA, 25 bp, E. coli
tttgaccgtggcgtgcatctgctgg

SEQ ID NO: 90470 - DNA, 25 bp, E. coli
tattttgaaatctactgggcggcgg

SEQ ID NO: 90471 - DNA, 25 bp, E. coli
tgattgggtgcttcgacgatcggcc

SEQ ID NO: 90472 - DNA, 25 bp, E. coli
tgattgggtgctacgacgatcggcc

SEQ ID NO: 90473 - DNA, 25 bp, E. coli
tgatgcagaacgtttcacccgctgg

SEQ ID NO: 90474 - DNA, 25 bp, E. coli
tgatgcagaacgattcacccgctgg

SEQ ID NO: 90475 - DNA, 25 bp, E. coli
tgcgcgggctgagacattacctgct

SEQ ID NO: 90476 - DNA, 25 bp, E. coli
tgcgcgggctgacacattacctgct

SEQ ID NO: 90477 - DNA, 25 bp, E. coli
tcatcacttcttcacggaggtcggt

SEQ ID NO: 90478 - DNA, 25 bp, E. coli
tcatcacttcttgacggaggtcggt

SEQ ID NO: 90479 - DNA, 25 bp, E. coli
gtgagatttattacccgcagcgccc

SEQ ID NO: 90480 - DNA, 25 bp, E. coli
gtgagatttatttcccgcagcgccc

SEQ ID NO: 90481 - DNA, 25 bp, E. coli
gacccacgtattggcaggatgctga

SEQ ID NO: 90482 - DNA, 25 bp, E. coli
gacccacgtattcgcaggatgctga

SEQ ID NO: 90483 - DNA, 25 bp, E. coli
aatttaacctgatgacggtaggccg

SEQ ID NO: 90484 - DNA, 25 bp, E. coli
aatttaacctgaagacggtaggccg

SEQ ID NO: 90485 - DNA, 25 bp, E. coli
tatggcgatgcaactgggaacgaac

SEQ ID NO: 90486 - DNA, 25 bp, E. coli
tatggcgatgcatctgggaacgaac

SEQ ID NO: 90487 - DNA, 25 bp, E. coli
tattggcggcgtgagcgaaccgatt

SEQ ID NO: 90488 - DNA, 25 bp, E. coli
tattggcggcgtcagcgaaccgatt

SEQ ID NO: 90489 - DNA, 25 bp, E. coli
ttgcgtggcacatgaacaggttggc

SEQ ID NO: 90490 - DNA, 25 bp, E. coli
ttgcgtggcacaagaacaggttggc

SEQ ID NO: 90491 - DNA, 25 bp, E. coli
tgataaatcagacctgcaagcggcg

SEQ ID NO: 90492 - DNA, 25 bp, E. coli
tgataaatcagagctgcaagcggcg

SEQ ID NO: 90493 - DNA, 25 bp, E. coli
taggtttttatagcggcccacgtct

SEQ ID NO: 90494 - DNA, 25 bp, E. coli
taggtttttataccggcccacgtct

SEQ ID NO: 90495 - DNA, 25 bp, E. coli
gcgaagaatatttcggcaccctgaa

SEQ ID NO: 90496 - DNA, 25 bp, E. coli
gcgaagaatattacggcaccctgaa

SEQ ID NO: 90497 - DNA, 25 bp, E. coli
gaagagtccagtcctgtcacgctga

SEQ ID NO: 90498 - DNA, 25 bp, E. coli
gaagagtccagtgctgtcacgctga

SEQ ID NO: 90499 - DNA, 25 bp, E. coli
ccctgcgtcgggatatggataacta

SEQ ID NO: 90500 - DNA, 25 bp, E. coli
ccctgcgtcgggttatggataacta

SEQ ID NO: 90501 - DNA, 25 bp, E. coli
ctgcaataaaaacagccggcggaat

SEQ ID NO: 90502 - DNA, 25 bp, E. coli
ctgcaataaaaagagccggcggaat

SEQ ID NO: 90503 - DNA, 25 bp, E. coli
gatccagtcctagaataccagcgtg

SEQ ID NO: 90504 - DNA, 25 bp, E. coli
gatccagtcctacaataccagcgtg

SEQ ID NO: 90505 - DNA, 25 bp, E. coli
caataagttgtgatcctggcgcccg

SEQ ID NO: 90506 - DNA, 25 bp, E. coli
caataagttgtgttcctggcgcccg

SEQ ID NO: 90507 - DNA, 25 bp, E. coli
tttcagtaaggaagctgccggtggc

SEQ ID NO: 90508 - DNA, 25 bp, E. coli
tttcagtaaggatgctgccggtggc

SEQ ID NO: 90509 - DNA, 25 bp, E. coli
ttttatcagcaacgacctgtccccg

SEQ ID NO: 90510 - DNA, 25 bp, E. coli
ttttatcagcaaggacctgtccccg

SEQ ID NO: 90511 - DNA, 25 bp, E. coli
tgcagtcagacctttatcccgggag

SEQ ID NO: 90512 - DNA, 25 bp, E. coli
tgcagtcagaccattatcccgggag

SEQ ID NO: 90513 - DNA, 25 bp, E. coli
tctgacgcaggacgatgatacgcca

SEQ ID NO: 90514 - DNA, 25 bp, E. coli
tctgacgcaggaggatgatacgcca

SEQ ID NO: 90515 - DNA, 25 bp, E. coli
gaagaggcttatgttaacccactgg

SEQ ID NO: 90516 - DNA, 25 bp, E. coli
gaagaggcttatcttaacccactgg

SEQ ID NO: 90517 - DNA, 25 bp, E. coli
gattacagaaatcatcggacgtgtg

SEQ ID NO: 90518 - DNA, 25 bp, E. coli
gattacagaaatgatcggacgtgtg

SEQ ID NO: 90519 - DNA, 25 bp, E. coli
ggcgcaagcctggaaacaataagtt

SEQ ID NO: 90520 - DNA, 25 bp, E. coli
ggctgtttcctgctcctgacaaaga

SEQ ID NO: 90521 - DNA, 25 bp, E. coli
ggctgtttcctggtcctgacaaaga

SEQ ID NO: 90522 - DNA, 25 bp, E. coli
ggcccctgcaggaattgtgcgatta

SEQ ID NO: 90523 - DNA, 25 bp, E. coli
ggcccctgcaggtattgtgcgatta

SEQ ID NO: 90524 - DNA, 25 bp, E. coli
ggcgcaagcctgcaaacaataagtt

SEQ ID NO: 90525 - DNA, 25 bp, E. coli
gatgcgcagtatcctgagtggccca

SEQ ID NO: 90526 - DNA, 25 bp, E. coli
gatgcgcagtatgctgagtggccca

SEQ ID NO: 90527 - DNA, 25 bp, E. coli
caagctgcaccggaagaagatttac

SEQ ID NO: 90528 - DNA, 25 bp, E. coli
caagctgcaccgcaagaagatttac

SEQ ID NO: 90529 - DNA, 25 bp, E. coli
cacttcatgcaaaataacgggatcg

SEQ ID NO: 90530 - DNA, 25 bp, E. coli
cacttcatgcaatataacgggatcg

SEQ ID NO: 90531 - DNA, 25 bp, E. coli
tttgtgtgcgcctgtatcagtcctg

SEQ ID NO: 90532 - DNA, 25 bp, E. coli
tttgtgtgcgccagtatcagtcctg

SEQ ID NO: 90533 - DNA, 25 bp, E. coli
tcatcgacgcaacaaacgaacccag

SEQ ID NO: 90534 - DNA, 25 bp, E. coli
tcatcgacgcaagaaacgaacccag

SEQ ID NO: 90535 - DNA, 25 bp, E. coli
cctggttaaccgtctgcaagctgca

SEQ ID NO: 90536 - DNA, 25 bp, E. coli
cctggttaaccgactgcaagctgca

SEQ ID NO: 90537 - DNA, 25 bp, E. coli
gctgtggtaaaagaacggtcggaat

SEQ ID NO: 90538 - DNA, 25 bp, E. coli
gctgtggtaaaacaacggtcggaat

SEQ ID NO: 90539 - DNA, 25 bp, E. coli
gaagttgcgcatattatcatcgacg

SEQ ID NO: 90540 - DNA, 25 bp, E. coli
gaagttgcgcattttatcatcgacg

SEQ ID NO: 90541 - DNA, 25 bp, E. coli
gaacccagccagctgatttctgaaa

SEQ ID NO: 90542 - DNA, 25 bp, E. coli
gacacaacctctatttctgatcggg

SEQ ID NO: 90543 - DNA, 25 bp, E. coli
gacacaacctctttttctgatcggg

SEQ ID NO: 90544 - DNA, 25 bp, E. coli
gaacccagccaggtgatttctgaaa

SEQ ID NO: 90545 - DNA, 25 bp, E. coli
ggcggcggcattattctgacggaat

SEQ ID NO: 90546 - DNA, 25 bp, E. coli
ggcggcggcatttttctgacggaat

SEQ ID NO: 90547 - DNA, 25 bp, E. coli
tcacagctcaatttgacggtcgcgg

SEQ ID NO: 90548 - DNA, 25 bp, E. coli
tcacagctcaatatgacggtcgcgg

SEQ ID NO: 90549 - DNA, 25 bp, E. coli
aatgtgtcgcgccatacgctggagc

SEQ ID NO: 90550 - DNA, 25 bp, E. coli
aatgtgtcgcgcgatacgctggagc

SEQ ID NO: 90551 - DNA, 25 bp, E. coli
tataccgtttcccttacggcgagcg

SEQ ID NO: 90552 - DNA, 25 bp, E. coli
aactcagcgcggttttactggtgac

SEQ ID NO: 90553 - DNA, 25 bp, E. coli
aactcagcgcggatttactggtgac

SEQ ID NO: 90554 - DNA, 25 bp, E. coli
ttattctggttaccggacgcagcga

SEQ ID NO: 90555 - DNA, 25 bp, E. coli
ttattctggttagcggacgcagcga

SEQ ID NO: 90556 - DNA, 25 bp, E. coli
tgttgaagatgacccggttacccag

SEQ ID NO: 90557 - DNA, 25 bp, E. coli
tgttgaagatgagccggttacccag

SEQ ID NO: 90558 - DNA, 25 bp, E. coli
tgcgcgtcgggtcgaaaaccctgac

SEQ ID NO: 90559 - DNA, 25 bp, E. coli
tgcgcgtcgggtggaaaaccctgac

SEQ ID NO: 90560 - DNA, 25 bp, E. coli
gcgaaattctcacccgtgaacgtct

SEQ ID NO: 90561 - DNA, 25 bp, E. coli
gcgaaattctcagccgtgaacgtct

SEQ ID NO: 90562 - DNA, 25 bp, E. coli
gaaaatggcctgttgttaacccgcg

SEQ ID NO: 90563 - DNA, 25 bp, E. coli
gaaaatggcctgatgttaacccgcg

SEQ ID NO: 90564 - DNA, 25 bp, E. coli
cgattaaactgagccgcgcagagta

SEQ ID NO: 90565 - DNA, 25 bp, E. coli
cgattaaactgacccgcgcagagta

SEQ ID NO: 90566 - DNA, 25 bp, E. coli
ggaaatgggcgctgacgattacgtc

SEQ ID NO: 90567 - DNA, 25 bp, E. coli
ggaaatgggcgcagacgattacgtc

SEQ ID NO: 90568 - DNA, 25 bp, E. coli
tataccgtttccgttacggcgagcg

SEQ ID NO: 90569 - DNA, 25 bp, E. coli
gacctgcgcaccctcgatgtgttaa

SEQ ID NO: 90570 - DNA, 25 bp, E. coli
gacctgcgcaccgtcgatgtgttaa

SEQ ID NO: 90571 - DNA, 25 bp, E. coli
atgaaatttttagcgctgctggcgc

SEQ ID NO: 90572 - DNA, 25 bp, E. coli
atgaaatttttaccgctgctggcgc

SEQ ID NO: 90573 - DNA, 25 bp, E. coli
atttgctgacaatggcgaaggccgc

SEQ ID NO: 90574 - DNA, 25 bp, E. coli
atttgctgacaaaggcgaaggccgc

SEQ ID NO: 90575 - DNA, 25 bp, E. coli
aaagtgctggaacaaaacttccgcg

SEQ ID NO: 90576 - DNA, 25 bp, E. coli
aaagtgctggaagaaaacttccgcg

SEQ ID NO: 90577 - DNA, 25 bp, E. coli
ttttcaacaccaacgatctcgccgg

SEQ ID NO: 90578 - DNA, 25 bp, E. coli
ttttcaacaccatcgatctcgccgg

SEQ ID NO: 90579 - DNA, 25 bp, E. coli
tgttccaggccgttcgcaaagtgct

SEQ ID NO: 90580 - DNA, 25 bp, E. coli
tgattagcccgtatgtgagcgccct

SEQ ID NO: 90581 - DNA, 25 bp, E. coli
tgattagcccgtttgtgagcgccct

SEQ ID NO: 90582 - DNA, 25 bp, E. coli
tgttccaggccgatcgcaaagtgct

SEQ ID NO: 90583 - DNA, 25 bp, E. coli
tgaccctggacgatcttcagcaacg

SEQ ID NO: 90584 - DNA, 25 bp, E. coli
tgaccctggacgttcttcagcaacg

SEQ ID NO: 90585 - DNA, 25 bp, E. coli
tcaaacccggacgattaaagatctg

SEQ ID NO: 90586 - DNA, 25 bp, E. coli
tcaaacccggaccattaaagatctg

SEQ ID NO: 90587 - DNA, 25 bp, E. coli
cgcatggtgcaggtgatcaacggtc

SEQ ID NO: 90588 - DNA, 25 bp, E. coli
cgcatggtgcagctgatcaacggtc

SEQ ID NO: 90589 - DNA, 25 bp, E. coli
taatgataaacagggcgatcgcacc

SEQ ID NO: 90590 - DNA, 25 bp, E. coli
taatgataaacacggcgatcgcacc

SEQ ID NO: 90591 - DNA, 25 bp, E. coli
gatctcgccgggaaaacctatctgg

SEQ ID NO: 90592 - DNA, 25 bp, E. coli
gatctcgccgggtaaacctatctgg

SEQ ID NO: 90593 - DNA, 25 bp, E. coli
aagggacgaccttgcgcaattggcc

SEQ ID NO: 90594 - DNA, 25 bp, E. coli
aagggacgacctagcgcaattggcc

SEQ ID NO: 90595 - DNA, 25 bp, E. coli
catggaagcaaaccgaatgcggtct

SEQ ID NO: 90596 - DNA, 25 bp, E. coli
catggaagcaaagcgaatgcggtct

SEQ ID NO: 90597 - DNA, 25 bp, E. coli
cagtatgtcatccacgcctgtggta

SEQ ID NO: 90598 - DNA, 25 bp, E. coli
cagtatgtcatcgacgcctgtggta

SEQ ID NO: 90599 - DNA, 25 bp, E. coli
tacttccgtaattgagggcgcccga

SEQ ID NO: 90600 - DNA, 25 bp, E. coli
tacttccgtaatagagggcgcccga

SEQ ID NO: 90601 - DNA, 25 bp, E. coli
tagagtatacgtaggaaaccttgcg

SEQ ID NO: 90602 - DNA, 25 bp, E. coli
tagagtatacgttggaaaccttgcg

SEQ ID NO: 90603 - DNA, 25 bp, E. coli
tgaagataattcagctggcgcacaa

SEQ ID NO: 90604 - DNA, 25 bp, E. coli
tgaagataattctgctggcgcacaa

SEQ ID NO: 90605 - DNA, 25 bp, E. coli
tgcggtctcaaaccgcctctgtaga

SEQ ID NO: 90606 - DNA, 25 bp, E. coli
tgcggtctcaaagcgcctctgtaga

SEQ ID NO: 90607 - DNA, 25 bp, E. coli
gaatggctcaacacaacagccggtg

SEQ ID NO: 90608 - DNA, 25 bp, E. coli
gaatggctcaactcaacagccggtg

SEQ ID NO: 90609 - DNA, 25 bp, E. coli
gatcacctcatgaaaccgcacgttg

SEQ ID NO: 90610 - DNA, 25 bp, E. coli
gatcacctcatgtaaccgcacgttg

SEQ ID NO: 90611 - DNA, 25 bp, E. coli
gtctgtgttacaagcgccggcaagg

SEQ ID NO: 90612 - DNA, 25 bp, E. coli
gtctgtgttacatgcgccggcaagg

SEQ ID NO: 90613 - DNA, 25 bp, E. coli
ggtaaccagattcaagctccgcttg

SEQ ID NO: 90614 - DNA, 25 bp, E. coli
ggtaaccagattgaagctccgcttg

SEQ ID NO: 90615 - DNA, 25 bp, E. coli
cataaggcctcggaatggcttgcaa

SEQ ID NO: 90616 - DNA, 25 bp, E. coli
cataaggcctcgcaatggcttgcaa

SEQ ID NO: 90617 - DNA, 25 bp, E. coli
caaggctttacatgttttgaggtag

SEQ ID NO: 90618 - DNA, 25 bp, E. coli
caaggctttacaagttttgaggtag

SEQ ID NO: 90619 - DNA, 25 bp, E. coli
taggaacttctaagtcgtgggccgc

SEQ ID NO: 90620 - DNA, 25 bp, E. coli
taggaacttctatgtcgtgggccgc

SEQ ID NO: 90621 - DNA, 25 bp, E. coli
tatttaagtgccttgcctttagagg

SEQ ID NO: 90622 - DNA, 25 bp, E. coli
tatttaagtgccatgcctttagagg

SEQ ID NO: 90623 - DNA, 25 bp, E. coli
tttatgcccgtcttatccgtttccg

SEQ ID NO: 90624 - DNA, 25 bp, E. coli
tttatgcccgtcatatccgtttccg

SEQ ID NO: 90625 - DNA, 25 bp, E. coli
tcgtgggccgcacgttcgaatcctg

SEQ ID NO: 90626 - DNA, 25 bp, E. coli
tcgtgggccgcaggttcgaatcctg

SEQ ID NO: 90627 - DNA, 25 bp, E. coli
gcctttagaggcatataagcgaaaa

SEQ ID NO: 90628 - DNA, 25 bp, E. coli
gcctttagaggcttataagcgaaaa

SEQ ID NO: 90629 - DNA, 25 bp, E. coli
gcgaaaatagcaagaggtttatcct

SEQ ID NO: 90630 - DNA, 25 bp, E. coli
gcgaaaatagcatgaggtttatcct

SEQ ID NO: 90631 - DNA, 25 bp, E. coli
gaatgattatcacaatgcgctatct

SEQ ID NO: 90632 - DNA, 25 bp, E. coli
gaatgattatcagaatgcgctatct

SEQ ID NO: 90633 - DNA, 25 bp, E. coli
gacaaaactgagacacataaggcct

SEQ ID NO: 90634 - DNA, 25 bp, E. coli
gacaaaactgagtcacataaggcct

SEQ ID NO: 90635 - DNA, 25 bp, E. coli
gggcgcgccattacttcctcattta

SEQ ID NO: 90636 - DNA, 25 bp, E. coli
gggcgcgccatttcttcctcattta

SEQ ID NO: 90637 - DNA, 25 bp, E. coli
cacgtatatcgaacccaccggtaca

SEQ ID NO: 90638 - DNA, 25 bp, E. coli
cacgtatatcgatcccaccggtaca

SEQ ID NO: 90639 - DNA, 25 bp, E. coli
tactggaaaaggtcatgaaatgggc

SEQ ID NO: 90640 - DNA, 25 bp, E. coli
tactggaaaaggacatgaaatgggc

SEQ ID NO: 90641 - DNA, 25 bp, E. coli
ttacccgtggtcagacggtggcgct

SEQ ID NO: 90642 - DNA, 25 bp, E. coli
ttacccgtggtctgacggtggcgct

SEQ ID NO: 90643 - DNA, 25 bp, E. coli
tgaccctgacagttgaagaatgcct

SEQ ID NO: 90644 - DNA, 25 bp, E. coli
tgaccctgacagatgaagaatgcct

SEQ ID NO: 90645 - DNA, 25 bp, E. coli
tgcgcctgatcattgccgggcagat

SEQ ID NO: 90646 - DNA, 25 bp, E. coli
tgcgcctgatcaatgccgggcagat

SEQ ID NO: 90647 - DNA, 25 bp, E. coli
tctgggccggtgaaacgaactttcg

SEQ ID NO: 90648 - DNA, 25 bp, E. coli
tctgggccggtgtaacgaactttcg

SEQ ID NO: 90649 - DNA, 25 bp, E. coli
gaagaatgcctgcaactactggaaa

SEQ ID NO: 90650 - DNA, 25 bp, E. coli
gaagaatgcctggaactactggaaa

SEQ ID NO: 90651 - DNA, 25 bp, E. coli
gattgccacgcaatacaccggttac

SEQ ID NO: 90652 - DNA, 25 bp, E. coli
gattgccacgcattacaccggttac

SEQ ID NO: 90653 - DNA, 25 bp, E. coli
ggtgccgggacgttcacgattgcca

SEQ ID NO: 90654 - DNA, 25 bp, E. coli
ggtgccgggacgatcacgattgcca

SEQ ID NO: 90655 - DNA, 25 bp, E. coli
gatgcccgcgtcctgtaagcagtat

SEQ ID NO: 90656 - DNA, 25 bp, E. coli
gatgaatggttaagtcgctacgact

SEQ ID NO: 90657 - DNA, 25 bp, E. coli
gatgcccgcgtcgtgtaagcagtat

SEQ ID NO: 90658 - DNA, 25 bp, E. coli
gatgaatggttatgtcgctacgact

SEQ ID NO: 90659 - DNA, 25 bp, E. coli
aatagtcaacgcgaactggaagcgg

SEQ ID NO: 90660 - DNA, 25 bp, E. coli
aatagtcaacgccaactggaagcgg

SEQ ID NO: 90661 - DNA, 25 bp, E. coli
tgccaaaagatatcgtcgcccagtt

SEQ ID NO: 90662 - DNA, 25 bp, E. coli
tccgcacgtctgtaagcgctcgttg

SEQ ID NO: 90663 - DNA, 25 bp, E. coli
tccgcacgtctgaaagcgctcgttg

SEQ ID NO: 90664 - DNA, 25 bp, E. coli
tgccaaaagataacgtcgcccagtt

SEQ ID NO: 90665 - DNA, 25 bp, E. coli
gcaagcactacggaaccagttgaat

SEQ ID NO: 90666 - DNA, 25 bp, E. coli
gcaagcactacgcaaccagttgaat

SEQ ID NO: 90667 - DNA, 25 bp, E. coli
gaacattaacttctgcgggcaaagg

SEQ ID NO: 90668 - DNA, 25 bp, E. coli
gaacattaacttgtgcgggcaaagg

SEQ ID NO: 90669 - DNA, 25 bp, E. coli
gaaagtagcgccgatttgccaaaag

SEQ ID NO: 90670 - DNA, 25 bp, E. coli
gaaagtagcgcccatttgccaaaag

SEQ ID NO: 90671 - DNA, 25 bp, E. coli
gatacggtaacgttccgcgatctca

SEQ ID NO: 90672 - DNA, 25 bp, E. coli
gatacggtaacgatccgcgatctca

SEQ ID NO: 90673 - DNA, 25 bp, E. coli
ggatcatctaacctgctcggcgaag

SEQ ID NO: 90674 - DNA, 25 bp, E. coli
ggatcatctaacgtgctcggcgaag

SEQ ID NO: 90675 - DNA, 25 bp, E. coli
tggaaagtaccgtgcaactggcgga

SEQ ID NO: 90676 - DNA, 25 bp, E. coli
tggaaagtaccgagcaactggcgga

SEQ ID NO: 90677 - DNA, 25 bp, E. coli
gagatccaccaagtaattctggcgg

SEQ ID NO: 90678 - DNA, 25 bp, E. coli
gatgcccgccgtgagttgaatgaaa

SEQ ID NO: 90679 - DNA, 25 bp, E. coli
gagatccaccaactaattctggcgg

SEQ ID NO: 90680 - DNA, 25 bp, E. coli
gatgcccgccgtcagttgaatgaaa

SEQ ID NO: 90681 - DNA, 25 bp, E. coli
caatatgtaggcttggcacggtggc

SEQ ID NO: 90682 - DNA, 25 bp, E. coli
caactcaaaggcagtagtcaggcag

SEQ ID NO: 90683 - DNA, 25 bp, E. coli
caatatgtaggcatggcacggtggc

SEQ ID NO: 90684 - DNA, 25 bp, E. coli
cactattgaaacgttgcggacagca

SEQ ID NO: 90685 - DNA, 25 bp, E. coli
cactattgaaaccttgcggacagca

SEQ ID NO: 90686 - DNA, 25 bp, E. coli
caactcaaaggctgtagtcaggcag

SEQ ID NO: 90687 - DNA, 25 bp, E. coli
tagccgtttagccagtgagatcgcc

SEQ ID NO: 90688 - DNA, 25 bp, E. coli
tatgttatccggtcaaaactcggcc

SEQ ID NO: 90689 - DNA, 25 bp, E. coli
tatgttatccggacaaaactcggcc

SEQ ID NO: 90690 - DNA, 25 bp, E. coli
tagccgtttagcgagtgagatcgcc

SEQ ID NO: 90691 - DNA, 25 bp, E. coli
ttttgagcgcatccagcagattgag

SEQ ID NO: 90692 - DNA, 25 bp, E. coli
ttttgagcgcatgcagcagattgag

SEQ ID NO: 90693 - DNA, 25 bp, E. coli
tgatcgccaagtcgaagtagtgccg

SEQ ID NO: 90694 - DNA, 25 bp, E. coli
tgatcgccaagtggaagtagtgccg

SEQ ID NO: 90695 - DNA, 25 bp, E. coli
tgaagctagccacatcacggaacgg

SEQ ID NO: 90696 - DNA, 25 bp, E. coli
tgaagctagccagatcacggaacgg

SEQ ID NO: 90697 - DNA, 25 bp, E. coli
gaatatgctgcggtgacctgtagtg

SEQ ID NO: 90698 - DNA, 25 bp, E. coli
gaatatgctgcgctgacctgtagtg

SEQ ID NO: 90699 - DNA, 25 bp, E. coli
ggtacaacttgcagagccgacggca

SEQ ID NO: 90700 - DNA, 25 bp, E. coli
ggtacaacttgctgagccgacggca

SEQ ID NO: 90701 - DNA, 25 bp, E. coli
tcaagcaagggaatcaggcactggt

SEQ ID NO: 90702 - DNA, 25 bp, E. coli
tcaagcaagggattcaggcactggt

SEQ ID NO: 90703 - DNA, 25 bp, E. coli
caatggacgatctgtgggctgaagc

SEQ ID NO: 90704 - DNA, 25 bp, E. coli
caatggacgatcagtgggctgaagc

SEQ ID NO: 90705 - DNA, 25 bp, E. coli
tgttccagcaatttggcggtggtga

SEQ ID NO: 90706 - DNA, 25 bp, E. coli
tgttccagcaatatggcggtggtga

SEQ ID NO: 90707 - DNA, 25 bp, E. coli
tgagtgacatgattaatccggccga

SEQ ID NO: 90708 - DNA, 25 bp, E. coli
tgcgtctgacgctagggtccgtcgt

SEQ ID NO: 90709 - DNA, 25 bp, E. coli
tgcgtctgacgcaagggtccgtcgt

SEQ ID NO: 90710 - DNA, 25 bp, E. coli
tgagtgacatgaataatccggccga

SEQ ID NO: 90711 - DNA, 25 bp, E. coli
ccatcaaagagcagttgcgtctgac

SEQ ID NO: 90712 - DNA, 25 bp, E. coli
ccatcaaagagctgttgcgtctgac

SEQ ID NO: 90713 - DNA, 25 bp, E. coli
cgatgacaacaagggcgcaatggac

SEQ ID NO: 90714 - DNA, 25 bp, E. coli
cgatgacaacaacggcgcaatggac

SEQ ID NO: 90715 - DNA, 25 bp, E. coli
gataaatatggcctgcggatcaccg

SEQ ID NO: 90716 - DNA, 25 bp, E. coli
gattatggatattccggtcaagctg

SEQ ID NO: 90717 - DNA, 25 bp, E. coli
gataaatatggcgtgcggatcaccg

SEQ ID NO: 90718 - DNA, 25 bp, E. coli
gattatggatataccggtcaagctg

SEQ ID NO: 90719 - DNA, 25 bp, E. coli
gtcaagctgaccctcgagctgggcc

SEQ ID NO: 90720 - DNA, 25 bp, E. coli
gtcaagctgaccgtcgagctgggcc

SEQ ID NO: 90721 - DNA, 25 bp, E. coli
tcagcggaacgtagcaggatatcga

SEQ ID NO: 90722 - DNA, 25 bp, E. coli
tcagcggaacgttgcaggatatcga

SEQ ID NO: 90723 - DNA, 25 bp, E. coli
tcaacggttatttaatcgcccaggg

SEQ ID NO: 90724 - DNA, 25 bp, E. coli
tcaacggttattaaatcgcccaggg

SEQ ID NO: 90725 - DNA, 25 bp, E. coli
cagagaaagtaattcaatacggcga

SEQ ID NO: 90726 - DNA, 25 bp, E. coli
cagagaaagtaaatcaatacggcga

SEQ ID NO: 90727 - DNA, 25 bp, E. coli
tacggcgaaatattgaatacacatg

SEQ ID NO: 90728 - DNA, 25 bp, E. coli
actgttgcgttgtgtggaacctggc

SEQ ID NO: 90729 - DNA, 25 bp, E. coli
actgttgcgttgagtggaacctggc

SEQ ID NO: 90730 - DNA, 25 bp, E. coli
tacggcgaaataatgaatacacatg

SEQ ID NO: 90731 - DNA, 25 bp, E. coli
tatactaaagcaaggtaagcatgct

SEQ ID NO: 90732 - DNA, 25 bp, E. coli
tatactaaagcatggtaagcatgct

SEQ ID NO: 90733 - DNA, 25 bp, E. coli
tattttgagcattggtaacagagca

SEQ ID NO: 90734 - DNA, 25 bp, E. coli
tattttgagcataggtaacagagca

SEQ ID NO: 90735 - DNA, 25 bp, E. coli
tgtctttccagataaaagtgtaagc

SEQ ID NO: 90736 - DNA, 25 bp, E. coli
tgtctttccagaaaaaagtgtaagc

SEQ ID NO: 90737 - DNA, 25 bp, E. coli
gacacagcccatttaacatcaaaga

SEQ ID NO: 90738 - DNA, 25 bp, E. coli
gacacagcccatataacatcaaaga

SEQ ID NO: 90739 - DNA, 25 bp, E. coli
gatatataacgatacatgcactgca

SEQ ID NO: 90740 - DNA, 25 bp, E. coli
gatatataacgaaacatgcactgca

SEQ ID NO: 90741 - DNA, 25 bp, E. coli
ggaacctggcaacaaggtaacagag

SEQ ID NO: 90742 - DNA, 25 bp, E. coli
ggaacctggcaagaaggtaacagag

SEQ ID NO: 90743 - DNA, 25 bp, E. coli
taatttttaatgtccagggacgagc

SEQ ID NO: 90744 - DNA, 25 bp, E. coli
taatttttaatgaccagggacgagc

SEQ ID NO: 90745 - DNA, 25 bp, E. coli
gaccagggacgaccaaatcttacca

SEQ ID NO: 90746 - DNA, 25 bp, E. coli
gaccagggacgagcaaatcttacca

SEQ ID NO: 90747 - DNA, 25 bp, E. coli
cttttactggaattaagatcagcca

SEQ ID NO: 90748 - DNA, 25 bp, E. coli
cttttactggaaataagatcagcca

SEQ ID NO: 90749 - DNA, 25 bp, E. coli
actgttatgcaatactactttgtgg

SEQ ID NO: 90750 - DNA, 25 bp, E. coli
actgttatgcaaaactactttgtgg

SEQ ID NO: 90751 - DNA, 25 bp, E. coli
tacgctgtgcgaaaatatattcgtg

SEQ ID NO: 90752 - DNA, 25 bp, E. coli
tacgctgtgcgataatatattcgtg

SEQ ID NO: 90753 - DNA, 25 bp, E. coli
tataaacataaggtatacgctgtgc

SEQ ID NO: 90754 - DNA, 25 bp, E. coli
tataaacataagctatacgctgtgc

SEQ ID NO: 90755 - DNA, 25 bp, E. coli
tatactgaaattcaaataatcgcag

SEQ ID NO: 90756 - DNA, 25 bp, E. coli
tatactgaaattgaaataatcgcag

SEQ ID NO: 90757 - DNA, 25 bp, E. coli
tttggtcctacctaatctggcagtt

SEQ ID NO: 90758 - DNA, 25 bp, E. coli
tttggtcctaccaaatctggcagtt

SEQ ID NO: 90759 - DNA, 25 bp, E. coli
tgcgctaagaaagagtctggcatca

SEQ ID NO: 90760 - DNA, 25 bp, E. coli
tgcgctaagaaacagtctggcatca

SEQ ID NO: 90761 - DNA, 25 bp, E. coli
tcgtgctgcattaacttattatcaa

SEQ ID NO: 90762 - DNA, 25 bp, E. coli
tctggcatcattacattagtatact

SEQ ID NO: 90763 - DNA, 25 bp, E. coli
tctggcatcatttcattagtatact

SEQ ID NO: 90764 - DNA, 25 bp, E. coli
tctggcagtttttgcgctaagaaac

SEQ ID NO: 90765 - DNA, 25 bp, E. coli
tctggcagttttagcgctaagaaac

SEQ ID NO: 90766 - DNA, 25 bp, E. coli
tcgtgctgcatttacttattatcaa

SEQ ID NO: 90767 - DNA, 25 bp, E. coli
taatcgcagtatcaaatataaggga

SEQ ID NO: 90768 - DNA, 25 bp, E. coli
taatcgcagtatgaaatataaggga

SEQ ID NO: 90769 - DNA, 25 bp, E. coli
tacgtttttacgtgtctgcggcgac

SEQ ID NO: 90770 - DNA, 25 bp, E. coli
tacgtttttacgagtctgcggcgac

SEQ ID NO: 90771 - DNA, 25 bp, E. coli
tacccggcacacttgcgaaatgggc

SEQ ID NO: 90772 - DNA, 25 bp, E. coli
tacccggcacacatgcgaaatgggc

SEQ ID NO: 90773 - DNA, 25 bp, E. coli
tttttcccggcagacagatacacgc

SEQ ID NO: 90774 - DNA, 25 bp, E. coli
tttttcccggcacacagatacacgc

SEQ ID NO: 90775 - DNA, 25 bp, E. coli
tgttatccaccagcagcagacaatg

SEQ ID NO: 90776 - DNA, 25 bp, E. coli
tgttatccaccaccagcagacaatg

SEQ ID NO: 90777 - DNA, 25 bp, E. coli
gatttccgaacctttatgacgggcg

SEQ ID NO: 90778 - DNA, 25 bp, E. coli
gatccatcagggaatgccagtgctg

SEQ ID NO: 90779 - DNA, 25 bp, E. coli
gatttccgaaccattatgacgggcg

SEQ ID NO: 90780 - DNA, 25 bp, E. coli
gtaatcttacgtcgtcctcgcaggg

SEQ ID NO: 90781 - DNA, 25 bp, E. coli
ggtgccaccatggatcctggagatg

SEQ ID NO: 90782 - DNA, 25 bp, E. coli
gtaatcttacgtggtcctcgcaggg

SEQ ID NO: 90783 - DNA, 25 bp, E. coli
ggtgccaccatgcatcctggagatg

SEQ ID NO: 90784 - DNA, 25 bp, E. coli
taatcggtagcggaaatctgaacag

SEQ ID NO: 90785 - DNA, 25 bp, E. coli
taatcggtagcgcaaatctgaacag

SEQ ID NO: 90786 - DNA, 25 bp, E. coli
tcactctcgagggtctggcgaagca

SEQ ID NO: 90787 - DNA, 25 bp, E. coli
tcactctcgaggctctggcgaagca

SEQ ID NO: 90788 - DNA, 25 bp, E. coli
gatccatcagggtatgccagtgctg

SEQ ID NO: 90789 - DNA, 25 bp, E. coli
gatgaaccgcacagggatgccttca

SEQ ID NO: 90790 - DNA, 25 bp, E. coli
gatgaaccgcactgggatgccttca

SEQ ID NO: 90791 - DNA, 25 bp, E. coli
aaaaatactcgaagcaatactggcg

SEQ ID NO: 90792 - DNA, 25 bp, E. coli
aaaaatactcgatgcaatactggcg

SEQ ID NO: 90793 - DNA, 25 bp, E. coli
tagcaattctctaacgtcgccaccg

SEQ ID NO: 90794 - DNA, 25 bp, E. coli
tagcttttatggttaacgcccacgt

SEQ ID NO: 90795 - DNA, 25 bp, E. coli
tagcttttatggataacgcccacgt

SEQ ID NO: 90796 - DNA, 25 bp, E. coli
tagcaattctcttacgtcgccaccg

SEQ ID NO: 90797 - DNA, 25 bp, E. coli
ttcaggactggaccgattattcacc

SEQ ID NO: 90798 - DNA, 25 bp, E. coli
ttcaggactggagcgattattcacc

SEQ ID NO: 90799 - DNA, 25 bp, E. coli
tttatatcaactgatcacgcgtagc

SEQ ID NO: 90800 - DNA, 25 bp, E. coli
tttatatcaactcatcacgcgtagc

SEQ ID NO: 90801 - DNA, 25 bp, E. coli
tgatgtatgccggttgtctgcccac

SEQ ID NO: 90802 - DNA, 25 bp, E. coli
tgatgtatgccgcttgtctgcccac

SEQ ID NO: 90803 - DNA, 25 bp, E. coli
tcaggtcacctttctggtggagaaa

SEQ ID NO: 90804 - DNA, 25 bp, E. coli
tcaggtcaccttactggtggagaaa

SEQ ID NO: 90805 - DNA, 25 bp, E. coli
gcgacgagtcgctctggttacccat

SEQ ID NO: 90806 - DNA, 25 bp, E. coli
gcgacgagtcgcactggttacccat

SEQ ID NO: 90807 - DNA, 25 bp, E. coli
cttatttatttgaggcgcactggcc

SEQ ID NO: 90808 - DNA, 25 bp, E. coli
cttatttatttgtggcgcactggcc

SEQ ID NO: 90809 - DNA, 25 bp, E. coli
ggcgcaacgctaaaaacaattcagg

SEQ ID NO: 90810 - DNA, 25 bp, E. coli
ggcgcaacgctataaacaattcagg

SEQ ID NO: 90811 - DNA, 25 bp, E. coli
gatcctcggttttcccatcggcctg

SEQ ID NO: 90812 - DNA, 25 bp, E. coli
gatcctcggtttacccatcggcctg

SEQ ID NO: 90813 - DNA, 25 bp, E. coli
tacaatgctgctatatttctgcgct

SEQ ID NO: 90814 - DNA, 25 bp, E. coli
tacaatgctgctttatttctgcgct

SEQ ID NO: 90815 - DNA, 25 bp, E. coli
tattcgccgtaatattgatgatgcg

SEQ ID NO: 90816 - DNA, 25 bp, E. coli
tattcgccgtaaaattgatgatgcg

SEQ ID NO: 90817 - DNA, 25 bp, E. coli
tatttctgcgctctggtcagtgcgt

SEQ ID NO: 90818 - DNA, 25 bp, E. coli
tatttctgcgctgtggtcagtgcgt

SEQ ID NO: 90819 - DNA, 25 bp, E. coli
tgacattcgttcatacaatgctgct

SEQ ID NO: 90820 - DNA, 25 bp, E. coli
tgacattcgttcttacaatgctgct

SEQ ID NO: 90821 - DNA, 25 bp, E. coli
tcagtgcgttatttctggtgagcgg

SEQ ID NO: 90822 - DNA, 25 bp, E. coli
tcagtgcgttatatctggtgagcgg

SEQ ID NO: 90823 - DNA, 25 bp, E. coli
gaaaaactcagtaaaacagcacagg

SEQ ID NO: 90824 - DNA, 25 bp, E. coli
gaaaaactcagttaaacagcacagg

SEQ ID NO: 90825 - DNA, 25 bp, E. coli
cgttatatctggtgagcggtggtta

SEQ ID NO: 90826 - DNA, 25 bp, E. coli
cgttatatctggagagcggtggtta

SEQ ID NO: 90827 - DNA, 25 bp, E. coli
gtaaaacagcacaggcaccgtcatc

SEQ ID NO: 90828 - DNA, 25 bp, E. coli
gtaaaacagcactggcaccgtcatc

SEQ ID NO: 90829 - DNA, 25 bp, E. coli
ggtcatcagaaaatatattcgccgt

SEQ ID NO: 90830 - DNA, 25 bp, E. coli
ggtcatcagaaattatattcgccgt

SEQ ID NO: 90831 - DNA, 25 bp, E. coli
gagcggtggttataaggtcatcaga

SEQ ID NO: 90832 - DNA, 25 bp, E. coli
gagcggtggttaaaaggtcatcaga

SEQ ID NO: 90833 - DNA, 25 bp, E. coli
gatgatgcggcagctgaaaaactca

SEQ ID NO: 90834 - DNA, 25 bp, E. coli
gatgatgcggcacctgaaaaactca

SEQ ID NO: 90835 - DNA, 25 bp, E. coli
aagtctatggcgacacgttcctcgg

SEQ ID NO: 90836 - DNA, 25 bp, E. coli
aagtctatggcgtcacgttcctcgg

SEQ ID NO: 90837 - DNA, 25 bp, E. coli
caaaagcgtactcttcctcggggcg

SEQ ID NO: 90838 - DNA, 25 bp, E. coli
caaaagcgtactgttcctcggggcg

SEQ ID NO: 90839 - DNA, 25 bp, E. coli
aaagtctatggcgtcacgttcctcg

SEQ ID NO: 90840 - DNA, 25 bp, E. coli
aaagtctatggcctcacgttcctcg

SEQ ID NO: 90841 - DNA, 25 bp, E. coli
ttgctcttggcctggtcggtggtct

SEQ ID NO: 90842 - DNA, 25 bp, E. coli
ttgctcttggccaggtcggtggtct

SEQ ID NO: 90843 - DNA, 25 bp, E. coli
tctatggcgtcacgttcctcggcgc

SEQ ID NO: 90844 - DNA, 25 bp, E. coli
tctatggcgtcaggttcctcggcgc

SEQ ID NO: 90845 - DNA, 25 bp, E. coli
cgctgattgctcatggcctggtcgg

SEQ ID NO: 90846 - DNA, 25 bp, E. coli
cgctgattgctcttggcctggtcgg

SEQ ID NO: 90847 - DNA, 25 bp, E. coli
ctgattgctcttcgcctggtcggtg

SEQ ID NO: 90848 - DNA, 25 bp, E. coli
ctcttggcctggtcggtggtctgta

SEQ ID NO: 90849 - DNA, 25 bp, E. coli
ctcttggcctggacggtggtctgta

SEQ ID NO: 90850 - DNA, 25 bp, E. coli
ctgattgctcttggcctggtcggtg

SEQ ID NO: 90851 - DNA, 25 bp, E. coli
gttcaaaagcgtactgttcctcggg

SEQ ID NO: 90852 - DNA, 25 bp, E. coli
gttcaaaagcgttctgttcctcggg

SEQ ID NO: 90853 - DNA, 25 bp, E. coli
ggcgaaagtctatggcgtcacgttc

SEQ ID NO: 90854 - DNA, 25 bp, E. coli
ggcgaaagtctaaggcgtcacgttc

SEQ ID NO: 90855 - DNA, 25 bp, E. coli
ggcgctgattgctcttggcctggtc

SEQ ID NO: 90856 - DNA, 25 bp, E. coli
ggcgctgattgcacttggcctggtc

SEQ ID NO: 90857 - DNA, 25 bp, E. coli
taaatgcgttgagacctctatgggc

SEQ ID NO: 90858 - DNA, 25 bp, E. coli
taaatgcgttgacacctctatgggc

SEQ ID NO: 90859 - DNA, 25 bp, E. coli
tacacggcggcgtaaagtataccag

SEQ ID NO: 90860 - DNA, 25 bp, E. coli
tacactgcgctgttggatggtcgtc

SEQ ID NO: 90861 - DNA, 25 bp, E. coli
tacacggcggcgaaaagtataccag

SEQ ID NO: 90862 - DNA, 25 bp, E. coli
tacactgcgctgatggatggtcgtc

SEQ ID NO: 90863 - DNA, 25 bp, E. coli
accctgggcatgtgcgttgacgcaa

SEQ ID NO: 90864 - DNA, 25 bp, E. coli
accctgggcatgagcgttgacgcaa

SEQ ID NO: 90865 - DNA, 25 bp, E. coli
tgtacaaagagcacggcatccgtcg

SEQ ID NO: 90866 - DNA, 25 bp, E. coli
tgtacaaagagctcggcatccgtcg

SEQ ID NO: 90867 - DNA, 25 bp, E. coli
tgaactgtctctgggcaaactgggc

SEQ ID NO: 90868 - DNA, 25 bp, E. coli
tgaactgtctctcggcaaactgggc

SEQ ID NO: 90869 - DNA, 25 bp, E. coli
tctatgtaacccaggaagcggcaaa

SEQ ID NO: 90870 - DNA, 25 bp, E. coli
tcatcaacaaagtaggtacccgtcc

SEQ ID NO: 90871 - DNA, 25 bp, E. coli
tcatcaacaaagaaggtacccgtcc

SEQ ID NO: 90872 - DNA, 25 bp, E. coli
tctatgtaaccctggaagcggcaaa

SEQ ID NO: 90873 - DNA, 25 bp, E. coli
gcgactgccgctttgttgaagacaa

SEQ ID NO: 90874 - DNA, 25 bp, E. coli
gcgactgccgctatgttgaagacaa

SEQ ID NO: 90875 - DNA, 25 bp, E. coli
gaagaactggttatcgcgcaagacg

SEQ ID NO: 90876 - DNA, 25 bp, E. coli
gcaaaaatgctgtacaaaccggtag

SEQ ID NO: 90877 - DNA, 25 bp, E. coli
gcaaaaatgctgaacaaaccggtag

SEQ ID NO: 90878 - DNA, 25 bp, E. coli
gaagaactggttttcgcgcaagacg

SEQ ID NO: 90879 - DNA, 25 bp, E. coli
aggactggcagcagacttttgcggt

SEQ ID NO: 90880 - DNA, 25 bp, E. coli
aggactggcagctgacttttgcggt

SEQ ID NO: 90881 - DNA, 25 bp, E. coli
aaagcggcgctgtaaagcctggcgt

SEQ ID NO: 90882 - DNA, 25 bp, E. coli
aaagcggcgctgaaaagcctggcgt

SEQ ID NO: 90883 - DNA, 25 bp, E. coli
ttagctgaaacggagcgactggacg

SEQ ID NO: 90884 - DNA, 25 bp, E. coli
ttagctgaaacgcagcgactggacg

SEQ ID NO: 90885 - DNA, 25 bp, E. coli
tgcttatggcgcttcgaaagcggcg

SEQ ID NO: 90886 - DNA, 25 bp, E. coli
tgcttatggcgcatcgaaagcggcg

SEQ ID NO: 90887 - DNA, 25 bp, E. coli
gcgtgcgctgtaatgtggtttcgcc

SEQ ID NO: 90888 - DNA, 25 bp, E. coli
gcgtgcgctgtattgtggtttcgcc

SEQ ID NO: 90889 - DNA, 25 bp, E. coli
gaaagttacaggatttgatcaagcg

SEQ ID NO: 90890 - DNA, 25 bp, E. coli
gaaagttacaggttttgatcaagcg

SEQ ID NO: 90891 - DNA, 25 bp, E. coli
cgcggctttggccagcagtttaaac

SEQ ID NO: 90892 - DNA, 25 bp, E. coli
cgcggctttggcgagcagtttaaac

SEQ ID NO: 90893 - DNA, 25 bp, E. coli
gatatgcaacgcacgctgtgggtga

SEQ ID NO: 90894 - DNA, 25 bp, E. coli
gatattgtggtcgatggcggctcaa

SEQ ID NO: 90895 - DNA, 25 bp, E. coli
gatattgtggtccatggcggctcaa

SEQ ID NO: 90896 - DNA, 25 bp, E. coli
gatatgcaacgctcgctgtgggtga

SEQ ID NO: 90897 - DNA, 25 bp, E. coli
gagatcgccaactcgattttgttcc

SEQ ID NO: 90898 - DNA, 25 bp, E. coli
gagcagtttaaagtcggcattccgc

SEQ ID NO: 90899 - DNA, 25 bp, E. coli
gagatcgccaacacgattttgttcc

SEQ ID NO: 90900 - DNA, 25 bp, E. coli
gagcagtttaaactcggcattccgc

SEQ ID NO: 90901 - DNA, 25 bp, E. coli
caaaaatctttctggtggcgctcgg

SEQ ID NO: 90902 - DNA, 25 bp, E. coli
caaacggacgtggtggtagtcgcta

SEQ ID NO: 90903 - DNA, 25 bp, E. coli
caaaaatctttcaggtggcgctcgg

SEQ ID NO: 90904 - DNA, 25 bp, E. coli
caaacggacgtgctggtagtcgcta

SEQ ID NO: 90905 - DNA, 25 bp, E. coli
agaagtggttattgcgcgttgcccc

SEQ ID NO: 90906 - DNA, 25 bp, E. coli
agaagtggttatagcgcgttgcccc

SEQ ID NO: 90907 - DNA, 25 bp, E. coli
tatccatgtgatcctgcctggtgcc

SEQ ID NO: 90908 - DNA, 25 bp, E. coli
tatcatttgaagcaggccacggtat

SEQ ID NO: 90909 - DNA, 25 bp, E. coli
tatccatgtgatgctgcctggtgcc

SEQ ID NO: 90910 - DNA, 25 bp, E. coli
tatcatttgaaggaggccacggtat

SEQ ID NO: 90911 - DNA, 25 bp, E. coli
tatatcaacacctggcatggcatcc

SEQ ID NO: 90912 - DNA, 25 bp, E. coli
tatatcaacaccaggcatggcatcc

SEQ ID NO: 90913 - DNA, 25 bp, E. coli
tattattctttaggccctgctcggc

SEQ ID NO: 90914 - DNA, 25 bp, E. coli
tattattctttacgccctgctcggc

SEQ ID NO: 90915 - DNA, 25 bp, E. coli
tctggttgcgctcgaacccggctta

SEQ ID NO: 90916 - DNA, 25 bp, E. coli
tctggttgcgctggaacccggctta

SEQ ID NO: 90917 - DNA, 25 bp, E. coli
ggtgccctgccctcaattatggtcg

SEQ ID NO: 90918 - DNA, 25 bp, E. coli
ggtgccctgcccacaattatggtcg

SEQ ID NO: 90919 - DNA, 25 bp, E. coli
tggcaacgccagagaagaagtggtt

SEQ ID NO: 90920 - DNA, 25 bp, E. coli
tggcaacgccagtgaagaagtggtt

SEQ ID NO: 90921 - DNA, 25 bp, E. coli
tcagatgttgcgcaacgtgccgcat

SEQ ID NO: 90922 - DNA, 25 bp, E. coli
tcagatgttgcggaacgtgccgcat

SEQ ID NO: 90923 - DNA, 25 bp, E. coli
aacgtcatggttccttgctgcgaaa

SEQ ID NO: 90924 - DNA, 25 bp, E. coli
catagatttgacacagacgggactg

SEQ ID NO: 90925 - DNA, 25 bp, E. coli
catagatttgactcagacgggactg

SEQ ID NO: 90926 - DNA, 25 bp, E. coli
aacgtcatggttgcttgctgcgaaa

SEQ ID NO: 90927 - DNA, 25 bp, E. coli
tatggcagtctcacctcagatgacg

SEQ ID NO: 90928 - DNA, 25 bp, E. coli
tatggcagtctctcctcagatgacg

SEQ ID NO: 90929 - DNA, 25 bp, E. coli
tatcatgggaaagtggcattaccgg

SEQ ID NO: 90930 - DNA, 25 bp, E. coli
tatcatgggaaactggcattaccgg

SEQ ID NO: 90931 - DNA, 25 bp, E. coli
tattagccccatattgcgacgtcgc

SEQ ID NO: 90932 - DNA, 25 bp, E. coli
tattagccccattttgcgacgtcgc

SEQ ID NO: 90933 - DNA, 25 bp, E. coli
ttatccggaggtgaacgtcaacgca

SEQ ID NO: 90934 - DNA, 25 bp, E. coli
ttatccggaggtcaacgtcaacgca

SEQ ID NO: 90935 - DNA, 25 bp, E. coli
tgatctggagcatcgaaatccccgt

SEQ ID NO: 90936 - DNA, 25 bp, E. coli
tgatctggagcaacgaaatccccgt

SEQ ID NO: 90937 - DNA, 25 bp, E. coli
tcaacctgtggttgggagcacacct

SEQ ID NO: 90938 - DNA, 25 bp, E. coli
tcaacgcatcgcaattgcaagggcg

SEQ ID NO: 90939 - DNA, 25 bp, E. coli
tcaacgcatcgctattgcaagggcg

SEQ ID NO: 90940 - DNA, 25 bp, E. coli
tatacgccctggagattttagccca

SEQ ID NO: 90941 - DNA, 25 bp, E. coli
tatacgccctggtgattttagccca

SEQ ID NO: 90942 - DNA, 25 bp, E. coli
taaggaactgctttctgaaccggaa

SEQ ID NO: 90943 - DNA, 25 bp, E. coli
tcaacctgtggtagggagcacacct

SEQ ID NO: 90944 - DNA, 25 bp, E. coli
taaggaactgctatctgaaccggaa

SEQ ID NO: 90945 - DNA, 25 bp, E. coli
caggtttaccttgatggcgcgaaca

SEQ ID NO: 90946 - DNA, 25 bp, E. coli
caggtttaccttcatggcgcgaaca

SEQ ID NO: 90947 - DNA, 25 bp, E. coli
tacgacgccgtttgtatgcagccga

SEQ ID NO: 90948 - DNA, 25 bp, E. coli
tacgacgccgttagtatgcagccga

SEQ ID NO: 90949 - DNA, 25 bp, E. coli
tttattgaacgcgatatcggaccgg

SEQ ID NO: 90950 - DNA, 25 bp, E. coli
tttattgaacgccatatcggaccgg

SEQ ID NO: 90951 - DNA, 25 bp, E. coli
tcctgcaccatgaaactgaacgccg

SEQ ID NO: 90952 - DNA, 25 bp, E. coli
tcgaaggcatgttaacccgtcaggg

SEQ ID NO: 90953 - DNA, 25 bp, E. coli
tcgaaggcatgtaaacccgtcaggg

SEQ ID NO: 90954 - DNA, 25 bp, E. coli
tcctgcaccatgtaactgaacgccg

SEQ ID NO: 90955 - DNA, 25 bp, E. coli
tcatagcgtggtgcaaatcgaaggc

SEQ ID NO: 90956 - DNA, 25 bp, E. coli
tcatgaaagccgcaacgaagggcat

SEQ ID NO: 90957 - DNA, 25 bp, E. coli
tcatgaaagccggaacgaagggcat

SEQ ID NO: 90958 - DNA, 25 bp, E. coli
tcatagcgtggtccaaatcgaaggc

SEQ ID NO: 90959 - DNA, 25 bp, E. coli
gctgactggctggtgaaactgaccg

SEQ ID NO: 90960 - DNA, 25 bp, E. coli
gctgactggctgctgaaactgaccg

SEQ ID NO: 90961 - DNA, 25 bp, E. coli
gaaaatccgggctggtataccgcgt

SEQ ID NO: 90962 - DNA, 25 bp, E. coli
gaaaatccgggcaggtataccgcgt

SEQ ID NO: 90963 - DNA, 25 bp, E. coli
ggtgctgttaactgcgccgggtaaa

SEQ ID NO: 90964 - DNA, 25 bp, E. coli
ggtgctgttaacagcgccgggtaaa

SEQ ID NO: 90965 - DNA, 25 bp, E. coli
gatgtggtccgtactcgtgccgaaa

SEQ ID NO: 90966 - DNA, 25 bp, E. coli
gatgtggtccgttctcgtgccgaaa

SEQ ID NO: 90967 - DNA, 25 bp, E. coli
caaattggctcctatcgcagccagg

SEQ ID NO: 90968 - DNA, 25 bp, E. coli
caaattggctccaatcgcagccagg

SEQ ID NO: 90969 - DNA, 25 bp, E. coli
catgtggtgcgcttctccttctggc

SEQ ID NO: 90970 - DNA, 25 bp, E. coli
catgtggtgcgcatctccttctggc

SEQ ID NO: 90971 - DNA, 25 bp, E. coli
aaatcgccagttgccggaagtgctg

SEQ ID NO: 90972 - DNA, 25 bp, E. coli
aaatcgccagttcccggaagtgctg

SEQ ID NO: 90973 - DNA, 25 bp, E. coli
tttctcgccctgtggtggaacgcgc

SEQ ID NO: 90974 - DNA, 25 bp, E. coli
tttctcgccctgaggtggaacgcgc

SEQ ID NO: 90975 - DNA, 25 bp, E. coli
tgtggacctcgtagcgtattgcgct

SEQ ID NO: 90976 - DNA, 25 bp, E. coli
tgtggacctcgttgcgtattgcgct

SEQ ID NO: 90977 - DNA, 25 bp, E. coli
tgcgtagtgctgaccatgatgctgc

SEQ ID NO: 90978 - DNA, 25 bp, E. coli
tgagttacgactacgatcctgcccg

SEQ ID NO: 90979 - DNA, 25 bp, E. coli
tgagttacgacttcgatcctgcccg

SEQ ID NO: 90980 - DNA, 25 bp, E. coli
tgcgtagtgctgtccatgatgctgc

SEQ ID NO: 90981 - DNA, 25 bp, E. coli
tcttagcgtctatggtcgccagggc

SEQ ID NO: 90982 - DNA, 25 bp, E. coli
tcttagcgtctaaggtcgccagggc

SEQ ID NO: 90983 - DNA, 25 bp, E. coli
tggagtggaccttttcgccctacgg

SEQ ID NO: 90984 - DNA, 25 bp, E. coli
tggagtggacctattcgccctacgg

SEQ ID NO: 90985 - DNA, 25 bp, E. coli
ggtcaccgcgttaattctgctgctg

SEQ ID NO: 90986 - DNA, 25 bp, E. coli
ggtcaccgcgtttattctgctgctg

SEQ ID NO: 90987 - DNA, 25 bp, E. coli
tggaaaacccgatgcgcgatatcac

SEQ ID NO: 90988 - DNA, 25 bp, E. coli
tggaaaacccgaagcgcgatatcac

SEQ ID NO: 90989 - DNA, 25 bp, E. coli
caggcctacagattcttgcgccatt

SEQ ID NO: 90990 - DNA, 25 bp, E. coli
caggcctacagaatcttgcgccatt

SEQ ID NO: 90991 - DNA, 25 bp, E. coli
tacagattcttgcgccattcgtagg

SEQ ID NO: 90992 - DNA, 25 bp, E. coli
tacagattcttgggccattcgtagg

SEQ ID NO: 90993 - DNA, 25 bp, E. coli
aggcctacagatacttgcgccattc

SEQ ID NO: 90994 - DNA, 25 bp, E. coli
agattcttgcgccattcgtaggccg

SEQ ID NO: 90995 - DNA, 25 bp, E. coli
atccggcaatggagacaaatgcctg

SEQ ID NO: 90996 - DNA, 25 bp, E. coli
aggcctacagattcttgcgccattc

SEQ ID NO: 90997 - DNA, 25 bp, E. coli
agattcttgcgcgattcgtaggccg

SEQ ID NO: 90998 - DNA, 25 bp, E. coli
atccggcaatggtgacaaatgcctg

SEQ ID NO: 90999 - DNA, 25 bp, E. coli
tcaggcctacagtttcttgcgccat

SEQ ID NO: 91000 - DNA, 25 bp, E. coli
tcaggcctacagattcttgcgccat

SEQ ID NO: 91001 - DNA, 25 bp, E. coli
gcctacagattcttgcgccattcgt

SEQ ID NO: 91002 - DNA, 25 bp, E. coli
gcctacagattcatgcgccattcgt

SEQ ID NO: 91003 - DNA, 25 bp, E. coli
cctacagattcttgcgccattcgta

SEQ ID NO: 91004 - DNA, 25 bp, E. coli
cctacagattctagcgccattcgta

SEQ ID NO: 91005 - DNA, 25 bp, E. coli
ctacagattcttgcgccattcgtag

SEQ ID NO: 91006 - DNA, 25 bp, E. coli
ctacagattcttccgccattcgtag

SEQ ID NO: 91007 - DNA, 25 bp, E. coli
ggcaatggtgactaatgcctgatgc

SEQ ID NO: 91008 - DNA, 25 bp, E. coli
ggcaatggtgacaaatgcctgatgc

SEQ ID NO: 91009 - DNA, 25 bp, E. coli
ggcctacagattgttgcgccattcg

SEQ ID NO: 91010 - DNA, 25 bp, E. coli
ggcctacagattcttgcgccattcg

SEQ ID NO: 91011 - DNA, 25 bp, E. coli
caggattttcttgacgcagccggta

SEQ ID NO: 91012 - DNA, 25 bp, E. coli
caggattttcttcacgcagccggta

SEQ ID NO: 91013 - DNA, 25 bp, E. coli
agatgaagaagctcgcacctggcga

SEQ ID NO: 91014 - DNA, 25 bp, E. coli
agatgaagaagcacgcacctggcga

SEQ ID NO: 91015 - DNA, 25 bp, E. coli
tatttctgttaagggtgcggcggcc

SEQ ID NO: 91016 - DNA, 25 bp, E. coli
tatttctgttaacggtgcggcggcc

SEQ ID NO: 91017 - DNA, 25 bp, E. coli
tctggaatgtcaccaacggcaagcg

SEQ ID NO: 91018 - DNA, 25 bp, E. coli
tctggaatgtcagcaacggcaagcg

SEQ ID NO: 91019 - DNA, 25 bp, E. coli
gccagcttcgtttccatgccagatg

SEQ ID NO: 91020 - DNA, 25 bp, E. coli
gccagcttcgttaccatgccagatg

SEQ ID NO: 91021 - DNA, 25 bp, E. coli
gcagccggtattctcgaaaacgaag

SEQ ID NO: 91022 - DNA, 25 bp, E. coli
gcagccggtattgtcgaaaacgaag

SEQ ID NO: 91023 - DNA, 25 bp, E. coli
gaaagtgactcatgcggacctgcac

SEQ ID NO: 91024 - DNA, 25 bp, E. coli
gaaatgaaacgttccgcgaaagcga

SEQ ID NO: 91025 - DNA, 25 bp, E. coli
gaaatgaaacgtaccgcgaaagcga

SEQ ID NO: 91026 - DNA, 25 bp, E. coli
gaaagtgactcaagcggacctgcac

SEQ ID NO: 91027 - DNA, 25 bp, E. coli
cgcgaaagcgattccggtacaggtt

SEQ ID NO: 91028 - DNA, 25 bp, E. coli
cgcgaaagcgataccggtacaggtt

SEQ ID NO: 91029 - DNA, 25 bp, E. coli
gatattgtcatcatcgccagcttcg

SEQ ID NO: 91030 - DNA, 25 bp, E. coli
gatattgtcatcttcgccagcttcg

SEQ ID NO: 91031 - DNA, 25 bp, E. coli
gggcaaactccaccgcgtgaaagtg

SEQ ID NO: 91032 - DNA, 25 bp, E. coli
gggcaaactccagcgcgtgaaagtg

SEQ ID NO: 91033 - DNA, 25 bp, E. coli
caaggacaagagaacgtgatgagcc

SEQ ID NO: 91034 - DNA, 25 bp, E. coli
caaggacaagagtacgtgatgagcc

SEQ ID NO: 91035 - DNA, 25 bp, E. coli
taaagatgtcgctgaagctctggcg

SEQ ID NO: 91036 - DNA, 25 bp, E. coli
taaagatgtcgcagaagctctggcg

SEQ ID NO: 91037 - DNA, 25 bp, E. coli
tatggaaggtcagtcgatcgtcaac

SEQ ID NO: 91038 - DNA, 25 bp, E. coli
tatggaaggtcactcgatcgtcaac

SEQ ID NO: 91039 - DNA, 25 bp, E. coli
tattaggtcgtattgcctcggcaag

SEQ ID NO: 91040 - DNA, 25 bp, E. coli
tattaggtcgtaatgcctcggcaag

SEQ ID NO: 91041 - DNA, 25 bp, E. coli
tttctatcaggcgagacagcgggat

SEQ ID NO: 91042 - DNA, 25 bp, E. coli
tttctatcaggccagacagcgggat

SEQ ID NO: 91043 - DNA, 25 bp, E. coli
tgtacggtgccgcaggatcaaatgc

SEQ ID NO: 91044 - DNA, 25 bp, E. coli
tgtacggtgccggaggatcaaatgc

SEQ ID NO: 91045 - DNA, 25 bp, E. coli
tgttgatttcttgtcaccaggcgcg

SEQ ID NO: 91046 - DNA, 25 bp, E. coli
tgttgatttcttctcaccaggcgcg

SEQ ID NO: 91047 - DNA, 25 bp, E. coli
cattccgggcgaaccagtgatgtaa

SEQ ID NO: 91048 - DNA, 25 bp, E. coli
cattccgggcgatccagtgatgtaa

SEQ ID NO: 91049 - DNA, 25 bp, E. coli
ggtaacctgagttgtgcacccgcaa

SEQ ID NO: 91050 - DNA, 25 bp, E. coli
ggtaacctgagtagtgcacccgcaa

SEQ ID NO: 91051 - DNA, 25 bp, E. coli
tggcttttgatgtagcgccgcagga

SEQ ID NO: 91052 - DNA, 25 bp, E. coli
tggcttttgatgaagcgccgcagga

SEQ ID NO: 91053 - DNA, 25 bp, E. coli
gagtttgattcaccgcttccgaacg

SEQ ID NO: 91054 - DNA, 25 bp, E. coli
gagtttgattcagcgcttccgaacg

SEQ ID NO: 91055 - DNA, 25 bp, E. coli
catcctgcaatgttacgagctctgg

SEQ ID NO: 91056 - DNA, 25 bp, E. coli
catcctgcaatgatacgagctctgg

SEQ ID NO: 91057 - DNA, 25 bp, E. coli
tacccgggtggcgaacatttatgac

SEQ ID NO: 91058 - DNA, 25 bp, E. coli
tagtcgaaaaggaagccagcgcacc

SEQ ID NO: 91059 - DNA, 25 bp, E. coli
tacccgggtggccaacatttatgac

SEQ ID NO: 91060 - DNA, 25 bp, E. coli
tagtcgaaaaggtagccagcgcacc

SEQ ID NO: 91061 - DNA, 25 bp, E. coli
ttcttgatccagctgcgggcgatgc

SEQ ID NO: 91062 - DNA, 25 bp, E. coli
ttcttgatccaggtgcgggcgatgc

SEQ ID NO: 91063 - DNA, 25 bp, E. coli
tatcaggcatcaacgctggatccgg

SEQ ID NO: 91064 - DNA, 25 bp, E. coli
tatcaggcatcatcgctggatccgg

SEQ ID NO: 91065 - DNA, 25 bp, E. coli
ttgttactacctcatggcgacccgg

SEQ ID NO: 91066 - DNA, 25 bp, E. coli
ttgttactacctgatggcgacccgg

SEQ ID NO: 91067 - DNA, 25 bp, E. coli
cgttgatcgcaacaatacccgggtg

SEQ ID NO: 91068 - DNA, 25 bp, E. coli
cgttgatcgcaagaatacccgggtg

SEQ ID NO: 91069 - DNA, 25 bp, E. coli
cggtgcacaaaatgaaacggcggct

SEQ ID NO: 91070 - DNA, 25 bp, E. coli
cggtgcacaaaaagaaacggcggct

SEQ ID NO: 91071 - DNA, 25 bp, E. coli
tggcggaaccgaaaaaccttgcaga

SEQ ID NO: 91072 - DNA, 25 bp, E. coli
tggcggaaccgataaaccttgcaga

SEQ ID NO: 91073 - DNA, 25 bp, E. coli
taactatctcaatgagcgggctggc

SEQ ID NO: 91074 - DNA, 25 bp, E. coli
taactatctcaaagagcgggctggc

SEQ ID NO: 91075 - DNA, 25 bp, E. coli
gatgacgctaatgaagggccgaacg

SEQ ID NO: 91076 - DNA, 25 bp, E. coli
gatgacgctaatcaagggccgaacg

SEQ ID NO: 91077 - DNA, 25 bp, E. coli
tatctcgaacagataagcgacgcgc

SEQ ID NO: 91078 - DNA, 25 bp, E. coli
tatctcgaacagttaagcgacgcgc

SEQ ID NO: 91079 - DNA, 25 bp, E. coli
tgctcaacacgagggcaggaatgga

SEQ ID NO: 91080 - DNA, 25 bp, E. coli
tgcttgactatctggcacgcgacag

SEQ ID NO: 91081 - DNA, 25 bp, E. coli
tgactatctggcacgcgacagtaaa

SEQ ID NO: 91082 - DNA, 25 bp, E. coli
tgcttgactatcaggcacgcgacag

SEQ ID NO: 91083 - DNA, 25 bp, E. coli
tgctcaacacgacggcaggaatgga

SEQ ID NO: 91084 - DNA, 25 bp, E. coli
tgactatctggctcgcgacagtaaa

SEQ ID NO: 91085 - DNA, 25 bp, E. coli
gcgactgctcaacacgacggcagga

SEQ ID NO: 91086 - DNA, 25 bp, E. coli
gcgataacgagagtcggctggcagt

SEQ ID NO: 91087 - DNA, 25 bp, E. coli
gcgactgctcaagacgacggcagga

SEQ ID NO: 91088 - DNA, 25 bp, E. coli
gctctatctcgatcagttaagcgac

SEQ ID NO: 91089 - DNA, 25 bp, E. coli
gcgataacgagactcggctggcagt

SEQ ID NO: 91090 - DNA, 25 bp, E. coli
gctctatctcgaacagttaagcgac

SEQ ID NO: 91091 - DNA, 25 bp, E. coli
gcacagcgactggtcaacacgacgg

SEQ ID NO: 91092 - DNA, 25 bp, E. coli
gaattgcttgacaatctggcacgcg

SEQ ID NO: 91093 - DNA, 25 bp, E. coli
gaattgcttgactatctggcacgcg

SEQ ID NO: 91094 - DNA, 25 bp, E. coli
gcacagcgactgctcaacacgacgg

SEQ ID NO: 91095 - DNA, 25 bp, E. coli
gaacagttaagccacgcgcgacgct

SEQ ID NO: 91096 - DNA, 25 bp, E. coli
gaacagttaagcgacgcgcgacgct

SEQ ID NO: 91097 - DNA, 25 bp, E. coli
taagcgacgcgcgacgctttgtttc

SEQ ID NO: 91098 - DNA, 25 bp, E. coli
taagcgacgcgccacgctttgtttc

SEQ ID NO: 91099 - DNA, 25 bp, E. coli
aatgtatttcttattcgcgcaatgg

SEQ ID NO: 91100 - DNA, 25 bp, E. coli
caacgtaactgctttcgcctctgga

SEQ ID NO: 91101 - DNA, 25 bp, E. coli
aatgtatttctttttcgcgcaatgg

SEQ ID NO: 91102 - DNA, 25 bp, E. coli
caacatataagaaaaagtcacctgc

SEQ ID NO: 91103 - DNA, 25 bp, E. coli
caacgtaactgcattcgcctctgga

SEQ ID NO: 91104 - DNA, 25 bp, E. coli
caacatataagataaagtcacctgc

SEQ ID NO: 91105 - DNA, 25 bp, E. coli
cactttcacgaggactatcacggga

SEQ ID NO: 91106 - DNA, 25 bp, E. coli
cactttcacgagcactatcacggga

SEQ ID NO: 91107 - DNA, 25 bp, E. coli
catcgcatccgctgagaggctttct

SEQ ID NO: 91108 - DNA, 25 bp, E. coli
catcgcatccgcagagaggctttct

SEQ ID NO: 91109 - DNA, 25 bp, E. coli
tatcacgggattaacagtggcatcg

SEQ ID NO: 91110 - DNA, 25 bp, E. coli
tatcacgggatttacagtggcatcg

SEQ ID NO: 91111 - DNA, 25 bp, E. coli
tcgcgcaatgggtgatagaaaatcg

SEQ ID NO: 91112 - DNA, 25 bp, E. coli
tcgcgcaatgggagatagaaaatcg

SEQ ID NO: 91113 - DNA, 25 bp, E. coli
gcctctggatgctgttttcgtctgt

SEQ ID NO: 91114 - DNA, 25 bp, E. coli
gcctctggatgcagttttcgtctgt

SEQ ID NO: 91115 - DNA, 25 bp, E. coli
gaaaatcgctccaagtgataatgct

SEQ ID NO: 91116 - DNA, 25 bp, E. coli
gaaaatcgctcctagtgataatgct

SEQ ID NO: 91117 - DNA, 25 bp, E. coli
ctcgtggcagtgaaaatttcaacat

SEQ ID NO: 91118 - DNA, 25 bp, E. coli
ctcgtggcagtgtaaatttcaacat

SEQ ID NO: 91119 - DNA, 25 bp, E. coli
gattaacagtgggatcgcatccgca

SEQ ID NO: 91120 - DNA, 25 bp, E. coli
gattaacagtggcatcgcatccgca

SEQ ID NO: 91121 - DNA, 25 bp, E. coli
cacagatcgtgatagcggttttcgg

SEQ ID NO: 91122 - DNA, 25 bp, E. coli
cacagatcgtgaaagcggttttcgg

SEQ ID NO: 91123 - DNA, 25 bp, E. coli
tatccccgctgggtgatgagcgcgg

SEQ ID NO: 91124 - DNA, 25 bp, E. coli
tatccccgctggctgatgagcgcgg

SEQ ID NO: 91125 - DNA, 25 bp, E. coli
tgttgcactgaacgacgccatgctc

SEQ ID NO: 91126 - DNA, 25 bp, E. coli
tgttgcactgaaggacgccatgctc

SEQ ID NO: 91127 - DNA, 25 bp, E. coli
tccgtaatgcactgatcgtgaaagc

SEQ ID NO: 91128 - DNA, 25 bp, E. coli
tccgtaatgcacagatcgtgaaagc

SEQ ID NO: 91129 - DNA, 25 bp, E. coli
tctggggcgcaccttatccgaactg

SEQ ID NO: 91130 - DNA, 25 bp, E. coli
tctggggcgcacgttatccgaactg

SEQ ID NO: 91131 - DNA, 25 bp, E. coli
gcctgagtgcgagcgaggcgatgat

SEQ ID NO: 91132 - DNA, 25 bp, E. coli
gcctgagtgcgaccgaggcgatgat

SEQ ID NO: 91133 - DNA, 25 bp, E. coli
gcgaggatgaggataagccggaggt

SEQ ID NO: 91134 - DNA, 25 bp, E. coli
gcgaggatgaggttaagccggaggt

SEQ ID NO: 91135 - DNA, 25 bp, E. coli
cgatgatgtggaaggagttcgacag

SEQ ID NO: 91136 - DNA, 25 bp, E. coli
cgatgatgtggatggagttcgacag

SEQ ID NO: 91137 - DNA, 25 bp, E. coli
ctgaaggacgccatgctctgctggg

SEQ ID NO: 91138 - DNA, 25 bp, E. coli
ctgaaggacgccttgctctgctggg

SEQ ID NO: 91139 - DNA, 25 bp, E. coli
gggatatccgtaatgcacagatcgt

SEQ ID NO: 91140 - DNA, 25 bp, E. coli
gggatatccgtattgcacagatcgt

SEQ ID NO: 91141 - DNA, 25 bp, E. coli
gatgaatgttgcactgaaggacgcc

SEQ ID NO: 91142 - DNA, 25 bp, E. coli
gatgaatgttgctctgaaggacgcc

SEQ ID NO: 91143 - DNA, 25 bp, E. coli
atcctcggcgcggtcggaattgtcg

SEQ ID NO: 91144 - DNA, 25 bp, E. coli
atcctcggcgcgctcggaattgtcg

SEQ ID NO: 91145 - DNA, 25 bp, E. coli
aactggatcgctcgatagaagaagc

SEQ ID NO: 91146 - DNA, 25 bp, E. coli
aactggatcgctggatagaagaagc

SEQ ID NO: 91147 - DNA, 25 bp, E. coli
tggtaatgccagttgtcatcacggg

SEQ ID NO: 91148 - DNA, 25 bp, E. coli
tcgccctggcggattgtgattttgc

SEQ ID NO: 91149 - DNA, 25 bp, E. coli
tcgccctggcggtttgtgattttgc

SEQ ID NO: 91150 - DNA, 25 bp, E. coli
gaattgtcggatttatcgcctggta

SEQ ID NO: 91151 - DNA, 25 bp, E. coli
gaattgtcggatatatcgcctggta

SEQ ID NO: 91152 - DNA, 25 bp, E. coli
gaaaaacagcggttacgcgacatcc

SEQ ID NO: 91153 - DNA, 25 bp, E. coli
gaaaaacagcggatacgcgacatcc

SEQ ID NO: 91154 - DNA, 25 bp, E. coli
cgctttggcaggtttcgcggatcaa

SEQ ID NO: 91155 - DNA, 25 bp, E. coli
cgctttggcaggattcgcggatcaa

SEQ ID NO: 91156 - DNA, 25 bp, E. coli
gtgcgacgccgctgaaagtgttttt

SEQ ID NO: 91157 - DNA, 25 bp, E. coli
gggtgaatccggtaatcaacgccct

SEQ ID NO: 91158 - DNA, 25 bp, E. coli
gtgcgacgccgcagaaagtgttttt

SEQ ID NO: 91159 - DNA, 25 bp, E. coli
gggtgaatccggaaatcaacgccct

SEQ ID NO: 91160 - DNA, 25 bp, E. coli
tggtaatgccagatgtcatcacggg

SEQ ID NO: 91161 - DNA, 25 bp, E. coli
taagtctgacaaatgcggcctgtgc

SEQ ID NO: 91162 - DNA, 25 bp, E. coli
taagtctgacaattgcggcctgtgc

SEQ ID NO: 91163 - DNA, 25 bp, E. coli
gatgatctggtgttcgccagctttg

SEQ ID NO: 91164 - DNA, 25 bp, E. coli
gatgatctggtgatcgccagctttg

SEQ ID NO: 91165 - DNA, 25 bp, E. coli
aatgcgtcggttcgtgaactatctc

SEQ ID NO: 91166 - DNA, 25 bp, E. coli
aatgcgtcggttggtgaactatctc

SEQ ID NO: 91167 - DNA, 25 bp, E. coli
tatttaatgcgtgggttggtgaact

SEQ ID NO: 91168 - DNA, 25 bp, E. coli
tatttaatgcgtcggttggtgaact

SEQ ID NO: 91169 - DNA, 25 bp, E. coli
ttaatgcgtcggttggtgaactatc

SEQ ID NO: 91170 - DNA, 25 bp, E. coli
ttaatgcgtcggatggtgaactatc

SEQ ID NO: 91171 - DNA, 25 bp, E. coli
tgcgtcggttggtgaactatctcat

SEQ ID NO: 91172 - DNA, 25 bp, E. coli
tgcgtcggttggagaactatctcat

SEQ ID NO: 91173 - DNA, 25 bp, E. coli
gcaattatggacctaatctacgtgt

SEQ ID NO: 91174 - DNA, 25 bp, E. coli
gcaattatggacgtaatctacgtgt

SEQ ID NO: 91175 - DNA, 25 bp, E. coli
cggttggtgaacaatctcattaata

SEQ ID NO: 91176 - DNA, 25 bp, E. coli
cgtcggttggtgtactatctcatta

SEQ ID NO: 91177 - DNA, 25 bp, E. coli
cggttggtgaactatctcattaata

SEQ ID NO: 91178 - DNA, 25 bp, E. coli
cgtcggttggtgaactatctcatta

SEQ ID NO: 91179 - DNA, 25 bp, E. coli
gtgaactatctctttaatattcgcg

SEQ ID NO: 91180 - DNA, 25 bp, E. coli
gggactattagctattatggaccta

SEQ ID NO: 91181 - DNA, 25 bp, E. coli
gtgaactatctcattaatattcgcg

SEQ ID NO: 91182 - DNA, 25 bp, E. coli
gggactattagcaattatggaccta

SEQ ID NO: 91183 - DNA, 25 bp, E. coli
tggacctaatctacgtgttttattt

SEQ ID NO: 91184 - DNA, 25 bp, E. coli
tggacctaatcttcgtgttttattt

SEQ ID NO: 91185 - DNA, 25 bp, E. coli
tatggacctaatctacgtgttttat

SEQ ID NO: 91186 - DNA, 25 bp, E. coli
tatggacctaatgtacgtgttttat

SEQ ID NO: 91187 - DNA, 25 bp, E. coli
aatggcgcaagattctgtaggcctg

SEQ ID NO: 91188 - DNA, 25 bp, E. coli
aatggcgcaagaatctgtaggcctg

SEQ ID NO: 91189 - DNA, 25 bp, E. coli
caggcatttgtctccattgccggat

SEQ ID NO: 91190 - DNA, 25 bp, E. coli
caggcatttgtcaccattgccggat

SEQ ID NO: 91191 - DNA, 25 bp, E. coli
acgaatggcgcaagaatctgtaggc

SEQ ID NO: 91192 - DNA, 25 bp, E. coli
atggcgcaagaatctgtaggcctga

SEQ ID NO: 91193 - DNA, 25 bp, E. coli
atggcgcaagaaactgtaggcctga

SEQ ID NO: 91194 - DNA, 25 bp, E. coli
acgaatggcgcatgaatctgtaggc

SEQ ID NO: 91195 - DNA, 25 bp, E. coli
tacgaatggcgcaagaatctgtagg

SEQ ID NO: 91196 - DNA, 25 bp, E. coli
tacgaatggcgctagaatctgtagg

SEQ ID NO: 91197 - DNA, 25 bp, E. coli
gaatggcgcaagtatctgtaggcct

SEQ ID NO: 91198 - DNA, 25 bp, E. coli
gaatggcgcaagaatctgtaggcct

SEQ ID NO: 91199 - DNA, 25 bp, E. coli
gcatcaggcatttgtcaccattgcc

SEQ ID NO: 91200 - DNA, 25 bp, E. coli
gcatcaggcattagtcaccattgcc

SEQ ID NO: 91201 - DNA, 25 bp, E. coli
cgaatggcgcaagaatctgtaggcc

SEQ ID NO: 91202 - DNA, 25 bp, E. coli
cgaatggcgcaacaatctgtaggcc

SEQ ID NO: 91203 - DNA, 25 bp, E. coli
ctacgaatggcggaagaatctgtag

SEQ ID NO: 91204 - DNA, 25 bp, E. coli
cggcctacgaatggcgcaagaatct

SEQ ID NO: 91205 - DNA, 25 bp, E. coli
ctacgaatggcgcaagaatctgtag

SEQ ID NO: 91206 - DNA, 25 bp, E. coli
cggcctacgaatcgcgcaagaatct

SEQ ID NO: 91207 - DNA, 25 bp, E. coli
ggcctacgaatgccgcaagaatctg

SEQ ID NO: 91208 - DNA, 25 bp, E. coli
ggcctacgaatggcgcaagaatctg

SEQ ID NO: 91209 - DNA, 25 bp, E. coli
ataaaggtaaacacatatccaattg

SEQ ID NO: 91210 - DNA, 25 bp, E. coli
aggtaaacacatttccaattgattt

SEQ ID NO: 91211 - DNA, 25 bp, E. coli
aggtaaacacatatccaattgattt

SEQ ID NO: 91212 - DNA, 25 bp, E. coli
ataaaggtaaactcatatccaattg

SEQ ID NO: 91213 - DNA, 25 bp, E. coli
aaataaaggtaaacacatatccaat

SEQ ID NO: 91214 - DNA, 25 bp, E. coli
aaaggtaaacacatatccaattgat

SEQ ID NO: 91215 - DNA, 25 bp, E. coli
acacatatccaattgatttaattaa

SEQ ID NO: 91216 - DNA, 25 bp, E. coli
aaggtaaacacaaatccaattgatt

SEQ ID NO: 91217 - DNA, 25 bp, E. coli
aaataaaggtaatcacatatccaat

SEQ ID NO: 91218 - DNA, 25 bp, E. coli
aaggtaaacacatatccaattgatt

SEQ ID NO: 91219 - DNA, 25 bp, E. coli
aaaggtaaacacttatccaattgat

SEQ ID NO: 91220 - DNA, 25 bp, E. coli
acacatatccaaatgatttaattaa

SEQ ID NO: 91221 - DNA, 25 bp, E. coli
tgaaaataaaggaaaacacatatcc

SEQ ID NO: 91222 - DNA, 25 bp, E. coli
tgaaaataaaggtaaacacatatcc

SEQ ID NO: 91223 - DNA, 25 bp, E. coli
gaaaataaaggtaaacacatatcca

SEQ ID NO: 91224 - DNA, 25 bp, E. coli
gaaaataaaggttaacacatatcca

SEQ ID NO: 91225 - DNA, 25 bp, E. coli
gtaaacacatatccaattgatttaa

SEQ ID NO: 91226 - DNA, 25 bp, E. coli
gtaaacacatatgcaattgatttaa

SEQ ID NO: 91227 - DNA, 25 bp, E. coli
ggtaaacacatatccaattgattta

SEQ ID NO: 91228 - DNA, 25 bp, E. coli
ggtaaacacataaccaattgattta

SEQ ID NO: 91229 - DNA, 25 bp, E. coli
taaaggtaaacagatatccaattga

SEQ ID NO: 91230 - DNA, 25 bp, E. coli
taaaggtaaacacatatccaattga

SEQ ID NO: 91231 - DNA, 25 bp, E. coli
aactggaagacaacgaagcatcggc

SEQ ID NO: 91232 - DNA, 25 bp, E. coli
caatctgaacttcgccagagcctgg

SEQ ID NO: 91233 - DNA, 25 bp, E. coli
caatctgaacttggccagagcctgg

SEQ ID NO: 91234 - DNA, 25 bp, E. coli
aactggaagacatcgaagcatcggc

SEQ ID NO: 91235 - DNA, 25 bp, E. coli
tttgaagatgcgcaagatcacgccg

SEQ ID NO: 91236 - DNA, 25 bp, E. coli
tttgaagatgcggaagatcacgccg

SEQ ID NO: 91237 - DNA, 25 bp, E. coli
tgtgtctgatggttacccagcgcgc

SEQ ID NO: 91238 - DNA, 25 bp, E. coli
tgtatcgtatgcgtgcccgtagcca

SEQ ID NO: 91239 - DNA, 25 bp, E. coli
tgtgtctgatggatacccagcgcgc

SEQ ID NO: 91240 - DNA, 25 bp, E. coli
tgtatcgtatgcctgcccgtagcca

SEQ ID NO: 91241 - DNA, 25 bp, E. coli
tgctgccgcataacgaatccctgtt

SEQ ID NO: 91242 - DNA, 25 bp, E. coli
tgctgccgcatatcgaatccctgtt

SEQ ID NO: 91243 - DNA, 25 bp, E. coli
gaaaataaccgagtgacccggctgg

SEQ ID NO: 91244 - DNA, 25 bp, E. coli
gaaaataaccgactgacccggctgg

SEQ ID NO: 91245 - DNA, 25 bp, E. coli
gatcacgccggtaactccactgtgg

SEQ ID NO: 91246 - DNA, 25 bp, E. coli
gatcacgccggttactccactgtgg

SEQ ID NO: 91247 - DNA, 25 bp, E. coli
ggattgatcttgtcgaaccggacga

SEQ ID NO: 91248 - DNA, 25 bp, E. coli
ggattgatcttgacgaaccggacga

SEQ ID NO: 91249 - DNA, 25 bp, E. coli
tggaagtcgaagtgtcacaacccct

SEQ ID NO: 91250 - DNA, 25 bp, E. coli
tggaagtcgaagagtcacaacccct

SEQ ID NO: 91251 - DNA, 25 bp, E. coli
gagcgactgcgcgtacaatctgaac

SEQ ID NO: 91252 - DNA, 25 bp, E. coli
gagcgactgcgcctacaatctgaac

SEQ ID NO: 91253 - DNA, 25 bp, E. coli
cagtcgaaatcatgactttccagtt

SEQ ID NO: 91254 - DNA, 25 bp, E. coli
cagtcgaaatcaagactttccagtt

SEQ ID NO: 91255 - DNA, 25 bp, E. coli
catgactttccagtttggatgatgt

SEQ ID NO: 91256 - DNA, 25 bp, E. coli
catgactttccactttggatgatgt

SEQ ID NO: 91257 - DNA, 25 bp, E. coli
aaatcatgactttccagtttggatg

SEQ ID NO: 91258 - DNA, 25 bp, E. coli
actttccagtttggatgatgttgta

SEQ ID NO: 91259 - DNA, 25 bp, E. coli
actttccagtttcgatgatgttgta

SEQ ID NO: 91260 - DNA, 25 bp, E. coli
aaatcatgacttaccagtttggatg

SEQ ID NO: 91261 - DNA, 25 bp, E. coli
ttcgacgaaagcagtccggctaacc

SEQ ID NO: 91262 - DNA, 25 bp, E. coli
ttcgacgaaagctgtccggctaacc

SEQ ID NO: 91263 - DNA, 25 bp, E. coli
tggtcagtcgaattcatgactttcc

SEQ ID NO: 91264 - DNA, 25 bp, E. coli
tgttcgacgaaagctgtccggctaa

SEQ ID NO: 91265 - DNA, 25 bp, E. coli
tggtcagtcgaaatcatgactttcc

SEQ ID NO: 91266 - DNA, 25 bp, E. coli
tgttcgacgaaacctgtccggctaa

SEQ ID NO: 91267 - DNA, 25 bp, E. coli
gacgaaagctgtccggctaaccgct

SEQ ID NO: 91268 - DNA, 25 bp, E. coli
gaaagctgtccgcctaaccgctttt

SEQ ID NO: 91269 - DNA, 25 bp, E. coli
gaaagctgtccggctaaccgctttt

SEQ ID NO: 91270 - DNA, 25 bp, E. coli
gacgaaagctgtgcggctaaccgct

SEQ ID NO: 91271 - DNA, 25 bp, E. coli
cgaaatcatgacattccagtttgga

SEQ ID NO: 91272 - DNA, 25 bp, E. coli
cgaaatcatgactttccagtttgga

SEQ ID NO: 91273 - DNA, 25 bp, E. coli
gtcagtcgaaatcatgactttccag

SEQ ID NO: 91274 - DNA, 25 bp, E. coli
gtcagtcgaaatgatgactttccag

SEQ ID NO: 91275 - DNA, 25 bp, E. coli
cacacgtatcggcacatattccggg

SEQ ID NO: 91276 - DNA, 25 bp, E. coli
cacacgtatcgggacatattccggg

SEQ ID NO: 91277 - DNA, 25 bp, E. coli
catttcgtatacacagactggacgg

SEQ ID NO: 91278 - DNA, 25 bp, E. coli
taacaacacacaggtatcggcacat

SEQ ID NO: 91279 - DNA, 25 bp, E. coli
taacaacacacacgtatcggcacat

SEQ ID NO: 91280 - DNA, 25 bp, E. coli
atatgggatacgaggaggcataacc

SEQ ID NO: 91281 - DNA, 25 bp, E. coli
atatgggatacgtggaggcataacc

SEQ ID NO: 91282 - DNA, 25 bp, E. coli
tatacacagactggacggaagcgac

SEQ ID NO: 91283 - DNA, 25 bp, E. coli
tatacacagactcgacggaagcgac

SEQ ID NO: 91284 - DNA, 25 bp, E. coli
tgtgtaacaacacacacgtatcggc

SEQ ID NO: 91285 - DNA, 25 bp, E. coli
tgtgtaacaacagacacgtatcggc

SEQ ID NO: 91286 - DNA, 25 bp, E. coli
gactggacggaaccgacaatctcac

SEQ ID NO: 91287 - DNA, 25 bp, E. coli
gactggacggaagcgacaatctcac

SEQ ID NO: 91288 - DNA, 25 bp, E. coli
gaagcgacaatcacactttgtgtaa

SEQ ID NO: 91289 - DNA, 25 bp, E. coli
gaagcgacaatctcactttgtgtaa

SEQ ID NO: 91290 - DNA, 25 bp, E. coli
gacaatctcactatgtgtaacaaca

SEQ ID NO: 91291 - DNA, 25 bp, E. coli
gacaatctcactttgtgtaacaaca

SEQ ID NO: 91292 - DNA, 25 bp, E. coli
catttcgtatactcagactggacgg

SEQ ID NO: 91293 - DNA, 25 bp, E. coli
ggacttccgatccatttcgtataca

SEQ ID NO: 91294 - DNA, 25 bp, E. coli
ggacggaagcgacaatctcactttg

SEQ ID NO: 91295 - DNA, 25 bp, E. coli
ggacttccgatcgatttcgtataca

SEQ ID NO: 91296 - DNA, 25 bp, E. coli
ggacggaagcgagaatctcactttg

SEQ ID NO: 91297 - DNA, 25 bp, E. coli
aattagaggaatgtatgcgagggaa

SEQ ID NO: 91298 - DNA, 25 bp, E. coli
aattagaggaatctatgcgagggaa

SEQ ID NO: 91299 - DNA, 25 bp, E. coli
tagaggaatctatgcgagggaaaaa

SEQ ID NO: 91300 - DNA, 25 bp, E. coli
tagaggaatctaagcgagggaaaaa

SEQ ID NO: 91301 - DNA, 25 bp, E. coli
attagaggaatctatgcgagggaaa

SEQ ID NO: 91302 - DNA, 25 bp, E. coli
attagaggaatcaatgcgagggaaa

SEQ ID NO: 91303 - DNA, 25 bp, E. coli
gtatcggtgtccaggaatttaatta

SEQ ID NO: 91304 - DNA, 25 bp, E. coli
agaggaatctatgcgagggaaaaaa

SEQ ID NO: 91305 - DNA, 25 bp, E. coli
atggtatcggtgacctggaatttaa

SEQ ID NO: 91306 - DNA, 25 bp, E. coli
gtatcggtgtcctggaatttaatta

SEQ ID NO: 91307 - DNA, 25 bp, E. coli
atggtatcggtgtcctggaatttaa

SEQ ID NO: 91308 - DNA, 25 bp, E. coli
agaggaatctatccgagggaaaaaa

SEQ ID NO: 91309 - DNA, 25 bp, E. coli
ttagaggaatctttgcgagggaaaa

SEQ ID NO: 91310 - DNA, 25 bp, E. coli
ttagaggaatctatgcgagggaaaa

SEQ ID NO: 91311 - DNA, 25 bp, E. coli
tatcggtgtcctcgaatttaattag

SEQ ID NO: 91312 - DNA, 25 bp, E. coli
tatcggtgtcctggaatttaattag

SEQ ID NO: 91313 - DNA, 25 bp, E. coli
ggtatcggtgtcctggaatttaatt

SEQ ID NO: 91314 - DNA, 25 bp, E. coli
ggtatcggtgtcgtggaatttaatt

SEQ ID NO: 91315 - DNA, 25 bp, E. coli
tggtatcggtgtcctggaatttaat

SEQ ID NO: 91316 - DNA, 25 bp, E. coli
tggtatcggtgtgctggaatttaat

SEQ ID NO: 91317 - DNA, 25 bp, E. coli
taattagaggaaactatgcgaggga

SEQ ID NO: 91318 - DNA, 25 bp, E. coli
taattagaggaatctatgcgaggga

SEQ ID NO: 91319 - DNA, 25 bp, E. coli
aatgaatatttacccactcatccgg

SEQ ID NO: 91320 - DNA, 25 bp, E. coli
aatgaatatttagccactcatccgg

SEQ ID NO: 91321 - DNA, 25 bp, E. coli
agtgatctttgctctggatgaccag

SEQ ID NO: 91322 - DNA, 25 bp, E. coli
agtgatctttgcactggatgaccag

SEQ ID NO: 91323 - DNA, 25 bp, E. coli
aatagacccggtccttaaggagttg

SEQ ID NO: 91324 - DNA, 25 bp, E. coli
actcatccggtaatgattgagcgcg

SEQ ID NO: 91325 - DNA, 25 bp, E. coli
actcatccggtattgattgagcgcg

SEQ ID NO: 91326 - DNA, 25 bp, E. coli
aatagacccggtgcttaaggagttg

SEQ ID NO: 91327 - DNA, 25 bp, E. coli
tattcggtaatatcccgtgcccgac

SEQ ID NO: 91328 - DNA, 25 bp, E. coli
tattcggtaataacccgtgcccgac

SEQ ID NO: 91329 - DNA, 25 bp, E. coli
gcctttgcctttttctctgacagag

SEQ ID NO: 91330 - DNA, 25 bp, E. coli
gcctttgcctttatctctgacagag

SEQ ID NO: 91331 - DNA, 25 bp, E. coli
cgtgcccgacgtaatgctggaatgg

SEQ ID NO: 91332 - DNA, 25 bp, E. coli
cgtgcccgacgttatgctggaatgg

SEQ ID NO: 91333 - DNA, 25 bp, E. coli
gataccggaaccagaaatagacccg

SEQ ID NO: 91334 - DNA, 25 bp, E. coli
gattgagcgcgaagaatttgaagca

SEQ ID NO: 91335 - DNA, 25 bp, E. coli
gataccggaacctgaaatagacccg

SEQ ID NO: 91336 - DNA, 25 bp, E. coli
gattgagcgcgatgaatttgaagca

SEQ ID NO: 91337 - DNA, 25 bp, E. coli
ggagttgttgtacgcctattcggta

SEQ ID NO: 91338 - DNA, 25 bp, E. coli
ggagttgttgtaggcctattcggta

SEQ ID NO: 91339 - DNA, 25 bp, E. coli
gaccagtattttgaggagcagtgtg

SEQ ID NO: 91340 - DNA, 25 bp, E. coli
gaccagtattttcaggagcagtgtg

SEQ ID NO: 91341 - DNA, 25 bp, E. coli
caggtgcattacacgatgtcacggt

SEQ ID NO: 91342 - DNA, 25 bp, E. coli
caggtgcattactcgatgtcacggt

SEQ ID NO: 91343 - DNA, 25 bp, E. coli
catattaattgtgtggtctggcctc

SEQ ID NO: 91344 - DNA, 25 bp, E. coli
catattaattgtctggtctggcctc

SEQ ID NO: 91345 - DNA, 25 bp, E. coli
taaactatgcggctttacggtcagt

SEQ ID NO: 91346 - DNA, 25 bp, E. coli
tatgcgggtttacggtcagtaccca

SEQ ID NO: 91347 - DNA, 25 bp, E. coli
tatgcgggtttagggtcagtaccca

SEQ ID NO: 91348 - DNA, 25 bp, E. coli
tgtggtctggcctcaatttattgac

SEQ ID NO: 91349 - DNA, 25 bp, E. coli
tgtggtctggccacaatttattgac

SEQ ID NO: 91350 - DNA, 25 bp, E. coli
gcctcaatttatagacgaagaggat

SEQ ID NO: 91351 - DNA, 25 bp, E. coli
gcctcaatttattgacgaagaggat

SEQ ID NO: 91352 - DNA, 25 bp, E. coli
cgaagaggattaagtatctcatggc

SEQ ID NO: 91353 - DNA, 25 bp, E. coli
cgaagaggattatgtatctcatggc

SEQ ID NO: 91354 - DNA, 25 bp, E. coli
cggtcagtacccatattaattgtgt

SEQ ID NO: 91355 - DNA, 25 bp, E. coli
cggtcagtacccttattaattgtgt

SEQ ID NO: 91356 - DNA, 25 bp, E. coli
cattatcacgcccacaggtgcatta

SEQ ID NO: 91357 - DNA, 25 bp, E. coli
cattatcacgccgacaggtgcatta

SEQ ID NO: 91358 - DNA, 25 bp, E. coli
taaactatgcgggtttacggtcagt

SEQ ID NO: 91359 - DNA, 25 bp, E. coli
taagtatctcatcgctgaatggagc

SEQ ID NO: 91360 - DNA, 25 bp, E. coli
taagtatctcatggctgaatggagc

SEQ ID NO: 91361 - DNA, 25 bp, E. coli
gatgtcacggtaacgcctgtacggt

SEQ ID NO: 91362 - DNA, 25 bp, E. coli
gatgtcacggtatcgcctgtacggt

SEQ ID NO: 91363 - DNA, 25 bp, E. coli
tacttaaggattcggaggagtctga

SEQ ID NO: 91364 - DNA, 25 bp, E. coli
tacttaaggattgggaggagtctga

SEQ ID NO: 91365 - DNA, 25 bp, E. coli
atacaacgcggctgccgatcgcgct

SEQ ID NO: 91366 - DNA, 25 bp, E. coli
atacaacgcggcagccgatcgcgct

SEQ ID NO: 91367 - DNA, 25 bp, E. coli
tatcagacagaagatgaaaagcgcg

SEQ ID NO: 91368 - DNA, 25 bp, E. coli
tatcagacagaacatgaaaagcgcg

SEQ ID NO: 91369 - DNA, 25 bp, E. coli
tcctcaagggcggatgaggcgttta

SEQ ID NO: 91370 - DNA, 25 bp, E. coli
tcctcaagggcgcatgaggcgttta

SEQ ID NO: 91371 - DNA, 25 bp, E. coli
tgccacatccgccagtgtacgtcga

SEQ ID NO: 91372 - DNA, 25 bp, E. coli
tgccaatcatgctagcgaaggagaa

SEQ ID NO: 91373 - DNA, 25 bp, E. coli
tgccacatccgcgagtgtacgtcga

SEQ ID NO: 91374 - DNA, 25 bp, E. coli
tgccaatcatgcaagcgaaggagaa

SEQ ID NO: 91375 - DNA, 25 bp, E. coli
cgaaggagaaaaccagctatcagac

SEQ ID NO: 91376 - DNA, 25 bp, E. coli
cgatcgcgctgtacctcaagggcgg

SEQ ID NO: 91377 - DNA, 25 bp, E. coli
cgatcgcgctgttcctcaagggcgg

SEQ ID NO: 91378 - DNA, 25 bp, E. coli
cgcgggaatggctggaaatacttaa

SEQ ID NO: 91379 - DNA, 25 bp, E. coli
cgaaggagaaaagcagctatcagac

SEQ ID NO: 91380 - DNA, 25 bp, E. coli
cgcgggaatggcaggaaatacttaa

SEQ ID NO: 91381 - DNA, 25 bp, E. coli
ggagtctgaaagcatgcctgataca

SEQ ID NO: 91382 - DNA, 25 bp, E. coli
ggagtctgaaaggatgcctgataca

SEQ ID NO: 91383 - DNA, 25 bp, E. coli
gatgaggcgtttttgccacatccgc

SEQ ID NO: 91384 - DNA, 25 bp, E. coli
gatgaggcgtttatgccacatccgc

SEQ ID NO: 91385 - DNA, 25 bp, E. coli
aatcctgagaaaagcaaacaatggg

SEQ ID NO: 91386 - DNA, 25 bp, E. coli
aatcctgagaaatgcaaacaatggg

SEQ ID NO: 91387 - DNA, 25 bp, E. coli
caaatcttgggctactgtacggctc

SEQ ID NO: 91388 - DNA, 25 bp, E. coli
caaatcttgggcaactgtacggctc

SEQ ID NO: 91389 - DNA, 25 bp, E. coli
caggacgcagcgacgataattctca

SEQ ID NO: 91390 - DNA, 25 bp, E. coli
cagcactgtgcttgcgccaactact

SEQ ID NO: 91391 - DNA, 25 bp, E. coli
cagcactgtgctagcgccaactact

SEQ ID NO: 91392 - DNA, 25 bp, E. coli
caggacgcagcgtcgataattctca

SEQ ID NO: 91393 - DNA, 25 bp, E. coli
tgtacggctcctacggtaatccgaa

SEQ ID NO: 91394 - DNA, 25 bp, E. coli
tgtacggctccttcggtaatccgaa

SEQ ID NO: 91395 - DNA, 25 bp, E. coli
tgatcttagtcacttccctattgcg

SEQ ID NO: 91396 - DNA, 25 bp, E. coli
tgatcttagtcagttccctattgcg

SEQ ID NO: 91397 - DNA, 25 bp, E. coli
tgcggcatccttcttctattgtgga

SEQ ID NO: 91398 - DNA, 25 bp, E. coli
tgcggcatccttgttctattgtgga

SEQ ID NO: 91399 - DNA, 25 bp, E. coli
tgacgcatattattctcccggcttg

SEQ ID NO: 91400 - DNA, 25 bp, E. coli
tgacgcatattaatctcccggcttg

SEQ ID NO: 91401 - DNA, 25 bp, E. coli
gccaactactgtagtgacgcgtcag

SEQ ID NO: 91402 - DNA, 25 bp, E. coli
gccaactactgttgtgacgcgtcag

SEQ ID NO: 91403 - DNA, 25 bp, E. coli
ggtaatccgaatgtgaatcctgaga

SEQ ID NO: 91404 - DNA, 25 bp, E. coli
ggtaatccgaatctgaatcctgaga

SEQ ID NO: 91405 - DNA, 25 bp, E. coli
ggcttgccactgctcgatacccgta

SEQ ID NO: 91406 - DNA, 25 bp, E. coli
ggcttgccactggtcgatacccgta

SEQ ID NO: 91407 - DNA, 25 bp, E. coli
taaagctgcttcagaagtagaaggt

SEQ ID NO: 91408 - DNA, 25 bp, E. coli
taaatcagaatcaagaagagctcat

SEQ ID NO: 91409 - DNA, 25 bp, E. coli
taaagctgcttctgaagtagaaggt

SEQ ID NO: 91410 - DNA, 25 bp, E. coli
taaatcagaatctagaagagctcat

SEQ ID NO: 91411 - DNA, 25 bp, E. coli
taaagctccggataatacaattgca

SEQ ID NO: 91412 - DNA, 25 bp, E. coli
taaagctccggaaaatacaattgca

SEQ ID NO: 91413 - DNA, 25 bp, E. coli
tagaggattacctagtaaagctccg

SEQ ID NO: 91414 - DNA, 25 bp, E. coli
tagaacggactacaaatatgtccgg

SEQ ID NO: 91415 - DNA, 25 bp, E. coli
tagaacggactagaaatatgtccgg

SEQ ID NO: 91416 - DNA, 25 bp, E. coli
tagaggattaccaagtaaagctccg

SEQ ID NO: 91417 - DNA, 25 bp, E. coli
tattactggaccgaatggactagca

SEQ ID NO: 91418 - DNA, 25 bp, E. coli
tattactggacccaatggactagca

SEQ ID NO: 91419 - DNA, 25 bp, E. coli
tgaaattaaagatgcttctgcagga

SEQ ID NO: 91420 - DNA, 25 bp, E. coli
tgaaattaaagaagcttctgcagga

SEQ ID NO: 91421 - DNA, 25 bp, E. coli
tctaaaagtatgcttaagcaagtgg

SEQ ID NO: 91422 - DNA, 25 bp, E. coli
tctgcaggatcttggtttggtgaaa

SEQ ID NO: 91423 - DNA, 25 bp, E. coli
tctaaaagtatggttaagcaagtgg

SEQ ID NO: 91424 - DNA, 25 bp, E. coli
tctgcaggatctaggtttggtgaaa

SEQ ID NO: 91425 - DNA, 25 bp, E. coli
gctaactgtataaggacatagagga

SEQ ID NO: 91426 - DNA, 25 bp, E. coli
gctaactgtatatggacatagagga

SEQ ID NO: 91427 - DNA, 25 bp, E. coli
gaacatttgccatctttcgatgatg

SEQ ID NO: 91428 - DNA, 25 bp, E. coli
gaacatttgccaactttcgatgatg

SEQ ID NO: 91429 - DNA, 25 bp, E. coli
aagaagcagtctggcgtgaaagccg

SEQ ID NO: 91430 - DNA, 25 bp, E. coli
aagaagcagtctcgcgtgaaagccg

SEQ ID NO: 91431 - DNA, 25 bp, E. coli
tacgtttaagcgaaagccggagcgt

SEQ ID NO: 91432 - DNA, 25 bp, E. coli
taaaattgaacatgctcctggccag

SEQ ID NO: 91433 - DNA, 25 bp, E. coli
tacgtttaagcgtaagccggagcgt

SEQ ID NO: 91434 - DNA, 25 bp, E. coli
taaaattgaacaagctcctggccag

SEQ ID NO: 91435 - DNA, 25 bp, E. coli
tgagcagcgtgataagccaacctgg

SEQ ID NO: 91436 - DNA, 25 bp, E. coli
tgaaaacctgttggctctgctggaa

SEQ ID NO: 91437 - DNA, 25 bp, E. coli
tgaaaacctgttcgctctgctggaa

SEQ ID NO: 91438 - DNA, 25 bp, E. coli
tgagcagcgtgaaaagccaacctgg

SEQ ID NO: 91439 - DNA, 25 bp, E. coli
tgcggacattaaggaacacctgatc

SEQ ID NO: 91440 - DNA, 25 bp, E. coli
tgcgtgaaaagcaaaaagttcgccg

SEQ ID NO: 91441 - DNA, 25 bp, E. coli
tgcgtgaaaagctaaaagttcgccg

SEQ ID NO: 91442 - DNA, 25 bp, E. coli
tgcggacattaacgaacacctgatc

SEQ ID NO: 91443 - DNA, 25 bp, E. coli
cgtctgaaaggcaacaccggtgaaa

SEQ ID NO: 91444 - DNA, 25 bp, E. coli
cgtctgaaaggctacaccggtgaaa

SEQ ID NO: 91445 - DNA, 25 bp, E. coli
tcaagctgagccctcgtgagggcac

SEQ ID NO: 91446 - DNA, 25 bp, E. coli
tattccttaagtgtggcgttcgcgc

SEQ ID NO: 91447 - DNA, 25 bp, E. coli
tattccttaagtctggcgttcgcgc

SEQ ID NO: 91448 - DNA, 25 bp, E. coli
tcaagctgagccgtcgtgagggcac

SEQ ID NO: 91449 - DNA, 25 bp, E. coli
gagcgttctgatgtgtctgcggaca

SEQ ID NO: 91450 - DNA, 25 bp, E. coli
gagcgttctgatctgtctgcggaca

SEQ ID NO: 91451 - DNA, 25 bp, E. coli
caggagagcaaatcgatgaaaaacc

SEQ ID NO: 91452 - DNA, 25 bp, E. coli
caggagagcaaaacgatgaaaaacc

SEQ ID NO: 91453 - DNA, 25 bp, E. coli
aaagaacatcatgccgacaccaaag

SEQ ID NO: 91454 - DNA, 25 bp, E. coli
aaagcgccgccataccggtattgca

SEQ ID NO: 91455 - DNA, 25 bp, E. coli
aaagcgccgccaaaccggtattgca

SEQ ID NO: 91456 - DNA, 25 bp, E. coli
aaagaacatcatcccgacaccaaag

SEQ ID NO: 91457 - DNA, 25 bp, E. coli
tatccgactcgtttttgggcttctg

SEQ ID NO: 91458 - DNA, 25 bp, E. coli
tatccgactcgtatttgggcttctg

SEQ ID NO: 91459 - DNA, 25 bp, E. coli
ttagttcgtagaaacgctcctggcg

SEQ ID NO: 91460 - DNA, 25 bp, E. coli
ttagttcgtagatacgctcctggcg

SEQ ID NO: 91461 - DNA, 25 bp, E. coli
tgtggcatgtatgggcttgttaccg

SEQ ID NO: 91462 - DNA, 25 bp, E. coli
tgtggcatgtatcggcttgttaccg

SEQ ID NO: 91463 - DNA, 25 bp, E. coli
tgagactcagcaaccgacggatggg

SEQ ID NO: 91464 - DNA, 25 bp, E. coli
tgagactcagcatccgacggatggg

SEQ ID NO: 91465 - DNA, 25 bp, E. coli
tctggcagtgggagagactcagcaa

SEQ ID NO: 91466 - DNA, 25 bp, E. coli
tctggcagtgggtgagactcagcaa

SEQ ID NO: 91467 - DNA, 25 bp, E. coli
gcacgacgagcaccaaagagatgca

SEQ ID NO: 91468 - DNA, 25 bp, E. coli
gcacgacgagcagcaaagagatgca

SEQ ID NO: 91469 - DNA, 25 bp, E. coli
gaaaaaccgtaatgcaaagattctg

SEQ ID NO: 91470 - DNA, 25 bp, E. coli
gaaaaaccgtaaagcaaagattctg

SEQ ID NO: 91471 - DNA, 25 bp, E. coli
gggcttctgcgctaattgcaaagaa

SEQ ID NO: 91472 - DNA, 25 bp, E. coli
gggcttctgcgcaaattgcaaagaa

SEQ ID NO: 91473 - DNA, 25 bp, E. coli
cagctttggccaatttatggaggca

SEQ ID NO: 91474 - DNA, 25 bp, E. coli
cagctttggccattttatggaggca

SEQ ID NO: 91475 - DNA, 25 bp, E. coli
tattgctgaatatgagatttaatga

SEQ ID NO: 91476 - DNA, 25 bp, E. coli
tatggaggcaatacggactttgaac

SEQ ID NO: 91477 - DNA, 25 bp, E. coli
tattgctgaataagagatttaatga

SEQ ID NO: 91478 - DNA, 25 bp, E. coli
tatggaggcaattcggactttgaac

SEQ ID NO: 91479 - DNA, 25 bp, E. coli
tgggtatggctatccagatatatat

SEQ ID NO: 91480 - DNA, 25 bp, E. coli
tgggtatggctaaccagatatatat

SEQ ID NO: 91481 - DNA, 25 bp, E. coli
tgattcagctttcgccattttatgg

SEQ ID NO: 91482 - DNA, 25 bp, E. coli
tgattcagctttggccattttatgg

SEQ ID NO: 91483 - DNA, 25 bp, E. coli
ccattttatggacgcaatacggact

SEQ ID NO: 91484 - DNA, 25 bp, E. coli
ccattttatggaggcaatacggact

SEQ ID NO: 91485 - DNA, 25 bp, E. coli
gcaatacggactttgaacagttggg

SEQ ID NO: 91486 - DNA, 25 bp, E. coli
gcaatacggactatgaacagttggg

SEQ ID NO: 91487 - DNA, 25 bp, E. coli
gaacagttgggtatggctatccaga

SEQ ID NO: 91488 - DNA, 25 bp, E. coli
gaacagttgggtttggctatccaga

SEQ ID NO: 91489 - DNA, 25 bp, E. coli
ctttgaacagttgggtatggctatc

SEQ ID NO: 91490 - DNA, 25 bp, E. coli
ctttgaacagttcggtatggctatc

SEQ ID NO: 91491 - DNA, 25 bp, E. coli
cggactttgaacagttgggtatggc

SEQ ID NO: 91492 - DNA, 25 bp, E. coli
cggactttgaactgttgggtatggc

SEQ ID NO: 91493 - DNA, 25 bp, E. coli
ggctatccagatttatattattaag

SEQ ID NO: 91494 - DNA, 25 bp, E. coli
ggctatccagatatatattattaag

SEQ ID NO: 91495 - DNA, 25 bp, E. coli
caagggaatcatccgctgacggtta

SEQ ID NO: 91496 - DNA, 25 bp, E. coli
aatcaggagttacccgcgacaatcg

SEQ ID NO: 91497 - DNA, 25 bp, E. coli
aatcaggagttagccgcgacaatcg

SEQ ID NO: 91498 - DNA, 25 bp, E. coli
caagggaatcatgcgctgacggtta

SEQ ID NO: 91499 - DNA, 25 bp, E. coli
caatcgaccgacaggaatcactgga

SEQ ID NO: 91500 - DNA, 25 bp, E. coli
caatcgaccgactggaatcactgga

SEQ ID NO: 91501 - DNA, 25 bp, E. coli
tacgccgactggatattgataaacg

SEQ ID NO: 91502 - DNA, 25 bp, E. coli
tacactttgggctgacaggcacctc

SEQ ID NO: 91503 - DNA, 25 bp, E. coli
tacactttgggcagacaggcacctc

SEQ ID NO: 91504 - DNA, 25 bp, E. coli
tatcgacgtatgctgcgacaaggga

SEQ ID NO: 91505 - DNA, 25 bp, E. coli
tatcgacgtatggtgcgacaaggga

SEQ ID NO: 91506 - DNA, 25 bp, E. coli
tacgccgactggttattgataaacg

SEQ ID NO: 91507 - DNA, 25 bp, E. coli
gaaaagctgatttgcgcgtatcgac

SEQ ID NO: 91508 - DNA, 25 bp, E. coli
gacacgctttcacgattacgccgac

SEQ ID NO: 91509 - DNA, 25 bp, E. coli
gactcagaaaagtttaaccaactgc

SEQ ID NO: 91510 - DNA, 25 bp, E. coli
gaaaagctgattagcgcgtatcgac

SEQ ID NO: 91511 - DNA, 25 bp, E. coli
gacacgctttcaggattacgccgac

SEQ ID NO: 91512 - DNA, 25 bp, E. coli
gactcagaaaagattaaccaactgc

SEQ ID NO: 91513 - DNA, 25 bp, E. coli
cattaagcgactcaatgaaatggag

SEQ ID NO: 91514 - DNA, 25 bp, E. coli
cattaagcgactgaatgaaatggag

SEQ ID NO: 91515 - DNA, 25 bp, E. coli
gatggataatatacatgacacgctt

SEQ ID NO: 91516 - DNA, 25 bp, E. coli
gatggataatattcatgacacgctt

SEQ ID NO: 91517 - DNA, 25 bp, E. coli
caggcgataaactgcatattgtgca

SEQ ID NO: 91518 - DNA, 25 bp, E. coli
cagaactgcgatgtttatgcgctct

SEQ ID NO: 91519 - DNA, 25 bp, E. coli
cagaactgcgatctttatgcgctct

SEQ ID NO: 91520 - DNA, 25 bp, E. coli
caggcgataaacagcatattgtgca

SEQ ID NO: 91521 - DNA, 25 bp, E. coli
aaaaatatctggagcagaactgcga

SEQ ID NO: 91522 - DNA, 25 bp, E. coli
acaggagccagtggtgatattggac

SEQ ID NO: 91523 - DNA, 25 bp, E. coli
acaggagccagtcgtgatattggac

SEQ ID NO: 91524 - DNA, 25 bp, E. coli
aaaaccgtactggtgacaggagcca

SEQ ID NO: 91525 - DNA, 25 bp, E. coli
aaaaatatctggtgcagaactgcga

SEQ ID NO: 91526 - DNA, 25 bp, E. coli
aaaaccgtactgctgacaggagcca

SEQ ID NO: 91527 - DNA, 25 bp, E. coli
tatgcgctctataaatccaacgacg

SEQ ID NO: 91528 - DNA, 25 bp, E. coli
tatgcgctctattaatccaacgacg

SEQ ID NO: 91529 - DNA, 25 bp, E. coli
tattggactgggtatttgcgaaaaa

SEQ ID NO: 91530 - DNA, 25 bp, E. coli
tattggactgggaatttgcgaaaaa

SEQ ID NO: 91531 - DNA, 25 bp, E. coli
tgatttaaatgataaaaccgtactg

SEQ ID NO: 91532 - DNA, 25 bp, E. coli
tgatttaaatgaaaaaaccgtactg

SEQ ID NO: 91533 - DNA, 25 bp, E. coli
tccaacgacgtggaattaacggcgc

SEQ ID NO: 91534 - DNA, 25 bp, E. coli
tccaacgacgtgcaattaacggcgc

SEQ ID NO: 91535 - DNA, 25 bp, E. coli
gaaagcaagccaacctgcaggcgat

SEQ ID NO: 91536 - DNA, 25 bp, E. coli
gaaagcaagccatcctgcaggcgat

SEQ ID NO: 91537 - DNA, 25 bp, E. coli
taacggcgctgatagcaagccatcc

SEQ ID NO: 91538 - DNA, 25 bp, E. coli
taacggcgctgaaagcaagccatcc

SEQ ID NO: 91539 - DNA, 25 bp, E. coli
tatcgacgcactggtggaacaggcg

SEQ ID NO: 91540 - DNA, 25 bp, E. coli
tatcgacgcactcgtggaacaggcg

SEQ ID NO: 91541 - DNA, 25 bp, E. coli
tgtggcaggagctggcagacatcac

SEQ ID NO: 91542 - DNA, 25 bp, E. coli
tgtggcaggagcaggcagacatcac

SEQ ID NO: 91543 - DNA, 25 bp, E. coli
tgacgcgagctgtcagacgtgacct

SEQ ID NO: 91544 - DNA, 25 bp, E. coli
tgacgcgagctgacagacgtgacct

SEQ ID NO: 91545 - DNA, 25 bp, E. coli
tcgccatgagctttgaagagagcct

SEQ ID NO: 91546 - DNA, 25 bp, E. coli
tcgccatgagctatgaagagagcct

SEQ ID NO: 91547 - DNA, 25 bp, E. coli
tctgacagcgtctttatgcgggtga

SEQ ID NO: 91548 - DNA, 25 bp, E. coli
tctggtctgcgagaaatgtcacttc

SEQ ID NO: 91549 - DNA, 25 bp, E. coli
tctgacagcgtcattatgcgggtga

SEQ ID NO: 91550 - DNA, 25 bp, E. coli
tctggtctgcgacaaatgtcacttc

SEQ ID NO: 91551 - DNA, 25 bp, E. coli
gaagtgctgacggtatgcccgaaat

SEQ ID NO: 91552 - DNA, 25 bp, E. coli
gaatggcgcgaagttttccaggacc

SEQ ID NO: 91553 - DNA, 25 bp, E. coli
gaagtgctgacgctatgcccgaaat

SEQ ID NO: 91554 - DNA, 25 bp, E. coli
gaatggcgcgaacttttccaggacc

SEQ ID NO: 91555 - DNA, 25 bp, E. coli
cgcgcgagcgcgtaataaaaacagg

SEQ ID NO: 91556 - DNA, 25 bp, E. coli
cgcgcgagcgcgaaataaaaacagg

SEQ ID NO: 91557 - DNA, 25 bp, E. coli
gataaaacgcagcttgaatggcgcg

SEQ ID NO: 91558 - DNA, 25 bp, E. coli
gataaaacgcaggttgaatggcgcg

SEQ ID NO: 91559 - DNA, 25 bp, E. coli
taacgcgaaccgaggtcgatgagct

SEQ ID NO: 91560 - DNA, 25 bp, E. coli
taacgcgaaccgtggtcgatgagct

SEQ ID NO: 91561 - DNA, 25 bp, E. coli
aatcgacggattttacctcctttct

SEQ ID NO: 91562 - DNA, 25 bp, E. coli
aatcgacggattatacctcctttct

SEQ ID NO: 91563 - DNA, 25 bp, E. coli
caaaaaggttgtgtaaagcagtctc

SEQ ID NO: 91564 - DNA, 25 bp, E. coli
caaaaaggttgtctaaagcagtctc

SEQ ID NO: 91565 - DNA, 25 bp, E. coli
aaaggttgtgtatagcagtctcgca

SEQ ID NO: 91566 - DNA, 25 bp, E. coli
aaaggttgtgtaaagcagtctcgca

SEQ ID NO: 91567 - DNA, 25 bp, E. coli
tatacctcctttcttcaaggcggca

SEQ ID NO: 91568 - DNA, 25 bp, E. coli
tatacctcctttgttcaaggcggca

SEQ ID NO: 91569 - DNA, 25 bp, E. coli
ttatgaaagaagattattccatccg

SEQ ID NO: 91570 - DNA, 25 bp, E. coli
ttatgaaagaagtttattccatccg

SEQ ID NO: 91571 - DNA, 25 bp, E. coli
tgtaaagcagtctcgcaaacgtttg

SEQ ID NO: 91572 - DNA, 25 bp, E. coli
tgtaaagcagtcacgcaaacgtttg

SEQ ID NO: 91573 - DNA, 25 bp, E. coli
gcaaacgtttgcattccctgttaga

SEQ ID NO: 91574 - DNA, 25 bp, E. coli
gcaaacgtttgctttccctgttaga

SEQ ID NO: 91575 - DNA, 25 bp, E. coli
gaaagaagattaatccatccgaaaa

SEQ ID NO: 91576 - DNA, 25 bp, E. coli
gaaaagacgtgcaaaaaggttgtgt

SEQ ID NO: 91577 - DNA, 25 bp, E. coli
gaaagaagattattccatccgaaaa

SEQ ID NO: 91578 - DNA, 25 bp, E. coli
gaaaagacgtgctaaaaggttgtgt

SEQ ID NO: 91579 - DNA, 25 bp, E. coli
ctcctttcttcatggcggcaatatt

SEQ ID NO: 91580 - DNA, 25 bp, E. coli
ctcctttcttcaaggcggcaatatt

SEQ ID NO: 91581 - DNA, 25 bp, E. coli
gtttgctttccctgttagaattgcg

SEQ ID NO: 91582 - DNA, 25 bp, E. coli
gtttgctttcccagttagaattgcg

SEQ ID NO: 91583 - DNA, 25 bp, E. coli
cagtcggatgctgaccatgggcgat

SEQ ID NO: 91584 - DNA, 25 bp, E. coli
cttgctggttattttagttgccgga

SEQ ID NO: 91585 - DNA, 25 bp, E. coli
cttgctggttatattagttgccgga

SEQ ID NO: 91586 - DNA, 25 bp, E. coli
cagtcggatgctcaccatgggcgat

SEQ ID NO: 91587 - DNA, 25 bp, E. coli
accatgggcgatacggtggtgaaaa

SEQ ID NO: 91588 - DNA, 25 bp, E. coli
accatgggcgattcggtggtgaaaa

SEQ ID NO: 91589 - DNA, 25 bp, E. coli
atctattggctgctcccgccgctgg

SEQ ID NO: 91590 - DNA, 25 bp, E. coli
atctattggctggtcccgccgctgg

SEQ ID NO: 91591 - DNA, 25 bp, E. coli
aaatatgcgcagacggatgctgacc

SEQ ID NO: 91592 - DNA, 25 bp, E. coli
aaatatgcgcagtcggatgctgacc

SEQ ID NO: 91593 - DNA, 25 bp, E. coli
tagtggcctgctagctccgttgctg

SEQ ID NO: 91594 - DNA, 25 bp, E. coli
tagtggcctgcttgctccgttgctg

SEQ ID NO: 91595 - DNA, 25 bp, E. coli
tgcaatggccgataatatgcgcagt

SEQ ID NO: 91596 - DNA, 25 bp, E. coli
tgcaatggccgaaaatatgcgcagt

SEQ ID NO: 91597 - DNA, 25 bp, E. coli
tcgtcggtatattgctactgatggc

SEQ ID NO: 91598 - DNA, 25 bp, E. coli
tcgtcggtatatagctactgatggc

SEQ ID NO: 91599 - DNA, 25 bp, E. coli
cgccgctgggcgtcgtcgattgtat

SEQ ID NO: 91600 - DNA, 25 bp, E. coli
cgccgctgggcgacgtcgattgtat

SEQ ID NO: 91601 - DNA, 25 bp, E. coli
gattgtattggtcgttttcgtcggt

SEQ ID NO: 91602 - DNA, 25 bp, E. coli
gattgtattggtggttttcgtcggt

SEQ ID NO: 91603 - DNA, 25 bp, E. coli
taagctttctgagtttgccgccacg

SEQ ID NO: 91604 - DNA, 25 bp, E. coli
taagctttctgactttgccgccacg

SEQ ID NO: 91605 - DNA, 25 bp, E. coli
cagccgatccgtaacgtgtaattcc

SEQ ID NO: 91606 - DNA, 25 bp, E. coli
cagccgatccgttacgtgtaattcc

SEQ ID NO: 91607 - DNA, 25 bp, E. coli
agccgatccgttacgtgtaattcct

SEQ ID NO: 91608 - DNA, 25 bp, E. coli
agccgatccgtttcgtgtaattcct

SEQ ID NO: 91609 - DNA, 25 bp, E. coli
tcgccgcagccgttccgttacgtgt

SEQ ID NO: 91610 - DNA, 25 bp, E. coli
tcgccgcagccgatccgttacgtgt

SEQ ID NO: 91611 - DNA, 25 bp, E. coli
gccgcagccgatccgttacgtgtaa

SEQ ID NO: 91612 - DNA, 25 bp, E. coli
ccgttacgtgtatttccttccatca

SEQ ID NO: 91613 - DNA, 25 bp, E. coli
gccgcagccgatgcgttacgtgtaa

SEQ ID NO: 91614 - DNA, 25 bp, E. coli
gccgatccgttaggtgtaattcctt

SEQ ID NO: 91615 - DNA, 25 bp, E. coli
gccgatccgttacgtgtaattcctt

SEQ ID NO: 91616 - DNA, 25 bp, E. coli
gcagccgatccgttacgtgtaattc

SEQ ID NO: 91617 - DNA, 25 bp, E. coli
gcagccgatccgatacgtgtaattc

SEQ ID NO: 91618 - DNA, 25 bp, E. coli
cgttacgtgtaaatccttccatcat

SEQ ID NO: 91619 - DNA, 25 bp, E. coli
cgcagccgatccgttacgtgtaatt

SEQ ID NO: 91620 - DNA, 25 bp, E. coli
ccgttacgtgtaattccttccatca

SEQ ID NO: 91621 - DNA, 25 bp, E. coli
cgttacgtgtaattccttccatcat

SEQ ID NO: 91622 - DNA, 25 bp, E. coli
cgcagccgatcccttacgtgtaatt

SEQ ID NO: 91623 - DNA, 25 bp, E. coli
gttacgtgtaattccttccatcatg

SEQ ID NO: 91624 - DNA, 25 bp, E. coli
gttacgtgtaataccttccatcatg

SEQ ID NO: 91625 - DNA, 25 bp, E. coli
gatccgttacgtctaattccttcca

SEQ ID NO: 91626 - DNA, 25 bp, E. coli
gatccgttacgtgtaattccttcca

SEQ ID NO: 91627 - DNA, 25 bp, E. coli
aaaaggaaaacggatgggacacgct

SEQ ID NO: 91628 - DNA, 25 bp, E. coli
aaaaggaaaacgcatgggacacgct

SEQ ID NO: 91629 - DNA, 25 bp, E. coli
tttgatcaacaatcacacgcgggta

SEQ ID NO: 91630 - DNA, 25 bp, E. coli
tttgatcaacaaacacacgcgggta

SEQ ID NO: 91631 - DNA, 25 bp, E. coli
tgatcactgaaggtgtaccgacact

SEQ ID NO: 91632 - DNA, 25 bp, E. coli
tgatcactgaagctgtaccgacact

SEQ ID NO: 91633 - DNA, 25 bp, E. coli
taaattccgggcgttcgataaagca

SEQ ID NO: 91634 - DNA, 25 bp, E. coli
taaattccgggccttcgataaagca

SEQ ID NO: 91635 - DNA, 25 bp, E. coli
tgcagggcattagcggcaaaaacgg

SEQ ID NO: 91636 - DNA, 25 bp, E. coli
tgcagggcattaccggcaaaaacgg

SEQ ID NO: 91637 - DNA, 25 bp, E. coli
tccggtacattatcctacgaagctg

SEQ ID NO: 91638 - DNA, 25 bp, E. coli
tccggtacattaacctacgaagctg

SEQ ID NO: 91639 - DNA, 25 bp, E. coli
ccatgaaatgaaaaaaccggtcgta

SEQ ID NO: 91640 - DNA, 25 bp, E. coli
ccacctgtattggtattggcggcga

SEQ ID NO: 91641 - DNA, 25 bp, E. coli
ccacctgtattgctattggcggcga

SEQ ID NO: 91642 - DNA, 25 bp, E. coli
ccatgaaatgaataaaccggtcgta

SEQ ID NO: 91643 - DNA, 25 bp, E. coli
ggcacatttcattcagagcaggcta

SEQ ID NO: 91644 - DNA, 25 bp, E. coli
ggactaactttattgatgcgctgcg

SEQ ID NO: 91645 - DNA, 25 bp, E. coli
ggactaactttaatgatgcgctgcg

SEQ ID NO: 91646 - DNA, 25 bp, E. coli
ggcacatttcatacagagcaggcta

SEQ ID NO: 91647 - DNA, 25 bp, E. coli
gatgcgacaaactgaggctgatgcc

SEQ ID NO: 91648 - DNA, 25 bp, E. coli
gatgcgacaaacagaggctgatgcc

SEQ ID NO: 91649 - DNA, 25 bp, E. coli
caaagactctggtttaatgctgcat

SEQ ID NO: 91650 - DNA, 25 bp, E. coli
caaagactctggattaatgctgcat

SEQ ID NO: 91651 - DNA, 25 bp, E. coli
cagaaaaaaggcatcgaggttccac

SEQ ID NO: 91652 - DNA, 25 bp, E. coli
cagaaaaaaggcttcgaggttccac

SEQ ID NO: 91653 - DNA, 25 bp, E. coli
tatcgactgggacgcgcaattctct

SEQ ID NO: 91654 - DNA, 25 bp, E. coli
tatcgactgggaggcgcaattctct

SEQ ID NO: 91655 - DNA, 25 bp, E. coli
tgtgtctcattttctggcggcaaag

SEQ ID NO: 91656 - DNA, 25 bp, E. coli
tgtgtctcatttactggcggcaaag

SEQ ID NO: 91657 - DNA, 25 bp, E. coli
tgctcaatagcaagccggaaaaaac

SEQ ID NO: 91658 - DNA, 25 bp, E. coli
tgctcaatagcatgccggaaaaaac

SEQ ID NO: 91659 - DNA, 25 bp, E. coli
tgccgacgataatccctggactacg

SEQ ID NO: 91660 - DNA, 25 bp, E. coli
tgccgacgataaaccctggactacg

SEQ ID NO: 91661 - DNA, 25 bp, E. coli
tctggaagctgcacgagagcgtatt

SEQ ID NO: 91662 - DNA, 25 bp, E. coli
tctggaagctgctcgagagcgtatt

SEQ ID NO: 91663 - DNA, 25 bp, E. coli
cctgcgcgagttgtacaccgatgtc

SEQ ID NO: 91664 - DNA, 25 bp, E. coli
cctgcgcgagttctacaccgatgtc

SEQ ID NO: 91665 - DNA, 25 bp, E. coli
cgaggttccacaaacccagcaaggg

SEQ ID NO: 91666 - DNA, 25 bp, E. coli
cgaggttccacatacccagcaaggg

SEQ ID NO: 91667 - DNA, 25 bp, E. coli
ggacctggtatggaaatcatcaaag

SEQ ID NO: 91668 - DNA, 25 bp, E. coli
ggacctggtatgcaaatcatcaaag

SEQ ID NO: 91669 - DNA, 25 bp, E. coli
taactatgttcactccctgcgcgag

SEQ ID NO: 91670 - DNA, 25 bp, E. coli
taactatgttcagtccctgcgcgag

SEQ ID NO: 91671 - DNA, 25 bp, E. coli
caaagctatcagtttcagcaggccg

SEQ ID NO: 91672 - DNA, 25 bp, E. coli
caaagctatcagattcagcaggccg

SEQ ID NO: 91673 - DNA, 25 bp, E. coli
catcttcaaagggtgctggtgcggc

SEQ ID NO: 91674 - DNA, 25 bp, E. coli
catcttcaaaggctgctggtgcggc

SEQ ID NO: 91675 - DNA, 25 bp, E. coli
taaagctctggtgaaggctacggaa

SEQ ID NO: 91676 - DNA, 25 bp, E. coli
taaagctctggtcaaggctacggaa

SEQ ID NO: 91677 - DNA, 25 bp, E. coli
aaaactcctcggcaagatggtgact

SEQ ID NO: 91678 - DNA, 25 bp, E. coli
aaaactcctcgggaagatggtgact

SEQ ID NO: 91679 - DNA, 25 bp, E. coli
ttttgcagcaatcaacaacgcggct

SEQ ID NO: 91680 - DNA, 25 bp, E. coli
ttttgcagcaatgaacaacgcggct

SEQ ID NO: 91681 - DNA, 25 bp, E. coli
tgctgaagatcttgcagacgccgcc

SEQ ID NO: 91682 - DNA, 25 bp, E. coli
tgcgatgcagaatgcgatggccaca

SEQ ID NO: 91683 - DNA, 25 bp, E. coli
tgcgatgcagaaagcgatggccaca

SEQ ID NO: 91684 - DNA, 25 bp, E. coli
tgctgaagatctagcagacgccgcc

SEQ ID NO: 91685 - DNA, 25 bp, E. coli
gccgccgagaagtcaagcagaatca

SEQ ID NO: 91686 - DNA, 25 bp, E. coli
gccgccgagaagacaagcagaatca

SEQ ID NO: 91687 - DNA, 25 bp, E. coli
gtgatataacgtccgctgtccgcga

SEQ ID NO: 91688 - DNA, 25 bp, E. coli
gtgatataacgtgcgctgtccgcga

SEQ ID NO: 91689 - DNA, 25 bp, E. coli
taatgaacaacgagcgaagtcgctg

SEQ ID NO: 91690 - DNA, 25 bp, E. coli
taatgaacaacgtgcgaagtcgctg

SEQ ID NO: 91691 - DNA, 25 bp, E. coli
gatgatgttgcgaaagcctctgact

SEQ ID NO: 91692 - DNA, 25 bp, E. coli
gatgatgttgcgtaagcctctgact

SEQ ID NO: 91693 - DNA, 25 bp, E. coli
aagtatcgggataatcattctgacg

SEQ ID NO: 91694 - DNA, 25 bp, E. coli
aagtatcgggattatcattctgacg

SEQ ID NO: 91695 - DNA, 25 bp, E. coli
cactgtcgccgtatcaattctggtg

SEQ ID NO: 91696 - DNA, 25 bp, E. coli
cactgtcgccgtttcaattctggtg

SEQ ID NO: 91697 - DNA, 25 bp, E. coli
tatcagtcataagaccactgtcgcc

SEQ ID NO: 91698 - DNA, 25 bp, E. coli
tatcagtcataacaccactgtcgcc

SEQ ID NO: 91699 - DNA, 25 bp, E. coli
tgtcactttgctcatcctgctcggg

SEQ ID NO: 91700 - DNA, 25 bp, E. coli
tgtcactttgctgatcctgctcggg

SEQ ID NO: 91701 - DNA, 25 bp, E. coli
tcattgtccgcgtcacaccgttaag

SEQ ID NO: 91702 - DNA, 25 bp, E. coli
tcattgtccgcgacacaccgttaag

SEQ ID NO: 91703 - DNA, 25 bp, E. coli
gcgtgacgttaaagggcagccagcc

SEQ ID NO: 91704 - DNA, 25 bp, E. coli
gcgtgacgttaatgggcagccagcc

SEQ ID NO: 91705 - DNA, 25 bp, E. coli
gcgtcacaccgttaagcaccttttt

SEQ ID NO: 91706 - DNA, 25 bp, E. coli
gcgtcacaccgtaaagcaccttttt

SEQ ID NO: 91707 - DNA, 25 bp, E. coli
ctcgggttagctgcgctgggcttta

SEQ ID NO: 91708 - DNA, 25 bp, E. coli
cattctgacgataggcgttatggcc

SEQ ID NO: 91709 - DNA, 25 bp, E. coli
ctcgggttagctccgctgggcttta

SEQ ID NO: 91710 - DNA, 25 bp, E. coli
cattctgacgattggcgttatggcc

SEQ ID NO: 91711 - DNA, 25 bp, E. coli
gattcactcgttactgaactggaaa

SEQ ID NO: 91712 - DNA, 25 bp, E. coli
gattcactcgtttctgaactggaaa

SEQ ID NO: 91713 - DNA, 25 bp, E. coli
taatgggcagcctgccgcaactggt

SEQ ID NO: 91714 - DNA, 25 bp, E. coli
taatgggcagccagccgcaactggt

SEQ ID NO: 91715 - DNA, 25 bp, E. coli
cataaacggtctcgtgatccgggcg

SEQ ID NO: 91716 - DNA, 25 bp, E. coli
cattattgcagatgacgccgtttgc

SEQ ID NO: 91717 - DNA, 25 bp, E. coli
cattattgcagaagacgccgtttgc

SEQ ID NO: 91718 - DNA, 25 bp, E. coli
cataaacggtctggtgatccgggcg

SEQ ID NO: 91719 - DNA, 25 bp, E. coli
aaagaagtgttccactgccagacgg

SEQ ID NO: 91720 - DNA, 25 bp, E. coli
aaagaagtgttcgactgccagacgg

SEQ ID NO: 91721 - DNA, 25 bp, E. coli
tacgcgccgtgtaaagcagaagaat

SEQ ID NO: 91722 - DNA, 25 bp, E. coli
tacgcgccgtgttaagcagaagaat

SEQ ID NO: 91723 - DNA, 25 bp, E. coli
tcttcgcggtgatgaagccgtcgca

SEQ ID NO: 91724 - DNA, 25 bp, E. coli
tcttcgcggtgaagaagccgtcgca

SEQ ID NO: 91725 - DNA, 25 bp, E. coli
gaagggtatgtctatctgctgcccg

SEQ ID NO: 91726 - DNA, 25 bp, E. coli
gaagggtattactcacacgcatttg

SEQ ID NO: 91727 - DNA, 25 bp, E. coli
gaagggtatgtcaatctgctgcccg

SEQ ID NO: 91728 - DNA, 25 bp, E. coli
gaagggtattacacacacgcatttg

SEQ ID NO: 91729 - DNA, 25 bp, E. coli
cgacagcgcggaaatgatgcaagca

SEQ ID NO: 91730 - DNA, 25 bp, E. coli
cgacagcgcggatatgatgcaagca

SEQ ID NO: 91731 - DNA, 25 bp, E. coli
gtagcgataaaagcggcggcgaaac

SEQ ID NO: 91732 - DNA, 25 bp, E. coli
gtagcgataaaaccggcggcgaaac

SEQ ID NO: 91733 - DNA, 25 bp, E. coli
ggactttaatatacacctctggcag

SEQ ID NO: 91734 - DNA, 25 bp, E. coli
ggactttaatattcacctctggcag

SEQ ID NO: 91735 - DNA, 25 bp, E. coli
gatgcgttgcccgaaatcaccacgt

SEQ ID NO: 91736 - DNA, 25 bp, E. coli
gatgcgttgccccaaatcaccacgt

SEQ ID NO: 91737 - DNA, 25 bp, E. coli
caatttttggcgctggttattgcca

SEQ ID NO: 91738 - DNA, 25 bp, E. coli
aatttttatgctggcgctgggcgca

SEQ ID NO: 91739 - DNA, 25 bp, E. coli
caatttttggcggtggttattgcca

SEQ ID NO: 91740 - DNA, 25 bp, E. coli
aatttttatgctcgcgctgggcgca

SEQ ID NO: 91741 - DNA, 25 bp, E. coli
caatttaccttctgctcaaaatttt

SEQ ID NO: 91742 - DNA, 25 bp, E. coli
caatttaccttcagctcaaaatttt

SEQ ID NO: 91743 - DNA, 25 bp, E. coli
tatgctggcgctcggcgcattaatg

SEQ ID NO: 91744 - DNA, 25 bp, E. coli
tatgctggcgctgggcgcattaatg

SEQ ID NO: 91745 - DNA, 25 bp, E. coli
tttggcggtggttattgccatgctg

SEQ ID NO: 91746 - DNA, 25 bp, E. coli
tttggcggtggtaattgccatgctg

SEQ ID NO: 91747 - DNA, 25 bp, E. coli
gccaacaatttagcttctgctcaaa

SEQ ID NO: 91748 - DNA, 25 bp, E. coli
gccaacaatttaccttctgctcaaa

SEQ ID NO: 91749 - DNA, 25 bp, E. coli
gcgcattaatgctatttttctcggg

SEQ ID NO: 91750 - DNA, 25 bp, E. coli
gcgcattaatgcaatttttctcggg

SEQ ID NO: 91751 - DNA, 25 bp, E. coli
tggaaagaataaagcaaaacagaaa

SEQ ID NO: 91752 - DNA, 25 bp, E. coli
ggcgctgggcgctttaatgctattt

SEQ ID NO: 91753 - DNA, 25 bp, E. coli
ggcgcaatttttcgcggtggttatt

SEQ ID NO: 91754 - DNA, 25 bp, E. coli
ggcgctgggcgcattaatgctattt

SEQ ID NO: 91755 - DNA, 25 bp, E. coli
tggaaagaataatgcaaaacagaaa

SEQ ID NO: 91756 - DNA, 25 bp, E. coli
ggcgcaatttttggcggtggttatt

SEQ ID NO: 91757 - DNA, 25 bp, E. coli
taatgctattttactcggggcgagt

SEQ ID NO: 91758 - DNA, 25 bp, E. coli
taatgctatttttctcggggcgagt

SEQ ID NO: 91759 - DNA, 25 bp, E. coli
tacggtaaagcatccgttggcgcac

SEQ ID NO: 91760 - DNA, 25 bp, E. coli
tacggtaaagcaaccgttggcgcac

SEQ ID NO: 91761 - DNA, 25 bp, E. coli
aaatttgtctttttcggcgcgggcg

SEQ ID NO: 91762 - DNA, 25 bp, E. coli
aaatttgtctttatcggcgcgggcg

SEQ ID NO: 91763 - DNA, 25 bp, E. coli
tcttatggacgcaagctgaacggtg

SEQ ID NO: 91764 - DNA, 25 bp, E. coli
tcttatggacgctagctgaacggtg

SEQ ID NO: 91765 - DNA, 25 bp, E. coli
cctatttacgcgagctggagcctga

SEQ ID NO: 91766 - DNA, 25 bp, E. coli
cctatttacgcgtgctggagcctga

SEQ ID NO: 91767 - DNA, 25 bp, E. coli
gaagtccgcgccctaaagcgtaatg

SEQ ID NO: 91768 - DNA, 25 bp, E. coli
gaagtccgcgccgtaaagcgtaatg

SEQ ID NO: 91769 - DNA, 25 bp, E. coli
gaaccgggcattgtgcactgatgga

SEQ ID NO: 91770 - DNA, 25 bp, E. coli
gaaccgggcattctgcactgatgga

SEQ ID NO: 91771 - DNA, 25 bp, E. coli
cccgcaatggcacgctacgttgaaa

SEQ ID NO: 91772 - DNA, 25 bp, E. coli
cgcagatcaaagagtgggcaccgtt

SEQ ID NO: 91773 - DNA, 25 bp, E. coli
cccgcaatggcaggctacgttgaaa

SEQ ID NO: 91774 - DNA, 25 bp, E. coli
cgcagatcaaagtgtgggcaccgtt

SEQ ID NO: 91775 - DNA, 25 bp, E. coli
gatagtacgccgaaaccgcagttga

SEQ ID NO: 91776 - DNA, 25 bp, E. coli
gatccgcaacagtaagtggcagcca

SEQ ID NO: 91777 - DNA, 25 bp, E. coli
gatagtacgccgtaaccgcagttga

SEQ ID NO: 91778 - DNA, 25 bp, E. coli
ggaccgttaccgttgccgatctgaa

SEQ ID NO: 91779 - DNA, 25 bp, E. coli
ggaccgttaccgatgccgatctgaa

SEQ ID NO: 91780 - DNA, 25 bp, E. coli
gatccgcaacagaaagtggcagcca

SEQ ID NO: 91781 - DNA, 25 bp, E. coli
catcgaaagcgttggtcattactgg

SEQ ID NO: 91782 - DNA, 25 bp, E. coli
catcgaaagcgtaggtcattactgg

SEQ ID NO: 91783 - DNA, 25 bp, E. coli
attcgctgggtatactggctggcgc

SEQ ID NO: 91784 - DNA, 25 bp, E. coli
attcgctgggtaaactggctggcgc

SEQ ID NO: 91785 - DNA, 25 bp, E. coli
aaaatctggcctagttgctggactc

SEQ ID NO: 91786 - DNA, 25 bp, E. coli
aaagagaaaaatgtggccttgttgc

SEQ ID NO: 91787 - DNA, 25 bp, E. coli
aaaatctggccttgttgctggactc

SEQ ID NO: 91788 - DNA, 25 bp, E. coli
aaagagaaaaatctggccttgttgc

SEQ ID NO: 91789 - DNA, 25 bp, E. coli
tgattgcgaaatgtcgcgatacctt

SEQ ID NO: 91790 - DNA, 25 bp, E. coli
tgattgcgaaatctcgcgatacctt

SEQ ID NO: 91791 - DNA, 25 bp, E. coli
tctgtagcgaaccataaagctgccc

SEQ ID NO: 91792 - DNA, 25 bp, E. coli
tctgtagcgaacgataaagctgccc

SEQ ID NO: 91793 - DNA, 25 bp, E. coli
gccttgttgctggactctgtagcga

SEQ ID NO: 91794 - DNA, 25 bp, E. coli
gccttgttgctgcactctgtagcga

SEQ ID NO: 91795 - DNA, 25 bp, E. coli
gctgccctgattgcgaaatctcgcg

SEQ ID NO: 91796 - DNA, 25 bp, E. coli
gctgccctgattccgaaatctcgcg

SEQ ID NO: 91797 - DNA, 25 bp, E. coli
gcaagttcacatggaaagcgtaggt

SEQ ID NO: 91798 - DNA, 25 bp, E. coli
gcaagttcacatcgaaagcgtaggt

SEQ ID NO: 91799 - DNA, 25 bp, E. coli
gaacgataaagctgccctgattgcg

SEQ ID NO: 91800 - DNA, 25 bp, E. coli
gaacgataaagcagccctgattgcg

SEQ ID NO: 91801 - DNA, 25 bp, E. coli
cgcgaaaaccgaagcgaaaggcgca

SEQ ID NO: 91802 - DNA, 25 bp, E. coli
cgcgaaaaccgatgcgaaaggcgca

SEQ ID NO: 91803 - DNA, 25 bp, E. coli
tagaccttaagccaggagcaggatc

SEQ ID NO: 91804 - DNA, 25 bp, E. coli
tagaccttaagcgaggagcaggatc

SEQ ID NO: 91805 - DNA, 25 bp, E. coli
tataagttcattccagctcacagtg

SEQ ID NO: 91806 - DNA, 25 bp, E. coli
tataagttcattgcagctcacagtg

SEQ ID NO: 91807 - DNA, 25 bp, E. coli
tgaaatcagatgtgtacgaaatcac

SEQ ID NO: 91808 - DNA, 25 bp, E. coli
tgaaatcagatgagtacgaaatcac

SEQ ID NO: 91809 - DNA, 25 bp, E. coli
cctggcaggccattgggttgagaat

SEQ ID NO: 91810 - DNA, 25 bp, E. coli
gcctttggcttgagtgtagacctta

SEQ ID NO: 91811 - DNA, 25 bp, E. coli
cctggcaggccaatgggttgagaat

SEQ ID NO: 91812 - DNA, 25 bp, E. coli
gcctttggcttgtgtgtagacctta

SEQ ID NO: 91813 - DNA, 25 bp, E. coli
gcggtttgtcatttctcttttcagg

SEQ ID NO: 91814 - DNA, 25 bp, E. coli
gcggtttgtcatatctcttttcagg

SEQ ID NO: 91815 - DNA, 25 bp, E. coli
gaatattagagttttggaagcgcat

SEQ ID NO: 91816 - DNA, 25 bp, E. coli
gaatattagagtattggaagcgcat

SEQ ID NO: 91817 - DNA, 25 bp, E. coli
cgaaatcacattttttgcctttggc

SEQ ID NO: 91818 - DNA, 25 bp, E. coli
cgaaatcacattatttgcctttggc

SEQ ID NO: 91819 - DNA, 25 bp, E. coli
ggagcaggatcttctttcagactta

SEQ ID NO: 91820 - DNA, 25 bp, E. coli
ggagcaggatctactttcagactta

SEQ ID NO: 91821 - DNA, 25 bp, E. coli
taagcgagattttgtgcctggcagg

SEQ ID NO: 91822 - DNA, 25 bp, E. coli
tcagacttatggcataatgcgcggt

SEQ ID NO: 91823 - DNA, 25 bp, E. coli
tcagacttatgggataatgcgcggt

SEQ ID NO: 91824 - DNA, 25 bp, E. coli
taagcgagatttagtgcctggcagg

SEQ ID NO: 91825 - DNA, 25 bp, E. coli
cagggcgcggcaactcgttttgaac

SEQ ID NO: 91826 - DNA, 25 bp, E. coli
cagggcgcggcatctcgttttgaac

SEQ ID NO: 91827 - DNA, 25 bp, E. coli
accgcgcgtattgctgttggatgaa

SEQ ID NO: 91828 - DNA, 25 bp, E. coli
accgcgcgtattcctgttggatgaa

SEQ ID NO: 91829 - DNA, 25 bp, E. coli
tatctttggtaatcccgccagcaat

SEQ ID NO: 91830 - DNA, 25 bp, E. coli
tatctttggtaaacccgccagcaat

SEQ ID NO: 91831 - DNA, 25 bp, E. coli
tttgaactgaaaatgaacggcggtg

SEQ ID NO: 91832 - DNA, 25 bp, E. coli
tttgaactgaaattgaacggcggtg

SEQ ID NO: 91833 - DNA, 25 bp, E. coli
tggtgaactgcacgccaatggcacg

SEQ ID NO: 91834 - DNA, 25 bp, E. coli
tggtgaactgcaggccaatggcacg

SEQ ID NO: 91835 - DNA, 25 bp, E. coli
tcttgacaatgtggcctatgggctg

SEQ ID NO: 91836 - DNA, 25 bp, E. coli
tcttgacaatgtcgcctatgggctg

SEQ ID NO: 91837 - DNA, 25 bp, E. coli
gcattggtgaatcaaccgcgcgtat

SEQ ID NO: 91838 - DNA, 25 bp, E. coli
gcattggtgaatgaaccgcgcgtat

SEQ ID NO: 91839 - DNA, 25 bp, E. coli
gttgctatcgccagagcattggtga

SEQ ID NO: 91840 - DNA, 25 bp, E. coli
gttgctatcgcctgagcattggtga

SEQ ID NO: 91841 - DNA, 25 bp, E. coli
gggctatctctaactttggtaaacc

SEQ ID NO: 91842 - DNA, 25 bp, E. coli
gggctatctctatctttggtaaacc

SEQ ID NO: 91843 - DNA, 25 bp, E. coli
tggtcagcgccagcgggttgctatc

SEQ ID NO: 91844 - DNA, 25 bp, E. coli
tggtcagcgccaccgggttgctatc

SEQ ID NO: 91845 - DNA, 25 bp, E. coli
gttgccgggttcgttggtacatcga

SEQ ID NO: 91846 - DNA, 25 bp, E. coli
gttgccgggttccttggtacatcga

SEQ ID NO: 91847 - DNA, 25 bp, E. coli
aatgtttgtccagatacggtacgcg

SEQ ID NO: 91848 - DNA, 25 bp, E. coli
aatgtttgtccacatacggtacgcg

SEQ ID NO: 91849 - DNA, 25 bp, E. coli
caaccgtttgccttcagagtattaa

SEQ ID NO: 91850 - DNA, 25 bp, E. coli
caaccgtttgccatcagagtattaa

SEQ ID NO: 91851 - DNA, 25 bp, E. coli
caaaggacgcgctaatgttatctgt

SEQ ID NO: 91852 - DNA, 25 bp, E. coli
caaaggacgcgcaaatgttatctgt

SEQ ID NO: 91853 - DNA, 25 bp, E. coli
cataattcctacgaacaaatccgcg

SEQ ID NO: 91854 - DNA, 25 bp, E. coli
cataattcctaccaacaaatccgcg

SEQ ID NO: 91855 - DNA, 25 bp, E. coli
taaaggcaaactggtcgctatcaac

SEQ ID NO: 91856 - DNA, 25 bp, E. coli
taaaggcaaactcgtcgctatcaac

SEQ ID NO: 91857 - DNA, 25 bp, E. coli
tgaacaaaatcaactctggcgagac

SEQ ID NO: 91858 - DNA, 25 bp, E. coli
tgaacaaaatcatctctggcgagac

SEQ ID NO: 91859 - DNA, 25 bp, E. coli
tgacgggcattagtgcaaaggacgc

SEQ ID NO: 91860 - DNA, 25 bp, E. coli
tgacgggcattactgcaaaggacgc

SEQ ID NO: 91861 - DNA, 25 bp, E. coli
cctcttcaggaaattggtaagctcg

SEQ ID NO: 91862 - DNA, 25 bp, E. coli
cctcttcaggaatttggtaagctcg

SEQ ID NO: 91863 - DNA, 25 bp, E. coli
gctgctttgcgttaaggcggctata

SEQ ID NO: 91864 - DNA, 25 bp, E. coli
gctgctttgcgtaaaggcggctata

SEQ ID NO: 91865 - DNA, 25 bp, E. coli
gctttttactggttagcctggcaaa

SEQ ID NO: 91866 - DNA, 25 bp, E. coli
gctttttactggatagcctggcaaa

SEQ ID NO: 91867 - DNA, 25 bp, E. coli
ggtacgcgcttccagtttaataatg

SEQ ID NO: 91868 - DNA, 25 bp, E. coli
ggtacgcgcttcgagtttaataatg

SEQ ID NO: 91869 - DNA, 25 bp, E. coli
aagtcctggcaagcgcgggaagcca

SEQ ID NO: 91870 - DNA, 25 bp, E. coli
aagtcctggcaaccgcgggaagcca

SEQ ID NO: 91871 - DNA, 25 bp, E. coli
agaatagccggcaggaagaagcacc

SEQ ID NO: 91872 - DNA, 25 bp, E. coli
ataaaaatcgcgtcaacagcggcca

SEQ ID NO: 91873 - DNA, 25 bp, E. coli
attataaagtcagccacggacagcg

SEQ ID NO: 91874 - DNA, 25 bp, E. coli
agaatagccggctggaagaagcacc

SEQ ID NO: 91875 - DNA, 25 bp, E. coli
ataaaaatcgcgacaacagcggcca

SEQ ID NO: 91876 - DNA, 25 bp, E. coli
agaagcacccgggaagctcttcgaa

SEQ ID NO: 91877 - DNA, 25 bp, E. coli
agaagcacccggcaagctcttcgaa

SEQ ID NO: 91878 - DNA, 25 bp, E. coli
attataaagtcacccacggacagcg

SEQ ID NO: 91879 - DNA, 25 bp, E. coli
acagcgcttcgtcgtgcgtactgca

SEQ ID NO: 91880 - DNA, 25 bp, E. coli
acagcgcttcgtggtgcgtactgca

SEQ ID NO: 91881 - DNA, 25 bp, E. coli
tgcgtactgcacagaatagccggct

SEQ ID NO: 91882 - DNA, 25 bp, E. coli
tgcgtactgcactgaatagccggct

SEQ ID NO: 91883 - DNA, 25 bp, E. coli
tcagaggacggtccctgctggcatc

SEQ ID NO: 91884 - DNA, 25 bp, E. coli
tcagaggacggtgcctgctggcatc

SEQ ID NO: 91885 - DNA, 25 bp, E. coli
gcaagctcttcgtactgccggaagt

SEQ ID NO: 91886 - DNA, 25 bp, E. coli
gcaagctcttcgaactgccggaagt

SEQ ID NO: 91887 - DNA, 25 bp, E. coli
gaactgccggaactcctggcaaccg

SEQ ID NO: 91888 - DNA, 25 bp, E. coli
gaactgccggaagtcctggcaaccg

SEQ ID NO: 91889 - DNA, 25 bp, E. coli
gacggtgcctgcaggcatctgctga

SEQ ID NO: 91890 - DNA, 25 bp, E. coli
gacggtgcctgctggcatctgctga

SEQ ID NO: 91891 - DNA, 25 bp, E. coli
caactgactgatgcatttgcgcgta

SEQ ID NO: 91892 - DNA, 25 bp, E. coli
caactgactgatccatttgcgcgta

SEQ ID NO: 91893 - DNA, 25 bp, E. coli
tcatcgaactgatggaaacgggcga

SEQ ID NO: 91894 - DNA, 25 bp, E. coli
tcatcgaactgaaggaaacgggcga

SEQ ID NO: 91895 - DNA, 25 bp, E. coli
gcggcgtcaccattaaaggctttct

SEQ ID NO: 91896 - DNA, 25 bp, E. coli
gcggcgtcaccaataaaggctttct

SEQ ID NO: 91897 - DNA, 25 bp, E. coli
gaaggtcaaagtcaataccgtgctg

SEQ ID NO: 91898 - DNA, 25 bp, E. coli
gaaggtcaaagtgaataccgtgctg

SEQ ID NO: 91899 - DNA, 25 bp, E. coli
gaaaaagacttctgcgccacttgca

SEQ ID NO: 91900 - DNA, 25 bp, E. coli
gaaaaagacttcagcgccacttgca

SEQ ID NO: 91901 - DNA, 25 bp, E. coli
gtaagcatcacatctctggtcaggt

SEQ ID NO: 91902 - DNA, 25 bp, E. coli
gattacgccggacagattggcctta

SEQ ID NO: 91903 - DNA, 25 bp, E. coli
gattacgccggagagattggcctta

SEQ ID NO: 91904 - DNA, 25 bp, E. coli
ggatccaccaattacgtcaacgcag

SEQ ID NO: 91905 - DNA, 25 bp, E. coli
ggatccaccaataacgtcaacgcag

SEQ ID NO: 91906 - DNA, 25 bp, E. coli
gtaagcatcacaactctggtcaggt

SEQ ID NO: 91907 - DNA, 25 bp, E. coli
tggaagacgatacccagcaacaggc

SEQ ID NO: 91908 - DNA, 25 bp, E. coli
tggaagacgatagccagcaacaggc

SEQ ID NO: 91909 - DNA, 25 bp, E. coli
taagttttactagttgcgcctgtcg

SEQ ID NO: 91910 - DNA, 25 bp, E. coli
taactttcgttggacctactgcctg

SEQ ID NO: 91911 - DNA, 25 bp, E. coli
taagttttactacttgcgcctgtcg

SEQ ID NO: 91912 - DNA, 25 bp, E. coli
taactttcgttgcacctactgcctg

SEQ ID NO: 91913 - DNA, 25 bp, E. coli
cactttttcaacatcattgtgctca

SEQ ID NO: 91914 - DNA, 25 bp, E. coli
cactttttcaacttcattgtgctca

SEQ ID NO: 91915 - DNA, 25 bp, E. coli
tatgcgacacgaagaagaaacagcc

SEQ ID NO: 91916 - DNA, 25 bp, E. coli
tatgcgacacgatgaagaaacagcc

SEQ ID NO: 91917 - DNA, 25 bp, E. coli
tattggtcacatattatgcgacacg

SEQ ID NO: 91918 - DNA, 25 bp, E. coli
tattggtcacattttatgcgacacg

SEQ ID NO: 91919 - DNA, 25 bp, E. coli
ttttcaacatcaatgtgctcaacaa

SEQ ID NO: 91920 - DNA, 25 bp, E. coli
ttttcaacatcattgtgctcaacaa

SEQ ID NO: 91921 - DNA, 25 bp, E. coli
gcgacacgatgatgaaacagccgaa

SEQ ID NO: 91922 - DNA, 25 bp, E. coli
gcgacacgatgaagaaacagccgaa

SEQ ID NO: 91923 - DNA, 25 bp, E. coli
gacatgcgagttgatgcaactaaaa

SEQ ID NO: 91924 - DNA, 25 bp, E. coli
gacatgcgagttcatgcaactaaaa

SEQ ID NO: 91925 - DNA, 25 bp, E. coli
cgagttcatgcaactaaaaaattgc

SEQ ID NO: 91926 - DNA, 25 bp, E. coli
cgagttcatgcatctaaaaaattgc

SEQ ID NO: 91927 - DNA, 25 bp, E. coli
ggcagattagcacactttttcaaca

SEQ ID NO: 91928 - DNA, 25 bp, E. coli
ggtcacattttatgcgacacgatga

SEQ ID NO: 91929 - DNA, 25 bp, E. coli
ggagggcagatttgcacactttttc

SEQ ID NO: 91930 - DNA, 25 bp, E. coli
ggagggcagattagcacactttttc

SEQ ID NO: 91931 - DNA, 25 bp, E. coli
ggtcacattttaagcgacacgatga

SEQ ID NO: 91932 - DNA, 25 bp, E. coli
ggcagattagcagactttttcaaca

SEQ ID NO: 91933 - DNA, 25 bp, E. coli
tggagacatgcgagttcatgcaact

SEQ ID NO: 91934 - DNA, 25 bp, E. coli
tggagacatgcgtgttcatgcaact

SEQ ID NO: 91935 - DNA, 25 bp, E. coli
tagtgaacacaaccatagatatgtc

SEQ ID NO: 91936 - DNA, 25 bp, E. coli
tagtgcagttaaccactataaccag

SEQ ID NO: 91937 - DNA, 25 bp, E. coli
tagtgcagttaagcactataaccag

SEQ ID NO: 91938 - DNA, 25 bp, E. coli
tagtgaacacaagcatagatatgtc

SEQ ID NO: 91939 - DNA, 25 bp, E. coli
tgtcaaatgtaaattcctgtagcgt

SEQ ID NO: 91940 - DNA, 25 bp, E. coli
tgtcaaatgtaatttcctgtagcgt

SEQ ID NO: 91941 - DNA, 25 bp, E. coli
ccataatttctattgcttaagcagg

SEQ ID NO: 91942 - DNA, 25 bp, E. coli
cctgtagcgttaatgacacataaat

SEQ ID NO: 91943 - DNA, 25 bp, E. coli
cctgtagcgttattgacacataaat

SEQ ID NO: 91944 - DNA, 25 bp, E. coli
ccataatttctaatgcttaagcagg

SEQ ID NO: 91945 - DNA, 25 bp, E. coli
ccagcacctcttttgttttcttaaa

SEQ ID NO: 91946 - DNA, 25 bp, E. coli
ccagcacctcttatgttttcttaaa

SEQ ID NO: 91947 - DNA, 25 bp, E. coli
gaataaggctatttcagattacatc

SEQ ID NO: 91948 - DNA, 25 bp, E. coli
gaataaggctatatcagattacatc

SEQ ID NO: 91949 - DNA, 25 bp, E. coli
cttaagcaggatccaagaaaccaat

SEQ ID NO: 91950 - DNA, 25 bp, E. coli
cttaagcaggatgcaagaaaccaat

SEQ ID NO: 91951 - DNA, 25 bp, E. coli
gattacatcactgaattcctaagat

SEQ ID NO: 91952 - DNA, 25 bp, E. coli
gattacatcactcaattcctaagat

SEQ ID NO: 91953 - DNA, 25 bp, E. coli
ggttaaatttgcaggttatagtgca

SEQ ID NO: 91954 - DNA, 25 bp, E. coli
ggttaaatttgctggttatagtgca

SEQ ID NO: 91955 - DNA, 25 bp, E. coli
tcaatgcgttagagaacaatctact

SEQ ID NO: 91956 - DNA, 25 bp, E. coli
tcaatgcgttagtgaacaatctact

SEQ ID NO: 91957 - DNA, 25 bp, E. coli
tacgatctcgcctcgctttgtcagg

SEQ ID NO: 91958 - DNA, 25 bp, E. coli
tacgatctcgccacgctttgtcagg

SEQ ID NO: 91959 - DNA, 25 bp, E. coli
tacgccgtagcgtactgggatatcc

SEQ ID NO: 91960 - DNA, 25 bp, E. coli
tacgccgctgctaaaaggagaatgc

SEQ ID NO: 91961 - DNA, 25 bp, E. coli
tagtgaaaccagcagccaggcgtta

SEQ ID NO: 91962 - DNA, 25 bp, E. coli
tagactttgccattccgctggcggt

SEQ ID NO: 91963 - DNA, 25 bp, E. coli
tagactttgccaatccgctggcggt

SEQ ID NO: 91964 - DNA, 25 bp, E. coli
tacgccgtagcgaactgggatatcc

SEQ ID NO: 91965 - DNA, 25 bp, E. coli
tacgccgctgcttaaaggagaatgc

SEQ ID NO: 91966 - DNA, 25 bp, E. coli
tagtgaaaccaggagccaggcgtta

SEQ ID NO: 91967 - DNA, 25 bp, E. coli
tatctcgtggtgaaaacttaccgcc

SEQ ID NO: 91968 - DNA, 25 bp, E. coli
tatctcgtggtgtaaacttaccgcc

SEQ ID NO: 91969 - DNA, 25 bp, E. coli
tatttaccctgtggcgttatgcggg

SEQ ID NO: 91970 - DNA, 25 bp, E. coli
tatttaccctgtcgcgttatgcggg

SEQ ID NO: 91971 - DNA, 25 bp, E. coli
cgggccgggcggtttatattcatca

SEQ ID NO: 91972 - DNA, 25 bp, E. coli
cgggccgggcggattatattcatca

SEQ ID NO: 91973 - DNA, 25 bp, E. coli
gggctgaacaaagacgatgcactga

SEQ ID NO: 91974 - DNA, 25 bp, E. coli
ggagaatgctatgtccgcccagaaa

SEQ ID NO: 91975 - DNA, 25 bp, E. coli
gggctgaacaaacacgatgcactga

SEQ ID NO: 91976 - DNA, 25 bp, E. coli
ggagaatgctatctccgcccagaaa

SEQ ID NO: 91977 - DNA, 25 bp, E. coli
gacctttatgaacgacgagcagcgc

SEQ ID NO: 91978 - DNA, 25 bp, E. coli
gacctttatgaaggacgagcagcgc

SEQ ID NO: 91979 - DNA, 25 bp, E. coli
catccggcttttttcattatgttga

SEQ ID NO: 91980 - DNA, 25 bp, E. coli
catccggcttttatcattatgttga

SEQ ID NO: 91981 - DNA, 25 bp, E. coli
caatacccggaatagactttcgtca

SEQ ID NO: 91982 - DNA, 25 bp, E. coli
caatacccggaaaagactttcgtca

SEQ ID NO: 91983 - DNA, 25 bp, E. coli
aacaaatctgctcgccggatgtctg

SEQ ID NO: 91984 - DNA, 25 bp, E. coli
aacaaatctgctggccggatgtctg

SEQ ID NO: 91985 - DNA, 25 bp, E. coli
tatcaaaaccttaataacatccgaa

SEQ ID NO: 91986 - DNA, 25 bp, E. coli
tatcaaaacctttataacatccgaa

SEQ ID NO: 91987 - DNA, 25 bp, E. coli
ttacctataaaaaataaccatgtat

SEQ ID NO: 91988 - DNA, 25 bp, E. coli
ttacctataaaatataaccatgtat

SEQ ID NO: 91989 - DNA, 25 bp, E. coli
tccgaaaaagaatgatacgaatagc

SEQ ID NO: 91990 - DNA, 25 bp, E. coli
tccgaaaaagaaagatacgaatagc

SEQ ID NO: 91991 - DNA, 25 bp, E. coli
tctgctcgccggatgtctgactcat

SEQ ID NO: 91992 - DNA, 25 bp, E. coli
tctgctcgccggttgtctgactcat

SEQ ID NO: 91993 - DNA, 25 bp, E. coli
tcaatgtcgttatataaattaccta

SEQ ID NO: 91994 - DNA, 25 bp, E. coli
tcgtcacttttatttaaagggatgt

SEQ ID NO: 91995 - DNA, 25 bp, E. coli
tcgtcacttttaattaaagggatgt

SEQ ID NO: 91996 - DNA, 25 bp, E. coli
tcaatgtcgttaaataaattaccta

SEQ ID NO: 91997 - DNA, 25 bp, E. coli
gaatagcatttacacaatacccgga

SEQ ID NO: 91998 - DNA, 25 bp, E. coli
gaatagcatttagacaatacccgga

SEQ ID NO: 91999 - DNA, 25 bp, E. coli
ggatgtctgactcatccggctttta

SEQ ID NO: 92000 - DNA, 25 bp, E. coli
ggatgtctgactgatccggctttta

SEQ ID NO: 92001 - DNA, 25 bp, E. coli
cactccgggcacaggatcaacgtta

SEQ ID NO: 92002 - DNA, 25 bp, E. coli
cactccgggcactggatcaacgtta

SEQ ID NO: 92003 - DNA, 25 bp, E. coli
cagatacgatatcgctcccgggaaa

SEQ ID NO: 92004 - DNA, 25 bp, E. coli
cagatacgatatggctcccgggaaa

SEQ ID NO: 92005 - DNA, 25 bp, E. coli
aacggagtgcgtcgaaaatgtcgcc

SEQ ID NO: 92006 - DNA, 25 bp, E. coli
aacggagtgcgtggaaaatgtcgcc

SEQ ID NO: 92007 - DNA, 25 bp, E. coli
tatcggttttcgatccccaggacta

SEQ ID NO: 92008 - DNA, 25 bp, E. coli
tatcggttttcgttccccaggacta

SEQ ID NO: 92009 - DNA, 25 bp, E. coli
tatttgtgcttaccagttccggctg

SEQ ID NO: 92010 - DNA, 25 bp, E. coli
tatttgtgcttagcagttccggctg

SEQ ID NO: 92011 - DNA, 25 bp, E. coli
tggtgacagtaaagccacgcgaacc

SEQ ID NO: 92012 - DNA, 25 bp, E. coli
tgttcaaaacctccatgattaccgc

SEQ ID NO: 92013 - DNA, 25 bp, E. coli
tgttcaaaacctgcatgattaccgc

SEQ ID NO: 92014 - DNA, 25 bp, E. coli
ccactgctgattaccgtttccggaa

SEQ ID NO: 92015 - DNA, 25 bp, E. coli
ccactgctgatttccgtttccggaa

SEQ ID NO: 92016 - DNA, 25 bp, E. coli
gcggaaacgatgaaggatttggccc

SEQ ID NO: 92017 - DNA, 25 bp, E. coli
gcggaaacgatgtaggatttggccc

SEQ ID NO: 92018 - DNA, 25 bp, E. coli
gaaagtaacggcgatcgtgtcagtc

SEQ ID NO: 92019 - DNA, 25 bp, E. coli
gacaaatatggtcagacgctggtga

SEQ ID NO: 92020 - DNA, 25 bp, E. coli
gacaaatatggtgagacgctggtga

SEQ ID NO: 92021 - DNA, 25 bp, E. coli
gaaagtaacggccatcgtgtcagtc

SEQ ID NO: 92022 - DNA, 25 bp, E. coli
tggtgacagtaatgccacgcgaacc

SEQ ID NO: 92023 - DNA, 25 bp, E. coli
caatgtggcagcaggtagggttcta

SEQ ID NO: 92024 - DNA, 25 bp, E. coli
caatgtggcagctggtagggttcta

SEQ ID NO: 92025 - DNA, 25 bp, E. coli
aactgtttggcggtaaaggcccgca

SEQ ID NO: 92026 - DNA, 25 bp, E. coli
aactgtttggcgctaaaggcccgca

SEQ ID NO: 92027 - DNA, 25 bp, E. coli
tggtagggttcttcctcggctggct

SEQ ID NO: 92028 - DNA, 25 bp, E. coli
gcgaatcctatacaaaagaagacct

SEQ ID NO: 92029 - DNA, 25 bp, E. coli
gcgaatcctatagaaaagaagacct

SEQ ID NO: 92030 - DNA, 25 bp, E. coli
gaagaccttcttccctctggtcgcg

SEQ ID NO: 92031 - DNA, 25 bp, E. coli
gaagaccttcttgcctctggtcgcg

SEQ ID NO: 92032 - DNA, 25 bp, E. coli
gaaagtcggtctcttccaggatacg

SEQ ID NO: 92033 - DNA, 25 bp, E. coli
gaaagtcggtctgttccaggatacg

SEQ ID NO: 92034 - DNA, 25 bp, E. coli
cggatctgtggtacttcggatgcca

SEQ ID NO: 92035 - DNA, 25 bp, E. coli
ctggatatcaatccggatctgtggt

SEQ ID NO: 92036 - DNA, 25 bp, E. coli
ctggatatcaatgcggatctgtggt

SEQ ID NO: 92037 - DNA, 25 bp, E. coli
cggatctgtggttcttcggatgcca

SEQ ID NO: 92038 - DNA, 25 bp, E. coli
ggtggtaacttcgacaaagggtatg

SEQ ID NO: 92039 - DNA, 25 bp, E. coli
ggtggtaacttccacaaagggtatg

SEQ ID NO: 92040 - DNA, 25 bp, E. coli
tggtagggttctacctcggctggct

SEQ ID NO: 92041 - DNA, 25 bp, E. coli
taaccgtcgtctgattatgggcctg

SEQ ID NO: 92042 - DNA, 25 bp, E. coli
taaccgtcgtctcattatgggcctg

SEQ ID NO: 92043 - DNA, 25 bp, E. coli
gatggaccgtgtcgtcaaaatgacc

SEQ ID NO: 92044 - DNA, 25 bp, E. coli
gatggaccgtgtggtcaaaatgacc

SEQ ID NO: 92045 - DNA, 25 bp, E. coli
aatgcggtgccacgccttgctccgt

SEQ ID NO: 92046 - DNA, 25 bp, E. coli
aatgcggtgccaggccttgctccgt

SEQ ID NO: 92047 - DNA, 25 bp, E. coli
caccccattgattaacctattgaaa

SEQ ID NO: 92048 - DNA, 25 bp, E. coli
caccccattgataaacctattgaaa

SEQ ID NO: 92049 - DNA, 25 bp, E. coli
catcaatggcccaatttacactggg

SEQ ID NO: 92050 - DNA, 25 bp, E. coli
catcaatggccctatttacactggg

SEQ ID NO: 92051 - DNA, 25 bp, E. coli
tatggtgagcaaaagcgttccgttc

SEQ ID NO: 92052 - DNA, 25 bp, E. coli
tatggtgagcaatagcgttccgttc

SEQ ID NO: 92053 - DNA, 25 bp, E. coli
tatcacttgcagaaatgcggtgcca

SEQ ID NO: 92054 - DNA, 25 bp, E. coli
tatcacttgcagtaatgcggtgcca

SEQ ID NO: 92055 - DNA, 25 bp, E. coli
ttgctccgtaacacaccccattgat

SEQ ID NO: 92056 - DNA, 25 bp, E. coli
ttgctccgtaactcaccccattgat

SEQ ID NO: 92057 - DNA, 25 bp, E. coli
ccaatttacactgggtcattactca

SEQ ID NO: 92058 - DNA, 25 bp, E. coli
ccaatttacactcggtcattactca

SEQ ID NO: 92059 - DNA, 25 bp, E. coli
gcgttccgttcctattagacataag

SEQ ID NO: 92060 - DNA, 25 bp, E. coli
gcgttccgttccaattagacataag

SEQ ID NO: 92061 - DNA, 25 bp, E. coli
gctaatgctttagatctccttcgcg

SEQ ID NO: 92062 - DNA, 25 bp, E. coli
gctaatgctttacatctccttcgcg

SEQ ID NO: 92063 - DNA, 25 bp, E. coli
gaataaaattggagtaagtgcgtgg

SEQ ID NO: 92064 - DNA, 25 bp, E. coli
gaataaaattggtgtaagtgcgtgg

SEQ ID NO: 92065 - DNA, 25 bp, E. coli
gggtcattactcttaatatctgcta

SEQ ID NO: 92066 - DNA, 25 bp, E. coli
gggtcattactcataatatctgcta

SEQ ID NO: 92067 - DNA, 25 bp, E. coli
aatccagctccattatttgttataa

SEQ ID NO: 92068 - DNA, 25 bp, E. coli
aatccagctccaatatttgttataa

SEQ ID NO: 92069 - DNA, 25 bp, E. coli
caagcatcaggctatccagctccaa

SEQ ID NO: 92070 - DNA, 25 bp, E. coli
caagcatcaggcaatccagctccaa

SEQ ID NO: 92071 - DNA, 25 bp, E. coli
caggcaatccaggtccaatatttgt

SEQ ID NO: 92072 - DNA, 25 bp, E. coli
caggcaatccagctccaatatttgt

SEQ ID NO: 92073 - DNA, 25 bp, E. coli
tactctgcacaagcatcaggcaatc

SEQ ID NO: 92074 - DNA, 25 bp, E. coli
tactctgcacaaccatcaggcaatc

SEQ ID NO: 92075 - DNA, 25 bp, E. coli
tgcacaagcatcaggcaatccagct

SEQ ID NO: 92076 - DNA, 25 bp, E. coli
tgcacaagcatctggcaatccagct

SEQ ID NO: 92077 - DNA, 25 bp, E. coli
ttactctgcacaagcatcaggcaat

SEQ ID NO: 92078 - DNA, 25 bp, E. coli
tctgcacaagcatcaggcaatccag

SEQ ID NO: 92079 - DNA, 25 bp, E. coli
ttactctgcacatgcatcaggcaat

SEQ ID NO: 92080 - DNA, 25 bp, E. coli
tcaggcaatccacctccaatatttg

SEQ ID NO: 92081 - DNA, 25 bp, E. coli
tctgcacaagcaacaggcaatccag

SEQ ID NO: 92082 - DNA, 25 bp, E. coli
tcaggcaatccagctccaatatttg

SEQ ID NO: 92083 - DNA, 25 bp, E. coli
gcatcaggcaatccagctccaatat

SEQ ID NO: 92084 - DNA, 25 bp, E. coli
gcaatccagctccaatatttgttat

SEQ ID NO: 92085 - DNA, 25 bp, E. coli
gcatcaggcaatgcagctccaatat

SEQ ID NO: 92086 - DNA, 25 bp, E. coli
gcaatccagctcgaatatttgttat

SEQ ID NO: 92087 - DNA, 25 bp, E. coli
ggcaatccagctccaatatttgtta

SEQ ID NO: 92088 - DNA, 25 bp, E. coli
ggcaatccagctgcaatatttgtta

SEQ ID NO: 92089 - DNA, 25 bp, E. coli
tacgggactggacatcaatatgctt

SEQ ID NO: 92090 - DNA, 25 bp, E. coli
tacgggactggagatcaatatgctt

SEQ ID NO: 92091 - DNA, 25 bp, E. coli
ttgcttttgcgctaacccgctggca

SEQ ID NO: 92092 - DNA, 25 bp, E. coli
ttacctcggtatgccttgtgactgg

SEQ ID NO: 92093 - DNA, 25 bp, E. coli
ttgcttttgcgcaaacccgctggca

SEQ ID NO: 92094 - DNA, 25 bp, E. coli
ttacctcggtatcccttgtgactgg

SEQ ID NO: 92095 - DNA, 25 bp, E. coli
tgataaatgcttataaacccgcccg

SEQ ID NO: 92096 - DNA, 25 bp, E. coli
tgataaatgcttttaaacccgcccg

SEQ ID NO: 92097 - DNA, 25 bp, E. coli
cgaacaaaaataggcgccaggtgaa

SEQ ID NO: 92098 - DNA, 25 bp, E. coli
cgaacaaaaatacgcgccaggtgaa

SEQ ID NO: 92099 - DNA, 25 bp, E. coli
gctccgtaaactgctttcagtggga

SEQ ID NO: 92100 - DNA, 25 bp, E. coli
gctccgtaaactcctttcagtggga

SEQ ID NO: 92101 - DNA, 25 bp, E. coli
gatatgtcctaatatgccgctcgcg

SEQ ID NO: 92102 - DNA, 25 bp, E. coli
gatatgtcctaaaatgccgctcgcg

SEQ ID NO: 92103 - DNA, 25 bp, E. coli
ggtgaatttccctctggcgcgtaga

SEQ ID NO: 92104 - DNA, 25 bp, E. coli
ggtgaatttcccactggcgcgtaga

SEQ ID NO: 92105 - DNA, 25 bp, E. coli
ggcatcaagcgccacacagacgtaa

SEQ ID NO: 92106 - DNA, 25 bp, E. coli
ggcatcaagcgcgacacagacgtaa

SEQ ID NO: 92107 - DNA, 25 bp, E. coli
taattaagtgatttcgacagcgcgt

SEQ ID NO: 92108 - DNA, 25 bp, E. coli
taatttgcttcggacgttggacgta

SEQ ID NO: 92109 - DNA, 25 bp, E. coli
taattaagtgatatcgacagcgcgt

SEQ ID NO: 92110 - DNA, 25 bp, E. coli
taatttgcttcgcacgttggacgta

SEQ ID NO: 92111 - DNA, 25 bp, E. coli
aaggcactcgcctggatctggatcg

SEQ ID NO: 92112 - DNA, 25 bp, E. coli
aaggcactcgccaggatctggatcg

SEQ ID NO: 92113 - DNA, 25 bp, E. coli
aactatttctgatcgcgttgctgcg

SEQ ID NO: 92114 - DNA, 25 bp, E. coli
aactatttctgaacgcgttgctgcg

SEQ ID NO: 92115 - DNA, 25 bp, E. coli
taccaggttgttgtcgctgacagcc

SEQ ID NO: 92116 - DNA, 25 bp, E. coli
taccaggttgttctcgctgacagcc

SEQ ID NO: 92117 - DNA, 25 bp, E. coli
tattcgtttagcacgtcacggcgct

SEQ ID NO: 92118 - DNA, 25 bp, E. coli
tattcgtttagctcgtcacggcgct

SEQ ID NO: 92119 - DNA, 25 bp, E. coli
tgcacgcaacggtcgcttcatcgag

SEQ ID NO: 92120 - DNA, 25 bp, E. coli
tgcacgcaacggacgcttcatcgag

SEQ ID NO: 92121 - DNA, 25 bp, E. coli
tgctgcgctgatcaaagaagtaaac

SEQ ID NO: 92122 - DNA, 25 bp, E. coli
tgctgcgctgatgaaagaagtaaac

SEQ ID NO: 92123 - DNA, 25 bp, E. coli
tctggatcgcatcgctcactgggtt

SEQ ID NO: 92124 - DNA, 25 bp, E. coli
tctggatcgcatggctcactgggtt

SEQ ID NO: 92125 - DNA, 25 bp, E. coli
gctgacagccgttatgcacgcaacg

SEQ ID NO: 92126 - DNA, 25 bp, E. coli
gctagcgaaaaacaagaaggcactc

SEQ ID NO: 92127 - DNA, 25 bp, E. coli
gctgacagccgtaatgcacgcaacg

SEQ ID NO: 92128 - DNA, 25 bp, E. coli
gctagcgaaaaagaagaaggcactc

SEQ ID NO: 92129 - DNA, 25 bp, E. coli
gctaaaaagcgtccgttctaccagg

SEQ ID NO: 92130 - DNA, 25 bp, E. coli
gctaaaaagcgtgcgttctaccagg

SEQ ID NO: 92131 - DNA, 25 bp, E. coli
gtttcttcaacccaatcgctagcga

SEQ ID NO: 92132 - DNA, 25 bp, E. coli
gtttcttcaaccgaatcgctagcga

SEQ ID NO: 92133 - DNA, 25 bp, E. coli
cactgttaacgagaaaatttagtga

SEQ ID NO: 92134 - DNA, 25 bp, E. coli
cactgttaacgacaaaatttagtga

SEQ ID NO: 92135 - DNA, 25 bp, E. coli
cagggcgcaggaaaggtttcataac

SEQ ID NO: 92136 - DNA, 25 bp, E. coli
cagggcgcaggataggtttcataac

SEQ ID NO: 92137 - DNA, 25 bp, E. coli
aaacaaggtggtttacagggcgcag

SEQ ID NO: 92138 - DNA, 25 bp, E. coli
aacttgatcataaaaaattgatcga

SEQ ID NO: 92139 - DNA, 25 bp, E. coli
aacttgatcatataaaattgatcga

SEQ ID NO: 92140 - DNA, 25 bp, E. coli
aaaaattgatcgataataattctca

SEQ ID NO: 92141 - DNA, 25 bp, E. coli
aaacaaggtggtatacagggcgcag

SEQ ID NO: 92142 - DNA, 25 bp, E. coli
aaaaattgatcgttaataattctca

SEQ ID NO: 92143 - DNA, 25 bp, E. coli
tttacagggcgctggataggtttca

SEQ ID NO: 92144 - DNA, 25 bp, E. coli
tttacagggcgcaggataggtttca

SEQ ID NO: 92145 - DNA, 25 bp, E. coli
gcatggggggataaccataaaaaca

SEQ ID NO: 92146 - DNA, 25 bp, E. coli
gcatggggggattaccataaaaaca

SEQ ID NO: 92147 - DNA, 25 bp, E. coli
gacaaaatttagagatgaggcatgg

SEQ ID NO: 92148 - DNA, 25 bp, E. coli
gacaaaatttagtgatgaggcatgg

SEQ ID NO: 92149 - DNA, 25 bp, E. coli
cccctgtttattgtgttaatggtgg

SEQ ID NO: 92150 - DNA, 25 bp, E. coli
cccctgtttattctgttaatggtgg

SEQ ID NO: 92151 - DNA, 25 bp, E. coli
taattctcattaacacgtttgcatt

SEQ ID NO: 92152 - DNA, 25 bp, E. coli
taattctcattatcacgtttgcatt

SEQ ID NO: 92153 - DNA, 25 bp, E. coli
ggcgcaggatagctttcataacccc

SEQ ID NO: 92154 - DNA, 25 bp, E. coli
ggcgcaggataggtttcataacccc

SEQ ID NO: 92155 - DNA, 25 bp, E. coli
caagttgcgtggagttcggcatgcc

SEQ ID NO: 92156 - DNA, 25 bp, E. coli
aatcaaaattcaggatggcccggcg

SEQ ID NO: 92157 - DNA, 25 bp, E. coli
aatcaaaattcacgatggcccggcg

SEQ ID NO: 92158 - DNA, 25 bp, E. coli
caagttgcgtggtgttcggcatgcc

SEQ ID NO: 92159 - DNA, 25 bp, E. coli
catcaatatgggaggtgtctgcgaa

SEQ ID NO: 92160 - DNA, 25 bp, E. coli
catcaatatgggtggtgtctgcgaa

SEQ ID NO: 92161 - DNA, 25 bp, E. coli
ttttgtcaccaatccgcaactgggt

SEQ ID NO: 92162 - DNA, 25 bp, E. coli
ttttgtcaccaaaccgcaactgggt

SEQ ID NO: 92163 - DNA, 25 bp, E. coli
tgttaattacccagcatatgccgcc

SEQ ID NO: 92164 - DNA, 25 bp, E. coli
tgttaattaccctgcatatgccgcc

SEQ ID NO: 92165 - DNA, 25 bp, E. coli
tgccggacaggccatacgtatttaa

SEQ ID NO: 92166 - DNA, 25 bp, E. coli
tgccggacaggcgatacgtatttaa

SEQ ID NO: 92167 - DNA, 25 bp, E. coli
ggcatggacccttgcgcaaaacgaa

SEQ ID NO: 92168 - DNA, 25 bp, E. coli
tggtttcttcccagaccggcaaagg

SEQ ID NO: 92169 - DNA, 25 bp, E. coli
ggcatggaccctagcgcaaaacgaa

SEQ ID NO: 92170 - DNA, 25 bp, E. coli
tggtttcttccctgaccggcaaagg

SEQ ID NO: 92171 - DNA, 25 bp, E. coli
taatgcgtttgcctccaatgcccgt

SEQ ID NO: 92172 - DNA, 25 bp, E. coli
tcaacgggtggatctgaggcaattc

SEQ ID NO: 92173 - DNA, 25 bp, E. coli
tcaacgggtggaactgaggcaattc

SEQ ID NO: 92174 - DNA, 25 bp, E. coli
taatgcgtttgcgtccaatgcccgt

SEQ ID NO: 92175 - DNA, 25 bp, E. coli
gatggacggactggatttcctcgaa

SEQ ID NO: 92176 - DNA, 25 bp, E. coli
gatggacggactcgatttcctcgaa

SEQ ID NO: 92177 - DNA, 25 bp, E. coli
ctcgacaggatcgaacaagggttaa

SEQ ID NO: 92178 - DNA, 25 bp, E. coli
ctcgacaggatccaacaagggttaa

SEQ ID NO: 92179 - DNA, 25 bp, E. coli
catttccagaatcgtctcgacagga

SEQ ID NO: 92180 - DNA, 25 bp, E. coli
cctttttcaactttcggccctggtg

SEQ ID NO: 92181 - DNA, 25 bp, E. coli
cctttttcaactatcggccctggtg

SEQ ID NO: 92182 - DNA, 25 bp, E. coli
tataaagaacttcttcaggagcgga

SEQ ID NO: 92183 - DNA, 25 bp, E. coli
tataaagaacttgttcaggagcgga

SEQ ID NO: 92184 - DNA, 25 bp, E. coli
tcttgacgattttcgcgcatttcca

SEQ ID NO: 92185 - DNA, 25 bp, E. coli
tcttgacgatttacgcgcatttcca

SEQ ID NO: 92186 - DNA, 25 bp, E. coli
gccctggtgtgcgagagattcgtac

SEQ ID NO: 92187 - DNA, 25 bp, E. coli
gccctggtgtgccagagattcgtac

SEQ ID NO: 92188 - DNA, 25 bp, E. coli
gcttttcttgattccagtcttgacg

SEQ ID NO: 92189 - DNA, 25 bp, E. coli
gcttttcttgataccagtcttgacg

SEQ ID NO: 92190 - DNA, 25 bp, E. coli
gaaattggctatgaactcgacagga

SEQ ID NO: 92191 - DNA, 25 bp, E. coli
gaaattggctatcaactcgacagga

SEQ ID NO: 92192 - DNA, 25 bp, E. coli
catttccagaatggtctcgacagga

SEQ ID NO: 92193 - DNA, 25 bp, E. coli
gatattgatttagccaaacgacgct

SEQ ID NO: 92194 - DNA, 25 bp, E. coli
gatattgatttacccaaacgacgct

SEQ ID NO: 92195 - DNA, 25 bp, E. coli
gagattcgtactggcgatgctgatg

SEQ ID NO: 92196 - DNA, 25 bp, E. coli
gatgctgatgggttctatcgcgtca

SEQ ID NO: 92197 - DNA, 25 bp, E. coli
gagattcgtactcgcgatgctgatg

SEQ ID NO: 92198 - DNA, 25 bp, E. coli
gatgctgatgggatctatcgcgtca

SEQ ID NO: 92199 - DNA, 25 bp, E. coli
caagagatttcatatttgggagagc

SEQ ID NO: 92200 - DNA, 25 bp, E. coli
caagagatttcaaatttgggagagc

SEQ ID NO: 92201 - DNA, 25 bp, E. coli
aagtagtcaaattcaccacgccctg

SEQ ID NO: 92202 - DNA, 25 bp, E. coli
aagtagtcaaatacaccacgccctg

SEQ ID NO: 92203 - DNA, 25 bp, E. coli
caaaaagtagtctaattcaccacgc

SEQ ID NO: 92204 - DNA, 25 bp, E. coli
caaaaagtagtcaaattcaccacgc

SEQ ID NO: 92205 - DNA, 25 bp, E. coli
catatttgggagagcatcatgctgg

SEQ ID NO: 92206 - DNA, 25 bp, E. coli
catatttgggagtgcatcatgctgg

SEQ ID NO: 92207 - DNA, 25 bp, E. coli
tttgggagagcaacatgctggaact

SEQ ID NO: 92208 - DNA, 25 bp, E. coli
tttgggagagcatcatgctggaact

SEQ ID NO: 92209 - DNA, 25 bp, E. coli
tttttggcatgattcttgtaatgcc

SEQ ID NO: 92210 - DNA, 25 bp, E. coli
tttttggcatgaatcttgtaatgcc

SEQ ID NO: 92211 - DNA, 25 bp, E. coli
tcaccaaaaagtagtcaaattcacc

SEQ ID NO: 92212 - DNA, 25 bp, E. coli
gcggataagcgttaacttttcacca

SEQ ID NO: 92213 - DNA, 25 bp, E. coli
gcggataagcgtaaacttttcacca

SEQ ID NO: 92214 - DNA, 25 bp, E. coli
gattatttttgggatgattcttgta

SEQ ID NO: 92215 - DNA, 25 bp, E. coli
gtagtcaaattcaccacgccctgcg

SEQ ID NO: 92216 - DNA, 25 bp, E. coli
gattatttttggcatgattcttgta

SEQ ID NO: 92217 - DNA, 25 bp, E. coli
ggagagcatcatgctggaactactt

SEQ ID NO: 92218 - DNA, 25 bp, E. coli
gtagtcaaattctccacgccctgcg

SEQ ID NO: 92219 - DNA, 25 bp, E. coli
ggagagcatcatcctggaactactt

SEQ ID NO: 92220 - DNA, 25 bp, E. coli
tcaccaaaaagttgtcaaattcacc

SEQ ID NO: 92221 - DNA, 25 bp, E. coli
gaatgttgaaacagtagcccgttcc

SEQ ID NO: 92222 - DNA, 25 bp, E. coli
caaccaaccgggtagcagtgatgat

SEQ ID NO: 92223 - DNA, 25 bp, E. coli
caaccaaccgggaagcagtgatgat

SEQ ID NO: 92224 - DNA, 25 bp, E. coli
gaatgttgaaactgtagcccgttcc

SEQ ID NO: 92225 - DNA, 25 bp, E. coli
caaaatgaatatggtggtagcgcaa

SEQ ID NO: 92226 - DNA, 25 bp, E. coli
caaaatgaatatcgtggtagcgcaa

SEQ ID NO: 92227 - DNA, 25 bp, E. coli
tagcgcaagatctctacccggaatc

SEQ ID NO: 92228 - DNA, 25 bp, E. coli
tagcgcaagatcactacccggaatc

SEQ ID NO: 92229 - DNA, 25 bp, E. coli
tttgaagaagctcagcatggcaccg

SEQ ID NO: 92230 - DNA, 25 bp, E. coli
tttgaagaagctgagcatggcaccg

SEQ ID NO: 92231 - DNA, 25 bp, E. coli
tgtgccgattgtggacgatcacctg

SEQ ID NO: 92232 - DNA, 25 bp, E. coli
tgtgccgattgtcgacgatcacctg

SEQ ID NO: 92233 - DNA, 25 bp, E. coli
tcagcaatggcgtgcggcgtgttta

SEQ ID NO: 92234 - DNA, 25 bp, E. coli
gcgtgtttatgatcgaatgcgtcca

SEQ ID NO: 92235 - DNA, 25 bp, E. coli
gcgtgtttatgaacgaatgcgtcca

SEQ ID NO: 92236 - DNA, 25 bp, E. coli
ccgcgagctaaaagaagaggttgga

SEQ ID NO: 92237 - DNA, 25 bp, E. coli
ccgcgagctaaatgaagaggttgga

SEQ ID NO: 92238 - DNA, 25 bp, E. coli
ggccgctggcgcttatgatggattt

SEQ ID NO: 92239 - DNA, 25 bp, E. coli
ggcaccgtcttacttttccagcaaa

SEQ ID NO: 92240 - DNA, 25 bp, E. coli
ggcaccgtcttagttttccagcaaa

SEQ ID NO: 92241 - DNA, 25 bp, E. coli
ggccgctggcgcatatgatggattt

SEQ ID NO: 92242 - DNA, 25 bp, E. coli
tcagcaatggcgagcggcgtgttta

SEQ ID NO: 92243 - DNA, 25 bp, E. coli
cacaggccgtggtatttaatgataa

SEQ ID NO: 92244 - DNA, 25 bp, E. coli
cacaggccgtggaatttaatgataa

SEQ ID NO: 92245 - DNA, 25 bp, E. coli
caggaggaagcaggtgaaaaaactc

SEQ ID NO: 92246 - DNA, 25 bp, E. coli
caggaggaagcacgtgaaaaaactc

SEQ ID NO: 92247 - DNA, 25 bp, E. coli
aatgacccggaatgtcggttgcctg

SEQ ID NO: 92248 - DNA, 25 bp, E. coli
aatgacccggaaagtcggttgcctg

SEQ ID NO: 92249 - DNA, 25 bp, E. coli
ttggcgtcagcatacggcaaatcgc

SEQ ID NO: 92250 - DNA, 25 bp, E. coli
ttggcgtcagcaaacggcaaatcgc

SEQ ID NO: 92251 - DNA, 25 bp, E. coli
gccttaattaccacgctacaggatg

SEQ ID NO: 92252 - DNA, 25 bp, E. coli
gccttaattacctcgctacaggatg

SEQ ID NO: 92253 - DNA, 25 bp, E. coli
gcgatattgatacgccgggtgaata

SEQ ID NO: 92254 - DNA, 25 bp, E. coli
gcgatattgataggccgggtgaata

SEQ ID NO: 92255 - DNA, 25 bp, E. coli
gcagcaactggtggattatctggca

SEQ ID NO: 92256 - DNA, 25 bp, E. coli
gcagcaactggtcgattatctggca

SEQ ID NO: 92257 - DNA, 25 bp, E. coli
cgcgaaagttattgcttgagacggg

SEQ ID NO: 92258 - DNA, 25 bp, E. coli
cgcgaaagttatagcttgagacggg

SEQ ID NO: 92259 - DNA, 25 bp, E. coli
ccccgctggtatgacgccttaatta

SEQ ID NO: 92260 - DNA, 25 bp, E. coli
ccccgctggtatcacgccttaatta

SEQ ID NO: 92261 - DNA, 25 bp, E. coli
tggcatctctcaccaaacaggagga

SEQ ID NO: 92262 - DNA, 25 bp, E. coli
tggcatctctcagcaaacaggagga

SEQ ID NO: 92263 - DNA, 25 bp, E. coli
ggcaaatcgccgtcatcagtaaaac

SEQ ID NO: 92264 - DNA, 25 bp, E. coli
ggcaaatcgccgacatcagtaaaac

SEQ ID NO: 92265 - DNA, 25 bp, E. coli
caacctgccgcttttattcgtataa

SEQ ID NO: 92266 - DNA, 25 bp, E. coli
caacctgccgctattattcgtataa

SEQ ID NO: 92267 - DNA, 25 bp, E. coli
cactagcgaagatatcaacgatgcg

SEQ ID NO: 92268 - DNA, 25 bp, E. coli
cactagcgaagaaatcaacgatgcg

SEQ ID NO: 92269 - DNA, 25 bp, E. coli
catcactgggtgacgtatgctgaag

SEQ ID NO: 92270 - DNA, 25 bp, E. coli
catcactgggtgtcgtatgctgaag

SEQ ID NO: 92271 - DNA, 25 bp, E. coli
agatcgataaacagcacgcgctgcg

SEQ ID NO: 92272 - DNA, 25 bp, E. coli
agatcgataaactgcacgcgctgcg

SEQ ID NO: 92273 - DNA, 25 bp, E. coli
tcggtatccatgtccttaagctggc

SEQ ID NO: 92274 - DNA, 25 bp, E. coli
tcggtatccatgaccttaagctggc

SEQ ID NO: 92275 - DNA, 25 bp, E. coli
tcagcatgtagagaataaccgtttc

SEQ ID NO: 92276 - DNA, 25 bp, E. coli
gaataaccgtttgtctttgctggaa

SEQ ID NO: 92277 - DNA, 25 bp, E. coli
gaataaccgtttctctttgctggaa

SEQ ID NO: 92278 - DNA, 25 bp, E. coli
gaagaagaaattaacaaccgtcagg

SEQ ID NO: 92279 - DNA, 25 bp, E. coli
gaagaagaaatttacaaccgtcagg

SEQ ID NO: 92280 - DNA, 25 bp, E. coli
gatatcgcacgtcaacatcactggg

SEQ ID NO: 92281 - DNA, 25 bp, E. coli
gatatcgcacgtgaacatcactggg

SEQ ID NO: 92282 - DNA, 25 bp, E. coli
taactcaggatgagctcgatatcgc

SEQ ID NO: 92283 - DNA, 25 bp, E. coli
taactcaggatgtgctcgatatcgc

SEQ ID NO: 92284 - DNA, 25 bp, E. coli
tcagcatgtagacaataaccgtttc

SEQ ID NO: 92285 - DNA, 25 bp, E. coli
gatgcgctgaattatcgcaccgtaa

SEQ ID NO: 92286 - DNA, 25 bp, E. coli
gatgcgctgaataatcgcaccgtaa

SEQ ID NO: 92287 - DNA, 25 bp, E. coli
aagagctggagcgtgagaacaacca

SEQ ID NO: 92288 - DNA, 25 bp, E. coli
aagagctggagcctgagaacaacca

SEQ ID NO: 92289 - DNA, 25 bp, E. coli
tagaagtgtttgtgaaactggaagc

SEQ ID NO: 92290 - DNA, 25 bp, E. coli
tacagcaggcgaatgataccatcac

SEQ ID NO: 92291 - DNA, 25 bp, E. coli
tagaagtgtttgagaaactggaagc

SEQ ID NO: 92292 - DNA, 25 bp, E. coli
tacagcaggcgattgataccatcac

SEQ ID NO: 92293 - DNA, 25 bp, E. coli
agaacggctggcaggaacgtctgca

SEQ ID NO: 92294 - DNA, 25 bp, E. coli
agaacggctggctggaacgtctgca

SEQ ID NO: 92295 - DNA, 25 bp, E. coli
tgtcgcaggaagttcaaaatgccca

SEQ ID NO: 92296 - DNA, 25 bp, E. coli
tgtcgcaggaagatcaaaatgccca

SEQ ID NO: 92297 - DNA, 25 bp, E. coli
tgttgcagatggaaatcgaagagct

SEQ ID NO: 92298 - DNA, 25 bp, E. coli
tgttgcagatggtaatcgaagagct

SEQ ID NO: 92299 - DNA, 25 bp, E. coli
tctgcaggccctgctgggtcgcatg

SEQ ID NO: 92300 - DNA, 25 bp, E. coli
tctgcaggccctcctgggtcgcatg

SEQ ID NO: 92301 - DNA, 25 bp, E. coli
gaacaaccatctgaaagaacagcag

SEQ ID NO: 92302 - DNA, 25 bp, E. coli
gaacaaccatctcaaagaacagcag

SEQ ID NO: 92303 - DNA, 25 bp, E. coli
gataccatcactgtgttgcagatgg

SEQ ID NO: 92304 - DNA, 25 bp, E. coli
gataccatcactctgttgcagatgg

SEQ ID NO: 92305 - DNA, 25 bp, E. coli
tggaagcaaaagaacagcaggcgat

SEQ ID NO: 92306 - DNA, 25 bp, E. coli
tggaagcaaaagtacagcaggcgat

SEQ ID NO: 92307 - DNA, 25 bp, E. coli
tcaaaatgcccaccatcagcgcgaa

SEQ ID NO: 92308 - DNA, 25 bp, E. coli
tcaaaatgcccagcatcagcgcgaa

SEQ ID NO: 92309 - DNA, 25 bp, E. coli
cagaatcgttctggctgcgatgaac

SEQ ID NO: 92310 - DNA, 25 bp, E. coli
cacgttttgcggaatcgctgtactc

SEQ ID NO: 92311 - DNA, 25 bp, E. coli
cacgttttgcggtatcgctgtactc

SEQ ID NO: 92312 - DNA, 25 bp, E. coli
cagaatcgttctcgctgcgatgaac

SEQ ID NO: 92313 - DNA, 25 bp, E. coli
agcagggcatcgtcatcgacgctga

SEQ ID NO: 92314 - DNA, 25 bp, E. coli
agcagggcatcgacatcgacgctga

SEQ ID NO: 92315 - DNA, 25 bp, E. coli
tgtatgatattcacgtccatcgacg

SEQ ID NO: 92316 - DNA, 25 bp, E. coli
tgtatgatattctcgtccatcgacg

SEQ ID NO: 92317 - DNA, 25 bp, E. coli
gctaacgtgttcagaatcgttctgg

SEQ ID NO: 92318 - DNA, 25 bp, E. coli
gctgtactcttttgcggttttcatc

SEQ ID NO: 92319 - DNA, 25 bp, E. coli
gctgcgatgaacatcgctttcgcta

SEQ ID NO: 92320 - DNA, 25 bp, E. coli
gctgcgatgaacttcgctttcgcta

SEQ ID NO: 92321 - DNA, 25 bp, E. coli
gctgtactctttagcggttttcatc

SEQ ID NO: 92322 - DNA, 25 bp, E. coli
gctaacgtgttctgaatcgttctgg

SEQ ID NO: 92323 - DNA, 25 bp, E. coli
gaatatccagttcgaaggcatccgc

SEQ ID NO: 92324 - DNA, 25 bp, E. coli
gaatatccagttggaaggcatccgc

SEQ ID NO: 92325 - DNA, 25 bp, E. coli
ggcatccgccaattcacgccatgta

SEQ ID NO: 92326 - DNA, 25 bp, E. coli
ggcatccgccaaatcacgccatgta

SEQ ID NO: 92327 - DNA, 25 bp, E. coli
taatttcattgatcgccgccagcag

SEQ ID NO: 92328 - DNA, 25 bp, E. coli
taatttcattgaacgccgccagcag

SEQ ID NO: 92329 - DNA, 25 bp, E. coli
gacgctgacctctcgttttgcggta

SEQ ID NO: 92330 - DNA, 25 bp, E. coli
gacgctgacctcacgttttgcggta

SEQ ID NO: 92331 - DNA, 25 bp, E. coli
gaagggattttctgcggcgtaagct

SEQ ID NO: 92332 - DNA, 25 bp, E. coli
gaagggattttcagcggcgtaagct

SEQ ID NO: 92333 - DNA, 25 bp, E. coli
aaagaacagggcatggaaggcgcac

SEQ ID NO: 92334 - DNA, 25 bp, E. coli
aaagaacagggcttggaaggcgcac

SEQ ID NO: 92335 - DNA, 25 bp, E. coli
ttttctgcggcgaaagctccggcgg

SEQ ID NO: 92336 - DNA, 25 bp, E. coli
ttttctgcggcgtaagctccggcgg

SEQ ID NO: 92337 - DNA, 25 bp, E. coli
tgcctacggtgcagaactgattctg

SEQ ID NO: 92338 - DNA, 25 bp, E. coli
tgcctacggtgctgaactgattctg

SEQ ID NO: 92339 - DNA, 25 bp, E. coli
tctggcgcttgatatggcgaatcgc

SEQ ID NO: 92340 - DNA, 25 bp, E. coli
tctggcgcttgaaatggcgaatcgc

SEQ ID NO: 92341 - DNA, 25 bp, E. coli
gccggaagaaggcagcagtattccc

SEQ ID NO: 92342 - DNA, 25 bp, E. coli
cctgcagccggatgaaggcagcagt

SEQ ID NO: 92343 - DNA, 25 bp, E. coli
gccggaagaagggagcagtattccc

SEQ ID NO: 92344 - DNA, 25 bp, E. coli
cctgcagccggaagaaggcagcagt

SEQ ID NO: 92345 - DNA, 25 bp, E. coli
gcgatgcgtgcctacggtgcagaac

SEQ ID NO: 92346 - DNA, 25 bp, E. coli
gcaaactggcgggcgtattacccat

SEQ ID NO: 92347 - DNA, 25 bp, E. coli
gcttgaaatggccaatcgcggcgaa

SEQ ID NO: 92348 - DNA, 25 bp, E. coli
gcgatgcgtgccaacggtgcagaac

SEQ ID NO: 92349 - DNA, 25 bp, E. coli
gcaaactggcggccgtattacccat

SEQ ID NO: 92350 - DNA, 25 bp, E. coli
gcttgaaatggcgaatcgcggcgaa

SEQ ID NO: 92351 - DNA, 25 bp, E. coli
cgaactggcagtccgggaagggatt

SEQ ID NO: 92352 - DNA, 25 bp, E. coli
cgaactggcagtgcgggaagggatt

SEQ ID NO: 92353 - DNA, 25 bp, E. coli
aatgctctcgccctctgctgtgctg

SEQ ID NO: 92354 - DNA, 25 bp, E. coli
aatgctctcgccgtctgctgtgctg

SEQ ID NO: 92355 - DNA, 25 bp, E. coli
aaccaccagaaggtacgcgaactgg

SEQ ID NO: 92356 - DNA, 25 bp, E. coli
aaccaccagaagctacgcgaactgg

SEQ ID NO: 92357 - DNA, 25 bp, E. coli
tgcaacgaatggcaacgcctcaaaa

SEQ ID NO: 92358 - DNA, 25 bp, E. coli
tgcaacgaatgggaacgcctcaaaa

SEQ ID NO: 92359 - DNA, 25 bp, E. coli
tcgctgatttctccgcaacgctggg

SEQ ID NO: 92360 - DNA, 25 bp, E. coli
tcgctgatttctgcgcaacgctggg

SEQ ID NO: 92361 - DNA, 25 bp, E. coli
gccggaagcaatgcagcaagagctg

SEQ ID NO: 92362 - DNA, 25 bp, E. coli
gccggaagcaatccagcaagagctg

SEQ ID NO: 92363 - DNA, 25 bp, E. coli
gaactggcatttgccctgcaacgaa

SEQ ID NO: 92364 - DNA, 25 bp, E. coli
gaactggcatttcccctgcaacgaa

SEQ ID NO: 92365 - DNA, 25 bp, E. coli
tggatcagctggtgcacgccagaac

SEQ ID NO: 92366 - DNA, 25 bp, E. coli
tggcgaaccggatacgccggaagca

SEQ ID NO: 92367 - DNA, 25 bp, E. coli
tggatcagctggagcacgccagaac

SEQ ID NO: 92368 - DNA, 25 bp, E. coli
tggcgaaccggaaacgccggaagca

SEQ ID NO: 92369 - DNA, 25 bp, E. coli
tcacgctccatcttgaaatcgctga

SEQ ID NO: 92370 - DNA, 25 bp, E. coli
tcaaaaattactggcatttcgcgca

SEQ ID NO: 92371 - DNA, 25 bp, E. coli
tcaaaaattactcgcatttcgcgca

SEQ ID NO: 92372 - DNA, 25 bp, E. coli
tcacgctccatcatgaaatcgctga

SEQ ID NO: 92373 - DNA, 25 bp, E. coli
gagctgctgcaaggcatcgataacg

SEQ ID NO: 92374 - DNA, 25 bp, E. coli
gagctgctgcaacgcatcgataacg

SEQ ID NO: 92375 - DNA, 25 bp, E. coli
caagttcgcgatgagttaaccgcca

SEQ ID NO: 92376 - DNA, 25 bp, E. coli
caagttcgcgatcagttaaccgcca

SEQ ID NO: 92377 - DNA, 25 bp, E. coli
catttaatgcgtgttgccagcggcc

SEQ ID NO: 92378 - DNA, 25 bp, E. coli
catcaggataaccacgcggttagcc

SEQ ID NO: 92379 - DNA, 25 bp, E. coli
catcaggataacgacgcggttagcc

SEQ ID NO: 92380 - DNA, 25 bp, E. coli
tgaagaagatctccgtaaaagcctc

SEQ ID NO: 92381 - DNA, 25 bp, E. coli
tgcaagaggcgttaatccgctggct

SEQ ID NO: 92382 - DNA, 25 bp, E. coli
tgaagaagatctgcgtaaaagcctc

SEQ ID NO: 92383 - DNA, 25 bp, E. coli
tgcaagaggcgtaaatccgctggct

SEQ ID NO: 92384 - DNA, 25 bp, E. coli
tcgctctctacggtcacagtgttgc

SEQ ID NO: 92385 - DNA, 25 bp, E. coli
tcgctctctacgctcacagtgttgc

SEQ ID NO: 92386 - DNA, 25 bp, E. coli
cgcagcggttgaggcggaaactatt

SEQ ID NO: 92387 - DNA, 25 bp, E. coli
cgaatttatggcctggctgcgagca

SEQ ID NO: 92388 - DNA, 25 bp, E. coli
cgcagcggttgacgcggaaactatt

SEQ ID NO: 92389 - DNA, 25 bp, E. coli
cgaatttatggcgtggctgcgagca

SEQ ID NO: 92390 - DNA, 25 bp, E. coli
cattcgcgagtaacgcagccaggca

SEQ ID NO: 92391 - DNA, 25 bp, E. coli
cattcgcgagtatcgcagccaggca

SEQ ID NO: 92392 - DNA, 25 bp, E. coli
catttaatgcgtcttgccagcggcc

SEQ ID NO: 92393 - DNA, 25 bp, E. coli
ggaaactattgtggctcaggaaacc

SEQ ID NO: 92394 - DNA, 25 bp, E. coli
ggaaactattgtcgctcaggaaacc

SEQ ID NO: 92395 - DNA, 25 bp, E. coli
taaccgcttgatgcatgcgccaacg

SEQ ID NO: 92396 - DNA, 25 bp, E. coli
taaccgcttgatccatgcgccaacg

SEQ ID NO: 92397 - DNA, 25 bp, E. coli
caatatctggagttcttcgctgata

SEQ ID NO: 92398 - DNA, 25 bp, E. coli
caatatctggagatcttcgctgata

SEQ ID NO: 92399 - DNA, 25 bp, E. coli
atgcacgccacctttcatcatctga

SEQ ID NO: 92400 - DNA, 25 bp, E. coli
atgcacgccaccattcatcatctga

SEQ ID NO: 92401 - DNA, 25 bp, E. coli
actttgcagcaaagcacgccaccat

SEQ ID NO: 92402 - DNA, 25 bp, E. coli
actttgcagcaatgcacgccaccat

SEQ ID NO: 92403 - DNA, 25 bp, E. coli
tatcttttatcgtcgccagttccgc

SEQ ID NO: 92404 - DNA, 25 bp, E. coli
tatcttttatcgacgccagttccgc

SEQ ID NO: 92405 - DNA, 25 bp, E. coli
tgtgcaatgccgattggcgcaaatg

SEQ ID NO: 92406 - DNA, 25 bp, E. coli
tgtgcaatgccgtttggcgcaaatg

SEQ ID NO: 92407 - DNA, 25 bp, E. coli
tgcgttgtgcaaagccgtttggcgc

SEQ ID NO: 92408 - DNA, 25 bp, E. coli
tgcgttgtgcaatgccgtttggcgc

SEQ ID NO: 92409 - DNA, 25 bp, E. coli
tcgccagttccgcaacaatatctgg

SEQ ID NO: 92410 - DNA, 25 bp, E. coli
tcgccagttccggaacaatatctgg

SEQ ID NO: 92411 - DNA, 25 bp, E. coli
gcgactttgcaggaatgcacgccac

SEQ ID NO: 92412 - DNA, 25 bp, E. coli
gcgactttgcagcaatgcacgccac

SEQ ID NO: 92413 - DNA, 25 bp, E. coli
gcgcaaatgatcattgcgactttgc

SEQ ID NO: 92414 - DNA, 25 bp, E. coli
gcgcaaatgatctttgcgactttgc

SEQ ID NO: 92415 - DNA, 25 bp, E. coli
gcaatgccgtttggcgcaaatgatc

SEQ ID NO: 92416 - DNA, 25 bp, E. coli
gcaatgccgtttcgcgcaaatgatc

SEQ ID NO: 92417 - DNA, 25 bp, E. coli
gactttgcagcattgcacgccacca

SEQ ID NO: 92418 - DNA, 25 bp, E. coli
gactttgcagcaatgcacgccacca

SEQ ID NO: 92419 - DNA, 25 bp, E. coli
catttttgccggaggttatgcggca

SEQ ID NO: 92420 - DNA, 25 bp, E. coli
catttttgccggtggttatgcggca

SEQ ID NO: 92421 - DNA, 25 bp, E. coli
taaaccggcgctctttacccatgac

SEQ ID NO: 92422 - DNA, 25 bp, E. coli
taaaccggcgctgtttacccatgac

SEQ ID NO: 92423 - DNA, 25 bp, E. coli
tagcactcgtgcatccgatcaaggt

SEQ ID NO: 92424 - DNA, 25 bp, E. coli
tacctgtgggcccatgtactggcag

SEQ ID NO: 92425 - DNA, 25 bp, E. coli
tagcactcgtgcttccgatcaaggt

SEQ ID NO: 92426 - DNA, 25 bp, E. coli
tacctgtgggccgatgtactggcag

SEQ ID NO: 92427 - DNA, 25 bp, E. coli
tgtactggcagcagatgccttctcg

SEQ ID NO: 92428 - DNA, 25 bp, E. coli
tgtactggcagctgatgccttctcg

SEQ ID NO: 92429 - DNA, 25 bp, E. coli
gactgcgctaatgacgaatccgtta

SEQ ID NO: 92430 - DNA, 25 bp, E. coli
gactgcgctaatcacgaatccgtta

SEQ ID NO: 92431 - DNA, 25 bp, E. coli
gaacgccggtaagtgggacaacagc

SEQ ID NO: 92432 - DNA, 25 bp, E. coli
gaacgccggtaactgggacaacagc

SEQ ID NO: 92433 - DNA, 25 bp, E. coli
cgatcaaggtccgaacgccggtaag

SEQ ID NO: 92434 - DNA, 25 bp, E. coli
cgatcaaggtcccaacgccggtaag

SEQ ID NO: 92435 - DNA, 25 bp, E. coli
gttgccgtggtagcgtctccgtcat

SEQ ID NO: 92436 - DNA, 25 bp, E. coli
gtttacccatgacgaagtgatcacc

SEQ ID NO: 92437 - DNA, 25 bp, E. coli
gtttacccatgaggaagtgatcacc

SEQ ID NO: 92438 - DNA, 25 bp, E. coli
gttgccgtggtaccgtctccgtcat

SEQ ID NO: 92439 - DNA, 25 bp, E. coli
gatgtatcgcgcatatagcactcgt

SEQ ID NO: 92440 - DNA, 25 bp, E. coli
gatgtatcgcgcttatagcactcgt

SEQ ID NO: 92441 - DNA, 25 bp, E. coli
tattccccaaccacgacggcacgtt

SEQ ID NO: 92442 - DNA, 25 bp, E. coli
tattccccaacctcgacggcacgtt

SEQ ID NO: 92443 - DNA, 25 bp, E. coli
tgcggagtattccccaaccacgacg

SEQ ID NO: 92444 - DNA, 25 bp, E. coli
tgcggagtattcgccaaccacgacg

SEQ ID NO: 92445 - DNA, 25 bp, E. coli
tgtgcggagtattccccaaccacga

SEQ ID NO: 92446 - DNA, 25 bp, E. coli
tgtgcggagtataccccaaccacga

SEQ ID NO: 92447 - DNA, 25 bp, E. coli
tctggtgtgcggagtattccccaac

SEQ ID NO: 92448 - DNA, 25 bp, E. coli
tctggtgtgcggtgtattccccaac

SEQ ID NO: 92449 - DNA, 25 bp, E. coli
ggtgtgcggagtattccccaaccac

SEQ ID NO: 92450 - DNA, 25 bp, E. coli
ggtgtgcggagttttccccaaccac

SEQ ID NO: 92451 - DNA, 25 bp, E. coli
ctctggtgtgcgcagtattccccaa

SEQ ID NO: 92452 - DNA, 25 bp, E. coli
ctctggtgtgcggagtattccccaa

SEQ ID NO: 92453 - DNA, 25 bp, E. coli
gtattccccaaccacgacggcacgt

SEQ ID NO: 92454 - DNA, 25 bp, E. coli
gtattccccaacgacgacggcacgt

SEQ ID NO: 92455 - DNA, 25 bp, E. coli
gtgtgcggagtattccccaaccacg

SEQ ID NO: 92456 - DNA, 25 bp, E. coli
ggagtattccccaaccacgacggca

SEQ ID NO: 92457 - DNA, 25 bp, E. coli
gtgcggagtattgcccaaccacgac

SEQ ID NO: 92458 - DNA, 25 bp, E. coli
ggagtattcccctaccacgacggca

SEQ ID NO: 92459 - DNA, 25 bp, E. coli
gtgtgcggagtaatccccaaccacg

SEQ ID NO: 92460 - DNA, 25 bp, E. coli
gtgcggagtattccccaaccacgac

SEQ ID NO: 92461 - DNA, 25 bp, E. coli
gagtattccccaaccacgacggcac

SEQ ID NO: 92462 - DNA, 25 bp, E. coli
gagtattccccatccacgacggcac

SEQ ID NO: 92463 - DNA, 25 bp, E. coli
aatgttgatcactgcggcaagtatc

SEQ ID NO: 92464 - DNA, 25 bp, E. coli
aatgttgatcacagcggcaagtatc

SEQ ID NO: 92465 - DNA, 25 bp, E. coli
agccgcgcggctacaatgttgatca

SEQ ID NO: 92466 - DNA, 25 bp, E. coli
agccgcgcggcttcaatgttgatca

SEQ ID NO: 92467 - DNA, 25 bp, E. coli
ccagccgcgcgggttcaatgttgat

SEQ ID NO: 92468 - DNA, 25 bp, E. coli
ccagccgcgcggcttcaatgttgat

SEQ ID NO: 92469 - DNA, 25 bp, E. coli
gcttcaatgttgttcacagcggcaa

SEQ ID NO: 92470 - DNA, 25 bp, E. coli
gcgcggcttcaaagttgatcacagc

SEQ ID NO: 92471 - DNA, 25 bp, E. coli
gcttcaatgttgatcacagcggcaa

SEQ ID NO: 92472 - DNA, 25 bp, E. coli
gcggcttcaatgatgatcacagcgg

SEQ ID NO: 92473 - DNA, 25 bp, E. coli
gcggcttcaatgttgatcacagcgg

SEQ ID NO: 92474 - DNA, 25 bp, E. coli
gcgcggcttcaatgttgatcacagc

SEQ ID NO: 92475 - DNA, 25 bp, E. coli
ccgcgcggcttctatgttgatcaca

SEQ ID NO: 92476 - DNA, 25 bp, E. coli
ccgcgcggcttcaatgttgatcaca

SEQ ID NO: 92477 - DNA, 25 bp, E. coli
cttcaatgttgatcacagcggcaag

SEQ ID NO: 92478 - DNA, 25 bp, E. coli
cttcaatgttgaacacagcggcaag

SEQ ID NO: 92479 - DNA, 25 bp, E. coli
gatcacagcggctagtatctgattg

SEQ ID NO: 92480 - DNA, 25 bp, E. coli
gatcacagcggcaagtatctgattg

SEQ ID NO: 92481 - DNA, 25 bp, E. coli
tcacagcggcaactatctgattgcc

SEQ ID NO: 92482 - DNA, 25 bp, E. coli
tcaatgttgatctcagcggcaagta

SEQ ID NO: 92483 - DNA, 25 bp, E. coli
tcaatgttgatcacagcggcaagta

SEQ ID NO: 92484 - DNA, 25 bp, E. coli
tcacagcggcaagtatctgattgcc

SEQ ID NO: 92485 - DNA, 25 bp, E. coli
caacggatgttatcatattgccaat

SEQ ID NO: 92486 - DNA, 25 bp, E. coli
caacggatgttaacatattgccaat

SEQ ID NO: 92487 - DNA, 25 bp, E. coli
tacgtttattcttccgtcacacaga

SEQ ID NO: 92488 - DNA, 25 bp, E. coli
taaattcatccgttgccaatctggc

SEQ ID NO: 92489 - DNA, 25 bp, E. coli
taaattcatccgatgccaatctggc

SEQ ID NO: 92490 - DNA, 25 bp, E. coli
tacgtttattctaccgtcacacaga

SEQ ID NO: 92491 - DNA, 25 bp, E. coli
tattgccaatttctcaacggacgtg

SEQ ID NO: 92492 - DNA, 25 bp, E. coli
tattgccaatttgtcaacggacgtg

SEQ ID NO: 92493 - DNA, 25 bp, E. coli
ttgggagttaccagccggatgcggc

SEQ ID NO: 92494 - DNA, 25 bp, E. coli
ttgggagttacctgccggatgcggc

SEQ ID NO: 92495 - DNA, 25 bp, E. coli
tccgtcacacagataaattcatccg

SEQ ID NO: 92496 - DNA, 25 bp, E. coli
tccggcctacgttcagcacgttact

SEQ ID NO: 92497 - DNA, 25 bp, E. coli
tccgtcacacagttaaattcatccg

SEQ ID NO: 92498 - DNA, 25 bp, E. coli
tccggcctacgtacagcacgttact

SEQ ID NO: 92499 - DNA, 25 bp, E. coli
ccaatttgtcaacggacgtgatgaa

SEQ ID NO: 92500 - DNA, 25 bp, E. coli
gccaatctggcaacggatgttatca

SEQ ID NO: 92501 - DNA, 25 bp, E. coli
gccaatctggcatcggatgttatca

SEQ ID NO: 92502 - DNA, 25 bp, E. coli
ccaatttgtcaagggacgtgatgaa

SEQ ID NO: 92503 - DNA, 25 bp, E. coli
gcacgttactcctggccggataaga

SEQ ID NO: 92504 - DNA, 25 bp, E. coli
gcacgttactccaggccggataaga

SEQ ID NO: 92505 - DNA, 25 bp, E. coli
cgcatccggcaatgtctgcccagtt

SEQ ID NO: 92506 - DNA, 25 bp, E. coli
cgcatccggcaaagtctgcccagtt

SEQ ID NO: 92507 - DNA, 25 bp, E. coli
aatggaacaaaacctcgagctgtta

SEQ ID NO: 92508 - DNA, 25 bp, E. coli
aatggaacaaaagctcgagctgtta

SEQ ID NO: 92509 - DNA, 25 bp, E. coli
caaaacctcgagctgttagcgacag

SEQ ID NO: 92510 - DNA, 25 bp, E. coli
caaaacctcgaggtgttagcgacag

SEQ ID NO: 92511 - DNA, 25 bp, E. coli
tacaaacaatcaggtatcggtcgcg

SEQ ID NO: 92512 - DNA, 25 bp, E. coli
tacaaacaatcacgtatcggtcgcg

SEQ ID NO: 92513 - DNA, 25 bp, E. coli
aatcaggtatcggtcgcgaaaccca

SEQ ID NO: 92514 - DNA, 25 bp, E. coli
aatcaggtatcgctcgcgaaaccca

SEQ ID NO: 92515 - DNA, 25 bp, E. coli
taccgctggcgaatgaccatttccg

SEQ ID NO: 92516 - DNA, 25 bp, E. coli
taccgctggcgattgaccatttccg

SEQ ID NO: 92517 - DNA, 25 bp, E. coli
tcggtcgcgaaacccacaagatgat

SEQ ID NO: 92518 - DNA, 25 bp, E. coli
tcggtcgcgaaagccacaagatgat

SEQ ID NO: 92519 - DNA, 25 bp, E. coli
cctcgagctgttagcgacagctgaa

SEQ ID NO: 92520 - DNA, 25 bp, E. coli
cctcgagctgtttgcgacagctgaa

SEQ ID NO: 92521 - DNA, 25 bp, E. coli
ccatttccgctaattcgcctcgtgt

SEQ ID NO: 92522 - DNA, 25 bp, E. coli
gaaaccagtgctgcggatgtaccgc

SEQ ID NO: 92523 - DNA, 25 bp, E. coli
gaaaccagtgctccggatgtaccgc

SEQ ID NO: 92524 - DNA, 25 bp, E. coli
ccatttccgctatttcgcctcgtgt

SEQ ID NO: 92525 - DNA, 25 bp, E. coli
cggatgtaccgcaggcgattgacca

SEQ ID NO: 92526 - DNA, 25 bp, E. coli
cggatgtaccgctggcgattgacca

SEQ ID NO: 92527 - DNA, 25 bp, E. coli
gattgaccatttgcgctatttcgcc

SEQ ID NO: 92528 - DNA, 25 bp, E. coli
gattgaccatttccgctatttcgcc

SEQ ID NO: 92529 - DNA, 25 bp, E. coli
aatgtcacgctttatggcacaacca

SEQ ID NO: 92530 - DNA, 25 bp, E. coli
caattaatgcgggagatgaagacct

SEQ ID NO: 92531 - DNA, 25 bp, E. coli
aatgtcacgcttaatggcacaacca

SEQ ID NO: 92532 - DNA, 25 bp, E. coli
caattaatgcggcagatgaagacct

SEQ ID NO: 92533 - DNA, 25 bp, E. coli
tagttttgaaggagatgcaaccgac

SEQ ID NO: 92534 - DNA, 25 bp, E. coli
tagttttgaaggtgatgcaaccgac

SEQ ID NO: 92535 - DNA, 25 bp, E. coli
agcattcgctgcagataacgcggta

SEQ ID NO: 92536 - DNA, 25 bp, E. coli
agcattcgctgctgataacgcggta

SEQ ID NO: 92537 - DNA, 25 bp, E. coli
tattagcaatactgcagacaaacag

SEQ ID NO: 92538 - DNA, 25 bp, E. coli
tattagcaatacagcagacaaacag

SEQ ID NO: 92539 - DNA, 25 bp, E. coli
ttcggttacgctgaataaagataag

SEQ ID NO: 92540 - DNA, 25 bp, E. coli
ttcggttacgctcaataaagataag

SEQ ID NO: 92541 - DNA, 25 bp, E. coli
gcagacaaacagattacagccgtaa

SEQ ID NO: 92542 - DNA, 25 bp, E. coli
gcagacaaacagtttacagccgtaa

SEQ ID NO: 92543 - DNA, 25 bp, E. coli
gataacgcggtatcaactgattcgg

SEQ ID NO: 92544 - DNA, 25 bp, E. coli
gataacgcggtaacaactgattcgg

SEQ ID NO: 92545 - DNA, 25 bp, E. coli
gatattactgctgaatcaacggcag

SEQ ID NO: 92546 - DNA, 25 bp, E. coli
gatattactgctcaatcaacggcag

SEQ ID NO: 92547 - DNA, 25 bp, E. coli
gggccaagggaattaatgtcacgct

SEQ ID NO: 92548 - DNA, 25 bp, E. coli
gggccaagggaaataatgtcacgct

SEQ ID NO: 92549 - DNA, 25 bp, E. coli
taataagagttcgagcaacgcctcc

SEQ ID NO: 92550 - DNA, 25 bp, E. coli
taataagagttccagcaacgcctcc

SEQ ID NO: 92551 - DNA, 25 bp, E. coli
cagtaacttcccctatttcgacagt

SEQ ID NO: 92552 - DNA, 25 bp, E. coli
cagtaacttcccgtatttcgacagt

SEQ ID NO: 92553 - DNA, 25 bp, E. coli
caggaattacctattctgccgctgg

SEQ ID NO: 92554 - DNA, 25 bp, E. coli
caggaattaccttttctgccgctgg

SEQ ID NO: 92555 - DNA, 25 bp, E. coli
tacaggacgattctcgaaactcctg

SEQ ID NO: 92556 - DNA, 25 bp, E. coli
tacaggacgattgtcgaaactcctg

SEQ ID NO: 92557 - DNA, 25 bp, E. coli
taacttcccctatttcgacagtctg

SEQ ID NO: 92558 - DNA, 25 bp, E. coli
taacttcccctaattcgacagtctg

SEQ ID NO: 92559 - DNA, 25 bp, E. coli
tctggcgcaggatttacctattctg

SEQ ID NO: 92560 - DNA, 25 bp, E. coli
tctggcggtacaggacgattgtcga

SEQ ID NO: 92561 - DNA, 25 bp, E. coli
tctggcgcaggaattacctattctg

SEQ ID NO: 92562 - DNA, 25 bp, E. coli
tctggcggtacacgacgattgtcga

SEQ ID NO: 92563 - DNA, 25 bp, E. coli
gatttaggctctggcggtacaggac

SEQ ID NO: 92564 - DNA, 25 bp, E. coli
gatttctggcgtggtaagccgttga

SEQ ID NO: 92565 - DNA, 25 bp, E. coli
gatttctggcgtcgtaagccgttga

SEQ ID NO: 92566 - DNA, 25 bp, E. coli
gatttaggctctcgcggtacaggac

SEQ ID NO: 92567 - DNA, 25 bp, E. coli
tggtaagccgttgatgccacaagtg

SEQ ID NO: 92568 - DNA, 25 bp, E. coli
tggtaagccgttcatgccacaagtg

SEQ ID NO: 92569 - DNA, 25 bp, E. coli
taagccgttgatcccacaagtggtg

SEQ ID NO: 92570 - DNA, 25 bp, E. coli
taagccgttgatgccacaagtggtg

SEQ ID NO: 92571 - DNA, 25 bp, E. coli
gatgccacaagtcgtggtggattta

SEQ ID NO: 92572 - DNA, 25 bp, E. coli
gatgccacaagtggtggtggattta

SEQ ID NO: 92573 - DNA, 25 bp, E. coli
cacttgtgaagcacgtgttgatggc

SEQ ID NO: 92574 - DNA, 25 bp, E. coli
cacttgtgaagctcgtgttgatggc

SEQ ID NO: 92575 - DNA, 25 bp, E. coli
aacaggttcaggtcaataatccggg

SEQ ID NO: 92576 - DNA, 25 bp, E. coli
aacaggttcaggacaataatccggg

SEQ ID NO: 92577 - DNA, 25 bp, E. coli
ttagcggtctggtcgttgataacac

SEQ ID NO: 92578 - DNA, 25 bp, E. coli
ttagcggtctggacgttgataacac

SEQ ID NO: 92579 - DNA, 25 bp, E. coli
tttgctgctaacgatatggacggcg

SEQ ID NO: 92580 - DNA, 25 bp, E. coli
tttgctgctaaccatatggacggcg

SEQ ID NO: 92581 - DNA, 25 bp, E. coli
tgactgcagcaatgctaacccggct

SEQ ID NO: 92582 - DNA, 25 bp, E. coli
tgactgcagcaaagctaacccggct

SEQ ID NO: 92583 - DNA, 25 bp, E. coli
tcctatgttcgtgcggatgcaagca

SEQ ID NO: 92584 - DNA, 25 bp, E. coli
tcctatgttcgtccggatgcaagca

SEQ ID NO: 92585 - DNA, 25 bp, E. coli
ccactgtaggtggtaaagctaaacc

SEQ ID NO: 92586 - DNA, 25 bp, E. coli
ccactgtaggtgctaaagctaaacc

SEQ ID NO: 92587 - DNA, 25 bp, E. coli
gcgctgtccggttttatgttggcaa

SEQ ID NO: 92588 - DNA, 25 bp, E. coli
gcgctgtccggtattatgttggcaa

SEQ ID NO: 92589 - DNA, 25 bp, E. coli
cggctccgggtagtactgcaaaaat

SEQ ID NO: 92590 - DNA, 25 bp, E. coli
cggctccgggtactactgcaaaaat

SEQ ID NO: 92591 - DNA, 25 bp, E. coli
gatggcggtaactaagacggtctga

SEQ ID NO: 92592 - DNA, 25 bp, E. coli
gatggcggtaacaaagacggtctga

SEQ ID NO: 92593 - DNA, 25 bp, E. coli
gatgcaagcaaagcagctactgccg

SEQ ID NO: 92594 - DNA, 25 bp, E. coli
gatgcaagcaaaccagctactgccg

SEQ ID NO: 92595 - DNA, 25 bp, E. coli
cattttgctgagtacacaccgtggt

SEQ ID NO: 92596 - DNA, 25 bp, E. coli
tacagacgctgctgaccgaagctat

SEQ ID NO: 92597 - DNA, 25 bp, E. coli
taaagtaccgctggatgagtacccg

SEQ ID NO: 92598 - DNA, 25 bp, E. coli
tactcgctgccacaatattgtgcgc

SEQ ID NO: 92599 - DNA, 25 bp, E. coli
tactcgctgccagaatattgtgcgc

SEQ ID NO: 92600 - DNA, 25 bp, E. coli
taaagtaccgctcgatgagtacccg

SEQ ID NO: 92601 - DNA, 25 bp, E. coli
tacagacgctgcagaccgaagctat

SEQ ID NO: 92602 - DNA, 25 bp, E. coli
aaaccgtcacgggaatatgccagca

SEQ ID NO: 92603 - DNA, 25 bp, E. coli
aaaccgtcacggcaatatgccagca

SEQ ID NO: 92604 - DNA, 25 bp, E. coli
gcaaatttgcgaggacatgacggaa

SEQ ID NO: 92605 - DNA, 25 bp, E. coli
gcaaatttgcgacgacatgacggaa

SEQ ID NO: 92606 - DNA, 25 bp, E. coli
taatggcattcagccgaccaaagtc

SEQ ID NO: 92607 - DNA, 25 bp, E. coli
taatggcattcacccgaccaaagtc

SEQ ID NO: 92608 - DNA, 25 bp, E. coli
gaaaacggcgcatattgccctgatg

SEQ ID NO: 92609 - DNA, 25 bp, E. coli
gaaaacggcgcaaattgccctgatg

SEQ ID NO: 92610 - DNA, 25 bp, E. coli
ctgatttcgaggactgtaagcggca

SEQ ID NO: 92611 - DNA, 25 bp, E. coli
cattttgctgagaacacaccgtggt

SEQ ID NO: 92612 - DNA, 25 bp, E. coli
ctgatttcgaggtctgtaagcggca

SEQ ID NO: 92613 - DNA, 25 bp, E. coli
taacctgccacatggatgttgcgtg

SEQ ID NO: 92614 - DNA, 25 bp, E. coli
taacctgccacaaggatgttgcgtg

SEQ ID NO: 92615 - DNA, 25 bp, E. coli
taagcggcatggtctggaacaaacc

SEQ ID NO: 92616 - DNA, 25 bp, E. coli
taagcggcatggactggaacaaacc

SEQ ID NO: 92617 - DNA, 25 bp, E. coli
cacgcaatggtcgaatttatctggc

SEQ ID NO: 92618 - DNA, 25 bp, E. coli
cacgcaatggtccaatttatctggc

SEQ ID NO: 92619 - DNA, 25 bp, E. coli
taacagaagaactaagaaaggcatt

SEQ ID NO: 92620 - DNA, 25 bp, E. coli
taacagaagaacaaagaaaggcatt

SEQ ID NO: 92621 - DNA, 25 bp, E. coli
aatggtcgaattaatctggcgttga

SEQ ID NO: 92622 - DNA, 25 bp, E. coli
aatggtcgaatttatctggcgttga

SEQ ID NO: 92623 - DNA, 25 bp, E. coli
actattgtccgacaagctgctttaa

SEQ ID NO: 92624 - DNA, 25 bp, E. coli
actattgtccgagaagctgctttaa

SEQ ID NO: 92625 - DNA, 25 bp, E. coli
tatctggcgttgttttatcctaaaa

SEQ ID NO: 92626 - DNA, 25 bp, E. coli
tatctggcgttgatttatcctaaaa

SEQ ID NO: 92627 - DNA, 25 bp, E. coli
tattacaacgtaacacgcaatggtc

SEQ ID NO: 92628 - DNA, 25 bp, E. coli
tattacaacgtatcacgcaatggtc

SEQ ID NO: 92629 - DNA, 25 bp, E. coli
tgatttatcctataaatgaacagga

SEQ ID NO: 92630 - DNA, 25 bp, E. coli
tgatttatcctaaaaatgaacagga

SEQ ID NO: 92631 - DNA, 25 bp, E. coli
tgaaactattgtccgagaagctgct

SEQ ID NO: 92632 - DNA, 25 bp, E. coli
tgaaactattgtgcgagaagctgct

SEQ ID NO: 92633 - DNA, 25 bp, E. coli
gaacaggatgatttaacagaagaac

SEQ ID NO: 92634 - DNA, 25 bp, E. coli
gaacaggatgatataacagaagaac

SEQ ID NO: 92635 - DNA, 25 bp, E. coli
gaaaggcattgaaactattgtccga

SEQ ID NO: 92636 - DNA, 25 bp, E. coli
gaaaggcattgatactattgtccga

SEQ ID NO: 92637 - DNA, 25 bp, E. coli
ggcattcgaatattttattacaacg

SEQ ID NO: 92638 - DNA, 25 bp, E. coli
ggcattcgaataatttattacaacg

SEQ ID NO: 92639 - DNA, 25 bp, E. coli
caagctggcgaactgcaggaaaagc

SEQ ID NO: 92640 - DNA, 25 bp, E. coli
caatgcgcgccgatctggaagtcgc

SEQ ID NO: 92641 - DNA, 25 bp, E. coli
caatgcgcgccgttctggaagtcgc

SEQ ID NO: 92642 - DNA, 25 bp, E. coli
caagctggcgaagtgcaggaaaagc

SEQ ID NO: 92643 - DNA, 25 bp, E. coli
tatcatcgccggaggtgcaatgcgc

SEQ ID NO: 92644 - DNA, 25 bp, E. coli
tatcatcgccggtggtgcaatgcgc

SEQ ID NO: 92645 - DNA, 25 bp, E. coli
ttaacgtcgcgcagaataacggcac

SEQ ID NO: 92646 - DNA, 25 bp, E. coli
ttaacgtcgcgctgaataacggcac

SEQ ID NO: 92647 - DNA, 25 bp, E. coli
gctgccaagcgtcgtaaatccgttg

SEQ ID NO: 92648 - DNA, 25 bp, E. coli
gctgccaagcgtggtaaatccgttg

SEQ ID NO: 92649 - DNA, 25 bp, E. coli
gaattctccagatatggtcgctgcc

SEQ ID NO: 92650 - DNA, 25 bp, E. coli
gaagttccagcagcgatccagaaag

SEQ ID NO: 92651 - DNA, 25 bp, E. coli
gaattctccagaaatggtcgctgcc

SEQ ID NO: 92652 - DNA, 25 bp, E. coli
gaagttccagcaccgatccagaaag

SEQ ID NO: 92653 - DNA, 25 bp, E. coli
ggttctcgcgtaatcatgcagccgg

SEQ ID NO: 92654 - DNA, 25 bp, E. coli
ggttctcgcgtattcatgcagccgg

SEQ ID NO: 92655 - DNA, 25 bp, E. coli
tggctcacatcgaaaaacaagctgg

SEQ ID NO: 92656 - DNA, 25 bp, E. coli
ggaaaagctgatggcggtaaaccgc

SEQ ID NO: 92657 - DNA, 25 bp, E. coli
tggctcacatcgtaaaacaagctgg

SEQ ID NO: 92658 - DNA, 25 bp, E. coli
tggaaaaagcccctcgcaatatgat

SEQ ID NO: 92659 - DNA, 25 bp, E. coli
ggaaaagctgatcgcggtaaaccgc

SEQ ID NO: 92660 - DNA, 25 bp, E. coli
tggaaaaagcccgtcgcaatatgat

SEQ ID NO: 92661 - DNA, 25 bp, E. coli
cagcagagcatctgtccacactaag

SEQ ID NO: 92662 - DNA, 25 bp, E. coli
cagcagagcatcagtccacactaag

SEQ ID NO: 92663 - DNA, 25 bp, E. coli
agagcatcagtcgacactaagcgcc

SEQ ID NO: 92664 - DNA, 25 bp, E. coli
agcatcagtccacactaagcgccgg

SEQ ID NO: 92665 - DNA, 25 bp, E. coli
atcagtccacacaaagcgccgggta

SEQ ID NO: 92666 - DNA, 25 bp, E. coli
agagcatcagtccacactaagcgcc

SEQ ID NO: 92667 - DNA, 25 bp, E. coli
agtccacactaagcgccgggtatct

SEQ ID NO: 92668 - DNA, 25 bp, E. coli
agtccacactaaccgccgggtatct

SEQ ID NO: 92669 - DNA, 25 bp, E. coli
atcagtccacactaagcgccgggta

SEQ ID NO: 92670 - DNA, 25 bp, E. coli
agcatcagtccagactaagcgccgg

SEQ ID NO: 92671 - DNA, 25 bp, E. coli
actaagcgccgggtatcttcagacc

SEQ ID NO: 92672 - DNA, 25 bp, E. coli
actaagcgccggctatcttcagacc

SEQ ID NO: 92673 - DNA, 25 bp, E. coli
ttgccgctggtacgccagcgagcgc

SEQ ID NO: 92674 - DNA, 25 bp, E. coli
ttgccgctggtaggccagcgagcgc

SEQ ID NO: 92675 - DNA, 25 bp, E. coli
gcagagcatcagaccacactaagcg

SEQ ID NO: 92676 - DNA, 25 bp, E. coli
gcagagcatcagtccacactaagcg

SEQ ID NO: 92677 - DNA, 25 bp, E. coli
cgcagcagagcaacagtccacacta

SEQ ID NO: 92678 - DNA, 25 bp, E. coli
cgcagcagagcatcagtccacacta

SEQ ID NO: 92679 - DNA, 25 bp, E. coli
ctggttgccgctggtacgccagcga

SEQ ID NO: 92680 - DNA, 25 bp, E. coli
ctggttgccgctcgtacgccagcga

SEQ ID NO: 92681 - DNA, 25 bp, E. coli
taagcgccgggtatcttcagaccca

SEQ ID NO: 92682 - DNA, 25 bp, E. coli
taagcgccgggtttcttcagaccca

SEQ ID NO: 92683 - DNA, 25 bp, E. coli
aattacgcgggccagtgaaacaaca

SEQ ID NO: 92684 - DNA, 25 bp, E. coli
aattacgcgggcgagtgaaacaaca

SEQ ID NO: 92685 - DNA, 25 bp, E. coli
cacgatgggtgagcgtcgccgtttc

SEQ ID NO: 92686 - DNA, 25 bp, E. coli
cacgatgggtgaccgtcgccgtttc

SEQ ID NO: 92687 - DNA, 25 bp, E. coli
agcgtcgccgtttctgggagaaatt

SEQ ID NO: 92688 - DNA, 25 bp, E. coli
atggtagcggtcacctctggcggca

SEQ ID NO: 92689 - DNA, 25 bp, E. coli
agcgtcgccgttactgggagaaatt

SEQ ID NO: 92690 - DNA, 25 bp, E. coli
atggtagcggtctcctctggcggca

SEQ ID NO: 92691 - DNA, 25 bp, E. coli
tacgcgggcgagtgaaacaacagtt

SEQ ID NO: 92692 - DNA, 25 bp, E. coli
tacgcgggcgagagaaacaacagtt

SEQ ID NO: 92693 - DNA, 25 bp, E. coli
tacgccgggcaaatacgcgggcgag

SEQ ID NO: 92694 - DNA, 25 bp, E. coli
tacgccgggcaattacgcgggcgag

SEQ ID NO: 92695 - DNA, 25 bp, E. coli
tgagcgtcgccgtttctgggagaaa

SEQ ID NO: 92696 - DNA, 25 bp, E. coli
tgagcgtcgccgattctgggagaaa

SEQ ID NO: 92697 - DNA, 25 bp, E. coli
ccacgatgggtgtgcgtcgccgttt

SEQ ID NO: 92698 - DNA, 25 bp, E. coli
ccacgatgggtgagcgtcgccgttt

SEQ ID NO: 92699 - DNA, 25 bp, E. coli
cgcgggcgagtgaaacaacagttcg

SEQ ID NO: 92700 - DNA, 25 bp, E. coli
cgcgggcgagtgtaacaacagttcg

SEQ ID NO: 92701 - DNA, 25 bp, E. coli
cgggcgagtgaaacaacagttcgcc

SEQ ID NO: 92702 - DNA, 25 bp, E. coli
ctcatggtagcgctctcctctggcg

SEQ ID NO: 92703 - DNA, 25 bp, E. coli
ctcatggtagcggtctcctctggcg

SEQ ID NO: 92704 - DNA, 25 bp, E. coli
cgggcgagtgaatcaacagttcgcc

SEQ ID NO: 92705 - DNA, 25 bp, E. coli
accggcttcttctcttatcagcgaa

SEQ ID NO: 92706 - DNA, 25 bp, E. coli
atgtttacatcagtggcgcaagcca

SEQ ID NO: 92707 - DNA, 25 bp, E. coli
accggcttcttcacttatcagcgaa

SEQ ID NO: 92708 - DNA, 25 bp, E. coli
atgtttacatcactggcgcaagcca

SEQ ID NO: 92709 - DNA, 25 bp, E. coli
ttcttcacttatgagcgaactaaac

SEQ ID NO: 92710 - DNA, 25 bp, E. coli
ttcttcacttatcagcgaactaaac

SEQ ID NO: 92711 - DNA, 25 bp, E. coli
tgcaaccggcttgttcacttatcag

SEQ ID NO: 92712 - DNA, 25 bp, E. coli
tgcaaccggcttcttcacttatcag

SEQ ID NO: 92713 - DNA, 25 bp, E. coli
tcagtggcgcaagccaatgctgcgg

SEQ ID NO: 92714 - DNA, 25 bp, E. coli
tcagtggcgcaacccaatgctgcgg

SEQ ID NO: 92715 - DNA, 25 bp, E. coli
gctggatgtgcatccggcttcttca

SEQ ID NO: 92716 - DNA, 25 bp, E. coli
gctggatgtgcaaccggcttcttca

SEQ ID NO: 92717 - DNA, 25 bp, E. coli
ccgggccgccaatgcgctggcagga

SEQ ID NO: 92718 - DNA, 25 bp, E. coli
ccgggccgccaaagcgctggcagga

SEQ ID NO: 92719 - DNA, 25 bp, E. coli
ctcgtccacactcgctggatgtgca

SEQ ID NO: 92720 - DNA, 25 bp, E. coli
ctcgtccacactggctggatgtgca

SEQ ID NO: 92721 - DNA, 25 bp, E. coli
gtttacatcagtcgcgcaagccaat

SEQ ID NO: 92722 - DNA, 25 bp, E. coli
gtttacatcagtggcgcaagccaat

SEQ ID NO: 92723 - DNA, 25 bp, E. coli
tggcgcaagccaatgctgcggttat

SEQ ID NO: 92724 - DNA, 25 bp, E. coli
ggcaaaacactgcttcacgccgggc

SEQ ID NO: 92725 - DNA, 25 bp, E. coli
tggcgcaagccattgctgcggttat

SEQ ID NO: 92726 - DNA, 25 bp, E. coli
ggcaaaacactggttcacgccgggc

SEQ ID NO: 92727 - DNA, 25 bp, E. coli
aacgagtggtgtggtcaaagctctg

SEQ ID NO: 92728 - DNA, 25 bp, E. coli
caaagctctggtgtggagtgcagca

SEQ ID NO: 92729 - DNA, 25 bp, E. coli
caaagctctggtctggagtgcagca

SEQ ID NO: 92730 - DNA, 25 bp, E. coli
agtggtgtcgtcaaagctctggtgt

SEQ ID NO: 92731 - DNA, 25 bp, E. coli
agtggtgtcgtctaagctctggtgt

SEQ ID NO: 92732 - DNA, 25 bp, E. coli
aataactcgcacgttcagttttggg

SEQ ID NO: 92733 - DNA, 25 bp, E. coli
aacgagtggtgtcgtcaaagctctg

SEQ ID NO: 92734 - DNA, 25 bp, E. coli
aataactcgcaccttcagttttggg

SEQ ID NO: 92735 - DNA, 25 bp, E. coli
ttttggggagatgtaagggctaatc

SEQ ID NO: 92736 - DNA, 25 bp, E. coli
ttttggggagatctaagggctaatc

SEQ ID NO: 92737 - DNA, 25 bp, E. coli
tgcattccttgtttaaggaaaaacg

SEQ ID NO: 92738 - DNA, 25 bp, E. coli
tgcattccttgtataaggaaaaacg

SEQ ID NO: 92739 - DNA, 25 bp, E. coli
tcgtcaaagctcaggtgtggagtgc

SEQ ID NO: 92740 - DNA, 25 bp, E. coli
tcgtcaaagctctggtgtggagtgc

SEQ ID NO: 92741 - DNA, 25 bp, E. coli
ccattgaaacgactggtgtcgtcaa

SEQ ID NO: 92742 - DNA, 25 bp, E. coli
ccattgaaacgagtggtgtcgtcaa

SEQ ID NO: 92743 - DNA, 25 bp, E. coli
gaaacgagtggtctcgtcaaagctc

SEQ ID NO: 92744 - DNA, 25 bp, E. coli
gaaacgagtggtgtcgtcaaagctc

SEQ ID NO: 92745 - DNA, 25 bp, E. coli
ccccattgaaacgagtggtgtcgtc

SEQ ID NO: 92746 - DNA, 25 bp, E. coli
ccccattgaaaccagtggtgtcgtc

SEQ ID NO: 92747 - DNA, 25 bp, E. coli
ggctgcattcctagtttaaggaaaa

SEQ ID NO: 92748 - DNA, 25 bp, E. coli
ggctgcattccttgtttaaggaaaa

SEQ ID NO: 92749 - DNA, 25 bp, E. coli
atggtggggccgtctgtgcgcgtga

SEQ ID NO: 92750 - DNA, 25 bp, E. coli
atggtggggccgactgtgcgcgtga

SEQ ID NO: 92751 - DNA, 25 bp, E. coli
actgacaacaagcgaaggtgcgaat

SEQ ID NO: 92752 - DNA, 25 bp, E. coli
aactgacaacaagggaaggtgcgaa

SEQ ID NO: 92753 - DNA, 25 bp, E. coli
aactgacaacaacggaaggtgcgaa

SEQ ID NO: 92754 - DNA, 25 bp, E. coli
actgacaacaagggaaggtgcgaat

SEQ ID NO: 92755 - DNA, 25 bp, E. coli
tgacaacaagggtaggtgcgaataa

SEQ ID NO: 92756 - DNA, 25 bp, E. coli
tgacaacaagggaaggtgcgaataa

SEQ ID NO: 92757 - DNA, 25 bp, E. coli
ctgacaacaagggaaggtgcgaata

SEQ ID NO: 92758 - DNA, 25 bp, E. coli
cgggtatggcttacagccgtgtgtc

SEQ ID NO: 92759 - DNA, 25 bp, E. coli
ctgacaacaaggcaaggtgcgaata

SEQ ID NO: 92760 - DNA, 25 bp, E. coli
cgggtatggctttcagccgtgtgtc

SEQ ID NO: 92761 - DNA, 25 bp, E. coli
ggtggggccgtctgtgcgcgtgaat

SEQ ID NO: 92762 - DNA, 25 bp, E. coli
ggtggggccgtcagtgcgcgtgaat

SEQ ID NO: 92763 - DNA, 25 bp, E. coli
gtggggccgtctctgcgcgtgaatg

SEQ ID NO: 92764 - DNA, 25 bp, E. coli
gtggggccgtctgtgcgcgtgaatg

SEQ ID NO: 92765 - DNA, 25 bp, E. coli
tggggccgtctgtgcgcgtgaatga

SEQ ID NO: 92766 - DNA, 25 bp, E. coli
tggtggggccgtctgtgcgcgtgaa

SEQ ID NO: 92767 - DNA, 25 bp, E. coli
tggggccgtctgagcgcgtgaatga

SEQ ID NO: 92768 - DNA, 25 bp, E. coli
tggtggggccgtgtgtgcgcgtgaa

SEQ ID NO: 92769 - DNA, 25 bp, E. coli
gatggtggggccctctgtgcgcgtg

SEQ ID NO: 92770 - DNA, 25 bp, E. coli
gatggtggggccgtctgtgcgcgtg

SEQ ID NO: 92771 - DNA, 25 bp, E. coli
aaccgtctccggaatgttgcctgag

SEQ ID NO: 92772 - DNA, 25 bp, E. coli
gcggaaaaatttcttcctcttcaca

SEQ ID NO: 92773 - DNA, 25 bp, E. coli
gcggaaaaatttgttcctcttcaca

SEQ ID NO: 92774 - DNA, 25 bp, E. coli
aaccgtctccggtatgttgcctgag

SEQ ID NO: 92775 - DNA, 25 bp, E. coli
tatgacagtggcctgaattttgcgc

SEQ ID NO: 92776 - DNA, 25 bp, E. coli
tatgacagtggcgtgaattttgcgc

SEQ ID NO: 92777 - DNA, 25 bp, E. coli
ttttttgtacaagcgacatgcccgt

SEQ ID NO: 92778 - DNA, 25 bp, E. coli
ttttttgtacaaccgacatgcccgt

SEQ ID NO: 92779 - DNA, 25 bp, E. coli
tgtagctcacaaatatgacagtggc

SEQ ID NO: 92780 - DNA, 25 bp, E. coli
tgtctctaacgtccggaaaaatttg

SEQ ID NO: 92781 - DNA, 25 bp, E. coli
tgtagctcacaattatgacagtggc

SEQ ID NO: 92782 - DNA, 25 bp, E. coli
tgtctctaacgtgcggaaaaatttg

SEQ ID NO: 92783 - DNA, 25 bp, E. coli
tctccggtatgtagcctgaggcggt

SEQ ID NO: 92784 - DNA, 25 bp, E. coli
tctccggtatgttgcctgaggcggt

SEQ ID NO: 92785 - DNA, 25 bp, E. coli
gacatgcccgtgtagctcacaaata

SEQ ID NO: 92786 - DNA, 25 bp, E. coli
gacatgcccgtgaagctcacaaata

SEQ ID NO: 92787 - DNA, 25 bp, E. coli
cattgacggcagttatgattcgcgg

SEQ ID NO: 92788 - DNA, 25 bp, E. coli
cattgacggcagatatgattcgcgg

SEQ ID NO: 92789 - DNA, 25 bp, E. coli
gatttgtaaataaaaccgtctccgg

SEQ ID NO: 92790 - DNA, 25 bp, E. coli
gatttgtaaatataaccgtctccgg

SEQ ID NO: 92791 - DNA, 25 bp, E. coli
ggcgtgaattttccgcattgacggc

SEQ ID NO: 92792 - DNA, 25 bp, E. coli
ggcgtgaattttgcgcattgacggc

SEQ ID NO: 92793 - DNA, 25 bp, E. coli
caccgcaggcgaaatcggcgctctg

SEQ ID NO: 92794 - DNA, 25 bp, E. coli
caccgcaggcgatatcggcgctctg

SEQ ID NO: 92795 - DNA, 25 bp, E. coli
agtcgggtgcttactcatttacgca

SEQ ID NO: 92796 - DNA, 25 bp, E. coli
agtcgggtgctttctcatttacgca

SEQ ID NO: 92797 - DNA, 25 bp, E. coli
aaaagcgttaatatccgcagtcggg

SEQ ID NO: 92798 - DNA, 25 bp, E. coli
aaaagcgttaatttccgcagtcggg

SEQ ID NO: 92799 - DNA, 25 bp, E. coli
tcccggcgaattagctggatctgca

SEQ ID NO: 92800 - DNA, 25 bp, E. coli
tcccggcgaatttgctggatctgca

SEQ ID NO: 92801 - DNA, 25 bp, E. coli
gctggatctgcaccgcaggcgaaat

SEQ ID NO: 92802 - DNA, 25 bp, E. coli
gctggatctgcagcgcaggcgaaat

SEQ ID NO: 92803 - DNA, 25 bp, E. coli
gaattagctggatctgcaccgcagg

SEQ ID NO: 92804 - DNA, 25 bp, E. coli
gaattagctggaactgcaccgcagg

SEQ ID NO: 92805 - DNA, 25 bp, E. coli
ccgcagtcgggtgctttctcattta

SEQ ID NO: 92806 - DNA, 25 bp, E. coli
ccgcagtcgggtcctttctcattta

SEQ ID NO: 92807 - DNA, 25 bp, E. coli
gatctgcaccgctggcgaaatcggc

SEQ ID NO: 92808 - DNA, 25 bp, E. coli
ggtgctttctcatttacgcaccccg

SEQ ID NO: 92809 - DNA, 25 bp, E. coli
ggtgctttctcaattacgcaccccg

SEQ ID NO: 92810 - DNA, 25 bp, E. coli
ggcaatcccggccaattagctggat

SEQ ID NO: 92811 - DNA, 25 bp, E. coli
ggcaatcccggcgaattagctggat

SEQ ID NO: 92812 - DNA, 25 bp, E. coli
taatatccgcagacgggtgctttct

SEQ ID NO: 92813 - DNA, 25 bp, E. coli
taatatccgcagtcgggtgctttct

SEQ ID NO: 92814 - DNA, 25 bp, E. coli
gatctgcaccgcaggcgaaatcggc

SEQ ID NO: 92815 - DNA, 25 bp, E. coli
aatttgcagtgcttgatgttaatca

SEQ ID NO: 92816 - DNA, 25 bp, E. coli
aatttgcagtgcatgatgttaatca

SEQ ID NO: 92817 - DNA, 25 bp, E. coli
caagatatttctaccatcatgcaaa

SEQ ID NO: 92818 - DNA, 25 bp, E. coli
caagatatttcttccatcatgcaaa

SEQ ID NO: 92819 - DNA, 25 bp, E. coli
catataaagattcaaaaatttgtgc

SEQ ID NO: 92820 - DNA, 25 bp, E. coli
cataaatgtcggtgtcatcatgcgc

SEQ ID NO: 92821 - DNA, 25 bp, E. coli
cataaatgtcggagtcatcatgcgc

SEQ ID NO: 92822 - DNA, 25 bp, E. coli
catataaagattgaaaaatttgtgc

SEQ ID NO: 92823 - DNA, 25 bp, E. coli
tacgcaaaatgggatagactcaaga

SEQ ID NO: 92824 - DNA, 25 bp, E. coli
tacgcaaaatggcatagactcaaga

SEQ ID NO: 92825 - DNA, 25 bp, E. coli
tacgctctatggctccctgacgttt

SEQ ID NO: 92826 - DNA, 25 bp, E. coli
tagccacgtatcaattataggtact

SEQ ID NO: 92827 - DNA, 25 bp, E. coli
tacgctctatgggtccctgacgttt

SEQ ID NO: 92828 - DNA, 25 bp, E. coli
tagccacgtatctattataggtact

SEQ ID NO: 92829 - DNA, 25 bp, E. coli
tgtcatcatgcgctacgctctatgg

SEQ ID NO: 92830 - DNA, 25 bp, E. coli
tgtcatcatgcggtacgctctatgg

SEQ ID NO: 92831 - DNA, 25 bp, E. coli
tcagcgggacaaggttcaaaacatt

SEQ ID NO: 92832 - DNA, 25 bp, E. coli
tcagcgggacaacgttcaaaacatt

SEQ ID NO: 92833 - DNA, 25 bp, E. coli
gcttcacctcaacttcacatataaa

SEQ ID NO: 92834 - DNA, 25 bp, E. coli
gcttcacctcaagttcacatataaa

SEQ ID NO: 92835 - DNA, 25 bp, E. coli
gtgcaaattcactactcagcgggac

SEQ ID NO: 92836 - DNA, 25 bp, E. coli
gtgcaaattcacaactcagcgggac

SEQ ID NO: 92837 - DNA, 25 bp, E. coli
caaagccatgaagctcgacgagaag

SEQ ID NO: 92838 - DNA, 25 bp, E. coli
caaagccatgaacctcgacgagaag

SEQ ID NO: 92839 - DNA, 25 bp, E. coli
cacgagttgtggcttaacaagccgc

SEQ ID NO: 92840 - DNA, 25 bp, E. coli
cacgagttgtgggttaacaagccgc

SEQ ID NO: 92841 - DNA, 25 bp, E. coli
catattcaaagctacggtaatccgg

SEQ ID NO: 92842 - DNA, 25 bp, E. coli
catattcaaagcaacggtaatccgg

SEQ ID NO: 92843 - DNA, 25 bp, E. coli
taacaagccgcatatcctgcaacac

SEQ ID NO: 92844 - DNA, 25 bp, E. coli
taacaagccgcaaatcctgcaacac

SEQ ID NO: 92845 - DNA, 25 bp, E. coli
tgctgcgcgctcacgagttgtggct

SEQ ID NO: 92846 - DNA, 25 bp, E. coli
tgctgcgcgctctcgagttgtggct

SEQ ID NO: 92847 - DNA, 25 bp, E. coli
gcctggtggactacgccgagctgct

SEQ ID NO: 92848 - DNA, 25 bp, E. coli
gcctggtggacttcgccgagctgct

SEQ ID NO: 92849 - DNA, 25 bp, E. coli
cctggtggacgaattccaggatacc

SEQ ID NO: 92850 - DNA, 25 bp, E. coli
cctgcaacactaccgcgaacgtttt

SEQ ID NO: 92851 - DNA, 25 bp, E. coli
cctgcaacactagcgcgaacgtttt

SEQ ID NO: 92852 - DNA, 25 bp, E. coli
cctggtggacgatttccaggatacc

SEQ ID NO: 92853 - DNA, 25 bp, E. coli
gcttaagcgtctcatcaaagccatg

SEQ ID NO: 92854 - DNA, 25 bp, E. coli
gcttaagcgtctgatcaaagccatg

SEQ ID NO: 92855 - DNA, 25 bp, E. coli
cgaattccaggaaaccaacaacatt

SEQ ID NO: 92856 - DNA, 25 bp, E. coli
cgaattccaggataccaacaacatt

SEQ ID NO: 92857 - DNA, 25 bp, E. coli
gtaatccggtggagcagacctggca

SEQ ID NO: 92858 - DNA, 25 bp, E. coli
gtaatccggtggtgcagacctggca

SEQ ID NO: 92859 - DNA, 25 bp, E. coli
catgggttcacgttgcaggactgga

SEQ ID NO: 92860 - DNA, 25 bp, E. coli
catgggttcacgatgcaggactgga

SEQ ID NO: 92861 - DNA, 25 bp, E. coli
tacttggcggtacaaactctctggc

SEQ ID NO: 92862 - DNA, 25 bp, E. coli
tacttggcggtagaaactctctggc

SEQ ID NO: 92863 - DNA, 25 bp, E. coli
aaaaatccgcgctctgaatgacaag

SEQ ID NO: 92864 - DNA, 25 bp, E. coli
aaaaatccgcgcactgaatgacaag

SEQ ID NO: 92865 - DNA, 25 bp, E. coli
gacgtattagagagtgccacagcag

SEQ ID NO: 92866 - DNA, 25 bp, E. coli
gaaacaggactcaaaccagatcgcg

SEQ ID NO: 92867 - DNA, 25 bp, E. coli
gaaacaggactctaaccagatcgcg

SEQ ID NO: 92868 - DNA, 25 bp, E. coli
gacgtattagagtgtgccacagcag

SEQ ID NO: 92869 - DNA, 25 bp, E. coli
cgatggatgttcgaagagcgcccaa

SEQ ID NO: 92870 - DNA, 25 bp, E. coli
cgttctggcgcaaagccggagtgat

SEQ ID NO: 92871 - DNA, 25 bp, E. coli
cgatggatgttccaagagcgcccaa

SEQ ID NO: 92872 - DNA, 25 bp, E. coli
cgttctggcgcatagccggagtgat

SEQ ID NO: 92873 - DNA, 25 bp, E. coli
ggaaccgtctgggacaaaaagggat

SEQ ID NO: 92874 - DNA, 25 bp, E. coli
gggtatgccttggtgcaccgtaaaa

SEQ ID NO: 92875 - DNA, 25 bp, E. coli
gggtatgccttgctgcaccgtaaaa

SEQ ID NO: 92876 - DNA, 25 bp, E. coli
ggaaccgtctggcacaaaaagggat

SEQ ID NO: 92877 - DNA, 25 bp, E. coli
taatctagccgatgccagagaggca

SEQ ID NO: 92878 - DNA, 25 bp, E. coli
taatctagccgaagccagagaggca

SEQ ID NO: 92879 - DNA, 25 bp, E. coli
gataatacctacgtgaaagttcgtg

SEQ ID NO: 92880 - DNA, 25 bp, E. coli
gataatacctacctgaaagttcgtg

SEQ ID NO: 92881 - DNA, 25 bp, E. coli
aatttatataccagttgctttgcag

SEQ ID NO: 92882 - DNA, 25 bp, E. coli
aatttatatacctgttgctttgcag

SEQ ID NO: 92883 - DNA, 25 bp, E. coli
tactaacatttgcactgaatctgat

SEQ ID NO: 92884 - DNA, 25 bp, E. coli
tactaacatttggactgaatctgat

SEQ ID NO: 92885 - DNA, 25 bp, E. coli
tgaacactattttaaccagcaaact

SEQ ID NO: 92886 - DNA, 25 bp, E. coli
tgaacactatttaaaccagcaaact

SEQ ID NO: 92887 - DNA, 25 bp, E. coli
tgctttgcagcttcatcatgctgta

SEQ ID NO: 92888 - DNA, 25 bp, E. coli
tgctttgcagctacatcatgctgta

SEQ ID NO: 92889 - DNA, 25 bp, E. coli
tcatgctgtatgagatggttaccat

SEQ ID NO: 92890 - DNA, 25 bp, E. coli
tcatgctgtatgtgatggttaccat

SEQ ID NO: 92891 - DNA, 25 bp, E. coli
ccagcaaactacctatagcattact

SEQ ID NO: 92892 - DNA, 25 bp, E. coli
ccagcaaactacgtatagcattact

SEQ ID NO: 92893 - DNA, 25 bp, E. coli
gaatctgataactacttcacttctt

SEQ ID NO: 92894 - DNA, 25 bp, E. coli
gaatctgataacaacttcacttctt

SEQ ID NO: 92895 - DNA, 25 bp, E. coli
cattggtaacaatagcaacttttta

SEQ ID NO: 92896 - DNA, 25 bp, E. coli
cattggtaacaaaagcaacttttta

SEQ ID NO: 92897 - DNA, 25 bp, E. coli
gatacctgaaaagaccataccgatt

SEQ ID NO: 92898 - DNA, 25 bp, E. coli
gatacctgaaaacaccataccgatt

SEQ ID NO: 92899 - DNA, 25 bp, E. coli
ggttaccatgctacattatttatga

SEQ ID NO: 92900 - DNA, 25 bp, E. coli
ggttaccatgcttcattatttatga

SEQ ID NO: 92901 - DNA, 25 bp, E. coli
gataagttaaatcctttgtatacag

SEQ ID NO: 92902 - DNA, 25 bp, E. coli
gataagttaaatgctttgtatacag

SEQ ID NO: 92903 - DNA, 25 bp, E. coli
tacagaaatggcaggtacagcctca

SEQ ID NO: 92904 - DNA, 25 bp, E. coli
tacagaaatggctggtacagcctca

SEQ ID NO: 92905 - DNA, 25 bp, E. coli
aaaactgcaggtctttcctctggca

SEQ ID NO: 92906 - DNA, 25 bp, E. coli
aaaactgcaggtgtttcctctggca

SEQ ID NO: 92907 - DNA, 25 bp, E. coli
ttatacagaataccgggatcgcacg

SEQ ID NO: 92908 - DNA, 25 bp, E. coli
ttatacagaatagcgggatcgcacg

SEQ ID NO: 92909 - DNA, 25 bp, E. coli
tccggaacggaccactgataacctg

SEQ ID NO: 92910 - DNA, 25 bp, E. coli
tcgcgttacagatgggaaaactgca

SEQ ID NO: 92911 - DNA, 25 bp, E. coli
tccggaacggacgactgataacctg

SEQ ID NO: 92912 - DNA, 25 bp, E. coli
tcgcgttacagaagggaaaactgca

SEQ ID NO: 92913 - DNA, 25 bp, E. coli
tcagtcagcctgacatcagaacggt

SEQ ID NO: 92914 - DNA, 25 bp, E. coli
tcagtcagcctgtcatcagaacggt

SEQ ID NO: 92915 - DNA, 25 bp, E. coli
gccggctcattttttacagcggtag

SEQ ID NO: 92916 - DNA, 25 bp, E. coli
gccggctcatttattacagcggtag

SEQ ID NO: 92917 - DNA, 25 bp, E. coli
gttacagaacgttctttacagcgcg

SEQ ID NO: 92918 - DNA, 25 bp, E. coli
gttacagaacgtactttacagcgcg

SEQ ID NO: 92919 - DNA, 25 bp, E. coli
ggtacagcctcagacgacagagcag

SEQ ID NO: 92920 - DNA, 25 bp, E. coli
ggtacagcctcacacgacagagcag

SEQ ID NO: 92921 - DNA, 25 bp, E. coli
ggcgccggatatcactgcaacgttc

SEQ ID NO: 92922 - DNA, 25 bp, E. coli
ggcgccggatatgactgcaacgttc

SEQ ID NO: 92923 - DNA, 25 bp, E. coli
gatggtatccgtcactggagccctg

SEQ ID NO: 92924 - DNA, 25 bp, E. coli
gatggtatccgtgactggagccctg

SEQ ID NO: 92925 - DNA, 25 bp, E. coli
aatattcagtgcttcgacgtcggcg

SEQ ID NO: 92926 - DNA, 25 bp, E. coli
aatattcagtgcatcgacgtcggcg

SEQ ID NO: 92927 - DNA, 25 bp, E. coli
caaagcatgtgggaaacctggcagg

SEQ ID NO: 92928 - DNA, 25 bp, E. coli
caaagcatgtggcaaacctggcagg

SEQ ID NO: 92929 - DNA, 25 bp, E. coli
tactatgacgtttacgagctgggcc

SEQ ID NO: 92930 - DNA, 25 bp, E. coli
tactatgacgttaacgagctgggcc

SEQ ID NO: 92931 - DNA, 25 bp, E. coli
aaagcagctggaaccgcaaaaccgt

SEQ ID NO: 92932 - DNA, 25 bp, E. coli
aaagcagctggatccgcaaaaccgt

SEQ ID NO: 92933 - DNA, 25 bp, E. coli
tatgggtttgccatcgtcagcgggc

SEQ ID NO: 92934 - DNA, 25 bp, E. coli
taccgtggcggacatgctgcaatat

SEQ ID NO: 92935 - DNA, 25 bp, E. coli
taccgtggcggagatgctgcaatat

SEQ ID NO: 92936 - DNA, 25 bp, E. coli
tatgggtttgccttcgtcagcgggc

SEQ ID NO: 92937 - DNA, 25 bp, E. coli
tatcatcggcgtggaacgtaacgaa

SEQ ID NO: 92938 - DNA, 25 bp, E. coli
tatcatcggcgtcgaacgtaacgaa

SEQ ID NO: 92939 - DNA, 25 bp, E. coli
tggtcggcgcatttcaggagatcct

SEQ ID NO: 92940 - DNA, 25 bp, E. coli
tggtcggcgcatatcaggagatcct

SEQ ID NO: 92941 - DNA, 25 bp, E. coli
gaactgtctgaccaaggcgataccg

SEQ ID NO: 92942 - DNA, 25 bp, E. coli
gaactgtctgacgaaggcgataccg

SEQ ID NO: 92943 - DNA, 25 bp, E. coli
gttgcaatgagcacccaggaagcca

SEQ ID NO: 92944 - DNA, 25 bp, E. coli
gttgcaatgagctcccaggaagcca

SEQ ID NO: 92945 - DNA, 25 bp, E. coli
ggaatcctacggctataacggcgat

SEQ ID NO: 92946 - DNA, 25 bp, E. coli
ggaatcctacgggtataacggcgat

SEQ ID NO: 92947 - DNA, 25 bp, E. coli
taaaaaatcctgtacgtgttgcggg

SEQ ID NO: 92948 - DNA, 25 bp, E. coli
taaaaaatcctgaacgtgttgcggg

SEQ ID NO: 92949 - DNA, 25 bp, E. coli
atgttcattgctccgccaacgggcg

SEQ ID NO: 92950 - DNA, 25 bp, E. coli
attgaaacgcctgatcccggtgacc

SEQ ID NO: 92951 - DNA, 25 bp, E. coli
atgttcattgctgcgccaacgggcg

SEQ ID NO: 92952 - DNA, 25 bp, E. coli
attgaaacgcctcatcccggtgacc

SEQ ID NO: 92953 - DNA, 25 bp, E. coli
acatttctgctgtagcgctgacccg

SEQ ID NO: 92954 - DNA, 25 bp, E. coli
aaagcgctctttgcacagctggcgg

SEQ ID NO: 92955 - DNA, 25 bp, E. coli
aaagcgctctttccacagctggcgg

SEQ ID NO: 92956 - DNA, 25 bp, E. coli
acatttctgctgaagcgctgacccg

SEQ ID NO: 92957 - DNA, 25 bp, E. coli
tatcgataccgcgatgcgtcttggg

SEQ ID NO: 92958 - DNA, 25 bp, E. coli
tatcgataccgccatgcgtcttggg

SEQ ID NO: 92959 - DNA, 25 bp, E. coli
ttattattccgaggcctggcgggca

SEQ ID NO: 92960 - DNA, 25 bp, E. coli
ttattattccgacgcctggcgggca

SEQ ID NO: 92961 - DNA, 25 bp, E. coli
tgattgagacactaggcgagacggc

SEQ ID NO: 92962 - DNA, 25 bp, E. coli
tgattgagacacaaggcgagacggc

SEQ ID NO: 92963 - DNA, 25 bp, E. coli
tgatgcgcttcaaaaaggcgtggcc

SEQ ID NO: 92964 - DNA, 25 bp, E. coli
tgatgcgcttcataaaggcgtggcc

SEQ ID NO: 92965 - DNA, 25 bp, E. coli
gaaaactgactgctgaaacctgtga

SEQ ID NO: 92966 - DNA, 25 bp, E. coli
gaaaactgactggtgaaacctgtga

SEQ ID NO: 92967 - DNA, 25 bp, E. coli
gggccgctggaaataaccgatctga

SEQ ID NO: 92968 - DNA, 25 bp, E. coli
gggccgctggaattaaccgatctga

SEQ ID NO: 92969 - DNA, 25 bp, E. coli
caagcgttagagcaccatgaactca

SEQ ID NO: 92970 - DNA, 25 bp, E. coli
caagcgttagaggaccatgaactca

SEQ ID NO: 92971 - DNA, 25 bp, E. coli
taaaaccttgatggtggaagctatc

SEQ ID NO: 92972 - DNA, 25 bp, E. coli
taaaaccttgatcgtggaagctatc

SEQ ID NO: 92973 - DNA, 25 bp, E. coli
taaaacgctggtcctttatcgccca

SEQ ID NO: 92974 - DNA, 25 bp, E. coli
taaaacgctggtgctttatcgccca

SEQ ID NO: 92975 - DNA, 25 bp, E. coli
tgtacaggtcatcggtaaaacgctg

SEQ ID NO: 92976 - DNA, 25 bp, E. coli
tgtacaggtcatgggtaaaacgctg

SEQ ID NO: 92977 - DNA, 25 bp, E. coli
tgaactcatcaaggtgaaaatcgcc

SEQ ID NO: 92978 - DNA, 25 bp, E. coli
tgaaaatcgccaccgaagatcgcga

SEQ ID NO: 92979 - DNA, 25 bp, E. coli
tgaaaatcgccagcgaagatcgcga

SEQ ID NO: 92980 - DNA, 25 bp, E. coli
tgaactcatcaacgtgaaaatcgcc

SEQ ID NO: 92981 - DNA, 25 bp, E. coli
tgctggccgagaatgaacaagcgtt

SEQ ID NO: 92982 - DNA, 25 bp, E. coli
tgctggccgagattgaacaagcgtt

SEQ ID NO: 92983 - DNA, 25 bp, E. coli
tctgcttggcagaaatggtttgacc

SEQ ID NO: 92984 - DNA, 25 bp, E. coli
tctgcttggcagtaatggtttgacc

SEQ ID NO: 92985 - DNA, 25 bp, E. coli
gcacctgaaaggtctggcacatccg

SEQ ID NO: 92986 - DNA, 25 bp, E. coli
gcacctgaaaggactggcacatccg

SEQ ID NO: 92987 - DNA, 25 bp, E. coli
gaacgtaaaatctcgctgccacgct

SEQ ID NO: 92988 - DNA, 25 bp, E. coli
gaacgtaaaatcacgctgccacgct

SEQ ID NO: 92989 - DNA, 25 bp, E. coli
tggaagctatcgtgcgcgaaaccgg

SEQ ID NO: 92990 - DNA, 25 bp, E. coli
tggaagctatcgagcgcgaaaccgg

SEQ ID NO: 92991 - DNA, 25 bp, E. coli
caatattaaaaaagaaagcagccaa

SEQ ID NO: 92992 - DNA, 25 bp, E. coli
caatattaaaaatgaaagcagccaa

SEQ ID NO: 92993 - DNA, 25 bp, E. coli
agagggatttatggaacatcagaga

SEQ ID NO: 92994 - DNA, 25 bp, E. coli
agagggatttatcgaacatcagaga

SEQ ID NO: 92995 - DNA, 25 bp, E. coli
tattcgatacgtcaaattaagaggg

SEQ ID NO: 92996 - DNA, 25 bp, E. coli
tattcgatacgtgaaattaagaggg

SEQ ID NO: 92997 - DNA, 25 bp, E. coli
tcctcatagctacattaaaacaacg

SEQ ID NO: 92998 - DNA, 25 bp, E. coli
tcctcatagctagattaaaacaacg

SEQ ID NO: 92999 - DNA, 25 bp, E. coli
gaatcggccagctatattaaaaaag

SEQ ID NO: 93000 - DNA, 25 bp, E. coli
gaatcggccagcaatattaaaaaag

SEQ ID NO: 93001 - DNA, 25 bp, E. coli
gaaagcagccaatgatgttgcttca

SEQ ID NO: 93002 - DNA, 25 bp, E. coli
gaaagcagccaaagatgttgcttca

SEQ ID NO: 93003 - DNA, 25 bp, E. coli
cgatacgtgaaattaagagggattt

SEQ ID NO: 93004 - DNA, 25 bp, E. coli
cgatacgtgaaaataagagggattt

SEQ ID NO: 93005 - DNA, 25 bp, E. coli
taaaaaagaaaggagccaaagatgt

SEQ ID NO: 93006 - DNA, 25 bp, E. coli
taagagggatttatggaacatcaga

SEQ ID NO: 93007 - DNA, 25 bp, E. coli
taagagggatttttggaacatcaga

SEQ ID NO: 93008 - DNA, 25 bp, E. coli
taaaaaagaaagcagccaaagatgt

SEQ ID NO: 93009 - DNA, 25 bp, E. coli
taaaacaacgtttttcgatacgtga

SEQ ID NO: 93010 - DNA, 25 bp, E. coli
taaaacaacgttattcgatacgtga

SEQ ID NO: 93011 - DNA, 25 bp, E. coli
gatgttgcttcagtattaaaaataa

SEQ ID NO: 93012 - DNA, 25 bp, E. coli
gatgttgcttcactattaaaaataa

SEQ ID NO: 93013 - DNA, 25 bp, E. coli
aatactgcgcgaagcaaaagctggc

SEQ ID NO: 93014 - DNA, 25 bp, E. coli
aatactgcgcgatgcaaaagctggc

SEQ ID NO: 93015 - DNA, 25 bp, E. coli
caggcattctgcaatactgcgcgaa

SEQ ID NO: 93016 - DNA, 25 bp, E. coli
caggcattctgctatactgcgcgaa

SEQ ID NO: 93017 - DNA, 25 bp, E. coli
catcttctgtgctgtgccattgccg

SEQ ID NO: 93018 - DNA, 25 bp, E. coli
catcttctgtgcagtgccattgccg

SEQ ID NO: 93019 - DNA, 25 bp, E. coli
tggtcgctcgcgacattaactaact

SEQ ID NO: 93020 - DNA, 25 bp, E. coli
cgccagcgcatttatttccaccggg

SEQ ID NO: 93021 - DNA, 25 bp, E. coli
cgccagcgcattaatttccaccggg

SEQ ID NO: 93022 - DNA, 25 bp, E. coli
ctgggcctgaactgtgaagagcaaa

SEQ ID NO: 93023 - DNA, 25 bp, E. coli
ctgggcctgaacagtgaagagcaaa

SEQ ID NO: 93024 - DNA, 25 bp, E. coli
ggtgaaaaccaatgcctgcgatctg

SEQ ID NO: 93025 - DNA, 25 bp, E. coli
ggtgcatgctgcgtcctggaaagat

SEQ ID NO: 93026 - DNA, 25 bp, E. coli
ggtgcatgctgcctcctggaaagat

SEQ ID NO: 93027 - DNA, 25 bp, E. coli
ggtgaaaaccaaagcctgcgatctg

SEQ ID NO: 93028 - DNA, 25 bp, E. coli
tggtcgctcgcgtcattaactaact

SEQ ID NO: 93029 - DNA, 25 bp, E. coli
tggaaagatgcggtctccagcgccg

SEQ ID NO: 93030 - DNA, 25 bp, E. coli
ggccttaagcgctgataacatgaac

SEQ ID NO: 93031 - DNA, 25 bp, E. coli
tggaaagatgcgctctccagcgccg

SEQ ID NO: 93032 - DNA, 25 bp, E. coli
ggccttaagcgcagataacatgaac

SEQ ID NO: 93033 - DNA, 25 bp, E. coli
gatggtcagcaactcaatctggata

SEQ ID NO: 93034 - DNA, 25 bp, E. coli
gatggtcagcaagtcaatctggata

SEQ ID NO: 93035 - DNA, 25 bp, E. coli
aattttgccgcgtaaatggcctgcg

SEQ ID NO: 93036 - DNA, 25 bp, E. coli
aattttgccgcgaaaatggcctgcg

SEQ ID NO: 93037 - DNA, 25 bp, E. coli
aaggattcattaacccctccgacgg

SEQ ID NO: 93038 - DNA, 25 bp, E. coli
aaggattcattatcccctccgacgg

SEQ ID NO: 93039 - DNA, 25 bp, E. coli
cagaagtgcttaaaccaggattacg

SEQ ID NO: 93040 - DNA, 25 bp, E. coli
caaaagcggcaaaggattcattatc

SEQ ID NO: 93041 - DNA, 25 bp, E. coli
cagaagtgcttataccaggattacg

SEQ ID NO: 93042 - DNA, 25 bp, E. coli
caaaagcggcaatggattcattatc

SEQ ID NO: 93043 - DNA, 25 bp, E. coli
caggtccatattaccgcattcactc

SEQ ID NO: 93044 - DNA, 25 bp, E. coli
caggtccatatttccgcattcactc

SEQ ID NO: 93045 - DNA, 25 bp, E. coli
atatttccgcattcactccccgcga

SEQ ID NO: 93046 - DNA, 25 bp, E. coli
atatttccgcatacactccccgcga

SEQ ID NO: 93047 - DNA, 25 bp, E. coli
tttgatcgcaaaagcggcaaaggat

SEQ ID NO: 93048 - DNA, 25 bp, E. coli
tttgatcgcaaatgcggcaaaggat

SEQ ID NO: 93049 - DNA, 25 bp, E. coli
tccccgcgacgctgaagtgcttata

SEQ ID NO: 93050 - DNA, 25 bp, E. coli
tcgcaaaagcgggaaaggattcatt

SEQ ID NO: 93051 - DNA, 25 bp, E. coli
tccccgcgacgcagaagtgcttata

SEQ ID NO: 93052 - DNA, 25 bp, E. coli
tcgcaaaagcggcaaaggattcatt

SEQ ID NO: 93053 - DNA, 25 bp, E. coli
tcattatcccctgcgacggtcgtaa

SEQ ID NO: 93054 - DNA, 25 bp, E. coli
tcattatcccctccgacggtcgtaa

SEQ ID NO: 93055 - DNA, 25 bp, E. coli
gcgacgcagaagagcttataccagg

SEQ ID NO: 93056 - DNA, 25 bp, E. coli
gcgacgcagaagtgcttataccagg

SEQ ID NO: 93057 - DNA, 25 bp, E. coli
aatatcagggcggagcgacccgttt

SEQ ID NO: 93058 - DNA, 25 bp, E. coli
aatatcagggcgcagcgacccgttt

SEQ ID NO: 93059 - DNA, 25 bp, E. coli
agtcgccatcgccagagcactggtg

SEQ ID NO: 93060 - DNA, 25 bp, E. coli
agagcactggtgaacgaaccgcgtg

SEQ ID NO: 93061 - DNA, 25 bp, E. coli
agtcgccatcgcgagagcactggtg

SEQ ID NO: 93062 - DNA, 25 bp, E. coli
agagcactggtgtacgaaccgcgtg

SEQ ID NO: 93063 - DNA, 25 bp, E. coli
aacacccctggccaagtgcaggcta

SEQ ID NO: 93064 - DNA, 25 bp, E. coli
aacacccctggcgaagtgcaggcta

SEQ ID NO: 93065 - DNA, 25 bp, E. coli
ttgttgcgggatacgttgggacatc

SEQ ID NO: 93066 - DNA, 25 bp, E. coli
ttgttgcgggattcgttgggacatc

SEQ ID NO: 93067 - DNA, 25 bp, E. coli
tctctatttttggtacgcccgccag

SEQ ID NO: 93068 - DNA, 25 bp, E. coli
tctctatttttgctacgcccgccag

SEQ ID NO: 93069 - DNA, 25 bp, E. coli
gaactgacactgtgcggcggtgaaa

SEQ ID NO: 93070 - DNA, 25 bp, E. coli
gaactgacactgagcggcggtgaaa

SEQ ID NO: 93071 - DNA, 25 bp, E. coli
gcgacccgttttcaactgacactga

SEQ ID NO: 93072 - DNA, 25 bp, E. coli
cgaagtgcaggctaatggcacgatc

SEQ ID NO: 93073 - DNA, 25 bp, E. coli
cgaaccgcgtgtcttgttgctggat

SEQ ID NO: 93074 - DNA, 25 bp, E. coli
cgaagtgcaggcaaatggcacgatc

SEQ ID NO: 93075 - DNA, 25 bp, E. coli
cgaaccgcgtgtgttgttgctggat

SEQ ID NO: 93076 - DNA, 25 bp, E. coli
gcgacccgttttgaactgacactga

SEQ ID NO: 93077 - DNA, 25 bp, E. coli
gattcttgacaaggtagcctacggg

SEQ ID NO: 93078 - DNA, 25 bp, E. coli
gattcttgacaacgtagcctacggg

SEQ ID NO: 93079 - DNA, 25 bp, E. coli
aattatttcgctacactggttccac

SEQ ID NO: 93080 - DNA, 25 bp, E. coli
aattatttcgcttcactggttccac

SEQ ID NO: 93081 - DNA, 25 bp, E. coli
taaattatttcgctacactggttcc

SEQ ID NO: 93082 - DNA, 25 bp, E. coli
taaattatttcggtacactggttcc

SEQ ID NO: 93083 - DNA, 25 bp, E. coli
agggcggaataattcactatcattc

SEQ ID NO: 93084 - DNA, 25 bp, E. coli
agggcggaataaatcactatcattc

SEQ ID NO: 93085 - DNA, 25 bp, E. coli
tatgctggacatatttcattctcta

SEQ ID NO: 93086 - DNA, 25 bp, E. coli
tatgctggacatttttcattctcta

SEQ ID NO: 93087 - DNA, 25 bp, E. coli
tgctgttaaaaatttaatcacctgc

SEQ ID NO: 93088 - DNA, 25 bp, E. coli
tccacttttgtgatttacacgggtt

SEQ ID NO: 93089 - DNA, 25 bp, E. coli
tgctgttaaaaaattaatcacctgc

SEQ ID NO: 93090 - DNA, 25 bp, E. coli
tccacttttgtgttttacacgggtt

SEQ ID NO: 93091 - DNA, 25 bp, E. coli
cgctacactggtaccacttttgtga

SEQ ID NO: 93092 - DNA, 25 bp, E. coli
cgctacactggttccacttttgtga

SEQ ID NO: 93093 - DNA, 25 bp, E. coli
cggaataattcactatcattcaggg

SEQ ID NO: 93094 - DNA, 25 bp, E. coli
cggaataattcagtatcattcaggg

SEQ ID NO: 93095 - DNA, 25 bp, E. coli
taaaaaattaatcacctgccaaaag

SEQ ID NO: 93096 - DNA, 25 bp, E. coli
taaaaaattaatgacctgccaaaag

SEQ ID NO: 93097 - DNA, 25 bp, E. coli
tcacctgccaaaagaaataaaaaag

SEQ ID NO: 93098 - DNA, 25 bp, E. coli
tcacctgccaaatgaaataaaaaag

SEQ ID NO: 93099 - DNA, 25 bp, E. coli
gagaaagcctcccattaaattattt

SEQ ID NO: 93100 - DNA, 25 bp, E. coli
gagaaagcctccgattaaattattt

SEQ ID NO: 93101 - DNA, 25 bp, E. coli
aacgcgccgctgcttaatcagccga

SEQ ID NO: 93102 - DNA, 25 bp, E. coli
aacgcgccgctggttaatcagccga

SEQ ID NO: 93103 - DNA, 25 bp, E. coli
atgatcgccccggaactgccaaagt

SEQ ID NO: 93104 - DNA, 25 bp, E. coli
atgatcgccccgcaactgccaaagt

SEQ ID NO: 93105 - DNA, 25 bp, E. coli
aacagatgaggcgatctccagcgag

SEQ ID NO: 93106 - DNA, 25 bp, E. coli
aacagatgaggccatctccagcgag

SEQ ID NO: 93107 - DNA, 25 bp, E. coli
ttcatgaacttagcgagcgcccgca

SEQ ID NO: 93108 - DNA, 25 bp, E. coli
ttcatgaacttaccgagcgcccgca

SEQ ID NO: 93109 - DNA, 25 bp, E. coli
tgttgcgcctcagcggcgcaggtat

SEQ ID NO: 93110 - DNA, 25 bp, E. coli
tgttgcgcctcaccggcgcaggtat

SEQ ID NO: 93111 - DNA, 25 bp, E. coli
gcattcttcatgaacttaccgagcg

SEQ ID NO: 93112 - DNA, 25 bp, E. coli
gcattcttcatgtacttaccgagcg

SEQ ID NO: 93113 - DNA, 25 bp, E. coli
cgcaactgccaaagtgcattcttca

SEQ ID NO: 93114 - DNA, 25 bp, E. coli
cgcaactgccaatgtgcattcttca

SEQ ID NO: 93115 - DNA, 25 bp, E. coli
cggtgggcgtatgttgcgcctcacc

SEQ ID NO: 93116 - DNA, 25 bp, E. coli
cggtgggcgtatcttgcgcctcacc

SEQ ID NO: 93117 - DNA, 25 bp, E. coli
ggcactgccgttccaccagaagcgg

SEQ ID NO: 93118 - DNA, 25 bp, E. coli
ggcactgccgttgcaccagaagcgg

SEQ ID NO: 93119 - DNA, 25 bp, E. coli
tcaccagcctgaccggtgggcgtat

SEQ ID NO: 93120 - DNA, 25 bp, E. coli
taatcagccgaaacaggcgaccttc

SEQ ID NO: 93121 - DNA, 25 bp, E. coli
taatcagccgaatcaggcgaccttc

SEQ ID NO: 93122 - DNA, 25 bp, E. coli
tcaccagcctgagcggtgggcgtat

SEQ ID NO: 93123 - DNA, 25 bp, E. coli
aagtgatccgctacttctataaggg

SEQ ID NO: 93124 - DNA, 25 bp, E. coli
aagtgatccgcttcttctataaggg

SEQ ID NO: 93125 - DNA, 25 bp, E. coli
cagcagcacgctcagcaaaacgatc

SEQ ID NO: 93126 - DNA, 25 bp, E. coli
cagcagcacgctgagcaaaacgatc

SEQ ID NO: 93127 - DNA, 25 bp, E. coli
cagatgaaaaagagcgctactaccg

SEQ ID NO: 93128 - DNA, 25 bp, E. coli
cagatgaaaaagtgcgctactaccg

SEQ ID NO: 93129 - DNA, 25 bp, E. coli
actaccactttctgtacgccaacgg

SEQ ID NO: 93130 - DNA, 25 bp, E. coli
atgcgcagcgcgataatgccaaccg

SEQ ID NO: 93131 - DNA, 25 bp, E. coli
actaccactttcagtacgccaacgg

SEQ ID NO: 93132 - DNA, 25 bp, E. coli
atgcgcagcgcgttaatgccaaccg

SEQ ID NO: 93133 - DNA, 25 bp, E. coli
tttatgaacagtcacagcagcacgc

SEQ ID NO: 93134 - DNA, 25 bp, E. coli
ttcaccgcttgaggacgggcaggtt

SEQ ID NO: 93135 - DNA, 25 bp, E. coli
tttatgaacagtgacagcagcacgc

SEQ ID NO: 93136 - DNA, 25 bp, E. coli
ttcaccgcttgacgacgggcaggtt

SEQ ID NO: 93137 - DNA, 25 bp, E. coli
tgatcaggccctcagtgatgcgcag

SEQ ID NO: 93138 - DNA, 25 bp, E. coli
tgatcaggccctgagtgatgcgcag

SEQ ID NO: 93139 - DNA, 25 bp, E. coli
tgccgggcaagtcgcgtcgttttac

SEQ ID NO: 93140 - DNA, 25 bp, E. coli
tgccgggcaagtggcgtcgttttac

SEQ ID NO: 93141 - DNA, 25 bp, E. coli
cggataacaaaggacgggttgcact

SEQ ID NO: 93142 - DNA, 25 bp, E. coli
cggataacaaagcacgggttgcact

SEQ ID NO: 93143 - DNA, 25 bp, E. coli
gagaattactacctgatgccgggca

SEQ ID NO: 93144 - DNA, 25 bp, E. coli
gagaattactacgtgatgccgggca

SEQ ID NO: 93145 - DNA, 25 bp, E. coli
ggttctacccctccgtaggcctgat

SEQ ID NO: 93146 - DNA, 25 bp, E. coli
ggttctacccctgcgtaggcctgat

SEQ ID NO: 93147 - DNA, 25 bp, E. coli
tagggatttcctacccgcgcatcaa

SEQ ID NO: 93148 - DNA, 25 bp, E. coli
tagggatttccttcccgcgcatcaa

SEQ ID NO: 93149 - DNA, 25 bp, E. coli
ttttacgccctgacatcctgttcgg

SEQ ID NO: 93150 - DNA, 25 bp, E. coli
ttttacgccctgtcatcctgttcgg

SEQ ID NO: 93151 - DNA, 25 bp, E. coli
tgtcatcctgttcggggcgcattct

SEQ ID NO: 93152 - DNA, 25 bp, E. coli
tgtcatcctgttgggggcgcattct

SEQ ID NO: 93153 - DNA, 25 bp, E. coli
ccttcccgcgcaacaataaaaatgg

SEQ ID NO: 93154 - DNA, 25 bp, E. coli
ccttcccgcgcatcaataaaaatgg

SEQ ID NO: 93155 - DNA, 25 bp, E. coli
gacctacggttctacccctgcgtag

SEQ ID NO: 93156 - DNA, 25 bp, E. coli
gacctacggttcaacccctgcgtag

SEQ ID NO: 93157 - DNA, 25 bp, E. coli
gcattctaacagaaaaagaaaacgt

SEQ ID NO: 93158 - DNA, 25 bp, E. coli
gcattctaacagtaaaagaaaacgt

SEQ ID NO: 93159 - DNA, 25 bp, E. coli
gtcccacgattttacgccctgtcat

SEQ ID NO: 93160 - DNA, 25 bp, E. coli
gtcccacgatttaacgccctgtcat

SEQ ID NO: 93161 - DNA, 25 bp, E. coli
gggcgcattctaacagaaaaagaaa

SEQ ID NO: 93162 - DNA, 25 bp, E. coli
gggcgcattctatcagaaaaagaaa

SEQ ID NO: 93163 - DNA, 25 bp, E. coli
tgtgtcccacgaatttacgccctgt

SEQ ID NO: 93164 - DNA, 25 bp, E. coli
tttgcgtagggatttccttcccgcg

SEQ ID NO: 93165 - DNA, 25 bp, E. coli
tttgcgtagggaattccttcccgcg

SEQ ID NO: 93166 - DNA, 25 bp, E. coli
tgtgtcccacgattttacgccctgt

SEQ ID NO: 93167 - DNA, 25 bp, E. coli
cattttgggcataggtccgaacgcg

SEQ ID NO: 93168 - DNA, 25 bp, E. coli
cataagtccgtggtcacaaagcaca

SEQ ID NO: 93169 - DNA, 25 bp, E. coli
cattttgggcattggtccgaacgcg

SEQ ID NO: 93170 - DNA, 25 bp, E. coli
cataagtccgtgctcacaaagcaca

SEQ ID NO: 93171 - DNA, 25 bp, E. coli
actcataagtccctggtcacaaagc

SEQ ID NO: 93172 - DNA, 25 bp, E. coli
actcataagtccgtggtcacaaagc

SEQ ID NO: 93173 - DNA, 25 bp, E. coli
ttcacgccattttgggcattggtcc

SEQ ID NO: 93174 - DNA, 25 bp, E. coli
ttcacgccatttagggcattggtcc

SEQ ID NO: 93175 - DNA, 25 bp, E. coli
tttcacgccattttgggcattggtc

SEQ ID NO: 93176 - DNA, 25 bp, E. coli
tttcacgccattatgggcattggtc

SEQ ID NO: 93177 - DNA, 25 bp, E. coli
tcataagtccgtcgtcacaaagcac

SEQ ID NO: 93178 - DNA, 25 bp, E. coli
tcataagtccgtggtcacaaagcac

SEQ ID NO: 93179 - DNA, 25 bp, E. coli
ccattttgggcattggtccgaacgc

SEQ ID NO: 93180 - DNA, 25 bp, E. coli
ccattttgggcaatggtccgaacgc

SEQ ID NO: 93181 - DNA, 25 bp, E. coli
gccattttgggctttggtccgaacg

SEQ ID NO: 93182 - DNA, 25 bp, E. coli
gccattttgggcattggtccgaacg

SEQ ID NO: 93183 - DNA, 25 bp, E. coli
ctcataagtccgtggtcacaaagca

SEQ ID NO: 93184 - DNA, 25 bp, E. coli
ctcataagtccgaggtcacaaagca

SEQ ID NO: 93185 - DNA, 25 bp, E. coli
gtttcacgccatattgggcattggt

SEQ ID NO: 93186 - DNA, 25 bp, E. coli
gtttcacgccattttgggcattggt

SEQ ID NO: 93187 - DNA, 25 bp, E. coli
tcacgccattttcggcattggtccg

SEQ ID NO: 93188 - DNA, 25 bp, E. coli
tcacgccattttgggcattggtccg

SEQ ID NO: 93189 - DNA, 25 bp, E. coli
caacttgttgattattgtagcggaa

SEQ ID NO: 93190 - DNA, 25 bp, E. coli
caacttgttgataattgtagcggaa

SEQ ID NO: 93191 - DNA, 25 bp, E. coli
tagcggaaaagtgaggaagaagaac

SEQ ID NO: 93192 - DNA, 25 bp, E. coli
taccgcctcttatcgattcaacttg

SEQ ID NO: 93193 - DNA, 25 bp, E. coli
tagcggaaaagtcaggaagaagaac

SEQ ID NO: 93194 - DNA, 25 bp, E. coli
taccgcctcttaacgattcaacttg

SEQ ID NO: 93195 - DNA, 25 bp, E. coli
ttgtaaaaggcccaatgaatatccg

SEQ ID NO: 93196 - DNA, 25 bp, E. coli
ttgtaaaaggccgaatgaatatccg

SEQ ID NO: 93197 - DNA, 25 bp, E. coli
tgtgagaggtcaaatcagaaaaagg

SEQ ID NO: 93198 - DNA, 25 bp, E. coli
tgataagtttgcttgtgcgggcctg

SEQ ID NO: 93199 - DNA, 25 bp, E. coli
tgataagtttgcatgtgcgggcctg

SEQ ID NO: 93200 - DNA, 25 bp, E. coli
tgtgagaggtcatatcagaaaaagg

SEQ ID NO: 93201 - DNA, 25 bp, E. coli
tcagaaaaaggaatagcgcagattg

SEQ ID NO: 93202 - DNA, 25 bp, E. coli
gcgcagattgagctttttgtaaaag

SEQ ID NO: 93203 - DNA, 25 bp, E. coli
gcgcagattgaggtttttgtaaaag

SEQ ID NO: 93204 - DNA, 25 bp, E. coli
gaatatccggccagagattgctgat

SEQ ID NO: 93205 - DNA, 25 bp, E. coli
gaagaactaattcctgtgagaggtc

SEQ ID NO: 93206 - DNA, 25 bp, E. coli
gaatatccggcctgagattgctgat

SEQ ID NO: 93207 - DNA, 25 bp, E. coli
gaagaactaattgctgtgagaggtc

SEQ ID NO: 93208 - DNA, 25 bp, E. coli
gggactgtccgtccgcgctttcgaa

SEQ ID NO: 93209 - DNA, 25 bp, E. coli
gggactgtccgtgcgcgctttcgaa

SEQ ID NO: 93210 - DNA, 25 bp, E. coli
tcagaaaaaggattagcgcagattg

SEQ ID NO: 93211 - DNA, 25 bp, E. coli
cagacctttaatgcgctgaccatag

SEQ ID NO: 93212 - DNA, 25 bp, E. coli
cagacctttaatccgctgaccatag

SEQ ID NO: 93213 - DNA, 25 bp, E. coli
agtttgcagcaatccctctttgcag

SEQ ID NO: 93214 - DNA, 25 bp, E. coli
agtttgcagcaaaccctctttgcag

SEQ ID NO: 93215 - DNA, 25 bp, E. coli
tattttttcgctccccggcattacg

SEQ ID NO: 93216 - DNA, 25 bp, E. coli
tattttttcgctgcccggcattacg

SEQ ID NO: 93217 - DNA, 25 bp, E. coli
gcatagagagggtttgcagtttgca

SEQ ID NO: 93218 - DNA, 25 bp, E. coli
gcatagagagggattgcagtttgca

SEQ ID NO: 93219 - DNA, 25 bp, E. coli
gcagcgaactcacgcatacatcaag

SEQ ID NO: 93220 - DNA, 25 bp, E. coli
gcagcgaactcaggcatacatcaag

SEQ ID NO: 93221 - DNA, 25 bp, E. coli
cgatcacattaagaaatcagcgctt

SEQ ID NO: 93222 - DNA, 25 bp, E. coli
ccgctgaccataggcgctaacatag

SEQ ID NO: 93223 - DNA, 25 bp, E. coli
cgatcacattaacaaatcagcgctt

SEQ ID NO: 93224 - DNA, 25 bp, E. coli
ccgctgaccatacgcgctaacatag

SEQ ID NO: 93225 - DNA, 25 bp, E. coli
ggattcatcatagaattaattcgta

SEQ ID NO: 93226 - DNA, 25 bp, E. coli
ggattcatcatacaattaattcgta

SEQ ID NO: 93227 - DNA, 25 bp, E. coli
ggcatacatcaagcatagagaggga

SEQ ID NO: 93228 - DNA, 25 bp, E. coli
ggcattacgcaatgcgcagcgaact

SEQ ID NO: 93229 - DNA, 25 bp, E. coli
ggcatacatcaaccatagagaggga

SEQ ID NO: 93230 - DNA, 25 bp, E. coli
ggcattacgcaaagcgcagcgaact

SEQ ID NO: 93231 - DNA, 25 bp, E. coli
taattcgtaaaacgtgctaccgatc

SEQ ID NO: 93232 - DNA, 25 bp, E. coli
taattcgtaaaaggtgctaccgatc

SEQ ID NO: 93233 - DNA, 25 bp, E. coli
caacagcggcgaattagaagtcacg

SEQ ID NO: 93234 - DNA, 25 bp, E. coli
caaacagtgatagcaaggaacccga

SEQ ID NO: 93235 - DNA, 25 bp, E. coli
cactgctggatgatggtcgcctgag

SEQ ID NO: 93236 - DNA, 25 bp, E. coli
caacagcggcgatttagaagtcacg

SEQ ID NO: 93237 - DNA, 25 bp, E. coli
caaacagtgataccaaggaacccga

SEQ ID NO: 93238 - DNA, 25 bp, E. coli
cactgctggatgttggtcgcctgag

SEQ ID NO: 93239 - DNA, 25 bp, E. coli
tacaattacggccttaccggcggcg

SEQ ID NO: 93240 - DNA, 25 bp, E. coli
tacaattacggcgttaccggcggcg

SEQ ID NO: 93241 - DNA, 25 bp, E. coli
atatgttgccaatcagccagcgcgg

SEQ ID NO: 93242 - DNA, 25 bp, E. coli
atatgttgccaaacagccagcgcgg

SEQ ID NO: 93243 - DNA, 25 bp, E. coli
tacgcggtatcggaaacagtagtgc

SEQ ID NO: 93244 - DNA, 25 bp, E. coli
tacgcggtatcgcaaacagtagtgc

SEQ ID NO: 93245 - DNA, 25 bp, E. coli
tgacgctctcgctatatctgggcaa

SEQ ID NO: 93246 - DNA, 25 bp, E. coli
tgacgctctcgcaatatctgggcaa

SEQ ID NO: 93247 - DNA, 25 bp, E. coli
gcggcctgctcgcttctgaagatta

SEQ ID NO: 93248 - DNA, 25 bp, E. coli
gcggcctgctcggttctgaagatta

SEQ ID NO: 93249 - DNA, 25 bp, E. coli
gaaatgcgtcttgatggctcactgc

SEQ ID NO: 93250 - DNA, 25 bp, E. coli
gaaatgcgtcttcatggctcactgc

SEQ ID NO: 93251 - DNA, 25 bp, E. coli
gtcagcgatcgcaacggtaaaccgt

SEQ ID NO: 93252 - DNA, 25 bp, E. coli
gtcagcgatcgctacggtaaaccgt

SEQ ID NO: 93253 - DNA, 25 bp, E. coli
ggaacccgaatttgctgaagccacg

SEQ ID NO: 93254 - DNA, 25 bp, E. coli
ggaacccgaattagctgaagccacg

SEQ ID NO: 93255 - DNA, 25 bp, E. coli
cagaaaggcggacaagtgtttaccg

SEQ ID NO: 93256 - DNA, 25 bp, E. coli
cagaaaggcggagaagtgtttaccg

SEQ ID NO: 93257 - DNA, 25 bp, E. coli
tacgtttgtcttttgtaacccgatg

SEQ ID NO: 93258 - DNA, 25 bp, E. coli
tacgtttgtcttatgtaacccgatg

SEQ ID NO: 93259 - DNA, 25 bp, E. coli
tgtttcccgttatctgctgctaccg

SEQ ID NO: 93260 - DNA, 25 bp, E. coli
tgtttcccgttaactgctgctaccg

SEQ ID NO: 93261 - DNA, 25 bp, E. coli
tttgtaacccgatgaccttaagtct

SEQ ID NO: 93262 - DNA, 25 bp, E. coli
tttgtaacccgaagaccttaagtct

SEQ ID NO: 93263 - DNA, 25 bp, E. coli
tctgctgctaccgtgcattggtacg

SEQ ID NO: 93264 - DNA, 25 bp, E. coli
tctgctgctaccctgcattggtacg

SEQ ID NO: 93265 - DNA, 25 bp, E. coli
gctgctaccgtgcattggtacgttt

SEQ ID NO: 93266 - DNA, 25 bp, E. coli
gctgctaccgtggattggtacgttt

SEQ ID NO: 93267 - DNA, 25 bp, E. coli
cccgatgacctttagtcttggtcgc

SEQ ID NO: 93268 - DNA, 25 bp, E. coli
ccctgtttcccgttatctgctgcta

SEQ ID NO: 93269 - DNA, 25 bp, E. coli
cgttatctgctgctaccgtgcattg

SEQ ID NO: 93270 - DNA, 25 bp, E. coli
cgttatctgctggtaccgtgcattg

SEQ ID NO: 93271 - DNA, 25 bp, E. coli
cccgatgaccttaagtcttggtcgc

SEQ ID NO: 93272 - DNA, 25 bp, E. coli
ccctgtttcccgatatctgctgcta

SEQ ID NO: 93273 - DNA, 25 bp, E. coli
gtaacccgatgaccttaagtcttgg

SEQ ID NO: 93274 - DNA, 25 bp, E. coli
ggttcatcgggctgttccagaaagg

SEQ ID NO: 93275 - DNA, 25 bp, E. coli
gtaacccgatgagcttaagtcttgg

SEQ ID NO: 93276 - DNA, 25 bp, E. coli
ggttcatcgggcagttccagaaagg

SEQ ID NO: 93277 - DNA, 25 bp, E. coli
aaccagacgatcatagcgagtgggc

SEQ ID NO: 93278 - DNA, 25 bp, E. coli
aaccagacgatcttagcgagtgggc

SEQ ID NO: 93279 - DNA, 25 bp, E. coli
caaaagatggtgtgcctcgcttgca

SEQ ID NO: 93280 - DNA, 25 bp, E. coli
caaaagatggtgagcctcgcttgca

SEQ ID NO: 93281 - DNA, 25 bp, E. coli
tactcgtggcgatcaaatggaacta

SEQ ID NO: 93282 - DNA, 25 bp, E. coli
tactcgtggcgaacaaatggaacta

SEQ ID NO: 93283 - DNA, 25 bp, E. coli
tatccacggtatgcgctgaggctta

SEQ ID NO: 93284 - DNA, 25 bp, E. coli
tatggttcctaatcaggtaacgccg

SEQ ID NO: 93285 - DNA, 25 bp, E. coli
tatggttcctaaacaggtaacgccg

SEQ ID NO: 93286 - DNA, 25 bp, E. coli
tatccacggtatccgctgaggctta

SEQ ID NO: 93287 - DNA, 25 bp, E. coli
ttgaagatcaacttggagcgccagt

SEQ ID NO: 93288 - DNA, 25 bp, E. coli
ttgaagatcaacatggagcgccagt

SEQ ID NO: 93289 - DNA, 25 bp, E. coli
tcgcttgcacataaaagaacccggc

SEQ ID NO: 93290 - DNA, 25 bp, E. coli
tcgcttgcacattaaagaacccggc

SEQ ID NO: 93291 - DNA, 25 bp, E. coli
tctgttgtgggaagcacagcgccgt

SEQ ID NO: 93292 - DNA, 25 bp, E. coli
tctgttgtgggatgcacagcgccgt

SEQ ID NO: 93293 - DNA, 25 bp, E. coli
gattcgccacgaccatgccaaatgg

SEQ ID NO: 93294 - DNA, 25 bp, E. coli
gattcgccacgagcatgccaaatgg

SEQ ID NO: 93295 - DNA, 25 bp, E. coli
ggaactagcacgtattgcactggca

SEQ ID NO: 93296 - DNA, 25 bp, E. coli
ggaactagcacgaattgcactggca

SEQ ID NO: 93297 - DNA, 25 bp, E. coli
taacgccggaaatcagcaacgcgat

SEQ ID NO: 93298 - DNA, 25 bp, E. coli
taacgccggaaaacagcaacgcgat

SEQ ID NO: 93299 - DNA, 25 bp, E. coli
caaaaatgcggatgtatgggctgca

SEQ ID NO: 93300 - DNA, 25 bp, E. coli
cactgacggtcacgtcgcctatggt

SEQ ID NO: 93301 - DNA, 25 bp, E. coli
caaaacccgtcttgcatttgcaggc

SEQ ID NO: 93302 - DNA, 25 bp, E. coli
cactgacggtcaggtcgcctatggt

SEQ ID NO: 93303 - DNA, 25 bp, E. coli
caaaaatgcggaagtatgggctgca

SEQ ID NO: 93304 - DNA, 25 bp, E. coli
cacaaaactttgtagcagtagcaca

SEQ ID NO: 93305 - DNA, 25 bp, E. coli
cacaaaactttgaagcagtagcaca

SEQ ID NO: 93306 - DNA, 25 bp, E. coli
caaaacccgtctagcatttgcaggc

SEQ ID NO: 93307 - DNA, 25 bp, E. coli
caggcctgaaatttggtgattacgg

SEQ ID NO: 93308 - DNA, 25 bp, E. coli
caggcctgaaatatggtgattacgg

SEQ ID NO: 93309 - DNA, 25 bp, E. coli
aagaccttggtgatcatggtgaccg

SEQ ID NO: 93310 - DNA, 25 bp, E. coli
aagaccttggtgttcatggtgaccg

SEQ ID NO: 93311 - DNA, 25 bp, E. coli
tagtcaagtatgacgatgtcggtgc

SEQ ID NO: 93312 - DNA, 25 bp, E. coli
tagtcaagtatgtcgatgtcggtgc

SEQ ID NO: 93313 - DNA, 25 bp, E. coli
gcactactggtgatgcaacttatcg

SEQ ID NO: 93314 - DNA, 25 bp, E. coli
gcactactggtgttgcaacttatcg

SEQ ID NO: 93315 - DNA, 25 bp, E. coli
ggtattgataccgacgacatcgtcg

SEQ ID NO: 93316 - DNA, 25 bp, E. coli
ggtattgatacccacgacatcgtcg

SEQ ID NO: 93317 - DNA, 25 bp, E. coli
ggctgcaggcctgaaatatgatgcg

SEQ ID NO: 93318 - DNA, 25 bp, E. coli
ggctgcaggcctcaaatatgatgcg

SEQ ID NO: 93319 - DNA, 25 bp, E. coli
taagagcaaattgaatgcctccggc

SEQ ID NO: 93320 - DNA, 25 bp, E. coli
taagagcaaattcaatgcctccggc

SEQ ID NO: 93321 - DNA, 25 bp, E. coli
accggtgccgatcaccccgttacag

SEQ ID NO: 93322 - DNA, 25 bp, E. coli
accggtgccgatgaccccgttacag

SEQ ID NO: 93323 - DNA, 25 bp, E. coli
tagcgcaccggtgccgatgaccccg

SEQ ID NO: 93324 - DNA, 25 bp, E. coli
tagcgcaccggtcccgatgaccccg

SEQ ID NO: 93325 - DNA, 25 bp, E. coli
tgctggtggaagataaccgcgatta

SEQ ID NO: 93326 - DNA, 25 bp, E. coli
tgctggtggaagttaaccgcgatta

SEQ ID NO: 93327 - DNA, 25 bp, E. coli
gctggtggaagttaaccgcgattac

SEQ ID NO: 93328 - DNA, 25 bp, E. coli
gctggtggaagtaaaccgcgattac

SEQ ID NO: 93329 - DNA, 25 bp, E. coli
ccgtgctggtggaagttaaccgcga

SEQ ID NO: 93330 - DNA, 25 bp, E. coli
cgccgtgctggtggaagttaaccgc

SEQ ID NO: 93331 - DNA, 25 bp, E. coli
ccgtgctggtggtagttaaccgcga

SEQ ID NO: 93332 - DNA, 25 bp, E. coli
cgccgtgctggtcgaagttaaccgc

SEQ ID NO: 93333 - DNA, 25 bp, E. coli
ctggtggaagttaaccgcgattacg

SEQ ID NO: 93334 - DNA, 25 bp, E. coli
cgtgctggtggatgttaaccgcgat

SEQ ID NO: 93335 - DNA, 25 bp, E. coli
cgtgctggtggaagttaaccgcgat

SEQ ID NO: 93336 - DNA, 25 bp, E. coli
ctggtggaagtttaccgcgattacg

SEQ ID NO: 93337 - DNA, 25 bp, E. coli
gtgctggtggaagttaaccgcgatt

SEQ ID NO: 93338 - DNA, 25 bp, E. coli
gtgctggtggaacttaaccgcgatt

SEQ ID NO: 93339 - DNA, 25 bp, E. coli
tggtggaagttaaccgcgattacgt

SEQ ID NO: 93340 - DNA, 25 bp, E. coli
tggtggaagttatccgcgattacgt

SEQ ID NO: 93341 - DNA, 25 bp, E. coli
tggaagttaaccgcgattacgtcac

SEQ ID NO: 93342 - DNA, 25 bp, E. coli
tggaagttaaccccgattacgtcac

SEQ ID NO: 93343 - DNA, 25 bp, E. coli
caaaaaatataaattgaaagtgtgg

SEQ ID NO: 93344 - DNA, 25 bp, E. coli
caaaaaatataatttgaaagtgtgg

SEQ ID NO: 93345 - DNA, 25 bp, E. coli
taaaaataagactgttttctacgcg

SEQ ID NO: 93346 - DNA, 25 bp, E. coli
taaaaataagacagttttctacgcg

SEQ ID NO: 93347 - DNA, 25 bp, E. coli
taagactgttttctacgcgaattca

SEQ ID NO: 93348 - DNA, 25 bp, E. coli
aaataagactgttttctacgcgaat

SEQ ID NO: 93349 - DNA, 25 bp, E. coli
aaataagactgtattctacgcgaat

SEQ ID NO: 93350 - DNA, 25 bp, E. coli
taagactgttttgtacgcgaattca

SEQ ID NO: 93351 - DNA, 25 bp, E. coli
tagtctttccacaaatataggcaaa

SEQ ID NO: 93352 - DNA, 25 bp, E. coli
tagtctttccactaatataggcaaa

SEQ ID NO: 93353 - DNA, 25 bp, E. coli
ttccacaaatataggcaaaaaatat

SEQ ID NO: 93354 - DNA, 25 bp, E. coli
ttccacaaatattggcaaaaaatat

SEQ ID NO: 93355 - DNA, 25 bp, E. coli
tgtatagtctttgcacaaatatagg

SEQ ID NO: 93356 - DNA, 25 bp, E. coli
tgtatagtctttccacaaatatagg

SEQ ID NO: 93357 - DNA, 25 bp, E. coli
tataatttgaaactgtggtttacta

SEQ ID NO: 93358 - DNA, 25 bp, E. coli
tataatttgaaagtgtggtttacta

SEQ ID NO: 93359 - DNA, 25 bp, E. coli
gactgttttctacgcgaattcatag

SEQ ID NO: 93360 - DNA, 25 bp, E. coli
gactgttttctaggcgaattcatag

SEQ ID NO: 93361 - DNA, 25 bp, E. coli
gtctttccacaaatataggcaaaaa

SEQ ID NO: 93362 - DNA, 25 bp, E. coli
gtctttccacaattataggcaaaaa

SEQ ID NO: 93363 - DNA, 25 bp, E. coli
tgtggtttactaaaaataagactgt

SEQ ID NO: 93364 - DNA, 25 bp, E. coli
tgtggtttactataaataagactgt

SEQ ID NO: 93365 - DNA, 25 bp, E. coli
catgaattttgcttggaaccgtgcg

SEQ ID NO: 93366 - DNA, 25 bp, E. coli
catgaattttgcatggaaccgtgcg

SEQ ID NO: 93367 - DNA, 25 bp, E. coli
tacgcagcataacgcgctaaattcg

SEQ ID NO: 93368 - DNA, 25 bp, E. coli
agcctctttcggagttagcgtaaca

SEQ ID NO: 93369 - DNA, 25 bp, E. coli
agcctctttcggtgttagcgtaaca

SEQ ID NO: 93370 - DNA, 25 bp, E. coli
tacgcagcataaggcgctaaattcg

SEQ ID NO: 93371 - DNA, 25 bp, E. coli
ttttcaattttaaccaggagacgga

SEQ ID NO: 93372 - DNA, 25 bp, E. coli
ttttcaattttatccaggagacgga

SEQ ID NO: 93373 - DNA, 25 bp, E. coli
tgcttgaaatatggtgatgccgtac

SEQ ID NO: 93374 - DNA, 25 bp, E. coli
tgatgccgtacccataacacaggga

SEQ ID NO: 93375 - DNA, 25 bp, E. coli
tgcttgaaatatcgtgatgccgtac

SEQ ID NO: 93376 - DNA, 25 bp, E. coli
tgatgccgtaccgataacacaggga

SEQ ID NO: 93377 - DNA, 25 bp, E. coli
gctaaattcgcagaaaggcccgtca

SEQ ID NO: 93378 - DNA, 25 bp, E. coli
gctgataatccgtccataaggttac

SEQ ID NO: 93379 - DNA, 25 bp, E. coli
gctgataatccgaccataaggttac

SEQ ID NO: 93380 - DNA, 25 bp, E. coli
gctaaattcgcacaaaggcccgtca

SEQ ID NO: 93381 - DNA, 25 bp, E. coli
tggaaccgtgcgtaaagcctctttc

SEQ ID NO: 93382 - DNA, 25 bp, E. coli
tggaaccgtgcgaaaagcctctttc

SEQ ID NO: 93383 - DNA, 25 bp, E. coli
taacacagggacaagctgataatcc

SEQ ID NO: 93384 - DNA, 25 bp, E. coli
taaggttacaatcggtacagcaggt

SEQ ID NO: 93385 - DNA, 25 bp, E. coli
taacacagggactagctgataatcc

SEQ ID NO: 93386 - DNA, 25 bp, E. coli
taaggttacaatgggtacagcaggt

SEQ ID NO: 93387 - DNA, 25 bp, E. coli
caagaaacggtattggcgctcaggc

SEQ ID NO: 93388 - DNA, 25 bp, E. coli
aatgtcactgaatttgccccgggag

SEQ ID NO: 93389 - DNA, 25 bp, E. coli
caagaaacggtaatggcgctcaggc

SEQ ID NO: 93390 - DNA, 25 bp, E. coli
aatgtcactgaaattgccccgggag

SEQ ID NO: 93391 - DNA, 25 bp, E. coli
tacatattgccaaacgctgcggagc

SEQ ID NO: 93392 - DNA, 25 bp, E. coli
tacatattgccatacgctgcggagc

SEQ ID NO: 93393 - DNA, 25 bp, E. coli
acatgttgcatcctacgctggcggc

SEQ ID NO: 93394 - DNA, 25 bp, E. coli
acatgttgcatcgtacgctggcggc

SEQ ID NO: 93395 - DNA, 25 bp, E. coli
tagagattgaggaactggccaccgg

SEQ ID NO: 93396 - DNA, 25 bp, E. coli
tagagattgaggtactggccaccgg

SEQ ID NO: 93397 - DNA, 25 bp, E. coli
tgtggaagacaatgcgctaccgatg

SEQ ID NO: 93398 - DNA, 25 bp, E. coli
tgtggaagacaaagcgctaccgatg

SEQ ID NO: 93399 - DNA, 25 bp, E. coli
gcgcgctaatttccaacccggagaa

SEQ ID NO: 93400 - DNA, 25 bp, E. coli
gcgcgctaatttgcaacccggagaa

SEQ ID NO: 93401 - DNA, 25 bp, E. coli
cattgcttgtatgctcccggtgcgg

SEQ ID NO: 93402 - DNA, 25 bp, E. coli
cattgcttgtatcctcccggtgcgg

SEQ ID NO: 93403 - DNA, 25 bp, E. coli
gattgcgtagtgtgaaaaccagccc

SEQ ID NO: 93404 - DNA, 25 bp, E. coli
gattgcgtagtgagaaaaccagccc

SEQ ID NO: 93405 - DNA, 25 bp, E. coli
tcaaacagggtgtataccgggcaac

SEQ ID NO: 93406 - DNA, 25 bp, E. coli
tcagcagacagtcaaaaagcggccc

SEQ ID NO: 93407 - DNA, 25 bp, E. coli
tcaaacagggtgaataccgggcaac

SEQ ID NO: 93408 - DNA, 25 bp, E. coli
tcagcagacagtgaaaaagcggccc

SEQ ID NO: 93409 - DNA, 25 bp, E. coli
caagcatcgcaagaggaaggacgtc

SEQ ID NO: 93410 - DNA, 25 bp, E. coli
caacctctgctgtggatgcggctga

SEQ ID NO: 93411 - DNA, 25 bp, E. coli
caagcatcgcaacaggaaggacgtc

SEQ ID NO: 93412 - DNA, 25 bp, E. coli
caaagcggagctaggcggcaatatc

SEQ ID NO: 93413 - DNA, 25 bp, E. coli
caaagcggagcttggcggcaatatc

SEQ ID NO: 93414 - DNA, 25 bp, E. coli
caacctctgctgaggatgcggctga

SEQ ID NO: 93415 - DNA, 25 bp, E. coli
tacgaaacttgcttggcgtgacctg

SEQ ID NO: 93416 - DNA, 25 bp, E. coli
tacgaaacttgcatggcgtgacctg

SEQ ID NO: 93417 - DNA, 25 bp, E. coli
tagacgatgtgagtgacgcactgcc

SEQ ID NO: 93418 - DNA, 25 bp, E. coli
tagacgatgtgactgacgcactgcc

SEQ ID NO: 93419 - DNA, 25 bp, E. coli
tccaggagatggtgccagagctttc

SEQ ID NO: 93420 - DNA, 25 bp, E. coli
tccaggagatggagccagagctttc

SEQ ID NO: 93421 - DNA, 25 bp, E. coli
tctggtgcatcacgcaaatggcggt

SEQ ID NO: 93422 - DNA, 25 bp, E. coli
tctggtgcatcaggcaaatggcggt

SEQ ID NO: 93423 - DNA, 25 bp, E. coli
gaatcagagtatcgctatcacaggt

SEQ ID NO: 93424 - DNA, 25 bp, E. coli
gaatcagagtatggctatcacaggt

SEQ ID NO: 93425 - DNA, 25 bp, E. coli
gaaaaatatcgttaaccgcgagcgt

SEQ ID NO: 93426 - DNA, 25 bp, E. coli
gaaaaatatcgtaaaccgcgagcgt

SEQ ID NO: 93427 - DNA, 25 bp, E. coli
gattgaaaccgatggcgaacgcatc

SEQ ID NO: 93428 - DNA, 25 bp, E. coli
gattgaaaccgaaggcgaacgcatc

SEQ ID NO: 93429 - DNA, 25 bp, E. coli
tcacaggttcagtcgatcagttcgg

SEQ ID NO: 93430 - DNA, 25 bp, E. coli
tcacaggttcagacgatcagttcgg

SEQ ID NO: 93431 - DNA, 25 bp, E. coli
tcacggaaatagtgttttatactgg

SEQ ID NO: 93432 - DNA, 25 bp, E. coli
tcacggaaatagagttttatactgg

SEQ ID NO: 93433 - DNA, 25 bp, E. coli
tacgggcgttagattttacaacgat

SEQ ID NO: 93434 - DNA, 25 bp, E. coli
accacatccacacgcagtatgattt

SEQ ID NO: 93435 - DNA, 25 bp, E. coli
accacatccacaggcagtatgattt

SEQ ID NO: 93436 - DNA, 25 bp, E. coli
tacgggcgttagtttttacaacgat

SEQ ID NO: 93437 - DNA, 25 bp, E. coli
tagatccctcctagctttaaaacgt

SEQ ID NO: 93438 - DNA, 25 bp, E. coli
tagatccctccttgctttaaaacgt

SEQ ID NO: 93439 - DNA, 25 bp, E. coli
tatacctctggtttttagatccctc

SEQ ID NO: 93440 - DNA, 25 bp, E. coli
tatacctctggtatttagatccctc

SEQ ID NO: 93441 - DNA, 25 bp, E. coli
tttattgccataagccagtcgatgc

SEQ ID NO: 93442 - DNA, 25 bp, E. coli
tttattgccatatgccagtcgatgc

SEQ ID NO: 93443 - DNA, 25 bp, E. coli
tgattttttgttcgcatgattagcc

SEQ ID NO: 93444 - DNA, 25 bp, E. coli
tgattttttgttggcatgattagcc

SEQ ID NO: 93445 - DNA, 25 bp, E. coli
tctttgcagtcataatacgggcgtt

SEQ ID NO: 93446 - DNA, 25 bp, E. coli
tctttgcagtcaaaatacgggcgtt

SEQ ID NO: 93447 - DNA, 25 bp, E. coli
ccgcctttgtcaacttttattgcca

SEQ ID NO: 93448 - DNA, 25 bp, E. coli
ccgcctttgtcatcttttattgcca

SEQ ID NO: 93449 - DNA, 25 bp, E. coli
gatttcttatcgctatatacctctg

SEQ ID NO: 93450 - DNA, 25 bp, E. coli
gattagccatgtctttttcacggaa

SEQ ID NO: 93451 - DNA, 25 bp, E. coli
gattagccatgtgtttttcacggaa

SEQ ID NO: 93452 - DNA, 25 bp, E. coli
gatttcttatcggtatatacctctg

SEQ ID NO: 93453 - DNA, 25 bp, E. coli
caaacgcttatgctgccggtgaggt

SEQ ID NO: 93454 - DNA, 25 bp, E. coli
caaacgcttatggtgccggtgaggt

SEQ ID NO: 93455 - DNA, 25 bp, E. coli
cataagtcggtaggtggtagcgcac

SEQ ID NO: 93456 - DNA, 25 bp, E. coli
cataagtcggtacgtggtagcgcac

SEQ ID NO: 93457 - DNA, 25 bp, E. coli
tacgggcaggaatatcgttacgctc

SEQ ID NO: 93458 - DNA, 25 bp, E. coli
tacgggcaggaaaatcgttacgctc

SEQ ID NO: 93459 - DNA, 25 bp, E. coli
tattggcgcaaccactgaaaacccg

SEQ ID NO: 93460 - DNA, 25 bp, E. coli
tattggcgcaacgactgaaaacccg

SEQ ID NO: 93461 - DNA, 25 bp, E. coli
tgattgcccgctatgcgaacgctga

SEQ ID NO: 93462 - DNA, 25 bp, E. coli
tgattgcccgctttgcgaacgctga

SEQ ID NO: 93463 - DNA, 25 bp, E. coli
tcgatgatagcgctaagcgggtcct

SEQ ID NO: 93464 - DNA, 25 bp, E. coli
tcgatgatagcggtaagcgggtcct

SEQ ID NO: 93465 - DNA, 25 bp, E. coli
gaattactgaccgaaatcgccggtg

SEQ ID NO: 93466 - DNA, 25 bp, E. coli
gaattactgacccaaatcgccggtg

SEQ ID NO: 93467 - DNA, 25 bp, E. coli
cgatggaagacataacccgtggcta

SEQ ID NO: 93468 - DNA, 25 bp, E. coli
cgatggaagacaaaacccgtggcta

SEQ ID NO: 93469 - DNA, 25 bp, E. coli
gattgctttactggcgttggcccgg

SEQ ID NO: 93470 - DNA, 25 bp, E. coli
gattgctttactcgcgttggcccgg

SEQ ID NO: 93471 - DNA, 25 bp, E. coli
taatacttttcatcctctggccgcg

SEQ ID NO: 93472 - DNA, 25 bp, E. coli
taatacttttcaacctctggccgcg

SEQ ID NO: 93473 - DNA, 25 bp, E. coli
taatgaaggaaatgggctacgggca

SEQ ID NO: 93474 - DNA, 25 bp, E. coli
taatgaaggaaaagggctacgggca

SEQ ID NO: 93475 - DNA, 25 bp, E. coli
aaccggtgccattgagcgtgcggat

SEQ ID NO: 93476 - DNA, 25 bp, E. coli
taactaccgccgaatcatgcaccgg

SEQ ID NO: 93477 - DNA, 25 bp, E. coli
taactaccgccgtatcatgcaccgg

SEQ ID NO: 93478 - DNA, 25 bp, E. coli
aaccggtgccatagagcgtgcggat

SEQ ID NO: 93479 - DNA, 25 bp, E. coli
tattaaaggccacaactacactgcg

SEQ ID NO: 93480 - DNA, 25 bp, E. coli
tattaaaggccagaactacactgcg

SEQ ID NO: 93481 - DNA, 25 bp, E. coli
tattgaaaacctcacatccgcgttg

SEQ ID NO: 93482 - DNA, 25 bp, E. coli
tattgaaaacctgacatccgcgttg

SEQ ID NO: 93483 - DNA, 25 bp, E. coli
ttagctttagcggtgaggtttgccc

SEQ ID NO: 93484 - DNA, 25 bp, E. coli
tttgctggcgacagcgaaacggtat

SEQ ID NO: 93485 - DNA, 25 bp, E. coli
tttgctggcgactgcgaaacggtat

SEQ ID NO: 93486 - DNA, 25 bp, E. coli
ttagctttagcgctgaggtttgccc

SEQ ID NO: 93487 - DNA, 25 bp, E. coli
tgaaaatcctcagcgtaagccagca

SEQ ID NO: 93488 - DNA, 25 bp, E. coli
tgaaaatcctcaccgtaagccagca

SEQ ID NO: 93489 - DNA, 25 bp, E. coli
cgccctgtgtgcagctgaagataca

SEQ ID NO: 93490 - DNA, 25 bp, E. coli
cgccctgtgtgctgctgaagataca

SEQ ID NO: 93491 - DNA, 25 bp, E. coli
gtattgccattaccggctacggcgg

SEQ ID NO: 93492 - DNA, 25 bp, E. coli
gtattgccattagcggctacggcgg

SEQ ID NO: 93493 - DNA, 25 bp, E. coli
gatcaattacgcttaactaccgccg

SEQ ID NO: 93494 - DNA, 25 bp, E. coli
gatcaattacgcataactaccgccg

SEQ ID NO: 93495 - DNA, 25 bp, E. coli
ggctttgttactttcaccgatcagg

SEQ ID NO: 93496 - DNA, 25 bp, E. coli
ggctttgttactatcaccgatcagg

SEQ ID NO: 93497 - DNA, 25 bp, E. coli
caataccggcaatcagaattgcgga

SEQ ID NO: 93498 - DNA, 25 bp, E. coli
aattgcggatggaactattcaggcc

SEQ ID NO: 93499 - DNA, 25 bp, E. coli
aatatacgccatttgacatcctcca

SEQ ID NO: 93500 - DNA, 25 bp, E. coli
caataccggcaaacagaattgcgga

SEQ ID NO: 93501 - DNA, 25 bp, E. coli
aattgcggatggtactattcaggcc

SEQ ID NO: 93502 - DNA, 25 bp, E. coli
aatatacgccatatgacatcctcca

SEQ ID NO: 93503 - DNA, 25 bp, E. coli
cagccagtattgcatggctttctta

SEQ ID NO: 93504 - DNA, 25 bp, E. coli
cagccagtattggatggctttctta

SEQ ID NO: 93505 - DNA, 25 bp, E. coli
tatcgatgaggacttttttcagcca

SEQ ID NO: 93506 - DNA, 25 bp, E. coli
tatcgatgaggagttttttcagcca

SEQ ID NO: 93507 - DNA, 25 bp, E. coli
ttatcgccggggtacaataccggca

SEQ ID NO: 93508 - DNA, 25 bp, E. coli
ttatcgccggggaacaataccggca

SEQ ID NO: 93509 - DNA, 25 bp, E. coli
tcaggcccacgaagatatcgatgag

SEQ ID NO: 93510 - DNA, 25 bp, E. coli
tcaggcccacgatgatatcgatgag

SEQ ID NO: 93511 - DNA, 25 bp, E. coli
gaggagttttttcagccagtattgg

SEQ ID NO: 93512 - DNA, 25 bp, E. coli
gaggagttttttgagccagtattgg

SEQ ID NO: 93513 - DNA, 25 bp, E. coli
cggcaatcagaattgcggatggaac

SEQ ID NO: 93514 - DNA, 25 bp, E. coli
cggcaatcagaaatgcggatggaac

SEQ ID NO: 93515 - DNA, 25 bp, E. coli
ggctttcttataaccaaatatacgc

SEQ ID NO: 93516 - DNA, 25 bp, E. coli
ggctttcttatatccaaatatacgc

SEQ ID NO: 93517 - DNA, 25 bp, E. coli
gatggaactattgaggcccacgatg

SEQ ID NO: 93518 - DNA, 25 bp, E. coli
gatggaactattcaggcccacgatg

SEQ ID NO: 93519 - DNA, 25 bp, E. coli
caacagactgttttaccgctacgca

SEQ ID NO: 93520 - DNA, 25 bp, E. coli
caacagactgttataccgctacgca

SEQ ID NO: 93521 - DNA, 25 bp, E. coli
tactgaaaaatacaggcgctgccgg

SEQ ID NO: 93522 - DNA, 25 bp, E. coli
tactgaaaaatagaggcgctgccgg

SEQ ID NO: 93523 - DNA, 25 bp, E. coli
tacgcaacagtattcttcgggcatt

SEQ ID NO: 93524 - DNA, 25 bp, E. coli
tacgcaacagtaatcttcgggcatt

SEQ ID NO: 93525 - DNA, 25 bp, E. coli
tatttcaaattacaccgtgtgcaga

SEQ ID NO: 93526 - DNA, 25 bp, E. coli
tatttttctggtcctctgcctgcgg

SEQ ID NO: 93527 - DNA, 25 bp, E. coli
tatttttctggtgctctgcctgcgg

SEQ ID NO: 93528 - DNA, 25 bp, E. coli
tatttcaaattagaccgtgtgcaga

SEQ ID NO: 93529 - DNA, 25 bp, E. coli
tgagtcatgccctgaaggtccggcg

SEQ ID NO: 93530 - DNA, 25 bp, E. coli
tgagtcatgcccagaaggtccggcg

SEQ ID NO: 93531 - DNA, 25 bp, E. coli
ccatgtttaacacggactcctggtg

SEQ ID NO: 93532 - DNA, 25 bp, E. coli
ccatgtttaacagggactcctggtg

SEQ ID NO: 93533 - DNA, 25 bp, E. coli
gcttaaagccgtttgccatggacgt

SEQ ID NO: 93534 - DNA, 25 bp, E. coli
gcttaaagccgtatgccatggacgt

SEQ ID NO: 93535 - DNA, 25 bp, E. coli
gcaatgattgaatccgctgaacgtg

SEQ ID NO: 93536 - DNA, 25 bp, E. coli
gcaatgattgaaaccgctgaacgtg

SEQ ID NO: 93537 - DNA, 25 bp, E. coli
cattctgaatatctggcgctgacgg

SEQ ID NO: 93538 - DNA, 25 bp, E. coli
cattctgaatatgtggcgctgacgg

SEQ ID NO: 93539 - DNA, 25 bp, E. coli
ggacggaccgtgctttattgccaga

SEQ ID NO: 93540 - DNA, 25 bp, E. coli
ggacggaccgtggtttattgccaga

SEQ ID NO: 93541 - DNA, 25 bp, E. coli
caccgcggatcacggtactaacatc

SEQ ID NO: 93542 - DNA, 25 bp, E. coli
caccgcggatcagggtactaacatc

SEQ ID NO: 93543 - DNA, 25 bp, E. coli
aaagactttcttttcgcgaccctga

SEQ ID NO: 93544 - DNA, 25 bp, E. coli
gaacccagagttgatcggtccggct

SEQ ID NO: 93545 - DNA, 25 bp, E. coli
gaacccagagttcatcggtccggct

SEQ ID NO: 93546 - DNA, 25 bp, E. coli
aaagactttcttatcgcgaccctga

SEQ ID NO: 93547 - DNA, 25 bp, E. coli
tataacccggaactcgataccgcac

SEQ ID NO: 93548 - DNA, 25 bp, E. coli
tataacccggaagtcgataccgcac

SEQ ID NO: 93549 - DNA, 25 bp, E. coli
tgggctacatcaaagacaacctggc

SEQ ID NO: 93550 - DNA, 25 bp, E. coli
tgggctacatcatagacaacctggc

SEQ ID NO: 93551 - DNA, 25 bp, E. coli
tcattactggatgcgctgggctaca

SEQ ID NO: 93552 - DNA, 25 bp, E. coli
tcattactggatccgctgggctaca

SEQ ID NO: 93553 - DNA, 25 bp, E. coli
gaagtctgcccgaaacacgtcgatc

SEQ ID NO: 93554 - DNA, 25 bp, E. coli
gaagtctgcccgtaacacgtcgatc

SEQ ID NO: 93555 - DNA, 25 bp, E. coli
gaaagtctggaagcgatcaaaccgt

SEQ ID NO: 93556 - DNA, 25 bp, E. coli
gaaagtctggaaccgatcaaaccgt

SEQ ID NO: 93557 - DNA, 25 bp, E. coli
cgttataacgaacatagccgcgacc

SEQ ID NO: 93558 - DNA, 25 bp, E. coli
cgttataacgaagatagccgcgacc

SEQ ID NO: 93559 - DNA, 25 bp, E. coli
tggcgaagtatcaccagttctccgg

SEQ ID NO: 93560 - DNA, 25 bp, E. coli
tggttaacaacgagccaaaactggc

SEQ ID NO: 93561 - DNA, 25 bp, E. coli
tggcgaagtatctccagttctccgg

SEQ ID NO: 93562 - DNA, 25 bp, E. coli
tggttaacaacgtgccaaaactggc

SEQ ID NO: 93563 - DNA, 25 bp, E. coli
cagcgggtgaaagaagggcgcttgt

SEQ ID NO: 93564 - DNA, 25 bp, E. coli
cagcgggtgaaacaagggcgcttgt

SEQ ID NO: 93565 - DNA, 25 bp, E. coli
aaaccagcggttgcgtggcagtgcg

SEQ ID NO: 93566 - DNA, 25 bp, E. coli
aaaccagcggttccgtggcagtgcg

SEQ ID NO: 93567 - DNA, 25 bp, E. coli
ttcgcgcaacggcaaggtatttctc

SEQ ID NO: 93568 - DNA, 25 bp, E. coli
ttcgcgcaacgggaaggtatttctc

SEQ ID NO: 93569 - DNA, 25 bp, E. coli
tctggcattacgcttgttaccttcg

SEQ ID NO: 93570 - DNA, 25 bp, E. coli
tctggcattacggttgttaccttcg

SEQ ID NO: 93571 - DNA, 25 bp, E. coli
gcgacattacactcgcgcggcgcag

SEQ ID NO: 93572 - DNA, 25 bp, E. coli
gcgacattacacacgcgcggcgcag

SEQ ID NO: 93573 - DNA, 25 bp, E. coli
gcaaggtatttctctggcattacgg

SEQ ID NO: 93574 - DNA, 25 bp, E. coli
gcaaggtatttcactggcattacgg

SEQ ID NO: 93575 - DNA, 25 bp, E. coli
gcaacggcaaggaatttctctggca

SEQ ID NO: 93576 - DNA, 25 bp, E. coli
gcaacggcaaggtatttctctggca

SEQ ID NO: 93577 - DNA, 25 bp, E. coli
gaacagcttggtccgccaccggtat

SEQ ID NO: 93578 - DNA, 25 bp, E. coli
gaacagcttggtgcgccaccggtat

SEQ ID NO: 93579 - DNA, 25 bp, E. coli
gtgcgttcgcgctacggcaaggtat

SEQ ID NO: 93580 - DNA, 25 bp, E. coli
gtgcgttcgcgcaacggcaaggtat

SEQ ID NO: 93581 - DNA, 25 bp, E. coli
ggtgctggcgactttacacacgcgc

SEQ ID NO: 93582 - DNA, 25 bp, E. coli
ggtgcgccaccgctattgccggaat

SEQ ID NO: 93583 - DNA, 25 bp, E. coli
ggtgctggcgacattacacacgcgc

SEQ ID NO: 93584 - DNA, 25 bp, E. coli
ggtgcgccaccggtattgccggaat

SEQ ID NO: 93585 - DNA, 25 bp, E. coli
catgaagtgaactcgctacgtgaag

SEQ ID NO: 93586 - DNA, 25 bp, E. coli
catgaagtgaacacgctacgtgaag

SEQ ID NO: 93587 - DNA, 25 bp, E. coli
tacatgatggcctgtgtggcggaca

SEQ ID NO: 93588 - DNA, 25 bp, E. coli
tacatgatggccagtgtggcggaca

SEQ ID NO: 93589 - DNA, 25 bp, E. coli
agatgaaagaagaactggccgcggc

SEQ ID NO: 93590 - DNA, 25 bp, E. coli
agatgaaagaagtactggccgcggc

SEQ ID NO: 93591 - DNA, 25 bp, E. coli
taccgttgtgctagcgattgcggcg

SEQ ID NO: 93592 - DNA, 25 bp, E. coli
taccgttgtgcttgcgattgcggcg

SEQ ID NO: 93593 - DNA, 25 bp, E. coli
tttaaaggcagcatggacgcccatg

SEQ ID NO: 93594 - DNA, 25 bp, E. coli
tttaaaggcagcttggacgcccatg

SEQ ID NO: 93595 - DNA, 25 bp, E. coli
gcagcattcaaagcgcaggatcagg

SEQ ID NO: 93596 - DNA, 25 bp, E. coli
gcagcattcaaaccgcaggatcagg

SEQ ID NO: 93597 - DNA, 25 bp, E. coli
gactcattgaccgattcaccggcag

SEQ ID NO: 93598 - DNA, 25 bp, E. coli
gactcattgacccattcaccggcag

SEQ ID NO: 93599 - DNA, 25 bp, E. coli
cgggtgaacactcgtacggacaaca

SEQ ID NO: 93600 - DNA, 25 bp, E. coli
cgggtgaacactggtacggacaaca

SEQ ID NO: 93601 - DNA, 25 bp, E. coli
gatcaggttgtgctccgtctggaaa

SEQ ID NO: 93602 - DNA, 25 bp, E. coli
gatcaggttgtggtccgtctggaaa

SEQ ID NO: 93603 - DNA, 25 bp, E. coli
tcaacgtaataaacgccagcgtggc

SEQ ID NO: 93604 - DNA, 25 bp, E. coli
tcaacgtaataatcgccagcgtggc

SEQ ID NO: 93605 - DNA, 25 bp, E. coli
ggtcaacaatctcagcgaacagtat

SEQ ID NO: 93606 - DNA, 25 bp, E. coli
ggtcaacaatctgagcgaacagtat

SEQ ID NO: 93607 - DNA, 25 bp, E. coli
cagtcacaaggcataccgaggtaaa

SEQ ID NO: 93608 - DNA, 25 bp, E. coli
cagtcacaaggcttaccgaggtaaa

SEQ ID NO: 93609 - DNA, 25 bp, E. coli
taaagtgtcagtttgcgacgcgagc

SEQ ID NO: 93610 - DNA, 25 bp, E. coli
taaagtgtcagtatgcgacgcgagc

SEQ ID NO: 93611 - DNA, 25 bp, E. coli
cccactgaaaggagtttacggagct

SEQ ID NO: 93612 - DNA, 25 bp, E. coli
cccactgaaaggtgtttacggagct

SEQ ID NO: 93613 - DNA, 25 bp, E. coli
aaaataatgcaaaaacgcgctgtcg

SEQ ID NO: 93614 - DNA, 25 bp, E. coli
aaaataatgcaataacgcgctgtcg

SEQ ID NO: 93615 - DNA, 25 bp, E. coli
tattttacgtccaacgtgcgaagca

SEQ ID NO: 93616 - DNA, 25 bp, E. coli
tattttacgtcctacgtgcgaagca

SEQ ID NO: 93617 - DNA, 25 bp, E. coli
ttacgtctgtgtcgcgcttgatgcc

SEQ ID NO: 93618 - DNA, 25 bp, E. coli
ttacgtctgtgtggcgcttgatgcc

SEQ ID NO: 93619 - DNA, 25 bp, E. coli
tgccagcgggtttgcgcaaaagcaa

SEQ ID NO: 93620 - DNA, 25 bp, E. coli
tgccagcgggttagcgcaaaagcaa

SEQ ID NO: 93621 - DNA, 25 bp, E. coli
tctacgcgccagagggaaattcacc

SEQ ID NO: 93622 - DNA, 25 bp, E. coli
tctacgcgccagtgggaaattcacc

SEQ ID NO: 93623 - DNA, 25 bp, E. coli
gacgcgagcggcattttaggacata

SEQ ID NO: 93624 - DNA, 25 bp, E. coli
gacgcgagcggctttttaggacata

SEQ ID NO: 93625 - DNA, 25 bp, E. coli
tcagctggtgagttaattaacgggc

SEQ ID NO: 93626 - DNA, 25 bp, E. coli
tcagctggtgagataattaacgggc

SEQ ID NO: 93627 - DNA, 25 bp, E. coli
taagcatattgaagtccagtcccgt

SEQ ID NO: 93628 - DNA, 25 bp, E. coli
taagcatattgatgtccagtcccgt

SEQ ID NO: 93629 - DNA, 25 bp, E. coli
tacgtctgatgccaaaaggatgtgc

SEQ ID NO: 93630 - DNA, 25 bp, E. coli
acgtctgatgccaaaaggatgtgca

SEQ ID NO: 93631 - DNA, 25 bp, E. coli
acgtctgatgcctaaaggatgtgca

SEQ ID NO: 93632 - DNA, 25 bp, E. coli
tacgtctgatgcgaaaaggatgtgc

SEQ ID NO: 93633 - DNA, 25 bp, E. coli
tttacgtctgatgccaaaaggatgt

SEQ ID NO: 93634 - DNA, 25 bp, E. coli
ttacgtctgatggcaaaaggatgtg

SEQ ID NO: 93635 - DNA, 25 bp, E. coli
ttacgtctgatgccaaaaggatgtg

SEQ ID NO: 93636 - DNA, 25 bp, E. coli
tttacgtctgatcccaaaaggatgt

SEQ ID NO: 93637 - DNA, 25 bp, E. coli
tgatgccaaaagcatgtgcacaatg

SEQ ID NO: 93638 - DNA, 25 bp, E. coli
tgatgccaaaaggatgtgcacaatg

SEQ ID NO: 93639 - DNA, 25 bp, E. coli
tctgatgccaaaaggatgtgcacaa

SEQ ID NO: 93640 - DNA, 25 bp, E. coli
tctgatgccaaatggatgtgcacaa

SEQ ID NO: 93641 - DNA, 25 bp, E. coli
ctgatgccaaaacgatgtgcacaat

SEQ ID NO: 93642 - DNA, 25 bp, E. coli
cgtttacgtctgatgccaaaaggat

SEQ ID NO: 93643 - DNA, 25 bp, E. coli
ctgatgccaaaaggatgtgcacaat

SEQ ID NO: 93644 - DNA, 25 bp, E. coli
cgtttacgtctgttgccaaaaggat

SEQ ID NO: 93645 - DNA, 25 bp, E. coli
cgtctgatgccataaggatgtgcac

SEQ ID NO: 93646 - DNA, 25 bp, E. coli
cgtctgatgccaaaaggatgtgcac

SEQ ID NO: 93647 - DNA, 25 bp, E. coli
gtttacgtctgaagccaaaaggatg

SEQ ID NO: 93648 - DNA, 25 bp, E. coli
gtttacgtctgatgccaaaaggatg

SEQ ID NO: 93649 - DNA, 25 bp, E. coli
gtctgatgccaataggatgtgcaca

SEQ ID NO: 93650 - DNA, 25 bp, E. coli
gtctgatgccaaaaggatgtgcaca

SEQ ID NO: 93651 - DNA, 25 bp, E. coli
cacgggttccatagacggtgtaccg

SEQ ID NO: 93652 - DNA, 25 bp, E. coli
cacgggttccattgacggtgtaccg

SEQ ID NO: 93653 - DNA, 25 bp, E. coli
catgcctgaaaacctgacgttaacc

SEQ ID NO: 93654 - DNA, 25 bp, E. coli
catgcctgaaaagctgacgttaacc

SEQ ID NO: 93655 - DNA, 25 bp, E. coli
aaagatatcctctcgggttccattg

SEQ ID NO: 93656 - DNA, 25 bp, E. coli
aaagatatcctcacgggttccattg

SEQ ID NO: 93657 - DNA, 25 bp, E. coli
tatcctcacgggttccattgacggt

SEQ ID NO: 93658 - DNA, 25 bp, E. coli
tatcctcacgggatccattgacggt

SEQ ID NO: 93659 - DNA, 25 bp, E. coli
tcgcgacaggttcggaaccggtatt

SEQ ID NO: 93660 - DNA, 25 bp, E. coli
tcgcgacaggttgggaaccggtatt

SEQ ID NO: 93661 - DNA, 25 bp, E. coli
gcctgaaaagctcacgttaaccaaa

SEQ ID NO: 93662 - DNA, 25 bp, E. coli
gcctgaaaagctgacgttaaccaaa

SEQ ID NO: 93663 - DNA, 25 bp, E. coli
gctgacgttaacgaaatccaccctt

SEQ ID NO: 93664 - DNA, 25 bp, E. coli
gctgacgttaaccaaatccaccctt

SEQ ID NO: 93665 - DNA, 25 bp, E. coli
gaaaagctgacgataaccaaatcca

SEQ ID NO: 93666 - DNA, 25 bp, E. coli
gaaaagctgacgttaaccaaatcca

SEQ ID NO: 93667 - DNA, 25 bp, E. coli
cattgacggtgttccggacatctac

SEQ ID NO: 93668 - DNA, 25 bp, E. coli
cattgacggtgtaccggacatctac

SEQ ID NO: 93669 - DNA, 25 bp, E. coli
gttccattgacggtgtaccggacat

SEQ ID NO: 93670 - DNA, 25 bp, E. coli
gttccattgacgctgtaccggacat

SEQ ID NO: 93671 - DNA, 25 bp, E. coli
gggcaaagatatgctcacgggttcc

SEQ ID NO: 93672 - DNA, 25 bp, E. coli
gggcaaagatatcctcacgggttcc

SEQ ID NO: 93673 - DNA, 25 bp, E. coli
aatcattgccagtttttcatcgcgg

SEQ ID NO: 93674 - DNA, 25 bp, E. coli
aatcattgccagattttcatcgcgg

SEQ ID NO: 93675 - DNA, 25 bp, E. coli
catgtaatgaatggcacgcaggagc

SEQ ID NO: 93676 - DNA, 25 bp, E. coli
catgtaatgaatcgcacgcaggagc

SEQ ID NO: 93677 - DNA, 25 bp, E. coli
acatgcgggcgcagccatctggagc

SEQ ID NO: 93678 - DNA, 25 bp, E. coli
acatgcgggcgctgccatctggagc

SEQ ID NO: 93679 - DNA, 25 bp, E. coli
ttaagcccggtcgtgaatcattgcc

SEQ ID NO: 93680 - DNA, 25 bp, E. coli
ttaagcccggtcctgaatcattgcc

SEQ ID NO: 93681 - DNA, 25 bp, E. coli
gccggaaccgaataacatgcgggcg

SEQ ID NO: 93682 - DNA, 25 bp, E. coli
ccatctggagcggttcctgctgttc

SEQ ID NO: 93683 - DNA, 25 bp, E. coli
ccagtttttcatcgcggcagggtgc

SEQ ID NO: 93684 - DNA, 25 bp, E. coli
ccagtttttcatggcggcagggtgc

SEQ ID NO: 93685 - DNA, 25 bp, E. coli
gccggaaccgaaaaacatgcgggcg

SEQ ID NO: 93686 - DNA, 25 bp, E. coli
ccatctggagcgcttcctgctgttc

SEQ ID NO: 93687 - DNA, 25 bp, E. coli
gagcaacttactcaacaaaatctga

SEQ ID NO: 93688 - DNA, 25 bp, E. coli
gaaaccgttattgacagttacggtg

SEQ ID NO: 93689 - DNA, 25 bp, E. coli
gagcaacttactgaacaaaatctga

SEQ ID NO: 93690 - DNA, 25 bp, E. coli
gaaaccgttattcacagttacggtg

SEQ ID NO: 93691 - DNA, 25 bp, E. coli
tcacagttacggtgctggcgcaatg

SEQ ID NO: 93692 - DNA, 25 bp, E. coli
tcacagttacggagctggcgcaatg

SEQ ID NO: 93693 - DNA, 25 bp, E. coli
gatgattgacgtcatacgccatgta

SEQ ID NO: 93694 - DNA, 25 bp, E. coli
gatgattgacgtgatacgccatgta

SEQ ID NO: 93695 - DNA, 25 bp, E. coli
aaggccggtatctcttcacaagctg

SEQ ID NO: 93696 - DNA, 25 bp, E. coli
aaggccggtatcacttcacaagctg

SEQ ID NO: 93697 - DNA, 25 bp, E. coli
catgcacctgctgaaattctgcggg

SEQ ID NO: 93698 - DNA, 25 bp, E. coli
catgcacctgctcaaattctgcggg

SEQ ID NO: 93699 - DNA, 25 bp, E. coli
taaaccgttgctccacatgttggcg

SEQ ID NO: 93700 - DNA, 25 bp, E. coli
taaaccgttgctgcacatgttggcg

SEQ ID NO: 93701 - DNA, 25 bp, E. coli
aaattgcgggagcattaacgcggca

SEQ ID NO: 93702 - DNA, 25 bp, E. coli
aaattgcgggaggattaacgcggca

SEQ ID NO: 93703 - DNA, 25 bp, E. coli
tagagatgactgtagaaggccggta

SEQ ID NO: 93704 - DNA, 25 bp, E. coli
tagagatgactgaagaaggccggta

SEQ ID NO: 93705 - DNA, 25 bp, E. coli
ttaacgcggcaagtagccgaagcat

SEQ ID NO: 93706 - DNA, 25 bp, E. coli
ttaacgcggcaactagccgaagcat

SEQ ID NO: 93707 - DNA, 25 bp, E. coli
tgctgatgaatagccgtcaggccaa

SEQ ID NO: 93708 - DNA, 25 bp, E. coli
tgaaaagtggctcgagttggcatct

SEQ ID NO: 93709 - DNA, 25 bp, E. coli
tgctgatgaatacccgtcaggccaa

SEQ ID NO: 93710 - DNA, 25 bp, E. coli
tgaaaagtggctggagttggcatct

SEQ ID NO: 93711 - DNA, 25 bp, E. coli
gcgggagcgcttcattagtcgtaaa

SEQ ID NO: 93712 - DNA, 25 bp, E. coli
gcgggagcgcttgattagtcgtaaa

SEQ ID NO: 93713 - DNA, 25 bp, E. coli
gaagcattttatgcccgcaccgatg

SEQ ID NO: 93714 - DNA, 25 bp, E. coli
gaagcattttatccccgcaccgatg

SEQ ID NO: 93715 - DNA, 25 bp, E. coli
gatggccccaatgtcgagcgtgtgc

SEQ ID NO: 93716 - DNA, 25 bp, E. coli
gatggccccaatctcgagcgtgtgc

SEQ ID NO: 93717 - DNA, 25 bp, E. coli
caaagggctgaacgaacaggacaag

SEQ ID NO: 93718 - DNA, 25 bp, E. coli
caaagggctgaaggaacaggacaag

SEQ ID NO: 93719 - DNA, 25 bp, E. coli
taacaagcaagtcgatgtcgccacc

SEQ ID NO: 93720 - DNA, 25 bp, E. coli
aaaaaccaccgcgattcaggcgcaa

SEQ ID NO: 93721 - DNA, 25 bp, E. coli
aaatccggcatacgccgaagagcag

SEQ ID NO: 93722 - DNA, 25 bp, E. coli
aaatccggcataggccgaagagcag

SEQ ID NO: 93723 - DNA, 25 bp, E. coli
aaaaaccaccgccattcaggcgcaa

SEQ ID NO: 93724 - DNA, 25 bp, E. coli
tgttaaatccgggatacgccgaaga

SEQ ID NO: 93725 - DNA, 25 bp, E. coli
tgttaaatccggcatacgccgaaga

SEQ ID NO: 93726 - DNA, 25 bp, E. coli
tcgccgtcgctatcaagcaagtgga

SEQ ID NO: 93727 - DNA, 25 bp, E. coli
tcgccgtcgctaacaagcaagtgga

SEQ ID NO: 93728 - DNA, 25 bp, E. coli
gccattcaggcggaactggatgatt

SEQ ID NO: 93729 - DNA, 25 bp, E. coli
gccattcaggcgcaactggatgatt

SEQ ID NO: 93730 - DNA, 25 bp, E. coli
gcaactggatgaattggaccgcctg

SEQ ID NO: 93731 - DNA, 25 bp, E. coli
gcaactggatgatttggaccgcctg

SEQ ID NO: 93732 - DNA, 25 bp, E. coli
cgtgaaggacaacaaagggctgaac

SEQ ID NO: 93733 - DNA, 25 bp, E. coli
cgtgaaggacaagaaagggctgaac

SEQ ID NO: 93734 - DNA, 25 bp, E. coli
tcagcaccctgttaaatccggcata

SEQ ID NO: 93735 - DNA, 25 bp, E. coli
tcagcaccctgtaaaatccggcata

SEQ ID NO: 93736 - DNA, 25 bp, E. coli
taacaagcaagtggatgtcgccacc

SEQ ID NO: 93737 - DNA, 25 bp, E. coli
gatgcaaagcgtcaaggacaacaaa

SEQ ID NO: 93738 - DNA, 25 bp, E. coli
gatgcaaagcgtgaaggacaacaaa

SEQ ID NO: 93739 - DNA, 25 bp, E. coli
caatgatagccgtagattttgcctg

SEQ ID NO: 93740 - DNA, 25 bp, E. coli
caatgatagccgaagattttgcctg

SEQ ID NO: 93741 - DNA, 25 bp, E. coli
cagcgactccgtcatagtggtttca

SEQ ID NO: 93742 - DNA, 25 bp, E. coli
cagcgactccgtgatagtggtttca

SEQ ID NO: 93743 - DNA, 25 bp, E. coli
tatatttatcccaacatctaacggt

SEQ ID NO: 93744 - DNA, 25 bp, E. coli
tatatttatccctacatctaacggt

SEQ ID NO: 93745 - DNA, 25 bp, E. coli
tttaacgatggacaagcaggctttc

SEQ ID NO: 93746 - DNA, 25 bp, E. coli
tttaacgatggagaagcaggctttc

SEQ ID NO: 93747 - DNA, 25 bp, E. coli
tgctgaccggagactcatacaagga

SEQ ID NO: 93748 - DNA, 25 bp, E. coli
tgctgaccggagtctcatacaagga

SEQ ID NO: 93749 - DNA, 25 bp, E. coli
tccactttcagtatgctaatgcttg

SEQ ID NO: 93750 - DNA, 25 bp, E. coli
tccactttcagtttgctaatgcttg

SEQ ID NO: 93751 - DNA, 25 bp, E. coli
gcctgttcaggctatggttcgatga

SEQ ID NO: 93752 - DNA, 25 bp, E. coli
gcctgttcaggcaatggttcgatga

SEQ ID NO: 93753 - DNA, 25 bp, E. coli
gctaatgcttgcacctactgattca

SEQ ID NO: 93754 - DNA, 25 bp, E. coli
gctaatgcttgctcctactgattca

SEQ ID NO: 93755 - DNA, 25 bp, E. coli
ggctttcttgttatagtctctacca

SEQ ID NO: 93756 - DNA, 25 bp, E. coli
ggctttcttgttttagtctctacca

SEQ ID NO: 93757 - DNA, 25 bp, E. coli
taacggtaagatttccagacgtcgt

SEQ ID NO: 93758 - DNA, 25 bp, E. coli
taacggtaagatatccagacgtcgt

SEQ ID NO: 93759 - DNA, 25 bp, E. coli
tcaacatgaattgccagcgactccg

SEQ ID NO: 93760 - DNA, 25 bp, E. coli
tcaacatgaattcccagcgactccg

SEQ ID NO: 93761 - DNA, 25 bp, E. coli
caaagtgcgattagacgaagataca

SEQ ID NO: 93762 - DNA, 25 bp, E. coli
caaagtgcgatttgacgaagataca

SEQ ID NO: 93763 - DNA, 25 bp, E. coli
tatcacgcattattcaaaagggact

SEQ ID NO: 93764 - DNA, 25 bp, E. coli
tatcaatgggaatcgccgaggaatg

SEQ ID NO: 93765 - DNA, 25 bp, E. coli
tatcacgcattaatcaaaagggact

SEQ ID NO: 93766 - DNA, 25 bp, E. coli
tatcaatgggaaacgccgaggaatg

SEQ ID NO: 93767 - DNA, 25 bp, E. coli
tcttgagaataatggtccgacgttc

SEQ ID NO: 93768 - DNA, 25 bp, E. coli
tcttgagaataaaggtccgacgttc

SEQ ID NO: 93769 - DNA, 25 bp, E. coli
gcttgatagtccattagtgacgcac

SEQ ID NO: 93770 - DNA, 25 bp, E. coli
gcttgatagtcctttagtgacgcac

SEQ ID NO: 93771 - DNA, 25 bp, E. coli
gacgaacttaaatactccgccgagg

SEQ ID NO: 93772 - DNA, 25 bp, E. coli
gactttgactccttaacagtagctg

SEQ ID NO: 93773 - DNA, 25 bp, E. coli
gacgaacttaaaaactccgccgagg

SEQ ID NO: 93774 - DNA, 25 bp, E. coli
gactttgactccataacagtagctg

SEQ ID NO: 93775 - DNA, 25 bp, E. coli
cttaaataagaatggaagctctggt

SEQ ID NO: 93776 - DNA, 25 bp, E. coli
cttaaataagaaaggaagctctggt

SEQ ID NO: 93777 - DNA, 25 bp, E. coli
tggatcacacaaaacatagcattct

SEQ ID NO: 93778 - DNA, 25 bp, E. coli
tggatcacacaatacatagcattct

SEQ ID NO: 93779 - DNA, 25 bp, E. coli
taaaggtacccgtgcagtaatgcat

SEQ ID NO: 93780 - DNA, 25 bp, E. coli
taaaggtacccgagcagtaatgcat

SEQ ID NO: 93781 - DNA, 25 bp, E. coli
gatgttaatagcctcagtctcagtg

SEQ ID NO: 93782 - DNA, 25 bp, E. coli
gatgttaatagcgtcagtctcagtg

SEQ ID NO: 93783 - DNA, 25 bp, E. coli
aataatcgccggcatacctggagcg

SEQ ID NO: 93784 - DNA, 25 bp, E. coli
aataatcgccgggatacctggagcg

SEQ ID NO: 93785 - DNA, 25 bp, E. coli
tacctggagcgaacatatccgccga

SEQ ID NO: 93786 - DNA, 25 bp, E. coli
tacctggagcgatcatatccgccga

SEQ ID NO: 93787 - DNA, 25 bp, E. coli
tatttgcacaaagagggttgggcga

SEQ ID NO: 93788 - DNA, 25 bp, E. coli
tatttgcacaaacagggttgggcga

SEQ ID NO: 93789 - DNA, 25 bp, E. coli
ttacagatctgtgcggatgctcagc

SEQ ID NO: 93790 - DNA, 25 bp, E. coli
ttacagatctgtccggatgctcagc

SEQ ID NO: 93791 - DNA, 25 bp, E. coli
gaatattacctcacccgtggcagca

SEQ ID NO: 93792 - DNA, 25 bp, E. coli
gaatattacctctcccgtggcagca

SEQ ID NO: 93793 - DNA, 25 bp, E. coli
gacgtccagttcgagttttttgcag

SEQ ID NO: 93794 - DNA, 25 bp, E. coli
gaacaatcattatagaaagccgccc

SEQ ID NO: 93795 - DNA, 25 bp, E. coli
gacgtccagttccagttttttgcag

SEQ ID NO: 93796 - DNA, 25 bp, E. coli
gaacaatcattaaagaaagccgccc

SEQ ID NO: 93797 - DNA, 25 bp, E. coli
cgattattaacagcgcccgtgcgac

SEQ ID NO: 93798 - DNA, 25 bp, E. coli
cgattattaacaccgcccgtgcgac

SEQ ID NO: 93799 - DNA, 25 bp, E. coli
cggcggcctgcggaataatattgaa

SEQ ID NO: 93800 - DNA, 25 bp, E. coli
cggcggcctgcgcaataatattgaa

SEQ ID NO: 93801 - DNA, 25 bp, E. coli
gggcaaaaacacctagcgcaagcgg

SEQ ID NO: 93802 - DNA, 25 bp, E. coli
gggcaaaaacacgtagcgcaagcgg

SEQ ID NO: 93803 - DNA, 25 bp, E. coli
ggataatccggatcttaagccgcgt

SEQ ID NO: 93804 - DNA, 25 bp, E. coli
ggataatccggaacttaagccgcgt

SEQ ID NO: 93805 - DNA, 25 bp, E. coli
aatctgttgttcaaatggcgacaac

SEQ ID NO: 93806 - DNA, 25 bp, E. coli
aatctgttgttctaatggcgacaac

SEQ ID NO: 93807 - DNA, 25 bp, E. coli
taaacagcagctcgttgctgcctcc

SEQ ID NO: 93808 - DNA, 25 bp, E. coli
taaacagcagctggttgctgcctcc

SEQ ID NO: 93809 - DNA, 25 bp, E. coli
aaaggctgcccttattatcctcccg

SEQ ID NO: 93810 - DNA, 25 bp, E. coli
aaaggctgccctaattatcctcccg

SEQ ID NO: 93811 - DNA, 25 bp, E. coli
tatcctcccgaatttaaacagcagc

SEQ ID NO: 93812 - DNA, 25 bp, E. coli
tatcctcccgaaattaaacagcagc

SEQ ID NO: 93813 - DNA, 25 bp, E. coli
ttgctcttgaaattggcattaacgc

SEQ ID NO: 93814 - DNA, 25 bp, E. coli
ttgctcttgaaaatggcattaacgc

SEQ ID NO: 93815 - DNA, 25 bp, E. coli
tgtgaacccgggttatccatctcaa

SEQ ID NO: 93816 - DNA, 25 bp, E. coli
tgtgaacccgggatatccatctcaa

SEQ ID NO: 93817 - DNA, 25 bp, E. coli
tcccggcaggcgtaaaggctgccct

SEQ ID NO: 93818 - DNA, 25 bp, E. coli
tcccggcaggcgaaaaggctgccct

SEQ ID NO: 93819 - DNA, 25 bp, E. coli
gctgcctcctgtgaacccgggatat

SEQ ID NO: 93820 - DNA, 25 bp, E. coli
gctgcctcctgtcaacccgggatat

SEQ ID NO: 93821 - DNA, 25 bp, E. coli
gcagaaaaatgtgactcccggcagg

SEQ ID NO: 93822 - DNA, 25 bp, E. coli
gcagaaaaatgtcactcccggcagg

SEQ ID NO: 93823 - DNA, 25 bp, E. coli
gggatatccatctcaaaacttgctc

SEQ ID NO: 93824 - DNA, 25 bp, E. coli
gggatatccatcacaaaacttgctc

SEQ ID NO: 93825 - DNA, 25 bp, E. coli
tcaaaacttgctcttgaaaatggca

SEQ ID NO: 93826 - DNA, 25 bp, E. coli
tcaaaacttgctgttgaaaatggca

SEQ ID NO: 93827 - DNA, 25 bp, E. coli
cagattaatcgttgtcgccgcgctc

SEQ ID NO: 93828 - DNA, 25 bp, E. coli
cagattaatcgtagtcgccgcgctc

SEQ ID NO: 93829 - DNA, 25 bp, E. coli
tatctccgacagtggtgtccgttct

SEQ ID NO: 93830 - DNA, 25 bp, E. coli
taccgatgaggctactgaacaggct

SEQ ID NO: 93831 - DNA, 25 bp, E. coli
taccgatgaggcaactgaacaggct

SEQ ID NO: 93832 - DNA, 25 bp, E. coli
tatctccgacagaggtgtccgttct

SEQ ID NO: 93833 - DNA, 25 bp, E. coli
tttcccgacacatggtcagcaccgg

SEQ ID NO: 93834 - DNA, 25 bp, E. coli
tatcgttaccgccaactggtcgctg

SEQ ID NO: 93835 - DNA, 25 bp, E. coli
tatcgttaccgcgaactggtcgctg

SEQ ID NO: 93836 - DNA, 25 bp, E. coli
tttcccgacacaaggtcagcaccgg

SEQ ID NO: 93837 - DNA, 25 bp, E. coli
tgctcaatctgggtgaagaactcag

SEQ ID NO: 93838 - DNA, 25 bp, E. coli
tgctcaatctggctgaagaactcag

SEQ ID NO: 93839 - DNA, 25 bp, E. coli
gctgttgttgataacgccgtcgctt

SEQ ID NO: 93840 - DNA, 25 bp, E. coli
gctgttgttgattacgccgtcgctt

SEQ ID NO: 93841 - DNA, 25 bp, E. coli
gaactcagcaacgtatcaaaagcct

SEQ ID NO: 93842 - DNA, 25 bp, E. coli
gaactcagcaacctatcaaaagcct

SEQ ID NO: 93843 - DNA, 25 bp, E. coli
cctgtaaaatcatgggcgtttcgcg

SEQ ID NO: 93844 - DNA, 25 bp, E. coli
cctgtaaaatcaagggcgtttcgcg

SEQ ID NO: 93845 - DNA, 25 bp, E. coli
ccgtcatcaaactcaaagccggttt

SEQ ID NO: 93846 - DNA, 25 bp, E. coli
ccgtcatcaaacacaaagccggttt

SEQ ID NO: 93847 - DNA, 25 bp, E. coli
taaccttaagaaccgtaccgatgag

SEQ ID NO: 93848 - DNA, 25 bp, E. coli
taaccttaagaagcgtaccgatgag

SEQ ID NO: 93849 - DNA, 25 bp, E. coli
caactatcagcctcctgaacagagt

SEQ ID NO: 93850 - DNA, 25 bp, E. coli
caactatcagccacctgaacagagt

SEQ ID NO: 93851 - DNA, 25 bp, E. coli
cagtcattcttcttggcgtggcgag

SEQ ID NO: 93852 - DNA, 25 bp, E. coli
cagtcattcttcatggcgtggcgag

SEQ ID NO: 93853 - DNA, 25 bp, E. coli
tgaatcgtcttaatgaattaacagg

SEQ ID NO: 93854 - DNA, 25 bp, E. coli
tgaatcgtcttattgaattaacagg

SEQ ID NO: 93855 - DNA, 25 bp, E. coli
tcttcttggcgtcgcgagtcacatt

SEQ ID NO: 93856 - DNA, 25 bp, E. coli
tcttcttggcgtggcgagtcacatt

SEQ ID NO: 93857 - DNA, 25 bp, E. coli
gcgtggcgagtcacattgacaacta

SEQ ID NO: 93858 - DNA, 25 bp, E. coli
gcgtggcgagtctcattgacaacta

SEQ ID NO: 93859 - DNA, 25 bp, E. coli
cgttcttgtcgtttcagtcattctt

SEQ ID NO: 93860 - DNA, 25 bp, E. coli
cgttcttgtcgtatcagtcattctt

SEQ ID NO: 93861 - DNA, 25 bp, E. coli
cttggcgtggcgagtcacattgaca

SEQ ID NO: 93862 - DNA, 25 bp, E. coli
cgtcttattgaattaacaggttgga

SEQ ID NO: 93863 - DNA, 25 bp, E. coli
cattgacaactatcagccacctgaa

SEQ ID NO: 93864 - DNA, 25 bp, E. coli
cttggcgtggcgtgtcacattgaca

SEQ ID NO: 93865 - DNA, 25 bp, E. coli
cattgacaactaacagccacctgaa

SEQ ID NO: 93866 - DNA, 25 bp, E. coli
cgtcttattgaaataacaggttgga

SEQ ID NO: 93867 - DNA, 25 bp, E. coli
taacaggttggatcgttcttgtcgt

SEQ ID NO: 93868 - DNA, 25 bp, E. coli
taacaggttggaacgttcttgtcgt

SEQ ID NO: 93869 - DNA, 25 bp, E. coli
gagtcacattgagaactatcagcca

SEQ ID NO: 93870 - DNA, 25 bp, E. coli
gagtcacattgacaactatcagcca

SEQ ID NO: 93871 - DNA, 25 bp, E. coli
caactggatggagtggtgcaacgct

SEQ ID NO: 93872 - DNA, 25 bp, E. coli
caactggatggactggtgcaacgct

SEQ ID NO: 93873 - DNA, 25 bp, E. coli
tacgacgatgttgtaaggctgaaac

SEQ ID NO: 93874 - DNA, 25 bp, E. coli
tacgacgatgttctaaggctgaaac

SEQ ID NO: 93875 - DNA, 25 bp, E. coli
agtggtgcaacggtgccatgacgac

SEQ ID NO: 93876 - DNA, 25 bp, E. coli
agtggtgcaacgctgccatgacgac

SEQ ID NO: 93877 - DNA, 25 bp, E. coli
tacgcaatgtggctgagtatgtaac

SEQ ID NO: 93878 - DNA, 25 bp, E. coli
tatgtaactggcttggcagccctgc

SEQ ID NO: 93879 - DNA, 25 bp, E. coli
tatgtaactggcatggcagccctgc

SEQ ID NO: 93880 - DNA, 25 bp, E. coli
tacgcaatgtgggtgagtatgtaac

SEQ ID NO: 93881 - DNA, 25 bp, E. coli
tatctgatgacacagcaactggatg

SEQ ID NO: 93882 - DNA, 25 bp, E. coli
tatctgatgacagagcaactggatg

SEQ ID NO: 93883 - DNA, 25 bp, E. coli
ccatgacgacctgatgaatgcggag

SEQ ID NO: 93884 - DNA, 25 bp, E. coli
ccatgacgacctcatgaatgcggag

SEQ ID NO: 93885 - DNA, 25 bp, E. coli
gaaccagtttgagatttcctacgac

SEQ ID NO: 93886 - DNA, 25 bp, E. coli
gaaccagtttgacatttcctacgac

SEQ ID NO: 93887 - DNA, 25 bp, E. coli
gcagccctgcagcactgttatgaaa

SEQ ID NO: 93888 - DNA, 25 bp, E. coli
gcagccctgcaggactgttatgaaa

SEQ ID NO: 93889 - DNA, 25 bp, E. coli
gttatgaaaagccagcaggtgccca

SEQ ID NO: 93890 - DNA, 25 bp, E. coli
gttatgaaaagcgagcaggtgccca

SEQ ID NO: 93891 - DNA, 25 bp, E. coli
ggtgcccaatgccaacaactggttt

SEQ ID NO: 93892 - DNA, 25 bp, E. coli
ggtgcccaatgcgaacaactggttt

SEQ ID NO: 93893 - DNA, 25 bp, E. coli
caatatcgcgatacgctgaataaat

SEQ ID NO: 93894 - DNA, 25 bp, E. coli
caatatcgcgattcgctgaataaat

SEQ ID NO: 93895 - DNA, 25 bp, E. coli
caccagtatggtccatggcgtcacc

SEQ ID NO: 93896 - DNA, 25 bp, E. coli
caccagtatggtgcatggcgtcacc

SEQ ID NO: 93897 - DNA, 25 bp, E. coli
caccatcaacaaaaaaggcgcactg

SEQ ID NO: 93898 - DNA, 25 bp, E. coli
caccatcaacaataaaggcgcactg

SEQ ID NO: 93899 - DNA, 25 bp, E. coli
agggtacagcgcacaagctgggcaa

SEQ ID NO: 93900 - DNA, 25 bp, E. coli
agggtacagcgctcaagctgggcaa

SEQ ID NO: 93901 - DNA, 25 bp, E. coli
tgaatacaacaacggtacagcgctc

SEQ ID NO: 93902 - DNA, 25 bp, E. coli
tgaatacaacaagggtacagcgctc

SEQ ID NO: 93903 - DNA, 25 bp, E. coli
gctcagttctgtccgtggaacggta

SEQ ID NO: 93904 - DNA, 25 bp, E. coli
gctcagttctgtgcgtggaacggta

SEQ ID NO: 93905 - DNA, 25 bp, E. coli
gaataaattactccaggatgacgca

SEQ ID NO: 93906 - DNA, 25 bp, E. coli
gcacacgcagctcgcgcaaaatatt

SEQ ID NO: 93907 - DNA, 25 bp, E. coli
gaataaattactgcaggatgacgca

SEQ ID NO: 93908 - DNA, 25 bp, E. coli
gcaaaatattgtcacttcctggctg

SEQ ID NO: 93909 - DNA, 25 bp, E. coli
gcaaaatattgtgacttcctggctg

SEQ ID NO: 93910 - DNA, 25 bp, E. coli
gcacacgcagctggcgcaaaatatt

SEQ ID NO: 93911 - DNA, 25 bp, E. coli
taacgaatgcggcaactgcgctcag

SEQ ID NO: 93912 - DNA, 25 bp, E. coli
taacgaatgcgggaactgcgctcag

SEQ ID NO: 93913 - DNA, 25 bp, E. coli
gagtatggctgcacacccgatttaa

SEQ ID NO: 93914 - DNA, 25 bp, E. coli
gagtatggctgctcacccgatttaa

SEQ ID NO: 93915 - DNA, 25 bp, E. coli
taccatccggcctaagattgtcaag

SEQ ID NO: 93916 - DNA, 25 bp, E. coli
taccatccggccaaagattgtcaag

SEQ ID NO: 93917 - DNA, 25 bp, E. coli
atagattgcaatgcacttgtaggcc

SEQ ID NO: 93918 - DNA, 25 bp, E. coli
atagattgcaatccacttgtaggcc

SEQ ID NO: 93919 - DNA, 25 bp, E. coli
ttatccgtcctacaaaacatcgcaa

SEQ ID NO: 93920 - DNA, 25 bp, E. coli
ttatccgtcctagaaaacatcgcaa

SEQ ID NO: 93921 - DNA, 25 bp, E. coli
tctcaggccgggtgggtaataccat

SEQ ID NO: 93922 - DNA, 25 bp, E. coli
tccggccaaagaatgtcaagtaagt

SEQ ID NO: 93923 - DNA, 25 bp, E. coli
tccggccaaagattgtcaagtaagt

SEQ ID NO: 93924 - DNA, 25 bp, E. coli
tctcaggccgggagggtaataccat

SEQ ID NO: 93925 - DNA, 25 bp, E. coli
ccaaagattgtcaagtaagtgcgct

SEQ ID NO: 93926 - DNA, 25 bp, E. coli
ccaaagattgtctagtaagtgcgct

SEQ ID NO: 93927 - DNA, 25 bp, E. coli
ccgtcctacaaatcatcgcaaattc

SEQ ID NO: 93928 - DNA, 25 bp, E. coli
ccgtcctacaaaacatcgcaaattc

SEQ ID NO: 93929 - DNA, 25 bp, E. coli
tgtcaagtaagtgcgctttgttgat

SEQ ID NO: 93930 - DNA, 25 bp, E. coli
tgtcaagtaagtccgctttgttgat

SEQ ID NO: 93931 - DNA, 25 bp, E. coli
ggtgggtaatacgatccggccattt

SEQ ID NO: 93932 - DNA, 25 bp, E. coli
gggtaataccatgcggccattttca

SEQ ID NO: 93933 - DNA, 25 bp, E. coli
ggtgggtaatacgatccggccaaag

SEQ ID NO: 93934 - DNA, 25 bp, E. coli
ggtgggtaataccatccggccattt

SEQ ID NO: 93935 - DNA, 25 bp, E. coli
ggtgggtaataccatccggccaaag

SEQ ID NO: 93936 - DNA, 25 bp, E. coli
gggtaataccatccggccattttca

SEQ ID NO: 93937 - DNA, 25 bp, E. coli
cagtattcgctgtggttcggtaaga

SEQ ID NO: 93938 - DNA, 25 bp, E. coli
cagtattcgctgaggttcggtaaga

SEQ ID NO: 93939 - DNA, 25 bp, E. coli
atgggtaaactaacgctgctgttgc

SEQ ID NO: 93940 - DNA, 25 bp, E. coli
atgggtaaactatcgctgctgttgc

SEQ ID NO: 93941 - DNA, 25 bp, E. coli
ctttttgccgaatttgacgatctca

SEQ ID NO: 93942 - DNA, 25 bp, E. coli
gcgaaacttaaagcgcgaaacgatc

SEQ ID NO: 93943 - DNA, 25 bp, E. coli
gcgaaacttaaaccgcgaaacgatc

SEQ ID NO: 93944 - DNA, 25 bp, E. coli
ctttttgccgaaattgacgatctca

SEQ ID NO: 93945 - DNA, 25 bp, E. coli
tttatcgtctggagcctgacgcgtc

SEQ ID NO: 93946 - DNA, 25 bp, E. coli
tttatcgtctggtgcctgacgcgtc

SEQ ID NO: 93947 - DNA, 25 bp, E. coli
tgctggctattctggtctggctaca

SEQ ID NO: 93948 - DNA, 25 bp, E. coli
tgacgatctcaaaggcggccaggag

SEQ ID NO: 93949 - DNA, 25 bp, E. coli
tgctggctattcaggtctggctaca

SEQ ID NO: 93950 - DNA, 25 bp, E. coli
tgacgatctcaatggcggccaggag

SEQ ID NO: 93951 - DNA, 25 bp, E. coli
tcggtaagaacggtatacatgacta

SEQ ID NO: 93952 - DNA, 25 bp, E. coli
tcggtaagaacgctatacatgacta

SEQ ID NO: 93953 - DNA, 25 bp, E. coli
cgctcgaagagcgtgcgcgtaatga

SEQ ID NO: 93954 - DNA, 25 bp, E. coli
cgctcgaagagcctgcgcgtaatga

SEQ ID NO: 93955 - DNA, 25 bp, E. coli
taatgaactcaggatgaccaggccg

SEQ ID NO: 93956 - DNA, 25 bp, E. coli
taatgaactcagcatgaccaggccg

SEQ ID NO: 93957 - DNA, 25 bp, E. coli
gatgtggcggcagagcaagctacaa

SEQ ID NO: 93958 - DNA, 25 bp, E. coli
gatgtggcggcacagcaagctacaa

SEQ ID NO: 93959 - DNA, 25 bp, E. coli
caacagatttcattttgcattccaa

SEQ ID NO: 93960 - DNA, 25 bp, E. coli
caacagatttcaatttgcattccaa

SEQ ID NO: 93961 - DNA, 25 bp, E. coli
cattttgcattccaaagttcagagg

SEQ ID NO: 93962 - DNA, 25 bp, E. coli
tttgcacattcgttggatcacttcg

SEQ ID NO: 93963 - DNA, 25 bp, E. coli
ttcagaggtagtgatgattaagaaa

SEQ ID NO: 93964 - DNA, 25 bp, E. coli
tttgcacattcgatggatcacttcg

SEQ ID NO: 93965 - DNA, 25 bp, E. coli
ttcgatgtgcaacaagacttccggc

SEQ ID NO: 93966 - DNA, 25 bp, E. coli
ttcgatgtgcaagaagacttccggc

SEQ ID NO: 93967 - DNA, 25 bp, E. coli
ttcagaggtagtcatgattaagaaa

SEQ ID NO: 93968 - DNA, 25 bp, E. coli
ccaaagttcagacgtagtcatgatt

SEQ ID NO: 93969 - DNA, 25 bp, E. coli
ccaaagttcagaggtagtcatgatt

SEQ ID NO: 93970 - DNA, 25 bp, E. coli
gcattccaaagttcagaggtagtca

SEQ ID NO: 93971 - DNA, 25 bp, E. coli
gcattccaaagtacagaggtagtca

SEQ ID NO: 93972 - DNA, 25 bp, E. coli
gaagacttccggcaacagatttcat

SEQ ID NO: 93973 - DNA, 25 bp, E. coli
gaagacttccgggaacagatttcat

SEQ ID NO: 93974 - DNA, 25 bp, E. coli
gacttccggcaacagatttcatttt

SEQ ID NO: 93975 - DNA, 25 bp, E. coli
gacttccggcaagagatttcatttt

SEQ ID NO: 93976 - DNA, 25 bp, E. coli
cattcgttggatgacttcgatgtgc

SEQ ID NO: 93977 - DNA, 25 bp, E. coli
cattcgttggatcacttcgatgtgc

SEQ ID NO: 93978 - DNA, 25 bp, E. coli
cattttgcattcgaaagttcagagg

SEQ ID NO: 93979 - DNA, 25 bp, E. coli
gttatactatttccacattcgttgg

SEQ ID NO: 93980 - DNA, 25 bp, E. coli
gttatactatttgcacattcgttgg

SEQ ID NO: 93981 - DNA, 25 bp, E. coli
aacgctgtttcgagtgccgtggcaa

SEQ ID NO: 93982 - DNA, 25 bp, E. coli
gcaacctggaggtgccaaccttaaa

SEQ ID NO: 93983 - DNA, 25 bp, E. coli
gcaacctggaggagccaaccttaaa

SEQ ID NO: 93984 - DNA, 25 bp, E. coli
gggaccaacgctgtttcgtgtgccg

SEQ ID NO: 93985 - DNA, 25 bp, E. coli
gggaccaacgctctttcgtgtgccg

SEQ ID NO: 93986 - DNA, 25 bp, E. coli
aacgctgtttcgtgtgccgtggcaa

SEQ ID NO: 93987 - DNA, 25 bp, E. coli
tagccacgggagttttatctcataa

SEQ ID NO: 93988 - DNA, 25 bp, E. coli
tagccacgggagatttatctcataa

SEQ ID NO: 93989 - DNA, 25 bp, E. coli
tttcgtgtgccgaggcaacctggag

SEQ ID NO: 93990 - DNA, 25 bp, E. coli
tttcgtgtgccgtggcaacctggag

SEQ ID NO: 93991 - DNA, 25 bp, E. coli
tctgctaactgcatcgctgcagttt

SEQ ID NO: 93992 - DNA, 25 bp, E. coli
tctatacacaaccacgggggatgtc

SEQ ID NO: 93993 - DNA, 25 bp, E. coli
tctatacacaacgacgggggatgtc

SEQ ID NO: 93994 - DNA, 25 bp, E. coli
tctgctaactgcttcgctgcagttt

SEQ ID NO: 93995 - DNA, 25 bp, E. coli
cgttagccacggcagatttatctca

SEQ ID NO: 93996 - DNA, 25 bp, E. coli
cgttagccacgggagatttatctca

SEQ ID NO: 93997 - DNA, 25 bp, E. coli
ggaatattctatacacaacgacggg

SEQ ID NO: 93998 - DNA, 25 bp, E. coli
ggaatattctattcacaacgacggg

SEQ ID NO: 93999 - DNA, 25 bp, E. coli
tggaggtgccaaccttaaacttcgg

SEQ ID NO: 94000 - DNA, 25 bp, E. coli
tggaggtgccaagcttaaacttcgg

SEQ ID NO: 94001 - DNA, 25 bp, E. coli
gatgtcgttagccacgggagattta

SEQ ID NO: 94002 - DNA, 25 bp, E. coli
gatgtcgttagcgacgggagattta

SEQ ID NO: 94003 - DNA, 25 bp, E. coli
aaccattggcgatatcacggcgacc

SEQ ID NO: 94004 - DNA, 25 bp, E. coli
caagaactgattatggtgccaacgc

SEQ ID NO: 94005 - DNA, 25 bp, E. coli
aaccattggcgaaatcacggcgacc

SEQ ID NO: 94006 - DNA, 25 bp, E. coli
caagaactgattttggtgccaacgc

SEQ ID NO: 94007 - DNA, 25 bp, E. coli
tatcgtttctcgtgagccgctgaac

SEQ ID NO: 94008 - DNA, 25 bp, E. coli
tatgtcgctgttagcctccggtgtg

SEQ ID NO: 94009 - DNA, 25 bp, E. coli
tatgtcgctgtttgcctccggtgtg

SEQ ID NO: 94010 - DNA, 25 bp, E. coli
tatcgtttctcgagagccgctgaac

SEQ ID NO: 94011 - DNA, 25 bp, E. coli
tgtaatgtttggcaccatcgccgcc

SEQ ID NO: 94012 - DNA, 25 bp, E. coli
tgtaatgtttgggaccatcgccgcc

SEQ ID NO: 94013 - DNA, 25 bp, E. coli
tgaatggctgaaaaacctgctctcc

SEQ ID NO: 94014 - DNA, 25 bp, E. coli
tgaatggctgaataacctgctctcc

SEQ ID NO: 94015 - DNA, 25 bp, E. coli
tcgagtcagaaaatgcgcaaccggt

SEQ ID NO: 94016 - DNA, 25 bp, E. coli
tcgagtcagaaattgcgcaaccggt

SEQ ID NO: 94017 - DNA, 25 bp, E. coli
cattgaatggagactgctgctgccg

SEQ ID NO: 94018 - DNA, 25 bp, E. coli
cattgaatggagtctgctgctgccg

SEQ ID NO: 94019 - DNA, 25 bp, E. coli
gattctgattatcgcgctgtcgctg

SEQ ID NO: 94020 - DNA, 25 bp, E. coli
gattctgattatggcgctgtcgctg

SEQ ID NO: 94021 - DNA, 25 bp, E. coli
gatcacttcgctcgaaaccattggc

SEQ ID NO: 94022 - DNA, 25 bp, E. coli
gttgtctattcagggcaccagcttc

SEQ ID NO: 94023 - DNA, 25 bp, E. coli
gttgtctattcacggcaccagcttc

SEQ ID NO: 94024 - DNA, 25 bp, E. coli
gatcacttcgctggaaaccattggc

SEQ ID NO: 94025 - DNA, 25 bp, E. coli
agcagactactatttccggcaattc

SEQ ID NO: 94026 - DNA, 25 bp, E. coli
atttccggcaatacctgtctcctca

SEQ ID NO: 94027 - DNA, 25 bp, E. coli
agcagactactaattccggcaattc

SEQ ID NO: 94028 - DNA, 25 bp, E. coli
atttccggcaattcctgtctcctca

SEQ ID NO: 94029 - DNA, 25 bp, E. coli
acttagcagacttctatttccggca

SEQ ID NO: 94030 - DNA, 25 bp, E. coli
acttagcagactactatttccggca

SEQ ID NO: 94031 - DNA, 25 bp, E. coli
tatctgcgatttgcgaaattgcctg

SEQ ID NO: 94032 - DNA, 25 bp, E. coli
tatctgcgatttccgaaattgcctg

SEQ ID NO: 94033 - DNA, 25 bp, E. coli
tgctatctgcgaattgcgaaattgc

SEQ ID NO: 94034 - DNA, 25 bp, E. coli
tgctatctgcgatttgcgaaattgc

SEQ ID NO: 94035 - DNA, 25 bp, E. coli
tgcctgatgcgcttcacttagcaga

SEQ ID NO: 94036 - DNA, 25 bp, E. coli
tgcctgatgcgcatcacttagcaga

SEQ ID NO: 94037 - DNA, 25 bp, E. coli
tcacttagcagagtactatttccgg

SEQ ID NO: 94038 - DNA, 25 bp, E. coli
tcacttagcagactactatttccgg

SEQ ID NO: 94039 - DNA, 25 bp, E. coli
cctgatgcgcttcacttagcagact

SEQ ID NO: 94040 - DNA, 25 bp, E. coli
cctgatgcgcttgacttagcagact

SEQ ID NO: 94041 - DNA, 25 bp, E. coli
gcgcttcacttaccagactactatt

SEQ ID NO: 94042 - DNA, 25 bp, E. coli
gcgatttgcgaatttgcctgatgcg

SEQ ID NO: 94043 - DNA, 25 bp, E. coli
gcgatttgcgaaattgcctgatgcg

SEQ ID NO: 94044 - DNA, 25 bp, E. coli
gcgcttcacttagcagactactatt

SEQ ID NO: 94045 - DNA, 25 bp, E. coli
gatgcgcttcacttagcagactact

SEQ ID NO: 94046 - DNA, 25 bp, E. coli
gatgcgcttcacatagcagactact

SEQ ID NO: 94047 - DNA, 25 bp, E. coli
caatgatattcgctctctggcgggt

SEQ ID NO: 94048 - DNA, 25 bp, E. coli
caatgatattcggtctctggcgggt

SEQ ID NO: 94049 - DNA, 25 bp, E. coli
catctggcgggccacgtattaagcg

SEQ ID NO: 94050 - DNA, 25 bp, E. coli
caggtattcagcattccgcgaacga

SEQ ID NO: 94051 - DNA, 25 bp, E. coli
catctggcgggcgacgtattaagcg

SEQ ID NO: 94052 - DNA, 25 bp, E. coli
caggtattcagctttccgcgaacga

SEQ ID NO: 94053 - DNA, 25 bp, E. coli
agatattctgactacctgcgcgcag

SEQ ID NO: 94054 - DNA, 25 bp, E. coli
agatattctgacaacctgcgcgcag

SEQ ID NO: 94055 - DNA, 25 bp, E. coli
tatgctgaaactgggcgactggctg

SEQ ID NO: 94056 - DNA, 25 bp, E. coli
tatgctgaaactcggcgactggctg

SEQ ID NO: 94057 - DNA, 25 bp, E. coli
tggtactgcggagcttcgaaaaacg

SEQ ID NO: 94058 - DNA, 25 bp, E. coli
tgaccttaatggaacgccaactggc

SEQ ID NO: 94059 - DNA, 25 bp, E. coli
tgaccttaatggtacgccaactggc

SEQ ID NO: 94060 - DNA, 25 bp, E. coli
gaatcgccagcatggttctacggag

SEQ ID NO: 94061 - DNA, 25 bp, E. coli
gaatcgccagcaaggttctacggag

SEQ ID NO: 94062 - DNA, 25 bp, E. coli
gaaatgcaacgtgtgaataaagcgc

SEQ ID NO: 94063 - DNA, 25 bp, E. coli
gaaatgcaacgtctgaataaagcgc

SEQ ID NO: 94064 - DNA, 25 bp, E. coli
ctttaaaaactggagcgggatgtca

SEQ ID NO: 94065 - DNA, 25 bp, E. coli
ctttaaaaactgcagcgggatgtca

SEQ ID NO: 94066 - DNA, 25 bp, E. coli
gggattaaactgatcggcgcgattc

SEQ ID NO: 94067 - DNA, 25 bp, E. coli
gggattaaactgttcggcgcgattc

SEQ ID NO: 94068 - DNA, 25 bp, E. coli
tggtactgcggaccttcgaaaaacg

SEQ ID NO: 94069 - DNA, 25 bp, E. coli
cacggtgaagcacaaactgttcctc

SEQ ID NO: 94070 - DNA, 25 bp, E. coli
cacggtgaagcagaaactgttcctc

SEQ ID NO: 94071 - DNA, 25 bp, E. coli
ttcctgctcggttttccggtgctgc

SEQ ID NO: 94072 - DNA, 25 bp, E. coli
ttcctgctcggtattccggtgctgc

SEQ ID NO: 94073 - DNA, 25 bp, E. coli
tcttcggactcgtgttcagccgtac

SEQ ID NO: 94074 - DNA, 25 bp, E. coli
tcttcggactcgagttcagccgtac

SEQ ID NO: 94075 - DNA, 25 bp, E. coli
cctgctcggttttccggtgctgcgt

SEQ ID NO: 94076 - DNA, 25 bp, E. coli
ggctgaacgtggatgttggtctttc

SEQ ID NO: 94077 - DNA, 25 bp, E. coli
cctgctcggtttaccggtgctgcgt

SEQ ID NO: 94078 - DNA, 25 bp, E. coli
ggctgaacgtggttgttggtctttc

SEQ ID NO: 94079 - DNA, 25 bp, E. coli
gcagaaactgttgctcgtggcgctg

SEQ ID NO: 94080 - DNA, 25 bp, E. coli
gaacgtggttgttggtctttctggt

SEQ ID NO: 94081 - DNA, 25 bp, E. coli
gaacgtggttgtaggtctttctggt

SEQ ID NO: 94082 - DNA, 25 bp, E. coli
gaagcagaaactcttcctcgtggcg

SEQ ID NO: 94083 - DNA, 25 bp, E. coli
gaagcagaaactgttcctcgtggcg

SEQ ID NO: 94084 - DNA, 25 bp, E. coli
gcagaaactgttcctcgtggcgctg

SEQ ID NO: 94085 - DNA, 25 bp, E. coli
ctccacggtgaaccagaaactgttc

SEQ ID NO: 94086 - DNA, 25 bp, E. coli
ctccacggtgaagcagaaactgttc

SEQ ID NO: 94087 - DNA, 25 bp, E. coli
ggttgttggtctttctggtctgctg

SEQ ID NO: 94088 - DNA, 25 bp, E. coli
ggttgttggtctatctggtctgctg

SEQ ID NO: 94089 - DNA, 25 bp, E. coli
ggtgaagcagaaactgttcctcgtg

SEQ ID NO: 94090 - DNA, 25 bp, E. coli
ggtgaagcagaatctgttcctcgtg

SEQ ID NO: 94091 - DNA, 25 bp, E. coli
aaaagttacactgcgaatattcggc

SEQ ID NO: 94092 - DNA, 25 bp, E. coli
aaagagtaattcctgacccaggtca

SEQ ID NO: 94093 - DNA, 25 bp, E. coli
aaaagttacactccgaatattcggc

SEQ ID NO: 94094 - DNA, 25 bp, E. coli
aaagagtaattcgtgacccaggtca

SEQ ID NO: 94095 - DNA, 25 bp, E. coli
tgaagaactacggaattactacggg

SEQ ID NO: 94096 - DNA, 25 bp, E. coli
tgaagaactacgcaattactacggg

SEQ ID NO: 94097 - DNA, 25 bp, E. coli
tcagtgaccagaattggaaaacccg

SEQ ID NO: 94098 - DNA, 25 bp, E. coli
tcagtgaccagatttggaaaacccg

SEQ ID NO: 94099 - DNA, 25 bp, E. coli
tcatttacgggttggcgaaagatca

SEQ ID NO: 94100 - DNA, 25 bp, E. coli
tcatttacgggtaggcgaaagatca

SEQ ID NO: 94101 - DNA, 25 bp, E. coli
tcagagaattgaacaacgcatgtgg

SEQ ID NO: 94102 - DNA, 25 bp, E. coli
gcaactcgattaccggcaacctaaa

SEQ ID NO: 94103 - DNA, 25 bp, E. coli
gcaactcgattagcggcaacctaaa

SEQ ID NO: 94104 - DNA, 25 bp, E. coli
gaaaacccggaggattctgaataag

SEQ ID NO: 94105 - DNA, 25 bp, E. coli
gaaaacccggagcattctgaataag

SEQ ID NO: 94106 - DNA, 25 bp, E. coli
gaaaacccgttgcagtgttgcgcaa

SEQ ID NO: 94107 - DNA, 25 bp, E. coli
gaaaacccgttggagtgttgcgcaa

SEQ ID NO: 94108 - DNA, 25 bp, E. coli
gattgtttcatagtccaggaagacg

SEQ ID NO: 94109 - DNA, 25 bp, E. coli
gattgtttcatactccaggaagacg

SEQ ID NO: 94110 - DNA, 25 bp, E. coli
tcagagaattgatcaacgcatgtgg

SEQ ID NO: 94111 - DNA, 25 bp, E. coli
gacggtaaaccagtctctgcagggc

SEQ ID NO: 94112 - DNA, 25 bp, E. coli
gacggtaaaccactctctgcagggc

SEQ ID NO: 94113 - DNA, 25 bp, E. coli
caagcgatgggccttgcgctccata

SEQ ID NO: 94114 - DNA, 25 bp, E. coli
caagcgatgggcgttgcgctccata

SEQ ID NO: 94115 - DNA, 25 bp, E. coli
aataaactctctacccattcagggc

SEQ ID NO: 94116 - DNA, 25 bp, E. coli
aataaactctcttcccattcagggc

SEQ ID NO: 94117 - DNA, 25 bp, E. coli
cacaattgattcgtacgacgccgac

SEQ ID NO: 94118 - DNA, 25 bp, E. coli
cacaattgattcctacgacgccgac

SEQ ID NO: 94119 - DNA, 25 bp, E. coli
taactttgcgtccatgaccacgaga

SEQ ID NO: 94120 - DNA, 25 bp, E. coli
taaattgtcgcatcgtgagcgtaga

SEQ ID NO: 94121 - DNA, 25 bp, E. coli
taaattgtcgcaacgtgagcgtaga

SEQ ID NO: 94122 - DNA, 25 bp, E. coli
tagatctgcgagcatacgcgcctgc

SEQ ID NO: 94123 - DNA, 25 bp, E. coli
tagatctgcgaggatacgcgcctgc

SEQ ID NO: 94124 - DNA, 25 bp, E. coli
tgcaaattcctgtccctgaaccgat

SEQ ID NO: 94125 - DNA, 25 bp, E. coli
tgcaaattcctgaccctgaaccgat

SEQ ID NO: 94126 - DNA, 25 bp, E. coli
tgaccagagggaaatatgacgacac

SEQ ID NO: 94127 - DNA, 25 bp, E. coli
tgaccagagggatatatgacgacac

SEQ ID NO: 94128 - DNA, 25 bp, E. coli
gcaggtgaatgctacgtcaagcgat

SEQ ID NO: 94129 - DNA, 25 bp, E. coli
gcaggtgaatgcaacgtcaagcgat

SEQ ID NO: 94130 - DNA, 25 bp, E. coli
gtctgtatacaaaaacgccgcaaag

SEQ ID NO: 94131 - DNA, 25 bp, E. coli
gtctgtatacaataacgccgcaaag

SEQ ID NO: 94132 - DNA, 25 bp, E. coli
taactttgcgtcgatgaccacgaga

SEQ ID NO: 94133 - DNA, 25 bp, E. coli
taagagtccacccaatgaccagagg

SEQ ID NO: 94134 - DNA, 25 bp, E. coli
taagagtccaccgaatgaccagagg

SEQ ID NO: 94135 - DNA, 25 bp, E. coli
caggcggtatggaaaatgtattgtc

SEQ ID NO: 94136 - DNA, 25 bp, E. coli
caggcggtatggtaaatgtattgtc

SEQ ID NO: 94137 - DNA, 25 bp, E. coli
aggcggtatggataatgtattgtca

SEQ ID NO: 94138 - DNA, 25 bp, E. coli
atggaaaatgtaatgtcagcgtcac

SEQ ID NO: 94139 - DNA, 25 bp, E. coli
atggaaaatgtattgtcagcgtcac

SEQ ID NO: 94140 - DNA, 25 bp, E. coli
aggcggtatggaaaatgtattgtca

SEQ ID NO: 94141 - DNA, 25 bp, E. coli
tatggaaaatgtattgtcagcgtca

SEQ ID NO: 94142 - DNA, 25 bp, E. coli
tatggaaaatgttttgtcagcgtca

SEQ ID NO: 94143 - DNA, 25 bp, E. coli
ccgtgtttcagcgtattttggcgag

SEQ ID NO: 94144 - DNA, 25 bp, E. coli
ccgtgtttcagcctattttggcgag

SEQ ID NO: 94145 - DNA, 25 bp, E. coli
gcggtatggaaaatgtattgtcagc

SEQ ID NO: 94146 - DNA, 25 bp, E. coli
gcggtatggaaattgtattgtcagc

SEQ ID NO: 94147 - DNA, 25 bp, E. coli
ccgccgtgtttctgcctattttggc

SEQ ID NO: 94148 - DNA, 25 bp, E. coli
cgccgtgtttcagcctattttggcg

SEQ ID NO: 94149 - DNA, 25 bp, E. coli
ccgccgtgtttcagcctattttggc

SEQ ID NO: 94150 - DNA, 25 bp, E. coli
cgccgtgtttcaccctattttggcg

SEQ ID NO: 94151 - DNA, 25 bp, E. coli
cggtatggaaaaagtattgtcagcg

SEQ ID NO: 94152 - DNA, 25 bp, E. coli
cggtatggaaaatgtattgtcagcg

SEQ ID NO: 94153 - DNA, 25 bp, E. coli
gtatggaaaatgtattgtcagcgtc

SEQ ID NO: 94154 - DNA, 25 bp, E. coli
gtatggaaaatgaattgtcagcgtc

SEQ ID NO: 94155 - DNA, 25 bp, E. coli
tggaaaatgtatagtcagcgtcacg

SEQ ID NO: 94156 - DNA, 25 bp, E. coli
tggaaaatgtattgtcagcgtcacg

SEQ ID NO: 94157 - DNA, 25 bp, E. coli
aacttaagtctgcacgaaatgcccg

SEQ ID NO: 94158 - DNA, 25 bp, E. coli
aacttaagtctggacgaaatgcccg

SEQ ID NO: 94159 - DNA, 25 bp, E. coli
tatatgaactcaccggagcaggctc

SEQ ID NO: 94160 - DNA, 25 bp, E. coli
tatatgaactcagcggagcaggctc

SEQ ID NO: 94161 - DNA, 25 bp, E. coli
tgaactcaccggtgcaggctccggt

SEQ ID NO: 94162 - DNA, 25 bp, E. coli
tgaactcaccggagcaggctccggt

SEQ ID NO: 94163 - DNA, 25 bp, E. coli
tgcccgaaaacgtaagtttgaggcg

SEQ ID NO: 94164 - DNA, 25 bp, E. coli
tgcccgaaaacgaaagtttgaggcg

SEQ ID NO: 94165 - DNA, 25 bp, E. coli
tctggacgaaatgcccgaaaacgaa

SEQ ID NO: 94166 - DNA, 25 bp, E. coli
tctggacgaaatccccgaaaacgaa

SEQ ID NO: 94167 - DNA, 25 bp, E. coli
gccatacgttcctcctttatatgaa

SEQ ID NO: 94168 - DNA, 25 bp, E. coli
gccatacgttccacctttatatgaa

SEQ ID NO: 94169 - DNA, 25 bp, E. coli
gctccggtgaggagttgtgaactta

SEQ ID NO: 94170 - DNA, 25 bp, E. coli
gctccggtgaggtgttgtgaactta

SEQ ID NO: 94171 - DNA, 25 bp, E. coli
ctttatatgaactcaccggagcagg

SEQ ID NO: 94172 - DNA, 25 bp, E. coli
ctttatatgaacacaccggagcagg

SEQ ID NO: 94173 - DNA, 25 bp, E. coli
ggtgttgtgaacttaagtctggacg

SEQ ID NO: 94174 - DNA, 25 bp, E. coli
ggtgttgtgaacataagtctggacg

SEQ ID NO: 94175 - DNA, 25 bp, E. coli
ggttggattagcgatacgttcctcc

SEQ ID NO: 94176 - DNA, 25 bp, E. coli
ggttggattagccatacgttcctcc

SEQ ID NO: 94177 - DNA, 25 bp, E. coli
taagtctggacgaaatgcccgaaaa

SEQ ID NO: 94178 - DNA, 25 bp, E. coli
taagtctggacgtaatgcccgaaaa

SEQ ID NO: 94179 - DNA, 25 bp, E. coli
caaaagtggcgagatcatggacaga

SEQ ID NO: 94180 - DNA, 25 bp, E. coli
caaaagtggcgacatcatggacaga

SEQ ID NO: 94181 - DNA, 25 bp, E. coli
cagtgaacctgaaatcctcgcgaaa

SEQ ID NO: 94182 - DNA, 25 bp, E. coli
cagtgaacctgatatcctcgcgaaa

SEQ ID NO: 94183 - DNA, 25 bp, E. coli
taaagcaagcaactattccagaggc

SEQ ID NO: 94184 - DNA, 25 bp, E. coli
taaagcaagcaagtattccagaggc

SEQ ID NO: 94185 - DNA, 25 bp, E. coli
agtgatttgcccgaacctgaaggaa

SEQ ID NO: 94186 - DNA, 25 bp, E. coli
agtgatttgccccaacctgaaggaa

SEQ ID NO: 94187 - DNA, 25 bp, E. coli
tgttaacgatatttccggcctggcc

SEQ ID NO: 94188 - DNA, 25 bp, E. coli
tgttaacgatatatccggcctggcc

SEQ ID NO: 94189 - DNA, 25 bp, E. coli
tgtttgtcgcaatagaaagacgccc

SEQ ID NO: 94190 - DNA, 25 bp, E. coli
tgtttgtcgcaaaagaaagacgccc

SEQ ID NO: 94191 - DNA, 25 bp, E. coli
tgagatgcttgacctgacaaaagga

SEQ ID NO: 94192 - DNA, 25 bp, E. coli
tgagatgcttgagctgacaaaagga

SEQ ID NO: 94193 - DNA, 25 bp, E. coli
tccagaggcacttaatgatatacgt

SEQ ID NO: 94194 - DNA, 25 bp, E. coli
tccagaggcactaaatgatatacgt

SEQ ID NO: 94195 - DNA, 25 bp, E. coli
tctccagacctgctgagtgtaaagc

SEQ ID NO: 94196 - DNA, 25 bp, E. coli
tctccagacctggtgagtgtaaagc

SEQ ID NO: 94197 - DNA, 25 bp, E. coli
gctgcagtagacgaaaagacttctg

SEQ ID NO: 94198 - DNA, 25 bp, E. coli
gctgcagtagaccaaaagacttctg

SEQ ID NO: 94199 - DNA, 25 bp, E. coli
gatgatttcctgtatgccacccaga

SEQ ID NO: 94200 - DNA, 25 bp, E. coli
gatgatttcctgaatgccacccaga

SEQ ID NO: 94201 - DNA, 25 bp, E. coli
cactgaatgaatccacccgtgcgga

SEQ ID NO: 94202 - DNA, 25 bp, E. coli
cactgaatgaatgcacccgtgcgga

SEQ ID NO: 94203 - DNA, 25 bp, E. coli
caggatatccggcaggaaacactga

SEQ ID NO: 94204 - DNA, 25 bp, E. coli
caggatatccgggaggaaacactga

SEQ ID NO: 94205 - DNA, 25 bp, E. coli
agtatcagccgtatcccattcaggg

SEQ ID NO: 94206 - DNA, 25 bp, E. coli
agtatcagccgtttcccattcaggg

SEQ ID NO: 94207 - DNA, 25 bp, E. coli
agcagtcggccaccgtggtgctctg

SEQ ID NO: 94208 - DNA, 25 bp, E. coli
agcagtcggccagcgtggtgctctg

SEQ ID NO: 94209 - DNA, 25 bp, E. coli
atggcaaaggcaccagtacgcgccc

SEQ ID NO: 94210 - DNA, 25 bp, E. coli
atggcaaaggcagcagtacgcgccc

SEQ ID NO: 94211 - DNA, 25 bp, E. coli
ttctaacctgtagggtatggtcacc

SEQ ID NO: 94212 - DNA, 25 bp, E. coli
ttctaacctgtacggtatggtcacc

SEQ ID NO: 94213 - DNA, 25 bp, E. coli
tgaatgcacccgagcggagcagtcg

SEQ ID NO: 94214 - DNA, 25 bp, E. coli
tgaatgcacccgtgcggagcagtcg

SEQ ID NO: 94215 - DNA, 25 bp, E. coli
cctgtacggtatggtcaccgggatg

SEQ ID NO: 94216 - DNA, 25 bp, E. coli
cctgtacggtatcgtcaccgggatg

SEQ ID NO: 94217 - DNA, 25 bp, E. coli
gttttgaactgattggcaaaggcac

SEQ ID NO: 94218 - DNA, 25 bp, E. coli
gttttgaactgaatggcaaaggcac

SEQ ID NO: 94219 - DNA, 25 bp, E. coli
gggcgacagtatgagccgtatccca

SEQ ID NO: 94220 - DNA, 25 bp, E. coli
gggcgacagtatcagccgtatccca

SEQ ID NO: 94221 - DNA, 25 bp, E. coli
ggaaacactgaaagaatgcacccgt

SEQ ID NO: 94222 - DNA, 25 bp, E. coli
ggaaacactgaatgaatgcacccgt

SEQ ID NO: 94223 - DNA, 25 bp, E. coli
tatgatcttggtgagctttacggcg

SEQ ID NO: 94224 - DNA, 25 bp, E. coli
tatgatcttggtcagctttacggcg

SEQ ID NO: 94225 - DNA, 25 bp, E. coli
tattactgctcaatgaccgaagcca

SEQ ID NO: 94226 - DNA, 25 bp, E. coli
tattactgctcattgaccgaagcca

SEQ ID NO: 94227 - DNA, 25 bp, E. coli
ttttagccacttatctgagcagcga

SEQ ID NO: 94228 - DNA, 25 bp, E. coli
ttttagccacttttctgagcagcga

SEQ ID NO: 94229 - DNA, 25 bp, E. coli
tgcttcaaggactgaagttaaccct

SEQ ID NO: 94230 - DNA, 25 bp, E. coli
tgcttcaaggacagaagttaaccct

SEQ ID NO: 94231 - DNA, 25 bp, E. coli
ccagagccgtgttggaaatcattga

SEQ ID NO: 94232 - DNA, 25 bp, E. coli
ccagagccgtgtaggaaatcattga

SEQ ID NO: 94233 - DNA, 25 bp, E. coli
gccttgccctttccatcagaagttg

SEQ ID NO: 94234 - DNA, 25 bp, E. coli
gccttgccctttgcatcagaagttg

SEQ ID NO: 94235 - DNA, 25 bp, E. coli
gcataaatatggttactcgtcctca

SEQ ID NO: 94236 - DNA, 25 bp, E. coli
gcataaatatggatactcgtcctca

SEQ ID NO: 94237 - DNA, 25 bp, E. coli
gaagccaaattgaggtaactgcagg

SEQ ID NO: 94238 - DNA, 25 bp, E. coli
gaattgtttgctgatgccttgccct

SEQ ID NO: 94239 - DNA, 25 bp, E. coli
gaagccaaattgtggtaactgcagg

SEQ ID NO: 94240 - DNA, 25 bp, E. coli
gaattgtttgctcatgccttgccct

SEQ ID NO: 94241 - DNA, 25 bp, E. coli
tcagccgaagtaaaaagccggttag

SEQ ID NO: 94242 - DNA, 25 bp, E. coli
taaccctactggaccctgaaatgtg

SEQ ID NO: 94243 - DNA, 25 bp, E. coli
tcagccgaagtataaagccggttag

SEQ ID NO: 94244 - DNA, 25 bp, E. coli
taaccctactggtccctgaaatgtg

SEQ ID NO: 94245 - DNA, 25 bp, E. coli
cataaactgagtcgccttgagcggg

SEQ ID NO: 94246 - DNA, 25 bp, E. coli
cataaactgagtggccttgagcggg

SEQ ID NO: 94247 - DNA, 25 bp, E. coli
taaatggtaagtcgacatccggcac

SEQ ID NO: 94248 - DNA, 25 bp, E. coli
taaatggtaagtggacatccggcac

SEQ ID NO: 94249 - DNA, 25 bp, E. coli
tatatgtcagttagcccgctggacg

SEQ ID NO: 94250 - DNA, 25 bp, E. coli
tatatgtcagtttgcccgctggacg

SEQ ID NO: 94251 - DNA, 25 bp, E. coli
tatattctggacaactgtggccggg

SEQ ID NO: 94252 - DNA, 25 bp, E. coli
tatattctggactactgtggccggg

SEQ ID NO: 94253 - DNA, 25 bp, E. coli
tttcacctacgatgcacagggccgg

SEQ ID NO: 94254 - DNA, 25 bp, E. coli
tttatgagtacgtcgctgcggaccg

SEQ ID NO: 94255 - DNA, 25 bp, E. coli
tttcacctacgaagcacagggccgg

SEQ ID NO: 94256 - DNA, 25 bp, E. coli
tttatgagtacgacgctgcggaccg

SEQ ID NO: 94257 - DNA, 25 bp, E. coli
tgtctggacaatggagtacggcccg

SEQ ID NO: 94258 - DNA, 25 bp, E. coli
tgtctggacaatcgagtacggcccg

SEQ ID NO: 94259 - DNA, 25 bp, E. coli
gaaactgggcaaactgggaaacctg

SEQ ID NO: 94260 - DNA, 25 bp, E. coli
gacagaagtcattaacccgcagggc

SEQ ID NO: 94261 - DNA, 25 bp, E. coli
gacagaagtcataaacccgcagggc

SEQ ID NO: 94262 - DNA, 25 bp, E. coli
gaaactgggcaatctgggaaacctg

SEQ ID NO: 94263 - DNA, 25 bp, E. coli
ggataacggcatacagacgctggcg

SEQ ID NO: 94264 - DNA, 25 bp, E. coli
ggataacggcattcagacgctggcg

SEQ ID NO: 94265 - DNA, 25 bp, E. coli
ggaacgctgttatcaccctgacgga

SEQ ID NO: 94266 - DNA, 25 bp, E. coli
ggaacgctgttaacaccctgacgga

SEQ ID NO: 94267 - DNA, 25 bp, E. coli
ctaccgcgctttgcggtggcaaaag

SEQ ID NO: 94268 - DNA, 25 bp, E. coli
ctaccgcgctttccggtggcaaaag

SEQ ID NO: 94269 - DNA, 25 bp, E. coli
accattacggccatgtgcgcacatc

SEQ ID NO: 94270 - DNA, 25 bp, E. coli
accattacggccttgtgcgcacatc

SEQ ID NO: 94271 - DNA, 25 bp, E. coli
acatcatgctggaaaagcggttagc

SEQ ID NO: 94272 - DNA, 25 bp, E. coli
acatcatgctggtaaagcggttagc

SEQ ID NO: 94273 - DNA, 25 bp, E. coli
ttgaagagagttttgtggctggata

SEQ ID NO: 94274 - DNA, 25 bp, E. coli
ttgaagagagttatgtggctggata

SEQ ID NO: 94275 - DNA, 25 bp, E. coli
tgatgaggccgatgttggcgtcttt

SEQ ID NO: 94276 - DNA, 25 bp, E. coli
tgatgaggccgaagttggcgtcttt

SEQ ID NO: 94277 - DNA, 25 bp, E. coli
gcttgagcaggacttttcagtccag

SEQ ID NO: 94278 - DNA, 25 bp, E. coli
gcgtcttttatcgtgtagggaatga

SEQ ID NO: 94279 - DNA, 25 bp, E. coli
gcttgagcaggagttttcagtccag

SEQ ID NO: 94280 - DNA, 25 bp, E. coli
gcgtcttttatcctgtagggaatga

SEQ ID NO: 94281 - DNA, 25 bp, E. coli
gttgggtgaacaatcactggtgctg

SEQ ID NO: 94282 - DNA, 25 bp, E. coli
gttgggtgaacattcactggtgctg

SEQ ID NO: 94283 - DNA, 25 bp, E. coli
gggtcagctacctaccgcgctttgc

SEQ ID NO: 94284 - DNA, 25 bp, E. coli
gggtcagctaccaaccgcgctttgc

SEQ ID NO: 94285 - DNA, 25 bp, E. coli
ggccatgtgcgctcatcatgctgga

SEQ ID NO: 94286 - DNA, 25 bp, E. coli
ggccatgtgcgcacatcatgctgga

SEQ ID NO: 94287 - DNA, 25 bp, E. coli
gagttttcagtccagttatttgaga

SEQ ID NO: 94288 - DNA, 25 bp, E. coli
gagttttcagtcgagttatttgaga

SEQ ID NO: 94289 - DNA, 25 bp, E. coli
acctggatggtgcatatttgcggca

SEQ ID NO: 94290 - DNA, 25 bp, E. coli
acctggatggtggatatttgcggca

SEQ ID NO: 94291 - DNA, 25 bp, E. coli
tatggaaatgaatggcgcagaaacc

SEQ ID NO: 94292 - DNA, 25 bp, E. coli
tatggaaatgaaaggcgcagaaacc

SEQ ID NO: 94293 - DNA, 25 bp, E. coli
ttcatcaccgtctgttccgctggcg

SEQ ID NO: 94294 - DNA, 25 bp, E. coli
ttcatcaccgtcagttccgctggcg

SEQ ID NO: 94295 - DNA, 25 bp, E. coli
ttagcgaactgctaagcgctattcg

SEQ ID NO: 94296 - DNA, 25 bp, E. coli
ttagcgaactgcaaagcgctattcg

SEQ ID NO: 94297 - DNA, 25 bp, E. coli
tcgcattcatggtaacgcggtggaa

SEQ ID NO: 94298 - DNA, 25 bp, E. coli
tcgcattcatggaaacgcggtggaa

SEQ ID NO: 94299 - DNA, 25 bp, E. coli
tcttttgatgtccttcgcctgcgaa

SEQ ID NO: 94300 - DNA, 25 bp, E. coli
tcttttgatgtcgttcgcctgcgaa

SEQ ID NO: 94301 - DNA, 25 bp, E. coli
gccacctggtgtgcgctgttgctga

SEQ ID NO: 94302 - DNA, 25 bp, E. coli
gccacctggtgtccgctgttgctga

SEQ ID NO: 94303 - DNA, 25 bp, E. coli
gcgaatgcagtagcgcgttgcctat

SEQ ID NO: 94304 - DNA, 25 bp, E. coli
gcggcatcgtttagcttgctggtcg

SEQ ID NO: 94305 - DNA, 25 bp, E. coli
gctggtcgtctgttgcattattacg

SEQ ID NO: 94306 - DNA, 25 bp, E. coli
gcgaatgcagtaccgcgttgcctat

SEQ ID NO: 94307 - DNA, 25 bp, E. coli
gctggtcgtctgatgcattattacg

SEQ ID NO: 94308 - DNA, 25 bp, E. coli
gcggcatcgttttgcttgctggtcg

SEQ ID NO: 94309 - DNA, 25 bp, E. coli
gaatctttggtaaatgccctgggag

SEQ ID NO: 94310 - DNA, 25 bp, E. coli
gaatctttggtatatgccctgggag

SEQ ID NO: 94311 - DNA, 25 bp, E. coli
aacccgatgcgccagagtaatctgc

SEQ ID NO: 94312 - DNA, 25 bp, E. coli
caaaaagtggacaggctggacgtta

SEQ ID NO: 94313 - DNA, 25 bp, E. coli
caaaaagtggactggctggacgtta

SEQ ID NO: 94314 - DNA, 25 bp, E. coli
tacaacctgtcaataggcgtgcgga

SEQ ID NO: 94315 - DNA, 25 bp, E. coli
tacaacctgtcattaggcgtgcgga

SEQ ID NO: 94316 - DNA, 25 bp, E. coli
tactggctacatggctggcatcacg

SEQ ID NO: 94317 - DNA, 25 bp, E. coli
tactggctacatcgctggcatcacg

SEQ ID NO: 94318 - DNA, 25 bp, E. coli
aaatagtcgcttctcctgtaacccg

SEQ ID NO: 94319 - DNA, 25 bp, E. coli
aacccgatgcgcgagagtaatctgc

SEQ ID NO: 94320 - DNA, 25 bp, E. coli
aaatagtcgcttgtcctgtaacccg

SEQ ID NO: 94321 - DNA, 25 bp, E. coli
tatttcgctgcctggaagtgctctg

SEQ ID NO: 94322 - DNA, 25 bp, E. coli
tatttcgctgccaggaagtgctctg

SEQ ID NO: 94323 - DNA, 25 bp, E. coli
tgagtttattaccagcgagcaagcc

SEQ ID NO: 94324 - DNA, 25 bp, E. coli
tgagtttattacgagcgagcaagcc

SEQ ID NO: 94325 - DNA, 25 bp, E. coli
tgaaggtcgctaccagagttctcca

SEQ ID NO: 94326 - DNA, 25 bp, E. coli
tgaaggtcgctagcagagttctcca

SEQ ID NO: 94327 - DNA, 25 bp, E. coli
ccgaaactgggcaggctggaaaaag

SEQ ID NO: 94328 - DNA, 25 bp, E. coli
ccgaaactgggctggctggaaaaag

SEQ ID NO: 94329 - DNA, 25 bp, E. coli
cgtgttgcaattgaccgggcggcaa

SEQ ID NO: 94330 - DNA, 25 bp, E. coli
cgtgttgcaattcaccgggcggcaa

SEQ ID NO: 94331 - DNA, 25 bp, E. coli
tggcatcacgaattgcgcccgctgt

SEQ ID NO: 94332 - DNA, 25 bp, E. coli
tggcatcacgaaatgcgcccgctgt

SEQ ID NO: 94333 - DNA, 25 bp, E. coli
aatcaaaatccccagccaatacaac

SEQ ID NO: 94334 - DNA, 25 bp, E. coli
aatcaaaatcccgagccaatacaac

SEQ ID NO: 94335 - DNA, 25 bp, E. coli
catcatattttcgatcattagtgtg

SEQ ID NO: 94336 - DNA, 25 bp, E. coli
catcatattttccatcattagtgtg

SEQ ID NO: 94337 - DNA, 25 bp, E. coli
tacctgatcagcctaaacaccttat

SEQ ID NO: 94338 - DNA, 25 bp, E. coli
tatgcgggcgttttgctttttggcg

SEQ ID NO: 94339 - DNA, 25 bp, E. coli
tatgcgggcgttatgctttttggcg

SEQ ID NO: 94340 - DNA, 25 bp, E. coli
tacctgatcagcgtaaacaccttat

SEQ ID NO: 94341 - DNA, 25 bp, E. coli
tttggcgcgccttgttacctgatca

SEQ ID NO: 94342 - DNA, 25 bp, E. coli
tttggcgcgcctagttacctgatca

SEQ ID NO: 94343 - DNA, 25 bp, E. coli
ttccatcattagagtgatcatctgg

SEQ ID NO: 94344 - DNA, 25 bp, E. coli
ttatctggcctagggtctgcgtacg

SEQ ID NO: 94345 - DNA, 25 bp, E. coli
ttccatcattagtgtgatcatctgg

SEQ ID NO: 94346 - DNA, 25 bp, E. coli
ttatctggcctacggtctgcgtacg

SEQ ID NO: 94347 - DNA, 25 bp, E. coli
tctgcgtacgcattcaaaatcccca

SEQ ID NO: 94348 - DNA, 25 bp, E. coli
tctgcgtacgcaatcaaaatcccca

SEQ ID NO: 94349 - DNA, 25 bp, E. coli
gccaatacaacatttaacaccatca

SEQ ID NO: 94350 - DNA, 25 bp, E. coli
gccaatacaacaattaacaccatca

SEQ ID NO: 94351 - DNA, 25 bp, E. coli
gacgtgttcctgaacgcccgcatat

SEQ ID NO: 94352 - DNA, 25 bp, E. coli
gacgtgttcctgtacgcccgcatat

SEQ ID NO: 94353 - DNA, 25 bp, E. coli
gtgatcatctggatattttctgttg

SEQ ID NO: 94354 - DNA, 25 bp, E. coli
gtgatcatctggttattttctgttg

SEQ ID NO: 94355 - DNA, 25 bp, E. coli
cacgatctgaaatatgcctggcagg

SEQ ID NO: 94356 - DNA, 25 bp, E. coli
cacgatctgaaaaatgcctggcagg

SEQ ID NO: 94357 - DNA, 25 bp, E. coli
aaatcgcgacgtagttgctgccagg

SEQ ID NO: 94358 - DNA, 25 bp, E. coli
aaatcgcgacgttgttgctgccagg

SEQ ID NO: 94359 - DNA, 25 bp, E. coli
ttgccaaagcacaggacgatgcccg

SEQ ID NO: 94360 - DNA, 25 bp, E. coli
tatgcccgcgaggtcggaatggaca

SEQ ID NO: 94361 - DNA, 25 bp, E. coli
tatgcccgcgagctcggaatggaca

SEQ ID NO: 94362 - DNA, 25 bp, E. coli
ttgccaaagcactggacgatgcccg

SEQ ID NO: 94363 - DNA, 25 bp, E. coli
tgtggtgaagcacgccaaaatcgcg

SEQ ID NO: 94364 - DNA, 25 bp, E. coli
tgtggtgaagcaggccaaaatcgcg

SEQ ID NO: 94365 - DNA, 25 bp, E. coli
tgaacatgagcgatatccgtgaccg

SEQ ID NO: 94366 - DNA, 25 bp, E. coli
tgaacatgagcgttatccgtgaccg

SEQ ID NO: 94367 - DNA, 25 bp, E. coli
gctttaactatggtttcggcgcaca

SEQ ID NO: 94368 - DNA, 25 bp, E. coli
gctttaactatgctttcggcgcaca

SEQ ID NO: 94369 - DNA, 25 bp, E. coli
gaaaacgttcgccagattgccaaag

SEQ ID NO: 94370 - DNA, 25 bp, E. coli
gaaaacgttcgcgagattgccaaag

SEQ ID NO: 94371 - DNA, 25 bp, E. coli
taacctgagtcttggcgtggcgaac

SEQ ID NO: 94372 - DNA, 25 bp, E. coli
taacctgagtctaggcgtggcgaac

SEQ ID NO: 94373 - DNA, 25 bp, E. coli
gatgcccgcgtgcattcgattgaag

SEQ ID NO: 94374 - DNA, 25 bp, E. coli
gatgatgagccaaatgaccacgccg

SEQ ID NO: 94375 - DNA, 25 bp, E. coli
gatgatgagccatatgaccacgccg

SEQ ID NO: 94376 - DNA, 25 bp, E. coli
gatgcccgcgtggattcgattgaag

SEQ ID NO: 94377 - DNA, 25 bp, E. coli
catctctgagaatgcgccgttagcc

SEQ ID NO: 94378 - DNA, 25 bp, E. coli
catctctgagaaagcgccgttagcc

SEQ ID NO: 94379 - DNA, 25 bp, E. coli
tgtcactatcaagaaagtggcggtc

SEQ ID NO: 94380 - DNA, 25 bp, E. coli
tgtcactatcaacaaagtggcggtc

SEQ ID NO: 94381 - DNA, 25 bp, E. coli
tgtcggcatcctgaaccatgttgtg

SEQ ID NO: 94382 - DNA, 25 bp, E. coli
tgggcgaagcactcaccatgaactc

SEQ ID NO: 94383 - DNA, 25 bp, E. coli
tgtcggcatcctcaaccatgttgtg

SEQ ID NO: 94384 - DNA, 25 bp, E. coli
tgcaggcgttaagcgatctcaaccg

SEQ ID NO: 94385 - DNA, 25 bp, E. coli
tgcaggcgttaaccgatctcaaccg

SEQ ID NO: 94386 - DNA, 25 bp, E. coli
tgccgttatcaaagaagagctgcgt

SEQ ID NO: 94387 - DNA, 25 bp, E. coli
tgccgttatcaatgaagagctgcgt

SEQ ID NO: 94388 - DNA, 25 bp, E. coli
gatattcacgaactgccgtctggcg

SEQ ID NO: 94389 - DNA, 25 bp, E. coli
gatattcacgaagtgccgtctggcg

SEQ ID NO: 94390 - DNA, 25 bp, E. coli
gattaccaggaacggatgaacgctt

SEQ ID NO: 94391 - DNA, 25 bp, E. coli
gattaccaggaagggatgaacgctt

SEQ ID NO: 94392 - DNA, 25 bp, E. coli
tgggcgaagcacacaccatgaactc

SEQ ID NO: 94393 - DNA, 25 bp, E. coli
tcaatgacgcctctaaacctcggcg

SEQ ID NO: 94394 - DNA, 25 bp, E. coli
tcaatgacgcctgtaaacctcggcg

SEQ ID NO: 94395 - DNA, 25 bp, E. coli
gagtggatccaaagtcttctccgca

SEQ ID NO: 94396 - DNA, 25 bp, E. coli
gacgcgggcttccacattgtcaaag

SEQ ID NO: 94397 - DNA, 25 bp, E. coli
gagtggatccaatgtcttctccgca

SEQ ID NO: 94398 - DNA, 25 bp, E. coli
gacgcgggcttcgacattgtcaaag

SEQ ID NO: 94399 - DNA, 25 bp, E. coli
aattggtctggctacggtatatcgc

SEQ ID NO: 94400 - DNA, 25 bp, E. coli
aattggtctggcaacggtatatcgc

SEQ ID NO: 94401 - DNA, 25 bp, E. coli
cacgtcagtgcggaagatttataca

SEQ ID NO: 94402 - DNA, 25 bp, E. coli
cacgtcagtgcgcaagatttataca

SEQ ID NO: 94403 - DNA, 25 bp, E. coli
tactgaaccagtttgacgacgctgg

SEQ ID NO: 94404 - DNA, 25 bp, E. coli
tactgaaccagtatgacgacgctgg

SEQ ID NO: 94405 - DNA, 25 bp, E. coli
aaatccgtatttgaactgacacagc

SEQ ID NO: 94406 - DNA, 25 bp, E. coli
aagaaagctggcgtgaaagtaacgc

SEQ ID NO: 94407 - DNA, 25 bp, E. coli
aaatccgtatttcaactgacacagc

SEQ ID NO: 94408 - DNA, 25 bp, E. coli
aagaaagctggcctgaaagtaacgc

SEQ ID NO: 94409 - DNA, 25 bp, E. coli
tcgtcacccgcctcaattttgaagg

SEQ ID NO: 94410 - DNA, 25 bp, E. coli
tcgtcacccgccacaattttgaagg

SEQ ID NO: 94411 - DNA, 25 bp, E. coli
gactgataacaaaaccgccctaaag

SEQ ID NO: 94412 - DNA, 25 bp, E. coli
gactgataacaataccgccctaaag

SEQ ID NO: 94413 - DNA, 25 bp, E. coli
tggcattcgcctcactaaccacagt

SEQ ID NO: 94414 - DNA, 25 bp, E. coli
tggaagttcttctggagccggacaa

SEQ ID NO: 94415 - DNA, 25 bp, E. coli
tggcattcgcctgactaaccacagt

SEQ ID NO: 94416 - DNA, 25 bp, E. coli
tggaagttcttcaggagccggacaa

SEQ ID NO: 94417 - DNA, 25 bp, E. coli
gagccggacaaccatcacgtcagtg

SEQ ID NO: 94418 - DNA, 25 bp, E. coli
gagccggacaacgatcacgtcagtg

SEQ ID NO: 94419 - DNA, 25 bp, E. coli
gatgattccatcgaagcgcgtcagc

SEQ ID NO: 94420 - DNA, 25 bp, E. coli
gatgattccatccaagcgcgtcagc

SEQ ID NO: 94421 - DNA, 25 bp, E. coli
aatgcgctttgtaaatgcctgatgc

SEQ ID NO: 94422 - DNA, 25 bp, E. coli
aatgcgctttgttaatgcctgatgc

SEQ ID NO: 94423 - DNA, 25 bp, E. coli
cagtatcggggtgacggataatcac

SEQ ID NO: 94424 - DNA, 25 bp, E. coli
cagtatcggggtcacggataatcac

SEQ ID NO: 94425 - DNA, 25 bp, E. coli
ttgttaatgcctgatgcggcgttaa

SEQ ID NO: 94426 - DNA, 25 bp, E. coli
ttgttaatgcctcatgcggcgttaa

SEQ ID NO: 94427 - DNA, 25 bp, E. coli
tgggattaagaatatcgattcgacg

SEQ ID NO: 94428 - DNA, 25 bp, E. coli
tgggattaagaaaatcgattcgacg

SEQ ID NO: 94429 - DNA, 25 bp, E. coli
tccggcctacaaagtcctgcagatt

SEQ ID NO: 94430 - DNA, 25 bp, E. coli
tccggcctacaatgtcctgcagatt

SEQ ID NO: 94431 - DNA, 25 bp, E. coli
tacaaagtcctggagattcaatata

SEQ ID NO: 94432 - DNA, 25 bp, E. coli
tacaaagtcctgcagattcaatata

SEQ ID NO: 94433 - DNA, 25 bp, E. coli
gaaaatcgattccacgttactcaga

SEQ ID NO: 94434 - DNA, 25 bp, E. coli
gacaaatgcgctttgttaatgcctg

SEQ ID NO: 94435 - DNA, 25 bp, E. coli
gaaaatcgattcgacgttactcaga

SEQ ID NO: 94436 - DNA, 25 bp, E. coli
gacaaatgcgctatgttaatgcctg

SEQ ID NO: 94437 - DNA, 25 bp, E. coli
gattcgacgttagtcagattgctga

SEQ ID NO: 94438 - DNA, 25 bp, E. coli
gattcgacgttactcagattgctga

SEQ ID NO: 94439 - DNA, 25 bp, E. coli
ggcctacaaagtcctgcagattcaa

SEQ ID NO: 94440 - DNA, 25 bp, E. coli
ggcctacaaagtgctgcagattcaa

SEQ ID NO: 94441 - DNA, 25 bp, E. coli
taatggaagtgaattgatgtgggat

SEQ ID NO: 94442 - DNA, 25 bp, E. coli
taatggaagtgatttgatgtgggat

SEQ ID NO: 94443 - DNA, 25 bp, E. coli
cacaggctgaactggactccgatgg

SEQ ID NO: 94444 - DNA, 25 bp, E. coli
cacaggctgaacaggactccgatgg

SEQ ID NO: 94445 - DNA, 25 bp, E. coli
ctccgatggtgaagtaaagttaact

SEQ ID NO: 94446 - DNA, 25 bp, E. coli
ctccgatggtgatgtaaagttaact

SEQ ID NO: 94447 - DNA, 25 bp, E. coli
aaaaaatgacacgagaagcagcgaa

SEQ ID NO: 94448 - DNA, 25 bp, E. coli
aaaaaatgacaccagaagcagcgaa

SEQ ID NO: 94449 - DNA, 25 bp, E. coli
acaccagaagcaccgaagcggcagg

SEQ ID NO: 94450 - DNA, 25 bp, E. coli
acaccagaagcagcgaagcggcagg

SEQ ID NO: 94451 - DNA, 25 bp, E. coli
ttttccgacagggagccacaggctg

SEQ ID NO: 94452 - DNA, 25 bp, E. coli
ttttccgacaggcagccacaggctg

SEQ ID NO: 94453 - DNA, 25 bp, E. coli
tgtgtgtgcgtttttaatcaccaaa

SEQ ID NO: 94454 - DNA, 25 bp, E. coli
tcatacggcgatttaacgtattttt

SEQ ID NO: 94455 - DNA, 25 bp, E. coli
tcatacggcgatataacgtattttt

SEQ ID NO: 94456 - DNA, 25 bp, E. coli
gaagcggcaggatattgcataaact

SEQ ID NO: 94457 - DNA, 25 bp, E. coli
gaagcggcaggaaattgcataaact

SEQ ID NO: 94458 - DNA, 25 bp, E. coli
cggtttctttaactttgtgtgtgcg

SEQ ID NO: 94459 - DNA, 25 bp, E. coli
cggtttctttaagtttgtgtgtgcg

SEQ ID NO: 94460 - DNA, 25 bp, E. coli
gttaacttttaagcaacagctggca

SEQ ID NO: 94461 - DNA, 25 bp, E. coli
gttaacttttaaccaacagctggca

SEQ ID NO: 94462 - DNA, 25 bp, E. coli
tgtgtgtgcgttattaatcaccaaa

SEQ ID NO: 94463 - DNA, 25 bp, E. coli
taatcaccaaacatatcatacggcg

SEQ ID NO: 94464 - DNA, 25 bp, E. coli
taatcaccaaacttatcatacggcg

SEQ ID NO: 94465 - DNA, 25 bp, E. coli
tacaggcgctattgcacgacggaat

SEQ ID NO: 94466 - DNA, 25 bp, E. coli
tacaggcgctatagcacgacggaat

SEQ ID NO: 94467 - DNA, 25 bp, E. coli
ttaacaggtcttcgcctacaggcgc

SEQ ID NO: 94468 - DNA, 25 bp, E. coli
ttaacaggtcttggcctacaggcgc

SEQ ID NO: 94469 - DNA, 25 bp, E. coli
tgataaaccttcgactggcaacgag

SEQ ID NO: 94470 - DNA, 25 bp, E. coli
tgataaaccttccactggcaacgag

SEQ ID NO: 94471 - DNA, 25 bp, E. coli
tgcggatatcaagcccttgtcgtga

SEQ ID NO: 94472 - DNA, 25 bp, E. coli
tgcggatatcaaccccttgtcgtga

SEQ ID NO: 94473 - DNA, 25 bp, E. coli
tctattgccagaatgacgaaagcgt

SEQ ID NO: 94474 - DNA, 25 bp, E. coli
tctattgccagattgacgaaagcgt

SEQ ID NO: 94475 - DNA, 25 bp, E. coli
gaatgcgtcgcacgttgataaacct

SEQ ID NO: 94476 - DNA, 25 bp, E. coli
gaatgcgtcgcaggttgataaacct

SEQ ID NO: 94477 - DNA, 25 bp, E. coli
gacgaaagcgtctcactgtacctga

SEQ ID NO: 94478 - DNA, 25 bp, E. coli
gactctgttcacgaaaattcaggtg

SEQ ID NO: 94479 - DNA, 25 bp, E. coli
gacgaaagcgtcacactgtacctga

SEQ ID NO: 94480 - DNA, 25 bp, E. coli
gactctgttcaccaaaattcaggtg

SEQ ID NO: 94481 - DNA, 25 bp, E. coli
cggaattttggtggaatgtcaagca

SEQ ID NO: 94482 - DNA, 25 bp, E. coli
cggaattttggtcgaatgtcaagca

SEQ ID NO: 94483 - DNA, 25 bp, E. coli
gatatggactcgctctctgcggata

SEQ ID NO: 94484 - DNA, 25 bp, E. coli
gatatggactcggtctctgcggata

SEQ ID NO: 94485 - DNA, 25 bp, E. coli
tggcaacgagtttccgatatggact

SEQ ID NO: 94486 - DNA, 25 bp, E. coli
tggcaacgagttaccgatatggact

SEQ ID NO: 94487 - DNA, 25 bp, E. coli
tacatcctaatgctattcgcctggg

SEQ ID NO: 94488 - DNA, 25 bp, E. coli
taaaaagcagcagcgtaaaggccgt

SEQ ID NO: 94489 - DNA, 25 bp, E. coli
taaagttgaagtaagcggccgtctg

SEQ ID NO: 94490 - DNA, 25 bp, E. coli
taaaaagcagcaccgtaaaggccgt

SEQ ID NO: 94491 - DNA, 25 bp, E. coli
taaagttgaagttagcggccgtctg

SEQ ID NO: 94492 - DNA, 25 bp, E. coli
tacatcctaatggtattcgcctggg

SEQ ID NO: 94493 - DNA, 25 bp, E. coli
aaagaattcgctcacaacctggaca

SEQ ID NO: 94494 - DNA, 25 bp, E. coli
aaagaattcgctgacaacctggaca

SEQ ID NO: 94495 - DNA, 25 bp, E. coli
tatcgttatcgaccgtccggctaag

SEQ ID NO: 94496 - DNA, 25 bp, E. coli
tatcgttatcgagcgtccggctaag

SEQ ID NO: 94497 - DNA, 25 bp, E. coli
tcttcaaaggcgtgatcctgggtgg

SEQ ID NO: 94498 - DNA, 25 bp, E. coli
tcttcaaaggcgagatcctgggtgg

SEQ ID NO: 94499 - DNA, 25 bp, E. coli
cctgactaaggaactggctaaagcg

SEQ ID NO: 94500 - DNA, 25 bp, E. coli
cctgactaaggatctggctaaagcg

SEQ ID NO: 94501 - DNA, 25 bp, E. coli
gaaaaactgcgtaaggtcgtagcgg

SEQ ID NO: 94502 - DNA, 25 bp, E. coli
gaacgcaatgcgactgggcgctaaa

SEQ ID NO: 94503 - DNA, 25 bp, E. coli
gaaaaactgcgttaggtcgtagcgg

SEQ ID NO: 94504 - DNA, 25 bp, E. coli
gaacgcaatgcgtctgggcgctaaa

SEQ ID NO: 94505 - DNA, 25 bp, E. coli
cggaaatcgcacgtaccgaatggta

SEQ ID NO: 94506 - DNA, 25 bp, E. coli
cggaaatcgcacctaccgaatggta

SEQ ID NO: 94507 - DNA, 25 bp, E. coli
taagcctgaactggacgcaaaactg

SEQ ID NO: 94508 - DNA, 25 bp, E. coli
taagcctgaactcgacgcaaaactg

SEQ ID NO: 94509 - DNA, 25 bp, E. coli
aacgagattatgaacgccgcagcca

SEQ ID NO: 94510 - DNA, 25 bp, E. coli
aacgagattatgtacgccgcagcca

SEQ ID NO: 94511 - DNA, 25 bp, E. coli
cacaagaaagaagagtccgagacgc

SEQ ID NO: 94512 - DNA, 25 bp, E. coli
cacaagaaagaacagtccgagacgc

SEQ ID NO: 94513 - DNA, 25 bp, E. coli
tacgtgctcagcaggcgttcgaagg

SEQ ID NO: 94514 - DNA, 25 bp, E. coli
tacgactgaacaaagctggcagcag

SEQ ID NO: 94515 - DNA, 25 bp, E. coli
tacgtgctcagctggcgttcgaagg

SEQ ID NO: 94516 - DNA, 25 bp, E. coli
agttccgtggaaagaacagacgccg

SEQ ID NO: 94517 - DNA, 25 bp, E. coli
agttccgtggaatgaacagacgccg

SEQ ID NO: 94518 - DNA, 25 bp, E. coli
tacgactgaacatagctggcagcag

SEQ ID NO: 94519 - DNA, 25 bp, E. coli
ttcgcggcgaaataagagcacctca

SEQ ID NO: 94520 - DNA, 25 bp, E. coli
ttcgcggcgaaaaaagagcacctca

SEQ ID NO: 94521 - DNA, 25 bp, E. coli
tctgccggtggtcaagtgaaaacgc

SEQ ID NO: 94522 - DNA, 25 bp, E. coli
tctgccggtggtgaagtgaaaacgc

SEQ ID NO: 94523 - DNA, 25 bp, E. coli
gctgcaaagccacaaagtgaccgga

SEQ ID NO: 94524 - DNA, 25 bp, E. coli
gctgcaaagccagaaagtgaccgga

SEQ ID NO: 94525 - DNA, 25 bp, E. coli
gaaaaaagacgatcgccgctggatg

SEQ ID NO: 94526 - DNA, 25 bp, E. coli
gaaaaaagacgaacgccgctggatg

SEQ ID NO: 94527 - DNA, 25 bp, E. coli
cccggtgaaaggcaaagagaacgca

SEQ ID NO: 94528 - DNA, 25 bp, E. coli
cccggtgaaagggaaagagaacgca

SEQ ID NO: 94529 - DNA, 25 bp, E. coli
tggcgggtcatagaaactgcattcg

SEQ ID NO: 94530 - DNA, 25 bp, E. coli
tggcgggtcatacaaactgcattcg

SEQ ID NO: 94531 - DNA, 25 bp, E. coli
catgaattgcttctcccctttgtgc

SEQ ID NO: 94532 - DNA, 25 bp, E. coli
catgaattgcttgtcccctttgtgc

SEQ ID NO: 94533 - DNA, 25 bp, E. coli
tacgccggatctttgcattgagggg

SEQ ID NO: 94534 - DNA, 25 bp, E. coli
tacgccggatctatgcattgagggg

SEQ ID NO: 94535 - DNA, 25 bp, E. coli
tataaccatgaattgcttctcccct

SEQ ID NO: 94536 - DNA, 25 bp, E. coli
tataaccatgaaatgcttctcccct

SEQ ID NO: 94537 - DNA, 25 bp, E. coli
ttctcccctttgagcaagaacgcgt

SEQ ID NO: 94538 - DNA, 25 bp, E. coli
ttctcccctttgtgcaagaacgcgt

SEQ ID NO: 94539 - DNA, 25 bp, E. coli
tgttggtataacgatgaattgcttc

SEQ ID NO: 94540 - DNA, 25 bp, E. coli
tgttggtataaccatgaattgcttc

SEQ ID NO: 94541 - DNA, 25 bp, E. coli
tgaattgcttctcccctttgtgcaa

SEQ ID NO: 94542 - DNA, 25 bp, E. coli
tgcttctcccctatgtgcaagaacg

SEQ ID NO: 94543 - DNA, 25 bp, E. coli
tgaattgcttctgccctttgtgcaa

SEQ ID NO: 94544 - DNA, 25 bp, E. coli
tgcaagaacgcgtccagtatggatc

SEQ ID NO: 94545 - DNA, 25 bp, E. coli
tgcttctcccctttgtgcaagaacg

SEQ ID NO: 94546 - DNA, 25 bp, E. coli
tgcaagaacgcgaccagtatggatc

SEQ ID NO: 94547 - DNA, 25 bp, E. coli
gcattgaggggatgcgtaaaaagaa

SEQ ID NO: 94548 - DNA, 25 bp, E. coli
gcattgaggggaagcgtaaaaagaa

SEQ ID NO: 94549 - DNA, 25 bp, E. coli
ggtataaccatgtattgcttctccc

SEQ ID NO: 94550 - DNA, 25 bp, E. coli
ggtataaccatgaattgcttctccc

SEQ ID NO: 94551 - DNA, 25 bp, E. coli
tttgtgcaagaaggcgtccagtatg

SEQ ID NO: 94552 - DNA, 25 bp, E. coli
tttgtgcaagaacgcgtccagtatg

SEQ ID NO: 94553 - DNA, 25 bp, E. coli
tattgatcgcgttctgctggcgggc

SEQ ID NO: 94554 - DNA, 25 bp, E. coli
tatttgtgttgcgatccggtgcgcc

SEQ ID NO: 94555 - DNA, 25 bp, E. coli
tatttgtgttgccatccggtgcgcc

SEQ ID NO: 94556 - DNA, 25 bp, E. coli
tattgatcgcgtactgctggcgggc

SEQ ID NO: 94557 - DNA, 25 bp, E. coli
tgaccgatgaatatggctggccgcg

SEQ ID NO: 94558 - DNA, 25 bp, E. coli
tgaccgatgaatttggctggccgcg

SEQ ID NO: 94559 - DNA, 25 bp, E. coli
ctataacagtggaatgcgcgacgcc

SEQ ID NO: 94560 - DNA, 25 bp, E. coli
ctataacagtggtatgcgcgacgcc

SEQ ID NO: 94561 - DNA, 25 bp, E. coli
gataagttgatccactacccgcgtg

SEQ ID NO: 94562 - DNA, 25 bp, E. coli
gatacctatcaacaagaacgtcgcg

SEQ ID NO: 94563 - DNA, 25 bp, E. coli
gatacctatcaagaagaacgtcgcg

SEQ ID NO: 94564 - DNA, 25 bp, E. coli
gataagttgatcgactacccgcgtg

SEQ ID NO: 94565 - DNA, 25 bp, E. coli
ggaaatagtcaatgcccagtggctg

SEQ ID NO: 94566 - DNA, 25 bp, E. coli
ggaaatagtcaaagcccagtggctg

SEQ ID NO: 94567 - DNA, 25 bp, E. coli
tgggcaagacccagaataaactggc

SEQ ID NO: 94568 - DNA, 25 bp, E. coli
tgggcaagaccctgaataaactggc

SEQ ID NO: 94569 - DNA, 25 bp, E. coli
taagcaaagtgcagcctaatccgga

SEQ ID NO: 94570 - DNA, 25 bp, E. coli
taaccatagcgttcaggtggcgatc

SEQ ID NO: 94571 - DNA, 25 bp, E. coli
taagcaaagtgctgcctaatccgga

SEQ ID NO: 94572 - DNA, 25 bp, E. coli
taaccatagcgtacaggtggcgatc

SEQ ID NO: 94573 - DNA, 25 bp, E. coli
gatgattgacctctccgtgacggcg

SEQ ID NO: 94574 - DNA, 25 bp, E. coli
gatgattgacctgtccgtgacggcg

SEQ ID NO: 94575 - DNA, 25 bp, E. coli
tacgcttgccgaaccgcatggtcca

SEQ ID NO: 94576 - DNA, 25 bp, E. coli
tacgcttgccgatccgcatggtcca

SEQ ID NO: 94577 - DNA, 25 bp, E. coli
acgcctgccagccagactccgcagg

SEQ ID NO: 94578 - DNA, 25 bp, E. coli
cttgccgatccggatggtccagtct

SEQ ID NO: 94579 - DNA, 25 bp, E. coli
cttgccgatccgcatggtccagtct

SEQ ID NO: 94580 - DNA, 25 bp, E. coli
acgcttgccgatgcgcatggtccag

SEQ ID NO: 94581 - DNA, 25 bp, E. coli
acgcttgccgatccgcatggtccag

SEQ ID NO: 94582 - DNA, 25 bp, E. coli
acgcctgccagcgagactccgcagg

SEQ ID NO: 94583 - DNA, 25 bp, E. coli
ttgccgatccgcatggtccagtctg

SEQ ID NO: 94584 - DNA, 25 bp, E. coli
ttgccgatccgcttggtccagtctg

SEQ ID NO: 94585 - DNA, 25 bp, E. coli
tccgcatggtccagtctgcggctgt

SEQ ID NO: 94586 - DNA, 25 bp, E. coli
tgccgatccgcatggtccagtctgc

SEQ ID NO: 94587 - DNA, 25 bp, E. coli
tgccgatccgcaaggtccagtctgc

SEQ ID NO: 94588 - DNA, 25 bp, E. coli
tccgcatggtcctgtctgcggctgt

SEQ ID NO: 94589 - DNA, 25 bp, E. coli
gccagactccgctggcgctgcgtga

SEQ ID NO: 94590 - DNA, 25 bp, E. coli
gccgagaacttcctacgcctgccag

SEQ ID NO: 94591 - DNA, 25 bp, E. coli
gccgagaacttcgtacgcctgccag

SEQ ID NO: 94592 - DNA, 25 bp, E. coli
gccagactccgcaggcgctgcgtga

SEQ ID NO: 94593 - DNA, 25 bp, E. coli
gatccgcatggtgcagtctgcggct

SEQ ID NO: 94594 - DNA, 25 bp, E. coli
gatcgccgagaagttcctacgcctg

SEQ ID NO: 94595 - DNA, 25 bp, E. coli
gatcgccgagaacttcctacgcctg

SEQ ID NO: 94596 - DNA, 25 bp, E. coli
gatccgcatggtccagtctgcggct

SEQ ID NO: 94597 - DNA, 25 bp, E. coli
caaatgccgtgcagaagaaccggcg

SEQ ID NO: 94598 - DNA, 25 bp, E. coli
caaatgccgtgctgaagaaccggcg

SEQ ID NO: 94599 - DNA, 25 bp, E. coli
acgccactgacaaatgccgtgctga

SEQ ID NO: 94600 - DNA, 25 bp, E. coli
acgccactgacatatgccgtgctga

SEQ ID NO: 94601 - DNA, 25 bp, E. coli
tacgccactgactaatgccgtgctg

SEQ ID NO: 94602 - DNA, 25 bp, E. coli
tatgcaggccaggtagtagaaacgg

SEQ ID NO: 94603 - DNA, 25 bp, E. coli
tatgcaggccagctagtagaaacgg

SEQ ID NO: 94604 - DNA, 25 bp, E. coli
tacgccactgacaaatgccgtgctg

SEQ ID NO: 94605 - DNA, 25 bp, E. coli
tgacaaatgccgagctgaagaaccg

SEQ ID NO: 94606 - DNA, 25 bp, E. coli
tgacaaatgccgtgctgaagaaccg

SEQ ID NO: 94607 - DNA, 25 bp, E. coli
ccactgacaaatcccgtgctgaaga

SEQ ID NO: 94608 - DNA, 25 bp, E. coli
gccactgacaaaagccgtgctgaag

SEQ ID NO: 94609 - DNA, 25 bp, E. coli
ccactgacaaatgccgtgctgaaga

SEQ ID NO: 94610 - DNA, 25 bp, E. coli
ccaggtagtagaaacgggcgatgcg

SEQ ID NO: 94611 - DNA, 25 bp, E. coli
gccactgacaaatgccgtgctgaag

SEQ ID NO: 94612 - DNA, 25 bp, E. coli
ccaggtagtagatacgggcgatgcg

SEQ ID NO: 94613 - DNA, 25 bp, E. coli
gacaaatgccgtcctgaagaaccgg

SEQ ID NO: 94614 - DNA, 25 bp, E. coli
gacaaatgccgtgctgaagaaccgg

SEQ ID NO: 94615 - DNA, 25 bp, E. coli
ctgacaaatgccctgctgaagaacc

SEQ ID NO: 94616 - DNA, 25 bp, E. coli
cggctctggtaattcggtcagttcg

SEQ ID NO: 94617 - DNA, 25 bp, E. coli
ctgacaaatgccgtgctgaagaacc

SEQ ID NO: 94618 - DNA, 25 bp, E. coli
cggctctggtaaatcggtcagttcg

SEQ ID NO: 94619 - DNA, 25 bp, E. coli
tacttaagcagattgaggcaaaaac

SEQ ID NO: 94620 - DNA, 25 bp, E. coli
tacttaagcagaatgaggcaaaaac

SEQ ID NO: 94621 - DNA, 25 bp, E. coli
aaactgacgccgttcatgccgatgc

SEQ ID NO: 94622 - DNA, 25 bp, E. coli
aaactgacgccgatcatgccgatgc

SEQ ID NO: 94623 - DNA, 25 bp, E. coli
aaatcgctgattatatccgcccgaa

SEQ ID NO: 94624 - DNA, 25 bp, E. coli
aaatcgctgattttatccgcccgaa

SEQ ID NO: 94625 - DNA, 25 bp, E. coli
tataaaaccaccttcaagacggcca

SEQ ID NO: 94626 - DNA, 25 bp, E. coli
tattgtcagcaaacatggcagcgtc

SEQ ID NO: 94627 - DNA, 25 bp, E. coli
tataaaaccaccatcaagacggcca

SEQ ID NO: 94628 - DNA, 25 bp, E. coli
tattgtcagcaatcatggcagcgtc

SEQ ID NO: 94629 - DNA, 25 bp, E. coli
tcacgcgttgatgaaattcgagtcc

SEQ ID NO: 94630 - DNA, 25 bp, E. coli
tcacgcgttgatcaaattcgagtcc

SEQ ID NO: 94631 - DNA, 25 bp, E. coli
gcttcgttgcaataagaacagccgg

SEQ ID NO: 94632 - DNA, 25 bp, E. coli
gcttcgttgcaaaaagaacagccgg

SEQ ID NO: 94633 - DNA, 25 bp, E. coli
gaacagccggaaccctttgttgccg

SEQ ID NO: 94634 - DNA, 25 bp, E. coli
gaacagccggaagcctttgttgccg

SEQ ID NO: 94635 - DNA, 25 bp, E. coli
gacaatccgatctgttttggcgaag

SEQ ID NO: 94636 - DNA, 25 bp, E. coli
gacaatccgatcagttttggcgaag

SEQ ID NO: 94637 - DNA, 25 bp, E. coli
tggcaacaacgatgagcaagaactg

SEQ ID NO: 94638 - DNA, 25 bp, E. coli
tggacgtgggtgctttccgactctt

SEQ ID NO: 94639 - DNA, 25 bp, E. coli
tggcaacaacgaagagcaagaactg

SEQ ID NO: 94640 - DNA, 25 bp, E. coli
tggacgtgggtggtttccgactctt

SEQ ID NO: 94641 - DNA, 25 bp, E. coli
aacgtagtgatgtccgaagacgggc

SEQ ID NO: 94642 - DNA, 25 bp, E. coli
cagggtggacgcacaatggaaatcc

SEQ ID NO: 94643 - DNA, 25 bp, E. coli
cagggtggacgctcaatggaaatcc

SEQ ID NO: 94644 - DNA, 25 bp, E. coli
tacagaagctggtggaaaacggcaa

SEQ ID NO: 94645 - DNA, 25 bp, E. coli
tacagaagctggaggaaaacggcaa

SEQ ID NO: 94646 - DNA, 25 bp, E. coli
aacgtagtgatgaccgaagacgggc

SEQ ID NO: 94647 - DNA, 25 bp, E. coli
tagcaataatcacgtgcgtcccgtt

SEQ ID NO: 94648 - DNA, 25 bp, E. coli
tagcaataatcaggtgcgtcccgtt

SEQ ID NO: 94649 - DNA, 25 bp, E. coli
tatacaaaacatgcagaaggctcgg

SEQ ID NO: 94650 - DNA, 25 bp, E. coli
tatacaaaacatccagaaggctcgg

SEQ ID NO: 94651 - DNA, 25 bp, E. coli
ttcgcgcggcagaagatttgaaagc

SEQ ID NO: 94652 - DNA, 25 bp, E. coli
ttcaggctgatggtggcacgcgtac

SEQ ID NO: 94653 - DNA, 25 bp, E. coli
ttcaggctgatgctggcacgcgtac

SEQ ID NO: 94654 - DNA, 25 bp, E. coli
ttcgcgcggcagtagatttgaaagc

SEQ ID NO: 94655 - DNA, 25 bp, E. coli
tgtgtaccgcctctattgaagaagg

SEQ ID NO: 94656 - DNA, 25 bp, E. coli
tgtgtaccgcctgtattgaagaagg

SEQ ID NO: 94657 - DNA, 25 bp, E. coli
gcagagaccgacatgaacgtagtga

SEQ ID NO: 94658 - DNA, 25 bp, E. coli
gcagagaccgacttgaacgtagtga

SEQ ID NO: 94659 - DNA, 25 bp, E. coli
gaaatccagcgtctgatcgcccgtg

SEQ ID NO: 94660 - DNA, 25 bp, E. coli
gaaatccagcgtgtgatcgcccgtg

SEQ ID NO: 94661 - DNA, 25 bp, E. coli
tggactgcgacgtgcttcaggctga

SEQ ID NO: 94662 - DNA, 25 bp, E. coli
tggactgcgacgagcttcaggctga

SEQ ID NO: 94663 - DNA, 25 bp, E. coli
caatgtcatcgttggtcacggtagt

SEQ ID NO: 94664 - DNA, 25 bp, E. coli
caatgtcatcgtaggtcacggtagt

SEQ ID NO: 94665 - DNA, 25 bp, E. coli
caaacaatgtcaacgttggtcacgg

SEQ ID NO: 94666 - DNA, 25 bp, E. coli
caaacaatgtcatcgttggtcacgg

SEQ ID NO: 94667 - DNA, 25 bp, E. coli
tcatcgttggtctcggtagtattgg

SEQ ID NO: 94668 - DNA, 25 bp, E. coli
acgacgccgggtacaggttatgttg

SEQ ID NO: 94669 - DNA, 25 bp, E. coli
tcatcgttggtcacggtagtattgg

SEQ ID NO: 94670 - DNA, 25 bp, E. coli
aaacagactacgacgccgggtacag

SEQ ID NO: 94671 - DNA, 25 bp, E. coli
aaacagactacgtcgccgggtacag

SEQ ID NO: 94672 - DNA, 25 bp, E. coli
acgacgccgggttcaggttatgttg

SEQ ID NO: 94673 - DNA, 25 bp, E. coli
tattctcccggttcaccgttgctcg

SEQ ID NO: 94674 - DNA, 25 bp, E. coli
tattctcccggtacaccgttgctcg

SEQ ID NO: 94675 - DNA, 25 bp, E. coli
tcacggtagtataggtgcgggtgtc

SEQ ID NO: 94676 - DNA, 25 bp, E. coli
tcacggtagtattggtgcgggtgtc

SEQ ID NO: 94677 - DNA, 25 bp, E. coli
tctcccggttcaccgttgctcgata

SEQ ID NO: 94678 - DNA, 25 bp, E. coli
tctcccggttcagcgttgctcgata

SEQ ID NO: 94679 - DNA, 25 bp, E. coli
ccagtgggcaaagaatgtcatcgtt

SEQ ID NO: 94680 - DNA, 25 bp, E. coli
ccagtgggcaaacaatgtcatcgtt

SEQ ID NO: 94681 - DNA, 25 bp, E. coli
gtcgactggcagtaacagactacga

SEQ ID NO: 94682 - DNA, 25 bp, E. coli
gtcgactggcagaaacagactacga

SEQ ID NO: 94683 - DNA, 25 bp, E. coli
tggcagaaacagactacgacgccgg

SEQ ID NO: 94684 - DNA, 25 bp, E. coli
tggcagaaacagtctacgacgccgg

SEQ ID NO: 94685 - DNA, 25 bp, E. coli
cgccgacgttcgagtgccagttaga

SEQ ID NO: 94686 - DNA, 25 bp, E. coli
cgccgacgttcgtgtgccagttaga

SEQ ID NO: 94687 - DNA, 25 bp, E. coli
cagttagagtaacgcgcacagataa

SEQ ID NO: 94688 - DNA, 25 bp, E. coli
cagttagagtaaggcgcacagataa

SEQ ID NO: 94689 - DNA, 25 bp, E. coli
aaaaaggccatcgttcctgtgacag

SEQ ID NO: 94690 - DNA, 25 bp, E. coli
aaaaaggccatccttcctgtgacag

SEQ ID NO: 94691 - DNA, 25 bp, E. coli
tagtccatcacagagcgcattaaga

SEQ ID NO: 94692 - DNA, 25 bp, E. coli
taccgaacagatcacgtacatacgc

SEQ ID NO: 94693 - DNA, 25 bp, E. coli
tagtccatcacacagcgcattaaga

SEQ ID NO: 94694 - DNA, 25 bp, E. coli
taccgaacagatgacgtacatacgc

SEQ ID NO: 94695 - DNA, 25 bp, E. coli
ttactaaggaaagtgaatgcacctg

SEQ ID NO: 94696 - DNA, 25 bp, E. coli
ttactaaggaaactgaatgcacctg

SEQ ID NO: 94697 - DNA, 25 bp, E. coli
gactattcctaagacttcagggcaa

SEQ ID NO: 94698 - DNA, 25 bp, E. coli
gactattcctaacacttcagggcaa

SEQ ID NO: 94699 - DNA, 25 bp, E. coli
cgtttacgccactggaacagtctga

SEQ ID NO: 94700 - DNA, 25 bp, E. coli
cgtttacgccacaggaacagtctga

SEQ ID NO: 94701 - DNA, 25 bp, E. coli
gataactgaatggagtgccctgaca

SEQ ID NO: 94702 - DNA, 25 bp, E. coli
gataactgaatgcagtgccctgaca

SEQ ID NO: 94703 - DNA, 25 bp, E. coli
gggcaaagttcctgaccaatataaa

SEQ ID NO: 94704 - DNA, 25 bp, E. coli
gggcaaagttccagaccaatataaa

SEQ ID NO: 94705 - DNA, 25 bp, E. coli
ggaacagtctgatccaccggtaacc

SEQ ID NO: 94706 - DNA, 25 bp, E. coli
ggaacagtctgaaccaccggtaacc

SEQ ID NO: 94707 - DNA, 25 bp, E. coli
cactgacacgcgaagaactgatgta

SEQ ID NO: 94708 - DNA, 25 bp, E. coli
cactgacacgcgtagaactgatgta

SEQ ID NO: 94709 - DNA, 25 bp, E. coli
aaatcagatccgtcgggagcgccca

SEQ ID NO: 94710 - DNA, 25 bp, E. coli
aaatcagatccgacgggagcgccca

SEQ ID NO: 94711 - DNA, 25 bp, E. coli
tttcgtgccatcagcaccaatggct

SEQ ID NO: 94712 - DNA, 25 bp, E. coli
tttcgtgccatctgcaccaatggct

SEQ ID NO: 94713 - DNA, 25 bp, E. coli
tgtaaatcagatccgtcgggagcgc

SEQ ID NO: 94714 - DNA, 25 bp, E. coli
tgtaaatcagatgcgtcgggagcgc

SEQ ID NO: 94715 - DNA, 25 bp, E. coli
taccacgtcccgagtatttttggag

SEQ ID NO: 94716 - DNA, 25 bp, E. coli
taccacgtcccgtgtatttttggag

SEQ ID NO: 94717 - DNA, 25 bp, E. coli
tcccgagtatttttggagaagaccg

SEQ ID NO: 94718 - DNA, 25 bp, E. coli
tcccgagtatttatggagaagaccg

SEQ ID NO: 94719 - DNA, 25 bp, E. coli
tcatgtaaatcacatccgtcgggag

SEQ ID NO: 94720 - DNA, 25 bp, E. coli
tcatgtaaatcagatccgtcgggag

SEQ ID NO: 94721 - DNA, 25 bp, E. coli
gaactgatgtacgacgtcccgagta

SEQ ID NO: 94722 - DNA, 25 bp, E. coli
gaactgatgtaccacgtcccgagta

SEQ ID NO: 94723 - DNA, 25 bp, E. coli
cgcgaagaactgttgtaccacgtcc

SEQ ID NO: 94724 - DNA, 25 bp, E. coli
cgcgaagaactgatgtaccacgtcc

SEQ ID NO: 94725 - DNA, 25 bp, E. coli
ctgcaccaatggcttggtctgcggt

SEQ ID NO: 94726 - DNA, 25 bp, E. coli
ctgcaccaatgggttggtctgcggt

SEQ ID NO: 94727 - DNA, 25 bp, E. coli
ggagcgcccactgacacgcgaagaa

SEQ ID NO: 94728 - DNA, 25 bp, E. coli
ggagcgcccactcacacgcgaagaa

SEQ ID NO: 94729 - DNA, 25 bp, E. coli
caagaaatttgccaggcgttacgaa

SEQ ID NO: 94730 - DNA, 25 bp, E. coli
caagaaatttgcgaggcgttacgaa

SEQ ID NO: 94731 - DNA, 25 bp, E. coli
caaacgccatcagcacaggcgaggg

SEQ ID NO: 94732 - DNA, 25 bp, E. coli
caaacgccatcaccacaggcgaggg

SEQ ID NO: 94733 - DNA, 25 bp, E. coli
cagcacaggcgaggggcaaaaaacg

SEQ ID NO: 94734 - DNA, 25 bp, E. coli
cagcacaggcgacgggcaaaaaacg

SEQ ID NO: 94735 - DNA, 25 bp, E. coli
agaaatttgcgaggcgttacgaaga

SEQ ID NO: 94736 - DNA, 25 bp, E. coli
agaaatttgcgacgcgttacgaaga

SEQ ID NO: 94737 - DNA, 25 bp, E. coli
tttggcaaacgcgatcagcacaggc

SEQ ID NO: 94738 - DNA, 25 bp, E. coli
tttggcaaacgccatcagcacaggc

SEQ ID NO: 94739 - DNA, 25 bp, E. coli
ttgcagcgaaagtcaagaaatttgc

SEQ ID NO: 94740 - DNA, 25 bp, E. coli
ttgcagcgaaagacaagaaatttgc

SEQ ID NO: 94741 - DNA, 25 bp, E. coli
tttttatttcgttgcagcgaaagac

SEQ ID NO: 94742 - DNA, 25 bp, E. coli
tttttatttcgtagcagcgaaagac

SEQ ID NO: 94743 - DNA, 25 bp, E. coli
gctactttggcaaacgccatcagca

SEQ ID NO: 94744 - DNA, 25 bp, E. coli
gctactttggcatacgccatcagca

SEQ ID NO: 94745 - DNA, 25 bp, E. coli
gaggttttttatttcgttgcagcga

SEQ ID NO: 94746 - DNA, 25 bp, E. coli
gacaagaaatttccgaggcgttacg

SEQ ID NO: 94747 - DNA, 25 bp, E. coli
gaggttttttatatcgttgcagcga

SEQ ID NO: 94748 - DNA, 25 bp, E. coli
gacaagaaatttgcgaggcgttacg

SEQ ID NO: 94749 - DNA, 25 bp, E. coli
cgaaagacaagaaatttgcgaggcg

SEQ ID NO: 94750 - DNA, 25 bp, E. coli
cgaaagacaagatatttgcgaggcg

SEQ ID NO: 94751 - DNA, 25 bp, E. coli
aatgtaatgcgttatatcttcctga

SEQ ID NO: 94752 - DNA, 25 bp, E. coli
aatgtaatgcgtaatatcttcctga

SEQ ID NO: 94753 - DNA, 25 bp, E. coli
caggaatggattatcttctacacac

SEQ ID NO: 94754 - DNA, 25 bp, E. coli
caggaatggattttcttctacacac

SEQ ID NO: 94755 - DNA, 25 bp, E. coli
taaagcgcacttttctaacaacctg

SEQ ID NO: 94756 - DNA, 25 bp, E. coli
taaagcgcacttatctaacaacctg

SEQ ID NO: 94757 - DNA, 25 bp, E. coli
tgataaatcatattccagtacgtct

SEQ ID NO: 94758 - DNA, 25 bp, E. coli
tgatttccctttaatctccacccgg

SEQ ID NO: 94759 - DNA, 25 bp, E. coli
tgatttcccttttatctccacccgg

SEQ ID NO: 94760 - DNA, 25 bp, E. coli
tgataaatcataatccagtacgtct

SEQ ID NO: 94761 - DNA, 25 bp, E. coli
tgcgctgtatcggtgataactaagc

SEQ ID NO: 94762 - DNA, 25 bp, E. coli
tgcgctgtatcgctgataactaagc

SEQ ID NO: 94763 - DNA, 25 bp, E. coli
tctccacccggtaatatttgtgtgt

SEQ ID NO: 94764 - DNA, 25 bp, E. coli
tctccacccggttatatttgtgtgt

SEQ ID NO: 94765 - DNA, 25 bp, E. coli
cgttaacaactaacaaaatgcgctc

SEQ ID NO: 94766 - DNA, 25 bp, E. coli
cgttaacaactatcaaaatgcgctc

SEQ ID NO: 94767 - DNA, 25 bp, E. coli
cgtcgcatccgacataaataaagcg

SEQ ID NO: 94768 - DNA, 25 bp, E. coli
cgtcgcatccgagataaataaagcg

SEQ ID NO: 94769 - DNA, 25 bp, E. coli
gtacgtctttaatctactgcgctgt

SEQ ID NO: 94770 - DNA, 25 bp, E. coli
gtacgtctttaaactactgcgctgt

SEQ ID NO: 94771 - DNA, 25 bp, E. coli
taactaagcagcacactgatacacc

SEQ ID NO: 94772 - DNA, 25 bp, E. coli
taactaagcagctcactgatacacc

SEQ ID NO: 94773 - DNA, 25 bp, E. coli
aataaactcgacctttatggcaagg

SEQ ID NO: 94774 - DNA, 25 bp, E. coli
aataaactcgacgtttatggcaagg

SEQ ID NO: 94775 - DNA, 25 bp, E. coli
cacgctgccgaactctataacaagg

SEQ ID NO: 94776 - DNA, 25 bp, E. coli
caaatgattggtattggtcactggg

SEQ ID NO: 94777 - DNA, 25 bp, E. coli
cacgctgccgaagtctataacaagg

SEQ ID NO: 94778 - DNA, 25 bp, E. coli
caaatgattggttttggtcactggg

SEQ ID NO: 94779 - DNA, 25 bp, E. coli
tatggcaaggtttccgctctacgtt

SEQ ID NO: 94780 - DNA, 25 bp, E. coli
tatggcaaggttaccgctctacgtt

SEQ ID NO: 94781 - DNA, 25 bp, E. coli
tattttactgatgataagcgtgacg

SEQ ID NO: 94782 - DNA, 25 bp, E. coli
tataacgatgaagccaacggctcgc

SEQ ID NO: 94783 - DNA, 25 bp, E. coli
tataacgatgaacccaacggctcgc

SEQ ID NO: 94784 - DNA, 25 bp, E. coli
tattttactgatcataagcgtgacg

SEQ ID NO: 94785 - DNA, 25 bp, E. coli
ttagctgcgaacctagcacacgctg

SEQ ID NO: 94786 - DNA, 25 bp, E. coli
ttagctgcgaacgtagcacacgctg

SEQ ID NO: 94787 - DNA, 25 bp, E. coli
tgataaaacttatgcccgtctcggc

SEQ ID NO: 94788 - DNA, 25 bp, E. coli
tgtaactggtttcttagctgcgaac

SEQ ID NO: 94789 - DNA, 25 bp, E. coli
tgtaactggtttgttagctgcgaac

SEQ ID NO: 94790 - DNA, 25 bp, E. coli
tgataaaacttaagcccgtctcggc

SEQ ID NO: 94791 - DNA, 25 bp, E. coli
tcggctttaaaggagaaacgcaaat

SEQ ID NO: 94792 - DNA, 25 bp, E. coli
tcggctttaaagcagaaacgcaaat

SEQ ID NO: 94793 - DNA, 25 bp, E. coli
taagcgtgacgaaggtgataaaact

SEQ ID NO: 94794 - DNA, 25 bp, E. coli
taagcgtgacgatggtgataaaact

SEQ ID NO: 94795 - DNA, 25 bp, E. coli
aatttacctgccgtttttcatgatg

SEQ ID NO: 94796 - DNA, 25 bp, E. coli
aatttacctgccctttttcatgatg

SEQ ID NO: 94797 - DNA, 25 bp, E. coli
tacctgccgtttttcatgatgcagg

SEQ ID NO: 94798 - DNA, 25 bp, E. coli
tacctgccgtttatcatgatgcagg

SEQ ID NO: 94799 - DNA, 25 bp, E. coli
tttcatgatgcaggccgttagctgc

SEQ ID NO: 94800 - DNA, 25 bp, E. coli
tttcatgatgcacgccgttagctgc

SEQ ID NO: 94801 - DNA, 25 bp, E. coli
tttttcatgatggaggccgttagct

SEQ ID NO: 94802 - DNA, 25 bp, E. coli
tttttcatgatgcaggccgttagct

SEQ ID NO: 94803 - DNA, 25 bp, E. coli
tgccgtttttcatgatgcaggccgt

SEQ ID NO: 94804 - DNA, 25 bp, E. coli
tgccgtttttcaagatgcaggccgt

SEQ ID NO: 94805 - DNA, 25 bp, E. coli
ccgtttttcatgatgcaggccgtta

SEQ ID NO: 94806 - DNA, 25 bp, E. coli
ccgtttttcatgttgcaggccgtta

SEQ ID NO: 94807 - DNA, 25 bp, E. coli
gcggcaaataatttacctgccgttt

SEQ ID NO: 94808 - DNA, 25 bp, E. coli
gcgcggcaaataatttacctgccgt

SEQ ID NO: 94809 - DNA, 25 bp, E. coli
gcggcaaataatatacctgccgttt

SEQ ID NO: 94810 - DNA, 25 bp, E. coli
gcgcggcaaatattttacctgccgt

SEQ ID NO: 94811 - DNA, 25 bp, E. coli
cgtttttcatgaagcaggccgttag

SEQ ID NO: 94812 - DNA, 25 bp, E. coli
cgtttttcatgatgcaggccgttag

SEQ ID NO: 94813 - DNA, 25 bp, E. coli
gtgcgcggcaaaaaatttacctgcc

SEQ ID NO: 94814 - DNA, 25 bp, E. coli
gtgcgcggcaaataatttacctgcc

SEQ ID NO: 94815 - DNA, 25 bp, E. coli
gatgcaggccgtaagctgcaattag

SEQ ID NO: 94816 - DNA, 25 bp, E. coli
gatgcaggccgttagctgcaattag

SEQ ID NO: 94817 - DNA, 25 bp, E. coli
gtttggcggtatgagttttactccg

SEQ ID NO: 94818 - DNA, 25 bp, E. coli
gtttggcggtatcagttttactccg

SEQ ID NO: 94819 - DNA, 25 bp, E. coli
tatcagttttactccgtgactgctc

SEQ ID NO: 94820 - DNA, 25 bp, E. coli
ttctggtgacgtttggcggtatcag

SEQ ID NO: 94821 - DNA, 25 bp, E. coli
ttctggtgacgtatggcggtatcag

SEQ ID NO: 94822 - DNA, 25 bp, E. coli
tatcagttttacaccgtgactgctc

SEQ ID NO: 94823 - DNA, 25 bp, E. coli
ttttactccgtgactgctctgccgc

SEQ ID NO: 94824 - DNA, 25 bp, E. coli
ttttactccgtgtctgctctgccgc

SEQ ID NO: 94825 - DNA, 25 bp, E. coli
ttggcggtatcagttttactccgtg

SEQ ID NO: 94826 - DNA, 25 bp, E. coli
ttggcggtatcacttttactccgtg

SEQ ID NO: 94827 - DNA, 25 bp, E. coli
gcggtatcagttttactccgtgact

SEQ ID NO: 94828 - DNA, 25 bp, E. coli
gcggtatcagttatactccgtgact

SEQ ID NO: 94829 - DNA, 25 bp, E. coli
gacgtttggcggtatcagttttact

SEQ ID NO: 94830 - DNA, 25 bp, E. coli
gacgtttggcggaatcagttttact

SEQ ID NO: 94831 - DNA, 25 bp, E. coli
ctggtgacgtttcgcggtatcagtt

SEQ ID NO: 94832 - DNA, 25 bp, E. coli
ctggtgacgtttggcggtatcagtt

SEQ ID NO: 94833 - DNA, 25 bp, E. coli
gttttactccgtgactgctctgccg

SEQ ID NO: 94834 - DNA, 25 bp, E. coli
gttttactccgtcactgctctgccg

SEQ ID NO: 94835 - DNA, 25 bp, E. coli
ggtatcagtttttctccgtgactgc

SEQ ID NO: 94836 - DNA, 25 bp, E. coli
ggtatcagttttactccgtgactgc

SEQ ID NO: 94837 - DNA, 25 bp, E. coli
ggcggtatcagtattactccgtgac

SEQ ID NO: 94838 - DNA, 25 bp, E. coli
ggcggtatcagttttactccgtgac

SEQ ID NO: 94839 - DNA, 25 bp, E. coli
caatatatcccttacctgatcgccg

SEQ ID NO: 94840 - DNA, 25 bp, E. coli
caatatatccctaacctgatcgccg

SEQ ID NO: 94841 - DNA, 25 bp, E. coli
aacctgttgccgcttgccgtactgg

SEQ ID NO: 94842 - DNA, 25 bp, E. coli
aacctgttgccggttgccgtactgg

SEQ ID NO: 94843 - DNA, 25 bp, E. coli
tttatgaccaaacccgataaatgcg

SEQ ID NO: 94844 - DNA, 25 bp, E. coli
tttatgaccaaagccgataaatgcg

SEQ ID NO: 94845 - DNA, 25 bp, E. coli
tgctacatccagctcagcaacctgt

SEQ ID NO: 94846 - DNA, 25 bp, E. coli
tgacccacggctatgaagtggctgg

SEQ ID NO: 94847 - DNA, 25 bp, E. coli
tgctacatccaggtcagcaacctgt

SEQ ID NO: 94848 - DNA, 25 bp, E. coli
tgacccacggctttgaagtggctgg

SEQ ID NO: 94849 - DNA, 25 bp, E. coli
tcgcttcagcgtttgcggtgattgc

SEQ ID NO: 94850 - DNA, 25 bp, E. coli
tcgcttcagcgtatgcggtgattgc

SEQ ID NO: 94851 - DNA, 25 bp, E. coli
gcaattggtcttggcctgccgttta

SEQ ID NO: 94852 - DNA, 25 bp, E. coli
gcaattggtcttcgcctgccgttta

SEQ ID NO: 94853 - DNA, 25 bp, E. coli
cattgcatggtctacgggcgttgat

SEQ ID NO: 94854 - DNA, 25 bp, E. coli
cttaactggacaacgatgctcatcg

SEQ ID NO: 94855 - DNA, 25 bp, E. coli
cattgcatggtcaacgggcgttgat

SEQ ID NO: 94856 - DNA, 25 bp, E. coli
cttaactggacatcgatgctcatcg

SEQ ID NO: 94857 - DNA, 25 bp, E. coli
gattgctttcctctgtacttacctg

SEQ ID NO: 94858 - DNA, 25 bp, E. coli
gattgctttcctgtgtacttacctg

SEQ ID NO: 94859 - DNA, 25 bp, E. coli
gagtttttcaatccgaaatcccggc

SEQ ID NO: 94860 - DNA, 25 bp, E. coli
gagtttttcaatgcgaaatcccggc

SEQ ID NO: 94861 - DNA, 25 bp, E. coli
cacactggcggataacctggttggc

SEQ ID NO: 94862 - DNA, 25 bp, E. coli
cacactggcggaaaacctggttggc

SEQ ID NO: 94863 - DNA, 25 bp, E. coli
catgcttgccaatcgtatgggtgcg

SEQ ID NO: 94864 - DNA, 25 bp, E. coli
catgcttgccaaacgtatgggtgcg

SEQ ID NO: 94865 - DNA, 25 bp, E. coli
tactcgtgtggctgcaattttccgc

SEQ ID NO: 94866 - DNA, 25 bp, E. coli
tactcgtgtggcagcaattttccgc

SEQ ID NO: 94867 - DNA, 25 bp, E. coli
taaagcctattaaggcggcccgctg

SEQ ID NO: 94868 - DNA, 25 bp, E. coli
taaagcctattatggcggcccgctg

SEQ ID NO: 94869 - DNA, 25 bp, E. coli
aaaattatcattgtgggtgccggcc

SEQ ID NO: 94870 - DNA, 25 bp, E. coli
aaaattatcattctgggtgccggcc

SEQ ID NO: 94871 - DNA, 25 bp, E. coli
taccgactgattgagtatcccggcg

SEQ ID NO: 94872 - DNA, 25 bp, E. coli
taccgactgattcagtatcccggcg

SEQ ID NO: 94873 - DNA, 25 bp, E. coli
tgacgaaatcaacctaccgccagga

SEQ ID NO: 94874 - DNA, 25 bp, E. coli
tgacgaaatcaagctaccgccagga

SEQ ID NO: 94875 - DNA, 25 bp, E. coli
tccgcgcggtgaagagtgaattaca

SEQ ID NO: 94876 - DNA, 25 bp, E. coli
tccgcgcggtgatgagtgaattaca

SEQ ID NO: 94877 - DNA, 25 bp, E. coli
tcatcgaacgtattcagcagcgcgc

SEQ ID NO: 94878 - DNA, 25 bp, E. coli
tcatcgaacgtaatcagcagcgcgc

SEQ ID NO: 94879 - DNA, 25 bp, E. coli
gtaatgcactttcgaccatgcgcga

SEQ ID NO: 94880 - DNA, 25 bp, E. coli
gtaatgcactttggaccatgcgcga

SEQ ID NO: 94881 - DNA, 25 bp, E. coli
gatgaaagcaccacacgcgttgtcg

SEQ ID NO: 94882 - DNA, 25 bp, E. coli
gatgaaagcacctcacgcgttgtcg

SEQ ID NO: 94883 - DNA, 25 bp, E. coli
caatttttcacggtaaatgaaaggg

SEQ ID NO: 94884 - DNA, 25 bp, E. coli
aataatctcattgaatttttcacgc

SEQ ID NO: 94885 - DNA, 25 bp, E. coli
caatttttcacgctaaatgaaaggg

SEQ ID NO: 94886 - DNA, 25 bp, E. coli
aataatctcattcaatttttcacgc

SEQ ID NO: 94887 - DNA, 25 bp, E. coli
cacgctaaatgatagggagattaaa

SEQ ID NO: 94888 - DNA, 25 bp, E. coli
cacgctaaatgaaagggagattaaa

SEQ ID NO: 94889 - DNA, 25 bp, E. coli
cataagtttagtgggttcagcatca

SEQ ID NO: 94890 - DNA, 25 bp, E. coli
cataagtttagtcggttcagcatca

SEQ ID NO: 94891 - DNA, 25 bp, E. coli
atgtctggtgagtgctgtagaagca

SEQ ID NO: 94892 - DNA, 25 bp, E. coli
atgtctggtgagagctgtagaagca

SEQ ID NO: 94893 - DNA, 25 bp, E. coli
aaagaatcttcaaaagtttagtggg

SEQ ID NO: 94894 - DNA, 25 bp, E. coli
aaagaatcttcataagtttagtggg

SEQ ID NO: 94895 - DNA, 25 bp, E. coli
tagtgggttcaggatcagagatgtc

SEQ ID NO: 94896 - DNA, 25 bp, E. coli
tagtgggttcagcatcagagatgtc

SEQ ID NO: 94897 - DNA, 25 bp, E. coli
tatttgtcagttaatgtcagtgcgg

SEQ ID NO: 94898 - DNA, 25 bp, E. coli
tatttgtcagtttatgtcagtgcgg

SEQ ID NO: 94899 - DNA, 25 bp, E. coli
tgctgtagaagcaggaataatctca

SEQ ID NO: 94900 - DNA, 25 bp, E. coli
tgctgtagaagctggaataatctca

SEQ ID NO: 94901 - DNA, 25 bp, E. coli
gaaagggagatttaatatttgtcag

SEQ ID NO: 94902 - DNA, 25 bp, E. coli
gaaagggagattaaatatttgtcag

SEQ ID NO: 94903 - DNA, 25 bp, E. coli
tcagcatcagagttgtctggtgagt

SEQ ID NO: 94904 - DNA, 25 bp, E. coli
tcagcatcagagatgtctggtgagt

SEQ ID NO: 94905 - DNA, 25 bp, E. coli
aacgggatgaccagcaagaggcgct

SEQ ID NO: 94906 - DNA, 25 bp, E. coli
aacctggcgcaagggaaagctgctg

SEQ ID NO: 94907 - DNA, 25 bp, E. coli
catcaggataacgatgcggtcagtc

SEQ ID NO: 94908 - DNA, 25 bp, E. coli
catcaggataaccatgcggtcagtc

SEQ ID NO: 94909 - DNA, 25 bp, E. coli
catttaatgcgcgttgccagtgggc

SEQ ID NO: 94910 - DNA, 25 bp, E. coli
aacgggatgacctgcaagaggcgct

SEQ ID NO: 94911 - DNA, 25 bp, E. coli
aacctggcgcaacggaaagctgctg

SEQ ID NO: 94912 - DNA, 25 bp, E. coli
tagccaggcagagcaggttcgtgat

SEQ ID NO: 94913 - DNA, 25 bp, E. coli
tagccaggcagaccaggttcgtgat

SEQ ID NO: 94914 - DNA, 25 bp, E. coli
tattcgcgattatcgtagccaggca

SEQ ID NO: 94915 - DNA, 25 bp, E. coli
tatttcccgcagtcatgaccctttt

SEQ ID NO: 94916 - DNA, 25 bp, E. coli
tattcgcgattaacgtagccaggca

SEQ ID NO: 94917 - DNA, 25 bp, E. coli
tatttcccgcagacatgaccctttt

SEQ ID NO: 94918 - DNA, 25 bp, E. coli
tgctgctgtggaggcggaaactatc

SEQ ID NO: 94919 - DNA, 25 bp, E. coli
tgctgctgtggacgcggaaactatc

SEQ ID NO: 94920 - DNA, 25 bp, E. coli
cgcccaggaggcgagtgaatttatg

SEQ ID NO: 94921 - DNA, 25 bp, E. coli
cgcccaggaggccagtgaatttatg

SEQ ID NO: 94922 - DNA, 25 bp, E. coli
catttaatgcgccttgccagtgggc

SEQ ID NO: 94923 - DNA, 25 bp, E. coli
ggcttgattctcacgtccttggcga

SEQ ID NO: 94924 - DNA, 25 bp, E. coli
ggcttgattctctcgtccttggcga

SEQ ID NO: 94925 - DNA, 25 bp, E. coli
taatctcaacgaagacgatctgcgt

SEQ ID NO: 94926 - DNA, 25 bp, E. coli
taatctcaacgatgacgatctgcgt

SEQ ID NO: 94927 - DNA, 25 bp, E. coli
tacgcgggccggagaaaattcagcc

SEQ ID NO: 94928 - DNA, 25 bp, E. coli
actggcaagggcaggagatcatcga

SEQ ID NO: 94929 - DNA, 25 bp, E. coli
aaagttccgtgaacccattctggca

SEQ ID NO: 94930 - DNA, 25 bp, E. coli
aaagttccgtgatcccattctggca

SEQ ID NO: 94931 - DNA, 25 bp, E. coli
actggcaagggctggagatcatcga

SEQ ID NO: 94932 - DNA, 25 bp, E. coli
tacgcgggccggtgaaaattcagcc

SEQ ID NO: 94933 - DNA, 25 bp, E. coli
tttgatgaaagtctgccgtgcgcgc

SEQ ID NO: 94934 - DNA, 25 bp, E. coli
tataaagcgacgatgcccgcgattg

SEQ ID NO: 94935 - DNA, 25 bp, E. coli
tataaagcgacgttgcccgcgattg

SEQ ID NO: 94936 - DNA, 25 bp, E. coli
tttgatgaaagtgtgccgtgcgcgc

SEQ ID NO: 94937 - DNA, 25 bp, E. coli
ttgctgaaaactcgcaaaccgggcg

SEQ ID NO: 94938 - DNA, 25 bp, E. coli
ttgctgaaaactggcaaaccgggcg

SEQ ID NO: 94939 - DNA, 25 bp, E. coli
tgttccataatcagggcaacccggt

SEQ ID NO: 94940 - DNA, 25 bp, E. coli
tgttccataatctgggcaacccggt

SEQ ID NO: 94941 - DNA, 25 bp, E. coli
tgccggacgactcggaaaaagctca

SEQ ID NO: 94942 - DNA, 25 bp, E. coli
tgccggacgactgggaaaaagctca

SEQ ID NO: 94943 - DNA, 25 bp, E. coli
cctcgcaagggcagaaaatggcagc

SEQ ID NO: 94944 - DNA, 25 bp, E. coli
cctcgcaagggctgaaaatggcagc

SEQ ID NO: 94945 - DNA, 25 bp, E. coli
cattcatccagtgggtacgtcaggg

SEQ ID NO: 94946 - DNA, 25 bp, E. coli
cattcatccagtcggtacgtcaggg

SEQ ID NO: 94947 - DNA, 25 bp, E. coli
gatgatcatacgattgcgcggcgga

SEQ ID NO: 94948 - DNA, 25 bp, E. coli
gatgatcatacgtttgcgcggcgga

SEQ ID NO: 94949 - DNA, 25 bp, E. coli
tatgactacatcaaaatcgcgcgag

SEQ ID NO: 94950 - DNA, 25 bp, E. coli
tatgactacatctaaatcgcgcgag

SEQ ID NO: 94951 - DNA, 25 bp, E. coli
tgcgtcagcaacgaaaaatcctgcg

SEQ ID NO: 94952 - DNA, 25 bp, E. coli
tgcgtcagcaaccaaaaatcctgcg

SEQ ID NO: 94953 - DNA, 25 bp, E. coli
tctaatgaatcgctattgtcgcggg

SEQ ID NO: 94954 - DNA, 25 bp, E. coli
tctaatgaatcggtattgtcgcggg

SEQ ID NO: 94955 - DNA, 25 bp, E. coli
cctcgatgtgtgtatttggcccgct

SEQ ID NO: 94956 - DNA, 25 bp, E. coli
gccgccggatcggtattttactgaa

SEQ ID NO: 94957 - DNA, 25 bp, E. coli
gccgccggatcgctattttactgaa

SEQ ID NO: 94958 - DNA, 25 bp, E. coli
cctcgatgtgtgaatttggcccgct

SEQ ID NO: 94959 - DNA, 25 bp, E. coli
gaaggacgcacactcttttctcagc

SEQ ID NO: 94960 - DNA, 25 bp, E. coli
gaaggacgcacagtcttttctcagc

SEQ ID NO: 94961 - DNA, 25 bp, E. coli
gaatacggcggttctggcgctataa

SEQ ID NO: 94962 - DNA, 25 bp, E. coli
gaatacggcggtactggcgctataa

SEQ ID NO: 94963 - DNA, 25 bp, E. coli
cccggcaccgatagaaacgctgaat

SEQ ID NO: 94964 - DNA, 25 bp, E. coli
cccggcaccgattgaaacgctgaat

SEQ ID NO: 94965 - DNA, 25 bp, E. coli
gattgagcgtctaccctggctgcgt

SEQ ID NO: 94966 - DNA, 25 bp, E. coli
gattgagcgtcttccctggctgcgt

SEQ ID NO: 94967 - DNA, 25 bp, E. coli
tggtaccgggatcgcaaatttctct

SEQ ID NO: 94968 - DNA, 25 bp, E. coli
tggtaccgggatggcaaatttctct

SEQ ID NO: 94969 - DNA, 25 bp, E. coli
gatctatcaaacttgcgggcggtta

SEQ ID NO: 94970 - DNA, 25 bp, E. coli
gatctatcaaacatgcgggcggtta

SEQ ID NO: 94971 - DNA, 25 bp, E. coli
catatggcagcgctttacgcactga

SEQ ID NO: 94972 - DNA, 25 bp, E. coli
cagttgcagccaagaatccgtccag

SEQ ID NO: 94973 - DNA, 25 bp, E. coli
catatggcagcggtttacgcactga

SEQ ID NO: 94974 - DNA, 25 bp, E. coli
cagttgcagccatgaatccgtccag

SEQ ID NO: 94975 - DNA, 25 bp, E. coli
tattcattgatgacgcgcaacgtgc

SEQ ID NO: 94976 - DNA, 25 bp, E. coli
tattcattgatgtcgcgcaacgtgc

SEQ ID NO: 94977 - DNA, 25 bp, E. coli
ttaaaacacagtcaacagttgcagc

SEQ ID NO: 94978 - DNA, 25 bp, E. coli
ttaaaacacagtgaacagttgcagc

SEQ ID NO: 94979 - DNA, 25 bp, E. coli
tgtcagcagagctagacaagctgtc

SEQ ID NO: 94980 - DNA, 25 bp, E. coli
tgtcagcagagcaagacaagctgtc

SEQ ID NO: 94981 - DNA, 25 bp, E. coli
tgaggaacagagcaaagaaatcgac

SEQ ID NO: 94982 - DNA, 25 bp, E. coli
tgaggaacagaggaaagaaatcgac

SEQ ID NO: 94983 - DNA, 25 bp, E. coli
ccagggcagcccagaaagataatca

SEQ ID NO: 94984 - DNA, 25 bp, E. coli
cctgatagaacggtctcaagctgta

SEQ ID NO: 94985 - DNA, 25 bp, E. coli
cctgatagaacgctctcaagctgta

SEQ ID NO: 94986 - DNA, 25 bp, E. coli
ccagggcagccctgaaagataatca

SEQ ID NO: 94987 - DNA, 25 bp, E. coli
ccctgaagcagccaaagttattgag

SEQ ID NO: 94988 - DNA, 25 bp, E. coli
ccctgaagcagcgaaagttattgag

SEQ ID NO: 94989 - DNA, 25 bp, E. coli
gataacgccttagcacacaaaagag

SEQ ID NO: 94990 - DNA, 25 bp, E. coli
gataacgccttaccacacaaaagag

SEQ ID NO: 94991 - DNA, 25 bp, E. coli
gagcttctgacatatctccgcctga

SEQ ID NO: 94992 - DNA, 25 bp, E. coli
gagcttctgacaaatctccgcctga

SEQ ID NO: 94993 - DNA, 25 bp, E. coli
aacgccaggaactgcaagagcagga

SEQ ID NO: 94994 - DNA, 25 bp, E. coli
caaccagatcctggacgttcgcgaa

SEQ ID NO: 94995 - DNA, 25 bp, E. coli
caaccagatcctcgacgttcgcgaa

SEQ ID NO: 94996 - DNA, 25 bp, E. coli
ctcgtcagatgcaggtaggcggaaa

SEQ ID NO: 94997 - DNA, 25 bp, E. coli
ctcgtcagatgctggtaggcggaaa

SEQ ID NO: 94998 - DNA, 25 bp, E. coli
taaaaccactgttatcgcgctgcgc

SEQ ID NO: 94999 - DNA, 25 bp, E. coli
taaaaccactgtaatcgcgctgcgc

SEQ ID NO: 95000 - DNA, 25 bp, E. coli
atggcacgcgtatctgttcaggacg

SEQ ID NO: 95001 - DNA, 25 bp, E. coli
atggcacgcgtaactgttcaggacg

SEQ ID NO: 95002 - DNA, 25 bp, E. coli
aacgccaggaacagcaagagcagga

SEQ ID NO: 95003 - DNA, 25 bp, E. coli
ttttgacctggtactggtcgccgcg

SEQ ID NO: 95004 - DNA, 25 bp, E. coli
ttttgacctggttctggtcgccgcg

SEQ ID NO: 95005 - DNA, 25 bp, E. coli
gaagccgctgaaatacaagccgtta

SEQ ID NO: 95006 - DNA, 25 bp, E. coli
gaagccgctgaattacaagccgtta

SEQ ID NO: 95007 - DNA, 25 bp, E. coli
gaaaggatccgcaggtaccggaaga

SEQ ID NO: 95008 - DNA, 25 bp, E. coli
gacgctgtagagtaaattggtaacc

SEQ ID NO: 95009 - DNA, 25 bp, E. coli
gacgctgtagagaaaattggtaacc

SEQ ID NO: 95010 - DNA, 25 bp, E. coli
gaaaggatccgctggtaccggaaga

SEQ ID NO: 95011 - DNA, 25 bp, E. coli
ccgctattgctgaaggtcgtcgtta

SEQ ID NO: 95012 - DNA, 25 bp, E. coli
ccgctattgctgtaggtcgtcgtta

SEQ ID NO: 95013 - DNA, 25 bp, E. coli
cgctgcgcgaaaacgaagaaggtct

SEQ ID NO: 95014 - DNA, 25 bp, E. coli
cgctgcgcgaaatcgaagaaggtct

SEQ ID NO: 95015 - DNA, 25 bp, E. coli
cagtggtcgccaaagcgcataatct

SEQ ID NO: 95016 - DNA, 25 bp, E. coli
cagtggtcgccatagcgcataatct

SEQ ID NO: 95017 - DNA, 25 bp, E. coli
tacagtggtcgccaaagcgcataat

SEQ ID NO: 95018 - DNA, 25 bp, E. coli
tacagtggtcgcgaaagcgcataat

SEQ ID NO: 95019 - DNA, 25 bp, E. coli
ttcggcgcacttcttagccaacgct

SEQ ID NO: 95020 - DNA, 25 bp, E. coli
ttcggcgcacttgttagccaacgct

SEQ ID NO: 95021 - DNA, 25 bp, E. coli
ttgcggtgtcggagattagcattcc

SEQ ID NO: 95022 - DNA, 25 bp, E. coli
ttgcggtgtcggtgattagcattcc

SEQ ID NO: 95023 - DNA, 25 bp, E. coli
tgtttcaccactcgcgtaagaagcc

SEQ ID NO: 95024 - DNA, 25 bp, E. coli
tgtttcaccactggcgtaagaagcc

SEQ ID NO: 95025 - DNA, 25 bp, E. coli
gcggtgtcggtgtttagcattccat

SEQ ID NO: 95026 - DNA, 25 bp, E. coli
gcataatctgtttcaccactcgcgt

SEQ ID NO: 95027 - DNA, 25 bp, E. coli
gcgttttcggcggacttcttagcca

SEQ ID NO: 95028 - DNA, 25 bp, E. coli
gcggtgtcggtgattagcattccat

SEQ ID NO: 95029 - DNA, 25 bp, E. coli
gcgttttcggcgcacttcttagcca

SEQ ID NO: 95030 - DNA, 25 bp, E. coli
gcataatctgttacaccactcgcgt

SEQ ID NO: 95031 - DNA, 25 bp, E. coli
gtcggtgattagcattccattactg

SEQ ID NO: 95032 - DNA, 25 bp, E. coli
gtcggtgattaggattccattactg

SEQ ID NO: 95033 - DNA, 25 bp, E. coli
tcaccactcgcgaaagaagccagcg

SEQ ID NO: 95034 - DNA, 25 bp, E. coli
taatctgtttcaccactcgcgtaag

SEQ ID NO: 95035 - DNA, 25 bp, E. coli
taatctgtttcagcactcgcgtaag

SEQ ID NO: 95036 - DNA, 25 bp, E. coli
tcaccactcgcgtaagaagccagcg

SEQ ID NO: 95037 - DNA, 25 bp, E. coli
tgatcccggatgtcgttgaggttgc

SEQ ID NO: 95038 - DNA, 25 bp, E. coli
tcgttgaggttggtaaaaacaatgc

SEQ ID NO: 95039 - DNA, 25 bp, E. coli
tgatcccggatgacgttgaggttgc

SEQ ID NO: 95040 - DNA, 25 bp, E. coli
tgacctctcacctgcatgaaaaaga

SEQ ID NO: 95041 - DNA, 25 bp, E. coli
tgacctctcaccagcatgaaaaaga

SEQ ID NO: 95042 - DNA, 25 bp, E. coli
tcccggatgtcgttgaggttgctaa

SEQ ID NO: 95043 - DNA, 25 bp, E. coli
tcccggatgtcgatgaggttgctaa

SEQ ID NO: 95044 - DNA, 25 bp, E. coli
tcacctgcatgaaaaagattttttg

SEQ ID NO: 95045 - DNA, 25 bp, E. coli
tcacctgcatgataaagattttttg

SEQ ID NO: 95046 - DNA, 25 bp, E. coli
cctctcacctgcttgaaaaagattt

SEQ ID NO: 95047 - DNA, 25 bp, E. coli
cctctcacctgcatgaaaaagattt

SEQ ID NO: 95048 - DNA, 25 bp, E. coli
cctgatcccggatgtcgttgaggtt

SEQ ID NO: 95049 - DNA, 25 bp, E. coli
cctgatcccggaagtcgttgaggtt

SEQ ID NO: 95050 - DNA, 25 bp, E. coli
gctgacctctcagctgcatgaaaaa

SEQ ID NO: 95051 - DNA, 25 bp, E. coli
gctgacctctcacctgcatgaaaaa

SEQ ID NO: 95052 - DNA, 25 bp, E. coli
ccggatgtcgttgaggttgctaaaa

SEQ ID NO: 95053 - DNA, 25 bp, E. coli
ccggatgtcgttcaggttgctaaaa

SEQ ID NO: 95054 - DNA, 25 bp, E. coli
tgaggttgctaaaaacaatgctaaa

SEQ ID NO: 95055 - DNA, 25 bp, E. coli
tcgttgaggttgctaaaaacaatgc

SEQ ID NO: 95056 - DNA, 25 bp, E. coli
tgaggttgctaataacaatgctaaa

SEQ ID NO: 95057 - DNA, 25 bp, E. coli
gatgtcgttgagcttgctaaaaaca

SEQ ID NO: 95058 - DNA, 25 bp, E. coli
gatgtcgttgaggttgctaaaaaca

SEQ ID NO: 95059 - DNA, 25 bp, E. coli
caacgttgatgaatgcggtcagccc

SEQ ID NO: 95060 - DNA, 25 bp, E. coli
caaaggccgcgctttttgcgaaaaa

SEQ ID NO: 95061 - DNA, 25 bp, E. coli
caacgttgatgattgcggtcagccc

SEQ ID NO: 95062 - DNA, 25 bp, E. coli
caaaggccgcgcattttgcgaaaaa

SEQ ID NO: 95063 - DNA, 25 bp, E. coli
acgttgatgattccggtcagcccgc

SEQ ID NO: 95064 - DNA, 25 bp, E. coli
acgttgatgattgcggtcagcccgc

SEQ ID NO: 95065 - DNA, 25 bp, E. coli
ttgatgattgcggtcagcccgctgg

SEQ ID NO: 95066 - DNA, 25 bp, E. coli
ttgatgattgcgctcagcccgctgg

SEQ ID NO: 95067 - DNA, 25 bp, E. coli
tgatgattgcggtcagcccgctggc

SEQ ID NO: 95068 - DNA, 25 bp, E. coli
tgtacagtggacaatgaatgcctgg

SEQ ID NO: 95069 - DNA, 25 bp, E. coli
tgtacagtggactatgaatgcctgg

SEQ ID NO: 95070 - DNA, 25 bp, E. coli
tgatgattgcggacagcccgctggc

SEQ ID NO: 95071 - DNA, 25 bp, E. coli
gcagggtgtacactggacaatgaat

SEQ ID NO: 95072 - DNA, 25 bp, E. coli
gaatcaacgttgatgattgcggtca

SEQ ID NO: 95073 - DNA, 25 bp, E. coli
gcagggtgtacagtggacaatgaat

SEQ ID NO: 95074 - DNA, 25 bp, E. coli
gaatcaacgttgttgattgcggtca

SEQ ID NO: 95075 - DNA, 25 bp, E. coli
gggtgtacagtggacaatgaatgcc

SEQ ID NO: 95076 - DNA, 25 bp, E. coli
gggtgtacagtgcacaatgaatgcc

SEQ ID NO: 95077 - DNA, 25 bp, E. coli
ggcacgggcaaaggccgcgcatttt

SEQ ID NO: 95078 - DNA, 25 bp, E. coli
ggcacgggcaaacgccgcgcatttt

SEQ ID NO: 95079 - DNA, 25 bp, E. coli
tcaacgttgatgattgcggtcagcc

SEQ ID NO: 95080 - DNA, 25 bp, E. coli
tcaacgttgatgtttgcggtcagcc

SEQ ID NO: 95081 - DNA, 25 bp, E. coli
cagactgtggtttctccacaaacgc

SEQ ID NO: 95082 - DNA, 25 bp, E. coli
cagactgtggttactccacaaacgc

SEQ ID NO: 95083 - DNA, 25 bp, E. coli
tacgttgttgatgacaccgcttaag

SEQ ID NO: 95084 - DNA, 25 bp, E. coli
actgtggttactgcacaaacgcaga

SEQ ID NO: 95085 - DNA, 25 bp, E. coli
actgtggttactccacaaacgcaga

SEQ ID NO: 95086 - DNA, 25 bp, E. coli
tacgttgttgatcacaccgcttaag

SEQ ID NO: 95087 - DNA, 25 bp, E. coli
tgtggttactcctcaaacgcagatc

SEQ ID NO: 95088 - DNA, 25 bp, E. coli
tgtggttactccacaaacgcagatc

SEQ ID NO: 95089 - DNA, 25 bp, E. coli
tggtggacagacagtggttactcca

SEQ ID NO: 95090 - DNA, 25 bp, E. coli
gacagactgtggttactccacaaac

SEQ ID NO: 95091 - DNA, 25 bp, E. coli
gacagactgtggatactccacaaac

SEQ ID NO: 95092 - DNA, 25 bp, E. coli
gactgtggttacaccacaaacgcag

SEQ ID NO: 95093 - DNA, 25 bp, E. coli
gactgtggttactccacaaacgcag

SEQ ID NO: 95094 - DNA, 25 bp, E. coli
ggtggacagactctggttactccac

SEQ ID NO: 95095 - DNA, 25 bp, E. coli
ggtacgttgttgttgacaccgctta

SEQ ID NO: 95096 - DNA, 25 bp, E. coli
ggtggacagactgtggttactccac

SEQ ID NO: 95097 - DNA, 25 bp, E. coli
ggtacgttgttgatgacaccgctta

SEQ ID NO: 95098 - DNA, 25 bp, E. coli
ggacagactgtgcttactccacaaa

SEQ ID NO: 95099 - DNA, 25 bp, E. coli
tggacagactgtggttactccacaa

SEQ ID NO: 95100 - DNA, 25 bp, E. coli
ggacagactgtggttactccacaaa

SEQ ID NO: 95101 - DNA, 25 bp, E. coli
tggtggacagactgtggttactcca

SEQ ID NO: 95102 - DNA, 25 bp, E. coli
tggacagactgtcgttactccacaa

SEQ ID NO: 95103 - DNA, 25 bp, E. coli
aagaaagggacacgccacacgtatg

SEQ ID NO: 95104 - DNA, 25 bp, E. coli
aagaaagggacaggccacacgtatg

SEQ ID NO: 95105 - DNA, 25 bp, E. coli
catctgcgcagggtacttcatgaag

SEQ ID NO: 95106 - DNA, 25 bp, E. coli
catctgcgcaggctacttcatgaag

SEQ ID NO: 95107 - DNA, 25 bp, E. coli
aaacgcctgaaacgctggttgccag

SEQ ID NO: 95108 - DNA, 25 bp, E. coli
aaacgcctgaaaggctggttgccag

SEQ ID NO: 95109 - DNA, 25 bp, E. coli
tatggcggccaccatacggcataac

SEQ ID NO: 95110 - DNA, 25 bp, E. coli
tatggcggccacgatacggcataac

SEQ ID NO: 95111 - DNA, 25 bp, E. coli
tatacaggctctcaatcatctgcgc

SEQ ID NO: 95112 - DNA, 25 bp, E. coli
tatacaggctctgaatcatctgcgc

SEQ ID NO: 95113 - DNA, 25 bp, E. coli
tcgtcagttactcggcagggaagca

SEQ ID NO: 95114 - DNA, 25 bp, E. coli
tcgtcagttactgggcagggaagca

SEQ ID NO: 95115 - DNA, 25 bp, E. coli
tctgtgacacctgaagtggaggtac

SEQ ID NO: 95116 - DNA, 25 bp, E. coli
tctgtgacacctcaagtggaggtac

SEQ ID NO: 95117 - DNA, 25 bp, E. coli
tcacccaacccgtggtggtgtcggc

SEQ ID NO: 95118 - DNA, 25 bp, E. coli
ccaggaacgatcagaaaaagagact

SEQ ID NO: 95119 - DNA, 25 bp, E. coli
ccaggaacgatctgaaaaagagact

SEQ ID NO: 95120 - DNA, 25 bp, E. coli
gattataacccctatgtcatggcgc

SEQ ID NO: 95121 - DNA, 25 bp, E. coli
gattataaccccaatgtcatggcgc

SEQ ID NO: 95122 - DNA, 25 bp, E. coli
tcacccaacccgaggtggtgtcggc

SEQ ID NO: 95123 - DNA, 25 bp, E. coli
gagaagaacccctatctggtggtgg

SEQ ID NO: 95124 - DNA, 25 bp, E. coli
gagaagaaccccaatctggtggtgg

SEQ ID NO: 95125 - DNA, 25 bp, E. coli
cagccggctgcttttcaatgtttac

SEQ ID NO: 95126 - DNA, 25 bp, E. coli
cagccggctgctattcaatgtttac

SEQ ID NO: 95127 - DNA, 25 bp, E. coli
catgtcgatgaaagcagtcatagca

SEQ ID NO: 95128 - DNA, 25 bp, E. coli
catgtcgatgaatgcagtcatagca

SEQ ID NO: 95129 - DNA, 25 bp, E. coli
tacacctctgcttttgtaacatcag

SEQ ID NO: 95130 - DNA, 25 bp, E. coli
tacacctctgctattgtaacatcag

SEQ ID NO: 95131 - DNA, 25 bp, E. coli
aaaaaacagtcatcagccggctgct

SEQ ID NO: 95132 - DNA, 25 bp, E. coli
aacaggcaggaagttatatccaggg

SEQ ID NO: 95133 - DNA, 25 bp, E. coli
aaaaaacagtcaacagccggctgct

SEQ ID NO: 95134 - DNA, 25 bp, E. coli
aacaggcaggaacttatatccaggg

SEQ ID NO: 95135 - DNA, 25 bp, E. coli
aaacggaagaatcgatgatctcgca

SEQ ID NO: 95136 - DNA, 25 bp, E. coli
aaacggaagaatggatgatctcgca

SEQ ID NO: 95137 - DNA, 25 bp, E. coli
tgcatttcttactaacaggcaggaa

SEQ ID NO: 95138 - DNA, 25 bp, E. coli
tgcatttcttacaaacaggcaggaa

SEQ ID NO: 95139 - DNA, 25 bp, E. coli
tctgctggcagtcaggaaaacggaa

SEQ ID NO: 95140 - DNA, 25 bp, E. coli
tctgctggcagtgaggaaaacggaa

SEQ ID NO: 95141 - DNA, 25 bp, E. coli
gcccatattactacacatgtcgatg

SEQ ID NO: 95142 - DNA, 25 bp, E. coli
gcccatattacttcacatgtcgatg

SEQ ID NO: 95143 - DNA, 25 bp, E. coli
gcaaatgtctttttccggagccatt

SEQ ID NO: 95144 - DNA, 25 bp, E. coli
gaagaggttcttatcgactggatgt

SEQ ID NO: 95145 - DNA, 25 bp, E. coli
gcaaatgtctttatccggagccatt

SEQ ID NO: 95146 - DNA, 25 bp, E. coli
gaagaggttcttttcgactggatgt

SEQ ID NO: 95147 - DNA, 25 bp, E. coli
caacgattcgttatcagtgcaggaa

SEQ ID NO: 95148 - DNA, 25 bp, E. coli
caacgattcgttttcagtgcaggaa

SEQ ID NO: 95149 - DNA, 25 bp, E. coli
cgtcataaaaatcaggccccttgta

SEQ ID NO: 95150 - DNA, 25 bp, E. coli
cagaggtaacctaaacgaaggctga

SEQ ID NO: 95151 - DNA, 25 bp, E. coli
catgcaagcattcaccgccggttta

SEQ ID NO: 95152 - DNA, 25 bp, E. coli
catgcaagcattgaccgccggttta

SEQ ID NO: 95153 - DNA, 25 bp, E. coli
cagaggtaaccttaacgaaggctga

SEQ ID NO: 95154 - DNA, 25 bp, E. coli
cgtcataaaaatgaggccccttgta

SEQ ID NO: 95155 - DNA, 25 bp, E. coli
taaaattattccgagtacggccata

SEQ ID NO: 95156 - DNA, 25 bp, E. coli
tattacccagcaatatttgcctccg

SEQ ID NO: 95157 - DNA, 25 bp, E. coli
tattacccagcattatttgcctccg

SEQ ID NO: 95158 - DNA, 25 bp, E. coli
ccatttgtggctcaaatacgcggcc

SEQ ID NO: 95159 - DNA, 25 bp, E. coli
ccatttgtggctgaaatacgcggcc

SEQ ID NO: 95160 - DNA, 25 bp, E. coli
gaaaactgatgctactgtgtcaacg

SEQ ID NO: 95161 - DNA, 25 bp, E. coli
gaaaactgatgcaactgtgtcaacg

SEQ ID NO: 95162 - DNA, 25 bp, E. coli
cgttcattagtcatcccatttgtgg

SEQ ID NO: 95163 - DNA, 25 bp, E. coli
gccggttaggtgagggattatctcc

SEQ ID NO: 95164 - DNA, 25 bp, E. coli
cgttcattagtcttcccatttgtgg

SEQ ID NO: 95165 - DNA, 25 bp, E. coli
gccggttaggtgtgggattatctcc

SEQ ID NO: 95166 - DNA, 25 bp, E. coli
ggaaaatgcctgatagcgtaaaagc

SEQ ID NO: 95167 - DNA, 25 bp, E. coli
ggaaaatgcctgttagcgtaaaagc

SEQ ID NO: 95168 - DNA, 25 bp, E. coli
taaaattattcccagtacggccata

SEQ ID NO: 95169 - DNA, 25 bp, E. coli
taccggttcatacctacctggctga

SEQ ID NO: 95170 - DNA, 25 bp, E. coli
taccggttcatagctacctggctga

SEQ ID NO: 95171 - DNA, 25 bp, E. coli
tatctcggagtggtcgtggatatcg

SEQ ID NO: 95172 - DNA, 25 bp, E. coli
tatctcggagtgctcgtggatatcg

SEQ ID NO: 95173 - DNA, 25 bp, E. coli
tgaaccgtcgcctgatgagctggcg

SEQ ID NO: 95174 - DNA, 25 bp, E. coli
tgaaccgtcgccagatgagctggcg

SEQ ID NO: 95175 - DNA, 25 bp, E. coli
gctgaagcccagctaagtagcgaat

SEQ ID NO: 95176 - DNA, 25 bp, E. coli
gctgaagcccaggtaagtagcgaat

SEQ ID NO: 95177 - DNA, 25 bp, E. coli
gaacatcctgaacagccatccatgg

SEQ ID NO: 95178 - DNA, 25 bp, E. coli
gaacatcctgaagagccatccatgg

SEQ ID NO: 95179 - DNA, 25 bp, E. coli
cattccctgttaggttatctcggag

SEQ ID NO: 95180 - DNA, 25 bp, E. coli
cattccctgttacgttatctcggag

SEQ ID NO: 95181 - DNA, 25 bp, E. coli
gatatcgacccggtttattcgctct

SEQ ID NO: 95182 - DNA, 25 bp, E. coli
gtagcgaattgctggatgaacatcc

SEQ ID NO: 95183 - DNA, 25 bp, E. coli
gattgccagcaatttcggtatcggc

SEQ ID NO: 95184 - DNA, 25 bp, E. coli
gatatcgacccgctttattcgctct

SEQ ID NO: 95185 - DNA, 25 bp, E. coli
gtagcgaattgcaggatgaacatcc

SEQ ID NO: 95186 - DNA, 25 bp, E. coli
gattgccagcaaattcggtatcggc

SEQ ID NO: 95187 - DNA, 25 bp, E. coli
gtgaatgacgaggttcgcgccgctc

SEQ ID NO: 95188 - DNA, 25 bp, E. coli
gtgaatgacgagcttcgcgccgctc

SEQ ID NO: 95189 - DNA, 25 bp, E. coli
tggcgcagaccaaccgcaaacaact

SEQ ID NO: 95190 - DNA, 25 bp, E. coli
tggcgcagaccatccgcaaacaact

SEQ ID NO: 95191 - DNA, 25 bp, E. coli
catttaaatactatacgacagcgac

SEQ ID NO: 95192 - DNA, 25 bp, E. coli
catttaaatactttacgacagcgac

SEQ ID NO: 95193 - DNA, 25 bp, E. coli
tactatacgacagcgacatttatcg

SEQ ID NO: 95194 - DNA, 25 bp, E. coli
tactatacgacaccgacatttatcg

SEQ ID NO: 95195 - DNA, 25 bp, E. coli
tgctgccgctgtttcccgacatcag

SEQ ID NO: 95196 - DNA, 25 bp, E. coli
tgctgccgctgtatcccgacatcag

SEQ ID NO: 95197 - DNA, 25 bp, E. coli
ccggaaattattccgattgctatcg

SEQ ID NO: 95198 - DNA, 25 bp, E. coli
ccggaaattattgcgattgctatcg

SEQ ID NO: 95199 - DNA, 25 bp, E. coli
gcggcgctacgctcaatgaaacatt

SEQ ID NO: 95200 - DNA, 25 bp, E. coli
gctctggcgggctcattcctgctgt

SEQ ID NO: 95201 - DNA, 25 bp, E. coli
gcggcgctacgcacaatgaaacatt

SEQ ID NO: 95202 - DNA, 25 bp, E. coli
gctctggcgggcacattcctgctgt

SEQ ID NO: 95203 - DNA, 25 bp, E. coli
gctgtatcccgacatcagcccggaa

SEQ ID NO: 95204 - DNA, 25 bp, E. coli
gctgtatcccgagatcagcccggaa

SEQ ID NO: 95205 - DNA, 25 bp, E. coli
gacagcgacattaatcgcttcagtc

SEQ ID NO: 95206 - DNA, 25 bp, E. coli
gacagcgacatttatcgcttcagtc

SEQ ID NO: 95207 - DNA, 25 bp, E. coli
gacatcagcccggaaattattgcga

SEQ ID NO: 95208 - DNA, 25 bp, E. coli
gacatcagcccgcaaattattgcga

SEQ ID NO: 95209 - DNA, 25 bp, E. coli
gtgaagcaatatagcggcgctacgc

SEQ ID NO: 95210 - DNA, 25 bp, E. coli
gtgaagcaatattgcggcgctacgc

SEQ ID NO: 95211 - DNA, 25 bp, E. coli
ggcacattcctggtgtcatttatca

SEQ ID NO: 95212 - DNA, 25 bp, E. coli
ggcacattcctgctgtcatttatca

SEQ ID NO: 95213 - DNA, 25 bp, E. coli
aaccgcgagctgtatctcacctggc

SEQ ID NO: 95214 - DNA, 25 bp, E. coli
aaccgcgagctgaatctcacctggc

SEQ ID NO: 95215 - DNA, 25 bp, E. coli
tacgcggcctgaacataacccgatc

SEQ ID NO: 95216 - DNA, 25 bp, E. coli
tagccccacgccagatgatgaatct

SEQ ID NO: 95217 - DNA, 25 bp, E. coli
tagccccacgcctgatgatgaatct

SEQ ID NO: 95218 - DNA, 25 bp, E. coli
tacgcggcctgatcataacccgatc

SEQ ID NO: 95219 - DNA, 25 bp, E. coli
ttaatcctttcctgatagccccacg

SEQ ID NO: 95220 - DNA, 25 bp, E. coli
ttaatcctttccagatagccccacg

SEQ ID NO: 95221 - DNA, 25 bp, E. coli
tgatcataaccccatcgtcgccggt

SEQ ID NO: 95222 - DNA, 25 bp, E. coli
tgatcataacccgatcgtcgccggt

SEQ ID NO: 95223 - DNA, 25 bp, E. coli
gctgaatctcacctggcaaaatacg

SEQ ID NO: 95224 - DNA, 25 bp, E. coli
gctgaatctcacgtggcaaaatacg

SEQ ID NO: 95225 - DNA, 25 bp, E. coli
gcgcacgacattgtggtgtgagttc

SEQ ID NO: 95226 - DNA, 25 bp, E. coli
gcgcacgacattctggtgtgagttc

SEQ ID NO: 95227 - DNA, 25 bp, E. coli
gcactggcggtagtgcaatcgaaag

SEQ ID NO: 95228 - DNA, 25 bp, E. coli
gcactggcggtactgcaatcgaaag

SEQ ID NO: 95229 - DNA, 25 bp, E. coli
gaaaaaactgctccgcacgacattg

SEQ ID NO: 95230 - DNA, 25 bp, E. coli
gaaaaaactgctgcgcacgacattg

SEQ ID NO: 95231 - DNA, 25 bp, E. coli
ctgatgggcggcagtatgctgctct

SEQ ID NO: 95232 - DNA, 25 bp, E. coli
ctgatgggcggctgtatgctgctct

SEQ ID NO: 95233 - DNA, 25 bp, E. coli
gggctgcgaccataccgcctgttgt

SEQ ID NO: 95234 - DNA, 25 bp, E. coli
gggctgcgaccaaaccgcctgttgt

SEQ ID NO: 95235 - DNA, 25 bp, E. coli
tagtgactgtacctaccaccgagcc

SEQ ID NO: 95236 - DNA, 25 bp, E. coli
tagtgactgtacgtaccaccgagcc

SEQ ID NO: 95237 - DNA, 25 bp, E. coli
ttctggagcagatgagtaccaccgc

SEQ ID NO: 95238 - DNA, 25 bp, E. coli
ttcattcccggaggccattcagtgg

SEQ ID NO: 95239 - DNA, 25 bp, E. coli
ttttgaaaccctagaagcgggctgg

SEQ ID NO: 95240 - DNA, 25 bp, E. coli
ttcattcccggacgccattcagtgg

SEQ ID NO: 95241 - DNA, 25 bp, E. coli
ttttgaaacccttgaagcgggctgg

SEQ ID NO: 95242 - DNA, 25 bp, E. coli
ttctggagcagaagagtaccaccgc

SEQ ID NO: 95243 - DNA, 25 bp, E. coli
tcaccattaatgtcacgccggtaag

SEQ ID NO: 95244 - DNA, 25 bp, E. coli
tcaccattaatgacacgccggtaag

SEQ ID NO: 95245 - DNA, 25 bp, E. coli
gcgataaggtgtgcgccctggaaaa

SEQ ID NO: 95246 - DNA, 25 bp, E. coli
gcgataaggtgtccgccctggaaaa

SEQ ID NO: 95247 - DNA, 25 bp, E. coli
cgctcgaacggctggtgatgacact

SEQ ID NO: 95248 - DNA, 25 bp, E. coli
cgctcgaacggcaggtgatgacact

SEQ ID NO: 95249 - DNA, 25 bp, E. coli
taaccgtgacttaagcgaagcgctc

SEQ ID NO: 95250 - DNA, 25 bp, E. coli
taaccgtgactttagcgaagcgctc

SEQ ID NO: 95251 - DNA, 25 bp, E. coli
gaccgtgggaaatctgctggatcag

SEQ ID NO: 95252 - DNA, 25 bp, E. coli
gacgatctgggagctaaactggctg

SEQ ID NO: 95253 - DNA, 25 bp, E. coli
gacgatctgggacctaaactggctg

SEQ ID NO: 95254 - DNA, 25 bp, E. coli
gacgcttcgtgaagccagactggca

SEQ ID NO: 95255 - DNA, 25 bp, E. coli
gaccgtgggaaaactgctggatcag

SEQ ID NO: 95256 - DNA, 25 bp, E. coli
gacgcttcgtgatgccagactggca

SEQ ID NO: 95257 - DNA, 25 bp, E. coli
caatatggcggtcaccggcttttac

SEQ ID NO: 95258 - DNA, 25 bp, E. coli
caatatggcggtgaccggcttttac

SEQ ID NO: 95259 - DNA, 25 bp, E. coli
agattatttccgcatgtcgccggag

SEQ ID NO: 95260 - DNA, 25 bp, E. coli
atatggcggtcagcggcttttaccg

SEQ ID NO: 95261 - DNA, 25 bp, E. coli
atatggcggtcaccggcttttaccg

SEQ ID NO: 95262 - DNA, 25 bp, E. coli
agattatttccggatgtcgccggag

SEQ ID NO: 95263 - DNA, 25 bp, E. coli
tagcaatatattggcgcacgcccgg

SEQ ID NO: 95264 - DNA, 25 bp, E. coli
tagcaatatattcgcgcacgcccgg

SEQ ID NO: 95265 - DNA, 25 bp, E. coli
tatagcaatatattggcgcacgccc

SEQ ID NO: 95266 - DNA, 25 bp, E. coli
tatagcaatataatggcgcacgccc

SEQ ID NO: 95267 - DNA, 25 bp, E. coli
tgctctatagcaatatattggcgca

SEQ ID NO: 95268 - DNA, 25 bp, E. coli
tgctctatagcattatattggcgca

SEQ ID NO: 95269 - DNA, 25 bp, E. coli
tctatagcaatatattggcgcacgc

SEQ ID NO: 95270 - DNA, 25 bp, E. coli
tctatagcaataaattggcgcacgc

SEQ ID NO: 95271 - DNA, 25 bp, E. coli
gctctatagcaatatattggcgcac

SEQ ID NO: 95272 - DNA, 25 bp, E. coli
gctctatagcaaaatattggcgcac

SEQ ID NO: 95273 - DNA, 25 bp, E. coli
gacaatatggcgctcaccggctttt

SEQ ID NO: 95274 - DNA, 25 bp, E. coli
gacaatatggcggtcaccggctttt

SEQ ID NO: 95275 - DNA, 25 bp, E. coli
cggaagattatttccggatgtcgcc

SEQ ID NO: 95276 - DNA, 25 bp, E. coli
cggaagattattaccggatgtcgcc

SEQ ID NO: 95277 - DNA, 25 bp, E. coli
ggaagattatttgcggatgtcgccg

SEQ ID NO: 95278 - DNA, 25 bp, E. coli
ggaagattatttccggatgtcgccg

SEQ ID NO: 95279 - DNA, 25 bp, E. coli
cacgctggtgcaatttccggcctgg

SEQ ID NO: 95280 - DNA, 25 bp, E. coli
cacgctggtgcattttccggcctgg

SEQ ID NO: 95281 - DNA, 25 bp, E. coli
cataccaaagctgactgcaccggtg

SEQ ID NO: 95282 - DNA, 25 bp, E. coli
cataccaaagctcactgcaccggtg

SEQ ID NO: 95283 - DNA, 25 bp, E. coli
actggccggaatcattgaacaggcc

SEQ ID NO: 95284 - DNA, 25 bp, E. coli
actggccggaatgattgaacaggcc

SEQ ID NO: 95285 - DNA, 25 bp, E. coli
tgaaccatacggtgatttaaccatg

SEQ ID NO: 95286 - DNA, 25 bp, E. coli
tgaaccatacggagatttaaccatg

SEQ ID NO: 95287 - DNA, 25 bp, E. coli
gctggtgcatttaccggcctggccg

SEQ ID NO: 95288 - DNA, 25 bp, E. coli
gctggtgcattttccggcctggccg

SEQ ID NO: 95289 - DNA, 25 bp, E. coli
gaatgattgaacaggcctggtgcag

SEQ ID NO: 95290 - DNA, 25 bp, E. coli
gaatgattgaactggcctggtgcag

SEQ ID NO: 95291 - DNA, 25 bp, E. coli
cggagatttaaccatgacctacaaa

SEQ ID NO: 95292 - DNA, 25 bp, E. coli
cggagatttaacgatgacctacaaa

SEQ ID NO: 95293 - DNA, 25 bp, E. coli
ggatgccatgccacgctggtgcatt

SEQ ID NO: 95294 - DNA, 25 bp, E. coli
gtggatgccggatgccatgccacgc

SEQ ID NO: 95295 - DNA, 25 bp, E. coli
gtggctattccgaatgaaccatacg

SEQ ID NO: 95296 - DNA, 25 bp, E. coli
gtggatgccggaagccatgccacgc

SEQ ID NO: 95297 - DNA, 25 bp, E. coli
ggatgccatgcctcgctggtgcatt

SEQ ID NO: 95298 - DNA, 25 bp, E. coli
gtggctattccgtatgaaccatacg

SEQ ID NO: 95299 - DNA, 25 bp, E. coli
tggcgaaggagcttaccaaagctca

SEQ ID NO: 95300 - DNA, 25 bp, E. coli
tggcgaaggagcataccaaagctca

SEQ ID NO: 95301 - DNA, 25 bp, E. coli
taaaggcgaaaagattctgtcttcc

SEQ ID NO: 95302 - DNA, 25 bp, E. coli
taaaggcgaaaacattctgtcttcc

SEQ ID NO: 95303 - DNA, 25 bp, E. coli
aacattctgtctacctgtccgtcga

SEQ ID NO: 95304 - DNA, 25 bp, E. coli
aacattctgtcttcctgtccgtcga

SEQ ID NO: 95305 - DNA, 25 bp, E. coli
tgtgtaaaggcgtaaacattctgtc

SEQ ID NO: 95306 - DNA, 25 bp, E. coli
tgtgtaaaggcgaaaacattctgtc

SEQ ID NO: 95307 - DNA, 25 bp, E. coli
tgtcgagccatcaggaacgcagttc

SEQ ID NO: 95308 - DNA, 25 bp, E. coli
tgtcgagccatctggaacgcagttc

SEQ ID NO: 95309 - DNA, 25 bp, E. coli
tctgtcttcctgaccgtcgatatcg

SEQ ID NO: 95310 - DNA, 25 bp, E. coli
tctgtcttcctgtccgtcgatatcg

SEQ ID NO: 95311 - DNA, 25 bp, E. coli
tcctgtccgtcgttatcggttgcag

SEQ ID NO: 95312 - DNA, 25 bp, E. coli
tcctgtccgtcgatatcggttgcag

SEQ ID NO: 95313 - DNA, 25 bp, E. coli
gtccgtcgatatgggttgcaggtct

SEQ ID NO: 95314 - DNA, 25 bp, E. coli
gtccgtcgatatcggttgcaggtct

SEQ ID NO: 95315 - DNA, 25 bp, E. coli
cgatctggtgtgaaaaggcgaaaac

SEQ ID NO: 95316 - DNA, 25 bp, E. coli
ccccggtttgcgttctggtgtgtaa

SEQ ID NO: 95317 - DNA, 25 bp, E. coli
ccccggtttgcgatctggtgtgtaa

SEQ ID NO: 95318 - DNA, 25 bp, E. coli
cgatctggtgtgtaaaggcgaaaac

SEQ ID NO: 95319 - DNA, 25 bp, E. coli
taatggcctgtccagccatcaggaa

SEQ ID NO: 95320 - DNA, 25 bp, E. coli
taatggcctgtcgagccatcaggaa

SEQ ID NO: 95321 - DNA, 25 bp, E. coli
gagccatcaggaacgcagttcaccc

SEQ ID NO: 95322 - DNA, 25 bp, E. coli
gagccatcaggatcgcagttcaccc

SEQ ID NO: 95323 - DNA, 25 bp, E. coli
aaaactgtcgccgtatgatgcagcc

SEQ ID NO: 95324 - DNA, 25 bp, E. coli
aaagcggtcggctttgaggtcacgt

SEQ ID NO: 95325 - DNA, 25 bp, E. coli
actgtcgccgtaagatgcagcctgt

SEQ ID NO: 95326 - DNA, 25 bp, E. coli
actgtcgccgtatgatgcagcctgt

SEQ ID NO: 95327 - DNA, 25 bp, E. coli
aaagcggtcggcattgaggtcacgt

SEQ ID NO: 95328 - DNA, 25 bp, E. coli
aaaactgtcgccctatgatgcagcc

SEQ ID NO: 95329 - DNA, 25 bp, E. coli
ttgaggtcacgtagttggcccagga

SEQ ID NO: 95330 - DNA, 25 bp, E. coli
ttgcttgggcaaaaactgtcgccgt

SEQ ID NO: 95331 - DNA, 25 bp, E. coli
ttgaggtcacgttgttggcccagga

SEQ ID NO: 95332 - DNA, 25 bp, E. coli
ttgcttgggcaataactgtcgccgt

SEQ ID NO: 95333 - DNA, 25 bp, E. coli
gcgactggccaaagcggtcggcatt

SEQ ID NO: 95334 - DNA, 25 bp, E. coli
gcgactggccaatgcggtcggcatt

SEQ ID NO: 95335 - DNA, 25 bp, E. coli
gcttgggcaaaatctgtcgccgtat

SEQ ID NO: 95336 - DNA, 25 bp, E. coli
gcttgggcaaaaactgtcgccgtat

SEQ ID NO: 95337 - DNA, 25 bp, E. coli
gcattgaggtcaggttgttggccca

SEQ ID NO: 95338 - DNA, 25 bp, E. coli
gcattgaggtcacgttgttggccca

SEQ ID NO: 95339 - DNA, 25 bp, E. coli
cggtcggcattgaggtcacgttgtt

SEQ ID NO: 95340 - DNA, 25 bp, E. coli
cggtcggcattgtggtcacgttgtt

SEQ ID NO: 95341 - DNA, 25 bp, E. coli
ggtcacgttgttcgcccaggagagc

SEQ ID NO: 95342 - DNA, 25 bp, E. coli
ggtcacgttgttggcccaggagagc

SEQ ID NO: 95343 - DNA, 25 bp, E. coli
ggcaaaaactgtggccgtatgatgc

SEQ ID NO: 95344 - DNA, 25 bp, E. coli
ggcaaaaactgtcgccgtatgatgc

SEQ ID NO: 95345 - DNA, 25 bp, E. coli
caaagcaggtaaatccgttatgcca

SEQ ID NO: 95346 - DNA, 25 bp, E. coli
cactcaggctgaaataggtcgttat

SEQ ID NO: 95347 - DNA, 25 bp, E. coli
caaatgcgccggagttgattcatga

SEQ ID NO: 95348 - DNA, 25 bp, E. coli
cactcaggctgatataggtcgttat

SEQ ID NO: 95349 - DNA, 25 bp, E. coli
caaatgcgccggtgttgattcatga

SEQ ID NO: 95350 - DNA, 25 bp, E. coli
caaagcaggtaattccgttatgcca

SEQ ID NO: 95351 - DNA, 25 bp, E. coli
gcaatggtttagctttggcgttccc

SEQ ID NO: 95352 - DNA, 25 bp, E. coli
gcaatggtttaggtttggcgttccc

SEQ ID NO: 95353 - DNA, 25 bp, E. coli
aaattaggcagaaatacactcaggc

SEQ ID NO: 95354 - DNA, 25 bp, E. coli
aaattaggcagatatacactcaggc

SEQ ID NO: 95355 - DNA, 25 bp, E. coli
gaagtgggaagtaaccccgcatgaa

SEQ ID NO: 95356 - DNA, 25 bp, E. coli
gaagtgggaagttaccccgcatgaa

SEQ ID NO: 95357 - DNA, 25 bp, E. coli
cccgcatgaaatgcgcccagatatt

SEQ ID NO: 95358 - DNA, 25 bp, E. coli
cgttatgccaactaatgaagtggga

SEQ ID NO: 95359 - DNA, 25 bp, E. coli
cgttatgccaacaaatgaagtggga

SEQ ID NO: 95360 - DNA, 25 bp, E. coli
cccgcatgaaatccgcccagatatt

SEQ ID NO: 95361 - DNA, 25 bp, E. coli
gatatttatccttacccaaccgacg

SEQ ID NO: 95362 - DNA, 25 bp, E. coli
gatatttatcctaacccaaccgacg

SEQ ID NO: 95363 - DNA, 25 bp, E. coli
gatagcactcgccaaaaaattaggc

SEQ ID NO: 95364 - DNA, 25 bp, E. coli
gatagcactcgcgaaaaaattaggc

SEQ ID NO: 95365 - DNA, 25 bp, E. coli
taaggttaacacttcaaatgcgccg

SEQ ID NO: 95366 - DNA, 25 bp, E. coli
taaggttaacacatcaaatgcgccg

SEQ ID NO: 95367 - DNA, 25 bp, E. coli
tatcaaaggcccttggggatcggct

SEQ ID NO: 95368 - DNA, 25 bp, E. coli
tatcaaaggcccatggggatcggct

SEQ ID NO: 95369 - DNA, 25 bp, E. coli
tgtgggcctgtgataattagtggtt

SEQ ID NO: 95370 - DNA, 25 bp, E. coli
tgtgggcctgtgttaattagtggtt

SEQ ID NO: 95371 - DNA, 25 bp, E. coli
cctgtgttaattagtggttattcgc

SEQ ID NO: 95372 - DNA, 25 bp, E. coli
cctgtgttaatttgtggttattcgc

SEQ ID NO: 95373 - DNA, 25 bp, E. coli
gcctgtgttaataagtggttattcg

SEQ ID NO: 95374 - DNA, 25 bp, E. coli
gcctgtgttaattagtggttattcg

SEQ ID NO: 95375 - DNA, 25 bp, E. coli
ctgtgggcctgtgttaattagtggt

SEQ ID NO: 95376 - DNA, 25 bp, E. coli
cggctgtgggccagtgttaattagt

SEQ ID NO: 95377 - DNA, 25 bp, E. coli
cggctgtgggcctgtgttaattagt

SEQ ID NO: 95378 - DNA, 25 bp, E. coli
ctgtgggcctgtcttaattagtggt

SEQ ID NO: 95379 - DNA, 25 bp, E. coli
gtgggcctgtgtaaattagtggtta

SEQ ID NO: 95380 - DNA, 25 bp, E. coli
gtgggcctgtgttaattagtggtta

SEQ ID NO: 95381 - DNA, 25 bp, E. coli
tgggcctgtgttaattagtggttat

SEQ ID NO: 95382 - DNA, 25 bp, E. coli
tggcttgttcatccaaaccttctaa

SEQ ID NO: 95383 - DNA, 25 bp, E. coli
ggcttgttcatgcaaaccttctaat

SEQ ID NO: 95384 - DNA, 25 bp, E. coli
ggcctgtgttaattagtggttattc

SEQ ID NO: 95385 - DNA, 25 bp, E. coli
ggcttgttcatggaaaccttctaat

SEQ ID NO: 95386 - DNA, 25 bp, E. coli
tggcttgttcatgcaaaccttctaa

SEQ ID NO: 95387 - DNA, 25 bp, E. coli
ggcctgtgttaaatagtggttattc

SEQ ID NO: 95388 - DNA, 25 bp, E. coli
tgggcctgtgtttattagtggttat

SEQ ID NO: 95389 - DNA, 25 bp, E. coli
cagttctggtatacgtttccctgtg

SEQ ID NO: 95390 - DNA, 25 bp, E. coli
cagtaactggcgattgtattgtggc

SEQ ID NO: 95391 - DNA, 25 bp, E. coli
cagttctggtattcgtttccctgtg

SEQ ID NO: 95392 - DNA, 25 bp, E. coli
cagtaactggcgtttgtattgtggc

SEQ ID NO: 95393 - DNA, 25 bp, E. coli
tacgtttccctgtgtatctgcactg

SEQ ID NO: 95394 - DNA, 25 bp, E. coli
tacgtttccctgagtatctgcactg

SEQ ID NO: 95395 - DNA, 25 bp, E. coli
tgtatctgcactggttcagcaaggt

SEQ ID NO: 95396 - DNA, 25 bp, E. coli
tgtatctgcactcgttcagcaaggt

SEQ ID NO: 95397 - DNA, 25 bp, E. coli
tccctgtgtatcagcactggttcag

SEQ ID NO: 95398 - DNA, 25 bp, E. coli
tccctgtgtatctgcactggttcag

SEQ ID NO: 95399 - DNA, 25 bp, E. coli
gacagactgcctcgtcattccattc

SEQ ID NO: 95400 - DNA, 25 bp, E. coli
gacagactgcctggtcattccattc

SEQ ID NO: 95401 - DNA, 25 bp, E. coli
cgtttgtattgtcgcagttctggta

SEQ ID NO: 95402 - DNA, 25 bp, E. coli
cgtttgtattgtggcagttctggta

SEQ ID NO: 95403 - DNA, 25 bp, E. coli
cattccattcgtttcgccagtaact

SEQ ID NO: 95404 - DNA, 25 bp, E. coli
cattcgtatcgcgagtaactggcgt

SEQ ID NO: 95405 - DNA, 25 bp, E. coli
cattccattcgtatcgccagtaact

SEQ ID NO: 95406 - DNA, 25 bp, E. coli
cattcgtatcgccagtaactggcgt

SEQ ID NO: 95407 - DNA, 25 bp, E. coli
gtggcagttctgctatacgtttccc

SEQ ID NO: 95408 - DNA, 25 bp, E. coli
gtggcagttctggtatacgtttccc

SEQ ID NO: 95409 - DNA, 25 bp, E. coli
ggctttctgacacactgcctcgtca

SEQ ID NO: 95410 - DNA, 25 bp, E. coli
ggctttctgacagactgcctcgtca

SEQ ID NO: 95411 - DNA, 25 bp, E. coli
aagcctcagcgaccgaatatatcgg

SEQ ID NO: 95412 - DNA, 25 bp, E. coli
aagcctcagcgagcgaatatatcgg

SEQ ID NO: 95413 - DNA, 25 bp, E. coli
aaagcggccttttactccctgcaag

SEQ ID NO: 95414 - DNA, 25 bp, E. coli
aaagcggcctttaactccctgcaag

SEQ ID NO: 95415 - DNA, 25 bp, E. coli
ttagtcctcaaagcctctgtagccg

SEQ ID NO: 95416 - DNA, 25 bp, E. coli
tatcaagctgtttaagaaattcacc

SEQ ID NO: 95417 - DNA, 25 bp, E. coli
tatcaagctgttaaagaaattcacc

SEQ ID NO: 95418 - DNA, 25 bp, E. coli
ttagtcctcaaaccctctgtagccg

SEQ ID NO: 95419 - DNA, 25 bp, E. coli
tttcgctgctgagggtgacgatccc

SEQ ID NO: 95420 - DNA, 25 bp, E. coli
tttcgctgctgacggtgacgatccc

SEQ ID NO: 95421 - DNA, 25 bp, E. coli
tgacgatcccgctaaagcggccttt

SEQ ID NO: 95422 - DNA, 25 bp, E. coli
tgacgatcccgcaaaagcggccttt

SEQ ID NO: 95423 - DNA, 25 bp, E. coli
tccgatgctgtctttcgctgctgag

SEQ ID NO: 95424 - DNA, 25 bp, E. coli
tccgatgctgtcattcgctgctgag

SEQ ID NO: 95425 - DNA, 25 bp, E. coli
tcggcgcaactaacggtatcaagct

SEQ ID NO: 95426 - DNA, 25 bp, E. coli
tcggcgcaactatcggtatcaagct

SEQ ID NO: 95427 - DNA, 25 bp, E. coli
gaaattcacctcgaaagcaagctga

SEQ ID NO: 95428 - DNA, 25 bp, E. coli
gaaattcacctccaaagcaagctga

SEQ ID NO: 95429 - DNA, 25 bp, E. coli
cgatggttgttgtcattgtcggcgc

SEQ ID NO: 95430 - DNA, 25 bp, E. coli
cgatggttgttgacattgtcggcgc

SEQ ID NO: 95431 - DNA, 25 bp, E. coli
gtagccgttgctaccctcgttccga

SEQ ID NO: 95432 - DNA, 25 bp, E. coli
gtagccgttgcttccctcgttccga

SEQ ID NO: 95433 - DNA, 25 bp, E. coli
tacgctatttgtggtgtattgcgcg

SEQ ID NO: 95434 - DNA, 25 bp, E. coli
aggcgctctccaattaccccataag

SEQ ID NO: 95435 - DNA, 25 bp, E. coli
aggcgctctccatttaccccataag

SEQ ID NO: 95436 - DNA, 25 bp, E. coli
tacgctatttgtcgtgtattgcgcg

SEQ ID NO: 95437 - DNA, 25 bp, E. coli
ttaccacagcgaagccagaagttgc

SEQ ID NO: 95438 - DNA, 25 bp, E. coli
ttaccccataaggaaatgaccgcag

SEQ ID NO: 95439 - DNA, 25 bp, E. coli
ttaccacagcgatgccagaagttgc

SEQ ID NO: 95440 - DNA, 25 bp, E. coli
ttaccccataagcaaatgaccgcag

SEQ ID NO: 95441 - DNA, 25 bp, E. coli
tgtcgaaacagaatgcgccgatgtt

SEQ ID NO: 95442 - DNA, 25 bp, E. coli
tgtcgaaacagattgcgccgatgtt

SEQ ID NO: 95443 - DNA, 25 bp, E. coli
tgaccgcagaaacaatggccgaatg

SEQ ID NO: 95444 - DNA, 25 bp, E. coli
tgaccgcagaaagaatggccgaatg

SEQ ID NO: 95445 - DNA, 25 bp, E. coli
tctcgcgcgcttcagtgtcgaaaca

SEQ ID NO: 95446 - DNA, 25 bp, E. coli
tctcgcgcgcttgagtgtcgaaaca

SEQ ID NO: 95447 - DNA, 25 bp, E. coli
ccagaagttgctgaggcgcattttc

SEQ ID NO: 95448 - DNA, 25 bp, E. coli
ccagaagttgctcaggcgcattttc

SEQ ID NO: 95449 - DNA, 25 bp, E. coli
gaatggcccgacgatacgctatttg

SEQ ID NO: 95450 - DNA, 25 bp, E. coli
gaatggcccgaccatacgctatttg

SEQ ID NO: 95451 - DNA, 25 bp, E. coli
gactctctggcttatattggcgatg

SEQ ID NO: 95452 - DNA, 25 bp, E. coli
gactctctggctaatattggcgatg

SEQ ID NO: 95453 - DNA, 25 bp, E. coli
ggccacattgtatcggtgcagaccg

SEQ ID NO: 95454 - DNA, 25 bp, E. coli
ggccacattgtaacggtgcagaccg

SEQ ID NO: 95455 - DNA, 25 bp, E. coli
catctgccgtggtgccacccgggtg

SEQ ID NO: 95456 - DNA, 25 bp, E. coli
catctgccgtggagccacccgggtg

SEQ ID NO: 95457 - DNA, 25 bp, E. coli
agctgtcgaagggtaagcgtacagc

SEQ ID NO: 95458 - DNA, 25 bp, E. coli
agctgtcgaaggctaagcgtacagc

SEQ ID NO: 95459 - DNA, 25 bp, E. coli
aagctgtcgaagggtaagcgtacag

SEQ ID NO: 95460 - DNA, 25 bp, E. coli
aagctgtcgaagcgtaagcgtacag

SEQ ID NO: 95461 - DNA, 25 bp, E. coli
tgtcgaagggtaagcgtacagcctg

SEQ ID NO: 95462 - DNA, 25 bp, E. coli
tgaagctgtcgaagggtaagcgtac

SEQ ID NO: 95463 - DNA, 25 bp, E. coli
tgaagctgtcgatgggtaagcgtac

SEQ ID NO: 95464 - DNA, 25 bp, E. coli
tgtcgaagggtatgcgtacagcctg

SEQ ID NO: 95465 - DNA, 25 bp, E. coli
tgcaggggcgtcagcgcctgaaatc

SEQ ID NO: 95466 - DNA, 25 bp, E. coli
tgcaggggcgtctgcgcctgaaatc

SEQ ID NO: 95467 - DNA, 25 bp, E. coli
gctgtcgaagggtaagcgtacagcc

SEQ ID NO: 95468 - DNA, 25 bp, E. coli
gctgtcgaagggaaagcgtacagcc

SEQ ID NO: 95469 - DNA, 25 bp, E. coli
gaagctgtcgaacggtaagcgtaca

SEQ ID NO: 95470 - DNA, 25 bp, E. coli
gaagctgtcgaagggtaagcgtaca

SEQ ID NO: 95471 - DNA, 25 bp, E. coli
ctgtcgaagggttagcgtacagcct

SEQ ID NO: 95472 - DNA, 25 bp, E. coli
ctgtcgaagggtaagcgtacagcct

SEQ ID NO: 95473 - DNA, 25 bp, E. coli
gtcgaagggtaagcgtacagcctga

SEQ ID NO: 95474 - DNA, 25 bp, E. coli
gtcgaagggtaaccgtacagcctga

SEQ ID NO: 95475 - DNA, 25 bp, E. coli
gatggtaagcctgtgattcctggca

SEQ ID NO: 95476 - DNA, 25 bp, E. coli
gatggtaagcctctgattcctggca

SEQ ID NO: 95477 - DNA, 25 bp, E. coli
caaaaactgattcccaaccgcgagc

SEQ ID NO: 95478 - DNA, 25 bp, E. coli
caaaaactgattgccaaccgcgagc

SEQ ID NO: 95479 - DNA, 25 bp, E. coli
tagggctggcaatgagttactggca

SEQ ID NO: 95480 - DNA, 25 bp, E. coli
tagggctggcaaagagttactggca

SEQ ID NO: 95481 - DNA, 25 bp, E. coli
tatacccatctaccgcaagtggtgc

SEQ ID NO: 95482 - DNA, 25 bp, E. coli
tatacccatctagcgcaagtggtgc

SEQ ID NO: 95483 - DNA, 25 bp, E. coli
tggtgctgacgctgaatacgatgac

SEQ ID NO: 95484 - DNA, 25 bp, E. coli
tggtgctgacgcagaatacgatgac

SEQ ID NO: 95485 - DNA, 25 bp, E. coli
tgcgtacggatatgccaattggcgc

SEQ ID NO: 95486 - DNA, 25 bp, E. coli
tgcgtacggataagccaattggcgc

SEQ ID NO: 95487 - DNA, 25 bp, E. coli
gctgctctggcctacattatgggcg

SEQ ID NO: 95488 - DNA, 25 bp, E. coli
gctgctctggccaacattatgggcg

SEQ ID NO: 95489 - DNA, 25 bp, E. coli
gctggcgcgctgtttgtttatcaac

SEQ ID NO: 95490 - DNA, 25 bp, E. coli
gctggcgcgctgattgtttatcaac

SEQ ID NO: 95491 - DNA, 25 bp, E. coli
gaataagctgctggcgtttcatcgc

SEQ ID NO: 95492 - DNA, 25 bp, E. coli
gaataagctgctcgcgtttcatcgc

SEQ ID NO: 95493 - DNA, 25 bp, E. coli
cccgtttatgaaccggtatacccat

SEQ ID NO: 95494 - DNA, 25 bp, E. coli
cccgtttatgaagcggtatacccat

SEQ ID NO: 95495 - DNA, 25 bp, E. coli
cggtggcttacgacacgcagtatgc

SEQ ID NO: 95496 - DNA, 25 bp, E. coli
cggtggcttacgtcacgcagtatgc

SEQ ID NO: 95497 - DNA, 25 bp, E. coli
gatggtcatgtttagcgcacggcga

SEQ ID NO: 95498 - DNA, 25 bp, E. coli
gatggtcatgttaagcgcacggcga

SEQ ID NO: 95499 - DNA, 25 bp, E. coli
cagtctgaccgatgatggcattatc

SEQ ID NO: 95500 - DNA, 25 bp, E. coli
cagtctgaccgaagatggcattatc

SEQ ID NO: 95501 - DNA, 25 bp, E. coli
tactgacggcactggaaccagattt

SEQ ID NO: 95502 - DNA, 25 bp, E. coli
tactgacggcacaggaaccagattt

SEQ ID NO: 95503 - DNA, 25 bp, E. coli
tgatttttgcgataccgtcggtgga

SEQ ID NO: 95504 - DNA, 25 bp, E. coli
tgatttttgcgaaaccgtcggtgga

SEQ ID NO: 95505 - DNA, 25 bp, E. coli
tcgaaggaaccgtctttcgggccag

SEQ ID NO: 95506 - DNA, 25 bp, E. coli
tcgaaggaaccgactttcgggccag

SEQ ID NO: 95507 - DNA, 25 bp, E. coli
tgcgcacctgcgcacgattaatggt

SEQ ID NO: 95508 - DNA, 25 bp, E. coli
tgcgcacctgcggacgattaatggt

SEQ ID NO: 95509 - DNA, 25 bp, E. coli
tctttttccagatccgccagcggta

SEQ ID NO: 95510 - DNA, 25 bp, E. coli
tctttttccagaaccgccagcggta

SEQ ID NO: 95511 - DNA, 25 bp, E. coli
gccattcaaccgctgcgtaaagcat

SEQ ID NO: 95512 - DNA, 25 bp, E. coli
gccattcaaccggtgcgtaaagcat

SEQ ID NO: 95513 - DNA, 25 bp, E. coli
gacaggtacggatctgacgctggaa

SEQ ID NO: 95514 - DNA, 25 bp, E. coli
gacaggtacggaactgacgctggaa

SEQ ID NO: 95515 - DNA, 25 bp, E. coli
cgatagtcaggtggcacatcatgtg

SEQ ID NO: 95516 - DNA, 25 bp, E. coli
cgatagtcaggtcgcacatcatgtg

SEQ ID NO: 95517 - DNA, 25 bp, E. coli
gtcaccaccggagcagaacgcttta

SEQ ID NO: 95518 - DNA, 25 bp, E. coli
gtcaccaccggaccagaacgcttta

SEQ ID NO: 95519 - DNA, 25 bp, E. coli
ggaatcatctttatagccgccgtaa

SEQ ID NO: 95520 - DNA, 25 bp, E. coli
ggaatcatctttttagccgccgtaa

SEQ ID NO: 95521 - DNA, 25 bp, E. coli
atcactggcctgtgaccagacccgg

SEQ ID NO: 95522 - DNA, 25 bp, E. coli
attcccgtttcacggcagttaacat

SEQ ID NO: 95523 - DNA, 25 bp, E. coli
atcactggcctgagaccagacccgg

SEQ ID NO: 95524 - DNA, 25 bp, E. coli
attcccgtttcagggcagttaacat

SEQ ID NO: 95525 - DNA, 25 bp, E. coli
aaaaacgatcgcgctggacaccgcg

SEQ ID NO: 95526 - DNA, 25 bp, E. coli
aaaaacgatcgccctggacaccgcg

SEQ ID NO: 95527 - DNA, 25 bp, E. coli
tgaccagacccgcgggggatcatcc

SEQ ID NO: 95528 - DNA, 25 bp, E. coli
tgaccagacccgggggggatcatcc

SEQ ID NO: 95529 - DNA, 25 bp, E. coli
tctcacgcagagtaaaaattcccgt

SEQ ID NO: 95530 - DNA, 25 bp, E. coli
tctcacgcagagaaaaaattcccgt

SEQ ID NO: 95531 - DNA, 25 bp, E. coli
cctctcacgcagtgaaaaaattccc

SEQ ID NO: 95532 - DNA, 25 bp, E. coli
cctctcacgcagagaaaaaattccc

SEQ ID NO: 95533 - DNA, 25 bp, E. coli
ccgtttcagggctgttaacatgtta

SEQ ID NO: 95534 - DNA, 25 bp, E. coli
cccctctcacgctgagaaaaaattc

SEQ ID NO: 95535 - DNA, 25 bp, E. coli
cccctctcacgcagagaaaaaattc

SEQ ID NO: 95536 - DNA, 25 bp, E. coli
ccgtttcagggcagttaacatgtta

SEQ ID NO: 95537 - DNA, 25 bp, E. coli
cgtttcagggcacttaacatgttaa

SEQ ID NO: 95538 - DNA, 25 bp, E. coli
cgcagagaaaaatttcccgtttcag

SEQ ID NO: 95539 - DNA, 25 bp, E. coli
cgcagagaaaaaattcccgtttcag

SEQ ID NO: 95540 - DNA, 25 bp, E. coli
cgtttcagggcagttaacatgttaa

SEQ ID NO: 95541 - DNA, 25 bp, E. coli
tcacgcagagaataaattcccgttt

SEQ ID NO: 95542 - DNA, 25 bp, E. coli
tcacgcagagaaaaaattcccgttt

SEQ ID NO: 95543 - DNA, 25 bp, E. coli
acagcagatactgctccggcaggtc

SEQ ID NO: 95544 - DNA, 25 bp, E. coli
actcctccggcacgtcgattaagcg

SEQ ID NO: 95545 - DNA, 25 bp, E. coli
actcctccggcaggtcgattaagcg

SEQ ID NO: 95546 - DNA, 25 bp, E. coli
acagcagatactcctccggcaggtc

SEQ ID NO: 95547 - DNA, 25 bp, E. coli
ttgccaaacggctttatcgtattgg

SEQ ID NO: 95548 - DNA, 25 bp, E. coli
ttgccaaacggcattatcgtattgg

SEQ ID NO: 95549 - DNA, 25 bp, E. coli
tattggctatttcaatcagctgctc

SEQ ID NO: 95550 - DNA, 25 bp, E. coli
tattggctatttgaatcagctgctc

SEQ ID NO: 95551 - DNA, 25 bp, E. coli
tgcattagctcaccgagcttccctg

SEQ ID NO: 95552 - DNA, 25 bp, E. coli
tgcattagctcagcgagcttccctg

SEQ ID NO: 95553 - DNA, 25 bp, E. coli
tgcgggcaaaccacagcagatactc

SEQ ID NO: 95554 - DNA, 25 bp, E. coli
tgcgggcaaacctcagcagatactc

SEQ ID NO: 95555 - DNA, 25 bp, E. coli
cggcattatcgtattggctatttca

SEQ ID NO: 95556 - DNA, 25 bp, E. coli
cggcattatcgttttggctatttca

SEQ ID NO: 95557 - DNA, 25 bp, E. coli
gggaactcatctttgcgggcaaacc

SEQ ID NO: 95558 - DNA, 25 bp, E. coli
ggtcgattaagccacgccctttgta

SEQ ID NO: 95559 - DNA, 25 bp, E. coli
gggaactcatctatgcgggcaaacc

SEQ ID NO: 95560 - DNA, 25 bp, E. coli
ggtcgattaagcgacgccctttgta

SEQ ID NO: 95561 - DNA, 25 bp, E. coli
ggctggaccagtagcgtcagcccct

SEQ ID NO: 95562 - DNA, 25 bp, E. coli
ggctggaccagttgcgtcagcccct

SEQ ID NO: 95563 - DNA, 25 bp, E. coli
tcagcagcgtgaattgcattagctc

SEQ ID NO: 95564 - DNA, 25 bp, E. coli
tcagcagcgtgatttgcattagctc

SEQ ID NO: 95565 - DNA, 25 bp, E. coli
aatgaaatcaggtcaggtggcgctc

SEQ ID NO: 95566 - DNA, 25 bp, E. coli
aatgaaatcaggacaggtggcgctc

SEQ ID NO: 95567 - DNA, 25 bp, E. coli
caaagagcgttacaaccagtgccag

SEQ ID NO: 95568 - DNA, 25 bp, E. coli
caaagagcgttagaaccagtgccag

SEQ ID NO: 95569 - DNA, 25 bp, E. coli
aaaagagtcaaatccggttcagccg

SEQ ID NO: 95570 - DNA, 25 bp, E. coli
aaaagagtcaaaaccggttcagccg

SEQ ID NO: 95571 - DNA, 25 bp, E. coli
tactcgcagcagttttcaggtatct

SEQ ID NO: 95572 - DNA, 25 bp, E. coli
ccactgtgtggatgtgccgcccata

SEQ ID NO: 95573 - DNA, 25 bp, E. coli
gccagaacattaactgcagccatac

SEQ ID NO: 95574 - DNA, 25 bp, E. coli
gccagaacattatctgcagccatac

SEQ ID NO: 95575 - DNA, 25 bp, E. coli
ccactgtgtggaagtgccgcccata

SEQ ID NO: 95576 - DNA, 25 bp, E. coli
gcagccatacttttgttacccatga

SEQ ID NO: 95577 - DNA, 25 bp, E. coli
gcagccatacttatgttacccatga

SEQ ID NO: 95578 - DNA, 25 bp, E. coli
gaactcgaaaaaagatgatttgccc

SEQ ID NO: 95579 - DNA, 25 bp, E. coli
gaactcgaaaaatgatgatttgccc

SEQ ID NO: 95580 - DNA, 25 bp, E. coli
gttcgattgcaaggccaaaagagtc

SEQ ID NO: 95581 - DNA, 25 bp, E. coli
gttcgattgcaacgccaaaagagtc

SEQ ID NO: 95582 - DNA, 25 bp, E. coli
ggtatcttcattcaccaaagagcgt

SEQ ID NO: 95583 - DNA, 25 bp, E. coli
ggttcagccgcatccaatgaaatca

SEQ ID NO: 95584 - DNA, 25 bp, E. coli
ggtatcttcattgaccaaagagcgt

SEQ ID NO: 95585 - DNA, 25 bp, E. coli
ggttcagccgcaaccaatgaaatca

SEQ ID NO: 95586 - DNA, 25 bp, E. coli
tactcgcagcagatttcaggtatct

SEQ ID NO: 95587 - DNA, 25 bp, E. coli
cactggtttacgaacatggcaagca

SEQ ID NO: 95588 - DNA, 25 bp, E. coli
caaaatgtggtaccgattggcgaca

SEQ ID NO: 95589 - DNA, 25 bp, E. coli
cactggtttacgtacatggcaagca

SEQ ID NO: 95590 - DNA, 25 bp, E. coli
caaaatgtggtagcgattggcgaca

SEQ ID NO: 95591 - DNA, 25 bp, E. coli
tacataaagcaaacggtatttcgcg

SEQ ID NO: 95592 - DNA, 25 bp, E. coli
tacataaagcaatcggtatttcgcg

SEQ ID NO: 95593 - DNA, 25 bp, E. coli
aaacgctgggatctgtcaccgcaaa

SEQ ID NO: 95594 - DNA, 25 bp, E. coli
aaacgctgggatgtgtcaccgcaaa

SEQ ID NO: 95595 - DNA, 25 bp, E. coli
tatttcgcggtttctgaaacgctgg

SEQ ID NO: 95596 - DNA, 25 bp, E. coli
tatcaggaactgtaaaagcgcggca

SEQ ID NO: 95597 - DNA, 25 bp, E. coli
tatttcgcggttactgaaacgctgg

SEQ ID NO: 95598 - DNA, 25 bp, E. coli
tatcaggaactgaaaaagcgcggca

SEQ ID NO: 95599 - DNA, 25 bp, E. coli
gaactgacccgagatgaatcgcgga

SEQ ID NO: 95600 - DNA, 25 bp, E. coli
gaacaaatcccgttagtgatcgaca

SEQ ID NO: 95601 - DNA, 25 bp, E. coli
gaacaaatcccgatagtgatcgaca

SEQ ID NO: 95602 - DNA, 25 bp, E. coli
gaactgacccgacatgaatcgcgga

SEQ ID NO: 95603 - DNA, 25 bp, E. coli
cggagatgctgataatggcgcgtta

SEQ ID NO: 95604 - DNA, 25 bp, E. coli
cggagatgctgaaaatggcgcgtta

SEQ ID NO: 95605 - DNA, 25 bp, E. coli
gattatcaggagtttgacgacgtac

SEQ ID NO: 95606 - DNA, 25 bp, E. coli
gattatcaggagattgacgacgtac

SEQ ID NO: 95607 - DNA, 25 bp, E. coli
gatgagatctctattgtcgcggaaa

SEQ ID NO: 95608 - DNA, 25 bp, E. coli
gatgagatctcttttgtcgcggaaa

SEQ ID NO: 95609 - DNA, 25 bp, E. coli
cacgagcaatagtaatactgaagca

SEQ ID NO: 95610 - DNA, 25 bp, E. coli
cacgagcaatagaaatactgaagca

SEQ ID NO: 95611 - DNA, 25 bp, E. coli
tactctatgtaagcatctgcgggat

SEQ ID NO: 95612 - DNA, 25 bp, E. coli
taaaagaacatatgagtacacgagc

SEQ ID NO: 95613 - DNA, 25 bp, E. coli
tactctatgtaaccatctgcgggat

SEQ ID NO: 95614 - DNA, 25 bp, E. coli
tacgacttgcatttaccagtagatg

SEQ ID NO: 95615 - DNA, 25 bp, E. coli
taaaagaacataagagtacacgagc

SEQ ID NO: 95616 - DNA, 25 bp, E. coli
aaatatgccgtcttacgtttgagca

SEQ ID NO: 95617 - DNA, 25 bp, E. coli
aaatatgccgtcatacgtttgagca

SEQ ID NO: 95618 - DNA, 25 bp, E. coli
tacgacttgcatataccagtagatg

SEQ ID NO: 95619 - DNA, 25 bp, E. coli
tatttataccgtagcgttgaccaag

SEQ ID NO: 95620 - DNA, 25 bp, E. coli
tatttataccgttgcgttgaccaag

SEQ ID NO: 95621 - DNA, 25 bp, E. coli
tcttctcacaaatagaaagggtggg

SEQ ID NO: 95622 - DNA, 25 bp, E. coli
tcttctcacaaaaagaaagggtggg

SEQ ID NO: 95623 - DNA, 25 bp, E. coli
cgcatttaatttcgtccccgaatca

SEQ ID NO: 95624 - DNA, 25 bp, E. coli
cgcatttaatttggtccccgaatca

SEQ ID NO: 95625 - DNA, 25 bp, E. coli
cgggttaccgcatgatttattgaca

SEQ ID NO: 95626 - DNA, 25 bp, E. coli
ctcttgttcataacgctgcggctta

SEQ ID NO: 95627 - DNA, 25 bp, E. coli
cgggttaccgcaagatttattgaca

SEQ ID NO: 95628 - DNA, 25 bp, E. coli
ctcttgttcatatcgctgcggctta

SEQ ID NO: 95629 - DNA, 25 bp, E. coli
ggcttatcataatccaacgcttgca

SEQ ID NO: 95630 - DNA, 25 bp, E. coli
ggcttatcataaaccaacgcttgca

SEQ ID NO: 95631 - DNA, 25 bp, E. coli
aacctgttcagcgacctgacggtcg

SEQ ID NO: 95632 - DNA, 25 bp, E. coli
cagcaaaaaatgacgctattgatgg

SEQ ID NO: 95633 - DNA, 25 bp, E. coli
cagcaaaaaatgtcgctattgatgg

SEQ ID NO: 95634 - DNA, 25 bp, E. coli
taaaactgactgatatcacctggct

SEQ ID NO: 95635 - DNA, 25 bp, E. coli
taaaactgactgttatcacctggct

SEQ ID NO: 95636 - DNA, 25 bp, E. coli
aacctgttcagccacctgacggtcg

SEQ ID NO: 95637 - DNA, 25 bp, E. coli
tagcgcgttgtcaggtacgcgaaca

SEQ ID NO: 95638 - DNA, 25 bp, E. coli
tagcgcgttgtctggtacgcgaaca

SEQ ID NO: 95639 - DNA, 25 bp, E. coli
tgttgagcggtaaggcgagtgcttc

SEQ ID NO: 95640 - DNA, 25 bp, E. coli
tgtttcaggagaacaacctgttcag

SEQ ID NO: 95641 - DNA, 25 bp, E. coli
tgttgagcggtatggcgagtgcttc

SEQ ID NO: 95642 - DNA, 25 bp, E. coli
tgtttcaggagatcaacctgttcag

SEQ ID NO: 95643 - DNA, 25 bp, E. coli
tgacgctattgatggtgtcgcacag

SEQ ID NO: 95644 - DNA, 25 bp, E. coli
tgacgctattgaaggtgtcgcacag

SEQ ID NO: 95645 - DNA, 25 bp, E. coli
tcgatgctgtttgaggagaacaacc

SEQ ID NO: 95646 - DNA, 25 bp, E. coli
tgccgatgcgttttagcttaacggt

SEQ ID NO: 95647 - DNA, 25 bp, E. coli
tgccgatgcgttatagcttaacggt

SEQ ID NO: 95648 - DNA, 25 bp, E. coli
tcgatgctgtttcaggagaacaacc

SEQ ID NO: 95649 - DNA, 25 bp, E. coli
ttgataatttaatggcgcggttacc

SEQ ID NO: 95650 - DNA, 25 bp, E. coli
ttgataatttaaaggcgcggttacc

SEQ ID NO: 95651 - DNA, 25 bp, E. coli
tcacgccgtccgctgtcgatgctgt

SEQ ID NO: 95652 - DNA, 25 bp, E. coli
tcacgccgtccggtgtcgatgctgt

SEQ ID NO: 95653 - DNA, 25 bp, E. coli
catatccagtatacatgatgcgggc

SEQ ID NO: 95654 - DNA, 25 bp, E. coli
catgatgcgggcattttgctgatat

SEQ ID NO: 95655 - DNA, 25 bp, E. coli
catgatgcgggctttttgctgatat

SEQ ID NO: 95656 - DNA, 25 bp, E. coli
catatccagtattcatgatgcgggc

SEQ ID NO: 95657 - DNA, 25 bp, E. coli
tataaacactgacgtaactctcatg

SEQ ID NO: 95658 - DNA, 25 bp, E. coli
tataaacactgaggtaactctcatg

SEQ ID NO: 95659 - DNA, 25 bp, E. coli
tgctgatatttatcccgaacattcc

SEQ ID NO: 95660 - DNA, 25 bp, E. coli
tgctgatatttaacccgaacattcc

SEQ ID NO: 95661 - DNA, 25 bp, E. coli
tgaactaacgcacgaaccgatcaga

SEQ ID NO: 95662 - DNA, 25 bp, E. coli
tgaactaacgcaggaaccgatcaga

SEQ ID NO: 95663 - DNA, 25 bp, E. coli
tcgtgatgtgaactaacgcaggaac

SEQ ID NO: 95664 - DNA, 25 bp, E. coli
tctgcgacagatattattctctgga

SEQ ID NO: 95665 - DNA, 25 bp, E. coli
tctgcgacagattttattctctgga

SEQ ID NO: 95666 - DNA, 25 bp, E. coli
tcgtgatgtgaagtaacgcaggaac

SEQ ID NO: 95667 - DNA, 25 bp, E. coli
cctgatacagacaattaatacaacc

SEQ ID NO: 95668 - DNA, 25 bp, E. coli
cctgatacagactattaatacaacc

SEQ ID NO: 95669 - DNA, 25 bp, E. coli
gggaccgaatccatatataaacact

SEQ ID NO: 95670 - DNA, 25 bp, E. coli
gggaccgaatccttatataaacact

SEQ ID NO: 95671 - DNA, 25 bp, E. coli
taacccgaacattcctgatacagac

SEQ ID NO: 95672 - DNA, 25 bp, E. coli
taacccgaacatacctgatacagac

SEQ ID NO: 95673 - DNA, 25 bp, E. coli
taatacaaccttatctgcgacagat

SEQ ID NO: 95674 - DNA, 25 bp, E. coli
taatacaaccttttctgcgacagat

SEQ ID NO: 95675 - DNA, 25 bp, E. coli
caacagcggtgtttttgtgggttgg

SEQ ID NO: 95676 - DNA, 25 bp, E. coli
caacagcggtgtatttgtgggttgg

SEQ ID NO: 95677 - DNA, 25 bp, E. coli
aattcgccacccgttgatgccggtg

SEQ ID NO: 95678 - DNA, 25 bp, E. coli
aattcgccaccccttgatgccggtg

SEQ ID NO: 95679 - DNA, 25 bp, E. coli
cagcggtaaagccactgaccgtttg

SEQ ID NO: 95680 - DNA, 25 bp, E. coli
cagcggtaaagcgactgaccgtttg

SEQ ID NO: 95681 - DNA, 25 bp, E. coli
taaagcgactgagcgtttgagtcat

SEQ ID NO: 95682 - DNA, 25 bp, E. coli
taaagcgactgaccgtttgagtcat

SEQ ID NO: 95683 - DNA, 25 bp, E. coli
attcgccacccgttgatgccggtgt

SEQ ID NO: 95684 - DNA, 25 bp, E. coli
attcgccacccgatgatgccggtgt

SEQ ID NO: 95685 - DNA, 25 bp, E. coli
agcgactgaccgtttgagtcattat

SEQ ID NO: 95686 - DNA, 25 bp, E. coli
agcgactgaccgattgagtcattat

SEQ ID NO: 95687 - DNA, 25 bp, E. coli
tatggcgcagcggtaaagcgactga

SEQ ID NO: 95688 - DNA, 25 bp, E. coli
tatggcgcagcgctaaagcgactga

SEQ ID NO: 95689 - DNA, 25 bp, E. coli
gcgcagcggtaatgcgactgaccgt

SEQ ID NO: 95690 - DNA, 25 bp, E. coli
gctgctggcaactgcggtgtttttg

SEQ ID NO: 95691 - DNA, 25 bp, E. coli
gctgctggcaacagcggtgtttttg

SEQ ID NO: 95692 - DNA, 25 bp, E. coli
gcgcagcggtaaagcgactgaccgt

SEQ ID NO: 95693 - DNA, 25 bp, E. coli
gttaattcgccagccgttgatgccg

SEQ ID NO: 95694 - DNA, 25 bp, E. coli
gttaattcgccacccgttgatgccg

SEQ ID NO: 95695 - DNA, 25 bp, E. coli
gtgttaattcgccacccgttgatgc

SEQ ID NO: 95696 - DNA, 25 bp, E. coli
gtgttaattcgcgacccgttgatgc

SEQ ID NO: 95697 - DNA, 25 bp, E. coli
cactgcgggtcacgtgttacgtgcc

SEQ ID NO: 95698 - DNA, 25 bp, E. coli
cactgcgggtcaggtgttacgtgcc

SEQ ID NO: 95699 - DNA, 25 bp, E. coli
taaagccctgttggcatcgggtggc

SEQ ID NO: 95700 - DNA, 25 bp, E. coli
taaagccctgttcgcatcgggtggc

SEQ ID NO: 95701 - DNA, 25 bp, E. coli
aggctacagcctttgccgccgtgtt

SEQ ID NO: 95702 - DNA, 25 bp, E. coli
aggctacagcctatgccgccgtgtt

SEQ ID NO: 95703 - DNA, 25 bp, E. coli
aagccaccgcaggacaacaaattgg

SEQ ID NO: 95704 - DNA, 25 bp, E. coli
aagccaccgcagcacaacaaattgg

SEQ ID NO: 95705 - DNA, 25 bp, E. coli
tctctgatctgtagctggttgccgc

SEQ ID NO: 95706 - DNA, 25 bp, E. coli
tctctgatctgttgctggttgccgc

SEQ ID NO: 95707 - DNA, 25 bp, E. coli
gacagctaccgttacactgtggagt

SEQ ID NO: 95708 - DNA, 25 bp, E. coli
gacagctaccgtaacactgtggagt

SEQ ID NO: 95709 - DNA, 25 bp, E. coli
cgatgggcattcgaatcctggttgc

SEQ ID NO: 95710 - DNA, 25 bp, E. coli
cgtttgccatcgctcagtaccttag

SEQ ID NO: 95711 - DNA, 25 bp, E. coli
cgtttgccatcggtcagtaccttag

SEQ ID NO: 95712 - DNA, 25 bp, E. coli
cgatgggcattccaatcctggttgc

SEQ ID NO: 95713 - DNA, 25 bp, E. coli
ccttagctctaagttcattgggccg

SEQ ID NO: 95714 - DNA, 25 bp, E. coli
ccttagctctaacttcattgggccg

SEQ ID NO: 95715 - DNA, 25 bp, E. coli
ggtatcactgctctgcctgacgctg

SEQ ID NO: 95716 - DNA, 25 bp, E. coli
ggtatcactgctgtgcctgacgctg

SEQ ID NO: 95717 - DNA, 25 bp, E. coli
gtcggatacctcttctaacgccctg

SEQ ID NO: 95718 - DNA, 25 bp, E. coli
gtcggatacctcatctaacgccctg

SEQ ID NO: 95719 - DNA, 25 bp, E. coli
cagcccgctggaaatgcaaaagtag

SEQ ID NO: 95720 - DNA, 25 bp, E. coli
cagcccgctggatatgcaaaagtag

SEQ ID NO: 95721 - DNA, 25 bp, E. coli
tattatggcgcgaaaagaaacccgg

SEQ ID NO: 95722 - DNA, 25 bp, E. coli
tattatggcgcgtaaagaaacccgg

SEQ ID NO: 95723 - DNA, 25 bp, E. coli
tttctgaaggcgcatcagccagcgc

SEQ ID NO: 95724 - DNA, 25 bp, E. coli
tttctgaaggcggatcagccagcgc

SEQ ID NO: 95725 - DNA, 25 bp, E. coli
ttaggcacagcggtagctattcgtg

SEQ ID NO: 95726 - DNA, 25 bp, E. coli
ttaggcacagcgctagctattcgtg

SEQ ID NO: 95727 - DNA, 25 bp, E. coli
tctggtggatgtatcttggcggccc

SEQ ID NO: 95728 - DNA, 25 bp, E. coli
tctggtggatgtttcttggcggccc

SEQ ID NO: 95729 - DNA, 25 bp, E. coli
gctacgggatccttgctggtttcaa

SEQ ID NO: 95730 - DNA, 25 bp, E. coli
gctacgggatccatgctggtttcaa

SEQ ID NO: 95731 - DNA, 25 bp, E. coli
cgcattagggcacgtcactgttcaa

SEQ ID NO: 95732 - DNA, 25 bp, E. coli
cgcattagggcaggtcactgttcaa

SEQ ID NO: 95733 - DNA, 25 bp, E. coli
cggaacactgttagcactggtcggt

SEQ ID NO: 95734 - DNA, 25 bp, E. coli
cggaacactgtttgcactggtcggt

SEQ ID NO: 95735 - DNA, 25 bp, E. coli
ggcggcccgcttcgactaatgtcta

SEQ ID NO: 95736 - DNA, 25 bp, E. coli
ggcggcccgcttggactaatgtcta

SEQ ID NO: 95737 - DNA, 25 bp, E. coli
taattccatcgcagggcaataccgt

SEQ ID NO: 95738 - DNA, 25 bp, E. coli
taattccatcgctgggcaataccgt

SEQ ID NO: 95739 - DNA, 25 bp, E. coli
gatgcttgccacgattcttgcgggt

SEQ ID NO: 95740 - DNA, 25 bp, E. coli
gatgcttgccaccattcttgcgggt

SEQ ID NO: 95741 - DNA, 25 bp, E. coli
ttatcagaactcattataagtctcc

SEQ ID NO: 95742 - DNA, 25 bp, E. coli
ttatcagaactctttataagtctcc

SEQ ID NO: 95743 - DNA, 25 bp, E. coli
tgcacatcgatagcgacataccaac

SEQ ID NO: 95744 - DNA, 25 bp, E. coli
tgcacatcgataccgacataccaac

SEQ ID NO: 95745 - DNA, 25 bp, E. coli
tcgtaaccattgtatgaaactgtct

SEQ ID NO: 95746 - DNA, 25 bp, E. coli
tcagagcctatttatcaatttgcgc

SEQ ID NO: 95747 - DNA, 25 bp, E. coli
tcatcaccctacttgatacctctga

SEQ ID NO: 95748 - DNA, 25 bp, E. coli
tcatcaccctacatgatacctctga

SEQ ID NO: 95749 - DNA, 25 bp, E. coli
tcagagcctattaatcaatttgcgc

SEQ ID NO: 95750 - DNA, 25 bp, E. coli
tcgtaaccattgaatgaaactgtct

SEQ ID NO: 95751 - DNA, 25 bp, E. coli
gctgtcatactgtgttactcaggaa

SEQ ID NO: 95752 - DNA, 25 bp, E. coli
gctgtcatactgagttactcaggaa

SEQ ID NO: 95753 - DNA, 25 bp, E. coli
gacttaagttcgatgctgtcatact

SEQ ID NO: 95754 - DNA, 25 bp, E. coli
gaactcattataagtctcctcatag

SEQ ID NO: 95755 - DNA, 25 bp, E. coli
gaactcattatatgtctcctcatag

SEQ ID NO: 95756 - DNA, 25 bp, E. coli
gacttaagttcgttgctgtcatact

SEQ ID NO: 95757 - DNA, 25 bp, E. coli
ccgcaaactgtccaaaaatatcaca

SEQ ID NO: 95758 - DNA, 25 bp, E. coli
ccgcaaactgtcgaaaaatatcaca

SEQ ID NO: 95759 - DNA, 25 bp, E. coli
gatacctctgacataagttcgatgc

SEQ ID NO: 95760 - DNA, 25 bp, E. coli
gatacctctgacttaagttcgatgc

SEQ ID NO: 95761 - DNA, 25 bp, E. coli
tgtcgaaaaatatcacaaaattgtt

SEQ ID NO: 95762 - DNA, 25 bp, E. coli
tgtcgaaaaataacacaaaattgtt

SEQ ID NO: 95763 - DNA, 25 bp, E. coli
agccctgaagtctgccgacgtacag

SEQ ID NO: 95764 - DNA, 25 bp, E. coli
agccctgaagtcagccgacgtacag

SEQ ID NO: 95765 - DNA, 25 bp, E. coli
tttgattcgaccgtctgtcaccgct

SEQ ID NO: 95766 - DNA, 25 bp, E. coli
tttgattcgaccctctgtcaccgct

SEQ ID NO: 95767 - DNA, 25 bp, E. coli
tttctgccgactgcgatgacgtcac

SEQ ID NO: 95768 - DNA, 25 bp, E. coli
tttctgccgactccgatgacgtcac

SEQ ID NO: 95769 - DNA, 25 bp, E. coli
tgtcaccgctatccgggtgattgcc

SEQ ID NO: 95770 - DNA, 25 bp, E. coli
tgatttctgccgactccgatgacgt

SEQ ID NO: 95771 - DNA, 25 bp, E. coli
tgatttctgccgtctccgatgacgt

SEQ ID NO: 95772 - DNA, 25 bp, E. coli
tgtcaccgctatgcgggtgattgcc

SEQ ID NO: 95773 - DNA, 25 bp, E. coli
gaagtggtgtatggccgctcgctat

SEQ ID NO: 95774 - DNA, 25 bp, E. coli
gaagtggtgtatcgccgctcgctat

SEQ ID NO: 95775 - DNA, 25 bp, E. coli
gtgtatggccgctcgctatatgcgg

SEQ ID NO: 95776 - DNA, 25 bp, E. coli
gtgtatggccgcacgctatatgcgg

SEQ ID NO: 95777 - DNA, 25 bp, E. coli
tggcattgatgcagccctgaagtct

SEQ ID NO: 95778 - DNA, 25 bp, E. coli
tggcattgatgctgccctgaagtct

SEQ ID NO: 95779 - DNA, 25 bp, E. coli
gacctatggcatagatgcagccctg

SEQ ID NO: 95780 - DNA, 25 bp, E. coli
gaccgtctgtcaccgctatgcgggt

SEQ ID NO: 95781 - DNA, 25 bp, E. coli
gacctatggcattgatgcagccctg

SEQ ID NO: 95782 - DNA, 25 bp, E. coli
gaccgtctgtcagcgctatgcgggt

SEQ ID NO: 95783 - DNA, 25 bp, E. coli
gatgcagccctgtagtctgccgacg

SEQ ID NO: 95784 - DNA, 25 bp, E. coli
gatgcagccctgaagtctgccgacg

SEQ ID NO: 95785 - DNA, 25 bp, E. coli
cactttcggaagagacaccagacgc

SEQ ID NO: 95786 - DNA, 25 bp, E. coli
cactttcggaagtgacaccagacgc

SEQ ID NO: 95787 - DNA, 25 bp, E. coli
tgtacgaaggtgacagaacgccagt

SEQ ID NO: 95788 - DNA, 25 bp, E. coli
tgtacgaaggtgtcagaacgccagt

SEQ ID NO: 95789 - DNA, 25 bp, E. coli
tgaaattgcactgtacgtcggcggt

SEQ ID NO: 95790 - DNA, 25 bp, E. coli
tgaaattgcactctacgtcggcggt

SEQ ID NO: 95791 - DNA, 25 bp, E. coli
tctcacgccgatgactgtgttcgat

SEQ ID NO: 95792 - DNA, 25 bp, E. coli
tctttgatttagacaccgcgacagc

SEQ ID NO: 95793 - DNA, 25 bp, E. coli
tctcacgccgatcactgtgttcgat

SEQ ID NO: 95794 - DNA, 25 bp, E. coli
tctttgatttagtcaccgcgacagc

SEQ ID NO: 95795 - DNA, 25 bp, E. coli
gcgatgtcggcattgttctttgatt

SEQ ID NO: 95796 - DNA, 25 bp, E. coli
gcgatgtcggcaatgttctttgatt

SEQ ID NO: 95797 - DNA, 25 bp, E. coli
gcaaagtgccgctgtacgaaggtga

SEQ ID NO: 95798 - DNA, 25 bp, E. coli
gcaaagtgccgcagtacgaaggtga

SEQ ID NO: 95799 - DNA, 25 bp, E. coli
gactgtgttcgaaacctttggcatt

SEQ ID NO: 95800 - DNA, 25 bp, E. coli
gactgtgttcgatacctttggcatt

SEQ ID NO: 95801 - DNA, 25 bp, E. coli
cgacagcattgattaacttcggtgc

SEQ ID NO: 95802 - DNA, 25 bp, E. coli
cgacagcattgaataacttcggtgc

SEQ ID NO: 95803 - DNA, 25 bp, E. coli
tctacgtcggcggtaagctgttcca

SEQ ID NO: 95804 - DNA, 25 bp, E. coli
tggcattgtatctggcattagcgac

SEQ ID NO: 95805 - DNA, 25 bp, E. coli
tggcattgtatcaggcattagcgac

SEQ ID NO: 95806 - DNA, 25 bp, E. coli
tctacgtcggcgctaagctgttcca

SEQ ID NO: 95807 - DNA, 25 bp, E. coli
caaacttgttgaccgtactgaaggc

SEQ ID NO: 95808 - DNA, 25 bp, E. coli
caaacttgttgagcgtactgaaggc

SEQ ID NO: 95809 - DNA, 25 bp, E. coli
taaaaaatgcctcgatcgtctggtc

SEQ ID NO: 95810 - DNA, 25 bp, E. coli
taaaaaatgcctggatcgtctggtc

SEQ ID NO: 95811 - DNA, 25 bp, E. coli
cagaaagggagtgcaacgaatacca

SEQ ID NO: 95812 - DNA, 25 bp, E. coli
cagaaagggagtccaacgaatacca

SEQ ID NO: 95813 - DNA, 25 bp, E. coli
tgccccgcaaactgtacgaaagatg

SEQ ID NO: 95814 - DNA, 25 bp, E. coli
tgccccgcaaacagtacgaaagatg

SEQ ID NO: 95815 - DNA, 25 bp, E. coli
tcatcacgaggctaaacagcaggag

SEQ ID NO: 95816 - DNA, 25 bp, E. coli
tcatcacgaggcaaaacagcaggag

SEQ ID NO: 95817 - DNA, 25 bp, E. coli
gaaggctatataccaggatcggcag

SEQ ID NO: 95818 - DNA, 25 bp, E. coli
gaaggctatatagcaggatcggcag

SEQ ID NO: 95819 - DNA, 25 bp, E. coli
gacttgatgaagaattgccccgcaa

SEQ ID NO: 95820 - DNA, 25 bp, E. coli
gaacaatcgacaaacgagccaggct

SEQ ID NO: 95821 - DNA, 25 bp, E. coli
gacttgatgaagtattgccccgcaa

SEQ ID NO: 95822 - DNA, 25 bp, E. coli
gaacatacagtctacgacgaggctg

SEQ ID NO: 95823 - DNA, 25 bp, E. coli
gaacaatcgacatacgagccaggct

SEQ ID NO: 95824 - DNA, 25 bp, E. coli
gaacatacagtcaacgacgaggctg

SEQ ID NO: 95825 - DNA, 25 bp, E. coli
cttcgctggtactggcaaaaactca

SEQ ID NO: 95826 - DNA, 25 bp, E. coli
cttcgctggtacaggcaaaaactca

SEQ ID NO: 95827 - DNA, 25 bp, E. coli
tcacgaggaaacagatcatcacgag

SEQ ID NO: 95828 - DNA, 25 bp, E. coli
tcacgaggaaactgatcatcacgag

SEQ ID NO: 95829 - DNA, 25 bp, E. coli
cagttgtttattcagggtgagttcc

SEQ ID NO: 95830 - DNA, 25 bp, E. coli
cagttgtttattgagggtgagttcc

SEQ ID NO: 95831 - DNA, 25 bp, E. coli
tacgtgtttaatgtgagtccctatc

SEQ ID NO: 95832 - DNA, 25 bp, E. coli
tacgtgtttaatctgagtccctatc

SEQ ID NO: 95833 - DNA, 25 bp, E. coli
cggaacgtcaccagataaaatttgt

SEQ ID NO: 95834 - DNA, 25 bp, E. coli
cggaacgtcacctgataaaatttgt

SEQ ID NO: 95835 - DNA, 25 bp, E. coli
tacggcggcccgttagtccagggtt

SEQ ID NO: 95836 - DNA, 25 bp, E. coli
tacggcggcccgatagtccagggtt

SEQ ID NO: 95837 - DNA, 25 bp, E. coli
tgtgtaaagccaaatagctcagacg

SEQ ID NO: 95838 - DNA, 25 bp, E. coli
tgtgtaaagccatatagctcagacg

SEQ ID NO: 95839 - DNA, 25 bp, E. coli
tgcactggtcttttacgatatctga

SEQ ID NO: 95840 - DNA, 25 bp, E. coli
tgcactggtcttatacgatatctga

SEQ ID NO: 95841 - DNA, 25 bp, E. coli
tcttgccgggaatgaaagaggaaat

SEQ ID NO: 95842 - DNA, 25 bp, E. coli
tcttgccgggaaagaaagaggaaat

SEQ ID NO: 95843 - DNA, 25 bp, E. coli
gagaactccatacaactttttacgg

SEQ ID NO: 95844 - DNA, 25 bp, E. coli
gagaactccatagaactttttacgg

SEQ ID NO: 95845 - DNA, 25 bp, E. coli
gatagtcgcgcccactgcatcgaga

SEQ ID NO: 95846 - DNA, 25 bp, E. coli
gatagtcgcgccgactgcatcgaga

SEQ ID NO: 95847 - DNA, 25 bp, E. coli
ggtgagttccgaccctgaaacaaca

SEQ ID NO: 95848 - DNA, 25 bp, E. coli
ggtgagttccgagcctgaaacaaca

SEQ ID NO: 95849 - DNA, 25 bp, E. coli
gagtttacatagtattgcactggtc

SEQ ID NO: 95850 - DNA, 25 bp, E. coli
gagtttacatagaattgcactggtc

SEQ ID NO: 95851 - DNA, 25 bp, E. coli
cagaaggtgaatttcttgaaatgct

SEQ ID NO: 95852 - DNA, 25 bp, E. coli
cagaaggtgaatatcttgaaatgct

SEQ ID NO: 95853 - DNA, 25 bp, E. coli
tactgaacatcctaaaaagggagat

SEQ ID NO: 95854 - DNA, 25 bp, E. coli
tactgaacatccaaaaaagggagat

SEQ ID NO: 95855 - DNA, 25 bp, E. coli
aaagggagatctcattttctatcct

SEQ ID NO: 95856 - DNA, 25 bp, E. coli
aaagggagatctgattttctatcct

SEQ ID NO: 95857 - DNA, 25 bp, E. coli
aaatgcttgaggagatagtaaatgc

SEQ ID NO: 95858 - DNA, 25 bp, E. coli
aaatgcttgaggtgatagtaaatgc

SEQ ID NO: 95859 - DNA, 25 bp, E. coli
aaatatatttttacacagaaggtga

SEQ ID NO: 95860 - DNA, 25 bp, E. coli
aaatatattttttcacagaaggtga

SEQ ID NO: 95861 - DNA, 25 bp, E. coli
tatcctaattcccaagaagatggtg

SEQ ID NO: 95862 - DNA, 25 bp, E. coli
tagcaaagataaatccctaaaaggg

SEQ ID NO: 95863 - DNA, 25 bp, E. coli
tatcctaattccgaagaagatggtg

SEQ ID NO: 95864 - DNA, 25 bp, E. coli
tagcaaagataattccctaaaaggg

SEQ ID NO: 95865 - DNA, 25 bp, E. coli
gaagatggtgaacctgaaaacatcc

SEQ ID NO: 95866 - DNA, 25 bp, E. coli
gaagatggtgaagctgaaaacatcc

SEQ ID NO: 95867 - DNA, 25 bp, E. coli
gaaaaatatctccataccttagtgg

SEQ ID NO: 95868 - DNA, 25 bp, E. coli
gaaaaatatctcgataccttagtgg

SEQ ID NO: 95869 - DNA, 25 bp, E. coli
gataccttagtgcatcatttcatta

SEQ ID NO: 95870 - DNA, 25 bp, E. coli
gataccttagtggatcatttcatta

SEQ ID NO: 95871 - DNA, 25 bp, E. coli
gagatagtaaatgcaactagcaaag

SEQ ID NO: 95872 - DNA, 25 bp, E. coli
gagatagtaaatccaactagcaaag

SEQ ID NO: 95873 - DNA, 25 bp, E. coli
aacctgaagcgcttgcacctaacga

SEQ ID NO: 95874 - DNA, 25 bp, E. coli
acctggtgacctgtgccgcgatgta

SEQ ID NO: 95875 - DNA, 25 bp, E. coli
acctggtgacctctgccgcgatgta

SEQ ID NO: 95876 - DNA, 25 bp, E. coli
aacctgaagcgcatgcacctaacga

SEQ ID NO: 95877 - DNA, 25 bp, E. coli
tccgtacgaaggcatggaaactgat

SEQ ID NO: 95878 - DNA, 25 bp, E. coli
tccgtacgaagggatggaaactgat

SEQ ID NO: 95879 - DNA, 25 bp, E. coli
tcttggcgaatttcaagaactctcc

SEQ ID NO: 95880 - DNA, 25 bp, E. coli
tcttggcgaattacaagaactctcc

SEQ ID NO: 95881 - DNA, 25 bp, E. coli
cctacgaagggctgtttggcaaagc

SEQ ID NO: 95882 - DNA, 25 bp, E. coli
cctacgaagggcagtttggcaaagc

SEQ ID NO: 95883 - DNA, 25 bp, E. coli
gcgtatctatcaagggccgtcacgg

SEQ ID NO: 95884 - DNA, 25 bp, E. coli
gcgtatctatcatgggccgtcacgg

SEQ ID NO: 95885 - DNA, 25 bp, E. coli
gaactctcccaacgtctgggttatg

SEQ ID NO: 95886 - DNA, 25 bp, E. coli
gcatgcacctaaggaaaaaacctgg

SEQ ID NO: 95887 - DNA, 25 bp, E. coli
gcaaagcgccggatgttgataagtg

SEQ ID NO: 95888 - DNA, 25 bp, E. coli
gcaaaggcacccacaccgtttctga

SEQ ID NO: 95889 - DNA, 25 bp, E. coli
gcaaaggcaccctcaccgtttctga

SEQ ID NO: 95890 - DNA, 25 bp, E. coli
gcaaagcgccggttgttgataagtg

SEQ ID NO: 95891 - DNA, 25 bp, E. coli
gcatgcacctaacgaaaaaacctgg

SEQ ID NO: 95892 - DNA, 25 bp, E. coli
gaactctcccaaggtctgggttatg

SEQ ID NO: 95893 - DNA, 25 bp, E. coli
cgtcacggcattgcggtgatcggct

SEQ ID NO: 95894 - DNA, 25 bp, E. coli
cgtcacggcattccggtgatcggct

SEQ ID NO: 95895 - DNA, 25 bp, E. coli
tttccaccgctgatacctgaaacgg

SEQ ID NO: 95896 - DNA, 25 bp, E. coli
tttccaccgctgttacctgaaacgg

SEQ ID NO: 95897 - DNA, 25 bp, E. coli
tacgcctgaggcgttagatgctgcc

SEQ ID NO: 95898 - DNA, 25 bp, E. coli
tacgcctgaggccttagatgctgcc

SEQ ID NO: 95899 - DNA, 25 bp, E. coli
taccgccagcatcatgggatcgggc

SEQ ID NO: 95900 - DNA, 25 bp, E. coli
taccgccagcatgatgggatcgggc

SEQ ID NO: 95901 - DNA, 25 bp, E. coli
tatagctattttcccgttgcgctgg

SEQ ID NO: 95902 - DNA, 25 bp, E. coli
tatagctattttgccgttgcgctgg

SEQ ID NO: 95903 - DNA, 25 bp, E. coli
ttgcagcaggccataagcgagacgg

SEQ ID NO: 95904 - DNA, 25 bp, E. coli
ttgaaatagaatgacgcgagctggc

SEQ ID NO: 95905 - DNA, 25 bp, E. coli
ttgcagcaggccttaagcgagacgg

SEQ ID NO: 95906 - DNA, 25 bp, E. coli
ttgaaatagaatcacgcgagctggc

SEQ ID NO: 95907 - DNA, 25 bp, E. coli
gcgagctggcagttattcccgttct

SEQ ID NO: 95908 - DNA, 25 bp, E. coli
gcgagctggcagatattcccgttct

SEQ ID NO: 95909 - DNA, 25 bp, E. coli
gaatcactacgtatgcagcaggcct

SEQ ID NO: 95910 - DNA, 25 bp, E. coli
gcagcgcggcggataaatcaattct

SEQ ID NO: 95911 - DNA, 25 bp, E. coli
gaatcactacgtttgcagcaggcct

SEQ ID NO: 95912 - DNA, 25 bp, E. coli
gcagcgcggcggttaaatcaattct

SEQ ID NO: 95913 - DNA, 25 bp, E. coli
gataaactgctaacctgttcatggc

SEQ ID NO: 95914 - DNA, 25 bp, E. coli
gataaactgctatcctgttcatggc

SEQ ID NO: 95915 - DNA, 25 bp, E. coli
gagtgggaagcgacaaaccacctgg

SEQ ID NO: 95916 - DNA, 25 bp, E. coli
gagtgggaagcgtcaaaccacctgg

SEQ ID NO: 95917 - DNA, 25 bp, E. coli
aggcgcggcgtgttgtacaactact

SEQ ID NO: 95918 - DNA, 25 bp, E. coli
agcgcgcgtggttgcctcgatgcaa

SEQ ID NO: 95919 - DNA, 25 bp, E. coli
agcgcgcgtggtagcctcgatgcaa

SEQ ID NO: 95920 - DNA, 25 bp, E. coli
aggcgcggcgtgatgtacaactact

SEQ ID NO: 95921 - DNA, 25 bp, E. coli
tgtacaactactccgcgcgcaaagt

SEQ ID NO: 95922 - DNA, 25 bp, E. coli
tgtacaactactgcgcgcgcaaagt

SEQ ID NO: 95923 - DNA, 25 bp, E. coli
tgatgtacaactactgcgcgcgcaa

SEQ ID NO: 95924 - DNA, 25 bp, E. coli
tgatgtacaacttctgcgcgcgcaa

SEQ ID NO: 95925 - DNA, 25 bp, E. coli
tcgatgcaagatcctaacccgcagg

SEQ ID NO: 95926 - DNA, 25 bp, E. coli
tgcctcgatgcaagatcctaacccg

SEQ ID NO: 95927 - DNA, 25 bp, E. coli
tgcctcgatgcatgatcctaacccg

SEQ ID NO: 95928 - DNA, 25 bp, E. coli
tcgatgcaagatgctaacccgcagg

SEQ ID NO: 95929 - DNA, 25 bp, E. coli
gcgcggcgtgatctacaactactgc

SEQ ID NO: 95930 - DNA, 25 bp, E. coli
gcgcggcgtgatgtacaactactgc

SEQ ID NO: 95931 - DNA, 25 bp, E. coli
gcaagatcctaagccgcaggtcgct

SEQ ID NO: 95932 - DNA, 25 bp, E. coli
gcaagatcctaacccgcaggtcgct

SEQ ID NO: 95933 - DNA, 25 bp, E. coli
cgtgatgtacaactactgcgcgcgc

SEQ ID NO: 95934 - DNA, 25 bp, E. coli
cgtggttgcctccatgcaagatcct

SEQ ID NO: 95935 - DNA, 25 bp, E. coli
cgtggttgcctcgatgcaagatcct

SEQ ID NO: 95936 - DNA, 25 bp, E. coli
cgtgatgtacaagtactgcgcgcgc

SEQ ID NO: 95937 - DNA, 25 bp, E. coli
gatgcaagatccaaacccgcaggtc

SEQ ID NO: 95938 - DNA, 25 bp, E. coli
gatgcaagatcctaacccgcaggtc

SEQ ID NO: 95939 - DNA, 25 bp, E. coli
caagctggctggcaatctctttcgg

SEQ ID NO: 95940 - DNA, 25 bp, E. coli
caagctggctgggaatctctttcgg

SEQ ID NO: 95941 - DNA, 25 bp, E. coli
tatctccggatttataaagctgacg

SEQ ID NO: 95942 - DNA, 25 bp, E. coli
tatcaattacaagcgacagggagcc

SEQ ID NO: 95943 - DNA, 25 bp, E. coli
tatctccggattaataaagctgacg

SEQ ID NO: 95944 - DNA, 25 bp, E. coli
tatcaattacaaccgacagggagcc

SEQ ID NO: 95945 - DNA, 25 bp, E. coli
tgttcggcatcacctttggcttcgg

SEQ ID NO: 95946 - DNA, 25 bp, E. coli
tgttcggcatcagctttggcttcgg

SEQ ID NO: 95947 - DNA, 25 bp, E. coli
tcgcgaccgctctgaaattccagac

SEQ ID NO: 95948 - DNA, 25 bp, E. coli
tcgcgaccgctcagaaattccagac

SEQ ID NO: 95949 - DNA, 25 bp, E. coli
gcagccagctcctgcagcggtttat

SEQ ID NO: 95950 - DNA, 25 bp, E. coli
gaactctcggttcaggcgttgcaaa

SEQ ID NO: 95951 - DNA, 25 bp, E. coli
gcagccagctccagcagcggtttat

SEQ ID NO: 95952 - DNA, 25 bp, E. coli
gaactctcggttgaggcgttgcaaa

SEQ ID NO: 95953 - DNA, 25 bp, E. coli
gaactctgcgtgtgcgtatcgccgc

SEQ ID NO: 95954 - DNA, 25 bp, E. coli
gaaaatgggagcagggagttctacc

SEQ ID NO: 95955 - DNA, 25 bp, E. coli
gaactctgcgtgagcgtatcgccgc

SEQ ID NO: 95956 - DNA, 25 bp, E. coli
gaaaatgggagctgggagttctacc

SEQ ID NO: 95957 - DNA, 25 bp, E. coli
ggataatgtttacggtcatgcgccc

SEQ ID NO: 95958 - DNA, 25 bp, E. coli
ggataatgtttagggtcatgcgccc

SEQ ID NO: 95959 - DNA, 25 bp, E. coli
ggaacaccagcgacaggcgtgaaat

SEQ ID NO: 95960 - DNA, 25 bp, E. coli
ggaacaccagcgtcaggcgtgaaat

SEQ ID NO: 95961 - DNA, 25 bp, E. coli
aatgcaggtccagagggtccaaagg

SEQ ID NO: 95962 - DNA, 25 bp, E. coli
agagaccggtctgacgggaaatgca

SEQ ID NO: 95963 - DNA, 25 bp, E. coli
agagaccggtctcacgggaaatgca

SEQ ID NO: 95964 - DNA, 25 bp, E. coli
aatgcaggtccacagggtccaaagg

SEQ ID NO: 95965 - DNA, 25 bp, E. coli
acgggaaatgcacgtccacagggtc

SEQ ID NO: 95966 - DNA, 25 bp, E. coli
aaatgcaggtcctcagggtccaaag

SEQ ID NO: 95967 - DNA, 25 bp, E. coli
acgggaaatgcaggtccacagggtc

SEQ ID NO: 95968 - DNA, 25 bp, E. coli
aaatgcaggtccacagggtccaaag

SEQ ID NO: 95969 - DNA, 25 bp, E. coli
tctgacgggaaatgcaggtccacag

SEQ ID NO: 95970 - DNA, 25 bp, E. coli
tctgacgggaaaagcaggtccacag

SEQ ID NO: 95971 - DNA, 25 bp, E. coli
ccggtctgacgggaaatgcaggtcc

SEQ ID NO: 95972 - DNA, 25 bp, E. coli
ccggtctgacggcaaatgcaggtcc

SEQ ID NO: 95973 - DNA, 25 bp, E. coli
cggtctgacgggaaatgcaggtcca

SEQ ID NO: 95974 - DNA, 25 bp, E. coli
ctgacgggaaatgcaggtccacagg

SEQ ID NO: 95975 - DNA, 25 bp, E. coli
ctgacgggaaatccaggtccacagg

SEQ ID NO: 95976 - DNA, 25 bp, E. coli
cggtctgacgggtaatgcaggtcca

SEQ ID NO: 95977 - DNA, 25 bp, E. coli
ggtctgacgggatatgcaggtccac

SEQ ID NO: 95978 - DNA, 25 bp, E. coli
gggaaatgcaggaccacagggtcca

SEQ ID NO: 95979 - DNA, 25 bp, E. coli
ggtctgacgggaaatgcaggtccac

SEQ ID NO: 95980 - DNA, 25 bp, E. coli
gggaaatgcaggtccacagggtcca

SEQ ID NO: 95981 - DNA, 25 bp, E. coli
ggaaatgcaggtccacagggtccaa

SEQ ID NO: 95982 - DNA, 25 bp, E. coli
ggaaatgcaggtgcacagggtccaa

SEQ ID NO: 95983 - DNA, 25 bp, E. coli
cacccagtgccggataacggattca

SEQ ID NO: 95984 - DNA, 25 bp, E. coli
cacccagtgccgcataacggattca

SEQ ID NO: 95985 - DNA, 25 bp, E. coli
tgtcatgtctttcctccggcctggt

SEQ ID NO: 95986 - DNA, 25 bp, E. coli
tgtcatgtctttgctccggcctggt

SEQ ID NO: 95987 - DNA, 25 bp, E. coli
tgagaatctccacccaggttgcaga

SEQ ID NO: 95988 - DNA, 25 bp, E. coli
tgagaatctccagccaggttgcaga

SEQ ID NO: 95989 - DNA, 25 bp, E. coli
gcacattaatcacttgggtctccaa

SEQ ID NO: 95990 - DNA, 25 bp, E. coli
gcacattaatcagttgggtctccaa

SEQ ID NO: 95991 - DNA, 25 bp, E. coli
gacaaccgtcagtcgaaactcagga

SEQ ID NO: 95992 - DNA, 25 bp, E. coli
gacaaccgtcagacgaaactcagga

SEQ ID NO: 95993 - DNA, 25 bp, E. coli
ccggcctggtttaatgttcagaaga

SEQ ID NO: 95994 - DNA, 25 bp, E. coli
ccggcctggttttatgttcagaaga

SEQ ID NO: 95995 - DNA, 25 bp, E. coli
gatcaatatcgtcgagttaccagtc

SEQ ID NO: 95996 - DNA, 25 bp, E. coli
gatattaaaccgagcagcggcctcg

SEQ ID NO: 95997 - DNA, 25 bp, E. coli
gatattaaaccgtgcagcggcctcg

SEQ ID NO: 95998 - DNA, 25 bp, E. coli
ggttgcagaagagccacttttccag

SEQ ID NO: 95999 - DNA, 25 bp, E. coli
ggttgcagaagacccacttttccag

SEQ ID NO: 96000 - DNA, 25 bp, E. coli
ggcctcgcgcgtcgtaagttcttca

SEQ ID NO: 96001 - DNA, 25 bp, E. coli
ggcctcgcgcgtggtaagttcttca

SEQ ID NO: 96002 - DNA, 25 bp, E. coli
tcactcagagacttcaggacaaccg

SEQ ID NO: 96003 - DNA, 25 bp, E. coli
tcactcagagacatcaggacaaccg

SEQ ID NO: 96004 - DNA, 25 bp, E. coli
gatcaatatcgtggagttaccagtc

SEQ ID NO: 96005 - DNA, 25 bp, E. coli
aatgccctggcaacatcagtaggcg

SEQ ID NO: 96006 - DNA, 25 bp, E. coli
aatattcaggttgcgcaaggttgca

SEQ ID NO: 96007 - DNA, 25 bp, E. coli
aatgccctggcatcatcagtaggcg

SEQ ID NO: 96008 - DNA, 25 bp, E. coli
aatattcaggttccgcaaggttgca

SEQ ID NO: 96009 - DNA, 25 bp, E. coli
cacaaatctggatggttggaaccta

SEQ ID NO: 96010 - DNA, 25 bp, E. coli
cacaaatctggaaggttggaaccta

SEQ ID NO: 96011 - DNA, 25 bp, E. coli
ttccgccacacgtgataccaatggg

SEQ ID NO: 96012 - DNA, 25 bp, E. coli
ttccgccacacgagataccaatggg

SEQ ID NO: 96013 - DNA, 25 bp, E. coli
tgatgtcaacaaaaatgcgcctggc

SEQ ID NO: 96014 - DNA, 25 bp, E. coli
tgatgtcaacaataatgcgcctggc

SEQ ID NO: 96015 - DNA, 25 bp, E. coli
tcagtaggcgttgcgttcagattgg

SEQ ID NO: 96016 - DNA, 25 bp, E. coli
tctctggaatagttccgtctggtgc

SEQ ID NO: 96017 - DNA, 25 bp, E. coli
tctctggaatagatccgtctggtgc

SEQ ID NO: 96018 - DNA, 25 bp, E. coli
tcagtaggcgttccgttcagattgg

SEQ ID NO: 96019 - DNA, 25 bp, E. coli
gcaaaccatctaattgggcatcagg

SEQ ID NO: 96020 - DNA, 25 bp, E. coli
gaagcccgctggtgttactcctgta

SEQ ID NO: 96021 - DNA, 25 bp, E. coli
gaagcccgctggagttactcctgta

SEQ ID NO: 96022 - DNA, 25 bp, E. coli
gcaaaccatctatttgggcatcagg

SEQ ID NO: 96023 - DNA, 25 bp, E. coli
taatatgccggaagtgtgggccagt

SEQ ID NO: 96024 - DNA, 25 bp, E. coli
taatatgccggatgtgtgggccagt

SEQ ID NO: 96025 - DNA, 25 bp, E. coli
gagaacgtgcatattgttatccggg

SEQ ID NO: 96026 - DNA, 25 bp, E. coli
gagaacgtgcattttgttatccggg

SEQ ID NO: 96027 - DNA, 25 bp, E. coli
caccgctgaagtaatgaagtaaggc

SEQ ID NO: 96028 - DNA, 25 bp, E. coli
caccgctgaagttatgaagtaaggc

SEQ ID NO: 96029 - DNA, 25 bp, E. coli
catttctgactcgacctggttgtag

SEQ ID NO: 96030 - DNA, 25 bp, E. coli
catttctgactccacctggttgtag

SEQ ID NO: 96031 - DNA, 25 bp, E. coli
tgaagtaaggcaccaagcctcgcca

SEQ ID NO: 96032 - DNA, 25 bp, E. coli
tcgccatgttctgcgccattttaga

SEQ ID NO: 96033 - DNA, 25 bp, E. coli
tcgccatgttctccgccattttaga

SEQ ID NO: 96034 - DNA, 25 bp, E. coli
tgaagtaaggcagcaagcctcgcca

SEQ ID NO: 96035 - DNA, 25 bp, E. coli
tccgccattttacaagcataatcct

SEQ ID NO: 96036 - DNA, 25 bp, E. coli
tcgatccaatgtgtttctgcttctg

SEQ ID NO: 96037 - DNA, 25 bp, E. coli
tcgatccaatgtctttctgcttctg

SEQ ID NO: 96038 - DNA, 25 bp, E. coli
tccgccattttagaagcataatcct

SEQ ID NO: 96039 - DNA, 25 bp, E. coli
tctgcttctgcacagaatcggaggc

SEQ ID NO: 96040 - DNA, 25 bp, E. coli
tctgcttctgcagagaatcggaggc

SEQ ID NO: 96041 - DNA, 25 bp, E. coli
gaaggccaatcaatctcatttctga

SEQ ID NO: 96042 - DNA, 25 bp, E. coli
gaaggccaatcattctcatttctga

SEQ ID NO: 96043 - DNA, 25 bp, E. coli
cttaaaatcatatagaaggccaatc

SEQ ID NO: 96044 - DNA, 25 bp, E. coli
cttaaaatcataaagaaggccaatc

SEQ ID NO: 96045 - DNA, 25 bp, E. coli
ggtaacagatatatcgcctccatca

SEQ ID NO: 96046 - DNA, 25 bp, E. coli
ggtaacagatatttcgcctccatca

SEQ ID NO: 96047 - DNA, 25 bp, E. coli
gacctggttgtagaattcgatccaa

SEQ ID NO: 96048 - DNA, 25 bp, E. coli
gacctggttgtacaattcgatccaa

SEQ ID NO: 96049 - DNA, 25 bp, E. coli
aatggctggagtaatgagtgatgac

SEQ ID NO: 96050 - DNA, 25 bp, E. coli
aatggctggagttatgagtgatgac

SEQ ID NO: 96051 - DNA, 25 bp, E. coli
aaggcaatacaatgttgttatttcc

SEQ ID NO: 96052 - DNA, 25 bp, E. coli
aaggcaatacaaagttgttatttcc

SEQ ID NO: 96053 - DNA, 25 bp, E. coli
tagtctccagtcttttaatggctgg

SEQ ID NO: 96054 - DNA, 25 bp, E. coli
tagtctccagtcatttaatggctgg

SEQ ID NO: 96055 - DNA, 25 bp, E. coli
tattgtgtggctaaaatatttccag

SEQ ID NO: 96056 - DNA, 25 bp, E. coli
tattgtgtggcttaaatatttccag

SEQ ID NO: 96057 - DNA, 25 bp, E. coli
gaaagcccaacaacaacccacaatg

SEQ ID NO: 96058 - DNA, 25 bp, E. coli
gaaagcccaacatcaacccacaatg

SEQ ID NO: 96059 - DNA, 25 bp, E. coli
gatttagctgctatatattgtgtgg

SEQ ID NO: 96060 - DNA, 25 bp, E. coli
gatttagctgctttatattgtgtgg

SEQ ID NO: 96061 - DNA, 25 bp, E. coli
ttttttatgaaagcccaacatcaac

SEQ ID NO: 96062 - DNA, 25 bp, E. coli
ttttaagtaattcggatttagctgc

SEQ ID NO: 96063 - DNA, 25 bp, E. coli
ttttaagtaattgggatttagctgc

SEQ ID NO: 96064 - DNA, 25 bp, E. coli
ttttttatgaaaccccaacatcaac

SEQ ID NO: 96065 - DNA, 25 bp, E. coli
ggctaaaatatttccagatggagaa

SEQ ID NO: 96066 - DNA, 25 bp, E. coli
ggctaaaatattaccagatggagaa

SEQ ID NO: 96067 - DNA, 25 bp, E. coli
taatgctagttctaaaaagatgtat

SEQ ID NO: 96068 - DNA, 25 bp, E. coli
taatgctagttcaaaaaagatgtat

SEQ ID NO: 96069 - DNA, 25 bp, E. coli
gttatttccttgctttagtctccag

SEQ ID NO: 96070 - DNA, 25 bp, E. coli
gttatttccttggtttagtctccag

SEQ ID NO: 96071 - DNA, 25 bp, E. coli
cagtaaagtttaagtcgatgaccag

SEQ ID NO: 96072 - DNA, 25 bp, E. coli
cagtaaagtttatgtcgatgaccag

SEQ ID NO: 96073 - DNA, 25 bp, E. coli
caggttggcgtgtcctggacatcca

SEQ ID NO: 96074 - DNA, 25 bp, E. coli
caggttggcgtgacctggacatcca

SEQ ID NO: 96075 - DNA, 25 bp, E. coli
tttgccgtacgccacaaacggtacg

SEQ ID NO: 96076 - DNA, 25 bp, E. coli
tttgccgtacgcgacaaacggtacg

SEQ ID NO: 96077 - DNA, 25 bp, E. coli
tcgaaaaaaccaataacgtcatcgg

SEQ ID NO: 96078 - DNA, 25 bp, E. coli
tcgaaaaaaccattaacgtcatcgg

SEQ ID NO: 96079 - DNA, 25 bp, E. coli
tcggcaatatgcttttctcggaagg

SEQ ID NO: 96080 - DNA, 25 bp, E. coli
tcggcaatatgcatttctcggaagg

SEQ ID NO: 96081 - DNA, 25 bp, E. coli
tctcggaagggataaagcaaatcag

SEQ ID NO: 96082 - DNA, 25 bp, E. coli
tctcggaagggaaaaagcaaatcag

SEQ ID NO: 96083 - DNA, 25 bp, E. coli
gaatgttttcatacaggacgtccct

SEQ ID NO: 96084 - DNA, 25 bp, E. coli
gaatgttttcattcaggacgtccct

SEQ ID NO: 96085 - DNA, 25 bp, E. coli
gaagatcttcctcatttgccgtacg

SEQ ID NO: 96086 - DNA, 25 bp, E. coli
gaagatcttcctgatttgccgtacg

SEQ ID NO: 96087 - DNA, 25 bp, E. coli
cgatgaccaggatctcacggactta

SEQ ID NO: 96088 - DNA, 25 bp, E. coli
cgatgaccaggaactcacggactta

SEQ ID NO: 96089 - DNA, 25 bp, E. coli
gacctgaaagatgtcaacgtcggca

SEQ ID NO: 96090 - DNA, 25 bp, E. coli
gacgtccctggccatcaaaaagaac

SEQ ID NO: 96091 - DNA, 25 bp, E. coli
gacctgaaagatctcaacgtcggca

SEQ ID NO: 96092 - DNA, 25 bp, E. coli
gacgtccctggcgatcaaaaagaac

SEQ ID NO: 96093 - DNA, 25 bp, E. coli
caacctggccagacaaaattgttcc

SEQ ID NO: 96094 - DNA, 25 bp, E. coli
caacctggccagtcaaaattgttcc

SEQ ID NO: 96095 - DNA, 25 bp, E. coli
cagacaaaattgttccgtagacagt

SEQ ID NO: 96096 - DNA, 25 bp, E. coli
cttcttcgtgaatgcggtttgttgc

SEQ ID NO: 96097 - DNA, 25 bp, E. coli
cttcttcgtgaaagcggtttgttgc

SEQ ID NO: 96098 - DNA, 25 bp, E. coli
catctggcgcttcttcgtgaaagcg

SEQ ID NO: 96099 - DNA, 25 bp, E. coli
cagacaaaattgatccgtagacagt

SEQ ID NO: 96100 - DNA, 25 bp, E. coli
catctggcgcttgttcgtgaaagcg

SEQ ID NO: 96101 - DNA, 25 bp, E. coli
tagacagtaagaacacttgtagtta

SEQ ID NO: 96102 - DNA, 25 bp, E. coli
tagacagtaagatcacttgtagtta

SEQ ID NO: 96103 - DNA, 25 bp, E. coli
atgggccgcgaatattattgagcag

SEQ ID NO: 96104 - DNA, 25 bp, E. coli
atgggccgcgaaaattattgagcag

SEQ ID NO: 96105 - DNA, 25 bp, E. coli
tttgttgctggatcgcaagcagggt

SEQ ID NO: 96106 - DNA, 25 bp, E. coli
ttccgtagacagtaagaacacttgt

SEQ ID NO: 96107 - DNA, 25 bp, E. coli
ttccgtagacagaaagaacacttgt

SEQ ID NO: 96108 - DNA, 25 bp, E. coli
tttgttgctggaacgcaagcagggt

SEQ ID NO: 96109 - DNA, 25 bp, E. coli
tgtccgcaacctcgccagacaaaat

SEQ ID NO: 96110 - DNA, 25 bp, E. coli
tgtccgcaacctggccagacaaaat

SEQ ID NO: 96111 - DNA, 25 bp, E. coli
tcatgggccgcgaaaattattgagc

SEQ ID NO: 96112 - DNA, 25 bp, E. coli
tcatgggccgcgtaaattattgagc

SEQ ID NO: 96113 - DNA, 25 bp, E. coli
cgccatctggcgcttcttcgtgaaa

SEQ ID NO: 96114 - DNA, 25 bp, E. coli
cgccatctggcggttcttcgtgaaa

SEQ ID NO: 96115 - DNA, 25 bp, E. coli
caaagtttatgtaggcaataaccct

SEQ ID NO: 96116 - DNA, 25 bp, E. coli
caaagtttatgttggcaataaccct

SEQ ID NO: 96117 - DNA, 25 bp, E. coli
catccagaacgtaccatttgttgcg

SEQ ID NO: 96118 - DNA, 25 bp, E. coli
catccagaacgttccatttgttgcg

SEQ ID NO: 96119 - DNA, 25 bp, E. coli
ttgttcccgccgacatccagaacgt

SEQ ID NO: 96120 - DNA, 25 bp, E. coli
ttgttcccgccgtcatccagaacgt

SEQ ID NO: 96121 - DNA, 25 bp, E. coli
tctggcgtagaaaaatccgtttcct

SEQ ID NO: 96122 - DNA, 25 bp, E. coli
tctggcgtagaataatccgtttcct

SEQ ID NO: 96123 - DNA, 25 bp, E. coli
gccgttcgcattacttctggcgtag

SEQ ID NO: 96124 - DNA, 25 bp, E. coli
gccgttcgcatttcttctggcgtag

SEQ ID NO: 96125 - DNA, 25 bp, E. coli
gaaccgcttattaacaaagtttatg

SEQ ID NO: 96126 - DNA, 25 bp, E. coli
gaaccgcttatttacaaagtttatg

SEQ ID NO: 96127 - DNA, 25 bp, E. coli
tcgaggttgggaaaagccgttcgca

SEQ ID NO: 96128 - DNA, 25 bp, E. coli
tcgaggttgggataagccgttcgca

SEQ ID NO: 96129 - DNA, 25 bp, E. coli
cgtaccatttgtagcgatatttaaa

SEQ ID NO: 96130 - DNA, 25 bp, E. coli
cgtaccatttgttgcgatatttaaa

SEQ ID NO: 96131 - DNA, 25 bp, E. coli
ggcaataaccctaagattgttcccg

SEQ ID NO: 96132 - DNA, 25 bp, E. coli
ggcaataacccttagattgttcccg

SEQ ID NO: 96133 - DNA, 25 bp, E. coli
gatgtgcttcactaagaaccgctta

SEQ ID NO: 96134 - DNA, 25 bp, E. coli
gatatttaaaatagtcgaggttggg

SEQ ID NO: 96135 - DNA, 25 bp, E. coli
gatatttaaaattgtcgaggttggg

SEQ ID NO: 96136 - DNA, 25 bp, E. coli
gatgtgcttcacaaagaaccgctta

SEQ ID NO: 96137 - DNA, 25 bp, E. coli
caatacccggtttctggtggagccg

SEQ ID NO: 96138 - DNA, 25 bp, E. coli
caatacccggttactggtggagccg

SEQ ID NO: 96139 - DNA, 25 bp, E. coli
tttcagtaacgcacgggtgattcgt

SEQ ID NO: 96140 - DNA, 25 bp, E. coli
tttcagtaacgctcgggtgattcgt

SEQ ID NO: 96141 - DNA, 25 bp, E. coli
taacgcacgggtcattcgtgctgct

SEQ ID NO: 96142 - DNA, 25 bp, E. coli
tgctgccgttttacagtaacgcacg

SEQ ID NO: 96143 - DNA, 25 bp, E. coli
tgactggctgttgcgccatattaaa

SEQ ID NO: 96144 - DNA, 25 bp, E. coli
tgctgccgtttttcagtaacgcacg

SEQ ID NO: 96145 - DNA, 25 bp, E. coli
tgactggctgttccgccatattaaa

SEQ ID NO: 96146 - DNA, 25 bp, E. coli
gccgctggtggaagacaaaacattg

SEQ ID NO: 96147 - DNA, 25 bp, E. coli
gccgctggtggatgacaaaacattg

SEQ ID NO: 96148 - DNA, 25 bp, E. coli
gctgttgcgccaaattaaatcctgc

SEQ ID NO: 96149 - DNA, 25 bp, E. coli
gctgttgcgccatattaaatcctgc

SEQ ID NO: 96150 - DNA, 25 bp, E. coli
cgtttttcagtatcgcacgggtgat

SEQ ID NO: 96151 - DNA, 25 bp, E. coli
cgtttttcagtaacgcacgggtgat

SEQ ID NO: 96152 - DNA, 25 bp, E. coli
ctggtggtgctgctgcattgtctga

SEQ ID NO: 96153 - DNA, 25 bp, E. coli
ctggtggtgctggtgcattgtctga

SEQ ID NO: 96154 - DNA, 25 bp, E. coli
tggaagacaaaagattgctgccgtt

SEQ ID NO: 96155 - DNA, 25 bp, E. coli
tggaagacaaaacattgctgccgtt

SEQ ID NO: 96156 - DNA, 25 bp, E. coli
taacgcacgggtgattcgtgctgct

SEQ ID NO: 96157 - DNA, 25 bp, E. coli
taagccagccgacgatccccatcac

SEQ ID NO: 96158 - DNA, 25 bp, E. coli
taagccagccgaggatccccatcac

SEQ ID NO: 96159 - DNA, 25 bp, E. coli
cagaaaaaatactctctgccggtgt

SEQ ID NO: 96160 - DNA, 25 bp, E. coli
cagaaaaaatacactctgccggtgt

SEQ ID NO: 96161 - DNA, 25 bp, E. coli
tatggatgagcggagaagaactgat

SEQ ID NO: 96162 - DNA, 25 bp, E. coli
tatggatgagcgcagaagaactgat

SEQ ID NO: 96163 - DNA, 25 bp, E. coli
ttaggcttacccgatgaagatgggc

SEQ ID NO: 96164 - DNA, 25 bp, E. coli
ttaggcttaccccatgaagatgggc

SEQ ID NO: 96165 - DNA, 25 bp, E. coli
tgaagatgggctccattttcttgcc

SEQ ID NO: 96166 - DNA, 25 bp, E. coli
tgaagatgggctgcattttcttgcc

SEQ ID NO: 96167 - DNA, 25 bp, E. coli
tgatgcttaaagcaggcagcccggt

SEQ ID NO: 96168 - DNA, 25 bp, E. coli
tgatgcttaaaggaggcagcccggt

SEQ ID NO: 96169 - DNA, 25 bp, E. coli
tgagctgaacgtaggcaacctgacg

SEQ ID NO: 96170 - DNA, 25 bp, E. coli
tgagctgaacgttggcaacctgacg

SEQ ID NO: 96171 - DNA, 25 bp, E. coli
cctgacgctgaaaatgggtcgccgc

SEQ ID NO: 96172 - DNA, 25 bp, E. coli
cctgacgctgaatatgggtcgccgc

SEQ ID NO: 96173 - DNA, 25 bp, E. coli
ctgtcgcgcctgatgcttaaagcag

SEQ ID NO: 96174 - DNA, 25 bp, E. coli
ctgtcgcgcctgttgcttaaagcag

SEQ ID NO: 96175 - DNA, 25 bp, E. coli
gatatctacaacagggacaacgagc

SEQ ID NO: 96176 - DNA, 25 bp, E. coli
gatatctacaactgggacaacgagc

SEQ ID NO: 96177 - DNA, 25 bp, E. coli
ggtgttaattctgaccgcccgcgat

SEQ ID NO: 96178 - DNA, 25 bp, E. coli
ggagaagaactgtttctgacgccca

SEQ ID NO: 96179 - DNA, 25 bp, E. coli
ggagaagaactgattctgacgccca

SEQ ID NO: 96180 - DNA, 25 bp, E. coli
ggtgttaattctcaccgcccgcgat

SEQ ID NO: 96181 - DNA, 25 bp, E. coli
caaatatcagggagtaacgttgacc

SEQ ID NO: 96182 - DNA, 25 bp, E. coli
caaatatcagggtgtaacgttgacc

SEQ ID NO: 96183 - DNA, 25 bp, E. coli
tgctattaaccggacgaagcgtggt

SEQ ID NO: 96184 - DNA, 25 bp, E. coli
tgctattaaccgcacgaagcgtggt

SEQ ID NO: 96185 - DNA, 25 bp, E. coli
tcttttagccggaatcggcccgatg

SEQ ID NO: 96186 - DNA, 25 bp, E. coli
tcttttagccggtatcggcccgatg

SEQ ID NO: 96187 - DNA, 25 bp, E. coli
cctctgagcgactaaatagggcgta

SEQ ID NO: 96188 - DNA, 25 bp, E. coli
cctctgagcgacaaaatagggcgta

SEQ ID NO: 96189 - DNA, 25 bp, E. coli
gctcttcgtcgttcgtgttgcagaa

SEQ ID NO: 96190 - DNA, 25 bp, E. coli
gctcttcgtcgtacgtgttgcagaa

SEQ ID NO: 96191 - DNA, 25 bp, E. coli
gaagcgtggtgctgaaccgccgttt

SEQ ID NO: 96192 - DNA, 25 bp, E. coli
gaagcgtggtgcagaaccgccgttt

SEQ ID NO: 96193 - DNA, 25 bp, E. coli
gacaactgttatatggccctctgag

SEQ ID NO: 96194 - DNA, 25 bp, E. coli
gacaactgttatttggccctctgag

SEQ ID NO: 96195 - DNA, 25 bp, E. coli
cggctttgccggtgatgtctgagca

SEQ ID NO: 96196 - DNA, 25 bp, E. coli
cattgttagcacttttgactggcgc

SEQ ID NO: 96197 - DNA, 25 bp, E. coli
cggctttgccggagatgtctgagca

SEQ ID NO: 96198 - DNA, 25 bp, E. coli
cattgttagcacatttgactggcgc

SEQ ID NO: 96199 - DNA, 25 bp, E. coli
taatgacggtgattggcctggcacc

SEQ ID NO: 96200 - DNA, 25 bp, E. coli
taatgacggtgaatggcctggcacc

SEQ ID NO: 96201 - DNA, 25 bp, E. coli
gactggcgcactttattctgggtaa

SEQ ID NO: 96202 - DNA, 25 bp, E. coli
gactggcgcactatattctgggtaa

SEQ ID NO: 96203 - DNA, 25 bp, E. coli
cagatgagattttcgttatcgatgg

SEQ ID NO: 96204 - DNA, 25 bp, E. coli
cataaggctcttttcagaaaaagcg

SEQ ID NO: 96205 - DNA, 25 bp, E. coli
cagatgagatttacgttatcgatgg

SEQ ID NO: 96206 - DNA, 25 bp, E. coli
cataaggctcttatcagaaaaagcg

SEQ ID NO: 96207 - DNA, 25 bp, E. coli
taactggccctgctgttttttctca

SEQ ID NO: 96208 - DNA, 25 bp, E. coli
aaatcgattctgttattggtgaact

SEQ ID NO: 96209 - DNA, 25 bp, E. coli
aaatcgattctgatattggtgaact

SEQ ID NO: 96210 - DNA, 25 bp, E. coli
ttttctcagtgcaaggtgattatct

SEQ ID NO: 96211 - DNA, 25 bp, E. coli
ttttctcagtgctaggtgattatct

SEQ ID NO: 96212 - DNA, 25 bp, E. coli
tgtggcagagttatctgtaaacagg

SEQ ID NO: 96213 - DNA, 25 bp, E. coli
tgtggcagagttttctgtaaacagg

SEQ ID NO: 96214 - DNA, 25 bp, E. coli
tcagaaaaagcgtgatgattggttc

SEQ ID NO: 96215 - DNA, 25 bp, E. coli
gattggttctggtgttttgattcag

SEQ ID NO: 96216 - DNA, 25 bp, E. coli
gattggttctggagttttgattcag

SEQ ID NO: 96217 - DNA, 25 bp, E. coli
ggtgattatcttaatcataaggctc

SEQ ID NO: 96218 - DNA, 25 bp, E. coli
ggtgaactttgttcttgtggcagag

SEQ ID NO: 96219 - DNA, 25 bp, E. coli
ggtgattatctttatcataaggctc

SEQ ID NO: 96220 - DNA, 25 bp, E. coli
ggtgaactttgtacttgtggcagag

SEQ ID NO: 96221 - DNA, 25 bp, E. coli
taacgttttcagcataagaaaatcg

SEQ ID NO: 96222 - DNA, 25 bp, E. coli
tcagaaaaagcgagatgattggttc

SEQ ID NO: 96223 - DNA, 25 bp, E. coli
taacgttttcaggataagaaaatcg

SEQ ID NO: 96224 - DNA, 25 bp, E. coli
taactggccctggtgttttttctca

SEQ ID NO: 96225 - DNA, 25 bp, E. coli
aattcaccaacgcatgcaggaggcc

SEQ ID NO: 96226 - DNA, 25 bp, E. coli
aaggcccttacaacagtcacggtgg

SEQ ID NO: 96227 - DNA, 25 bp, E. coli
aattcaccaacggatgcaggaggcc

SEQ ID NO: 96228 - DNA, 25 bp, E. coli
aaggcccttacatcagtcacggtgg

SEQ ID NO: 96229 - DNA, 25 bp, E. coli
tactacagctttgcgcggatatcga

SEQ ID NO: 96230 - DNA, 25 bp, E. coli
tactacagctttccgcggatatcga

SEQ ID NO: 96231 - DNA, 25 bp, E. coli
tgacggcgctggtgatgcaattaca

SEQ ID NO: 96232 - DNA, 25 bp, E. coli
tgacggcgctggagatgcaattaca

SEQ ID NO: 96233 - DNA, 25 bp, E. coli
cctttacagaggacattgcggaacg

SEQ ID NO: 96234 - DNA, 25 bp, E. coli
cctttacagaggtcattgcggaacg

SEQ ID NO: 96235 - DNA, 25 bp, E. coli
gcattgcgttgcgaccggatcagca

SEQ ID NO: 96236 - DNA, 25 bp, E. coli
gcattgcgttgccaccggatcagca

SEQ ID NO: 96237 - DNA, 25 bp, E. coli
ctttttcaacactggctcggctgga

SEQ ID NO: 96238 - DNA, 25 bp, E. coli
cggctataaactcggattcggcaaa

SEQ ID NO: 96239 - DNA, 25 bp, E. coli
cattggcaaatatgctgacggcgct

SEQ ID NO: 96240 - DNA, 25 bp, E. coli
cggctataaactgggattcggcaaa

SEQ ID NO: 96241 - DNA, 25 bp, E. coli
cattggcaaataagctgacggcgct

SEQ ID NO: 96242 - DNA, 25 bp, E. coli
ctttttcaacacaggctcggctgga

SEQ ID NO: 96243 - DNA, 25 bp, E. coli
ggaaaacctgctaccctgaccgtgg

SEQ ID NO: 96244 - DNA, 25 bp, E. coli
ggaaaacctgcttccctgaccgtgg

SEQ ID NO: 96245 - DNA, 25 bp, E. coli
taatagtgatgtaccgcttgccgca

SEQ ID NO: 96246 - DNA, 25 bp, E. coli
taatagtgatgttccgcttgccgca

SEQ ID NO: 96247 - DNA, 25 bp, E. coli
caatgcttcggtatcgtcgcagcgg

SEQ ID NO: 96248 - DNA, 25 bp, E. coli
caatgcttcggtttcgtcgcagcgg

SEQ ID NO: 96249 - DNA, 25 bp, E. coli
gcgaccgtgaaaccctgttctgggt

SEQ ID NO: 96250 - DNA, 25 bp, E. coli
gcgaccgtgaaagcctgttctgggt

SEQ ID NO: 96251 - DNA, 25 bp, E. coli
cattacagctggcaattattagccg

SEQ ID NO: 96252 - DNA, 25 bp, E. coli
cattacagctgggaattattagccg

SEQ ID NO: 96253 - DNA, 25 bp, E. coli
tagcaatctccctaacaccatggtg

SEQ ID NO: 96254 - DNA, 25 bp, E. coli
tatccggcaaacgagaaacaggttt

SEQ ID NO: 96255 - DNA, 25 bp, E. coli
tatccggcaaaccagaaacaggttt

SEQ ID NO: 96256 - DNA, 25 bp, E. coli
tagcaatctcccaaacaccatggtg

SEQ ID NO: 96257 - DNA, 25 bp, E. coli
tccgcgtattaaggcaaccatgcag

SEQ ID NO: 96258 - DNA, 25 bp, E. coli
tgcctgtcacgaataatgatcctgc

SEQ ID NO: 96259 - DNA, 25 bp, E. coli
tgccagtgtctatctcattcagtca

SEQ ID NO: 96260 - DNA, 25 bp, E. coli
tgcctgtcacgattaatgatcctgc

SEQ ID NO: 96261 - DNA, 25 bp, E. coli
tccgcgtattaacgcaaccatgcag

SEQ ID NO: 96262 - DNA, 25 bp, E. coli
tgccagtgtctaactcattcagtca

SEQ ID NO: 96263 - DNA, 25 bp, E. coli
ccatggtgccgccaaaaggtgaagt

SEQ ID NO: 96264 - DNA, 25 bp, E. coli
ccatggtgccgcgaaaaggtgaagt

SEQ ID NO: 96265 - DNA, 25 bp, E. coli
gcgacgcgggtaatttatccggcaa

SEQ ID NO: 96266 - DNA, 25 bp, E. coli
gcgacgcgggtattttatccggcaa

SEQ ID NO: 96267 - DNA, 25 bp, E. coli
ctggcaatggcagctgaagaagcgc

SEQ ID NO: 96268 - DNA, 25 bp, E. coli
ctggcaatggcacctgaagaagcgc

SEQ ID NO: 96269 - DNA, 25 bp, E. coli
aatatcagctatgccggacagggcg

SEQ ID NO: 96270 - DNA, 25 bp, E. coli
aatatcagctatcccggacagggcg

SEQ ID NO: 96271 - DNA, 25 bp, E. coli
tacgtggtgtttttgatgaccctga

SEQ ID NO: 96272 - DNA, 25 bp, E. coli
tacgcgggtacaagggaacgtcagc

SEQ ID NO: 96273 - DNA, 25 bp, E. coli
tacgtggtgtttatgatgaccctga

SEQ ID NO: 96274 - DNA, 25 bp, E. coli
tacgcgggtacatgggaacgtcagc

SEQ ID NO: 96275 - DNA, 25 bp, E. coli
ttttgatgaccctgaaaatatcagc

SEQ ID NO: 96276 - DNA, 25 bp, E. coli
ttttgatgacccagaaaatatcagc

SEQ ID NO: 96277 - DNA, 25 bp, E. coli
gaaaatatcagcaatgccggacagg

SEQ ID NO: 96278 - DNA, 25 bp, E. coli
gaaaatatcagctatgccggacagg

SEQ ID NO: 96279 - DNA, 25 bp, E. coli
ccgatgaaacgaaacgcgggtacat

SEQ ID NO: 96280 - DNA, 25 bp, E. coli
ccgatgaaacgatacgcgggtacat

SEQ ID NO: 96281 - DNA, 25 bp, E. coli
cgtccctgtttgaccggactgatga

SEQ ID NO: 96282 - DNA, 25 bp, E. coli
cgtccctgtttgtccggactgatga

SEQ ID NO: 96283 - DNA, 25 bp, E. coli
gttgaaggctcctgcccgtccctgt

SEQ ID NO: 96284 - DNA, 25 bp, E. coli
gttgaaggctccagcccgtccctgt

SEQ ID NO: 96285 - DNA, 25 bp, E. coli
gataacctgttccatgctgccattg

SEQ ID NO: 96286 - DNA, 25 bp, E. coli
gataacctgttcgatgctgccattg

SEQ ID NO: 96287 - DNA, 25 bp, E. coli
gtggctgatttcgataacctgttcg

SEQ ID NO: 96288 - DNA, 25 bp, E. coli
ggtacatgggaaggtcagccaccat

SEQ ID NO: 96289 - DNA, 25 bp, E. coli
ggtacatgggaacgtcagccaccat

SEQ ID NO: 96290 - DNA, 25 bp, E. coli
gtggctgatttccataacctgttcg

SEQ ID NO: 96291 - DNA, 25 bp, E. coli
caaaagtccgcatccaaatgtatcg

SEQ ID NO: 96292 - DNA, 25 bp, E. coli
cagcctcctgtttatgttagcgaac

SEQ ID NO: 96293 - DNA, 25 bp, E. coli
caaaagtccgcaaccaaatgtatcg

SEQ ID NO: 96294 - DNA, 25 bp, E. coli
cagcctcctgttaatgttagcgaac

SEQ ID NO: 96295 - DNA, 25 bp, E. coli
attttgatgaaatcgctgtgcgcgc

SEQ ID NO: 96296 - DNA, 25 bp, E. coli
attttgatgaaaacgctgtgcgcgc

SEQ ID NO: 96297 - DNA, 25 bp, E. coli
aaatgtatcgccagttaacgccgga

SEQ ID NO: 96298 - DNA, 25 bp, E. coli
aaatgtatcgcctgttaacgccgga

SEQ ID NO: 96299 - DNA, 25 bp, E. coli
tttaaccgaacatcagcgtcagcag

SEQ ID NO: 96300 - DNA, 25 bp, E. coli
tttaaccgaacaacagcgtcagcag

SEQ ID NO: 96301 - DNA, 25 bp, E. coli
tgttcgacggcataagtttaaccga

SEQ ID NO: 96302 - DNA, 25 bp, E. coli
tgttcgacggcaaaagtttaaccga

SEQ ID NO: 96303 - DNA, 25 bp, E. coli
tcaggttgagatggcaaaagtccgc

SEQ ID NO: 96304 - DNA, 25 bp, E. coli
tcaggttgagatcgcaaaagtccgc

SEQ ID NO: 96305 - DNA, 25 bp, E. coli
gttagcgaactggagacaatgcatc

SEQ ID NO: 96306 - DNA, 25 bp, E. coli
gttagcgaactgcagacaatgcatc

SEQ ID NO: 96307 - DNA, 25 bp, E. coli
taacgccggagcagcaagcggtttt

SEQ ID NO: 96308 - DNA, 25 bp, E. coli
taacgccggagctgcaagcggtttt

SEQ ID NO: 96309 - DNA, 25 bp, E. coli
gagtagtagcaagtcacgttcccag

SEQ ID NO: 96310 - DNA, 25 bp, E. coli
gagatcttatgctacaggcccggca

SEQ ID NO: 96311 - DNA, 25 bp, E. coli
gagatcttatgcaacaggcccggca

SEQ ID NO: 96312 - DNA, 25 bp, E. coli
gagtagtagcaactcacgttcccag

SEQ ID NO: 96313 - DNA, 25 bp, E. coli
tgtacctttttgtttaaccattggg

SEQ ID NO: 96314 - DNA, 25 bp, E. coli
agtttgcttacggactcacagggcg

SEQ ID NO: 96315 - DNA, 25 bp, E. coli
agtttgcttacgcactcacagggcg

SEQ ID NO: 96316 - DNA, 25 bp, E. coli
tgtacctttttgattaaccattggg

SEQ ID NO: 96317 - DNA, 25 bp, E. coli
tgagggaacccattacgtacgacac

SEQ ID NO: 96318 - DNA, 25 bp, E. coli
tgagggaacccaatacgtacgacac

SEQ ID NO: 96319 - DNA, 25 bp, E. coli
tgcttacccttttttcgagccgccg

SEQ ID NO: 96320 - DNA, 25 bp, E. coli
tgcttaccctttattcgagccgccg

SEQ ID NO: 96321 - DNA, 25 bp, E. coli
tcgagccgccgcatgatactgcttt

SEQ ID NO: 96322 - DNA, 25 bp, E. coli
tcgagccgccgcttgatactgcttt

SEQ ID NO: 96323 - DNA, 25 bp, E. coli
tcacgcaatcgtaaacctagtttgc

SEQ ID NO: 96324 - DNA, 25 bp, E. coli
tcacgcaatcgttaacctagtttgc

SEQ ID NO: 96325 - DNA, 25 bp, E. coli
gcatgatactgctttacgttgacaa

SEQ ID NO: 96326 - DNA, 25 bp, E. coli
gcatgatactgcattacgttgacaa

SEQ ID NO: 96327 - DNA, 25 bp, E. coli
gctttacgttgacaatgcaatggtt

SEQ ID NO: 96328 - DNA, 25 bp, E. coli
gctttacgttgagaatgcaatggtt

SEQ ID NO: 96329 - DNA, 25 bp, E. coli
gcaatggttaattttcacgcaatcg

SEQ ID NO: 96330 - DNA, 25 bp, E. coli
gcaatggttaatattcacgcaatcg

SEQ ID NO: 96331 - DNA, 25 bp, E. coli
gtacgacacgtcagttaccttaaca

SEQ ID NO: 96332 - DNA, 25 bp, E. coli
gtacgacacgtctgttaccttaaca

SEQ ID NO: 96333 - DNA, 25 bp, E. coli
tcacagggcgtatactagcgccgtt

SEQ ID NO: 96334 - DNA, 25 bp, E. coli
tcacagggcgtaaactagcgccgtt

SEQ ID NO: 96335 - DNA, 25 bp, E. coli
tatggtggcggaataccagtcccgg

SEQ ID NO: 96336 - DNA, 25 bp, E. coli
tatggtggcggattaccagtcccgg

SEQ ID NO: 96337 - DNA, 25 bp, E. coli
tattttatgtgaacgccagccggac

SEQ ID NO: 96338 - DNA, 25 bp, E. coli
tattttatgtgatcgccagccggac

SEQ ID NO: 96339 - DNA, 25 bp, E. coli
tgggagccatcaatacttacgcagc

SEQ ID NO: 96340 - DNA, 25 bp, E. coli
tgggagccatcattacttacgcagc

SEQ ID NO: 96341 - DNA, 25 bp, E. coli
tccttactggctcgacggtcactgt

SEQ ID NO: 96342 - DNA, 25 bp, E. coli
tccttactggctggacggtcactgt

SEQ ID NO: 96343 - DNA, 25 bp, E. coli
gcaaatcggtgaggaatcgcaggca

SEQ ID NO: 96344 - DNA, 25 bp, E. coli
gcaaatcggtgacgaatcgcaggca

SEQ ID NO: 96345 - DNA, 25 bp, E. coli
gaaacaatggctggctgcttcgccc

SEQ ID NO: 96346 - DNA, 25 bp, E. coli
gaaacaatggctcgctgcttcgccc

SEQ ID NO: 96347 - DNA, 25 bp, E. coli
cccaggcggaaaccgatggacgtac

SEQ ID NO: 96348 - DNA, 25 bp, E. coli
cttgcgcagcaagagtaccggatgt

SEQ ID NO: 96349 - DNA, 25 bp, E. coli
cgggctgctgtttaatgaccgcaca

SEQ ID NO: 96350 - DNA, 25 bp, E. coli
cccaggcggaaagcgatggacgtac

SEQ ID NO: 96351 - DNA, 25 bp, E. coli
cggcactgcgtcagggttacaaaca

SEQ ID NO: 96352 - DNA, 25 bp, E. coli
cgggctgctgttaaatgaccgcaca

SEQ ID NO: 96353 - DNA, 25 bp, E. coli
cttgcgcagcaacagtaccggatgt

SEQ ID NO: 96354 - DNA, 25 bp, E. coli
cggcactgcgtctgggttacaaaca

SEQ ID NO: 96355 - DNA, 25 bp, E. coli
gatatctggacatgctacccgaagg

SEQ ID NO: 96356 - DNA, 25 bp, E. coli
gatatctggacaagctacccgaagg

SEQ ID NO: 96357 - DNA, 25 bp, E. coli
cacgctttaggatagtgtaatggta

SEQ ID NO: 96358 - DNA, 25 bp, E. coli
cacgctttaggaaagtgtaatggta

SEQ ID NO: 96359 - DNA, 25 bp, E. coli
ttgtgatcagtagcacgtatcgagg

SEQ ID NO: 96360 - DNA, 25 bp, E. coli
ttgtgatcagtaccacgtatcgagg

SEQ ID NO: 96361 - DNA, 25 bp, E. coli
tgttcaggctgacctagcttcgctg

SEQ ID NO: 96362 - DNA, 25 bp, E. coli
tgttcaggctgagctagcttcgctg

SEQ ID NO: 96363 - DNA, 25 bp, E. coli
tgatgacagagtctccagtgggcac

SEQ ID NO: 96364 - DNA, 25 bp, E. coli
tgatgacagagtgtccagtgggcac

SEQ ID NO: 96365 - DNA, 25 bp, E. coli
gcccaacaatgttgaggttaacgaa

SEQ ID NO: 96366 - DNA, 25 bp, E. coli
ccagtgggcacggatggtgtcttac

SEQ ID NO: 96367 - DNA, 25 bp, E. coli
ccagtgggcacgcatggtgtcttac

SEQ ID NO: 96368 - DNA, 25 bp, E. coli
gcccaacaatgtagaggttaacgaa

SEQ ID NO: 96369 - DNA, 25 bp, E. coli
gctacaaatttgtcgctgggtgaga

SEQ ID NO: 96370 - DNA, 25 bp, E. coli
gctacaaatttgacgctgggtgaga

SEQ ID NO: 96371 - DNA, 25 bp, E. coli
gcttcgctgacacacaatattgtga

SEQ ID NO: 96372 - DNA, 25 bp, E. coli
gcttcgctgacagacaatattgtga

SEQ ID NO: 96373 - DNA, 25 bp, E. coli
cgtatcgaggaggagtagcgctaca

SEQ ID NO: 96374 - DNA, 25 bp, E. coli
cgtatcgaggagcagtagcgctaca

SEQ ID NO: 96375 - DNA, 25 bp, E. coli
gtgtcttacgacatgcttaccttaa

SEQ ID NO: 96376 - DNA, 25 bp, E. coli
gtgtcttacgacttgcttaccttaa

SEQ ID NO: 96377 - DNA, 25 bp, E. coli
taatcgttcccagtgtgcctatagc

SEQ ID NO: 96378 - DNA, 25 bp, E. coli
taatcgttcccactgtgcctatagc

SEQ ID NO: 96379 - DNA, 25 bp, E. coli
aatgcggtggagtttctacctgaaa

SEQ ID NO: 96380 - DNA, 25 bp, E. coli
aatgcggtggagattctacctgaaa

SEQ ID NO: 96381 - DNA, 25 bp, E. coli
cagtggtcaaatgcggtggagtttc

SEQ ID NO: 96382 - DNA, 25 bp, E. coli
cagtggtcaaatccggtggagtttc

SEQ ID NO: 96383 - DNA, 25 bp, E. coli
tactgggtaatgttcagcgcgcgca

SEQ ID NO: 96384 - DNA, 25 bp, E. coli
tactgggtaatgatcagcgcgcgca

SEQ ID NO: 96385 - DNA, 25 bp, E. coli
agcggtgcgtaatctactgggtaat

SEQ ID NO: 96386 - DNA, 25 bp, E. coli
acgcaccattctcgatgtcggctgc

SEQ ID NO: 96387 - DNA, 25 bp, E. coli
agcggtgcgtaaactactgggtaat

SEQ ID NO: 96388 - DNA, 25 bp, E. coli
acgcaccattctggatgtcggctgc

SEQ ID NO: 96389 - DNA, 25 bp, E. coli
tattgcatagcgatacggcagaaag

SEQ ID NO: 96390 - DNA, 25 bp, E. coli
tattgcatagcgttacggcagaaag

SEQ ID NO: 96391 - DNA, 25 bp, E. coli
tctgtgccagtttgaagcggtgcgt

SEQ ID NO: 96392 - DNA, 25 bp, E. coli
tctgtgccagttagaagcggtgcgt

SEQ ID NO: 96393 - DNA, 25 bp, E. coli
cgttacggcagaaagcgaagagcca

SEQ ID NO: 96394 - DNA, 25 bp, E. coli
cgttacggcagatagcgaagagcca

SEQ ID NO: 96395 - DNA, 25 bp, E. coli
gggatcgaccctacgcaactgtttc

SEQ ID NO: 96396 - DNA, 25 bp, E. coli
gggatcgacccttcgcaactgtttc

SEQ ID NO: 96397 - DNA, 25 bp, E. coli
tggttttgtagatatccgcattgcg

SEQ ID NO: 96398 - DNA, 25 bp, E. coli
tggttttgtagaaatccgcattgcg

SEQ ID NO: 96399 - DNA, 25 bp, E. coli
tcaactggtcaatgaaggtgaactg

SEQ ID NO: 96400 - DNA, 25 bp, E. coli
tcaactggtcaaagaaggtgaactg

SEQ ID NO: 96401 - DNA, 25 bp, E. coli
tgattggccatgatgatatccgcag

SEQ ID NO: 96402 - DNA, 25 bp, E. coli
tgattggccatgttgatatccgcag

SEQ ID NO: 96403 - DNA, 25 bp, E. coli
tcatcgagtgcaacagggagcaatg

SEQ ID NO: 96404 - DNA, 25 bp, E. coli
tcacgcaacacgctggagatgcttc

SEQ ID NO: 96405 - DNA, 25 bp, E. coli
tcttcagtgacaaaatcatcgagtg

SEQ ID NO: 96406 - DNA, 25 bp, E. coli
tcttcagtgacataatcatcgagtg

SEQ ID NO: 96407 - DNA, 25 bp, E. coli
tcatcgagtgcatcagggagcaatg

SEQ ID NO: 96408 - DNA, 25 bp, E. coli
gaaaaagttagtccgtctcatgggt

SEQ ID NO: 96409 - DNA, 25 bp, E. coli
gaaaaagttagtgcgtctcatgggt

SEQ ID NO: 96410 - DNA, 25 bp, E. coli
cgatatgccaccgacccgtgatgaa

SEQ ID NO: 96411 - DNA, 25 bp, E. coli
cgatatgccacccacccgtgatgaa

SEQ ID NO: 96412 - DNA, 25 bp, E. coli
cccgtgatgaacagattaaacttat

SEQ ID NO: 96413 - DNA, 25 bp, E. coli
cccgtgatgaactgattaaacttat

SEQ ID NO: 96414 - DNA, 25 bp, E. coli
ggcaacgaaccgacaataattaatt

SEQ ID NO: 96415 - DNA, 25 bp, E. coli
gggagcaatgtcacctgatgcctgc

SEQ ID NO: 96416 - DNA, 25 bp, E. coli
gggagcaatgtctcctgatgcctgc

SEQ ID NO: 96417 - DNA, 25 bp, E. coli
ggcaacgaaccgtcaataattaatt

SEQ ID NO: 96418 - DNA, 25 bp, E. coli
tcacgcaacacggtggagatgcttc

SEQ ID NO: 96419 - DNA, 25 bp, E. coli
gagatgcttcataacaacggcaacg

SEQ ID NO: 96420 - DNA, 25 bp, E. coli
gagatgcttcattacaacggcaacg

SEQ ID NO: 96421 - DNA, 25 bp, E. coli
gatgcctgccttctccttgaatgtg

SEQ ID NO: 96422 - DNA, 25 bp, E. coli
gatgcctgccttgtccttgaatgtg

SEQ ID NO: 96423 - DNA, 25 bp, E. coli
cataacaagtatttcgggtaagggt

SEQ ID NO: 96424 - DNA, 25 bp, E. coli
cagtacgccgctaacgcaattgcta

SEQ ID NO: 96425 - DNA, 25 bp, E. coli
cataacaagtatatcgggtaagggt

SEQ ID NO: 96426 - DNA, 25 bp, E. coli
cagtacgccgcttacgcaattgcta

SEQ ID NO: 96427 - DNA, 25 bp, E. coli
taccgcagttacaatcatagccccg

SEQ ID NO: 96428 - DNA, 25 bp, E. coli
taccgcagttactatcatagccccg

SEQ ID NO: 96429 - DNA, 25 bp, E. coli
taggcccgctagaaatgcgctacgg

SEQ ID NO: 96430 - DNA, 25 bp, E. coli
taggcccgctagtaatgcgctacgg

SEQ ID NO: 96431 - DNA, 25 bp, E. coli
tatactttacagcaacagtacgccg

SEQ ID NO: 96432 - DNA, 25 bp, E. coli
tatttccgggattaatgtactaccg

SEQ ID NO: 96433 - DNA, 25 bp, E. coli
tatttccgggataaatgtactaccg

SEQ ID NO: 96434 - DNA, 25 bp, E. coli
tatactttacaggaacagtacgccg

SEQ ID NO: 96435 - DNA, 25 bp, E. coli
tgttaaaccctgataatcgctccgg

SEQ ID NO: 96436 - DNA, 25 bp, E. coli
tgttaaaccctgttaatcgctccgg

SEQ ID NO: 96437 - DNA, 25 bp, E. coli
ccatattgttgtattaggcccgcta

SEQ ID NO: 96438 - DNA, 25 bp, E. coli
ccatattgttgttttaggcccgcta

SEQ ID NO: 96439 - DNA, 25 bp, E. coli
taagggtttctgatccgcacacgca

SEQ ID NO: 96440 - DNA, 25 bp, E. coli
taataagcaaaagaggactgaactg

SEQ ID NO: 96441 - DNA, 25 bp, E. coli
taagggtttctgttccgcacacgca

SEQ ID NO: 96442 - DNA, 25 bp, E. coli
taataagcaaaacaggactgaactg

SEQ ID NO: 96443 - DNA, 25 bp, E. coli
gacgcagagtatggttaagatgtcc

SEQ ID NO: 96444 - DNA, 25 bp, E. coli
gacgcagagtatcgttaagatgtcc

SEQ ID NO: 96445 - DNA, 25 bp, E. coli
caacgtctgatgtacgccatcggcg

SEQ ID NO: 96446 - DNA, 25 bp, E. coli
caacgtctgatgaacgccatcggcg

SEQ ID NO: 96447 - DNA, 25 bp, E. coli
catggctatctgaggatgcatcgta

SEQ ID NO: 96448 - DNA, 25 bp, E. coli
catggctatctgtggatgcatcgta

SEQ ID NO: 96449 - DNA, 25 bp, E. coli
tatcgctgtctgactttccgcatgg

SEQ ID NO: 96450 - DNA, 25 bp, E. coli
tatcgctgtctgtctttccgcatgg

SEQ ID NO: 96451 - DNA, 25 bp, E. coli
tgggcgatgcgctaaccctgttgcc

SEQ ID NO: 96452 - DNA, 25 bp, E. coli
tgggcgatgcgcaaaccctgttgcc

SEQ ID NO: 96453 - DNA, 25 bp, E. coli
tctatttcgccactcagatgacgct

SEQ ID NO: 96454 - DNA, 25 bp, E. coli
tctatttcgccagtcagatgacgct

SEQ ID NO: 96455 - DNA, 25 bp, E. coli
gaactgtggttcttccgtccgaccg

SEQ ID NO: 96456 - DNA, 25 bp, E. coli
gaactgtggttcatccgtccgaccg

SEQ ID NO: 96457 - DNA, 25 bp, E. coli
gttggcctatctccacgtttatcgg

SEQ ID NO: 96458 - DNA, 25 bp, E. coli
gttggcctatctgcacgtttatcgg

SEQ ID NO: 96459 - DNA, 25 bp, E. coli
ggcgcttcgttgctgtttatcagta

SEQ ID NO: 96460 - DNA, 25 bp, E. coli
tggcaacgctgggtgtttaaaccgt

SEQ ID NO: 96461 - DNA, 25 bp, E. coli
ggcgcttcgttggtgtttatcagta

SEQ ID NO: 96462 - DNA, 25 bp, E. coli
tggcaacgctggctgtttaaaccgt

SEQ ID NO: 96463 - DNA, 25 bp, E. coli
gatgttcgacgcgattagctatctg

SEQ ID NO: 96464 - DNA, 25 bp, E. coli
gatgcatcgtatggtgggccaacct

SEQ ID NO: 96465 - DNA, 25 bp, E. coli
gatgcatcgtatcgtgggccaacct

SEQ ID NO: 96466 - DNA, 25 bp, E. coli
gatgttcgacgccattagctatctg

SEQ ID NO: 96467 - DNA, 25 bp, E. coli
caatttgctggctgagctccgcgca

SEQ ID NO: 96468 - DNA, 25 bp, E. coli
caatttgctggcagagctccgcgca

SEQ ID NO: 96469 - DNA, 25 bp, E. coli
atttgctggcagagctccgcgcaca

SEQ ID NO: 96470 - DNA, 25 bp, E. coli
attcgcaatttggtggcagagctcc

SEQ ID NO: 96471 - DNA, 25 bp, E. coli
atttgctggcagtgctccgcgcaca

SEQ ID NO: 96472 - DNA, 25 bp, E. coli
attcgcaatttgctggcagagctcc

SEQ ID NO: 96473 - DNA, 25 bp, E. coli
gactttaacccggaggagcggacgc

SEQ ID NO: 96474 - DNA, 25 bp, E. coli
gactttaacccgcaggagcggacgc

SEQ ID NO: 96475 - DNA, 25 bp, E. coli
ttaacccgcaggagcggacgcaact

SEQ ID NO: 96476 - DNA, 25 bp, E. coli
ttaacccgcaggtgcggacgcaact

SEQ ID NO: 96477 - DNA, 25 bp, E. coli
tgtgctgcccggaattcgcaatttg

SEQ ID NO: 96478 - DNA, 25 bp, E. coli
tgtgctgcccggtattcgcaatttg

SEQ ID NO: 96479 - DNA, 25 bp, E. coli
tccgcgcacagctgatcccggtagg

SEQ ID NO: 96480 - DNA, 25 bp, E. coli
tccgcgcacagcagatcccggtagg

SEQ ID NO: 96481 - DNA, 25 bp, E. coli
ccggtattcgcaatttgctggcaga

SEQ ID NO: 96482 - DNA, 25 bp, E. coli
gcgcacagcagaacccggtagggct

SEQ ID NO: 96483 - DNA, 25 bp, E. coli
ccggtattcgcattttgctggcaga

SEQ ID NO: 96484 - DNA, 25 bp, E. coli
gcgcacagcagatcccggtagggct

SEQ ID NO: 96485 - DNA, 25 bp, E. coli
ctgcccggtattggcaatttgctgg

SEQ ID NO: 96486 - DNA, 25 bp, E. coli
ctgcccggtattcgcaatttgctgg

SEQ ID NO: 96487 - DNA, 25 bp, E. coli
taatgctgtgctgcccggtattcgc

SEQ ID NO: 96488 - DNA, 25 bp, E. coli
taatgctgtgctccccggtattcgc

SEQ ID NO: 96489 - DNA, 25 bp, E. coli
caagaaacaggcagatgagcgcgtc

SEQ ID NO: 96490 - DNA, 25 bp, E. coli
caagaaacaggctgatgagcgcgtc

SEQ ID NO: 96491 - DNA, 25 bp, E. coli
tataaagacaaaccgcgtaaggcag

SEQ ID NO: 96492 - DNA, 25 bp, E. coli
tataaagacaaagcgcgtaaggcag

SEQ ID NO: 96493 - DNA, 25 bp, E. coli
tgaagttcaaagttatcgccctggc

SEQ ID NO: 96494 - DNA, 25 bp, E. coli
tgaagttcaaagatatcgccctggc

SEQ ID NO: 96495 - DNA, 25 bp, E. coli
tgagcgcgtcgcacaatacatttcc

SEQ ID NO: 96496 - DNA, 25 bp, E. coli
tgagcgcgtcgctcaatacatttcc

SEQ ID NO: 96497 - DNA, 25 bp, E. coli
gcatattgtcacctccggtacggca

SEQ ID NO: 96498 - DNA, 25 bp, E. coli
gcgcagccggatccctataaagaca

SEQ ID NO: 96499 - DNA, 25 bp, E. coli
gcgcagccggatgcctataaagaca

SEQ ID NO: 96500 - DNA, 25 bp, E. coli
gcatattgtcacgtccggtacggca

SEQ ID NO: 96501 - DNA, 25 bp, E. coli
cgattgaagttatcgtggccgcgaa

SEQ ID NO: 96502 - DNA, 25 bp, E. coli
cgattgaagttaacgtggccgcgaa

SEQ ID NO: 96503 - DNA, 25 bp, E. coli
gataacgcgattcatcaggcgcagg

SEQ ID NO: 96504 - DNA, 25 bp, E. coli
gataacgcgattgatcaggcgcagg

SEQ ID NO: 96505 - DNA, 25 bp, E. coli
tggaagtcacgctccgtcagttaga

SEQ ID NO: 96506 - DNA, 25 bp, E. coli
tggaagtcacgcaccgtcagttaga

SEQ ID NO: 96507 - DNA, 25 bp, E. coli
gatgcggtgccacacattgccactc

SEQ ID NO: 96508 - DNA, 25 bp, E. coli
gagcaggccgctattcagtttgatg

SEQ ID NO: 96509 - DNA, 25 bp, E. coli
gagcaggccgcttttcagtttgatg

SEQ ID NO: 96510 - DNA, 25 bp, E. coli
gatgcggtgccagacattgccactc

SEQ ID NO: 96511 - DNA, 25 bp, E. coli
cattatattgttgccagcgaacgcg

SEQ ID NO: 96512 - DNA, 25 bp, E. coli
cagcgaacgcggcattgaagcctta

SEQ ID NO: 96513 - DNA, 25 bp, E. coli
cagcgaacgcgggattgaagcctta

SEQ ID NO: 96514 - DNA, 25 bp, E. coli
tatcgccgggctcattccacttttc

SEQ ID NO: 96515 - DNA, 25 bp, E. coli
tatcgccgggctgattccacttttc

SEQ ID NO: 96516 - DNA, 25 bp, E. coli
tatttcaccggaatgatgcgcttgc

SEQ ID NO: 96517 - DNA, 25 bp, E. coli
tatttcaccggattgatgcgcttgc

SEQ ID NO: 96518 - DNA, 25 bp, E. coli
ttttagtatgtgctcgattattccc

SEQ ID NO: 96519 - DNA, 25 bp, E. coli
ttttagtatgtggtcgattattccc

SEQ ID NO: 96520 - DNA, 25 bp, E. coli
gccttacgcgcatccatcattttta

SEQ ID NO: 96521 - DNA, 25 bp, E. coli
gccttacgcgcaaccatcattttta

SEQ ID NO: 96522 - DNA, 25 bp, E. coli
gctggtaatcaatgccgcgctcggt

SEQ ID NO: 96523 - DNA, 25 bp, E. coli
gctggtaatcaaagccgcgctcggt

SEQ ID NO: 96524 - DNA, 25 bp, E. coli
gaaaaattattaaatcgccgggctg

SEQ ID NO: 96525 - DNA, 25 bp, E. coli
gaaaaattattatatcgccgggctg

SEQ ID NO: 96526 - DNA, 25 bp, E. coli
cgacctttgcgcttatcgcgcatta

SEQ ID NO: 96527 - DNA, 25 bp, E. coli
cgacctttgcgcatatcgcgcatta

SEQ ID NO: 96528 - DNA, 25 bp, E. coli
cattatattgttcccagcgaacgcg

SEQ ID NO: 96529 - DNA, 25 bp, E. coli
gattccacttttcccgacctttgcg

SEQ ID NO: 96530 - DNA, 25 bp, E. coli
gattccacttttgccgacctttgcg

SEQ ID NO: 96531 - DNA, 25 bp, E. coli
taagcgcatgggagttgattatatg

SEQ ID NO: 96532 - DNA, 25 bp, E. coli
taagcgcatgggtgttgattatatg

SEQ ID NO: 96533 - DNA, 25 bp, E. coli
aagtttactcctgagcaagtcgccg

SEQ ID NO: 96534 - DNA, 25 bp, E. coli
aagtttactcctcagcaagtcgccg

SEQ ID NO: 96535 - DNA, 25 bp, E. coli
catgggctatggctggacaaattcc

SEQ ID NO: 96536 - DNA, 25 bp, E. coli
catgggctatgggtggacaaattcc

SEQ ID NO: 96537 - DNA, 25 bp, E. coli
taacacatgcccctatggatggaca

SEQ ID NO: 96538 - DNA, 25 bp, E. coli
attgaaacgggccaatgtcgtggcc

SEQ ID NO: 96539 - DNA, 25 bp, E. coli
attgaaacgggcgaatgtcgtggcc

SEQ ID NO: 96540 - DNA, 25 bp, E. coli
aaaaatgactactaattgctcccgg

SEQ ID NO: 96541 - DNA, 25 bp, E. coli
aaattggcctcgacagggctaacac

SEQ ID NO: 96542 - DNA, 25 bp, E. coli
aaattggcctcgtcagggctaacac

SEQ ID NO: 96543 - DNA, 25 bp, E. coli
aaaaatgactacaaattgctcccgg

SEQ ID NO: 96544 - DNA, 25 bp, E. coli
aagtcgccgctaagcaatcttatgg

SEQ ID NO: 96545 - DNA, 25 bp, E. coli
aagtcgccgctatgcaatcttatgg

SEQ ID NO: 96546 - DNA, 25 bp, E. coli
tatcccatagccagtaacaagaccg

SEQ ID NO: 96547 - DNA, 25 bp, E. coli
tatggatttactgaatccgccggcg

SEQ ID NO: 96548 - DNA, 25 bp, E. coli
tatggatttactcaatccgccggcg

SEQ ID NO: 96549 - DNA, 25 bp, E. coli
tatcccatagcctgtaacaagaccg

SEQ ID NO: 96550 - DNA, 25 bp, E. coli
tgctcccggaaagccagcaacagat

SEQ ID NO: 96551 - DNA, 25 bp, E. coli
tgctcccggaaacccagcaacagat

SEQ ID NO: 96552 - DNA, 25 bp, E. coli
gcgactggtcgctgggcttatcaga

SEQ ID NO: 96553 - DNA, 25 bp, E. coli
gcgactggtcgcagggcttatcaga

SEQ ID NO: 96554 - DNA, 25 bp, E. coli
taacacatgcccgtatggatggaca

SEQ ID NO: 96555 - DNA, 25 bp, E. coli
catttcacaaatcagtgaggcggcc

SEQ ID NO: 96556 - DNA, 25 bp, E. coli
agcagagcgttgaccgccggtcgct

SEQ ID NO: 96557 - DNA, 25 bp, E. coli
aggcgcgtcaggtgctggcaaatca

SEQ ID NO: 96558 - DNA, 25 bp, E. coli
aggcgcgtcaggagctggcaaatca

SEQ ID NO: 96559 - DNA, 25 bp, E. coli
agcagagcgttgtccgccggtcgct

SEQ ID NO: 96560 - DNA, 25 bp, E. coli
aacagaacattcagcacagcgaggg

SEQ ID NO: 96561 - DNA, 25 bp, E. coli
acgtgcctgtgaagccggtgccgat

SEQ ID NO: 96562 - DNA, 25 bp, E. coli
acgtgcctgtgatgccggtgccgat

SEQ ID NO: 96563 - DNA, 25 bp, E. coli
aacagaacattctgcacagcgaggg

SEQ ID NO: 96564 - DNA, 25 bp, E. coli
ttcctgatgatgtggctgatcgggt

SEQ ID NO: 96565 - DNA, 25 bp, E. coli
ttcctgatgatgaggctgatcgggt

SEQ ID NO: 96566 - DNA, 25 bp, E. coli
tgaaatacgtgcctgtgaagccggt

SEQ ID NO: 96567 - DNA, 25 bp, E. coli
tgaaatacgtgcgtgtgaagccggt

SEQ ID NO: 96568 - DNA, 25 bp, E. coli
cgccgggccgtctgtgaaatacgtg

SEQ ID NO: 96569 - DNA, 25 bp, E. coli
cgccgggccgtcagtgaaatacgtg

SEQ ID NO: 96570 - DNA, 25 bp, E. coli
catttcacaaatgagtgaggcggcc

SEQ ID NO: 96571 - DNA, 25 bp, E. coli
ggcctctgccccagttcctgatgat

SEQ ID NO: 96572 - DNA, 25 bp, E. coli
ggcctctgcccctgttcctgatgat

SEQ ID NO: 96573 - DNA, 25 bp, E. coli
tggcaaatcagcagcacaccctgca

SEQ ID NO: 96574 - DNA, 25 bp, E. coli
tggcaaatcagctgcacaccctgca

SEQ ID NO: 96575 - DNA, 25 bp, E. coli
gaggcggccacgaatgaaaaacaac

SEQ ID NO: 96576 - DNA, 25 bp, E. coli
gaggcggccacgtatgaaaaacaac

SEQ ID NO: 96577 - DNA, 25 bp, E. coli
attttcacagcctttttcaggagtt

SEQ ID NO: 96578 - DNA, 25 bp, E. coli
agcctggcatttcgcgggcgatatt

SEQ ID NO: 96579 - DNA, 25 bp, E. coli
agcctggcatttggcgggcgatatt

SEQ ID NO: 96580 - DNA, 25 bp, E. coli
attttcacagccattttcaggagtt

SEQ ID NO: 96581 - DNA, 25 bp, E. coli
tttcctgttttcctaatcagcctgg

SEQ ID NO: 96582 - DNA, 25 bp, E. coli
tttcctgttttcgtaatcagcctgg

SEQ ID NO: 96583 - DNA, 25 bp, E. coli
ttttcaggagttcagccatgaacgc

SEQ ID NO: 96584 - DNA, 25 bp, E. coli
ttttcaggagttgagccatgaacgc

SEQ ID NO: 96585 - DNA, 25 bp, E. coli
cctgttttcctattcagcctggcat

SEQ ID NO: 96586 - DNA, 25 bp, E. coli
gccattttcaggtgttcagccatga

SEQ ID NO: 96587 - DNA, 25 bp, E. coli
cctgttttcctaatcagcctggcat

SEQ ID NO: 96588 - DNA, 25 bp, E. coli
gccattttcaggagttcagccatga

SEQ ID NO: 96589 - DNA, 25 bp, E. coli
cgatattttcactgccattttcagg

SEQ ID NO: 96590 - DNA, 25 bp, E. coli
cgatattttcacagccattttcagg

SEQ ID NO: 96591 - DNA, 25 bp, E. coli
tcagcctggcatttcgcgggcgata

SEQ ID NO: 96592 - DNA, 25 bp, E. coli
tcacagccatttacaggagttcagc

SEQ ID NO: 96593 - DNA, 25 bp, E. coli
tcagcctggcatatcgcgggcgata

SEQ ID NO: 96594 - DNA, 25 bp, E. coli
taatcagcctggcatttcgcgggcg

SEQ ID NO: 96595 - DNA, 25 bp, E. coli
taatcagcctgggatttcgcgggcg

SEQ ID NO: 96596 - DNA, 25 bp, E. coli
tcacagccattttcaggagttcagc

SEQ ID NO: 96597 - DNA, 25 bp, E. coli
gagttcagccatgaacgcttattac

SEQ ID NO: 96598 - DNA, 25 bp, E. coli
gagttcagccatcaacgcttattac

SEQ ID NO: 96599 - DNA, 25 bp, E. coli
caagagaagtttagtagcagctggc

SEQ ID NO: 96600 - DNA, 25 bp, E. coli
caagagaagttttgtagcagctggc

SEQ ID NO: 96601 - DNA, 25 bp, E. coli
caacagctggattaggattcggcca

SEQ ID NO: 96602 - DNA, 25 bp, E. coli
caacagctggataaggattcggcca

SEQ ID NO: 96603 - DNA, 25 bp, E. coli
taaaaagctggccattgctgcctct

SEQ ID NO: 96604 - DNA, 25 bp, E. coli
taaaaagctggcgattgctgcctct

SEQ ID NO: 96605 - DNA, 25 bp, E. coli
aaagagatcccggacgaagttcacg

SEQ ID NO: 96606 - DNA, 25 bp, E. coli
aaagagatcccgcacgaagttcacg

SEQ ID NO: 96607 - DNA, 25 bp, E. coli
tgaagttaccgaagtcaaccgctac

SEQ ID NO: 96608 - DNA, 25 bp, E. coli
tgaagttaccgatgtcaaccgctac

SEQ ID NO: 96609 - DNA, 25 bp, E. coli
cctggcgtcgctcaatcctgggata

SEQ ID NO: 96610 - DNA, 25 bp, E. coli
cctggcgtcgctgaatcctgggata

SEQ ID NO: 96611 - DNA, 25 bp, E. coli
gaagttcagtcaatagatccgcaca

SEQ ID NO: 96612 - DNA, 25 bp, E. coli
gaagttcagtcattagatccgcaca

SEQ ID NO: 96613 - DNA, 25 bp, E. coli
gaataccgcgcaatataagagcccg

SEQ ID NO: 96614 - DNA, 25 bp, E. coli
gaataccgcgcattataagagcccg

SEQ ID NO: 96615 - DNA, 25 bp, E. coli
gaaattcggcgaaaaatggacccag

SEQ ID NO: 96616 - DNA, 25 bp, E. coli
gaaattcggcgataaatggacccag

SEQ ID NO: 96617 - DNA, 25 bp, E. coli
taataaagacgccaaagtctggacc

SEQ ID NO: 96618 - DNA, 25 bp, E. coli
taagagcccggcgtttgacagcatt

SEQ ID NO: 96619 - DNA, 25 bp, E. coli
taagagcccggcctttgacagcatt

SEQ ID NO: 96620 - DNA, 25 bp, E. coli
taataaagacgcgaaagtctggacc

SEQ ID NO: 96621 - DNA, 25 bp, E. coli
taggcaatgactcgtgcattccgaa

SEQ ID NO: 96622 - DNA, 25 bp, E. coli
taggcaatgactggtgcattccgaa

SEQ ID NO: 96623 - DNA, 25 bp, E. coli
aacggttttacttcgcttgccacag

SEQ ID NO: 96624 - DNA, 25 bp, E. coli
aacggttttactacgcttgccacag

SEQ ID NO: 96625 - DNA, 25 bp, E. coli
ttcgcttgccacaggaggatatgtg

SEQ ID NO: 96626 - DNA, 25 bp, E. coli
ttcgcttgccactggaggatatgtg

SEQ ID NO: 96627 - DNA, 25 bp, E. coli
tcgcatctcggtagctggcgcacag

SEQ ID NO: 96628 - DNA, 25 bp, E. coli
tcgcatctcggttgctggcgcacag

SEQ ID NO: 96629 - DNA, 25 bp, E. coli
ccaaagcgttgataatgagtattac

SEQ ID NO: 96630 - DNA, 25 bp, E. coli
ccaaagcgttgaaaatgagtattac

SEQ ID NO: 96631 - DNA, 25 bp, E. coli
gaagaaaatgactttcgcatctcgg

SEQ ID NO: 96632 - DNA, 25 bp, E. coli
gaagaaaatgacattcgcatctcgg

SEQ ID NO: 96633 - DNA, 25 bp, E. coli
gacttgaagaagaattaacggctta

SEQ ID NO: 96634 - DNA, 25 bp, E. coli
gacttgaagaagtattaacggctta

SEQ ID NO: 96635 - DNA, 25 bp, E. coli
cggacgcagaaaacattaaagcggg

SEQ ID NO: 96636 - DNA, 25 bp, E. coli
cggacgcagaaatcattaaagcggg

SEQ ID NO: 96637 - DNA, 25 bp, E. coli
ctgctcagaataggcaatgactggt

SEQ ID NO: 96638 - DNA, 25 bp, E. coli
ctgctcagaatacgcaatgactggt

SEQ ID NO: 96639 - DNA, 25 bp, E. coli
taatggcatgggtaaagcttactga

SEQ ID NO: 96640 - DNA, 25 bp, E. coli
taacggcttataaagcagatatccc

SEQ ID NO: 96641 - DNA, 25 bp, E. coli
taatggcatgggaaaagcttactga

SEQ ID NO: 96642 - DNA, 25 bp, E. coli
taacggcttatatagcagatatccc

SEQ ID NO: 96643 - DNA, 25 bp, E. coli
cagacagaaatatcgacgcggagcc

SEQ ID NO: 96644 - DNA, 25 bp, E. coli
cagacagaaataacgacgcggagcc

SEQ ID NO: 96645 - DNA, 25 bp, E. coli
tacttccggcgactggctaaaatcg

SEQ ID NO: 96646 - DNA, 25 bp, E. coli
tacttccggcgagtggctaaaatcg

SEQ ID NO: 96647 - DNA, 25 bp, E. coli
agcatcgccgtccattgacacagcg

SEQ ID NO: 96648 - DNA, 25 bp, E. coli
agcatcgccgtcgattgacacagcg

SEQ ID NO: 96649 - DNA, 25 bp, E. coli
tgataaccttcaacgctatgcggga

SEQ ID NO: 96650 - DNA, 25 bp, E. coli
tgataaccttcatcgctatgcggga

SEQ ID NO: 96651 - DNA, 25 bp, E. coli
tgctcttttggcatccgaatggccc

SEQ ID NO: 96652 - DNA, 25 bp, E. coli
tgctcttttggcttccgaatggccc

SEQ ID NO: 96653 - DNA, 25 bp, E. coli
tgccgtcgctgtccataaagtgagt

SEQ ID NO: 96654 - DNA, 25 bp, E. coli
tgccgtcgctgtgcataaagtgagt

SEQ ID NO: 96655 - DNA, 25 bp, E. coli
gcgcgccagtggagcgatagctttc

SEQ ID NO: 96656 - DNA, 25 bp, E. coli
gcgcgccagtggtgcgatagctttc

SEQ ID NO: 96657 - DNA, 25 bp, E. coli
gacacagcgcttacttcaggtcatg

SEQ ID NO: 96658 - DNA, 25 bp, E. coli
gacacagcgctttcttcaggtcatg

SEQ ID NO: 96659 - DNA, 25 bp, E. coli
gatagctttcgacaccgtggcactg

SEQ ID NO: 96660 - DNA, 25 bp, E. coli
gattcacatagttcagcggcatccg

SEQ ID NO: 96661 - DNA, 25 bp, E. coli
gattcacatagtacagcggcatccg

SEQ ID NO: 96662 - DNA, 25 bp, E. coli
gatagctttcgagaccgtggcactg

SEQ ID NO: 96663 - DNA, 25 bp, E. coli
gatcattggcggctgattcacatag

SEQ ID NO: 96664 - DNA, 25 bp, E. coli
gatcattggcgggtgattcacatag

SEQ ID NO: 96665 - DNA, 25 bp, E. coli
atagtcctgttgtgactagtcccgt

SEQ ID NO: 96666 - DNA, 25 bp, E. coli
atagtcctgttgagactagtcccgt

SEQ ID NO: 96667 - DNA, 25 bp, E. coli
aaataaaactcatcacgggcgtggc

SEQ ID NO: 96668 - DNA, 25 bp, E. coli
aaatacaaggtcatcagagcttctg

SEQ ID NO: 96669 - DNA, 25 bp, E. coli
aaataaaactcaacacgggcgtggc

SEQ ID NO: 96670 - DNA, 25 bp, E. coli
aaatacaaggtcttcagagcttctg

SEQ ID NO: 96671 - DNA, 25 bp, E. coli
ttaatgcgcctgcttacaacaagag

SEQ ID NO: 96672 - DNA, 25 bp, E. coli
ttaatgcgcctggttacaacaagag

SEQ ID NO: 96673 - DNA, 25 bp, E. coli
tctgaggatgatgccgttgagaata

SEQ ID NO: 96674 - DNA, 25 bp, E. coli
tctgaggatgatcccgttgagaata

SEQ ID NO: 96675 - DNA, 25 bp, E. coli
gcctgcttacaagaagagtaatgaa

SEQ ID NO: 96676 - DNA, 25 bp, E. coli
gcctgcttacaacaagagtaatgaa

SEQ ID NO: 96677 - DNA, 25 bp, E. coli
gactttgatgattgttcctctgagg

SEQ ID NO: 96678 - DNA, 25 bp, E. coli
gactagtcccgtagtatcaagttct

SEQ ID NO: 96679 - DNA, 25 bp, E. coli
gactttgatgatagttcctctgagg

SEQ ID NO: 96680 - DNA, 25 bp, E. coli
gactagtcccgttgtatcaagttct

SEQ ID NO: 96681 - DNA, 25 bp, E. coli
ccgttgtatcaacttctaaaagcag

SEQ ID NO: 96682 - DNA, 25 bp, E. coli
ccgttgtatcaagttctaaaagcag

SEQ ID NO: 96683 - DNA, 25 bp, E. coli
gataaaaatacaaggtcttcagagc

SEQ ID NO: 96684 - DNA, 25 bp, E. coli
gataaaaatacatggtcttcagagc

SEQ ID NO: 96685 - DNA, 25 bp, E. coli
taagtggagtattgactgatcgtaa

SEQ ID NO: 96686 - DNA, 25 bp, E. coli
taagtggagtatagactgatcgtaa

SEQ ID NO: 96687 - DNA, 25 bp, E. coli
aaccttgtcgttggctttggcatca

SEQ ID NO: 96688 - DNA, 25 bp, E. coli
aaccttgtcgttcgctttggcatca

SEQ ID NO: 96689 - DNA, 25 bp, E. coli
taaaaactgactccgggtatggagc

SEQ ID NO: 96690 - DNA, 25 bp, E. coli
taaaaactgactgcgggtatggagc

SEQ ID NO: 96691 - DNA, 25 bp, E. coli
tatgtttgagcgtagcgttggtaac

SEQ ID NO: 96692 - DNA, 25 bp, E. coli
taccaggcgcgtgaatgttacccca

SEQ ID NO: 96693 - DNA, 25 bp, E. coli
tatgtttgagcgaagcgttggtaac

SEQ ID NO: 96694 - DNA, 25 bp, E. coli
taccaggcgcgtcaatgttacccca

SEQ ID NO: 96695 - DNA, 25 bp, E. coli
tgtcgttccgcattatctgttctgg

SEQ ID NO: 96696 - DNA, 25 bp, E. coli
tgtcgttccgcaatatctgttctgg

SEQ ID NO: 96697 - DNA, 25 bp, E. coli
tgtagtgaaaactacaaccttgtcg

SEQ ID NO: 96698 - DNA, 25 bp, E. coli
tgtagtgaaaacaacaaccttgtcg

SEQ ID NO: 96699 - DNA, 25 bp, E. coli
tgaaagctcaatccatcaatctggt

SEQ ID NO: 96700 - DNA, 25 bp, E. coli
tgaaagctcaatgcatcaatctggt

SEQ ID NO: 96701 - DNA, 25 bp, E. coli
tctggtggctactgcgttatggaag

SEQ ID NO: 96702 - DNA, 25 bp, E. coli
tctggtggctacagcgttatggaag

SEQ ID NO: 96703 - DNA, 25 bp, E. coli
gacggaattttgcatcagcttctca

SEQ ID NO: 96704 - DNA, 25 bp, E. coli
gacggaattttggatcagcttctca

SEQ ID NO: 96705 - DNA, 25 bp, E. coli
cgttggtaacgcaaccaggcgcgtg

SEQ ID NO: 96706 - DNA, 25 bp, E. coli
cgttggtaacgctaccaggcgcgtg

SEQ ID NO: 96707 - DNA, 25 bp, E. coli
gagctatgggtaatttctgtaccca

SEQ ID NO: 96708 - DNA, 25 bp, E. coli
gagctatgggtattttctgtaccca

SEQ ID NO: 96709 - DNA, 25 bp, E. coli
aatctcgataaattacacccgggag

SEQ ID NO: 96710 - DNA, 25 bp, E. coli
aatctcgataaaatacacccgggag

SEQ ID NO: 96711 - DNA, 25 bp, E. coli
caaaaaggcgatttggctgacaaca

SEQ ID NO: 96712 - DNA, 25 bp, E. coli
caaaaaggcgatatggctgacaaca

SEQ ID NO: 96713 - DNA, 25 bp, E. coli
tatatagcgccaatgtccaaaaagg

SEQ ID NO: 96714 - DNA, 25 bp, E. coli
tatatagcgccattgtccaaaaagg

SEQ ID NO: 96715 - DNA, 25 bp, E. coli
tgctctggactgaaaacgatgcgga

SEQ ID NO: 96716 - DNA, 25 bp, E. coli
tgctctggactgtaaacgatgcgga

SEQ ID NO: 96717 - DNA, 25 bp, E. coli
tccagaagagaatatcaaagcagca

SEQ ID NO: 96718 - DNA, 25 bp, E. coli
tccagaagagaaaatcaaagcagca

SEQ ID NO: 96719 - DNA, 25 bp, E. coli
tctggagaaaaatctacagcccttg

SEQ ID NO: 96720 - DNA, 25 bp, E. coli
tctggagaaaaaactacagcccttg

SEQ ID NO: 96721 - DNA, 25 bp, E. coli
tcggaaagataatgcgatgccagct

SEQ ID NO: 96722 - DNA, 25 bp, E. coli
tcggaaagataaagcgatgccagct

SEQ ID NO: 96723 - DNA, 25 bp, E. coli
gaattataatggtggtggcgatccc

SEQ ID NO: 96724 - DNA, 25 bp, E. coli
gaattataatggaggtggcgatccc

SEQ ID NO: 96725 - DNA, 25 bp, E. coli
tgggcaaaagaacaaataactggct

SEQ ID NO: 96726 - DNA, 25 bp, E. coli
tgggcaaaagaagaaataactggct

SEQ ID NO: 96727 - DNA, 25 bp, E. coli
tggcgatcccaactatgcaataaaa

SEQ ID NO: 96728 - DNA, 25 bp, E. coli
tggcgatcccaagtatgcaataaaa

SEQ ID NO: 96729 - DNA, 25 bp, E. coli
gatgcggaaaatacttctcagtgga

SEQ ID NO: 96730 - DNA, 25 bp, E. coli
gatgcggaaaattcttctcagtgga

SEQ ID NO: 96731 - DNA, 25 bp, E. coli
cagtcccggaagtttgaaggcgtca

SEQ ID NO: 96732 - DNA, 25 bp, E. coli
cagtcccggaagattgaaggcgtca

SEQ ID NO: 96733 - DNA, 25 bp, E. coli
tacgggctggaataaactccctgag

SEQ ID NO: 96734 - DNA, 25 bp, E. coli
tacgggctggaaaaaactccctgag

SEQ ID NO: 96735 - DNA, 25 bp, E. coli
aaactgaaagacgtgcggagcgcat

SEQ ID NO: 96736 - DNA, 25 bp, E. coli
actgagcattcatgacgcgggcgga

SEQ ID NO: 96737 - DNA, 25 bp, E. coli
aaactgaaagacctgcggagcgcat

SEQ ID NO: 96738 - DNA, 25 bp, E. coli
actgagcattcaagacgcgggcgga

SEQ ID NO: 96739 - DNA, 25 bp, E. coli
tcttaaccgggcgatactggatcag

SEQ ID NO: 96740 - DNA, 25 bp, E. coli
tcttaaccgggccatactggatcag

SEQ ID NO: 96741 - DNA, 25 bp, E. coli
gcaacgtcgcgggaaaatcaggtct

SEQ ID NO: 96742 - DNA, 25 bp, E. coli
gcaacgtcgcggcaaaatcaggtct

SEQ ID NO: 96743 - DNA, 25 bp, E. coli
cgaatataagcaggcatggcgcggc

SEQ ID NO: 96744 - DNA, 25 bp, E. coli
cgaatataagcacgcatggcgcggc

SEQ ID NO: 96745 - DNA, 25 bp, E. coli
gattatggccgtctgaaactcccgt

SEQ ID NO: 96746 - DNA, 25 bp, E. coli
gattaatccggcctacaccagtcag

SEQ ID NO: 96747 - DNA, 25 bp, E. coli
gattaatccggcgtacaccagtcag

SEQ ID NO: 96748 - DNA, 25 bp, E. coli
tggcaacactttcagacggcacggt

SEQ ID NO: 96749 - DNA, 25 bp, E. coli
tggcaacactttgagacggcacggt

SEQ ID NO: 96750 - DNA, 25 bp, E. coli
gatggttaaattctccgccaactgg

SEQ ID NO: 96751 - DNA, 25 bp, E. coli
gattatggccgtgtgaaactcccgt

SEQ ID NO: 96752 - DNA, 25 bp, E. coli
gatggttaaattgtccgccaactgg

SEQ ID NO: 96753 - DNA, 25 bp, E. coli
cacgtatagatgagcttgagcgcga

SEQ ID NO: 96754 - DNA, 25 bp, E. coli
cacgtatagatgtgcttgagcgcga

SEQ ID NO: 96755 - DNA, 25 bp, E. coli
catgctgcacgctgtctggtctggc

SEQ ID NO: 96756 - DNA, 25 bp, E. coli
catgctgcacgcagtctggtctggc

SEQ ID NO: 96757 - DNA, 25 bp, E. coli
atggcgcgccatccgggaatattcg

SEQ ID NO: 96758 - DNA, 25 bp, E. coli
ataacgtaacgtggataaacctgcg

SEQ ID NO: 96759 - DNA, 25 bp, E. coli
atggcgcgccatgcgggaatattcg

SEQ ID NO: 96760 - DNA, 25 bp, E. coli
ataacgtaacgtcgataaacctgcg

SEQ ID NO: 96761 - DNA, 25 bp, E. coli
aaatcgttcctctgagaatatcccg

SEQ ID NO: 96762 - DNA, 25 bp, E. coli
aaatcgttcctcagagaatatcccg

SEQ ID NO: 96763 - DNA, 25 bp, E. coli
tatgattgcagtgcgaattgggccg

SEQ ID NO: 96764 - DNA, 25 bp, E. coli
tatgattgcagtccgaattgggccg

SEQ ID NO: 96765 - DNA, 25 bp, E. coli
tggtctggccgatgttaaaatcgtt

SEQ ID NO: 96766 - DNA, 25 bp, E. coli
tggtctggccgaagttaaaatcgtt

SEQ ID NO: 96767 - DNA, 25 bp, E. coli
tgagcgcgagctcgaatcacttatc

SEQ ID NO: 96768 - DNA, 25 bp, E. coli
tgagcgcgagctggaatcacttatc

SEQ ID NO: 96769 - DNA, 25 bp, E. coli
tcgctgcatcaataacgtaacgtgg

SEQ ID NO: 96770 - DNA, 25 bp, E. coli
tcgctgcatcaaaaacgtaacgtgg

SEQ ID NO: 96771 - DNA, 25 bp, E. coli
gaattattgcctctcttgagccacg

SEQ ID NO: 96772 - DNA, 25 bp, E. coli
gaattattgcctgtcttgagccacg

SEQ ID NO: 96773 - DNA, 25 bp, E. coli
tcacttatccaagtgaatggcgcgc

SEQ ID NO: 96774 - DNA, 25 bp, E. coli
tcacttatccaactgaatggcgcgc

SEQ ID NO: 96775 - DNA, 25 bp, E. coli
aataaaaagcctgtctcatcaggtg

SEQ ID NO: 96776 - DNA, 25 bp, E. coli
aataaaaagcctctctcatcaggtg

SEQ ID NO: 96777 - DNA, 25 bp, E. coli
cagcccgggaccaaaatggcaagta

SEQ ID NO: 96778 - DNA, 25 bp, E. coli
caccactgacacaatgaggaaaacc

SEQ ID NO: 96779 - DNA, 25 bp, E. coli
caccactgacactatgaggaaaacc

SEQ ID NO: 96780 - DNA, 25 bp, E. coli
cagcccgggacctaaatggcaagta

SEQ ID NO: 96781 - DNA, 25 bp, E. coli
ttgtcgcagccagactggacacggc

SEQ ID NO: 96782 - DNA, 25 bp, E. coli
ttgtcgcagccacactggacacggc

SEQ ID NO: 96783 - DNA, 25 bp, E. coli
tgagaatttcgagcacagcccggga

SEQ ID NO: 96784 - DNA, 25 bp, E. coli
tgagaatttcgaccacagcccggga

SEQ ID NO: 96785 - DNA, 25 bp, E. coli
tcatcaggtgtaattgtcgcagcca

SEQ ID NO: 96786 - DNA, 25 bp, E. coli
tcatcaggtgtatttgtcgcagcca

SEQ ID NO: 96787 - DNA, 25 bp, E. coli
tctaagtccaacgaaccagtgtcac

SEQ ID NO: 96788 - DNA, 25 bp, E. coli
tctaagtccaaccaaccagtgtcac

SEQ ID NO: 96789 - DNA, 25 bp, E. coli
cctgatgggataggctctaagtcca

SEQ ID NO: 96790 - DNA, 25 bp, E. coli
cctgatgggatacgctctaagtcca

SEQ ID NO: 96791 - DNA, 25 bp, E. coli
gcaagtaaaatagcctgatgggata

SEQ ID NO: 96792 - DNA, 25 bp, E. coli
gcaagtaaaataccctgatgggata

SEQ ID NO: 96793 - DNA, 25 bp, E. coli
gaaacggaaaactgcgcctgaaagc

SEQ ID NO: 96794 - DNA, 25 bp, E. coli
gaaacggaaaacagcgcctgaaagc

SEQ ID NO: 96795 - DNA, 25 bp, E. coli
ctagcgcgtgagaagagaaacggaa

SEQ ID NO: 96796 - DNA, 25 bp, E. coli
ctagcgcgtgagtagagaaacggaa

SEQ ID NO: 96797 - DNA, 25 bp, E. coli
cagagcagcaagaaagcccgaatgc

SEQ ID NO: 96798 - DNA, 25 bp, E. coli
cagagcagcaagtaagcccgaatgc

SEQ ID NO: 96799 - DNA, 25 bp, E. coli
caaacgggcgctcgctttaggaaag

SEQ ID NO: 96800 - DNA, 25 bp, E. coli
caaacgggcgctggctttaggaaag

SEQ ID NO: 96801 - DNA, 25 bp, E. coli
tatcgccagtggtgctgtcgtgatg

SEQ ID NO: 96802 - DNA, 25 bp, E. coli
tatcgccagtggagctgtcgtgatg

SEQ ID NO: 96803 - DNA, 25 bp, E. coli
tttaggaaaggatgttccgtggccg

SEQ ID NO: 96804 - DNA, 25 bp, E. coli
tttaggaaaggaagttccgtggccg

SEQ ID NO: 96805 - DNA, 25 bp, E. coli
tgttccgtggccgtaaatgcaggtg

SEQ ID NO: 96806 - DNA, 25 bp, E. coli
tgtttcacagcggttgctatcgcgg

SEQ ID NO: 96807 - DNA, 25 bp, E. coli
tgttccgtggccctaaatgcaggtg

SEQ ID NO: 96808 - DNA, 25 bp, E. coli
tgtttcacagcgcttgctatcgcgg

SEQ ID NO: 96809 - DNA, 25 bp, E. coli
gctatcgcggcattatcgccagtgg

SEQ ID NO: 96810 - DNA, 25 bp, E. coli
gctatcgcggcaatatcgccagtgg

SEQ ID NO: 96811 - DNA, 25 bp, E. coli
cggtcttcgcatggaccgcacaatg

SEQ ID NO: 96812 - DNA, 25 bp, E. coli
cggtcttcgcatcgaccgcacaatg

SEQ ID NO: 96813 - DNA, 25 bp, E. coli
cgtaaatgcaggagtttcacagcgc

SEQ ID NO: 96814 - DNA, 25 bp, E. coli
cgtaaatgcaggtgtttcacagcgc

SEQ ID NO: 96815 - DNA, 25 bp, E. coli
gtaagcccgaatcccgccctttggg

SEQ ID NO: 96816 - DNA, 25 bp, E. coli
gtaagcccgaatgccgccctttggg

SEQ ID NO: 96817 - DNA, 25 bp, E. coli
gtgctgtcgtgaagcggtcttcgca

SEQ ID NO: 96818 - DNA, 25 bp, E. coli
gtgctgtcgtgatgcggtcttcgca

SEQ ID NO: 96819 - DNA, 25 bp, E. coli
tacgtaatgacgctctacgcacaag

SEQ ID NO: 96820 - DNA, 25 bp, E. coli
tacgtaatgacggtctacgcacaag

SEQ ID NO: 96821 - DNA, 25 bp, E. coli
ttacgatgactaggtaatgacgctc

SEQ ID NO: 96822 - DNA, 25 bp, E. coli
ttacgatgactacgtaatgacgctc

SEQ ID NO: 96823 - DNA, 25 bp, E. coli
tcgctttccgctcaagaatacttcg

SEQ ID NO: 96824 - DNA, 25 bp, E. coli
tcgctttccgctgaagaatacttcg

SEQ ID NO: 96825 - DNA, 25 bp, E. coli
gctctacgcacaaggcgtgctgacg

SEQ ID NO: 96826 - DNA, 25 bp, E. coli
gctctacgcacatggcgtgctgacg

SEQ ID NO: 96827 - DNA, 25 bp, E. coli
cgctgaagaatacttcggtgccagc

SEQ ID NO: 96828 - DNA, 25 bp, E. coli
cgccacaacgagagtggcagtctgg

SEQ ID NO: 96829 - DNA, 25 bp, E. coli
cgccacaacgagtgtggcagtctgg

SEQ ID NO: 96830 - DNA, 25 bp, E. coli
cgctgaagaatagttcggtgccagc

SEQ ID NO: 96831 - DNA, 25 bp, E. coli
gattgatgaaaagcgttttcgccac

SEQ ID NO: 96832 - DNA, 25 bp, E. coli
gttttcgccacaacgagagtggcag

SEQ ID NO: 96833 - DNA, 25 bp, E. coli
gttttcgccacatcgagagtggcag

SEQ ID NO: 96834 - DNA, 25 bp, E. coli
gattgatgaaaaccgttttcgccac

SEQ ID NO: 96835 - DNA, 25 bp, E. coli
taatgacgctctacgcacaaggcgt

SEQ ID NO: 96836 - DNA, 25 bp, E. coli
taatgacgctcttcgcacaaggcgt

SEQ ID NO: 96837 - DNA, 25 bp, E. coli
gacgctctacgcacaaggcgtgctg

SEQ ID NO: 96838 - DNA, 25 bp, E. coli
gatgactacgtattgacgctctacg

SEQ ID NO: 96839 - DNA, 25 bp, E. coli
gatgactacgtaatgacgctctacg

SEQ ID NO: 96840 - DNA, 25 bp, E. coli
gacgctctacgctcaaggcgtgctg

SEQ ID NO: 96841 - DNA, 25 bp, E. coli
attggccttgatgcggcgttgctgc

SEQ ID NO: 96842 - DNA, 25 bp, E. coli
attggccttgatccggcgttgctgc

SEQ ID NO: 96843 - DNA, 25 bp, E. coli
ttcctgattggcgttgatccggcgt

SEQ ID NO: 96844 - DNA, 25 bp, E. coli
ttcctgattggccttgatccggcgt

SEQ ID NO: 96845 - DNA, 25 bp, E. coli
tttgtgtgccggctaatcaggtgct

SEQ ID NO: 96846 - DNA, 25 bp, E. coli
tttgtgtgccgggtaatcaggtgct

SEQ ID NO: 96847 - DNA, 25 bp, E. coli
tgatccggcgttgctgctgggacat

SEQ ID NO: 96848 - DNA, 25 bp, E. coli
tgattggccttgttccggcgttgct

SEQ ID NO: 96849 - DNA, 25 bp, E. coli
tgattggccttgatccggcgttgct

SEQ ID NO: 96850 - DNA, 25 bp, E. coli
tgatccggcgttcctgctgggacat

SEQ ID NO: 96851 - DNA, 25 bp, E. coli
tccggcgttgctgctgggacatacg

SEQ ID NO: 96852 - DNA, 25 bp, E. coli
tgccgggtaatcaggtgctgccgtt

SEQ ID NO: 96853 - DNA, 25 bp, E. coli
tgccgggtaatctggtgctgccgtt

SEQ ID NO: 96854 - DNA, 25 bp, E. coli
tccggcgttgctcctgggacatacg

SEQ ID NO: 96855 - DNA, 25 bp, E. coli
ccttgatccggccttgctgctggga

SEQ ID NO: 96856 - DNA, 25 bp, E. coli
cctgattggcctagatccggcgttg

SEQ ID NO: 96857 - DNA, 25 bp, E. coli
cctgattggccttgatccggcgttg

SEQ ID NO: 96858 - DNA, 25 bp, E. coli
gccgggtaatcacgtgctgccgttt

SEQ ID NO: 96859 - DNA, 25 bp, E. coli
ccttgatccggcgttgctgctggga

SEQ ID NO: 96860 - DNA, 25 bp, E. coli
gccgggtaatcaggtgctgccgttt

SEQ ID NO: 96861 - DNA, 25 bp, E. coli
cgttgctgctggcacatacggcggt

SEQ ID NO: 96862 - DNA, 25 bp, E. coli
cgttgctgctgggacatacggcggt

SEQ ID NO: 96863 - DNA, 25 bp, E. coli
aatgctaatgatctgcttcatgcgc

SEQ ID NO: 96864 - DNA, 25 bp, E. coli
aatgctaatgatgtgcttcatgcgc

SEQ ID NO: 96865 - DNA, 25 bp, E. coli
cttcgccgcgcctgttcagcatggt

SEQ ID NO: 96866 - DNA, 25 bp, E. coli
cttcgccgcgccagttcagcatggt

SEQ ID NO: 96867 - DNA, 25 bp, E. coli
tatgtccaggcgcaaccggtgatga

SEQ ID NO: 96868 - DNA, 25 bp, E. coli
tatgtccaggcggaaccggtgatga

SEQ ID NO: 96869 - DNA, 25 bp, E. coli
ttaacgccgtatcaatcgaacgtcg

SEQ ID NO: 96870 - DNA, 25 bp, E. coli
ttaacgccgtatgaatcgaacgtcg

SEQ ID NO: 96871 - DNA, 25 bp, E. coli
tcgaacgtcgtgtgtaatgctaatg

SEQ ID NO: 96872 - DNA, 25 bp, E. coli
tcgaacgtcgtgagtaatgctaatg

SEQ ID NO: 96873 - DNA, 25 bp, E. coli
tctgcatattgtggacagcgacggg

SEQ ID NO: 96874 - DNA, 25 bp, E. coli
tctgcatattgtcgacagcgacggg

SEQ ID NO: 96875 - DNA, 25 bp, E. coli
gctggaacgctttcgcgcgctgctg

SEQ ID NO: 96876 - DNA, 25 bp, E. coli
gctgcgggaactcatgcgcgatatt

SEQ ID NO: 96877 - DNA, 25 bp, E. coli
gctggaacgcttacgcgcgctgctg

SEQ ID NO: 96878 - DNA, 25 bp, E. coli
gctgcgggaactgatgcgcgatatt

SEQ ID NO: 96879 - DNA, 25 bp, E. coli
cgatgtatatgatcgagcccagact

SEQ ID NO: 96880 - DNA, 25 bp, E. coli
cgatgtatatgaacgagcccagact

SEQ ID NO: 96881 - DNA, 25 bp, E. coli
tcagcatggtcgtcatttgcgcgcc

SEQ ID NO: 96882 - DNA, 25 bp, E. coli
tcagcatggtcgacatttgcgcgcc

SEQ ID NO: 96883 - DNA, 25 bp, E. coli
gatgagttatttggacaaactgggc

SEQ ID NO: 96884 - DNA, 25 bp, E. coli
gatgagttatttcgacaaactgggc

SEQ ID NO: 96885 - DNA, 25 bp, E. coli
taaataccggaatggcggtagcgtg

SEQ ID NO: 96886 - DNA, 25 bp, E. coli
taaataccggaaaggcggtagcgtg

SEQ ID NO: 96887 - DNA, 25 bp, E. coli
aggctggtaattcttggtatggcat

SEQ ID NO: 96888 - DNA, 25 bp, E. coli
accggaaaggcgctagcgtgccatt

SEQ ID NO: 96889 - DNA, 25 bp, E. coli
aggctggtaattgttggtatggcat

SEQ ID NO: 96890 - DNA, 25 bp, E. coli
accggaaaggcggtagcgtgccatt

SEQ ID NO: 96891 - DNA, 25 bp, E. coli
aaaggcggtagcgtgccattgcaaa

SEQ ID NO: 96892 - DNA, 25 bp, E. coli
aaaaaatggtgggaggtatcgtcag

SEQ ID NO: 96893 - DNA, 25 bp, E. coli
aaaaaatggtggcaggtatcgtcag

SEQ ID NO: 96894 - DNA, 25 bp, E. coli
aaaggcggtagcctgccattgcaaa

SEQ ID NO: 96895 - DNA, 25 bp, E. coli
tattactcagcaatctggtaccggt

SEQ ID NO: 96896 - DNA, 25 bp, E. coli
tattactcagcattctggtaccggt

SEQ ID NO: 96897 - DNA, 25 bp, E. coli
tgatgtgggtaattaccggaaaggc

SEQ ID NO: 96898 - DNA, 25 bp, E. coli
tgatgtgggtaaataccggaaaggc

SEQ ID NO: 96899 - DNA, 25 bp, E. coli
gcggtagcgtgccattgcaaaaaat

SEQ ID NO: 96900 - DNA, 25 bp, E. coli
gcggtagcgtgcgattgcaaaaaat

SEQ ID NO: 96901 - DNA, 25 bp, E. coli
gcaaaaaatggtgggaggtatcgtc

SEQ ID NO: 96902 - DNA, 25 bp, E. coli
gcaaaaaatggtcggaggtatcgtc

SEQ ID NO: 96903 - DNA, 25 bp, E. coli
cgtgccattgcaaaaaatggtggga

SEQ ID NO: 96904 - DNA, 25 bp, E. coli
cgtgccattgcataaaatggtggga

SEQ ID NO: 96905 - DNA, 25 bp, E. coli
gtatcgtcaggacgctggtaattgt

SEQ ID NO: 96906 - DNA, 25 bp, E. coli
gtatcgtcaggaggctggtaattgt

SEQ ID NO: 96907 - DNA, 25 bp, E. coli
cacctggcatcatatttatgaggaa

SEQ ID NO: 96908 - DNA, 25 bp, E. coli
cacctggcatcaaatttatgaggaa

SEQ ID NO: 96909 - DNA, 25 bp, E. coli
aaacgcagcctcacctggcatcaaa

SEQ ID NO: 96910 - DNA, 25 bp, E. coli
aaacgcagcctctcctggcatcaaa

SEQ ID NO: 96911 - DNA, 25 bp, E. coli
ttctgtgctcgggacctgtaggcct

SEQ ID NO: 96912 - DNA, 25 bp, E. coli
ttctgtgctcggcacctgtaggcct

SEQ ID NO: 96913 - DNA, 25 bp, E. coli
tccgtcctacggatctgtgctcggg

SEQ ID NO: 96914 - DNA, 25 bp, E. coli
tccgtcctacggttctgtgctcggg

SEQ ID NO: 96915 - DNA, 25 bp, E. coli
tcgcatcaggcaaaaagcggcaacg

SEQ ID NO: 96916 - DNA, 25 bp, E. coli
tcgcatcaggcataaagcggcaacg

SEQ ID NO: 96917 - DNA, 25 bp, E. coli
tcggttccgacaacggttgccggat

SEQ ID NO: 96918 - DNA, 25 bp, E. coli
tcggttccgacatcggttgccggat

SEQ ID NO: 96919 - DNA, 25 bp, E. coli
tctgtgctcgggacttgtaggcctg

SEQ ID NO: 96920 - DNA, 25 bp, E. coli
tctgtgctcgggtcttgtaggcctg

SEQ ID NO: 96921 - DNA, 25 bp, E. coli
gcaacgaacaaatcaaacgcagcct

SEQ ID NO: 96922 - DNA, 25 bp, E. coli
gcaacgaacaaaacaaacgcagcct

SEQ ID NO: 96923 - DNA, 25 bp, E. coli
gcaaaaagcggcaacgaacaaaaca

SEQ ID NO: 96924 - DNA, 25 bp, E. coli
gcaaaaagcggctacgaacaaaaca

SEQ ID NO: 96925 - DNA, 25 bp, E. coli
ccgtcctacggttctgtgctcggga

SEQ ID NO: 96926 - DNA, 25 bp, E. coli
ccgtcctacggtactgtgctcggga

SEQ ID NO: 96927 - DNA, 25 bp, E. coli
tgctgttttcggttccgacaacggt

SEQ ID NO: 96928 - DNA, 25 bp, E. coli
tgctgttttcggatccgacaacggt

SEQ ID NO: 96929 - DNA, 25 bp, E. coli
attatgttccgccagtatgaccgcc

SEQ ID NO: 96930 - DNA, 25 bp, E. coli
attatgttccgcgagtatgaccgcc

SEQ ID NO: 96931 - DNA, 25 bp, E. coli
aaaggtgttcgccataaaggtgaat

SEQ ID NO: 96932 - DNA, 25 bp, E. coli
aaaggtgttcgcgataaaggtgaat

SEQ ID NO: 96933 - DNA, 25 bp, E. coli
tatgttccgcgactatgaccgcctg

SEQ ID NO: 96934 - DNA, 25 bp, E. coli
tatgttccgcgagtatgaccgcctg

SEQ ID NO: 96935 - DNA, 25 bp, E. coli
ttccgcgagtatcaccgcctgatta

SEQ ID NO: 96936 - DNA, 25 bp, E. coli
ttccgcgagtatgaccgcctgatta

SEQ ID NO: 96937 - DNA, 25 bp, E. coli
tgttccgcgagtttgaccgcctgat

SEQ ID NO: 96938 - DNA, 25 bp, E. coli
tgttccgcgagtatgaccgcctgat

SEQ ID NO: 96939 - DNA, 25 bp, E. coli
tgactactggaaaaagcgaattatg

SEQ ID NO: 96940 - DNA, 25 bp, E. coli
tgactactggaataagcgaattatg

SEQ ID NO: 96941 - DNA, 25 bp, E. coli
gcgaattatgttgcgcgagtatgac

SEQ ID NO: 96942 - DNA, 25 bp, E. coli
gcgaattatgttccgcgagtatgac

SEQ ID NO: 96943 - DNA, 25 bp, E. coli
gaataagcgaataatgttccgcgag

SEQ ID NO: 96944 - DNA, 25 bp, E. coli
gaataagcgaattatgttccgcgag

SEQ ID NO: 96945 - DNA, 25 bp, E. coli
gtttaatgactactggaataagcga

SEQ ID NO: 96946 - DNA, 25 bp, E. coli
gtttaatgactagtggaataagcga

SEQ ID NO: 96947 - DNA, 25 bp, E. coli
ggtgttcgcgataaaggtgaatatc

SEQ ID NO: 96948 - DNA, 25 bp, E. coli
ggtgttcgcgattaaggtgaatatc

SEQ ID NO: 96949 - DNA, 25 bp, E. coli
taagcgaattatgttccgcgagtat

SEQ ID NO: 96950 - DNA, 25 bp, E. coli
taagcgaattatcttccgcgagtat

SEQ ID NO: 96951 - DNA, 25 bp, E. coli
aatagaaccacacccgatgattgcg

SEQ ID NO: 96952 - DNA, 25 bp, E. coli
caacgaacgcctccggaggttgtcc

SEQ ID NO: 96953 - DNA, 25 bp, E. coli
caacgaacgcctgcggaggttgtcc

SEQ ID NO: 96954 - DNA, 25 bp, E. coli
aatagaaccacagccgatgattgcg

SEQ ID NO: 96955 - DNA, 25 bp, E. coli
tacatggcgccagtatctgccaggt

SEQ ID NO: 96956 - DNA, 25 bp, E. coli
tacatggcgccactatctgccaggt

SEQ ID NO: 96957 - DNA, 25 bp, E. coli
atgaactggctagccgactggcctg

SEQ ID NO: 96958 - DNA, 25 bp, E. coli
atgaactggctacccgactggcctg

SEQ ID NO: 96959 - DNA, 25 bp, E. coli
actggcctggcgagtacatggcgcc

SEQ ID NO: 96960 - DNA, 25 bp, E. coli
actggcctggcgtgtacatggcgcc

SEQ ID NO: 96961 - DNA, 25 bp, E. coli
tcgatatatcaaccgcaagcgtgcg

SEQ ID NO: 96962 - DNA, 25 bp, E. coli
tcgatatatcaagcgcaagcgtgcg

SEQ ID NO: 96963 - DNA, 25 bp, E. coli
tctgccaggtgaattcattcgatat

SEQ ID NO: 96964 - DNA, 25 bp, E. coli
tctgccaggtgatttcattcgatat

SEQ ID NO: 96965 - DNA, 25 bp, E. coli
ccagactggcttttcagcgtcgaaa

SEQ ID NO: 96966 - DNA, 25 bp, E. coli
ccagactggcttatcagcgtcgaaa

SEQ ID NO: 96967 - DNA, 25 bp, E. coli
cctccgggcgcgattggcgatgaac

SEQ ID NO: 96968 - DNA, 25 bp, E. coli
cctccgggcgcgtttggcgatgaac

SEQ ID NO: 96969 - DNA, 25 bp, E. coli
ggaccatgccgcaatagcgagctgg

SEQ ID NO: 96970 - DNA, 25 bp, E. coli
ggaccatgccgctatagcgagctgg

SEQ ID NO: 96971 - DNA, 25 bp, E. coli
gaggttgtcctctttcctccgggcg

SEQ ID NO: 96972 - DNA, 25 bp, E. coli
gaggttgtcctcattcctccgggcg

SEQ ID NO: 96973 - DNA, 25 bp, E. coli
cacttcggagcggatgatgaacggc

SEQ ID NO: 96974 - DNA, 25 bp, E. coli
caaacggatcggcagattatcgaga

SEQ ID NO: 96975 - DNA, 25 bp, E. coli
caaacggatcgggagattatcgaga

SEQ ID NO: 96976 - DNA, 25 bp, E. coli
cacttcggagcgcatgatgaacggc

SEQ ID NO: 96977 - DNA, 25 bp, E. coli
acagctgcgcgaagaaggtttcgac

SEQ ID NO: 96978 - DNA, 25 bp, E. coli
acagctgcgcgatgaaggtttcgac

SEQ ID NO: 96979 - DNA, 25 bp, E. coli
tatgatcggcgaagtcagcggcatg

SEQ ID NO: 96980 - DNA, 25 bp, E. coli
tatgatcggcgatgtcagcggcatg

SEQ ID NO: 96981 - DNA, 25 bp, E. coli
tatcgagattatggcgagcaaggcc

SEQ ID NO: 96982 - DNA, 25 bp, E. coli
tatcgagattatcgcgagcaaggcc

SEQ ID NO: 96983 - DNA, 25 bp, E. coli
tgttaatggcgctggatgataccgc

SEQ ID NO: 96984 - DNA, 25 bp, E. coli
tggtggtagcagtacacttcggagc

SEQ ID NO: 96985 - DNA, 25 bp, E. coli
tggtggtagcagaacacttcggagc

SEQ ID NO: 96986 - DNA, 25 bp, E. coli
tgttaatggcgcaggatgataccgc

SEQ ID NO: 96987 - DNA, 25 bp, E. coli
tcgaccagtgctacggctgcgtgga

SEQ ID NO: 96988 - DNA, 25 bp, E. coli
tcgaccagtgcttcggctgcgtgga

SEQ ID NO: 96989 - DNA, 25 bp, E. coli
gcaagccattcgatgcagcaaacgg

SEQ ID NO: 96990 - DNA, 25 bp, E. coli
gcaagccattcgttgcagcaaacgg

SEQ ID NO: 96991 - DNA, 25 bp, E. coli
gattgccaacctctgtgcgttagca

SEQ ID NO: 96992 - DNA, 25 bp, E. coli
gatttgcgatggagcgtcgaacagc

SEQ ID NO: 96993 - DNA, 25 bp, E. coli
gatttgcgatggtgcgtcgaacagc

SEQ ID NO: 96994 - DNA, 25 bp, E. coli
gattgccaacctgtgtgcgttagca

SEQ ID NO: 96995 - DNA, 25 bp, E. coli
caaatgagtgcacaagcagcaggta

SEQ ID NO: 96996 - DNA, 25 bp, E. coli
cagcggtggtatgtggtcgttctac

SEQ ID NO: 96997 - DNA, 25 bp, E. coli
caaatgagtgcagaagcagcaggta

SEQ ID NO: 96998 - DNA, 25 bp, E. coli
cagcggtggtatctggtcgttctac

SEQ ID NO: 96999 - DNA, 25 bp, E. coli
tacagaatgtgacgcgatgaccgca

SEQ ID NO: 97000 - DNA, 25 bp, E. coli
tacagaatgtgaggcgatgaccgca

SEQ ID NO: 97001 - DNA, 25 bp, E. coli
agtactttggcggtatcccgcagtg

SEQ ID NO: 97002 - DNA, 25 bp, E. coli
agtactttggcgctatcccgcagtg

SEQ ID NO: 97003 - DNA, 25 bp, E. coli
ttaactgcctgaacggtaacgatgc

SEQ ID NO: 97004 - DNA, 25 bp, E. coli
ttaactgcctgatcggtaacgatgc

SEQ ID NO: 97005 - DNA, 25 bp, E. coli
tgattgcgtatagccaccatgcctg

SEQ ID NO: 97006 - DNA, 25 bp, E. coli
tgattgcgtatacccaccatgcctg

SEQ ID NO: 97007 - DNA, 25 bp, E. coli
cctgcgggagtatgccatgcaacat

SEQ ID NO: 97008 - DNA, 25 bp, E. coli
cctgcgggagtaagccatgcaacat

SEQ ID NO: 97009 - DNA, 25 bp, E. coli
gaacagcgtatccatttctggccac

SEQ ID NO: 97010 - DNA, 25 bp, E. coli
gaacagcgtatcgatttctggccac

SEQ ID NO: 97011 - DNA, 25 bp, E. coli
cgttctacacccacagcaatggcgg

SEQ ID NO: 97012 - DNA, 25 bp, E. coli
cgagcctgacaaggatgagacatgg

SEQ ID NO: 97013 - DNA, 25 bp, E. coli
cgagcctgacaacgatgagacatgg

SEQ ID NO: 97014 - DNA, 25 bp, E. coli
cgttctacaccctcagcaatggcgg

SEQ ID NO: 97015 - DNA, 25 bp, E. coli
tggagccgcataacttcgcctggat

SEQ ID NO: 97016 - DNA, 25 bp, E. coli
tggagccgcatatcttcgcctggat

SEQ ID NO: 97017 - DNA, 25 bp, E. coli
aatcgcccgggctgctttgccgaat

SEQ ID NO: 97018 - DNA, 25 bp, E. coli
aatcgcccgggcagctttgccgaat

SEQ ID NO: 97019 - DNA, 25 bp, E. coli
cacgataggcgttggtgttaatcgc

SEQ ID NO: 97020 - DNA, 25 bp, E. coli
cacgataggcgtaggtgttaatcgc

SEQ ID NO: 97021 - DNA, 25 bp, E. coli
catatcacctgtcgtcattgccgca

SEQ ID NO: 97022 - DNA, 25 bp, E. coli
caggcccgattggtattatggcagc

SEQ ID NO: 97023 - DNA, 25 bp, E. coli
catatcacctgtggtcattgccgca

SEQ ID NO: 97024 - DNA, 25 bp, E. coli
caggcccgattgctattatggcagc

SEQ ID NO: 97025 - DNA, 25 bp, E. coli
aaaatctcaatgtcgtgatggcgga

SEQ ID NO: 97026 - DNA, 25 bp, E. coli
aaaatctcaatgacgtgatggcgga

SEQ ID NO: 97027 - DNA, 25 bp, E. coli
gcttgacaccatcaatcacggcggc

SEQ ID NO: 97028 - DNA, 25 bp, E. coli
gcttgacaccatgaatcacggcggc

SEQ ID NO: 97029 - DNA, 25 bp, E. coli
gacaatatttcccatgacttagccg

SEQ ID NO: 97030 - DNA, 25 bp, E. coli
gacttagccgcaatttttgatccct

SEQ ID NO: 97031 - DNA, 25 bp, E. coli
gacttagccgcattttttgatccct

SEQ ID NO: 97032 - DNA, 25 bp, E. coli
gacaatatttccgatgacttagccg

SEQ ID NO: 97033 - DNA, 25 bp, E. coli
cattgccgcaacagtcgtggtggtc

SEQ ID NO: 97034 - DNA, 25 bp, E. coli
cggagttaggcatgaccgaaggttt

SEQ ID NO: 97035 - DNA, 25 bp, E. coli
cggagttaggcaagaccgaaggttt

SEQ ID NO: 97036 - DNA, 25 bp, E. coli
cattgccgcaactgtcgtggtggtc

SEQ ID NO: 97037 - DNA, 25 bp, E. coli
gttaacgtcgccaaagaaaatctca

SEQ ID NO: 97038 - DNA, 25 bp, E. coli
gttaacgtcgcctaagaaaatctca

SEQ ID NO: 97039 - DNA, 25 bp, E. coli
catctggagcctttgatagtgaaaa

SEQ ID NO: 97040 - DNA, 25 bp, E. coli
catctggagcctatgatagtgaaaa

SEQ ID NO: 97041 - DNA, 25 bp, E. coli
agttgtgcctgggaaatactatcca

SEQ ID NO: 97042 - DNA, 25 bp, E. coli
agttgtgcctggcaaatactatcca

SEQ ID NO: 97043 - DNA, 25 bp, E. coli
tttaccgatgtgcagttgcgtggct

SEQ ID NO: 97044 - DNA, 25 bp, E. coli
tttaccgatgtggagttgcgtggct

SEQ ID NO: 97045 - DNA, 25 bp, E. coli
tgatggcagcatcaatgacgattac

SEQ ID NO: 97046 - DNA, 25 bp, E. coli
tgacgattaccggattgattacctg

SEQ ID NO: 97047 - DNA, 25 bp, E. coli
tgatggcagcatgaatgacgattac

SEQ ID NO: 97048 - DNA, 25 bp, E. coli
tgacgattaccgcattgattacctg

SEQ ID NO: 97049 - DNA, 25 bp, E. coli
gaatccgtatgttaaagcgtctgac

SEQ ID NO: 97050 - DNA, 25 bp, E. coli
gaatccgtatgtaaaagcgtctgac

SEQ ID NO: 97051 - DNA, 25 bp, E. coli
gcagttgcgtggctattacccgtcc

SEQ ID NO: 97052 - DNA, 25 bp, E. coli
gcagttgcgtgggtattacccgtcc

SEQ ID NO: 97053 - DNA, 25 bp, E. coli
cgcgcatcgcatgaacccggagatg

SEQ ID NO: 97054 - DNA, 25 bp, E. coli
cgcgcatcgcatcaacccggagatg

SEQ ID NO: 97055 - DNA, 25 bp, E. coli
cgaaggcagcgttccgaatccgtat

SEQ ID NO: 97056 - DNA, 25 bp, E. coli
cgaaggcagcgtaccgaatccgtat

SEQ ID NO: 97057 - DNA, 25 bp, E. coli
tggtttcgaaggcagcgtaccgaat

SEQ ID NO: 97058 - DNA, 25 bp, E. coli
tggtttcgaagggagcgtaccgaat

SEQ ID NO: 97059 - DNA, 25 bp, E. coli
tcaccaaagaagttgtgcctggcaa

SEQ ID NO: 97060 - DNA, 25 bp, E. coli
tcaccaaagaagatgtgcctggcaa

SEQ ID NO: 97061 - DNA, 25 bp, E. coli
caatcgcgctcgagatgcaggctta

SEQ ID NO: 97062 - DNA, 25 bp, E. coli
caatcgcgctcgtgatgcaggctta

SEQ ID NO: 97063 - DNA, 25 bp, E. coli
caacacgttggcctgaagagaacgc

SEQ ID NO: 97064 - DNA, 25 bp, E. coli
caacacgttggcgtgaagagaacgc

SEQ ID NO: 97065 - DNA, 25 bp, E. coli
taaaaaacatgcagcaacacgttgg

SEQ ID NO: 97066 - DNA, 25 bp, E. coli
taaaaaacatgctgcaacacgttgg

SEQ ID NO: 97067 - DNA, 25 bp, E. coli
aaagtgtgaccgtcaccgtcgaccg

SEQ ID NO: 97068 - DNA, 25 bp, E. coli
aaagtgtgaccgacaccgtcgaccg

SEQ ID NO: 97069 - DNA, 25 bp, E. coli
tatcgctgcgttaaatcaattggct

SEQ ID NO: 97070 - DNA, 25 bp, E. coli
tatcgctgcgtttaatcaattggct

SEQ ID NO: 97071 - DNA, 25 bp, E. coli
tgactgcaaaacctaccacacaaag

SEQ ID NO: 97072 - DNA, 25 bp, E. coli
tgactgcaaaacgtaccacacaaag

SEQ ID NO: 97073 - DNA, 25 bp, E. coli
tcgaccgtgagtaagtcaatcgcgc

SEQ ID NO: 97074 - DNA, 25 bp, E. coli
tcgaccgtgagttagtcaatcgcgc

SEQ ID NO: 97075 - DNA, 25 bp, E. coli
tctctgatgagttccggagcttcta

SEQ ID NO: 97076 - DNA, 25 bp, E. coli
tctctgatgagtaccggagcttcta

SEQ ID NO: 97077 - DNA, 25 bp, E. coli
cttacggttgcggtcaatgctgaac

SEQ ID NO: 97078 - DNA, 25 bp, E. coli
cttacggttgcgctcaatgctgaac

SEQ ID NO: 97079 - DNA, 25 bp, E. coli
ggcttaaatatgagcgccaccctta

SEQ ID NO: 97080 - DNA, 25 bp, E. coli
ggcttaaatatgtgcgccaccctta

SEQ ID NO: 97081 - DNA, 25 bp, E. coli
tcaattggctgatgaaaccggatgt

SEQ ID NO: 97082 - DNA, 25 bp, E. coli
tcaattggctgaagaaaccggatgt

SEQ ID NO: 97083 - DNA, 25 bp, E. coli
caaaactgcctggtgaaacggtgaa

SEQ ID NO: 97084 - DNA, 25 bp, E. coli
caaaactgcctgctgaaacggtgaa

SEQ ID NO: 97085 - DNA, 25 bp, E. coli
tacgcggaacttagaggagcaggct

SEQ ID NO: 97086 - DNA, 25 bp, E. coli
tacgcggaactttgaggagcaggct

SEQ ID NO: 97087 - DNA, 25 bp, E. coli
ttgtcgagcagaaagtgaaacgccc

SEQ ID NO: 97088 - DNA, 25 bp, E. coli
ttgtcgagcagatagtgaaacgccc

SEQ ID NO: 97089 - DNA, 25 bp, E. coli
tgttaattacgagccgaccgagctg

SEQ ID NO: 97090 - DNA, 25 bp, E. coli
tgttaattacgacccgaccgagctg

SEQ ID NO: 97091 - DNA, 25 bp, E. coli
tgctggaaggcaacgaagtcacgct

SEQ ID NO: 97092 - DNA, 25 bp, E. coli
tgctggaaggcatcgaagtcacgct

SEQ ID NO: 97093 - DNA, 25 bp, E. coli
gaaaaactggcatttcgcggcgata

SEQ ID NO: 97094 - DNA, 25 bp, E. coli
gaaaaactggcaattcgcggcgata

SEQ ID NO: 97095 - DNA, 25 bp, E. coli
cgatgatggatttacccggcgagca

SEQ ID NO: 97096 - DNA, 25 bp, E. coli
cgcgcgggcgcaactatctgattaa

SEQ ID NO: 97097 - DNA, 25 bp, E. coli
cgcgcgggcgcatctatctgattaa

SEQ ID NO: 97098 - DNA, 25 bp, E. coli
cgatgatggattaacccggcgagca

SEQ ID NO: 97099 - DNA, 25 bp, E. coli
gttttaatgttggaaggctgcgccc

SEQ ID NO: 97100 - DNA, 25 bp, E. coli
gttttaatgttgcaaggctgcgccc

SEQ ID NO: 97101 - DNA, 25 bp, E. coli
tcaatgaaagtgttaccgcgaccgc

SEQ ID NO: 97102 - DNA, 25 bp, E. coli
tcaatgaaagtgataccgcgaccgc

SEQ ID NO: 97103 - DNA, 25 bp, E. coli
taatattgatgcctggtggcccgcg

SEQ ID NO: 97104 - DNA, 25 bp, E. coli
taatattgatgcgtggtggcccgcg

SEQ ID NO: 97105 - DNA, 25 bp, E. coli
aaaaattgcagagcgagaactgtca

SEQ ID NO: 97106 - DNA, 25 bp, E. coli
aaaaattgcagaccgagaactgtca

SEQ ID NO: 97107 - DNA, 25 bp, E. coli
tattcagatgacacaggattaccgg

SEQ ID NO: 97108 - DNA, 25 bp, E. coli
tattcagatgactcaggattaccgg

SEQ ID NO: 97109 - DNA, 25 bp, E. coli
tgcaaagcggattgcctcggtgatg

SEQ ID NO: 97110 - DNA, 25 bp, E. coli
tgcaaagcggatagcctcggtgatg

SEQ ID NO: 97111 - DNA, 25 bp, E. coli
tcggtaacaaactaccagaatactg

SEQ ID NO: 97112 - DNA, 25 bp, E. coli
tcggtaacaaacaaccagaatactg

SEQ ID NO: 97113 - DNA, 25 bp, E. coli
gcacttcaccaacgtctgaacgaag

SEQ ID NO: 97114 - DNA, 25 bp, E. coli
gaatactgaagaaactgcaaagcgg

SEQ ID NO: 97115 - DNA, 25 bp, E. coli
gcaatcgcttctttctatgaggaaa

SEQ ID NO: 97116 - DNA, 25 bp, E. coli
gaatactgaagatactgcaaagcgg

SEQ ID NO: 97117 - DNA, 25 bp, E. coli
gcaatcgcttctatctatgaggaaa

SEQ ID NO: 97118 - DNA, 25 bp, E. coli
gcacttcaccaaggtctgaacgaag

SEQ ID NO: 97119 - DNA, 25 bp, E. coli
gaaatccaggaatttgcagcacatg

SEQ ID NO: 97120 - DNA, 25 bp, E. coli
gaaatccaggaaattgcagcacatg

SEQ ID NO: 97121 - DNA, 25 bp, E. coli
gaactgtcatctcctgcggcaatcg

SEQ ID NO: 97122 - DNA, 25 bp, E. coli
gaactgtcatctgctgcggcaatcg

SEQ ID NO: 97123 - DNA, 25 bp, E. coli
cctcggtgatggcttttcatgtcga

SEQ ID NO: 97124 - DNA, 25 bp, E. coli
cctcggtgatgggttttcatgtcga

SEQ ID NO: 97125 - DNA, 25 bp, E. coli
ggattaccggaactgctctcattac

SEQ ID NO: 97126 - DNA, 25 bp, E. coli
ggattaccggaagtgctctcattac

SEQ ID NO: 97127 - DNA, 25 bp, E. coli
agcccggatgaagtcattgctgcgg

SEQ ID NO: 97128 - DNA, 25 bp, E. coli
agcccggatgaactcattgctgcgg

SEQ ID NO: 97129 - DNA, 25 bp, E. coli
tagcccggatgaactcattgctgcg

SEQ ID NO: 97130 - DNA, 25 bp, E. coli
tagcccggatgatctcattgctgcg

SEQ ID NO: 97131 - DNA, 25 bp, E. coli
tgtagcccggatcaactcattgctg

SEQ ID NO: 97132 - DNA, 25 bp, E. coli
tgtagcccggatgaactcattgctg

SEQ ID NO: 97133 - DNA, 25 bp, E. coli
tccaaacgctgttgcccggatgaac

SEQ ID NO: 97134 - DNA, 25 bp, E. coli
tccaaacgctgtagcccggatgaac

SEQ ID NO: 97135 - DNA, 25 bp, E. coli
ccaaacgctgtagcccggatgaact

SEQ ID NO: 97136 - DNA, 25 bp, E. coli
gcccggatgaacacattgctgcggt

SEQ ID NO: 97137 - DNA, 25 bp, E. coli
ccaaacgctgtaccccggatgaact

SEQ ID NO: 97138 - DNA, 25 bp, E. coli
gcccggatgaactcattgctgcggt

SEQ ID NO: 97139 - DNA, 25 bp, E. coli
gctgtagcccggatgaactcattgc

SEQ ID NO: 97140 - DNA, 25 bp, E. coli
gctgtagcccggttgaactcattgc

SEQ ID NO: 97141 - DNA, 25 bp, E. coli
cccggatgaactgattgctgcggtg

SEQ ID NO: 97142 - DNA, 25 bp, E. coli
cgctgtagcccgcatgaactcattg

SEQ ID NO: 97143 - DNA, 25 bp, E. coli
cgctgtagcccggatgaactcattg

SEQ ID NO: 97144 - DNA, 25 bp, E. coli
cccggatgaactcattgctgcggtg

SEQ ID NO: 97145 - DNA, 25 bp, E. coli
cggatgaactcattgctgcggtgca

SEQ ID NO: 97146 - DNA, 25 bp, E. coli
cggatgaactcaatgctgcggtgca

SEQ ID NO: 97147 - DNA, 25 bp, E. coli
ggatgaactcatagctgcggtgcat

SEQ ID NO: 97148 - DNA, 25 bp, E. coli
ggatgaactcattgctgcggtgcat

SEQ ID NO: 97149 - DNA, 25 bp, E. coli
cagttattgctgcaacacggtgcca

SEQ ID NO: 97150 - DNA, 25 bp, E. coli
cagttattgctggaacacggtgcca

SEQ ID NO: 97151 - DNA, 25 bp, E. coli
ccttttttaattagctgtctgaacg

SEQ ID NO: 97152 - DNA, 25 bp, E. coli
ccttttttaatttgctgtctgaacg

SEQ ID NO: 97153 - DNA, 25 bp, E. coli
tgaccgataaatttggcaaaacgcc

SEQ ID NO: 97154 - DNA, 25 bp, E. coli
tgaccgataaatatggcaaaacgcc

SEQ ID NO: 97155 - DNA, 25 bp, E. coli
gcctgcctgtgataaaggccattta

SEQ ID NO: 97156 - DNA, 25 bp, E. coli
gcctgcctgtgaaaaaggccattta

SEQ ID NO: 97157 - DNA, 25 bp, E. coli
cgctggcaagtttatatcagcaata

SEQ ID NO: 97158 - DNA, 25 bp, E. coli
cgctggcaagttaatatcagcaata

SEQ ID NO: 97159 - DNA, 25 bp, E. coli
cggcctgacgccagcctgtgaaaaa

SEQ ID NO: 97160 - DNA, 25 bp, E. coli
cggcctgacgcctgcctgtgaaaaa

SEQ ID NO: 97161 - DNA, 25 bp, E. coli
gtgccagcccgcatctgaccgataa

SEQ ID NO: 97162 - DNA, 25 bp, E. coli
ggtgtcgatatttatacctgcgatc

SEQ ID NO: 97163 - DNA, 25 bp, E. coli
gtgccagcccgcttctgaccgataa

SEQ ID NO: 97164 - DNA, 25 bp, E. coli
ggtgtcgatattaatacctgcgatc

SEQ ID NO: 97165 - DNA, 25 bp, E. coli
ggccatttaagttttgtaaaagagc

SEQ ID NO: 97166 - DNA, 25 bp, E. coli
ggaaaacggcaattacgctggcaag

SEQ ID NO: 97167 - DNA, 25 bp, E. coli
ggaaaacggcaaatacgctggcaag

SEQ ID NO: 97168 - DNA, 25 bp, E. coli
ggccatttaagtattgtaaaagagc

SEQ ID NO: 97169 - DNA, 25 bp, E. coli
tcagcaatatgcatgcgttcaggca

SEQ ID NO: 97170 - DNA, 25 bp, E. coli
tcagcaatatgcttgcgttcaggca

SEQ ID NO: 97171 - DNA, 25 bp, E. coli
tacacctcgcatggaaagctggact

SEQ ID NO: 97172 - DNA, 25 bp, E. coli
tacacctcgcatcgaaagctggact

SEQ ID NO: 97173 - DNA, 25 bp, E. coli
atcatggaaagcaagaggatgtggc

SEQ ID NO: 97174 - DNA, 25 bp, E. coli
atcatggaaagctagaggatgtggc

SEQ ID NO: 97175 - DNA, 25 bp, E. coli
gaaggaaccttaagggctttgaagc

SEQ ID NO: 97176 - DNA, 25 bp, E. coli
gaaggaaccttatgggctttgaagc

SEQ ID NO: 97177 - DNA, 25 bp, E. coli
ttatggctgcgtttcattggtggcg

SEQ ID NO: 97178 - DNA, 25 bp, E. coli
ttatggctgcgtatcattggtggcg

SEQ ID NO: 97179 - DNA, 25 bp, E. coli
tgtggcgaagtatttatgcccctcc

SEQ ID NO: 97180 - DNA, 25 bp, E. coli
tgtggcgaagtaattatgcccctcc

SEQ ID NO: 97181 - DNA, 25 bp, E. coli
gcatttgtctcaagcgtcgtcgcag

SEQ ID NO: 97182 - DNA, 25 bp, E. coli
gcatttgtctcatgcgtcgtcgcag

SEQ ID NO: 97183 - DNA, 25 bp, E. coli
gaaacacgctatagccatcatggaa

SEQ ID NO: 97184 - DNA, 25 bp, E. coli
gaaacacgctattgccatcatggaa

SEQ ID NO: 97185 - DNA, 25 bp, E. coli
cgttaacaacctgccagactgggat

SEQ ID NO: 97186 - DNA, 25 bp, E. coli
cgttaacaacctcccagactgggat

SEQ ID NO: 97187 - DNA, 25 bp, E. coli
cattggtggcgaaaggtcgttaaca

SEQ ID NO: 97188 - DNA, 25 bp, E. coli
cattggtggcgataggtcgttaaca

SEQ ID NO: 97189 - DNA, 25 bp, E. coli
ggatacagggattcaaccgggcact

SEQ ID NO: 97190 - DNA, 25 bp, E. coli
ggatacagggatacaaccgggcact

SEQ ID NO: 97191 - DNA, 25 bp, E. coli
tggactcaagataccaccgctacct

SEQ ID NO: 97192 - DNA, 25 bp, E. coli
tggactcaagattccaccgctacct

SEQ ID NO: 97193 - DNA, 25 bp, E. coli
taaaattaacatataccgcgtggcg

SEQ ID NO: 97194 - DNA, 25 bp, E. coli
taaaattaacatttaccgcgtggcg

SEQ ID NO: 97195 - DNA, 25 bp, E. coli
taacatttaccgggtggcgaaagat

SEQ ID NO: 97196 - DNA, 25 bp, E. coli
agttacaggcgcgtttcgacgaaga

SEQ ID NO: 97197 - DNA, 25 bp, E. coli
agttacaggcgcctttcgacgaaga

SEQ ID NO: 97198 - DNA, 25 bp, E. coli
aggcttcgttcgtcccgagcgtact

SEQ ID NO: 97199 - DNA, 25 bp, E. coli
attaacatttaccgcgtggcgaaag

SEQ ID NO: 97200 - DNA, 25 bp, E. coli
attaacatttacggcgtggcgaaag

SEQ ID NO: 97201 - DNA, 25 bp, E. coli
aggcttcgttcgacccgagcgtact

SEQ ID NO: 97202 - DNA, 25 bp, E. coli
ttaacatttaccgcgtggcgaaaga

SEQ ID NO: 97203 - DNA, 25 bp, E. coli
ttaacatttaccccgtggcgaaaga

SEQ ID NO: 97204 - DNA, 25 bp, E. coli
ttcgttcgaccccagcgtactggcg

SEQ ID NO: 97205 - DNA, 25 bp, E. coli
ttcgttcgacccgagcgtactggcg

SEQ ID NO: 97206 - DNA, 25 bp, E. coli
tcaggcttcgttggacccgagcgta

SEQ ID NO: 97207 - DNA, 25 bp, E. coli
tcaggcttcgttcgacccgagcgta

SEQ ID NO: 97208 - DNA, 25 bp, E. coli
ggcttcgttcgacccgagcgtactg

SEQ ID NO: 97209 - DNA, 25 bp, E. coli
ggcttcgttcgagccgagcgtactg

SEQ ID NO: 97210 - DNA, 25 bp, E. coli
ggttgagttacaggcgcgtttcgac

SEQ ID NO: 97211 - DNA, 25 bp, E. coli
ggttgagttacacgcgcgtttcgac

SEQ ID NO: 97212 - DNA, 25 bp, E. coli
tggttgagttacaggcgcgtttcga

SEQ ID NO: 97213 - DNA, 25 bp, E. coli
tggttgagttactggcgcgtttcga

SEQ ID NO: 97214 - DNA, 25 bp, E. coli
taacatttaccgcgtggcgaaagat

SEQ ID NO: 97215 - DNA, 25 bp, E. coli
caatggcggcacagacggaacttct

SEQ ID NO: 97216 - DNA, 25 bp, E. coli
caatggcggcactgacggaacttct

SEQ ID NO: 97217 - DNA, 25 bp, E. coli
caaggatgggttttcaacgacggat

SEQ ID NO: 97218 - DNA, 25 bp, E. coli
caaggatgggttatcaacgacggat

SEQ ID NO: 97219 - DNA, 25 bp, E. coli
tacttcgcagcgagtgagctggctc

SEQ ID NO: 97220 - DNA, 25 bp, E. coli
tacttcgcagcgtgtgagctggctc

SEQ ID NO: 97221 - DNA, 25 bp, E. coli
tatattaaagctgccgaagcggtag

SEQ ID NO: 97222 - DNA, 25 bp, E. coli
tatattaaagctcccgaagcggtag

SEQ ID NO: 97223 - DNA, 25 bp, E. coli
tgaaagacgtctgttccgccgactc

SEQ ID NO: 97224 - DNA, 25 bp, E. coli
tgaaagacgtctcttccgccgactc

SEQ ID NO: 97225 - DNA, 25 bp, E. coli
tgcgttcccacatgcagcaatggcg

SEQ ID NO: 97226 - DNA, 25 bp, E. coli
tgcgttcccacaagcagcaatggcg

SEQ ID NO: 97227 - DNA, 25 bp, E. coli
gaagaaagtactaccaacctgttgg

SEQ ID NO: 97228 - DNA, 25 bp, E. coli
gaagaaagtacttccaacctgttgg

SEQ ID NO: 97229 - DNA, 25 bp, E. coli
gaaaacgcccgtagctggctgttga

SEQ ID NO: 97230 - DNA, 25 bp, E. coli
gaaaacgcccgttgctggctgttga

SEQ ID NO: 97231 - DNA, 25 bp, E. coli
cgacggatcgctggtacatatatta

SEQ ID NO: 97232 - DNA, 25 bp, E. coli
cgacggatcgctcgtacatatatta

SEQ ID NO: 97233 - DNA, 25 bp, E. coli
gattttgacaacattgccgctggag

SEQ ID NO: 97234 - DNA, 25 bp, E. coli
gatcggatgacgtaagccattgctg

SEQ ID NO: 97235 - DNA, 25 bp, E. coli
gattttgacaactttgccgctggag

SEQ ID NO: 97236 - DNA, 25 bp, E. coli
gatcggatgacgaaagccattgctg

SEQ ID NO: 97237 - DNA, 25 bp, E. coli
cagctgcgcgcgaaaggtattgcta

SEQ ID NO: 97238 - DNA, 25 bp, E. coli
cacaccgatcgaagaatgctacgag

SEQ ID NO: 97239 - DNA, 25 bp, E. coli
cacaccgatcgatgaatgctacgag

SEQ ID NO: 97240 - DNA, 25 bp, E. coli
cagctgcgcgcgtaaggtattgcta

SEQ ID NO: 97241 - DNA, 25 bp, E. coli
taccggcgaattagagtgcaccagc

SEQ ID NO: 97242 - DNA, 25 bp, E. coli
taccggcgaatttgagtgcaccagc

SEQ ID NO: 97243 - DNA, 25 bp, E. coli
ttgctattgttgagcgtctgcgtca

SEQ ID NO: 97244 - DNA, 25 bp, E. coli
ttgctattgttgtgcgtctgcgtca

SEQ ID NO: 97245 - DNA, 25 bp, E. coli
tcaaacaccgttagtgacctttggt

SEQ ID NO: 97246 - DNA, 25 bp, E. coli
tcaaacaccgtttgtgacctttggt

SEQ ID NO: 97247 - DNA, 25 bp, E. coli
gcctctacagtacgccgagtgagaa

SEQ ID NO: 97248 - DNA, 25 bp, E. coli
gcctctacagtaggccgagtgagaa

SEQ ID NO: 97249 - DNA, 25 bp, E. coli
gaagaaactggctacggtttcagcc

SEQ ID NO: 97250 - DNA, 25 bp, E. coli
gaatgctgacgaggacgtttctgaa

SEQ ID NO: 97251 - DNA, 25 bp, E. coli
gcacacgaacgtggtgatattcact

SEQ ID NO: 97252 - DNA, 25 bp, E. coli
gaatgctgacgacgacgtttctgaa

SEQ ID NO: 97253 - DNA, 25 bp, E. coli
gcacacgaacgtcgtgatattcact

SEQ ID NO: 97254 - DNA, 25 bp, E. coli
gaagaaactggcaacggtttcagcc

SEQ ID NO: 97255 - DNA, 25 bp, E. coli
cgtgcgtctgaaagctgacgacgac

SEQ ID NO: 97256 - DNA, 25 bp, E. coli
cgtgcgtctgaatgctgacgacgac

SEQ ID NO: 97257 - DNA, 25 bp, E. coli
ggcaccaacacagcgatcgatgaat

SEQ ID NO: 97258 - DNA, 25 bp, E. coli
ggcaccaacacaccgatcgatgaat

SEQ ID NO: 97259 - DNA, 25 bp, E. coli
catgctacgttaatgggatcatcga

SEQ ID NO: 97260 - DNA, 25 bp, E. coli
catgctacgttattgggatcatcga

SEQ ID NO: 97261 - DNA, 25 bp, E. coli
tattaaatgggttcaggcacaacgt

SEQ ID NO: 97262 - DNA, 25 bp, E. coli
tataatcaggtcagtatcaccacgc

SEQ ID NO: 97263 - DNA, 25 bp, E. coli
tttggtaacgagcagtgcgaccccg

SEQ ID NO: 97264 - DNA, 25 bp, E. coli
tataatcaggtctgtatcaccacgc

SEQ ID NO: 97265 - DNA, 25 bp, E. coli
tattaaatgggtacaggcacaacgt

SEQ ID NO: 97266 - DNA, 25 bp, E. coli
tttgaccattcaccgcatcagccag

SEQ ID NO: 97267 - DNA, 25 bp, E. coli
tttgaccattcagcgcatcagccag

SEQ ID NO: 97268 - DNA, 25 bp, E. coli
tttggtaacgaggagtgcgaccccg

SEQ ID NO: 97269 - DNA, 25 bp, E. coli
tgggaaatgccaccacagacgatgc

SEQ ID NO: 97270 - DNA, 25 bp, E. coli
tgggaaatgccagcacagacgatgc

SEQ ID NO: 97271 - DNA, 25 bp, E. coli
tctgatagccccaggaatcgccttg

SEQ ID NO: 97272 - DNA, 25 bp, E. coli
tctgatagcccctggaatcgccttg

SEQ ID NO: 97273 - DNA, 25 bp, E. coli
gccacggatgccaacgcacatattt

SEQ ID NO: 97274 - DNA, 25 bp, E. coli
gccacggatgcctacgcacatattt

SEQ ID NO: 97275 - DNA, 25 bp, E. coli
gattcgccacaacgcttaacggcag

SEQ ID NO: 97276 - DNA, 25 bp, E. coli
gattcgccacaaggcttaacggcag

SEQ ID NO: 97277 - DNA, 25 bp, E. coli
gatcatcgaaaatacccttaactgg

SEQ ID NO: 97278 - DNA, 25 bp, E. coli
gagcaaggcgcaaactataatcagg

SEQ ID NO: 97279 - DNA, 25 bp, E. coli
gagcaaggcgcatactataatcagg

SEQ ID NO: 97280 - DNA, 25 bp, E. coli
gatcatcgaaaaaacccttaactgg

SEQ ID NO: 97281 - DNA, 25 bp, E. coli
cagaatttctaatctggatgcagat

SEQ ID NO: 97282 - DNA, 25 bp, E. coli
caacacgttgaaatcaggtcaggga

SEQ ID NO: 97283 - DNA, 25 bp, E. coli
caacacgttgaattcaggtcaggga

SEQ ID NO: 97284 - DNA, 25 bp, E. coli
cagggttgcgatgtaaagaatgatc

SEQ ID NO: 97285 - DNA, 25 bp, E. coli
cagggttgcgatctaaagaatgatc

SEQ ID NO: 97286 - DNA, 25 bp, E. coli
cagacttgtctaagatgtcgcgtca

SEQ ID NO: 97287 - DNA, 25 bp, E. coli
cagaatttctaaactggatgcagat

SEQ ID NO: 97288 - DNA, 25 bp, E. coli
cagacttgtctatgatgtcgcgtca

SEQ ID NO: 97289 - DNA, 25 bp, E. coli
acatacctgtatgcgtcgtctgaag

SEQ ID NO: 97290 - DNA, 25 bp, E. coli
acatacctgtatccgtcgtctgaag

SEQ ID NO: 97291 - DNA, 25 bp, E. coli
tcgtctgaaggatgtctcaacgccg

SEQ ID NO: 97292 - DNA, 25 bp, E. coli
tcgtctgaaggaagtctcaacgccg

SEQ ID NO: 97293 - DNA, 25 bp, E. coli
tctcaacgccgaatacagaatttct

SEQ ID NO: 97294 - DNA, 25 bp, E. coli
tctcaacgccgattacagaatttct

SEQ ID NO: 97295 - DNA, 25 bp, E. coli
gcagatttatctacaccggacgcag

SEQ ID NO: 97296 - DNA, 25 bp, E. coli
gcagatttatcttcaccggacgcag

SEQ ID NO: 97297 - DNA, 25 bp, E. coli
gaaagtcactttttcagggttgcga

SEQ ID NO: 97298 - DNA, 25 bp, E. coli
gaaagtcactttatcagggttgcga

SEQ ID NO: 97299 - DNA, 25 bp, E. coli
gattattaccagtctaacatacctg

SEQ ID NO: 97300 - DNA, 25 bp, E. coli
gattattaccagactaacatacctg

SEQ ID NO: 97301 - DNA, 25 bp, E. coli
gatgtcgcgtcatactatttttcaa

SEQ ID NO: 97302 - DNA, 25 bp, E. coli
gatgtcgcgtcaaactatttttcaa

SEQ ID NO: 97303 - DNA, 25 bp, E. coli
caaatcgccagtccgcagatggctg

SEQ ID NO: 97304 - DNA, 25 bp, E. coli
caaatcgccagtgcgcagatggctg

SEQ ID NO: 97305 - DNA, 25 bp, E. coli
cagatggctgaatggttttcgttgc

SEQ ID NO: 97306 - DNA, 25 bp, E. coli
cagatggctgaaaggttttcgttgc

SEQ ID NO: 97307 - DNA, 25 bp, E. coli
catctgcatttttcgctgggagagg

SEQ ID NO: 97308 - DNA, 25 bp, E. coli
caggacgagcaagagattaaacgct

SEQ ID NO: 97309 - DNA, 25 bp, E. coli
catctgcattttacgctgggagagg

SEQ ID NO: 97310 - DNA, 25 bp, E. coli
caggacgagcaacagattaaacgct

SEQ ID NO: 97311 - DNA, 25 bp, E. coli
taaacgcttgttagttgaggcaggg

SEQ ID NO: 97312 - DNA, 25 bp, E. coli
taaacgcttgtttgttgaggcaggg

SEQ ID NO: 97313 - DNA, 25 bp, E. coli
tacgcggcactaagccagttattgc

SEQ ID NO: 97314 - DNA, 25 bp, E. coli
tatgcatcggccaacaaacaggacg

SEQ ID NO: 97315 - DNA, 25 bp, E. coli
tacgcggcactatgccagttattgc

SEQ ID NO: 97316 - DNA, 25 bp, E. coli
tatgcatcggcctacaaacaggacg

SEQ ID NO: 97317 - DNA, 25 bp, E. coli
gctttggttttttcgcggcactaag

SEQ ID NO: 97318 - DNA, 25 bp, E. coli
gctttggtttttacgcggcactaag

SEQ ID NO: 97319 - DNA, 25 bp, E. coli
gacagtacgtgaggatgcccgtctg

SEQ ID NO: 97320 - DNA, 25 bp, E. coli
gacttttgcggcgtgtttctgatga

SEQ ID NO: 97321 - DNA, 25 bp, E. coli
gacttttgcggcctgtttctgatga

SEQ ID NO: 97322 - DNA, 25 bp, E. coli
gacagtacgtgacgatgcccgtctg

SEQ ID NO: 97323 - DNA, 25 bp, E. coli
gatgaacaactgacgcaaatcgcca

SEQ ID NO: 97324 - DNA, 25 bp, E. coli
gatgaacaactgtcgcaaatcgcca

SEQ ID NO: 97325 - DNA, 25 bp, E. coli
cagtttgctttttgatcatcagggc

SEQ ID NO: 97326 - DNA, 25 bp, E. coli
cagtttgcttttagatcatcagggc

SEQ ID NO: 97327 - DNA, 25 bp, E. coli
acttacaagtgtgtcatatcggcga

SEQ ID NO: 97328 - DNA, 25 bp, E. coli
acttacaagtgtctcatatcggcga

SEQ ID NO: 97329 - DNA, 25 bp, E. coli
tattatggccgaattgaggagggaa

SEQ ID NO: 97330 - DNA, 25 bp, E. coli
tattatggccgatttgaggagggaa

SEQ ID NO: 97331 - DNA, 25 bp, E. coli
tgtacgcctaaatctgaaacgagac

SEQ ID NO: 97332 - DNA, 25 bp, E. coli
tgtattttaccgagggcatcacccc

SEQ ID NO: 97333 - DNA, 25 bp, E. coli
tgtattttaccgtgggcatcacccc

SEQ ID NO: 97334 - DNA, 25 bp, E. coli
tgtacgcctaaaactgaaacgagac

SEQ ID NO: 97335 - DNA, 25 bp, E. coli
tcgtcagaaatgcaaacaggagcct

SEQ ID NO: 97336 - DNA, 25 bp, E. coli
tcgtcagaaatggaaacaggagcct

SEQ ID NO: 97337 - DNA, 25 bp, E. coli
gcaaagcgacctaaaaagccctgta

SEQ ID NO: 97338 - DNA, 25 bp, E. coli
gcaaagcgaccttaaaagccctgta

SEQ ID NO: 97339 - DNA, 25 bp, E. coli
gatacagtgagtagacaccgggcaa

SEQ ID NO: 97340 - DNA, 25 bp, E. coli
gatcatcagggcaaaagtaccggcc

SEQ ID NO: 97341 - DNA, 25 bp, E. coli
gtaccggcccaaacgatgaccataa

SEQ ID NO: 97342 - DNA, 25 bp, E. coli
gatacagtgagttgacaccgggcaa

SEQ ID NO: 97343 - DNA, 25 bp, E. coli
gatcatcagggctaaagtaccggcc

SEQ ID NO: 97344 - DNA, 25 bp, E. coli
gtaccggcccaatcgatgaccataa

SEQ ID NO: 97345 - DNA, 25 bp, E. coli
taaactgctcgacacggcgctaatg

SEQ ID NO: 97346 - DNA, 25 bp, E. coli
taaactgctcgagacggcgctaatg

SEQ ID NO: 97347 - DNA, 25 bp, E. coli
aattaggcgaatcgctggctcaggc

SEQ ID NO: 97348 - DNA, 25 bp, E. coli
aattaggcgaatggctggctcaggc

SEQ ID NO: 97349 - DNA, 25 bp, E. coli
tacggacgttcattattgggcgcgc

SEQ ID NO: 97350 - DNA, 25 bp, E. coli
tacggacgttcaatattgggcgcgc

SEQ ID NO: 97351 - DNA, 25 bp, E. coli
tattgaagatcccagacacagcgaa

SEQ ID NO: 97352 - DNA, 25 bp, E. coli
tattgaagatccgagacacagcgaa

SEQ ID NO: 97353 - DNA, 25 bp, E. coli
tttgaattgcctctggtaaccagcg

SEQ ID NO: 97354 - DNA, 25 bp, E. coli
tttgaattgcctgtggtaaccagcg

SEQ ID NO: 97355 - DNA, 25 bp, E. coli
ttgattctggctggcactcacggtg

SEQ ID NO: 97356 - DNA, 25 bp, E. coli
ttgattctggctcgcactcacggtg

SEQ ID NO: 97357 - DNA, 25 bp, E. coli
tgtgtgtgaatcctgacggctgcca

SEQ ID NO: 97358 - DNA, 25 bp, E. coli
tgtaatacttccagaaccagagacg

SEQ ID NO: 97359 - DNA, 25 bp, E. coli
tgtgtgtgaatcgtgacggctgcca

SEQ ID NO: 97360 - DNA, 25 bp, E. coli
tgtaatacttcctgaaccagagacg

SEQ ID NO: 97361 - DNA, 25 bp, E. coli
gaacttgcattggatcaccgcagag

SEQ ID NO: 97362 - DNA, 25 bp, E. coli
gaaaactcttcggtcgtcacgctct

SEQ ID NO: 97363 - DNA, 25 bp, E. coli
gaacttgcattgcatcaccgcagag

SEQ ID NO: 97364 - DNA, 25 bp, E. coli
gaaaactcttcgctcgtcacgctct

SEQ ID NO: 97365 - DNA, 25 bp, E. coli
cattcaacctgcgtgggtggtctca

SEQ ID NO: 97366 - DNA, 25 bp, E. coli
cattcaacctgcctgggtggtctca

SEQ ID NO: 97367 - DNA, 25 bp, E. coli
taaccagcgtcggttatgaaacgcc

SEQ ID NO: 97368 - DNA, 25 bp, E. coli
taaccagcgtcgcttatgaaacgcc

SEQ ID NO: 97369 - DNA, 25 bp, E. coli
tattcagaccgtatcctttgtgcgg

SEQ ID NO: 97370 - DNA, 25 bp, E. coli
tattcagaccgtttcctttgtgcgg

SEQ ID NO: 97371 - DNA, 25 bp, E. coli
tgcagtgtgccgaagaagttctcca

SEQ ID NO: 97372 - DNA, 25 bp, E. coli
tgcagtgtgccgtagaagttctcca

SEQ ID NO: 97373 - DNA, 25 bp, E. coli
tccatcgctgcgatattcagaccgt

SEQ ID NO: 97374 - DNA, 25 bp, E. coli
tccatcgctgcgttattcagaccgt

SEQ ID NO: 97375 - DNA, 25 bp, E. coli
gaagaagttctcgatcgctgcgtta

SEQ ID NO: 97376 - DNA, 25 bp, E. coli
gaattagcgatccaccacgatgcga

SEQ ID NO: 97377 - DNA, 25 bp, E. coli
gaattagcgatcgaccacgatgcga

SEQ ID NO: 97378 - DNA, 25 bp, E. coli
gaagaagttctccatcgctgcgtta

SEQ ID NO: 97379 - DNA, 25 bp, E. coli
gaacatcgttcactgattcacgacg

SEQ ID NO: 97380 - DNA, 25 bp, E. coli
gaacatcgttcagtgattcacgacg

SEQ ID NO: 97381 - DNA, 25 bp, E. coli
cgatgcgattttgcagtgtgccgaa

SEQ ID NO: 97382 - DNA, 25 bp, E. coli
cgatgcgattttccagtgtgccgaa

SEQ ID NO: 97383 - DNA, 25 bp, E. coli
gattcacgacgaattagcgatcgac

SEQ ID NO: 97384 - DNA, 25 bp, E. coli
gattcacgacgatttagcgatcgac

SEQ ID NO: 97385 - DNA, 25 bp, E. coli
ggcatattttgtgctactccatggg

SEQ ID NO: 97386 - DNA, 25 bp, E. coli
ggcatattttgtcctactccatggg

SEQ ID NO: 97387 - DNA, 25 bp, E. coli
gaccgtttccttagtgcggcatatt

SEQ ID NO: 97388 - DNA, 25 bp, E. coli
gaccgtttcctttgtgcggcatatt

SEQ ID NO: 97389 - DNA, 25 bp, E. coli
gatcgaccacgatgcgattttgcag

SEQ ID NO: 97390 - DNA, 25 bp, E. coli
gatcgaccacgaagcgattttgcag

SEQ ID NO: 97391 - DNA, 25 bp, E. coli
cagcatcgtccgcaaaaaccgattg

SEQ ID NO: 97392 - DNA, 25 bp, E. coli
cagcatcgtccggaaaaaccgattg

SEQ ID NO: 97393 - DNA, 25 bp, E. coli
catcgtccgcaaaaaccgattgttg

SEQ ID NO: 97394 - DNA, 25 bp, E. coli
catgatggtaaaaaccgctaacgcg

SEQ ID NO: 97395 - DNA, 25 bp, E. coli
catgatggtaaataccgctaacgcg

SEQ ID NO: 97396 - DNA, 25 bp, E. coli
catcgtccgcaataaccgattgttg

SEQ ID NO: 97397 - DNA, 25 bp, E. coli
atcgacccgctggtgacgccgcctg

SEQ ID NO: 97398 - DNA, 25 bp, E. coli
atcgacccgctgctgacgccgcctg

SEQ ID NO: 97399 - DNA, 25 bp, E. coli
aaaccgattgttgccgttatctaca

SEQ ID NO: 97400 - DNA, 25 bp, E. coli
aaaccgattgttcccgttatctaca

SEQ ID NO: 97401 - DNA, 25 bp, E. coli
taccgctaacgccaaagaggaagcg

SEQ ID NO: 97402 - DNA, 25 bp, E. coli
taccgctaacgcgaaagaggaagcg

SEQ ID NO: 97403 - DNA, 25 bp, E. coli
cgcgaaagaggaagcgaaagccgcc

SEQ ID NO: 97404 - DNA, 25 bp, E. coli
cgcgaaagaggatgcgaaagccgcc

SEQ ID NO: 97405 - DNA, 25 bp, E. coli
gttgccgttatcaacactcacagcc

SEQ ID NO: 97406 - DNA, 25 bp, E. coli
gattgttgccgtaatctacactcac

SEQ ID NO: 97407 - DNA, 25 bp, E. coli
gttgccgttatctacactcacagcc

SEQ ID NO: 97408 - DNA, 25 bp, E. coli
gattgttgccgttatctacactcac

SEQ ID NO: 97409 - DNA, 25 bp, E. coli
ggtaaataccgcaaacgcgaaagag

SEQ ID NO: 97410 - DNA, 25 bp, E. coli
ggtaaataccgctaacgcgaaagag

SEQ ID NO: 97411 - DNA, 25 bp, E. coli
taacgcgaaagacgaagcgaaagcc

SEQ ID NO: 97412 - DNA, 25 bp, E. coli
taacgcgaaagaggaagcgaaagcc

SEQ ID NO: 97413 - DNA, 25 bp, E. coli
cagttctggcagaatttgacctgct

SEQ ID NO: 97414 - DNA, 25 bp, E. coli
cagtatttgaccagctgggtgcgct

SEQ ID NO: 97415 - DNA, 25 bp, E. coli
cagttctggcagtatttgacctgct

SEQ ID NO: 97416 - DNA, 25 bp, E. coli
cagtatttgacctgctgggtgcgct

SEQ ID NO: 97417 - DNA, 25 bp, E. coli
agtatttgacctgctgggtgcgctg

SEQ ID NO: 97418 - DNA, 25 bp, E. coli
agtatttgacctcctgggtgcgctg

SEQ ID NO: 97419 - DNA, 25 bp, E. coli
atttgacctgctcggtgcgctggtt

SEQ ID NO: 97420 - DNA, 25 bp, E. coli
atttgacctgctgggtgcgctggtt

SEQ ID NO: 97421 - DNA, 25 bp, E. coli
tatttgacctgctgggtgcgctggt

SEQ ID NO: 97422 - DNA, 25 bp, E. coli
tatttgacctgcagggtgcgctggt

SEQ ID NO: 97423 - DNA, 25 bp, E. coli
ttgacctgctgggtgcgctggttat

SEQ ID NO: 97424 - DNA, 25 bp, E. coli
ttgacctgctggctgcgctggttat

SEQ ID NO: 97425 - DNA, 25 bp, E. coli
tgacctgctgggtgcgctggttatc

SEQ ID NO: 97426 - DNA, 25 bp, E. coli
tgacctgctgggagcgctggttatc

SEQ ID NO: 97427 - DNA, 25 bp, E. coli
tctggcagtattagacctgctgggt

SEQ ID NO: 97428 - DNA, 25 bp, E. coli
tctggcagtatttgacctgctgggt

SEQ ID NO: 97429 - DNA, 25 bp, E. coli
gcagttctggcagtatttgacctgc

SEQ ID NO: 97430 - DNA, 25 bp, E. coli
gcagttctggcactatttgacctgc

SEQ ID NO: 97431 - DNA, 25 bp, E. coli
gttctggcagtaattgacctgctgg

SEQ ID NO: 97432 - DNA, 25 bp, E. coli
gttctggcagtatttgacctgctgg

SEQ ID NO: 97433 - DNA, 25 bp, E. coli
tggcagtatttgacctgctgggtgc

SEQ ID NO: 97434 - DNA, 25 bp, E. coli
tggcagtatttgtcctgctgggtgc

SEQ ID NO: 97435 - DNA, 25 bp, E. coli
aagtctatctgcctgttgcccggtg

SEQ ID NO: 97436 - DNA, 25 bp, E. coli
aattccagctcatccctctgaagag

SEQ ID NO: 97437 - DNA, 25 bp, E. coli
aagtctatctgcgtgttgcccggtg

SEQ ID NO: 97438 - DNA, 25 bp, E. coli
aattccagctcaaccctctgaagag

SEQ ID NO: 97439 - DNA, 25 bp, E. coli
accctctgaagaggttgatcactcc

SEQ ID NO: 97440 - DNA, 25 bp, E. coli
accctctgaagacgttgatcactcc

SEQ ID NO: 97441 - DNA, 25 bp, E. coli
tttccaggtcggcaagtctatctgc

SEQ ID NO: 97442 - DNA, 25 bp, E. coli
tttccaggtcgggaagtctatctgc

SEQ ID NO: 97443 - DNA, 25 bp, E. coli
ttctttccaggtcggcaagtctatc

SEQ ID NO: 97444 - DNA, 25 bp, E. coli
ttctttccaggtgggcaagtctatc

SEQ ID NO: 97445 - DNA, 25 bp, E. coli
tgaatagttatgttttccctgttgt

SEQ ID NO: 97446 - DNA, 25 bp, E. coli
tgaatagttatgatttccctgttgt

SEQ ID NO: 97447 - DNA, 25 bp, E. coli
tccagctcaaccctctgaagaggtt

SEQ ID NO: 97448 - DNA, 25 bp, E. coli
tccagctcaaccgtctgaagaggtt

SEQ ID NO: 97449 - DNA, 25 bp, E. coli
ccagatgaatagatatgttttccct

SEQ ID NO: 97450 - DNA, 25 bp, E. coli
ccagatgaatagttatgttttccct

SEQ ID NO: 97451 - DNA, 25 bp, E. coli
gtgatcgtccagttgaatagttatg

SEQ ID NO: 97452 - DNA, 25 bp, E. coli
gtgatcgtccagatgaatagttatg

SEQ ID NO: 97453 - DNA, 25 bp, E. coli
gtctatctgcctcttgcccggtgat

SEQ ID NO: 97454 - DNA, 25 bp, E. coli
gtctatctgcctgttgcccggtgat

SEQ ID NO: 97455 - DNA, 25 bp, E. coli
ggtcggcaagtctatctgcctgttg

SEQ ID NO: 97456 - DNA, 25 bp, E. coli
ggtcggcaagtcaatctgcctgttg

SEQ ID NO: 97457 - DNA, 25 bp, E. coli
aagggatgagcgttcctgtccagat

SEQ ID NO: 97458 - DNA, 25 bp, E. coli
aagggatgagcgatcctgtccagat

SEQ ID NO: 97459 - DNA, 25 bp, E. coli
cactgctggcgtgtgcaggtccgat

SEQ ID NO: 97460 - DNA, 25 bp, E. coli
ctgaacttctttgccgggccgacgg

SEQ ID NO: 97461 - DNA, 25 bp, E. coli
cactgctggcgtctgcaggtccgat

SEQ ID NO: 97462 - DNA, 25 bp, E. coli
ctgaacttctttcccgggccgacgg

SEQ ID NO: 97463 - DNA, 25 bp, E. coli
aacagcacgcacctcgtcggtacat

SEQ ID NO: 97464 - DNA, 25 bp, E. coli
aacagcacgcacgtcgtcggtacat

SEQ ID NO: 97465 - DNA, 25 bp, E. coli
tattgcactgctcgcgtgtgcaggt

SEQ ID NO: 97466 - DNA, 25 bp, E. coli
tattgcactgctggcgtgtgcaggt

SEQ ID NO: 97467 - DNA, 25 bp, E. coli
tgatgaattactcgcggaagatggc

SEQ ID NO: 97468 - DNA, 25 bp, E. coli
tgatgaattactggcggaagatggc

SEQ ID NO: 97469 - DNA, 25 bp, E. coli
gcggaagatggcagtctgaacttct

SEQ ID NO: 97470 - DNA, 25 bp, E. coli
gcggaagatggctgtctgaacttct

SEQ ID NO: 97471 - DNA, 25 bp, E. coli
cgacaaacgtctggcgcaggtacag

SEQ ID NO: 97472 - DNA, 25 bp, E. coli
cgacaaacgtctcgcgcaggtacag

SEQ ID NO: 97473 - DNA, 25 bp, E. coli
ctgctgtcgttgagatggctgatga

SEQ ID NO: 97474 - DNA, 25 bp, E. coli
ctgctgtcgttgtgatggctgatga

SEQ ID NO: 97475 - DNA, 25 bp, E. coli
gatggctgatgaattactggcggaa

SEQ ID NO: 97476 - DNA, 25 bp, E. coli
gatggctgatgatttactggcggaa

SEQ ID NO: 97477 - DNA, 25 bp, E. coli
gatgagcgatccagtccagatgctg

SEQ ID NO: 97478 - DNA, 25 bp, E. coli
gatgagcgatcctgtccagatgctg

SEQ ID NO: 97479 - DNA, 25 bp, E. coli
aattaataatgatggtcgcgcccaa

SEQ ID NO: 97480 - DNA, 25 bp, E. coli
aataatgaaggtggcgcccaacgtt

SEQ ID NO: 97481 - DNA, 25 bp, E. coli
aattaataatgaaggtcgcgcccaa

SEQ ID NO: 97482 - DNA, 25 bp, E. coli
aataatgaaggtcgcgcccaacgtt

SEQ ID NO: 97483 - DNA, 25 bp, E. coli
agatctgggcgtatatggcgcgcat

SEQ ID NO: 97484 - DNA, 25 bp, E. coli
agatctgggcgtttatggcgcgcat

SEQ ID NO: 97485 - DNA, 25 bp, E. coli
tatggcgcgcatcacaacgtctact

SEQ ID NO: 97486 - DNA, 25 bp, E. coli
tatggcgcgcatgacaacgtctact

SEQ ID NO: 97487 - DNA, 25 bp, E. coli
ttaataatgaaggtcgcgcccaacg

SEQ ID NO: 97488 - DNA, 25 bp, E. coli
tttatggcgcgcttgacaacgtcta

SEQ ID NO: 97489 - DNA, 25 bp, E. coli
ttaataatgaagctcgcgcccaacg

SEQ ID NO: 97490 - DNA, 25 bp, E. coli
tttatggcgcgcatgacaacgtcta

SEQ ID NO: 97491 - DNA, 25 bp, E. coli
gcgacggtacggtaattaataatga

SEQ ID NO: 97492 - DNA, 25 bp, E. coli
gcgacggtacggaaattaataatga

SEQ ID NO: 97493 - DNA, 25 bp, E. coli
ctgggcgtttatcgcgcgcatgaca

SEQ ID NO: 97494 - DNA, 25 bp, E. coli
ctgggcgtttatggcgcgcatgaca

SEQ ID NO: 97495 - DNA, 25 bp, E. coli
tggcgcgcatgagaacgtctacttc

SEQ ID NO: 97496 - DNA, 25 bp, E. coli
tggcgcgcatgacaacgtctacttc

SEQ ID NO: 97497 - DNA, 25 bp, E. coli
taattaataatgtaggtcgcgccca

SEQ ID NO: 97498 - DNA, 25 bp, E. coli
taataatgaaggtcgcgcccaacgt

SEQ ID NO: 97499 - DNA, 25 bp, E. coli
taataatgaaggacgcgcccaacgt

SEQ ID NO: 97500 - DNA, 25 bp, E. coli
taattaataatgaaggtcgcgccca

SEQ ID NO: 97501 - DNA, 25 bp, E. coli
aatccaggcgcaatacggtactcag

SEQ ID NO: 97502 - DNA, 25 bp, E. coli
aatccaggcgcattacggtactcag

SEQ ID NO: 97503 - DNA, 25 bp, E. coli
caaagccgttgttgggccagtggta

SEQ ID NO: 97504 - DNA, 25 bp, E. coli
caactcaactggagaacgttttcgg

SEQ ID NO: 97505 - DNA, 25 bp, E. coli
caaagccgttgtagggccagtggta

SEQ ID NO: 97506 - DNA, 25 bp, E. coli
caactcaactggtgaacgttttcgg

SEQ ID NO: 97507 - DNA, 25 bp, E. coli
tatcagggattagaggcctacagcc

SEQ ID NO: 97508 - DNA, 25 bp, E. coli
tatcagggattacaggcctacagcc

SEQ ID NO: 97509 - DNA, 25 bp, E. coli
tgcaaaatgccatgcgcaaagccgt

SEQ ID NO: 97510 - DNA, 25 bp, E. coli
tgcaaaatgccaagcgcaaagccgt

SEQ ID NO: 97511 - DNA, 25 bp, E. coli
ccagcaaccggctcaaatgacagta

SEQ ID NO: 97512 - DNA, 25 bp, E. coli
ccagcaaccggcacaaatgacagta

SEQ ID NO: 97513 - DNA, 25 bp, E. coli
gcggcattttgctgcgctacggaaa

SEQ ID NO: 97514 - DNA, 25 bp, E. coli
gcggcattttgcagcgctacggaaa

SEQ ID NO: 97515 - DNA, 25 bp, E. coli
gaagtcgccattgcacgcgtaagca

SEQ ID NO: 97516 - DNA, 25 bp, E. coli
gaagtcgccattccacgcgtaagca

SEQ ID NO: 97517 - DNA, 25 bp, E. coli
cattaaaccttctgaagcaggcgcg

SEQ ID NO: 97518 - DNA, 25 bp, E. coli
cattaaaccttcagaagcaggcgcg

SEQ ID NO: 97519 - DNA, 25 bp, E. coli
gagaaaatttccacgcgtaatcagg

SEQ ID NO: 97520 - DNA, 25 bp, E. coli
gaccgaatgaaaccagaagtcgcca

SEQ ID NO: 97521 - DNA, 25 bp, E. coli
gagaaaatttcctcgcgtaatcagg

SEQ ID NO: 97522 - DNA, 25 bp, E. coli
gaccgaatgaaagcagaagtcgcca

SEQ ID NO: 97523 - DNA, 25 bp, E. coli
aacgctgtggcgaggattgagcact

SEQ ID NO: 97524 - DNA, 25 bp, E. coli
cagcaatgtgatgtgacgatggtgc

SEQ ID NO: 97525 - DNA, 25 bp, E. coli
cagcaatgtgatctgacgatggtgc

SEQ ID NO: 97526 - DNA, 25 bp, E. coli
aacgctgtggcgtggattgagcact

SEQ ID NO: 97527 - DNA, 25 bp, E. coli
tgcaaagctggctgcaatgtgatgt

SEQ ID NO: 97528 - DNA, 25 bp, E. coli
tgcaaagctggcagcaatgtgatgt

SEQ ID NO: 97529 - DNA, 25 bp, E. coli
ccgattggtcgcaacgctgtggcgt

SEQ ID NO: 97530 - DNA, 25 bp, E. coli
ccagcttagcccgataaccctgctt

SEQ ID NO: 97531 - DNA, 25 bp, E. coli
ccagcttagccccataaccctgctt

SEQ ID NO: 97532 - DNA, 25 bp, E. coli
ccgattggtcgctacgctgtggcgt

SEQ ID NO: 97533 - DNA, 25 bp, E. coli
gctggcagcaatgtgatgtgacgat

SEQ ID NO: 97534 - DNA, 25 bp, E. coli
gctggcagcaatctgatgtgacgat

SEQ ID NO: 97535 - DNA, 25 bp, E. coli
gaatcggctgctcgatattgatatc

SEQ ID NO: 97536 - DNA, 25 bp, E. coli
gaatcggctgctggatattgatatc

SEQ ID NO: 97537 - DNA, 25 bp, E. coli
gttacggctttcagcgctacgtagc

SEQ ID NO: 97538 - DNA, 25 bp, E. coli
gttacggctttctgcgctacgtagc

SEQ ID NO: 97539 - DNA, 25 bp, E. coli
gatatgaatcggctgctggatattg

SEQ ID NO: 97540 - DNA, 25 bp, E. coli
gatatgaatcgggtgctggatattg

SEQ ID NO: 97541 - DNA, 25 bp, E. coli
ggagcgccagcttagcccgataacc

SEQ ID NO: 97542 - DNA, 25 bp, E. coli
tggcgttacggctttctgcgctacg

SEQ ID NO: 97543 - DNA, 25 bp, E. coli
tggcgttacggcattctgcgctacg

SEQ ID NO: 97544 - DNA, 25 bp, E. coli
ggagcgccagctaagcccgataacc

SEQ ID NO: 97545 - DNA, 25 bp, E. coli
caaaaactgacaccaaaagatgtgc

SEQ ID NO: 97546 - DNA, 25 bp, E. coli
caaaaactgacagcaaaagatgtgc

SEQ ID NO: 97547 - DNA, 25 bp, E. coli
cagtaacctgcggtctgctgataag

SEQ ID NO: 97548 - DNA, 25 bp, E. coli
cagtaacctgcgctctgctgataag

SEQ ID NO: 97549 - DNA, 25 bp, E. coli
acaacactgagaccggcgagatgct

SEQ ID NO: 97550 - DNA, 25 bp, E. coli
acaacactgagagcggcgagatgct

SEQ ID NO: 97551 - DNA, 25 bp, E. coli
acaaagcccacaacactgagagcgg

SEQ ID NO: 97552 - DNA, 25 bp, E. coli
acaaagcccacatcactgagagcgg

SEQ ID NO: 97553 - DNA, 25 bp, E. coli
tattttaacgcctgtaacctgcgct

SEQ ID NO: 97554 - DNA, 25 bp, E. coli
tattttaacgccagtaacctgcgct

SEQ ID NO: 97555 - DNA, 25 bp, E. coli
tgatgctcgatcctaaagagttcaa

SEQ ID NO: 97556 - DNA, 25 bp, E. coli
tgatgctcgatcgtaaagagttcaa

SEQ ID NO: 97557 - DNA, 25 bp, E. coli
gctgacaggcgctcagcaaggcgca

SEQ ID NO: 97558 - DNA, 25 bp, E. coli
gctgacaggcgcacagcaaggcgca

SEQ ID NO: 97559 - DNA, 25 bp, E. coli
gctatcgccagttggcacagcagct

SEQ ID NO: 97560 - DNA, 25 bp, E. coli
gctatcgccagtaggcacagcagct

SEQ ID NO: 97561 - DNA, 25 bp, E. coli
gaaggtgatgctggatcctaaagag

SEQ ID NO: 97562 - DNA, 25 bp, E. coli
gaaggtgatgctcgatcctaaagag

SEQ ID NO: 97563 - DNA, 25 bp, E. coli
cgctctgctgataagtttttccgcc

SEQ ID NO: 97564 - DNA, 25 bp, E. coli
cgctctgctgattagtttttccgcc

SEQ ID NO: 97565 - DNA, 25 bp, E. coli
ggaaaattacaagccgctgacaggc

SEQ ID NO: 97566 - DNA, 25 bp, E. coli
ggaaaattacaacccgctgacaggc

SEQ ID NO: 97567 - DNA, 25 bp, E. coli
caatttataacttcgtggcgcccgg

SEQ ID NO: 97568 - DNA, 25 bp, E. coli
caatttataactacgtggcgcccgg

SEQ ID NO: 97569 - DNA, 25 bp, E. coli
caacgatgagatcgtacaaagcagg

SEQ ID NO: 97570 - DNA, 25 bp, E. coli
caacgatgagatggtacaaagcagg

SEQ ID NO: 97571 - DNA, 25 bp, E. coli
cagtctctggaattaaagcatggtg

SEQ ID NO: 97572 - DNA, 25 bp, E. coli
cagtctctggaaataaagcatggtg

SEQ ID NO: 97573 - DNA, 25 bp, E. coli
tacagccatggtaagaaattttcgg

SEQ ID NO: 97574 - DNA, 25 bp, E. coli
tacagccatggttagaaattttcgg

SEQ ID NO: 97575 - DNA, 25 bp, E. coli
tatttaagaataacggcggatgccg

SEQ ID NO: 97576 - DNA, 25 bp, E. coli
tatttaagaatatcggcggatgccg

SEQ ID NO: 97577 - DNA, 25 bp, E. coli
tcggcagtcgccactatggtgaatc

SEQ ID NO: 97578 - DNA, 25 bp, E. coli
tcggcagtcgcctctatggtgaatc

SEQ ID NO: 97579 - DNA, 25 bp, E. coli
gaaacgttaactcttatcagggagg

SEQ ID NO: 97580 - DNA, 25 bp, E. coli
gaaaccaggagaaacaactcgtctg

SEQ ID NO: 97581 - DNA, 25 bp, E. coli
gaaaccaggagatacaactcgtctg

SEQ ID NO: 97582 - DNA, 25 bp, E. coli
gaaacgttaactgttatcagggagg

SEQ ID NO: 97583 - DNA, 25 bp, E. coli
cgggcattgctagggtaacctggaa

SEQ ID NO: 97584 - DNA, 25 bp, E. coli
cgggcattgctacggtaacctggaa

SEQ ID NO: 97585 - DNA, 25 bp, E. coli
ggagtactatctggttcagcaacgc

SEQ ID NO: 97586 - DNA, 25 bp, E. coli
ggagtactatctcgttcagcaacgc

SEQ ID NO: 97587 - DNA, 25 bp, E. coli
taatggtcctgacttcgctgatggc

SEQ ID NO: 97588 - DNA, 25 bp, E. coli
taatggtcctgagttcgctgatggc

SEQ ID NO: 97589 - DNA, 25 bp, E. coli
atctccattaatagtgatatcctgg

SEQ ID NO: 97590 - DNA, 25 bp, E. coli
atctccattaattgtgatatcctgg

SEQ ID NO: 97591 - DNA, 25 bp, E. coli
ttcatgcagtcggtatgaagattac

SEQ ID NO: 97592 - DNA, 25 bp, E. coli
ttcatgcagtcgctatgaagattac

SEQ ID NO: 97593 - DNA, 25 bp, E. coli
tgtcaacctgaaaaaagcaaccctc

SEQ ID NO: 97594 - DNA, 25 bp, E. coli
tgggtattaccattctccgtggtga

SEQ ID NO: 97595 - DNA, 25 bp, E. coli
tgtctcgtgtcatcctgaataaagc

SEQ ID NO: 97596 - DNA, 25 bp, E. coli
tgtctcgtgtcaacctgaataaagc

SEQ ID NO: 97597 - DNA, 25 bp, E. coli
tgtcaacctgaataaagcaaccctc

SEQ ID NO: 97598 - DNA, 25 bp, E. coli
tgtcacaaactgtggataatcttca

SEQ ID NO: 97599 - DNA, 25 bp, E. coli
tgtcacaaactgaggataatcttca

SEQ ID NO: 97600 - DNA, 25 bp, E. coli
tgggtattaccaatctccgtggtga

SEQ ID NO: 97601 - DNA, 25 bp, E. coli
tctccgtggtgaggaaaatatctcc

SEQ ID NO: 97602 - DNA, 25 bp, E. coli
tctccgtggtgacgaaaatatctcc

SEQ ID NO: 97603 - DNA, 25 bp, E. coli
cctgaataaagcaaccctccagaat

SEQ ID NO: 97604 - DNA, 25 bp, E. coli
cctgaataaagctaccctccagaat

SEQ ID NO: 97605 - DNA, 25 bp, E. coli
gatctgtctcgtgtcaacctgaata

SEQ ID NO: 97606 - DNA, 25 bp, E. coli
gatctgtctcgtctcaacctgaata

SEQ ID NO: 97607 - DNA, 25 bp, E. coli
ggataatcttcatgcagtcgctatg

SEQ ID NO: 97608 - DNA, 25 bp, E. coli
ggataatcttcaagcagtcgctatg

SEQ ID NO: 97609 - DNA, 25 bp, E. coli
gaggaaaatatctccattaatagtg

SEQ ID NO: 97610 - DNA, 25 bp, E. coli
gaggaaaatatcaccattaatagtg

SEQ ID NO: 97611 - DNA, 25 bp, E. coli
cagttgaggagtatagtgaaggcac

SEQ ID NO: 97612 - DNA, 25 bp, E. coli
cagggcatcaggtcggtatctttgt

SEQ ID NO: 97613 - DNA, 25 bp, E. coli
cagggcatcaggacggtatctttgt

SEQ ID NO: 97614 - DNA, 25 bp, E. coli
cagttgaggagtttagtgaaggcac

SEQ ID NO: 97615 - DNA, 25 bp, E. coli
taacagtcaaaagggatggcggtcc

SEQ ID NO: 97616 - DNA, 25 bp, E. coli
aacggatggcggtccgcgtcgtcct

SEQ ID NO: 97617 - DNA, 25 bp, E. coli
aacggatggcggaccgcgtcgtcct

SEQ ID NO: 97618 - DNA, 25 bp, E. coli
tttaatgaagcagggcatcaggacg

SEQ ID NO: 97619 - DNA, 25 bp, E. coli
tttaatgaagcacggcatcaggacg

SEQ ID NO: 97620 - DNA, 25 bp, E. coli
tggtttcgctggaagactacccgct

SEQ ID NO: 97621 - DNA, 25 bp, E. coli
tggtttcgctggtagactacccgct

SEQ ID NO: 97622 - DNA, 25 bp, E. coli
tcgtcctggcgtggtactggcagtt

SEQ ID NO: 97623 - DNA, 25 bp, E. coli
tcgtcctggcgtcgtactggcagtt

SEQ ID NO: 97624 - DNA, 25 bp, E. coli
gaagactacccgctcggcatctggt

SEQ ID NO: 97625 - DNA, 25 bp, E. coli
gaagactacccggtcggcatctggt

SEQ ID NO: 97626 - DNA, 25 bp, E. coli
gaaggcacaatgtacctggtttcgc

SEQ ID NO: 97627 - DNA, 25 bp, E. coli
gaaggtgaatgatcgggtaacagtc

SEQ ID NO: 97628 - DNA, 25 bp, E. coli
gaaggcacaatgaacctggtttcgc

SEQ ID NO: 97629 - DNA, 25 bp, E. coli
gaaggtgaatgaacgggtaacagtc

SEQ ID NO: 97630 - DNA, 25 bp, E. coli
cggcatctggttgtttaatgaagca

SEQ ID NO: 97631 - DNA, 25 bp, E. coli
cggcatctggttctttaatgaagca

SEQ ID NO: 97632 - DNA, 25 bp, E. coli
taacagtcaaaacggatggcggtcc

SEQ ID NO: 97633 - DNA, 25 bp, E. coli
caagcctttatagaactgtttgctg

SEQ ID NO: 97634 - DNA, 25 bp, E. coli
caagcctttatacaactgtttgctg

SEQ ID NO: 97635 - DNA, 25 bp, E. coli
cagacgactggctactaacatcgca

SEQ ID NO: 97636 - DNA, 25 bp, E. coli
cagacgactggcaactaacatcgca

SEQ ID NO: 97637 - DNA, 25 bp, E. coli
acgactggcaactaacatcgcagca

SEQ ID NO: 97638 - DNA, 25 bp, E. coli
agcaactggagtggtcaccattatg

SEQ ID NO: 97639 - DNA, 25 bp, E. coli
agcaactggagtcgtcaccattatg

SEQ ID NO: 97640 - DNA, 25 bp, E. coli
acgactggcaacaaacatcgcagca

SEQ ID NO: 97641 - DNA, 25 bp, E. coli
tagaactgtttggtgaagatgatca

SEQ ID NO: 97642 - DNA, 25 bp, E. coli
tagaactgtttgctgaagatgatca

SEQ ID NO: 97643 - DNA, 25 bp, E. coli
tgtttgctgaagttgatcagccgaa

SEQ ID NO: 97644 - DNA, 25 bp, E. coli
tgtttgctgaagatgatcagccgaa

SEQ ID NO: 97645 - DNA, 25 bp, E. coli
tgaagatgatcacccgaaacaataa

SEQ ID NO: 97646 - DNA, 25 bp, E. coli
tgaagatgatcagccgaaacaataa

SEQ ID NO: 97647 - DNA, 25 bp, E. coli
tcgttattccagacgactggcaact

SEQ ID NO: 97648 - DNA, 25 bp, E. coli
tcgttattccagtcgactggcaact

SEQ ID NO: 97649 - DNA, 25 bp, E. coli
gaatgttccgtcgttattccagacg

SEQ ID NO: 97650 - DNA, 25 bp, E. coli
gaatgttccgtccttattccagacg

SEQ ID NO: 97651 - DNA, 25 bp, E. coli
gtcaggagcaactggagtcgtcacc

SEQ ID NO: 97652 - DNA, 25 bp, E. coli
ggagcaactggagtcgtcaccatta

SEQ ID NO: 97653 - DNA, 25 bp, E. coli
gtcaggagcaacaggagtcgtcacc

SEQ ID NO: 97654 - DNA, 25 bp, E. coli
ggagcaactggactcgtcaccatta

SEQ ID NO: 97655 - DNA, 25 bp, E. coli
caaacacaagctgggactgatgcgt

SEQ ID NO: 97656 - DNA, 25 bp, E. coli
caaacacaagctcggactgatgcgt

SEQ ID NO: 97657 - DNA, 25 bp, E. coli
taccgtaatgaagaaacgctggagc

SEQ ID NO: 97658 - DNA, 25 bp, E. coli
taccgtaatgaacaaacgctggagc

SEQ ID NO: 97659 - DNA, 25 bp, E. coli
taccgttgtgccaattctgcgtgcg

SEQ ID NO: 97660 - DNA, 25 bp, E. coli
taccgttgtgcctattctgcgtgcg

SEQ ID NO: 97661 - DNA, 25 bp, E. coli
ttgacccaatgctggcaaccggtgg

SEQ ID NO: 97662 - DNA, 25 bp, E. coli
ttgacccaatgcaggcaaccggtgg

SEQ ID NO: 97663 - DNA, 25 bp, E. coli
tgagcaagatatcagcaccaagcgc

SEQ ID NO: 97664 - DNA, 25 bp, E. coli
tgagcaagatatgagcaccaagcgc

SEQ ID NO: 97665 - DNA, 25 bp, E. coli
tctaacatcgatgagcgtatggcgc

SEQ ID NO: 97666 - DNA, 25 bp, E. coli
tctaacatcgatcagcgtatggcgc

SEQ ID NO: 97667 - DNA, 25 bp, E. coli
tcggcgatgccggtgacaaaatctt

SEQ ID NO: 97668 - DNA, 25 bp, E. coli
tcggcgatgccgctgacaaaatctt

SEQ ID NO: 97669 - DNA, 25 bp, E. coli
gcgaccatcgacgtgctgaaaaaag

SEQ ID NO: 97670 - DNA, 25 bp, E. coli
gcgaccatcgacctgctgaaaaaag

SEQ ID NO: 97671 - DNA, 25 bp, E. coli
cgtatggcgctgttcgttgacccaa

SEQ ID NO: 97672 - DNA, 25 bp, E. coli
cgtatggcgctgatcgttgacccaa

SEQ ID NO: 97673 - DNA, 25 bp, E. coli
cttccgaagtgggtagcctgctgac

SEQ ID NO: 97674 - DNA, 25 bp, E. coli
cttccgaagtggctagcctgctgac

SEQ ID NO: 97675 - DNA, 25 bp, E. coli
ggatacattattgcgggcctcggcg

SEQ ID NO: 97676 - DNA, 25 bp, E. coli
ggatacattattccgggcctcggcg

SEQ ID NO: 97677 - DNA, 25 bp, E. coli
caccactttgttgaaattgacagca

SEQ ID NO: 97678 - DNA, 25 bp, E. coli
caccactttgttcaaattgacagca

SEQ ID NO: 97679 - DNA, 25 bp, E. coli
tacaaccagattccaagatgcttgc

SEQ ID NO: 97680 - DNA, 25 bp, E. coli
tacaaccagattgcaagatgcttgc

SEQ ID NO: 97681 - DNA, 25 bp, E. coli
tttaatcagctgtcgcgttcccctg

SEQ ID NO: 97682 - DNA, 25 bp, E. coli
tttaatcagctgacgcgttcccctg

SEQ ID NO: 97683 - DNA, 25 bp, E. coli
tgcactgccatttatatgcgccccg

SEQ ID NO: 97684 - DNA, 25 bp, E. coli
tgcactgccattaatatgcgccccg

SEQ ID NO: 97685 - DNA, 25 bp, E. coli
tgcaccacgatgcttcattacccaa

SEQ ID NO: 97686 - DNA, 25 bp, E. coli
tgcaccacgatggttcattacccaa

SEQ ID NO: 97687 - DNA, 25 bp, E. coli
cctataaaaggagggtatgcaccac

SEQ ID NO: 97688 - DNA, 25 bp, E. coli
cctataaaaggacggtatgcaccac

SEQ ID NO: 97689 - DNA, 25 bp, E. coli
gctaaccaactgacaaataagagat

SEQ ID NO: 97690 - DNA, 25 bp, E. coli
gctaaccaactgtcaaataagagat

SEQ ID NO: 97691 - DNA, 25 bp, E. coli
cccaataagattcaaagctcaccac

SEQ ID NO: 97692 - DNA, 25 bp, E. coli
cccaataagattgaaagctcaccac

SEQ ID NO: 97693 - DNA, 25 bp, E. coli
ggtgttgatgtagaagctaaccaac

SEQ ID NO: 97694 - DNA, 25 bp, E. coli
ggtgttgatgtacaagctaaccaac

SEQ ID NO: 97695 - DNA, 25 bp, E. coli
taagaatcggccgaagtgccgccat

SEQ ID NO: 97696 - DNA, 25 bp, E. coli
taagaatcggcccaagtgccgccat

SEQ ID NO: 97697 - DNA, 25 bp, E. coli
gtgccgccattagttacaaccagat

SEQ ID NO: 97698 - DNA, 25 bp, E. coli
gtgccgccattacttacaaccagat

SEQ ID NO: 97699 - DNA, 25 bp, E. coli
taaacttttcgtcaataccatgcgg

SEQ ID NO: 97700 - DNA, 25 bp, E. coli
ttcatggtgaactggagatttttca

SEQ ID NO: 97701 - DNA, 25 bp, E. coli
ttcatggtgaacaggagatttttca

SEQ ID NO: 97702 - DNA, 25 bp, E. coli
tatttggtagaagatgtaaccatgg

SEQ ID NO: 97703 - DNA, 25 bp, E. coli
tatttggtagaacatgtaaccatgg

SEQ ID NO: 97704 - DNA, 25 bp, E. coli
ttttcaatctgacgtttgcgcacca

SEQ ID NO: 97705 - DNA, 25 bp, E. coli
ttttcaatctgaggtttgcgcacca

SEQ ID NO: 97706 - DNA, 25 bp, E. coli
tgtaaccatggaatcacatatgcca

SEQ ID NO: 97707 - DNA, 25 bp, E. coli
tgtaaccatggattcacatatgcca

SEQ ID NO: 97708 - DNA, 25 bp, E. coli
taccgttggtagaaaaacattatct

SEQ ID NO: 97709 - DNA, 25 bp, E. coli
taccgttggtagtaaaacattatct

SEQ ID NO: 97710 - DNA, 25 bp, E. coli
tgcgcaccactctaacataaacttt

SEQ ID NO: 97711 - DNA, 25 bp, E. coli
tgcgcaccactcaaacataaacttt

SEQ ID NO: 97712 - DNA, 25 bp, E. coli
tgccatatacttagaccatgaggga

SEQ ID NO: 97713 - DNA, 25 bp, E. coli
tgccatatactttgaccatgaggga

SEQ ID NO: 97714 - DNA, 25 bp, E. coli
ccatgcggaatgtccgatttttacc

SEQ ID NO: 97715 - DNA, 25 bp, E. coli
ccatgcggaatgaccgatttttacc

SEQ ID NO: 97716 - DNA, 25 bp, E. coli
cttgcgtggcgtatcatggtgaaca

SEQ ID NO: 97717 - DNA, 25 bp, E. coli
ctttgaccatgacggatgcttgcgt

SEQ ID NO: 97718 - DNA, 25 bp, E. coli
cttgcgtggcgtttcatggtgaaca

SEQ ID NO: 97719 - DNA, 25 bp, E. coli
ctttgaccatgagggatgcttgcgt

SEQ ID NO: 97720 - DNA, 25 bp, E. coli
taaacttttcgtgaataccatgcgg

SEQ ID NO: 97721 - DNA, 25 bp, E. coli
cagcagtacgcgagagttcagggaa

SEQ ID NO: 97722 - DNA, 25 bp, E. coli
cagcagtacgcgtgagttcagggaa

SEQ ID NO: 97723 - DNA, 25 bp, E. coli
tacgcaaaggccagaaaaaagcagt

SEQ ID NO: 97724 - DNA, 25 bp, E. coli
tacgcaaaggcctgaaaaaagcagt

SEQ ID NO: 97725 - DNA, 25 bp, E. coli
aaacaactgtggctgatgagccgat

SEQ ID NO: 97726 - DNA, 25 bp, E. coli
aaacaactgtgggtgatgagccgat

SEQ ID NO: 97727 - DNA, 25 bp, E. coli
tatagcggactcactgacatcccga

SEQ ID NO: 97728 - DNA, 25 bp, E. coli
tattctggatggtgcaggttaccac

SEQ ID NO: 97729 - DNA, 25 bp, E. coli
tatagcggactctctgacatcccga

SEQ ID NO: 97730 - DNA, 25 bp, E. coli
tattctggatggagcaggttaccac

SEQ ID NO: 97731 - DNA, 25 bp, E. coli
tcttttttaaccagacactgccgga

SEQ ID NO: 97732 - DNA, 25 bp, E. coli
tcttttttaacctgacactgccgga

SEQ ID NO: 97733 - DNA, 25 bp, E. coli
gccgcacacgcctgaatatcatggg

SEQ ID NO: 97734 - DNA, 25 bp, E. coli
gccgcacacgccagaatatcatggg

SEQ ID NO: 97735 - DNA, 25 bp, E. coli
gcagtaaaaacaacaggcagccgca

SEQ ID NO: 97736 - DNA, 25 bp, E. coli
gcagtaaaaacatcaggcagccgca

SEQ ID NO: 97737 - DNA, 25 bp, E. coli
gaatctgaaagcactgacgtcaccg

SEQ ID NO: 97738 - DNA, 25 bp, E. coli
gaatctgaaagctctgacgtcaccg

SEQ ID NO: 97739 - DNA, 25 bp, E. coli
gaaattaatgaaggaacatgcccgg

SEQ ID NO: 97740 - DNA, 25 bp, E. coli
gaaattaatgaacgaacatgcccgg

SEQ ID NO: 97741 - DNA, 25 bp, E. coli
tcagctatggctcgatacgcaaagg

SEQ ID NO: 97742 - DNA, 25 bp, E. coli
tcagctatggctggatacgcaaagg

SEQ ID NO: 97743 - DNA, 25 bp, E. coli
tacaggacttcgtgaatcgagtcac

SEQ ID NO: 97744 - DNA, 25 bp, E. coli
tacaggacttcgagaatcgagtcac

SEQ ID NO: 97745 - DNA, 25 bp, E. coli
ttgttaacgaatctgatccagatcg

SEQ ID NO: 97746 - DNA, 25 bp, E. coli
ttcactacctgtaatgagattgcag

SEQ ID NO: 97747 - DNA, 25 bp, E. coli
ttgttaacgaatgtgatccagatcg

SEQ ID NO: 97748 - DNA, 25 bp, E. coli
ttcactacctgttatgagattgcag

SEQ ID NO: 97749 - DNA, 25 bp, E. coli
tgtcagcactgattacaggacttcg

SEQ ID NO: 97750 - DNA, 25 bp, E. coli
tgtcagcactgaatacaggacttcg

SEQ ID NO: 97751 - DNA, 25 bp, E. coli
tgcagtaaatgagtgcttgctggcg

SEQ ID NO: 97752 - DNA, 25 bp, E. coli
tgcagtaaatgactgcttgctggcg

SEQ ID NO: 97753 - DNA, 25 bp, E. coli
cctgttatgagattgcagtaaatga

SEQ ID NO: 97754 - DNA, 25 bp, E. coli
cctgttatgagaatgcagtaaatga

SEQ ID NO: 97755 - DNA, 25 bp, E. coli
gaatcgagtcactgcaatggaaacg

SEQ ID NO: 97756 - DNA, 25 bp, E. coli
gaatcgagtcacagcaatggaaacg

SEQ ID NO: 97757 - DNA, 25 bp, E. coli
gcaatggaaacggttacagccgttt

SEQ ID NO: 97758 - DNA, 25 bp, E. coli
gcaatggaaacgcttacagccgttt

SEQ ID NO: 97759 - DNA, 25 bp, E. coli
ctggcggctattttgtcagcactga

SEQ ID NO: 97760 - DNA, 25 bp, E. coli
ctggcggctattatgtcagcactga

SEQ ID NO: 97761 - DNA, 25 bp, E. coli
tcacagcaatggaaacggttacagc

SEQ ID NO: 97762 - DNA, 25 bp, E. coli
tcacagcaatggtaacggttacagc

SEQ ID NO: 97763 - DNA, 25 bp, E. coli
tacagccgttttgttaacgaatgtg

SEQ ID NO: 97764 - DNA, 25 bp, E. coli
tacagccgttttcttaacgaatgtg

SEQ ID NO: 97765 - DNA, 25 bp, E. coli
aacgcgctaccatcggggtttgagg

SEQ ID NO: 97766 - DNA, 25 bp, E. coli
aacgcgctaccaacggggtttgagg

SEQ ID NO: 97767 - DNA, 25 bp, E. coli
tttcggctatcttctggaaacggca

SEQ ID NO: 97768 - DNA, 25 bp, E. coli
tttcggctatctactggaaacggca

SEQ ID NO: 97769 - DNA, 25 bp, E. coli
gccgctgccgcttaaccattcgaaa

SEQ ID NO: 97770 - DNA, 25 bp, E. coli
gccgctgccgctaaaccattcgaaa

SEQ ID NO: 97771 - DNA, 25 bp, E. coli
gccgcttaaccaatcgaaactcact

SEQ ID NO: 97772 - DNA, 25 bp, E. coli
gccgcttaaccattcgaaactcact

SEQ ID NO: 97773 - DNA, 25 bp, E. coli
gctgatggaaaaggcgctaccatcg

SEQ ID NO: 97774 - DNA, 25 bp, E. coli
gctgatggaaaacgcgctaccatcg

SEQ ID NO: 97775 - DNA, 25 bp, E. coli
gaaactcactttgggctatctactg

SEQ ID NO: 97776 - DNA, 25 bp, E. coli
gaaactcactttcggctatctactg

SEQ ID NO: 97777 - DNA, 25 bp, E. coli
ctatctactggaaacggcacatagc

SEQ ID NO: 97778 - DNA, 25 bp, E. coli
cggctatctactggaaacggcacat

SEQ ID NO: 97779 - DNA, 25 bp, E. coli
ctatctactggatacggcacatagc

SEQ ID NO: 97780 - DNA, 25 bp, E. coli
cggctatctactcgaaacggcacat

SEQ ID NO: 97781 - DNA, 25 bp, E. coli
ggtctacggtccaccggatgagcag

SEQ ID NO: 97782 - DNA, 25 bp, E. coli
gtgcgacacaatgccggtctacggt

SEQ ID NO: 97783 - DNA, 25 bp, E. coli
gtgcgacacaatcccggtctacggt

SEQ ID NO: 97784 - DNA, 25 bp, E. coli
ggtctacggtcctccggatgagcag

SEQ ID NO: 97785 - DNA, 25 bp, E. coli
ggcgtgtgcgacacaatcccggtct

SEQ ID NO: 97786 - DNA, 25 bp, E. coli
ggcgtgtgcgactcaatcccggtct

SEQ ID NO: 97787 - DNA, 25 bp, E. coli
caatcgctggcgaaggtgacgtcaa

SEQ ID NO: 97788 - DNA, 25 bp, E. coli
caatcgctggcgtaggtgacgtcaa

SEQ ID NO: 97789 - DNA, 25 bp, E. coli
aatccggtaccagaaaaattgcagg

SEQ ID NO: 97790 - DNA, 25 bp, E. coli
aatccggtaccacaaaaattgcagg

SEQ ID NO: 97791 - DNA, 25 bp, E. coli
tatcagatcgcgataacacagtggg

SEQ ID NO: 97792 - DNA, 25 bp, E. coli
tatcagatcgcgttaacacagtggg

SEQ ID NO: 97793 - DNA, 25 bp, E. coli
ttttcgacatcaacgtggcggcggg

SEQ ID NO: 97794 - DNA, 25 bp, E. coli
ttttcgacatcatcgtggcggcggg

SEQ ID NO: 97795 - DNA, 25 bp, E. coli
ttgcagggaaaaggcaggaacgcct

SEQ ID NO: 97796 - DNA, 25 bp, E. coli
ttgcagggaaaacgcaggaacgcct

SEQ ID NO: 97797 - DNA, 25 bp, E. coli
tgactggaaaaaagataacgcggga

SEQ ID NO: 97798 - DNA, 25 bp, E. coli
tgactggaaaaatgataacgcggga

SEQ ID NO: 97799 - DNA, 25 bp, E. coli
tccggtaccgcgttgaagtgactgg

SEQ ID NO: 97800 - DNA, 25 bp, E. coli
tccggtaccgcgatgaagtgactgg

SEQ ID NO: 97801 - DNA, 25 bp, E. coli
tcttgaagaacaacataaagcctgg

SEQ ID NO: 97802 - DNA, 25 bp, E. coli
tcttgaagaacatcataaagcctgg

SEQ ID NO: 97803 - DNA, 25 bp, E. coli
ccaatcccgggaaagcaatcgctgg

SEQ ID NO: 97804 - DNA, 25 bp, E. coli
ccaatcccgggatagcaatcgctgg

SEQ ID NO: 97805 - DNA, 25 bp, E. coli
gcgcaggcagtaaaagcagaacttt

SEQ ID NO: 97806 - DNA, 25 bp, E. coli
gcgcaggcagtataagcagaacttt

SEQ ID NO: 97807 - DNA, 25 bp, E. coli
cgatacagggcgttacaggcgaaaa

SEQ ID NO: 97808 - DNA, 25 bp, E. coli
cgatacagggcgatacaggcgaaaa

SEQ ID NO: 97809 - DNA, 25 bp, E. coli
aaagcagtgtagaaaggcaagtccc

SEQ ID NO: 97810 - DNA, 25 bp, E. coli
acatcaacggttagacgtacagacc

SEQ ID NO: 97811 - DNA, 25 bp, E. coli
acatcaacggtttgacgtacagacc

SEQ ID NO: 97812 - DNA, 25 bp, E. coli
aaagcagtgtagtaaggcaagtccc

SEQ ID NO: 97813 - DNA, 25 bp, E. coli
tattgctgtttagggtcctgatgac

SEQ ID NO: 97814 - DNA, 25 bp, E. coli
tattgctgtttacggtcctgatgac

SEQ ID NO: 97815 - DNA, 25 bp, E. coli
ttatcgttgatagccctcgtagtgc

SEQ ID NO: 97816 - DNA, 25 bp, E. coli
ttatcgttgatacccctcgtagtgc

SEQ ID NO: 97817 - DNA, 25 bp, E. coli
tgcatcacccgccaatgcgtggctt

SEQ ID NO: 97818 - DNA, 25 bp, E. coli
tgcatcacccgcgaatgcgtggctt

SEQ ID NO: 97819 - DNA, 25 bp, E. coli
tgacgtacagacgattaaagcagtg

SEQ ID NO: 97820 - DNA, 25 bp, E. coli
tgacgtacagaccattaaagcagtg

SEQ ID NO: 97821 - DNA, 25 bp, E. coli
tgcgtggcttaaagcacatcaacgg

SEQ ID NO: 97822 - DNA, 25 bp, E. coli
tgcgtggcttaatgcacatcaacgg

SEQ ID NO: 97823 - DNA, 25 bp, E. coli
gaaaaataattgttgcatcacccgc

SEQ ID NO: 97824 - DNA, 25 bp, E. coli
gaaaaataattgatgcatcacccgc

SEQ ID NO: 97825 - DNA, 25 bp, E. coli
gtagtgcacattcctttaacgcttc

SEQ ID NO: 97826 - DNA, 25 bp, E. coli
gtagtgcacattgctttaacgcttc

SEQ ID NO: 97827 - DNA, 25 bp, E. coli
ggcaagtcccttcaagagttatcgt

SEQ ID NO: 97828 - DNA, 25 bp, E. coli
ggcaagtcccttgaagagttatcgt

SEQ ID NO: 97829 - DNA, 25 bp, E. coli
gatgacaggacccttttccaaccga

SEQ ID NO: 97830 - DNA, 25 bp, E. coli
gatgacaggaccgttttccaaccga

SEQ ID NO: 97831 - DNA, 25 bp, E. coli
caaaatttgtggctgaagactgggc

SEQ ID NO: 97832 - DNA, 25 bp, E. coli
caaaatttgtgggtgaagactgggc

SEQ ID NO: 97833 - DNA, 25 bp, E. coli
caaatgtagcgttaaatgtgtggat

SEQ ID NO: 97834 - DNA, 25 bp, E. coli
caaatgtagcgtaaaatgtgtggat

SEQ ID NO: 97835 - DNA, 25 bp, E. coli
taaaatgtgtggttgttaattatcg

SEQ ID NO: 97836 - DNA, 25 bp, E. coli
taacaaataatttttaatgcgcaaa

SEQ ID NO: 97837 - DNA, 25 bp, E. coli
taacaaataattattaatgcgcaaa

SEQ ID NO: 97838 - DNA, 25 bp, E. coli
tttcgcccgcaaccaaaatttgtgg

SEQ ID NO: 97839 - DNA, 25 bp, E. coli
tttcgcccgcaagcaaaatttgtgg

SEQ ID NO: 97840 - DNA, 25 bp, E. coli
ttatcgataattcctatatcatgcc

SEQ ID NO: 97841 - DNA, 25 bp, E. coli
ttatcgataattgctatatcatgcc

SEQ ID NO: 97842 - DNA, 25 bp, E. coli
tgtcgcatttttacgcccgcaacca

SEQ ID NO: 97843 - DNA, 25 bp, E. coli
tgtcgcattttttcgcccgcaacca

SEQ ID NO: 97844 - DNA, 25 bp, E. coli
tgaagactgggccaaattgccgcgc

SEQ ID NO: 97845 - DNA, 25 bp, E. coli
tgaagactgggcgaaattgccgcgc

SEQ ID NO: 97846 - DNA, 25 bp, E. coli
gccgcgcttgtatataacaaataat

SEQ ID NO: 97847 - DNA, 25 bp, E. coli
gccgcgcttgtaaataacaaataat

SEQ ID NO: 97848 - DNA, 25 bp, E. coli
gaaattgccgcggttgtaaataaca

SEQ ID NO: 97849 - DNA, 25 bp, E. coli
gaaattgccgcgcttgtaaataaca

SEQ ID NO: 97850 - DNA, 25 bp, E. coli
taatgcgcaaatctagcgtaaaatg

SEQ ID NO: 97851 - DNA, 25 bp, E. coli
taaaatgtgtggatgttaattatcg

SEQ ID NO: 97852 - DNA, 25 bp, E. coli
taatgcgcaaatgtagcgtaaaatg

SEQ ID NO: 97853 - DNA, 25 bp, E. coli
caatgattacacctacggtctggtt

SEQ ID NO: 97854 - DNA, 25 bp, E. coli
cacctacggtctcgtttttctgctt

SEQ ID NO: 97855 - DNA, 25 bp, E. coli
cacctacggtctggtttttctgctt

SEQ ID NO: 97856 - DNA, 25 bp, E. coli
caatgattacacgtacggtctggtt

SEQ ID NO: 97857 - DNA, 25 bp, E. coli
tacacctacggtgtggtttttctgc

SEQ ID NO: 97858 - DNA, 25 bp, E. coli
tacacctacggtctggtttttctgc

SEQ ID NO: 97859 - DNA, 25 bp, E. coli
tatcaatgattacacctacggtctg

SEQ ID NO: 97860 - DNA, 25 bp, E. coli
tatcaatgattagacctacggtctg

SEQ ID NO: 97861 - DNA, 25 bp, E. coli
ttaccagccgtccaggacctggcat

SEQ ID NO: 97862 - DNA, 25 bp, E. coli
ttaccagccgtcgaggacctggcat

SEQ ID NO: 97863 - DNA, 25 bp, E. coli
tgtcctctggcgatttaccagccgt

SEQ ID NO: 97864 - DNA, 25 bp, E. coli
tgtcctctggcgttttaccagccgt

SEQ ID NO: 97865 - DNA, 25 bp, E. coli
tgatatcaatgaatacacctacggt

SEQ ID NO: 97866 - DNA, 25 bp, E. coli
tgatatcaatgattacacctacggt

SEQ ID NO: 97867 - DNA, 25 bp, E. coli
ccatcattgtcctctggcgatttac

SEQ ID NO: 97868 - DNA, 25 bp, E. coli
ccatcattgtccactggcgatttac

SEQ ID NO: 97869 - DNA, 25 bp, E. coli
cgtccaggacctggcatatggatga

SEQ ID NO: 97870 - DNA, 25 bp, E. coli
cgtccaggacctcgcatatggatga

SEQ ID NO: 97871 - DNA, 25 bp, E. coli
gatttaccagccctccaggacctgg

SEQ ID NO: 97872 - DNA, 25 bp, E. coli
gatttaccagccgtccaggacctgg

SEQ ID NO: 97873 - DNA, 25 bp, E. coli
tggcgatttacctgccgtccaggac

SEQ ID NO: 97874 - DNA, 25 bp, E. coli
tggcgatttaccagccgtccaggac

SEQ ID NO: 97875 - DNA, 25 bp, E. coli
tacgccgcgtagtcagattattaaa

SEQ ID NO: 97876 - DNA, 25 bp, E. coli
accaggctggcgacgtcgataacga

SEQ ID NO: 97877 - DNA, 25 bp, E. coli
aaacaccggatgtattactgcgcca

SEQ ID NO: 97878 - DNA, 25 bp, E. coli
aaacaccggatgaattactgcgcca

SEQ ID NO: 97879 - DNA, 25 bp, E. coli
accaggctggcgtcgtcgataacga

SEQ ID NO: 97880 - DNA, 25 bp, E. coli
tacgccgcgtagacagattattaaa

SEQ ID NO: 97881 - DNA, 25 bp, E. coli
ttaaagccattgatgaacggctgcc

SEQ ID NO: 97882 - DNA, 25 bp, E. coli
ttaaagccattgttgaacggctgcc

SEQ ID NO: 97883 - DNA, 25 bp, E. coli
tgtaaaagaggagcacaaagccacg

SEQ ID NO: 97884 - DNA, 25 bp, E. coli
tgtaaaagaggaccacaaagccacg

SEQ ID NO: 97885 - DNA, 25 bp, E. coli
tccgctgggcgcaggaatattacca

SEQ ID NO: 97886 - DNA, 25 bp, E. coli
tccgctgggcgctggaatattacca

SEQ ID NO: 97887 - DNA, 25 bp, E. coli
gcctgtcggcagtaaaaacaccgga

SEQ ID NO: 97888 - DNA, 25 bp, E. coli
gcctgtcggcagaaaaaacaccgga

SEQ ID NO: 97889 - DNA, 25 bp, E. coli
gaatttatccgtatccgctgggcgc

SEQ ID NO: 97890 - DNA, 25 bp, E. coli
gaatttatccgtttccgctgggcgc

SEQ ID NO: 97891 - DNA, 25 bp, E. coli
gcactggcgctgttagccgcactta

SEQ ID NO: 97892 - DNA, 25 bp, E. coli
gcactggcgctgatagccgcactta

SEQ ID NO: 97893 - DNA, 25 bp, E. coli
taatcttgactctctggcagagggt

SEQ ID NO: 97894 - DNA, 25 bp, E. coli
taatcttgactcactggcagagggt

SEQ ID NO: 97895 - DNA, 25 bp, E. coli
gatgaacctgaatggcgtattaccg

SEQ ID NO: 97896 - DNA, 25 bp, E. coli
gatgaacctgaaaggcgtattaccg

SEQ ID NO: 97897 - DNA, 25 bp, E. coli
catatggccttaaaaggtatgcgat

SEQ ID NO: 97898 - DNA, 25 bp, E. coli
catatggccttataaggtatgcgat

SEQ ID NO: 97899 - DNA, 25 bp, E. coli
tacgcacgttatgtttaaaggcact

SEQ ID NO: 97900 - DNA, 25 bp, E. coli
taaaaggtatgccataaccggagga

SEQ ID NO: 97901 - DNA, 25 bp, E. coli
taacacaggttacagaagttctgga

SEQ ID NO: 97902 - DNA, 25 bp, E. coli
taaaaggtatgcgataaccggagga

SEQ ID NO: 97903 - DNA, 25 bp, E. coli
tagtttccttgcttacatttatctg

SEQ ID NO: 97904 - DNA, 25 bp, E. coli
tagtttccttgcatacatttatctg

SEQ ID NO: 97905 - DNA, 25 bp, E. coli
tacgcacgttatctttaaaggcact

SEQ ID NO: 97906 - DNA, 25 bp, E. coli
tttttcactaaatagtgtgatcggg

SEQ ID NO: 97907 - DNA, 25 bp, E. coli
tttttcactaaaaagtgtgatcggg

SEQ ID NO: 97908 - DNA, 25 bp, E. coli
tgaaatcagaaaaagcatatggcct

SEQ ID NO: 97909 - DNA, 25 bp, E. coli
tgaaatcagaaatagcatatggcct

SEQ ID NO: 97910 - DNA, 25 bp, E. coli
tccaatgtccatatagtgacgcaat

SEQ ID NO: 97911 - DNA, 25 bp, E. coli
tccaatgtccatttagtgacgcaat

SEQ ID NO: 97912 - DNA, 25 bp, E. coli
gtttaaaggcactacactgattggg

SEQ ID NO: 97913 - DNA, 25 bp, E. coli
gtttaaaggcacaacactgattggg

SEQ ID NO: 97914 - DNA, 25 bp, E. coli
gggacaatatatttacgcacgttat

SEQ ID NO: 97915 - DNA, 25 bp, E. coli
gggacaatatatatacgcacgttat

SEQ ID NO: 97916 - DNA, 25 bp, E. coli
tagtgacgcaatttttactttgtaa

SEQ ID NO: 97917 - DNA, 25 bp, E. coli
tagtgacgcaatatttactttgtaa

SEQ ID NO: 97918 - DNA, 25 bp, E. coli
taacacaggttagagaagttctgga

SEQ ID NO: 97919 - DNA, 25 bp, E. coli
aattagattttctgccgcaggcggg

SEQ ID NO: 97920 - DNA, 25 bp, E. coli
aataatgcccttcctcctgaatcgg

SEQ ID NO: 97921 - DNA, 25 bp, E. coli
caatttattcggaagcacctggcaa

SEQ ID NO: 97922 - DNA, 25 bp, E. coli
aatcgtacacttattagggctggca

SEQ ID NO: 97923 - DNA, 25 bp, E. coli
aatcgtacactttttagggctggca

SEQ ID NO: 97924 - DNA, 25 bp, E. coli
aattagattttcagccgcaggcggg

SEQ ID NO: 97925 - DNA, 25 bp, E. coli
caatttattcggtagcacctggcaa

SEQ ID NO: 97926 - DNA, 25 bp, E. coli
aataatgcccttgctcctgaatcgg

SEQ ID NO: 97927 - DNA, 25 bp, E. coli
cagtgacgctggactattttgccga

SEQ ID NO: 97928 - DNA, 25 bp, E. coli
cagtgacgctggtctattttgccga

SEQ ID NO: 97929 - DNA, 25 bp, E. coli
tattttgccgacaatgtaaccccga

SEQ ID NO: 97930 - DNA, 25 bp, E. coli
tattccggccaggatgtggatctca

SEQ ID NO: 97931 - DNA, 25 bp, E. coli
tattttgccgactatgtaaccccga

SEQ ID NO: 97932 - DNA, 25 bp, E. coli
tattccggccagcatgtggatctca

SEQ ID NO: 97933 - DNA, 25 bp, E. coli
tgaatatgaacaccaggctaccggg

SEQ ID NO: 97934 - DNA, 25 bp, E. coli
tgaatatgaacagcaggctaccggg

SEQ ID NO: 97935 - DNA, 25 bp, E. coli
cgacaacggattttgcgggtggcaa

SEQ ID NO: 97936 - DNA, 25 bp, E. coli
cgacaacggattatgcgggtggcaa

SEQ ID NO: 97937 - DNA, 25 bp, E. coli
tggcaatgctgtaccctcaacctgg

SEQ ID NO: 97938 - DNA, 25 bp, E. coli
tggcaatgctgttccctcaacctgg

SEQ ID NO: 97939 - DNA, 25 bp, E. coli
taataatggcgtagtcgatctcggc

SEQ ID NO: 97940 - DNA, 25 bp, E. coli
taataatggcgttgtcgatctcggc

SEQ ID NO: 97941 - DNA, 25 bp, E. coli
catgtccggggaatatttgttagat

SEQ ID NO: 97942 - DNA, 25 bp, E. coli
catgtccggggattatttgttagat

SEQ ID NO: 97943 - DNA, 25 bp, E. coli
taaaaaagaggagataattcaatag

SEQ ID NO: 97944 - DNA, 25 bp, E. coli
taccagacacgtattccgacagctt

SEQ ID NO: 97945 - DNA, 25 bp, E. coli
taaaaaagaggacataattcaatag

SEQ ID NO: 97946 - DNA, 25 bp, E. coli
acagcttcacaaaaccggagtccgg

SEQ ID NO: 97947 - DNA, 25 bp, E. coli
acagcttcacaataccggagtccgg

SEQ ID NO: 97948 - DNA, 25 bp, E. coli
taccagacacgttttccgacagctt

SEQ ID NO: 97949 - DNA, 25 bp, E. coli
tattccgacagcatcacaaaaccgg

SEQ ID NO: 97950 - DNA, 25 bp, E. coli
tattccgacagcttcacaaaaccgg

SEQ ID NO: 97951 - DNA, 25 bp, E. coli
tatttgttagattaaaaagaggaga

SEQ ID NO: 97952 - DNA, 25 bp, E. coli
tatttgttagataaaaaagaggaga

SEQ ID NO: 97953 - DNA, 25 bp, E. coli
tggtaccagacacgtattccgacag

SEQ ID NO: 97954 - DNA, 25 bp, E. coli
tggtaccagacaggtattccgacag

SEQ ID NO: 97955 - DNA, 25 bp, E. coli
tcacaaaaccggagtccggctccgg

SEQ ID NO: 97956 - DNA, 25 bp, E. coli
tcacaaaaccggtgtccggctccgg

SEQ ID NO: 97957 - DNA, 25 bp, E. coli
tccggtttttgttgtcatgtccggg

SEQ ID NO: 97958 - DNA, 25 bp, E. coli
tccggctccggtatttgttgtcatg

SEQ ID NO: 97959 - DNA, 25 bp, E. coli
tccggctccggtttttgttgtcatg

SEQ ID NO: 97960 - DNA, 25 bp, E. coli
tccggtttttgtagtcatgtccggg

SEQ ID NO: 97961 - DNA, 25 bp, E. coli
gacacgtattcccacagcttcacaa

SEQ ID NO: 97962 - DNA, 25 bp, E. coli
gacacgtattccgacagcttcacaa

SEQ ID NO: 97963 - DNA, 25 bp, E. coli
catcatttgtcttcactcgccgcga

SEQ ID NO: 97964 - DNA, 25 bp, E. coli
catcatttgtctacactcgccgcga

SEQ ID NO: 97965 - DNA, 25 bp, E. coli
atttgtctacactcgccgcgaaccg

SEQ ID NO: 97966 - DNA, 25 bp, E. coli
atttgtctacacacgccgcgaaccg

SEQ ID NO: 97967 - DNA, 25 bp, E. coli
tgcgtgagacatcatttgtctacac

SEQ ID NO: 97968 - DNA, 25 bp, E. coli
tgcgtgagacatgatttgtctacac

SEQ ID NO: 97969 - DNA, 25 bp, E. coli
tcgggccgtcgatattctgcgcgag

SEQ ID NO: 97970 - DNA, 25 bp, E. coli
tcgggccgtcgaaattctgcgcgag

SEQ ID NO: 97971 - DNA, 25 bp, E. coli
tctgcgcgagcgcaatgatgaactc

SEQ ID NO: 97972 - DNA, 25 bp, E. coli
tctgcgcgagcggaatgatgaactc

SEQ ID NO: 97973 - DNA, 25 bp, E. coli
tcatttgtctactctcgccgcgaac

SEQ ID NO: 97974 - DNA, 25 bp, E. coli
tcatttgtctacactcgccgcgaac

SEQ ID NO: 97975 - DNA, 25 bp, E. coli
gccgtcgatattgtgcgcgagcgca

SEQ ID NO: 97976 - DNA, 25 bp, E. coli
gccgtcgatattctgcgcgagcgca

SEQ ID NO: 97977 - DNA, 25 bp, E. coli
gcgcaatgatgaactcgccaaactg

SEQ ID NO: 97978 - DNA, 25 bp, E. coli
gcgcaatgatgatctcgccaaactg

SEQ ID NO: 97979 - DNA, 25 bp, E. coli
cgagcgcaatgaagaactcgccaaa

SEQ ID NO: 97980 - DNA, 25 bp, E. coli
cgagcgcaatgatgaactcgccaaa

SEQ ID NO: 97981 - DNA, 25 bp, E. coli
cgtcgatattctccgcgagcgcaat

SEQ ID NO: 97982 - DNA, 25 bp, E. coli
cgtcgatattctgcgcgagcgcaat

SEQ ID NO: 97983 - DNA, 25 bp, E. coli
gatattctgcgccagcgcaatgatg

SEQ ID NO: 97984 - DNA, 25 bp, E. coli
gatattctgcgcgagcgcaatgatg

SEQ ID NO: 97985 - DNA, 25 bp, E. coli
cacaggataagcatcttgtcggcaa

SEQ ID NO: 97986 - DNA, 25 bp, E. coli
caaagctcgtcaccagtggcactgg

SEQ ID NO: 97987 - DNA, 25 bp, E. coli
cacaggataagcttcttgtcggcaa

SEQ ID NO: 97988 - DNA, 25 bp, E. coli
caaagctcgtcagcagtggcactgg

SEQ ID NO: 97989 - DNA, 25 bp, E. coli
tacccggcgcattgagcgcaacaat

SEQ ID NO: 97990 - DNA, 25 bp, E. coli
tacccggcgcatagagcgcaacaat

SEQ ID NO: 97991 - DNA, 25 bp, E. coli
ttggtcctcgcactgatgaaacatg

SEQ ID NO: 97992 - DNA, 25 bp, E. coli
ttggtcctcgcagtgatgaaacatg

SEQ ID NO: 97993 - DNA, 25 bp, E. coli
tgtcggcaagatttttacccggcgc

SEQ ID NO: 97994 - DNA, 25 bp, E. coli
tgtcggcaagatatttacccggcgc

SEQ ID NO: 97995 - DNA, 25 bp, E. coli
tgctggcttacagttttggtcctcg

SEQ ID NO: 97996 - DNA, 25 bp, E. coli
tgctggcttacacttttggtcctcg

SEQ ID NO: 97997 - DNA, 25 bp, E. coli
gcatgataaccagagacaaccggag

SEQ ID NO: 97998 - DNA, 25 bp, E. coli
gcatgataaccacagacaaccggag

SEQ ID NO: 97999 - DNA, 25 bp, E. coli
gacaaccggagctgttataccagag

SEQ ID NO: 98000 - DNA, 25 bp, E. coli
gacaaccggagcagttataccagag

SEQ ID NO: 98001 - DNA, 25 bp, E. coli
gagcgcaacaatctgacacttcgta

SEQ ID NO: 98002 - DNA, 25 bp, E. coli
gttataccagagaaatgccacagga

SEQ ID NO: 98003 - DNA, 25 bp, E. coli
gttataccagagtaatgccacagga

SEQ ID NO: 98004 - DNA, 25 bp, E. coli
tggaaattcacgtaaagccattggt

SEQ ID NO: 98005 - DNA, 25 bp, E. coli
tggaaattcacgaaaagccattggt

SEQ ID NO: 98006 - DNA, 25 bp, E. coli
gagcgcaacaatgtgacacttcgta

SEQ ID NO: 98007 - DNA, 25 bp, E. coli
aggtttagcgtatcccttaggcgag

SEQ ID NO: 98008 - DNA, 25 bp, E. coli
aggtttagcgtaacccttaggcgag

SEQ ID NO: 98009 - DNA, 25 bp, E. coli
ttcttcactagcgtacgggcagtcc

SEQ ID NO: 98010 - DNA, 25 bp, E. coli
ttcttcactagcctacgggcagtcc

SEQ ID NO: 98011 - DNA, 25 bp, E. coli
ttcagtcatgggtgatgaccccaga

SEQ ID NO: 98012 - DNA, 25 bp, E. coli
ttcagtcatgggagatgaccccaga

SEQ ID NO: 98013 - DNA, 25 bp, E. coli
tgaagattgccagacaaagcgtcat

SEQ ID NO: 98014 - DNA, 25 bp, E. coli
tgaagattgccacacaaagcgtcat

SEQ ID NO: 98015 - DNA, 25 bp, E. coli
gcgccgttggcgtaagacagagaaa

SEQ ID NO: 98016 - DNA, 25 bp, E. coli
gcgccgttggcgaaagacagagaaa

SEQ ID NO: 98017 - DNA, 25 bp, E. coli
gcgtaacgtatccaaccatcaatga

SEQ ID NO: 98018 - DNA, 25 bp, E. coli
gcgtaacgtatcgaaccatcaatga

SEQ ID NO: 98019 - DNA, 25 bp, E. coli
gaaactgcgttgcacttcgtcagct

SEQ ID NO: 98020 - DNA, 25 bp, E. coli
gaaactgcgttggacttcgtcagct

SEQ ID NO: 98021 - DNA, 25 bp, E. coli
gtgtacgtaacaccagtccggatgt

SEQ ID NO: 98022 - DNA, 25 bp, E. coli
ggcagtcccttcaacaacgaagcgg

SEQ ID NO: 98023 - DNA, 25 bp, E. coli
gtgtacgtaacagcagtccggatgt

SEQ ID NO: 98024 - DNA, 25 bp, E. coli
ggcagtcccttctacaacgaagcgg

SEQ ID NO: 98025 - DNA, 25 bp, E. coli
ggaaacgccgcaactcaactgtaaa

SEQ ID NO: 98026 - DNA, 25 bp, E. coli
tttctggcgaccaaaaggtttagcg

SEQ ID NO: 98027 - DNA, 25 bp, E. coli
tttctggcgacctaaaggtttagcg

SEQ ID NO: 98028 - DNA, 25 bp, E. coli
ggaaacgccgcatctcaactgtaaa

SEQ ID NO: 98029 - DNA, 25 bp, E. coli
caatggttcgcgctttacgcacggg

SEQ ID NO: 98030 - DNA, 25 bp, E. coli
caatggttcgcggtttacgcacggg

SEQ ID NO: 98031 - DNA, 25 bp, E. coli
aatgggttcagggatctgggctacc

SEQ ID NO: 98032 - DNA, 25 bp, E. coli
aatgggttcaggcatctgggctacc

SEQ ID NO: 98033 - DNA, 25 bp, E. coli
catgctgaacttcttgatgcggcaa

SEQ ID NO: 98034 - DNA, 25 bp, E. coli
catgctgaacttgttgatgcggcaa

SEQ ID NO: 98035 - DNA, 25 bp, E. coli
tacagccgggcttatcagtgaagtt

SEQ ID NO: 98036 - DNA, 25 bp, E. coli
taacaccgcaactaaaactgagtcg

SEQ ID NO: 98037 - DNA, 25 bp, E. coli
taaaattgcgcgtgtctctacggaa

SEQ ID NO: 98038 - DNA, 25 bp, E. coli
taaaattgcgcgagtctctacggaa

SEQ ID NO: 98039 - DNA, 25 bp, E. coli
tacagccgggctaatcagtgaagtt

SEQ ID NO: 98040 - DNA, 25 bp, E. coli
tgtctatcgcgaagatcagcccatg

SEQ ID NO: 98041 - DNA, 25 bp, E. coli
tgtctatcgcgatgatcagcccatg

SEQ ID NO: 98042 - DNA, 25 bp, E. coli
tctacggaaaactctacagccgggc

SEQ ID NO: 98043 - DNA, 25 bp, E. coli
tctacggaaaacactacagccgggc

SEQ ID NO: 98044 - DNA, 25 bp, E. coli
tcgtcgttctcatccgcagcaagta

SEQ ID NO: 98045 - DNA, 25 bp, E. coli
tcgtcgttctcaaccgcagcaagta

SEQ ID NO: 98046 - DNA, 25 bp, E. coli
cattgttacagcaactcggtcagca

SEQ ID NO: 98047 - DNA, 25 bp, E. coli
cattgttacagctactcggtcagca

SEQ ID NO: 98048 - DNA, 25 bp, E. coli
tgggctaccctttacgaaagtaatg

SEQ ID NO: 98049 - DNA, 25 bp, E. coli
tgggctacccttaacgaaagtaatg

SEQ ID NO: 98050 - DNA, 25 bp, E. coli
taacaccgcaacaaaaactgagtcg

SEQ ID NO: 98051 - DNA, 25 bp, E. coli
caaattgctgtatctaacaagagcg

SEQ ID NO: 98052 - DNA, 25 bp, E. coli
caaattgctgtaactaacaagagcg

SEQ ID NO: 98053 - DNA, 25 bp, E. coli
tacaacgaatggatgcgcactaaag

SEQ ID NO: 98054 - DNA, 25 bp, E. coli
tacaacgaatggttgcgcactaaag

SEQ ID NO: 98055 - DNA, 25 bp, E. coli
tgcgcactaaagaaacgtcaagcct

SEQ ID NO: 98056 - DNA, 25 bp, E. coli
tcgaaactaccgtacaagaaaacag

SEQ ID NO: 98057 - DNA, 25 bp, E. coli
tcgaaactaccgaacaagaaaacag

SEQ ID NO: 98058 - DNA, 25 bp, E. coli
tccacatgacgaggtaatggctgaa

SEQ ID NO: 98059 - DNA, 25 bp, E. coli
tccacatgacgacgtaatggctgaa

SEQ ID NO: 98060 - DNA, 25 bp, E. coli
tgcgcactaaagtaacgtcaagcct

SEQ ID NO: 98061 - DNA, 25 bp, E. coli
tctccgatagttacagaattcgaaa

SEQ ID NO: 98062 - DNA, 25 bp, E. coli
tctccgatagtttcagaattcgaaa

SEQ ID NO: 98063 - DNA, 25 bp, E. coli
gccccgcaattcgacatgacgaggt

SEQ ID NO: 98064 - DNA, 25 bp, E. coli
gccccgcaattccacatgacgaggt

SEQ ID NO: 98065 - DNA, 25 bp, E. coli
gaaaatcttattgctcaaattgctg

SEQ ID NO: 98066 - DNA, 25 bp, E. coli
gaaaatcttattcctcaaattgctg

SEQ ID NO: 98067 - DNA, 25 bp, E. coli
ggtaatggctgaaatggaaaatctt

SEQ ID NO: 98068 - DNA, 25 bp, E. coli
ggtaatggctgatatggaaaatctt

SEQ ID NO: 98069 - DNA, 25 bp, E. coli
tgggtacagccctttctccgatagt

SEQ ID NO: 98070 - DNA, 25 bp, E. coli
tgggtacagcccattctccgatagt

SEQ ID NO: 98071 - DNA, 25 bp, E. coli
taacgtcaagccatgcagacactcg

SEQ ID NO: 98072 - DNA, 25 bp, E. coli
taacgtcaagccttgcagacactcg

SEQ ID NO: 98073 - DNA, 25 bp, E. coli
aagatgtcatgatcggcaatgtgcc

SEQ ID NO: 98074 - DNA, 25 bp, E. coli
aagatgtcatgaacggcaatgtgcc

SEQ ID NO: 98075 - DNA, 25 bp, E. coli
cactgaaaccgaaatgcgggcgcgt

SEQ ID NO: 98076 - DNA, 25 bp, E. coli
cactgaaaccgatatgcgggcgcgt

SEQ ID NO: 98077 - DNA, 25 bp, E. coli
attcgggcgcaaccagaagggcttc

SEQ ID NO: 98078 - DNA, 25 bp, E. coli
attcgggcgcaagcagaagggcttc

SEQ ID NO: 98079 - DNA, 25 bp, E. coli
tattccggccgttcttgttcagcac

SEQ ID NO: 98080 - DNA, 25 bp, E. coli
tattacctgtgccatcagcgagcct

SEQ ID NO: 98081 - DNA, 25 bp, E. coli
tattacctgtgcgatcagcgagcct

SEQ ID NO: 98082 - DNA, 25 bp, E. coli
tattccggccgtacttgttcagcac

SEQ ID NO: 98083 - DNA, 25 bp, E. coli
ttaccgcgaggatttgctcaggccg

SEQ ID NO: 98084 - DNA, 25 bp, E. coli
ttaccgcgaggaattgctcaggccg

SEQ ID NO: 98085 - DNA, 25 bp, E. coli
tgttcagcactgttgcgcgattgcc

SEQ ID NO: 98086 - DNA, 25 bp, E. coli
tgttcagcactgatgcgcgattgcc

SEQ ID NO: 98087 - DNA, 25 bp, E. coli
tacacgttgccgctggaggttattc

SEQ ID NO: 98088 - DNA, 25 bp, E. coli
tacacgttgccggtggaggttattc

SEQ ID NO: 98089 - DNA, 25 bp, E. coli
tctgatgcagcgctattcgggcgca

SEQ ID NO: 98090 - DNA, 25 bp, E. coli
tctgatgcagcggtattcgggcgca

SEQ ID NO: 98091 - DNA, 25 bp, E. coli
cgctggcctggctgaaagatgtcat

SEQ ID NO: 98092 - DNA, 25 bp, E. coli
cgctggcctggcagaaagatgtcat

SEQ ID NO: 98093 - DNA, 25 bp, E. coli
gtgaccgttaccctgaagcgctggc

SEQ ID NO: 98094 - DNA, 25 bp, E. coli
gtgaccgttaccgtgaagcgctggc

SEQ ID NO: 98095 - DNA, 25 bp, E. coli
tatcgaagacgtcccggatgtcgtt

SEQ ID NO: 98096 - DNA, 25 bp, E. coli
tatcgaagacgtgccggatgtcgtt

SEQ ID NO: 98097 - DNA, 25 bp, E. coli
tatcgacaccgtagaactgaaaggc

SEQ ID NO: 98098 - DNA, 25 bp, E. coli
tattgctgaagaaggtcagcgcgtg

SEQ ID NO: 98099 - DNA, 25 bp, E. coli
tattgctgaagatggtcagcgcgtg

SEQ ID NO: 98100 - DNA, 25 bp, E. coli
tatcgacaccgttgaactgaaaggc

SEQ ID NO: 98101 - DNA, 25 bp, E. coli
tctatcgaatctcatagcggcgttg

SEQ ID NO: 98102 - DNA, 25 bp, E. coli
tctatcgaatctgatagcggcgttg

SEQ ID NO: 98103 - DNA, 25 bp, E. coli
gaaaccccggttttccgcatcaaga

SEQ ID NO: 98104 - DNA, 25 bp, E. coli
gaaaccccggttatccgcatcaaga

SEQ ID NO: 98105 - DNA, 25 bp, E. coli
gaaatctctggtttccgacgacaag

SEQ ID NO: 98106 - DNA, 25 bp, E. coli
gaaatctctggtatccgacgacaag

SEQ ID NO: 98107 - DNA, 25 bp, E. coli
gaactgatcaaactgtccggtagcg

SEQ ID NO: 98108 - DNA, 25 bp, E. coli
gaactgatcaaagtgtccggtagcg

SEQ ID NO: 98109 - DNA, 25 bp, E. coli
cgacgacaagaacgataccggaact

SEQ ID NO: 98110 - DNA, 25 bp, E. coli
cgacgacaagaaggataccggaact

SEQ ID NO: 98111 - DNA, 25 bp, E. coli
ggttgttatctcgaacatggacgaa

SEQ ID NO: 98112 - DNA, 25 bp, E. coli
ggttgttatctccaacatggacgaa

SEQ ID NO: 98113 - DNA, 25 bp, E. coli
tggcgagatcgtgaatatcgaagac

SEQ ID NO: 98114 - DNA, 25 bp, E. coli
tggcgagatcgtcaatatcgaagac

SEQ ID NO: 98115 - DNA, 25 bp, E. coli
gagatcattgctccgctctctggcg

SEQ ID NO: 98116 - DNA, 25 bp, E. coli
gagatcattgctgcgctctctggcg

SEQ ID NO: 98117 - DNA, 25 bp, E. coli
cagacgaaaatgtgatggcgcgcga

SEQ ID NO: 98118 - DNA, 25 bp, E. coli
cataccgatctgatgacgacgctga

SEQ ID NO: 98119 - DNA, 25 bp, E. coli
catttgcacggaaatatagccgggc

SEQ ID NO: 98120 - DNA, 25 bp, E. coli
cagacgaaaatgagatggcgcgcga

SEQ ID NO: 98121 - DNA, 25 bp, E. coli
cataccgatctgttgacgacgctga

SEQ ID NO: 98122 - DNA, 25 bp, E. coli
taccgtgaaaaactctcccagatgg

SEQ ID NO: 98123 - DNA, 25 bp, E. coli
taccgtgaaaaagtctcccagatgg

SEQ ID NO: 98124 - DNA, 25 bp, E. coli
tttatcgtcggctcccagaggctga

SEQ ID NO: 98125 - DNA, 25 bp, E. coli
tttatcgtcggcacccagaggctga

SEQ ID NO: 98126 - DNA, 25 bp, E. coli
tgtcgatgaccacatcaaccgcgtg

SEQ ID NO: 98127 - DNA, 25 bp, E. coli
tgtcgatgaccagatcaaccgcgtg

SEQ ID NO: 98128 - DNA, 25 bp, E. coli
tgatgcgcaggactatcaacgccgt

SEQ ID NO: 98129 - DNA, 25 bp, E. coli
tgatgcgcaggagtatcaacgccgt

SEQ ID NO: 98130 - DNA, 25 bp, E. coli
tctggcaaactgcacaatacggtgg

SEQ ID NO: 98131 - DNA, 25 bp, E. coli
tctggcaaactggacaatacggtgg

SEQ ID NO: 98132 - DNA, 25 bp, E. coli
gaagaaacctttcactggtcccacg

SEQ ID NO: 98133 - DNA, 25 bp, E. coli
gaagaaacctttgactggtcccacg

SEQ ID NO: 98134 - DNA, 25 bp, E. coli
gctacgcacaagaagataaccgctg

SEQ ID NO: 98135 - DNA, 25 bp, E. coli
gctacgcacaagtagataaccgctg

SEQ ID NO: 98136 - DNA, 25 bp, E. coli
catttgcacggatatatagccgggc

SEQ ID NO: 98137 - DNA, 25 bp, E. coli
taattactgcgcataatcagcaagg

SEQ ID NO: 98138 - DNA, 25 bp, E. coli
taattactgcgcttaatcagcaagg

SEQ ID NO: 98139 - DNA, 25 bp, E. coli
caacgttttaattagcggtgagacg

SEQ ID NO: 98140 - DNA, 25 bp, E. coli
caacgttttaataagcggtgagacg

SEQ ID NO: 98141 - DNA, 25 bp, E. coli
tactggcagggccatttcgcgctga

SEQ ID NO: 98142 - DNA, 25 bp, E. coli
tactggcagggcgatttcgcgctga

SEQ ID NO: 98143 - DNA, 25 bp, E. coli
gggaacgttcgtcaactggaacatg

SEQ ID NO: 98144 - DNA, 25 bp, E. coli
gggaacgttcgtgaactggaacatg

SEQ ID NO: 98145 - DNA, 25 bp, E. coli
tgacttgttccaccgcctgagcgtg

SEQ ID NO: 98146 - DNA, 25 bp, E. coli
tgacttgttccagcgcctgagcgtg

SEQ ID NO: 98147 - DNA, 25 bp, E. coli
gcgctgacttgtaccaccgcctgag

SEQ ID NO: 98148 - DNA, 25 bp, E. coli
gcgctgacttgttccaccgcctgag

SEQ ID NO: 98149 - DNA, 25 bp, E. coli
gcggcatccgatgtcaacgttttaa

SEQ ID NO: 98150 - DNA, 25 bp, E. coli
gcgatttcgcgctgacttgttccac

SEQ ID NO: 98151 - DNA, 25 bp, E. coli
gcggcatccgatctcaacgttttaa

SEQ ID NO: 98152 - DNA, 25 bp, E. coli
gcgatttcgcgcagacttgttccac

SEQ ID NO: 98153 - DNA, 25 bp, E. coli
gaacgttcgtgatctggaacatgct

SEQ ID NO: 98154 - DNA, 25 bp, E. coli
gaacgttcgtgaactggaacatgct

SEQ ID NO: 98155 - DNA, 25 bp, E. coli
gatctcaacgttataattagcggtg

SEQ ID NO: 98156 - DNA, 25 bp, E. coli
gatctcaacgttttaattagcggtg

SEQ ID NO: 98157 - DNA, 25 bp, E. coli
gatttcgcgctgtcttgttccaccg

SEQ ID NO: 98158 - DNA, 25 bp, E. coli
gatttcgcgctgacttgttccaccg

SEQ ID NO: 98159 - DNA, 25 bp, E. coli
tggcggcatccgatctcaacgtttt

SEQ ID NO: 98160 - DNA, 25 bp, E. coli
tggcggcatccgttctcaacgtttt

SEQ ID NO: 98161 - DNA, 25 bp, E. coli
cagaatccggtgattgctgccgtta

SEQ ID NO: 98162 - DNA, 25 bp, E. coli
cagaatccggtgtttgctgccgtta

SEQ ID NO: 98163 - DNA, 25 bp, E. coli
ttaacgcgggtgtcgtggcgctttc

SEQ ID NO: 98164 - DNA, 25 bp, E. coli
tttttgaaactgctgaccgaggcgg

SEQ ID NO: 98165 - DNA, 25 bp, E. coli
ttaacgcgggtgacgtggcgctttc

SEQ ID NO: 98166 - DNA, 25 bp, E. coli
tttttgaaactggtgaccgaggcgg

SEQ ID NO: 98167 - DNA, 25 bp, E. coli
tgccgttaaagataatgccagcctg

SEQ ID NO: 98168 - DNA, 25 bp, E. coli
tgccgttaaagaaaatgccagcctg

SEQ ID NO: 98169 - DNA, 25 bp, E. coli
tcatgttgatttcctggaaggcgcg

SEQ ID NO: 98170 - DNA, 25 bp, E. coli
tcatgttgatttgctggaaggcgcg

SEQ ID NO: 98171 - DNA, 25 bp, E. coli
gcggcaagagcgcaaggttttttct

SEQ ID NO: 98172 - DNA, 25 bp, E. coli
gcggcaagagcggaaggttttttct

SEQ ID NO: 98173 - DNA, 25 bp, E. coli
gcaagttgcgcattcgaatccggat

SEQ ID NO: 98174 - DNA, 25 bp, E. coli
gcaagttgcgcaatcgaatccggat

SEQ ID NO: 98175 - DNA, 25 bp, E. coli
gattgtattgagatcctgccaggct

SEQ ID NO: 98176 - DNA, 25 bp, E. coli
gattgtattgagttcctgccaggct

SEQ ID NO: 98177 - DNA, 25 bp, E. coli
gtggcgctttcctccacgaataccg

SEQ ID NO: 98178 - DNA, 25 bp, E. coli
gtggcgctttccaccacgaataccg

SEQ ID NO: 98179 - DNA, 25 bp, E. coli
tggaaggcgcgtgaaataaagaagt

SEQ ID NO: 98180 - DNA, 25 bp, E. coli
tggaaggcgcgtcaaataaagaagt

SEQ ID NO: 98181 - DNA, 25 bp, E. coli
gatgaagaagatgcgcgtaatgcga

SEQ ID NO: 98182 - DNA, 25 bp, E. coli
gatgaagaagatccgcgtaatgcga

SEQ ID NO: 98183 - DNA, 25 bp, E. coli
cagccgtggcgttaagtccgttatg

SEQ ID NO: 98184 - DNA, 25 bp, E. coli
caaaggcaccgaaaaacaggcagct

SEQ ID NO: 98185 - DNA, 25 bp, E. coli
caaaggcaccgataaacaggcagct

SEQ ID NO: 98186 - DNA, 25 bp, E. coli
cagccgtggcgtaaagtccgttatg

SEQ ID NO: 98187 - DNA, 25 bp, E. coli
cacgaccttgtctgagttacaggag

SEQ ID NO: 98188 - DNA, 25 bp, E. coli
cacgaccttgtcagagttacaggag

SEQ ID NO: 98189 - DNA, 25 bp, E. coli
catatgattctgaccagcatggagg

SEQ ID NO: 98190 - DNA, 25 bp, E. coli
catatgattctgtccagcatggagg

SEQ ID NO: 98191 - DNA, 25 bp, E. coli
catgattctggattcagccgtggcg

SEQ ID NO: 98192 - DNA, 25 bp, E. coli
catgattctggaatcagccgtggcg

SEQ ID NO: 98193 - DNA, 25 bp, E. coli
tcttgctgaaattgccaaaggcacc

SEQ ID NO: 98194 - DNA, 25 bp, E. coli
tcttgctgaaatagccaaaggcacc

SEQ ID NO: 98195 - DNA, 25 bp, E. coli
ccggaggcatgaaaccggaagatgc

SEQ ID NO: 98196 - DNA, 25 bp, E. coli
ccggaggcatgataccggaagatgc

SEQ ID NO: 98197 - DNA, 25 bp, E. coli
gctgcccttcagtcgcttaatgaaa

SEQ ID NO: 98198 - DNA, 25 bp, E. coli
gctgcccttcagacgcttaatgaaa

SEQ ID NO: 98199 - DNA, 25 bp, E. coli
gaaatgcgtatatctccacgcccga

SEQ ID NO: 98200 - DNA, 25 bp, E. coli
gaaatgcgtataactccacgcccga

SEQ ID NO: 98201 - DNA, 25 bp, E. coli
cgtaaaattctcatcgccggaggca

SEQ ID NO: 98202 - DNA, 25 bp, E. coli
cgtaaaattctcttcgccggaggca

SEQ ID NO: 98203 - DNA, 25 bp, E. coli
tgtgacaaacgggatatgccagaaa

SEQ ID NO: 98204 - DNA, 25 bp, E. coli
tgtgacaaacggcatatgccagaaa

SEQ ID NO: 98205 - DNA, 25 bp, E. coli
cattctctggagaatggatacacct

SEQ ID NO: 98206 - DNA, 25 bp, E. coli
cattctctggagtatggatacacct

SEQ ID NO: 98207 - DNA, 25 bp, E. coli
attaatgccccattctctggagaat

SEQ ID NO: 98208 - DNA, 25 bp, E. coli
attaatgccccaatctctggagaat

SEQ ID NO: 98209 - DNA, 25 bp, E. coli
ttctctggagaaaggatacacctct

SEQ ID NO: 98210 - DNA, 25 bp, E. coli
ttaatgccccatactctggagaatg

SEQ ID NO: 98211 - DNA, 25 bp, E. coli
ttaatgccccattctctggagaatg

SEQ ID NO: 98212 - DNA, 25 bp, E. coli
ttctctggagaatggatacacctct

SEQ ID NO: 98213 - DNA, 25 bp, E. coli
tgccccattctcaggagaatggata

SEQ ID NO: 98214 - DNA, 25 bp, E. coli
tgccccattctctggagaatggata

SEQ ID NO: 98215 - DNA, 25 bp, E. coli
tctctggagaatggatacacctctg

SEQ ID NO: 98216 - DNA, 25 bp, E. coli
tctctggagaatcgatacacctctg

SEQ ID NO: 98217 - DNA, 25 bp, E. coli
gaagaacaacaccccattaatgccc

SEQ ID NO: 98218 - DNA, 25 bp, E. coli
gaagaacaacacgccattaatgccc

SEQ ID NO: 98219 - DNA, 25 bp, E. coli
ctctggagaatgcatacacctctga

SEQ ID NO: 98220 - DNA, 25 bp, E. coli
ctctggagaatggatacacctctga

SEQ ID NO: 98221 - DNA, 25 bp, E. coli
gtaataaatacatataacggtgata

SEQ ID NO: 98222 - DNA, 25 bp, E. coli
gtaataaatacaaataacggtgata

SEQ ID NO: 98223 - DNA, 25 bp, E. coli
ggtgtaataaattcatataacggtg

SEQ ID NO: 98224 - DNA, 25 bp, E. coli
ggtgtaataaatacatataacggtg

SEQ ID NO: 98225 - DNA, 25 bp, E. coli
taatgccccattctctggagaatgg

SEQ ID NO: 98226 - DNA, 25 bp, E. coli
taatgccccattgtctggagaatgg

SEQ ID NO: 98227 - DNA, 25 bp, E. coli
caaaaaggataatacgatggctact

SEQ ID NO: 98228 - DNA, 25 bp, E. coli
caaaaaggataaaacgatggctact

SEQ ID NO: 98229 - DNA, 25 bp, E. coli
aaacgatggctactccacacattaa

SEQ ID NO: 98230 - DNA, 25 bp, E. coli
aaacgatggctagtccacacattaa

SEQ ID NO: 98231 - DNA, 25 bp, E. coli
tagacgcggcaaaagcactgggcgt

SEQ ID NO: 98232 - DNA, 25 bp, E. coli
tagacgcggcaatagcactgggcgt

SEQ ID NO: 98233 - DNA, 25 bp, E. coli
tttgggcggagcagtgactccgcct

SEQ ID NO: 98234 - DNA, 25 bp, E. coli
tttgggcggagctgtgactccgcct

SEQ ID NO: 98235 - DNA, 25 bp, E. coli
tgtcacaaaaaggataaaacgatgg

SEQ ID NO: 98236 - DNA, 25 bp, E. coli
tgtcacaaaaagcataaaacgatgg

SEQ ID NO: 98237 - DNA, 25 bp, E. coli
tgcgtaacgcggaagacgcggcaaa

SEQ ID NO: 98238 - DNA, 25 bp, E. coli
tgcgtaacgcggtagacgcggcaaa

SEQ ID NO: 98239 - DNA, 25 bp, E. coli
gactccgccttttatatgtcacaaa

SEQ ID NO: 98240 - DNA, 25 bp, E. coli
gactccgcctttaatatgtcacaaa

SEQ ID NO: 98241 - DNA, 25 bp, E. coli
cggcaaaagcacagggcgttgatgc

SEQ ID NO: 98242 - DNA, 25 bp, E. coli
cggcaaaagcactgggcgttgatgc

SEQ ID NO: 98243 - DNA, 25 bp, E. coli
ggataaaacgatggctactccacac

SEQ ID NO: 98244 - DNA, 25 bp, E. coli
ggagcagtgactgcgcctttaatat

SEQ ID NO: 98245 - DNA, 25 bp, E. coli
ggataaaacgatcgctactccacac

SEQ ID NO: 98246 - DNA, 25 bp, E. coli
ggagcagtgactccgcctttaatat

SEQ ID NO: 98247 - DNA, 25 bp, E. coli
taacgcggtagacgcggcaaaagca

SEQ ID NO: 98248 - DNA, 25 bp, E. coli
taacgcggtagaggcggcaaaagca

SEQ ID NO: 98249 - DNA, 25 bp, E. coli
tattcgtccattgcatgatcgcgtg

SEQ ID NO: 98250 - DNA, 25 bp, E. coli
tattcgtccattccatgatcgcgtg

SEQ ID NO: 98251 - DNA, 25 bp, E. coli
ttgaaaatggcgaagtgaagccgct

SEQ ID NO: 98252 - DNA, 25 bp, E. coli
ttgaaaatggcgtagtgaagccgct

SEQ ID NO: 98253 - DNA, 25 bp, E. coli
tgaccggctctgcagcggctaaatc

SEQ ID NO: 98254 - DNA, 25 bp, E. coli
tgaccggctctggagcggctaaatc

SEQ ID NO: 98255 - DNA, 25 bp, E. coli
tcatgtccgaaaccgacattctggc

SEQ ID NO: 98256 - DNA, 25 bp, E. coli
tcatgtccgaaagcgacattctggc

SEQ ID NO: 98257 - DNA, 25 bp, E. coli
gctggcggcatccttctgaccggct

SEQ ID NO: 98258 - DNA, 25 bp, E. coli
gctggcggcatcgttctgaccggct

SEQ ID NO: 98259 - DNA, 25 bp, E. coli
gcaatggccgtaaccttgaaaatgg

SEQ ID NO: 98260 - DNA, 25 bp, E. coli
gaagtgttgatcatgtccgaaagcg

SEQ ID NO: 98261 - DNA, 25 bp, E. coli
gcaatggccgtatccttgaaaatgg

SEQ ID NO: 98262 - DNA, 25 bp, E. coli
gaagtgttgatcttgtccgaaagcg

SEQ ID NO: 98263 - DNA, 25 bp, E. coli
cattctggcaatagttgaagcgtaa

SEQ ID NO: 98264 - DNA, 25 bp, E. coli
cattctggcaattgttgaagcgtaa

SEQ ID NO: 98265 - DNA, 25 bp, E. coli
gatcgcgtgatcgtcaagcgtaaag

SEQ ID NO: 98266 - DNA, 25 bp, E. coli
gttgaaactaaatctgctggcggca

SEQ ID NO: 98267 - DNA, 25 bp, E. coli
gatcgcgtgatcctcaagcgtaaag

SEQ ID NO: 98268 - DNA, 25 bp, E. coli
gttgaaactaaaactgctggcggca

SEQ ID NO: 98269 - DNA, 25 bp, E. coli
gttattttcaaccatggctacggtg

SEQ ID NO: 98270 - DNA, 25 bp, E. coli
gttattttcaacgatggctacggtg

SEQ ID NO: 98271 - DNA, 25 bp, E. coli
taaatgtagtgctgatgaaaccccg

SEQ ID NO: 98272 - DNA, 25 bp, E. coli
taaatgtagtgcagatgaaaccccg

SEQ ID NO: 98273 - DNA, 25 bp, E. coli
tttgcctgcgaacctgaaatgctga

SEQ ID NO: 98274 - DNA, 25 bp, E. coli
tttgcctgcgaagctgaaatgctga

SEQ ID NO: 98275 - DNA, 25 bp, E. coli
tgtttgcaaaccgcgcagaagcaga

SEQ ID NO: 98276 - DNA, 25 bp, E. coli
tgtttgcaaaccccgcagaagcaga

SEQ ID NO: 98277 - DNA, 25 bp, E. coli
tgctgctgtatgcatgttggcacca

SEQ ID NO: 98278 - DNA, 25 bp, E. coli
tgctgctgtatggatgttggcacca

SEQ ID NO: 98279 - DNA, 25 bp, E. coli
ccattatggacaactccgactgcac

SEQ ID NO: 98280 - DNA, 25 bp, E. coli
ccattatggacatctccgactgcac

SEQ ID NO: 98281 - DNA, 25 bp, E. coli
gaaaccccggttagctgctgtatgg

SEQ ID NO: 98282 - DNA, 25 bp, E. coli
gaaaccccggtttgctgctgtatgg

SEQ ID NO: 98283 - DNA, 25 bp, E. coli
ccccgactttcactgaagagtctga

SEQ ID NO: 98284 - DNA, 25 bp, E. coli
ccccgactttcagtgaagagtctga

SEQ ID NO: 98285 - DNA, 25 bp, E. coli
gatatcgatttcacttttgcctgcg

SEQ ID NO: 98286 - DNA, 25 bp, E. coli
gatatcgatttctcttttgcctgcg

SEQ ID NO: 98287 - DNA, 25 bp, E. coli
gtagtgctgatgaaaccccggtttg

SEQ ID NO: 98288 - DNA, 25 bp, E. coli
ggtgtgcgcctggatatcgatttca

SEQ ID NO: 98289 - DNA, 25 bp, E. coli
ggtgtgcgcctgcatatcgatttca

SEQ ID NO: 98290 - DNA, 25 bp, E. coli
gtagtgctgatgtaaccccggtttg

SEQ ID NO: 98291 - DNA, 25 bp, E. coli
tggatgttggcagcattatggacaa

SEQ ID NO: 98292 - DNA, 25 bp, E. coli
tggatgttggcaccattatggacaa

SEQ ID NO: 98293 - DNA, 25 bp, E. coli
aatatattgctgatcctcggtctgg

SEQ ID NO: 98294 - DNA, 25 bp, E. coli
aattgctatcggaaccagcctgccg

SEQ ID NO: 98295 - DNA, 25 bp, E. coli
aatatattgctgttcctcggtctgg

SEQ ID NO: 98296 - DNA, 25 bp, E. coli
aattgctatcggtaccagcctgccg

SEQ ID NO: 98297 - DNA, 25 bp, E. coli
cacggtgctggccaattactttgcc

SEQ ID NO: 98298 - DNA, 25 bp, E. coli
cacggtgctggcgaattactttgcc

SEQ ID NO: 98299 - DNA, 25 bp, E. coli
tatgacggacaacttagtcgcagcg

SEQ ID NO: 98300 - DNA, 25 bp, E. coli
tatgacggacaagttagtcgcagcg

SEQ ID NO: 98301 - DNA, 25 bp, E. coli
tgacagcctgaccagagagcagctt

SEQ ID NO: 98302 - DNA, 25 bp, E. coli
tgacagcctgacgagagagcagctt

SEQ ID NO: 98303 - DNA, 25 bp, E. coli
tcattgttaaacatgcacgtcaggc

SEQ ID NO: 98304 - DNA, 25 bp, E. coli
tcattgttaaacttgcacgtcaggc

SEQ ID NO: 98305 - DNA, 25 bp, E. coli
cccttaatgttgatggtcagcgtgg

SEQ ID NO: 98306 - DNA, 25 bp, E. coli
cccttaatgttgttggtcagcgtgg

SEQ ID NO: 98307 - DNA, 25 bp, E. coli
gtttacccgcgctgataacgccagg

SEQ ID NO: 98308 - DNA, 25 bp, E. coli
gtcgtttacagtgccgaccgcctgg

SEQ ID NO: 98309 - DNA, 25 bp, E. coli
gatttagccgttcgtacagccctcg

SEQ ID NO: 98310 - DNA, 25 bp, E. coli
gtcgtttacagtcccgaccgcctgg

SEQ ID NO: 98311 - DNA, 25 bp, E. coli
gatttagccgttggtacagccctcg

SEQ ID NO: 98312 - DNA, 25 bp, E. coli
gtttacccgcgcagataacgccagg

SEQ ID NO: 98313 - DNA, 25 bp, E. coli
taacgccaggagtgattgatccact

SEQ ID NO: 98314 - DNA, 25 bp, E. coli
taacgccaggagagattgatccact

SEQ ID NO: 98315 - DNA, 25 bp, E. coli
cactggtggtgttttcagcccggta

SEQ ID NO: 98316 - DNA, 25 bp, E. coli
cactggtggtgtattcagcccggta

SEQ ID NO: 98317 - DNA, 25 bp, E. coli
cccggatttttgtcgaacaggaatg

SEQ ID NO: 98318 - DNA, 25 bp, E. coli
cccggatttttgacgaacaggaatg

SEQ ID NO: 98319 - DNA, 25 bp, E. coli
aacaggcggagattaacggcgtcgt

SEQ ID NO: 98320 - DNA, 25 bp, E. coli
aacaggcggagaataacggcgtcgt

SEQ ID NO: 98321 - DNA, 25 bp, E. coli
tacgcgaatgtgttgccggatggac

SEQ ID NO: 98322 - DNA, 25 bp, E. coli
tacgcgaatgtgatgccggatggac

SEQ ID NO: 98323 - DNA, 25 bp, E. coli
tgtctgatctgtatacgcgaatgtg

SEQ ID NO: 98324 - DNA, 25 bp, E. coli
tgtctgatctgtttacgcgaatgtg

SEQ ID NO: 98325 - DNA, 25 bp, E. coli
cgctttcgggcagccagttgtcact

SEQ ID NO: 98326 - DNA, 25 bp, E. coli
cgctttcgggcacccagttgtcact

SEQ ID NO: 98327 - DNA, 25 bp, E. coli
cgtccggcccgtcatgatgttgttg

SEQ ID NO: 98328 - DNA, 25 bp, E. coli
cgtgtacgacgtgatgccggaggaa

SEQ ID NO: 98329 - DNA, 25 bp, E. coli
cgtgtacgacgtcatgccggaggaa

SEQ ID NO: 98330 - DNA, 25 bp, E. coli
cgtccggcccgtgatgatgttgttg

SEQ ID NO: 98331 - DNA, 25 bp, E. coli
ggtgacccgttaagacacgtacaac

SEQ ID NO: 98332 - DNA, 25 bp, E. coli
ggtgacccgttatgacacgtacaac

SEQ ID NO: 98333 - DNA, 25 bp, E. coli
ggcgcacactgacggtgacccgtta

SEQ ID NO: 98334 - DNA, 25 bp, E. coli
ggcgcacactgagggtgacccgtta

SEQ ID NO: 98335 - DNA, 25 bp, E. coli
gatgggcaaacaggcggagattaac

SEQ ID NO: 98336 - DNA, 25 bp, E. coli
gatgggcaaacacgcggagattaac

SEQ ID NO: 98337 - DNA, 25 bp, E. coli
caaactgcattactggtcgctggat

SEQ ID NO: 98338 - DNA, 25 bp, E. coli
caaactgcattagtggtcgctggat

SEQ ID NO: 98339 - DNA, 25 bp, E. coli
cataatcccgcatgatgagctgggt

SEQ ID NO: 98340 - DNA, 25 bp, E. coli
cataatcccgcaagatgagctgggt

SEQ ID NO: 98341 - DNA, 25 bp, E. coli
taaagccgaaagctgcgatgactgc

SEQ ID NO: 98342 - DNA, 25 bp, E. coli
taaagccgaaaggtgcgatgactgc

SEQ ID NO: 98343 - DNA, 25 bp, E. coli
tgctgtacgaccttccgctggagat

SEQ ID NO: 98344 - DNA, 25 bp, E. coli
tgctgtacgaccatccgctggagat

SEQ ID NO: 98345 - DNA, 25 bp, E. coli
gcaacctgtgtgaaactgaatggca

SEQ ID NO: 98346 - DNA, 25 bp, E. coli
gcaacctgtgtgtaactgaatggca

SEQ ID NO: 98347 - DNA, 25 bp, E. coli
cgttctgccgcgagataagcactgg

SEQ ID NO: 98348 - DNA, 25 bp, E. coli
cgttctgccgcgtgataagcactgg

SEQ ID NO: 98349 - DNA, 25 bp, E. coli
ctgaaacctgaaatgagcggcccgg

SEQ ID NO: 98350 - DNA, 25 bp, E. coli
ctgaaacctgaattgagcggcccgg

SEQ ID NO: 98351 - DNA, 25 bp, E. coli
gatttctcgtccgtcagcagcgata

SEQ ID NO: 98352 - DNA, 25 bp, E. coli
gatttctcgtccctcagcagcgata

SEQ ID NO: 98353 - DNA, 25 bp, E. coli
tggatgacgaactggccgcgattaa

SEQ ID NO: 98354 - DNA, 25 bp, E. coli
tggatgacgaacaggccgcgattaa

SEQ ID NO: 98355 - DNA, 25 bp, E. coli
tcaagaatttatacaaccgccgcgc

SEQ ID NO: 98356 - DNA, 25 bp, E. coli
tcaagaatttattcaaccgccgcgc

SEQ ID NO: 98357 - DNA, 25 bp, E. coli
gatgacctcgccactctggtactgg

SEQ ID NO: 98358 - DNA, 25 bp, E. coli
gatgacctcgcctctctggtactgg

SEQ ID NO: 98359 - DNA, 25 bp, E. coli
tgatcgttcgctcaaagaagcatcg

SEQ ID NO: 98360 - DNA, 25 bp, E. coli
tgatcgttcgctgaaagaagcatcg

SEQ ID NO: 98361 - DNA, 25 bp, E. coli
tccatcggattcttcttagataaag

SEQ ID NO: 98362 - DNA, 25 bp, E. coli
tccatcggattcatcttagataaag

SEQ ID NO: 98363 - DNA, 25 bp, E. coli
taataccctctacattgagttaatc

SEQ ID NO: 98364 - DNA, 25 bp, E. coli
taataccctctagattgagttaatc

SEQ ID NO: 98365 - DNA, 25 bp, E. coli
ccatcagggcgcatcgatatacaaa

SEQ ID NO: 98366 - DNA, 25 bp, E. coli
ccatcagggcgcttcgatatacaaa

SEQ ID NO: 98367 - DNA, 25 bp, E. coli
gcacttatttttcatcgttcgctca

SEQ ID NO: 98368 - DNA, 25 bp, E. coli
gcacttatttttgatcgttcgctca

SEQ ID NO: 98369 - DNA, 25 bp, E. coli
gcatcgaacgctgggttttagataa

SEQ ID NO: 98370 - DNA, 25 bp, E. coli
gcatcgaacgctcggttttagataa

SEQ ID NO: 98371 - DNA, 25 bp, E. coli
gattatatagtgtaatccgatttga

SEQ ID NO: 98372 - DNA, 25 bp, E. coli
gattatatagtgaaatccgatttga

SEQ ID NO: 98373 - DNA, 25 bp, E. coli
gtagcgttacaagtattacacaaag

SEQ ID NO: 98374 - DNA, 25 bp, E. coli
gtagcgttacaactattacacaaag

SEQ ID NO: 98375 - DNA, 25 bp, E. coli
tcaaagaagcatggaacgctgggtt

SEQ ID NO: 98376 - DNA, 25 bp, E. coli
tcaaagaagcatcgaacgctgggtt

SEQ ID NO: 98377 - DNA, 25 bp, E. coli
gagttaatctccttgtagcgttaca

SEQ ID NO: 98378 - DNA, 25 bp, E. coli
gagaaaacaggaagcttccatcgga

SEQ ID NO: 98379 - DNA, 25 bp, E. coli
gagttaatctccatgtagcgttaca

SEQ ID NO: 98380 - DNA, 25 bp, E. coli
gagaaaacaggatgcttccatcgga

SEQ ID NO: 98381 - DNA, 25 bp, E. coli
caacgtcacggttaatgaaaactgt

SEQ ID NO: 98382 - DNA, 25 bp, E. coli
taaaggcaatcaccgggcaggtaat

SEQ ID NO: 98383 - DNA, 25 bp, E. coli
taaagctgtatcgaaatcatttccg

SEQ ID NO: 98384 - DNA, 25 bp, E. coli
taaaggcaatcagcgggcaggtaat

SEQ ID NO: 98385 - DNA, 25 bp, E. coli
taaagctgtatccaaatcatttccg

SEQ ID NO: 98386 - DNA, 25 bp, E. coli
atcatttccgaaacaggctggtacg

SEQ ID NO: 98387 - DNA, 25 bp, E. coli
atcatttccgaatcaggctggtacg

SEQ ID NO: 98388 - DNA, 25 bp, E. coli
caacgtcacggtaaatgaaaactgt

SEQ ID NO: 98389 - DNA, 25 bp, E. coli
gaaggtaataccaacatctccggtg

SEQ ID NO: 98390 - DNA, 25 bp, E. coli
gaaggtaatacctacatctccggtg

SEQ ID NO: 98391 - DNA, 25 bp, E. coli
gactcaggtcagaggtgacttcgtt

SEQ ID NO: 98392 - DNA, 25 bp, E. coli
gactcaggtcagtggtgacttcgtt

SEQ ID NO: 98393 - DNA, 25 bp, E. coli
cggttattgatatgccgagtggcag

SEQ ID NO: 98394 - DNA, 25 bp, E. coli
cggttattgataagccgagtggcag

SEQ ID NO: 98395 - DNA, 25 bp, E. coli
ggttttccataatggcaatcagcgg

SEQ ID NO: 98396 - DNA, 25 bp, E. coli
ggttttccataaaggcaatcagcgg

SEQ ID NO: 98397 - DNA, 25 bp, E. coli
ggaatagcgtattgcgatccgggaa

SEQ ID NO: 98398 - DNA, 25 bp, E. coli
ggaatagcgtatagcgatccgggaa

SEQ ID NO: 98399 - DNA, 25 bp, E. coli
taacccgggaggtacaagatacacg

SEQ ID NO: 98400 - DNA, 25 bp, E. coli
taacccgggaggaacaagatacacg

SEQ ID NO: 98401 - DNA, 25 bp, E. coli
gaccgtcaaatcattattccgccca

SEQ ID NO: 98402 - DNA, 25 bp, E. coli
gaccgtcaaatctttattccgccca

SEQ ID NO: 98403 - DNA, 25 bp, E. coli
tatataattggtattctgggaacta

SEQ ID NO: 98404 - DNA, 25 bp, E. coli
tatataattggttttctgggaacta

SEQ ID NO: 98405 - DNA, 25 bp, E. coli
tatatataattgctattctgggaac

SEQ ID NO: 98406 - DNA, 25 bp, E. coli
tatatataattggtattctgggaac

SEQ ID NO: 98407 - DNA, 25 bp, E. coli
taataacggcttaaattggaataca

SEQ ID NO: 98408 - DNA, 25 bp, E. coli
taataacggctttaattggaataca

SEQ ID NO: 98409 - DNA, 25 bp, E. coli
tctgggaactattttctcaaaatac

SEQ ID NO: 98410 - DNA, 25 bp, E. coli
tctgggaactatattctcaaaatac

SEQ ID NO: 98411 - DNA, 25 bp, E. coli
gaactatattctcaaaatacagtag

SEQ ID NO: 98412 - DNA, 25 bp, E. coli
gaactatattctgaaaatacagtag

SEQ ID NO: 98413 - DNA, 25 bp, E. coli
cggctttaattgcaatacatatatt

SEQ ID NO: 98414 - DNA, 25 bp, E. coli
cggctttaattggaatacatatatt

SEQ ID NO: 98415 - DNA, 25 bp, E. coli
gataattattattataacggcttta

SEQ ID NO: 98416 - DNA, 25 bp, E. coli
gataattattataataacggcttta

SEQ ID NO: 98417 - DNA, 25 bp, E. coli
ggtattctgggatctatattctcaa

SEQ ID NO: 98418 - DNA, 25 bp, E. coli
ggtattctgggaactatattctcaa

SEQ ID NO: 98419 - DNA, 25 bp, E. coli
ggaatacatataatacaacgtatta

SEQ ID NO: 98420 - DNA, 25 bp, E. coli
ggaatacatatattacaacgtatta

SEQ ID NO: 98421 - DNA, 25 bp, E. coli
taattggaatacttatattacaacg

SEQ ID NO: 98422 - DNA, 25 bp, E. coli
taacggctttaaatggaatacatat

SEQ ID NO: 98423 - DNA, 25 bp, E. coli
taacggctttaattggaatacatat

SEQ ID NO: 98424 - DNA, 25 bp, E. coli
taattggaatacatatattacaacg

SEQ ID NO: 98425 - DNA, 25 bp, E. coli
cacatcaaagcactctgtcagtcag

SEQ ID NO: 98426 - DNA, 25 bp, E. coli
cacatcaaagcagtctgtcagtcag

SEQ ID NO: 98427 - DNA, 25 bp, E. coli
agcagtctgtcactcagtgcgtgaa

SEQ ID NO: 98428 - DNA, 25 bp, E. coli
agcagtctgtcagtcagtgcgtgaa

SEQ ID NO: 98429 - DNA, 25 bp, E. coli
ttgccgctggtcgtcgtcggttgca

SEQ ID NO: 98430 - DNA, 25 bp, E. coli
ttgccgctggtcctcgtcggttgca

SEQ ID NO: 98431 - DNA, 25 bp, E. coli
tcgtcggttgcagatcaaagcagtc

SEQ ID NO: 98432 - DNA, 25 bp, E. coli
tcgtcggttgcacatcaaagcagtc

SEQ ID NO: 98433 - DNA, 25 bp, E. coli
tctgtcagtcagtgcgtgaagccac

SEQ ID NO: 98434 - DNA, 25 bp, E. coli
tcggttgcacatcaaagcagtctgt

SEQ ID NO: 98435 - DNA, 25 bp, E. coli
tcggttgcacatgaaagcagtctgt

SEQ ID NO: 98436 - DNA, 25 bp, E. coli
tctgtcagtcagagcgtgaagccac

SEQ ID NO: 98437 - DNA, 25 bp, E. coli
tcaaagcagtctgtcagtcagtgcg

SEQ ID NO: 98438 - DNA, 25 bp, E. coli
gctggtcgtcgtcggttgcacatca

SEQ ID NO: 98439 - DNA, 25 bp, E. coli
gctggtcgtcgtgggttgcacatca

SEQ ID NO: 98440 - DNA, 25 bp, E. coli
gttgcacatcaaagcagtctgtcag

SEQ ID NO: 98441 - DNA, 25 bp, E. coli
gttgcacatcaatgcagtctgtcag

SEQ ID NO: 98442 - DNA, 25 bp, E. coli
gtcagtcagtgcgtgaagccaccac

SEQ ID NO: 98443 - DNA, 25 bp, E. coli
ggtcgtcgtcggttgcacatcaaag

SEQ ID NO: 98444 - DNA, 25 bp, E. coli
ggtcgtcgtcggatgcacatcaaag

SEQ ID NO: 98445 - DNA, 25 bp, E. coli
gtcagtcagtgcctgaagccaccac

SEQ ID NO: 98446 - DNA, 25 bp, E. coli
tcaaagcagtctctcagtcagtgcg

SEQ ID NO: 98447 - DNA, 25 bp, E. coli
cagcgcatggactacttctgccagc

SEQ ID NO: 98448 - DNA, 25 bp, E. coli
cagcgcatggacaacttctgccagc

SEQ ID NO: 98449 - DNA, 25 bp, E. coli
catcagaagttgaccagcgcatgga

SEQ ID NO: 98450 - DNA, 25 bp, E. coli
catcagaagttgtccagcgcatgga

SEQ ID NO: 98451 - DNA, 25 bp, E. coli
aaaaccgaagcctgctacaacttcg

SEQ ID NO: 98452 - DNA, 25 bp, E. coli
caacttcggtttcttgattaaggca

SEQ ID NO: 98453 - DNA, 25 bp, E. coli
aaaaccgaagccagctacaacttcg

SEQ ID NO: 98454 - DNA, 25 bp, E. coli
caacttcggtttgttgattaaggca

SEQ ID NO: 98455 - DNA, 25 bp, E. coli
tatggtcgcataataacggaacaat

SEQ ID NO: 98456 - DNA, 25 bp, E. coli
tatggtcgcatattaacggaacaat

SEQ ID NO: 98457 - DNA, 25 bp, E. coli
tttcggatatatacatatggtcgca

SEQ ID NO: 98458 - DNA, 25 bp, E. coli
tttcggatatattcatatggtcgca

SEQ ID NO: 98459 - DNA, 25 bp, E. coli
tcatagaaagagaagcggaattaac

SEQ ID NO: 98460 - DNA, 25 bp, E. coli
tctgccagcttcacgaaagccttat

SEQ ID NO: 98461 - DNA, 25 bp, E. coli
tcatagaaagagtagcggaattaac

SEQ ID NO: 98462 - DNA, 25 bp, E. coli
tctgccagcttctcgaaagccttat

SEQ ID NO: 98463 - DNA, 25 bp, E. coli
gcatagcagggataaataaaaaccg

SEQ ID NO: 98464 - DNA, 25 bp, E. coli
gcatagcagggaaaaataaaaaccg

SEQ ID NO: 98465 - DNA, 25 bp, E. coli
ggaattaacatcatgcatagcaggg

SEQ ID NO: 98466 - DNA, 25 bp, E. coli
ggaattaacatcttgcatagcaggg

SEQ ID NO: 98467 - DNA, 25 bp, E. coli
taaggcagtaaattaagcagcggtt

SEQ ID NO: 98468 - DNA, 25 bp, E. coli
taaggcagtaaaataagcagcggtt

SEQ ID NO: 98469 - DNA, 25 bp, E. coli
acagcgaaatggtccgtacgggcaa

SEQ ID NO: 98470 - DNA, 25 bp, E. coli
acagcgaaatggaccgtacgggcaa

SEQ ID NO: 98471 - DNA, 25 bp, E. coli
aaaagctatgctagtctgacaccgg

SEQ ID NO: 98472 - DNA, 25 bp, E. coli
aaaagctatgcttgtctgacaccgg

SEQ ID NO: 98473 - DNA, 25 bp, E. coli
tataaccagaacttccgcgatgcgg

SEQ ID NO: 98474 - DNA, 25 bp, E. coli
tataagatcatgatgggacgtccgc

SEQ ID NO: 98475 - DNA, 25 bp, E. coli
tataaccagaacatccgcgatgcgg

SEQ ID NO: 98476 - DNA, 25 bp, E. coli
tataagatcatgttgggacgtccgc

SEQ ID NO: 98477 - DNA, 25 bp, E. coli
tggtaaatgcctcaagcccggtcaa

SEQ ID NO: 98478 - DNA, 25 bp, E. coli
tgatttacgaaacgcaggttccggc

SEQ ID NO: 98479 - DNA, 25 bp, E. coli
tgatttacgaaaggcaggttccggc

SEQ ID NO: 98480 - DNA, 25 bp, E. coli
tcgaatatacctggcccgactggga

SEQ ID NO: 98481 - DNA, 25 bp, E. coli
tcgaatatacctcgcccgactggga

SEQ ID NO: 98482 - DNA, 25 bp, E. coli
ccaggccaggttggctataagatca

SEQ ID NO: 98483 - DNA, 25 bp, E. coli
ccaggccaggttcgctataagatca

SEQ ID NO: 98484 - DNA, 25 bp, E. coli
gacagtaacgagttcagcggcaacg

SEQ ID NO: 98485 - DNA, 25 bp, E. coli
gaaaactatcagactgcggcgctgg

SEQ ID NO: 98486 - DNA, 25 bp, E. coli
gacagtaacgagatcagcggcaacg

SEQ ID NO: 98487 - DNA, 25 bp, E. coli
gaaaactatcagtctgcggcgctgg

SEQ ID NO: 98488 - DNA, 25 bp, E. coli
tggtaaatgcctgaagcccggtcaa

SEQ ID NO: 98489 - DNA, 25 bp, E. coli
taatatgagcgtttccctgactggc

SEQ ID NO: 98490 - DNA, 25 bp, E. coli
taatatgagcgtatccctgactggc

SEQ ID NO: 98491 - DNA, 25 bp, E. coli
atcattaacggtcgtgcccggcacg

SEQ ID NO: 98492 - DNA, 25 bp, E. coli
atcattaacggtggtgcccggcacg

SEQ ID NO: 98493 - DNA, 25 bp, E. coli
tttaccgcgcaataggcagtgatag

SEQ ID NO: 98494 - DNA, 25 bp, E. coli
tttaccgcgcaaaaggcagtgatag

SEQ ID NO: 98495 - DNA, 25 bp, E. coli
tgttttaacttaggtggcgctggcg

SEQ ID NO: 98496 - DNA, 25 bp, E. coli
tgatatcgatgccttacccgacggc

SEQ ID NO: 98497 - DNA, 25 bp, E. coli
tgttttaacttacgtggcgctggcg

SEQ ID NO: 98498 - DNA, 25 bp, E. coli
tgtttaacgcgcaacctgggcaggt

SEQ ID NO: 98499 - DNA, 25 bp, E. coli
tgatatcgatgcgttacccgacggc

SEQ ID NO: 98500 - DNA, 25 bp, E. coli
tgtttaacgcgctacctgggcaggt

SEQ ID NO: 98501 - DNA, 25 bp, E. coli
tgctttttaagctcgacccggttcg

SEQ ID NO: 98502 - DNA, 25 bp, E. coli
tgctttttaagcacgacccggttcg

SEQ ID NO: 98503 - DNA, 25 bp, E. coli
gccaggcggttcatatcaggcgcag

SEQ ID NO: 98504 - DNA, 25 bp, E. coli
gccaggcggttcttatcaggcgcag

SEQ ID NO: 98505 - DNA, 25 bp, E. coli
cgacagtatggttaacggcgagcaa

SEQ ID NO: 98506 - DNA, 25 bp, E. coli
cgacagtatggtaaacggcgagcaa

SEQ ID NO: 98507 - DNA, 25 bp, E. coli
ggtgatggtcttgatccccgagcaa

SEQ ID NO: 98508 - DNA, 25 bp, E. coli
ggcaaaactcgctgttacgtctgaa

SEQ ID NO: 98509 - DNA, 25 bp, E. coli
ggtgatggtcttcatccccgagcaa

SEQ ID NO: 98510 - DNA, 25 bp, E. coli
ggcaaaactcgcagttacgtctgaa

SEQ ID NO: 98511 - DNA, 25 bp, E. coli
gacgatgcgcgggaaaatttcctcg

SEQ ID NO: 98512 - DNA, 25 bp, E. coli
gacgatgcgcggcaaaatttcctcg

SEQ ID NO: 98513 - DNA, 25 bp, E. coli
caaactcgaaaatttgacgctccca

SEQ ID NO: 98514 - DNA, 25 bp, E. coli
caaactcgaaaaattgacgctccca

SEQ ID NO: 98515 - DNA, 25 bp, E. coli
cacctcgtggctgattatggacggc

SEQ ID NO: 98516 - DNA, 25 bp, E. coli
cacctcgtggctcattatggacggc

SEQ ID NO: 98517 - DNA, 25 bp, E. coli
tatggacggcgttattggcaaagtg

SEQ ID NO: 98518 - DNA, 25 bp, E. coli
taggctttgctaccagaaattatcc

SEQ ID NO: 98519 - DNA, 25 bp, E. coli
tatggacggcgtaattggcaaagtg

SEQ ID NO: 98520 - DNA, 25 bp, E. coli
taggctttgctagcagaaattatcc

SEQ ID NO: 98521 - DNA, 25 bp, E. coli
tattggcaaagtcgaacaagactca

SEQ ID NO: 98522 - DNA, 25 bp, E. coli
tattggcaaagtggaacaagactca

SEQ ID NO: 98523 - DNA, 25 bp, E. coli
tgtcttattgacatactggtaggct

SEQ ID NO: 98524 - DNA, 25 bp, E. coli
tgtcttattgacttactggtaggct

SEQ ID NO: 98525 - DNA, 25 bp, E. coli
tcccgggtcagctaactcgaaaaat

SEQ ID NO: 98526 - DNA, 25 bp, E. coli
tcccgggtcagcaaactcgaaaaat

SEQ ID NO: 98527 - DNA, 25 bp, E. coli
gctatttagcgcctttgtcttattg

SEQ ID NO: 98528 - DNA, 25 bp, E. coli
gctatttagcgcgtttgtcttattg

SEQ ID NO: 98529 - DNA, 25 bp, E. coli
cgcgcacctcgtcgctgattatgga

SEQ ID NO: 98530 - DNA, 25 bp, E. coli
cgcgcacctcgtggctgattatgga

SEQ ID NO: 98531 - DNA, 25 bp, E. coli
tggaacaagactgactcccgggtca

SEQ ID NO: 98532 - DNA, 25 bp, E. coli
tggaacaagactcactcccgggtca

SEQ ID NO: 98533 - DNA, 25 bp, E. coli
gacgctcccattttttgtgctttcg

SEQ ID NO: 98534 - DNA, 25 bp, E. coli
gacgctcccattatttgtgctttcg

SEQ ID NO: 98535 - DNA, 25 bp, E. coli
cagtttgctgttacatctgtgtggg

SEQ ID NO: 98536 - DNA, 25 bp, E. coli
cagtttgctgtttcatctgtgtggg

SEQ ID NO: 98537 - DNA, 25 bp, E. coli
tacggcgagaaagtaaacgtaacat

SEQ ID NO: 98538 - DNA, 25 bp, E. coli
aaagaacgctgacatttgtgcctcg

SEQ ID NO: 98539 - DNA, 25 bp, E. coli
aaagaacgctgagatttgtgcctcg

SEQ ID NO: 98540 - DNA, 25 bp, E. coli
tacggcgagaaactaaacgtaacat

SEQ ID NO: 98541 - DNA, 25 bp, E. coli
tttgtgcctcgtagatggcgcaggc

SEQ ID NO: 98542 - DNA, 25 bp, E. coli
tttgtgcctcgttgatggcgcaggc

SEQ ID NO: 98543 - DNA, 25 bp, E. coli
ttaaatcagcacagctgctggaagg

SEQ ID NO: 98544 - DNA, 25 bp, E. coli
ttacatctgtgtcggaaaagaacgc

SEQ ID NO: 98545 - DNA, 25 bp, E. coli
ttacatctgtgtgggaaaagaacgc

SEQ ID NO: 98546 - DNA, 25 bp, E. coli
ttaaatcagcactgctgctggaagg

SEQ ID NO: 98547 - DNA, 25 bp, E. coli
tcggttaaatcaccacagctgctgg

SEQ ID NO: 98548 - DNA, 25 bp, E. coli
tctgtgtgggaatagaacgctgaga

SEQ ID NO: 98549 - DNA, 25 bp, E. coli
tcggttaaatcagcacagctgctgg

SEQ ID NO: 98550 - DNA, 25 bp, E. coli
tctgtgtgggaaaagaacgctgaga

SEQ ID NO: 98551 - DNA, 25 bp, E. coli
gcaggacagtttcctgttacatctg

SEQ ID NO: 98552 - DNA, 25 bp, E. coli
gcaggacagtttgctgttacatctg

SEQ ID NO: 98553 - DNA, 25 bp, E. coli
cggcgagaaagtaaacgtaacatga

SEQ ID NO: 98554 - DNA, 25 bp, E. coli
cggcgagaaagttaacgtaacatga

SEQ ID NO: 98555 - DNA, 25 bp, E. coli
gagatttgtgcctcgttgatggcgc

SEQ ID NO: 98556 - DNA, 25 bp, E. coli
gagatttgtgccacgttgatggcgc

SEQ ID NO: 98557 - DNA, 25 bp, E. coli
tgtttcgacgcatcaggcgcttgag

SEQ ID NO: 98558 - DNA, 25 bp, E. coli
tgacccggacactctgctgaaagat

SEQ ID NO: 98559 - DNA, 25 bp, E. coli
tgacccggacacactgctgaaagat

SEQ ID NO: 98560 - DNA, 25 bp, E. coli
tgtttcgacgcaacaggcgcttgag

SEQ ID NO: 98561 - DNA, 25 bp, E. coli
tctgactaacgaagcgatgcccgaa

SEQ ID NO: 98562 - DNA, 25 bp, E. coli
tctgactaacgatgcgatgcccgaa

SEQ ID NO: 98563 - DNA, 25 bp, E. coli
cctgaatgaggagtggcgcacgcta

SEQ ID NO: 98564 - DNA, 25 bp, E. coli
cctgaatgaggactggcgcacgcta

SEQ ID NO: 98565 - DNA, 25 bp, E. coli
gaaaatgcacttttgccgcaggagg

SEQ ID NO: 98566 - DNA, 25 bp, E. coli
gaaagtcagggcctagtctcaaagg

SEQ ID NO: 98567 - DNA, 25 bp, E. coli
gaaaatgcacttatgccgcaggagg

SEQ ID NO: 98568 - DNA, 25 bp, E. coli
gaaagtcagggcgtagtctcaaagg

SEQ ID NO: 98569 - DNA, 25 bp, E. coli
ggtattcgcgcataacaaatctggg

SEQ ID NO: 98570 - DNA, 25 bp, E. coli
ggtattcgcgcaaaacaaatctggg

SEQ ID NO: 98571 - DNA, 25 bp, E. coli
ggaaagtatatccacgcgcacgaca

SEQ ID NO: 98572 - DNA, 25 bp, E. coli
ggaaagtatatcgacgcgcacgaca

SEQ ID NO: 98573 - DNA, 25 bp, E. coli
taatattgcgacaatccgccagcgc

SEQ ID NO: 98574 - DNA, 25 bp, E. coli
taaactggcgggtgttgccccggat

SEQ ID NO: 98575 - DNA, 25 bp, E. coli
taagcctgctcatatcaacaatggg

SEQ ID NO: 98576 - DNA, 25 bp, E. coli
taaactggcgggagttgccccggat

SEQ ID NO: 98577 - DNA, 25 bp, E. coli
taatattgcgactatccgccagcgc

SEQ ID NO: 98578 - DNA, 25 bp, E. coli
taagcctgctcaaatcaacaatggg

SEQ ID NO: 98579 - DNA, 25 bp, E. coli
agagatccccatttcccgctgatgg

SEQ ID NO: 98580 - DNA, 25 bp, E. coli
agattttattgcgaagcgcgcgcca

SEQ ID NO: 98581 - DNA, 25 bp, E. coli
agctcatcggccagcaatgtcgtga

SEQ ID NO: 98582 - DNA, 25 bp, E. coli
agagatccccatatcccgctgatgg

SEQ ID NO: 98583 - DNA, 25 bp, E. coli
agctcatcggcctgcaatgtcgtga

SEQ ID NO: 98584 - DNA, 25 bp, E. coli
agattttattgccaagcgcgcgcca

SEQ ID NO: 98585 - DNA, 25 bp, E. coli
tattcggaagagacactacttggca

SEQ ID NO: 98586 - DNA, 25 bp, E. coli
tattcggaagagtcactacttggca

SEQ ID NO: 98587 - DNA, 25 bp, E. coli
ttggcatcatcgacaccagcgtctg

SEQ ID NO: 98588 - DNA, 25 bp, E. coli
ttggcatcatcgtcaccagcgtctg

SEQ ID NO: 98589 - DNA, 25 bp, E. coli
tgaactgtgagacgaaacagcgtac

SEQ ID NO: 98590 - DNA, 25 bp, E. coli
tgaactgtgagaggaaacagcgtac

SEQ ID NO: 98591 - DNA, 25 bp, E. coli
ccaatactgggccaagggagatttt

SEQ ID NO: 98592 - DNA, 25 bp, E. coli
ccaatactgggcgaagggagatttt

SEQ ID NO: 98593 - DNA, 25 bp, E. coli
gcgtaatatccaacgggacagcccg

SEQ ID NO: 98594 - DNA, 25 bp, E. coli
gcgtaatatccatcgggacagcccg

SEQ ID NO: 98595 - DNA, 25 bp, E. coli
ccggataggccctatggtcagctca

SEQ ID NO: 98596 - DNA, 25 bp, E. coli
cgcgccaattggacagtgggaacct

SEQ ID NO: 98597 - DNA, 25 bp, E. coli
cgcgccaattggtcagtgggaacct

SEQ ID NO: 98598 - DNA, 25 bp, E. coli
ccggataggcccaatggtcagctca

SEQ ID NO: 98599 - DNA, 25 bp, E. coli
gatgctaaaacctgaacctcccaga

SEQ ID NO: 98600 - DNA, 25 bp, E. coli
gatgctaaaaccagaacctcccaga

SEQ ID NO: 98601 - DNA, 25 bp, E. coli
caactggaaggtactaaagcattca

SEQ ID NO: 98602 - DNA, 25 bp, E. coli
caactggaaggttctaaagcattca

SEQ ID NO: 98603 - DNA, 25 bp, E. coli
cagtagtgaccgttgaggttcatca

SEQ ID NO: 98604 - DNA, 25 bp, E. coli
cattcaccaaagtctttctggcccg

SEQ ID NO: 98605 - DNA, 25 bp, E. coli
caggtgctgcactactggaaggttc

SEQ ID NO: 98606 - DNA, 25 bp, E. coli
cagtagtgaccgatgaggttcatca

SEQ ID NO: 98607 - DNA, 25 bp, E. coli
caggtgctgcacaactggaaggttc

SEQ ID NO: 98608 - DNA, 25 bp, E. coli
cattcaccaaagactttctggcccg

SEQ ID NO: 98609 - DNA, 25 bp, E. coli
taacattcccactgcggaataccag

SEQ ID NO: 98610 - DNA, 25 bp, E. coli
actgcgctggaagccgcgctacaga

SEQ ID NO: 98611 - DNA, 25 bp, E. coli
acgctggaagaacctgaagccgccg

SEQ ID NO: 98612 - DNA, 25 bp, E. coli
actgcgctggaacccgcgctacaga

SEQ ID NO: 98613 - DNA, 25 bp, E. coli
acgctggaagaagctgaagccgccg

SEQ ID NO: 98614 - DNA, 25 bp, E. coli
tgaagccgccgtccgcgacatgctg

SEQ ID NO: 98615 - DNA, 25 bp, E. coli
tgaagccgccgtgcgcgacatgctg

SEQ ID NO: 98616 - DNA, 25 bp, E. coli
gctgcacaactggaaggttctaaag

SEQ ID NO: 98617 - DNA, 25 bp, E. coli
gctgcacaactgcaaggttctaaag

SEQ ID NO: 98618 - DNA, 25 bp, E. coli
ccctgcgccagtagtgaccgatgag

SEQ ID NO: 98619 - DNA, 25 bp, E. coli
ccctgcgccagttgtgaccgatgag

SEQ ID NO: 98620 - DNA, 25 bp, E. coli
ggttctaaagcattcaccaaagact

SEQ ID NO: 98621 - DNA, 25 bp, E. coli
ggttctaaagcaatcaccaaagact

SEQ ID NO: 98622 - DNA, 25 bp, E. coli
taacattcccacagcggaataccag

SEQ ID NO: 98623 - DNA, 25 bp, E. coli
aaccgatggcaatccgctgcctgcg

SEQ ID NO: 98624 - DNA, 25 bp, E. coli
caccggaggaagacacatcatagtg

SEQ ID NO: 98625 - DNA, 25 bp, E. coli
caccggaggaagtcacatcatagtg

SEQ ID NO: 98626 - DNA, 25 bp, E. coli
caggtgagtcaggtggaaccgctta

SEQ ID NO: 98627 - DNA, 25 bp, E. coli
caggtgagtcagctggaaccgctta

SEQ ID NO: 98628 - DNA, 25 bp, E. coli
tacaggtgagtctggtggaaccgct

SEQ ID NO: 98629 - DNA, 25 bp, E. coli
tacaggtgagtcaggtggaaccgct

SEQ ID NO: 98630 - DNA, 25 bp, E. coli
accgcataacacgtctagttatcag

SEQ ID NO: 98631 - DNA, 25 bp, E. coli
accgcataacacctctagttatcag

SEQ ID NO: 98632 - DNA, 25 bp, E. coli
aaccgatggcaaaccgctgcctgcg

SEQ ID NO: 98633 - DNA, 25 bp, E. coli
tgagttcaccgcttaacacctctag

SEQ ID NO: 98634 - DNA, 25 bp, E. coli
tgagttcaccgcataacacctctag

SEQ ID NO: 98635 - DNA, 25 bp, E. coli
tcaggtggaaccccttaccgaacag

SEQ ID NO: 98636 - DNA, 25 bp, E. coli
tcaggtggaaccgcttaccgaacag

SEQ ID NO: 98637 - DNA, 25 bp, E. coli
cgctgcctgcgtacaccggaggaag

SEQ ID NO: 98638 - DNA, 25 bp, E. coli
cgctgcctgcgttcaccggaggaag

SEQ ID NO: 98639 - DNA, 25 bp, E. coli
gttcaccggaggaagtcacatcata

SEQ ID NO: 98640 - DNA, 25 bp, E. coli
gttcaccggaggtagtcacatcata

SEQ ID NO: 98641 - DNA, 25 bp, E. coli
gttcaccgcatatcacctctagtta

SEQ ID NO: 98642 - DNA, 25 bp, E. coli
gttcaccgcataacacctctagtta

SEQ ID NO: 98643 - DNA, 25 bp, E. coli
gagtcaggtggaaccgcttaccgaa

SEQ ID NO: 98644 - DNA, 25 bp, E. coli
gagtcaggtggatccgcttaccgaa

SEQ ID NO: 98645 - DNA, 25 bp, E. coli
cagaaaaggtacaccggtctgttga

SEQ ID NO: 98646 - DNA, 25 bp, E. coli
cagaaaaggtactccggtctgttga

SEQ ID NO: 98647 - DNA, 25 bp, E. coli
tacagaagcacaacgggagtggttg

SEQ ID NO: 98648 - DNA, 25 bp, E. coli
tacagaagcacatcgggagtggttg

SEQ ID NO: 98649 - DNA, 25 bp, E. coli
tattcagaaaagctacaccggtctg

SEQ ID NO: 98650 - DNA, 25 bp, E. coli
tattcagaaaaggtacaccggtctg

SEQ ID NO: 98651 - DNA, 25 bp, E. coli
ttgttgcgccggtattattgtctgg

SEQ ID NO: 98652 - DNA, 25 bp, E. coli
ttgttgcgccggaattattgtctgg

SEQ ID NO: 98653 - DNA, 25 bp, E. coli
tgggaaatgttgtatgtacagaagc

SEQ ID NO: 98654 - DNA, 25 bp, E. coli
tgggaaatgttgaatgtacagaagc

SEQ ID NO: 98655 - DNA, 25 bp, E. coli
tgtctggcgcagatatcgtccccgc

SEQ ID NO: 98656 - DNA, 25 bp, E. coli
tgtctggcgcagttatcgtccccgc

SEQ ID NO: 98657 - DNA, 25 bp, E. coli
gaatgtacagaagcacaacgggagt

SEQ ID NO: 98658 - DNA, 25 bp, E. coli
gaatgtacagaaccacaacgggagt

SEQ ID NO: 98659 - DNA, 25 bp, E. coli
ccgctggcttttagttatgggaaat

SEQ ID NO: 98660 - DNA, 25 bp, E. coli
cgccggaattatagtctggcgcaga

SEQ ID NO: 98661 - DNA, 25 bp, E. coli
cgccggaattattgtctggcgcaga

SEQ ID NO: 98662 - DNA, 25 bp, E. coli
ccgctggctttttgttatgggaaat

SEQ ID NO: 98663 - DNA, 25 bp, E. coli
ctgcagatgccacgctgaggcgaat

SEQ ID NO: 98664 - DNA, 25 bp, E. coli
ctgcagatgccaggctgaggcgaat

SEQ ID NO: 98665 - DNA, 25 bp, E. coli
tggcgaaagctggagatgccacgct

SEQ ID NO: 98666 - DNA, 25 bp, E. coli
tggcgaaagctgcagatgccacgct

SEQ ID NO: 98667 - DNA, 25 bp, E. coli
aatgattggtggcattgaccgcccc

SEQ ID NO: 98668 - DNA, 25 bp, E. coli
aatgattggtgggattgaccgcccc

SEQ ID NO: 98669 - DNA, 25 bp, E. coli
cagtcggccttggaggtggatttca

SEQ ID NO: 98670 - DNA, 25 bp, E. coli
cagtcggccttgcaggtggatttca

SEQ ID NO: 98671 - DNA, 25 bp, E. coli
ttgaccgccccgtcagtggaaagat

SEQ ID NO: 98672 - DNA, 25 bp, E. coli
tactcatcaggtttgcgatcgcgtt

SEQ ID NO: 98673 - DNA, 25 bp, E. coli
ttgaccgccccgacagtggaaagat

SEQ ID NO: 98674 - DNA, 25 bp, E. coli
taaaacaatatcatggccagtcggc

SEQ ID NO: 98675 - DNA, 25 bp, E. coli
tactcatcaggtatgcgatcgcgtt

SEQ ID NO: 98676 - DNA, 25 bp, E. coli
taaaacaatatcttggccagtcggc

SEQ ID NO: 98677 - DNA, 25 bp, E. coli
tacgcgaagcaacaagaactgaaag

SEQ ID NO: 98678 - DNA, 25 bp, E. coli
tacgcgaagcaagaagaactgaaag

SEQ ID NO: 98679 - DNA, 25 bp, E. coli
tatatcgtcgatcaagtaacggcgg

SEQ ID NO: 98680 - DNA, 25 bp, E. coli
tatatcgtcgatgaagtaacggcgg

SEQ ID NO: 98681 - DNA, 25 bp, E. coli
cctttattggtcctaatggtgcggg

SEQ ID NO: 98682 - DNA, 25 bp, E. coli
cctttattggtcgtaatggtgcggg

SEQ ID NO: 98683 - DNA, 25 bp, E. coli
gcacgccaacggctcgacattatgt

SEQ ID NO: 98684 - DNA, 25 bp, E. coli
gcacgccaacgggtcgacattatgt

SEQ ID NO: 98685 - DNA, 25 bp, E. coli
gatgtggcgctaatcatacctagag

SEQ ID NO: 98686 - DNA, 25 bp, E. coli
gacgaagtcatatcgcacgccaacg

SEQ ID NO: 98687 - DNA, 25 bp, E. coli
gatgtggcgctattcatacctagag

SEQ ID NO: 98688 - DNA, 25 bp, E. coli
gacgaagtcataacgcacgccaacg

SEQ ID NO: 98689 - DNA, 25 bp, E. coli
caacgattactgtacagcagggcgg

SEQ ID NO: 98690 - DNA, 25 bp, E. coli
caattgtgagattaatcagggcggc

SEQ ID NO: 98691 - DNA, 25 bp, E. coli
caattgtgagataaatcagggcggc

SEQ ID NO: 98692 - DNA, 25 bp, E. coli
caacgattactgaacagcagggcgg

SEQ ID NO: 98693 - DNA, 25 bp, E. coli
cacagatattgttcagtccgaggga

SEQ ID NO: 98694 - DNA, 25 bp, E. coli
cacagatattgtacagtccgaggga

SEQ ID NO: 98695 - DNA, 25 bp, E. coli
tacggtaacaatcgcacgctatcgg

SEQ ID NO: 98696 - DNA, 25 bp, E. coli
tacggtaacaatggcacgctatcgg

SEQ ID NO: 98697 - DNA, 25 bp, E. coli
aagagccgaaaaaaccgtggtcacg

SEQ ID NO: 98698 - DNA, 25 bp, E. coli
aagagccgaaaataccgtggtcacg

SEQ ID NO: 98699 - DNA, 25 bp, E. coli
tttgtcgtagagcaagatcgcgcac

SEQ ID NO: 98700 - DNA, 25 bp, E. coli
tttgtcgtagaggaagatcgcgcac

SEQ ID NO: 98701 - DNA, 25 bp, E. coli
ttaatggccgccatcccgaaggtga

SEQ ID NO: 98702 - DNA, 25 bp, E. coli
ttaatggccgccttcccgaaggtga

SEQ ID NO: 98703 - DNA, 25 bp, E. coli
tgcaaattgttaagaccggcgaggt

SEQ ID NO: 98704 - DNA, 25 bp, E. coli
tgcaaattgttatgaccggcgaggt

SEQ ID NO: 98705 - DNA, 25 bp, E. coli
tctacgctcgcttcggttaatggcc

SEQ ID NO: 98706 - DNA, 25 bp, E. coli
tctacgctcgctacggttaatggcc

SEQ ID NO: 98707 - DNA, 25 bp, E. coli
taatctcggtggagaagactctgac

SEQ ID NO: 98708 - DNA, 25 bp, E. coli
taatctcggtggtgaagactctgac

SEQ ID NO: 98709 - DNA, 25 bp, E. coli
cgaaaaacttgatgagcgacgggaa

SEQ ID NO: 98710 - DNA, 25 bp, E. coli
cgaaaaacttgaagagcgacgggaa

SEQ ID NO: 98711 - DNA, 25 bp, E. coli
aagcgattctcgttgctgccgcgca

SEQ ID NO: 98712 - DNA, 25 bp, E. coli
aagcgattctcgatgctgccgcgca

SEQ ID NO: 98713 - DNA, 25 bp, E. coli
caactgggtctggatatctgtgcga

SEQ ID NO: 98714 - DNA, 25 bp, E. coli
caactgggtctgcatatctgtgcga

SEQ ID NO: 98715 - DNA, 25 bp, E. coli
taaaacttgagcttaccggtctgga

SEQ ID NO: 98716 - DNA, 25 bp, E. coli
tatgcgccagcaatatcacgacgta

SEQ ID NO: 98717 - DNA, 25 bp, E. coli
tatgcgccagcattatcacgacgta

SEQ ID NO: 98718 - DNA, 25 bp, E. coli
tgtgcgatgaccaccgagatgggac

SEQ ID NO: 98719 - DNA, 25 bp, E. coli
tgtgcgatgacctccgagatgggac

SEQ ID NO: 98720 - DNA, 25 bp, E. coli
tgcctggcaggaggtagataccgtt

SEQ ID NO: 98721 - DNA, 25 bp, E. coli
tgcctggcaggacgtagataccgtt

SEQ ID NO: 98722 - DNA, 25 bp, E. coli
tcttgaggcactcaaagccagcggt

SEQ ID NO: 98723 - DNA, 25 bp, E. coli
tcttgaggcactgaaagccagcggt

SEQ ID NO: 98724 - DNA, 25 bp, E. coli
gcgtgccgtactccgtgaagatacc

SEQ ID NO: 98725 - DNA, 25 bp, E. coli
gcgtgccgtactgcgtgaagatacc

SEQ ID NO: 98726 - DNA, 25 bp, E. coli
gcaaaagctggtccctgaaacatgg

SEQ ID NO: 98727 - DNA, 25 bp, E. coli
gcaaaagctggtgcctgaaacatgg

SEQ ID NO: 98728 - DNA, 25 bp, E. coli
gatatggacggctcgttgctcgacc

SEQ ID NO: 98729 - DNA, 25 bp, E. coli
gatatggacggcacgttgctcgacc

SEQ ID NO: 98730 - DNA, 25 bp, E. coli
taaaacttgagcataccggtctgga

SEQ ID NO: 98731 - DNA, 25 bp, E. coli
gagaaacagtatcaacgccatccgt

SEQ ID NO: 98732 - DNA, 25 bp, E. coli
gagaaacagtatgaacgccatccgt

SEQ ID NO: 98733 - DNA, 25 bp, E. coli
catggctgctttacgcatcttacgt

SEQ ID NO: 98734 - DNA, 25 bp, E. coli
catggctgcttttcgcatcttacgt

SEQ ID NO: 98735 - DNA, 25 bp, E. coli
catcttacgtcttaaccctgccttg

SEQ ID NO: 98736 - DNA, 25 bp, E. coli
catcttacgtctaaaccctgccttg

SEQ ID NO: 98737 - DNA, 25 bp, E. coli
tacgtcttaaccctgccttgaatac

SEQ ID NO: 98738 - DNA, 25 bp, E. coli
tacgtcttaaccgtgccttgaatac

SEQ ID NO: 98739 - DNA, 25 bp, E. coli
tgtgccgtatccgtgaaaataattc

SEQ ID NO: 98740 - DNA, 25 bp, E. coli
tgtgccgtatccctgaaaataattc

SEQ ID NO: 98741 - DNA, 25 bp, E. coli
tgccgtatccctcaaaataattctg

SEQ ID NO: 98742 - DNA, 25 bp, E. coli
tgccgtatccctgaaaataattctg

SEQ ID NO: 98743 - DNA, 25 bp, E. coli
tcttacgtcttaaccctgccttgaa

SEQ ID NO: 98744 - DNA, 25 bp, E. coli
tcttacgtcttatccctgccttgaa

SEQ ID NO: 98745 - DNA, 25 bp, E. coli
ccatggctgcttttcgcatcttacg

SEQ ID NO: 98746 - DNA, 25 bp, E. coli
gccgtatccctgaaaataattctgc

SEQ ID NO: 98747 - DNA, 25 bp, E. coli
ccatggctgcttatcgcatcttacg

SEQ ID NO: 98748 - DNA, 25 bp, E. coli
gccgtatccctgtaaataattctgc

SEQ ID NO: 98749 - DNA, 25 bp, E. coli
gcttttcgcatcttacgtcttaacc

SEQ ID NO: 98750 - DNA, 25 bp, E. coli
gcttttcgcatcatacgtcttaacc

SEQ ID NO: 98751 - DNA, 25 bp, E. coli
gctgcttttcgcttcttacgtctta

SEQ ID NO: 98752 - DNA, 25 bp, E. coli
gctgcttttcgcatcttacgtctta

SEQ ID NO: 98753 - DNA, 25 bp, E. coli
tttcgcatcttaggtcttaaccctg

SEQ ID NO: 98754 - DNA, 25 bp, E. coli
tttcgcatcttacgtcttaaccctg

SEQ ID NO: 98755 - DNA, 25 bp, E. coli
aatccacatttctgacgaggcgctg

SEQ ID NO: 98756 - DNA, 25 bp, E. coli
aatccacatttcagacgaggcgctg

SEQ ID NO: 98757 - DNA, 25 bp, E. coli
taaaactgccatggttgaaggtctg

SEQ ID NO: 98758 - DNA, 25 bp, E. coli
aaatcgctattgaacaggctcgccg

SEQ ID NO: 98759 - DNA, 25 bp, E. coli
aaatcgctattgtacaggctcgccg

SEQ ID NO: 98760 - DNA, 25 bp, E. coli
tctgcgtggcctgaaagaacgttac

SEQ ID NO: 98761 - DNA, 25 bp, E. coli
tctgcgtggcctcaaagaacgttac

SEQ ID NO: 98762 - DNA, 25 bp, E. coli
ccagaaagtgttagttgccgagcct

SEQ ID NO: 98763 - DNA, 25 bp, E. coli
ccagaaagtgtttgttgccgagcct

SEQ ID NO: 98764 - DNA, 25 bp, E. coli
gaattacataccatggtcggcgcgg

SEQ ID NO: 98765 - DNA, 25 bp, E. coli
gaattacataccttggtcggcgcgg

SEQ ID NO: 98766 - DNA, 25 bp, E. coli
gaactggaaaaggaactggaagccg

SEQ ID NO: 98767 - DNA, 25 bp, E. coli
gaaaaagatgctccgctggaacgtc

SEQ ID NO: 98768 - DNA, 25 bp, E. coli
gaactggaaaagcaactggaagccg

SEQ ID NO: 98769 - DNA, 25 bp, E. coli
gaaaaagatgctgcgctggaacgtc

SEQ ID NO: 98770 - DNA, 25 bp, E. coli
cggatgtctgaactgcaatacggca

SEQ ID NO: 98771 - DNA, 25 bp, E. coli
cggatgtctgaagtgcaatacggca

SEQ ID NO: 98772 - DNA, 25 bp, E. coli
tggacgccggaatcatgctgaaacc

SEQ ID NO: 98773 - DNA, 25 bp, E. coli
tggtaagccataacttccgtccgga

SEQ ID NO: 98774 - DNA, 25 bp, E. coli
tggtaagccatatcttccgtccgga

SEQ ID NO: 98775 - DNA, 25 bp, E. coli
tggacgccggaaacatgctgaaacc

SEQ ID NO: 98776 - DNA, 25 bp, E. coli
taaaactgccatcgttgaaggtctg

SEQ ID NO: 98777 - DNA, 25 bp, E. coli
aacaaagcggctcgaagagtctgtc

SEQ ID NO: 98778 - DNA, 25 bp, E. coli
acagggtcacgtttcttaatcagag

SEQ ID NO: 98779 - DNA, 25 bp, E. coli
aacaaagcggctggaagagtctgtc

SEQ ID NO: 98780 - DNA, 25 bp, E. coli
acagggtcacgtatcttaatcagag

SEQ ID NO: 98781 - DNA, 25 bp, E. coli
tagtaacatatggacagaccgcgcg

SEQ ID NO: 98782 - DNA, 25 bp, E. coli
tagtaacatatgcacagaccgcgcg

SEQ ID NO: 98783 - DNA, 25 bp, E. coli
tattcgcatttggtatccgtatggc

SEQ ID NO: 98784 - DNA, 25 bp, E. coli
tattcgcatttgctatccgtatggc

SEQ ID NO: 98785 - DNA, 25 bp, E. coli
ttctggagctgaggtggatgacccc

SEQ ID NO: 98786 - DNA, 25 bp, E. coli
ttctggagctgacgtggatgacccc

SEQ ID NO: 98787 - DNA, 25 bp, E. coli
ttttgcctggagtgacatcgtctta

SEQ ID NO: 98788 - DNA, 25 bp, E. coli
ttttgcctggagagacatcgtctta

SEQ ID NO: 98789 - DNA, 25 bp, E. coli
ccttttcttctggtggcgggcagat

SEQ ID NO: 98790 - DNA, 25 bp, E. coli
ccttttcttctgctggcgggcagat

SEQ ID NO: 98791 - DNA, 25 bp, E. coli
cgtcttatgttgcaccgtatcggta

SEQ ID NO: 98792 - DNA, 25 bp, E. coli
cgtcttatgttggaccgtatcggta

SEQ ID NO: 98793 - DNA, 25 bp, E. coli
tggatgaccccgatctacatgagaa

SEQ ID NO: 98794 - DNA, 25 bp, E. coli
tggatgaccccgttctacatgagaa

SEQ ID NO: 98795 - DNA, 25 bp, E. coli
gaccgcgcgtgaagatactgaatga

SEQ ID NO: 98796 - DNA, 25 bp, E. coli
gagtctgtcagcttaccttaaggtt

SEQ ID NO: 98797 - DNA, 25 bp, E. coli
gaccgcgcgtgatgatactgaatga

SEQ ID NO: 98798 - DNA, 25 bp, E. coli
gagtctgtcagcataccttaaggtt

SEQ ID NO: 98799 - DNA, 25 bp, E. coli
aatatgatggccctgccgtttcacg

SEQ ID NO: 98800 - DNA, 25 bp, E. coli
aatatgatggccgtgccgtttcacg

SEQ ID NO: 98801 - DNA, 25 bp, E. coli
catccggtatcaggaagagtgcgac

SEQ ID NO: 98802 - DNA, 25 bp, E. coli
catccggtatcacgaagagtgcgac

SEQ ID NO: 98803 - DNA, 25 bp, E. coli
tacgttcccatgtaacctgtcgttg

SEQ ID NO: 98804 - DNA, 25 bp, E. coli
tacgttcccatgaaacctgtcgttg

SEQ ID NO: 98805 - DNA, 25 bp, E. coli
taaagccgcgcaagtatcaaaaatc

SEQ ID NO: 98806 - DNA, 25 bp, E. coli
taaagccgcgcatgtatcaaaaatc

SEQ ID NO: 98807 - DNA, 25 bp, E. coli
acttcgaaaacttgccggctggcta

SEQ ID NO: 98808 - DNA, 25 bp, E. coli
acttcgaaaactagccggctggcta

SEQ ID NO: 98809 - DNA, 25 bp, E. coli
tgagtggaaacacgttaaagccgcg

SEQ ID NO: 98810 - DNA, 25 bp, E. coli
tgagtggaaacaggttaaagccgcg

SEQ ID NO: 98811 - DNA, 25 bp, E. coli
tgatggaagaactcaaccaggcttg

SEQ ID NO: 98812 - DNA, 25 bp, E. coli
tgatggaagaacacaaccaggcttg

SEQ ID NO: 98813 - DNA, 25 bp, E. coli
tctttacgagtagtggacgaagggt

SEQ ID NO: 98814 - DNA, 25 bp, E. coli
tctttacgagtactggacgaagggt

SEQ ID NO: 98815 - DNA, 25 bp, E. coli
ccagtgtgtttgctaccgggctgaa

SEQ ID NO: 98816 - DNA, 25 bp, E. coli
ccagtgtgtttggtaccgggctgaa

SEQ ID NO: 98817 - DNA, 25 bp, E. coli
cgaaatccgcgataaggtcatccgg

SEQ ID NO: 98818 - DNA, 25 bp, E. coli
cgaaatccgcgaaaaggtcatccgg

SEQ ID NO: 98819 - DNA, 25 bp, E. coli
cgttaatccccgaaaaatgagcgtg

SEQ ID NO: 98820 - DNA, 25 bp, E. coli
cgttaatccccgtaaaatgagcgtg

SEQ ID NO: 98821 - DNA, 25 bp, E. coli
aatcatcagcgagcaggcagcattg

SEQ ID NO: 98822 - DNA, 25 bp, E. coli
aatcatcagcgaccaggcagcattg

SEQ ID NO: 98823 - DNA, 25 bp, E. coli
agacggaatcatcagcgaccaggca

SEQ ID NO: 98824 - DNA, 25 bp, E. coli
agagacggaatcatcagcgaccagg

SEQ ID NO: 98825 - DNA, 25 bp, E. coli
acggaatcatcagcgaccaggcagc

SEQ ID NO: 98826 - DNA, 25 bp, E. coli
atcatcagcgaccaggcagcattga

SEQ ID NO: 98827 - DNA, 25 bp, E. coli
agacggaatcatgagcgaccaggca

SEQ ID NO: 98828 - DNA, 25 bp, E. coli
atcatcagcgacgaggcagcattga

SEQ ID NO: 98829 - DNA, 25 bp, E. coli
agagacggaatcttcagcgaccagg

SEQ ID NO: 98830 - DNA, 25 bp, E. coli
acggaatcatcaccgaccaggcagc

SEQ ID NO: 98831 - DNA, 25 bp, E. coli
tatcagagacggtatcatcagcgac

SEQ ID NO: 98832 - DNA, 25 bp, E. coli
tatcagagacggaatcatcagcgac

SEQ ID NO: 98833 - DNA, 25 bp, E. coli
tctcggtatcagtgacggaatcatc

SEQ ID NO: 98834 - DNA, 25 bp, E. coli
tcagagacggaaacatcagcgacca

SEQ ID NO: 98835 - DNA, 25 bp, E. coli
tcagagacggaatcatcagcgacca

SEQ ID NO: 98836 - DNA, 25 bp, E. coli
tcggtatcagagacggaatcatcag

SEQ ID NO: 98837 - DNA, 25 bp, E. coli
tctcggtatcagagacggaatcatc

SEQ ID NO: 98838 - DNA, 25 bp, E. coli
tcggtatcagagtcggaatcatcag

SEQ ID NO: 98839 - DNA, 25 bp, E. coli
cggtatcagagagggaatcatcagc

SEQ ID NO: 98840 - DNA, 25 bp, E. coli
cggtatcagagacggaatcatcagc

SEQ ID NO: 98841 - DNA, 25 bp, E. coli
ggaatcatcagcgaccaggcagcat

SEQ ID NO: 98842 - DNA, 25 bp, E. coli
ggaatcatcagccaccaggcagcat

SEQ ID NO: 98843 - DNA, 25 bp, E. coli
aatgagcgattttttacagtattca

SEQ ID NO: 98844 - DNA, 25 bp, E. coli
aatgagcgatttattacagtattca

SEQ ID NO: 98845 - DNA, 25 bp, E. coli
aatcgtagcaaagcaacacccaggt

SEQ ID NO: 98846 - DNA, 25 bp, E. coli
aatcgtagcaaaccaacacccaggt

SEQ ID NO: 98847 - DNA, 25 bp, E. coli
acagtattcatacgtggtttagtca

SEQ ID NO: 98848 - DNA, 25 bp, E. coli
acagtattcataggtggtttagtca

SEQ ID NO: 98849 - DNA, 25 bp, E. coli
acacccaggtatgctttttaagaca

SEQ ID NO: 98850 - DNA, 25 bp, E. coli
acacccaggtatcctttttaagaca

SEQ ID NO: 98851 - DNA, 25 bp, E. coli
tgtgttcaggagaaatgattatggc

SEQ ID NO: 98852 - DNA, 25 bp, E. coli
tgtgttcaggagtaatgattatggc

SEQ ID NO: 98853 - DNA, 25 bp, E. coli
tcgagacataaataatgagcgattt

SEQ ID NO: 98854 - DNA, 25 bp, E. coli
tcgagacataaaaaatgagcgattt

SEQ ID NO: 98855 - DNA, 25 bp, E. coli
tcggcaatgtattatgctcgggcga

SEQ ID NO: 98856 - DNA, 25 bp, E. coli
tcggcaatgtataatgctcgggcga

SEQ ID NO: 98857 - DNA, 25 bp, E. coli
gctttttaagactaatcggcaatgt

SEQ ID NO: 98858 - DNA, 25 bp, E. coli
gctcgggcgaataaatattgtgttc

SEQ ID NO: 98859 - DNA, 25 bp, E. coli
gctttttaagacaaatcggcaatgt

SEQ ID NO: 98860 - DNA, 25 bp, E. coli
gctcgggcgaattaatattgtgttc

SEQ ID NO: 98861 - DNA, 25 bp, E. coli
gggtaaaagcccaatatcgagacat

SEQ ID NO: 98862 - DNA, 25 bp, E. coli
ggtggtttagtcataatcgtagcaa

SEQ ID NO: 98863 - DNA, 25 bp, E. coli
gggtaaaagccctatatcgagacat

SEQ ID NO: 98864 - DNA, 25 bp, E. coli
ggtggtttagtcttaatcgtagcaa

SEQ ID NO: 98865 - DNA, 25 bp, E. coli
cagcacagccgaatgctgtggtgag

SEQ ID NO: 98866 - DNA, 25 bp, E. coli
cagtgacgatgcttattacgcgacc

SEQ ID NO: 98867 - DNA, 25 bp, E. coli
cagtgacgatgcatattacgcgacc

SEQ ID NO: 98868 - DNA, 25 bp, E. coli
cagcacagccgattgctgtggtgag

SEQ ID NO: 98869 - DNA, 25 bp, E. coli
aggaattaaagcttgggattatgtc

SEQ ID NO: 98870 - DNA, 25 bp, E. coli
agggaggaattatagcatgggatta

SEQ ID NO: 98871 - DNA, 25 bp, E. coli
atattacgcgaccttaccctggcaa

SEQ ID NO: 98872 - DNA, 25 bp, E. coli
agggaggaattaaagcatgggatta

SEQ ID NO: 98873 - DNA, 25 bp, E. coli
atattacgcgacgttaccctggcaa

SEQ ID NO: 98874 - DNA, 25 bp, E. coli
aggaattaaagcatgggattatgtc

SEQ ID NO: 98875 - DNA, 25 bp, E. coli
taccctggcaacgactggctgacta

SEQ ID NO: 98876 - DNA, 25 bp, E. coli
taccctggcaaccactggctgacta

SEQ ID NO: 98877 - DNA, 25 bp, E. coli
tgcatattacgcgaccttaccctgg

SEQ ID NO: 98878 - DNA, 25 bp, E. coli
tgcatattacgccaccttaccctgg

SEQ ID NO: 98879 - DNA, 25 bp, E. coli
tgccagtgacgatgcatattacgcg

SEQ ID NO: 98880 - DNA, 25 bp, E. coli
tgccagtgacgaagcatattacgcg

SEQ ID NO: 98881 - DNA, 25 bp, E. coli
gacgatgcatattacgcgaccttac

SEQ ID NO: 98882 - DNA, 25 bp, E. coli
gacgatgcatataacgcgaccttac

SEQ ID NO: 98883 - DNA, 25 bp, E. coli
ccgaatgctgtggtgagggaggaat

SEQ ID NO: 98884 - DNA, 25 bp, E. coli
ccgaatgctgtgctgagggaggaat

SEQ ID NO: 98885 - DNA, 25 bp, E. coli
ggctgactacccgacatgcccggaa

SEQ ID NO: 98886 - DNA, 25 bp, E. coli
ggctgactaccccacatgcccggaa

SEQ ID NO: 98887 - DNA, 25 bp, E. coli
tacccgcgaaacacagactaactat

SEQ ID NO: 98888 - DNA, 25 bp, E. coli
tacccgcgaaactcagactaactat

SEQ ID NO: 98889 - DNA, 25 bp, E. coli
tacgcctgtggcacaggcactcgct

SEQ ID NO: 98890 - DNA, 25 bp, E. coli
tacgcctgtggctcaggcactcgct

SEQ ID NO: 98891 - DNA, 25 bp, E. coli
taccggcgctatcggtcatgatctc

SEQ ID NO: 98892 - DNA, 25 bp, E. coli
taccggcgctatgggtcatgatctc

SEQ ID NO: 98893 - DNA, 25 bp, E. coli
tattcgcaatatggtaagaaacgtg

SEQ ID NO: 98894 - DNA, 25 bp, E. coli
tatttctgttggtgcgggcgcacgg

SEQ ID NO: 98895 - DNA, 25 bp, E. coli
tatttctgttggagcgggcgcacgg

SEQ ID NO: 98896 - DNA, 25 bp, E. coli
tattcgcaatatcgtaagaaacgtg

SEQ ID NO: 98897 - DNA, 25 bp, E. coli
tgtattggtatttcgcctgtggcac

SEQ ID NO: 98898 - DNA, 25 bp, E. coli
tgtattggtattacgcctgtggcac

SEQ ID NO: 98899 - DNA, 25 bp, E. coli
gcgctatcggtcatgatctcagtac

SEQ ID NO: 98900 - DNA, 25 bp, E. coli
gcgctatcggtcttgatctcagtac

SEQ ID NO: 98901 - DNA, 25 bp, E. coli
ccccgcatggcacatgattggcggc

SEQ ID NO: 98902 - DNA, 25 bp, E. coli
cgaaacacagactaactatggcgtt

SEQ ID NO: 98903 - DNA, 25 bp, E. coli
ccccgcatggcagatgattggcggc

SEQ ID NO: 98904 - DNA, 25 bp, E. coli
cgaaacacagacaaactatggcgtt

SEQ ID NO: 98905 - DNA, 25 bp, E. coli
tggataaacgccagctacttaccgc

SEQ ID NO: 98906 - DNA, 25 bp, E. coli
tggtaagaaacgagtcgaaggctac

SEQ ID NO: 98907 - DNA, 25 bp, E. coli
tggataaacgcctgctacttaccgc

SEQ ID NO: 98908 - DNA, 25 bp, E. coli
tggtaagaaacgtgtcgaaggctac

SEQ ID NO: 98909 - DNA, 25 bp, E. coli
cataatcacgatcaggagcacagcc

SEQ ID NO: 98910 - DNA, 25 bp, E. coli
cataatcacgatgaggagcacagcc

SEQ ID NO: 98911 - DNA, 25 bp, E. coli
aaagcctgctgggatctcggcaatc

SEQ ID NO: 98912 - DNA, 25 bp, E. coli
aaagcctgctggcatctcggcaatc

SEQ ID NO: 98913 - DNA, 25 bp, E. coli
aaataatgcccgcagagctgcgcta

SEQ ID NO: 98914 - DNA, 25 bp, E. coli
aaataatgcccggagagctgcgcta

SEQ ID NO: 98915 - DNA, 25 bp, E. coli
tttgcacatcttgcgtttgagccgg

SEQ ID NO: 98916 - DNA, 25 bp, E. coli
tttgcacatcttccgtttgagccgg

SEQ ID NO: 98917 - DNA, 25 bp, E. coli
gcgttaccctccgtgttgacatgcg

SEQ ID NO: 98918 - DNA, 25 bp, E. coli
gcgttaccctccctgttgacatgcg

SEQ ID NO: 98919 - DNA, 25 bp, E. coli
gaattcattaagctgatcgccgctg

SEQ ID NO: 98920 - DNA, 25 bp, E. coli
gcagatccttttttgctcgcgaaag

SEQ ID NO: 98921 - DNA, 25 bp, E. coli
gcagatccttttatgctcgcgaaag

SEQ ID NO: 98922 - DNA, 25 bp, E. coli
gaattcattaaggtgatcgccgctg

SEQ ID NO: 98923 - DNA, 25 bp, E. coli
gaagccgtttctctagtgcgctgcg

SEQ ID NO: 98924 - DNA, 25 bp, E. coli
gaagccgtttctgtagtgcgctgcg

SEQ ID NO: 98925 - DNA, 25 bp, E. coli
cgtcctcgatgatatgctgcgccag

SEQ ID NO: 98926 - DNA, 25 bp, E. coli
ctgctgctgcgcgatggtgatattc

SEQ ID NO: 98927 - DNA, 25 bp, E. coli
cgtcctcgatgaaatgctgcgccag

SEQ ID NO: 98928 - DNA, 25 bp, E. coli
ctgctgctgcgccatggtgatattc

SEQ ID NO: 98929 - DNA, 25 bp, E. coli
taacgatggacgacaggctggactg

SEQ ID NO: 98930 - DNA, 25 bp, E. coli
taacgatggacgtcaggctggactg

SEQ ID NO: 98931 - DNA, 25 bp, E. coli
caattaccgactgcggcgaatcgtt

SEQ ID NO: 98932 - DNA, 25 bp, E. coli
caattaccgactccggcgaatcgtt

SEQ ID NO: 98933 - DNA, 25 bp, E. coli
accgcacagctactggcagataacc

SEQ ID NO: 98934 - DNA, 25 bp, E. coli
accgcacagctagtggcagataacc

SEQ ID NO: 98935 - DNA, 25 bp, E. coli
tttactgacgaagggcagatcgttt

SEQ ID NO: 98936 - DNA, 25 bp, E. coli
ttattcaggtaagtggcaaacgcgg

SEQ ID NO: 98937 - DNA, 25 bp, E. coli
tttactgacgaacggcagatcgttt

SEQ ID NO: 98938 - DNA, 25 bp, E. coli
ttattcaggtaactggcaaacgcgg

SEQ ID NO: 98939 - DNA, 25 bp, E. coli
tccagccatttaatcaggtaagtgg

SEQ ID NO: 98940 - DNA, 25 bp, E. coli
tccagccatttattcaggtaagtgg

SEQ ID NO: 98941 - DNA, 25 bp, E. coli
cgaagggcagatcgttttacgtagc

SEQ ID NO: 98942 - DNA, 25 bp, E. coli
cgaagggcagatggttttacgtagc

SEQ ID NO: 98943 - DNA, 25 bp, E. coli
cgtagccgtactgatggtgagcaat

SEQ ID NO: 98944 - DNA, 25 bp, E. coli
cgggcaattaccgactccggcgaat

SEQ ID NO: 98945 - DNA, 25 bp, E. coli
cgaataatgcgggaacctccgccgg

SEQ ID NO: 98946 - DNA, 25 bp, E. coli
cgggcaattacccactccggcgaat

SEQ ID NO: 98947 - DNA, 25 bp, E. coli
cgtagccgtactcatggtgagcaat

SEQ ID NO: 98948 - DNA, 25 bp, E. coli
cgaataatgcggcaacctccgccgg

SEQ ID NO: 98949 - DNA, 25 bp, E. coli
ggcagatcgttttacgtagccgtac

SEQ ID NO: 98950 - DNA, 25 bp, E. coli
ggcagatcgtttaacgtagccgtac

SEQ ID NO: 98951 - DNA, 25 bp, E. coli
ggcaccgcacaggtactggcagata

SEQ ID NO: 98952 - DNA, 25 bp, E. coli
ggcaccgcacagctactggcagata

SEQ ID NO: 98953 - DNA, 25 bp, E. coli
catcgatgcgaattgataataattc

SEQ ID NO: 98954 - DNA, 25 bp, E. coli
catcgatgcgaaatgataataattc

SEQ ID NO: 98955 - DNA, 25 bp, E. coli
tatctggcgttaaggcattttccac

SEQ ID NO: 98956 - DNA, 25 bp, E. coli
tatctggcgttatggcattttccac

SEQ ID NO: 98957 - DNA, 25 bp, E. coli
ttatttgcaacactattatctggcg

SEQ ID NO: 98958 - DNA, 25 bp, E. coli
ttatttgcaacagtattatctggcg

SEQ ID NO: 98959 - DNA, 25 bp, E. coli
tcagtatcagcatcaccgacagttc

SEQ ID NO: 98960 - DNA, 25 bp, E. coli
tcagtatcagcaacaccgacagttc

SEQ ID NO: 98961 - DNA, 25 bp, E. coli
ccaccaatgcagatgataaaataat

SEQ ID NO: 98962 - DNA, 25 bp, E. coli
ccaccaatgcagttgataaaataat

SEQ ID NO: 98963 - DNA, 25 bp, E. coli
gcaacactattatctggcgttatgg

SEQ ID NO: 98964 - DNA, 25 bp, E. coli
gcaacactattaactggcgttatgg

SEQ ID NO: 98965 - DNA, 25 bp, E. coli
gaaaatataatgcttcatcctggaa

SEQ ID NO: 98966 - DNA, 25 bp, E. coli
gaaaatataatggttcatcctggaa

SEQ ID NO: 98967 - DNA, 25 bp, E. coli
ccgcaacagcagtattgtataaata

SEQ ID NO: 98968 - DNA, 25 bp, E. coli
ccgcaacagcagaattgtataaata

SEQ ID NO: 98969 - DNA, 25 bp, E. coli
gataataattcatccgcaacagcag

SEQ ID NO: 98970 - DNA, 25 bp, E. coli
gataataattcaaccgcaacagcag

SEQ ID NO: 98971 - DNA, 25 bp, E. coli
tggcattttccaccaatgcagatga

SEQ ID NO: 98972 - DNA, 25 bp, E. coli
tggcattttccagcaatgcagatga

SEQ ID NO: 98973 - DNA, 25 bp, E. coli
taattctgaaacatatcagcgtctc

SEQ ID NO: 98974 - DNA, 25 bp, E. coli
taattctgaaacttatcagcgtctc

SEQ ID NO: 98975 - DNA, 25 bp, E. coli
tacatgattgacagccacgagggaa

SEQ ID NO: 98976 - DNA, 25 bp, E. coli
tacatgattgactgccacgagggaa

SEQ ID NO: 98977 - DNA, 25 bp, E. coli
acagaacgtgatgttgccgctcgcg

SEQ ID NO: 98978 - DNA, 25 bp, E. coli
acagaacgtgatcttgccgctcgcg

SEQ ID NO: 98979 - DNA, 25 bp, E. coli
tgccgacacagatgacaccgtgctg

SEQ ID NO: 98980 - DNA, 25 bp, E. coli
tgccgacacagaagacaccgtgctg

SEQ ID NO: 98981 - DNA, 25 bp, E. coli
gctcgcgtgcgtgatcgttatgaca

SEQ ID NO: 98982 - DNA, 25 bp, E. coli
gctcgcgtgcgtcatcgttatgaca

SEQ ID NO: 98983 - DNA, 25 bp, E. coli
gctggaaattcagcggctggctaca

SEQ ID NO: 98984 - DNA, 25 bp, E. coli
gctggaaattcaccggctggctaca

SEQ ID NO: 98985 - DNA, 25 bp, E. coli
gaatacctgctctacacagaacgtg

SEQ ID NO: 98986 - DNA, 25 bp, E. coli
gaatacctgctcaacacagaacgtg

SEQ ID NO: 98987 - DNA, 25 bp, E. coli
gacatgtacctgtaatccctgcctg

SEQ ID NO: 98988 - DNA, 25 bp, E. coli
gacaccctgaatcgcatgacgaagt

SEQ ID NO: 98989 - DNA, 25 bp, E. coli
gacatgtacctgaaatccctgcctg

SEQ ID NO: 98990 - DNA, 25 bp, E. coli
gacaccctgaatggcatgacgaagt

SEQ ID NO: 98991 - DNA, 25 bp, E. coli
cgcagctcgctgacggaaagattgt

SEQ ID NO: 98992 - DNA, 25 bp, E. coli
cgcagctcgctgtcggaaagattgt

SEQ ID NO: 98993 - DNA, 25 bp, E. coli
cgttattggcatataccagcgccca

SEQ ID NO: 98994 - DNA, 25 bp, E. coli
cgttattggcatttaccagcgccca

SEQ ID NO: 98995 - DNA, 25 bp, E. coli
gatgtgattgccgacagcatccgca

SEQ ID NO: 98996 - DNA, 25 bp, E. coli
gatgtgattgcccacagcatccgca

SEQ ID NO: 98997 - DNA, 25 bp, E. coli
caaatggcactagcagaaaccgggc

SEQ ID NO: 98998 - DNA, 25 bp, E. coli
caaatggcactaccagaaaccgggc

SEQ ID NO: 98999 - DNA, 25 bp, E. coli
catttactgagaagcgtcaaccgca

SEQ ID NO: 99000 - DNA, 25 bp, E. coli
actttggtgattaatcgcccggcga

SEQ ID NO: 99001 - DNA, 25 bp, E. coli
actttggtgatttatcgcccggcga

SEQ ID NO: 99002 - DNA, 25 bp, E. coli
actgcttgggcggtcactggtgaaa

SEQ ID NO: 99003 - DNA, 25 bp, E. coli
actgcttgggcgctcactggtgaaa

SEQ ID NO: 99004 - DNA, 25 bp, E. coli
tatccgtatttgtagcgccgaagca

SEQ ID NO: 99005 - DNA, 25 bp, E. coli
tatccgtatttgaagcgccgaagca

SEQ ID NO: 99006 - DNA, 25 bp, E. coli
tatttaccggtgtaccactggatgc

SEQ ID NO: 99007 - DNA, 25 bp, E. coli
tatttaccggtgaaccactggatgc

SEQ ID NO: 99008 - DNA, 25 bp, E. coli
tgcagtgcagatcgccaagcaggtt

SEQ ID NO: 99009 - DNA, 25 bp, E. coli
tgaatcgcgttgacgccagggagac

SEQ ID NO: 99010 - DNA, 25 bp, E. coli
tgcagtgcagatggccaagcaggtt

SEQ ID NO: 99011 - DNA, 25 bp, E. coli
tgaatcgcgttgtcgccagggagac

SEQ ID NO: 99012 - DNA, 25 bp, E. coli
tgaccagtgccagtgaaaaagcgtt

SEQ ID NO: 99013 - DNA, 25 bp, E. coli
tgaccagtgccactgaaaaagcgtt

SEQ ID NO: 99014 - DNA, 25 bp, E. coli
gaaggtattgctctggcctcgacgc

SEQ ID NO: 99015 - DNA, 25 bp, E. coli
gaaggtattgctgtggcctcgacgc

SEQ ID NO: 99016 - DNA, 25 bp, E. coli
catttactgagatgcgtcaaccgca

SEQ ID NO: 99017 - DNA, 25 bp, E. coli
gagatgctcgaagaactgctggcgc

SEQ ID NO: 99018 - DNA, 25 bp, E. coli
gagatgctcgaacaactgctggcgc

SEQ ID NO: 99019 - DNA, 25 bp, E. coli
aattgtgctaatcggcggcgcttac

SEQ ID NO: 99020 - DNA, 25 bp, E. coli
aattgtgctaatgggcggcgcttac

SEQ ID NO: 99021 - DNA, 25 bp, E. coli
catccggcaatagatttattaggca

SEQ ID NO: 99022 - DNA, 25 bp, E. coli
catccggcaatacatttattaggca

SEQ ID NO: 99023 - DNA, 25 bp, E. coli
agatttattagggatcactattgta

SEQ ID NO: 99024 - DNA, 25 bp, E. coli
agatttattaggcatcactattgta

SEQ ID NO: 99025 - DNA, 25 bp, E. coli
tgtagcgggtaaacagacgcttgat

SEQ ID NO: 99026 - DNA, 25 bp, E. coli
tgtagcgggtaatcagacgcttgat

SEQ ID NO: 99027 - DNA, 25 bp, E. coli
tgaaattgtgcttatgggcggcgct

SEQ ID NO: 99028 - DNA, 25 bp, E. coli
tgaaattgtgctaatgggcggcgct

SEQ ID NO: 99029 - DNA, 25 bp, E. coli
tcagacgcttgaaaaaacattaatt

SEQ ID NO: 99030 - DNA, 25 bp, E. coli
tcagacgcttgataaaacattaatt

SEQ ID NO: 99031 - DNA, 25 bp, E. coli
gcggcgcttacggtacaggcaactt

SEQ ID NO: 99032 - DNA, 25 bp, E. coli
gcggcgcttacgctacaggcaactt

SEQ ID NO: 99033 - DNA, 25 bp, E. coli
gcttacggtacacgcaacttcacgc

SEQ ID NO: 99034 - DNA, 25 bp, E. coli
gcttacggtacaggcaacttcacgc

SEQ ID NO: 99035 - DNA, 25 bp, E. coli
gctttcaaatatggcggtggcaatg

SEQ ID NO: 99036 - DNA, 25 bp, E. coli
gctttcaaatatcgcggtggcaatg

SEQ ID NO: 99037 - DNA, 25 bp, E. coli
cggtacaggcaagttcacgccatct

SEQ ID NO: 99038 - DNA, 25 bp, E. coli
cggtacaggcaacttcacgccatct

SEQ ID NO: 99039 - DNA, 25 bp, E. coli
gtgccggttggtccgctttcaaata

SEQ ID NO: 99040 - DNA, 25 bp, E. coli
gtgccggttggtgcgctttcaaata

SEQ ID NO: 99041 - DNA, 25 bp, E. coli
caaacgctgggtttagttgtggcct

SEQ ID NO: 99042 - DNA, 25 bp, E. coli
caaacgctgggtatagttgtggcct

SEQ ID NO: 99043 - DNA, 25 bp, E. coli
cattgccgcggtaatggtattaaac

SEQ ID NO: 99044 - DNA, 25 bp, E. coli
cattgccgcggttatggtattaaac

SEQ ID NO: 99045 - DNA, 25 bp, E. coli
taaaaacggcgttctgattgccagt

SEQ ID NO: 99046 - DNA, 25 bp, E. coli
taaaaacggcgtactgattgccagt

SEQ ID NO: 99047 - DNA, 25 bp, E. coli
tattatcggcggtatgcttggtccg

SEQ ID NO: 99048 - DNA, 25 bp, E. coli
tattatcggcggaatgcttggtccg

SEQ ID NO: 99049 - DNA, 25 bp, E. coli
tattgttcagcgttgggacagcctg

SEQ ID NO: 99050 - DNA, 25 bp, E. coli
tattgttcagcgatgggacagcctg

SEQ ID NO: 99051 - DNA, 25 bp, E. coli
tgatctgcccgtggaaattaatgga

SEQ ID NO: 99052 - DNA, 25 bp, E. coli
tgatctgcccgtcgaaattaatgga

SEQ ID NO: 99053 - DNA, 25 bp, E. coli
tctgattggcaaaatctggccggga

SEQ ID NO: 99054 - DNA, 25 bp, E. coli
tctgattggcaatatctggccggga

SEQ ID NO: 99055 - DNA, 25 bp, E. coli
cgtgtttcatggattgtcggcgtca

SEQ ID NO: 99056 - DNA, 25 bp, E. coli
cggtgagcgcatgcgactttacgca

SEQ ID NO: 99057 - DNA, 25 bp, E. coli
cggtgagcgcatccgactttacgca

SEQ ID NO: 99058 - DNA, 25 bp, E. coli
cgtgtttcatggtttgtcggcgtca

SEQ ID NO: 99059 - DNA, 25 bp, E. coli
gggtatgtattattgccggagccag

SEQ ID NO: 99060 - DNA, 25 bp, E. coli
gggtcactggccagcttgattctga

SEQ ID NO: 99061 - DNA, 25 bp, E. coli
gggtcactggcctgcttgattctga

SEQ ID NO: 99062 - DNA, 25 bp, E. coli
gggtatgtattaatgccggagccag

SEQ ID NO: 99063 - DNA, 25 bp, E. coli
tacgcttctggtcggagactcgctg

SEQ ID NO: 99064 - DNA, 25 bp, E. coli
atttacgcttctggtcggagactcg

SEQ ID NO: 99065 - DNA, 25 bp, E. coli
atttacgcttctcgtcggagactcg

SEQ ID NO: 99066 - DNA, 25 bp, E. coli
tacgcttctggtgggagactcgctg

SEQ ID NO: 99067 - DNA, 25 bp, E. coli
tttacgcttctgctcggagactcgc

SEQ ID NO: 99068 - DNA, 25 bp, E. coli
tttacgcttctggtcggagactcgc

SEQ ID NO: 99069 - DNA, 25 bp, E. coli
ttacgcttctggacggagactcgct

SEQ ID NO: 99070 - DNA, 25 bp, E. coli
ttacgcttctggtcggagactcgct

SEQ ID NO: 99071 - DNA, 25 bp, E. coli
ttctggtcggagactcgctgtgtga

SEQ ID NO: 99072 - DNA, 25 bp, E. coli
ttctggtcggagtctcgctgtgtga

SEQ ID NO: 99073 - DNA, 25 bp, E. coli
tggtcggagactggctgtgtgagtt

SEQ ID NO: 99074 - DNA, 25 bp, E. coli
gcttctggtcggtgactcgctgtgt

SEQ ID NO: 99075 - DNA, 25 bp, E. coli
gcttctggtcggagactcgctgtgt

SEQ ID NO: 99076 - DNA, 25 bp, E. coli
cgcttctggtcgcagactcgctgtg

SEQ ID NO: 99077 - DNA, 25 bp, E. coli
cgcttctggtcggagactcgctgtg

SEQ ID NO: 99078 - DNA, 25 bp, E. coli
gatttacgcttctggtcggagactc

SEQ ID NO: 99079 - DNA, 25 bp, E. coli
gatttacgcttcaggtcggagactc

SEQ ID NO: 99080 - DNA, 25 bp, E. coli
gggatttacgctactggtcggagac

SEQ ID NO: 99081 - DNA, 25 bp, E. coli
ggatttacgcttctggtcggagact

SEQ ID NO: 99082 - DNA, 25 bp, E. coli
gggatttacgcttctggtcggagac

SEQ ID NO: 99083 - DNA, 25 bp, E. coli
ggatttacgcttgtggtcggagact

SEQ ID NO: 99084 - DNA, 25 bp, E. coli
tggtcggagactcgctgtgtgagtt

SEQ ID NO: 99085 - DNA, 25 bp, E. coli
aaggcgcgaatatcttagcaatgta

SEQ ID NO: 99086 - DNA, 25 bp, E. coli
aaggcgcgaataacttagcaatgta

SEQ ID NO: 99087 - DNA, 25 bp, E. coli
cactttccgctgattcggtgccaga

SEQ ID NO: 99088 - DNA, 25 bp, E. coli
cactttccgctgtttcggtgccaga

SEQ ID NO: 99089 - DNA, 25 bp, E. coli
cattttttgaataagcatgtggcga

SEQ ID NO: 99090 - DNA, 25 bp, E. coli
taacgaattatataaaggcgcgaat

SEQ ID NO: 99091 - DNA, 25 bp, E. coli
agcatgtggcgaaaacagattttta

SEQ ID NO: 99092 - DNA, 25 bp, E. coli
agcatgtggcgataacagattttta

SEQ ID NO: 99093 - DNA, 25 bp, E. coli
tagcgtccctggtaaggtaacgaat

SEQ ID NO: 99094 - DNA, 25 bp, E. coli
tagcgtccctggaaaggtaacgaat

SEQ ID NO: 99095 - DNA, 25 bp, E. coli
tatcaagagtccctacaacaaaaaa

SEQ ID NO: 99096 - DNA, 25 bp, E. coli
tatcaagagtccgtacaacaaaaaa

SEQ ID NO: 99097 - DNA, 25 bp, E. coli
ttcggtgccagagtgaaatcagcct

SEQ ID NO: 99098 - DNA, 25 bp, E. coli
ttcggtgccagactgaaatcagcct

SEQ ID NO: 99099 - DNA, 25 bp, E. coli
tgaaatcagcctataggaggaaatg

SEQ ID NO: 99100 - DNA, 25 bp, E. coli
tgaaatcagcctttaggaggaaatg

SEQ ID NO: 99101 - DNA, 25 bp, E. coli
cattttttgaattagcatgtggcga

SEQ ID NO: 99102 - DNA, 25 bp, E. coli
taacgaattataaaaaggcgcgaat

SEQ ID NO: 99103 - DNA, 25 bp, E. coli
taaggatcaaagtttagcgtccctg

SEQ ID NO: 99104 - DNA, 25 bp, E. coli
taaggatcaaagattagcgtccctg

SEQ ID NO: 99105 - DNA, 25 bp, E. coli
gagaccatcgcgctcccggaaactt

SEQ ID NO: 99106 - DNA, 25 bp, E. coli
gagaccatcgcggtcccggaaactt

SEQ ID NO: 99107 - DNA, 25 bp, E. coli
tttgccgcctcttttgaagccgacg

SEQ ID NO: 99108 - DNA, 25 bp, E. coli
ttgaagccgacggatccctggctga

SEQ ID NO: 99109 - DNA, 25 bp, E. coli
ttgttgacgcggcactggcagataa

SEQ ID NO: 99110 - DNA, 25 bp, E. coli
ttgaagccgacgcatccctggctga

SEQ ID NO: 99111 - DNA, 25 bp, E. coli
ttgttgacgcgggactggcagataa

SEQ ID NO: 99112 - DNA, 25 bp, E. coli
tttgccgcctctattgaagccgacg

SEQ ID NO: 99113 - DNA, 25 bp, E. coli
tgtctcagacgttttggccgccttc

SEQ ID NO: 99114 - DNA, 25 bp, E. coli
tgtctcagacgtattggccgccttc

SEQ ID NO: 99115 - DNA, 25 bp, E. coli
tgctgctgcggacgcactctgttct

SEQ ID NO: 99116 - DNA, 25 bp, E. coli
tgctgctgcggaggcactctgttct

SEQ ID NO: 99117 - DNA, 25 bp, E. coli
tctgctgccgttacagaggacttag

SEQ ID NO: 99118 - DNA, 25 bp, E. coli
tctgctgccgtttcagaggacttag

SEQ ID NO: 99119 - DNA, 25 bp, E. coli
ccctggctgaggtggcagcttctga

SEQ ID NO: 99120 - DNA, 25 bp, E. coli
ccctggctgaggaggcagcttctga

SEQ ID NO: 99121 - DNA, 25 bp, E. coli
gattgttgtgacactgccgcattcg

SEQ ID NO: 99122 - DNA, 25 bp, E. coli
gattgttgtgactctgccgcattcg

SEQ ID NO: 99123 - DNA, 25 bp, E. coli
tggcagataatggagccgctgtttt

SEQ ID NO: 99124 - DNA, 25 bp, E. coli
tggcagataatgcagccgctgtttt

SEQ ID NO: 99125 - DNA, 25 bp, E. coli
gaggctgcgctcgtttctgatgatt

SEQ ID NO: 99126 - DNA, 25 bp, E. coli
gaggacttagcgtttgtctcagacg

SEQ ID NO: 99127 - DNA, 25 bp, E. coli
gaggacttagcgattgtctcagacg

SEQ ID NO: 99128 - DNA, 25 bp, E. coli
gaggctgcgctcctttctgatgatt

SEQ ID NO: 99129 - DNA, 25 bp, E. coli
caagtattgatgacaaaccgtcccg

SEQ ID NO: 99130 - DNA, 25 bp, E. coli
caagtattgatgtcaaaccgtcccg

SEQ ID NO: 99131 - DNA, 25 bp, E. coli
cacttaggttactgatacacaggag

SEQ ID NO: 99132 - DNA, 25 bp, E. coli
cacttaggttacagatacacaggag

SEQ ID NO: 99133 - DNA, 25 bp, E. coli
tttattaaaaaggtcgcccagtcgg

SEQ ID NO: 99134 - DNA, 25 bp, E. coli
tttattaaaaagctcgcccagtcgg

SEQ ID NO: 99135 - DNA, 25 bp, E. coli
ttatgaggcctgcagaaatctccag

SEQ ID NO: 99136 - DNA, 25 bp, E. coli
ttatgaggcctggagaaatctccag

SEQ ID NO: 99137 - DNA, 25 bp, E. coli
tcgctggagatggatgaacttaacg

SEQ ID NO: 99138 - DNA, 25 bp, E. coli
tcgctggagatgcatgaacttaacg

SEQ ID NO: 99139 - DNA, 25 bp, E. coli
tcatcaggagacctcacaaaacgct

SEQ ID NO: 99140 - DNA, 25 bp, E. coli
tcatcaggagacgtcacaaaacgct

SEQ ID NO: 99141 - DNA, 25 bp, E. coli
gaattttaaaactagcaatgcggca

SEQ ID NO: 99142 - DNA, 25 bp, E. coli
gaattttaaaacaagcaatgcggca

SEQ ID NO: 99143 - DNA, 25 bp, E. coli
gacagatggtatgtcaacttcgcca

SEQ ID NO: 99144 - DNA, 25 bp, E. coli
gacagatggtatctcaacttcgcca

SEQ ID NO: 99145 - DNA, 25 bp, E. coli
gaaaataccttcagagcatcaacga

SEQ ID NO: 99146 - DNA, 25 bp, E. coli
gaaaataccttctgagcatcaacga

SEQ ID NO: 99147 - DNA, 25 bp, E. coli
gatattatgcctcgccgatggacca

SEQ ID NO: 99148 - DNA, 25 bp, E. coli
gatattatgcctggccgatggacca

SEQ ID NO: 99149 - DNA, 25 bp, E. coli
ggagtattcaaatccctggcaagta

SEQ ID NO: 99150 - DNA, 25 bp, E. coli
ggagtattcaaaaccctggcaagta

SEQ ID NO: 99151 - DNA, 25 bp, E. coli
catttgtctgatcccgcacgtaggc

SEQ ID NO: 99152 - DNA, 25 bp, E. coli
catttgtctgatgccgcacgtaggc

SEQ ID NO: 99153 - DNA, 25 bp, E. coli
agtgacatttgtctgatgccgcacg

SEQ ID NO: 99154 - DNA, 25 bp, E. coli
agtgacatttgtgtgatgccgcacg

SEQ ID NO: 99155 - DNA, 25 bp, E. coli
aaagcagtgacatttgtctgatgcc

SEQ ID NO: 99156 - DNA, 25 bp, E. coli
acatttgtctgatgccgcacgtagg

SEQ ID NO: 99157 - DNA, 25 bp, E. coli
acatttgtctgaagccgcacgtagg

SEQ ID NO: 99158 - DNA, 25 bp, E. coli
aaagcagtgacaattgtctgatgcc

SEQ ID NO: 99159 - DNA, 25 bp, E. coli
tgtctgatgccggacgtaggcctga

SEQ ID NO: 99160 - DNA, 25 bp, E. coli
tgtctgatgccgcacgtaggcctga

SEQ ID NO: 99161 - DNA, 25 bp, E. coli
tgacatttgtctcatgccgcacgta

SEQ ID NO: 99162 - DNA, 25 bp, E. coli
tgacatttgtctgatgccgcacgta

SEQ ID NO: 99163 - DNA, 25 bp, E. coli
tctgatgccgcacgtaggcctgata

SEQ ID NO: 99164 - DNA, 25 bp, E. coli
tctgatgccgcaggtaggcctgata

SEQ ID NO: 99165 - DNA, 25 bp, E. coli
ccaaagcagtgagatttgtctgatg

SEQ ID NO: 99166 - DNA, 25 bp, E. coli
ccaaagcagtgacatttgtctgatg

SEQ ID NO: 99167 - DNA, 25 bp, E. coli
gcagtgacatttgtctgatgccgca

SEQ ID NO: 99168 - DNA, 25 bp, E. coli
gcagtgacatttctctgatgccgca

SEQ ID NO: 99169 - DNA, 25 bp, E. coli
gacatttgtctgttgccgcacgtag

SEQ ID NO: 99170 - DNA, 25 bp, E. coli
gacatttgtctgatgccgcacgtag

SEQ ID NO: 99171 - DNA, 25 bp, E. coli
gtctgatgccgctcgtaggcctgat

SEQ ID NO: 99172 - DNA, 25 bp, E. coli
gtctgatgccgcacgtaggcctgat

SEQ ID NO: 99173 - DNA, 25 bp, E. coli
caaaacacaaagtggtcagaccaga

SEQ ID NO: 99174 - DNA, 25 bp, E. coli
caaaacacaaagaggtcagaccaga

SEQ ID NO: 99175 - DNA, 25 bp, E. coli
catctgtcggttgtatttccctcca

SEQ ID NO: 99176 - DNA, 25 bp, E. coli
catctgtcggttctatttccctcca

SEQ ID NO: 99177 - DNA, 25 bp, E. coli
agaccagattgaagcgataaaaacg

SEQ ID NO: 99178 - DNA, 25 bp, E. coli
agaccagattgatgcgataaaaacg

SEQ ID NO: 99179 - DNA, 25 bp, E. coli
tatttccctccacaatgccagcagg

SEQ ID NO: 99180 - DNA, 25 bp, E. coli
tttgtcgctccaagcgcttgctctt

SEQ ID NO: 99181 - DNA, 25 bp, E. coli
tttgtcgctccatgcgcttgctctt

SEQ ID NO: 99182 - DNA, 25 bp, E. coli
tatttccctccagaatgccagcagg

SEQ ID NO: 99183 - DNA, 25 bp, E. coli
tctttctgtatgaaggtttgagcac

SEQ ID NO: 99184 - DNA, 25 bp, E. coli
tctttctgtatgtaggtttgagcac

SEQ ID NO: 99185 - DNA, 25 bp, E. coli
gcttgctcttcaactagcggttaaa

SEQ ID NO: 99186 - DNA, 25 bp, E. coli
gcttgctcttcatctagcggttaaa

SEQ ID NO: 99187 - DNA, 25 bp, E. coli
gaatgccagcagcaccgcactttgt

SEQ ID NO: 99188 - DNA, 25 bp, E. coli
gaaggtttgagcacgttggccttac

SEQ ID NO: 99189 - DNA, 25 bp, E. coli
gaatgccagcaggaccgcactttgt

SEQ ID NO: 99190 - DNA, 25 bp, E. coli
gaaggtttgagctcgttggccttac

SEQ ID NO: 99191 - DNA, 25 bp, E. coli
cgttggccttacatacatctgtcgg

SEQ ID NO: 99192 - DNA, 25 bp, E. coli
cgttggccttacttacatctgtcgg

SEQ ID NO: 99193 - DNA, 25 bp, E. coli
ggaccgcactttcttacgcaaccaa

SEQ ID NO: 99194 - DNA, 25 bp, E. coli
ggaccgcactttgttacgcaaccaa

SEQ ID NO: 99195 - DNA, 25 bp, E. coli
aagagaacatcaatgctgcggcgca

SEQ ID NO: 99196 - DNA, 25 bp, E. coli
aagagaacatcattgctgcggcgca

SEQ ID NO: 99197 - DNA, 25 bp, E. coli
caataatgttgaggaagcggaagat

SEQ ID NO: 99198 - DNA, 25 bp, E. coli
caataatgttgacgaagcggaagat

SEQ ID NO: 99199 - DNA, 25 bp, E. coli
caggcaggcggtaatggatttgtta

SEQ ID NO: 99200 - DNA, 25 bp, E. coli
caggcaggcggttatggatttgtta

SEQ ID NO: 99201 - DNA, 25 bp, E. coli
ttaccgccgcgaggctggaggaaaa

SEQ ID NO: 99202 - DNA, 25 bp, E. coli
ttaccgccgcgacgctggaggaaaa

SEQ ID NO: 99203 - DNA, 25 bp, E. coli
tgttaatggtgactgcagaagcgaa

SEQ ID NO: 99204 - DNA, 25 bp, E. coli
tgttaatggtgagtgcagaagcgaa

SEQ ID NO: 99205 - DNA, 25 bp, E. coli
tgcagaagcgaagaaagagaacatc

SEQ ID NO: 99206 - DNA, 25 bp, E. coli
tgcagaagcgaacaaagagaacatc

SEQ ID NO: 99207 - DNA, 25 bp, E. coli
tcgacgctctcaataagttgcaggc

SEQ ID NO: 99208 - DNA, 25 bp, E. coli
tcgacgctctcattaagttgcaggc

SEQ ID NO: 99209 - DNA, 25 bp, E. coli
gcgatgtcggcaatgccagtgttaa

SEQ ID NO: 99210 - DNA, 25 bp, E. coli
gcgatgtcggcattgccagtgttaa

SEQ ID NO: 99211 - DNA, 25 bp, E. coli
gttatctccgactggaacatgccca

SEQ ID NO: 99212 - DNA, 25 bp, E. coli
gttatctccgacaggaacatgccca

SEQ ID NO: 99213 - DNA, 25 bp, E. coli
gatgacttttcctccatgcgacgca

SEQ ID NO: 99214 - DNA, 25 bp, E. coli
gacgcatagtgcctaacctgctgaa

SEQ ID NO: 99215 - DNA, 25 bp, E. coli
gacgcatagtgcgtaacctgctgaa

SEQ ID NO: 99216 - DNA, 25 bp, E. coli
gatgacttttccaccatgcgacgca

SEQ ID NO: 99217 - DNA, 25 bp, E. coli
aatggtcagggctagaatcgcctgg

SEQ ID NO: 99218 - DNA, 25 bp, E. coli
aatggtcagggcaagaatcgcctgg

SEQ ID NO: 99219 - DNA, 25 bp, E. coli
acatgcagaactgcgtacactcttg

SEQ ID NO: 99220 - DNA, 25 bp, E. coli
acatgcagaactccgtacactcttg

SEQ ID NO: 99221 - DNA, 25 bp, E. coli
tcgcctggggtagcttttaatggcg

SEQ ID NO: 99222 - DNA, 25 bp, E. coli
tcgcctggggtaccttttaatggcg

SEQ ID NO: 99223 - DNA, 25 bp, E. coli
ccagcaggatgaagcgtaaagcgct

SEQ ID NO: 99224 - DNA, 25 bp, E. coli
ccagcaggatgatgcgtaaagcgct

SEQ ID NO: 99225 - DNA, 25 bp, E. coli
gcaataaccagcaggatgatgcgta

SEQ ID NO: 99226 - DNA, 25 bp, E. coli
gcaataaccagctggatgatgcgta

SEQ ID NO: 99227 - DNA, 25 bp, E. coli
cgaacaacatgctgaactgcgtaca

SEQ ID NO: 99228 - DNA, 25 bp, E. coli
cgaacaacatgcagaactgcgtaca

SEQ ID NO: 99229 - DNA, 25 bp, E. coli
cggtaatggtcagggcaagaatcgc

SEQ ID NO: 99230 - DNA, 25 bp, E. coli
cggacaattggctgcggagaagtaa

SEQ ID NO: 99231 - DNA, 25 bp, E. coli
cggtaatggtcacggcaagaatcgc

SEQ ID NO: 99232 - DNA, 25 bp, E. coli
cggacaattggcagcggagaagtaa

SEQ ID NO: 99233 - DNA, 25 bp, E. coli
tggcgttgcgcgcacaattggctgc

SEQ ID NO: 99234 - DNA, 25 bp, E. coli
ggctcgcaataagcagcaggatgat

SEQ ID NO: 99235 - DNA, 25 bp, E. coli
tggcgttgcgcggacaattggctgc

SEQ ID NO: 99236 - DNA, 25 bp, E. coli
ggctcgcaataaccagcaggatgat

SEQ ID NO: 99237 - DNA, 25 bp, E. coli
gatgatgcgtaaagcgcttcgcgct

SEQ ID NO: 99238 - DNA, 25 bp, E. coli
gatgatgcgtaatgcgcttcgcgct

SEQ ID NO: 99239 - DNA, 25 bp, E. coli
caggaccgctatctgctggcagacg

SEQ ID NO: 99240 - DNA, 25 bp, E. coli
cagttagaacatagcgcgattcgca

SEQ ID NO: 99241 - DNA, 25 bp, E. coli
caggaccgctatgtgctggcagacg

SEQ ID NO: 99242 - DNA, 25 bp, E. coli
cagttagaacattgcgcgattcgca

SEQ ID NO: 99243 - DNA, 25 bp, E. coli
tattccggcggcagtcagattcagg

SEQ ID NO: 99244 - DNA, 25 bp, E. coli
tattccggcggctgtcagattcagg

SEQ ID NO: 99245 - DNA, 25 bp, E. coli
tgttgacgagcatcaacctgatgcc

SEQ ID NO: 99246 - DNA, 25 bp, E. coli
tgttattagccggattcgcgccacg

SEQ ID NO: 99247 - DNA, 25 bp, E. coli
tgttattagccgcattcgcgccacg

SEQ ID NO: 99248 - DNA, 25 bp, E. coli
tgttgacgagcaacaacctgatgcc

SEQ ID NO: 99249 - DNA, 25 bp, E. coli
tcgccaggcgaaaccgcagttagaa

SEQ ID NO: 99250 - DNA, 25 bp, E. coli
tcgccaggcgaatccgcagttagaa

SEQ ID NO: 99251 - DNA, 25 bp, E. coli
gctgcgagtttcatacctgcggtga

SEQ ID NO: 99252 - DNA, 25 bp, E. coli
gctgcgagtttcttacctgcggtga

SEQ ID NO: 99253 - DNA, 25 bp, E. coli
gaaaagcgccgtcattgccaatgca

SEQ ID NO: 99254 - DNA, 25 bp, E. coli
gaaaagcgccgtgattgccaatgca

SEQ ID NO: 99255 - DNA, 25 bp, E. coli
cgcagaaactcggtgccttgcctta

SEQ ID NO: 99256 - DNA, 25 bp, E. coli
cgctggtggacacgatttgccgtca

SEQ ID NO: 99257 - DNA, 25 bp, E. coli
cgcagaaactcgctgccttgcctta

SEQ ID NO: 99258 - DNA, 25 bp, E. coli
cgctggtggacaggatttgccgtca

SEQ ID NO: 99259 - DNA, 25 bp, E. coli
gatcttgcgtgatagtattgccagc

SEQ ID NO: 99260 - DNA, 25 bp, E. coli
gatcttgcgtgaaagtattgccagc

SEQ ID NO: 99261 - DNA, 25 bp, E. coli
aattcgattgactgttggcggatgc

SEQ ID NO: 99262 - DNA, 25 bp, E. coli
aattcgattgacagttggcggatgc

SEQ ID NO: 99263 - DNA, 25 bp, E. coli
cattttctgacaacctcatccgcta

SEQ ID NO: 99264 - DNA, 25 bp, E. coli
cattttctgacatcctcatccgcta

SEQ ID NO: 99265 - DNA, 25 bp, E. coli
tacagtaaataccttacctggcgcg

SEQ ID NO: 99266 - DNA, 25 bp, E. coli
tacagtaaatacgttacctggcgcg

SEQ ID NO: 99267 - DNA, 25 bp, E. coli
tcgcatcgggcattcagcatcaaac

SEQ ID NO: 99268 - DNA, 25 bp, E. coli
tcgcatcgggcaatcagcatcaaac

SEQ ID NO: 99269 - DNA, 25 bp, E. coli
tcgtaggcctgacaagacgcaacag

SEQ ID NO: 99270 - DNA, 25 bp, E. coli
tgcgcatcttttgtctcgatataca

SEQ ID NO: 99271 - DNA, 25 bp, E. coli
tcgtaggcctgagaagacgcaacag

SEQ ID NO: 99272 - DNA, 25 bp, E. coli
tgccactcaaaacgacaaactactt

SEQ ID NO: 99273 - DNA, 25 bp, E. coli
tgcgcatcttttctctcgatataca

SEQ ID NO: 99274 - DNA, 25 bp, E. coli
tgccactcaaaaggacaaactactt

SEQ ID NO: 99275 - DNA, 25 bp, E. coli
tcatccgctatgctacaggcactaa

SEQ ID NO: 99276 - DNA, 25 bp, E. coli
tcatccgctatggtacaggcactaa

SEQ ID NO: 99277 - DNA, 25 bp, E. coli
cctggcgcgaatttctttgaataac

SEQ ID NO: 99278 - DNA, 25 bp, E. coli
cctggcgcgaatatctttgaataac

SEQ ID NO: 99279 - DNA, 25 bp, E. coli
gctacaggcactaaaaatggttatt

SEQ ID NO: 99280 - DNA, 25 bp, E. coli
gctacaggcacttaaaatggttatt

SEQ ID NO: 99281 - DNA, 25 bp, E. coli
gaacgcaccacaatcgtaggcctga

SEQ ID NO: 99282 - DNA, 25 bp, E. coli
gaacgcaccacattcgtaggcctga

SEQ ID NO: 99283 - DNA, 25 bp, E. coli
tatcgcacagatggaagctgacctg

SEQ ID NO: 99284 - DNA, 25 bp, E. coli
tatcgcacagatcgaagctgacctg

SEQ ID NO: 99285 - DNA, 25 bp, E. coli
tgaaaaacggctgctgccggcagcg

SEQ ID NO: 99286 - DNA, 25 bp, E. coli
tgaaacgtctccatgccgaacagga

SEQ ID NO: 99287 - DNA, 25 bp, E. coli
tgaaccgtgcccagctggaaaagct

SEQ ID NO: 99288 - DNA, 25 bp, E. coli
tgaaaaacggctcctgccggcagcg

SEQ ID NO: 99289 - DNA, 25 bp, E. coli
tgaaacgtctccttgccgaacagga

SEQ ID NO: 99290 - DNA, 25 bp, E. coli
tgaaccgtgccctgctggaaaagct

SEQ ID NO: 99291 - DNA, 25 bp, E. coli
tcagaaagaaagtgatacccttacc

SEQ ID NO: 99292 - DNA, 25 bp, E. coli
tcagaaagaaagagatacccttacc

SEQ ID NO: 99293 - DNA, 25 bp, E. coli
tcatgctgcccggaatgtggaggct

SEQ ID NO: 99294 - DNA, 25 bp, E. coli
tcatgctgcccgcaatgtggaggct

SEQ ID NO: 99295 - DNA, 25 bp, E. coli
gctatctgggtgtggatgccgccta

SEQ ID NO: 99296 - DNA, 25 bp, E. coli
gctatctgggtgaggatgccgccta

SEQ ID NO: 99297 - DNA, 25 bp, E. coli
gaaaagctgaaccagcgtgaacgcg

SEQ ID NO: 99298 - DNA, 25 bp, E. coli
gaacgtcggcaggtgctccgaaaaa

SEQ ID NO: 99299 - DNA, 25 bp, E. coli
gaaaagctgaacgagcgtgaacgcg

SEQ ID NO: 99300 - DNA, 25 bp, E. coli
gaacgtcggcagctgctccgaaaaa

SEQ ID NO: 99301 - DNA, 25 bp, E. coli
tgagcagctcacatcctgacgatat

SEQ ID NO: 99302 - DNA, 25 bp, E. coli
tgagcagctcacttcctgacgatat

SEQ ID NO: 99303 - DNA, 25 bp, E. coli
taagctgcgccggatgaacgtcggc

SEQ ID NO: 99304 - DNA, 25 bp, E. coli
taagctgcgccgcatgaacgtcggc

SEQ ID NO: 99305 - DNA, 25 bp, E. coli
caggatattcccggcgttcttgccg

SEQ ID NO: 99306 - DNA, 25 bp, E. coli
caggatattccccgcgttcttgccg

SEQ ID NO: 99307 - DNA, 25 bp, E. coli
attcccggcgttgttgccgtgtttg

SEQ ID NO: 99308 - DNA, 25 bp, E. coli
aggatattcccggcgttcttgccgt

SEQ ID NO: 99309 - DNA, 25 bp, E. coli
atattcccggcgttcttgccgtgtt

SEQ ID NO: 99310 - DNA, 25 bp, E. coli
attcccggcgttcttgccgtgtttg

SEQ ID NO: 99311 - DNA, 25 bp, E. coli
atattcccggcgatcttgccgtgtt

SEQ ID NO: 99312 - DNA, 25 bp, E. coli
aggatattcccgccgttcttgccgt

SEQ ID NO: 99313 - DNA, 25 bp, E. coli
tattcccggcgtacttgccgtgttt

SEQ ID NO: 99314 - DNA, 25 bp, E. coli
tattcccggcgttcttgccgtgttt

SEQ ID NO: 99315 - DNA, 25 bp, E. coli
ttcccggcgttcttgccgtgtttgc

SEQ ID NO: 99316 - DNA, 25 bp, E. coli
ttcccggcgttcatgccgtgtttgc

SEQ ID NO: 99317 - DNA, 25 bp, E. coli
gcaggatattccgggcgttcttgcc

SEQ ID NO: 99318 - DNA, 25 bp, E. coli
gcaggatattcccggcgttcttgcc

SEQ ID NO: 99319 - DNA, 25 bp, E. coli
gatattcccggcgttcttgccgtgt

SEQ ID NO: 99320 - DNA, 25 bp, E. coli
gatattcccggccttcttgccgtgt

SEQ ID NO: 99321 - DNA, 25 bp, E. coli
aataccgtgcttgcgctgaatcagg

SEQ ID NO: 99322 - DNA, 25 bp, E. coli
aataccgtgcttccgctgaatcagg

SEQ ID NO: 99323 - DNA, 25 bp, E. coli
cagggctgcgacgatctgtttaaac

SEQ ID NO: 99324 - DNA, 25 bp, E. coli
cagggctgcgaccatctgtttaaac

SEQ ID NO: 99325 - DNA, 25 bp, E. coli
ttgatgcgtggctgatggaaaacgc

SEQ ID NO: 99326 - DNA, 25 bp, E. coli
ttgatgcgtggcagatggaaaacgc

SEQ ID NO: 99327 - DNA, 25 bp, E. coli
tgtgatttaaattccgtgcttgcgc

SEQ ID NO: 99328 - DNA, 25 bp, E. coli
tgtgatttaaataccgtgcttgcgc

SEQ ID NO: 99329 - DNA, 25 bp, E. coli
tgcaccgcgtaatcactgtgattta

SEQ ID NO: 99330 - DNA, 25 bp, E. coli
tgcaccgcgtaaacactgtgattta

SEQ ID NO: 99331 - DNA, 25 bp, E. coli
tgcttgatttcagccacacggtgga

SEQ ID NO: 99332 - DNA, 25 bp, E. coli
tgcttgatttcacccacacggtgga

SEQ ID NO: 99333 - DNA, 25 bp, E. coli
tctgtttaaacatccgggcctgctt

SEQ ID NO: 99334 - DNA, 25 bp, E. coli
tctgtttaaacaaccgggcctgctt

SEQ ID NO: 99335 - DNA, 25 bp, E. coli
cgctgaatcaggatatccgctcgcc

SEQ ID NO: 99336 - DNA, 25 bp, E. coli
ccgtttgtggtgattgatttgcagg

SEQ ID NO: 99337 - DNA, 25 bp, E. coli
cgctgaaattttaacgcaataatca

SEQ ID NO: 99338 - DNA, 25 bp, E. coli
ccgtttgtggtgtttgatttgcagg

SEQ ID NO: 99339 - DNA, 25 bp, E. coli
cgctgaatcaggttatccgctcgcc

SEQ ID NO: 99340 - DNA, 25 bp, E. coli
cgctgaaatttttacgcaataatca

SEQ ID NO: 99341 - DNA, 25 bp, E. coli
gtcgcccggatccttccagcagttt

SEQ ID NO: 99342 - DNA, 25 bp, E. coli
gtcgcccggatcgttccagcagttt

SEQ ID NO: 99343 - DNA, 25 bp, E. coli
aaagatgcctgcgtgctggtagagc

SEQ ID NO: 99344 - DNA, 25 bp, E. coli
aaagatgcctgcctgctggtagagc

SEQ ID NO: 99345 - DNA, 25 bp, E. coli
tcactcccggctgtaataacgaaag

SEQ ID NO: 99346 - DNA, 25 bp, E. coli
tcactcccggctctaataacgaaag

SEQ ID NO: 99347 - DNA, 25 bp, E. coli
tctatggtattgatcctgctgggaa

SEQ ID NO: 99348 - DNA, 25 bp, E. coli
tctggtcggcagagatgaaaaatcg

SEQ ID NO: 99349 - DNA, 25 bp, E. coli
tctatggtattgttcctgctgggaa

SEQ ID NO: 99350 - DNA, 25 bp, E. coli
tctggtcggcagtgatgaaaaatcg

SEQ ID NO: 99351 - DNA, 25 bp, E. coli
cctgctgggaaagaatggaaagaga

SEQ ID NO: 99352 - DNA, 25 bp, E. coli
cctgctgggaaacaatggaaagaga

SEQ ID NO: 99353 - DNA, 25 bp, E. coli
gaaaaattactcatggctgcggagg

SEQ ID NO: 99354 - DNA, 25 bp, E. coli
gaaaaattactcttggctgcggagg

SEQ ID NO: 99355 - DNA, 25 bp, E. coli
cgatcttacggtggatggcgaaaga

SEQ ID NO: 99356 - DNA, 25 bp, E. coli
cgatcttacggtcgatggcgaaaga

SEQ ID NO: 99357 - DNA, 25 bp, E. coli
ggtaagtctctatatgctcgaacag

SEQ ID NO: 99358 - DNA, 25 bp, E. coli
ggtaagtctctaaatgctcgaacag

SEQ ID NO: 99359 - DNA, 25 bp, E. coli
tggagtacaacgtcttcagcagcag

SEQ ID NO: 99360 - DNA, 25 bp, E. coli
tggaaaaccggatacgatattctgg

SEQ ID NO: 99361 - DNA, 25 bp, E. coli
tggagtacaacgacttcagcagcag

SEQ ID NO: 99362 - DNA, 25 bp, E. coli
tggaaaaccggaaacgatattctgg

SEQ ID NO: 99363 - DNA, 25 bp, E. coli
gagattacgatgtattcactcccgg

SEQ ID NO: 99364 - DNA, 25 bp, E. coli
gagattacgatgaattcactcccgg

SEQ ID NO: 99365 - DNA, 25 bp, E. coli
tttacttagcgaaacccagacgatg

SEQ ID NO: 99366 - DNA, 25 bp, E. coli
tttacttagcgatacccagacgatg

SEQ ID NO: 99367 - DNA, 25 bp, E. coli
gccagggatatgatctcagctgtaa

SEQ ID NO: 99368 - DNA, 25 bp, E. coli
gccagggatatgttctcagctgtaa

SEQ ID NO: 99369 - DNA, 25 bp, E. coli
gactgaacagtaacctgccagggat

SEQ ID NO: 99370 - DNA, 25 bp, E. coli
gaaatgaatttcacgattctgaaag

SEQ ID NO: 99371 - DNA, 25 bp, E. coli
gaactcttatcacatatccaggcaa

SEQ ID NO: 99372 - DNA, 25 bp, E. coli
gactgaacagtatcctgccagggat

SEQ ID NO: 99373 - DNA, 25 bp, E. coli
gaaatgaatttctcgattctgaaag

SEQ ID NO: 99374 - DNA, 25 bp, E. coli
gaactcttatcagatatccaggcaa

SEQ ID NO: 99375 - DNA, 25 bp, E. coli
cccagacgatgttggcaggatatta

SEQ ID NO: 99376 - DNA, 25 bp, E. coli
cccagacgatgtaggcaggatatta

SEQ ID NO: 99377 - DNA, 25 bp, E. coli
gtttcgggcattcctgtaagcacag

SEQ ID NO: 99378 - DNA, 25 bp, E. coli
gtttcgggcattgctgtaagcacag

SEQ ID NO: 99379 - DNA, 25 bp, E. coli
gggccgaccacgactgaacagtatc

SEQ ID NO: 99380 - DNA, 25 bp, E. coli
gggccgaccacgtctgaacagtatc

SEQ ID NO: 99381 - DNA, 25 bp, E. coli
tggaatatacacgagacaaagggct

SEQ ID NO: 99382 - DNA, 25 bp, E. coli
ggcaacgtcacatgaactcttatca

SEQ ID NO: 99383 - DNA, 25 bp, E. coli
tgctaaccccaaatacgaaatgaat

SEQ ID NO: 99384 - DNA, 25 bp, E. coli
tggaatatacaccagacaaagggct

SEQ ID NO: 99385 - DNA, 25 bp, E. coli
tgctaaccccaattacgaaatgaat

SEQ ID NO: 99386 - DNA, 25 bp, E. coli
ggcaacgtcacaagaactcttatca

SEQ ID NO: 99387 - DNA, 25 bp, E. coli
caacgaactggtcacgatggaactc

SEQ ID NO: 99388 - DNA, 25 bp, E. coli
caacgaactggtgacgatggaactc

SEQ ID NO: 99389 - DNA, 25 bp, E. coli
taaaacgtgcctttggtgaatcggc

SEQ ID NO: 99390 - DNA, 25 bp, E. coli
tactatgccgtttgatgccgtcaca

SEQ ID NO: 99391 - DNA, 25 bp, E. coli
tactatgccgttagatgccgtcaca

SEQ ID NO: 99392 - DNA, 25 bp, E. coli
taaaacgtgcctatggtgaatcggc

SEQ ID NO: 99393 - DNA, 25 bp, E. coli
tacgcagtctgatggaacacggcgc

SEQ ID NO: 99394 - DNA, 25 bp, E. coli
tacgacagcagcaagccggttggtc

SEQ ID NO: 99395 - DNA, 25 bp, E. coli
tacgcagtctgaaggaacacggcgc

SEQ ID NO: 99396 - DNA, 25 bp, E. coli
tacgacagcagctagccggttggtc

SEQ ID NO: 99397 - DNA, 25 bp, E. coli
tttacgctgacgagtggaagcccga

SEQ ID NO: 99398 - DNA, 25 bp, E. coli
tataaagtgccgaggatcgctgacg

SEQ ID NO: 99399 - DNA, 25 bp, E. coli
tataaagtgccgtggatcgctgacg

SEQ ID NO: 99400 - DNA, 25 bp, E. coli
tttacgctgacgtgtggaagcccga

SEQ ID NO: 99401 - DNA, 25 bp, E. coli
ttcaaagcgggctacaccattacgg

SEQ ID NO: 99402 - DNA, 25 bp, E. coli
ttcaaagcgggcaacaccattacgg

SEQ ID NO: 99403 - DNA, 25 bp, E. coli
tgatccacgaagctgttccagcccg

SEQ ID NO: 99404 - DNA, 25 bp, E. coli
tgatccacgaaggtgttccagcccg

SEQ ID NO: 99405 - DNA, 25 bp, E. coli
gacatgcacatgagggtacgccgga

SEQ ID NO: 99406 - DNA, 25 bp, E. coli
gacatgcacatgtgggtacgccgga

SEQ ID NO: 99407 - DNA, 25 bp, E. coli
tggcggctgggcaaatatcactacg

SEQ ID NO: 99408 - DNA, 25 bp, E. coli
tggcggctgggctaatatcactacg

SEQ ID NO: 99409 - DNA, 25 bp, E. coli
caactcaggccgcagctgatggttg

SEQ ID NO: 99410 - DNA, 25 bp, E. coli
aatagcctgccgcaactcaggccgg

SEQ ID NO: 99411 - DNA, 25 bp, E. coli
caactcaggccggagctgatggttg

SEQ ID NO: 99412 - DNA, 25 bp, E. coli
aatagcctgccggaactcaggccgg

SEQ ID NO: 99413 - DNA, 25 bp, E. coli
atggttgccagaccggccatgcgat

SEQ ID NO: 99414 - DNA, 25 bp, E. coli
atggttgccagagcggccatgcgat

SEQ ID NO: 99415 - DNA, 25 bp, E. coli
actcaggccggagctgatggttgcc

SEQ ID NO: 99416 - DNA, 25 bp, E. coli
actcaggccggacctgatggttgcc

SEQ ID NO: 99417 - DNA, 25 bp, E. coli
tgcgattcccttctcctgctctctg

SEQ ID NO: 99418 - DNA, 25 bp, E. coli
tgctctctgcaatgcccagacctga

SEQ ID NO: 99419 - DNA, 25 bp, E. coli
tgcgattcccttgtcctgctctctg

SEQ ID NO: 99420 - DNA, 25 bp, E. coli
tgctctctgcaaagcccagacctga

SEQ ID NO: 99421 - DNA, 25 bp, E. coli
tgccgcaactcaggccggagctgat

SEQ ID NO: 99422 - DNA, 25 bp, E. coli
tgccgcaactcacgccggagctgat

SEQ ID NO: 99423 - DNA, 25 bp, E. coli
gccagagcggccatgcgattccctt

SEQ ID NO: 99424 - DNA, 25 bp, E. coli
gccagagcggccttgcgattccctt

SEQ ID NO: 99425 - DNA, 25 bp, E. coli
ctgccgcgcacagcggcccgaatag

SEQ ID NO: 99426 - DNA, 25 bp, E. coli
ctgccgcgcacaccggcccgaatag

SEQ ID NO: 99427 - DNA, 25 bp, E. coli
ctgatggttgccagagcggccatgc

SEQ ID NO: 99428 - DNA, 25 bp, E. coli
ctgatggttgcctgagcggccatgc

SEQ ID NO: 99429 - DNA, 25 bp, E. coli
tggccagcattggtgccgcgcacag

SEQ ID NO: 99430 - DNA, 25 bp, E. coli
tggccagcattgctgccgcgcacag

SEQ ID NO: 99431 - DNA, 25 bp, E. coli
cagacggctattgctgcggtgagaa

SEQ ID NO: 99432 - DNA, 25 bp, E. coli
cacaagtcattatttcagcagtgta

SEQ ID NO: 99433 - DNA, 25 bp, E. coli
cacaagtcattaattcagcagtgta

SEQ ID NO: 99434 - DNA, 25 bp, E. coli
cagtgtatgaattaaaagaggtgca

SEQ ID NO: 99435 - DNA, 25 bp, E. coli
cagtgtatgaataaaaagaggtgca

SEQ ID NO: 99436 - DNA, 25 bp, E. coli
cagacggctattcctgcggtgagaa

SEQ ID NO: 99437 - DNA, 25 bp, E. coli
aaaaccttccgtgtatttgccagcg

SEQ ID NO: 99438 - DNA, 25 bp, E. coli
aaaaccttccgtctatttgccagcg

SEQ ID NO: 99439 - DNA, 25 bp, E. coli
tatcgctcagaatgtgaaggctgtt

SEQ ID NO: 99440 - DNA, 25 bp, E. coli
tatcgctcagaaagtgaaggctgtt

SEQ ID NO: 99441 - DNA, 25 bp, E. coli
tgaaggctgttaatgttcagacggc

SEQ ID NO: 99442 - DNA, 25 bp, E. coli
tgaaggctgttattgttcagacggc

SEQ ID NO: 99443 - DNA, 25 bp, E. coli
tcatcagaatatcgcttatcacaag

SEQ ID NO: 99444 - DNA, 25 bp, E. coli
tcatcagaatatggcttatcacaag

SEQ ID NO: 99445 - DNA, 25 bp, E. coli
gccacacaattggtatcgctcagaa

SEQ ID NO: 99446 - DNA, 25 bp, E. coli
gccacacaattgctatcgctcagaa

SEQ ID NO: 99447 - DNA, 25 bp, E. coli
gcggtgagaagcgaatcatcagaat

SEQ ID NO: 99448 - DNA, 25 bp, E. coli
gcggtgagaagccaatcatcagaat

SEQ ID NO: 99449 - DNA, 25 bp, E. coli
gttaacccactacgccacacaattg

SEQ ID NO: 99450 - DNA, 25 bp, E. coli
gttaacccactaggccacacaattg

SEQ ID NO: 99451 - DNA, 25 bp, E. coli
gtgtatttgccagcgctgttaaccc

SEQ ID NO: 99452 - DNA, 25 bp, E. coli
gtgtatttgccaccgctgttaaccc

SEQ ID NO: 99453 - DNA, 25 bp, E. coli
caaagttgtggccatgacggtgctc

SEQ ID NO: 99454 - DNA, 25 bp, E. coli
caaagcgtggactttactgctggca

SEQ ID NO: 99455 - DNA, 25 bp, E. coli
caaagttgtggcgatgacggtgctc

SEQ ID NO: 99456 - DNA, 25 bp, E. coli
caaagcgtggacattactgctggca

SEQ ID NO: 99457 - DNA, 25 bp, E. coli
taaacaatgcgcagtggtcgcggga

SEQ ID NO: 99458 - DNA, 25 bp, E. coli
taaacaatgcgctgtggtcgcggga

SEQ ID NO: 99459 - DNA, 25 bp, E. coli
tgatgcactcactggcggtcactga

SEQ ID NO: 99460 - DNA, 25 bp, E. coli
tgatgcactcacaggcggtcactga

SEQ ID NO: 99461 - DNA, 25 bp, E. coli
tccgcatgggcctattacgaactcg

SEQ ID NO: 99462 - DNA, 25 bp, E. coli
tccgcatgggccaattacgaactcg

SEQ ID NO: 99463 - DNA, 25 bp, E. coli
gctggtatcggtacacgcgtttgcg

SEQ ID NO: 99464 - DNA, 25 bp, E. coli
gctggtcaatgcattcgtggtcaac

SEQ ID NO: 99465 - DNA, 25 bp, E. coli
gctggtcaatgctttcgtggtcaac

SEQ ID NO: 99466 - DNA, 25 bp, E. coli
gctggtatcggttcacgcgtttgcg

SEQ ID NO: 99467 - DNA, 25 bp, E. coli
gactgggcagtaattcgattggcga

SEQ ID NO: 99468 - DNA, 25 bp, E. coli
gactgggcagtatttcgattggcga

SEQ ID NO: 99469 - DNA, 25 bp, E. coli
cgttattacaactctgccgggtcga

SEQ ID NO: 99470 - DNA, 25 bp, E. coli
cgttattacaacactgccgggtcga

SEQ ID NO: 99471 - DNA, 25 bp, E. coli
tggacacaaagttcgctcacgcgta

SEQ ID NO: 99472 - DNA, 25 bp, E. coli
tggacacaaagtacgctcacgcgta

SEQ ID NO: 99473 - DNA, 25 bp, E. coli
gatgtgcgcatgaagtccggcgata

SEQ ID NO: 99474 - DNA, 25 bp, E. coli
gatgtgcgcatgtagtccggcgata

SEQ ID NO: 99475 - DNA, 25 bp, E. coli
aatgcccggcggatgaaatcactca

SEQ ID NO: 99476 - DNA, 25 bp, E. coli
aatgcccggcggttgaaatcactca

SEQ ID NO: 99477 - DNA, 25 bp, E. coli
aaagctggctggtgaagtgccgcca

SEQ ID NO: 99478 - DNA, 25 bp, E. coli
aaagctggctggagaagtgccgcca

SEQ ID NO: 99479 - DNA, 25 bp, E. coli
tgaaaaacctgaaaaaccgccagcg

SEQ ID NO: 99480 - DNA, 25 bp, E. coli
tgaaaaacctgataaaccgccagcg

SEQ ID NO: 99481 - DNA, 25 bp, E. coli
tcagttagcagacactgccagcgcg

SEQ ID NO: 99482 - DNA, 25 bp, E. coli
tcagttagcagagactgccagcgcg

SEQ ID NO: 99483 - DNA, 25 bp, E. coli
gccggtacggttttgctgcaacaac

SEQ ID NO: 99484 - DNA, 25 bp, E. coli
cctggcgcggcatcggattgtcttt

SEQ ID NO: 99485 - DNA, 25 bp, E. coli
ccagcgcgcggctaagattggcgta

SEQ ID NO: 99486 - DNA, 25 bp, E. coli
gccggtacggttatgctgcaacaac

SEQ ID NO: 99487 - DNA, 25 bp, E. coli
ccagcgcgcggcaaagattggcgta

SEQ ID NO: 99488 - DNA, 25 bp, E. coli
cctggcgcggcaacggattgtcttt

SEQ ID NO: 99489 - DNA, 25 bp, E. coli
gatatcttatcggtggcctggcgcg

SEQ ID NO: 99490 - DNA, 25 bp, E. coli
gatatcttatcgctggcctggcgcg

SEQ ID NO: 99491 - DNA, 25 bp, E. coli
gtagcaatcagtcatgacgccgcat

SEQ ID NO: 99492 - DNA, 25 bp, E. coli
gtagcaatcagtgatgacgccgcat

SEQ ID NO: 99493 - DNA, 25 bp, E. coli
taatggcaggtcttcttacgcccac

SEQ ID NO: 99494 - DNA, 25 bp, E. coli
taatggcaggtcatcttacgcccac

SEQ ID NO: 99495 - DNA, 25 bp, E. coli
gatctgcatagtccgcagcgacgga

SEQ ID NO: 99496 - DNA, 25 bp, E. coli
gatctgcatagtgcgcagcgacgga

SEQ ID NO: 99497 - DNA, 25 bp, E. coli
caagcgccatattacttccaggaag

SEQ ID NO: 99498 - DNA, 25 bp, E. coli
caagcgccatataacttccaggaag

SEQ ID NO: 99499 - DNA, 25 bp, E. coli
caggccatgagtgaaaactacgcgg

SEQ ID NO: 99500 - DNA, 25 bp, E. coli
caggccatgagtcaaaactacgcgg

SEQ ID NO: 99501 - DNA, 25 bp, E. coli
tacaaagtcgccttgctgatgcaag

SEQ ID NO: 99502 - DNA, 25 bp, E. coli
tacaaagtcgccatgctgatgcaag

SEQ ID NO: 99503 - DNA, 25 bp, E. coli
acgccgttcgttttgagtgccagac

SEQ ID NO: 99504 - DNA, 25 bp, E. coli
acgccgttcgttatgagtgccagac

SEQ ID NO: 99505 - DNA, 25 bp, E. coli
aactacgcggcgatgtctttgcaag

SEQ ID NO: 99506 - DNA, 25 bp, E. coli
aactacgcggcgttgtctttgcaag

SEQ ID NO: 99507 - DNA, 25 bp, E. coli
ttccaggaagcggagattgaagccg

SEQ ID NO: 99508 - DNA, 25 bp, E. coli
ttccaggaagcgcagattgaagccg

SEQ ID NO: 99509 - DNA, 25 bp, E. coli
ccatcaggatgaattgccgttagcg

SEQ ID NO: 99510 - DNA, 25 bp, E. coli
ccatcaggatgatttgccgttagcg

SEQ ID NO: 99511 - DNA, 25 bp, E. coli
gaacggagactaggcggatatcgct

SEQ ID NO: 99512 - DNA, 25 bp, E. coli
gaacggagactacgcggatatcgct

SEQ ID NO: 99513 - DNA, 25 bp, E. coli
cgagcgatttatgacctatggcaag

SEQ ID NO: 99514 - DNA, 25 bp, E. coli
cgagcgatttatcacctatggcaag

SEQ ID NO: 99515 - DNA, 25 bp, E. coli
gattactattactcaacgcaggcca

SEQ ID NO: 99516 - DNA, 25 bp, E. coli
gattactattacacaacgcaggcca

SEQ ID NO: 99517 - DNA, 25 bp, E. coli
ggtagagcagttacagaacccctga

SEQ ID NO: 99518 - DNA, 25 bp, E. coli
ggtagagcagtttcagaacccctga

SEQ ID NO: 99519 - DNA, 25 bp, E. coli
cataaagtttatgtttccaggaata

SEQ ID NO: 99520 - DNA, 25 bp, E. coli
cataaagtttatctttccaggaata

SEQ ID NO: 99521 - DNA, 25 bp, E. coli
agctccttgctgtaagataatttcg

SEQ ID NO: 99522 - DNA, 25 bp, E. coli
agctccttgctgaaagataatttcg

SEQ ID NO: 99523 - DNA, 25 bp, E. coli
tttccctgggtacatggcataaagt

SEQ ID NO: 99524 - DNA, 25 bp, E. coli
tagcgcagaaagagttatttatccg

SEQ ID NO: 99525 - DNA, 25 bp, E. coli
tagcgcagaaagtgttatttatccg

SEQ ID NO: 99526 - DNA, 25 bp, E. coli
tttccctgggtagatggcataaagt

SEQ ID NO: 99527 - DNA, 25 bp, E. coli
tatccgtaagatgttgcatgacctg

SEQ ID NO: 99528 - DNA, 25 bp, E. coli
tatccgtaagatcttgcatgacctg

SEQ ID NO: 99529 - DNA, 25 bp, E. coli
tatactgaagatgattttccctggg

SEQ ID NO: 99530 - DNA, 25 bp, E. coli
tatactgaagatcattttccctggg

SEQ ID NO: 99531 - DNA, 25 bp, E. coli
tccaggaatattgcatgtcatagtt

SEQ ID NO: 99532 - DNA, 25 bp, E. coli
tccaggaatattccatgtcatagtt

SEQ ID NO: 99533 - DNA, 25 bp, E. coli
tctccgacggttaacataattacta

SEQ ID NO: 99534 - DNA, 25 bp, E. coli
tctccgacggtttacataattacta

SEQ ID NO: 99535 - DNA, 25 bp, E. coli
gcgattttccttagttagcgcagaa

SEQ ID NO: 99536 - DNA, 25 bp, E. coli
gcgattttcctttgttagcgcagaa

SEQ ID NO: 99537 - DNA, 25 bp, E. coli
cttgcatgacctcaaaagaatattg

SEQ ID NO: 99538 - DNA, 25 bp, E. coli
cttgcatgacctgaaaagaatattg

SEQ ID NO: 99539 - DNA, 25 bp, E. coli
ttaccgtacgtaatgttctccgacg

SEQ ID NO: 99540 - DNA, 25 bp, E. coli
ttaccgtacgtattgttctccgacg

SEQ ID NO: 99541 - DNA, 25 bp, E. coli
caggctatcgagttggtcttaatgc

SEQ ID NO: 99542 - DNA, 25 bp, E. coli
catatgaacattaactgagggcgag

SEQ ID NO: 99543 - DNA, 25 bp, E. coli
catatgaacatttactgagggcgag

SEQ ID NO: 99544 - DNA, 25 bp, E. coli
caggctatcgagatggtcttaatgc

SEQ ID NO: 99545 - DNA, 25 bp, E. coli
tattgtcggagctattaagatcact

SEQ ID NO: 99546 - DNA, 25 bp, E. coli
tattgtcggagcaattaagatcact

SEQ ID NO: 99547 - DNA, 25 bp, E. coli
tgggttaaagatttccaggctatcg

SEQ ID NO: 99548 - DNA, 25 bp, E. coli
tgcttacagaagttatcataccaga

SEQ ID NO: 99549 - DNA, 25 bp, E. coli
tgcttacagaagatatcataccaga

SEQ ID NO: 99550 - DNA, 25 bp, E. coli
tcataccagaggataagttacagga

SEQ ID NO: 99551 - DNA, 25 bp, E. coli
tcataccagaggttaagttacagga

SEQ ID NO: 99552 - DNA, 25 bp, E. coli
gcttattaatgatgcaaacacaccg

SEQ ID NO: 99553 - DNA, 25 bp, E. coli
gcttattaatgaagcaaacacaccg

SEQ ID NO: 99554 - DNA, 25 bp, E. coli
gaataactttagacccattagagca

SEQ ID NO: 99555 - DNA, 25 bp, E. coli
gaataactttagtcccattagagca

SEQ ID NO: 99556 - DNA, 25 bp, E. coli
cattaaacttgatcctggcgaggcc

SEQ ID NO: 99557 - DNA, 25 bp, E. coli
cattaaacttgaacctggcgaggcc

SEQ ID NO: 99558 - DNA, 25 bp, E. coli
tggcgaggccaagaatatacagctt

SEQ ID NO: 99559 - DNA, 25 bp, E. coli
tggcgaggccaacaatatacagctt

SEQ ID NO: 99560 - DNA, 25 bp, E. coli
tgggttaaagatatccaggctatcg

SEQ ID NO: 99561 - DNA, 25 bp, E. coli
gatgatattatctaactggctcgaa

SEQ ID NO: 99562 - DNA, 25 bp, E. coli
gatgatattatcaaactggctcgaa

SEQ ID NO: 99563 - DNA, 25 bp, E. coli
tatccactgcagataacgggcttcc

SEQ ID NO: 99564 - DNA, 25 bp, E. coli
tatccactgcagttaacgggcttcc

SEQ ID NO: 99565 - DNA, 25 bp, E. coli
tatccagttggctcgagagatcggt

SEQ ID NO: 99566 - DNA, 25 bp, E. coli
tatccagttggcacgagagatcggt

SEQ ID NO: 99567 - DNA, 25 bp, E. coli
tatattctgggccaagggcctgacg

SEQ ID NO: 99568 - DNA, 25 bp, E. coli
tatattctgggcgaagggcctgacg

SEQ ID NO: 99569 - DNA, 25 bp, E. coli
tgatgaaaacctgcgcacttggcag

SEQ ID NO: 99570 - DNA, 25 bp, E. coli
tgattgccgcaaaagtgactccgcg

SEQ ID NO: 99571 - DNA, 25 bp, E. coli
tgattgccgcaatagtgactccgcg

SEQ ID NO: 99572 - DNA, 25 bp, E. coli
tgatgaaaacctccgcacttggcag

SEQ ID NO: 99573 - DNA, 25 bp, E. coli
tgaaaatccataccacagaggcgct

SEQ ID NO: 99574 - DNA, 25 bp, E. coli
tgaaaatccatagcacagaggcgct

SEQ ID NO: 99575 - DNA, 25 bp, E. coli
gaatatgggctaagtgatcctcgcc

SEQ ID NO: 99576 - DNA, 25 bp, E. coli
gaatatgggctatgtgatcctcgcc

SEQ ID NO: 99577 - DNA, 25 bp, E. coli
gaaatatcccatgaagcgcgtcggc

SEQ ID NO: 99578 - DNA, 25 bp, E. coli
gaaatatcccatcaagcgcgtcggc

SEQ ID NO: 99579 - DNA, 25 bp, E. coli
gaaagcggtctggagttcctgcacc

SEQ ID NO: 99580 - DNA, 25 bp, E. coli
gaaagcggtctgcagttcctgcacc

SEQ ID NO: 99581 - DNA, 25 bp, E. coli
gactacgaggagatgaaaacgaccg

SEQ ID NO: 99582 - DNA, 25 bp, E. coli
gactacgaggagttgaaaacgaccg

SEQ ID NO: 99583 - DNA, 25 bp, E. coli
gatgctgagtgaagtcgccaaacgc

SEQ ID NO: 99584 - DNA, 25 bp, E. coli
gatgctgagtgatgtcgccaaacgc

SEQ ID NO: 99585 - DNA, 25 bp, E. coli
aagaagcctatattgcccggttgcg

SEQ ID NO: 99586 - DNA, 25 bp, E. coli
aagaagcctataatgcccggttgcg

SEQ ID NO: 99587 - DNA, 25 bp, E. coli
caaatagtttaagccgcagtacgga

SEQ ID NO: 99588 - DNA, 25 bp, E. coli
caaatagtttaacccgcagtacgga

SEQ ID NO: 99589 - DNA, 25 bp, E. coli
aaatgcctgggaaaaatcacgctca

SEQ ID NO: 99590 - DNA, 25 bp, E. coli
aaatgcctgggataaatcacgctca

SEQ ID NO: 99591 - DNA, 25 bp, E. coli
tattattaccgttgccgcctgctgc

SEQ ID NO: 99592 - DNA, 25 bp, E. coli
tattattaccgtagccgcctgctgc

SEQ ID NO: 99593 - DNA, 25 bp, E. coli
ttggaagatgccagcgaatgcagcg

SEQ ID NO: 99594 - DNA, 25 bp, E. coli
ttggaagatgcctgcgaatgcagcg

SEQ ID NO: 99595 - DNA, 25 bp, E. coli
tttttccactggagcgcaatgccgc

SEQ ID NO: 99596 - DNA, 25 bp, E. coli
tttttccactggtgcgcaatgccgc

SEQ ID NO: 99597 - DNA, 25 bp, E. coli
tgatgcggatgaatctcacctgggc

SEQ ID NO: 99598 - DNA, 25 bp, E. coli
tgatgcggatgattctcacctgggc

SEQ ID NO: 99599 - DNA, 25 bp, E. coli
tcttcgagagcgttcgcgggcgtat

SEQ ID NO: 99600 - DNA, 25 bp, E. coli
tcttcgagagcgatcgcgggcgtat

SEQ ID NO: 99601 - DNA, 25 bp, E. coli
ggcgtatcatcatctctccggcaat

SEQ ID NO: 99602 - DNA, 25 bp, E. coli
ggcgtatcatcaactctccggcaat

SEQ ID NO: 99603 - DNA, 25 bp, E. coli
tggattatggaagctgccgacgaca

SEQ ID NO: 99604 - DNA, 25 bp, E. coli
tggattatggaacctgccgacgaca

SEQ ID NO: 99605 - DNA, 25 bp, E. coli
gatgaataccgacgtctgatggccg

SEQ ID NO: 99606 - DNA, 25 bp, E. coli
gatgaataccgaggtctgatggccg

SEQ ID NO: 99607 - DNA, 25 bp, E. coli
caggcttctttgtgctgcaaccggg

SEQ ID NO: 99608 - DNA, 25 bp, E. coli
caggcttctttgagctgcaaccggg

SEQ ID NO: 99609 - DNA, 25 bp, E. coli
taaagcgtttgaactctcagcgccc

SEQ ID NO: 99610 - DNA, 25 bp, E. coli
taaagcgtttgatctctcagcgccc

SEQ ID NO: 99611 - DNA, 25 bp, E. coli
tgatcacaggcaacgtcgagggctt

SEQ ID NO: 99612 - DNA, 25 bp, E. coli
tgatcacaggcatcgtcgagggctt

SEQ ID NO: 99613 - DNA, 25 bp, E. coli
tcttgatatgacacggcgtgaccgt

SEQ ID NO: 99614 - DNA, 25 bp, E. coli
tcttgatatgactcggcgtgaccgt

SEQ ID NO: 99615 - DNA, 25 bp, E. coli
cattcttcttctgcaaaccggcgga

SEQ ID NO: 99616 - DNA, 25 bp, E. coli
cattcttcttctccaaaccggcgga

SEQ ID NO: 99617 - DNA, 25 bp, E. coli
gatattcgccatctcatctggtcgg

SEQ ID NO: 99618 - DNA, 25 bp, E. coli
gatattcgccatgtcatctggtcgg

SEQ ID NO: 99619 - DNA, 25 bp, E. coli
ggtaaaaaaggcagcgatatcccgc

SEQ ID NO: 99620 - DNA, 25 bp, E. coli
gtgatgaacaataccccgtgcgccg

SEQ ID NO: 99621 - DNA, 25 bp, E. coli
ggtaaaaaaggctgcgatatcccgc

SEQ ID NO: 99622 - DNA, 25 bp, E. coli
gtgatgaacaattccccgtgcgccg

SEQ ID NO: 99623 - DNA, 25 bp, E. coli
taacggcgaagatcatcagcgcagc

SEQ ID NO: 99624 - DNA, 25 bp, E. coli
tcaaatggaaatccgccagatgggc

SEQ ID NO: 99625 - DNA, 25 bp, E. coli
tcaatacgtattggaaccgcaagcg

SEQ ID NO: 99626 - DNA, 25 bp, E. coli
taacggcgaagaacatcagcgcagc

SEQ ID NO: 99627 - DNA, 25 bp, E. coli
tcaatacgtattcgaaccgcaagcg

SEQ ID NO: 99628 - DNA, 25 bp, E. coli
tcaaatggaaatgcgccagatgggc

SEQ ID NO: 99629 - DNA, 25 bp, E. coli
aagccgacacagcaagtgaccgacg

SEQ ID NO: 99630 - DNA, 25 bp, E. coli
tacgcgtcgatgatggcaaccattg

SEQ ID NO: 99631 - DNA, 25 bp, E. coli
aagccgacacaggaagtgaccgacg

SEQ ID NO: 99632 - DNA, 25 bp, E. coli
tacgcgtcgatgttggcaaccattg

SEQ ID NO: 99633 - DNA, 25 bp, E. coli
tgctgactggtcacatcatgttcca

SEQ ID NO: 99634 - DNA, 25 bp, E. coli
tgctgactggtctcatcatgttcca

SEQ ID NO: 99635 - DNA, 25 bp, E. coli
gcctgtggctctacaatcctgatta

SEQ ID NO: 99636 - DNA, 25 bp, E. coli
gcctgtggctcttcaatcctgatta

SEQ ID NO: 99637 - DNA, 25 bp, E. coli
gcaatttccgattcttacgcgtcga

SEQ ID NO: 99638 - DNA, 25 bp, E. coli
gcaatttccgatacttacgcgtcga

SEQ ID NO: 99639 - DNA, 25 bp, E. coli
gacacaggaagtcaccgacggctgt

SEQ ID NO: 99640 - DNA, 25 bp, E. coli
gacacaggaagtgaccgacggctgt

SEQ ID NO: 99641 - DNA, 25 bp, E. coli
cgtaccatcatggtgactggtcaca

SEQ ID NO: 99642 - DNA, 25 bp, E. coli
cgtaccatcatgctgactggtcaca

SEQ ID NO: 99643 - DNA, 25 bp, E. coli
gtcgcattaccgctattcgtaccat

SEQ ID NO: 99644 - DNA, 25 bp, E. coli
gtcgcattaccggtattcgtaccat

SEQ ID NO: 99645 - DNA, 25 bp, E. coli
ggtattcgtaccatcatgctgactg

SEQ ID NO: 99646 - DNA, 25 bp, E. coli
ggtattcgtaccttcatgctgactg

SEQ ID NO: 99647 - DNA, 25 bp, E. coli
ggtcgcctgtgggtcttcaatcctg

SEQ ID NO: 99648 - DNA, 25 bp, E. coli
ggtcgcctgtggctcttcaatcctg

SEQ ID NO: 99649 - DNA, 25 bp, E. coli
gatgatggcaacgattgaacgcatg

SEQ ID NO: 99650 - DNA, 25 bp, E. coli
gatgatggcaaccattgaacgcatg

SEQ ID NO: 99651 - DNA, 25 bp, E. coli
catctgttggtagaattatttgtta

SEQ ID NO: 99652 - DNA, 25 bp, E. coli
catctgttggtacaattatttgtta

SEQ ID NO: 99653 - DNA, 25 bp, E. coli
attgtcacgaagcacaccacattaa

SEQ ID NO: 99654 - DNA, 25 bp, E. coli
attgtcacgaaggacaccacattaa

SEQ ID NO: 99655 - DNA, 25 bp, E. coli
ttcggccaacggctggacctgccag

SEQ ID NO: 99656 - DNA, 25 bp, E. coli
ttcggccaacgggtggacctgccag

SEQ ID NO: 99657 - DNA, 25 bp, E. coli
tattgtcacgaagcacaccacatta

SEQ ID NO: 99658 - DNA, 25 bp, E. coli
tattgtcacgaaccacaccacatta

SEQ ID NO: 99659 - DNA, 25 bp, E. coli
tattaatttattgtcacgaagcaca

SEQ ID NO: 99660 - DNA, 25 bp, E. coli
tattaatttattctcacgaagcaca

SEQ ID NO: 99661 - DNA, 25 bp, E. coli
tttttcggccaagggctggacctgc

SEQ ID NO: 99662 - DNA, 25 bp, E. coli
tttttcggccaacggctggacctgc

SEQ ID NO: 99663 - DNA, 25 bp, E. coli
tttattgtcacgtagcacaccacat

SEQ ID NO: 99664 - DNA, 25 bp, E. coli
tttattgtcacgaagcacaccacat

SEQ ID NO: 99665 - DNA, 25 bp, E. coli
tcggtattgtccagattagcttact

SEQ ID NO: 99666 - DNA, 25 bp, E. coli
tcggtattgtcctgattagcttact

SEQ ID NO: 99667 - DNA, 25 bp, E. coli
gccatctgttggtacaattatttgt

SEQ ID NO: 99668 - DNA, 25 bp, E. coli
gccatctgttggaacaattatttgt

SEQ ID NO: 99669 - DNA, 25 bp, E. coli
ggagtcggtattgtcctgattagct

SEQ ID NO: 99670 - DNA, 25 bp, E. coli
ggagtcggtattctcctgattagct

SEQ ID NO: 99671 - DNA, 25 bp, E. coli
taatttattgtcacgaagcacacca

SEQ ID NO: 99672 - DNA, 25 bp, E. coli
taatttattgtctcgaagcacacca

SEQ ID NO: 99673 - DNA, 25 bp, E. coli
caattgcaggctgaggctgcgttca

SEQ ID NO: 99674 - DNA, 25 bp, E. coli
caattgcaggctcaggctgcgttca

SEQ ID NO: 99675 - DNA, 25 bp, E. coli
tacccttgatggtgcctgtacatag

SEQ ID NO: 99676 - DNA, 25 bp, E. coli
tacccttgatggagcctgtacatag

SEQ ID NO: 99677 - DNA, 25 bp, E. coli
aaaaatcatccatccggctggtcag

SEQ ID NO: 99678 - DNA, 25 bp, E. coli
aaaaatcatccaaccggctggtcag

SEQ ID NO: 99679 - DNA, 25 bp, E. coli
ttgtaagccggaacggaggcaacgt

SEQ ID NO: 99680 - DNA, 25 bp, E. coli
ttgtaagccggatcggaggcaacgt

SEQ ID NO: 99681 - DNA, 25 bp, E. coli
ttatggacgacaaacaattgcaggc

SEQ ID NO: 99682 - DNA, 25 bp, E. coli
ttatggacgacatacaattgcaggc

SEQ ID NO: 99683 - DNA, 25 bp, E. coli
tcgcaaccggcgatagatgcttcat

SEQ ID NO: 99684 - DNA, 25 bp, E. coli
tcgcaaccggcgttagatgcttcat

SEQ ID NO: 99685 - DNA, 25 bp, E. coli
gcgttcagcaaaccatcgcaaccgg

SEQ ID NO: 99686 - DNA, 25 bp, E. coli
gcgttcagcaaagcatcgcaaccgg

SEQ ID NO: 99687 - DNA, 25 bp, E. coli
gaactcgacttctgataaatcacgc

SEQ ID NO: 99688 - DNA, 25 bp, E. coli
gacagagccattgcccatgatagtg

SEQ ID NO: 99689 - DNA, 25 bp, E. coli
gacagagccattccccatgatagtg

SEQ ID NO: 99690 - DNA, 25 bp, E. coli
gaactcgacttcagataaatcacgc

SEQ ID NO: 99691 - DNA, 25 bp, E. coli
gatggacactatttccccggaacct

SEQ ID NO: 99692 - DNA, 25 bp, E. coli
gaggcaacgtctactgggtgcaaaa

SEQ ID NO: 99693 - DNA, 25 bp, E. coli
gaggcaacgtcttctgggtgcaaaa

SEQ ID NO: 99694 - DNA, 25 bp, E. coli
gatggacactatatccccggaacct

SEQ ID NO: 99695 - DNA, 25 bp, E. coli
caagttgttgctatgggacgaccag

SEQ ID NO: 99696 - DNA, 25 bp, E. coli
caagttgttgctttgggacgaccag

SEQ ID NO: 99697 - DNA, 25 bp, E. coli
caaaggctccccactggaagatgaa

SEQ ID NO: 99698 - DNA, 25 bp, E. coli
caaaggctcccctctggaagatgaa

SEQ ID NO: 99699 - DNA, 25 bp, E. coli
aaaaatctttcgttgcacgttcgcg

SEQ ID NO: 99700 - DNA, 25 bp, E. coli
aaaaatctttcgatgcacgttcgcg

SEQ ID NO: 99701 - DNA, 25 bp, E. coli
tatgtgaagttaaagacgcgcctga

SEQ ID NO: 99702 - DNA, 25 bp, E. coli
tatgtgaagttatagacgcgcctga

SEQ ID NO: 99703 - DNA, 25 bp, E. coli
tatttgagaatgaccaacctggctg

SEQ ID NO: 99704 - DNA, 25 bp, E. coli
tatttgagaatgtccaacctggctg

SEQ ID NO: 99705 - DNA, 25 bp, E. coli
gaattactggcgctagagatcgcgc

SEQ ID NO: 99706 - DNA, 25 bp, E. coli
gaattactggcggtagagatcgcgc

SEQ ID NO: 99707 - DNA, 25 bp, E. coli
gaatgttcattatctcgtgccacgc

SEQ ID NO: 99708 - DNA, 25 bp, E. coli
gaatgttcattaactcgtgccacgc

SEQ ID NO: 99709 - DNA, 25 bp, E. coli
gacccagaatggtatggttccgacg

SEQ ID NO: 99710 - DNA, 25 bp, E. coli
gactaaaatattccccgaggctgag

SEQ ID NO: 99711 - DNA, 25 bp, E. coli
gactaaaatattgcccgaggctgag

SEQ ID NO: 99712 - DNA, 25 bp, E. coli
cgtgccacgcattgatgagaactct

SEQ ID NO: 99713 - DNA, 25 bp, E. coli
cgtgccacgcatagatgagaactct

SEQ ID NO: 99714 - DNA, 25 bp, E. coli
gacccagaatggaatggttccgacg

SEQ ID NO: 99715 - DNA, 25 bp, E. coli
gagcgcgactcaggtttcataacca

SEQ ID NO: 99716 - DNA, 25 bp, E. coli
gagcgcgactcacgtttcataacca

SEQ ID NO: 99717 - DNA, 25 bp, E. coli
caaactgctggtagttgcggcgctg

SEQ ID NO: 99718 - DNA, 25 bp, E. coli
caaactgctggttgttgcggcgctg

SEQ ID NO: 99719 - DNA, 25 bp, E. coli
caggctgaaaagctctctcataaag

SEQ ID NO: 99720 - DNA, 25 bp, E. coli
caggctgaaaaggtctctcataaag

SEQ ID NO: 99721 - DNA, 25 bp, E. coli
tagttgcggcgcaggtcgttctgct

SEQ ID NO: 99722 - DNA, 25 bp, E. coli
tagttgcggcgctggtcgttctgct

SEQ ID NO: 99723 - DNA, 25 bp, E. coli
aaaggcgcagaccttgatcttcagg

SEQ ID NO: 99724 - DNA, 25 bp, E. coli
aaaggcgcagacgttgatcttcagg

SEQ ID NO: 99725 - DNA, 25 bp, E. coli
ccattaaagggtacaagaaggcgat

SEQ ID NO: 99726 - DNA, 25 bp, E. coli
ccattaaagggttcaagaaggcgat

SEQ ID NO: 99727 - DNA, 25 bp, E. coli
cgatgctgcggccaaaaaaggcgca

SEQ ID NO: 99728 - DNA, 25 bp, E. coli
cgatgctgcggcgaaaaaaggcgca

SEQ ID NO: 99729 - DNA, 25 bp, E. coli
cggagaccttggagcggccattaaa

SEQ ID NO: 99730 - DNA, 25 bp, E. coli
cggagaccttggtgcggccattaaa

SEQ ID NO: 99731 - DNA, 25 bp, E. coli
tcaagaaggcgatgaatgatgacga

SEQ ID NO: 99732 - DNA, 25 bp, E. coli
taagaagttacgtacgctgggcgga

SEQ ID NO: 99733 - DNA, 25 bp, E. coli
tcaagaaggcgaagaatgatgacga

SEQ ID NO: 99734 - DNA, 25 bp, E. coli
taagaagttacgaacgctgggcgga

SEQ ID NO: 99735 - DNA, 25 bp, E. coli
gtcgttctgctgtttgggactaaga

SEQ ID NO: 99736 - DNA, 25 bp, E. coli
gagattagtattaccaaactgctgg

SEQ ID NO: 99737 - DNA, 25 bp, E. coli
gagattagtatttccaaactgctgg

SEQ ID NO: 99738 - DNA, 25 bp, E. coli
gtcgttctgctgattgggactaaga

SEQ ID NO: 99739 - DNA, 25 bp, E. coli
taaagccagctaagtgggcggcaac

SEQ ID NO: 99740 - DNA, 25 bp, E. coli
taaagccagctatgtgggcggcaac

SEQ ID NO: 99741 - DNA, 25 bp, E. coli
agcactggacgaatgctgcgcagag

SEQ ID NO: 99742 - DNA, 25 bp, E. coli
agcactggacgattgctgcgcagag

SEQ ID NO: 99743 - DNA, 25 bp, E. coli
aaaatcaatgagataaccggttgcc

SEQ ID NO: 99744 - DNA, 25 bp, E. coli
aaaatcaatgagttaaccggttgcc

SEQ ID NO: 99745 - DNA, 25 bp, E. coli
tatctgcacactgttacgtgagctg

SEQ ID NO: 99746 - DNA, 25 bp, E. coli
tatctgcacactcttacgtgagctg

SEQ ID NO: 99747 - DNA, 25 bp, E. coli
tgaaatcattacgtgccgggcgtgc

SEQ ID NO: 99748 - DNA, 25 bp, E. coli
tgaaatcattacctgccgggcgtgc

SEQ ID NO: 99749 - DNA, 25 bp, E. coli
gccgggacaggttaagccagctatg

SEQ ID NO: 99750 - DNA, 25 bp, E. coli
gccgggacaggtaaagccagctatg

SEQ ID NO: 99751 - DNA, 25 bp, E. coli
gctggtaaaacaatctcccggcgac

SEQ ID NO: 99752 - DNA, 25 bp, E. coli
gcgtatccgtgacccgcataaagat

SEQ ID NO: 99753 - DNA, 25 bp, E. coli
gctggtaaaacattctcccggcgac

SEQ ID NO: 99754 - DNA, 25 bp, E. coli
gcgactttggctaccagcgttcacg

SEQ ID NO: 99755 - DNA, 25 bp, E. coli
gcgtatccgtgagccgcataaagat

SEQ ID NO: 99756 - DNA, 25 bp, E. coli
gcgactttggcttccagcgttcacg

SEQ ID NO: 99757 - DNA, 25 bp, E. coli
cgcggacagcaaaaacgggtggtca

SEQ ID NO: 99758 - DNA, 25 bp, E. coli
cgcggacagcaataacgggtggtca

SEQ ID NO: 99759 - DNA, 25 bp, E. coli
taaccggttgccagttaaatgccgg

SEQ ID NO: 99760 - DNA, 25 bp, E. coli
taaccggttgcctgttaaatgccgg

SEQ ID NO: 99761 - DNA, 25 bp, E. coli
caacagtattgaggtgacgccggtc

SEQ ID NO: 99762 - DNA, 25 bp, E. coli
caacagtattgacgtgacgccggtc

SEQ ID NO: 99763 - DNA, 25 bp, E. coli
aacatacagtgaggtgaccggtgcc

SEQ ID NO: 99764 - DNA, 25 bp, E. coli
aacatacagtgacgtgaccggtgcc

SEQ ID NO: 99765 - DNA, 25 bp, E. coli
tataaagcaactcgctcgtcgcagc

SEQ ID NO: 99766 - DNA, 25 bp, E. coli
tataaagcaactggctcgtcgcagc

SEQ ID NO: 99767 - DNA, 25 bp, E. coli
tttattaccgtggaacagagtcagg

SEQ ID NO: 99768 - DNA, 25 bp, E. coli
ttactacgttattccactggccggg

SEQ ID NO: 99769 - DNA, 25 bp, E. coli
tttattaccgtgcaacagagtcagg

SEQ ID NO: 99770 - DNA, 25 bp, E. coli
ttactacgttataccactggccggg

SEQ ID NO: 99771 - DNA, 25 bp, E. coli
tcttctccatgcaggacggacggct

SEQ ID NO: 99772 - DNA, 25 bp, E. coli
tcttctccatgctggacggacggct

SEQ ID NO: 99773 - DNA, 25 bp, E. coli
tcattgatggtatggacgggacgcc

SEQ ID NO: 99774 - DNA, 25 bp, E. coli
tcattgatggtaaggacgggacgcc

SEQ ID NO: 99775 - DNA, 25 bp, E. coli
tcatcggtcgtagaaaagccgcgct

SEQ ID NO: 99776 - DNA, 25 bp, E. coli
tcatcggtcgtacaaaagccgcgct

SEQ ID NO: 99777 - DNA, 25 bp, E. coli
gaatttgactttgacggaacgccag

SEQ ID NO: 99778 - DNA, 25 bp, E. coli
gaagttcctcgtcgtttatgcagca

SEQ ID NO: 99779 - DNA, 25 bp, E. coli
gaagttcctcgtggtttatgcagca

SEQ ID NO: 99780 - DNA, 25 bp, E. coli
gaatttgactttcacggaacgccag

SEQ ID NO: 99781 - DNA, 25 bp, E. coli
gatggcgctccctgtaaatataacg

SEQ ID NO: 99782 - DNA, 25 bp, E. coli
gatggcgctcccagtaaatataacg

SEQ ID NO: 99783 - DNA, 25 bp, E. coli
cacttcaccgaatgtagtgtcctca

SEQ ID NO: 99784 - DNA, 25 bp, E. coli
cacttcaccgaaagtagtgtcctca

SEQ ID NO: 99785 - DNA, 25 bp, E. coli
tagtgtcctcatagcttacctcctg

SEQ ID NO: 99786 - DNA, 25 bp, E. coli
tagtgtcctcattgcttacctcctg

SEQ ID NO: 99787 - DNA, 25 bp, E. coli
tgagttttgcaaacagcctgttggc

SEQ ID NO: 99788 - DNA, 25 bp, E. coli
tgagttttgcaatcagcctgttggc

SEQ ID NO: 99789 - DNA, 25 bp, E. coli
cctggataaagtcacctgcatagca

SEQ ID NO: 99790 - DNA, 25 bp, E. coli
cctggataaagtgacctgcatagca

SEQ ID NO: 99791 - DNA, 25 bp, E. coli
gcatagcaggtgtctttaactcccc

SEQ ID NO: 99792 - DNA, 25 bp, E. coli
gcatagcaggtgactttaactcccc

SEQ ID NO: 99793 - DNA, 25 bp, E. coli
gaaaggcatattttcaggcgttctg

SEQ ID NO: 99794 - DNA, 25 bp, E. coli
gaaaggcatattatcaggcgttctg

SEQ ID NO: 99795 - DNA, 25 bp, E. coli
ggtatccacagagaaacctgaaggg

SEQ ID NO: 99796 - DNA, 25 bp, E. coli
ggtatccacagacaaacctgaaggg

SEQ ID NO: 99797 - DNA, 25 bp, E. coli
ggcgttctgctcgtccttctcaaag

SEQ ID NO: 99798 - DNA, 25 bp, E. coli
tggcagcttgccgtttcaaatcaat

SEQ ID NO: 99799 - DNA, 25 bp, E. coli
ggctattgtgcgctcatacactcaa

SEQ ID NO: 99800 - DNA, 25 bp, E. coli
tggcagcttgccctttcaaatcaat

SEQ ID NO: 99801 - DNA, 25 bp, E. coli
ggctattgtgcggtcatacactcaa

SEQ ID NO: 99802 - DNA, 25 bp, E. coli
ggcgttctgctcctccttctcaaag

SEQ ID NO: 99803 - DNA, 25 bp, E. coli
tcaaatcaataagcggtatccacag

SEQ ID NO: 99804 - DNA, 25 bp, E. coli
tcaaatcaataaccggtatccacag

SEQ ID NO: 99805 - DNA, 25 bp, E. coli
catgaagcgaaggatctggaatacc

SEQ ID NO: 99806 - DNA, 25 bp, E. coli
catgaagcgaagcatctggaatacc

SEQ ID NO: 99807 - DNA, 25 bp, E. coli
tcccggcagaagtagtcacagtacg

SEQ ID NO: 99808 - DNA, 25 bp, E. coli
tcccggcagaagaagtcacagtacg

SEQ ID NO: 99809 - DNA, 25 bp, E. coli
tctgacgatggataaaggcgactcg

SEQ ID NO: 99810 - DNA, 25 bp, E. coli
tctgacgatggaaaaaggcgactcg

SEQ ID NO: 99811 - DNA, 25 bp, E. coli
gccagccagacgtagaggattatga

SEQ ID NO: 99812 - DNA, 25 bp, E. coli
gccagccagacgaagaggattatga

SEQ ID NO: 99813 - DNA, 25 bp, E. coli
gcatatactgcatacctgggccagc

SEQ ID NO: 99814 - DNA, 25 bp, E. coli
gcatatactgcaaacctgggccagc

SEQ ID NO: 99815 - DNA, 25 bp, E. coli
gcatgagcgacctgattgaaaaccg

SEQ ID NO: 99816 - DNA, 25 bp, E. coli
gcatgagcgaccagattgaaaaccg

SEQ ID NO: 99817 - DNA, 25 bp, E. coli
gaaatgatgctggaagctaaccgca

SEQ ID NO: 99818 - DNA, 25 bp, E. coli
gaaatgatgctgcaagctaaccgca

SEQ ID NO: 99819 - DNA, 25 bp, E. coli
gattctcaagcatctcccggtaggt

SEQ ID NO: 99820 - DNA, 25 bp, E. coli
gattatgatgcgatccctcgtcgtg

SEQ ID NO: 99821 - DNA, 25 bp, E. coli
gattctcaagcaactcccggtaggt

SEQ ID NO: 99822 - DNA, 25 bp, E. coli
gattatgatgcgttccctcgtcgtg

SEQ ID NO: 99823 - DNA, 25 bp, E. coli
gatgcgacaaaagggagcggttcct

SEQ ID NO: 99824 - DNA, 25 bp, E. coli
gatcgactgccggaaacaactggtg

SEQ ID NO: 99825 - DNA, 25 bp, E. coli
gatgcgacaaaacggagcggttcct

SEQ ID NO: 99826 - DNA, 25 bp, E. coli
gatcgactgccgcaaacaactggtg

SEQ ID NO: 99827 - DNA, 25 bp, E. coli
aagtttcacctggactgtagaccgg

SEQ ID NO: 99828 - DNA, 25 bp, E. coli
aagtttcacctgcactgtagaccgg

SEQ ID NO: 99829 - DNA, 25 bp, E. coli
tagaccggataaggcattatcgcct

SEQ ID NO: 99830 - DNA, 25 bp, E. coli
tacgggaccaccaatgtaggtcgga

SEQ ID NO: 99831 - DNA, 25 bp, E. coli
tagaccggataacgcattatcgcct

SEQ ID NO: 99832 - DNA, 25 bp, E. coli
tacgggaccacctatgtaggtcgga

SEQ ID NO: 99833 - DNA, 25 bp, E. coli
tgcctgatgtgaggtttaacgtgtc

SEQ ID NO: 99834 - DNA, 25 bp, E. coli
tgcctgatgtgacgtttaacgtgtc

SEQ ID NO: 99835 - DNA, 25 bp, E. coli
tctccggcaattgaagcctgatgcg

SEQ ID NO: 99836 - DNA, 25 bp, E. coli
tcaggcctacgggtgaccgacaatg

SEQ ID NO: 99837 - DNA, 25 bp, E. coli
tcaggcctacggctgaccgacaatg

SEQ ID NO: 99838 - DNA, 25 bp, E. coli
tctccggcaattcaagcctgatgcg

SEQ ID NO: 99839 - DNA, 25 bp, E. coli
gcattatcgccttctccggcaattg

SEQ ID NO: 99840 - DNA, 25 bp, E. coli
gcattatcgcctactccggcaattg

SEQ ID NO: 99841 - DNA, 25 bp, E. coli
gacaatgcccggtagcgatacgaaa

SEQ ID NO: 99842 - DNA, 25 bp, E. coli
gacaatgcccggaagcgatacgaaa

SEQ ID NO: 99843 - DNA, 25 bp, E. coli
cgtttaacgtgtcttatcaggccta

SEQ ID NO: 99844 - DNA, 25 bp, E. coli
cgtttaacgtgtgttatcaggccta

SEQ ID NO: 99845 - DNA, 25 bp, E. coli
gataacgattactgaaggatggaca

SEQ ID NO: 99846 - DNA, 25 bp, E. coli
gataacgattacagaaggatggaca

SEQ ID NO: 99847 - DNA, 25 bp, E. coli
gatacgaaatatacggtctacggtt

SEQ ID NO: 99848 - DNA, 25 bp, E. coli
gatacgaaatattcggtctacggtt

SEQ ID NO: 99849 - DNA, 25 bp, E. coli
caaagtggttgtcgttcctgattca

SEQ ID NO: 99850 - DNA, 25 bp, E. coli
caaagtggttgtggttcctgattca

SEQ ID NO: 99851 - DNA, 25 bp, E. coli
catcttgccagcctaggtgaaggga

SEQ ID NO: 99852 - DNA, 25 bp, E. coli
catccttatgttcgccatcttgcca

SEQ ID NO: 99853 - DNA, 25 bp, E. coli
catcttgccagcgtaggtgaaggga

SEQ ID NO: 99854 - DNA, 25 bp, E. coli
catccttatgttggccatcttgcca

SEQ ID NO: 99855 - DNA, 25 bp, E. coli
aaaaattgtctagtgttgggcgcgc

SEQ ID NO: 99856 - DNA, 25 bp, E. coli
aaaaattgtctactgttgggcgcgc

SEQ ID NO: 99857 - DNA, 25 bp, E. coli
tgtgccgagtggatacaaagtggtt

SEQ ID NO: 99858 - DNA, 25 bp, E. coli
tgggcgcgcttttaatgggctttac

SEQ ID NO: 99859 - DNA, 25 bp, E. coli
tgtgccgagtggttacaaagtggtt

SEQ ID NO: 99860 - DNA, 25 bp, E. coli
tgggcgcgctttaaatgggctttac

SEQ ID NO: 99861 - DNA, 25 bp, E. coli
gaagggatggttttcgaacaccaga

SEQ ID NO: 99862 - DNA, 25 bp, E. coli
gaagggatggttatcgaacaccaga

SEQ ID NO: 99863 - DNA, 25 bp, E. coli
cgaacaccagatagacgaccatcac

SEQ ID NO: 99864 - DNA, 25 bp, E. coli
cgaacaccagattgacgaccatcac

SEQ ID NO: 99865 - DNA, 25 bp, E. coli
gttccacaagcgctcagcgtcgcga

SEQ ID NO: 99866 - DNA, 25 bp, E. coli
gttccacaagcggtcagcgtcgcga

SEQ ID NO: 99867 - DNA, 25 bp, E. coli
gtcagcgtcgcgactgtgccgcaaa

SEQ ID NO: 99868 - DNA, 25 bp, E. coli
gattcagtcagcgttccacaagcgg

SEQ ID NO: 99869 - DNA, 25 bp, E. coli
gattcagtcagccttccacaagcgg

SEQ ID NO: 99870 - DNA, 25 bp, E. coli
gtcagcgtcgcgtctgtgccgcaaa

SEQ ID NO: 99871 - DNA, 25 bp, E. coli
caggtgagcttctattttgctcata

SEQ ID NO: 99872 - DNA, 25 bp, E. coli
caggtgagcttcaattttgctcata

SEQ ID NO: 99873 - DNA, 25 bp, E. coli
acttcccagcctttcgctttcgcgg

SEQ ID NO: 99874 - DNA, 25 bp, E. coli
acttcccagcctatcgctttcgcgg

SEQ ID NO: 99875 - DNA, 25 bp, E. coli
tttctactttcacttcccagccttt

SEQ ID NO: 99876 - DNA, 25 bp, E. coli
tttctactttcagttcccagccttt

SEQ ID NO: 99877 - DNA, 25 bp, E. coli
tgcgccaggtgaccttcaattttgc

SEQ ID NO: 99878 - DNA, 25 bp, E. coli
tgcgccaggtgagcttcaattttgc

SEQ ID NO: 99879 - DNA, 25 bp, E. coli
gccaggtgagcttcaattttgctca

SEQ ID NO: 99880 - DNA, 25 bp, E. coli
gccaggtgagctacaattttgctca

SEQ ID NO: 99881 - DNA, 25 bp, E. coli
gcgccaggtgagcttcaattttgct

SEQ ID NO: 99882 - DNA, 25 bp, E. coli
gcgccaggtgaggttcaattttgct

SEQ ID NO: 99883 - DNA, 25 bp, E. coli
gtttgcgccaggtgagcttcaattt

SEQ ID NO: 99884 - DNA, 25 bp, E. coli
gtttgcgccaggagagcttcaattt

SEQ ID NO: 99885 - DNA, 25 bp, E. coli
ggtttctactttcacttcccagcct

SEQ ID NO: 99886 - DNA, 25 bp, E. coli
ggtttctactttgacttcccagcct

SEQ ID NO: 99887 - DNA, 25 bp, E. coli
tgggtttctactttcacttcccagc

SEQ ID NO: 99888 - DNA, 25 bp, E. coli
tgggtttctactatcacttcccagc

SEQ ID NO: 99889 - DNA, 25 bp, E. coli
taagcggtttgccccaggtgagctt

SEQ ID NO: 99890 - DNA, 25 bp, E. coli
taagcggtttgcgccaggtgagctt

SEQ ID NO: 99891 - DNA, 25 bp, E. coli
gagcttcaattttgctcataatggc

SEQ ID NO: 99892 - DNA, 25 bp, E. coli
gagcttcaatttagctcataatggc

SEQ ID NO: 99893 - DNA, 25 bp, E. coli
cataccggtaaaaacttcagcgccg

SEQ ID NO: 99894 - DNA, 25 bp, E. coli
cactttatcgacgttgagcaggcat

SEQ ID NO: 99895 - DNA, 25 bp, E. coli
cactttatcgaccttgagcaggcat

SEQ ID NO: 99896 - DNA, 25 bp, E. coli
cataccggtaaatacttcagcgccg

SEQ ID NO: 99897 - DNA, 25 bp, E. coli
tacatggactgaagaagagatccgc

SEQ ID NO: 99898 - DNA, 25 bp, E. coli
tacatggactgatgaagagatccgc

SEQ ID NO: 99899 - DNA, 25 bp, E. coli
tgaaccgttactccgcaaagagaat

SEQ ID NO: 99900 - DNA, 25 bp, E. coli
tgaaccgttactgcgcaaagagaat

SEQ ID NO: 99901 - DNA, 25 bp, E. coli
gctgctgttgatctccttcggtcga

SEQ ID NO: 99902 - DNA, 25 bp, E. coli
gcggttttcgcagctgagacgatca

SEQ ID NO: 99903 - DNA, 25 bp, E. coli
gcggttttcgcacctgagacgatca

SEQ ID NO: 99904 - DNA, 25 bp, E. coli
gctgctgttgatgtccttcggtcga

SEQ ID NO: 99905 - DNA, 25 bp, E. coli
gaatctgcggatgatcctgaccgga

SEQ ID NO: 99906 - DNA, 25 bp, E. coli
gaagcgggcgctctttaccaaaacg

SEQ ID NO: 99907 - DNA, 25 bp, E. coli
gaatctgcggatcatcctgaccgga

SEQ ID NO: 99908 - DNA, 25 bp, E. coli
gaagcgggcgctgtttaccaaaacg

SEQ ID NO: 99909 - DNA, 25 bp, E. coli
cgtaatcattcatccgtggcaggca

SEQ ID NO: 99910 - DNA, 25 bp, E. coli
cgtaatcattcaaccgtggcaggca

SEQ ID NO: 99911 - DNA, 25 bp, E. coli
taaccgcgtggtccaaggcgtaatc

SEQ ID NO: 99912 - DNA, 25 bp, E. coli
taaccgcgtggtgcaaggcgtaatc

SEQ ID NO: 99913 - DNA, 25 bp, E. coli
gatgaccagcagcattaccaccatg

SEQ ID NO: 99914 - DNA, 25 bp, E. coli
gatgaccagcaggattaccaccatg

SEQ ID NO: 99915 - DNA, 25 bp, E. coli
cagggcatctcacggattttaccga

SEQ ID NO: 99916 - DNA, 25 bp, E. coli
cagggcatctcagggattttaccga

SEQ ID NO: 99917 - DNA, 25 bp, E. coli
taaagcaccggttcgcacgatggta

SEQ ID NO: 99918 - DNA, 25 bp, E. coli
taaagcaccggtacgcacgatggta

SEQ ID NO: 99919 - DNA, 25 bp, E. coli
tacgcacgatggtagacattctcta

SEQ ID NO: 99920 - DNA, 25 bp, E. coli
actgggcggtgcactagctccaatc

SEQ ID NO: 99921 - DNA, 25 bp, E. coli
actgggcggtgctctagctccaatc

SEQ ID NO: 99922 - DNA, 25 bp, E. coli
tacgcacgatggaagacattctcta

SEQ ID NO: 99923 - DNA, 25 bp, E. coli
tagtttaacgtttgtggtgatcctg

SEQ ID NO: 99924 - DNA, 25 bp, E. coli
tagtttaacgttagtggtgatcctg

SEQ ID NO: 99925 - DNA, 25 bp, E. coli
tagctccaatccacggcgcgttgat

SEQ ID NO: 99926 - DNA, 25 bp, E. coli
tagctccaatcctcggcgcgttgat

SEQ ID NO: 99927 - DNA, 25 bp, E. coli
tcttaaccgcgcacaatggcgggca

SEQ ID NO: 99928 - DNA, 25 bp, E. coli
tcttaaccgcgctcaatggcgggca

SEQ ID NO: 99929 - DNA, 25 bp, E. coli
ccagcaaatgctaggtcagggcatc

SEQ ID NO: 99930 - DNA, 25 bp, E. coli
ccagcaaatgcttggtcagggcatc

SEQ ID NO: 99931 - DNA, 25 bp, E. coli
cggcacttggctcgctctcgtttag

SEQ ID NO: 99932 - DNA, 25 bp, E. coli
ctggatctgggaacggcacttggct

SEQ ID NO: 99933 - DNA, 25 bp, E. coli
cggcacttggctggctctcgtttag

SEQ ID NO: 99934 - DNA, 25 bp, E. coli
ctggatctgggatcggcacttggct

SEQ ID NO: 99935 - DNA, 25 bp, E. coli
ggttttctgatttccggcttctcag

SEQ ID NO: 99936 - DNA, 25 bp, E. coli
ggttttctgattaccggcttctcag

SEQ ID NO: 99937 - DNA, 25 bp, E. coli
aaggtcagggcacggattctacaga

SEQ ID NO: 99938 - DNA, 25 bp, E. coli
aaggtcagggcagggattctacaga

SEQ ID NO: 99939 - DNA, 25 bp, E. coli
taaattttgttatttcggcgtgaag

SEQ ID NO: 99940 - DNA, 25 bp, E. coli
taaattttgttaattcggcgtgaag

SEQ ID NO: 99941 - DNA, 25 bp, E. coli
aatctcattcgcaggcggaggcgaa

SEQ ID NO: 99942 - DNA, 25 bp, E. coli
aatctcattcgctggcggaggcgaa

SEQ ID NO: 99943 - DNA, 25 bp, E. coli
tatcgcaatctcattcgctggcgga

SEQ ID NO: 99944 - DNA, 25 bp, E. coli
tattcagttacacgaaaggtcaggg

SEQ ID NO: 99945 - DNA, 25 bp, E. coli
tatcgcaatctctttcgctggcgga

SEQ ID NO: 99946 - DNA, 25 bp, E. coli
tattcagttacaggaaaggtcaggg

SEQ ID NO: 99947 - DNA, 25 bp, E. coli
taattgcaacaaggctgggaagagg

SEQ ID NO: 99948 - DNA, 25 bp, E. coli
taattgcaacaacgctgggaagagg

SEQ ID NO: 99949 - DNA, 25 bp, E. coli
gccatactatttaattgcaacaagg

SEQ ID NO: 99950 - DNA, 25 bp, E. coli
gccatactattttattgcaacaagg

SEQ ID NO: 99951 - DNA, 25 bp, E. coli
gcagggattctacagagttctggat

SEQ ID NO: 99952 - DNA, 25 bp, E. coli
gcagggattctagagagttctggat

SEQ ID NO: 99953 - DNA, 25 bp, E. coli
gacagcattttggtcaaaaaatagc

SEQ ID NO: 99954 - DNA, 25 bp, E. coli
gacagcattttgctcaaaaaatagc

SEQ ID NO: 99955 - DNA, 25 bp, E. coli
cgtgaagaattgatcctggacagca

SEQ ID NO: 99956 - DNA, 25 bp, E. coli
cgtgaagaattgttcctggacagca

SEQ ID NO: 99957 - DNA, 25 bp, E. coli
ggataaaatttgtatcgcaatctca

SEQ ID NO: 99958 - DNA, 25 bp, E. coli
ggataaaatttgaatcgcaatctca

SEQ ID NO: 99959 - DNA, 25 bp, E. coli
caccgcgtgcattaagcatcaggca

SEQ ID NO: 99960 - DNA, 25 bp, E. coli
caccgcgtgcataaagcatcaggca

SEQ ID NO: 99961 - DNA, 25 bp, E. coli
caggcaatgactctgttgaagtgca

SEQ ID NO: 99962 - DNA, 25 bp, E. coli
caggcaatgactgtgttgaagtgca

SEQ ID NO: 99963 - DNA, 25 bp, E. coli
taacaggccgacctcactctgtgac

SEQ ID NO: 99964 - DNA, 25 bp, E. coli
taacaggccgacgtcactctgtgac

SEQ ID NO: 99965 - DNA, 25 bp, E. coli
aaattattcagtttctctcagcgga

SEQ ID NO: 99966 - DNA, 25 bp, E. coli
aaattattcagtatctctcagcgga

SEQ ID NO: 99967 - DNA, 25 bp, E. coli
ttcgcatgacgataaaccggcaggc

SEQ ID NO: 99968 - DNA, 25 bp, E. coli
ttcgcatgacgaaaaaccggcaggc

SEQ ID NO: 99969 - DNA, 25 bp, E. coli
tgtgacgtttatgcaagtattctcc

SEQ ID NO: 99970 - DNA, 25 bp, E. coli
tgtgacgtttatccaagtattctcc

SEQ ID NO: 99971 - DNA, 25 bp, E. coli
tgccatcattaaacgccaccgcgtg

SEQ ID NO: 99972 - DNA, 25 bp, E. coli
tgccatcattaatcgccaccgcgtg

SEQ ID NO: 99973 - DNA, 25 bp, E. coli
gaatttaagcatctttcgcatgacg

SEQ ID NO: 99974 - DNA, 25 bp, E. coli
gaatttaagcatgtttcgcatgacg

SEQ ID NO: 99975 - DNA, 25 bp, E. coli
gaacgtgatacgtataacaggccga

SEQ ID NO: 99976 - DNA, 25 bp, E. coli
gaacgtgatacgaataacaggccga

SEQ ID NO: 99977 - DNA, 25 bp, E. coli
cggaatttcaggcatctgtacaggc

SEQ ID NO: 99978 - DNA, 25 bp, E. coli
cggaatttcagggatctgtacaggc

SEQ ID NO: 99979 - DNA, 25 bp, E. coli
gtattctccagtatcacagccctga

SEQ ID NO: 99980 - DNA, 25 bp, E. coli
gtattctccagtttcacagccctga

SEQ ID NO: 99981 - DNA, 25 bp, E. coli
caaacgttgcctcaatcctggcggt

SEQ ID NO: 99982 - DNA, 25 bp, E. coli
caaacgttgcctgaatcctggcggt

SEQ ID NO: 99983 - DNA, 25 bp, E. coli
catttggtcgcgtaatggcgctgga

SEQ ID NO: 99984 - DNA, 25 bp, E. coli
catttggtcgcgaaatggcgctgga

SEQ ID NO: 99985 - DNA, 25 bp, E. coli
tatcttcgtcgctcaaaacggcgtc

SEQ ID NO: 99986 - DNA, 25 bp, E. coli
tatcttcgtcgcacaaaacggcgtc

SEQ ID NO: 99987 - DNA, 25 bp, E. coli
tatcatgaaaagtccgatcaccagg

SEQ ID NO: 99988 - DNA, 25 bp, E. coli
tatcatgaaaagaccgatcaccagg

SEQ ID NO: 99989 - DNA, 25 bp, E. coli
tgccatgctgcgagaagtaacccga

SEQ ID NO: 99990 - DNA, 25 bp, E. coli
tgccatgctgcgtgaagtaacccga

SEQ ID NO: 99991 - DNA, 25 bp, E. coli
tctcaaccgaaaatattcaggcgcg

SEQ ID NO: 99992 - DNA, 25 bp, E. coli
tctcaaccgaaattattcaggcgcg

SEQ ID NO: 99993 - DNA, 25 bp, E. coli
gaaacatgtgctcattatcggcggc

SEQ ID NO: 99994 - DNA, 25 bp, E. coli
gaaacatgtgctgattatcggcggc

SEQ ID NO: 99995 - DNA, 25 bp, E. coli
tggcttttatcacgcggcgatcccg

SEQ ID NO: 99996 - DNA, 25 bp, E. coli
ggcatgaaacgcaacacgaccagtt

SEQ ID NO: 99997 - DNA, 25 bp, E. coli
ggcatgaaacgctacacgaccagtt

SEQ ID NO: 99998 - DNA, 25 bp, E. coli
tggcttttatcaggcggcgatcccg

SEQ ID NO: 99999 - DNA, 25 bp, E. coli
gatgtcattatctccgactgcaccg

SEQ ID NO: 100000 - DNA, 25 bp, E. coli
gatgatgacccatgttccgctactg

SEQ ID NO: 100001 - DNA, 25 bp, E. coli
gatgatgacccaagttccgctactg

SEQ ID NO: 100002 - DNA, 25 bp, E. coli
gatgtcattatcaccgactgcaccg

SEQ ID NO: 100003 - DNA, 25 bp, E. coli
caagctgtcgaaagaagcggaacct

SEQ ID NO: 100004 - DNA, 25 bp, E. coli
caagctgtcgaatgaagcggaacct

SEQ ID NO: 100005 - DNA, 25 bp, E. coli
taacaatggtttcaccccgcaagaa

SEQ ID NO: 100006 - DNA, 25 bp, E. coli
aaaaacatgtttattcgcccgagcg

SEQ ID NO: 100007 - DNA, 25 bp, E. coli
aaaaacatgttttttcgcccgagcg

SEQ ID NO: 100008 - DNA, 25 bp, E. coli
tatgaacggcgccaagtgcactaac

SEQ ID NO: 100009 - DNA, 25 bp, E. coli
tatgaacggcgcgaagtgcactaac

SEQ ID NO: 100010 - DNA, 25 bp, E. coli
tttaacctgaccgagcgcatgcagc

SEQ ID NO: 100011 - DNA, 25 bp, E. coli
tttcatcaccgatgtggcctggcag

SEQ ID NO: 100012 - DNA, 25 bp, E. coli
tttaacctgacccagcgcatgcagc

SEQ ID NO: 100013 - DNA, 25 bp, E. coli
tttcatcaccgaagtggcctggcag

SEQ ID NO: 100014 - DNA, 25 bp, E. coli
tgtttaacttcgaaggcggctgcta

SEQ ID NO: 100015 - DNA, 25 bp, E. coli
tgtttaacttcgtaggcggctgcta

SEQ ID NO: 100016 - DNA, 25 bp, E. coli
tgctggaaaacgtcaccgtgcgtga

SEQ ID NO: 100017 - DNA, 25 bp, E. coli
tgaactacctgctgccgctgaaagg

SEQ ID NO: 100018 - DNA, 25 bp, E. coli
tgaactacctgcagccgctgaaagg

SEQ ID NO: 100019 - DNA, 25 bp, E. coli
tgctggaaaacgacaccgtgcgtga

SEQ ID NO: 100020 - DNA, 25 bp, E. coli
cctggcaggcgctttttgtcaaaaa

SEQ ID NO: 100021 - DNA, 25 bp, E. coli
cctggcaggcgcattttgtcaaaaa

SEQ ID NO: 100022 - DNA, 25 bp, E. coli
taactaatctggctgccgttgccgt

SEQ ID NO: 100023 - DNA, 25 bp, E. coli
taacaatggtttgaccccgcaagaa

SEQ ID NO: 100024 - DNA, 25 bp, E. coli
taactaatctgggtgccgttgccgt

SEQ ID NO: 100025 - DNA, 25 bp, E. coli
atggcggcgtttcatacgcacccgg

SEQ ID NO: 100026 - DNA, 25 bp, E. coli
atggcggcgtttgatacgcacccgg

SEQ ID NO: 100027 - DNA, 25 bp, E. coli
tgatggcggcgtatgatacgcaccc

SEQ ID NO: 100028 - DNA, 25 bp, E. coli
tgatggcggcgtttgatacgcaccc

SEQ ID NO: 100029 - DNA, 25 bp, E. coli
gcgtttgatacggacccggaggcgg

SEQ ID NO: 100030 - DNA, 25 bp, E. coli
gcgtttgatacgcacccggaggcgg

SEQ ID NO: 100031 - DNA, 25 bp, E. coli
gcggcgtttgattcgcacccggagg

SEQ ID NO: 100032 - DNA, 25 bp, E. coli
gcggcgtttgatacgcacccggagg

SEQ ID NO: 100033 - DNA, 25 bp, E. coli
cgtttgatacgctcccggaggcggg

SEQ ID NO: 100034 - DNA, 25 bp, E. coli
cgtttgatacgcacccggaggcggg

SEQ ID NO: 100035 - DNA, 25 bp, E. coli
cggcgtttgataggcacccggaggc

SEQ ID NO: 100036 - DNA, 25 bp, E. coli
cggcgtttgatacgcacccggaggc

SEQ ID NO: 100037 - DNA, 25 bp, E. coli
gatacgcacccgcaggcgggaaaat

SEQ ID NO: 100038 - DNA, 25 bp, E. coli
gtgatggcggcgtttgatacgcacc

SEQ ID NO: 100039 - DNA, 25 bp, E. coli
gtggatgagttaccgctggtgatgg

SEQ ID NO: 100040 - DNA, 25 bp, E. coli
gtggatgagttagcgctggtgatgg

SEQ ID NO: 100041 - DNA, 25 bp, E. coli
gtgatggcggcgattgatacgcacc

SEQ ID NO: 100042 - DNA, 25 bp, E. coli
tggcggcgtttgttacgcacccgga

SEQ ID NO: 100043 - DNA, 25 bp, E. coli
tggcggcgtttgatacgcacccgga

SEQ ID NO: 100044 - DNA, 25 bp, E. coli
gatggcggcgtttgatacgcacccg

SEQ ID NO: 100045 - DNA, 25 bp, E. coli
gatacgcacccggaggcgggaaaat

SEQ ID NO: 100046 - DNA, 25 bp, E. coli
gatggcggcgttagatacgcacccg

SEQ ID NO: 100047 - DNA, 25 bp, E. coli
caaaatgcgcgggtaaaagcaccgt

SEQ ID NO: 100048 - DNA, 25 bp, E. coli
caaaatgcgcggctaaaagcaccgt

SEQ ID NO: 100049 - DNA, 25 bp, E. coli
cagaatctgtcctttgtccgccagg

SEQ ID NO: 100050 - DNA, 25 bp, E. coli
cagaatctgtccattgtccgccagg

SEQ ID NO: 100051 - DNA, 25 bp, E. coli
tacgtccggtgaagacgctaagcag

SEQ ID NO: 100052 - DNA, 25 bp, E. coli
tacgtccggtgatgacgctaagcag

SEQ ID NO: 100053 - DNA, 25 bp, E. coli
tattggtgtccagacgctaaaagcg

SEQ ID NO: 100054 - DNA, 25 bp, E. coli
tattggtgtccacacgctaaaagcg

SEQ ID NO: 100055 - DNA, 25 bp, E. coli
tgaccctgatgtcgcattttgccga

SEQ ID NO: 100056 - DNA, 25 bp, E. coli
tgaccctgatgtggcattttgccga

SEQ ID NO: 100057 - DNA, 25 bp, E. coli
tctggtcggtggtaaaagcgaacgc

SEQ ID NO: 100058 - DNA, 25 bp, E. coli
tctggtcggtggaaaaagcgaacgc

SEQ ID NO: 100059 - DNA, 25 bp, E. coli
gaaaggaccgatgctgatgctggaa

SEQ ID NO: 100060 - DNA, 25 bp, E. coli
gaaaggaccgatcctgatgctggaa

SEQ ID NO: 100061 - DNA, 25 bp, E. coli
gcgaatgttggcgaaatgaccctga

SEQ ID NO: 100062 - DNA, 25 bp, E. coli
gcgaatgttggccaaatgaccctga

SEQ ID NO: 100063 - DNA, 25 bp, E. coli
gatcgcgtgctttccgtctggcagc

SEQ ID NO: 100064 - DNA, 25 bp, E. coli
taacgttacgtgagcgcggctggaa

SEQ ID NO: 100065 - DNA, 25 bp, E. coli
taacgttacgtgtgcgcggctggaa

SEQ ID NO: 100066 - DNA, 25 bp, E. coli
gatgaatcggttcggcttccagccc

SEQ ID NO: 100067 - DNA, 25 bp, E. coli
gatgaatcggttgggcttccagccc

SEQ ID NO: 100068 - DNA, 25 bp, E. coli
gatcgcgtgcttaccgtctggcagc

SEQ ID NO: 100069 - DNA, 25 bp, E. coli
tattggcgatttcaggccgtagacc

SEQ ID NO: 100070 - DNA, 25 bp, E. coli
tatcttggcggtactgcgggtatgc

SEQ ID NO: 100071 - DNA, 25 bp, E. coli
tattggcgatttgaggccgtagacc

SEQ ID NO: 100072 - DNA, 25 bp, E. coli
tatcttggcggttctgcgggtatgc

SEQ ID NO: 100073 - DNA, 25 bp, E. coli
ttttcaaacccgtcagaatgccggg

SEQ ID NO: 100074 - DNA, 25 bp, E. coli
ttgaaagatggcttcaccacgccgg

SEQ ID NO: 100075 - DNA, 25 bp, E. coli
ttaattgaaaaggatcgcgccgacc

SEQ ID NO: 100076 - DNA, 25 bp, E. coli
ttgaaagatggcatcaccacgccgg

SEQ ID NO: 100077 - DNA, 25 bp, E. coli
ttaattgaaaagcatcgcgccgacc

SEQ ID NO: 100078 - DNA, 25 bp, E. coli
ttttcaaacccgacagaatgccggg

SEQ ID NO: 100079 - DNA, 25 bp, E. coli
tgaactctatcggatcaccggctgg

SEQ ID NO: 100080 - DNA, 25 bp, E. coli
tgaactctatcgcatcaccggctgg

SEQ ID NO: 100081 - DNA, 25 bp, E. coli
tctgcagtctgggaaaagtgctacc

SEQ ID NO: 100082 - DNA, 25 bp, E. coli
tctgcagtctggcaaaagtgctacc

SEQ ID NO: 100083 - DNA, 25 bp, E. coli
ccttcagaaagagagctgggagaac

SEQ ID NO: 100084 - DNA, 25 bp, E. coli
ccaggcgttgttgaacctcgaggca

SEQ ID NO: 100085 - DNA, 25 bp, E. coli
ccttcagaaagacagctgggagaac

SEQ ID NO: 100086 - DNA, 25 bp, E. coli
ccaggcgttgttcaacctcgaggca

SEQ ID NO: 100087 - DNA, 25 bp, E. coli
ggttcgtgacccagccgcgatttaa

SEQ ID NO: 100088 - DNA, 25 bp, E. coli
ggttcgtgaccctgccgcgatttaa

SEQ ID NO: 100089 - DNA, 25 bp, E. coli
cattaaacgtatcacgctgcgccag

SEQ ID NO: 100090 - DNA, 25 bp, E. coli
cattaaacgtatgacgctgcgccag

SEQ ID NO: 100091 - DNA, 25 bp, E. coli
cagagagccaggttaaacagctgca

SEQ ID NO: 100092 - DNA, 25 bp, E. coli
cagagagccaggataaacagctgca

SEQ ID NO: 100093 - DNA, 25 bp, E. coli
aaatggacaggcaacggcggaatct

SEQ ID NO: 100094 - DNA, 25 bp, E. coli
aaaacggatccgcacaatggcattg

SEQ ID NO: 100095 - DNA, 25 bp, E. coli
aaaacggatccggacaatggcattg

SEQ ID NO: 100096 - DNA, 25 bp, E. coli
aaatggacaggctacggcggaatct

SEQ ID NO: 100097 - DNA, 25 bp, E. coli
tatgagcatgacgtggaacggcctg

SEQ ID NO: 100098 - DNA, 25 bp, E. coli
tatgagcatgacctggaacggcctg

SEQ ID NO: 100099 - DNA, 25 bp, E. coli
ttaaggccgctctgggcaatacgcc

SEQ ID NO: 100100 - DNA, 25 bp, E. coli
ttaaggccgctcagggcaatacgcc

SEQ ID NO: 100101 - DNA, 25 bp, E. coli
tgacggtatgcgaaagatggacaac

SEQ ID NO: 100102 - DNA, 25 bp, E. coli
tgacggtatgcgtaagatggacaac

SEQ ID NO: 100103 - DNA, 25 bp, E. coli
gctggaacaacggatggcattgctg

SEQ ID NO: 100104 - DNA, 25 bp, E. coli
gctggaacaacgcatggcattgctg

SEQ ID NO: 100105 - DNA, 25 bp, E. coli
gacggcgataaataacacggtgatg

SEQ ID NO: 100106 - DNA, 25 bp, E. coli
gacggcgataaaaaacacggtgatg

SEQ ID NO: 100107 - DNA, 25 bp, E. coli
cattgatgatgatgggacgtacacc

SEQ ID NO: 100108 - DNA, 25 bp, E. coli
cattgatgatgaagggacgtacacc

SEQ ID NO: 100109 - DNA, 25 bp, E. coli
gagaaagatttcactgccgggatta

SEQ ID NO: 100110 - DNA, 25 bp, E. coli
gagctcggttatttctacgcgcaca

SEQ ID NO: 100111 - DNA, 25 bp, E. coli
gagaaagatttctctgccgggatta

SEQ ID NO: 100112 - DNA, 25 bp, E. coli
gagctcggttatatctacgcgcaca

SEQ ID NO: 100113 - DNA, 25 bp, E. coli
caccagaaacagcaggagtgcagcc

SEQ ID NO: 100114 - DNA, 25 bp, E. coli
caccaccagaaagagcaggagtgca

SEQ ID NO: 100115 - DNA, 25 bp, E. coli
cagcaccgacatgattctgctggtg

SEQ ID NO: 100116 - DNA, 25 bp, E. coli
cagcaccgacatcattctgctggtg

SEQ ID NO: 100117 - DNA, 25 bp, E. coli
caccaccagaaacagcaggagtgca

SEQ ID NO: 100118 - DNA, 25 bp, E. coli
caccagaaacaggaggagtgcagcc

SEQ ID NO: 100119 - DNA, 25 bp, E. coli
accagaaacagcaggagtgcagcca

SEQ ID NO: 100120 - DNA, 25 bp, E. coli
agaaacagcaggtgtgcagccacag

SEQ ID NO: 100121 - DNA, 25 bp, E. coli
accagaaacagctggagtgcagcca

SEQ ID NO: 100122 - DNA, 25 bp, E. coli
agaaacagcaggagtgcagccacag

SEQ ID NO: 100123 - DNA, 25 bp, E. coli
tgaaatccaccatcaccaccagaaa

SEQ ID NO: 100124 - DNA, 25 bp, E. coli
tgaaatccaccaacaccaccagaaa

SEQ ID NO: 100125 - DNA, 25 bp, E. coli
ccgacatgattcagctggtgaaatc

SEQ ID NO: 100126 - DNA, 25 bp, E. coli
gcaccgacatgaatctgctggtgaa

SEQ ID NO: 100127 - DNA, 25 bp, E. coli
gcaccgacatgattctgctggtgaa

SEQ ID NO: 100128 - DNA, 25 bp, E. coli
cgacatgattctcctggtgaaatcc

SEQ ID NO: 100129 - DNA, 25 bp, E. coli
cgacatgattctgctggtgaaatcc

SEQ ID NO: 100130 - DNA, 25 bp, E. coli
cgccagcaccgagatgattctgctg

SEQ ID NO: 100131 - DNA, 25 bp, E. coli
cgccagcaccgacatgattctgctg

SEQ ID NO: 100132 - DNA, 25 bp, E. coli
ccgacatgattctgctggtgaaatc

SEQ ID NO: 100133 - DNA, 25 bp, E. coli
ggtgaaatccacgatcaccaccaga

SEQ ID NO: 100134 - DNA, 25 bp, E. coli
ggtgaaatccaccatcaccaccaga

SEQ ID NO: 100135 - DNA, 25 bp, E. coli
caatgggcgcggagatattacagtc

SEQ ID NO: 100136 - DNA, 25 bp, E. coli
caatgggcgcggtgatattacagtc

SEQ ID NO: 100137 - DNA, 25 bp, E. coli
catccagtggcgctaatggcggatt

SEQ ID NO: 100138 - DNA, 25 bp, E. coli
catccagtggcggtaatggcggatt

SEQ ID NO: 100139 - DNA, 25 bp, E. coli
cagagagacttcagtgcccgcttga

SEQ ID NO: 100140 - DNA, 25 bp, E. coli
cagagagacttctgtgcccgcttga

SEQ ID NO: 100141 - DNA, 25 bp, E. coli
tacactggagcagcctgaaaaaggt

SEQ ID NO: 100142 - DNA, 25 bp, E. coli
tacactggagcaccctgaaaaaggt

SEQ ID NO: 100143 - DNA, 25 bp, E. coli
tatgtactttatatgatgccgctgc

SEQ ID NO: 100144 - DNA, 25 bp, E. coli
tatgtactttatttgatgccgctgc

SEQ ID NO: 100145 - DNA, 25 bp, E. coli
ttatgacgatacgagaggaaacttc

SEQ ID NO: 100146 - DNA, 25 bp, E. coli
ttatgacgataccagaggaaacttc

SEQ ID NO: 100147 - DNA, 25 bp, E. coli
tgtgtatgattcaactaatgggcgc

SEQ ID NO: 100148 - DNA, 25 bp, E. coli
tgtgtatgattctactaatgggcgc

SEQ ID NO: 100149 - DNA, 25 bp, E. coli
tcgtgcccgaatagtagccaatggg

SEQ ID NO: 100150 - DNA, 25 bp, E. coli
tcgtgcccgaattgtagccaatggg

SEQ ID NO: 100151 - DNA, 25 bp, E. coli
cgagcccttggtcagagaatgctaa

SEQ ID NO: 100152 - DNA, 25 bp, E. coli
cgagcccttggtgagagaatgctaa

SEQ ID NO: 100153 - DNA, 25 bp, E. coli
gatttaatagtgctcctcgagccct

SEQ ID NO: 100154 - DNA, 25 bp, E. coli
gatttaatagtggtcctcgagccct

SEQ ID NO: 100155 - DNA, 25 bp, E. coli
taatgggcgcttttcatccagtggc

SEQ ID NO: 100156 - DNA, 25 bp, E. coli
taatgggcgcttatcatccagtggc

SEQ ID NO: 100157 - DNA, 25 bp, E. coli
aggatataatatgtctgatgcgcca

SEQ ID NO: 100158 - DNA, 25 bp, E. coli
aggatataatatctctgatgcgcca

SEQ ID NO: 100159 - DNA, 25 bp, E. coli
tatctggcagcagttctacgaagac

SEQ ID NO: 100160 - DNA, 25 bp, E. coli
tttgctaggaaaacgaatcaaccgc

SEQ ID NO: 100161 - DNA, 25 bp, E. coli
tatctggcagcacttctacgaagac

SEQ ID NO: 100162 - DNA, 25 bp, E. coli
tttgctaggaaatcgaatcaaccgc

SEQ ID NO: 100163 - DNA, 25 bp, E. coli
ccggcacagggcaattggttcgttc

SEQ ID NO: 100164 - DNA, 25 bp, E. coli
ccggcacagggctattggttcgttc

SEQ ID NO: 100165 - DNA, 25 bp, E. coli
gaattcgtttgcctctctctgtggg

SEQ ID NO: 100166 - DNA, 25 bp, E. coli
gaattcgtttgcgtctctctgtggg

SEQ ID NO: 100167 - DNA, 25 bp, E. coli
gacagcctttgaacgattgacagaa

SEQ ID NO: 100168 - DNA, 25 bp, E. coli
gacagcctttgatcgattgacagaa

SEQ ID NO: 100169 - DNA, 25 bp, E. coli
cgagcaaagctgttaaatgatgacg

SEQ ID NO: 100170 - DNA, 25 bp, E. coli
cgatgtgcattataattgtcgcgca

SEQ ID NO: 100171 - DNA, 25 bp, E. coli
cgatgtgcattaaaattgtcgcgca

SEQ ID NO: 100172 - DNA, 25 bp, E. coli
cgagcaaagctgataaatgatgacg

SEQ ID NO: 100173 - DNA, 25 bp, E. coli
taagttttatggtatctggcagcac

SEQ ID NO: 100174 - DNA, 25 bp, E. coli
taagttttatggaatctggcagcac

SEQ ID NO: 100175 - DNA, 25 bp, E. coli
taatgcttattggtggctatcgcga

SEQ ID NO: 100176 - DNA, 25 bp, E. coli
taatgcttattgctggctatcgcga

SEQ ID NO: 100177 - DNA, 25 bp, E. coli
gatgaaaaattggagacagcctttg

SEQ ID NO: 100178 - DNA, 25 bp, E. coli
gatgaaaaattgcagacagcctttg

SEQ ID NO: 100179 - DNA, 25 bp, E. coli
cagccagcggttttgcttctaacgg

SEQ ID NO: 100180 - DNA, 25 bp, E. coli
cagccagcggttatgcttctaacgg

SEQ ID NO: 100181 - DNA, 25 bp, E. coli
caactgtggttcttctgggtggtgc

SEQ ID NO: 100182 - DNA, 25 bp, E. coli
cactattggtttttgggctggcgga

SEQ ID NO: 100183 - DNA, 25 bp, E. coli
caactgtggttcatctgggtggtgc

SEQ ID NO: 100184 - DNA, 25 bp, E. coli
cactattggtttatgggctggcgga

SEQ ID NO: 100185 - DNA, 25 bp, E. coli
tacgtaattgcccaggttgtcggcg

SEQ ID NO: 100186 - DNA, 25 bp, E. coli
aaacgggttttgacgcggcagccag

SEQ ID NO: 100187 - DNA, 25 bp, E. coli
aaacgggttttgtcgcggcagccag

SEQ ID NO: 100188 - DNA, 25 bp, E. coli
tacgtaattgccgaggttgtcggcg

SEQ ID NO: 100189 - DNA, 25 bp, E. coli
tatggcgagcattcaccaggcggtt

SEQ ID NO: 100190 - DNA, 25 bp, E. coli
tatggcgagcatacaccaggcggtt

SEQ ID NO: 100191 - DNA, 25 bp, E. coli
ccggcaaaagaactcgttggctacg

SEQ ID NO: 100192 - DNA, 25 bp, E. coli
ccggcaaaagaagtcgttggctacg

SEQ ID NO: 100193 - DNA, 25 bp, E. coli
gcggctgggcataagaacaactgtg

SEQ ID NO: 100194 - DNA, 25 bp, E. coli
gcggctgggcattagaacaactgtg

SEQ ID NO: 100195 - DNA, 25 bp, E. coli
ggttattccatggtttccgcgctgg

SEQ ID NO: 100196 - DNA, 25 bp, E. coli
ggttattccatgctttccgcgctgg

SEQ ID NO: 100197 - DNA, 25 bp, E. coli
tggtcattttaagccggcggtcact

SEQ ID NO: 100198 - DNA, 25 bp, E. coli
ggcttcccggaaataggcattggtt

SEQ ID NO: 100199 - DNA, 25 bp, E. coli
ggcttcccggaattaggcattggtt

SEQ ID NO: 100200 - DNA, 25 bp, E. coli
tggtcattttaacccggcggtcact

SEQ ID NO: 100201 - DNA, 25 bp, E. coli
tacctgggcaaaatcaagaagtggg

SEQ ID NO: 100202 - DNA, 25 bp, E. coli
tacctgggcaaattcaagaagtggg

SEQ ID NO: 100203 - DNA, 25 bp, E. coli
ttgcagaagcaagcctgacaggtgc

SEQ ID NO: 100204 - DNA, 25 bp, E. coli
ttgtcgccgcgaccttatcgatgag

SEQ ID NO: 100205 - DNA, 25 bp, E. coli
ttgtcgccgcgagcttatcgatgag

SEQ ID NO: 100206 - DNA, 25 bp, E. coli
ttgcagaagcaaccctgacaggtgc

SEQ ID NO: 100207 - DNA, 25 bp, E. coli
tggtgctggatgctaaaaccctcgg

SEQ ID NO: 100208 - DNA, 25 bp, E. coli
tggtgctggatggtaaaaccctcgg

SEQ ID NO: 100209 - DNA, 25 bp, E. coli
tgaccaaccagaaaggcgaagatgc

SEQ ID NO: 100210 - DNA, 25 bp, E. coli
tgaccaaccagataggcgaagatgc

SEQ ID NO: 100211 - DNA, 25 bp, E. coli
tgaatccgggtctgaaactgccttc

SEQ ID NO: 100212 - DNA, 25 bp, E. coli
tgaatccgggtcagaaactgccttc

SEQ ID NO: 100213 - DNA, 25 bp, E. coli
tgaaagttatgcctaccaccgtcgc

SEQ ID NO: 100214 - DNA, 25 bp, E. coli
tgaaagttatgcgtaccaccgtcgc

SEQ ID NO: 100215 - DNA, 25 bp, E. coli
cctgcgccggtgaatgccaaatggg

SEQ ID NO: 100216 - DNA, 25 bp, E. coli
cctgcgccggtgtatgccaaatggg

SEQ ID NO: 100217 - DNA, 25 bp, E. coli
gctctaccgtaatatggccgatcgg

SEQ ID NO: 100218 - DNA, 25 bp, E. coli
gctctaccgtaaaatggccgatcgg

SEQ ID NO: 100219 - DNA, 25 bp, E. coli
cgctgtctgacgaaaaactggctca

SEQ ID NO: 100220 - DNA, 25 bp, E. coli
cgcgctgcgtggaagaccaatatta

SEQ ID NO: 100221 - DNA, 25 bp, E. coli
cgctgtctgacgtaaaactggctca

SEQ ID NO: 100222 - DNA, 25 bp, E. coli
cgcgctgcgtggtagaccaatatta

SEQ ID NO: 100223 - DNA, 25 bp, E. coli
caccgccctgaattgctggagatta

SEQ ID NO: 100224 - DNA, 25 bp, E. coli
caccgccctgaaatgctggagatta

SEQ ID NO: 100225 - DNA, 25 bp, E. coli
taaagatatcgcctatccgggtgat

SEQ ID NO: 100226 - DNA, 25 bp, E. coli
taaagatatcgcgtatccgggtgat

SEQ ID NO: 100227 - DNA, 25 bp, E. coli
aaacactattccgtgaccgcgtacg

SEQ ID NO: 100228 - DNA, 25 bp, E. coli
aaacactattccctgaccgcgtacg

SEQ ID NO: 100229 - DNA, 25 bp, E. coli
tatttcggaaatcttcggccaggcc

SEQ ID NO: 100230 - DNA, 25 bp, E. coli
tatttcggaaatgttcggccaggcc

SEQ ID NO: 100231 - DNA, 25 bp, E. coli
tgaccgacatttccgatatctggcg

SEQ ID NO: 100232 - DNA, 25 bp, E. coli
tgaccgacatttgcgatatctggcg

SEQ ID NO: 100233 - DNA, 25 bp, E. coli
gaaaatggctttctcagtgtcgtga

SEQ ID NO: 100234 - DNA, 25 bp, E. coli
gaaaatcttcctcgaaatgggcggc

SEQ ID NO: 100235 - DNA, 25 bp, E. coli
gaaaatcttcctggaaatgggcggc

SEQ ID NO: 100236 - DNA, 25 bp, E. coli
gaaaatggctttgtcagtgtcgtga

SEQ ID NO: 100237 - DNA, 25 bp, E. coli
cgcgtacgtcggaaaaaagctgatt

SEQ ID NO: 100238 - DNA, 25 bp, E. coli
cgcgtacgtcggtaaaaagctgatt

SEQ ID NO: 100239 - DNA, 25 bp, E. coli
gatatctggcgccaacgttttgagg

SEQ ID NO: 100240 - DNA, 25 bp, E. coli
gatatctggcgcgaacgttttgagg

SEQ ID NO: 100241 - DNA, 25 bp, E. coli
ggagattatccgtacctggcgcagc

SEQ ID NO: 100242 - DNA, 25 bp, E. coli
ggagattatccgaacctggcgcagc

SEQ ID NO: 100243 - DNA, 25 bp, E. coli
gagtatctctctttcctgaccgaca

SEQ ID NO: 100244 - DNA, 25 bp, E. coli
gagtatctctctatcctgaccgaca

SEQ ID NO: 100245 - DNA, 25 bp, E. coli
caaagaaggcggatcgaatgacctc

SEQ ID NO: 100246 - DNA, 25 bp, E. coli
caaagaaggcggttcgaatgacctc

SEQ ID NO: 100247 - DNA, 25 bp, E. coli
catacctatttttgggttctgtgcc

SEQ ID NO: 100248 - DNA, 25 bp, E. coli
catacctattttagggttctgtgcc

SEQ ID NO: 100249 - DNA, 25 bp, E. coli
aattcgatacttccccaaaaatctg

SEQ ID NO: 100250 - DNA, 25 bp, E. coli
aattcgatacttgcccaaaaatctg

SEQ ID NO: 100251 - DNA, 25 bp, E. coli
tgaaagaagcgcctattggatataa

SEQ ID NO: 100252 - DNA, 25 bp, E. coli
tgaaagaagcgcgtattggatataa

SEQ ID NO: 100253 - DNA, 25 bp, E. coli
tgccatggactctgacagggatctg

SEQ ID NO: 100254 - DNA, 25 bp, E. coli
tgccatggactcagacagggatctg

SEQ ID NO: 100255 - DNA, 25 bp, E. coli
tctgacagggatctgctatgaaata

SEQ ID NO: 100256 - DNA, 25 bp, E. coli
tctgacagggatgtgctatgaaata

SEQ ID NO: 100257 - DNA, 25 bp, E. coli
gcggatcgaatgtcctcaaagaaaa

SEQ ID NO: 100258 - DNA, 25 bp, E. coli
gcggatcgaatgacctcaaagaaaa

SEQ ID NO: 100259 - DNA, 25 bp, E. coli
gattgtggctattataagatacaag

SEQ ID NO: 100260 - DNA, 25 bp, E. coli
gattgtggctataataagatacaag

SEQ ID NO: 100261 - DNA, 25 bp, E. coli
gtaatgaacttgacttatcatacct

SEQ ID NO: 100262 - DNA, 25 bp, E. coli
gtaatgaacttgtcttatcatacct

SEQ ID NO: 100263 - DNA, 25 bp, E. coli
tcaaagaaaatgaagatagagcgtt

SEQ ID NO: 100264 - DNA, 25 bp, E. coli
tcaaagaaaatgtagatagagcgtt

SEQ ID NO: 100265 - DNA, 25 bp, E. coli
gatacaagaaattcgatacttcccc

SEQ ID NO: 100266 - DNA, 25 bp, E. coli
gatacaagaaatacgatacttcccc

SEQ ID NO: 100267 - DNA, 25 bp, E. coli
atcaacataccagccagacttctgg

SEQ ID NO: 100268 - DNA, 25 bp, E. coli
atgagtcatcaagataccacccaga

SEQ ID NO: 100269 - DNA, 25 bp, E. coli
acagcgtacttcagggtatcctcgg

SEQ ID NO: 100270 - DNA, 25 bp, E. coli
acagcgtacttctgggtatcctcgg

SEQ ID NO: 100271 - DNA, 25 bp, E. coli
ataccacccagacttctggtcaggg

SEQ ID NO: 100272 - DNA, 25 bp, E. coli
acttctgggtatcctcggcttcttc

SEQ ID NO: 100273 - DNA, 25 bp, E. coli
atcaacataccacccagacttctgg

SEQ ID NO: 100274 - DNA, 25 bp, E. coli
acttctgggtatgctcggcttcttc

SEQ ID NO: 100275 - DNA, 25 bp, E. coli
ataccacccagagttctggtcaggg

SEQ ID NO: 100276 - DNA, 25 bp, E. coli
atgagtcatcaacataccacccaga

SEQ ID NO: 100277 - DNA, 25 bp, E. coli
acttctcacagcctacttctgggta

SEQ ID NO: 100278 - DNA, 25 bp, E. coli
acttctcacagcgtacttctgggta

SEQ ID NO: 100279 - DNA, 25 bp, E. coli
tgacttccagtctggcacgcgtgaa

SEQ ID NO: 100280 - DNA, 25 bp, E. coli
tgacttccagtcaggcacgcgtgaa

SEQ ID NO: 100281 - DNA, 25 bp, E. coli
tgctgatgacttgcagtctggcacg

SEQ ID NO: 100282 - DNA, 25 bp, E. coli
tgctgatgacttccagtctggcacg

SEQ ID NO: 100283 - DNA, 25 bp, E. coli
tccagtctggcaggcgtgaactggc

SEQ ID NO: 100284 - DNA, 25 bp, E. coli
tccagtctggcacgcgtgaactggc

SEQ ID NO: 100285 - DNA, 25 bp, E. coli
gcgtacttctggctatcctcggctt

SEQ ID NO: 100286 - DNA, 25 bp, E. coli
gcgtacttctgggtatcctcggctt

SEQ ID NO: 100287 - DNA, 25 bp, E. coli
gatgacttccagtctggcacgcgtg

SEQ ID NO: 100288 - DNA, 25 bp, E. coli
gatgacttccagactggcacgcgtg

SEQ ID NO: 100289 - DNA, 25 bp, E. coli
caggctaacgttgaaggctcgcaga

SEQ ID NO: 100290 - DNA, 25 bp, E. coli
caggctaacgttcaaggctcgcaga

SEQ ID NO: 100291 - DNA, 25 bp, E. coli
taaagcgtatgtgatggcggaaacc

SEQ ID NO: 100292 - DNA, 25 bp, E. coli
taaagcgtatgtcatggcggaaacc

SEQ ID NO: 100293 - DNA, 25 bp, E. coli
aaatgacggcgaatttacagcctgg

SEQ ID NO: 100294 - DNA, 25 bp, E. coli
aaatgacggcgattttacagcctgg

SEQ ID NO: 100295 - DNA, 25 bp, E. coli
tattcagaaccagagccagaaggcg

SEQ ID NO: 100296 - DNA, 25 bp, E. coli
tattcagaaccacagccagaaggcg

SEQ ID NO: 100297 - DNA, 25 bp, E. coli
tgaaaggaccgaatactgcgctggc

SEQ ID NO: 100298 - DNA, 25 bp, E. coli
tgaccgtgacggttaagcagtgcga

SEQ ID NO: 100299 - DNA, 25 bp, E. coli
tgacgcccgtgaagatgattacgag

SEQ ID NO: 100300 - DNA, 25 bp, E. coli
tgaaaggaccgattactgcgctggc

SEQ ID NO: 100301 - DNA, 25 bp, E. coli
tgaccgtgacggataagcagtgcga

SEQ ID NO: 100302 - DNA, 25 bp, E. coli
tgacgcccgtgatgatgattacgag

SEQ ID NO: 100303 - DNA, 25 bp, E. coli
gtctgctgactatcccgaaagggaa

SEQ ID NO: 100304 - DNA, 25 bp, E. coli
gatctggatggctgcattgacgccc

SEQ ID NO: 100305 - DNA, 25 bp, E. coli
gatctggatggcagcattgacgccc

SEQ ID NO: 100306 - DNA, 25 bp, E. coli
gtctgctgactaacccgaaagggaa

SEQ ID NO: 100307 - DNA, 25 bp, E. coli
tggcgaatacgaaatgacctgcggt

SEQ ID NO: 100308 - DNA, 25 bp, E. coli
tggcgaatacgatatgacctgcggt

SEQ ID NO: 100309 - DNA, 25 bp, E. coli
taacgccgggaaaacacagttcatt

SEQ ID NO: 100310 - DNA, 25 bp, E. coli
taacgccgggaatacacagttcatt

SEQ ID NO: 100311 - DNA, 25 bp, E. coli
tacgcagcacgtctatgacaaaggg

SEQ ID NO: 100312 - DNA, 25 bp, E. coli
taaaggccacatgaataccggactg

SEQ ID NO: 100313 - DNA, 25 bp, E. coli
tatgcatgtggtcactgaagtccag

SEQ ID NO: 100314 - DNA, 25 bp, E. coli
tatgcaaactgagcaacagcgagcc

SEQ ID NO: 100315 - DNA, 25 bp, E. coli
tacgcagcacgtgtatgacaaaggg

SEQ ID NO: 100316 - DNA, 25 bp, E. coli
tatgcatgtggtgactgaagtccag

SEQ ID NO: 100317 - DNA, 25 bp, E. coli
tatgcaaactgaccaacagcgagcc

SEQ ID NO: 100318 - DNA, 25 bp, E. coli
tatctcttcgaaggccatagtgctg

SEQ ID NO: 100319 - DNA, 25 bp, E. coli
tatctcttcgaacgccatagtgctg

SEQ ID NO: 100320 - DNA, 25 bp, E. coli
ttttgcaacatgctgcggaaagcgc

SEQ ID NO: 100321 - DNA, 25 bp, E. coli
ttttgcaacatggtgcggaaagcgc

SEQ ID NO: 100322 - DNA, 25 bp, E. coli
tgggcaatgcctcacatcgacacgt

SEQ ID NO: 100323 - DNA, 25 bp, E. coli
tgggcaatgcctgacatcgacacgt

SEQ ID NO: 100324 - DNA, 25 bp, E. coli
tgagctttcctcacgactgggtcgg

SEQ ID NO: 100325 - DNA, 25 bp, E. coli
tgagctttcctctcgactgggtcgg

SEQ ID NO: 100326 - DNA, 25 bp, E. coli
gctgctggcacatcgtcatcttcat

SEQ ID NO: 100327 - DNA, 25 bp, E. coli
gctgctggcacaacgtcatcttcat

SEQ ID NO: 100328 - DNA, 25 bp, E. coli
gacacgtaaaaaacacgatcgcggc

SEQ ID NO: 100329 - DNA, 25 bp, E. coli
gacacgtaaaaatcacgatcgcggc

SEQ ID NO: 100330 - DNA, 25 bp, E. coli
cattacgttacccaagatggctggt

SEQ ID NO: 100331 - DNA, 25 bp, E. coli
cattacgttaccgaagatggctggt

SEQ ID NO: 100332 - DNA, 25 bp, E. coli
taaaggccacatcaataccggactg

SEQ ID NO: 100333 - DNA, 25 bp, E. coli
caatgatgccgcgaacacacttgtt

SEQ ID NO: 100334 - DNA, 25 bp, E. coli
caatgatgccgccaacacacttgtt

SEQ ID NO: 100335 - DNA, 25 bp, E. coli
cacacttgttttctgatataggacg

SEQ ID NO: 100336 - DNA, 25 bp, E. coli
cacacttgttttgtgatataggacg

SEQ ID NO: 100337 - DNA, 25 bp, E. coli
tgtaaaggatgtcaacggttcacca

SEQ ID NO: 100338 - DNA, 25 bp, E. coli
tgtaaaggatgtgaacggttcacca

SEQ ID NO: 100339 - DNA, 25 bp, E. coli
tgcacgattttgcaaactactgggt

SEQ ID NO: 100340 - DNA, 25 bp, E. coli
tgcacgattttggaaactactgggt

SEQ ID NO: 100341 - DNA, 25 bp, E. coli
tcttcatcggatacaatgatgccgc

SEQ ID NO: 100342 - DNA, 25 bp, E. coli
tcatcgcgcaaacatgtcaaaagca

SEQ ID NO: 100343 - DNA, 25 bp, E. coli
tcatcgcgcaaagatgtcaaaagca

SEQ ID NO: 100344 - DNA, 25 bp, E. coli
tcttcatcggattcaatgatgccgc

SEQ ID NO: 100345 - DNA, 25 bp, E. coli
gctaacggcccttgattttgtaaag

SEQ ID NO: 100346 - DNA, 25 bp, E. coli
gctaacggccctagattttgtaaag

SEQ ID NO: 100347 - DNA, 25 bp, E. coli
gaatgattgtgactggctaacggcc

SEQ ID NO: 100348 - DNA, 25 bp, E. coli
gaatgattgtgagtggctaacggcc

SEQ ID NO: 100349 - DNA, 25 bp, E. coli
gactctgcaataacctggccgttag

SEQ ID NO: 100350 - DNA, 25 bp, E. coli
gactctgcaatatcctggccgttag

SEQ ID NO: 100351 - DNA, 25 bp, E. coli
ggttcaccaacgcatctcacttttt

SEQ ID NO: 100352 - DNA, 25 bp, E. coli
ggttcaccaacggatctcacttttt

SEQ ID NO: 100353 - DNA, 25 bp, E. coli
ggtgattttcgtcaggttccaacag

SEQ ID NO: 100354 - DNA, 25 bp, E. coli
ggtgattttcgtgaggttccaacag

SEQ ID NO: 100355 - DNA, 25 bp, E. coli
caccagcctgatcatggaaatgagc

SEQ ID NO: 100356 - DNA, 25 bp, E. coli
caccagcctgatgatggaaatgagc

SEQ ID NO: 100357 - DNA, 25 bp, E. coli
aaagccatgagacaacgtttgtccg

SEQ ID NO: 100358 - DNA, 25 bp, E. coli
aaagccatgagagaacgtttgtccg

SEQ ID NO: 100359 - DNA, 25 bp, E. coli
ttgcggtaacgggttaggcaccagc

SEQ ID NO: 100360 - DNA, 25 bp, E. coli
ttgcggtaacggcttaggcaccagc

SEQ ID NO: 100361 - DNA, 25 bp, E. coli
tgttgatcatgtggacctgggctcc

SEQ ID NO: 100362 - DNA, 25 bp, E. coli
tgttgatcatgtcgacctgggctcc

SEQ ID NO: 100363 - DNA, 25 bp, E. coli
tgaaggatttgtccatcagcgctga

SEQ ID NO: 100364 - DNA, 25 bp, E. coli
tgaaggatttgtgcatcagcgctga

SEQ ID NO: 100365 - DNA, 25 bp, E. coli
tctgtcgcaggcaaaatcgtcgccc

SEQ ID NO: 100366 - DNA, 25 bp, E. coli
tccgcgaaagggacgccgagtgata

SEQ ID NO: 100367 - DNA, 25 bp, E. coli
tccgcgaaagggtcgccgagtgata

SEQ ID NO: 100368 - DNA, 25 bp, E. coli
tctgtcgcaggctaaatcgtcgccc

SEQ ID NO: 100369 - DNA, 25 bp, E. coli
gcattaaccgaaataggcgcactgt

SEQ ID NO: 100370 - DNA, 25 bp, E. coli
gcattaaccgaattaggcgcactgt

SEQ ID NO: 100371 - DNA, 25 bp, E. coli
cgagtgatatctttgtcggcaccaa

SEQ ID NO: 100372 - DNA, 25 bp, E. coli
cgagtgatatctatgtcggcaccaa

SEQ ID NO: 100373 - DNA, 25 bp, E. coli
cgtcgccctggaaaatatgattgat

SEQ ID NO: 100374 - DNA, 25 bp, E. coli
cgtcgccctggataatatgattgat

SEQ ID NO: 100375 - DNA, 25 bp, E. coli
gatattgccgaggagttagtcgcgc

SEQ ID NO: 100376 - DNA, 25 bp, E. coli
gatattgccgagcagttagtcgcgc

SEQ ID NO: 100377 - DNA, 25 bp, E. coli
acgcggtcagtcaggtcgtgaaatc

SEQ ID NO: 100378 - DNA, 25 bp, E. coli
acgcggtcagtctggtcgtgaaatc

SEQ ID NO: 100379 - DNA, 25 bp, E. coli
ttccggatgcaagcggcgggcgtct

SEQ ID NO: 100380 - DNA, 25 bp, E. coli
ttccggatgcaaccggcgggcgtct

SEQ ID NO: 100381 - DNA, 25 bp, E. coli
tgaccatgtcctcaatgtcgtcggg

SEQ ID NO: 100382 - DNA, 25 bp, E. coli
tgaccatgtcctgaatgtcgtcggg

SEQ ID NO: 100383 - DNA, 25 bp, E. coli
tcctgaatgtcgacggggtcccggt

SEQ ID NO: 100384 - DNA, 25 bp, E. coli
tcccggttccggttgcaaccggcgg

SEQ ID NO: 100385 - DNA, 25 bp, E. coli
tcctgaatgtcgtcggggtcccggt

SEQ ID NO: 100386 - DNA, 25 bp, E. coli
tcccggttccggatgcaaccggcgg

SEQ ID NO: 100387 - DNA, 25 bp, E. coli
tcagtctggtcgtgaaatcacggcg

SEQ ID NO: 100388 - DNA, 25 bp, E. coli
tcagtctggtcgagaaatcacggcg

SEQ ID NO: 100389 - DNA, 25 bp, E. coli
cctggcgtgaccatgtcctgaatgt

SEQ ID NO: 100390 - DNA, 25 bp, E. coli
cctggcgtgaccttgtcctgaatgt

SEQ ID NO: 100391 - DNA, 25 bp, E. coli
ctggtcgtgaaaacacggcggcgtc

SEQ ID NO: 100392 - DNA, 25 bp, E. coli
ctggtcgtgaaatcacggcggcgtc

SEQ ID NO: 100393 - DNA, 25 bp, E. coli
gtacgcggtcagtctggtcgtgaaa

SEQ ID NO: 100394 - DNA, 25 bp, E. coli
gtccctggcgtgtccatgtcctgaa

SEQ ID NO: 100395 - DNA, 25 bp, E. coli
gtacgcggtcagactggtcgtgaaa

SEQ ID NO: 100396 - DNA, 25 bp, E. coli
gtccctggcgtgaccatgtcctgaa

SEQ ID NO: 100397 - DNA, 25 bp, E. coli
ggcgtgaccatgtcctgaatgtcgt

SEQ ID NO: 100398 - DNA, 25 bp, E. coli
ggcgtgaccatgacctgaatgtcgt

SEQ ID NO: 100399 - DNA, 25 bp, E. coli
caaaagcagcgaaattcagcccgcg

SEQ ID NO: 100400 - DNA, 25 bp, E. coli
caaaagcagcgatattcagcccgcg

SEQ ID NO: 100401 - DNA, 25 bp, E. coli
cacttggcgtccagcttggcgttag

SEQ ID NO: 100402 - DNA, 25 bp, E. coli
cacttggcgtcctgcttggcgttag

SEQ ID NO: 100403 - DNA, 25 bp, E. coli
tactccggcagttgtgctgagcaat

SEQ ID NO: 100404 - DNA, 25 bp, E. coli
tactccggcagtagtgctgagcaat

SEQ ID NO: 100405 - DNA, 25 bp, E. coli
tattgccgaccaatacgcacttggc

SEQ ID NO: 100406 - DNA, 25 bp, E. coli
tattgccgaccattacgcacttggc

SEQ ID NO: 100407 - DNA, 25 bp, E. coli
tgagcaatggcacacttgttccggg

SEQ ID NO: 100408 - DNA, 25 bp, E. coli
tgaaagctatctggtgtgcgaaaga

SEQ ID NO: 100409 - DNA, 25 bp, E. coli
tgatggcaggtataagcgtcgcacc

SEQ ID NO: 100410 - DNA, 25 bp, E. coli
tgaaagctatctcgtgtgcgaaaga

SEQ ID NO: 100411 - DNA, 25 bp, E. coli
tgagcaatggcagacttgttccggg

SEQ ID NO: 100412 - DNA, 25 bp, E. coli
tgatggcaggtaaaagcgtcgcacc

SEQ ID NO: 100413 - DNA, 25 bp, E. coli
tcaggctgatgacgcggcaattcaa

SEQ ID NO: 100414 - DNA, 25 bp, E. coli
tcaggctgatgaggcggcaattcaa

SEQ ID NO: 100415 - DNA, 25 bp, E. coli
gccaaaatgggcatcaaaagcagcg

SEQ ID NO: 100416 - DNA, 25 bp, E. coli
gccaaaatgggcttcaaaagcagcg

SEQ ID NO: 100417 - DNA, 25 bp, E. coli
ggctccggtcaatgtcaccaataag

SEQ ID NO: 100418 - DNA, 25 bp, E. coli
ggctccggtcaaagtcaccaataag

SEQ ID NO: 100419 - DNA, 25 bp, E. coli
gacgaacaccaaaaaatgaccagcg

SEQ ID NO: 100420 - DNA, 25 bp, E. coli
gacgaacaccaataaatgaccagcg

SEQ ID NO: 100421 - DNA, 25 bp, E. coli
taaacgcctgggacgtggtatcggt

SEQ ID NO: 100422 - DNA, 25 bp, E. coli
taaaggcgctcgtgctgctatcgaa

SEQ ID NO: 100423 - DNA, 25 bp, E. coli
taaaggcgctcgagctgctatcgaa

SEQ ID NO: 100424 - DNA, 25 bp, E. coli
taaacgcctgggtcgtggtatcggt

SEQ ID NO: 100425 - DNA, 25 bp, E. coli
tagacctgaacacgctgaaagcggc

SEQ ID NO: 100426 - DNA, 25 bp, E. coli
tatcggtatccacatcgagttcgcg

SEQ ID NO: 100427 - DNA, 25 bp, E. coli
tatcggtatccagatcgagttcgcg

SEQ ID NO: 100428 - DNA, 25 bp, E. coli
tatcgaagctgctggcggtaaaatc

SEQ ID NO: 100429 - DNA, 25 bp, E. coli
tatcgaagctgcaggcggtaaaatc

SEQ ID NO: 100430 - DNA, 25 bp, E. coli
tagacctgaacaggctgaaagcggc

SEQ ID NO: 100431 - DNA, 25 bp, E. coli
tgtaccgtcgtctgccgaaattcgg

SEQ ID NO: 100432 - DNA, 25 bp, E. coli
tgtaccgtcgtcagccgaaattcgg

SEQ ID NO: 100433 - DNA, 25 bp, E. coli
tcgagttcgcgatagtgatcctggc

SEQ ID NO: 100434 - DNA, 25 bp, E. coli
tcgagttcgcgaaagtgatcctggc

SEQ ID NO: 100435 - DNA, 25 bp, E. coli
tctgacctggcttaagtagaaggcg

SEQ ID NO: 100436 - DNA, 25 bp, E. coli
tctgacctggctaaagtagaaggcg

SEQ ID NO: 100437 - DNA, 25 bp, E. coli
ccggtggtcgtgctcacaaaggtca

SEQ ID NO: 100438 - DNA, 25 bp, E. coli
ccggtggtcgtggtcacaaaggtca

SEQ ID NO: 100439 - DNA, 25 bp, E. coli
tggctggcgaagaaacgactccggt

SEQ ID NO: 100440 - DNA, 25 bp, E. coli
tggtatcggttctggcctcggtaaa

SEQ ID NO: 100441 - DNA, 25 bp, E. coli
tggctggcgaagtaacgactccggt

SEQ ID NO: 100442 - DNA, 25 bp, E. coli
tggtatcggttcaggcctcggtaaa

SEQ ID NO: 100443 - DNA, 25 bp, E. coli
catcgagatgtttcggataagcaac

SEQ ID NO: 100444 - DNA, 25 bp, E. coli
catcgagatgttacggataagcaac

SEQ ID NO: 100445 - DNA, 25 bp, E. coli
taaatttctctacacgcgatgctgg

SEQ ID NO: 100446 - DNA, 25 bp, E. coli
taaatttctctagacgcgatgctgg

SEQ ID NO: 100447 - DNA, 25 bp, E. coli
aacctgtagtggagcctttggcgac

SEQ ID NO: 100448 - DNA, 25 bp, E. coli
aacctgtagtggtgcctttggcgac

SEQ ID NO: 100449 - DNA, 25 bp, E. coli
tagtgattctgtgcggcttgctacc

SEQ ID NO: 100450 - DNA, 25 bp, E. coli
tagtgattctgtccggcttgctacc

SEQ ID NO: 100451 - DNA, 25 bp, E. coli
tatatgggataatgccgcccttgcg

SEQ ID NO: 100452 - DNA, 25 bp, E. coli
tatatgctggcatcctttctaggca

SEQ ID NO: 100453 - DNA, 25 bp, E. coli
tatatgctggcaacctttctaggca

SEQ ID NO: 100454 - DNA, 25 bp, E. coli
tatatgggataaagccgcccttgcg

SEQ ID NO: 100455 - DNA, 25 bp, E. coli
gaagttttgatggtcaatctccgga

SEQ ID NO: 100456 - DNA, 25 bp, E. coli
gaagttttgatgctcaatctccgga

SEQ ID NO: 100457 - DNA, 25 bp, E. coli
ccgcccttgcggttttcattgtaga

SEQ ID NO: 100458 - DNA, 25 bp, E. coli
ccgcccttgcggatttcattgtaga

SEQ ID NO: 100459 - DNA, 25 bp, E. coli
gattacctcgtcacatctgatgtgg

SEQ ID NO: 100460 - DNA, 25 bp, E. coli
gattacctcgtctcatctgatgtgg

SEQ ID NO: 100461 - DNA, 25 bp, E. coli
ggaaaagattaacctcccaggcatg

SEQ ID NO: 100462 - DNA, 25 bp, E. coli
ggaaaagattaagctcccaggcatg

SEQ ID NO: 100463 - DNA, 25 bp, E. coli
gatggagattctctcgaaacctgta

SEQ ID NO: 100464 - DNA, 25 bp, E. coli
gatggagattctgtcgaaacctgta

SEQ ID NO: 100465 - DNA, 25 bp, E. coli
caacaacgcggacgaagcatgagta

SEQ ID NO: 100466 - DNA, 25 bp, E. coli
caacaacgcggaggaagcatgagta

SEQ ID NO: 100467 - DNA, 25 bp, E. coli
taaagccggacaggaagtgattacc

SEQ ID NO: 100468 - DNA, 25 bp, E. coli
taaagccggacacgaagtgattacc

SEQ ID NO: 100469 - DNA, 25 bp, E. coli
agaatttacttctcccgcagacgag

SEQ ID NO: 100470 - DNA, 25 bp, E. coli
agaatttacttcacccgcagacgag

SEQ ID NO: 100471 - DNA, 25 bp, E. coli
tgattaccattgaaaaacaagcggg

SEQ ID NO: 100472 - DNA, 25 bp, E. coli
tgattaccattgtaaaacaagcggg

SEQ ID NO: 100473 - DNA, 25 bp, E. coli
gccagcgtttaaccgcgaggcgtta

SEQ ID NO: 100474 - DNA, 25 bp, E. coli
gccagcgtttaagcgcgaggcgtta

SEQ ID NO: 100475 - DNA, 25 bp, E. coli
gacaccggacgatctgccagcgttt

SEQ ID NO: 100476 - DNA, 25 bp, E. coli
gacaccggacgaactgccagcgttt

SEQ ID NO: 100477 - DNA, 25 bp, E. coli
cgcggaattttacgatcaggaagtc

SEQ ID NO: 100478 - DNA, 25 bp, E. coli
cgcggaattttaggatcaggaagtc

SEQ ID NO: 100479 - DNA, 25 bp, E. coli
cgcagacgagttgcgtaaagccgga

SEQ ID NO: 100480 - DNA, 25 bp, E. coli
cgcagacgagttccgtaaagccgga

SEQ ID NO: 100481 - DNA, 25 bp, E. coli
gataaatccatccatgaagtgacgc

SEQ ID NO: 100482 - DNA, 25 bp, E. coli
gataaatccatcgatgaagtgacgc

SEQ ID NO: 100483 - DNA, 25 bp, E. coli
gggaaattcgccacatccaatgcaa

SEQ ID NO: 100484 - DNA, 25 bp, E. coli
gggaaattcgcctcatccaatgcaa

SEQ ID NO: 100485 - DNA, 25 bp, E. coli
gagaagccagcgagaccatcgataa

SEQ ID NO: 100486 - DNA, 25 bp, E. coli
gagaagccagcgtgaccatcgataa

SEQ ID NO: 100487 - DNA, 25 bp, E. coli
catcggtatgatagcgccagaagct

SEQ ID NO: 100488 - DNA, 25 bp, E. coli
catcggtatgattgcgccagaagct

SEQ ID NO: 100489 - DNA, 25 bp, E. coli
aaaacgtctttgagctggaatcccg

SEQ ID NO: 100490 - DNA, 25 bp, E. coli
aaaacgtctttgtgctggaatcccg

SEQ ID NO: 100491 - DNA, 25 bp, E. coli
tatgctgcgtaacatcccgaaacgc

SEQ ID NO: 100492 - DNA, 25 bp, E. coli
tatgctgcgtaagatcccgaaacgc

SEQ ID NO: 100493 - DNA, 25 bp, E. coli
tattgacgagttcccgcagtcgggc

SEQ ID NO: 100494 - DNA, 25 bp, E. coli
tattgacgagttgccgcagtcgggc

SEQ ID NO: 100495 - DNA, 25 bp, E. coli
ttgtcgcccgtgttgagaactcatg

SEQ ID NO: 100496 - DNA, 25 bp, E. coli
ttgtcgcccgtgatgagaactcatg

SEQ ID NO: 100497 - DNA, 25 bp, E. coli
tgattgtgccggttacgttaaccct

SEQ ID NO: 100498 - DNA, 25 bp, E. coli
tgattgtgccggatacgttaaccct

SEQ ID NO: 100499 - DNA, 25 bp, E. coli
tgatcatgaacgagtacgcgctggt

SEQ ID NO: 100500 - DNA, 25 bp, E. coli
tgatcatgaacgtgtacgcgctggt

SEQ ID NO: 100501 - DNA, 25 bp, E. coli
tgaaccgcgtgcaggctaaccaaag

SEQ ID NO: 100502 - DNA, 25 bp, E. coli
tgaaccgcgtgctggctaaccaaag

SEQ ID NO: 100503 - DNA, 25 bp, E. coli
tcgggcaactaccaaaccatcggcg

SEQ ID NO: 100504 - DNA, 25 bp, E. coli
tcgggcaactacgaaaccatcggcg

SEQ ID NO: 100505 - DNA, 25 bp, E. coli
cgctggcgggcgagttacgtaaaca

SEQ ID NO: 100506 - DNA, 25 bp, E. coli
cgctggcgggcgtgttacgtaaaca

SEQ ID NO: 100507 - DNA, 25 bp, E. coli
gattctaaagacgtgctgaaccgcg

SEQ ID NO: 100508 - DNA, 25 bp, E. coli
gattctaaagacctgctgaaccgcg

SEQ ID NO: 100509 - DNA, 25 bp, E. coli
aactggcgacacagcttagcgatgc

SEQ ID NO: 100510 - DNA, 25 bp, E. coli
taaagataacgggacacgcagtggt

SEQ ID NO: 100511 - DNA, 25 bp, E. coli
taaagataacggcacacgcagtggt

SEQ ID NO: 100512 - DNA, 25 bp, E. coli
aactggcgacactgcttagcgatgc

SEQ ID NO: 100513 - DNA, 25 bp, E. coli
tgcctcccgggaaaataaccatcgg

SEQ ID NO: 100514 - DNA, 25 bp, E. coli
tgcctcccgggataataaccatcgg

SEQ ID NO: 100515 - DNA, 25 bp, E. coli
gcccagcaatttaatgactaccgca

SEQ ID NO: 100516 - DNA, 25 bp, E. coli
gcccggataacgtggcccagcaatt

SEQ ID NO: 100517 - DNA, 25 bp, E. coli
gcccggataacgaggcccagcaatt

SEQ ID NO: 100518 - DNA, 25 bp, E. coli
gcccagcaattttatgactaccgca

SEQ ID NO: 100519 - DNA, 25 bp, E. coli
gcaccacagtcagtccagcttataa

SEQ ID NO: 100520 - DNA, 25 bp, E. coli
gcaccacagtcactccagcttataa

SEQ ID NO: 100521 - DNA, 25 bp, E. coli
gactaccgcattatgcaccgcagca

SEQ ID NO: 100522 - DNA, 25 bp, E. coli
gactaccgcattttgcaccgcagca

SEQ ID NO: 100523 - DNA, 25 bp, E. coli
gaccaacgatcctttctccagtcga

SEQ ID NO: 100524 - DNA, 25 bp, E. coli
gaccaacgatccattctccagtcga

SEQ ID NO: 100525 - DNA, 25 bp, E. coli
cttatctgagcgacaaactggcgac

SEQ ID NO: 100526 - DNA, 25 bp, E. coli
cttgcgttgaagcaggcccggataa

SEQ ID NO: 100527 - DNA, 25 bp, E. coli
cttatctgagcgtcaaactggcgac

SEQ ID NO: 100528 - DNA, 25 bp, E. coli
cttgcgttgaaggaggcccggataa

SEQ ID NO: 100529 - DNA, 25 bp, E. coli
taaccatcgggaactactgaccaac

SEQ ID NO: 100530 - DNA, 25 bp, E. coli
taaccatcgggatctactgaccaac

SEQ ID NO: 100531 - DNA, 25 bp, E. coli
taaataaatatctatcccatctcca

SEQ ID NO: 100532 - DNA, 25 bp, E. coli
taaataaatatcaatcccatctcca

SEQ ID NO: 100533 - DNA, 25 bp, E. coli
ttctaaagtgcagaataggcgacct

SEQ ID NO: 100534 - DNA, 25 bp, E. coli
tagtttaaacatgtctttgcggaaa

SEQ ID NO: 100535 - DNA, 25 bp, E. coli
tagtttaaacatctctttgcggaaa

SEQ ID NO: 100536 - DNA, 25 bp, E. coli
taccctaaccaattgcacttgtgaa

SEQ ID NO: 100537 - DNA, 25 bp, E. coli
tatctcatctctatccttaattacg

SEQ ID NO: 100538 - DNA, 25 bp, E. coli
tatctcatctctttccttaattacg

SEQ ID NO: 100539 - DNA, 25 bp, E. coli
taccctaaccaaatgcacttgtgaa

SEQ ID NO: 100540 - DNA, 25 bp, E. coli
tttgggtaacaattatcattgctca

SEQ ID NO: 100541 - DNA, 25 bp, E. coli
tttgggtaacaaatatcattgctca

SEQ ID NO: 100542 - DNA, 25 bp, E. coli
tgttcaaaagcttctaaagtgcaca

SEQ ID NO: 100543 - DNA, 25 bp, E. coli
tgttcaaaagctactaaagtgcaca

SEQ ID NO: 100544 - DNA, 25 bp, E. coli
tctttgcggaaataatataacttcc

SEQ ID NO: 100545 - DNA, 25 bp, E. coli
tctcctatttgtgtcatgaatagtc

SEQ ID NO: 100546 - DNA, 25 bp, E. coli
tcattcttcaaacatgtagtctgac

SEQ ID NO: 100547 - DNA, 25 bp, E. coli
tctcctatttgtctcatgaatagtc

SEQ ID NO: 100548 - DNA, 25 bp, E. coli
tcattcttcaaagatgtagtctgac

SEQ ID NO: 100549 - DNA, 25 bp, E. coli
tctttgcggaaaaaatataacttcc

SEQ ID NO: 100550 - DNA, 25 bp, E. coli
taggcgacctaatgaacaatggttg

SEQ ID NO: 100551 - DNA, 25 bp, E. coli
taggcgacctaaagaacaatggttg

SEQ ID NO: 100552 - DNA, 25 bp, E. coli
ttctaaagtgcacaataggcgacct

SEQ ID NO: 100553 - DNA, 25 bp, E. coli
aatggtttccatcacacagccaacg

SEQ ID NO: 100554 - DNA, 25 bp, E. coli
aatggtttccatgacacagccaacg

SEQ ID NO: 100555 - DNA, 25 bp, E. coli
tatgggatcgtctcatggccttgcc

SEQ ID NO: 100556 - DNA, 25 bp, E. coli
tatgggatcgtcacatggccttgcc

SEQ ID NO: 100557 - DNA, 25 bp, E. coli
ttgatcaacgtacccagatgcgccg

SEQ ID NO: 100558 - DNA, 25 bp, E. coli
ttgatcaacgtagccagatgcgccg

SEQ ID NO: 100559 - DNA, 25 bp, E. coli
tgtgcatatgctcccgacggatctg

SEQ ID NO: 100560 - DNA, 25 bp, E. coli
tgatcagttagtaccggctccggaa

SEQ ID NO: 100561 - DNA, 25 bp, E. coli
tgatcagttagttccggctccggaa

SEQ ID NO: 100562 - DNA, 25 bp, E. coli
tgtgcatatgctgccgacggatctg

SEQ ID NO: 100563 - DNA, 25 bp, E. coli
cctggatttgcaaaccgggctgtta

SEQ ID NO: 100564 - DNA, 25 bp, E. coli
gcctgttgaagatactgaagtccga

SEQ ID NO: 100565 - DNA, 25 bp, E. coli
ccaatgcgttgatgaccgggacgtc

SEQ ID NO: 100566 - DNA, 25 bp, E. coli
cctggatttgcataccgggctgtta

SEQ ID NO: 100567 - DNA, 25 bp, E. coli
gcctgttgaagaaactgaagtccga

SEQ ID NO: 100568 - DNA, 25 bp, E. coli
ccaatgcgttgaagaccgggacgtc

SEQ ID NO: 100569 - DNA, 25 bp, E. coli
cgacaaagtggtgaagatgcctggc

SEQ ID NO: 100570 - DNA, 25 bp, E. coli
cgacaaagtggtcaagatgcctggc

SEQ ID NO: 100571 - DNA, 25 bp, E. coli
taagaaaggcatcacctacgctcag

SEQ ID NO: 100572 - DNA, 25 bp, E. coli
taagaaaggcatgacctacgctcag

SEQ ID NO: 100573 - DNA, 25 bp, E. coli
gatcctttccgctatcggcgtggcg

SEQ ID NO: 100574 - DNA, 25 bp, E. coli
gatcctttccgcaatcggcgtggcg

SEQ ID NO: 100575 - DNA, 25 bp, E. coli
catcaaaggcatcgagttcgaggcg

SEQ ID NO: 100576 - DNA, 25 bp, E. coli
catcaaaggcatggagttcgaggcg

SEQ ID NO: 100577 - DNA, 25 bp, E. coli
tacgtcggcatctcccgtgcggcaa

SEQ ID NO: 100578 - DNA, 25 bp, E. coli
taaatacctgtacgtcggcatcacc

SEQ ID NO: 100579 - DNA, 25 bp, E. coli
tacgtcggcatcacccgtgcggcaa

SEQ ID NO: 100580 - DNA, 25 bp, E. coli
taaatacctgtaggtcggcatcacc

SEQ ID NO: 100581 - DNA, 25 bp, E. coli
tgttcgataaattcctgtacgtcgg

SEQ ID NO: 100582 - DNA, 25 bp, E. coli
tgtcagcattgagcagctcgccact

SEQ ID NO: 100583 - DNA, 25 bp, E. coli
tgtcagcattgaccagctcgccact

SEQ ID NO: 100584 - DNA, 25 bp, E. coli
tgttcgataaatacctgtacgtcgg

SEQ ID NO: 100585 - DNA, 25 bp, E. coli
tgcgcgtgttcgtcatccagcacat

SEQ ID NO: 100586 - DNA, 25 bp, E. coli
tgcgcgtgttcgacatccagcacat

SEQ ID NO: 100587 - DNA, 25 bp, E. coli
gacatccagcacatcaaaggcatgg

SEQ ID NO: 100588 - DNA, 25 bp, E. coli
gacatccagcacttcaaaggcatgg

SEQ ID NO: 100589 - DNA, 25 bp, E. coli
cgtgcggcaaccaacctggacgtga

SEQ ID NO: 100590 - DNA, 25 bp, E. coli
cggcgctgttcgttaaatacctgta

SEQ ID NO: 100591 - DNA, 25 bp, E. coli
cggcgctgttcgataaatacctgta

SEQ ID NO: 100592 - DNA, 25 bp, E. coli
cgtgcggcaacctacctggacgtga

SEQ ID NO: 100593 - DNA, 25 bp, E. coli
ggcggtgttcttagtcagcattgac

SEQ ID NO: 100594 - DNA, 25 bp, E. coli
ggcggtgttctttgtcagcattgac

SEQ ID NO: 100595 - DNA, 25 bp, E. coli
gagttcgaggcgctgttctttgtca

SEQ ID NO: 100596 - DNA, 25 bp, E. coli
gagttcgaggcggtgttctttgtca

SEQ ID NO: 100597 - DNA, 25 bp, E. coli
cagagtttaaagacgactgccacca

SEQ ID NO: 100598 - DNA, 25 bp, E. coli
cagagtttaaagtcgactgccacca

SEQ ID NO: 100599 - DNA, 25 bp, E. coli
taggtcgtaaaagagccaacgtcgt

SEQ ID NO: 100600 - DNA, 25 bp, E. coli
taggtcgtaaaacagccaacgtcgt

SEQ ID NO: 100601 - DNA, 25 bp, E. coli
accattggttgatcctgcacgggcg

SEQ ID NO: 100602 - DNA, 25 bp, E. coli
accattggttgaacctgcacgggcg

SEQ ID NO: 100603 - DNA, 25 bp, E. coli
tacgcctgcagcgatgcttgaactg

SEQ ID NO: 100604 - DNA, 25 bp, E. coli
tacgcctgcagccatgcttgaactg

SEQ ID NO: 100605 - DNA, 25 bp, E. coli
tattaaacactggattcggctggcc

SEQ ID NO: 100606 - DNA, 25 bp, E. coli
tattaaacactgcattcggctggcc

SEQ ID NO: 100607 - DNA, 25 bp, E. coli
tgttaataaggccacggcgaaactc

SEQ ID NO: 100608 - DNA, 25 bp, E. coli
tgttaataaggcgacggcgaaactc

SEQ ID NO: 100609 - DNA, 25 bp, E. coli
gaagatcgtgctgcgcttgaagccc

SEQ ID NO: 100610 - DNA, 25 bp, E. coli
gaagatcgtgctccgcttgaagccc

SEQ ID NO: 100611 - DNA, 25 bp, E. coli
gattgccgtactcctttccgctcag

SEQ ID NO: 100612 - DNA, 25 bp, E. coli
gattgccgtactgctttccgctcag

SEQ ID NO: 100613 - DNA, 25 bp, E. coli
ggccgactattgctgtcgacacgca

SEQ ID NO: 100614 - DNA, 25 bp, E. coli
tggagatcctcagtcgcctgcgtga

SEQ ID NO: 100615 - DNA, 25 bp, E. coli
ggcgttatacctgcattgcccgcaa

SEQ ID NO: 100616 - DNA, 25 bp, E. coli
ggccgactattggtgtcgacacgca

SEQ ID NO: 100617 - DNA, 25 bp, E. coli
ggcgttatacctccattgcccgcaa

SEQ ID NO: 100618 - DNA, 25 bp, E. coli
tggagatcctcactcgcctgcgtga

SEQ ID NO: 100619 - DNA, 25 bp, E. coli
agcaaaagcttacctgaactggctc

SEQ ID NO: 100620 - DNA, 25 bp, E. coli
agcaaaagcttagctgaactggctc

SEQ ID NO: 100621 - DNA, 25 bp, E. coli
aaaagcttacctcaactggctctat

SEQ ID NO: 100622 - DNA, 25 bp, E. coli
actcgtgctggtagcttctctgcta

SEQ ID NO: 100623 - DNA, 25 bp, E. coli
caaaagcttaccagaactggctcta

SEQ ID NO: 100624 - DNA, 25 bp, E. coli
actcgtgctggttgcttctctgcta

SEQ ID NO: 100625 - DNA, 25 bp, E. coli
caaaagcttacctgaactggctcta

SEQ ID NO: 100626 - DNA, 25 bp, E. coli
aaaagcttacctgaactggctctat

SEQ ID NO: 100627 - DNA, 25 bp, E. coli
tgctggttgcttgtctgctactggc

SEQ ID NO: 100628 - DNA, 25 bp, E. coli
tgctggttgcttctctgctactggc

SEQ ID NO: 100629 - DNA, 25 bp, E. coli
tcgtgctggttggttctctgctact

SEQ ID NO: 100630 - DNA, 25 bp, E. coli
tcgtgctggttgcttctctgctact

SEQ ID NO: 100631 - DNA, 25 bp, E. coli
gcggacaaagccgacggtggtgata

SEQ ID NO: 100632 - DNA, 25 bp, E. coli
gcggacaaagcccacggtggtgata

SEQ ID NO: 100633 - DNA, 25 bp, E. coli
gcaaaagcttacgtgaactggctct

SEQ ID NO: 100634 - DNA, 25 bp, E. coli
gcaaaagcttacctgaactggctct

SEQ ID NO: 100635 - DNA, 25 bp, E. coli
cgtgctggttgcatctctgctactg

SEQ ID NO: 100636 - DNA, 25 bp, E. coli
cgtgctggttgcttctctgctactg

SEQ ID NO: 100637 - DNA, 25 bp, E. coli
ctcgtgctggttgcttctctgctac

SEQ ID NO: 100638 - DNA, 25 bp, E. coli
ctcgtgctggttccttctctgctac

SEQ ID NO: 100639 - DNA, 25 bp, E. coli
gtgctggttgcttctctgctactgg

SEQ ID NO: 100640 - DNA, 25 bp, E. coli
gtgctggttgctactctgctactgg

SEQ ID NO: 100641 - DNA, 25 bp, E. coli
cactcgacgttgaaatgatgcccgg

SEQ ID NO: 100642 - DNA, 25 bp, E. coli
cactcgacgttgtaatgatgcccgg

SEQ ID NO: 100643 - DNA, 25 bp, E. coli
agcctttcgcgctctcgacgttgaa

SEQ ID NO: 100644 - DNA, 25 bp, E. coli
agcctttcgcgcactcgacgttgaa

SEQ ID NO: 100645 - DNA, 25 bp, E. coli
agatccgcataggatagcccaaacg

SEQ ID NO: 100646 - DNA, 25 bp, E. coli
agatccgcatagcatagcccaaacg

SEQ ID NO: 100647 - DNA, 25 bp, E. coli
tttcaatacggcaacaaatgtagcg

SEQ ID NO: 100648 - DNA, 25 bp, E. coli
tttcaatacggctacaaatgtagcg

SEQ ID NO: 100649 - DNA, 25 bp, E. coli
ttttcagatccggatagcatagccc

SEQ ID NO: 100650 - DNA, 25 bp, E. coli
ttttcagatccgcatagcatagccc

SEQ ID NO: 100651 - DNA, 25 bp, E. coli
tcgcgcactcgaggttgaaatgatg

SEQ ID NO: 100652 - DNA, 25 bp, E. coli
tcgcgcactcgacgttgaaatgatg

SEQ ID NO: 100653 - DNA, 25 bp, E. coli
ccagtggtcctgatttcaatacggc

SEQ ID NO: 100654 - DNA, 25 bp, E. coli
ccagtggtcctgttttcaatacggc

SEQ ID NO: 100655 - DNA, 25 bp, E. coli
cgttgaaatgatccccggattattc

SEQ ID NO: 100656 - DNA, 25 bp, E. coli
cgttgaaatgatgcccggattattc

SEQ ID NO: 100657 - DNA, 25 bp, E. coli
ggtcctgttttcaatacggctacaa

SEQ ID NO: 100658 - DNA, 25 bp, E. coli
ggtcctgttttctatacggctacaa

SEQ ID NO: 100659 - DNA, 25 bp, E. coli
gtcaaaacagcctttcgcgcactcg

SEQ ID NO: 100660 - DNA, 25 bp, E. coli
gtcaaaacagccattcgcgcactcg

SEQ ID NO: 100661 - DNA, 25 bp, E. coli
ggcagccagtggacctgttttcaat

SEQ ID NO: 100662 - DNA, 25 bp, E. coli
ggcagccagtggtcctgttttcaat

SEQ ID NO: 100663 - DNA, 25 bp, E. coli
aattgctggacgctaacacctgacg

SEQ ID NO: 100664 - DNA, 25 bp, E. coli
aattgctggacggtaacacctgacg

SEQ ID NO: 100665 - DNA, 25 bp, E. coli
taacaatgtgctgacgcttcggccg

SEQ ID NO: 100666 - DNA, 25 bp, E. coli
taacaatgtgctcacgcttcggccg

SEQ ID NO: 100667 - DNA, 25 bp, E. coli
aaatatcagattaccgactcggccc

SEQ ID NO: 100668 - DNA, 25 bp, E. coli
aaatatcagatttccgactcggccc

SEQ ID NO: 100669 - DNA, 25 bp, E. coli
tatgaccacgcctcgttagaaggtg

SEQ ID NO: 100670 - DNA, 25 bp, E. coli
tatgacaaagcacgcatcaccgttt

SEQ ID NO: 100671 - DNA, 25 bp, E. coli
tatgaccacgccacgttagaaggtg

SEQ ID NO: 100672 - DNA, 25 bp, E. coli
tatgacaaagcaggcatcaccgttt

SEQ ID NO: 100673 - DNA, 25 bp, E. coli
tattttcgccaatacgctgcgccag

SEQ ID NO: 100674 - DNA, 25 bp, E. coli
tattttcgccaaaacgctgcgccag

SEQ ID NO: 100675 - DNA, 25 bp, E. coli
tgaaattggacaactacgcagcgtt

SEQ ID NO: 100676 - DNA, 25 bp, E. coli
tgaaattggacatctacgcagcgtt

SEQ ID NO: 100677 - DNA, 25 bp, E. coli
ggatatcccggatgccaaaagctgg

SEQ ID NO: 100678 - DNA, 25 bp, E. coli
ggtttatcccgatgttgtgcgcccg

SEQ ID NO: 100679 - DNA, 25 bp, E. coli
ggtttatcccgaagttgtgcgcccg

SEQ ID NO: 100680 - DNA, 25 bp, E. coli
ggatatcccggaagccaaaagctgg

SEQ ID NO: 100681 - DNA, 25 bp, E. coli
tggcttgcagagttgtcacaccggg

SEQ ID NO: 100682 - DNA, 25 bp, E. coli
tggcttgcagagatgtcacaccggg

SEQ ID NO: 100683 - DNA, 25 bp, E. coli
ggctacgagcgctacatctggacta

SEQ ID NO: 100684 - DNA, 25 bp, E. coli
ggctacgagcgcaacatctggacta

SEQ ID NO: 100685 - DNA, 25 bp, E. coli
cataatgataaaagccggatgagtc

SEQ ID NO: 100686 - DNA, 25 bp, E. coli
cataatgataaatgccggatgagtc

SEQ ID NO: 100687 - DNA, 25 bp, E. coli
cagacatccggcgagcagatttgtt

SEQ ID NO: 100688 - DNA, 25 bp, E. coli
cagacatccggccagcagatttgtt

SEQ ID NO: 100689 - DNA, 25 bp, E. coli
taaaagccggatgagtcagacatcc

SEQ ID NO: 100690 - DNA, 25 bp, E. coli
taaaagtgacgatagtctattccgg

SEQ ID NO: 100691 - DNA, 25 bp, E. coli
taaaagtgacgaaagtctattccgg

SEQ ID NO: 100692 - DNA, 25 bp, E. coli
taaaagccggatcagtcagacatcc

SEQ ID NO: 100693 - DNA, 25 bp, E. coli
tttcggatgttaaaaaggttttgat

SEQ ID NO: 100694 - DNA, 25 bp, E. coli
tttcggatgttataaaggttttgat

SEQ ID NO: 100695 - DNA, 25 bp, E. coli
tcatcaacataaagataaaagccgg

SEQ ID NO: 100696 - DNA, 25 bp, E. coli
tcatcaacataatgataaaagccgg

SEQ ID NO: 100697 - DNA, 25 bp, E. coli
ccgggtattgtgtaaatgctattcg

SEQ ID NO: 100698 - DNA, 25 bp, E. coli
ccgggtattgtgaaaatgctattcg

SEQ ID NO: 100699 - DNA, 25 bp, E. coli
gctattcgtatctttctttttcgga

SEQ ID NO: 100700 - DNA, 25 bp, E. coli
gctattcgtatcattctttttcgga

SEQ ID NO: 100701 - DNA, 25 bp, E. coli
tgacgaaagtcttttccgggtattg

SEQ ID NO: 100702 - DNA, 25 bp, E. coli
tgacgaaagtctattccgggtattg

SEQ ID NO: 100703 - DNA, 25 bp, E. coli
ggtaatttatataacgacattgaaa

SEQ ID NO: 100704 - DNA, 25 bp, E. coli
ggtaatttatattacgacattgaaa

SEQ ID NO: 100705 - DNA, 25 bp, E. coli
gatgagtcagacatccggcgagcag

SEQ ID NO: 100706 - DNA, 25 bp, E. coli
gatgagtcagacttccggcgagcag

SEQ ID NO: 100707 - DNA, 25 bp, E. coli
tacttgctaaactacaaggacgcct

SEQ ID NO: 100708 - DNA, 25 bp, E. coli
taaacagtctccactataaggccga

SEQ ID NO: 100709 - DNA, 25 bp, E. coli
tacttgctaaacaacaaggacgcct

SEQ ID NO: 100710 - DNA, 25 bp, E. coli
aacgtcgtgatctaatgaaagcgca

SEQ ID NO: 100711 - DNA, 25 bp, E. coli
aacgtcgtgatcaaatgaaagcgca

SEQ ID NO: 100712 - DNA, 25 bp, E. coli
taccttgcgcaaagtaacgaacttg

SEQ ID NO: 100713 - DNA, 25 bp, E. coli
taccttgcgcaatgtaacgaacttg

SEQ ID NO: 100714 - DNA, 25 bp, E. coli
tgggctgagaactaaaactcgtgtc

SEQ ID NO: 100715 - DNA, 25 bp, E. coli
tgggctgagaacaaaaactcgtgtc

SEQ ID NO: 100716 - DNA, 25 bp, E. coli
tcgctgacaacgaaaccaggacttt

SEQ ID NO: 100717 - DNA, 25 bp, E. coli
tcgctgacaacgtaaccaggacttt

SEQ ID NO: 100718 - DNA, 25 bp, E. coli
cctgcctgcgcaatgtgtgaatgat

SEQ ID NO: 100719 - DNA, 25 bp, E. coli
cctgcctgcgcattgtgtgaatgat

SEQ ID NO: 100720 - DNA, 25 bp, E. coli
gaatgaataagtccgaacgtcgtga

SEQ ID NO: 100721 - DNA, 25 bp, E. coli
gaatgaataagtgcgaacgtcgtga

SEQ ID NO: 100722 - DNA, 25 bp, E. coli
gaatgatgcgatgctcagcagaatg

SEQ ID NO: 100723 - DNA, 25 bp, E. coli
gaatgatgcgatcctcagcagaatg

SEQ ID NO: 100724 - DNA, 25 bp, E. coli
gaaattgcgaataatccgggtaaca

SEQ ID NO: 100725 - DNA, 25 bp, E. coli
gaaattgcgaattatccgggtaaca

SEQ ID NO: 100726 - DNA, 25 bp, E. coli
gatatcaccggttttccgcagggag

SEQ ID NO: 100727 - DNA, 25 bp, E. coli
gatatcaccggtattccgcagggag

SEQ ID NO: 100728 - DNA, 25 bp, E. coli
taaacagtctcctctataaggccga

SEQ ID NO: 100729 - DNA, 25 bp, E. coli
aataggtagctaaggcacaggttca

SEQ ID NO: 100730 - DNA, 25 bp, E. coli
caatgcgacgaatgtggagtttggt

SEQ ID NO: 100731 - DNA, 25 bp, E. coli
aataggtagctatggcacaggttca

SEQ ID NO: 100732 - DNA, 25 bp, E. coli
caatgcgacgaaagtggagtttggt

SEQ ID NO: 100733 - DNA, 25 bp, E. coli
agattaggttctacgacaggaggcg

SEQ ID NO: 100734 - DNA, 25 bp, E. coli
agattaggttcttcgacaggaggcg

SEQ ID NO: 100735 - DNA, 25 bp, E. coli
taccgatgcggatggtgcacttggc

SEQ ID NO: 100736 - DNA, 25 bp, E. coli
taccgatgcggaaggtgcacttggc

SEQ ID NO: 100737 - DNA, 25 bp, E. coli
tggtgcacttgggaacacccgggaa

SEQ ID NO: 100738 - DNA, 25 bp, E. coli
tggtgcacttggcaacacccgggaa

SEQ ID NO: 100739 - DNA, 25 bp, E. coli
tgaggactcagagggcaccgttaat

SEQ ID NO: 100740 - DNA, 25 bp, E. coli
tgaggactcagacggcaccgttaat

SEQ ID NO: 100741 - DNA, 25 bp, E. coli
ggaggtaccatctttttcgatacgg

SEQ ID NO: 100742 - DNA, 25 bp, E. coli
ggaggtaccatcattttcgatacgg

SEQ ID NO: 100743 - DNA, 25 bp, E. coli
gacatcatctacaaacgcacaattg

SEQ ID NO: 100744 - DNA, 25 bp, E. coli
gacatcatctactaacgcacaattg

SEQ ID NO: 100745 - DNA, 25 bp, E. coli
cattttaggctaacaggcgggcagt

SEQ ID NO: 100746 - DNA, 25 bp, E. coli
cgtcattggcgctaatgaggactca

SEQ ID NO: 100747 - DNA, 25 bp, E. coli
cattttaggctatcaggcgggcagt

SEQ ID NO: 100748 - DNA, 25 bp, E. coli
cgtcattggcgcaaatgaggactca

SEQ ID NO: 100749 - DNA, 25 bp, E. coli
tggtcttggcgatggcgtttttgtc

SEQ ID NO: 100750 - DNA, 25 bp, E. coli
tggtcttggcgaaggcgtttttgtc

SEQ ID NO: 100751 - DNA, 25 bp, E. coli
aatttgtgtttggtgcatccgcccg

SEQ ID NO: 100752 - DNA, 25 bp, E. coli
aatttgtgtttgctgcatccgcccg

SEQ ID NO: 100753 - DNA, 25 bp, E. coli
caaaacttttgaaggcactgtcgcc

SEQ ID NO: 100754 - DNA, 25 bp, E. coli
caaaacttttgatggcactgtcgcc

SEQ ID NO: 100755 - DNA, 25 bp, E. coli
aaaaaattgcgaagaccgtgccctc

SEQ ID NO: 100756 - DNA, 25 bp, E. coli
aaaaaattgcgatgaccgtgccctc

SEQ ID NO: 100757 - DNA, 25 bp, E. coli
tagccgcgatgacttcgaagacgac

SEQ ID NO: 100758 - DNA, 25 bp, E. coli
tagccgcgatgagttcgaagacgac

SEQ ID NO: 100759 - DNA, 25 bp, E. coli
tttgtggcaaaatccggctctgtcg

SEQ ID NO: 100760 - DNA, 25 bp, E. coli
tttgtggcaaaaaccggctctgtcg

SEQ ID NO: 100761 - DNA, 25 bp, E. coli
tttaccccaaagaggatggctccgg

SEQ ID NO: 100762 - DNA, 25 bp, E. coli
tttaccccaaagtggatggctccgg

SEQ ID NO: 100763 - DNA, 25 bp, E. coli
tcagtgcggcctcctatgacggtca

SEQ ID NO: 100764 - DNA, 25 bp, E. coli
tcagtgcggcctgctatgacggtca

SEQ ID NO: 100765 - DNA, 25 bp, E. coli
gaaggtcgcgcattcaccgataacg

SEQ ID NO: 100766 - DNA, 25 bp, E. coli
gaatttaccgctcacggtggccgca

SEQ ID NO: 100767 - DNA, 25 bp, E. coli
gcaatgtgggctacggcttctggca

SEQ ID NO: 100768 - DNA, 25 bp, E. coli
gaaggtcgcgcaatcaccgataacg

SEQ ID NO: 100769 - DNA, 25 bp, E. coli
gaatttaccgctgacggtggccgca

SEQ ID NO: 100770 - DNA, 25 bp, E. coli
gcaatgtgggcttcggcttctggca

SEQ ID NO: 100771 - DNA, 25 bp, E. coli
gaaatccaacacgtacggctggctg

SEQ ID NO: 100772 - DNA, 25 bp, E. coli
gaaatccaacacctacggctggctg

SEQ ID NO: 100773 - DNA, 25 bp, E. coli
aatacattacatcaatgggacgagg

SEQ ID NO: 100774 - DNA, 25 bp, E. coli
aatacattacatgaatgggacgagg

SEQ ID NO: 100775 - DNA, 25 bp, E. coli
caagttgagttttttgccgacgaag

SEQ ID NO: 100776 - DNA, 25 bp, E. coli
caagttgagtttattgccgacgaag

SEQ ID NO: 100777 - DNA, 25 bp, E. coli
cagttcaatgccgaaaaatacgttt

SEQ ID NO: 100778 - DNA, 25 bp, E. coli
cagttcaatgcccaaaaatacgttt

SEQ ID NO: 100779 - DNA, 25 bp, E. coli
aaatacgttttgcaggacggcgaca

SEQ ID NO: 100780 - DNA, 25 bp, E. coli
aaatacgttttggaggacggcgaca

SEQ ID NO: 100781 - DNA, 25 bp, E. coli
tgaagaagccattgacgctgcacgc

SEQ ID NO: 100782 - DNA, 25 bp, E. coli
tgaagaagccatagacgctgcacgc

SEQ ID NO: 100783 - DNA, 25 bp, E. coli
ccaccgctggattccgaggaaggac

SEQ ID NO: 100784 - DNA, 25 bp, E. coli
ccaccgctggataccgaggaaggac

SEQ ID NO: 100785 - DNA, 25 bp, E. coli
gaatttcagcttgagccaccgctgg

SEQ ID NO: 100786 - DNA, 25 bp, E. coli
gaatttcttgcacacaaccccggca

SEQ ID NO: 100787 - DNA, 25 bp, E. coli
gaatttcttgcagacaaccccggca

SEQ ID NO: 100788 - DNA, 25 bp, E. coli
gaatttcagcttcagccaccgctgg

SEQ ID NO: 100789 - DNA, 25 bp, E. coli
gacggcgacatcttgtggcaagttg

SEQ ID NO: 100790 - DNA, 25 bp, E. coli
gacggcgacatcatgtggcaagttg

SEQ ID NO: 100791 - DNA, 25 bp, E. coli
cgaatgtgcaacagttcaatgccca

SEQ ID NO: 100792 - DNA, 25 bp, E. coli
cgaatgtgcaactgttcaatgccca

SEQ ID NO: 100793 - DNA, 25 bp, E. coli
gacgctgcacgcgaagaatttcttg

SEQ ID NO: 100794 - DNA, 25 bp, E. coli
gacgctgcacgccaagaatttcttg

SEQ ID NO: 100795 - DNA, 25 bp, E. coli
aatgcccggttgattgcgctgcacg

SEQ ID NO: 100796 - DNA, 25 bp, E. coli
aatgcccggttgtttgcgctgcacg

SEQ ID NO: 100797 - DNA, 25 bp, E. coli
aacctgggaaacgattcacggcgcg

SEQ ID NO: 100798 - DNA, 25 bp, E. coli
caccgtctgttacatagcctggaag

SEQ ID NO: 100799 - DNA, 25 bp, E. coli
caccgtctgttagatagcctggaag

SEQ ID NO: 100800 - DNA, 25 bp, E. coli
aacctgggaaaccattcacggcgcg

SEQ ID NO: 100801 - DNA, 25 bp, E. coli
ttcacggcgtgatgaaaaatgcgct

SEQ ID NO: 100802 - DNA, 25 bp, E. coli
ttcacggcgtgaagaaaaatgcgct

SEQ ID NO: 100803 - DNA, 25 bp, E. coli
tgccaaatcaaatggccgccgtgat

SEQ ID NO: 100804 - DNA, 25 bp, E. coli
tgccaaatcaaaaggccgccgtgat

SEQ ID NO: 100805 - DNA, 25 bp, E. coli
ccgttgatctgaatgccgccgagga

SEQ ID NO: 100806 - DNA, 25 bp, E. coli
gccgcgcacgctcattttttatgaa

SEQ ID NO: 100807 - DNA, 25 bp, E. coli
ccgttgatctgattgccgccgagga

SEQ ID NO: 100808 - DNA, 25 bp, E. coli
gccgcgcacgctgattttttatgaa

SEQ ID NO: 100809 - DNA, 25 bp, E. coli
gaacgccgctaattaacgatcctgg

SEQ ID NO: 100810 - DNA, 25 bp, E. coli
gaacgccgctaaataacgatcctgg

SEQ ID NO: 100811 - DNA, 25 bp, E. coli
cattgcgctggtttccgatgccgga

SEQ ID NO: 100812 - DNA, 25 bp, E. coli
ctgtataagtatgcgctggagcagc

SEQ ID NO: 100813 - DNA, 25 bp, E. coli
cattgcgctggtatccgatgccgga

SEQ ID NO: 100814 - DNA, 25 bp, E. coli
ctgtataagtatccgctggagcagc

SEQ ID NO: 100815 - DNA, 25 bp, E. coli
tggcggatatcagccagcgtgcgtt

SEQ ID NO: 100816 - DNA, 25 bp, E. coli
tggcggatatcacccagcgtgcgtt

SEQ ID NO: 100817 - DNA, 25 bp, E. coli
aaccggttgcgctgttggagcgtca

SEQ ID NO: 100818 - DNA, 25 bp, E. coli
cactgctggaaattccatgtgctta

SEQ ID NO: 100819 - DNA, 25 bp, E. coli
cactgctggaaaatccatgtgctta

SEQ ID NO: 100820 - DNA, 25 bp, E. coli
cagttccaggctgcgatagtcgtta

SEQ ID NO: 100821 - DNA, 25 bp, E. coli
cagttccaggctccgatagtcgtta

SEQ ID NO: 100822 - DNA, 25 bp, E. coli
aaagaaaccggttgcgcagttggag

SEQ ID NO: 100823 - DNA, 25 bp, E. coli
aaccggttgcgcagttggagcgtca

SEQ ID NO: 100824 - DNA, 25 bp, E. coli
aaagaaaccggtagcgcagttggag

SEQ ID NO: 100825 - DNA, 25 bp, E. coli
tatgggttgttatcgcagttccagg

SEQ ID NO: 100826 - DNA, 25 bp, E. coli
tatgggttgttaacgcagttccagg

SEQ ID NO: 100827 - DNA, 25 bp, E. coli
tgcgcagttggagcgtcagcattca

SEQ ID NO: 100828 - DNA, 25 bp, E. coli
tccaggctgcgaaagtcgttaactg

SEQ ID NO: 100829 - DNA, 25 bp, E. coli
tgcgcagttggaccgtcagcattca

SEQ ID NO: 100830 - DNA, 25 bp, E. coli
tccaggctgcgatagtcgttaactg

SEQ ID NO: 100831 - DNA, 25 bp, E. coli
ccatgtgcttatcggttgttatcgc

SEQ ID NO: 100832 - DNA, 25 bp, E. coli
ccatgtgcttatgggttgttatcgc

SEQ ID NO: 100833 - DNA, 25 bp, E. coli
gcgatagtcgttaactgttttacac

SEQ ID NO: 100834 - DNA, 25 bp, E. coli
gcgatagtcgtttactgttttacac

SEQ ID NO: 100835 - DNA, 25 bp, E. coli
taataatgttatgaaaaagaaaccg

SEQ ID NO: 100836 - DNA, 25 bp, E. coli
taataatgttatcaaaaagaaaccg

SEQ ID NO: 100837 - DNA, 25 bp, E. coli
gagcgtcagcattcactgctggaaa

SEQ ID NO: 100838 - DNA, 25 bp, E. coli
gagcgtcagcatacactgctggaaa

SEQ ID NO: 100839 - DNA, 25 bp, E. coli
cagcggtttatatagatattcccgg

SEQ ID NO: 100840 - DNA, 25 bp, E. coli
cagcggtttataaagatattcccgg

SEQ ID NO: 100841 - DNA, 25 bp, E. coli
cagcttaatcttccggtggatcgcg

SEQ ID NO: 100842 - DNA, 25 bp, E. coli
cagcttaatcttgcggtggatcgcg

SEQ ID NO: 100843 - DNA, 25 bp, E. coli
acccgttcgcggctgaaatccgcag

SEQ ID NO: 100844 - DNA, 25 bp, E. coli
acccgttcgcgggtgaaatccgcag

SEQ ID NO: 100845 - DNA, 25 bp, E. coli
tttatcgacccagcggatgaatctc

SEQ ID NO: 100846 - DNA, 25 bp, E. coli
tttatcgacccaccggatgaatctc

SEQ ID NO: 100847 - DNA, 25 bp, E. coli
tgaacagcagctaaatcttgcggtg

SEQ ID NO: 100848 - DNA, 25 bp, E. coli
tgaacagcagcttaatcttgcggtg

SEQ ID NO: 100849 - DNA, 25 bp, E. coli
tcttgcggtggatcgcgtgatgacc

SEQ ID NO: 100850 - DNA, 25 bp, E. coli
tcttgcggtggaacgcgtgatgacc

SEQ ID NO: 100851 - DNA, 25 bp, E. coli
gcctgcaacagcacatgcgcggcga

SEQ ID NO: 100852 - DNA, 25 bp, E. coli
gcctgcaacagctcatgcgcggcga

SEQ ID NO: 100853 - DNA, 25 bp, E. coli
gcaacagctcatgcgcggcgacgaa

SEQ ID NO: 100854 - DNA, 25 bp, E. coli
gcaacagctcatccgcggcgacgaa

SEQ ID NO: 100855 - DNA, 25 bp, E. coli
gaaatccgcagtggttacatcgacg

SEQ ID NO: 100856 - DNA, 25 bp, E. coli
gaaatccgcagtcgttacatcgacg

SEQ ID NO: 100857 - DNA, 25 bp, E. coli
cgtatttcagcggtttataaagata

SEQ ID NO: 100858 - DNA, 25 bp, E. coli
cgcagtggttacatcgacgtgtcga

SEQ ID NO: 100859 - DNA, 25 bp, E. coli
cgcagtggttacttcgacgtgtcga

SEQ ID NO: 100860 - DNA, 25 bp, E. coli
cgtatttcagcgctttataaagata

SEQ ID NO: 100861 - DNA, 25 bp, E. coli
tatatccggctggattcggcaagag

SEQ ID NO: 100862 - DNA, 25 bp, E. coli
tatatccggctgcattcggcaagag

SEQ ID NO: 100863 - DNA, 25 bp, E. coli
tttatggtggcaggcacggtcgcct

SEQ ID NO: 100864 - DNA, 25 bp, E. coli
tttatggtggcacgcacggtcgcct

SEQ ID NO: 100865 - DNA, 25 bp, E. coli
tgattatggcgcagtcactcccgct

SEQ ID NO: 100866 - DNA, 25 bp, E. coli
tgattatggcgctgtcactcccgct

SEQ ID NO: 100867 - DNA, 25 bp, E. coli
tgaaaccgctgaggttgacgaccgg

SEQ ID NO: 100868 - DNA, 25 bp, E. coli
tgaaaccgctgacgttgacgaccgg

SEQ ID NO: 100869 - DNA, 25 bp, E. coli
gcgatcctgacttttgccgcagcga

SEQ ID NO: 100870 - DNA, 25 bp, E. coli
gcgatcctgactattgccgcagcga

SEQ ID NO: 100871 - DNA, 25 bp, E. coli
gacaaccctgttaatgctgccctgg

SEQ ID NO: 100872 - DNA, 25 bp, E. coli
gacaaccctgtttatgctgccctgg

SEQ ID NO: 100873 - DNA, 25 bp, E. coli
ctgaagtttattagggcgccgtgga

SEQ ID NO: 100874 - DNA, 25 bp, E. coli
ctgaagtttatttgggcgccgtgga

SEQ ID NO: 100875 - DNA, 25 bp, E. coli
ggtctgtctttacgccacgctgatg

SEQ ID NO: 100876 - DNA, 25 bp, E. coli
ggtctgtctttaggccacgctgatg

SEQ ID NO: 100877 - DNA, 25 bp, E. coli
tcaatgtactgaagcggcaatcgcc

SEQ ID NO: 100878 - DNA, 25 bp, E. coli
tcaatgtactgatgcggcaatcgcc

SEQ ID NO: 100879 - DNA, 25 bp, E. coli
taatcctgcgtggtcaggtcgcgct

SEQ ID NO: 100880 - DNA, 25 bp, E. coli
taatcctgcgtgctcaggtcgcgct

SEQ ID NO: 100881 - DNA, 25 bp, E. coli
tcaacattttggctatgcggcctgc

SEQ ID NO: 100882 - DNA, 25 bp, E. coli
tcaacattttgggtatgcggcctgc

SEQ ID NO: 100883 - DNA, 25 bp, E. coli
cacgctggcgggtcgtttttattgc

SEQ ID NO: 100884 - DNA, 25 bp, E. coli
cacgctggcgggacgtttttattgc

SEQ ID NO: 100885 - DNA, 25 bp, E. coli
aaagcgtcggtacttaagcagaaat

SEQ ID NO: 100886 - DNA, 25 bp, E. coli
aaagcgtcggtagttaagcagaaat

SEQ ID NO: 100887 - DNA, 25 bp, E. coli
tatgtcaaccgatgaaaagcgtcgg

SEQ ID NO: 100888 - DNA, 25 bp, E. coli
tatgtcaaccgaagaaaagcgtcgg

SEQ ID NO: 100889 - DNA, 25 bp, E. coli
tattgcgtcaggcttgacatccgtt

SEQ ID NO: 100890 - DNA, 25 bp, E. coli
tattgcgtcagggttgacatccgtt

SEQ ID NO: 100891 - DNA, 25 bp, E. coli
tttaaccaccgctgcacaattagct

SEQ ID NO: 100892 - DNA, 25 bp, E. coli
ttacggatgcagaactcacgctggc

SEQ ID NO: 100893 - DNA, 25 bp, E. coli
tttaaccaccgcagcacaattagct

SEQ ID NO: 100894 - DNA, 25 bp, E. coli
ttacggatgcagtactcacgctggc

SEQ ID NO: 100895 - DNA, 25 bp, E. coli
tccagtaactctaaaagcatatcgc

SEQ ID NO: 100896 - DNA, 25 bp, E. coli
tccagtaactcttaaagcatatcgc

SEQ ID NO: 100897 - DNA, 25 bp, E. coli
tcaggataggttatgcaacgcgtgc

SEQ ID NO: 100898 - DNA, 25 bp, E. coli
tcaggataggttttgcaacgcgtgc

SEQ ID NO: 100899 - DNA, 25 bp, E. coli
gcatatcgcattgatctggagctga

SEQ ID NO: 100900 - DNA, 25 bp, E. coli
gcatatcgcattcatctggagctga

SEQ ID NO: 100901 - DNA, 25 bp, E. coli
gacatccgtttttgtatccagtaac

SEQ ID NO: 100902 - DNA, 25 bp, E. coli
gacatccgttttagtatccagtaac

SEQ ID NO: 100903 - DNA, 25 bp, E. coli
taatcataactaccgcgaatactca

SEQ ID NO: 100904 - DNA, 25 bp, E. coli
taatcataactagcgcgaatactca

SEQ ID NO: 100905 - DNA, 25 bp, E. coli
caaaataaagtccatcgacccagga

SEQ ID NO: 100906 - DNA, 25 bp, E. coli
caaagcggagttattcgatggcaga

SEQ ID NO: 100907 - DNA, 25 bp, E. coli
caaagccgcgttttctatgcgcgca

SEQ ID NO: 100908 - DNA, 25 bp, E. coli
cagccgtggagttgcgaagaaaagc

SEQ ID NO: 100909 - DNA, 25 bp, E. coli
caaaataaagtcgatcgacccagga

SEQ ID NO: 100910 - DNA, 25 bp, E. coli
caaagcggagtttttcgatggcaga

SEQ ID NO: 100911 - DNA, 25 bp, E. coli
cagccgtggagtagcgaagaaaagc

SEQ ID NO: 100912 - DNA, 25 bp, E. coli
caaagccgcgttatctatgcgcgca

SEQ ID NO: 100913 - DNA, 25 bp, E. coli
tatcacactaaacgccaggcgatgg

SEQ ID NO: 100914 - DNA, 25 bp, E. coli
tatcacactaaaggccaggcgatgg

SEQ ID NO: 100915 - DNA, 25 bp, E. coli
tgataccaacaaagaactacgcgcc

SEQ ID NO: 100916 - DNA, 25 bp, E. coli
tgataccaacaatgaactacgcgcc

SEQ ID NO: 100917 - DNA, 25 bp, E. coli
tgcatattgatagcgggccagcacg

SEQ ID NO: 100918 - DNA, 25 bp, E. coli
tgcatattgataccgggccagcacg

SEQ ID NO: 100919 - DNA, 25 bp, E. coli
tcgaccagttgtatcgcctgcaagg

SEQ ID NO: 100920 - DNA, 25 bp, E. coli
tcgaccagttgtttcgcctgcaagg

SEQ ID NO: 100921 - DNA, 25 bp, E. coli
tcataccggagagtcaatcaaagcg

SEQ ID NO: 100922 - DNA, 25 bp, E. coli
tcataccggagactcaatcaaagcg

SEQ ID NO: 100923 - DNA, 25 bp, E. coli
gttaagcaatatacgcaaagccgcg

SEQ ID NO: 100924 - DNA, 25 bp, E. coli
gttaagcaatattcgcaaagccgcg

SEQ ID NO: 100925 - DNA, 25 bp, E. coli
tggcagaggctaaattcaggaagaa

SEQ ID NO: 100926 - DNA, 25 bp, E. coli
tggcagaggctatattcaggaagaa

SEQ ID NO: 100927 - DNA, 25 bp, E. coli
cacaacgagctaacgaaacttggcg

SEQ ID NO: 100928 - DNA, 25 bp, E. coli
cacaacgagctatcgaaacttggcg

SEQ ID NO: 100929 - DNA, 25 bp, E. coli
caggctgcacaccagatggcgactt

SEQ ID NO: 100930 - DNA, 25 bp, E. coli
cagatggcgactagcgcaatgaaca

SEQ ID NO: 100931 - DNA, 25 bp, E. coli
cagatggcgacttgcgcaatgaaca

SEQ ID NO: 100932 - DNA, 25 bp, E. coli
caggctgcacacgagatggcgactt

SEQ ID NO: 100933 - DNA, 25 bp, E. coli
actgcacagctacggttacaaaggc

SEQ ID NO: 100934 - DNA, 25 bp, E. coli
actgcacagctagggttacaaaggc

SEQ ID NO: 100935 - DNA, 25 bp, E. coli
tatctcgctataccgaatgcatcag

SEQ ID NO: 100936 - DNA, 25 bp, E. coli
tatctcgctatagcgaatgcatcag

SEQ ID NO: 100937 - DNA, 25 bp, E. coli
tgcacaccagatcgcgacttgcgca

SEQ ID NO: 100938 - DNA, 25 bp, E. coli
tgcacaccagatggcgacttgcgca

SEQ ID NO: 100939 - DNA, 25 bp, E. coli
tctgctgcggccgacaacgagctaa

SEQ ID NO: 100940 - DNA, 25 bp, E. coli
tctgctgcggcccacaacgagctaa

SEQ ID NO: 100941 - DNA, 25 bp, E. coli
gcgtgctcaggcagcacaccagatg

SEQ ID NO: 100942 - DNA, 25 bp, E. coli
gctacggttacaaaggcctgaccaa

SEQ ID NO: 100943 - DNA, 25 bp, E. coli
gctacggttacataggcctgaccaa

SEQ ID NO: 100944 - DNA, 25 bp, E. coli
gcgtgctcaggctgcacaccagatg

SEQ ID NO: 100945 - DNA, 25 bp, E. coli
ggcccacaacgagctaacgaaactt

SEQ ID NO: 100946 - DNA, 25 bp, E. coli
ggcccacaacgacctaacgaaactt

SEQ ID NO: 100947 - DNA, 25 bp, E. coli
ggcgacttgcgctatgaacaacatt

SEQ ID NO: 100948 - DNA, 25 bp, E. coli
ggcgacttgcgcaatgaacaacatt

SEQ ID NO: 100949 - DNA, 25 bp, E. coli
caggagtgagggttagggagaggtt

SEQ ID NO: 100950 - DNA, 25 bp, E. coli
caggagtgagggatagggagaggtt

SEQ ID NO: 100951 - DNA, 25 bp, E. coli
cactaagggcggagtgacataattt

SEQ ID NO: 100952 - DNA, 25 bp, E. coli
cactaagggcggtgtgacataattt

SEQ ID NO: 100953 - DNA, 25 bp, E. coli
cccctggtgttcatagtaagcctgg

SEQ ID NO: 100954 - DNA, 25 bp, E. coli
agtgacataatttcaggagtgaggg

SEQ ID NO: 100955 - DNA, 25 bp, E. coli
agtgacataattacaggagtgaggg

SEQ ID NO: 100956 - DNA, 25 bp, E. coli
cccctggtgttcttagtaagcctgg

SEQ ID NO: 100957 - DNA, 25 bp, E. coli
tgttcttagtaaccctggaagctaa

SEQ ID NO: 100958 - DNA, 25 bp, E. coli
tgttcttagtaagcctggaagctaa

SEQ ID NO: 100959 - DNA, 25 bp, E. coli
taagggcggagtcacataatttcag

SEQ ID NO: 100960 - DNA, 25 bp, E. coli
taagggcggagtgacataatttcag

SEQ ID NO: 100961 - DNA, 25 bp, E. coli
tcaccagtatgatgacgtgcttcat

SEQ ID NO: 100962 - DNA, 25 bp, E. coli
gcctggaagctaatcactaagagta

SEQ ID NO: 100963 - DNA, 25 bp, E. coli
gcctggaagctattcactaagagta

SEQ ID NO: 100964 - DNA, 25 bp, E. coli
gctaatcactaacagtatcaccagt

SEQ ID NO: 100965 - DNA, 25 bp, E. coli
gctaatcactaagagtatcaccagt

SEQ ID NO: 100966 - DNA, 25 bp, E. coli
ggcggagtgacaaaatttcaggagt

SEQ ID NO: 100967 - DNA, 25 bp, E. coli
ggcggagtgacataatttcaggagt

SEQ ID NO: 100968 - DNA, 25 bp, E. coli
tcaccagtatgaagacgtgcttcat

SEQ ID NO: 100969 - DNA, 25 bp, E. coli
taagagtatcacgagtatgatgacg

SEQ ID NO: 100970 - DNA, 25 bp, E. coli
taagagtatcaccagtatgatgacg

SEQ ID NO: 100971 - DNA, 25 bp, E. coli
caaagtacaacgtaaaagagctggc

SEQ ID NO: 100972 - DNA, 25 bp, E. coli
caaagtacaacgaaaaagagctggc

SEQ ID NO: 100973 - DNA, 25 bp, E. coli
ttgccgaaaaaagaccgccacagtt

SEQ ID NO: 100974 - DNA, 25 bp, E. coli
ttgccgaaaaaacaccgccacagtt

SEQ ID NO: 100975 - DNA, 25 bp, E. coli
atggtaggtgcaaccgcgcggttca

SEQ ID NO: 100976 - DNA, 25 bp, E. coli
atggtaggtgcatccgcgcggttca

SEQ ID NO: 100977 - DNA, 25 bp, E. coli
tttgtgcccaaaaagcgggcaagcg

SEQ ID NO: 100978 - DNA, 25 bp, E. coli
tttgtgcccaaatagcgggcaagcg

SEQ ID NO: 100979 - DNA, 25 bp, E. coli
gccacagtttctgtaccacggtacg

SEQ ID NO: 100980 - DNA, 25 bp, E. coli
gccacagtttctctaccacggtacg

SEQ ID NO: 100981 - DNA, 25 bp, E. coli
gctggcggatacgagcaagttttta

SEQ ID NO: 100982 - DNA, 25 bp, E. coli
gctggcggataccagcaagttttta

SEQ ID NO: 100983 - DNA, 25 bp, E. coli
gcaggtcgctatatcctttgccgaa

SEQ ID NO: 100984 - DNA, 25 bp, E. coli
gcaggtcgctatttcctttgccgaa

SEQ ID NO: 100985 - DNA, 25 bp, E. coli
gacacaaaccggaggcgattggtat

SEQ ID NO: 100986 - DNA, 25 bp, E. coli
gacacaaaccggtggcgattggtat

SEQ ID NO: 100987 - DNA, 25 bp, E. coli
cgattggtatcgtactggaccgtga

SEQ ID NO: 100988 - DNA, 25 bp, E. coli
cgattggtatcgaactggaccgtga

SEQ ID NO: 100989 - DNA, 25 bp, E. coli
gataagctcatagtttgtgcccaaa

SEQ ID NO: 100990 - DNA, 25 bp, E. coli
gataagctcatactttgtgcccaaa

SEQ ID NO: 100991 - DNA, 25 bp, E. coli
ggcaagccgtttccttgacgagata

SEQ ID NO: 100992 - DNA, 25 bp, E. coli
ggcaagccgtttgcttgacgagata

SEQ ID NO: 100993 - DNA, 25 bp, E. coli
caataacggcgtggtgctggaaagc

SEQ ID NO: 100994 - DNA, 25 bp, E. coli
caataacggcgtcgtgctggaaagc

SEQ ID NO: 100995 - DNA, 25 bp, E. coli
catattctgctgtaaccgtcgccga

SEQ ID NO: 100996 - DNA, 25 bp, E. coli
catattctgctgaaaccgtcgccga

SEQ ID NO: 100997 - DNA, 25 bp, E. coli
aaaacgctgcttctcggtatcgcca

SEQ ID NO: 100998 - DNA, 25 bp, E. coli
aaaacgctgcttgtcggtatcgcca

SEQ ID NO: 100999 - DNA, 25 bp, E. coli
tagtcgataaagtcgcagccgtcgt

SEQ ID NO: 101000 - DNA, 25 bp, E. coli
tagtcgataaagacgcagccgtcgt

SEQ ID NO: 101001 - DNA, 25 bp, E. coli
tgaaaatctccgatgagcagctgga

SEQ ID NO: 101002 - DNA, 25 bp, E. coli
tgaaaatctccgttgagcagctgga

SEQ ID NO: 101003 - DNA, 25 bp, E. coli
tgcgcggcgaaagcaaaaatatctc

SEQ ID NO: 101004 - DNA, 25 bp, E. coli
tgcgcggcgaaaccaaaaatatctc

SEQ ID NO: 101005 - DNA, 25 bp, E. coli
tctgaagtgcgtaacaacgaggtgc

SEQ ID NO: 101006 - DNA, 25 bp, E. coli
tctgaagtgcgttacaacgaggtgc

SEQ ID NO: 101007 - DNA, 25 bp, E. coli
gaactgctggattcccgtaatgtcg

SEQ ID NO: 101008 - DNA, 25 bp, E. coli
gaaagagttctctcaggatccaggc

SEQ ID NO: 101009 - DNA, 25 bp, E. coli
gaaagagttctcacaggatccaggc

SEQ ID NO: 101010 - DNA, 25 bp, E. coli
gaactgctggatacccgtaatgtcg

SEQ ID NO: 101011 - DNA, 25 bp, E. coli
ctgaaagttaacgacctgcgcggcg

SEQ ID NO: 101012 - DNA, 25 bp, E. coli
ctgaaagttaaccacctgcgcggcg

SEQ ID NO: 101013 - DNA, 25 bp, E. coli
taagcaccgcgatgaaaggcgacat

SEQ ID NO: 101014 - DNA, 25 bp, E. coli
taagcaccgcgaagaaaggcgacat

SEQ ID NO: 101015 - DNA, 25 bp, E. coli
caatatgattgaagaaggcgatcgc

SEQ ID NO: 101016 - DNA, 25 bp, E. coli
caatatgattgatgaaggcgatcgc

SEQ ID NO: 101017 - DNA, 25 bp, E. coli
tataccatgctgcagattctgcgca

SEQ ID NO: 101018 - DNA, 25 bp, E. coli
tataccatgctggagattctgcgca

SEQ ID NO: 101019 - DNA, 25 bp, E. coli
tgcagaatgtggtgccgtcgcatct

SEQ ID NO: 101020 - DNA, 25 bp, E. coli
tgcagaatgtggagccgtcgcatct

SEQ ID NO: 101021 - DNA, 25 bp, E. coli
tccgaaactgatgagcgatgatggc

SEQ ID NO: 101022 - DNA, 25 bp, E. coli
tccgaaactgatcagcgatgatggc

SEQ ID NO: 101023 - DNA, 25 bp, E. coli
gccgatgcaaaagcgttcccgatta

SEQ ID NO: 101024 - DNA, 25 bp, E. coli
gcctactgccgcgagaaagatattc

SEQ ID NO: 101025 - DNA, 25 bp, E. coli
gcctactgccgccagaaagatattc

SEQ ID NO: 101026 - DNA, 25 bp, E. coli
gccgatgcaaaaccgttcccgatta

SEQ ID NO: 101027 - DNA, 25 bp, E. coli
gcaaagcgcgccaatcaatttttcg

SEQ ID NO: 101028 - DNA, 25 bp, E. coli
gcaaagcgcgcctatcaatttttcg

SEQ ID NO: 101029 - DNA, 25 bp, E. coli
gattattccgtgcaacctgtgcggt

SEQ ID NO: 101030 - DNA, 25 bp, E. coli
gattattccgtggaacctgtgcggt

SEQ ID NO: 101031 - DNA, 25 bp, E. coli
taacgtgggcgatgccattgctgac

SEQ ID NO: 101032 - DNA, 25 bp, E. coli
taacctcgatcataagcaaccgggc

SEQ ID NO: 101033 - DNA, 25 bp, E. coli
taacctcgatcaaaagcaaccgggc

SEQ ID NO: 101034 - DNA, 25 bp, E. coli
taacgtgggcgaagccattgctgac

SEQ ID NO: 101035 - DNA, 25 bp, E. coli
gatgaaaggtatgcctccgaaactg

SEQ ID NO: 101036 - DNA, 25 bp, E. coli
gatgaaaggtatccctccgaaactg

SEQ ID NO: 101037 - DNA, 25 bp, E. coli
caggtcgttgctatgagtactctcg

SEQ ID NO: 101038 - DNA, 25 bp, E. coli
caggtcgttgctttgagtactctcg

SEQ ID NO: 101039 - DNA, 25 bp, E. coli
aaataaccattcaccactgcctggg

SEQ ID NO: 101040 - DNA, 25 bp, E. coli
aaataaccattctccactgcctggg

SEQ ID NO: 101041 - DNA, 25 bp, E. coli
tatttctggcagctcgttgctatga

SEQ ID NO: 101042 - DNA, 25 bp, E. coli
tatttctggcaggtcgttgctatga

SEQ ID NO: 101043 - DNA, 25 bp, E. coli
tttttcttacctcgccacggtggag

SEQ ID NO: 101044 - DNA, 25 bp, E. coli
tttttcttacctggccacggtggag

SEQ ID NO: 101045 - DNA, 25 bp, E. coli
gccacggtggagaaacaagtatttc

SEQ ID NO: 101046 - DNA, 25 bp, E. coli
gccacggtggagtaacaagtatttc

SEQ ID NO: 101047 - DNA, 25 bp, E. coli
gaaagcaagtttaggcgatgccgat

SEQ ID NO: 101048 - DNA, 25 bp, E. coli
gaaacaagtattactggcaggtcgt

SEQ ID NO: 101049 - DNA, 25 bp, E. coli
gaaacaagtatttctggcaggtcgt

SEQ ID NO: 101050 - DNA, 25 bp, E. coli
gaaagcaagttttggcgatgccgat

SEQ ID NO: 101051 - DNA, 25 bp, E. coli
cgttgctatgagaactctcgaaagc

SEQ ID NO: 101052 - DNA, 25 bp, E. coli
cgttgctatgagtactctcgaaagc

SEQ ID NO: 101053 - DNA, 25 bp, E. coli
tggcgatgccgaaaaataaccattc

SEQ ID NO: 101054 - DNA, 25 bp, E. coli
tggcgatgccgataaataaccattc

SEQ ID NO: 101055 - DNA, 25 bp, E. coli
tcaccactgcctcggcttgagtact

SEQ ID NO: 101056 - DNA, 25 bp, E. coli
tcaccactgcctgggcttgagtact

SEQ ID NO: 101057 - DNA, 25 bp, E. coli
gagtactctcgatagcaagttttgg

SEQ ID NO: 101058 - DNA, 25 bp, E. coli
gagtactctcgaaagcaagttttgg

SEQ ID NO: 101059 - DNA, 25 bp, E. coli
caatctgcgcatacctgaagggtca

SEQ ID NO: 101060 - DNA, 25 bp, E. coli
aatctgcgcattgctgaagggtcaa

SEQ ID NO: 101061 - DNA, 25 bp, E. coli
aatctgcgcattcctgaagggtcaa

SEQ ID NO: 101062 - DNA, 25 bp, E. coli
caatctgcgcattcctgaagggtca

SEQ ID NO: 101063 - DNA, 25 bp, E. coli
cattggtatttctctggtgtaaagt

SEQ ID NO: 101064 - DNA, 25 bp, E. coli
cattggtatttcactggtgtaaagt

SEQ ID NO: 101065 - DNA, 25 bp, E. coli
tgcgcattcctgtagggtcaataaa

SEQ ID NO: 101066 - DNA, 25 bp, E. coli
tgcgcattcctgaagggtcaataaa

SEQ ID NO: 101067 - DNA, 25 bp, E. coli
tctgcgcattcctgaagggtcaata

SEQ ID NO: 101068 - DNA, 25 bp, E. coli
tctgcgcattccagaagggtcaata

SEQ ID NO: 101069 - DNA, 25 bp, E. coli
gccattggtattactctggtgtaaa

SEQ ID NO: 101070 - DNA, 25 bp, E. coli
gccattggtatttctctggtgtaaa

SEQ ID NO: 101071 - DNA, 25 bp, E. coli
gcgcattcctgatgggtcaataaac

SEQ ID NO: 101072 - DNA, 25 bp, E. coli
gcgcattcctgaagggtcaataaac

SEQ ID NO: 101073 - DNA, 25 bp, E. coli
tttggaaggtgcgattggtatttct

SEQ ID NO: 101074 - DNA, 25 bp, E. coli
tttggaaggtgccattggtatttct

SEQ ID NO: 101075 - DNA, 25 bp, E. coli
gaaggtgccattcgtatttctctgg

SEQ ID NO: 101076 - DNA, 25 bp, E. coli
gaaggtgccattggtatttctctgg

SEQ ID NO: 101077 - DNA, 25 bp, E. coli
ggtgccattggtatttctctggtgt

SEQ ID NO: 101078 - DNA, 25 bp, E. coli
ggtgccattggtttttctctggtgt

SEQ ID NO: 101079 - DNA, 25 bp, E. coli
ttggtatttctcaggtgtaaagtga

SEQ ID NO: 101080 - DNA, 25 bp, E. coli
ttggtatttctctggtgtaaagtga

SEQ ID NO: 101081 - DNA, 25 bp, E. coli
caggcactgtgtcgattaagagcaa

SEQ ID NO: 101082 - DNA, 25 bp, E. coli
caggcactgtgtggattaagagcaa

SEQ ID NO: 101083 - DNA, 25 bp, E. coli
agtaacatgtttcggccagccctgg

SEQ ID NO: 101084 - DNA, 25 bp, E. coli
agtaacatgtttgggccagccctgg

SEQ ID NO: 101085 - DNA, 25 bp, E. coli
aaaaaatcatcctggtgccgggtca

SEQ ID NO: 101086 - DNA, 25 bp, E. coli
aaaaaatcatccaggtgccgggtca

SEQ ID NO: 101087 - DNA, 25 bp, E. coli
ttgatgaacatcattgcccgcgccg

SEQ ID NO: 101088 - DNA, 25 bp, E. coli
ttgatgaacatctttgcccgcgccg

SEQ ID NO: 101089 - DNA, 25 bp, E. coli
tgtcgaaatatatcctggcgcctgc

SEQ ID NO: 101090 - DNA, 25 bp, E. coli
tgattgccgagattgtcagcccgca

SEQ ID NO: 101091 - DNA, 25 bp, E. coli
tgtgtaccgcaagaaacagactgag

SEQ ID NO: 101092 - DNA, 25 bp, E. coli
tgtcgaaatataacctggcgcctgc

SEQ ID NO: 101093 - DNA, 25 bp, E. coli
tgtgtaccgcaacaaacagactgag

SEQ ID NO: 101094 - DNA, 25 bp, E. coli
tgattgccgagaatgtcagcccgca

SEQ ID NO: 101095 - DNA, 25 bp, E. coli
gctattgcgacacgtttcccgggtt

SEQ ID NO: 101096 - DNA, 25 bp, E. coli
gctattgcgacaggtttcccgggtt

SEQ ID NO: 101097 - DNA, 25 bp, E. coli
gcaaactgagcaaatacaacctggg

SEQ ID NO: 101098 - DNA, 25 bp, E. coli
gcaaactgagcatatacaacctggg

SEQ ID NO: 101099 - DNA, 25 bp, E. coli
gaaaacccgtcaatcgtctggaaga

SEQ ID NO: 101100 - DNA, 25 bp, E. coli
gaaaacccgtcattcgtctggaaga

SEQ ID NO: 101101 - DNA, 25 bp, E. coli
ccgaaatttgggagaaggtgcatcc

SEQ ID NO: 101102 - DNA, 25 bp, E. coli
ccgaaatttgggtgaaggtgcatcc

SEQ ID NO: 101103 - DNA, 25 bp, E. coli
caaagtgatattggtggcgtcttcc

SEQ ID NO: 101104 - DNA, 25 bp, E. coli
caaagtgatattcgtggcgtcttcc

SEQ ID NO: 101105 - DNA, 25 bp, E. coli
taaacaagctattcgccgtcacctg

SEQ ID NO: 101106 - DNA, 25 bp, E. coli
taaacaagctatacgccgtcacctg

SEQ ID NO: 101107 - DNA, 25 bp, E. coli
acggcgtagcgtttggttactccaa

SEQ ID NO: 101108 - DNA, 25 bp, E. coli
acggcgtagcgtatggttactccaa

SEQ ID NO: 101109 - DNA, 25 bp, E. coli
aaagttaacccgctgtggatcatcg

SEQ ID NO: 101110 - DNA, 25 bp, E. coli
aacttcgaacgtttgcaggcactgg

SEQ ID NO: 101111 - DNA, 25 bp, E. coli
aacttcgaacgtatgcaggcactgg

SEQ ID NO: 101112 - DNA, 25 bp, E. coli
aaagttaacccggtgtggatcatcg

SEQ ID NO: 101113 - DNA, 25 bp, E. coli
tgtttaacctggagcgtctggcaac

SEQ ID NO: 101114 - DNA, 25 bp, E. coli
tgtttaacctggtgcgtctggcaac

SEQ ID NO: 101115 - DNA, 25 bp, E. coli
tggtggcttcctccaaaaactgacg

SEQ ID NO: 101116 - DNA, 25 bp, E. coli
tgctatcaacggaatcaaagtcggt

SEQ ID NO: 101117 - DNA, 25 bp, E. coli
tgctatcaacggtatcaaagtcggt

SEQ ID NO: 101118 - DNA, 25 bp, E. coli
tcgcattactgagcagacgggcaaa

SEQ ID NO: 101119 - DNA, 25 bp, E. coli
tcgcattactgaccagacgggcaaa

SEQ ID NO: 101120 - DNA, 25 bp, E. coli
tctaccctgagaacaacgaagctcg

SEQ ID NO: 101121 - DNA, 25 bp, E. coli
tctaccctgagatcaacgaagctcg

SEQ ID NO: 101122 - DNA, 25 bp, E. coli
gaagaacagcgtgctaatggcgcag

SEQ ID NO: 101123 - DNA, 25 bp, E. coli
gaagaacagcgtcctaatggcgcag

SEQ ID NO: 101124 - DNA, 25 bp, E. coli
tggtggcttcctgcaaaaactgacg

SEQ ID NO: 101125 - DNA, 25 bp, E. coli
aatagtgatttgattcacgctttta

SEQ ID NO: 101126 - DNA, 25 bp, E. coli
aatagtgatttgtttcacgctttta

SEQ ID NO: 101127 - DNA, 25 bp, E. coli
cacgcttttattattcacctggatg

SEQ ID NO: 101128 - DNA, 25 bp, E. coli
cacctggatgataagagattcactg

SEQ ID NO: 101129 - DNA, 25 bp, E. coli
cacctggatgattagagattcactg

SEQ ID NO: 101130 - DNA, 25 bp, E. coli
cacgcttttatttttcacctggatg

SEQ ID NO: 101131 - DNA, 25 bp, E. coli
tatttttcacctggatgataagaga

SEQ ID NO: 101132 - DNA, 25 bp, E. coli
tatttttcacctcgatgataagaga

SEQ ID NO: 101133 - DNA, 25 bp, E. coli
ttcacctggatgataagagattcac

SEQ ID NO: 101134 - DNA, 25 bp, E. coli
ttcacctggatgttaagagattcac

SEQ ID NO: 101135 - DNA, 25 bp, E. coli
tctttaatagtgttttgtttcacgc

SEQ ID NO: 101136 - DNA, 25 bp, E. coli
tctttaatagtgatttgtttcacgc

SEQ ID NO: 101137 - DNA, 25 bp, E. coli
cctggatgataagagattcactgtg

SEQ ID NO: 101138 - DNA, 25 bp, E. coli
cctggatgataacagattcactgtg

SEQ ID NO: 101139 - DNA, 25 bp, E. coli
ctgtgtgaattgcatattaaacagg

SEQ ID NO: 101140 - DNA, 25 bp, E. coli
ctgtgtgaattggatattaaacagg

SEQ ID NO: 101141 - DNA, 25 bp, E. coli
tcactgtgtgaaatgcatattaaac

SEQ ID NO: 101142 - DNA, 25 bp, E. coli
taagagattcacagtgtgaattgca

SEQ ID NO: 101143 - DNA, 25 bp, E. coli
tcactgtgtgaattgcatattaaac

SEQ ID NO: 101144 - DNA, 25 bp, E. coli
taagagattcactgtgtgaattgca

SEQ ID NO: 101145 - DNA, 25 bp, E. coli
gatgataagagattcactgtgtgaa

SEQ ID NO: 101146 - DNA, 25 bp, E. coli
gatgataagagaatcactgtgtgaa

SEQ ID NO: 101147 - DNA, 25 bp, E. coli
ttggtgctggcgatattcccgttca

SEQ ID NO: 101148 - DNA, 25 bp, E. coli
ttggtgctggcgttattcccgttca

SEQ ID NO: 101149 - DNA, 25 bp, E. coli
tgataccttccgatcagcagcgggt

SEQ ID NO: 101150 - DNA, 25 bp, E. coli
tgataccttccgttcagcagcgggt

SEQ ID NO: 101151 - DNA, 25 bp, E. coli
tcttcctgctgaaaccttccgttca

SEQ ID NO: 101152 - DNA, 25 bp, E. coli
tcttcctgctgataccttccgttca

SEQ ID NO: 101153 - DNA, 25 bp, E. coli
gcccttggtgctcgcgatattcccg

SEQ ID NO: 101154 - DNA, 25 bp, E. coli
gcccttggtgctggcgatattcccg

SEQ ID NO: 101155 - DNA, 25 bp, E. coli
cctgcccttggtgctggcgatattc

SEQ ID NO: 101156 - DNA, 25 bp, E. coli
cctgcccttggtcctggcgatattc

SEQ ID NO: 101157 - DNA, 25 bp, E. coli
gcagcgggttgtaatcccttcctga

SEQ ID NO: 101158 - DNA, 25 bp, E. coli
gcagcgggttgttatcccttcctga

SEQ ID NO: 101159 - DNA, 25 bp, E. coli
gctggcgatattcccgttcatcttc

SEQ ID NO: 101160 - DNA, 25 bp, E. coli
gctggcgatattgccgttcatcttc

SEQ ID NO: 101161 - DNA, 25 bp, E. coli
cgttcatcttcctgctgataccttc

SEQ ID NO: 101162 - DNA, 25 bp, E. coli
cgttcatcttccagctgataccttc

SEQ ID NO: 101163 - DNA, 25 bp, E. coli
ttccgttcagcagcgggttgttatc

SEQ ID NO: 101164 - DNA, 25 bp, E. coli
ttccgttcagcaccgggttgttatc

SEQ ID NO: 101165 - DNA, 25 bp, E. coli
tcagcagcgggttgttatcccttcc

SEQ ID NO: 101166 - DNA, 25 bp, E. coli
taccttccgttcagcagcgggttgt

SEQ ID NO: 101167 - DNA, 25 bp, E. coli
tcagcagcgggtagttatcccttcc

SEQ ID NO: 101168 - DNA, 25 bp, E. coli
taccttccgttctgcagcgggttgt

SEQ ID NO: 101169 - DNA, 25 bp, E. coli
aagatggcgaactcagcaaaccgga

SEQ ID NO: 101170 - DNA, 25 bp, E. coli
aagatggcgaacacagcaaaccgga

SEQ ID NO: 101171 - DNA, 25 bp, E. coli
cacgcgcccgcgataagggtctgat

SEQ ID NO: 101172 - DNA, 25 bp, E. coli
cacgcgcccgcgttaagggtctgat

SEQ ID NO: 101173 - DNA, 25 bp, E. coli
cacagcaaaccggacgtaaaactca

SEQ ID NO: 101174 - DNA, 25 bp, E. coli
cacagcaaaccgcacgtaaaactca

SEQ ID NO: 101175 - DNA, 25 bp, E. coli
atggcgaacacaccaaaccggacgt

SEQ ID NO: 101176 - DNA, 25 bp, E. coli
acgcgcccgcgaaaagggtctgatt

SEQ ID NO: 101177 - DNA, 25 bp, E. coli
accgggcggactcggtggcacctat

SEQ ID NO: 101178 - DNA, 25 bp, E. coli
atggcgaacacagcaaaccggacgt

SEQ ID NO: 101179 - DNA, 25 bp, E. coli
accgggcggactgggtggcacctat

SEQ ID NO: 101180 - DNA, 25 bp, E. coli
acgcgcccgcgataagggtctgatt

SEQ ID NO: 101181 - DNA, 25 bp, E. coli
tagcgggaccatggcctttagcggt

SEQ ID NO: 101182 - DNA, 25 bp, E. coli
tagcgggaccatcgcctttagcggt

SEQ ID NO: 101183 - DNA, 25 bp, E. coli
ttgaagatggcgtacacagcaaacc

SEQ ID NO: 101184 - DNA, 25 bp, E. coli
ttgaagatggcgaacacagcaaacc

SEQ ID NO: 101185 - DNA, 25 bp, E. coli
gcgaacacagcaaaccggacgtaaa

SEQ ID NO: 101186 - DNA, 25 bp, E. coli
gcgaacacagcataccggacgtaaa

SEQ ID NO: 101187 - DNA, 25 bp, E. coli
cggaagtgatggtcgccgtcgcacc

SEQ ID NO: 101188 - DNA, 25 bp, E. coli
cggaagtgatggacgccgtcgcacc

SEQ ID NO: 101189 - DNA, 25 bp, E. coli
gaccatcgccttaagcggtgcgtat

SEQ ID NO: 101190 - DNA, 25 bp, E. coli
gaccatcgcctttagcggtgcgtat

SEQ ID NO: 101191 - DNA, 25 bp, E. coli
aaatcctgggttggtaataatggcg

SEQ ID NO: 101192 - DNA, 25 bp, E. coli
aaatcctgggttcgtaataatggcg

SEQ ID NO: 101193 - DNA, 25 bp, E. coli
tgaaccgcgacgatatgaacatgca

SEQ ID NO: 101194 - DNA, 25 bp, E. coli
tgaaccgcgacgttatgaacatgca

SEQ ID NO: 101195 - DNA, 25 bp, E. coli
tctgatattgactggttcaccgctg

SEQ ID NO: 101196 - DNA, 25 bp, E. coli
tctgatattgacaggttcaccgctg

SEQ ID NO: 101197 - DNA, 25 bp, E. coli
tcatatgctggctacagaggtccct

SEQ ID NO: 101198 - DNA, 25 bp, E. coli
tcatatgctggcaacagaggtccct

SEQ ID NO: 101199 - DNA, 25 bp, E. coli
gaaagacgctatattcggcggcaaa

SEQ ID NO: 101200 - DNA, 25 bp, E. coli
gaaaatttaggtcgtgcctccaggg

SEQ ID NO: 101201 - DNA, 25 bp, E. coli
gaaaatttaggtggtgcctccaggg

SEQ ID NO: 101202 - DNA, 25 bp, E. coli
gacattagcgctgctctccggtaaa

SEQ ID NO: 101203 - DNA, 25 bp, E. coli
gaaagacgctattttcggcggcaaa

SEQ ID NO: 101204 - DNA, 25 bp, E. coli
gacattagcgctcctctccggtaaa

SEQ ID NO: 101205 - DNA, 25 bp, E. coli
gatatggtctgaacggagctgctgc

SEQ ID NO: 101206 - DNA, 25 bp, E. coli
gatatggtctgatcggagctgctgc

SEQ ID NO: 101207 - DNA, 25 bp, E. coli
ggaacaaggttctgcacatctggga

SEQ ID NO: 101208 - DNA, 25 bp, E. coli
ggaacaaggttcagcacatctggga

SEQ ID NO: 101209 - DNA, 25 bp, E. coli
tcaaagccttaaacgtgcgatgcgt

SEQ ID NO: 101210 - DNA, 25 bp, E. coli
tcaaagccttaatcgtgcgatgcgt

SEQ ID NO: 101211 - DNA, 25 bp, E. coli
gaggtccctggaccaaaacagcgta

SEQ ID NO: 101212 - DNA, 25 bp, E. coli
gaggtccctggagcaaaacagcgta

SEQ ID NO: 101213 - DNA, 25 bp, E. coli
caaaccggttgatgtaattgactcg

SEQ ID NO: 101214 - DNA, 25 bp, E. coli
tactggtatcaaaaatgcgcgcaca

SEQ ID NO: 101215 - DNA, 25 bp, E. coli
tactggtatcaataatgcgcgcaca

SEQ ID NO: 101216 - DNA, 25 bp, E. coli
caaaccggttgaagtaattgactcg

SEQ ID NO: 101217 - DNA, 25 bp, E. coli
tatggcaaagtccatggtttaggcg

SEQ ID NO: 101218 - DNA, 25 bp, E. coli
tatggcaaagtcgatggtttaggcg

SEQ ID NO: 101219 - DNA, 25 bp, E. coli
tttaggcgtgctaaaggctgcggtt

SEQ ID NO: 101220 - DNA, 25 bp, E. coli
tttaggcgtgcttaaggctgcggtt

SEQ ID NO: 101221 - DNA, 25 bp, E. coli
tgcttatatgttccccgaaatccag

SEQ ID NO: 101222 - DNA, 25 bp, E. coli
tgcttatatgttgcccgaaatccag

SEQ ID NO: 101223 - DNA, 25 bp, E. coli
tgcgggcatgtcaacctctttactg

SEQ ID NO: 101224 - DNA, 25 bp, E. coli
tgcggttgcagccattaaaaaagcc

SEQ ID NO: 101225 - DNA, 25 bp, E. coli
tgcggttgcagcgattaaaaaagcc

SEQ ID NO: 101226 - DNA, 25 bp, E. coli
tgcgggcatgtctacctctttactg

SEQ ID NO: 101227 - DNA, 25 bp, E. coli
gcatttccggaatcactggctggtg

SEQ ID NO: 101228 - DNA, 25 bp, E. coli
gcatttccggaaacactggctggtg

SEQ ID NO: 101229 - DNA, 25 bp, E. coli
gaaaaaggtcagtatgccgatgtcg

SEQ ID NO: 101230 - DNA, 25 bp, E. coli
gaaaaaggtcagaatgccgatgtcg

SEQ ID NO: 101231 - DNA, 25 bp, E. coli
gaaatccagcgtatgttacccaaca

SEQ ID NO: 101232 - DNA, 25 bp, E. coli
gaaatccagcgtttgttacccaaca

SEQ ID NO: 101233 - DNA, 25 bp, E. coli
ccgatgtcgtgtaattagggccgca

SEQ ID NO: 101234 - DNA, 25 bp, E. coli
ccgatgtcgtgttattagggccgca

SEQ ID NO: 101235 - DNA, 25 bp, E. coli
caccgatctggtcattggcgaaaaa

SEQ ID NO: 101236 - DNA, 25 bp, E. coli
caccgatctggtgattggcgaaaaa

SEQ ID NO: 101237 - DNA, 25 bp, E. coli
cagacatagcgttatatatattggc

SEQ ID NO: 101238 - DNA, 25 bp, E. coli
cagacatagcgtaatatatattggc

SEQ ID NO: 101239 - DNA, 25 bp, E. coli
tacaatataataaacaccgatctgg

SEQ ID NO: 101240 - DNA, 25 bp, E. coli
tacaatataatatacaccgatctgg

SEQ ID NO: 101241 - DNA, 25 bp, E. coli
aactaaaacagacgtctgtgcctga

SEQ ID NO: 101242 - DNA, 25 bp, E. coli
aactaaaacagaggtctgtgcctga

SEQ ID NO: 101243 - DNA, 25 bp, E. coli
tatcagccggatatacattccagta

SEQ ID NO: 101244 - DNA, 25 bp, E. coli
tatattggcatttttatcagccgga

SEQ ID NO: 101245 - DNA, 25 bp, E. coli
tatcagccggatttacattccagta

SEQ ID NO: 101246 - DNA, 25 bp, E. coli
tatattggcattattatcagccgga

SEQ ID NO: 101247 - DNA, 25 bp, E. coli
tgtcacgacataaaagaaagatgca

SEQ ID NO: 101248 - DNA, 25 bp, E. coli
tgtcacgacatataagaaagatgca

SEQ ID NO: 101249 - DNA, 25 bp, E. coli
tcatttcaggactctaagcaatcgt

SEQ ID NO: 101250 - DNA, 25 bp, E. coli
tctgggttatcactggtcttattac

SEQ ID NO: 101251 - DNA, 25 bp, E. coli
tcatttcaggacactaagcaatcgt

SEQ ID NO: 101252 - DNA, 25 bp, E. coli
tctgggttatcagtggtcttattac

SEQ ID NO: 101253 - DNA, 25 bp, E. coli
ggataatcataataccccatggtta

SEQ ID NO: 101254 - DNA, 25 bp, E. coli
ggataatcataaaaccccatggtta

SEQ ID NO: 101255 - DNA, 25 bp, E. coli
taatgaaacgaattccactattgac

SEQ ID NO: 101256 - DNA, 25 bp, E. coli
taatgaaacgaaatccactattgac

SEQ ID NO: 101257 - DNA, 25 bp, E. coli
cacaagtcgaactggcgaaaagcgg

SEQ ID NO: 101258 - DNA, 25 bp, E. coli
cacaagtcgaacaggcgaaaagcgg

SEQ ID NO: 101259 - DNA, 25 bp, E. coli
actgaccaatctggcgaaccctaaa

SEQ ID NO: 101260 - DNA, 25 bp, E. coli
actgaccaatctcgcgaaccctaaa

SEQ ID NO: 101261 - DNA, 25 bp, E. coli
aaaagaggttgtatctgcccctgcg

SEQ ID NO: 101262 - DNA, 25 bp, E. coli
aaaagaggttgtttctgcccctgcg

SEQ ID NO: 101263 - DNA, 25 bp, E. coli
ttgtttctgcccgtgcgccacaagt

SEQ ID NO: 101264 - DNA, 25 bp, E. coli
ttgtttctgcccctgcgccacaagt

SEQ ID NO: 101265 - DNA, 25 bp, E. coli
tctactttggttcggtgttctcgct

SEQ ID NO: 101266 - DNA, 25 bp, E. coli
tcttaagggctttctgaccaatctc

SEQ ID NO: 101267 - DNA, 25 bp, E. coli
tctactttggttgggtgttctcgct

SEQ ID NO: 101268 - DNA, 25 bp, E. coli
tcttaagggcttactgaccaatctc

SEQ ID NO: 101269 - DNA, 25 bp, E. coli
gcgggcgcagttatcttaagggctt

SEQ ID NO: 101270 - DNA, 25 bp, E. coli
gcgggcgcagttttcttaagggctt

SEQ ID NO: 101271 - DNA, 25 bp, E. coli
gataatgtcggcaccaccgaacgct

SEQ ID NO: 101272 - DNA, 25 bp, E. coli
gataatgtcggctccaccgaacgct

SEQ ID NO: 101273 - DNA, 25 bp, E. coli
cgcgaaccctaaagcgattatctac

SEQ ID NO: 101274 - DNA, 25 bp, E. coli
cgcgaaccctaatgcgattatctac

SEQ ID NO: 101275 - DNA, 25 bp, E. coli
gtttgtcggtgataatgtcggcacc

SEQ ID NO: 101276 - DNA, 25 bp, E. coli
gtttgtcggtgaaaatgtcggcacc

SEQ ID NO: 101277 - DNA, 25 bp, E. coli
tggttcggtgttgtcgctgtttgtc

SEQ ID NO: 101278 - DNA, 25 bp, E. coli
tggttcggtgttctcgctgtttgtc

SEQ ID NO: 101279 - DNA, 25 bp, E. coli
agttggagagcaatttggcgatgca

SEQ ID NO: 101280 - DNA, 25 bp, E. coli
agttggagagcattttggcgatgca

SEQ ID NO: 101281 - DNA, 25 bp, E. coli
acaggatatggccttattcgcgttg

SEQ ID NO: 101282 - DNA, 25 bp, E. coli
acaggatatggcgttattcgcgttg

SEQ ID NO: 101283 - DNA, 25 bp, E. coli
tatagttggagagcattttggcgat

SEQ ID NO: 101284 - DNA, 25 bp, E. coli
tatagttggagaccattttggcgat

SEQ ID NO: 101285 - DNA, 25 bp, E. coli
tatatagttggagagcattttggcg

SEQ ID NO: 101286 - DNA, 25 bp, E. coli
tatatagttggacagcattttggcg

SEQ ID NO: 101287 - DNA, 25 bp, E. coli
ttgctgcgcttaggccacaatacgc

SEQ ID NO: 101288 - DNA, 25 bp, E. coli
ttgctgcgcttacgccacaatacgc

SEQ ID NO: 101289 - DNA, 25 bp, E. coli
gcgcttacgccacaatacgcagcag

SEQ ID NO: 101290 - DNA, 25 bp, E. coli
gcgcttacgccagaatacgcagcag

SEQ ID NO: 101291 - DNA, 25 bp, E. coli
ccggaagcgtatatagttggagagc

SEQ ID NO: 101292 - DNA, 25 bp, E. coli
ccggaagcgtatttagttggagagc

SEQ ID NO: 101293 - DNA, 25 bp, E. coli
gcgttgctgcgcatacgccacaata

SEQ ID NO: 101294 - DNA, 25 bp, E. coli
gcgttgctgcgcttacgccacaata

SEQ ID NO: 101295 - DNA, 25 bp, E. coli
gaagcgtatatagttggagagcatt

SEQ ID NO: 101296 - DNA, 25 bp, E. coli
gaagcgtatatacttggagagcatt

SEQ ID NO: 101297 - DNA, 25 bp, E. coli
cggaagcgtatatagttggagagca

SEQ ID NO: 101298 - DNA, 25 bp, E. coli
cggaagcgtataaagttggagagca

SEQ ID NO: 101299 - DNA, 25 bp, E. coli
gttgctgcgcttacgccacaatacg

SEQ ID NO: 101300 - DNA, 25 bp, E. coli
gttgctgcgctttcgccacaatacg

SEQ ID NO: 101301 - DNA, 25 bp, E. coli
cacattttatcgccatgaaaaagaa

SEQ ID NO: 101302 - DNA, 25 bp, E. coli
caccacagttaatatgtcatacaat

SEQ ID NO: 101303 - DNA, 25 bp, E. coli
caccacagttaaaatgtcatacaat

SEQ ID NO: 101304 - DNA, 25 bp, E. coli
cacattttatcggcatgaaaaagaa

SEQ ID NO: 101305 - DNA, 25 bp, E. coli
cataaaccacattttatcgccatga

SEQ ID NO: 101306 - DNA, 25 bp, E. coli
cataaaccacatattatcgccatga

SEQ ID NO: 101307 - DNA, 25 bp, E. coli
taaaccacattttatcgccatgaaa

SEQ ID NO: 101308 - DNA, 25 bp, E. coli
taaaccacatttaatcgccatgaaa

SEQ ID NO: 101309 - DNA, 25 bp, E. coli
tacaatttatgtagaaacgcaaacg

SEQ ID NO: 101310 - DNA, 25 bp, E. coli
tacaatttatgttgaaacgcaaacg

SEQ ID NO: 101311 - DNA, 25 bp, E. coli
accacattttatcgccatgaaaaag

SEQ ID NO: 101312 - DNA, 25 bp, E. coli
accacattttatggccatgaaaaag

SEQ ID NO: 101313 - DNA, 25 bp, E. coli
aaaccacattttttcgccatgaaaa

SEQ ID NO: 101314 - DNA, 25 bp, E. coli
aaaccacattttatcgccatgaaaa

SEQ ID NO: 101315 - DNA, 25 bp, E. coli
tgttgaaacgcaaacgtttccctat

SEQ ID NO: 101316 - DNA, 25 bp, E. coli
tgttgaaacgcatacgtttccctat

SEQ ID NO: 101317 - DNA, 25 bp, E. coli
tcgccatgaaaatgaaattatcgcc

SEQ ID NO: 101318 - DNA, 25 bp, E. coli
tcgccatgaaaaagaaattatcgcc

SEQ ID NO: 101319 - DNA, 25 bp, E. coli
tcataaaccacattttatcgccatg

SEQ ID NO: 101320 - DNA, 25 bp, E. coli
tcataaaccacaatttatcgccatg

SEQ ID NO: 101321 - DNA, 25 bp, E. coli
tcacgcgacaaaaatcaccacagtt

SEQ ID NO: 101322 - DNA, 25 bp, E. coli
tcacgcgacaaatatcaccacagtt

SEQ ID NO: 101323 - DNA, 25 bp, E. coli
caactggcccacgaaaaagggctgc

SEQ ID NO: 101324 - DNA, 25 bp, E. coli
caccaaagaggctgcgctaaaagcg

SEQ ID NO: 101325 - DNA, 25 bp, E. coli
caactggcccaccaaaaagggctgc

SEQ ID NO: 101326 - DNA, 25 bp, E. coli
caccaaagaggcagcgctaaaagcg

SEQ ID NO: 101327 - DNA, 25 bp, E. coli
tccggcaccggctgtcaggagttga

SEQ ID NO: 101328 - DNA, 25 bp, E. coli
tccggcaccggcagtcaggagttga

SEQ ID NO: 101329 - DNA, 25 bp, E. coli
gctcaagcaactggcccacgaaaaa

SEQ ID NO: 101330 - DNA, 25 bp, E. coli
gctcaagcaactcgcccacgaaaaa

SEQ ID NO: 101331 - DNA, 25 bp, E. coli
gcagtcaggagttgagcgtccgcat

SEQ ID NO: 101332 - DNA, 25 bp, E. coli
gcagtcaggagtagagcgtccgcat

SEQ ID NO: 101333 - DNA, 25 bp, E. coli
cattcatgaattaggcggcggcgtt

SEQ ID NO: 101334 - DNA, 25 bp, E. coli
cattcatgaatttggcggcggcgtt

SEQ ID NO: 101335 - DNA, 25 bp, E. coli
gtttgcccgcgggaccaaagaggca

SEQ ID NO: 101336 - DNA, 25 bp, E. coli
gtttgcccgcggcaccaaagaggca

SEQ ID NO: 101337 - DNA, 25 bp, E. coli
gggtaccgatctagatacgccatcg

SEQ ID NO: 101338 - DNA, 25 bp, E. coli
ggcagcgctaaatgcggtgatgctc

SEQ ID NO: 101339 - DNA, 25 bp, E. coli
ggagttgagcgtccgcattcatgaa

SEQ ID NO: 101340 - DNA, 25 bp, E. coli
ggcagcgctaaaagcggtgatgctc

SEQ ID NO: 101341 - DNA, 25 bp, E. coli
gggtaccgatcttgatacgccatcg

SEQ ID NO: 101342 - DNA, 25 bp, E. coli
ggagttgagcgtgcgcattcatgaa

SEQ ID NO: 101343 - DNA, 25 bp, E. coli
tggcggcggcgtttcgcaactgatt

SEQ ID NO: 101344 - DNA, 25 bp, E. coli
tggcggcggcgtatcgcaactgatt

SEQ ID NO: 101345 - DNA, 25 bp, E. coli
cattggaccgaatacctgcgttgat

SEQ ID NO: 101346 - DNA, 25 bp, E. coli
catggtaatgagcatcagatcgacg

SEQ ID NO: 101347 - DNA, 25 bp, E. coli
catggtaatgaggatcagatcgacg

SEQ ID NO: 101348 - DNA, 25 bp, E. coli
cattggaccgaaaacctgcgttgat

SEQ ID NO: 101349 - DNA, 25 bp, E. coli
tatctgttcaaatccccaggcggta

SEQ ID NO: 101350 - DNA, 25 bp, E. coli
tatctgttcaaaaccccaggcggta

SEQ ID NO: 101351 - DNA, 25 bp, E. coli
tgatatcttgcgtatgggcgaagcg

SEQ ID NO: 101352 - DNA, 25 bp, E. coli
tgatatcttgcgaatgggcgaagcg

SEQ ID NO: 101353 - DNA, 25 bp, E. coli
tcgcaatgtggtggctcggctgtac

SEQ ID NO: 101354 - DNA, 25 bp, E. coli
tcgcaatgtggtcgctcggctgtac

SEQ ID NO: 101355 - DNA, 25 bp, E. coli
tcagatcgacgtcgctttaggttca

SEQ ID NO: 101356 - DNA, 25 bp, E. coli
tcagatcgacgtggctttaggttca

SEQ ID NO: 101357 - DNA, 25 bp, E. coli
tcatgcacttgacgctttcgaccgc

SEQ ID NO: 101358 - DNA, 25 bp, E. coli
tcatgcacttgaggctttcgaccgc

SEQ ID NO: 101359 - DNA, 25 bp, E. coli
gaaattgagcaacagcaggtcgcac

SEQ ID NO: 101360 - DNA, 25 bp, E. coli
gaaattgagcaagagcaggtcgcac

SEQ ID NO: 101361 - DNA, 25 bp, E. coli
ggttcatacggccaaaacccacgcg

SEQ ID NO: 101362 - DNA, 25 bp, E. coli
ggtcgcacctgggactttcgcaatg

SEQ ID NO: 101363 - DNA, 25 bp, E. coli
ggttcatacggcgaaaacccacgcg

SEQ ID NO: 101364 - DNA, 25 bp, E. coli
ggtcgcacctggcactttcgcaatg

SEQ ID NO: 101365 - DNA, 25 bp, E. coli
tggttgaaatcacaaggcggtgcca

SEQ ID NO: 101366 - DNA, 25 bp, E. coli
tggttgaaatcagaaggcggtgcca

SEQ ID NO: 101367 - DNA, 25 bp, E. coli
aatgatcattaatgagatgtacgac

SEQ ID NO: 101368 - DNA, 25 bp, E. coli
aatgatcattaaagagatgtacgac

SEQ ID NO: 101369 - DNA, 25 bp, E. coli
caaactgcggaaaatcagatggtga

SEQ ID NO: 101370 - DNA, 25 bp, E. coli
caaactgcggaatatcagatggtga

SEQ ID NO: 101371 - DNA, 25 bp, E. coli
cagatggtgatgactgttagcgcgt

SEQ ID NO: 101372 - DNA, 25 bp, E. coli
cagatggtgatgtctgttagcgcgt

SEQ ID NO: 101373 - DNA, 25 bp, E. coli
tagcgcgtcggtattgattcctgga

SEQ ID NO: 101374 - DNA, 25 bp, E. coli
tagcgcgtcggttttgattcctgga

SEQ ID NO: 101375 - DNA, 25 bp, E. coli
tgggtgctgtatgaatctcacagga

SEQ ID NO: 101376 - DNA, 25 bp, E. coli
tgggtgctgtatcaatctcacagga

SEQ ID NO: 101377 - DNA, 25 bp, E. coli
ccatccctgcgtttgggtgctgtat

SEQ ID NO: 101378 - DNA, 25 bp, E. coli
ccatccctgcgtatgggtgctgtat

SEQ ID NO: 101379 - DNA, 25 bp, E. coli
cgaaagataacgtgcaggaaatgat

SEQ ID NO: 101380 - DNA, 25 bp, E. coli
cgaaagataacgagcaggaaatgat

SEQ ID NO: 101381 - DNA, 25 bp, E. coli
gattcctggacgagatatctacccg

SEQ ID NO: 101382 - DNA, 25 bp, E. coli
gttttccgtaatggtcaaactgcgg

SEQ ID NO: 101383 - DNA, 25 bp, E. coli
gattcctggacgtgatatctacccg

SEQ ID NO: 101384 - DNA, 25 bp, E. coli
gttttccgtaatcgtcaaactgcgg

SEQ ID NO: 101385 - DNA, 25 bp, E. coli
tcaatctcacagcataccgcgtcgg

SEQ ID NO: 101386 - DNA, 25 bp, E. coli
tcaatctcacaggataccgcgtcgg

SEQ ID NO: 101387 - DNA, 25 bp, E. coli
gataccgcgtcggttttccgtaatg

SEQ ID NO: 101388 - DNA, 25 bp, E. coli
gataccgcgtcgcttttccgtaatg

SEQ ID NO: 101389 - DNA, 25 bp, E. coli
caaaaaatgtgaaattgcacgcact

SEQ ID NO: 101390 - DNA, 25 bp, E. coli
cactggcctggaacaactgaactta

SEQ ID NO: 101391 - DNA, 25 bp, E. coli
caaaaaatgtgatattgcacgcact

SEQ ID NO: 101392 - DNA, 25 bp, E. coli
cactggcctggatcaactgaactta

SEQ ID NO: 101393 - DNA, 25 bp, E. coli
cactgtcatggtccaactgcttcaa

SEQ ID NO: 101394 - DNA, 25 bp, E. coli
cactgtcatggtgcaactgcttcaa

SEQ ID NO: 101395 - DNA, 25 bp, E. coli
tacgccagtttaagtatctgcctga

SEQ ID NO: 101396 - DNA, 25 bp, E. coli
caatcttgagtaaccccgtcgttga

SEQ ID NO: 101397 - DNA, 25 bp, E. coli
caatcttgagtatccccgtcgttga

SEQ ID NO: 101398 - DNA, 25 bp, E. coli
tacgccagtttatgtatctgcctga

SEQ ID NO: 101399 - DNA, 25 bp, E. coli
ttaagcacaatgatatatcggcgcg

SEQ ID NO: 101400 - DNA, 25 bp, E. coli
ttaagcacaatgttatatcggcgcg

SEQ ID NO: 101401 - DNA, 25 bp, E. coli
cctgaactggcaaggttaagcacaa

SEQ ID NO: 101402 - DNA, 25 bp, E. coli
cctgaactggcatggttaagcacaa

SEQ ID NO: 101403 - DNA, 25 bp, E. coli
cgagatttgtgcctctgatcgagac

SEQ ID NO: 101404 - DNA, 25 bp, E. coli
cgcgtattccgttgcataagtgtgc

SEQ ID NO: 101405 - DNA, 25 bp, E. coli
cgagatttgtgcgtctgatcgagac

SEQ ID NO: 101406 - DNA, 25 bp, E. coli
cgcgtattccgtagcataagtgtgc

SEQ ID NO: 101407 - DNA, 25 bp, E. coli
tcgggttaaacgaggtacagttctg

SEQ ID NO: 101408 - DNA, 25 bp, E. coli
tcgggttaaacgtggtacagttctg

SEQ ID NO: 101409 - DNA, 25 bp, E. coli
gtaataacttctcccactggcctgg

SEQ ID NO: 101410 - DNA, 25 bp, E. coli
gtaataacttctgccactggcctgg

SEQ ID NO: 101411 - DNA, 25 bp, E. coli
taaagaaagttaaaatgccgccagc

SEQ ID NO: 101412 - DNA, 25 bp, E. coli
tactgttgggcgcaaaaatgacgta

SEQ ID NO: 101413 - DNA, 25 bp, E. coli
taaaatgccgcctgcggaactggcg

SEQ ID NO: 101414 - DNA, 25 bp, E. coli
tactgttgggcggaaaaatgacgta

SEQ ID NO: 101415 - DNA, 25 bp, E. coli
taaaatgccgccagcggaactggcg

SEQ ID NO: 101416 - DNA, 25 bp, E. coli
tactggtgttatcttgcgggattaa

SEQ ID NO: 101417 - DNA, 25 bp, E. coli
taaagaaagttataatgccgccagc

SEQ ID NO: 101418 - DNA, 25 bp, E. coli
tactggtgttatgttgcgggattaa

SEQ ID NO: 101419 - DNA, 25 bp, E. coli
tacctgaggaataagtgacttagag

SEQ ID NO: 101420 - DNA, 25 bp, E. coli
tacctgaggaattagtgacttagag

SEQ ID NO: 101421 - DNA, 25 bp, E. coli
tgaggaacattctggatatattaac

SEQ ID NO: 101422 - DNA, 25 bp, E. coli
tgaggaacattcaggatatattaac

SEQ ID NO: 101423 - DNA, 25 bp, E. coli
gaatttaggatttttccggcttcat

SEQ ID NO: 101424 - DNA, 25 bp, E. coli
gaatttaggattattccggcttcat

SEQ ID NO: 101425 - DNA, 25 bp, E. coli
gagaattagtcatattaagcgcaac

SEQ ID NO: 101426 - DNA, 25 bp, E. coli
tgacgtaagttgacgttcgaccggg

SEQ ID NO: 101427 - DNA, 25 bp, E. coli
tgacgtaagttgtcgttcgaccggg

SEQ ID NO: 101428 - DNA, 25 bp, E. coli
gagaattagtcaaattaagcgcaac

SEQ ID NO: 101429 - DNA, 25 bp, E. coli
gatatattaacaattacctgaggaa

SEQ ID NO: 101430 - DNA, 25 bp, E. coli
gatatattaacatttacctgaggaa

SEQ ID NO: 101431 - DNA, 25 bp, E. coli
taagcgcaacgagaagatagaggga

SEQ ID NO: 101432 - DNA, 25 bp, E. coli
taagcgcaacgacaagatagaggga

SEQ ID NO: 101433 - DNA, 25 bp, E. coli
caatgatgtgcatgacgtactggac

SEQ ID NO: 101434 - DNA, 25 bp, E. coli
caatgatgtgcaagacgtactggac

SEQ ID NO: 101435 - DNA, 25 bp, E. coli
caataggtatcggtctcggtgcctg

SEQ ID NO: 101436 - DNA, 25 bp, E. coli
caataggtatcgctctcggtgcctg

SEQ ID NO: 101437 - DNA, 25 bp, E. coli
tactggacgaactactggcaggact

SEQ ID NO: 101438 - DNA, 25 bp, E. coli
tactggacgaacaactggcaggact

SEQ ID NO: 101439 - DNA, 25 bp, E. coli
aaaagtcgccctgctgtcgggtggc

SEQ ID NO: 101440 - DNA, 25 bp, E. coli
aaaagtcgccctcctgtcgggtggc

SEQ ID NO: 101441 - DNA, 25 bp, E. coli
tttaattggcgcgtactgcacctca

SEQ ID NO: 101442 - DNA, 25 bp, E. coli
tttaattggcgcctactgcacctca

SEQ ID NO: 101443 - DNA, 25 bp, E. coli
tgcacctcactgcatatgaccggtt

SEQ ID NO: 101444 - DNA, 25 bp, E. coli
tgcacctcactggatatgaccggtt

SEQ ID NO: 101445 - DNA, 25 bp, E. coli
tcactggacgcctgtgcggaactgg

SEQ ID NO: 101446 - DNA, 25 bp, E. coli
gccagcaagcgggattgactatcga

SEQ ID NO: 101447 - DNA, 25 bp, E. coli
gccagcaagcggcattgactatcga

SEQ ID NO: 101448 - DNA, 25 bp, E. coli
cgatagcggcgtaaaagtgaccact

SEQ ID NO: 101449 - DNA, 25 bp, E. coli
cgatagcggcgttaaagtgaccact

SEQ ID NO: 101450 - DNA, 25 bp, E. coli
gataaaatctttcaatgcgccatgc

SEQ ID NO: 101451 - DNA, 25 bp, E. coli
gataaaatctttgaatgcgccatgc

SEQ ID NO: 101452 - DNA, 25 bp, E. coli
tcactggacgccagtgcggaactgg

SEQ ID NO: 101453 - DNA, 25 bp, E. coli
gatgaaatgttccacaccctgctgg

SEQ ID NO: 101454 - DNA, 25 bp, E. coli
gatgaaatgttcgacaccctgctgg

SEQ ID NO: 101455 - DNA, 25 bp, E. coli
aatgtcgggctttatggcaatgccg

SEQ ID NO: 101456 - DNA, 25 bp, E. coli
aatgtcgggcttaatggcaatgccg

SEQ ID NO: 101457 - DNA, 25 bp, E. coli
aaatggcggaaaacggcgacagctc

SEQ ID NO: 101458 - DNA, 25 bp, E. coli
aaatggcggaaatcggcgacagctc

SEQ ID NO: 101459 - DNA, 25 bp, E. coli
tatcgccggtgttacagcaatgtcg

SEQ ID NO: 101460 - DNA, 25 bp, E. coli
tatcgccggtgtaacagcaatgtcg

SEQ ID NO: 101461 - DNA, 25 bp, E. coli
tttagtggcaaaggtagtacgctgg

SEQ ID NO: 101462 - DNA, 25 bp, E. coli
tttagtggcaaacgtagtacgctgg

SEQ ID NO: 101463 - DNA, 25 bp, E. coli
tctattactggcagcgtgaacgcga

SEQ ID NO: 101464 - DNA, 25 bp, E. coli
tctattactggctgcgtgaacgcga

SEQ ID NO: 101465 - DNA, 25 bp, E. coli
cctatgacgaagtctggtccggcga

SEQ ID NO: 101466 - DNA, 25 bp, E. coli
cctcgattttcactccggttatgct

SEQ ID NO: 101467 - DNA, 25 bp, E. coli
cctcgattttcagtccggttatgct

SEQ ID NO: 101468 - DNA, 25 bp, E. coli
cctatgacgaagactggtccggcga

SEQ ID NO: 101469 - DNA, 25 bp, E. coli
gaacgcgaccgtaaagatgttaccg

SEQ ID NO: 101470 - DNA, 25 bp, E. coli
gaacgcgaccgttaagatgttaccg

SEQ ID NO: 101471 - DNA, 25 bp, E. coli
cgtttacggcgaatgaaatggcgga

SEQ ID NO: 101472 - DNA, 25 bp, E. coli
cgtttacggcgattgaaatggcgga

SEQ ID NO: 101473 - DNA, 25 bp, E. coli
gattcaaccttaaccggcggtatct

SEQ ID NO: 101474 - DNA, 25 bp, E. coli
gattcaaccttatccggcggtatct

SEQ ID NO: 101475 - DNA, 25 bp, E. coli
ggttatgctgctgatatgttcggcc

SEQ ID NO: 101476 - DNA, 25 bp, E. coli
ggttatgctgctcatatgttcggcc

SEQ ID NO: 101477 - DNA, 25 bp, E. coli
cagccaggaagcatacgacgaggcg

SEQ ID NO: 101478 - DNA, 25 bp, E. coli
cacgactggagcagattttaggcca

SEQ ID NO: 101479 - DNA, 25 bp, E. coli
caccagccaggaagcttacgacgag

SEQ ID NO: 101480 - DNA, 25 bp, E. coli
caccagccaggatgcttacgacgag

SEQ ID NO: 101481 - DNA, 25 bp, E. coli
cagccaggaagcttacgacgaggcg

SEQ ID NO: 101482 - DNA, 25 bp, E. coli
cacgactggagctgattttaggcca

SEQ ID NO: 101483 - DNA, 25 bp, E. coli
tacctgaatctgtacggttttctgc

SEQ ID NO: 101484 - DNA, 25 bp, E. coli
tacgctggtgcgttttgatccggtg

SEQ ID NO: 101485 - DNA, 25 bp, E. coli
agcgattacctgtatctgtacggtt

SEQ ID NO: 101486 - DNA, 25 bp, E. coli
agcttacgacgacgcggtggcgaaa

SEQ ID NO: 101487 - DNA, 25 bp, E. coli
agcgattacctgaatctgtacggtt

SEQ ID NO: 101488 - DNA, 25 bp, E. coli
agcttacgacgaggcggtggcgaaa

SEQ ID NO: 101489 - DNA, 25 bp, E. coli
tacgctggtgcgatttgatccggtg

SEQ ID NO: 101490 - DNA, 25 bp, E. coli
tacctgaatctgaacggttttctgc

SEQ ID NO: 101491 - DNA, 25 bp, E. coli
ttttctgcgcgatatctaccagatg

SEQ ID NO: 101492 - DNA, 25 bp, E. coli
ttttctgcgcgaaatctaccagatg

SEQ ID NO: 101493 - DNA, 25 bp, E. coli
tgaatctgtacggttttctgcgcga

SEQ ID NO: 101494 - DNA, 25 bp, E. coli
tgaatctgtacgcttttctgcgcga

SEQ ID NO: 101495 - DNA, 25 bp, E. coli
tctgtacggtttactgcgcgatatc

SEQ ID NO: 101496 - DNA, 25 bp, E. coli
tctgtacggttttctgcgcgatatc

SEQ ID NO: 101497 - DNA, 25 bp, E. coli
gactacgctggtgcgttttgatccg

SEQ ID NO: 101498 - DNA, 25 bp, E. coli
gactacgctggtccgttttgatccg

SEQ ID NO: 101499 - DNA, 25 bp, E. coli
cattgaacagtaaccaggtttctcc

SEQ ID NO: 101500 - DNA, 25 bp, E. coli
catcttcatccgcttcaggtgctat

SEQ ID NO: 101501 - DNA, 25 bp, E. coli
catcttcatccggttcaggtgctat

SEQ ID NO: 101502 - DNA, 25 bp, E. coli
cattgaacagtatccaggtttctcc

SEQ ID NO: 101503 - DNA, 25 bp, E. coli
aggtttctccatcatcttcatccgg

SEQ ID NO: 101504 - DNA, 25 bp, E. coli
aggtttctccatgatcttcatccgg

SEQ ID NO: 101505 - DNA, 25 bp, E. coli
acagtatccaggtttctccatcatc

SEQ ID NO: 101506 - DNA, 25 bp, E. coli
acagtatccaggattctccatcatc

SEQ ID NO: 101507 - DNA, 25 bp, E. coli
tatccaggtttcaccatcatcttca

SEQ ID NO: 101508 - DNA, 25 bp, E. coli
tatccaggtttctccatcatcttca

SEQ ID NO: 101509 - DNA, 25 bp, E. coli
ttcatccggttctggtgctataaat

SEQ ID NO: 101510 - DNA, 25 bp, E. coli
ttcatccggttcaggtgctataaat

SEQ ID NO: 101511 - DNA, 25 bp, E. coli
tccatcatcttcttccggttcaggt

SEQ ID NO: 101512 - DNA, 25 bp, E. coli
tccatcatcttcatccggttcaggt

SEQ ID NO: 101513 - DNA, 25 bp, E. coli
tcttcatccggtacaggtgctataa

SEQ ID NO: 101514 - DNA, 25 bp, E. coli
tcttcatccggttcaggtgctataa

SEQ ID NO: 101515 - DNA, 25 bp, E. coli
ccatcatcttcatccggttcaggtg

SEQ ID NO: 101516 - DNA, 25 bp, E. coli
ccatcatcttcaaccggttcaggtg

SEQ ID NO: 101517 - DNA, 25 bp, E. coli
gaacagtatccacgtttctccatca

SEQ ID NO: 101518 - DNA, 25 bp, E. coli
gaacagtatccaggtttctccatca

SEQ ID NO: 101519 - DNA, 25 bp, E. coli
ggcattgaacagaatccaggtttct

SEQ ID NO: 101520 - DNA, 25 bp, E. coli
ggcattgaacagtatccaggtttct

SEQ ID NO: 101521 - DNA, 25 bp, E. coli
aatgcattcgcactaagtcacggag

SEQ ID NO: 101522 - DNA, 25 bp, E. coli
aatgcattcgcagtaagtcacggag

SEQ ID NO: 101523 - DNA, 25 bp, E. coli
catccaataaatgtcgcgtgttaga

SEQ ID NO: 101524 - DNA, 25 bp, E. coli
cataactccaggtggtcatggtggc

SEQ ID NO: 101525 - DNA, 25 bp, E. coli
catccaataaatctcgcgtgttaga

SEQ ID NO: 101526 - DNA, 25 bp, E. coli
cataactccaggaggtcatggtggc

SEQ ID NO: 101527 - DNA, 25 bp, E. coli
tactcgttaccgtcatctttgtggc

SEQ ID NO: 101528 - DNA, 25 bp, E. coli
tacgagatgatcagttacatccagg

SEQ ID NO: 101529 - DNA, 25 bp, E. coli
tacatccaggacaatgaccaacagg

SEQ ID NO: 101530 - DNA, 25 bp, E. coli
tactcgttaccgacatctttgtggc

SEQ ID NO: 101531 - DNA, 25 bp, E. coli
tacatccaggactatgaccaacagg

SEQ ID NO: 101532 - DNA, 25 bp, E. coli
tacgagatgatctgttacatccagg

SEQ ID NO: 101533 - DNA, 25 bp, E. coli
tccagagcgtagatgacaaaggttt

SEQ ID NO: 101534 - DNA, 25 bp, E. coli
tccagagcgtagttgacaaaggttt

SEQ ID NO: 101535 - DNA, 25 bp, E. coli
gctgggctgtgatgcaatttttcga

SEQ ID NO: 101536 - DNA, 25 bp, E. coli
gctgggctgtgaagcaatttttcga

SEQ ID NO: 101537 - DNA, 25 bp, E. coli
ggagacagcgcaacacttaaagaag

SEQ ID NO: 101538 - DNA, 25 bp, E. coli
ggagacagcgcatcacttaaagaag

SEQ ID NO: 101539 - DNA, 25 bp, E. coli
tcaatgacggtagaaatccagagcg

SEQ ID NO: 101540 - DNA, 25 bp, E. coli
tcaatgacggtacaaatccagagcg

SEQ ID NO: 101541 - DNA, 25 bp, E. coli
gaccaacaggctttgctgagtctca

SEQ ID NO: 101542 - DNA, 25 bp, E. coli
gaccaacaggctatgctgagtctca

SEQ ID NO: 101543 - DNA, 25 bp, E. coli
aaccgcctgcgcctgcgccgggagg

SEQ ID NO: 101544 - DNA, 25 bp, E. coli
aagtggtgctcatccgcctgcgcgt

SEQ ID NO: 101545 - DNA, 25 bp, E. coli
aagtggtgctcaaccgcctgcgcgt

SEQ ID NO: 101546 - DNA, 25 bp, E. coli
caaagtggtgctcaaccgcctgcgc

SEQ ID NO: 101547 - DNA, 25 bp, E. coli
caaagtggtgctgaaccgcctgcgc

SEQ ID NO: 101548 - DNA, 25 bp, E. coli
agtggtgctcaaccgcctgcgcgtg

SEQ ID NO: 101549 - DNA, 25 bp, E. coli
agtggtgctcaagcgcctgcgcgtg

SEQ ID NO: 101550 - DNA, 25 bp, E. coli
aaagtggtgctcaaccgcctgcgcg

SEQ ID NO: 101551 - DNA, 25 bp, E. coli
aaccgcctgcgcgtgcgccgggagg

SEQ ID NO: 101552 - DNA, 25 bp, E. coli
aaagtggtgctctaccgcctgcgcg

SEQ ID NO: 101553 - DNA, 25 bp, E. coli
acaaagggctacgccgccgcaaagt

SEQ ID NO: 101554 - DNA, 25 bp, E. coli
acaaagggctaccccgccgcaaagt

SEQ ID NO: 101555 - DNA, 25 bp, E. coli
tgctcaaccgccagcgcgtgcgccg

SEQ ID NO: 101556 - DNA, 25 bp, E. coli
tgctcaaccgcctgcgcgtgcgccg

SEQ ID NO: 101557 - DNA, 25 bp, E. coli
gccgcaaagtggtgctcaaccgcct

SEQ ID NO: 101558 - DNA, 25 bp, E. coli
gccgcaaagtggagctcaaccgcct

SEQ ID NO: 101559 - DNA, 25 bp, E. coli
gcaaagtggtgctcaaccgcctgcg

SEQ ID NO: 101560 - DNA, 25 bp, E. coli
gcaaagtggtgcacaaccgcctgcg

SEQ ID NO: 101561 - DNA, 25 bp, E. coli
gccgccgcaaagaggtgctcaaccg

SEQ ID NO: 101562 - DNA, 25 bp, E. coli
cgcaaagtggtggtcaaccgcctgc

SEQ ID NO: 101563 - DNA, 25 bp, E. coli
cgcaaagtggtgctcaaccgcctgc

SEQ ID NO: 101564 - DNA, 25 bp, E. coli
gccgccgcaaagtggtgctcaaccg

SEQ ID NO: 101565 - DNA, 25 bp, E. coli
catcgctcattcttccaggcattta

SEQ ID NO: 101566 - DNA, 25 bp, E. coli
catcgctcattcatccaggcattta

SEQ ID NO: 101567 - DNA, 25 bp, E. coli
catggtgtgagcagcgaggctcaaa

SEQ ID NO: 101568 - DNA, 25 bp, E. coli
catggtgtgagctgcgaggctcaaa

SEQ ID NO: 101569 - DNA, 25 bp, E. coli
taaagaagaggcttttgccagagcg

SEQ ID NO: 101570 - DNA, 25 bp, E. coli
taaagaagaggcatttgccagagcg

SEQ ID NO: 101571 - DNA, 25 bp, E. coli
tatggacgaactggaaggtcatgag

SEQ ID NO: 101572 - DNA, 25 bp, E. coli
tatggacgaactcgaaggtcatgag

SEQ ID NO: 101573 - DNA, 25 bp, E. coli
tgttctatcagaaaggaaaaactcc

SEQ ID NO: 101574 - DNA, 25 bp, E. coli
tgttctatcagataggaaaaactcc

SEQ ID NO: 101575 - DNA, 25 bp, E. coli
tgaatattgaacatccctatgggcg

SEQ ID NO: 101576 - DNA, 25 bp, E. coli
tgaatattgaacttccctatgggcg

SEQ ID NO: 101577 - DNA, 25 bp, E. coli
tcagtggtgatattccggcgatccc

SEQ ID NO: 101578 - DNA, 25 bp, E. coli
tcagtggtgataatccggcgatccc

SEQ ID NO: 101579 - DNA, 25 bp, E. coli
ccagagcggatgagcttactgaacg

SEQ ID NO: 101580 - DNA, 25 bp, E. coli
ccagagcggatgtgcttactgaacg

SEQ ID NO: 101581 - DNA, 25 bp, E. coli
gctaaattgtttccgcacactggca

SEQ ID NO: 101582 - DNA, 25 bp, E. coli
gctaaattgtttgcgcacactggca

SEQ ID NO: 101583 - DNA, 25 bp, E. coli
ctttccctggacagtgcggtgacaa

SEQ ID NO: 101584 - DNA, 25 bp, E. coli
ctttccctggactgtgcggtgacaa

SEQ ID NO: 101585 - DNA, 25 bp, E. coli
ggtaatccgatagcccacagcaaat

SEQ ID NO: 101586 - DNA, 25 bp, E. coli
ggtaatccgataccccacagcaaat

SEQ ID NO: 101587 - DNA, 25 bp, E. coli
caatggtcgccatatctttagtaac

SEQ ID NO: 101588 - DNA, 25 bp, E. coli
caatggtcgccaaatctttagtaac

SEQ ID NO: 101589 - DNA, 25 bp, E. coli
catgagcgaaagtaaagaggatatt

SEQ ID NO: 101590 - DNA, 25 bp, E. coli
catgagcgaaagaaaagaggatatt

SEQ ID NO: 101591 - DNA, 25 bp, E. coli
taaacagcaaaaggttgtagagatg

SEQ ID NO: 101592 - DNA, 25 bp, E. coli
taaacagcaaaacgttgtagagatg

SEQ ID NO: 101593 - DNA, 25 bp, E. coli
aaatgacctcagtgttatggctgcc

SEQ ID NO: 101594 - DNA, 25 bp, E. coli
aaatgacctcagagttatggctgcc

SEQ ID NO: 101595 - DNA, 25 bp, E. coli
ttatggctgccatattattggtaga

SEQ ID NO: 101596 - DNA, 25 bp, E. coli
ttatggctgccaaattattggtaga

SEQ ID NO: 101597 - DNA, 25 bp, E. coli
ttttaattcattctcagagccagga

SEQ ID NO: 101598 - DNA, 25 bp, E. coli
ttttaattcattgtcagagccagga

SEQ ID NO: 101599 - DNA, 25 bp, E. coli
tttccatatctgacttacaagctga

SEQ ID NO: 101600 - DNA, 25 bp, E. coli
tttccatatctgtcttacaagctga

SEQ ID NO: 101601 - DNA, 25 bp, E. coli
tgtcattaagttatccatatctgtc

SEQ ID NO: 101602 - DNA, 25 bp, E. coli
tgtcattaagttttccatatctgtc

SEQ ID NO: 101603 - DNA, 25 bp, E. coli
gcaaaacgttgtagagatggtttat

SEQ ID NO: 101604 - DNA, 25 bp, E. coli
gaatcatgagcgaaagtaaagagga

SEQ ID NO: 101605 - DNA, 25 bp, E. coli
gaatcatgagcgtaagtaaagagga

SEQ ID NO: 101606 - DNA, 25 bp, E. coli
gcaaaacgttgttgagatggtttat

SEQ ID NO: 101607 - DNA, 25 bp, E. coli
cgctcttgataaaaaagaattaaat

SEQ ID NO: 101608 - DNA, 25 bp, E. coli
cgctcttgataataaagaattaaat

SEQ ID NO: 101609 - DNA, 25 bp, E. coli
cacaaatgaatgagcagaccgggca

SEQ ID NO: 101610 - DNA, 25 bp, E. coli
cacaaatgaatgtgcagaccgggca

SEQ ID NO: 101611 - DNA, 25 bp, E. coli
taaaggagaacaacccatttgcgtg

SEQ ID NO: 101612 - DNA, 25 bp, E. coli
taaaggagaacatcccatttgcgtg

SEQ ID NO: 101613 - DNA, 25 bp, E. coli
aaaaggaggcgtcacatcatgcatg

SEQ ID NO: 101614 - DNA, 25 bp, E. coli
aaaattgcccgacgatggcgatgca

SEQ ID NO: 101615 - DNA, 25 bp, E. coli
aaaattgcccgaggatggcgatgca

SEQ ID NO: 101616 - DNA, 25 bp, E. coli
aaaaggaggcgtgacatcatgcatg

SEQ ID NO: 101617 - DNA, 25 bp, E. coli
tacctgattcgtggattacgcagcc

SEQ ID NO: 101618 - DNA, 25 bp, E. coli
tacctgattcgtcgattacgcagcc

SEQ ID NO: 101619 - DNA, 25 bp, E. coli
tgattaaaccgcttcagggcgcgga

SEQ ID NO: 101620 - DNA, 25 bp, E. coli
tgattaaaccgcatcagggcgcgga

SEQ ID NO: 101621 - DNA, 25 bp, E. coli
cctgtaaccattgcgcggatccgat

SEQ ID NO: 101622 - DNA, 25 bp, E. coli
cctgtaaccattccgcggatccgat

SEQ ID NO: 101623 - DNA, 25 bp, E. coli
gccctattgatgtgttgcgtgaaaa

SEQ ID NO: 101624 - DNA, 25 bp, E. coli
gccctattgatgagttgcgtgaaaa

SEQ ID NO: 101625 - DNA, 25 bp, E. coli
gatccgatctgttccaaaaattgcc

SEQ ID NO: 101626 - DNA, 25 bp, E. coli
taagtgcgtcggatgcggttactgc

SEQ ID NO: 101627 - DNA, 25 bp, E. coli
taagtgcgtcggttgcggttactgc

SEQ ID NO: 101628 - DNA, 25 bp, E. coli
gatccgatctgtaccaaaaattgcc

SEQ ID NO: 101629 - DNA, 25 bp, E. coli
gatgcataagcgacccggagacggt

SEQ ID NO: 101630 - DNA, 25 bp, E. coli
gatgcataagcgtcccggagacggt

SEQ ID NO: 101631 - DNA, 25 bp, E. coli
aaggtatgtctgtctgtatccggcc

SEQ ID NO: 101632 - DNA, 25 bp, E. coli
aaggtatgtctgactgtatccggcc

SEQ ID NO: 101633 - DNA, 25 bp, E. coli
taaaaatgtctgacaggccggcatc

SEQ ID NO: 101634 - DNA, 25 bp, E. coli
taaaaatgtctgtcaggccggcatc

SEQ ID NO: 101635 - DNA, 25 bp, E. coli
tatctgctgagactctggctgccgg

SEQ ID NO: 101636 - DNA, 25 bp, E. coli
tatctgctgagagtctggctgccgg

SEQ ID NO: 101637 - DNA, 25 bp, E. coli
ttctgcttgatgtacccacgacggg

SEQ ID NO: 101638 - DNA, 25 bp, E. coli
ttctgcttgatgaacccacgacggg

SEQ ID NO: 101639 - DNA, 25 bp, E. coli
tgcagctttcgcctcttccgggaag

SEQ ID NO: 101640 - DNA, 25 bp, E. coli
tgaatgaaatagttcgccgcccggt

SEQ ID NO: 101641 - DNA, 25 bp, E. coli
tgcagctttcgcgtcttccgggaag

SEQ ID NO: 101642 - DNA, 25 bp, E. coli
tgaatgaaatagatcgccgcccggt

SEQ ID NO: 101643 - DNA, 25 bp, E. coli
tcatattaatgcgtccatgcgggaa

SEQ ID NO: 101644 - DNA, 25 bp, E. coli
tcatattaatgcctccatgcgggaa

SEQ ID NO: 101645 - DNA, 25 bp, E. coli
gctctggacggaatagaaaccctga

SEQ ID NO: 101646 - DNA, 25 bp, E. coli
gctctggacggattagaaaccctga

SEQ ID NO: 101647 - DNA, 25 bp, E. coli
gaattccatttcagcgcagtcacgt

SEQ ID NO: 101648 - DNA, 25 bp, E. coli
gaattccatttctgcgcagtcacgt

SEQ ID NO: 101649 - DNA, 25 bp, E. coli
tggatatactgcaagtgtcgcccgt

SEQ ID NO: 101650 - DNA, 25 bp, E. coli
tggatatactgctagtgtcgcccgt

SEQ ID NO: 101651 - DNA, 25 bp, E. coli
gatggtccccgccatgaaatactga

SEQ ID NO: 101652 - DNA, 25 bp, E. coli
gatggtccccgcgatgaaatactga

SEQ ID NO: 101653 - DNA, 25 bp, E. coli
cacgcgtgctgaacaaattccggta

SEQ ID NO: 101654 - DNA, 25 bp, E. coli
cacgcgtgctgatcaaattccggta

SEQ ID NO: 101655 - DNA, 25 bp, E. coli
cagacatcatcatgccgacgggtaa

SEQ ID NO: 101656 - DNA, 25 bp, E. coli
cagacatcatcaagccgacgggtaa

SEQ ID NO: 101657 - DNA, 25 bp, E. coli
aaaacgaggctgtgttgaacgcgct

SEQ ID NO: 101658 - DNA, 25 bp, E. coli
aaaacgaggctgagttgaacgcgct

SEQ ID NO: 101659 - DNA, 25 bp, E. coli
tattcgtctcgaagaccgcgcggtt

SEQ ID NO: 101660 - DNA, 25 bp, E. coli
tattaaaggaagagacgcagcatgc

SEQ ID NO: 101661 - DNA, 25 bp, E. coli
tattcgtctcgatgaccgcgcggtt

SEQ ID NO: 101662 - DNA, 25 bp, E. coli
tattaaaggaagtgacgcagcatgc

SEQ ID NO: 101663 - DNA, 25 bp, E. coli
tcggtaaagagatagtcggcgtgct

SEQ ID NO: 101664 - DNA, 25 bp, E. coli
tcggtaaagagaaagtcggcgtgct

SEQ ID NO: 101665 - DNA, 25 bp, E. coli
gaagcttgaaaatgccagacccgcg

SEQ ID NO: 101666 - DNA, 25 bp, E. coli
gaagcttgaaaaagccagacccgcg

SEQ ID NO: 101667 - DNA, 25 bp, E. coli
gaacatcatgaacgatatcgcgcgc

SEQ ID NO: 101668 - DNA, 25 bp, E. coli
gaacatcatgaaggatatcgcgcgc

SEQ ID NO: 101669 - DNA, 25 bp, E. coli
gaaattcgaagataacgcgctgccg

SEQ ID NO: 101670 - DNA, 25 bp, E. coli
gaaattcgtgaaaccctgactcgcc

SEQ ID NO: 101671 - DNA, 25 bp, E. coli
gaaattcgtgaatccctgactcgcc

SEQ ID NO: 101672 - DNA, 25 bp, E. coli
gaaattcgaagaaaacgcgctgccg

SEQ ID NO: 101673 - DNA, 25 bp, E. coli
gatgttacgtccagaatggccagcg

SEQ ID NO: 101674 - DNA, 25 bp, E. coli
gatgttacgtcctgaatggccagcg

SEQ ID NO: 101675 - DNA, 25 bp, E. coli
taactggttcgaagtccggttttag

SEQ ID NO: 101676 - DNA, 25 bp, E. coli
taactggttcgatgtccggttttag

SEQ ID NO: 101677 - DNA, 25 bp, E. coli
tatggttaacttgcagagaaaccgg

SEQ ID NO: 101678 - DNA, 25 bp, E. coli
tatggttaacttccagagaaaccgg

SEQ ID NO: 101679 - DNA, 25 bp, E. coli
tagtgtctgttttttgcgcatgtcc

SEQ ID NO: 101680 - DNA, 25 bp, E. coli
tagtgtctgtttattgcgcatgtcc

SEQ ID NO: 101681 - DNA, 25 bp, E. coli
tatttttcatatggttaacttgcag

SEQ ID NO: 101682 - DNA, 25 bp, E. coli
tatttttcatatcgttaacttgcag

SEQ ID NO: 101683 - DNA, 25 bp, E. coli
tgcacactttcggttaactggttcg

SEQ ID NO: 101684 - DNA, 25 bp, E. coli
tgcacactttcgcttaactggttcg

SEQ ID NO: 101685 - DNA, 25 bp, E. coli
tcgatgtccggttttagtgtctgtt

SEQ ID NO: 101686 - DNA, 25 bp, E. coli
tcgatgtccggtattagtgtctgtt

SEQ ID NO: 101687 - DNA, 25 bp, E. coli
tcggttaactggttcgatgtccggt

SEQ ID NO: 101688 - DNA, 25 bp, E. coli
tcggttaactggatcgatgtccggt

SEQ ID NO: 101689 - DNA, 25 bp, E. coli
ccggttcatggatagcatgttttta

SEQ ID NO: 101690 - DNA, 25 bp, E. coli
ccggttcatggaaagcatgttttta

SEQ ID NO: 101691 - DNA, 25 bp, E. coli
gcgcatgtccggatcatggaaagca

SEQ ID NO: 101692 - DNA, 25 bp, E. coli
gcatgtgatttgtgcacactttcgg

SEQ ID NO: 101693 - DNA, 25 bp, E. coli
gcgcatgtccggttcatggaaagca

SEQ ID NO: 101694 - DNA, 25 bp, E. coli
gcatgtgatttgagcacactttcgg

SEQ ID NO: 101695 - DNA, 25 bp, E. coli
ctgttttttgcggatgtccggttca

SEQ ID NO: 101696 - DNA, 25 bp, E. coli
ctgttttttgcgcatgtccggttca

SEQ ID NO: 101697 - DNA, 25 bp, E. coli
ccggcgtgatcaaactaacgttttg

SEQ ID NO: 101698 - DNA, 25 bp, E. coli
ccggcgtgatcatactaacgttttg

SEQ ID NO: 101699 - DNA, 25 bp, E. coli
tatccgcattttagctttgcatgag

SEQ ID NO: 101700 - DNA, 25 bp, E. coli
tatccgcatttttgctttgcatgag

SEQ ID NO: 101701 - DNA, 25 bp, E. coli
tgatcatactaacgttttgatgcac

SEQ ID NO: 101702 - DNA, 25 bp, E. coli
tgatcatactaaggttttgatgcac

SEQ ID NO: 101703 - DNA, 25 bp, E. coli
tgccaaccggcgtgatcatactaac

SEQ ID NO: 101704 - DNA, 25 bp, E. coli
tgccaaccggcgagatcatactaac

SEQ ID NO: 101705 - DNA, 25 bp, E. coli
gctcagggatattttcgcccacata

SEQ ID NO: 101706 - DNA, 25 bp, E. coli
gctttgcatgagttacacaatctca

SEQ ID NO: 101707 - DNA, 25 bp, E. coli
gctcagggatatattcgcccacata

SEQ ID NO: 101708 - DNA, 25 bp, E. coli
gctttgcatgagatacacaatctca

SEQ ID NO: 101709 - DNA, 25 bp, E. coli
gcacgctcagggatattttcgccca

SEQ ID NO: 101710 - DNA, 25 bp, E. coli
gcacgctcagggttattttcgccca

SEQ ID NO: 101711 - DNA, 25 bp, E. coli
gacagcacccttatccgcatttttg

SEQ ID NO: 101712 - DNA, 25 bp, E. coli
gacagcacccttttccgcatttttg

SEQ ID NO: 101713 - DNA, 25 bp, E. coli
tcaaagatcgaggactaacgcgcgg

SEQ ID NO: 101714 - DNA, 25 bp, E. coli
tcaaagatcgagcactaacgcgcgg

SEQ ID NO: 101715 - DNA, 25 bp, E. coli
tcaacaacttttagatgacagcacc

SEQ ID NO: 101716 - DNA, 25 bp, E. coli
tcaacaactttttgatgacagcacc

SEQ ID NO: 101717 - DNA, 25 bp, E. coli
gagttacacaatgtcaaagatcgag

SEQ ID NO: 101718 - DNA, 25 bp, E. coli
gagttacacaatctcaaagatcgag

SEQ ID NO: 101719 - DNA, 25 bp, E. coli
cacgctcatggttggcgactcgtta

SEQ ID NO: 101720 - DNA, 25 bp, E. coli
cacgctcatggtaggcgactcgtta

SEQ ID NO: 101721 - DNA, 25 bp, E. coli
tacagtactgggattcacgctcatg

SEQ ID NO: 101722 - DNA, 25 bp, E. coli
tacagtactgggtttcacgctcatg

SEQ ID NO: 101723 - DNA, 25 bp, E. coli
tactgggattcaggctcatggtagg

SEQ ID NO: 101724 - DNA, 25 bp, E. coli
tactgggattcacgctcatggtagg

SEQ ID NO: 101725 - DNA, 25 bp, E. coli
taggcgactcgttatgtgagttgag

SEQ ID NO: 101726 - DNA, 25 bp, E. coli
tatgtgagttgagtatcagagagcg

SEQ ID NO: 101727 - DNA, 25 bp, E. coli
tatgtgagttgactatcagagagcg

SEQ ID NO: 101728 - DNA, 25 bp, E. coli
taggcgactcgtaatgtgagttgag

SEQ ID NO: 101729 - DNA, 25 bp, E. coli
ttgtggcaatcatagtactgtgttg

SEQ ID NO: 101730 - DNA, 25 bp, E. coli
ttgtggcaatcaaagtactgtgttg

SEQ ID NO: 101731 - DNA, 25 bp, E. coli
tgttgtacagtagtgggattcacgc

SEQ ID NO: 101732 - DNA, 25 bp, E. coli
tgttgtacagtactgggattcacgc

SEQ ID NO: 101733 - DNA, 25 bp, E. coli
tcagagagcgtggtatggagtttaa

SEQ ID NO: 101734 - DNA, 25 bp, E. coli
tcagagagcgtgctatggagtttaa

SEQ ID NO: 101735 - DNA, 25 bp, E. coli
gcaatcatagtagtgtgttgtacag

SEQ ID NO: 101736 - DNA, 25 bp, E. coli
gcaatcatagtactgtgttgtacag

SEQ ID NO: 101737 - DNA, 25 bp, E. coli
gtatggagtttatggcagttctcgc

SEQ ID NO: 101738 - DNA, 25 bp, E. coli
gtatggagtttaaggcagttctcgc

SEQ ID NO: 101739 - DNA, 25 bp, E. coli
ggattcacgctcatggtaggcgact

SEQ ID NO: 101740 - DNA, 25 bp, E. coli
ggattcacgctcttggtaggcgact

SEQ ID NO: 101741 - DNA, 25 bp, E. coli
cagggcgaaactgtcgctgaagcga

SEQ ID NO: 101742 - DNA, 25 bp, E. coli
cagggcgaaactctcgctgaagcga

SEQ ID NO: 101743 - DNA, 25 bp, E. coli
tattttgaagattacgagcttatcc

SEQ ID NO: 101744 - DNA, 25 bp, E. coli
tattgaagtaccattgagcgtcgcc

SEQ ID NO: 101745 - DNA, 25 bp, E. coli
tattttgaagataacgagcttatcc

SEQ ID NO: 101746 - DNA, 25 bp, E. coli
tattgaagtacctttgagcgtcgcc

SEQ ID NO: 101747 - DNA, 25 bp, E. coli
ttgtggatatccgtgaagcgttgac

SEQ ID NO: 101748 - DNA, 25 bp, E. coli
ttgtggatatccctgaagcgttgac

SEQ ID NO: 101749 - DNA, 25 bp, E. coli
tgaagcgatggatgcggcaaaagat

SEQ ID NO: 101750 - DNA, 25 bp, E. coli
tgaagcgatggaagcggcaaaagat

SEQ ID NO: 101751 - DNA, 25 bp, E. coli
tgcgagagacagtcgaaattatgcg

SEQ ID NO: 101752 - DNA, 25 bp, E. coli
tgcgagagacagacgaaattatgcg

SEQ ID NO: 101753 - DNA, 25 bp, E. coli
gccggaaggcggttatatggtttct

SEQ ID NO: 101754 - DNA, 25 bp, E. coli
gccggaaggcggatatatggtttct

SEQ ID NO: 101755 - DNA, 25 bp, E. coli
gaaattatgcgttatcccgtcactc

SEQ ID NO: 101756 - DNA, 25 bp, E. coli
gaaattatgcgtaatcccgtcactc

SEQ ID NO: 101757 - DNA, 25 bp, E. coli
ggcaaaagatgctttactgaccgca

SEQ ID NO: 101758 - DNA, 25 bp, E. coli
ggcaaaagatgcattactgaccgca

SEQ ID NO: 101759 - DNA, 25 bp, E. coli
gaccgcatttgatttttattttgaa

SEQ ID NO: 101760 - DNA, 25 bp, E. coli
gagcttatccctataccttcgccat

SEQ ID NO: 101761 - DNA, 25 bp, E. coli
gaccgcatttgaattttattttgaa

SEQ ID NO: 101762 - DNA, 25 bp, E. coli
gagcttatccctttaccttcgccat

SEQ ID NO: 101763 - DNA, 25 bp, E. coli
attattggcgcgttcaccacactga

SEQ ID NO: 101764 - DNA, 25 bp, E. coli
agatcgggccgcagcttggcccggc

SEQ ID NO: 101765 - DNA, 25 bp, E. coli
atctctccggctttctgttgctggc

SEQ ID NO: 101766 - DNA, 25 bp, E. coli
attattggcgcgatcaccacactga

SEQ ID NO: 101767 - DNA, 25 bp, E. coli
atctctccggctatctgttgctggc

SEQ ID NO: 101768 - DNA, 25 bp, E. coli
agatcgggccgctgcttggcccggc

SEQ ID NO: 101769 - DNA, 25 bp, E. coli
ttattggcgcgatcaccacactgat

SEQ ID NO: 101770 - DNA, 25 bp, E. coli
ttattggcgcgaacaccacactgat

SEQ ID NO: 101771 - DNA, 25 bp, E. coli
tgcccggtcagatcgggccgctgct

SEQ ID NO: 101772 - DNA, 25 bp, E. coli
tgcccggtcagaacgggccgctgct

SEQ ID NO: 101773 - DNA, 25 bp, E. coli
tctctccggcttactgttgctggcg

SEQ ID NO: 101774 - DNA, 25 bp, E. coli
tctctccggctttctgttgctggcg

SEQ ID NO: 101775 - DNA, 25 bp, E. coli
tctccggctttctgttgctggcggt

SEQ ID NO: 101776 - DNA, 25 bp, E. coli
tctccggctttcagttgctggcggt

SEQ ID NO: 101777 - DNA, 25 bp, E. coli
gcccaaaataacaaccgcgccctgt

SEQ ID NO: 101778 - DNA, 25 bp, E. coli
gcccaaaataactaccgcgccctgt

SEQ ID NO: 101779 - DNA, 25 bp, E. coli
ctctccggctttctgttgctggcgg

SEQ ID NO: 101780 - DNA, 25 bp, E. coli
ctctccggctttgtgttgctggcgg

SEQ ID NO: 101781 - DNA, 25 bp, E. coli
gattattggcgccatcaccacactg

SEQ ID NO: 101782 - DNA, 25 bp, E. coli
gattattggcgcgatcaccacactg

SEQ ID NO: 101783 - DNA, 25 bp, E. coli
gatctctccggctttctgttgctgg

SEQ ID NO: 101784 - DNA, 25 bp, E. coli
gatctctccggcattctgttgctgg

SEQ ID NO: 101785 - DNA, 25 bp, E. coli
catgtaccgtggaatgacgcgtacc

SEQ ID NO: 101786 - DNA, 25 bp, E. coli
catgtaccgtggtatgacgcgtacc

SEQ ID NO: 101787 - DNA, 25 bp, E. coli
taaacgtggtttggacagcggcgat

SEQ ID NO: 101788 - DNA, 25 bp, E. coli
aaaccggcgatcaggaagaggcgct

SEQ ID NO: 101789 - DNA, 25 bp, E. coli
aaaccggcgatctggaagaggcgct

SEQ ID NO: 101790 - DNA, 25 bp, E. coli
tatctgtgcgtatggaactccaggc

SEQ ID NO: 101791 - DNA, 25 bp, E. coli
tatctgtgcgtaaggaactccaggc

SEQ ID NO: 101792 - DNA, 25 bp, E. coli
gcggcgatccgggacaatgcaatac

SEQ ID NO: 101793 - DNA, 25 bp, E. coli
gcggcgatccggcacaatgcaatac

SEQ ID NO: 101794 - DNA, 25 bp, E. coli
gcagaaactgttaggcatcgagccg

SEQ ID NO: 101795 - DNA, 25 bp, E. coli
gaagccgcaaaattcacctcggtga

SEQ ID NO: 101796 - DNA, 25 bp, E. coli
gcaaccgaagctcgtcatgtaccgt

SEQ ID NO: 101797 - DNA, 25 bp, E. coli
gcagaaactgtttggcatcgagccg

SEQ ID NO: 101798 - DNA, 25 bp, E. coli
gcaaccgaagctggtcatgtaccgt

SEQ ID NO: 101799 - DNA, 25 bp, E. coli
gaagccgcaaaaatcacctcggtga

SEQ ID NO: 101800 - DNA, 25 bp, E. coli
gattctggcaacgacggaagacacc

SEQ ID NO: 101801 - DNA, 25 bp, E. coli
gattctggcaaccacggaagacacc

SEQ ID NO: 101802 - DNA, 25 bp, E. coli
ggcgagtagtacgagacagtttcac

SEQ ID NO: 101803 - DNA, 25 bp, E. coli
ggcgagtagtaccagacagtttcac

SEQ ID NO: 101804 - DNA, 25 bp, E. coli
taaacgtggtttcgacagcggcgat

SEQ ID NO: 101805 - DNA, 25 bp, E. coli
gaccgtttacaagagcaaagtcagg

SEQ ID NO: 101806 - DNA, 25 bp, E. coli
gaccgtttacaacagcaaagtcagg

SEQ ID NO: 101807 - DNA, 25 bp, E. coli
aaatggcgcctctttacttgactgg

SEQ ID NO: 101808 - DNA, 25 bp, E. coli
aaaagtcattattagggcgctgtcg

SEQ ID NO: 101809 - DNA, 25 bp, E. coli
aaatggcgcctcattacttgactgg

SEQ ID NO: 101810 - DNA, 25 bp, E. coli
aaaagtcattataagggcgctgtcg

SEQ ID NO: 101811 - DNA, 25 bp, E. coli
tatcattaaaaatcagcgggctgct

SEQ ID NO: 101812 - DNA, 25 bp, E. coli
tatcattaaaaaacagcgggctgct

SEQ ID NO: 101813 - DNA, 25 bp, E. coli
tcgacaatcgagaagctgctcaatg

SEQ ID NO: 101814 - DNA, 25 bp, E. coli
tctgaaacgattgaagggctaagcc

SEQ ID NO: 101815 - DNA, 25 bp, E. coli
tctgaaacgattcaagggctaagcc

SEQ ID NO: 101816 - DNA, 25 bp, E. coli
tcgacaatcgagtagctgctcaatg

SEQ ID NO: 101817 - DNA, 25 bp, E. coli
tctggctaacagaagactggttgct

SEQ ID NO: 101818 - DNA, 25 bp, E. coli
tctggctaacagtagactggttgct

SEQ ID NO: 101819 - DNA, 25 bp, E. coli
cctactttggcgttgtttggcaaca

SEQ ID NO: 101820 - DNA, 25 bp, E. coli
cctgggatatcggaaaggtagcgca

SEQ ID NO: 101821 - DNA, 25 bp, E. coli
cctactttggcgatgtttggcaaca

SEQ ID NO: 101822 - DNA, 25 bp, E. coli
cctgggatatcgcaaaggtagcgca

SEQ ID NO: 101823 - DNA, 25 bp, E. coli
gattaaggatctacccgagcgtgag

SEQ ID NO: 101824 - DNA, 25 bp, E. coli
gattaaggatcttcccgagcgtgag

SEQ ID NO: 101825 - DNA, 25 bp, E. coli
ggatgaggattctgaaaatggcgcc

SEQ ID NO: 101826 - DNA, 25 bp, E. coli
ggatgaggattcagaaaatggcgcc

SEQ ID NO: 101827 - DNA, 25 bp, E. coli
gggctgctggaacaacacgatccta

SEQ ID NO: 101828 - DNA, 25 bp, E. coli
gggctgctggaagaacacgatccta

SEQ ID NO: 101829 - DNA, 25 bp, E. coli
caatgttgtcatgccgaatgtggcg

SEQ ID NO: 101830 - DNA, 25 bp, E. coli
caatgttgtcatcccgaatgtggcg

SEQ ID NO: 101831 - DNA, 25 bp, E. coli
ccctttaaagtgaacagaggacgtg

SEQ ID NO: 101832 - DNA, 25 bp, E. coli
ccctttaaagtgtacagaggacgtg

SEQ ID NO: 101833 - DNA, 25 bp, E. coli
tagtgccctcgagatgtaatttcag

SEQ ID NO: 101834 - DNA, 25 bp, E. coli
tagtgccctcgacatgtaatttcag

SEQ ID NO: 101835 - DNA, 25 bp, E. coli
tgcgtactaaccaccaatataagga

SEQ ID NO: 101836 - DNA, 25 bp, E. coli
tgcgtactaacctccaatataagga

SEQ ID NO: 101837 - DNA, 25 bp, E. coli
tttggcttgtggacgcggaatttca

SEQ ID NO: 101838 - DNA, 25 bp, E. coli
tttggcttgtggtcgcggaatttca

SEQ ID NO: 101839 - DNA, 25 bp, E. coli
gctttctgagaaaggtgaatcccct

SEQ ID NO: 101840 - DNA, 25 bp, E. coli
gctttctgagaatggtgaatcccct

SEQ ID NO: 101841 - DNA, 25 bp, E. coli
gaatgtggcgatatctcagcaggaa

SEQ ID NO: 101842 - DNA, 25 bp, E. coli
gaatgtggcgatttctcagcaggaa

SEQ ID NO: 101843 - DNA, 25 bp, E. coli
ggtgaatccccttaaacagagcgta

SEQ ID NO: 101844 - DNA, 25 bp, E. coli
ggtgaatcccctaaaacagagcgta

SEQ ID NO: 101845 - DNA, 25 bp, E. coli
tgtagaatggccaccgccaaatggc

SEQ ID NO: 101846 - DNA, 25 bp, E. coli
tgtagaatggcctccgccaaatggc

SEQ ID NO: 101847 - DNA, 25 bp, E. coli
tcagcaggaaaagggcggaatagct

SEQ ID NO: 101848 - DNA, 25 bp, E. coli
taatgccgggttacacaatgttgtc

SEQ ID NO: 101849 - DNA, 25 bp, E. coli
tcagcaggaaaacggcggaatagct

SEQ ID NO: 101850 - DNA, 25 bp, E. coli
taatgccgggtttcacaatgttgtc

SEQ ID NO: 101851 - DNA, 25 bp, E. coli
aatgctcacggtaagaattgtctca

SEQ ID NO: 101852 - DNA, 25 bp, E. coli
aatgctcacggttagaattgtctca

SEQ ID NO: 101853 - DNA, 25 bp, E. coli
caataaaccggcgaaatgctcacgg

SEQ ID NO: 101854 - DNA, 25 bp, E. coli
caataaaccggccaaatgctcacgg

SEQ ID NO: 101855 - DNA, 25 bp, E. coli
tacggttatttcatagggatcaagc

SEQ ID NO: 101856 - DNA, 25 bp, E. coli
tacggttatttcttagggatcaagc

SEQ ID NO: 101857 - DNA, 25 bp, E. coli
tctgttgcgtaagggaaagtcaaaa

SEQ ID NO: 101858 - DNA, 25 bp, E. coli
tctgttgcgtaacggaaagtcaaaa

SEQ ID NO: 101859 - DNA, 25 bp, E. coli
gaattgtctcatcaacggtacggtt

SEQ ID NO: 101860 - DNA, 25 bp, E. coli
gaaagctaagaaataaacctaccat

SEQ ID NO: 101861 - DNA, 25 bp, E. coli
gaattgtctcatgaacggtacggtt

SEQ ID NO: 101862 - DNA, 25 bp, E. coli
gaaagctaagaattaaacctaccat

SEQ ID NO: 101863 - DNA, 25 bp, E. coli
gaaagtcaaaaagtgagcaaattcc

SEQ ID NO: 101864 - DNA, 25 bp, E. coli
gaaagtcaaaaactgagcaaattcc

SEQ ID NO: 101865 - DNA, 25 bp, E. coli
gattatcagtttactagcgaaagct

SEQ ID NO: 101866 - DNA, 25 bp, E. coli
gtcaccattttgtctgattatcagt

SEQ ID NO: 101867 - DNA, 25 bp, E. coli
gattatcagttttctagcgaaagct

SEQ ID NO: 101868 - DNA, 25 bp, E. coli
gtcaccattttgactgattatcagt

SEQ ID NO: 101869 - DNA, 25 bp, E. coli
tcaatttagaagctcacaagacgtg

SEQ ID NO: 101870 - DNA, 25 bp, E. coli
tcaatttagaaggtcacaagacgtg

SEQ ID NO: 101871 - DNA, 25 bp, E. coli
gagcaaattcccgtctcgccgtaaa

SEQ ID NO: 101872 - DNA, 25 bp, E. coli
gagcaaattcccctctcgccgtaaa

SEQ ID NO: 101873 - DNA, 25 bp, E. coli
caggtcgctcctcgcacatttgcga

SEQ ID NO: 101874 - DNA, 25 bp, E. coli
caggtcgctcctggcacatttgcga

SEQ ID NO: 101875 - DNA, 25 bp, E. coli
tactctaactataatgcgaagcacg

SEQ ID NO: 101876 - DNA, 25 bp, E. coli
tactctaactattatgcgaagcacg

SEQ ID NO: 101877 - DNA, 25 bp, E. coli
tacctgttcaaatcgcctggcggct

SEQ ID NO: 101878 - DNA, 25 bp, E. coli
tacctgttcaaaacgcctggcggct

SEQ ID NO: 101879 - DNA, 25 bp, E. coli
ttgcatcgtggtgaaaccgggcgat

SEQ ID NO: 101880 - DNA, 25 bp, E. coli
ttatcggaccgaaaacctgtgtgga

SEQ ID NO: 101881 - DNA, 25 bp, E. coli
ttgaaatcggaaggtggcaccaacg

SEQ ID NO: 101882 - DNA, 25 bp, E. coli
ttgcatcgtggtcaaaccgggcgat

SEQ ID NO: 101883 - DNA, 25 bp, E. coli
ttgaaatcggaacgtggcaccaacg

SEQ ID NO: 101884 - DNA, 25 bp, E. coli
ttatcggaccgataacctgtgtgga

SEQ ID NO: 101885 - DNA, 25 bp, E. coli
tgatgctttcgagcgtactgcactg

SEQ ID NO: 101886 - DNA, 25 bp, E. coli
tgatgctttcgaccgtactgcactg

SEQ ID NO: 101887 - DNA, 25 bp, E. coli
tgcgaagcacggaaacgaacatcag

SEQ ID NO: 101888 - DNA, 25 bp, E. coli
tgcgaagcacggtaacgaacatcag

SEQ ID NO: 101889 - DNA, 25 bp, E. coli
gaaattgaacaacaacaggtcgctc

SEQ ID NO: 101890 - DNA, 25 bp, E. coli
gaaattgaacaagaacaggtcgctc

SEQ ID NO: 101891 - DNA, 25 bp, E. coli
cgttgatttctgctgcggcactggc

SEQ ID NO: 101892 - DNA, 25 bp, E. coli
cgttgatttctggtgcggcactggc

SEQ ID NO: 101893 - DNA, 25 bp, E. coli
gaccagcgccgaaatgctgcgtatg

SEQ ID NO: 101894 - DNA, 25 bp, E. coli
gaccagcgccgatatgctgcgtatg

SEQ ID NO: 101895 - DNA, 25 bp, E. coli
cagccgctgcaaatgttctggccgg

SEQ ID NO: 101896 - DNA, 25 bp, E. coli
cagccgctgcaattgttctggccgg

SEQ ID NO: 101897 - DNA, 25 bp, E. coli
agtatatctggacccagccgctgca

SEQ ID NO: 101898 - DNA, 25 bp, E. coli
agtatatctggagccagccgctgca

SEQ ID NO: 101899 - DNA, 25 bp, E. coli
atctggtgacggtgcacgcacacta

SEQ ID NO: 101900 - DNA, 25 bp, E. coli
atctggtgacggagcacgcacacta

SEQ ID NO: 101901 - DNA, 25 bp, E. coli
tatcagcgtgatcgcctttaacctg

SEQ ID NO: 101902 - DNA, 25 bp, E. coli
tatcagcgtgatggcctttaacctg

SEQ ID NO: 101903 - DNA, 25 bp, E. coli
ttaacctggtgggtgacgcactgcg

SEQ ID NO: 101904 - DNA, 25 bp, E. coli
ttaacctggtggctgacgcactgcg

SEQ ID NO: 101905 - DNA, 25 bp, E. coli
ttttctcgcggcagatggcagcgac

SEQ ID NO: 101906 - DNA, 25 bp, E. coli
ttttctcgcggctgatggcagcgac

SEQ ID NO: 101907 - DNA, 25 bp, E. coli
tgattgcgctcaccagccagtggtg

SEQ ID NO: 101908 - DNA, 25 bp, E. coli
tgattgcgctcagcagccagtggtg

SEQ ID NO: 101909 - DNA, 25 bp, E. coli
tcgcactgggcgtggtatgcacgca

SEQ ID NO: 101910 - DNA, 25 bp, E. coli
tcgcactgggcgaggtatgcacgca

SEQ ID NO: 101911 - DNA, 25 bp, E. coli
tcattatcgccctgctggcgctgat

SEQ ID NO: 101912 - DNA, 25 bp, E. coli
tcattatcgcccagctggcgctgat

SEQ ID NO: 101913 - DNA, 25 bp, E. coli
gccagtggtggctgccgtatgaccc

SEQ ID NO: 101914 - DNA, 25 bp, E. coli
gccagtggtggcagccgtatgaccc

SEQ ID NO: 101915 - DNA, 25 bp, E. coli
tggcgctgtttatcagcgtgatggc

SEQ ID NO: 101916 - DNA, 25 bp, E. coli
tggcgctgtttaacagcgtgatggc

SEQ ID NO: 101917 - DNA, 25 bp, E. coli
tatcgactacgatacggtcgggcaa

SEQ ID NO: 101918 - DNA, 25 bp, E. coli
tacggcggtgaatacgcgtcgatga

SEQ ID NO: 101919 - DNA, 25 bp, E. coli
tacggcggtgaaaacgcgtcgatga

SEQ ID NO: 101920 - DNA, 25 bp, E. coli
tatcgactacgaaacggtcgggcaa

SEQ ID NO: 101921 - DNA, 25 bp, E. coli
acggtcgggcaatacggcagtatgc

SEQ ID NO: 101922 - DNA, 25 bp, E. coli
acggtcgggcaaaacggcagtatgc

SEQ ID NO: 101923 - DNA, 25 bp, E. coli
tgatatcgactaggaaacggtcggg

SEQ ID NO: 101924 - DNA, 25 bp, E. coli
tgatatcgactacgaaacggtcggg

SEQ ID NO: 101925 - DNA, 25 bp, E. coli
tgctgatggttaccgtcagcggtac

SEQ ID NO: 101926 - DNA, 25 bp, E. coli
tgctgatggttagcgtcagcggtac

SEQ ID NO: 101927 - DNA, 25 bp, E. coli
tcggtattgataacgactacgaaac

SEQ ID NO: 101928 - DNA, 25 bp, E. coli
tcggtattgatatcgactacgaaac

SEQ ID NO: 101929 - DNA, 25 bp, E. coli
tcgttgaatattgcggtgtggtgac

SEQ ID NO: 101930 - DNA, 25 bp, E. coli
tcgttgaatattccggtgtggtgac

SEQ ID NO: 101931 - DNA, 25 bp, E. coli
tctggaaggccagaccatcgttgaa

SEQ ID NO: 101932 - DNA, 25 bp, E. coli
tctggaaggccacaccatcgttgaa

SEQ ID NO: 101933 - DNA, 25 bp, E. coli
gccagaccatcgatgaatattgcgg

SEQ ID NO: 101934 - DNA, 25 bp, E. coli
gccagaccatcgttgaatattgcgg

SEQ ID NO: 101935 - DNA, 25 bp, E. coli
gaaggccagaccttcgttgaatatt

SEQ ID NO: 101936 - DNA, 25 bp, E. coli
gaaggccagaccatcgttgaatatt

SEQ ID NO: 101937 - DNA, 25 bp, E. coli
ggcaaaacggcactatgctgatggt

SEQ ID NO: 101938 - DNA, 25 bp, E. coli
ggcaaaacggcagtatgctgatggt

SEQ ID NO: 101939 - DNA, 25 bp, E. coli
caatgaagtgttccagggctatcgc

SEQ ID NO: 101940 - DNA, 25 bp, E. coli
caatgaagtgttgcagggctatcgc

SEQ ID NO: 101941 - DNA, 25 bp, E. coli
caaagctggtgttgaccggtgaacg

SEQ ID NO: 101942 - DNA, 25 bp, E. coli
caaagctggtgtagaccggtgaacg

SEQ ID NO: 101943 - DNA, 25 bp, E. coli
tactctgaaggaagcggcgatgacc

SEQ ID NO: 101944 - DNA, 25 bp, E. coli
tactctgaaggatgcggcgatgacc

SEQ ID NO: 101945 - DNA, 25 bp, E. coli
ttatgactctggagcggcagtaggc

SEQ ID NO: 101946 - DNA, 25 bp, E. coli
ttatgactctggtgcggcagtaggc

SEQ ID NO: 101947 - DNA, 25 bp, E. coli
tcctggcagttgtcgctgaataacg

SEQ ID NO: 101948 - DNA, 25 bp, E. coli
tcctggcagttgacgctgaataacg

SEQ ID NO: 101949 - DNA, 25 bp, E. coli
tccaatgctgtaaggcccggaaggc

SEQ ID NO: 101950 - DNA, 25 bp, E. coli
tccaatgctgtatggcccggaaggc

SEQ ID NO: 101951 - DNA, 25 bp, E. coli
gctggatggaagttgcgcaacgcct

SEQ ID NO: 101952 - DNA, 25 bp, E. coli
gctggatggaagatgcgcaacgcct

SEQ ID NO: 101953 - DNA, 25 bp, E. coli
gaagaggtttctactcgccgcaata

SEQ ID NO: 101954 - DNA, 25 bp, E. coli
gaagaggtttcttctcgccgcaata

SEQ ID NO: 101955 - DNA, 25 bp, E. coli
cgattgcgcggtcgaatgatcaaca

SEQ ID NO: 101956 - DNA, 25 bp, E. coli
cgattgcgcggtggaatgatcaaca

SEQ ID NO: 101957 - DNA, 25 bp, E. coli
gatattaagctcaatcttggccggg

SEQ ID NO: 101958 - DNA, 25 bp, E. coli
gatattaagctctatcttggccggg

SEQ ID NO: 101959 - DNA, 25 bp, E. coli
gacgatatccggcagtcgatcctgg

SEQ ID NO: 101960 - DNA, 25 bp, E. coli
gacgatatccgggagtcgatcctgg

SEQ ID NO: 101961 - DNA, 25 bp, E. coli
catccgcccggattttgatcgtgaa

SEQ ID NO: 101962 - DNA, 25 bp, E. coli
catccgcccggaatttgatcgtgaa

SEQ ID NO: 101963 - DNA, 25 bp, E. coli
taacggcggcagtttacgaggacaa

SEQ ID NO: 101964 - DNA, 25 bp, E. coli
aaattcagggctccatcgcgctgga

SEQ ID NO: 101965 - DNA, 25 bp, E. coli
aaagcgccgttgtccatgaaacagg

SEQ ID NO: 101966 - DNA, 25 bp, E. coli
aaattcagggctgcatcgcgctgga

SEQ ID NO: 101967 - DNA, 25 bp, E. coli
aaagcgccgttgaccatgaaacagg

SEQ ID NO: 101968 - DNA, 25 bp, E. coli
tatgaacagatggaggcagcaggca

SEQ ID NO: 101969 - DNA, 25 bp, E. coli
tagtgaaagtggcttccaccgccgt

SEQ ID NO: 101970 - DNA, 25 bp, E. coli
tatgaacagatgcaggcagcaggca

SEQ ID NO: 101971 - DNA, 25 bp, E. coli
tagtgaaagtgggttccaccgccgt

SEQ ID NO: 101972 - DNA, 25 bp, E. coli
ttcaaaatcaatgtcgcgcgccagt

SEQ ID NO: 101973 - DNA, 25 bp, E. coli
ttcaaaatcaatctcgcgcgccagt

SEQ ID NO: 101974 - DNA, 25 bp, E. coli
tgttcaaaatctccttcccggcgga

SEQ ID NO: 101975 - DNA, 25 bp, E. coli
tgttcaaaatctgcttcccggcgga

SEQ ID NO: 101976 - DNA, 25 bp, E. coli
gcctggaacagaagccggtcaatga

SEQ ID NO: 101977 - DNA, 25 bp, E. coli
gcctggaacagatgccggtcaatga

SEQ ID NO: 101978 - DNA, 25 bp, E. coli
gccctgcgcgagaagatcaattgct

SEQ ID NO: 101979 - DNA, 25 bp, E. coli
gcattcagtacaaggtggcgatccc

SEQ ID NO: 101980 - DNA, 25 bp, E. coli
gccctgcgcgagtagatcaattgct

SEQ ID NO: 101981 - DNA, 25 bp, E. coli
gcattcagtacatggtggcgatccc

SEQ ID NO: 101982 - DNA, 25 bp, E. coli
taacggcggcagattacgaggacaa

SEQ ID NO: 101983 - DNA, 25 bp, E. coli
caaggaactctctggactcgtcgta

SEQ ID NO: 101984 - DNA, 25 bp, E. coli
caaggaactctcaggactcgtcgta

SEQ ID NO: 101985 - DNA, 25 bp, E. coli
cagaagctgcgtatcaacgtgggac

SEQ ID NO: 101986 - DNA, 25 bp, E. coli
cagaagctgcgtttcaacgtgggac

SEQ ID NO: 101987 - DNA, 25 bp, E. coli
tactggcagtccaaaagcgaatggg

SEQ ID NO: 101988 - DNA, 25 bp, E. coli
tactggcagtcctaaagcgaatggg

SEQ ID NO: 101989 - DNA, 25 bp, E. coli
tggtgaaacgaccaactacccgcgt

SEQ ID NO: 101990 - DNA, 25 bp, E. coli
tggtgaaacgacgaactacccgcgt

SEQ ID NO: 101991 - DNA, 25 bp, E. coli
tgagtttgccatactgaccgcagca

SEQ ID NO: 101992 - DNA, 25 bp, E. coli
tgagtttgccattctgaccgcagca

SEQ ID NO: 101993 - DNA, 25 bp, E. coli
tctttgcgtggcaatgggaacccga

SEQ ID NO: 101994 - DNA, 25 bp, E. coli
tctttgcgtggctatgggaacccga

SEQ ID NO: 101995 - DNA, 25 bp, E. coli
gaagggacaactgtcggatactgct

SEQ ID NO: 101996 - DNA, 25 bp, E. coli
gaagggacaactctcggatactgct

SEQ ID NO: 101997 - DNA, 25 bp, E. coli
gaaacggtgatccattacgccaagg

SEQ ID NO: 101998 - DNA, 25 bp, E. coli
gaaacggtgatcgattacgccaagg

SEQ ID NO: 101999 - DNA, 25 bp, E. coli
gatataccgacttaacgcagcatgg

SEQ ID NO: 102000 - DNA, 25 bp, E. coli
gatataccgactaaacgcagcatgg

SEQ ID NO: 102001 - DNA, 25 bp, E. coli
ggaagtctccttagccgaagcgcgt

SEQ ID NO: 102002 - DNA, 25 bp, E. coli
ggaagtctcctttgccgaagcgcgt

SEQ ID NO: 102003 - DNA, 25 bp, E. coli
taaccaagaatgaaaccgccagtcg

SEQ ID NO: 102004 - DNA, 25 bp, E. coli
taaccaagaatgtaaccgccagtcg

SEQ ID NO: 102005 - DNA, 25 bp, E. coli
aagttgaccaggaaaaggcgcaggc

SEQ ID NO: 102006 - DNA, 25 bp, E. coli
aagttgaccaggtaaaggcgcaggc

SEQ ID NO: 102007 - DNA, 25 bp, E. coli
catcaatcagaccatttcaacggcg

SEQ ID NO: 102008 - DNA, 25 bp, E. coli
catcaatcagacgatttcaacggcg

SEQ ID NO: 102009 - DNA, 25 bp, E. coli
cagtctgaaaccctgggaagagcgt

SEQ ID NO: 102010 - DNA, 25 bp, E. coli
cagtctgaaaccgtgggaagagcgt

SEQ ID NO: 102011 - DNA, 25 bp, E. coli
cacggcaacgggtttcgactttgag

SEQ ID NO: 102012 - DNA, 25 bp, E. coli
cacggcaacgggattcgactttgag

SEQ ID NO: 102013 - DNA, 25 bp, E. coli
tatgcgtctgcgacctatcctgatg

SEQ ID NO: 102014 - DNA, 25 bp, E. coli
tatgttcaggcggatgccaaattcc

SEQ ID NO: 102015 - DNA, 25 bp, E. coli
tatgttcaggcgcatgccaaattcc

SEQ ID NO: 102016 - DNA, 25 bp, E. coli
tatgcgtctgcgtcctatcctgatg

SEQ ID NO: 102017 - DNA, 25 bp, E. coli
tgctgccagaagttgtcgataaact

SEQ ID NO: 102018 - DNA, 25 bp, E. coli
tgctgccagaagatgtcgataaact

SEQ ID NO: 102019 - DNA, 25 bp, E. coli
gccattgttgaagtgggcacggcaa

SEQ ID NO: 102020 - DNA, 25 bp, E. coli
gccattgttgaactgggcacggcaa

SEQ ID NO: 102021 - DNA, 25 bp, E. coli
gaagacaccgcggagtttaaactgg

SEQ ID NO: 102022 - DNA, 25 bp, E. coli
gaagacaccgcgcagtttaaactgg

SEQ ID NO: 102023 - DNA, 25 bp, E. coli
ggcttgtcggcctaaaacgctattt

SEQ ID NO: 102024 - DNA, 25 bp, E. coli
ggcttgtcggccaaaaacgctattt

SEQ ID NO: 102025 - DNA, 25 bp, E. coli
tcacattgggtgtatggctctccgc

SEQ ID NO: 102026 - DNA, 25 bp, E. coli
tcacattgggtgaatggctctccgc

SEQ ID NO: 102027 - DNA, 25 bp, E. coli
caggcgaaactggttggttttcctc

SEQ ID NO: 102028 - DNA, 25 bp, E. coli
caggtaagacgtgagaaattcgatc

SEQ ID NO: 102029 - DNA, 25 bp, E. coli
caggtaagacgtcagaaattcgatc

SEQ ID NO: 102030 - DNA, 25 bp, E. coli
caggacgtcgatgatttcgaattgt

SEQ ID NO: 102031 - DNA, 25 bp, E. coli
caggacgtcgatcatttcgaattgt

SEQ ID NO: 102032 - DNA, 25 bp, E. coli
caggcgaaactgcttggttttcctc

SEQ ID NO: 102033 - DNA, 25 bp, E. coli
agcaaccagcgcttgctgaactgcg

SEQ ID NO: 102034 - DNA, 25 bp, E. coli
agcaaccagcgcatgctgaactgcg

SEQ ID NO: 102035 - DNA, 25 bp, E. coli
agatccgcgcgcagcaggcgaaact

SEQ ID NO: 102036 - DNA, 25 bp, E. coli
agcgcttgctgatctgcgcgatcgc

SEQ ID NO: 102037 - DNA, 25 bp, E. coli
agcgcttgctgaactgcgcgatcgc

SEQ ID NO: 102038 - DNA, 25 bp, E. coli
agatccgcgcgctgcaggcgaaact

SEQ ID NO: 102039 - DNA, 25 bp, E. coli
tcaggagaagaaaatgacaacaatg

SEQ ID NO: 102040 - DNA, 25 bp, E. coli
tcaggagaagaatatgacaacaatg

SEQ ID NO: 102041 - DNA, 25 bp, E. coli
gcaaaaacgccagaagcagcgctca

SEQ ID NO: 102042 - DNA, 25 bp, E. coli
gaagcgcagctctagccttatttcg

SEQ ID NO: 102043 - DNA, 25 bp, E. coli
gaagcgcagctcaagccttatttcg

SEQ ID NO: 102044 - DNA, 25 bp, E. coli
gcaaaaacgccacaagcagcgctca

SEQ ID NO: 102045 - DNA, 25 bp, E. coli
cgatctcgatgatgcgcagctcaag

SEQ ID NO: 102046 - DNA, 25 bp, E. coli
cgatctcgatgaagcgcagctcaag

SEQ ID NO: 102047 - DNA, 25 bp, E. coli
cattttatgccgagcaggtaagacg

SEQ ID NO: 102048 - DNA, 25 bp, E. coli
cattttatgccgtgcaggtaagacg

SEQ ID NO: 102049 - DNA, 25 bp, E. coli
tactaatcgcactgttgaaggtgaa

SEQ ID NO: 102050 - DNA, 25 bp, E. coli
tactaatcgcacagttgaaggtgaa

SEQ ID NO: 102051 - DNA, 25 bp, E. coli
actaatcgcactcttgaaggtgaaa

SEQ ID NO: 102052 - DNA, 25 bp, E. coli
actaatcgcactgttgaaggtgaaa

SEQ ID NO: 102053 - DNA, 25 bp, E. coli
tttactaatcgctctgttgaaggtg

SEQ ID NO: 102054 - DNA, 25 bp, E. coli
ttactaatcgcactgttgaaggtga

SEQ ID NO: 102055 - DNA, 25 bp, E. coli
tttactaatcgcactgttgaaggtg

SEQ ID NO: 102056 - DNA, 25 bp, E. coli
ttactaatcgcagtgttgaaggtga

SEQ ID NO: 102057 - DNA, 25 bp, E. coli
ttctggcggtgctgatcgatgcgct

SEQ ID NO: 102058 - DNA, 25 bp, E. coli
ttctggcggtgcagatcgatgcgct

SEQ ID NO: 102059 - DNA, 25 bp, E. coli
tcgatttactaatcgcactgttgaa

SEQ ID NO: 102060 - DNA, 25 bp, E. coli
tgcgctgttcgatttactaatcgca

SEQ ID NO: 102061 - DNA, 25 bp, E. coli
tgcgctgttcgaattactaatcgca

SEQ ID NO: 102062 - DNA, 25 bp, E. coli
tcgatttactaaacgcactgttgaa

SEQ ID NO: 102063 - DNA, 25 bp, E. coli
cgatttactaatggcactgttgaag

SEQ ID NO: 102064 - DNA, 25 bp, E. coli
cgatgcgctgttcgatttactaatc

SEQ ID NO: 102065 - DNA, 25 bp, E. coli
cgatgcgctgttggatttactaatc

SEQ ID NO: 102066 - DNA, 25 bp, E. coli
cgatttactaatcgcactgttgaag

SEQ ID NO: 102067 - DNA, 25 bp, E. coli
gttcgatttacttatcgcactgttg

SEQ ID NO: 102068 - DNA, 25 bp, E. coli
gttcgatttactaatcgcactgttg

SEQ ID NO: 102069 - DNA, 25 bp, E. coli
gatgcgctgttccatttactaatcg

SEQ ID NO: 102070 - DNA, 25 bp, E. coli
gatgcgctgttcgatttactaatcg

SEQ ID NO: 102071 - DNA, 25 bp, E. coli
aaccggaatcgcgtggcagaagttg

SEQ ID NO: 102072 - DNA, 25 bp, E. coli
atcgcctggcagaagttgttacccg

SEQ ID NO: 102073 - DNA, 25 bp, E. coli
atcgcctggcagtagttgttacccg

SEQ ID NO: 102074 - DNA, 25 bp, E. coli
aaccggaatcgcctggcagaagttg

SEQ ID NO: 102075 - DNA, 25 bp, E. coli
tgccggactggtggataaccggaat

SEQ ID NO: 102076 - DNA, 25 bp, E. coli
tgccggactggtcgataaccggaat

SEQ ID NO: 102077 - DNA, 25 bp, E. coli
cctggcagaagttgttacccgcaaa

SEQ ID NO: 102078 - DNA, 25 bp, E. coli
cctggcagaagtagttacccgcaaa

SEQ ID NO: 102079 - DNA, 25 bp, E. coli
gaatcgcctggctgaagttgttacc

SEQ ID NO: 102080 - DNA, 25 bp, E. coli
gaatcgcctggcagaagttgttacc

SEQ ID NO: 102081 - DNA, 25 bp, E. coli
gactggtggataaccggaatcgcct

SEQ ID NO: 102082 - DNA, 25 bp, E. coli
cgcctggcagaacttgttacccgca

SEQ ID NO: 102083 - DNA, 25 bp, E. coli
cgcctggcagaagttgttacccgca

SEQ ID NO: 102084 - DNA, 25 bp, E. coli
gataaccggaatcgcctggcagaag

SEQ ID NO: 102085 - DNA, 25 bp, E. coli
gataaccggaatggcctggcagaag

SEQ ID NO: 102086 - DNA, 25 bp, E. coli
ggtggataaccggaatcgcctggca

SEQ ID NO: 102087 - DNA, 25 bp, E. coli
ggtggataaccgcaatcgcctggca

SEQ ID NO: 102088 - DNA, 25 bp, E. coli
tggataaccggaatcgcctggcaga

SEQ ID NO: 102089 - DNA, 25 bp, E. coli
ggcagaagttgtaacccgcaaattg

SEQ ID NO: 102090 - DNA, 25 bp, E. coli
tggataaccggattcgcctggcaga

SEQ ID NO: 102091 - DNA, 25 bp, E. coli
ggcagaagttgttacccgcaaattg

SEQ ID NO: 102092 - DNA, 25 bp, E. coli
gactggtggatatccggaatcgcct

SEQ ID NO: 102093 - DNA, 25 bp, E. coli
aatttgttgaacctacgggctgtga

SEQ ID NO: 102094 - DNA, 25 bp, E. coli
aatttgttgaacgtacgggctgtga

SEQ ID NO: 102095 - DNA, 25 bp, E. coli
cagatattgggaaaacgatgccaca

SEQ ID NO: 102096 - DNA, 25 bp, E. coli
cagatattgggataacgatgccaca

SEQ ID NO: 102097 - DNA, 25 bp, E. coli
taactcattgggttcatggtcggag

SEQ ID NO: 102098 - DNA, 25 bp, E. coli
taactcattgggatcatggtcggag

SEQ ID NO: 102099 - DNA, 25 bp, E. coli
tataccgatcctgaccaggcggctg

SEQ ID NO: 102100 - DNA, 25 bp, E. coli
tataccgatcctcaccaggcggctg

SEQ ID NO: 102101 - DNA, 25 bp, E. coli
tgttcggttctgatggcaaagcgga

SEQ ID NO: 102102 - DNA, 25 bp, E. coli
tgttcggttctgttggcaaagcgga

SEQ ID NO: 102103 - DNA, 25 bp, E. coli
tgaggtcgtcaatcgcgtacgcgat

SEQ ID NO: 102104 - DNA, 25 bp, E. coli
tgaggtcgtcaaacgcgtacgcgat

SEQ ID NO: 102105 - DNA, 25 bp, E. coli
tgatgggcgttaacgacgcagccga

SEQ ID NO: 102106 - DNA, 25 bp, E. coli
tgatgggcgttatcgacgcagccga

SEQ ID NO: 102107 - DNA, 25 bp, E. coli
gcgctggcgggctatcactataccg

SEQ ID NO: 102108 - DNA, 25 bp, E. coli
gcgctggcgggcaatcactataccg

SEQ ID NO: 102109 - DNA, 25 bp, E. coli
gcaacggtgccgctaataactcatt

SEQ ID NO: 102110 - DNA, 25 bp, E. coli
gcaacggtgccggtaataactcatt

SEQ ID NO: 102111 - DNA, 25 bp, E. coli
gaaaccgtttatgaggaagcgctgg

SEQ ID NO: 102112 - DNA, 25 bp, E. coli
gaaaccgtttatcaggaagcgctgg

SEQ ID NO: 102113 - DNA, 25 bp, E. coli
ggtttatacgtctgagccacaattg

SEQ ID NO: 102114 - DNA, 25 bp, E. coli
ggtttatacgtcagagccacaattg

SEQ ID NO: 102115 - DNA, 25 bp, E. coli
caggttgcggttttaacgatattca

SEQ ID NO: 102116 - DNA, 25 bp, E. coli
caggttgcggttataacgatattca

SEQ ID NO: 102117 - DNA, 25 bp, E. coli
ttattttcaatttatcaggttgcgg

SEQ ID NO: 102118 - DNA, 25 bp, E. coli
ttattttcaattaatcaggttgcgg

SEQ ID NO: 102119 - DNA, 25 bp, E. coli
tcttgtcgctagtattaaaggttac

SEQ ID NO: 102120 - DNA, 25 bp, E. coli
tcttgtcgctagaattaaaggttac

SEQ ID NO: 102121 - DNA, 25 bp, E. coli
cctcctggtcagaagtattaaatca

SEQ ID NO: 102122 - DNA, 25 bp, E. coli
cctcctggtcagtagtattaaatca

SEQ ID NO: 102123 - DNA, 25 bp, E. coli
gcgttaccctcacttaaaggctcaa

SEQ ID NO: 102124 - DNA, 25 bp, E. coli
gcgttaccctcagttaaaggctcaa

SEQ ID NO: 102125 - DNA, 25 bp, E. coli
gaacaagaggtactagaagccgtaa

SEQ ID NO: 102126 - DNA, 25 bp, E. coli
gaacaagaggtagtagaagccgtaa

SEQ ID NO: 102127 - DNA, 25 bp, E. coli
cgaaggaagtgataatagaattgcc

SEQ ID NO: 102128 - DNA, 25 bp, E. coli
cgaaggaagtgaaaatagaattgcc

SEQ ID NO: 102129 - DNA, 25 bp, E. coli
gatattcaaaccaatgatgaacagg

SEQ ID NO: 102130 - DNA, 25 bp, E. coli
gatattcaaacctatgatgaacagg

SEQ ID NO: 102131 - DNA, 25 bp, E. coli
ggttactccagcgatgaacaagagg

SEQ ID NO: 102132 - DNA, 25 bp, E. coli
ggttactccagccatgaacaagagg

SEQ ID NO: 102133 - DNA, 25 bp, E. coli
ggctcaagagctgtatcaaaactta

SEQ ID NO: 102134 - DNA, 25 bp, E. coli
ggctcaagagctctatcaaaactta

SEQ ID NO: 102135 - DNA, 25 bp, E. coli
gatgaacaggttaatgcctcctggt

SEQ ID NO: 102136 - DNA, 25 bp, E. coli
gatgaacaggtttatgcctcctggt

SEQ ID NO: 102137 - DNA, 25 bp, E. coli
cacgtagtgtggatgccttacacgc

SEQ ID NO: 102138 - DNA, 25 bp, E. coli
cacgtagtgtggttgccttacacgc

SEQ ID NO: 102139 - DNA, 25 bp, E. coli
ttcgttaagcgaactccagccctgg

SEQ ID NO: 102140 - DNA, 25 bp, E. coli
ttcgttaagcgatctccagccctgg

SEQ ID NO: 102141 - DNA, 25 bp, E. coli
tggtgcaaaagtattgtccccggct

SEQ ID NO: 102142 - DNA, 25 bp, E. coli
tggtgcaaaagttttgtccccggct

SEQ ID NO: 102143 - DNA, 25 bp, E. coli
tgcaaaagcggctatctgcggctgg

SEQ ID NO: 102144 - DNA, 25 bp, E. coli
tgcaaaagcggcaatctgcggctgg

SEQ ID NO: 102145 - DNA, 25 bp, E. coli
tcaggactgggcgagatgaaaaact

SEQ ID NO: 102146 - DNA, 25 bp, E. coli
tcaggactgggccagatgaaaaact

SEQ ID NO: 102147 - DNA, 25 bp, E. coli
gccggacggcaacctgattgacgat

SEQ ID NO: 102148 - DNA, 25 bp, E. coli
gccggacggcaagctgattgacgat

SEQ ID NO: 102149 - DNA, 25 bp, E. coli
gcgccggagcataaccagattgtta

SEQ ID NO: 102150 - DNA, 25 bp, E. coli
gcgccggagcattaccagattgtta

SEQ ID NO: 102151 - DNA, 25 bp, E. coli
gcaaaaccatcttcgctcaggactg

SEQ ID NO: 102152 - DNA, 25 bp, E. coli
gcaaaaccatctacgctcaggactg

SEQ ID NO: 102153 - DNA, 25 bp, E. coli
gacttctcatttagcgacacgctgg

SEQ ID NO: 102154 - DNA, 25 bp, E. coli
gacttctcattttgcgacacgctgg

SEQ ID NO: 102155 - DNA, 25 bp, E. coli
ctggctttcaaacgcgaaggctatc

SEQ ID NO: 102156 - DNA, 25 bp, E. coli
ctggctttcaaaggcgaaggctatc

SEQ ID NO: 102157 - DNA, 25 bp, E. coli
gattcgccgggtgctgcaaaaccat

SEQ ID NO: 102158 - DNA, 25 bp, E. coli
gattcgccgggtcctgcaaaaccat

SEQ ID NO: 102159 - DNA, 25 bp, E. coli
tatgacgccggatgatcccattgtg

SEQ ID NO: 102160 - DNA, 25 bp, E. coli
tatgacgccggaagatcccattgtg

SEQ ID NO: 102161 - DNA, 25 bp, E. coli
tgtgatggaaagcattaaactggcg

SEQ ID NO: 102162 - DNA, 25 bp, E. coli
tgtgatggaaaggattaaactggcg

SEQ ID NO: 102163 - DNA, 25 bp, E. coli
tcgcgccggaagtgagcggattcta

SEQ ID NO: 102164 - DNA, 25 bp, E. coli
tcgcgccggaagagagcggattcta

SEQ ID NO: 102165 - DNA, 25 bp, E. coli
tctatgcccgtaaggtcagcaaagg

SEQ ID NO: 102166 - DNA, 25 bp, E. coli
tctatgcccgtatggtcagcaaagg

SEQ ID NO: 102167 - DNA, 25 bp, E. coli
gaaggacgccatgcgctgtatcaaa

SEQ ID NO: 102168 - DNA, 25 bp, E. coli
gaaggacgccatccgctgtatcaaa

SEQ ID NO: 102169 - DNA, 25 bp, E. coli
gcaagattccatactgacgaccgta

SEQ ID NO: 102170 - DNA, 25 bp, E. coli
gcaagattccattctgacgaccgta

SEQ ID NO: 102171 - DNA, 25 bp, E. coli
ctcaaagtgtggcttaacgccgcaa

SEQ ID NO: 102172 - DNA, 25 bp, E. coli
ctcaaagtgtgggttaacgccgcaa

SEQ ID NO: 102173 - DNA, 25 bp, E. coli
gatatcgacggtcaagtgaccacgc

SEQ ID NO: 102174 - DNA, 25 bp, E. coli
gattgtcaatgtcgcctcaaagtgt

SEQ ID NO: 102175 - DNA, 25 bp, E. coli
gattgtcaatgtggcctcaaagtgt

SEQ ID NO: 102176 - DNA, 25 bp, E. coli
gatatcgacggtgaagtgaccacgc

SEQ ID NO: 102177 - DNA, 25 bp, E. coli
ggtgacgttcccgatgttcagtaag

SEQ ID NO: 102178 - DNA, 25 bp, E. coli
ggtgacgttccccatgttcagtaag

SEQ ID NO: 102179 - DNA, 25 bp, E. coli
taacgccgcaatatgagcagttgga

SEQ ID NO: 102180 - DNA, 25 bp, E. coli
taacgccgcaatttgagcagttgga

SEQ ID NO: 102181 - DNA, 25 bp, E. coli
gaagccttcaagagccgaactaaaa

SEQ ID NO: 102182 - DNA, 25 bp, E. coli
taaaaatcgatgatttcgcccgggt

SEQ ID NO: 102183 - DNA, 25 bp, E. coli
taaaaatcgatgttttcgcccgggt

SEQ ID NO: 102184 - DNA, 25 bp, E. coli
gaagccttcaagtgccgaactaaaa

SEQ ID NO: 102185 - DNA, 25 bp, E. coli
tatcagtcgccaaggtaaaggaatg

SEQ ID NO: 102186 - DNA, 25 bp, E. coli
tatcagtcgccatggtaaaggaatg

SEQ ID NO: 102187 - DNA, 25 bp, E. coli
tgggaatccagacgcgtgaagcctt

SEQ ID NO: 102188 - DNA, 25 bp, E. coli
tgggaatccagaggcgtgaagcctt

SEQ ID NO: 102189 - DNA, 25 bp, E. coli
tccaatgcatgacctgttgagcagc

SEQ ID NO: 102190 - DNA, 25 bp, E. coli
tccaatgcatgagctgttgagcagc

SEQ ID NO: 102191 - DNA, 25 bp, E. coli
gccaacccggcattaagtaagcagt

SEQ ID NO: 102192 - DNA, 25 bp, E. coli
cctgacgcacagaacaacgtcctgt

SEQ ID NO: 102193 - DNA, 25 bp, E. coli
cctgacgcacagtacaacgtcctgt

SEQ ID NO: 102194 - DNA, 25 bp, E. coli
gccaacccggcaataagtaagcagt

SEQ ID NO: 102195 - DNA, 25 bp, E. coli
gcagttacgaaaagggacaggatta

SEQ ID NO: 102196 - DNA, 25 bp, E. coli
gcagttacgaaatgggacaggatta

SEQ ID NO: 102197 - DNA, 25 bp, E. coli
gttgagcagcctcgaacagattgtt

SEQ ID NO: 102198 - DNA, 25 bp, E. coli
gttgagcagcctggaacagattgtt

SEQ ID NO: 102199 - DNA, 25 bp, E. coli
gatgcgtttgattcaagccaacccg

SEQ ID NO: 102200 - DNA, 25 bp, E. coli
gatgaaacgcagtaaattaccctga

SEQ ID NO: 102201 - DNA, 25 bp, E. coli
gatgcgtttgatacaagccaacccg

SEQ ID NO: 102202 - DNA, 25 bp, E. coli
gatgaaacgcagaaaattaccctga

SEQ ID NO: 102203 - DNA, 25 bp, E. coli
aaaggacaggcatttatcgcgaccg

SEQ ID NO: 102204 - DNA, 25 bp, E. coli
aaaggacaggcaattatcgcgaccg

SEQ ID NO: 102205 - DNA, 25 bp, E. coli
aaccgtcagtatcggaacattccga

SEQ ID NO: 102206 - DNA, 25 bp, E. coli
aaccgtcagtatgggaacattccga

SEQ ID NO: 102207 - DNA, 25 bp, E. coli
tctggtatgttgattacgccgccgc

SEQ ID NO: 102208 - DNA, 25 bp, E. coli
tcttcgggtgaagagagtgctaaca

SEQ ID NO: 102209 - DNA, 25 bp, E. coli
tctggtatgttgtttacgccgccgc

SEQ ID NO: 102210 - DNA, 25 bp, E. coli
tcttcgggtgaacagagtgctaaca

SEQ ID NO: 102211 - DNA, 25 bp, E. coli
ccgacgcagcagtgcaaggagttgt

SEQ ID NO: 102212 - DNA, 25 bp, E. coli
gctcagcagccggtacagatggaaa

SEQ ID NO: 102213 - DNA, 25 bp, E. coli
gctcagcagccgctacagatggaaa

SEQ ID NO: 102214 - DNA, 25 bp, E. coli
gacacaatgctggtccgggaacaac

SEQ ID NO: 102215 - DNA, 25 bp, E. coli
gacacaatgctgctccgggaacaac

SEQ ID NO: 102216 - DNA, 25 bp, E. coli
ccgacgcagcagagcaaggagttgt

SEQ ID NO: 102217 - DNA, 25 bp, E. coli
gatttccgtgacgttgctcagcgca

SEQ ID NO: 102218 - DNA, 25 bp, E. coli
gatatcgcaggcagcaaaggacagg

SEQ ID NO: 102219 - DNA, 25 bp, E. coli
gatcgaaaccttaggcgcttctgag

SEQ ID NO: 102220 - DNA, 25 bp, E. coli
gatttccgtgaccttgctcagcgca

SEQ ID NO: 102221 - DNA, 25 bp, E. coli
gatatcgcaggctgcaaaggacagg

SEQ ID NO: 102222 - DNA, 25 bp, E. coli
gatcgaaacctttggcgcttctgag

SEQ ID NO: 102223 - DNA, 25 bp, E. coli
gatgattacctgtgtgcctacgccc

SEQ ID NO: 102224 - DNA, 25 bp, E. coli
gatgattacctgagtgcctacgccc

SEQ ID NO: 102225 - DNA, 25 bp, E. coli
tatgggctacggagttgatgaaaaa

SEQ ID NO: 102226 - DNA, 25 bp, E. coli
tatgggctacggtgttgatgaaaaa

SEQ ID NO: 102227 - DNA, 25 bp, E. coli
tgttaaccgacagccagtgcatcct

SEQ ID NO: 102228 - DNA, 25 bp, E. coli
tgttaaccgacacccagtgcatcct

SEQ ID NO: 102229 - DNA, 25 bp, E. coli
tgtaccaatatccaggaaaccgacc

SEQ ID NO: 102230 - DNA, 25 bp, E. coli
tgtaccaatatcgaggaaaccgacc

SEQ ID NO: 102231 - DNA, 25 bp, E. coli
tcaggagatttttggtacgcgccca

SEQ ID NO: 102232 - DNA, 25 bp, E. coli
tcaggagattttaggtacgcgccca

SEQ ID NO: 102233 - DNA, 25 bp, E. coli
ccagtgcatcctcgatgccgcagaa

SEQ ID NO: 102234 - DNA, 25 bp, E. coli
ccaggtcgtacaaatgggctacggt

SEQ ID NO: 102235 - DNA, 25 bp, E. coli
ccagtgcatcctggatgccgcagaa

SEQ ID NO: 102236 - DNA, 25 bp, E. coli
ccggggcgaatagctgtggtcacat

SEQ ID NO: 102237 - DNA, 25 bp, E. coli
ccaggtcgtacatatgggctacggt

SEQ ID NO: 102238 - DNA, 25 bp, E. coli
ccggggcgaatacctgtggtcacat

SEQ ID NO: 102239 - DNA, 25 bp, E. coli
gacggcgtttatttgtaccaatatc

SEQ ID NO: 102240 - DNA, 25 bp, E. coli
gacagccagtgcttcctcgatgccg

SEQ ID NO: 102241 - DNA, 25 bp, E. coli
gacagccagtgcatcctcgatgccg

SEQ ID NO: 102242 - DNA, 25 bp, E. coli
ctacggtgttgatgaaaaagtgcag

SEQ ID NO: 102243 - DNA, 25 bp, E. coli
ctacggtgttgaagaaaaagtgcag

SEQ ID NO: 102244 - DNA, 25 bp, E. coli
gagattttaggtacgcgcccattac

SEQ ID NO: 102245 - DNA, 25 bp, E. coli
gagattttaggttcgcgcccattac

SEQ ID NO: 102246 - DNA, 25 bp, E. coli
gacggcgtttatatgtaccaatatc

SEQ ID NO: 102247 - DNA, 25 bp, E. coli
caagcgaaaggtcagtttgataacc

SEQ ID NO: 102248 - DNA, 25 bp, E. coli
caagcgaaaggtgagtttgataacc

SEQ ID NO: 102249 - DNA, 25 bp, E. coli
catatagcagaagcgcaagcgaaag

SEQ ID NO: 102250 - DNA, 25 bp, E. coli
catatagcagaaccgcaagcgaaag

SEQ ID NO: 102251 - DNA, 25 bp, E. coli
aggtagcggcgatccattgatactg

SEQ ID NO: 102252 - DNA, 25 bp, E. coli
aggtagcggcgaaccattgatactg

SEQ ID NO: 102253 - DNA, 25 bp, E. coli
tacgcggcgattttgctgacaagtt

SEQ ID NO: 102254 - DNA, 25 bp, E. coli
tacgcggcgattatgctgacaagtt

SEQ ID NO: 102255 - DNA, 25 bp, E. coli
tgtggttacttgtccagtgggcaga

SEQ ID NO: 102256 - DNA, 25 bp, E. coli
tgagtaccgattttttacgcggcga

SEQ ID NO: 102257 - DNA, 25 bp, E. coli
tgtggttacttgaccagtgggcaga

SEQ ID NO: 102258 - DNA, 25 bp, E. coli
tgagtaccgattatttacgcggcga

SEQ ID NO: 102259 - DNA, 25 bp, E. coli
gctgcgacaagcaggattgagtacc

SEQ ID NO: 102260 - DNA, 25 bp, E. coli
gctgcgacaagctggattgagtacc

SEQ ID NO: 102261 - DNA, 25 bp, E. coli
cattgatactggatgatgattctca

SEQ ID NO: 102262 - DNA, 25 bp, E. coli
cattactggaattgaagctgcgaca

SEQ ID NO: 102263 - DNA, 25 bp, E. coli
cattactggaatagaagctgcgaca

SEQ ID NO: 102264 - DNA, 25 bp, E. coli
cattgatactggttgatgattctca

SEQ ID NO: 102265 - DNA, 25 bp, E. coli
gttgcttaccgccagaacttgagca

SEQ ID NO: 102266 - DNA, 25 bp, E. coli
gttgcttaccgcgagaacttgagca

SEQ ID NO: 102267 - DNA, 25 bp, E. coli
gatgatccgcaaaatcaagaggtta

SEQ ID NO: 102268 - DNA, 25 bp, E. coli
gatgatccgcaatatcaagaggtta

SEQ ID NO: 102269 - DNA, 25 bp, E. coli
aaggcatttcataccgttctgatgg

SEQ ID NO: 102270 - DNA, 25 bp, E. coli
aatttggtgaattattgtcgcgtca

SEQ ID NO: 102271 - DNA, 25 bp, E. coli
aaggcatttcattccgttctgatgg

SEQ ID NO: 102272 - DNA, 25 bp, E. coli
aatttggtgaataattgtcgcgtca

SEQ ID NO: 102273 - DNA, 25 bp, E. coli
taaagtgcacttcgttatggttgtc

SEQ ID NO: 102274 - DNA, 25 bp, E. coli
taaagtgcacttggttatggttgtc

SEQ ID NO: 102275 - DNA, 25 bp, E. coli
tatggttgtcgggagagatttttcc

SEQ ID NO: 102276 - DNA, 25 bp, E. coli
tatggttgtcggcagagatttttcc

SEQ ID NO: 102277 - DNA, 25 bp, E. coli
tttttattactgcaggaatactgcc

SEQ ID NO: 102278 - DNA, 25 bp, E. coli
tttttattactggaggaatactgcc

SEQ ID NO: 102279 - DNA, 25 bp, E. coli
gcgatagtgggtgctaacttaccaa

SEQ ID NO: 102280 - DNA, 25 bp, E. coli
gcgatagtgggtcctaacttaccaa

SEQ ID NO: 102281 - DNA, 25 bp, E. coli
gcatttcatgccgtttttccccagg

SEQ ID NO: 102282 - DNA, 25 bp, E. coli
gcatttcatgccctttttccccagg

SEQ ID NO: 102283 - DNA, 25 bp, E. coli
cgcgtcattcattcctgaactaagg

SEQ ID NO: 102284 - DNA, 25 bp, E. coli
cgtaacagtcactattgaaaccatt

SEQ ID NO: 102285 - DNA, 25 bp, E. coli
cgcgtcattcatacctgaactaagg

SEQ ID NO: 102286 - DNA, 25 bp, E. coli
cgtaacagtcacaattgaaaccatt

SEQ ID NO: 102287 - DNA, 25 bp, E. coli
cattaaataacaatagttgtggcga

SEQ ID NO: 102288 - DNA, 25 bp, E. coli
cgtttttccccaggcataaagtgca

SEQ ID NO: 102289 - DNA, 25 bp, E. coli
cgtttttccccacgcataaagtgca

SEQ ID NO: 102290 - DNA, 25 bp, E. coli
cattaaataacattagttgtggcga

SEQ ID NO: 102291 - DNA, 25 bp, E. coli
aagggctggctttctcctctcagga

SEQ ID NO: 102292 - DNA, 25 bp, E. coli
aagggctggcttactcctctcagga

SEQ ID NO: 102293 - DNA, 25 bp, E. coli
catcagtgatgatcgtgactacgcc

SEQ ID NO: 102294 - DNA, 25 bp, E. coli
catcagtgatgaacgtgactacgcc

SEQ ID NO: 102295 - DNA, 25 bp, E. coli
tactttagacgatgtttctggcgcg

SEQ ID NO: 102296 - DNA, 25 bp, E. coli
tactttagacgaagtttctggcgcg

SEQ ID NO: 102297 - DNA, 25 bp, E. coli
tttcacacaacatcaagcaggcgga

SEQ ID NO: 102298 - DNA, 25 bp, E. coli
tttcacacaacaacaagcaggcgga

SEQ ID NO: 102299 - DNA, 25 bp, E. coli
tgttgtcacatgagtcacgcgccct

SEQ ID NO: 102300 - DNA, 25 bp, E. coli
tgttgtcacatgtgtcacgcgccct

SEQ ID NO: 102301 - DNA, 25 bp, E. coli
gccagcatgtcggagggtttcagaa

SEQ ID NO: 102302 - DNA, 25 bp, E. coli
gccagcatgtcgcagggtttcagaa

SEQ ID NO: 102303 - DNA, 25 bp, E. coli
gcaatcctgcgtccgtaaaagccag

SEQ ID NO: 102304 - DNA, 25 bp, E. coli
gcaatcctgcgtgcgtaaaagccag

SEQ ID NO: 102305 - DNA, 25 bp, E. coli
ctaactgtggctttgaagggctggc

SEQ ID NO: 102306 - DNA, 25 bp, E. coli
ctaactgtggctatgaagggctggc

SEQ ID NO: 102307 - DNA, 25 bp, E. coli
gttgaaatgacgaccgagggcgact

SEQ ID NO: 102308 - DNA, 25 bp, E. coli
gttgaaatgacgtccgagggcgact

SEQ ID NO: 102309 - DNA, 25 bp, E. coli
gatagaggtctagaaagtaaccggg

SEQ ID NO: 102310 - DNA, 25 bp, E. coli
gatttcacttaacgctgactcggaa

SEQ ID NO: 102311 - DNA, 25 bp, E. coli
gatttcacttaaggctgactcggaa

SEQ ID NO: 102312 - DNA, 25 bp, E. coli
gatagaggtctacaaagtaaccggg

SEQ ID NO: 102313 - DNA, 25 bp, E. coli
catgttgttattaatggacagaact

SEQ ID NO: 102314 - DNA, 25 bp, E. coli
catgttgttatttatggacagaact

SEQ ID NO: 102315 - DNA, 25 bp, E. coli
atggcttaagcctgaagaagaacga

SEQ ID NO: 102316 - DNA, 25 bp, E. coli
atggcttaagccagaagaagaacga

SEQ ID NO: 102317 - DNA, 25 bp, E. coli
tatggcttaagccagaagaagaacg

SEQ ID NO: 102318 - DNA, 25 bp, E. coli
tatggcttaagcgagaagaagaacg

SEQ ID NO: 102319 - DNA, 25 bp, E. coli
tgttattaatggacagaacttcctg

SEQ ID NO: 102320 - DNA, 25 bp, E. coli
tgttgttattaaaggacagaacttc

SEQ ID NO: 102321 - DNA, 25 bp, E. coli
tgttattaatggtcagaacttcctg

SEQ ID NO: 102322 - DNA, 25 bp, E. coli
tgttgttattaatggacagaacttc

SEQ ID NO: 102323 - DNA, 25 bp, E. coli
gcatgttgttataaatggacagaac

SEQ ID NO: 102324 - DNA, 25 bp, E. coli
gcatgttgttattaatggacagaac

SEQ ID NO: 102325 - DNA, 25 bp, E. coli
gaatatggcttaagccagaagaaga

SEQ ID NO: 102326 - DNA, 25 bp, E. coli
gaatatggcttatgccagaagaaga

SEQ ID NO: 102327 - DNA, 25 bp, E. coli
cgggaatatggcttaagccagaaga

SEQ ID NO: 102328 - DNA, 25 bp, E. coli
cgggaatatggcataagccagaaga

SEQ ID NO: 102329 - DNA, 25 bp, E. coli
gttgttattaatcgacagaacttcc

SEQ ID NO: 102330 - DNA, 25 bp, E. coli
gttgttattaatggacagaacttcc

SEQ ID NO: 102331 - DNA, 25 bp, E. coli
ggaatatggcttaagccagaagaag

SEQ ID NO: 102332 - DNA, 25 bp, E. coli
tggcttaagccacaagaagaacgaa

SEQ ID NO: 102333 - DNA, 25 bp, E. coli
ggaatatggctttagccagaagaag

SEQ ID NO: 102334 - DNA, 25 bp, E. coli
tggcttaagccagaagaagaacgaa

SEQ ID NO: 102335 - DNA, 25 bp, E. coli
caacactggttaacgctctcggcgg

SEQ ID NO: 102336 - DNA, 25 bp, E. coli
cactggcgggttgtactggttcacg

SEQ ID NO: 102337 - DNA, 25 bp, E. coli
caacactggttatcgctctcggcgg

SEQ ID NO: 102338 - DNA, 25 bp, E. coli
cactggcgggttctactggttcacg

SEQ ID NO: 102339 - DNA, 25 bp, E. coli
ttctcgccggagtcaaaggcactct

SEQ ID NO: 102340 - DNA, 25 bp, E. coli
ttctcgccggagacaaaggcactct

SEQ ID NO: 102341 - DNA, 25 bp, E. coli
tcaggtactacaggcagaaaaaggc

SEQ ID NO: 102342 - DNA, 25 bp, E. coli
tcaggtactacacgcagaaaaaggc

SEQ ID NO: 102343 - DNA, 25 bp, E. coli
gacaaagatctttcagccgcgctac

SEQ ID NO: 102344 - DNA, 25 bp, E. coli
gacaaagatcttacagccgcgctac

SEQ ID NO: 102345 - DNA, 25 bp, E. coli
gatcggctacatgctacaacaggcg

SEQ ID NO: 102346 - DNA, 25 bp, E. coli
gatcggctacatcctacaacaggcg

SEQ ID NO: 102347 - DNA, 25 bp, E. coli
ggtaatgccctggttaaacgaggcg

SEQ ID NO: 102348 - DNA, 25 bp, E. coli
ggtaatgccctgcttaaacgaggcg

SEQ ID NO: 102349 - DNA, 25 bp, E. coli
ggttcacgggaaaggcccacaagtt

SEQ ID NO: 102350 - DNA, 25 bp, E. coli
ggtcacgccggaattactcaacgaa

SEQ ID NO: 102351 - DNA, 25 bp, E. coli
ggtcacgccggatttactcaacgaa

SEQ ID NO: 102352 - DNA, 25 bp, E. coli
ggttcacgggaatggcccacaagtt

SEQ ID NO: 102353 - DNA, 25 bp, E. coli
ggctctcttgcagatggtccggaaa

SEQ ID NO: 102354 - DNA, 25 bp, E. coli
ggctctcttgcacatggtccggaaa

SEQ ID NO: 102355 - DNA, 25 bp, E. coli
gatcctcactgaagcggacgcagta

SEQ ID NO: 102356 - DNA, 25 bp, E. coli
gatcctcactgatgcggacgcagta

SEQ ID NO: 102357 - DNA, 25 bp, E. coli
ccctggtggcacagaatttgaactg

SEQ ID NO: 102358 - DNA, 25 bp, E. coli
ccctggtggcactgaatttgaactg

SEQ ID NO: 102359 - DNA, 25 bp, E. coli
cactgaatttgaactgagcacgccg

SEQ ID NO: 102360 - DNA, 25 bp, E. coli
cactgaatttgatctgagcacgccg

SEQ ID NO: 102361 - DNA, 25 bp, E. coli
cacccgccctggtggcactgaattt

SEQ ID NO: 102362 - DNA, 25 bp, E. coli
cacccgccctggaggcactgaattt

SEQ ID NO: 102363 - DNA, 25 bp, E. coli
tttgaactgagctcgccggatgatt

SEQ ID NO: 102364 - DNA, 25 bp, E. coli
tttgaactgagcacgccggatgatt

SEQ ID NO: 102365 - DNA, 25 bp, E. coli
tgggaagcgcggaaatcgccacccg

SEQ ID NO: 102366 - DNA, 25 bp, E. coli
tgggaagcgcggtaatcgccacccg

SEQ ID NO: 102367 - DNA, 25 bp, E. coli
tgataagtccgtggtcgcaaagtat

SEQ ID NO: 102368 - DNA, 25 bp, E. coli
tgataagtccgtcgtcgcaaagtat

SEQ ID NO: 102369 - DNA, 25 bp, E. coli
tgagcacgccggttgattacacgat

SEQ ID NO: 102370 - DNA, 25 bp, E. coli
tgagcacgccggatgattacacgat

SEQ ID NO: 102371 - DNA, 25 bp, E. coli
ccgtggtcgcaatgtatgacggtaa

SEQ ID NO: 102372 - DNA, 25 bp, E. coli
cgcaaagtatgacggtaaaagacgc

SEQ ID NO: 102373 - DNA, 25 bp, E. coli
cgcaaagtatgagggtaaaagacgc

SEQ ID NO: 102374 - DNA, 25 bp, E. coli
ccgtggtcgcaaagtatgacggtaa

SEQ ID NO: 102375 - DNA, 25 bp, E. coli
tggcactgaatttgaactgagcacg

SEQ ID NO: 102376 - DNA, 25 bp, E. coli
tggcactgaattagaactgagcacg

SEQ ID NO: 102377 - DNA, 25 bp, E. coli
taagtccgtggtggcaaagtatgac

SEQ ID NO: 102378 - DNA, 25 bp, E. coli
taagtccgtggtcgcaaagtatgac

SEQ ID NO: 102379 - DNA, 25 bp, E. coli
aatgaactagagaaagctgccgccc

SEQ ID NO: 102380 - DNA, 25 bp, E. coli
aatgaactagagtaagctgccgccc

SEQ ID NO: 102381 - DNA, 25 bp, E. coli
caaaggtgataaccaaggtgcgcgt

SEQ ID NO: 102382 - DNA, 25 bp, E. coli
cactgattggctggcgctactggaa

SEQ ID NO: 102383 - DNA, 25 bp, E. coli
cactgattggctcgcgctactggaa

SEQ ID NO: 102384 - DNA, 25 bp, E. coli
caaaggtgataagcaaggtgcgcgt

SEQ ID NO: 102385 - DNA, 25 bp, E. coli
taaaaatacttatggtgcgctggct

SEQ ID NO: 102386 - DNA, 25 bp, E. coli
taaaaatacttaaggtgcgctggct

SEQ ID NO: 102387 - DNA, 25 bp, E. coli
ttgcctatcaaattgcggttaccgc

SEQ ID NO: 102388 - DNA, 25 bp, E. coli
ttgcctatcaaaatgcggttaccgc

SEQ ID NO: 102389 - DNA, 25 bp, E. coli
tgagcgaaggcataccggatagcat

SEQ ID NO: 102390 - DNA, 25 bp, E. coli
tgagcgaaggcaaaccggatagcat

SEQ ID NO: 102391 - DNA, 25 bp, E. coli
tcgcgttcaggtacagctcaagcag

SEQ ID NO: 102392 - DNA, 25 bp, E. coli
tcgcgttcaggttcagctcaagcag

SEQ ID NO: 102393 - DNA, 25 bp, E. coli
tctcaaagccgtgataaatctgcgt

SEQ ID NO: 102394 - DNA, 25 bp, E. coli
tctcaaagccgtcataaatctgcgt

SEQ ID NO: 102395 - DNA, 25 bp, E. coli
gctggcagacaccagcgatgaaaat

SEQ ID NO: 102396 - DNA, 25 bp, E. coli
gctactggaacagccatcaggttga

SEQ ID NO: 102397 - DNA, 25 bp, E. coli
gctggcagacacgagcgatgaaaat

SEQ ID NO: 102398 - DNA, 25 bp, E. coli
gctactggaacacccatcaggttga

SEQ ID NO: 102399 - DNA, 25 bp, E. coli
cattgttgccgagctgcgtggtgaa

SEQ ID NO: 102400 - DNA, 25 bp, E. coli
cattgttgccgacctgcgtggtgaa

SEQ ID NO: 102401 - DNA, 25 bp, E. coli
cagaacgatagaccgacacgtaggg

SEQ ID NO: 102402 - DNA, 25 bp, E. coli
cagagacagaacagagccgaaatat

SEQ ID NO: 102403 - DNA, 25 bp, E. coli
cagagctggcctaaaaggtggcaat

SEQ ID NO: 102404 - DNA, 25 bp, E. coli
cagaacagagccgaaatataaagcg

SEQ ID NO: 102405 - DNA, 25 bp, E. coli
cagagacagaactgagccgaaatat

SEQ ID NO: 102406 - DNA, 25 bp, E. coli
cagaacgatagagcgacacgtaggg

SEQ ID NO: 102407 - DNA, 25 bp, E. coli
cagagctggccttaaaggtggcaat

SEQ ID NO: 102408 - DNA, 25 bp, E. coli
cagaacagagcccaaatataaagcg

SEQ ID NO: 102409 - DNA, 25 bp, E. coli
atgaccagaacaggcagagacagaa

SEQ ID NO: 102410 - DNA, 25 bp, E. coli
atgaccagaacacgcagagacagaa

SEQ ID NO: 102411 - DNA, 25 bp, E. coli
aacacgcagagacagaacagagccg

SEQ ID NO: 102412 - DNA, 25 bp, E. coli
aacacgcagagagagaacagagccg

SEQ ID NO: 102413 - DNA, 25 bp, E. coli
tataacagagctcgccttaaaggtg

SEQ ID NO: 102414 - DNA, 25 bp, E. coli
tataacagagctggccttaaaggtg

SEQ ID NO: 102415 - DNA, 25 bp, E. coli
ccttaaaggtggcaatcagaacgat

SEQ ID NO: 102416 - DNA, 25 bp, E. coli
ccttaaaggtgggaatcagaacgat

SEQ ID NO: 102417 - DNA, 25 bp, E. coli
gcgttagatatatcagagctggcct

SEQ ID NO: 102418 - DNA, 25 bp, E. coli
gcgttagatataacagagctggcct

SEQ ID NO: 102419 - DNA, 25 bp, E. coli
gcaatcagaacgatagaccgacacg

SEQ ID NO: 102420 - DNA, 25 bp, E. coli
gcaatcagaacgttagaccgacacg

SEQ ID NO: 102421 - DNA, 25 bp, E. coli
gagccgaaatataaagcgttagata

SEQ ID NO: 102422 - DNA, 25 bp, E. coli
gagccgaaatattaagcgttagata

SEQ ID NO: 102423 - DNA, 25 bp, E. coli
cacgcgcctgtttgttcaatggaga

SEQ ID NO: 102424 - DNA, 25 bp, E. coli
cacgcgcctgttagttcaatggaga

SEQ ID NO: 102425 - DNA, 25 bp, E. coli
tacagacagaccatttcggacgttg

SEQ ID NO: 102426 - DNA, 25 bp, E. coli
ttgcccggctaaaaaagtgaatcgc

SEQ ID NO: 102427 - DNA, 25 bp, E. coli
tacagacagaccttttcggacgttg

SEQ ID NO: 102428 - DNA, 25 bp, E. coli
ttgcccggctaataaagtgaatcgc

SEQ ID NO: 102429 - DNA, 25 bp, E. coli
tattaacgtggatagcggtgcccag

SEQ ID NO: 102430 - DNA, 25 bp, E. coli
tattaacgtggaaagcggtgcccag

SEQ ID NO: 102431 - DNA, 25 bp, E. coli
ttgatatcaatatgggttgcccggc

SEQ ID NO: 102432 - DNA, 25 bp, E. coli
ttgatatcaataagggttgcccggc

SEQ ID NO: 102433 - DNA, 25 bp, E. coli
tgcacattgatgtacccggtattcg

SEQ ID NO: 102434 - DNA, 25 bp, E. coli
tgcacattgatgaacccggtattcg

SEQ ID NO: 102435 - DNA, 25 bp, E. coli
gaatcgcaagctcgcaggttcagcc

SEQ ID NO: 102436 - DNA, 25 bp, E. coli
gaatcgcaagctggcaggttcagcc

SEQ ID NO: 102437 - DNA, 25 bp, E. coli
cattgaggatgccagcgaacagctg

SEQ ID NO: 102438 - DNA, 25 bp, E. coli
cgggcagttaaggagaaagtttcca

SEQ ID NO: 102439 - DNA, 25 bp, E. coli
cattgaggatgcgagcgaacagctg

SEQ ID NO: 102440 - DNA, 25 bp, E. coli
cgggcagttaagcagaaagtttcca

SEQ ID NO: 102441 - DNA, 25 bp, E. coli
taactgcgaagacattgcccaactg

SEQ ID NO: 102442 - DNA, 25 bp, E. coli
taactgcgaagagattgcccaactg

SEQ ID NO: 102443 - DNA, 25 bp, E. coli
gagatgatgtcttctaacccacagg

SEQ ID NO: 102444 - DNA, 25 bp, E. coli
gagatgatgtctactaacccacagg

SEQ ID NO: 102445 - DNA, 25 bp, E. coli
caattaaagccgttttctggagcgt

SEQ ID NO: 102446 - DNA, 25 bp, E. coli
caattaaagccgatttctggagcgt

SEQ ID NO: 102447 - DNA, 25 bp, E. coli
taccgggcatggaagaacgaatttt

SEQ ID NO: 102448 - DNA, 25 bp, E. coli
tatctcaagcactaccctgcataag

SEQ ID NO: 102449 - DNA, 25 bp, E. coli
tagctatgattggaccgttttaacg

SEQ ID NO: 102450 - DNA, 25 bp, E. coli
tagctatgattgcaccgttttaacg

SEQ ID NO: 102451 - DNA, 25 bp, E. coli
tatctcaagcacaaccctgcataag

SEQ ID NO: 102452 - DNA, 25 bp, E. coli
taccgggcatggtagaacgaatttt

SEQ ID NO: 102453 - DNA, 25 bp, E. coli
tgaataatcactattgccgaggtaa

SEQ ID NO: 102454 - DNA, 25 bp, E. coli
tgaataatcacttttgccgaggtaa

SEQ ID NO: 102455 - DNA, 25 bp, E. coli
tgccccgccgaggatttatctcaag

SEQ ID NO: 102456 - DNA, 25 bp, E. coli
tgccccgccgagcatttatctcaag

SEQ ID NO: 102457 - DNA, 25 bp, E. coli
gccgaggtaacagcgtcataacaac

SEQ ID NO: 102458 - DNA, 25 bp, E. coli
cctgcataagaaaaaccggagatac

SEQ ID NO: 102459 - DNA, 25 bp, E. coli
cctgcataagaataaccggagatac

SEQ ID NO: 102460 - DNA, 25 bp, E. coli
gccgaggtaacaccgtcataacaac

SEQ ID NO: 102461 - DNA, 25 bp, E. coli
gcttcggcgttctgtaacacttcat

SEQ ID NO: 102462 - DNA, 25 bp, E. coli
gcttcggcgttcagtaacacttcat

SEQ ID NO: 102463 - DNA, 25 bp, E. coli
gaattttaaaaactgagcttcggcg

SEQ ID NO: 102464 - DNA, 25 bp, E. coli
gaattttaaaaagtgagcttcggcg

SEQ ID NO: 102465 - DNA, 25 bp, E. coli
cgttgtaacccgtatgtaacagtga

SEQ ID NO: 102466 - DNA, 25 bp, E. coli
cgttgtaacccgaatgtaacagtga

SEQ ID NO: 102467 - DNA, 25 bp, E. coli
caccacgttttgctgatggcggcga

SEQ ID NO: 102468 - DNA, 25 bp, E. coli
caccacgttttggtgatggcggcga

SEQ ID NO: 102469 - DNA, 25 bp, E. coli
actgcatggtcttcgcgggctacgt

SEQ ID NO: 102470 - DNA, 25 bp, E. coli
actgcatggtctacgcgggctacgt

SEQ ID NO: 102471 - DNA, 25 bp, E. coli
tatcctggtttaccggactggcgct

SEQ ID NO: 102472 - DNA, 25 bp, E. coli
tatcctggtttagcggactggcgct

SEQ ID NO: 102473 - DNA, 25 bp, E. coli
gcgattccggtgatttgcgccttca

SEQ ID NO: 102474 - DNA, 25 bp, E. coli
gcgattccggtgttttgcgccttca

SEQ ID NO: 102475 - DNA, 25 bp, E. coli
ccgagcttcctgtatatcaacaaag

SEQ ID NO: 102476 - DNA, 25 bp, E. coli
cccgatcgtgaattgcaggtgatta

SEQ ID NO: 102477 - DNA, 25 bp, E. coli
cccgatcgtgaaatgcaggtgatta

SEQ ID NO: 102478 - DNA, 25 bp, E. coli
ccgagcttcctgaatatcaacaaag

SEQ ID NO: 102479 - DNA, 25 bp, E. coli
cattggcactacacagattggctgg

SEQ ID NO: 102480 - DNA, 25 bp, E. coli
cattggcactactcagattggctgg

SEQ ID NO: 102481 - DNA, 25 bp, E. coli
gggctacgttgcaactccgctgttt

SEQ ID NO: 102482 - DNA, 25 bp, E. coli
gggctacgttgctactccgctgttt

SEQ ID NO: 102483 - DNA, 25 bp, E. coli
ggactgttttcccatcccgatcgtg

SEQ ID NO: 102484 - DNA, 25 bp, E. coli
tggcactatcctgaagttatcctgg

SEQ ID NO: 102485 - DNA, 25 bp, E. coli
ggactgttttccgatcccgatcgtg

SEQ ID NO: 102486 - DNA, 25 bp, E. coli
tggcactatcctcaagttatcctgg

SEQ ID NO: 102487 - DNA, 25 bp, E. coli
gatggcgcgtaaatatccgcagcgt

SEQ ID NO: 102488 - DNA, 25 bp, E. coli
gatggcgcgtaattatccgcagcgt

SEQ ID NO: 102489 - DNA, 25 bp, E. coli
caccgttaacggctcagacgctggt

SEQ ID NO: 102490 - DNA, 25 bp, E. coli
cactgatcctctggcgagtgagggc

SEQ ID NO: 102491 - DNA, 25 bp, E. coli
cactgatcctctcgcgagtgagggc

SEQ ID NO: 102492 - DNA, 25 bp, E. coli
caccgttaacgggtcagacgctggt

SEQ ID NO: 102493 - DNA, 25 bp, E. coli
cagttacgttgtccgcagtgccaga

SEQ ID NO: 102494 - DNA, 25 bp, E. coli
cagttacgttgtgcgcagtgccaga

SEQ ID NO: 102495 - DNA, 25 bp, E. coli
taaagggcttctgacgctactgctg

SEQ ID NO: 102496 - DNA, 25 bp, E. coli
taaagggcttctcacgctactgctg

SEQ ID NO: 102497 - DNA, 25 bp, E. coli
tgttactgctgatggcactgatcct

SEQ ID NO: 102498 - DNA, 25 bp, E. coli
tgttactgctgaaggcactgatcct

SEQ ID NO: 102499 - DNA, 25 bp, E. coli
tccgcaacaacagcaacaggcgtta

SEQ ID NO: 102500 - DNA, 25 bp, E. coli
tccgcaacaacaccaacaggcgtta

SEQ ID NO: 102501 - DNA, 25 bp, E. coli
gattttgttcgcaataacccaccgt

SEQ ID NO: 102502 - DNA, 25 bp, E. coli
gattttgttcgctataacccaccgt

SEQ ID NO: 102503 - DNA, 25 bp, E. coli
gtcagtatgcgccatcaggtttaca

SEQ ID NO: 102504 - DNA, 25 bp, E. coli
gtcagtatgcgcgatcaggtttaca

SEQ ID NO: 102505 - DNA, 25 bp, E. coli
ggcgttaaatatagccagccagtta

SEQ ID NO: 102506 - DNA, 25 bp, E. coli
tggatgaccgaacgctacggagatt

SEQ ID NO: 102507 - DNA, 25 bp, E. coli
tggcaattcgcctatccgcaacaac

SEQ ID NO: 102508 - DNA, 25 bp, E. coli
tggcaattcgccaatccgcaacaac

SEQ ID NO: 102509 - DNA, 25 bp, E. coli
tggatgaccgaaggctacggagatt

SEQ ID NO: 102510 - DNA, 25 bp, E. coli
ggcgttaaatattgccagccagtta

SEQ ID NO: 102511 - DNA, 25 bp, E. coli
cacgatttaatccacgggagagtaa

SEQ ID NO: 102512 - DNA, 25 bp, E. coli
cacgatttaatcgacgggagagtaa

SEQ ID NO: 102513 - DNA, 25 bp, E. coli
cacaagagatctggagaaaggacgg

SEQ ID NO: 102514 - DNA, 25 bp, E. coli
cacaagagatctcgagaaaggacgg

SEQ ID NO: 102515 - DNA, 25 bp, E. coli
taaaaaccagcgtttacaccaaaga

SEQ ID NO: 102516 - DNA, 25 bp, E. coli
taaaaaccagcgattacaccaaaga

SEQ ID NO: 102517 - DNA, 25 bp, E. coli
tttttcgcacacaagagatctggag

SEQ ID NO: 102518 - DNA, 25 bp, E. coli
tttttcgcacactagagatctggag

SEQ ID NO: 102519 - DNA, 25 bp, E. coli
tgcgcctgatgcatgcagaaggtgt

SEQ ID NO: 102520 - DNA, 25 bp, E. coli
tgcgcctgatgcttgcagaaggtgt

SEQ ID NO: 102521 - DNA, 25 bp, E. coli
taatcgacgggagagtaaaaaccag

SEQ ID NO: 102522 - DNA, 25 bp, E. coli
taatcgacgggacagtaaaaaccag

SEQ ID NO: 102523 - DNA, 25 bp, E. coli
gaagaattgcgcctgatgcatgcag

SEQ ID NO: 102524 - DNA, 25 bp, E. coli
gcagaaggtgtttttcgcacacaag

SEQ ID NO: 102525 - DNA, 25 bp, E. coli
gcagaaggtgttattcgcacacaag

SEQ ID NO: 102526 - DNA, 25 bp, E. coli
gaagaattgcgcgtgatgcatgcag

SEQ ID NO: 102527 - DNA, 25 bp, E. coli
gattacaccaaacaagaattgcgcc

SEQ ID NO: 102528 - DNA, 25 bp, E. coli
gattacaccaaagaagaattgcgcc

SEQ ID NO: 102529 - DNA, 25 bp, E. coli
gatctggagaaaggacggttattta

SEQ ID NO: 102530 - DNA, 25 bp, E. coli
gacgggagagtataaaccagcgatt

SEQ ID NO: 102531 - DNA, 25 bp, E. coli
gacgggagagtaaaaaccagcgatt

SEQ ID NO: 102532 - DNA, 25 bp, E. coli
gatctggagaaacgacggttattta

SEQ ID NO: 102533 - DNA, 25 bp, E. coli
tacacgaagaagctcgcagcgactg

SEQ ID NO: 102534 - DNA, 25 bp, E. coli
tacacgaagaaggtcgcagcgactg

SEQ ID NO: 102535 - DNA, 25 bp, E. coli
attacgaagacgacgcgcagaccta

SEQ ID NO: 102536 - DNA, 25 bp, E. coli
attacgaagacgtcgcgcagaccta

SEQ ID NO: 102537 - DNA, 25 bp, E. coli
aaataactgttgtagcgcccatcgg

SEQ ID NO: 102538 - DNA, 25 bp, E. coli
aaataactgttgaagcgcccatcgg

SEQ ID NO: 102539 - DNA, 25 bp, E. coli
tgaccagaacgtggactggagtctg

SEQ ID NO: 102540 - DNA, 25 bp, E. coli
tgcataacggcatcagcgcggaaat

SEQ ID NO: 102541 - DNA, 25 bp, E. coli
tgcataacggcaacagcgcggaaat

SEQ ID NO: 102542 - DNA, 25 bp, E. coli
tgaccagaacgtcgactggagtctg

SEQ ID NO: 102543 - DNA, 25 bp, E. coli
tctggcaaaagatgtcgccggtggc

SEQ ID NO: 102544 - DNA, 25 bp, E. coli
tctggcaaaagaagtcgccggtggc

SEQ ID NO: 102545 - DNA, 25 bp, E. coli
ccttccacggtggagaaataactgt

SEQ ID NO: 102546 - DNA, 25 bp, E. coli
ccttccacggtgcagaaataactgt

SEQ ID NO: 102547 - DNA, 25 bp, E. coli
gacattctggttcctccggtacacg

SEQ ID NO: 102548 - DNA, 25 bp, E. coli
gacattctggttgctccggtacacg

SEQ ID NO: 102549 - DNA, 25 bp, E. coli
cggcaaagcgcggttatctggcaaa

SEQ ID NO: 102550 - DNA, 25 bp, E. coli
cggcaaagcgcgcttatctggcaaa

SEQ ID NO: 102551 - DNA, 25 bp, E. coli
gatctctgcgaagaggcggcaaagc

SEQ ID NO: 102552 - DNA, 25 bp, E. coli
gatctctgcgaacaggcggcaaagc

SEQ ID NO: 102553 - DNA, 25 bp, E. coli
tggattcgcgtaacaagcagtggaa

SEQ ID NO: 102554 - DNA, 25 bp, E. coli
tggattcgcgtatcaagcagtggaa

SEQ ID NO: 102555 - DNA, 25 bp, E. coli
aagtgccgtacttctcgcgagatga

SEQ ID NO: 102556 - DNA, 25 bp, E. coli
aagtgccgtactactcgcgagatga

SEQ ID NO: 102557 - DNA, 25 bp, E. coli
taaacaatacttggatgaactggcg

SEQ ID NO: 102558 - DNA, 25 bp, E. coli
taaacaatacttcgatgaactggcg

SEQ ID NO: 102559 - DNA, 25 bp, E. coli
ttaagtcaggcacaaacgggatggc

SEQ ID NO: 102560 - DNA, 25 bp, E. coli
ttaagtcaggcagaaacgggatggc

SEQ ID NO: 102561 - DNA, 25 bp, E. coli
tgatcagttaagcaaccaggcgtcg

SEQ ID NO: 102562 - DNA, 25 bp, E. coli
tgatcagttaaggaaccaggcgtcg

SEQ ID NO: 102563 - DNA, 25 bp, E. coli
gcgttgcagcaaacaatgcccctga

SEQ ID NO: 102564 - DNA, 25 bp, E. coli
gcgttgcagcaatcaatgcccctga

SEQ ID NO: 102565 - DNA, 25 bp, E. coli
gattcgcgtgataaaatcgtggccc

SEQ ID NO: 102566 - DNA, 25 bp, E. coli
gattcgcgtgattaaatcgtggccc

SEQ ID NO: 102567 - DNA, 25 bp, E. coli
ggcgtttttccctaccgcagaggca

SEQ ID NO: 102568 - DNA, 25 bp, E. coli
ggcgtttttcccaaccgcagaggca

SEQ ID NO: 102569 - DNA, 25 bp, E. coli
taatccgaaagccatggacagcgcc

SEQ ID NO: 102570 - DNA, 25 bp, E. coli
tcaatgattatctcgcagggctggc

SEQ ID NO: 102571 - DNA, 25 bp, E. coli
taatccgaaagcgatggacagcgcc

SEQ ID NO: 102572 - DNA, 25 bp, E. coli
tcaccgacgcgctaaagggcattat

SEQ ID NO: 102573 - DNA, 25 bp, E. coli
tcaccgacgcgcaaaagggcattat

SEQ ID NO: 102574 - DNA, 25 bp, E. coli
tcaatgattatcacgcagggctggc

SEQ ID NO: 102575 - DNA, 25 bp, E. coli
gagtttgcgcaattccagcaggcgg

SEQ ID NO: 102576 - DNA, 25 bp, E. coli
gagtttgcgcaaatccagcaggcgg

SEQ ID NO: 102577 - DNA, 25 bp, E. coli
cattagttaaatgatggcttttgcc

SEQ ID NO: 102578 - DNA, 25 bp, E. coli
cattagttaaatcatggcttttgcc

SEQ ID NO: 102579 - DNA, 25 bp, E. coli
tactaaacattagttaaatcatggc

SEQ ID NO: 102580 - DNA, 25 bp, E. coli
tactaaacattacttaaatcatggc

SEQ ID NO: 102581 - DNA, 25 bp, E. coli
tatctacccggtcaatggcaccgga

SEQ ID NO: 102582 - DNA, 25 bp, E. coli
tatctacccggtgaatggcaccgga

SEQ ID NO: 102583 - DNA, 25 bp, E. coli
tgatggtttatttacattcatcctg

SEQ ID NO: 102584 - DNA, 25 bp, E. coli
tgtgtaattttagtactcatccgac

SEQ ID NO: 102585 - DNA, 25 bp, E. coli
tgtgtaattttactactcatccgac

SEQ ID NO: 102586 - DNA, 25 bp, E. coli
tgatggtttattaacattcatcctg

SEQ ID NO: 102587 - DNA, 25 bp, E. coli
tactcatccgacgacttatttttgc

SEQ ID NO: 102588 - DNA, 25 bp, E. coli
tactcatccgaccacttatttttgc

SEQ ID NO: 102589 - DNA, 25 bp, E. coli
gaatggcaccggtaaaatgaatttg

SEQ ID NO: 102590 - DNA, 25 bp, E. coli
gaatggcaccggaaaaatgaatttg

SEQ ID NO: 102591 - DNA, 25 bp, E. coli
cccttttgtatcaacccggtgaatg

SEQ ID NO: 102592 - DNA, 25 bp, E. coli
cccttttgtatctacccggtgaatg

SEQ ID NO: 102593 - DNA, 25 bp, E. coli
cattcatcctgtaattaagttacac

SEQ ID NO: 102594 - DNA, 25 bp, E. coli
cattcatcctgttattaagttacac

SEQ ID NO: 102595 - DNA, 25 bp, E. coli
gaccacttatttttgcttattgatg

SEQ ID NO: 102596 - DNA, 25 bp, E. coli
gaccacttatttatgcttattgatg

SEQ ID NO: 102597 - DNA, 25 bp, E. coli
gatgaaaatagttccgccttttgtg

SEQ ID NO: 102598 - DNA, 25 bp, E. coli
gatgaaaatagtaccgccttttgtg

SEQ ID NO: 102599 - DNA, 25 bp, E. coli
cagctgccagaagcgattactcagg

SEQ ID NO: 102600 - DNA, 25 bp, E. coli
cagctgccagaaccgattactcagg

SEQ ID NO: 102601 - DNA, 25 bp, E. coli
catcaacgacgtacctgcgcagagt

SEQ ID NO: 102602 - DNA, 25 bp, E. coli
catcaacgacgttcctgcgcagagt

SEQ ID NO: 102603 - DNA, 25 bp, E. coli
taaaaacctgatgccactgctgggt

SEQ ID NO: 102604 - DNA, 25 bp, E. coli
taaaaacctgatcccactgctgggt

SEQ ID NO: 102605 - DNA, 25 bp, E. coli
attcagggacgtcgtattccagtac

SEQ ID NO: 102606 - DNA, 25 bp, E. coli
attcagggacgtggtattccagtac

SEQ ID NO: 102607 - DNA, 25 bp, E. coli
actgctgggtatgggtggcgaaacc

SEQ ID NO: 102608 - DNA, 25 bp, E. coli
actgctgggtatcggtggcgaaacc

SEQ ID NO: 102609 - DNA, 25 bp, E. coli
aacctgatgccagtgctgggtatgg

SEQ ID NO: 102610 - DNA, 25 bp, E. coli
aacctgatgccactgctgggtatgg

SEQ ID NO: 102611 - DNA, 25 bp, E. coli
tgccatcaacgaggtacctgcgcag

SEQ ID NO: 102612 - DNA, 25 bp, E. coli
tgccatcaacgacgtacctgcgcag

SEQ ID NO: 102613 - DNA, 25 bp, E. coli
gccagaagcgattactcaggcggtg

SEQ ID NO: 102614 - DNA, 25 bp, E. coli
gccagaagcgataactcaggcggtg

SEQ ID NO: 102615 - DNA, 25 bp, E. coli
gccggattcagggacgtggtattcc

SEQ ID NO: 102616 - DNA, 25 bp, E. coli
gccggattcaggcacgtggtattcc

SEQ ID NO: 102617 - DNA, 25 bp, E. coli
gtttaaaaacctcatgccactgctg

SEQ ID NO: 102618 - DNA, 25 bp, E. coli
gtttaaaaacctgatgccactgctg

SEQ ID NO: 102619 - DNA, 25 bp, E. coli
ggcgtttaaaaagctgatgccactg

SEQ ID NO: 102620 - DNA, 25 bp, E. coli
ggcgtttaaaaacctgatgccactg

SEQ ID NO: 102621 - DNA, 25 bp, E. coli
caacagcggtatctgggtacgcgca

SEQ ID NO: 102622 - DNA, 25 bp, E. coli
caacagcggtatgtgggtacgcgca

SEQ ID NO: 102623 - DNA, 25 bp, E. coli
aagccgcgggtaacgttcttctaga

SEQ ID NO: 102624 - DNA, 25 bp, E. coli
aagccgcgggtatcgttcttctaga

SEQ ID NO: 102625 - DNA, 25 bp, E. coli
tatccggacagaaaatacagtgagc

SEQ ID NO: 102626 - DNA, 25 bp, E. coli
tatagcttgccagaaaaagccgcgg

SEQ ID NO: 102627 - DNA, 25 bp, E. coli
tatagcttgccacaaaaagccgcgg

SEQ ID NO: 102628 - DNA, 25 bp, E. coli
tatccggacagataatacagtgagc

SEQ ID NO: 102629 - DNA, 25 bp, E. coli
tgtgtcagaatttatggcagccgct

SEQ ID NO: 102630 - DNA, 25 bp, E. coli
tgtgtcagaattaatggcagccgct

SEQ ID NO: 102631 - DNA, 25 bp, E. coli
tgagcaaatcccaaacagccgtgaa

SEQ ID NO: 102632 - DNA, 25 bp, E. coli
tgagcaaatccctaacagccgtgaa

SEQ ID NO: 102633 - DNA, 25 bp, E. coli
tgccaattgtggtacggtcatcgct

SEQ ID NO: 102634 - DNA, 25 bp, E. coli
tgccaattgtggaacggtcatcgct

SEQ ID NO: 102635 - DNA, 25 bp, E. coli
gaagctttggcatcgttaccggaat

SEQ ID NO: 102636 - DNA, 25 bp, E. coli
gaagctttggcaacgttaccggaat

SEQ ID NO: 102637 - DNA, 25 bp, E. coli
gaaaaactcggcgtgcggagcaatg

SEQ ID NO: 102638 - DNA, 25 bp, E. coli
gaaaaactcggcctgcggagcaatg

SEQ ID NO: 102639 - DNA, 25 bp, E. coli
cattatgccgcatttgagcgagcga

SEQ ID NO: 102640 - DNA, 25 bp, E. coli
cattatgccgcaattgagcgagcga

SEQ ID NO: 102641 - DNA, 25 bp, E. coli
ggtttaataagatgcctggcctgga

SEQ ID NO: 102642 - DNA, 25 bp, E. coli
ggtttaataagaagcctggcctgga

SEQ ID NO: 102643 - DNA, 25 bp, E. coli
aataagctcttgtcagcggcagggc

SEQ ID NO: 102644 - DNA, 25 bp, E. coli
aataagctcttgacagcggcagggc

SEQ ID NO: 102645 - DNA, 25 bp, E. coli
caatttagagaattagggcgagccg

SEQ ID NO: 102646 - DNA, 25 bp, E. coli
caatttagagaaatagggcgagccg

SEQ ID NO: 102647 - DNA, 25 bp, E. coli
tacaagtaagatggaataaaccggg

SEQ ID NO: 102648 - DNA, 25 bp, E. coli
tacaagtaagatcgaataaaccggg

SEQ ID NO: 102649 - DNA, 25 bp, E. coli
tagggcgagccgacaagcatttgac

SEQ ID NO: 102650 - DNA, 25 bp, E. coli
tagggcgagccgtcaagcatttgac

SEQ ID NO: 102651 - DNA, 25 bp, E. coli
tgttcaaaacctcgccaactctaga

SEQ ID NO: 102652 - DNA, 25 bp, E. coli
tgttcaaaacctggccaactctaga

SEQ ID NO: 102653 - DNA, 25 bp, E. coli
tcatgtggagtagattggtcaggca

SEQ ID NO: 102654 - DNA, 25 bp, E. coli
tcatgtggagtacattggtcaggca

SEQ ID NO: 102655 - DNA, 25 bp, E. coli
gcagggcgttctgccgataaccgta

SEQ ID NO: 102656 - DNA, 25 bp, E. coli
gcagggcgttctcccgataaccgta

SEQ ID NO: 102657 - DNA, 25 bp, E. coli
gaatgtgacagaagtcgctgatgcc

SEQ ID NO: 102658 - DNA, 25 bp, E. coli
gaatgtgacagatgtcgctgatgcc

SEQ ID NO: 102659 - DNA, 25 bp, E. coli
cgctgatgccaacgatagatgatag

SEQ ID NO: 102660 - DNA, 25 bp, E. coli
cgctgatgccaaggatagatgatag

SEQ ID NO: 102661 - DNA, 25 bp, E. coli
taaccgtaaccgaagatgataactg

SEQ ID NO: 102662 - DNA, 25 bp, E. coli
taacgctattgagaggaatgtgaca

SEQ ID NO: 102663 - DNA, 25 bp, E. coli
taaccgtaaccgtagatgataactg

SEQ ID NO: 102664 - DNA, 25 bp, E. coli
taacgctattgacaggaatgtgaca

SEQ ID NO: 102665 - DNA, 25 bp, E. coli
caattaccgatgttgttcgccgtct

SEQ ID NO: 102666 - DNA, 25 bp, E. coli
caattaccgatgatgttcgccgtct

SEQ ID NO: 102667 - DNA, 25 bp, E. coli
catggttatctggatggtggtgcaa

SEQ ID NO: 102668 - DNA, 25 bp, E. coli
catggttatctgcatggtggtgcaa

SEQ ID NO: 102669 - DNA, 25 bp, E. coli
taccgatgttgttcgccgtctgaac

SEQ ID NO: 102670 - DNA, 25 bp, E. coli
taccgatgttgtacgccgtctgaac

SEQ ID NO: 102671 - DNA, 25 bp, E. coli
tatctggatggtcgtgcaatgagcc

SEQ ID NO: 102672 - DNA, 25 bp, E. coli
tatctggatggtggtgcaatgagcc

SEQ ID NO: 102673 - DNA, 25 bp, E. coli
ttcgccgtctgatcctgagcgcgga

SEQ ID NO: 102674 - DNA, 25 bp, E. coli
ttcgccgtctgaacctgagcgcgga

SEQ ID NO: 102675 - DNA, 25 bp, E. coli
tggtggtgcaatcagccaattaccg

SEQ ID NO: 102676 - DNA, 25 bp, E. coli
tgcgaccgttcgccgccgtcgttta

SEQ ID NO: 102677 - DNA, 25 bp, E. coli
tgcgaccgttcggcgccgtcgttta

SEQ ID NO: 102678 - DNA, 25 bp, E. coli
tgttgttcgccgtctgaacctgagc

SEQ ID NO: 102679 - DNA, 25 bp, E. coli
tggtggtgcaatgagccaattaccg

SEQ ID NO: 102680 - DNA, 25 bp, E. coli
tgttgttcgccgactgaacctgagc

SEQ ID NO: 102681 - DNA, 25 bp, E. coli
tgcaatgagccaattaccgatgttg

SEQ ID NO: 102682 - DNA, 25 bp, E. coli
tgcaatgagccatttaccgatgttg

SEQ ID NO: 102683 - DNA, 25 bp, E. coli
ccgtctgaacctgagcgcggatggc

SEQ ID NO: 102684 - DNA, 25 bp, E. coli
ccgtctgaacctcagcgcggatggc

SEQ ID NO: 102685 - DNA, 25 bp, E. coli
gagccaattacccatgttgttcgcc

SEQ ID NO: 102686 - DNA, 25 bp, E. coli
gagccaattaccgatgttgttcgcc

SEQ ID NO: 102687 - DNA, 25 bp, E. coli
tacttggagccagtatcgactacgc

SEQ ID NO: 102688 - DNA, 25 bp, E. coli
tacttggagccactatcgactacgc

SEQ ID NO: 102689 - DNA, 25 bp, E. coli
tatcatgcaactggtaggacaggtg

SEQ ID NO: 102690 - DNA, 25 bp, E. coli
tatcatgcaactcgtaggacaggtg

SEQ ID NO: 102691 - DNA, 25 bp, E. coli
ttggcatggattgtaggcgccgccc

SEQ ID NO: 102692 - DNA, 25 bp, E. coli
ttatgattcttcacgcttccggcgg

SEQ ID NO: 102693 - DNA, 25 bp, E. coli
ttggcatggattctaggcgccgccc

SEQ ID NO: 102694 - DNA, 25 bp, E. coli
ttatgattcttctcgcttccggcgg

SEQ ID NO: 102695 - DNA, 25 bp, E. coli
tccaggcaggtacatgacgaccatc

SEQ ID NO: 102696 - DNA, 25 bp, E. coli
tccaggcaggtagatgacgaccatc

SEQ ID NO: 102697 - DNA, 25 bp, E. coli
tcattttcggcgaggaccgctttcg

SEQ ID NO: 102698 - DNA, 25 bp, E. coli
tcattttcggcgtggaccgctttcg

SEQ ID NO: 102699 - DNA, 25 bp, E. coli
cgaccatcagggacagcttcaagga

SEQ ID NO: 102700 - DNA, 25 bp, E. coli
cgaccatcagggtcagcttcaagga

SEQ ID NO: 102701 - DNA, 25 bp, E. coli
gtattcggaatcttgcacgccctcg

SEQ ID NO: 102702 - DNA, 25 bp, E. coli
gttgggcgccatgtccttgcatgca

SEQ ID NO: 102703 - DNA, 25 bp, E. coli
gttgggcgccatctccttgcatgca

SEQ ID NO: 102704 - DNA, 25 bp, E. coli
gtattcggaatcatgcacgccctcg

SEQ ID NO: 102705 - DNA, 25 bp, E. coli
gatgatcggcctgtcgcttgcggta

SEQ ID NO: 102706 - DNA, 25 bp, E. coli
gatgatcggcctctcgcttgcggta

SEQ ID NO: 102707 - DNA, 25 bp, E. coli
gagaagcaggcctttatcgccggca

SEQ ID NO: 102708 - DNA, 25 bp, E. coli
gagaagcaggccattatcgccggca

SEQ ID NO: 102709 - DNA, 25 bp, E. coli
cacatatggtgaagagcgaaaatta

SEQ ID NO: 102710 - DNA, 25 bp, E. coli
cacatatggtgatgagcgaaaatta

SEQ ID NO: 102711 - DNA, 25 bp, E. coli
caggcggcagaaaaattaaacaaat

SEQ ID NO: 102712 - DNA, 25 bp, E. coli
caggcggcagaataattaaacaaat

SEQ ID NO: 102713 - DNA, 25 bp, E. coli
aaaataatcgcccaatttgatgtcg

SEQ ID NO: 102714 - DNA, 25 bp, E. coli
aaacagatcctcaggcggcagaaaa

SEQ ID NO: 102715 - DNA, 25 bp, E. coli
aaacagatcctctggcggcagaaaa

SEQ ID NO: 102716 - DNA, 25 bp, E. coli
aaaataatcgccgaatttgatgtcg

SEQ ID NO: 102717 - DNA, 25 bp, E. coli
tgagtattgtgagccaaacaagaaa

SEQ ID NO: 102718 - DNA, 25 bp, E. coli
tgagtattgtgacccaaacaagaaa

SEQ ID NO: 102719 - DNA, 25 bp, E. coli
tttgatgtcgtataagaaagcgtta

SEQ ID NO: 102720 - DNA, 25 bp, E. coli
taagtgaaaaagcaaaaacagatcc

SEQ ID NO: 102721 - DNA, 25 bp, E. coli
tttgatgtcgtaaaagaaagcgtta

SEQ ID NO: 102722 - DNA, 25 bp, E. coli
taagtgaaaaaggaaaaacagatcc

SEQ ID NO: 102723 - DNA, 25 bp, E. coli
tctgccctaagtaagattgaaaaac

SEQ ID NO: 102724 - DNA, 25 bp, E. coli
tctgccctaagttagattgaaaaac

SEQ ID NO: 102725 - DNA, 25 bp, E. coli
gaaaattatatgattctgccctaag

SEQ ID NO: 102726 - DNA, 25 bp, E. coli
gaaaattatatgtttctgccctaag

SEQ ID NO: 102727 - DNA, 25 bp, E. coli
taatagagacactgagtccagcaag

SEQ ID NO: 102728 - DNA, 25 bp, E. coli
taatagagacacagagtccagcaag

SEQ ID NO: 102729 - DNA, 25 bp, E. coli
gagtccagcaagatctaaaagccaa

SEQ ID NO: 102730 - DNA, 25 bp, E. coli
gagtccagcaagttctaaaagccaa

SEQ ID NO: 102731 - DNA, 25 bp, E. coli
taaaagatgcgaatacaggaaaggc

SEQ ID NO: 102732 - DNA, 25 bp, E. coli
taaaagatgcgattacaggaaaggc

SEQ ID NO: 102733 - DNA, 25 bp, E. coli
tacaggaaaggccaaagaagaatgc

SEQ ID NO: 102734 - DNA, 25 bp, E. coli
tacaggaaaggcgaaagaagaatgc

SEQ ID NO: 102735 - DNA, 25 bp, E. coli
cggtcgtttaactcggaagtgatgt

SEQ ID NO: 102736 - DNA, 25 bp, E. coli
cggtcgtttaacacggaagtgatgt

SEQ ID NO: 102737 - DNA, 25 bp, E. coli
tacctcagtcgcaaaaagatgcgat

SEQ ID NO: 102738 - DNA, 25 bp, E. coli
tacctcagtcgctaaaagatgcgat

SEQ ID NO: 102739 - DNA, 25 bp, E. coli
tgagaatacctctgtcgctaaaaga

SEQ ID NO: 102740 - DNA, 25 bp, E. coli
tgagaatacctcagtcgctaaaaga

SEQ ID NO: 102741 - DNA, 25 bp, E. coli
gccaaagaagaaagccggtcgttta

SEQ ID NO: 102742 - DNA, 25 bp, E. coli
gccaaagaagaatgccggtcgttta

SEQ ID NO: 102743 - DNA, 25 bp, E. coli
gcagaattttggagagaatacctca

SEQ ID NO: 102744 - DNA, 25 bp, E. coli
gcagaattttggtgagaatacctca

SEQ ID NO: 102745 - DNA, 25 bp, E. coli
gaatgccggtcgattaactcggaag

SEQ ID NO: 102746 - DNA, 25 bp, E. coli
gaatgccggtcgtttaactcggaag

SEQ ID NO: 102747 - DNA, 25 bp, E. coli
gaaaaagaagttagcagaattttgg

SEQ ID NO: 102748 - DNA, 25 bp, E. coli
gaaaggccaaagtagaatgccggtc

SEQ ID NO: 102749 - DNA, 25 bp, E. coli
gaaaggccaaagaagaatgccggtc

SEQ ID NO: 102750 - DNA, 25 bp, E. coli
gaaaaagaagtttgcagaattttgg

SEQ ID NO: 102751 - DNA, 25 bp, E. coli
gatgcgattacaggaaaggccaaag

SEQ ID NO: 102752 - DNA, 25 bp, E. coli
gatgcgattacacgaaaggccaaag

SEQ ID NO: 102753 - DNA, 25 bp, E. coli
aacgaatagtgcgttttactgcgac

SEQ ID NO: 102754 - DNA, 25 bp, E. coli
aacgaatagtgccttttactgcgac

SEQ ID NO: 102755 - DNA, 25 bp, E. coli
cagttagcgcggtattaattagctc

SEQ ID NO: 102756 - DNA, 25 bp, E. coli
cagttagcgcggaattaattagctc

SEQ ID NO: 102757 - DNA, 25 bp, E. coli
cacatttttaactcttagtatcaac

SEQ ID NO: 102758 - DNA, 25 bp, E. coli
cacatttttaacacttagtatcaac

SEQ ID NO: 102759 - DNA, 25 bp, E. coli
tagctcaataataagtgtatacttg

SEQ ID NO: 102760 - DNA, 25 bp, E. coli
tagctcaataattagtgtatacttg

SEQ ID NO: 102761 - DNA, 25 bp, E. coli
tagaattaacgaaaaataaccgtat

SEQ ID NO: 102762 - DNA, 25 bp, E. coli
tagaattaacgataaataaccgtat

SEQ ID NO: 102763 - DNA, 25 bp, E. coli
tatcaactgaaagagttagcgcggt

SEQ ID NO: 102764 - DNA, 25 bp, E. coli
tatcaactgaaacagttagcgcggt

SEQ ID NO: 102765 - DNA, 25 bp, E. coli
tctgccccgtcgattctgacggcgg

SEQ ID NO: 102766 - DNA, 25 bp, E. coli
tgcgacatgtcattcacacaatgaa

SEQ ID NO: 102767 - DNA, 25 bp, E. coli
tctgccccgtcgtttctgacggcgg

SEQ ID NO: 102768 - DNA, 25 bp, E. coli
tgcgacatgtcaatcacacaatgaa

SEQ ID NO: 102769 - DNA, 25 bp, E. coli
gctttcccctgcgattaatttaacg

SEQ ID NO: 102770 - DNA, 25 bp, E. coli
gcgttttactgcgacatgtcattca

SEQ ID NO: 102771 - DNA, 25 bp, E. coli
gcgttttactgccacatgtcattca

SEQ ID NO: 102772 - DNA, 25 bp, E. coli
gctttcccctgccattaatttaacg

SEQ ID NO: 102773 - DNA, 25 bp, E. coli
ggaaaatgttgcttatccctctcaa

SEQ ID NO: 102774 - DNA, 25 bp, E. coli
ggaaaatgttgcatatccctctcaa

SEQ ID NO: 102775 - DNA, 25 bp, E. coli
aacgcttagatctggctttggccga

SEQ ID NO: 102776 - DNA, 25 bp, E. coli
catatcactcatccgctggtgggcg

SEQ ID NO: 102777 - DNA, 25 bp, E. coli
catatcactcatgcgctggtgggcg

SEQ ID NO: 102778 - DNA, 25 bp, E. coli
tacagctcactggaacggtgtccga

SEQ ID NO: 102779 - DNA, 25 bp, E. coli
taaaagaatggaacctcgaccagcg

SEQ ID NO: 102780 - DNA, 25 bp, E. coli
taaaagaatggatcctcgaccagcg

SEQ ID NO: 102781 - DNA, 25 bp, E. coli
tacagctcactgcaacggtgtccga

SEQ ID NO: 102782 - DNA, 25 bp, E. coli
aacgcttagatcaggctttggccga

SEQ ID NO: 102783 - DNA, 25 bp, E. coli
ttactcgtgagtttgaagcggtggc

SEQ ID NO: 102784 - DNA, 25 bp, E. coli
ttactcgtgagtatgaagcggtggc

SEQ ID NO: 102785 - DNA, 25 bp, E. coli
tcccgctggataacgtctatgaaga

SEQ ID NO: 102786 - DNA, 25 bp, E. coli
tgcgtctttatctcccgatctccgg

SEQ ID NO: 102787 - DNA, 25 bp, E. coli
tgcgtctttatcacccgatctccgg

SEQ ID NO: 102788 - DNA, 25 bp, E. coli
tcccgctggatatcgtctatgaaga

SEQ ID NO: 102789 - DNA, 25 bp, E. coli
gttttgaaccgctggatatcccgct

SEQ ID NO: 102790 - DNA, 25 bp, E. coli
gttttgaaccgcaggatatcccgct

SEQ ID NO: 102791 - DNA, 25 bp, E. coli
gtctggaaactgcacgtacgcacca

SEQ ID NO: 102792 - DNA, 25 bp, E. coli
gtctggaaactggacgtacgcacca

SEQ ID NO: 102793 - DNA, 25 bp, E. coli
ggcatgcgcctattccacaagatat

SEQ ID NO: 102794 - DNA, 25 bp, E. coli
ggcaaaaaccgtaccggctcagacg

SEQ ID NO: 102795 - DNA, 25 bp, E. coli
ggcaaaaaccgttccggctcagacg

SEQ ID NO: 102796 - DNA, 25 bp, E. coli
ggcatgcgcctaatccacaagatat

SEQ ID NO: 102797 - DNA, 25 bp, E. coli
tagaaagtcaaggtgttcaggcgtt

SEQ ID NO: 102798 - DNA, 25 bp, E. coli
tagaaagtcaagctgttcaggcgtt

SEQ ID NO: 102799 - DNA, 25 bp, E. coli
tatactttacacttaaggaagaggg

SEQ ID NO: 102800 - DNA, 25 bp, E. coli
tatactttacacataaggaagaggg

SEQ ID NO: 102801 - DNA, 25 bp, E. coli
tgttacaacccacaaagttccggag

SEQ ID NO: 102802 - DNA, 25 bp, E. coli
tgttacaacccagaaagttccggag

SEQ ID NO: 102803 - DNA, 25 bp, E. coli
tcctgagtgtgtacataactggcgc

SEQ ID NO: 102804 - DNA, 25 bp, E. coli
tcctgagtgtgttcataactggcgc

SEQ ID NO: 102805 - DNA, 25 bp, E. coli
tgcggccccgctagacaaaaaactg

SEQ ID NO: 102806 - DNA, 25 bp, E. coli
tgcggccccgcttgacaaaaaactg

SEQ ID NO: 102807 - DNA, 25 bp, E. coli
gcctgagtggacaattagaaagtca

SEQ ID NO: 102808 - DNA, 25 bp, E. coli
gcccgcacataacccactgggtgtt

SEQ ID NO: 102809 - DNA, 25 bp, E. coli
gcccgcacataagccactgggtgtt

SEQ ID NO: 102810 - DNA, 25 bp, E. coli
gcctgagtggactattagaaagtca

SEQ ID NO: 102811 - DNA, 25 bp, E. coli
gcgtagtttactggttgcggccccg

SEQ ID NO: 102812 - DNA, 25 bp, E. coli
gcgtagtttactcgttgcggccccg

SEQ ID NO: 102813 - DNA, 25 bp, E. coli
cccactgggtgttgtctatacttta

SEQ ID NO: 102814 - DNA, 25 bp, E. coli
cccactgggtgtagtctatacttta

SEQ ID NO: 102815 - DNA, 25 bp, E. coli
ggttgtaattgtgatcacgcccgca

SEQ ID NO: 102816 - DNA, 25 bp, E. coli
ggttgtaattgtcatcacgcccgca

SEQ ID NO: 102817 - DNA, 25 bp, E. coli
taacgtaataattgcctgagtggac

SEQ ID NO: 102818 - DNA, 25 bp, E. coli
taacgtaataatagcctgagtggac

SEQ ID NO: 102819 - DNA, 25 bp, E. coli
caatgcctgttggtgtggcgttact

SEQ ID NO: 102820 - DNA, 25 bp, E. coli
caatgcctgttgctgtggcgttact

SEQ ID NO: 102821 - DNA, 25 bp, E. coli
cagagttcgacatagccgttgcggc

SEQ ID NO: 102822 - DNA, 25 bp, E. coli
cagagttcgacaaagccgttgcggc

SEQ ID NO: 102823 - DNA, 25 bp, E. coli
aaatcggctctatatccctggtcag

SEQ ID NO: 102824 - DNA, 25 bp, E. coli
aaatcggctctaaatccctggtcag

SEQ ID NO: 102825 - DNA, 25 bp, E. coli
tgttaaagcaactagagaactggtc

SEQ ID NO: 102826 - DNA, 25 bp, E. coli
tggtcaatgcagacccctttctggg

SEQ ID NO: 102827 - DNA, 25 bp, E. coli
tggtcaatgcagtcccctttctggg

SEQ ID NO: 102828 - DNA, 25 bp, E. coli
tgttaaagcaacaagagaactggtc

SEQ ID NO: 102829 - DNA, 25 bp, E. coli
tgactgctaatgctgcacgcgctgt

SEQ ID NO: 102830 - DNA, 25 bp, E. coli
tgactgctaatggtgcacgcgctgt

SEQ ID NO: 102831 - DNA, 25 bp, E. coli
tctggacaacgaaccttgacgatac

SEQ ID NO: 102832 - DNA, 25 bp, E. coli
tctggacaacgatccttgacgatac

SEQ ID NO: 102833 - DNA, 25 bp, E. coli
gactttctggcgagccgcattgcag

SEQ ID NO: 102834 - DNA, 25 bp, E. coli
gactttctggcgtgccgcattgcag

SEQ ID NO: 102835 - DNA, 25 bp, E. coli
ccctttctgggacgcagtgactcag

SEQ ID NO: 102836 - DNA, 25 bp, E. coli
ccctttctgggaggcagtgactcag

SEQ ID NO: 102837 - DNA, 25 bp, E. coli
tgacgataccccacattaaggcact

SEQ ID NO: 102838 - DNA, 25 bp, E. coli
tgacgatacccctcattaaggcact

SEQ ID NO: 102839 - DNA, 25 bp, E. coli
tcagcccgatttggcgttaagccgg

SEQ ID NO: 102840 - DNA, 25 bp, E. coli
tcagcccgatttcgcgttaagccgg

SEQ ID NO: 102841 - DNA, 25 bp, E. coli
caaaagtgatattgcctgatgcgct

SEQ ID NO: 102842 - DNA, 25 bp, E. coli
caaaagtgatatagcctgatgcgct

SEQ ID NO: 102843 - DNA, 25 bp, E. coli
atttcaaaagtgatattgcctgatg

SEQ ID NO: 102844 - DNA, 25 bp, E. coli
atttcaaaagtgttattgcctgatg

SEQ ID NO: 102845 - DNA, 25 bp, E. coli
tttcaaaagtgatattgcctgatgc

SEQ ID NO: 102846 - DNA, 25 bp, E. coli
ttcaaaagtgatattgcctgatgcg

SEQ ID NO: 102847 - DNA, 25 bp, E. coli
ttgatttcaaaactgatattgcctg

SEQ ID NO: 102848 - DNA, 25 bp, E. coli
ttcaaaagtgattttgcctgatgcg

SEQ ID NO: 102849 - DNA, 25 bp, E. coli
ttgatttcaaaagtgatattgcctg

SEQ ID NO: 102850 - DNA, 25 bp, E. coli
tttcaaaagtgaaattgcctgatgc

SEQ ID NO: 102851 - DNA, 25 bp, E. coli
tgatttcaaaagtgatattgcctga

SEQ ID NO: 102852 - DNA, 25 bp, E. coli
tgatttcaaaagagatattgcctga

SEQ ID NO: 102853 - DNA, 25 bp, E. coli
gatttcaaaagtcatattgcctgat

SEQ ID NO: 102854 - DNA, 25 bp, E. coli
gatttcaaaagtgatattgcctgat

SEQ ID NO: 102855 - DNA, 25 bp, E. coli
tcaaaagtgatattgcctgatgcgc

SEQ ID NO: 102856 - DNA, 25 bp, E. coli
tcaaaagtgataatgcctgatgcgc

SEQ ID NO: 102857 - DNA, 25 bp, E. coli
cccgttccggatacgctttcagagt

SEQ ID NO: 102858 - DNA, 25 bp, E. coli
cccgttccggattcgctttcagagt

SEQ ID NO: 102859 - DNA, 25 bp, E. coli
tgctgaccgcactttgcgtgccggt

SEQ ID NO: 102860 - DNA, 25 bp, E. coli
tgctgaccgcacattgcgtgccggt

SEQ ID NO: 102861 - DNA, 25 bp, E. coli
tccgcgacctgtttgataaactgcc

SEQ ID NO: 102862 - DNA, 25 bp, E. coli
tccgcgacctgtatgataaactgcc

SEQ ID NO: 102863 - DNA, 25 bp, E. coli
gccgattctgcataaacagttcccg

SEQ ID NO: 102864 - DNA, 25 bp, E. coli
gccgattctgcaaaaacagttcccg

SEQ ID NO: 102865 - DNA, 25 bp, E. coli
gcgtttctgaaacagccggagccgc

SEQ ID NO: 102866 - DNA, 25 bp, E. coli
gctttcagagtaagcgtttgccgga

SEQ ID NO: 102867 - DNA, 25 bp, E. coli
gctttcagagtatgcgtttgccgga

SEQ ID NO: 102868 - DNA, 25 bp, E. coli
gcgtttctgaaagagccggagccgc

SEQ ID NO: 102869 - DNA, 25 bp, E. coli
gaacaaggcgaaactgcgccggaag

SEQ ID NO: 102870 - DNA, 25 bp, E. coli
gaacaaggcgaatctgcgccggaag

SEQ ID NO: 102871 - DNA, 25 bp, E. coli
cgtttcccggttactgtggcgctgg

SEQ ID NO: 102872 - DNA, 25 bp, E. coli
cgtttcccggtttctgtggcgctgg

SEQ ID NO: 102873 - DNA, 25 bp, E. coli
ggcgctgcgtgatgttggtaaatta

SEQ ID NO: 102874 - DNA, 25 bp, E. coli
ggcgctgcgtgaagttggtaaatta

SEQ ID NO: 102875 - DNA, 25 bp, E. coli
taagcaagtattcaacatgccgaca

SEQ ID NO: 102876 - DNA, 25 bp, E. coli
taagcaagtattgaacatgccgaca

SEQ ID NO: 102877 - DNA, 25 bp, E. coli
gaccgaagtggtgaagtgtatctcc

SEQ ID NO: 102878 - DNA, 25 bp, E. coli
gaccgaagtggtcaagtgtatctcc

SEQ ID NO: 102879 - DNA, 25 bp, E. coli
caccacctgttggaatgttgcgcta

SEQ ID NO: 102880 - DNA, 25 bp, E. coli
caccacctgttgcaatgttgcgcta

SEQ ID NO: 102881 - DNA, 25 bp, E. coli
taaatgcataaaggctaaacttgcg

SEQ ID NO: 102882 - DNA, 25 bp, E. coli
taaatgcataaacgctaaacttgcg

SEQ ID NO: 102883 - DNA, 25 bp, E. coli
tattgagaaacaagcctgcgtcacg

SEQ ID NO: 102884 - DNA, 25 bp, E. coli
tattgagaaacatgcctgcgtcacg

SEQ ID NO: 102885 - DNA, 25 bp, E. coli
tgttgcgctaatgcataagcgactg

SEQ ID NO: 102886 - DNA, 25 bp, E. coli
tgttgcgctaatccataagcgactg

SEQ ID NO: 102887 - DNA, 25 bp, E. coli
tgcgtgactacagattcttgagatg

SEQ ID NO: 102888 - DNA, 25 bp, E. coli
tgcgtgactacacattcttgagatg

SEQ ID NO: 102889 - DNA, 25 bp, E. coli
gcgtcacggcatccaaattctgctt

SEQ ID NO: 102890 - DNA, 25 bp, E. coli
gcgtcacggcatgcaaattctgctt

SEQ ID NO: 102891 - DNA, 25 bp, E. coli
gaatttttatgctaacagtcagccc

SEQ ID NO: 102892 - DNA, 25 bp, E. coli
gaacggtagggtatattgtcaccac

SEQ ID NO: 102893 - DNA, 25 bp, E. coli
gaacggtagggtttattgtcaccac

SEQ ID NO: 102894 - DNA, 25 bp, E. coli
gaatttttatgcaaacagtcagccc

SEQ ID NO: 102895 - DNA, 25 bp, E. coli
ccctgaagaaggctgaaataatgtt

SEQ ID NO: 102896 - DNA, 25 bp, E. coli
ccctgaagaagggtgaaataatgtt

SEQ ID NO: 102897 - DNA, 25 bp, E. coli
taagttaggttcgtgattacggcaa

SEQ ID NO: 102898 - DNA, 25 bp, E. coli
taagttaggttcctgattacggcaa

SEQ ID NO: 102899 - DNA, 25 bp, E. coli
gagatgtggtcattgtaaacggcaa

SEQ ID NO: 102900 - DNA, 25 bp, E. coli
gagatgtggtcaatgtaaacggcaa

SEQ ID NO: 102901 - DNA, 25 bp, E. coli
caacagtggttgagcgacgtacaaa

SEQ ID NO: 102902 - DNA, 25 bp, E. coli
caaatccggcctggaagagtgcgaa

SEQ ID NO: 102903 - DNA, 25 bp, E. coli
caaagcatgttcgagtacaccggca

SEQ ID NO: 102904 - DNA, 25 bp, E. coli
caacagtggttgtgcgacgtacaaa

SEQ ID NO: 102905 - DNA, 25 bp, E. coli
caaagcatgttccagtacaccggca

SEQ ID NO: 102906 - DNA, 25 bp, E. coli
caaatccggcctcgaagagtgcgaa

SEQ ID NO: 102907 - DNA, 25 bp, E. coli
agttcgtttgaactacagcgcgcca

SEQ ID NO: 102908 - DNA, 25 bp, E. coli
agttcgtttgaagtacagcgcgcca

SEQ ID NO: 102909 - DNA, 25 bp, E. coli
aaaaatgaaatctgcgccgacggcg

SEQ ID NO: 102910 - DNA, 25 bp, E. coli
aaaaatgaaatcagcgccgacggcg

SEQ ID NO: 102911 - DNA, 25 bp, E. coli
tatgcgtcttaagcttgcccaggcg

SEQ ID NO: 102912 - DNA, 25 bp, E. coli
tatgcgtcttaaccttgcccaggcg

SEQ ID NO: 102913 - DNA, 25 bp, E. coli
tatatcgaccgtatccgtgccaaag

SEQ ID NO: 102914 - DNA, 25 bp, E. coli
tatatcgaccgtttccgtgccaaag

SEQ ID NO: 102915 - DNA, 25 bp, E. coli
tttccgggaagctggcaactggcgt

SEQ ID NO: 102916 - DNA, 25 bp, E. coli
tttccgggaagcaggcaactggcgt

SEQ ID NO: 102917 - DNA, 25 bp, E. coli
gcacggcctcggattcagcaatgaa

SEQ ID NO: 102918 - DNA, 25 bp, E. coli
gaatatgtcattgacggcgaccgtg

SEQ ID NO: 102919 - DNA, 25 bp, E. coli
gaatatgtcattcacggcgaccgtg

SEQ ID NO: 102920 - DNA, 25 bp, E. coli
gcacggcctcggtttcagcaatgaa

SEQ ID NO: 102921 - DNA, 25 bp, E. coli
gttacaaattcgtcgcggcgtgcgc

SEQ ID NO: 102922 - DNA, 25 bp, E. coli
gttacaaattcgacgcggcgtgcgc

SEQ ID NO: 102923 - DNA, 25 bp, E. coli
taaaacgccgttaggacgctatctg

SEQ ID NO: 102924 - DNA, 25 bp, E. coli
taaaacgccgtttggacgctatctg

SEQ ID NO: 102925 - DNA, 25 bp, E. coli
aactgctcgactcgctgttgctgga

SEQ ID NO: 102926 - DNA, 25 bp, E. coli
aactgctcgactggctgttgctgga

SEQ ID NO: 102927 - DNA, 25 bp, E. coli
tttgtcgagcagaatgaaatccccg

SEQ ID NO: 102928 - DNA, 25 bp, E. coli
ttcacatcatcgacattaacccggg

SEQ ID NO: 102929 - DNA, 25 bp, E. coli
tttgtcgagcagtatgaaatccccg

SEQ ID NO: 102930 - DNA, 25 bp, E. coli
ttcacatcatcgtcattaacccggg

SEQ ID NO: 102931 - DNA, 25 bp, E. coli
tgttatgtgccgttggtgaaccgtg

SEQ ID NO: 102932 - DNA, 25 bp, E. coli
tgttatgtgccgatggtgaaccgtg

SEQ ID NO: 102933 - DNA, 25 bp, E. coli
tgctgccgaaagagtctcgttactg

SEQ ID NO: 102934 - DNA, 25 bp, E. coli
tgctgccgaaagtgtctcgttactg

SEQ ID NO: 102935 - DNA, 25 bp, E. coli
tcctgtgtcaacgttaagcgggccg

SEQ ID NO: 102936 - DNA, 25 bp, E. coli
tcctgtgtcaaccttaagcgggccg

SEQ ID NO: 102937 - DNA, 25 bp, E. coli
tgaaccgtggcttgccggtcgtacc

SEQ ID NO: 102938 - DNA, 25 bp, E. coli
tgaaccgtggctagccggtcgtacc

SEQ ID NO: 102939 - DNA, 25 bp, E. coli
gacaaaacgttttgaacagcaggga

SEQ ID NO: 102940 - DNA, 25 bp, E. coli
gacaaaacgtttagaacagcaggga

SEQ ID NO: 102941 - DNA, 25 bp, E. coli
ctttattgagattggccgtgatgcc

SEQ ID NO: 102942 - DNA, 25 bp, E. coli
ctttattgagataggccgtgatgcc

SEQ ID NO: 102943 - DNA, 25 bp, E. coli
ggtcgtaccgtcgttcctgtgtcaa

SEQ ID NO: 102944 - DNA, 25 bp, E. coli
ggtcgtaccgtccttcctgtgtcaa

SEQ ID NO: 102945 - DNA, 25 bp, E. coli
cagacaccatggacacaacgttgag

SEQ ID NO: 102946 - DNA, 25 bp, E. coli
catctcttatgtacgccttagtgcc

SEQ ID NO: 102947 - DNA, 25 bp, E. coli
catctcttatgttcgccttagtgcc

SEQ ID NO: 102948 - DNA, 25 bp, E. coli
cagacaccatggtcacaacgttgag

SEQ ID NO: 102949 - DNA, 25 bp, E. coli
tacggtgcttatcgtccactgacag

SEQ ID NO: 102950 - DNA, 25 bp, E. coli
taaactccggaaagacgcagagccg

SEQ ID NO: 102951 - DNA, 25 bp, E. coli
taaactccggaatgacgcagagccg

SEQ ID NO: 102952 - DNA, 25 bp, E. coli
tacggtgcttatggtccactgacag

SEQ ID NO: 102953 - DNA, 25 bp, E. coli
actgacagatgtcgcttatgcctca

SEQ ID NO: 102954 - DNA, 25 bp, E. coli
actgacagatgtggcttatgcctca

SEQ ID NO: 102955 - DNA, 25 bp, E. coli
gccttagtgcctcataaactccgga

SEQ ID NO: 102956 - DNA, 25 bp, E. coli
gccttagtgcctgataaactccgga

SEQ ID NO: 102957 - DNA, 25 bp, E. coli
gcttatgcctcatcagacaccatgg

SEQ ID NO: 102958 - DNA, 25 bp, E. coli
gcttatgcctcaacagacaccatgg

SEQ ID NO: 102959 - DNA, 25 bp, E. coli
gaagcacccacttgttgtcatacag

SEQ ID NO: 102960 - DNA, 25 bp, E. coli
gaagcacccactagttgtcatacag

SEQ ID NO: 102961 - DNA, 25 bp, E. coli
gacacaacgttgagtgaagcaccca

SEQ ID NO: 102962 - DNA, 25 bp, E. coli
gacacaacgttgtgtgaagcaccca

SEQ ID NO: 102963 - DNA, 25 bp, E. coli
gtagatgctcattccatctcttatg

SEQ ID NO: 102964 - DNA, 25 bp, E. coli
gtagatgctcataccatctcttatg

SEQ ID NO: 102965 - DNA, 25 bp, E. coli
gacgcagagccgtttacggtgctta

SEQ ID NO: 102966 - DNA, 25 bp, E. coli
gacgcagagccgattacggtgctta

SEQ ID NO: 102967 - DNA, 25 bp, E. coli
cagttcaggtggttgattcctcaca

SEQ ID NO: 102968 - DNA, 25 bp, E. coli
catcggcctggcatgatgttgcgct

SEQ ID NO: 102969 - DNA, 25 bp, E. coli
catcggcctggcttgatgttgcgct

SEQ ID NO: 102970 - DNA, 25 bp, E. coli
cagttcaggtggatgattcctcaca

SEQ ID NO: 102971 - DNA, 25 bp, E. coli
ttgactaattgtgcggtgggaacgt

SEQ ID NO: 102972 - DNA, 25 bp, E. coli
ttgactaattgtccggtgggaacgt

SEQ ID NO: 102973 - DNA, 25 bp, E. coli
gcgcacttcccgatacaggtcagag

SEQ ID NO: 102974 - DNA, 25 bp, E. coli
gcgcacttcccgttacaggtcagag

SEQ ID NO: 102975 - DNA, 25 bp, E. coli
gctacaggatgagagtggcaacaca

SEQ ID NO: 102976 - DNA, 25 bp, E. coli
gctacaggatgacagtggcaacaca

SEQ ID NO: 102977 - DNA, 25 bp, E. coli
gcaacacattgaatactggcgcaac

SEQ ID NO: 102978 - DNA, 25 bp, E. coli
gcaacacattgattactggcgcaac

SEQ ID NO: 102979 - DNA, 25 bp, E. coli
gagccactcagggaaccattcaggc

SEQ ID NO: 102980 - DNA, 25 bp, E. coli
gagccactcaggcaaccattcaggc

SEQ ID NO: 102981 - DNA, 25 bp, E. coli
cattcaggcagtgattagcatcacc

SEQ ID NO: 102982 - DNA, 25 bp, E. coli
ctggcgcaaccaaaacagttcaggt

SEQ ID NO: 102983 - DNA, 25 bp, E. coli
ctggcgcaaccataacagttcaggt

SEQ ID NO: 102984 - DNA, 25 bp, E. coli
cattcaggcagtcattagcatcacc

SEQ ID NO: 102985 - DNA, 25 bp, E. coli
gggaccgcgcaaaacatccagttag

SEQ ID NO: 102986 - DNA, 25 bp, E. coli
gggaccgcgcaatacatccagttag

SEQ ID NO: 102987 - DNA, 25 bp, E. coli
gggcagccgacactaccggatatta

SEQ ID NO: 102988 - DNA, 25 bp, E. coli
gggcagccgacagtaccggatatta

SEQ ID NO: 102989 - DNA, 25 bp, E. coli
tacacacaaaataacgtttacgacg

SEQ ID NO: 102990 - DNA, 25 bp, E. coli
tacacacaaaattacgtttacgacg

SEQ ID NO: 102991 - DNA, 25 bp, E. coli
aaactggcatctacgtcgccggtta

SEQ ID NO: 102992 - DNA, 25 bp, E. coli
aaactggcatcttcgtcgccggtta

SEQ ID NO: 102993 - DNA, 25 bp, E. coli
tttaccagtcgctacaacacctaca

SEQ ID NO: 102994 - DNA, 25 bp, E. coli
tttaccagtcgcaacaacacctaca

SEQ ID NO: 102995 - DNA, 25 bp, E. coli
gcaacaagctcatcaaagcgcaagt

SEQ ID NO: 102996 - DNA, 25 bp, E. coli
gcaacaagctcaacaaagcgcaagt

SEQ ID NO: 102997 - DNA, 25 bp, E. coli
cgcaagttgaaagcaaaactggcat

SEQ ID NO: 102998 - DNA, 25 bp, E. coli
cgcaagttgaaaccaaaactggcat

SEQ ID NO: 102999 - DNA, 25 bp, E. coli
cgtcgccggttatcattacgatgta

SEQ ID NO: 103000 - DNA, 25 bp, E. coli
cgtcgccggttaacattacgatgta

SEQ ID NO: 103001 - DNA, 25 bp, E. coli
cattacgatgtagttggcagatgca

SEQ ID NO: 103002 - DNA, 25 bp, E. coli
cattacgatgtacttggcagatgca

SEQ ID NO: 103003 - DNA, 25 bp, E. coli
gtttacgacgactgcaacaagctca

SEQ ID NO: 103004 - DNA, 25 bp, E. coli
gtttacgacgacagcaacaagctca

SEQ ID NO: 103005 - DNA, 25 bp, E. coli
gtcgcaagagaatagatgaaaatat

SEQ ID NO: 103006 - DNA, 25 bp, E. coli
gtcgcaagagaaaagatgaaaatat

SEQ ID NO: 103007 - DNA, 25 bp, E. coli
ggcagatgcatctaaagtcgcaaga

SEQ ID NO: 103008 - DNA, 25 bp, E. coli
ggcagatgcatcaaaagtcgcaaga

SEQ ID NO: 103009 - DNA, 25 bp, E. coli
gagtagaaaaactttaccagtcgct

SEQ ID NO: 103010 - DNA, 25 bp, E. coli
gagtagaaaaacattaccagtcgct

SEQ ID NO: 103011 - DNA, 25 bp, E. coli
caaagtttcccgagccaacagggag

SEQ ID NO: 103012 - DNA, 25 bp, E. coli
caaagtttcccgtgccaacagggag

SEQ ID NO: 103013 - DNA, 25 bp, E. coli
actgagagcacatagtttcccgtgc

SEQ ID NO: 103014 - DNA, 25 bp, E. coli
actgagagcacaaagtttcccgtgc

SEQ ID NO: 103015 - DNA, 25 bp, E. coli
tcctcttcccggacccctatgccgg

SEQ ID NO: 103016 - DNA, 25 bp, E. coli
tcctcttcccggtcccctatgccgg

SEQ ID NO: 103017 - DNA, 25 bp, E. coli
tctggagacggcagactatcctctt

SEQ ID NO: 103018 - DNA, 25 bp, E. coli
tctggagacggctgactatcctctt

SEQ ID NO: 103019 - DNA, 25 bp, E. coli
gccaacagggagagttataacggtt

SEQ ID NO: 103020 - DNA, 25 bp, E. coli
gccaacagggagtgttataacggtt

SEQ ID NO: 103021 - DNA, 25 bp, E. coli
gacggcagactaacctcttcccggt

SEQ ID NO: 103022 - DNA, 25 bp, E. coli
gacggcagactatcctcttcccggt

SEQ ID NO: 103023 - DNA, 25 bp, E. coli
cccgtgccaacacggagtgttataa

SEQ ID NO: 103024 - DNA, 25 bp, E. coli
cccgtgccaacagggagtgttataa

SEQ ID NO: 103025 - DNA, 25 bp, E. coli
gtttcccgtgcctacagggagtgtt

SEQ ID NO: 103026 - DNA, 25 bp, E. coli
gtttcccgtgccaacagggagtgtt

SEQ ID NO: 103027 - DNA, 25 bp, E. coli
ggtttattagtctggagacggcaga

SEQ ID NO: 103028 - DNA, 25 bp, E. coli
ggtttattagtcaggagacggcaga

SEQ ID NO: 103029 - DNA, 25 bp, E. coli
taacggtttatttgtctggagacgg

SEQ ID NO: 103030 - DNA, 25 bp, E. coli
taacggtttattagtctggagacgg

SEQ ID NO: 103031 - DNA, 25 bp, E. coli
gagagcacaaagattcccgtgccaa

SEQ ID NO: 103032 - DNA, 25 bp, E. coli
gagagcacaaagtttcccgtgccaa

SEQ ID NO: 103033 - DNA, 25 bp, E. coli
cacctttacatataaaagcgtggac

SEQ ID NO: 103034 - DNA, 25 bp, E. coli
cacctttacataaaaaagcgtggac

SEQ ID NO: 103035 - DNA, 25 bp, E. coli
tacagagaattttactcactaaagt

SEQ ID NO: 103036 - DNA, 25 bp, E. coli
tacagagaatttaactcactaaagt

SEQ ID NO: 103037 - DNA, 25 bp, E. coli
catataaaagcgaggacaaaaaaca

SEQ ID NO: 103038 - DNA, 25 bp, E. coli
catataaaagcgtggacaaaaaaca

SEQ ID NO: 103039 - DNA, 25 bp, E. coli
tattggacgagcttacagaaaaagc

SEQ ID NO: 103040 - DNA, 25 bp, E. coli
tattggacgagcatacagaaaaagc

SEQ ID NO: 103041 - DNA, 25 bp, E. coli
gccaactagctgtcaaatatacaga

SEQ ID NO: 103042 - DNA, 25 bp, E. coli
gccaactagctgacaaatatacaga

SEQ ID NO: 103043 - DNA, 25 bp, E. coli
gcatacagaaaatgcaaatcacctt

SEQ ID NO: 103044 - DNA, 25 bp, E. coli
gcatacagaaaaagcaaatcacctt

SEQ ID NO: 103045 - DNA, 25 bp, E. coli
gaatattgccaattgttataaggca

SEQ ID NO: 103046 - DNA, 25 bp, E. coli
gaatattgccaaatgttataaggca

SEQ ID NO: 103047 - DNA, 25 bp, E. coli
gaaaattattatattggacgagcat

SEQ ID NO: 103048 - DNA, 25 bp, E. coli
gaaaattattattttggacgagcat

SEQ ID NO: 103049 - DNA, 25 bp, E. coli
ggcatttaaaatgagccaactagct

SEQ ID NO: 103050 - DNA, 25 bp, E. coli
ggcatttaaaatcagccaactagct

SEQ ID NO: 103051 - DNA, 25 bp, E. coli
taattgccaaataagaatattgcca

SEQ ID NO: 103052 - DNA, 25 bp, E. coli
taattgccaaattagaatattgcca

SEQ ID NO: 103053 - DNA, 25 bp, E. coli
taactccttaattgcgtttggtttg

SEQ ID NO: 103054 - DNA, 25 bp, E. coli
taactccttaatagcgtttggtttg

SEQ ID NO: 103055 - DNA, 25 bp, E. coli
tagttcgctgattagtgaagaagcc

SEQ ID NO: 103056 - DNA, 25 bp, E. coli
tagttcgctgataagtgaagaagcc

SEQ ID NO: 103057 - DNA, 25 bp, E. coli
ttcgctgataagtgaagaagccggt

SEQ ID NO: 103058 - DNA, 25 bp, E. coli
ttcgctgataagagaagaagccggt

SEQ ID NO: 103059 - DNA, 25 bp, E. coli
tgcacatccagccagtgtggacgag

SEQ ID NO: 103060 - DNA, 25 bp, E. coli
tgcacatccagcgagtgtggacgag

SEQ ID NO: 103061 - DNA, 25 bp, E. coli
tcctgccagcgctttggcggcccgg

SEQ ID NO: 103062 - DNA, 25 bp, E. coli
tcctgccagcgcattggcggcccgg

SEQ ID NO: 103063 - DNA, 25 bp, E. coli
gcccggcgtgaaccagtgttttgcc

SEQ ID NO: 103064 - DNA, 25 bp, E. coli
gcccggcgtgaagcagtgttttgcc

SEQ ID NO: 103065 - DNA, 25 bp, E. coli
gcagcattggcttgcgccactgatg

SEQ ID NO: 103066 - DNA, 25 bp, E. coli
gcagcattggctagcgccactgatg

SEQ ID NO: 103067 - DNA, 25 bp, E. coli
ctgataagtgaacaagccggttgca

SEQ ID NO: 103068 - DNA, 25 bp, E. coli
ctgataagtgaagaagccggttgca

SEQ ID NO: 103069 - DNA, 25 bp, E. coli
gataagtgaagaagccggttgcaca

SEQ ID NO: 103070 - DNA, 25 bp, E. coli
gataagtgaagatgccggttgcaca

SEQ ID NO: 103071 - DNA, 25 bp, E. coli
gtgaagaagccgcttgcacatccag

SEQ ID NO: 103072 - DNA, 25 bp, E. coli
gtgaagaagccggttgcacatccag

SEQ ID NO: 103073 - DNA, 25 bp, E. coli
tggcttgcgccagtgatgtaaacat

SEQ ID NO: 103074 - DNA, 25 bp, E. coli
tggcttgcgccactgatgtaaacat

SEQ ID NO: 103075 - DNA, 25 bp, E. coli
taaccgcagcataggcttgcgccac

SEQ ID NO: 103076 - DNA, 25 bp, E. coli
taaccgcagcattggcttgcgccac

SEQ ID NO: 103077 - DNA, 25 bp, E. coli
caaagctattgcgacagagagagag

SEQ ID NO: 103078 - DNA, 25 bp, E. coli
caaagctattgccacagagagagag

SEQ ID NO: 103079 - DNA, 25 bp, E. coli
tactaccggtgaacctgtttgccag

SEQ ID NO: 103080 - DNA, 25 bp, E. coli
tactaccggtgatcctgtttgccag

SEQ ID NO: 103081 - DNA, 25 bp, E. coli
taggaagcgtggacagaggtacaac

SEQ ID NO: 103082 - DNA, 25 bp, E. coli
taggaagcgtggtcagaggtacaac

SEQ ID NO: 103083 - DNA, 25 bp, E. coli
ttagaaatctcccacagtgacccgc

SEQ ID NO: 103084 - DNA, 25 bp, E. coli
ttagaaatctccgacagtgacccgc

SEQ ID NO: 103085 - DNA, 25 bp, E. coli
tgttagtacccctgcagattttcgg

SEQ ID NO: 103086 - DNA, 25 bp, E. coli
tgttagtaccccagcagattttcgg

SEQ ID NO: 103087 - DNA, 25 bp, E. coli
tgtagcaccgcttccattagggagc

SEQ ID NO: 103088 - DNA, 25 bp, E. coli
tgtagcaccgctaccattagggagc

SEQ ID NO: 103089 - DNA, 25 bp, E. coli
tcttagtggagatatccctgctcgg

SEQ ID NO: 103090 - DNA, 25 bp, E. coli
tcttagtggagaaatccctgctcgg

SEQ ID NO: 103091 - DNA, 25 bp, E. coli
tcatcaacacatggaggtcagtctg

SEQ ID NO: 103092 - DNA, 25 bp, E. coli
tcatcaacacatcgaggtcagtctg

SEQ ID NO: 103093 - DNA, 25 bp, E. coli
gaacatcatagacacgccaggacat

SEQ ID NO: 103094 - DNA, 25 bp, E. coli
gaacatcatagagacgccaggacat

SEQ ID NO: 103095 - DNA, 25 bp, E. coli
ggcgataacctcatttcagtggaaa

SEQ ID NO: 103096 - DNA, 25 bp, E. coli
ggcgataacctcttttcagtggaaa

SEQ ID NO: 103097 - DNA, 25 bp, E. coli
gatggcgtacaagcacaaactcgta

SEQ ID NO: 103098 - DNA, 25 bp, E. coli
gatggcgtacaaccacaaactcgta

SEQ ID NO: 103099 - DNA, 25 bp, E. coli
aattccagccgctgatctgtgtcag

SEQ ID NO: 103100 - DNA, 25 bp, E. coli
aattccagccgcagatctgtgtcag

SEQ ID NO: 103101 - DNA, 25 bp, E. coli
ttccagccgcagtcctgtgtcagcg

SEQ ID NO: 103102 - DNA, 25 bp, E. coli
ttccagccgcagacctgtgtcagcg

SEQ ID NO: 103103 - DNA, 25 bp, E. coli
ttatccggcctaggtagagcactga

SEQ ID NO: 103104 - DNA, 25 bp, E. coli
ttatccggcctacgtagagcactga

SEQ ID NO: 103105 - DNA, 25 bp, E. coli
tgatctgtgtcagcggctaccgtga

SEQ ID NO: 103106 - DNA, 25 bp, E. coli
tgtctgccagctgtagtttatgccg

SEQ ID NO: 103107 - DNA, 25 bp, E. coli
tgatctgtgtcaccggctaccgtga

SEQ ID NO: 103108 - DNA, 25 bp, E. coli
tgtctgccagctctagtttatgccg

SEQ ID NO: 103109 - DNA, 25 bp, E. coli
gcatcaggcaataccagccgcagac

SEQ ID NO: 103110 - DNA, 25 bp, E. coli
gcatcaggcaattccagccgcagac

SEQ ID NO: 103111 - DNA, 25 bp, E. coli
cgcatcaggcaattccagccgctga

SEQ ID NO: 103112 - DNA, 25 bp, E. coli
cgcatcaggcaaatccagccgctga

SEQ ID NO: 103113 - DNA, 25 bp, E. coli
ctgccagctgtactttatgccggat

SEQ ID NO: 103114 - DNA, 25 bp, E. coli
ctgccagctgtagtttatgccggat

SEQ ID NO: 103115 - DNA, 25 bp, E. coli
ggcctacgtagagcactgaactcgt

SEQ ID NO: 103116 - DNA, 25 bp, E. coli
ggcctacgtagaccactgaactcgt

SEQ ID NO: 103117 - DNA, 25 bp, E. coli
ggctaccgtgatacattcccgccaa

SEQ ID NO: 103118 - DNA, 25 bp, E. coli
ggctaccgtgattcattcccgccaa

SEQ ID NO: 103119 - DNA, 25 bp, E. coli
gagcactgaactcgtaggcctgata

SEQ ID NO: 103120 - DNA, 25 bp, E. coli
gagcactgaactggtaggcctgata

SEQ ID NO: 103121 - DNA, 25 bp, E. coli
tacttatcgcaaatggcgtctggac

SEQ ID NO: 103122 - DNA, 25 bp, E. coli
tacttatcgcaattggcgtctggac

SEQ ID NO: 103123 - DNA, 25 bp, E. coli
agggcggagctaggaccccatgatt

SEQ ID NO: 103124 - DNA, 25 bp, E. coli
agggcggagctacgaccccatgatt

SEQ ID NO: 103125 - DNA, 25 bp, E. coli
tatttggcctgactatgcgagcggc

SEQ ID NO: 103126 - DNA, 25 bp, E. coli
tatttggcctgagtatgcgagcggc

SEQ ID NO: 103127 - DNA, 25 bp, E. coli
tctgcgacggaaggccaagtaagta

SEQ ID NO: 103128 - DNA, 25 bp, E. coli
tctgcgacggaacgccaagtaagta

SEQ ID NO: 103129 - DNA, 25 bp, E. coli
gcccttatgatccaatctgcgacgg

SEQ ID NO: 103130 - DNA, 25 bp, E. coli
gcccttatgatcgaatctgcgacgg

SEQ ID NO: 103131 - DNA, 25 bp, E. coli
gctgaaggtgatagtagtgcatgct

SEQ ID NO: 103132 - DNA, 25 bp, E. coli
gctgaaggtgattgtagtgcatgct

SEQ ID NO: 103133 - DNA, 25 bp, E. coli
cccatgattgggtgcttatttggcc

SEQ ID NO: 103134 - DNA, 25 bp, E. coli
cccatgattgggagcttatttggcc

SEQ ID NO: 103135 - DNA, 25 bp, E. coli
ggccagacttggagtatcgccatct

SEQ ID NO: 103136 - DNA, 25 bp, E. coli
ggccagacttggtgtatcgccatct

SEQ ID NO: 103137 - DNA, 25 bp, E. coli
ggcaaacacatgtagttcatgctga

SEQ ID NO: 103138 - DNA, 25 bp, E. coli
ggcaaacacatgaagttcatgctga

SEQ ID NO: 103139 - DNA, 25 bp, E. coli
gacgaacagctatatctccaacccg

SEQ ID NO: 103140 - DNA, 25 bp, E. coli
gatgctaagaaattcgcggccagac

SEQ ID NO: 103141 - DNA, 25 bp, E. coli
gatgctaagaaaatcgcggccagac

SEQ ID NO: 103142 - DNA, 25 bp, E. coli
gacgaacagctaaatctccaacccg

SEQ ID NO: 103143 - DNA, 25 bp, E. coli
taaaccggcggtacagacagaagaa

SEQ ID NO: 103144 - DNA, 25 bp, E. coli
taaaccggcggttcagacagaagaa

SEQ ID NO: 103145 - DNA, 25 bp, E. coli
aaaccattacggcattctgctggcg

SEQ ID NO: 103146 - DNA, 25 bp, E. coli
aaactacagggtgtgctggtcagcc

SEQ ID NO: 103147 - DNA, 25 bp, E. coli
aaaccattacgggattctgctggcg

SEQ ID NO: 103148 - DNA, 25 bp, E. coli
aaactacagggtctgctggtcagcc

SEQ ID NO: 103149 - DNA, 25 bp, E. coli
tattgtttacggagagccgctttgc

SEQ ID NO: 103150 - DNA, 25 bp, E. coli
tattgtttacggtgagccgctttgc

SEQ ID NO: 103151 - DNA, 25 bp, E. coli
tatctcccggaaccggatgtggcaa

SEQ ID NO: 103152 - DNA, 25 bp, E. coli
tatctcccggaagcggatgtggcaa

SEQ ID NO: 103153 - DNA, 25 bp, E. coli
tatcacactgcttaaacctctggcg

SEQ ID NO: 103154 - DNA, 25 bp, E. coli
tatcacactgctaaaacctctggcg

SEQ ID NO: 103155 - DNA, 25 bp, E. coli
tttttaccgcgctgcttatcgggca

SEQ ID NO: 103156 - DNA, 25 bp, E. coli
ttatctccgggatcactggtgccac

SEQ ID NO: 103157 - DNA, 25 bp, E. coli
tttcagtcagacacagcagagtgcg

SEQ ID NO: 103158 - DNA, 25 bp, E. coli
tttcagtcagactcagcagagtgcg

SEQ ID NO: 103159 - DNA, 25 bp, E. coli
tttttaccgcgcagcttatcgggca

SEQ ID NO: 103160 - DNA, 25 bp, E. coli
ttatctccgggaacactggtgccac

SEQ ID NO: 103161 - DNA, 25 bp, E. coli
gattggcacggctctgtacggtctg

SEQ ID NO: 103162 - DNA, 25 bp, E. coli
gattggcacggcactgtacggtctg

SEQ ID NO: 103163 - DNA, 25 bp, E. coli
gatgtctgctatgacttccggatgg

SEQ ID NO: 103164 - DNA, 25 bp, E. coli
gatgtctgctatcacttccggatgg

SEQ ID NO: 103165 - DNA, 25 bp, E. coli
aatagcattcatgcacagccaggcg

SEQ ID NO: 103166 - DNA, 25 bp, E. coli
aatagcattcatccacagccaggcg

SEQ ID NO: 103167 - DNA, 25 bp, E. coli
cagtatgttttcgaatgaggcggga

SEQ ID NO: 103168 - DNA, 25 bp, E. coli
cagtatgttttccaatgaggcggga

SEQ ID NO: 103169 - DNA, 25 bp, E. coli
tattactggcgggtaacggcacaac

SEQ ID NO: 103170 - DNA, 25 bp, E. coli
tattactggcggctaacggcacaac

SEQ ID NO: 103171 - DNA, 25 bp, E. coli
tgtgcagtttcgctacatccgccag

SEQ ID NO: 103172 - DNA, 25 bp, E. coli
tgtgcagtttcggtacatccgccag

SEQ ID NO: 103173 - DNA, 25 bp, E. coli
tcttcggcgcagcttgttggttcac

SEQ ID NO: 103174 - DNA, 25 bp, E. coli
tcttcggcgcaggttgttggttcac

SEQ ID NO: 103175 - DNA, 25 bp, E. coli
ccagtgattatctacgccagcgtaa

SEQ ID NO: 103176 - DNA, 25 bp, E. coli
ccagtgattatcaacgccagcgtaa

SEQ ID NO: 103177 - DNA, 25 bp, E. coli
cggcgcggcgggttataccttaagc

SEQ ID NO: 103178 - DNA, 25 bp, E. coli
cggcgcggcgggatataccttaagc

SEQ ID NO: 103179 - DNA, 25 bp, E. coli
cttaagccaggccattactaacggt

SEQ ID NO: 103180 - DNA, 25 bp, E. coli
cttaagccaggcgattactaacggt

SEQ ID NO: 103181 - DNA, 25 bp, E. coli
tcagcttatccacaaggcgatgcgg

SEQ ID NO: 103182 - DNA, 25 bp, E. coli
taatgatttaccagctcttcggcgc

SEQ ID NO: 103183 - DNA, 25 bp, E. coli
tcagcttatccagaaggcgatgcgg

SEQ ID NO: 103184 - DNA, 25 bp, E. coli
taatgatttacctgctcttcggcgc

SEQ ID NO: 103185 - DNA, 25 bp, E. coli
gatggcgataatgtgggtactgacc

SEQ ID NO: 103186 - DNA, 25 bp, E. coli
gatggcgataatctgggtactgacc

SEQ ID NO: 103187 - DNA, 25 bp, E. coli
catccagcggttccgtgaacttaac

SEQ ID NO: 103188 - DNA, 25 bp, E. coli
catccagcggttgcgtgaacttaac

SEQ ID NO: 103189 - DNA, 25 bp, E. coli
atttcctgtctggacggcacgcgtg

SEQ ID NO: 103190 - DNA, 25 bp, E. coli
atttcctgtctgcacggcacgcgtg

SEQ ID NO: 103191 - DNA, 25 bp, E. coli
tgcaaaaggaactggcgcgcaatca

SEQ ID NO: 103192 - DNA, 25 bp, E. coli
tgaaacatgctgttgccagcgcggt

SEQ ID NO: 103193 - DNA, 25 bp, E. coli
tgcaaaaggaacaggcgcgcaatca

SEQ ID NO: 103194 - DNA, 25 bp, E. coli
tgatgaacgccatcgcgctgatcgc

SEQ ID NO: 103195 - DNA, 25 bp, E. coli
tgaaacatgctgatgccagcgcggt

SEQ ID NO: 103196 - DNA, 25 bp, E. coli
tgatgaacgccaacgcgctgatcgc

SEQ ID NO: 103197 - DNA, 25 bp, E. coli
tctcgctgctggagcaaagtctgac

SEQ ID NO: 103198 - DNA, 25 bp, E. coli
tctcgctgctggtgcaaagtctgac

SEQ ID NO: 103199 - DNA, 25 bp, E. coli
gacgctgtttcgagtctgccaggaa

SEQ ID NO: 103200 - DNA, 25 bp, E. coli
gacgctgtttcgtgtctgccaggaa

SEQ ID NO: 103201 - DNA, 25 bp, E. coli
gaacttaaccagtcgctgcaaaagg

SEQ ID NO: 103202 - DNA, 25 bp, E. coli
gactggcgcaccttgctgttacagg

SEQ ID NO: 103203 - DNA, 25 bp, E. coli
gaacttaaccagacgctgcaaaagg

SEQ ID NO: 103204 - DNA, 25 bp, E. coli
gactggcgcaccatgctgttacagg

SEQ ID NO: 103205 - DNA, 25 bp, E. coli
ccccgatatgtcaggtgttctggca

SEQ ID NO: 103206 - DNA, 25 bp, E. coli
ccccgatatgtctggtgttctggca

SEQ ID NO: 103207 - DNA, 25 bp, E. coli
tcagcgttaagccaaaaccagcgcg

SEQ ID NO: 103208 - DNA, 25 bp, E. coli
tcagcgttaagcgaaaaccagcgcg

SEQ ID NO: 103209 - DNA, 25 bp, E. coli
caacacagttaactcggtacgcccg

SEQ ID NO: 103210 - DNA, 25 bp, E. coli
caaaagataaagtccacgtgctgct

SEQ ID NO: 103211 - DNA, 25 bp, E. coli
caacacagttaagtcggtacgcccg

SEQ ID NO: 103212 - DNA, 25 bp, E. coli
caaaagataaagaccacgtgctgct

SEQ ID NO: 103213 - DNA, 25 bp, E. coli
tacaactttccggatctgacgggtc

SEQ ID NO: 103214 - DNA, 25 bp, E. coli
tacaactttccgcatctgacgggtc

SEQ ID NO: 103215 - DNA, 25 bp, E. coli
aaatacagcatggagtgtgtcgggc

SEQ ID NO: 103216 - DNA, 25 bp, E. coli
aaatacagcatgcagtgtgtcgggc

SEQ ID NO: 103217 - DNA, 25 bp, E. coli
tagccaaatgaaaacagcccagcgc

SEQ ID NO: 103218 - DNA, 25 bp, E. coli
tagccaaatgaatacagcccagcgc

SEQ ID NO: 103219 - DNA, 25 bp, E. coli
tttgctgaatacgatgctgctgggc

SEQ ID NO: 103220 - DNA, 25 bp, E. coli
tttgctgaataccatgctgctgggc

SEQ ID NO: 103221 - DNA, 25 bp, E. coli
gcactcgccgaagaagctgtaacca

SEQ ID NO: 103222 - DNA, 25 bp, E. coli
gctgtaaccattctcgacgggcgag

SEQ ID NO: 103223 - DNA, 25 bp, E. coli
gctgtaaccattgtcgacgggcgag

SEQ ID NO: 103224 - DNA, 25 bp, E. coli
gcactcgccgaacaagctgtaacca

SEQ ID NO: 103225 - DNA, 25 bp, E. coli
cgctgcgacgctcaataaaaaacta

SEQ ID NO: 103226 - DNA, 25 bp, E. coli
cgctgcgacgctgaataaaaaacta

SEQ ID NO: 103227 - DNA, 25 bp, E. coli
tggaaagtcgcaccacgaaatcttg

SEQ ID NO: 103228 - DNA, 25 bp, E. coli
tggaaagtcgcagcacgaaatcttg

SEQ ID NO: 103229 - DNA, 25 bp, E. coli
gacgcgtctggctctgcaaaacgag

SEQ ID NO: 103230 - DNA, 25 bp, E. coli
gacgcgtctggcactgcaaaacgag

SEQ ID NO: 103231 - DNA, 25 bp, E. coli
aaccttcgcgaagtgggtcatgtca

SEQ ID NO: 103232 - DNA, 25 bp, E. coli
agcgtggcggaagacaaccttcgcg

SEQ ID NO: 103233 - DNA, 25 bp, E. coli
agcgtggcggaacacaaccttcgcg

SEQ ID NO: 103234 - DNA, 25 bp, E. coli
aaccttcgcgaactgggtcatgtca

SEQ ID NO: 103235 - DNA, 25 bp, E. coli
tatcgcgccgggatcggttttgaag

SEQ ID NO: 103236 - DNA, 25 bp, E. coli
tatcgcgccgggttcggttttgaag

SEQ ID NO: 103237 - DNA, 25 bp, E. coli
tatttatcagacgaccatcacccgt

SEQ ID NO: 103238 - DNA, 25 bp, E. coli
tatttatcagaccaccatcacccgt

SEQ ID NO: 103239 - DNA, 25 bp, E. coli
gctcatcaccttacgtgaaggcgcg

SEQ ID NO: 103240 - DNA, 25 bp, E. coli
gctcatcacctttcgtgaaggcgcg

SEQ ID NO: 103241 - DNA, 25 bp, E. coli
gaatttccgggctctgtccatgtgg

SEQ ID NO: 103242 - DNA, 25 bp, E. coli
gcactgtccatgtggcaggccctgt

SEQ ID NO: 103243 - DNA, 25 bp, E. coli
gaatttccgggcactgtccatgtgg

SEQ ID NO: 103244 - DNA, 25 bp, E. coli
gcactgtccatgaggcaggccctgt

SEQ ID NO: 103245 - DNA, 25 bp, E. coli
cattgccacggcgagttgaaaggtg

SEQ ID NO: 103246 - DNA, 25 bp, E. coli
cattgccacggccagttgaaaggtg

SEQ ID NO: 103247 - DNA, 25 bp, E. coli
gttgaaaggtgctctccatcccggt

SEQ ID NO: 103248 - DNA, 25 bp, E. coli
gttgaaaggtgcactccatcccggt

SEQ ID NO: 103249 - DNA, 25 bp, E. coli
gtcatgtcaccctgcgcttcgatgg

SEQ ID NO: 103250 - DNA, 25 bp, E. coli
gtcatgtcacccagcgcttcgatgg

SEQ ID NO: 103251 - DNA, 25 bp, E. coli
gagtattgcttctttcattgccacg

SEQ ID NO: 103252 - DNA, 25 bp, E. coli
gagtattgcttcattcattgccacg

SEQ ID NO: 103253 - DNA, 25 bp, E. coli
caagctcttagtagtaacccggaag

SEQ ID NO: 103254 - DNA, 25 bp, E. coli
caagctcttagttgtaacccggaag

SEQ ID NO: 103255 - DNA, 25 bp, E. coli
caaagccgctatcgacaaagcatta

SEQ ID NO: 103256 - DNA, 25 bp, E. coli
caaagccgctatggacaaagcatta

SEQ ID NO: 103257 - DNA, 25 bp, E. coli
aactttaacgcacaagcggctaccg

SEQ ID NO: 103258 - DNA, 25 bp, E. coli
atggccctggtggaggtatcacgcc

SEQ ID NO: 103259 - DNA, 25 bp, E. coli
atggccctggtgcaggtatcacgcc

SEQ ID NO: 103260 - DNA, 25 bp, E. coli
aactttaacgcagaagcggctaccg

SEQ ID NO: 103261 - DNA, 25 bp, E. coli
tatcacgccagtaaacattaacggt

SEQ ID NO: 103262 - DNA, 25 bp, E. coli
tatcacgccagttaacattaacggt

SEQ ID NO: 103263 - DNA, 25 bp, E. coli
tggtggaggtatgacgccagtaaac

SEQ ID NO: 103264 - DNA, 25 bp, E. coli
tggtggaggtatcacgccagtaaac

SEQ ID NO: 103265 - DNA, 25 bp, E. coli
tcacgggctttatctttaacgcaga

SEQ ID NO: 103266 - DNA, 25 bp, E. coli
tcacgggctttaactttaacgcaga

SEQ ID NO: 103267 - DNA, 25 bp, E. coli
gcggttctgttctcgggctttaact

SEQ ID NO: 103268 - DNA, 25 bp, E. coli
gcggttctgttcacgggctttaact

SEQ ID NO: 103269 - DNA, 25 bp, E. coli
cggctaccgtaaaacaagctcttag

SEQ ID NO: 103270 - DNA, 25 bp, E. coli
cggctaccgtaatacaagctcttag

SEQ ID NO: 103271 - DNA, 25 bp, E. coli
ggtgacgctaccaacaaagccgcta

SEQ ID NO: 103272 - DNA, 25 bp, E. coli
ggtgacgctacctacaaagccgcta

SEQ ID NO: 103273 - DNA, 25 bp, E. coli
taacccggaagcgtgggctgaacaa

SEQ ID NO: 103274 - DNA, 25 bp, E. coli
taacccggaagcctgggctgaacaa

SEQ ID NO: 103275 - DNA, 25 bp, E. coli
aaatcgattcaggtttggcttttcc

SEQ ID NO: 103276 - DNA, 25 bp, E. coli
aaatcgattcagctttggcttttcc

SEQ ID NO: 103277 - DNA, 25 bp, E. coli
aacattatgccggtaaaggaagaat

SEQ ID NO: 103278 - DNA, 25 bp, E. coli
aacattatgccgctaaaggaagaat

SEQ ID NO: 103279 - DNA, 25 bp, E. coli
tttcgtacgtcaataaacattatgc

SEQ ID NO: 103280 - DNA, 25 bp, E. coli
tttcgtacgtcattaaacattatgc

SEQ ID NO: 103281 - DNA, 25 bp, E. coli
tgccgctaaaggaagaattgaacca

SEQ ID NO: 103282 - DNA, 25 bp, E. coli
tgccgctaaaggtagaattgaacca

SEQ ID NO: 103283 - DNA, 25 bp, E. coli
tcagctttggcttttcctgtaacga

SEQ ID NO: 103284 - DNA, 25 bp, E. coli
tcagctttggctattcctgtaacga

SEQ ID NO: 103285 - DNA, 25 bp, E. coli
tcataaaatcgaatcagctttggct

SEQ ID NO: 103286 - DNA, 25 bp, E. coli
tcataaaatcgattcagctttggct

SEQ ID NO: 103287 - DNA, 25 bp, E. coli
gctaaaggaagatttgaaccaaatc

SEQ ID NO: 103288 - DNA, 25 bp, E. coli
gctaaaggaagaattgaaccaaatc

SEQ ID NO: 103289 - DNA, 25 bp, E. coli
gctttggcttttgctgtaacgatta

SEQ ID NO: 103290 - DNA, 25 bp, E. coli
gctttggcttttcctgtaacgatta

SEQ ID NO: 103291 - DNA, 25 bp, E. coli
gaattgaaccaaatcataaaatcga

SEQ ID NO: 103292 - DNA, 25 bp, E. coli
gaattgaaccaattcataaaatcga

SEQ ID NO: 103293 - DNA, 25 bp, E. coli
cgctgacgtttcgtacgtcattaaa

SEQ ID NO: 103294 - DNA, 25 bp, E. coli
cgctgacgtttcctacgtcattaaa

SEQ ID NO: 103295 - DNA, 25 bp, E. coli
gtgttgaccgctgacgtttcgtacg

SEQ ID NO: 103296 - DNA, 25 bp, E. coli
gtgttgaccgctcacgtttcgtacg

SEQ ID NO: 103297 - DNA, 25 bp, E. coli
taccggacaggacgccatattgcgt

SEQ ID NO: 103298 - DNA, 25 bp, E. coli
taccggacaggaggccatattgcgt

SEQ ID NO: 103299 - DNA, 25 bp, E. coli
tatggcttgttactggctctggcgc

SEQ ID NO: 103300 - DNA, 25 bp, E. coli
tatggcttgttagtggctctggcgc

SEQ ID NO: 103301 - DNA, 25 bp, E. coli
tattgagggcgatcctgacattgcg

SEQ ID NO: 103302 - DNA, 25 bp, E. coli
tattgagggcgaacctgacattgcg

SEQ ID NO: 103303 - DNA, 25 bp, E. coli
ttaatgacgagataagcgccgggct

SEQ ID NO: 103304 - DNA, 25 bp, E. coli
ttaatgacgagaaaagcgccgggct

SEQ ID NO: 103305 - DNA, 25 bp, E. coli
tgatgacacggctatctgcgcactg

SEQ ID NO: 103306 - DNA, 25 bp, E. coli
tgattaaaactcagcgcggtctggg

SEQ ID NO: 103307 - DNA, 25 bp, E. coli
tgattaaaactctgcgcggtctggg

SEQ ID NO: 103308 - DNA, 25 bp, E. coli
tgatgacacggcaatctgcgcactg

SEQ ID NO: 103309 - DNA, 25 bp, E. coli
gctggatatgatgctacccgatacc

SEQ ID NO: 103310 - DNA, 25 bp, E. coli
gctggatatgatcctacccgatacc

SEQ ID NO: 103311 - DNA, 25 bp, E. coli
gaaactgcgtccgacattgccggtg

SEQ ID NO: 103312 - DNA, 25 bp, E. coli
gaaactgcgtcccacattgccggtg

SEQ ID NO: 103313 - DNA, 25 bp, E. coli
cgagttaactcacggcgaatatggc

SEQ ID NO: 103314 - DNA, 25 bp, E. coli
cgagttaactcagggcgaatatggc

SEQ ID NO: 103315 - DNA, 25 bp, E. coli
gtttcagtctgccataccggacagg

SEQ ID NO: 103316 - DNA, 25 bp, E. coli
gtttcagtctgcgataccggacagg

SEQ ID NO: 103317 - DNA, 25 bp, E. coli
gtatctcgataccatgcgctgccag

SEQ ID NO: 103318 - DNA, 25 bp, E. coli
gtatctcgatacgatgcgctgccag

SEQ ID NO: 103319 - DNA, 25 bp, E. coli
aatcagccggaacatgtcattgttc

SEQ ID NO: 103320 - DNA, 25 bp, E. coli
aatcagccggaagatgtcattgttc

SEQ ID NO: 103321 - DNA, 25 bp, E. coli
cacaattgaattgcaaggagcacat

SEQ ID NO: 103322 - DNA, 25 bp, E. coli
cacaattgaattccaaggagcacat

SEQ ID NO: 103323 - DNA, 25 bp, E. coli
ctctgagggttgaggttcgtatgca

SEQ ID NO: 103324 - DNA, 25 bp, E. coli
ctctgagggttgtggttcgtatgca

SEQ ID NO: 103325 - DNA, 25 bp, E. coli
taaatgccgctcattctgaaaatga

SEQ ID NO: 103326 - DNA, 25 bp, E. coli
tacacatgcgggaaatcagccggaa

SEQ ID NO: 103327 - DNA, 25 bp, E. coli
tacaagccaatagataaatcctccc

SEQ ID NO: 103328 - DNA, 25 bp, E. coli
tacacatgcgggtaatcagccggaa

SEQ ID NO: 103329 - DNA, 25 bp, E. coli
taaatgccgctctttctgaaaatga

SEQ ID NO: 103330 - DNA, 25 bp, E. coli
tacaagccaatacataaatcctccc

SEQ ID NO: 103331 - DNA, 25 bp, E. coli
aaatacaaggtttgatctctgaggg

SEQ ID NO: 103332 - DNA, 25 bp, E. coli
aaatacaaggttagatctctgaggg

SEQ ID NO: 103333 - DNA, 25 bp, E. coli
tatccacactcaattacacatgcgg

SEQ ID NO: 103334 - DNA, 25 bp, E. coli
tatccacactcatttacacatgcgg

SEQ ID NO: 103335 - DNA, 25 bp, E. coli
tcgcgagtacggaatcatatagttg

SEQ ID NO: 103336 - DNA, 25 bp, E. coli
tcgcgagtacggtatcatatagttg

SEQ ID NO: 103337 - DNA, 25 bp, E. coli
tggaagcaccatttcgcgagtacgg

SEQ ID NO: 103338 - DNA, 25 bp, E. coli
tggaagcaccatatcgcgagtacgg

SEQ ID NO: 103339 - DNA, 25 bp, E. coli
gagtataatgtactgcatcacccca

SEQ ID NO: 103340 - DNA, 25 bp, E. coli
gagtataatgtagtgcatcacccca

SEQ ID NO: 103341 - DNA, 25 bp, E. coli
ttatcccgatttacgcgatcgcagc

SEQ ID NO: 103342 - DNA, 25 bp, E. coli
ttatcccgattttcgcgatcgcagc

SEQ ID NO: 103343 - DNA, 25 bp, E. coli
tgaacaggttacgttcgagcgcatc

SEQ ID NO: 103344 - DNA, 25 bp, E. coli
tgaacaggttaccttcgagcgcatc

SEQ ID NO: 103345 - DNA, 25 bp, E. coli
gcgcccacgccctgaatctcattga

SEQ ID NO: 103346 - DNA, 25 bp, E. coli
gcgcccacgcccagaatctcattga

SEQ ID NO: 103347 - DNA, 25 bp, E. coli
ccggagcatattatgaacaggttac

SEQ ID NO: 103348 - DNA, 25 bp, E. coli
ccggagcatattttgaacaggttac

SEQ ID NO: 103349 - DNA, 25 bp, E. coli
gcaatacttaaatcggtatcatgtg

SEQ ID NO: 103350 - DNA, 25 bp, E. coli
gcaatccctgcattacttaaatcgg

SEQ ID NO: 103351 - DNA, 25 bp, E. coli
gcaatacttaaaacggtatcatgtg

SEQ ID NO: 103352 - DNA, 25 bp, E. coli
gcaatccctgcaatacttaaatcgg

SEQ ID NO: 103353 - DNA, 25 bp, E. coli
cgatcgcagccggagtggcgcaatc

SEQ ID NO: 103354 - DNA, 25 bp, E. coli
cgatcgcagccgcagtggcgcaatc

SEQ ID NO: 103355 - DNA, 25 bp, E. coli
gatacgcgagccaccggagcatatt

SEQ ID NO: 103356 - DNA, 25 bp, E. coli
gtatcatgtgatacgcgagcctccg

SEQ ID NO: 103357 - DNA, 25 bp, E. coli
gatacgcgagcctccggagcatatt

SEQ ID NO: 103358 - DNA, 25 bp, E. coli
gtatcatgtgattcgcgagcctccg

SEQ ID NO: 103359 - DNA, 25 bp, E. coli
ggagtggcgcaaaccctgcaatact

SEQ ID NO: 103360 - DNA, 25 bp, E. coli
ggagtggcgcaatccctgcaatact

SEQ ID NO: 103361 - DNA, 25 bp, E. coli
gagcctccggaggatattttgaaca

SEQ ID NO: 103362 - DNA, 25 bp, E. coli
gagcctccggagcatattttgaaca

SEQ ID NO: 103363 - DNA, 25 bp, E. coli
aatctgctggtgacaaagcgcgacg

SEQ ID NO: 103364 - DNA, 25 bp, E. coli
aatctgctggtgtcaaagcgcgacg

SEQ ID NO: 103365 - DNA, 25 bp, E. coli
cacttacgcgaaagggatcctgccg

SEQ ID NO: 103366 - DNA, 25 bp, E. coli
cacttacgcgaatgggatcctgccg

SEQ ID NO: 103367 - DNA, 25 bp, E. coli
tacgctgtctgctttcaacctgggc

SEQ ID NO: 103368 - DNA, 25 bp, E. coli
acaaccgtggtgtggaaggcaaccg

SEQ ID NO: 103369 - DNA, 25 bp, E. coli
acaaccgtggtgaggaaggcaaccg

SEQ ID NO: 103370 - DNA, 25 bp, E. coli
tacgctgtctgcattcaacctgggc

SEQ ID NO: 103371 - DNA, 25 bp, E. coli
tatgagaaagacgacagcatccgca

SEQ ID NO: 103372 - DNA, 25 bp, E. coli
tatgagaaagaccacagcatccgca

SEQ ID NO: 103373 - DNA, 25 bp, E. coli
tattatcagaacacccgtgacggcg

SEQ ID NO: 103374 - DNA, 25 bp, E. coli
tattatcagaactcccgtgacggcg

SEQ ID NO: 103375 - DNA, 25 bp, E. coli
tcccgtcaggaatagtgccgatgca

SEQ ID NO: 103376 - DNA, 25 bp, E. coli
tcccgtcaggaaaagtgccgatgca

SEQ ID NO: 103377 - DNA, 25 bp, E. coli
cctatgagctgctgtgggaaatgcc

SEQ ID NO: 103378 - DNA, 25 bp, E. coli
cctatgagctgcagtgggaaatgcc

SEQ ID NO: 103379 - DNA, 25 bp, E. coli
gaaaccattatcaaggctgccgcag

SEQ ID NO: 103380 - DNA, 25 bp, E. coli
gaaaccattatctaggctgccgcag

SEQ ID NO: 103381 - DNA, 25 bp, E. coli
ggttacgtcagcatcaaagcgtcga

SEQ ID NO: 103382 - DNA, 25 bp, E. coli
ggttacgtcagcttcaaagcgtcga

SEQ ID NO: 103383 - DNA, 25 bp, E. coli
tcaatccaggacgatggctgcgaaa

SEQ ID NO: 103384 - DNA, 25 bp, E. coli
tcaatccaggaccatggctgcgaaa

SEQ ID NO: 103385 - DNA, 25 bp, E. coli
cagccgttgtgcgaactgccaaagg

SEQ ID NO: 103386 - DNA, 25 bp, E. coli
cagccgttgtgccaactgccaaagg

SEQ ID NO: 103387 - DNA, 25 bp, E. coli
aaactactgtgtcgaagactgtaac

SEQ ID NO: 103388 - DNA, 25 bp, E. coli
aaactactgtgtggaagactgtaac

SEQ ID NO: 103389 - DNA, 25 bp, E. coli
tgtatgaactttctgccgtgacgca

SEQ ID NO: 103390 - DNA, 25 bp, E. coli
tgtatgaactttgtgccgtgacgca

SEQ ID NO: 103391 - DNA, 25 bp, E. coli
tgaaaattgatttccgctggacggg

SEQ ID NO: 103392 - DNA, 25 bp, E. coli
tgaaaattgattaccgctggacggg

SEQ ID NO: 103393 - DNA, 25 bp, E. coli
tccgctaaacctagccattggcgaa

SEQ ID NO: 103394 - DNA, 25 bp, E. coli
tccgctaaaccttgccattggcgaa

SEQ ID NO: 103395 - DNA, 25 bp, E. coli
gccattcgccgtcaagtagccagcg

SEQ ID NO: 103396 - DNA, 25 bp, E. coli
gccattcgccgtgaagtagccagcg

SEQ ID NO: 103397 - DNA, 25 bp, E. coli
gcggtgggcatattcatccgctaaa

SEQ ID NO: 103398 - DNA, 25 bp, E. coli
gctgtcggaagatttagcccgttcg

SEQ ID NO: 103399 - DNA, 25 bp, E. coli
gctgtcggaagaattagcccgttcg

SEQ ID NO: 103400 - DNA, 25 bp, E. coli
gcggtgggcataatcatccgctaaa

SEQ ID NO: 103401 - DNA, 25 bp, E. coli
gaactgccaaaggtcaggtgacggc

SEQ ID NO: 103402 - DNA, 25 bp, E. coli
gaactgccaaagctcaggtgacggc

SEQ ID NO: 103403 - DNA, 25 bp, E. coli
gatcaccaccgaacggctgtcggaa

SEQ ID NO: 103404 - DNA, 25 bp, E. coli
gatcaccaccgatcggctgtcggaa

SEQ ID NO: 103405 - DNA, 25 bp, E. coli
gtagccagcgatcgctataccggtg

SEQ ID NO: 103406 - DNA, 25 bp, E. coli
gtagccagcgatggctataccggtg

SEQ ID NO: 103407 - DNA, 25 bp, E. coli
tacatcaagtcgagccattgcggga

SEQ ID NO: 103408 - DNA, 25 bp, E. coli
tacatcaagtcgtgccattgcggga

SEQ ID NO: 103409 - DNA, 25 bp, E. coli
tatccgccgcaaagcattagtggga

SEQ ID NO: 103410 - DNA, 25 bp, E. coli
tatgcacggtttacccgagcaggat

SEQ ID NO: 103411 - DNA, 25 bp, E. coli
tatgcacggttttcccgagcaggat

SEQ ID NO: 103412 - DNA, 25 bp, E. coli
tatcgtggtgaaagatggcgcgaac

SEQ ID NO: 103413 - DNA, 25 bp, E. coli
tatccgccgcaatgcattagtggga

SEQ ID NO: 103414 - DNA, 25 bp, E. coli
tatcgtggtgaatgatggcgcgaac

SEQ ID NO: 103415 - DNA, 25 bp, E. coli
tattctcggcaagggcgtttacgtt

SEQ ID NO: 103416 - DNA, 25 bp, E. coli
tattctcggcaacggcgtttacgtt

SEQ ID NO: 103417 - DNA, 25 bp, E. coli
ttgtgaaagccaaagcagaaatgcc

SEQ ID NO: 103418 - DNA, 25 bp, E. coli
ttgtgaaagccatagcagaaatgcc

SEQ ID NO: 103419 - DNA, 25 bp, E. coli
ttggcatggaaatagcagggtacgc

SEQ ID NO: 103420 - DNA, 25 bp, E. coli
ttggcatggaaaaagcagggtacgc

SEQ ID NO: 103421 - DNA, 25 bp, E. coli
gaacagcattgtaggtgcatccgca

SEQ ID NO: 103422 - DNA, 25 bp, E. coli
gaacagcattgttggtgcatccgca

SEQ ID NO: 103423 - DNA, 25 bp, E. coli
gttgggccaaatcccagcctgcgtg

SEQ ID NO: 103424 - DNA, 25 bp, E. coli
gttgggccaaatgccagcctgcgtg

SEQ ID NO: 103425 - DNA, 25 bp, E. coli
taattacctgatagtcggcagcccg

SEQ ID NO: 103426 - DNA, 25 bp, E. coli
taattacctgattgtcggcagcccg

SEQ ID NO: 103427 - DNA, 25 bp, E. coli
gagagttttgtcgatccgacagcgg

SEQ ID NO: 103428 - DNA, 25 bp, E. coli
gagagttttgtccatccgacagcgg

SEQ ID NO: 103429 - DNA, 25 bp, E. coli
caatgatgtgaataagggaaccatc

SEQ ID NO: 103430 - DNA, 25 bp, E. coli
caatgatgtgaaaaagggaaccatc

SEQ ID NO: 103431 - DNA, 25 bp, E. coli
caggttccctttagcgttagtgccg

SEQ ID NO: 103432 - DNA, 25 bp, E. coli
caggttcccttttgcgttagtgccg

SEQ ID NO: 103433 - DNA, 25 bp, E. coli
ttttgcgttagtgccggaggccgca

SEQ ID NO: 103434 - DNA, 25 bp, E. coli
ttttgcgttagtcccggaggccgca

SEQ ID NO: 103435 - DNA, 25 bp, E. coli
tcccttttgcgtaagtgccggaggc

SEQ ID NO: 103436 - DNA, 25 bp, E. coli
tcccttttgcgttagtgccggaggc

SEQ ID NO: 103437 - DNA, 25 bp, E. coli
tgtcaatgatgtcaaaaagggaacc

SEQ ID NO: 103438 - DNA, 25 bp, E. coli
tgtcaatgatgtgaaaaagggaacc

SEQ ID NO: 103439 - DNA, 25 bp, E. coli
gaaccatcaggtacccttttgcgtt

SEQ ID NO: 103440 - DNA, 25 bp, E. coli
gaaccatcaggttcccttttgcgtt

SEQ ID NO: 103441 - DNA, 25 bp, E. coli
cgcgtctactccgacctactgcgaa

SEQ ID NO: 103442 - DNA, 25 bp, E. coli
ccgcattggcgcctaacgtcggatg

SEQ ID NO: 103443 - DNA, 25 bp, E. coli
ccgcattggcgcgtaacgtcggatg

SEQ ID NO: 103444 - DNA, 25 bp, E. coli
cgcgtctactcccacctactgcgaa

SEQ ID NO: 103445 - DNA, 25 bp, E. coli
cattggcgcgtaacgtcggatgcga

SEQ ID NO: 103446 - DNA, 25 bp, E. coli
cattggcgcgtatcgtcggatgcga

SEQ ID NO: 103447 - DNA, 25 bp, E. coli
gttagtgccggacgccgcattggcg

SEQ ID NO: 103448 - DNA, 25 bp, E. coli
gttagtgccggaggccgcattggcg

SEQ ID NO: 103449 - DNA, 25 bp, E. coli
tgtgaaaaagggaaccatcaggttc

SEQ ID NO: 103450 - DNA, 25 bp, E. coli
tgtgaaaaagggtaccatcaggttc

SEQ ID NO: 103451 - DNA, 25 bp, E. coli
caaagtcagcaacaaatcccgctca

SEQ ID NO: 103452 - DNA, 25 bp, E. coli
caaatatcaacttcgttataagtcc

SEQ ID NO: 103453 - DNA, 25 bp, E. coli
caaattcttgatgcgcaaagtcagc

SEQ ID NO: 103454 - DNA, 25 bp, E. coli
caaattcttgatccgcaaagtcagc

SEQ ID NO: 103455 - DNA, 25 bp, E. coli
caaagtcagcaagaaatcccgctca

SEQ ID NO: 103456 - DNA, 25 bp, E. coli
caaatatcaactacgttataagtcc

SEQ ID NO: 103457 - DNA, 25 bp, E. coli
agaaatcccgctgaatcaggtccag

SEQ ID NO: 103458 - DNA, 25 bp, E. coli
agaaatcccgctcaatcaggtccag

SEQ ID NO: 103459 - DNA, 25 bp, E. coli
ttcgttataagtccacaaaggcggg

SEQ ID NO: 103460 - DNA, 25 bp, E. coli
ttcgttataagtgcacaaaggcggg

SEQ ID NO: 103461 - DNA, 25 bp, E. coli
tgcgcaaagtcagcaagaaatcccg

SEQ ID NO: 103462 - DNA, 25 bp, E. coli
tgcgcaaagtcaccaagaaatcccg

SEQ ID NO: 103463 - DNA, 25 bp, E. coli
gctcaatcaggtccagcctcttacg

SEQ ID NO: 103464 - DNA, 25 bp, E. coli
gctcaatcaggtgcagcctcttacg

SEQ ID NO: 103465 - DNA, 25 bp, E. coli
gattgccgtgcaaattcttgatgcg

SEQ ID NO: 103466 - DNA, 25 bp, E. coli
gattgccgtgcatattcttgatgcg

SEQ ID NO: 103467 - DNA, 25 bp, E. coli
gtccagcctctttcgcccttaaaag

SEQ ID NO: 103468 - DNA, 25 bp, E. coli
gtccagcctcttacgcccttaaaag

SEQ ID NO: 103469 - DNA, 25 bp, E. coli
gggataacacacacaaatatcaact

SEQ ID NO: 103470 - DNA, 25 bp, E. coli
gggataacacactcaaatatcaact

SEQ ID NO: 103471 - DNA, 25 bp, E. coli
taagtccacaaaggcgggagcaacg

SEQ ID NO: 103472 - DNA, 25 bp, E. coli
taagtccacaaacgcgggagcaacg

SEQ ID NO: 103473 - DNA, 25 bp, E. coli
cacatttcgggctaataattcgcga

SEQ ID NO: 103474 - DNA, 25 bp, E. coli
cacatttcgggcaaataattcgcga

SEQ ID NO: 103475 - DNA, 25 bp, E. coli
catgctctgggtaacttgcgaaacc

SEQ ID NO: 103476 - DNA, 25 bp, E. coli
catgctctgggttacttgcgaaacc

SEQ ID NO: 103477 - DNA, 25 bp, E. coli
taaattgtttctgcttgacctgtgg

SEQ ID NO: 103478 - DNA, 25 bp, E. coli
taaattgtttctccttgacctgtgg

SEQ ID NO: 103479 - DNA, 25 bp, E. coli
tatacggtatagacctgagcaatag

SEQ ID NO: 103480 - DNA, 25 bp, E. coli
tatacggtatagtcctgagcaatag

SEQ ID NO: 103481 - DNA, 25 bp, E. coli
ttgtggctgaaacgagtatacggta

SEQ ID NO: 103482 - DNA, 25 bp, E. coli
ttgtggctgaaaggagtatacggta

SEQ ID NO: 103483 - DNA, 25 bp, E. coli
gccttaacctgcatccatgctctgg

SEQ ID NO: 103484 - DNA, 25 bp, E. coli
gcgcaatggccgctttccgttgtta

SEQ ID NO: 103485 - DNA, 25 bp, E. coli
gcgcaatggccggtttccgttgtta

SEQ ID NO: 103486 - DNA, 25 bp, E. coli
gccttaacctgcttccatgctctgg

SEQ ID NO: 103487 - DNA, 25 bp, E. coli
cgaagataattaagaactcaggcca

SEQ ID NO: 103488 - DNA, 25 bp, E. coli
cgaagataattatgaactcaggcca

SEQ ID NO: 103489 - DNA, 25 bp, E. coli
gattatctgtcacccagacactccg

SEQ ID NO: 103490 - DNA, 25 bp, E. coli
gttgttactcaagctttcagacgaa

SEQ ID NO: 103491 - DNA, 25 bp, E. coli
gttgttactcaacctttcagacgaa

SEQ ID NO: 103492 - DNA, 25 bp, E. coli
gattatctgtcagccagacactccg

SEQ ID NO: 103493 - DNA, 25 bp, E. coli
gacctgtggttaagaccctcttcac

SEQ ID NO: 103494 - DNA, 25 bp, E. coli
gacctgtggttatgaccctcttcac

SEQ ID NO: 103495 - DNA, 25 bp, E. coli
cactggacaggcagattaaagaagc

SEQ ID NO: 103496 - DNA, 25 bp, E. coli
cactggacaggctgattaaagaagc

SEQ ID NO: 103497 - DNA, 25 bp, E. coli
aagctacccgactggacgtcgcggt

SEQ ID NO: 103498 - DNA, 25 bp, E. coli
aagctacccgacaggacgtcgcggt

SEQ ID NO: 103499 - DNA, 25 bp, E. coli
ttaaagaagctacccgacaggacgt

SEQ ID NO: 103500 - DNA, 25 bp, E. coli
ttaaagaagctagccgacaggacgt

SEQ ID NO: 103501 - DNA, 25 bp, E. coli
tgtctcgcagtgagaaaagcactgg

SEQ ID NO: 103502 - DNA, 25 bp, E. coli
tgagaaaagcactggacaggctgat

SEQ ID NO: 103503 - DNA, 25 bp, E. coli
tgatcttgctacaactctcctctgc

SEQ ID NO: 103504 - DNA, 25 bp, E. coli
tgatcttgctactactctcctctgc

SEQ ID NO: 103505 - DNA, 25 bp, E. coli
tgagaaaagcacaggacaggctgat

SEQ ID NO: 103506 - DNA, 25 bp, E. coli
tgtctcgcagtgtgaaaagcactgg

SEQ ID NO: 103507 - DNA, 25 bp, E. coli
tgctacaactctgctctgctcaggg

SEQ ID NO: 103508 - DNA, 25 bp, E. coli
tgctacaactctcctctgctcaggg

SEQ ID NO: 103509 - DNA, 25 bp, E. coli
tctcctctgctctggggccggaaga

SEQ ID NO: 103510 - DNA, 25 bp, E. coli
tctcctctgctcaggggccggaaga

SEQ ID NO: 103511 - DNA, 25 bp, E. coli
gaagaatgttgtgtcgcagtgagaa

SEQ ID NO: 103512 - DNA, 25 bp, E. coli
gaagaatgttgtctcgcagtgagaa

SEQ ID NO: 103513 - DNA, 25 bp, E. coli
ggctgattaaagaagctacccgaca

SEQ ID NO: 103514 - DNA, 25 bp, E. coli
ggccggaagaatcttgtctcgcagt

SEQ ID NO: 103515 - DNA, 25 bp, E. coli
ggccggaagaatgttgtctcgcagt

SEQ ID NO: 103516 - DNA, 25 bp, E. coli
ggctgattaaagtagctacccgaca

SEQ ID NO: 103517 - DNA, 25 bp, E. coli
caggcgtctgatatgcttttgtgca

SEQ ID NO: 103518 - DNA, 25 bp, E. coli
caggcgtctgatttgcttttgtgca

SEQ ID NO: 103519 - DNA, 25 bp, E. coli
taaagcttgtttcgattaacatcag

SEQ ID NO: 103520 - DNA, 25 bp, E. coli
taaacgactcgacgtttatcggcct

SEQ ID NO: 103521 - DNA, 25 bp, E. coli
taaacgactcgaggtttatcggcct

SEQ ID NO: 103522 - DNA, 25 bp, E. coli
taaagcttgtttggattaacatcag

SEQ ID NO: 103523 - DNA, 25 bp, E. coli
agagcttcctttaggtgtcgccttc

SEQ ID NO: 103524 - DNA, 25 bp, E. coli
agagcttccttttggtgtcgccttc

SEQ ID NO: 103525 - DNA, 25 bp, E. coli
aaagtctgtttgaactcttcaggcc

SEQ ID NO: 103526 - DNA, 25 bp, E. coli
aaagtctgtttgtactcttcaggcc

SEQ ID NO: 103527 - DNA, 25 bp, E. coli
tatcggcctggcattgaggcgcaac

SEQ ID NO: 103528 - DNA, 25 bp, E. coli
tatcggcctggctttgaggcgcaac

SEQ ID NO: 103529 - DNA, 25 bp, E. coli
tgtgcaacagtgagtcagaacttac

SEQ ID NO: 103530 - DNA, 25 bp, E. coli
tgtgcaacagtgtgtcagaacttac

SEQ ID NO: 103531 - DNA, 25 bp, E. coli
tggtgtcgccttcccaggcgtctga

SEQ ID NO: 103532 - DNA, 25 bp, E. coli
tggtgtcgccttgccaggcgtctga

SEQ ID NO: 103533 - DNA, 25 bp, E. coli
tgaggcgcaacatactacactatct

SEQ ID NO: 103534 - DNA, 25 bp, E. coli
tgaggcgcaacaaactacactatct

SEQ ID NO: 103535 - DNA, 25 bp, E. coli
tcttcaggcctttagtaaacgactc

SEQ ID NO: 103536 - DNA, 25 bp, E. coli
tcttcaggccttaagtaaacgactc

SEQ ID NO: 103537 - DNA, 25 bp, E. coli
gaacttacatctcactcactgatag

SEQ ID NO: 103538 - DNA, 25 bp, E. coli
gaacttacatctgactcactgatag

SEQ ID NO: 103539 - DNA, 25 bp, E. coli
aatccggcgcgactcaggttgtgca

SEQ ID NO: 103540 - DNA, 25 bp, E. coli
aatccggcgcgagtcaggttgtgca

SEQ ID NO: 103541 - DNA, 25 bp, E. coli
tacgccgggcgtggaaccaaagtag

SEQ ID NO: 103542 - DNA, 25 bp, E. coli
tacgccgggcgtcgaaccaaagtag

SEQ ID NO: 103543 - DNA, 25 bp, E. coli
tgtcagcctctgttctgctctggaa

SEQ ID NO: 103544 - DNA, 25 bp, E. coli
tgttctgctctgcaaatacaccgca

SEQ ID NO: 103545 - DNA, 25 bp, E. coli
tgttctgctctggaaatacaccgca

SEQ ID NO: 103546 - DNA, 25 bp, E. coli
tgtcagcctctgatctgctctggaa

SEQ ID NO: 103547 - DNA, 25 bp, E. coli
tgacagccactcagttgtcagcctc

SEQ ID NO: 103548 - DNA, 25 bp, E. coli
tgacagccactctgttgtcagcctc

SEQ ID NO: 103549 - DNA, 25 bp, E. coli
tcaggttgtgcagcgaaatacgccg

SEQ ID NO: 103550 - DNA, 25 bp, E. coli
tcaggttgtgcaccgaaatacgccg

SEQ ID NO: 103551 - DNA, 25 bp, E. coli
ccagtactggcgaaaacgacgcgat

SEQ ID NO: 103552 - DNA, 25 bp, E. coli
ccagtactggcgtaaacgacgcgat

SEQ ID NO: 103553 - DNA, 25 bp, E. coli
gcagcagttacctgtactggcgaaa

SEQ ID NO: 103554 - DNA, 25 bp, E. coli
gcagcagttaccagtactggcgaaa

SEQ ID NO: 103555 - DNA, 25 bp, E. coli
gaaatacaccgctgcagttaccagt

SEQ ID NO: 103556 - DNA, 25 bp, E. coli
gaaatacaccgcagcagttaccagt

SEQ ID NO: 103557 - DNA, 25 bp, E. coli
gatacggttaatccggcgcgagtca

SEQ ID NO: 103558 - DNA, 25 bp, E. coli
gatacggttaatgcggcgcgagtca

SEQ ID NO: 103559 - DNA, 25 bp, E. coli
tggcgaaaacgaggcgatacggtta

SEQ ID NO: 103560 - DNA, 25 bp, E. coli
tggcgaaaacgacgcgatacggtta

SEQ ID NO: 103561 - DNA, 25 bp, E. coli
caagcagggcagttaggagcattta

SEQ ID NO: 103562 - DNA, 25 bp, E. coli
caagcagggcagataggagcattta

SEQ ID NO: 103563 - DNA, 25 bp, E. coli
tacttttatcagaggctcgcttgaa

SEQ ID NO: 103564 - DNA, 25 bp, E. coli
tacttttatcagtggctcgcttgaa

SEQ ID NO: 103565 - DNA, 25 bp, E. coli
tatataaagggaccacaagcagggc

SEQ ID NO: 103566 - DNA, 25 bp, E. coli
tattcagtgcgtcgttaaatgggca

SEQ ID NO: 103567 - DNA, 25 bp, E. coli
tattcagtgcgtggttaaatgggca

SEQ ID NO: 103568 - DNA, 25 bp, E. coli
tatataaagggagcacaagcagggc

SEQ ID NO: 103569 - DNA, 25 bp, E. coli
gctaatttctctgtaaggcttccta

SEQ ID NO: 103570 - DNA, 25 bp, E. coli
gctactgtgctttctataaatggac

SEQ ID NO: 103571 - DNA, 25 bp, E. coli
gctactgtgcttactataaatggac

SEQ ID NO: 103572 - DNA, 25 bp, E. coli
gctaatttctctctaaggcttccta

SEQ ID NO: 103573 - DNA, 25 bp, E. coli
gaaattcctacagctatagttgcag

SEQ ID NO: 103574 - DNA, 25 bp, E. coli
gaaattcctacacctatagttgcag

SEQ ID NO: 103575 - DNA, 25 bp, E. coli
cgcttgaagcttggattgcggaaga

SEQ ID NO: 103576 - DNA, 25 bp, E. coli
cgcttgaagcttcgattgcggaaga

SEQ ID NO: 103577 - DNA, 25 bp, E. coli
tggaaaccttagttcagtgacttgg

SEQ ID NO: 103578 - DNA, 25 bp, E. coli
tggaaaccttagatcagtgacttgg

SEQ ID NO: 103579 - DNA, 25 bp, E. coli
taattttaaaccttctgctcctggg

SEQ ID NO: 103580 - DNA, 25 bp, E. coli
taattttaaaccatctgctcctggg

SEQ ID NO: 103581 - DNA, 25 bp, E. coli
gatgataattctagagctactgtgc

SEQ ID NO: 103582 - DNA, 25 bp, E. coli
gatgataattcttgagctactgtgc

SEQ ID NO: 103583 - DNA, 25 bp, E. coli
aattggcgaacgtgcgccagttgcg

SEQ ID NO: 103584 - DNA, 25 bp, E. coli
aattggcgaacgagcgccagttgcg

SEQ ID NO: 103585 - DNA, 25 bp, E. coli
accgtttattgccactggcgcgcgc

SEQ ID NO: 103586 - DNA, 25 bp, E. coli
accgtttattgcgactggcgcgcgc

SEQ ID NO: 103587 - DNA, 25 bp, E. coli
accgctggacgtactgcttggcaaa

SEQ ID NO: 103588 - DNA, 25 bp, E. coli
accgctggacgttctgcttggcaaa

SEQ ID NO: 103589 - DNA, 25 bp, E. coli
tgaagccgttgaagcggtactggca

SEQ ID NO: 103590 - DNA, 25 bp, E. coli
tgaagccgttgatgcggtactggca

SEQ ID NO: 103591 - DNA, 25 bp, E. coli
tcctggtagcgtgcggtggtttttc

SEQ ID NO: 103592 - DNA, 25 bp, E. coli
tcctggtagcgtccggtggtttttc

SEQ ID NO: 103593 - DNA, 25 bp, E. coli
gccgattgatctaccgctggacgta

SEQ ID NO: 103594 - DNA, 25 bp, E. coli
gccgattgatcttccgctggacgta

SEQ ID NO: 103595 - DNA, 25 bp, E. coli
cgaagcgatggctattggcgaacgt

SEQ ID NO: 103596 - DNA, 25 bp, E. coli
cgaagcgatggcaattggcgaacgt

SEQ ID NO: 103597 - DNA, 25 bp, E. coli
cgttgaagcggtactggcacagcat

SEQ ID NO: 103598 - DNA, 25 bp, E. coli
cgttgaagcggttctggcacagcat

SEQ ID NO: 103599 - DNA, 25 bp, E. coli
ctgcattgtttagcgaagaactggg

SEQ ID NO: 103600 - DNA, 25 bp, E. coli
ctgcattgtttaccgaagaactggg

SEQ ID NO: 103601 - DNA, 25 bp, E. coli
gtttattgccacaggcgcgcgcccg

SEQ ID NO: 103602 - DNA, 25 bp, E. coli
gtttattgccactggcgcgcgcccg

SEQ ID NO: 103603 - DNA, 25 bp, E. coli
tggagggtttccacgtcctggtagc

SEQ ID NO: 103604 - DNA, 25 bp, E. coli
tggagggtttcctcgtcctggtagc

SEQ ID NO: 103605 - DNA, 25 bp, E. coli
caatgcttgaagtagctgacgccag

SEQ ID NO: 103606 - DNA, 25 bp, E. coli
caacccgcgggtaatggcaatgctt

SEQ ID NO: 103607 - DNA, 25 bp, E. coli
caatgcttgaagaagctgacgccag

SEQ ID NO: 103608 - DNA, 25 bp, E. coli
caacccgcgggttatggcaatgctt

SEQ ID NO: 103609 - DNA, 25 bp, E. coli
aaaagaatgcatccccatcttagcg

SEQ ID NO: 103610 - DNA, 25 bp, E. coli
aatccttaaatgaggacgacgacgc

SEQ ID NO: 103611 - DNA, 25 bp, E. coli
aaaagcgatccacaacatctgcagg

SEQ ID NO: 103612 - DNA, 25 bp, E. coli
aaaagcgatccagaacatctgcagg

SEQ ID NO: 103613 - DNA, 25 bp, E. coli
aaaagaatgcatgcccatcttagcg

SEQ ID NO: 103614 - DNA, 25 bp, E. coli
aatccttaaatgtggacgacgacgc

SEQ ID NO: 103615 - DNA, 25 bp, E. coli
tgacgccagaatgttcgctaacggt

SEQ ID NO: 103616 - DNA, 25 bp, E. coli
tgacgccagaatcttcgctaacggt

SEQ ID NO: 103617 - DNA, 25 bp, E. coli
gcgcgtaccgatgacttcccggaag

SEQ ID NO: 103618 - DNA, 25 bp, E. coli
gcgcgtaccgatcacttcccggaag

SEQ ID NO: 103619 - DNA, 25 bp, E. coli
gaagtgtttgcttccatgatggaag

SEQ ID NO: 103620 - DNA, 25 bp, E. coli
gaagtgtttgctaccatgatggaag

SEQ ID NO: 103621 - DNA, 25 bp, E. coli
cgctaacggttgtgcacatatgaaa

SEQ ID NO: 103622 - DNA, 25 bp, E. coli
cgctaacggttgagcacatatgaaa

SEQ ID NO: 103623 - DNA, 25 bp, E. coli
ccggaagtccttgccttgcgtaaat

SEQ ID NO: 103624 - DNA, 25 bp, E. coli
ccggaagtccttcccttgcgtaaat

SEQ ID NO: 103625 - DNA, 25 bp, E. coli
gagcacattcgttgctgcgttgaag

SEQ ID NO: 103626 - DNA, 25 bp, E. coli
gagcacattcgtagctgcgttgaag

SEQ ID NO: 103627 - DNA, 25 bp, E. coli
caaccgtctgctgaaggaagccatc

SEQ ID NO: 103628 - DNA, 25 bp, E. coli
caaccgtctgctcaaggaagccatc

SEQ ID NO: 103629 - DNA, 25 bp, E. coli
tactccgtgcagtctatggtggtga

SEQ ID NO: 103630 - DNA, 25 bp, E. coli
tactccgtgcagactatggtggtga

SEQ ID NO: 103631 - DNA, 25 bp, E. coli
tattactacacccatgtcgtcgggc

SEQ ID NO: 103632 - DNA, 25 bp, E. coli
tattacaggtcaacatggtggcaga

SEQ ID NO: 103633 - DNA, 25 bp, E. coli
tttgctgaatgtcggaacggcgctt

SEQ ID NO: 103634 - DNA, 25 bp, E. coli
tattacaggtcatcatggtggcaga

SEQ ID NO: 103635 - DNA, 25 bp, E. coli
tttgctgaatgtgggaacggcgctt

SEQ ID NO: 103636 - DNA, 25 bp, E. coli
tatctgtcgtatgcgggagctgcta

SEQ ID NO: 103637 - DNA, 25 bp, E. coli
tattactacaccgatgtcgtcgggc

SEQ ID NO: 103638 - DNA, 25 bp, E. coli
tatctgtcgtatccgggagctgcta

SEQ ID NO: 103639 - DNA, 25 bp, E. coli
tgttcatgctgatattccggtcggt

SEQ ID NO: 103640 - DNA, 25 bp, E. coli
tgttcatgctgaaattccggtcggt

SEQ ID NO: 103641 - DNA, 25 bp, E. coli
tgttacggcaggagtgacgctacca

SEQ ID NO: 103642 - DNA, 25 bp, E. coli
tgttacggcaggtgtgacgctacca

SEQ ID NO: 103643 - DNA, 25 bp, E. coli
cgacgcattttatgggccggagcat

SEQ ID NO: 103644 - DNA, 25 bp, E. coli
cgacgcattttaagggccggagcat

SEQ ID NO: 103645 - DNA, 25 bp, E. coli
gtttgcgtgacctacatcctctggg

SEQ ID NO: 103646 - DNA, 25 bp, E. coli
gtttgcgtgaccaacatcctctggg

SEQ ID NO: 103647 - DNA, 25 bp, E. coli
ggatcctgatcggtacgttggcaaa

SEQ ID NO: 103648 - DNA, 25 bp, E. coli
ggatcctgatcgctacgttggcaaa

SEQ ID NO: 103649 - DNA, 25 bp, E. coli
cagcatccaggattaccctctcaga

SEQ ID NO: 103650 - DNA, 25 bp, E. coli
cagcatccaggaataccctctcaga

SEQ ID NO: 103651 - DNA, 25 bp, E. coli
cagtttctcgcgcaggcgctgaaaa

SEQ ID NO: 103652 - DNA, 25 bp, E. coli
cagtttctcgcggaggcgctgaaaa

SEQ ID NO: 103653 - DNA, 25 bp, E. coli
aaagcattgcagtttctcgcgcagg

SEQ ID NO: 103654 - DNA, 25 bp, E. coli
aaatagcgcctgtttttatttcagg

SEQ ID NO: 103655 - DNA, 25 bp, E. coli
aaagcattgcagattctcgcgcagg

SEQ ID NO: 103656 - DNA, 25 bp, E. coli
aaatagcgcctgattttatttcagg

SEQ ID NO: 103657 - DNA, 25 bp, E. coli
tccaggattaccctctcagagacta

SEQ ID NO: 103658 - DNA, 25 bp, E. coli
tccaggattaccgtctcagagacta

SEQ ID NO: 103659 - DNA, 25 bp, E. coli
ccctctcagagagtaaaagcattgc

SEQ ID NO: 103660 - DNA, 25 bp, E. coli
cctgtttttatttcaggcaatcggg

SEQ ID NO: 103661 - DNA, 25 bp, E. coli
ccctctcagagactaaaagcattgc

SEQ ID NO: 103662 - DNA, 25 bp, E. coli
cctgtttttattacaggcaatcggg

SEQ ID NO: 103663 - DNA, 25 bp, E. coli
cattgcagtttctcgcgcaggcgct

SEQ ID NO: 103664 - DNA, 25 bp, E. coli
cattgcagtttcacgcgcaggcgct

SEQ ID NO: 103665 - DNA, 25 bp, E. coli
tggttggcaaatctggaatccagca

SEQ ID NO: 103666 - DNA, 25 bp, E. coli
ggcgctgaaaattgcgcctgttttt

SEQ ID NO: 103667 - DNA, 25 bp, E. coli
ggcaaatctggaatccagcatccag

SEQ ID NO: 103668 - DNA, 25 bp, E. coli
ggcgctgaaaatagcgcctgttttt

SEQ ID NO: 103669 - DNA, 25 bp, E. coli
ggcaaatctggattccagcatccag

SEQ ID NO: 103670 - DNA, 25 bp, E. coli
tggttggcaaatgtggaatccagca

SEQ ID NO: 103671 - DNA, 25 bp, E. coli
caatagccaatgtttatacccagcc

SEQ ID NO: 103672 - DNA, 25 bp, E. coli
caagtttcaattacgtcctgcctga

SEQ ID NO: 103673 - DNA, 25 bp, E. coli
caagtttcaatttcgtcctgcctga

SEQ ID NO: 103674 - DNA, 25 bp, E. coli
caatagccaatgattatacccagcc

SEQ ID NO: 103675 - DNA, 25 bp, E. coli
cagccattgaatacggcatgcgatc

SEQ ID NO: 103676 - DNA, 25 bp, E. coli
cagccattgaattcggcatgcgatc

SEQ ID NO: 103677 - DNA, 25 bp, E. coli
catttcaacatgtaactttgggcaa

SEQ ID NO: 103678 - DNA, 25 bp, E. coli
tagtgaggttgagagatatccgctg

SEQ ID NO: 103679 - DNA, 25 bp, E. coli
tagtgaggttgacagatatccgctg

SEQ ID NO: 103680 - DNA, 25 bp, E. coli
tataatgcgattggcattaacccgc

SEQ ID NO: 103681 - DNA, 25 bp, E. coli
tatcaacaatgattgccaatagctt

SEQ ID NO: 103682 - DNA, 25 bp, E. coli
tataatgcgattcgcattaacccgc

SEQ ID NO: 103683 - DNA, 25 bp, E. coli
tatcaacaatgaatgccaatagctt

SEQ ID NO: 103684 - DNA, 25 bp, E. coli
gcattaacccgcatttgtcgatata

SEQ ID NO: 103685 - DNA, 25 bp, E. coli
gctgcctgatgaccaattatgccca

SEQ ID NO: 103686 - DNA, 25 bp, E. coli
gctgcctgatgagcaattatgccca

SEQ ID NO: 103687 - DNA, 25 bp, E. coli
gcattaacccgcttttgtcgatata

SEQ ID NO: 103688 - DNA, 25 bp, E. coli
ctttgggcaaaatcaagatacgcgc

SEQ ID NO: 103689 - DNA, 25 bp, E. coli
ctttgggcaaaaacaagatacgcgc

SEQ ID NO: 103690 - DNA, 25 bp, E. coli
catttcaacatgaaactttgggcaa

SEQ ID NO: 103691 - DNA, 25 bp, E. coli
gatacgcgcagaagaatactttccg

SEQ ID NO: 103692 - DNA, 25 bp, E. coli
gatacgcgcagatgaatactttccg

SEQ ID NO: 103693 - DNA, 25 bp, E. coli
cacctttttggtgctaccgctgatt

SEQ ID NO: 103694 - DNA, 25 bp, E. coli
cacctttttggtcctaccgctgatt

SEQ ID NO: 103695 - DNA, 25 bp, E. coli
taccgctgatttctggtggtgcaac

SEQ ID NO: 103696 - DNA, 25 bp, E. coli
taccgctgatttgtggtggtgcaac

SEQ ID NO: 103697 - DNA, 25 bp, E. coli
tttttggtgctaccgctgatttgtg

SEQ ID NO: 103698 - DNA, 25 bp, E. coli
tttttggtgctagcgctgatttgtg

SEQ ID NO: 103699 - DNA, 25 bp, E. coli
tcttaaaccgcagctttttggtgct

SEQ ID NO: 103700 - DNA, 25 bp, E. coli
tgtggtggtgcatcccgtttgcgtt

SEQ ID NO: 103701 - DNA, 25 bp, E. coli
tgtggtggtgcaacccgtttgcgtt

SEQ ID NO: 103702 - DNA, 25 bp, E. coli
tgcaacccgtttccgttgcggctga

SEQ ID NO: 103703 - DNA, 25 bp, E. coli
tggtgcaacccgattgcgttgcggc

SEQ ID NO: 103704 - DNA, 25 bp, E. coli
tgcaacccgtttgcgttgcggctga

SEQ ID NO: 103705 - DNA, 25 bp, E. coli
tcttaaaccgcacctttttggtgct

SEQ ID NO: 103706 - DNA, 25 bp, E. coli
tgctaccgctgaattgtggtggtgc

SEQ ID NO: 103707 - DNA, 25 bp, E. coli
tgctaccgctgatttgtggtggtgc

SEQ ID NO: 103708 - DNA, 25 bp, E. coli
gatttgtggtggtgcaacccgtttg

SEQ ID NO: 103709 - DNA, 25 bp, E. coli
gatttgtggtggagcaacccgtttg

SEQ ID NO: 103710 - DNA, 25 bp, E. coli
gctgatttgtggtggtgcaacccgt

SEQ ID NO: 103711 - DNA, 25 bp, E. coli
gctgatttgtggaggtgcaacccgt

SEQ ID NO: 103712 - DNA, 25 bp, E. coli
ccgctgatttgtcgtggtgcaaccc

SEQ ID NO: 103713 - DNA, 25 bp, E. coli
ccgctgatttgtggtggtgcaaccc

SEQ ID NO: 103714 - DNA, 25 bp, E. coli
tggtgcaacccgtttgcgttgcggc

SEQ ID NO: 103715 - DNA, 25 bp, E. coli
caactttggcacatctattgctttg

SEQ ID NO: 103716 - DNA, 25 bp, E. coli
aatattctcctaaccaactttggca

SEQ ID NO: 103717 - DNA, 25 bp, E. coli
aatattctcctatccaactttggca

SEQ ID NO: 103718 - DNA, 25 bp, E. coli
caactttggcacttctattgctttg

SEQ ID NO: 103719 - DNA, 25 bp, E. coli
atttcggcacgctcaccggatgcgg

SEQ ID NO: 103720 - DNA, 25 bp, E. coli
acagcatcagtacaacctagttgca

SEQ ID NO: 103721 - DNA, 25 bp, E. coli
atttcggcacgcacaccggatgcgg

SEQ ID NO: 103722 - DNA, 25 bp, E. coli
acagcatcagtagaacctagttgca

SEQ ID NO: 103723 - DNA, 25 bp, E. coli
tagttgcaccacagtaatccagcgg

SEQ ID NO: 103724 - DNA, 25 bp, E. coli
tagttgcaccactgtaatccagcgg

SEQ ID NO: 103725 - DNA, 25 bp, E. coli
tcccttcttatcgtgccggaataca

SEQ ID NO: 103726 - DNA, 25 bp, E. coli
tcccttcttatcctgccggaataca

SEQ ID NO: 103727 - DNA, 25 bp, E. coli
gcggcatcagtgcattatccggata

SEQ ID NO: 103728 - DNA, 25 bp, E. coli
gcggcatcagtggattatccggata

SEQ ID NO: 103729 - DNA, 25 bp, E. coli
gctttgttatactaggcaaaccctg

SEQ ID NO: 103730 - DNA, 25 bp, E. coli
gctttgttatacaaggcaaaccctg

SEQ ID NO: 103731 - DNA, 25 bp, E. coli
ggaatacatcccatatttcggcacg

SEQ ID NO: 103732 - DNA, 25 bp, E. coli
ggaatacatcccttatttcggcacg

SEQ ID NO: 103733 - DNA, 25 bp, E. coli
taatccagcggtagcactaaaagag

SEQ ID NO: 103734 - DNA, 25 bp, E. coli
taatccagcggttgcactaaaagag

SEQ ID NO: 103735 - DNA, 25 bp, E. coli
tagccaaactaattgttacctaagg

SEQ ID NO: 103736 - DNA, 25 bp, E. coli
tagccaaactaaatgttacctaagg

SEQ ID NO: 103737 - DNA, 25 bp, E. coli
aatccacatacccaagtggacgtga

SEQ ID NO: 103738 - DNA, 25 bp, E. coli
gaatcggtcagcctcgatctaatga

SEQ ID NO: 103739 - DNA, 25 bp, E. coli
gaatcggtcagcgtcgatctaatga

SEQ ID NO: 103740 - DNA, 25 bp, E. coli
aatccacataccgaagtggacgtga

SEQ ID NO: 103741 - DNA, 25 bp, E. coli
cacagcgtcggtgccttccaggatg

SEQ ID NO: 103742 - DNA, 25 bp, E. coli
cacagcgtcggtcccttccaggatg

SEQ ID NO: 103743 - DNA, 25 bp, E. coli
cagatggtgcagaccgtactggaac

SEQ ID NO: 103744 - DNA, 25 bp, E. coli
cagatggtgcagtccgtactggaac

SEQ ID NO: 103745 - DNA, 25 bp, E. coli
aacatcctcaatgcacataccgaag

SEQ ID NO: 103746 - DNA, 25 bp, E. coli
aacatcctcaatccacataccgaag

SEQ ID NO: 103747 - DNA, 25 bp, E. coli
tcggtcagcctccatctaatgaaac

SEQ ID NO: 103748 - DNA, 25 bp, E. coli
tcggtcagcctcgatctaatgaaac

SEQ ID NO: 103749 - DNA, 25 bp, E. coli
cctcgatctaatgaaacgcagcaat

SEQ ID NO: 103750 - DNA, 25 bp, E. coli
cctcgatctaatcaaacgcagcaat

SEQ ID NO: 103751 - DNA, 25 bp, E. coli
gcagatggtgcactccgtactggaa

SEQ ID NO: 103752 - DNA, 25 bp, E. coli
gcagatggtgcagtccgtactggaa

SEQ ID NO: 103753 - DNA, 25 bp, E. coli
cgtcggtcccttgcaggatgagcaa

SEQ ID NO: 103754 - DNA, 25 bp, E. coli
cgtcggtcccttccaggatgagcaa

SEQ ID NO: 103755 - DNA, 25 bp, E. coli
ggtcagcctcgaactaatgaaacgc

SEQ ID NO: 103756 - DNA, 25 bp, E. coli
ggtcagcctcgatctaatgaaacgc

SEQ ID NO: 103757 - DNA, 25 bp, E. coli
tcagcctcgatcaaatgaaacgcag

SEQ ID NO: 103758 - DNA, 25 bp, E. coli
tcagcctcgatctaatgaaacgcag

SEQ ID NO: 103759 - DNA, 25 bp, E. coli
tatttaccgtgagtgtcagggcagc

SEQ ID NO: 103760 - DNA, 25 bp, E. coli
tttaaccggcgggaggctgaacgct

SEQ ID NO: 103761 - DNA, 25 bp, E. coli
tttaaccggcggcaggctgaacgct

SEQ ID NO: 103762 - DNA, 25 bp, E. coli
tatttaccgtgactgtcagggcagc

SEQ ID NO: 103763 - DNA, 25 bp, E. coli
ttttatgcctcaggcgacagactgg

SEQ ID NO: 103764 - DNA, 25 bp, E. coli
ttcgatttcgctaacccgctgcagg

SEQ ID NO: 103765 - DNA, 25 bp, E. coli
ttcgatttcgcttacccgctgcagg

SEQ ID NO: 103766 - DNA, 25 bp, E. coli
ttttatgcctcacgcgacagactgg

SEQ ID NO: 103767 - DNA, 25 bp, E. coli
tgaattttggcgaagctgagcaggc

SEQ ID NO: 103768 - DNA, 25 bp, E. coli
tgaattttggcgtagctgagcaggc

SEQ ID NO: 103769 - DNA, 25 bp, E. coli
tctcaactacgtgctggaaagtccg

SEQ ID NO: 103770 - DNA, 25 bp, E. coli
tctcaactacgtcctggaaagtccg

SEQ ID NO: 103771 - DNA, 25 bp, E. coli
tcccgctggatgagcagaaatcgct

SEQ ID NO: 103772 - DNA, 25 bp, E. coli
tcccgctggatgtgcagaaatcgct

SEQ ID NO: 103773 - DNA, 25 bp, E. coli
gaaactttccacgagcgcgtgctgg

SEQ ID NO: 103774 - DNA, 25 bp, E. coli
gaaactttccaccagcgcgtgctgg

SEQ ID NO: 103775 - DNA, 25 bp, E. coli
gattaaagactttggtgaggccggc

SEQ ID NO: 103776 - DNA, 25 bp, E. coli
gattaaagacttaggtgaggccggc

SEQ ID NO: 103777 - DNA, 25 bp, E. coli
gatttgccgcagtgaatgcgcctca

SEQ ID NO: 103778 - DNA, 25 bp, E. coli
gatttgccgcagagaatgcgcctca

SEQ ID NO: 103779 - DNA, 25 bp, E. coli
gtggataaaacgcaaatcgccggtg

SEQ ID NO: 103780 - DNA, 25 bp, E. coli
gtggataaaacggaaatcgccggtg

SEQ ID NO: 103781 - DNA, 25 bp, E. coli
aaggacgtgacggtgacgctgccgg

SEQ ID NO: 103782 - DNA, 25 bp, E. coli
aaggacgtgacgctgacgctgccgg

SEQ ID NO: 103783 - DNA, 25 bp, E. coli
atcacacacggcacgcttccttaag

SEQ ID NO: 103784 - DNA, 25 bp, E. coli
atcacacacggctcgcttccttaag

SEQ ID NO: 103785 - DNA, 25 bp, E. coli
tattcgcccgcgttggcgagccgcg

SEQ ID NO: 103786 - DNA, 25 bp, E. coli
tattcgcccgcgatggcgagccgcg

SEQ ID NO: 103787 - DNA, 25 bp, E. coli
tgtgatcgacattggcccgggcgca

SEQ ID NO: 103788 - DNA, 25 bp, E. coli
tgtgatcgacataggcccgggcgca

SEQ ID NO: 103789 - DNA, 25 bp, E. coli
tgacgctgccggtgggtctgtttac

SEQ ID NO: 103790 - DNA, 25 bp, E. coli
tgacgctgccggagggtctgtttac

SEQ ID NO: 103791 - DNA, 25 bp, E. coli
tgcgtttgttattcgcccgcgttgg

SEQ ID NO: 103792 - DNA, 25 bp, E. coli
tgcgtttgttatacgcccgcgttgg

SEQ ID NO: 103793 - DNA, 25 bp, E. coli
gcaaccacccttacaggcggtgaag

SEQ ID NO: 103794 - DNA, 25 bp, E. coli
gcaaccaccctttcaggcggtgaag

SEQ ID NO: 103795 - DNA, 25 bp, E. coli
cgccgctgaccatgtgatcgacatt

SEQ ID NO: 103796 - DNA, 25 bp, E. coli
cccgggcgcaggagttcacggcggt

SEQ ID NO: 103797 - DNA, 25 bp, E. coli
cgccgctgaccaagtgatcgacatt

SEQ ID NO: 103798 - DNA, 25 bp, E. coli
cccgggcgcaggtgttcacggcggt

SEQ ID NO: 103799 - DNA, 25 bp, E. coli
gaccatgtgatccacattggcccgg

SEQ ID NO: 103800 - DNA, 25 bp, E. coli
gagtgcgaagcatcacacacggcac

SEQ ID NO: 103801 - DNA, 25 bp, E. coli
gagtgcgaagcaacacacacggcac

SEQ ID NO: 103802 - DNA, 25 bp, E. coli
gaccatgtgatcgacattggcccgg

SEQ ID NO: 103803 - DNA, 25 bp, E. coli
caatgaagcccggtgaaaagcgggc

SEQ ID NO: 103804 - DNA, 25 bp, E. coli
caatgaagcccgctgaaaagcgggc

SEQ ID NO: 103805 - DNA, 25 bp, E. coli
aatccaggccaggattaaaagcggg

SEQ ID NO: 103806 - DNA, 25 bp, E. coli
aatccaggccagcattaaaagcggg

SEQ ID NO: 103807 - DNA, 25 bp, E. coli
caggccagcatttaaagcgggcttt

SEQ ID NO: 103808 - DNA, 25 bp, E. coli
caggccagcattaaaagcgggcttt

SEQ ID NO: 103809 - DNA, 25 bp, E. coli
aggcctacgcgtcccctgcaatatt

SEQ ID NO: 103810 - DNA, 25 bp, E. coli
aggcctacgcgtgccctgcaatatt

SEQ ID NO: 103811 - DNA, 25 bp, E. coli
aaagcgcactttgccagaaatccag

SEQ ID NO: 103812 - DNA, 25 bp, E. coli
aaaaacaatgaaccccgctgaaaag

SEQ ID NO: 103813 - DNA, 25 bp, E. coli
aaaaacaatgaagcccgctgaaaag

SEQ ID NO: 103814 - DNA, 25 bp, E. coli
aaagcgcactttcccagaaatccag

SEQ ID NO: 103815 - DNA, 25 bp, E. coli
gccagaaatccaggccagcattaaa

SEQ ID NO: 103816 - DNA, 25 bp, E. coli
gccagaaatccacgccagcattaaa

SEQ ID NO: 103817 - DNA, 25 bp, E. coli
gcactttgccagaaatccaggccag

SEQ ID NO: 103818 - DNA, 25 bp, E. coli
gcactttgccagtaatccaggccag

SEQ ID NO: 103819 - DNA, 25 bp, E. coli
gaaatccaggccagcattaaaagcg

SEQ ID NO: 103820 - DNA, 25 bp, E. coli
gaaatccaggcctgcattaaaagcg

SEQ ID NO: 103821 - DNA, 25 bp, E. coli
gaaaagcgggctgagactgatgaca

SEQ ID NO: 103822 - DNA, 25 bp, E. coli
gaaaagcgggctcagactgatgaca

SEQ ID NO: 103823 - DNA, 25 bp, E. coli
ggccagcattaatagcgggcttttt

SEQ ID NO: 103824 - DNA, 25 bp, E. coli
ggccagcattaaaagcgggcttttt

SEQ ID NO: 103825 - DNA, 25 bp, E. coli
caacctgtttgaagtggctgacggc

SEQ ID NO: 103826 - DNA, 25 bp, E. coli
caacgcaggtaaatccagcgcgctg

SEQ ID NO: 103827 - DNA, 25 bp, E. coli
caagctgcggcacaaactggatacc

SEQ ID NO: 103828 - DNA, 25 bp, E. coli
caagctgcggcagaaactggatacc

SEQ ID NO: 103829 - DNA, 25 bp, E. coli
caacctgtttgatgtggctgacggc

SEQ ID NO: 103830 - DNA, 25 bp, E. coli
caacgcaggtaattccagcgcgctg

SEQ ID NO: 103831 - DNA, 25 bp, E. coli
tacggttatgcggaagtcccggaag

SEQ ID NO: 103832 - DNA, 25 bp, E. coli
tacggttatgcgcaagtcccggaag

SEQ ID NO: 103833 - DNA, 25 bp, E. coli
ttttgcaggccgttccaacgcaggt

SEQ ID NO: 103834 - DNA, 25 bp, E. coli
ttttgcaggccgatccaacgcaggt

SEQ ID NO: 103835 - DNA, 25 bp, E. coli
tcccggaagagatgaagcgcaaatg

SEQ ID NO: 103836 - DNA, 25 bp, E. coli
tcccggaagagaagaagcgcaaatg

SEQ ID NO: 103837 - DNA, 25 bp, E. coli
gcgctgaacacgctgactaaccaga

SEQ ID NO: 103838 - DNA, 25 bp, E. coli
gcgctgaacacggtgactaaccaga

SEQ ID NO: 103839 - DNA, 25 bp, E. coli
gaaaagcctggctcgtacctcaaaa

SEQ ID NO: 103840 - DNA, 25 bp, E. coli
gaaaagcctggcacgtacctcaaaa

SEQ ID NO: 103841 - DNA, 25 bp, E. coli
gatattcgccatgcgctgaaagatt

SEQ ID NO: 103842 - DNA, 25 bp, E. coli
gatattcgccatccgctgaaagatt

SEQ ID NO: 103843 - DNA, 25 bp, E. coli
gagatgcagcctctagaagaaacgc

SEQ ID NO: 103844 - DNA, 25 bp, E. coli
gagatgcagcctgtagaagaaacgc

SEQ ID NO: 103845 - DNA, 25 bp, E. coli
gatgagtgcgccagatattcgccac

SEQ ID NO: 103846 - DNA, 25 bp, E. coli
gatgagtgcgcctgatattcgccac

SEQ ID NO: 103847 - DNA, 25 bp, E. coli
caggacaagacgaaaaattgacagc

SEQ ID NO: 103848 - DNA, 25 bp, E. coli
caggacaagacgtaaaattgacagc

SEQ ID NO: 103849 - DNA, 25 bp, E. coli
taaagaatgaatcgcagccaaggca

SEQ ID NO: 103850 - DNA, 25 bp, E. coli
taaagaatgaatggcagccaaggca

SEQ ID NO: 103851 - DNA, 25 bp, E. coli
ttttttgcagactcactcactgcgg

SEQ ID NO: 103852 - DNA, 25 bp, E. coli
ttttttgcagacacactcactgcgg

SEQ ID NO: 103853 - DNA, 25 bp, E. coli
tgtgcttttgcgcagaaatttcgcg

SEQ ID NO: 103854 - DNA, 25 bp, E. coli
tgtgcttttgcggagaaatttcgcg

SEQ ID NO: 103855 - DNA, 25 bp, E. coli
taaaaagaaaagattacgtgcctga

SEQ ID NO: 103856 - DNA, 25 bp, E. coli
tctttatcagcactaaactagtggg

SEQ ID NO: 103857 - DNA, 25 bp, E. coli
tctttatcagcagtaaactagtggg

SEQ ID NO: 103858 - DNA, 25 bp, E. coli
taaaaagaaaagtttacgtgcctga

SEQ ID NO: 103859 - DNA, 25 bp, E. coli
gccaaggcattcttcaaaaaattgt

SEQ ID NO: 103860 - DNA, 25 bp, E. coli
gccaaggcattcatcaaaaaattgt

SEQ ID NO: 103861 - DNA, 25 bp, E. coli
gaaacgtctggtatcaactgcccaa

SEQ ID NO: 103862 - DNA, 25 bp, E. coli
gaaatttcgcgatatggcaggacaa

SEQ ID NO: 103863 - DNA, 25 bp, E. coli
gaaatttcgcgaaatggcaggacaa

SEQ ID NO: 103864 - DNA, 25 bp, E. coli
gaaacgtctggtttcaactgcccaa

SEQ ID NO: 103865 - DNA, 25 bp, E. coli
gggtcgtaaaccacgtcatcaaggg

SEQ ID NO: 103866 - DNA, 25 bp, E. coli
gggtcgtaaacctcgtcatcaaggg

SEQ ID NO: 103867 - DNA, 25 bp, E. coli
tcactgcggttgactactaaatggg

SEQ ID NO: 103868 - DNA, 25 bp, E. coli
tcactgcggttgtctactaaatggg

SEQ ID NO: 103869 - DNA, 25 bp, E. coli
aagctgcacgagtgaaagtggcgca

SEQ ID NO: 103870 - DNA, 25 bp, E. coli
aagctgcacgagagaaagtggcgca

SEQ ID NO: 103871 - DNA, 25 bp, E. coli
acgagagaaagtggcgcaattactg

SEQ ID NO: 103872 - DNA, 25 bp, E. coli
accgcgcgttatgaagctgcacgag

SEQ ID NO: 103873 - DNA, 25 bp, E. coli
acgagagaaagtcgcgcaattactg

SEQ ID NO: 103874 - DNA, 25 bp, E. coli
accgcgcgttatcaagctgcacgag

SEQ ID NO: 103875 - DNA, 25 bp, E. coli
ttatgaagctgctcgagagaaagtg

SEQ ID NO: 103876 - DNA, 25 bp, E. coli
ttatgaagctgcacgagagaaagtg

SEQ ID NO: 103877 - DNA, 25 bp, E. coli
tgcaccggatgaaaaaactatcgtc

SEQ ID NO: 103878 - DNA, 25 bp, E. coli
tgaatgcaccggttgataaaactat

SEQ ID NO: 103879 - DNA, 25 bp, E. coli
tgcaccggatgataaaactatcgtc

SEQ ID NO: 103880 - DNA, 25 bp, E. coli
tgaatgcaccggatgataaaactat

SEQ ID NO: 103881 - DNA, 25 bp, E. coli
ccggatgataaaactatcgtctgga

SEQ ID NO: 103882 - DNA, 25 bp, E. coli
ccggatgataaatctatcgtctgga

SEQ ID NO: 103883 - DNA, 25 bp, E. coli
gctgcacgagagaaagtggcgcaat

SEQ ID NO: 103884 - DNA, 25 bp, E. coli
gctgcacgagagtaagtggcgcaat

SEQ ID NO: 103885 - DNA, 25 bp, E. coli
gcacgagagaaactggcgcaattac

SEQ ID NO: 103886 - DNA, 25 bp, E. coli
gcacgagagaaagtggcgcaattac

SEQ ID NO: 103887 - DNA, 25 bp, E. coli
cgctggcggaagttgcgctggcgaa

SEQ ID NO: 103888 - DNA, 25 bp, E. coli
cgctggcggaagatgcgctggcgaa

SEQ ID NO: 103889 - DNA, 25 bp, E. coli
cgcgttatgaagctgcacgagagaa

SEQ ID NO: 103890 - DNA, 25 bp, E. coli
cgcgttatgaaggtgcacgagagaa

SEQ ID NO: 103891 - DNA, 25 bp, E. coli
taccgcgtaacaacatcaagcgttg

SEQ ID NO: 103892 - DNA, 25 bp, E. coli
tagatgcggctgtacgcttatggca

SEQ ID NO: 103893 - DNA, 25 bp, E. coli
tacccgtgttatcgcttgaaagcgc

SEQ ID NO: 103894 - DNA, 25 bp, E. coli
tagatgcggctgaacgcttatggca

SEQ ID NO: 103895 - DNA, 25 bp, E. coli
tacccgtgttatggcttgaaagcgc

SEQ ID NO: 103896 - DNA, 25 bp, E. coli
taccgcgtaacatcatcaagcgttg

SEQ ID NO: 103897 - DNA, 25 bp, E. coli
tatttatacccagcaagcgacagag

SEQ ID NO: 103898 - DNA, 25 bp, E. coli
tatttatacccaccaagcgacagag

SEQ ID NO: 103899 - DNA, 25 bp, E. coli
ttgaagtagtaaacgtgatccacgc

SEQ ID NO: 103900 - DNA, 25 bp, E. coli
ttgaagtagtaatcgtgatccacgc

SEQ ID NO: 103901 - DNA, 25 bp, E. coli
tgtgctgccgttatccgaacatccg

SEQ ID NO: 103902 - DNA, 25 bp, E. coli
tgtgctgccgttttccgaacatccg

SEQ ID NO: 103903 - DNA, 25 bp, E. coli
tgctcgtttcgagatagatgcggct

SEQ ID NO: 103904 - DNA, 25 bp, E. coli
tgctcgtttcgacatagatgcggct

SEQ ID NO: 103905 - DNA, 25 bp, E. coli
tgcgtgagattgtagcccaccctaa

SEQ ID NO: 103906 - DNA, 25 bp, E. coli
tgcgtgagattgaagcccaccctaa

SEQ ID NO: 103907 - DNA, 25 bp, E. coli
gaaagcgcagataccgacctagatg

SEQ ID NO: 103908 - DNA, 25 bp, E. coli
gacagagtacctcgcttgcgtgaga

SEQ ID NO: 103909 - DNA, 25 bp, E. coli
gaaagcgcagattccgacctagatg

SEQ ID NO: 103910 - DNA, 25 bp, E. coli
gacagagtacctggcttgcgtgaga

SEQ ID NO: 103911 - DNA, 25 bp, E. coli
cgtgatccacgctagacgccagttt

SEQ ID NO: 103912 - DNA, 25 bp, E. coli
cgtgatccacgcaagacgccagttt

SEQ ID NO: 103913 - DNA, 25 bp, E. coli
caaacagattgggtatccggtggca

SEQ ID NO: 103914 - DNA, 25 bp, E. coli
caaacagattggctatccggtggca

SEQ ID NO: 103915 - DNA, 25 bp, E. coli
aacgtctgttgaacaccacggcagg

SEQ ID NO: 103916 - DNA, 25 bp, E. coli
aacgtctgttgatcaccacggcagg

SEQ ID NO: 103917 - DNA, 25 bp, E. coli
tgttgaacaccagggcaggaatgga

SEQ ID NO: 103918 - DNA, 25 bp, E. coli
tgttgaacaccacggcaggaatgga

SEQ ID NO: 103919 - DNA, 25 bp, E. coli
cctgcaagcgtatggtatgaatact

SEQ ID NO: 103920 - DNA, 25 bp, E. coli
cctgcaagcgtaaggtatgaatact

SEQ ID NO: 103921 - DNA, 25 bp, E. coli
gctcgactatttcgcgcgcgacagt

SEQ ID NO: 103922 - DNA, 25 bp, E. coli
gctcgactatttggcgcgcgacagt

SEQ ID NO: 103923 - DNA, 25 bp, E. coli
cgaacaattaagagatgcgcgacgt

SEQ ID NO: 103924 - DNA, 25 bp, E. coli
cgaacaattaagtgatgcgcgacgt

SEQ ID NO: 103925 - DNA, 25 bp, E. coli
ctatccggtggcactgaaattgcgc

SEQ ID NO: 103926 - DNA, 25 bp, E. coli
ctatccggtggctctgaaattgcgc

SEQ ID NO: 103927 - DNA, 25 bp, E. coli
gtatgaatactctccctacctggat

SEQ ID NO: 103928 - DNA, 25 bp, E. coli
gtagcccggcggctcaacgtctgtt

SEQ ID NO: 103929 - DNA, 25 bp, E. coli
gtagcccggcgggtcaacgtctgtt

SEQ ID NO: 103930 - DNA, 25 bp, E. coli
ggtacatattgcgaaacagattggc

SEQ ID NO: 103931 - DNA, 25 bp, E. coli
ggtacatattgccaaacagattggc

SEQ ID NO: 103932 - DNA, 25 bp, E. coli
gtatgaatactcaccctacctggat

SEQ ID NO: 103933 - DNA, 25 bp, E. coli
gatgaattgctcgactatttggcgc

SEQ ID NO: 103934 - DNA, 25 bp, E. coli
gatgaattgctccactatttggcgc

SEQ ID NO: 103935 - DNA, 25 bp, E. coli
caaggactggcgattgtgatgagca

SEQ ID NO: 103936 - DNA, 25 bp, E. coli
caaggactggcgtttgtgatgagca

SEQ ID NO: 103937 - DNA, 25 bp, E. coli
tagacaaaattctgagcgcgctgtg

SEQ ID NO: 103938 - DNA, 25 bp, E. coli
tagacaaaattcagagcgcgctgtg

SEQ ID NO: 103939 - DNA, 25 bp, E. coli
tatctttcacaagagcagacgccgc

SEQ ID NO: 103940 - DNA, 25 bp, E. coli
tatctttcacaacagcagacgccgc

SEQ ID NO: 103941 - DNA, 25 bp, E. coli
tcttgatgagcccatgaacagtctt

SEQ ID NO: 103942 - DNA, 25 bp, E. coli
tcttgatgagccgatgaacagtctt

SEQ ID NO: 103943 - DNA, 25 bp, E. coli
gctaaaaggtggaaaaatgctggcc

SEQ ID NO: 103944 - DNA, 25 bp, E. coli
gctaaaaggtggtaaaatgctggcc

SEQ ID NO: 103945 - DNA, 25 bp, E. coli
gaatggccggaaagaccagcggtaa

SEQ ID NO: 103946 - DNA, 25 bp, E. coli
gaatggccggaatgaccagcggtaa

SEQ ID NO: 103947 - DNA, 25 bp, E. coli
cgccgtctggatttcgaaggtcaca

SEQ ID NO: 103948 - DNA, 25 bp, E. coli
cgccgtctggatatcgaaggtcaca

SEQ ID NO: 103949 - DNA, 25 bp, E. coli
cggtgaatggcaacgcgtacgtctt

SEQ ID NO: 103950 - DNA, 25 bp, E. coli
cggtgaatggcatcgcgtacgtctt

SEQ ID NO: 103951 - DNA, 25 bp, E. coli
gtagcaccaatctactttccggcgg

SEQ ID NO: 103952 - DNA, 25 bp, E. coli
gtagcaccaatcaactttccggcgg

SEQ ID NO: 103953 - DNA, 25 bp, E. coli
taagagtaccttactggcgcgaatg

SEQ ID NO: 103954 - DNA, 25 bp, E. coli
taagagtacctttctggcgcgaatg

SEQ ID NO: 103955 - DNA, 25 bp, E. coli
gataaaacgcgttccgaactactga

SEQ ID NO: 103956 - DNA, 25 bp, E. coli
gataaaacgcgtaccgaactactga

SEQ ID NO: 103957 - DNA, 25 bp, E. coli
aactgaccgggcattgtactctggc

SEQ ID NO: 103958 - DNA, 25 bp, E. coli
cagaatggttagcagagatgcgtcc

SEQ ID NO: 103959 - DNA, 25 bp, E. coli
cagaatggttaggagagatgcgtcc

SEQ ID NO: 103960 - DNA, 25 bp, E. coli
tactctggcgcagcttgacgaggcg

SEQ ID NO: 103961 - DNA, 25 bp, E. coli
tactctggcgcaccttgacgaggcg

SEQ ID NO: 103962 - DNA, 25 bp, E. coli
cggttttttacgtgcgagcacgacg

SEQ ID NO: 103963 - DNA, 25 bp, E. coli
cggttttttacgagcgagcacgacg

SEQ ID NO: 103964 - DNA, 25 bp, E. coli
aactgaccgggctttgtactctggc

SEQ ID NO: 103965 - DNA, 25 bp, E. coli
tatgacctacgtagaatcggctgct

SEQ ID NO: 103966 - DNA, 25 bp, E. coli
tatgacctacgttgaatcggctgct

SEQ ID NO: 103967 - DNA, 25 bp, E. coli
ttatcgatcaggagaaagcggcggt

SEQ ID NO: 103968 - DNA, 25 bp, E. coli
ttatcgatcaggtgaaagcggcggt

SEQ ID NO: 103969 - DNA, 25 bp, E. coli
tccgtggtttatcgtggcacagaac

SEQ ID NO: 103970 - DNA, 25 bp, E. coli
tccgtggtttatggtggcacagaac

SEQ ID NO: 103971 - DNA, 25 bp, E. coli
gacggcggaaatgtgtaagctcacc

SEQ ID NO: 103972 - DNA, 25 bp, E. coli
ggaaatcgctgatctgatcgcccag

SEQ ID NO: 103973 - DNA, 25 bp, E. coli
ggaaatcgctgaactgatcgcccag

SEQ ID NO: 103974 - DNA, 25 bp, E. coli
taacgtctgggatctgattcgcctg

SEQ ID NO: 103975 - DNA, 25 bp, E. coli
tcaacattgcttactgcccggaacg

SEQ ID NO: 103976 - DNA, 25 bp, E. coli
taacgtctgggaactgattcgcctg

SEQ ID NO: 103977 - DNA, 25 bp, E. coli
tcaacattgctttctgcccggaacg

SEQ ID NO: 103978 - DNA, 25 bp, E. coli
gacggcggaaatctgtaagctcacc

SEQ ID NO: 103979 - DNA, 25 bp, E. coli
caacttcttagtgccgtaatgatgt

SEQ ID NO: 103980 - DNA, 25 bp, E. coli
caacttcttagtcccgtaatgatgt

SEQ ID NO: 103981 - DNA, 25 bp, E. coli
atctggcacaacatcgagtcggtga

SEQ ID NO: 103982 - DNA, 25 bp, E. coli
atctggcacaacttcgagtcggtga

SEQ ID NO: 103983 - DNA, 25 bp, E. coli
taccctcaccacaggcgtggttctt

SEQ ID NO: 103984 - DNA, 25 bp, E. coli
taccctcaccactggcgtggttctt

SEQ ID NO: 103985 - DNA, 25 bp, E. coli
cgctggcaacttcttagtgccgtaa

SEQ ID NO: 103986 - DNA, 25 bp, E. coli
cgctggcaacttgttagtgccgtaa

SEQ ID NO: 103987 - DNA, 25 bp, E. coli
cttagtgccgtaatgatgtttctgg

SEQ ID NO: 103988 - DNA, 25 bp, E. coli
cttcttcgctgggaacttcttagtg

SEQ ID NO: 103989 - DNA, 25 bp, E. coli
ctggcacaacatggagtcggtgatg

SEQ ID NO: 103990 - DNA, 25 bp, E. coli
cttcttcgctggcaacttcttagtg

SEQ ID NO: 103991 - DNA, 25 bp, E. coli
ctggcacaacatcgagtcggtgatg

SEQ ID NO: 103992 - DNA, 25 bp, E. coli
cttagtgccgtattgatgtttctgg

SEQ ID NO: 103993 - DNA, 25 bp, E. coli
ggttgcttggcaacacaatggcgga

SEQ ID NO: 103994 - DNA, 25 bp, E. coli
gtggttcttcttcgctggcaacttc

SEQ ID NO: 103995 - DNA, 25 bp, E. coli
ggttgcttggcatcacaatggcgga

SEQ ID NO: 103996 - DNA, 25 bp, E. coli
gtggttcttcttggctggcaacttc

SEQ ID NO: 103997 - DNA, 25 bp, E. coli
tggctaccctcagcactggcgtggt

SEQ ID NO: 103998 - DNA, 25 bp, E. coli
ggcgtggttcttcttcgctggcaac

SEQ ID NO: 103999 - DNA, 25 bp, E. coli
ggcgtggttcttgttcgctggcaac

SEQ ID NO: 104000 - DNA, 25 bp, E. coli
tggctaccctcaccactggcgtggt

SEQ ID NO: 104001 - DNA, 25 bp, E. coli
taaaatagcctaatgggacaggcgc

SEQ ID NO: 104002 - DNA, 25 bp, E. coli
tactctaagagcgtaccgcagtagg

SEQ ID NO: 104003 - DNA, 25 bp, E. coli
taaaatagcctattgggacaggcgc

SEQ ID NO: 104004 - DNA, 25 bp, E. coli
tactctaagagcctaccgcagtagg

SEQ ID NO: 104005 - DNA, 25 bp, E. coli
tgaggatttcgagcataacccaggg

SEQ ID NO: 104006 - DNA, 25 bp, E. coli
tgaggatttcgaccataacccaggg

SEQ ID NO: 104007 - DNA, 25 bp, E. coli
taacccagggcctaactgacaaata

SEQ ID NO: 104008 - DNA, 25 bp, E. coli
taacccagggccaaactgacaaata

SEQ ID NO: 104009 - DNA, 25 bp, E. coli
tcgtcacttttactctaagagccta

SEQ ID NO: 104010 - DNA, 25 bp, E. coli
tcgtcacttttagtctaagagccta

SEQ ID NO: 104011 - DNA, 25 bp, E. coli
cctaccgcagtaggcgtaattgttg

SEQ ID NO: 104012 - DNA, 25 bp, E. coli
cctaccgcagtacgcgtaattgttg

SEQ ID NO: 104013 - DNA, 25 bp, E. coli
gcttattttcatatgaggaccgcac

SEQ ID NO: 104014 - DNA, 25 bp, E. coli
gcttattttcatttgaggaccgcac

SEQ ID NO: 104015 - DNA, 25 bp, E. coli
gcattatagctaataagcgcgtcat

SEQ ID NO: 104016 - DNA, 25 bp, E. coli
gcattatagctattaagcgcgtcat

SEQ ID NO: 104017 - DNA, 25 bp, E. coli
cgcgtcatgtcataaagttgagggc

SEQ ID NO: 104018 - DNA, 25 bp, E. coli
cgcgtcatgtcaaaaagttgagggc

SEQ ID NO: 104019 - DNA, 25 bp, E. coli
ggacaggcgctatgaaaattgttgc

SEQ ID NO: 104020 - DNA, 25 bp, E. coli
ggacaggcgctaagaaaattgttgc

SEQ ID NO: 104021 - DNA, 25 bp, E. coli
taagaaaattgttgcgcattatagc

SEQ ID NO: 104022 - DNA, 25 bp, E. coli
taagaaaattgtagcgcattatagc

SEQ ID NO: 104023 - DNA, 25 bp, E. coli
tactggctgcatggaagacatatcg

SEQ ID NO: 104024 - DNA, 25 bp, E. coli
tacaacagtagcagcggatgttgag

SEQ ID NO: 104025 - DNA, 25 bp, E. coli
tacaacagtagctgcggatgttgag

SEQ ID NO: 104026 - DNA, 25 bp, E. coli
tactggctgcatcgaagacatatcg

SEQ ID NO: 104027 - DNA, 25 bp, E. coli
atattgcgacggaggaagaggcatc

SEQ ID NO: 104028 - DNA, 25 bp, E. coli
atattgcgacggtggaagaggcatc

SEQ ID NO: 104029 - DNA, 25 bp, E. coli
tagatttggatattgcgacggagga

SEQ ID NO: 104030 - DNA, 25 bp, E. coli
tagatttggataatgcgacggagga

SEQ ID NO: 104031 - DNA, 25 bp, E. coli
ttacctggttgtggccggatggaga

SEQ ID NO: 104032 - DNA, 25 bp, E. coli
ttacctggttgtcgccggatggaga

SEQ ID NO: 104033 - DNA, 25 bp, E. coli
tgttgatacaacagtagcagcggat

SEQ ID NO: 104034 - DNA, 25 bp, E. coli
tgagtggccagtcgccccacaataa

SEQ ID NO: 104035 - DNA, 25 bp, E. coli
tgttgatacaactgtagcagcggat

SEQ ID NO: 104036 - DNA, 25 bp, E. coli
tgagtggccagtggccccacaataa

SEQ ID NO: 104037 - DNA, 25 bp, E. coli
gctgcatggaagtcatatcgggtat

SEQ ID NO: 104038 - DNA, 25 bp, E. coli
gctgcatggaagacatatcgggtat

SEQ ID NO: 104039 - DNA, 25 bp, E. coli
cggatgttgagtcgccagtcgcccc

SEQ ID NO: 104040 - DNA, 25 bp, E. coli
cttcaggatgccgtagatttggata

SEQ ID NO: 104041 - DNA, 25 bp, E. coli
cttcaggatgccctagatttggata

SEQ ID NO: 104042 - DNA, 25 bp, E. coli
cggatgttgagtggccagtcgcccc

SEQ ID NO: 104043 - DNA, 25 bp, E. coli
ggaagaggcatcgttactggctgca

SEQ ID NO: 104044 - DNA, 25 bp, E. coli
ggaagaggcatccttactggctgca

SEQ ID NO: 104045 - DNA, 25 bp, E. coli
catccggcattatccggcattatcc

SEQ ID NO: 104046 - DNA, 25 bp, E. coli
catccggcattaaccggcattatcc

SEQ ID NO: 104047 - DNA, 25 bp, E. coli
cattgactacaaacttaacgttgtt

SEQ ID NO: 104048 - DNA, 25 bp, E. coli
cattgactacaatcttaacgttgtt

SEQ ID NO: 104049 - DNA, 25 bp, E. coli
attgccatccggcattatccggcat

SEQ ID NO: 104050 - DNA, 25 bp, E. coli
attgccatccgggattatccggcat

SEQ ID NO: 104051 - DNA, 25 bp, E. coli
tatccggcattgactacaaacttaa

SEQ ID NO: 104052 - DNA, 25 bp, E. coli
tatccggcattaaccggcattgact

SEQ ID NO: 104053 - DNA, 25 bp, E. coli
tatccggcattgtctacaaacttaa

SEQ ID NO: 104054 - DNA, 25 bp, E. coli
tatccggcattatccggcattgact

SEQ ID NO: 104055 - DNA, 25 bp, E. coli
tgactacaaactaaacgttgttcgt

SEQ ID NO: 104056 - DNA, 25 bp, E. coli
tgactacaaacttaacgttgttcgt

SEQ ID NO: 104057 - DNA, 25 bp, E. coli
tccggcattgacaacaaacttaacg

SEQ ID NO: 104058 - DNA, 25 bp, E. coli
tccggcattgactacaaacttaacg

SEQ ID NO: 104059 - DNA, 25 bp, E. coli
gccatccggcattatccggcattat

SEQ ID NO: 104060 - DNA, 25 bp, E. coli
gccatccggcataatccggcattat

SEQ ID NO: 104061 - DNA, 25 bp, E. coli
gcattatccggctttgactacaaac

SEQ ID NO: 104062 - DNA, 25 bp, E. coli
gcattatccggcattgactacaaac

SEQ ID NO: 104063 - DNA, 25 bp, E. coli
gcattatccggcattatccggcatt

SEQ ID NO: 104064 - DNA, 25 bp, E. coli
gcattatccggctttatccggcatt

SEQ ID NO: 104065 - DNA, 25 bp, E. coli
ggcattgactacaaacttaacgttg

SEQ ID NO: 104066 - DNA, 25 bp, E. coli
ggcattgactactaacttaacgttg

SEQ ID NO: 104067 - DNA, 25 bp, E. coli
caataaattggccatgaatgctgat

SEQ ID NO: 104068 - DNA, 25 bp, E. coli
caataaattggcgatgaatgctgat

SEQ ID NO: 104069 - DNA, 25 bp, E. coli
caaattgatggtcgattgatgcaaa

SEQ ID NO: 104070 - DNA, 25 bp, E. coli
caaaacgcatatatagcggttggca

SEQ ID NO: 104071 - DNA, 25 bp, E. coli
caaaacgcatatttagcggttggca

SEQ ID NO: 104072 - DNA, 25 bp, E. coli
caaattgatggtggattgatgcaaa

SEQ ID NO: 104073 - DNA, 25 bp, E. coli
catcatctttaaacgatgcgcggaa

SEQ ID NO: 104074 - DNA, 25 bp, E. coli
catcatctttaatcgatgcgcggaa

SEQ ID NO: 104075 - DNA, 25 bp, E. coli
tattcccatcgctgaaaacgacgca

SEQ ID NO: 104076 - DNA, 25 bp, E. coli
tattcccatcgcagaaaacgacgca

SEQ ID NO: 104077 - DNA, 25 bp, E. coli
tgccattaagacattgaagttgctg

SEQ ID NO: 104078 - DNA, 25 bp, E. coli
tgccattaagactttgaagttgctg

SEQ ID NO: 104079 - DNA, 25 bp, E. coli
gaacaagcggaaataaatagagcag

SEQ ID NO: 104080 - DNA, 25 bp, E. coli
gaacaagcggaattaaatagagcag

SEQ ID NO: 104081 - DNA, 25 bp, E. coli
cgatgcgcggaattatttaacttga

SEQ ID NO: 104082 - DNA, 25 bp, E. coli
cgatgcgcggaaatatttaacttga

SEQ ID NO: 104083 - DNA, 25 bp, E. coli
gtctccaggccccaaagtaaataat

SEQ ID NO: 104084 - DNA, 25 bp, E. coli
gtctccaggcccgaaagtaaataat

SEQ ID NO: 104085 - DNA, 25 bp, E. coli
ggctgtgcgctctaaaaataatcta

SEQ ID NO: 104086 - DNA, 25 bp, E. coli
ggctgtgcgctcaaaaaataatcta

SEQ ID NO: 104087 - DNA, 25 bp, E. coli
taattgcaatggtgttagctgcggc

SEQ ID NO: 104088 - DNA, 25 bp, E. coli
taattgcaatggagttagctgcggc

SEQ ID NO: 104089 - DNA, 25 bp, E. coli
taaaagaagtcggtattcgcgccat

SEQ ID NO: 104090 - DNA, 25 bp, E. coli
taaaagaagtcgctattcgcgccat

SEQ ID NO: 104091 - DNA, 25 bp, E. coli
tatgacagagccgtcgattatcgcc

SEQ ID NO: 104092 - DNA, 25 bp, E. coli
tatgacagagccctcgattatcgcc

SEQ ID NO: 104093 - DNA, 25 bp, E. coli
tgattacacataatagcccgcttgg

SEQ ID NO: 104094 - DNA, 25 bp, E. coli
tgattacacatattagcccgcttgg

SEQ ID NO: 104095 - DNA, 25 bp, E. coli
tggtccttacaatatcaacggcgat

SEQ ID NO: 104096 - DNA, 25 bp, E. coli
tggtccttacaaaatcaacggcgat

SEQ ID NO: 104097 - DNA, 25 bp, E. coli
tgaacgcggcgttaagctggaactg

SEQ ID NO: 104098 - DNA, 25 bp, E. coli
tgaacccggccaacaaagatcaggt

SEQ ID NO: 104099 - DNA, 25 bp, E. coli
tgaacccggccatcaaagatcaggt

SEQ ID NO: 104100 - DNA, 25 bp, E. coli
tgaatatctgcaccggctgtggtcc

SEQ ID NO: 104101 - DNA, 25 bp, E. coli
tgaatatctgcagcggctgtggtcc

SEQ ID NO: 104102 - DNA, 25 bp, E. coli
tgaacgcggcgtaaagctggaactg

SEQ ID NO: 104103 - DNA, 25 bp, E. coli
tgccgctggtgatagaaaatcgccg

SEQ ID NO: 104104 - DNA, 25 bp, E. coli
tgccgctggtgaaagaaaatcgccg

SEQ ID NO: 104105 - DNA, 25 bp, E. coli
gaattattcgcggtttgcaggccaa

SEQ ID NO: 104106 - DNA, 25 bp, E. coli
gaattattcgcgctttgcaggccaa

SEQ ID NO: 104107 - DNA, 25 bp, E. coli
gatgaaaaaatccatgccgctggtg

SEQ ID NO: 104108 - DNA, 25 bp, E. coli
gagtatttgtatccccgtcgcgtcg

SEQ ID NO: 104109 - DNA, 25 bp, E. coli
gagtatttgtatgcccgtcgcgtcg

SEQ ID NO: 104110 - DNA, 25 bp, E. coli
gatgaaaaaatcgatgccgctggtg

SEQ ID NO: 104111 - DNA, 25 bp, E. coli
catcgaatttttgatgttgccgcta

SEQ ID NO: 104112 - DNA, 25 bp, E. coli
catcgaatttttcatgttgccgcta

SEQ ID NO: 104113 - DNA, 25 bp, E. coli
taaaatcatttggagatgcgctctg

SEQ ID NO: 104114 - DNA, 25 bp, E. coli
taaaaagacagttcaaacaggatca

SEQ ID NO: 104115 - DNA, 25 bp, E. coli
taaaaagacagtacaaacaggatca

SEQ ID NO: 104116 - DNA, 25 bp, E. coli
taaaatcatttgcagatgcgctctg

SEQ ID NO: 104117 - DNA, 25 bp, E. coli
tatcagactcatgagggtgccattt

SEQ ID NO: 104118 - DNA, 25 bp, E. coli
tatctctaacctctgggtcctctgc

SEQ ID NO: 104119 - DNA, 25 bp, E. coli
tatcagactcatcagggtgccattt

SEQ ID NO: 104120 - DNA, 25 bp, E. coli
tatctctaacctgtgggtcctctgc

SEQ ID NO: 104121 - DNA, 25 bp, E. coli
tgttgccgctaatcagccataaaat

SEQ ID NO: 104122 - DNA, 25 bp, E. coli
tgttgccgctaaacagccataaaat

SEQ ID NO: 104123 - DNA, 25 bp, E. coli
gcgctctgtcgaggtagtctcataa

SEQ ID NO: 104124 - DNA, 25 bp, E. coli
gcgctctgtcgacgtagtctcataa

SEQ ID NO: 104125 - DNA, 25 bp, E. coli
ggtgccattttgagcatatgcggac

SEQ ID NO: 104126 - DNA, 25 bp, E. coli
ggtgccattttgtgcatatgcggac

SEQ ID NO: 104127 - DNA, 25 bp, E. coli
tgggtcctctgcataatccttaaac

SEQ ID NO: 104128 - DNA, 25 bp, E. coli
tgggtcctctgcttaatccttaaac

SEQ ID NO: 104129 - DNA, 25 bp, E. coli
taaggttcgtttatagatcgacggc

SEQ ID NO: 104130 - DNA, 25 bp, E. coli
taaggttcgtttttagatcgacggc

SEQ ID NO: 104131 - DNA, 25 bp, E. coli
gatcgacggcaatgtgagttacctt

SEQ ID NO: 104132 - DNA, 25 bp, E. coli
gatcgacggcaaagtgagttacctt

SEQ ID NO: 104133 - DNA, 25 bp, E. coli
caggactttctccggttaacgacag

SEQ ID NO: 104134 - DNA, 25 bp, E. coli
catttgcagataatggagctggaag

SEQ ID NO: 104135 - DNA, 25 bp, E. coli
caggactttctcgggttaacgacag

SEQ ID NO: 104136 - DNA, 25 bp, E. coli
catttgcagatattggagctggaag

SEQ ID NO: 104137 - DNA, 25 bp, E. coli
tattactggcaggagttctgctggc

SEQ ID NO: 104138 - DNA, 25 bp, E. coli
tattactggcagcagttctgctggc

SEQ ID NO: 104139 - DNA, 25 bp, E. coli
tgtactggacgacccgaaagtggat

SEQ ID NO: 104140 - DNA, 25 bp, E. coli
tgtactggacgagccgaaagtggat

SEQ ID NO: 104141 - DNA, 25 bp, E. coli
tgaaaagcatataaaagttggcgtt

SEQ ID NO: 104142 - DNA, 25 bp, E. coli
tgaaaagcatattaaagttggcgtt

SEQ ID NO: 104143 - DNA, 25 bp, E. coli
gacccgaaagtggatgtagcgatta

SEQ ID NO: 104144 - DNA, 25 bp, E. coli
cgaccagagcagcagcgatgaaaag

SEQ ID NO: 104145 - DNA, 25 bp, E. coli
cgaccagagcaggagcgatgaaaag

SEQ ID NO: 104146 - DNA, 25 bp, E. coli
gataatccacgccatttgcagataa

SEQ ID NO: 104147 - DNA, 25 bp, E. coli
gataatccacgcgatttgcagataa

SEQ ID NO: 104148 - DNA, 25 bp, E. coli
gggccgcattattactggcaggagt

SEQ ID NO: 104149 - DNA, 25 bp, E. coli
gggccgcattataactggcaggagt

SEQ ID NO: 104150 - DNA, 25 bp, E. coli
ggcacagttgccacgtgtactggac

SEQ ID NO: 104151 - DNA, 25 bp, E. coli
ggcacagttgcctcgtgtactggac

SEQ ID NO: 104152 - DNA, 25 bp, E. coli
gagcagcagcgaagaaaagcatatt

SEQ ID NO: 104153 - DNA, 25 bp, E. coli
gacccgaaagtgcatgtagcgatta

SEQ ID NO: 104154 - DNA, 25 bp, E. coli
gagcagcagcgatgaaaagcatatt

SEQ ID NO: 104155 - DNA, 25 bp, E. coli
aataccgcgatctaaaacgctgtcg

SEQ ID NO: 104156 - DNA, 25 bp, E. coli
aataccgcgatcaaaaacgctgtcg

SEQ ID NO: 104157 - DNA, 25 bp, E. coli
caccgatggcttactgaaactgaaa

SEQ ID NO: 104158 - DNA, 25 bp, E. coli
caccgatggctttctgaaactgaaa

SEQ ID NO: 104159 - DNA, 25 bp, E. coli
cagtggtccggtagctgcgtacagc

SEQ ID NO: 104160 - DNA, 25 bp, E. coli
cagtggtccggttgctgcgtacagc

SEQ ID NO: 104161 - DNA, 25 bp, E. coli
aaactgcttgatgaagctgaacgcc

SEQ ID NO: 104162 - DNA, 25 bp, E. coli
aaactgcttgatcaagctgaacgcc

SEQ ID NO: 104163 - DNA, 25 bp, E. coli
tttaccacggaaaaagatctccagc

SEQ ID NO: 104164 - DNA, 25 bp, E. coli
tttaccacggaataagatctccagc

SEQ ID NO: 104165 - DNA, 25 bp, E. coli
tgaaaacgaactgcagctccagcgt

SEQ ID NO: 104166 - DNA, 25 bp, E. coli
tgaaaacgaactccagctccagcgt

SEQ ID NO: 104167 - DNA, 25 bp, E. coli
gccgatgttaacaacgtaccgcaaa

SEQ ID NO: 104168 - DNA, 25 bp, E. coli
gccgatgttaactacgtaccgcaaa

SEQ ID NO: 104169 - DNA, 25 bp, E. coli
cgctgaccagcgtagtgaacaaaca

SEQ ID NO: 104170 - DNA, 25 bp, E. coli
cgatgctcaacgacacggaaagtta

SEQ ID NO: 104171 - DNA, 25 bp, E. coli
cgctgaccagcgaagtgaacaaaca

SEQ ID NO: 104172 - DNA, 25 bp, E. coli
cgatgctcaacgtcacggaaagtta

SEQ ID NO: 104173 - DNA, 25 bp, E. coli
ggttgctcgtcataccaccgatggc

SEQ ID NO: 104174 - DNA, 25 bp, E. coli
ggttgctcgtcaaaccaccgatggc

SEQ ID NO: 104175 - DNA, 25 bp, E. coli
tggacaccggtcgatcaatctaaaa

SEQ ID NO: 104176 - DNA, 25 bp, E. coli
tggacaccggtccatcaatctaaaa

SEQ ID NO: 104177 - DNA, 25 bp, E. coli
cagacgtttcgcacctgagcaggca

SEQ ID NO: 104178 - DNA, 25 bp, E. coli
cagacgtttcgctcctgagcaggca

SEQ ID NO: 104179 - DNA, 25 bp, E. coli
aaacaatctcgccttccaggtcgtc

SEQ ID NO: 104180 - DNA, 25 bp, E. coli
aaacaatctcgcgttccaggtcgtc

SEQ ID NO: 104181 - DNA, 25 bp, E. coli
tgagcaggcagtctctgcggcaaaa

SEQ ID NO: 104182 - DNA, 25 bp, E. coli
tggtcactaaaatacaatctcgcgt

SEQ ID NO: 104183 - DNA, 25 bp, E. coli
tggtcactaaaaaacaatctcgcgt

SEQ ID NO: 104184 - DNA, 25 bp, E. coli
tgaggtattaaatgaagcggcgcgc

SEQ ID NO: 104185 - DNA, 25 bp, E. coli
tgagcaggcagtgtctgcggcaaaa

SEQ ID NO: 104186 - DNA, 25 bp, E. coli
tgaggtattaaaagaagcggcgcgc

SEQ ID NO: 104187 - DNA, 25 bp, E. coli
ccaaaaaggtttcgatgctgtcagt

SEQ ID NO: 104188 - DNA, 25 bp, E. coli
ccaaaaaggtttggatgctgtcagt

SEQ ID NO: 104189 - DNA, 25 bp, E. coli
gcggcaaaagtgctttttcaccaaa

SEQ ID NO: 104190 - DNA, 25 bp, E. coli
gctgcgctggctctatggttcttga

SEQ ID NO: 104191 - DNA, 25 bp, E. coli
gctgcgctggctgtatggttcttga

SEQ ID NO: 104192 - DNA, 25 bp, E. coli
gcggcaaaagtggtttttcaccaaa

SEQ ID NO: 104193 - DNA, 25 bp, E. coli
gatatagccaaaacggcggctgcgc

SEQ ID NO: 104194 - DNA, 25 bp, E. coli
gttccaggtcgtgccagacgtttcg

SEQ ID NO: 104195 - DNA, 25 bp, E. coli
gatatagccaaatcggcggctgcgc

SEQ ID NO: 104196 - DNA, 25 bp, E. coli
gttccaggtcgtcccagacgtttcg

SEQ ID NO: 104197 - DNA, 25 bp, E. coli
ggagtgcctggcagaggtattaaaa

SEQ ID NO: 104198 - DNA, 25 bp, E. coli
ggagtgcctggctgaggtattaaaa

SEQ ID NO: 104199 - DNA, 25 bp, E. coli
caacttccgcttatggcacagaacg

SEQ ID NO: 104200 - DNA, 25 bp, E. coli
caacttccgcttttggcacagaacg

SEQ ID NO: 104201 - DNA, 25 bp, E. coli
cattaacattgaagacgaccagggc

SEQ ID NO: 104202 - DNA, 25 bp, E. coli
caggcttgagcgtgaagcggacact

SEQ ID NO: 104203 - DNA, 25 bp, E. coli
catcggctgattgcgtagcagggcc

SEQ ID NO: 104204 - DNA, 25 bp, E. coli
caggcttgagcgagaagcggacact

SEQ ID NO: 104205 - DNA, 25 bp, E. coli
cagggccactggtatctgccggtat

SEQ ID NO: 104206 - DNA, 25 bp, E. coli
cagggccactggaatctgccggtat

SEQ ID NO: 104207 - DNA, 25 bp, E. coli
catcggctgattccgtagcagggcc

SEQ ID NO: 104208 - DNA, 25 bp, E. coli
agccagaaatatcccgagccagcgg

SEQ ID NO: 104209 - DNA, 25 bp, E. coli
agccagaaatatgccgagccagcgg

SEQ ID NO: 104210 - DNA, 25 bp, E. coli
ttagcaaacgctttctggtctgccg

SEQ ID NO: 104211 - DNA, 25 bp, E. coli
ttagcaaacgctatctggtctgccg

SEQ ID NO: 104212 - DNA, 25 bp, E. coli
tgtgaatagctactgtaaatgcccc

SEQ ID NO: 104213 - DNA, 25 bp, E. coli
tgtgaatagctagtgtaaatgcccc

SEQ ID NO: 104214 - DNA, 25 bp, E. coli
tccgcctgatagatcgtgatgccga

SEQ ID NO: 104215 - DNA, 25 bp, E. coli
tccgcctgatagttcgtgatgccga

SEQ ID NO: 104216 - DNA, 25 bp, E. coli
gctatatccacacgtcaggcatccg

SEQ ID NO: 104217 - DNA, 25 bp, E. coli
gctatatccacaggtcaggcatccg

SEQ ID NO: 104218 - DNA, 25 bp, E. coli
cattaacattgatgacgaccagggc

SEQ ID NO: 104219 - DNA, 25 bp, E. coli
cattatttttagtgggcgtctggca

SEQ ID NO: 104220 - DNA, 25 bp, E. coli
cattatttttagagggcgtctggca

SEQ ID NO: 104221 - DNA, 25 bp, E. coli
aagcaggaatttttattatctcccc

SEQ ID NO: 104222 - DNA, 25 bp, E. coli
cagctgttgcagtggtttcgtgcag

SEQ ID NO: 104223 - DNA, 25 bp, E. coli
cagctgttgcagaggtttcgtgcag

SEQ ID NO: 104224 - DNA, 25 bp, E. coli
tacaggctcgcaattctgattaacg

SEQ ID NO: 104225 - DNA, 25 bp, E. coli
tacaggctcgcatttctgattaacg

SEQ ID NO: 104226 - DNA, 25 bp, E. coli
agggtgtggtactggctcgcaattc

SEQ ID NO: 104227 - DNA, 25 bp, E. coli
accgtcatcggacgagatataactg

SEQ ID NO: 104228 - DNA, 25 bp, E. coli
accgtcatcggaggagatataactg

SEQ ID NO: 104229 - DNA, 25 bp, E. coli
agggtgtggtacaggctcgcaattc

SEQ ID NO: 104230 - DNA, 25 bp, E. coli
aagcaggaatttatattatctcccc

SEQ ID NO: 104231 - DNA, 25 bp, E. coli
aacagctgttgctgtggtttcgtgc

SEQ ID NO: 104232 - DNA, 25 bp, E. coli
aacagctgttgcagtggtttcgtgc

SEQ ID NO: 104233 - DNA, 25 bp, E. coli
tgaagaaatacattaagcaggaatt

SEQ ID NO: 104234 - DNA, 25 bp, E. coli
tgaagaaatacaataagcaggaatt

SEQ ID NO: 104235 - DNA, 25 bp, E. coli
tctgattaacgagctgtccaggtag

SEQ ID NO: 104236 - DNA, 25 bp, E. coli
tctgattaacgacctgtccaggtag

SEQ ID NO: 104237 - DNA, 25 bp, E. coli
cctgtccaggtagtatgaagaaata

SEQ ID NO: 104238 - DNA, 25 bp, E. coli
cctgtccaggtactatgaagaaata

SEQ ID NO: 104239 - DNA, 25 bp, E. coli
gcaattctgatttacgacctgtcca

SEQ ID NO: 104240 - DNA, 25 bp, E. coli
gcaattctgattaacgacctgtcca

SEQ ID NO: 104241 - DNA, 25 bp, E. coli
cccgattaccgtgatcggaggagat

SEQ ID NO: 104242 - DNA, 25 bp, E. coli
cccgattaccgtcatcggaggagat

SEQ ID NO: 104243 - DNA, 25 bp, E. coli
tacggctatcaaggtcgatgatcgc

SEQ ID NO: 104244 - DNA, 25 bp, E. coli
tacggctatcaacgtcgatgatcgc

SEQ ID NO: 104245 - DNA, 25 bp, E. coli
taaagtcatgctcggcctggatgcg

SEQ ID NO: 104246 - DNA, 25 bp, E. coli
taaagtcatgctgggcctggatgcg

SEQ ID NO: 104247 - DNA, 25 bp, E. coli
agtttgctcggcaatcgtcttggcg

SEQ ID NO: 104248 - DNA, 25 bp, E. coli
ggtaaacggactgactttcaactgg

SEQ ID NO: 104249 - DNA, 25 bp, E. coli
ggtaaacggactcactttcaactgg

SEQ ID NO: 104250 - DNA, 25 bp, E. coli
agtttgctcggctatcgtcttggcg

SEQ ID NO: 104251 - DNA, 25 bp, E. coli
tgcgcaacagaccacttttgccggg

SEQ ID NO: 104252 - DNA, 25 bp, E. coli
tgcgcaacagacgacttttgccggg

SEQ ID NO: 104253 - DNA, 25 bp, E. coli
tcgcttatcaggaaccggtaaacgg

SEQ ID NO: 104254 - DNA, 25 bp, E. coli
tcgcttttgccaacgtgccggatgt

SEQ ID NO: 104255 - DNA, 25 bp, E. coli
tcgcttttgccatcgtgccggatgt

SEQ ID NO: 104256 - DNA, 25 bp, E. coli
tcgcttatcaggtaccggtaaacgg

SEQ ID NO: 104257 - DNA, 25 bp, E. coli
tctggttggctcgatcactgaccgc

SEQ ID NO: 104258 - DNA, 25 bp, E. coli
tctggttggctccatcactgaccgc

SEQ ID NO: 104259 - DNA, 25 bp, E. coli
cattcgtgtgatcggcactatcggc

SEQ ID NO: 104260 - DNA, 25 bp, E. coli
cattcgtgtgatgggcactatcggc

SEQ ID NO: 104261 - DNA, 25 bp, E. coli
gatcgcgatattgcgttgacacaag

SEQ ID NO: 104262 - DNA, 25 bp, E. coli
gatcgcgatattccgttgacacaag

SEQ ID NO: 104263 - DNA, 25 bp, E. coli
gaccgaagttgggatgaaaaacgcc

SEQ ID NO: 104264 - DNA, 25 bp, E. coli
gaccgaagttggcatgaaaaacgcc

SEQ ID NO: 104265 - DNA, 25 bp, E. coli
aatgatcaccgaagaaagccgtccg

SEQ ID NO: 104266 - DNA, 25 bp, E. coli
aatgatcaccgatgaaagccgtccg

SEQ ID NO: 104267 - DNA, 25 bp, E. coli
catgagcgacttaggtattccggcc

SEQ ID NO: 104268 - DNA, 25 bp, E. coli
catgagcgactttggtattccggcc

SEQ ID NO: 104269 - DNA, 25 bp, E. coli
taaaactgatcgaaaacaatgcgcg

SEQ ID NO: 104270 - DNA, 25 bp, E. coli
taaaactgatcgtaaacaatgcgcg

SEQ ID NO: 104271 - DNA, 25 bp, E. coli
tagcaaaatgaaggagaacctgccg

SEQ ID NO: 104272 - DNA, 25 bp, E. coli
tagcaaaatgaacgagaacctgccg

SEQ ID NO: 104273 - DNA, 25 bp, E. coli
tatcgataagaccaaagcactgagc

SEQ ID NO: 104274 - DNA, 25 bp, E. coli
tatcgatacgacagaatgctggccg

SEQ ID NO: 104275 - DNA, 25 bp, E. coli
tatcgatacgactgaatgctggccg

SEQ ID NO: 104276 - DNA, 25 bp, E. coli
tatcgataagacgaaagcactgagc

SEQ ID NO: 104277 - DNA, 25 bp, E. coli
tgcattccagaatagcccggtaggt

SEQ ID NO: 104278 - DNA, 25 bp, E. coli
tgcattccagaaaagcccggtaggt

SEQ ID NO: 104279 - DNA, 25 bp, E. coli
tgaaatcggcgcacactatccgggc

SEQ ID NO: 104280 - DNA, 25 bp, E. coli
tgaaatcggcgctcactatccgggc

SEQ ID NO: 104281 - DNA, 25 bp, E. coli
tgcgtgtgaaaatcatgctgccgtc

SEQ ID NO: 104282 - DNA, 25 bp, E. coli
tgcgtgtgaaaaacatgctgccgtc

SEQ ID NO: 104283 - DNA, 25 bp, E. coli
taacgagcacatgtatcttgacccg

SEQ ID NO: 104284 - DNA, 25 bp, E. coli
taacgagcacatctatcttgacccg

SEQ ID NO: 104285 - DNA, 25 bp, E. coli
gatgtaagcctgaatgacctgcgtt

SEQ ID NO: 104286 - DNA, 25 bp, E. coli
gatgtaagcctgtatgacctgcgtt

SEQ ID NO: 104287 - DNA, 25 bp, E. coli
caagtaaatattggcaacccgagct

SEQ ID NO: 104288 - DNA, 25 bp, E. coli
aatattggcaacccgagctggaagc

SEQ ID NO: 104289 - DNA, 25 bp, E. coli
aatattggcaacgcgagctggaagc

SEQ ID NO: 104290 - DNA, 25 bp, E. coli
caagtaaatattcgcaacccgagct

SEQ ID NO: 104291 - DNA, 25 bp, E. coli
cagcctgcggccatttttgtcttta

SEQ ID NO: 104292 - DNA, 25 bp, E. coli
cacaagtaaatattggcaacccgag

SEQ ID NO: 104293 - DNA, 25 bp, E. coli
cagcctgcggccttttttgtcttta

SEQ ID NO: 104294 - DNA, 25 bp, E. coli
cacaagtaaataatggcaacccgag

SEQ ID NO: 104295 - DNA, 25 bp, E. coli
taaatattggcatcccgagctggaa

SEQ ID NO: 104296 - DNA, 25 bp, E. coli
taaatattggcaacccgagctggaa

SEQ ID NO: 104297 - DNA, 25 bp, E. coli
agtaaatattggcaacccgagctgg

SEQ ID NO: 104298 - DNA, 25 bp, E. coli
agtaaatattgggaacccgagctgg

SEQ ID NO: 104299 - DNA, 25 bp, E. coli
aaatattggcaagccgagctggaag

SEQ ID NO: 104300 - DNA, 25 bp, E. coli
aaatattggcaacccgagctggaag

SEQ ID NO: 104301 - DNA, 25 bp, E. coli
acaagtaaatattggcaacccgagc

SEQ ID NO: 104302 - DNA, 25 bp, E. coli
acaagtaaatataggcaacccgagc

SEQ ID NO: 104303 - DNA, 25 bp, E. coli
gcctgcggccatttttgtctttatc

SEQ ID NO: 104304 - DNA, 25 bp, E. coli
tccacaagtaaatattggcaacccg

SEQ ID NO: 104305 - DNA, 25 bp, E. coli
gcctgcggccatatttgtctttatc

SEQ ID NO: 104306 - DNA, 25 bp, E. coli
tccacaagtaaaaattggcaacccg

SEQ ID NO: 104307 - DNA, 25 bp, E. coli
gtaaatattggcaacccgagctgga

SEQ ID NO: 104308 - DNA, 25 bp, E. coli
gtaaatattggctacccgagctgga

SEQ ID NO: 104309 - DNA, 25 bp, E. coli
aatgctcatgttgcgcgcagtctgc

SEQ ID NO: 104310 - DNA, 25 bp, E. coli
aatgctcatgttccgcgcagtctgc

SEQ ID NO: 104311 - DNA, 25 bp, E. coli
taaaatcgtggtaagacctgccggg

SEQ ID NO: 104312 - DNA, 25 bp, E. coli
taaaatcgtggttagacctgccggg

SEQ ID NO: 104313 - DNA, 25 bp, E. coli
ttttcaacatttaatacactacgaa

SEQ ID NO: 104314 - DNA, 25 bp, E. coli
ttttcaacattttatacactacgaa

SEQ ID NO: 104315 - DNA, 25 bp, E. coli
gcgcagtctgcgaggttatgagtaa

SEQ ID NO: 104316 - DNA, 25 bp, E. coli
gcgcagtctgcgtggttatgagtaa

SEQ ID NO: 104317 - DNA, 25 bp, E. coli
ccgcgatttgcagaaaatgctcatg

SEQ ID NO: 104318 - DNA, 25 bp, E. coli
ccgcgatttgcacaaaatgctcatg

SEQ ID NO: 104319 - DNA, 25 bp, E. coli
cgtggttatgagtaataattagtgc

SEQ ID NO: 104320 - DNA, 25 bp, E. coli
cgtggttatgagaaataattagtgc

SEQ ID NO: 104321 - DNA, 25 bp, E. coli
ggatttagttgctaatttttcaaca

SEQ ID NO: 104322 - DNA, 25 bp, E. coli
ggcctcaaaataacgtaaaatcgtg

SEQ ID NO: 104323 - DNA, 25 bp, E. coli
ggatttagttgcaaatttttcaaca

SEQ ID NO: 104324 - DNA, 25 bp, E. coli
ggcctcaaaatatcgtaaaatcgtg

SEQ ID NO: 104325 - DNA, 25 bp, E. coli
taataattagtgcaaaatgatttgc

SEQ ID NO: 104326 - DNA, 25 bp, E. coli
taataattagtggaaaatgatttgc

SEQ ID NO: 104327 - DNA, 25 bp, E. coli
gtgcaaaatgatatgcgttattggg

SEQ ID NO: 104328 - DNA, 25 bp, E. coli
gacctgccgggaattagttgcaaat

SEQ ID NO: 104329 - DNA, 25 bp, E. coli
gtgcaaaatgatttgcgttattggg

SEQ ID NO: 104330 - DNA, 25 bp, E. coli
gacctgccgggatttagttgcaaat

SEQ ID NO: 104331 - DNA, 25 bp, E. coli
cagttattcggcttgcacggcgcaa

SEQ ID NO: 104332 - DNA, 25 bp, E. coli
catgaaatgctacgtgcgcgggtac

SEQ ID NO: 104333 - DNA, 25 bp, E. coli
catgaaatgctaggtgcgcgggtac

SEQ ID NO: 104334 - DNA, 25 bp, E. coli
cagttattcggcatgcacggcgcaa

SEQ ID NO: 104335 - DNA, 25 bp, E. coli
tagtacgtaacgatcggccttgcca

SEQ ID NO: 104336 - DNA, 25 bp, E. coli
tagtacgtaacgttcggccttgcca

SEQ ID NO: 104337 - DNA, 25 bp, E. coli
tagttctcgatagggtcacgctggc

SEQ ID NO: 104338 - DNA, 25 bp, E. coli
tagttctcgatacggtcacgctggc

SEQ ID NO: 104339 - DNA, 25 bp, E. coli
tatgcacgcgatgaggcctattggc

SEQ ID NO: 104340 - DNA, 25 bp, E. coli
tatgcacgcgatcaggcctattggc

SEQ ID NO: 104341 - DNA, 25 bp, E. coli
tgcatttcaactgggacgcggtcga

SEQ ID NO: 104342 - DNA, 25 bp, E. coli
tgctggtaatgatacgtcgctgcct

SEQ ID NO: 104343 - DNA, 25 bp, E. coli
tgcatttcaactcggacgcggtcga

SEQ ID NO: 104344 - DNA, 25 bp, E. coli
tgctggtaatgaaacgtcgctgcct

SEQ ID NO: 104345 - DNA, 25 bp, E. coli
tctacatcacagtagtcgagggccc

SEQ ID NO: 104346 - DNA, 25 bp, E. coli
tctacatcacagaagtcgagggccc

SEQ ID NO: 104347 - DNA, 25 bp, E. coli
cattgacggatgatcagcgcgccta

SEQ ID NO: 104348 - DNA, 25 bp, E. coli
cattgacggatgttcagcgcgccta

SEQ ID NO: 104349 - DNA, 25 bp, E. coli
gtaaatagttctctggcgctgccca

SEQ ID NO: 104350 - DNA, 25 bp, E. coli
gtaaatagttctgtggcgctgccca

SEQ ID NO: 104351 - DNA, 25 bp, E. coli
gatgctgactgccttccaactggtg

SEQ ID NO: 104352 - DNA, 25 bp, E. coli
gatgctgactgcgttccaactggtg

SEQ ID NO: 104353 - DNA, 25 bp, E. coli
cgcaattttgttataagccataccg

SEQ ID NO: 104354 - DNA, 25 bp, E. coli
cgcaattttgttttaagccataccg

SEQ ID NO: 104355 - DNA, 25 bp, E. coli
tttgttttaagccataccgacctga

SEQ ID NO: 104356 - DNA, 25 bp, E. coli
ttgttttaagccataccgacctgat

SEQ ID NO: 104357 - DNA, 25 bp, E. coli
ttgttttaagccttaccgacctgat

SEQ ID NO: 104358 - DNA, 25 bp, E. coli
tttgttttaagcgataccgacctga

SEQ ID NO: 104359 - DNA, 25 bp, E. coli
tgttttaagccaaaccgacctgatg

SEQ ID NO: 104360 - DNA, 25 bp, E. coli
tgttttaagccataccgacctgatg

SEQ ID NO: 104361 - DNA, 25 bp, E. coli
tcgctgcgcaattttgttttaagcc

SEQ ID NO: 104362 - DNA, 25 bp, E. coli
tgcgcaattttgttttaagccatac

SEQ ID NO: 104363 - DNA, 25 bp, E. coli
tgcgcaattttgatttaagccatac

SEQ ID NO: 104364 - DNA, 25 bp, E. coli
tcgctgcgcaatattgttttaagcc

SEQ ID NO: 104365 - DNA, 25 bp, E. coli
ccgtcgctgcgcaattttgttttaa

SEQ ID NO: 104366 - DNA, 25 bp, E. coli
ccgtcgctgcgctattttgttttaa

SEQ ID NO: 104367 - DNA, 25 bp, E. coli
gctgcgcaatttagttttaagccat

SEQ ID NO: 104368 - DNA, 25 bp, E. coli
gctgcgcaattttgttttaagccat

SEQ ID NO: 104369 - DNA, 25 bp, E. coli
gcaattttgtttaaagccataccga

SEQ ID NO: 104370 - DNA, 25 bp, E. coli
gcaattttgttttaagccataccga

SEQ ID NO: 104371 - DNA, 25 bp, E. coli
cgctgcgcaattatgttttaagcca

SEQ ID NO: 104372 - DNA, 25 bp, E. coli
cgctgcgcaattttgttttaagcca

SEQ ID NO: 104373 - DNA, 25 bp, E. coli
cgtcgctgcgcaattttgttttaag

SEQ ID NO: 104374 - DNA, 25 bp, E. coli
cgtcgctgcgcatttttgttttaag

SEQ ID NO: 104375 - DNA, 25 bp, E. coli
tacatgccgcagctggtttaagtaa

SEQ ID NO: 104376 - DNA, 25 bp, E. coli
tacatgccgcaggtggtttaagtaa

SEQ ID NO: 104377 - DNA, 25 bp, E. coli
atgtcggcggtgatcacgctggttc

SEQ ID NO: 104378 - DNA, 25 bp, E. coli
atgtcggcggtgttcacgctggttc

SEQ ID NO: 104379 - DNA, 25 bp, E. coli
tattctcggcaacaatttcgcaatt

SEQ ID NO: 104380 - DNA, 25 bp, E. coli
tattctcggcaagaatttcgcaatt

SEQ ID NO: 104381 - DNA, 25 bp, E. coli
tggtgttcgggaattcagtttatgc

SEQ ID NO: 104382 - DNA, 25 bp, E. coli
gaatttcgcaatacttgcgcgccgc

SEQ ID NO: 104383 - DNA, 25 bp, E. coli
gaatttcgcaattcttgcgcgccgc

SEQ ID NO: 104384 - DNA, 25 bp, E. coli
cgctggttctcgctgcgttgctgct

SEQ ID NO: 104385 - DNA, 25 bp, E. coli
cgctggttctcggtgcgttgctgct

SEQ ID NO: 104386 - DNA, 25 bp, E. coli
cggtgatcacgcaggttctcggtgc

SEQ ID NO: 104387 - DNA, 25 bp, E. coli
cggtgatcacgctggttctcggtgc

SEQ ID NO: 104388 - DNA, 25 bp, E. coli
gtagacacgctggaaaccatcgatc

SEQ ID NO: 104389 - DNA, 25 bp, E. coli
gtagacacgctgcaaaccatcgatc

SEQ ID NO: 104390 - DNA, 25 bp, E. coli
ggatttcagtttttgcaatgcgtaa

SEQ ID NO: 104391 - DNA, 25 bp, E. coli
ggatttcagtttatgcaatgcgtaa

SEQ ID NO: 104392 - DNA, 25 bp, E. coli
tggtttaagtaatgcggtagacacg

SEQ ID NO: 104393 - DNA, 25 bp, E. coli
tggtgttcgggatttcagtttatgc

SEQ ID NO: 104394 - DNA, 25 bp, E. coli
tggtttaagtaaagcggtagacacg

SEQ ID NO: 104395 - DNA, 25 bp, E. coli
taatgcggtagacacgctgcaaacc

SEQ ID NO: 104396 - DNA, 25 bp, E. coli
taatgcggtagagacgctgcaaacc

SEQ ID NO: 104397 - DNA, 25 bp, E. coli
aacgctgctaactaccagttgaaat

SEQ ID NO: 104398 - DNA, 25 bp, E. coli
tacatccgatataggaactttattc

SEQ ID NO: 104399 - DNA, 25 bp, E. coli
tacatccgatattggaactttattc

SEQ ID NO: 104400 - DNA, 25 bp, E. coli
aacgctgctaacaaccagttgaaat

SEQ ID NO: 104401 - DNA, 25 bp, E. coli
taaaataacccagattgatactaat

SEQ ID NO: 104402 - DNA, 25 bp, E. coli
taaaataacccacattgatactaat

SEQ ID NO: 104403 - DNA, 25 bp, E. coli
ccagttgaaatatataaatcttgat

SEQ ID NO: 104404 - DNA, 25 bp, E. coli
ccagttgaaataaataaatcttgat

SEQ ID NO: 104405 - DNA, 25 bp, E. coli
gccaaaaacacttcaaaactggaat

SEQ ID NO: 104406 - DNA, 25 bp, E. coli
gccaaaaacactacaaaactggaat

SEQ ID NO: 104407 - DNA, 25 bp, E. coli
gctaagtctgaatagtaatgctctt

SEQ ID NO: 104408 - DNA, 25 bp, E. coli
gctaagtctgaaaagtaatgctctt

SEQ ID NO: 104409 - DNA, 25 bp, E. coli
ccccataataaatcagagcaaaact

SEQ ID NO: 104410 - DNA, 25 bp, E. coli
ccccataataaaacagagcaaaact

SEQ ID NO: 104411 - DNA, 25 bp, E. coli
cattgatactaaaaatacatccgat

SEQ ID NO: 104412 - DNA, 25 bp, E. coli
cattgatactaataatacatccgat

SEQ ID NO: 104413 - DNA, 25 bp, E. coli
gttgcaggtaataaaaatgaactct

SEQ ID NO: 104414 - DNA, 25 bp, E. coli
gttgcaggtaattaaaatgaactct

SEQ ID NO: 104415 - DNA, 25 bp, E. coli
taataaaaatgatctcttactgctg

SEQ ID NO: 104416 - DNA, 25 bp, E. coli
taataaaaatgaactcttactgctg

SEQ ID NO: 104417 - DNA, 25 bp, E. coli
tgcacatttaaacgccaaaaacact

SEQ ID NO: 104418 - DNA, 25 bp, E. coli
tgcacatttaaaggccaaaaacact

SEQ ID NO: 104419 - DNA, 25 bp, E. coli
catccgaggcactggcatttaaaaa

SEQ ID NO: 104420 - DNA, 25 bp, E. coli
catccgaggcacaggcatttaaaaa

SEQ ID NO: 104421 - DNA, 25 bp, E. coli
catttaaaaatgcagaagccgcaca

SEQ ID NO: 104422 - DNA, 25 bp, E. coli
tactggctggctctagttcacccac

SEQ ID NO: 104423 - DNA, 25 bp, E. coli
tactggctggctgtagttcacccac

SEQ ID NO: 104424 - DNA, 25 bp, E. coli
tatcagtcaggtgtatataacgtca

SEQ ID NO: 104425 - DNA, 25 bp, E. coli
tatcatcacacaggaaaagtcgcct

SEQ ID NO: 104426 - DNA, 25 bp, E. coli
tatcagtcaggtctatataacgtca

SEQ ID NO: 104427 - DNA, 25 bp, E. coli
tatcatcacacacgaaaagtcgcct

SEQ ID NO: 104428 - DNA, 25 bp, E. coli
gcccaggcggcaaagaaagccattt

SEQ ID NO: 104429 - DNA, 25 bp, E. coli
cctgctggcggtaatattactggct

SEQ ID NO: 104430 - DNA, 25 bp, E. coli
cctgctggcggttatattactggct

SEQ ID NO: 104431 - DNA, 25 bp, E. coli
gcccaggcggcatagaaagccattt

SEQ ID NO: 104432 - DNA, 25 bp, E. coli
gaacagcagcgtgaggcggctattt

SEQ ID NO: 104433 - DNA, 25 bp, E. coli
gaacagcagcgtcaggcggctattt

SEQ ID NO: 104434 - DNA, 25 bp, E. coli
cattaaatcgttatccctgctggcg

SEQ ID NO: 104435 - DNA, 25 bp, E. coli
cattaaatcgttttccctgctggcg

SEQ ID NO: 104436 - DNA, 25 bp, E. coli
catttaaaaatggagaagccgcaca

SEQ ID NO: 104437 - DNA, 25 bp, E. coli
ggcatgacctttagaatgagcagta

SEQ ID NO: 104438 - DNA, 25 bp, E. coli
ggctattttaagtgcatccgaggca

SEQ ID NO: 104439 - DNA, 25 bp, E. coli
ggctattttaagagcatccgaggca

SEQ ID NO: 104440 - DNA, 25 bp, E. coli
ggcatgaccttttgaatgagcagta

SEQ ID NO: 104441 - DNA, 25 bp, E. coli
cagagtacgaagatttattggcacg

SEQ ID NO: 104442 - DNA, 25 bp, E. coli
cagagtacgaagttttattggcacg

SEQ ID NO: 104443 - DNA, 25 bp, E. coli
tagaatctattaggccccaactcgc

SEQ ID NO: 104444 - DNA, 25 bp, E. coli
tagaatctattacgccccaactcgc

SEQ ID NO: 104445 - DNA, 25 bp, E. coli
tgttacactggcttgaccaagaggc

SEQ ID NO: 104446 - DNA, 25 bp, E. coli
tgttacactggcatgaccaagaggc

SEQ ID NO: 104447 - DNA, 25 bp, E. coli
cctcgccttatataaatgcttcggg

SEQ ID NO: 104448 - DNA, 25 bp, E. coli
cctcgccttataaaaatgcttcggg

SEQ ID NO: 104449 - DNA, 25 bp, E. coli
gaacctctattggaagggcacgcga

SEQ ID NO: 104450 - DNA, 25 bp, E. coli
gaacctctattgcaagggcacgcga

SEQ ID NO: 104451 - DNA, 25 bp, E. coli
gattcaatttaataccgcctcgcct

SEQ ID NO: 104452 - DNA, 25 bp, E. coli
gattcaatttaaaaccgcctcgcct

SEQ ID NO: 104453 - DNA, 25 bp, E. coli
ggtataataaatggacccgaggtcg

SEQ ID NO: 104454 - DNA, 25 bp, E. coli
ggtataataaatcgacccgaggtcg

SEQ ID NO: 104455 - DNA, 25 bp, E. coli
ggctgttccatcttcaaaagaagag

SEQ ID NO: 104456 - DNA, 25 bp, E. coli
ggctgttccatcatcaaaagaagag

SEQ ID NO: 104457 - DNA, 25 bp, E. coli
ggcgtttagcactgaaattctaccg

SEQ ID NO: 104458 - DNA, 25 bp, E. coli
ggcgtttagcacagaaattctaccg

SEQ ID NO: 104459 - DNA, 25 bp, E. coli
ggaaaataagcagcaactcgtggct

SEQ ID NO: 104460 - DNA, 25 bp, E. coli
ggaaaataagcaccaactcgtggct

SEQ ID NO: 104461 - DNA, 25 bp, E. coli
gattagcgtagccaatctggtttcc

SEQ ID NO: 104462 - DNA, 25 bp, E. coli
gattagcgtagcgaatctggtttcc

SEQ ID NO: 104463 - DNA, 25 bp, E. coli
caaaaactgaaggaagggtggcagc

SEQ ID NO: 104464 - DNA, 25 bp, E. coli
caccgggcggtggagtatgcaaata

SEQ ID NO: 104465 - DNA, 25 bp, E. coli
caccgggcggtgcagtatgcaaata

SEQ ID NO: 104466 - DNA, 25 bp, E. coli
caaaaactgaagcaagggtggcagc

SEQ ID NO: 104467 - DNA, 25 bp, E. coli
tatgtcatacggagagggactgcca

SEQ ID NO: 104468 - DNA, 25 bp, E. coli
tatgtcatacggtgagggactgcca

SEQ ID NO: 104469 - DNA, 25 bp, E. coli
tatggtgcggagatcatccagccag

SEQ ID NO: 104470 - DNA, 25 bp, E. coli
tatggtgcggagttcatccagccag

SEQ ID NO: 104471 - DNA, 25 bp, E. coli
tattaaacagttagcgcgtcgcagt

SEQ ID NO: 104472 - DNA, 25 bp, E. coli
tattactatgtgttcgcgcttgctg

SEQ ID NO: 104473 - DNA, 25 bp, E. coli
tattactatgtgatcgcgcttgctg

SEQ ID NO: 104474 - DNA, 25 bp, E. coli
tattaaacagtttgcgcgtcgcagt

SEQ ID NO: 104475 - DNA, 25 bp, E. coli
ttgccggatacaatcgacagccctg

SEQ ID NO: 104476 - DNA, 25 bp, E. coli
ttgccggatacattcgacagccctg

SEQ ID NO: 104477 - DNA, 25 bp, E. coli
ccttatggtagtccgctgatttcga

SEQ ID NO: 104478 - DNA, 25 bp, E. coli
ccttatggtagtgcgctgatttcga

SEQ ID NO: 104479 - DNA, 25 bp, E. coli
gacagccctgatgcacgtattaaac

SEQ ID NO: 104480 - DNA, 25 bp, E. coli
gacagccctgatccacgtattaaac

SEQ ID NO: 104481 - DNA, 25 bp, E. coli
gatttcgacagctggttatggtgcg

SEQ ID NO: 104482 - DNA, 25 bp, E. coli
gatttcgacagcaggttatggtgcg

SEQ ID NO: 104483 - DNA, 25 bp, E. coli
gggagcatctcatcaccagaggagc

SEQ ID NO: 104484 - DNA, 25 bp, E. coli
gggagcatctcaacaccagaggagc

SEQ ID NO: 104485 - DNA, 25 bp, E. coli
tacgctgccagcaaaagcgatggcg

SEQ ID NO: 104486 - DNA, 25 bp, E. coli
aaagcgccgtggttccatcatcagg

SEQ ID NO: 104487 - DNA, 25 bp, E. coli
aaagcgccgtggatccatcatcagg

SEQ ID NO: 104488 - DNA, 25 bp, E. coli
taccgtgcggtctgataaactgcct

SEQ ID NO: 104489 - DNA, 25 bp, E. coli
tacgctgccagctaaagcgatggcg

SEQ ID NO: 104490 - DNA, 25 bp, E. coli
taccgtgcggtcagataaactgcct

SEQ ID NO: 104491 - DNA, 25 bp, E. coli
tataccgactggaatgaaacgcagc

SEQ ID NO: 104492 - DNA, 25 bp, E. coli
tataccgactggtatgaaacgcagc

SEQ ID NO: 104493 - DNA, 25 bp, E. coli
ttgcggcaaaaaggctggaagtgct

SEQ ID NO: 104494 - DNA, 25 bp, E. coli
ttgattgaggagtcatcgcagccgg

SEQ ID NO: 104495 - DNA, 25 bp, E. coli
ttgcggcaaaaacgctggaagtgct

SEQ ID NO: 104496 - DNA, 25 bp, E. coli
ttgattgaggagacatcgcagccgg

SEQ ID NO: 104497 - DNA, 25 bp, E. coli
gaaaaaatagtcttcgcccatcgcg

SEQ ID NO: 104498 - DNA, 25 bp, E. coli
gaaaaaccttaggatggcgatcatg

SEQ ID NO: 104499 - DNA, 25 bp, E. coli
gaaaaaatagtcatcgcccatcgcg

SEQ ID NO: 104500 - DNA, 25 bp, E. coli
gaaaaaccttagcatggcgatcatg

SEQ ID NO: 104501 - DNA, 25 bp, E. coli
gatatttgccggagcatacgctgcc

SEQ ID NO: 104502 - DNA, 25 bp, E. coli
gatatttgccggtgcatacgctgcc

SEQ ID NO: 104503 - DNA, 25 bp, E. coli
ggtagtgcatccttataccgtgcgg

SEQ ID NO: 104504 - DNA, 25 bp, E. coli
ggtaatatcaaagtcactggcatgg

SEQ ID NO: 104505 - DNA, 25 bp, E. coli
ggtaatatcaaactcactggcatgg

SEQ ID NO: 104506 - DNA, 25 bp, E. coli
ggtagtgcatccatataccgtgcgg

SEQ ID NO: 104507 - DNA, 25 bp, E. coli
caggaacacaggattacggacaggc

SEQ ID NO: 104508 - DNA, 25 bp, E. coli
caggaacacaggtttacggacaggc

SEQ ID NO: 104509 - DNA, 25 bp, E. coli
taaatttcagggaaacatgccgggt

SEQ ID NO: 104510 - DNA, 25 bp, E. coli
taaatttcagggtaacatgccgggt

SEQ ID NO: 104511 - DNA, 25 bp, E. coli
tacacccggtagatcaggctggcgg

SEQ ID NO: 104512 - DNA, 25 bp, E. coli
tacacccggtagttcaggctggcgg

SEQ ID NO: 104513 - DNA, 25 bp, E. coli
tatcctggcgtgaagcagtcagacc

SEQ ID NO: 104514 - DNA, 25 bp, E. coli
tatggtaccggctgtgaaattcagc

SEQ ID NO: 104515 - DNA, 25 bp, E. coli
tatggtaccggcagtgaaattcagc

SEQ ID NO: 104516 - DNA, 25 bp, E. coli
tattgcgcgtacacagggagaactg

SEQ ID NO: 104517 - DNA, 25 bp, E. coli
tatcctggcgtgtagcagtcagacc

SEQ ID NO: 104518 - DNA, 25 bp, E. coli
tatcttgcgaaactgcgtgacacgc

SEQ ID NO: 104519 - DNA, 25 bp, E. coli
tattgcgcgtactcagggagaactg

SEQ ID NO: 104520 - DNA, 25 bp, E. coli
tatcttgcgaaagtgcgtgacacgc

SEQ ID NO: 104521 - DNA, 25 bp, E. coli
tgaaatcaacagaaaaagacccggc

SEQ ID NO: 104522 - DNA, 25 bp, E. coli
tgaaatcaacagtaaaagacccggc

SEQ ID NO: 104523 - DNA, 25 bp, E. coli
gaatctggcgaagctgagccgtgac

SEQ ID NO: 104524 - DNA, 25 bp, E. coli
gaatctggcgaacctgagccgtgac

SEQ ID NO: 104525 - DNA, 25 bp, E. coli
gacaataatctgtcaccggagcagg

SEQ ID NO: 104526 - DNA, 25 bp, E. coli
gacaataatctgacaccggagcagg

SEQ ID NO: 104527 - DNA, 25 bp, E. coli
taatttagcaggagctctggccgga

SEQ ID NO: 104528 - DNA, 25 bp, E. coli
taatttagcaggtgctctggccgga

SEQ ID NO: 104529 - DNA, 25 bp, E. coli
agggcgaacggtaccagccctgcgt

SEQ ID NO: 104530 - DNA, 25 bp, E. coli
acggtaccagccctgcgtgaatatc

SEQ ID NO: 104531 - DNA, 25 bp, E. coli
agggcgaacggttccagccctgcgt

SEQ ID NO: 104532 - DNA, 25 bp, E. coli
acggtaccagccgtgcgtgaatatc

SEQ ID NO: 104533 - DNA, 25 bp, E. coli
tgataggcacccgggagggcgaacg

SEQ ID NO: 104534 - DNA, 25 bp, E. coli
tgataggcaccccggagggcgaacg

SEQ ID NO: 104535 - DNA, 25 bp, E. coli
tgcggcttcgtgataggcaccccgg

SEQ ID NO: 104536 - DNA, 25 bp, E. coli
tgcggcttcgtgttaggcaccccgg

SEQ ID NO: 104537 - DNA, 25 bp, E. coli
tcgtgataggcagcccggagggcga

SEQ ID NO: 104538 - DNA, 25 bp, E. coli
tcgtgataggcaccccggagggcga

SEQ ID NO: 104539 - DNA, 25 bp, E. coli
gcggcttcgtgaaaggcaccccgga

SEQ ID NO: 104540 - DNA, 25 bp, E. coli
gcggcttcgtgataggcaccccgga

SEQ ID NO: 104541 - DNA, 25 bp, E. coli
gcgaacggtacctgccctgcgtgaa

SEQ ID NO: 104542 - DNA, 25 bp, E. coli
cttcgtgatagggaccccggagggc

SEQ ID NO: 104543 - DNA, 25 bp, E. coli
cgaacggtaccacccctgcgtgaat

SEQ ID NO: 104544 - DNA, 25 bp, E. coli
cggcttcgtgataggcaccccggag

SEQ ID NO: 104545 - DNA, 25 bp, E. coli
cttcgtgataggcaccccggagggc

SEQ ID NO: 104546 - DNA, 25 bp, E. coli
gcgaacggtaccagccctgcgtgaa

SEQ ID NO: 104547 - DNA, 25 bp, E. coli
cggcttcgtgattggcaccccggag

SEQ ID NO: 104548 - DNA, 25 bp, E. coli
cgaacggtaccagccctgcgtgaat

SEQ ID NO: 104549 - DNA, 25 bp, E. coli
gtgcggcttcgtcataggcaccccg

SEQ ID NO: 104550 - DNA, 25 bp, E. coli
gtgcggcttcgtgataggcaccccg

SEQ ID NO: 104551 - DNA, 25 bp, E. coli
caacagagcctggttctgcggtcat

SEQ ID NO: 104552 - DNA, 25 bp, E. coli
caacagagcctgcttctgcggtcat

SEQ ID NO: 104553 - DNA, 25 bp, E. coli
catcagtaagcatccgcagcacatt

SEQ ID NO: 104554 - DNA, 25 bp, E. coli
catcagtaagcaaccgcagcacatt

SEQ ID NO: 104555 - DNA, 25 bp, E. coli
cagagcctggttctgcggtcatgaa

SEQ ID NO: 104556 - DNA, 25 bp, E. coli
cagagcctggttgtgcggtcatgaa

SEQ ID NO: 104557 - DNA, 25 bp, E. coli
acttgttccgtgtcttgccgaaagt

SEQ ID NO: 104558 - DNA, 25 bp, E. coli
acttgttccgtgacttgccgaaagt

SEQ ID NO: 104559 - DNA, 25 bp, E. coli
gacttgttccgtgacttgccgaaag

SEQ ID NO: 104560 - DNA, 25 bp, E. coli
gacttgttccgtcacttgccgaaag

SEQ ID NO: 104561 - DNA, 25 bp, E. coli
tgatcgtcaccatcccgccgtacgt

SEQ ID NO: 104562 - DNA, 25 bp, E. coli
tgatcgtcaccaacccgccgtacgt

SEQ ID NO: 104563 - DNA, 25 bp, E. coli
tgtgctgatttgtgaagtgggcaac

SEQ ID NO: 104564 - DNA, 25 bp, E. coli
tgtgctgatttgagaagtgggcaac

SEQ ID NO: 104565 - DNA, 25 bp, E. coli
ccgacttgttccctgacttgccgaa

SEQ ID NO: 104566 - DNA, 25 bp, E. coli
ccgacttgttccgtgacttgccgaa

SEQ ID NO: 104567 - DNA, 25 bp, E. coli
ctcatcagtaaggaaccgcagcaca

SEQ ID NO: 104568 - DNA, 25 bp, E. coli
ctcatcagtaagcaaccgcagcaca

SEQ ID NO: 104569 - DNA, 25 bp, E. coli
gaccaacagagcgtggttctgcggt

SEQ ID NO: 104570 - DNA, 25 bp, E. coli
gagcctggttctgcggtcatgaatt

SEQ ID NO: 104571 - DNA, 25 bp, E. coli
gagcctggttctccggtcatgaatt

SEQ ID NO: 104572 - DNA, 25 bp, E. coli
gaccaacagagcctggttctgcggt

SEQ ID NO: 104573 - DNA, 25 bp, E. coli
caaatatgcccatcctgtgtgagat

SEQ ID NO: 104574 - DNA, 25 bp, E. coli
caaaagacaaagtgggatgcagaca

SEQ ID NO: 104575 - DNA, 25 bp, E. coli
caaaagacaaagagggatgcagaca

SEQ ID NO: 104576 - DNA, 25 bp, E. coli
caaatatgcccaacctgtgtgagat

SEQ ID NO: 104577 - DNA, 25 bp, E. coli
ttgactctgcagcttgagaacgacc

SEQ ID NO: 104578 - DNA, 25 bp, E. coli
ttgactctgcaggttgagaacgacc

SEQ ID NO: 104579 - DNA, 25 bp, E. coli
tccagcggaatttcgggagcatata

SEQ ID NO: 104580 - DNA, 25 bp, E. coli
tccagcggaattacgggagcatata

SEQ ID NO: 104581 - DNA, 25 bp, E. coli
tctatgaagcgaataatccagcgga

SEQ ID NO: 104582 - DNA, 25 bp, E. coli
tctatgaagcgattaatccagcgga

SEQ ID NO: 104583 - DNA, 25 bp, E. coli
gaaaagggcgacttggaacaaatca

SEQ ID NO: 104584 - DNA, 25 bp, E. coli
gaaacatcagcttagtattggcgca

SEQ ID NO: 104585 - DNA, 25 bp, E. coli
gaaacatcagctaagtattggcgca

SEQ ID NO: 104586 - DNA, 25 bp, E. coli
gaaaagggcgacatggaacaaatca

SEQ ID NO: 104587 - DNA, 25 bp, E. coli
ctcgagaaattacagcaggcgcaag

SEQ ID NO: 104588 - DNA, 25 bp, E. coli
ctcgagaaattagagcaggcgcaag

SEQ ID NO: 104589 - DNA, 25 bp, E. coli
tggcgcacgcctcattactaaaaat

SEQ ID NO: 104590 - DNA, 25 bp, E. coli
ggaactccaggaattgctcgagaaa

SEQ ID NO: 104591 - DNA, 25 bp, E. coli
ggaactccaggatttgctcgagaaa

SEQ ID NO: 104592 - DNA, 25 bp, E. coli
tggcgcacgcctgattactaaaaat

SEQ ID NO: 104593 - DNA, 25 bp, E. coli
gagtattacacctgtgcgtgaagca

SEQ ID NO: 104594 - DNA, 25 bp, E. coli
gagtattacaccagtgcgtgaagca

SEQ ID NO: 104595 - DNA, 25 bp, E. coli
caccgctgtcgttgaatggcattca

SEQ ID NO: 104596 - DNA, 25 bp, E. coli
caccgctgtcgtagaatggcattca

SEQ ID NO: 104597 - DNA, 25 bp, E. coli
acttactgcggccatttgctacgaa

SEQ ID NO: 104598 - DNA, 25 bp, E. coli
acttactgcggcgatttgctacgaa

SEQ ID NO: 104599 - DNA, 25 bp, E. coli
tgatgagtctgccagcacgtaaaca

SEQ ID NO: 104600 - DNA, 25 bp, E. coli
tgatgagtctgcgagcacgtaaaca

SEQ ID NO: 104601 - DNA, 25 bp, E. coli
tgaaatgggacggagaccagctact

SEQ ID NO: 104602 - DNA, 25 bp, E. coli
tgaaatgggacgcagaccagctact

SEQ ID NO: 104603 - DNA, 25 bp, E. coli
gaatggcattcatcttactgcggcc

SEQ ID NO: 104604 - DNA, 25 bp, E. coli
gaatggcattcaacttactgcggcc

SEQ ID NO: 104605 - DNA, 25 bp, E. coli
gttctttgatttcccgatgtcttca

SEQ ID NO: 104606 - DNA, 25 bp, E. coli
gttctttgatttgccgatgtcttca

SEQ ID NO: 104607 - DNA, 25 bp, E. coli
gtgttgaccactaacgtgacaccaa

SEQ ID NO: 104608 - DNA, 25 bp, E. coli
gtgttgaccacttacgtgacaccaa

SEQ ID NO: 104609 - DNA, 25 bp, E. coli
ggttttgccgctgtactgatgagtc

SEQ ID NO: 104610 - DNA, 25 bp, E. coli
ggttttgccgctctactgatgagtc

SEQ ID NO: 104611 - DNA, 25 bp, E. coli
ggaccatatattcagccaccgctgt

SEQ ID NO: 104612 - DNA, 25 bp, E. coli
ggaccatatattgagccaccgctgt

SEQ ID NO: 104613 - DNA, 25 bp, E. coli
gatgtcttcattcagccgcggacca

SEQ ID NO: 104614 - DNA, 25 bp, E. coli
gatgtcttcattgagccgcggacca

SEQ ID NO: 104615 - DNA, 25 bp, E. coli
gagaccagctacttaatacgctgaa

SEQ ID NO: 104616 - DNA, 25 bp, E. coli
gagaccagctacataatacgctgaa

SEQ ID NO: 104617 - DNA, 25 bp, E. coli
cttgtcggaaaaaagtacccagatg

SEQ ID NO: 104618 - DNA, 25 bp, E. coli
ataccaccagaacgacttgtcggaa

SEQ ID NO: 104619 - DNA, 25 bp, E. coli
cttgtcggaaaatagtacccagatg

SEQ ID NO: 104620 - DNA, 25 bp, E. coli
ataccaccagaaggacttgtcggaa

SEQ ID NO: 104621 - DNA, 25 bp, E. coli
aaaagtacccagttgtggactggca

SEQ ID NO: 104622 - DNA, 25 bp, E. coli
aaaagtacccagatgtggactggca

SEQ ID NO: 104623 - DNA, 25 bp, E. coli
tacccagatgtggactggcaacgat

SEQ ID NO: 104624 - DNA, 25 bp, E. coli
tacccagatgtgcactggcaacgat

SEQ ID NO: 104625 - DNA, 25 bp, E. coli
tgtggactggcatcgataaatactg

SEQ ID NO: 104626 - DNA, 25 bp, E. coli
tgtggactggcaacgataaatactg

SEQ ID NO: 104627 - DNA, 25 bp, E. coli
tcggaaaaaagtacccagatgtgga

SEQ ID NO: 104628 - DNA, 25 bp, E. coli
tcctccccgttactggcaattactt

SEQ ID NO: 104629 - DNA, 25 bp, E. coli
tcctccccgttagtggcaattactt

SEQ ID NO: 104630 - DNA, 25 bp, E. coli
tcggaaaaaagttcccagatgtgga

SEQ ID NO: 104631 - DNA, 25 bp, E. coli
tatccggcacggatgcttcccttaa

SEQ ID NO: 104632 - DNA, 25 bp, E. coli
tatccggcacggttgcttcccttaa

SEQ ID NO: 104633 - DNA, 25 bp, E. coli
cgataaatactgacatcacatgtca

SEQ ID NO: 104634 - DNA, 25 bp, E. coli
cgataaatactgtcatcacatgtca

SEQ ID NO: 104635 - DNA, 25 bp, E. coli
ggcacggttgcttcccttaaatcct

SEQ ID NO: 104636 - DNA, 25 bp, E. coli
ggactggcaacgataaatactgtca

SEQ ID NO: 104637 - DNA, 25 bp, E. coli
ggactggcaacgttaaatactgtca

SEQ ID NO: 104638 - DNA, 25 bp, E. coli
ggcacggttgctacccttaaatcct

SEQ ID NO: 104639 - DNA, 25 bp, E. coli
taccctttatccttgctgaatcgaa

SEQ ID NO: 104640 - DNA, 25 bp, E. coli
agcaagatgattctgaagttcagga

SEQ ID NO: 104641 - DNA, 25 bp, E. coli
agcaagatgattgtgaagttcagga

SEQ ID NO: 104642 - DNA, 25 bp, E. coli
tatcccttttcagtatcataccctt

SEQ ID NO: 104643 - DNA, 25 bp, E. coli
tatcccttttcactatcataccctt

SEQ ID NO: 104644 - DNA, 25 bp, E. coli
taccctttatccatgctgaatcgaa

SEQ ID NO: 104645 - DNA, 25 bp, E. coli
tttatccttgctcaatcgaagcagc

SEQ ID NO: 104646 - DNA, 25 bp, E. coli
tatcatacccttaatccttgctgaa

SEQ ID NO: 104647 - DNA, 25 bp, E. coli
tatcataccctttatccttgctgaa

SEQ ID NO: 104648 - DNA, 25 bp, E. coli
tttatccttgctgaatcgaagcagc

SEQ ID NO: 104649 - DNA, 25 bp, E. coli
tgctgaatcgaaccagcagcaagat

SEQ ID NO: 104650 - DNA, 25 bp, E. coli
tgaatcgaagcagcagcaagatgat

SEQ ID NO: 104651 - DNA, 25 bp, E. coli
tgctgaatcgaagcagcagcaagat

SEQ ID NO: 104652 - DNA, 25 bp, E. coli
tgaatcgaagcaccagcaagatgat

SEQ ID NO: 104653 - DNA, 25 bp, E. coli
tccttgctgaatggaagcagcagca

SEQ ID NO: 104654 - DNA, 25 bp, E. coli
tccttgctgaatcgaagcagcagca

SEQ ID NO: 104655 - DNA, 25 bp, E. coli
gcagcaagatgaatctgaagttcag

SEQ ID NO: 104656 - DNA, 25 bp, E. coli
gcagcaagatgattctgaagttcag

SEQ ID NO: 104657 - DNA, 25 bp, E. coli
gaagcagcagcatgatgattctgaa

SEQ ID NO: 104658 - DNA, 25 bp, E. coli
gaagcagcagcaagatgattctgaa

SEQ ID NO: 104659 - DNA, 25 bp, E. coli
gacaatgcttttatcccttttcact

SEQ ID NO: 104660 - DNA, 25 bp, E. coli
gacaatgcttttttcccttttcact

SEQ ID NO: 104661 - DNA, 25 bp, E. coli
caagagatcccgtatgctgagacga

SEQ ID NO: 104662 - DNA, 25 bp, E. coli
caagagatcccgaatgctgagacga

SEQ ID NO: 104663 - DNA, 25 bp, E. coli
catgtgtgcaagtcagggcctgcgt

SEQ ID NO: 104664 - DNA, 25 bp, E. coli
catgtgtgcaagacagggcctgcgt

SEQ ID NO: 104665 - DNA, 25 bp, E. coli
tacaacgggcgctattcagccgcat

SEQ ID NO: 104666 - DNA, 25 bp, E. coli
tactctggtcgcctagttcgtcact

SEQ ID NO: 104667 - DNA, 25 bp, E. coli
tacaacgggcgcaattcagccgcat

SEQ ID NO: 104668 - DNA, 25 bp, E. coli
tactctggtcgcgtagttcgtcact

SEQ ID NO: 104669 - DNA, 25 bp, E. coli
tacccaggtcagcaacgttacgata

SEQ ID NO: 104670 - DNA, 25 bp, E. coli
tacccaggtcaggaacgttacgata

SEQ ID NO: 104671 - DNA, 25 bp, E. coli
tgaaatggaatcagcaaccctgctg

SEQ ID NO: 104672 - DNA, 25 bp, E. coli
tgaaatggaatctgcaaccctgctg

SEQ ID NO: 104673 - DNA, 25 bp, E. coli
gaattcccggctgtcgctgatttcg

SEQ ID NO: 104674 - DNA, 25 bp, E. coli
gaattcccggctctcgctgatttcg

SEQ ID NO: 104675 - DNA, 25 bp, E. coli
gaagctgcgaaatccattggcgcga

SEQ ID NO: 104676 - DNA, 25 bp, E. coli
gaagctgcgaaaaccattggcgcga

SEQ ID NO: 104677 - DNA, 25 bp, E. coli
ctattgctgttgtagagctggcaca

SEQ ID NO: 104678 - DNA, 25 bp, E. coli
ctattgctgttgaagagctggcaca

SEQ ID NO: 104679 - DNA, 25 bp, E. coli
gatttcgaatgttcgactgcgctgg

SEQ ID NO: 104680 - DNA, 25 bp, E. coli
gatttcgaatgtacgactgcgctgg

SEQ ID NO: 104681 - DNA, 25 bp, E. coli
ggttaagctggcttctcaccgcgaa

SEQ ID NO: 104682 - DNA, 25 bp, E. coli
ggttaagctggcatctcaccgcgaa

SEQ ID NO: 104683 - DNA, 25 bp, E. coli
tatattgaattaacgccagcgggaa

SEQ ID NO: 104684 - DNA, 25 bp, E. coli
tatattgaattatcgccagcgggaa

SEQ ID NO: 104685 - DNA, 25 bp, E. coli
tatacaacggctgctgggatgcgct

SEQ ID NO: 104686 - DNA, 25 bp, E. coli
tatacaacggctcctgggatgcgct

SEQ ID NO: 104687 - DNA, 25 bp, E. coli
tgttcatctcagtcgaaacgcttcg

SEQ ID NO: 104688 - DNA, 25 bp, E. coli
tgttcatctcagacgaaacgcttcg

SEQ ID NO: 104689 - DNA, 25 bp, E. coli
tgaactgttcatacgtaagggacgc

SEQ ID NO: 104690 - DNA, 25 bp, E. coli
tgaattgcgtcagtatccagcggtt

SEQ ID NO: 104691 - DNA, 25 bp, E. coli
tgaactgttcattcgtaagggacgc

SEQ ID NO: 104692 - DNA, 25 bp, E. coli
tgaattgcgtcactatccagcggtt

SEQ ID NO: 104693 - DNA, 25 bp, E. coli
tcgttccgatggaatgggcaaagcc

SEQ ID NO: 104694 - DNA, 25 bp, E. coli
tcgttccgatggtatgggcaaagcc

SEQ ID NO: 104695 - DNA, 25 bp, E. coli
tcatgcagtacctagcagtgaaggc

SEQ ID NO: 104696 - DNA, 25 bp, E. coli
tcatgcagtaccaagcagtgaaggc

SEQ ID NO: 104697 - DNA, 25 bp, E. coli
gaaggcatcatttgcgaaccggtcg

SEQ ID NO: 104698 - DNA, 25 bp, E. coli
gaaggcatcattagcgaaccggtcg

SEQ ID NO: 104699 - DNA, 25 bp, E. coli
gcaaaactattcatggcgacctgga

SEQ ID NO: 104700 - DNA, 25 bp, E. coli
gcaaaactattcttggcgacctgga

SEQ ID NO: 104701 - DNA, 25 bp, E. coli
ccgcagccgagcagttaaataaagt

SEQ ID NO: 104702 - DNA, 25 bp, E. coli
ccgcagccgagctgttaaataaagt

SEQ ID NO: 104703 - DNA, 25 bp, E. coli
ggaagcattaaagcgcaacacagtg

SEQ ID NO: 104704 - DNA, 25 bp, E. coli
ggaagcattaaaccgcaacacagtg

SEQ ID NO: 104705 - DNA, 25 bp, E. coli
attcctgattatccggatgcgacac

SEQ ID NO: 104706 - DNA, 25 bp, E. coli
attcctgattatgcggatgcgacac

SEQ ID NO: 104707 - DNA, 25 bp, E. coli
tatccggatgcgtcacatcctttca

SEQ ID NO: 104708 - DNA, 25 bp, E. coli
tatccggatgcgacacatcctttca

SEQ ID NO: 104709 - DNA, 25 bp, E. coli
ttatccggatgcgacacatcctttc

SEQ ID NO: 104710 - DNA, 25 bp, E. coli
tattcctgattaaccggatgcgaca

SEQ ID NO: 104711 - DNA, 25 bp, E. coli
tattcctgattatccggatgcgaca

SEQ ID NO: 104712 - DNA, 25 bp, E. coli
tttattcctgataatccggatgcga

SEQ ID NO: 104713 - DNA, 25 bp, E. coli
ttattcctgattttccggatgcgac

SEQ ID NO: 104714 - DNA, 25 bp, E. coli
ttcctgattatcgggatgcgacaca

SEQ ID NO: 104715 - DNA, 25 bp, E. coli
ttcctgattatccggatgcgacaca

SEQ ID NO: 104716 - DNA, 25 bp, E. coli
ttatccggatgccacacatcctttc

SEQ ID NO: 104717 - DNA, 25 bp, E. coli
ttattcctgattatccggatgcgac

SEQ ID NO: 104718 - DNA, 25 bp, E. coli
tttattcctgattatccggatgcga

SEQ ID NO: 104719 - DNA, 25 bp, E. coli
tgattatccggaagcgacacatcct

SEQ ID NO: 104720 - DNA, 25 bp, E. coli
tgattatccggatgcgacacatcct

SEQ ID NO: 104721 - DNA, 25 bp, E. coli
cctgattatccggatgcgacacatc

SEQ ID NO: 104722 - DNA, 25 bp, E. coli
cctgattatccgcatgcgacacatc

SEQ ID NO: 104723 - DNA, 25 bp, E. coli
ctgattatccggatgcgacacatcc

SEQ ID NO: 104724 - DNA, 25 bp, E. coli
ctgattatccggttgcgacacatcc

SEQ ID NO: 104725 - DNA, 25 bp, E. coli
gattatccggatgcgacacatcctt

SEQ ID NO: 104726 - DNA, 25 bp, E. coli
gattatccggatccgacacatcctt

SEQ ID NO: 104727 - DNA, 25 bp, E. coli
ttgccgtatactgcgggcttcgtca

SEQ ID NO: 104728 - DNA, 25 bp, E. coli
ttgccgtatactccgggcttcgtca

SEQ ID NO: 104729 - DNA, 25 bp, E. coli
agccgggaatttaagagcgttgata

SEQ ID NO: 104730 - DNA, 25 bp, E. coli
agccgggaattttagagcgttgata

SEQ ID NO: 104731 - DNA, 25 bp, E. coli
aacattgaaagggtgggaggttact

SEQ ID NO: 104732 - DNA, 25 bp, E. coli
aacattgaaaggctgggaggttact

SEQ ID NO: 104733 - DNA, 25 bp, E. coli
ttcgagaagggacttgtgaatgtca

SEQ ID NO: 104734 - DNA, 25 bp, E. coli
ttcgagaagggagttgtgaatgtca

SEQ ID NO: 104735 - DNA, 25 bp, E. coli
tcaattccggtgagtttgagtattt

SEQ ID NO: 104736 - DNA, 25 bp, E. coli
tcaattccggtgtgtttgagtattt

SEQ ID NO: 104737 - DNA, 25 bp, E. coli
gctgggaggttactaacagtaacat

SEQ ID NO: 104738 - DNA, 25 bp, E. coli
gctgggaggttagtaacagtaacat

SEQ ID NO: 104739 - DNA, 25 bp, E. coli
gttcatgaaatcaattccggtgagt

SEQ ID NO: 104740 - DNA, 25 bp, E. coli
gataataatttgagagagtactccg

SEQ ID NO: 104741 - DNA, 25 bp, E. coli
gttcatgaaatctattccggtgagt

SEQ ID NO: 104742 - DNA, 25 bp, E. coli
gataataatttgtgagagtactccg

SEQ ID NO: 104743 - DNA, 25 bp, E. coli
tggaaatttgccgtatactccgggc

SEQ ID NO: 104744 - DNA, 25 bp, E. coli
tggaaatttgccctatactccgggc

SEQ ID NO: 104745 - DNA, 25 bp, E. coli
gagtactccgatttcgcatattcgt

SEQ ID NO: 104746 - DNA, 25 bp, E. coli
tgcggggatccgcacggtaacacta

SEQ ID NO: 104747 - DNA, 25 bp, E. coli
gagtactccgatatcgcatattcgt

SEQ ID NO: 104748 - DNA, 25 bp, E. coli
tgcggggatccggacggtaacacta

SEQ ID NO: 104749 - DNA, 25 bp, E. coli
aaccagatgtacgtcgaggcgggca

SEQ ID NO: 104750 - DNA, 25 bp, E. coli
aaccagatgtacctcgaggcgggca

SEQ ID NO: 104751 - DNA, 25 bp, E. coli
cacgacagcctgtttgaagccagca

SEQ ID NO: 104752 - DNA, 25 bp, E. coli
cacgacagcctgattgaagccagca

SEQ ID NO: 104753 - DNA, 25 bp, E. coli
tacagacggtggaaaaacgccaggg

SEQ ID NO: 104754 - DNA, 25 bp, E. coli
tacagacggtggtaaaacgccaggg

SEQ ID NO: 104755 - DNA, 25 bp, E. coli
tacgcaaagcagctgaagccgtcgg

SEQ ID NO: 104756 - DNA, 25 bp, E. coli
tacgcaaagcaggtgaagccgtcgg

SEQ ID NO: 104757 - DNA, 25 bp, E. coli
tatccagctggaatatgccgaacag

SEQ ID NO: 104758 - DNA, 25 bp, E. coli
tatccagctggattatgccgaacag

SEQ ID NO: 104759 - DNA, 25 bp, E. coli
tatctgctggagatacttcgtgccc

SEQ ID NO: 104760 - DNA, 25 bp, E. coli
tatctgctggagttacttcgtgccc

SEQ ID NO: 104761 - DNA, 25 bp, E. coli
gaagccagcacctttgtacagacgg

SEQ ID NO: 104762 - DNA, 25 bp, E. coli
gaagccagcaccattgtacagacgg

SEQ ID NO: 104763 - DNA, 25 bp, E. coli
gaaattctcatcatcactacgccgg

SEQ ID NO: 104764 - DNA, 25 bp, E. coli
gaaattctcatcttcactacgccgg

SEQ ID NO: 104765 - DNA, 25 bp, E. coli
cgcgcggcgtatggaagcaactgtt

SEQ ID NO: 104766 - DNA, 25 bp, E. coli
cgcgcggcgtatcgaagcaactgtt

SEQ ID NO: 104767 - DNA, 25 bp, E. coli
gattgcatccgaatacgcgcggcgt

SEQ ID NO: 104768 - DNA, 25 bp, E. coli
gataacatcttcatcggtcagggct

SEQ ID NO: 104769 - DNA, 25 bp, E. coli
gattgcatccgattacgcgcggcgt

SEQ ID NO: 104770 - DNA, 25 bp, E. coli
gataacatcttcttcggtcagggct

SEQ ID NO: 104771 - DNA, 25 bp, E. coli
cacggtctggcctttaaagagcgcg

SEQ ID NO: 104772 - DNA, 25 bp, E. coli
cacggtctggccattaaagagcgcg

SEQ ID NO: 104773 - DNA, 25 bp, E. coli
agtggctccacgcagaaatcgcttg

SEQ ID NO: 104774 - DNA, 25 bp, E. coli
agtggctccacggagaaatcgcttg

SEQ ID NO: 104775 - DNA, 25 bp, E. coli
aaaagcgcgctgcaataccttcgac

SEQ ID NO: 104776 - DNA, 25 bp, E. coli
aaaagcgcgctggaataccttcgac

SEQ ID NO: 104777 - DNA, 25 bp, E. coli
tatatctgagaagaaagccgggccg

SEQ ID NO: 104778 - DNA, 25 bp, E. coli
tatttgctgacttcattgccgccag

SEQ ID NO: 104779 - DNA, 25 bp, E. coli
tatatctgagaacaaagccgggccg

SEQ ID NO: 104780 - DNA, 25 bp, E. coli
tatttgctgactacattgccgccag

SEQ ID NO: 104781 - DNA, 25 bp, E. coli
tgcctcgcgtacaaaaagttctggt

SEQ ID NO: 104782 - DNA, 25 bp, E. coli
tgccgttaagcccaagtatcagacc

SEQ ID NO: 104783 - DNA, 25 bp, E. coli
tgccgttaagccgaagtatcagacc

SEQ ID NO: 104784 - DNA, 25 bp, E. coli
tgcctcgcgtactaaaagttctggt

SEQ ID NO: 104785 - DNA, 25 bp, E. coli
gaatcgcttgtttcccgtagccggg

SEQ ID NO: 104786 - DNA, 25 bp, E. coli
gaatcgcttgttacccgtagccggg

SEQ ID NO: 104787 - DNA, 25 bp, E. coli
cggaatgaaagatacctggacggtc

SEQ ID NO: 104788 - DNA, 25 bp, E. coli
cggaatgaaagaaacctggacggtc

SEQ ID NO: 104789 - DNA, 25 bp, E. coli
gatcagttacgcaacagcggcagca

SEQ ID NO: 104790 - DNA, 25 bp, E. coli
gatatgaccgctgaagtgctggcgc

SEQ ID NO: 104791 - DNA, 25 bp, E. coli
gatcagttacgctacagcggcagca

SEQ ID NO: 104792 - DNA, 25 bp, E. coli
gatatgaccgctcaagtgctggcgc

SEQ ID NO: 104793 - DNA, 25 bp, E. coli
aacgctgtgatgaactggctcgtgc

SEQ ID NO: 104794 - DNA, 25 bp, E. coli
aacgctgtgatgtactggctcgtgc

SEQ ID NO: 104795 - DNA, 25 bp, E. coli
cagccagtatgtccgccagggtatc

SEQ ID NO: 104796 - DNA, 25 bp, E. coli
cagccagtatgtgcgccagggtatc

SEQ ID NO: 104797 - DNA, 25 bp, E. coli
taaaaaatgtcgttctctggcaacg

SEQ ID NO: 104798 - DNA, 25 bp, E. coli
taaaaaatgtcgatctctggcaacg

SEQ ID NO: 104799 - DNA, 25 bp, E. coli
aaccgtatggagttgatggccgcta

SEQ ID NO: 104800 - DNA, 25 bp, E. coli
aaccgtatggagatgatggccgcta

SEQ ID NO: 104801 - DNA, 25 bp, E. coli
tattttacgctaacgcggacgcgag

SEQ ID NO: 104802 - DNA, 25 bp, E. coli
tattttacgctatcgcggacgcgag

SEQ ID NO: 104803 - DNA, 25 bp, E. coli
tgggttaaaggccatgccggacacc

SEQ ID NO: 104804 - DNA, 25 bp, E. coli
tgggttaaaggcgatgccggacacc

SEQ ID NO: 104805 - DNA, 25 bp, E. coli
tcgcggacgcgagaaaacctttagc

SEQ ID NO: 104806 - DNA, 25 bp, E. coli
tcgcggacgcgacaaaacctttagc

SEQ ID NO: 104807 - DNA, 25 bp, E. coli
tccataactggataaaacgtggctg

SEQ ID NO: 104808 - DNA, 25 bp, E. coli
tccataactggaaaaaacgtggctg

SEQ ID NO: 104809 - DNA, 25 bp, E. coli
tcattttgagtagcgacagccagta

SEQ ID NO: 104810 - DNA, 25 bp, E. coli
tcattttgagtaccgacagccagta

SEQ ID NO: 104811 - DNA, 25 bp, E. coli
gacacccggaaaacgaacgctgtga

SEQ ID NO: 104812 - DNA, 25 bp, E. coli
gacacccggaaatcgaacgctgtga

SEQ ID NO: 104813 - DNA, 25 bp, E. coli
cgcgctggaggcgttaaaagaacat

SEQ ID NO: 104814 - DNA, 25 bp, E. coli
cgcgctggaggccttaaaagaacat

SEQ ID NO: 104815 - DNA, 25 bp, E. coli
tactggagcgtctggttgaaccgga

SEQ ID NO: 104816 - DNA, 25 bp, E. coli
tactggagcgtcaggttgaaccgga

SEQ ID NO: 104817 - DNA, 25 bp, E. coli
aaatatgccgacgaccatcgaagcg

SEQ ID NO: 104818 - DNA, 25 bp, E. coli
aaatatgccgaccaccatcgaagcg

SEQ ID NO: 104819 - DNA, 25 bp, E. coli
tatctcgaaggcgaacagccgtggt

SEQ ID NO: 104820 - DNA, 25 bp, E. coli
tatctcgaaggccaacagccgtggt

SEQ ID NO: 104821 - DNA, 25 bp, E. coli
tgagcaaaccaactacgtgcagggc

SEQ ID NO: 104822 - DNA, 25 bp, E. coli
tgagcaaaccaagtacgtgcagggc

SEQ ID NO: 104823 - DNA, 25 bp, E. coli
tcctcaaccatgaccaaaagcgcga

SEQ ID NO: 104824 - DNA, 25 bp, E. coli
tcctcaaccatgtccaaaagcgcga

SEQ ID NO: 104825 - DNA, 25 bp, E. coli
gaatcaaaccgagttcgcgcaagcc

SEQ ID NO: 104826 - DNA, 25 bp, E. coli
gaagcaatgctaaaacgccacggta

SEQ ID NO: 104827 - DNA, 25 bp, E. coli
gaagcaatgctataacgccacggta

SEQ ID NO: 104828 - DNA, 25 bp, E. coli
gaatcaaaccgacttcgcgcaagcc

SEQ ID NO: 104829 - DNA, 25 bp, E. coli
gactgaactgttccagcaggcaggc

SEQ ID NO: 104830 - DNA, 25 bp, E. coli
gactgaactgttgcagcaggcaggc

SEQ ID NO: 104831 - DNA, 25 bp, E. coli
gaaagccgagaatgttgacgcacgt

SEQ ID NO: 104832 - DNA, 25 bp, E. coli
gaaagccgagaaagttgacgcacgt

SEQ ID NO: 104833 - DNA, 25 bp, E. coli
ccgcgatggtcgtgtggcagattac

SEQ ID NO: 104834 - DNA, 25 bp, E. coli
ccgcgatggtcgagtggcagattac

SEQ ID NO: 104835 - DNA, 25 bp, E. coli
ggcagtcttattggcccggaagcta

SEQ ID NO: 104836 - DNA, 25 bp, E. coli
ggcagtcttattcgcccggaagcta

SEQ ID NO: 104837 - DNA, 25 bp, E. coli
aattgccgctattgcactatggccg

SEQ ID NO: 104838 - DNA, 25 bp, E. coli
aattgccgctatagcactatggccg

SEQ ID NO: 104839 - DNA, 25 bp, E. coli
cattctgaactttgtgcttggcgga

SEQ ID NO: 104840 - DNA, 25 bp, E. coli
cattctgaacttagtgcttggcgga

SEQ ID NO: 104841 - DNA, 25 bp, E. coli
taaactgtctctcgtgccttatggc

SEQ ID NO: 104842 - DNA, 25 bp, E. coli
taaactgtctctggtgccttatggc

SEQ ID NO: 104843 - DNA, 25 bp, E. coli
tatgcctgatgctcattgcaacggg

SEQ ID NO: 104844 - DNA, 25 bp, E. coli
tatgcctgatgcacattgcaacggg

SEQ ID NO: 104845 - DNA, 25 bp, E. coli
tatcggtagaaacagcgcaagctgc

SEQ ID NO: 104846 - DNA, 25 bp, E. coli
tatcggtagaaagagcgcaagctgc

SEQ ID NO: 104847 - DNA, 25 bp, E. coli
tgcaacgggcatggcacaatgtatt

SEQ ID NO: 104848 - DNA, 25 bp, E. coli
tgcaacgggcatcgcacaatgtatt

SEQ ID NO: 104849 - DNA, 25 bp, E. coli
tcatgtcgatgatctgaacccggct

SEQ ID NO: 104850 - DNA, 25 bp, E. coli
tcatgtcgatgaactgaacccggct

SEQ ID NO: 104851 - DNA, 25 bp, E. coli
cctgctgggagaacactaaactgtc

SEQ ID NO: 104852 - DNA, 25 bp, E. coli
cctgctgggagatcactaaactgtc

SEQ ID NO: 104853 - DNA, 25 bp, E. coli
gcggatttgccaccactctgggctg

SEQ ID NO: 104854 - DNA, 25 bp, E. coli
gcggatttgccagcactctgggctg

SEQ ID NO: 104855 - DNA, 25 bp, E. coli
ctctgggctggcagttggcgactct

SEQ ID NO: 104856 - DNA, 25 bp, E. coli
ctctgggctggctgttggcgactct

SEQ ID NO: 104857 - DNA, 25 bp, E. coli
gatttttaccttaccgctgacacga

SEQ ID NO: 104858 - DNA, 25 bp, E. coli
gatttttacctttccgctgacacga

SEQ ID NO: 104859 - DNA, 25 bp, E. coli
caacttgcgagcgatccgatgctac

SEQ ID NO: 104860 - DNA, 25 bp, E. coli
caacttgcgagccatccgatgctac

SEQ ID NO: 104861 - DNA, 25 bp, E. coli
caaagtacagcaacgtgaccaacag

SEQ ID NO: 104862 - DNA, 25 bp, E. coli
cacaactgggcataggcttgggaac

SEQ ID NO: 104863 - DNA, 25 bp, E. coli
cacaactgggcaaaggcttgggaac

SEQ ID NO: 104864 - DNA, 25 bp, E. coli
caaagtacagcatcgtgaccaacag

SEQ ID NO: 104865 - DNA, 25 bp, E. coli
tacaggaacagtacttgccaagcgt

SEQ ID NO: 104866 - DNA, 25 bp, E. coli
tactggcgaatggatcacaactggg

SEQ ID NO: 104867 - DNA, 25 bp, E. coli
tactggcgaatgcatcacaactggg

SEQ ID NO: 104868 - DNA, 25 bp, E. coli
tacaggaacagttcttgccaagcgt

SEQ ID NO: 104869 - DNA, 25 bp, E. coli
tacgcggaatagtccagttactggc

SEQ ID NO: 104870 - DNA, 25 bp, E. coli
tacgcggaatagaccagttactggc

SEQ ID NO: 104871 - DNA, 25 bp, E. coli
tgtacatggttctaacacgccaggc

SEQ ID NO: 104872 - DNA, 25 bp, E. coli
tgtacatggttcaaacacgccaggc

SEQ ID NO: 104873 - DNA, 25 bp, E. coli
gcgttttagcgctagagtccgtcac

SEQ ID NO: 104874 - DNA, 25 bp, E. coli
gcgttttagcgcaagagtccgtcac

SEQ ID NO: 104875 - DNA, 25 bp, E. coli
cattcgagcgaacacgcaggtttgc

SEQ ID NO: 104876 - DNA, 25 bp, E. coli
cattcgagcgaagacgcaggtttgc

SEQ ID NO: 104877 - DNA, 25 bp, E. coli
tgagaggcaaggtaccgtaaccacc

SEQ ID NO: 104878 - DNA, 25 bp, E. coli
tgagaggcaaggaaccgtaaccacc

SEQ ID NO: 104879 - DNA, 25 bp, E. coli
gagttgctgttctatgatcccgagg

SEQ ID NO: 104880 - DNA, 25 bp, E. coli
gagttgctgttcaatgatcccgagg

SEQ ID NO: 104881 - DNA, 25 bp, E. coli
cagctttatattcccagtgccaccg

SEQ ID NO: 104882 - DNA, 25 bp, E. coli
cagctttatattgccagtgccaccg

SEQ ID NO: 104883 - DNA, 25 bp, E. coli
tacgaaaaagagttcgcacagctgg

SEQ ID NO: 104884 - DNA, 25 bp, E. coli
agtgccaccgccacctatatggtag

SEQ ID NO: 104885 - DNA, 25 bp, E. coli
agtgccaccgcctcctatatggtag

SEQ ID NO: 104886 - DNA, 25 bp, E. coli
acatgccatttaaccgcgcattggg

SEQ ID NO: 104887 - DNA, 25 bp, E. coli
acatgccatttatccgcgcattggg

SEQ ID NO: 104888 - DNA, 25 bp, E. coli
tacgaaaaagagatcgcacagctgg

SEQ ID NO: 104889 - DNA, 25 bp, E. coli
tgtctgccgtacagaccgctgaaca

SEQ ID NO: 104890 - DNA, 25 bp, E. coli
tgtctgccgtactgaccgctgaaca

SEQ ID NO: 104891 - DNA, 25 bp, E. coli
tgcaggcaataaagtcgccgtcgcc

SEQ ID NO: 104892 - DNA, 25 bp, E. coli
tgcaggcaataatgtcgccgtcgcc

SEQ ID NO: 104893 - DNA, 25 bp, E. coli
gatggaactggagcgttacgaaaaa

SEQ ID NO: 104894 - DNA, 25 bp, E. coli
gatggaactggaccgttacgaaaaa

SEQ ID NO: 104895 - DNA, 25 bp, E. coli
cgcacagctggcgtttaaaaatcag

SEQ ID NO: 104896 - DNA, 25 bp, E. coli
cgcacagctggcctttaaaaatcag

SEQ ID NO: 104897 - DNA, 25 bp, E. coli
gtcgcccgcgttgaattacacaatg

SEQ ID NO: 104898 - DNA, 25 bp, E. coli
gtcgcccgcgttcaattacacaatg

SEQ ID NO: 104899 - DNA, 25 bp, E. coli
gtgaagatgaactacgccagcggct

SEQ ID NO: 104900 - DNA, 25 bp, E. coli
gtgaagatgaacaacgccagcggct

SEQ ID NO: 104901 - DNA, 25 bp, E. coli
taacccgccacgaaaccatcagtga

SEQ ID NO: 104902 - DNA, 25 bp, E. coli
taacccgccacgtaaccatcagtga

SEQ ID NO: 104903 - DNA, 25 bp, E. coli
aattgacccctgtgcctgaacttac

SEQ ID NO: 104904 - DNA, 25 bp, E. coli
aattgacccctgagcctgaacttac

SEQ ID NO: 104905 - DNA, 25 bp, E. coli
aacttaccacctcggtgagttcagg

SEQ ID NO: 104906 - DNA, 25 bp, E. coli
aacttaccacctgggtgagttcagg

SEQ ID NO: 104907 - DNA, 25 bp, E. coli
ttattaccaggaaagttgatcaggg

SEQ ID NO: 104908 - DNA, 25 bp, E. coli
ttattaccaggatagttgatcaggg

SEQ ID NO: 104909 - DNA, 25 bp, E. coli
tgtttgcgcataattgacccctgtg

SEQ ID NO: 104910 - DNA, 25 bp, E. coli
tgtttgcgcatatttgacccctgtg

SEQ ID NO: 104911 - DNA, 25 bp, E. coli
tgttcttgcggtctaacacgaagtg

SEQ ID NO: 104912 - DNA, 25 bp, E. coli
tgttcttgcggtgtaacacgaagtg

SEQ ID NO: 104913 - DNA, 25 bp, E. coli
tccgtgacatttacatgttcttgcg

SEQ ID NO: 104914 - DNA, 25 bp, E. coli
tccgtgacattttcatgttcttgcg

SEQ ID NO: 104915 - DNA, 25 bp, E. coli
tcatttagactgaccgacaacgggc

SEQ ID NO: 104916 - DNA, 25 bp, E. coli
tcatttagactgtccgacaacgggc

SEQ ID NO: 104917 - DNA, 25 bp, E. coli
gactgaccgacatcgggcagttttt

SEQ ID NO: 104918 - DNA, 25 bp, E. coli
gactgaccgacaacgggcagttttt

SEQ ID NO: 104919 - DNA, 25 bp, E. coli
ccccgagtgcgggtgtttgcgcata

SEQ ID NO: 104920 - DNA, 25 bp, E. coli
ccccgagtgcggctgtttgcgcata

SEQ ID NO: 104921 - DNA, 25 bp, E. coli
ggtttatttcacatcttccgtgaca

SEQ ID NO: 104922 - DNA, 25 bp, E. coli
ggtttatttcacttcttccgtgaca

SEQ ID NO: 104923 - DNA, 25 bp, E. coli
taacacgaagtgattttaacgtcat

SEQ ID NO: 104924 - DNA, 25 bp, E. coli
taacacgaagtgtttttaacgtcat

SEQ ID NO: 104925 - DNA, 25 bp, E. coli
caacatgcaatgaagatggctttac

SEQ ID NO: 104926 - DNA, 25 bp, E. coli
caacatgcaatgtagatggctttac

SEQ ID NO: 104927 - DNA, 25 bp, E. coli
ctaggcctataggagataaatcatc

SEQ ID NO: 104928 - DNA, 25 bp, E. coli
ctaggcctatagcagataaatcatc

SEQ ID NO: 104929 - DNA, 25 bp, E. coli
tttgatatgcgtgctcccggaagcg

SEQ ID NO: 104930 - DNA, 25 bp, E. coli
tttgatatgcgtcctcccggaagcg

SEQ ID NO: 104931 - DNA, 25 bp, E. coli
ttacagtgtttatcagaagatcctg

SEQ ID NO: 104932 - DNA, 25 bp, E. coli
ttacagtgtttaacagaagatcctg

SEQ ID NO: 104933 - DNA, 25 bp, E. coli
tcagaagtcgcaaggatgtcaaaaa

SEQ ID NO: 104934 - DNA, 25 bp, E. coli
tcagaagtcgcatggatgtcaaaaa

SEQ ID NO: 104935 - DNA, 25 bp, E. coli
cctgaaatatctaggcctatagcag

SEQ ID NO: 104936 - DNA, 25 bp, E. coli
cctgaaatatcttggcctatagcag

SEQ ID NO: 104937 - DNA, 25 bp, E. coli
gcagacagaactccacaactgaggt

SEQ ID NO: 104938 - DNA, 25 bp, E. coli
gaagatcctgtagttttgatatgcg

SEQ ID NO: 104939 - DNA, 25 bp, E. coli
gaagatcctgtacttttgatatgcg

SEQ ID NO: 104940 - DNA, 25 bp, E. coli
gcagacagaactgcacaactgaggt

SEQ ID NO: 104941 - DNA, 25 bp, E. coli
gtatcttagactgaacaacatgcaa

SEQ ID NO: 104942 - DNA, 25 bp, E. coli
gtatcttagactcaacaacatgcaa

SEQ ID NO: 104943 - DNA, 25 bp, E. coli
taatagagacagtgacaaataatac

SEQ ID NO: 104944 - DNA, 25 bp, E. coli
taatagagacagagacaaataatac

SEQ ID NO: 104945 - DNA, 25 bp, E. coli
gaggttatcaatatcagaagtcgca

SEQ ID NO: 104946 - DNA, 25 bp, E. coli
gaggttatcaatttcagaagtcgca

SEQ ID NO: 104947 - DNA, 25 bp, E. coli
caggcaacgggattttcgctcgcca

SEQ ID NO: 104948 - DNA, 25 bp, E. coli
caggcaacgggaatttcgctcgcca

SEQ ID NO: 104949 - DNA, 25 bp, E. coli
catgacccgcgtccaaaaagagcgt

SEQ ID NO: 104950 - DNA, 25 bp, E. coli
catgacccgcgtgcaaaaagagcgt

SEQ ID NO: 104951 - DNA, 25 bp, E. coli
tacatcactgggaaaaaagggcgaa

SEQ ID NO: 104952 - DNA, 25 bp, E. coli
tacatcactgggtaaaaagggcgaa

SEQ ID NO: 104953 - DNA, 25 bp, E. coli
ttactggcactgcttctgaatcgcg

SEQ ID NO: 104954 - DNA, 25 bp, E. coli
ttactggcactggttctgaatcgcg

SEQ ID NO: 104955 - DNA, 25 bp, E. coli
tgacctgaaataaggccgcaccgtt

SEQ ID NO: 104956 - DNA, 25 bp, E. coli
tgaatgccggtgatggctccaacca

SEQ ID NO: 104957 - DNA, 25 bp, E. coli
tgaatgccggtgttggctccaacca

SEQ ID NO: 104958 - DNA, 25 bp, E. coli
tgacctgaaatatggccgcaccgtt

SEQ ID NO: 104959 - DNA, 25 bp, E. coli
tccgagtacgccaacgtgaaagcgc

SEQ ID NO: 104960 - DNA, 25 bp, E. coli
tccgagtacgcctacgtgaaagcgc

SEQ ID NO: 104961 - DNA, 25 bp, E. coli
tccgctgccgcgtgttgatgagatt

SEQ ID NO: 104962 - DNA, 25 bp, E. coli
tccgctgccgcgagttgatgagatt

SEQ ID NO: 104963 - DNA, 25 bp, E. coli
gcagtttgttctacgcgccagcgat

SEQ ID NO: 104964 - DNA, 25 bp, E. coli
gcagtttgttcttcgcgccagcgat

SEQ ID NO: 104965 - DNA, 25 bp, E. coli
tggacaatctccacgtcgcaatggt

SEQ ID NO: 104966 - DNA, 25 bp, E. coli
tggacaatctcctcgtcgcaatggt

SEQ ID NO: 104967 - DNA, 25 bp, E. coli
gatgaccttaatctggtgctggcga

SEQ ID NO: 104968 - DNA, 25 bp, E. coli
gatgaccttaatgtggtgctggcga

SEQ ID NO: 104969 - DNA, 25 bp, E. coli
aattccggggctattgaaagtgatg

SEQ ID NO: 104970 - DNA, 25 bp, E. coli
aattccggggcttttgaaagtgatg

SEQ ID NO: 104971 - DNA, 25 bp, E. coli
ggattcgtttgacaattccggggct

SEQ ID NO: 104972 - DNA, 25 bp, E. coli
ggattcgtttgagaattccggggct

SEQ ID NO: 104973 - DNA, 25 bp, E. coli
attgcggattcgtttgagaattccg

SEQ ID NO: 104974 - DNA, 25 bp, E. coli
attgcggattcgattgagaattccg

SEQ ID NO: 104975 - DNA, 25 bp, E. coli
tgcggattcgtttgagaattccggg

SEQ ID NO: 104976 - DNA, 25 bp, E. coli
tgcggattcgttagagaattccggg

SEQ ID NO: 104977 - DNA, 25 bp, E. coli
ttgcggattcgtatgagaattccgg

SEQ ID NO: 104978 - DNA, 25 bp, E. coli
ttgcggattcgtttgagaattccgg

SEQ ID NO: 104979 - DNA, 25 bp, E. coli
gaattccggggcatttgaaagtgat

SEQ ID NO: 104980 - DNA, 25 bp, E. coli
gaattccggggcttttgaaagtgat

SEQ ID NO: 104981 - DNA, 25 bp, E. coli
gattgcggattcgtttgagaattcc

SEQ ID NO: 104982 - DNA, 25 bp, E. coli
gattcgtttgagtattccggggctt

SEQ ID NO: 104983 - DNA, 25 bp, E. coli
gattgcggattcctttgagaattcc

SEQ ID NO: 104984 - DNA, 25 bp, E. coli
gattcgtttgagaattccggggctt

SEQ ID NO: 104985 - DNA, 25 bp, E. coli
tgagaattccggcgcttttgaaagt

SEQ ID NO: 104986 - DNA, 25 bp, E. coli
tcgtttgagaattccggggcttttg

SEQ ID NO: 104987 - DNA, 25 bp, E. coli
tgagaattccggggcttttgaaagt

SEQ ID NO: 104988 - DNA, 25 bp, E. coli
tcgtttgagaataccggggcttttg

SEQ ID NO: 104989 - DNA, 25 bp, E. coli
gagaattccgggccttttgaaagtg

SEQ ID NO: 104990 - DNA, 25 bp, E. coli
gagaattccggggcttttgaaagtg

SEQ ID NO: 104991 - DNA, 25 bp, E. coli
taaaatcgcgttatcctgcagacgc

SEQ ID NO: 104992 - DNA, 25 bp, E. coli
taaaatcgcgttttcctgcagacgc

SEQ ID NO: 104993 - DNA, 25 bp, E. coli
cactcctgggtgagaattaacgttt

SEQ ID NO: 104994 - DNA, 25 bp, E. coli
cactcctgggtgtgaattaacgttt

SEQ ID NO: 104995 - DNA, 25 bp, E. coli
tatcatatcagaaaaaagggccgga

SEQ ID NO: 104996 - DNA, 25 bp, E. coli
tatcatatcagataaaagggccgga

SEQ ID NO: 104997 - DNA, 25 bp, E. coli
ttatccgaactacgtccgacaaaca

SEQ ID NO: 104998 - DNA, 25 bp, E. coli
ttatccgaactaggtccgacaaaca

SEQ ID NO: 104999 - DNA, 25 bp, E. coli
tgctgtctggtgagccggatgtttt

SEQ ID NO: 105000 - DNA, 25 bp, E. coli
tgcgaattaccgctaaaatcgcgtt

SEQ ID NO: 105001 - DNA, 25 bp, E. coli
tgcgaattaccggtaaaatcgcgtt

SEQ ID NO: 105002 - DNA, 25 bp, E. coli
tgctgtctggtgtgccggatgtttt

SEQ ID NO: 105003 - DNA, 25 bp, E. coli
gcacacgtttgcgtatcatatcaga

SEQ ID NO: 105004 - DNA, 25 bp, E. coli
gcacacgtttgcctatcatatcaga

SEQ ID NO: 105005 - DNA, 25 bp, E. coli
cgtccgacaaactaatttcgtgcga

SEQ ID NO: 105006 - DNA, 25 bp, E. coli
cgtccgacaaacaaatttcgtgcga

SEQ ID NO: 105007 - DNA, 25 bp, E. coli
cgttttaaaatcatttgctgtctgg

SEQ ID NO: 105008 - DNA, 25 bp, E. coli
cgttttaaaatcttttgctgtctgg

SEQ ID NO: 105009 - DNA, 25 bp, E. coli
gttttcctgcagacgcacacgtttg

SEQ ID NO: 105010 - DNA, 25 bp, E. coli
gttttcctgcagtcgcacacgtttg

SEQ ID NO: 105011 - DNA, 25 bp, E. coli
ggccggatgattccagccctgtatt

SEQ ID NO: 105012 - DNA, 25 bp, E. coli
ggccggatgattgcagccctgtatt

SEQ ID NO: 105013 - DNA, 25 bp, E. coli
caacgtggagttggataaatgctct

SEQ ID NO: 105014 - DNA, 25 bp, E. coli
cactgacgtacttctgggaacgact

SEQ ID NO: 105015 - DNA, 25 bp, E. coli
caacgtggagttcgataaatgctct

SEQ ID NO: 105016 - DNA, 25 bp, E. coli
cactgacgtactactgggaacgact

SEQ ID NO: 105017 - DNA, 25 bp, E. coli
taaatgctctgggtcaaatagtggt

SEQ ID NO: 105018 - DNA, 25 bp, E. coli
taaatgctctggctcaaatagtggt

SEQ ID NO: 105019 - DNA, 25 bp, E. coli
aaaaagagagccttgccggagcgtt

SEQ ID NO: 105020 - DNA, 25 bp, E. coli
aaatagtggtatgaggattcaccgg

SEQ ID NO: 105021 - DNA, 25 bp, E. coli
aaaaagagagccatgccggagcgtt

SEQ ID NO: 105022 - DNA, 25 bp, E. coli
aaatagtggtatcaggattcaccgg

SEQ ID NO: 105023 - DNA, 25 bp, E. coli
tattggtggcctcatcagcatcgaa

SEQ ID NO: 105024 - DNA, 25 bp, E. coli
tattggtggcctgatcagcatcgaa

SEQ ID NO: 105025 - DNA, 25 bp, E. coli
tttacatgattctcgcgacagcggg

SEQ ID NO: 105026 - DNA, 25 bp, E. coli
tttacatgattcacgcgacagcggg

SEQ ID NO: 105027 - DNA, 25 bp, E. coli
tgtgaagcagagtaaagcaacgtgg

SEQ ID NO: 105028 - DNA, 25 bp, E. coli
tgtgaagcagagaaaagcaacgtgg

SEQ ID NO: 105029 - DNA, 25 bp, E. coli
tctggtccgctacctgatagatgtg

SEQ ID NO: 105030 - DNA, 25 bp, E. coli
tctggtccgctagctgatagatgtg

SEQ ID NO: 105031 - DNA, 25 bp, E. coli
cgatgggttcggatgcactgacgta

SEQ ID NO: 105032 - DNA, 25 bp, E. coli
cgatgggttcggttgcactgacgta

SEQ ID NO: 105033 - DNA, 25 bp, E. coli
ggctcgttttgctgatcatcgcagg

SEQ ID NO: 105034 - DNA, 25 bp, E. coli
ggctcgttttgcagatcatcgcagg

SEQ ID NO: 105035 - DNA, 25 bp, E. coli
caaaatgctggcacattgcgaagcc

SEQ ID NO: 105036 - DNA, 25 bp, E. coli
caaaatgctggctcattgcgaagcc

SEQ ID NO: 105037 - DNA, 25 bp, E. coli
caccgcgaaggacctgaactggcat

SEQ ID NO: 105038 - DNA, 25 bp, E. coli
caccgcgaaggagctgaactggcat

SEQ ID NO: 105039 - DNA, 25 bp, E. coli
tattggttttgcacctggcgatcag

SEQ ID NO: 105040 - DNA, 25 bp, E. coli
tattggttttgctcctggcgatcag

SEQ ID NO: 105041 - DNA, 25 bp, E. coli
tgttaacgccatctctgctggtccg

SEQ ID NO: 105042 - DNA, 25 bp, E. coli
tgttaacgccatgtctgctggtccg

SEQ ID NO: 105043 - DNA, 25 bp, E. coli
tctggcaaaagcgtctctggaagcg

SEQ ID NO: 105044 - DNA, 25 bp, E. coli
tctggcaaaagcctctctggaagcg

SEQ ID NO: 105045 - DNA, 25 bp, E. coli
cctacagcttcgatgcaatggcaaa

SEQ ID NO: 105046 - DNA, 25 bp, E. coli
cctacagcttcgttgcaatggcaaa

SEQ ID NO: 105047 - DNA, 25 bp, E. coli
gctatatggcgatcgcgatgggtcc

SEQ ID NO: 105048 - DNA, 25 bp, E. coli
gctatatggcgaacgcgatgggtcc

SEQ ID NO: 105049 - DNA, 25 bp, E. coli
gaacgacaaactgaaaggccgcgta

SEQ ID NO: 105050 - DNA, 25 bp, E. coli
gaacgacaaactcaaaggccgcgta

SEQ ID NO: 105051 - DNA, 25 bp, E. coli
ggtatctccggtcaagtggtccacg

SEQ ID NO: 105052 - DNA, 25 bp, E. coli
ggtatctccggtgaagtggtccacg

SEQ ID NO: 105053 - DNA, 25 bp, E. coli
gaccctttcctaccttggcgctgag

SEQ ID NO: 105054 - DNA, 25 bp, E. coli
gatggtgactatcttaacgccgtta

SEQ ID NO: 105055 - DNA, 25 bp, E. coli
gatggtgactatgttaacgccgtta

SEQ ID NO: 105056 - DNA, 25 bp, E. coli
gaccctttcctagcttggcgctgag

SEQ ID NO: 105057 - DNA, 25 bp, E. coli
cactggtggtatgcgcactggtgat

SEQ ID NO: 105058 - DNA, 25 bp, E. coli
cactggtggtatccgcactggtgat

SEQ ID NO: 105059 - DNA, 25 bp, E. coli
taactatcttgcaccggaatccgca

SEQ ID NO: 105060 - DNA, 25 bp, E. coli
tattgattaactttcttgctccgga

SEQ ID NO: 105061 - DNA, 25 bp, E. coli
tattgattaactatcttgctccgga

SEQ ID NO: 105062 - DNA, 25 bp, E. coli
tgttcagtggtatcggcggtccgca

SEQ ID NO: 105063 - DNA, 25 bp, E. coli
tgttcagtggtaacggcggtccgca

SEQ ID NO: 105064 - DNA, 25 bp, E. coli
tgctgttcagtggtaacggcggtcc

SEQ ID NO: 105065 - DNA, 25 bp, E. coli
tgctgttcagtgctaacggcggtcc

SEQ ID NO: 105066 - DNA, 25 bp, E. coli
tccgcatttggcgtgttaatggcac

SEQ ID NO: 105067 - DNA, 25 bp, E. coli
tccgcatttggcctgttaatggcac

SEQ ID NO: 105068 - DNA, 25 bp, E. coli
cctgttaatggctctggtggtatcc

SEQ ID NO: 105069 - DNA, 25 bp, E. coli
cctgttaatggcactggtggtatcc

SEQ ID NO: 105070 - DNA, 25 bp, E. coli
ccggaatccgcatttggcctgttaa

SEQ ID NO: 105071 - DNA, 25 bp, E. coli
ccggaatccgcaattggcctgttaa

SEQ ID NO: 105072 - DNA, 25 bp, E. coli
gctggcttcgctactggctggaact

SEQ ID NO: 105073 - DNA, 25 bp, E. coli
gctggcttcgcttctggctggaact

SEQ ID NO: 105074 - DNA, 25 bp, E. coli
ccaacgtaacagtgtttggtgagat

SEQ ID NO: 105075 - DNA, 25 bp, E. coli
ccaacgtaacagagtttggtgagat

SEQ ID NO: 105076 - DNA, 25 bp, E. coli
ggcagctttgctggcttcgcttctg

SEQ ID NO: 105077 - DNA, 25 bp, E. coli
ggcagctttgctcgcttcgcttctg

SEQ ID NO: 105078 - DNA, 25 bp, E. coli
taactatcttgctccggaatccgca

SEQ ID NO: 105079 - DNA, 25 bp, E. coli
caattacgcagataatggctgggtc

SEQ ID NO: 105080 - DNA, 25 bp, E. coli
caattacgcagaaaatggctgggtc

SEQ ID NO: 105081 - DNA, 25 bp, E. coli
tacaactcagatgacaattacgcag

SEQ ID NO: 105082 - DNA, 25 bp, E. coli
tacaactcagatcacaattacgcag

SEQ ID NO: 105083 - DNA, 25 bp, E. coli
aagagatcggactgggacttagcca

SEQ ID NO: 105084 - DNA, 25 bp, E. coli
aagagatcggacagggacttagcca

SEQ ID NO: 105085 - DNA, 25 bp, E. coli
tatccccttcatagccgaggcaaaa

SEQ ID NO: 105086 - DNA, 25 bp, E. coli
tatccccttcattgccgaggcaaaa

SEQ ID NO: 105087 - DNA, 25 bp, E. coli
tcattcaggtgtcaacgggacggca

SEQ ID NO: 105088 - DNA, 25 bp, E. coli
tcattcaggtgtgaacgggacggca

SEQ ID NO: 105089 - DNA, 25 bp, E. coli
ccaggtcatggcgagataattgaga

SEQ ID NO: 105090 - DNA, 25 bp, E. coli
ccaggtcatggccagataattgaga

SEQ ID NO: 105091 - DNA, 25 bp, E. coli
gcaaattcgagacggattaccggcc

SEQ ID NO: 105092 - DNA, 25 bp, E. coli
gcaaattcgagagggattaccggcc

SEQ ID NO: 105093 - DNA, 25 bp, E. coli
gattaccggccatataggtctgaga

SEQ ID NO: 105094 - DNA, 25 bp, E. coli
gattaccggccaaataggtctgaga

SEQ ID NO: 105095 - DNA, 25 bp, E. coli
ggtcattgttggctatccccttcat

SEQ ID NO: 105096 - DNA, 25 bp, E. coli
ggtcattgttgggtatccccttcat

SEQ ID NO: 105097 - DNA, 25 bp, E. coli
taagttcaggagtagtcattcaggt

SEQ ID NO: 105098 - DNA, 25 bp, E. coli
taagttcaggagaagtcattcaggt

SEQ ID NO: 105099 - DNA, 25 bp, E. coli
gatggccatcatacttacccacatg

SEQ ID NO: 105100 - DNA, 25 bp, E. coli
gatggccatcattcttacccacatg

SEQ ID NO: 105101 - DNA, 25 bp, E. coli
aacgtggtgtcaacccgttaagcta

SEQ ID NO: 105102 - DNA, 25 bp, E. coli
caaacgtggtgtcatcccgttaagc

SEQ ID NO: 105103 - DNA, 25 bp, E. coli
caaacgtggtgtgatcccgttaagc

SEQ ID NO: 105104 - DNA, 25 bp, E. coli
catgttgatcaaacgtggtgtcatc

SEQ ID NO: 105105 - DNA, 25 bp, E. coli
catgttgatcaatcgtggtgtcatc

SEQ ID NO: 105106 - DNA, 25 bp, E. coli
atcatgttgatcaaacgtggtgtca

SEQ ID NO: 105107 - DNA, 25 bp, E. coli
acgtggtgtcatcccgttaagctat

SEQ ID NO: 105108 - DNA, 25 bp, E. coli
atcatgttgatctaacgtggtgtca

SEQ ID NO: 105109 - DNA, 25 bp, E. coli
acgtggtgtcatgccgttaagctat

SEQ ID NO: 105110 - DNA, 25 bp, E. coli
aacgtggtgtcatcccgttaagcta

SEQ ID NO: 105111 - DNA, 25 bp, E. coli
ttgatcaaacgtcgtgtcatcccgt

SEQ ID NO: 105112 - DNA, 25 bp, E. coli
ttgatcaaacgtggtgtcatcccgt

SEQ ID NO: 105113 - DNA, 25 bp, E. coli
tgttgatcaaacgtggtgtcatccc

SEQ ID NO: 105114 - DNA, 25 bp, E. coli
tgttgatcaaacctggtgtcatccc

SEQ ID NO: 105115 - DNA, 25 bp, E. coli
tgatcaaacgtgctgtcatcccgtt

SEQ ID NO: 105116 - DNA, 25 bp, E. coli
tgatcaaacgtggtgtcatcccgtt

SEQ ID NO: 105117 - DNA, 25 bp, E. coli
gatcaaacgtggagtcatcccgtta

SEQ ID NO: 105118 - DNA, 25 bp, E. coli
gatcaaacgtggtgtcatcccgtta

SEQ ID NO: 105119 - DNA, 25 bp, E. coli
gttgatcaaacgtggtgtcatcccg

SEQ ID NO: 105120 - DNA, 25 bp, E. coli
gttgatcaaacgaggtgtcatcccg

SEQ ID NO: 105121 - DNA, 25 bp, E. coli
tcaaacgtggtgtcatcccgttaag

SEQ ID NO: 105122 - DNA, 25 bp, E. coli
tcaaacgtggtgacatcccgttaag

SEQ ID NO: 105123 - DNA, 25 bp, E. coli
cattaggtgatagattaaccttcgc

SEQ ID NO: 105124 - DNA, 25 bp, E. coli
cattaggtgatacattaaccttcgc

SEQ ID NO: 105125 - DNA, 25 bp, E. coli
cagttcgctatcgtacaaattatca

SEQ ID NO: 105126 - DNA, 25 bp, E. coli
cagttcgctatcctacaaattatca

SEQ ID NO: 105127 - DNA, 25 bp, E. coli
aaaaggcaacgcgttaactcgcaga

SEQ ID NO: 105128 - DNA, 25 bp, E. coli
aaaaggcaacgccttaactcgcaga

SEQ ID NO: 105129 - DNA, 25 bp, E. coli
tatgaatacagggatctcaaggcac

SEQ ID NO: 105130 - DNA, 25 bp, E. coli
tagcaactcaatattagcctctcgt

SEQ ID NO: 105131 - DNA, 25 bp, E. coli
tagcaactcaattttagcctctcgt

SEQ ID NO: 105132 - DNA, 25 bp, E. coli
tatgaatacaggcatctcaaggcac

SEQ ID NO: 105133 - DNA, 25 bp, E. coli
tattcctcaaaaaaccaaaagcgcg

SEQ ID NO: 105134 - DNA, 25 bp, E. coli
tattcctcaaaataccaaaagcgcg

SEQ ID NO: 105135 - DNA, 25 bp, E. coli
tcgcagaaagaaaaatacagttcgc

SEQ ID NO: 105136 - DNA, 25 bp, E. coli
tcgcagaaagaataatacagttcgc

SEQ ID NO: 105137 - DNA, 25 bp, E. coli
tctactgttttattttgacgcgggt

SEQ ID NO: 105138 - DNA, 25 bp, E. coli
tctactgttttaatttgacgcgggt

SEQ ID NO: 105139 - DNA, 25 bp, E. coli
gcatctcaaggctcataaacacaaa

SEQ ID NO: 105140 - DNA, 25 bp, E. coli
gcatctcaaggcacataaacacaaa

SEQ ID NO: 105141 - DNA, 25 bp, E. coli
cgcgggttgaaacaggcagaattaa

SEQ ID NO: 105142 - DNA, 25 bp, E. coli
cgcgggttgaaagaggcagaattaa

SEQ ID NO: 105143 - DNA, 25 bp, E. coli
cgctattttctctctctgtgtcgaa

SEQ ID NO: 105144 - DNA, 25 bp, E. coli
cgctattttctcactctgtgtcgaa

SEQ ID NO: 105145 - DNA, 25 bp, E. coli
caataactctgattacgccacatgt

SEQ ID NO: 105146 - DNA, 25 bp, E. coli
caataactctgaatacgccacatgt

SEQ ID NO: 105147 - DNA, 25 bp, E. coli
aaccttgctgctcttaccgttgatg

SEQ ID NO: 105148 - DNA, 25 bp, E. coli
aaccttgctgctgttaccgttgatg

SEQ ID NO: 105149 - DNA, 25 bp, E. coli
tatgctggcagatggtcgcatccct

SEQ ID NO: 105150 - DNA, 25 bp, E. coli
taccgttgatgctcttactgattgc

SEQ ID NO: 105151 - DNA, 25 bp, E. coli
taccgttgatgcacttactgattgc

SEQ ID NO: 105152 - DNA, 25 bp, E. coli
tatgctggcagaaggtcgcatccct

SEQ ID NO: 105153 - DNA, 25 bp, E. coli
tcgagcgttataccgaacttactgg

SEQ ID NO: 105154 - DNA, 25 bp, E. coli
tcgagcgttatagcgaacttactgg

SEQ ID NO: 105155 - DNA, 25 bp, E. coli
gccacatgtcacaatcgagcgttat

SEQ ID NO: 105156 - DNA, 25 bp, E. coli
gccacatgtcactatcgagcgttat

SEQ ID NO: 105157 - DNA, 25 bp, E. coli
gcatccctcggcttcgtcttcgtaa

SEQ ID NO: 105158 - DNA, 25 bp, E. coli
gcatccctcggcatcgtcttcgtaa

SEQ ID NO: 105159 - DNA, 25 bp, E. coli
gaacttactggtctttcaatcgaca

SEQ ID NO: 105160 - DNA, 25 bp, E. coli
gaacttactggtgtttcaatcgaca

SEQ ID NO: 105161 - DNA, 25 bp, E. coli
gacacaatcaaccatatgctggcag

SEQ ID NO: 105162 - DNA, 25 bp, E. coli
gaaaaggtaatgttcaaccttgctg

SEQ ID NO: 105163 - DNA, 25 bp, E. coli
gacacaatcaacgatatgctggcag

SEQ ID NO: 105164 - DNA, 25 bp, E. coli
gaaaaggtaatgatcaaccttgctg

SEQ ID NO: 105165 - DNA, 25 bp, E. coli
gacccctaacatttcaataactctg

SEQ ID NO: 105166 - DNA, 25 bp, E. coli
gacccctaacatatcaataactctg

SEQ ID NO: 105167 - DNA, 25 bp, E. coli
caaaacactgaaaggagctgccgca

SEQ ID NO: 105168 - DNA, 25 bp, E. coli
caaaacactgaatggagctgccgca

SEQ ID NO: 105169 - DNA, 25 bp, E. coli
tacgccaaaacactgaaaggagctg

SEQ ID NO: 105170 - DNA, 25 bp, E. coli
aaaacactgaaaggagctgccgcat

SEQ ID NO: 105171 - DNA, 25 bp, E. coli
aaaacactgaaacgagctgccgcat

SEQ ID NO: 105172 - DNA, 25 bp, E. coli
aacactgaaaggagctgccgcatga

SEQ ID NO: 105173 - DNA, 25 bp, E. coli
aacactgaaaggtgctgccgcatga

SEQ ID NO: 105174 - DNA, 25 bp, E. coli
tacgccaaaacagtgaaaggagctg

SEQ ID NO: 105175 - DNA, 25 bp, E. coli
tttgagtcttatttggcagaacgtc

SEQ ID NO: 105176 - DNA, 25 bp, E. coli
tttgagtcttatatggcagaacgtc

SEQ ID NO: 105177 - DNA, 25 bp, E. coli
ttacgccaaaactctgaaaggagct

SEQ ID NO: 105178 - DNA, 25 bp, E. coli
ttacgccaaaacactgaaaggagct

SEQ ID NO: 105179 - DNA, 25 bp, E. coli
tgagtcttatatggcagaacgtctt

SEQ ID NO: 105180 - DNA, 25 bp, E. coli
tgagtcttatatcgcagaacgtctt

SEQ ID NO: 105181 - DNA, 25 bp, E. coli
gccaaaacactgtaaggagctgccg

SEQ ID NO: 105182 - DNA, 25 bp, E. coli
gccaaaacactgaaaggagctgccg

SEQ ID NO: 105183 - DNA, 25 bp, E. coli
cgctggatgcgcgtgcgcttatatc

SEQ ID NO: 105184 - DNA, 25 bp, E. coli
cgctggatgcgcctgcgcttatatc

SEQ ID NO: 105185 - DNA, 25 bp, E. coli
ctggatgcgcctgcgcttatatcgt

SEQ ID NO: 105186 - DNA, 25 bp, E. coli
ctggatgcgcctccgcttatatcgt

SEQ ID NO: 105187 - DNA, 25 bp, E. coli
gtcttatatggcagaacgtcttcgc

SEQ ID NO: 105188 - DNA, 25 bp, E. coli
gtcttatatggctgaacgtcttcgc

SEQ ID NO: 105189 - DNA, 25 bp, E. coli
cacgatggtgttcttgaaagaagca

SEQ ID NO: 105190 - DNA, 25 bp, E. coli
cacgatggtgttgttgaaagaagca

SEQ ID NO: 105191 - DNA, 25 bp, E. coli
caaacggagtggttttgcgagaacc

SEQ ID NO: 105192 - DNA, 25 bp, E. coli
caaacggagtggatttgcgagaacc

SEQ ID NO: 105193 - DNA, 25 bp, E. coli
cataacttccagtttcttgatgccg

SEQ ID NO: 105194 - DNA, 25 bp, E. coli
cataacttccagattcttgatgccg

SEQ ID NO: 105195 - DNA, 25 bp, E. coli
aacgcgttacccagacgatcagtga

SEQ ID NO: 105196 - DNA, 25 bp, E. coli
aacgcgttaccctgacgatcagtga

SEQ ID NO: 105197 - DNA, 25 bp, E. coli
ttagtgatgcggaaacctgcggcgt

SEQ ID NO: 105198 - DNA, 25 bp, E. coli
ttagtgatgcggtaacctgcggcgt

SEQ ID NO: 105199 - DNA, 25 bp, E. coli
tgagccacgccgtcagagacttgtt

SEQ ID NO: 105200 - DNA, 25 bp, E. coli
tgagccacgccgacagagacttgtt

SEQ ID NO: 105201 - DNA, 25 bp, E. coli
gcggcgttcagagcacgaatagtag

SEQ ID NO: 105202 - DNA, 25 bp, E. coli
gcggcgttcagaccacgaatagtag

SEQ ID NO: 105203 - DNA, 25 bp, E. coli
gaagcatggataagagccacgccgt

SEQ ID NO: 105204 - DNA, 25 bp, E. coli
gaatagtagattggcggcctggacc

SEQ ID NO: 105205 - DNA, 25 bp, E. coli
gaatagtagattcgcggcctggacc

SEQ ID NO: 105206 - DNA, 25 bp, E. coli
gaagcatggatatgagccacgccgt

SEQ ID NO: 105207 - DNA, 25 bp, E. coli
cgtattctttcagggcgtcagcgca

SEQ ID NO: 105208 - DNA, 25 bp, E. coli
cgtattctttcacggcgtcagcgca

SEQ ID NO: 105209 - DNA, 25 bp, E. coli
gagggatcggagacacatcagtaat

SEQ ID NO: 105210 - DNA, 25 bp, E. coli
gagggatcggagtcacatcagtaat

SEQ ID NO: 105211 - DNA, 25 bp, E. coli
caataaacgagaatggggaggcaac

SEQ ID NO: 105212 - DNA, 25 bp, E. coli
caataaacgagattggggaggcaac

SEQ ID NO: 105213 - DNA, 25 bp, E. coli
cagaacccgatcctattttgcaact

SEQ ID NO: 105214 - DNA, 25 bp, E. coli
cagaacccgatcgtattttgcaact

SEQ ID NO: 105215 - DNA, 25 bp, E. coli
attttgcaactaactgccgaacagg

SEQ ID NO: 105216 - DNA, 25 bp, E. coli
attttgcaactatctgccgaacagg

SEQ ID NO: 105217 - DNA, 25 bp, E. coli
ttgaactgacggtgagctgcctgat

SEQ ID NO: 105218 - DNA, 25 bp, E. coli
tttagccgattaggtgcgcaagttc

SEQ ID NO: 105219 - DNA, 25 bp, E. coli
tttagccgattacgtgcgcaagttc

SEQ ID NO: 105220 - DNA, 25 bp, E. coli
ttgaactgacggagagctgcctgat

SEQ ID NO: 105221 - DNA, 25 bp, E. coli
tgacggagagctgcctgattgagaa

SEQ ID NO: 105222 - DNA, 25 bp, E. coli
tgacggagagctccctgattgagaa

SEQ ID NO: 105223 - DNA, 25 bp, E. coli
ccgaaatcacagtacccgatcgtat

SEQ ID NO: 105224 - DNA, 25 bp, E. coli
cgattaggtgcgcaagttcatctgg

SEQ ID NO: 105225 - DNA, 25 bp, E. coli
ccgaaatcacagaacccgatcgtat

SEQ ID NO: 105226 - DNA, 25 bp, E. coli
cgattaggtgcggaagttcatctgg

SEQ ID NO: 105227 - DNA, 25 bp, E. coli
gatcgtattttgcaactatctgccg

SEQ ID NO: 105228 - DNA, 25 bp, E. coli
gatcgtattttggaactatctgccg

SEQ ID NO: 105229 - DNA, 25 bp, E. coli
ggagagctgcctgattgagaatgat

SEQ ID NO: 105230 - DNA, 25 bp, E. coli
ggagagctgcctcattgagaatgat

SEQ ID NO: 105231 - DNA, 25 bp, E. coli
gatgttgaactgacggagagctgcc

SEQ ID NO: 105232 - DNA, 25 bp, E. coli
gatgttgaactgtcggagagctgcc

SEQ ID NO: 105233 - DNA, 25 bp, E. coli
aatagccaggacgtgatgcaagcgg

SEQ ID NO: 105234 - DNA, 25 bp, E. coli
aatagccaggacctgatgcaagcgg

SEQ ID NO: 105235 - DNA, 25 bp, E. coli
cacattaagtgaagttgcggtccct

SEQ ID NO: 105236 - DNA, 25 bp, E. coli
cacattaagtgatgttgcggtccct

SEQ ID NO: 105237 - DNA, 25 bp, E. coli
taactccgaggctatcaaacatgcg

SEQ ID NO: 105238 - DNA, 25 bp, E. coli
ttgaccgacctgcaagggcagcttg

SEQ ID NO: 105239 - DNA, 25 bp, E. coli
ttgttaatgaactcgggcggctgct

SEQ ID NO: 105240 - DNA, 25 bp, E. coli
ttgttaatgaacacgggcggctgct

SEQ ID NO: 105241 - DNA, 25 bp, E. coli
ttgaccgacctggaagggcagcttg

SEQ ID NO: 105242 - DNA, 25 bp, E. coli
tttattgaaggaccgtgccacagca

SEQ ID NO: 105243 - DNA, 25 bp, E. coli
tttattgaaggagcgtgccacagca

SEQ ID NO: 105244 - DNA, 25 bp, E. coli
tgggaattagttgcctgtcgcgacg

SEQ ID NO: 105245 - DNA, 25 bp, E. coli
tgggaattagttccctgtcgcgacg

SEQ ID NO: 105246 - DNA, 25 bp, E. coli
gaacaactgtttcgcgaagacaacg

SEQ ID NO: 105247 - DNA, 25 bp, E. coli
gaaatcatttctgaaccgtggctgg

SEQ ID NO: 105248 - DNA, 25 bp, E. coli
gaaatcatttctcaaccgtggctgg

SEQ ID NO: 105249 - DNA, 25 bp, E. coli
gaacaactgtttggcgaagacaacg

SEQ ID NO: 105250 - DNA, 25 bp, E. coli
cgttgtggcgtatacatcatcggca

SEQ ID NO: 105251 - DNA, 25 bp, E. coli
cgttgtggcgtaaacatcatcggca

SEQ ID NO: 105252 - DNA, 25 bp, E. coli
ggtccggtcaccttagaacagctgg

SEQ ID NO: 105253 - DNA, 25 bp, E. coli
ggtccggtcaccatagaacagctgg

SEQ ID NO: 105254 - DNA, 25 bp, E. coli
taactccgaggcaatcaaacatgcg

SEQ ID NO: 105255 - DNA, 25 bp, E. coli
caacttggctggcatagctgcgaca

SEQ ID NO: 105256 - DNA, 25 bp, E. coli
caacttggctgggatagctgcgaca

SEQ ID NO: 105257 - DNA, 25 bp, E. coli
catcattttggttactggcgacgcg

SEQ ID NO: 105258 - DNA, 25 bp, E. coli
cagggctttcgcctcgggatcatcg

SEQ ID NO: 105259 - DNA, 25 bp, E. coli
cagggctttcgcgtcgggatcatcg

SEQ ID NO: 105260 - DNA, 25 bp, E. coli
catcattttggtaactggcgacgcg

SEQ ID NO: 105261 - DNA, 25 bp, E. coli
tactgggccgcctgttttggaccgg

SEQ ID NO: 105262 - DNA, 25 bp, E. coli
taaagtgctgtacgcccatgcttcg

SEQ ID NO: 105263 - DNA, 25 bp, E. coli
tactgggccgccagttttggaccgg

SEQ ID NO: 105264 - DNA, 25 bp, E. coli
taaagtgctgtaggcccatgcttcg

SEQ ID NO: 105265 - DNA, 25 bp, E. coli
tacgtcatgacgatgcctacacgcc

SEQ ID NO: 105266 - DNA, 25 bp, E. coli
tacgtcatgacgttgcctacacgcc

SEQ ID NO: 105267 - DNA, 25 bp, E. coli
tgggaaaaaaccaacgtgttgctgc

SEQ ID NO: 105268 - DNA, 25 bp, E. coli
tgggaaaaaacctacgtgttgctgc

SEQ ID NO: 105269 - DNA, 25 bp, E. coli
tgccgtgcgcggttaacaaaccggt

SEQ ID NO: 105270 - DNA, 25 bp, E. coli
tgccgtgcgcggataacaaaccggt

SEQ ID NO: 105271 - DNA, 25 bp, E. coli
gtatgtcgatcacccaagcttcggg

SEQ ID NO: 105272 - DNA, 25 bp, E. coli
gattactggtcccataccgtgcgcc

SEQ ID NO: 105273 - DNA, 25 bp, E. coli
gattactggtccgataccgtgcgcc

SEQ ID NO: 105274 - DNA, 25 bp, E. coli
gtatgtcgatcagccaagcttcggg

SEQ ID NO: 105275 - DNA, 25 bp, E. coli
tggtggattcgatagccgacatgct

SEQ ID NO: 105276 - DNA, 25 bp, E. coli
tggtggattcgaaagccgacatgct

SEQ ID NO: 105277 - DNA, 25 bp, E. coli
caagaacgccgttaaatggtggtga

SEQ ID NO: 105278 - DNA, 25 bp, E. coli
aagtggtctggtacgcaccggatca

SEQ ID NO: 105279 - DNA, 25 bp, E. coli
aagtggtctggttcgcaccggatca

SEQ ID NO: 105280 - DNA, 25 bp, E. coli
caagaacgccgtaaaatggtggtga

SEQ ID NO: 105281 - DNA, 25 bp, E. coli
taccgcctcggttgtggattaggaa

SEQ ID NO: 105282 - DNA, 25 bp, E. coli
taccgcctcggtagtggattaggaa

SEQ ID NO: 105283 - DNA, 25 bp, E. coli
aacacattcgtgacgtgcaggcgca

SEQ ID NO: 105284 - DNA, 25 bp, E. coli
aacacattcgtgtcgtgcaggcgca

SEQ ID NO: 105285 - DNA, 25 bp, E. coli
aaacgcggcatcctgttagttggca

SEQ ID NO: 105286 - DNA, 25 bp, E. coli
aaacgcggcatcgtgttagttggca

SEQ ID NO: 105287 - DNA, 25 bp, E. coli
taccgccgcgtggatgaacaaagtg

SEQ ID NO: 105288 - DNA, 25 bp, E. coli
taccgccgcgtgcatgaacaaagtg

SEQ ID NO: 105289 - DNA, 25 bp, E. coli
ttgtgcatcgcaacctggaactgtg

SEQ ID NO: 105290 - DNA, 25 bp, E. coli
ttgtgcatcgcatcctggaactgtg

SEQ ID NO: 105291 - DNA, 25 bp, E. coli
tgctcgaccgcaaagatttaaaagg

SEQ ID NO: 105292 - DNA, 25 bp, E. coli
tgctcgaccgcatagatttaaaagg

SEQ ID NO: 105293 - DNA, 25 bp, E. coli
tcccggaaatgaccgaacaagaacg

SEQ ID NO: 105294 - DNA, 25 bp, E. coli
tcccggaaatgagcgaacaagaacg

SEQ ID NO: 105295 - DNA, 25 bp, E. coli
cgcggcagtttgctatgcaggaacc

SEQ ID NO: 105296 - DNA, 25 bp, E. coli
cgcggcagtttggtatgcaggaacc

SEQ ID NO: 105297 - DNA, 25 bp, E. coli
ctgattgactggctacaaacctggg

SEQ ID NO: 105298 - DNA, 25 bp, E. coli
ctgattgactgggtacaaacctggg

SEQ ID NO: 105299 - DNA, 25 bp, E. coli
cactccggtatcagaaatggctacg

SEQ ID NO: 105300 - DNA, 25 bp, E. coli
cactccggtatctgaaatggctacg

SEQ ID NO: 105301 - DNA, 25 bp, E. coli
agcctatgctgtgggttacgaaagc

SEQ ID NO: 105302 - DNA, 25 bp, E. coli
agcctatgctgtcggttacgaaagc

SEQ ID NO: 105303 - DNA, 25 bp, E. coli
ttacgatgtcaccacagcagcctat

SEQ ID NO: 105304 - DNA, 25 bp, E. coli
ttacgatgtcacgacagcagcctat

SEQ ID NO: 105305 - DNA, 25 bp, E. coli
gctacgtctcaaagaagtcaggcga

SEQ ID NO: 105306 - DNA, 25 bp, E. coli
gctacgtctcaatgaagtcaggcga

SEQ ID NO: 105307 - DNA, 25 bp, E. coli
gcagcctatgctgtcggttacgaaa

SEQ ID NO: 105308 - DNA, 25 bp, E. coli
gcagcctatgctctcggttacgaaa

SEQ ID NO: 105309 - DNA, 25 bp, E. coli
gaaatggctacgactcaatgaagtc

SEQ ID NO: 105310 - DNA, 25 bp, E. coli
gaaatggctacgtctcaatgaagtc

SEQ ID NO: 105311 - DNA, 25 bp, E. coli
gaacattacgatctcaccacagcag

SEQ ID NO: 105312 - DNA, 25 bp, E. coli
gaacattacgatgtcaccacagcag

SEQ ID NO: 105313 - DNA, 25 bp, E. coli
cggtatcagaaatggctacgtctca

SEQ ID NO: 105314 - DNA, 25 bp, E. coli
cggtatcagaaaaggctacgtctca

SEQ ID NO: 105315 - DNA, 25 bp, E. coli
gatgctgaatgaacattacgatgtc

SEQ ID NO: 105316 - DNA, 25 bp, E. coli
gatgtcaccacagcagcctatgctg

SEQ ID NO: 105317 - DNA, 25 bp, E. coli
gatgtcaccacaccagcctatgctg

SEQ ID NO: 105318 - DNA, 25 bp, E. coli
gagtccactccggtatcagaaatgg

SEQ ID NO: 105319 - DNA, 25 bp, E. coli
gatgctgaatgatcattacgatgtc

SEQ ID NO: 105320 - DNA, 25 bp, E. coli
gagtccactccgctatcagaaatgg

SEQ ID NO: 105321 - DNA, 25 bp, E. coli
cacatggcgttcgtggtcgtgccga

SEQ ID NO: 105322 - DNA, 25 bp, E. coli
cacatggcgttcctggtcgtgccga

SEQ ID NO: 105323 - DNA, 25 bp, E. coli
catggcgttcctggtcgtgccgatg

SEQ ID NO: 105324 - DNA, 25 bp, E. coli
catggcgttcctcgtcgtgccgatg

SEQ ID NO: 105325 - DNA, 25 bp, E. coli
aaccttgccagtgtgcgagctggtg

SEQ ID NO: 105326 - DNA, 25 bp, E. coli
aaccttgccagtctgcgagctggtg

SEQ ID NO: 105327 - DNA, 25 bp, E. coli
tattagtggcgcaggcgctgctgat

SEQ ID NO: 105328 - DNA, 25 bp, E. coli
tattagtggcgctggcgctgctgat

SEQ ID NO: 105329 - DNA, 25 bp, E. coli
tgaccaggaagttccgactgcgttc

SEQ ID NO: 105330 - DNA, 25 bp, E. coli
tgaccaggaagtaccgactgcgttc

SEQ ID NO: 105331 - DNA, 25 bp, E. coli
tccgactgcgttggaaaagccggat

SEQ ID NO: 105332 - DNA, 25 bp, E. coli
tccgactgcgttcgaaaagccggat

SEQ ID NO: 105333 - DNA, 25 bp, E. coli
tctgcgagctggagggcgtgtggtg

SEQ ID NO: 105334 - DNA, 25 bp, E. coli
tctgcgagctggtgggcgtgtggtg

SEQ ID NO: 105335 - DNA, 25 bp, E. coli
gcgctggcgctggtgatactgaaaa

SEQ ID NO: 105336 - DNA, 25 bp, E. coli
gcgctggcgctgctgatactgaaaa

SEQ ID NO: 105337 - DNA, 25 bp, E. coli
gaacgccaaccttgccagtctgcga

SEQ ID NO: 105338 - DNA, 25 bp, E. coli
gaagttccgactccgttcgaaaagc

SEQ ID NO: 105339 - DNA, 25 bp, E. coli
gaacgccaacctagccagtctgcga

SEQ ID NO: 105340 - DNA, 25 bp, E. coli
gaagttccgactgcgttcgaaaagc

SEQ ID NO: 105341 - DNA, 25 bp, E. coli
gtcgcacatggcgttcctggtcgtg

SEQ ID NO: 105342 - DNA, 25 bp, E. coli
gtcgcacatggccttcctggtcgtg

SEQ ID NO: 105343 - DNA, 25 bp, E. coli
caatccacagtatgtggctcgcgaa

SEQ ID NO: 105344 - DNA, 25 bp, E. coli
caatccacagtaagtggctcgcgaa

SEQ ID NO: 105345 - DNA, 25 bp, E. coli
aatccacagtatgtggctcgcgaat

SEQ ID NO: 105346 - DNA, 25 bp, E. coli
aatccacagtatctggctcgcgaat

SEQ ID NO: 105347 - DNA, 25 bp, E. coli
cacagtatgtgggtcgcgaatcaat

SEQ ID NO: 105348 - DNA, 25 bp, E. coli
cacagtatgtggctcgcgaatcaat

SEQ ID NO: 105349 - DNA, 25 bp, E. coli
cagtatgtggctcgcgaatcaatca

SEQ ID NO: 105350 - DNA, 25 bp, E. coli
cagtatgtggctggcgaatcaatca

SEQ ID NO: 105351 - DNA, 25 bp, E. coli
agtatgtggctcccgaatcaatcac

SEQ ID NO: 105352 - DNA, 25 bp, E. coli
atgtggctcgcgaatcaatcactca

SEQ ID NO: 105353 - DNA, 25 bp, E. coli
atccacagtatgaggctcgcgaatc

SEQ ID NO: 105354 - DNA, 25 bp, E. coli
atgtggctcgcgtatcaatcactca

SEQ ID NO: 105355 - DNA, 25 bp, E. coli
agtatgtggctcgcgaatcaatcac

SEQ ID NO: 105356 - DNA, 25 bp, E. coli
atccacagtatgtggctcgcgaatc

SEQ ID NO: 105357 - DNA, 25 bp, E. coli
acagtatgtggctcgcgaatcaatc

SEQ ID NO: 105358 - DNA, 25 bp, E. coli
acagtatgtggcacgcgaatcaatc

SEQ ID NO: 105359 - DNA, 25 bp, E. coli
tatgtggctcgcgaatcaatcactc

SEQ ID NO: 105360 - DNA, 25 bp, E. coli
tatgtggctcgccaatcaatcactc

SEQ ID NO: 105361 - DNA, 25 bp, E. coli
tgtggctcgcgaatcaatcactcag

SEQ ID NO: 105362 - DNA, 25 bp, E. coli
tgtggctcgcgattcaatcactcag

SEQ ID NO: 105363 - DNA, 25 bp, E. coli
tccacagtatgtcgctcgcgaatca

SEQ ID NO: 105364 - DNA, 25 bp, E. coli
tccacagtatgtggctcgcgaatca

SEQ ID NO: 105365 - DNA, 25 bp, E. coli
caacggtctgaaaaaggatccatcc

SEQ ID NO: 105366 - DNA, 25 bp, E. coli
caaatcagtcgtcttggtgggccga

SEQ ID NO: 105367 - DNA, 25 bp, E. coli
caaatcagtcgtgttggtgggccga

SEQ ID NO: 105368 - DNA, 25 bp, E. coli
caacggtctgaataaggatccatcc

SEQ ID NO: 105369 - DNA, 25 bp, E. coli
atattgatctcagtctggcccaggc

SEQ ID NO: 105370 - DNA, 25 bp, E. coli
atattgatctcactctggcccaggc

SEQ ID NO: 105371 - DNA, 25 bp, E. coli
tatgcgctgacctctaatcagggcg

SEQ ID NO: 105372 - DNA, 25 bp, E. coli
tatgcgctgaccactaatcagggcg

SEQ ID NO: 105373 - DNA, 25 bp, E. coli
tgaaagcccctgatacgcgtaacga

SEQ ID NO: 105374 - DNA, 25 bp, E. coli
tgaaagcccctgttacgcgtaacga

SEQ ID NO: 105375 - DNA, 25 bp, E. coli
tctggaagacgtacgcaaaggcagt

SEQ ID NO: 105376 - DNA, 25 bp, E. coli
tctggaagacgttcgcaaaggcagt

SEQ ID NO: 105377 - DNA, 25 bp, E. coli
ccaggcggtggcgaaaaatctcggt

SEQ ID NO: 105378 - DNA, 25 bp, E. coli
cctcactcgtttgggatgaagcaca

SEQ ID NO: 105379 - DNA, 25 bp, E. coli
ccaggcggtggccaaaaatctcggt

SEQ ID NO: 105380 - DNA, 25 bp, E. coli
cctcactcgtttcggatgaagcaca

SEQ ID NO: 105381 - DNA, 25 bp, E. coli
gatcaaaactcagtgcgtgccggta

SEQ ID NO: 105382 - DNA, 25 bp, E. coli
gatcaaaactcactgcgtgccggta

SEQ ID NO: 105383 - DNA, 25 bp, E. coli
tcagcgtgtcgggaaaatggtgctc

SEQ ID NO: 105384 - DNA, 25 bp, E. coli
tcagcgtgtcggcaaaatggtgctc

SEQ ID NO: 105385 - DNA, 25 bp, E. coli
gacgcgcgcaagtttaaagcaacaa

SEQ ID NO: 105386 - DNA, 25 bp, E. coli
gacgcgcgcaagattaaagcaacaa

SEQ ID NO: 105387 - DNA, 25 bp, E. coli
aatcgttaaacggtgccttgtcggg

SEQ ID NO: 105388 - DNA, 25 bp, E. coli
aatcgttaaacgctgccttgtcggg

SEQ ID NO: 105389 - DNA, 25 bp, E. coli
cagccgccacaataggtgtatgact

SEQ ID NO: 105390 - DNA, 25 bp, E. coli
cagccgccacaaaaggtgtatgact

SEQ ID NO: 105391 - DNA, 25 bp, E. coli
cagttgccgcgctgggtttatgtaa

SEQ ID NO: 105392 - DNA, 25 bp, E. coli
cagttgccgcgcagggtttatgtaa

SEQ ID NO: 105393 - DNA, 25 bp, E. coli
acctccgtggaagggctgaaactga

SEQ ID NO: 105394 - DNA, 25 bp, E. coli
acctccgtggaacggctgaaactga

SEQ ID NO: 105395 - DNA, 25 bp, E. coli
aaagatgtgtgaagcaacagccgcc

SEQ ID NO: 105396 - DNA, 25 bp, E. coli
aaagatgtgtgatgcaacagccgcc

SEQ ID NO: 105397 - DNA, 25 bp, E. coli
gcattggtaataggtcgggcgtcat

SEQ ID NO: 105398 - DNA, 25 bp, E. coli
gcattggtaatacgtcgggcgtcat

SEQ ID NO: 105399 - DNA, 25 bp, E. coli
gaagggcttatcaccaacgtgctgc

SEQ ID NO: 105400 - DNA, 25 bp, E. coli
gaacgacaggcagcagaagggctta

SEQ ID NO: 105401 - DNA, 25 bp, E. coli
gaacgacaggcaccagaagggctta

SEQ ID NO: 105402 - DNA, 25 bp, E. coli
gaagggcttatctccaacgtgctgc

SEQ ID NO: 105403 - DNA, 25 bp, E. coli
gactcggtggtgtcgtttgccttca

SEQ ID NO: 105404 - DNA, 25 bp, E. coli
gaaattgctcaaacagcggcgctgg

SEQ ID NO: 105405 - DNA, 25 bp, E. coli
gactcggtggtgacgtttgccttca

SEQ ID NO: 105406 - DNA, 25 bp, E. coli
gaaattgctcaatcagcggcgctgg

SEQ ID NO: 105407 - DNA, 25 bp, E. coli
ggcaaaaccattacggaacgacagg

SEQ ID NO: 105408 - DNA, 25 bp, E. coli
ggcaaaaccatttcggaacgacagg

SEQ ID NO: 105409 - DNA, 25 bp, E. coli
aagcggttactgttgccgatggcaa

SEQ ID NO: 105410 - DNA, 25 bp, E. coli
aagcggttactgatgccgatggcaa

SEQ ID NO: 105411 - DNA, 25 bp, E. coli
gaaggttactgggaacccaagcacc

SEQ ID NO: 105412 - DNA, 25 bp, E. coli
gaaggttactggcaacccaagcacc

SEQ ID NO: 105413 - DNA, 25 bp, E. coli
cacaagcgcaggaggaatgcaaaca

SEQ ID NO: 105414 - DNA, 25 bp, E. coli
cacaagcgcaggtggaatgcaaaca

SEQ ID NO: 105415 - DNA, 25 bp, E. coli
taaaagcatccctagcgaatggagc

SEQ ID NO: 105416 - DNA, 25 bp, E. coli
taaaagcatcccaagcgaatggagc

SEQ ID NO: 105417 - DNA, 25 bp, E. coli
agatatatcgctagtggcaggccca

SEQ ID NO: 105418 - DNA, 25 bp, E. coli
agatatatcgcttgtggcaggccca

SEQ ID NO: 105419 - DNA, 25 bp, E. coli
taccgtgacagcttcgatggttggc

SEQ ID NO: 105420 - DNA, 25 bp, E. coli
taccgtgacagcatcgatggttggc

SEQ ID NO: 105421 - DNA, 25 bp, E. coli
tgagcgatggcgacaaagcggttac

SEQ ID NO: 105422 - DNA, 25 bp, E. coli
tgagcgatggcgtcaaagcggttac

SEQ ID NO: 105423 - DNA, 25 bp, E. coli
tcggtgtcaatgctcctaaaggcgc

SEQ ID NO: 105424 - DNA, 25 bp, E. coli
tcggtgtcaatggtcctaaaggcgc

SEQ ID NO: 105425 - DNA, 25 bp, E. coli
gcagtccatccttaagaacaaccag

SEQ ID NO: 105426 - DNA, 25 bp, E. coli
gcagtccatcctaaagaacaaccag

SEQ ID NO: 105427 - DNA, 25 bp, E. coli
cattggaatgaccaggctacaggca

SEQ ID NO: 105428 - DNA, 25 bp, E. coli
cattggaatgacgaggctacaggca

SEQ ID NO: 105429 - DNA, 25 bp, E. coli
tggaaacggcaacccagtagaaggt

SEQ ID NO: 105430 - DNA, 25 bp, E. coli
tggaaacggcaagccagtagaaggt

SEQ ID NO: 105431 - DNA, 25 bp, E. coli
aagttttccactgacaacgcgggca

SEQ ID NO: 105432 - DNA, 25 bp, E. coli
aagttttccactcacaacgcgggca

SEQ ID NO: 105433 - DNA, 25 bp, E. coli
taactcagcgctcgatacgggtggc

SEQ ID NO: 105434 - DNA, 25 bp, E. coli
taactcagcgctggatacgggtggc

SEQ ID NO: 105435 - DNA, 25 bp, E. coli
taccccgcgctcttggaatgctttc

SEQ ID NO: 105436 - DNA, 25 bp, E. coli
taccccgcgctcatggaatgctttc

SEQ ID NO: 105437 - DNA, 25 bp, E. coli
tgtgcgtaggtatcgctaactcagc

SEQ ID NO: 105438 - DNA, 25 bp, E. coli
tgttatcggtttgtcagcagctggc

SEQ ID NO: 105439 - DNA, 25 bp, E. coli
tgtgcgtaggtaacgctaactcagc

SEQ ID NO: 105440 - DNA, 25 bp, E. coli
tgttatcggtttctcagcagctggc

SEQ ID NO: 105441 - DNA, 25 bp, E. coli
tcgattttactttcgcgctgctggc

SEQ ID NO: 105442 - DNA, 25 bp, E. coli
tcgattttacttacgcgctgctggc

SEQ ID NO: 105443 - DNA, 25 bp, E. coli
gcaaaccgttagtctggctggaagg

SEQ ID NO: 105444 - DNA, 25 bp, E. coli
gcaaaccgttagactggctggaagg

SEQ ID NO: 105445 - DNA, 25 bp, E. coli
gaaaagcaaattgcccagccagttg

SEQ ID NO: 105446 - DNA, 25 bp, E. coli
gaaagcctctggttcggcggtcata

SEQ ID NO: 105447 - DNA, 25 bp, E. coli
gaaagcctctggatcggcggtcata

SEQ ID NO: 105448 - DNA, 25 bp, E. coli
gaaaagcaaattccccagccagttg

SEQ ID NO: 105449 - DNA, 25 bp, E. coli
gttatctgtcgaacatcggcctgca

SEQ ID NO: 105450 - DNA, 25 bp, E. coli
gttatctgtcgatcatcggcctgca

SEQ ID NO: 105451 - DNA, 25 bp, E. coli
gggcaaatgttcaacccaatgctgg

SEQ ID NO: 105452 - DNA, 25 bp, E. coli
gggcaaatgttctacccaatgctgg

SEQ ID NO: 105453 - DNA, 25 bp, E. coli
tacagttcagcgtcaagtttatcca

SEQ ID NO: 105454 - DNA, 25 bp, E. coli
tacagttcagcgacaagtttatcca

SEQ ID NO: 105455 - DNA, 25 bp, E. coli
acttgcttacgctgctcttcacggg

SEQ ID NO: 105456 - DNA, 25 bp, E. coli
acttgcttacgcagctcttcacggg

SEQ ID NO: 105457 - DNA, 25 bp, E. coli
tatccacgatgtggctgttagcagc

SEQ ID NO: 105458 - DNA, 25 bp, E. coli
tatccacgatgtcgctgttagcagc

SEQ ID NO: 105459 - DNA, 25 bp, E. coli
ttcgatgatcttgtcggcgccagca

SEQ ID NO: 105460 - DNA, 25 bp, E. coli
ttcgatgatcttctcggcgccagca

SEQ ID NO: 105461 - DNA, 25 bp, E. coli
tgttagcagcttgatccacggaacg

SEQ ID NO: 105462 - DNA, 25 bp, E. coli
tgttagcagcttcatccacggaacg

SEQ ID NO: 105463 - DNA, 25 bp, E. coli
tgctcgatgattacctgggcttccg

SEQ ID NO: 105464 - DNA, 25 bp, E. coli
tgctcgatgatttcctgggcttccg

SEQ ID NO: 105465 - DNA, 25 bp, E. coli
tcgttctgcggaagcaaggccgtca

SEQ ID NO: 105466 - DNA, 25 bp, E. coli
tcgttctgcggatgcaaggccgtca

SEQ ID NO: 105467 - DNA, 25 bp, E. coli
tccagaatctgccagcggcgtttgt

SEQ ID NO: 105468 - DNA, 25 bp, E. coli
tccagaatctgcgagcggcgtttgt

SEQ ID NO: 105469 - DNA, 25 bp, E. coli
tcttcacgggcaggtttacgctcgg

SEQ ID NO: 105470 - DNA, 25 bp, E. coli
tcttcacgggcacgtttacgctcgg

SEQ ID NO: 105471 - DNA, 25 bp, E. coli
gccagcaacagcgaggatagcaact

SEQ ID NO: 105472 - DNA, 25 bp, E. coli
gccagcaacagccaggatagcaact

SEQ ID NO: 105473 - DNA, 25 bp, E. coli
gcttttttcagcaggtcggtcgcgc

SEQ ID NO: 105474 - DNA, 25 bp, E. coli
gcttttttcagctggtcggtcgcgc

SEQ ID NO: 105475 - DNA, 25 bp, E. coli
aatgctggcatttggcactggcacg

SEQ ID NO: 105476 - DNA, 25 bp, E. coli
aatgctggcattaggcactggcacg

SEQ ID NO: 105477 - DNA, 25 bp, E. coli
caaagcgttttgaatgccctggcac

SEQ ID NO: 105478 - DNA, 25 bp, E. coli
caaagcgttttgtatgccctggcac

SEQ ID NO: 105479 - DNA, 25 bp, E. coli
cagatccgcgcatcaggtgtgggaa

SEQ ID NO: 105480 - DNA, 25 bp, E. coli
cagatccgcgcaacaggtgtgggaa

SEQ ID NO: 105481 - DNA, 25 bp, E. coli
catttaacggtatgttgctggcggg

SEQ ID NO: 105482 - DNA, 25 bp, E. coli
agcctgatgtattgcggtgttccca

SEQ ID NO: 105483 - DNA, 25 bp, E. coli
agcctgatgtatagcggtgttccca

SEQ ID NO: 105484 - DNA, 25 bp, E. coli
tatttgcgccagtaacggcaaccgc

SEQ ID NO: 105485 - DNA, 25 bp, E. coli
tatttgcgccagaaacggcaaccgc

SEQ ID NO: 105486 - DNA, 25 bp, E. coli
ttgttttacagtacgcagatccgcg

SEQ ID NO: 105487 - DNA, 25 bp, E. coli
ttgttttacagttcgcagatccgcg

SEQ ID NO: 105488 - DNA, 25 bp, E. coli
gcaaacttagcaaggcaaacggtgt

SEQ ID NO: 105489 - DNA, 25 bp, E. coli
gcaaacttagcatggcaaacggtgt

SEQ ID NO: 105490 - DNA, 25 bp, E. coli
catttaacggtaagttgctggcggg

SEQ ID NO: 105491 - DNA, 25 bp, E. coli
gttactggccgggaaaatgctggca

SEQ ID NO: 105492 - DNA, 25 bp, E. coli
gttactggccggcaaaatgctggca

SEQ ID NO: 105493 - DNA, 25 bp, E. coli
taatggccgcttctgcaccgggtat

SEQ ID NO: 105494 - DNA, 25 bp, E. coli
taatggccgcttgtgcaccgggtat

SEQ ID NO: 105495 - DNA, 25 bp, E. coli
taagctgcgtccagtaaccatgtcg

SEQ ID NO: 105496 - DNA, 25 bp, E. coli
taagctgcgtcctgtaaccatgtcg

SEQ ID NO: 105497 - DNA, 25 bp, E. coli
aatggaatagtattgagtcgcatca

SEQ ID NO: 105498 - DNA, 25 bp, E. coli
aatggaatagtaatgagtcgcatca

SEQ ID NO: 105499 - DNA, 25 bp, E. coli
tacaaatggaattgtaatgagtcgc

SEQ ID NO: 105500 - DNA, 25 bp, E. coli
tagtcgatgcctcgcgtacgccgac

SEQ ID NO: 105501 - DNA, 25 bp, E. coli
tacaaatggaatagtaatgagtcgc

SEQ ID NO: 105502 - DNA, 25 bp, E. coli
tagtcgatgcctggcgtacgccgac

SEQ ID NO: 105503 - DNA, 25 bp, E. coli
caggaacttgaaacgacactagtcg

SEQ ID NO: 105504 - DNA, 25 bp, E. coli
caggaacttgaatcgacactagtcg

SEQ ID NO: 105505 - DNA, 25 bp, E. coli
taccggacaaacacatgtcagtaag

SEQ ID NO: 105506 - DNA, 25 bp, E. coli
taccggacaaactcatgtcagtaag

SEQ ID NO: 105507 - DNA, 25 bp, E. coli
ttattcatcatagccatttcgatga

SEQ ID NO: 105508 - DNA, 25 bp, E. coli
ttattcatcatacccatttcgatga

SEQ ID NO: 105509 - DNA, 25 bp, E. coli
tgaaacgacacttgtcgatgcctgg

SEQ ID NO: 105510 - DNA, 25 bp, E. coli
tgaaacgacactagtcgatgcctgg

SEQ ID NO: 105511 - DNA, 25 bp, E. coli
gcatttattcatcatacccatttcg

SEQ ID NO: 105512 - DNA, 25 bp, E. coli
gcatttattcatgatacccatttcg

SEQ ID NO: 105513 - DNA, 25 bp, E. coli
gacactagtcgaagcctggcgtacg

SEQ ID NO: 105514 - DNA, 25 bp, E. coli
gacactagtcgatgcctggcgtacg

SEQ ID NO: 105515 - DNA, 25 bp, E. coli
ggagaattccgcatttattcatcat

SEQ ID NO: 105516 - DNA, 25 bp, E. coli
ggacaaactcatgtcagtaagcgca

SEQ ID NO: 105517 - DNA, 25 bp, E. coli
ggacaaactcatctcagtaagcgca

SEQ ID NO: 105518 - DNA, 25 bp, E. coli
ggagaattccgcttttattcatcat

SEQ ID NO: 105519 - DNA, 25 bp, E. coli
aattaaatgtgtaatttttgcacca

SEQ ID NO: 105520 - DNA, 25 bp, E. coli
aagattgcatgatataaaaacgagc

SEQ ID NO: 105521 - DNA, 25 bp, E. coli
catgtaatttttcgcacttatagac

SEQ ID NO: 105522 - DNA, 25 bp, E. coli
aagattgcatgaaataaaaacgagc

SEQ ID NO: 105523 - DNA, 25 bp, E. coli
aattaaatgtgttatttttgcacca

SEQ ID NO: 105524 - DNA, 25 bp, E. coli
catgtaatttttggcacttatagac

SEQ ID NO: 105525 - DNA, 25 bp, E. coli
caggcattaagccacaaaaagatca

SEQ ID NO: 105526 - DNA, 25 bp, E. coli
caggcattaagcgacaaaaagatca

SEQ ID NO: 105527 - DNA, 25 bp, E. coli
aaaaagatcatctaacctgttctgg

SEQ ID NO: 105528 - DNA, 25 bp, E. coli
aaaaagatcatcaaacctgttctgg

SEQ ID NO: 105529 - DNA, 25 bp, E. coli
ttgcaccataactaatattttgtgg

SEQ ID NO: 105530 - DNA, 25 bp, E. coli
ttgcaccataacaaatattttgtgg

SEQ ID NO: 105531 - DNA, 25 bp, E. coli
tgtggctcatgcttgttttacaggc

SEQ ID NO: 105532 - DNA, 25 bp, E. coli
tgtggctcatgcatgttttacaggc

SEQ ID NO: 105533 - DNA, 25 bp, E. coli
tctggaaaacgcatgcgcagcaaga

SEQ ID NO: 105534 - DNA, 25 bp, E. coli
tctggaaaacgcttgcgcagcaaga

SEQ ID NO: 105535 - DNA, 25 bp, E. coli
gcttgcgcagcatgaagattgcatg

SEQ ID NO: 105536 - DNA, 25 bp, E. coli
gcttgcgcagcaagaagattgcatg

SEQ ID NO: 105537 - DNA, 25 bp, E. coli
gaatattcactctctttatttgcat

SEQ ID NO: 105538 - DNA, 25 bp, E. coli
gaatattcactcactttatttgcat

SEQ ID NO: 105539 - DNA, 25 bp, E. coli
taacctgttctgcaaaacgcttgcg

SEQ ID NO: 105540 - DNA, 25 bp, E. coli
taacctgttctggaaaacgcttgcg

SEQ ID NO: 105541 - DNA, 25 bp, E. coli
caaaccgcccgaaacagaaagtctg

SEQ ID NO: 105542 - DNA, 25 bp, E. coli
caaaccgcccgatacagaaagtctg

SEQ ID NO: 105543 - DNA, 25 bp, E. coli
tatgcggcggattacacggcaagag

SEQ ID NO: 105544 - DNA, 25 bp, E. coli
tatgcggcggataacacggcaagag

SEQ ID NO: 105545 - DNA, 25 bp, E. coli
tatccgcaggcacaatcggtgcatc

SEQ ID NO: 105546 - DNA, 25 bp, E. coli
tatccgcaggcagaatcggtgcatc

SEQ ID NO: 105547 - DNA, 25 bp, E. coli
tattatggtggtcaacaagccgagc

SEQ ID NO: 105548 - DNA, 25 bp, E. coli
tattatggtggtgaacaagccgagc

SEQ ID NO: 105549 - DNA, 25 bp, E. coli
tttatgcatcacgagaagcgagagc

SEQ ID NO: 105550 - DNA, 25 bp, E. coli
tttatgcatcaccagaagcgagagc

SEQ ID NO: 105551 - DNA, 25 bp, E. coli
tgacgattacccatccggcgtatgg

SEQ ID NO: 105552 - DNA, 25 bp, E. coli
tgacgattacccttccggcgtatgg

SEQ ID NO: 105553 - DNA, 25 bp, E. coli
tctggatatggctaccagcggcgtg

SEQ ID NO: 105554 - DNA, 25 bp, E. coli
tctggatatggcaaccagcggcgtg

SEQ ID NO: 105555 - DNA, 25 bp, E. coli
tctggaagagcacaaagacagcgtg

SEQ ID NO: 105556 - DNA, 25 bp, E. coli
tctggaagagcagaaagacagcgtg

SEQ ID NO: 105557 - DNA, 25 bp, E. coli
gcgtgattgtagtggcgctgaccaa

SEQ ID NO: 105558 - DNA, 25 bp, E. coli
gcgtgattgtagaggcgctgaccaa

SEQ ID NO: 105559 - DNA, 25 bp, E. coli
gatctgccgctgatttgcgactggc

SEQ ID NO: 105560 - DNA, 25 bp, E. coli
gatctgccgctgttttgcgactggc

SEQ ID NO: 105561 - DNA, 25 bp, E. coli
gagttaaaacgcgagttccgcgagc

SEQ ID NO: 105562 - DNA, 25 bp, E. coli
gagttaaaacgccagttccgcgagc

SEQ ID NO: 105563 - DNA, 25 bp, E. coli
aagaatgagatgcagcacactggat

SEQ ID NO: 105564 - DNA, 25 bp, E. coli
aagaatgagatggagcacactggat

SEQ ID NO: 105565 - DNA, 25 bp, E. coli
atggagcacactcgatattttactt

SEQ ID NO: 105566 - DNA, 25 bp, E. coli
atggagcacactggatattttactt

SEQ ID NO: 105567 - DNA, 25 bp, E. coli
tattaagaatgacatggagcacact

SEQ ID NO: 105568 - DNA, 25 bp, E. coli
tattaagaatgagatggagcacact

SEQ ID NO: 105569 - DNA, 25 bp, E. coli
ttaagaatgagaaggagcacactgg

SEQ ID NO: 105570 - DNA, 25 bp, E. coli
ttaagaatgagatggagcacactgg

SEQ ID NO: 105571 - DNA, 25 bp, E. coli
tgagatggagcagactggatatttt

SEQ ID NO: 105572 - DNA, 25 bp, E. coli
tgagatggagcacactggatatttt

SEQ ID NO: 105573 - DNA, 25 bp, E. coli
tctaaaaagatgatcttaataaatc

SEQ ID NO: 105574 - DNA, 25 bp, E. coli
tctaaaaagatgttcttaataaatc

SEQ ID NO: 105575 - DNA, 25 bp, E. coli
gaatgagatggagcacactggatat

SEQ ID NO: 105576 - DNA, 25 bp, E. coli
gaatgagatggaccacactggatat

SEQ ID NO: 105577 - DNA, 25 bp, E. coli
ctattaagaatgagatggagcacac

SEQ ID NO: 105578 - DNA, 25 bp, E. coli
ctattaagaatgtgatggagcacac

SEQ ID NO: 105579 - DNA, 25 bp, E. coli
taagaatgagatggagcacactgga

SEQ ID NO: 105580 - DNA, 25 bp, E. coli
taagaatgagatcgagcacactgga

SEQ ID NO: 105581 - DNA, 25 bp, E. coli
gatggagcacactggatattttact

SEQ ID NO: 105582 - DNA, 25 bp, E. coli
gatggagcacacaggatattttact

SEQ ID NO: 105583 - DNA, 25 bp, E. coli
tgaaactgtttcactcctttactta

SEQ ID NO: 105584 - DNA, 25 bp, E. coli
tgaaactgtttctctcctttactta

SEQ ID NO: 105585 - DNA, 25 bp, E. coli
aactgttgatcctgcatcccagcgc

SEQ ID NO: 105586 - DNA, 25 bp, E. coli
aactgttgatccagcatcccagcgc

SEQ ID NO: 105587 - DNA, 25 bp, E. coli
ttcagtgtggctatccttcaccggc

SEQ ID NO: 105588 - DNA, 25 bp, E. coli
ttcagtgtggctttccttcaccggc

SEQ ID NO: 105589 - DNA, 25 bp, E. coli
tgatttactgattgtcgatagcgct

SEQ ID NO: 105590 - DNA, 25 bp, E. coli
tgtttatcaagcgtgcggatctccg

SEQ ID NO: 105591 - DNA, 25 bp, E. coli
tgatttactgatagtcgatagcgct

SEQ ID NO: 105592 - DNA, 25 bp, E. coli
tgtttatcaagcctgcggatctccg

SEQ ID NO: 105593 - DNA, 25 bp, E. coli
tcgatagcgctattaccgccagcca

SEQ ID NO: 105594 - DNA, 25 bp, E. coli
tcgatagcgctaataccgccagcca

SEQ ID NO: 105595 - DNA, 25 bp, E. coli
ccagccatggtgatattgtcatcgc

SEQ ID NO: 105596 - DNA, 25 bp, E. coli
ccagccatggtgttattgtcatcgc

SEQ ID NO: 105597 - DNA, 25 bp, E. coli
gcggatctccgcgaaattgtgactt

SEQ ID NO: 105598 - DNA, 25 bp, E. coli
gcgcatcgatctcaatcaactgttg

SEQ ID NO: 105599 - DNA, 25 bp, E. coli
gcgcatcgatctgaatcaactgttg

SEQ ID NO: 105600 - DNA, 25 bp, E. coli
gcggatctccgccaaattgtgactt

SEQ ID NO: 105601 - DNA, 25 bp, E. coli
gcagattacgttgaacagcgcatcg

SEQ ID NO: 105602 - DNA, 25 bp, E. coli
gcagattacgttcaacagcgcatcg

SEQ ID NO: 105603 - DNA, 25 bp, E. coli
gaaaaaattgcatctacgcccgacg

SEQ ID NO: 105604 - DNA, 25 bp, E. coli
gaaaaaattgcaactacgcccgacg

SEQ ID NO: 105605 - DNA, 25 bp, E. coli
gatccacgtcgtaaaggcgatgcgc

SEQ ID NO: 105606 - DNA, 25 bp, E. coli
gatccacgtcgttaaggcgatgcgc

SEQ ID NO: 105607 - DNA, 25 bp, E. coli
caaaaactggcagaacgtgacggga

SEQ ID NO: 105608 - DNA, 25 bp, E. coli
caaaaactggcacaacgtgacggga

SEQ ID NO: 105609 - DNA, 25 bp, E. coli
cagagcgacgcacatgcagatgcca

SEQ ID NO: 105610 - DNA, 25 bp, E. coli
cagagcgacgcagatgcagatgcca

SEQ ID NO: 105611 - DNA, 25 bp, E. coli
tacacaggcgcgtcatattgccact

SEQ ID NO: 105612 - DNA, 25 bp, E. coli
tacacaggcgcgacatattgccact

SEQ ID NO: 105613 - DNA, 25 bp, E. coli
tagtcatggaatagccgcaacgacc

SEQ ID NO: 105614 - DNA, 25 bp, E. coli
tagtcatggaattgccgcaacgacc

SEQ ID NO: 105615 - DNA, 25 bp, E. coli
gcatctggatacctatgccccgcag

SEQ ID NO: 105616 - DNA, 25 bp, E. coli
gcatctggatacgtatgccccgcag

SEQ ID NO: 105617 - DNA, 25 bp, E. coli
gcaacatattgataaagcacttcct

SEQ ID NO: 105618 - DNA, 25 bp, E. coli
gcaacatattgaaaaagcacttcct

SEQ ID NO: 105619 - DNA, 25 bp, E. coli
gaatgaccggaagacccgcagaaat

SEQ ID NO: 105620 - DNA, 25 bp, E. coli
gaatgaccggaacacccgcagaaat

SEQ ID NO: 105621 - DNA, 25 bp, E. coli
cgcccgcgataagcgcaaaaactgg

SEQ ID NO: 105622 - DNA, 25 bp, E. coli
cgcccgcgataaccgcaaaaactgg

SEQ ID NO: 105623 - DNA, 25 bp, E. coli
gattttgccaattcacaggcgcgac

SEQ ID NO: 105624 - DNA, 25 bp, E. coli
gatattcgtacgtttaatagccgat

SEQ ID NO: 105625 - DNA, 25 bp, E. coli
gattttgccaatacacaggcgcgac

SEQ ID NO: 105626 - DNA, 25 bp, E. coli
gatattcgtacgattaatagccgat

SEQ ID NO: 105627 - DNA, 25 bp, E. coli
gggttaccgcagagatattcgtacg

SEQ ID NO: 105628 - DNA, 25 bp, E. coli
gggttaccgcagtgatattcgtacg

SEQ ID NO: 105629 - DNA, 25 bp, E. coli
aatgttttgcgtacagataacctgc

SEQ ID NO: 105630 - DNA, 25 bp, E. coli
aatgttttgcgttcagataacctgc

SEQ ID NO: 105631 - DNA, 25 bp, E. coli
caccgttctatctgttgcttttgca

SEQ ID NO: 105632 - DNA, 25 bp, E. coli
caccgttctatcagttgcttttgca

SEQ ID NO: 105633 - DNA, 25 bp, E. coli
cacctgttttctttcaatgatgtcg

SEQ ID NO: 105634 - DNA, 25 bp, E. coli
cacctgttttctatcaatgatgtcg

SEQ ID NO: 105635 - DNA, 25 bp, E. coli
taaagcataaaactatttctcccag

SEQ ID NO: 105636 - DNA, 25 bp, E. coli
taaagcataaaagtatttctcccag

SEQ ID NO: 105637 - DNA, 25 bp, E. coli
tatccatgcagcaataatgttttgc

SEQ ID NO: 105638 - DNA, 25 bp, E. coli
tatccatgcagctataatgttttgc

SEQ ID NO: 105639 - DNA, 25 bp, E. coli
ttttatcacgcataacaagtctgta

SEQ ID NO: 105640 - DNA, 25 bp, E. coli
ttttatcacgcaaaacaagtctgta

SEQ ID NO: 105641 - DNA, 25 bp, E. coli
ttcgcttgatgaccaaacaccgttc

SEQ ID NO: 105642 - DNA, 25 bp, E. coli
ttcgcttgatgagcaaacaccgttc

SEQ ID NO: 105643 - DNA, 25 bp, E. coli
cctgctaaataattaagagcgtgag

SEQ ID NO: 105644 - DNA, 25 bp, E. coli
cctgctaaataaataagagcgtgag

SEQ ID NO: 105645 - DNA, 25 bp, E. coli
cgtaaaaatagcgagatagacatcg

SEQ ID NO: 105646 - DNA, 25 bp, E. coli
cgtaaaaatagccagatagacatcg

SEQ ID NO: 105647 - DNA, 25 bp, E. coli
gatgtcgttttcttaagaatggagg

SEQ ID NO: 105648 - DNA, 25 bp, E. coli
gatcgttaatatgatccggcttcat

SEQ ID NO: 105649 - DNA, 25 bp, E. coli
gatcgttaatatcatccggcttcat

SEQ ID NO: 105650 - DNA, 25 bp, E. coli
gatgtcgttttcataagaatggagg

SEQ ID NO: 105651 - DNA, 25 bp, E. coli
aataaattcagaatattatctgttc

SEQ ID NO: 105652 - DNA, 25 bp, E. coli
aataaattcagattattatctgttc

SEQ ID NO: 105653 - DNA, 25 bp, E. coli
taaattcagaatattatctgttctt

SEQ ID NO: 105654 - DNA, 25 bp, E. coli
taaattcagaattttatctgttctt

SEQ ID NO: 105655 - DNA, 25 bp, E. coli
aattcagaatataatctgttcttaa

SEQ ID NO: 105656 - DNA, 25 bp, E. coli
aattcagaatattatctgttcttaa

SEQ ID NO: 105657 - DNA, 25 bp, E. coli
tatctatcaataaattcagaatatt

SEQ ID NO: 105658 - DNA, 25 bp, E. coli
tatctatcaatatattcagaatatt

SEQ ID NO: 105659 - DNA, 25 bp, E. coli
ttatctatcaattaattcagaatat

SEQ ID NO: 105660 - DNA, 25 bp, E. coli
ttatctatcaataaattcagaatat

SEQ ID NO: 105661 - DNA, 25 bp, E. coli
tgtttatctatcaataaattcagaa

SEQ ID NO: 105662 - DNA, 25 bp, E. coli
tgtttatctatctataaattcagaa

SEQ ID NO: 105663 - DNA, 25 bp, E. coli
tctgtttatctatcaataaattcag

SEQ ID NO: 105664 - DNA, 25 bp, E. coli
tctgtttatctaacaataaattcag

SEQ ID NO: 105665 - DNA, 25 bp, E. coli
ctgtttatctatcaataaattcaga

SEQ ID NO: 105666 - DNA, 25 bp, E. coli
ctatcaataaatacagaatattatc

SEQ ID NO: 105667 - DNA, 25 bp, E. coli
ctatcaataaattcagaatattatc

SEQ ID NO: 105668 - DNA, 25 bp, E. coli
ctgtttatctatgaataaattcaga

SEQ ID NO: 105669 - DNA, 25 bp, E. coli
gtttatctatcattaaattcagaat

SEQ ID NO: 105670 - DNA, 25 bp, E. coli
gtttatctatcaataaattcagaat

SEQ ID NO: 105671 - DNA, 25 bp, E. coli
tcaataaattcacaatattatctgt

SEQ ID NO: 105672 - DNA, 25 bp, E. coli
tcaataaattcagaatattatctgt

SEQ ID NO: 105673 - DNA, 25 bp, E. coli
caattaaatcacataaacctgcgag

SEQ ID NO: 105674 - DNA, 25 bp, E. coli
caattaaatcacttaaacctgcgag

SEQ ID NO: 105675 - DNA, 25 bp, E. coli
catagatattaaatatgatcgtggc

SEQ ID NO: 105676 - DNA, 25 bp, E. coli
catagatattaattatgatcgtggc

SEQ ID NO: 105677 - DNA, 25 bp, E. coli
taaaaaaccactaactctatgtgaa

SEQ ID NO: 105678 - DNA, 25 bp, E. coli
taaaaaaccacttactctatgtgaa

SEQ ID NO: 105679 - DNA, 25 bp, E. coli
acgccgaaatactccttaggatgta

SEQ ID NO: 105680 - DNA, 25 bp, E. coli
acgccgaaatacaccttaggatgta

SEQ ID NO: 105681 - DNA, 25 bp, E. coli
tagcgaaaggagaaaaagatatacc

SEQ ID NO: 105682 - DNA, 25 bp, E. coli
tagcgaaaggagtaaaagatatacc

SEQ ID NO: 105683 - DNA, 25 bp, E. coli
tcacttaaacctgcgagtcatttcg

SEQ ID NO: 105684 - DNA, 25 bp, E. coli
tcacttaaacctccgagtcatttcg

SEQ ID NO: 105685 - DNA, 25 bp, E. coli
gcgagtcatttcgtaattacattaa

SEQ ID NO: 105686 - DNA, 25 bp, E. coli
gcgagtcatttcctaattacattaa

SEQ ID NO: 105687 - DNA, 25 bp, E. coli
gaaaaagatatagctcgatcacccc

SEQ ID NO: 105688 - DNA, 25 bp, E. coli
gaaataaatcaaaatttcacgccga

SEQ ID NO: 105689 - DNA, 25 bp, E. coli
gaaataaatcaatatttcacgccga

SEQ ID NO: 105690 - DNA, 25 bp, E. coli
gaaaaagatatacctcgatcacccc

SEQ ID NO: 105691 - DNA, 25 bp, E. coli
tactccttaggaagtatagcgaaag

SEQ ID NO: 105692 - DNA, 25 bp, E. coli
tactccttaggatgtatagcgaaag

SEQ ID NO: 105693 - DNA, 25 bp, E. coli
gatcgtggcaaaatttattcattaa

SEQ ID NO: 105694 - DNA, 25 bp, E. coli
gatcgtggcaaattttattcattaa

SEQ ID NO: 105695 - DNA, 25 bp, E. coli
aatctctggtatgtggcgtgttccc

SEQ ID NO: 105696 - DNA, 25 bp, E. coli
aatctctggtatctggcgtgttccc

SEQ ID NO: 105697 - DNA, 25 bp, E. coli
acatggatacgctcaatcttggcaa

SEQ ID NO: 105698 - DNA, 25 bp, E. coli
aacatggatacgctcaatcttggca

SEQ ID NO: 105699 - DNA, 25 bp, E. coli
aaatgaggtcaacatggatacgctc

SEQ ID NO: 105700 - DNA, 25 bp, E. coli
aacatggatacggtcaatcttggca

SEQ ID NO: 105701 - DNA, 25 bp, E. coli
aaatgaggtcaagatggatacgctc

SEQ ID NO: 105702 - DNA, 25 bp, E. coli
acatggatacgcacaatcttggcaa

SEQ ID NO: 105703 - DNA, 25 bp, E. coli
tctctggtatgtggcgtgttcccca

SEQ ID NO: 105704 - DNA, 25 bp, E. coli
tctctggtatgtcgcgtgttcccca

SEQ ID NO: 105705 - DNA, 25 bp, E. coli
gctggttagccagaaacactgactg

SEQ ID NO: 105706 - DNA, 25 bp, E. coli
gctggttagccacaaacactgactg

SEQ ID NO: 105707 - DNA, 25 bp, E. coli
gaatctctggtaagtggcgtgttcc

SEQ ID NO: 105708 - DNA, 25 bp, E. coli
gaatctctggtatgtggcgtgttcc

SEQ ID NO: 105709 - DNA, 25 bp, E. coli
ctggttagccagtaacactgactga

SEQ ID NO: 105710 - DNA, 25 bp, E. coli
ctggttagccagaaacactgactga

SEQ ID NO: 105711 - DNA, 25 bp, E. coli
ggtcaacatggatacgctcaatctt

SEQ ID NO: 105712 - DNA, 25 bp, E. coli
ggtcaacatggaaacgctcaatctt

SEQ ID NO: 105713 - DNA, 25 bp, E. coli
tcaacatggataggctcaatcttgg

SEQ ID NO: 105714 - DNA, 25 bp, E. coli
tcaacatggatacgctcaatcttgg

SEQ ID NO: 105715 - DNA, 25 bp, E. coli
gaggtcaacatggatacgctcaatc

SEQ ID NO: 105716 - DNA, 25 bp, E. coli
gaggtcaacatgcatacgctcaatc

SEQ ID NO: 105717 - DNA, 25 bp, E. coli
caaatatccgttacagacctggccc

SEQ ID NO: 105718 - DNA, 25 bp, E. coli
caaatatccgtttcagacctggccc

SEQ ID NO: 105719 - DNA, 25 bp, E. coli
agatagcgccgcgtttgaacactgg

SEQ ID NO: 105720 - DNA, 25 bp, E. coli
agatagcgccgcctttgaacactgg

SEQ ID NO: 105721 - DNA, 25 bp, E. coli
tatctgctggcctgcagggaaaccc

SEQ ID NO: 105722 - DNA, 25 bp, E. coli
tatgccagcaaagccagttaaccgg

SEQ ID NO: 105723 - DNA, 25 bp, E. coli
tatgcggcgaacatggacagtgccc

SEQ ID NO: 105724 - DNA, 25 bp, E. coli
tatgcggcgaacttggacagtgccc

SEQ ID NO: 105725 - DNA, 25 bp, E. coli
tatgccagcaaacccagttaaccgg

SEQ ID NO: 105726 - DNA, 25 bp, E. coli
tatctgctggccagcagggaaaccc

SEQ ID NO: 105727 - DNA, 25 bp, E. coli
tgcaaccccggatcacgcaattggt

SEQ ID NO: 105728 - DNA, 25 bp, E. coli
tgcaaccccggaacacgcaattggt

SEQ ID NO: 105729 - DNA, 25 bp, E. coli
tccgcgcgacatcaaacccagtatt

SEQ ID NO: 105730 - DNA, 25 bp, E. coli
tccgcgcgacatgaaacccagtatt

SEQ ID NO: 105731 - DNA, 25 bp, E. coli
gactccggaaaaacgtctgcggctg

SEQ ID NO: 105732 - DNA, 25 bp, E. coli
gactccggaaaatcgtctgcggctg

SEQ ID NO: 105733 - DNA, 25 bp, E. coli
cgatgaagaacgaaaccgcggtgca

SEQ ID NO: 105734 - DNA, 25 bp, E. coli
cgatgaagaacgtaaccgcggtgca

SEQ ID NO: 105735 - DNA, 25 bp, E. coli
taattatgcgccagtgtgcccgcta

SEQ ID NO: 105736 - DNA, 25 bp, E. coli
taattatgcgcctgtgtgcccgcta

SEQ ID NO: 105737 - DNA, 25 bp, E. coli
gagccttggctacagctggattgaa

SEQ ID NO: 105738 - DNA, 25 bp, E. coli
gagccttggctagagctggattgaa

SEQ ID NO: 105739 - DNA, 25 bp, E. coli
aataattacccgcaagatcaggcag

SEQ ID NO: 105740 - DNA, 25 bp, E. coli
aatatcaacgactacaaccctcacg

SEQ ID NO: 105741 - DNA, 25 bp, E. coli
aatatcaacgacaacaaccctcacg

SEQ ID NO: 105742 - DNA, 25 bp, E. coli
aataattacccggaagatcaggcag

SEQ ID NO: 105743 - DNA, 25 bp, E. coli
taacgaccgcgaaattttgatctcc

SEQ ID NO: 105744 - DNA, 25 bp, E. coli
tttctgcgtaatttcaaagtgatgc

SEQ ID NO: 105745 - DNA, 25 bp, E. coli
tttctgcgtaatatcaaagtgatgc

SEQ ID NO: 105746 - DNA, 25 bp, E. coli
tgattatgaacttcgacatgcgcaa

SEQ ID NO: 105747 - DNA, 25 bp, E. coli
tgattatgaactacgacatgcgcaa

SEQ ID NO: 105748 - DNA, 25 bp, E. coli
tccgcaaaatttgcgagtgaataat

SEQ ID NO: 105749 - DNA, 25 bp, E. coli
tcgaggcgtctttatggcgaaagaa

SEQ ID NO: 105750 - DNA, 25 bp, E. coli
tgcgggaagcacttacgataataat

SEQ ID NO: 105751 - DNA, 25 bp, E. coli
tccgcaaaatttccgagtgaataat

SEQ ID NO: 105752 - DNA, 25 bp, E. coli
tgcgggaagcacatacgataataat

SEQ ID NO: 105753 - DNA, 25 bp, E. coli
tcgaggcgtcttaatggcgaaagaa

SEQ ID NO: 105754 - DNA, 25 bp, E. coli
gaatgccgtctcctttgtggcacta

SEQ ID NO: 105755 - DNA, 25 bp, E. coli
gaatgccgtctcgtttgtggcacta

SEQ ID NO: 105756 - DNA, 25 bp, E. coli
cccgcattgattatgaacttcgaca

SEQ ID NO: 105757 - DNA, 25 bp, E. coli
cccgcattgattttgaacttcgaca

SEQ ID NO: 105758 - DNA, 25 bp, E. coli
ccgcgatattttgatctccgaccat

SEQ ID NO: 105759 - DNA, 25 bp, E. coli
ccgcgatattttcatctccgaccat

SEQ ID NO: 105760 - DNA, 25 bp, E. coli
taacgaccgcgatattttgatctcc

SEQ ID NO: 105761 - DNA, 25 bp, E. coli
taaagcacgtcaggatctcgacaga

SEQ ID NO: 105762 - DNA, 25 bp, E. coli
taaatggtgggcatttcgcgcagga

SEQ ID NO: 105763 - DNA, 25 bp, E. coli
taaagcacgtcacgatctcgacaga

SEQ ID NO: 105764 - DNA, 25 bp, E. coli
taaatggtgggcttttcgcgcagga

SEQ ID NO: 105765 - DNA, 25 bp, E. coli
tttaacaagctgtcgctgatggcga

SEQ ID NO: 105766 - DNA, 25 bp, E. coli
tttaacaagctgacgctgatggcga

SEQ ID NO: 105767 - DNA, 25 bp, E. coli
tgcctatggcggtattgaagcggtt

SEQ ID NO: 105768 - DNA, 25 bp, E. coli
tgcctatggcggaattgaagcggtt

SEQ ID NO: 105769 - DNA, 25 bp, E. coli
gcatggatgattgtggtcaccgtcg

SEQ ID NO: 105770 - DNA, 25 bp, E. coli
gcgtcagcacaaactggcagcaggt

SEQ ID NO: 105771 - DNA, 25 bp, E. coli
gcgtcagcacaatctggcagcaggt

SEQ ID NO: 105772 - DNA, 25 bp, E. coli
gcatggatgattctggtcaccgtcg

SEQ ID NO: 105773 - DNA, 25 bp, E. coli
gaaatgggagctccttatcgcaaag

SEQ ID NO: 105774 - DNA, 25 bp, E. coli
gaaatgggagctgcttatcgcaaag

SEQ ID NO: 105775 - DNA, 25 bp, E. coli
cattgtggatgattggcggccctgt

SEQ ID NO: 105776 - DNA, 25 bp, E. coli
cattgtggatgaatggcggccctgt

SEQ ID NO: 105777 - DNA, 25 bp, E. coli
cattactgcggtgggcggtattgca

SEQ ID NO: 105778 - DNA, 25 bp, E. coli
cattactgcggtcggcggtattgca

SEQ ID NO: 105779 - DNA, 25 bp, E. coli
tggatttgccaaaagcccatcggct

SEQ ID NO: 105780 - DNA, 25 bp, E. coli
tggatttgccaatagcccatcggct

SEQ ID NO: 105781 - DNA, 25 bp, E. coli
gatgaataatagtgtcggaccacgt

SEQ ID NO: 105782 - DNA, 25 bp, E. coli
gatgaataatagagtcggaccacgt

SEQ ID NO: 105783 - DNA, 25 bp, E. coli
aaccgtcgagacttttgcgttggcg

SEQ ID NO: 105784 - DNA, 25 bp, E. coli
cagtcaggcagaggagttatggcaa

SEQ ID NO: 105785 - DNA, 25 bp, E. coli
cagtcaggcagacgagttatggcaa

SEQ ID NO: 105786 - DNA, 25 bp, E. coli
tactggttgctgcaaaaaaccgtgg

SEQ ID NO: 105787 - DNA, 25 bp, E. coli
tactggttgctggaaaaaaccgtgg

SEQ ID NO: 105788 - DNA, 25 bp, E. coli
tatggcaaaagctggaaagttaccc

SEQ ID NO: 105789 - DNA, 25 bp, E. coli
tatggcaaaagcaggaaagttaccc

SEQ ID NO: 105790 - DNA, 25 bp, E. coli
aaaaccgtggtgcaatttcctgagg

SEQ ID NO: 105791 - DNA, 25 bp, E. coli
aaaaccgtggtggaatttcctgagg

SEQ ID NO: 105792 - DNA, 25 bp, E. coli
aaccgtcgagacatttgcgttggcg

SEQ ID NO: 105793 - DNA, 25 bp, E. coli
taccggaacggttaaagcgcatctg

SEQ ID NO: 105794 - DNA, 25 bp, E. coli
taccggaacggtaaaagcgcatctg

SEQ ID NO: 105795 - DNA, 25 bp, E. coli
tttaaccatgttagcggcgggcgaa

SEQ ID NO: 105796 - DNA, 25 bp, E. coli
tttaaccatgtttgcggcgggcgaa

SEQ ID NO: 105797 - DNA, 25 bp, E. coli
tgtgcctcgtgattcaaccgtcgag

SEQ ID NO: 105798 - DNA, 25 bp, E. coli
tgtgcctcgtgaatcaaccgtcgag

SEQ ID NO: 105799 - DNA, 25 bp, E. coli
gcacccaggcggcaatgatgttaaa

SEQ ID NO: 105800 - DNA, 25 bp, E. coli
gcacccaggcgggaatgatgttaaa

SEQ ID NO: 105801 - DNA, 25 bp, E. coli
taatgtgctggcgattgtgcctcgt

SEQ ID NO: 105802 - DNA, 25 bp, E. coli
taatgtgctggccattgtgcctcgt

SEQ ID NO: 105803 - DNA, 25 bp, E. coli
gatctcaaatcgttaagcgcccgcc

SEQ ID NO: 105804 - DNA, 25 bp, E. coli
gatctcaaatcgataagcgcccgcc

SEQ ID NO: 105805 - DNA, 25 bp, E. coli
aagtattggtgatgagcctgaacga

SEQ ID NO: 105806 - DNA, 25 bp, E. coli
aagtattggtgaagagcctgaacga

SEQ ID NO: 105807 - DNA, 25 bp, E. coli
aatatctgtgccagtagcatcgctc

SEQ ID NO: 105808 - DNA, 25 bp, E. coli
aatatctgtgcctgtagcatcgctc

SEQ ID NO: 105809 - DNA, 25 bp, E. coli
cactgaataaatgacctgagccaga

SEQ ID NO: 105810 - DNA, 25 bp, E. coli
cactgaataaatcacctgagccaga

SEQ ID NO: 105811 - DNA, 25 bp, E. coli
gaacgccttaaagagcaaacccgca

SEQ ID NO: 105812 - DNA, 25 bp, E. coli
agtgaaaccatcctcagggatactg

SEQ ID NO: 105813 - DNA, 25 bp, E. coli
agtgaaaccatcgtcagggatactg

SEQ ID NO: 105814 - DNA, 25 bp, E. coli
gaacgccttaaacagcaaacccgca

SEQ ID NO: 105815 - DNA, 25 bp, E. coli
tgccgcaagacttccttcagtgtcc

SEQ ID NO: 105816 - DNA, 25 bp, E. coli
tgccgcaagactaccttcagtgtcc

SEQ ID NO: 105817 - DNA, 25 bp, E. coli
tcacctgagccagaaatatctgtgc

SEQ ID NO: 105818 - DNA, 25 bp, E. coli
ccatcgtcagggatactgttgccaa

SEQ ID NO: 105819 - DNA, 25 bp, E. coli
ccatcgtcagggttactgttgccaa

SEQ ID NO: 105820 - DNA, 25 bp, E. coli
cgtcttgttgtctgagagttatcac

SEQ ID NO: 105821 - DNA, 25 bp, E. coli
cgtcagggatacagttgccaaatgg

SEQ ID NO: 105822 - DNA, 25 bp, E. coli
cgtcagggatactgttgccaaatgg

SEQ ID NO: 105823 - DNA, 25 bp, E. coli
cgtcttgttgtcagagagttatcac

SEQ ID NO: 105824 - DNA, 25 bp, E. coli
tcacctgagccacaaatatctgtgc

SEQ ID NO: 105825 - DNA, 25 bp, E. coli
gagttatcactgaataaatcacctg

SEQ ID NO: 105826 - DNA, 25 bp, E. coli
gagttatcactgtataaatcacctg

SEQ ID NO: 105827 - DNA, 25 bp, E. coli
cacacggcaaattaggagtaactct

SEQ ID NO: 105828 - DNA, 25 bp, E. coli
cacacggcaaataaggagtaactct

SEQ ID NO: 105829 - DNA, 25 bp, E. coli
cacattcattaaggttattgctcat

SEQ ID NO: 105830 - DNA, 25 bp, E. coli
cagccaatagcccagaatactgcca

SEQ ID NO: 105831 - DNA, 25 bp, E. coli
cagccaatagccgagaatactgcca

SEQ ID NO: 105832 - DNA, 25 bp, E. coli
cacattcattaacgttattgctcat

SEQ ID NO: 105833 - DNA, 25 bp, E. coli
ctaaccacacggcaaataaggagta

SEQ ID NO: 105834 - DNA, 25 bp, E. coli
ctaaccacacgggaaataaggagta

SEQ ID NO: 105835 - DNA, 25 bp, E. coli
tagccgagaatagtgccattccaga

SEQ ID NO: 105836 - DNA, 25 bp, E. coli
tagccgagaatactgccattccaga

SEQ ID NO: 105837 - DNA, 25 bp, E. coli
taaggagtaactctttccgggtatg

SEQ ID NO: 105838 - DNA, 25 bp, E. coli
taaggagtaactgtttccgggtatg

SEQ ID NO: 105839 - DNA, 25 bp, E. coli
tgtatcgtcacattcattaaggtta

SEQ ID NO: 105840 - DNA, 25 bp, E. coli
tgtatcgtcacaatcattaaggtta

SEQ ID NO: 105841 - DNA, 25 bp, E. coli
tccgggtatgggaatacttcagcca

SEQ ID NO: 105842 - DNA, 25 bp, E. coli
tccgggtatgggtatacttcagcca

SEQ ID NO: 105843 - DNA, 25 bp, E. coli
gccattccagaatgtatcgtcacat

SEQ ID NO: 105844 - DNA, 25 bp, E. coli
gccattccagaaagtatcgtcacat

SEQ ID NO: 105845 - DNA, 25 bp, E. coli
tgtaaaatccctacccttaccgatg

SEQ ID NO: 105846 - DNA, 25 bp, E. coli
gggtatacttcacccaatagccgag

SEQ ID NO: 105847 - DNA, 25 bp, E. coli
gggtatacttcagccaatagccgag

SEQ ID NO: 105848 - DNA, 25 bp, E. coli
tgtaaaatcccttcccttaccgatg

SEQ ID NO: 105849 - DNA, 25 bp, E. coli
caattgtcagggtaattagcgtgaa

SEQ ID NO: 105850 - DNA, 25 bp, E. coli
caattgtcagggaaattagcgtgaa

SEQ ID NO: 105851 - DNA, 25 bp, E. coli
caaaacgattacagccgtcggttca

SEQ ID NO: 105852 - DNA, 25 bp, E. coli
caaaacgattactgccgtcggttca

SEQ ID NO: 105853 - DNA, 25 bp, E. coli
tacaggcagaaatacaagggaaatc

SEQ ID NO: 105854 - DNA, 25 bp, E. coli
tacaggcagaaaaacaagggaaatc

SEQ ID NO: 105855 - DNA, 25 bp, E. coli
taacaccagtcactaaaaatgatgc

SEQ ID NO: 105856 - DNA, 25 bp, E. coli
aaactcatcctctcaattgtcaggg

SEQ ID NO: 105857 - DNA, 25 bp, E. coli
aaactcatcctcacaattgtcaggg

SEQ ID NO: 105858 - DNA, 25 bp, E. coli
tagcgtcgccaatacgattactgcc

SEQ ID NO: 105859 - DNA, 25 bp, E. coli
tatatgatagcatagttaacaccag

SEQ ID NO: 105860 - DNA, 25 bp, E. coli
tatatgatagcaaagttaacaccag

SEQ ID NO: 105861 - DNA, 25 bp, E. coli
tagcgtcgccaaaacgattactgcc

SEQ ID NO: 105862 - DNA, 25 bp, E. coli
tattatcattcagtagcgtcgccaa

SEQ ID NO: 105863 - DNA, 25 bp, E. coli
tattatcattcactagcgtcgccaa

SEQ ID NO: 105864 - DNA, 25 bp, E. coli
tgggcgcgttttataagaacagagt

SEQ ID NO: 105865 - DNA, 25 bp, E. coli
tcggttcaaccaataacagcactga

SEQ ID NO: 105866 - DNA, 25 bp, E. coli
tcggttcaaccattaacagcactga

SEQ ID NO: 105867 - DNA, 25 bp, E. coli
gaaatcatataaaattctgggcgcg

SEQ ID NO: 105868 - DNA, 25 bp, E. coli
gaaatcatataatattctgggcgcg

SEQ ID NO: 105869 - DNA, 25 bp, E. coli
tgggcgcgttttttaagaacagagt

SEQ ID NO: 105870 - DNA, 25 bp, E. coli
taacaccagtcagtaaaaatgatgc

SEQ ID NO: 105871 - DNA, 25 bp, E. coli
agttttgtctgggttatcgctggca

SEQ ID NO: 105872 - DNA, 25 bp, E. coli
agttttgtctggcttatcgctggca

SEQ ID NO: 105873 - DNA, 25 bp, E. coli
agcaataaggactcatccgccatga

SEQ ID NO: 105874 - DNA, 25 bp, E. coli
agcaataaggacacatccgccatga

SEQ ID NO: 105875 - DNA, 25 bp, E. coli
aaattcagccgtattttgcgcgcga

SEQ ID NO: 105876 - DNA, 25 bp, E. coli
aaattcagccgttttttgcgcgcga

SEQ ID NO: 105877 - DNA, 25 bp, E. coli
taccgctcagggatgagttttgtct

SEQ ID NO: 105878 - DNA, 25 bp, E. coli
taccgctcagggttgagttttgtct

SEQ ID NO: 105879 - DNA, 25 bp, E. coli
ttggcgctaaatggcagaaaatgtg

SEQ ID NO: 105880 - DNA, 25 bp, E. coli
ttggcgctaaatcgcagaaaatgtg

SEQ ID NO: 105881 - DNA, 25 bp, E. coli
ttttgcgcgcgaacgctcacccttg

SEQ ID NO: 105882 - DNA, 25 bp, E. coli
ttttgcgcgcgatcgctcacccttg

SEQ ID NO: 105883 - DNA, 25 bp, E. coli
tctgaaatcgcagcaataaggactc

SEQ ID NO: 105884 - DNA, 25 bp, E. coli
tcgctggcaaacagtctgaaatcgc

SEQ ID NO: 105885 - DNA, 25 bp, E. coli
tctgaaatcgcaccaataaggactc

SEQ ID NO: 105886 - DNA, 25 bp, E. coli
tcgctggcaaactgtctgaaatcgc

SEQ ID NO: 105887 - DNA, 25 bp, E. coli
tcatcctgtggagttaccgctcagg

SEQ ID NO: 105888 - DNA, 25 bp, E. coli
tcatcctgtggacttaccgctcagg

SEQ ID NO: 105889 - DNA, 25 bp, E. coli
gggtttatcgcaaaattcagccgtt

SEQ ID NO: 105890 - DNA, 25 bp, E. coli
gggtttatcgcataattcagccgtt

SEQ ID NO: 105891 - DNA, 25 bp, E. coli
tcacccttgcttgtcatcctgtgga

SEQ ID NO: 105892 - DNA, 25 bp, E. coli
tcacccttgcttctcatcctgtgga

SEQ ID NO: 105893 - DNA, 25 bp, E. coli
cagtgattgacgtggccgagaaagc

SEQ ID NO: 105894 - DNA, 25 bp, E. coli
catgattctggtgacgtcactggga

SEQ ID NO: 105895 - DNA, 25 bp, E. coli
cagtgattgacgaggccgagaaagc

SEQ ID NO: 105896 - DNA, 25 bp, E. coli
catgattctggtcacgtcactggga

SEQ ID NO: 105897 - DNA, 25 bp, E. coli
ttgacgaggccgtgaaagcaggcat

SEQ ID NO: 105898 - DNA, 25 bp, E. coli
ttgacgaggccgagaaagcaggcat

SEQ ID NO: 105899 - DNA, 25 bp, E. coli
ttattaaccgtgctgatgtcgccgc

SEQ ID NO: 105900 - DNA, 25 bp, E. coli
ttattaaccgtggtgatgtcgccgc

SEQ ID NO: 105901 - DNA, 25 bp, E. coli
gcttgattatgccattctccgccct

SEQ ID NO: 105902 - DNA, 25 bp, E. coli
gcttgattatgcgattctccgccct

SEQ ID NO: 105903 - DNA, 25 bp, E. coli
gcaaaccagccagcttgattatgcc

SEQ ID NO: 105904 - DNA, 25 bp, E. coli
gcaaaccagccaccttgattatgcc

SEQ ID NO: 105905 - DNA, 25 bp, E. coli
gcaggcatcacacgcatgattctgg

SEQ ID NO: 105906 - DNA, 25 bp, E. coli
gcaggcatcacaggcatgattctgg

SEQ ID NO: 105907 - DNA, 25 bp, E. coli
ccgccctggcggtctgcttgatggt

SEQ ID NO: 105908 - DNA, 25 bp, E. coli
ccgccctggcggactgcttgatggt

SEQ ID NO: 105909 - DNA, 25 bp, E. coli
taaccgtgctgaagtcgccgcacat

SEQ ID NO: 105910 - DNA, 25 bp, E. coli
taaccgtgctgatgtcgccgcacat

SEQ ID NO: 105911 - DNA, 25 bp, E. coli
gagtgtcatggttttattaaccgtg

SEQ ID NO: 105912 - DNA, 25 bp, E. coli
gagaaagcaggcttcacacgcatga

SEQ ID NO: 105913 - DNA, 25 bp, E. coli
gagaaagcaggcatcacacgcatga

SEQ ID NO: 105914 - DNA, 25 bp, E. coli
gagtgtcatggtattattaaccgtg

SEQ ID NO: 105915 - DNA, 25 bp, E. coli
cattatggatgacccgtgatcagga

SEQ ID NO: 105916 - DNA, 25 bp, E. coli
taaatgctgttgttactagtggcgc

SEQ ID NO: 105917 - DNA, 25 bp, E. coli
taaatgctgttgatactagtggcgc

SEQ ID NO: 105918 - DNA, 25 bp, E. coli
agtgttattaaaaccggctccggca

SEQ ID NO: 105919 - DNA, 25 bp, E. coli
agtgttattaaatccggctccggca

SEQ ID NO: 105920 - DNA, 25 bp, E. coli
tatgatcatattggtttggccgcac

SEQ ID NO: 105921 - DNA, 25 bp, E. coli
taccacttatgttgagaaggtcccc

SEQ ID NO: 105922 - DNA, 25 bp, E. coli
taccacttatgtagagaaggtcccc

SEQ ID NO: 105923 - DNA, 25 bp, E. coli
tatgatcatattcgtttggccgcac

SEQ ID NO: 105924 - DNA, 25 bp, E. coli
tttccccggaagatatcgatcgagc

SEQ ID NO: 105925 - DNA, 25 bp, E. coli
tttccccggaagttatcgatcgagc

SEQ ID NO: 105926 - DNA, 25 bp, E. coli
tttatcccgaatgaaacagaactgg

SEQ ID NO: 105927 - DNA, 25 bp, E. coli
tttatcccgaatcaaacagaactgg

SEQ ID NO: 105928 - DNA, 25 bp, E. coli
gaaggtcccctgtaccagcagtggt

SEQ ID NO: 105929 - DNA, 25 bp, E. coli
gaaggtcccctgaaccagcagtggt

SEQ ID NO: 105930 - DNA, 25 bp, E. coli
cattatggatgagccgtgatcagga

SEQ ID NO: 105931 - DNA, 25 bp, E. coli
gttaccatgagcgaaaaaggcgcat

SEQ ID NO: 105932 - DNA, 25 bp, E. coli
gttaccatgagccaaaaaggcgcat

SEQ ID NO: 105933 - DNA, 25 bp, E. coli
ggaaacagtttagcacgcgattgag

SEQ ID NO: 105934 - DNA, 25 bp, E. coli
ggaaacagtttaccacgcgattgag

SEQ ID NO: 105935 - DNA, 25 bp, E. coli
tcacagggaaagctacgcaatcatc

SEQ ID NO: 105936 - DNA, 25 bp, E. coli
tcacagggaaaggtacgcaatcatc

SEQ ID NO: 105937 - DNA, 25 bp, E. coli
cactacgcgcaacaagtcagaggtt

SEQ ID NO: 105938 - DNA, 25 bp, E. coli
cactacgcgcaagaagtcagaggtt

SEQ ID NO: 105939 - DNA, 25 bp, E. coli
ttcgacaccgtttacaacaagatgg

SEQ ID NO: 105940 - DNA, 25 bp, E. coli
ttcgacaccgttaacaacaagatgg

SEQ ID NO: 105941 - DNA, 25 bp, E. coli
tgaaacgcgcataaatgctctggag

SEQ ID NO: 105942 - DNA, 25 bp, E. coli
tgctctggagtaagccactacgcgc

SEQ ID NO: 105943 - DNA, 25 bp, E. coli
tgaaaacgcttaggccgtcatccgg

SEQ ID NO: 105944 - DNA, 25 bp, E. coli
tgaaaacgcttacgccgtcatccgg

SEQ ID NO: 105945 - DNA, 25 bp, E. coli
tgaaacgcgcattaatgctctggag

SEQ ID NO: 105946 - DNA, 25 bp, E. coli
tgctctggagtatgccactacgcgc

SEQ ID NO: 105947 - DNA, 25 bp, E. coli
gacgtaaacccactgattgccttga

SEQ ID NO: 105948 - DNA, 25 bp, E. coli
gacgtaaacccagtgattgccttga

SEQ ID NO: 105949 - DNA, 25 bp, E. coli
gatattgcatcggttgataccagag

SEQ ID NO: 105950 - DNA, 25 bp, E. coli
gatattgcatcgcttgataccagag

SEQ ID NO: 105951 - DNA, 25 bp, E. coli
gggacgttggcaccattcttcgaca

SEQ ID NO: 105952 - DNA, 25 bp, E. coli
gggacgttggcagcattcttcgaca

SEQ ID NO: 105953 - DNA, 25 bp, E. coli
tggcgtatcagttaccatcccgaca

SEQ ID NO: 105954 - DNA, 25 bp, E. coli
tggcgtatcagtaaccatcccgaca

SEQ ID NO: 105955 - DNA, 25 bp, E. coli
gagttcagtcgcaggaatcgcaggt

SEQ ID NO: 105956 - DNA, 25 bp, E. coli
gaccaaccttgtaagcctgctgaaa

SEQ ID NO: 105957 - DNA, 25 bp, E. coli
gaccaaccttgttagcctgctgaaa

SEQ ID NO: 105958 - DNA, 25 bp, E. coli
gagttcagtcgctggaatcgcaggt

SEQ ID NO: 105959 - DNA, 25 bp, E. coli
aatccatgccggaattccacaatac

SEQ ID NO: 105960 - DNA, 25 bp, E. coli
aatccatgccggtattccacaatac

SEQ ID NO: 105961 - DNA, 25 bp, E. coli
catgccggtattgcacaatacccgg

SEQ ID NO: 105962 - DNA, 25 bp, E. coli
catgccggtattccacaatacccgg

SEQ ID NO: 105963 - DNA, 25 bp, E. coli
atccatgccggtattccacaatacc

SEQ ID NO: 105964 - DNA, 25 bp, E. coli
actcgggctggtcatcgttaagccg

SEQ ID NO: 105965 - DNA, 25 bp, E. coli
actcgggctggtgatcgttaagccg

SEQ ID NO: 105966 - DNA, 25 bp, E. coli
atccatgccggttttccacaatacc

SEQ ID NO: 105967 - DNA, 25 bp, E. coli
tcgggctggtgatcgttaagccggg

SEQ ID NO: 105968 - DNA, 25 bp, E. coli
tccatgccggtattccacaataccc

SEQ ID NO: 105969 - DNA, 25 bp, E. coli
tcgggctggtgaacgttaagccggg

SEQ ID NO: 105970 - DNA, 25 bp, E. coli
tccatgccggtaatccacaataccc

SEQ ID NO: 105971 - DNA, 25 bp, E. coli
gaatccatgccggtattccacaata

SEQ ID NO: 105972 - DNA, 25 bp, E. coli
gaatccatgccgctattccacaata

SEQ ID NO: 105973 - DNA, 25 bp, E. coli
cgggctggtgatggttaagccgggc

SEQ ID NO: 105974 - DNA, 25 bp, E. coli
ctcgggctggtgttcgttaagccgg

SEQ ID NO: 105975 - DNA, 25 bp, E. coli
ctcgggctggtgatcgttaagccgg

SEQ ID NO: 105976 - DNA, 25 bp, E. coli
cgggctggtgatcgttaagccgggc

SEQ ID NO: 105977 - DNA, 25 bp, E. coli
tacggcctgcaagcggtagatagcg

SEQ ID NO: 105978 - DNA, 25 bp, E. coli
tacggcctgcaaccggtagatagcg

SEQ ID NO: 105979 - DNA, 25 bp, E. coli
tgtacgtctccaacggtatgtccgc

SEQ ID NO: 105980 - DNA, 25 bp, E. coli
tgtacgtctccatcggtatgtccgc

SEQ ID NO: 105981 - DNA, 25 bp, E. coli
tccgcaggtaatacccgcaacgaag

SEQ ID NO: 105982 - DNA, 25 bp, E. coli
tccgcaggtaattcccgcaacgaag

SEQ ID NO: 105983 - DNA, 25 bp, E. coli
tctccaacggtatgtccgcaggtaa

SEQ ID NO: 105984 - DNA, 25 bp, E. coli
tctccaacggtaagtccgcaggtaa

SEQ ID NO: 105985 - DNA, 25 bp, E. coli
gcctgccgtttacgcgtcagtccga

SEQ ID NO: 105986 - DNA, 25 bp, E. coli
gcctgccgtttaggcgtcagtccga

SEQ ID NO: 105987 - DNA, 25 bp, E. coli
cctgccagagatcccggcagacgtg

SEQ ID NO: 105988 - DNA, 25 bp, E. coli
ccaacggtatgtccgcaggtaatac

SEQ ID NO: 105989 - DNA, 25 bp, E. coli
cctgccagagatgccggcagacgtg

SEQ ID NO: 105990 - DNA, 25 bp, E. coli
ccaacggtatgtgcgcaggtaatac

SEQ ID NO: 105991 - DNA, 25 bp, E. coli
gcgttttacggcgtgcaaccggtag

SEQ ID NO: 105992 - DNA, 25 bp, E. coli
gctgaaagcatctgcctgccagaga

SEQ ID NO: 105993 - DNA, 25 bp, E. coli
gctgaaagcatcagcctgccagaga

SEQ ID NO: 105994 - DNA, 25 bp, E. coli
gcgttttacggcctgcaaccggtag

SEQ ID NO: 105995 - DNA, 25 bp, E. coli
gaaagcatcagcctgccagagatcc

SEQ ID NO: 105996 - DNA, 25 bp, E. coli
gaaagcatcagcgtgccagagatcc

SEQ ID NO: 105997 - DNA, 25 bp, E. coli
ggtatgtccgcaggtaatacccgca

SEQ ID NO: 105998 - DNA, 25 bp, E. coli
ggtatgtccgcacgtaatacccgca

SEQ ID NO: 105999 - DNA, 25 bp, E. coli
cacaaaaggcgtgtatccgtcttac

SEQ ID NO: 106000 - DNA, 25 bp, E. coli
aagattatgcccgtagcgcggcgag

SEQ ID NO: 106001 - DNA, 25 bp, E. coli
cacaaaaggcgtctatccgtcttac

SEQ ID NO: 106002 - DNA, 25 bp, E. coli
aagattatgcccctagcgcggcgag

SEQ ID NO: 106003 - DNA, 25 bp, E. coli
cagtgcccctgtagtcacggaaaaa

SEQ ID NO: 106004 - DNA, 25 bp, E. coli
cagtgcccctgttgtcacggaaaaa

SEQ ID NO: 106005 - DNA, 25 bp, E. coli
tagcgcggcgaggaaaaaacagtgc

SEQ ID NO: 106006 - DNA, 25 bp, E. coli
tagcgcggcgagcaaaaaacagtgc

SEQ ID NO: 106007 - DNA, 25 bp, E. coli
ttagtatgaatgtcagagagcgggc

SEQ ID NO: 106008 - DNA, 25 bp, E. coli
ttagtatgaatgacagagagcgggc

SEQ ID NO: 106009 - DNA, 25 bp, E. coli
tcgcgtggcggccttaagaaaactc

SEQ ID NO: 106010 - DNA, 25 bp, E. coli
tcgcgtggcggcgttaagaaaactc

SEQ ID NO: 106011 - DNA, 25 bp, E. coli
gcgcggtgttgccattcatcgtgaa

SEQ ID NO: 106012 - DNA, 25 bp, E. coli
gcgcggtgttgcgattcatcgtgaa

SEQ ID NO: 106013 - DNA, 25 bp, E. coli
gaagcatgggcacaacaacaactga

SEQ ID NO: 106014 - DNA, 25 bp, E. coli
gaagcatgggcagaacaacaactga

SEQ ID NO: 106015 - DNA, 25 bp, E. coli
gaaagattaccttcaacggaggcat

SEQ ID NO: 106016 - DNA, 25 bp, E. coli
gaaagattacctacaacggaggcat

SEQ ID NO: 106017 - DNA, 25 bp, E. coli
cctgtaaagattttcgtgggcgcgg

SEQ ID NO: 106018 - DNA, 25 bp, E. coli
cctgtaaagattatcgtgggcgcgg

SEQ ID NO: 106019 - DNA, 25 bp, E. coli
taagccgccagtctgggcaaagtgc

SEQ ID NO: 106020 - DNA, 25 bp, E. coli
taagccgccagtgtgggcaaagtgc

SEQ ID NO: 106021 - DNA, 25 bp, E. coli
actgacggcgtacgtaccaagctgc

SEQ ID NO: 106022 - DNA, 25 bp, E. coli
actgacggcgtaggtaccaagctgc

SEQ ID NO: 106023 - DNA, 25 bp, E. coli
aacattccgcgcgtattgccagata

SEQ ID NO: 106024 - DNA, 25 bp, E. coli
aacattccgcgcctattgccagata

SEQ ID NO: 106025 - DNA, 25 bp, E. coli
tgtgatccgcaatccaccgaacttg

SEQ ID NO: 106026 - DNA, 25 bp, E. coli
tggtaagccatttgccgatcatctg

SEQ ID NO: 106027 - DNA, 25 bp, E. coli
tgtgatccgcaaaccaccgaacttg

SEQ ID NO: 106028 - DNA, 25 bp, E. coli
tggtaagccattagccgatcatctg

SEQ ID NO: 106029 - DNA, 25 bp, E. coli
tctcttagctacaaagatgccggtg

SEQ ID NO: 106030 - DNA, 25 bp, E. coli
tctgattccgaagaacgcgtggtta

SEQ ID NO: 106031 - DNA, 25 bp, E. coli
tctgattccgaacaacgcgtggtta

SEQ ID NO: 106032 - DNA, 25 bp, E. coli
tctcttagctactaagatgccggtg

SEQ ID NO: 106033 - DNA, 25 bp, E. coli
ccggaagtgttcaactggctgcaaa

SEQ ID NO: 106034 - DNA, 25 bp, E. coli
ccggaagtgttctactggctgcaaa

SEQ ID NO: 106035 - DNA, 25 bp, E. coli
gaagaaaacgcgacgtccggaagtg

SEQ ID NO: 106036 - DNA, 25 bp, E. coli
gaagaaaacgcgtcgtccggaagtg

SEQ ID NO: 106037 - DNA, 25 bp, E. coli
gactattacgcatccggaaaactgg

SEQ ID NO: 106038 - DNA, 25 bp, E. coli
gactattacgcaaccggaaaactgg

SEQ ID NO: 106039 - DNA, 25 bp, E. coli
ggcaccgacccgcatttacgtgaag

SEQ ID NO: 106040 - DNA, 25 bp, E. coli
ggcaccgacccggatttacgtgaag

SEQ ID NO: 106041 - DNA, 25 bp, E. coli
tcaatgccaacgctgaaaacgcgtg

SEQ ID NO: 106042 - DNA, 25 bp, E. coli
tcaatgccaacggtgaaaacgcgtg

SEQ ID NO: 106043 - DNA, 25 bp, E. coli
caagcttcaatgcttgcctgccgaa

SEQ ID NO: 106044 - DNA, 25 bp, E. coli
caagcttcaatggttgcctgccgaa

SEQ ID NO: 106045 - DNA, 25 bp, E. coli
catcttgctgttaatcaagcttcaa

SEQ ID NO: 106046 - DNA, 25 bp, E. coli
catcttgctgtttatcaagcttcaa

SEQ ID NO: 106047 - DNA, 25 bp, E. coli
atgactaccggcaactctggcacag

SEQ ID NO: 106048 - DNA, 25 bp, E. coli
atgactaccggctactctggcacag

SEQ ID NO: 106049 - DNA, 25 bp, E. coli
actctggcacagttggaataatcga

SEQ ID NO: 106050 - DNA, 25 bp, E. coli
actctggcacagatggaataatcga

SEQ ID NO: 106051 - DNA, 25 bp, E. coli
tatttcacagtcaaacttgctgcat

SEQ ID NO: 106052 - DNA, 25 bp, E. coli
tatttcacagtctaacttgctgcat

SEQ ID NO: 106053 - DNA, 25 bp, E. coli
tggttgcctgcccaactattccgca

SEQ ID NO: 106054 - DNA, 25 bp, E. coli
tgaagaatcgcggaacgccctaaag

SEQ ID NO: 106055 - DNA, 25 bp, E. coli
tgaagaatcgcgcaacgccctaaag

SEQ ID NO: 106056 - DNA, 25 bp, E. coli
tccgccctggaagacatcattaaaa

SEQ ID NO: 106057 - DNA, 25 bp, E. coli
tccgccctggaacacatcattaaaa

SEQ ID NO: 106058 - DNA, 25 bp, E. coli
tccgttaaagaacaatatttcacag

SEQ ID NO: 106059 - DNA, 25 bp, E. coli
ccttctgatgttgaaatcatgcggg

SEQ ID NO: 106060 - DNA, 25 bp, E. coli
ccttctgatgttcaaatcatgcggg

SEQ ID NO: 106061 - DNA, 25 bp, E. coli
tccgttaaagaagaatatttcacag

SEQ ID NO: 106062 - DNA, 25 bp, E. coli
gaaatcatgcggctatataccatgc

SEQ ID NO: 106063 - DNA, 25 bp, E. coli
gaaatcatgcgggtatataccatgc

SEQ ID NO: 106064 - DNA, 25 bp, E. coli
tggttgcctgccgaactattccgca

SEQ ID NO: 106065 - DNA, 25 bp, E. coli
catctggtgaagattctcggtaagc

SEQ ID NO: 106066 - DNA, 25 bp, E. coli
catctggtgaagtttctcggtaagc

SEQ ID NO: 106067 - DNA, 25 bp, E. coli
agcaattccgggatgccaaaagcca

SEQ ID NO: 106068 - DNA, 25 bp, E. coli
agcaattccgggttgccaaaagcca

SEQ ID NO: 106069 - DNA, 25 bp, E. coli
aaagccagccgtgattctattgtcg

SEQ ID NO: 106070 - DNA, 25 bp, E. coli
aaagccagccgtcattctattgtcg

SEQ ID NO: 106071 - DNA, 25 bp, E. coli
ttaatccgcaactaatcccgccaga

SEQ ID NO: 106072 - DNA, 25 bp, E. coli
ttaatccgcaacaaatcccgccaga

SEQ ID NO: 106073 - DNA, 25 bp, E. coli
tgaaaaaggcgatcttggccgccac

SEQ ID NO: 106074 - DNA, 25 bp, E. coli
tgaaaaaggcgaacttggccgccac

SEQ ID NO: 106075 - DNA, 25 bp, E. coli
tctcggtaagcaattccgggttgcc

SEQ ID NO: 106076 - DNA, 25 bp, E. coli
tctcggtaagcatttccgggttgcc

SEQ ID NO: 106077 - DNA, 25 bp, E. coli
tctattgtcggtttacatggcgacg

SEQ ID NO: 106078 - DNA, 25 bp, E. coli
tctattgtcggtatacatggcgacg

SEQ ID NO: 106079 - DNA, 25 bp, E. coli
gccaaaagccaggtggtgattgaaa

SEQ ID NO: 106080 - DNA, 25 bp, E. coli
gccaaaagccagctggtgattgaaa

SEQ ID NO: 106081 - DNA, 25 bp, E. coli
gacggtctggttatacggctctata

SEQ ID NO: 106082 - DNA, 25 bp, E. coli
gacggtctggttttacggctctata

SEQ ID NO: 106083 - DNA, 25 bp, E. coli
ctatattcagccgaaagccagccgt

SEQ ID NO: 106084 - DNA, 25 bp, E. coli
ctatattcagcccaaagccagccgt

SEQ ID NO: 106085 - DNA, 25 bp, E. coli
tggccgccacaatcaaattaaaatc

SEQ ID NO: 106086 - DNA, 25 bp, E. coli
tggccgccacaaacaaattaaaatc

SEQ ID NO: 106087 - DNA, 25 bp, E. coli
agcagaacctgctaagccgtggcac

SEQ ID NO: 106088 - DNA, 25 bp, E. coli
agcagaacctgcaaagccgtggcac

SEQ ID NO: 106089 - DNA, 25 bp, E. coli
gttaaaaagcaatacggcgatggct

SEQ ID NO: 106090 - DNA, 25 bp, E. coli
gaagcctggacccatatgttcccgg

SEQ ID NO: 106091 - DNA, 25 bp, E. coli
gaagcggtcgctcaataccagtttg

SEQ ID NO: 106092 - DNA, 25 bp, E. coli
gttaaaaagcaaaacggcgatggct

SEQ ID NO: 106093 - DNA, 25 bp, E. coli
gaagcctggaccgatatgttcccgg

SEQ ID NO: 106094 - DNA, 25 bp, E. coli
gaagcggtcgctgaataccagtttg

SEQ ID NO: 106095 - DNA, 25 bp, E. coli
cgttgtatgacgtggaagcctggac

SEQ ID NO: 106096 - DNA, 25 bp, E. coli
cgatggcttcggcacgtcattgaca

SEQ ID NO: 106097 - DNA, 25 bp, E. coli
cgatggcttcgggacgtcattgaca

SEQ ID NO: 106098 - DNA, 25 bp, E. coli
cgttgtatgacgaggaagcctggac

SEQ ID NO: 106099 - DNA, 25 bp, E. coli
cggcgcagaccgacaactttatgac

SEQ ID NO: 106100 - DNA, 25 bp, E. coli
ctttatgaccaatcgcgccagcggt

SEQ ID NO: 106101 - DNA, 25 bp, E. coli
cggcgcagaccgtcaactttatgac

SEQ ID NO: 106102 - DNA, 25 bp, E. coli
ctttatgaccaaacgcgccagcggt

SEQ ID NO: 106103 - DNA, 25 bp, E. coli
ggtctggcgacgtatcggaacaccg

SEQ ID NO: 106104 - DNA, 25 bp, E. coli
ggtctggcgacgaatcggaacaccg

SEQ ID NO: 106105 - DNA, 25 bp, E. coli
gatggcctgaacttaaccctgcaat

SEQ ID NO: 106106 - DNA, 25 bp, E. coli
gatggcgaccagagttatatccgtt

SEQ ID NO: 106107 - DNA, 25 bp, E. coli
gatggcgaccagtgttatatccgtt

SEQ ID NO: 106108 - DNA, 25 bp, E. coli
gatggcctgaacataaccctgcaat

SEQ ID NO: 106109 - DNA, 25 bp, E. coli
cacgcattatcgtaaggagaaaatc

SEQ ID NO: 106110 - DNA, 25 bp, E. coli
cacgcattatcgaaaggagaaaatc

SEQ ID NO: 106111 - DNA, 25 bp, E. coli
cagttatttatcctatgggtcaatg

SEQ ID NO: 106112 - DNA, 25 bp, E. coli
cagttatttatcgtatgggtcaatg

SEQ ID NO: 106113 - DNA, 25 bp, E. coli
taaagcgcaggcttatattgaactc

SEQ ID NO: 106114 - DNA, 25 bp, E. coli
taaagcgcaggcatatattgaactc

SEQ ID NO: 106115 - DNA, 25 bp, E. coli
tagtgttaagagtaaagcgcaggca

SEQ ID NO: 106116 - DNA, 25 bp, E. coli
tagtgttaagagaaaagcgcaggca

SEQ ID NO: 106117 - DNA, 25 bp, E. coli
tgggcaaatcaagtaaaacacgcat

SEQ ID NO: 106118 - DNA, 25 bp, E. coli
tgggcaaatcaactaaaacacgcat

SEQ ID NO: 106119 - DNA, 25 bp, E. coli
tgcattcgactagcatgaaaagggt

SEQ ID NO: 106120 - DNA, 25 bp, E. coli
tgcattcgactaccatgaaaagggt

SEQ ID NO: 106121 - DNA, 25 bp, E. coli
gcatttatgcgtacgaaaatcatga

SEQ ID NO: 106122 - DNA, 25 bp, E. coli
gcatttatgcgttcgaaaatcatga

SEQ ID NO: 106123 - DNA, 25 bp, E. coli
gaaatatcaacaagcatatgacctt

SEQ ID NO: 106124 - DNA, 25 bp, E. coli
gaaatatcaacatgcatatgacctt

SEQ ID NO: 106125 - DNA, 25 bp, E. coli
cgataattcagaagataatggctaa

SEQ ID NO: 106126 - DNA, 25 bp, E. coli
cgataattcagatgataatggctaa

SEQ ID NO: 106127 - DNA, 25 bp, E. coli
ggctaaaaatatggataacgcaatg

SEQ ID NO: 106128 - DNA, 25 bp, E. coli
ggctaaaaatatcgataacgcaatg

SEQ ID NO: 106129 - DNA, 25 bp, E. coli
gagaaaatctggcattactacatgg

SEQ ID NO: 106130 - DNA, 25 bp, E. coli
gagaaaatctgggattactacatgg

SEQ ID NO: 106131 - DNA, 25 bp, E. coli
cagtggcaagaatgtaaatcacttt

SEQ ID NO: 106132 - DNA, 25 bp, E. coli
cagtggcaagaaagtaaatcacttt

SEQ ID NO: 106133 - DNA, 25 bp, E. coli
tacatgatccctaattccgacagcg

SEQ ID NO: 106134 - DNA, 25 bp, E. coli
taaagggcagattaaggataatgcg

SEQ ID NO: 106135 - DNA, 25 bp, E. coli
tacatgatcccttattccgacagcg

SEQ ID NO: 106136 - DNA, 25 bp, E. coli
taaagggcagataaaggataatgcg

SEQ ID NO: 106137 - DNA, 25 bp, E. coli
gcagttacatgcgaaaaggaaaaca

SEQ ID NO: 106138 - DNA, 25 bp, E. coli
gcagttacatgccaaaaggaaaaca

SEQ ID NO: 106139 - DNA, 25 bp, E. coli
cgatatcagcatactaaagggcaga

SEQ ID NO: 106140 - DNA, 25 bp, E. coli
cgatatcagcattctaaagggcaga

SEQ ID NO: 106141 - DNA, 25 bp, E. coli
cgaaaaggaaaagatggcaatcggg

SEQ ID NO: 106142 - DNA, 25 bp, E. coli
cgaaaaggaaaacatggcaatcggg

SEQ ID NO: 106143 - DNA, 25 bp, E. coli
gataaaggataaagcgatagaagca

SEQ ID NO: 106144 - DNA, 25 bp, E. coli
gatagaagcatttctacatgatccc

SEQ ID NO: 106145 - DNA, 25 bp, E. coli
gataaaggataatgcgatagaagca

SEQ ID NO: 106146 - DNA, 25 bp, E. coli
gatagaagcattactacatgatccc

SEQ ID NO: 106147 - DNA, 25 bp, E. coli
gggaaaggcagttacatgcgaaaag

SEQ ID NO: 106148 - DNA, 25 bp, E. coli
gggaaaggcagtaacatgcgaaaag

SEQ ID NO: 106149 - DNA, 25 bp, E. coli
tcagcatactaatgggcagataaag

SEQ ID NO: 106150 - DNA, 25 bp, E. coli
tcagcatactaaagggcagataaag

SEQ ID NO: 106151 - DNA, 25 bp, E. coli
gaggccagtggcaagaaagtaaatc

SEQ ID NO: 106152 - DNA, 25 bp, E. coli
gaggccagtggctagaaagtaaatc

SEQ ID NO: 106153 - DNA, 25 bp, E. coli
caatgaacgtaaagtaccggtaatg

SEQ ID NO: 106154 - DNA, 25 bp, E. coli
caatgaacgtaatgtaccggtaatg

SEQ ID NO: 106155 - DNA, 25 bp, E. coli
tatgtaggcgaagacaatgaacgta

SEQ ID NO: 106156 - DNA, 25 bp, E. coli
taggcgaagacattgaacgtaaagt

SEQ ID NO: 106157 - DNA, 25 bp, E. coli
tatgtaggcgaacacaatgaacgta

SEQ ID NO: 106158 - DNA, 25 bp, E. coli
taggcgaagacaatgaacgtaaagt

SEQ ID NO: 106159 - DNA, 25 bp, E. coli
tgaacgtaaagtaccggtaatgatt

SEQ ID NO: 106160 - DNA, 25 bp, E. coli
tgaacgtaaagttccggtaatgatt

SEQ ID NO: 106161 - DNA, 25 bp, E. coli
tctgagcgcttcatatgtaggcgaa

SEQ ID NO: 106162 - DNA, 25 bp, E. coli
tcgtctgagcgcatcttatgtaggc

SEQ ID NO: 106163 - DNA, 25 bp, E. coli
tcttatgtaggcgaagacaatgaac

SEQ ID NO: 106164 - DNA, 25 bp, E. coli
tcttatgtaggccaagacaatgaac

SEQ ID NO: 106165 - DNA, 25 bp, E. coli
tcgtctgagcgcttcttatgtaggc

SEQ ID NO: 106166 - DNA, 25 bp, E. coli
tctgagcgcttcttatgtaggcgaa

SEQ ID NO: 106167 - DNA, 25 bp, E. coli
gcgcttcttatgtaggcgaagacaa

SEQ ID NO: 106168 - DNA, 25 bp, E. coli
gcgcttcttatgaaggcgaagacaa

SEQ ID NO: 106169 - DNA, 25 bp, E. coli
gcttcttatgtaggcgaagacaatg

SEQ ID NO: 106170 - DNA, 25 bp, E. coli
gcttcttatgtacgcgaagacaatg

SEQ ID NO: 106171 - DNA, 25 bp, E. coli
gaagacaatgaaggtaaagtaccgg

SEQ ID NO: 106172 - DNA, 25 bp, E. coli
gaagacaatgaacgtaaagtaccgg

SEQ ID NO: 106173 - DNA, 25 bp, E. coli
gagcgcttcttatgtaggcgaagac

SEQ ID NO: 106174 - DNA, 25 bp, E. coli
gagcgcttcttaagtaggcgaagac

SEQ ID NO: 106175 - DNA, 25 bp, E. coli
cacggcctgcctgtgtcagaaaatc

SEQ ID NO: 106176 - DNA, 25 bp, E. coli
cacggcctgcctctgtcagaaaatc

SEQ ID NO: 106177 - DNA, 25 bp, E. coli
tacttacgtacagatgaaggctggc

SEQ ID NO: 106178 - DNA, 25 bp, E. coli
tacttacgtacacatgaaggctggc

SEQ ID NO: 106179 - DNA, 25 bp, E. coli
tattggctggtctatgtcgccacgc

SEQ ID NO: 106180 - DNA, 25 bp, E. coli
tattggctggtcaatgtcgccacgc

SEQ ID NO: 106181 - DNA, 25 bp, E. coli
tgattacaatcggtggcggcggcac

SEQ ID NO: 106182 - DNA, 25 bp, E. coli
tgattacaatcgctggcggcggcac

SEQ ID NO: 106183 - DNA, 25 bp, E. coli
tgggcaggagacttcacgtacttac

SEQ ID NO: 106184 - DNA, 25 bp, E. coli
tgggcaggagacatcacgtacttac

SEQ ID NO: 106185 - DNA, 25 bp, E. coli
tcagcatcaaagcaatgtgccgcgt

SEQ ID NO: 106186 - DNA, 25 bp, E. coli
gcaggatttttaggccagtggcccg

SEQ ID NO: 106187 - DNA, 25 bp, E. coli
gcaggatttttacgccagtggcccg

SEQ ID NO: 106188 - DNA, 25 bp, E. coli
ccgtggaggccactactgttcagca

SEQ ID NO: 106189 - DNA, 25 bp, E. coli
ccgtggaggccagtactgttcagca

SEQ ID NO: 106190 - DNA, 25 bp, E. coli
cgttatcgttcagacggaccgtgga

SEQ ID NO: 106191 - DNA, 25 bp, E. coli
cgttatcgttcacacggaccgtgga

SEQ ID NO: 106192 - DNA, 25 bp, E. coli
gattatcaggcggaactgaagcggc

SEQ ID NO: 106193 - DNA, 25 bp, E. coli
gattatcaggcgcaactgaagcggc

SEQ ID NO: 106194 - DNA, 25 bp, E. coli
gataagcacgcgtcagcagttccgc

SEQ ID NO: 106195 - DNA, 25 bp, E. coli
gataagcacgcgacagcagttccgc

SEQ ID NO: 106196 - DNA, 25 bp, E. coli
tcagcatcaaaggaatgtgccgcgt

SEQ ID NO: 106197 - DNA, 25 bp, E. coli
caacgctggcaacagaataaccgag

SEQ ID NO: 106198 - DNA, 25 bp, E. coli
caacgctggcaagagaataaccgag

SEQ ID NO: 106199 - DNA, 25 bp, E. coli
cagctctttctggagacggcggatc

SEQ ID NO: 106200 - DNA, 25 bp, E. coli
cagcatcaccgagaacacaaatggg

SEQ ID NO: 106201 - DNA, 25 bp, E. coli
cagctctttctgcagacggcggatc

SEQ ID NO: 106202 - DNA, 25 bp, E. coli
cagcatcaccgacaacacaaatggg

SEQ ID NO: 106203 - DNA, 25 bp, E. coli
cggaccgtacttgtttatccaggca

SEQ ID NO: 106204 - DNA, 25 bp, E. coli
cggaccgtacttctttatccaggca

SEQ ID NO: 106205 - DNA, 25 bp, E. coli
tatcgagacgtgttgcaacgctggc

SEQ ID NO: 106206 - DNA, 25 bp, E. coli
tatccaggcataaaggctgtgggtg

SEQ ID NO: 106207 - DNA, 25 bp, E. coli
tatcgagacgtgatgcaacgctggc

SEQ ID NO: 106208 - DNA, 25 bp, E. coli
tatccaggcatataggctgtgggtg

SEQ ID NO: 106209 - DNA, 25 bp, E. coli
tttattagtggatgaatccggaccg

SEQ ID NO: 106210 - DNA, 25 bp, E. coli
tttattagtggaagaatccggaccg

SEQ ID NO: 106211 - DNA, 25 bp, E. coli
tctcggcctgagcatctgactgttc

SEQ ID NO: 106212 - DNA, 25 bp, E. coli
tctcggcctgaggatctgactgttc

SEQ ID NO: 106213 - DNA, 25 bp, E. coli
tcatgggcacctctctttaagccat

SEQ ID NO: 106214 - DNA, 25 bp, E. coli
tcatgggcacctgtctttaagccat

SEQ ID NO: 106215 - DNA, 25 bp, E. coli
gaataaccgagaacaacaacctgtt

SEQ ID NO: 106216 - DNA, 25 bp, E. coli
gaataaccgagatcaacaacctgtt

SEQ ID NO: 106217 - DNA, 25 bp, E. coli
ggataacgcttaccgctcatgggca

SEQ ID NO: 106218 - DNA, 25 bp, E. coli
ggataacgcttagcgctcatgggca

SEQ ID NO: 106219 - DNA, 25 bp, E. coli
cacacagaagaatgggctgactgcc

SEQ ID NO: 106220 - DNA, 25 bp, E. coli
cacacagaagaaagggctgactgcc

SEQ ID NO: 106221 - DNA, 25 bp, E. coli
taaaggcaaaaatggcgagcgcccc

SEQ ID NO: 106222 - DNA, 25 bp, E. coli
taaaggcaaaaaaggcgagcgcccc

SEQ ID NO: 106223 - DNA, 25 bp, E. coli
tattgacgctatgatgaacggccag

SEQ ID NO: 106224 - DNA, 25 bp, E. coli
tattgacgctatcatgaacggccag

SEQ ID NO: 106225 - DNA, 25 bp, E. coli
ttccgttgtgaagggaacacctgca

SEQ ID NO: 106226 - DNA, 25 bp, E. coli
ttccgttgtgaacggaacacctgca

SEQ ID NO: 106227 - DNA, 25 bp, E. coli
cctgttctactacaacgtgcgtgag

SEQ ID NO: 106228 - DNA, 25 bp, E. coli
cctgttctactagaacgtgcgtgag

SEQ ID NO: 106229 - DNA, 25 bp, E. coli
gcagtggccaggactataccgtcaa

SEQ ID NO: 106230 - DNA, 25 bp, E. coli
gcagtggccaggtctataccgtcaa

SEQ ID NO: 106231 - DNA, 25 bp, E. coli
gaaaagctgcctaacctggcgcaaa

SEQ ID NO: 106232 - DNA, 25 bp, E. coli
gaaaagctgccttacctggcgcaaa

SEQ ID NO: 106233 - DNA, 25 bp, E. coli
gtttaaaccgctggtgatgccaccg

SEQ ID NO: 106234 - DNA, 25 bp, E. coli
gattgacatgagaagaccgtggcag

SEQ ID NO: 106235 - DNA, 25 bp, E. coli
gtttaaggtcactctcacgcgcagt

SEQ ID NO: 106236 - DNA, 25 bp, E. coli
gtttaaaccgctcgtgatgccaccg

SEQ ID NO: 106237 - DNA, 25 bp, E. coli
gtttaaggtcacactcacgcgcagt

SEQ ID NO: 106238 - DNA, 25 bp, E. coli
gattgacatgagtagaccgtggcag

SEQ ID NO: 106239 - DNA, 25 bp, E. coli
gacctatatcaacgactacggcgcg

SEQ ID NO: 106240 - DNA, 25 bp, E. coli
gacctatatcaaggactacggcgcg

SEQ ID NO: 106241 - DNA, 25 bp, E. coli
cagaattgaattcttacagcggcga

SEQ ID NO: 106242 - DNA, 25 bp, E. coli
cagaattgaattgttacagcggcga

SEQ ID NO: 106243 - DNA, 25 bp, E. coli
cagtatcggtcactttacggtgagg

SEQ ID NO: 106244 - DNA, 25 bp, E. coli
cagtatcggtcagtttacggtgagg

SEQ ID NO: 106245 - DNA, 25 bp, E. coli
catagatgaagcattacagtgcccg

SEQ ID NO: 106246 - DNA, 25 bp, E. coli
catagatgaagctttacagtgcccg

SEQ ID NO: 106247 - DNA, 25 bp, E. coli
tacagtgcccgattacgctggcaat

SEQ ID NO: 106248 - DNA, 25 bp, E. coli
tacagcggcgataacattcatgttc

SEQ ID NO: 106249 - DNA, 25 bp, E. coli
tacagcggcgattacattcatgttc

SEQ ID NO: 106250 - DNA, 25 bp, E. coli
tacagtgcccgaatacgctggcaat

SEQ ID NO: 106251 - DNA, 25 bp, E. coli
tacgctggcaatacctcaacgaggt

SEQ ID NO: 106252 - DNA, 25 bp, E. coli
tacgctggcaattcctcaacgaggt

SEQ ID NO: 106253 - DNA, 25 bp, E. coli
gaactagccgatatcattagattgg

SEQ ID NO: 106254 - DNA, 25 bp, E. coli
gaactagccgatttcattagattgg

SEQ ID NO: 106255 - DNA, 25 bp, E. coli
cattatcaatgcttgtggccagaga

SEQ ID NO: 106256 - DNA, 25 bp, E. coli
cattatcaatgcatgtggccagaga

SEQ ID NO: 106257 - DNA, 25 bp, E. coli
ggtttaagccattcagaactagccg

SEQ ID NO: 106258 - DNA, 25 bp, E. coli
ggtttaagccatacagaactagccg

SEQ ID NO: 106259 - DNA, 25 bp, E. coli
taagaaatgctgaaggttccagagt

SEQ ID NO: 106260 - DNA, 25 bp, E. coli
taagaaatgctgtaggttccagagt

SEQ ID NO: 106261 - DNA, 25 bp, E. coli
gatgcatcacccactaagcagagag

SEQ ID NO: 106262 - DNA, 25 bp, E. coli
gatgcatcaccctctaagcagagag

SEQ ID NO: 106263 - DNA, 25 bp, E. coli
aagcataataaggtttttctgcttc

SEQ ID NO: 106264 - DNA, 25 bp, E. coli
aagctttttctgcttctgccggagg

SEQ ID NO: 106265 - DNA, 25 bp, E. coli
aagctttttctggttctgccggagg

SEQ ID NO: 106266 - DNA, 25 bp, E. coli
aagcataataagctttttctgcttc

SEQ ID NO: 106267 - DNA, 25 bp, E. coli
cataataagctttttctgcttctgc

SEQ ID NO: 106268 - DNA, 25 bp, E. coli
cataataagcttattctgcttctgc

SEQ ID NO: 106269 - DNA, 25 bp, E. coli
ataagctttttcagcttctgccgga

SEQ ID NO: 106270 - DNA, 25 bp, E. coli
ataataagctttttctgcttctgcc

SEQ ID NO: 106271 - DNA, 25 bp, E. coli
ataagctttttctgcttctgccgga

SEQ ID NO: 106272 - DNA, 25 bp, E. coli
ataataagctttatctgcttctgcc

SEQ ID NO: 106273 - DNA, 25 bp, E. coli
gcataataagctatttctgcttctg

SEQ ID NO: 106274 - DNA, 25 bp, E. coli
gcataataagctttttctgcttctg

SEQ ID NO: 106275 - DNA, 25 bp, E. coli
gaagcataataacctttttctgctt

SEQ ID NO: 106276 - DNA, 25 bp, E. coli
gaagcataataagctttttctgctt

SEQ ID NO: 106277 - DNA, 25 bp, E. coli
ggaagcataataagctttttctgct

SEQ ID NO: 106278 - DNA, 25 bp, E. coli
ggaagcataatatgctttttctgct

SEQ ID NO: 106279 - DNA, 25 bp, E. coli
tggaagcataattagctttttctgc

SEQ ID NO: 106280 - DNA, 25 bp, E. coli
tggaagcataataagctttttctgc

SEQ ID NO: 106281 - DNA, 25 bp, E. coli
taagctttttctccttctgccggag

SEQ ID NO: 106282 - DNA, 25 bp, E. coli
taagctttttctgcttctgccggag

SEQ ID NO: 106283 - DNA, 25 bp, E. coli
gatggaagcataataagctttttct

SEQ ID NO: 106284 - DNA, 25 bp, E. coli
gatggaagcatattaagctttttct

SEQ ID NO: 106285 - DNA, 25 bp, E. coli
aagttgatctgactacccctgacgg

SEQ ID NO: 106286 - DNA, 25 bp, E. coli
aagttgatctgagtacccctgacgg

SEQ ID NO: 106287 - DNA, 25 bp, E. coli
catttgctgttaagacggcgaccgt

SEQ ID NO: 106288 - DNA, 25 bp, E. coli
catttgctgttatgacggcgaccgt

SEQ ID NO: 106289 - DNA, 25 bp, E. coli
tacggtctttatgaagcgcagcagg

SEQ ID NO: 106290 - DNA, 25 bp, E. coli
tacggtctttatcaagcgcagcagg

SEQ ID NO: 106291 - DNA, 25 bp, E. coli
ttgcctgatggcgaagaccctgaca

SEQ ID NO: 106292 - DNA, 25 bp, E. coli
ttgcctgatggccaagaccctgaca

SEQ ID NO: 106293 - DNA, 25 bp, E. coli
tttaagcaacgatgaacgcctggag

SEQ ID NO: 106294 - DNA, 25 bp, E. coli
tttaagcaacgaagaacgcctggag

SEQ ID NO: 106295 - DNA, 25 bp, E. coli
tgctgccacccttgaaaaactgtcg

SEQ ID NO: 106296 - DNA, 25 bp, E. coli
tgagcgcacgcatggtttaagcaac

SEQ ID NO: 106297 - DNA, 25 bp, E. coli
tgagcgcacgcaaggtttaagcaac

SEQ ID NO: 106298 - DNA, 25 bp, E. coli
tgctgccaccctagaaaaactgtcg

SEQ ID NO: 106299 - DNA, 25 bp, E. coli
cctgaagcggttaggcggcaatcca

SEQ ID NO: 106300 - DNA, 25 bp, E. coli
cctgaagcggtttggcggcaatcca

SEQ ID NO: 106301 - DNA, 25 bp, E. coli
gaaaaacgcggaataagccacgagg

SEQ ID NO: 106302 - DNA, 25 bp, E. coli
gacattttccataaaggccgccagc

SEQ ID NO: 106303 - DNA, 25 bp, E. coli
gaaaaacgcggattaagccacgagg

SEQ ID NO: 106304 - DNA, 25 bp, E. coli
gacattttccattaaggccgccagc

SEQ ID NO: 106305 - DNA, 25 bp, E. coli
gattcgctgcttcaactgcgccagg

SEQ ID NO: 106306 - DNA, 25 bp, E. coli
gattcgctgcttgaactgcgccagg

SEQ ID NO: 106307 - DNA, 25 bp, E. coli
atttcttcgaacgtgcgcttccggt

SEQ ID NO: 106308 - DNA, 25 bp, E. coli
atttcttcgaacctgcgcttccggt

SEQ ID NO: 106309 - DNA, 25 bp, E. coli
agatttcttcgaacgtgcgcttccg

SEQ ID NO: 106310 - DNA, 25 bp, E. coli
agatttcttcgatcgtgcgcttccg

SEQ ID NO: 106311 - DNA, 25 bp, E. coli
tagatttcttcgtacgtgcgcttcc

SEQ ID NO: 106312 - DNA, 25 bp, E. coli
tagatttcttcgaacgtgcgcttcc

SEQ ID NO: 106313 - DNA, 25 bp, E. coli
ttgtcgttagatatcttcgaacgtg

SEQ ID NO: 106314 - DNA, 25 bp, E. coli
ttagatttcttcgaacgtgcgcttc

SEQ ID NO: 106315 - DNA, 25 bp, E. coli
ttagatttcttccaacgtgcgcttc

SEQ ID NO: 106316 - DNA, 25 bp, E. coli
ttgtcgttagatttcttcgaacgtg

SEQ ID NO: 106317 - DNA, 25 bp, E. coli
tgtcgttagatttcttcgaacgtgc

SEQ ID NO: 106318 - DNA, 25 bp, E. coli
tgtcgttagattacttcgaacgtgc

SEQ ID NO: 106319 - DNA, 25 bp, E. coli
tcgttagatttcttcgaacgtgcgc

SEQ ID NO: 106320 - DNA, 25 bp, E. coli
tcgttagatttcatcgaacgtgcgc

SEQ ID NO: 106321 - DNA, 25 bp, E. coli
gtcgttagatttcttcgaacgtgcg

SEQ ID NO: 106322 - DNA, 25 bp, E. coli
gtcgttagatttgttcgaacgtgcg

SEQ ID NO: 106323 - DNA, 25 bp, E. coli
cgttagatttctacgaacgtgcgct

SEQ ID NO: 106324 - DNA, 25 bp, E. coli
cgttagatttcttcgaacgtgcgct

SEQ ID NO: 106325 - DNA, 25 bp, E. coli
gatttcttcgaaggtgcgcttccgg

SEQ ID NO: 106326 - DNA, 25 bp, E. coli
gttagatttcttcgaacgtgcgctt

SEQ ID NO: 106327 - DNA, 25 bp, E. coli
gttagatttcttggaacgtgcgctt

SEQ ID NO: 106328 - DNA, 25 bp, E. coli
gatttcttcgaacgtgcgcttccgg

SEQ ID NO: 106329 - DNA, 25 bp, E. coli
catcgctcagcgtctaggtctcagt

SEQ ID NO: 106330 - DNA, 25 bp, E. coli
catcgctcagcgactaggtctcagt

SEQ ID NO: 106331 - DNA, 25 bp, E. coli
taacaagcctgaagagtgccctgag

SEQ ID NO: 106332 - DNA, 25 bp, E. coli
taaaacaggcataacagcccggtgc

SEQ ID NO: 106333 - DNA, 25 bp, E. coli
taacaagcctgatgagtgccctgag

SEQ ID NO: 106334 - DNA, 25 bp, E. coli
taaaacaggcattacagcccggtgc

SEQ ID NO: 106335 - DNA, 25 bp, E. coli
agtgccctgagagtgatcccggaaa

SEQ ID NO: 106336 - DNA, 25 bp, E. coli
agtgccctgagactgatcccggaaa

SEQ ID NO: 106337 - DNA, 25 bp, E. coli
tattgcatccggaatcgcatggcca

SEQ ID NO: 106338 - DNA, 25 bp, E. coli
tattgcatccggtatcgcatggcca

SEQ ID NO: 106339 - DNA, 25 bp, E. coli
tgaagataaactgaccatccgggcc

SEQ ID NO: 106340 - DNA, 25 bp, E. coli
tgaagataaactcaccatccgggcc

SEQ ID NO: 106341 - DNA, 25 bp, E. coli
tcgccagagagctcggtatcaatga

SEQ ID NO: 106342 - DNA, 25 bp, E. coli
tcgccagagagcacggtatcaatga

SEQ ID NO: 106343 - DNA, 25 bp, E. coli
tcactccggaaaagttacgggcgct

SEQ ID NO: 106344 - DNA, 25 bp, E. coli
tcactccggaaatgttacgggcgct

SEQ ID NO: 106345 - DNA, 25 bp, E. coli
tccgcgaaatgaaaggaggtacccg

SEQ ID NO: 106346 - DNA, 25 bp, E. coli
tccgcgaaatgataggaggtacccg

SEQ ID NO: 106347 - DNA, 25 bp, E. coli
tggcgaaaagaacgacgaacctcct

SEQ ID NO: 106348 - DNA, 25 bp, E. coli
tggcgaaaagaaggacgaacctcct

SEQ ID NO: 106349 - DNA, 25 bp, E. coli
tcaaatcagcgaaggcacatggcga

SEQ ID NO: 106350 - DNA, 25 bp, E. coli
tcaaatcagcgatggcacatggcga

SEQ ID NO: 106351 - DNA, 25 bp, E. coli
aaagtgcctccgttgccgcaggtgt

SEQ ID NO: 106352 - DNA, 25 bp, E. coli
actttggtaaagcacgcccggcata

SEQ ID NO: 106353 - DNA, 25 bp, E. coli
aaagtgcctccgatgccgcaggtgt

SEQ ID NO: 106354 - DNA, 25 bp, E. coli
actttggtaaaggacgcccggcata

SEQ ID NO: 106355 - DNA, 25 bp, E. coli
tatatggcggcaaggaacgtcagcg

SEQ ID NO: 106356 - DNA, 25 bp, E. coli
tatatggcggcatggaacgtcagcg

SEQ ID NO: 106357 - DNA, 25 bp, E. coli
ttgtcggtccgaaaatgatcacccg

SEQ ID NO: 106358 - DNA, 25 bp, E. coli
ttgtcggtccgataatgatcacccg

SEQ ID NO: 106359 - DNA, 25 bp, E. coli
tgtatgcgctgaattacaaccggct

SEQ ID NO: 106360 - DNA, 25 bp, E. coli
tgtatgcgctgatttacaaccggct

SEQ ID NO: 106361 - DNA, 25 bp, E. coli
tggtggttcttaggcttacgcccgc

SEQ ID NO: 106362 - DNA, 25 bp, E. coli
tgctggatcggcaatatcgccatgg

SEQ ID NO: 106363 - DNA, 25 bp, E. coli
tgctggatcggctatatcgccatgg

SEQ ID NO: 106364 - DNA, 25 bp, E. coli
cgttcatcggtgtggaaagtgcctc

SEQ ID NO: 106365 - DNA, 25 bp, E. coli
cgttcatcggtgaggaaagtgcctc

SEQ ID NO: 106366 - DNA, 25 bp, E. coli
ggtattaaccatgacctgcgtcgtg

SEQ ID NO: 106367 - DNA, 25 bp, E. coli
gggctctcgatgctatacgccaaaa

SEQ ID NO: 106368 - DNA, 25 bp, E. coli
ggtattaaccatcacctgcgtcgtg

SEQ ID NO: 106369 - DNA, 25 bp, E. coli
gggctctcgatggtatacgccaaaa

SEQ ID NO: 106370 - DNA, 25 bp, E. coli
tggtggttcttacgcttacgcccgc

SEQ ID NO: 106371 - DNA, 25 bp, E. coli
gatgctgatgctcacaaagtgggct

SEQ ID NO: 106372 - DNA, 25 bp, E. coli
gatgctgatgctgacaaagtgggct

SEQ ID NO: 106373 - DNA, 25 bp, E. coli
caaagtgtagaaggctggcaggaca

SEQ ID NO: 106374 - DNA, 25 bp, E. coli
caaagtgtagaacgctggcaggaca

SEQ ID NO: 106375 - DNA, 25 bp, E. coli
caaaaacgaacatatggcagagctt

SEQ ID NO: 106376 - DNA, 25 bp, E. coli
caaaaacgaacaaatggcagagctt

SEQ ID NO: 106377 - DNA, 25 bp, E. coli
catgctggcgtttgccgccgaggta

SEQ ID NO: 106378 - DNA, 25 bp, E. coli
catgctggcgttagccgccgaggta

SEQ ID NO: 106379 - DNA, 25 bp, E. coli
agagcttctctcaggcgcgcttgcg

SEQ ID NO: 106380 - DNA, 25 bp, E. coli
agagcttctctctggcgcgcttgcg

SEQ ID NO: 106381 - DNA, 25 bp, E. coli
aaagcagcttttgactttgccgtcg

SEQ ID NO: 106382 - DNA, 25 bp, E. coli
aaagcagcttttcactttgccgtcg

SEQ ID NO: 106383 - DNA, 25 bp, E. coli
tttgccgtcgaacaccaaagtgtag

SEQ ID NO: 106384 - DNA, 25 bp, E. coli
tttgccgtcgaagaccaaagtgtag

SEQ ID NO: 106385 - DNA, 25 bp, E. coli
ttgtggtgagcatctggacgaaaac

SEQ ID NO: 106386 - DNA, 25 bp, E. coli
ttccgctgccgctctgagtgaacaa

SEQ ID NO: 106387 - DNA, 25 bp, E. coli
ttccgctgccgcactgagtgaacaa

SEQ ID NO: 106388 - DNA, 25 bp, E. coli
ttgtggtgagcaactggacgaaaac

SEQ ID NO: 106389 - DNA, 25 bp, E. coli
tgaggtagacgtcatttccgctgcc

SEQ ID NO: 106390 - DNA, 25 bp, E. coli
tgaggtagacgtgatttccgctgcc

SEQ ID NO: 106391 - DNA, 25 bp, E. coli
gaatttattacggtagctcgcccct

SEQ ID NO: 106392 - DNA, 25 bp, E. coli
gaatttattacgctagctcgcccct

SEQ ID NO: 106393 - DNA, 25 bp, E. coli
cgtttatcgcagtttgtggtgagca

SEQ ID NO: 106394 - DNA, 25 bp, E. coli
cgtttatcgcagattgtggtgagca

SEQ ID NO: 106395 - DNA, 25 bp, E. coli
cacgccattgaggtgttaattcgcc

SEQ ID NO: 106396 - DNA, 25 bp, E. coli
cacgccattgagctgttaattcgcc

SEQ ID NO: 106397 - DNA, 25 bp, E. coli
tgagctggattaacggccaaacgcc

SEQ ID NO: 106398 - DNA, 25 bp, E. coli
tgagctggattatcggccaaacgcc

SEQ ID NO: 106399 - DNA, 25 bp, E. coli
tgccagccactgatttatgccgacg

SEQ ID NO: 106400 - DNA, 25 bp, E. coli
tgccagccactgttttatgccgacg

SEQ ID NO: 106401 - DNA, 25 bp, E. coli
tcatgaagcggataaagagcgtcac

SEQ ID NO: 106402 - DNA, 25 bp, E. coli
tcatgaagcggaaaaagagcgtcac

SEQ ID NO: 106403 - DNA, 25 bp, E. coli
cgcgcatgttgctgaataacggtca

SEQ ID NO: 106404 - DNA, 25 bp, E. coli
cgcgcatgttgcagaataacggtca

SEQ ID NO: 106405 - DNA, 25 bp, E. coli
cgtgaagcagtaatgaaagccgtga

SEQ ID NO: 106406 - DNA, 25 bp, E. coli
cgtgaagcagtattgaaagccgtga

SEQ ID NO: 106407 - DNA, 25 bp, E. coli
cattcgtgatgttgcgcgtcaggct

SEQ ID NO: 106408 - DNA, 25 bp, E. coli
cattcgtgatgtagcgcgtcaggct

SEQ ID NO: 106409 - DNA, 25 bp, E. coli
ggtttcccgggtcctcaataacagc

SEQ ID NO: 106410 - DNA, 25 bp, E. coli
ggtttcccgggtgctcaataacagc

SEQ ID NO: 106411 - DNA, 25 bp, E. coli
ggttatctttcttccagccacggca

SEQ ID NO: 106412 - DNA, 25 bp, E. coli
ggttatctttctaccagccacggca

SEQ ID NO: 106413 - DNA, 25 bp, E. coli
tggataatctcagcggtgcccgaat

SEQ ID NO: 106414 - DNA, 25 bp, E. coli
tggataatctcaccggtgcccgaat

SEQ ID NO: 106415 - DNA, 25 bp, E. coli
ggcggcgatcacaaactcaacaaat

SEQ ID NO: 106416 - DNA, 25 bp, E. coli
ggcggcgatcactaactcaacaaat

SEQ ID NO: 106417 - DNA, 25 bp, E. coli
taaaggcctccgattgcagcaatgg

SEQ ID NO: 106418 - DNA, 25 bp, E. coli
taaaggcctccgtttgcagcaatgg

SEQ ID NO: 106419 - DNA, 25 bp, E. coli
tactgacaaatttgaatggagcgcc

SEQ ID NO: 106420 - DNA, 25 bp, E. coli
tactgacaaattagaatggagcgcc

SEQ ID NO: 106421 - DNA, 25 bp, E. coli
taacatccgcgtaaataggcctggg

SEQ ID NO: 106422 - DNA, 25 bp, E. coli
atggagcgccgatgagaaagccagc

SEQ ID NO: 106423 - DNA, 25 bp, E. coli
atggagcgccgaagagaaagccagc

SEQ ID NO: 106424 - DNA, 25 bp, E. coli
ttaccggcggttcgctctgcaacag

SEQ ID NO: 106425 - DNA, 25 bp, E. coli
ttaccggcggttggctctgcaacag

SEQ ID NO: 106426 - DNA, 25 bp, E. coli
ttgttaatgaagcaacctctggcgc

SEQ ID NO: 106427 - DNA, 25 bp, E. coli
ttgttaatgaaggaacctctggcgc

SEQ ID NO: 106428 - DNA, 25 bp, E. coli
tctggataaagtggctaccgctgcg

SEQ ID NO: 106429 - DNA, 25 bp, E. coli
tctggataaagtcgctaccgctgcg

SEQ ID NO: 106430 - DNA, 25 bp, E. coli
cgcaccggtgcgattcaggcaaaag

SEQ ID NO: 106431 - DNA, 25 bp, E. coli
cgcaccggtgcgtttcaggcaaaag

SEQ ID NO: 106432 - DNA, 25 bp, E. coli
gtccagcagtgaccggtagtaacga

SEQ ID NO: 106433 - DNA, 25 bp, E. coli
gtccagcagtgagcggtagtaacga

SEQ ID NO: 106434 - DNA, 25 bp, E. coli
taacatccgcgttaataggcctggg

SEQ ID NO: 106435 - DNA, 25 bp, E. coli
taatgtcgattttacggccaccgta

SEQ ID NO: 106436 - DNA, 25 bp, E. coli
taagcgtagagataccgcagactcg

SEQ ID NO: 106437 - DNA, 25 bp, E. coli
taatgtcgatttaacggccaccgta

SEQ ID NO: 106438 - DNA, 25 bp, E. coli
taagcgtagagaaaccgcagactcg

SEQ ID NO: 106439 - DNA, 25 bp, E. coli
caatcggatctaatgttcgcgaaca

SEQ ID NO: 106440 - DNA, 25 bp, E. coli
caagagaacttgtgaaagtagagca

SEQ ID NO: 106441 - DNA, 25 bp, E. coli
aattgaaaatcataagccagctgaa

SEQ ID NO: 106442 - DNA, 25 bp, E. coli
caatcggatctattgttcgcgaaca

SEQ ID NO: 106443 - DNA, 25 bp, E. coli
aattgaaaatcaaaagccagctgaa

SEQ ID NO: 106444 - DNA, 25 bp, E. coli
caagagaacttgagaaagtagagca

SEQ ID NO: 106445 - DNA, 25 bp, E. coli
cagtgacagggataaatacttatca

SEQ ID NO: 106446 - DNA, 25 bp, E. coli
cagtgacagggaaaaatacttatca

SEQ ID NO: 106447 - DNA, 25 bp, E. coli
tattgtgagttcagtaatacaccgc

SEQ ID NO: 106448 - DNA, 25 bp, E. coli
tattgtgagttctgtaatacaccgc

SEQ ID NO: 106449 - DNA, 25 bp, E. coli
gccagctgaaagcattaattgaatc

SEQ ID NO: 106450 - DNA, 25 bp, E. coli
gccagctgaaaggattaattgaatc

SEQ ID NO: 106451 - DNA, 25 bp, E. coli
gaattatattcattcagtgacaggg

SEQ ID NO: 106452 - DNA, 25 bp, E. coli
gaattatattcaatcagtgacaggg

SEQ ID NO: 106453 - DNA, 25 bp, E. coli
gaatagatgttgaatcacaggcgaa

SEQ ID NO: 106454 - DNA, 25 bp, E. coli
gaatagatgttgtatcacaggcgaa

SEQ ID NO: 106455 - DNA, 25 bp, E. coli
gaaagcgcaatttatttatcctgaa

SEQ ID NO: 106456 - DNA, 25 bp, E. coli
gaaagcgcaattaatttatcctgaa

SEQ ID NO: 106457 - DNA, 25 bp, E. coli
gttgatgcacttgatgataagaagc

SEQ ID NO: 106458 - DNA, 25 bp, E. coli
gttgatgcacttcatgataagaagc

SEQ ID NO: 106459 - DNA, 25 bp, E. coli
gatcaagtcattctttcaagagaac

SEQ ID NO: 106460 - DNA, 25 bp, E. coli
gatcaagtcattgtttcaagagaac

SEQ ID NO: 106461 - DNA, 25 bp, E. coli
cacatgcgagggtactgctaatgac

SEQ ID NO: 106462 - DNA, 25 bp, E. coli
caaatggttccacagccgcagataa

SEQ ID NO: 106463 - DNA, 25 bp, E. coli
cacatgcgagggaactgctaatgac

SEQ ID NO: 106464 - DNA, 25 bp, E. coli
caaatggttccagagccgcagataa

SEQ ID NO: 106465 - DNA, 25 bp, E. coli
cagcgtactctcttatgcggcaaca

SEQ ID NO: 106466 - DNA, 25 bp, E. coli
cagcgtactctcatatgcggcaaca

SEQ ID NO: 106467 - DNA, 25 bp, E. coli
taaagcaagtgcagtcgccgttgaa

SEQ ID NO: 106468 - DNA, 25 bp, E. coli
taaagcaagtgctgtcgccgttgaa

SEQ ID NO: 106469 - DNA, 25 bp, E. coli
attaaccaagcgtgccacatgcgag

SEQ ID NO: 106470 - DNA, 25 bp, E. coli
attaaccaagcgagccacatgcgag

SEQ ID NO: 106471 - DNA, 25 bp, E. coli
tattatccgatgagtgcacgcctgg

SEQ ID NO: 106472 - DNA, 25 bp, E. coli
tattatccgatgtgtgcacgcctgg

SEQ ID NO: 106473 - DNA, 25 bp, E. coli
tgcgggtatcccgaataaaaaagcg

SEQ ID NO: 106474 - DNA, 25 bp, E. coli
tcgccgttgaagactggagcactgt

SEQ ID NO: 106475 - DNA, 25 bp, E. coli
tcgccgttgaagtctggagcactgt

SEQ ID NO: 106476 - DNA, 25 bp, E. coli
tgcgggtatccccaataaaaaagcg

SEQ ID NO: 106477 - DNA, 25 bp, E. coli
tccggcaacagggagtgcaacacaa

SEQ ID NO: 106478 - DNA, 25 bp, E. coli
tccggcaacaggcagtgcaacacaa

SEQ ID NO: 106479 - DNA, 25 bp, E. coli
cgtaaacaatgtgactgcgggtaag

SEQ ID NO: 106480 - DNA, 25 bp, E. coli
cgtaaacaatgtcactgcgggtaag

SEQ ID NO: 106481 - DNA, 25 bp, E. coli
gggtaagttttctgcaccagccaca

SEQ ID NO: 106482 - DNA, 25 bp, E. coli
gggtaagttttcagcaccagccaca

SEQ ID NO: 106483 - DNA, 25 bp, E. coli
caccagaagtactgacagatgttgc

SEQ ID NO: 106484 - DNA, 25 bp, E. coli
cactgctgtgtgtagtaataaatca

SEQ ID NO: 106485 - DNA, 25 bp, E. coli
caccagaagtacagacagatgttgc

SEQ ID NO: 106486 - DNA, 25 bp, E. coli
cactgctgtgtgaagtaataaatca

SEQ ID NO: 106487 - DNA, 25 bp, E. coli
tactgacagatgttgcactgctgtg

SEQ ID NO: 106488 - DNA, 25 bp, E. coli
tactgacagatgatgcactgctgtg

SEQ ID NO: 106489 - DNA, 25 bp, E. coli
taaaatagaagcaccagaagtactg

SEQ ID NO: 106490 - DNA, 25 bp, E. coli
taaaatagaagctccagaagtactg

SEQ ID NO: 106491 - DNA, 25 bp, E. coli
tagaagcaccagtagtactgacaga

SEQ ID NO: 106492 - DNA, 25 bp, E. coli
tagaagcaccagaagtactgacaga

SEQ ID NO: 106493 - DNA, 25 bp, E. coli
tattgatcgcactcctgacagctgc

SEQ ID NO: 106494 - DNA, 25 bp, E. coli
tattgatcgcacacctgacagctgc

SEQ ID NO: 106495 - DNA, 25 bp, E. coli
ttttttattgatggcacacctgaca

SEQ ID NO: 106496 - DNA, 25 bp, E. coli
ttttttattgatcgcacacctgaca

SEQ ID NO: 106497 - DNA, 25 bp, E. coli
cctgacagctgcctctaaaatagaa

SEQ ID NO: 106498 - DNA, 25 bp, E. coli
cctgacagctgcgtctaaaatagaa

SEQ ID NO: 106499 - DNA, 25 bp, E. coli
gctgcctctaaaatagaagcaccag

SEQ ID NO: 106500 - DNA, 25 bp, E. coli
gctgcctctaaattagaagcaccag

SEQ ID NO: 106501 - DNA, 25 bp, E. coli
gaagtactgacagatgttgcactgc

SEQ ID NO: 106502 - DNA, 25 bp, E. coli
gaagtactgacacatgttgcactgc

SEQ ID NO: 106503 - DNA, 25 bp, E. coli
gtgtgtagtaataaatcagccctaa

SEQ ID NO: 106504 - DNA, 25 bp, E. coli
gtgtgtagtaattaatcagccctaa

SEQ ID NO: 106505 - DNA, 25 bp, E. coli
aattttgcgctgttcccttcggtga

SEQ ID NO: 106506 - DNA, 25 bp, E. coli
aattttgcgctgatcccttcggtga

SEQ ID NO: 106507 - DNA, 25 bp, E. coli
taaagtgaagtacctgtgcggcctc

SEQ ID NO: 106508 - DNA, 25 bp, E. coli
taaacacactgagcgcgtacttggc

SEQ ID NO: 106509 - DNA, 25 bp, E. coli
taaagtgaagtagctgtgcggcctc

SEQ ID NO: 106510 - DNA, 25 bp, E. coli
taaagacgccattgtaagccgcctg

SEQ ID NO: 106511 - DNA, 25 bp, E. coli
taaagacgccatagtaagccgcctg

SEQ ID NO: 106512 - DNA, 25 bp, E. coli
taaacacactgaccgcgtacttggc

SEQ ID NO: 106513 - DNA, 25 bp, E. coli
ttaagcgaagtcatccacgaagcag

SEQ ID NO: 106514 - DNA, 25 bp, E. coli
ttaagcgaagtcttccacgaagcag

SEQ ID NO: 106515 - DNA, 25 bp, E. coli
tgttaatgcacagggcgaaccttcg

SEQ ID NO: 106516 - DNA, 25 bp, E. coli
tgttaatgcacacggcgaaccttcg

SEQ ID NO: 106517 - DNA, 25 bp, E. coli
tgcggcctcgcatcgttagaacatg

SEQ ID NO: 106518 - DNA, 25 bp, E. coli
tgcggcctcgcaacgttagaacatg

SEQ ID NO: 106519 - DNA, 25 bp, E. coli
tcttgaagccgagaaccgtggcggt

SEQ ID NO: 106520 - DNA, 25 bp, E. coli
tcttgaagccgacaaccgtggcggt

SEQ ID NO: 106521 - DNA, 25 bp, E. coli
gaatcgggtcggatcagacgtcacg

SEQ ID NO: 106522 - DNA, 25 bp, E. coli
gaatcgggtcggttcagacgtcacg

SEQ ID NO: 106523 - DNA, 25 bp, E. coli
gatttacacccaaccggaagttgcg

SEQ ID NO: 106524 - DNA, 25 bp, E. coli
gattgcaacaggttctcagccgcgt

SEQ ID NO: 106525 - DNA, 25 bp, E. coli
gattgcaacaggatctcagccgcgt

SEQ ID NO: 106526 - DNA, 25 bp, E. coli
gatttacacccatccggaagttgcg

SEQ ID NO: 106527 - DNA, 25 bp, E. coli
caaaacgattgatggatacggcatg

SEQ ID NO: 106528 - DNA, 25 bp, E. coli
caaaacgattgaaggatacggcatg

SEQ ID NO: 106529 - DNA, 25 bp, E. coli
tgacgaagttatagcagcaggcgca

SEQ ID NO: 106530 - DNA, 25 bp, E. coli
tgacgaagttattgcagcaggcgca

SEQ ID NO: 106531 - DNA, 25 bp, E. coli
tgccgaacaaactactggcgtgtga

SEQ ID NO: 106532 - DNA, 25 bp, E. coli
tgccgaacaaacaactggcgtgtga

SEQ ID NO: 106533 - DNA, 25 bp, E. coli
ccatattcgcgccattaaagagagc

SEQ ID NO: 106534 - DNA, 25 bp, E. coli
ccatattcgcgcgattaaagagagc

SEQ ID NO: 106535 - DNA, 25 bp, E. coli
gccttagaaaaaccgggattgccat

SEQ ID NO: 106536 - DNA, 25 bp, E. coli
gccttagaaaaagcgggattgccat

SEQ ID NO: 106537 - DNA, 25 bp, E. coli
gactggcaaagatttccctctggaa

SEQ ID NO: 106538 - DNA, 25 bp, E. coli
gactggcaaagaattccctctggaa

SEQ ID NO: 106539 - DNA, 25 bp, E. coli
gtcactgaatgcgtgtataacccgc

SEQ ID NO: 106540 - DNA, 25 bp, E. coli
gatatcagtctgttacatccgggac

SEQ ID NO: 106541 - DNA, 25 bp, E. coli
gtcactgaatgcctgtataacccgc

SEQ ID NO: 106542 - DNA, 25 bp, E. coli
gatctcgccgatgagcaagcctttg

SEQ ID NO: 106543 - DNA, 25 bp, E. coli
gatatcagtctgatacatccgggac

SEQ ID NO: 106544 - DNA, 25 bp, E. coli
ggatgttaccgctaaatacgaattg

SEQ ID NO: 106545 - DNA, 25 bp, E. coli
ggatgttaccgcaaaatacgaattg

SEQ ID NO: 106546 - DNA, 25 bp, E. coli
ggcttccgccgacattttaaccaat

SEQ ID NO: 106547 - DNA, 25 bp, E. coli
ggcttccgccgagattttaaccaat

SEQ ID NO: 106548 - DNA, 25 bp, E. coli
gatctcgccgatcagcaagcctttg

SEQ ID NO: 106549 - DNA, 25 bp, E. coli
aacgcaaagtcacgccggaggattc

SEQ ID NO: 106550 - DNA, 25 bp, E. coli
caaacagatccggaaagtaaatccg

SEQ ID NO: 106551 - DNA, 25 bp, E. coli
caaacagatccgcaaagtaaatccg

SEQ ID NO: 106552 - DNA, 25 bp, E. coli
cacaaacgctggaacggcgtgacgg

SEQ ID NO: 106553 - DNA, 25 bp, E. coli
cacaaacgctggtacggcgtgacgg

SEQ ID NO: 106554 - DNA, 25 bp, E. coli
aaaaaattcgcaccagtaatcgcag

SEQ ID NO: 106555 - DNA, 25 bp, E. coli
aacgcaaagtcaggccggaggattc

SEQ ID NO: 106556 - DNA, 25 bp, E. coli
aaaaaattcgcagcagtaatcgcag

SEQ ID NO: 106557 - DNA, 25 bp, E. coli
tgttgatatcgagcacaaacgctgg

SEQ ID NO: 106558 - DNA, 25 bp, E. coli
tgttgatatcgaccacaaacgctgg

SEQ ID NO: 106559 - DNA, 25 bp, E. coli
cgcggcaatatcgttgaacgcatct

SEQ ID NO: 106560 - DNA, 25 bp, E. coli
cgcggcaatatccttgaacgcatct

SEQ ID NO: 106561 - DNA, 25 bp, E. coli
cggtgacgccgaaagatacggttga

SEQ ID NO: 106562 - DNA, 25 bp, E. coli
cggtgacgccgatagatacggttga

SEQ ID NO: 106563 - DNA, 25 bp, E. coli
gtagaaagcgcataatccctgcgtg

SEQ ID NO: 106564 - DNA, 25 bp, E. coli
gtagaaagcgcaaaatccctgcgtg

SEQ ID NO: 106565 - DNA, 25 bp, E. coli
tgcgtgacgacacctgggtaaccct

SEQ ID NO: 106566 - DNA, 25 bp, E. coli
tgcgtgacgacagctgggtaaccct

SEQ ID NO: 106567 - DNA, 25 bp, E. coli
taatcgcagtaatggccctgtgcag

SEQ ID NO: 106568 - DNA, 25 bp, E. coli
taatcgcagtaaaggccctgtgcag

SEQ ID NO: 106569 - DNA, 25 bp, E. coli
gatgccagcggtactatcaatgttg

SEQ ID NO: 106570 - DNA, 25 bp, E. coli
gatgccagcggttctatcaatgttg

SEQ ID NO: 106571 - DNA, 25 bp, E. coli
aatgcaccgctttcttagtgaaacc

SEQ ID NO: 106572 - DNA, 25 bp, E. coli
aatgcaccgcttacttagtgaaacc

SEQ ID NO: 106573 - DNA, 25 bp, E. coli
caaatcttatcggatatccaggcaa

SEQ ID NO: 106574 - DNA, 25 bp, E. coli
caaatcttatcgcatatccaggcaa

SEQ ID NO: 106575 - DNA, 25 bp, E. coli
agttttggtcattcctgtaggcaca

SEQ ID NO: 106576 - DNA, 25 bp, E. coli
agttttggtcatacctgtaggcaca

SEQ ID NO: 106577 - DNA, 25 bp, E. coli
tagtgaaacccaaacgatgctggcg

SEQ ID NO: 106578 - DNA, 25 bp, E. coli
tagtgaaacccatacgatgctggcg

SEQ ID NO: 106579 - DNA, 25 bp, E. coli
tgtgtattgaaaagcaccgcttact

SEQ ID NO: 106580 - DNA, 25 bp, E. coli
tgtgtattgaaatgcaccgcttact

SEQ ID NO: 106581 - DNA, 25 bp, E. coli
tgctaatcccaattacgaaatggac

SEQ ID NO: 106582 - DNA, 25 bp, E. coli
tgctaatcccaaatacgaaatggac

SEQ ID NO: 106583 - DNA, 25 bp, E. coli
ccaaacgatgctggcgggatattac

SEQ ID NO: 106584 - DNA, 25 bp, E. coli
ccaaacgatgctcgcgggatattac

SEQ ID NO: 106585 - DNA, 25 bp, E. coli
gacttcatgattctgaaagacgtga

SEQ ID NO: 106586 - DNA, 25 bp, E. coli
gacttcatgattgtgaaagacgtga

SEQ ID NO: 106587 - DNA, 25 bp, E. coli
cgtcaaacaagggacttcatattca

SEQ ID NO: 106588 - DNA, 25 bp, E. coli
cgtcaaacaaggcacttcatattca

SEQ ID NO: 106589 - DNA, 25 bp, E. coli
ggcaacgtcacatcaaatcttatcg

SEQ ID NO: 106590 - DNA, 25 bp, E. coli
ggcaacgtcacaacaaatcttatcg

SEQ ID NO: 106591 - DNA, 25 bp, E. coli
taatggaatataggtcaaacaaggg

SEQ ID NO: 106592 - DNA, 25 bp, E. coli
taatggaatatacgtcaaacaaggg

SEQ ID NO: 106593 - DNA, 25 bp, E. coli
cagcgccgcgatgtcacaaattggg

SEQ ID NO: 106594 - DNA, 25 bp, E. coli
cagcgccgcgatctcacaaattggg

SEQ ID NO: 106595 - DNA, 25 bp, E. coli
tactcggcggaatgtttatggcaac

SEQ ID NO: 106596 - DNA, 25 bp, E. coli
tactcggcggaaagtttatggcaac

SEQ ID NO: 106597 - DNA, 25 bp, E. coli
tatggatggactccgcaaccaaacg

SEQ ID NO: 106598 - DNA, 25 bp, E. coli
tatggatggactgcgcaaccaaacg

SEQ ID NO: 106599 - DNA, 25 bp, E. coli
tatcatcgtatttggcgcaatctgg

SEQ ID NO: 106600 - DNA, 25 bp, E. coli
tatcatcgtattaggcgcaatctgg

SEQ ID NO: 106601 - DNA, 25 bp, E. coli
tgttctttacctggaccaccgatgg

SEQ ID NO: 106602 - DNA, 25 bp, E. coli
tgttctttacctcgaccaccgatgg

SEQ ID NO: 106603 - DNA, 25 bp, E. coli
gcagtagtcggtcgccaggctttaa

SEQ ID NO: 106604 - DNA, 25 bp, E. coli
gcagtagtcggtggccaggctttaa

SEQ ID NO: 106605 - DNA, 25 bp, E. coli
cgttgaacgcacgaaacttgccgtg

SEQ ID NO: 106606 - DNA, 25 bp, E. coli
cgttgaacgcaccaaacttgccgtg

SEQ ID NO: 106607 - DNA, 25 bp, E. coli
ctgacgttgctgttactcggcggaa

SEQ ID NO: 106608 - DNA, 25 bp, E. coli
ctgacgttgctgatactcggcggaa

SEQ ID NO: 106609 - DNA, 25 bp, E. coli
taacggattaatcgtagccatcgcc

SEQ ID NO: 106610 - DNA, 25 bp, E. coli
taacggattaatggtagccatcgcc

SEQ ID NO: 106611 - DNA, 25 bp, E. coli
gatggtgcctacataagcgcccgta

SEQ ID NO: 106612 - DNA, 25 bp, E. coli
gatggatgtaccgaccttctggcag

SEQ ID NO: 106613 - DNA, 25 bp, E. coli
gatggtgcctacttaagcgcccgta

SEQ ID NO: 106614 - DNA, 25 bp, E. coli
gatggatgtacccaccttctggcag

SEQ ID NO: 106615 - DNA, 25 bp, E. coli
taatgggttggtcaaaggagtcaat

SEQ ID NO: 106616 - DNA, 25 bp, E. coli
taatgggttggtgaaaggagtcaat

SEQ ID NO: 106617 - DNA, 25 bp, E. coli
tagaaggtgctgtattagaatataa

SEQ ID NO: 106618 - DNA, 25 bp, E. coli
tagaaggtgctgaattagaatataa

SEQ ID NO: 106619 - DNA, 25 bp, E. coli
tcgcaacaagagtaggatgtcgtcc

SEQ ID NO: 106620 - DNA, 25 bp, E. coli
tcgcaacaagagaaggatgtcgtcc

SEQ ID NO: 106621 - DNA, 25 bp, E. coli
tcagtaagtaaaataattagtggag

SEQ ID NO: 106622 - DNA, 25 bp, E. coli
tcagtaagtaaattaattagtggag

SEQ ID NO: 106623 - DNA, 25 bp, E. coli
cctaaaggtctaaaaatcagtaagt

SEQ ID NO: 106624 - DNA, 25 bp, E. coli
cctaaaggtctataaatcagtaagt

SEQ ID NO: 106625 - DNA, 25 bp, E. coli
gaattatttaatgggttggtcaaag

SEQ ID NO: 106626 - DNA, 25 bp, E. coli
gaattatttaatcggttggtcaaag

SEQ ID NO: 106627 - DNA, 25 bp, E. coli
ctataaatatatatcgcaacaagag

SEQ ID NO: 106628 - DNA, 25 bp, E. coli
ctataaatatatttcgcaacaagag

SEQ ID NO: 106629 - DNA, 25 bp, E. coli
ggatgtcgtccttaaggtctataaa

SEQ ID NO: 106630 - DNA, 25 bp, E. coli
ggatgtcgtcctaaaggtctataaa

SEQ ID NO: 106631 - DNA, 25 bp, E. coli
tggtcaaaggagtcaataatgtgtg

SEQ ID NO: 106632 - DNA, 25 bp, E. coli
tggtcaaaggagacaataatgtgtg

SEQ ID NO: 106633 - DNA, 25 bp, E. coli
taatagaaggaatgatttaaggaat

SEQ ID NO: 106634 - DNA, 25 bp, E. coli
tcaataatgtgtgatagatacaact

SEQ ID NO: 106635 - DNA, 25 bp, E. coli
tcaataatgtgtcatagatacaact

SEQ ID NO: 106636 - DNA, 25 bp, E. coli
taatagaaggaaagatttaaggaat

SEQ ID NO: 106637 - DNA, 25 bp, E. coli
caggttaacgcgtcctatggtccgc

SEQ ID NO: 106638 - DNA, 25 bp, E. coli
catcggcgattgttatcgtgtctaa

SEQ ID NO: 106639 - DNA, 25 bp, E. coli
caggttaacgcgacctatggtccgc

SEQ ID NO: 106640 - DNA, 25 bp, E. coli
catcggcgattgatatcgtgtctaa

SEQ ID NO: 106641 - DNA, 25 bp, E. coli
atgatgatgatattgaagtaccacc

SEQ ID NO: 106642 - DNA, 25 bp, E. coli
atgatgatgataatgaagtaccacc

SEQ ID NO: 106643 - DNA, 25 bp, E. coli
aacaataaagagatccagcagctgg

SEQ ID NO: 106644 - DNA, 25 bp, E. coli
aacaataaagagttccagcagctgg

SEQ ID NO: 106645 - DNA, 25 bp, E. coli
aaaggcacggtagtcaatttcgttg

SEQ ID NO: 106646 - DNA, 25 bp, E. coli
aaaggcacggtactcaatttcgttg

SEQ ID NO: 106647 - DNA, 25 bp, E. coli
tatggtccgctgttgcatccgggca

SEQ ID NO: 106648 - DNA, 25 bp, E. coli
tatgggcgatcagctatctacggca

SEQ ID NO: 106649 - DNA, 25 bp, E. coli
tatgggcgatcacctatctacggca

SEQ ID NO: 106650 - DNA, 25 bp, E. coli
tatggtccgctgatgcatccgggca

SEQ ID NO: 106651 - DNA, 25 bp, E. coli
gctatctacggcaaaaggcacggta

SEQ ID NO: 106652 - DNA, 25 bp, E. coli
gctatctacggctaaaggcacggta

SEQ ID NO: 106653 - DNA, 25 bp, E. coli
ctttgtgtcaaaggaccgcaggtga

SEQ ID NO: 106654 - DNA, 25 bp, E. coli
ctttgtgtcaaacgaccgcaggtga

SEQ ID NO: 106655 - DNA, 25 bp, E. coli
gttccagcagctggatttctccagt

SEQ ID NO: 106656 - DNA, 25 bp, E. coli
gttccagcagctcgatttctccagt

SEQ ID NO: 106657 - DNA, 25 bp, E. coli
ggtaaaagagtttgcgaaatatccg

SEQ ID NO: 106658 - DNA, 25 bp, E. coli
ggtaaaagagttagcgaaatatccg

SEQ ID NO: 106659 - DNA, 25 bp, E. coli
aagaatcctttgatgcaagtgatgc

SEQ ID NO: 106660 - DNA, 25 bp, E. coli
aatcctttgttggaagtgatgctta

SEQ ID NO: 106661 - DNA, 25 bp, E. coli
aagaatcctttgttgcaagtgatgc

SEQ ID NO: 106662 - DNA, 25 bp, E. coli
aatcctttgttgcaagtgatgctta

SEQ ID NO: 106663 - DNA, 25 bp, E. coli
cactttgattcataaaaagaatcct

SEQ ID NO: 106664 - DNA, 25 bp, E. coli
cactttgattcaaaaaaagaatcct

SEQ ID NO: 106665 - DNA, 25 bp, E. coli
atcctttgttgctagtgatgcttaa

SEQ ID NO: 106666 - DNA, 25 bp, E. coli
atcctttgttgcaagtgatgcttaa

SEQ ID NO: 106667 - DNA, 25 bp, E. coli
agaatcctttgtagcaagtgatgct

SEQ ID NO: 106668 - DNA, 25 bp, E. coli
agaatcctttgttgcaagtgatgct

SEQ ID NO: 106669 - DNA, 25 bp, E. coli
aaagaatcctttcttgcaagtgatg

SEQ ID NO: 106670 - DNA, 25 bp, E. coli
aaaaagaatcctatgttgcaagtga

SEQ ID NO: 106671 - DNA, 25 bp, E. coli
aaaaagaatcctttgttgcaagtga

SEQ ID NO: 106672 - DNA, 25 bp, E. coli
aaaagaatccttagttgcaagtgat

SEQ ID NO: 106673 - DNA, 25 bp, E. coli
aaagaatcctttgttgcaagtgatg

SEQ ID NO: 106674 - DNA, 25 bp, E. coli
aaaaaagaatccattgttgcaagtg

SEQ ID NO: 106675 - DNA, 25 bp, E. coli
aaaaaagaatcctttgttgcaagtg

SEQ ID NO: 106676 - DNA, 25 bp, E. coli
aaaagaatcctttgttgcaagtgat

SEQ ID NO: 106677 - DNA, 25 bp, E. coli
gaatcctttgttgcaagtgatgctt

SEQ ID NO: 106678 - DNA, 25 bp, E. coli
gaatcctttgttccaagtgatgctt

SEQ ID NO: 106679 - DNA, 25 bp, E. coli
tcactttgattctaaaaaagaatcc

SEQ ID NO: 106680 - DNA, 25 bp, E. coli
tcactttgattcaaaaaaagaatcc

SEQ ID NO: 106681 - DNA, 25 bp, E. coli
tacgggcgtaattctgcttatactg

SEQ ID NO: 106682 - DNA, 25 bp, E. coli
tatgaaggtgttaccaatcgcttcg

SEQ ID NO: 106683 - DNA, 25 bp, E. coli
tacgggcgtaatactgcttatactg

SEQ ID NO: 106684 - DNA, 25 bp, E. coli
tagtggcgttatctgtctgcttccg

SEQ ID NO: 106685 - DNA, 25 bp, E. coli
tagtggcgttatgtgtctgcttccg

SEQ ID NO: 106686 - DNA, 25 bp, E. coli
tatgaaggtgtttccaatcgcttcg

SEQ ID NO: 106687 - DNA, 25 bp, E. coli
tctggaagggtggaaaaacatcttt

SEQ ID NO: 106688 - DNA, 25 bp, E. coli
tctggaagggtgcaaaaacatcttt

SEQ ID NO: 106689 - DNA, 25 bp, E. coli
gcgctgcccgtgacatttattttaa

SEQ ID NO: 106690 - DNA, 25 bp, E. coli
gcgctgcccgtgtcatttattttaa

SEQ ID NO: 106691 - DNA, 25 bp, E. coli
gcttatactgtggtgcctgccgtca

SEQ ID NO: 106692 - DNA, 25 bp, E. coli
gcgatagcgttagccgtcagaagga

SEQ ID NO: 106693 - DNA, 25 bp, E. coli
gcgatagcgttacccgtcagaagga

SEQ ID NO: 106694 - DNA, 25 bp, E. coli
gcttatactgtgctgcctgccgtca

SEQ ID NO: 106695 - DNA, 25 bp, E. coli
cgtcaaagtcactagaccaggcata

SEQ ID NO: 106696 - DNA, 25 bp, E. coli
cgtcaaagtcacaagaccaggcata

SEQ ID NO: 106697 - DNA, 25 bp, E. coli
gttaccattgccctgttgatccctg

SEQ ID NO: 106698 - DNA, 25 bp, E. coli
gatttttgccgttccggcgatagcg

SEQ ID NO: 106699 - DNA, 25 bp, E. coli
gttaccattgccgtgttgatccctg

SEQ ID NO: 106700 - DNA, 25 bp, E. coli
gatttttgccgtaccggcgatagcg

SEQ ID NO: 106701 - DNA, 25 bp, E. coli
tcagaaggatgcacgatatcggata

SEQ ID NO: 106702 - DNA, 25 bp, E. coli
tcagaaggatgctcgatatcggata

SEQ ID NO: 106703 - DNA, 25 bp, E. coli
catgaactggtcgatccgaaaggta

SEQ ID NO: 106704 - DNA, 25 bp, E. coli
catagccgggtgatattcgatcatc

SEQ ID NO: 106705 - DNA, 25 bp, E. coli
catgaactggtccatccgaaaggta

SEQ ID NO: 106706 - DNA, 25 bp, E. coli
catagccgggtgttattcgatcatc

SEQ ID NO: 106707 - DNA, 25 bp, E. coli
tactggttacgaggactggaaaacg

SEQ ID NO: 106708 - DNA, 25 bp, E. coli
tactggttacgacgactggaaaacg

SEQ ID NO: 106709 - DNA, 25 bp, E. coli
aaaatttgtcggctaaatggcgcga

SEQ ID NO: 106710 - DNA, 25 bp, E. coli
aaaatttgtcgggtaaatggcgcga

SEQ ID NO: 106711 - DNA, 25 bp, E. coli
tttgaaaaacagttggagagcgcgt

SEQ ID NO: 106712 - DNA, 25 bp, E. coli
tttgaaaaacagatggagagcgcgt

SEQ ID NO: 106713 - DNA, 25 bp, E. coli
tgttgtgccgcaaaaaagccgactg

SEQ ID NO: 106714 - DNA, 25 bp, E. coli
tgttgtgccgcataaaagccgactg

SEQ ID NO: 106715 - DNA, 25 bp, E. coli
gaatatcggtctaggacagtgcgaa

SEQ ID NO: 106716 - DNA, 25 bp, E. coli
gaatatcggtcttggacagtgcgaa

SEQ ID NO: 106717 - DNA, 25 bp, E. coli
gaaattggtttcagtgacctcgcac

SEQ ID NO: 106718 - DNA, 25 bp, E. coli
gaaattggtttctgtgacctcgcac

SEQ ID NO: 106719 - DNA, 25 bp, E. coli
cgatgaaattatccgcctggacgca

SEQ ID NO: 106720 - DNA, 25 bp, E. coli
cgatgaaattatgcgcctggacgca

SEQ ID NO: 106721 - DNA, 25 bp, E. coli
cgttacagtgactgacctttcgcag

SEQ ID NO: 106722 - DNA, 25 bp, E. coli
cgttacagtgacagacctttcgcag

SEQ ID NO: 106723 - DNA, 25 bp, E. coli
gggaatctcactttaacgcgctata

SEQ ID NO: 106724 - DNA, 25 bp, E. coli
gggaatctcactataacgcgctata

SEQ ID NO: 106725 - DNA, 25 bp, E. coli
aatctgctggctgacggcgacagcg

SEQ ID NO: 106726 - DNA, 25 bp, E. coli
aatctgctggctcacggcgacagcg

SEQ ID NO: 106727 - DNA, 25 bp, E. coli
caaagtgaaaaagatccgcctggtt

SEQ ID NO: 106728 - DNA, 25 bp, E. coli
caaagtgaaaaacatccgcctggtt

SEQ ID NO: 106729 - DNA, 25 bp, E. coli
tacgaatggaacgacgcagaacctg

SEQ ID NO: 106730 - DNA, 25 bp, E. coli
taaagatctgaaggtgaaaggtagc

SEQ ID NO: 106731 - DNA, 25 bp, E. coli
taaagatctgaacgtgaaaggtagc

SEQ ID NO: 106732 - DNA, 25 bp, E. coli
tacgaatggaaccacgcagaacctg

SEQ ID NO: 106733 - DNA, 25 bp, E. coli
tggtccgatgaatctgaaatctgag

SEQ ID NO: 106734 - DNA, 25 bp, E. coli
tgaaggcgaccaaaacatcgattgc

SEQ ID NO: 106735 - DNA, 25 bp, E. coli
tgaaggcgaccataacatcgattgc

SEQ ID NO: 106736 - DNA, 25 bp, E. coli
tcgatgctgaaaattggcaccaaag

SEQ ID NO: 106737 - DNA, 25 bp, E. coli
tcgatgctgaaatttggcaccaaag

SEQ ID NO: 106738 - DNA, 25 bp, E. coli
tctgcccggaatctgcctacgaatg

SEQ ID NO: 106739 - DNA, 25 bp, E. coli
tctgcccggaatgtgcctacgaatg

SEQ ID NO: 106740 - DNA, 25 bp, E. coli
cctgcacaggaaagcgacgagctga

SEQ ID NO: 106741 - DNA, 25 bp, E. coli
cctgcacaggaatgcgacgagctga

SEQ ID NO: 106742 - DNA, 25 bp, E. coli
gaaaggtagctcatcgatgctgaaa

SEQ ID NO: 106743 - DNA, 25 bp, E. coli
gaaaggtagctcttcgatgctgaaa

SEQ ID NO: 106744 - DNA, 25 bp, E. coli
gataacggcatgaacatctgcccgg

SEQ ID NO: 106745 - DNA, 25 bp, E. coli
gataacggcatgtacatctgcccgg

SEQ ID NO: 106746 - DNA, 25 bp, E. coli
tggtccgatgaaactgaaatctgag

SEQ ID NO: 106747 - DNA, 25 bp, E. coli
cagcattgagttaacggagtccggg

SEQ ID NO: 106748 - DNA, 25 bp, E. coli
cagcattgagtttacggagtccggg

SEQ ID NO: 106749 - DNA, 25 bp, E. coli
cagtaaagccgctgaagagttgggt

SEQ ID NO: 106750 - DNA, 25 bp, E. coli
cagtaaagccgcagaagagttgggt

SEQ ID NO: 106751 - DNA, 25 bp, E. coli
tactatttcgcacggcatagaagcg

SEQ ID NO: 106752 - DNA, 25 bp, E. coli
tactatttcgcagggcatagaagcg

SEQ ID NO: 106753 - DNA, 25 bp, E. coli
tataacggcgtcagggatgcgatta

SEQ ID NO: 106754 - DNA, 25 bp, E. coli
tataacggcgtctgggatgcgatta

SEQ ID NO: 106755 - DNA, 25 bp, E. coli
ttttttccgcaaagctaccgacctg

SEQ ID NO: 106756 - DNA, 25 bp, E. coli
ttttttccgcaatgctaccgacctg

SEQ ID NO: 106757 - DNA, 25 bp, E. coli
tgggtttaaccagttccgccattag

SEQ ID NO: 106758 - DNA, 25 bp, E. coli
tgggtttaaccacttccgccattag

SEQ ID NO: 106759 - DNA, 25 bp, E. coli
tgttggcatttagtaccgctgcgcg

SEQ ID NO: 106760 - DNA, 25 bp, E. coli
tgttggcatttactaccgctgcgcg

SEQ ID NO: 106761 - DNA, 25 bp, E. coli
gcaggagtcaattctggtgccagat

SEQ ID NO: 106762 - DNA, 25 bp, E. coli
gcaggagtcaatactggtgccagat

SEQ ID NO: 106763 - DNA, 25 bp, E. coli
gaaaaagcagtttcctacctgccag

SEQ ID NO: 106764 - DNA, 25 bp, E. coli
gaaaaagcagttacctacctgccag

SEQ ID NO: 106765 - DNA, 25 bp, E. coli
gtcaccaccgaagtgtataacggcg

SEQ ID NO: 106766 - DNA, 25 bp, E. coli
gtcaccaccgaactgtataacggcg

SEQ ID NO: 106767 - DNA, 25 bp, E. coli
gaggacaccgcggatacgattaata

SEQ ID NO: 106768 - DNA, 25 bp, E. coli
gaggacaccgcgcatacgattaata

SEQ ID NO: 106769 - DNA, 25 bp, E. coli
acggcattgatggagcgttgaaatc

SEQ ID NO: 106770 - DNA, 25 bp, E. coli
acggcattgatgcagcgttgaaatc

SEQ ID NO: 106771 - DNA, 25 bp, E. coli
ttgattcgaccgacggtaaccgcca

SEQ ID NO: 106772 - DNA, 25 bp, E. coli
ttcgaccgtcggaaaccgccatgcg

SEQ ID NO: 106773 - DNA, 25 bp, E. coli
ttcgaccgtcggtaaccgccatgcg

SEQ ID NO: 106774 - DNA, 25 bp, E. coli
ttgattcgaccgtcggtaaccgcca

SEQ ID NO: 106775 - DNA, 25 bp, E. coli
tcggtaaccgccatgcgggtgattg

SEQ ID NO: 106776 - DNA, 25 bp, E. coli
tcggtaaccgccttgcgggtgattg

SEQ ID NO: 106777 - DNA, 25 bp, E. coli
cctacggcattgttgcagcgttgaa

SEQ ID NO: 106778 - DNA, 25 bp, E. coli
cctacggcattgatgcagcgttgaa

SEQ ID NO: 106779 - DNA, 25 bp, E. coli
gaagtggtatatggtcgctcgctgt

SEQ ID NO: 106780 - DNA, 25 bp, E. coli
gaagtggtatatcgtcgctcgctgt

SEQ ID NO: 106781 - DNA, 25 bp, E. coli
cattgatgcagcgttgaaatctgcc

SEQ ID NO: 106782 - DNA, 25 bp, E. coli
cattgatgcagccttgaaatctgcc

SEQ ID NO: 106783 - DNA, 25 bp, E. coli
gtatatggtcgctcgctgtatgcgg

SEQ ID NO: 106784 - DNA, 25 bp, E. coli
ggtaaccgccatccgggtgattgcc

SEQ ID NO: 106785 - DNA, 25 bp, E. coli
gtatatggtcgcacgctgtatgcgg

SEQ ID NO: 106786 - DNA, 25 bp, E. coli
ggtaaccgccatgcgggtgattgcc

SEQ ID NO: 106787 - DNA, 25 bp, E. coli
gatgcagcgttgaaatctgccgacg

SEQ ID NO: 106788 - DNA, 25 bp, E. coli
gatgcagcgttgtaatctgccgacg

SEQ ID NO: 106789 - DNA, 25 bp, E. coli
gacctacggcattgatgcagcgttg

SEQ ID NO: 106790 - DNA, 25 bp, E. coli
gacctacggcatagatgcagcgttg

SEQ ID NO: 106791 - DNA, 25 bp, E. coli
taccaggtggagaaccatttacggc

SEQ ID NO: 106792 - DNA, 25 bp, E. coli
taccaggtggagtaccatttacggc

SEQ ID NO: 106793 - DNA, 25 bp, E. coli
tttgtggaagggtaaccgctgatgc

SEQ ID NO: 106794 - DNA, 25 bp, E. coli
tttgtggaagggaaaccgctgatgc

SEQ ID NO: 106795 - DNA, 25 bp, E. coli
ttttgaaatcatgcctgcgcctccg

SEQ ID NO: 106796 - DNA, 25 bp, E. coli
ttttgaaatcatccctgcgcctccg

SEQ ID NO: 106797 - DNA, 25 bp, E. coli
tgcggatcacctcgttgtcatatag

SEQ ID NO: 106798 - DNA, 25 bp, E. coli
tgcggatcacctggttgtcatatag

SEQ ID NO: 106799 - DNA, 25 bp, E. coli
tcagaaatgccagcgaataccaggt

SEQ ID NO: 106800 - DNA, 25 bp, E. coli
tcagaaatgccaccgaataccaggt

SEQ ID NO: 106801 - DNA, 25 bp, E. coli
tctacaaaagcattgcggagcggtt

SEQ ID NO: 106802 - DNA, 25 bp, E. coli
tctacaaaagcaatgcggagcggtt

SEQ ID NO: 106803 - DNA, 25 bp, E. coli
ccgatagactgcaggcgcggcaaat

SEQ ID NO: 106804 - DNA, 25 bp, E. coli
ccgatagactgctggcgcggcaaat

SEQ ID NO: 106805 - DNA, 25 bp, E. coli
gctatatgccggtaaaactgttccg

SEQ ID NO: 106806 - DNA, 25 bp, E. coli
gctatatgccggaaaaactgttccg

SEQ ID NO: 106807 - DNA, 25 bp, E. coli
cgctgcaacatctggaagggtcgaa

SEQ ID NO: 106808 - DNA, 25 bp, E. coli
cgctgcaacatcaggaagggtcgaa

SEQ ID NO: 106809 - DNA, 25 bp, E. coli
ggcaaatgaaggaagcggaacacac

SEQ ID NO: 106810 - DNA, 25 bp, E. coli
ggcaaatgaaggtagcggaacacac

SEQ ID NO: 106811 - DNA, 25 bp, E. coli
gagtttgcggtatcgcggatgacca

SEQ ID NO: 106812 - DNA, 25 bp, E. coli
gagtttgcggtaacgcggatgacca

SEQ ID NO: 106813 - DNA, 25 bp, E. coli
aattccaggcaactgttatccggtc

SEQ ID NO: 106814 - DNA, 25 bp, E. coli
aattccaggcaagtgttatccggtc

SEQ ID NO: 106815 - DNA, 25 bp, E. coli
caatgcaggaatctatggcagcagc

SEQ ID NO: 106816 - DNA, 25 bp, E. coli
caatgcaggaatgtatggcagcagc

SEQ ID NO: 106817 - DNA, 25 bp, E. coli
cagaaaattccacgcaactgttatc

SEQ ID NO: 106818 - DNA, 25 bp, E. coli
cacagaacaatgcaggaatgtatgg

SEQ ID NO: 106819 - DNA, 25 bp, E. coli
cagaaaattccaggcaactgttatc

SEQ ID NO: 106820 - DNA, 25 bp, E. coli
cacagaacaatggaggaatgtatgg

SEQ ID NO: 106821 - DNA, 25 bp, E. coli
caggcaactgttttccggtcgataa

SEQ ID NO: 106822 - DNA, 25 bp, E. coli
caggcaactgttatccggtcgataa

SEQ ID NO: 106823 - DNA, 25 bp, E. coli
atgtatggcagctgcaaccgaacag

SEQ ID NO: 106824 - DNA, 25 bp, E. coli
atgtatggcagcagcaaccgaacag

SEQ ID NO: 106825 - DNA, 25 bp, E. coli
tatttgcacttaatctgacggtttt

SEQ ID NO: 106826 - DNA, 25 bp, E. coli
tatttgcacttattctgacggtttt

SEQ ID NO: 106827 - DNA, 25 bp, E. coli
tgtgcacaatgattccagtatttgc

SEQ ID NO: 106828 - DNA, 25 bp, E. coli
tgtgcacaatgaatccagtatttgc

SEQ ID NO: 106829 - DNA, 25 bp, E. coli
ccagtatttgcacttattctgacgg

SEQ ID NO: 106830 - DNA, 25 bp, E. coli
ccagtatttgcagttattctgacgg

SEQ ID NO: 106831 - DNA, 25 bp, E. coli
gcaggaatgtatcgcagcagcaacc

SEQ ID NO: 106832 - DNA, 25 bp, E. coli
gcaggaatgtatggcagcagcaacc

SEQ ID NO: 106833 - DNA, 25 bp, E. coli
gaatgtatggcaccagcaaccgaac

SEQ ID NO: 106834 - DNA, 25 bp, E. coli
gaatgtatggcagcagcaaccgaac

SEQ ID NO: 106835 - DNA, 25 bp, E. coli
cagcattaacgacgtacaccgtggc

SEQ ID NO: 106836 - DNA, 25 bp, E. coli
cagcattaacgaggtacaccgtggc

SEQ ID NO: 106837 - DNA, 25 bp, E. coli
gcgtgaagttaggaacccttccgcc

SEQ ID NO: 106838 - DNA, 25 bp, E. coli
gcgtgaagttagcaacccttccgcc

SEQ ID NO: 106839 - DNA, 25 bp, E. coli
tgaaggtgacggaaaccagcgccga

SEQ ID NO: 106840 - DNA, 25 bp, E. coli
tgaaggtgacggtaaccagcgccga

SEQ ID NO: 106841 - DNA, 25 bp, E. coli
tcctgcgggcggcacagcattaacg

SEQ ID NO: 106842 - DNA, 25 bp, E. coli
tcctgcgggcgggacagcattaacg

SEQ ID NO: 106843 - DNA, 25 bp, E. coli
cgccatcttttttagccgcggtgat

SEQ ID NO: 106844 - DNA, 25 bp, E. coli
cgccatctttttaagccgcggtgat

SEQ ID NO: 106845 - DNA, 25 bp, E. coli
cgtatctcagaagcggcgaaacatg

SEQ ID NO: 106846 - DNA, 25 bp, E. coli
cgtatctcagaaccggcgaaacatg

SEQ ID NO: 106847 - DNA, 25 bp, E. coli
gttagcaaccctaccgccatctttt

SEQ ID NO: 106848 - DNA, 25 bp, E. coli
gttagcaacccttccgccatctttt

SEQ ID NO: 106849 - DNA, 25 bp, E. coli
ggtggtgccgggaagcgccattctg

SEQ ID NO: 106850 - DNA, 25 bp, E. coli
ggtggtgccgggtagcgccattctg

SEQ ID NO: 106851 - DNA, 25 bp, E. coli
ggcggcacagcaataacgaggtaca

SEQ ID NO: 106852 - DNA, 25 bp, E. coli
ggcggcacagcattaacgaggtaca

SEQ ID NO: 106853 - DNA, 25 bp, E. coli
taacgaggtacagcgtggcaaaagc

SEQ ID NO: 106854 - DNA, 25 bp, E. coli
taacgaggtacaccgtggcaaaagc

SEQ ID NO: 106855 - DNA, 25 bp, E. coli
gaggtacaccgtggcaaaagctcca

SEQ ID NO: 106856 - DNA, 25 bp, E. coli
gaggtacaccgtcgcaaaagctcca

SEQ ID NO: 106857 - DNA, 25 bp, E. coli
atgcggtgctcactgcgaaaggaca

SEQ ID NO: 106858 - DNA, 25 bp, E. coli
atgcggtgctcagtgcgaaaggaca

SEQ ID NO: 106859 - DNA, 25 bp, E. coli
ttttgcaggttggacgctgcgcgat

SEQ ID NO: 106860 - DNA, 25 bp, E. coli
ttttgcaggttgcacgctgcgcgat

SEQ ID NO: 106861 - DNA, 25 bp, E. coli
tgtccaatagcgaagagtcttcacc

SEQ ID NO: 106862 - DNA, 25 bp, E. coli
tgtccaatagcgtagagtcttcacc

SEQ ID NO: 106863 - DNA, 25 bp, E. coli
tgccaccgattagcgttttgcaggt

SEQ ID NO: 106864 - DNA, 25 bp, E. coli
tgccaccgattaccgttttgcaggt

SEQ ID NO: 106865 - DNA, 25 bp, E. coli
tcctggtggcaactgtccaatagcg

SEQ ID NO: 106866 - DNA, 25 bp, E. coli
tcctggtggcaagtgtccaatagcg

SEQ ID NO: 106867 - DNA, 25 bp, E. coli
tcttatacgcaataatcctggtggc

SEQ ID NO: 106868 - DNA, 25 bp, E. coli
tcttatacgcaaaaatcctggtggc

SEQ ID NO: 106869 - DNA, 25 bp, E. coli
gctcagtgcgaatggacagtacaac

SEQ ID NO: 106870 - DNA, 25 bp, E. coli
gctcagtgcgaaaggacagtacaac

SEQ ID NO: 106871 - DNA, 25 bp, E. coli
cgaactcggtgttgggtgcgtctta

SEQ ID NO: 106872 - DNA, 25 bp, E. coli
cgaactcggtgtagggtgcgtctta

SEQ ID NO: 106873 - DNA, 25 bp, E. coli
ggtataaccacgtctctaacgggcg

SEQ ID NO: 106874 - DNA, 25 bp, E. coli
ggtataaccacgactctaacgggcg

SEQ ID NO: 106875 - DNA, 25 bp, E. coli
ggtaatactgacgataacccggata

SEQ ID NO: 106876 - DNA, 25 bp, E. coli
ggtaatactgaccataacccggata

SEQ ID NO: 106877 - DNA, 25 bp, E. coli
tggcgtgggattttaggcccgaact

SEQ ID NO: 106878 - DNA, 25 bp, E. coli
tggcgtgggattataggcccgaact

SEQ ID NO: 106879 - DNA, 25 bp, E. coli
aatattccatgtcgtggcgtgagcc

SEQ ID NO: 106880 - DNA, 25 bp, E. coli
aatattccatgtggtggcgtgagcc

SEQ ID NO: 106881 - DNA, 25 bp, E. coli
tatctgggtaaaaccggactcgaag

SEQ ID NO: 106882 - DNA, 25 bp, E. coli
tatctgaatgaagaagtggtcggcg

SEQ ID NO: 106883 - DNA, 25 bp, E. coli
tatctgggtaaatccggactcgaag

SEQ ID NO: 106884 - DNA, 25 bp, E. coli
tatctgaatgaacaagtggtcggcg

SEQ ID NO: 106885 - DNA, 25 bp, E. coli
tgcaccggctggaagaaaacctggc

SEQ ID NO: 106886 - DNA, 25 bp, E. coli
tgaagcaggagcacaaaccattcgt

SEQ ID NO: 106887 - DNA, 25 bp, E. coli
tgaagcaggagctcaaaccattcgt

SEQ ID NO: 106888 - DNA, 25 bp, E. coli
tgcaccggctggtagaaaacctggc

SEQ ID NO: 106889 - DNA, 25 bp, E. coli
tcatcgcagaaggtaaggtcaaaca

SEQ ID NO: 106890 - DNA, 25 bp, E. coli
tcatcgcagaagctaaggtcaaaca

SEQ ID NO: 106891 - DNA, 25 bp, E. coli
gcagattttaaacagccgtccggaa

SEQ ID NO: 106892 - DNA, 25 bp, E. coli
gcagattttaaagagccgtccggaa

SEQ ID NO: 106893 - DNA, 25 bp, E. coli
gcaaagatgattaccgcagcaccgt

SEQ ID NO: 106894 - DNA, 25 bp, E. coli
gcaaagatgatttccgcagcaccgt

SEQ ID NO: 106895 - DNA, 25 bp, E. coli
gaacggtgaaagacctcatcgcaga

SEQ ID NO: 106896 - DNA, 25 bp, E. coli
gaacggtgaaagtcctcatcgcaga

SEQ ID NO: 106897 - DNA, 25 bp, E. coli
gataccgccgaagtgtatggtccgt

SEQ ID NO: 106898 - DNA, 25 bp, E. coli
gataccgccgaactgtatggtccgt

SEQ ID NO: 106899 - DNA, 25 bp, E. coli
taacgtctgcacaaatcgcactggc

SEQ ID NO: 106900 - DNA, 25 bp, E. coli
taacgtctgcactaatcgcactggc

SEQ ID NO: 106901 - DNA, 25 bp, E. coli
gggttcctttgagaacaacgacgag

SEQ ID NO: 106902 - DNA, 25 bp, E. coli
gggttcctttgacaacaacgacgag

SEQ ID NO: 106903 - DNA, 25 bp, E. coli
aaagggaagtctgtcgacgaagcgc

SEQ ID NO: 106904 - DNA, 25 bp, E. coli
aactgccgccggagaaaattcactg

SEQ ID NO: 106905 - DNA, 25 bp, E. coli
aactgccgccggtgaaaattcactg

SEQ ID NO: 106906 - DNA, 25 bp, E. coli
aaagggaagtctctcgacgaagcgc

SEQ ID NO: 106907 - DNA, 25 bp, E. coli
tattctggcagatgacgcgatcaaa

SEQ ID NO: 106908 - DNA, 25 bp, E. coli
tattctggcagaagacgcgatcaaa

SEQ ID NO: 106909 - DNA, 25 bp, E. coli
ttatcgaccatttcgagaatccgcg

SEQ ID NO: 106910 - DNA, 25 bp, E. coli
ttatcgaccattacgagaatccgcg

SEQ ID NO: 106911 - DNA, 25 bp, E. coli
tgaaggtatcatagaagacgcgcgt

SEQ ID NO: 106912 - DNA, 25 bp, E. coli
tgaaggtatcattgaagacgcgcgt

SEQ ID NO: 106913 - DNA, 25 bp, E. coli
tgctgaagaacttgaactgccgccg

SEQ ID NO: 106914 - DNA, 25 bp, E. coli
tgctgaagaactagaactgccgccg

SEQ ID NO: 106915 - DNA, 25 bp, E. coli
ccagctccctggtcaccgaatgggt

SEQ ID NO: 106916 - DNA, 25 bp, E. coli
gccgccattgcgcactataaaagca

SEQ ID NO: 106917 - DNA, 25 bp, E. coli
gccgccattgcggactataaaagca

SEQ ID NO: 106918 - DNA, 25 bp, E. coli
ccagctccctggacaccgaatgggt

SEQ ID NO: 106919 - DNA, 25 bp, E. coli
gcttacagcgaataagttatcgacc

SEQ ID NO: 106920 - DNA, 25 bp, E. coli
gcttacagcgaaaaagttatcgacc

SEQ ID NO: 106921 - DNA, 25 bp, E. coli
gagaatccgcgttacgtgggttcct

SEQ ID NO: 106922 - DNA, 25 bp, E. coli
gagaatccgcgtaacgtgggttcct

SEQ ID NO: 106923 - DNA, 25 bp, E. coli
caaaattgcgctcacgccggatggc

SEQ ID NO: 106924 - DNA, 25 bp, E. coli
caaaattgcgctgacgccggatggc

SEQ ID NO: 106925 - DNA, 25 bp, E. coli
tgtaaacaatggaggcgaaggcaac

SEQ ID NO: 106926 - DNA, 25 bp, E. coli
tgtaaacaatggtggcgaaggcaac

SEQ ID NO: 106927 - DNA, 25 bp, E. coli
tccaaaacgtatttgggcagcgggt

SEQ ID NO: 106928 - DNA, 25 bp, E. coli
tccaaaacgtatatgggcagcgggt

SEQ ID NO: 106929 - DNA, 25 bp, E. coli
tctttcaggacagaggcacgattgc

SEQ ID NO: 106930 - DNA, 25 bp, E. coli
tcaggctgtcgaaggatggcatcac

SEQ ID NO: 106931 - DNA, 25 bp, E. coli
tctttcaggacacaggcacgattgc

SEQ ID NO: 106932 - DNA, 25 bp, E. coli
tcaggctgtcgatggatggcatcac

SEQ ID NO: 106933 - DNA, 25 bp, E. coli
gaaaaaggccactagatcaccggag

SEQ ID NO: 106934 - DNA, 25 bp, E. coli
gaaaaaggccacaagatcaccggag

SEQ ID NO: 106935 - DNA, 25 bp, E. coli
cattttgcggtgatcccggcagacc

SEQ ID NO: 106936 - DNA, 25 bp, E. coli
cattttgcggtgttcccggcagacc

SEQ ID NO: 106937 - DNA, 25 bp, E. coli
tggcatcaccatcgtgggcggttct

SEQ ID NO: 106938 - DNA, 25 bp, E. coli
tggccgtggaggtaagcaaaattgc

SEQ ID NO: 106939 - DNA, 25 bp, E. coli
tggccgtggaggaaagcaaaattgc

SEQ ID NO: 106940 - DNA, 25 bp, E. coli
tggcatcaccatggtgggcggttct

SEQ ID NO: 106941 - DNA, 25 bp, E. coli
tggataccgaagagctcaacgaccg

SEQ ID NO: 106942 - DNA, 25 bp, E. coli
tggataccgaagtgctcaacgaccg

SEQ ID NO: 106943 - DNA, 25 bp, E. coli
tcacgatccaggaaggtaaccgcct

SEQ ID NO: 106944 - DNA, 25 bp, E. coli
tcacgatccaggtaggtaaccgcct

SEQ ID NO: 106945 - DNA, 25 bp, E. coli
cagcagagatcggtattaaagcggc

SEQ ID NO: 106946 - DNA, 25 bp, E. coli
cagagatcgctaataaagcggcgca

SEQ ID NO: 106947 - DNA, 25 bp, E. coli
cagcagagatcgctattaaagcggc

SEQ ID NO: 106948 - DNA, 25 bp, E. coli
cagagatcgctattaaagcggcgca

SEQ ID NO: 106949 - DNA, 25 bp, E. coli
tattaaagcggcccaaactggtcac

SEQ ID NO: 106950 - DNA, 25 bp, E. coli
tattaaagcggcgcaaactggtcac

SEQ ID NO: 106951 - DNA, 25 bp, E. coli
tgggtcaggcacaggatgtcaacac

SEQ ID NO: 106952 - DNA, 25 bp, E. coli
tgggtcaggcactggatgtcaacac

SEQ ID NO: 106953 - DNA, 25 bp, E. coli
gaaacagcagagatcgctattaaag

SEQ ID NO: 106954 - DNA, 25 bp, E. coli
gaaacagcagagttcgctattaaag

SEQ ID NO: 106955 - DNA, 25 bp, E. coli
cgatggcgaaactgcagagatcgct

SEQ ID NO: 106956 - DNA, 25 bp, E. coli
cgatggcgaaacagcagagatcgct

SEQ ID NO: 106957 - DNA, 25 bp, E. coli
ccgcgatggcgatacagcagagatc

SEQ ID NO: 106958 - DNA, 25 bp, E. coli
ccgcgatggcgaaacagcagagatc

SEQ ID NO: 106959 - DNA, 25 bp, E. coli
ggtcaggcactggatgtcaacacgc

SEQ ID NO: 106960 - DNA, 25 bp, E. coli
ggtcaggcactgcatgtcaacacgc

SEQ ID NO: 106961 - DNA, 25 bp, E. coli
tggcgaaacagcagagatcgctatt

SEQ ID NO: 106962 - DNA, 25 bp, E. coli
tggcgaaacagctgagatcgctatt

SEQ ID NO: 106963 - DNA, 25 bp, E. coli
gagatcgctattaaagcggcgcaaa

SEQ ID NO: 106964 - DNA, 25 bp, E. coli
gagatcgctatttaagcggcgcaaa

SEQ ID NO: 106965 - DNA, 25 bp, E. coli
gatcgctattaatgcggcgcaaact

SEQ ID NO: 106966 - DNA, 25 bp, E. coli
gatcgctattaaagcggcgcaaact

SEQ ID NO: 106967 - DNA, 25 bp, E. coli
taaaaatggcctgctgagcatccag

SEQ ID NO: 106968 - DNA, 25 bp, E. coli
taaaaatggcctcctgagcatccag

SEQ ID NO: 106969 - DNA, 25 bp, E. coli
tgagcgcgtgatgcaaaccgaaatt

SEQ ID NO: 106970 - DNA, 25 bp, E. coli
tgaaggattgctcgattgcccgcac

SEQ ID NO: 106971 - DNA, 25 bp, E. coli
tgagcgcgtgatccaaaccgaaatt

SEQ ID NO: 106972 - DNA, 25 bp, E. coli
tgaaggattgctggattgcccgcac

SEQ ID NO: 106973 - DNA, 25 bp, E. coli
tccgggagtactcggacatgaagcc

SEQ ID NO: 106974 - DNA, 25 bp, E. coli
tccgggagtactgggacatgaagcc

SEQ ID NO: 106975 - DNA, 25 bp, E. coli
gccgtacctggcttagaagacctga

SEQ ID NO: 106976 - DNA, 25 bp, E. coli
gccgtacctggcatagaagacctga

SEQ ID NO: 106977 - DNA, 25 bp, E. coli
gcgggacgccatacatgcagcaaaa

SEQ ID NO: 106978 - DNA, 25 bp, E. coli
gcgggacgccattcatgcagcaaaa

SEQ ID NO: 106979 - DNA, 25 bp, E. coli
gcaaccatgccgtgatacgtcgctg

SEQ ID NO: 106980 - DNA, 25 bp, E. coli
gaagcctcggcaacggaagattcct

SEQ ID NO: 106981 - DNA, 25 bp, E. coli
gcaaccatgccgagatacgtcgctg

SEQ ID NO: 106982 - DNA, 25 bp, E. coli
gaagcctcggcatcggaagattcct

SEQ ID NO: 106983 - DNA, 25 bp, E. coli
cgtttgaaacagacgctgggccgta

SEQ ID NO: 106984 - DNA, 25 bp, E. coli
cgtttgaaacagtcgctgggccgta

SEQ ID NO: 106985 - DNA, 25 bp, E. coli
tggaaaacctgggtctgactgaaga

SEQ ID NO: 106986 - DNA, 25 bp, E. coli
tggaaaacctggctctgactgaaga

SEQ ID NO: 106987 - DNA, 25 bp, E. coli
taatgatggtgcaacccttgcggga

SEQ ID NO: 106988 - DNA, 25 bp, E. coli
taatgatggtgctacccttgcggga

SEQ ID NO: 106989 - DNA, 25 bp, E. coli
taaaggtattgtgctcctcatctcg

SEQ ID NO: 106990 - DNA, 25 bp, E. coli
taaaggtattgtcctcctcatctcg

SEQ ID NO: 106991 - DNA, 25 bp, E. coli
tatccaggcaattgtgcgtgtcctt

SEQ ID NO: 106992 - DNA, 25 bp, E. coli
tatccaggcaatagtgcgtgtcctt

SEQ ID NO: 106993 - DNA, 25 bp, E. coli
tgtggtggacgcagtgcatatagcc

SEQ ID NO: 106994 - DNA, 25 bp, E. coli
tgtggtggacgctgtgcatatagcc

SEQ ID NO: 106995 - DNA, 25 bp, E. coli
tgtggtttattaatggcaatctgcc

SEQ ID NO: 106996 - DNA, 25 bp, E. coli
tgtggtttattattggcaatctgcc

SEQ ID NO: 106997 - DNA, 25 bp, E. coli
tgcatatagccgtaatggagggtat

SEQ ID NO: 106998 - DNA, 25 bp, E. coli
tgcatatagccgaaatggagggtat

SEQ ID NO: 106999 - DNA, 25 bp, E. coli
tccggcaatggatgcaggagaatgc

SEQ ID NO: 107000 - DNA, 25 bp, E. coli
tgcgtgtccttaaaatcatgcaagg

SEQ ID NO: 107001 - DNA, 25 bp, E. coli
tccggcaatggaagcaggagaatgc

SEQ ID NO: 107002 - DNA, 25 bp, E. coli
tgcgtgtccttataatcatgcaagg

SEQ ID NO: 107003 - DNA, 25 bp, E. coli
tcttttagtggaaatgcagcaacag

SEQ ID NO: 107004 - DNA, 25 bp, E. coli
tcttttagtggatatgcagcaacag

SEQ ID NO: 107005 - DNA, 25 bp, E. coli
gaatccattgaatcttatccaggca

SEQ ID NO: 107006 - DNA, 25 bp, E. coli
gcaacaggaaagactgatgctcaga

SEQ ID NO: 107007 - DNA, 25 bp, E. coli
gcaacaggaaagtctgatgctcaga

SEQ ID NO: 107008 - DNA, 25 bp, E. coli
gaatccattgaaacttatccaggca

SEQ ID NO: 107009 - DNA, 25 bp, E. coli
gatgttaccgatcaaatgatccggc

SEQ ID NO: 107010 - DNA, 25 bp, E. coli
gatgttaccgatgaaatgatccggc

SEQ ID NO: 107011 - DNA, 25 bp, E. coli
aacgtattcacaatatcactgccag

SEQ ID NO: 107012 - DNA, 25 bp, E. coli
cataattgatagatcgttaccgagc

SEQ ID NO: 107013 - DNA, 25 bp, E. coli
cataattgatagttcgttaccgagc

SEQ ID NO: 107014 - DNA, 25 bp, E. coli
tacaagccgatattgcattcaatcg

SEQ ID NO: 107015 - DNA, 25 bp, E. coli
tacgagatattaccattacaagccg

SEQ ID NO: 107016 - DNA, 25 bp, E. coli
tacgagatattagcattacaagccg

SEQ ID NO: 107017 - DNA, 25 bp, E. coli
tacaagccgataatgcattcaatcg

SEQ ID NO: 107018 - DNA, 25 bp, E. coli
aacgtattcacattatcactgccag

SEQ ID NO: 107019 - DNA, 25 bp, E. coli
tacgcttccgatgatagtagagaac

SEQ ID NO: 107020 - DNA, 25 bp, E. coli
tacgcttccgatcatagtagagaac

SEQ ID NO: 107021 - DNA, 25 bp, E. coli
tattcatggtggcatacaaagcatc

SEQ ID NO: 107022 - DNA, 25 bp, E. coli
tattcatggtgggatacaaagcatc

SEQ ID NO: 107023 - DNA, 25 bp, E. coli
ttttgggcaatagatgcggctggac

SEQ ID NO: 107024 - DNA, 25 bp, E. coli
tttattgtatactcaggccgctggg

SEQ ID NO: 107025 - DNA, 25 bp, E. coli
ttttgggcaatacatgcggctggac

SEQ ID NO: 107026 - DNA, 25 bp, E. coli
tttattgtatacacaggccgctggg

SEQ ID NO: 107027 - DNA, 25 bp, E. coli
tctttcagttgagaggaatagcgct

SEQ ID NO: 107028 - DNA, 25 bp, E. coli
tctttcagttgacaggaatagcgct

SEQ ID NO: 107029 - DNA, 25 bp, E. coli
gcggctggacagattattgatactc

SEQ ID NO: 107030 - DNA, 25 bp, E. coli
gcggctggacagtttattgatactc

SEQ ID NO: 107031 - DNA, 25 bp, E. coli
gattcatcttctttcactggcgtta

SEQ ID NO: 107032 - DNA, 25 bp, E. coli
gattcatcttctatcactggcgtta

SEQ ID NO: 107033 - DNA, 25 bp, E. coli
aataagctgcactggcgtctggacg

SEQ ID NO: 107034 - DNA, 25 bp, E. coli
aataaattctatcgttctgctgatt

SEQ ID NO: 107035 - DNA, 25 bp, E. coli
aataagctgcacaggcgtctggacg

SEQ ID NO: 107036 - DNA, 25 bp, E. coli
aataaattctatggttctgctgatt

SEQ ID NO: 107037 - DNA, 25 bp, E. coli
taaattctatggatctgctgattta

SEQ ID NO: 107038 - DNA, 25 bp, E. coli
taaattctatggttctgctgattta

SEQ ID NO: 107039 - DNA, 25 bp, E. coli
ataaattctatggttctgctgattt

SEQ ID NO: 107040 - DNA, 25 bp, E. coli
ataaattctatgcttctgctgattt

SEQ ID NO: 107041 - DNA, 25 bp, E. coli
aaattctatggttctgctgatttaa

SEQ ID NO: 107042 - DNA, 25 bp, E. coli
aacgcagcagaattattttcaggga

SEQ ID NO: 107043 - DNA, 25 bp, E. coli
aaattctatggtactgctgatttaa

SEQ ID NO: 107044 - DNA, 25 bp, E. coli
aacgcagcagaaatattttcaggga

SEQ ID NO: 107045 - DNA, 25 bp, E. coli
gctttcgtagtaataccccgactct

SEQ ID NO: 107046 - DNA, 25 bp, E. coli
gctttcgtagtattaccccgactct

SEQ ID NO: 107047 - DNA, 25 bp, E. coli
gcagccatggactgaaactacctgg

SEQ ID NO: 107048 - DNA, 25 bp, E. coli
gcagccatggacagaaactacctgg

SEQ ID NO: 107049 - DNA, 25 bp, E. coli
cgtggtaatgaatgaagacgactac

SEQ ID NO: 107050 - DNA, 25 bp, E. coli
cgtggtaatgaaagaagacgactac

SEQ ID NO: 107051 - DNA, 25 bp, E. coli
tggcacgtggagtataagctgcaca

SEQ ID NO: 107052 - DNA, 25 bp, E. coli
tggacagaaactacctggcgtcagt

SEQ ID NO: 107053 - DNA, 25 bp, E. coli
tggcacgtggagaataagctgcaca

SEQ ID NO: 107054 - DNA, 25 bp, E. coli
tggacagaaacttcctggcgtcagt

SEQ ID NO: 107055 - DNA, 25 bp, E. coli
acccgtctggtgaaatatcgctggc

SEQ ID NO: 107056 - DNA, 25 bp, E. coli
acccgtctggtgtaatatcgctggc

SEQ ID NO: 107057 - DNA, 25 bp, E. coli
aacccgtctggtctaatatcgctgg

SEQ ID NO: 107058 - DNA, 25 bp, E. coli
aacccgtctggtgtaatatcgctgg

SEQ ID NO: 107059 - DNA, 25 bp, E. coli
tatcgctggcgaacccttgctatat

SEQ ID NO: 107060 - DNA, 25 bp, E. coli
tatcgctggcgatcccttgctatat

SEQ ID NO: 107061 - DNA, 25 bp, E. coli
tgtaatatcgctggcgatcccttgc

SEQ ID NO: 107062 - DNA, 25 bp, E. coli
tgtaatatcgctcgcgatcccttgc

SEQ ID NO: 107063 - DNA, 25 bp, E. coli
tgaacccgtctgctgtaatatcgct

SEQ ID NO: 107064 - DNA, 25 bp, E. coli
tgaacccgtctggtgtaatatcgct

SEQ ID NO: 107065 - DNA, 25 bp, E. coli
tctggtgtaatatcgctggcgatcc

SEQ ID NO: 107066 - DNA, 25 bp, E. coli
tctggtgtaataacgctggcgatcc

SEQ ID NO: 107067 - DNA, 25 bp, E. coli
ccgtctggtgtaatatcgctggcga

SEQ ID NO: 107068 - DNA, 25 bp, E. coli
ccgtctggtgtattatcgctggcga

SEQ ID NO: 107069 - DNA, 25 bp, E. coli
gaacccgtctggtgtaatatcgctg

SEQ ID NO: 107070 - DNA, 25 bp, E. coli
gaacccgtctggagtaatatcgctg

SEQ ID NO: 107071 - DNA, 25 bp, E. coli
cgctggcgatccgttgctatatggt

SEQ ID NO: 107072 - DNA, 25 bp, E. coli
cgctggcgatcccttgctatatggt

SEQ ID NO: 107073 - DNA, 25 bp, E. coli
cgtctggtgtaatatcgctggcgat

SEQ ID NO: 107074 - DNA, 25 bp, E. coli
cgtctggtgtaaaatcgctggcgat

SEQ ID NO: 107075 - DNA, 25 bp, E. coli
ggtgtaatatcgctggcgatccctt

SEQ ID NO: 107076 - DNA, 25 bp, E. coli
ggtgtaatatcggtggcgatccctt

SEQ ID NO: 107077 - DNA, 25 bp, E. coli
attgttccgcatggcaccgtggctg

SEQ ID NO: 107078 - DNA, 25 bp, E. coli
attgttccgcatcgcaccgtggctg

SEQ ID NO: 107079 - DNA, 25 bp, E. coli
tatttgcgctggtcaacccggtagg

SEQ ID NO: 107080 - DNA, 25 bp, E. coli
tatttgcgctggacaacccggtagg

SEQ ID NO: 107081 - DNA, 25 bp, E. coli
gcgatcagttctaccatcgtctggg

SEQ ID NO: 107082 - DNA, 25 bp, E. coli
gcggcagcgcgaaacaaaactaacc

SEQ ID NO: 107083 - DNA, 25 bp, E. coli
gcggcagcgcgatacaaaactaacc

SEQ ID NO: 107084 - DNA, 25 bp, E. coli
gcgatcagttcttccatcgtctggg

SEQ ID NO: 107085 - DNA, 25 bp, E. coli
gcatgaccagttttcagacagcggc

SEQ ID NO: 107086 - DNA, 25 bp, E. coli
gcatgaccagttatcagacagcggc

SEQ ID NO: 107087 - DNA, 25 bp, E. coli
gaaaaatcagaaaccgcggtacgtg

SEQ ID NO: 107088 - DNA, 25 bp, E. coli
gaaaaatcagaatccgcggtacgtg

SEQ ID NO: 107089 - DNA, 25 bp, E. coli
cgccagaccggcttcaacgtgatta

SEQ ID NO: 107090 - DNA, 25 bp, E. coli
cgatgtcgatgaacagcggcaagct

SEQ ID NO: 107091 - DNA, 25 bp, E. coli
cgccagaccggcatcaacgtgatta

SEQ ID NO: 107092 - DNA, 25 bp, E. coli
cgatgtcgatgatcagcggcaagct

SEQ ID NO: 107093 - DNA, 25 bp, E. coli
ggtacgcgttatcacagcattagct

SEQ ID NO: 107094 - DNA, 25 bp, E. coli
gggattattcccctctttatcagca

SEQ ID NO: 107095 - DNA, 25 bp, E. coli
gggattattcccgtctttatcagca

SEQ ID NO: 107096 - DNA, 25 bp, E. coli
ggtacgcgttatgacagcattagct

SEQ ID NO: 107097 - DNA, 25 bp, E. coli
tggatctcgctttttctcggcgaca

SEQ ID NO: 107098 - DNA, 25 bp, E. coli
tggatctcgcttattctcggcgaca

SEQ ID NO: 107099 - DNA, 25 bp, E. coli
aattactggaagatggcagcgatcc

SEQ ID NO: 107100 - DNA, 25 bp, E. coli
aattactggaagttggcagcgatcc

SEQ ID NO: 107101 - DNA, 25 bp, E. coli
tacgaagtgaccgatccagaagagc

SEQ ID NO: 107102 - DNA, 25 bp, E. coli
tacgaagtgacccatccagaagagc

SEQ ID NO: 107103 - DNA, 25 bp, E. coli
tgatcgatgccctggttgaacaact

SEQ ID NO: 107104 - DNA, 25 bp, E. coli
tgatcgatgcccaggttgaacaact

SEQ ID NO: 107105 - DNA, 25 bp, E. coli
tccgcagacgatctggaaaccctgg

SEQ ID NO: 107106 - DNA, 25 bp, E. coli
tcgaacaccatcattccgcagacga

SEQ ID NO: 107107 - DNA, 25 bp, E. coli
tccgcagacgatgtggaaaccctgg

SEQ ID NO: 107108 - DNA, 25 bp, E. coli
tcgaacaccatctttccgcagacga

SEQ ID NO: 107109 - DNA, 25 bp, E. coli
gcagcagttgaagcgtttaaactcg

SEQ ID NO: 107110 - DNA, 25 bp, E. coli
gcagcagttgaaccgtttaaactcg

SEQ ID NO: 107111 - DNA, 25 bp, E. coli
gaaaccctggaataagcagcagttg

SEQ ID NO: 107112 - DNA, 25 bp, E. coli
gaaaccctggaaaaagcagcagttg

SEQ ID NO: 107113 - DNA, 25 bp, E. coli
gattttgtcgatgaagacgatgacg

SEQ ID NO: 107114 - DNA, 25 bp, E. coli
gattttgtcgatcaagacgatgacg

SEQ ID NO: 107115 - DNA, 25 bp, E. coli
gatttgctgcgacatcctcagcgag

SEQ ID NO: 107116 - DNA, 25 bp, E. coli
gatttgctgcgagatcctcagcgag

SEQ ID NO: 107117 - DNA, 25 bp, E. coli
tggaagaacagcctgaagaaacacg

SEQ ID NO: 107118 - DNA, 25 bp, E. coli
tggaagaacagcgtgaagaaacacg

SEQ ID NO: 107119 - DNA, 25 bp, E. coli
gagaaatttgacgttgagtacgacg

SEQ ID NO: 107120 - DNA, 25 bp, E. coli
gagaaatttgaccttgagtacgacg

SEQ ID NO: 107121 - DNA, 25 bp, E. coli
caagttgtctacttgttaattataa

SEQ ID NO: 107122 - DNA, 25 bp, E. coli
caagttgtctacatgttaattataa

SEQ ID NO: 107123 - DNA, 25 bp, E. coli
tttttgatgtgaaattctggaacca

SEQ ID NO: 107124 - DNA, 25 bp, E. coli
ttgaaatggctagttattccccggg

SEQ ID NO: 107125 - DNA, 25 bp, E. coli
tttttgatgtgatattctggaacca

SEQ ID NO: 107126 - DNA, 25 bp, E. coli
ttgaaatggctacttattccccggg

SEQ ID NO: 107127 - DNA, 25 bp, E. coli
gctgtcgcctattttatacatacta

SEQ ID NO: 107128 - DNA, 25 bp, E. coli
gctgtcgcctatattatacatacta

SEQ ID NO: 107129 - DNA, 25 bp, E. coli
ctataattgatggttttctatgtga

SEQ ID NO: 107130 - DNA, 25 bp, E. coli
ctataattgatgcttttctatgtga

SEQ ID NO: 107131 - DNA, 25 bp, E. coli
gatattctggaaccattaatttgta

SEQ ID NO: 107132 - DNA, 25 bp, E. coli
gatattctggaagcattaatttgta

SEQ ID NO: 107133 - DNA, 25 bp, E. coli
ggttgctgtcgcgtattttatacat

SEQ ID NO: 107134 - DNA, 25 bp, E. coli
gtgatttagttaataaccttctggg

SEQ ID NO: 107135 - DNA, 25 bp, E. coli
ggttgctgtcgcctattttatacat

SEQ ID NO: 107136 - DNA, 25 bp, E. coli
gggttaattgtttcattgaaatggc

SEQ ID NO: 107137 - DNA, 25 bp, E. coli
gggttaattgttacattgaaatggc

SEQ ID NO: 107138 - DNA, 25 bp, E. coli
gtgatttagttattaaccttctggg

SEQ ID NO: 107139 - DNA, 25 bp, E. coli
taatgtttattacaagttgtctaca

SEQ ID NO: 107140 - DNA, 25 bp, E. coli
taatttgtaattcggttgctgtcgc

SEQ ID NO: 107141 - DNA, 25 bp, E. coli
taatttgtaattgggttgctgtcgc

SEQ ID NO: 107142 - DNA, 25 bp, E. coli
taatgtttattagaagttgtctaca

SEQ ID NO: 107143 - DNA, 25 bp, E. coli
cattttctgcaatgaccgcgtggca

SEQ ID NO: 107144 - DNA, 25 bp, E. coli
aaaacagcccagaacttcagaaagg

SEQ ID NO: 107145 - DNA, 25 bp, E. coli
aaaacagcccagtacttcagaaagg

SEQ ID NO: 107146 - DNA, 25 bp, E. coli
ttctcctgaactccgggaaaaccag

SEQ ID NO: 107147 - DNA, 25 bp, E. coli
ttctcctgaactgcgggaaaaccag

SEQ ID NO: 107148 - DNA, 25 bp, E. coli
tgacacgccgcttttactcgccggg

SEQ ID NO: 107149 - DNA, 25 bp, E. coli
tgacacgccgctattactcgccggg

SEQ ID NO: 107150 - DNA, 25 bp, E. coli
gctggcgaacgacctggaagcatcc

SEQ ID NO: 107151 - DNA, 25 bp, E. coli
gctggcgaacgagctggaagcatcc

SEQ ID NO: 107152 - DNA, 25 bp, E. coli
gaagcattacacaactggcggcact

SEQ ID NO: 107153 - DNA, 25 bp, E. coli
gaagcattacactactggcggcact

SEQ ID NO: 107154 - DNA, 25 bp, E. coli
gactgattatttccgggtgccatgc

SEQ ID NO: 107155 - DNA, 25 bp, E. coli
gactgattatttgcgggtgccatgc

SEQ ID NO: 107156 - DNA, 25 bp, E. coli
cgctgatttttaggccaccgagagc

SEQ ID NO: 107157 - DNA, 25 bp, E. coli
cgctgatttttacgccaccgagagc

SEQ ID NO: 107158 - DNA, 25 bp, E. coli
cattttctgcaaagaccgcgtggca

SEQ ID NO: 107159 - DNA, 25 bp, E. coli
gggcttgcgccacaaggactgatta

SEQ ID NO: 107160 - DNA, 25 bp, E. coli
gggcttgcgccagaaggactgatta

SEQ ID NO: 107161 - DNA, 25 bp, E. coli
ggaagcatccgtatcgcctgacacg

SEQ ID NO: 107162 - DNA, 25 bp, E. coli
ggaagcatccgtttcgcctgacacg

SEQ ID NO: 107163 - DNA, 25 bp, E. coli
gatgccgactttatcgctgagctga

SEQ ID NO: 107164 - DNA, 25 bp, E. coli
gatgccgactttttcgctgagctga

SEQ ID NO: 107165 - DNA, 25 bp, E. coli
cactgggtatggagcagcagcgact

SEQ ID NO: 107166 - DNA, 25 bp, E. coli
cactgggtatggtgcagcagcgact

SEQ ID NO: 107167 - DNA, 25 bp, E. coli
aaatctcgatgtgctttccggcgtg

SEQ ID NO: 107168 - DNA, 25 bp, E. coli
aaatctcgatgtcctttccggcgtg

SEQ ID NO: 107169 - DNA, 25 bp, E. coli
tatgtcaaacgaaggctatgcagcg

SEQ ID NO: 107170 - DNA, 25 bp, E. coli
tatgtcaaacgatggctatgcagcg

SEQ ID NO: 107171 - DNA, 25 bp, E. coli
tatcgctcaggtcagggatcgcagc

SEQ ID NO: 107172 - DNA, 25 bp, E. coli
tattggcatgcctgattcaaccggg

SEQ ID NO: 107173 - DNA, 25 bp, E. coli
tattggcatgccagattcaaccggg

SEQ ID NO: 107174 - DNA, 25 bp, E. coli
tattttatgccgaagcagcagggac

SEQ ID NO: 107175 - DNA, 25 bp, E. coli
tatcgctcaggtgagggatcgcagc

SEQ ID NO: 107176 - DNA, 25 bp, E. coli
tattttatgccgtagcagcagggac

SEQ ID NO: 107177 - DNA, 25 bp, E. coli
tgtaacagaatacggcagtgcgcac

SEQ ID NO: 107178 - DNA, 25 bp, E. coli
tgtaacagaatagggcagtgcgcac

SEQ ID NO: 107179 - DNA, 25 bp, E. coli
tgcagaaatacatccagcgacggct

SEQ ID NO: 107180 - DNA, 25 bp, E. coli
tgcagaaatacaaccagcgacggct

SEQ ID NO: 107181 - DNA, 25 bp, E. coli
tctttggtgataagccggacatggc

SEQ ID NO: 107182 - DNA, 25 bp, E. coli
tctttggtgatatgccggacatggc

SEQ ID NO: 107183 - DNA, 25 bp, E. coli
gattggcagtatggtaccagcgcag

SEQ ID NO: 107184 - DNA, 25 bp, E. coli
gattggcagtatcgtaccagcgcag

SEQ ID NO: 107185 - DNA, 25 bp, E. coli
tcaagaatggcggtaatgctcaggc

SEQ ID NO: 107186 - DNA, 25 bp, E. coli
tcaagaatggcgctaatgctcaggc

SEQ ID NO: 107187 - DNA, 25 bp, E. coli
caaaaatggaagtacagcgcaaagc

SEQ ID NO: 107188 - DNA, 25 bp, E. coli
caaaaatggaagaacagcgcaaagc

SEQ ID NO: 107189 - DNA, 25 bp, E. coli
ttcaaagacctgtacctgaccgacg

SEQ ID NO: 107190 - DNA, 25 bp, E. coli
ttcaaagacctgaacctgaccgacg

SEQ ID NO: 107191 - DNA, 25 bp, E. coli
tgacgccggaacagaaaaagcaatt

SEQ ID NO: 107192 - DNA, 25 bp, E. coli
tgcatgacatcaatgccagcgatac

SEQ ID NO: 107193 - DNA, 25 bp, E. coli
tgcatgacatcattgccagcgatac

SEQ ID NO: 107194 - DNA, 25 bp, E. coli
tgacgccggaactgaaaaagcaatt

SEQ ID NO: 107195 - DNA, 25 bp, E. coli
tcatgaaaggccagcgtgaccagat

SEQ ID NO: 107196 - DNA, 25 bp, E. coli
tcatgaaaggcctgcgtgaccagat

SEQ ID NO: 107197 - DNA, 25 bp, E. coli
gctgaagcgcagttcgcaaaaatgg

SEQ ID NO: 107198 - DNA, 25 bp, E. coli
gctgaagcgcagatcgcaaaaatgg

SEQ ID NO: 107199 - DNA, 25 bp, E. coli
gaagcgtctgacagaacgtccagcg

SEQ ID NO: 107200 - DNA, 25 bp, E. coli
gcaaagctaacatgctggcgcacat

SEQ ID NO: 107201 - DNA, 25 bp, E. coli
gaagcgtctgactgaacgtccagcg

SEQ ID NO: 107202 - DNA, 25 bp, E. coli
gcaaagctaacaagctggcgcacat

SEQ ID NO: 107203 - DNA, 25 bp, E. coli
cgtccagcggcaaaaggtaaaatgc

SEQ ID NO: 107204 - DNA, 25 bp, E. coli
cgtccagcggcataaggtaaaatgc

SEQ ID NO: 107205 - DNA, 25 bp, E. coli
gtgaccagatgaaacgtccgccgct

SEQ ID NO: 107206 - DNA, 25 bp, E. coli
gtgaccagatgatacgtccgccgct

SEQ ID NO: 107207 - DNA, 25 bp, E. coli
tggcgcacatggtaacccagaacaa

SEQ ID NO: 107208 - DNA, 25 bp, E. coli
tggcgcacatggaaacccagaacaa

SEQ ID NO: 107209 - DNA, 25 bp, E. coli
aaatcgtggcgctgttccgtcagaa

SEQ ID NO: 107210 - DNA, 25 bp, E. coli
aaatcgtggcgcagttccgtcagaa

SEQ ID NO: 107211 - DNA, 25 bp, E. coli
tattacgcatgagcagctgggtgca

SEQ ID NO: 107212 - DNA, 25 bp, E. coli
tattacgcatgaccagctgggtgca

SEQ ID NO: 107213 - DNA, 25 bp, E. coli
tcggcggcggaagaaaaacagatcc

SEQ ID NO: 107214 - DNA, 25 bp, E. coli
tcggcggcggaacaaaaacagatcc

SEQ ID NO: 107215 - DNA, 25 bp, E. coli
tcgaccggcaccttacagacgttaa

SEQ ID NO: 107216 - DNA, 25 bp, E. coli
tcgaccggcaccatacagacgttaa

SEQ ID NO: 107217 - DNA, 25 bp, E. coli
gcagccaggcgaaagtaaacccgtt

SEQ ID NO: 107218 - DNA, 25 bp, E. coli
gcagccaggcgatagtaaacccgtt

SEQ ID NO: 107219 - DNA, 25 bp, E. coli
gacgttaaacacagcgccgggttca

SEQ ID NO: 107220 - DNA, 25 bp, E. coli
gacgttaaacactgcgccgggttca

SEQ ID NO: 107221 - DNA, 25 bp, E. coli
cgccgagcgatggttatgtgaccca

SEQ ID NO: 107222 - DNA, 25 bp, E. coli
cgccgagcgatgcttatgtgaccca

SEQ ID NO: 107223 - DNA, 25 bp, E. coli
gattcgtccgggtacctatgccgcg

SEQ ID NO: 107224 - DNA, 25 bp, E. coli
gattcgtccgggaacctatgccgcg

SEQ ID NO: 107225 - DNA, 25 bp, E. coli
gatttgagcgctttaccagacggta

SEQ ID NO: 107226 - DNA, 25 bp, E. coli
gatttgagcgctataccagacggta

SEQ ID NO: 107227 - DNA, 25 bp, E. coli
ggtgctatttcgtctggacccgacg

SEQ ID NO: 107228 - DNA, 25 bp, E. coli
ggtgctatttcgactggacccgacg

SEQ ID NO: 107229 - DNA, 25 bp, E. coli
taaccttgagcagacgatagtgcgt

SEQ ID NO: 107230 - DNA, 25 bp, E. coli
taaccttgagcacacgatagtgcgt

SEQ ID NO: 107231 - DNA, 25 bp, E. coli
caagaatacaatctcgtcgatgcgc

SEQ ID NO: 107232 - DNA, 25 bp, E. coli
caagaatacaatgtcgtcgatgcgc

SEQ ID NO: 107233 - DNA, 25 bp, E. coli
catttcagccatcaaagattgttgg

SEQ ID NO: 107234 - DNA, 25 bp, E. coli
catttcagccatgaaagattgttgg

SEQ ID NO: 107235 - DNA, 25 bp, E. coli
acattaggcattatctcttgccagg

SEQ ID NO: 107236 - DNA, 25 bp, E. coli
acattaggcattttctcttgccagg

SEQ ID NO: 107237 - DNA, 25 bp, E. coli
ttatccaagccctttgacaagagga

SEQ ID NO: 107238 - DNA, 25 bp, E. coli
ttatccaagcccattgacaagagga

SEQ ID NO: 107239 - DNA, 25 bp, E. coli
ttatatagaacatgtgccacgcaca

SEQ ID NO: 107240 - DNA, 25 bp, E. coli
ttatatagaacaagtgccacgcaca

SEQ ID NO: 107241 - DNA, 25 bp, E. coli
tcgtcgatgcgcaattaaataaagc

SEQ ID NO: 107242 - DNA, 25 bp, E. coli
tcgtcgatgcgctattaaataaagc

SEQ ID NO: 107243 - DNA, 25 bp, E. coli
cctttcaaatgaggacgttcaggat

SEQ ID NO: 107244 - DNA, 25 bp, E. coli
cctttcaaatgacgacgttcaggat

SEQ ID NO: 107245 - DNA, 25 bp, E. coli
gcagctataccgaaactctgaagat

SEQ ID NO: 107246 - DNA, 25 bp, E. coli
gcagctataccgtaactctgaagat

SEQ ID NO: 107247 - DNA, 25 bp, E. coli
gaactcgccagtagcagctataccg

SEQ ID NO: 107248 - DNA, 25 bp, E. coli
gaactcgccagttgcagctataccg

SEQ ID NO: 107249 - DNA, 25 bp, E. coli
cgagcctggctgcattttagggaca

SEQ ID NO: 107250 - DNA, 25 bp, E. coli
cgagcctggctggattttagggaca

SEQ ID NO: 107251 - DNA, 25 bp, E. coli
gtatgatcatacagaccaatacgcg

SEQ ID NO: 107252 - DNA, 25 bp, E. coli
gtatgatcatactgaccaatacgcg

SEQ ID NO: 107253 - DNA, 25 bp, E. coli
aacaccgccgcgagaagttctggaa

SEQ ID NO: 107254 - DNA, 25 bp, E. coli
aacaccgccgcgtgaagttctggaa

SEQ ID NO: 107255 - DNA, 25 bp, E. coli
tatgaagagattgccgacgtgacca

SEQ ID NO: 107256 - DNA, 25 bp, E. coli
tatgaagagattcccgacgtgacca

SEQ ID NO: 107257 - DNA, 25 bp, E. coli
tattcagttgcctaacccgctggag

SEQ ID NO: 107258 - DNA, 25 bp, E. coli
tattcagttgccaaacccgctggag

SEQ ID NO: 107259 - DNA, 25 bp, E. coli
tattgggcgccagttagctcaacaa

SEQ ID NO: 107260 - DNA, 25 bp, E. coli
tattgggcgccacttagctcaacaa

SEQ ID NO: 107261 - DNA, 25 bp, E. coli
tttagaaggcgaagaaggcttccgc

SEQ ID NO: 107262 - DNA, 25 bp, E. coli
tttagaaggcgatgaaggcttccgc

SEQ ID NO: 107263 - DNA, 25 bp, E. coli
tgaaatcccgtgtaacgcgtaaccg

SEQ ID NO: 107264 - DNA, 25 bp, E. coli
tgaaatcccgtgaaacgcgtaaccg

SEQ ID NO: 107265 - DNA, 25 bp, E. coli
tccgcgatcgcgaagaaaaggtcat

SEQ ID NO: 107266 - DNA, 25 bp, E. coli
tccgcgatcgcgtagaaaaggtcat

SEQ ID NO: 107267 - DNA, 25 bp, E. coli
gaacgcaatccggtgtatgaagaga

SEQ ID NO: 107268 - DNA, 25 bp, E. coli
gaacgcaatccgctgtatgaagaga

SEQ ID NO: 107269 - DNA, 25 bp, E. coli
gttgctgcacgtagaaacaccgccg

SEQ ID NO: 107270 - DNA, 25 bp, E. coli
gattgagaaacgtaccggagctgat

SEQ ID NO: 107271 - DNA, 25 bp, E. coli
gattgagaaacgaaccggagctgat

SEQ ID NO: 107272 - DNA, 25 bp, E. coli
gttgctgcacgttgaaacaccgccg

SEQ ID NO: 107273 - DNA, 25 bp, E. coli
tcaatgagttgagcgagaaacaggg

SEQ ID NO: 107274 - DNA, 25 bp, E. coli
tcaatgagttgaccgagaaacaggg

SEQ ID NO: 107275 - DNA, 25 bp, E. coli
cagttctctaatattgcgggtaatc

SEQ ID NO: 107276 - DNA, 25 bp, E. coli
cagttctctaattttgcgggtaatc

SEQ ID NO: 107277 - DNA, 25 bp, E. coli
tataagacccgtttttctctccagt

SEQ ID NO: 107278 - DNA, 25 bp, E. coli
tataagacccgtatttctctccagt

SEQ ID NO: 107279 - DNA, 25 bp, E. coli
ttttgctgttgaaagcagggctgtt

SEQ ID NO: 107280 - DNA, 25 bp, E. coli
ttttgctgttgatagcagggctgtt

SEQ ID NO: 107281 - DNA, 25 bp, E. coli
tttacttagcaaagcctcggctccg

SEQ ID NO: 107282 - DNA, 25 bp, E. coli
tttacttagcaatgcctcggctccg

SEQ ID NO: 107283 - DNA, 25 bp, E. coli
tgttacgtctcgatgcgaagctagt

SEQ ID NO: 107284 - DNA, 25 bp, E. coli
tgtatcatctcttagttatgcagaa

SEQ ID NO: 107285 - DNA, 25 bp, E. coli
tgttacgtctcgttgcgaagctagt

SEQ ID NO: 107286 - DNA, 25 bp, E. coli
tgtatcatctctaagttatgcagaa

SEQ ID NO: 107287 - DNA, 25 bp, E. coli
tcgatgcgaagctagtttacgacga

SEQ ID NO: 107288 - DNA, 25 bp, E. coli
tcgatgcgaagcaagtttacgacga

SEQ ID NO: 107289 - DNA, 25 bp, E. coli
tctaagttatgcagaaaacacggag

SEQ ID NO: 107290 - DNA, 25 bp, E. coli
tctctccagttctctaatattgcgg

SEQ ID NO: 107291 - DNA, 25 bp, E. coli
tctaagttatgctgaaaacacggag

SEQ ID NO: 107292 - DNA, 25 bp, E. coli
tctctccagttcactaatattgcgg

SEQ ID NO: 107293 - DNA, 25 bp, E. coli
gctggcctcacgctttacttagcaa

SEQ ID NO: 107294 - DNA, 25 bp, E. coli
gctggcctcacggtttacttagcaa

SEQ ID NO: 107295 - DNA, 25 bp, E. coli
gcagggctgtttctatcatctctaa

SEQ ID NO: 107296 - DNA, 25 bp, E. coli
gcagggctgtttgtatcatctctaa

SEQ ID NO: 107297 - DNA, 25 bp, E. coli
cagcatccccatgggtgttgttgta

SEQ ID NO: 107298 - DNA, 25 bp, E. coli
catccccatgggagttgttgtattc

SEQ ID NO: 107299 - DNA, 25 bp, E. coli
cagcatccccatcggtgttgttgta

SEQ ID NO: 107300 - DNA, 25 bp, E. coli
catccccatgggtgttgttgtattc

SEQ ID NO: 107301 - DNA, 25 bp, E. coli
aggttgctgcagcatccccatgggt

SEQ ID NO: 107302 - DNA, 25 bp, E. coli
atgggcgaggttgctgcagcatccc

SEQ ID NO: 107303 - DNA, 25 bp, E. coli
atgggcgaggttcctgcagcatccc

SEQ ID NO: 107304 - DNA, 25 bp, E. coli
aggttgctgcaggatccccatgggt

SEQ ID NO: 107305 - DNA, 25 bp, E. coli
ttgctgcagcatccccatgggtgtt

SEQ ID NO: 107306 - DNA, 25 bp, E. coli
ttgctgcagcatgcccatgggtgtt

SEQ ID NO: 107307 - DNA, 25 bp, E. coli
tgcagcatccccttgggtgttgttg

SEQ ID NO: 107308 - DNA, 25 bp, E. coli
tgcagcatccccatgggtgttgttg

SEQ ID NO: 107309 - DNA, 25 bp, E. coli
tccccatgggtgttgttgtattcat

SEQ ID NO: 107310 - DNA, 25 bp, E. coli
tccccatgggtgatgttgtattcat

SEQ ID NO: 107311 - DNA, 25 bp, E. coli
cgaggttgctgctgcatccccatgg

SEQ ID NO: 107312 - DNA, 25 bp, E. coli
cgaggttgctgcagcatccccatgg

SEQ ID NO: 107313 - DNA, 25 bp, E. coli
ctgcagcatcccgatgggtgttgtt

SEQ ID NO: 107314 - DNA, 25 bp, E. coli
ctgcagcatccccatgggtgttgtt

SEQ ID NO: 107315 - DNA, 25 bp, E. coli
gttgctgcagcaaccccatgggtgt

SEQ ID NO: 107316 - DNA, 25 bp, E. coli
gttgctgcagcatccccatgggtgt

SEQ ID NO: 107317 - DNA, 25 bp, E. coli
ggcgaggttgctccagcatccccat

SEQ ID NO: 107318 - DNA, 25 bp, E. coli
ggcgaggttgctgcagcatccccat

SEQ ID NO: 107319 - DNA, 25 bp, E. coli
caataaggcggcacgcgagatgaaa

SEQ ID NO: 107320 - DNA, 25 bp, E. coli
caataaggcggctcgcgagatgaaa

SEQ ID NO: 107321 - DNA, 25 bp, E. coli
ttatcaggcgcgacatatcgcggcg

SEQ ID NO: 107322 - DNA, 25 bp, E. coli
ttatcaggcgcgtcatatcgcggcg

SEQ ID NO: 107323 - DNA, 25 bp, E. coli
tgatttccacctaccacacgctggg

SEQ ID NO: 107324 - DNA, 25 bp, E. coli
tgatttccaccttccacacgctggg

SEQ ID NO: 107325 - DNA, 25 bp, E. coli
gctgttgagtcaggatttcccggca

SEQ ID NO: 107326 - DNA, 25 bp, E. coli
gctttaccgtagttggcgatgacga

SEQ ID NO: 107327 - DNA, 25 bp, E. coli
gctgttgagtcacgatttcccggca

SEQ ID NO: 107328 - DNA, 25 bp, E. coli
gctaatttcgacgatctccaactgg

SEQ ID NO: 107329 - DNA, 25 bp, E. coli
gctttaccgtagatggcgatgacga

SEQ ID NO: 107330 - DNA, 25 bp, E. coli
gctaatttcgaccatctccaactgg

SEQ ID NO: 107331 - DNA, 25 bp, E. coli
gggctgatgatttccaccttccaca

SEQ ID NO: 107332 - DNA, 25 bp, E. coli
gggctgatgattaccaccttccaca

SEQ ID NO: 107333 - DNA, 25 bp, E. coli
gggatgaaggcttacttttcgctgt

SEQ ID NO: 107334 - DNA, 25 bp, E. coli
gggatgaaggctaacttttcgctgt

SEQ ID NO: 107335 - DNA, 25 bp, E. coli
ggcgatgacgatcagtcgatctact

SEQ ID NO: 107336 - DNA, 25 bp, E. coli
ggcgatgacgatgagtcgatctact

SEQ ID NO: 107337 - DNA, 25 bp, E. coli
ggcggtgaccttaaccaataaggcg

SEQ ID NO: 107338 - DNA, 25 bp, E. coli
ggcggtgacctttaccaataaggcg

SEQ ID NO: 107339 - DNA, 25 bp, E. coli
taacttttcgctgtttgacgatacc

SEQ ID NO: 107340 - DNA, 25 bp, E. coli
taacttttcgctctttgacgatacc

SEQ ID NO: 107341 - DNA, 25 bp, E. coli
catcgtacttacagggatcgcccgg

SEQ ID NO: 107342 - DNA, 25 bp, E. coli
catcgtacttactgggatcgcccgg

SEQ ID NO: 107343 - DNA, 25 bp, E. coli
tacaacgagcaataactgggactgg

SEQ ID NO: 107344 - DNA, 25 bp, E. coli
tacggcaaaggaaaactggacggca

SEQ ID NO: 107345 - DNA, 25 bp, E. coli
tacggcaaaggataactggacggca

SEQ ID NO: 107346 - DNA, 25 bp, E. coli
tacaacgagcaaaaactgggactgg

SEQ ID NO: 107347 - DNA, 25 bp, E. coli
taccaggttaaccttggcaccagcg

SEQ ID NO: 107348 - DNA, 25 bp, E. coli
tatgcctgcctgtcacctgagttag

SEQ ID NO: 107349 - DNA, 25 bp, E. coli
tatgagcattccgtggagcgacagc

SEQ ID NO: 107350 - DNA, 25 bp, E. coli
tatgcctgcctgacacctgagttag

SEQ ID NO: 107351 - DNA, 25 bp, E. coli
taccaggttaacgttggcaccagcg

SEQ ID NO: 107352 - DNA, 25 bp, E. coli
tatgagcattccctggagcgacagc

SEQ ID NO: 107353 - DNA, 25 bp, E. coli
tataaccagaacattgccgctgcgg

SEQ ID NO: 107354 - DNA, 25 bp, E. coli
tataaccagaactttgccgctgcgg

SEQ ID NO: 107355 - DNA, 25 bp, E. coli
tgttattcaggagcagacgcggcaa

SEQ ID NO: 107356 - DNA, 25 bp, E. coli
tgttattcaggaccagacgcggcaa

SEQ ID NO: 107357 - DNA, 25 bp, E. coli
gaagcgccgacgacaatttcagcaa

SEQ ID NO: 107358 - DNA, 25 bp, E. coli
gaagcgccgacgtcaatttcagcaa

SEQ ID NO: 107359 - DNA, 25 bp, E. coli
ggttatctgagcgacgacggttcgc

SEQ ID NO: 107360 - DNA, 25 bp, E. coli
ggttatctgagccacgacggttcgc

SEQ ID NO: 107361 - DNA, 25 bp, E. coli
taactatatcggcagcagcgtcagc

SEQ ID NO: 107362 - DNA, 25 bp, E. coli
taactatatcgggagcagcgtcagc

SEQ ID NO: 107363 - DNA, 25 bp, E. coli
aattttactggctgcgttgacgtca

SEQ ID NO: 107364 - DNA, 25 bp, E. coli
aattttactggcagcgttgacgtca

SEQ ID NO: 107365 - DNA, 25 bp, E. coli
tgaagtcgctgcacctaaggaaccg

SEQ ID NO: 107366 - DNA, 25 bp, E. coli
tgaagtcgctgctcctaaggaaccg

SEQ ID NO: 107367 - DNA, 25 bp, E. coli
tcatcaaggcagacaaagatgtcga

SEQ ID NO: 107368 - DNA, 25 bp, E. coli
tcatcaaggcagtcaaagatgtcga

SEQ ID NO: 107369 - DNA, 25 bp, E. coli
gctgcacctaaggaaccgatcacta

SEQ ID NO: 107370 - DNA, 25 bp, E. coli
gcctcgcattgaagtcgctgcacct

SEQ ID NO: 107371 - DNA, 25 bp, E. coli
gctgcacctaagcaaccgatcacta

SEQ ID NO: 107372 - DNA, 25 bp, E. coli
gcctcgcattgatgtcgctgcacct

SEQ ID NO: 107373 - DNA, 25 bp, E. coli
gctggttggctgaacgcctcgcatt

SEQ ID NO: 107374 - DNA, 25 bp, E. coli
gctggttggctgtacgcctcgcatt

SEQ ID NO: 107375 - DNA, 25 bp, E. coli
gcgttgacgtcatcttttatgctgg

SEQ ID NO: 107376 - DNA, 25 bp, E. coli
gcgttgacgtcaacttttatgctgg

SEQ ID NO: 107377 - DNA, 25 bp, E. coli
gacaaagatgtcgaagagctgcttg

SEQ ID NO: 107378 - DNA, 25 bp, E. coli
gaaccgatcactttcaatatgaacg

SEQ ID NO: 107379 - DNA, 25 bp, E. coli
gaaccgatcactatcaatatgaacg

SEQ ID NO: 107380 - DNA, 25 bp, E. coli
gacaaagatgtccaagagctgcttg

SEQ ID NO: 107381 - DNA, 25 bp, E. coli
cttttatgctggttggctgtacgcc

SEQ ID NO: 107382 - DNA, 25 bp, E. coli
cttttatgctggatggctgtacgcc

SEQ ID NO: 107383 - DNA, 25 bp, E. coli
gagcatgagatcttcatcaaggcag

SEQ ID NO: 107384 - DNA, 25 bp, E. coli
gagcatgagatcatcatcaaggcag

SEQ ID NO: 107385 - DNA, 25 bp, E. coli
aatgatggcccagtcgctcaggcaa

SEQ ID NO: 107386 - DNA, 25 bp, E. coli
aagcaatgtctcgagcccaatgatg

SEQ ID NO: 107387 - DNA, 25 bp, E. coli
aagcaatgtctccagcccaatgatg

SEQ ID NO: 107388 - DNA, 25 bp, E. coli
aatgatggcccactcgctcaggcaa

SEQ ID NO: 107389 - DNA, 25 bp, E. coli
cagtctctgttcttcctgcttatgc

SEQ ID NO: 107390 - DNA, 25 bp, E. coli
cagtctctgttcatcctgcttatgc

SEQ ID NO: 107391 - DNA, 25 bp, E. coli
tactgctgataaagccgacctaccg

SEQ ID NO: 107392 - DNA, 25 bp, E. coli
tactgctgataatgccgacctaccg

SEQ ID NO: 107393 - DNA, 25 bp, E. coli
tgataaaggtggtaaaaatgaagcc

SEQ ID NO: 107394 - DNA, 25 bp, E. coli
tgataaaggtggaaaaaatgaagcc

SEQ ID NO: 107395 - DNA, 25 bp, E. coli
tgaaacgtaaccagataaaggtggt

SEQ ID NO: 107396 - DNA, 25 bp, E. coli
tgaaacgtaacctgataaaggtggt

SEQ ID NO: 107397 - DNA, 25 bp, E. coli
tccgctcggtactgctgataaagcc

SEQ ID NO: 107398 - DNA, 25 bp, E. coli
tccgctcggtacagctgataaagcc

SEQ ID NO: 107399 - DNA, 25 bp, E. coli
gccgacctaccgcaaagcaatgtct

SEQ ID NO: 107400 - DNA, 25 bp, E. coli
gccgacctaccggaaagcaatgtct

SEQ ID NO: 107401 - DNA, 25 bp, E. coli
cctgcttatgctggtccgctcggta

SEQ ID NO: 107402 - DNA, 25 bp, E. coli
cctgcttatgctcgtccgctcggta

SEQ ID NO: 107403 - DNA, 25 bp, E. coli
gctgctttgatgttatcagtctctg

SEQ ID NO: 107404 - DNA, 25 bp, E. coli
gctgctttgatgatatcagtctctg

SEQ ID NO: 107405 - DNA, 25 bp, E. coli
gaagccttattttgctgctttgatg

SEQ ID NO: 107406 - DNA, 25 bp, E. coli
gaagccttatttagctgctttgatg

SEQ ID NO: 107407 - DNA, 25 bp, E. coli
caacttgagcaacgcttaggcgata

SEQ ID NO: 107408 - DNA, 25 bp, E. coli
caacttgagcaaggcttaggcgata

SEQ ID NO: 107409 - DNA, 25 bp, E. coli
aaagctgacagttaagaatcggcgc

SEQ ID NO: 107410 - DNA, 25 bp, E. coli
aagaaagcgggaatcgatcgttgcc

SEQ ID NO: 107411 - DNA, 25 bp, E. coli
aaagctgacagtaaagaatcggcgc

SEQ ID NO: 107412 - DNA, 25 bp, E. coli
aagaaagcgggattcgatcgttgcc

SEQ ID NO: 107413 - DNA, 25 bp, E. coli
tatccccggtgagagtaatgacagt

SEQ ID NO: 107414 - DNA, 25 bp, E. coli
tatccccggtgacagtaatgacagt

SEQ ID NO: 107415 - DNA, 25 bp, E. coli
ccattctggcgcagagtgataacga

SEQ ID NO: 107416 - DNA, 25 bp, E. coli
ccattctggcgctgagtgataacga

SEQ ID NO: 107417 - DNA, 25 bp, E. coli
ccattggcttactgttccgggcaaa

SEQ ID NO: 107418 - DNA, 25 bp, E. coli
ccattggcttacagttccgggcaaa

SEQ ID NO: 107419 - DNA, 25 bp, E. coli
gcaaagctcgcaagggcaatcagta

SEQ ID NO: 107420 - DNA, 25 bp, E. coli
gcaaagctcgcatgggcaatcagta

SEQ ID NO: 107421 - DNA, 25 bp, E. coli
gatagaaaccatctcaaccgtcggc

SEQ ID NO: 107422 - DNA, 25 bp, E. coli
gatagaaaccatgtcaaccgtcggc

SEQ ID NO: 107423 - DNA, 25 bp, E. coli
gtcaaaacagttgtcgccgtcagtg

SEQ ID NO: 107424 - DNA, 25 bp, E. coli
gtcaaaacagttctcgccgtcagtg

SEQ ID NO: 107425 - DNA, 25 bp, E. coli
taacgcgtttgtagtactctcggca

SEQ ID NO: 107426 - DNA, 25 bp, E. coli
tcaatttttggtccgcttatccgcg

SEQ ID NO: 107427 - DNA, 25 bp, E. coli
taacgcgtttgttgtactctcggca

SEQ ID NO: 107428 - DNA, 25 bp, E. coli
tcaatttttggtgcgcttatccgcg

SEQ ID NO: 107429 - DNA, 25 bp, E. coli
taaaattttgaggagcaacaaagga

SEQ ID NO: 107430 - DNA, 25 bp, E. coli
taaaattttgagcagcaacaaagga

SEQ ID NO: 107431 - DNA, 25 bp, E. coli
aaaagaggcgcggaaggatggctgg

SEQ ID NO: 107432 - DNA, 25 bp, E. coli
aaacgcgtgcttatgcgccagggca

SEQ ID NO: 107433 - DNA, 25 bp, E. coli
aaaagaggcgcgcaaggatggctgg

SEQ ID NO: 107434 - DNA, 25 bp, E. coli
acgcgtgcttttccgccagggcata

SEQ ID NO: 107435 - DNA, 25 bp, E. coli
aaacgcgtgcttttgcgccagggca

SEQ ID NO: 107436 - DNA, 25 bp, E. coli
acgcgtgcttttgcgccagggcata

SEQ ID NO: 107437 - DNA, 25 bp, E. coli
ttttgaggagcaacaaaggagagtg

SEQ ID NO: 107438 - DNA, 25 bp, E. coli
ttttgaggagcatcaaaggagagtg

SEQ ID NO: 107439 - DNA, 25 bp, E. coli
tgggctggctgtgcaaaagaggcgc

SEQ ID NO: 107440 - DNA, 25 bp, E. coli
tgggctggctgtccaaaagaggcgc

SEQ ID NO: 107441 - DNA, 25 bp, E. coli
ccagggcataaaattttgaggagca

SEQ ID NO: 107442 - DNA, 25 bp, E. coli
ccagggcataaatttttgaggagca

SEQ ID NO: 107443 - DNA, 25 bp, E. coli
gcttttgcgccagggcataaaattt

SEQ ID NO: 107444 - DNA, 25 bp, E. coli
gcttttgcgccacggcataaaattt

SEQ ID NO: 107445 - DNA, 25 bp, E. coli
gcaaggatggctcgcgaataagcaa

SEQ ID NO: 107446 - DNA, 25 bp, E. coli
gcaaggatggctggcgaataagcaa

SEQ ID NO: 107447 - DNA, 25 bp, E. coli
gacaaaacgcgtccttttgcgccag

SEQ ID NO: 107448 - DNA, 25 bp, E. coli
gacaaaacgcgtgcttttgcgccag

SEQ ID NO: 107449 - DNA, 25 bp, E. coli
gggcataaaattttgaggagcaaca

SEQ ID NO: 107450 - DNA, 25 bp, E. coli
gggcataaaattatgaggagcaaca

SEQ ID NO: 107451 - DNA, 25 bp, E. coli
aatgtgtactttgcctggatgcgct

SEQ ID NO: 107452 - DNA, 25 bp, E. coli
aatgtgtactttccctggatgcgct

SEQ ID NO: 107453 - DNA, 25 bp, E. coli
caaatgggaaccgattgccggatac

SEQ ID NO: 107454 - DNA, 25 bp, E. coli
caaatgggaacccattgccggatac

SEQ ID NO: 107455 - DNA, 25 bp, E. coli
tacggatgggaatgtacctggcgac

SEQ ID NO: 107456 - DNA, 25 bp, E. coli
tacggatgggaaagtacctggcgac

SEQ ID NO: 107457 - DNA, 25 bp, E. coli
taaggactcgtgcaacaaatgggaa

SEQ ID NO: 107458 - DNA, 25 bp, E. coli
taaggactcgtggaacaaatgggaa

SEQ ID NO: 107459 - DNA, 25 bp, E. coli
tatgccatggcaattaaggactcgt

SEQ ID NO: 107460 - DNA, 25 bp, E. coli
tatgccatggcatttaaggactcgt

SEQ ID NO: 107461 - DNA, 25 bp, E. coli
tttatatattccagccatcacctgg

SEQ ID NO: 107462 - DNA, 25 bp, E. coli
tttatatattcctgccatcacctgg

SEQ ID NO: 107463 - DNA, 25 bp, E. coli
tgaaaaaggaaagtggcatggcctg

SEQ ID NO: 107464 - DNA, 25 bp, E. coli
tgaaaaaggaaactggcatggcctg

SEQ ID NO: 107465 - DNA, 25 bp, E. coli
tcagatgacctagattccgggtacc

SEQ ID NO: 107466 - DNA, 25 bp, E. coli
tcagatgacctacattccgggtacc

SEQ ID NO: 107467 - DNA, 25 bp, E. coli
ccgggtacctacaacaatggcaatg

SEQ ID NO: 107468 - DNA, 25 bp, E. coli
ccgggtacctactacaatggcaatg

SEQ ID NO: 107469 - DNA, 25 bp, E. coli
gaccgctggcggatgaaaattttca

SEQ ID NO: 107470 - DNA, 25 bp, E. coli
gaccgctggcggttgaaaattttca

SEQ ID NO: 107471 - DNA, 25 bp, E. coli
gatcgctataaccagcgaccgtggg

SEQ ID NO: 107472 - DNA, 25 bp, E. coli
gatcgctataacgagcgaccgtggg

SEQ ID NO: 107473 - DNA, 25 bp, E. coli
ctatgaggacccagacaaagagtga

SEQ ID NO: 107474 - DNA, 25 bp, E. coli
ctatgaggaccctgacaaagagtga

SEQ ID NO: 107475 - DNA, 25 bp, E. coli
agtgaacatccgtccgctcaggaag

SEQ ID NO: 107476 - DNA, 25 bp, E. coli
agtgaacatccgaccgctcaggaag

SEQ ID NO: 107477 - DNA, 25 bp, E. coli
tatcctcgtgaagcatatatagtga

SEQ ID NO: 107478 - DNA, 25 bp, E. coli
tatcctcgtgaaccatatatagtga

SEQ ID NO: 107479 - DNA, 25 bp, E. coli
tggtaccaactctgagccgatcatc

SEQ ID NO: 107480 - DNA, 25 bp, E. coli
tgaaaaaggaaagccaggacagacg

SEQ ID NO: 107481 - DNA, 25 bp, E. coli
tgaaaaaggaaacccaggacagacg

SEQ ID NO: 107482 - DNA, 25 bp, E. coli
gctcaggaagcgatggatgcgaaaa

SEQ ID NO: 107483 - DNA, 25 bp, E. coli
gcgaaaaaacgcaatgaggaccctg

SEQ ID NO: 107484 - DNA, 25 bp, E. coli
gcgaaaaaacgctatgaggaccctg

SEQ ID NO: 107485 - DNA, 25 bp, E. coli
gctcaggaagcgttggatgcgaaaa

SEQ ID NO: 107486 - DNA, 25 bp, E. coli
gactcgttgatctgtgaacatccga

SEQ ID NO: 107487 - DNA, 25 bp, E. coli
gacagacggtaagctggtaccaact

SEQ ID NO: 107488 - DNA, 25 bp, E. coli
gaaaccgccttaacctcgtgaagca

SEQ ID NO: 107489 - DNA, 25 bp, E. coli
gaaaccgccttatcctcgtgaagca

SEQ ID NO: 107490 - DNA, 25 bp, E. coli
gacagacggtaacctggtaccaact

SEQ ID NO: 107491 - DNA, 25 bp, E. coli
gactcgttgatcagtgaacatccga

SEQ ID NO: 107492 - DNA, 25 bp, E. coli
gatcatcctaaagcagactcgttga

SEQ ID NO: 107493 - DNA, 25 bp, E. coli
tggtaccaactcagagccgatcatc

SEQ ID NO: 107494 - DNA, 25 bp, E. coli
gatcatcctaaaccagactcgttga

SEQ ID NO: 107495 - DNA, 25 bp, E. coli
cagacaaataatgcatttactggag

SEQ ID NO: 107496 - DNA, 25 bp, E. coli
caaatcgccgttaccagacaaataa

SEQ ID NO: 107497 - DNA, 25 bp, E. coli
caaatcgccgtttccagacaaataa

SEQ ID NO: 107498 - DNA, 25 bp, E. coli
cagacaaataatccatttactggag

SEQ ID NO: 107499 - DNA, 25 bp, E. coli
tacctcccgatataaaaggaaggat

SEQ ID NO: 107500 - DNA, 25 bp, E. coli
tacggaagtgtgacgcaggtcgacc

SEQ ID NO: 107501 - DNA, 25 bp, E. coli
tacggaagtgtgtcgcaggtcgacc

SEQ ID NO: 107502 - DNA, 25 bp, E. coli
tacctcccgataaaaaaggaaggat

SEQ ID NO: 107503 - DNA, 25 bp, E. coli
agtgtgacgcagctcgaccttgtga

SEQ ID NO: 107504 - DNA, 25 bp, E. coli
agattatcgggacagttacctcccg

SEQ ID NO: 107505 - DNA, 25 bp, E. coli
agtgtgacgcaggtcgaccttgtga

SEQ ID NO: 107506 - DNA, 25 bp, E. coli
agattatcgggagagttacctcccg

SEQ ID NO: 107507 - DNA, 25 bp, E. coli
tatgaacgtgcataacaaatcgccg

SEQ ID NO: 107508 - DNA, 25 bp, E. coli
tatgaacgtgcaaaacaaatcgccg

SEQ ID NO: 107509 - DNA, 25 bp, E. coli
tgcatttactggtgaattaatcccg

SEQ ID NO: 107510 - DNA, 25 bp, E. coli
tgcatttactggagaattaatcccg

SEQ ID NO: 107511 - DNA, 25 bp, E. coli
ctgtatgatttataagattatcggg

SEQ ID NO: 107512 - DNA, 25 bp, E. coli
ctgtatgatttaaaagattatcggg

SEQ ID NO: 107513 - DNA, 25 bp, E. coli
tggagaattaatgccgctgtacgga

SEQ ID NO: 107514 - DNA, 25 bp, E. coli
tggagaattaatcccgctgtacgga

SEQ ID NO: 107515 - DNA, 25 bp, E. coli
taatcccgctgttcggaagtgtgac

SEQ ID NO: 107516 - DNA, 25 bp, E. coli
taatcccgctgtacggaagtgtgac

SEQ ID NO: 107517 - DNA, 25 bp, E. coli
aatatgtgaccttccaggacgacgc

SEQ ID NO: 107518 - DNA, 25 bp, E. coli
aatatgtgacctaccaggacgacgc

SEQ ID NO: 107519 - DNA, 25 bp, E. coli
caaatctgtgcgagataccatgctc

SEQ ID NO: 107520 - DNA, 25 bp, E. coli
caaatctgtgcgtgataccatgctc

SEQ ID NO: 107521 - DNA, 25 bp, E. coli
catgctctgtacctgtctggtcaac

SEQ ID NO: 107522 - DNA, 25 bp, E. coli
cataccggcaagtaagtcaccctga

SEQ ID NO: 107523 - DNA, 25 bp, E. coli
catgctctgtacgtgtctggtcaac

SEQ ID NO: 107524 - DNA, 25 bp, E. coli
cataccggcaagaaagtcaccctga

SEQ ID NO: 107525 - DNA, 25 bp, E. coli
taaacgtatcgttcaggcgacgggt

SEQ ID NO: 107526 - DNA, 25 bp, E. coli
taaacgtatcgtacaggcgacgggt

SEQ ID NO: 107527 - DNA, 25 bp, E. coli
tatcgaatatctgcagtcccgtggt

SEQ ID NO: 107528 - DNA, 25 bp, E. coli
tatcgcgtactgtacgaagacggcc

SEQ ID NO: 107529 - DNA, 25 bp, E. coli
tatcgcgtactgaacgaagacggcc

SEQ ID NO: 107530 - DNA, 25 bp, E. coli
tatcgaatatctccagtcccgtggt

SEQ ID NO: 107531 - DNA, 25 bp, E. coli
tgttatcgaagtaaacgcgccggaa

SEQ ID NO: 107532 - DNA, 25 bp, E. coli
tgtgcgtcacaaaatgctcgatgcg

SEQ ID NO: 107533 - DNA, 25 bp, E. coli
tgttatcgaagttaacgcgccggaa

SEQ ID NO: 107534 - DNA, 25 bp, E. coli
tgtgcgtcacaatatgctcgatgcg

SEQ ID NO: 107535 - DNA, 25 bp, E. coli
cttgacgccggtatcgacgagttga

SEQ ID NO: 107536 - DNA, 25 bp, E. coli
cttgacgccggtttcgacgagttga

SEQ ID NO: 107537 - DNA, 25 bp, E. coli
ggatttcaaccgaagagcacctcaa

SEQ ID NO: 107538 - DNA, 25 bp, E. coli
ggatttcaaccgtagagcacctcaa

SEQ ID NO: 107539 - DNA, 25 bp, E. coli
cacctggtggtgcatgtgacgctcc

SEQ ID NO: 107540 - DNA, 25 bp, E. coli
cacctggtggtggatgtgacgctcc

SEQ ID NO: 107541 - DNA, 25 bp, E. coli
tttgtcacagcttacaccacgtcgt

SEQ ID NO: 107542 - DNA, 25 bp, E. coli
tttgtcacagctaacaccacgtcgt

SEQ ID NO: 107543 - DNA, 25 bp, E. coli
gcatcggcagacaacgaaaccgtta

SEQ ID NO: 107544 - DNA, 25 bp, E. coli
gcatcggcagactacgaaaccgtta

SEQ ID NO: 107545 - DNA, 25 bp, E. coli
cgcgtgacgggctaatcgtactcaa

SEQ ID NO: 107546 - DNA, 25 bp, E. coli
cgcgtgacgggcaaatcgtactcaa

SEQ ID NO: 107547 - DNA, 25 bp, E. coli
cgaccggcattaggcgttgtgaagt

SEQ ID NO: 107548 - DNA, 25 bp, E. coli
cgaccggcattacgcgttgtgaagt

SEQ ID NO: 107549 - DNA, 25 bp, E. coli
cggcaatctggatctggcgaatgat

SEQ ID NO: 107550 - DNA, 25 bp, E. coli
cgtgctggctatctacgcccgtgaa

SEQ ID NO: 107551 - DNA, 25 bp, E. coli
cattccgcgtcaggtttctgtgccg

SEQ ID NO: 107552 - DNA, 25 bp, E. coli
cggcaatctggaactggcgaatgat

SEQ ID NO: 107553 - DNA, 25 bp, E. coli
cattccgcgtcacgtttctgtgccg

SEQ ID NO: 107554 - DNA, 25 bp, E. coli
cgtgctggctatgtacgcccgtgaa

SEQ ID NO: 107555 - DNA, 25 bp, E. coli
tggcgacaagccagatcacgatgat

SEQ ID NO: 107556 - DNA, 25 bp, E. coli
tggcgacaagcctgatcacgatgat

SEQ ID NO: 107557 - DNA, 25 bp, E. coli
taacgcgcgcttaggtggcattccg

SEQ ID NO: 107558 - DNA, 25 bp, E. coli
taacgcgcgctttggtggcattccg

SEQ ID NO: 107559 - DNA, 25 bp, E. coli
gagcctgaagctgcctacgatgaag

SEQ ID NO: 107560 - DNA, 25 bp, E. coli
gagcctgaagctccctacgatgaag

SEQ ID NO: 107561 - DNA, 25 bp, E. coli
caccgcaaggcgtggtggatttgca

SEQ ID NO: 107562 - DNA, 25 bp, E. coli
caccgcaaggcgaggtggatttgca

SEQ ID NO: 107563 - DNA, 25 bp, E. coli
atttgcacggttatgctaccaacgg

SEQ ID NO: 107564 - DNA, 25 bp, E. coli
accgcaaggcgtggtggatttgcac

SEQ ID NO: 107565 - DNA, 25 bp, E. coli
ttgcacggttttgctaccaacggtc

SEQ ID NO: 107566 - DNA, 25 bp, E. coli
atttgcacggttttgctaccaacgg

SEQ ID NO: 107567 - DNA, 25 bp, E. coli
ttgcacggttttcctaccaacggtc

SEQ ID NO: 107568 - DNA, 25 bp, E. coli
accgcaaggcgtcgtggatttgcac

SEQ ID NO: 107569 - DNA, 25 bp, E. coli
tttgcacggttttgctaccaacggt

SEQ ID NO: 107570 - DNA, 25 bp, E. coli
tttgcacggtttagctaccaacggt

SEQ ID NO: 107571 - DNA, 25 bp, E. coli
tggtggatttgctcggttttgctac

SEQ ID NO: 107572 - DNA, 25 bp, E. coli
tggtggatttgcacggttttgctac

SEQ ID NO: 107573 - DNA, 25 bp, E. coli
tcaccgcaaggcgtggtggatttgc

SEQ ID NO: 107574 - DNA, 25 bp, E. coli
ctgtcaccgcaaggcgtggtggatt

SEQ ID NO: 107575 - DNA, 25 bp, E. coli
ctgtcaccgcaacgcgtggtggatt

SEQ ID NO: 107576 - DNA, 25 bp, E. coli
gatttgcacggttttgctaccaacg

SEQ ID NO: 107577 - DNA, 25 bp, E. coli
gatttgcacggtattgctaccaacg

SEQ ID NO: 107578 - DNA, 25 bp, E. coli
ggtggatttgcacggttttgctacc

SEQ ID NO: 107579 - DNA, 25 bp, E. coli
ggtggatttgcagggttttgctacc

SEQ ID NO: 107580 - DNA, 25 bp, E. coli
tggatttgcacggttttgctaccaa

SEQ ID NO: 107581 - DNA, 25 bp, E. coli
tggatttgcacgcttttgctaccaa

SEQ ID NO: 107582 - DNA, 25 bp, E. coli
tcaccgcaaggcctggtggatttgc

SEQ ID NO: 107583 - DNA, 25 bp, E. coli
tacgttagttctgggcgcgttgctg

SEQ ID NO: 107584 - DNA, 25 bp, E. coli
tacgttagttctcggcgcgttgctg

SEQ ID NO: 107585 - DNA, 25 bp, E. coli
agtacagaccttccaaaccatcgat

SEQ ID NO: 107586 - DNA, 25 bp, E. coli
agtacagaccttgcaaaccatcgat

SEQ ID NO: 107587 - DNA, 25 bp, E. coli
aacgcagtacagtccttgcaaacca

SEQ ID NO: 107588 - DNA, 25 bp, E. coli
aacgcagtacagaccttgcaaacca

SEQ ID NO: 107589 - DNA, 25 bp, E. coli
tattctcggcaagaagtttgcgatt

SEQ ID NO: 107590 - DNA, 25 bp, E. coli
tatctcggtttatgcgatgcgtaaa

SEQ ID NO: 107591 - DNA, 25 bp, E. coli
tattctcggcaacaagtttgcgatt

SEQ ID NO: 107592 - DNA, 25 bp, E. coli
tatctcggtttaagcgatgcgtaaa

SEQ ID NO: 107593 - DNA, 25 bp, E. coli
tggtggtgttcgctatctcggttta

SEQ ID NO: 107594 - DNA, 25 bp, E. coli
tcggtatctcggtttatgcgatgcg

SEQ ID NO: 107595 - DNA, 25 bp, E. coli
tcggtatctcggattatgcgatgcg

SEQ ID NO: 107596 - DNA, 25 bp, E. coli
gaagtttgcgatacttgcgcgccgc

SEQ ID NO: 107597 - DNA, 25 bp, E. coli
gaagtttgcgattcttgcgcgccgc

SEQ ID NO: 107598 - DNA, 25 bp, E. coli
cggatgtcggcgctaattacgttag

SEQ ID NO: 107599 - DNA, 25 bp, E. coli
cggatgtcggcggtaattacgttag

SEQ ID NO: 107600 - DNA, 25 bp, E. coli
tgtcggcggtaaatacgttagttct

SEQ ID NO: 107601 - DNA, 25 bp, E. coli
tgtcggcggtaattacgttagttct

SEQ ID NO: 107602 - DNA, 25 bp, E. coli
ggtaattacgtttgttctcggcgcg

SEQ ID NO: 107603 - DNA, 25 bp, E. coli
ggtaattacgttagttctcggcgcg

SEQ ID NO: 107604 - DNA, 25 bp, E. coli
tggtggtgttcggtatctcggttta

SEQ ID NO: 107605 - DNA, 25 bp, E. coli
taaagatgcgcttgcgccgctctgg

SEQ ID NO: 107606 - DNA, 25 bp, E. coli
taaagatgcgctagcgccgctctgg

SEQ ID NO: 107607 - DNA, 25 bp, E. coli
agttcataaagaagcgcttgcgccg

SEQ ID NO: 107608 - DNA, 25 bp, E. coli
agttcataaagatgcgcttgcgccg

SEQ ID NO: 107609 - DNA, 25 bp, E. coli
ttaaaagaatatttccgggcaaggc

SEQ ID NO: 107610 - DNA, 25 bp, E. coli
ttaaaagaatatatccgggcaaggc

SEQ ID NO: 107611 - DNA, 25 bp, E. coli
ttaatagcacctcccaatctggatg

SEQ ID NO: 107612 - DNA, 25 bp, E. coli
ttgcgccgctctcgcagccattggg

SEQ ID NO: 107613 - DNA, 25 bp, E. coli
ttaatagcacctgccaatctggatg

SEQ ID NO: 107614 - DNA, 25 bp, E. coli
ttgcgccgctctggcagccattggg

SEQ ID NO: 107615 - DNA, 25 bp, E. coli
tctggcagccattgggtgtaacgca

SEQ ID NO: 107616 - DNA, 25 bp, E. coli
tctggatgtttagcaagttcataaa

SEQ ID NO: 107617 - DNA, 25 bp, E. coli
tctggatgtttaccaagttcataaa

SEQ ID NO: 107618 - DNA, 25 bp, E. coli
tctggcagccatagggtgtaacgca

SEQ ID NO: 107619 - DNA, 25 bp, E. coli
ccgggcaaggctggatcgtctgtat

SEQ ID NO: 107620 - DNA, 25 bp, E. coli
ccgggcaaggctcgatcgtctgtat

SEQ ID NO: 107621 - DNA, 25 bp, E. coli
gaatgagttgttaatagcacctgcc

SEQ ID NO: 107622 - DNA, 25 bp, E. coli
gaatgagttgtttatagcacctgcc

SEQ ID NO: 107623 - DNA, 25 bp, E. coli
cattgggtgtaacgcattttctggc

SEQ ID NO: 107624 - DNA, 25 bp, E. coli
cattgggtgtaaggcattttctggc

SEQ ID NO: 107625 - DNA, 25 bp, E. coli
gatcgtctgtatcttcaggaacagg

SEQ ID NO: 107626 - DNA, 25 bp, E. coli
gatcgtctgtatgttcaggaacagg

SEQ ID NO: 107627 - DNA, 25 bp, E. coli
cagctttgcatttcctgtcaggaaa

SEQ ID NO: 107628 - DNA, 25 bp, E. coli
cagcgcgttgaacaagaacgccagc

SEQ ID NO: 107629 - DNA, 25 bp, E. coli
cagcgcgttgaagaagaacgccagc

SEQ ID NO: 107630 - DNA, 25 bp, E. coli
cagctttgcattacctgtcaggaaa

SEQ ID NO: 107631 - DNA, 25 bp, E. coli
ttacctgtcaggtaatcgcagagct

SEQ ID NO: 107632 - DNA, 25 bp, E. coli
ttacctgtcaggaaatcgcagagct

SEQ ID NO: 107633 - DNA, 25 bp, E. coli
tcgcagagctgaaaggcaaacatta

SEQ ID NO: 107634 - DNA, 25 bp, E. coli
tcgcagagctgataggcaaacatta

SEQ ID NO: 107635 - DNA, 25 bp, E. coli
gccattccgggtctgcagctttgca

SEQ ID NO: 107636 - DNA, 25 bp, E. coli
gccattccgggtgtgcagctttgca

SEQ ID NO: 107637 - DNA, 25 bp, E. coli
gctttgcattgagtgtgaagcacca

SEQ ID NO: 107638 - DNA, 25 bp, E. coli
gctttgcattgactgtgaagcacca

SEQ ID NO: 107639 - DNA, 25 bp, E. coli
gaacgccagcgtgatatccgtactg

SEQ ID NO: 107640 - DNA, 25 bp, E. coli
gcaaacattacaacggaggtgctgt

SEQ ID NO: 107641 - DNA, 25 bp, E. coli
gaacgccagcgtcatatccgtactg

SEQ ID NO: 107642 - DNA, 25 bp, E. coli
gcaaacattacatcggaggtgctgt

SEQ ID NO: 107643 - DNA, 25 bp, E. coli
tggatctcgtactgcagcgcgttga

SEQ ID NO: 107644 - DNA, 25 bp, E. coli
ggcgtgtcccgcctgctttgcattg

SEQ ID NO: 107645 - DNA, 25 bp, E. coli
tggatctcgtacagcagcgcgttga

SEQ ID NO: 107646 - DNA, 25 bp, E. coli
ggcgtgtcccgcgtgctttgcattg

SEQ ID NO: 107647 - DNA, 25 bp, E. coli
gagtgtgaagcagcaattccgccag

SEQ ID NO: 107648 - DNA, 25 bp, E. coli
gagtgtgaagcaccaattccgccag

SEQ ID NO: 107649 - DNA, 25 bp, E. coli
caacttgaacctcgtcttggtggga

SEQ ID NO: 107650 - DNA, 25 bp, E. coli
caacttgaacctggtcttggtggga

SEQ ID NO: 107651 - DNA, 25 bp, E. coli
taaatctttcatcagtcaatgggcc

SEQ ID NO: 107652 - DNA, 25 bp, E. coli
taaacagcttgaggataatggcggt

SEQ ID NO: 107653 - DNA, 25 bp, E. coli
taaacagcttgacgataatggcggt

SEQ ID NO: 107654 - DNA, 25 bp, E. coli
taaatctttcatgagtcaatgggcc

SEQ ID NO: 107655 - DNA, 25 bp, E. coli
aaaaataactatgctccgtgagggc

SEQ ID NO: 107656 - DNA, 25 bp, E. coli
aaaaataactatcctccgtgagggc

SEQ ID NO: 107657 - DNA, 25 bp, E. coli
tgaagcggatgatagcaacctcgcg

SEQ ID NO: 107658 - DNA, 25 bp, E. coli
tgaagcggatgaaagcaacctcgcg

SEQ ID NO: 107659 - DNA, 25 bp, E. coli
tgcgaagcgacgtgcaatgcctttg

SEQ ID NO: 107660 - DNA, 25 bp, E. coli
tgcgaagcgacgagcaatgcctttg

SEQ ID NO: 107661 - DNA, 25 bp, E. coli
tcctcgtgaggaccaaatacctgta

SEQ ID NO: 107662 - DNA, 25 bp, E. coli
tcctcgtgaggagcaaatacctgta

SEQ ID NO: 107663 - DNA, 25 bp, E. coli
tctggacgggaactactaaatgcac

SEQ ID NO: 107664 - DNA, 25 bp, E. coli
tctggacgggaagtactaaatgcac

SEQ ID NO: 107665 - DNA, 25 bp, E. coli
gaaacgaccagcgtggatgactgca

SEQ ID NO: 107666 - DNA, 25 bp, E. coli
gaaacgaccagcctggatgactgca

SEQ ID NO: 107667 - DNA, 25 bp, E. coli
taatccaggttcgtattcgggtgcc

SEQ ID NO: 107668 - DNA, 25 bp, E. coli
taatccaggttcctattcgggtgcc

SEQ ID NO: 107669 - DNA, 25 bp, E. coli
gatgaaccaatcacacgtcaggagg

SEQ ID NO: 107670 - DNA, 25 bp, E. coli
gatgaaccaatctcacgtcaggagg

SEQ ID NO: 107671 - DNA, 25 bp, E. coli
caaaacagtattccaggtcacaggg

SEQ ID NO: 107672 - DNA, 25 bp, E. coli
caaaacagtattgcaggtcacaggg

SEQ ID NO: 107673 - DNA, 25 bp, E. coli
caggcttgcgagttatgtttgagaa

SEQ ID NO: 107674 - DNA, 25 bp, E. coli
caggcttgcgagatatgtttgagaa

SEQ ID NO: 107675 - DNA, 25 bp, E. coli
taaaaagacgcggactcatgtgaaa

SEQ ID NO: 107676 - DNA, 25 bp, E. coli
taaaaagacgcgcactcatgtgaaa

SEQ ID NO: 107677 - DNA, 25 bp, E. coli
tttgagaataccactttatcccgcg

SEQ ID NO: 107678 - DNA, 25 bp, E. coli
tagataaacagggtgggacacttca

SEQ ID NO: 107679 - DNA, 25 bp, E. coli
tttgagaatacctctttatcccgcg

SEQ ID NO: 107680 - DNA, 25 bp, E. coli
tagataaacaggctgggacacttca

SEQ ID NO: 107681 - DNA, 25 bp, E. coli
ttatcccgcgtcagggagaggcagt

SEQ ID NO: 107682 - DNA, 25 bp, E. coli
ttatcccgcgtctgggagaggcagt

SEQ ID NO: 107683 - DNA, 25 bp, E. coli
tgttgtcaacactagacaggcttgc

SEQ ID NO: 107684 - DNA, 25 bp, E. coli
tgttgtcaacacaagacaggcttgc

SEQ ID NO: 107685 - DNA, 25 bp, E. coli
gcaggtcacaggcttagcagaaaat

SEQ ID NO: 107686 - DNA, 25 bp, E. coli
gcaggtcacagggttagcagaaaat

SEQ ID NO: 107687 - DNA, 25 bp, E. coli
gaaatactggtttttagtgcgccag

SEQ ID NO: 107688 - DNA, 25 bp, E. coli
gaaatactggttattagtgcgccag

SEQ ID NO: 107689 - DNA, 25 bp, E. coli
gttaagtctcctagtcgatcacccg

SEQ ID NO: 107690 - DNA, 25 bp, E. coli
gatctctataatgtcgcgcaaccta

SEQ ID NO: 107691 - DNA, 25 bp, E. coli
gttaagtctccttgtcgatcacccg

SEQ ID NO: 107692 - DNA, 25 bp, E. coli
gatctctataatctcgcgcaaccta

SEQ ID NO: 107693 - DNA, 25 bp, E. coli
cagtcaagcatagggtccgctgcgg

SEQ ID NO: 107694 - DNA, 25 bp, E. coli
catacggtccgcagcggtcctgcgg

SEQ ID NO: 107695 - DNA, 25 bp, E. coli
cagtcaagcatacggtccgctgcgg

SEQ ID NO: 107696 - DNA, 25 bp, E. coli
catacggtccgctgcggtcctgcgg

SEQ ID NO: 107697 - DNA, 25 bp, E. coli
ataacctctttattgtcagttcagg

SEQ ID NO: 107698 - DNA, 25 bp, E. coli
ataacctctttaatgtcagttcagg

SEQ ID NO: 107699 - DNA, 25 bp, E. coli
tcatcagtcaaggatacggtccgct

SEQ ID NO: 107700 - DNA, 25 bp, E. coli
tcagggtgatacacatcagtcaagc

SEQ ID NO: 107701 - DNA, 25 bp, E. coli
tcatcagtcaagcatacggtccgct

SEQ ID NO: 107702 - DNA, 25 bp, E. coli
tcagggtgatactcatcagtcaagc

SEQ ID NO: 107703 - DNA, 25 bp, E. coli
gccaggactcctgtgatatccggaa

SEQ ID NO: 107704 - DNA, 25 bp, E. coli
gccaggactcctctgatatccggaa

SEQ ID NO: 107705 - DNA, 25 bp, E. coli
gcgtacacagcctggactcctgtga

SEQ ID NO: 107706 - DNA, 25 bp, E. coli
gcgtacacagccaggactcctgtga

SEQ ID NO: 107707 - DNA, 25 bp, E. coli
gcgttcggcgtagacagccaggact

SEQ ID NO: 107708 - DNA, 25 bp, E. coli
gcgttcggcgtacacagccaggact

SEQ ID NO: 107709 - DNA, 25 bp, E. coli
ctcctgtgatatgcggaacatccct

SEQ ID NO: 107710 - DNA, 25 bp, E. coli
ctcctgtgatatccggaacatccct

SEQ ID NO: 107711 - DNA, 25 bp, E. coli
gatactcatcagacaagcatacggt

SEQ ID NO: 107712 - DNA, 25 bp, E. coli
gatactcatcagtcaagcatacggt

SEQ ID NO: 107713 - DNA, 25 bp, E. coli
gtcctgcggcgttcggcgtacacag

SEQ ID NO: 107714 - DNA, 25 bp, E. coli
gtcctgcggcgtacggcgtacacag

SEQ ID NO: 107715 - DNA, 25 bp, E. coli
caggagtgatgagctcaaagctatc

SEQ ID NO: 107716 - DNA, 25 bp, E. coli
caggttggcttctcatccggtctca

SEQ ID NO: 107717 - DNA, 25 bp, E. coli
caggagtgatgacctcaaagctatc

SEQ ID NO: 107718 - DNA, 25 bp, E. coli
caggttggcttcacatccggtctca

SEQ ID NO: 107719 - DNA, 25 bp, E. coli
tacttcgaatatacccatgacggca

SEQ ID NO: 107720 - DNA, 25 bp, E. coli
tacttcgaatattcccatgacggca

SEQ ID NO: 107721 - DNA, 25 bp, E. coli
tatggaggagaaaaccgtccagccg

SEQ ID NO: 107722 - DNA, 25 bp, E. coli
tatggaggagaataccgtccagccg

SEQ ID NO: 107723 - DNA, 25 bp, E. coli
tttctgagcgccagcgatgacagga

SEQ ID NO: 107724 - DNA, 25 bp, E. coli
tttctgagcgcctgcgatgacagga

SEQ ID NO: 107725 - DNA, 25 bp, E. coli
gcttcagcgatgtggtcagccgtca

SEQ ID NO: 107726 - DNA, 25 bp, E. coli
gctgctgataccgtcaaaccctgat

SEQ ID NO: 107727 - DNA, 25 bp, E. coli
gctgctgataccctcaaaccctgat

SEQ ID NO: 107728 - DNA, 25 bp, E. coli
gcttcagcgatgaggtcagccgtca

SEQ ID NO: 107729 - DNA, 25 bp, E. coli
gcaggtcttacgaacccgtgagtcg

SEQ ID NO: 107730 - DNA, 25 bp, E. coli
gcaggtcttacgtacccgtgagtcg

SEQ ID NO: 107731 - DNA, 25 bp, E. coli
gaatgcgctttgaattgccgacaat

SEQ ID NO: 107732 - DNA, 25 bp, E. coli
gaatgcgctttgtattgccgacaat

SEQ ID NO: 107733 - DNA, 25 bp, E. coli
ggttgccacctcactgtttctgagc

SEQ ID NO: 107734 - DNA, 25 bp, E. coli
ggttgccacctctctgtttctgagc

SEQ ID NO: 107735 - DNA, 25 bp, E. coli
gagggtggcagtaactactatctgg

SEQ ID NO: 107736 - DNA, 25 bp, E. coli
gagggtggcagttactactatctgg

SEQ ID NO: 107737 - DNA, 25 bp, E. coli
caaattcagtatggtggacgccaaa

SEQ ID NO: 107738 - DNA, 25 bp, E. coli
cacttgcgggccagactcttggaaa

SEQ ID NO: 107739 - DNA, 25 bp, E. coli
caaattcagtatcgtggacgccaaa

SEQ ID NO: 107740 - DNA, 25 bp, E. coli
cacttgcgggcctgactcttggaaa

SEQ ID NO: 107741 - DNA, 25 bp, E. coli
tactgactatctcgagaatgccacc

SEQ ID NO: 107742 - DNA, 25 bp, E. coli
tactgactatctggagaatgccacc

SEQ ID NO: 107743 - DNA, 25 bp, E. coli
tatgaactttcctggctgaatgcga

SEQ ID NO: 107744 - DNA, 25 bp, E. coli
tatgcaaaccatgaggcacttgcgg

SEQ ID NO: 107745 - DNA, 25 bp, E. coli
tatgaactttccaggctgaatgcga

SEQ ID NO: 107746 - DNA, 25 bp, E. coli
tatgcaaaccatcaggcacttgcgg

SEQ ID NO: 107747 - DNA, 25 bp, E. coli
tatcgtcttgatcaactggaaggcc

SEQ ID NO: 107748 - DNA, 25 bp, E. coli
tttgtcccatcgaccacaagactgg

SEQ ID NO: 107749 - DNA, 25 bp, E. coli
tatcgtcttgatgaactggaaggcc

SEQ ID NO: 107750 - DNA, 25 bp, E. coli
tttgtcccatcgtccacaagactgg

SEQ ID NO: 107751 - DNA, 25 bp, E. coli
tttaataactgggatgaggtgcgcc

SEQ ID NO: 107752 - DNA, 25 bp, E. coli
tttaataactggcatgaggtgcgcc

SEQ ID NO: 107753 - DNA, 25 bp, E. coli
gctggagcgcgagttaagcacttgc

SEQ ID NO: 107754 - DNA, 25 bp, E. coli
gctggagcgcgacttaagcacttgc

SEQ ID NO: 107755 - DNA, 25 bp, E. coli
gattaccgggattcctatgacgcca

SEQ ID NO: 107756 - DNA, 25 bp, E. coli
gattaccgggatacctatgacgcca

SEQ ID NO: 107757 - DNA, 25 bp, E. coli
ggtctggacatttacccgtggcgca

SEQ ID NO: 107758 - DNA, 25 bp, E. coli
ggtctggacattaacccgtggcgca

SEQ ID NO: 107759 - DNA, 25 bp, E. coli
taggcgcgaccaacaaactggaaga

SEQ ID NO: 107760 - DNA, 25 bp, E. coli
tatgcatggcaaacgtccgaaggct

SEQ ID NO: 107761 - DNA, 25 bp, E. coli
tatgcatggcaatcgtccgaaggct

SEQ ID NO: 107762 - DNA, 25 bp, E. coli
taggcgcgaccatcaaactggaaga

SEQ ID NO: 107763 - DNA, 25 bp, E. coli
tattgaaaacgctgcgcgtgaaccg

SEQ ID NO: 107764 - DNA, 25 bp, E. coli
tattgaaaacgcagcgcgtgaaccg

SEQ ID NO: 107765 - DNA, 25 bp, E. coli
gaaggctgttaacgtacgtaccgcg

SEQ ID NO: 107766 - DNA, 25 bp, E. coli
gaaccggtagagatccagaacgtcc

SEQ ID NO: 107767 - DNA, 25 bp, E. coli
gaaggctgttaaggtacgtaccgcg

SEQ ID NO: 107768 - DNA, 25 bp, E. coli
gaaccggtagagttccagaacgtcc

SEQ ID NO: 107769 - DNA, 25 bp, E. coli
gaaaaccgctttatgcatgtgccag

SEQ ID NO: 107770 - DNA, 25 bp, E. coli
gaaaaccgctttttgcatgtgccag

SEQ ID NO: 107771 - DNA, 25 bp, E. coli
gaacttcctgattacgctgggtgcg

SEQ ID NO: 107772 - DNA, 25 bp, E. coli
gaacttcctgataacgctgggtgcg

SEQ ID NO: 107773 - DNA, 25 bp, E. coli
gataaagtcagccttggcgcaacgg

SEQ ID NO: 107774 - DNA, 25 bp, E. coli
gatatgcaggcccagttcacgctgt

SEQ ID NO: 107775 - DNA, 25 bp, E. coli
gataaagtcagcgttggcgcaacgg

SEQ ID NO: 107776 - DNA, 25 bp, E. coli
gatatgcaggccgagttcacgctgt

SEQ ID NO: 107777 - DNA, 25 bp, E. coli
taagccagctgggtgcgaaagtaga

SEQ ID NO: 107778 - DNA, 25 bp, E. coli
taagccagctggctgcgaaagtaga

SEQ ID NO: 107779 - DNA, 25 bp, E. coli
gatctgcgtgcaacagcaagcctgg

SEQ ID NO: 107780 - DNA, 25 bp, E. coli
gatctgcgtgcatcagcaagcctgg

SEQ ID NO: 107781 - DNA, 25 bp, E. coli
caaatggaaaacatgcctgcacggc

SEQ ID NO: 107782 - DNA, 25 bp, E. coli
caaatggaaaacttgcctgcacggc

SEQ ID NO: 107783 - DNA, 25 bp, E. coli
catatgaatagttgaggctcccgga

SEQ ID NO: 107784 - DNA, 25 bp, E. coli
caggctcgccagtaacgctaaattc

SEQ ID NO: 107785 - DNA, 25 bp, E. coli
caggctcgccagaaacgctaaattc

SEQ ID NO: 107786 - DNA, 25 bp, E. coli
catatgaatagtagaggctcccgga

SEQ ID NO: 107787 - DNA, 25 bp, E. coli
tatcgacgatgagaacaacgtgccc

SEQ ID NO: 107788 - DNA, 25 bp, E. coli
tatcgacgatgacaacaacgtgccc

SEQ ID NO: 107789 - DNA, 25 bp, E. coli
ttttagcacaggttaagagccgttc

SEQ ID NO: 107790 - DNA, 25 bp, E. coli
ttttagcacaggataagagccgttc

SEQ ID NO: 107791 - DNA, 25 bp, E. coli
tccgcgtcaggataattaaacagtt

SEQ ID NO: 107792 - DNA, 25 bp, E. coli
tccgcgtcaggaaaattaaacagtt

SEQ ID NO: 107793 - DNA, 25 bp, E. coli
tcatttggctgttagcgcggtgtca

SEQ ID NO: 107794 - DNA, 25 bp, E. coli
tcatttggctgtaagcgcggtgtca

SEQ ID NO: 107795 - DNA, 25 bp, E. coli
ccttcaaaattaagcgtagatggca

SEQ ID NO: 107796 - DNA, 25 bp, E. coli
ccttcaaaattatgcgtagatggca

SEQ ID NO: 107797 - DNA, 25 bp, E. coli
gctcccggaagaggtaaactgaacg

SEQ ID NO: 107798 - DNA, 25 bp, E. coli
gctcccggaagacgtaaactgaacg

SEQ ID NO: 107799 - DNA, 25 bp, E. coli
gaacgacgtctcatgctaaaacaca

SEQ ID NO: 107800 - DNA, 25 bp, E. coli
gaacgacgtctcttgctaaaacaca

SEQ ID NO: 107801 - DNA, 25 bp, E. coli
taattaatgtaatgaccaggctcgc

SEQ ID NO: 107802 - DNA, 25 bp, E. coli
taattaatgtaaagaccaggctcgc

SEQ ID NO: 107803 - DNA, 25 bp, E. coli
aagtgatggcagtgttccgtcgcgc

SEQ ID NO: 107804 - DNA, 25 bp, E. coli
caatatgatcgccaccgactggcgg

SEQ ID NO: 107805 - DNA, 25 bp, E. coli
caatatgatcgcgaccgactggcgg

SEQ ID NO: 107806 - DNA, 25 bp, E. coli
aagtgatggcagagttccgtcgcgc

SEQ ID NO: 107807 - DNA, 25 bp, E. coli
caaaaacgttctcacgctggtgcgt

SEQ ID NO: 107808 - DNA, 25 bp, E. coli
caaaaacgttctgacgctggtgcgt

SEQ ID NO: 107809 - DNA, 25 bp, E. coli
catgcgactggtatcgcctgcgtca

SEQ ID NO: 107810 - DNA, 25 bp, E. coli
catgcgactggtttcgcctgcgtca

SEQ ID NO: 107811 - DNA, 25 bp, E. coli
aacggtgcctggacgctgaacgaag

SEQ ID NO: 107812 - DNA, 25 bp, E. coli
aacggtgcctggtcgctgaacgaag

SEQ ID NO: 107813 - DNA, 25 bp, E. coli
taccgggatagatgcggcaatgctg

SEQ ID NO: 107814 - DNA, 25 bp, E. coli
taccgggatagaagcggcaatgctg

SEQ ID NO: 107815 - DNA, 25 bp, E. coli
ttacgctcgatcctaacggtgcctg

SEQ ID NO: 107816 - DNA, 25 bp, E. coli
ttacgctcgatcgtaacggtgcctg

SEQ ID NO: 107817 - DNA, 25 bp, E. coli
tgccgtatcaaagccagccggatga

SEQ ID NO: 107818 - DNA, 25 bp, E. coli
tgccgtatcaaacccagccggatga

SEQ ID NO: 107819 - DNA, 25 bp, E. coli
tcatgaagaagccatgacgccggat

SEQ ID NO: 107820 - DNA, 25 bp, E. coli
tcatgaagaagcgatgacgccggat

SEQ ID NO: 107821 - DNA, 25 bp, E. coli
gctgtatcagaatcacgggcttggc

SEQ ID NO: 107822 - DNA, 25 bp, E. coli
gctgtatcagaaacacgggcttggc

SEQ ID NO: 107823 - DNA, 25 bp, E. coli
tggtcaacagcgaagcgaagtcgaa

SEQ ID NO: 107824 - DNA, 25 bp, E. coli
tggtcaacagcgtagcgaagtcgaa

SEQ ID NO: 107825 - DNA, 25 bp, E. coli
aatggtgccgtgttccacatcgtgc

SEQ ID NO: 107826 - DNA, 25 bp, E. coli
aatggtgccgtgatccacatcgtgc

SEQ ID NO: 107827 - DNA, 25 bp, E. coli
taaaagtggcggagtgtttcaggca

SEQ ID NO: 107828 - DNA, 25 bp, E. coli
tatgatcctgggtggtgtggcgcag

SEQ ID NO: 107829 - DNA, 25 bp, E. coli
tatgatcctgggaggtgtggcgcag

SEQ ID NO: 107830 - DNA, 25 bp, E. coli
tgattgcggtggcatggtggaaccc

SEQ ID NO: 107831 - DNA, 25 bp, E. coli
tgattgcggtgggatggtggaaccc

SEQ ID NO: 107832 - DNA, 25 bp, E. coli
tgccgggcgtgatacaggtgaaaat

SEQ ID NO: 107833 - DNA, 25 bp, E. coli
tgccgggcgtgaaacaggtgaaaat

SEQ ID NO: 107834 - DNA, 25 bp, E. coli
tctgcccgtcttaatgagccgctgg

SEQ ID NO: 107835 - DNA, 25 bp, E. coli
tctgcccgtctttatgagccgctgg

SEQ ID NO: 107836 - DNA, 25 bp, E. coli
ccatccgggcgcaggccatgcagat

SEQ ID NO: 107837 - DNA, 25 bp, E. coli
ccatccgggcgctggccatgcagat

SEQ ID NO: 107838 - DNA, 25 bp, E. coli
ctgtatcgggtatgtatgcagcagg

SEQ ID NO: 107839 - DNA, 25 bp, E. coli
ctgtatcgggtaagtatgcagcagg

SEQ ID NO: 107840 - DNA, 25 bp, E. coli
gtgaaaatgaataatctgcccgtct

SEQ ID NO: 107841 - DNA, 25 bp, E. coli
gtgaaaatgaattatctgcccgtct

SEQ ID NO: 107842 - DNA, 25 bp, E. coli
ggccatgcagatcccggcgtttcgt

SEQ ID NO: 107843 - DNA, 25 bp, E. coli
ggccatgcagatgccggcgtttcgt

SEQ ID NO: 107844 - DNA, 25 bp, E. coli
taaaagtggcggtgtgtttcaggca

SEQ ID NO: 107845 - DNA, 25 bp, E. coli
taatgagccgctggcaaatggtgcc

SEQ ID NO: 107846 - DNA, 25 bp, E. coli
taatgagccgctcgcaaatggtgcc

SEQ ID NO: 107847 - DNA, 25 bp, E. coli
acatcgcgctgtcgggacgtcatcc

SEQ ID NO: 107848 - DNA, 25 bp, E. coli
acatcgcgctgtggggacgtcatcc

SEQ ID NO: 107849 - DNA, 25 bp, E. coli
tccaccgtgaggaaggtatcagccg

SEQ ID NO: 107850 - DNA, 25 bp, E. coli
tccaccgtgaggtaggtatcagccg

SEQ ID NO: 107851 - DNA, 25 bp, E. coli
tcatccggtatggttatgataatcc

SEQ ID NO: 107852 - DNA, 25 bp, E. coli
tcatccggtatgcttatgataatcc

SEQ ID NO: 107853 - DNA, 25 bp, E. coli
taatccgcacagtgaattaccggcc

SEQ ID NO: 107854 - DNA, 25 bp, E. coli
taatccgcacagagaattaccggcc

SEQ ID NO: 107855 - DNA, 25 bp, E. coli
ccgtgaggaaggaatcagccgttac

SEQ ID NO: 107856 - DNA, 25 bp, E. coli
gcgcagtatggactatgacctcgcc

SEQ ID NO: 107857 - DNA, 25 bp, E. coli
gcgcagtatggagtatgacctcgcc

SEQ ID NO: 107858 - DNA, 25 bp, E. coli
ccgcacagtgaattaccggccacga

SEQ ID NO: 107859 - DNA, 25 bp, E. coli
ccgtgaggaaggtatcagccgttac

SEQ ID NO: 107860 - DNA, 25 bp, E. coli
ccgcacagtgaaataccggccacga

SEQ ID NO: 107861 - DNA, 25 bp, E. coli
gtatggagtatgacctcgccggacg

SEQ ID NO: 107862 - DNA, 25 bp, E. coli
ggagtatgacctcgccggacgcatc

SEQ ID NO: 107863 - DNA, 25 bp, E. coli
ggtatgcttatgttaatccgcacag

SEQ ID NO: 107864 - DNA, 25 bp, E. coli
gtatggagtatgtcctcgccggacg

SEQ ID NO: 107865 - DNA, 25 bp, E. coli
ggtatgcttatgataatccgcacag

SEQ ID NO: 107866 - DNA, 25 bp, E. coli
tgaggaaggtatcagccgttaccgc

SEQ ID NO: 107867 - DNA, 25 bp, E. coli
ggagtatgacctggccggacgcatc

SEQ ID NO: 107868 - DNA, 25 bp, E. coli
tgaggaaggtatgagccgttaccgc

SEQ ID NO: 107869 - DNA, 25 bp, E. coli
caccgagaaagatgcgatcgacgcg

SEQ ID NO: 107870 - DNA, 25 bp, E. coli
caccgagaaagaagcgatcgacgcg

SEQ ID NO: 107871 - DNA, 25 bp, E. coli
taaatcgatgatatctgcgccagtg

SEQ ID NO: 107872 - DNA, 25 bp, E. coli
taaatcgatgatttctgcgccagtg

SEQ ID NO: 107873 - DNA, 25 bp, E. coli
tatcatcacaagtggtcagacctcc

SEQ ID NO: 107874 - DNA, 25 bp, E. coli
tatcatcacaagaggtcagacctcc

SEQ ID NO: 107875 - DNA, 25 bp, E. coli
tgacactgagcaagcataacccggt

SEQ ID NO: 107876 - DNA, 25 bp, E. coli
tgacactgagcatgcataacccggt

SEQ ID NO: 107877 - DNA, 25 bp, E. coli
gcgcacattcgtcggcagttcaaaa

SEQ ID NO: 107878 - DNA, 25 bp, E. coli
gcgcacattcgtgggcagttcaaaa

SEQ ID NO: 107879 - DNA, 25 bp, E. coli
gaatgccacccgatcacgtattggt

SEQ ID NO: 107880 - DNA, 25 bp, E. coli
gaatgccacccgttcacgtattggt

SEQ ID NO: 107881 - DNA, 25 bp, E. coli
cgccagtgtttcctggattccgcaa

SEQ ID NO: 107882 - DNA, 25 bp, E. coli
cgttaacgcgttcgatcaactcctg

SEQ ID NO: 107883 - DNA, 25 bp, E. coli
cgccagtgtttcgtggattccgcaa

SEQ ID NO: 107884 - DNA, 25 bp, E. coli
cgttaacgcgttggatcaactcctg

SEQ ID NO: 107885 - DNA, 25 bp, E. coli
gattactcatgagctggcggacctg

SEQ ID NO: 107886 - DNA, 25 bp, E. coli
gattactcatgacctggcggacctg

SEQ ID NO: 107887 - DNA, 25 bp, E. coli
gattccgcaaagagatgccgccgat

SEQ ID NO: 107888 - DNA, 25 bp, E. coli
gattccgcaaagtgatgccgccgat

SEQ ID NO: 107889 - DNA, 25 bp, E. coli
gatgcgatggatatcactggtggta

SEQ ID NO: 107890 - DNA, 25 bp, E. coli
gatgcgatggatttcactggtggta

SEQ ID NO: 107891 - DNA, 25 bp, E. coli
aatatgcttccgcatctgtacgcag

SEQ ID NO: 107892 - DNA, 25 bp, E. coli
caatctgcgaatcaaaaatatgctt

SEQ ID NO: 107893 - DNA, 25 bp, E. coli
caatctgcgaatgaaaaatatgctt

SEQ ID NO: 107894 - DNA, 25 bp, E. coli
aatatgcttccggatctgtacgcag

SEQ ID NO: 107895 - DNA, 25 bp, E. coli
caaaaatatgctaccggatctgtac

SEQ ID NO: 107896 - DNA, 25 bp, E. coli
caaaaatatgcttccggatctgtac

SEQ ID NO: 107897 - DNA, 25 bp, E. coli
atgcttccggatgtgtacgcagaag

SEQ ID NO: 107898 - DNA, 25 bp, E. coli
atgcttccggatctgtacgcagaag

SEQ ID NO: 107899 - DNA, 25 bp, E. coli
agttcctcgatgagcgtgggatcgt

SEQ ID NO: 107900 - DNA, 25 bp, E. coli
agttcctcgatgtgcgtgggatcgt

SEQ ID NO: 107901 - DNA, 25 bp, E. coli
tatgcttccggatctgtacgcagaa

SEQ ID NO: 107902 - DNA, 25 bp, E. coli
tatgcttccggaactgtacgcagaa

SEQ ID NO: 107903 - DNA, 25 bp, E. coli
tgagcgtgggatggtggtagagaaa

SEQ ID NO: 107904 - DNA, 25 bp, E. coli
tgagcgtgggatcgtggtagagaaa

SEQ ID NO: 107905 - DNA, 25 bp, E. coli
tgcgaatcaaaattatgcttccgga

SEQ ID NO: 107906 - DNA, 25 bp, E. coli
tgcgaatcaaaaatatgcttccgga

SEQ ID NO: 107907 - DNA, 25 bp, E. coli
tctgcgaatcaaaaatatgcttccg

SEQ ID NO: 107908 - DNA, 25 bp, E. coli
tctgcgaatcaataatatgcttccg

SEQ ID NO: 107909 - DNA, 25 bp, E. coli
gaatcaaaaatatgcttccggatct

SEQ ID NO: 107910 - DNA, 25 bp, E. coli
gaatcaaaaataagcttccggatct

SEQ ID NO: 107911 - DNA, 25 bp, E. coli
cgaagttcctcgatgagcgtgggat

SEQ ID NO: 107912 - DNA, 25 bp, E. coli
cgaagttcctcgttgagcgtgggat

SEQ ID NO: 107913 - DNA, 25 bp, E. coli
aatcatactctgaggcgaacgctgg

SEQ ID NO: 107914 - DNA, 25 bp, E. coli
caacgtgtggttattgctcgcgccc

SEQ ID NO: 107915 - DNA, 25 bp, E. coli
aatcatactctgtggcgaacgctgg

SEQ ID NO: 107916 - DNA, 25 bp, E. coli
caacgtgtggtttttgctcgcgccc

SEQ ID NO: 107917 - DNA, 25 bp, E. coli
aacaggttggcttgcctttcgacgc

SEQ ID NO: 107918 - DNA, 25 bp, E. coli
aacaggttggctagcctttcgacgc

SEQ ID NO: 107919 - DNA, 25 bp, E. coli
tagaaaaacgcgaccagactgcact

SEQ ID NO: 107920 - DNA, 25 bp, E. coli
tagaaaaacgcgtccagactgcact

SEQ ID NO: 107921 - DNA, 25 bp, E. coli
tgggcacaccatcaaaccaggaatg

SEQ ID NO: 107922 - DNA, 25 bp, E. coli
tgggcacaccatgaaaccaggaatg

SEQ ID NO: 107923 - DNA, 25 bp, E. coli
tctgctggtcagtcacgatgccgat

SEQ ID NO: 107924 - DNA, 25 bp, E. coli
tctgctggtcagacacgatgccgat

SEQ ID NO: 107925 - DNA, 25 bp, E. coli
cctcggcgttggttatgtcggtaca

SEQ ID NO: 107926 - DNA, 25 bp, E. coli
cctcggcgttggatatgtcggtaca

SEQ ID NO: 107927 - DNA, 25 bp, E. coli
cgcatatgtctgttcgagcggcatt

SEQ ID NO: 107928 - DNA, 25 bp, E. coli
cgcatatgtctgatcgagcggcatt

SEQ ID NO: 107929 - DNA, 25 bp, E. coli
gatctccgccgctatgtgcaaatgg

SEQ ID NO: 107930 - DNA, 25 bp, E. coli
gatctccgccgcaatgtgcaaatgg

SEQ ID NO: 107931 - DNA, 25 bp, E. coli
taattgctggataacagcgcgactg

SEQ ID NO: 107932 - DNA, 25 bp, E. coli
taattgctggattacagcgcgactg

SEQ ID NO: 107933 - DNA, 25 bp, E. coli
gatgtccgagggtaaaattcagcga

SEQ ID NO: 107934 - DNA, 25 bp, E. coli
gatgtccgagggaaaaattcagcga

SEQ ID NO: 107935 - DNA, 25 bp, E. coli
aagccgacacccacggcagctgtgg

SEQ ID NO: 107936 - DNA, 25 bp, E. coli
aagccgacaccctcggcagctgtgg

SEQ ID NO: 107937 - DNA, 25 bp, E. coli
caccctcggcagctgtggttacgtt

SEQ ID NO: 107938 - DNA, 25 bp, E. coli
caccctcggcaggtgtggttacgtt

SEQ ID NO: 107939 - DNA, 25 bp, E. coli
atgccagagggcagacctgcgaagc

SEQ ID NO: 107940 - DNA, 25 bp, E. coli
agccgacaccctgggcagctgtggt

SEQ ID NO: 107941 - DNA, 25 bp, E. coli
agccgacaccctcggcagctgtggt

SEQ ID NO: 107942 - DNA, 25 bp, E. coli
atgccagagggctgacctgcgaagc

SEQ ID NO: 107943 - DNA, 25 bp, E. coli
actggcacccgcaaccacctcataa

SEQ ID NO: 107944 - DNA, 25 bp, E. coli
actggcacccgctaccacctcataa

SEQ ID NO: 107945 - DNA, 25 bp, E. coli
tgtatgccagagggctgacctgcga

SEQ ID NO: 107946 - DNA, 25 bp, E. coli
tgtatgccagagcgctgacctgcga

SEQ ID NO: 107947 - DNA, 25 bp, E. coli
tgtttatccgactctggcacccgca

SEQ ID NO: 107948 - DNA, 25 bp, E. coli
tgtttatccgacactggcacccgca

SEQ ID NO: 107949 - DNA, 25 bp, E. coli
tgccagagggctcacctgcgaagcc

SEQ ID NO: 107950 - DNA, 25 bp, E. coli
tgccagagggctgacctgcgaagcc

SEQ ID NO: 107951 - DNA, 25 bp, E. coli
gaagccgacaccgtcggcagctgtg

SEQ ID NO: 107952 - DNA, 25 bp, E. coli
gaagccgacaccctcggcagctgtg

SEQ ID NO: 107953 - DNA, 25 bp, E. coli
gacaccctcggcagctgtggttacg

SEQ ID NO: 107954 - DNA, 25 bp, E. coli
gacaccctcggctgctgtggttacg

SEQ ID NO: 107955 - DNA, 25 bp, E. coli
gtatgccagaggcctgacctgcgaa

SEQ ID NO: 107956 - DNA, 25 bp, E. coli
gtatgccagagggctgacctgcgaa

SEQ ID NO: 107957 - DNA, 25 bp, E. coli
aattatcgatgtcgtctggagaggc

SEQ ID NO: 107958 - DNA, 25 bp, E. coli
aattatcgatgtggtctggagaggc

SEQ ID NO: 107959 - DNA, 25 bp, E. coli
taaagttcctcttatggtagagtaa

SEQ ID NO: 107960 - DNA, 25 bp, E. coli
taaagttcctctaatggtagagtaa

SEQ ID NO: 107961 - DNA, 25 bp, E. coli
tatggagtgaaatgtaacagatatc

SEQ ID NO: 107962 - DNA, 25 bp, E. coli
tatggagtgaaaagtaacagatatc

SEQ ID NO: 107963 - DNA, 25 bp, E. coli
tatcataatgatccgaaaactcttc

SEQ ID NO: 107964 - DNA, 25 bp, E. coli
tatcataatgatgcgaaaactcttc

SEQ ID NO: 107965 - DNA, 25 bp, E. coli
ttgactgcgagtttcgactttgcga

SEQ ID NO: 107966 - DNA, 25 bp, E. coli
ttaacatttgctagttgactgcgag

SEQ ID NO: 107967 - DNA, 25 bp, E. coli
ttaacatttgcttgttgactgcgag

SEQ ID NO: 107968 - DNA, 25 bp, E. coli
ttgactgcgagtatcgactttgcga

SEQ ID NO: 107969 - DNA, 25 bp, E. coli
tcgctcatacgaaactaatgattag

SEQ ID NO: 107970 - DNA, 25 bp, E. coli
tgcgaaaactcttcagctaatgtaa

SEQ ID NO: 107971 - DNA, 25 bp, E. coli
tcgctcatacgatactaatgattag

SEQ ID NO: 107972 - DNA, 25 bp, E. coli
tgcgaaaactctacagctaatgtaa

SEQ ID NO: 107973 - DNA, 25 bp, E. coli
tctggagaggcatctgtcaaaaatc

SEQ ID NO: 107974 - DNA, 25 bp, E. coli
tctggagaggcaactgtcaaaaatc

SEQ ID NO: 107975 - DNA, 25 bp, E. coli
gaaagtaattgcaaacagatgtcct

SEQ ID NO: 107976 - DNA, 25 bp, E. coli
gaaagtaattgctaacagatgtcct

SEQ ID NO: 107977 - DNA, 25 bp, E. coli
gagtaatatgatgtatacggaaaca

SEQ ID NO: 107978 - DNA, 25 bp, E. coli
gagtaatatgatctatacggaaaca

SEQ ID NO: 107979 - DNA, 25 bp, E. coli
acggatccccgccagattctgacgg

SEQ ID NO: 107980 - DNA, 25 bp, E. coli
acggatccccgcgagattctgacgg

SEQ ID NO: 107981 - DNA, 25 bp, E. coli
ttttgacgggtcagattttgatgcg

SEQ ID NO: 107982 - DNA, 25 bp, E. coli
ttttttgccagatttcgacgcatca

SEQ ID NO: 107983 - DNA, 25 bp, E. coli
ttttgacgggtctgattttgatgcg

SEQ ID NO: 107984 - DNA, 25 bp, E. coli
ttttttgccagaattcgacgcatca

SEQ ID NO: 107985 - DNA, 25 bp, E. coli
tgccagatttcgacgcatcaaattt

SEQ ID NO: 107986 - DNA, 25 bp, E. coli
tgccagatttcgtcgcatcaaattt

SEQ ID NO: 107987 - DNA, 25 bp, E. coli
gcatcaaattttcacgggtcagatt

SEQ ID NO: 107988 - DNA, 25 bp, E. coli
gcatcaaattttgacgggtcagatt

SEQ ID NO: 107989 - DNA, 25 bp, E. coli
gacgcatcaaatattgacgggtcag

SEQ ID NO: 107990 - DNA, 25 bp, E. coli
gacgcatcaaattttgacgggtcag

SEQ ID NO: 107991 - DNA, 25 bp, E. coli
cgccagattctgacgggtgaaaacc

SEQ ID NO: 107992 - DNA, 25 bp, E. coli
cgccagattctgtcgggtgaaaacc

SEQ ID NO: 107993 - DNA, 25 bp, E. coli
cgggtcagattttgatgcgtcagat

SEQ ID NO: 107994 - DNA, 25 bp, E. coli
cgggtcagatttagatgcgtcagat

SEQ ID NO: 107995 - DNA, 25 bp, E. coli
gatttcgacgcaacaaattttgacg

SEQ ID NO: 107996 - DNA, 25 bp, E. coli
gatttcgacgcatcaaattttgacg

SEQ ID NO: 107997 - DNA, 25 bp, E. coli
gatgcgtcagattttgacgggtcag

SEQ ID NO: 107998 - DNA, 25 bp, E. coli
gatgcgtcagatattgacgggtcag

SEQ ID NO: 107999 - DNA, 25 bp, E. coli
gatccccgccagtttctgacgggtg

SEQ ID NO: 108000 - DNA, 25 bp, E. coli
gatccccgccagattctgacgggtg

SEQ ID NO: 108001 - DNA, 25 bp, E. coli
caactcaattactgcaatgccctcg

SEQ ID NO: 108002 - DNA, 25 bp, E. coli
caactcaattacagcaatgccctcg

SEQ ID NO: 108003 - DNA, 25 bp, E. coli
caaactacttaacctgtgacagagc

SEQ ID NO: 108004 - DNA, 25 bp, E. coli
caaactacttaagctgtgacagagc

SEQ ID NO: 108005 - DNA, 25 bp, E. coli
caggaaagtggttaaactgcaactc

SEQ ID NO: 108006 - DNA, 25 bp, E. coli
caggaaagtggtaaaactgcaactc

SEQ ID NO: 108007 - DNA, 25 bp, E. coli
acgcagtctgtcactgtcaggaaag

SEQ ID NO: 108008 - DNA, 25 bp, E. coli
acgtggtttgatcgcgtagatgcac

SEQ ID NO: 108009 - DNA, 25 bp, E. coli
acgtggtttgatggcgtagatgcac

SEQ ID NO: 108010 - DNA, 25 bp, E. coli
acgcagtctgtctctgtcaggaaag

SEQ ID NO: 108011 - DNA, 25 bp, E. coli
tgtgacagagcctacacgcagtctg

SEQ ID NO: 108012 - DNA, 25 bp, E. coli
tgtgacagagccaacacgcagtctg

SEQ ID NO: 108013 - DNA, 25 bp, E. coli
tgcaatgccctcctaattaagtgaa

SEQ ID NO: 108014 - DNA, 25 bp, E. coli
tgcaatgccctcgtaattaagtgaa

SEQ ID NO: 108015 - DNA, 25 bp, E. coli
gaatttacaataacgtcctgttcgg

SEQ ID NO: 108016 - DNA, 25 bp, E. coli
gaatttacaatatcgtcctgttcgg

SEQ ID NO: 108017 - DNA, 25 bp, E. coli
gaacgcgggatgttcattcttcatc

SEQ ID NO: 108018 - DNA, 25 bp, E. coli
gaacgcgggatgatcattcttcatc

SEQ ID NO: 108019 - DNA, 25 bp, E. coli
tcgtcctgttcgcagggaagaacgc

SEQ ID NO: 108020 - DNA, 25 bp, E. coli
tcgtcctgttcggagggaagaacgc

SEQ ID NO: 108021 - DNA, 25 bp, E. coli
gatgcacgttgtcacatgtagatga

SEQ ID NO: 108022 - DNA, 25 bp, E. coli
gatgcacgttgtgacatgtagatga

SEQ ID NO: 108023 - DNA, 25 bp, E. coli
aaccactggtggacggcgatatccc

SEQ ID NO: 108024 - DNA, 25 bp, E. coli
aaccactggtggtcggcgatatccc

SEQ ID NO: 108025 - DNA, 25 bp, E. coli
caaatacccgatgcgcgaactggat

SEQ ID NO: 108026 - DNA, 25 bp, E. coli
caaatacccgatccgcgaactggat

SEQ ID NO: 108027 - DNA, 25 bp, E. coli
tacggcatgcgttccattggcggcg

SEQ ID NO: 108028 - DNA, 25 bp, E. coli
aaattctcagtgcttgtcgcaggcg

SEQ ID NO: 108029 - DNA, 25 bp, E. coli
aaattctcagtggttgtcgcaggcg

SEQ ID NO: 108030 - DNA, 25 bp, E. coli
tacggcatgcgtaccattggcggcg

SEQ ID NO: 108031 - DNA, 25 bp, E. coli
tttgtcatggcgcacatccgcgtcg

SEQ ID NO: 108032 - DNA, 25 bp, E. coli
tttgtcatggcggacatccgcgtcg

SEQ ID NO: 108033 - DNA, 25 bp, E. coli
tcggtattgaaagccggatggcgca

SEQ ID NO: 108034 - DNA, 25 bp, E. coli
tcggtattgaaacccggatggcgca

SEQ ID NO: 108035 - DNA, 25 bp, E. coli
gcgatatcccgcagtttcagaaagg

SEQ ID NO: 108036 - DNA, 25 bp, E. coli
gcgatatcccgctgtttcagaaagg

SEQ ID NO: 108037 - DNA, 25 bp, E. coli
gatcgcaaacagttgcgcgtgcgct

SEQ ID NO: 108038 - DNA, 25 bp, E. coli
tttagttacaccaccgatcctgaag

SEQ ID NO: 108039 - DNA, 25 bp, E. coli
ggatgaaaaaatcccgctgcgccac

SEQ ID NO: 108040 - DNA, 25 bp, E. coli
ggatgaaaaaatgccgctgcgccac

SEQ ID NO: 108041 - DNA, 25 bp, E. coli
tttagttacacctccgatcctgaag

SEQ ID NO: 108042 - DNA, 25 bp, E. coli
ggtggaagcacctttacgccaggca

SEQ ID NO: 108043 - DNA, 25 bp, E. coli
ggtggaagcaccattacgccaggca

SEQ ID NO: 108044 - DNA, 25 bp, E. coli
gatcgcaaacagatgcgcgtgcgct

SEQ ID NO: 108045 - DNA, 25 bp, E. coli
catcgcggcaaaacgcgtccattga

SEQ ID NO: 108046 - DNA, 25 bp, E. coli
catcgcggcaaatcgcgtccattga

SEQ ID NO: 108047 - DNA, 25 bp, E. coli
aaaacgcgtccaatgaatatagcca

SEQ ID NO: 108048 - DNA, 25 bp, E. coli
aaaacgcgtccattgaatatagcca

SEQ ID NO: 108049 - DNA, 25 bp, E. coli
tagccaatattttaaccacccgatc

SEQ ID NO: 108050 - DNA, 25 bp, E. coli
tagccaatatttaaaccacccgatc

SEQ ID NO: 108051 - DNA, 25 bp, E. coli
tatagccaatatttaaaccacccga

SEQ ID NO: 108052 - DNA, 25 bp, E. coli
tatagccaatatataaaccacccga

SEQ ID NO: 108053 - DNA, 25 bp, E. coli
tgtcatcgcggctaaacgcgtccat

SEQ ID NO: 108054 - DNA, 25 bp, E. coli
tgtcatcgcggcaaaacgcgtccat

SEQ ID NO: 108055 - DNA, 25 bp, E. coli
tcctgattagctatgtgtatttggc

SEQ ID NO: 108056 - DNA, 25 bp, E. coli
tcctgattagctttgtgtatttggc

SEQ ID NO: 108057 - DNA, 25 bp, E. coli
gcctgatatgtcatcgcggcaaaac

SEQ ID NO: 108058 - DNA, 25 bp, E. coli
gcctgatatgtcttcgcggcaaaac

SEQ ID NO: 108059 - DNA, 25 bp, E. coli
gcggcaaaacgcctccattgaatat

SEQ ID NO: 108060 - DNA, 25 bp, E. coli
gcggcaaaacgcgtccattgaatat

SEQ ID NO: 108061 - DNA, 25 bp, E. coli
cgcgtccattgaatatagccaatat

SEQ ID NO: 108062 - DNA, 25 bp, E. coli
cgcgtccattgattatagccaatat

SEQ ID NO: 108063 - DNA, 25 bp, E. coli
ctgatatgtcatggcggcaaaacgc

SEQ ID NO: 108064 - DNA, 25 bp, E. coli
ctgatatgtcatcgcggcaaaacgc

SEQ ID NO: 108065 - DNA, 25 bp, E. coli
tgtgtttactcctgattagctatgt

SEQ ID NO: 108066 - DNA, 25 bp, E. coli
tgtgtttactccagattagctatgt

SEQ ID NO: 108067 - DNA, 25 bp, E. coli
aggcgcggttgccacctctacgatg

SEQ ID NO: 108068 - DNA, 25 bp, E. coli
ataaaattctgagtatcttacaggg

SEQ ID NO: 108069 - DNA, 25 bp, E. coli
aggcgcggttgcgacctctacgatg

SEQ ID NO: 108070 - DNA, 25 bp, E. coli
ataaaattctgactatcttacaggg

SEQ ID NO: 108071 - DNA, 25 bp, E. coli
tcggtatcgaagcattacaaaataa

SEQ ID NO: 108072 - DNA, 25 bp, E. coli
tccgttagttcacggcatgcctttt

SEQ ID NO: 108073 - DNA, 25 bp, E. coli
tccgttagttcagggcatgcctttt

SEQ ID NO: 108074 - DNA, 25 bp, E. coli
tcggtatcgaaggattacaaaataa

SEQ ID NO: 108075 - DNA, 25 bp, E. coli
ccagtgtcgggttaatgaaatagaa

SEQ ID NO: 108076 - DNA, 25 bp, E. coli
ccagtgtcgggtaaatgaaatagaa

SEQ ID NO: 108077 - DNA, 25 bp, E. coli
gaagaaattaaacagttgtgtcaga

SEQ ID NO: 108078 - DNA, 25 bp, E. coli
gaagaaattaaagagttgtgtcaga

SEQ ID NO: 108079 - DNA, 25 bp, E. coli
cctgttgaattaatccagtgtcggg

SEQ ID NO: 108080 - DNA, 25 bp, E. coli
cctgttgaattattccagtgtcggg

SEQ ID NO: 108081 - DNA, 25 bp, E. coli
gtgcatttgatatgcaccactgcca

SEQ ID NO: 108082 - DNA, 25 bp, E. coli
gtgcatttgataagcaccactgcca

SEQ ID NO: 108083 - DNA, 25 bp, E. coli
ggcgatattccgttagttcacggca

SEQ ID NO: 108084 - DNA, 25 bp, E. coli
ggcgatattccgatagttcacggca

SEQ ID NO: 108085 - DNA, 25 bp, E. coli
ggatcgtagtttaggcgatattccg

SEQ ID NO: 108086 - DNA, 25 bp, E. coli
ggatcgtagttttggcgatattccg

SEQ ID NO: 108087 - DNA, 25 bp, E. coli
gacctctacgatggcggcggaagaa

SEQ ID NO: 108088 - DNA, 25 bp, E. coli
gacctctacgatcgcggcggaagaa

SEQ ID NO: 108089 - DNA, 25 bp, E. coli
cagagcatgatgattcgccaggcac

SEQ ID NO: 108090 - DNA, 25 bp, E. coli
cagagcatgatgtttcgccaggcac

SEQ ID NO: 108091 - DNA, 25 bp, E. coli
tatctgcctggccaaattagtgtgg

SEQ ID NO: 108092 - DNA, 25 bp, E. coli
tttacaaaccgaccctgaaagtcag

SEQ ID NO: 108093 - DNA, 25 bp, E. coli
tttacaaaccgagcctgaaagtcag

SEQ ID NO: 108094 - DNA, 25 bp, E. coli
tatgcctgcaaacgcggcgtctgtg

SEQ ID NO: 108095 - DNA, 25 bp, E. coli
tatctgcctggcgaaattagtgtgg

SEQ ID NO: 108096 - DNA, 25 bp, E. coli
tatgcctgcaaaggcggcgtctgtg

SEQ ID NO: 108097 - DNA, 25 bp, E. coli
ttaacagtggcataagtcgagtcgg

SEQ ID NO: 108098 - DNA, 25 bp, E. coli
ttaacagtggcaaaagtcgagtcgg

SEQ ID NO: 108099 - DNA, 25 bp, E. coli
tctggaaccggaagaactggccgca

SEQ ID NO: 108100 - DNA, 25 bp, E. coli
tctggaaccggatgaactggccgca

SEQ ID NO: 108101 - DNA, 25 bp, E. coli
gcatttatttgtcgtccggcggcga

SEQ ID NO: 108102 - DNA, 25 bp, E. coli
gcatttatttgtggtccggcggcga

SEQ ID NO: 108103 - DNA, 25 bp, E. coli
gcagcaggatcaggtattacgccaa

SEQ ID NO: 108104 - DNA, 25 bp, E. coli
gcagcaggatcacgtattacgccaa

SEQ ID NO: 108105 - DNA, 25 bp, E. coli
gacagcgatctgcttcacgggcgta

SEQ ID NO: 108106 - DNA, 25 bp, E. coli
gacagcgatctggttcacgggcgta

SEQ ID NO: 108107 - DNA, 25 bp, E. coli
cgatgatggatgacgcggaaaccgc

SEQ ID NO: 108108 - DNA, 25 bp, E. coli
cgatgatggatgtcgcggaaaccgc

SEQ ID NO: 108109 - DNA, 25 bp, E. coli
gatgcggtgacctttacctttgcgg

SEQ ID NO: 108110 - DNA, 25 bp, E. coli
gatgcggtgaccattacctttgcgg

SEQ ID NO: 108111 - DNA, 25 bp, E. coli
agataattattggtgctgaccgcga

SEQ ID NO: 108112 - DNA, 25 bp, E. coli
agataattattgctgctgaccgcga

SEQ ID NO: 108113 - DNA, 25 bp, E. coli
tatgggctgcagaatgagaaacgac

SEQ ID NO: 108114 - DNA, 25 bp, E. coli
tatgggctgcagtatgagaaacgac

SEQ ID NO: 108115 - DNA, 25 bp, E. coli
tttcagcgacccaatgagtgccagg

SEQ ID NO: 108116 - DNA, 25 bp, E. coli
tttcagcgaccctatgagtgccagg

SEQ ID NO: 108117 - DNA, 25 bp, E. coli
tctggtctacatggaggctaacggc

SEQ ID NO: 108118 - DNA, 25 bp, E. coli
tctggtctacatcgaggctaacggc

SEQ ID NO: 108119 - DNA, 25 bp, E. coli
gcccgcacgataagaagcactggtt

SEQ ID NO: 108120 - DNA, 25 bp, E. coli
gcccgcacgatatgaagcactggtt

SEQ ID NO: 108121 - DNA, 25 bp, E. coli
gaaaattgcgtctctcgtggaaacc

SEQ ID NO: 108122 - DNA, 25 bp, E. coli
gaaaattgcgtcactcgtggaaacc

SEQ ID NO: 108123 - DNA, 25 bp, E. coli
cgtttgtttgataagtcccgccaga

SEQ ID NO: 108124 - DNA, 25 bp, E. coli
cgtttgtttgattagtcccgccaga

SEQ ID NO: 108125 - DNA, 25 bp, E. coli
gattttgcccgtgatgtcgctgcgc

SEQ ID NO: 108126 - DNA, 25 bp, E. coli
gatacccggacacgattgttcagcc

SEQ ID NO: 108127 - DNA, 25 bp, E. coli
gattttgcccgtcatgtcgctgcgc

SEQ ID NO: 108128 - DNA, 25 bp, E. coli
gatacccggacaggattgttcagcc

SEQ ID NO: 108129 - DNA, 25 bp, E. coli
taatattgttccacgtcagcctcga

SEQ ID NO: 108130 - DNA, 25 bp, E. coli
tcaagaattttagctgcgctgggcg

SEQ ID NO: 108131 - DNA, 25 bp, E. coli
taatattgttcctcgtcagcctcga

SEQ ID NO: 108132 - DNA, 25 bp, E. coli
tcaagaattttacctgcgctgggcg

SEQ ID NO: 108133 - DNA, 25 bp, E. coli
aattggttacctaacatctcatcga

SEQ ID NO: 108134 - DNA, 25 bp, E. coli
aattggttaccttacatctcatcga

SEQ ID NO: 108135 - DNA, 25 bp, E. coli
tcacaaagttgtgttacgaaggttg

SEQ ID NO: 108136 - DNA, 25 bp, E. coli
tcacaaagttgtcttacgaaggttg

SEQ ID NO: 108137 - DNA, 25 bp, E. coli
cagattacacggacacctggaaagg

SEQ ID NO: 108138 - DNA, 25 bp, E. coli
cattttactttttatcgccgctggc

SEQ ID NO: 108139 - DNA, 25 bp, E. coli
cagattacacggtcacctggaaagg

SEQ ID NO: 108140 - DNA, 25 bp, E. coli
tatgagggtgttctaatccatgtcg

SEQ ID NO: 108141 - DNA, 25 bp, E. coli
taccaaagggtagttcagattacac

SEQ ID NO: 108142 - DNA, 25 bp, E. coli
tatgagggtgttgtaatccatgtcg

SEQ ID NO: 108143 - DNA, 25 bp, E. coli
taccaaagggtacttcagattacac

SEQ ID NO: 108144 - DNA, 25 bp, E. coli
tttgtaagggcaacacctcagcctg

SEQ ID NO: 108145 - DNA, 25 bp, E. coli
tttgtaagggcatcacctcagcctg

SEQ ID NO: 108146 - DNA, 25 bp, E. coli
tgcaggcaggcactgaagataccaa

SEQ ID NO: 108147 - DNA, 25 bp, E. coli
tgcaggcaggcagtgaagataccaa

SEQ ID NO: 108148 - DNA, 25 bp, E. coli
gccgctggcggtgcaaagttcacaa

SEQ ID NO: 108149 - DNA, 25 bp, E. coli
gccgctggcggtccaaagttcacaa

SEQ ID NO: 108150 - DNA, 25 bp, E. coli
cattttacttttaatcgccgctggc

SEQ ID NO: 108151 - DNA, 25 bp, E. coli
tggaaacgcatttgccgaatcggca

SEQ ID NO: 108152 - DNA, 25 bp, E. coli
tggaaacgcattagccgaatcggca

SEQ ID NO: 108153 - DNA, 25 bp, E. coli
taagagcttagatcaggtgattgcc

SEQ ID NO: 108154 - DNA, 25 bp, E. coli
taagagcttagaacaggtgattgcc

SEQ ID NO: 108155 - DNA, 25 bp, E. coli
caatctggcgctgcatgttgacggt

SEQ ID NO: 108156 - DNA, 25 bp, E. coli
caatctggcgctccatgttgacggt

SEQ ID NO: 108157 - DNA, 25 bp, E. coli
cacgctaccgctcgataaagtggcg

SEQ ID NO: 108158 - DNA, 25 bp, E. coli
cacgctaccgctggataaagtggcg

SEQ ID NO: 108159 - DNA, 25 bp, E. coli
catgctcgaagccatgatggccgcc

SEQ ID NO: 108160 - DNA, 25 bp, E. coli
catgctcgaagcgatgatggccgcc

SEQ ID NO: 108161 - DNA, 25 bp, E. coli
taaacgtgccattcgctggcggaaa

SEQ ID NO: 108162 - DNA, 25 bp, E. coli
taaacgtgccatacgctggcggaaa

SEQ ID NO: 108163 - DNA, 25 bp, E. coli
aactatctgtttcaagccggtggcg

SEQ ID NO: 108164 - DNA, 25 bp, E. coli
aactatctgtttgaagccggtggcg

SEQ ID NO: 108165 - DNA, 25 bp, E. coli
tgattaacgcctcgccgattgtccg

SEQ ID NO: 108166 - DNA, 25 bp, E. coli
tgattaacgcctggccgattgtccg

SEQ ID NO: 108167 - DNA, 25 bp, E. coli
cctgtcgaaaggacttgggacgcca

SEQ ID NO: 108168 - DNA, 25 bp, E. coli
cctgtcgaaaggtcttgggacgcca

SEQ ID NO: 108169 - DNA, 25 bp, E. coli
gaagaaaatgctcccgcgttaggcg

SEQ ID NO: 108170 - DNA, 25 bp, E. coli
gaagaaaatgctgccgcgttaggcg

SEQ ID NO: 108171 - DNA, 25 bp, E. coli
ggtcaggccgcgcataactatctgt

SEQ ID NO: 108172 - DNA, 25 bp, E. coli
ggtcaggccgcggataactatctgt

SEQ ID NO: 108173 - DNA, 25 bp, E. coli
gacggtgcgcgcttctttaatgccg

SEQ ID NO: 108174 - DNA, 25 bp, E. coli
gacggtgcgcgcatctttaatgccg

SEQ ID NO: 108175 - DNA, 25 bp, E. coli
gaccctaccgttaatgctctgcagg

SEQ ID NO: 108176 - DNA, 25 bp, E. coli
gaccctaccgtttatgctctgcagg

SEQ ID NO: 108177 - DNA, 25 bp, E. coli
caaaaagccattctgggccgctggt

SEQ ID NO: 108178 - DNA, 25 bp, E. coli
caaaaagccattgtgggccgctggt

SEQ ID NO: 108179 - DNA, 25 bp, E. coli
tacacgagcagggagatgagcgtca

SEQ ID NO: 108180 - DNA, 25 bp, E. coli
tacacgagcaggcagatgagcgtca

SEQ ID NO: 108181 - DNA, 25 bp, E. coli
acattggcgataactacggctggca

SEQ ID NO: 108182 - DNA, 25 bp, E. coli
acattggcgatatctacggctggca

SEQ ID NO: 108183 - DNA, 25 bp, E. coli
tcagtgccagacgtaaacatgtgct

SEQ ID NO: 108184 - DNA, 25 bp, E. coli
gaaatatttgccctcagcgatgcca

SEQ ID NO: 108185 - DNA, 25 bp, E. coli
gaaatatttgccgtcagcgatgcca

SEQ ID NO: 108186 - DNA, 25 bp, E. coli
gtatggatattgtcccggacacgcc

SEQ ID NO: 108187 - DNA, 25 bp, E. coli
gttcgctcaacaacaaaacgccggg

SEQ ID NO: 108188 - DNA, 25 bp, E. coli
gatatgcagcaggttgaccacgacg

SEQ ID NO: 108189 - DNA, 25 bp, E. coli
gttcgctcaacatcaaaacgccggg

SEQ ID NO: 108190 - DNA, 25 bp, E. coli
gtatggatattgacccggacacgcc

SEQ ID NO: 108191 - DNA, 25 bp, E. coli
gatattcgtaaaccgagccacgcca

SEQ ID NO: 108192 - DNA, 25 bp, E. coli
gatatgcagcagcttgaccacgacg

SEQ ID NO: 108193 - DNA, 25 bp, E. coli
gatattcgtaaagcgagccacgcca

SEQ ID NO: 108194 - DNA, 25 bp, E. coli
tggatgaacctaggcgcggcattga

SEQ ID NO: 108195 - DNA, 25 bp, E. coli
tggatgaacctacgcgcggcattga

SEQ ID NO: 108196 - DNA, 25 bp, E. coli
ggaaaacatctatctcggccagctg

SEQ ID NO: 108197 - DNA, 25 bp, E. coli
ggaaaacatctaactcggccagctg

SEQ ID NO: 108198 - DNA, 25 bp, E. coli
tcagtgccagacctaaacatgtgct

SEQ ID NO: 108199 - DNA, 25 bp, E. coli
tacgcacccacaataagcggttggc

SEQ ID NO: 108200 - DNA, 25 bp, E. coli
taaagcccggctacactggctctgg

SEQ ID NO: 108201 - DNA, 25 bp, E. coli
tacgcacccacattaagcggttggc

SEQ ID NO: 108202 - DNA, 25 bp, E. coli
taaagcccggcttcactggctctgg

SEQ ID NO: 108203 - DNA, 25 bp, E. coli
aaatattcaccctacgcattgagcg

SEQ ID NO: 108204 - DNA, 25 bp, E. coli
aaatattcacccaacgcattgagcg

SEQ ID NO: 108205 - DNA, 25 bp, E. coli
ccgggagctactcgcactgcttaca

SEQ ID NO: 108206 - DNA, 25 bp, E. coli
ccgggagctactggcactgcttaca

SEQ ID NO: 108207 - DNA, 25 bp, E. coli
gaaccgatcaaaggtgccgggagct

SEQ ID NO: 108208 - DNA, 25 bp, E. coli
gaaccgatcaaacgtgccgggagct

SEQ ID NO: 108209 - DNA, 25 bp, E. coli
gaagaataagcaactgaccggcaaa

SEQ ID NO: 108210 - DNA, 25 bp, E. coli
gaagaataagcatctgaccggcaaa

SEQ ID NO: 108211 - DNA, 25 bp, E. coli
cgctcagttgagttccacgaaaaag

SEQ ID NO: 108212 - DNA, 25 bp, E. coli
cgctcagttgagatccacgaaaaag

SEQ ID NO: 108213 - DNA, 25 bp, E. coli
ggtacgcgtacaacaccaaaacagg

SEQ ID NO: 108214 - DNA, 25 bp, E. coli
ggtacgcgtacatcaccaaaacagg

SEQ ID NO: 108215 - DNA, 25 bp, E. coli
gtaataatctgaggctacgcaccca

SEQ ID NO: 108216 - DNA, 25 bp, E. coli
gtaataatctgacgctacgcaccca

SEQ ID NO: 108217 - DNA, 25 bp, E. coli
taagcggttggcacgtaaacaatct

SEQ ID NO: 108218 - DNA, 25 bp, E. coli
taagcggttggctcgtaaacaatct

SEQ ID NO: 108219 - DNA, 25 bp, E. coli
gatgagcaatggtgctacgttggca

SEQ ID NO: 108220 - DNA, 25 bp, E. coli
gatgagcaatggagctacgttggca

SEQ ID NO: 108221 - DNA, 25 bp, E. coli
gaattttttggtctcacgacgccca

SEQ ID NO: 108222 - DNA, 25 bp, E. coli
gaattttttggtgtcacgacgccca

SEQ ID NO: 108223 - DNA, 25 bp, E. coli
taaagacggcgtaatgcacaccgac

SEQ ID NO: 108224 - DNA, 25 bp, E. coli
taaagacggcgttatgcacaccgac

SEQ ID NO: 108225 - DNA, 25 bp, E. coli
tatgccgccgatcaatggtgccgag

SEQ ID NO: 108226 - DNA, 25 bp, E. coli
tatgccgccgatgaatggtgccgag

SEQ ID NO: 108227 - DNA, 25 bp, E. coli
tattgagcgtagatgccctgatgcg

SEQ ID NO: 108228 - DNA, 25 bp, E. coli
tattgagcgtagttgccctgatgcg

SEQ ID NO: 108229 - DNA, 25 bp, E. coli
tgctaacgatgaaccctggctgggt

SEQ ID NO: 108230 - DNA, 25 bp, E. coli
tgaattaaccggtcaggctggtgcg

SEQ ID NO: 108231 - DNA, 25 bp, E. coli
tgctaacgatgatccctggctgggt

SEQ ID NO: 108232 - DNA, 25 bp, E. coli
tgaattaaccggacaggctggtgcg

SEQ ID NO: 108233 - DNA, 25 bp, E. coli
gcaagattaacagtctggcgctgga

SEQ ID NO: 108234 - DNA, 25 bp, E. coli
gcaagattaacactctggcgctgga

SEQ ID NO: 108235 - DNA, 25 bp, E. coli
cccgttttcaggcatcgtggagcga

SEQ ID NO: 108236 - DNA, 25 bp, E. coli
cccgttttcagggatcgtggagcga

SEQ ID NO: 108237 - DNA, 25 bp, E. coli
gatacacggatcacgatggacggca

SEQ ID NO: 108238 - DNA, 25 bp, E. coli
gatacacggatctcgatggacggca

SEQ ID NO: 108239 - DNA, 25 bp, E. coli
taaccccattgttggcgcggcagtg

SEQ ID NO: 108240 - DNA, 25 bp, E. coli
taaccccattgtaggcgcggcagtg

SEQ ID NO: 108241 - DNA, 25 bp, E. coli
gatgatggttcagaagcctggcgct

SEQ ID NO: 108242 - DNA, 25 bp, E. coli
gatgatggttcacaagcctggcgct

SEQ ID NO: 108243 - DNA, 25 bp, E. coli
taccgctactgtgggagatgttccc

SEQ ID NO: 108244 - DNA, 25 bp, E. coli
taccgctactgtcggagatgttccc

SEQ ID NO: 108245 - DNA, 25 bp, E. coli
ttttcacaccatctacggcgagccg

SEQ ID NO: 108246 - DNA, 25 bp, E. coli
ttttcacaccatgtacggcgagccg

SEQ ID NO: 108247 - DNA, 25 bp, E. coli
tgaaaagctggaagaagtcaccgcc

SEQ ID NO: 108248 - DNA, 25 bp, E. coli
tgaaaagctggatgaagtcaccgcc

SEQ ID NO: 108249 - DNA, 25 bp, E. coli
ccaacgtcactaaacgaggcggcgt

SEQ ID NO: 108250 - DNA, 25 bp, E. coli
ccaacgtcactatacgaggcggcgt

SEQ ID NO: 108251 - DNA, 25 bp, E. coli
gcaaaaccattgaagcagcggaagg

SEQ ID NO: 108252 - DNA, 25 bp, E. coli
gcaaaaccattgtagcagcggaagg

SEQ ID NO: 108253 - DNA, 25 bp, E. coli
ggtagctggctgctgaacgatcaac

SEQ ID NO: 108254 - DNA, 25 bp, E. coli
ggtagctggctggtgaacgatcaac

SEQ ID NO: 108255 - DNA, 25 bp, E. coli
ggaagatcagctaaacgccggtaac

SEQ ID NO: 108256 - DNA, 25 bp, E. coli
ggaagatcagcttaacgccggtaac

SEQ ID NO: 108257 - DNA, 25 bp, E. coli
gaccctcgcccaggttgaaaagctg

SEQ ID NO: 108258 - DNA, 25 bp, E. coli
gaccctcgcccacgttgaaaagctg

SEQ ID NO: 108259 - DNA, 25 bp, E. coli
gagtcagtattaccgagcgcccgga

SEQ ID NO: 108260 - DNA, 25 bp, E. coli
gagtcagtattagcgagcgcccgga

SEQ ID NO: 108261 - DNA, 25 bp, E. coli
gatcgcttcgttgagctgcgtgaac

SEQ ID NO: 108262 - DNA, 25 bp, E. coli
gatgagctgatgaccaaattccgca

SEQ ID NO: 108263 - DNA, 25 bp, E. coli
gatcgcttcgttcagctgcgtgaac

SEQ ID NO: 108264 - DNA, 25 bp, E. coli
gatgagctgatgtccaaattccgca

SEQ ID NO: 108265 - DNA, 25 bp, E. coli
taaaagccgttgacttcgaccgtca

SEQ ID NO: 108266 - DNA, 25 bp, E. coli
agccgttgtcttggaccgtcatcca

SEQ ID NO: 108267 - DNA, 25 bp, E. coli
agaaattggcgggctgctgaccttc

SEQ ID NO: 108268 - DNA, 25 bp, E. coli
agaaattggcggcctgctgaccttc

SEQ ID NO: 108269 - DNA, 25 bp, E. coli
agccgttgtcttcgaccgtcatcca

SEQ ID NO: 108270 - DNA, 25 bp, E. coli
aaagccgttgtcttcgaccgtcatc

SEQ ID NO: 108271 - DNA, 25 bp, E. coli
actgcgtgcgtaggtccgtgcgcca

SEQ ID NO: 108272 - DNA, 25 bp, E. coli
aaagccgttgtcatcgaccgtcatc

SEQ ID NO: 108273 - DNA, 25 bp, E. coli
actgcgtgcgtacgtccgtgcgcca

SEQ ID NO: 108274 - DNA, 25 bp, E. coli
ccagaaattggcgggctgctgacct

SEQ ID NO: 108275 - DNA, 25 bp, E. coli
ccagaaattggccggctgctgacct

SEQ ID NO: 108276 - DNA, 25 bp, E. coli
gcgtaaaagccgatgtcttcgaccg

SEQ ID NO: 108277 - DNA, 25 bp, E. coli
gcgtaaaagccgttgtcttcgaccg

SEQ ID NO: 108278 - DNA, 25 bp, E. coli
gactgcgtgcgttcgtccgtgcgcc

SEQ ID NO: 108279 - DNA, 25 bp, E. coli
gactgcgtgcgtacgtccgtgcgcc

SEQ ID NO: 108280 - DNA, 25 bp, E. coli
cgttgtcttcgagcgtcatccagaa

SEQ ID NO: 108281 - DNA, 25 bp, E. coli
cgttgtcttcgaccgtcatccagaa

SEQ ID NO: 108282 - DNA, 25 bp, E. coli
tgtcttcgaccgtcatccagaaatt

SEQ ID NO: 108283 - DNA, 25 bp, E. coli
gtgcgccagggaccgaagcacgtta

SEQ ID NO: 108284 - DNA, 25 bp, E. coli
gtgcgccagggagcgaagcacgtta

SEQ ID NO: 108285 - DNA, 25 bp, E. coli
tgtcttcgaccgacatccagaaatt

SEQ ID NO: 108286 - DNA, 25 bp, E. coli
taaaagccgttgtcttcgaccgtca

SEQ ID NO: 108287 - DNA, 25 bp, E. coli
aaggcagcctgcatagctccgcatt

SEQ ID NO: 108288 - DNA, 25 bp, E. coli
aaggcagcctgcttagctccgcatt

SEQ ID NO: 108289 - DNA, 25 bp, E. coli
tactcgcgtaagattgctgcccggg

SEQ ID NO: 108290 - DNA, 25 bp, E. coli
tactcgcgtaagtttgctgcccggg

SEQ ID NO: 108291 - DNA, 25 bp, E. coli
taccctgtgatgtgccgttagtgcc

SEQ ID NO: 108292 - DNA, 25 bp, E. coli
taccctgtgatgagccgttagtgcc

SEQ ID NO: 108293 - DNA, 25 bp, E. coli
tgtcgccgctggtgggattattcct

SEQ ID NO: 108294 - DNA, 25 bp, E. coli
tgatcaaagagtgggctaccgtcgt

SEQ ID NO: 108295 - DNA, 25 bp, E. coli
tgtcgccgctggagggattattcct

SEQ ID NO: 108296 - DNA, 25 bp, E. coli
tgatcaaagagtcggctaccgtcgt

SEQ ID NO: 108297 - DNA, 25 bp, E. coli
tctcctggcaaaacgggcaggcgct

SEQ ID NO: 108298 - DNA, 25 bp, E. coli
tctcctggcaaatcgggcaggcgct

SEQ ID NO: 108299 - DNA, 25 bp, E. coli
tctgacgtcgcaccattatgtggtg

SEQ ID NO: 108300 - DNA, 25 bp, E. coli
tctgacgtcgcagcattatgtggtg

SEQ ID NO: 108301 - DNA, 25 bp, E. coli
gcctggccttgtccgatttgaaaca

SEQ ID NO: 108302 - DNA, 25 bp, E. coli
gcctggccttgtgcgatttgaaaca

SEQ ID NO: 108303 - DNA, 25 bp, E. coli
gcattactggttaatatgtcgccgc

SEQ ID NO: 108304 - DNA, 25 bp, E. coli
gcattactggtttatatgtcgccgc

SEQ ID NO: 108305 - DNA, 25 bp, E. coli
gaaacatcttcgcaagacgcgagcc

SEQ ID NO: 108306 - DNA, 25 bp, E. coli
gaaacatcttcggaagacgcgagcc

SEQ ID NO: 108307 - DNA, 25 bp, E. coli
tggcaaccgatcatcttaagcgtgg

SEQ ID NO: 108308 - DNA, 25 bp, E. coli
tggcaaccgatcttcttaagcgtgg

SEQ ID NO: 108309 - DNA, 25 bp, E. coli
taaagatttgataaccgtggtgccg

SEQ ID NO: 108310 - DNA, 25 bp, E. coli
taaagatttgattaccgtggtgccg

SEQ ID NO: 108311 - DNA, 25 bp, E. coli
tataacttcctgcatcatgcggcgg

SEQ ID NO: 108312 - DNA, 25 bp, E. coli
tataacttcctggatcatgcggcgg

SEQ ID NO: 108313 - DNA, 25 bp, E. coli
ttatcttggcgtgcactggccgctg

SEQ ID NO: 108314 - DNA, 25 bp, E. coli
tttatgctggcatcgcctgtggtcc

SEQ ID NO: 108315 - DNA, 25 bp, E. coli
ttatcttggcgtccactggccgctg

SEQ ID NO: 108316 - DNA, 25 bp, E. coli
tttatgctggcaacgcctgtggtcc

SEQ ID NO: 108317 - DNA, 25 bp, E. coli
tgcattaccgatccgcaaaggctgg

SEQ ID NO: 108318 - DNA, 25 bp, E. coli
tgcattaccgatgcgcaaaggctgg

SEQ ID NO: 108319 - DNA, 25 bp, E. coli
tcgtcattgcctcgtcgcgcgttta

SEQ ID NO: 108320 - DNA, 25 bp, E. coli
tcgtcattgcctggtcgcgcgttta

SEQ ID NO: 108321 - DNA, 25 bp, E. coli
gataaaaatcgctatcgcgctggcg

SEQ ID NO: 108322 - DNA, 25 bp, E. coli
gataaaaatcgcaatcgcgctggcg

SEQ ID NO: 108323 - DNA, 25 bp, E. coli
gggacatctttttccgcacgaccga

SEQ ID NO: 108324 - DNA, 25 bp, E. coli
gggacatcttttaccgcacgaccga

SEQ ID NO: 108325 - DNA, 25 bp, E. coli
ggcttacagcactacggcaactggt

SEQ ID NO: 108326 - DNA, 25 bp, E. coli
ggcttacagcacaacggcaactggt

SEQ ID NO: 108327 - DNA, 25 bp, E. coli
tcaacgtctgcattcgtggtatcgc

SEQ ID NO: 108328 - DNA, 25 bp, E. coli
tcaacgtctgcaatcgtggtatcgc

SEQ ID NO: 108329 - DNA, 25 bp, E. coli
tcacttttaatggtgctggccgtcg

SEQ ID NO: 108330 - DNA, 25 bp, E. coli
tcacttttaatgctgctggccgtcg

SEQ ID NO: 108331 - DNA, 25 bp, E. coli
cagactgttcttattttatactgca

SEQ ID NO: 108332 - DNA, 25 bp, E. coli
cagactgttctttttttatactgca

SEQ ID NO: 108333 - DNA, 25 bp, E. coli
taaaatccctatatttcagtcgatt

SEQ ID NO: 108334 - DNA, 25 bp, E. coli
tagcgattaaaatccctatttttca

SEQ ID NO: 108335 - DNA, 25 bp, E. coli
tagcgattaaaaaccctatttttca

SEQ ID NO: 108336 - DNA, 25 bp, E. coli
aatccctatttttcagtcgattaag

SEQ ID NO: 108337 - DNA, 25 bp, E. coli
aatccctattttacagtcgattaag

SEQ ID NO: 108338 - DNA, 25 bp, E. coli
actgttctttttatatactgcactg

SEQ ID NO: 108339 - DNA, 25 bp, E. coli
actgttctttttttatactgcactg

SEQ ID NO: 108340 - DNA, 25 bp, E. coli
tatgtgttaacatatcagactgttc

SEQ ID NO: 108341 - DNA, 25 bp, E. coli
tatgtgttaacaaatcagactgttc

SEQ ID NO: 108342 - DNA, 25 bp, E. coli
tttatgtgttaagaaatcagactgt

SEQ ID NO: 108343 - DNA, 25 bp, E. coli
tttatgtgttaacaaatcagactgt

SEQ ID NO: 108344 - DNA, 25 bp, E. coli
tgttaacaaatctgactgttctttt

SEQ ID NO: 108345 - DNA, 25 bp, E. coli
tgttaacaaatcagactgttctttt

SEQ ID NO: 108346 - DNA, 25 bp, E. coli
tgtgttaacaaatcagactgttctt

SEQ ID NO: 108347 - DNA, 25 bp, E. coli
tgtgttaacaaaacagactgttctt

SEQ ID NO: 108348 - DNA, 25 bp, E. coli
tccctatttttcagtcgattaagaa

SEQ ID NO: 108349 - DNA, 25 bp, E. coli
tccctatttttctgtcgattaagaa

SEQ ID NO: 108350 - DNA, 25 bp, E. coli
gattaaaatcccaatttttcagtcg

SEQ ID NO: 108351 - DNA, 25 bp, E. coli
gattaaaatccctatttttcagtcg

SEQ ID NO: 108352 - DNA, 25 bp, E. coli
taaaatccctatttttcagtcgatt

SEQ ID NO: 108353 - DNA, 25 bp, E. coli
catcagtatgacacggtggacgcgc

SEQ ID NO: 108354 - DNA, 25 bp, E. coli
catcagtatgactcggtggacgcgc

SEQ ID NO: 108355 - DNA, 25 bp, E. coli
accgtgcagaccctccagctatggg

SEQ ID NO: 108356 - DNA, 25 bp, E. coli
agcaggtactgaaggcaaatccggg

SEQ ID NO: 108357 - DNA, 25 bp, E. coli
accgtgcagaccgtccagctatggg

SEQ ID NO: 108358 - DNA, 25 bp, E. coli
agcaggtactgatggcaaatccggg

SEQ ID NO: 108359 - DNA, 25 bp, E. coli
aaagtgcgtgcggatcagtatgaca

SEQ ID NO: 108360 - DNA, 25 bp, E. coli
aaagtgcgtgcgcatcagtatgaca

SEQ ID NO: 108361 - DNA, 25 bp, E. coli
tatgacacggtgcacgcgctttgct

SEQ ID NO: 108362 - DNA, 25 bp, E. coli
tacctcacgggctgcaggtggagct

SEQ ID NO: 108363 - DNA, 25 bp, E. coli
tacctcacgggcagcaggtggagct

SEQ ID NO: 108364 - DNA, 25 bp, E. coli
tatgacacggtggacgcgctttgct

SEQ ID NO: 108365 - DNA, 25 bp, E. coli
tgtcacggagcaggtactgaaggca

SEQ ID NO: 108366 - DNA, 25 bp, E. coli
tgtcacggagcacgtactgaaggca

SEQ ID NO: 108367 - DNA, 25 bp, E. coli
gcagaccgtccacctatgggactga

SEQ ID NO: 108368 - DNA, 25 bp, E. coli
gcagaccgtccagctatgggactga

SEQ ID NO: 108369 - DNA, 25 bp, E. coli
ccctttttacctgacgggctgcagg

SEQ ID NO: 108370 - DNA, 25 bp, E. coli
ccctttttacctcacgggctgcagg

SEQ ID NO: 108371 - DNA, 25 bp, E. coli
cattacgggcgcacgcagggtgtca

SEQ ID NO: 108372 - DNA, 25 bp, E. coli
ctttgctggcgtgattacgggcgca

SEQ ID NO: 108373 - DNA, 25 bp, E. coli
cattacgggcgctcgcagggtgtca

SEQ ID NO: 108374 - DNA, 25 bp, E. coli
ctttgctggcgtcattacgggcgca

SEQ ID NO: 108375 - DNA, 25 bp, E. coli
agaatcttactccatctccgccgga

SEQ ID NO: 108376 - DNA, 25 bp, E. coli
agtcgcctaacgtttttcgtatgcg

SEQ ID NO: 108377 - DNA, 25 bp, E. coli
agaatcttactcgatctccgccgga

SEQ ID NO: 108378 - DNA, 25 bp, E. coli
agtcgcctaacgattttcgtatgcg

SEQ ID NO: 108379 - DNA, 25 bp, E. coli
acaacacgcgtatcttaacagcact

SEQ ID NO: 108380 - DNA, 25 bp, E. coli
acaacacgcgtaacttaacagcact

SEQ ID NO: 108381 - DNA, 25 bp, E. coli
tgggtaaaaccgtaatcatcgccga

SEQ ID NO: 108382 - DNA, 25 bp, E. coli
gccttcaaaacggtgtgcctgcacg

SEQ ID NO: 108383 - DNA, 25 bp, E. coli
gccagtcgcctaacgtttttcgtat

SEQ ID NO: 108384 - DNA, 25 bp, E. coli
gccagtcgcctatcgtttttcgtat

SEQ ID NO: 108385 - DNA, 25 bp, E. coli
gccttcaaaacgctgtgcctgcacg

SEQ ID NO: 108386 - DNA, 25 bp, E. coli
gcggatgggtaaaaccgaaatcatc

SEQ ID NO: 108387 - DNA, 25 bp, E. coli
gcggatgggtaataccgaaatcatc

SEQ ID NO: 108388 - DNA, 25 bp, E. coli
gcagattgaagattcttactccatc

SEQ ID NO: 108389 - DNA, 25 bp, E. coli
gaagaatcttactccatctccgccg

SEQ ID NO: 108390 - DNA, 25 bp, E. coli
gaagaatcttacaccatctccgccg

SEQ ID NO: 108391 - DNA, 25 bp, E. coli
gcagattgaagaatcttactccatc

SEQ ID NO: 108392 - DNA, 25 bp, E. coli
gtcggcccacaacacgcgtatctta

SEQ ID NO: 108393 - DNA, 25 bp, E. coli
gtcggcccacaagacgcgtatctta

SEQ ID NO: 108394 - DNA, 25 bp, E. coli
tgggtaaaaccgaaatcatcgccga

SEQ ID NO: 108395 - DNA, 25 bp, E. coli
tcaaaacgctgtgcctgcacgaagg

SEQ ID NO: 108396 - DNA, 25 bp, E. coli
tcaaaacgctgtccctgcacgaagg

SEQ ID NO: 108397 - DNA, 25 bp, E. coli
catgcagttgggacagcgtctgacg

SEQ ID NO: 108398 - DNA, 25 bp, E. coli
catgcagttgggtcagcgtctgacg

SEQ ID NO: 108399 - DNA, 25 bp, E. coli
aaagagtcactcagtgagcgcgcca

SEQ ID NO: 108400 - DNA, 25 bp, E. coli
aaagagtcactctgtgagcgcgcca

SEQ ID NO: 108401 - DNA, 25 bp, E. coli
tatgactatggcgttaactggaaag

SEQ ID NO: 108402 - DNA, 25 bp, E. coli
tatgactatggccttaactggaaag

SEQ ID NO: 108403 - DNA, 25 bp, E. coli
ttaactggaaagctcgcgccgtaca

SEQ ID NO: 108404 - DNA, 25 bp, E. coli
ttaactggaaaggtcgcgccgtaca

SEQ ID NO: 108405 - DNA, 25 bp, E. coli
tgggctcgatgattgcggcagaatt

SEQ ID NO: 108406 - DNA, 25 bp, E. coli
tgggctcgatgaatgcggcagaatt

SEQ ID NO: 108407 - DNA, 25 bp, E. coli
gcagaatttaaccacccgcaaacgg

SEQ ID NO: 108408 - DNA, 25 bp, E. coli
gcagaatttaacgacccgcaaacgg

SEQ ID NO: 108409 - DNA, 25 bp, E. coli
gcgtctgacgaataccctgattgat

SEQ ID NO: 108410 - DNA, 25 bp, E. coli
gcgtctgacgaaaaccctgattgat

SEQ ID NO: 108411 - DNA, 25 bp, E. coli
gcaaaaaattcagcaacgcgcgctg

SEQ ID NO: 108412 - DNA, 25 bp, E. coli
gcaaaaaattcaccaacgcgcgctg

SEQ ID NO: 108413 - DNA, 25 bp, E. coli
cggcaaactgttagcgatggatcat

SEQ ID NO: 108414 - DNA, 25 bp, E. coli
cggcaaactgtttgcgatggatcat

SEQ ID NO: 108415 - DNA, 25 bp, E. coli
cgtcagccgccattgcgcaaaaaat

SEQ ID NO: 108416 - DNA, 25 bp, E. coli
cgtcagccgccaatgcgcaaaaaat

SEQ ID NO: 108417 - DNA, 25 bp, E. coli
ggactgcttctactgacctgtggcg

SEQ ID NO: 108418 - DNA, 25 bp, E. coli
ggactgcttctagtgacctgtggcg

SEQ ID NO: 108419 - DNA, 25 bp, E. coli
catacgtgagaagccaagcatcgat

SEQ ID NO: 108420 - DNA, 25 bp, E. coli
catacgtgagaacccaagcatcgat

SEQ ID NO: 108421 - DNA, 25 bp, E. coli
tactggctgaacgtgaaatcgctag

SEQ ID NO: 108422 - DNA, 25 bp, E. coli
tactggctgaacctgaaatcgctag

SEQ ID NO: 108423 - DNA, 25 bp, E. coli
gagttggaactgacacccagtgcga

SEQ ID NO: 108424 - DNA, 25 bp, E. coli
gagttggaactgtcacccagtgcga

SEQ ID NO: 108425 - DNA, 25 bp, E. coli
taccggagcttttgcgttggccgcc

SEQ ID NO: 108426 - DNA, 25 bp, E. coli
tagtgacggctgatgaatccaggcc

SEQ ID NO: 108427 - DNA, 25 bp, E. coli
taccggagctttagcgttggccgcc

SEQ ID NO: 108428 - DNA, 25 bp, E. coli
tagtgacggctgttgaatccaggcc

SEQ ID NO: 108429 - DNA, 25 bp, E. coli
tttcagccagcagagaatatgcacg

SEQ ID NO: 108430 - DNA, 25 bp, E. coli
tttcagccagcacagaatatgcacg

SEQ ID NO: 108431 - DNA, 25 bp, E. coli
tgtgttctccccaactggctgagcg

SEQ ID NO: 108432 - DNA, 25 bp, E. coli
tgtgttctcccctactggctgagcg

SEQ ID NO: 108433 - DNA, 25 bp, E. coli
tcgatatagtcttcggtgaaccccg

SEQ ID NO: 108434 - DNA, 25 bp, E. coli
tcgatatagtctacggtgaaccccg

SEQ ID NO: 108435 - DNA, 25 bp, E. coli
gaagatcccgctagctgttgaagaa

SEQ ID NO: 108436 - DNA, 25 bp, E. coli
gaagatcccgcttgctgttgaagaa

SEQ ID NO: 108437 - DNA, 25 bp, E. coli
cgctagcggtaatctggtatgccca

SEQ ID NO: 108438 - DNA, 25 bp, E. coli
cgctagcggtaaactggtatgccca

SEQ ID NO: 108439 - DNA, 25 bp, E. coli
gatgtgttcaaaacctggctactga

SEQ ID NO: 108440 - DNA, 25 bp, E. coli
gatgtgttcaaatcctggctactga

SEQ ID NO: 108441 - DNA, 25 bp, E. coli
aagaatcctggtaaataatctgtga

SEQ ID NO: 108442 - DNA, 25 bp, E. coli
aagaatcctggttaataatctgtga

SEQ ID NO: 108443 - DNA, 25 bp, E. coli
cagttgggccatataatgcgcagta

SEQ ID NO: 108444 - DNA, 25 bp, E. coli
cagttgggccatttaatgcgcagta

SEQ ID NO: 108445 - DNA, 25 bp, E. coli
ttttttatgccgcaaaatcgcagga

SEQ ID NO: 108446 - DNA, 25 bp, E. coli
ttattctggatagtaaagaatcctg

SEQ ID NO: 108447 - DNA, 25 bp, E. coli
ttattctggatactaaagaatcctg

SEQ ID NO: 108448 - DNA, 25 bp, E. coli
ttttttatgccggaaaatcgcagga

SEQ ID NO: 108449 - DNA, 25 bp, E. coli
gccggaaaatcggaggattattctg

SEQ ID NO: 108450 - DNA, 25 bp, E. coli
gccggaaaatcgcaggattattctg

SEQ ID NO: 108451 - DNA, 25 bp, E. coli
gaaggatgccgtctaattctggttc

SEQ ID NO: 108452 - DNA, 25 bp, E. coli
gaaggatgccgtgtaattctggttc

SEQ ID NO: 108453 - DNA, 25 bp, E. coli
cgcaggattattgtggatagtaaag

SEQ ID NO: 108454 - DNA, 25 bp, E. coli
cgcaggattattctggatagtaaag

SEQ ID NO: 108455 - DNA, 25 bp, E. coli
ctggttcaagagatttttatgccgg

SEQ ID NO: 108456 - DNA, 25 bp, E. coli
ctggttcaagagttttttatgccgg

SEQ ID NO: 108457 - DNA, 25 bp, E. coli
taatctgtgatagtcagttgggcca

SEQ ID NO: 108458 - DNA, 25 bp, E. coli
taatctgtgatactcagttgggcca

SEQ ID NO: 108459 - DNA, 25 bp, E. coli
taatacgatggagtgaaggatgccg

SEQ ID NO: 108460 - DNA, 25 bp, E. coli
taatacgatggactgaaggatgccg

SEQ ID NO: 108461 - DNA, 25 bp, E. coli
gatgccgtgtaaatctggttcaaga

SEQ ID NO: 108462 - DNA, 25 bp, E. coli
gatgccgtgtaattctggttcaaga

SEQ ID NO: 108463 - DNA, 25 bp, E. coli
caaccttgggcgagctttacaggcg

SEQ ID NO: 108464 - DNA, 25 bp, E. coli
caagaagtcgatccccggttgacga

SEQ ID NO: 108465 - DNA, 25 bp, E. coli
caagaagtcgatgcccggttgacga

SEQ ID NO: 108466 - DNA, 25 bp, E. coli
caaccttgggcgtgctttacaggcg

SEQ ID NO: 108467 - DNA, 25 bp, E. coli
aaccgtgctgcaaaccaaccttggg

SEQ ID NO: 108468 - DNA, 25 bp, E. coli
cagaggtcattctaatccaggcaca

SEQ ID NO: 108469 - DNA, 25 bp, E. coli
cagaggtcattcaaatccaggcaca

SEQ ID NO: 108470 - DNA, 25 bp, E. coli
taaaaaagagatcatcgcccgcctg

SEQ ID NO: 108471 - DNA, 25 bp, E. coli
taaaaaagagatgatcgcccgcctg

SEQ ID NO: 108472 - DNA, 25 bp, E. coli
aaccgtgctgcataccaaccttggg

SEQ ID NO: 108473 - DNA, 25 bp, E. coli
tattcccgatgttatgcgtcaggca

SEQ ID NO: 108474 - DNA, 25 bp, E. coli
tattcccgatgtaatgcgtcaggca

SEQ ID NO: 108475 - DNA, 25 bp, E. coli
ttacgcgcggattaaatgaccctcg

SEQ ID NO: 108476 - DNA, 25 bp, E. coli
ttacgcgcggataaaatgaccctcg

SEQ ID NO: 108477 - DNA, 25 bp, E. coli
tgagtgaaaaataaccgaccctgcg

SEQ ID NO: 108478 - DNA, 25 bp, E. coli
tgagtgaaaaattaccgaccctgcg

SEQ ID NO: 108479 - DNA, 25 bp, E. coli
ggtttgccgaaacagccaatgccgc

SEQ ID NO: 108480 - DNA, 25 bp, E. coli
ggtttgccgaaagagccaatgccgc

SEQ ID NO: 108481 - DNA, 25 bp, E. coli
gatcttagccagtacggtttgccga

SEQ ID NO: 108482 - DNA, 25 bp, E. coli
gatacttatggtgacacccgcgtgg

SEQ ID NO: 108483 - DNA, 25 bp, E. coli
gatacttatggtcacacccgcgtgg

SEQ ID NO: 108484 - DNA, 25 bp, E. coli
gatcttagccagaacggtttgccga

SEQ ID NO: 108485 - DNA, 25 bp, E. coli
tacagcgatacaatgtgaagccggg

SEQ ID NO: 108486 - DNA, 25 bp, E. coli
tacagcgatacattgtgaagccggg

SEQ ID NO: 108487 - DNA, 25 bp, E. coli
agaagtccacgtcgtaaggccgcac

SEQ ID NO: 108488 - DNA, 25 bp, E. coli
agaagtccacgtggtaaggccgcac

SEQ ID NO: 108489 - DNA, 25 bp, E. coli
tatcactgacaccacaaaagagcgt

SEQ ID NO: 108490 - DNA, 25 bp, E. coli
tatcactgacacgacaaaagagcgt

SEQ ID NO: 108491 - DNA, 25 bp, E. coli
tttatgccagcatgccgcacatgcg

SEQ ID NO: 108492 - DNA, 25 bp, E. coli
tttatgccagcaagccgcacatgcg

SEQ ID NO: 108493 - DNA, 25 bp, E. coli
ttgtgaagccggcagaagtccacgt

SEQ ID NO: 108494 - DNA, 25 bp, E. coli
ttgtgaagccgggagaagtccacgt

SEQ ID NO: 108495 - DNA, 25 bp, E. coli
tgtcagaacgtgtattgcagcgcca

SEQ ID NO: 108496 - DNA, 25 bp, E. coli
tgtcagaacgtgaattgcagcgcca

SEQ ID NO: 108497 - DNA, 25 bp, E. coli
tgcagcgccacgatcatcacttatg

SEQ ID NO: 108498 - DNA, 25 bp, E. coli
tgcagcgccacgttcatcacttatg

SEQ ID NO: 108499 - DNA, 25 bp, E. coli
tcatcacttatgtgtcggtacagcg

SEQ ID NO: 108500 - DNA, 25 bp, E. coli
tcatcacttatgagtcggtacagcg

SEQ ID NO: 108501 - DNA, 25 bp, E. coli
gccgtcagggcaccaaattatgtgg

SEQ ID NO: 108502 - DNA, 25 bp, E. coli
gccgtcagggcagcaaattatgtgg

SEQ ID NO: 108503 - DNA, 25 bp, E. coli
gcacatgcgcgtacaagccgctata

SEQ ID NO: 108504 - DNA, 25 bp, E. coli
gcacatgcgcgttcaagccgctata

SEQ ID NO: 108505 - DNA, 25 bp, E. coli
gagcgttatcacgagtgtcagaacg

SEQ ID NO: 108506 - DNA, 25 bp, E. coli
gagcgttatcaccagtgtcagaacg

SEQ ID NO: 108507 - DNA, 25 bp, E. coli
aattttgccgcagattgatgccctg

SEQ ID NO: 108508 - DNA, 25 bp, E. coli
aattctcggttctgcgctggtagca

SEQ ID NO: 108509 - DNA, 25 bp, E. coli
aattttgccgcacattgatgccctg

SEQ ID NO: 108510 - DNA, 25 bp, E. coli
aattctcggttcagcgctggtagca

SEQ ID NO: 108511 - DNA, 25 bp, E. coli
catgcgccattaccgatgctgggac

SEQ ID NO: 108512 - DNA, 25 bp, E. coli
catgcgccattagcgatgctgggac

SEQ ID NO: 108513 - DNA, 25 bp, E. coli
tactgatttctagcttacacctggg

SEQ ID NO: 108514 - DNA, 25 bp, E. coli
tactggtcatgttacgcaaaggcgg

SEQ ID NO: 108515 - DNA, 25 bp, E. coli
tacgtcgattatcacctggcagcat

SEQ ID NO: 108516 - DNA, 25 bp, E. coli
tactggtcatgtaacgcaaaggcgg

SEQ ID NO: 108517 - DNA, 25 bp, E. coli
tactgatttctaccttacacctggg

SEQ ID NO: 108518 - DNA, 25 bp, E. coli
tacgtcgattatgacctggcagcat

SEQ ID NO: 108519 - DNA, 25 bp, E. coli
tgtaaaaagaatatcccggcggcgt

SEQ ID NO: 108520 - DNA, 25 bp, E. coli
tgtaaaaagaatttcccggcggcgt

SEQ ID NO: 108521 - DNA, 25 bp, E. coli
tgatgccctgcgtaatggatgcgtg

SEQ ID NO: 108522 - DNA, 25 bp, E. coli
tgatgccctgcgaaatggatgcgtg

SEQ ID NO: 108523 - DNA, 25 bp, E. coli
tcttaggtacagtgggaattctcgg

SEQ ID NO: 108524 - DNA, 25 bp, E. coli
tcttaggtacagagggaattctcgg

SEQ ID NO: 108525 - DNA, 25 bp, E. coli
ggcgcaagtttacatccatacgtcg

SEQ ID NO: 108526 - DNA, 25 bp, E. coli
ggcgcaagtttagatccatacgtcg

SEQ ID NO: 108527 - DNA, 25 bp, E. coli
taatgcgatgcaagcgctgagccac

SEQ ID NO: 108528 - DNA, 25 bp, E. coli
taatgcgatgcatgcgctgagccac

SEQ ID NO: 108529 - DNA, 25 bp, E. coli
aatcagtatgctggccggtttatta

SEQ ID NO: 108530 - DNA, 25 bp, E. coli
caagtttagttcgtgtatatgccat

SEQ ID NO: 108531 - DNA, 25 bp, E. coli
aatcagtatgctcgccggtttatta

SEQ ID NO: 108532 - DNA, 25 bp, E. coli
caagtttagttcctgtatatgccat

SEQ ID NO: 108533 - DNA, 25 bp, E. coli
gtccggttcgttgcgcttttacagg

SEQ ID NO: 108534 - DNA, 25 bp, E. coli
gtccggttcgttccgcttttacagg

SEQ ID NO: 108535 - DNA, 25 bp, E. coli
tatgtcgccatagggttattattac

SEQ ID NO: 108536 - DNA, 25 bp, E. coli
tatgctggccggtttattatttaat

SEQ ID NO: 108537 - DNA, 25 bp, E. coli
tatgctggccggattattatttaat

SEQ ID NO: 108538 - DNA, 25 bp, E. coli
tatgtcgccatacggttattattac

SEQ ID NO: 108539 - DNA, 25 bp, E. coli
tgtggagtccggttcgttgcgcttt

SEQ ID NO: 108540 - DNA, 25 bp, E. coli
tgtggagtccggatcgttgcgcttt

SEQ ID NO: 108541 - DNA, 25 bp, E. coli
ccatagtgaagagttgtggagtccg

SEQ ID NO: 108542 - DNA, 25 bp, E. coli
ccatagtgaagacttgtggagtccg

SEQ ID NO: 108543 - DNA, 25 bp, E. coli
cgattgtcgttggaagtttagttcc

SEQ ID NO: 108544 - DNA, 25 bp, E. coli
cgattgtcgttgcaagtttagttcc

SEQ ID NO: 108545 - DNA, 25 bp, E. coli
gattcaccaccaatgtatgtcgcca

SEQ ID NO: 108546 - DNA, 25 bp, E. coli
gattcaccaccattgtatgtcgcca

SEQ ID NO: 108547 - DNA, 25 bp, E. coli
gggaaatgccattgtgaagagttgt

SEQ ID NO: 108548 - DNA, 25 bp, E. coli
gggaaatgccatagtgaagagttgt

SEQ ID NO: 108549 - DNA, 25 bp, E. coli
ggcaaccaaatatgattcaccacca

SEQ ID NO: 108550 - DNA, 25 bp, E. coli
ggcaaccaaataagattcaccacca

SEQ ID NO: 108551 - DNA, 25 bp, E. coli
caattatctatattgatgagtgatc

SEQ ID NO: 108552 - DNA, 25 bp, E. coli
caattatctataatgatgagtgatc

SEQ ID NO: 108553 - DNA, 25 bp, E. coli
catccgctcaaaacgggcggttgtc

SEQ ID NO: 108554 - DNA, 25 bp, E. coli
catccgctcaaatcgggcggttgtc

SEQ ID NO: 108555 - DNA, 25 bp, E. coli
tatatgatgctacttttttaaatgg

SEQ ID NO: 108556 - DNA, 25 bp, E. coli
taaatggtttttacctgtcggcatc

SEQ ID NO: 108557 - DNA, 25 bp, E. coli
taaatggttttttcctgtcggcatc

SEQ ID NO: 108558 - DNA, 25 bp, E. coli
tatatgatgctagttttttaaatgg

SEQ ID NO: 108559 - DNA, 25 bp, E. coli
tcggcatccgctgaaaacgggcggt

SEQ ID NO: 108560 - DNA, 25 bp, E. coli
tcggcatccgctcaaaacgggcggt

SEQ ID NO: 108561 - DNA, 25 bp, E. coli
cgctcacttggtaaatcatttcact

SEQ ID NO: 108562 - DNA, 25 bp, E. coli
cgctcacttggttaatcatttcact

SEQ ID NO: 108563 - DNA, 25 bp, E. coli
cgggcggttgtcgataaacgctcac

SEQ ID NO: 108564 - DNA, 25 bp, E. coli
cgggcggttgtccataaacgctcac

SEQ ID NO: 108565 - DNA, 25 bp, E. coli
ggttaatcatttcactcttcaatta

SEQ ID NO: 108566 - DNA, 25 bp, E. coli
ggtttttacctgacggcatccgctc

SEQ ID NO: 108567 - DNA, 25 bp, E. coli
ggttaatcatttgactcttcaatta

SEQ ID NO: 108568 - DNA, 25 bp, E. coli
ggtttttacctgtcggcatccgctc

SEQ ID NO: 108569 - DNA, 25 bp, E. coli
ggttgtcgataaacgctcacttggt

SEQ ID NO: 108570 - DNA, 25 bp, E. coli
ggttgtcgataatcgctcacttggt

SEQ ID NO: 108571 - DNA, 25 bp, E. coli
gagtgatcagaaatacatgtgagaa

SEQ ID NO: 108572 - DNA, 25 bp, E. coli
gagtgatcagaattacatgtgagaa

SEQ ID NO: 108573 - DNA, 25 bp, E. coli
aatatccggtggtgctccagtcctg

SEQ ID NO: 108574 - DNA, 25 bp, E. coli
aatatccggtggagctccagtcctg

SEQ ID NO: 108575 - DNA, 25 bp, E. coli
cagcgcccgctggaaaaggtttatc

SEQ ID NO: 108576 - DNA, 25 bp, E. coli
cacgttgtctgaagagctcgagcgc

SEQ ID NO: 108577 - DNA, 25 bp, E. coli
cagcgcccgctgcaaaaggtttatc

SEQ ID NO: 108578 - DNA, 25 bp, E. coli
cacgttgtctgatgagctcgagcgc

SEQ ID NO: 108579 - DNA, 25 bp, E. coli
cataaagcgttcatggccgacctga

SEQ ID NO: 108580 - DNA, 25 bp, E. coli
cataaagcgttcttggccgacctga

SEQ ID NO: 108581 - DNA, 25 bp, E. coli
tactggcgctgattctggaaggcaa

SEQ ID NO: 108582 - DNA, 25 bp, E. coli
tactggcgctgaatctggaaggcaa

SEQ ID NO: 108583 - DNA, 25 bp, E. coli
taccaggatatcagccgggagatcg

SEQ ID NO: 108584 - DNA, 25 bp, E. coli
taccaggatatctgccgggagatcg

SEQ ID NO: 108585 - DNA, 25 bp, E. coli
tatttgtcggaatgcgaaggcgcta

SEQ ID NO: 108586 - DNA, 25 bp, E. coli
tatttgtcggaaagcgaaggcgcta

SEQ ID NO: 108587 - DNA, 25 bp, E. coli
ttaagtgatctggaaaaccgtggcg

SEQ ID NO: 108588 - DNA, 25 bp, E. coli
ttaagtgatctgcaaaaccgtggcg

SEQ ID NO: 108589 - DNA, 25 bp, E. coli
cctggcgccgcatgagggaaaatct

SEQ ID NO: 108590 - DNA, 25 bp, E. coli
cctggcgccgcaagagggaaaatct

SEQ ID NO: 108591 - DNA, 25 bp, E. coli
gcatttatccgcagacagaggtaca

SEQ ID NO: 108592 - DNA, 25 bp, E. coli
gcatttatccgctgacagaggtaca

SEQ ID NO: 108593 - DNA, 25 bp, E. coli
gagttaaaacagtggcagcagcgcc

SEQ ID NO: 108594 - DNA, 25 bp, E. coli
gagttaaaacagaggcagcagcgcc

SEQ ID NO: 108595 - DNA, 25 bp, E. coli
caacctgagaaaatcgcaaaaaaca

SEQ ID NO: 108596 - DNA, 25 bp, E. coli
caacctgagaaattcgcaaaaaaca

SEQ ID NO: 108597 - DNA, 25 bp, E. coli
cactcttattcacaataaaactctg

SEQ ID NO: 108598 - DNA, 25 bp, E. coli
catctttcggcaagcattaaattac

SEQ ID NO: 108599 - DNA, 25 bp, E. coli
cactcttattcagaataaaactctg

SEQ ID NO: 108600 - DNA, 25 bp, E. coli
catctttcggcatgcattaaattac

SEQ ID NO: 108601 - DNA, 25 bp, E. coli
ctttcggcaagcattaaattactat

SEQ ID NO: 108602 - DNA, 25 bp, E. coli
ctttcggcaagctttaaattactat

SEQ ID NO: 108603 - DNA, 25 bp, E. coli
aactctgtttatgatctttcggcaa

SEQ ID NO: 108604 - DNA, 25 bp, E. coli
aactctgtttatcatctttcggcaa

SEQ ID NO: 108605 - DNA, 25 bp, E. coli
tgagaaaatcgcaaaaaacactctt

SEQ ID NO: 108606 - DNA, 25 bp, E. coli
tgagaaaatcgctaaaaacactctt

SEQ ID NO: 108607 - DNA, 25 bp, E. coli
tgcagaatttacaacctgagaaaat

SEQ ID NO: 108608 - DNA, 25 bp, E. coli
tgcagaatttactacctgagaaaat

SEQ ID NO: 108609 - DNA, 25 bp, E. coli
tcgcaaaaaacactcttattcagaa

SEQ ID NO: 108610 - DNA, 25 bp, E. coli
tcgcaaaaaacagtcttattcagaa

SEQ ID NO: 108611 - DNA, 25 bp, E. coli
tctgtttatcatctttcggcaagca

SEQ ID NO: 108612 - DNA, 25 bp, E. coli
tctgtttatcatgtttcggcaagca

SEQ ID NO: 108613 - DNA, 25 bp, E. coli
gaatttacaaccagagaaaatcgca

SEQ ID NO: 108614 - DNA, 25 bp, E. coli
gaatttacaacctgagaaaatcgca

SEQ ID NO: 108615 - DNA, 25 bp, E. coli
taaattactatattaccgttcaaca

SEQ ID NO: 108616 - DNA, 25 bp, E. coli
taaattactataataccgttcaaca

SEQ ID NO: 108617 - DNA, 25 bp, E. coli
aagccagacccatatccaaaaccag

SEQ ID NO: 108618 - DNA, 25 bp, E. coli
caacgacggtgatgtttatttgtca

SEQ ID NO: 108619 - DNA, 25 bp, E. coli
caacgacggtgaagtttatttgtca

SEQ ID NO: 108620 - DNA, 25 bp, E. coli
aagccagacccaaatccaaaaccag

SEQ ID NO: 108621 - DNA, 25 bp, E. coli
aaatggcgtcgaaaccacgcttgcc

SEQ ID NO: 108622 - DNA, 25 bp, E. coli
aaatggcgtcgataccacgcttgcc

SEQ ID NO: 108623 - DNA, 25 bp, E. coli
tgaaggaattacgacgctaggcgct

SEQ ID NO: 108624 - DNA, 25 bp, E. coli
tgaaggaattaccacgctaggcgct

SEQ ID NO: 108625 - DNA, 25 bp, E. coli
ccaaaaagtggatgaacgaggtaca

SEQ ID NO: 108626 - DNA, 25 bp, E. coli
ccacgctaggcggttttatgggcta

SEQ ID NO: 108627 - DNA, 25 bp, E. coli
ccacgctaggcgcttttatgggcta

SEQ ID NO: 108628 - DNA, 25 bp, E. coli
ccaaaaagtggaagaacgaggtaca

SEQ ID NO: 108629 - DNA, 25 bp, E. coli
gctaataatacaaccattaacggtg

SEQ ID NO: 108630 - DNA, 25 bp, E. coli
gcatatctattcaggtggcacgcaa

SEQ ID NO: 108631 - DNA, 25 bp, E. coli
gctaataatacatccattaacggtg

SEQ ID NO: 108632 - DNA, 25 bp, E. coli
gcatatctattctggtggcacgcaa

SEQ ID NO: 108633 - DNA, 25 bp, E. coli
gactgtagatgggaaccaaaaagtg

SEQ ID NO: 108634 - DNA, 25 bp, E. coli
gactgtagatggcaaccaaaaagtg

SEQ ID NO: 108635 - DNA, 25 bp, E. coli
cgatagcgcgactttgactctggga

SEQ ID NO: 108636 - DNA, 25 bp, E. coli
cgatagcgcgacattgactctggga

SEQ ID NO: 108637 - DNA, 25 bp, E. coli
cattgactctggcaaatggcgtcga

SEQ ID NO: 108638 - DNA, 25 bp, E. coli
cattgactctgggaaatggcgtcga

SEQ ID NO: 108639 - DNA, 25 bp, E. coli
aagaaagcagcatccgagccgtatc

SEQ ID NO: 108640 - DNA, 25 bp, E. coli
aagcagcaaccgtgccgtatctggt

SEQ ID NO: 108641 - DNA, 25 bp, E. coli
aagaaagcagcaaccgagccgtatc

SEQ ID NO: 108642 - DNA, 25 bp, E. coli
aagcagcaaccgagccgtatctggt

SEQ ID NO: 108643 - DNA, 25 bp, E. coli
agtgcagttacacccggcgaaagtg

SEQ ID NO: 108644 - DNA, 25 bp, E. coli
agtgcagttacagccggcgaaagtg

SEQ ID NO: 108645 - DNA, 25 bp, E. coli
aaacatccgcttcgcccgtcagatt

SEQ ID NO: 108646 - DNA, 25 bp, E. coli
aaacatccgcttggcccgtcagatt

SEQ ID NO: 108647 - DNA, 25 bp, E. coli
tgaagaatgtcagcgcagtgcagtt

SEQ ID NO: 108648 - DNA, 25 bp, E. coli
tgaggcgaagaatgcagcaaccgag

SEQ ID NO: 108649 - DNA, 25 bp, E. coli
tgaggcgaagaaagcagcaaccgag

SEQ ID NO: 108650 - DNA, 25 bp, E. coli
tgaagaatgtcaccgcagtgcagtt

SEQ ID NO: 108651 - DNA, 25 bp, E. coli
tgccagctacaaagagatgcatggt

SEQ ID NO: 108652 - DNA, 25 bp, E. coli
tcggattgtgatcccgggaattgtc

SEQ ID NO: 108653 - DNA, 25 bp, E. coli
tgccagctacaatgagatgcatggt

SEQ ID NO: 108654 - DNA, 25 bp, E. coli
tcggattgtgatgccgggaattgtc

SEQ ID NO: 108655 - DNA, 25 bp, E. coli
tctgaagaatgtcaccgcagtgcag

SEQ ID NO: 108656 - DNA, 25 bp, E. coli
tctgaagaatgtgaccgcagtgcag

SEQ ID NO: 108657 - DNA, 25 bp, E. coli
gaatgtcaccgcagtgcagttacac

SEQ ID NO: 108658 - DNA, 25 bp, E. coli
gaatgtcaccgctgtgcagttacac

SEQ ID NO: 108659 - DNA, 25 bp, E. coli
gtcaccgcagtgcagttacacccgg

SEQ ID NO: 108660 - DNA, 25 bp, E. coli
gtcaccgcagtggagttacacccgg

SEQ ID NO: 108661 - DNA, 25 bp, E. coli
tactctgcgtctgcgtgtgcggaac

SEQ ID NO: 108662 - DNA, 25 bp, E. coli
tactctgcgtctccgtgtgcggaac

SEQ ID NO: 108663 - DNA, 25 bp, E. coli
tactgttgctgttaagtataacgcc

SEQ ID NO: 108664 - DNA, 25 bp, E. coli
tagcgtcaaaaatgccccggcaagt

SEQ ID NO: 108665 - DNA, 25 bp, E. coli
taaatacccgtaccgcattactagc

SEQ ID NO: 108666 - DNA, 25 bp, E. coli
tactgttgctgtaaagtataacgcc

SEQ ID NO: 108667 - DNA, 25 bp, E. coli
tagcgtcaaaaaagccccggcaagt

SEQ ID NO: 108668 - DNA, 25 bp, E. coli
tagcaattgcgttagcggcgtactg

SEQ ID NO: 108669 - DNA, 25 bp, E. coli
tatggacatctttacgatactctgc

SEQ ID NO: 108670 - DNA, 25 bp, E. coli
tatggacatcttaacgatactctgc

SEQ ID NO: 108671 - DNA, 25 bp, E. coli
tagcaattgcgtaagcggcgtactg

SEQ ID NO: 108672 - DNA, 25 bp, E. coli
tagcgggcctaatacaacaatatgg

SEQ ID NO: 108673 - DNA, 25 bp, E. coli
tagcgggcctaaaacaacaatatgg

SEQ ID NO: 108674 - DNA, 25 bp, E. coli
tgtgcggaacagaaacccttacccg

SEQ ID NO: 108675 - DNA, 25 bp, E. coli
tgttatgccagaggtagcaattgcg

SEQ ID NO: 108676 - DNA, 25 bp, E. coli
tgtgcggaacagtaacccttacccg

SEQ ID NO: 108677 - DNA, 25 bp, E. coli
tgttatgccagacgtagcaattgcg

SEQ ID NO: 108678 - DNA, 25 bp, E. coli
ccggagcgattaacagggtttaaca

SEQ ID NO: 108679 - DNA, 25 bp, E. coli
ccggagcgattatcagggtttaaca

SEQ ID NO: 108680 - DNA, 25 bp, E. coli
taactgcggtagtacatttatcccg

SEQ ID NO: 108681 - DNA, 25 bp, E. coli
taactgcggtagaacatttatcccg

SEQ ID NO: 108682 - DNA, 25 bp, E. coli
taaatacccgtagcgcattactagc

SEQ ID NO: 108683 - DNA, 25 bp, E. coli
caatctgctgaaaggtaccgtcggg

SEQ ID NO: 108684 - DNA, 25 bp, E. coli
caatctgctgaatggtaccgtcggg

SEQ ID NO: 108685 - DNA, 25 bp, E. coli
taacggtactggactggcgaaagga

SEQ ID NO: 108686 - DNA, 25 bp, E. coli
agatgaagccattccccaggacgaa

SEQ ID NO: 108687 - DNA, 25 bp, E. coli
agatgaagccataccccaggacgaa

SEQ ID NO: 108688 - DNA, 25 bp, E. coli
tctcctggacattaaccgcggacgg

SEQ ID NO: 108689 - DNA, 25 bp, E. coli
tctcctggacataaaccgcggacgg

SEQ ID NO: 108690 - DNA, 25 bp, E. coli
gccaaagagattctgccgcagctac

SEQ ID NO: 108691 - DNA, 25 bp, E. coli
gccaaagagattgtgccgcagctac

SEQ ID NO: 108692 - DNA, 25 bp, E. coli
gaagtgtctcgtcgtgaaacccgaa

SEQ ID NO: 108693 - DNA, 25 bp, E. coli
gaagtgtctcgtggtgaaacccgaa

SEQ ID NO: 108694 - DNA, 25 bp, E. coli
gaaaggattcttccgattcccgacg

SEQ ID NO: 108695 - DNA, 25 bp, E. coli
gaacctatgaccctactgccgctaa

SEQ ID NO: 108696 - DNA, 25 bp, E. coli
gaaaggattcttgcgattcccgacg

SEQ ID NO: 108697 - DNA, 25 bp, E. coli
gaacctatgaccgtactgccgctaa

SEQ ID NO: 108698 - DNA, 25 bp, E. coli
cgggccgcatctccactatgaagta

SEQ ID NO: 108699 - DNA, 25 bp, E. coli
cgggccgcatctgcactatgaagta

SEQ ID NO: 108700 - DNA, 25 bp, E. coli
tggtaaacgtgaccaaagccagctg

SEQ ID NO: 108701 - DNA, 25 bp, E. coli
tggatgacaaaatcgccggtgaagc

SEQ ID NO: 108702 - DNA, 25 bp, E. coli
tggatgacaaaaacgccggtgaagc

SEQ ID NO: 108703 - DNA, 25 bp, E. coli
tggtaaacgtgagcaaagccagctg

SEQ ID NO: 108704 - DNA, 25 bp, E. coli
taacggtactggtctggcgaaagga

SEQ ID NO: 108705 - DNA, 25 bp, E. coli
caaataggaaattgcgtgtcaccaa

SEQ ID NO: 108706 - DNA, 25 bp, E. coli
caaataggaaatagcgtgtcaccaa

SEQ ID NO: 108707 - DNA, 25 bp, E. coli
tacatagcaaaatcgtccaagagcg

SEQ ID NO: 108708 - DNA, 25 bp, E. coli
tacatagcaaaaacgtccaagagcg

SEQ ID NO: 108709 - DNA, 25 bp, E. coli
tattattggcggtcctccgtgccaa

SEQ ID NO: 108710 - DNA, 25 bp, E. coli
tatcatatctggttgtaccggaaca

SEQ ID NO: 108711 - DNA, 25 bp, E. coli
tatcatatctggatgtaccggaaca

SEQ ID NO: 108712 - DNA, 25 bp, E. coli
tattattggcggacctccgtgccaa

SEQ ID NO: 108713 - DNA, 25 bp, E. coli
tgattacaccaacagaagctgctag

SEQ ID NO: 108714 - DNA, 25 bp, E. coli
tgattacaccaagagaagctgctag

SEQ ID NO: 108715 - DNA, 25 bp, E. coli
tccaagaagtttgcacgtccaagaa

SEQ ID NO: 108716 - DNA, 25 bp, E. coli
tccaagaagtttccacgtccaagaa

SEQ ID NO: 108717 - DNA, 25 bp, E. coli
tattaaataaaacagtacagcccga

SEQ ID NO: 108718 - DNA, 25 bp, E. coli
tattaaataaaagagtacagcccga

SEQ ID NO: 108719 - DNA, 25 bp, E. coli
gctgctagattagaaggcttccctg

SEQ ID NO: 108720 - DNA, 25 bp, E. coli
gctgctagattacaaggcttccctg

SEQ ID NO: 108721 - DNA, 25 bp, E. coli
ccctcggaatgttggtgatacagaa

SEQ ID NO: 108722 - DNA, 25 bp, E. coli
ccctcggaatgtaggtgatacagaa

SEQ ID NO: 108723 - DNA, 25 bp, E. coli
ggtctaagtcttggtgctgcacgtg

SEQ ID NO: 108724 - DNA, 25 bp, E. coli
ggtctaagtcttcgtgctgcacgtg

SEQ ID NO: 108725 - DNA, 25 bp, E. coli
ggaagctttcaagccgtcaggccga

SEQ ID NO: 108726 - DNA, 25 bp, E. coli
ggaagctttcaacccgtcaggccga

SEQ ID NO: 108727 - DNA, 25 bp, E. coli
cagtaattaccgtggcggacgcgga

SEQ ID NO: 108728 - DNA, 25 bp, E. coli
cagtaattaccgaggcggacgcgga

SEQ ID NO: 108729 - DNA, 25 bp, E. coli
tatctgtggcatatcacgctgccgg

SEQ ID NO: 108730 - DNA, 25 bp, E. coli
tatctgtggcatttcacgctgccgg

SEQ ID NO: 108731 - DNA, 25 bp, E. coli
ttactgggctaccaagcgaccgtct

SEQ ID NO: 108732 - DNA, 25 bp, E. coli
ttactgggctacgaagcgaccgtct

SEQ ID NO: 108733 - DNA, 25 bp, E. coli
tcatcgtgcaaattgcgcctggcgg

SEQ ID NO: 108734 - DNA, 25 bp, E. coli
tcatcgtgcaaaatgcgcctggcgg

SEQ ID NO: 108735 - DNA, 25 bp, E. coli
gcatttatcatcttcggctacgcca

SEQ ID NO: 108736 - DNA, 25 bp, E. coli
gcatttatcatcatcggctacgcca

SEQ ID NO: 108737 - DNA, 25 bp, E. coli
cgccgtctgttgctggtgatcccaa

SEQ ID NO: 108738 - DNA, 25 bp, E. coli
cgccgtctgttggtggtgatcccaa

SEQ ID NO: 108739 - DNA, 25 bp, E. coli
gattcgctgccgtggtatcagaaaa

SEQ ID NO: 108740 - DNA, 25 bp, E. coli
gattcgctgccgaggtatcagaaaa

SEQ ID NO: 108741 - DNA, 25 bp, E. coli
gattccgttaggcattcgcaaagct

SEQ ID NO: 108742 - DNA, 25 bp, E. coli
gattccgttagggattcgcaaagct

SEQ ID NO: 108743 - DNA, 25 bp, E. coli
ggttttccggcgacgtttatcagca

SEQ ID NO: 108744 - DNA, 25 bp, E. coli
ggttttccggcgtcgtttatcagca

SEQ ID NO: 108745 - DNA, 25 bp, E. coli
tcaaaatgctctcggactacatccg

SEQ ID NO: 108746 - DNA, 25 bp, E. coli
tcaccctcggattgtggagcacgct

SEQ ID NO: 108747 - DNA, 25 bp, E. coli
tcaccctcggatagtggagcacgct

SEQ ID NO: 108748 - DNA, 25 bp, E. coli
tcaaaatgctctgggactacatccg

SEQ ID NO: 108749 - DNA, 25 bp, E. coli
caaatctctggctggatgacggcgc

SEQ ID NO: 108750 - DNA, 25 bp, E. coli
caaatctctggcaggatgacggcgc

SEQ ID NO: 108751 - DNA, 25 bp, E. coli
ctatttgccaaagcccggaagcgca

SEQ ID NO: 108752 - DNA, 25 bp, E. coli
ctatttgccaaaccccggaagcgca

SEQ ID NO: 108753 - DNA, 25 bp, E. coli
atggcatcgcaaaacgcaccgggta

SEQ ID NO: 108754 - DNA, 25 bp, E. coli
atggcatcgcaatacgcaccgggta

SEQ ID NO: 108755 - DNA, 25 bp, E. coli
tccggataaagaacaacgttggctg

SEQ ID NO: 108756 - DNA, 25 bp, E. coli
tccggataaagatcaacgttggctg

SEQ ID NO: 108757 - DNA, 25 bp, E. coli
gcatttctggtaacggcaagtggat

SEQ ID NO: 108758 - DNA, 25 bp, E. coli
gcatttctggtatcggcaagtggat

SEQ ID NO: 108759 - DNA, 25 bp, E. coli
gactaacacttatcgaagccatcgg

SEQ ID NO: 108760 - DNA, 25 bp, E. coli
gactaacacttaacgaagccatcgg

SEQ ID NO: 108761 - DNA, 25 bp, E. coli
cgtaagttggatccagatgctggca

SEQ ID NO: 108762 - DNA, 25 bp, E. coli
cattaccgggatcatggctgccctg

SEQ ID NO: 108763 - DNA, 25 bp, E. coli
cattaccgggatgatggctgccctg

SEQ ID NO: 108764 - DNA, 25 bp, E. coli
cgtaagttggatgcagatgctggca

SEQ ID NO: 108765 - DNA, 25 bp, E. coli
ggtattgcggcattcaccgcggcta

SEQ ID NO: 108766 - DNA, 25 bp, E. coli
ggtattgcggcaatcaccgcggcta

SEQ ID NO: 108767 - DNA, 25 bp, E. coli
taatagtcctctgcggcataacggg

SEQ ID NO: 108768 - DNA, 25 bp, E. coli
taatctggcaagcagcgattgtcgc

SEQ ID NO: 108769 - DNA, 25 bp, E. coli
taatctggcaaggagcgattgtcgc

SEQ ID NO: 108770 - DNA, 25 bp, E. coli
taatagtcctctccggcataacggg

SEQ ID NO: 108771 - DNA, 25 bp, E. coli
caaagacctcgataaaggcaagtgg

SEQ ID NO: 108772 - DNA, 25 bp, E. coli
caaagacctcgaaaaaggcaagtgg

SEQ ID NO: 108773 - DNA, 25 bp, E. coli
tacgaaatcgacaaagagagcggcg

SEQ ID NO: 108774 - DNA, 25 bp, E. coli
agagagcggcgctctgttcgttgac

SEQ ID NO: 108775 - DNA, 25 bp, E. coli
atgagcttactctacgtccctgcgg

SEQ ID NO: 108776 - DNA, 25 bp, E. coli
agagagcggcgcactgttcgttgac

SEQ ID NO: 108777 - DNA, 25 bp, E. coli
atgagcttactcaacgtccctgcgg

SEQ ID NO: 108778 - DNA, 25 bp, E. coli
tacgaaatcgactaagagagcggcg

SEQ ID NO: 108779 - DNA, 25 bp, E. coli
tgaaggttgggaaaacgcagaagcc

SEQ ID NO: 108780 - DNA, 25 bp, E. coli
tgaaggttgggataacgcagaagcc

SEQ ID NO: 108781 - DNA, 25 bp, E. coli
tctacgttgttaatgagatcccggc

SEQ ID NO: 108782 - DNA, 25 bp, E. coli
tctacgttgttattgagatcccggc

SEQ ID NO: 108783 - DNA, 25 bp, E. coli
gaagccgctaaagctgaaatcgttg

SEQ ID NO: 108784 - DNA, 25 bp, E. coli
gacgaagccggtgaagatgcgaaac

SEQ ID NO: 108785 - DNA, 25 bp, E. coli
gaagccgctaaacctgaaatcgttg

SEQ ID NO: 108786 - DNA, 25 bp, E. coli
gacgaagccggtcaagatgcgaaac

SEQ ID NO: 108787 - DNA, 25 bp, E. coli
gttgaccgcttcatgtccaccgcga

SEQ ID NO: 108788 - DNA, 25 bp, E. coli
gtccctgcgggtaaagatctgccgg

SEQ ID NO: 108789 - DNA, 25 bp, E. coli
gttgaccgcttcttgtccaccgcga

SEQ ID NO: 108790 - DNA, 25 bp, E. coli
gtccctgcgggttaagatctgccgg

SEQ ID NO: 108791 - DNA, 25 bp, E. coli
gatctgccggaagacatctacgttg

SEQ ID NO: 108792 - DNA, 25 bp, E. coli
gatctgccggaacacatctacgttg

SEQ ID NO: 108793 - DNA, 25 bp, E. coli
cagccggtagtatcaccggaagaag

SEQ ID NO: 108794 - DNA, 25 bp, E. coli
caaatcaaccctgcgggcattgctg

SEQ ID NO: 108795 - DNA, 25 bp, E. coli
caaatcaaccctccgggcattgctg

SEQ ID NO: 108796 - DNA, 25 bp, E. coli
cagccggtagtaacaccggaagaag

SEQ ID NO: 108797 - DNA, 25 bp, E. coli
catcggcgcgcatagcaaggtagat

SEQ ID NO: 108798 - DNA, 25 bp, E. coli
catcggcgcgcaaagcaaggtagat

SEQ ID NO: 108799 - DNA, 25 bp, E. coli
tgccgatacgtttgtgctgctcggc

SEQ ID NO: 108800 - DNA, 25 bp, E. coli
tgccgatacgttagtgctgctcggc

SEQ ID NO: 108801 - DNA, 25 bp, E. coli
tcatgcgccacagccggtagtaaca

SEQ ID NO: 108802 - DNA, 25 bp, E. coli
tcggaatgacgggattaatcggctt

SEQ ID NO: 108803 - DNA, 25 bp, E. coli
tcggaatgacggcattaatcggctt

SEQ ID NO: 108804 - DNA, 25 bp, E. coli
tcatgcgccacacccggtagtaaca

SEQ ID NO: 108805 - DNA, 25 bp, E. coli
cgtatgatgtcggaatgacgggatt

SEQ ID NO: 108806 - DNA, 25 bp, E. coli
cgcatagcaaggtagatatggcgct

SEQ ID NO: 108807 - DNA, 25 bp, E. coli
cgcatagcaaggaagatatggcgct

SEQ ID NO: 108808 - DNA, 25 bp, E. coli
cgtatgatgtcgcaatgacgggatt

SEQ ID NO: 108809 - DNA, 25 bp, E. coli
gatatcaaatcatccctgcgggcat

SEQ ID NO: 108810 - DNA, 25 bp, E. coli
gatatcaaatcaaccctgcgggcat

SEQ ID NO: 108811 - DNA, 25 bp, E. coli
ggcgatatcaaaacaaccctgcggg

SEQ ID NO: 108812 - DNA, 25 bp, E. coli
ggcgatatcaaatcaaccctgcggg

SEQ ID NO: 108813 - DNA, 25 bp, E. coli
gatgaatgccgatacgttagtgctg

SEQ ID NO: 108814 - DNA, 25 bp, E. coli
gatgaatgccgaaacgttagtgctg

SEQ ID NO: 108815 - DNA, 25 bp, E. coli
catccgtctcaggtgggcacaatga

SEQ ID NO: 108816 - DNA, 25 bp, E. coli
catccgtctcagctgggcacaatga

SEQ ID NO: 108817 - DNA, 25 bp, E. coli
taaagcgataaacgctaccgtagca

SEQ ID NO: 108818 - DNA, 25 bp, E. coli
tagccagcaagtggcgactgtcgag

SEQ ID NO: 108819 - DNA, 25 bp, E. coli
tagccagcaagtcgcgactgtcgag

SEQ ID NO: 108820 - DNA, 25 bp, E. coli
tgctggaacacaccttagccccgga

SEQ ID NO: 108821 - DNA, 25 bp, E. coli
tccggaggttgaatggatacaggtc

SEQ ID NO: 108822 - DNA, 25 bp, E. coli
tgctggaacacagcttagccccgga

SEQ ID NO: 108823 - DNA, 25 bp, E. coli
tccggaggttgattggatacaggtc

SEQ ID NO: 108824 - DNA, 25 bp, E. coli
gccccggaggatgggatataatacc

SEQ ID NO: 108825 - DNA, 25 bp, E. coli
gccccggaggatcggatataatacc

SEQ ID NO: 108826 - DNA, 25 bp, E. coli
gcaatcttcctggaagtgacaatgc

SEQ ID NO: 108827 - DNA, 25 bp, E. coli
gcaatcttcctgcaagtgacaatgc

SEQ ID NO: 108828 - DNA, 25 bp, E. coli
gatacaggtcgataatgccagcgct

SEQ ID NO: 108829 - DNA, 25 bp, E. coli
gatacaggtcgaaaatgccagcgct

SEQ ID NO: 108830 - DNA, 25 bp, E. coli
ggctaccgtagcaaaaagtcagttt

SEQ ID NO: 108831 - DNA, 25 bp, E. coli
ggctaccgtagctaaaagtcagttt

SEQ ID NO: 108832 - DNA, 25 bp, E. coli
taaagcgataaaggctaccgtagca

SEQ ID NO: 108833 - DNA, 25 bp, E. coli
taatacctggcgctatttatagtga

SEQ ID NO: 108834 - DNA, 25 bp, E. coli
taatacctggcggtatttatagtga

SEQ ID NO: 108835 - DNA, 25 bp, E. coli
gatctaattaatccactcgaggtag

SEQ ID NO: 108836 - DNA, 25 bp, E. coli
gatctaattaatgcactcgaggtag

SEQ ID NO: 108837 - DNA, 25 bp, E. coli
cagaataatgtaaatgaagccggat

SEQ ID NO: 108838 - DNA, 25 bp, E. coli
cagaataatgtatatgaagccggat

SEQ ID NO: 108839 - DNA, 25 bp, E. coli
tacagacttgttttgcgtgataaaa

SEQ ID NO: 108840 - DNA, 25 bp, E. coli
tacagacttgttatgcgtgataaaa

SEQ ID NO: 108841 - DNA, 25 bp, E. coli
aaaaatagatgtactcacgctctta

SEQ ID NO: 108842 - DNA, 25 bp, E. coli
aaaaatagatgttctcacgctctta

SEQ ID NO: 108843 - DNA, 25 bp, E. coli
tagaacggtgttagctcatcaagcg

SEQ ID NO: 108844 - DNA, 25 bp, E. coli
tagcaggttatctgaacgcaaaaca

SEQ ID NO: 108845 - DNA, 25 bp, E. coli
tagaacggtgtttgctcatcaagcg

SEQ ID NO: 108846 - DNA, 25 bp, E. coli
tagcaggttatcagaacgcaaaaca

SEQ ID NO: 108847 - DNA, 25 bp, E. coli
tattgctgcatggataataaagcga

SEQ ID NO: 108848 - DNA, 25 bp, E. coli
tattgctgcatgcataataaagcga

SEQ ID NO: 108849 - DNA, 25 bp, E. coli
tgaagccggatgatattaacgatca

SEQ ID NO: 108850 - DNA, 25 bp, E. coli
tgaagccggatgttattaacgatca

SEQ ID NO: 108851 - DNA, 25 bp, E. coli
tgcaaaagcaacagatagaacggtg

SEQ ID NO: 108852 - DNA, 25 bp, E. coli
tgcaaaagcaactgatagaacggtg

SEQ ID NO: 108853 - DNA, 25 bp, E. coli
cgacatcattgaaagaaaacaggtg

SEQ ID NO: 108854 - DNA, 25 bp, E. coli
cgacatcattgatagaaaacaggtg

SEQ ID NO: 108855 - DNA, 25 bp, E. coli
taacccctatacgatgtctatctgg

SEQ ID NO: 108856 - DNA, 25 bp, E. coli
taacccctataccatgtctatctgg

SEQ ID NO: 108857 - DNA, 25 bp, E. coli
taataacgcaagtgacaaaacaatg

SEQ ID NO: 108858 - DNA, 25 bp, E. coli
taataacgcaagagacaaaacaatg

SEQ ID NO: 108859 - DNA, 25 bp, E. coli
ctggtagcttgtgcgcaatcaaccg

SEQ ID NO: 108860 - DNA, 25 bp, E. coli
ctggtagcttgtccgcaatcaaccg

SEQ ID NO: 108861 - DNA, 25 bp, E. coli
caggcggtgaaacccgattgtgata

SEQ ID NO: 108862 - DNA, 25 bp, E. coli
caggcggtgaaagccgattgtgata

SEQ ID NO: 108863 - DNA, 25 bp, E. coli
ttgaagcctgccagagcgtgttaaa

SEQ ID NO: 108864 - DNA, 25 bp, E. coli
ttgaagcctgcctgagcgtgttaaa

SEQ ID NO: 108865 - DNA, 25 bp, E. coli
tgatcaggcggtcaaagccgattgt

SEQ ID NO: 108866 - DNA, 25 bp, E. coli
tgatcaggcggtgaaagccgattgt

SEQ ID NO: 108867 - DNA, 25 bp, E. coli
tgaaaaaactgaatctcatcgccat

SEQ ID NO: 108868 - DNA, 25 bp, E. coli
tgaaaaaactgattctcatcgccat

SEQ ID NO: 108869 - DNA, 25 bp, E. coli
ccggaaatgatcaggcggtgaaagc

SEQ ID NO: 108870 - DNA, 25 bp, E. coli
ccggaaatgatctggcggtgaaagc

SEQ ID NO: 108871 - DNA, 25 bp, E. coli
gcgtgttaaacgagctgaagaaaga

SEQ ID NO: 108872 - DNA, 25 bp, E. coli
gcgtgttaaacgtgctgaagaaaga

SEQ ID NO: 108873 - DNA, 25 bp, E. coli
gaaaaaattgaaccctgccagagcg

SEQ ID NO: 108874 - DNA, 25 bp, E. coli
gaaaaaattgaagcctgccagagcg

SEQ ID NO: 108875 - DNA, 25 bp, E. coli
cgtgctgaagaatgagaaacaacat

SEQ ID NO: 108876 - DNA, 25 bp, E. coli
cgtgctgaagaaagagaaacaacat

SEQ ID NO: 108877 - DNA, 25 bp, E. coli
gggctggtagctagtgcgcaatcaa

SEQ ID NO: 108878 - DNA, 25 bp, E. coli
gggctggtagcttgtgcgcaatcaa

SEQ ID NO: 108879 - DNA, 25 bp, E. coli
gagaaacaacatcagcagtttgccg

SEQ ID NO: 108880 - DNA, 25 bp, E. coli
gagaaacaacatgagcagtttgccg

SEQ ID NO: 108881 - DNA, 25 bp, E. coli
caatcctggcaaaggcagtggtaca

SEQ ID NO: 108882 - DNA, 25 bp, E. coli
caatcctggcaatggcagtggtaca

SEQ ID NO: 108883 - DNA, 25 bp, E. coli
tctggtgcatctggtgtgcttcctg

SEQ ID NO: 108884 - DNA, 25 bp, E. coli
tctggtgcatctcgtgtgcttcctg

SEQ ID NO: 108885 - DNA, 25 bp, E. coli
gcctctccggccctaattctgggaa

SEQ ID NO: 108886 - DNA, 25 bp, E. coli
gcctctccggccgtaattctgggaa

SEQ ID NO: 108887 - DNA, 25 bp, E. coli
gcgtaaaaacctacatgacaggctt

SEQ ID NO: 108888 - DNA, 25 bp, E. coli
gcgtaaaaaccttcatgacaggctt

SEQ ID NO: 108889 - DNA, 25 bp, E. coli
gaataccaaatctgatgaaggctgg

SEQ ID NO: 108890 - DNA, 25 bp, E. coli
gaataccaaatcagatgaaggctgg

SEQ ID NO: 108891 - DNA, 25 bp, E. coli
cgtaattctgggaacaatcctggca

SEQ ID NO: 108892 - DNA, 25 bp, E. coli
cgtaattctgggtacaatcctggca

SEQ ID NO: 108893 - DNA, 25 bp, E. coli
gattccgttctggatggtgatgaca

SEQ ID NO: 108894 - DNA, 25 bp, E. coli
gattccgttctgcatggtgatgaca

SEQ ID NO: 108895 - DNA, 25 bp, E. coli
gtggaacctcaactacaacatgatg

SEQ ID NO: 108896 - DNA, 25 bp, E. coli
gtgcttcctgcagatgaataccaaa

SEQ ID NO: 108897 - DNA, 25 bp, E. coli
gtggaacctcaagtacaacatgatg

SEQ ID NO: 108898 - DNA, 25 bp, E. coli
gtgcttcctgcacatgaataccaaa

SEQ ID NO: 108899 - DNA, 25 bp, E. coli
ggcgcgtcccatggcagcgtaaaaa

SEQ ID NO: 108900 - DNA, 25 bp, E. coli
ggctttatcctgtcgatcattctga

SEQ ID NO: 108901 - DNA, 25 bp, E. coli
ggctttatcctgacgatcattctga

SEQ ID NO: 108902 - DNA, 25 bp, E. coli
ggcgcgtcccatcgcagcgtaaaaa

SEQ ID NO: 108903 - DNA, 25 bp, E. coli
caggaagatttgcaagccaccgatc

SEQ ID NO: 108904 - DNA, 25 bp, E. coli
caggaagatttggaagccaccgatc

SEQ ID NO: 108905 - DNA, 25 bp, E. coli
tactcaagccgctgactggcgtttg

SEQ ID NO: 108906 - DNA, 25 bp, E. coli
tactcaagccgcagactggcgtttg

SEQ ID NO: 108907 - DNA, 25 bp, E. coli
tatggaaatcgaggtcgcgctggca

SEQ ID NO: 108908 - DNA, 25 bp, E. coli
tatggaaatcgacgtcgcgctggca

SEQ ID NO: 108909 - DNA, 25 bp, E. coli
tagcaacgggtgtcggcagtatcgc

SEQ ID NO: 108910 - DNA, 25 bp, E. coli
tagcaacgggtgacggcagtatcgc

SEQ ID NO: 108911 - DNA, 25 bp, E. coli
ttatatcgcgctcggacatgtgttc

SEQ ID NO: 108912 - DNA, 25 bp, E. coli
ttatatcgcgctgggacatgtgttc

SEQ ID NO: 108913 - DNA, 25 bp, E. coli
tgcaggcgtacgaactctccagcta

SEQ ID NO: 108914 - DNA, 25 bp, E. coli
tgcaggcgtacgtactctccagcta

SEQ ID NO: 108915 - DNA, 25 bp, E. coli
gacagcgtacagaggatcgaacgtc

SEQ ID NO: 108916 - DNA, 25 bp, E. coli
gacagcgtacagtggatcgaacgtc

SEQ ID NO: 108917 - DNA, 25 bp, E. coli
cgaacgtctgttcgatgcaggcgta

SEQ ID NO: 108918 - DNA, 25 bp, E. coli
cgaacgtctgttggatgcaggcgta

SEQ ID NO: 108919 - DNA, 25 bp, E. coli
gttcccgacgcaaaccaaacagatg

SEQ ID NO: 108920 - DNA, 25 bp, E. coli
gttcccgacgcataccaaacagatg

SEQ ID NO: 108921 - DNA, 25 bp, E. coli
gtcgtcagcgccattactcaagccg

SEQ ID NO: 108922 - DNA, 25 bp, E. coli
gtcgtcagcgcctttactcaagccg

SEQ ID NO: 108923 - DNA, 25 bp, E. coli
ggccgccgctataacgcgcgattgt

SEQ ID NO: 108924 - DNA, 25 bp, E. coli
ggccgccgctattacgcgcgattgt

SEQ ID NO: 108925 - DNA, 25 bp, E. coli
atccctggtttctcgctcagccggg

SEQ ID NO: 108926 - DNA, 25 bp, E. coli
atccctggtttcacgctcagccggg

SEQ ID NO: 108927 - DNA, 25 bp, E. coli
taccgctggcgaaattgtgcgatga

SEQ ID NO: 108928 - DNA, 25 bp, E. coli
taccgctggcgatattgtgcgatga

SEQ ID NO: 108929 - DNA, 25 bp, E. coli
tattcactgaatcacggcgagggca

SEQ ID NO: 108930 - DNA, 25 bp, E. coli
tattcactgaatgacggcgagggca

SEQ ID NO: 108931 - DNA, 25 bp, E. coli
tgtggcgcgcattttcaacattcag

SEQ ID NO: 108932 - DNA, 25 bp, E. coli
tggtgtgctaatgcggagtcgatct

SEQ ID NO: 108933 - DNA, 25 bp, E. coli
tgtggcgcgcatattcaacattcag

SEQ ID NO: 108934 - DNA, 25 bp, E. coli
tgcgtgatgcggatgaatgcccctc

SEQ ID NO: 108935 - DNA, 25 bp, E. coli
tgcgtgatgcggttgaatgcccctc

SEQ ID NO: 108936 - DNA, 25 bp, E. coli
gacattttctttcgcacgtccggcg

SEQ ID NO: 108937 - DNA, 25 bp, E. coli
gacattttctttggcacgtccggcg

SEQ ID NO: 108938 - DNA, 25 bp, E. coli
cgagggcattcgaacggtggtcttt

SEQ ID NO: 108939 - DNA, 25 bp, E. coli
cgagggcattcgtacggtggtcttt

SEQ ID NO: 108940 - DNA, 25 bp, E. coli
ggattggtcgcgttatcagccttga

SEQ ID NO: 108941 - DNA, 25 bp, E. coli
ggattggtcgcgatatcagccttga

SEQ ID NO: 108942 - DNA, 25 bp, E. coli
gtcgatctccgggaaaatccagacg

SEQ ID NO: 108943 - DNA, 25 bp, E. coli
gtcgatctccggcaaaatccagacg

SEQ ID NO: 108944 - DNA, 25 bp, E. coli
tggtgtgctaatccggagtcgatct

SEQ ID NO: 108945 - DNA, 25 bp, E. coli
tcagccgggagaatatgcagcaggc

SEQ ID NO: 108946 - DNA, 25 bp, E. coli
tcagccgggagattatgcagcaggc

SEQ ID NO: 108947 - DNA, 25 bp, E. coli
caggacctgtggatgctgcgagaca

SEQ ID NO: 108948 - DNA, 25 bp, E. coli
caggacctgtggttgctgcgagaca

SEQ ID NO: 108949 - DNA, 25 bp, E. coli
ttggaaacctttccggtaatacgag

SEQ ID NO: 108950 - DNA, 25 bp, E. coli
ttggaaacctttgcggtaatacgag

SEQ ID NO: 108951 - DNA, 25 bp, E. coli
tatcgcccaattggtttttgcaggg

SEQ ID NO: 108952 - DNA, 25 bp, E. coli
tatcgcgccattggtaattatccct

SEQ ID NO: 108953 - DNA, 25 bp, E. coli
tatcgcgccattcgtaattatccct

SEQ ID NO: 108954 - DNA, 25 bp, E. coli
tatcgcccaattcgtttttgcaggg

SEQ ID NO: 108955 - DNA, 25 bp, E. coli
tgtgagacccaatatttacagcgct

SEQ ID NO: 108956 - DNA, 25 bp, E. coli
tgtgagacccaaaatttacagcgct

SEQ ID NO: 108957 - DNA, 25 bp, E. coli
tgaataggatacaacgtgtgcacaa

SEQ ID NO: 108958 - DNA, 25 bp, E. coli
tgctagcttttaatgcccatcgaaa

SEQ ID NO: 108959 - DNA, 25 bp, E. coli
tgaataggatactacgtgtgcacaa

SEQ ID NO: 108960 - DNA, 25 bp, E. coli
tgctagcttttattgcccatcgaaa

SEQ ID NO: 108961 - DNA, 25 bp, E. coli
gctgcgagacatagatgtgagaccc

SEQ ID NO: 108962 - DNA, 25 bp, E. coli
gctgcgagacattgatgtgagaccc

SEQ ID NO: 108963 - DNA, 25 bp, E. coli
cattgtggaatttaagaaggcagga

SEQ ID NO: 108964 - DNA, 25 bp, E. coli
cattgtggaattaaagaaggcagga

SEQ ID NO: 108965 - DNA, 25 bp, E. coli
gattttggcttttcttacacaggac

SEQ ID NO: 108966 - DNA, 25 bp, E. coli
gattttggctttacttacacaggac

SEQ ID NO: 108967 - DNA, 25 bp, E. coli
taatatcacgctttgacattctggg

SEQ ID NO: 108968 - DNA, 25 bp, E. coli
taatatcacgctatgacattctggg

SEQ ID NO: 108969 - DNA, 25 bp, E. coli
caagacttattgcaatcttatgcca

SEQ ID NO: 108970 - DNA, 25 bp, E. coli
caagacttattggaatcttatgcca

SEQ ID NO: 108971 - DNA, 25 bp, E. coli
cattcgtttgttgagcggaccatag

SEQ ID NO: 108972 - DNA, 25 bp, E. coli
cattcgtttgttcagcggaccatag

SEQ ID NO: 108973 - DNA, 25 bp, E. coli
acttattggaatgttatgccattcg

SEQ ID NO: 108974 - DNA, 25 bp, E. coli
acttattggaatcttatgccattcg

SEQ ID NO: 108975 - DNA, 25 bp, E. coli
tatgccattcgtttgttgagcggac

SEQ ID NO: 108976 - DNA, 25 bp, E. coli
tatgccattcgtatgttgagcggac

SEQ ID NO: 108977 - DNA, 25 bp, E. coli
tgccattcgtttgttgagcggacca

SEQ ID NO: 108978 - DNA, 25 bp, E. coli
tgccattcgtttcttgagcggacca

SEQ ID NO: 108979 - DNA, 25 bp, E. coli
tcttatgccattcgtttgttgagcg

SEQ ID NO: 108980 - DNA, 25 bp, E. coli
tcttatcacaagacttattggaatc

SEQ ID NO: 108981 - DNA, 25 bp, E. coli
tcttatgccattggtttgttgagcg

SEQ ID NO: 108982 - DNA, 25 bp, E. coli
tcttatcacaagtcttattggaatc

SEQ ID NO: 108983 - DNA, 25 bp, E. coli
gccattcgtttgatgagcggaccat

SEQ ID NO: 108984 - DNA, 25 bp, E. coli
ccattcgtttgtagagcggaccata

SEQ ID NO: 108985 - DNA, 25 bp, E. coli
ccattcgtttgttgagcggaccata

SEQ ID NO: 108986 - DNA, 25 bp, E. coli
gccattcgtttgttgagcggaccat

SEQ ID NO: 108987 - DNA, 25 bp, E. coli
ggaatcttatgcgattcgtttgttg

SEQ ID NO: 108988 - DNA, 25 bp, E. coli
ggaatcttatgccattcgtttgttg

SEQ ID NO: 108989 - DNA, 25 bp, E. coli
taatgataaattcttatcacaagac

SEQ ID NO: 108990 - DNA, 25 bp, E. coli
taatgataaattgttatcacaagac

SEQ ID NO: 108991 - DNA, 25 bp, E. coli
aatgctttccgggttgtatggcgta

SEQ ID NO: 108992 - DNA, 25 bp, E. coli
aatgctttccggcttgtatggcgta

SEQ ID NO: 108993 - DNA, 25 bp, E. coli
caacgccgctcgctttcatgactgg

SEQ ID NO: 108994 - DNA, 25 bp, E. coli
caacgccgctcggtttcatgactgg

SEQ ID NO: 108995 - DNA, 25 bp, E. coli
ttgcaggccgaaaccttcagcgaag

SEQ ID NO: 108996 - DNA, 25 bp, E. coli
ttgcaggccgaatccttcagcgaag

SEQ ID NO: 108997 - DNA, 25 bp, E. coli
tcctcgatgagatgaacggcaaatt

SEQ ID NO: 108998 - DNA, 25 bp, E. coli
tgcccgagggaatgatctgtatcaa

SEQ ID NO: 108999 - DNA, 25 bp, E. coli
tgcccgagggaaagatctgtatcaa

SEQ ID NO: 109000 - DNA, 25 bp, E. coli
tcctcgatgagaagaacggcaaatt

SEQ ID NO: 109001 - DNA, 25 bp, E. coli
tcggctgaccaatccagagcaactg

SEQ ID NO: 109002 - DNA, 25 bp, E. coli
tctacgctaagaaagcacgcggtct

SEQ ID NO: 109003 - DNA, 25 bp, E. coli
tctacgctaagatagcacgcggtct

SEQ ID NO: 109004 - DNA, 25 bp, E. coli
tcggctgaccaaaccagagcaactg

SEQ ID NO: 109005 - DNA, 25 bp, E. coli
gacgatttcgatattgcccaacagc

SEQ ID NO: 109006 - DNA, 25 bp, E. coli
gacgatttcgattttgcccaacagc

SEQ ID NO: 109007 - DNA, 25 bp, E. coli
cggtgaagccgaagaaattgaatgc

SEQ ID NO: 109008 - DNA, 25 bp, E. coli
cggtgaagccgatgaaattgaatgc

SEQ ID NO: 109009 - DNA, 25 bp, E. coli
ggcgctcgcagcacaaggcgataat

SEQ ID NO: 109010 - DNA, 25 bp, E. coli
ggcgctcgcagctcaaggcgataat

SEQ ID NO: 109011 - DNA, 25 bp, E. coli
tcaccaacaagcagaacgaggcgct

SEQ ID NO: 109012 - DNA, 25 bp, E. coli
tcaccaacaagctgaacgaggcgct

SEQ ID NO: 109013 - DNA, 25 bp, E. coli
aatcgcttaaccaggtgatttctaa

SEQ ID NO: 109014 - DNA, 25 bp, E. coli
gcttaacctggtgatttctaaaaga

SEQ ID NO: 109015 - DNA, 25 bp, E. coli
gcttaacctggtcatttctaaaaga

SEQ ID NO: 109016 - DNA, 25 bp, E. coli
agctgaatcgctaaacctggtgatt

SEQ ID NO: 109017 - DNA, 25 bp, E. coli
agctgaatcgcttaacctggtgatt

SEQ ID NO: 109018 - DNA, 25 bp, E. coli
aatcgcttaacctggtgatttctaa

SEQ ID NO: 109019 - DNA, 25 bp, E. coli
ttaacctggtgaattctaaaagaag

SEQ ID NO: 109020 - DNA, 25 bp, E. coli
ttaacctggtgatttctaaaagaag

SEQ ID NO: 109021 - DNA, 25 bp, E. coli
tgatttctaaaagaagttttttgca

SEQ ID NO: 109022 - DNA, 25 bp, E. coli
tgatttctaaaacaagttttttgca

SEQ ID NO: 109023 - DNA, 25 bp, E. coli
tcgcttaacctgctgatttctaaaa

SEQ ID NO: 109024 - DNA, 25 bp, E. coli
tcgcttaacctggtgatttctaaaa

SEQ ID NO: 109025 - DNA, 25 bp, E. coli
gctgaatcgctttacctggtgattt

SEQ ID NO: 109026 - DNA, 25 bp, E. coli
gctgaatcgcttaacctggtgattt

SEQ ID NO: 109027 - DNA, 25 bp, E. coli
gaatcgcttaacgtggtgatttcta

SEQ ID NO: 109028 - DNA, 25 bp, E. coli
gaatcgcttaacctggtgatttcta

SEQ ID NO: 109029 - DNA, 25 bp, E. coli
ctgaatcgcttatcctggtgatttc

SEQ ID NO: 109030 - DNA, 25 bp, E. coli
ctgaatcgcttaacctggtgatttc

SEQ ID NO: 109031 - DNA, 25 bp, E. coli
taacctggtgatatctaaaagaagt

SEQ ID NO: 109032 - DNA, 25 bp, E. coli
taacctggtgatttctaaaagaagt

SEQ ID NO: 109033 - DNA, 25 bp, E. coli
gagctgaatcgcataacctggtgat

SEQ ID NO: 109034 - DNA, 25 bp, E. coli
gagctgaatcgcttaacctggtgat

SEQ ID NO: 109035 - DNA, 25 bp, E. coli
cagcgaatgcgtagggtaaactggc

SEQ ID NO: 109036 - DNA, 25 bp, E. coli
cagcgaatgcgttgggtaaactggc

SEQ ID NO: 109037 - DNA, 25 bp, E. coli
tacagtgggcaaacaaaaatgaccg

SEQ ID NO: 109038 - DNA, 25 bp, E. coli
taaaattctggtgatcgccgcggac

SEQ ID NO: 109039 - DNA, 25 bp, E. coli
tacagtgggcaatcaaaaatgaccg

SEQ ID NO: 109040 - DNA, 25 bp, E. coli
taaaattctggtcatcgccgcggac

SEQ ID NO: 109041 - DNA, 25 bp, E. coli
agtttgaatactcggctatgccgca

SEQ ID NO: 109042 - DNA, 25 bp, E. coli
agtttgaatactgggctatgccgca

SEQ ID NO: 109043 - DNA, 25 bp, E. coli
tatatgccgggtgatctcacctggt

SEQ ID NO: 109044 - DNA, 25 bp, E. coli
tatatgccgggtcatctcacctggt

SEQ ID NO: 109045 - DNA, 25 bp, E. coli
tcaccgggcgagtacataaggaccg

SEQ ID NO: 109046 - DNA, 25 bp, E. coli
tcattaatgacgacatcaccgggcg

SEQ ID NO: 109047 - DNA, 25 bp, E. coli
tcattaatgacgtcatcaccgggcg

SEQ ID NO: 109048 - DNA, 25 bp, E. coli
ccatgctgcaggattcgaattcgaa

SEQ ID NO: 109049 - DNA, 25 bp, E. coli
ccatgctgcaggtttcgaattcgaa

SEQ ID NO: 109050 - DNA, 25 bp, E. coli
ggcgacagtcctattgcagcgaatg

SEQ ID NO: 109051 - DNA, 25 bp, E. coli
ggcgacagtccttttgcagcgaatg

SEQ ID NO: 109052 - DNA, 25 bp, E. coli
taaccatccgattgaaacgttgctg

SEQ ID NO: 109053 - DNA, 25 bp, E. coli
taaccatccgatagaaacgttgctg

SEQ ID NO: 109054 - DNA, 25 bp, E. coli
tcaccgggcgagaacataaggaccg

SEQ ID NO: 109055 - DNA, 25 bp, E. coli
gacgaacgttatttgccgaccgata

SEQ ID NO: 109056 - DNA, 25 bp, E. coli
gacgaacgttatatgccgaccgata

SEQ ID NO: 109057 - DNA, 25 bp, E. coli
aatcgacgaaaaagctaaccgcctg

SEQ ID NO: 109058 - DNA, 25 bp, E. coli
aatcgacgaaaatgctaaccgcctg

SEQ ID NO: 109059 - DNA, 25 bp, E. coli
aaagctaaccgcctgaaaggttctg

SEQ ID NO: 109060 - DNA, 25 bp, E. coli
aaagctaaccgcgtgaaaggttctg

SEQ ID NO: 109061 - DNA, 25 bp, E. coli
tatttgtcagtgaggtcgatccggg

SEQ ID NO: 109062 - DNA, 25 bp, E. coli
tatttgtcagtgtggtcgatccggg

SEQ ID NO: 109063 - DNA, 25 bp, E. coli
tattgatgtgaagaaatgtgataag

SEQ ID NO: 109064 - DNA, 25 bp, E. coli
tattgatgtgaacaaatgtgataag

SEQ ID NO: 109065 - DNA, 25 bp, E. coli
tccgggcgtagggactgaccgtaaa

SEQ ID NO: 109066 - DNA, 25 bp, E. coli
tccgggcgtaggcactgaccgtaaa

SEQ ID NO: 109067 - DNA, 25 bp, E. coli
gcactgaccgtaaatcgatagtgct

SEQ ID NO: 109068 - DNA, 25 bp, E. coli
gcactgaccgtatatcgatagtgct

SEQ ID NO: 109069 - DNA, 25 bp, E. coli
gacgaaaaagcttaccgcctgaaag

SEQ ID NO: 109070 - DNA, 25 bp, E. coli
gacgaaaaagctaaccgcctgaaag

SEQ ID NO: 109071 - DNA, 25 bp, E. coli
ccgcaaggttcggtatttgtcagtg

SEQ ID NO: 109072 - DNA, 25 bp, E. coli
ccgcaaggttcgctatttgtcagtg

SEQ ID NO: 109073 - DNA, 25 bp, E. coli
cgtaggcactgagcgtaaatcgata

SEQ ID NO: 109074 - DNA, 25 bp, E. coli
cgtaggcactgaccgtaaatcgata

SEQ ID NO: 109075 - DNA, 25 bp, E. coli
gtcgatccgggcctaggcactgacc

SEQ ID NO: 109076 - DNA, 25 bp, E. coli
gtcgatccgggcgtaggcactgacc

SEQ ID NO: 109077 - DNA, 25 bp, E. coli
taaccgcctgaaaggttctgaaaag

SEQ ID NO: 109078 - DNA, 25 bp, E. coli
taaccgcctgaatggttctgaaaag

SEQ ID NO: 109079 - DNA, 25 bp, E. coli
cacgtgcagtgggtagtgaaacatc

SEQ ID NO: 109080 - DNA, 25 bp, E. coli
cacgtgcagtggctagtgaaacatc

SEQ ID NO: 109081 - DNA, 25 bp, E. coli
cagtatgctgacaggaaaggcgtac

SEQ ID NO: 109082 - DNA, 25 bp, E. coli
cagtatgctgactggaaaggcgtac

SEQ ID NO: 109083 - DNA, 25 bp, E. coli
cggttcaacgggtcgccatgtcggt

SEQ ID NO: 109084 - DNA, 25 bp, E. coli
cggttcaacgggacgccatgtcggt

SEQ ID NO: 109085 - DNA, 25 bp, E. coli
tgatttagttctgttccgtgccggt

SEQ ID NO: 109086 - DNA, 25 bp, E. coli
tgatttagttctcttccgtgccggt

SEQ ID NO: 109087 - DNA, 25 bp, E. coli
tgcatgtagtgctaataacaccgca

SEQ ID NO: 109088 - DNA, 25 bp, E. coli
tgcatgtagtgcaaataacaccgca

SEQ ID NO: 109089 - DNA, 25 bp, E. coli
tctgggcggcagcactaaaaaaggt

SEQ ID NO: 109090 - DNA, 25 bp, E. coli
tctgggcggcaggactaaaaaaggt

SEQ ID NO: 109091 - DNA, 25 bp, E. coli
gcaatttggctttgaacttccgcgt

SEQ ID NO: 109092 - DNA, 25 bp, E. coli
gcaatttggcttagaacttccgcgt

SEQ ID NO: 109093 - DNA, 25 bp, E. coli
gaatatgcatcctgagacacgtgca

SEQ ID NO: 109094 - DNA, 25 bp, E. coli
gaatatgcatccagagacacgtgca

SEQ ID NO: 109095 - DNA, 25 bp, E. coli
gaaaacctggttggtaatgtcgacg

SEQ ID NO: 109096 - DNA, 25 bp, E. coli
gaaaacctggttcgtaatgtcgacg

SEQ ID NO: 109097 - DNA, 25 bp, E. coli
cgtacagcgtacattccgtgagcaa

SEQ ID NO: 109098 - DNA, 25 bp, E. coli
cgtacagcgtactttccgtgagcaa

SEQ ID NO: 109099 - DNA, 25 bp, E. coli
gttacaacgaagcacgccgggttct

SEQ ID NO: 109100 - DNA, 25 bp, E. coli
gttacaacgaaggacgccgggttct

SEQ ID NO: 109101 - DNA, 25 bp, E. coli
caaggaactgaccatgaaataggca

SEQ ID NO: 109102 - DNA, 25 bp, E. coli
caaggaactgacgatgaaataggca

SEQ ID NO: 109103 - DNA, 25 bp, E. coli
catttctatggctaagggagtacaa

SEQ ID NO: 109104 - DNA, 25 bp, E. coli
catttctatggcaaagggagtacaa

SEQ ID NO: 109105 - DNA, 25 bp, E. coli
tactgcagccctctatccggaagtt

SEQ ID NO: 109106 - DNA, 25 bp, E. coli
taaaagttcgccatgaagctatggc

SEQ ID NO: 109107 - DNA, 25 bp, E. coli
tactgcagccctgtatccggaagtt

SEQ ID NO: 109108 - DNA, 25 bp, E. coli
tatgtcgggcttaatttcaggaggc

SEQ ID NO: 109109 - DNA, 25 bp, E. coli
tatgtcgggctttatttcaggaggc

SEQ ID NO: 109110 - DNA, 25 bp, E. coli
ttagaacagcggttaaagaagcact

SEQ ID NO: 109111 - DNA, 25 bp, E. coli
ttagaacagcggataaagaagcact

SEQ ID NO: 109112 - DNA, 25 bp, E. coli
tgggtgcaaaagacaaatacatggc

SEQ ID NO: 109113 - DNA, 25 bp, E. coli
tgggtgcaaaagtcaaatacatggc

SEQ ID NO: 109114 - DNA, 25 bp, E. coli
tctaagttgcctaccaatgggccaa

SEQ ID NO: 109115 - DNA, 25 bp, E. coli
tctaagttgccttccaatgggccaa

SEQ ID NO: 109116 - DNA, 25 bp, E. coli
gattacttctccacatcacaggcag

SEQ ID NO: 109117 - DNA, 25 bp, E. coli
gattacttctcctcatcacaggcag

SEQ ID NO: 109118 - DNA, 25 bp, E. coli
taaaagttcgccttgaagctatggc

SEQ ID NO: 109119 - DNA, 25 bp, E. coli
taattggagatacccgagttgtagc

SEQ ID NO: 109120 - DNA, 25 bp, E. coli
taactggatacaaggacaaggaact

SEQ ID NO: 109121 - DNA, 25 bp, E. coli
taactggatacatggacaaggaact

SEQ ID NO: 109122 - DNA, 25 bp, E. coli
taattggagatagccgagttgtagc

SEQ ID NO: 109123 - DNA, 25 bp, E. coli
caatttgcaacggactcaggtagcc

SEQ ID NO: 109124 - DNA, 25 bp, E. coli
caatttgcaacgcactcaggtagcc

SEQ ID NO: 109125 - DNA, 25 bp, E. coli
cacgctataacggagacgggtcagt

SEQ ID NO: 109126 - DNA, 25 bp, E. coli
cacgctataacgcagacgggtcagt

SEQ ID NO: 109127 - DNA, 25 bp, E. coli
taaacgaactgcaagtcgctacgga

SEQ ID NO: 109128 - DNA, 25 bp, E. coli
taaacgaactgctagtcgctacgga

SEQ ID NO: 109129 - DNA, 25 bp, E. coli
aacaaccgttatctcaatgtgcgcg

SEQ ID NO: 109130 - DNA, 25 bp, E. coli
aacaaccgttatgtcaatgtgcgcg

SEQ ID NO: 109131 - DNA, 25 bp, E. coli
ttgttgccgaactcaatgctcaggg

SEQ ID NO: 109132 - DNA, 25 bp, E. coli
ttgttgccgaacacaatgctcaggg

SEQ ID NO: 109133 - DNA, 25 bp, E. coli
tgggccaatggacaagcaagcgaac

SEQ ID NO: 109134 - DNA, 25 bp, E. coli
tgggccaatggagaagcaagcgaac

SEQ ID NO: 109135 - DNA, 25 bp, E. coli
tgctgctgtcgaaaaagtcgtcgcg

SEQ ID NO: 109136 - DNA, 25 bp, E. coli
tgctgctgtcgataaagtcgtcgcg

SEQ ID NO: 109137 - DNA, 25 bp, E. coli
gctatcgctgagtgcaaagtcgcct

SEQ ID NO: 109138 - DNA, 25 bp, E. coli
gctatcgctgagagcaaagtcgcct

SEQ ID NO: 109139 - DNA, 25 bp, E. coli
ctttaatggtataggcgcactgcgc

SEQ ID NO: 109140 - DNA, 25 bp, E. coli
ctttaatggtattggcgcactgcgc

SEQ ID NO: 109141 - DNA, 25 bp, E. coli
gggtcaattagccatgcctcacaag

SEQ ID NO: 109142 - DNA, 25 bp, E. coli
gggtcaattagcgatgcctcacaag

SEQ ID NO: 109143 - DNA, 25 bp, E. coli
tggagtcatcagtgaacaaggcccc

SEQ ID NO: 109144 - DNA, 25 bp, E. coli
tggagtcatcagagaacaaggcccc

SEQ ID NO: 109145 - DNA, 25 bp, E. coli
aatgcagcggtgcagcatcttcgcg

SEQ ID NO: 109146 - DNA, 25 bp, E. coli
aatgcagcggtggagcatcttcgcg

SEQ ID NO: 109147 - DNA, 25 bp, E. coli
caaccatgctgggataccgttcggt

SEQ ID NO: 109148 - DNA, 25 bp, E. coli
caaccatgctggcataccgttcggt

SEQ ID NO: 109149 - DNA, 25 bp, E. coli
actgcttgccggagaggaaaacgcc

SEQ ID NO: 109150 - DNA, 25 bp, E. coli
actgcttgccggtgaggaaaacgcc

SEQ ID NO: 109151 - DNA, 25 bp, E. coli
taccagaaagaaggtggcttcccgc

SEQ ID NO: 109152 - DNA, 25 bp, E. coli
taccagaaagaacgtggcttcccgc

SEQ ID NO: 109153 - DNA, 25 bp, E. coli
tgcagcccactgcttacatgagagg

SEQ ID NO: 109154 - DNA, 25 bp, E. coli
tgcagcccactggttacatgagagg

SEQ ID NO: 109155 - DNA, 25 bp, E. coli
tcgggattatctgcgcactgcttgc

SEQ ID NO: 109156 - DNA, 25 bp, E. coli
tcgggattatctccgcactgcttgc

SEQ ID NO: 109157 - DNA, 25 bp, E. coli
tcataccgctgtgaaggacgacgac

SEQ ID NO: 109158 - DNA, 25 bp, E. coli
tcataccgctgtcaaggacgacgac

SEQ ID NO: 109159 - DNA, 25 bp, E. coli
ccaatcaggaggaggcaaccatgct

SEQ ID NO: 109160 - DNA, 25 bp, E. coli
ccaatcaggaggtggcaaccatgct

SEQ ID NO: 109161 - DNA, 25 bp, E. coli
gacgttaactcaatgccagcagcag

SEQ ID NO: 109162 - DNA, 25 bp, E. coli
gcttcccgccaaccaatcaggaggt

SEQ ID NO: 109163 - DNA, 25 bp, E. coli
gcttcccgccaagcaatcaggaggt

SEQ ID NO: 109164 - DNA, 25 bp, E. coli
tcacgataaagcgtggcgtggcacg

SEQ ID NO: 109165 - DNA, 25 bp, E. coli
tcacgataaagcctggcgtggcacg

SEQ ID NO: 109166 - DNA, 25 bp, E. coli
gacgttaactcattgccagcagcag

SEQ ID NO: 109167 - DNA, 25 bp, E. coli
caactggaaggatcccagaagtata

SEQ ID NO: 109168 - DNA, 25 bp, E. coli
caactggaaggaacccagaagtata

SEQ ID NO: 109169 - DNA, 25 bp, E. coli
tatgcaaaaacaactggaaggaacc

SEQ ID NO: 109170 - DNA, 25 bp, E. coli
tatgcaaaaacatctggaaggaacc

SEQ ID NO: 109171 - DNA, 25 bp, E. coli
tcactatgcaaatacaactggaagg

SEQ ID NO: 109172 - DNA, 25 bp, E. coli
tcagagagaggcagatcactatgca

SEQ ID NO: 109173 - DNA, 25 bp, E. coli
tcactatgcaaaaacaactggaagg

SEQ ID NO: 109174 - DNA, 25 bp, E. coli
tcagagagaggctgatcactatgca

SEQ ID NO: 109175 - DNA, 25 bp, E. coli
ccagaagtatataaatgagcagtgc

SEQ ID NO: 109176 - DNA, 25 bp, E. coli
ccagaagtatattaatgagcagtgc

SEQ ID NO: 109177 - DNA, 25 bp, E. coli
gctgatcactatccaaaaacaactg

SEQ ID NO: 109178 - DNA, 25 bp, E. coli
gctgatcactatgcaaaaacaactg

SEQ ID NO: 109179 - DNA, 25 bp, E. coli
gaagtatattaatgagcagtgcaga

SEQ ID NO: 109180 - DNA, 25 bp, E. coli
gcaaaaacaactcgaaggaacccag

SEQ ID NO: 109181 - DNA, 25 bp, E. coli
gcaaaaacaactggaaggaacccag

SEQ ID NO: 109182 - DNA, 25 bp, E. coli
gaagtatattaaagagcagtgcaga

SEQ ID NO: 109183 - DNA, 25 bp, E. coli
gtatattaatgaccagtgcagatag

SEQ ID NO: 109184 - DNA, 25 bp, E. coli
gtatattaatgagcagtgcagatag

SEQ ID NO: 109185 - DNA, 25 bp, E. coli
ggaacccagaagtatattaatgagc

SEQ ID NO: 109186 - DNA, 25 bp, E. coli
ggaacccagaagaatattaatgagc

SEQ ID NO: 109187 - DNA, 25 bp, E. coli
gagaggctgatcactatgcaaaaac

SEQ ID NO: 109188 - DNA, 25 bp, E. coli
gagaggctgatctctatgcaaaaac

SEQ ID NO: 109189 - DNA, 25 bp, E. coli
aacgcgtactacctcaaggctctga

SEQ ID NO: 109190 - DNA, 25 bp, E. coli
tacggttactggcatagaaacgccg

SEQ ID NO: 109191 - DNA, 25 bp, E. coli
tacggttactgggatagaaacgccg

SEQ ID NO: 109192 - DNA, 25 bp, E. coli
aacgcgtactacgtcaaggctctga

SEQ ID NO: 109193 - DNA, 25 bp, E. coli
ttctgaccgatacaacccggaacgc

SEQ ID NO: 109194 - DNA, 25 bp, E. coli
ttctgaccgatagaacccggaacgc

SEQ ID NO: 109195 - DNA, 25 bp, E. coli
tttgaacactttgcccggagtctgg

SEQ ID NO: 109196 - DNA, 25 bp, E. coli
tttgaacactttccccggagtctgg

SEQ ID NO: 109197 - DNA, 25 bp, E. coli
ttaaccagcagcaggttgcgctcag

SEQ ID NO: 109198 - DNA, 25 bp, E. coli
ttaaccagcagctggttgcgctcag

SEQ ID NO: 109199 - DNA, 25 bp, E. coli
tcttctgtgaagatacgggtcatac

SEQ ID NO: 109200 - DNA, 25 bp, E. coli
tcttctgtgaagttacgggtcatac

SEQ ID NO: 109201 - DNA, 25 bp, E. coli
gcttcaggcttggtcacacggttag

SEQ ID NO: 109202 - DNA, 25 bp, E. coli
gcacggtagccatcgttagccaggt

SEQ ID NO: 109203 - DNA, 25 bp, E. coli
gcttcaggcttgctcacacggttag

SEQ ID NO: 109204 - DNA, 25 bp, E. coli
gcacggtagccaacgttagccaggt

SEQ ID NO: 109205 - DNA, 25 bp, E. coli
gaagttccagcggttaacggtacct

SEQ ID NO: 109206 - DNA, 25 bp, E. coli
gaagttccagcgcttaacggtacct

SEQ ID NO: 109207 - DNA, 25 bp, E. coli
cggtggtcacctcaatagcacggta

SEQ ID NO: 109208 - DNA, 25 bp, E. coli
cggtggtcacctgaatagcacggta

SEQ ID NO: 109209 - DNA, 25 bp, E. coli
taacgatcaggtcgctaccggttgc

SEQ ID NO: 109210 - DNA, 25 bp, E. coli
taacgatcaggtggctaccggttgc

SEQ ID NO: 109211 - DNA, 25 bp, E. coli
acttccgtgagtggttggtttcagc

SEQ ID NO: 109212 - DNA, 25 bp, E. coli
acttccgtgagtcgttggtttcagc

SEQ ID NO: 109213 - DNA, 25 bp, E. coli
tatccctgggaatggcagacttccg

SEQ ID NO: 109214 - DNA, 25 bp, E. coli
tatccctgggaaaggcagacttccg

SEQ ID NO: 109215 - DNA, 25 bp, E. coli
tataatcctgatcacgctagacgcg

SEQ ID NO: 109216 - DNA, 25 bp, E. coli
tataatcctgatgacgctagacgcg

SEQ ID NO: 109217 - DNA, 25 bp, E. coli
ttgagctggcaataagtccggacgg

SEQ ID NO: 109218 - DNA, 25 bp, E. coli
ttgagctggcaaaaagtccggacgg

SEQ ID NO: 109219 - DNA, 25 bp, E. coli
tgacacacagcataatgaatccgtt

SEQ ID NO: 109220 - DNA, 25 bp, E. coli
tgacacacagcaaaatgaatccgtt

SEQ ID NO: 109221 - DNA, 25 bp, E. coli
taatagtagtctagatcgggttaac

SEQ ID NO: 109222 - DNA, 25 bp, E. coli
taatagtagtcttgatcgggttaac

SEQ ID NO: 109223 - DNA, 25 bp, E. coli
cgttgaaataacaatatccctggga

SEQ ID NO: 109224 - DNA, 25 bp, E. coli
cgttgaaataactatatccctggga

SEQ ID NO: 109225 - DNA, 25 bp, E. coli
cgtgtaacgataagtacaaacgctg

SEQ ID NO: 109226 - DNA, 25 bp, E. coli
cgggaattggctcgcgcttcgtcta

SEQ ID NO: 109227 - DNA, 25 bp, E. coli
ctattaacgttgctttgagctggca

SEQ ID NO: 109228 - DNA, 25 bp, E. coli
cgggaattggctggcgcttcgtcta

SEQ ID NO: 109229 - DNA, 25 bp, E. coli
ctattaacgttggtttgagctggca

SEQ ID NO: 109230 - DNA, 25 bp, E. coli
cgtgtaacgatatgtacaaacgctg

SEQ ID NO: 109231 - DNA, 25 bp, E. coli
ggtatttaccgcagtccggacttat

SEQ ID NO: 109232 - DNA, 25 bp, E. coli
ggtatttaccgctgtccggacttat

SEQ ID NO: 109233 - DNA, 25 bp, E. coli
ttccgaagaagacaccaccgaaacg

SEQ ID NO: 109234 - DNA, 25 bp, E. coli
aaaactccgcgcagcaggtcattaa

SEQ ID NO: 109235 - DNA, 25 bp, E. coli
aaaactccgcgctgcaggtcattaa

SEQ ID NO: 109236 - DNA, 25 bp, E. coli
ttccgaagaagagaccaccgaaacg

SEQ ID NO: 109237 - DNA, 25 bp, E. coli
tgacggaaaactgcgcgcagcaggt

SEQ ID NO: 109238 - DNA, 25 bp, E. coli
tgcaggaagacctgggacaattact

SEQ ID NO: 109239 - DNA, 25 bp, E. coli
tgcaggaagaccagggacaattact

SEQ ID NO: 109240 - DNA, 25 bp, E. coli
tgacggaaaactccgcgcagcaggt

SEQ ID NO: 109241 - DNA, 25 bp, E. coli
gactattctgcacgaagaccaggga

SEQ ID NO: 109242 - DNA, 25 bp, E. coli
gacaattactgagtcttgccggtga

SEQ ID NO: 109243 - DNA, 25 bp, E. coli
gaaacgccgatgtatgtcaatcgcg

SEQ ID NO: 109244 - DNA, 25 bp, E. coli
gactattctgcaggaagaccaggga

SEQ ID NO: 109245 - DNA, 25 bp, E. coli
gacaccaccgaatcgccgatgtatg

SEQ ID NO: 109246 - DNA, 25 bp, E. coli
gacaattactgactcttgccggtga

SEQ ID NO: 109247 - DNA, 25 bp, E. coli
gaaacgccgatgaatgtcaatcgcg

SEQ ID NO: 109248 - DNA, 25 bp, E. coli
gacaccaccgaaacgccgatgtatg

SEQ ID NO: 109249 - DNA, 25 bp, E. coli
ggtggtcgcctgtctattctgcagg

SEQ ID NO: 109250 - DNA, 25 bp, E. coli
ggtggtcgcctgactattctgcagg

SEQ ID NO: 109251 - DNA, 25 bp, E. coli
tcaatcgcggtgctcgcctgactat

SEQ ID NO: 109252 - DNA, 25 bp, E. coli
tcaatcgcggtggtcgcctgactat

SEQ ID NO: 109253 - DNA, 25 bp, E. coli
gatgtatgtcaatcgcggtggtcgc

SEQ ID NO: 109254 - DNA, 25 bp, E. coli
gatgtatgtcaaacgcggtggtcgc

SEQ ID NO: 109255 - DNA, 25 bp, E. coli
aacgcggtatccgatcttggacaaa

SEQ ID NO: 109256 - DNA, 25 bp, E. coli
aacgcggtatcccatcttggacaaa

SEQ ID NO: 109257 - DNA, 25 bp, E. coli
cacaaacgcggtatccgatcttgga

SEQ ID NO: 109258 - DNA, 25 bp, E. coli
caaacgcggtatccgatcttggaca

SEQ ID NO: 109259 - DNA, 25 bp, E. coli
cacaaacgcggtttccgatcttgga

SEQ ID NO: 109260 - DNA, 25 bp, E. coli
caaacgcggtatgcgatcttggaca

SEQ ID NO: 109261 - DNA, 25 bp, E. coli
cactcggcacaaacgcggtatccga

SEQ ID NO: 109262 - DNA, 25 bp, E. coli
cactcggcacaatcgcggtatccga

SEQ ID NO: 109263 - DNA, 25 bp, E. coli
actggaatcagctctcggcacaaac

SEQ ID NO: 109264 - DNA, 25 bp, E. coli
actggaatcagcactcggcacaaac

SEQ ID NO: 109265 - DNA, 25 bp, E. coli
tatccgatcttgcacaaaaacttgg

SEQ ID NO: 109266 - DNA, 25 bp, E. coli
tatccgatcttggacaaaaacttgg

SEQ ID NO: 109267 - DNA, 25 bp, E. coli
cgcggtatccgatcttggacaaaaa

SEQ ID NO: 109268 - DNA, 25 bp, E. coli
cgcggtatccgaacttggacaaaaa

SEQ ID NO: 109269 - DNA, 25 bp, E. coli
cggtatccgatcttggacaaaaact

SEQ ID NO: 109270 - DNA, 25 bp, E. coli
cggtatccgatcatggacaaaaact

SEQ ID NO: 109271 - DNA, 25 bp, E. coli
ggcacaaacgcggtatccgatcttg

SEQ ID NO: 109272 - DNA, 25 bp, E. coli
ggcacaaacgcgctatccgatcttg

SEQ ID NO: 109273 - DNA, 25 bp, E. coli
tggaatcagcactcggcacaaacgc

SEQ ID NO: 109274 - DNA, 25 bp, E. coli
tggaatcagcacacggcacaaacgc

SEQ ID NO: 109275 - DNA, 25 bp, E. coli
tcagcactcggcacaaacgcggtat

SEQ ID NO: 109276 - DNA, 25 bp, E. coli
tcagcactcggctcaaacgcggtat

SEQ ID NO: 109277 - DNA, 25 bp, E. coli
aatacctgggagcaagcaatgcaac

SEQ ID NO: 109278 - DNA, 25 bp, E. coli
aatacctgggaggaagcaatgcaac

SEQ ID NO: 109279 - DNA, 25 bp, E. coli
caaaagcggcaagtgtcgcacatgt

SEQ ID NO: 109280 - DNA, 25 bp, E. coli
caaaagcggcaactgtcgcacatgt

SEQ ID NO: 109281 - DNA, 25 bp, E. coli
tagttatgctggataaagcgtatcc

SEQ ID NO: 109282 - DNA, 25 bp, E. coli
tagttatgctggttaaagcgtatcc

SEQ ID NO: 109283 - DNA, 25 bp, E. coli
tcggtctgcgtgagaacgtctttct

SEQ ID NO: 109284 - DNA, 25 bp, E. coli
tcggtctgcgtgtgaacgtctttct

SEQ ID NO: 109285 - DNA, 25 bp, E. coli
cctgggaggaagcaatgcaacaaaa

SEQ ID NO: 109286 - DNA, 25 bp, E. coli
cctgggaggaaggaatgcaacaaaa

SEQ ID NO: 109287 - DNA, 25 bp, E. coli
gcattaatcggtgtgcgtgagaacg

SEQ ID NO: 109288 - DNA, 25 bp, E. coli
gcattaatcggtctgcgtgagaacg

SEQ ID NO: 109289 - DNA, 25 bp, E. coli
gcaactgtcgcacatgtccaacaaa

SEQ ID NO: 109290 - DNA, 25 bp, E. coli
gcaactgtcgcagatgtccaacaaa

SEQ ID NO: 109291 - DNA, 25 bp, E. coli
gaattagttatgctggataaagcgt

SEQ ID NO: 109292 - DNA, 25 bp, E. coli
gaattagttatggtggataaagcgt

SEQ ID NO: 109293 - DNA, 25 bp, E. coli
gcgatcccaaaagcggcaactgtcg

SEQ ID NO: 109294 - DNA, 25 bp, E. coli
gcgatcccaaaaccggcaactgtcg

SEQ ID NO: 109295 - DNA, 25 bp, E. coli
ggaggaagcaatgcaacaaaaaatg

SEQ ID NO: 109296 - DNA, 25 bp, E. coli
ggaggaagcaatccaacaaaaaatg

SEQ ID NO: 109297 - DNA, 25 bp, E. coli
gatggcgatccctaaagcggcaact

SEQ ID NO: 109298 - DNA, 25 bp, E. coli
gatggcgatcccaaaagcggcaact

SEQ ID NO: 109299 - DNA, 25 bp, E. coli
cagaaaaggcttaccatgtccgtaa

SEQ ID NO: 109300 - DNA, 25 bp, E. coli
cagaaaaggctttccatgtccgtaa

SEQ ID NO: 109301 - DNA, 25 bp, E. coli
caggccattgtgttatatagcggtg

SEQ ID NO: 109302 - DNA, 25 bp, E. coli
caggccattgtgatatatagcggtg

SEQ ID NO: 109303 - DNA, 25 bp, E. coli
taacaaccagagatggctggcacat

SEQ ID NO: 109304 - DNA, 25 bp, E. coli
taacaaccagagttggctggcacat

SEQ ID NO: 109305 - DNA, 25 bp, E. coli
acaccatgcccggtgggatgaggca

SEQ ID NO: 109306 - DNA, 25 bp, E. coli
acaccatgcccgctgggatgaggca

SEQ ID NO: 109307 - DNA, 25 bp, E. coli
tatagcggtgagattttctgccgga

SEQ ID NO: 109308 - DNA, 25 bp, E. coli
tatagcggtgagtttttctgccgga

SEQ ID NO: 109309 - DNA, 25 bp, E. coli
tatatcacatcctttttcggcgcat

SEQ ID NO: 109310 - DNA, 25 bp, E. coli
tatatcacatccattttcggcgcat

SEQ ID NO: 109311 - DNA, 25 bp, E. coli
tgataaaagacaaccggttgaacgg

SEQ ID NO: 109312 - DNA, 25 bp, E. coli
tgataaaagacatccggttgaacgg

SEQ ID NO: 109313 - DNA, 25 bp, E. coli
tgaacgggcggcagatgcgctcatt

SEQ ID NO: 109314 - DNA, 25 bp, E. coli
tgaacgggcggctgatgcgctcatt

SEQ ID NO: 109315 - DNA, 25 bp, E. coli
cccggtggttatgtcgaaaaatcat

SEQ ID NO: 109316 - DNA, 25 bp, E. coli
cccggtggttatctcgaaaaatcat

SEQ ID NO: 109317 - DNA, 25 bp, E. coli
ggcgcatttgttattacccggtggt

SEQ ID NO: 109318 - DNA, 25 bp, E. coli
ggcgcatttgtttttacccggtggt

SEQ ID NO: 109319 - DNA, 25 bp, E. coli
gatgcgctcattcagcaggccattg

SEQ ID NO: 109320 - DNA, 25 bp, E. coli
gatgcgctcattgagcaggccattg

SEQ ID NO: 109321 - DNA, 25 bp, E. coli
caacgatcacggtggagagcgtagt

SEQ ID NO: 109322 - DNA, 25 bp, E. coli
caacgatcacggaggagagcgtagt

SEQ ID NO: 109323 - DNA, 25 bp, E. coli
catggaacgtcgtactcacccaata

SEQ ID NO: 109324 - DNA, 25 bp, E. coli
catggaacgtcgaactcacccaata

SEQ ID NO: 109325 - DNA, 25 bp, E. coli
atcacggtggagagcgtagtgcgct

SEQ ID NO: 109326 - DNA, 25 bp, E. coli
atggaacgtcgttctcacccaataa

SEQ ID NO: 109327 - DNA, 25 bp, E. coli
atcctcaacgtcgtgccggaatggc

SEQ ID NO: 109328 - DNA, 25 bp, E. coli
atcacggtggagtgcgtagtgcgct

SEQ ID NO: 109329 - DNA, 25 bp, E. coli
atcctcaacgtcctgccggaatggc

SEQ ID NO: 109330 - DNA, 25 bp, E. coli
atggaacgtcgtactcacccaataa

SEQ ID NO: 109331 - DNA, 25 bp, E. coli
tatcctcaacgtgctgccggaatgg

SEQ ID NO: 109332 - DNA, 25 bp, E. coli
tatcctcaacgtcctgccggaatgg

SEQ ID NO: 109333 - DNA, 25 bp, E. coli
tcttcggcaacgttcacggtggaga

SEQ ID NO: 109334 - DNA, 25 bp, E. coli
tcttcggcaacgatcacggtggaga

SEQ ID NO: 109335 - DNA, 25 bp, E. coli
gcgtagtgcgctcctgtacgggctg

SEQ ID NO: 109336 - DNA, 25 bp, E. coli
gcgtagtgcgctgctgtacgggctg

SEQ ID NO: 109337 - DNA, 25 bp, E. coli
cttcggcaacgatcacggtggagag

SEQ ID NO: 109338 - DNA, 25 bp, E. coli
cttcggcaacgaacacggtggagag

SEQ ID NO: 109339 - DNA, 25 bp, E. coli
gttcttcggcaaggatcacggtgga

SEQ ID NO: 109340 - DNA, 25 bp, E. coli
gttcttcggcaacgatcacggtgga

SEQ ID NO: 109341 - DNA, 25 bp, E. coli
ggaatggccttctaaccgtgttgat

SEQ ID NO: 109342 - DNA, 25 bp, E. coli
ggaatggccttcaaaccgtgttgat

SEQ ID NO: 109343 - DNA, 25 bp, E. coli
cacgattgaaaccagaagaaaccct

SEQ ID NO: 109344 - DNA, 25 bp, E. coli
cacgattgaaacgagaagaaaccct

SEQ ID NO: 109345 - DNA, 25 bp, E. coli
cagaaaccgttaatcaactgggcga

SEQ ID NO: 109346 - DNA, 25 bp, E. coli
cagaaaccgttattcaactgggcga

SEQ ID NO: 109347 - DNA, 25 bp, E. coli
tagttgcaagtaccgatatcagcct

SEQ ID NO: 109348 - DNA, 25 bp, E. coli
tagttgcaagtagcgatatcagcct

SEQ ID NO: 109349 - DNA, 25 bp, E. coli
tttatgccaccatgcgctaacctgg

SEQ ID NO: 109350 - DNA, 25 bp, E. coli
tttatgccaccaagcgctaacctgg

SEQ ID NO: 109351 - DNA, 25 bp, E. coli
tccggcggcgatattatccatacac

SEQ ID NO: 109352 - DNA, 25 bp, E. coli
tccggcggcgattttatccatacac

SEQ ID NO: 109353 - DNA, 25 bp, E. coli
tctctcggtggttggcctgaaatcc

SEQ ID NO: 109354 - DNA, 25 bp, E. coli
tctctcggtggtaggcctgaaatcc

SEQ ID NO: 109355 - DNA, 25 bp, E. coli
gcgcctgaaccgtgctggtgttgaa

SEQ ID NO: 109356 - DNA, 25 bp, E. coli
gcgcctgaaccgagctggtgttgaa

SEQ ID NO: 109357 - DNA, 25 bp, E. coli
cggcggtgcgctaatcaggacgatt

SEQ ID NO: 109358 - DNA, 25 bp, E. coli
cggcggtgcgcttatcaggacgatt

SEQ ID NO: 109359 - DNA, 25 bp, E. coli
taacctggcgctacgcgagttaggc

SEQ ID NO: 109360 - DNA, 25 bp, E. coli
taaaagtgccttcgccagaaaccgt

SEQ ID NO: 109361 - DNA, 25 bp, E. coli
taaaagtgccttggccagaaaccgt

SEQ ID NO: 109362 - DNA, 25 bp, E. coli
tcaatgttgagagtgaggcccagca

SEQ ID NO: 109363 - DNA, 25 bp, E. coli
tcaatgttgagactgaggcccagca

SEQ ID NO: 109364 - DNA, 25 bp, E. coli
taacctggcgcttcgcgagttaggc

SEQ ID NO: 109365 - DNA, 25 bp, E. coli
catctcgcctttgctagggttttca

SEQ ID NO: 109366 - DNA, 25 bp, E. coli
catctcgcctttcctagggttttca

SEQ ID NO: 109367 - DNA, 25 bp, E. coli
agcagttcgccgtccgacgtgccgt

SEQ ID NO: 109368 - DNA, 25 bp, E. coli
accgacgtgccgaggatggttccca

SEQ ID NO: 109369 - DNA, 25 bp, E. coli
accgacgtgccgtggatggttccca

SEQ ID NO: 109370 - DNA, 25 bp, E. coli
agcagttcgccgaccgacgtgccgt

SEQ ID NO: 109371 - DNA, 25 bp, E. coli
ttctttgatccacgccagcagttcg

SEQ ID NO: 109372 - DNA, 25 bp, E. coli
ttctttgatccaggccagcagttcg

SEQ ID NO: 109373 - DNA, 25 bp, E. coli
gccttcaataatcagcaccatctcg

SEQ ID NO: 109374 - DNA, 25 bp, E. coli
cctgggctttatggccttcaataat

SEQ ID NO: 109375 - DNA, 25 bp, E. coli
cctgggctttatcgccttcaataat

SEQ ID NO: 109376 - DNA, 25 bp, E. coli
gccttcaataatgagcaccatctcg

SEQ ID NO: 109377 - DNA, 25 bp, E. coli
gcatcggcgggcagttcgtcatcct

SEQ ID NO: 109378 - DNA, 25 bp, E. coli
gcatcggcgggctgttcgtcatcct

SEQ ID NO: 109379 - DNA, 25 bp, E. coli
gtcatcctgggctttatggccttca

SEQ ID NO: 109380 - DNA, 25 bp, E. coli
gtcatcctgggcattatggccttca

SEQ ID NO: 109381 - DNA, 25 bp, E. coli
gggcagttcgtcatcctgggcttta

SEQ ID NO: 109382 - DNA, 25 bp, E. coli
gggcagttcgtcttcctgggcttta

SEQ ID NO: 109383 - DNA, 25 bp, E. coli
tggttcccaggccggtgttcatcac

SEQ ID NO: 109384 - DNA, 25 bp, E. coli
tggttcccaggcgggtgttcatcac

SEQ ID NO: 109385 - DNA, 25 bp, E. coli
tcagcaccatctggcctttgctagg

SEQ ID NO: 109386 - DNA, 25 bp, E. coli
tcagcaccatctcgcctttgctagg

SEQ ID NO: 109387 - DNA, 25 bp, E. coli
catcgtggataaacttgtcgctgaa

SEQ ID NO: 109388 - DNA, 25 bp, E. coli
catcgtggataatcttgtcgctgaa

SEQ ID NO: 109389 - DNA, 25 bp, E. coli
taaacgtgcccgtgaagagctgcgt

SEQ ID NO: 109390 - DNA, 25 bp, E. coli
taaacgtgcccgagaagagctgcgt

SEQ ID NO: 109391 - DNA, 25 bp, E. coli
aattgaagccgagcgtaaacgtgcc

SEQ ID NO: 109392 - DNA, 25 bp, E. coli
aacaaacgccgctcgcagattctgg

SEQ ID NO: 109393 - DNA, 25 bp, E. coli
aacaaacgccgcacgcagattctgg

SEQ ID NO: 109394 - DNA, 25 bp, E. coli
aattgaagccgaccgtaaacgtgcc

SEQ ID NO: 109395 - DNA, 25 bp, E. coli
aaaaagaaattggtgacggccttgc

SEQ ID NO: 109396 - DNA, 25 bp, E. coli
aaaaagaaattgctgacggccttgc

SEQ ID NO: 109397 - DNA, 25 bp, E. coli
ttgaccttgcaatggccagcgcgac

SEQ ID NO: 109398 - DNA, 25 bp, E. coli
ttgaccttgcaaaggccagcgcgac

SEQ ID NO: 109399 - DNA, 25 bp, E. coli
tgaaaaaagcgaaagcggaagccca

SEQ ID NO: 109400 - DNA, 25 bp, E. coli
tgaaaaaagcgatagcggaagccca

SEQ ID NO: 109401 - DNA, 25 bp, E. coli
tgctggcgccgagaagatcatcgaa

SEQ ID NO: 109402 - DNA, 25 bp, E. coli
tgctggcgccgacaagatcatcgaa

SEQ ID NO: 109403 - DNA, 25 bp, E. coli
gcttccgcagaaggagcacataagg

SEQ ID NO: 109404 - DNA, 25 bp, E. coli
gcttccgcagaacgagcacataagg

SEQ ID NO: 109405 - DNA, 25 bp, E. coli
gaacgttccgtgcatgaagctgcta

SEQ ID NO: 109406 - DNA, 25 bp, E. coli
gaagcccaggtattcatcgagcagg

SEQ ID NO: 109407 - DNA, 25 bp, E. coli
gaagcccaggtaatcatcgagcagg

SEQ ID NO: 109408 - DNA, 25 bp, E. coli
gaacgttccgtggatgaagctgcta

SEQ ID NO: 109409 - DNA, 25 bp, E. coli
aattacccgcaagcatggcaatgtg

SEQ ID NO: 109410 - DNA, 25 bp, E. coli
aattacccgcaaccatggcaatgtg

SEQ ID NO: 109411 - DNA, 25 bp, E. coli
cagttaccgaaacatgaagtgggct

SEQ ID NO: 109412 - DNA, 25 bp, E. coli
cagttaccgaaagatgaagtgggct

SEQ ID NO: 109413 - DNA, 25 bp, E. coli
tattgataaacggttgggcgtgcag

SEQ ID NO: 109414 - DNA, 25 bp, E. coli
tattgccatgcaactggtcagtgcc

SEQ ID NO: 109415 - DNA, 25 bp, E. coli
tattgataaacgcttgggcgtgcag

SEQ ID NO: 109416 - DNA, 25 bp, E. coli
tattgccatgcatctggtcagtgcc

SEQ ID NO: 109417 - DNA, 25 bp, E. coli
tgaacgggcgattaagcgaactctt

SEQ ID NO: 109418 - DNA, 25 bp, E. coli
tgagcagtcatgaactgaacgggcg

SEQ ID NO: 109419 - DNA, 25 bp, E. coli
tgagcagtcatgtactgaacgggcg

SEQ ID NO: 109420 - DNA, 25 bp, E. coli
tgaacgggcgataaagcgaactctt

SEQ ID NO: 109421 - DNA, 25 bp, E. coli
gccataaatatagagcgcgtgcgca

SEQ ID NO: 109422 - DNA, 25 bp, E. coli
gccataaatatacagcgcgtgcgca

SEQ ID NO: 109423 - DNA, 25 bp, E. coli
gaaaaagagtatgccttgagcagtc

SEQ ID NO: 109424 - DNA, 25 bp, E. coli
gaaagcttgagtaatcagcgactgg

SEQ ID NO: 109425 - DNA, 25 bp, E. coli
gaaagcttgagttatcagcgactgg

SEQ ID NO: 109426 - DNA, 25 bp, E. coli
gaaaaagagtatcccttgagcagtc

SEQ ID NO: 109427 - DNA, 25 bp, E. coli
gatcaacagcggcaaaaagtcgtca

SEQ ID NO: 109428 - DNA, 25 bp, E. coli
ggtcagtgcccaaatgagcggaaat

SEQ ID NO: 109429 - DNA, 25 bp, E. coli
ggtcagtgcccatatgagcggaaat

SEQ ID NO: 109430 - DNA, 25 bp, E. coli
gatcaacagcgggaaaaagtcgtca

SEQ ID NO: 109431 - DNA, 25 bp, E. coli
caatggtccacagtctcgatcagat

SEQ ID NO: 109432 - DNA, 25 bp, E. coli
aatcccaacgatgcggtgagcggtt

SEQ ID NO: 109433 - DNA, 25 bp, E. coli
aatcccaacgatccggtgagcggtt

SEQ ID NO: 109434 - DNA, 25 bp, E. coli
caatggtccacactctcgatcagat

SEQ ID NO: 109435 - DNA, 25 bp, E. coli
caggaacagtttcaagcgtaccagc

SEQ ID NO: 109436 - DNA, 25 bp, E. coli
catgttgcagcacattgttaccgct

SEQ ID NO: 109437 - DNA, 25 bp, E. coli
catgttgcagcagattgttaccgct

SEQ ID NO: 109438 - DNA, 25 bp, E. coli
caggaacagtttgaagcgtaccagc

SEQ ID NO: 109439 - DNA, 25 bp, E. coli
tactggagcacagtctggcaacgct

SEQ ID NO: 109440 - DNA, 25 bp, E. coli
tactggagcacactctggcaacgct

SEQ ID NO: 109441 - DNA, 25 bp, E. coli
taaaaccgcgcaataatctggtgct

SEQ ID NO: 109442 - DNA, 25 bp, E. coli
taaaaccgcgcattaatctggtgct

SEQ ID NO: 109443 - DNA, 25 bp, E. coli
attatctgcgcgagcgggtcagcga

SEQ ID NO: 109444 - DNA, 25 bp, E. coli
attatctgcgcgtgcgggtcagcga

SEQ ID NO: 109445 - DNA, 25 bp, E. coli
tattggcacagcactggaagcccca

SEQ ID NO: 109446 - DNA, 25 bp, E. coli
tattggcacagctctggaagcccca

SEQ ID NO: 109447 - DNA, 25 bp, E. coli
gacagttatcggctgatccctgcga

SEQ ID NO: 109448 - DNA, 25 bp, E. coli
gacagttatcgggtgatccctgcga

SEQ ID NO: 109449 - DNA, 25 bp, E. coli
ggcgctgattggcactggcacttta

SEQ ID NO: 109450 - DNA, 25 bp, E. coli
ggcgctgattgggactggcacttta

SEQ ID NO: 109451 - DNA, 25 bp, E. coli
tcaattgcgggcgattttgcgcgct

SEQ ID NO: 109452 - DNA, 25 bp, E. coli
tcaattgcgggccattttgcgcgct

SEQ ID NO: 109453 - DNA, 25 bp, E. coli
ttcaccagtggaagggcggctttcc

SEQ ID NO: 109454 - DNA, 25 bp, E. coli
ttaaccatggtgacgcagcttgccg

SEQ ID NO: 109455 - DNA, 25 bp, E. coli
ttcaccagtggatgggcggctttcc

SEQ ID NO: 109456 - DNA, 25 bp, E. coli
ttaaccatggtgtcgcagcttgccg

SEQ ID NO: 109457 - DNA, 25 bp, E. coli
tggtcaatgagctgaaattcccgcc

SEQ ID NO: 109458 - DNA, 25 bp, E. coli
tggtcaatgagcagaaattcccgcc

SEQ ID NO: 109459 - DNA, 25 bp, E. coli
tgacgaattcatgaccgagcggcaa

SEQ ID NO: 109460 - DNA, 25 bp, E. coli
tgacgaattcatcaccgagcggcaa

SEQ ID NO: 109461 - DNA, 25 bp, E. coli
tgaaatctcaatggccagcggcttt

SEQ ID NO: 109462 - DNA, 25 bp, E. coli
tgaaatctcaatcgccagcggcttt

SEQ ID NO: 109463 - DNA, 25 bp, E. coli
tctgaatcggtaggaagaagcggct

SEQ ID NO: 109464 - DNA, 25 bp, E. coli
tctgaatcggtacgaagaagcggct

SEQ ID NO: 109465 - DNA, 25 bp, E. coli
gaaggcggtggcttttcctacaaca

SEQ ID NO: 109466 - DNA, 25 bp, E. coli
gaaggcggtggcatttcctacaaca

SEQ ID NO: 109467 - DNA, 25 bp, E. coli
gaagagtgcgatgtgctgccaagca

SEQ ID NO: 109468 - DNA, 25 bp, E. coli
gaagagtgcgatctgctgccaagca

SEQ ID NO: 109469 - DNA, 25 bp, E. coli
ggcaaaattcttccggtccgtgaca

SEQ ID NO: 109470 - DNA, 25 bp, E. coli
ggaaaaatcgatccgcgactggcag

SEQ ID NO: 109471 - DNA, 25 bp, E. coli
ggaaaaatcgatgcgcgactggcag

SEQ ID NO: 109472 - DNA, 25 bp, E. coli
ggcaaaattcttgcggtccgtgaca

SEQ ID NO: 109473 - DNA, 25 bp, E. coli
gatgtatgaagatcacgggatccgc

SEQ ID NO: 109474 - DNA, 25 bp, E. coli
gatgtatgaagaacacgggatccgc

SEQ ID NO: 109475 - DNA, 25 bp, E. coli
aactcattgtttcccgtcggtgaaa

SEQ ID NO: 109476 - DNA, 25 bp, E. coli
aactcattgtttgccgtcggtgaaa

SEQ ID NO: 109477 - DNA, 25 bp, E. coli
tcggtgaaaatacctggacgccatt

SEQ ID NO: 109478 - DNA, 25 bp, E. coli
tcggtgaaaatagctggacgccatt

SEQ ID NO: 109479 - DNA, 25 bp, E. coli
tctgctatggctggtagtaaacccg

SEQ ID NO: 109480 - DNA, 25 bp, E. coli
tctgctatggctcgtagtaaacccg

SEQ ID NO: 109481 - DNA, 25 bp, E. coli
gacttgcggatgcaacttaagggca

SEQ ID NO: 109482 - DNA, 25 bp, E. coli
gacttgcggatggaacttaagggca

SEQ ID NO: 109483 - DNA, 25 bp, E. coli
ctgttcaatcaacggcagccaggta

SEQ ID NO: 109484 - DNA, 25 bp, E. coli
ctgttcaatcaagggcagccaggta

SEQ ID NO: 109485 - DNA, 25 bp, E. coli
gattaacggcgatacggtactcagt

SEQ ID NO: 109486 - DNA, 25 bp, E. coli
gattaacggcgaaacggtactcagt

SEQ ID NO: 109487 - DNA, 25 bp, E. coli
ggtactcagtacgaatatcaccggg

SEQ ID NO: 109488 - DNA, 25 bp, E. coli
ggtactcagtaccaatatcaccggg

SEQ ID NO: 109489 - DNA, 25 bp, E. coli
tggcaccaattaacggcaagatgcg

SEQ ID NO: 109490 - DNA, 25 bp, E. coli
tggcaccaattatcggcaagatgcg

SEQ ID NO: 109491 - DNA, 25 bp, E. coli
ggcaatacctcatcgattaacggcg

SEQ ID NO: 109492 - DNA, 25 bp, E. coli
ggcaatacctcaacgattaacggcg

SEQ ID NO: 109493 - DNA, 25 bp, E. coli
taattctgcgcgagttggtcgatgc

SEQ ID NO: 109494 - DNA, 25 bp, E. coli
tcaataaccagcgacagttgaaggc

SEQ ID NO: 109495 - DNA, 25 bp, E. coli
taattctgcgcgtgttggtcgatgc

SEQ ID NO: 109496 - DNA, 25 bp, E. coli
tcaataaccagccacagttgaaggc

SEQ ID NO: 109497 - DNA, 25 bp, E. coli
caataggagtgctgggaagtctgct

SEQ ID NO: 109498 - DNA, 25 bp, E. coli
aataggagtgctcggaagtctgctg

SEQ ID NO: 109499 - DNA, 25 bp, E. coli
aataggagtgctgggaagtctgctg

SEQ ID NO: 109500 - DNA, 25 bp, E. coli
aatcagagaggaccgtcgtaaggtg

SEQ ID NO: 109501 - DNA, 25 bp, E. coli
caataggagtgcagggaagtctgct

SEQ ID NO: 109502 - DNA, 25 bp, E. coli
aatcagagaggagcgtcgtaaggtg

SEQ ID NO: 109503 - DNA, 25 bp, E. coli
aaatcagagaggtccgtcgtaaggt

SEQ ID NO: 109504 - DNA, 25 bp, E. coli
aaatcagagaggaccgtcgtaaggt

SEQ ID NO: 109505 - DNA, 25 bp, E. coli
tgggtggcaataggagtgctgggaa

SEQ ID NO: 109506 - DNA, 25 bp, E. coli
tgggtggcaatacgagtgctgggaa

SEQ ID NO: 109507 - DNA, 25 bp, E. coli
gactaacctgtaattcaaaatcaga

SEQ ID NO: 109508 - DNA, 25 bp, E. coli
gactaacctgtatttcaaaatcaga

SEQ ID NO: 109509 - DNA, 25 bp, E. coli
tcgtaaggtggcgcggggagagtag

SEQ ID NO: 109510 - DNA, 25 bp, E. coli
tcgtaaggtggcccggggagagtag

SEQ ID NO: 109511 - DNA, 25 bp, E. coli
gtggcaataggagtgctgggaagtc

SEQ ID NO: 109512 - DNA, 25 bp, E. coli
ggtggcaataggagtgctgggaagt

SEQ ID NO: 109513 - DNA, 25 bp, E. coli
gggtggcaataggagtgctgggaag

SEQ ID NO: 109514 - DNA, 25 bp, E. coli
gtggcaataggactgctgggaagtc

SEQ ID NO: 109515 - DNA, 25 bp, E. coli
gggtggcaatagcagtgctgggaag

SEQ ID NO: 109516 - DNA, 25 bp, E. coli
ggtggcaataggtgtgctgggaagt

SEQ ID NO: 109517 - DNA, 25 bp, E. coli
tggcaataggagtgctgggaagtct

SEQ ID NO: 109518 - DNA, 25 bp, E. coli
tggcaataggagagctgggaagtct

SEQ ID NO: 109519 - DNA, 25 bp, E. coli
cacgctacagagattctcaatatgg

SEQ ID NO: 109520 - DNA, 25 bp, E. coli
cacgctacagagtttctcaatatgg

SEQ ID NO: 109521 - DNA, 25 bp, E. coli
caaagctggttaatcatgggttggt

SEQ ID NO: 109522 - DNA, 25 bp, E. coli
caaagctggttattcatgggttggt

SEQ ID NO: 109523 - DNA, 25 bp, E. coli
ctttagctatacgaaatattccagg

SEQ ID NO: 109524 - DNA, 25 bp, E. coli
tatcgtaaatggagagggcaactct

SEQ ID NO: 109525 - DNA, 25 bp, E. coli
tatcgtaaatggtgagggcaactct

SEQ ID NO: 109526 - DNA, 25 bp, E. coli
tagcgaatatcgaaacaaagctggt

SEQ ID NO: 109527 - DNA, 25 bp, E. coli
tagcgaatatcgtaacaaagctggt

SEQ ID NO: 109528 - DNA, 25 bp, E. coli
tattccaggatttggcaacgtagcg

SEQ ID NO: 109529 - DNA, 25 bp, E. coli
tattccaggattaggcaacgtagcg

SEQ ID NO: 109530 - DNA, 25 bp, E. coli
tatcaaagaacatcaagacaacctc

SEQ ID NO: 109531 - DNA, 25 bp, E. coli
tatcaaagaacaacaagacaacctc

SEQ ID NO: 109532 - DNA, 25 bp, E. coli
tttaacgtgctgtaagttatggctg

SEQ ID NO: 109533 - DNA, 25 bp, E. coli
tttaacgtgctgaaagttatggctg

SEQ ID NO: 109534 - DNA, 25 bp, E. coli
tgagaaagatatagactggagctgg

SEQ ID NO: 109535 - DNA, 25 bp, E. coli
tgagaaagatattgactggagctgg

SEQ ID NO: 109536 - DNA, 25 bp, E. coli
ctttagctataccaaatattccagg

SEQ ID NO: 109537 - DNA, 25 bp, E. coli
gggcaactctaatccacgctacaga

SEQ ID NO: 109538 - DNA, 25 bp, E. coli
gggcaactctaaaccacgctacaga

SEQ ID NO: 109539 - DNA, 25 bp, E. coli
gatggtgctggatcgtactttagct

SEQ ID NO: 109540 - DNA, 25 bp, E. coli
gatggtgctggaacgtactttagct

SEQ ID NO: 109541 - DNA, 25 bp, E. coli
cagcaaccggtgtgattcgtcgcca

SEQ ID NO: 109542 - DNA, 25 bp, E. coli
caccagaagcgctggttgttgcggt

SEQ ID NO: 109543 - DNA, 25 bp, E. coli
cagcaaccggtgagattcgtcgcca

SEQ ID NO: 109544 - DNA, 25 bp, E. coli
caccagaagcgcaggttgttgcggt

SEQ ID NO: 109545 - DNA, 25 bp, E. coli
agtcgtcgagcaagggcaatcatta

SEQ ID NO: 109546 - DNA, 25 bp, E. coli
agtcgtcgagcatgggcaatcatta

SEQ ID NO: 109547 - DNA, 25 bp, E. coli
agacaaagcacttcttcaagagttg

SEQ ID NO: 109548 - DNA, 25 bp, E. coli
agacaaagcactacttcaagagttg

SEQ ID NO: 109549 - DNA, 25 bp, E. coli
tagatgcgccttgttcagcaaccgg

SEQ ID NO: 109550 - DNA, 25 bp, E. coli
tagatgcgccttcttcagcaaccgg

SEQ ID NO: 109551 - DNA, 25 bp, E. coli
tgaaggcgctatggcaattaagcgt

SEQ ID NO: 109552 - DNA, 25 bp, E. coli
tgaaggcgctatcgcaattaagcgt

SEQ ID NO: 109553 - DNA, 25 bp, E. coli
gcggaccgtgcattacctgattatg

SEQ ID NO: 109554 - DNA, 25 bp, E. coli
gcggaccgtgcaatacctgattatg

SEQ ID NO: 109555 - DNA, 25 bp, E. coli
cgtacgctttcgcagttagactggc

SEQ ID NO: 109556 - DNA, 25 bp, E. coli
cgtacgctttcggagttagactggc

SEQ ID NO: 109557 - DNA, 25 bp, E. coli
tcaagagttgtgctttggcgtactg

SEQ ID NO: 109558 - DNA, 25 bp, E. coli
tcaagagttgtggtttggcgtactg

SEQ ID NO: 109559 - DNA, 25 bp, E. coli
taagcgtccgcaacttaaagggttg

SEQ ID NO: 109560 - DNA, 25 bp, E. coli
taagcgtccgcatcttaaagggttg

SEQ ID NO: 109561 - DNA, 25 bp, E. coli
gatgaccggcaaacagcggaccgtg

SEQ ID NO: 109562 - DNA, 25 bp, E. coli
gatgaccggcaatcagcggaccgtg

SEQ ID NO: 109563 - DNA, 25 bp, E. coli
cagggttttttaaacctgtagatca

SEQ ID NO: 109564 - DNA, 25 bp, E. coli
cagggttttttatacctgtagatca

SEQ ID NO: 109565 - DNA, 25 bp, E. coli
catatcatggttttgaaataatcca

SEQ ID NO: 109566 - DNA, 25 bp, E. coli
catatcatggttatgaaataatcca

SEQ ID NO: 109567 - DNA, 25 bp, E. coli
acttttatgaccctgccgcatggca

SEQ ID NO: 109568 - DNA, 25 bp, E. coli
acttttatgaccgtgccgcatggca

SEQ ID NO: 109569 - DNA, 25 bp, E. coli
tatctgctgtaaaattaggtggtta

SEQ ID NO: 109570 - DNA, 25 bp, E. coli
tagatcatcatattccatatcatgg

SEQ ID NO: 109571 - DNA, 25 bp, E. coli
tagatcatcataatccatatcatgg

SEQ ID NO: 109572 - DNA, 25 bp, E. coli
tatacctgtagaacatcataatcca

SEQ ID NO: 109573 - DNA, 25 bp, E. coli
tatacctgtagatcatcataatcca

SEQ ID NO: 109574 - DNA, 25 bp, E. coli
tatctgctgtaatattaggtggtta

SEQ ID NO: 109575 - DNA, 25 bp, E. coli
tgaactttatgaattttatctgctg

SEQ ID NO: 109576 - DNA, 25 bp, E. coli
tgaactttatgatttttatctgctg

SEQ ID NO: 109577 - DNA, 25 bp, E. coli
tgccgcatggcacggttttttatac

SEQ ID NO: 109578 - DNA, 25 bp, E. coli
tgccgcatggcagggttttttatac

SEQ ID NO: 109579 - DNA, 25 bp, E. coli
tcttcttacttttatgaccctgccg

SEQ ID NO: 109580 - DNA, 25 bp, E. coli
tcttcttactttaatgaccctgccg

SEQ ID NO: 109581 - DNA, 25 bp, E. coli
ggtggttaataataatctcaataat

SEQ ID NO: 109582 - DNA, 25 bp, E. coli
ggtggttaataaaaatctcaataat

SEQ ID NO: 109583 - DNA, 25 bp, E. coli
taatttgaaaataggaatatccatc

SEQ ID NO: 109584 - DNA, 25 bp, E. coli
taatttgaaaattggaatatccatc

SEQ ID NO: 109585 - DNA, 25 bp, E. coli
cgagtagaatttgccacgtttcagg

SEQ ID NO: 109586 - DNA, 25 bp, E. coli
cgagtagaatttcccacgtttcagg

SEQ ID NO: 109587 - DNA, 25 bp, E. coli
taaacgttgacataatgtggcgtgg

SEQ ID NO: 109588 - DNA, 25 bp, E. coli
tacgtcccgtctgggtacaccaaat

SEQ ID NO: 109589 - DNA, 25 bp, E. coli
taaacgttgacaaaatgtggcgtgg

SEQ ID NO: 109590 - DNA, 25 bp, E. coli
tacgtcccgtctcggtacaccaaat

SEQ ID NO: 109591 - DNA, 25 bp, E. coli
tatcggagacaggaagagtttagtg

SEQ ID NO: 109592 - DNA, 25 bp, E. coli
tatcggagacagcaagagtttagtg

SEQ ID NO: 109593 - DNA, 25 bp, E. coli
ttttgtaaaatattgcgcttaaggg

SEQ ID NO: 109594 - DNA, 25 bp, E. coli
ttttgtaaaataatgcgcttaaggg

SEQ ID NO: 109595 - DNA, 25 bp, E. coli
tcggtacaccaattcccagcagtat

SEQ ID NO: 109596 - DNA, 25 bp, E. coli
tcggtacaccaaatcccagcagtat

SEQ ID NO: 109597 - DNA, 25 bp, E. coli
tggcgtggatcagtataatgcctgc

SEQ ID NO: 109598 - DNA, 25 bp, E. coli
tggcgtggatcactataatgcctgc

SEQ ID NO: 109599 - DNA, 25 bp, E. coli
taatgcctgcagtttttacgtcccg

SEQ ID NO: 109600 - DNA, 25 bp, E. coli
tacccaaaacgactagaatttgcca

SEQ ID NO: 109601 - DNA, 25 bp, E. coli
taatcatcttttttcggagacagga

SEQ ID NO: 109602 - DNA, 25 bp, E. coli
tcaacaaatgaatgtgaactggata

SEQ ID NO: 109603 - DNA, 25 bp, E. coli
tacccaaaacgagtagaatttgcca

SEQ ID NO: 109604 - DNA, 25 bp, E. coli
taatcatcttttatcggagacagga

SEQ ID NO: 109605 - DNA, 25 bp, E. coli
tcaacaaatgaaagtgaactggata

SEQ ID NO: 109606 - DNA, 25 bp, E. coli
taatgcctgcagattttacgtcccg

SEQ ID NO: 109607 - DNA, 25 bp, E. coli
cacttgagctggatggcgcgaagaa

SEQ ID NO: 109608 - DNA, 25 bp, E. coli
cacgccgatcgtaatattgagcgca

SEQ ID NO: 109609 - DNA, 25 bp, E. coli
cacttgagctggttggcgcgaagaa

SEQ ID NO: 109610 - DNA, 25 bp, E. coli
cacgccgatcgttatattgagcgca

SEQ ID NO: 109611 - DNA, 25 bp, E. coli
tcttccaaacttacaggacctgggc

SEQ ID NO: 109612 - DNA, 25 bp, E. coli
tcttccaaactttcaggacctgggc

SEQ ID NO: 109613 - DNA, 25 bp, E. coli
gctggaaacggaacttgatctgatt

SEQ ID NO: 109614 - DNA, 25 bp, E. coli
gcattctttttcaggaaggtcttcc

SEQ ID NO: 109615 - DNA, 25 bp, E. coli
gcattctttttctggaaggtcttcc

SEQ ID NO: 109616 - DNA, 25 bp, E. coli
gctggaaacggatcttgatctgatt

SEQ ID NO: 109617 - DNA, 25 bp, E. coli
gcaattggttatgccgatagcgttc

SEQ ID NO: 109618 - DNA, 25 bp, E. coli
gcaattggttatcccgatagcgttc

SEQ ID NO: 109619 - DNA, 25 bp, E. coli
gaaatgctgcgttctgatctggcac

SEQ ID NO: 109620 - DNA, 25 bp, E. coli
gaaatgctgcgtactgatctggcac

SEQ ID NO: 109621 - DNA, 25 bp, E. coli
cgttcatgattacgtcagccgcgat

SEQ ID NO: 109622 - DNA, 25 bp, E. coli
cgcgaagaatttgcgtgaggcaatt

SEQ ID NO: 109623 - DNA, 25 bp, E. coli
cgcgaagaatttccgtgaggcaatt

SEQ ID NO: 109624 - DNA, 25 bp, E. coli
cgttcatgattaggtcagccgcgat

SEQ ID NO: 109625 - DNA, 25 bp, E. coli
gggtctcaaacgtctcaatgatgtg

SEQ ID NO: 109626 - DNA, 25 bp, E. coli
gggtctcaaacgactcaatgatgtg

SEQ ID NO: 109627 - DNA, 25 bp, E. coli
gacctgggcaaagtgaacattggtg

SEQ ID NO: 109628 - DNA, 25 bp, E. coli
gacctgggcaaactgaacattggtg

SEQ ID NO: 109629 - DNA, 25 bp, E. coli
cagaagttcgcgttgaaggtggtca

SEQ ID NO: 109630 - DNA, 25 bp, E. coli
cagtaagcaaactgggtgacattga

SEQ ID NO: 109631 - DNA, 25 bp, E. coli
cagaagttcgcgatgaaggtggtca

SEQ ID NO: 109632 - DNA, 25 bp, E. coli
cagtaagcaaacagggtgacattga

SEQ ID NO: 109633 - DNA, 25 bp, E. coli
taaagccgctaacgacgatctgctg

SEQ ID NO: 109634 - DNA, 25 bp, E. coli
taaagccgctaaggacgatctgctg

SEQ ID NO: 109635 - DNA, 25 bp, E. coli
tagaagtgaaaccagaagttcgcgt

SEQ ID NO: 109636 - DNA, 25 bp, E. coli
tagaagtgaaacgagaagttcgcgt

SEQ ID NO: 109637 - DNA, 25 bp, E. coli
tgattacaggtatccagattactaa

SEQ ID NO: 109638 - DNA, 25 bp, E. coli
tgattacaggtaaccagattactaa

SEQ ID NO: 109639 - DNA, 25 bp, E. coli
tgctggacagcgtaaaaggcgaagc

SEQ ID NO: 109640 - DNA, 25 bp, E. coli
tgctggacagcgaaaaaggcgaagc

SEQ ID NO: 109641 - DNA, 25 bp, E. coli
gaagttccagtacaagtgaaaccag

SEQ ID NO: 109642 - DNA, 25 bp, E. coli
gaagtggttgcactaagcaaactgg

SEQ ID NO: 109643 - DNA, 25 bp, E. coli
gaagttccagtagaagtgaaaccag

SEQ ID NO: 109644 - DNA, 25 bp, E. coli
gaagtggttgcagtaagcaaactgg

SEQ ID NO: 109645 - DNA, 25 bp, E. coli
cgctaacgacgatctgctgaactct

SEQ ID NO: 109646 - DNA, 25 bp, E. coli
cgctaacgacgaactgctgaactct

SEQ ID NO: 109647 - DNA, 25 bp, E. coli
cgacgatctgctgaactctttctgg

SEQ ID NO: 109648 - DNA, 25 bp, E. coli
cgacgatctgctcaactctttctgg

SEQ ID NO: 109649 - DNA, 25 bp, E. coli
ggtatccagatttctaaagccgcta

SEQ ID NO: 109650 - DNA, 25 bp, E. coli
ggtatccagattactaaagccgcta

SEQ ID NO: 109651 - DNA, 25 bp, E. coli
caggtgccgttgtcatcagcacaac

SEQ ID NO: 109652 - DNA, 25 bp, E. coli
caggtgccgttgacatcagcacaac

SEQ ID NO: 109653 - DNA, 25 bp, E. coli
atcagcacaacccggcgatgtgctg

SEQ ID NO: 109654 - DNA, 25 bp, E. coli
atcagcacaaccgggcgatgtgctg

SEQ ID NO: 109655 - DNA, 25 bp, E. coli
ttgtcatcagcacaaccgggcgatg

SEQ ID NO: 109656 - DNA, 25 bp, E. coli
ttgtcatcagcagaaccgggcgatg

SEQ ID NO: 109657 - DNA, 25 bp, E. coli
tgtcatcagcactaccgggcgatgt

SEQ ID NO: 109658 - DNA, 25 bp, E. coli
tgtcatcagcacaaccgggcgatgt

SEQ ID NO: 109659 - DNA, 25 bp, E. coli
tgccgttgtcatgagcacaaccggg

SEQ ID NO: 109660 - DNA, 25 bp, E. coli
tgccgttgtcatcagcacaaccggg

SEQ ID NO: 109661 - DNA, 25 bp, E. coli
tcatcagcacaagcgggcgatgtgc

SEQ ID NO: 109662 - DNA, 25 bp, E. coli
tcatcagcacaaccgggcgatgtgc

SEQ ID NO: 109663 - DNA, 25 bp, E. coli
gccgttgtcatctgcacaaccgggc

SEQ ID NO: 109664 - DNA, 25 bp, E. coli
gccgttgtcatcagcacaaccgggc

SEQ ID NO: 109665 - DNA, 25 bp, E. coli
cgttgtcatcaggacaaccgggcga

SEQ ID NO: 109666 - DNA, 25 bp, E. coli
cgttgtcatcagcacaaccgggcga

SEQ ID NO: 109667 - DNA, 25 bp, E. coli
gttgtcatcagctcaaccgggcgat

SEQ ID NO: 109668 - DNA, 25 bp, E. coli
gttgtcatcagcacaaccgggcgat

SEQ ID NO: 109669 - DNA, 25 bp, E. coli
gtcatcagcacaaccgggcgatgtg

SEQ ID NO: 109670 - DNA, 25 bp, E. coli
ggtgccgttgtcatcagcacaaccg

SEQ ID NO: 109671 - DNA, 25 bp, E. coli
gtcatcagcacatccgggcgatgtg

SEQ ID NO: 109672 - DNA, 25 bp, E. coli
ggtgccgttgtcttcagcacaaccg

SEQ ID NO: 109673 - DNA, 25 bp, E. coli
aaactggaatcgaaaaggtgatgac

SEQ ID NO: 109674 - DNA, 25 bp, E. coli
aaactggaatcgtaaaggtgatgac

SEQ ID NO: 109675 - DNA, 25 bp, E. coli
tgctaatagttaaatcgcgaatcat

SEQ ID NO: 109676 - DNA, 25 bp, E. coli
tgctaatagttatatcgcgaatcat

SEQ ID NO: 109677 - DNA, 25 bp, E. coli
tgcggaaaacataaatgcactgata

SEQ ID NO: 109678 - DNA, 25 bp, E. coli
tgcggaaaacattaatgcactgata

SEQ ID NO: 109679 - DNA, 25 bp, E. coli
gcgatctgtataccaactgcggaaa

SEQ ID NO: 109680 - DNA, 25 bp, E. coli
gcgatctgtatagcaactgcggaaa

SEQ ID NO: 109681 - DNA, 25 bp, E. coli
gcaaaggatcttttaacgaaatgtt

SEQ ID NO: 109682 - DNA, 25 bp, E. coli
gcaaaggatcttataacgaaatgtt

SEQ ID NO: 109683 - DNA, 25 bp, E. coli
gaaatccgtcacagttcaaacatac

SEQ ID NO: 109684 - DNA, 25 bp, E. coli
gaaatccgtcactgttcaaacatac

SEQ ID NO: 109685 - DNA, 25 bp, E. coli
cgaaatgttaacaatgcgatctgta

SEQ ID NO: 109686 - DNA, 25 bp, E. coli
cgcgaatcataaaaagcaaaggatc

SEQ ID NO: 109687 - DNA, 25 bp, E. coli
cgcgaatcataataagcaaaggatc

SEQ ID NO: 109688 - DNA, 25 bp, E. coli
cgaaatgttaactatgcgatctgta

SEQ ID NO: 109689 - DNA, 25 bp, E. coli
ctttcataaaactatgtgattcgtg

SEQ ID NO: 109690 - DNA, 25 bp, E. coli
cgctactctccagatgtttcacatt

SEQ ID NO: 109691 - DNA, 25 bp, E. coli
cgctactctccacatgtttcacatt

SEQ ID NO: 109692 - DNA, 25 bp, E. coli
ctttcataaaacaatgtgattcgtg

SEQ ID NO: 109693 - DNA, 25 bp, E. coli
taaaaatagggtccgaaatccgtca

SEQ ID NO: 109694 - DNA, 25 bp, E. coli
taaaaatagggtgcgaaatccgtca

SEQ ID NO: 109695 - DNA, 25 bp, E. coli
catttacagcgtcatcaggatgcca

SEQ ID NO: 109696 - DNA, 25 bp, E. coli
tactgggaccggaactgttacgcac

SEQ ID NO: 109697 - DNA, 25 bp, E. coli
tactgggaccggtactgttacgcac

SEQ ID NO: 109698 - DNA, 25 bp, E. coli
aaagggctggcacttggcaatcgtc

SEQ ID NO: 109699 - DNA, 25 bp, E. coli
aaagggctggcagttggcaatcgtc

SEQ ID NO: 109700 - DNA, 25 bp, E. coli
tatgcggcaatcctggcaaatgcac

SEQ ID NO: 109701 - DNA, 25 bp, E. coli
tatgcggcaatcgtggcaaatgcac

SEQ ID NO: 109702 - DNA, 25 bp, E. coli
tattgatgtacacgcttacctggca

SEQ ID NO: 109703 - DNA, 25 bp, E. coli
tattgatgtacaggcttacctggca

SEQ ID NO: 109704 - DNA, 25 bp, E. coli
tgaagtgaacgaaaaccagggctgt

SEQ ID NO: 109705 - DNA, 25 bp, E. coli
tgaagtgaacgataaccagggctgt

SEQ ID NO: 109706 - DNA, 25 bp, E. coli
gaacaggcacgcgatatactgcagg

SEQ ID NO: 109707 - DNA, 25 bp, E. coli
gaacaggcacgccatatactgcagg

SEQ ID NO: 109708 - DNA, 25 bp, E. coli
catttacagcgtgatcaggatgcca

SEQ ID NO: 109709 - DNA, 25 bp, E. coli
cttgcccgacagcagaatgacttta

SEQ ID NO: 109710 - DNA, 25 bp, E. coli
cttgcccgacaggagaatgacttta

SEQ ID NO: 109711 - DNA, 25 bp, E. coli
tggcataactttacaggcggtccgg

SEQ ID NO: 109712 - DNA, 25 bp, E. coli
ggaactggtaaaagctgcaactgca

SEQ ID NO: 109713 - DNA, 25 bp, E. coli
tggcataacttttcaggcggtccgg

SEQ ID NO: 109714 - DNA, 25 bp, E. coli
ggaactggtaaatgctgcaactgca

SEQ ID NO: 109715 - DNA, 25 bp, E. coli
taatcatggtgctcgctggctactg

SEQ ID NO: 109716 - DNA, 25 bp, E. coli
taatcatggtgcacgctggctactg

SEQ ID NO: 109717 - DNA, 25 bp, E. coli
caaagttaccttatgaagttgcggg

SEQ ID NO: 109718 - DNA, 25 bp, E. coli
caaagttaccttttgaagttgcggg

SEQ ID NO: 109719 - DNA, 25 bp, E. coli
tactatttgcctgtaatgagacagc

SEQ ID NO: 109720 - DNA, 25 bp, E. coli
tactatttgcctctaatgagacagc

SEQ ID NO: 109721 - DNA, 25 bp, E. coli
actaccagatagttgggttgttgag

SEQ ID NO: 109722 - DNA, 25 bp, E. coli
actaccagatagatgggttgttgag

SEQ ID NO: 109723 - DNA, 25 bp, E. coli
tatatgttaggtttcgctatggcga

SEQ ID NO: 109724 - DNA, 25 bp, E. coli
tatatgttaggtatcgctatggcga

SEQ ID NO: 109725 - DNA, 25 bp, E. coli
tcgctatggcgatcggattgcagaa

SEQ ID NO: 109726 - DNA, 25 bp, E. coli
tacggtaaaaactgaaacaatggcg

SEQ ID NO: 109727 - DNA, 25 bp, E. coli
tacggtaaaaacagaaacaatggcg

SEQ ID NO: 109728 - DNA, 25 bp, E. coli
tcgctatggcgaacggattgcagaa

SEQ ID NO: 109729 - DNA, 25 bp, E. coli
gaaacaatggcgatacaattagctg

SEQ ID NO: 109730 - DNA, 25 bp, E. coli
gacagctgtttacggttctgatgaa

SEQ ID NO: 109731 - DNA, 25 bp, E. coli
gacagctgtttagggttctgatgaa

SEQ ID NO: 109732 - DNA, 25 bp, E. coli
gaaacaatggcgttacaattagctg

SEQ ID NO: 109733 - DNA, 25 bp, E. coli
ccatatttaattacggaactaccag

SEQ ID NO: 109734 - DNA, 25 bp, E. coli
ccatatttaatttcggaactaccag

SEQ ID NO: 109735 - DNA, 25 bp, E. coli
gataaatactctcttaaaaatacgg

SEQ ID NO: 109736 - DNA, 25 bp, E. coli
ggttgttgagggtgcaaagttacct

SEQ ID NO: 109737 - DNA, 25 bp, E. coli
ggttgttgagggagcaaagttacct

SEQ ID NO: 109738 - DNA, 25 bp, E. coli
gataaatactctgttaaaaatacgg

SEQ ID NO: 109739 - DNA, 25 bp, E. coli
aatacgccgggcaaccatgagtggt

SEQ ID NO: 109740 - DNA, 25 bp, E. coli
aatacgccgggctaccatgagtggt

SEQ ID NO: 109741 - DNA, 25 bp, E. coli
tacctggcgagcaagaaatcgacac

SEQ ID NO: 109742 - DNA, 25 bp, E. coli
tacctggcgagctagaaatcgacac

SEQ ID NO: 109743 - DNA, 25 bp, E. coli
tatatcggtgatcggaccaaaaccg

SEQ ID NO: 109744 - DNA, 25 bp, E. coli
tatatcggtgatgggaccaaaaccg

SEQ ID NO: 109745 - DNA, 25 bp, E. coli
tgcgaactgttagggccaggcaagc

SEQ ID NO: 109746 - DNA, 25 bp, E. coli
tgcgaactgttacggccaggcaagc

SEQ ID NO: 109747 - DNA, 25 bp, E. coli
tcatgcggtgatcctcaatgcggta

SEQ ID NO: 109748 - DNA, 25 bp, E. coli
tcatgcggtgatgctcaatgcggta

SEQ ID NO: 109749 - DNA, 25 bp, E. coli
cctataaacgtcagcctggcggtgc

SEQ ID NO: 109750 - DNA, 25 bp, E. coli
ccaactggcgcgaaatgggtcatgc

SEQ ID NO: 109751 - DNA, 25 bp, E. coli
ccaactggcgcgtaatgggtcatgc

SEQ ID NO: 109752 - DNA, 25 bp, E. coli
cctataaacgtctgcctggcggtgc

SEQ ID NO: 109753 - DNA, 25 bp, E. coli
gaaaaattgccgttcctgatgcgcc

SEQ ID NO: 109754 - DNA, 25 bp, E. coli
gactgggaacaggtacaaaaggcac

SEQ ID NO: 109755 - DNA, 25 bp, E. coli
gactgggaacagctacaaaaggcac

SEQ ID NO: 109756 - DNA, 25 bp, E. coli
gaaaaattgccgatcctgatgcgcc

SEQ ID NO: 109757 - DNA, 25 bp, E. coli
ggtagatattccacttgccgatccg

SEQ ID NO: 109758 - DNA, 25 bp, E. coli
ggtagatattcctcttgccgatccg

SEQ ID NO: 109759 - DNA, 25 bp, E. coli
tggcggaagcctcacaggatcgcta

SEQ ID NO: 109760 - DNA, 25 bp, E. coli
tggcggaagcctgacaggatcgcta

SEQ ID NO: 109761 - DNA, 25 bp, E. coli
caggtgagtgtgcaagatcttgtca

SEQ ID NO: 109762 - DNA, 25 bp, E. coli
caggtgagtgtggaagatcttgtca

SEQ ID NO: 109763 - DNA, 25 bp, E. coli
agaagaggctgaagccagcggcaac

SEQ ID NO: 109764 - DNA, 25 bp, E. coli
agaagaggctgatgccagcggcaac

SEQ ID NO: 109765 - DNA, 25 bp, E. coli
tccgggatgatccaagctgttcgtc

SEQ ID NO: 109766 - DNA, 25 bp, E. coli
tccgggatgatcgaagctgttcgtc

SEQ ID NO: 109767 - DNA, 25 bp, E. coli
cctgcaggtgagtgtggaagatctt

SEQ ID NO: 109768 - DNA, 25 bp, E. coli
gcctgtccgggatgatcgaagctgt

SEQ ID NO: 109769 - DNA, 25 bp, E. coli
gcctgtccgggaagatcgaagctgt

SEQ ID NO: 109770 - DNA, 25 bp, E. coli
cctgcaggtgagagtggaagatctt

SEQ ID NO: 109771 - DNA, 25 bp, E. coli
gctttctgagctgtctgcgctgcag

SEQ ID NO: 109772 - DNA, 25 bp, E. coli
gctttctgagctctctgcgctgcag

SEQ ID NO: 109773 - DNA, 25 bp, E. coli
gaaacggcgggcagaagaggctgaa

SEQ ID NO: 109774 - DNA, 25 bp, E. coli
gaaacggcgggctgaagaggctgaa

SEQ ID NO: 109775 - DNA, 25 bp, E. coli
gtcacgctttctgagctgtctgcgc

SEQ ID NO: 109776 - DNA, 25 bp, E. coli
gtcacgctttctcagctgtctgcgc

SEQ ID NO: 109777 - DNA, 25 bp, E. coli
gagtgtggaagatcttgtcagaacc

SEQ ID NO: 109778 - DNA, 25 bp, E. coli
gaggctgaagcctgcggcaacctgc

SEQ ID NO: 109779 - DNA, 25 bp, E. coli
gatgatcgaagctgttcgtccggat

SEQ ID NO: 109780 - DNA, 25 bp, E. coli
gagtgtggaagaacttgtcagaacc

SEQ ID NO: 109781 - DNA, 25 bp, E. coli
gatgatcgaagcagttcgtccggat

SEQ ID NO: 109782 - DNA, 25 bp, E. coli
gaggctgaagccagcggcaacctgc

SEQ ID NO: 109783 - DNA, 25 bp, E. coli
caatggtcgcatgctaaatgggtgc

SEQ ID NO: 109784 - DNA, 25 bp, E. coli
caatggtcgcatcctaaatgggtgc

SEQ ID NO: 109785 - DNA, 25 bp, E. coli
tacataccctgtgggaagacttacg

SEQ ID NO: 109786 - DNA, 25 bp, E. coli
tacataccctgtcggaagacttacg

SEQ ID NO: 109787 - DNA, 25 bp, E. coli
tacgtaaaacgcatccagagatcgg

SEQ ID NO: 109788 - DNA, 25 bp, E. coli
tacgtaaaacgcttccagagatcgg

SEQ ID NO: 109789 - DNA, 25 bp, E. coli
tagtgatgatatcacgcaaaaccgg

SEQ ID NO: 109790 - DNA, 25 bp, E. coli
tagtgatgatatgacgcaaaaccgg

SEQ ID NO: 109791 - DNA, 25 bp, E. coli
tctgttttaagtttccggcgaccat

SEQ ID NO: 109792 - DNA, 25 bp, E. coli
tctgttttaagtatccggcgaccat

SEQ ID NO: 109793 - DNA, 25 bp, E. coli
ggttacaaaaataagcgcagtggca

SEQ ID NO: 109794 - DNA, 25 bp, E. coli
ggttacaaaaattagcgcagtggca

SEQ ID NO: 109795 - DNA, 25 bp, E. coli
ggtgattttagacagccgcccggtt

SEQ ID NO: 109796 - DNA, 25 bp, E. coli
ggtgattttagagagccgcccggtt

SEQ ID NO: 109797 - DNA, 25 bp, E. coli
tcaccagccttgtagagtatgcccg

SEQ ID NO: 109798 - DNA, 25 bp, E. coli
taatcgcggtttacatcagcgcggc

SEQ ID NO: 109799 - DNA, 25 bp, E. coli
tcaccagccttgaagagtatgcccg

SEQ ID NO: 109800 - DNA, 25 bp, E. coli
taatcgcggttttcatcagcgcggc

SEQ ID NO: 109801 - DNA, 25 bp, E. coli
gagcagttccggctattccacagca

SEQ ID NO: 109802 - DNA, 25 bp, E. coli
gagcagttccgggtattccacagca

SEQ ID NO: 109803 - DNA, 25 bp, E. coli
gaccatttcgcatcaggcagcatta

SEQ ID NO: 109804 - DNA, 25 bp, E. coli
gaccatttcgcaacaggcagcatta

SEQ ID NO: 109805 - DNA, 25 bp, E. coli
caacattttttacaggcggctggcg

SEQ ID NO: 109806 - DNA, 25 bp, E. coli
caacattttttagaggcggctggcg

SEQ ID NO: 109807 - DNA, 25 bp, E. coli
cactacaaactttacttgggcgcga

SEQ ID NO: 109808 - DNA, 25 bp, E. coli
cactacaaacttaacttgggcgcga

SEQ ID NO: 109809 - DNA, 25 bp, E. coli
tacctggcgactggctgtggatttc

SEQ ID NO: 109810 - DNA, 25 bp, E. coli
tacctggcgactcgctgtggatttc

SEQ ID NO: 109811 - DNA, 25 bp, E. coli
ttaccgtttacgtcgcgatgcgcaa

SEQ ID NO: 109812 - DNA, 25 bp, E. coli
ttaccgtttacgacgcgatgcgcaa

SEQ ID NO: 109813 - DNA, 25 bp, E. coli
tgggaaaaccaacctgatgccgact

SEQ ID NO: 109814 - DNA, 25 bp, E. coli
tgtactggcacattttgcgggcgag

SEQ ID NO: 109815 - DNA, 25 bp, E. coli
tgtactggcacaatttgcgggcgag

SEQ ID NO: 109816 - DNA, 25 bp, E. coli
tgggaaaaccaagctgatgccgact

SEQ ID NO: 109817 - DNA, 25 bp, E. coli
taaccactacggtgcagggctacga

SEQ ID NO: 109818 - DNA, 25 bp, E. coli
taaccactacggagcagggctacga

SEQ ID NO: 109819 - DNA, 25 bp, E. coli
tctgacgacgacaggcttgaactgg

SEQ ID NO: 109820 - DNA, 25 bp, E. coli
tctgacgacgactggcttgaactgg

SEQ ID NO: 109821 - DNA, 25 bp, E. coli
cgctgcgtgggcctttacagaaaaa

SEQ ID NO: 109822 - DNA, 25 bp, E. coli
cgctgcgtgggcgtttacagaaaaa

SEQ ID NO: 109823 - DNA, 25 bp, E. coli
gagtgattgccctgaccctattgcg

SEQ ID NO: 109824 - DNA, 25 bp, E. coli
gagtgattgcccagaccctattgcg

SEQ ID NO: 109825 - DNA, 25 bp, E. coli
gatgccttgttagccagcgatgagc

SEQ ID NO: 109826 - DNA, 25 bp, E. coli
gatgccttgttacccagcgatgagc

SEQ ID NO: 109827 - DNA, 25 bp, E. coli
tacatcatgaaatcgaccggccttg

SEQ ID NO: 109828 - DNA, 25 bp, E. coli
tacatcatgaaaacgaccggccttg

SEQ ID NO: 109829 - DNA, 25 bp, E. coli
acgctgtgggctggaaatgacgaca

SEQ ID NO: 109830 - DNA, 25 bp, E. coli
acgctgtgggctcgaaatgacgaca

SEQ ID NO: 109831 - DNA, 25 bp, E. coli
tatgctgctgttaattaccgcgagg

SEQ ID NO: 109832 - DNA, 25 bp, E. coli
tatgctgctgtttattaccgcgagg

SEQ ID NO: 109833 - DNA, 25 bp, E. coli
tgttcagcatttacagagcatgccg

SEQ ID NO: 109834 - DNA, 25 bp, E. coli
tgttcagcattttcagagcatgccg

SEQ ID NO: 109835 - DNA, 25 bp, E. coli
tgacgacagagacgttatgctgacc

SEQ ID NO: 109836 - DNA, 25 bp, E. coli
tgacgacagagaggttatgctgacc

SEQ ID NO: 109837 - DNA, 25 bp, E. coli
tcctcgaaaggaaagggaacgctgt

SEQ ID NO: 109838 - DNA, 25 bp, E. coli
tccggataccgcgttgcatgcatac

SEQ ID NO: 109839 - DNA, 25 bp, E. coli
tccggataccgccttgcatgcatac

SEQ ID NO: 109840 - DNA, 25 bp, E. coli
tcctcgaaaggatagggaacgctgt

SEQ ID NO: 109841 - DNA, 25 bp, E. coli
ggaacgctgtaagatcccgggctga

SEQ ID NO: 109842 - DNA, 25 bp, E. coli
ggaacgctgtaacatcccgggctga

SEQ ID NO: 109843 - DNA, 25 bp, E. coli
taaaattaccgactggacgctgtgg

SEQ ID NO: 109844 - DNA, 25 bp, E. coli
taaaattaccgagtggacgctgtgg

SEQ ID NO: 109845 - DNA, 25 bp, E. coli
gacctgtcattttcgcagcgggaga

SEQ ID NO: 109846 - DNA, 25 bp, E. coli
gacctgtcatttacgcagcgggaga

SEQ ID NO: 109847 - DNA, 25 bp, E. coli
gagtaaaaacgtcattcgccatggg

SEQ ID NO: 109848 - DNA, 25 bp, E. coli
gagtaaaaacgtgattcgccatggg

SEQ ID NO: 109849 - DNA, 25 bp, E. coli
aatgcagtcagtttgacagcacctg

SEQ ID NO: 109850 - DNA, 25 bp, E. coli
aatgcagtcagtatgacagcacctg

SEQ ID NO: 109851 - DNA, 25 bp, E. coli
cagtatgacagcacctgaagcgcaa

SEQ ID NO: 109852 - DNA, 25 bp, E. coli
cagtatgacagctcctgaagcgcaa

SEQ ID NO: 109853 - DNA, 25 bp, E. coli
caggcgcggcgaagaatagtttttc

SEQ ID NO: 109854 - DNA, 25 bp, E. coli
caggcgcggcgatgaatagtttttc

SEQ ID NO: 109855 - DNA, 25 bp, E. coli
ttagcgggaaattctcccaaccagg

SEQ ID NO: 109856 - DNA, 25 bp, E. coli
ttagcgggaaatactcccaaccagg

SEQ ID NO: 109857 - DNA, 25 bp, E. coli
tgacagcacctgaagcgcaatttaa

SEQ ID NO: 109858 - DNA, 25 bp, E. coli
tgaagcgcaattaaaacgcttataa

SEQ ID NO: 109859 - DNA, 25 bp, E. coli
tgacagcacctgtagcgcaatttaa

SEQ ID NO: 109860 - DNA, 25 bp, E. coli
tgaagcgcaatttaaacgcttataa

SEQ ID NO: 109861 - DNA, 25 bp, E. coli
gcacctgaagcgcaatttaaacgct

SEQ ID NO: 109862 - DNA, 25 bp, E. coli
gcggtatatttaaacaattttagcg

SEQ ID NO: 109863 - DNA, 25 bp, E. coli
gcggtatatttatacaattttagcg

SEQ ID NO: 109864 - DNA, 25 bp, E. coli
gcacctgaagcggaatttaaacgct

SEQ ID NO: 109865 - DNA, 25 bp, E. coli
cgcggcgaagaatagtttttcgatt

SEQ ID NO: 109866 - DNA, 25 bp, E. coli
cgcggcgaagaaaagtttttcgatt

SEQ ID NO: 109867 - DNA, 25 bp, E. coli
gggaaatactcccaaccaggcgcgg

SEQ ID NO: 109868 - DNA, 25 bp, E. coli
gggaaatactccgaaccaggcgcgg

SEQ ID NO: 109869 - DNA, 25 bp, E. coli
gatgatacagcgctatatttaaaca

SEQ ID NO: 109870 - DNA, 25 bp, E. coli
gatgatacagcggtatatttaaaca

SEQ ID NO: 109871 - DNA, 25 bp, E. coli
caaattagccgaactcaggcgtggc

SEQ ID NO: 109872 - DNA, 25 bp, E. coli
caaattagccgatctcaggcgtggc

SEQ ID NO: 109873 - DNA, 25 bp, E. coli
caaaaacacgctcgtggtgcgctta

SEQ ID NO: 109874 - DNA, 25 bp, E. coli
caaaaacacgctggtggtgcgctta

SEQ ID NO: 109875 - DNA, 25 bp, E. coli
cagcaagagatgaaacgggcgctca

SEQ ID NO: 109876 - DNA, 25 bp, E. coli
cagcaagagatgtaacgggcgctca

SEQ ID NO: 109877 - DNA, 25 bp, E. coli
caggcgtggctgcaaagtttacgac

SEQ ID NO: 109878 - DNA, 25 bp, E. coli
caggcgtggctggaaagtttacgac

SEQ ID NO: 109879 - DNA, 25 bp, E. coli
tacaccgtgggcaatcgtccttatg

SEQ ID NO: 109880 - DNA, 25 bp, E. coli
taccgccgggctattacagatcctt

SEQ ID NO: 109881 - DNA, 25 bp, E. coli
tacaggctcatagattgattccggc

SEQ ID NO: 109882 - DNA, 25 bp, E. coli
tacaccgtgggctatcgtccttatg

SEQ ID NO: 109883 - DNA, 25 bp, E. coli
taaaaggcagcgttaaacctgaccg

SEQ ID NO: 109884 - DNA, 25 bp, E. coli
tacaggctcatacattgattccggc

SEQ ID NO: 109885 - DNA, 25 bp, E. coli
taaaaggcagcgataaacctgaccg

SEQ ID NO: 109886 - DNA, 25 bp, E. coli
taccgccgggcttttacagatcctt

SEQ ID NO: 109887 - DNA, 25 bp, E. coli
cctttgctgcaattatcgtcgggac

SEQ ID NO: 109888 - DNA, 25 bp, E. coli
cctttgctgcaaatatcgtcgggac

SEQ ID NO: 109889 - DNA, 25 bp, E. coli
gggatattcctaagccagtgggcag

SEQ ID NO: 109890 - DNA, 25 bp, E. coli
gggatattcctatgccagtgggcag

SEQ ID NO: 109891 - DNA, 25 bp, E. coli
taacctgcgtgatatcaatagcgac

SEQ ID NO: 109892 - DNA, 25 bp, E. coli
taacctgcgtgaaatcaatagcgac

SEQ ID NO: 109893 - DNA, 25 bp, E. coli
caatcatggcacctttgctaaagcg

SEQ ID NO: 109894 - DNA, 25 bp, E. coli
caagccaggactttgcgaacaaaca

SEQ ID NO: 109895 - DNA, 25 bp, E. coli
caatcatggcacgtttgctaaagcg

SEQ ID NO: 109896 - DNA, 25 bp, E. coli
caagccaggactatgcgaacaaaca

SEQ ID NO: 109897 - DNA, 25 bp, E. coli
caaacaatacaggtaacaggaactc

SEQ ID NO: 109898 - DNA, 25 bp, E. coli
caaacaatacagctaacaggaactc

SEQ ID NO: 109899 - DNA, 25 bp, E. coli
catagaaagggaaacgtttcgcgcg

SEQ ID NO: 109900 - DNA, 25 bp, E. coli
catagaaagggatacgtttcgcgcg

SEQ ID NO: 109901 - DNA, 25 bp, E. coli
tgctaaagcgtggaagccaggactt

SEQ ID NO: 109902 - DNA, 25 bp, E. coli
tgctaaagcgtgcaagccaggactt

SEQ ID NO: 109903 - DNA, 25 bp, E. coli
tgcgaacaaacatgccatcgacggc

SEQ ID NO: 109904 - DNA, 25 bp, E. coli
tgcgaacaaacaagccatcgacggc

SEQ ID NO: 109905 - DNA, 25 bp, E. coli
gaaaattcgcgctatcatggcacct

SEQ ID NO: 109906 - DNA, 25 bp, E. coli
gaaaattcgcgcaatcatggcacct

SEQ ID NO: 109907 - DNA, 25 bp, E. coli
ccgcatgagcagaaacatagaaagg

SEQ ID NO: 109908 - DNA, 25 bp, E. coli
ccgcatgagcagtaacatagaaagg

SEQ ID NO: 109909 - DNA, 25 bp, E. coli
gggtcaaactggtcaccagctccga

SEQ ID NO: 109910 - DNA, 25 bp, E. coli
gggtcaaactggacaccagctccga

SEQ ID NO: 109911 - DNA, 25 bp, E. coli
gacggcaccaaacggtcataataag

SEQ ID NO: 109912 - DNA, 25 bp, E. coli
gacggcaccaaagggtcataataag

SEQ ID NO: 109913 - DNA, 25 bp, E. coli
gagatatgggtcaaactggtcacca

SEQ ID NO: 109914 - DNA, 25 bp, E. coli
gagatatgggtctaactggtcacca

SEQ ID NO: 109915 - DNA, 25 bp, E. coli
cacttggggcgggtatgatcctacc

SEQ ID NO: 109916 - DNA, 25 bp, E. coli
cacttggggcggctatgatcctacc

SEQ ID NO: 109917 - DNA, 25 bp, E. coli
ttggcgggcaacatgatgtggaacc

SEQ ID NO: 109918 - DNA, 25 bp, E. coli
ttggcgggcaacttgatgtggaacc

SEQ ID NO: 109919 - DNA, 25 bp, E. coli
tgatcctaccgctcggtccacaaaa

SEQ ID NO: 109920 - DNA, 25 bp, E. coli
tgatcctaccgcacggtccacaaaa

SEQ ID NO: 109921 - DNA, 25 bp, E. coli
ccttggcgggcatcttgatgtggaa

SEQ ID NO: 109922 - DNA, 25 bp, E. coli
ccttggcgggcaacttgatgtggaa

SEQ ID NO: 109923 - DNA, 25 bp, E. coli
gcgggcaacttgttgtggaaccaaa

SEQ ID NO: 109924 - DNA, 25 bp, E. coli
gcgggcaacttgatgtggaaccaaa

SEQ ID NO: 109925 - DNA, 25 bp, E. coli
cgggcaacttgaagtggaaccaaaa

SEQ ID NO: 109926 - DNA, 25 bp, E. coli
cgggcaacttgatgtggaaccaaaa

SEQ ID NO: 109927 - DNA, 25 bp, E. coli
ggcgggcaacttgatgtggaaccaa

SEQ ID NO: 109928 - DNA, 25 bp, E. coli
gggcggctatgaacctaccgctcgg

SEQ ID NO: 109929 - DNA, 25 bp, E. coli
ggcaacttgatgaggaaccaaaacg

SEQ ID NO: 109930 - DNA, 25 bp, E. coli
ggcaacttgatgtggaaccaaaacg

SEQ ID NO: 109931 - DNA, 25 bp, E. coli
ggcgggcaacttcatgtggaaccaa

SEQ ID NO: 109932 - DNA, 25 bp, E. coli
gggcggctatgatcctaccgctcgg

SEQ ID NO: 109933 - DNA, 25 bp, E. coli
ggctatgatcctaccgctcggtcca

SEQ ID NO: 109934 - DNA, 25 bp, E. coli
ggctatgatccttccgctcggtcca

SEQ ID NO: 109935 - DNA, 25 bp, E. coli
gatcctaccgctgggtccacaaaat

SEQ ID NO: 109936 - DNA, 25 bp, E. coli
gatcctaccgctcggtccacaaaat

SEQ ID NO: 109937 - DNA, 25 bp, E. coli
caatcccagggaaggcaaagccata

SEQ ID NO: 109938 - DNA, 25 bp, E. coli
caatcccagggatggcaaagccata

SEQ ID NO: 109939 - DNA, 25 bp, E. coli
cagatgctttttctgactggcgaat

SEQ ID NO: 109940 - DNA, 25 bp, E. coli
cagatgctttttgtgactggcgaat

SEQ ID NO: 109941 - DNA, 25 bp, E. coli
agcgacgaacaatcccagggatggc

SEQ ID NO: 109942 - DNA, 25 bp, E. coli
agcgacgaacaaacccagggatggc

SEQ ID NO: 109943 - DNA, 25 bp, E. coli
tattgatgtcgaagactcaccacgc

SEQ ID NO: 109944 - DNA, 25 bp, E. coli
tattgatgtcgatgactcaccacgc

SEQ ID NO: 109945 - DNA, 25 bp, E. coli
ttttcaaccgtatacagcagagcgc

SEQ ID NO: 109946 - DNA, 25 bp, E. coli
ttttcaaccgtaaacagcagagcgc

SEQ ID NO: 109947 - DNA, 25 bp, E. coli
tcggcgtacgctgcaactctactaa

SEQ ID NO: 109948 - DNA, 25 bp, E. coli
tcggcgtacgctccaactctactaa

SEQ ID NO: 109949 - DNA, 25 bp, E. coli
tcgatgactcaccacgctttcacgg

SEQ ID NO: 109950 - DNA, 25 bp, E. coli
tcgatgactcacgacgctttcacgg

SEQ ID NO: 109951 - DNA, 25 bp, E. coli
gccccggcatagagccaatcagatg

SEQ ID NO: 109952 - DNA, 25 bp, E. coli
gccccggcatagtgccaatcagatg

SEQ ID NO: 109953 - DNA, 25 bp, E. coli
gctcagttttcacagccagcttcag

SEQ ID NO: 109954 - DNA, 25 bp, E. coli
gctcagttttcagagccagcttcag

SEQ ID NO: 109955 - DNA, 25 bp, E. coli
gcagagcgcccaaatctatcggcgt

SEQ ID NO: 109956 - DNA, 25 bp, E. coli
gcagagcgcccatatctatcggcgt

SEQ ID NO: 109957 - DNA, 25 bp, E. coli
tggcgaattacgtcagataaaaggc

SEQ ID NO: 109958 - DNA, 25 bp, E. coli
tggcgaattacgacagataaaaggc

SEQ ID NO: 109959 - DNA, 25 bp, E. coli
acaccgactggttgacttgctggaa

SEQ ID NO: 109960 - DNA, 25 bp, E. coli
acaccgactggtagacttgctggaa

SEQ ID NO: 109961 - DNA, 25 bp, E. coli
ttagtgtttcactggactcccgcga

SEQ ID NO: 109962 - DNA, 25 bp, E. coli
ttagtgtttcacaggactcccgcga

SEQ ID NO: 109963 - DNA, 25 bp, E. coli
tgtgatctacgagaaccgcgatgga

SEQ ID NO: 109964 - DNA, 25 bp, E. coli
tgtgatctacgacaaccgcgatgga

SEQ ID NO: 109965 - DNA, 25 bp, E. coli
tcggcatgggaagtttgaaacggct

SEQ ID NO: 109966 - DNA, 25 bp, E. coli
tcggcatgggaactttgaaacggct

SEQ ID NO: 109967 - DNA, 25 bp, E. coli
tcagatgtttatcaggcgcgcgctc

SEQ ID NO: 109968 - DNA, 25 bp, E. coli
tcagatgtttatgaggcgcgcgctc

SEQ ID NO: 109969 - DNA, 25 bp, E. coli
ccatgggaacatgaaaggtcgcgcc

SEQ ID NO: 109970 - DNA, 25 bp, E. coli
ccatgggaacatcaaaggtcgcgcc

SEQ ID NO: 109971 - DNA, 25 bp, E. coli
gcatgggcgttcacttcgtcggcaa

SEQ ID NO: 109972 - DNA, 25 bp, E. coli
gcatgggcgttctcttcgtcggcaa

SEQ ID NO: 109973 - DNA, 25 bp, E. coli
gaaagtttccatctaccaccaggtg

SEQ ID NO: 109974 - DNA, 25 bp, E. coli
gaaagtttccatgtaccaccaggtg

SEQ ID NO: 109975 - DNA, 25 bp, E. coli
ggtgcttgagctataccggacgcca

SEQ ID NO: 109976 - DNA, 25 bp, E. coli
ggtgcttgagctttaccggacgcca

SEQ ID NO: 109977 - DNA, 25 bp, E. coli
ggcttgcattttcgcgcgctaccga

SEQ ID NO: 109978 - DNA, 25 bp, E. coli
ggcttgcattttggcgcgctaccga

SEQ ID NO: 109979 - DNA, 25 bp, E. coli
tcaagtctggtcaaaacgtggtgct

SEQ ID NO: 109980 - DNA, 25 bp, E. coli
tcaagtctggtctaaacgtggtgct

SEQ ID NO: 109981 - DNA, 25 bp, E. coli
caacgcgcgctaactcctattataa

SEQ ID NO: 109982 - DNA, 25 bp, E. coli
caacgcgcgctatctcctattataa

SEQ ID NO: 109983 - DNA, 25 bp, E. coli
cactgttctattttcttaaggatga

SEQ ID NO: 109984 - DNA, 25 bp, E. coli
cactgttctattatcttaaggatga

SEQ ID NO: 109985 - DNA, 25 bp, E. coli
agcaaatgcggccacaacgcgcgct

SEQ ID NO: 109986 - DNA, 25 bp, E. coli
agcaaatgcggcgacaacgcgcgct

SEQ ID NO: 109987 - DNA, 25 bp, E. coli
aactgctggacacgacgctgatgca

SEQ ID NO: 109988 - DNA, 25 bp, E. coli
aactgctggacaggacgctgatgca

SEQ ID NO: 109989 - DNA, 25 bp, E. coli
tatcaactcgctcttcacgatgcca

SEQ ID NO: 109990 - DNA, 25 bp, E. coli
tatcaactcgctgttcacgatgcca

SEQ ID NO: 109991 - DNA, 25 bp, E. coli
tgccaaaatttaaggaactgctgga

SEQ ID NO: 109992 - DNA, 25 bp, E. coli
tgccaaaatttatggaactgctgga

SEQ ID NO: 109993 - DNA, 25 bp, E. coli
gcttgtttttctggtgaagttatcc

SEQ ID NO: 109994 - DNA, 25 bp, E. coli
gcttgtttttctcgtgaagttatcc

SEQ ID NO: 109995 - DNA, 25 bp, E. coli
gaagttatccatgattcactgttct

SEQ ID NO: 109996 - DNA, 25 bp, E. coli
gaagttatccatcattcactgttct

SEQ ID NO: 109997 - DNA, 25 bp, E. coli
cccgatgtgttactgaattatcgac

SEQ ID NO: 109998 - DNA, 25 bp, E. coli
cccgatgtgttagtgaattatcgac

SEQ ID NO: 109999 - DNA, 25 bp, E. coli
tcaatacattattttacccgatgtg

SEQ ID NO: 110000 - DNA, 25 bp, E. coli
tcaatacattatattacccgatgtg

SEQ ID NO: 110001 - DNA, 25 bp, E. coli
gatgcattgcaggattatcaactcg

SEQ ID NO: 110002 - DNA, 25 bp, E. coli
gatgcattgcagcattatcaactcg

SEQ ID NO: 110003 - DNA, 25 bp, E. coli
aagaccggcacacctcccgcagtga

SEQ ID NO: 110004 - DNA, 25 bp, E. coli
aagaccggcacagctcccgcagtga

SEQ ID NO: 110005 - DNA, 25 bp, E. coli
cacacctcccgctgtgaacggtatg

SEQ ID NO: 110006 - DNA, 25 bp, E. coli
cacacctcccgcagtgaacggtatg

SEQ ID NO: 110007 - DNA, 25 bp, E. coli
cacctcccgcagagaacggtatgcg

SEQ ID NO: 110008 - DNA, 25 bp, E. coli
cacctcccgcagtgaacggtatgcg

SEQ ID NO: 110009 - DNA, 25 bp, E. coli
agaccggcacacgtcccgcagtgaa

SEQ ID NO: 110010 - DNA, 25 bp, E. coli
agaccggcacacctcccgcagtgaa

SEQ ID NO: 110011 - DNA, 25 bp, E. coli
acctcccgcagtgaacggtatgcgt

SEQ ID NO: 110012 - DNA, 25 bp, E. coli
acctcccgcagtcaacggtatgcgt

SEQ ID NO: 110013 - DNA, 25 bp, E. coli
tcccgcagtgaagggtatgcgtaca

SEQ ID NO: 110014 - DNA, 25 bp, E. coli
tcccgcagtgaacggtatgcgtaca

SEQ ID NO: 110015 - DNA, 25 bp, E. coli
cctcccgcagtgaacggtatgcgta

SEQ ID NO: 110016 - DNA, 25 bp, E. coli
cctcccgcagtgtacggtatgcgta

SEQ ID NO: 110017 - DNA, 25 bp, E. coli
gcacacctcccggagtgaacggtat

SEQ ID NO: 110018 - DNA, 25 bp, E. coli
gaagaccggcactcctcccgcagtg

SEQ ID NO: 110019 - DNA, 25 bp, E. coli
gcacacctcccgcagtgaacggtat

SEQ ID NO: 110020 - DNA, 25 bp, E. coli
gaagaccggcacacctcccgcagtg

SEQ ID NO: 110021 - DNA, 25 bp, E. coli
cccgcagtgaaccgtatgcgtacat

SEQ ID NO: 110022 - DNA, 25 bp, E. coli
cccgcagtgaacggtatgcgtacat

SEQ ID NO: 110023 - DNA, 25 bp, E. coli
ctcccgcagtgaacggtatgcgtac

SEQ ID NO: 110024 - DNA, 25 bp, E. coli
ctcccgcagtgatcggtatgcgtac

SEQ ID NO: 110025 - DNA, 25 bp, E. coli
cagcctgcgccgtttgttgcggaca

SEQ ID NO: 110026 - DNA, 25 bp, E. coli
cagcctgcgccgattgttgcggaca

SEQ ID NO: 110027 - DNA, 25 bp, E. coli
aactgaagggcggtgaaacgatcct

SEQ ID NO: 110028 - DNA, 25 bp, E. coli
aactgaagggcgctgaaacgatcct

SEQ ID NO: 110029 - DNA, 25 bp, E. coli
tatgtaataccgcttgccgctggcg

SEQ ID NO: 110030 - DNA, 25 bp, E. coli
tatgtaataccggttgccgctggcg

SEQ ID NO: 110031 - DNA, 25 bp, E. coli
ttgttgcggacacccagccggacgt

SEQ ID NO: 110032 - DNA, 25 bp, E. coli
ttgttgcggacagccagccggacgt

SEQ ID NO: 110033 - DNA, 25 bp, E. coli
tgctaacaggataattgaccatgac

SEQ ID NO: 110034 - DNA, 25 bp, E. coli
tgaaacgatcctcgcgaagctggtg

SEQ ID NO: 110035 - DNA, 25 bp, E. coli
tgctaacaggattattgaccatgac

SEQ ID NO: 110036 - DNA, 25 bp, E. coli
tgaaacgatcctggcgaagctggtg

SEQ ID NO: 110037 - DNA, 25 bp, E. coli
ccgtcgcgtcttgggtatgtaatac

SEQ ID NO: 110038 - DNA, 25 bp, E. coli
ccgtcgcgtcttcggtatgtaatac

SEQ ID NO: 110039 - DNA, 25 bp, E. coli
gctggcgcgtttgcgctgatacgtc

SEQ ID NO: 110040 - DNA, 25 bp, E. coli
gctggcgcgtttccgctgatacgtc

SEQ ID NO: 110041 - DNA, 25 bp, E. coli
ggttattgaacaagcccagcctgcg

SEQ ID NO: 110042 - DNA, 25 bp, E. coli
ggttattgaacatgcccagcctgcg

SEQ ID NO: 110043 - DNA, 25 bp, E. coli
tggcgcagctacaggcggaaatcgt

SEQ ID NO: 110044 - DNA, 25 bp, E. coli
tggcgcagctactggcggaaatcgt

SEQ ID NO: 110045 - DNA, 25 bp, E. coli
taattagcgtactgtgtgagaacga

SEQ ID NO: 110046 - DNA, 25 bp, E. coli
taattagcgtacagtgtgagaacga

SEQ ID NO: 110047 - DNA, 25 bp, E. coli
catcactggcgatggctgtcagcaa

SEQ ID NO: 110048 - DNA, 25 bp, E. coli
catcactggcgaaggctgtcagcaa

SEQ ID NO: 110049 - DNA, 25 bp, E. coli
acgagtgaggcaactgaagcggccc

SEQ ID NO: 110050 - DNA, 25 bp, E. coli
actgaaaaaagcctcgtcgcacgag

SEQ ID NO: 110051 - DNA, 25 bp, E. coli
acgagtgaggcatctgaagcggccc

SEQ ID NO: 110052 - DNA, 25 bp, E. coli
actgaaaaaagcgtcgtcgcacgag

SEQ ID NO: 110053 - DNA, 25 bp, E. coli
taccgaactctgcaagctgaagcgt

SEQ ID NO: 110054 - DNA, 25 bp, E. coli
taccgaactctggaagctgaagcgt

SEQ ID NO: 110055 - DNA, 25 bp, E. coli
ttaacgcgattgtacagcatggtcc

SEQ ID NO: 110056 - DNA, 25 bp, E. coli
ttaacgcgattgaacagcatggtcc

SEQ ID NO: 110057 - DNA, 25 bp, E. coli
tgcagcccgtctagaaatcagccgt

SEQ ID NO: 110058 - DNA, 25 bp, E. coli
tgcagcccgtcttgaaatcagccgt

SEQ ID NO: 110059 - DNA, 25 bp, E. coli
tcagaagtgggagcgcttatgcgcc

SEQ ID NO: 110060 - DNA, 25 bp, E. coli
gccgtgacgatgctgttaccgaact

SEQ ID NO: 110061 - DNA, 25 bp, E. coli
gccgcgctgcggcaaattaataagc

SEQ ID NO: 110062 - DNA, 25 bp, E. coli
gccgcgctgcgggaaattaataagc

SEQ ID NO: 110063 - DNA, 25 bp, E. coli
gccgtgacgatggtgttaccgaact

SEQ ID NO: 110064 - DNA, 25 bp, E. coli
gcatggtcctcactcggctgacgaa

SEQ ID NO: 110065 - DNA, 25 bp, E. coli
gcatggtcctcagtcggctgacgaa

SEQ ID NO: 110066 - DNA, 25 bp, E. coli
cgtcgtggcgaacctgataacaagg

SEQ ID NO: 110067 - DNA, 25 bp, E. coli
cgtcgtggcgaagctgataacaagg

SEQ ID NO: 110068 - DNA, 25 bp, E. coli
tcagaagtgggaccgcttatgcgcc

SEQ ID NO: 110069 - DNA, 25 bp, E. coli
catggtttaccccacaggctggcta

SEQ ID NO: 110070 - DNA, 25 bp, E. coli
catggtttacccgacaggctggcta

SEQ ID NO: 110071 - DNA, 25 bp, E. coli
tactcaaagcgcaagggtacgacac

SEQ ID NO: 110072 - DNA, 25 bp, E. coli
tactcaaagcgctagggtacgacac

SEQ ID NO: 110073 - DNA, 25 bp, E. coli
tactcactggctaatacggcgggct

SEQ ID NO: 110074 - DNA, 25 bp, E. coli
tactcactggcttatacggcgggct

SEQ ID NO: 110075 - DNA, 25 bp, E. coli
tatcgacaggctagcccaggaaggg

SEQ ID NO: 110076 - DNA, 25 bp, E. coli
tatcgacaggcttgcccaggaaggg

SEQ ID NO: 110077 - DNA, 25 bp, E. coli
tatatgagcgcgaatcagaagcagc

SEQ ID NO: 110078 - DNA, 25 bp, E. coli
tatatgagcgcgtatcagaagcagc

SEQ ID NO: 110079 - DNA, 25 bp, E. coli
tattttatggcgactgggcagacaa

SEQ ID NO: 110080 - DNA, 25 bp, E. coli
tattttatggcgtctgggcagacaa

SEQ ID NO: 110081 - DNA, 25 bp, E. coli
tttaagttcaccatcacgcgcaggg

SEQ ID NO: 110082 - DNA, 25 bp, E. coli
tttaagttcaccttcacgcgcaggg

SEQ ID NO: 110083 - DNA, 25 bp, E. coli
tccaaccgatgaatgggcgatccgt

SEQ ID NO: 110084 - DNA, 25 bp, E. coli
tgccttagggcgaaacgaactcacg

SEQ ID NO: 110085 - DNA, 25 bp, E. coli
tccaaccgatgattgggcgatccgt

SEQ ID NO: 110086 - DNA, 25 bp, E. coli
tgccttagggcgtaacgaactcacg

SEQ ID NO: 110087 - DNA, 25 bp, E. coli
gaaacggatggattacgcggtcgca

SEQ ID NO: 110088 - DNA, 25 bp, E. coli
gaaacggatggaatacgcggtcgca

SEQ ID NO: 110089 - DNA, 25 bp, E. coli
tggataacgctaaagaacgcccgcg

SEQ ID NO: 110090 - DNA, 25 bp, E. coli
tggataacgctatagaacgcccgcg

SEQ ID NO: 110091 - DNA, 25 bp, E. coli
caaatctcgtgggtttcatctggta

SEQ ID NO: 110092 - DNA, 25 bp, E. coli
caaatctcgtggctttcatctggta

SEQ ID NO: 110093 - DNA, 25 bp, E. coli
cataaagggcgtattcagaccggca

SEQ ID NO: 110094 - DNA, 25 bp, E. coli
cataaagggcgttttcagaccggca

SEQ ID NO: 110095 - DNA, 25 bp, E. coli
aaatcctcaatggtgggaacatcgc

SEQ ID NO: 110096 - DNA, 25 bp, E. coli
aaatcctcaatgctgggaacatcgc

SEQ ID NO: 110097 - DNA, 25 bp, E. coli
tatgagcatgacaatgagggagcag

SEQ ID NO: 110098 - DNA, 25 bp, E. coli
tatgagcatgactatgagggagcag

SEQ ID NO: 110099 - DNA, 25 bp, E. coli
ttaatgagaactgcgatcccaccgt

SEQ ID NO: 110100 - DNA, 25 bp, E. coli
ttaatgagaactccgatcccaccgt

SEQ ID NO: 110101 - DNA, 25 bp, E. coli
tcgcatcatcgccacactacaaggg

SEQ ID NO: 110102 - DNA, 25 bp, E. coli
tcgcatcatcgcgacactacaaggg

SEQ ID NO: 110103 - DNA, 25 bp, E. coli
tcagctggctgaaatgccgcgcgtt

SEQ ID NO: 110104 - DNA, 25 bp, E. coli
tcagctggctgatatgccgcgcgtt

SEQ ID NO: 110105 - DNA, 25 bp, E. coli
gaacatcgcttgtattgccggtgca

SEQ ID NO: 110106 - DNA, 25 bp, E. coli
gaacatcgcttgaattgccggtgca

SEQ ID NO: 110107 - DNA, 25 bp, E. coli
cgtacgccacgacatggagcgtttt

SEQ ID NO: 110108 - DNA, 25 bp, E. coli
cgtacgccacgagatggagcgtttt

SEQ ID NO: 110109 - DNA, 25 bp, E. coli
ggtatcaaaagacgctcacgcttag

SEQ ID NO: 110110 - DNA, 25 bp, E. coli
gggagcagacgatatgccttctcat

SEQ ID NO: 110111 - DNA, 25 bp, E. coli
gggagcagacgaaatgccttctcat

SEQ ID NO: 110112 - DNA, 25 bp, E. coli
ggtatcaaaagaggctcacgcttag

SEQ ID NO: 110113 - DNA, 25 bp, E. coli
cacggcacgccgatcatgcttaaag

SEQ ID NO: 110114 - DNA, 25 bp, E. coli
cactggtggaagcatccaaagagga

SEQ ID NO: 110115 - DNA, 25 bp, E. coli
caaagaggaagtaaaagccacagcc

SEQ ID NO: 110116 - DNA, 25 bp, E. coli
cactggctgacgtcccgattcagga

SEQ ID NO: 110117 - DNA, 25 bp, E. coli
cactggctgacgacccgattcagga

SEQ ID NO: 110118 - DNA, 25 bp, E. coli
cactggtggaaggatccaaagagga

SEQ ID NO: 110119 - DNA, 25 bp, E. coli
cacggcacgccgttcatgcttaaag

SEQ ID NO: 110120 - DNA, 25 bp, E. coli
caaagaggaagttaaagccacagcc

SEQ ID NO: 110121 - DNA, 25 bp, E. coli
taaagctatccgtgaaatcatggcg

SEQ ID NO: 110122 - DNA, 25 bp, E. coli
taaagctatccgagaaatcatggcg

SEQ ID NO: 110123 - DNA, 25 bp, E. coli
ttaacctggcgtcccgtaacgctgg

SEQ ID NO: 110124 - DNA, 25 bp, E. coli
ttaacctggcgtgccgtaacgctgg

SEQ ID NO: 110125 - DNA, 25 bp, E. coli
tgctggtcctggtgggaaagatatc

SEQ ID NO: 110126 - DNA, 25 bp, E. coli
tgctggtcctggagggaaagatatc

SEQ ID NO: 110127 - DNA, 25 bp, E. coli
gctgttgggccaaaaagtgaatcca

SEQ ID NO: 110128 - DNA, 25 bp, E. coli
gctgttgggccataaagtgaatcca

SEQ ID NO: 110129 - DNA, 25 bp, E. coli
gaaagattccacagccgagctgtat

SEQ ID NO: 110130 - DNA, 25 bp, E. coli
gaaagattccactgccgagctgtat

SEQ ID NO: 110131 - DNA, 25 bp, E. coli
ctccgaaggcatggtaatggctgct

SEQ ID NO: 110132 - DNA, 25 bp, E. coli
ctccgaaggcatcgtaatggctgct

SEQ ID NO: 110133 - DNA, 25 bp, E. coli
gtcgcgatgccgatctgcaggcgat

SEQ ID NO: 110134 - DNA, 25 bp, E. coli
gtcgcgatgccgttctgcaggcgat

SEQ ID NO: 110135 - DNA, 25 bp, E. coli
attatggtgccgcatacgccacagg

SEQ ID NO: 110136 - DNA, 25 bp, E. coli
attatggtgccggatacgccacagg

SEQ ID NO: 110137 - DNA, 25 bp, E. coli
aaacaccgcgacgtgccaggaattg

SEQ ID NO: 110138 - DNA, 25 bp, E. coli
aaacaccgcgacctgccaggaattg

SEQ ID NO: 110139 - DNA, 25 bp, E. coli
tacgccacaggtagaagacgttctg

SEQ ID NO: 110140 - DNA, 25 bp, E. coli
tacgccacaggttgaagacgttctg

SEQ ID NO: 110141 - DNA, 25 bp, E. coli
tgcatgtcacaaccattggtccggt

SEQ ID NO: 110142 - DNA, 25 bp, E. coli
tgcatgtcacaagcattggtccggt

SEQ ID NO: 110143 - DNA, 25 bp, E. coli
ccggtcatcaacagcatgtcacaac

SEQ ID NO: 110144 - DNA, 25 bp, E. coli
ccggtcatcaactgcatgtcacaac

SEQ ID NO: 110145 - DNA, 25 bp, E. coli
gcggtttctgaagccttgttgtttg

SEQ ID NO: 110146 - DNA, 25 bp, E. coli
gcggtttctgaacccttgttgtttg

SEQ ID NO: 110147 - DNA, 25 bp, E. coli
gcgccaggtaactgatgcatcggac

SEQ ID NO: 110148 - DNA, 25 bp, E. coli
gcgccaggtaacagatgcatcggac

SEQ ID NO: 110149 - DNA, 25 bp, E. coli
gaagccttgttgtttgcttcaaaag

SEQ ID NO: 110150 - DNA, 25 bp, E. coli
gaagccttgttgattgcttcaaaag

SEQ ID NO: 110151 - DNA, 25 bp, E. coli
gaaactgcgcgcgaggtaacagatg

SEQ ID NO: 110152 - DNA, 25 bp, E. coli
gaaactgcgcgccaggtaacagatg

SEQ ID NO: 110153 - DNA, 25 bp, E. coli
cgcgacctgccacgaattgtttaat

SEQ ID NO: 110154 - DNA, 25 bp, E. coli
cgccgttagtgtagaaactgcgcgc

SEQ ID NO: 110155 - DNA, 25 bp, E. coli
cgcgacctgccaggaattgtttaat

SEQ ID NO: 110156 - DNA, 25 bp, E. coli
cgccgttagtgttgaaactgcgcgc

SEQ ID NO: 110157 - DNA, 25 bp, E. coli
catcagatgattcgccgcaaggaga

SEQ ID NO: 110158 - DNA, 25 bp, E. coli
catcagatgattggccgcaaggaga

SEQ ID NO: 110159 - DNA, 25 bp, E. coli
taaaaagaaatttgatagagcctgt

SEQ ID NO: 110160 - DNA, 25 bp, E. coli
tacgttgttcatacgaatggcttct

SEQ ID NO: 110161 - DNA, 25 bp, E. coli
taaaaagaaattagatagagcctgt

SEQ ID NO: 110162 - DNA, 25 bp, E. coli
aaaaagatcgcctgatacgttgttc

SEQ ID NO: 110163 - DNA, 25 bp, E. coli
aaaaagatcgccagatacgttgttc

SEQ ID NO: 110164 - DNA, 25 bp, E. coli
tacgttgttcattcgaatggcttct

SEQ ID NO: 110165 - DNA, 25 bp, E. coli
tgactagagtttctctaaaaagaaa

SEQ ID NO: 110166 - DNA, 25 bp, E. coli
tgactagagtttgtctaaaaagaaa

SEQ ID NO: 110167 - DNA, 25 bp, E. coli
tcttttcggccatcagatgattggc

SEQ ID NO: 110168 - DNA, 25 bp, E. coli
tcttttcggccaacagatgattggc

SEQ ID NO: 110169 - DNA, 25 bp, E. coli
gccgcaaggagatgaaagttttaat

SEQ ID NO: 110170 - DNA, 25 bp, E. coli
gccgcaaggagaagaaagttttaat

SEQ ID NO: 110171 - DNA, 25 bp, E. coli
gatagagcctgtatcttttcggcca

SEQ ID NO: 110172 - DNA, 25 bp, E. coli
gttcatacgaatcgcttctttatgg

SEQ ID NO: 110173 - DNA, 25 bp, E. coli
gattggccgcaaggagaagaaagtt

SEQ ID NO: 110174 - DNA, 25 bp, E. coli
gttcatacgaatggcttctttatgg

SEQ ID NO: 110175 - DNA, 25 bp, E. coli
gatagagcctgtttcttttcggcca

SEQ ID NO: 110176 - DNA, 25 bp, E. coli
gatcgcctgataggttgttcatacg

SEQ ID NO: 110177 - DNA, 25 bp, E. coli
gattggccgcaacgagaagaaagtt

SEQ ID NO: 110178 - DNA, 25 bp, E. coli
gatcgcctgatacgttgttcatacg

SEQ ID NO: 110179 - DNA, 25 bp, E. coli
cagcactgaaacgtataccggtcgt

SEQ ID NO: 110180 - DNA, 25 bp, E. coli
cagcactgaaacctataccggtcgt

SEQ ID NO: 110181 - DNA, 25 bp, E. coli
agcactgaaacgtataccggtcgtg

SEQ ID NO: 110182 - DNA, 25 bp, E. coli
agcactgaaacgaataccggtcgtg

SEQ ID NO: 110183 - DNA, 25 bp, E. coli
acggcagcactgtaacgtataccgg

SEQ ID NO: 110184 - DNA, 25 bp, E. coli
acggcagcactgaaacgtataccgg

SEQ ID NO: 110185 - DNA, 25 bp, E. coli
gcgtattcaccaacagcatcctgca

SEQ ID NO: 110186 - DNA, 25 bp, E. coli
gcgtattcaccatcagcatcctgca

SEQ ID NO: 110187 - DNA, 25 bp, E. coli
gcagcactgaaaggtataccggtcg

SEQ ID NO: 110188 - DNA, 25 bp, E. coli
gcacggcagcactgaaacgtatacc

SEQ ID NO: 110189 - DNA, 25 bp, E. coli
gcagcactgaaacgtataccggtcg

SEQ ID NO: 110190 - DNA, 25 bp, E. coli
gcacggcagcacagaaacgtatacc

SEQ ID NO: 110191 - DNA, 25 bp, E. coli
cgctggcacggcagcactgaaacgt

SEQ ID NO: 110192 - DNA, 25 bp, E. coli
cgctggcacggctgcactgaaacgt

SEQ ID NO: 110193 - DNA, 25 bp, E. coli
ctggcacggcagcactgaaacgtat

SEQ ID NO: 110194 - DNA, 25 bp, E. coli
ctggcacggcaggactgaaacgtat

SEQ ID NO: 110195 - DNA, 25 bp, E. coli
ggcagcactgaatcgtataccggtc

SEQ ID NO: 110196 - DNA, 25 bp, E. coli
ggcacggcagcactgaaacgtatac

SEQ ID NO: 110197 - DNA, 25 bp, E. coli
ggcacggcagcagtgaaacgtatac

SEQ ID NO: 110198 - DNA, 25 bp, E. coli
tggcacggcagcactgaaacgtata

SEQ ID NO: 110199 - DNA, 25 bp, E. coli
ggcagcactgaaacgtataccggtc

SEQ ID NO: 110200 - DNA, 25 bp, E. coli
tggcacggcagctctgaaacgtata

SEQ ID NO: 110201 - DNA, 25 bp, E. coli
aaagctgcgcagagtggttttcgcg

SEQ ID NO: 110202 - DNA, 25 bp, E. coli
aaagctgcgcagtgtggttttcgcg

SEQ ID NO: 110203 - DNA, 25 bp, E. coli
tacgctggatggttccgtaccgtta

SEQ ID NO: 110204 - DNA, 25 bp, E. coli
tatgccgcgaatatgctgatgaaag

SEQ ID NO: 110205 - DNA, 25 bp, E. coli
tatgccgcgaatttgctgatgaaag

SEQ ID NO: 110206 - DNA, 25 bp, E. coli
tacgctggatggatccgtaccgtta

SEQ ID NO: 110207 - DNA, 25 bp, E. coli
tattcctggtttgcatctcaccgga

SEQ ID NO: 110208 - DNA, 25 bp, E. coli
tattcctggtttccatctcaccgga

SEQ ID NO: 110209 - DNA, 25 bp, E. coli
tattgcctgtattcctggccgtgaa

SEQ ID NO: 110210 - DNA, 25 bp, E. coli
tattgcctgtatacctggccgtgaa

SEQ ID NO: 110211 - DNA, 25 bp, E. coli
tgtagaaaacctgcgttatgccgcg

SEQ ID NO: 110212 - DNA, 25 bp, E. coli
tgtagaaaacctccgttatgccgcg

SEQ ID NO: 110213 - DNA, 25 bp, E. coli
tgcagcggatggaaggtgaattaac

SEQ ID NO: 110214 - DNA, 25 bp, E. coli
tgcagcggatggtaggtgaattaac

SEQ ID NO: 110215 - DNA, 25 bp, E. coli
tctcgcccgttttgagaaagctgcg

SEQ ID NO: 110216 - DNA, 25 bp, E. coli
tctcgcccgtttagagaaagctgcg

SEQ ID NO: 110217 - DNA, 25 bp, E. coli
gaaaattctgactacaacggttggg

SEQ ID NO: 110218 - DNA, 25 bp, E. coli
gaaaattctgacaacaacggttggg

SEQ ID NO: 110219 - DNA, 25 bp, E. coli
ccacggaagccgctttacgctggat

SEQ ID NO: 110220 - DNA, 25 bp, E. coli
ccacggaagccggtttacgctggat

SEQ ID NO: 110221 - DNA, 25 bp, E. coli
gatggcgtagcaccagcgattcgtt

SEQ ID NO: 110222 - DNA, 25 bp, E. coli
gatggcgtagcagcagcgattcgtt

SEQ ID NO: 110223 - DNA, 25 bp, E. coli
caggatggcccgaaagtctcgttta

SEQ ID NO: 110224 - DNA, 25 bp, E. coli
caggatggcccgtaagtctcgttta

SEQ ID NO: 110225 - DNA, 25 bp, E. coli
gaatactcccctgaccgtaaacgtg

SEQ ID NO: 110226 - DNA, 25 bp, E. coli
gaatactcccctcaccgtaaacgtg

SEQ ID NO: 110227 - DNA, 25 bp, E. coli
aaacgtggctttttgggcagctggc

SEQ ID NO: 110228 - DNA, 25 bp, E. coli
aaacgtggctttatgggcagctggc

SEQ ID NO: 110229 - DNA, 25 bp, E. coli
tatggtcgccagaagatcctcgcta

SEQ ID NO: 110230 - DNA, 25 bp, E. coli
tatggtcgccagtagatcctcgcta

SEQ ID NO: 110231 - DNA, 25 bp, E. coli
tggtgcagcaacttccgcgaattga

SEQ ID NO: 110232 - DNA, 25 bp, E. coli
tgaccccagcgtgcagatggttgct

SEQ ID NO: 110233 - DNA, 25 bp, E. coli
tgaccccagcgtccagatggttgct

SEQ ID NO: 110234 - DNA, 25 bp, E. coli
gacacgattggtttttgggcaccga

SEQ ID NO: 110235 - DNA, 25 bp, E. coli
gacacgattggtatttgggcaccga

SEQ ID NO: 110236 - DNA, 25 bp, E. coli
gattaacagtaaggtcatcggcctg

SEQ ID NO: 110237 - DNA, 25 bp, E. coli
gattaacagtaacgtcatcggcctg

SEQ ID NO: 110238 - DNA, 25 bp, E. coli
tggtgcagcaacatccgcgaattga

SEQ ID NO: 110239 - DNA, 25 bp, E. coli
gatgatattgacgacgagattgccg

SEQ ID NO: 110240 - DNA, 25 bp, E. coli
gatggcacaaggattctcggtcggc

SEQ ID NO: 110241 - DNA, 25 bp, E. coli
gacgcatatccgatacagcgcgctg

SEQ ID NO: 110242 - DNA, 25 bp, E. coli
gatgatattgaccacgagattgccg

SEQ ID NO: 110243 - DNA, 25 bp, E. coli
gatggcacaaggtttctcggtcggc

SEQ ID NO: 110244 - DNA, 25 bp, E. coli
gacgcatatccgttacagcgcgctg

SEQ ID NO: 110245 - DNA, 25 bp, E. coli
catggagccgtatccgcacggctgg

SEQ ID NO: 110246 - DNA, 25 bp, E. coli
catggagccgtaaccgcacggctgg

SEQ ID NO: 110247 - DNA, 25 bp, E. coli
taccgattttgtcaccactcaggcg

SEQ ID NO: 110248 - DNA, 25 bp, E. coli
taccgattttgtgaccactcaggcg

SEQ ID NO: 110249 - DNA, 25 bp, E. coli
tattcctaccgaagtgaagccgttt

SEQ ID NO: 110250 - DNA, 25 bp, E. coli
tattcctaccgatgtgaagccgttt

SEQ ID NO: 110251 - DNA, 25 bp, E. coli
ccaccagtgcgtgggaatatggccg

SEQ ID NO: 110252 - DNA, 25 bp, E. coli
ccaccagtgcgtcggaatatggccg

SEQ ID NO: 110253 - DNA, 25 bp, E. coli
cgcattgcagtaatctgactacgat

SEQ ID NO: 110254 - DNA, 25 bp, E. coli
cgctgggccacggtcaatacattga

SEQ ID NO: 110255 - DNA, 25 bp, E. coli
cgcattgcagtattctgactacgat

SEQ ID NO: 110256 - DNA, 25 bp, E. coli
cgctgggccacgctcaatacattga

SEQ ID NO: 110257 - DNA, 25 bp, E. coli
cgaagtgaagccgttttttgtgcgt

SEQ ID NO: 110258 - DNA, 25 bp, E. coli
cgaagtgaagcccttttttgtgcgt

SEQ ID NO: 110259 - DNA, 25 bp, E. coli
gggatccagccggatctgatctaca

SEQ ID NO: 110260 - DNA, 25 bp, E. coli
gggatccagccgcatctgatctaca

SEQ ID NO: 110261 - DNA, 25 bp, E. coli
taagttctacccactgcataccgga

SEQ ID NO: 110262 - DNA, 25 bp, E. coli
taagttctaccctctgcataccgga

SEQ ID NO: 110263 - DNA, 25 bp, E. coli
tcaatacattgattttgcggtgaaa

SEQ ID NO: 110264 - DNA, 25 bp, E. coli
tcaatacattgaatttgcggtgaaa

SEQ ID NO: 110265 - DNA, 25 bp, E. coli
gatgagatcgcaatgcagtattctg

SEQ ID NO: 110266 - DNA, 25 bp, E. coli
gatgagatcgcattgcagtattctg

SEQ ID NO: 110267 - DNA, 25 bp, E. coli
cagagccagttccttccagcagtgt

SEQ ID NO: 110268 - DNA, 25 bp, E. coli
cagagccagttcgttccagcagtgt

SEQ ID NO: 110269 - DNA, 25 bp, E. coli
tacaacgtgattagcgatcctgcgg

SEQ ID NO: 110270 - DNA, 25 bp, E. coli
tacaacgtgatttgcgatcctgcgg

SEQ ID NO: 110271 - DNA, 25 bp, E. coli
aggttatatccttcgcgcaccgaga

SEQ ID NO: 110272 - DNA, 25 bp, E. coli
aggttatatcctacgcgcaccgaga

SEQ ID NO: 110273 - DNA, 25 bp, E. coli
actgacgatgtttacccctggctga

SEQ ID NO: 110274 - DNA, 25 bp, E. coli
actgacgatgttaacccctggctga

SEQ ID NO: 110275 - DNA, 25 bp, E. coli
tatgcctgaacataaacgtgagctg

SEQ ID NO: 110276 - DNA, 25 bp, E. coli
tatgcctgaacaaaaacgtgagctg

SEQ ID NO: 110277 - DNA, 25 bp, E. coli
tattgagccgatgaactgcctggcc

SEQ ID NO: 110278 - DNA, 25 bp, E. coli
tattgagccgatcaactgcctggcc

SEQ ID NO: 110279 - DNA, 25 bp, E. coli
ttttcataaaaggtggccgctggcc

SEQ ID NO: 110280 - DNA, 25 bp, E. coli
ttttcataaaagctggccgctggcc

SEQ ID NO: 110281 - DNA, 25 bp, E. coli
gctctataaccgaggcgatcgccgt

SEQ ID NO: 110282 - DNA, 25 bp, E. coli
gctctataaccgtggcgatcgccgt

SEQ ID NO: 110283 - DNA, 25 bp, E. coli
cgcagtgatatttgttggcccggca

SEQ ID NO: 110284 - DNA, 25 bp, E. coli
cgcagtgatattagttggcccggca

SEQ ID NO: 110285 - DNA, 25 bp, E. coli
gtatgacgctggaggagagttcccc

SEQ ID NO: 110286 - DNA, 25 bp, E. coli
gtatgacgctggtggagagttcccc

SEQ ID NO: 110287 - DNA, 25 bp, E. coli
gttgctcagtatatgcgggtgccca

SEQ ID NO: 110288 - DNA, 25 bp, E. coli
gttgctcagtatttgcgggtgccca

SEQ ID NO: 110289 - DNA, 25 bp, E. coli
acgaagaggcagattgaaggatgaa

SEQ ID NO: 110290 - DNA, 25 bp, E. coli
acgaagaggcagtttgaaggatgaa

SEQ ID NO: 110291 - DNA, 25 bp, E. coli
tatgcatcggcgtatcgacgtatta

SEQ ID NO: 110292 - DNA, 25 bp, E. coli
tatgcatcggcgaatcgacgtatta

SEQ ID NO: 110293 - DNA, 25 bp, E. coli
ttagacgcccataacgatgctctcg

SEQ ID NO: 110294 - DNA, 25 bp, E. coli
ttacgatgctctcgaaacccgcttc

SEQ ID NO: 110295 - DNA, 25 bp, E. coli
ttcgtaatgaaaggcgccgtgtcgc

SEQ ID NO: 110296 - DNA, 25 bp, E. coli
ttagacgcccattacgatgctctcg

SEQ ID NO: 110297 - DNA, 25 bp, E. coli
ttcgtaatgaaacgcgccgtgtcgc

SEQ ID NO: 110298 - DNA, 25 bp, E. coli
ttacgatgctctggaaacccgcttc

SEQ ID NO: 110299 - DNA, 25 bp, E. coli
gcccgggagcaagtgatgactattc

SEQ ID NO: 110300 - DNA, 25 bp, E. coli
gcgaatcgacgttttaaccgacaat

SEQ ID NO: 110301 - DNA, 25 bp, E. coli
gcccgggagcaactgatgactattc

SEQ ID NO: 110302 - DNA, 25 bp, E. coli
gcgaatcgacgtattaaccgacaat

SEQ ID NO: 110303 - DNA, 25 bp, E. coli
gaatttacctgtaatgcccgggagc

SEQ ID NO: 110304 - DNA, 25 bp, E. coli
gaatttacctgttatgcccgggagc

SEQ ID NO: 110305 - DNA, 25 bp, E. coli
ggcagccaacgaagaggcagtttga

SEQ ID NO: 110306 - DNA, 25 bp, E. coli
ggcagccaacgatgaggcagtttga

SEQ ID NO: 110307 - DNA, 25 bp, E. coli
taaccgacaatcagccagaagtccg

SEQ ID NO: 110308 - DNA, 25 bp, E. coli
taaccgacaatctgccagaagtccg

SEQ ID NO: 110309 - DNA, 25 bp, E. coli
gatgactattctaccagactcaccg

SEQ ID NO: 110310 - DNA, 25 bp, E. coli
gatgactattcttccagactcaccg

SEQ ID NO: 110311 - DNA, 25 bp, E. coli
taccaatgcgggtaaaggcgctgcg

SEQ ID NO: 110312 - DNA, 25 bp, E. coli
taccaatgcgggaaaaggcgctgcg

SEQ ID NO: 110313 - DNA, 25 bp, E. coli
tatatgccgtttcaagaggccgccc

SEQ ID NO: 110314 - DNA, 25 bp, E. coli
tatatgccgtttgaagaggccgccc

SEQ ID NO: 110315 - DNA, 25 bp, E. coli
tcacggtttcctgtttggcgacgcc

SEQ ID NO: 110316 - DNA, 25 bp, E. coli
tcacggtttcctctttggcgacgcc

SEQ ID NO: 110317 - DNA, 25 bp, E. coli
ccacgttcacgcatggctgggagaa

SEQ ID NO: 110318 - DNA, 25 bp, E. coli
ccacgttcacgcttggctgggagaa

SEQ ID NO: 110319 - DNA, 25 bp, E. coli
gcattgttagcgtaccgggcgtcta

SEQ ID NO: 110320 - DNA, 25 bp, E. coli
gcattgttagcgaaccgggcgtcta

SEQ ID NO: 110321 - DNA, 25 bp, E. coli
gaaagcattgacatatcacggccca

SEQ ID NO: 110322 - DNA, 25 bp, E. coli
gaaagcattgacttatcacggccca

SEQ ID NO: 110323 - DNA, 25 bp, E. coli
gttttgaagcgaaaggcagcaccac

SEQ ID NO: 110324 - DNA, 25 bp, E. coli
gttttgaagcgataggcagcaccac

SEQ ID NO: 110325 - DNA, 25 bp, E. coli
ggcccacatcaccttcaggtagaaa

SEQ ID NO: 110326 - DNA, 25 bp, E. coli
tggatgcagtaaaagacgccgtcgg

SEQ ID NO: 110327 - DNA, 25 bp, E. coli
ggcccacatcacgttcaggtagaaa

SEQ ID NO: 110328 - DNA, 25 bp, E. coli
tggatgcagtaatagacgccgtcgg

SEQ ID NO: 110329 - DNA, 25 bp, E. coli
taaggtgattctcgtacccggtgca

SEQ ID NO: 110330 - DNA, 25 bp, E. coli
taaggtgattctggtacccggtgca

SEQ ID NO: 110331 - DNA, 25 bp, E. coli
taacctgaaactcgagggcagcagc

SEQ ID NO: 110332 - DNA, 25 bp, E. coli
taacctgaaactggagggcagcagc

SEQ ID NO: 110333 - DNA, 25 bp, E. coli
aatcattcaagttgcatcaaggcgg

SEQ ID NO: 110334 - DNA, 25 bp, E. coli
aatcattcaagtagcatcaaggcgg

SEQ ID NO: 110335 - DNA, 25 bp, E. coli
cacaaactgcatatatctgatagac

SEQ ID NO: 110336 - DNA, 25 bp, E. coli
cacaaactgcatttatctgatagac

SEQ ID NO: 110337 - DNA, 25 bp, E. coli
catcaaggcggcaagtgagcgaatc

SEQ ID NO: 110338 - DNA, 25 bp, E. coli
catcaaggcggctagtgagcgaatc

SEQ ID NO: 110339 - DNA, 25 bp, E. coli
agcttactcaggaaagtgattcggg

SEQ ID NO: 110340 - DNA, 25 bp, E. coli
agcttactcaggtaagtgattcggg

SEQ ID NO: 110341 - DNA, 25 bp, E. coli
atctctgcgcccagacgttcacaaa

SEQ ID NO: 110342 - DNA, 25 bp, E. coli
atctctgcgccctgacgttcacaaa

SEQ ID NO: 110343 - DNA, 25 bp, E. coli
tgaagtgtatattaagaatgtcgcc

SEQ ID NO: 110344 - DNA, 25 bp, E. coli
tgaagtgtatataaagaatgtcgcc

SEQ ID NO: 110345 - DNA, 25 bp, E. coli
tgcgcccggcaatctatacacaaaa

SEQ ID NO: 110346 - DNA, 25 bp, E. coli
tgcgcccggcaaactatacacaaaa

SEQ ID NO: 110347 - DNA, 25 bp, E. coli
tctgtaagccggctaagcgcaatgc

SEQ ID NO: 110348 - DNA, 25 bp, E. coli
tctgatagacgtcaaacaggagtca

SEQ ID NO: 110349 - DNA, 25 bp, E. coli
tctgatagacgtgaaacaggagtca

SEQ ID NO: 110350 - DNA, 25 bp, E. coli
tctgtaagccgggtaagcgcaatgc

SEQ ID NO: 110351 - DNA, 25 bp, E. coli
gaatgtcgccagaaataaacgggca

SEQ ID NO: 110352 - DNA, 25 bp, E. coli
gaatgtcgccagtaataaacgggca

SEQ ID NO: 110353 - DNA, 25 bp, E. coli
gagcgaatcccgttgagcttactca

SEQ ID NO: 110354 - DNA, 25 bp, E. coli
gagcgaatcccgatgagcttactca

SEQ ID NO: 110355 - DNA, 25 bp, E. coli
tacgcttttttcacgcagacgatgc

SEQ ID NO: 110356 - DNA, 25 bp, E. coli
tacgcttttttctcgcagacgatgc

SEQ ID NO: 110357 - DNA, 25 bp, E. coli
tttatcgtctgcatacgcgcggtcg

SEQ ID NO: 110358 - DNA, 25 bp, E. coli
tttatcgtctgcttacgcgcggtcg

SEQ ID NO: 110359 - DNA, 25 bp, E. coli
tgtcggcgctctaccacagaatgga

SEQ ID NO: 110360 - DNA, 25 bp, E. coli
tgtcggcgctcttccacagaatgga

SEQ ID NO: 110361 - DNA, 25 bp, E. coli
tgcaatcggctgatcaaaatcaagg

SEQ ID NO: 110362 - DNA, 25 bp, E. coli
tgcgtgcaatggcttcagactgacc

SEQ ID NO: 110363 - DNA, 25 bp, E. coli
tgcaatcggctgttcaaaatcaagg

SEQ ID NO: 110364 - DNA, 25 bp, E. coli
tgcgtgcaatgggttcagactgacc

SEQ ID NO: 110365 - DNA, 25 bp, E. coli
gccaggcgaacgaaatccagggtat

SEQ ID NO: 110366 - DNA, 25 bp, E. coli
gccaggcgaacgtaatccagggtat

SEQ ID NO: 110367 - DNA, 25 bp, E. coli
gctggcataccatagttacggcgaa

SEQ ID NO: 110368 - DNA, 25 bp, E. coli
gcggtaaccttctggcgctggcata

SEQ ID NO: 110369 - DNA, 25 bp, E. coli
gcggtaaccttcaggcgctggcata

SEQ ID NO: 110370 - DNA, 25 bp, E. coli
gctggcataccaaagttacggcgaa

SEQ ID NO: 110371 - DNA, 25 bp, E. coli
gcaatctgccatgcaccgagatcgg

SEQ ID NO: 110372 - DNA, 25 bp, E. coli
gcaatctgccatccaccgagatcgg

SEQ ID NO: 110373 - DNA, 25 bp, E. coli
ggtcgccagccacttcgtcaaattc

SEQ ID NO: 110374 - DNA, 25 bp, E. coli
ggtcgccagccagttcgtcaaattc

SEQ ID NO: 110375 - DNA, 25 bp, E. coli
ggcgataccaccgacgatagcttta

SEQ ID NO: 110376 - DNA, 25 bp, E. coli
ggcgataccacccacgatagcttta

SEQ ID NO: 110377 - DNA, 25 bp, E. coli
caatggctggcgtctcttgcacggg

SEQ ID NO: 110378 - DNA, 25 bp, E. coli
caatggctggcgactcttgcacggg

SEQ ID NO: 110379 - DNA, 25 bp, E. coli
agccggaatatctgcaatggctggc

SEQ ID NO: 110380 - DNA, 25 bp, E. coli
atctgttcatctcgaacgcggcgcg

SEQ ID NO: 110381 - DNA, 25 bp, E. coli
agccggaatatcagcaatggctggc

SEQ ID NO: 110382 - DNA, 25 bp, E. coli
atctgttcatctggaacgcggcgcg

SEQ ID NO: 110383 - DNA, 25 bp, E. coli
tatctgttcatctggaacgcggcgc

SEQ ID NO: 110384 - DNA, 25 bp, E. coli
tatctgttcatcaggaacgcggcgc

SEQ ID NO: 110385 - DNA, 25 bp, E. coli
ttaaccttgcggatttcgcctgggc

SEQ ID NO: 110386 - DNA, 25 bp, E. coli
ttaaccttgcggttttcgcctgggc

SEQ ID NO: 110387 - DNA, 25 bp, E. coli
gcggcgcggttatccttgcggattt

SEQ ID NO: 110388 - DNA, 25 bp, E. coli
gcggcgcggttaaccttgcggattt

SEQ ID NO: 110389 - DNA, 25 bp, E. coli
gcgcagagcgatgccgatgcgttat

SEQ ID NO: 110390 - DNA, 25 bp, E. coli
gcgcagagcgatcccgatgcgttat

SEQ ID NO: 110391 - DNA, 25 bp, E. coli
cgtaagccggaatatctgcaatggc

SEQ ID NO: 110392 - DNA, 25 bp, E. coli
cgtaagccggaaaatctgcaatggc

SEQ ID NO: 110393 - DNA, 25 bp, E. coli
cgatgccgatgccttatctgttcat

SEQ ID NO: 110394 - DNA, 25 bp, E. coli
cgatgccgatgcgttatctgttcat

SEQ ID NO: 110395 - DNA, 25 bp, E. coli
ctggcgtctcttccacgggcgcaga

SEQ ID NO: 110396 - DNA, 25 bp, E. coli
ctggcgtctcttgcacgggcgcaga

SEQ ID NO: 110397 - DNA, 25 bp, E. coli
gagcgatgccgaagcgttatctgtt

SEQ ID NO: 110398 - DNA, 25 bp, E. coli
gagcgatgccgatgcgttatctgtt

SEQ ID NO: 110399 - DNA, 25 bp, E. coli
cacgtacggcatggctctgcaaggt

SEQ ID NO: 110400 - DNA, 25 bp, E. coli
cacgtacggcatcgctctgcaaggt

SEQ ID NO: 110401 - DNA, 25 bp, E. coli
tatcagtaaagagtcgccagcaggt

SEQ ID NO: 110402 - DNA, 25 bp, E. coli
tatcggcgtgaggtttggcattacc

SEQ ID NO: 110403 - DNA, 25 bp, E. coli
tatcggcgtgagctttggcattacc

SEQ ID NO: 110404 - DNA, 25 bp, E. coli
tatcagtaaagactcgccagcaggt

SEQ ID NO: 110405 - DNA, 25 bp, E. coli
tctgcaaggtgcgagcgaagcatta

SEQ ID NO: 110406 - DNA, 25 bp, E. coli
tctgcaaggtgccagcgaagcatta

SEQ ID NO: 110407 - DNA, 25 bp, E. coli
gccagtaccatgtaagaaccgccgt

SEQ ID NO: 110408 - DNA, 25 bp, E. coli
gccagtaccatgaaagaaccgccgt

SEQ ID NO: 110409 - DNA, 25 bp, E. coli
ccagcaggttactaaggtacggcga

SEQ ID NO: 110410 - DNA, 25 bp, E. coli
ccagcaggttacaaaggtacggcga

SEQ ID NO: 110411 - DNA, 25 bp, E. coli
gaacattgccgcaaacgaggcgtta

SEQ ID NO: 110412 - DNA, 25 bp, E. coli
gaacattgccgctaacgaggcgtta

SEQ ID NO: 110413 - DNA, 25 bp, E. coli
cattgcgatggtccttggcccgatc

SEQ ID NO: 110414 - DNA, 25 bp, E. coli
cattgcgatggtgcttggcccgatc

SEQ ID NO: 110415 - DNA, 25 bp, E. coli
cggcggctgaactctggaaggtcta

SEQ ID NO: 110416 - DNA, 25 bp, E. coli
cggcggctgaacactggaaggtcta

SEQ ID NO: 110417 - DNA, 25 bp, E. coli
gatcatcactcagaaacttgggctg

SEQ ID NO: 110418 - DNA, 25 bp, E. coli
gatgggtgtttagtccaccagccag

SEQ ID NO: 110419 - DNA, 25 bp, E. coli
gatcatcactcacaaacttgggctg

SEQ ID NO: 110420 - DNA, 25 bp, E. coli
gatgggtgtttactccaccagccag

SEQ ID NO: 110421 - DNA, 25 bp, E. coli
aaagctgtacgctaacgtctggcgg

SEQ ID NO: 110422 - DNA, 25 bp, E. coli
aaagctgtacgcaaacgtctggcgg

SEQ ID NO: 110423 - DNA, 25 bp, E. coli
aaaagcgtcacggataagcccagtc

SEQ ID NO: 110424 - DNA, 25 bp, E. coli
aaaagcgtcacgcataagcccagtc

SEQ ID NO: 110425 - DNA, 25 bp, E. coli
tgctgtgctgcataacgattatcgg

SEQ ID NO: 110426 - DNA, 25 bp, E. coli
tccagaatatggatatacgccgggt

SEQ ID NO: 110427 - DNA, 25 bp, E. coli
tccagaatatggttatacgccgggt

SEQ ID NO: 110428 - DNA, 25 bp, E. coli
tgctgtgctgcaaaacgattatcgg

SEQ ID NO: 110429 - DNA, 25 bp, E. coli
tcaggatgcggcctacaaagagtcg

SEQ ID NO: 110430 - DNA, 25 bp, E. coli
tcaggatgcggcgtacaaagagtcg

SEQ ID NO: 110431 - DNA, 25 bp, E. coli
gaattacatctcctatggcgtgcgt

SEQ ID NO: 110432 - DNA, 25 bp, E. coli
gaattacatctcgtatggcgtgcgt

SEQ ID NO: 110433 - DNA, 25 bp, E. coli
gaacgctgaagctcggcaatctgat

SEQ ID NO: 110434 - DNA, 25 bp, E. coli
gaacgctgaagcacggcaatctgat

SEQ ID NO: 110435 - DNA, 25 bp, E. coli
gattgagttagtggtcagcgccgca

SEQ ID NO: 110436 - DNA, 25 bp, E. coli
gattgagttagtcgtcagcgccgca

SEQ ID NO: 110437 - DNA, 25 bp, E. coli
ggtttgctgaagttacggctgcccg

SEQ ID NO: 110438 - DNA, 25 bp, E. coli
ggtttgctgaagatacggctgcccg

SEQ ID NO: 110439 - DNA, 25 bp, E. coli
taatgcactgcgtatggcggcgctg

SEQ ID NO: 110440 - DNA, 25 bp, E. coli
taatgcactgcgaatggcggcgctg

SEQ ID NO: 110441 - DNA, 25 bp, E. coli
gatgcactgtttcccgactacgcga

SEQ ID NO: 110442 - DNA, 25 bp, E. coli
gatgcactgtttgccgactacgcga

SEQ ID NO: 110443 - DNA, 25 bp, E. coli
aattgagcgcggagccgatgccgta

SEQ ID NO: 110444 - DNA, 25 bp, E. coli
aacctggatattaatctgtatgtcc

SEQ ID NO: 110445 - DNA, 25 bp, E. coli
aacctggatatttatctgtatgtcc

SEQ ID NO: 110446 - DNA, 25 bp, E. coli
caatgttgctatggtttttaagtac

SEQ ID NO: 110447 - DNA, 25 bp, E. coli
aattgagcgcggtgccgatgccgta

SEQ ID NO: 110448 - DNA, 25 bp, E. coli
caatgttgctatcgtttttaagtac

SEQ ID NO: 110449 - DNA, 25 bp, E. coli
tacgctaagacgaaaacccagtcaa

SEQ ID NO: 110450 - DNA, 25 bp, E. coli
tacgctaagacgtaaacccagtcaa

SEQ ID NO: 110451 - DNA, 25 bp, E. coli
tatgctggcagatattgagcgcggt

SEQ ID NO: 110452 - DNA, 25 bp, E. coli
tatgctggcagaaattgagcgcggt

SEQ ID NO: 110453 - DNA, 25 bp, E. coli
tatggtttttaactacgctaagacg

SEQ ID NO: 110454 - DNA, 25 bp, E. coli
tatggtttttaagtacgctaagacg

SEQ ID NO: 110455 - DNA, 25 bp, E. coli
tctgtatgtccaaagcaatgttgct

SEQ ID NO: 110456 - DNA, 25 bp, E. coli
tctgtatgtccatagcaatgttgct

SEQ ID NO: 110457 - DNA, 25 bp, E. coli
cctgggtggcgctccgtttattatc

SEQ ID NO: 110458 - DNA, 25 bp, E. coli
cctgggtggcgcaccgtttattatc

SEQ ID NO: 110459 - DNA, 25 bp, E. coli
gctaagacgtaaacccagtcaaaag

SEQ ID NO: 110460 - DNA, 25 bp, E. coli
gctaagacgtaatcccagtcaaaag

SEQ ID NO: 110461 - DNA, 25 bp, E. coli
gatatttatctgtatgtccatagca

SEQ ID NO: 110462 - DNA, 25 bp, E. coli
gatatttatctgaatgtccatagca

SEQ ID NO: 110463 - DNA, 25 bp, E. coli
taagtacgctaacacgtaaacccag

SEQ ID NO: 110464 - DNA, 25 bp, E. coli
taagtacgctaagacgtaaacccag

SEQ ID NO: 110465 - DNA, 25 bp, E. coli
caccggaaagcattggcagtacgca

SEQ ID NO: 110466 - DNA, 25 bp, E. coli
caccggaaagcaatggcagtacgca

SEQ ID NO: 110467 - DNA, 25 bp, E. coli
tacccgttaagtgcacggatgaccg

SEQ ID NO: 110468 - DNA, 25 bp, E. coli
taacaagtttacagacgctagcgca

SEQ ID NO: 110469 - DNA, 25 bp, E. coli
actatgggtacctgcagtgctcaga

SEQ ID NO: 110470 - DNA, 25 bp, E. coli
actatgggtaccagcagtgctcaga

SEQ ID NO: 110471 - DNA, 25 bp, E. coli
tacccgttaagtccacggatgaccg

SEQ ID NO: 110472 - DNA, 25 bp, E. coli
tatggactacagttacaccggaaag

SEQ ID NO: 110473 - DNA, 25 bp, E. coli
tatggactacagatacaccggaaag

SEQ ID NO: 110474 - DNA, 25 bp, E. coli
tttgcttctgcgagtacaacgtccg

SEQ ID NO: 110475 - DNA, 25 bp, E. coli
tttgcttctgcgtgtacaacgtccg

SEQ ID NO: 110476 - DNA, 25 bp, E. coli
tggttctcaatcctcatcggcgggt

SEQ ID NO: 110477 - DNA, 25 bp, E. coli
tgtgctcaaaagttaccagtgcctg

SEQ ID NO: 110478 - DNA, 25 bp, E. coli
tgtgctcaaaagataccagtgcctg

SEQ ID NO: 110479 - DNA, 25 bp, E. coli
tctgaactcggtgcaaaaagcaaag

SEQ ID NO: 110480 - DNA, 25 bp, E. coli
tctgaactcggtccaaaaagcaaag

SEQ ID NO: 110481 - DNA, 25 bp, E. coli
gaacggctgtggtagtatggactac

SEQ ID NO: 110482 - DNA, 25 bp, E. coli
gaacggctgtggaagtatggactac

SEQ ID NO: 110483 - DNA, 25 bp, E. coli
gattgctactgttgccgtgggtgta

SEQ ID NO: 110484 - DNA, 25 bp, E. coli
gattgctactgtagccgtgggtgta

SEQ ID NO: 110485 - DNA, 25 bp, E. coli
tggttctcaatcgtcatcggcgggt

SEQ ID NO: 110486 - DNA, 25 bp, E. coli
taacaagtttactgacgctagcgca

SEQ ID NO: 110487 - DNA, 25 bp, E. coli
tactcaaacctatggcccgatggcg

SEQ ID NO: 110488 - DNA, 25 bp, E. coli
tactcaaacctaaggcccgatggcg

SEQ ID NO: 110489 - DNA, 25 bp, E. coli
ttatggcggcaggtatggtgccacc

SEQ ID NO: 110490 - DNA, 25 bp, E. coli
ttatggcggcagctatggtgccacc

SEQ ID NO: 110491 - DNA, 25 bp, E. coli
tgttcctgagtgaagccaaaggcca

SEQ ID NO: 110492 - DNA, 25 bp, E. coli
tgttcctgagtgtagccaaaggcca

SEQ ID NO: 110493 - DNA, 25 bp, E. coli
tgtttgttctgcagatccctggcgc

SEQ ID NO: 110494 - DNA, 25 bp, E. coli
tgtttgttctgctgatccctggcgc

SEQ ID NO: 110495 - DNA, 25 bp, E. coli
cctttgcgctgatggtgccggtact

SEQ ID NO: 110496 - DNA, 25 bp, E. coli
cctttgcgctgaaggtgccggtact

SEQ ID NO: 110497 - DNA, 25 bp, E. coli
gaagccattgaaaccgaagcgaaaa

SEQ ID NO: 110498 - DNA, 25 bp, E. coli
gaagccattgaatccgaagcgaaaa

SEQ ID NO: 110499 - DNA, 25 bp, E. coli
cgctggcaatgggtctggcaacaat

SEQ ID NO: 110500 - DNA, 25 bp, E. coli
cgctggcaatggctctggcaacaat

SEQ ID NO: 110501 - DNA, 25 bp, E. coli
cggcggcgcgaatagcaaaactgga

SEQ ID NO: 110502 - DNA, 25 bp, E. coli
ctatatggcgaacaccctgctgggc

SEQ ID NO: 110503 - DNA, 25 bp, E. coli
cattcggtgtggctctgctgagtac

SEQ ID NO: 110504 - DNA, 25 bp, E. coli
cattcggtgtgggtctgctgagtac

SEQ ID NO: 110505 - DNA, 25 bp, E. coli
ctatatggcgaagaccctgctgggc

SEQ ID NO: 110506 - DNA, 25 bp, E. coli
cggcggcgcgaaaagcaaaactgga

SEQ ID NO: 110507 - DNA, 25 bp, E. coli
tggcgtagcacagacctttatggcg

SEQ ID NO: 110508 - DNA, 25 bp, E. coli
tggcgtagcacacacctttatggcg

SEQ ID NO: 110509 - DNA, 25 bp, E. coli
caacaagatcctttgcagagactgc

SEQ ID NO: 110510 - DNA, 25 bp, E. coli
caacaagatcctatgcagagactgc

SEQ ID NO: 110511 - DNA, 25 bp, E. coli
acgatatcggtctggtgcataacca

SEQ ID NO: 110512 - DNA, 25 bp, E. coli
taagtggccctgcaaagtacaagaa

SEQ ID NO: 110513 - DNA, 25 bp, E. coli
acgatatcggtcaggtgcataacca

SEQ ID NO: 110514 - DNA, 25 bp, E. coli
taagtggccctggaaagtacaagaa

SEQ ID NO: 110515 - DNA, 25 bp, E. coli
tgaatatttcttaagcgccccagaa

SEQ ID NO: 110516 - DNA, 25 bp, E. coli
tgaatatttctttagcgccccagaa

SEQ ID NO: 110517 - DNA, 25 bp, E. coli
tccctggcaggatgcactatcgatc

SEQ ID NO: 110518 - DNA, 25 bp, E. coli
tccctggcaggaagcactatcgatc

SEQ ID NO: 110519 - DNA, 25 bp, E. coli
tgctggctgggaacacgatcttcat

SEQ ID NO: 110520 - DNA, 25 bp, E. coli
tcgctcataagctggacacccgtaa

SEQ ID NO: 110521 - DNA, 25 bp, E. coli
tcgctcataagcaggacacccgtaa

SEQ ID NO: 110522 - DNA, 25 bp, E. coli
tgctggctgggatcacgatcttcat

SEQ ID NO: 110523 - DNA, 25 bp, E. coli
tcattaagaagcagccggatagcac

SEQ ID NO: 110524 - DNA, 25 bp, E. coli
tcattaagaagctgccggatagcac

SEQ ID NO: 110525 - DNA, 25 bp, E. coli
gcaagggcctatggttttgaactgg

SEQ ID NO: 110526 - DNA, 25 bp, E. coli
gcaagggcctatcgttttgaactgg

SEQ ID NO: 110527 - DNA, 25 bp, E. coli
cgtattgttcagtcaggtcagagct

SEQ ID NO: 110528 - DNA, 25 bp, E. coli
cgtattgttcagacaggtcagagct

SEQ ID NO: 110529 - DNA, 25 bp, E. coli
taatgatacagactcgttttcggcg

SEQ ID NO: 110530 - DNA, 25 bp, E. coli
taatgatacagagtcgttttcggcg

SEQ ID NO: 110531 - DNA, 25 bp, E. coli
caatggctgggaacgtccaatctgc

SEQ ID NO: 110532 - DNA, 25 bp, E. coli
caatggctgggatcgtccaatctgc

SEQ ID NO: 110533 - DNA, 25 bp, E. coli
tactctgcgcgcacaattaaacaac

SEQ ID NO: 110534 - DNA, 25 bp, E. coli
tactctgcgcgctcaattaaacaac

SEQ ID NO: 110535 - DNA, 25 bp, E. coli
tcgcattggcgaaacggtgacaatt

SEQ ID NO: 110536 - DNA, 25 bp, E. coli
tcgcattggcgatacggtgacaatt

SEQ ID NO: 110537 - DNA, 25 bp, E. coli
gccgaaagatatggtcgcgcaattc

SEQ ID NO: 110538 - DNA, 25 bp, E. coli
gccgaaagatatcgtcgcgcaattc

SEQ ID NO: 110539 - DNA, 25 bp, E. coli
gactctgcacgtcttaaggcgctcg

SEQ ID NO: 110540 - DNA, 25 bp, E. coli
gactctgcacgtgttaaggcgctcg

SEQ ID NO: 110541 - DNA, 25 bp, E. coli
gattctggctggcttccatgcccac

SEQ ID NO: 110542 - DNA, 25 bp, E. coli
gattctggctgggttccatgcccac

SEQ ID NO: 110543 - DNA, 25 bp, E. coli
gataattatccgaaactctccgcta

SEQ ID NO: 110544 - DNA, 25 bp, E. coli
gataattatccgtaactctccgcta

SEQ ID NO: 110545 - DNA, 25 bp, E. coli
gatgcgtatttgcaggccttgcgta

SEQ ID NO: 110546 - DNA, 25 bp, E. coli
gagatccaccagctgattctggctg

SEQ ID NO: 110547 - DNA, 25 bp, E. coli
gacgcccgccgtgagttaaatgaga

SEQ ID NO: 110548 - DNA, 25 bp, E. coli
gagaacgctgacgtctgcgggcaaa

SEQ ID NO: 110549 - DNA, 25 bp, E. coli
gagatccaccaggtgattctggctg

SEQ ID NO: 110550 - DNA, 25 bp, E. coli
gacgcccgccgtcagttaaatgaga

SEQ ID NO: 110551 - DNA, 25 bp, E. coli
gagaacgctgacctctgcgggcaaa

SEQ ID NO: 110552 - DNA, 25 bp, E. coli
gatgcgtatttggaggccttgcgta

SEQ ID NO: 110553 - DNA, 25 bp, E. coli
cacaattggcgcaggcatgctggca

SEQ ID NO: 110554 - DNA, 25 bp, E. coli
cacaattggcgctggcatgctggca

SEQ ID NO: 110555 - DNA, 25 bp, E. coli
tacacggcgctattactgctggagg

SEQ ID NO: 110556 - DNA, 25 bp, E. coli
tacacggcgctaatactgctggagg

SEQ ID NO: 110557 - DNA, 25 bp, E. coli
tatccacgaggatttgtgatggcgc

SEQ ID NO: 110558 - DNA, 25 bp, E. coli
tatcccttcgctcttgacctggcaa

SEQ ID NO: 110559 - DNA, 25 bp, E. coli
tatcccttcgctgttgacctggcaa

SEQ ID NO: 110560 - DNA, 25 bp, E. coli
tatcgtggcgggaaccacaattggc

SEQ ID NO: 110561 - DNA, 25 bp, E. coli
tatccacgaggaattgtgatggcgc

SEQ ID NO: 110562 - DNA, 25 bp, E. coli
tatcgtggcgggtaccacaattggc

SEQ ID NO: 110563 - DNA, 25 bp, E. coli
tgactgcggcattcatcagcggtgc

SEQ ID NO: 110564 - DNA, 25 bp, E. coli
tgactgcggcatacatcagcggtgc

SEQ ID NO: 110565 - DNA, 25 bp, E. coli
tcttaatgtatggtctgactgcggc

SEQ ID NO: 110566 - DNA, 25 bp, E. coli
tcttaatgtatgctctgactgcggc

SEQ ID NO: 110567 - DNA, 25 bp, E. coli
tctccgcatgttgagctggcagtgc

SEQ ID NO: 110568 - DNA, 25 bp, E. coli
tctccgcatgttcagctggcagtgc

SEQ ID NO: 110569 - DNA, 25 bp, E. coli
gcaaaacgctatgtgggacgctacg

SEQ ID NO: 110570 - DNA, 25 bp, E. coli
gcaaaacgctatctgggacgctacg

SEQ ID NO: 110571 - DNA, 25 bp, E. coli
cgttacgcgaaaaggtggcctctcc

SEQ ID NO: 110572 - DNA, 25 bp, E. coli
cgttacgcgaaatggtggcctctcc

SEQ ID NO: 110573 - DNA, 25 bp, E. coli
gatggcaacattcgtaagctacgct

SEQ ID NO: 110574 - DNA, 25 bp, E. coli
gatggcaacattggtaagctacgct

SEQ ID NO: 110575 - DNA, 25 bp, E. coli
aattaaggcggtccaggacctgaaa

SEQ ID NO: 110576 - DNA, 25 bp, E. coli
aattaaggcggtgcaggacctgaaa

SEQ ID NO: 110577 - DNA, 25 bp, E. coli
caccagaaaattaaggcggtgcagg

SEQ ID NO: 110578 - DNA, 25 bp, E. coli
caccagaaaatttaggcggtgcagg

SEQ ID NO: 110579 - DNA, 25 bp, E. coli
attaaggcggtgcaggacctgaaat

SEQ ID NO: 110580 - DNA, 25 bp, E. coli
accagaaaattatggcggtgcagga

SEQ ID NO: 110581 - DNA, 25 bp, E. coli
attaaggcggtggaggacctgaaat

SEQ ID NO: 110582 - DNA, 25 bp, E. coli
accagaaaattaaggcggtgcagga

SEQ ID NO: 110583 - DNA, 25 bp, E. coli
aaaattaaggcggtgcaggacctga

SEQ ID NO: 110584 - DNA, 25 bp, E. coli
aaattaaggcggtgcaggacctgaa

SEQ ID NO: 110585 - DNA, 25 bp, E. coli
aaattaaggcggagcaggacctgaa

SEQ ID NO: 110586 - DNA, 25 bp, E. coli
aaaattaaggcgctgcaggacctga

SEQ ID NO: 110587 - DNA, 25 bp, E. coli
ttaaggcggtgctggacctgaaatg

SEQ ID NO: 110588 - DNA, 25 bp, E. coli
ttaaggcggtgcaggacctgaaatg

SEQ ID NO: 110589 - DNA, 25 bp, E. coli
ccagaaaattaacgcggtgcaggac

SEQ ID NO: 110590 - DNA, 25 bp, E. coli
ccagaaaattaaggcggtgcaggac

SEQ ID NO: 110591 - DNA, 25 bp, E. coli
gcaccagaaaattaaggcggtgcag

SEQ ID NO: 110592 - DNA, 25 bp, E. coli
gcaccagaaaataaaggcggtgcag

SEQ ID NO: 110593 - DNA, 25 bp, E. coli
cggtgcaggacctgaaatgggccaa

SEQ ID NO: 110594 - DNA, 25 bp, E. coli
cggtgcaggaccagaaatgggccaa

SEQ ID NO: 110595 - DNA, 25 bp, E. coli
ggtgcaggacctgaaatgggccaat

SEQ ID NO: 110596 - DNA, 25 bp, E. coli
ggtgcaggacctcaaatgggccaat

SEQ ID NO: 110597 - DNA, 25 bp, E. coli
caaccctggcgatgtgtatactaaa

SEQ ID NO: 110598 - DNA, 25 bp, E. coli
caaccctggcgaagtgtatactaaa

SEQ ID NO: 110599 - DNA, 25 bp, E. coli
caaatccgaatccaggtagcacggc

SEQ ID NO: 110600 - DNA, 25 bp, E. coli
caaatccgaatcgaggtagcacggc

SEQ ID NO: 110601 - DNA, 25 bp, E. coli
taaagcgtcttaggttcgtgccgtc

SEQ ID NO: 110602 - DNA, 25 bp, E. coli
taaagccctggatgcaacgacaaaa

SEQ ID NO: 110603 - DNA, 25 bp, E. coli
tagcacggctaatatgaccttcggt

SEQ ID NO: 110604 - DNA, 25 bp, E. coli
taaagccctggaagcaacgacaaaa

SEQ ID NO: 110605 - DNA, 25 bp, E. coli
tactgcttctgcagatatggacggc

SEQ ID NO: 110606 - DNA, 25 bp, E. coli
tactgcttctgctgatatggacggc

SEQ ID NO: 110607 - DNA, 25 bp, E. coli
taaagcgtcttacgttcgtgccgtc

SEQ ID NO: 110608 - DNA, 25 bp, E. coli
tagcacggctaaaatgaccttcggt

SEQ ID NO: 110609 - DNA, 25 bp, E. coli
tattaacaacccttctgacggcgtt

SEQ ID NO: 110610 - DNA, 25 bp, E. coli
tattaacaacccatctgacggcgtt

SEQ ID NO: 110611 - DNA, 25 bp, E. coli
tgctgcaaaccggaaccgttggtga

SEQ ID NO: 110612 - DNA, 25 bp, E. coli
tgctgcaaaccgcaaccgttggtga

SEQ ID NO: 110613 - DNA, 25 bp, E. coli
tcgatgctggcgaactgaatgacac

SEQ ID NO: 110614 - DNA, 25 bp, E. coli
tcgatgctggcgtactgaatgacac

SEQ ID NO: 110615 - DNA, 25 bp, E. coli
gaatgacaccgttggcgctaaagct

SEQ ID NO: 110616 - DNA, 25 bp, E. coli
gaatgacaccgtaggcgctaaagct

SEQ ID NO: 110617 - DNA, 25 bp, E. coli
gataacacctgtgaaacccgcgttg

SEQ ID NO: 110618 - DNA, 25 bp, E. coli
gataacacctgtcaaacccgcgttg

SEQ ID NO: 110619 - DNA, 25 bp, E. coli
aatccggcgattacacgttggtcaa

SEQ ID NO: 110620 - DNA, 25 bp, E. coli
aatccggcgatttcacgttggtcaa

SEQ ID NO: 110621 - DNA, 25 bp, E. coli
cacgtcagcgtggaagataaagcta

SEQ ID NO: 110622 - DNA, 25 bp, E. coli
cacgtcagcgtgcaagataaagcta

SEQ ID NO: 110623 - DNA, 25 bp, E. coli
cctgcaaacggcacttaatgcggtg

SEQ ID NO: 110624 - DNA, 25 bp, E. coli
cctgcaaacggctcttaatgcggtg

SEQ ID NO: 110625 - DNA, 25 bp, E. coli
caggaaacgctccaccgctttgatt

SEQ ID NO: 110626 - DNA, 25 bp, E. coli
caggaaacgctcgaccgctttgatt

SEQ ID NO: 110627 - DNA, 25 bp, E. coli
tttccggcggcgagaaaaagcgcaa

SEQ ID NO: 110628 - DNA, 25 bp, E. coli
tttccggcggcgtgaaaaagcgcaa

SEQ ID NO: 110629 - DNA, 25 bp, E. coli
aaagtaccttatcggcaacgcttgc

SEQ ID NO: 110630 - DNA, 25 bp, E. coli
aaagtaccttatgggcaacgcttgc

SEQ ID NO: 110631 - DNA, 25 bp, E. coli
tttatggccttccagtatccggtgg

SEQ ID NO: 110632 - DNA, 25 bp, E. coli
tttatggccttcgagtatccggtgg

SEQ ID NO: 110633 - DNA, 25 bp, E. coli
tcagggacgaattgtgaaatccggc

SEQ ID NO: 110634 - DNA, 25 bp, E. coli
tcagggacgaatagtgaaatccggc

SEQ ID NO: 110635 - DNA, 25 bp, E. coli
gcttgccgggcgagaagattatgaa

SEQ ID NO: 110636 - DNA, 25 bp, E. coli
gcttgccgggcgtgaagattatgaa

SEQ ID NO: 110637 - DNA, 25 bp, E. coli
gaaaatcgctctcctgaagatgccg

SEQ ID NO: 110638 - DNA, 25 bp, E. coli
gaaaatcgctctgctgaagatgccg

SEQ ID NO: 110639 - DNA, 25 bp, E. coli
cgttggtcaaacaactggaggagca

SEQ ID NO: 110640 - DNA, 25 bp, E. coli
cgttggtcaaactactggaggagca

SEQ ID NO: 110641 - DNA, 25 bp, E. coli
taaaggtcagggacacaattttgcc

SEQ ID NO: 110642 - DNA, 25 bp, E. coli
tgtcaccggacagatggcagggtct

SEQ ID NO: 110643 - DNA, 25 bp, E. coli
tgtcaccggacacatggcagggtct

SEQ ID NO: 110644 - DNA, 25 bp, E. coli
tgacaaacgactgtgtcggcgaacg

SEQ ID NO: 110645 - DNA, 25 bp, E. coli
tgacaaacgactctgtcggcgaacg

SEQ ID NO: 110646 - DNA, 25 bp, E. coli
tccgggcggataccagaaatccctg

SEQ ID NO: 110647 - DNA, 25 bp, E. coli
tgcggcaaacagtaaaagagcgcct

SEQ ID NO: 110648 - DNA, 25 bp, E. coli
tgcggcaaacagaaaaagagcgcct

SEQ ID NO: 110649 - DNA, 25 bp, E. coli
tccgggcggatagcagaaatccctg

SEQ ID NO: 110650 - DNA, 25 bp, E. coli
gccatcggtgtccagcagtgcaatg

SEQ ID NO: 110651 - DNA, 25 bp, E. coli
gccatcggtgtcgagcagtgcaatg

SEQ ID NO: 110652 - DNA, 25 bp, E. coli
gacgcccgggttatgaagacgacat

SEQ ID NO: 110653 - DNA, 25 bp, E. coli
gcatggcagttttccagcctgatga

SEQ ID NO: 110654 - DNA, 25 bp, E. coli
gacgcccgggttttgaagacgacat

SEQ ID NO: 110655 - DNA, 25 bp, E. coli
gcatggcagtttaccagcctgatga

SEQ ID NO: 110656 - DNA, 25 bp, E. coli
cggttaccttcacatggcccgggag

SEQ ID NO: 110657 - DNA, 25 bp, E. coli
cggttaccttcagatggcccgggag

SEQ ID NO: 110658 - DNA, 25 bp, E. coli
gattacccctgattgccacatctga

SEQ ID NO: 110659 - DNA, 25 bp, E. coli
gattacccctgaatgccacatctga

SEQ ID NO: 110660 - DNA, 25 bp, E. coli
taaaggtcagggtcacaattttgcc

SEQ ID NO: 110661 - DNA, 25 bp, E. coli
gaggctattgccagtccggcagaca

SEQ ID NO: 110662 - DNA, 25 bp, E. coli
gaggctattgcctgtccggcagaca

SEQ ID NO: 110663 - DNA, 25 bp, E. coli
caaggagcagttgccggtactcaaa

SEQ ID NO: 110664 - DNA, 25 bp, E. coli
caaggagcagttcccggtactcaaa

SEQ ID NO: 110665 - DNA, 25 bp, E. coli
tacagattggcgtccggaagatcct

SEQ ID NO: 110666 - DNA, 25 bp, E. coli
tacagattggcgaccggaagatcct

SEQ ID NO: 110667 - DNA, 25 bp, E. coli
agctcgctggcaataacgggttcgc

SEQ ID NO: 110668 - DNA, 25 bp, E. coli
agctcgctggcattaacgggttcgc

SEQ ID NO: 110669 - DNA, 25 bp, E. coli
tatcttcggtggtcgtcgctggacg

SEQ ID NO: 110670 - DNA, 25 bp, E. coli
tatctgaccgtctgggcggaactcg

SEQ ID NO: 110671 - DNA, 25 bp, E. coli
tttccgaaacagaagcagggtggcg

SEQ ID NO: 110672 - DNA, 25 bp, E. coli
tatcttcggtggacgtcgctggacg

SEQ ID NO: 110673 - DNA, 25 bp, E. coli
tttccgaaacagtagcagggtggcg

SEQ ID NO: 110674 - DNA, 25 bp, E. coli
tatctgaccgtcagggcggaactcg

SEQ ID NO: 110675 - DNA, 25 bp, E. coli
tgttcctgaccttaccgactgacgg

SEQ ID NO: 110676 - DNA, 25 bp, E. coli
tgttcctgacctaaccgactgacgg

SEQ ID NO: 110677 - DNA, 25 bp, E. coli
gcagtatttggttgccagggcgtca

SEQ ID NO: 110678 - DNA, 25 bp, E. coli
gcagtatttggtagccagggcgtca

SEQ ID NO: 110679 - DNA, 25 bp, E. coli
cgtaaactgacaatggatcgcgtga

SEQ ID NO: 110680 - DNA, 25 bp, E. coli
cgtaaactgacattggatcgcgtga

SEQ ID NO: 110681 - DNA, 25 bp, E. coli
tcaaaaacgcagatcccggatgttc

SEQ ID NO: 110682 - DNA, 25 bp, E. coli
tcaaacagccggttgggactgagct

SEQ ID NO: 110683 - DNA, 25 bp, E. coli
tcaaacagccggatgggactgagct

SEQ ID NO: 110684 - DNA, 25 bp, E. coli
tcaaaaacgcagttcccggatgttc

SEQ ID NO: 110685 - DNA, 25 bp, E. coli
taaagcaccgctgactcttcaacag

SEQ ID NO: 110686 - DNA, 25 bp, E. coli
taaagcaccgctcactcttcaacag

SEQ ID NO: 110687 - DNA, 25 bp, E. coli
aacagaccgattagcaccccagcaa

SEQ ID NO: 110688 - DNA, 25 bp, E. coli
aacagaccgatttgcaccccagcaa

SEQ ID NO: 110689 - DNA, 25 bp, E. coli
taccttccttgcaacagagttcgac

SEQ ID NO: 110690 - DNA, 25 bp, E. coli
taccttccttgctacagagttcgac

SEQ ID NO: 110691 - DNA, 25 bp, E. coli
tattgttaccttccttgctacagag

SEQ ID NO: 110692 - DNA, 25 bp, E. coli
tattgttaccttgcttgctacagag

SEQ ID NO: 110693 - DNA, 25 bp, E. coli
ttgcaggataaagcaccgctcactc

SEQ ID NO: 110694 - DNA, 25 bp, E. coli
ttgcaggataaaccaccgctcactc

SEQ ID NO: 110695 - DNA, 25 bp, E. coli
tgcaccccagcatatgtagcgttat

SEQ ID NO: 110696 - DNA, 25 bp, E. coli
tgcaccccagcaaatgtagcgttat

SEQ ID NO: 110697 - DNA, 25 bp, E. coli
gctacagagttccacagatatcccg

SEQ ID NO: 110698 - DNA, 25 bp, E. coli
gctcactcttcatcagaccgatttg

SEQ ID NO: 110699 - DNA, 25 bp, E. coli
gctcactcttcaacagaccgatttg

SEQ ID NO: 110700 - DNA, 25 bp, E. coli
gctacagagttcgacagatatcccg

SEQ ID NO: 110701 - DNA, 25 bp, E. coli
ccagcaaatgtaccgttattgttac

SEQ ID NO: 110702 - DNA, 25 bp, E. coli
ccagcaaatgtagcgttattgttac

SEQ ID NO: 110703 - DNA, 25 bp, E. coli
gatatcccgctatgacattctccct

SEQ ID NO: 110704 - DNA, 25 bp, E. coli
gatatcccgctaagacattctccct

SEQ ID NO: 110705 - DNA, 25 bp, E. coli
gagttcgacagaaatcccgctatga

SEQ ID NO: 110706 - DNA, 25 bp, E. coli
gagttcgacagatatcccgctatga

SEQ ID NO: 110707 - DNA, 25 bp, E. coli
catacccatgcgttgattggtgaga

SEQ ID NO: 110708 - DNA, 25 bp, E. coli
caggcgaaaaaacagctgattgctg

SEQ ID NO: 110709 - DNA, 25 bp, E. coli
caggcgaaaaaagagctgattgctg

SEQ ID NO: 110710 - DNA, 25 bp, E. coli
catgacaatcaagggtgaacaggcg

SEQ ID NO: 110711 - DNA, 25 bp, E. coli
catgacaatcaacggtgaacaggcg

SEQ ID NO: 110712 - DNA, 25 bp, E. coli
catacccatgcgatgattggtgaga

SEQ ID NO: 110713 - DNA, 25 bp, E. coli
caggccgggcagaatatcgctgcca

SEQ ID NO: 110714 - DNA, 25 bp, E. coli
caggccgggcagtatatcgctgcca

SEQ ID NO: 110715 - DNA, 25 bp, E. coli
ttttattggcgaccagttccgtccg

SEQ ID NO: 110716 - DNA, 25 bp, E. coli
ttttattggcgagcagttccgtccg

SEQ ID NO: 110717 - DNA, 25 bp, E. coli
tgcgcccagtggtttgccgatttta

SEQ ID NO: 110718 - DNA, 25 bp, E. coli
tgcgcccagtggattgccgatttta

SEQ ID NO: 110719 - DNA, 25 bp, E. coli
gctggaccgcgtacgatgaagaaaa

SEQ ID NO: 110720 - DNA, 25 bp, E. coli
gctggaccgcgttcgatgaagaaaa

SEQ ID NO: 110721 - DNA, 25 bp, E. coli
gactgtgcgatgtataatcctgcca

SEQ ID NO: 110722 - DNA, 25 bp, E. coli
gactgtgcgatgaataatcctgcca

SEQ ID NO: 110723 - DNA, 25 bp, E. coli
gattaagctgctcacccaggatgac

SEQ ID NO: 110724 - DNA, 25 bp, E. coli
gattaagctgctgacccaggatgac

SEQ ID NO: 110725 - DNA, 25 bp, E. coli
gtgaatatggaatgaacgccaccac

SEQ ID NO: 110726 - DNA, 25 bp, E. coli
gtgaatatggaaagaacgccaccac

SEQ ID NO: 110727 - DNA, 25 bp, E. coli
gacctgattttggaaggattatcgc

SEQ ID NO: 110728 - DNA, 25 bp, E. coli
gacctgattttgcaaggattatcgc

SEQ ID NO: 110729 - DNA, 25 bp, E. coli
caccggctatgaaaaacgagacttt

SEQ ID NO: 110730 - DNA, 25 bp, E. coli
caccggctatgataaacgagacttt

SEQ ID NO: 110731 - DNA, 25 bp, E. coli
tacaccggctatgaaaaacgagact

SEQ ID NO: 110732 - DNA, 25 bp, E. coli
tacaccggctatcaaaaacgagact

SEQ ID NO: 110733 - DNA, 25 bp, E. coli
ttgtacaccggctatgaaaaacgag

SEQ ID NO: 110734 - DNA, 25 bp, E. coli
ttgtacaccggcaatgaaaaacgag

SEQ ID NO: 110735 - DNA, 25 bp, E. coli
tcatcttcgctatggcccgtaccgt

SEQ ID NO: 110736 - DNA, 25 bp, E. coli
tcatcttcgctaaggcccgtaccgt

SEQ ID NO: 110737 - DNA, 25 bp, E. coli
gccagttgtacagcggctatgaaaa

SEQ ID NO: 110738 - DNA, 25 bp, E. coli
gccagttgtacaccggctatgaaaa

SEQ ID NO: 110739 - DNA, 25 bp, E. coli
gaaaaacgagactttaaatcagatg

SEQ ID NO: 110740 - DNA, 25 bp, E. coli
gaaaaacgagacattaaatcagatg

SEQ ID NO: 110741 - DNA, 25 bp, E. coli
cgcgccagttgtacaccggctatga

SEQ ID NO: 110742 - DNA, 25 bp, E. coli
cgcgccagttgttcaccggctatga

SEQ ID NO: 110743 - DNA, 25 bp, E. coli
cggcatgaagatcgcccgtccgcgc

SEQ ID NO: 110744 - DNA, 25 bp, E. coli
cggcatgaagatggcccgtccgcgc

SEQ ID NO: 110745 - DNA, 25 bp, E. coli
cgagactttaaatcagatgttaaac

SEQ ID NO: 110746 - DNA, 25 bp, E. coli
cgagactttaaaacagatgttaaac

SEQ ID NO: 110747 - DNA, 25 bp, E. coli
gtcatcttcgctatggcccgtaccg

SEQ ID NO: 110748 - DNA, 25 bp, E. coli
gtccgcgccagtagtacaccggcta

SEQ ID NO: 110749 - DNA, 25 bp, E. coli
gtcatcttcgctttggcccgtaccg

SEQ ID NO: 110750 - DNA, 25 bp, E. coli
gtccgcgccagttgtacaccggcta

SEQ ID NO: 110751 - DNA, 25 bp, E. coli
caatggaaaagggaaaaccaccgcg

SEQ ID NO: 110752 - DNA, 25 bp, E. coli
caacgggctttacctgggatacaca

SEQ ID NO: 110753 - DNA, 25 bp, E. coli
caacgggctttagctgggatacaca

SEQ ID NO: 110754 - DNA, 25 bp, E. coli
caatggaaaaggcaaaaccaccgcg

SEQ ID NO: 110755 - DNA, 25 bp, E. coli
cacgcgcagttggtcacggaaaaaa

SEQ ID NO: 110756 - DNA, 25 bp, E. coli
caccgcggcattaggtacggcaaca

SEQ ID NO: 110757 - DNA, 25 bp, E. coli
cacgcgcagttgctcacggaaaaaa

SEQ ID NO: 110758 - DNA, 25 bp, E. coli
caccgcggcatttggtacggcaaca

SEQ ID NO: 110759 - DNA, 25 bp, E. coli
caggcccaggatcaacgcggtatta

SEQ ID NO: 110760 - DNA, 25 bp, E. coli
caggcccaggatgaacgcggtatta

SEQ ID NO: 110761 - DNA, 25 bp, E. coli
atgagtgatgaaggctaccaacagc

SEQ ID NO: 110762 - DNA, 25 bp, E. coli
atgagtgatgaacgctaccaacagc

SEQ ID NO: 110763 - DNA, 25 bp, E. coli
tatcatcgtctttaccggcaatgga

SEQ ID NO: 110764 - DNA, 25 bp, E. coli
tatcatcgtcttaaccggcaatgga

SEQ ID NO: 110765 - DNA, 25 bp, E. coli
tgcagtttattaaaggcacctggcc

SEQ ID NO: 110766 - DNA, 25 bp, E. coli
tgcagtttattataggcacctggcc

SEQ ID NO: 110767 - DNA, 25 bp, E. coli
tctggcaacatggaaagcggatgct

SEQ ID NO: 110768 - DNA, 25 bp, E. coli
tctggcaacatgcaaagcggatgct

SEQ ID NO: 110769 - DNA, 25 bp, E. coli
gcgtcagcagcgagtgaaagaaaaa

SEQ ID NO: 110770 - DNA, 25 bp, E. coli
gcgtcagcagcgtgtgaaagaaaaa

SEQ ID NO: 110771 - DNA, 25 bp, E. coli
cgtatgactatttgccactggaaga

SEQ ID NO: 110772 - DNA, 25 bp, E. coli
cgtatgactattagccactggaaga

SEQ ID NO: 110773 - DNA, 25 bp, E. coli
atatgagtgacctgctgaccggacg

SEQ ID NO: 110774 - DNA, 25 bp, E. coli
agtgacctgctgtccggacgcacgg

SEQ ID NO: 110775 - DNA, 25 bp, E. coli
agtgacctgctgaccggacgcacgg

SEQ ID NO: 110776 - DNA, 25 bp, E. coli
agcgtcttctatcgcgtctggtcag

SEQ ID NO: 110777 - DNA, 25 bp, E. coli
agcgtcttctatggcgtctggtcag

SEQ ID NO: 110778 - DNA, 25 bp, E. coli
atatgagtgaccagctgaccggacg

SEQ ID NO: 110779 - DNA, 25 bp, E. coli
aaaccttcctggtgaccattggcga

SEQ ID NO: 110780 - DNA, 25 bp, E. coli
aaaccttcctggagaccattggcga

SEQ ID NO: 110781 - DNA, 25 bp, E. coli
tgcatatgagtgtcctgctgaccgg

SEQ ID NO: 110782 - DNA, 25 bp, E. coli
tgcatatgagtgacctgctgaccgg

SEQ ID NO: 110783 - DNA, 25 bp, E. coli
tctgccgactgtcgcggaaaaaacc

SEQ ID NO: 110784 - DNA, 25 bp, E. coli
tctgccgactgtggcggaaaaaacc

SEQ ID NO: 110785 - DNA, 25 bp, E. coli
gaaaaaaccttcctggtgaccattg

SEQ ID NO: 110786 - DNA, 25 bp, E. coli
gaaaaaaccttcgtggtgaccattg

SEQ ID NO: 110787 - DNA, 25 bp, E. coli
gactgtggcggaaaaaaccttcctg

SEQ ID NO: 110788 - DNA, 25 bp, E. coli
cttcctggtgaccattggcgaccgc

SEQ ID NO: 110789 - DNA, 25 bp, E. coli
cttcctggtgacgattggcgaccgc

SEQ ID NO: 110790 - DNA, 25 bp, E. coli
ggtgcagcgtcttctatggcgtctg

SEQ ID NO: 110791 - DNA, 25 bp, E. coli
ggtgcagcgtctactatggcgtctg

SEQ ID NO: 110792 - DNA, 25 bp, E. coli
ggtcttggcggtggtgcagcgtctt

SEQ ID NO: 110793 - DNA, 25 bp, E. coli
ggtcttggcggtcgtgcagcgtctt

SEQ ID NO: 110794 - DNA, 25 bp, E. coli
gactgtggcggataaaaccttcctg

SEQ ID NO: 110795 - DNA, 25 bp, E. coli
cagatgacaaacagttgttacagga

SEQ ID NO: 110796 - DNA, 25 bp, E. coli
cagatgacaaactgttgttacagga

SEQ ID NO: 110797 - DNA, 25 bp, E. coli
atccgtgtgacacccttaactccta

SEQ ID NO: 110798 - DNA, 25 bp, E. coli
atccgtgtgacagccttaactccta

SEQ ID NO: 110799 - DNA, 25 bp, E. coli
tattgacgattatacctcgacagcc

SEQ ID NO: 110800 - DNA, 25 bp, E. coli
tattgacgattaaacctcgacagcc

SEQ ID NO: 110801 - DNA, 25 bp, E. coli
tgggttctcatcgaaatccgtgtga

SEQ ID NO: 110802 - DNA, 25 bp, E. coli
tgggttctcatccaaatccgtgtga

SEQ ID NO: 110803 - DNA, 25 bp, E. coli
tgcacatgatggcttctcatccaaa

SEQ ID NO: 110804 - DNA, 25 bp, E. coli
tgcacatgatgggttctcatccaaa

SEQ ID NO: 110805 - DNA, 25 bp, E. coli
tccagtacagtgacttccctgagcc

SEQ ID NO: 110806 - DNA, 25 bp, E. coli
tccagtacagtgtcttccctgagcc

SEQ ID NO: 110807 - DNA, 25 bp, E. coli
tctgatgcggaggatgccactttcc

SEQ ID NO: 110808 - DNA, 25 bp, E. coli
tctgatgcggagcatgccactttcc

SEQ ID NO: 110809 - DNA, 25 bp, E. coli
gcggatacatcctctccgaagataa

SEQ ID NO: 110810 - DNA, 25 bp, E. coli
gcggatacatccactccgaagataa

SEQ ID NO: 110811 - DNA, 25 bp, E. coli
cgcttcccgtaatacagatgacaaa

SEQ ID NO: 110812 - DNA, 25 bp, E. coli
cgcttcccgtaaaacagatgacaaa

SEQ ID NO: 110813 - DNA, 25 bp, E. coli
gattatacctcgacagcctccagta

SEQ ID NO: 110814 - DNA, 25 bp, E. coli
gattatacctcgtcagcctccagta

SEQ ID NO: 110815 - DNA, 25 bp, E. coli
ggagcatgccactttcctcaagaaa

SEQ ID NO: 110816 - DNA, 25 bp, E. coli
ggagcatgccacattcctcaagaaa

SEQ ID NO: 110817 - DNA, 25 bp, E. coli
cagcgatggtctcgcaatctgggat

SEQ ID NO: 110818 - DNA, 25 bp, E. coli
cagcgatggtctggcaatctgggat

SEQ ID NO: 110819 - DNA, 25 bp, E. coli
catgggcaataatgagcaggttccg

SEQ ID NO: 110820 - DNA, 25 bp, E. coli
catgggcaataaagagcaggttccg

SEQ ID NO: 110821 - DNA, 25 bp, E. coli
tacgggtattcgtcactcagagtac

SEQ ID NO: 110822 - DNA, 25 bp, E. coli
tacgggtattcgacactcagagtac

SEQ ID NO: 110823 - DNA, 25 bp, E. coli
atcagattgccgctgaacgccgcgt

SEQ ID NO: 110824 - DNA, 25 bp, E. coli
accattaacggcctgaaagcctcga

SEQ ID NO: 110825 - DNA, 25 bp, E. coli
accattaacggcgtgaaagcctcga

SEQ ID NO: 110826 - DNA, 25 bp, E. coli
atcagattgccggtgaacgccgcgt

SEQ ID NO: 110827 - DNA, 25 bp, E. coli
tgcaaatcatgggtggctggactcc

SEQ ID NO: 110828 - DNA, 25 bp, E. coli
tgcaaatcatggctggctggactcc

SEQ ID NO: 110829 - DNA, 25 bp, E. coli
tgagcagtcggtccatcagattgcc

SEQ ID NO: 110830 - DNA, 25 bp, E. coli
tgagcagtcggtgcatcagattgcc

SEQ ID NO: 110831 - DNA, 25 bp, E. coli
ggcactcacccgcataaagatatgg

SEQ ID NO: 110832 - DNA, 25 bp, E. coli
ggaaattttgacctacgtgctggaa

SEQ ID NO: 110833 - DNA, 25 bp, E. coli
ggcactcacccggataaagatatgg

SEQ ID NO: 110834 - DNA, 25 bp, E. coli
ggaaattttgacgtacgtgctggaa

SEQ ID NO: 110835 - DNA, 25 bp, E. coli
taacgacgacgtcattgaagcaggg

SEQ ID NO: 110836 - DNA, 25 bp, E. coli
taacgacgacgtgattgaagcaggg

SEQ ID NO: 110837 - DNA, 25 bp, E. coli
gatccaggtggtcaaaggcaatgtc

SEQ ID NO: 110838 - DNA, 25 bp, E. coli
gatccaggtggtgaaaggcaatgtc

SEQ ID NO: 110839 - DNA, 25 bp, E. coli
aaggtcttgatattaacagcggcgc

SEQ ID NO: 110840 - DNA, 25 bp, E. coli
aaggtcttgataataacagcggcgc

SEQ ID NO: 110841 - DNA, 25 bp, E. coli
cagcggcgcgctggactctaatgaa

SEQ ID NO: 110842 - DNA, 25 bp, E. coli
cagcgatgttgagggagaatatcca

SEQ ID NO: 110843 - DNA, 25 bp, E. coli
cagcgatgttgacggagaatatcca

SEQ ID NO: 110844 - DNA, 25 bp, E. coli
cagcggcgcgctcgactctaatgaa

SEQ ID NO: 110845 - DNA, 25 bp, E. coli
caccgggtgcagtgtggatagcatt

SEQ ID NO: 110846 - DNA, 25 bp, E. coli
caccgggtgcagagtggatagcatt

SEQ ID NO: 110847 - DNA, 25 bp, E. coli
agatgaaggcttattgaccagaacc

SEQ ID NO: 110848 - DNA, 25 bp, E. coli
agatgaaggctttttgaccagaacc

SEQ ID NO: 110849 - DNA, 25 bp, E. coli
tgctaaccaactcggcggaagcgat

SEQ ID NO: 110850 - DNA, 25 bp, E. coli
tgctaaccaactgggcggaagcgat

SEQ ID NO: 110851 - DNA, 25 bp, E. coli
gcagccgattcctgtagtaccgtaa

SEQ ID NO: 110852 - DNA, 25 bp, E. coli
gcagccgattccagtagtaccgtaa

SEQ ID NO: 110853 - DNA, 25 bp, E. coli
tggttgccaacgataaaaaggtgac

SEQ ID NO: 110854 - DNA, 25 bp, E. coli
tggttgccaacgttaaaaaggtgac

SEQ ID NO: 110855 - DNA, 25 bp, E. coli
tggcggcaaaagtcaggattcaggc

SEQ ID NO: 110856 - DNA, 25 bp, E. coli
tggcggcaaaagacaggattcaggc

SEQ ID NO: 110857 - DNA, 25 bp, E. coli
taataactgatatatcaccgggtgc

SEQ ID NO: 110858 - DNA, 25 bp, E. coli
taataactgataaatcaccgggtgc

SEQ ID NO: 110859 - DNA, 25 bp, E. coli
gagaagcagctttttgcacgcaagg

SEQ ID NO: 110860 - DNA, 25 bp, E. coli
gagaagcagcttattgcacgcaagg

SEQ ID NO: 110861 - DNA, 25 bp, E. coli
taccgtgataactgcgaaccgttgg

SEQ ID NO: 110862 - DNA, 25 bp, E. coli
taccgtgataacagcgaaccgttgg

SEQ ID NO: 110863 - DNA, 25 bp, E. coli
tagcgcgttcaatgccgcaactggg

SEQ ID NO: 110864 - DNA, 25 bp, E. coli
tagcgcgttcaaagccgcaactggg

SEQ ID NO: 110865 - DNA, 25 bp, E. coli
tattcaggtgaaggtcgatgccacg

SEQ ID NO: 110866 - DNA, 25 bp, E. coli
tattcaggtgaacgtcgatgccacg

SEQ ID NO: 110867 - DNA, 25 bp, E. coli
ttttgccaccggagatgatcaccgc

SEQ ID NO: 110868 - DNA, 25 bp, E. coli
ttggtatcgctggaaacccggatgc

SEQ ID NO: 110869 - DNA, 25 bp, E. coli
ttttgccaccggtgatgatcaccgc

SEQ ID NO: 110870 - DNA, 25 bp, E. coli
ttggtatcgctgcaaacccggatgc

SEQ ID NO: 110871 - DNA, 25 bp, E. coli
tgaagtgaacaggtttgtcgcgcgc

SEQ ID NO: 110872 - DNA, 25 bp, E. coli
tgaagtgaacagctttgtcgcgcgc

SEQ ID NO: 110873 - DNA, 25 bp, E. coli
gacacactttgttagcctcgcgcag

SEQ ID NO: 110874 - DNA, 25 bp, E. coli
gacacactttgtaagcctcgcgcag

SEQ ID NO: 110875 - DNA, 25 bp, E. coli
gattcgaaatcgtctggccgcagtt

SEQ ID NO: 110876 - DNA, 25 bp, E. coli
gatcaccgccgaagagatggatgcc

SEQ ID NO: 110877 - DNA, 25 bp, E. coli
gattgaaggctcgatcccgctgttt

SEQ ID NO: 110878 - DNA, 25 bp, E. coli
gatcaccgccgatgagatggatgcc

SEQ ID NO: 110879 - DNA, 25 bp, E. coli
gattcgaaatcgactggccgcagtt

SEQ ID NO: 110880 - DNA, 25 bp, E. coli
gattgaaggctccatcccgctgttt

SEQ ID NO: 110881 - DNA, 25 bp, E. coli
taattttcagcgagatgtcctcgcc

SEQ ID NO: 110882 - DNA, 25 bp, E. coli
taattttcagcgtgatgtcctcgcc

SEQ ID NO: 110883 - DNA, 25 bp, E. coli
aagttaaagcgcctcaccagccagg

SEQ ID NO: 110884 - DNA, 25 bp, E. coli
aagttaaagcgcgtcaccagccagg

SEQ ID NO: 110885 - DNA, 25 bp, E. coli
catttgccccagataatcgggcgcg

SEQ ID NO: 110886 - DNA, 25 bp, E. coli
catttgccccagttaatcgggcgcg

SEQ ID NO: 110887 - DNA, 25 bp, E. coli
taaagcgcgtcaccagccaggccag

SEQ ID NO: 110888 - DNA, 25 bp, E. coli
taaagcgcgtcagcagccaggccag

SEQ ID NO: 110889 - DNA, 25 bp, E. coli
tgccccagttaatcgggcgcgcgtc

SEQ ID NO: 110890 - DNA, 25 bp, E. coli
tgccccagttaaacgggcgcgcgtc

SEQ ID NO: 110891 - DNA, 25 bp, E. coli
tcgggcgcgcgtcataacgcttcaa

SEQ ID NO: 110892 - DNA, 25 bp, E. coli
tcgggcgcgcgtgataacgcttcaa

SEQ ID NO: 110893 - DNA, 25 bp, E. coli
tcagaaaccatttgccccagttaat

SEQ ID NO: 110894 - DNA, 25 bp, E. coli
gcatcccgatgcgaatcagaaacca

SEQ ID NO: 110895 - DNA, 25 bp, E. coli
gcatcccgatgccaatcagaaacca

SEQ ID NO: 110896 - DNA, 25 bp, E. coli
cgcgatcatcacggtcagccagatg

SEQ ID NO: 110897 - DNA, 25 bp, E. coli
ccgtcagccagatggcgtgcagcat

SEQ ID NO: 110898 - DNA, 25 bp, E. coli
ccgtcagccagaaggcgtgcagcat

SEQ ID NO: 110899 - DNA, 25 bp, E. coli
cgcgatcatcaccgtcagccagatg

SEQ ID NO: 110900 - DNA, 25 bp, E. coli
ggcgcgcgtcataacgcttcaattg

SEQ ID NO: 110901 - DNA, 25 bp, E. coli
ggcgcgcgtcattacgcttcaattg

SEQ ID NO: 110902 - DNA, 25 bp, E. coli
tcagaaaccattagccccagttaat

SEQ ID NO: 110903 - DNA, 25 bp, E. coli
gatgccaatcagtaaccatttgccc

SEQ ID NO: 110904 - DNA, 25 bp, E. coli
gatgccaatcagaaaccatttgccc

SEQ ID NO: 110905 - DNA, 25 bp, E. coli
caacgactgcgagagaaaaaccggt

SEQ ID NO: 110906 - DNA, 25 bp, E. coli
caacgactgcgacagaaaaaccggt

SEQ ID NO: 110907 - DNA, 25 bp, E. coli
catccgataaggtgaaaccgcaatg

SEQ ID NO: 110908 - DNA, 25 bp, E. coli
catccgataaggagaaaccgcaatg

SEQ ID NO: 110909 - DNA, 25 bp, E. coli
agaggctccggctgtatctgcggat

SEQ ID NO: 110910 - DNA, 25 bp, E. coli
agaggctccggcagtatctgcggat

SEQ ID NO: 110911 - DNA, 25 bp, E. coli
tatctgcggatggaacgactgcgac

SEQ ID NO: 110912 - DNA, 25 bp, E. coli
tatctgcggatgcaacgactgcgac

SEQ ID NO: 110913 - DNA, 25 bp, E. coli
tgaaaaagccgctgaagaggctccg

SEQ ID NO: 110914 - DNA, 25 bp, E. coli
tgaaaaagccgcagaagaggctccg

SEQ ID NO: 110915 - DNA, 25 bp, E. coli
tcgcccaaccgggatccgataagga

SEQ ID NO: 110916 - DNA, 25 bp, E. coli
tcgcccaaccggcatccgataagga

SEQ ID NO: 110917 - DNA, 25 bp, E. coli
tcggcgtcttgatgacggcgatgtc

SEQ ID NO: 110918 - DNA, 25 bp, E. coli
tcggcgtcttgaagacggcgatgtc

SEQ ID NO: 110919 - DNA, 25 bp, E. coli
gccctttacgcccttctggtgtcgg

SEQ ID NO: 110920 - DNA, 25 bp, E. coli
gccctttacgccgttctggtgtcgg

SEQ ID NO: 110921 - DNA, 25 bp, E. coli
gaaaaccatcttaatcaaacccgcg

SEQ ID NO: 110922 - DNA, 25 bp, E. coli
gaaaaccatctttatcaaacccgcg

SEQ ID NO: 110923 - DNA, 25 bp, E. coli
gacggcgatgtcattcaggctgaaa

SEQ ID NO: 110924 - DNA, 25 bp, E. coli
ggacgcctgattcgtgatcccgaca

SEQ ID NO: 110925 - DNA, 25 bp, E. coli
ggacgcctgattggtgatcccgaca

SEQ ID NO: 110926 - DNA, 25 bp, E. coli
gacggcgatgtctttcaggctgaaa

SEQ ID NO: 110927 - DNA, 25 bp, E. coli
aagttatcgataactgggctgcggc

SEQ ID NO: 110928 - DNA, 25 bp, E. coli
aagttatcgatatctgggctgcggc

SEQ ID NO: 110929 - DNA, 25 bp, E. coli
caatcggtgttatcgcggcacagtc

SEQ ID NO: 110930 - DNA, 25 bp, E. coli
caatcggtgttaacgcggcacagtc

SEQ ID NO: 110931 - DNA, 25 bp, E. coli
taaaagattacgtgtgcctgtgcgg

SEQ ID NO: 110932 - DNA, 25 bp, E. coli
taaaagattacgagtgcctgtgcgg

SEQ ID NO: 110933 - DNA, 25 bp, E. coli
agtacaagcgccagaaacaccgtgg

SEQ ID NO: 110934 - DNA, 25 bp, E. coli
agtacaagcgcctgaaacaccgtgg

SEQ ID NO: 110935 - DNA, 25 bp, E. coli
tagacgccctgctggataacggtcg

SEQ ID NO: 110936 - DNA, 25 bp, E. coli
tatgctgcaggaagcggtagacgcc

SEQ ID NO: 110937 - DNA, 25 bp, E. coli
tagacgccctgcaggataacggtcg

SEQ ID NO: 110938 - DNA, 25 bp, E. coli
tatgctgcaggatgcggtagacgcc

SEQ ID NO: 110939 - DNA, 25 bp, E. coli
tgaagtcggttgagaactccagcgg

SEQ ID NO: 110940 - DNA, 25 bp, E. coli
tgaagtcggttgtgaactccagcgg

SEQ ID NO: 110941 - DNA, 25 bp, E. coli
tgcgtccggcacagaaaatcgttga

SEQ ID NO: 110942 - DNA, 25 bp, E. coli
tgcgtccggcactgaaaatcgttga

SEQ ID NO: 110943 - DNA, 25 bp, E. coli
gctttactgacaagatcgacggcca

SEQ ID NO: 110944 - DNA, 25 bp, E. coli
gctttactgacatgatcgacggcca

SEQ ID NO: 110945 - DNA, 25 bp, E. coli
gactgcgcacatctggttcctgaaa

SEQ ID NO: 110946 - DNA, 25 bp, E. coli
gactgcgcacatgtggttcctgaaa

SEQ ID NO: 110947 - DNA, 25 bp, E. coli
gtaaagctaccaacgttaacgcggg

SEQ ID NO: 110948 - DNA, 25 bp, E. coli
gtaaagctaccatcgttaacgcggg

SEQ ID NO: 110949 - DNA, 25 bp, E. coli
aatcctgatgaaacgcaaaatcacc

SEQ ID NO: 110950 - DNA, 25 bp, E. coli
aatcctgatgaatcgcaaaatcacc

SEQ ID NO: 110951 - DNA, 25 bp, E. coli
caaagtgcatcatcttatgcgtcgt

SEQ ID NO: 110952 - DNA, 25 bp, E. coli
caaagtgcatcaacttatgcgtcgt

SEQ ID NO: 110953 - DNA, 25 bp, E. coli
caacgactggtgtaaggcgtcttta

SEQ ID NO: 110954 - DNA, 25 bp, E. coli
caacgactggtgaaaggcgtcttta

SEQ ID NO: 110955 - DNA, 25 bp, E. coli
ttagccgcaccgctttaggtctggt

SEQ ID NO: 110956 - DNA, 25 bp, E. coli
ttagccgcaccggtttaggtctggt

SEQ ID NO: 110957 - DNA, 25 bp, E. coli
tgatcaacgactcgtgaaaggcgtc

SEQ ID NO: 110958 - DNA, 25 bp, E. coli
tgtgcgatgatctacgactggtgaa

SEQ ID NO: 110959 - DNA, 25 bp, E. coli
tgatcaacgactggtgaaaggcgtc

SEQ ID NO: 110960 - DNA, 25 bp, E. coli
tgtgcgatgatcaacgactggtgaa

SEQ ID NO: 110961 - DNA, 25 bp, E. coli
tctggtggcagtgtgcgatgatcaa

SEQ ID NO: 110962 - DNA, 25 bp, E. coli
tctggtggcagtctgcgatgatcaa

SEQ ID NO: 110963 - DNA, 25 bp, E. coli
gaacaaagtgcatcatcttatgcgt

SEQ ID NO: 110964 - DNA, 25 bp, E. coli
gaacaaagtgcaacatcttatgcgt

SEQ ID NO: 110965 - DNA, 25 bp, E. coli
ccgcaccggttttggtctggtggca

SEQ ID NO: 110966 - DNA, 25 bp, E. coli
ccgcaccggtttaggtctggtggca

SEQ ID NO: 110967 - DNA, 25 bp, E. coli
cgactggtgaaaggcgtctttaccg

SEQ ID NO: 110968 - DNA, 25 bp, E. coli
cgactggtgaaacgcgtctttaccg

SEQ ID NO: 110969 - DNA, 25 bp, E. coli
tggcagtgtgcgatgatcaacgact

SEQ ID NO: 110970 - DNA, 25 bp, E. coli
tggcagtgtgcgttgatcaacgact

SEQ ID NO: 110971 - DNA, 25 bp, E. coli
cagataaagccttacgcgaagcgaa

SEQ ID NO: 110972 - DNA, 25 bp, E. coli
cagataaagcctaacgcgaagcgaa

SEQ ID NO: 110973 - DNA, 25 bp, E. coli
taaaaatgtcgaactcctgaccggc

SEQ ID NO: 110974 - DNA, 25 bp, E. coli
taaaaatgtcgatctcctgaccggc

SEQ ID NO: 110975 - DNA, 25 bp, E. coli
tagtgcccaggcaaaaatcattgcg

SEQ ID NO: 110976 - DNA, 25 bp, E. coli
tagtgcccaggctaaaatcattgcg

SEQ ID NO: 110977 - DNA, 25 bp, E. coli
tttaccgaactctatagtgcccagg

SEQ ID NO: 110978 - DNA, 25 bp, E. coli
tttaccgaactcaatagtgcccagg

SEQ ID NO: 110979 - DNA, 25 bp, E. coli
tgtcatgacggatgcagataaagcc

SEQ ID NO: 110980 - DNA, 25 bp, E. coli
tgtcatgacggaagcagataaagcc

SEQ ID NO: 110981 - DNA, 25 bp, E. coli
gcaacttacttcaactgactctgga

SEQ ID NO: 110982 - DNA, 25 bp, E. coli
gcaacttacttctactgactctgga

SEQ ID NO: 110983 - DNA, 25 bp, E. coli
gatattatccaggaaagcatccgcc

SEQ ID NO: 110984 - DNA, 25 bp, E. coli
gatattatccagcaaagcatccgcc

SEQ ID NO: 110985 - DNA, 25 bp, E. coli
gattagccagcgaactatggccgtt

SEQ ID NO: 110986 - DNA, 25 bp, E. coli
gattagccagcgtactatggccgtt

SEQ ID NO: 110987 - DNA, 25 bp, E. coli
ggcagtacactgttccagacaaagt

SEQ ID NO: 110988 - DNA, 25 bp, E. coli
ggcagtacactgatccagacaaagt

SEQ ID NO: 110989 - DNA, 25 bp, E. coli
taatcggcgctactttttcaacagc

SEQ ID NO: 110990 - DNA, 25 bp, E. coli
taatcggcgctagtttttcaacagc

SEQ ID NO: 110991 - DNA, 25 bp, E. coli
gatgatattttagcgcgactggagg

SEQ ID NO: 110992 - DNA, 25 bp, E. coli
gatgatattttaccgcgactggagg

SEQ ID NO: 110993 - DNA, 25 bp, E. coli
cagcttttgaaaaaattcaggagcg

SEQ ID NO: 110994 - DNA, 25 bp, E. coli
cagcttttgaaataattcaggagcg

SEQ ID NO: 110995 - DNA, 25 bp, E. coli
caggagattggtgagaaaaaagcac

SEQ ID NO: 110996 - DNA, 25 bp, E. coli
caggagattggtcagaaaaaagcac

SEQ ID NO: 110997 - DNA, 25 bp, E. coli
tacaaagaatgcttgagaaaatggc

SEQ ID NO: 110998 - DNA, 25 bp, E. coli
tacaaagaatgcatgagaaaatggc

SEQ ID NO: 110999 - DNA, 25 bp, E. coli
aacgaacgtcgtcaagaatactatc

SEQ ID NO: 111000 - DNA, 25 bp, E. coli
aacgaacgtcgtgaagaatactatc

SEQ ID NO: 111001 - DNA, 25 bp, E. coli
aaatggcatgtgaccgggtttcacc

SEQ ID NO: 111002 - DNA, 25 bp, E. coli
aaaaatccaagtcgaagccgcaact

SEQ ID NO: 111003 - DNA, 25 bp, E. coli
aaatggcatgtgtccgggtttcacc

SEQ ID NO: 111004 - DNA, 25 bp, E. coli
aaaaatccaagtggaagccgcaact

SEQ ID NO: 111005 - DNA, 25 bp, E. coli
ttcaggagcgtgctcaacgaacgtc

SEQ ID NO: 111006 - DNA, 25 bp, E. coli
ttcaggagcgtggtcaacgaacgtc

SEQ ID NO: 111007 - DNA, 25 bp, E. coli
gacatcaaaacagttgaacagcttt

SEQ ID NO: 111008 - DNA, 25 bp, E. coli
gacatcaaaacacttgaacagcttt

SEQ ID NO: 111009 - DNA, 25 bp, E. coli
gaagccgcaactaccgacatcaaaa

SEQ ID NO: 111010 - DNA, 25 bp, E. coli
gaagccgcaacttccgacatcaaaa

SEQ ID NO: 111011 - DNA, 25 bp, E. coli
cgtgaagaatactatcaggagattg

SEQ ID NO: 111012 - DNA, 25 bp, E. coli
cgtgaagaatacaatcaggagattg

SEQ ID NO: 111013 - DNA, 25 bp, E. coli
gggtttcaccagtagatctaaagga

SEQ ID NO: 111014 - DNA, 25 bp, E. coli
gggtttcaccagaagatctaaagga

SEQ ID NO: 111015 - DNA, 25 bp, E. coli
aatgttattccctggcgctgagtgg

SEQ ID NO: 111016 - DNA, 25 bp, E. coli
aatgttattcccaggcgctgagtgg

SEQ ID NO: 111017 - DNA, 25 bp, E. coli
caaagaagtctgattcgccaggata

SEQ ID NO: 111018 - DNA, 25 bp, E. coli
caaagaagtctgtttcgccaggata

SEQ ID NO: 111019 - DNA, 25 bp, E. coli
tattatcaccactagcagttcgaca

SEQ ID NO: 111020 - DNA, 25 bp, E. coli
tattatcaccacaagcagttcgaca

SEQ ID NO: 111021 - DNA, 25 bp, E. coli
ccttcagtggagatgcagtggttac

SEQ ID NO: 111022 - DNA, 25 bp, E. coli
ccttcagtggagttgcagtggttac

SEQ ID NO: 111023 - DNA, 25 bp, E. coli
gctgagtggcatccgcaatttgcag

SEQ ID NO: 111024 - DNA, 25 bp, E. coli
gctgagtggcatgcgcaatttgcag

SEQ ID NO: 111025 - DNA, 25 bp, E. coli
gaaaagatgcttcaacgacgcgaga

SEQ ID NO: 111026 - DNA, 25 bp, E. coli
gaaaagatgcttgaacgacgcgaga

SEQ ID NO: 111027 - DNA, 25 bp, E. coli
tttccaggaaatctggtacccgtct

SEQ ID NO: 111028 - DNA, 25 bp, E. coli
tttccaggaaatgtggtacccgtct

SEQ ID NO: 111029 - DNA, 25 bp, E. coli
ggatgtaattaaagccccggaagta

SEQ ID NO: 111030 - DNA, 25 bp, E. coli
ggatgtaattaatgccccggaagta

SEQ ID NO: 111031 - DNA, 25 bp, E. coli
ggtggcagccgagtgaacaaaatac

SEQ ID NO: 111032 - DNA, 25 bp, E. coli
ggtggcagccgactgaacaaaatac

SEQ ID NO: 111033 - DNA, 25 bp, E. coli
taatcccggaatggctggtatcgaa

SEQ ID NO: 111034 - DNA, 25 bp, E. coli
tcaatacttgatctgccagacggaa

SEQ ID NO: 111035 - DNA, 25 bp, E. coli
tcaatacttgatgtgccagacggaa

SEQ ID NO: 111036 - DNA, 25 bp, E. coli
taatcccggaatcgctggtatcgaa

SEQ ID NO: 111037 - DNA, 25 bp, E. coli
aattcacattcgacttccagcagcc

SEQ ID NO: 111038 - DNA, 25 bp, E. coli
aattcacattcgtcttccagcagcc

SEQ ID NO: 111039 - DNA, 25 bp, E. coli
ttggaaaaattaaggcgccgccact

SEQ ID NO: 111040 - DNA, 25 bp, E. coli
ttggaaaaattatggcgccgccact

SEQ ID NO: 111041 - DNA, 25 bp, E. coli
ttctcggccgccagaattcgctggg

SEQ ID NO: 111042 - DNA, 25 bp, E. coli
ttctcggccgcctgaattcgctggg

SEQ ID NO: 111043 - DNA, 25 bp, E. coli
ttacagtcgccatgaaaaacgttcg

SEQ ID NO: 111044 - DNA, 25 bp, E. coli
ttacagtcgccaagaaaaacgttcg

SEQ ID NO: 111045 - DNA, 25 bp, E. coli
gcgtgaaagcttccgtctgcgccaa

SEQ ID NO: 111046 - DNA, 25 bp, E. coli
gcgtgaaagcttgcgtctgcgccaa

SEQ ID NO: 111047 - DNA, 25 bp, E. coli
gaactcccggctttggatttcgtgg

SEQ ID NO: 111048 - DNA, 25 bp, E. coli
gcaatcggattatacgtctgacgcg

SEQ ID NO: 111049 - DNA, 25 bp, E. coli
gcaatcggattaaacgtctgacgcg

SEQ ID NO: 111050 - DNA, 25 bp, E. coli
gaactcccggctatggatttcgtgg

SEQ ID NO: 111051 - DNA, 25 bp, E. coli
gataaccgtgctgtctcggaagcgt

SEQ ID NO: 111052 - DNA, 25 bp, E. coli
gataaccgtgctctctcggaagcgt

SEQ ID NO: 111053 - DNA, 25 bp, E. coli
ggttaagctcgcttttcccagggag

SEQ ID NO: 111054 - DNA, 25 bp, E. coli
ggttaagctcgcatttcccagggag

SEQ ID NO: 111055 - DNA, 25 bp, E. coli
gggcatccccgtttcggtcttacag

SEQ ID NO: 111056 - DNA, 25 bp, E. coli
gggcatccccgtatcggtcttacag

SEQ ID NO: 111057 - DNA, 25 bp, E. coli
gacgcgcccatgtacgcaatcggat

SEQ ID NO: 111058 - DNA, 25 bp, E. coli
gacgcgcccatgaacgcaatcggat

SEQ ID NO: 111059 - DNA, 25 bp, E. coli
catatcccgctgagggtgcgtcgta

SEQ ID NO: 111060 - DNA, 25 bp, E. coli
catatcccgctgtgggtgcgtcgta

SEQ ID NO: 111061 - DNA, 25 bp, E. coli
tacatggcggttggcgtcaacaacg

SEQ ID NO: 111062 - DNA, 25 bp, E. coli
tacatggcggttcgcgtcaacaacg

SEQ ID NO: 111063 - DNA, 25 bp, E. coli
tatcgcgttgagtgtagcagcggac

SEQ ID NO: 111064 - DNA, 25 bp, E. coli
tatcgcgttgagagtagcagcggac

SEQ ID NO: 111065 - DNA, 25 bp, E. coli
ttattgcgatgggaaccgacctggc

SEQ ID NO: 111066 - DNA, 25 bp, E. coli
ttattgcgatggcaaccgacctggc

SEQ ID NO: 111067 - DNA, 25 bp, E. coli
ttattccgccacgaaatgggatgtg

SEQ ID NO: 111068 - DNA, 25 bp, E. coli
tttaatgctgcaacgtcgcgggcaa

SEQ ID NO: 111069 - DNA, 25 bp, E. coli
ttattccgccaccaaatgggatgtg

SEQ ID NO: 111070 - DNA, 25 bp, E. coli
tttaatgctgcatcgtcgcgggcaa

SEQ ID NO: 111071 - DNA, 25 bp, E. coli
tgttgccgcggcatacattgtcgag

SEQ ID NO: 111072 - DNA, 25 bp, E. coli
tgggacctgcgttcattgcggcgat

SEQ ID NO: 111073 - DNA, 25 bp, E. coli
tgggacctgcgtacattgcggcgat

SEQ ID NO: 111074 - DNA, 25 bp, E. coli
tgttgccgcggcttacattgtcgag

SEQ ID NO: 111075 - DNA, 25 bp, E. coli
gattgccaccggtaaaaatctggcg

SEQ ID NO: 111076 - DNA, 25 bp, E. coli
gattgccaccggaaaaaatctggcg

SEQ ID NO: 111077 - DNA, 25 bp, E. coli
taacctggcgcagctgggtaaagga

SEQ ID NO: 111078 - DNA, 25 bp, E. coli
tcaatctggcgaagatggctacagc

SEQ ID NO: 111079 - DNA, 25 bp, E. coli
tcaatctggcgatgatggctacagc

SEQ ID NO: 111080 - DNA, 25 bp, E. coli
taacctggcgcacctgggtaaagga

SEQ ID NO: 111081 - DNA, 25 bp, E. coli
cagcattaaaggttattccagccat

SEQ ID NO: 111082 - DNA, 25 bp, E. coli
cagccatgaacgagatgtactggaa

SEQ ID NO: 111083 - DNA, 25 bp, E. coli
cagccatgaacgtgatgtactggaa

SEQ ID NO: 111084 - DNA, 25 bp, E. coli
catgaacgagatgtactggaagccg

SEQ ID NO: 111085 - DNA, 25 bp, E. coli
catgaacgagatctactggaagccg

SEQ ID NO: 111086 - DNA, 25 bp, E. coli
cagcattaaaggatattccagccat

SEQ ID NO: 111087 - DNA, 25 bp, E. coli
aacgagatgtactggaagccgtaac

SEQ ID NO: 111088 - DNA, 25 bp, E. coli
aacgagatgtacaggaagccgtaac

SEQ ID NO: 111089 - DNA, 25 bp, E. coli
tattccagccatgaacgagatgtac

SEQ ID NO: 111090 - DNA, 25 bp, E. coli
tattccagccatcaacgagatgtac

SEQ ID NO: 111091 - DNA, 25 bp, E. coli
ttccagccatgatcgagatgtactg

SEQ ID NO: 111092 - DNA, 25 bp, E. coli
ttccagccatgaacgagatgtactg

SEQ ID NO: 111093 - DNA, 25 bp, E. coli
tgtcgccagcataaaaggttattcc

SEQ ID NO: 111094 - DNA, 25 bp, E. coli
tgtcgccagcattaaaggttattcc

SEQ ID NO: 111095 - DNA, 25 bp, E. coli
tcttgtcgccaggattaaaggttat

SEQ ID NO: 111096 - DNA, 25 bp, E. coli
tcttgtcgccagcattaaaggttat

SEQ ID NO: 111097 - DNA, 25 bp, E. coli
gccagcattaaacgttattccagcc

SEQ ID NO: 111098 - DNA, 25 bp, E. coli
gccagcattaaaggttattccagcc

SEQ ID NO: 111099 - DNA, 25 bp, E. coli
ggttattccagccatgaacgagatg

SEQ ID NO: 111100 - DNA, 25 bp, E. coli
ggttattccagcgatgaacgagatg

SEQ ID NO: 111101 - DNA, 25 bp, E. coli
gagatgtactggtagccgtaacatt

SEQ ID NO: 111102 - DNA, 25 bp, E. coli
gagatgtactggaagccgtaacatt

SEQ ID NO: 111103 - DNA, 25 bp, E. coli
caggccgtttcgtggtttacgcagc

SEQ ID NO: 111104 - DNA, 25 bp, E. coli
caggccgtttcgaggtttacgcagc

SEQ ID NO: 111105 - DNA, 25 bp, E. coli
aaagccaagctgaccaatgaccgga

SEQ ID NO: 111106 - DNA, 25 bp, E. coli
aaagccaagctgtccaatgaccgga

SEQ ID NO: 111107 - DNA, 25 bp, E. coli
tataaaagcgagcatacggacacgc

SEQ ID NO: 111108 - DNA, 25 bp, E. coli
tataaaagcgaggatacggacacgc

SEQ ID NO: 111109 - DNA, 25 bp, E. coli
tccgtaaaagcacataaagccaagc

SEQ ID NO: 111110 - DNA, 25 bp, E. coli
tccgtaaaagcagataaagccaagc

SEQ ID NO: 111111 - DNA, 25 bp, E. coli
gaatcacgacggataacgcgcagat

SEQ ID NO: 111112 - DNA, 25 bp, E. coli
gaatcacgacggttaacgcgcagat

SEQ ID NO: 111113 - DNA, 25 bp, E. coli
gacacgctcgtcaataacccagaag

SEQ ID NO: 111114 - DNA, 25 bp, E. coli
gaaaatgcgcgggaacttacgcagc

SEQ ID NO: 111115 - DNA, 25 bp, E. coli
gacacgctcgtctataacccagaag

SEQ ID NO: 111116 - DNA, 25 bp, E. coli
gaaaatgcgcggcaacttacgcagc

SEQ ID NO: 111117 - DNA, 25 bp, E. coli
ggataaaatcccgacatggtccgta

SEQ ID NO: 111118 - DNA, 25 bp, E. coli
ggataaaatccccacatggtccgta

SEQ ID NO: 111119 - DNA, 25 bp, E. coli
taatatggccgaaaaagacgatacc

SEQ ID NO: 111120 - DNA, 25 bp, E. coli
taactccagcggactgaaaatgcgc

SEQ ID NO: 111121 - DNA, 25 bp, E. coli
taatatggccgataaagacgatacc

SEQ ID NO: 111122 - DNA, 25 bp, E. coli
taactccagcggtctgaaaatgcgc

SEQ ID NO: 111123 - DNA, 25 bp, E. coli
gatgttacctctgaagacctcgtca

SEQ ID NO: 111124 - DNA, 25 bp, E. coli
gatgttacctctcaagacctcgtca

SEQ ID NO: 111125 - DNA, 25 bp, E. coli
cactgtgcagtgacgggatgttaac

SEQ ID NO: 111126 - DNA, 25 bp, E. coli
cactgtgcagtgtcgggatgttaac

SEQ ID NO: 111127 - DNA, 25 bp, E. coli
tgttaacaaacctgaatcatgccgc

SEQ ID NO: 111128 - DNA, 25 bp, E. coli
tgttcagcggtaaaaccggcaccgg

SEQ ID NO: 111129 - DNA, 25 bp, E. coli
tgttcagcggtataaccggcaccgg

SEQ ID NO: 111130 - DNA, 25 bp, E. coli
tgatcgccggacagcatcactgtgc

SEQ ID NO: 111131 - DNA, 25 bp, E. coli
tgttaacaaaccagaatcatgccgc

SEQ ID NO: 111132 - DNA, 25 bp, E. coli
tgatcgccggactgcatcactgtgc

SEQ ID NO: 111133 - DNA, 25 bp, E. coli
tgagaggattatggaccgcatgacc

SEQ ID NO: 111134 - DNA, 25 bp, E. coli
tgagaggattatcgaccgcatgacc

SEQ ID NO: 111135 - DNA, 25 bp, E. coli
gcatgacagctaggacaacggcaaa

SEQ ID NO: 111136 - DNA, 25 bp, E. coli
gcatgacagctacgacaacggcaaa

SEQ ID NO: 111137 - DNA, 25 bp, E. coli
cgtttaactgggatagctggcgtcc

SEQ ID NO: 111138 - DNA, 25 bp, E. coli
cgtttaactgggttagctggcgtcc

SEQ ID NO: 111139 - DNA, 25 bp, E. coli
cgacgggcaaaaatacgcgctgagc

SEQ ID NO: 111140 - DNA, 25 bp, E. coli
cgacgggcaaaattacgcgctgagc

SEQ ID NO: 111141 - DNA, 25 bp, E. coli
gattaaccgccagaatcaccagttg

SEQ ID NO: 111142 - DNA, 25 bp, E. coli
gattaaccgccacaatcaccagttg

SEQ ID NO: 111143 - DNA, 25 bp, E. coli
ggccaaatccattgctgacgaactg

SEQ ID NO: 111144 - DNA, 25 bp, E. coli
ggaaaaatcaccttgcagcggcgat

SEQ ID NO: 111145 - DNA, 25 bp, E. coli
ggaaaaatcaccatgcagcggcgat

SEQ ID NO: 111146 - DNA, 25 bp, E. coli
ggccaaatccatagctgacgaactg

SEQ ID NO: 111147 - DNA, 25 bp, E. coli
caaatcattgctgcccaacgtagca

SEQ ID NO: 111148 - DNA, 25 bp, E. coli
caaatcattgctccccaacgtagca

SEQ ID NO: 111149 - DNA, 25 bp, E. coli
cagtgtcctgcatatctcttgtgcg

SEQ ID NO: 111150 - DNA, 25 bp, E. coli
cagtgtcctgcaaatctcttgtgcg

SEQ ID NO: 111151 - DNA, 25 bp, E. coli
atagcgccacagattgccagtagca

SEQ ID NO: 111152 - DNA, 25 bp, E. coli
atagcgccacagtttgccagtagca

SEQ ID NO: 111153 - DNA, 25 bp, E. coli
tagcaacaacattgcgccacagatt

SEQ ID NO: 111154 - DNA, 25 bp, E. coli
tagcaacaacatagcgccacagatt

SEQ ID NO: 111155 - DNA, 25 bp, E. coli
ttatctgccggaccgtgttatgcgg

SEQ ID NO: 111156 - DNA, 25 bp, E. coli
ttttgttattactgccgtcgggtgg

SEQ ID NO: 111157 - DNA, 25 bp, E. coli
ttttgttattacagccgtcgggtgg

SEQ ID NO: 111158 - DNA, 25 bp, E. coli
ttatctgccggagcgtgttatgcgg

SEQ ID NO: 111159 - DNA, 25 bp, E. coli
tgtgcacatggtgactgtttctgcg

SEQ ID NO: 111160 - DNA, 25 bp, E. coli
tgtgcacatggtcactgtttctgcg

SEQ ID NO: 111161 - DNA, 25 bp, E. coli
tcttgtgcgtgataacggagtgtaa

SEQ ID NO: 111162 - DNA, 25 bp, E. coli
tcttgtgcgtgaaaacggagtgtaa

SEQ ID NO: 111163 - DNA, 25 bp, E. coli
cggagtgtaacaaaagggacaggca

SEQ ID NO: 111164 - DNA, 25 bp, E. coli
cggagtgtaacataagggacaggca

SEQ ID NO: 111165 - DNA, 25 bp, E. coli
ggctgtcttcgtatgtcactgctca

SEQ ID NO: 111166 - DNA, 25 bp, E. coli
ggctgtcttcgtttgtcactgctca

SEQ ID NO: 111167 - DNA, 25 bp, E. coli
tcaaagcgtttagtcggcataccag

SEQ ID NO: 111168 - DNA, 25 bp, E. coli
tcaaagcgtttactcggcataccag

SEQ ID NO: 111169 - DNA, 25 bp, E. coli
agcgttgttcaacgtttatgctaca

SEQ ID NO: 111170 - DNA, 25 bp, E. coli
agcgttgttcaaggtttatgctaca

SEQ ID NO: 111171 - DNA, 25 bp, E. coli
tagcgttgttcatcgtttatgctac

SEQ ID NO: 111172 - DNA, 25 bp, E. coli
tagcgttgttcaacgtttatgctac

SEQ ID NO: 111173 - DNA, 25 bp, E. coli
ttgttcaacgtttatgctacatacg

SEQ ID NO: 111174 - DNA, 25 bp, E. coli
ttcaacgtttatgctacatacgtga

SEQ ID NO: 111175 - DNA, 25 bp, E. coli
ttcaacgtttatcctacatacgtga

SEQ ID NO: 111176 - DNA, 25 bp, E. coli
ttgttcaacgttaatgctacatacg

SEQ ID NO: 111177 - DNA, 25 bp, E. coli
tgttcaacgtttttgctacatacgt

SEQ ID NO: 111178 - DNA, 25 bp, E. coli
tgtttagcgttgttcaacgtttatg

SEQ ID NO: 111179 - DNA, 25 bp, E. coli
tgttcaacgtttatgctacatacgt

SEQ ID NO: 111180 - DNA, 25 bp, E. coli
tgtttagcgttgatcaacgtttatg

SEQ ID NO: 111181 - DNA, 25 bp, E. coli
gcgttgttcaacgtttatgctacat

SEQ ID NO: 111182 - DNA, 25 bp, E. coli
gcgttgttcaacctttatgctacat

SEQ ID NO: 111183 - DNA, 25 bp, E. coli
cgttgttcaacgattatgctacata

SEQ ID NO: 111184 - DNA, 25 bp, E. coli
cgttgttcaacgtttatgctacata

SEQ ID NO: 111185 - DNA, 25 bp, E. coli
gttgttcaacgtttatgctacatac

SEQ ID NO: 111186 - DNA, 25 bp, E. coli
gttgttcaacgtatatgctacatac

SEQ ID NO: 111187 - DNA, 25 bp, E. coli
gttcaacgtttatgctacatacgtg

SEQ ID NO: 111188 - DNA, 25 bp, E. coli
gttcaacgtttaagctacatacgtg

SEQ ID NO: 111189 - DNA, 25 bp, E. coli
tcaacgtttatgctacatacgtgaa

SEQ ID NO: 111190 - DNA, 25 bp, E. coli
tcaacgtttatggtacatacgtgaa

SEQ ID NO: 111191 - DNA, 25 bp, E. coli
caatttatgaatgccaatgaaagtg

SEQ ID NO: 111192 - DNA, 25 bp, E. coli
caatttatgaatcccaatgaaagtg

SEQ ID NO: 111193 - DNA, 25 bp, E. coli
ctggtgaaaaactggcctcgctccc

SEQ ID NO: 111194 - DNA, 25 bp, E. coli
ctggtgaaaaacaggcctcgctccc

SEQ ID NO: 111195 - DNA, 25 bp, E. coli
atgaaacaccgcgaaaagttactca

SEQ ID NO: 111196 - DNA, 25 bp, E. coli
atgaaacaccgccaaaagttactca

SEQ ID NO: 111197 - DNA, 25 bp, E. coli
tatcaccaatttatgaatcccaatg

SEQ ID NO: 111198 - DNA, 25 bp, E. coli
tatcaccaatttttgaatcccaatg

SEQ ID NO: 111199 - DNA, 25 bp, E. coli
tgatgccagcatcattaagtgatga

SEQ ID NO: 111200 - DNA, 25 bp, E. coli
tgaaaaacaggcctcgctcccctgt

SEQ ID NO: 111201 - DNA, 25 bp, E. coli
tgaaaaacaggcgtcgctcccctgt

SEQ ID NO: 111202 - DNA, 25 bp, E. coli
tgatgccagcatgattaagtgatga

SEQ ID NO: 111203 - DNA, 25 bp, E. coli
gccagcatcatttagtgatgataaa

SEQ ID NO: 111204 - DNA, 25 bp, E. coli
gccagcatcattaagtgatgataaa

SEQ ID NO: 111205 - DNA, 25 bp, E. coli
gaatgacgtgttcatgccagcatca

SEQ ID NO: 111206 - DNA, 25 bp, E. coli
gaatgacgtgttgatgccagcatca

SEQ ID NO: 111207 - DNA, 25 bp, E. coli
cccaatgaaagtgatttgaatgacg

SEQ ID NO: 111208 - DNA, 25 bp, E. coli
cccaatgaaagtcatttgaatgacg

SEQ ID NO: 111209 - DNA, 25 bp, E. coli
gatttgaatgacctgttgatgccag

SEQ ID NO: 111210 - DNA, 25 bp, E. coli
gatttgaatgacgtgttgatgccag

SEQ ID NO: 111211 - DNA, 25 bp, E. coli
gatgataaaattatcaaacatatgg

SEQ ID NO: 111212 - DNA, 25 bp, E. coli
gatgataaaattttcaaacatatgg

SEQ ID NO: 111213 - DNA, 25 bp, E. coli
aagcacaactggtggcgttgctcaa

SEQ ID NO: 111214 - DNA, 25 bp, E. coli
aagcacaactggaggcgttgctcaa

SEQ ID NO: 111215 - DNA, 25 bp, E. coli
attatcgcacgagcgcagtcgggtt

SEQ ID NO: 111216 - DNA, 25 bp, E. coli
attatcgcacgaccgcagtcgggtt

SEQ ID NO: 111217 - DNA, 25 bp, E. coli
aaaaaagcacaactggtggcgttgc

SEQ ID NO: 111218 - DNA, 25 bp, E. coli
aaaaaagcacaagtggtggcgttgc

SEQ ID NO: 111219 - DNA, 25 bp, E. coli
acaactggtggccttgctcaatcag

SEQ ID NO: 111220 - DNA, 25 bp, E. coli
acaactggtggcgttgctcaatcag

SEQ ID NO: 111221 - DNA, 25 bp, E. coli
tatattatcgcacgaccgcagtcgg

SEQ ID NO: 111222 - DNA, 25 bp, E. coli
tttccacgcgccgatacgacgccca

SEQ ID NO: 111223 - DNA, 25 bp, E. coli
tttccacgcgcccatacgacgccca

SEQ ID NO: 111224 - DNA, 25 bp, E. coli
tattatcgcacgtccgcagtcgggt

SEQ ID NO: 111225 - DNA, 25 bp, E. coli
tatattatcgcaggaccgcagtcgg

SEQ ID NO: 111226 - DNA, 25 bp, E. coli
tattatcgcacgaccgcagtcgggt

SEQ ID NO: 111227 - DNA, 25 bp, E. coli
tgcctggcaggcactgctgcgttat

SEQ ID NO: 111228 - DNA, 25 bp, E. coli
tgcctggcaggctctgctgcgttat

SEQ ID NO: 111229 - DNA, 25 bp, E. coli
cgtaaacaacgtgcctggcaggcac

SEQ ID NO: 111230 - DNA, 25 bp, E. coli
cgtaaacaacgtccctggcaggcac

SEQ ID NO: 111231 - DNA, 25 bp, E. coli
gggatatattatcgcacgaccgcag

SEQ ID NO: 111232 - DNA, 25 bp, E. coli
gggatatattatggcacgaccgcag

SEQ ID NO: 111233 - DNA, 25 bp, E. coli
taacgccgcaaataaaagcacaact

SEQ ID NO: 111234 - DNA, 25 bp, E. coli
taacgccgcaaaaaaaagcacaact

SEQ ID NO: 111235 - DNA, 25 bp, E. coli
cactgattgaggcttctgacgcgat

SEQ ID NO: 111236 - DNA, 25 bp, E. coli
cactgattgagggttctgacgcgat

SEQ ID NO: 111237 - DNA, 25 bp, E. coli
catggttcgtggagatgttgcagcc

SEQ ID NO: 111238 - DNA, 25 bp, E. coli
catggttcgtggtgatgttgcagcc

SEQ ID NO: 111239 - DNA, 25 bp, E. coli
taaagaggaaaggacaatggaagca

SEQ ID NO: 111240 - DNA, 25 bp, E. coli
taaagaggaaagcacaatggaagca

SEQ ID NO: 111241 - DNA, 25 bp, E. coli
tatcggcgagctcgtatctgtacac

SEQ ID NO: 111242 - DNA, 25 bp, E. coli
tatcggcgagctggtatctgtacac

SEQ ID NO: 111243 - DNA, 25 bp, E. coli
tatctgtacacgttatcccgcgtcc

SEQ ID NO: 111244 - DNA, 25 bp, E. coli
tatctgtacacgatatcccgcgtcc

SEQ ID NO: 111245 - DNA, 25 bp, E. coli
ttggcggcggcctgtgtactgccat

SEQ ID NO: 111246 - DNA, 25 bp, E. coli
ttggcggcggccagtgtactgccat

SEQ ID NO: 111247 - DNA, 25 bp, E. coli
tcccgatcggcctgaaaggcgatag

SEQ ID NO: 111248 - DNA, 25 bp, E. coli
tcccgatcggccagaaaggcgatag

SEQ ID NO: 111249 - DNA, 25 bp, E. coli
gcattaggaatgatcgaaacccggg

SEQ ID NO: 111250 - DNA, 25 bp, E. coli
gcattaggaatgttcgaaacccggg

SEQ ID NO: 111251 - DNA, 25 bp, E. coli
cgttctggacccagataaagaggaa

SEQ ID NO: 111252 - DNA, 25 bp, E. coli
cgttctggaccctgataaagaggaa

SEQ ID NO: 111253 - DNA, 25 bp, E. coli
cgcgcgtcaagctggttggtgttaa

SEQ ID NO: 111254 - DNA, 25 bp, E. coli
cgcgcgtcaagcaggttggtgttaa

SEQ ID NO: 111255 - DNA, 25 bp, E. coli
gtccgcacggcgtcctggaagaagt

SEQ ID NO: 111256 - DNA, 25 bp, E. coli
gtccgcacggcgacctggaagaagt

SEQ ID NO: 111257 - DNA, 25 bp, E. coli
ttgtgaacgtcacggcgcagagatc

SEQ ID NO: 111258 - DNA, 25 bp, E. coli
ttttgtgtatagtttgccgggcgca

SEQ ID NO: 111259 - DNA, 25 bp, E. coli
ttgtgaacgtcagggcgcagagatc

SEQ ID NO: 111260 - DNA, 25 bp, E. coli
ttttgtgtatagattgccgggcgca

SEQ ID NO: 111261 - DNA, 25 bp, E. coli
tgactcctgtttgacgtctatcaga

SEQ ID NO: 111262 - DNA, 25 bp, E. coli
tgactcctgtttcacgtctatcaga

SEQ ID NO: 111263 - DNA, 25 bp, E. coli
tgagtaagctcaacgggattcgctc

SEQ ID NO: 111264 - DNA, 25 bp, E. coli
tgagtaagctcatcgggattcgctc

SEQ ID NO: 111265 - DNA, 25 bp, E. coli
tctggcgacattgtttatatacact

SEQ ID NO: 111266 - DNA, 25 bp, E. coli
tctggcgacattctttatatacact

SEQ ID NO: 111267 - DNA, 25 bp, E. coli
gccgccttgatggaacttgaatgat

SEQ ID NO: 111268 - DNA, 25 bp, E. coli
gccgccttgatgcaacttgaatgat

SEQ ID NO: 111269 - DNA, 25 bp, E. coli
gcattgcgcttacccggcttacaga

SEQ ID NO: 111270 - DNA, 25 bp, E. coli
gcattgcgcttagccggcttacaga

SEQ ID NO: 111271 - DNA, 25 bp, E. coli
ccgtatgcccgtttatttctggcga

SEQ ID NO: 111272 - DNA, 25 bp, E. coli
cccgaatcactttcctgagtaagct

SEQ ID NO: 111273 - DNA, 25 bp, E. coli
ccgtatgcccgtatatttctggcga

SEQ ID NO: 111274 - DNA, 25 bp, E. coli
cccgaatcacttacctgagtaagct

SEQ ID NO: 111275 - DNA, 25 bp, E. coli
cgtctatcagatttatgcagtttgt

SEQ ID NO: 111276 - DNA, 25 bp, E. coli
cgtctatcagatatatgcagtttgt

SEQ ID NO: 111277 - DNA, 25 bp, E. coli
gattcgctcacttgccgccttgatg

SEQ ID NO: 111278 - DNA, 25 bp, E. coli
gattcgctcactagccgccttgatg

SEQ ID NO: 111279 - DNA, 25 bp, E. coli
taaaagctggactatccgttcagtt

SEQ ID NO: 111280 - DNA, 25 bp, E. coli
tttcatctgcccagaaggcggcggc

SEQ ID NO: 111281 - DNA, 25 bp, E. coli
tttcatctgccctgaaggcggcggc

SEQ ID NO: 111282 - DNA, 25 bp, E. coli
gccagtgttattctgcccgtcgaag

SEQ ID NO: 111283 - DNA, 25 bp, E. coli
gccagtgttattgtgcccgtcgaag

SEQ ID NO: 111284 - DNA, 25 bp, E. coli
ccgtcgaagtagaagcggcagtcgc

SEQ ID NO: 111285 - DNA, 25 bp, E. coli
ccgtcgaagtagtagcggcagtcgc

SEQ ID NO: 111286 - DNA, 25 bp, E. coli
gccaaagggtttggtttcatctgcc

SEQ ID NO: 111287 - DNA, 25 bp, E. coli
gccaaagggtttcgtttcatctgcc

SEQ ID NO: 111288 - DNA, 25 bp, E. coli
ccgttcagtttgttgtccaccaggg

SEQ ID NO: 111289 - DNA, 25 bp, E. coli
ccgttcagtttgatgtccaccaggg

SEQ ID NO: 111290 - DNA, 25 bp, E. coli
cattcagatggatggttacagaacg

SEQ ID NO: 111291 - DNA, 25 bp, E. coli
cattcagatggaaggttacagaacg

SEQ ID NO: 111292 - DNA, 25 bp, E. coli
ggttacagaacggtaaaagctggac

SEQ ID NO: 111293 - DNA, 25 bp, E. coli
ggttacagaacgctaaaagctggac

SEQ ID NO: 111294 - DNA, 25 bp, E. coli
ggccaaaaggcattcacgccagtgt

SEQ ID NO: 111295 - DNA, 25 bp, E. coli
ggcggcgaagatattttcgctcatt

SEQ ID NO: 111296 - DNA, 25 bp, E. coli
ggccaaaaggcaatcacgccagtgt

SEQ ID NO: 111297 - DNA, 25 bp, E. coli
ggcggcgaagattttttcgctcatt

SEQ ID NO: 111298 - DNA, 25 bp, E. coli
taaaagctggacaatccgttcagtt

SEQ ID NO: 111299 - DNA, 25 bp, E. coli
taagtggttcaacaatgccaaaggg

SEQ ID NO: 111300 - DNA, 25 bp, E. coli
taagtggttcaagaatgccaaaggg

SEQ ID NO: 111301 - DNA, 25 bp, E. coli
ttggtgaggccataccaggagctgc

SEQ ID NO: 111302 - DNA, 25 bp, E. coli
ttggtgaggccaaaccaggagctgc

SEQ ID NO: 111303 - DNA, 25 bp, E. coli
tctgcaaggccacacggtgattgcc

SEQ ID NO: 111304 - DNA, 25 bp, E. coli
tctgcaaggccagacggtgattgcc

SEQ ID NO: 111305 - DNA, 25 bp, E. coli
gccccggtgatttacagcaaagcgt

SEQ ID NO: 111306 - DNA, 25 bp, E. coli
gccccggtgattaacagcaaagcgt

SEQ ID NO: 111307 - DNA, 25 bp, E. coli
gcaaattggcaccattgacgcgcaa

SEQ ID NO: 111308 - DNA, 25 bp, E. coli
gcaaattggcacgattgacgcgcaa

SEQ ID NO: 111309 - DNA, 25 bp, E. coli
gaaaaatgtgctcacgatccctctg

SEQ ID NO: 111310 - DNA, 25 bp, E. coli
gaaaaatgtgctgacgatccctctg

SEQ ID NO: 111311 - DNA, 25 bp, E. coli
cgcaggtcagcggtcagttgaaaac

SEQ ID NO: 111312 - DNA, 25 bp, E. coli
cgattggcgcacctaacgataccga

SEQ ID NO: 111313 - DNA, 25 bp, E. coli
ccgcgacggagaaggctgtgaaaca

SEQ ID NO: 111314 - DNA, 25 bp, E. coli
cgattggcgcacgtaacgataccga

SEQ ID NO: 111315 - DNA, 25 bp, E. coli
cgcaggtcagcgctcagttgaaaac

SEQ ID NO: 111316 - DNA, 25 bp, E. coli
ccgcgacggagatggctgtgaaaca

SEQ ID NO: 111317 - DNA, 25 bp, E. coli
cggatgtaatcctcctgaagccggg

SEQ ID NO: 111318 - DNA, 25 bp, E. coli
cggatgtaatccacctgaagccggg

SEQ ID NO: 111319 - DNA, 25 bp, E. coli
ggaagtcacgcatatcaccactctg

SEQ ID NO: 111320 - DNA, 25 bp, E. coli
tggagaattctttacgcacccgtgc

SEQ ID NO: 111321 - DNA, 25 bp, E. coli
tggagaattcttaacgcacccgtgc

SEQ ID NO: 111322 - DNA, 25 bp, E. coli
ggaagtcacgcaaatcaccactctg

SEQ ID NO: 111323 - DNA, 25 bp, E. coli
aatcggtgtagtgctcggcgttctg

SEQ ID NO: 111324 - DNA, 25 bp, E. coli
aatcggtgtagtcctcggcgttctg

SEQ ID NO: 111325 - DNA, 25 bp, E. coli
catctgcgtgctgagttgaaatccc

SEQ ID NO: 111326 - DNA, 25 bp, E. coli
catctgcgtgctcagttgaaatccc

SEQ ID NO: 111327 - DNA, 25 bp, E. coli
agcggagcaggcactgaaacagagc

SEQ ID NO: 111328 - DNA, 25 bp, E. coli
agcggagcaggctctgaaacagagc

SEQ ID NO: 111329 - DNA, 25 bp, E. coli
tgaaacagagccgttatcgcctggg

SEQ ID NO: 111330 - DNA, 25 bp, E. coli
tgaaacagagcccttatcgcctggg

SEQ ID NO: 111331 - DNA, 25 bp, E. coli
tgaaatccctttgcgatacgctgga

SEQ ID NO: 111332 - DNA, 25 bp, E. coli
tgaaatccctttccgatacgctgga

SEQ ID NO: 111333 - DNA, 25 bp, E. coli
tccgatacgctgcaagaggtgctta

SEQ ID NO: 111334 - DNA, 25 bp, E. coli
tccgatacgctggaagaggtgctta

SEQ ID NO: 111335 - DNA, 25 bp, E. coli
gaacacactacgcaacatctgcgtg

SEQ ID NO: 111336 - DNA, 25 bp, E. coli
gaacacactacggaacatctgcgtg

SEQ ID NO: 111337 - DNA, 25 bp, E. coli
cgcctgggtgaatccggtgatgcca

SEQ ID NO: 111338 - DNA, 25 bp, E. coli
cgcctgggtgaaaccggtgatgcca

SEQ ID NO: 111339 - DNA, 25 bp, E. coli
cggcgttctgctctcgcgtcgttaa

SEQ ID NO: 111340 - DNA, 25 bp, E. coli
cggcgttctgctgtcgcgtcgttaa

SEQ ID NO: 111341 - DNA, 25 bp, E. coli
taagattcgtaggaaagcggagcag

SEQ ID NO: 111342 - DNA, 25 bp, E. coli
taagattcgtagcaaagcggagcag

SEQ ID NO: 111343 - DNA, 25 bp, E. coli
gaggtgcttagctcatctggcgaga

SEQ ID NO: 111344 - DNA, 25 bp, E. coli
gaggtgcttagcacatctggcgaga

SEQ ID NO: 111345 - DNA, 25 bp, E. coli
aagcgctgcccgtgtttgataaaga

SEQ ID NO: 111346 - DNA, 25 bp, E. coli
aagcgctgcccgagtttgataaaga

SEQ ID NO: 111347 - DNA, 25 bp, E. coli
caaacggtgatggaaacgttgcttc

SEQ ID NO: 111348 - DNA, 25 bp, E. coli
caaacggtgatgcaaacgttgcttc

SEQ ID NO: 111349 - DNA, 25 bp, E. coli
tacgtcctgcgccaagatggcagcc

SEQ ID NO: 111350 - DNA, 25 bp, E. coli
tacgtcctgcgcgaagatggcagcc

SEQ ID NO: 111351 - DNA, 25 bp, E. coli
tgaaactgaagctgaaagcgctgcc

SEQ ID NO: 111352 - DNA, 25 bp, E. coli
tgacaaacctgagcagccaaattgg

SEQ ID NO: 111353 - DNA, 25 bp, E. coli
tgacaaacctgaccagccaaattgg

SEQ ID NO: 111354 - DNA, 25 bp, E. coli
tgaaactgaagcagaaagcgctgcc

SEQ ID NO: 111355 - DNA, 25 bp, E. coli
ccggagacgccattctggacatgaa

SEQ ID NO: 111356 - DNA, 25 bp, E. coli
ccggagacgccaatctggacatgaa

SEQ ID NO: 111357 - DNA, 25 bp, E. coli
gcattgatcgtcagtggcctgctcg

SEQ ID NO: 111358 - DNA, 25 bp, E. coli
gcattgatcgtctgtggcctgctcg

SEQ ID NO: 111359 - DNA, 25 bp, E. coli
gaaattaaccagacgcttgcgaaac

SEQ ID NO: 111360 - DNA, 25 bp, E. coli
gaaattaaccagtcgcttgcgaaac

SEQ ID NO: 111361 - DNA, 25 bp, E. coli
tggtcgcgaagacccgaataaggtt

SEQ ID NO: 111362 - DNA, 25 bp, E. coli
tggacatgaactccctgttcggtag

SEQ ID NO: 111363 - DNA, 25 bp, E. coli
tggacatgaactgcctgttcggtag

SEQ ID NO: 111364 - DNA, 25 bp, E. coli
tggtcgcgaagagccgaataaggtt

SEQ ID NO: 111365 - DNA, 25 bp, E. coli
ggctgacgcccaaattgttctgaca

SEQ ID NO: 111366 - DNA, 25 bp, E. coli
ggctgacgcccatattgttctgaca

SEQ ID NO: 111367 - DNA, 25 bp, E. coli
tacaggaagttgatatagcccttgg

SEQ ID NO: 111368 - DNA, 25 bp, E. coli
tacaggaagttgttatagcccttgg

SEQ ID NO: 111369 - DNA, 25 bp, E. coli
tattcgcaaaaagagtacaccagga

SEQ ID NO: 111370 - DNA, 25 bp, E. coli
tttatacattgatcaacggcgtcac

SEQ ID NO: 111371 - DNA, 25 bp, E. coli
tttatacattgaacaacggcgtcac

SEQ ID NO: 111372 - DNA, 25 bp, E. coli
tattcgcaaaaacagtacaccagga

SEQ ID NO: 111373 - DNA, 25 bp, E. coli
tatagacagcagaaacatatcagcc

SEQ ID NO: 111374 - DNA, 25 bp, E. coli
tatagacagcagtaacatatcagcc

SEQ ID NO: 111375 - DNA, 25 bp, E. coli
ttttatgacttatcagggcgagtcc

SEQ ID NO: 111376 - DNA, 25 bp, E. coli
ttttatgacttaacagggcgagtcc

SEQ ID NO: 111377 - DNA, 25 bp, E. coli
gaagactgatttttgacgcactagg

SEQ ID NO: 111378 - DNA, 25 bp, E. coli
gaagactgatttatgacgcactagg

SEQ ID NO: 111379 - DNA, 25 bp, E. coli
gaactggcaaatattcttacccgcg

SEQ ID NO: 111380 - DNA, 25 bp, E. coli
gacatcaggaacacatatcgcccgg

SEQ ID NO: 111381 - DNA, 25 bp, E. coli
gacatcaggaactcatatcgcccgg

SEQ ID NO: 111382 - DNA, 25 bp, E. coli
gaactggcaaattttcttacccgcg

SEQ ID NO: 111383 - DNA, 25 bp, E. coli
cattgccgcgttagctatactaaag

SEQ ID NO: 111384 - DNA, 25 bp, E. coli
cattgccgcgtttgctatactaaag

SEQ ID NO: 111385 - DNA, 25 bp, E. coli
ggaataattcagactcagcaggagt

SEQ ID NO: 111386 - DNA, 25 bp, E. coli
ggaataattcagtctcagcaggagt

SEQ ID NO: 111387 - DNA, 25 bp, E. coli
tggatcacgaatacccagagtcctg

SEQ ID NO: 111388 - DNA, 25 bp, E. coli
tggatcacgaattcccagagtcctg

SEQ ID NO: 111389 - DNA, 25 bp, E. coli
caaagtacctctcggtttaagcgca

SEQ ID NO: 111390 - DNA, 25 bp, E. coli
caaagtacctctgggtttaagcgca

SEQ ID NO: 111391 - DNA, 25 bp, E. coli
tgataagacacccatgccattaccg

SEQ ID NO: 111392 - DNA, 25 bp, E. coli
tgataagacaccgatgccattaccg

SEQ ID NO: 111393 - DNA, 25 bp, E. coli
tgtactggaatattgtgacctaccc

SEQ ID NO: 111394 - DNA, 25 bp, E. coli
tgtactggaataatgtgacctaccc

SEQ ID NO: 111395 - DNA, 25 bp, E. coli
tcagttgtaatgtcgatggcgggtc

SEQ ID NO: 111396 - DNA, 25 bp, E. coli
tcagttgtaatgacgatggcgggtc

SEQ ID NO: 111397 - DNA, 25 bp, E. coli
gccagaatctggatgtagacttgtc

SEQ ID NO: 111398 - DNA, 25 bp, E. coli
gccagaatctggttgtagacttgtc

SEQ ID NO: 111399 - DNA, 25 bp, E. coli
gacaagtgtttgctaacacagcacc

SEQ ID NO: 111400 - DNA, 25 bp, E. coli
gacaagtgtttggtaacacagcacc

SEQ ID NO: 111401 - DNA, 25 bp, E. coli
cccggactttccaggaagcgcagaa

SEQ ID NO: 111402 - DNA, 25 bp, E. coli
cccggactttcctggaagcgcagaa

SEQ ID NO: 111403 - DNA, 25 bp, E. coli
cgtccagtcagtgattggtgtcact

SEQ ID NO: 111404 - DNA, 25 bp, E. coli
cgtccagtcagtcattggtgtcact

SEQ ID NO: 111405 - DNA, 25 bp, E. coli
ggcggctggtaccacactgatcata

SEQ ID NO: 111406 - DNA, 25 bp, E. coli
ggcggctggtacgacactgatcata

SEQ ID NO: 111407 - DNA, 25 bp, E. coli
taagttgctggaatgattacggcgg

SEQ ID NO: 111408 - DNA, 25 bp, E. coli
taagttgctggattgattacggcgg

SEQ ID NO: 111409 - DNA, 25 bp, E. coli
taagcgcaacctttggacaaacagg

SEQ ID NO: 111410 - DNA, 25 bp, E. coli
taagcgcaacctatggacaaacagg

SEQ ID NO: 111411 - DNA, 25 bp, E. coli
cagcgctgtctcgttttggccttga

SEQ ID NO: 111412 - DNA, 25 bp, E. coli
cagcgctgtctccttttggccttga

SEQ ID NO: 111413 - DNA, 25 bp, E. coli
caggaattgatttctcgctttcgag

SEQ ID NO: 111414 - DNA, 25 bp, E. coli
caggaattgattactcgctttcgag

SEQ ID NO: 111415 - DNA, 25 bp, E. coli
aaaatgatattgctcggcggttgcg

SEQ ID NO: 111416 - DNA, 25 bp, E. coli
aaaaggaaactcagccatcaggacg

SEQ ID NO: 111417 - DNA, 25 bp, E. coli
aaaatgatattggtcggcggttgcg

SEQ ID NO: 111418 - DNA, 25 bp, E. coli
aaaaggaaactctgccatcaggacg

SEQ ID NO: 111419 - DNA, 25 bp, E. coli
tgtgttgggaattcactcacctgaa

SEQ ID NO: 111420 - DNA, 25 bp, E. coli
tgtgttgggaatacactcacctgaa

SEQ ID NO: 111421 - DNA, 25 bp, E. coli
ccatgagcgacaatggtggagtcaa

SEQ ID NO: 111422 - DNA, 25 bp, E. coli
ccatgagcgacattggtggagtcaa

SEQ ID NO: 111423 - DNA, 25 bp, E. coli
gacttagtcaagttgccatgagcga

SEQ ID NO: 111424 - DNA, 25 bp, E. coli
gaaacttataaccatgatgagcagg

SEQ ID NO: 111425 - DNA, 25 bp, E. coli
gacttagtcaagatgccatgagcga

SEQ ID NO: 111426 - DNA, 25 bp, E. coli
gaaacttataacgatgatgagcagg

SEQ ID NO: 111427 - DNA, 25 bp, E. coli
gggctttaaaaggtgcgatcagtga

SEQ ID NO: 111428 - DNA, 25 bp, E. coli
gggctttaaaagctgcgatcagtga

SEQ ID NO: 111429 - DNA, 25 bp, E. coli
taataaccgtatcgctggtcgtgac

SEQ ID NO: 111430 - DNA, 25 bp, E. coli
taataaccgtatggctggtcgtgac

SEQ ID NO: 111431 - DNA, 25 bp, E. coli
gagatagctttcctgatgctgcgta

SEQ ID NO: 111432 - DNA, 25 bp, E. coli
gagatagctttcgtgatgctgcgta

SEQ ID NO: 111433 - DNA, 25 bp, E. coli
caagccctgcttccgatggaaacaa

SEQ ID NO: 111434 - DNA, 25 bp, E. coli
caagccctgcttgcgatggaaacaa

SEQ ID NO: 111435 - DNA, 25 bp, E. coli
atcctgccggaagcggtagagtttg

SEQ ID NO: 111436 - DNA, 25 bp, E. coli
atcctgccggaaccggtagagtttg

SEQ ID NO: 111437 - DNA, 25 bp, E. coli
ttggttgccgcccagctggtcgtcc

SEQ ID NO: 111438 - DNA, 25 bp, E. coli
tatgggcggcgaacctgaccccgta

SEQ ID NO: 111439 - DNA, 25 bp, E. coli
tatgggcggcgatcctgaccccgta

SEQ ID NO: 111440 - DNA, 25 bp, E. coli
ttggttgccgccgagctggtcgtcc

SEQ ID NO: 111441 - DNA, 25 bp, E. coli
ttgcgatggaaagaacagaaataca

SEQ ID NO: 111442 - DNA, 25 bp, E. coli
ttgcgatggaaacaacagaaataca

SEQ ID NO: 111443 - DNA, 25 bp, E. coli
tttatgcaagccgtgcttgcgatgg

SEQ ID NO: 111444 - DNA, 25 bp, E. coli
tttatgcaagccctgcttgcgatgg

SEQ ID NO: 111445 - DNA, 25 bp, E. coli
tgcaattgccgtcggcatcctgccg

SEQ ID NO: 111446 - DNA, 25 bp, E. coli
tgcaattgccgtgggcatcctgccg

SEQ ID NO: 111447 - DNA, 25 bp, E. coli
tcctgaccccgtacctgtcagggtg

SEQ ID NO: 111448 - DNA, 25 bp, E. coli
tcctgaccccgttcctgtcagggtg

SEQ ID NO: 111449 - DNA, 25 bp, E. coli
cctgcttgcgatcgaaacaacagaa

SEQ ID NO: 111450 - DNA, 25 bp, E. coli
cctgcttgcgatggaaacaacagaa

SEQ ID NO: 111451 - DNA, 25 bp, E. coli
ccgccgagctggtcgtccctgattt

SEQ ID NO: 111452 - DNA, 25 bp, E. coli
ccgccgagctggacgtccctgattt

SEQ ID NO: 111453 - DNA, 25 bp, E. coli
ggcatcctgccggaaccggtagagt

SEQ ID NO: 111454 - DNA, 25 bp, E. coli
ggcatcctgccgcaaccggtagagt

SEQ ID NO: 111455 - DNA, 25 bp, E. coli
aagcatataccccatataatataca

SEQ ID NO: 111456 - DNA, 25 bp, E. coli
aagcatatacccgatataatataca

SEQ ID NO: 111457 - DNA, 25 bp, E. coli
cacttaagcttattactggcctggc

SEQ ID NO: 111458 - DNA, 25 bp, E. coli
cacttaagcttaatactggcctggc

SEQ ID NO: 111459 - DNA, 25 bp, E. coli
attctttcgcctggtgcatttgaag

SEQ ID NO: 111460 - DNA, 25 bp, E. coli
attctttcgcctcgtgcatttgaag

SEQ ID NO: 111461 - DNA, 25 bp, E. coli
tagatgtggatatcgaattgtttca

SEQ ID NO: 111462 - DNA, 25 bp, E. coli
tagatgtggataacgaattgtttca

SEQ ID NO: 111463 - DNA, 25 bp, E. coli
tatttaatttgtattccccagcact

SEQ ID NO: 111464 - DNA, 25 bp, E. coli
tatttaatttgttttccccagcact

SEQ ID NO: 111465 - DNA, 25 bp, E. coli
ttctggacagatggttttcctccag

SEQ ID NO: 111466 - DNA, 25 bp, E. coli
ttctggacagatcgttttcctccag

SEQ ID NO: 111467 - DNA, 25 bp, E. coli
tgaccttagatgaaataaacaatac

SEQ ID NO: 111468 - DNA, 25 bp, E. coli
tgaccttagatgtaataaacaatac

SEQ ID NO: 111469 - DNA, 25 bp, E. coli
cctggcaattctttcgcctggtgca

SEQ ID NO: 111470 - DNA, 25 bp, E. coli
cctggcaattctatcgcctggtgca

SEQ ID NO: 111471 - DNA, 25 bp, E. coli
tgttttccccagcacttaagcttaa

SEQ ID NO: 111472 - DNA, 25 bp, E. coli
tgttttccccaggacttaagcttaa

SEQ ID NO: 111473 - DNA, 25 bp, E. coli
ggcaataagagacgaaccgatagac

SEQ ID NO: 111474 - DNA, 25 bp, E. coli
ggcaataagagaggaaccgatagac

SEQ ID NO: 111475 - DNA, 25 bp, E. coli
taatactggcctcgcaattctttcg

SEQ ID NO: 111476 - DNA, 25 bp, E. coli
taatactggcctggcaattctttcg

SEQ ID NO: 111477 - DNA, 25 bp, E. coli
cacaatgttgcgttaaatgagaaaa

SEQ ID NO: 111478 - DNA, 25 bp, E. coli
cacaatgttgcgataaatgagaaaa

SEQ ID NO: 111479 - DNA, 25 bp, E. coli
tcatcaatagttcttgaggaattca

SEQ ID NO: 111480 - DNA, 25 bp, E. coli
tgtctgtggagaagatgctaaagtc

SEQ ID NO: 111481 - DNA, 25 bp, E. coli
tcatcaatagttgttgaggaattca

SEQ ID NO: 111482 - DNA, 25 bp, E. coli
tgtctgtggagatgatgctaaagtc

SEQ ID NO: 111483 - DNA, 25 bp, E. coli
tgcgttaaatgagaaaatgttctgg

SEQ ID NO: 111484 - DNA, 25 bp, E. coli
tgcgttaaatgacaaaatgttctgg

SEQ ID NO: 111485 - DNA, 25 bp, E. coli
tcttgaggaattcattatgactatc

SEQ ID NO: 111486 - DNA, 25 bp, E. coli
tcttgaggaattgattatgactatc

SEQ ID NO: 111487 - DNA, 25 bp, E. coli
tcttcgctgttctcaatgttgcgtt

SEQ ID NO: 111488 - DNA, 25 bp, E. coli
tcttcgctgttcacaatgttgcgtt

SEQ ID NO: 111489 - DNA, 25 bp, E. coli
gctaaagtcatcaatagttcttgag

SEQ ID NO: 111490 - DNA, 25 bp, E. coli
gctaaagtcatctatagttcttgag

SEQ ID NO: 111491 - DNA, 25 bp, E. coli
gaaacgtcttcgctgttcacaatgt

SEQ ID NO: 111492 - DNA, 25 bp, E. coli
gaaacgtcttcggtgttcacaatgt

SEQ ID NO: 111493 - DNA, 25 bp, E. coli
gactatcattggaatcgttcttgcc

SEQ ID NO: 111494 - DNA, 25 bp, E. coli
gactatcattggtatcgttcttgcc

SEQ ID NO: 111495 - DNA, 25 bp, E. coli
cattggtatcgtacttgccagaaac

SEQ ID NO: 111496 - DNA, 25 bp, E. coli
cattggtatcgttcttgccagaaac

SEQ ID NO: 111497 - DNA, 25 bp, E. coli
gttcttgccagaaacgtcttcgctg

SEQ ID NO: 111498 - DNA, 25 bp, E. coli
gttcttgccagatacgtcttcgctg

SEQ ID NO: 111499 - DNA, 25 bp, E. coli
aagaatatccgcgaagcgctgcatg

SEQ ID NO: 111500 - DNA, 25 bp, E. coli
aagaatatccgccaagcgctgcatg

SEQ ID NO: 111501 - DNA, 25 bp, E. coli
caactggctggcgaaacatggcagc

SEQ ID NO: 111502 - DNA, 25 bp, E. coli
caactggctggccaaacatggcagc

SEQ ID NO: 111503 - DNA, 25 bp, E. coli
catggcagccgcgaaaagttaatta

SEQ ID NO: 111504 - DNA, 25 bp, E. coli
catggcagccgccaaaagttaatta

SEQ ID NO: 111505 - DNA, 25 bp, E. coli
tatctcaatggtccaaaacccgctg

SEQ ID NO: 111506 - DNA, 25 bp, E. coli
tttggtgaacagaacagcgaagccg

SEQ ID NO: 111507 - DNA, 25 bp, E. coli
tatcggcgtgtccaacgaaactgca

SEQ ID NO: 111508 - DNA, 25 bp, E. coli
tttggtgaacagtacagcgaagccg

SEQ ID NO: 111509 - DNA, 25 bp, E. coli
tatcggcgtgtcgaacgaaactgca

SEQ ID NO: 111510 - DNA, 25 bp, E. coli
tatctcaatggtgcaaaacccgctg

SEQ ID NO: 111511 - DNA, 25 bp, E. coli
tcaggcgctggatcggaagaatatc

SEQ ID NO: 111512 - DNA, 25 bp, E. coli
tcaggcgctggaacggaagaatatc

SEQ ID NO: 111513 - DNA, 25 bp, E. coli
gatatcgccagacgtcatggcctgg

SEQ ID NO: 111514 - DNA, 25 bp, E. coli
gatatcgccagaggtcatggcctgg

SEQ ID NO: 111515 - DNA, 25 bp, E. coli
ggtgagcaaacgcaaaaagccgtcg

SEQ ID NO: 111516 - DNA, 25 bp, E. coli
ggtgagcaaacggaaaaagccgtcg

SEQ ID NO: 111517 - DNA, 25 bp, E. coli
taatgcgctaccagcatctggcgga

SEQ ID NO: 111518 - DNA, 25 bp, E. coli
taattatcgcctgcaaagtgagcgg

SEQ ID NO: 111519 - DNA, 25 bp, E. coli
taattatcgcctccaaagtgagcgg

SEQ ID NO: 111520 - DNA, 25 bp, E. coli
taatgcgctacctgcatctggcgga

SEQ ID NO: 111521 - DNA, 25 bp, E. coli
caataaagcccacttgctggccggg

SEQ ID NO: 111522 - DNA, 25 bp, E. coli
caacgctcttcaactggtgcctgga

SEQ ID NO: 111523 - DNA, 25 bp, E. coli
caataaagcccagttgctggccggg

SEQ ID NO: 111524 - DNA, 25 bp, E. coli
caacgctcttcatctggtgcctgga

SEQ ID NO: 111525 - DNA, 25 bp, E. coli
tacgcgattgcgacgtgctgaagac

SEQ ID NO: 111526 - DNA, 25 bp, E. coli
taccgcacccggatatggaaattcg

SEQ ID NO: 111527 - DNA, 25 bp, E. coli
tacgcgattgcgtcgtgctgaagac

SEQ ID NO: 111528 - DNA, 25 bp, E. coli
taccgcacccggttatggaaattcg

SEQ ID NO: 111529 - DNA, 25 bp, E. coli
tttgatgaaggttaactgcccaccg

SEQ ID NO: 111530 - DNA, 25 bp, E. coli
tttgatgaaggtaaactgcccaccg

SEQ ID NO: 111531 - DNA, 25 bp, E. coli
ttaatgatgacaccccggaagcgag

SEQ ID NO: 111532 - DNA, 25 bp, E. coli
ttaatgatgacagcccggaagcgag

SEQ ID NO: 111533 - DNA, 25 bp, E. coli
tcatagttattgacagcgcgcctaa

SEQ ID NO: 111534 - DNA, 25 bp, E. coli
tcatgaaatgacgaaggctatcgcc

SEQ ID NO: 111535 - DNA, 25 bp, E. coli
tcatagttattgtcagcgcgcctaa

SEQ ID NO: 111536 - DNA, 25 bp, E. coli
tcatgaaatgaccaaggctatcgcc

SEQ ID NO: 111537 - DNA, 25 bp, E. coli
gctgaagacgtatttccaccggtga

SEQ ID NO: 111538 - DNA, 25 bp, E. coli
gctgaagacgtaattccaccggtga

SEQ ID NO: 111539 - DNA, 25 bp, E. coli
ccccgtggatggtggagcaaattcg

SEQ ID NO: 111540 - DNA, 25 bp, E. coli
ccccgtggatggaggagcaaattcg

SEQ ID NO: 111541 - DNA, 25 bp, E. coli
gatcgtctgattaaaccacgctggg

SEQ ID NO: 111542 - DNA, 25 bp, E. coli
gatcgtctgatttaaccacgctggg

SEQ ID NO: 111543 - DNA, 25 bp, E. coli
cattcagttctctacagtcggcaaa

SEQ ID NO: 111544 - DNA, 25 bp, E. coli
catcgtggcgatcgaacgtaataat

SEQ ID NO: 111545 - DNA, 25 bp, E. coli
cattcagttctcaacagtcggcaaa

SEQ ID NO: 111546 - DNA, 25 bp, E. coli
catcgtggcgatggaacgtaataat

SEQ ID NO: 111547 - DNA, 25 bp, E. coli
taaacaacatatacgcgaggccatc

SEQ ID NO: 111548 - DNA, 25 bp, E. coli
taaacaacatattcgcgaggccatc

SEQ ID NO: 111549 - DNA, 25 bp, E. coli
tacgtaaaatttgcacgccacaggc

SEQ ID NO: 111550 - DNA, 25 bp, E. coli
tacgtaaaatttccacgccacaggc

SEQ ID NO: 111551 - DNA, 25 bp, E. coli
ttgccgctatgatgccaacgatgct

SEQ ID NO: 111552 - DNA, 25 bp, E. coli
ttgccgctatgaagccaacgatgct

SEQ ID NO: 111553 - DNA, 25 bp, E. coli
tttctcaggccgtgtcgccattcag

SEQ ID NO: 111554 - DNA, 25 bp, E. coli
tttctcaggccgagtcgccattcag

SEQ ID NO: 111555 - DNA, 25 bp, E. coli
tgcacatttgcacaaggttgccgct

SEQ ID NO: 111556 - DNA, 25 bp, E. coli
tgagagcggcaaaagcaaactacac

SEQ ID NO: 111557 - DNA, 25 bp, E. coli
tgagagcggcaatagcaaactacac

SEQ ID NO: 111558 - DNA, 25 bp, E. coli
tgcacatttgcagaaggttgccgct

SEQ ID NO: 111559 - DNA, 25 bp, E. coli
tcggcaaaagagaaaaccacggtat

SEQ ID NO: 111560 - DNA, 25 bp, E. coli
tcggcaaaagagtaaaccacggtat

SEQ ID NO: 111561 - DNA, 25 bp, E. coli
gccacaggcgtctttatcagatgaa

SEQ ID NO: 111562 - DNA, 25 bp, E. coli
gccacaggcgtcattatcagatgaa

SEQ ID NO: 111563 - DNA, 25 bp, E. coli
ggtaaggtagaaagcccggatatgt

SEQ ID NO: 111564 - DNA, 25 bp, E. coli
ggtaaggtagaatgcccggatatgt

SEQ ID NO: 111565 - DNA, 25 bp, E. coli
acttccgttctactccgcttcatgt

SEQ ID NO: 111566 - DNA, 25 bp, E. coli
acttccgttctagtccgcttcatgt

SEQ ID NO: 111567 - DNA, 25 bp, E. coli
ttacgtcggctagcctgacgctgca

SEQ ID NO: 111568 - DNA, 25 bp, E. coli
ttagaatgcactacctgatgctgtg

SEQ ID NO: 111569 - DNA, 25 bp, E. coli
ttacgtcggctaccctgacgctgca

SEQ ID NO: 111570 - DNA, 25 bp, E. coli
ttagaatgcacttcctgatgctgtg

SEQ ID NO: 111571 - DNA, 25 bp, E. coli
tgtggatacgcatatttcggcgcga

SEQ ID NO: 111572 - DNA, 25 bp, E. coli
tgtggatacgcaaatttcggcgcga

SEQ ID NO: 111573 - DNA, 25 bp, E. coli
gccagatgaatccatatgcgtaaac

SEQ ID NO: 111574 - DNA, 25 bp, E. coli
gccagatgaatcgatatgcgtaaac

SEQ ID NO: 111575 - DNA, 25 bp, E. coli
cccgcgtttttaattgccagatgaa

SEQ ID NO: 111576 - DNA, 25 bp, E. coli
cgcttcatgttaactactctatgca

SEQ ID NO: 111577 - DNA, 25 bp, E. coli
cccgcgtttttatttgccagatgaa

SEQ ID NO: 111578 - DNA, 25 bp, E. coli
cgcttcatgttatctactctatgca

SEQ ID NO: 111579 - DNA, 25 bp, E. coli
gttacgctgtttctttagaatgcac

SEQ ID NO: 111580 - DNA, 25 bp, E. coli
gttacgctgtttgtttagaatgcac

SEQ ID NO: 111581 - DNA, 25 bp, E. coli
tcaagccaacgccatttacgtcggc

SEQ ID NO: 111582 - DNA, 25 bp, E. coli
tcaagccaacgcgatttacgtcggc

SEQ ID NO: 111583 - DNA, 25 bp, E. coli
gacgctgaccagagcttttcccgcg

SEQ ID NO: 111584 - DNA, 25 bp, E. coli
gacgctgaccagtgcttttcccgcg

SEQ ID NO: 111585 - DNA, 25 bp, E. coli
gatcgcaaacaaaaacgagttacgc

SEQ ID NO: 111586 - DNA, 25 bp, E. coli
gatcgcaaacaataacgagttacgc

SEQ ID NO: 111587 - DNA, 25 bp, E. coli
caaagtggccataaacgaagcgatc

SEQ ID NO: 111588 - DNA, 25 bp, E. coli
caaagtggccattaacgaagcgatc

SEQ ID NO: 111589 - DNA, 25 bp, E. coli
catacctcgacgcactgatgaagcc

SEQ ID NO: 111590 - DNA, 25 bp, E. coli
catacctcgacggactgatgaagcc

SEQ ID NO: 111591 - DNA, 25 bp, E. coli
taaagcagcacctgtgattcgccct

SEQ ID NO: 111592 - DNA, 25 bp, E. coli
taaagcagcaccagtgattcgccct

SEQ ID NO: 111593 - DNA, 25 bp, E. coli
tagcgatgtgccttacaaagtggcc

SEQ ID NO: 111594 - DNA, 25 bp, E. coli
tagcgatgtgccatacaaagtggcc

SEQ ID NO: 111595 - DNA, 25 bp, E. coli
tgtacttccgtgagctgctggccgg

SEQ ID NO: 111596 - DNA, 25 bp, E. coli
tgtacttccgtgtgctgctggccgg

SEQ ID NO: 111597 - DNA, 25 bp, E. coli
tcgttcggcgcacaagacagccata

SEQ ID NO: 111598 - DNA, 25 bp, E. coli
tcgttcggcgcagaagacagccata

SEQ ID NO: 111599 - DNA, 25 bp, E. coli
gaataccagttcgtggctgaacagg

SEQ ID NO: 111600 - DNA, 25 bp, E. coli
gaataccagttcctggctgaacagg

SEQ ID NO: 111601 - DNA, 25 bp, E. coli
gaaaaagcagtactgcgcattgcgc

SEQ ID NO: 111602 - DNA, 25 bp, E. coli
gaaaaagcagtagtgcgcattgcgc

SEQ ID NO: 111603 - DNA, 25 bp, E. coli
gacagccataagatcgtcaacggcg

SEQ ID NO: 111604 - DNA, 25 bp, E. coli
gacagccataagttcgtcaacggcg

SEQ ID NO: 111605 - DNA, 25 bp, E. coli
tggcagttgtccgagaacgacatcg

SEQ ID NO: 111606 - DNA, 25 bp, E. coli
tggcagttgtcccagaacgacatcg

SEQ ID NO: 111607 - DNA, 25 bp, E. coli
tcaacggcgtacacgataaagcagc

SEQ ID NO: 111608 - DNA, 25 bp, E. coli
tcaacggcgtactcgataaagcagc

SEQ ID NO: 111609 - DNA, 25 bp, E. coli
caactggaaagtatgggcaaagccg

SEQ ID NO: 111610 - DNA, 25 bp, E. coli
aagccagacattcaacactccacag

SEQ ID NO: 111611 - DNA, 25 bp, E. coli
caacaactggaatgtatgggcaaag

SEQ ID NO: 111612 - DNA, 25 bp, E. coli
caactggaaagtttgggcaaagccg

SEQ ID NO: 111613 - DNA, 25 bp, E. coli
caacaactggaaagtatgggcaaag

SEQ ID NO: 111614 - DNA, 25 bp, E. coli
ctgcaacaactggaaagtatgggca

SEQ ID NO: 111615 - DNA, 25 bp, E. coli
actggaaagtatgggcaaagccgtg

SEQ ID NO: 111616 - DNA, 25 bp, E. coli
actggaaagtatcggcaaagccgtg

SEQ ID NO: 111617 - DNA, 25 bp, E. coli
aagccagacattgaacactccacag

SEQ ID NO: 111618 - DNA, 25 bp, E. coli
tgctgcaacaactggaaagtatggg

SEQ ID NO: 111619 - DNA, 25 bp, E. coli
tgctgcaacaacaggaaagtatggg

SEQ ID NO: 111620 - DNA, 25 bp, E. coli
tgcgcgagtggtcggcgctgcgtta

SEQ ID NO: 111621 - DNA, 25 bp, E. coli
tgcgcgagtggtgggcgctgcgtta

SEQ ID NO: 111622 - DNA, 25 bp, E. coli
cctgtctgcgcgagtggtgggcgct

SEQ ID NO: 111623 - DNA, 25 bp, E. coli
ccatgctgcaacaactggaaagtat

SEQ ID NO: 111624 - DNA, 25 bp, E. coli
cctgtctgcgcgtgtggtgggcgct

SEQ ID NO: 111625 - DNA, 25 bp, E. coli
ccatgctgcaactactggaaagtat

SEQ ID NO: 111626 - DNA, 25 bp, E. coli
ctgcaacaactgcaaagtatgggca

SEQ ID NO: 111627 - DNA, 25 bp, E. coli
gataagccagactttgaacactcca

SEQ ID NO: 111628 - DNA, 25 bp, E. coli
gataagccagacattgaacactcca

SEQ ID NO: 111629 - DNA, 25 bp, E. coli
taagccagacatagaacactccaca

SEQ ID NO: 111630 - DNA, 25 bp, E. coli
taagccagacattgaacactccaca

SEQ ID NO: 111631 - DNA, 25 bp, E. coli
aatattttactctccattctcggcg

SEQ ID NO: 111632 - DNA, 25 bp, E. coli
aatattttactcaccattctcggcg

SEQ ID NO: 111633 - DNA, 25 bp, E. coli
caccggtggtgctgttaatcaatgg

SEQ ID NO: 111634 - DNA, 25 bp, E. coli
caccggtggtgcagttaatcaatgg

SEQ ID NO: 111635 - DNA, 25 bp, E. coli
cagtgaatacggaggtcccgccgtc

SEQ ID NO: 111636 - DNA, 25 bp, E. coli
cagtgaatacggtggtcccgccgtc

SEQ ID NO: 111637 - DNA, 25 bp, E. coli
agttatctgcaattacaggcgctgc

SEQ ID NO: 111638 - DNA, 25 bp, E. coli
agttatctgcaaatacaggcgctgc

SEQ ID NO: 111639 - DNA, 25 bp, E. coli
tttactcaccatactcggcgctatt

SEQ ID NO: 111640 - DNA, 25 bp, E. coli
tttactcaccattctcggcgctatt

SEQ ID NO: 111641 - DNA, 25 bp, E. coli
tctgcaattacaggcgctgccgtta

SEQ ID NO: 111642 - DNA, 25 bp, E. coli
tctgcaattacacgcgctgccgtta

SEQ ID NO: 111643 - DNA, 25 bp, E. coli
cgcgcggcgcagaaaagctgtcgaa

SEQ ID NO: 111644 - DNA, 25 bp, E. coli
cgcgcggcgcagtaaagctgtcgaa

SEQ ID NO: 111645 - DNA, 25 bp, E. coli
gtcattatcagaccggacttaaaaa

SEQ ID NO: 111646 - DNA, 25 bp, E. coli
ggtggtcccgccctccttaagtgcg

SEQ ID NO: 111647 - DNA, 25 bp, E. coli
gtcattatcagagcggacttaaaaa

SEQ ID NO: 111648 - DNA, 25 bp, E. coli
ggtggtcccgccgtccttaagtgcg

SEQ ID NO: 111649 - DNA, 25 bp, E. coli
tggtcccgccgtgcttaagtgcgca

SEQ ID NO: 111650 - DNA, 25 bp, E. coli
tggcaccggtggtgctgttaatcaa

SEQ ID NO: 111651 - DNA, 25 bp, E. coli
tggcaccggtggagctgttaatcaa

SEQ ID NO: 111652 - DNA, 25 bp, E. coli
tggtcccgccgtccttaagtgcgca

SEQ ID NO: 111653 - DNA, 25 bp, E. coli
aagaatggcaagtgcttacgatgag

SEQ ID NO: 111654 - DNA, 25 bp, E. coli
aagaatggcaagagcttacgatgag

SEQ ID NO: 111655 - DNA, 25 bp, E. coli
tacttccgcgtgatataacgaaaga

SEQ ID NO: 111656 - DNA, 25 bp, E. coli
tacttccgcgtgttataacgaaaga

SEQ ID NO: 111657 - DNA, 25 bp, E. coli
tacgatgagtttacttccgcgtgat

SEQ ID NO: 111658 - DNA, 25 bp, E. coli
tacgatgagttttcttccgcgtgat

SEQ ID NO: 111659 - DNA, 25 bp, E. coli
tttgatcctgacaagaaagaatggc

SEQ ID NO: 111660 - DNA, 25 bp, E. coli
tttgatcctgactagaaagaatggc

SEQ ID NO: 111661 - DNA, 25 bp, E. coli
tccgcgtgatataacgaaagaaaaa

SEQ ID NO: 111662 - DNA, 25 bp, E. coli
tccgcgtgatattacgaaagaaaaa

SEQ ID NO: 111663 - DNA, 25 bp, E. coli
gagcttacgatgtgtttacttccgc

SEQ ID NO: 111664 - DNA, 25 bp, E. coli
gagcttacgatgagtttacttccgc

SEQ ID NO: 111665 - DNA, 25 bp, E. coli
ctgacaagaaagtatggcaagagct

SEQ ID NO: 111666 - DNA, 25 bp, E. coli
ctgacaagaaagaatggcaagagct

SEQ ID NO: 111667 - DNA, 25 bp, E. coli
gtctatggctttcatcctgacaaga

SEQ ID NO: 111668 - DNA, 25 bp, E. coli
gtctatggctttgatcctgacaaga

SEQ ID NO: 111669 - DNA, 25 bp, E. coli
tggcaagagctttcgatgagtttac

SEQ ID NO: 111670 - DNA, 25 bp, E. coli
tggcaagagcttacgatgagtttac

SEQ ID NO: 111671 - DNA, 25 bp, E. coli
gatgagtttactaccgcgtgatata

SEQ ID NO: 111672 - DNA, 25 bp, E. coli
gatcctgacaagtaagaatggcaag

SEQ ID NO: 111673 - DNA, 25 bp, E. coli
gatcctgacaagaaagaatggcaag

SEQ ID NO: 111674 - DNA, 25 bp, E. coli
gatgagtttacttccgcgtgatata

SEQ ID NO: 111675 - DNA, 25 bp, E. coli
caatagactgaaattcccctgcttc

SEQ ID NO: 111676 - DNA, 25 bp, E. coli
caatagactgaatttcccctgcttc

SEQ ID NO: 111677 - DNA, 25 bp, E. coli
cactggagaattaataaatcctcgc

SEQ ID NO: 111678 - DNA, 25 bp, E. coli
cacaatagcaggtggaaaacgccct

SEQ ID NO: 111679 - DNA, 25 bp, E. coli
cacaatagcaggaggaaaacgccct

SEQ ID NO: 111680 - DNA, 25 bp, E. coli
cactggagaatttataaatcctcgc

SEQ ID NO: 111681 - DNA, 25 bp, E. coli
caggcggctttttagtctctcatat

SEQ ID NO: 111682 - DNA, 25 bp, E. coli
cagttaagacattctgttcagcaca

SEQ ID NO: 111683 - DNA, 25 bp, E. coli
cagttaagacatactgttcagcaca

SEQ ID NO: 111684 - DNA, 25 bp, E. coli
caggcggcttttaagtctctcatat

SEQ ID NO: 111685 - DNA, 25 bp, E. coli
taaatcctcgctacaatagactgaa

SEQ ID NO: 111686 - DNA, 25 bp, E. coli
taaatcctcgcttcaatagactgaa

SEQ ID NO: 111687 - DNA, 25 bp, E. coli
ttttgctgcccattcaggcggcttt

SEQ ID NO: 111688 - DNA, 25 bp, E. coli
ttttgctgcccaatcaggcggcttt

SEQ ID NO: 111689 - DNA, 25 bp, E. coli
tctgttcagcacaatagcaggtgga

SEQ ID NO: 111690 - DNA, 25 bp, E. coli
tctgttcagcactatagcaggtgga

SEQ ID NO: 111691 - DNA, 25 bp, E. coli
gaatggctattttttcactggagaa

SEQ ID NO: 111692 - DNA, 25 bp, E. coli
gaatggctatttattcactggagaa

SEQ ID NO: 111693 - DNA, 25 bp, E. coli
ctcatataactacaaataaaaggtg

SEQ ID NO: 111694 - DNA, 25 bp, E. coli
ctcatataactagaaataaaaggtg

SEQ ID NO: 111695 - DNA, 25 bp, E. coli
tggaaaacgcccataccagtgaagg

SEQ ID NO: 111696 - DNA, 25 bp, E. coli
tggaaaacgcccttaccagtgaagg

SEQ ID NO: 111697 - DNA, 25 bp, E. coli
aattctgatgagtaaacaaaccagc

SEQ ID NO: 111698 - DNA, 25 bp, E. coli
aattctgatgagaaaacaaaccagc

SEQ ID NO: 111699 - DNA, 25 bp, E. coli
taaattctgatgtgaaaacaaacca

SEQ ID NO: 111700 - DNA, 25 bp, E. coli
taaattctgatgagaaaacaaacca

SEQ ID NO: 111701 - DNA, 25 bp, E. coli
attctgatgagaaaacaaaccagca

SEQ ID NO: 111702 - DNA, 25 bp, E. coli
attctgatgagataacaaaccagca

SEQ ID NO: 111703 - DNA, 25 bp, E. coli
aaattctgatgacaaaacaaaccag

SEQ ID NO: 111704 - DNA, 25 bp, E. coli
aaattctgatgagaaaacaaaccag

SEQ ID NO: 111705 - DNA, 25 bp, E. coli
ttctgatgagaatacaaaccagcag

SEQ ID NO: 111706 - DNA, 25 bp, E. coli
ttctgatgagaaaacaaaccagcag

SEQ ID NO: 111707 - DNA, 25 bp, E. coli
tgatgagaaaactaaccagcagaaa

SEQ ID NO: 111708 - DNA, 25 bp, E. coli
tgatgagaaaacaaaccagcagaaa

SEQ ID NO: 111709 - DNA, 25 bp, E. coli
tctgatgagaaaacaaaccagcaga

SEQ ID NO: 111710 - DNA, 25 bp, E. coli
tctgatgagaaatcaaaccagcaga

SEQ ID NO: 111711 - DNA, 25 bp, E. coli
ctgatgagaaaagaaaccagcagaa

SEQ ID NO: 111712 - DNA, 25 bp, E. coli
ctgatgagaaaacaaaccagcagaa

SEQ ID NO: 111713 - DNA, 25 bp, E. coli
ttaaattctgatgagaaaacaaacc

SEQ ID NO: 111714 - DNA, 25 bp, E. coli
ttaaattctgatcagaaaacaaacc

SEQ ID NO: 111715 - DNA, 25 bp, E. coli
gatgagaaaacaaaccagcagaaat

SEQ ID NO: 111716 - DNA, 25 bp, E. coli
gatgagaaaacataccagcagaaat

SEQ ID NO: 111717 - DNA, 25 bp, E. coli
atatgccaccgcacccgtttgtgcg

SEQ ID NO: 111718 - DNA, 25 bp, E. coli
atatgccaccgctcccgtttgtgcg

SEQ ID NO: 111719 - DNA, 25 bp, E. coli
ttctactggcggtttgtggaaatgg

SEQ ID NO: 111720 - DNA, 25 bp, E. coli
ttctactggcggattgtggaaatgg

SEQ ID NO: 111721 - DNA, 25 bp, E. coli
tgttaatccggacaccggtaacagc

SEQ ID NO: 111722 - DNA, 25 bp, E. coli
tgttaatccggagaccggtaacagc

SEQ ID NO: 111723 - DNA, 25 bp, E. coli
tccggacaccggaaacagcgataac

SEQ ID NO: 111724 - DNA, 25 bp, E. coli
tccggacaccggtaacagcgataac

SEQ ID NO: 111725 - DNA, 25 bp, E. coli
ccatgaaggcggttaacccgcgcaa

SEQ ID NO: 111726 - DNA, 25 bp, E. coli
ccggtaacagcgataacaccatgaa

SEQ ID NO: 111727 - DNA, 25 bp, E. coli
ccatgaaggcggataacccgcgcaa

SEQ ID NO: 111728 - DNA, 25 bp, E. coli
ccggtaacagcgttaacaccatgaa

SEQ ID NO: 111729 - DNA, 25 bp, E. coli
cattgatgaggttctgagacgatga

SEQ ID NO: 111730 - DNA, 25 bp, E. coli
cattgatgaggtactgagacgatga

SEQ ID NO: 111731 - DNA, 25 bp, E. coli
gggaccgtgaatatgccaccgcacc

SEQ ID NO: 111732 - DNA, 25 bp, E. coli
gtgaatatgccaccgcacccgtttg

SEQ ID NO: 111733 - DNA, 25 bp, E. coli
gggaccgtgaatttgccaccgcacc

SEQ ID NO: 111734 - DNA, 25 bp, E. coli
gtgaatatgccagcgcacccgtttg

SEQ ID NO: 111735 - DNA, 25 bp, E. coli
ggccattgatgacgtactgagacga

SEQ ID NO: 111736 - DNA, 25 bp, E. coli
ggccattgatgaggtactgagacga

SEQ ID NO: 111737 - DNA, 25 bp, E. coli
taacaccatgaaggcggataacccg

SEQ ID NO: 111738 - DNA, 25 bp, E. coli
taacaccatgaacgcggataacccg

SEQ ID NO: 111739 - DNA, 25 bp, E. coli
aaaaacgcgcaaatagcctcagtaa

SEQ ID NO: 111740 - DNA, 25 bp, E. coli
aaagctggctgttatgaacatcgaa

SEQ ID NO: 111741 - DNA, 25 bp, E. coli
aaagctggctgtaatgaacatcgaa

SEQ ID NO: 111742 - DNA, 25 bp, E. coli
aaaaacgcgcaattagcctcagtaa

SEQ ID NO: 111743 - DNA, 25 bp, E. coli
tagaaatgaactccccacagaatgg

SEQ ID NO: 111744 - DNA, 25 bp, E. coli
tagaaatgaactgcccacagaatgg

SEQ ID NO: 111745 - DNA, 25 bp, E. coli
tttatggccaaattgtggaaccggc

SEQ ID NO: 111746 - DNA, 25 bp, E. coli
tttatggccaaaatgtggaaccggc

SEQ ID NO: 111747 - DNA, 25 bp, E. coli
ttttaaactctcatatgctcggcag

SEQ ID NO: 111748 - DNA, 25 bp, E. coli
ttttaaactctcttatgctcggcag

SEQ ID NO: 111749 - DNA, 25 bp, E. coli
tgtggaaccggcttgtgacgtcagc

SEQ ID NO: 111750 - DNA, 25 bp, E. coli
tgtggaaccggcatgtgacgtcagc

SEQ ID NO: 111751 - DNA, 25 bp, E. coli
tcttgataaacagaaaaagctggct

SEQ ID NO: 111752 - DNA, 25 bp, E. coli
tcttgataaacacaaaaagctggct

SEQ ID NO: 111753 - DNA, 25 bp, E. coli
gcctcagtaaaagtgcagtatcttg

SEQ ID NO: 111754 - DNA, 25 bp, E. coli
gcctcagtaaaactgcagtatcttg

SEQ ID NO: 111755 - DNA, 25 bp, E. coli
gcacccagtcatcacccgtagaaat

SEQ ID NO: 111756 - DNA, 25 bp, E. coli
gcacccagtcatgacccgtagaaat

SEQ ID NO: 111757 - DNA, 25 bp, E. coli
gggcgtgatccatttttatggccaa

SEQ ID NO: 111758 - DNA, 25 bp, E. coli
gggcgtgatccaattttatggccaa

SEQ ID NO: 111759 - DNA, 25 bp, E. coli
ggcatgtgacgtgagcacccagtca

SEQ ID NO: 111760 - DNA, 25 bp, E. coli
ggcatgtgacgtcagcacccagtca

SEQ ID NO: 111761 - DNA, 25 bp, E. coli
caatggctttggacaacacgccgga

SEQ ID NO: 111762 - DNA, 25 bp, E. coli
caatggctttggtcaacacgccgga

SEQ ID NO: 111763 - DNA, 25 bp, E. coli
catcgaacaagcaaaacgccgtggt

SEQ ID NO: 111764 - DNA, 25 bp, E. coli
catcgaacaagctaaacgccgtggt

SEQ ID NO: 111765 - DNA, 25 bp, E. coli
taaagcacgggtaatgtcgtccacc

SEQ ID NO: 111766 - DNA, 25 bp, E. coli
taaagcacgggttatgtcgtccacc

SEQ ID NO: 111767 - DNA, 25 bp, E. coli
aaaaagtgcgttcgttagctgccgg

SEQ ID NO: 111768 - DNA, 25 bp, E. coli
aaaaagtgcgttggttagctgccgg

SEQ ID NO: 111769 - DNA, 25 bp, E. coli
aaatggttgctgatcaaggcctggc

SEQ ID NO: 111770 - DNA, 25 bp, E. coli
aaatggttgctgttcaaggcctggc

SEQ ID NO: 111771 - DNA, 25 bp, E. coli
tttaccccggtaagccagaagctgc

SEQ ID NO: 111772 - DNA, 25 bp, E. coli
tatctggaaaatttcgctcgtggcg

SEQ ID NO: 111773 - DNA, 25 bp, E. coli
tttaccccggtatgccagaagctgc

SEQ ID NO: 111774 - DNA, 25 bp, E. coli
tatctggtggtgacacgatcgccga

SEQ ID NO: 111775 - DNA, 25 bp, E. coli
tatctggaaaatatcgctcgtggcg

SEQ ID NO: 111776 - DNA, 25 bp, E. coli
tatctggtggtgtcacgatcgccga

SEQ ID NO: 111777 - DNA, 25 bp, E. coli
tgcccgcccggaatgcttaacaagt

SEQ ID NO: 111778 - DNA, 25 bp, E. coli
tgcccgcccggattgcttaacaagt

SEQ ID NO: 111779 - DNA, 25 bp, E. coli
ggccgcgccgggacaattgattgat

SEQ ID NO: 111780 - DNA, 25 bp, E. coli
ggccgcgccgggtcaattgattgat

SEQ ID NO: 111781 - DNA, 25 bp, E. coli
gatgctggccatcagtaacgttacc

SEQ ID NO: 111782 - DNA, 25 bp, E. coli
gatgctggccatgagtaacgttacc

SEQ ID NO: 111783 - DNA, 25 bp, E. coli
caaaacaggcgtcggttatccgcaa

SEQ ID NO: 111784 - DNA, 25 bp, E. coli
caaaacaggcgtgggttatccgcaa

SEQ ID NO: 111785 - DNA, 25 bp, E. coli
taaaaccgttaacctgccgctgcga

SEQ ID NO: 111786 - DNA, 25 bp, E. coli
taaacagattctcgacctgaacccg

SEQ ID NO: 111787 - DNA, 25 bp, E. coli
taaaaccgttaagctgccgctgcga

SEQ ID NO: 111788 - DNA, 25 bp, E. coli
taaagacgttctgatccgccctaaa

SEQ ID NO: 111789 - DNA, 25 bp, E. coli
taaacagattctggacctgaacccg

SEQ ID NO: 111790 - DNA, 25 bp, E. coli
aacattcaggtctgagctggtccgg

SEQ ID NO: 111791 - DNA, 25 bp, E. coli
aacattcaggtcagagctggtccgg

SEQ ID NO: 111792 - DNA, 25 bp, E. coli
tatcgcgcagcacaaggtaaaaccg

SEQ ID NO: 111793 - DNA, 25 bp, E. coli
tatcgcgcagcagaaggtaaaaccg

SEQ ID NO: 111794 - DNA, 25 bp, E. coli
tattctgtcgaacagtggcaagcgt

SEQ ID NO: 111795 - DNA, 25 bp, E. coli
tattctgtcgaagagtggcaagcgt

SEQ ID NO: 111796 - DNA, 25 bp, E. coli
tgtacaactcgcgtcaaaacaggcg

SEQ ID NO: 111797 - DNA, 25 bp, E. coli
tgtacaactcgcctcaaaacaggcg

SEQ ID NO: 111798 - DNA, 25 bp, E. coli
tgcgaggcccggatgaaaataccgc

SEQ ID NO: 111799 - DNA, 25 bp, E. coli
tgcgaggcccggttgaaaataccgc

SEQ ID NO: 111800 - DNA, 25 bp, E. coli
gcgtggccgaccaaaaccatttgtg

SEQ ID NO: 111801 - DNA, 25 bp, E. coli
gcgtggccgacctaaaccatttgtg

SEQ ID NO: 111802 - DNA, 25 bp, E. coli
taaagacgttctcatccgccctaaa

SEQ ID NO: 111803 - DNA, 25 bp, E. coli
gagtctgcgatgaaacgtcacgttg

SEQ ID NO: 111804 - DNA, 25 bp, E. coli
gagtctgcgatgtaacgtcacgttg

SEQ ID NO: 111805 - DNA, 25 bp, E. coli
aatcaggctcctgcgctgtatgcga

SEQ ID NO: 111806 - DNA, 25 bp, E. coli
aatcaggctcctccgctgtatgcga

SEQ ID NO: 111807 - DNA, 25 bp, E. coli
caaagaggaactcaaccgcttatca

SEQ ID NO: 111808 - DNA, 25 bp, E. coli
caaagaggaactgaaccgcttatca

SEQ ID NO: 111809 - DNA, 25 bp, E. coli
cagtcaaagaggaactgaaccgctt

SEQ ID NO: 111810 - DNA, 25 bp, E. coli
cagtcaaagaggtactgaaccgctt

SEQ ID NO: 111811 - DNA, 25 bp, E. coli
tacctcgcgggcagtcaaagaggaa

SEQ ID NO: 111812 - DNA, 25 bp, E. coli
tacctcgcgggctgtcaaagaggaa

SEQ ID NO: 111813 - DNA, 25 bp, E. coli
tgcgctgtatgcgatttcactggtc

SEQ ID NO: 111814 - DNA, 25 bp, E. coli
tcgcgggcagtcaaagaggaactga

SEQ ID NO: 111815 - DNA, 25 bp, E. coli
tgcgctgtatgccatttcactggtc

SEQ ID NO: 111816 - DNA, 25 bp, E. coli
tcgcgggcagtctaagaggaactga

SEQ ID NO: 111817 - DNA, 25 bp, E. coli
cctcaaatcagggtcctgcgctgta

SEQ ID NO: 111818 - DNA, 25 bp, E. coli
cctcaaatcaggctcctgcgctgta

SEQ ID NO: 111819 - DNA, 25 bp, E. coli
gcttatcagcctttttcccggcaag

SEQ ID NO: 111820 - DNA, 25 bp, E. coli
gcttatcagcctatttcccggcaag

SEQ ID NO: 111821 - DNA, 25 bp, E. coli
ctatttcccggctagtctgaagacg

SEQ ID NO: 111822 - DNA, 25 bp, E. coli
ctatttcccggcaagtctgaagacg

SEQ ID NO: 111823 - DNA, 25 bp, E. coli
ggaactgaaccgcttatcagcctat

SEQ ID NO: 111824 - DNA, 25 bp, E. coli
ggctcctgcgctctatgcgatttca

SEQ ID NO: 111825 - DNA, 25 bp, E. coli
ggaactgaaccggttatcagcctat

SEQ ID NO: 111826 - DNA, 25 bp, E. coli
ggctcctgcgctgtatgcgatttca

SEQ ID NO: 111827 - DNA, 25 bp, E. coli
caaggcctgtgggagagattaaacc

SEQ ID NO: 111828 - DNA, 25 bp, E. coli
caaggcctgtggcagagattaaacc

SEQ ID NO: 111829 - DNA, 25 bp, E. coli
taaacgatatgcagattcgccgcgc

SEQ ID NO: 111830 - DNA, 25 bp, E. coli
taaacgatatgctgattcgccgcgc

SEQ ID NO: 111831 - DNA, 25 bp, E. coli
taaatctgctaaatggtcggcggga

SEQ ID NO: 111832 - DNA, 25 bp, E. coli
taaatctgctaattggtcggcggga

SEQ ID NO: 111833 - DNA, 25 bp, E. coli
tacgtgccttagagggttactccgg

SEQ ID NO: 111834 - DNA, 25 bp, E. coli
tacgtgccttagtgggttactccgg

SEQ ID NO: 111835 - DNA, 25 bp, E. coli
tgagaaccatcgaattacgcgcggc

SEQ ID NO: 111836 - DNA, 25 bp, E. coli
tgagaaccatcgtattacgcgcggc

SEQ ID NO: 111837 - DNA, 25 bp, E. coli
tgcaaacagagtcagagaacgcctt

SEQ ID NO: 111838 - DNA, 25 bp, E. coli
tgcaaacagagtgagagaacgcctt

SEQ ID NO: 111839 - DNA, 25 bp, E. coli
tccgaataggcctatgagcgaagcg

SEQ ID NO: 111840 - DNA, 25 bp, E. coli
tccgaataggccaatgagcgaagcg

SEQ ID NO: 111841 - DNA, 25 bp, E. coli
gaacgccttcgaaaagatagccaga

SEQ ID NO: 111842 - DNA, 25 bp, E. coli
gaacgccttcgataagatagccaga

SEQ ID NO: 111843 - DNA, 25 bp, E. coli
ccctagtgaggttcgaaaagagcaa

SEQ ID NO: 111844 - DNA, 25 bp, E. coli
ccctagtgaggtacgaaaagagcaa

SEQ ID NO: 111845 - DNA, 25 bp, E. coli
cttgtggcagaacgaaagaacccta

SEQ ID NO: 111846 - DNA, 25 bp, E. coli
cttgtggcagaaggaaagaacccta

SEQ ID NO: 111847 - DNA, 25 bp, E. coli
gagtaagcttgtccagatagccacg

SEQ ID NO: 111848 - DNA, 25 bp, E. coli
gagtaagcttgtgcagatagccacg

SEQ ID NO: 111849 - DNA, 25 bp, E. coli
cactcgctgagctattaggatataa

SEQ ID NO: 111850 - DNA, 25 bp, E. coli
cactcgctgagcaattaggatataa

SEQ ID NO: 111851 - DNA, 25 bp, E. coli
cacatcttgatgtgacacatggtca

SEQ ID NO: 111852 - DNA, 25 bp, E. coli
cacatcttgatgagacacatggtca

SEQ ID NO: 111853 - DNA, 25 bp, E. coli
taaaaatgaagttcgtgatgctgca

SEQ ID NO: 111854 - DNA, 25 bp, E. coli
taaaaatgaagtacgtgatgctgca

SEQ ID NO: 111855 - DNA, 25 bp, E. coli
tatggcactttggtaacactcgctg

SEQ ID NO: 111856 - DNA, 25 bp, E. coli
tatggcactttgctaacactcgctg

SEQ ID NO: 111857 - DNA, 25 bp, E. coli
tattatcggatacatacagcgctga

SEQ ID NO: 111858 - DNA, 25 bp, E. coli
tattatcggatagatacagcgctga

SEQ ID NO: 111859 - DNA, 25 bp, E. coli
tgagaaacaacttacaaaggcactg

SEQ ID NO: 111860 - DNA, 25 bp, E. coli
tgtgccgcaatggaaggacttatcg

SEQ ID NO: 111861 - DNA, 25 bp, E. coli
tgagaaacaactaacaaaggcactg

SEQ ID NO: 111862 - DNA, 25 bp, E. coli
tgtgccgcaatgcaaggacttatcg

SEQ ID NO: 111863 - DNA, 25 bp, E. coli
gctaaactcctgaaagaaacactgg

SEQ ID NO: 111864 - DNA, 25 bp, E. coli
gctaaactcctgtaagaaacactgg

SEQ ID NO: 111865 - DNA, 25 bp, E. coli
gattgctgcagctcaaaaagtagag

SEQ ID NO: 111866 - DNA, 25 bp, E. coli
gattgctgcagcacaaaaagtagag

SEQ ID NO: 111867 - DNA, 25 bp, E. coli
ggtcaaattgaaggcatcgatcagg

SEQ ID NO: 111868 - DNA, 25 bp, E. coli
ggtcaaattgaacgcatcgatcagg

SEQ ID NO: 111869 - DNA, 25 bp, E. coli
gatgtcaaattatcagacctggcat

SEQ ID NO: 111870 - DNA, 25 bp, E. coli
gatgtcaaattaacagacctggcat

SEQ ID NO: 111871 - DNA, 25 bp, E. coli
aacttacgagtaacaacacaatcag

SEQ ID NO: 111872 - DNA, 25 bp, E. coli
aacttacgagtatcaacacaatcag

SEQ ID NO: 111873 - DNA, 25 bp, E. coli
ttacgagtaacatcacaatcagtat

SEQ ID NO: 111874 - DNA, 25 bp, E. coli
ttacgagtaacaacacaatcagtat

SEQ ID NO: 111875 - DNA, 25 bp, E. coli
ttaataagctgcgaaacttacgagt

SEQ ID NO: 111876 - DNA, 25 bp, E. coli
ttaataagctgccaaacttacgagt

SEQ ID NO: 111877 - DNA, 25 bp, E. coli
tctgattggctgttaataagctgcg

SEQ ID NO: 111878 - DNA, 25 bp, E. coli
tctgattggctgataataagctgcg

SEQ ID NO: 111879 - DNA, 25 bp, E. coli
gctgttgtttttacaacctagagta

SEQ ID NO: 111880 - DNA, 25 bp, E. coli
gctgcgaaactttcgagtaacaaca

SEQ ID NO: 111881 - DNA, 25 bp, E. coli
gctgcgaaacttacgagtaacaaca

SEQ ID NO: 111882 - DNA, 25 bp, E. coli
gctgttgttttttcaacctagagta

SEQ ID NO: 111883 - DNA, 25 bp, E. coli
gacgctgttgttttttcaacctaga

SEQ ID NO: 111884 - DNA, 25 bp, E. coli
ccctctgattggctgttaataagct

SEQ ID NO: 111885 - DNA, 25 bp, E. coli
ccctctgattgggtgttaataagct

SEQ ID NO: 111886 - DNA, 25 bp, E. coli
gattggctgttattaagctgcgaaa

SEQ ID NO: 111887 - DNA, 25 bp, E. coli
gattggctgttaataagctgcgaaa

SEQ ID NO: 111888 - DNA, 25 bp, E. coli
tggctgttaataagctgcgaaactt

SEQ ID NO: 111889 - DNA, 25 bp, E. coli
tggctgttaatatgctgcgaaactt

SEQ ID NO: 111890 - DNA, 25 bp, E. coli
taagctgcgaaagttacgagtaaca

SEQ ID NO: 111891 - DNA, 25 bp, E. coli
taagctgcgaaacttacgagtaaca

SEQ ID NO: 111892 - DNA, 25 bp, E. coli
gacgctgttgttatttcaacctaga

SEQ ID NO: 111893 - DNA, 25 bp, E. coli
aaggtgtgcctggaagccgccgtct

SEQ ID NO: 111894 - DNA, 25 bp, E. coli
aaggtgtgcctgcaagccgccgtct

SEQ ID NO: 111895 - DNA, 25 bp, E. coli
ttaattacgacacgagtaagacctt

SEQ ID NO: 111896 - DNA, 25 bp, E. coli
ttaattacgacaggagtaagacctt

SEQ ID NO: 111897 - DNA, 25 bp, E. coli
tccagaagataagcttacagacggc

SEQ ID NO: 111898 - DNA, 25 bp, E. coli
tccagaagataaccttacagacggc

SEQ ID NO: 111899 - DNA, 25 bp, E. coli
gccgccgtctatggttaaacaagga

SEQ ID NO: 111900 - DNA, 25 bp, E. coli
gccgccgtctatcgttaaacaagga

SEQ ID NO: 111901 - DNA, 25 bp, E. coli
gcagtcatatttcctaactccttga

SEQ ID NO: 111902 - DNA, 25 bp, E. coli
gcagtcatatttgctaactccttga

SEQ ID NO: 111903 - DNA, 25 bp, E. coli
gcacggcggctgtacaattaattac

SEQ ID NO: 111904 - DNA, 25 bp, E. coli
gcacggcggctgaacaattaattac

SEQ ID NO: 111905 - DNA, 25 bp, E. coli
taatatgaatttggaatagcagtca

SEQ ID NO: 111906 - DNA, 25 bp, E. coli
taaccttacagagggcataatgcgc

SEQ ID NO: 111907 - DNA, 25 bp, E. coli
taaccttacagacggcataatgcgc

SEQ ID NO: 111908 - DNA, 25 bp, E. coli
taatatgaatttcgaatagcagtca

SEQ ID NO: 111909 - DNA, 25 bp, E. coli
taatgcgcggtacctcacaacctga

SEQ ID NO: 111910 - DNA, 25 bp, E. coli
taactccttgactatactccagaag

SEQ ID NO: 111911 - DNA, 25 bp, E. coli
taatgcgcggtagctcacaacctga

SEQ ID NO: 111912 - DNA, 25 bp, E. coli
taactccttgacaatactccagaag

SEQ ID NO: 111913 - DNA, 25 bp, E. coli
gagatatttttagggcacggcggct

SEQ ID NO: 111914 - DNA, 25 bp, E. coli
gagatatttttacggcacggcggct

SEQ ID NO: 111915 - DNA, 25 bp, E. coli
aaccagagacgcttccggcatttgg

SEQ ID NO: 111916 - DNA, 25 bp, E. coli
cacacagatcatcatgttatgtgcg

SEQ ID NO: 111917 - DNA, 25 bp, E. coli
cacacagatcatgatgttatgtgcg

SEQ ID NO: 111918 - DNA, 25 bp, E. coli
caaaaccacacacatcatgatgtta

SEQ ID NO: 111919 - DNA, 25 bp, E. coli
caaaaccacacagatcatgatgtta

SEQ ID NO: 111920 - DNA, 25 bp, E. coli
catgatgttatgagcgtttatgacc

SEQ ID NO: 111921 - DNA, 25 bp, E. coli
catgatgttatgtgcgtttatgacc

SEQ ID NO: 111922 - DNA, 25 bp, E. coli
aaccagagacgcatccggcatttgg

SEQ ID NO: 111923 - DNA, 25 bp, E. coli
tatgtgcgtttaagaccgaatgcgg

SEQ ID NO: 111924 - DNA, 25 bp, E. coli
tatgtgcgtttatgaccgaatgcgg

SEQ ID NO: 111925 - DNA, 25 bp, E. coli
tttatgaccgaaagcggaccacatt

SEQ ID NO: 111926 - DNA, 25 bp, E. coli
tttatgaccgaatgcggaccacatt

SEQ ID NO: 111927 - DNA, 25 bp, E. coli
tgtgcgtttatgaccgaatgcggac

SEQ ID NO: 111928 - DNA, 25 bp, E. coli
tgtgcgtttatgtccgaatgcggac

SEQ ID NO: 111929 - DNA, 25 bp, E. coli
tgaccgaatgcggaccacattcaca

SEQ ID NO: 111930 - DNA, 25 bp, E. coli
tgaccgaatgcgcaccacattcaca

SEQ ID NO: 111931 - DNA, 25 bp, E. coli
gcctacaaaaccacacagatcatga

SEQ ID NO: 111932 - DNA, 25 bp, E. coli
gcctacaaaacctcacagatcatga

SEQ ID NO: 111933 - DNA, 25 bp, E. coli
gcgtttatgaccgaatgcggaccac

SEQ ID NO: 111934 - DNA, 25 bp, E. coli
gcgtttatgacccaatgcggaccac

SEQ ID NO: 111935 - DNA, 25 bp, E. coli
gatgttatgtgcgtttatgaccgaa

SEQ ID NO: 111936 - DNA, 25 bp, E. coli
gatgttatgtgcctttatgaccgaa

SEQ ID NO: 111937 - DNA, 25 bp, E. coli
cagggaagacagcaagtaagtcagg

SEQ ID NO: 111938 - DNA, 25 bp, E. coli
catgcaccggcatctggaggctgac

SEQ ID NO: 111939 - DNA, 25 bp, E. coli
cagggaagacaggaagtaagtcagg

SEQ ID NO: 111940 - DNA, 25 bp, E. coli
catgcaccggcaactggaggctgac

SEQ ID NO: 111941 - DNA, 25 bp, E. coli
catctggaggctgaccacgataagc

SEQ ID NO: 111942 - DNA, 25 bp, E. coli
catctggaggctcaccacgataagc

SEQ ID NO: 111943 - DNA, 25 bp, E. coli
accggcatctggaggctgaccacga

SEQ ID NO: 111944 - DNA, 25 bp, E. coli
accacgataagcagccgctggtggt

SEQ ID NO: 111945 - DNA, 25 bp, E. coli
accacgataagctgccgctggtggt

SEQ ID NO: 111946 - DNA, 25 bp, E. coli
accggcatctggtggctgaccacga

SEQ ID NO: 111947 - DNA, 25 bp, E. coli
tgcaccggcatctggaggctgacca

SEQ ID NO: 111948 - DNA, 25 bp, E. coli
tgaccacgataacctgccgctggtg

SEQ ID NO: 111949 - DNA, 25 bp, E. coli
tgaccacgataagctgccgctggtg

SEQ ID NO: 111950 - DNA, 25 bp, E. coli
tgcaccggcatcaggaggctgacca

SEQ ID NO: 111951 - DNA, 25 bp, E. coli
tctggaggctgagcacgataagctg

SEQ ID NO: 111952 - DNA, 25 bp, E. coli
tctggaggctgaccacgataagctg

SEQ ID NO: 111953 - DNA, 25 bp, E. coli
tggaggctgaccacgataagctgcc

SEQ ID NO: 111954 - DNA, 25 bp, E. coli
ggcatctggaggctgaccacgataa

SEQ ID NO: 111955 - DNA, 25 bp, E. coli
ggctgaccacgataagctgccgctg

SEQ ID NO: 111956 - DNA, 25 bp, E. coli
ggctgaccacgaaaagctgccgctg

SEQ ID NO: 111957 - DNA, 25 bp, E. coli
ggcatctggagggtgaccacgataa

SEQ ID NO: 111958 - DNA, 25 bp, E. coli
tggaggctgacctcgataagctgcc

SEQ ID NO: 111959 - DNA, 25 bp, E. coli
aatcagatgcttaatcaagacgagc

SEQ ID NO: 111960 - DNA, 25 bp, E. coli
caaggaaatagttcaacagcaagca

SEQ ID NO: 111961 - DNA, 25 bp, E. coli
aatcagatgctttatcaagacgagc

SEQ ID NO: 111962 - DNA, 25 bp, E. coli
caaggaaatagtacaacagcaagca

SEQ ID NO: 111963 - DNA, 25 bp, E. coli
cactggtggctaaaaggagaaaaat

SEQ ID NO: 111964 - DNA, 25 bp, E. coli
cactggtggctataaggagaaaaat

SEQ ID NO: 111965 - DNA, 25 bp, E. coli
taaagttacagtgattcagcagcag

SEQ ID NO: 111966 - DNA, 25 bp, E. coli
tacgaccgactaaaaaagcgcatca

SEQ ID NO: 111967 - DNA, 25 bp, E. coli
taaagttacagtcattcagcagcag

SEQ ID NO: 111968 - DNA, 25 bp, E. coli
tacgaccgactataaaagcgcatca

SEQ ID NO: 111969 - DNA, 25 bp, E. coli
ttagatatgaaggagttactcggcg

SEQ ID NO: 111970 - DNA, 25 bp, E. coli
ttagatatgaagcagttactcggcg

SEQ ID NO: 111971 - DNA, 25 bp, E. coli
gccaggatatatattactcgttacg

SEQ ID NO: 111972 - DNA, 25 bp, E. coli
gccgagcggcgataaatacttaaca

SEQ ID NO: 111973 - DNA, 25 bp, E. coli
gccgagcggcgaaaaatacttaaca

SEQ ID NO: 111974 - DNA, 25 bp, E. coli
gccaggatatattttactcgttacg

SEQ ID NO: 111975 - DNA, 25 bp, E. coli
gcagcagatcgcagagataaatctt

SEQ ID NO: 111976 - DNA, 25 bp, E. coli
gcagcagatcgctgagataaatctt

SEQ ID NO: 111977 - DNA, 25 bp, E. coli
gcaacttaaaaacctgcagtcactg

SEQ ID NO: 111978 - DNA, 25 bp, E. coli
gcaacttaaaaagctgcagtcactg

SEQ ID NO: 111979 - DNA, 25 bp, E. coli
gaaaagcaaaaattagccgagcggc

SEQ ID NO: 111980 - DNA, 25 bp, E. coli
gaaaagcaaaaaatagccgagcggc

SEQ ID NO: 111981 - DNA, 25 bp, E. coli
caagttgtgcagaatatctacatcg

SEQ ID NO: 111982 - DNA, 25 bp, E. coli
caagttgtgcagtatatctacatcg

SEQ ID NO: 111983 - DNA, 25 bp, E. coli
accaaacctcatgggtggcaacggg

SEQ ID NO: 111984 - DNA, 25 bp, E. coli
accaaacctcatcggtggcaacggg

SEQ ID NO: 111985 - DNA, 25 bp, E. coli
tatctacatcgagacaagttacgga

SEQ ID NO: 111986 - DNA, 25 bp, E. coli
tatctacatcgacacaagttacgga

SEQ ID NO: 111987 - DNA, 25 bp, E. coli
ttgttttgctacgaaacctcatggg

SEQ ID NO: 111988 - DNA, 25 bp, E. coli
ttgttttgctaccaaacctcatggg

SEQ ID NO: 111989 - DNA, 25 bp, E. coli
tgctcatactgttaacaagttgtgc

SEQ ID NO: 111990 - DNA, 25 bp, E. coli
tgctcatactgtaaacaagttgtgc

SEQ ID NO: 111991 - DNA, 25 bp, E. coli
tcgttctttctcatcgcccatcagg

SEQ ID NO: 111992 - DNA, 25 bp, E. coli
tcttcgcccatctggcggtaaaaca

SEQ ID NO: 111993 - DNA, 25 bp, E. coli
tcttcgcccatcaggcggtaaaaca

SEQ ID NO: 111994 - DNA, 25 bp, E. coli
tcgttctttctcttcgcccatcagg

SEQ ID NO: 111995 - DNA, 25 bp, E. coli
ccaaagtacttcatacatatcacaa

SEQ ID NO: 111996 - DNA, 25 bp, E. coli
ccaaagtacttcttacatatcacaa

SEQ ID NO: 111997 - DNA, 25 bp, E. coli
gacaagttacggtcttatacttcca

SEQ ID NO: 111998 - DNA, 25 bp, E. coli
gacaagttacggacttatacttcca

SEQ ID NO: 111999 - DNA, 25 bp, E. coli
cgctactataggcagttggagtaaa

SEQ ID NO: 112000 - DNA, 25 bp, E. coli
cgctactatagggagttggagtaaa

SEQ ID NO: 112001 - DNA, 25 bp, E. coli
tggagtaaaacgctcaagaagaatt

SEQ ID NO: 112002 - DNA, 25 bp, E. coli
tggagtaaaacggtcaagaagaatt

SEQ ID NO: 112003 - DNA, 25 bp, E. coli
caaggcgtcacggtagatgatcaac

SEQ ID NO: 112004 - DNA, 25 bp, E. coli
caaggcgtcacgctagatgatcaac

SEQ ID NO: 112005 - DNA, 25 bp, E. coli
caagcagcgtttgggctgatgccgc

SEQ ID NO: 112006 - DNA, 25 bp, E. coli
caagctacggcaacctggctgaaag

SEQ ID NO: 112007 - DNA, 25 bp, E. coli
caagctacggcatcctggctgaaag

SEQ ID NO: 112008 - DNA, 25 bp, E. coli
caagcagcgtttcggctgatgccgc

SEQ ID NO: 112009 - DNA, 25 bp, E. coli
tacgccgtttatcctgattgcccgc

SEQ ID NO: 112010 - DNA, 25 bp, E. coli
taacgtgggacgagatggcacaatc

SEQ ID NO: 112011 - DNA, 25 bp, E. coli
tacgccgtttatgctgattgcccgc

SEQ ID NO: 112012 - DNA, 25 bp, E. coli
tgaaagatgccagcggtaatacgcc

SEQ ID NO: 112013 - DNA, 25 bp, E. coli
tgaaagatgccaccggtaatacgcc

SEQ ID NO: 112014 - DNA, 25 bp, E. coli
tccatcagtttagcgcggtggagca

SEQ ID NO: 112015 - DNA, 25 bp, E. coli
tccatcagtttaccgcggtggagca

SEQ ID NO: 112016 - DNA, 25 bp, E. coli
gcaggacgatcaccgcagcagttat

SEQ ID NO: 112017 - DNA, 25 bp, E. coli
gaagcagttcaccattaacgtggga

SEQ ID NO: 112018 - DNA, 25 bp, E. coli
gaagcagttcacgattaacgtggga

SEQ ID NO: 112019 - DNA, 25 bp, E. coli
gcaggacgatcagcgcagcagttat

SEQ ID NO: 112020 - DNA, 25 bp, E. coli
gataaagtcagctgcttccacgcca

SEQ ID NO: 112021 - DNA, 25 bp, E. coli
gataaagtcagcagcttccacgcca

SEQ ID NO: 112022 - DNA, 25 bp, E. coli
taacgtgggacgtgatggcacaatc

SEQ ID NO: 112023 - DNA, 25 bp, E. coli
taacccgttcgttgagcaagctacg

SEQ ID NO: 112024 - DNA, 25 bp, E. coli
taacccgttcgtagagcaagctacg

SEQ ID NO: 112025 - DNA, 25 bp, E. coli
aaggcttcctttgttgatgcatgtc

SEQ ID NO: 112026 - DNA, 25 bp, E. coli
aaggcttcctttcttgatgcatgtc

SEQ ID NO: 112027 - DNA, 25 bp, E. coli
caaattgtgaagtgaatgtgcttcc

SEQ ID NO: 112028 - DNA, 25 bp, E. coli
caaattgtgaagagaatgtgcttcc

SEQ ID NO: 112029 - DNA, 25 bp, E. coli
taaaaaggttgacttagatcgcaga

SEQ ID NO: 112030 - DNA, 25 bp, E. coli
taaatcagagccttagaggccacgc

SEQ ID NO: 112031 - DNA, 25 bp, E. coli
tacgatctgtattaagacggattgt

SEQ ID NO: 112032 - DNA, 25 bp, E. coli
taaatcagagccatagaggccacgc

SEQ ID NO: 112033 - DNA, 25 bp, E. coli
tacgatctgtataaagacggattgt

SEQ ID NO: 112034 - DNA, 25 bp, E. coli
taaaaaggttgagttagatcgcaga

SEQ ID NO: 112035 - DNA, 25 bp, E. coli
atatagccccgctaacgtgaccacg

SEQ ID NO: 112036 - DNA, 25 bp, E. coli
atatagccccgcaaacgtgaccacg

SEQ ID NO: 112037 - DNA, 25 bp, E. coli
tgcacaacgaggtagctaaaaggct

SEQ ID NO: 112038 - DNA, 25 bp, E. coli
tgcacaacgaggaagctaaaaggct

SEQ ID NO: 112039 - DNA, 25 bp, E. coli
tcgcagaaacgggtacatatagccc

SEQ ID NO: 112040 - DNA, 25 bp, E. coli
tcgcagaaacggctacatatagccc

SEQ ID NO: 112041 - DNA, 25 bp, E. coli
gcaggcgaggcatcaatctttacga

SEQ ID NO: 112042 - DNA, 25 bp, E. coli
gcaggcgaggcaacaatctttacga

SEQ ID NO: 112043 - DNA, 25 bp, E. coli
gaccacgcccgctgatattacttaa

SEQ ID NO: 112044 - DNA, 25 bp, E. coli
gaccacgcccgcagatattacttaa

SEQ ID NO: 112045 - DNA, 25 bp, E. coli
gatgcatgtcaagcacaaatctatc

SEQ ID NO: 112046 - DNA, 25 bp, E. coli
gatgcatgtcaaccacaaatctatc

SEQ ID NO: 112047 - DNA, 25 bp, E. coli
caggcgtagctggtctgctgagtgc

SEQ ID NO: 112048 - DNA, 25 bp, E. coli
caggcgtagctgctctgctgagtgc

SEQ ID NO: 112049 - DNA, 25 bp, E. coli
aggcgtagctgctctgctgagtgca

SEQ ID NO: 112050 - DNA, 25 bp, E. coli
aggcgtagctgcactgctgagtgca

SEQ ID NO: 112051 - DNA, 25 bp, E. coli
tagctgctctgcagagtgcaccacg

SEQ ID NO: 112052 - DNA, 25 bp, E. coli
tagctgctctgctgagtgcaccacg

SEQ ID NO: 112053 - DNA, 25 bp, E. coli
tgccaggcgtagctgctctgctgag

SEQ ID NO: 112054 - DNA, 25 bp, E. coli
tgccaggcgtaggtgctctgctgag

SEQ ID NO: 112055 - DNA, 25 bp, E. coli
gccaggcgtagcagctctgctgagt

SEQ ID NO: 112056 - DNA, 25 bp, E. coli
ccaggcgtagctgctctgctgagtg

SEQ ID NO: 112057 - DNA, 25 bp, E. coli
gccaggcgtagctgctctgctgagt

SEQ ID NO: 112058 - DNA, 25 bp, E. coli
ccaggcgtagctcctctgctgagtg

SEQ ID NO: 112059 - DNA, 25 bp, E. coli
gcgtagctgctcagctgagtgcacc

SEQ ID NO: 112060 - DNA, 25 bp, E. coli
gcgtagctgctctgctgagtgcacc

SEQ ID NO: 112061 - DNA, 25 bp, E. coli
cgtagctgctctgctgagtgcacca

SEQ ID NO: 112062 - DNA, 25 bp, E. coli
cgtagctgctctcctgagtgcacca

SEQ ID NO: 112063 - DNA, 25 bp, E. coli
gtgccaggcgtagctgctctgctga

SEQ ID NO: 112064 - DNA, 25 bp, E. coli
gtgccaggcgtacctgctctgctga

SEQ ID NO: 112065 - DNA, 25 bp, E. coli
ggcgtagctgctgtgctgagtgcac

SEQ ID NO: 112066 - DNA, 25 bp, E. coli
ggcgtagctgctctgctgagtgcac

SEQ ID NO: 112067 - DNA, 25 bp, E. coli
gtagctgctctggtgagtgcaccac

SEQ ID NO: 112068 - DNA, 25 bp, E. coli
gtagctgctctgctgagtgcaccac

SEQ ID NO: 112069 - DNA, 25 bp, E. coli
aacgcgccggagatcttcgacaagg

SEQ ID NO: 112070 - DNA, 25 bp, E. coli
caactgctacctggatctgatgcgc

SEQ ID NO: 112071 - DNA, 25 bp, E. coli
aacgcgccggagttcttcgacaagg

SEQ ID NO: 112072 - DNA, 25 bp, E. coli
caactgctacctcgatctgatgcgc

SEQ ID NO: 112073 - DNA, 25 bp, E. coli
tatgtgttcattcacggcgggccgc

SEQ ID NO: 112074 - DNA, 25 bp, E. coli
tatgtgttcattgacggcgggccgc

SEQ ID NO: 112075 - DNA, 25 bp, E. coli
tgtttaataagctgctcgcctcccg

SEQ ID NO: 112076 - DNA, 25 bp, E. coli
tgtttaataagcagctcgcctcccg

SEQ ID NO: 112077 - DNA, 25 bp, E. coli
tcccgcgacgtaatgatggagcacg

SEQ ID NO: 112078 - DNA, 25 bp, E. coli
tcccgcgacgtattgatggagcacg

SEQ ID NO: 112079 - DNA, 25 bp, E. coli
cgacgaaagagatagagagcctgcc

SEQ ID NO: 112080 - DNA, 25 bp, E. coli
cgacgaaagagaaagagagcctgcc

SEQ ID NO: 112081 - DNA, 25 bp, E. coli
cggacgttattgttgcgctggcaaa

SEQ ID NO: 112082 - DNA, 25 bp, E. coli
cggacgttattgatgcgctggcaaa

SEQ ID NO: 112083 - DNA, 25 bp, E. coli
gatcacgcgctgcaaatgaacaagt

SEQ ID NO: 112084 - DNA, 25 bp, E. coli
gatcacgcgctggaaatgaacaagt

SEQ ID NO: 112085 - DNA, 25 bp, E. coli
ggtacttacgcctaagaactgcgcg

SEQ ID NO: 112086 - DNA, 25 bp, E. coli
ggtacttacgccaaagaactgcgcg

SEQ ID NO: 112087 - DNA, 25 bp, E. coli
ggctgattacccagcaagatgatga

SEQ ID NO: 112088 - DNA, 25 bp, E. coli
ggctgattaccctgcaagatgatga

SEQ ID NO: 112089 - DNA, 25 bp, E. coli
gatggtacgcataaacaacgcaggc

SEQ ID NO: 112090 - DNA, 25 bp, E. coli
gatggtacgcattaacaacgcaggc

SEQ ID NO: 112091 - DNA, 25 bp, E. coli
cacggtttattgttctgggacggcg

SEQ ID NO: 112092 - DNA, 25 bp, E. coli
cacggtttattgatctgggacggcg

SEQ ID NO: 112093 - DNA, 25 bp, E. coli
cactgggcgcactgtatggctggca

SEQ ID NO: 112094 - DNA, 25 bp, E. coli
cactgggcgcacagtatggctggca

SEQ ID NO: 112095 - DNA, 25 bp, E. coli
ttgggctaccaaaggcggcttatct

SEQ ID NO: 112096 - DNA, 25 bp, E. coli
ttgggctaccaatggcggcttatct

SEQ ID NO: 112097 - DNA, 25 bp, E. coli
tctcatcggccacgtgaaattcctc

SEQ ID NO: 112098 - DNA, 25 bp, E. coli
tctcatcggccaggtgaaattcctc

SEQ ID NO: 112099 - DNA, 25 bp, E. coli
gcgatgcgccatgggtaaaaagcct

SEQ ID NO: 112100 - DNA, 25 bp, E. coli
gctgttttatggcttctggccgcaa

SEQ ID NO: 112101 - DNA, 25 bp, E. coli
gcgatgcgccatcggtaaaaagcct

SEQ ID NO: 112102 - DNA, 25 bp, E. coli
gctattaaacatgagcgcctttggg

SEQ ID NO: 112103 - DNA, 25 bp, E. coli
gctattaaacatcagcgcctttggg

SEQ ID NO: 112104 - DNA, 25 bp, E. coli
gctgttttatgggttctggccgcaa

SEQ ID NO: 112105 - DNA, 25 bp, E. coli
cgtttcaggcgaatggctatgcgtc

SEQ ID NO: 112106 - DNA, 25 bp, E. coli
cgtttcaggcgattggctatgcgtc

SEQ ID NO: 112107 - DNA, 25 bp, E. coli
gatccagtcgcgcttaacgctgtta

SEQ ID NO: 112108 - DNA, 25 bp, E. coli
ggctctggcgtcagttaactttgcg

SEQ ID NO: 112109 - DNA, 25 bp, E. coli
ggcctgcaaatgttgctgccccgtg

SEQ ID NO: 112110 - DNA, 25 bp, E. coli
ggcctgcaaatgatgctgccccgtg

SEQ ID NO: 112111 - DNA, 25 bp, E. coli
ggctctggcgtctgttaactttgcg

SEQ ID NO: 112112 - DNA, 25 bp, E. coli
gatccagtcgcggttaacgctgtta

SEQ ID NO: 112113 - DNA, 25 bp, E. coli
caaatgcggcattgtctgggaacga

SEQ ID NO: 112114 - DNA, 25 bp, E. coli
caaatgcggcatagtctgggaacga

SEQ ID NO: 112115 - DNA, 25 bp, E. coli
tataggcgctgctaacgtcgatgct

SEQ ID NO: 112116 - DNA, 25 bp, E. coli
tataggcgctgcaaacgtcgatgct

SEQ ID NO: 112117 - DNA, 25 bp, E. coli
tcgatgctgaccatatccgcgagta

SEQ ID NO: 112118 - DNA, 25 bp, E. coli
tcgatgctgaccttatccgcgagta

SEQ ID NO: 112119 - DNA, 25 bp, E. coli
gccccgtgaacaggttgtagtagaa

SEQ ID NO: 112120 - DNA, 25 bp, E. coli
gccccgtgaacacgttgtagtagaa

SEQ ID NO: 112121 - DNA, 25 bp, E. coli
gaaatacagtatcctcgaccgggca

SEQ ID NO: 112122 - DNA, 25 bp, E. coli
gaaatacagtatgctcgaccgggca

SEQ ID NO: 112123 - DNA, 25 bp, E. coli
cgaccgggcaatggaaaacgaactg

SEQ ID NO: 112124 - DNA, 25 bp, E. coli
cgaccgggcaatcgaaaacgaactg

SEQ ID NO: 112125 - DNA, 25 bp, E. coli
cattggcggcggtcctgcatggaat

SEQ ID NO: 112126 - DNA, 25 bp, E. coli
cattggcggcggacctgcatggaat

SEQ ID NO: 112127 - DNA, 25 bp, E. coli
gatatgcttgaagagtggcagccac

SEQ ID NO: 112128 - DNA, 25 bp, E. coli
gatatgcttgaacagtggcagccac

SEQ ID NO: 112129 - DNA, 25 bp, E. coli
gatatctacatgtcgcactggcagt

SEQ ID NO: 112130 - DNA, 25 bp, E. coli
gatatctacatgacgcactggcagt

SEQ ID NO: 112131 - DNA, 25 bp, E. coli
ggcgctcgggcatataaagtctggt

SEQ ID NO: 112132 - DNA, 25 bp, E. coli
ggcgctcgggcaaataaagtctggt

SEQ ID NO: 112133 - DNA, 25 bp, E. coli
tcaacttatcggttgcagacgcaac

SEQ ID NO: 112134 - DNA, 25 bp, E. coli
tcaacttatcggatgcagacgcaac

SEQ ID NO: 112135 - DNA, 25 bp, E. coli
aaggagctgatcgttgaaatggcgc

SEQ ID NO: 112136 - DNA, 25 bp, E. coli
aaggagctgatccttgaaatggcgc

SEQ ID NO: 112137 - DNA, 25 bp, E. coli
catgtaaacgtgatttccagctcac

SEQ ID NO: 112138 - DNA, 25 bp, E. coli
catgtaaacgtgttttccagctcac

SEQ ID NO: 112139 - DNA, 25 bp, E. coli
aaacccggctttaaggagctgatcg

SEQ ID NO: 112140 - DNA, 25 bp, E. coli
aaacccggcttttaggagctgatcg

SEQ ID NO: 112141 - DNA, 25 bp, E. coli
taccgttactgttcattgtccgcgc

SEQ ID NO: 112142 - DNA, 25 bp, E. coli
taccgttactgtacattgtccgcgc

SEQ ID NO: 112143 - DNA, 25 bp, E. coli
tgttcccagcatcagcgtttccgtt

SEQ ID NO: 112144 - DNA, 25 bp, E. coli
tgttcccagcatgagcgtttccgtt

SEQ ID NO: 112145 - DNA, 25 bp, E. coli
tgtccgcgctgttattccgataaag

SEQ ID NO: 112146 - DNA, 25 bp, E. coli
tgtccgcgctgtaattccgataaag

SEQ ID NO: 112147 - DNA, 25 bp, E. coli
tgaaatggcgcaaaatggcacaggg

SEQ ID NO: 112148 - DNA, 25 bp, E. coli
tgaaatggcgcataatggcacaggg

SEQ ID NO: 112149 - DNA, 25 bp, E. coli
tcttatgaagccagaaaacccggct

SEQ ID NO: 112150 - DNA, 25 bp, E. coli
tcttatgaagcctgaaaacccggct

SEQ ID NO: 112151 - DNA, 25 bp, E. coli
gacatggtcgtagttgttcccagca

SEQ ID NO: 112152 - DNA, 25 bp, E. coli
gacatggtcgtacttgttcccagca

SEQ ID NO: 112153 - DNA, 25 bp, E. coli
gtttccgttgtcgttcatgtaaacg

SEQ ID NO: 112154 - DNA, 25 bp, E. coli
gtttccgttgtccttcatgtaaacg

SEQ ID NO: 112155 - DNA, 25 bp, E. coli
gggccgtgatatcgccagaacactg

SEQ ID NO: 112156 - DNA, 25 bp, E. coli
gggccgtgatatggccagaacactg

SEQ ID NO: 112157 - DNA, 25 bp, E. coli
cagccgaaaattttgcgcgtgttgt

SEQ ID NO: 112158 - DNA, 25 bp, E. coli
cagccgaaaattatgcgcgtgttgt

SEQ ID NO: 112159 - DNA, 25 bp, E. coli
tacaatcgccgccttgaactgcatc

SEQ ID NO: 112160 - DNA, 25 bp, E. coli
tacaatcgccgcgttgaactgcatc

SEQ ID NO: 112161 - DNA, 25 bp, E. coli
atgtgccgtgatggtatccagctta

SEQ ID NO: 112162 - DNA, 25 bp, E. coli
atgtgccgtgatcgtatccagctta

SEQ ID NO: 112163 - DNA, 25 bp, E. coli
aaaattatgcgcgtgttgttgctga

SEQ ID NO: 112164 - DNA, 25 bp, E. coli
aaaattatgcgcctgttgttgctga

SEQ ID NO: 112165 - DNA, 25 bp, E. coli
ttaatccgccgcctatctggaatca

SEQ ID NO: 112166 - DNA, 25 bp, E. coli
ttaatccgccgcgtatctggaatca

SEQ ID NO: 112167 - DNA, 25 bp, E. coli
tgatgtgccgtgttggtatccagct

SEQ ID NO: 112168 - DNA, 25 bp, E. coli
tgatgtgccgtgatggtatccagct

SEQ ID NO: 112169 - DNA, 25 bp, E. coli
gccgcgttgaactgcatcgggagaa

SEQ ID NO: 112170 - DNA, 25 bp, E. coli
gccgcgttgaacagcatcgggagaa

SEQ ID NO: 112171 - DNA, 25 bp, E. coli
gcatcgggagaatgaaaaaataacg

SEQ ID NO: 112172 - DNA, 25 bp, E. coli
gcatcgggagaaagaaaaaataacg

SEQ ID NO: 112173 - DNA, 25 bp, E. coli
cgttgaactgcaacgggagaaagaa

SEQ ID NO: 112174 - DNA, 25 bp, E. coli
cgttgaactgcatcgggagaaagaa

SEQ ID NO: 112175 - DNA, 25 bp, E. coli
ccgcgtatctggtatcagccagcag

SEQ ID NO: 112176 - DNA, 25 bp, E. coli
ccgcgtatctggaatcagccagcag

SEQ ID NO: 112177 - DNA, 25 bp, E. coli
cgtgacagccgaaaattatgcgcgt

SEQ ID NO: 112178 - DNA, 25 bp, E. coli
cgtgacagccgataattatgcgcgt

SEQ ID NO: 112179 - DNA, 25 bp, E. coli
gactgcgcccgtgtctgatggtaga

SEQ ID NO: 112180 - DNA, 25 bp, E. coli
gactgcgcccgtctctgatggtaga

SEQ ID NO: 112181 - DNA, 25 bp, E. coli
caggttgcgttgctacaaactcagg

SEQ ID NO: 112182 - DNA, 25 bp, E. coli
caggttgcgttggtacaaactcagg

SEQ ID NO: 112183 - DNA, 25 bp, E. coli
tttgttggcattaaccaggcagggc

SEQ ID NO: 112184 - DNA, 25 bp, E. coli
tttcagatattatcgccgggcgcga

SEQ ID NO: 112185 - DNA, 25 bp, E. coli
tttgttggcatttaccaggcagggc

SEQ ID NO: 112186 - DNA, 25 bp, E. coli
tttcagatattaacgccgggcgcga

SEQ ID NO: 112187 - DNA, 25 bp, E. coli
tgaatatgggacagccactggcgac

SEQ ID NO: 112188 - DNA, 25 bp, E. coli
tgaatatgggactgccactggcgac

SEQ ID NO: 112189 - DNA, 25 bp, E. coli
tcttttgatgtagaagccgggctgc

SEQ ID NO: 112190 - DNA, 25 bp, E. coli
tcttttgatgtacaagccgggctgc

SEQ ID NO: 112191 - DNA, 25 bp, E. coli
gaagcgttagatccgaatagcccgc

SEQ ID NO: 112192 - DNA, 25 bp, E. coli
gaagcccagattgctgactcgcgta

SEQ ID NO: 112193 - DNA, 25 bp, E. coli
gaagcgttagatgcgaatagcccgc

SEQ ID NO: 112194 - DNA, 25 bp, E. coli
gaagcccagattcctgactcgcgta

SEQ ID NO: 112195 - DNA, 25 bp, E. coli
gaaatgaccgatgccttgctgcgtg

SEQ ID NO: 112196 - DNA, 25 bp, E. coli
gaaatgaccgatcccttgctgcgtg

SEQ ID NO: 112197 - DNA, 25 bp, E. coli
cgagggcaatcactcttccgagcaa

SEQ ID NO: 112198 - DNA, 25 bp, E. coli
cgagggcaatcagtcttccgagcaa

SEQ ID NO: 112199 - DNA, 25 bp, E. coli
gatttaaagcccatgccgcagaggt

SEQ ID NO: 112200 - DNA, 25 bp, E. coli
gatttaaagcccttgccgcagaggt

SEQ ID NO: 112201 - DNA, 25 bp, E. coli
aatgaaaggcgttctgggctacacc

SEQ ID NO: 112202 - DNA, 25 bp, E. coli
aatgaaaggcgtactgggctacacc

SEQ ID NO: 112203 - DNA, 25 bp, E. coli
caacttcgtgaatctggtatcctgg

SEQ ID NO: 112204 - DNA, 25 bp, E. coli
caaactgactggtatggcgttccgc

SEQ ID NO: 112205 - DNA, 25 bp, E. coli
caaactgactggaatggcgttccgc

SEQ ID NO: 112206 - DNA, 25 bp, E. coli
caacttcgtgaaactggtatcctgg

SEQ ID NO: 112207 - DNA, 25 bp, E. coli
aaagttctggacctgatcgctcaca

SEQ ID NO: 112208 - DNA, 25 bp, E. coli
aaagttctggacgtgatcgctcaca

SEQ ID NO: 112209 - DNA, 25 bp, E. coli
tgttcctgactgacgaaactgctcg

SEQ ID NO: 112210 - DNA, 25 bp, E. coli
tgttcctgactgtcgaaactgctcg

SEQ ID NO: 112211 - DNA, 25 bp, E. coli
tgctcgtaaacacatcaccgctggt

SEQ ID NO: 112212 - DNA, 25 bp, E. coli
tgatggcccgtctcacaaagactgg

SEQ ID NO: 112213 - DNA, 25 bp, E. coli
tgaaatatgactccactcacggccg

SEQ ID NO: 112214 - DNA, 25 bp, E. coli
tgaaatatgactgcactcacggccg

SEQ ID NO: 112215 - DNA, 25 bp, E. coli
tgctcgtaaacagatcaccgctggt

SEQ ID NO: 112216 - DNA, 25 bp, E. coli
tgatggcccgtcacacaaagactgg

SEQ ID NO: 112217 - DNA, 25 bp, E. coli
cgtgatccggcttacctgaaatggg

SEQ ID NO: 112218 - DNA, 25 bp, E. coli
cgtgatccggctaacctgaaatggg

SEQ ID NO: 112219 - DNA, 25 bp, E. coli
taacttcgacaattatgctggccag

SEQ ID NO: 112220 - DNA, 25 bp, E. coli
taacttcgacaaatatgctggccag

SEQ ID NO: 112221 - DNA, 25 bp, E. coli
gaccgttcgtctcgaaaaagctgca

SEQ ID NO: 112222 - DNA, 25 bp, E. coli
gaccgttcgtctggaaaaagctgca

SEQ ID NO: 112223 - DNA, 25 bp, E. coli
aatttggtggcttcgacgggattcg

SEQ ID NO: 112224 - DNA, 25 bp, E. coli
aatttggtggctacgacgggattcg

SEQ ID NO: 112225 - DNA, 25 bp, E. coli
tacgacgggattcgaacctgtgacc

SEQ ID NO: 112226 - DNA, 25 bp, E. coli
tacgacgggattggaacctgtgacc

SEQ ID NO: 112227 - DNA, 25 bp, E. coli
tcgaacctgtgaccccatcattatg

SEQ ID NO: 112228 - DNA, 25 bp, E. coli
tcgaacctgtgagcccatcattatg

SEQ ID NO: 112229 - DNA, 25 bp, E. coli
cgtattcgacactttcagaatttgg

SEQ ID NO: 112230 - DNA, 25 bp, E. coli
cgtattcgacacattcagaatttgg

SEQ ID NO: 112231 - DNA, 25 bp, E. coli
cttgaataaattggctggggtacga

SEQ ID NO: 112232 - DNA, 25 bp, E. coli
cttgaataaattcgctggggtacga

SEQ ID NO: 112233 - DNA, 25 bp, E. coli
cattcagaatttggtggctacgacg

SEQ ID NO: 112234 - DNA, 25 bp, E. coli
cattcagaatttcgtggctacgacg

SEQ ID NO: 112235 - DNA, 25 bp, E. coli
cgataccccaacagggtgcacttac

SEQ ID NO: 112236 - DNA, 25 bp, E. coli
cgataccccaactgggtgcacttac

SEQ ID NO: 112237 - DNA, 25 bp, E. coli
gggattcgaaccagtgaccccatca

SEQ ID NO: 112238 - DNA, 25 bp, E. coli
gggattcgaacctgtgaccccatca

SEQ ID NO: 112239 - DNA, 25 bp, E. coli
tggcgatacccctactgggtgcact

SEQ ID NO: 112240 - DNA, 25 bp, E. coli
tggctacgacggcattcgaacctgt

SEQ ID NO: 112241 - DNA, 25 bp, E. coli
tggcgataccccaacaaattggttt

SEQ ID NO: 112242 - DNA, 25 bp, E. coli
tggcgatacccctacaaattggttt

SEQ ID NO: 112243 - DNA, 25 bp, E. coli
tggcgataccccaactgggtgcact

SEQ ID NO: 112244 - DNA, 25 bp, E. coli
tggctacgacgggattcgaacctgt

SEQ ID NO: 112245 - DNA, 25 bp, E. coli
cacattacgattgccgcccggatga

SEQ ID NO: 112246 - DNA, 25 bp, E. coli
cacattacgattcccgcccggatga

SEQ ID NO: 112247 - DNA, 25 bp, E. coli
catgacgggccaatgtgatattgcg

SEQ ID NO: 112248 - DNA, 25 bp, E. coli
cagtatcaacaggttgcggcggtta

SEQ ID NO: 112249 - DNA, 25 bp, E. coli
catgcgggagtcactcagtatcagg

SEQ ID NO: 112250 - DNA, 25 bp, E. coli
catgcgggagtctctcagtatcagg

SEQ ID NO: 112251 - DNA, 25 bp, E. coli
cagtatcaacagcttgcggcggtta

SEQ ID NO: 112252 - DNA, 25 bp, E. coli
catgacgggccattgtgatattgcg

SEQ ID NO: 112253 - DNA, 25 bp, E. coli
tacgctggcgtaaaccgatgcgcag

SEQ ID NO: 112254 - DNA, 25 bp, E. coli
tacgctggcgtataccgatgcgcag

SEQ ID NO: 112255 - DNA, 25 bp, E. coli
tattgcgccggaacggaaaaccgat

SEQ ID NO: 112256 - DNA, 25 bp, E. coli
tattgcgccggatcggaaaaccgat

SEQ ID NO: 112257 - DNA, 25 bp, E. coli
tcgccgtgatggagaaatagtccag

SEQ ID NO: 112258 - DNA, 25 bp, E. coli
tcgccgtgatggtgaaatagtccag

SEQ ID NO: 112259 - DNA, 25 bp, E. coli
tctttgctgagatcgcccatttgcg

SEQ ID NO: 112260 - DNA, 25 bp, E. coli
tctttgctgagaacgcccatttgcg

SEQ ID NO: 112261 - DNA, 25 bp, E. coli
ggatcgacgcataattcactggaac

SEQ ID NO: 112262 - DNA, 25 bp, E. coli
ggatcgacgcattattcactggaac

SEQ ID NO: 112263 - DNA, 25 bp, E. coli
ggtggtgcacaatattagcctgccg

SEQ ID NO: 112264 - DNA, 25 bp, E. coli
ggtggtgcacaaaattagcctgccg

SEQ ID NO: 112265 - DNA, 25 bp, E. coli
tcactggaactattgatccgcaggc

SEQ ID NO: 112266 - DNA, 25 bp, E. coli
tcactggaactaatgatccgcaggc

SEQ ID NO: 112267 - DNA, 25 bp, E. coli
cacgcgctgcatgtatgttcagaaa

SEQ ID NO: 112268 - DNA, 25 bp, E. coli
cacgcgctgcatctatgttcagaaa

SEQ ID NO: 112269 - DNA, 25 bp, E. coli
tttgcaaccgtgatcttgtttggcc

SEQ ID NO: 112270 - DNA, 25 bp, E. coli
tattgtttaacagattcacgcgctg

SEQ ID NO: 112271 - DNA, 25 bp, E. coli
tattgtttaacacattcacgcgctg

SEQ ID NO: 112272 - DNA, 25 bp, E. coli
tatagccggtcagtgcattcaccac

SEQ ID NO: 112273 - DNA, 25 bp, E. coli
tttgcaaccgtgttcttgtttggcc

SEQ ID NO: 112274 - DNA, 25 bp, E. coli
tatagccggtcactgcattcaccac

SEQ ID NO: 112275 - DNA, 25 bp, E. coli
tgtttggcctttgcttatagccggt

SEQ ID NO: 112276 - DNA, 25 bp, E. coli
tgtttggcctttccttatagccggt

SEQ ID NO: 112277 - DNA, 25 bp, E. coli
gaaaaatgacctttcctgaggtaca

SEQ ID NO: 112278 - DNA, 25 bp, E. coli
gaaaaatgacctatcctgaggtaca

SEQ ID NO: 112279 - DNA, 25 bp, E. coli
gtatgttcagaaaatgtgcacgcta

SEQ ID NO: 112280 - DNA, 25 bp, E. coli
gattactgcggataaagtcatctac

SEQ ID NO: 112281 - DNA, 25 bp, E. coli
gattactgcggaaaaagtcatctac

SEQ ID NO: 112282 - DNA, 25 bp, E. coli
gtatgttcagaatatgtgcacgcta

SEQ ID NO: 112283 - DNA, 25 bp, E. coli
gtgcattcaccaccacaagcagata

SEQ ID NO: 112284 - DNA, 25 bp, E. coli
gtgcattcaccagcacaagcagata

SEQ ID NO: 112285 - DNA, 25 bp, E. coli
gaggtacagttgctcgctcaaatcc

SEQ ID NO: 112286 - DNA, 25 bp, E. coli
gagattcaatatttaagggcacggt

SEQ ID NO: 112287 - DNA, 25 bp, E. coli
gagattcaatatataagggcacggt

SEQ ID NO: 112288 - DNA, 25 bp, E. coli
gaggtacagttggtcgctcaaatcc

SEQ ID NO: 112289 - DNA, 25 bp, E. coli
caagaaaagaaacaactgacgcaca

SEQ ID NO: 112290 - DNA, 25 bp, E. coli
caagttacggatcttacgagtagct

SEQ ID NO: 112291 - DNA, 25 bp, E. coli
caagttacggatgttacgagtagct

SEQ ID NO: 112292 - DNA, 25 bp, E. coli
caagaaaagaaagaactgacgcaca

SEQ ID NO: 112293 - DNA, 25 bp, E. coli
agcggttccgctggaggctcagata

SEQ ID NO: 112294 - DNA, 25 bp, E. coli
agcggttccgctcgaggctcagata

SEQ ID NO: 112295 - DNA, 25 bp, E. coli
tataaaattaccgatgccgccgtca

SEQ ID NO: 112296 - DNA, 25 bp, E. coli
tataaaattacccatgccgccgtca

SEQ ID NO: 112297 - DNA, 25 bp, E. coli
tatcattcagacaacagcggttccg

SEQ ID NO: 112298 - DNA, 25 bp, E. coli
tatcattcagactacagcggttccg

SEQ ID NO: 112299 - DNA, 25 bp, E. coli
ttgttcccacaaccaaagacgagac

SEQ ID NO: 112300 - DNA, 25 bp, E. coli
ttgttcccacaagcaaagacgagac

SEQ ID NO: 112301 - DNA, 25 bp, E. coli
tgtcgcgcatgtaaaagtggagtct

SEQ ID NO: 112302 - DNA, 25 bp, E. coli
tgtcgcgcatgttaaagtggagtct

SEQ ID NO: 112303 - DNA, 25 bp, E. coli
taatacccaagtgcaaattgccgta

SEQ ID NO: 112304 - DNA, 25 bp, E. coli
taatacccaagtccaaattgccgta

SEQ ID NO: 112305 - DNA, 25 bp, E. coli
ccacaattacagcaacaagttacgg

SEQ ID NO: 112306 - DNA, 25 bp, E. coli
ccacaattacaggaacaagttacgg

SEQ ID NO: 112307 - DNA, 25 bp, E. coli
cgtatgttcctttgttgcagcccaa

SEQ ID NO: 112308 - DNA, 25 bp, E. coli
cgtatgttccttagttgcagcccaa

SEQ ID NO: 112309 - DNA, 25 bp, E. coli
tggagatatcatgcgtagcaacatg

SEQ ID NO: 112310 - DNA, 25 bp, E. coli
tggagatatcatccgtagcaacatg

SEQ ID NO: 112311 - DNA, 25 bp, E. coli
aacgtatgagatgacggcatcggca

SEQ ID NO: 112312 - DNA, 25 bp, E. coli
aacgtatgagatcacggcatcggca

SEQ ID NO: 112313 - DNA, 25 bp, E. coli
actaatgcggcaggtaaagcggaca

SEQ ID NO: 112314 - DNA, 25 bp, E. coli
actaatgcggcacgtaaagcggaca

SEQ ID NO: 112315 - DNA, 25 bp, E. coli
tatgtgggtcgagattaagacgcca

SEQ ID NO: 112316 - DNA, 25 bp, E. coli
tatgtgggtcgacattaagacgcca

SEQ ID NO: 112317 - DNA, 25 bp, E. coli
tatcgactgcgaagctggaggtgac

SEQ ID NO: 112318 - DNA, 25 bp, E. coli
tatcgactgcgatgctggaggtgac

SEQ ID NO: 112319 - DNA, 25 bp, E. coli
taccgaattggccaacctttggcga

SEQ ID NO: 112320 - DNA, 25 bp, E. coli
taccgaattggcgaacctttggcga

SEQ ID NO: 112321 - DNA, 25 bp, E. coli
ttgacgttgactgcggtggactccg

SEQ ID NO: 112322 - DNA, 25 bp, E. coli
ttgacgttgactccggtggactccg

SEQ ID NO: 112323 - DNA, 25 bp, E. coli
gaatagccagccatcgaatacgcag

SEQ ID NO: 112324 - DNA, 25 bp, E. coli
gaatagccagccttcgaatacgcag

SEQ ID NO: 112325 - DNA, 25 bp, E. coli
gaaatgaagccagtgacggtgacca

SEQ ID NO: 112326 - DNA, 25 bp, E. coli
gaaatgaagccactgacggtgacca

SEQ ID NO: 112327 - DNA, 25 bp, E. coli
cattaccgcggtggatgccgatacg

SEQ ID NO: 112328 - DNA, 25 bp, E. coli
cattaccgcggtcgatgccgatacg

SEQ ID NO: 112329 - DNA, 25 bp, E. coli
gattggcaactatgcactggcggac

SEQ ID NO: 112330 - DNA, 25 bp, E. coli
gattggcaactaagcactggcggac

SEQ ID NO: 112331 - DNA, 25 bp, E. coli
ggtgaaattcaacgcggatgccagc

SEQ ID NO: 112332 - DNA, 25 bp, E. coli
ggtgaaattcaaggcggatgccagc

SEQ ID NO: 112333 - DNA, 25 bp, E. coli
cagcagcacccgcttgtcgttttgt

SEQ ID NO: 112334 - DNA, 25 bp, E. coli
cagcagcacccggttgtcgttttgt

SEQ ID NO: 112335 - DNA, 25 bp, E. coli
aggtacccaggaagcccgtgaactg

SEQ ID NO: 112336 - DNA, 25 bp, E. coli
aggtacccaggatgcccgtgaactg

SEQ ID NO: 112337 - DNA, 25 bp, E. coli
tagtcatgcatgaggaaaaaggcaa

SEQ ID NO: 112338 - DNA, 25 bp, E. coli
tagtcatgcatgtggaaaaaggcaa

SEQ ID NO: 112339 - DNA, 25 bp, E. coli
ttgccggactggctactcatgccgc

SEQ ID NO: 112340 - DNA, 25 bp, E. coli
ttgccggactgggtactcatgccgc

SEQ ID NO: 112341 - DNA, 25 bp, E. coli
tcatcattttacaggcgctcgctgc

SEQ ID NO: 112342 - DNA, 25 bp, E. coli
tcatgccgcctgcagtagcaatggt

SEQ ID NO: 112343 - DNA, 25 bp, E. coli
tcatgccgcctggagtagcaatggt

SEQ ID NO: 112344 - DNA, 25 bp, E. coli
tcatcattttactggcgctcgctgc

SEQ ID NO: 112345 - DNA, 25 bp, E. coli
gcttgtcagataaaacaggtattac

SEQ ID NO: 112346 - DNA, 25 bp, E. coli
gcttgtcagatataacaggtattac

SEQ ID NO: 112347 - DNA, 25 bp, E. coli
gcgacatttaaacctgattatctgg

SEQ ID NO: 112348 - DNA, 25 bp, E. coli
gcgacatttaaagctgattatctgg

SEQ ID NO: 112349 - DNA, 25 bp, E. coli
cgcttttagtgcagatatccctgat

SEQ ID NO: 112350 - DNA, 25 bp, E. coli
cgcttttagtgctgatatccctgat

SEQ ID NO: 112351 - DNA, 25 bp, E. coli
cattgcctgacaaatattgctaaag

SEQ ID NO: 112352 - DNA, 25 bp, E. coli
cgttcaaccaatgaatgcttgtcag

SEQ ID NO: 112353 - DNA, 25 bp, E. coli
cattgcctgacatatattgctaaag

SEQ ID NO: 112354 - DNA, 25 bp, E. coli
cgttcaaccaatcaatgcttgtcag

SEQ ID NO: 112355 - DNA, 25 bp, E. coli
tagcttgtgccggttataaccagga

SEQ ID NO: 112356 - DNA, 25 bp, E. coli
tagcttgtgccgcttataaccagga

SEQ ID NO: 112357 - DNA, 25 bp, E. coli
tttatttccagaccaggcgtacccg

SEQ ID NO: 112358 - DNA, 25 bp, E. coli
tttatttccagagcaggcgtacccg

SEQ ID NO: 112359 - DNA, 25 bp, E. coli
tcccggcagtgctaatgttggctat

SEQ ID NO: 112360 - DNA, 25 bp, E. coli
tcccggcagtgcaaatgttggctat

SEQ ID NO: 112361 - DNA, 25 bp, E. coli
tctgcgggtatttgcgactcaggat

SEQ ID NO: 112362 - DNA, 25 bp, E. coli
tctgcgggtattagcgactcaggat

SEQ ID NO: 112363 - DNA, 25 bp, E. coli
gctttgcagcgtagtggaggcctcc

SEQ ID NO: 112364 - DNA, 25 bp, E. coli
gctttgcagcgttgtggaggcctcc

SEQ ID NO: 112365 - DNA, 25 bp, E. coli
gcatttccgaatagatgtctgcggg

SEQ ID NO: 112366 - DNA, 25 bp, E. coli
gcatttccgaattgatgtctgcggg

SEQ ID NO: 112367 - DNA, 25 bp, E. coli
gacgtctcaggagacagtaacctat

SEQ ID NO: 112368 - DNA, 25 bp, E. coli
gacgtctcaggacacagtaacctat

SEQ ID NO: 112369 - DNA, 25 bp, E. coli
gatatcaaaaatagccatccggttt

SEQ ID NO: 112370 - DNA, 25 bp, E. coli
gatatcaaaaattgccatccggttt

SEQ ID NO: 112371 - DNA, 25 bp, E. coli
ggcgtacccggtatcggtgcttcat

SEQ ID NO: 112372 - DNA, 25 bp, E. coli
ggcgtacccggtttcggtgcttcat

SEQ ID NO: 112373 - DNA, 25 bp, E. coli
tggacggcacggtgcaaaaggctct

SEQ ID NO: 112374 - DNA, 25 bp, E. coli
tggacggcacggagcaaaaggctct

SEQ ID NO: 112375 - DNA, 25 bp, E. coli
ggccaattgatgttccgctgacgtc

SEQ ID NO: 112376 - DNA, 25 bp, E. coli
ggccaattgatgatccgctgacgtc

SEQ ID NO: 112377 - DNA, 25 bp, E. coli
aatggaccgggatgcaggtgaaata

SEQ ID NO: 112378 - DNA, 25 bp, E. coli
aatggaccgggaagcaggtgaaata

SEQ ID NO: 112379 - DNA, 25 bp, E. coli
cagcgatgcgctctatctcgatgaa

SEQ ID NO: 112380 - DNA, 25 bp, E. coli
cagcgatgcgctgtatctcgatgaa

SEQ ID NO: 112381 - DNA, 25 bp, E. coli
gacgggaacggtgactttccgccat

SEQ ID NO: 112382 - DNA, 25 bp, E. coli
gacgggaacggtcactttccgccat

SEQ ID NO: 112383 - DNA, 25 bp, E. coli
acattccggtgaccgttgaacgcca

SEQ ID NO: 112384 - DNA, 25 bp, E. coli
acattccggtgagcgttgaacgcca

SEQ ID NO: 112385 - DNA, 25 bp, E. coli
taccagcgagcaggatgcagttctg

SEQ ID NO: 112386 - DNA, 25 bp, E. coli
taccagcgagcacgatgcagttctg

SEQ ID NO: 112387 - DNA, 25 bp, E. coli
tgccggtgaaagaactgacgggaac

SEQ ID NO: 112388 - DNA, 25 bp, E. coli
tgccggtgaaagtactgacgggaac

SEQ ID NO: 112389 - DNA, 25 bp, E. coli
tgaaatgggcgaactggcctatatg

SEQ ID NO: 112390 - DNA, 25 bp, E. coli
tgaaatgggcgatctggcctatatg

SEQ ID NO: 112391 - DNA, 25 bp, E. coli
ccggtgaccagctatgagattgaca

SEQ ID NO: 112392 - DNA, 25 bp, E. coli
ccggtgaccagcaatgagattgaca

SEQ ID NO: 112393 - DNA, 25 bp, E. coli
gcttctcgcaaatagggcaattcgt

SEQ ID NO: 112394 - DNA, 25 bp, E. coli
gcttctcgcaaaaagggcaattcgt

SEQ ID NO: 112395 - DNA, 25 bp, E. coli
cgttctgcctcctgctcgttatgtg

SEQ ID NO: 112396 - DNA, 25 bp, E. coli
cgttctgcctccagctcgttatgtg

SEQ ID NO: 112397 - DNA, 25 bp, E. coli
ggctcaacaaagtaacattccggtg

SEQ ID NO: 112398 - DNA, 25 bp, E. coli
ggctcaacaaagaaacattccggtg

SEQ ID NO: 112399 - DNA, 25 bp, E. coli
aatctgaaacgatacctgacagcgc

SEQ ID NO: 112400 - DNA, 25 bp, E. coli
aatctgaaacgaaacctgacagcgc

SEQ ID NO: 112401 - DNA, 25 bp, E. coli
caacacaaatattgacctgaagcgg

SEQ ID NO: 112402 - DNA, 25 bp, E. coli
caacacaaatatagacctgaagcgg

SEQ ID NO: 112403 - DNA, 25 bp, E. coli
tctaaaaaatagagagccccgttag

SEQ ID NO: 112404 - DNA, 25 bp, E. coli
tctaaaaaatagtgagccccgttag

SEQ ID NO: 112405 - DNA, 25 bp, E. coli
gcaagaggtcgcttcacgcgataaa

SEQ ID NO: 112406 - DNA, 25 bp, E. coli
gaagctttcagtgtcagcgacggtg

SEQ ID NO: 112407 - DNA, 25 bp, E. coli
gcaagaggtcgcatcacgcgataaa

SEQ ID NO: 112408 - DNA, 25 bp, E. coli
gaagctttcagtctcagcgacggtg

SEQ ID NO: 112409 - DNA, 25 bp, E. coli
cttctgacaaaataggcgcatcccc

SEQ ID NO: 112410 - DNA, 25 bp, E. coli
cttctgacaaaaaaggcgcatcccc

SEQ ID NO: 112411 - DNA, 25 bp, E. coli
gatttacaacgccatcatggacgaa

SEQ ID NO: 112412 - DNA, 25 bp, E. coli
gatttacaacgcgatcatggacgaa

SEQ ID NO: 112413 - DNA, 25 bp, E. coli
ggtgcgcctcaccttcgcaagaggt

SEQ ID NO: 112414 - DNA, 25 bp, E. coli
ggtgcgcctcacgttcgcaagaggt

SEQ ID NO: 112415 - DNA, 25 bp, E. coli
tctacgtaacagatggaatcctctc

SEQ ID NO: 112416 - DNA, 25 bp, E. coli
tctacgtaacagttggaatcctctc

SEQ ID NO: 112417 - DNA, 25 bp, E. coli
ggcgcatccccttcgatctacgtaa

SEQ ID NO: 112418 - DNA, 25 bp, E. coli
ggcgcatcccctacgatctacgtaa

SEQ ID NO: 112419 - DNA, 25 bp, E. coli
gagccccgttagatgaatacttccg

SEQ ID NO: 112420 - DNA, 25 bp, E. coli
gagccccgttagttgaatacttccg

SEQ ID NO: 112421 - DNA, 25 bp, E. coli
cactggcagatgaagggaaaatcac

SEQ ID NO: 112422 - DNA, 25 bp, E. coli
cactggcagatgtagggaaaatcac

SEQ ID NO: 112423 - DNA, 25 bp, E. coli
catcgacagcaaaaccaactggact

SEQ ID NO: 112424 - DNA, 25 bp, E. coli
catcgacagcaataccaactggact

SEQ ID NO: 112425 - DNA, 25 bp, E. coli
catcactgactatcgcaatgcagga

SEQ ID NO: 112426 - DNA, 25 bp, E. coli
catcactgactaacgcaatgcagga

SEQ ID NO: 112427 - DNA, 25 bp, E. coli
agtggttgccaccttcccggaagat

SEQ ID NO: 112428 - DNA, 25 bp, E. coli
agtggttgccacgttcccggaagat

SEQ ID NO: 112429 - DNA, 25 bp, E. coli
aaaactgggcgcttgggatacgctc

SEQ ID NO: 112430 - DNA, 25 bp, E. coli
aaaactgggcgcatgggatacgctc

SEQ ID NO: 112431 - DNA, 25 bp, E. coli
tagcctggtcgttgtagcaccgaaa

SEQ ID NO: 112432 - DNA, 25 bp, E. coli
tagcctggtcgtagtagcaccgaaa

SEQ ID NO: 112433 - DNA, 25 bp, E. coli
gaagggcataactatgcgacagtga

SEQ ID NO: 112434 - DNA, 25 bp, E. coli
gaagggcataacaatgcgacagtga

SEQ ID NO: 112435 - DNA, 25 bp, E. coli
gaatatccggttgctgttgtggaag

SEQ ID NO: 112436 - DNA, 25 bp, E. coli
gaatatccggttcctgttgtggaag

SEQ ID NO: 112437 - DNA, 25 bp, E. coli
gacactgctcggcaatagcctggtc

SEQ ID NO: 112438 - DNA, 25 bp, E. coli
gacactgctcgggaatagcctggtc

SEQ ID NO: 112439 - DNA, 25 bp, E. coli
ctgttgctggcattgcactggcaga

SEQ ID NO: 112440 - DNA, 25 bp, E. coli
ctgttgctggcaatgcactggcaga

SEQ ID NO: 112441 - DNA, 25 bp, E. coli
gggaaaatcacgctgttcgccgccg

SEQ ID NO: 112442 - DNA, 25 bp, E. coli
gggaaaatcacggtgttcgccgccg

SEQ ID NO: 112443 - DNA, 25 bp, E. coli
cagacccttagcgagcaggaaagtc

SEQ ID NO: 112444 - DNA, 25 bp, E. coli
cagacccttagccagcaggaaagtc

SEQ ID NO: 112445 - DNA, 25 bp, E. coli
aggcgcagacccttagccagcagga

SEQ ID NO: 112446 - DNA, 25 bp, E. coli
aggcgcagacccatagccagcagga

SEQ ID NO: 112447 - DNA, 25 bp, E. coli
tgtatgcctgaactgcttacccgcc

SEQ ID NO: 112448 - DNA, 25 bp, E. coli
tgtatgcctgaagtgcttacccgcc

SEQ ID NO: 112449 - DNA, 25 bp, E. coli
tggtgaactgaatccggaacacctg

SEQ ID NO: 112450 - DNA, 25 bp, E. coli
tgcaccgaaatatcacaccggattt

SEQ ID NO: 112451 - DNA, 25 bp, E. coli
tgcaccgaaataacacaccggattt

SEQ ID NO: 112452 - DNA, 25 bp, E. coli
tcatcagctattatcagcggtggta

SEQ ID NO: 112453 - DNA, 25 bp, E. coli
tcatcagctattttcagcggtggta

SEQ ID NO: 112454 - DNA, 25 bp, E. coli
gcctgcgcggtatgctgcctattat

SEQ ID NO: 112455 - DNA, 25 bp, E. coli
gcctgcgcggtaagctgcctattat

SEQ ID NO: 112456 - DNA, 25 bp, E. coli
ccagcaggaaagtcatcagctattt

SEQ ID NO: 112457 - DNA, 25 bp, E. coli
ccagcaggaaagacatcagctattt

SEQ ID NO: 112458 - DNA, 25 bp, E. coli
gcggtaagctgcctattattggcat

SEQ ID NO: 112459 - DNA, 25 bp, E. coli
gcggtaagctgcgtattattggcat

SEQ ID NO: 112460 - DNA, 25 bp, E. coli
gaagctggttgtttgcctgaactgc

SEQ ID NO: 112461 - DNA, 25 bp, E. coli
gaagctggttgtatgcctgaactgc

SEQ ID NO: 112462 - DNA, 25 bp, E. coli
gaaagtcatcagctattttcagcgg

SEQ ID NO: 112463 - DNA, 25 bp, E. coli
gaaagtcatcaggtattttcagcgg

SEQ ID NO: 112464 - DNA, 25 bp, E. coli
tggtgaactgaaaccggaacacctg

SEQ ID NO: 112465 - DNA, 25 bp, E. coli
aagcgcaagcatgattaacgtgggt

SEQ ID NO: 112466 - DNA, 25 bp, E. coli
caacgcaaaagcaggcgtaagcgca

SEQ ID NO: 112467 - DNA, 25 bp, E. coli
caacgcaaaagctggcgtaagcgca

SEQ ID NO: 112468 - DNA, 25 bp, E. coli
caggcgtaagcgcaagcatcattaa

SEQ ID NO: 112469 - DNA, 25 bp, E. coli
caggcgtaagcggaagcatcattaa

SEQ ID NO: 112470 - DNA, 25 bp, E. coli
aaagcaggcgtaagcgcaagcatca

SEQ ID NO: 112471 - DNA, 25 bp, E. coli
aaagcaggcgtatgcgcaagcatca

SEQ ID NO: 112472 - DNA, 25 bp, E. coli
aagcgcaagcatcattaacgtgggt

SEQ ID NO: 112473 - DNA, 25 bp, E. coli
tgataatgcgatcacactctcggtc

SEQ ID NO: 112474 - DNA, 25 bp, E. coli
tgataatgcgatgacactctcggtc

SEQ ID NO: 112475 - DNA, 25 bp, E. coli
gcaaaagcaggcctaagcgcaagca

SEQ ID NO: 112476 - DNA, 25 bp, E. coli
gcaaaagcaggcgtaagcgcaagca

SEQ ID NO: 112477 - DNA, 25 bp, E. coli
cgtaagcgcaagcatcattaacgtg

SEQ ID NO: 112478 - DNA, 25 bp, E. coli
cgtaagcgcaaggatcattaacgtg

SEQ ID NO: 112479 - DNA, 25 bp, E. coli
gataatgcgatgtcactctcggtca

SEQ ID NO: 112480 - DNA, 25 bp, E. coli
gataatgcgatgacactctcggtca

SEQ ID NO: 112481 - DNA, 25 bp, E. coli
ggcgtaagcgcatgcatcattaacg

SEQ ID NO: 112482 - DNA, 25 bp, E. coli
ggcgtaagcgcaagcatcattaacg

SEQ ID NO: 112483 - DNA, 25 bp, E. coli
taagcgcaagcatcattaacgtggg

SEQ ID NO: 112484 - DNA, 25 bp, E. coli
taatgcgatgacactctcggtcagc

SEQ ID NO: 112485 - DNA, 25 bp, E. coli
taatgcgatgactctctcggtcagc

SEQ ID NO: 112486 - DNA, 25 bp, E. coli
taagcgcaagcaacattaacgtggg

SEQ ID NO: 112487 - DNA, 25 bp, E. coli
aattcgcgcggctgaagagctggaa

SEQ ID NO: 112488 - DNA, 25 bp, E. coli
aattcgcgcggcagaagagctggaa

SEQ ID NO: 112489 - DNA, 25 bp, E. coli
caaactggcggtcaatttcggtgct

SEQ ID NO: 112490 - DNA, 25 bp, E. coli
caaactggcggtgaatttcggtgct

SEQ ID NO: 112491 - DNA, 25 bp, E. coli
caacagaagttgttgcacgcctctc

SEQ ID NO: 112492 - DNA, 25 bp, E. coli
caacagaagttgatgcacgcctctc

SEQ ID NO: 112493 - DNA, 25 bp, E. coli
tacccggtcgcgtgtcaacagaagt

SEQ ID NO: 112494 - DNA, 25 bp, E. coli
tatgactggtatcaggcacgcaagc

SEQ ID NO: 112495 - DNA, 25 bp, E. coli
tatgactggtatgaggcacgcaagc

SEQ ID NO: 112496 - DNA, 25 bp, E. coli
tacccggtcgcgagtcaacagaagt

SEQ ID NO: 112497 - DNA, 25 bp, E. coli
ttcgacctgggatggaattcgcgcg

SEQ ID NO: 112498 - DNA, 25 bp, E. coli
ttcgacctgggaaggaattcgcgcg

SEQ ID NO: 112499 - DNA, 25 bp, E. coli
tgcgatggcggttgaaaaactgtct

SEQ ID NO: 112500 - DNA, 25 bp, E. coli
tcccatgagcgaagcggagttccgt

SEQ ID NO: 112501 - DNA, 25 bp, E. coli
tgcgatggcggtagaaaaactgtct

SEQ ID NO: 112502 - DNA, 25 bp, E. coli
tcccatgagcgatgcggagttccgt

SEQ ID NO: 112503 - DNA, 25 bp, E. coli
gcaagacccaggaacaacaggtggt

SEQ ID NO: 112504 - DNA, 25 bp, E. coli
gcaagacccaggtacaacaggtggt

SEQ ID NO: 112505 - DNA, 25 bp, E. coli
gaaaagagtattcagaaggcgcgcc

SEQ ID NO: 112506 - DNA, 25 bp, E. coli
gaaaccattgtgatgggcgcgagct

SEQ ID NO: 112507 - DNA, 25 bp, E. coli
gaaaccattgtgttgggcgcgagct

SEQ ID NO: 112508 - DNA, 25 bp, E. coli
gaaaagagtattgagaaggcgcgcc

SEQ ID NO: 112509 - DNA, 25 bp, E. coli
catcggctccggatattctggtgca

SEQ ID NO: 112510 - DNA, 25 bp, E. coli
catcggctccggttattctggtgca

SEQ ID NO: 112511 - DNA, 25 bp, E. coli
tacgccacgactaaccgtcaggaag

SEQ ID NO: 112512 - DNA, 25 bp, E. coli
aaagtgcatatgcaagtcgcccgcg

SEQ ID NO: 112513 - DNA, 25 bp, E. coli
aaagtgcatatggaagtcgcccgcg

SEQ ID NO: 112514 - DNA, 25 bp, E. coli
tacgccacgacttaccgtcaggaag

SEQ ID NO: 112515 - DNA, 25 bp, E. coli
tcgaagtgccgatagagctgcgtgt

SEQ ID NO: 112516 - DNA, 25 bp, E. coli
tcgaagtgccgaaagagctgcgtgt

SEQ ID NO: 112517 - DNA, 25 bp, E. coli
tctgatgtgatcgacgcgctgcgta

SEQ ID NO: 112518 - DNA, 25 bp, E. coli
tctgatgtgatccacgcgctgcgta

SEQ ID NO: 112519 - DNA, 25 bp, E. coli
gcaccgatatatctccgtcacgaag

SEQ ID NO: 112520 - DNA, 25 bp, E. coli
gcaccgatatatgtccgtcacgaag

SEQ ID NO: 112521 - DNA, 25 bp, E. coli
cgatgtgtggaatctgacggtcaaa

SEQ ID NO: 112522 - DNA, 25 bp, E. coli
cgatgtgtggaaactgacggtcaaa

SEQ ID NO: 112523 - DNA, 25 bp, E. coli
cattccgctggatggccgtgaagaa

SEQ ID NO: 112524 - DNA, 25 bp, E. coli
cattccgctggaaggccgtgaagaa

SEQ ID NO: 112525 - DNA, 25 bp, E. coli
cggtcaaaaacgtagagaagctctc

SEQ ID NO: 112526 - DNA, 25 bp, E. coli
cggtcaaaaacgaagagaagctctc

SEQ ID NO: 112527 - DNA, 25 bp, E. coli
ggtccgcgcaaacatgacatctgct

SEQ ID NO: 112528 - DNA, 25 bp, E. coli
ggtccgcgcaaagatgacatctgct

SEQ ID NO: 112529 - DNA, 25 bp, E. coli
gaccgcgctatctgcattgttgaaa

SEQ ID NO: 112530 - DNA, 25 bp, E. coli
gaccgcgctatcagcattgttgaaa

SEQ ID NO: 112531 - DNA, 25 bp, E. coli
cactgagccggtgcgtattcgccag

SEQ ID NO: 112532 - DNA, 25 bp, E. coli
cactgagccggtccgtattcgccag

SEQ ID NO: 112533 - DNA, 25 bp, E. coli
catactctggacagaacgaggcgca

SEQ ID NO: 112534 - DNA, 25 bp, E. coli
caggcgtgggatctgttcgaaaaac

SEQ ID NO: 112535 - DNA, 25 bp, E. coli
catactctggactgaacgaggcgca

SEQ ID NO: 112536 - DNA, 25 bp, E. coli
caggcgtgggatgtgttcgaaaaac

SEQ ID NO: 112537 - DNA, 25 bp, E. coli
aacttttggcgctgctttacggcac

SEQ ID NO: 112538 - DNA, 25 bp, E. coli
aacttttggcgcagctttacggcac

SEQ ID NO: 112539 - DNA, 25 bp, E. coli
tagatatttatgagcctgacgggcc

SEQ ID NO: 112540 - DNA, 25 bp, E. coli
tagatatttatgtgcctgacgggcc

SEQ ID NO: 112541 - DNA, 25 bp, E. coli
ttctcgtatatcttcgggagggcga

SEQ ID NO: 112542 - DNA, 25 bp, E. coli
ttctcgtatatcatcgggagggcga

SEQ ID NO: 112543 - DNA, 25 bp, E. coli
gcttaagaacaaagagttgccgcct

SEQ ID NO: 112544 - DNA, 25 bp, E. coli
gcttaagaacaatgagttgccgcct

SEQ ID NO: 112545 - DNA, 25 bp, E. coli
gcaaaaatgctcgaaactgatcagg

SEQ ID NO: 112546 - DNA, 25 bp, E. coli
gcaaaaatgctccaaactgatcagg

SEQ ID NO: 112547 - DNA, 25 bp, E. coli
cgacgaaccttcaggcatgggaaag

SEQ ID NO: 112548 - DNA, 25 bp, E. coli
cgacgaaccttctggcatgggaaag

SEQ ID NO: 112549 - DNA, 25 bp, E. coli
cattgttccgtgagttgtatcccgc

SEQ ID NO: 112550 - DNA, 25 bp, E. coli
cattgttccgtgtgttgtatcccgc

SEQ ID NO: 112551 - DNA, 25 bp, E. coli
gattcagtctgggtattccggcata

SEQ ID NO: 112552 - DNA, 25 bp, E. coli
gattcagtctggctattccggcata

SEQ ID NO: 112553 - DNA, 25 bp, E. coli
caagaagcgtatctgtttgcaccgg

SEQ ID NO: 112554 - DNA, 25 bp, E. coli
caagaagcgtatgtgtttgcaccgg

SEQ ID NO: 112555 - DNA, 25 bp, E. coli
acctgactttgttgtcggcccggcg

SEQ ID NO: 112556 - DNA, 25 bp, E. coli
acctgactttgtagtcggcccggcg

SEQ ID NO: 112557 - DNA, 25 bp, E. coli
ttctggtcacaatacaatggcctgc

SEQ ID NO: 112558 - DNA, 25 bp, E. coli
ttctggtcacaaaacaatggcctgc

SEQ ID NO: 112559 - DNA, 25 bp, E. coli
tgggaatacaattaccgcggcgtgg

SEQ ID NO: 112560 - DNA, 25 bp, E. coli
tgggaatacaataaccgcggcgtgg

SEQ ID NO: 112561 - DNA, 25 bp, E. coli
tcgataacaccgaattccgcgtggt

SEQ ID NO: 112562 - DNA, 25 bp, E. coli
tcgataacaccgtattccgcgtggt

SEQ ID NO: 112563 - DNA, 25 bp, E. coli
gaaccgtctggaaacgaatcgtcag

SEQ ID NO: 112564 - DNA, 25 bp, E. coli
gaaccgtctggatacgaatcgtcag

SEQ ID NO: 112565 - DNA, 25 bp, E. coli
gttgatgccaataccaacggtcagg

SEQ ID NO: 112566 - DNA, 25 bp, E. coli
gatagcgccatctacgaaggtttta

SEQ ID NO: 112567 - DNA, 25 bp, E. coli
gttgatgccaattccaacggtcagg

SEQ ID NO: 112568 - DNA, 25 bp, E. coli
gattctgtcggcaaaagaagcgcag

SEQ ID NO: 112569 - DNA, 25 bp, E. coli
gattctgtcggctaaagaagcgcag

SEQ ID NO: 112570 - DNA, 25 bp, E. coli
gatagcgccatcaacgaaggtttta

SEQ ID NO: 112571 - DNA, 25 bp, E. coli
ggatatcgtttcaggtcgcggcgca

SEQ ID NO: 112572 - DNA, 25 bp, E. coli
ggatatcgtttctggtcgcggcgca

SEQ ID NO: 112573 - DNA, 25 bp, E. coli
taacgcataccacgattcaggcggc

SEQ ID NO: 112574 - DNA, 25 bp, E. coli
taacgcataccaggattcaggcggc

SEQ ID NO: 112575 - DNA, 25 bp, E. coli
aattatgttcgtgtggttgctgagg

SEQ ID NO: 112576 - DNA, 25 bp, E. coli
aattatgttcgtctggttgctgagg

SEQ ID NO: 112577 - DNA, 25 bp, E. coli
cactgtatcgggtaacggagaaaat

SEQ ID NO: 112578 - DNA, 25 bp, E. coli
cactgtatcgggaaacggagaaaat

SEQ ID NO: 112579 - DNA, 25 bp, E. coli
tacaatcgccgcgtggcactgtatc

SEQ ID NO: 112580 - DNA, 25 bp, E. coli
tacaatcgccgcctggcactgtatc

SEQ ID NO: 112581 - DNA, 25 bp, E. coli
ttaatccgccgcgttgccggaatca

SEQ ID NO: 112582 - DNA, 25 bp, E. coli
ttaatccgccgccttgccggaatca

SEQ ID NO: 112583 - DNA, 25 bp, E. coli
tggttgctgaggagattcgccgtaa

SEQ ID NO: 112584 - DNA, 25 bp, E. coli
tgctgaggtgattcgccgtaatggt

SEQ ID NO: 112585 - DNA, 25 bp, E. coli
tgctgaggtgatacgccgtaatggt

SEQ ID NO: 112586 - DNA, 25 bp, E. coli
gcgtgaccgccgtaaattatgttcg

SEQ ID NO: 112587 - DNA, 25 bp, E. coli
gcgtgaccgccgaaaattatgttcg

SEQ ID NO: 112588 - DNA, 25 bp, E. coli
ccgcgttgccggtatcagccagcag

SEQ ID NO: 112589 - DNA, 25 bp, E. coli
ccgcgttgccggaatcagccagcag

SEQ ID NO: 112590 - DNA, 25 bp, E. coli
ccgcgtggcactgtatcgggaaacg

SEQ ID NO: 112591 - DNA, 25 bp, E. coli
ccgcgtggcactctatcgggaaacg

SEQ ID NO: 112592 - DNA, 25 bp, E. coli
gattcgccgtaaaggtatccagctt

SEQ ID NO: 112593 - DNA, 25 bp, E. coli
gattcgccgtaatggtatccagctt

SEQ ID NO: 112594 - DNA, 25 bp, E. coli
ggagaaaattacgtaccactggaag

SEQ ID NO: 112595 - DNA, 25 bp, E. coli
ggagaaaattacctaccactggaag

SEQ ID NO: 112596 - DNA, 25 bp, E. coli
tggttgctgaggtgattcgccgtaa

SEQ ID NO: 112597 - DNA, 25 bp, E. coli
caatgtatgttaggcgttttaaagg

SEQ ID NO: 112598 - DNA, 25 bp, E. coli
caatgtatgttacgcgttttaaagg

SEQ ID NO: 112599 - DNA, 25 bp, E. coli
taaacgcaggcaatgtatgttacgc

SEQ ID NO: 112600 - DNA, 25 bp, E. coli
taaacgcaggcattgtatgttacgc

SEQ ID NO: 112601 - DNA, 25 bp, E. coli
tttagacgcagttttgcgaaccagg

SEQ ID NO: 112602 - DNA, 25 bp, E. coli
tttagacgcagtattgcgaaccagg

SEQ ID NO: 112603 - DNA, 25 bp, E. coli
tgctcgcgaggtcccggtttaactt

SEQ ID NO: 112604 - DNA, 25 bp, E. coli
tgctcgcgaggtgccggtttaactt

SEQ ID NO: 112605 - DNA, 25 bp, E. coli
tgcgaaccaggttgttttgcccgtt

SEQ ID NO: 112606 - DNA, 25 bp, E. coli
tgcgaaccaggtagttttgcccgtt

SEQ ID NO: 112607 - DNA, 25 bp, E. coli
gccaggcgattttgagtgatcgtac

SEQ ID NO: 112608 - DNA, 25 bp, E. coli
gccaggcgatttagagtgatcgtac

SEQ ID NO: 112609 - DNA, 25 bp, E. coli
cgaattctcattattctgcaagagt

SEQ ID NO: 112610 - DNA, 25 bp, E. coli
cgaattctcatttttctgcaagagt

SEQ ID NO: 112611 - DNA, 25 bp, E. coli
cgttttttgtgcatctatagggtga

SEQ ID NO: 112612 - DNA, 25 bp, E. coli
cgttttttgtgcttctatagggtga

SEQ ID NO: 112613 - DNA, 25 bp, E. coli
gggtgattttatatttgccaggcga

SEQ ID NO: 112614 - DNA, 25 bp, E. coli
gggtgattttatttttgccaggcga

SEQ ID NO: 112615 - DNA, 25 bp, E. coli
gagttcaaagaatgttaaacgcagg

SEQ ID NO: 112616 - DNA, 25 bp, E. coli
gagttcaaagaaagttaaacgcagg

SEQ ID NO: 112617 - DNA, 25 bp, E. coli
gagtgatcgtacacacgaattctca

SEQ ID NO: 112618 - DNA, 25 bp, E. coli
gagtgatcgtactcacgaattctca

SEQ ID NO: 112619 - DNA, 25 bp, E. coli
caagctgctggataccgtgggcaac

SEQ ID NO: 112620 - DNA, 25 bp, E. coli
caagctgctggaaaccgtgggcaac

SEQ ID NO: 112621 - DNA, 25 bp, E. coli
aacacgtctggactgcggcattcgg

SEQ ID NO: 112622 - DNA, 25 bp, E. coli
aacacgtctggagtgcggcattcgg

SEQ ID NO: 112623 - DNA, 25 bp, E. coli
tatctgaccatgcatacgctgggcg

SEQ ID NO: 112624 - DNA, 25 bp, E. coli
tatctgaccatggatacgctgggcg

SEQ ID NO: 112625 - DNA, 25 bp, E. coli
tattaacggtagaggcgctggcaaa

SEQ ID NO: 112626 - DNA, 25 bp, E. coli
tattaacggtagtggcgctggcaaa

SEQ ID NO: 112627 - DNA, 25 bp, E. coli
ttaccgctggcccaacaaggtctgg

SEQ ID NO: 112628 - DNA, 25 bp, E. coli
ttaccgctggccgaacaaggtctgg

SEQ ID NO: 112629 - DNA, 25 bp, E. coli
tctggtttcgctgtatccgggcaag

SEQ ID NO: 112630 - DNA, 25 bp, E. coli
tctggtttcgctctatccgggcaag

SEQ ID NO: 112631 - DNA, 25 bp, E. coli
tcatggtggcattattcgtcccgcg

SEQ ID NO: 112632 - DNA, 25 bp, E. coli
tcatggtggcataattcgtcccgcg

SEQ ID NO: 112633 - DNA, 25 bp, E. coli
tctgactctgctgtacctggcgctg

SEQ ID NO: 112634 - DNA, 25 bp, E. coli
tctgactctgctctacctggcgctg

SEQ ID NO: 112635 - DNA, 25 bp, E. coli
gcgtcgctggtccatcagtctgcaa

SEQ ID NO: 112636 - DNA, 25 bp, E. coli
gcgtcgctggtcgatcagtctgcaa

SEQ ID NO: 112637 - DNA, 25 bp, E. coli
cgttataccgtcagggctggcctga

SEQ ID NO: 112638 - DNA, 25 bp, E. coli
cgttataccgtctgggctggcctga

SEQ ID NO: 112639 - DNA, 25 bp, E. coli
ggcgcgttctcgaggcgttaccgaa

SEQ ID NO: 112640 - DNA, 25 bp, E. coli
ggcgcgttctcgtggcgttaccgaa

SEQ ID NO: 112641 - DNA, 25 bp, E. coli
cagcagcggctacagtgggtaaaac

SEQ ID NO: 112642 - DNA, 25 bp, E. coli
cagcagcggctagagtgggtaaaac

SEQ ID NO: 112643 - DNA, 25 bp, E. coli
tgaacagggaaaatcagcagcggct

SEQ ID NO: 112644 - DNA, 25 bp, E. coli
tgaacagggaaattcagcagcggct

SEQ ID NO: 112645 - DNA, 25 bp, E. coli
tccagaatcaggtttgaaccgcccc

SEQ ID NO: 112646 - DNA, 25 bp, E. coli
tccagaatcaggattgaaccgcccc

SEQ ID NO: 112647 - DNA, 25 bp, E. coli
tcagggcatcgctggtctggaaagc

SEQ ID NO: 112648 - DNA, 25 bp, E. coli
tcagggcatcgcaggtctggaaagc

SEQ ID NO: 112649 - DNA, 25 bp, E. coli
gcgcagatatctcgctcagggcatc

SEQ ID NO: 112650 - DNA, 25 bp, E. coli
gcgcagatatctggctcagggcatc

SEQ ID NO: 112651 - DNA, 25 bp, E. coli
gaaaaccggcacttgcgaagtcgct

SEQ ID NO: 112652 - DNA, 25 bp, E. coli
gaaaaccggcacatgcgaagtcgct

SEQ ID NO: 112653 - DNA, 25 bp, E. coli
cgtcgctgtggcatttctcggccca

SEQ ID NO: 112654 - DNA, 25 bp, E. coli
cgtcgctgtggcttttctcggccca

SEQ ID NO: 112655 - DNA, 25 bp, E. coli
gtaaaactctatgaaacgtccggtg

SEQ ID NO: 112656 - DNA, 25 bp, E. coli
gattctggagttacgttctcagcga

SEQ ID NO: 112657 - DNA, 25 bp, E. coli
gattctggagtttcgttctcagcga

SEQ ID NO: 112658 - DNA, 25 bp, E. coli
gtaaaactctatcaaacgtccggtg

SEQ ID NO: 112659 - DNA, 25 bp, E. coli
tcggcccacattgcgtaaaatggtg

SEQ ID NO: 112660 - DNA, 25 bp, E. coli
tcggcccacattccgtaaaatggtg

SEQ ID NO: 112661 - DNA, 25 bp, E. coli
ggcaatagcaactatccacaaagtc

SEQ ID NO: 112662 - DNA, 25 bp, E. coli
ggcaatagcaacaatccacaaagtc

SEQ ID NO: 112663 - DNA, 25 bp, E. coli
acggatgtggaattgcctggttgcc

SEQ ID NO: 112664 - DNA, 25 bp, E. coli
acggatgtggaaatgcctggttgcc

SEQ ID NO: 112665 - DNA, 25 bp, E. coli
tagaatgcccgcaagggcggctgac

SEQ ID NO: 112666 - DNA, 25 bp, E. coli
tagaatgcccgctagggcggctgac

SEQ ID NO: 112667 - DNA, 25 bp, E. coli
cgaattagttatgccgattcaggcc

SEQ ID NO: 112668 - DNA, 25 bp, E. coli
cgagctggagattgaacctggctga

SEQ ID NO: 112669 - DNA, 25 bp, E. coli
cgagctggagatagaacctggctga

SEQ ID NO: 112670 - DNA, 25 bp, E. coli
ccgaatggacgttgaatgcccgcaa

SEQ ID NO: 112671 - DNA, 25 bp, E. coli
ccgaatggacgtagaatgcccgcaa

SEQ ID NO: 112672 - DNA, 25 bp, E. coli
cgaattagttatcccgattcaggcc

SEQ ID NO: 112673 - DNA, 25 bp, E. coli
ctcgacggatgtggaattgcctggt

SEQ ID NO: 112674 - DNA, 25 bp, E. coli
ctgaatcgggaccaattagttatcc

SEQ ID NO: 112675 - DNA, 25 bp, E. coli
ctgaatcgggacgaattagttatcc

SEQ ID NO: 112676 - DNA, 25 bp, E. coli
ctcgacggatgtcgaattgcctggt

SEQ ID NO: 112677 - DNA, 25 bp, E. coli
gtataacgtaatggatgactgtggt

SEQ ID NO: 112678 - DNA, 25 bp, E. coli
gtataacgtaatcgatgactgtggt

SEQ ID NO: 112679 - DNA, 25 bp, E. coli
ggcataaacggtagtcagccgcccg

SEQ ID NO: 112680 - DNA, 25 bp, E. coli
ggcggctgacagagtataacgtaat

SEQ ID NO: 112681 - DNA, 25 bp, E. coli
ggcataaacggttgtcagccgcccg

SEQ ID NO: 112682 - DNA, 25 bp, E. coli
ggcggctgacagtgtataacgtaat

SEQ ID NO: 112683 - DNA, 25 bp, E. coli
tcagccgcccgattggacgtagaat

SEQ ID NO: 112684 - DNA, 25 bp, E. coli
tcagccgcccgaatggacgtagaat

SEQ ID NO: 112685 - DNA, 25 bp, E. coli
catttaatagaaaaagtgctcccgg

SEQ ID NO: 112686 - DNA, 25 bp, E. coli
tatcgagtcaagaatcccaaaggga

SEQ ID NO: 112687 - DNA, 25 bp, E. coli
tattggactcaacaatgctgccagc

SEQ ID NO: 112688 - DNA, 25 bp, E. coli
tatctgcttcgaatgagctctggac

SEQ ID NO: 112689 - DNA, 25 bp, E. coli
tatctgcttcgattgagctctggac

SEQ ID NO: 112690 - DNA, 25 bp, E. coli
tattggactcaagaatgctgccagc

SEQ ID NO: 112691 - DNA, 25 bp, E. coli
tatcgagtcaagtatcccaaaggga

SEQ ID NO: 112692 - DNA, 25 bp, E. coli
tttaaaatcacttggcgatctccgc

SEQ ID NO: 112693 - DNA, 25 bp, E. coli
tttaaaatcactaggcgatctccgc

SEQ ID NO: 112694 - DNA, 25 bp, E. coli
ccagtagtactggaagaggttccaa

SEQ ID NO: 112695 - DNA, 25 bp, E. coli
ccagtagtactgcaagaggttccaa

SEQ ID NO: 112696 - DNA, 25 bp, E. coli
gaaagtcctacgctcaagagaagca

SEQ ID NO: 112697 - DNA, 25 bp, E. coli
gaaagtcctacggtcaagagaagca

SEQ ID NO: 112698 - DNA, 25 bp, E. coli
gaaattcatggacagttcgcacgtg

SEQ ID NO: 112699 - DNA, 25 bp, E. coli
gaacattcatgcttttatcgggcgg

SEQ ID NO: 112700 - DNA, 25 bp, E. coli
gaacattcatgcatttatcgggcgg

SEQ ID NO: 112701 - DNA, 25 bp, E. coli
gaaattcatggagagttcgcacgtg

SEQ ID NO: 112702 - DNA, 25 bp, E. coli
catttaatagaataagtgctcccgg

SEQ ID NO: 112703 - DNA, 25 bp, E. coli
taaggcattcctacgagcagatggt

SEQ ID NO: 112704 - DNA, 25 bp, E. coli
taaggcattccttcgagcagatggt

SEQ ID NO: 112705 - DNA, 25 bp, E. coli
gacggttaattctatgcccagcacg

SEQ ID NO: 112706 - DNA, 25 bp, E. coli
gacggttaattcaatgcccagcacg

SEQ ID NO: 112707 - DNA, 25 bp, E. coli
catactgaatggatgggattgaccg

SEQ ID NO: 112708 - DNA, 25 bp, E. coli
catctcatgcgtacgcgttactgcg

SEQ ID NO: 112709 - DNA, 25 bp, E. coli
catactgaatggttgggattgaccg

SEQ ID NO: 112710 - DNA, 25 bp, E. coli
catctcatgcgttcgcgttactgcg

SEQ ID NO: 112711 - DNA, 25 bp, E. coli
tactgcgcttttctgatgcaagacg

SEQ ID NO: 112712 - DNA, 25 bp, E. coli
tactgcgcttttgtgatgcaagacg

SEQ ID NO: 112713 - DNA, 25 bp, E. coli
cgcaacgatccctgcccttgtggtt

SEQ ID NO: 112714 - DNA, 25 bp, E. coli
cgcaacgatcccagcccttgtggtt

SEQ ID NO: 112715 - DNA, 25 bp, E. coli
aaatttaaaaagtgctgcggccaat

SEQ ID NO: 112716 - DNA, 25 bp, E. coli
actatattgacggtacacgtccgca

SEQ ID NO: 112717 - DNA, 25 bp, E. coli
aaatttaaaaagagctgcggccaat

SEQ ID NO: 112718 - DNA, 25 bp, E. coli
actatattgacgctacacgtccgca

SEQ ID NO: 112719 - DNA, 25 bp, E. coli
tatgtgtctggtgaaaaggttgcac

SEQ ID NO: 112720 - DNA, 25 bp, E. coli
tatgtgtctggtcaaaaggttgcac

SEQ ID NO: 112721 - DNA, 25 bp, E. coli
tgtctcagctttctccctgtggtag

SEQ ID NO: 112722 - DNA, 25 bp, E. coli
tgtctcagctttgtccctgtggtag

SEQ ID NO: 112723 - DNA, 25 bp, E. coli
tgcacctgatccagaacatctcatg

SEQ ID NO: 112724 - DNA, 25 bp, E. coli
tgcacctgatcctgaacatctcatg

SEQ ID NO: 112725 - DNA, 25 bp, E. coli
ccctgtggtagtcctgtcgagtata

SEQ ID NO: 112726 - DNA, 25 bp, E. coli
ccctgtggtagtgctgtcgagtata

SEQ ID NO: 112727 - DNA, 25 bp, E. coli
gagtatagcctatgttgccaccctt

SEQ ID NO: 112728 - DNA, 25 bp, E. coli
gagtatagcctaagttgccaccctt

SEQ ID NO: 112729 - DNA, 25 bp, E. coli
aaccacatgagtaaggcggcgggct

SEQ ID NO: 112730 - DNA, 25 bp, E. coli
aaccacatgagttaggcggcgggct

SEQ ID NO: 112731 - DNA, 25 bp, E. coli
tattactggcctatctgttcgccgg

SEQ ID NO: 112732 - DNA, 25 bp, E. coli
tattaagcgcgaagttgatcaccat

SEQ ID NO: 112733 - DNA, 25 bp, E. coli
tattactggcctttctgttcgccgg

SEQ ID NO: 112734 - DNA, 25 bp, E. coli
tattaagcgcgatgttgatcaccat

SEQ ID NO: 112735 - DNA, 25 bp, E. coli
tgtttgtcggttgcagcgtcgccat

SEQ ID NO: 112736 - DNA, 25 bp, E. coli
tgtttgtcggttccagcgtcgccat

SEQ ID NO: 112737 - DNA, 25 bp, E. coli
tctgcgagcagatggaagcgaaatt

SEQ ID NO: 112738 - DNA, 25 bp, E. coli
tctgcgagcagaaggaagcgaaatt

SEQ ID NO: 112739 - DNA, 25 bp, E. coli
ccggcgcaacagttagaagtgatct

SEQ ID NO: 112740 - DNA, 25 bp, E. coli
ccggcgcaacagatagaagtgatct

SEQ ID NO: 112741 - DNA, 25 bp, E. coli
ccatgttctcgtatatgggcgcaga

SEQ ID NO: 112742 - DNA, 25 bp, E. coli
ccatgttctcgtttatgggcgcaga

SEQ ID NO: 112743 - DNA, 25 bp, E. coli
gcagaaattgtcaccattgccgccg

SEQ ID NO: 112744 - DNA, 25 bp, E. coli
gaatttgagttcaggctggcgctgt

SEQ ID NO: 112745 - DNA, 25 bp, E. coli
gaatttgagttctggctggcgctgt

SEQ ID NO: 112746 - DNA, 25 bp, E. coli
gcagaaattgtctccattgccgccg

SEQ ID NO: 112747 - DNA, 25 bp, E. coli
ccgacacgccggtaaaacatattgt

SEQ ID NO: 112748 - DNA, 25 bp, E. coli
ccgacacgccggaaaaacatattgt

SEQ ID NO: 112749 - DNA, 25 bp, E. coli
gatagcggcggcattatgcccaacg

SEQ ID NO: 112750 - DNA, 25 bp, E. coli
gatagcggcggctttatgcccaacg

SEQ ID NO: 112751 - DNA, 25 bp, E. coli
taaaacccgtactgccgaacagaat

SEQ ID NO: 112752 - DNA, 25 bp, E. coli
taaaacccgtacagccgaacagaat

SEQ ID NO: 112753 - DNA, 25 bp, E. coli
aaacaagttgccgtaatcgctgccg

SEQ ID NO: 112754 - DNA, 25 bp, E. coli
aaaaaatcgcgaagcgctatcgcgc

SEQ ID NO: 112755 - DNA, 25 bp, E. coli
aaaaaatcgcgatgcgctatcgcgc

SEQ ID NO: 112756 - DNA, 25 bp, E. coli
aaacaagttgccctaatcgctgccg

SEQ ID NO: 112757 - DNA, 25 bp, E. coli
tgcaaaatacagaggcagaagacct

SEQ ID NO: 112758 - DNA, 25 bp, E. coli
tgcaaaatacagtggcagaagacct

SEQ ID NO: 112759 - DNA, 25 bp, E. coli
tctcgcacttgcagaagcggtaagc

SEQ ID NO: 112760 - DNA, 25 bp, E. coli
tctcgcacttgctgaagcggtaagc

SEQ ID NO: 112761 - DNA, 25 bp, E. coli
gctatcgcgcaagctggagattgaa

SEQ ID NO: 112762 - DNA, 25 bp, E. coli
gctatcgcgcaacctggagattgaa

SEQ ID NO: 112763 - DNA, 25 bp, E. coli
gaagcgcgtgcttatctcgcacttg

SEQ ID NO: 112764 - DNA, 25 bp, E. coli
gcagaagacctgacgaaaaacggtc

SEQ ID NO: 112765 - DNA, 25 bp, E. coli
gcagaagacctgtcgaaaaacggtc

SEQ ID NO: 112766 - DNA, 25 bp, E. coli
gaagcgcgtgctaatctcgcacttg

SEQ ID NO: 112767 - DNA, 25 bp, E. coli
gaaatccgttgagccgatgaagtca

SEQ ID NO: 112768 - DNA, 25 bp, E. coli
gaaatccgttgacccgatgaagtca

SEQ ID NO: 112769 - DNA, 25 bp, E. coli
cgaacagaatgcacgtattgcggct

SEQ ID NO: 112770 - DNA, 25 bp, E. coli
cgaacagaatgctcgtattgcggct

SEQ ID NO: 112771 - DNA, 25 bp, E. coli
ccgatgaagtcaatcgacggtatca

SEQ ID NO: 112772 - DNA, 25 bp, E. coli
ccgatgaagtcattcgacggtatca

SEQ ID NO: 112773 - DNA, 25 bp, E. coli
caagtcgctttgttggactgactca

SEQ ID NO: 112774 - DNA, 25 bp, E. coli
caagtcgctttgatggactgactca

SEQ ID NO: 112775 - DNA, 25 bp, E. coli
cacagtggtaaaagccgaggcgaaa

SEQ ID NO: 112776 - DNA, 25 bp, E. coli
cacgttgcaatctatttgggagata

SEQ ID NO: 112777 - DNA, 25 bp, E. coli
cacagtggtaaatgccgaggcgaaa

SEQ ID NO: 112778 - DNA, 25 bp, E. coli
cacgttgcaatcaatttgggagata

SEQ ID NO: 112779 - DNA, 25 bp, E. coli
taaagcaagtcgctttgttggactg

SEQ ID NO: 112780 - DNA, 25 bp, E. coli
taaagcaagtcggtttgttggactg

SEQ ID NO: 112781 - DNA, 25 bp, E. coli
agataacaacgtagccgaagcgaca

SEQ ID NO: 112782 - DNA, 25 bp, E. coli
agataacaacgttgccgaagcgaca

SEQ ID NO: 112783 - DNA, 25 bp, E. coli
tatttgggagataacaacgttgccg

SEQ ID NO: 112784 - DNA, 25 bp, E. coli
tatttgggagattacaacgttgccg

SEQ ID NO: 112785 - DNA, 25 bp, E. coli
tgggagataacatcgttgccgaagc

SEQ ID NO: 112786 - DNA, 25 bp, E. coli
tgggagataacaacgttgccgaagc

SEQ ID NO: 112787 - DNA, 25 bp, E. coli
tcgctttgttggtctgactcagtga

SEQ ID NO: 112788 - DNA, 25 bp, E. coli
tcgctttgttggactgactcagtga

SEQ ID NO: 112789 - DNA, 25 bp, E. coli
tcatcagccacagtggtaaatgccg

SEQ ID NO: 112790 - DNA, 25 bp, E. coli
tcatcagccacactggtaaatgccg

SEQ ID NO: 112791 - DNA, 25 bp, E. coli
gccagggatttaaattaaagcaagt

SEQ ID NO: 112792 - DNA, 25 bp, E. coli
gccagggatttatattaaagcaagt

SEQ ID NO: 112793 - DNA, 25 bp, E. coli
gtggtgatgtctgtgcatttaaacc

SEQ ID NO: 112794 - DNA, 25 bp, E. coli
gtggtgatgtctctgcatttaaacc

SEQ ID NO: 112795 - DNA, 25 bp, E. coli
caatgttggtgaccttgagaagcac

SEQ ID NO: 112796 - DNA, 25 bp, E. coli
caatgttggtgagcttgagaagcac

SEQ ID NO: 112797 - DNA, 25 bp, E. coli
catactgagtatcgcctggatcgcg

SEQ ID NO: 112798 - DNA, 25 bp, E. coli
catactgagtatggcctggatcgcg

SEQ ID NO: 112799 - DNA, 25 bp, E. coli
tactggtggcggatcttgtgactac

SEQ ID NO: 112800 - DNA, 25 bp, E. coli
tactggtggcggttcttgtgactac

SEQ ID NO: 112801 - DNA, 25 bp, E. coli
tatgcaatttgttggccgtcatccc

SEQ ID NO: 112802 - DNA, 25 bp, E. coli
tatgcaatttgtaggccgtcatccc

SEQ ID NO: 112803 - DNA, 25 bp, E. coli
tgtgactacgtttaagagcctgacc

SEQ ID NO: 112804 - DNA, 25 bp, E. coli
tgttgccgagcgtaatcaaagccaa

SEQ ID NO: 112805 - DNA, 25 bp, E. coli
tgttgccgagcgaaatcaaagccaa

SEQ ID NO: 112806 - DNA, 25 bp, E. coli
tgtgactacgttaaagagcctgacc

SEQ ID NO: 112807 - DNA, 25 bp, E. coli
tgagaagcacaaagacaaaccggtt

SEQ ID NO: 112808 - DNA, 25 bp, E. coli
tgagaagcacaatgacaaaccggtt

SEQ ID NO: 112809 - DNA, 25 bp, E. coli
tcagcgtgatgacttccgtaaaggc

SEQ ID NO: 112810 - DNA, 25 bp, E. coli
gaagctacgcgtctgatcaacaaag

SEQ ID NO: 112811 - DNA, 25 bp, E. coli
gaagctacgcgtgtgatcaacaaag

SEQ ID NO: 112812 - DNA, 25 bp, E. coli
ccgtaaaggccatatcgcaggttct

SEQ ID NO: 112813 - DNA, 25 bp, E. coli
ccgtaaaggccaaatcgcaggttct

SEQ ID NO: 112814 - DNA, 25 bp, E. coli
tcagcgtgatgagttccgtaaaggc

SEQ ID NO: 112815 - DNA, 25 bp, E. coli
taagagcctgacctcgaaagtgaag

SEQ ID NO: 112816 - DNA, 25 bp, E. coli
taagagcctgacgtcgaaagtgaag

SEQ ID NO: 112817 - DNA, 25 bp, E. coli
taccttccgtttgaggcgaagatcg

SEQ ID NO: 112818 - DNA, 25 bp, E. coli
taccttccgtttcaggcgaagatcg

SEQ ID NO: 112819 - DNA, 25 bp, E. coli
tatgcgggaaatcttcgagttttgg

SEQ ID NO: 112820 - DNA, 25 bp, E. coli
tatgcgggaaatgttcgagttttgg

SEQ ID NO: 112821 - DNA, 25 bp, E. coli
tttgggtatatgtattctcgctcgg

SEQ ID NO: 112822 - DNA, 25 bp, E. coli
tttgggtatatgaattctcgctcgg

SEQ ID NO: 112823 - DNA, 25 bp, E. coli
tctcgctcggtaattgtctggtttg

SEQ ID NO: 112824 - DNA, 25 bp, E. coli
tctcgctcggtatttgtctggtttg

SEQ ID NO: 112825 - DNA, 25 bp, E. coli
tctggtttgtggatggtggcttttt

SEQ ID NO: 112826 - DNA, 25 bp, E. coli
tctggtttgtggttggtggcttttt

SEQ ID NO: 112827 - DNA, 25 bp, E. coli
gcagcattttttgttcttacgccac

SEQ ID NO: 112828 - DNA, 25 bp, E. coli
gcgaagatcgtatattgcaagcaat

SEQ ID NO: 112829 - DNA, 25 bp, E. coli
gcgaagatcgtaaattgcaagcaat

SEQ ID NO: 112830 - DNA, 25 bp, E. coli
gcagcattttttcttcttacgccac

SEQ ID NO: 112831 - DNA, 25 bp, E. coli
gaaatatttgcactataccttccgt

SEQ ID NO: 112832 - DNA, 25 bp, E. coli
gaaatatttgcagtataccttccgt

SEQ ID NO: 112833 - DNA, 25 bp, E. coli
tcttaagaaaactctttatgcggga

SEQ ID NO: 112834 - DNA, 25 bp, E. coli
tcttaagaaaacactttatgcggga

SEQ ID NO: 112835 - DNA, 25 bp, E. coli
cttgagtcgggacgaaatatttgca

SEQ ID NO: 112836 - DNA, 25 bp, E. coli
cttgagtcgggaggaaatatttgca

SEQ ID NO: 112837 - DNA, 25 bp, E. coli
taagtatgactgcatgcttgagtcg

SEQ ID NO: 112838 - DNA, 25 bp, E. coli
taagtatgactggatgcttgagtcg

SEQ ID NO: 112839 - DNA, 25 bp, E. coli
caatgtgcatacttggtggatcggc

SEQ ID NO: 112840 - DNA, 25 bp, E. coli
caatgtgcatacatggtggatcggc

SEQ ID NO: 112841 - DNA, 25 bp, E. coli
cactggctggatgcactggctgaaa

SEQ ID NO: 112842 - DNA, 25 bp, E. coli
cactggctggatccactggctgaaa

SEQ ID NO: 112843 - DNA, 25 bp, E. coli
cagttattcttcatcgcgaccagca

SEQ ID NO: 112844 - DNA, 25 bp, E. coli
cagtgccactgtatatgacgcgcgg

SEQ ID NO: 112845 - DNA, 25 bp, E. coli
cagtgccactgtttatgacgcgcgg

SEQ ID NO: 112846 - DNA, 25 bp, E. coli
cagttattcttcttcgcgaccagca

SEQ ID NO: 112847 - DNA, 25 bp, E. coli
aaaggtcagggtggcgacatcttgc

SEQ ID NO: 112848 - DNA, 25 bp, E. coli
aaaggtcagggtcgcgacatcttgc

SEQ ID NO: 112849 - DNA, 25 bp, E. coli
tagcggtgaataccctggcagtgcc

SEQ ID NO: 112850 - DNA, 25 bp, E. coli
tagcggtgaatagcctggcagtgcc

SEQ ID NO: 112851 - DNA, 25 bp, E. coli
tttggtccgtgctactctatgccga

SEQ ID NO: 112852 - DNA, 25 bp, E. coli
tttggtccgtgcaactctatgccga

SEQ ID NO: 112853 - DNA, 25 bp, E. coli
tcctgttctggattaacgcctggca

SEQ ID NO: 112854 - DNA, 25 bp, E. coli
tcctgttctggaataacgcctggca

SEQ ID NO: 112855 - DNA, 25 bp, E. coli
tcttattcagaattcgccgcgtgtc

SEQ ID NO: 112856 - DNA, 25 bp, E. coli
tcttattcagaaatcgccgcgtgtc

SEQ ID NO: 112857 - DNA, 25 bp, E. coli
gctggctgccagaaacaatgtgcat

SEQ ID NO: 112858 - DNA, 25 bp, E. coli
gctggctgccagtaacaatgtgcat

SEQ ID NO: 112859 - DNA, 25 bp, E. coli
ggtttaaacctgaccgctggcttat

SEQ ID NO: 112860 - DNA, 25 bp, E. coli
ggtttaaacctgtccgctggcttat

SEQ ID NO: 112861 - DNA, 25 bp, E. coli
catgagcggtaagcgttatcccgaa

SEQ ID NO: 112862 - DNA, 25 bp, E. coli
catttgtgttctcggtgatgctgcc

SEQ ID NO: 112863 - DNA, 25 bp, E. coli
catttgtgttctgggtgatgctgcc

SEQ ID NO: 112864 - DNA, 25 bp, E. coli
catgagcggtaaccgttatcccgaa

SEQ ID NO: 112865 - DNA, 25 bp, E. coli
taaagaacagtcagatgctcaggcc

SEQ ID NO: 112866 - DNA, 25 bp, E. coli
taaagaacagtctgatgctcaggcc

SEQ ID NO: 112867 - DNA, 25 bp, E. coli
tatgcctggatatagaagtacggtc

SEQ ID NO: 112868 - DNA, 25 bp, E. coli
tatgcctggataaagaagtacggtc

SEQ ID NO: 112869 - DNA, 25 bp, E. coli
tccagaaagagcagaaacgggttac

SEQ ID NO: 112870 - DNA, 25 bp, E. coli
tccagaaagagctgaaacgggttac

SEQ ID NO: 112871 - DNA, 25 bp, E. coli
gccagcgttgcaacacgtctcgata

SEQ ID NO: 112872 - DNA, 25 bp, E. coli
gccagcgttgcatcacgtctcgata

SEQ ID NO: 112873 - DNA, 25 bp, E. coli
cttaaagagaggtgcccatgagcgg

SEQ ID NO: 112874 - DNA, 25 bp, E. coli
cttaaagagaggagcccatgagcgg

SEQ ID NO: 112875 - DNA, 25 bp, E. coli
gatatcaccacccacagcctttatg

SEQ ID NO: 112876 - DNA, 25 bp, E. coli
gatctcggttatactgttgccagcg

SEQ ID NO: 112877 - DNA, 25 bp, E. coli
gatatcaccaccgacagcctttatg

SEQ ID NO: 112878 - DNA, 25 bp, E. coli
ggtccggattcttccactaataaag

SEQ ID NO: 112879 - DNA, 25 bp, E. coli
ggtccggattctaccactaataaag

SEQ ID NO: 112880 - DNA, 25 bp, E. coli
gagatccgccgtgtccagaaagagc

SEQ ID NO: 112881 - DNA, 25 bp, E. coli
gagatccgccgtctccagaaagagc

SEQ ID NO: 112882 - DNA, 25 bp, E. coli
gatctcggttattctgttgccagcg

SEQ ID NO: 112883 - DNA, 25 bp, E. coli
cataccattaaagttgaaacccagg

SEQ ID NO: 112884 - DNA, 25 bp, E. coli
cataccattaaacttgaaacccagg

SEQ ID NO: 112885 - DNA, 25 bp, E. coli
cagaaaatgaattacaggcggcaga

SEQ ID NO: 112886 - DNA, 25 bp, E. coli
cagaaaatgaataacaggcggcaga

SEQ ID NO: 112887 - DNA, 25 bp, E. coli
ttgaaaaggtcgtaaaatcactggg

SEQ ID NO: 112888 - DNA, 25 bp, E. coli
ttgaaaaggtcgaaaaatcactggg

SEQ ID NO: 112889 - DNA, 25 bp, E. coli
tgtgcgagtaaagacagagatcgtc

SEQ ID NO: 112890 - DNA, 25 bp, E. coli
tgtgcgagtaaacacagagatcgtc

SEQ ID NO: 112891 - DNA, 25 bp, E. coli
tgaatattgtctgtgttgccgcctg

SEQ ID NO: 112892 - DNA, 25 bp, E. coli
tgaatattgtctctgttgccgcctg

SEQ ID NO: 112893 - DNA, 25 bp, E. coli
gctcatacctattttgctcgtgaaa

SEQ ID NO: 112894 - DNA, 25 bp, E. coli
gctcatacctatattgctcgtgaaa

SEQ ID NO: 112895 - DNA, 25 bp, E. coli
gaagaacgcttcaccaataaacgta

SEQ ID NO: 112896 - DNA, 25 bp, E. coli
gaagaacgcttctccaataaacgta

SEQ ID NO: 112897 - DNA, 25 bp, E. coli
gaaacccagggatccattggtacag

SEQ ID NO: 112898 - DNA, 25 bp, E. coli
gaaacccagggaaccattggtacag

SEQ ID NO: 112899 - DNA, 25 bp, E. coli
gatatctctgctcctgacgtcgtga

SEQ ID NO: 112900 - DNA, 25 bp, E. coli
gatatctctgctgctgacgtcgtga

SEQ ID NO: 112901 - DNA, 25 bp, E. coli
ggagcaaaagctgtgggccatacca

SEQ ID NO: 112902 - DNA, 25 bp, E. coli
ggagcaaaagctctgggccatacca

SEQ ID NO: 112903 - DNA, 25 bp, E. coli
gagatcgtcattaaatcgcccgttc

SEQ ID NO: 112904 - DNA, 25 bp, E. coli
gagatcgtcatttaatcgcccgttc

SEQ ID NO: 112905 - DNA, 25 bp, E. coli
catctttccgttcgctgcatacgta

SEQ ID NO: 112906 - DNA, 25 bp, E. coli
catctttccgttggctgcatacgta

SEQ ID NO: 112907 - DNA, 25 bp, E. coli
ttccgttggctgcatacgtaatgac

SEQ ID NO: 112908 - DNA, 25 bp, E. coli
ttccgttggctggatacgtaatgac

SEQ ID NO: 112909 - DNA, 25 bp, E. coli
tctttccgttgggtgcatacgtaat

SEQ ID NO: 112910 - DNA, 25 bp, E. coli
tctttccgttggctgcatacgtaat

SEQ ID NO: 112911 - DNA, 25 bp, E. coli
ccgttggctgcaaacgtaatgacta

SEQ ID NO: 112912 - DNA, 25 bp, E. coli
ccgactcaggtacgagatgcttctg

SEQ ID NO: 112913 - DNA, 25 bp, E. coli
gctaaattactctatggcattccga

SEQ ID NO: 112914 - DNA, 25 bp, E. coli
gctaaattactcaatggcattccga

SEQ ID NO: 112915 - DNA, 25 bp, E. coli
gactcaggtaggtgatgcttctggt

SEQ ID NO: 112916 - DNA, 25 bp, E. coli
gactcaggtaggagatgcttctggt

SEQ ID NO: 112917 - DNA, 25 bp, E. coli
cccgactcaggttggagatgcttct

SEQ ID NO: 112918 - DNA, 25 bp, E. coli
cccgactcaggtaggagatgcttct

SEQ ID NO: 112919 - DNA, 25 bp, E. coli
cgcatctttccgttggctgcatacg

SEQ ID NO: 112920 - DNA, 25 bp, E. coli
cgactcaggtaggagatgcttctgg

SEQ ID NO: 112921 - DNA, 25 bp, E. coli
cgactcaggtagcagatgcttctgg

SEQ ID NO: 112922 - DNA, 25 bp, E. coli
ccgactcaggtaggagatgcttctg

SEQ ID NO: 112923 - DNA, 25 bp, E. coli
ccgttggctgcatacgtaatgacta

SEQ ID NO: 112924 - DNA, 25 bp, E. coli
cgcatctttccgatggctgcatacg

SEQ ID NO: 112925 - DNA, 25 bp, E. coli
taaattactcaaaggcattccgatt

SEQ ID NO: 112926 - DNA, 25 bp, E. coli
taaattactcaatggcattccgatt

SEQ ID NO: 112927 - DNA, 25 bp, E. coli
catgttgttcatctcggatgtggca

SEQ ID NO: 112928 - DNA, 25 bp, E. coli
catgttgttcatgtcggatgtggca

SEQ ID NO: 112929 - DNA, 25 bp, E. coli
ttagcgcgccttcacggcactttat

SEQ ID NO: 112930 - DNA, 25 bp, E. coli
ttagcgcgccttgacggcactttat

SEQ ID NO: 112931 - DNA, 25 bp, E. coli
tccttgaacgaaaatttactgccat

SEQ ID NO: 112932 - DNA, 25 bp, E. coli
tgtcatcagtcttagcgcgccttca

SEQ ID NO: 112933 - DNA, 25 bp, E. coli
tccttgaacgaatatttactgccat

SEQ ID NO: 112934 - DNA, 25 bp, E. coli
tgtcatcagtctaagcgcgccttca

SEQ ID NO: 112935 - DNA, 25 bp, E. coli
tctggcgattttccgcttgtcatca

SEQ ID NO: 112936 - DNA, 25 bp, E. coli
tctggcgattttgcgcttgtcatca

SEQ ID NO: 112937 - DNA, 25 bp, E. coli
gccttatctgacttacaaaacattg

SEQ ID NO: 112938 - DNA, 25 bp, E. coli
gccttatctgacatacaaaacattg

SEQ ID NO: 112939 - DNA, 25 bp, E. coli
gctgctttaaaaacaagtgattgag

SEQ ID NO: 112940 - DNA, 25 bp, E. coli
gctgctttaaaatcaagtgattgag

SEQ ID NO: 112941 - DNA, 25 bp, E. coli
ggcactttattaattccttgaacga

SEQ ID NO: 112942 - DNA, 25 bp, E. coli
ggcactttattatttccttgaacga

SEQ ID NO: 112943 - DNA, 25 bp, E. coli
tcaatagattgcataacccgcgcag

SEQ ID NO: 112944 - DNA, 25 bp, E. coli
taacccgcgcagtccagataagcgt

SEQ ID NO: 112945 - DNA, 25 bp, E. coli
taacccgcgcagaccagataagcgt

SEQ ID NO: 112946 - DNA, 25 bp, E. coli
tcaatagattgcttaacccgcgcag

SEQ ID NO: 112947 - DNA, 25 bp, E. coli
gaggtgcctctgataattagctaag

SEQ ID NO: 112948 - DNA, 25 bp, E. coli
gaggtgcctctgttaattagctaag

SEQ ID NO: 112949 - DNA, 25 bp, E. coli
tttaccggctaaactgcgcagttcg

SEQ ID NO: 112950 - DNA, 25 bp, E. coli
ttttatggtgaagagattagcgagg

SEQ ID NO: 112951 - DNA, 25 bp, E. coli
tttaccggctaatctgcgcagttcg

SEQ ID NO: 112952 - DNA, 25 bp, E. coli
ttttatggtgaacagattagcgagg

SEQ ID NO: 112953 - DNA, 25 bp, E. coli
tccggcgtttgtggataatacgatt

SEQ ID NO: 112954 - DNA, 25 bp, E. coli
tccggcgtttgtcgataatacgatt

SEQ ID NO: 112955 - DNA, 25 bp, E. coli
tcctgcaagtgcttgatgattccag

SEQ ID NO: 112956 - DNA, 25 bp, E. coli
tcctgcaagtgcatgatgattccag

SEQ ID NO: 112957 - DNA, 25 bp, E. coli
gcttgatgattcgagccatcgcggg

SEQ ID NO: 112958 - DNA, 25 bp, E. coli
gcttgatgattccagccatcgcggg

SEQ ID NO: 112959 - DNA, 25 bp, E. coli
cgtttgtcgatattacgattcgcca

SEQ ID NO: 112960 - DNA, 25 bp, E. coli
cgtttgtcgataatacgattcgcca

SEQ ID NO: 112961 - DNA, 25 bp, E. coli
gataatacgattcgccagagtgctt

SEQ ID NO: 112962 - DNA, 25 bp, E. coli
gataatacgattggccagagtgctt

SEQ ID NO: 112963 - DNA, 25 bp, E. coli
gtgatttaccgggtaatctgcgcag

SEQ ID NO: 112964 - DNA, 25 bp, E. coli
gtcatgtgccatgcggcgtttgtcg

SEQ ID NO: 112965 - DNA, 25 bp, E. coli
ggattgcgttgcgcatcgaccgtca

SEQ ID NO: 112966 - DNA, 25 bp, E. coli
gtcatgtgccatccggcgtttgtcg

SEQ ID NO: 112967 - DNA, 25 bp, E. coli
ggattgcgttgcccatcgaccgtca

SEQ ID NO: 112968 - DNA, 25 bp, E. coli
gtgatttaccggctaatctgcgcag

SEQ ID NO: 112969 - DNA, 25 bp, E. coli
tggaagtcatgtgccatccggcgtt

SEQ ID NO: 112970 - DNA, 25 bp, E. coli
tggaagtcatgtcccatccggcgtt

SEQ ID NO: 112971 - DNA, 25 bp, E. coli
cagggaacgcactgctagtctgtaa

SEQ ID NO: 112972 - DNA, 25 bp, E. coli
cagggaacgcacagctagtctgtaa

SEQ ID NO: 112973 - DNA, 25 bp, E. coli
tagtgtcactaccaaagaaaaaggg

SEQ ID NO: 112974 - DNA, 25 bp, E. coli
tagtgtcactacgaaagaaaaaggg

SEQ ID NO: 112975 - DNA, 25 bp, E. coli
ttcaacgtaaaaccgtggcaggagg

SEQ ID NO: 112976 - DNA, 25 bp, E. coli
ttcaacgtaaaagcgtggcaggagg

SEQ ID NO: 112977 - DNA, 25 bp, E. coli
tgcaccacgcctgactgaagaactg

SEQ ID NO: 112978 - DNA, 25 bp, E. coli
tgcaccacgcctcactgaagaactg

SEQ ID NO: 112979 - DNA, 25 bp, E. coli
tcttacccagcaataacagcgttac

SEQ ID NO: 112980 - DNA, 25 bp, E. coli
tcttacccagcattaacagcgttac

SEQ ID NO: 112981 - DNA, 25 bp, E. coli
ccttgatttattaggtgggctggca

SEQ ID NO: 112982 - DNA, 25 bp, E. coli
ccttgatttatttggtgggctggca

SEQ ID NO: 112983 - DNA, 25 bp, E. coli
gtcaggacatcatcggcagggaacg

SEQ ID NO: 112984 - DNA, 25 bp, E. coli
gtcaggacatcaacggcagggaacg

SEQ ID NO: 112985 - DNA, 25 bp, E. coli
ggctacgttttcatgtaaccccttg

SEQ ID NO: 112986 - DNA, 25 bp, E. coli
ggctacgttttcttgtaaccccttg

SEQ ID NO: 112987 - DNA, 25 bp, E. coli
ggttcaactttcgttagctgcctga

SEQ ID NO: 112988 - DNA, 25 bp, E. coli
ggttcaactttccttagctgcctga

SEQ ID NO: 112989 - DNA, 25 bp, E. coli
tagtctgtaaacagaaccgactggg

SEQ ID NO: 112990 - DNA, 25 bp, E. coli
tagtctgtaaactgaaccgactggg

SEQ ID NO: 112991 - DNA, 25 bp, E. coli
ggtccggactgataaaactggtcag

SEQ ID NO: 112992 - DNA, 25 bp, E. coli
ggtccggactgaaaaaactggtcag

SEQ ID NO: 112993 - DNA, 25 bp, E. coli
aacgctttgcgctgcgcccgaacaa

SEQ ID NO: 112994 - DNA, 25 bp, E. coli
aacgctttgcgcagcgcccgaacaa

SEQ ID NO: 112995 - DNA, 25 bp, E. coli
caggcgagtccctataccaaaactt

SEQ ID NO: 112996 - DNA, 25 bp, E. coli
caggcgagtcccaataccaaaactt

SEQ ID NO: 112997 - DNA, 25 bp, E. coli
taccgttacactctaccaacttaat

SEQ ID NO: 112998 - DNA, 25 bp, E. coli
atgcggaaggtccaacgctttgcgc

SEQ ID NO: 112999 - DNA, 25 bp, E. coli
atgcggaaggtcgaacgctttgcgc

SEQ ID NO: 113000 - DNA, 25 bp, E. coli
taccgttacactgtaccaacttaat

SEQ ID NO: 113001 - DNA, 25 bp, E. coli
ttgccagggctgacagaaagtttcg

SEQ ID NO: 113002 - DNA, 25 bp, E. coli
ttgccagggctgtcagaaagtttcg

SEQ ID NO: 113003 - DNA, 25 bp, E. coli
tgtcagaaagttacgccaccggttt

SEQ ID NO: 113004 - DNA, 25 bp, E. coli
tgtcagaaagtttcgccaccggttt

SEQ ID NO: 113005 - DNA, 25 bp, E. coli
ccagggctgtcacaaagtttcgcca

SEQ ID NO: 113006 - DNA, 25 bp, E. coli
ccagggctgtcagaaagtttcgcca

SEQ ID NO: 113007 - DNA, 25 bp, E. coli
gcagatagttttgccagggctgtca

SEQ ID NO: 113008 - DNA, 25 bp, E. coli
gcagatagttttcccagggctgtca

SEQ ID NO: 113009 - DNA, 25 bp, E. coli
gatagttttgcctgggctgtcagaa

SEQ ID NO: 113010 - DNA, 25 bp, E. coli
gatatcgcaggtcaggcgagtccca

SEQ ID NO: 113011 - DNA, 25 bp, E. coli
gatagttttgccagggctgtcagaa

SEQ ID NO: 113012 - DNA, 25 bp, E. coli
gatatcgcaggtgaggcgagtccca

SEQ ID NO: 113013 - DNA, 25 bp, E. coli
ggtcaggcgagtgccaataccaaaa

SEQ ID NO: 113014 - DNA, 25 bp, E. coli
ggtcaggcgagtcccaataccaaaa

SEQ ID NO: 113015 - DNA, 25 bp, E. coli
aacgccggatgtgtcccggctctga

SEQ ID NO: 113016 - DNA, 25 bp, E. coli
aacgccggatgtctcccggctctga

SEQ ID NO: 113017 - DNA, 25 bp, E. coli
acaaaacgccggttgtctcccggct

SEQ ID NO: 113018 - DNA, 25 bp, E. coli
agcgcctgctgaacaaaacgccgga

SEQ ID NO: 113019 - DNA, 25 bp, E. coli
acaaaacgccggatgtctcccggct

SEQ ID NO: 113020 - DNA, 25 bp, E. coli
agcgcctgctgatcaaaacgccgga

SEQ ID NO: 113021 - DNA, 25 bp, E. coli
ttgttgcccggctacacggtgtggc

SEQ ID NO: 113022 - DNA, 25 bp, E. coli
ttgttgcccggcaacacggtgtggc

SEQ ID NO: 113023 - DNA, 25 bp, E. coli
tgttgcccggcaacacggtgtggca

SEQ ID NO: 113024 - DNA, 25 bp, E. coli
tgttgcccggcatcacggtgtggca

SEQ ID NO: 113025 - DNA, 25 bp, E. coli
tgctgaacaaaaggccggatgtctc

SEQ ID NO: 113026 - DNA, 25 bp, E. coli
tgctgaacaaaacgccggatgtctc

SEQ ID NO: 113027 - DNA, 25 bp, E. coli
gcctgctgaacaaaacgccggatgt

SEQ ID NO: 113028 - DNA, 25 bp, E. coli
cctgctgaacaatacgccggatgtc

SEQ ID NO: 113029 - DNA, 25 bp, E. coli
gcgcctgctgaagaaaacgccggat

SEQ ID NO: 113030 - DNA, 25 bp, E. coli
gcctgctgaacataacgccggatgt

SEQ ID NO: 113031 - DNA, 25 bp, E. coli
cctgctgaacaaaacgccggatgtc

SEQ ID NO: 113032 - DNA, 25 bp, E. coli
gcgcctgctgaacaaaacgccggat

SEQ ID NO: 113033 - DNA, 25 bp, E. coli
ggccgcaggagaacaggtcgttcct

SEQ ID NO: 113034 - DNA, 25 bp, E. coli
tggccgcaggagaacaggtcgttcc

SEQ ID NO: 113035 - DNA, 25 bp, E. coli
tggccgcaggagtacaggtcgttcc

SEQ ID NO: 113036 - DNA, 25 bp, E. coli
ggccgcaggagatcaggtcgttcct

SEQ ID NO: 113037 - DNA, 25 bp, E. coli
caaggttcagttgcgggaatgtacc

SEQ ID NO: 113038 - DNA, 25 bp, E. coli
aatgtaccgcggcataccatgctgg

SEQ ID NO: 113039 - DNA, 25 bp, E. coli
aatgtaccgcgggataccatgctgg

SEQ ID NO: 113040 - DNA, 25 bp, E. coli
caaggttcagttccgggaatgtacc

SEQ ID NO: 113041 - DNA, 25 bp, E. coli
tacggtaacacggagtaccacttcg

SEQ ID NO: 113042 - DNA, 25 bp, E. coli
tacggtaacacgcagtaccacttcg

SEQ ID NO: 113043 - DNA, 25 bp, E. coli
tgaacagcgcatggaagttaaccgg

SEQ ID NO: 113044 - DNA, 25 bp, E. coli
tgaacagcgcatcgaagttaaccgg

SEQ ID NO: 113045 - DNA, 25 bp, E. coli
tgctgaacttcacacaggaacgcgg

SEQ ID NO: 113046 - DNA, 25 bp, E. coli
tgctgaacttcagacaggaacgcgg

SEQ ID NO: 113047 - DNA, 25 bp, E. coli
cctgctgctgcatatagttcatgaa

SEQ ID NO: 113048 - DNA, 25 bp, E. coli
cctgctgctgcaaatagttcatgaa

SEQ ID NO: 113049 - DNA, 25 bp, E. coli
gaagatgccgtatccagatcaagtt

SEQ ID NO: 113050 - DNA, 25 bp, E. coli
gaagatgccgtaaccagatcaagtt

SEQ ID NO: 113051 - DNA, 25 bp, E. coli
cgatggagaaaaaaccgccctgctg

SEQ ID NO: 113052 - DNA, 25 bp, E. coli
cgatggagaaaataccgccctgctg

SEQ ID NO: 113053 - DNA, 25 bp, E. coli
ctttctggaaaaggtgcggcgcgtt

SEQ ID NO: 113054 - DNA, 25 bp, E. coli
ctttctggaaaacgtgcggcgcgtt

SEQ ID NO: 113055 - DNA, 25 bp, E. coli
ggtgccttcgattcccgcgatggag

SEQ ID NO: 113056 - DNA, 25 bp, E. coli
ggtgccttcgatacccgcgatggag

SEQ ID NO: 113057 - DNA, 25 bp, E. coli
gatgttcttcagaaccttcgccagc

SEQ ID NO: 113058 - DNA, 25 bp, E. coli
gatgttcttcagtaccttcgccagc

SEQ ID NO: 113059 - DNA, 25 bp, E. coli
aattgcgtgctcaaaaagcgcgctg

SEQ ID NO: 113060 - DNA, 25 bp, E. coli
aattgcgtgctctaaaagcgcgctg

SEQ ID NO: 113061 - DNA, 25 bp, E. coli
taaaagcgcgctcaaacaagggcag

SEQ ID NO: 113062 - DNA, 25 bp, E. coli
taaaagcgcgctgaaacaagggcag

SEQ ID NO: 113063 - DNA, 25 bp, E. coli
aaagcgcgctgaaacaagggcaggt

SEQ ID NO: 113064 - DNA, 25 bp, E. coli
aaaaattgcgtgctctaaaagcgcg

SEQ ID NO: 113065 - DNA, 25 bp, E. coli
aaagcgcgctgatacaagggcaggt

SEQ ID NO: 113066 - DNA, 25 bp, E. coli
aaaaattgcgtggtctaaaagcgcg

SEQ ID NO: 113067 - DNA, 25 bp, E. coli
tttagagtatgaaaaattgcgtgct

SEQ ID NO: 113068 - DNA, 25 bp, E. coli
tttagagtatgataaattgcgtgct

SEQ ID NO: 113069 - DNA, 25 bp, E. coli
tgaaacaagggctggtttccctgcc

SEQ ID NO: 113070 - DNA, 25 bp, E. coli
tgaaaaattgcgtgctctaaaagcg

SEQ ID NO: 113071 - DNA, 25 bp, E. coli
tgaaacaagggcaggtttccctgcc

SEQ ID NO: 113072 - DNA, 25 bp, E. coli
tgaaaaattgcgagctctaaaagcg

SEQ ID NO: 113073 - DNA, 25 bp, E. coli
tctaaaagcgcggtgaaacaagggc

SEQ ID NO: 113074 - DNA, 25 bp, E. coli
tctaaaagcgcgctgaaacaagggc

SEQ ID NO: 113075 - DNA, 25 bp, E. coli
gcaggtttccctgccctgtgatttt

SEQ ID NO: 113076 - DNA, 25 bp, E. coli
gcaggtttccctcccctgtgatttt

SEQ ID NO: 113077 - DNA, 25 bp, E. coli
cgcgctgaaacaagggcaggtttcc

SEQ ID NO: 113078 - DNA, 25 bp, E. coli
cgcgctgaaacatgggcaggtttcc

SEQ ID NO: 113079 - DNA, 25 bp, E. coli
cgtgctctaaaaccgcgctgaaaca

SEQ ID NO: 113080 - DNA, 25 bp, E. coli
cgtgctctaaaagcgcgctgaaaca

SEQ ID NO: 113081 - DNA, 25 bp, E. coli
cactacaatcggtggttgcgcgcgt

SEQ ID NO: 113082 - DNA, 25 bp, E. coli
cactacaatcggaggttgcgcgcgt

SEQ ID NO: 113083 - DNA, 25 bp, E. coli
tatcaccgttgacgtcgctgcggaa

SEQ ID NO: 113084 - DNA, 25 bp, E. coli
tatcaccgttgaggtcgctgcggaa

SEQ ID NO: 113085 - DNA, 25 bp, E. coli
tcccgatcaaatcggtgctaaagcc

SEQ ID NO: 113086 - DNA, 25 bp, E. coli
tcccgatcaaatgggtgctaaagcc

SEQ ID NO: 113087 - DNA, 25 bp, E. coli
tcagctatgttgctgagcctggcat

SEQ ID NO: 113088 - DNA, 25 bp, E. coli
tcagctatgttggtgagcctggcat

SEQ ID NO: 113089 - DNA, 25 bp, E. coli
gaccgataactatgcgggaggcgtt

SEQ ID NO: 113090 - DNA, 25 bp, E. coli
gaccgataactaagcgggaggcgtt

SEQ ID NO: 113091 - DNA, 25 bp, E. coli
gaagcgttaacgactgcgcaaaaca

SEQ ID NO: 113092 - DNA, 25 bp, E. coli
gaagcgttaacgtctgcgcaaaaca

SEQ ID NO: 113093 - DNA, 25 bp, E. coli
cgcgtgatgccgatgacagtgaaaa

SEQ ID NO: 113094 - DNA, 25 bp, E. coli
cgcgtgatgccgttgacagtgaaaa

SEQ ID NO: 113095 - DNA, 25 bp, E. coli
cattgttctcgcaaagttcgttggc

SEQ ID NO: 113096 - DNA, 25 bp, E. coli
cattgttctcgctaagttcgttggc

SEQ ID NO: 113097 - DNA, 25 bp, E. coli
ggtcgattcgaatggcgtccaggca

SEQ ID NO: 113098 - DNA, 25 bp, E. coli
ggtcgattcgaaaggcgtccaggca

SEQ ID NO: 113099 - DNA, 25 bp, E. coli
taagaaagggtttagcgatacaccg

SEQ ID NO: 113100 - DNA, 25 bp, E. coli
taagaaagggttaagcgatacaccg

SEQ ID NO: 113101 - DNA, 25 bp, E. coli
gatcacctcaatggtaaaccggtag

SEQ ID NO: 113102 - DNA, 25 bp, E. coli
gatcacctcaatcgtaaaccggtag

SEQ ID NO: 113103 - DNA, 25 bp, E. coli
catgatgatgtgatcgagtcccgga

SEQ ID NO: 113104 - DNA, 25 bp, E. coli
cataatcgctacagttcgtgggaga

SEQ ID NO: 113105 - DNA, 25 bp, E. coli
catgatgatgtgttcgagtcccgga

SEQ ID NO: 113106 - DNA, 25 bp, E. coli
cataatcgctactgttcgtgggaga

SEQ ID NO: 113107 - DNA, 25 bp, E. coli
taaagtgtttgaagcaggctgtgcc

SEQ ID NO: 113108 - DNA, 25 bp, E. coli
taaagtgtttgatgcaggctgtgcc

SEQ ID NO: 113109 - DNA, 25 bp, E. coli
tgtttatctggatcccgcgcagtgg

SEQ ID NO: 113110 - DNA, 25 bp, E. coli
tgtttatctggaacccgcgcagtgg

SEQ ID NO: 113111 - DNA, 25 bp, E. coli
tgatgaaagatattgatgcgccgcc

SEQ ID NO: 113112 - DNA, 25 bp, E. coli
tgcaaaatgaacagccgctatccgg

SEQ ID NO: 113113 - DNA, 25 bp, E. coli
tgatgaaagataatgatgcgccgcc

SEQ ID NO: 113114 - DNA, 25 bp, E. coli
tgcaaaatgaactgccgctatccgg

SEQ ID NO: 113115 - DNA, 25 bp, E. coli
ccatgactgggcaaaccgggaatat

SEQ ID NO: 113116 - DNA, 25 bp, E. coli
ccatgactgggctaaccgggaatat

SEQ ID NO: 113117 - DNA, 25 bp, E. coli
gaaacgtttgatgcgcacgagccgt

SEQ ID NO: 113118 - DNA, 25 bp, E. coli
gaaacgtttgatccgcacgagccgt

SEQ ID NO: 113119 - DNA, 25 bp, E. coli
gatcactggcatccaagcgttgcgc

SEQ ID NO: 113120 - DNA, 25 bp, E. coli
gatcactggcatgcaagcgttgcgc

SEQ ID NO: 113121 - DNA, 25 bp, E. coli
ggtattacgcatcccggcacaggaa

SEQ ID NO: 113122 - DNA, 25 bp, E. coli
ggtacaaatgatggactgggcgcca

SEQ ID NO: 113123 - DNA, 25 bp, E. coli
ggtacaaatgatcgactgggcgcca

SEQ ID NO: 113124 - DNA, 25 bp, E. coli
ggtattacgcatgccggcacaggaa

SEQ ID NO: 113125 - DNA, 25 bp, E. coli
aatttttcgccgttctgttcagcgg

SEQ ID NO: 113126 - DNA, 25 bp, E. coli
aatttttcgccgatctgttcagcgg

SEQ ID NO: 113127 - DNA, 25 bp, E. coli
caaaccggtgatgctgttaagcctg

SEQ ID NO: 113128 - DNA, 25 bp, E. coli
caaaactgtttgctcagcatggaac

SEQ ID NO: 113129 - DNA, 25 bp, E. coli
caaaactgtttggtcagcatggaac

SEQ ID NO: 113130 - DNA, 25 bp, E. coli
caaaccggtgatcctgttaagcctg

SEQ ID NO: 113131 - DNA, 25 bp, E. coli
tatgtattgattatccccgtctgga

SEQ ID NO: 113132 - DNA, 25 bp, E. coli
tatgtattgattttccccgtctgga

SEQ ID NO: 113133 - DNA, 25 bp, E. coli
tgttcagcggcctggtgcttaaccc

SEQ ID NO: 113134 - DNA, 25 bp, E. coli
tgttcagcggccaggtgcttaaccc

SEQ ID NO: 113135 - DNA, 25 bp, E. coli
tcgttttacgattgccgcaccacgt

SEQ ID NO: 113136 - DNA, 25 bp, E. coli
tcgttttacgatagccgcaccacgt

SEQ ID NO: 113137 - DNA, 25 bp, E. coli
tcaggataattaagcccagccgctc

SEQ ID NO: 113138 - DNA, 25 bp, E. coli
tcaggataattatgcccagccgctc

SEQ ID NO: 113139 - DNA, 25 bp, E. coli
gaaggtgaagcgatgcttaccgccc

SEQ ID NO: 113140 - DNA, 25 bp, E. coli
gaaggtgaagcgttgcttaccgccc

SEQ ID NO: 113141 - DNA, 25 bp, E. coli
ccgctggtgttatgtttgctgcatc

SEQ ID NO: 113142 - DNA, 25 bp, E. coli
cgcgcggcgattatctctatcacag

SEQ ID NO: 113143 - DNA, 25 bp, E. coli
cgaatacggcaatctgctggaagca

SEQ ID NO: 113144 - DNA, 25 bp, E. coli
cgaatacggcaaactgctggaagca

SEQ ID NO: 113145 - DNA, 25 bp, E. coli
cgcgcggcgattttctctatcacag

SEQ ID NO: 113146 - DNA, 25 bp, E. coli
ccgctggtgttaagtttgctgcatc

SEQ ID NO: 113147 - DNA, 25 bp, E. coli
caacatgagatgttaaaaaccgcgg

SEQ ID NO: 113148 - DNA, 25 bp, E. coli
caacatgagatgataaaaaccgcgg

SEQ ID NO: 113149 - DNA, 25 bp, E. coli
cagtcaacttgaagccagaacacag

SEQ ID NO: 113150 - DNA, 25 bp, E. coli
cagtcaacttgatgccagaacacag

SEQ ID NO: 113151 - DNA, 25 bp, E. coli
taaatgagacagtgtgcgaacgggt

SEQ ID NO: 113152 - DNA, 25 bp, E. coli
taaatgagacagagtgcgaacgggt

SEQ ID NO: 113153 - DNA, 25 bp, E. coli
ttcgctccgaagtgataaatgagac

SEQ ID NO: 113154 - DNA, 25 bp, E. coli
ttcgctccgaagagataaatgagac

SEQ ID NO: 113155 - DNA, 25 bp, E. coli
tgaaggatattcacaatgcccgcga

SEQ ID NO: 113156 - DNA, 25 bp, E. coli
tgaaggatattctcaatgcccgcga

SEQ ID NO: 113157 - DNA, 25 bp, E. coli
tcatcttgggctcaacgaaccggga

SEQ ID NO: 113158 - DNA, 25 bp, E. coli
tcatcttgggctgaacgaaccggga

SEQ ID NO: 113159 - DNA, 25 bp, E. coli
gactcgtgggatgaccttaggcctg

SEQ ID NO: 113160 - DNA, 25 bp, E. coli
gactcgtgggatcaccttaggcctg

SEQ ID NO: 113161 - DNA, 25 bp, E. coli
gaagaccagctcttcagctttcgct

SEQ ID NO: 113162 - DNA, 25 bp, E. coli
gaagaccagctcatcagctttcgct

SEQ ID NO: 113163 - DNA, 25 bp, E. coli
cgcgcaaaggcgctctggatttatg

SEQ ID NO: 113164 - DNA, 25 bp, E. coli
cgcgcaaaggcggtctggatttatg

SEQ ID NO: 113165 - DNA, 25 bp, E. coli
gggtggatctgcgattaacgatgcc

SEQ ID NO: 113166 - DNA, 25 bp, E. coli
gggtggatctgccattaacgatgcc

SEQ ID NO: 113167 - DNA, 25 bp, E. coli
taacgaacctgaatgcgcgcaaagg

SEQ ID NO: 113168 - DNA, 25 bp, E. coli
taacgaacctgattgcgcgcaaagg

SEQ ID NO: 113169 - DNA, 25 bp, E. coli
aatggtgcgacgatcctcctgtaca

SEQ ID NO: 113170 - DNA, 25 bp, E. coli
aatggtgcgacgttcctcctgtaca

SEQ ID NO: 113171 - DNA, 25 bp, E. coli
aagttatccgccataaacgtgaagt

SEQ ID NO: 113172 - DNA, 25 bp, E. coli
aagttatccgccttaaacgtgaagt

SEQ ID NO: 113173 - DNA, 25 bp, E. coli
caggcggtgtgagtgagctaatcca

SEQ ID NO: 113174 - DNA, 25 bp, E. coli
caggcggtgtgactgagctaatcca

SEQ ID NO: 113175 - DNA, 25 bp, E. coli
aacattacttacgatctcacgcgca

SEQ ID NO: 113176 - DNA, 25 bp, E. coli
aacattacttaccatctcacgcgca

SEQ ID NO: 113177 - DNA, 25 bp, E. coli
tcgaagatgaagttattgaagtgct

SEQ ID NO: 113178 - DNA, 25 bp, E. coli
tcgaagatgaagatattgaagtgct

SEQ ID NO: 113179 - DNA, 25 bp, E. coli
gctaatccacttatttatcgccgaa

SEQ ID NO: 113180 - DNA, 25 bp, E. coli
ccggcgagatacgtgacggtaagac

SEQ ID NO: 113181 - DNA, 25 bp, E. coli
ccggcgagatacctgacggtaagac

SEQ ID NO: 113182 - DNA, 25 bp, E. coli
gctaatccacttttttatcgccgaa

SEQ ID NO: 113183 - DNA, 25 bp, E. coli
gaactgtatatgtcgccaggcggtg

SEQ ID NO: 113184 - DNA, 25 bp, E. coli
gaactgtatatgacgccaggcggtg

SEQ ID NO: 113185 - DNA, 25 bp, E. coli
cgaagaaaaagaccgtggttctgat

SEQ ID NO: 113186 - DNA, 25 bp, E. coli
cgctacctgggttaatggcaatgaa

SEQ ID NO: 113187 - DNA, 25 bp, E. coli
cgctacctgggtaaatggcaatgaa

SEQ ID NO: 113188 - DNA, 25 bp, E. coli
cgaagaaaaagagcgtggttctgat

SEQ ID NO: 113189 - DNA, 25 bp, E. coli
gataactatttctccctgcacaaca

SEQ ID NO: 113190 - DNA, 25 bp, E. coli
gataactatttcaccctgcacaaca

SEQ ID NO: 113191 - DNA, 25 bp, E. coli
aaacgatgcacagcgggttttctca

SEQ ID NO: 113192 - DNA, 25 bp, E. coli
aaacgatgcacaccgggttttctca

SEQ ID NO: 113193 - DNA, 25 bp, E. coli
tatggtgctgctgtgtgaaatctga

SEQ ID NO: 113194 - DNA, 25 bp, E. coli
tatggtgctgctctgtgaaatctga

SEQ ID NO: 113195 - DNA, 25 bp, E. coli
tatcgatcaaatttggtgctgctgt

SEQ ID NO: 113196 - DNA, 25 bp, E. coli
tatcgatcaaatatggtgctgctgt

SEQ ID NO: 113197 - DNA, 25 bp, E. coli
tcatttttcacgagatgggagcgat

SEQ ID NO: 113198 - DNA, 25 bp, E. coli
tcatttttcacgtgatgggagcgat

SEQ ID NO: 113199 - DNA, 25 bp, E. coli
gcacaccgggttttctcatttttca

SEQ ID NO: 113200 - DNA, 25 bp, E. coli
gaagccgcctgtgcggtgcggtggt

SEQ ID NO: 113201 - DNA, 25 bp, E. coli
gcacaccgggttatctcatttttca

SEQ ID NO: 113202 - DNA, 25 bp, E. coli
gaagccgcctgtccggtgcggtggt

SEQ ID NO: 113203 - DNA, 25 bp, E. coli
gaaaccggataatacaaccgcattg

SEQ ID NO: 113204 - DNA, 25 bp, E. coli
gaaaccggataaaacaaccgcattg

SEQ ID NO: 113205 - DNA, 25 bp, E. coli
ccgcattgtgcatatatcgatcaaa

SEQ ID NO: 113206 - DNA, 25 bp, E. coli
ccgcattgtgcaaatatcgatcaaa

SEQ ID NO: 113207 - DNA, 25 bp, E. coli
cggataaaacaagcgcattgtgcaa

SEQ ID NO: 113208 - DNA, 25 bp, E. coli
cggataaaacaaccgcattgtgcaa

SEQ ID NO: 113209 - DNA, 25 bp, E. coli
tcacgagatgggtgcgatttcccgc

SEQ ID NO: 113210 - DNA, 25 bp, E. coli
tcacgagatgggagcgatttcccgc

SEQ ID NO: 113211 - DNA, 25 bp, E. coli
gatgggagcgatatcccgcgaagcc

SEQ ID NO: 113212 - DNA, 25 bp, E. coli
gatgggagcgatttcccgcgaagcc

SEQ ID NO: 113213 - DNA, 25 bp, E. coli
aatgtgctgcgtgccggattacgca

SEQ ID NO: 113214 - DNA, 25 bp, E. coli
aatgtgctgcgtcccggattacgca

SEQ ID NO: 113215 - DNA, 25 bp, E. coli
tacatcaacaagctctggcaacgcc

SEQ ID NO: 113216 - DNA, 25 bp, E. coli
tacatcaacaaggtctggcaacgcc

SEQ ID NO: 113217 - DNA, 25 bp, E. coli
tgatacaaggacttgccgcgccgat

SEQ ID NO: 113218 - DNA, 25 bp, E. coli
tgatacaaggacatgccgcgccgat

SEQ ID NO: 113219 - DNA, 25 bp, E. coli
tgcagccaggctctaaaacgctctc

SEQ ID NO: 113220 - DNA, 25 bp, E. coli
tgcagccaggctgtaaaacgctctc

SEQ ID NO: 113221 - DNA, 25 bp, E. coli
tccagcaggcgagagaaatcgtccg

SEQ ID NO: 113222 - DNA, 25 bp, E. coli
tccagcaggcgacagaaatcgtccg

SEQ ID NO: 113223 - DNA, 25 bp, E. coli
tcagtttgcgctcagtcacggcgtg

SEQ ID NO: 113224 - DNA, 25 bp, E. coli
tcagtttgcgctgagtcacggcgtg

SEQ ID NO: 113225 - DNA, 25 bp, E. coli
gcatggcaacctcgcaatgcgggaa

SEQ ID NO: 113226 - DNA, 25 bp, E. coli
gcatggcaacctggcaatgcgggaa

SEQ ID NO: 113227 - DNA, 25 bp, E. coli
gacagaagtgaagcgcgaaagcagt

SEQ ID NO: 113228 - DNA, 25 bp, E. coli
gacagaagtgaaccgcgaaagcagt

SEQ ID NO: 113229 - DNA, 25 bp, E. coli
cggatgtctgtatcgcgggcaacct

SEQ ID NO: 113230 - DNA, 25 bp, E. coli
cggatgtctgtaacgcgggcaacct

SEQ ID NO: 113231 - DNA, 25 bp, E. coli
cgggaagaatttgctcatcgctggc

SEQ ID NO: 113232 - DNA, 25 bp, E. coli
cgggaagaatttcctcatcgctggc

SEQ ID NO: 113233 - DNA, 25 bp, E. coli
gattacgcattaacggcttgcagcc

SEQ ID NO: 113234 - DNA, 25 bp, E. coli
gattacgcattatcggcttgcagcc

SEQ ID NO: 113235 - DNA, 25 bp, E. coli
caaccgttgcaggtgttaaaagcct

SEQ ID NO: 113236 - DNA, 25 bp, E. coli
caaccgttgcagctgttaaaagcct

SEQ ID NO: 113237 - DNA, 25 bp, E. coli
cagcatgtgcttgatcaggataacg

SEQ ID NO: 113238 - DNA, 25 bp, E. coli
cagcatgtgcttcatcaggataacg

SEQ ID NO: 113239 - DNA, 25 bp, E. coli
acgcgttgaattggtgctggcttaa

SEQ ID NO: 113240 - DNA, 25 bp, E. coli
acgcgttgaattcgtgctggcttaa

SEQ ID NO: 113241 - DNA, 25 bp, E. coli
aaaacgcgttgatttcgtgctggct

SEQ ID NO: 113242 - DNA, 25 bp, E. coli
aaaacgcgttgaattcgtgctggct

SEQ ID NO: 113243 - DNA, 25 bp, E. coli
ttacttctgtcagcacgggcatggc

SEQ ID NO: 113244 - DNA, 25 bp, E. coli
ttacttctgtcaccacgggcatggc

SEQ ID NO: 113245 - DNA, 25 bp, E. coli
gcttgatatcgataaaacgcgttga

SEQ ID NO: 113246 - DNA, 25 bp, E. coli
gcttgatatcgaaaaaacgcgttga

SEQ ID NO: 113247 - DNA, 25 bp, E. coli
gcttgatcaggaaaacggccatgcg

SEQ ID NO: 113248 - DNA, 25 bp, E. coli
gcttgatcaggataacggccatgcg

SEQ ID NO: 113249 - DNA, 25 bp, E. coli
cattgtccacaaagtcagcatgtgc

SEQ ID NO: 113250 - DNA, 25 bp, E. coli
cgggcatggcttgatatcgaaaaaa

SEQ ID NO: 113251 - DNA, 25 bp, E. coli
cgggcatggcttcatatcgaaaaaa

SEQ ID NO: 113252 - DNA, 25 bp, E. coli
cattgtccacaatgtcagcatgtgc

SEQ ID NO: 113253 - DNA, 25 bp, E. coli
gtagattacttctgtcagcacgggc

SEQ ID NO: 113254 - DNA, 25 bp, E. coli
gtagattacttcagtcagcacgggc

SEQ ID NO: 113255 - DNA, 25 bp, E. coli
tggaactgcattgtccacaatgtca

SEQ ID NO: 113256 - DNA, 25 bp, E. coli
tggaactgcattctccacaatgtca

SEQ ID NO: 113257 - DNA, 25 bp, E. coli
aagattctcgtgagctggtcgtcgg

SEQ ID NO: 113258 - DNA, 25 bp, E. coli
aagattctcgtgtgctggtcgtcgg

SEQ ID NO: 113259 - DNA, 25 bp, E. coli
agattctcgtgtgctggtcgtcggc

SEQ ID NO: 113260 - DNA, 25 bp, E. coli
agattctcgtgtcctggtcgtcggc

SEQ ID NO: 113261 - DNA, 25 bp, E. coli
attctcgtgtgctggtcgtcggcct

SEQ ID NO: 113262 - DNA, 25 bp, E. coli
attctcgtgtgcaggtcgtcggcct

SEQ ID NO: 113263 - DNA, 25 bp, E. coli
aaagattctcgtctgctggtcgtcg

SEQ ID NO: 113264 - DNA, 25 bp, E. coli
aaagattctcgtgtgctggtcgtcg

SEQ ID NO: 113265 - DNA, 25 bp, E. coli
tgtgctggtcgtcggcctcggtgga

SEQ ID NO: 113266 - DNA, 25 bp, E. coli
tgtgctggtcgtgggcctcggtgga

SEQ ID NO: 113267 - DNA, 25 bp, E. coli
tcgtcggcctcgctggactcggctg

SEQ ID NO: 113268 - DNA, 25 bp, E. coli
tcgtcggcctcggtggactcggctg

SEQ ID NO: 113269 - DNA, 25 bp, E. coli
tgaaagattctcgtgtgctggtcgt

SEQ ID NO: 113270 - DNA, 25 bp, E. coli
tgaaagattctcctgtgctggtcgt

SEQ ID NO: 113271 - DNA, 25 bp, E. coli
tctcgtgtgctgctcgtcggcctcg

SEQ ID NO: 113272 - DNA, 25 bp, E. coli
tctcgtgtgctggtcgtcggcctcg

SEQ ID NO: 113273 - DNA, 25 bp, E. coli
cctcggtggactcggctgcgcagct

SEQ ID NO: 113274 - DNA, 25 bp, E. coli
cctcggtggactgggctgcgcagct

SEQ ID NO: 113275 - DNA, 25 bp, E. coli
gctgaaagattctcgtgtgctggtc

SEQ ID NO: 113276 - DNA, 25 bp, E. coli
gctgaaagattcacgtgtgctggtc

SEQ ID NO: 113277 - DNA, 25 bp, E. coli
gaaagattctcgtgtgctggtcgtc

SEQ ID NO: 113278 - DNA, 25 bp, E. coli
gaaagattctcgagtgctggtcgtc

SEQ ID NO: 113279 - DNA, 25 bp, E. coli
catacctgtcagcagtcaaaaggca

SEQ ID NO: 113280 - DNA, 25 bp, E. coli
catacctgtcaggagtcaaaaggca

SEQ ID NO: 113281 - DNA, 25 bp, E. coli
tatgcagcgttcgttgcaacgcctt

SEQ ID NO: 113282 - DNA, 25 bp, E. coli
tagccgagttgctgagtatgcagcg

SEQ ID NO: 113283 - DNA, 25 bp, E. coli
tatgcagcgttccttgcaacgcctt

SEQ ID NO: 113284 - DNA, 25 bp, E. coli
taggtttcagtctggagtcgatccg

SEQ ID NO: 113285 - DNA, 25 bp, E. coli
tagccgagttgcagagtatgcagcg

SEQ ID NO: 113286 - DNA, 25 bp, E. coli
taggtttcagtcaggagtcgatccg

SEQ ID NO: 113287 - DNA, 25 bp, E. coli
tataccgaaagccatctccagcgat

SEQ ID NO: 113288 - DNA, 25 bp, E. coli
tataccgaaagcgatctccagcgat

SEQ ID NO: 113289 - DNA, 25 bp, E. coli
tgtatcgcattggtgagctggcaaa

SEQ ID NO: 113290 - DNA, 25 bp, E. coli
tgtatcgcattgctgagctggcaaa

SEQ ID NO: 113291 - DNA, 25 bp, E. coli
gcggaagtaacacccgacacgattc

SEQ ID NO: 113292 - DNA, 25 bp, E. coli
gcggaagtaacagccgacacgattc

SEQ ID NO: 113293 - DNA, 25 bp, E. coli
gattgaaatttatccgccatgccag

SEQ ID NO: 113294 - DNA, 25 bp, E. coli
gattcttgaagcacttgaacaaggg

SEQ ID NO: 113295 - DNA, 25 bp, E. coli
gattcttgaagctcttgaacaaggg

SEQ ID NO: 113296 - DNA, 25 bp, E. coli
gattgaaatttaaccgccatgccag

SEQ ID NO: 113297 - DNA, 25 bp, E. coli
tcaaaaggcattctgcaggaaagat

SEQ ID NO: 113298 - DNA, 25 bp, E. coli
tcaaaaggcattgtgcaggaaagat

SEQ ID NO: 113299 - DNA, 25 bp, E. coli
gagtcgatccgccagttgctgtcga

SEQ ID NO: 113300 - DNA, 25 bp, E. coli
gagtcgatccgcgagttgctgtcga

SEQ ID NO: 113301 - DNA, 25 bp, E. coli
atcagtacgctggttgactgggtgc

SEQ ID NO: 113302 - DNA, 25 bp, E. coli
atcagtacgctgcttgactgggtgc

SEQ ID NO: 113303 - DNA, 25 bp, E. coli
tatcagtacgctgcttgactgggtg

SEQ ID NO: 113304 - DNA, 25 bp, E. coli
tatcagtacgctccttgactgggtg

SEQ ID NO: 113305 - DNA, 25 bp, E. coli
tgctccggcgcgtatcagtacgctg

SEQ ID NO: 113306 - DNA, 25 bp, E. coli
tgctccggcgcgaatcagtacgctg

SEQ ID NO: 113307 - DNA, 25 bp, E. coli
tccggcgcgtatgagtacgctgctt

SEQ ID NO: 113308 - DNA, 25 bp, E. coli
tccggcgcgtatcagtacgctgctt

SEQ ID NO: 113309 - DNA, 25 bp, E. coli
gcgcgtatcagttcgctgcttgact

SEQ ID NO: 113310 - DNA, 25 bp, E. coli
gcgcgtatcagtacgctgcttgact

SEQ ID NO: 113311 - DNA, 25 bp, E. coli
gctccggcgcgtttcagtacgctgc

SEQ ID NO: 113312 - DNA, 25 bp, E. coli
gctccggcgcgtatcagtacgctgc

SEQ ID NO: 113313 - DNA, 25 bp, E. coli
cgcgtatcagtacgctgcttgactg

SEQ ID NO: 113314 - DNA, 25 bp, E. coli
cgcgtatcagtaggctgcttgactg

SEQ ID NO: 113315 - DNA, 25 bp, E. coli
cggcgcgtatcagtacgctgcttga

SEQ ID NO: 113316 - DNA, 25 bp, E. coli
cgtatcagtacgctgcttgactggg

SEQ ID NO: 113317 - DNA, 25 bp, E. coli
cgtatcagtacggtgcttgactggg

SEQ ID NO: 113318 - DNA, 25 bp, E. coli
cggcgcgtatcactacgctgcttga

SEQ ID NO: 113319 - DNA, 25 bp, E. coli
gtatcagtacgcagcttgactgggt

SEQ ID NO: 113320 - DNA, 25 bp, E. coli
gtatcagtacgctgcttgactgggt

SEQ ID NO: 113321 - DNA, 25 bp, E. coli
ggcgcgtatcagaacgctgcttgac

SEQ ID NO: 113322 - DNA, 25 bp, E. coli
ggcgcgtatcagtacgctgcttgac

SEQ ID NO: 113323 - DNA, 25 bp, E. coli
taaaatgccgaatctgcgtcagcag

SEQ ID NO: 113324 - DNA, 25 bp, E. coli
taaaatgccgaaactgcgtcagcag

SEQ ID NO: 113325 - DNA, 25 bp, E. coli
tataccatcactcagcaaggcgacg

SEQ ID NO: 113326 - DNA, 25 bp, E. coli
tatacggcgcatacagtctggcggt

SEQ ID NO: 113327 - DNA, 25 bp, E. coli
tataccatcactgagcaaggcgacg

SEQ ID NO: 113328 - DNA, 25 bp, E. coli
tatacggcgcattcagtctggcggt

SEQ ID NO: 113329 - DNA, 25 bp, E. coli
tgtgaaatcccgatcgaaacgctgg

SEQ ID NO: 113330 - DNA, 25 bp, E. coli
tgatcccggaaaagcgaattatacg

SEQ ID NO: 113331 - DNA, 25 bp, E. coli
tgatcccggaaatgcgaattatacg

SEQ ID NO: 113332 - DNA, 25 bp, E. coli
tgtgaaatcccgttcgaaacgctgg

SEQ ID NO: 113333 - DNA, 25 bp, E. coli
tcattgagcggaagaagcctattca

SEQ ID NO: 113334 - DNA, 25 bp, E. coli
tcattgagcggatgaagcctattca

SEQ ID NO: 113335 - DNA, 25 bp, E. coli
cctattcagaaaggccagacgctgt

SEQ ID NO: 113336 - DNA, 25 bp, E. coli
cctattcagaaacgccagacgctgt

SEQ ID NO: 113337 - DNA, 25 bp, E. coli
gccgaggaacgtgtggctgcattca

SEQ ID NO: 113338 - DNA, 25 bp, E. coli
gccgaggaacgtctggctgcattca

SEQ ID NO: 113339 - DNA, 25 bp, E. coli
gaattccgcctgtcgatgactcgtg

SEQ ID NO: 113340 - DNA, 25 bp, E. coli
gaattccgcctgacgatgactcgtg

SEQ ID NO: 113341 - DNA, 25 bp, E. coli
gcaaggcgacgagcaaatcactggt

SEQ ID NO: 113342 - DNA, 25 bp, E. coli
gcaaggcgacgaccaaatcactggt

SEQ ID NO: 113343 - DNA, 25 bp, E. coli
cgaaaataacgaagcgctggcccag

SEQ ID NO: 113344 - DNA, 25 bp, E. coli
cgaaaataacgatgcgctggcccag

SEQ ID NO: 113345 - DNA, 25 bp, E. coli
aatggctgctatactatgttattca

SEQ ID NO: 113346 - DNA, 25 bp, E. coli
aatggctgctattctatgttattca

SEQ ID NO: 113347 - DNA, 25 bp, E. coli
caaaggattttcatggaacgtgcga

SEQ ID NO: 113348 - DNA, 25 bp, E. coli
caaaggattttcttggaacgtgcga

SEQ ID NO: 113349 - DNA, 25 bp, E. coli
catcaggctgcttgtactggtgcaa

SEQ ID NO: 113350 - DNA, 25 bp, E. coli
catcaggctgctagtactggtgcaa

SEQ ID NO: 113351 - DNA, 25 bp, E. coli
taaatactcgtcaaacatcaggctg

SEQ ID NO: 113352 - DNA, 25 bp, E. coli
tactggtgcaatgctgatttcttag

SEQ ID NO: 113353 - DNA, 25 bp, E. coli
taaatactcgtctaacatcaggctg

SEQ ID NO: 113354 - DNA, 25 bp, E. coli
tactggtgcaatcctgatttcttag

SEQ ID NO: 113355 - DNA, 25 bp, E. coli
aaatgccgtcatcttatttgtatga

SEQ ID NO: 113356 - DNA, 25 bp, E. coli
aaatgccgtcatgttatttgtatga

SEQ ID NO: 113357 - DNA, 25 bp, E. coli
ttcgtagaaaaactgaatggctgct

SEQ ID NO: 113358 - DNA, 25 bp, E. coli
ttcgtagaaaaagtgaatggctgct

SEQ ID NO: 113359 - DNA, 25 bp, E. coli
tgtatgaccaataagtgatcattgg

SEQ ID NO: 113360 - DNA, 25 bp, E. coli
tgtatgaccaattagtgatcattgg

SEQ ID NO: 113361 - DNA, 25 bp, E. coli
tgaaacattacgctttgcaaaggat

SEQ ID NO: 113362 - DNA, 25 bp, E. coli
tgaaacattacggtttgcaaaggat

SEQ ID NO: 113363 - DNA, 25 bp, E. coli
ggaacgtgcgagtaaaatgccgtca

SEQ ID NO: 113364 - DNA, 25 bp, E. coli
ggaacgtgcgagaaaaatgccgtca

SEQ ID NO: 113365 - DNA, 25 bp, E. coli
gagggttcctgattcgtagaaaaag

SEQ ID NO: 113366 - DNA, 25 bp, E. coli
gagggttcctgaatcgtagaaaaag

SEQ ID NO: 113367 - DNA, 25 bp, E. coli
aagcagattgtccttaatcgccggg

SEQ ID NO: 113368 - DNA, 25 bp, E. coli
aagcagattgtcgttaatcgccggg

SEQ ID NO: 113369 - DNA, 25 bp, E. coli
cacgcgaccgaagccagtgaataca

SEQ ID NO: 113370 - DNA, 25 bp, E. coli
cacgcgaccgaacccagtgaataca

SEQ ID NO: 113371 - DNA, 25 bp, E. coli
tatgggtatcagtctggcgtttctc

SEQ ID NO: 113372 - DNA, 25 bp, E. coli
tatgggtatcagactggcgtttctc

SEQ ID NO: 113373 - DNA, 25 bp, E. coli
tattcagttgcggaataatggcatg

SEQ ID NO: 113374 - DNA, 25 bp, E. coli
tattcagttgcgcaataatggcatg

SEQ ID NO: 113375 - DNA, 25 bp, E. coli
ttttactgtgtaatattgccgccct

SEQ ID NO: 113376 - DNA, 25 bp, E. coli
ttttactgtgtattattgccgccct

SEQ ID NO: 113377 - DNA, 25 bp, E. coli
gcgtttctcgattacctcgccagta

SEQ ID NO: 113378 - DNA, 25 bp, E. coli
gcgtttctcgataacctcgccagta

SEQ ID NO: 113379 - DNA, 25 bp, E. coli
gaaaaactcccgacgcgtattgcga

SEQ ID NO: 113380 - DNA, 25 bp, E. coli
gaaaaactcccgtcgcgtattgcga

SEQ ID NO: 113381 - DNA, 25 bp, E. coli
cgttttttaatgatctggcccgtga

SEQ ID NO: 113382 - DNA, 25 bp, E. coli
cgttttttaatgttctggcccgtga

SEQ ID NO: 113383 - DNA, 25 bp, E. coli
tgtgggttacctcattccgcttcgc

SEQ ID NO: 113384 - DNA, 25 bp, E. coli
ggactggctttcttacaacacgcga

SEQ ID NO: 113385 - DNA, 25 bp, E. coli
tgtgggttacctgattccgcttcgc

SEQ ID NO: 113386 - DNA, 25 bp, E. coli
ggactggctttcatacaacacgcga

SEQ ID NO: 113387 - DNA, 25 bp, E. coli
gtcgctaaaactgtgcggcgtagta

SEQ ID NO: 113388 - DNA, 25 bp, E. coli
gtcgctaaaactctgcggcgtagta

SEQ ID NO: 113389 - DNA, 25 bp, E. coli
cacgtcgaatcacgcaaagccggtc

SEQ ID NO: 113390 - DNA, 25 bp, E. coli
cacgtcgaatcaggcaaagccggtc

SEQ ID NO: 113391 - DNA, 25 bp, E. coli
caggcaaagccggtcaagaagacat

SEQ ID NO: 113392 - DNA, 25 bp, E. coli
caggcaaagccgctcaagaagacat

SEQ ID NO: 113393 - DNA, 25 bp, E. coli
aacgcttcttgcctgttcgtttggg

SEQ ID NO: 113394 - DNA, 25 bp, E. coli
aacgcttcttgcgtgttcgtttggg

SEQ ID NO: 113395 - DNA, 25 bp, E. coli
tttggggtaatctccgcgctggcgc

SEQ ID NO: 113396 - DNA, 25 bp, E. coli
tatttcgcatggattctgggaacgc

SEQ ID NO: 113397 - DNA, 25 bp, E. coli
tatttcgcatggtttctgggaacgc

SEQ ID NO: 113398 - DNA, 25 bp, E. coli
tttggggtaatcaccgcgctggcgc

SEQ ID NO: 113399 - DNA, 25 bp, E. coli
tgggaacgcttcttgcctgttcgtt

SEQ ID NO: 113400 - DNA, 25 bp, E. coli
tgggaacgcttcatgcctgttcgtt

SEQ ID NO: 113401 - DNA, 25 bp, E. coli
gcctgttcgtttcgggtaatcaccg

SEQ ID NO: 113402 - DNA, 25 bp, E. coli
gcctgttcgtttggggtaatcaccg

SEQ ID NO: 113403 - DNA, 25 bp, E. coli
gaatcaggcaaacccggtcaagaag

SEQ ID NO: 113404 - DNA, 25 bp, E. coli
gcaaagccggtcaagaagacatctg

SEQ ID NO: 113405 - DNA, 25 bp, E. coli
gcaaagccggtctagaagacatctg

SEQ ID NO: 113406 - DNA, 25 bp, E. coli
gaatcaggcaaagccggtcaagaag

SEQ ID NO: 113407 - DNA, 25 bp, E. coli
cgtcgaatcagggaaagccggtcaa

SEQ ID NO: 113408 - DNA, 25 bp, E. coli
cgtcgaatcaggcaaagccggtcaa

SEQ ID NO: 113409 - DNA, 25 bp, E. coli
gtggtatttcgcatggattctggga

SEQ ID NO: 113410 - DNA, 25 bp, E. coli
gtggtatttcgcttggattctggga

SEQ ID NO: 113411 - DNA, 25 bp, E. coli
caaccgggttttgactttcagcaag

SEQ ID NO: 113412 - DNA, 25 bp, E. coli
caaccgggttttcactttcagcaag

SEQ ID NO: 113413 - DNA, 25 bp, E. coli
taaagtagcgaatgaagcctgtccg

SEQ ID NO: 113414 - DNA, 25 bp, E. coli
taaacgatattaagcatacgggcga

SEQ ID NO: 113415 - DNA, 25 bp, E. coli
taaagtagcgaaagaagcctgtccg

SEQ ID NO: 113416 - DNA, 25 bp, E. coli
taaacgatattatgcatacgggcga

SEQ ID NO: 113417 - DNA, 25 bp, E. coli
tgagatcccgcatgttaagaaaacg

SEQ ID NO: 113418 - DNA, 25 bp, E. coli
tgagatcccgcaagttaagaaaacg

SEQ ID NO: 113419 - DNA, 25 bp, E. coli
tgcctggcggaggttgatcaataca

SEQ ID NO: 113420 - DNA, 25 bp, E. coli
tgcctggcggagcttgatcaataca

SEQ ID NO: 113421 - DNA, 25 bp, E. coli
gcggcgcactgggtcgtaaacttct

SEQ ID NO: 113422 - DNA, 25 bp, E. coli
gcggcgcactggctcgtaaacttct

SEQ ID NO: 113423 - DNA, 25 bp, E. coli
cgattgaacgtgtatgcctggcgga

SEQ ID NO: 113424 - DNA, 25 bp, E. coli
cgattgaacgtgaatgcctggcgga

SEQ ID NO: 113425 - DNA, 25 bp, E. coli
tgtcgcacgtagtgttacaaccggg

SEQ ID NO: 113426 - DNA, 25 bp, E. coli
tgtcgcacgtagagttacaaccggg

SEQ ID NO: 113427 - DNA, 25 bp, E. coli
taagtattgccgttgtgatgacgcc

SEQ ID NO: 113428 - DNA, 25 bp, E. coli
taaacttctgctccgcgtaaacgat

SEQ ID NO: 113429 - DNA, 25 bp, E. coli
taagtattgccgatgtgatgacgcc

SEQ ID NO: 113430 - DNA, 25 bp, E. coli
taagaaaacggccagtctgcgtgac

SEQ ID NO: 113431 - DNA, 25 bp, E. coli
taagaaaacggcgagtctgcgtgac

SEQ ID NO: 113432 - DNA, 25 bp, E. coli
taaacttctgctgcgcgtaaacgat

SEQ ID NO: 113433 - DNA, 25 bp, E. coli
tacaccaacccgaattacggcgatg

SEQ ID NO: 113434 - DNA, 25 bp, E. coli
tacaccaacccgtattacggcgatg

SEQ ID NO: 113435 - DNA, 25 bp, E. coli
tatgccgcagcggtaggaggtggtt

SEQ ID NO: 113436 - DNA, 25 bp, E. coli
tatgccgcagcgctaggaggtggtt

SEQ ID NO: 113437 - DNA, 25 bp, E. coli
tattgaggcgggatatcgctacctg

SEQ ID NO: 113438 - DNA, 25 bp, E. coli
tattgaggcgggttatcgctacctg

SEQ ID NO: 113439 - DNA, 25 bp, E. coli
tgaatctgtcggctaaagacggtaa

SEQ ID NO: 113440 - DNA, 25 bp, E. coli
tgaatctgtcgggtaaagacggtaa

SEQ ID NO: 113441 - DNA, 25 bp, E. coli
ccaacccgaattacggcgatgaagg

SEQ ID NO: 113442 - DNA, 25 bp, E. coli
ccaacccgaatttcggcgatgaagg

SEQ ID NO: 113443 - DNA, 25 bp, E. coli
gcaacagcttccctttgtttggcga

SEQ ID NO: 113444 - DNA, 25 bp, E. coli
gcaacagcttccgtttgtttggcga

SEQ ID NO: 113445 - DNA, 25 bp, E. coli
gaaaattggcaacagcttccgtttg

SEQ ID NO: 113446 - DNA, 25 bp, E. coli
gaaaattggcaagagcttccgtttg

SEQ ID NO: 113447 - DNA, 25 bp, E. coli
cgtccagtcagttttgaggcgggtt

SEQ ID NO: 113448 - DNA, 25 bp, E. coli
cgtccagtcagtattgaggcgggtt

SEQ ID NO: 113449 - DNA, 25 bp, E. coli
gttatcgctaccagaatctgtcggg

SEQ ID NO: 113450 - DNA, 25 bp, E. coli
gtaaccgcgacaacgccgtggctga

SEQ ID NO: 113451 - DNA, 25 bp, E. coli
gttatcgctacctgaatctgtcggg

SEQ ID NO: 113452 - DNA, 25 bp, E. coli
gtaaccgcgacatcgccgtggctga

SEQ ID NO: 113453 - DNA, 25 bp, E. coli
tggtttgcagtgcaaaattggcaac

SEQ ID NO: 113454 - DNA, 25 bp, E. coli
tggtttgcagtggaaaattggcaac

SEQ ID NO: 113455 - DNA, 25 bp, E. coli
catgaaatcggcgtgagcgttgact

SEQ ID NO: 113456 - DNA, 25 bp, E. coli
catgaaatcggcctgagcgttgact

SEQ ID NO: 113457 - DNA, 25 bp, E. coli
tactgaactggtaaccggcacgggt

SEQ ID NO: 113458 - DNA, 25 bp, E. coli
tactgaactggttaccggcacgggt

SEQ ID NO: 113459 - DNA, 25 bp, E. coli
aactgttgacctagacgcttccgca

SEQ ID NO: 113460 - DNA, 25 bp, E. coli
aactgttgaccttgacgcttccgca

SEQ ID NO: 113461 - DNA, 25 bp, E. coli
tatgcagccattgatctcggttcga

SEQ ID NO: 113462 - DNA, 25 bp, E. coli
tatgcagccattcatctcggttcga

SEQ ID NO: 113463 - DNA, 25 bp, E. coli
tattcagtgtatcaccctggcgggc

SEQ ID NO: 113464 - DNA, 25 bp, E. coli
tattcagtgtatgaccctggcgggc

SEQ ID NO: 113465 - DNA, 25 bp, E. coli
tcgatattgatctggcacagcgcgt

SEQ ID NO: 113466 - DNA, 25 bp, E. coli
tcgatattgatcaggcacagcgcgt

SEQ ID NO: 113467 - DNA, 25 bp, E. coli
ccgtgcaggcgtaacaggaaatcat

SEQ ID NO: 113468 - DNA, 25 bp, E. coli
ccgtgcaggcgttacaggaaatcat

SEQ ID NO: 113469 - DNA, 25 bp, E. coli
gaattacggtatcacggctggaaag

SEQ ID NO: 113470 - DNA, 25 bp, E. coli
gcaaattcgcgttgtcgctacggcg

SEQ ID NO: 113471 - DNA, 25 bp, E. coli
gaattacggtatgacggctggaaag

SEQ ID NO: 113472 - DNA, 25 bp, E. coli
gcaaattcgcgtagtcgctacggcg

SEQ ID NO: 113473 - DNA, 25 bp, E. coli
ggcatcttgaaggaataagccgcga

SEQ ID NO: 113474 - DNA, 25 bp, E. coli
ggcatcttgaagcaataagccgcga

SEQ ID NO: 113475 - DNA, 25 bp, E. coli
gatggatgaacggattaccctggaa

SEQ ID NO: 113476 - DNA, 25 bp, E. coli
gatggatgaacgcattaccctggaa

SEQ ID NO: 113477 - DNA, 25 bp, E. coli
cacagaaaccgcagtcaatgacgca

SEQ ID NO: 113478 - DNA, 25 bp, E. coli
cacagaaaccgctgtcaatgacgca

SEQ ID NO: 113479 - DNA, 25 bp, E. coli
taacacgagaaagtctggctattcc

SEQ ID NO: 113480 - DNA, 25 bp, E. coli
taacacgagaaactctggctattcc

SEQ ID NO: 113481 - DNA, 25 bp, E. coli
acgagaaagtctggctattccgtaa

SEQ ID NO: 113482 - DNA, 25 bp, E. coli
acgagaaagtctcgctattccgtaa

SEQ ID NO: 113483 - DNA, 25 bp, E. coli
ttatctgaatgatatgtgtcaatcc

SEQ ID NO: 113484 - DNA, 25 bp, E. coli
ttatctgaatgaaatgtgtcaatcc

SEQ ID NO: 113485 - DNA, 25 bp, E. coli
tgtcaatgacgcattttgtcggacg

SEQ ID NO: 113486 - DNA, 25 bp, E. coli
tgtgtcaatccagagaaaccgctgt

SEQ ID NO: 113487 - DNA, 25 bp, E. coli
tgtgtcaatccacagaaaccgctgt

SEQ ID NO: 113488 - DNA, 25 bp, E. coli
tgtcggacgttatcacgagaaagtc

SEQ ID NO: 113489 - DNA, 25 bp, E. coli
tgtcggacgttaacacgagaaagtc

SEQ ID NO: 113490 - DNA, 25 bp, E. coli
tgtcaatgacgctttttgtcggacg

SEQ ID NO: 113491 - DNA, 25 bp, E. coli
gacgttaacacgtgaaagtctggct

SEQ ID NO: 113492 - DNA, 25 bp, E. coli
gacgttaacacgagaaagtctggct

SEQ ID NO: 113493 - DNA, 25 bp, E. coli
gaaatgtgtcaatccacagaaaccg

SEQ ID NO: 113494 - DNA, 25 bp, E. coli
gaaatgtgtcaaaccacagaaaccg

SEQ ID NO: 113495 - DNA, 25 bp, E. coli
cggcagtagcattaattcattatct

SEQ ID NO: 113496 - DNA, 25 bp, E. coli
cggcagtagcataaattcattatct

SEQ ID NO: 113497 - DNA, 25 bp, E. coli
gacgcattttgtcggacgttaacac

SEQ ID NO: 113498 - DNA, 25 bp, E. coli
gacgcattttgtgggacgttaacac

SEQ ID NO: 113499 - DNA, 25 bp, E. coli
caaagaaaggtcctcgttccagcgg

SEQ ID NO: 113500 - DNA, 25 bp, E. coli
caaaatctgatgaaccgcaggaggc

SEQ ID NO: 113501 - DNA, 25 bp, E. coli
caaagaaaggtcgtcgttccagcgg

SEQ ID NO: 113502 - DNA, 25 bp, E. coli
caaaatctgatgtaccgcaggaggc

SEQ ID NO: 113503 - DNA, 25 bp, E. coli
gacgttggacgtaaagccgacgacg

SEQ ID NO: 113504 - DNA, 25 bp, E. coli
gacgttggacgttaagccgacgacg

SEQ ID NO: 113505 - DNA, 25 bp, E. coli
tattcactctaatgtgaccgccggc

SEQ ID NO: 113506 - DNA, 25 bp, E. coli
tattcactctaaagtgaccgccggc

SEQ ID NO: 113507 - DNA, 25 bp, E. coli
tgtatgcccatatggtgatcgcccg

SEQ ID NO: 113508 - DNA, 25 bp, E. coli
tgtatgcccataaggtgatcgcccg

SEQ ID NO: 113509 - DNA, 25 bp, E. coli
gccgcaatgaaatccgctaacgtta

SEQ ID NO: 113510 - DNA, 25 bp, E. coli
gccgcaatgaaaaccgctaacgtta

SEQ ID NO: 113511 - DNA, 25 bp, E. coli
gaacctcaacctcaagtgcctgctg

SEQ ID NO: 113512 - DNA, 25 bp, E. coli
gaacctcaacctgaagtgcctgctg

SEQ ID NO: 113513 - DNA, 25 bp, E. coli
cgacgcgcagcagagttgaatttat

SEQ ID NO: 113514 - DNA, 25 bp, E. coli
cgacgcgcagcacagttgaatttat

SEQ ID NO: 113515 - DNA, 25 bp, E. coli
cgtggagcagcaacaaccggttaaa

SEQ ID NO: 113516 - DNA, 25 bp, E. coli
cgtggagcagcatcaaccggttaaa

SEQ ID NO: 113517 - DNA, 25 bp, E. coli
taatcgaaaccgacgggatgtctgc

SEQ ID NO: 113518 - DNA, 25 bp, E. coli
taatcgaaaccgtcgggatgtctgc

SEQ ID NO: 113519 - DNA, 25 bp, E. coli
gatgaaacgctgtagtccgtggagc

SEQ ID NO: 113520 - DNA, 25 bp, E. coli
gatgaaacgctgaagtccgtggagc

SEQ ID NO: 113521 - DNA, 25 bp, E. coli
caatgtcgctgacgactggcaaatg

SEQ ID NO: 113522 - DNA, 25 bp, E. coli
caatgtcgctgaggactggcaaatg

SEQ ID NO: 113523 - DNA, 25 bp, E. coli
atggagttggtaacaaattgtgtgg

SEQ ID NO: 113524 - DNA, 25 bp, E. coli
atggagttggtatcaaattgtgtgg

SEQ ID NO: 113525 - DNA, 25 bp, E. coli
ttggcaattcttggcggatcacgga

SEQ ID NO: 113526 - DNA, 25 bp, E. coli
ttggcaattcttcgcggatcacgga

SEQ ID NO: 113527 - DNA, 25 bp, E. coli
tcgctgaggactcgcaaatggctat

SEQ ID NO: 113528 - DNA, 25 bp, E. coli
tcgctgaggactggcaaatggctat

SEQ ID NO: 113529 - DNA, 25 bp, E. coli
tcttggcggatcacggaaatgggca

SEQ ID NO: 113530 - DNA, 25 bp, E. coli
tcttggcggatctcggaaatgggca

SEQ ID NO: 113531 - DNA, 25 bp, E. coli
gctatgatccgcattattatcgggt

SEQ ID NO: 113532 - DNA, 25 bp, E. coli
gctatgatccgctttattatcgggt

SEQ ID NO: 113533 - DNA, 25 bp, E. coli
gaaatgggcaatctcgctgaggact

SEQ ID NO: 113534 - DNA, 25 bp, E. coli
gaaatgggcaatgtcgctgaggact

SEQ ID NO: 113535 - DNA, 25 bp, E. coli
gatcacggaaatgggcaatgtcgct

SEQ ID NO: 113536 - DNA, 25 bp, E. coli
gatcacggaaatcggcaatgtcgct

SEQ ID NO: 113537 - DNA, 25 bp, E. coli
ggactggcaaatggctatgatccgc

SEQ ID NO: 113538 - DNA, 25 bp, E. coli
ggactggcaaatcgctatgatccgc

SEQ ID NO: 113539 - DNA, 25 bp, E. coli
ggcaaatggctaagatccgctttat

SEQ ID NO: 113540 - DNA, 25 bp, E. coli
ggcaaatggctatgatccgctttat

SEQ ID NO: 113541 - DNA, 25 bp, E. coli
taacaaattgtgaggttggcaattc

SEQ ID NO: 113542 - DNA, 25 bp, E. coli
taacaaattgtgtggttggcaattc

SEQ ID NO: 113543 - DNA, 25 bp, E. coli
caaagattatcactgcccgaatggc

SEQ ID NO: 113544 - DNA, 25 bp, E. coli
caaagattatcagtgcccgaatggc

SEQ ID NO: 113545 - DNA, 25 bp, E. coli
aggatttaacccagcgcaggcaaca

SEQ ID NO: 113546 - DNA, 25 bp, E. coli
aggatttaaccctgcgcaggcaaca

SEQ ID NO: 113547 - DNA, 25 bp, E. coli
aaaggcaggcgctcagacattacgg

SEQ ID NO: 113548 - DNA, 25 bp, E. coli
aaaggcaggcgcacagacattacgg

SEQ ID NO: 113549 - DNA, 25 bp, E. coli
tatttgacagcgaaagcagacggca

SEQ ID NO: 113550 - DNA, 25 bp, E. coli
tatttgacagcgtaagcagacggca

SEQ ID NO: 113551 - DNA, 25 bp, E. coli
tgagcagcgatctctgtcagaacgg

SEQ ID NO: 113552 - DNA, 25 bp, E. coli
tgagcagcgatcactgtcagaacgg

SEQ ID NO: 113553 - DNA, 25 bp, E. coli
tcataacaggatcgcgcaagtcgtg

SEQ ID NO: 113554 - DNA, 25 bp, E. coli
tcataacaggatggcgcaagtcgtg

SEQ ID NO: 113555 - DNA, 25 bp, E. coli
tctatccaggaggacaggctgcaac

SEQ ID NO: 113556 - DNA, 25 bp, E. coli
tctatccaggagcacaggctgcaac

SEQ ID NO: 113557 - DNA, 25 bp, E. coli
gcttaacctgaattgcgatgctctg

SEQ ID NO: 113558 - DNA, 25 bp, E. coli
gcttaacctgaaatgcgatgctctg

SEQ ID NO: 113559 - DNA, 25 bp, E. coli
gatatctgggaccacatgttgcaca

SEQ ID NO: 113560 - DNA, 25 bp, E. coli
gatatctgggacgacatgttgcaca

SEQ ID NO: 113561 - DNA, 25 bp, E. coli
tcaagcaaacagaggagaccaggtg

SEQ ID NO: 113562 - DNA, 25 bp, E. coli
tcaagcaaacagtggagaccaggtg

SEQ ID NO: 113563 - DNA, 25 bp, E. coli
gatgctacttgctcttgtcactgga

SEQ ID NO: 113564 - DNA, 25 bp, E. coli
gatgctacttgcacttgtcactgga

SEQ ID NO: 113565 - DNA, 25 bp, E. coli
aattatgactggctgaaactgccgc

SEQ ID NO: 113566 - DNA, 25 bp, E. coli
aattatgactgggtgaaactgccgc

SEQ ID NO: 113567 - DNA, 25 bp, E. coli
cagttaggccgtttgctgcgtcagg

SEQ ID NO: 113568 - DNA, 25 bp, E. coli
cagttaggccgtatgctgcgtcagg

SEQ ID NO: 113569 - DNA, 25 bp, E. coli
tgacgcataaccagcatcaggacgg

SEQ ID NO: 113570 - DNA, 25 bp, E. coli
tgacgcataacctgcatcaggacgg

SEQ ID NO: 113571 - DNA, 25 bp, E. coli
tcaggcaggcgaaccgttaggcatt

SEQ ID NO: 113572 - DNA, 25 bp, E. coli
tcaggcaggcgatccgttaggcatt

SEQ ID NO: 113573 - DNA, 25 bp, E. coli
gccatccggcctttgtgaaccgcga

SEQ ID NO: 113574 - DNA, 25 bp, E. coli
gccatccggcctatgtgaaccgcga

SEQ ID NO: 113575 - DNA, 25 bp, E. coli
gcgaatgtattgacgagcagggcat

SEQ ID NO: 113576 - DNA, 25 bp, E. coli
gcggtgccttttcaacaaagcgtga

SEQ ID NO: 113577 - DNA, 25 bp, E. coli
gcgaatgtattgtcgagcagggcat

SEQ ID NO: 113578 - DNA, 25 bp, E. coli
gcggtgccttttgaacaaagcgtga

SEQ ID NO: 113579 - DNA, 25 bp, E. coli
gaatttgaccgacagcgacacatcg

SEQ ID NO: 113580 - DNA, 25 bp, E. coli
gaatttgaccgagagcgacacatcg

SEQ ID NO: 113581 - DNA, 25 bp, E. coli
cgtgtgcataactgcggtcactgga

SEQ ID NO: 113582 - DNA, 25 bp, E. coli
cgtgtgcataacagcggtcactgga

SEQ ID NO: 113583 - DNA, 25 bp, E. coli
tggtacgacaaagaagtccgtccgg

SEQ ID NO: 113584 - DNA, 25 bp, E. coli
tggtacgacaaacaagtccgtccgg

SEQ ID NO: 113585 - DNA, 25 bp, E. coli
gatggcagcaccgtgttttatccgc

SEQ ID NO: 113586 - DNA, 25 bp, E. coli
gatggcagcaccctgttttatccgc

SEQ ID NO: 113587 - DNA, 25 bp, E. coli
cacttgctgttaaccattccaatta

SEQ ID NO: 113588 - DNA, 25 bp, E. coli
catgtatcttgtgggaaatttcttt

SEQ ID NO: 113589 - DNA, 25 bp, E. coli
cacttgctgttatccattccaatta

SEQ ID NO: 113590 - DNA, 25 bp, E. coli
caggcgtttgcagtcctgtgtgcct

SEQ ID NO: 113591 - DNA, 25 bp, E. coli
catgtatcttgtcggaaatttcttt

SEQ ID NO: 113592 - DNA, 25 bp, E. coli
caggcgtttgcactcctgtgtgcct

SEQ ID NO: 113593 - DNA, 25 bp, E. coli
tcttttttacagaccgccgtcatga

SEQ ID NO: 113594 - DNA, 25 bp, E. coli
tcctgtgtgcctctgcaatattacg

SEQ ID NO: 113595 - DNA, 25 bp, E. coli
tcttttttacagtccgccgtcatga

SEQ ID NO: 113596 - DNA, 25 bp, E. coli
tcctgtgtgcctgtgcaatattacg

SEQ ID NO: 113597 - DNA, 25 bp, E. coli
tcatgatcggcagccaggcgtttgc

SEQ ID NO: 113598 - DNA, 25 bp, E. coli
tcatgatcggcacccaggcgtttgc

SEQ ID NO: 113599 - DNA, 25 bp, E. coli
cccgtttaatttggccacttgctgt

SEQ ID NO: 113600 - DNA, 25 bp, E. coli
cccgtttaatttcgccacttgctgt

SEQ ID NO: 113601 - DNA, 25 bp, E. coli
ctcgcagtactgttttcctttagtg

SEQ ID NO: 113602 - DNA, 25 bp, E. coli
ctcgcagtactgatttcctttagtg

SEQ ID NO: 113603 - DNA, 25 bp, E. coli
gatatttaattggtcgtccgcagcc

SEQ ID NO: 113604 - DNA, 25 bp, E. coli
gatatttaattgctcgtccgcagcc

SEQ ID NO: 113605 - DNA, 25 bp, E. coli
tggcagctcttagcgtgctgctact

SEQ ID NO: 113606 - DNA, 25 bp, E. coli
tggcagctcttaccgtgctgctact

SEQ ID NO: 113607 - DNA, 25 bp, E. coli
gatgtgcacaccgtatgaaaatgac

SEQ ID NO: 113608 - DNA, 25 bp, E. coli
gatgtgcacaccctatgaaaatgac

SEQ ID NO: 113609 - DNA, 25 bp, E. coli
caaccagatgccgatagcgatatca

SEQ ID NO: 113610 - DNA, 25 bp, E. coli
caaccagatgcccatagcgatatca

SEQ ID NO: 113611 - DNA, 25 bp, E. coli
acagcgcggtttctaccctggatga

SEQ ID NO: 113612 - DNA, 25 bp, E. coli
acagcgcggtttgtaccctggatga

SEQ ID NO: 113613 - DNA, 25 bp, E. coli
tcgcaaggtacaacagtatctgacc

SEQ ID NO: 113614 - DNA, 25 bp, E. coli
tcgcaaggtacatcagtatctgacc

SEQ ID NO: 113615 - DNA, 25 bp, E. coli
gaaattcgcaagctacatcagtatc

SEQ ID NO: 113616 - DNA, 25 bp, E. coli
gaaattcgcaaggtacatcagtatc

SEQ ID NO: 113617 - DNA, 25 bp, E. coli
ccatcagcgccgaaattcgcaaggt

SEQ ID NO: 113618 - DNA, 25 bp, E. coli
ccatcagcgccgtaattcgcaaggt

SEQ ID NO: 113619 - DNA, 25 bp, E. coli
cgcatccgcagcagcgtgagcgggc

SEQ ID NO: 113620 - DNA, 25 bp, E. coli
cgccgaaattcggaaggtacatcag

SEQ ID NO: 113621 - DNA, 25 bp, E. coli
cgccgaaattcgcaaggtacatcag

SEQ ID NO: 113622 - DNA, 25 bp, E. coli
cgcatccgcagctgcgtgagcgggc

SEQ ID NO: 113623 - DNA, 25 bp, E. coli
gatagcgatatcaccgtaacggcag

SEQ ID NO: 113624 - DNA, 25 bp, E. coli
gattacagcgcgctttctaccctgg

SEQ ID NO: 113625 - DNA, 25 bp, E. coli
gatagcgatatctccgtaacggcag

SEQ ID NO: 113626 - DNA, 25 bp, E. coli
gattacagcgcggtttctaccctgg

SEQ ID NO: 113627 - DNA, 25 bp, E. coli
ggtttctaccctggatgatgttgag

SEQ ID NO: 113628 - DNA, 25 bp, E. coli
ggtttctaccctcgatgatgttgag

SEQ ID NO: 113629 - DNA, 25 bp, E. coli
gatgccgatagccatatcaccgtaa

SEQ ID NO: 113630 - DNA, 25 bp, E. coli
gatgccgatagcgatatcaccgtaa

SEQ ID NO: 113631 - DNA, 25 bp, E. coli
tacattgccgactgtaacagtgctc

SEQ ID NO: 113632 - DNA, 25 bp, E. coli
tacattgccgacagtaacagtgctc

SEQ ID NO: 113633 - DNA, 25 bp, E. coli
aacagtgctctgataggactacagc

SEQ ID NO: 113634 - DNA, 25 bp, E. coli
aacagtgctctgttaggactacagc

SEQ ID NO: 113635 - DNA, 25 bp, E. coli
tatccggcaaatccggagagcgcca

SEQ ID NO: 113636 - DNA, 25 bp, E. coli
tatccggcaaatgcggagagcgcca

SEQ ID NO: 113637 - DNA, 25 bp, E. coli
tggtttgcagcggtacattgccgac

SEQ ID NO: 113638 - DNA, 25 bp, E. coli
tgatctggcggttggcgtagcggaa

SEQ ID NO: 113639 - DNA, 25 bp, E. coli
tggtttgcagcgctacattgccgac

SEQ ID NO: 113640 - DNA, 25 bp, E. coli
tgatctggcggtaggcgtagcggaa

SEQ ID NO: 113641 - DNA, 25 bp, E. coli
tgcaccgaaagcctatccggagcag

SEQ ID NO: 113642 - DNA, 25 bp, E. coli
tgcaccgaaagcgtatccggagcag

SEQ ID NO: 113643 - DNA, 25 bp, E. coli
gcgaatatagctggctgctgaccac

SEQ ID NO: 113644 - DNA, 25 bp, E. coli
gcgaatatagctcgctgctgaccac

SEQ ID NO: 113645 - DNA, 25 bp, E. coli
gaaccggtgaatattcctggcacca

SEQ ID NO: 113646 - DNA, 25 bp, E. coli
gaaccggtgaattttcctggcacca

SEQ ID NO: 113647 - DNA, 25 bp, E. coli
gacgttccgtgcaccgaaagcgtat

SEQ ID NO: 113648 - DNA, 25 bp, E. coli
gacgttccgtgctccgaaagcgtat

SEQ ID NO: 113649 - DNA, 25 bp, E. coli
ctggatatggcccaaccggtgaata

SEQ ID NO: 113650 - DNA, 25 bp, E. coli
ctggatatggccgaaccggtgaata

SEQ ID NO: 113651 - DNA, 25 bp, E. coli
gtgctctgttagcactacagccgga

SEQ ID NO: 113652 - DNA, 25 bp, E. coli
gtgctctgttaggactacagccgga

SEQ ID NO: 113653 - DNA, 25 bp, E. coli
cacctgaaggagtaagagcataaca

SEQ ID NO: 113654 - DNA, 25 bp, E. coli
cacctgaaggagaaagagcataaca

SEQ ID NO: 113655 - DNA, 25 bp, E. coli
cagtaccaccaggttgagttcgaca

SEQ ID NO: 113656 - DNA, 25 bp, E. coli
cagtaccaccagcttgagttcgaca

SEQ ID NO: 113657 - DNA, 25 bp, E. coli
aaagccctctggcaatatactcagg

SEQ ID NO: 113658 - DNA, 25 bp, E. coli
aaagccctctgggaatatactcagg

SEQ ID NO: 113659 - DNA, 25 bp, E. coli
tatcttcagggtaatcccgagcagc

SEQ ID NO: 113660 - DNA, 25 bp, E. coli
tatcttcagggttatcccgagcagc

SEQ ID NO: 113661 - DNA, 25 bp, E. coli
tgcagggcggcatgctgaaagcaaa

SEQ ID NO: 113662 - DNA, 25 bp, E. coli
tgcagggcggcaagctgaaagcaaa

SEQ ID NO: 113663 - DNA, 25 bp, E. coli
tctgggcgatgtcctggcaaaacgc

SEQ ID NO: 113664 - DNA, 25 bp, E. coli
tctgggcgatgtgctggcaaaacgc

SEQ ID NO: 113665 - DNA, 25 bp, E. coli
ccggaaccgtttatgcgcatgatcg

SEQ ID NO: 113666 - DNA, 25 bp, E. coli
ccggaaccgtttttgcgcatgatcg

SEQ ID NO: 113667 - DNA, 25 bp, E. coli
cgtgggcggttatgagcaatcttac

SEQ ID NO: 113668 - DNA, 25 bp, E. coli
cgtgggcggttaagagcaatcttac

SEQ ID NO: 113669 - DNA, 25 bp, E. coli
gtcgctaccgtgtttcgcaacgcgc

SEQ ID NO: 113670 - DNA, 25 bp, E. coli
gtcgctaccgtgattcgcaacgcgc

SEQ ID NO: 113671 - DNA, 25 bp, E. coli
tggcaaaacgctttccgggaacaca

SEQ ID NO: 113672 - DNA, 25 bp, E. coli
tggcaaaacgctatccgggaacaca

SEQ ID NO: 113673 - DNA, 25 bp, E. coli
gagcagctacttacccaggtgcgaa

SEQ ID NO: 113674 - DNA, 25 bp, E. coli
gagcagctactttcccaggtgcgaa

SEQ ID NO: 113675 - DNA, 25 bp, E. coli
tactgtgggacaccaaaaagcgacg

SEQ ID NO: 113676 - DNA, 25 bp, E. coli
tactgtgggacagcaaaaagcgacg

SEQ ID NO: 113677 - DNA, 25 bp, E. coli
taaatttggcgacaaagagacgccg

SEQ ID NO: 113678 - DNA, 25 bp, E. coli
tacggataccgccaaagagcagatt

SEQ ID NO: 113679 - DNA, 25 bp, E. coli
taaatttggcgagaaagagacgccg

SEQ ID NO: 113680 - DNA, 25 bp, E. coli
tacggataccgcgaaagagcagatt

SEQ ID NO: 113681 - DNA, 25 bp, E. coli
tatctgcgaaaagaccgggatctgg

SEQ ID NO: 113682 - DNA, 25 bp, E. coli
tatacccgccggtatggtgcagaaa

SEQ ID NO: 113683 - DNA, 25 bp, E. coli
tatacccgccggaatggtgcagaaa

SEQ ID NO: 113684 - DNA, 25 bp, E. coli
tattgaacaggaaggctctccgacg

SEQ ID NO: 113685 - DNA, 25 bp, E. coli
tatctgcgaaaacaccgggatctgg

SEQ ID NO: 113686 - DNA, 25 bp, E. coli
tattgaacaggatggctctccgacg

SEQ ID NO: 113687 - DNA, 25 bp, E. coli
tgaaggctcggtgtggccaaagtcc

SEQ ID NO: 113688 - DNA, 25 bp, E. coli
tgaaggctcggtctggccaaagtcc

SEQ ID NO: 113689 - DNA, 25 bp, E. coli
gcgaacgtccggttgctgaagtgat

SEQ ID NO: 113690 - DNA, 25 bp, E. coli
gcgaacgtccggatgctgaagtgat

SEQ ID NO: 113691 - DNA, 25 bp, E. coli
gcagattattatgggccgccacgac

SEQ ID NO: 113692 - DNA, 25 bp, E. coli
gcagattattatcggccgccacgac

SEQ ID NO: 113693 - DNA, 25 bp, E. coli
cgtttggcctcatatggacgccgga

SEQ ID NO: 113694 - DNA, 25 bp, E. coli
cgtttggcctcaaatggacgccgga

SEQ ID NO: 113695 - DNA, 25 bp, E. coli
tggcaaaaagcagcgggataacacg

SEQ ID NO: 113696 - DNA, 25 bp, E. coli
tggcaaaaagcaccgggataacacg

SEQ ID NO: 113697 - DNA, 25 bp, E. coli
ccgcgtaccggtcagcaattccttt

SEQ ID NO: 113698 - DNA, 25 bp, E. coli
ccgcgtaccggtgagcaattccttt

SEQ ID NO: 113699 - DNA, 25 bp, E. coli
agcaaacagcaaccaaccgctggcg

SEQ ID NO: 113700 - DNA, 25 bp, E. coli
atgaagcccgcgtaccggtgagcaa

SEQ ID NO: 113701 - DNA, 25 bp, E. coli
atgaagcccgcgaaccggtgagcaa

SEQ ID NO: 113702 - DNA, 25 bp, E. coli
agcaaacagcaagcaaccgctggcg

SEQ ID NO: 113703 - DNA, 25 bp, E. coli
acatcaaacccctttttgagattgg

SEQ ID NO: 113704 - DNA, 25 bp, E. coli
acatcaaaccccattttgagattgg

SEQ ID NO: 113705 - DNA, 25 bp, E. coli
ttccgacgataaaggtcatgtggcg

SEQ ID NO: 113706 - DNA, 25 bp, E. coli
ttccgacgataatggtcatgtggcg

SEQ ID NO: 113707 - DNA, 25 bp, E. coli
gcctgtcatttatcagctacgatca

SEQ ID NO: 113708 - DNA, 25 bp, E. coli
gcctgtcatttaacagctacgatca

SEQ ID NO: 113709 - DNA, 25 bp, E. coli
ggataaagcagctaacagcaaccaa

SEQ ID NO: 113710 - DNA, 25 bp, E. coli
ggataaagcagcaaacagcaaccaa

SEQ ID NO: 113711 - DNA, 25 bp, E. coli
ggcagtgaaacggtttccgacgata

SEQ ID NO: 113712 - DNA, 25 bp, E. coli
ggcaaactacatgaaaccccatttt

SEQ ID NO: 113713 - DNA, 25 bp, E. coli
ggcaacatctattttcctctcggca

SEQ ID NO: 113714 - DNA, 25 bp, E. coli
ggcagtgaaacgctttccgacgata

SEQ ID NO: 113715 - DNA, 25 bp, E. coli
ggcaaactacatcaaaccccatttt

SEQ ID NO: 113716 - DNA, 25 bp, E. coli
ggcaacatctatattcctctcggca

SEQ ID NO: 113717 - DNA, 25 bp, E. coli
taatggtcatgtggcgttgaatctc

SEQ ID NO: 113718 - DNA, 25 bp, E. coli
taatggtcatgtcgcgttgaatctc

SEQ ID NO: 113719 - DNA, 25 bp, E. coli
caccaagttgtctgtgcgaccacca

SEQ ID NO: 113720 - DNA, 25 bp, E. coli
cagccctttggctgtgaggaaacgc

SEQ ID NO: 113721 - DNA, 25 bp, E. coli
cagccctttggcagtgaggaaacgc

SEQ ID NO: 113722 - DNA, 25 bp, E. coli
caccaagttgtcagtgcgaccacca

SEQ ID NO: 113723 - DNA, 25 bp, E. coli
taaaattcaggccattctgcaggca

SEQ ID NO: 113724 - DNA, 25 bp, E. coli
taaaattcaggcgattctgcaggca

SEQ ID NO: 113725 - DNA, 25 bp, E. coli
tatcaccaggcggtgatcctggcgc

SEQ ID NO: 113726 - DNA, 25 bp, E. coli
tatcaccaggcgctgatcctggcgc

SEQ ID NO: 113727 - DNA, 25 bp, E. coli
tgcaggcatttctcgagatcttcgg

SEQ ID NO: 113728 - DNA, 25 bp, E. coli
tgcaggcatttcacgagatcttcgg

SEQ ID NO: 113729 - DNA, 25 bp, E. coli
tcgagagcggtgaaccggaacagcc

SEQ ID NO: 113730 - DNA, 25 bp, E. coli
tcctggcgctgagtccgtttcataa

SEQ ID NO: 113731 - DNA, 25 bp, E. coli
tcgagagcggtgtaccggaacagcc

SEQ ID NO: 113732 - DNA, 25 bp, E. coli
tcctggcgctgactccgtttcataa

SEQ ID NO: 113733 - DNA, 25 bp, E. coli
ccggtattgatgtgattggtcgtaa

SEQ ID NO: 113734 - DNA, 25 bp, E. coli
ccggtattgatgagattggtcgtaa

SEQ ID NO: 113735 - DNA, 25 bp, E. coli
gcttggtcccgtgatgtcgcgttat

SEQ ID NO: 113736 - DNA, 25 bp, E. coli
gcttggtcccgtcatgtcgcgttat

SEQ ID NO: 113737 - DNA, 25 bp, E. coli
gacagcactttcagttgggtggtga

SEQ ID NO: 113738 - DNA, 25 bp, E. coli
gacagcactttctgttgggtggtga

SEQ ID NO: 113739 - DNA, 25 bp, E. coli
gatcttcggcgatggatcctgccat

SEQ ID NO: 113740 - DNA, 25 bp, E. coli
gatcttcggcgaaggatcctgccat

SEQ ID NO: 113741 - DNA, 25 bp, E. coli
tatttctccgatgagtttcagccgt

SEQ ID NO: 113742 - DNA, 25 bp, E. coli
tatttctccgatcagtttcagccgt

SEQ ID NO: 113743 - DNA, 25 bp, E. coli
tttgaggcgaagaaactgcgccgtg

SEQ ID NO: 113744 - DNA, 25 bp, E. coli
tttgaggcgaagtaactgcgccgtg

SEQ ID NO: 113745 - DNA, 25 bp, E. coli
tgggcacgggaaccatattttgaag

SEQ ID NO: 113746 - DNA, 25 bp, E. coli
tgggcacgggaagcatattttgaag

SEQ ID NO: 113747 - DNA, 25 bp, E. coli
tctccgatgagtatcagccgttatt

SEQ ID NO: 113748 - DNA, 25 bp, E. coli
tctccgatgagtttcagccgttatt

SEQ ID NO: 113749 - DNA, 25 bp, E. coli
gccagccattatatctccgatgagt

SEQ ID NO: 113750 - DNA, 25 bp, E. coli
gccagccattatttctccgatgagt

SEQ ID NO: 113751 - DNA, 25 bp, E. coli
gctgatgccagcgattatttctccg

SEQ ID NO: 113752 - DNA, 25 bp, E. coli
gcatgggcacgggaagcatattttg

SEQ ID NO: 113753 - DNA, 25 bp, E. coli
gctgatgccagccattatttctccg

SEQ ID NO: 113754 - DNA, 25 bp, E. coli
gcatgggcacggcaagcatattttg

SEQ ID NO: 113755 - DNA, 25 bp, E. coli
gaagaaactgcgccgtggcgattat

SEQ ID NO: 113756 - DNA, 25 bp, E. coli
gaagaaactgcggcgtggcgattat

SEQ ID NO: 113757 - DNA, 25 bp, E. coli
ccgatgagtttcagccgttattaaa

SEQ ID NO: 113758 - DNA, 25 bp, E. coli
ccgatgagtttctgccgttattaaa

SEQ ID NO: 113759 - DNA, 25 bp, E. coli
gatgccagccattatttctccgatg

SEQ ID NO: 113760 - DNA, 25 bp, E. coli
gagtttcagccgttattaaataccg

SEQ ID NO: 113761 - DNA, 25 bp, E. coli
gatgccagccataatttctccgatg

SEQ ID NO: 113762 - DNA, 25 bp, E. coli
gagtttcagccgatattaaataccg

SEQ ID NO: 113763 - DNA, 25 bp, E. coli
catttggcggtaacagttttactcc

SEQ ID NO: 113764 - DNA, 25 bp, E. coli
catttggcggtatcagttttactcc

SEQ ID NO: 113765 - DNA, 25 bp, E. coli
atttggcggtatcagttttactccg

SEQ ID NO: 113766 - DNA, 25 bp, E. coli
atttggcggtatgagttttactccg

SEQ ID NO: 113767 - DNA, 25 bp, E. coli
tatcagttttactccgtaactgctc

SEQ ID NO: 113768 - DNA, 25 bp, E. coli
tatcagttttacaccgtaactgctc

SEQ ID NO: 113769 - DNA, 25 bp, E. coli
ttttactccgtatctgctctgccgc

SEQ ID NO: 113770 - DNA, 25 bp, E. coli
ttttactccgtaactgctctgccgc

SEQ ID NO: 113771 - DNA, 25 bp, E. coli
tgacatttggcggtatcagttttac

SEQ ID NO: 113772 - DNA, 25 bp, E. coli
tgacatttggcgctatcagttttac

SEQ ID NO: 113773 - DNA, 25 bp, E. coli
ttggcggtatcagttttactccgta

SEQ ID NO: 113774 - DNA, 25 bp, E. coli
ttggcggtatcacttttactccgta

SEQ ID NO: 113775 - DNA, 25 bp, E. coli
gcggtatcagttatactccgtaact

SEQ ID NO: 113776 - DNA, 25 bp, E. coli
gcggtatcagttttactccgtaact

SEQ ID NO: 113777 - DNA, 25 bp, E. coli
gacatttggcggtatcagttttact

SEQ ID NO: 113778 - DNA, 25 bp, E. coli
gacatttggcggaatcagttttact

SEQ ID NO: 113779 - DNA, 25 bp, E. coli
gttttactccgttactgctctgccg

SEQ ID NO: 113780 - DNA, 25 bp, E. coli
gttttactccgtaactgctctgccg

SEQ ID NO: 113781 - DNA, 25 bp, E. coli
ggtatcagttttactccgtaactgc

SEQ ID NO: 113782 - DNA, 25 bp, E. coli
ggtatcagtttttctccgtaactgc

SEQ ID NO: 113783 - DNA, 25 bp, E. coli
tggcggtatcagatttactccgtaa

SEQ ID NO: 113784 - DNA, 25 bp, E. coli
tggcggtatcagttttactccgtaa

SEQ ID NO: 113785 - DNA, 25 bp, E. coli
aagcgcggacaaatacgctttctgg

SEQ ID NO: 113786 - DNA, 25 bp, E. coli
aagcgcggacaattacgctttctgg

SEQ ID NO: 113787 - DNA, 25 bp, E. coli
cagcatacgcacttctacaatcgac

SEQ ID NO: 113788 - DNA, 25 bp, E. coli
cagcatacgcacatctacaatcgac

SEQ ID NO: 113789 - DNA, 25 bp, E. coli
tacgcacatctacaatcgacactgg

SEQ ID NO: 113790 - DNA, 25 bp, E. coli
acgcacatctacaatcgacactgga

SEQ ID NO: 113791 - DNA, 25 bp, E. coli
acgttgcgcaaatgtccccgactct

SEQ ID NO: 113792 - DNA, 25 bp, E. coli
acgcacatctactatcgacactgga

SEQ ID NO: 113793 - DNA, 25 bp, E. coli
acgttgcgcaaaagtccccgactct

SEQ ID NO: 113794 - DNA, 25 bp, E. coli
tacgcacatctagaatcgacactgg

SEQ ID NO: 113795 - DNA, 25 bp, E. coli
tccagcatacgctcatctacaatcg

SEQ ID NO: 113796 - DNA, 25 bp, E. coli
tccagcatacgcacatctacaatcg

SEQ ID NO: 113797 - DNA, 25 bp, E. coli
gcggaaagcgcgcacaattacgctt

SEQ ID NO: 113798 - DNA, 25 bp, E. coli
gcatacgcacatgtacaatcgacac

SEQ ID NO: 113799 - DNA, 25 bp, E. coli
gcggaaagcgcggacaattacgctt

SEQ ID NO: 113800 - DNA, 25 bp, E. coli
gcatacgcacatctacaatcgacac

SEQ ID NO: 113801 - DNA, 25 bp, E. coli
cgcggacaattacgctttctggtca

SEQ ID NO: 113802 - DNA, 25 bp, E. coli
cgcggacaattaggctttctggtca

SEQ ID NO: 113803 - DNA, 25 bp, E. coli
cggacaattacggtttctggtcacg

SEQ ID NO: 113804 - DNA, 25 bp, E. coli
cggacaattacgctttctggtcacg

SEQ ID NO: 113805 - DNA, 25 bp, E. coli
gtacgctgttgcgtcaggcacagga

SEQ ID NO: 113806 - DNA, 25 bp, E. coli
gtacgctgttgcctcaggcacagga

SEQ ID NO: 113807 - DNA, 25 bp, E. coli
cacatagttcgatccggaacaggcg

SEQ ID NO: 113808 - DNA, 25 bp, E. coli
cacatagttcgaaccggaacaggcg

SEQ ID NO: 113809 - DNA, 25 bp, E. coli
catacaggcagaaataattgcggca

SEQ ID NO: 113810 - DNA, 25 bp, E. coli
catacaggcagatataattgcggca

SEQ ID NO: 113811 - DNA, 25 bp, E. coli
tacgtccgtcataggtgtgcatcac

SEQ ID NO: 113812 - DNA, 25 bp, E. coli
tacgtccgtcattggtgtgcatcac

SEQ ID NO: 113813 - DNA, 25 bp, E. coli
tactgatccagtacgaccatctctt

SEQ ID NO: 113814 - DNA, 25 bp, E. coli
tactgatccagttcgaccatctctt

SEQ ID NO: 113815 - DNA, 25 bp, E. coli
tatcagtctgtgctttgccgtcaga

SEQ ID NO: 113816 - DNA, 25 bp, E. coli
tatcagtctgtggtttgccgtcaga

SEQ ID NO: 113817 - DNA, 25 bp, E. coli
tgtgcatcacatagttcgaaccgga

SEQ ID NO: 113818 - DNA, 25 bp, E. coli
tgtgcatcacattgttcgaaccgga

SEQ ID NO: 113819 - DNA, 25 bp, E. coli
tgccgtcagagacgatggtacgtcc

SEQ ID NO: 113820 - DNA, 25 bp, E. coli
tgccgtcagagaggatggtacgtcc

SEQ ID NO: 113821 - DNA, 25 bp, E. coli
tcataccggtatggttatcagtctg

SEQ ID NO: 113822 - DNA, 25 bp, E. coli
tcataccggtatcgttatcagtctg

SEQ ID NO: 113823 - DNA, 25 bp, E. coli
gcgtctttatacgaaatcataccgg

SEQ ID NO: 113824 - DNA, 25 bp, E. coli
gcgtctttataccaaatcataccgg

SEQ ID NO: 113825 - DNA, 25 bp, E. coli
gatctgctgtttcttgccattagcg

SEQ ID NO: 113826 - DNA, 25 bp, E. coli
gatctgctgtttgttgccattagcg

SEQ ID NO: 113827 - DNA, 25 bp, E. coli
taattgcggcagtctttttcatcat

SEQ ID NO: 113828 - DNA, 25 bp, E. coli
taattgcggcagactttttcatcat

SEQ ID NO: 113829 - DNA, 25 bp, E. coli
taaaattgttatagccaaccgcggc

SEQ ID NO: 113830 - DNA, 25 bp, E. coli
taaaaagttatcagaacatcccggc

SEQ ID NO: 113831 - DNA, 25 bp, E. coli
taaaaagttatctgaacatcccggc

SEQ ID NO: 113832 - DNA, 25 bp, E. coli
tcgccacgtcgagattcaggtactg

SEQ ID NO: 113833 - DNA, 25 bp, E. coli
tcgccacgtcgacattcaggtactg

SEQ ID NO: 113834 - DNA, 25 bp, E. coli
tcttcgtgcctgaaaagaactgggc

SEQ ID NO: 113835 - DNA, 25 bp, E. coli
tctatctggcggtacgtgactgctc

SEQ ID NO: 113836 - DNA, 25 bp, E. coli
tcttcgtgcctgtaaagaactgggc

SEQ ID NO: 113837 - DNA, 25 bp, E. coli
tctatctggcggaacgtgactgctc

SEQ ID NO: 113838 - DNA, 25 bp, E. coli
cctgatgggcgagaaagtatccgca

SEQ ID NO: 113839 - DNA, 25 bp, E. coli
cctgatgggcgacaaagtatccgca

SEQ ID NO: 113840 - DNA, 25 bp, E. coli
gaactgggcatcaagactgtcgctg

SEQ ID NO: 113841 - DNA, 25 bp, E. coli
gaactgggcatctagactgtcgctg

SEQ ID NO: 113842 - DNA, 25 bp, E. coli
cgagttcctgttcgaaaacggcgag

SEQ ID NO: 113843 - DNA, 25 bp, E. coli
cgagttcctgttggaaaacggcgag

SEQ ID NO: 113844 - DNA, 25 bp, E. coli
ggtcaaccgctgacgatcaagcaag

SEQ ID NO: 113845 - DNA, 25 bp, E. coli
ggtcaaccgctgtcgatcaagcaag

SEQ ID NO: 113846 - DNA, 25 bp, E. coli
gggagtctcataactacgcgggcta

SEQ ID NO: 113847 - DNA, 25 bp, E. coli
gggagtctcatatctacgcgggcta

SEQ ID NO: 113848 - DNA, 25 bp, E. coli
ggcgcagtagcaatccatccgggtt

SEQ ID NO: 113849 - DNA, 25 bp, E. coli
ggcgcagtagcattccatccgggtt

SEQ ID NO: 113850 - DNA, 25 bp, E. coli
taaaattgttattgccaaccgcggc

SEQ ID NO: 113851 - DNA, 25 bp, E. coli
caaaagcgccgagtgagcggcaaga

SEQ ID NO: 113852 - DNA, 25 bp, E. coli
caaaagcgccgactgagcggcaaga

SEQ ID NO: 113853 - DNA, 25 bp, E. coli
tttctcgtggagagggaacagatgc

SEQ ID NO: 113854 - DNA, 25 bp, E. coli
ttggtttcccgtgtcagcgatgtga

SEQ ID NO: 113855 - DNA, 25 bp, E. coli
tttctcgtggagtgggaacagatgc

SEQ ID NO: 113856 - DNA, 25 bp, E. coli
ttggtttcccgtctcagcgatgtga

SEQ ID NO: 113857 - DNA, 25 bp, E. coli
tgtatacacaggcaagattcaggct

SEQ ID NO: 113858 - DNA, 25 bp, E. coli
tgtatacacagggaagattcaggct

SEQ ID NO: 113859 - DNA, 25 bp, E. coli
gcattatctctagtgggcgcgggaa

SEQ ID NO: 113860 - DNA, 25 bp, E. coli
gcattatctctactgggcgcgggaa

SEQ ID NO: 113861 - DNA, 25 bp, E. coli
gcaagatcgaagttttttcccgccg

SEQ ID NO: 113862 - DNA, 25 bp, E. coli
gcaagatcgaagatttttcccgccg

SEQ ID NO: 113863 - DNA, 25 bp, E. coli
gaacagatgcgatatccggttgatg

SEQ ID NO: 113864 - DNA, 25 bp, E. coli
gaacagatgcgaaatccggttgatg

SEQ ID NO: 113865 - DNA, 25 bp, E. coli
gatatcagcgatatagcgcagttga

SEQ ID NO: 113866 - DNA, 25 bp, E. coli
gattcaggcttaacccgaaggcaaa

SEQ ID NO: 113867 - DNA, 25 bp, E. coli
gatatcagcgatttagcgcagttga

SEQ ID NO: 113868 - DNA, 25 bp, E. coli
gattcaggcttatcccgaaggcaaa

SEQ ID NO: 113869 - DNA, 25 bp, E. coli
ggcatatgccgtatgatgacgatca

SEQ ID NO: 113870 - DNA, 25 bp, E. coli
ggcatatgccgtttgatgacgatca

SEQ ID NO: 113871 - DNA, 25 bp, E. coli
gagaggcattaaatcaggtcagcca

SEQ ID NO: 113872 - DNA, 25 bp, E. coli
gagaggcattaattcaggtcagcca

SEQ ID NO: 113873 - DNA, 25 bp, E. coli
caaaacgctttgctgcgccgagcta

SEQ ID NO: 113874 - DNA, 25 bp, E. coli
caaaacgctttggtgcgccgagcta

SEQ ID NO: 113875 - DNA, 25 bp, E. coli
cagagtgatttgtttaacgtcgccc

SEQ ID NO: 113876 - DNA, 25 bp, E. coli
cagagtgatttgattaacgtcgccc

SEQ ID NO: 113877 - DNA, 25 bp, E. coli
tacaatccgccaaatggtggcccgg

SEQ ID NO: 113878 - DNA, 25 bp, E. coli
tacaatccgccatatggtggcccgg

SEQ ID NO: 113879 - DNA, 25 bp, E. coli
caataaaaaaggtggcccgctggca

SEQ ID NO: 113880 - DNA, 25 bp, E. coli
caataaaaaaggaggcccgctggca

SEQ ID NO: 113881 - DNA, 25 bp, E. coli
tatggactgctcctccgagtgtgcg

SEQ ID NO: 113882 - DNA, 25 bp, E. coli
tatggactgctcgtccgagtgtgcg

SEQ ID NO: 113883 - DNA, 25 bp, E. coli
tatctccctcgacgaagcgatggca

SEQ ID NO: 113884 - DNA, 25 bp, E. coli
tatctccctcgaggaagcgatggca

SEQ ID NO: 113885 - DNA, 25 bp, E. coli
tgtctaagctgtgtccggaaatggt

SEQ ID NO: 113886 - DNA, 25 bp, E. coli
tgtctaagctgtctccggaaatggt

SEQ ID NO: 113887 - DNA, 25 bp, E. coli
tgatgactgacatcggctggttcgc

SEQ ID NO: 113888 - DNA, 25 bp, E. coli
tgatgactgacaacggctggttcgc

SEQ ID NO: 113889 - DNA, 25 bp, E. coli
gtaaagatactcacgccctgtccga

SEQ ID NO: 113890 - DNA, 25 bp, E. coli
gtaaagatactctcgccctgtccga

SEQ ID NO: 113891 - DNA, 25 bp, E. coli
ggtatcgtcactgcggcaggtttga

SEQ ID NO: 113892 - DNA, 25 bp, E. coli
ggtatcgtcactccggcaggtttga

SEQ ID NO: 113893 - DNA, 25 bp, E. coli
gatgaatccgaagcactacctggcg

SEQ ID NO: 113894 - DNA, 25 bp, E. coli
gatgaatccgaaccactacctggcg

SEQ ID NO: 113895 - DNA, 25 bp, E. coli
aagtgctggatgtgtctggtcgtca

SEQ ID NO: 113896 - DNA, 25 bp, E. coli
aagtgctggatgagtctggtcgtca

SEQ ID NO: 113897 - DNA, 25 bp, E. coli
cacacaagacgcgatcgacgttaag

SEQ ID NO: 113898 - DNA, 25 bp, E. coli
cacacaagacgccatcgacgttaag

SEQ ID NO: 113899 - DNA, 25 bp, E. coli
caggcggtggttttctgttaggcaa

SEQ ID NO: 113900 - DNA, 25 bp, E. coli
caggcggtggttatctgttaggcaa

SEQ ID NO: 113901 - DNA, 25 bp, E. coli
tagcgccgttgaggaatctgtagat

SEQ ID NO: 113902 - DNA, 25 bp, E. coli
tagcgccgttgacgaatctgtagat

SEQ ID NO: 113903 - DNA, 25 bp, E. coli
tttccagcgtacctggaccaggcgg

SEQ ID NO: 113904 - DNA, 25 bp, E. coli
tttccagcgtacgtggaccaggcgg

SEQ ID NO: 113905 - DNA, 25 bp, E. coli
tctgtagatgccacccgttgtcagg

SEQ ID NO: 113906 - DNA, 25 bp, E. coli
tctgtagatgcctcccgttgtcagg

SEQ ID NO: 113907 - DNA, 25 bp, E. coli
tgacgttgcgctcaactctgaagcg

SEQ ID NO: 113908 - DNA, 25 bp, E. coli
tgacgttgcgctgaactctgaagcg

SEQ ID NO: 113909 - DNA, 25 bp, E. coli
tgccagcagcatggccgttggcgaa

SEQ ID NO: 113910 - DNA, 25 bp, E. coli
tgccagcagcatcgccgttggcgaa

SEQ ID NO: 113911 - DNA, 25 bp, E. coli
gctatgccgtgagcgcaatgcttga

SEQ ID NO: 113912 - DNA, 25 bp, E. coli
gctatgccgtgaccgcaatgcttga

SEQ ID NO: 113913 - DNA, 25 bp, E. coli
gactgacatctatagggcgctatgc

SEQ ID NO: 113914 - DNA, 25 bp, E. coli
gactgacatctaaagggcgctatgc

SEQ ID NO: 113915 - DNA, 25 bp, E. coli
ggtaccgttggctgatatttccgaa

SEQ ID NO: 113916 - DNA, 25 bp, E. coli
ggtaccgttggcagatatttccgaa

SEQ ID NO: 113917 - DNA, 25 bp, E. coli
caactgttgttggatggccgtaacg

SEQ ID NO: 113918 - DNA, 25 bp, E. coli
caactgttgttgcatggccgtaacg

SEQ ID NO: 113919 - DNA, 25 bp, E. coli
catcagaagaactggcgctacagct

SEQ ID NO: 113920 - DNA, 25 bp, E. coli
catcagaagaacaggcgctacagct

SEQ ID NO: 113921 - DNA, 25 bp, E. coli
tacgccgaagcgatcgacaaagtgt

SEQ ID NO: 113922 - DNA, 25 bp, E. coli
acatgaaacgcgtctggctggaagc

SEQ ID NO: 113923 - DNA, 25 bp, E. coli
acatgaaacgcgactggctggaagc

SEQ ID NO: 113924 - DNA, 25 bp, E. coli
acatcgttttcgctgactgcccgga

SEQ ID NO: 113925 - DNA, 25 bp, E. coli
acatcgttttcggtgactgcccgga

SEQ ID NO: 113926 - DNA, 25 bp, E. coli
tacgccgaagcgttcgacaaagtgt

SEQ ID NO: 113927 - DNA, 25 bp, E. coli
tttggcggctattagcagagcggca

SEQ ID NO: 113928 - DNA, 25 bp, E. coli
tttggcggctataagcagagcggca

SEQ ID NO: 113929 - DNA, 25 bp, E. coli
tggtcacgcgttacacatcagaaga

SEQ ID NO: 113930 - DNA, 25 bp, E. coli
tgctgcggcggaaaatgaaaccttt

SEQ ID NO: 113931 - DNA, 25 bp, E. coli
tgctgcggcggataatgaaaccttt

SEQ ID NO: 113932 - DNA, 25 bp, E. coli
gaaaaccatctgcataagcctggag

SEQ ID NO: 113933 - DNA, 25 bp, E. coli
gaaaaccatctggataagcctggag

SEQ ID NO: 113934 - DNA, 25 bp, E. coli
tggcactgctggtaactctcgacac

SEQ ID NO: 113935 - DNA, 25 bp, E. coli
tggcactgctggaaactctcgacac

SEQ ID NO: 113936 - DNA, 25 bp, E. coli
tggtcacgcgtttcacatcagaaga

SEQ ID NO: 113937 - DNA, 25 bp, E. coli
taactacaacgacggcgatatgacc

SEQ ID NO: 113938 - DNA, 25 bp, E. coli
taactacaacgagggcgatatgacc

SEQ ID NO: 113939 - DNA, 25 bp, E. coli
caagctttctgcaatccttatggcc

SEQ ID NO: 113940 - DNA, 25 bp, E. coli
aagttatgaaactcaagctttctgc

SEQ ID NO: 113941 - DNA, 25 bp, E. coli
aagttatgaaacacaagctttctgc

SEQ ID NO: 113942 - DNA, 25 bp, E. coli
caagctttctgctatccttatggcc

SEQ ID NO: 113943 - DNA, 25 bp, E. coli
agctgcgtttgctgcccctgaagca

SEQ ID NO: 113944 - DNA, 25 bp, E. coli
acgggtactactcgcaccacaacga

SEQ ID NO: 113945 - DNA, 25 bp, E. coli
acgggtactactggcaccacaacga

SEQ ID NO: 113946 - DNA, 25 bp, E. coli
agctgcgtttgcagcccctgaagca

SEQ ID NO: 113947 - DNA, 25 bp, E. coli
ttcatgttgacgtcgccagctgcgt

SEQ ID NO: 113948 - DNA, 25 bp, E. coli
ttcatgttgacgacgccagctgcgt

SEQ ID NO: 113949 - DNA, 25 bp, E. coli
gaccgaggcaaccacgggtactact

SEQ ID NO: 113950 - DNA, 25 bp, E. coli
gaccgaggcaacgacgggtactact

SEQ ID NO: 113951 - DNA, 25 bp, E. coli
gacagttgtcggtgtggcaacggct

SEQ ID NO: 113952 - DNA, 25 bp, E. coli
gacagttgtcggagtggcaacggct

SEQ ID NO: 113953 - DNA, 25 bp, E. coli
gacagtggcgatggcggttctcata

SEQ ID NO: 113954 - DNA, 25 bp, E. coli
gacagtggcgatcgcggttctcata

SEQ ID NO: 113955 - DNA, 25 bp, E. coli
ccttatggccttgatgttgacgacg

SEQ ID NO: 113956 - DNA, 25 bp, E. coli
ccttatggccttcatgttgacgacg

SEQ ID NO: 113957 - DNA, 25 bp, E. coli
gttgcagcaaatgacagtggcgatg

SEQ ID NO: 113958 - DNA, 25 bp, E. coli
gttgcagcaaatcacagtggcgatg

SEQ ID NO: 113959 - DNA, 25 bp, E. coli
gatggcggttctcataacacctcaa

SEQ ID NO: 113960 - DNA, 25 bp, E. coli
gatggcggttctgataacacctcaa

SEQ ID NO: 113961 - DNA, 25 bp, E. coli
caattcatgccgatggctttaccaa

SEQ ID NO: 113962 - DNA, 25 bp, E. coli
caattcatgccgttggctttaccaa

SEQ ID NO: 113963 - DNA, 25 bp, E. coli
gcgattgctaaatacgtccgttcca

SEQ ID NO: 113964 - DNA, 25 bp, E. coli
gcgattgctaaaaacgtccgttcca

SEQ ID NO: 113965 - DNA, 25 bp, E. coli
ttaggcacggcggcgtttcgtcaga

SEQ ID NO: 113966 - DNA, 25 bp, E. coli
ttaggcacggcgccgtttcgtcaga

SEQ ID NO: 113967 - DNA, 25 bp, E. coli
tgctggcgattgctaaaaacgtccg

SEQ ID NO: 113968 - DNA, 25 bp, E. coli
tgctggcgattggtaaaaacgtccg

SEQ ID NO: 113969 - DNA, 25 bp, E. coli
tgctaaaaacgtgcgttccattttg

SEQ ID NO: 113970 - DNA, 25 bp, E. coli
tgctaaaaacgtccgttccattttg

SEQ ID NO: 113971 - DNA, 25 bp, E. coli
tgccgatggctttaccaacccgaaa

SEQ ID NO: 113972 - DNA, 25 bp, E. coli
tgccgatggcttaaccaacccgaaa

SEQ ID NO: 113973 - DNA, 25 bp, E. coli
ccagaaagcacaatcgaaaaagcga

SEQ ID NO: 113974 - DNA, 25 bp, E. coli
ccagaaagcacattcgaaaaagcga

SEQ ID NO: 113975 - DNA, 25 bp, E. coli
gaaagcacattccaaaaagcgataa

SEQ ID NO: 113976 - DNA, 25 bp, E. coli
gaaagcacattcgaaaaagcgataa

SEQ ID NO: 113977 - DNA, 25 bp, E. coli
gtttatgtcaattcatgccgatggc

SEQ ID NO: 113978 - DNA, 25 bp, E. coli
gtttatgtcaatacatgccgatggc

SEQ ID NO: 113979 - DNA, 25 bp, E. coli
ggtgctggcgattgctaaaaacgtc

SEQ ID NO: 113980 - DNA, 25 bp, E. coli
ggtgctggcgatagctaaaaacgtc

SEQ ID NO: 113981 - DNA, 25 bp, E. coli
tggcgattgctataaacgtccgttc

SEQ ID NO: 113982 - DNA, 25 bp, E. coli
tggcgattgctaaaaacgtccgttc

SEQ ID NO: 113983 - DNA, 25 bp, E. coli
aatttaccagcctatcgcagcacgt

SEQ ID NO: 113984 - DNA, 25 bp, E. coli
aatttaccagccaatcgcagcacgt

SEQ ID NO: 113985 - DNA, 25 bp, E. coli
catcctgtggtttccttggcgtttt

SEQ ID NO: 113986 - DNA, 25 bp, E. coli
catcctgtggttaccttggcgtttt

SEQ ID NO: 113987 - DNA, 25 bp, E. coli
cataaggtgtgtctgcggtttttca

SEQ ID NO: 113988 - DNA, 25 bp, E. coli
cataaggtgtgtgtgcggtttttca

SEQ ID NO: 113989 - DNA, 25 bp, E. coli
caggtgttttttgccatcctgtggt

SEQ ID NO: 113990 - DNA, 25 bp, E. coli
caggtgttttttcccatcctgtggt

SEQ ID NO: 113991 - DNA, 25 bp, E. coli
taaaaagcatcctaagttcgatctc

SEQ ID NO: 113992 - DNA, 25 bp, E. coli
taaaaagcatccaaagttcgatctc

SEQ ID NO: 113993 - DNA, 25 bp, E. coli
agttcgatctcagtgtctatctggg

SEQ ID NO: 113994 - DNA, 25 bp, E. coli
agttcgatctcactgtctatctggg

SEQ ID NO: 113995 - DNA, 25 bp, E. coli
tatgcgtaaaatcaagaacggctgg

SEQ ID NO: 113996 - DNA, 25 bp, E. coli
tatgcgtaaaatgaagaacggctgg

SEQ ID NO: 113997 - DNA, 25 bp, E. coli
tctaggttttttgagatagttgcat

SEQ ID NO: 113998 - DNA, 25 bp, E. coli
tctaggttttttcagatagttgcat

SEQ ID NO: 113999 - DNA, 25 bp, E. coli
gcacgttcttgcttaaggtgtgtct

SEQ ID NO: 114000 - DNA, 25 bp, E. coli
gcacgttcttgcataaggtgtgtct

SEQ ID NO: 114001 - DNA, 25 bp, E. coli
gggcctatttctctcccatatatgc

SEQ ID NO: 114002 - DNA, 25 bp, E. coli
gggcctatttctgtcccatatatgc

SEQ ID NO: 114003 - DNA, 25 bp, E. coli
tcacactatcgaaaaatttaccagc

SEQ ID NO: 114004 - DNA, 25 bp, E. coli
tcacactatcgataaatttaccagc

SEQ ID NO: 114005 - DNA, 25 bp, E. coli
tagggtctgaggtacatcttagaaa

SEQ ID NO: 114006 - DNA, 25 bp, E. coli
taggtcggaccacctggaatgttgc

SEQ ID NO: 114007 - DNA, 25 bp, E. coli
tagggtctgaggaacatcttagaaa

SEQ ID NO: 114008 - DNA, 25 bp, E. coli
taggtcggaccagctggaatgttgc

SEQ ID NO: 114009 - DNA, 25 bp, E. coli
tgctgtaacaggtgcgcgaagtgta

SEQ ID NO: 114010 - DNA, 25 bp, E. coli
tgctgtaacaggagcgcgaagtgta

SEQ ID NO: 114011 - DNA, 25 bp, E. coli
tcttagaaatcagaccagtggcgag

SEQ ID NO: 114012 - DNA, 25 bp, E. coli
tcttagaaatcacaccagtggcgag

SEQ ID NO: 114013 - DNA, 25 bp, E. coli
ccacaacgtttaactggcaccttgg

SEQ ID NO: 114014 - DNA, 25 bp, E. coli
ccacaacgtttatctggcaccttgg

SEQ ID NO: 114015 - DNA, 25 bp, E. coli
gcagaattaacatctggagcagcac

SEQ ID NO: 114016 - DNA, 25 bp, E. coli
gcaaaatttggaggtggcgcactca

SEQ ID NO: 114017 - DNA, 25 bp, E. coli
gcaaaatttggacgtggcgcactca

SEQ ID NO: 114018 - DNA, 25 bp, E. coli
gcagaattaacaactggagcagcac

SEQ ID NO: 114019 - DNA, 25 bp, E. coli
ggtcacttatccgattttgcagaat

SEQ ID NO: 114020 - DNA, 25 bp, E. coli
ggtcacttatcccattttgcagaat

SEQ ID NO: 114021 - DNA, 25 bp, E. coli
ggcgcactcatggattcgggtgaat

SEQ ID NO: 114022 - DNA, 25 bp, E. coli
ggcgcactcatgcattcgggtgaat

SEQ ID NO: 114023 - DNA, 25 bp, E. coli
taagaaacgcgatccagctggcaaa

SEQ ID NO: 114024 - DNA, 25 bp, E. coli
taagaaacgcgaaccagctggcaaa

SEQ ID NO: 114025 - DNA, 25 bp, E. coli
gagcagcactttgcggaagcgtaaa

SEQ ID NO: 114026 - DNA, 25 bp, E. coli
gagcagcactttccggaagcgtaaa

SEQ ID NO: 114027 - DNA, 25 bp, E. coli
cagacgatgggccatattcctccgg

SEQ ID NO: 114028 - DNA, 25 bp, E. coli
catattacccttccggcattgcctg

SEQ ID NO: 114029 - DNA, 25 bp, E. coli
catattacccttgcggcattgcctg

SEQ ID NO: 114030 - DNA, 25 bp, E. coli
cagacgatgggcgatattcctccgg

SEQ ID NO: 114031 - DNA, 25 bp, E. coli
ttaccgctacgtgttaaccggcttg

SEQ ID NO: 114032 - DNA, 25 bp, E. coli
ttaccgctacgtcttaaccggcttg

SEQ ID NO: 114033 - DNA, 25 bp, E. coli
tacgcccgttgctgctttgcgtgat

SEQ ID NO: 114034 - DNA, 25 bp, E. coli
tacgcccgttgcagctttgcgtgat

SEQ ID NO: 114035 - DNA, 25 bp, E. coli
gcctcacttgagtatgcgaaaaaag

SEQ ID NO: 114036 - DNA, 25 bp, E. coli
gcctcacttgagaatgcgaaaaaag

SEQ ID NO: 114037 - DNA, 25 bp, E. coli
gcaggaaatcgcgacatattaccct

SEQ ID NO: 114038 - DNA, 25 bp, E. coli
gcaggaaatcgccacatattaccct

SEQ ID NO: 114039 - DNA, 25 bp, E. coli
gtttgtggtttacggcgattcgcca

SEQ ID NO: 114040 - DNA, 25 bp, E. coli
gattcgccacaggaaacattgcggc

SEQ ID NO: 114041 - DNA, 25 bp, E. coli
gtttgtggtttagggcgattcgcca

SEQ ID NO: 114042 - DNA, 25 bp, E. coli
gattcgccacagcaaacattgcggc

SEQ ID NO: 114043 - DNA, 25 bp, E. coli
gtgttccgctctatacgcccgttgc

SEQ ID NO: 114044 - DNA, 25 bp, E. coli
gtgttccgctctttacgcccgttgc

SEQ ID NO: 114045 - DNA, 25 bp, E. coli
gggttaaaagtaccgcgttgatgca

SEQ ID NO: 114046 - DNA, 25 bp, E. coli
gggttaaaagtagcgcgttgatgca

SEQ ID NO: 114047 - DNA, 25 bp, E. coli
gaggctaatcctatggtcgctcagg

SEQ ID NO: 114048 - DNA, 25 bp, E. coli
gaggctaatcctttggtcgctcagg

SEQ ID NO: 114049 - DNA, 25 bp, E. coli
caaagggccagctcagtatgaagtc

SEQ ID NO: 114050 - DNA, 25 bp, E. coli
cacgttagtcgttcagggcgagtcg

SEQ ID NO: 114051 - DNA, 25 bp, E. coli
cacgttagtcgtacagggcgagtcg

SEQ ID NO: 114052 - DNA, 25 bp, E. coli
caaagggccagcacagtatgaagtc

SEQ ID NO: 114053 - DNA, 25 bp, E. coli
cagaagacagtgaacagccgggctt

SEQ ID NO: 114054 - DNA, 25 bp, E. coli
cagaagacagtgtacagccgggctt

SEQ ID NO: 114055 - DNA, 25 bp, E. coli
taaaacggatatctcactgcgcggc

SEQ ID NO: 114056 - DNA, 25 bp, E. coli
taaaacggatatgtcactgcgcggc

SEQ ID NO: 114057 - DNA, 25 bp, E. coli
tatgaagtccggctgacgctgaccg

SEQ ID NO: 114058 - DNA, 25 bp, E. coli
tatgaagtccgggtgacgctgaccg

SEQ ID NO: 114059 - DNA, 25 bp, E. coli
tcgctggcggagctgcattttccca

SEQ ID NO: 114060 - DNA, 25 bp, E. coli
tcgctggcggaggtgcattttccca

SEQ ID NO: 114061 - DNA, 25 bp, E. coli
gacgatgggtgactttaccgcctcc

SEQ ID NO: 114062 - DNA, 25 bp, E. coli
gacgatgggtgagtttaccgcctcc

SEQ ID NO: 114063 - DNA, 25 bp, E. coli
cgattaacaatagcagcggcgcgac

SEQ ID NO: 114064 - DNA, 25 bp, E. coli
cgattaacaataccagcggcgcgac

SEQ ID NO: 114065 - DNA, 25 bp, E. coli
cgtaaagacctgatggtgaccgggc

SEQ ID NO: 114066 - DNA, 25 bp, E. coli
cgtaaagacctgttggtgaccgggc

SEQ ID NO: 114067 - DNA, 25 bp, E. coli
ggtgccagtggtgtttcagctcaaa

SEQ ID NO: 114068 - DNA, 25 bp, E. coli
ggtgccagtggtctttcagctcaaa

SEQ ID NO: 114069 - DNA, 25 bp, E. coli
ggcgcgacctttgtgctgagtaacg

SEQ ID NO: 114070 - DNA, 25 bp, E. coli
ggcgcgacctttctgctgagtaacg

SEQ ID NO: 114071 - DNA, 25 bp, E. coli
catcaacgtagctaatgacctgccg

SEQ ID NO: 114072 - DNA, 25 bp, E. coli
catgcgaaatgtcatggtccatccg

SEQ ID NO: 114073 - DNA, 25 bp, E. coli
catgcgaaatgtgatggtccatccg

SEQ ID NO: 114074 - DNA, 25 bp, E. coli
cagactgacctgcttgaagccatgg

SEQ ID NO: 114075 - DNA, 25 bp, E. coli
catcaacgtagcaaatgacctgccg

SEQ ID NO: 114076 - DNA, 25 bp, E. coli
cagactgacctggttgaagccatgg

SEQ ID NO: 114077 - DNA, 25 bp, E. coli
tattgaagcgcaaccggatccggaa

SEQ ID NO: 114078 - DNA, 25 bp, E. coli
tattgaagcgcatccggatccggaa

SEQ ID NO: 114079 - DNA, 25 bp, E. coli
tgataaattcaaagaaggcggcaac

SEQ ID NO: 114080 - DNA, 25 bp, E. coli
tgataaattcaatgaaggcggcaac

SEQ ID NO: 114081 - DNA, 25 bp, E. coli
tgcgcatttgcgtgcactacgtaac

SEQ ID NO: 114082 - DNA, 25 bp, E. coli
tgccgctggctaaactggaaccgtt

SEQ ID NO: 114083 - DNA, 25 bp, E. coli
tgcgcatttgcgagcactacgtaac

SEQ ID NO: 114084 - DNA, 25 bp, E. coli
tgccgctggctatactggaaccgtt

SEQ ID NO: 114085 - DNA, 25 bp, E. coli
gccatggcgaaatccggtgcggtaa

SEQ ID NO: 114086 - DNA, 25 bp, E. coli
gccatggcgaaaaccggtgcggtaa

SEQ ID NO: 114087 - DNA, 25 bp, E. coli
gctaacttcggctatgacaacctgg

SEQ ID NO: 114088 - DNA, 25 bp, E. coli
gctaacttcggcaatgacaacctgg

SEQ ID NO: 114089 - DNA, 25 bp, E. coli
gaatctcgcgatctggcgatgcgca

SEQ ID NO: 114090 - DNA, 25 bp, E. coli
gaatctcgcgatgtggcgatgcgca

SEQ ID NO: 114091 - DNA, 25 bp, E. coli
gatgtgattcagttgccggcgtttc

SEQ ID NO: 114092 - DNA, 25 bp, E. coli
gatgtgattcagatgccggcgtttc

SEQ ID NO: 114093 - DNA, 25 bp, E. coli
taaactgcagcgaccttaccgctat

SEQ ID NO: 114094 - DNA, 25 bp, E. coli
taaactgcagcgtccttaccgctat

SEQ ID NO: 114095 - DNA, 25 bp, E. coli
agaagtgccagactttatattccac

SEQ ID NO: 114096 - DNA, 25 bp, E. coli
agaagtgccagagtttatattccac

SEQ ID NO: 114097 - DNA, 25 bp, E. coli
tagcgtttcgttatttaaactgcag

SEQ ID NO: 114098 - DNA, 25 bp, E. coli
tagcgtttcgttttttaaactgcag

SEQ ID NO: 114099 - DNA, 25 bp, E. coli
tttttaaactgcagcgaccttaccg

SEQ ID NO: 114100 - DNA, 25 bp, E. coli
ttttattcttatggatagcgtttcg

SEQ ID NO: 114101 - DNA, 25 bp, E. coli
ttttattcttatcgatagcgtttcg

SEQ ID NO: 114102 - DNA, 25 bp, E. coli
tttttaaactgctgcgaccttaccg

SEQ ID NO: 114103 - DNA, 25 bp, E. coli
tcaggtaatcataaataaaaggata

SEQ ID NO: 114104 - DNA, 25 bp, E. coli
tcaggtaatcattaataaaaggata

SEQ ID NO: 114105 - DNA, 25 bp, E. coli
gccagactttattttccacttttat

SEQ ID NO: 114106 - DNA, 25 bp, E. coli
gccagactttatattccacttttat

SEQ ID NO: 114107 - DNA, 25 bp, E. coli
ccgctatagtcaggtaatcattaat

SEQ ID NO: 114108 - DNA, 25 bp, E. coli
ccgctatagtcacgtaatcattaat

SEQ ID NO: 114109 - DNA, 25 bp, E. coli
gcgaccttaccgctatagtcaggta

SEQ ID NO: 114110 - DNA, 25 bp, E. coli
gcgaccttaccggtatagtcaggta

SEQ ID NO: 114111 - DNA, 25 bp, E. coli
cgtggtcagtaagaagtgccagact

SEQ ID NO: 114112 - DNA, 25 bp, E. coli
cgtggtcagtaacaagtgccagact

SEQ ID NO: 114113 - DNA, 25 bp, E. coli
gtttgcgtggtctgtaagaagtgcc

SEQ ID NO: 114114 - DNA, 25 bp, E. coli
gtttgcgtggtcagtaagaagtgcc

SEQ ID NO: 114115 - DNA, 25 bp, E. coli
aatttgtgacaccagataagccgct

SEQ ID NO: 114116 - DNA, 25 bp, E. coli
aatttgtgacacgagataagccgct

SEQ ID NO: 114117 - DNA, 25 bp, E. coli
tactgtggcctgctaaactcgcgat

SEQ ID NO: 114118 - DNA, 25 bp, E. coli
tactgtggcctggtaaactcgcgat

SEQ ID NO: 114119 - DNA, 25 bp, E. coli
tactcaacgtggcaaatcatcgaca

SEQ ID NO: 114120 - DNA, 25 bp, E. coli
tactcaacgtgggaaatcatcgaca

SEQ ID NO: 114121 - DNA, 25 bp, E. coli
tatttgataaacagcccgatgccac

SEQ ID NO: 114122 - DNA, 25 bp, E. coli
tatttgataaactgcccgatgccac

SEQ ID NO: 114123 - DNA, 25 bp, E. coli
tttttgctggagaacgatgcgctgg

SEQ ID NO: 114124 - DNA, 25 bp, E. coli
tttttgctggagtacgatgcgctgg

SEQ ID NO: 114125 - DNA, 25 bp, E. coli
gaaatcgtatctgtcctcaagttgg

SEQ ID NO: 114126 - DNA, 25 bp, E. coli
gaaaaaacgagctttacctggcgct

SEQ ID NO: 114127 - DNA, 25 bp, E. coli
gaaatcgtatctctcctcaagttgg

SEQ ID NO: 114128 - DNA, 25 bp, E. coli
gaaaaaacgagcattacctggcgct

SEQ ID NO: 114129 - DNA, 25 bp, E. coli
cgtggtttgcgataaagctgactcc

SEQ ID NO: 114130 - DNA, 25 bp, E. coli
cgtggtttgcgaaaaagctgactcc

SEQ ID NO: 114131 - DNA, 25 bp, E. coli
gatttatccgcatgatggtgccagg

SEQ ID NO: 114132 - DNA, 25 bp, E. coli
gatttatccgcaagatggtgccagg

SEQ ID NO: 114133 - DNA, 25 bp, E. coli
taagccgctggtgatcgaaactcgt

SEQ ID NO: 114134 - DNA, 25 bp, E. coli
taagccgctggtcatcgaaactcgt

SEQ ID NO: 114135 - DNA, 25 bp, E. coli
gatgccacctgtattaacccgctga

SEQ ID NO: 114136 - DNA, 25 bp, E. coli
gatgccacctgttttaacccgctga

SEQ ID NO: 114137 - DNA, 25 bp, E. coli
aaactgtcgtctttgcactgattca

SEQ ID NO: 114138 - DNA, 25 bp, E. coli
aaactgtcgtctatgcactgattca

SEQ ID NO: 114139 - DNA, 25 bp, E. coli
taccgagccttttgtgataaatggg

SEQ ID NO: 114140 - DNA, 25 bp, E. coli
taccgagcctttagtgataaatggg

SEQ ID NO: 114141 - DNA, 25 bp, E. coli
tatttacgctggattgtggcggcag

SEQ ID NO: 114142 - DNA, 25 bp, E. coli
tattggccatgaattttaccgagcc

SEQ ID NO: 114143 - DNA, 25 bp, E. coli
tatttacgctggtttgtggcggcag

SEQ ID NO: 114144 - DNA, 25 bp, E. coli
tattggccatgatttttaccgagcc

SEQ ID NO: 114145 - DNA, 25 bp, E. coli
tgggaaagtgactatacgggtaact

SEQ ID NO: 114146 - DNA, 25 bp, E. coli
tgggaaagtgacaatacgggtaact

SEQ ID NO: 114147 - DNA, 25 bp, E. coli
tcacgccgttgaggtagaagtcccg

SEQ ID NO: 114148 - DNA, 25 bp, E. coli
gaagaagcactaaatcgtcgccaga

SEQ ID NO: 114149 - DNA, 25 bp, E. coli
gcagaatttctgttcgccgcaggga

SEQ ID NO: 114150 - DNA, 25 bp, E. coli
gaagaagcactatatcgtcgccaga

SEQ ID NO: 114151 - DNA, 25 bp, E. coli
gcagaatttctgatcgccgcaggga

SEQ ID NO: 114152 - DNA, 25 bp, E. coli
ccgcagggaatcttcacgccgttga

SEQ ID NO: 114153 - DNA, 25 bp, E. coli
ccgcagggaatcatcacgccgttga

SEQ ID NO: 114154 - DNA, 25 bp, E. coli
tcacgccgttgacgtagaagtcccg

SEQ ID NO: 114155 - DNA, 25 bp, E. coli
taagtacgggcgatttggcgcatga

SEQ ID NO: 114156 - DNA, 25 bp, E. coli
taacgattaatgaaaggcccagtgc

SEQ ID NO: 114157 - DNA, 25 bp, E. coli
taagtacgggcgttttggcgcatga

SEQ ID NO: 114158 - DNA, 25 bp, E. coli
taacgattaatgtaaggcccagtgc

SEQ ID NO: 114159 - DNA, 25 bp, E. coli
cagaaaagaatatccgcgaaaaagt

SEQ ID NO: 114160 - DNA, 25 bp, E. coli
cagaaaagaataaccgcgaaaaagt

SEQ ID NO: 114161 - DNA, 25 bp, E. coli
acgacgtggtatgggcgtcgttcaa

SEQ ID NO: 114162 - DNA, 25 bp, E. coli
acgacgtggtatcggcgtcgttcaa

SEQ ID NO: 114163 - DNA, 25 bp, E. coli
tatccgcgaaaaagtagagcgacag

SEQ ID NO: 114164 - DNA, 25 bp, E. coli
tagagcgacagaatttttgtttctc

SEQ ID NO: 114165 - DNA, 25 bp, E. coli
tagagcgacagattttttgtttctc

SEQ ID NO: 114166 - DNA, 25 bp, E. coli
tttgtttctcatactgtttatcgtg

SEQ ID NO: 114167 - DNA, 25 bp, E. coli
tttgtttctcattctgtttatcgtg

SEQ ID NO: 114168 - DNA, 25 bp, E. coli
tatccgcgaaaatgtagagcgacag

SEQ ID NO: 114169 - DNA, 25 bp, E. coli
tgtataacgacgaggtatgggcgtc

SEQ ID NO: 114170 - DNA, 25 bp, E. coli
tgtataacgacgtggtatgggcgtc

SEQ ID NO: 114171 - DNA, 25 bp, E. coli
gctagttattgagttgtataacgac

SEQ ID NO: 114172 - DNA, 25 bp, E. coli
gctagttattgacttgtataacgac

SEQ ID NO: 114173 - DNA, 25 bp, E. coli
gcaatcgggaaaataattgagctag

SEQ ID NO: 114174 - DNA, 25 bp, E. coli
gcaatcgggaaattaattgagctag

SEQ ID NO: 114175 - DNA, 25 bp, E. coli
gatatccccgctaatttttgtctgg

SEQ ID NO: 114176 - DNA, 25 bp, E. coli
gatatccccgcttatttttgtctgg

SEQ ID NO: 114177 - DNA, 25 bp, E. coli
gtgcctacattaatcagaaaagaat

SEQ ID NO: 114178 - DNA, 25 bp, E. coli
gtgcctacattattcagaaaagaat

SEQ ID NO: 114179 - DNA, 25 bp, E. coli
taatttttgtctcggcaatcgggaa

SEQ ID NO: 114180 - DNA, 25 bp, E. coli
taatttttgtctgggcaatcgggaa

SEQ ID NO: 114181 - DNA, 25 bp, E. coli
attaagaaagccagcacccaggccg

SEQ ID NO: 114182 - DNA, 25 bp, E. coli
attaagaaagcctgcacccaggccg

SEQ ID NO: 114183 - DNA, 25 bp, E. coli
tacccgtggtttctgtgccgatgat

SEQ ID NO: 114184 - DNA, 25 bp, E. coli
tataaagcgacggttaatgtggccg

SEQ ID NO: 114185 - DNA, 25 bp, E. coli
tataaagcgacgcttaatgtggccg

SEQ ID NO: 114186 - DNA, 25 bp, E. coli
tacccgtggtttgtgtgccgatgat

SEQ ID NO: 114187 - DNA, 25 bp, E. coli
ccaggccgcagaagtggcgctgttt

SEQ ID NO: 114188 - DNA, 25 bp, E. coli
ccaggccgcagatgtggcgctgttt

SEQ ID NO: 114189 - DNA, 25 bp, E. coli
gcagtttgccaatctttccgtctgg

SEQ ID NO: 114190 - DNA, 25 bp, E. coli
gcagtttgccaaactttccgtctgg

SEQ ID NO: 114191 - DNA, 25 bp, E. coli
cggcgcaaatctggtggcagcaaaa

SEQ ID NO: 114192 - DNA, 25 bp, E. coli
cggaagcgtggctgcgtaacgatca

SEQ ID NO: 114193 - DNA, 25 bp, E. coli
ctttgccgatcgtaccatgacgctg

SEQ ID NO: 114194 - DNA, 25 bp, E. coli
cggcgcaaatctcgtggcagcaaaa

SEQ ID NO: 114195 - DNA, 25 bp, E. coli
cggaagcgtggcagcgtaacgatca

SEQ ID NO: 114196 - DNA, 25 bp, E. coli
ctttgccgatcgaaccatgacgctg

SEQ ID NO: 114197 - DNA, 25 bp, E. coli
gttaatgtggcccatctcgaccgca

SEQ ID NO: 114198 - DNA, 25 bp, E. coli
gttaatgtggccgatctcgaccgca

SEQ ID NO: 114199 - DNA, 25 bp, E. coli
gaccgcaaccagtttctcgatgcct

SEQ ID NO: 114200 - DNA, 25 bp, E. coli
gatgaacgtctggaatttacccgtg

SEQ ID NO: 114201 - DNA, 25 bp, E. coli
gaccgcaaccagattctcgatgcct

SEQ ID NO: 114202 - DNA, 25 bp, E. coli
gatgaacgtctgcaatttacccgtg

SEQ ID NO: 114203 - DNA, 25 bp, E. coli
catagtctttgcctctaaaagagac

SEQ ID NO: 114204 - DNA, 25 bp, E. coli
catagtctttgcgtctaaaagagac

SEQ ID NO: 114205 - DNA, 25 bp, E. coli
taaaagagacaaaggtggaatcccc

SEQ ID NO: 114206 - DNA, 25 bp, E. coli
taaaagagacaatggtggaatcccc

SEQ ID NO: 114207 - DNA, 25 bp, E. coli
taaagtgaacaggatagtctttgcc

SEQ ID NO: 114208 - DNA, 25 bp, E. coli
taaagtgaacagcatagtctttgcc

SEQ ID NO: 114209 - DNA, 25 bp, E. coli
tatacccgatgaaggcgttgttgca

SEQ ID NO: 114210 - DNA, 25 bp, E. coli
tatacccgatgatggcgttgttgca

SEQ ID NO: 114211 - DNA, 25 bp, E. coli
tgtacacataatgatcttttgggcc

SEQ ID NO: 114212 - DNA, 25 bp, E. coli
tgtacacataatcatcttttgggcc

SEQ ID NO: 114213 - DNA, 25 bp, E. coli
tcatctacgatatcttcattgggta

SEQ ID NO: 114214 - DNA, 25 bp, E. coli
tcatctacgataacttcattgggta

SEQ ID NO: 114215 - DNA, 25 bp, E. coli
tcattgggtataagaagccttctgt

SEQ ID NO: 114216 - DNA, 25 bp, E. coli
tcattgggtatatgaagccttctgt

SEQ ID NO: 114217 - DNA, 25 bp, E. coli
gcgttgttgcatacgggctttaagc

SEQ ID NO: 114218 - DNA, 25 bp, E. coli
gcgttgttgcattcgggctttaagc

SEQ ID NO: 114219 - DNA, 25 bp, E. coli
gaagccttctgttgaacctgttcca

SEQ ID NO: 114220 - DNA, 25 bp, E. coli
gaagccttctgtagaacctgttcca

SEQ ID NO: 114221 - DNA, 25 bp, E. coli
ccctatttctggttatacccgatga

SEQ ID NO: 114222 - DNA, 25 bp, E. coli
ccctatttctggatatacccgatga

SEQ ID NO: 114223 - DNA, 25 bp, E. coli
cgggctttaagctgaatttcatcta

SEQ ID NO: 114224 - DNA, 25 bp, E. coli
cgggctttaagcagaatttcatcta

SEQ ID NO: 114225 - DNA, 25 bp, E. coli
cagcatgggaatgaagcgaattgtg

SEQ ID NO: 114226 - DNA, 25 bp, E. coli
cagcatgggaatcaagcgaattgtg

SEQ ID NO: 114227 - DNA, 25 bp, E. coli
catgggaatgaaccgaattgtggta

SEQ ID NO: 114228 - DNA, 25 bp, E. coli
catgggaatgaagcgaattgtggta

SEQ ID NO: 114229 - DNA, 25 bp, E. coli
agcatgggaatgtagcgaattgtgg

SEQ ID NO: 114230 - DNA, 25 bp, E. coli
agcatgggaatgaagcgaattgtgg

SEQ ID NO: 114231 - DNA, 25 bp, E. coli
tattggcagtggcatgttgcccttt

SEQ ID NO: 114232 - DNA, 25 bp, E. coli
tattggcagtgggatgttgcccttt

SEQ ID NO: 114233 - DNA, 25 bp, E. coli
tgggaatgaagcgaattgtggtaca

SEQ ID NO: 114234 - DNA, 25 bp, E. coli
tgggaatgaagccaattgtggtaca

SEQ ID NO: 114235 - DNA, 25 bp, E. coli
tcggtttctcgcggtttcatgccgg

SEQ ID NO: 114236 - DNA, 25 bp, E. coli
tcggtttctcgccgtttcatgccgg

SEQ ID NO: 114237 - DNA, 25 bp, E. coli
gaatgaagcgaattgtggtacaggt

SEQ ID NO: 114238 - DNA, 25 bp, E. coli
gcatgggaatgaagcgaattgtggt

SEQ ID NO: 114239 - DNA, 25 bp, E. coli
gcatgggaatgatgcgaattgtggt

SEQ ID NO: 114240 - DNA, 25 bp, E. coli
gaatgaagcgaaatgtggtacaggt

SEQ ID NO: 114241 - DNA, 25 bp, E. coli
ctttgccggacgaattggcagtggc

SEQ ID NO: 114242 - DNA, 25 bp, E. coli
ctttgccggacgtattggcagtggc

SEQ ID NO: 114243 - DNA, 25 bp, E. coli
ggaatgaagcgaattgtggtacagg

SEQ ID NO: 114244 - DNA, 25 bp, E. coli
gggaatgaagcgaattgtggtacag

SEQ ID NO: 114245 - DNA, 25 bp, E. coli
gggaatgaagcgtattgtggtacag

SEQ ID NO: 114246 - DNA, 25 bp, E. coli
ggaatgaagcgatttgtggtacagg

SEQ ID NO: 114247 - DNA, 25 bp, E. coli
caagattttttcaccagagtctggg

SEQ ID NO: 114248 - DNA, 25 bp, E. coli
caagattttttctccagagtctggg

SEQ ID NO: 114249 - DNA, 25 bp, E. coli
tacaaagagagctttggtggcgcaa

SEQ ID NO: 114250 - DNA, 25 bp, E. coli
tacaaagagagcattggtggcgcaa

SEQ ID NO: 114251 - DNA, 25 bp, E. coli
actgttgcggaaattaatggctgcc

SEQ ID NO: 114252 - DNA, 25 bp, E. coli
actgttgcggaatttaatggctgcc

SEQ ID NO: 114253 - DNA, 25 bp, E. coli
tataaaacacggatactggattcgg

SEQ ID NO: 114254 - DNA, 25 bp, E. coli
tataaaacacggttactggattcgg

SEQ ID NO: 114255 - DNA, 25 bp, E. coli
ttaacgtcgttcagacaacgccagc

SEQ ID NO: 114256 - DNA, 25 bp, E. coli
ttaacgtcgttctgacaacgccagc

SEQ ID NO: 114257 - DNA, 25 bp, E. coli
tgtttaaccctgtcttaccgtgagg

SEQ ID NO: 114258 - DNA, 25 bp, E. coli
tgtttaaccctgacttaccgtgagg

SEQ ID NO: 114259 - DNA, 25 bp, E. coli
gaaggtatgcgtgtgcctactaaca

SEQ ID NO: 114260 - DNA, 25 bp, E. coli
gaagcttttcctgatgtggttgcac

SEQ ID NO: 114261 - DNA, 25 bp, E. coli
gaaggtatgcgtctgcctactaaca

SEQ ID NO: 114262 - DNA, 25 bp, E. coli
gaagcttttcctcatgtggttgcac

SEQ ID NO: 114263 - DNA, 25 bp, E. coli
gaacatatccattatcagacgcgga

SEQ ID NO: 114264 - DNA, 25 bp, E. coli
gaacatatccataatcagacgcgga

SEQ ID NO: 114265 - DNA, 25 bp, E. coli
gatttcgcgctgttggtgatactac

SEQ ID NO: 114266 - DNA, 25 bp, E. coli
gatttcgcgctgatggtgatactac

SEQ ID NO: 114267 - DNA, 25 bp, E. coli
taatatcgagttctggcctgagcac

SEQ ID NO: 114268 - DNA, 25 bp, E. coli
taatatcgagttgtggcctgagcac

SEQ ID NO: 114269 - DNA, 25 bp, E. coli
tacacacagaaatcctggtggcagc

SEQ ID NO: 114270 - DNA, 25 bp, E. coli
tacacacagaaaacctggtggcagc

SEQ ID NO: 114271 - DNA, 25 bp, E. coli
tacaactttgctggctggacgctgc

SEQ ID NO: 114272 - DNA, 25 bp, E. coli
tacaactttgctcgctggacgctgc

SEQ ID NO: 114273 - DNA, 25 bp, E. coli
ggaatacggacgataacccggacat

SEQ ID NO: 114274 - DNA, 25 bp, E. coli
ggaatacggacgttaacccggacat

SEQ ID NO: 114275 - DNA, 25 bp, E. coli
tgcgcgatgtggaaatgggctacaa

SEQ ID NO: 114276 - DNA, 25 bp, E. coli
tgcgcgatgtggtaatgggctacaa

SEQ ID NO: 114277 - DNA, 25 bp, E. coli
tctaatagcgatgagtcatcaccgt

SEQ ID NO: 114278 - DNA, 25 bp, E. coli
tctaatagcgatcagtcatcaccgt

SEQ ID NO: 114279 - DNA, 25 bp, E. coli
cctggtggcagctttctaatagcga

SEQ ID NO: 114280 - DNA, 25 bp, E. coli
cctggtggcagcattctaatagcga

SEQ ID NO: 114281 - DNA, 25 bp, E. coli
ctgagcgcgaaagggcagtacaact

SEQ ID NO: 114282 - DNA, 25 bp, E. coli
ctgagcgcgaaacggcagtacaact

SEQ ID NO: 114283 - DNA, 25 bp, E. coli
tgggctacaaccacgactcaaacgg

SEQ ID NO: 114284 - DNA, 25 bp, E. coli
gggccaaactctctactgggcgcct

SEQ ID NO: 114285 - DNA, 25 bp, E. coli
gggccaaactctgtactgggcgcct

SEQ ID NO: 114286 - DNA, 25 bp, E. coli
tgtgggagttatgctaaacgacctg

SEQ ID NO: 114287 - DNA, 25 bp, E. coli
tgtgggagttatcctaaacgacctg

SEQ ID NO: 114288 - DNA, 25 bp, E. coli
tcggttttgccacggattacaactt

SEQ ID NO: 114289 - DNA, 25 bp, E. coli
tgggctacaacctcgactcaaacgg

SEQ ID NO: 114290 - DNA, 25 bp, E. coli
tcggttttgccagggattacaactt

SEQ ID NO: 114291 - DNA, 25 bp, E. coli
aattttgccactgcggcaattgcca

SEQ ID NO: 114292 - DNA, 25 bp, E. coli
aattttgccactccggcaattgcca

SEQ ID NO: 114293 - DNA, 25 bp, E. coli
cacgccgaagtgcatgtgatgagcc

SEQ ID NO: 114294 - DNA, 25 bp, E. coli
cacgccgaagtggatgtgatgagcc

SEQ ID NO: 114295 - DNA, 25 bp, E. coli
cagtgttggcccgttccaggatgag

SEQ ID NO: 114296 - DNA, 25 bp, E. coli
cagtgttggccccttccaggatgag

SEQ ID NO: 114297 - DNA, 25 bp, E. coli
atgcgcgacttactgaagccgtcag

SEQ ID NO: 114298 - DNA, 25 bp, E. coli
atgcgcgacttagtgaagccgtcag

SEQ ID NO: 114299 - DNA, 25 bp, E. coli
aacattctcaatgcacacgccgaag

SEQ ID NO: 114300 - DNA, 25 bp, E. coli
aacattctcaatccacacgccgaag

SEQ ID NO: 114301 - DNA, 25 bp, E. coli
ttctcaatccacacgccgaagtgga

SEQ ID NO: 114302 - DNA, 25 bp, E. coli
ttctcaatccactcgccgaagtgga

SEQ ID NO: 114303 - DNA, 25 bp, E. coli
tgttggcccgttgcaggatgagcaa

SEQ ID NO: 114304 - DNA, 25 bp, E. coli
tgttggcccgttccaggatgagcaa

SEQ ID NO: 114305 - DNA, 25 bp, E. coli
tgaatgcgcgacttagtgaagccgt

SEQ ID NO: 114306 - DNA, 25 bp, E. coli
tgaatgcgcgacatagtgaagccgt

SEQ ID NO: 114307 - DNA, 25 bp, E. coli
tctcgatgaattatgccactccggc

SEQ ID NO: 114308 - DNA, 25 bp, E. coli
tctcgatgaattttgccactccggc

SEQ ID NO: 114309 - DNA, 25 bp, E. coli
ccggcgctgaatccgcgacttagtg

SEQ ID NO: 114310 - DNA, 25 bp, E. coli
ccggcgctgaatgcgcgacttagtg

SEQ ID NO: 114311 - DNA, 25 bp, E. coli
gcactctgccattatctcgatgaat

SEQ ID NO: 114312 - DNA, 25 bp, E. coli
gcactctgccataatctcgatgaat

SEQ ID NO: 114313 - DNA, 25 bp, E. coli
cataattcgtgacctggcgctgcaa

SEQ ID NO: 114314 - DNA, 25 bp, E. coli
cataattcgtgagctggcgctgcaa

SEQ ID NO: 114315 - DNA, 25 bp, E. coli
tttgaaatgccggtcgcccaggcat

SEQ ID NO: 114316 - DNA, 25 bp, E. coli
tttgaaatgccgctcgcccaggcat

SEQ ID NO: 114317 - DNA, 25 bp, E. coli
ccgggaaaccctaaatcatcgtcag

SEQ ID NO: 114318 - DNA, 25 bp, E. coli
ccgggaaacccttaatcatcgtcag

SEQ ID NO: 114319 - DNA, 25 bp, E. coli
gccgtatcgcgcgagtgaagatgaa

SEQ ID NO: 114320 - DNA, 25 bp, E. coli
gccgtatcgcgccagtgaagatgaa

SEQ ID NO: 114321 - DNA, 25 bp, E. coli
gctgcaaattggagtgaaaccctga

SEQ ID NO: 114322 - DNA, 25 bp, E. coli
gctgcaaattggtgtgaaaccctga

SEQ ID NO: 114323 - DNA, 25 bp, E. coli
gacaagtggcattccctggaggtgc

SEQ ID NO: 114324 - DNA, 25 bp, E. coli
gacaagtggcataccctggaggtgc

SEQ ID NO: 114325 - DNA, 25 bp, E. coli
ccctggaggtgcagtcgatgacacg

SEQ ID NO: 114326 - DNA, 25 bp, E. coli
ccctggaggtgctgtcgatgacacg

SEQ ID NO: 114327 - DNA, 25 bp, E. coli
gtgttaatccccatcgtccgtcgac

SEQ ID NO: 114328 - DNA, 25 bp, E. coli
gtgttaatccccttcgtccgtcgac

SEQ ID NO: 114329 - DNA, 25 bp, E. coli
ggaatgaccgcaggcataattcgtg

SEQ ID NO: 114330 - DNA, 25 bp, E. coli
tggaataccgtaccctgacgcttga

SEQ ID NO: 114331 - DNA, 25 bp, E. coli
ggcattacatctgggtcgttatcac

SEQ ID NO: 114332 - DNA, 25 bp, E. coli
tggaataccgtagcctgacgcttga

SEQ ID NO: 114333 - DNA, 25 bp, E. coli
ggaatgaccgcacgcataattcgtg

SEQ ID NO: 114334 - DNA, 25 bp, E. coli
ggcattacatctcggtcgttatcac

SEQ ID NO: 114335 - DNA, 25 bp, E. coli
catcacgaagctgaatgaagcgcaa

SEQ ID NO: 114336 - DNA, 25 bp, E. coli
catcacgaagctcaatgaagcgcaa

SEQ ID NO: 114337 - DNA, 25 bp, E. coli
taaaaacgcaatcgaaaccgcagat

SEQ ID NO: 114338 - DNA, 25 bp, E. coli
taaacaggagtattcacaggcagcc

SEQ ID NO: 114339 - DNA, 25 bp, E. coli
taaaaacgcaatggaaaccgcagat

SEQ ID NO: 114340 - DNA, 25 bp, E. coli
taaacaggagtaatcacaggcagcc

SEQ ID NO: 114341 - DNA, 25 bp, E. coli
aaaagcagctatatccagtcacagg

SEQ ID NO: 114342 - DNA, 25 bp, E. coli
aaaagcagctatttccagtcacagg

SEQ ID NO: 114343 - DNA, 25 bp, E. coli
tgagaagaaagcatccgcccagaaa

SEQ ID NO: 114344 - DNA, 25 bp, E. coli
tgagaagaaagcttccgcccagaaa

SEQ ID NO: 114345 - DNA, 25 bp, E. coli
tcctattctattgctgcgggcgtag

SEQ ID NO: 114346 - DNA, 25 bp, E. coli
tcctattctattcctgcgggcgtag

SEQ ID NO: 114347 - DNA, 25 bp, E. coli
gctggtaagctctcaaagtttcaac

SEQ ID NO: 114348 - DNA, 25 bp, E. coli
gctggtaagctcacaaagtttcaac

SEQ ID NO: 114349 - DNA, 25 bp, E. coli
gaagcgcaaaaaaccctgctggtaa

SEQ ID NO: 114350 - DNA, 25 bp, E. coli
gaagcgcaaaaatccctgctggtaa

SEQ ID NO: 114351 - DNA, 25 bp, E. coli
cccctggcagacgtttgatgaaacc

SEQ ID NO: 114352 - DNA, 25 bp, E. coli
cgcttccgggaaactgctggcgtta

SEQ ID NO: 114353 - DNA, 25 bp, E. coli
cccctggcagacctttgatgaaacc

SEQ ID NO: 114354 - DNA, 25 bp, E. coli
cgcttccgggaatctgctggcgtta

SEQ ID NO: 114355 - DNA, 25 bp, E. coli
cattaaggtactcgatgacggcatc

SEQ ID NO: 114356 - DNA, 25 bp, E. coli
cattaaggtactggatgacggcatc

SEQ ID NO: 114357 - DNA, 25 bp, E. coli
aatggccattgaaagtcgcttcaaa

SEQ ID NO: 114358 - DNA, 25 bp, E. coli
caatggccattgtaagtcgcttcaa

SEQ ID NO: 114359 - DNA, 25 bp, E. coli
caatggccattgaaagtcgcttcaa

SEQ ID NO: 114360 - DNA, 25 bp, E. coli
aatggccattgatagtcgcttcaaa

SEQ ID NO: 114361 - DNA, 25 bp, E. coli
aaagtcgcttcatatatatgatgct

SEQ ID NO: 114362 - DNA, 25 bp, E. coli
aaagtcgcttcaaatatatgatgct

SEQ ID NO: 114363 - DNA, 25 bp, E. coli
tttaatgcgcgctatattcagtctg

SEQ ID NO: 114364 - DNA, 25 bp, E. coli
tttaatgcgcgcaatattcagtctg

SEQ ID NO: 114365 - DNA, 25 bp, E. coli
tgttgctttttactctctctattcc

SEQ ID NO: 114366 - DNA, 25 bp, E. coli
tgttgcaatggccattgaaagtcgc

SEQ ID NO: 114367 - DNA, 25 bp, E. coli
tgttgcaatggcgattgaaagtcgc

SEQ ID NO: 114368 - DNA, 25 bp, E. coli
tgttgctttttagtctctctattcc

SEQ ID NO: 114369 - DNA, 25 bp, E. coli
tgcaatggccatagaaagtcgcttc

SEQ ID NO: 114370 - DNA, 25 bp, E. coli
tgcaatggccattgaaagtcgcttc

SEQ ID NO: 114371 - DNA, 25 bp, E. coli
gctttttactctctctattcctgtc

SEQ ID NO: 114372 - DNA, 25 bp, E. coli
gctttttactctgtctattcctgtc

SEQ ID NO: 114373 - DNA, 25 bp, E. coli
gaaagtcgcttcaaatatatgatgc

SEQ ID NO: 114374 - DNA, 25 bp, E. coli
gaaagtcgcttctaatatatgatgc

SEQ ID NO: 114375 - DNA, 25 bp, E. coli
ctctctctattcctgtcatttctga

SEQ ID NO: 114376 - DNA, 25 bp, E. coli
ctctctctattcgtgtcatttctga

SEQ ID NO: 114377 - DNA, 25 bp, E. coli
ggccattgaaagtcgcttcaaatat

SEQ ID NO: 114378 - DNA, 25 bp, E. coli
ggccattgaaagacgcttcaaatat

SEQ ID NO: 114379 - DNA, 25 bp, E. coli
caatcggctgtggttcaccggtcag

SEQ ID NO: 114380 - DNA, 25 bp, E. coli
caatcggctgtgcttcaccggtcag

SEQ ID NO: 114381 - DNA, 25 bp, E. coli
catattgacggtgaggtcaccgcca

SEQ ID NO: 114382 - DNA, 25 bp, E. coli
cgaattcatcacaggacgggacgcc

SEQ ID NO: 114383 - DNA, 25 bp, E. coli
catattgacggtcaggtcaccgcca

SEQ ID NO: 114384 - DNA, 25 bp, E. coli
cgaattcatcactggacgggacgcc

SEQ ID NO: 114385 - DNA, 25 bp, E. coli
tacgggcaataagcagttcgcgcgg

SEQ ID NO: 114386 - DNA, 25 bp, E. coli
tacgggcaataaccagttcgcgcgg

SEQ ID NO: 114387 - DNA, 25 bp, E. coli
tataaatgcgggtaaccacgccctg

SEQ ID NO: 114388 - DNA, 25 bp, E. coli
tataaatgcgggaaaccacgccctg

SEQ ID NO: 114389 - DNA, 25 bp, E. coli
tttaaagcccatcttcgcgatgacg

SEQ ID NO: 114390 - DNA, 25 bp, E. coli
tttaaagcccatgttcgcgatgacg

SEQ ID NO: 114391 - DNA, 25 bp, E. coli
tgatggaaggaatccgtcatgccgt

SEQ ID NO: 114392 - DNA, 25 bp, E. coli
tgatggaaggaaaccgtcatgccgt

SEQ ID NO: 114393 - DNA, 25 bp, E. coli
gcaatcgcggtaacgcagtgaccac

SEQ ID NO: 114394 - DNA, 25 bp, E. coli
gcaatcgcggtatcgcagtgaccac

SEQ ID NO: 114395 - DNA, 25 bp, E. coli
ggctacgcatttagtcttccaggaa

SEQ ID NO: 114396 - DNA, 25 bp, E. coli
ggctacgcattttgtcttccaggaa

SEQ ID NO: 114397 - DNA, 25 bp, E. coli
ggcgcatggcaaacactcagggagc

SEQ ID NO: 114398 - DNA, 25 bp, E. coli
ggcgcatggcaatcactcagggagc

SEQ ID NO: 114399 - DNA, 25 bp, E. coli
taaggcagcagttcttcggtaagca

SEQ ID NO: 114400 - DNA, 25 bp, E. coli
taaggcagcagtacttcggtaagca

SEQ ID NO: 114401 - DNA, 25 bp, E. coli
aaacatttccggtttatttcgagca

SEQ ID NO: 114402 - DNA, 25 bp, E. coli
aaacatttccggattatttcgagca

SEQ ID NO: 114403 - DNA, 25 bp, E. coli
tatttcgagcaggtggcgcggatta

SEQ ID NO: 114404 - DNA, 25 bp, E. coli
tatttcgagcagctggcgcggatta

SEQ ID NO: 114405 - DNA, 25 bp, E. coli
ttgtgctgaccggtgagccgcgtat

SEQ ID NO: 114406 - DNA, 25 bp, E. coli
ttgtgctgaccgctgagccgcgtat

SEQ ID NO: 114407 - DNA, 25 bp, E. coli
tgtcagatacaccagtgacgattct

SEQ ID NO: 114408 - DNA, 25 bp, E. coli
tgtcagatacacgagtgacgattct

SEQ ID NO: 114409 - DNA, 25 bp, E. coli
tgccgagatcgccacatacaatgat

SEQ ID NO: 114410 - DNA, 25 bp, E. coli
tgccgagatcgcgacatacaatgat

SEQ ID NO: 114411 - DNA, 25 bp, E. coli
tcagtctccgggaacttatttggtc

SEQ ID NO: 114412 - DNA, 25 bp, E. coli
tcagtctccgggtacttatttggtc

SEQ ID NO: 114413 - DNA, 25 bp, E. coli
cgcgacatacaatgatcaccggatg

SEQ ID NO: 114414 - DNA, 25 bp, E. coli
cgcgacatacaaagatcaccggatg

SEQ ID NO: 114415 - DNA, 25 bp, E. coli
ctggcgcggattagccaggcagcct

SEQ ID NO: 114416 - DNA, 25 bp, E. coli
cgggcagtcttatcagtctccgggt

SEQ ID NO: 114417 - DNA, 25 bp, E. coli
ctcgctggtggccttgtcagataca

SEQ ID NO: 114418 - DNA, 25 bp, E. coli
cgggcagtcttaacagtctccgggt

SEQ ID NO: 114419 - DNA, 25 bp, E. coli
ctcgctggtggcgttgtcagataca

SEQ ID NO: 114420 - DNA, 25 bp, E. coli
ctggcgcggatttgccaggcagcct

SEQ ID NO: 114421 - DNA, 25 bp, E. coli
gggcacgattactttcgtatcactc

SEQ ID NO: 114422 - DNA, 25 bp, E. coli
gggcacgattacattcgtatcactc

SEQ ID NO: 114423 - DNA, 25 bp, E. coli
tactggtcaatatcgcctatctggg

SEQ ID NO: 114424 - DNA, 25 bp, E. coli
tactgcgtacaggtcgcgttcgaaa

SEQ ID NO: 114425 - DNA, 25 bp, E. coli
tactggtcaataacgcctatctggg

SEQ ID NO: 114426 - DNA, 25 bp, E. coli
tactgcgtacagctcgcgttcgaaa

SEQ ID NO: 114427 - DNA, 25 bp, E. coli
acgcctatctgggtctgattcgcca

SEQ ID NO: 114428 - DNA, 25 bp, E. coli
acgcctatctggctctgattcgcca

SEQ ID NO: 114429 - DNA, 25 bp, E. coli
ttgtgccgctgaaccagagcgcaat

SEQ ID NO: 114430 - DNA, 25 bp, E. coli
ttgtgccgctgatccagagcgcaat

SEQ ID NO: 114431 - DNA, 25 bp, E. coli
gcgttcgaaaattttaactccagcg

SEQ ID NO: 114432 - DNA, 25 bp, E. coli
gcgttcgaaaatattaactccagcg

SEQ ID NO: 114433 - DNA, 25 bp, E. coli
cgcaacgtgcctatgatatggatta

SEQ ID NO: 114434 - DNA, 25 bp, E. coli
ccgctgatccagagcgcaatgtggt

SEQ ID NO: 114435 - DNA, 25 bp, E. coli
cgccagtcgcaaggtgcctttgata

SEQ ID NO: 114436 - DNA, 25 bp, E. coli
ccgctgatccagtgcgcaatgtggt

SEQ ID NO: 114437 - DNA, 25 bp, E. coli
cgccagtcgcaacgtgcctttgata

SEQ ID NO: 114438 - DNA, 25 bp, E. coli
cgcaacgtgcctttgatatggatta

SEQ ID NO: 114439 - DNA, 25 bp, E. coli
gatatggattacagcgtacagctcg

SEQ ID NO: 114440 - DNA, 25 bp, E. coli
gatatggattactgcgtacagctcg

SEQ ID NO: 114441 - DNA, 25 bp, E. coli
ggtctgattcgcgagtcgcaacgtg

SEQ ID NO: 114442 - DNA, 25 bp, E. coli
ggtctgattcgccagtcgcaacgtg

SEQ ID NO: 114443 - DNA, 25 bp, E. coli
tcaactgtgggcaggcaggcccgct

SEQ ID NO: 114444 - DNA, 25 bp, E. coli
tcaactgtgggctggcaggcccgct

SEQ ID NO: 114445 - DNA, 25 bp, E. coli
caaattaccgtgcaaagtctggcgg

SEQ ID NO: 114446 - DNA, 25 bp, E. coli
caaattaccgtggaaagtctggcgg

SEQ ID NO: 114447 - DNA, 25 bp, E. coli
aactttcgaaacctctgtggcagca

SEQ ID NO: 114448 - DNA, 25 bp, E. coli
aactttcgaaacgtctgtggcagca

SEQ ID NO: 114449 - DNA, 25 bp, E. coli
taccgggcaactggacaatggcttg

SEQ ID NO: 114450 - DNA, 25 bp, E. coli
taccgggcaactcgacaatggcttg

SEQ ID NO: 114451 - DNA, 25 bp, E. coli
tatcgacagtaatgaagcgctggcg

SEQ ID NO: 114452 - DNA, 25 bp, E. coli
tatcgacagtaaagaagcgctggcg

SEQ ID NO: 114453 - DNA, 25 bp, E. coli
tccgcgggtgaagagcaaaagctac

SEQ ID NO: 114454 - DNA, 25 bp, E. coli
tccgcgggtgaacagcaaaagctac

SEQ ID NO: 114455 - DNA, 25 bp, E. coli
tcttcagtgaatcgagtaatgccgc

SEQ ID NO: 114456 - DNA, 25 bp, E. coli
tcttcagtgaatggagtaatgccgc

SEQ ID NO: 114457 - DNA, 25 bp, E. coli
gaagactatttctggcggcactgcg

SEQ ID NO: 114458 - DNA, 25 bp, E. coli
gaagactatttcaggcggcactgcg

SEQ ID NO: 114459 - DNA, 25 bp, E. coli
gaatacgttgctctccgttagcgcg

SEQ ID NO: 114460 - DNA, 25 bp, E. coli
gaatacgttgctgtccgttagcgcg

SEQ ID NO: 114461 - DNA, 25 bp, E. coli
gttattctggcataatccgcgggtg

SEQ ID NO: 114462 - DNA, 25 bp, E. coli
gttattctggcaaaatccgcgggtg

SEQ ID NO: 114463 - DNA, 25 bp, E. coli
ggtaaaccattaactcgcgcgacgg

SEQ ID NO: 114464 - DNA, 25 bp, E. coli
ggtaaaccattatctcgcgcgacgg

SEQ ID NO: 114465 - DNA, 25 bp, E. coli
taattactgaggtatggcgtgccca

SEQ ID NO: 114466 - DNA, 25 bp, E. coli
taattactgaggaatggcgtgccca

SEQ ID NO: 114467 - DNA, 25 bp, E. coli
tgatgccattagaggccagcagcct

SEQ ID NO: 114468 - DNA, 25 bp, E. coli
tgatgccattagtggccagcagcct

SEQ ID NO: 114469 - DNA, 25 bp, E. coli
tgaaagcggaacgtaccaaacgcgc

SEQ ID NO: 114470 - DNA, 25 bp, E. coli
tgaaagcggaacctaccaaacgcgc

SEQ ID NO: 114471 - DNA, 25 bp, E. coli
tctggagctggccatcatcaacctg

SEQ ID NO: 114472 - DNA, 25 bp, E. coli
tctggagctggcgatcatcaacctg

SEQ ID NO: 114473 - DNA, 25 bp, E. coli
ccgtttatggatcgcattggtcgca

SEQ ID NO: 114474 - DNA, 25 bp, E. coli
ccgtttatggatggcattggtcgca

SEQ ID NO: 114475 - DNA, 25 bp, E. coli
gctataccaaaaggttacagccggg

SEQ ID NO: 114476 - DNA, 25 bp, E. coli
gctataccaaaacgttacagccggg

SEQ ID NO: 114477 - DNA, 25 bp, E. coli
gcgttacagcagttcggttcctcca

SEQ ID NO: 114478 - DNA, 25 bp, E. coli
gcgttacagcagatcggttcctcca

SEQ ID NO: 114479 - DNA, 25 bp, E. coli
gaagcccgcgcctccaaaatggtgt

SEQ ID NO: 114480 - DNA, 25 bp, E. coli
gaagcccgcgccaccaaaatggtgt

SEQ ID NO: 114481 - DNA, 25 bp, E. coli
gaaatgctctctcagcgcgacagca

SEQ ID NO: 114482 - DNA, 25 bp, E. coli
gaaatgctctctgagcgcgacagca

SEQ ID NO: 114483 - DNA, 25 bp, E. coli
cgtattgaaattcgcgacgtgcgcc

SEQ ID NO: 114484 - DNA, 25 bp, E. coli
cgtattgaaattggcgacgtgcgcc

SEQ ID NO: 114485 - DNA, 25 bp, E. coli
ggttcctccagttacagcaaagtag

SEQ ID NO: 114486 - DNA, 25 bp, E. coli
ggttcctccagtaacagcaaagtag

SEQ ID NO: 114487 - DNA, 25 bp, E. coli
tcaatgaacgcggagatgaaagcgg

SEQ ID NO: 114488 - DNA, 25 bp, E. coli
tcaatgaacgcgcagatgaaagcgg

SEQ ID NO: 114489 - DNA, 25 bp, E. coli
catcggcgctaaagtcaccgttgtt

SEQ ID NO: 114490 - DNA, 25 bp, E. coli
cattaccgtgcccggtcgtaccatt

SEQ ID NO: 114491 - DNA, 25 bp, E. coli
cattaccgtgccgggtcgtaccatt

SEQ ID NO: 114492 - DNA, 25 bp, E. coli
catcggcgctaatgtcaccgttgtt

SEQ ID NO: 114493 - DNA, 25 bp, E. coli
aaaagagggcgagtccatcggcgct

SEQ ID NO: 114494 - DNA, 25 bp, E. coli
aaaagagggcgactccatcggcgct

SEQ ID NO: 114495 - DNA, 25 bp, E. coli
tattgaaatccgtggctgcctgacc

SEQ ID NO: 114496 - DNA, 25 bp, E. coli
tattgaaatccgaggctgcctgacc

SEQ ID NO: 114497 - DNA, 25 bp, E. coli
ttgatcgaaaactctgaccagcgct

SEQ ID NO: 114498 - DNA, 25 bp, E. coli
ttgatcgaaaacactgaccagcgct

SEQ ID NO: 114499 - DNA, 25 bp, E. coli
tcgacgcgttagtcgagttgatgcg

SEQ ID NO: 114500 - DNA, 25 bp, E. coli
tcgacgcgttagacgagttgatgcg

SEQ ID NO: 114501 - DNA, 25 bp, E. coli
gccgagaaatttcgtattgaaatcc

SEQ ID NO: 114502 - DNA, 25 bp, E. coli
gccgagaaatttggtattgaaatcc

SEQ ID NO: 114503 - DNA, 25 bp, E. coli
ccagcgctctcaggattacagtgcg

SEQ ID NO: 114504 - DNA, 25 bp, E. coli
ccagcgctctcacgattacagtgcg

SEQ ID NO: 114505 - DNA, 25 bp, E. coli
gaaaacactgacgagcgctctcagg

SEQ ID NO: 114506 - DNA, 25 bp, E. coli
gaaaacactgaccagcgctctcagg

SEQ ID NO: 114507 - DNA, 25 bp, E. coli
cgagttgatgcgtgcgctgaaaaaa

SEQ ID NO: 114508 - DNA, 25 bp, E. coli
cgagttgatgcgagcgctgaaaaaa

SEQ ID NO: 114509 - DNA, 25 bp, E. coli
tggaaattggcgacggctttgacgt

SEQ ID NO: 114510 - DNA, 25 bp, E. coli
tggaaattggcgtcggctttgacgt

SEQ ID NO: 114511 - DNA, 25 bp, E. coli
catttctcccaaaaagcagggtgca

SEQ ID NO: 114512 - DNA, 25 bp, E. coli
catttctcccaataagcagggtgca

SEQ ID NO: 114513 - DNA, 25 bp, E. coli
taaacctgccagaaccgaagaacga

SEQ ID NO: 114514 - DNA, 25 bp, E. coli
taaacctgccagtaccgaagaacga

SEQ ID NO: 114515 - DNA, 25 bp, E. coli
aaaggtgaccatgaaccagcaggga

SEQ ID NO: 114516 - DNA, 25 bp, E. coli
aaaggtgaccatcaaccagcaggga

SEQ ID NO: 114517 - DNA, 25 bp, E. coli
tttacacaaaagctctcggtggcgg

SEQ ID NO: 114518 - DNA, 25 bp, E. coli
tttacacaaaaggtctcggtggcgg

SEQ ID NO: 114519 - DNA, 25 bp, E. coli
tgaaagcctggtgagtcacaaccgg

SEQ ID NO: 114520 - DNA, 25 bp, E. coli
tgaaagcctggtcagtcacaaccgg

SEQ ID NO: 114521 - DNA, 25 bp, E. coli
gctgagcaggcacaacccggattta

SEQ ID NO: 114522 - DNA, 25 bp, E. coli
gctgagcaggcagaacccggattta

SEQ ID NO: 114523 - DNA, 25 bp, E. coli
gcatgcatcctgatatccgaaaaga

SEQ ID NO: 114524 - DNA, 25 bp, E. coli
gcatgcatcctgttatccgaaaaga

SEQ ID NO: 114525 - DNA, 25 bp, E. coli
gaaagcttctcagaaagaggcactg

SEQ ID NO: 114526 - DNA, 25 bp, E. coli
gaaagcttctcacaaagaggcactg

SEQ ID NO: 114527 - DNA, 25 bp, E. coli
gactggattgtactcgagcgataac

SEQ ID NO: 114528 - DNA, 25 bp, E. coli
taaccatcaaaaaatccgcagcagg

SEQ ID NO: 114529 - DNA, 25 bp, E. coli
taaccatcaaaatatccgcagcagg

SEQ ID NO: 114530 - DNA, 25 bp, E. coli
gagctacgccctttaccggaagcga

SEQ ID NO: 114531 - DNA, 25 bp, E. coli
gagctacgccctataccggaagcga

SEQ ID NO: 114532 - DNA, 25 bp, E. coli
gactggattgtagtcgagcgataac

SEQ ID NO: 114533 - DNA, 25 bp, E. coli
caaaaccgaacgctcagtgactggg

SEQ ID NO: 114534 - DNA, 25 bp, E. coli
caaaaccgaacggtcagtgactggg

SEQ ID NO: 114535 - DNA, 25 bp, E. coli
aggtcgaacaaatagctgctaatgg

SEQ ID NO: 114536 - DNA, 25 bp, E. coli
aggtcgaacaaaaagctgctaatgg

SEQ ID NO: 114537 - DNA, 25 bp, E. coli
tagcgatcatattattgcaccacga

SEQ ID NO: 114538 - DNA, 25 bp, E. coli
tagcgatcatataattgcaccacga

SEQ ID NO: 114539 - DNA, 25 bp, E. coli
tattgttagcgcacctgccttttcg

SEQ ID NO: 114540 - DNA, 25 bp, E. coli
tataaatcaggctagaaaggcgttc

SEQ ID NO: 114541 - DNA, 25 bp, E. coli
tttcgcatggtcatcactcacacgg

SEQ ID NO: 114542 - DNA, 25 bp, E. coli
tataaatcaggcaagaaaggcgttc

SEQ ID NO: 114543 - DNA, 25 bp, E. coli
tattgttagcgctcctgccttttcg

SEQ ID NO: 114544 - DNA, 25 bp, E. coli
tttcgcatggtcttcactcacacgg

SEQ ID NO: 114545 - DNA, 25 bp, E. coli
tgattggcattgaggacggcattgt

SEQ ID NO: 114546 - DNA, 25 bp, E. coli
tgattggcattgtggacggcattgt

SEQ ID NO: 114547 - DNA, 25 bp, E. coli
tgactgggatggagtctggcaatcc

SEQ ID NO: 114548 - DNA, 25 bp, E. coli
tgaaatggaaaagtggccaacgtat

SEQ ID NO: 114549 - DNA, 25 bp, E. coli
tgactgggatggtgtctggcaatcc

SEQ ID NO: 114550 - DNA, 25 bp, E. coli
tgaaatggaaaactggccaacgtat

SEQ ID NO: 114551 - DNA, 25 bp, E. coli
tcacacggcaaacccttaacagagg

SEQ ID NO: 114552 - DNA, 25 bp, E. coli
ctttcagaagaaagcggatgcagat

SEQ ID NO: 114553 - DNA, 25 bp, E. coli
ctttcagaagaatgcggatgcagat

SEQ ID NO: 114554 - DNA, 25 bp, E. coli
tcacacggcaaagccttaacagagg

SEQ ID NO: 114555 - DNA, 25 bp, E. coli
catatttttaagagtgattcgccag

SEQ ID NO: 114556 - DNA, 25 bp, E. coli
cagtacacctattaaaatcaaatgg

SEQ ID NO: 114557 - DNA, 25 bp, E. coli
cagtacacctataaaaatcaaatgg

SEQ ID NO: 114558 - DNA, 25 bp, E. coli
catatttttaagtgtgattcgccag

SEQ ID NO: 114559 - DNA, 25 bp, E. coli
tacatatttttatgagtgattcgcc

SEQ ID NO: 114560 - DNA, 25 bp, E. coli
tacatatttttaagagtgattcgcc

SEQ ID NO: 114561 - DNA, 25 bp, E. coli
agagtgattcgccagtgtataaaaa

SEQ ID NO: 114562 - DNA, 25 bp, E. coli
agagtgattcgcgagtgtataaaaa

SEQ ID NO: 114563 - DNA, 25 bp, E. coli
aaatcaaatggtaattacgatggct

SEQ ID NO: 114564 - DNA, 25 bp, E. coli
aaatcaaatggttattacgatggct

SEQ ID NO: 114565 - DNA, 25 bp, E. coli
tatttttaagagtgattcgccagtg

SEQ ID NO: 114566 - DNA, 25 bp, E. coli
tatttttaagagagattcgccagtg

SEQ ID NO: 114567 - DNA, 25 bp, E. coli
tttttaagagtgtttcgccagtgta

SEQ ID NO: 114568 - DNA, 25 bp, E. coli
ttaagagtgattggccagtgtataa

SEQ ID NO: 114569 - DNA, 25 bp, E. coli
tttttaagagtgattcgccagtgta

SEQ ID NO: 114570 - DNA, 25 bp, E. coli
ttaagagtgattcgccagtgtataa

SEQ ID NO: 114571 - DNA, 25 bp, E. coli
tcgccagtgtataaaaaaacagtac

SEQ ID NO: 114572 - DNA, 25 bp, E. coli
tcgccagtgtattaaaaaacagtac

SEQ ID NO: 114573 - DNA, 25 bp, E. coli
gagtgattcgcctgtgtataaaaaa

SEQ ID NO: 114574 - DNA, 25 bp, E. coli
gatgcaaaggcaaaaaattttactt

SEQ ID NO: 114575 - DNA, 25 bp, E. coli
gagtgattcgccagtgtataaaaaa

SEQ ID NO: 114576 - DNA, 25 bp, E. coli
gatgcaaaggcataaaattttactt

SEQ ID NO: 114577 - DNA, 25 bp, E. coli
aatttattatcatgctttttacagc

SEQ ID NO: 114578 - DNA, 25 bp, E. coli
aatttattatcaagctttttacagc

SEQ ID NO: 114579 - DNA, 25 bp, E. coli
caccgcttttcgtgaaaatcttttg

SEQ ID NO: 114580 - DNA, 25 bp, E. coli
caccgcttttcgagaaaatcttttg

SEQ ID NO: 114581 - DNA, 25 bp, E. coli
cagattatgggttaaggatgccaca

SEQ ID NO: 114582 - DNA, 25 bp, E. coli
cagattatgggtaaaggatgccaca

SEQ ID NO: 114583 - DNA, 25 bp, E. coli
aacatgagttttacaccgcttttcg

SEQ ID NO: 114584 - DNA, 25 bp, E. coli
aacatgagtttttcaccgcttttcg

SEQ ID NO: 114585 - DNA, 25 bp, E. coli
tgggtaaaggatgccacagacagga

SEQ ID NO: 114586 - DNA, 25 bp, E. coli
tgggtaaaggatcccacagacagga

SEQ ID NO: 114587 - DNA, 25 bp, E. coli
tgtgcataaattatttacatcgctt

SEQ ID NO: 114588 - DNA, 25 bp, E. coli
tgtgcataaattttttacatcgctt

SEQ ID NO: 114589 - DNA, 25 bp, E. coli
tccgtgcctgtttatcagattatgg

SEQ ID NO: 114590 - DNA, 25 bp, E. coli
tccgtgcctgttaatcagattatgg

SEQ ID NO: 114591 - DNA, 25 bp, E. coli
gaaaatcttttgaagatcttctgga

SEQ ID NO: 114592 - DNA, 25 bp, E. coli
gaaaatcttttgtagatcttctgga

SEQ ID NO: 114593 - DNA, 25 bp, E. coli
cgtcatgtggataactttgtgcata

SEQ ID NO: 114594 - DNA, 25 bp, E. coli
cgtcatgtggattactttgtgcata

SEQ ID NO: 114595 - DNA, 25 bp, E. coli
gatcttctggatcgctcgcaaatcg

SEQ ID NO: 114596 - DNA, 25 bp, E. coli
gatcttctggatggctcgcaaatcg

SEQ ID NO: 114597 - DNA, 25 bp, E. coli
gatcgctcgcaattcgtcatgtgga

SEQ ID NO: 114598 - DNA, 25 bp, E. coli
gatcgctcgcaaatcgtcatgtgga

SEQ ID NO: 114599 - DNA, 25 bp, E. coli
caattatcgagcgttagccagcggt

SEQ ID NO: 114600 - DNA, 25 bp, E. coli
caacctgctggctctggatgatccc

SEQ ID NO: 114601 - DNA, 25 bp, E. coli
caattatcgagccttagccagcggt

SEQ ID NO: 114602 - DNA, 25 bp, E. coli
caacctgctggcactggatgatccc

SEQ ID NO: 114603 - DNA, 25 bp, E. coli
cacagcggatatagataagacggta

SEQ ID NO: 114604 - DNA, 25 bp, E. coli
cacagcggatattgataagacggta

SEQ ID NO: 114605 - DNA, 25 bp, E. coli
tacgtaatagcgatcgctcccggct

SEQ ID NO: 114606 - DNA, 25 bp, E. coli
agacggtagatttaggcagatggcc

SEQ ID NO: 114607 - DNA, 25 bp, E. coli
agacggtagattaaggcagatggcc

SEQ ID NO: 114608 - DNA, 25 bp, E. coli
tacgtaatagcgttcgctcccggct

SEQ ID NO: 114609 - DNA, 25 bp, E. coli
tgcgattttatttacgggaacgccg

SEQ ID NO: 114610 - DNA, 25 bp, E. coli
tgcgattttattaacgggaacgccg

SEQ ID NO: 114611 - DNA, 25 bp, E. coli
cccgactgaggatgtagatgcaaat

SEQ ID NO: 114612 - DNA, 25 bp, E. coli
cccttttagcctccggctggaggga

SEQ ID NO: 114613 - DNA, 25 bp, E. coli
cccttttagcctgcggctggaggga

SEQ ID NO: 114614 - DNA, 25 bp, E. coli
cccgactgaggaagtagatgcaaat

SEQ ID NO: 114615 - DNA, 25 bp, E. coli
ggcacaaaccgtcgccatcgaatta

SEQ ID NO: 114616 - DNA, 25 bp, E. coli
tggatgatcccgcaatggcacaaac

SEQ ID NO: 114617 - DNA, 25 bp, E. coli
ggcacaaaccgtggccatcgaatta

SEQ ID NO: 114618 - DNA, 25 bp, E. coli
tggatgatcccggaatggcacaaac

SEQ ID NO: 114619 - DNA, 25 bp, E. coli
gatgtcctccggcttcagttgcgat

SEQ ID NO: 114620 - DNA, 25 bp, E. coli
gatgtcctccgggttcagttgcgat

SEQ ID NO: 114621 - DNA, 25 bp, E. coli
caatgttcttaaagcttcaggcgga

SEQ ID NO: 114622 - DNA, 25 bp, E. coli
caatgttcttaatgcttcaggcgga

SEQ ID NO: 114623 - DNA, 25 bp, E. coli
caaaagcggaatcagtaaccagggt

SEQ ID NO: 114624 - DNA, 25 bp, E. coli
caaaagcggaatgagtaaccagggt

SEQ ID NO: 114625 - DNA, 25 bp, E. coli
catggctgctggctctaggcaaata

SEQ ID NO: 114626 - DNA, 25 bp, E. coli
catggctgctgggtctaggcaaata

SEQ ID NO: 114627 - DNA, 25 bp, E. coli
cagggtaatattcatcttggcgtcg

SEQ ID NO: 114628 - DNA, 25 bp, E. coli
cagggtaatattgatcttggcgtcg

SEQ ID NO: 114629 - DNA, 25 bp, E. coli
taaaaaacagcagctgcaaaagcgg

SEQ ID NO: 114630 - DNA, 25 bp, E. coli
taaaaaacagcacctgcaaaagcgg

SEQ ID NO: 114631 - DNA, 25 bp, E. coli
tattttctactctggattcggcgaa

SEQ ID NO: 114632 - DNA, 25 bp, E. coli
tattttctactcaggattcggcgaa

SEQ ID NO: 114633 - DNA, 25 bp, E. coli
ccattgctggacaggatattgacct

SEQ ID NO: 114634 - DNA, 25 bp, E. coli
ccattgctggactggatattgacct

SEQ ID NO: 114635 - DNA, 25 bp, E. coli
gcaaaaaatcgaacctgcattgagt

SEQ ID NO: 114636 - DNA, 25 bp, E. coli
gcaaaaaatcgatcctgcattgagt

SEQ ID NO: 114637 - DNA, 25 bp, E. coli
cattacagggaagtggcgatgtgct

SEQ ID NO: 114638 - DNA, 25 bp, E. coli
cattacagggaactggcgatgtgct

SEQ ID NO: 114639 - DNA, 25 bp, E. coli
gattttagagccgttagcggtgtca

SEQ ID NO: 114640 - DNA, 25 bp, E. coli
gattttagagcccttagcggtgtca

SEQ ID NO: 114641 - DNA, 25 bp, E. coli
tcaaccaggtggaaaagagttcact

SEQ ID NO: 114642 - DNA, 25 bp, E. coli
tcaaccaggtggtaaagagttcact

SEQ ID NO: 114643 - DNA, 25 bp, E. coli
caatacaaacaggagaacgcgcgtc

SEQ ID NO: 114644 - DNA, 25 bp, E. coli
aacgatatccgcctaattgcagccg

SEQ ID NO: 114645 - DNA, 25 bp, E. coli
caatacaaacagcagaacgcgcgtc

SEQ ID NO: 114646 - DNA, 25 bp, E. coli
aacgatatccgcgtaattgcagccg

SEQ ID NO: 114647 - DNA, 25 bp, E. coli
tatactgtgattgaggcgcgtccga

SEQ ID NO: 114648 - DNA, 25 bp, E. coli
tatactgtgattcaggcgcgtccga

SEQ ID NO: 114649 - DNA, 25 bp, E. coli
tattgccttcgcgagacgcgatggg

SEQ ID NO: 114650 - DNA, 25 bp, E. coli
tattgccttcgccagacgcgatggg

SEQ ID NO: 114651 - DNA, 25 bp, E. coli
ccggtcatcagcgacaaaggtgttg

SEQ ID NO: 114652 - DNA, 25 bp, E. coli
ccggtcatcagccacaaaggtgttg

SEQ ID NO: 114653 - DNA, 25 bp, E. coli
gctgatttgtgatgcgacccacgcg

SEQ ID NO: 114654 - DNA, 25 bp, E. coli
gctgatttgtgaagcgacccacgcg

SEQ ID NO: 114655 - DNA, 25 bp, E. coli
gaagccaatttttagccgtggcccg

SEQ ID NO: 114656 - DNA, 25 bp, E. coli
gaagccaattttaagccgtggcccg

SEQ ID NO: 114657 - DNA, 25 bp, E. coli
gaactgctgatggttggacaataca

SEQ ID NO: 114658 - DNA, 25 bp, E. coli
gaactgctgatgcttggacaataca

SEQ ID NO: 114659 - DNA, 25 bp, E. coli
cgtacttatatggataccgccgtca

SEQ ID NO: 114660 - DNA, 25 bp, E. coli
cgtacttatatgcataccgccgtca

SEQ ID NO: 114661 - DNA, 25 bp, E. coli
gtaaaactcgatacccagcgcgctt

SEQ ID NO: 114662 - DNA, 25 bp, E. coli
gtaaaactcgattcccagcgcgctt

SEQ ID NO: 114663 - DNA, 25 bp, E. coli
taatggcgtttatgaaggccagccg

SEQ ID NO: 114664 - DNA, 25 bp, E. coli
taatggcgtttaagaaggccagccg

SEQ ID NO: 114665 - DNA, 25 bp, E. coli
caaaaatgctggtggaagaggatcc

SEQ ID NO: 114666 - DNA, 25 bp, E. coli
cagaaagttaccattcacggctggg

SEQ ID NO: 114667 - DNA, 25 bp, E. coli
caaaaatgctggaggaagaggatcc

SEQ ID NO: 114668 - DNA, 25 bp, E. coli
cagaaagttacctttcacggctggg

SEQ ID NO: 114669 - DNA, 25 bp, E. coli
tacaagccgcagatgaaaacccgga

SEQ ID NO: 114670 - DNA, 25 bp, E. coli
tacaagccgcagttgaaaacccgga

SEQ ID NO: 114671 - DNA, 25 bp, E. coli
aaaaccgcgcttactatggattgga

SEQ ID NO: 114672 - DNA, 25 bp, E. coli
aaaaccgcgctttctatggattgga

SEQ ID NO: 114673 - DNA, 25 bp, E. coli
tatctgtggccagtacggttgcggc

SEQ ID NO: 114674 - DNA, 25 bp, E. coli
tatgcaatcagcctggaaacgcggg

SEQ ID NO: 114675 - DNA, 25 bp, E. coli
tatctgtggccactacggttgcggc

SEQ ID NO: 114676 - DNA, 25 bp, E. coli
tatgcaatcagcgtggaaacgcggg

SEQ ID NO: 114677 - DNA, 25 bp, E. coli
ttttttgagaaactggcacaagcgc

SEQ ID NO: 114678 - DNA, 25 bp, E. coli
ttttttgagaaagtggcacaagcgc

SEQ ID NO: 114679 - DNA, 25 bp, E. coli
cttgagcaacgtaaccgtcacggga

SEQ ID NO: 114680 - DNA, 25 bp, E. coli
cttgagcaacgttaccgtcacggga

SEQ ID NO: 114681 - DNA, 25 bp, E. coli
ggcttatcaacatctggctgctgca

SEQ ID NO: 114682 - DNA, 25 bp, E. coli
ggcttatcaacaactggctgctgca

SEQ ID NO: 114683 - DNA, 25 bp, E. coli
taaccggtcttgtgccgggcgaact

SEQ ID NO: 114684 - DNA, 25 bp, E. coli
taaccggtcttgagccgggcgaact

SEQ ID NO: 114685 - DNA, 25 bp, E. coli
gagcgccgtctggataccttgtgtg

SEQ ID NO: 114686 - DNA, 25 bp, E. coli
gagcgccgtctgcataccttgtgtg

SEQ ID NO: 114687 - DNA, 25 bp, E. coli
aaaaagcgactgcaatatgccaaaa

SEQ ID NO: 114688 - DNA, 25 bp, E. coli
aaaaagcgactggaatatgccaaaa

SEQ ID NO: 114689 - DNA, 25 bp, E. coli
tagacaatcgtaaggctttagcaaa

SEQ ID NO: 114690 - DNA, 25 bp, E. coli
tagacaatcgtatggctttagcaaa

SEQ ID NO: 114691 - DNA, 25 bp, E. coli
tataagcattttacccgttgtggaa

SEQ ID NO: 114692 - DNA, 25 bp, E. coli
tataagcatttttcccgttgtggaa

SEQ ID NO: 114693 - DNA, 25 bp, E. coli
ttttcccgttgtggaatgacgtggc

SEQ ID NO: 114694 - DNA, 25 bp, E. coli
ttttcccgttgtcgaatgacgtggc

SEQ ID NO: 114695 - DNA, 25 bp, E. coli
tgattatggtttaatgcagataaac

SEQ ID NO: 114696 - DNA, 25 bp, E. coli
tgattatggttttatgcagataaac

SEQ ID NO: 114697 - DNA, 25 bp, E. coli
cccgttgtggaatgacgtggcaatg

SEQ ID NO: 114698 - DNA, 25 bp, E. coli
cccgttgtggaaagacgtggcaatg

SEQ ID NO: 114699 - DNA, 25 bp, E. coli
ggcttaatgaactagacaatcgtaa

SEQ ID NO: 114700 - DNA, 25 bp, E. coli
ggcttaatgaacaagacaatcgtaa

SEQ ID NO: 114701 - DNA, 25 bp, E. coli
taatgaactagacaatcgtaaggct

SEQ ID NO: 114702 - DNA, 25 bp, E. coli
tttgttagataaaccctgcctgaac

SEQ ID NO: 114703 - DNA, 25 bp, E. coli
tttgttagataatccctgcctgaac

SEQ ID NO: 114704 - DNA, 25 bp, E. coli
taatgaactagagaatcgtaaggct

SEQ ID NO: 114705 - DNA, 25 bp, E. coli
gagttttgattatggtttaatgcag

SEQ ID NO: 114706 - DNA, 25 bp, E. coli
gataatccctgcgtgaacattaaaa

SEQ ID NO: 114707 - DNA, 25 bp, E. coli
gataatccctgcctgaacattaaaa

SEQ ID NO: 114708 - DNA, 25 bp, E. coli
gagttttgattaaggtttaatgcag

SEQ ID NO: 114709 - DNA, 25 bp, E. coli
caaacagaacgacgaccagagggtg

SEQ ID NO: 114710 - DNA, 25 bp, E. coli
caaacagaacgaggaccagagggtg

SEQ ID NO: 114711 - DNA, 25 bp, E. coli
catgtgattgagcttatggcgcgtc

SEQ ID NO: 114712 - DNA, 25 bp, E. coli
catgtgattgaggttatggcgcgtc

SEQ ID NO: 114713 - DNA, 25 bp, E. coli
aaatctcattgcatgggcgtggtcg

SEQ ID NO: 114714 - DNA, 25 bp, E. coli
aaatctcattgcttgggcgtggtcg

SEQ ID NO: 114715 - DNA, 25 bp, E. coli
ttaatgccatgattcggttctgccg

SEQ ID NO: 114716 - DNA, 25 bp, E. coli
ttaatgccatgaatcggttctgccg

SEQ ID NO: 114717 - DNA, 25 bp, E. coli
ttgccgatagttcccggaaagcctg

SEQ ID NO: 114718 - DNA, 25 bp, E. coli
ttgccgatagttgccggaaagcctg

SEQ ID NO: 114719 - DNA, 25 bp, E. coli
tgagtttggttaggtcctgccggaa

SEQ ID NO: 114720 - DNA, 25 bp, E. coli
tgagtttggttacgtcctgccggaa

SEQ ID NO: 114721 - DNA, 25 bp, E. coli
cctgccggaaggagcattgccgata

SEQ ID NO: 114722 - DNA, 25 bp, E. coli
cctgccggaaggtgcattgccgata

SEQ ID NO: 114723 - DNA, 25 bp, E. coli
gaacaggagcagatactggttccgg

SEQ ID NO: 114724 - DNA, 25 bp, E. coli
gaaagcctgccagggtacggcatgt

SEQ ID NO: 114725 - DNA, 25 bp, E. coli
gaaagcctgccacggtacggcatgt

SEQ ID NO: 114726 - DNA, 25 bp, E. coli
gaacaggagcagttactggttccgg

SEQ ID NO: 114727 - DNA, 25 bp, E. coli
cgtcatggacgtgatgaacaggagc

SEQ ID NO: 114728 - DNA, 25 bp, E. coli
cgtcatggacgtcatgaacaggagc

SEQ ID NO: 114729 - DNA, 25 bp, E. coli
gacgccgggtcacttatccaaacag

SEQ ID NO: 114730 - DNA, 25 bp, E. coli
gacgccgggtcagttatccaaacag

SEQ ID NO: 114731 - DNA, 25 bp, E. coli
cccgtacctctgataatggtctaaa

SEQ ID NO: 114732 - DNA, 25 bp, E. coli
caaaaatagtgcttgaaataagctt

SEQ ID NO: 114733 - DNA, 25 bp, E. coli
cccgtacctctgttaatggtctaaa

SEQ ID NO: 114734 - DNA, 25 bp, E. coli
caaaaatagtgcatgaaataagctt

SEQ ID NO: 114735 - DNA, 25 bp, E. coli
gtaacaaacacggttcccatataga

SEQ ID NO: 114736 - DNA, 25 bp, E. coli
gtaacaaacacgcttcccatataga

SEQ ID NO: 114737 - DNA, 25 bp, E. coli
aacacccaaatggatttctttatga

SEQ ID NO: 114738 - DNA, 25 bp, E. coli
aataagctttttctctaccaatccg

SEQ ID NO: 114739 - DNA, 25 bp, E. coli
aacacccaaatgcatttctttatga

SEQ ID NO: 114740 - DNA, 25 bp, E. coli
aataagctttttgtctaccaatccg

SEQ ID NO: 114741 - DNA, 25 bp, E. coli
tgctcaataaggtaaatttggcgtg

SEQ ID NO: 114742 - DNA, 25 bp, E. coli
tgaattaatccgaaacaaacacgct

SEQ ID NO: 114743 - DNA, 25 bp, E. coli
tgaattaatccgtaacaaacacgct

SEQ ID NO: 114744 - DNA, 25 bp, E. coli
tgctcaataaggaaaatttggcgtg

SEQ ID NO: 114745 - DNA, 25 bp, E. coli
tcctggcacaataacatcaaccagc

SEQ ID NO: 114746 - DNA, 25 bp, E. coli
tcctggcacaattacatcaaccagc

SEQ ID NO: 114747 - DNA, 25 bp, E. coli
gcaccacaatattccacagcactaa

SEQ ID NO: 114748 - DNA, 25 bp, E. coli
gcaccacaatataccacagcactaa

SEQ ID NO: 114749 - DNA, 25 bp, E. coli
gatataaatattcatcagcaccaca

SEQ ID NO: 114750 - DNA, 25 bp, E. coli
gatataaatattgatcagcaccaca

SEQ ID NO: 114751 - DNA, 25 bp, E. coli
tggcatttcatcaccatctgcggca

SEQ ID NO: 114752 - DNA, 25 bp, E. coli
tggcatttcatctccatctgcggca

SEQ ID NO: 114753 - DNA, 25 bp, E. coli
cactgtcgcgaggtggcgtatatta

SEQ ID NO: 114754 - DNA, 25 bp, E. coli
cactgtcgcgagctggcgtatatta

SEQ ID NO: 114755 - DNA, 25 bp, E. coli
taaagagcagttgcgacgcggcttt

SEQ ID NO: 114756 - DNA, 25 bp, E. coli
taaagagcagttccgacgcggcttt

SEQ ID NO: 114757 - DNA, 25 bp, E. coli
agagcagttgcgacgcggctttcag

SEQ ID NO: 114758 - DNA, 25 bp, E. coli
agagcagttgcgtcgcggctttcag

SEQ ID NO: 114759 - DNA, 25 bp, E. coli
ttcagctcactgacgcgaggtggcg

SEQ ID NO: 114760 - DNA, 25 bp, E. coli
ttcagctcactgtcgcgaggtggcg

SEQ ID NO: 114761 - DNA, 25 bp, E. coli
tgttaaagagcagttgcgacgcggc

SEQ ID NO: 114762 - DNA, 25 bp, E. coli
tgttaaagagcacttgcgacgcggc

SEQ ID NO: 114763 - DNA, 25 bp, E. coli
tgcgacgcggctttcagctcactgt

SEQ ID NO: 114764 - DNA, 25 bp, E. coli
tgcgacgcggctatcagctcactgt

SEQ ID NO: 114765 - DNA, 25 bp, E. coli
gctcactgtcgccaggtggcgtata

SEQ ID NO: 114766 - DNA, 25 bp, E. coli
gcggctttcagcacactgtcgcgag

SEQ ID NO: 114767 - DNA, 25 bp, E. coli
gctcactgtcgcgaggtggcgtata

SEQ ID NO: 114768 - DNA, 25 bp, E. coli
gcggctttcagctcactgtcgcgag

SEQ ID NO: 114769 - DNA, 25 bp, E. coli
gctttcagctcactgtcgcgaggtg

SEQ ID NO: 114770 - DNA, 25 bp, E. coli
gctttcagctcagtgtcgcgaggtg

SEQ ID NO: 114771 - DNA, 25 bp, E. coli
ctgtcgcgaggtcgcgtatattacg

SEQ ID NO: 114772 - DNA, 25 bp, E. coli
ctgtcgcgaggtggcgtatattacg

SEQ ID NO: 114773 - DNA, 25 bp, E. coli
gttgcgacgcgggtttcagctcact

SEQ ID NO: 114774 - DNA, 25 bp, E. coli
gttgcgacgcggctttcagctcact

SEQ ID NO: 114775 - DNA, 25 bp, E. coli
aatttgagggcggaaagatacacac

SEQ ID NO: 114776 - DNA, 25 bp, E. coli
aatttgagggcgcaaagatacacac

SEQ ID NO: 114777 - DNA, 25 bp, E. coli
taaacgacatctgacttcttccggg

SEQ ID NO: 114778 - DNA, 25 bp, E. coli
taaacgacatctcacttcttccggg

SEQ ID NO: 114779 - DNA, 25 bp, E. coli
agttcagcccggcaaggtgcctgac

SEQ ID NO: 114780 - DNA, 25 bp, E. coli
agttcagcccgggaaggtgcctgac

SEQ ID NO: 114781 - DNA, 25 bp, E. coli
tgaaatctgtctttcggcgatggct

SEQ ID NO: 114782 - DNA, 25 bp, E. coli
tgaaatctgtctatcggcgatggct

SEQ ID NO: 114783 - DNA, 25 bp, E. coli
tgcctgaccgtataaatgaaatctg

SEQ ID NO: 114784 - DNA, 25 bp, E. coli
tgcctgaccgtaaaaatgaaatctg

SEQ ID NO: 114785 - DNA, 25 bp, E. coli
gcgatggcttaatcatttaccgccg

SEQ ID NO: 114786 - DNA, 25 bp, E. coli
gcgatggcttaaacatttaccgccg

SEQ ID NO: 114787 - DNA, 25 bp, E. coli
cgcgtgagggtgctaagaaacattc

SEQ ID NO: 114788 - DNA, 25 bp, E. coli
cgcgtgagggtggtaagaaacattc

SEQ ID NO: 114789 - DNA, 25 bp, E. coli
gatagattatcccaacgctttactc

SEQ ID NO: 114790 - DNA, 25 bp, E. coli
gatagattatccgaacgctttactc

SEQ ID NO: 114791 - DNA, 25 bp, E. coli
ggcgcgcaatatttgtaggttgaac

SEQ ID NO: 114792 - DNA, 25 bp, E. coli
ggcgcgcaatatatgtaggttgaac

SEQ ID NO: 114793 - DNA, 25 bp, E. coli
tcagcttttagccagttcagcccgg

SEQ ID NO: 114794 - DNA, 25 bp, E. coli
tcagcttttagcgagttcagcccgg

SEQ ID NO: 114795 - DNA, 25 bp, E. coli
gatgagtaagtgtccaaaaacgaga

SEQ ID NO: 114796 - DNA, 25 bp, E. coli
gatgagtaagtgaccaaaaacgaga

SEQ ID NO: 114797 - DNA, 25 bp, E. coli
caatctggcgagcagacaagcacac

SEQ ID NO: 114798 - DNA, 25 bp, E. coli
caatctggcgaggagacaagcacac

SEQ ID NO: 114799 - DNA, 25 bp, E. coli
cagcagcattccacgcctgtttgca

SEQ ID NO: 114800 - DNA, 25 bp, E. coli
cagcagcattcctcgcctgtttgca

SEQ ID NO: 114801 - DNA, 25 bp, E. coli
cagaaaggcttaatgcatcagcagc

SEQ ID NO: 114802 - DNA, 25 bp, E. coli
cagacaagcacactcccatgagacg

SEQ ID NO: 114803 - DNA, 25 bp, E. coli
cagacaagcacagtcccatgagacg

SEQ ID NO: 114804 - DNA, 25 bp, E. coli
cagaaaggcttattgcatcagcagc

SEQ ID NO: 114805 - DNA, 25 bp, E. coli
tatgtgctgcaagaatctggcgagc

SEQ ID NO: 114806 - DNA, 25 bp, E. coli
tatgtgctgcaacaatctggcgagc

SEQ ID NO: 114807 - DNA, 25 bp, E. coli
tctctgcctgagaccagaaaggctt

SEQ ID NO: 114808 - DNA, 25 bp, E. coli
tctctgcctgagtccagaaaggctt

SEQ ID NO: 114809 - DNA, 25 bp, E. coli
gcctgtttgcaaccgcgtaaggtca

SEQ ID NO: 114810 - DNA, 25 bp, E. coli
gcctgtttgcaagcgcgtaaggtca

SEQ ID NO: 114811 - DNA, 25 bp, E. coli
cctttgttacaattctctgcctgag

SEQ ID NO: 114812 - DNA, 25 bp, E. coli
cctttgttacaaatctctgcctgag

SEQ ID NO: 114813 - DNA, 25 bp, E. coli
gcaaccgcgtaacgtcattcatctg

SEQ ID NO: 114814 - DNA, 25 bp, E. coli
gcaaccgcgtaaggtcattcatctg

SEQ ID NO: 114815 - DNA, 25 bp, E. coli
cattcatctgcaaatgtgctgcaac

SEQ ID NO: 114816 - DNA, 25 bp, E. coli
cattcatctgcatatgtgctgcaac

SEQ ID NO: 114817 - DNA, 25 bp, E. coli
gtgcagttcgtttcctttgttacaa

SEQ ID NO: 114818 - DNA, 25 bp, E. coli
gtgcagttcgttacctttgttacaa

SEQ ID NO: 114819 - DNA, 25 bp, E. coli
tacaggagtggatcatttatcgcag

SEQ ID NO: 114820 - DNA, 25 bp, E. coli
tacaggagtggaacatttatcgcag

SEQ ID NO: 114821 - DNA, 25 bp, E. coli
aaaccatgcgagatattgacaatga

SEQ ID NO: 114822 - DNA, 25 bp, E. coli
aaaccatgcgagttattgacaatga

SEQ ID NO: 114823 - DNA, 25 bp, E. coli
aacttatagataaccaaaatgcagg

SEQ ID NO: 114824 - DNA, 25 bp, E. coli
aacttatagatatccaaaatgcagg

SEQ ID NO: 114825 - DNA, 25 bp, E. coli
tagaaaccagaaaggaatgtcacca

SEQ ID NO: 114826 - DNA, 25 bp, E. coli
tagaaaccagaatggaatgtcacca

SEQ ID NO: 114827 - DNA, 25 bp, E. coli
tataattttatattgacggcggagc

SEQ ID NO: 114828 - DNA, 25 bp, E. coli
tataattttataatgacggcggagc

SEQ ID NO: 114829 - DNA, 25 bp, E. coli
tgatgaatttactgccggaagggaa

SEQ ID NO: 114830 - DNA, 25 bp, E. coli
tgatgaatttacagccggaagggaa

SEQ ID NO: 114831 - DNA, 25 bp, E. coli
tgcaggtaatataaaagatgcgaca

SEQ ID NO: 114832 - DNA, 25 bp, E. coli
tgcaggtaatattaaagatgcgaca

SEQ ID NO: 114833 - DNA, 25 bp, E. coli
gcgacaattgtttataaggcaaaga

SEQ ID NO: 114834 - DNA, 25 bp, E. coli
gcgacaattgttaataaggcaaaga

SEQ ID NO: 114835 - DNA, 25 bp, E. coli
gaaaatattatctggcatgatggtg

SEQ ID NO: 114836 - DNA, 25 bp, E. coli
gacggcggagctttatgttgatgaa

SEQ ID NO: 114837 - DNA, 25 bp, E. coli
gaaaatattatcaggcatgatggtg

SEQ ID NO: 114838 - DNA, 25 bp, E. coli
tggaatgtcaccacaccgagtataa

SEQ ID NO: 114839 - DNA, 25 bp, E. coli
tggaatgtcacctcaccgagtataa

SEQ ID NO: 114840 - DNA, 25 bp, E. coli
gacggcggagctatatgttgatgaa

SEQ ID NO: 114841 - DNA, 25 bp, E. coli
cacaaacaattattacggtcatctg

SEQ ID NO: 114842 - DNA, 25 bp, E. coli
cacaaacaattaatacggtcatctg

SEQ ID NO: 114843 - DNA, 25 bp, E. coli
atgaccgctctttaaaatatttatc

SEQ ID NO: 114844 - DNA, 25 bp, E. coli
atgaccgctcttaaaaatatttatc

SEQ ID NO: 114845 - DNA, 25 bp, E. coli
tatgatttattttctgaaacgggca

SEQ ID NO: 114846 - DNA, 25 bp, E. coli
tatgatttatttactgaaacgggca

SEQ ID NO: 114847 - DNA, 25 bp, E. coli
ttttcggcacaaacaattaatacgg

SEQ ID NO: 114848 - DNA, 25 bp, E. coli
ttttcggcacaatcaattaatacgg

SEQ ID NO: 114849 - DNA, 25 bp, E. coli
tttcggcacaaacaattaatacggt

SEQ ID NO: 114850 - DNA, 25 bp, E. coli
tttcggcacaaagaattaatacggt

SEQ ID NO: 114851 - DNA, 25 bp, E. coli
ttcggcacaaactattaatacggtc

SEQ ID NO: 114852 - DNA, 25 bp, E. coli
tcggcacaaacaattaatacggtca

SEQ ID NO: 114853 - DNA, 25 bp, E. coli
ttcggcacaaacaattaatacggtc

SEQ ID NO: 114854 - DNA, 25 bp, E. coli
tcggcacaaacatttaatacggtca

SEQ ID NO: 114855 - DNA, 25 bp, E. coli
gatttattttctcaaacgggcatga

SEQ ID NO: 114856 - DNA, 25 bp, E. coli
taaaaatatttatcaaaacggtcat

SEQ ID NO: 114857 - DNA, 25 bp, E. coli
taaaaatatttaacaaaacggtcat

SEQ ID NO: 114858 - DNA, 25 bp, E. coli
gatttattttctgaaacgggcatga

SEQ ID NO: 114859 - DNA, 25 bp, E. coli
ggcacaaacaataaatacggtcatc

SEQ ID NO: 114860 - DNA, 25 bp, E. coli
ggcacaaacaattaatacggtcatc

SEQ ID NO: 114861 - DNA, 25 bp, E. coli
gaccgctcttaaaaatatttatcaa

SEQ ID NO: 114862 - DNA, 25 bp, E. coli
gaccgctcttaataatatttatcaa

SEQ ID NO: 114863 - DNA, 25 bp, E. coli
caagtttgttccctacagtcgctgg

SEQ ID NO: 114864 - DNA, 25 bp, E. coli
caagtttgttccgtacagtcgctgg

SEQ ID NO: 114865 - DNA, 25 bp, E. coli
agcagcctgtgtccgctcagcatga

SEQ ID NO: 114866 - DNA, 25 bp, E. coli
agcagcctgtgtgcgctcagcatga

SEQ ID NO: 114867 - DNA, 25 bp, E. coli
actggatattatggcctggccggga

SEQ ID NO: 114868 - DNA, 25 bp, E. coli
actggatattatcgcctggccggga

SEQ ID NO: 114869 - DNA, 25 bp, E. coli
ttcgaaaaagagtcaggctgcgcgg

SEQ ID NO: 114870 - DNA, 25 bp, E. coli
ttacgatctggttacggcatccggc

SEQ ID NO: 114871 - DNA, 25 bp, E. coli
ttacgatctggtaacggcatccggc

SEQ ID NO: 114872 - DNA, 25 bp, E. coli
ttcgaaaaagagacaggctgcgcgg

SEQ ID NO: 114873 - DNA, 25 bp, E. coli
tgacactaccgtccaaatgagcgat

SEQ ID NO: 114874 - DNA, 25 bp, E. coli
tgacactaccgtgcaaatgagcgat

SEQ ID NO: 114875 - DNA, 25 bp, E. coli
tgagcaagacatatgcccgcagcag

SEQ ID NO: 114876 - DNA, 25 bp, E. coli
tgagcaagacatttgcccgcagcag

SEQ ID NO: 114877 - DNA, 25 bp, E. coli
tgcgcctacaaaaggatgaactggt

SEQ ID NO: 114878 - DNA, 25 bp, E. coli
tgcgcctacaaatggatgaactggt

SEQ ID NO: 114879 - DNA, 25 bp, E. coli
gtttacggcacagcttaccaatggg

SEQ ID NO: 114880 - DNA, 25 bp, E. coli
gtttacggcacaccttaccaatggg

SEQ ID NO: 114881 - DNA, 25 bp, E. coli
gggccgaacctgctgatgtacaaca

SEQ ID NO: 114882 - DNA, 25 bp, E. coli
gggccgaacctggtgatgtacaaca

SEQ ID NO: 114883 - DNA, 25 bp, E. coli
gatgtacaacacaaaaaccttcccg

SEQ ID NO: 114884 - DNA, 25 bp, E. coli
gatgtacaacactaaaaccttcccg

SEQ ID NO: 114885 - DNA, 25 bp, E. coli
tatttctcgcaacgaagattcagca

SEQ ID NO: 114886 - DNA, 25 bp, E. coli
tatttctcgcaaggaagattcagca

SEQ ID NO: 114887 - DNA, 25 bp, E. coli
tcgccacagacataacaatacagct

SEQ ID NO: 114888 - DNA, 25 bp, E. coli
tcgccacagacaaaacaatacagct

SEQ ID NO: 114889 - DNA, 25 bp, E. coli
ccagaaattcctggcggcagatata

SEQ ID NO: 114890 - DNA, 25 bp, E. coli
ccagaaattcctcgcggcagatata

SEQ ID NO: 114891 - DNA, 25 bp, E. coli
gaattttgtattattgccgccagaa

SEQ ID NO: 114892 - DNA, 25 bp, E. coli
gaaggtagtcaaattcgccacagac

SEQ ID NO: 114893 - DNA, 25 bp, E. coli
gaattttgtatttttgccgccagaa

SEQ ID NO: 114894 - DNA, 25 bp, E. coli
gaaggtagtcaatttcgccacagac

SEQ ID NO: 114895 - DNA, 25 bp, E. coli
cgggaattttccgaggagcaatcta

SEQ ID NO: 114896 - DNA, 25 bp, E. coli
cgggaattttcccaggagcaatcta

SEQ ID NO: 114897 - DNA, 25 bp, E. coli
gattctgtgcttcggtttcatgtcg

SEQ ID NO: 114898 - DNA, 25 bp, E. coli
gattctgtgcttgggtttcatgtcg

SEQ ID NO: 114899 - DNA, 25 bp, E. coli
ggattccatgtcgtttcttgcactg

SEQ ID NO: 114900 - DNA, 25 bp, E. coli
ggattccatgtcctttcttgcactg

SEQ ID NO: 114901 - DNA, 25 bp, E. coli
tcaataataaaatgctccacggaaa

SEQ ID NO: 114902 - DNA, 25 bp, E. coli
tcaataataaaaagctccacggaaa

SEQ ID NO: 114903 - DNA, 25 bp, E. coli
tcacccctgcggaaataatacggga

SEQ ID NO: 114904 - DNA, 25 bp, E. coli
tcaatactaattttcacccctgcgg

SEQ ID NO: 114905 - DNA, 25 bp, E. coli
tcacccctgcggtaataatacggga

SEQ ID NO: 114906 - DNA, 25 bp, E. coli
tcaatactaattatcacccctgcgg

SEQ ID NO: 114907 - DNA, 25 bp, E. coli
aatacctgacggtagctggagctga

SEQ ID NO: 114908 - DNA, 25 bp, E. coli
aatacctgacggaagctggagctga

SEQ ID NO: 114909 - DNA, 25 bp, E. coli
catttccggatgacgtgcctgcaga

SEQ ID NO: 114910 - DNA, 25 bp, E. coli
tactgctgacacaggatgatacccg

SEQ ID NO: 114911 - DNA, 25 bp, E. coli
tactgctgacactggatgatacccg

SEQ ID NO: 114912 - DNA, 25 bp, E. coli
tacgtatgcagcgtcagtcagcgga

SEQ ID NO: 114913 - DNA, 25 bp, E. coli
tacgtatgcagcctcagtcagcgga

SEQ ID NO: 114914 - DNA, 25 bp, E. coli
tatcgactacgaaagactgaactgg

SEQ ID NO: 114915 - DNA, 25 bp, E. coli
tatcgactacgatagactgaactgg

SEQ ID NO: 114916 - DNA, 25 bp, E. coli
tattattcccgggagcagggagcag

SEQ ID NO: 114917 - DNA, 25 bp, E. coli
tattattcccggcagcagggagcag

SEQ ID NO: 114918 - DNA, 25 bp, E. coli
cctatgtcagaagagggatgccggc

SEQ ID NO: 114919 - DNA, 25 bp, E. coli
cctatgtcagaacagggatgccggc

SEQ ID NO: 114920 - DNA, 25 bp, E. coli
gcatcgccggccttaagcagagtaa

SEQ ID NO: 114921 - DNA, 25 bp, E. coli
gcatcgccggccataagcagagtaa

SEQ ID NO: 114922 - DNA, 25 bp, E. coli
catttccggatgtcgtgcctgcaga

SEQ ID NO: 114923 - DNA, 25 bp, E. coli
gttgacagatgttcaggcagccctt

SEQ ID NO: 114924 - DNA, 25 bp, E. coli
gttgacagatgtacaggcagccctt

SEQ ID NO: 114925 - DNA, 25 bp, E. coli
ggatgccggcacttgtaaaactgac

SEQ ID NO: 114926 - DNA, 25 bp, E. coli
ggatgccggcacatgtaaaactgac

SEQ ID NO: 114927 - DNA, 25 bp, E. coli
taaggaaatagcaatgacccggcca

SEQ ID NO: 114928 - DNA, 25 bp, E. coli
taaggaaatagctatgacccggcca

SEQ ID NO: 114929 - DNA, 25 bp, E. coli
catgtctgaccttttctgcaatcag

SEQ ID NO: 114930 - DNA, 25 bp, E. coli
catgtctgacctattctgcaatcag

SEQ ID NO: 114931 - DNA, 25 bp, E. coli
aaaatgcagaattaaccagacattc

SEQ ID NO: 114932 - DNA, 25 bp, E. coli
aaaatgcagaataaaccagacattc

SEQ ID NO: 114933 - DNA, 25 bp, E. coli
tgaaaagaaacgttaaaatcctcca

SEQ ID NO: 114934 - DNA, 25 bp, E. coli
tgaaaagaaacgataaaatcctcca

SEQ ID NO: 114935 - DNA, 25 bp, E. coli
ccattacagaggtttaaattgataa

SEQ ID NO: 114936 - DNA, 25 bp, E. coli
ccattacagaggattaaattgataa

SEQ ID NO: 114937 - DNA, 25 bp, E. coli
gcagaataaacctgacattcatgtc

SEQ ID NO: 114938 - DNA, 25 bp, E. coli
gcagaataaaccagacattcatgtc

SEQ ID NO: 114939 - DNA, 25 bp, E. coli
gaaacgataaaaacctccattacag

SEQ ID NO: 114940 - DNA, 25 bp, E. coli
gacattcatgtcagacctattctgc

SEQ ID NO: 114941 - DNA, 25 bp, E. coli
gaaacgataaaatcctccattacag

SEQ ID NO: 114942 - DNA, 25 bp, E. coli
gacattcatgtctgacctattctgc

SEQ ID NO: 114943 - DNA, 25 bp, E. coli
cgataaaatcctgcattacagagga

SEQ ID NO: 114944 - DNA, 25 bp, E. coli
cgataaaatcctccattacagagga

SEQ ID NO: 114945 - DNA, 25 bp, E. coli
taataagaataatcaggaggaaagg

SEQ ID NO: 114946 - DNA, 25 bp, E. coli
taagaataaacacgaggaaaggtga

SEQ ID NO: 114947 - DNA, 25 bp, E. coli
taagaataaacaggaggaaaggtga

SEQ ID NO: 114948 - DNA, 25 bp, E. coli
taataagaataaacaggaggaaagg

SEQ ID NO: 114949 - DNA, 25 bp, E. coli
tcctccattacagaggattaaattg

SEQ ID NO: 114950 - DNA, 25 bp, E. coli
tcctccattacacaggattaaattg

SEQ ID NO: 114951 - DNA, 25 bp, E. coli
ttgaagtatttatcgatgagcttgg

SEQ ID NO: 114952 - DNA, 25 bp, E. coli
tatttaacgatgagcttggtaagcc

SEQ ID NO: 114953 - DNA, 25 bp, E. coli
tatttaacgatgtgcttggtaagcc

SEQ ID NO: 114954 - DNA, 25 bp, E. coli
ttgaagtatttaacgatgagcttgg

SEQ ID NO: 114955 - DNA, 25 bp, E. coli
tgagcttggtaacccacggctgcga

SEQ ID NO: 114956 - DNA, 25 bp, E. coli
tgagcttggtaagccacggctgcga

SEQ ID NO: 114957 - DNA, 25 bp, E. coli
gcgaaacgctttcccgtaaaagaag

SEQ ID NO: 114958 - DNA, 25 bp, E. coli
tctggcgaaacggtttgccgtaaaa

SEQ ID NO: 114959 - DNA, 25 bp, E. coli
gcgaaacgctttgccgtaaaagaag

SEQ ID NO: 114960 - DNA, 25 bp, E. coli
tctggcgaaacgctttgccgtaaaa

SEQ ID NO: 114961 - DNA, 25 bp, E. coli
cgctttgccgtaaaagaagccgcag

SEQ ID NO: 114962 - DNA, 25 bp, E. coli
cgctttgccgtataagaagccgcag

SEQ ID NO: 114963 - DNA, 25 bp, E. coli
ctttgccgtaaatgaagccgcagca

SEQ ID NO: 114964 - DNA, 25 bp, E. coli
cttggtaagccacggctgcgactgt

SEQ ID NO: 114965 - DNA, 25 bp, E. coli
cttggtaagccagggctgcgactgt

SEQ ID NO: 114966 - DNA, 25 bp, E. coli
ctttgccgtaaaagaagccgcagca

SEQ ID NO: 114967 - DNA, 25 bp, E. coli
ggtaagccacggctgcgactgtggg

SEQ ID NO: 114968 - DNA, 25 bp, E. coli
ggtaagccacgggtgcgactgtggg

SEQ ID NO: 114969 - DNA, 25 bp, E. coli
taacgatgagctaggtaagccacgg

SEQ ID NO: 114970 - DNA, 25 bp, E. coli
taacgatgagcttggtaagccacgg

SEQ ID NO: 114971 - DNA, 25 bp, E. coli
gatgagcttggttagccacggctgc

SEQ ID NO: 114972 - DNA, 25 bp, E. coli
gatgagcttggtaagccacggctgc

SEQ ID NO: 114973 - DNA, 25 bp, E. coli
caatttaatcctctgtaatggagga

SEQ ID NO: 114974 - DNA, 25 bp, E. coli
caatttaatcctgtgtaatggagga

SEQ ID NO: 114975 - DNA, 25 bp, E. coli
ctgtaatggaggtttttatcgtttc

SEQ ID NO: 114976 - DNA, 25 bp, E. coli
ctgtaatggaggattttatcgtttc

SEQ ID NO: 114977 - DNA, 25 bp, E. coli
tgattgcagaataggtcagacatga

SEQ ID NO: 114978 - DNA, 25 bp, E. coli
tgattgcagaattggtcagacatga

SEQ ID NO: 114979 - DNA, 25 bp, E. coli
tcctctgtaatgcaggattttatcg

SEQ ID NO: 114980 - DNA, 25 bp, E. coli
tcctctgtaatggaggattttatcg

SEQ ID NO: 114981 - DNA, 25 bp, E. coli
tcacctttcctcctgtttattctta

SEQ ID NO: 114982 - DNA, 25 bp, E. coli
gaataggtcagagatgaatgtctgg

SEQ ID NO: 114983 - DNA, 25 bp, E. coli
gaatgtctggttaattctgcatttt

SEQ ID NO: 114984 - DNA, 25 bp, E. coli
gaatgtctggtttattctgcatttt

SEQ ID NO: 114985 - DNA, 25 bp, E. coli
gaataggtcagacatgaatgtctgg

SEQ ID NO: 114986 - DNA, 25 bp, E. coli
gcagaataggtctgacatgaatgtc

SEQ ID NO: 114987 - DNA, 25 bp, E. coli
gcagaataggtcagacatgaatgtc

SEQ ID NO: 114988 - DNA, 25 bp, E. coli
gacatgaatgtctggtttattctgc

SEQ ID NO: 114989 - DNA, 25 bp, E. coli
gacatgaatgtcaggtttattctgc

SEQ ID NO: 114990 - DNA, 25 bp, E. coli
tcgtttcttttcacctttcctcctg

SEQ ID NO: 114991 - DNA, 25 bp, E. coli
tcgtttcttttctcctttcctcctg

SEQ ID NO: 114992 - DNA, 25 bp, E. coli
tggaggattttatcgtttcttttca

SEQ ID NO: 114993 - DNA, 25 bp, E. coli
tggaggattttaacgtttcttttca

SEQ ID NO: 114994 - DNA, 25 bp, E. coli
tcacctttcctcgtgtttattctta

SEQ ID NO: 114995 - DNA, 25 bp, E. coli
aatatgtaagatcgaaggctgttcc

SEQ ID NO: 114996 - DNA, 25 bp, E. coli
aatatgtaagatggaaggctgttcc

SEQ ID NO: 114997 - DNA, 25 bp, E. coli
cacttgatgttcctcgctactatgg

SEQ ID NO: 114998 - DNA, 25 bp, E. coli
cacttgatgttcgtcgctactatgg

SEQ ID NO: 114999 - DNA, 25 bp, E. coli
catcttattcctatcggctattggg

SEQ ID NO: 115000 - DNA, 25 bp, E. coli
catcttattcctttcggctattggg

SEQ ID NO: 115001 - DNA, 25 bp, E. coli
taccaggtgaccagtcctgtaggcc

SEQ ID NO: 115002 - DNA, 25 bp, E. coli
taaatcgccgatcgcgcggttccct

SEQ ID NO: 115003 - DNA, 25 bp, E. coli
taaatcgccgatggcgcggttccct

SEQ ID NO: 115004 - DNA, 25 bp, E. coli
taccaggtgacctgtcctgtaggcc

SEQ ID NO: 115005 - DNA, 25 bp, E. coli
tgccagggtggctcaatctccacca

SEQ ID NO: 115006 - DNA, 25 bp, E. coli
tgccagggtggcacaatctccacca

SEQ ID NO: 115007 - DNA, 25 bp, E. coli
tcaggcgttcgtggcggcatcatta

SEQ ID NO: 115008 - DNA, 25 bp, E. coli
tcaggcgttcgtcgcggcatcatta

SEQ ID NO: 115009 - DNA, 25 bp, E. coli
gctattgggtaaaatgaccgatacc

SEQ ID NO: 115010 - DNA, 25 bp, E. coli
gctactatggaaggctcaagccggt

SEQ ID NO: 115011 - DNA, 25 bp, E. coli
gctattgggtaatatgaccgatacc

SEQ ID NO: 115012 - DNA, 25 bp, E. coli
gctactatggaacgctcaagccggt

SEQ ID NO: 115013 - DNA, 25 bp, E. coli
gaaggctgttcccttcacttgatgt

SEQ ID NO: 115014 - DNA, 25 bp, E. coli
gaaggctgttccgttcacttgatgt

SEQ ID NO: 115015 - DNA, 25 bp, E. coli
ctcaagccggtgtacgtgccagggt

SEQ ID NO: 115016 - DNA, 25 bp, E. coli
ctcaagccggtgaacgtgccagggt

SEQ ID NO: 115017 - DNA, 25 bp, E. coli
atttagttcgggagatgagtgcgcc

SEQ ID NO: 115018 - DNA, 25 bp, E. coli
agtcccacgccggaacaagatttag

SEQ ID NO: 115019 - DNA, 25 bp, E. coli
atttagttcgggtgatgagtgcgcc

SEQ ID NO: 115020 - DNA, 25 bp, E. coli
agtcccacgccgcaacaagatttag

SEQ ID NO: 115021 - DNA, 25 bp, E. coli
tatcaaaggcatactggcaggtacg

SEQ ID NO: 115022 - DNA, 25 bp, E. coli
tatcaaaggcattctggcaggtacg

SEQ ID NO: 115023 - DNA, 25 bp, E. coli
tttatggcggtcctggctggcccta

SEQ ID NO: 115024 - DNA, 25 bp, E. coli
tttatggcggtcgtggctggcccta

SEQ ID NO: 115025 - DNA, 25 bp, E. coli
tacaaacgttggcatttaacccagc

SEQ ID NO: 115026 - DNA, 25 bp, E. coli
tacaaacgttgggatttaacccagc

SEQ ID NO: 115027 - DNA, 25 bp, E. coli
gccccgcgagagtacaaacagttgt

SEQ ID NO: 115028 - DNA, 25 bp, E. coli
gccccgcgagagaacaaacagttgt

SEQ ID NO: 115029 - DNA, 25 bp, E. coli
gcaggtacgtttgcgctaatgctga

SEQ ID NO: 115030 - DNA, 25 bp, E. coli
gcaggtacgtttccgctaatgctga

SEQ ID NO: 115031 - DNA, 25 bp, E. coli
tgtgaacggttttctggacccggtg

SEQ ID NO: 115032 - DNA, 25 bp, E. coli
cgccgcagctgttcgttggtcagga

SEQ ID NO: 115033 - DNA, 25 bp, E. coli
cgccgcagctgtacgttggtcagga

SEQ ID NO: 115034 - DNA, 25 bp, E. coli
tgtgaacggtttactggacccggtg

SEQ ID NO: 115035 - DNA, 25 bp, E. coli
gggagaaccttcacgcggtcgcatt

SEQ ID NO: 115036 - DNA, 25 bp, E. coli
gggagaaccttctcgcggtcgcatt

SEQ ID NO: 115037 - DNA, 25 bp, E. coli
taacccagcaggagattatgccgcc

SEQ ID NO: 115038 - DNA, 25 bp, E. coli
taacccagcaggtgattatgccgcc

SEQ ID NO: 115039 - DNA, 25 bp, E. coli
agcaatatgacgttccgcgggcaga

SEQ ID NO: 115040 - DNA, 25 bp, E. coli
agactcgagggaagtcactggcgca

SEQ ID NO: 115041 - DNA, 25 bp, E. coli
agcaatatgacgatccgcgggcaga

SEQ ID NO: 115042 - DNA, 25 bp, E. coli
agtcggacggcggaaaatgttcctc

SEQ ID NO: 115043 - DNA, 25 bp, E. coli
agactcgagggatgtcactggcgca

SEQ ID NO: 115044 - DNA, 25 bp, E. coli
agtcggacggcgcaaaatgttcctc

SEQ ID NO: 115045 - DNA, 25 bp, E. coli
aaactggacgctgactggattggct

SEQ ID NO: 115046 - DNA, 25 bp, E. coli
aaactggacgctcactggattggct

SEQ ID NO: 115047 - DNA, 25 bp, E. coli
tatgcctttttcactggcgggccgg

SEQ ID NO: 115048 - DNA, 25 bp, E. coli
tatgcctttttctctggcgggccgg

SEQ ID NO: 115049 - DNA, 25 bp, E. coli
tattcaccgccgcattttgctgtgg

SEQ ID NO: 115050 - DNA, 25 bp, E. coli
tattcaccgccggattttgctgtgg

SEQ ID NO: 115051 - DNA, 25 bp, E. coli
tctgccgtgggcctgattatgtcct

SEQ ID NO: 115052 - DNA, 25 bp, E. coli
tctgccgtgggcgtgattatgtcct

SEQ ID NO: 115053 - DNA, 25 bp, E. coli
tcattgatatcatcgccatcggcgt

SEQ ID NO: 115054 - DNA, 25 bp, E. coli
tcattgatatcaacgccatcggcgt

SEQ ID NO: 115055 - DNA, 25 bp, E. coli
gccaggtgatccgaatgttcgccat

SEQ ID NO: 115056 - DNA, 25 bp, E. coli
ccatcggcgtgatatcggtggcgac

SEQ ID NO: 115057 - DNA, 25 bp, E. coli
ccatcggcgtgaaatcggtggcgac

SEQ ID NO: 115058 - DNA, 25 bp, E. coli
gccaggtgatcccaatgttcgccat

SEQ ID NO: 115059 - DNA, 25 bp, E. coli
gttgatttccgttgcgtttgccccg

SEQ ID NO: 115060 - DNA, 25 bp, E. coli
gttgatttccgtagcgtttgccccg

SEQ ID NO: 115061 - DNA, 25 bp, E. coli
caaaagcggagattcagctatcctt

SEQ ID NO: 115062 - DNA, 25 bp, E. coli
caaaagcggagaatcagctatcctt

SEQ ID NO: 115063 - DNA, 25 bp, E. coli
catacttgcaaatgcggagaatcag

SEQ ID NO: 115064 - DNA, 25 bp, E. coli
caggtatcgaactgatttttcgcct

SEQ ID NO: 115065 - DNA, 25 bp, E. coli
catacttgcaaaagcggagaatcag

SEQ ID NO: 115066 - DNA, 25 bp, E. coli
caggtatcgaacagatttttcgcct

SEQ ID NO: 115067 - DNA, 25 bp, E. coli
agcggagaatcacctatccttttcc

SEQ ID NO: 115068 - DNA, 25 bp, E. coli
agcggagaatcagctatccttttcc

SEQ ID NO: 115069 - DNA, 25 bp, E. coli
tgcaaaagcggagaatcagctatcc

SEQ ID NO: 115070 - DNA, 25 bp, E. coli
tgcaaaagcggacaatcagctatcc

SEQ ID NO: 115071 - DNA, 25 bp, E. coli
gcctttcatactagcaaaagcggag

SEQ ID NO: 115072 - DNA, 25 bp, E. coli
gcctttcatacttgcaaaagcggag

SEQ ID NO: 115073 - DNA, 25 bp, E. coli
gaactgatttttcgcctttcatact

SEQ ID NO: 115074 - DNA, 25 bp, E. coli
gaactgatttttggcctttcatact

SEQ ID NO: 115075 - DNA, 25 bp, E. coli
cttgcaaaagcggagaatcagctat

SEQ ID NO: 115076 - DNA, 25 bp, E. coli
ctttcatacttgcaaaagcggagaa

SEQ ID NO: 115077 - DNA, 25 bp, E. coli
cttgcaaaagcgcagaatcagctat

SEQ ID NO: 115078 - DNA, 25 bp, E. coli
ctttcatacttggaaaagcggagaa

SEQ ID NO: 115079 - DNA, 25 bp, E. coli
gatttttcgcctttcatacttgcaa

SEQ ID NO: 115080 - DNA, 25 bp, E. coli
gatttttcgcctatcatacttgcaa

SEQ ID NO: 115081 - DNA, 25 bp, E. coli
gagaatcagctatccttttccctga

SEQ ID NO: 115082 - DNA, 25 bp, E. coli
gagaatcagctaaccttttccctga

SEQ ID NO: 115083 - DNA, 25 bp, E. coli
aattgatcatcagattagcttatgg

SEQ ID NO: 115084 - DNA, 25 bp, E. coli
aattgatcatcacattagcttatgg

SEQ ID NO: 115085 - DNA, 25 bp, E. coli
caccagtttctaaacaaagatgatg

SEQ ID NO: 115086 - DNA, 25 bp, E. coli
caaagatgatgtgatgagaaagtca

SEQ ID NO: 115087 - DNA, 25 bp, E. coli
caaagatgatgtcatgagaaagtca

SEQ ID NO: 115088 - DNA, 25 bp, E. coli
caccagtttctatacaaagatgatg

SEQ ID NO: 115089 - DNA, 25 bp, E. coli
tatggttaaaaaatgcaaaaatcgc

SEQ ID NO: 115090 - DNA, 25 bp, E. coli
tagaaaatataatgcgaaaacggag

SEQ ID NO: 115091 - DNA, 25 bp, E. coli
tagaaaatataaagcgaaaacggag

SEQ ID NO: 115092 - DNA, 25 bp, E. coli
tatggttaaaaattgcaaaaatcgc

SEQ ID NO: 115093 - DNA, 25 bp, E. coli
ttcaaatgaggataatctcccggcg

SEQ ID NO: 115094 - DNA, 25 bp, E. coli
ttcaaatgaggaaaatctcccggcg

SEQ ID NO: 115095 - DNA, 25 bp, E. coli
tgcgaaaacggaggtgaaattagtt

SEQ ID NO: 115096 - DNA, 25 bp, E. coli
tgcgaaaacggacgtgaaattagtt

SEQ ID NO: 115097 - DNA, 25 bp, E. coli
gcaaaaatcgcgtcagaataaaaaa

SEQ ID NO: 115098 - DNA, 25 bp, E. coli
gcaaaaatcgcgacagaataaaaaa

SEQ ID NO: 115099 - DNA, 25 bp, E. coli
gaaaaaaccgggagatgaaagtgtg

SEQ ID NO: 115100 - DNA, 25 bp, E. coli
gaaaaaaccgggtgatgaaagtgtg

SEQ ID NO: 115101 - DNA, 25 bp, E. coli
gggtatcaaataaacaacagaggag

SEQ ID NO: 115102 - DNA, 25 bp, E. coli
gggtatcaaatatacaacagaggag

SEQ ID NO: 115103 - DNA, 25 bp, E. coli
gagatgaaagtgagatgggtatcaa

SEQ ID NO: 115104 - DNA, 25 bp, E. coli
gagatgaaagtgtgatgggtatcaa

SEQ ID NO: 115105 - DNA, 25 bp, E. coli
caacctttagatgccagtgaactgg

SEQ ID NO: 115106 - DNA, 25 bp, E. coli
caacctttagatcccagtgaactgg

SEQ ID NO: 115107 - DNA, 25 bp, E. coli
caccgatgatggtcacgttgcaaaa

SEQ ID NO: 115108 - DNA, 25 bp, E. coli
caccgatgatggacacgttgcaaaa

SEQ ID NO: 115109 - DNA, 25 bp, E. coli
tgagcataatctggcgcaacgtctg

SEQ ID NO: 115110 - DNA, 25 bp, E. coli
tgcaaaatatgggaacgcgtcccgc

SEQ ID NO: 115111 - DNA, 25 bp, E. coli
tgcaaaatatggcaacgcgtcccgc

SEQ ID NO: 115112 - DNA, 25 bp, E. coli
tgagcataatctcgcgcaacgtctg

SEQ ID NO: 115113 - DNA, 25 bp, E. coli
tcataactttggacagacgccgctg

SEQ ID NO: 115114 - DNA, 25 bp, E. coli
tcataactttggtcagacgccgctg

SEQ ID NO: 115115 - DNA, 25 bp, E. coli
gcttaatgacgaaagtgacctcact

SEQ ID NO: 115116 - DNA, 25 bp, E. coli
gcttaatgacgatagtgacctcact

SEQ ID NO: 115117 - DNA, 25 bp, E. coli
gcaatcgatgctcgaactttccggg

SEQ ID NO: 115118 - DNA, 25 bp, E. coli
gcaatcgatgctggaactttccggg

SEQ ID NO: 115119 - DNA, 25 bp, E. coli
gaaagatggcgagttaattccagcg

SEQ ID NO: 115120 - DNA, 25 bp, E. coli
gaaagatggcgacttaattccagcg

SEQ ID NO: 115121 - DNA, 25 bp, E. coli
cccgcgctgtggttactgttagtcg

SEQ ID NO: 115122 - DNA, 25 bp, E. coli
cccgcgctgtggatactgttagtcg

SEQ ID NO: 115123 - DNA, 25 bp, E. coli
gattatcctgatgctggtctggctg

SEQ ID NO: 115124 - DNA, 25 bp, E. coli
gattatcctgatcctggtctggctg

SEQ ID NO: 115125 - DNA, 25 bp, E. coli
gggcaatcagcctttatccagtcag

SEQ ID NO: 115126 - DNA, 25 bp, E. coli
gggcaatcagccattatccagtcag

SEQ ID NO: 115127 - DNA, 25 bp, E. coli
actttgcccgtgaagccctgattga

SEQ ID NO: 115128 - DNA, 25 bp, E. coli
actttgcccgtgtagccctgattga

SEQ ID NO: 115129 - DNA, 25 bp, E. coli
tatgggccgctgcatcagatgcagc

SEQ ID NO: 115130 - DNA, 25 bp, E. coli
tatgggccgctggatcagatgcagc

SEQ ID NO: 115131 - DNA, 25 bp, E. coli
tatatcggcatcgactcaaccggcg

SEQ ID NO: 115132 - DNA, 25 bp, E. coli
tatatcggcatccactcaaccggcg

SEQ ID NO: 115133 - DNA, 25 bp, E. coli
tgtactttcaggcataccgcgtcgc

SEQ ID NO: 115134 - DNA, 25 bp, E. coli
tgtactttcagggataccgcgtcgc

SEQ ID NO: 115135 - DNA, 25 bp, E. coli
tctggaccgactttcatgcactggc

SEQ ID NO: 115136 - DNA, 25 bp, E. coli
tctggaccgactatcatgcactggc

SEQ ID NO: 115137 - DNA, 25 bp, E. coli
gccgtcagccggtaaagaatgtctt

SEQ ID NO: 115138 - DNA, 25 bp, E. coli
gccgtcagccggaaaagaatgtctt

SEQ ID NO: 115139 - DNA, 25 bp, E. coli
gaaagcgttctttcctgccgtccgg

SEQ ID NO: 115140 - DNA, 25 bp, E. coli
gaaagcgttcttacctgccgtccgg

SEQ ID NO: 115141 - DNA, 25 bp, E. coli
tcaaagagattgtcctgctggcgcg

SEQ ID NO: 115142 - DNA, 25 bp, E. coli
taacgaaccgctccagggtgaatcc

SEQ ID NO: 115143 - DNA, 25 bp, E. coli
tcaaagagattgacctgctggcgcg

SEQ ID NO: 115144 - DNA, 25 bp, E. coli
tcacagctggaataaacgcgacaag

SEQ ID NO: 115145 - DNA, 25 bp, E. coli
tcacagctggaaaaaacgcgacaag

SEQ ID NO: 115146 - DNA, 25 bp, E. coli
taacgaaccgctgcagggtgaatcc

SEQ ID NO: 115147 - DNA, 25 bp, E. coli
gatgcacgcactgtttaacgaaccg

SEQ ID NO: 115148 - DNA, 25 bp, E. coli
gatgcacgcactctttaacgaaccg

SEQ ID NO: 115149 - DNA, 25 bp, E. coli
catctgctgctctacgatcctgaaa

SEQ ID NO: 115150 - DNA, 25 bp, E. coli
catctgctgctcaacgatcctgaaa

SEQ ID NO: 115151 - DNA, 25 bp, E. coli
atgattgcgattcccgacatcttgc

SEQ ID NO: 115152 - DNA, 25 bp, E. coli
atgattgcgattgccgacatcttgc

SEQ ID NO: 115153 - DNA, 25 bp, E. coli
tttgagcgggaacaggaaattaacg

SEQ ID NO: 115154 - DNA, 25 bp, E. coli
tttgagcgggaagaggaaattaacg

SEQ ID NO: 115155 - DNA, 25 bp, E. coli
ttcgtacccttaaggatcaatatgg

SEQ ID NO: 115156 - DNA, 25 bp, E. coli
ttcgtacccttatggatcaatatgg

SEQ ID NO: 115157 - DNA, 25 bp, E. coli
tctggtgtgtgcgaaaataaccgcg

SEQ ID NO: 115158 - DNA, 25 bp, E. coli
tctggtgtgtgccaaaataaccgcg

SEQ ID NO: 115159 - DNA, 25 bp, E. coli
cgctggaactggaagatcatctgct

SEQ ID NO: 115160 - DNA, 25 bp, E. coli
cgctggaactggtagatcatctgct

SEQ ID NO: 115161 - DNA, 25 bp, E. coli
tggcgggtattcagaacgaggaaca

SEQ ID NO: 115162 - DNA, 25 bp, E. coli
tggcaacgcgatacggcatttctcc

SEQ ID NO: 115163 - DNA, 25 bp, E. coli
tggcgggtattctgaacgaggaaca

SEQ ID NO: 115164 - DNA, 25 bp, E. coli
tggcaacgcgattcggcatttctcc

SEQ ID NO: 115165 - DNA, 25 bp, E. coli
taaccgcgtgggtagaatcagcgcc

SEQ ID NO: 115166 - DNA, 25 bp, E. coli
taaccgcgtgggaagaatcagcgcc

SEQ ID NO: 115167 - DNA, 25 bp, E. coli
gagaaaagctaagtgctgtggcacc

SEQ ID NO: 115168 - DNA, 25 bp, E. coli
ggaaattaacgctggaacacgctaa

SEQ ID NO: 115169 - DNA, 25 bp, E. coli
ggaaattaacgcaggaacacgctaa

SEQ ID NO: 115170 - DNA, 25 bp, E. coli
gagaaaagctaactgctgtggcacc

SEQ ID NO: 115171 - DNA, 25 bp, E. coli
tacaggcaattcctgatgtgactcc

SEQ ID NO: 115172 - DNA, 25 bp, E. coli
tacaggcaattcgtgatgtgactcc

SEQ ID NO: 115173 - DNA, 25 bp, E. coli
taaagcaggacataccgacgaccat

SEQ ID NO: 115174 - DNA, 25 bp, E. coli
taaagcaggacaaaccgacgaccat

SEQ ID NO: 115175 - DNA, 25 bp, E. coli
tttatgaacagtggcttacccgtcg

SEQ ID NO: 115176 - DNA, 25 bp, E. coli
tttatgaacagtcgcttacccgtcg

SEQ ID NO: 115177 - DNA, 25 bp, E. coli
tgtatggctacgtcgcatctatgcc

SEQ ID NO: 115178 - DNA, 25 bp, E. coli
tgtatggctacgacgcatctatgcc

SEQ ID NO: 115179 - DNA, 25 bp, E. coli
ccactacgttttatgtcggagacaa

SEQ ID NO: 115180 - DNA, 25 bp, E. coli
ccattttggaacgatgaggcgaaga

SEQ ID NO: 115181 - DNA, 25 bp, E. coli
ccattttggaaccatgaggcgaaga

SEQ ID NO: 115182 - DNA, 25 bp, E. coli
ccactacgttttttgtcggagacaa

SEQ ID NO: 115183 - DNA, 25 bp, E. coli
gaatcctgaccatctgccgatgatg

SEQ ID NO: 115184 - DNA, 25 bp, E. coli
gaatcctgaccaactgccgatgatg

SEQ ID NO: 115185 - DNA, 25 bp, E. coli
gaaaaagtagctcacagcccggatc

SEQ ID NO: 115186 - DNA, 25 bp, E. coli
gaaaaagtagctgacagcccggatc

SEQ ID NO: 115187 - DNA, 25 bp, E. coli
cgagcccagcgcgaagcaattatta

SEQ ID NO: 115188 - DNA, 25 bp, E. coli
cgagcccagcgccaagcaattatta

SEQ ID NO: 115189 - DNA, 25 bp, E. coli
taatcatgctgaatttgcgcgagcc

SEQ ID NO: 115190 - DNA, 25 bp, E. coli
taatcatgctgattttgcgcgagcc

SEQ ID NO: 115191 - DNA, 25 bp, E. coli
gatgtgactccattacccgtaacag

SEQ ID NO: 115192 - DNA, 25 bp, E. coli
gatgtgactccaatacccgtaacag

SEQ ID NO: 115193 - DNA, 25 bp, E. coli
atgcacctggtctcccgcgtggtcg

SEQ ID NO: 115194 - DNA, 25 bp, E. coli
acagggaccttgaaagccgtattga

SEQ ID NO: 115195 - DNA, 25 bp, E. coli
atgcacctggtcacccgcgtggtcg

SEQ ID NO: 115196 - DNA, 25 bp, E. coli
acagggaccttgtaagccgtattga

SEQ ID NO: 115197 - DNA, 25 bp, E. coli
tgctcgcctgaaggatcttcgccag

SEQ ID NO: 115198 - DNA, 25 bp, E. coli
tgctcgcctgaacgatcttcgccag

SEQ ID NO: 115199 - DNA, 25 bp, E. coli
tcgctcgacagggaccttgaaagcc

SEQ ID NO: 115200 - DNA, 25 bp, E. coli
tcgcctgaacgaacttcgccagcaa

SEQ ID NO: 115201 - DNA, 25 bp, E. coli
tcgctcgacaggcaccttgaaagcc

SEQ ID NO: 115202 - DNA, 25 bp, E. coli
tcgcctgaacgatcttcgccagcaa

SEQ ID NO: 115203 - DNA, 25 bp, E. coli
gctcgacagggaccttgaaagccgt

SEQ ID NO: 115204 - DNA, 25 bp, E. coli
gctcgacagggagcttgaaagccgt

SEQ ID NO: 115205 - DNA, 25 bp, E. coli
cgatggctcgctcgacagggacctt

SEQ ID NO: 115206 - DNA, 25 bp, E. coli
cgatggctcgctggacagggacctt

SEQ ID NO: 115207 - DNA, 25 bp, E. coli
ctgaacgatcttcgccagcaactga

SEQ ID NO: 115208 - DNA, 25 bp, E. coli
cgacagggaccttgaaagccgtatt

SEQ ID NO: 115209 - DNA, 25 bp, E. coli
ctgaacgatcttggccagcaactga

SEQ ID NO: 115210 - DNA, 25 bp, E. coli
cgacagggacctagaaagccgtatt

SEQ ID NO: 115211 - DNA, 25 bp, E. coli
tggtctcccgcgaggtcggtgagct

SEQ ID NO: 115212 - DNA, 25 bp, E. coli
ggctcgctcgactgggaccttgaaa

SEQ ID NO: 115213 - DNA, 25 bp, E. coli
tggtctcccgcgtggtcggtgagct

SEQ ID NO: 115214 - DNA, 25 bp, E. coli
ggctcgctcgacagggaccttgaaa

SEQ ID NO: 115215 - DNA, 25 bp, E. coli
cagttcggcaagcagatgggcttct

SEQ ID NO: 115216 - DNA, 25 bp, E. coli
cagttcggcaaggagatgggcttct

SEQ ID NO: 115217 - DNA, 25 bp, E. coli
tatttgcaggcaaaatctgagccgc

SEQ ID NO: 115218 - DNA, 25 bp, E. coli
tatattcgtcaacgcatcgccgatg

SEQ ID NO: 115219 - DNA, 25 bp, E. coli
tatttgcaggcataatctgagccgc

SEQ ID NO: 115220 - DNA, 25 bp, E. coli
tatattcgtcaaggcatcgccgatg

SEQ ID NO: 115221 - DNA, 25 bp, E. coli
tgcacaagcagggaatgagtagccg

SEQ ID NO: 115222 - DNA, 25 bp, E. coli
tgcacaagcaggcaatgagtagccg

SEQ ID NO: 115223 - DNA, 25 bp, E. coli
gcaacgtgacgcatatcagaccggt

SEQ ID NO: 115224 - DNA, 25 bp, E. coli
gcaacgtgacgcttatcagaccggt

SEQ ID NO: 115225 - DNA, 25 bp, E. coli
gaaagcatgaaacaatccaggcccg

SEQ ID NO: 115226 - DNA, 25 bp, E. coli
gaaagcatgaaagaatccaggcccg

SEQ ID NO: 115227 - DNA, 25 bp, E. coli
gacgtgcatcctagtgaaaatctgg

SEQ ID NO: 115228 - DNA, 25 bp, E. coli
cccggacgacagatgcaggttgact

SEQ ID NO: 115229 - DNA, 25 bp, E. coli
cccggacgacagttgcaggttgact

SEQ ID NO: 115230 - DNA, 25 bp, E. coli
gttatgacacgcaggaaacctgcca

SEQ ID NO: 115231 - DNA, 25 bp, E. coli
gttatgacacgctggaaacctgcca

SEQ ID NO: 115232 - DNA, 25 bp, E. coli
taatcgctcgcgtgatcagagacca

SEQ ID NO: 115233 - DNA, 25 bp, E. coli
taatcgctcgcgagatcagagacca

SEQ ID NO: 115234 - DNA, 25 bp, E. coli
gacgtgcatccttgtgaaaatctgg

SEQ ID NO: 115235 - DNA, 25 bp, E. coli
gacctgctgttgcttcactcctgga

SEQ ID NO: 115236 - DNA, 25 bp, E. coli
gacctgctgttggttcactcctgga

SEQ ID NO: 115237 - DNA, 25 bp, E. coli
caatgtggcgttcatggaagaccgc

SEQ ID NO: 115238 - DNA, 25 bp, E. coli
caatgtggcgttgatggaagaccgc

SEQ ID NO: 115239 - DNA, 25 bp, E. coli
tttaccgggaactgggctggacgct

SEQ ID NO: 115240 - DNA, 25 bp, E. coli
tttaccgggaacagggctggacgct

SEQ ID NO: 115241 - DNA, 25 bp, E. coli
acctggtgccgcaaccggagcgcgt

SEQ ID NO: 115242 - DNA, 25 bp, E. coli
acctggtgccgctaccggagcgcgt

SEQ ID NO: 115243 - DNA, 25 bp, E. coli
tgatctggcacctgaaaatcgtcag

SEQ ID NO: 115244 - DNA, 25 bp, E. coli
tgggttccgtcagcaaccgctgcta

SEQ ID NO: 115245 - DNA, 25 bp, E. coli
tgatctggcaccagaaaatcgtcag

SEQ ID NO: 115246 - DNA, 25 bp, E. coli
tgggctgcgcggaaaagcgcaaatt

SEQ ID NO: 115247 - DNA, 25 bp, E. coli
tgggctgcgcggtaaagcgcaaatt

SEQ ID NO: 115248 - DNA, 25 bp, E. coli
tctggcgcaattttgatgagatcgt

SEQ ID NO: 115249 - DNA, 25 bp, E. coli
tctggcgcaattatgatgagatcgt

SEQ ID NO: 115250 - DNA, 25 bp, E. coli
gcggtaaagcgctaattggtaaagg

SEQ ID NO: 115251 - DNA, 25 bp, E. coli
gcggtaaagcgcaaattggtaaagg

SEQ ID NO: 115252 - DNA, 25 bp, E. coli
gatcgttcatgaactggcaccagaa

SEQ ID NO: 115253 - DNA, 25 bp, E. coli
gtgccggatattgacaatgtggcgt

SEQ ID NO: 115254 - DNA, 25 bp, E. coli
gtgccggatattcacaatgtggcgt

SEQ ID NO: 115255 - DNA, 25 bp, E. coli
tgggttccgtcaccaaccgctgcta

SEQ ID NO: 115256 - DNA, 25 bp, E. coli
gatcgttcatgatctggcaccagaa

SEQ ID NO: 115257 - DNA, 25 bp, E. coli
gacgctgcggcgttctggcgcaatt

SEQ ID NO: 115258 - DNA, 25 bp, E. coli
gacgctgcggcgatctggcgcaatt

SEQ ID NO: 115259 - DNA, 25 bp, E. coli
taactttctggttggtgccaacggc

SEQ ID NO: 115260 - DNA, 25 bp, E. coli
tacagaagagcaatcctcgactggg

SEQ ID NO: 115261 - DNA, 25 bp, E. coli
tacagaagagcattcctcgactggg

SEQ ID NO: 115262 - DNA, 25 bp, E. coli
tacgtctggcgcaaggagagttcct

SEQ ID NO: 115263 - DNA, 25 bp, E. coli
tacgtctggcgctaggagagttcct

SEQ ID NO: 115264 - DNA, 25 bp, E. coli
ttctccacgggcgattacagggcga

SEQ ID NO: 115265 - DNA, 25 bp, E. coli
ttctccacgggccattacagggcga

SEQ ID NO: 115266 - DNA, 25 bp, E. coli
ttacgaacagctacgcccgtgggat

SEQ ID NO: 115267 - DNA, 25 bp, E. coli
ttacgaacagcttcgcccgtgggat

SEQ ID NO: 115268 - DNA, 25 bp, E. coli
tgctggaagccaactatacgctcgg

SEQ ID NO: 115269 - DNA, 25 bp, E. coli
tgctggaagccatctatacgctcgg

SEQ ID NO: 115270 - DNA, 25 bp, E. coli
gaagataccttatcgcgtgggcagc

SEQ ID NO: 115271 - DNA, 25 bp, E. coli
gaagataccttaacgcgtgggcagc

SEQ ID NO: 115272 - DNA, 25 bp, E. coli
gcaacattgaaaccgcggatctcgc

SEQ ID NO: 115273 - DNA, 25 bp, E. coli
gcaacattgaaagcgcggatctcgc

SEQ ID NO: 115274 - DNA, 25 bp, E. coli
gactttctctttgcagcgcggctgg

SEQ ID NO: 115275 - DNA, 25 bp, E. coli
gactttctctttccagcgcggctgg

SEQ ID NO: 115276 - DNA, 25 bp, E. coli
cgtaattttgaaggcgatcgccagc

SEQ ID NO: 115277 - DNA, 25 bp, E. coli
cgtaattttgaacgcgatcgccagc

SEQ ID NO: 115278 - DNA, 25 bp, E. coli
taactttctggtaggtgccaacggc

SEQ ID NO: 115279 - DNA, 25 bp, E. coli
gatgctttcacatcgaacccggatt

SEQ ID NO: 115280 - DNA, 25 bp, E. coli
gatgctttcacaacgaacccggatt

SEQ ID NO: 115281 - DNA, 25 bp, E. coli
caactgggccagacgtcatgggtta

SEQ ID NO: 115282 - DNA, 25 bp, E. coli
caactgggccagtcgtcatgggtta

SEQ ID NO: 115283 - DNA, 25 bp, E. coli
tactgtgaccaatcagccaaatggc

SEQ ID NO: 115284 - DNA, 25 bp, E. coli
tactgtgaccaaacagccaaatggc

SEQ ID NO: 115285 - DNA, 25 bp, E. coli
tgaagcgcggaaaaccagaacctga

SEQ ID NO: 115286 - DNA, 25 bp, E. coli
tgaataaagcagctattccgtgggc

SEQ ID NO: 115287 - DNA, 25 bp, E. coli
tgaataaagcaggtattccgtgggc

SEQ ID NO: 115288 - DNA, 25 bp, E. coli
tgaagcgcggaataccagaacctga

SEQ ID NO: 115289 - DNA, 25 bp, E. coli
tcgaggccacggtaaccgaaggtat

SEQ ID NO: 115290 - DNA, 25 bp, E. coli
tcgaggccacggaaaccgaaggtat

SEQ ID NO: 115291 - DNA, 25 bp, E. coli
tcattcacggtatacaggcgatcac

SEQ ID NO: 115292 - DNA, 25 bp, E. coli
tcattcacggtaaacaggcgatcac

SEQ ID NO: 115293 - DNA, 25 bp, E. coli
ccagaggtgtttctaaccgctgagc

SEQ ID NO: 115294 - DNA, 25 bp, E. coli
ccagaggtgtttgtaaccgctgagc

SEQ ID NO: 115295 - DNA, 25 bp, E. coli
gcgtatctgttaggcgcgcagctgc

SEQ ID NO: 115296 - DNA, 25 bp, E. coli
gcgtatctgttacgcgcgcagctgc

SEQ ID NO: 115297 - DNA, 25 bp, E. coli
gacttctggctccatgccggtagcg

SEQ ID NO: 115298 - DNA, 25 bp, E. coli
gacttctggctcgatgccggtagcg

SEQ ID NO: 115299 - DNA, 25 bp, E. coli
cggaagaggtgctggctttcattca

SEQ ID NO: 115300 - DNA, 25 bp, E. coli
cggaagaggtgcaggctttcattca

SEQ ID NO: 115301 - DNA, 25 bp, E. coli
tggaacgctggtggattccctgcct

SEQ ID NO: 115302 - DNA, 25 bp, E. coli
tggaacgctggtcgattccctgcct

SEQ ID NO: 115303 - DNA, 25 bp, E. coli
catcggcgtgatagtctttgtcgga

SEQ ID NO: 115304 - DNA, 25 bp, E. coli
catcggcgtgattgtctttgtcgga

SEQ ID NO: 115305 - DNA, 25 bp, E. coli
ctttgtcggattgacggcgtatgac

SEQ ID NO: 115306 - DNA, 25 bp, E. coli
catttgttgcctggtatgcggctaa

SEQ ID NO: 115307 - DNA, 25 bp, E. coli
catttgttgcctcgtatgcggctaa

SEQ ID NO: 115308 - DNA, 25 bp, E. coli
ctttgtcggattcacggcgtatgac

SEQ ID NO: 115309 - DNA, 25 bp, E. coli
ttttaatcggtcagatcatcgcgca

SEQ ID NO: 115310 - DNA, 25 bp, E. coli
ttatgctttattgggcgctgacggg

SEQ ID NO: 115311 - DNA, 25 bp, E. coli
ttttaatcggtctgatcatcgcgca

SEQ ID NO: 115312 - DNA, 25 bp, E. coli
ttatgctttattcggcgctgacggg

SEQ ID NO: 115313 - DNA, 25 bp, E. coli
tgtacggttacagcacgaagcgcga

SEQ ID NO: 115314 - DNA, 25 bp, E. coli
tgatggagctgttgttcactaaccg

SEQ ID NO: 115315 - DNA, 25 bp, E. coli
tgatggagctgtagttcactaaccg

SEQ ID NO: 115316 - DNA, 25 bp, E. coli
tgtacggttacaccacgaagcgcga

SEQ ID NO: 115317 - DNA, 25 bp, E. coli
tctatggctggaagaccgttggctt

SEQ ID NO: 115318 - DNA, 25 bp, E. coli
tctatggctggatgaccgttggctt

SEQ ID NO: 115319 - DNA, 25 bp, E. coli
cgatgattcaaatgctgagcgcagg

SEQ ID NO: 115320 - DNA, 25 bp, E. coli
cgctgacgggtcatacgctttccag

SEQ ID NO: 115321 - DNA, 25 bp, E. coli
cgatgattcaaaagctgagcgcagg

SEQ ID NO: 115322 - DNA, 25 bp, E. coli
cgctgacgggtcttacgctttccag

SEQ ID NO: 115323 - DNA, 25 bp, E. coli
ggcgcaatgagcgtgtacggttaca

SEQ ID NO: 115324 - DNA, 25 bp, E. coli
ggcgcaatgagcctgtacggttaca

SEQ ID NO: 115325 - DNA, 25 bp, E. coli
aattcagaccattgcacccatcgga

SEQ ID NO: 115326 - DNA, 25 bp, E. coli
aattcagaccatagcacccatcgga

SEQ ID NO: 115327 - DNA, 25 bp, E. coli
catttctgcctgtaattagcccgta

SEQ ID NO: 115328 - DNA, 25 bp, E. coli
catttctgcctgaaattagcccgta

SEQ ID NO: 115329 - DNA, 25 bp, E. coli
taacgtcaacaactgtggcacacat

SEQ ID NO: 115330 - DNA, 25 bp, E. coli
aaatagtaacgtgaacaagtgtggc

SEQ ID NO: 115331 - DNA, 25 bp, E. coli
aaatagtaacgtcaacaagtgtggc

SEQ ID NO: 115332 - DNA, 25 bp, E. coli
ttatcaatgcacgagcgggctaact

SEQ ID NO: 115333 - DNA, 25 bp, E. coli
ttagcccgtaatacagaccattgca

SEQ ID NO: 115334 - DNA, 25 bp, E. coli
ttagcccgtaattcagaccattgca

SEQ ID NO: 115335 - DNA, 25 bp, E. coli
ttatcaatgcaccagcgggctaact

SEQ ID NO: 115336 - DNA, 25 bp, E. coli
tcctcgccggaacagtggttaacaa

SEQ ID NO: 115337 - DNA, 25 bp, E. coli
tcctcgccggaagagtggttaacaa

SEQ ID NO: 115338 - DNA, 25 bp, E. coli
tccttattatcattgcaccagcggg

SEQ ID NO: 115339 - DNA, 25 bp, E. coli
tccttattatcaatgcaccagcggg

SEQ ID NO: 115340 - DNA, 25 bp, E. coli
gccggaagagtgcttaacaaaatag

SEQ ID NO: 115341 - DNA, 25 bp, E. coli
gccggaagagtggttaacaaaatag

SEQ ID NO: 115342 - DNA, 25 bp, E. coli
gcgggctaactttcctcgccggaag

SEQ ID NO: 115343 - DNA, 25 bp, E. coli
gcgggctaacttacctcgccggaag

SEQ ID NO: 115344 - DNA, 25 bp, E. coli
gtgtggcacacatcacgcatttctg

SEQ ID NO: 115345 - DNA, 25 bp, E. coli
gtgtggcacacaacacgcatttctg

SEQ ID NO: 115346 - DNA, 25 bp, E. coli
taacgtcaacaagtgtggcacacat

SEQ ID NO: 115347 - DNA, 25 bp, E. coli
cagccgtaccgatattactattctg

SEQ ID NO: 115348 - DNA, 25 bp, E. coli
cagccgtaccgaaattactattctg

SEQ ID NO: 115349 - DNA, 25 bp, E. coli
caaagccagcgtcatttgattgccg

SEQ ID NO: 115350 - DNA, 25 bp, E. coli
caaagccagcgtgatttgattgccg

SEQ ID NO: 115351 - DNA, 25 bp, E. coli
catacagccatcacggtccgaaaga

SEQ ID NO: 115352 - DNA, 25 bp, E. coli
catacagccatctcggtccgaaaga

SEQ ID NO: 115353 - DNA, 25 bp, E. coli
tactattctgcatagccagcgtgat

SEQ ID NO: 115354 - DNA, 25 bp, E. coli
tactattctgcaaagccagcgtgat

SEQ ID NO: 115355 - DNA, 25 bp, E. coli
acggcttccatgagccgtccagtga

SEQ ID NO: 115356 - DNA, 25 bp, E. coli
acggcttccatgtgccgtccagtga

SEQ ID NO: 115357 - DNA, 25 bp, E. coli
ttccatgagccgaccagtgaagcag

SEQ ID NO: 115358 - DNA, 25 bp, E. coli
ttccatgagccgtccagtgaagcag

SEQ ID NO: 115359 - DNA, 25 bp, E. coli
ccagaccgtcaggttcccgattgat

SEQ ID NO: 115360 - DNA, 25 bp, E. coli
ccagaccgtcagcttcccgattgat

SEQ ID NO: 115361 - DNA, 25 bp, E. coli
ccatctcggtcccaaagagtctgac

SEQ ID NO: 115362 - DNA, 25 bp, E. coli
ccatctcggtccgaaagagtctgac

SEQ ID NO: 115363 - DNA, 25 bp, E. coli
cgtgatttgattcccgccctgaaag

SEQ ID NO: 115364 - DNA, 25 bp, E. coli
cgtgatttgattgccgccctgaaag

SEQ ID NO: 115365 - DNA, 25 bp, E. coli
cgtcagcttccccattgatatcgag

SEQ ID NO: 115366 - DNA, 25 bp, E. coli
cgtcagcttcccgattgatatcgag

SEQ ID NO: 115367 - DNA, 25 bp, E. coli
gagccgtccagtcaagcagctgaaa

SEQ ID NO: 115368 - DNA, 25 bp, E. coli
gagccgtccagtgaagcagctgaaa

SEQ ID NO: 115369 - DNA, 25 bp, E. coli
cagcatgatgctgacggtaccagtc

SEQ ID NO: 115370 - DNA, 25 bp, E. coli
cagcatgatgctcacggtaccagtc

SEQ ID NO: 115371 - DNA, 25 bp, E. coli
catacacgttttgataccagttgct

SEQ ID NO: 115372 - DNA, 25 bp, E. coli
catacacgttttcataccagttgct

SEQ ID NO: 115373 - DNA, 25 bp, E. coli
aaaatgccacagtcctccctgaagt

SEQ ID NO: 115374 - DNA, 25 bp, E. coli
aaaatgccacagacctccctgaagt

SEQ ID NO: 115375 - DNA, 25 bp, E. coli
taccagttgctgtcagcatgatgct

SEQ ID NO: 115376 - DNA, 25 bp, E. coli
taccagttgctgacagcatgatgct

SEQ ID NO: 115377 - DNA, 25 bp, E. coli
ttgctgagccggaaaacgcgctggc

SEQ ID NO: 115378 - DNA, 25 bp, E. coli
ttgctgagccggtaaacgcgctggc

SEQ ID NO: 115379 - DNA, 25 bp, E. coli
gaatccgctgaagcagatgcacggc

SEQ ID NO: 115380 - DNA, 25 bp, E. coli
gaatccgctgaaccagatgcacggc

SEQ ID NO: 115381 - DNA, 25 bp, E. coli
ctgacggtaccagtcgcgggctttt

SEQ ID NO: 115382 - DNA, 25 bp, E. coli
cgtccccggtgagtgatttcagcct

SEQ ID NO: 115383 - DNA, 25 bp, E. coli
cgtccccggtgactgatttcagcct

SEQ ID NO: 115384 - DNA, 25 bp, E. coli
ctgacggtaccactcgcgggctttt

SEQ ID NO: 115385 - DNA, 25 bp, E. coli
tggcagtaacgtgcccggtgactga

SEQ ID NO: 115386 - DNA, 25 bp, E. coli
tggcagtaacgtccccggtgactga

SEQ ID NO: 115387 - DNA, 25 bp, E. coli
tggctgcagaatccgctgaaccaga

SEQ ID NO: 115388 - DNA, 25 bp, E. coli
tggctgcagaatgcgctgaaccaga

SEQ ID NO: 115389 - DNA, 25 bp, E. coli
gatgcacggctcatccataaacctg

SEQ ID NO: 115390 - DNA, 25 bp, E. coli
gatgcacggctcttccataaacctg

SEQ ID NO: 115391 - DNA, 25 bp, E. coli
caccattcgactttcttgtttagca

SEQ ID NO: 115392 - DNA, 25 bp, E. coli
caccattcgactatcttgtttagca

SEQ ID NO: 115393 - DNA, 25 bp, E. coli
catcctgcacataaggcgtaattcg

SEQ ID NO: 115394 - DNA, 25 bp, E. coli
catcctgcacattaggcgtaattcg

SEQ ID NO: 115395 - DNA, 25 bp, E. coli
tactgtgcaagctactctatgtcgg

SEQ ID NO: 115396 - DNA, 25 bp, E. coli
tactgtgcaagcaactctatgtcgg

SEQ ID NO: 115397 - DNA, 25 bp, E. coli
ttaggcgtaaaaagacgcatcctgc

SEQ ID NO: 115398 - DNA, 25 bp, E. coli
ttaggcgtaaaatgacgcatcctgc

SEQ ID NO: 115399 - DNA, 25 bp, E. coli
tctatgtcggtgcaattaggcgtaa

SEQ ID NO: 115400 - DNA, 25 bp, E. coli
tctatgtcggtggaattaggcgtaa

SEQ ID NO: 115401 - DNA, 25 bp, E. coli
gcgtaattcgagtgacttttcccca

SEQ ID NO: 115402 - DNA, 25 bp, E. coli
gcgtaattcgagagacttttcccca

SEQ ID NO: 115403 - DNA, 25 bp, E. coli
cgttaagcctgttaaacgagatggt

SEQ ID NO: 115404 - DNA, 25 bp, E. coli
cgttaagcctgtaaaacgagatggt

SEQ ID NO: 115405 - DNA, 25 bp, E. coli
tcactttgtaaacctgatgacatcg

SEQ ID NO: 115406 - DNA, 25 bp, E. coli
tacaccgataacagcgaatattacg

SEQ ID NO: 115407 - DNA, 25 bp, E. coli
tcactttgtaaagctgatgacatcg

SEQ ID NO: 115408 - DNA, 25 bp, E. coli
tacaccgataactgcgaatattacg

SEQ ID NO: 115409 - DNA, 25 bp, E. coli
tattacgctaatgtcggttttaacg

SEQ ID NO: 115410 - DNA, 25 bp, E. coli
tattacgctaatctcggttttaacg

SEQ ID NO: 115411 - DNA, 25 bp, E. coli
gatgacatcgtcagagcttactgtg

SEQ ID NO: 115412 - DNA, 25 bp, E. coli
gatgacatcgtctgagcttactgtg

SEQ ID NO: 115413 - DNA, 25 bp, E. coli
caggccggcactcgcgcgaatattt

SEQ ID NO: 115414 - DNA, 25 bp, E. coli
caggccggcactggcgcgaatattt

SEQ ID NO: 115415 - DNA, 25 bp, E. coli
tacaaaagtgctgagacagtcccct

SEQ ID NO: 115416 - DNA, 25 bp, E. coli
tacaaaagtgctcagacagtcccct

SEQ ID NO: 115417 - DNA, 25 bp, E. coli
tacgtcaacgaaataatttttctcg

SEQ ID NO: 115418 - DNA, 25 bp, E. coli
tacgtcaacgaattaatttttctcg

SEQ ID NO: 115419 - DNA, 25 bp, E. coli
actattttctaatggcgcttcggcg

SEQ ID NO: 115420 - DNA, 25 bp, E. coli
actattttctaaaggcgcttcggcg

SEQ ID NO: 115421 - DNA, 25 bp, E. coli
tagcaatctcaatgatacgtcaacg

SEQ ID NO: 115422 - DNA, 25 bp, E. coli
tagcaatctcaaagatacgtcaacg

SEQ ID NO: 115423 - DNA, 25 bp, E. coli
tcggcgcctttttagtcagatgaca

SEQ ID NO: 115424 - DNA, 25 bp, E. coli
tcagatgacaaactacaaaagtgct

SEQ ID NO: 115425 - DNA, 25 bp, E. coli
tcagatgacaaagtacaaaagtgct

SEQ ID NO: 115426 - DNA, 25 bp, E. coli
tcggcgccttttaagtcagatgaca

SEQ ID NO: 115427 - DNA, 25 bp, E. coli
ccaacattgaagtttgagccagttt

SEQ ID NO: 115428 - DNA, 25 bp, E. coli
ccaacattgaagattgagccagttt

SEQ ID NO: 115429 - DNA, 25 bp, E. coli
gcactggcgcgaatatttaccctca

SEQ ID NO: 115430 - DNA, 25 bp, E. coli
gcactggcgcgattatttaccctca

SEQ ID NO: 115431 - DNA, 25 bp, E. coli
ggaaaagcgtgccaacattgaagat

SEQ ID NO: 115432 - DNA, 25 bp, E. coli
ggaaaagcgtgcgaacattgaagat

SEQ ID NO: 115433 - DNA, 25 bp, E. coli
gagccagtttgttagcaatctcaaa

SEQ ID NO: 115434 - DNA, 25 bp, E. coli
gagccagtttgtaagcaatctcaaa

SEQ ID NO: 115435 - DNA, 25 bp, E. coli
cttgacgccattgccgctgaaattc

SEQ ID NO: 115436 - DNA, 25 bp, E. coli
cttgacgccattcccgctgaaattc

SEQ ID NO: 115437 - DNA, 25 bp, E. coli
caggagcaggatcttgacgccattg

SEQ ID NO: 115438 - DNA, 25 bp, E. coli
caggagcaggatgttgacgccattg

SEQ ID NO: 115439 - DNA, 25 bp, E. coli
agcattgatcgagcagcgtctggaa

SEQ ID NO: 115440 - DNA, 25 bp, E. coli
agcccaggagcaggatcttgacgcc

SEQ ID NO: 115441 - DNA, 25 bp, E. coli
agcccaggagcacgatcttgacgcc

SEQ ID NO: 115442 - DNA, 25 bp, E. coli
agcattgatcgaccagcgtctggaa

SEQ ID NO: 115443 - DNA, 25 bp, E. coli
ttctcgcggcgcaggatggtacgct

SEQ ID NO: 115444 - DNA, 25 bp, E. coli
ttctcgcggcgctggatggtacgct

SEQ ID NO: 115445 - DNA, 25 bp, E. coli
tgaaagcattgatcgagcagcgtct

SEQ ID NO: 115446 - DNA, 25 bp, E. coli
tgaaagcattgaacgagcagcgtct

SEQ ID NO: 115447 - DNA, 25 bp, E. coli
ctggatggtacgctggacgacttta

SEQ ID NO: 115448 - DNA, 25 bp, E. coli
ctggatggtacggtggacgacttta

SEQ ID NO: 115449 - DNA, 25 bp, E. coli
tggtacgctggacgactttattgtc

SEQ ID NO: 115450 - DNA, 25 bp, E. coli
ggatcttgacgcgattgccgctgaa

SEQ ID NO: 115451 - DNA, 25 bp, E. coli
tggtacgctggaggactttattgtc

SEQ ID NO: 115452 - DNA, 25 bp, E. coli
ggatcttgacgccattgccgctgaa

SEQ ID NO: 115453 - DNA, 25 bp, E. coli
ggacgactttatagtcgcgcgcgaa

SEQ ID NO: 115454 - DNA, 25 bp, E. coli
ggcactgaaagctttgatcgagcag

SEQ ID NO: 115455 - DNA, 25 bp, E. coli
ggacgactttattgtcgcgcgcgaa

SEQ ID NO: 115456 - DNA, 25 bp, E. coli
ggcactgaaagcattgatcgagcag

SEQ ID NO: 115457 - DNA, 25 bp, E. coli
catgaaaattatgccagattattgg

SEQ ID NO: 115458 - DNA, 25 bp, E. coli
catgaaaattatcccagattattgg

SEQ ID NO: 115459 - DNA, 25 bp, E. coli
aaattatcccagattattggcagca

SEQ ID NO: 115460 - DNA, 25 bp, E. coli
aaattatcccagtttattggcagca

SEQ ID NO: 115461 - DNA, 25 bp, E. coli
tatcccagattaatggcagcaatat

SEQ ID NO: 115462 - DNA, 25 bp, E. coli
tatcccagattattggcagcaatat

SEQ ID NO: 115463 - DNA, 25 bp, E. coli
tttcttcaacgctatgtcatcgatc

SEQ ID NO: 115464 - DNA, 25 bp, E. coli
tttcttcaacgcaatgtcatcgatc

SEQ ID NO: 115465 - DNA, 25 bp, E. coli
tgtatcacttttatgccggaagttg

SEQ ID NO: 115466 - DNA, 25 bp, E. coli
tgtatcacttttttgccggaagttg

SEQ ID NO: 115467 - DNA, 25 bp, E. coli
tcttgtatcacttttttgccggaag

SEQ ID NO: 115468 - DNA, 25 bp, E. coli
tcttgtatcactattttgccggaag

SEQ ID NO: 115469 - DNA, 25 bp, E. coli
ccttttcttcaacgctatgtcatcg

SEQ ID NO: 115470 - DNA, 25 bp, E. coli
ccttttcttcaaggctatgtcatcg

SEQ ID NO: 115471 - DNA, 25 bp, E. coli
gctatgtcatcgttcttgtatcact

SEQ ID NO: 115472 - DNA, 25 bp, E. coli
gctatgtcatcgatcttgtatcact

SEQ ID NO: 115473 - DNA, 25 bp, E. coli
gtttgcattttaatagttggatagg

SEQ ID NO: 115474 - DNA, 25 bp, E. coli
gtttgcattttattagttggatagg

SEQ ID NO: 115475 - DNA, 25 bp, E. coli
tcaacgctatgtcatcgatcttgta

SEQ ID NO: 115476 - DNA, 25 bp, E. coli
tcaacgctatgtgatcgatcttgta

SEQ ID NO: 115477 - DNA, 25 bp, E. coli
gatcttgtatcacttttttgccgga

SEQ ID NO: 115478 - DNA, 25 bp, E. coli
gatcttgtatcagttttttgccgga

SEQ ID NO: 115479 - DNA, 25 bp, E. coli
aacgctgggccgatcttctgagtag

SEQ ID NO: 115480 - DNA, 25 bp, E. coli
aacgctgggccgttcttctgagtag

SEQ ID NO: 115481 - DNA, 25 bp, E. coli
cagaaattgctttaaggccaccgcg

SEQ ID NO: 115482 - DNA, 25 bp, E. coli
cagaaattgcttaaaggccaccgcg

SEQ ID NO: 115483 - DNA, 25 bp, E. coli
tattaccgcgaaacctatgccgaag

SEQ ID NO: 115484 - DNA, 25 bp, E. coli
tattaccgcgaatcctatgccgaag

SEQ ID NO: 115485 - DNA, 25 bp, E. coli
tgtattactgactaagccgcctccg

SEQ ID NO: 115486 - DNA, 25 bp, E. coli
tgtattactgacaaagccgcctccg

SEQ ID NO: 115487 - DNA, 25 bp, E. coli
tcgtggaatgtagcaacgctgggcc

SEQ ID NO: 115488 - DNA, 25 bp, E. coli
tcgtggaatgtaccaacgctgggcc

SEQ ID NO: 115489 - DNA, 25 bp, E. coli
gcttttgaaaacagcgccactcgtg

SEQ ID NO: 115490 - DNA, 25 bp, E. coli
gcttttgaaaactgcgccactcgtg

SEQ ID NO: 115491 - DNA, 25 bp, E. coli
cgagttgatcgaagtaccgctggaa

SEQ ID NO: 115492 - DNA, 25 bp, E. coli
cgagttgatcgatgtaccgctggaa

SEQ ID NO: 115493 - DNA, 25 bp, E. coli
cgcgcggccctgatcaagttgaagt

SEQ ID NO: 115494 - DNA, 25 bp, E. coli
cgcgcggccctgttcaagttgaagt

SEQ ID NO: 115495 - DNA, 25 bp, E. coli
ggaagtgctcgaaaaaaccgccgct

SEQ ID NO: 115496 - DNA, 25 bp, E. coli
ggaagtgctcgataaaaccgccgct

SEQ ID NO: 115497 - DNA, 25 bp, E. coli
taagcgcctcggtgatggacaaacc

SEQ ID NO: 115498 - DNA, 25 bp, E. coli
taagcgcctcggagatggacaaacc

SEQ ID NO: 115499 - DNA, 25 bp, E. coli
gagcagttcgcctgtgaccagtatc

SEQ ID NO: 115500 - DNA, 25 bp, E. coli
gagcagttcgccagtgaccagtatc

SEQ ID NO: 115501 - DNA, 25 bp, E. coli
aaaatcgtcatgtactgcaccggcg

SEQ ID NO: 115502 - DNA, 25 bp, E. coli
aaatgttggctgagagcgaaccgcg

SEQ ID NO: 115503 - DNA, 25 bp, E. coli
aaaatcgtcatgaactgcaccggcg

SEQ ID NO: 115504 - DNA, 25 bp, E. coli
aaatgttggctgtgagcgaaccgcg

SEQ ID NO: 115505 - DNA, 25 bp, E. coli
tatctggcgcatgagggcattaacg

SEQ ID NO: 115506 - DNA, 25 bp, E. coli
tttgctgcgaagtaagcgcgttacc

SEQ ID NO: 115507 - DNA, 25 bp, E. coli
tatctggcgcatcagggcattaacg

SEQ ID NO: 115508 - DNA, 25 bp, E. coli
tttgctgcgaagaaagcgcgttacc

SEQ ID NO: 115509 - DNA, 25 bp, E. coli
tcgggcaggacgagaaaatggcaat

SEQ ID NO: 115510 - DNA, 25 bp, E. coli
tcgggcaggacgtgaaaatggcaat

SEQ ID NO: 115511 - DNA, 25 bp, E. coli
gcaaatcagcgtacctgcgagcaat

SEQ ID NO: 115512 - DNA, 25 bp, E. coli
gcaaatcagcgttcctgcgagcaat

SEQ ID NO: 115513 - DNA, 25 bp, E. coli
cattcgttgtgataaggccagtgcc

SEQ ID NO: 115514 - DNA, 25 bp, E. coli
cattcgttgtgaaaaggccagtgcc

SEQ ID NO: 115515 - DNA, 25 bp, E. coli
gtgaacgccatgcttgacgatcccg

SEQ ID NO: 115516 - DNA, 25 bp, E. coli
gtgaacgccatggttgacgatcccg

SEQ ID NO: 115517 - DNA, 25 bp, E. coli
ggcagataccttgcgtgagcagctg

SEQ ID NO: 115518 - DNA, 25 bp, E. coli
ggcagataccttccgtgagcagctg

SEQ ID NO: 115519 - DNA, 25 bp, E. coli
gacgggaaatccttctgggtactgc

SEQ ID NO: 115520 - DNA, 25 bp, E. coli
gacgatcctcactttgatgccagca

SEQ ID NO: 115521 - DNA, 25 bp, E. coli
gacgggaaatccatctgggtactgc

SEQ ID NO: 115522 - DNA, 25 bp, E. coli
gacgatcctcacattgatgccagca

SEQ ID NO: 115523 - DNA, 25 bp, E. coli
caatcgtggtgaagagcagcgacta

SEQ ID NO: 115524 - DNA, 25 bp, E. coli
caatcgtggtgatgagcagcgacta

SEQ ID NO: 115525 - DNA, 25 bp, E. coli
cacgcggtgtggtgctgctgtctac

SEQ ID NO: 115526 - DNA, 25 bp, E. coli
cacgcggtgtggagctgctgtctac

SEQ ID NO: 115527 - DNA, 25 bp, E. coli
cagtgtttctgacaaagccggtatc

SEQ ID NO: 115528 - DNA, 25 bp, E. coli
cagtgtttctgagaaagccggtatc

SEQ ID NO: 115529 - DNA, 25 bp, E. coli
tacatggtggcattctgggccgtcg

SEQ ID NO: 115530 - DNA, 25 bp, E. coli
tacatggtggcaatctgggccgtcg

SEQ ID NO: 115531 - DNA, 25 bp, E. coli
actacttcggcaccatggttccggc

SEQ ID NO: 115532 - DNA, 25 bp, E. coli
aaagaagcctcccttgctaccgcaa

SEQ ID NO: 115533 - DNA, 25 bp, E. coli
aaagaagcctccgttgctaccgcaa

SEQ ID NO: 115534 - DNA, 25 bp, E. coli
actacttcggcagcatggttccggc

SEQ ID NO: 115535 - DNA, 25 bp, E. coli
tgattgtgaagcacgccaacccttg

SEQ ID NO: 115536 - DNA, 25 bp, E. coli
tgattgtgaagctcgccaacccttg

SEQ ID NO: 115537 - DNA, 25 bp, E. coli
tccgtgatgacgaagtgattgccgc

SEQ ID NO: 115538 - DNA, 25 bp, E. coli
tccgtgatgacgtagtgattgccgc

SEQ ID NO: 115539 - DNA, 25 bp, E. coli
tccgccgccaagtaccataaagatg

SEQ ID NO: 115540 - DNA, 25 bp, E. coli
tccgccgccaagaaccataaagatg

SEQ ID NO: 115541 - DNA, 25 bp, E. coli
gaagtgattattccgccgtccgcca

SEQ ID NO: 115542 - DNA, 25 bp, E. coli
gaagtgattattgcgccgtccgcca

SEQ ID NO: 115543 - DNA, 25 bp, E. coli
cgtgaagaccctccatccgaaagta

SEQ ID NO: 115544 - DNA, 25 bp, E. coli
cgtgaagaccctgcatccgaaagta

SEQ ID NO: 115545 - DNA, 25 bp, E. coli
atgaactgttcggtgctgactgggc

SEQ ID NO: 115546 - DNA, 25 bp, E. coli
atgaactgttcgctgctgactgggc

SEQ ID NO: 115547 - DNA, 25 bp, E. coli
ttcccacacggtaacgacgacatcg

SEQ ID NO: 115548 - DNA, 25 bp, E. coli
ttcccacacggttacgacgacatcg

SEQ ID NO: 115549 - DNA, 25 bp, E. coli
tgtcatcaggccaaaactccggtcg

SEQ ID NO: 115550 - DNA, 25 bp, E. coli
tgtcatcaggcctaaactccggtcg

SEQ ID NO: 115551 - DNA, 25 bp, E. coli
tgatctgaaagcaagcagcctgcgt

SEQ ID NO: 115552 - DNA, 25 bp, E. coli
tgatctgaaagctagcagcctgcgt

SEQ ID NO: 115553 - DNA, 25 bp, E. coli
cctctaccggtaaagtggctgtgaa

SEQ ID NO: 115554 - DNA, 25 bp, E. coli
cctctaccggtatagtggctgtgaa

SEQ ID NO: 115555 - DNA, 25 bp, E. coli
gcagcctgcgtgcactgaaattgat

SEQ ID NO: 115556 - DNA, 25 bp, E. coli
gcagcctgcgtggactgaaattgat

SEQ ID NO: 115557 - DNA, 25 bp, E. coli
gaaattgatggagctgaccaccctg

SEQ ID NO: 115558 - DNA, 25 bp, E. coli
gaactgaaagaccaagcgctgatcc

SEQ ID NO: 115559 - DNA, 25 bp, E. coli
gaaagcgcgcgcatcatgatggaag

SEQ ID NO: 115560 - DNA, 25 bp, E. coli
gaaattgatggacctgaccaccctg

SEQ ID NO: 115561 - DNA, 25 bp, E. coli
gaactgaaagacgaagcgctgatcc

SEQ ID NO: 115562 - DNA, 25 bp, E. coli
gaaagcgcgcgcttcatgatggaag

SEQ ID NO: 115563 - DNA, 25 bp, E. coli
gatatgggcgtagaaaaaaccgttg

SEQ ID NO: 115564 - DNA, 25 bp, E. coli
gatatgggcgtacaaaaaaccgttg

SEQ ID NO: 115565 - DNA, 25 bp, E. coli
gatccgtaaagcctctgaaatctcc

SEQ ID NO: 115566 - DNA, 25 bp, E. coli
gatccgtaaagcgtctgaaatctcc

SEQ ID NO: 115567 - DNA, 25 bp, E. coli
cattttacaggtcgtttgtcagtga

SEQ ID NO: 115568 - DNA, 25 bp, E. coli
cattttacaggtggtttgtcagtga

SEQ ID NO: 115569 - DNA, 25 bp, E. coli
atgattgacattttacaggtggttt

SEQ ID NO: 115570 - DNA, 25 bp, E. coli
attgacattttagaggtggtttgtc

SEQ ID NO: 115571 - DNA, 25 bp, E. coli
attgacattttacaggtggtttgtc

SEQ ID NO: 115572 - DNA, 25 bp, E. coli
atgattgacattatacaggtggttt

SEQ ID NO: 115573 - DNA, 25 bp, E. coli
acattttacaggaggtttgtcagtg

SEQ ID NO: 115574 - DNA, 25 bp, E. coli
acattttacaggtggtttgtcagtg

SEQ ID NO: 115575 - DNA, 25 bp, E. coli
tgattgacatttaacaggtggtttg

SEQ ID NO: 115576 - DNA, 25 bp, E. coli
tgacattttacaggtggtttgtcag

SEQ ID NO: 115577 - DNA, 25 bp, E. coli
tgattgacattttacaggtggtttg

SEQ ID NO: 115578 - DNA, 25 bp, E. coli
ttgacattttactggtggtttgtca

SEQ ID NO: 115579 - DNA, 25 bp, E. coli
tgacattttacacgtggtttgtcag

SEQ ID NO: 115580 - DNA, 25 bp, E. coli
ttgacattttacaggtggtttgtca

SEQ ID NO: 115581 - DNA, 25 bp, E. coli
gacattttacaggtggtttgtcagt

SEQ ID NO: 115582 - DNA, 25 bp, E. coli
gacattttacagctggtttgtcagt

SEQ ID NO: 115583 - DNA, 25 bp, E. coli
gattgacattttacaggtggtttgt

SEQ ID NO: 115584 - DNA, 25 bp, E. coli
gattgacatttttcaggtggtttgt

SEQ ID NO: 115585 - DNA, 25 bp, E. coli
aaggcgtacaatcgtcgctttccgg

SEQ ID NO: 115586 - DNA, 25 bp, E. coli
gaaagtcgccttctacattttgacg

SEQ ID NO: 115587 - DNA, 25 bp, E. coli
aaggcgtacaatggtcgctttccgg

SEQ ID NO: 115588 - DNA, 25 bp, E. coli
gaaagtcgccttgtacattttgacg

SEQ ID NO: 115589 - DNA, 25 bp, E. coli
ttgccagaatgcagtcggccccggt

SEQ ID NO: 115590 - DNA, 25 bp, E. coli
ttgccagaatgctgtcggccccggt

SEQ ID NO: 115591 - DNA, 25 bp, E. coli
tgcagtttaaagctgagatccgcag

SEQ ID NO: 115592 - DNA, 25 bp, E. coli
tgcagtttaaaggtgagatccgcag

SEQ ID NO: 115593 - DNA, 25 bp, E. coli
cgacaacacgctcggctttggtaaa

SEQ ID NO: 115594 - DNA, 25 bp, E. coli
cgacaacacgctgggctttggtaaa

SEQ ID NO: 115595 - DNA, 25 bp, E. coli
cgccatcagccgatggctggcaaaa

SEQ ID NO: 115596 - DNA, 25 bp, E. coli
cgccatcagccgttggctggcaaaa

SEQ ID NO: 115597 - DNA, 25 bp, E. coli
ctttccggttgcgagaatgctgtcg

SEQ ID NO: 115598 - DNA, 25 bp, E. coli
ctttccggttgccagaatgctgtcg

SEQ ID NO: 115599 - DNA, 25 bp, E. coli
gtcagccgaaaagggtagcgttaat

SEQ ID NO: 115600 - DNA, 25 bp, E. coli
gtcagccgaaaacggtagcgttaat

SEQ ID NO: 115601 - DNA, 25 bp, E. coli
tggctggcaaaagaacatgttgtca

SEQ ID NO: 115602 - DNA, 25 bp, E. coli
tgccggaacggtaaacggtcagccg

SEQ ID NO: 115603 - DNA, 25 bp, E. coli
tggctggcaaaacaacatgttgtca

SEQ ID NO: 115604 - DNA, 25 bp, E. coli
tgccggaacggttaacggtcagccg

SEQ ID NO: 115605 - DNA, 25 bp, E. coli
tcaaattcaccgacaacacgctggg

SEQ ID NO: 115606 - DNA, 25 bp, E. coli
tcaaattcaccgtcaacacgctggg

SEQ ID NO: 115607 - DNA, 25 bp, E. coli
cagcgaggcatttcaccacattgca

SEQ ID NO: 115608 - DNA, 25 bp, E. coli
caactgaatcttactgaagatatcc

SEQ ID NO: 115609 - DNA, 25 bp, E. coli
cagcgaggcattacaccacattgca

SEQ ID NO: 115610 - DNA, 25 bp, E. coli
caactgaatctttctgaagatatcc

SEQ ID NO: 115611 - DNA, 25 bp, E. coli
catgtgctggtttaattcaccgtgc

SEQ ID NO: 115612 - DNA, 25 bp, E. coli
catgtgctggttaaattcaccgtgc

SEQ ID NO: 115613 - DNA, 25 bp, E. coli
tactgaagatatgcgtctctggcag

SEQ ID NO: 115614 - DNA, 25 bp, E. coli
tactgaagatatccgtctctggcag

SEQ ID NO: 115615 - DNA, 25 bp, E. coli
tatttagcggtgaatacaccggcgg

SEQ ID NO: 115616 - DNA, 25 bp, E. coli
ttgaccgatcttttattgcaagggc

SEQ ID NO: 115617 - DNA, 25 bp, E. coli
tatttagcggtgtatacaccggcgg

SEQ ID NO: 115618 - DNA, 25 bp, E. coli
ttgaccgatcttatattgcaagggc

SEQ ID NO: 115619 - DNA, 25 bp, E. coli
tcccgtatggcgagtggatgatgcc

SEQ ID NO: 115620 - DNA, 25 bp, E. coli
tcccgtatggcgtgtggatgatgcc

SEQ ID NO: 115621 - DNA, 25 bp, E. coli
gcgtattcccgtatggcgagtggat

SEQ ID NO: 115622 - DNA, 25 bp, E. coli
gctggttaaattcaccgtgccacag

SEQ ID NO: 115623 - DNA, 25 bp, E. coli
gctggttaaattgaccgtgccacag

SEQ ID NO: 115624 - DNA, 25 bp, E. coli
gcgtattcccgtttggcgagtggat

SEQ ID NO: 115625 - DNA, 25 bp, E. coli
ggcatttcaccagattgcacaagaa

SEQ ID NO: 115626 - DNA, 25 bp, E. coli
ggcatttcaccacattgcacaagaa

SEQ ID NO: 115627 - DNA, 25 bp, E. coli
ggcgacttgcttattgcggaatcta

SEQ ID NO: 115628 - DNA, 25 bp, E. coli
ggcgacttgctttttgcggaatcta

SEQ ID NO: 115629 - DNA, 25 bp, E. coli
aattttttatgtcattggtgtgaac

SEQ ID NO: 115630 - DNA, 25 bp, E. coli
aattttttatgtgattggtgtgaac

SEQ ID NO: 115631 - DNA, 25 bp, E. coli
cacatattcgttaacttagtgcatt

SEQ ID NO: 115632 - DNA, 25 bp, E. coli
cacatattcgtttacttagtgcatt

SEQ ID NO: 115633 - DNA, 25 bp, E. coli
catgagaaaacacatattcgtttac

SEQ ID NO: 115634 - DNA, 25 bp, E. coli
catgagaaaacagatattcgtttac

SEQ ID NO: 115635 - DNA, 25 bp, E. coli
tcggaataacctggccaatgagtct

SEQ ID NO: 115636 - DNA, 25 bp, E. coli
tcggaataacctcgccaatgagtct

SEQ ID NO: 115637 - DNA, 25 bp, E. coli
tctcacatgagaaaacacatattcg

SEQ ID NO: 115638 - DNA, 25 bp, E. coli
tctcacatgagataacacatattcg

SEQ ID NO: 115639 - DNA, 25 bp, E. coli
gaacatatccttagtcattatctgg

SEQ ID NO: 115640 - DNA, 25 bp, E. coli
gaacatatcctttgtcattatctgg

SEQ ID NO: 115641 - DNA, 25 bp, E. coli
cattatctggtttatctcacatgag

SEQ ID NO: 115642 - DNA, 25 bp, E. coli
ctggtcggaatatcctggccaatga

SEQ ID NO: 115643 - DNA, 25 bp, E. coli
cattatctggttaatctcacatgag

SEQ ID NO: 115644 - DNA, 25 bp, E. coli
ctggtcggaataacctggccaatga

SEQ ID NO: 115645 - DNA, 25 bp, E. coli
gattggtgtgaagatatcctttgtc

SEQ ID NO: 115646 - DNA, 25 bp, E. coli
gattggtgtgaacatatcctttgtc

SEQ ID NO: 115647 - DNA, 25 bp, E. coli
tggcactattctgtaaaatattaat

SEQ ID NO: 115648 - DNA, 25 bp, E. coli
ggcattacttttatctctcttttag

SEQ ID NO: 115649 - DNA, 25 bp, E. coli
tggcactattctctaaaatattaat

SEQ ID NO: 115650 - DNA, 25 bp, E. coli
ggcattacttttttctctcttttag

SEQ ID NO: 115651 - DNA, 25 bp, E. coli
caatgagtatcatctaacccaggaa

SEQ ID NO: 115652 - DNA, 25 bp, E. coli
caatgagtatcaactaacccaggaa

SEQ ID NO: 115653 - DNA, 25 bp, E. coli
caacccgcatgactttgaaaaagac

SEQ ID NO: 115654 - DNA, 25 bp, E. coli
caacccgcatgagtttgaaaaagac

SEQ ID NO: 115655 - DNA, 25 bp, E. coli
gactttgaaaaacacaattttcagc

SEQ ID NO: 115656 - DNA, 25 bp, E. coli
gactttgaaaaagacaattttcagc

SEQ ID NO: 115657 - DNA, 25 bp, E. coli
tagagcgagtgttcaacccgcatga

SEQ ID NO: 115658 - DNA, 25 bp, E. coli
tagagcgagtgtacaacccgcatga

SEQ ID NO: 115659 - DNA, 25 bp, E. coli
tttattgctgattacaatgagtatc

SEQ ID NO: 115660 - DNA, 25 bp, E. coli
tttattgctgataacaatgagtatc

SEQ ID NO: 115661 - DNA, 25 bp, E. coli
tgataattgcatcgtaaaaaactat

SEQ ID NO: 115662 - DNA, 25 bp, E. coli
tgataattgcatggtaaaaaactat

SEQ ID NO: 115663 - DNA, 25 bp, E. coli
gcgagtgttcaagccgcatgacttt

SEQ ID NO: 115664 - DNA, 25 bp, E. coli
gcatcgtaaaaaactatttaatggt

SEQ ID NO: 115665 - DNA, 25 bp, E. coli
gcatcgtaaaaatctatttaatggt

SEQ ID NO: 115666 - DNA, 25 bp, E. coli
gcgagtgttcaacccgcatgacttt

SEQ ID NO: 115667 - DNA, 25 bp, E. coli
taacccaggaaattaagatagagcg

SEQ ID NO: 115668 - DNA, 25 bp, E. coli
taagatagagcgagtgttcaacccg

SEQ ID NO: 115669 - DNA, 25 bp, E. coli
taagatagagcgtgtgttcaacccg

SEQ ID NO: 115670 - DNA, 25 bp, E. coli
taatgaatatccataccgtaatact

SEQ ID NO: 115671 - DNA, 25 bp, E. coli
taacccaggaaaataagatagagcg

SEQ ID NO: 115672 - DNA, 25 bp, E. coli
taatgaatatccttaccgtaatact

SEQ ID NO: 115673 - DNA, 25 bp, E. coli
aagtcgaccgcgtaaagagcctgca

SEQ ID NO: 115674 - DNA, 25 bp, E. coli
aagtcgaccgcgaaaagagcctgca

SEQ ID NO: 115675 - DNA, 25 bp, E. coli
tacaacggttgcttcttggccgaca

SEQ ID NO: 115676 - DNA, 25 bp, E. coli
tacaacggttgcatcttggccgaca

SEQ ID NO: 115677 - DNA, 25 bp, E. coli
tagaaaacctagttgcggacgacga

SEQ ID NO: 115678 - DNA, 25 bp, E. coli
tagaaaacctagatgcggacgacga

SEQ ID NO: 115679 - DNA, 25 bp, E. coli
ttcaggaaaaagtcgcagcaccgct

SEQ ID NO: 115680 - DNA, 25 bp, E. coli
ttcaggaaaaagacgcagcaccgct

SEQ ID NO: 115681 - DNA, 25 bp, E. coli
tgttcaacaaggaaacggccgatgg

SEQ ID NO: 115682 - DNA, 25 bp, E. coli
tgttcaacaaggtaacggccgatgg

SEQ ID NO: 115683 - DNA, 25 bp, E. coli
tgttatgccccatgaagctggcgga

SEQ ID NO: 115684 - DNA, 25 bp, E. coli
tgttatgccccaagaagctggcgga

SEQ ID NO: 115685 - DNA, 25 bp, E. coli
tcgatcttggctaccagcagggcaa

SEQ ID NO: 115686 - DNA, 25 bp, E. coli
tcgatcttggcttccagcagggcaa

SEQ ID NO: 115687 - DNA, 25 bp, E. coli
gaagtcattcaccatcacacggagg

SEQ ID NO: 115688 - DNA, 25 bp, E. coli
gaagtcattcacgatcacacggagg

SEQ ID NO: 115689 - DNA, 25 bp, E. coli
gacattaacgaggatgctctgccga

SEQ ID NO: 115690 - DNA, 25 bp, E. coli
gacattttccgtcgcgcacaggcta

SEQ ID NO: 115691 - DNA, 25 bp, E. coli
gacattaacgagcatgctctgccga

SEQ ID NO: 115692 - DNA, 25 bp, E. coli
gacattttccgtggcgcacaggcta

SEQ ID NO: 115693 - DNA, 25 bp, E. coli
ccgcgctggccgagataaagtatta

SEQ ID NO: 115694 - DNA, 25 bp, E. coli
ccgcgctggccgtgataaagtatta

SEQ ID NO: 115695 - DNA, 25 bp, E. coli
cagtacccggctattgtaacgtgtt

SEQ ID NO: 115696 - DNA, 25 bp, E. coli
cagtacccggcttttgtaacgtgtt

SEQ ID NO: 115697 - DNA, 25 bp, E. coli
ttttttggaagtggcctcgcagaag

SEQ ID NO: 115698 - DNA, 25 bp, E. coli
ttcttcctgtctgacgaaaatccag

SEQ ID NO: 115699 - DNA, 25 bp, E. coli
ttcttcctgtctcacgaaaatccag

SEQ ID NO: 115700 - DNA, 25 bp, E. coli
ttttttggaagtcgcctcgcagaag

SEQ ID NO: 115701 - DNA, 25 bp, E. coli
tgtctcacgaaaatccagtacccgg

SEQ ID NO: 115702 - DNA, 25 bp, E. coli
tgtctcacgaaattccagtacccgg

SEQ ID NO: 115703 - DNA, 25 bp, E. coli
tcttttacgggattatcagtaaaca

SEQ ID NO: 115704 - DNA, 25 bp, E. coli
tcttttacgggaatatcagtaaaca

SEQ ID NO: 115705 - DNA, 25 bp, E. coli
tcgcgatcgcgaaattaattcacaa

SEQ ID NO: 115706 - DNA, 25 bp, E. coli
tcgcgatcgcgatattaattcacaa

SEQ ID NO: 115707 - DNA, 25 bp, E. coli
tcacgaaaatcctgtacccggctat

SEQ ID NO: 115708 - DNA, 25 bp, E. coli
tcacgaaaatccagtacccggctat

SEQ ID NO: 115709 - DNA, 25 bp, E. coli
cctcgcagaagggacagatcgcgta

SEQ ID NO: 115710 - DNA, 25 bp, E. coli
cctcgcagaaggcacagatcgcgta

SEQ ID NO: 115711 - DNA, 25 bp, E. coli
gaaaatccagtagccggctattgta

SEQ ID NO: 115712 - DNA, 25 bp, E. coli
gaaaatccagtacccggctattgta

SEQ ID NO: 115713 - DNA, 25 bp, E. coli
cgcgaaattaattcacaacaattca

SEQ ID NO: 115714 - DNA, 25 bp, E. coli
cgcgaaattaatacacaacaattca

SEQ ID NO: 115715 - DNA, 25 bp, E. coli
tggaagtcgcctcgcagaaggcaca

SEQ ID NO: 115716 - DNA, 25 bp, E. coli
tggaagtcgcctggcagaaggcaca

SEQ ID NO: 115717 - DNA, 25 bp, E. coli
caaaagagtcgctatcatatcaatg

SEQ ID NO: 115718 - DNA, 25 bp, E. coli
caaaagagtcgcaatcatatcaatg

SEQ ID NO: 115719 - DNA, 25 bp, E. coli
cttccttctggtgaaattgttgcta

SEQ ID NO: 115720 - DNA, 25 bp, E. coli
cttccttctggtcaaattgttgcta

SEQ ID NO: 115721 - DNA, 25 bp, E. coli
aacttaataagcgtaaattagcgct

SEQ ID NO: 115722 - DNA, 25 bp, E. coli
aacttaataagcctaaattagcgct

SEQ ID NO: 115723 - DNA, 25 bp, E. coli
aaacgtacggttatgcttgtcgatc

SEQ ID NO: 115724 - DNA, 25 bp, E. coli
aaacgtacggttttgcttgtcgatc

SEQ ID NO: 115725 - DNA, 25 bp, E. coli
tatgcttgtcgatcagataccagag

SEQ ID NO: 115726 - DNA, 25 bp, E. coli
tatgcttgtcgaacagataccagag

SEQ ID NO: 115727 - DNA, 25 bp, E. coli
gcgcttgaattaatacgtgattgga

SEQ ID NO: 115728 - DNA, 25 bp, E. coli
gcgcttgaattattacgtgattgga

SEQ ID NO: 115729 - DNA, 25 bp, E. coli
ctcttgattgagtttgtacggcaaa

SEQ ID NO: 115730 - DNA, 25 bp, E. coli
ctcttgattgagattgtacggcaaa

SEQ ID NO: 115731 - DNA, 25 bp, E. coli
gataccagagaaccaaaagagtcgc

SEQ ID NO: 115732 - DNA, 25 bp, E. coli
gataagacaatttaatccagcaagt

SEQ ID NO: 115733 - DNA, 25 bp, E. coli
gataagacaattaaatccagcaagt

SEQ ID NO: 115734 - DNA, 25 bp, E. coli
gataccagagaagcaaaagagtcgc

SEQ ID NO: 115735 - DNA, 25 bp, E. coli
ggtattgctaatattgaactcttga

SEQ ID NO: 115736 - DNA, 25 bp, E. coli
ggtattgctaattttgaactcttga

SEQ ID NO: 115737 - DNA, 25 bp, E. coli
gatgcattgattacacttccttctg

SEQ ID NO: 115738 - DNA, 25 bp, E. coli
gatgcattgatttcacttccttctg

SEQ ID NO: 115739 - DNA, 25 bp, E. coli
aatattgcaggggacgcgtaggcct

SEQ ID NO: 115740 - DNA, 25 bp, E. coli
aatattgcagggcacgcgtaggcct

SEQ ID NO: 115741 - DNA, 25 bp, E. coli
aaaagcccgcttataatgctggcct

SEQ ID NO: 115742 - DNA, 25 bp, E. coli
aaaagcccgcttttaatgctggcct

SEQ ID NO: 115743 - DNA, 25 bp, E. coli
ttcagcgggcttgattgtttttaat

SEQ ID NO: 115744 - DNA, 25 bp, E. coli
ttcagcgggcttcattgtttttaat

SEQ ID NO: 115745 - DNA, 25 bp, E. coli
tgtcatcagtctgagcccgcttttc

SEQ ID NO: 115746 - DNA, 25 bp, E. coli
tgtcatcagtctcagcccgcttttc

SEQ ID NO: 115747 - DNA, 25 bp, E. coli
tgctggcctggatttctggcaaagt

SEQ ID NO: 115748 - DNA, 25 bp, E. coli
taaaaaagcccgcttttaatgctgg

SEQ ID NO: 115749 - DNA, 25 bp, E. coli
tgctggcctggaattctggcaaagt

SEQ ID NO: 115750 - DNA, 25 bp, E. coli
taaaaaagcccggttttaatgctgg

SEQ ID NO: 115751 - DNA, 25 bp, E. coli
gcccgcttttcagcgggcttcattg

SEQ ID NO: 115752 - DNA, 25 bp, E. coli
gcctggatttctcgcaaagtgcgct

SEQ ID NO: 115753 - DNA, 25 bp, E. coli
gcccgcttttcaccgggcttcattg

SEQ ID NO: 115754 - DNA, 25 bp, E. coli
gcctggatttctggcaaagtgcgct

SEQ ID NO: 115755 - DNA, 25 bp, E. coli
cccgcttttaatgctggcctggatt

SEQ ID NO: 115756 - DNA, 25 bp, E. coli
cccgcttttaatcctggcctggatt

SEQ ID NO: 115757 - DNA, 25 bp, E. coli
ggatttctggcatagtgcgctttgt

SEQ ID NO: 115758 - DNA, 25 bp, E. coli
ggatttctggcaaagtgcgctttgt

SEQ ID NO: 115759 - DNA, 25 bp, E. coli
taatgctggcctcgatttctggcaa

SEQ ID NO: 115760 - DNA, 25 bp, E. coli
taatgctggcctggatttctggcaa

SEQ ID NO: 115761 - DNA, 25 bp, E. coli
caagcgcgtgaactgggctataccg

SEQ ID NO: 115762 - DNA, 25 bp, E. coli
cagcacggcgttgggactgaaagca

SEQ ID NO: 115763 - DNA, 25 bp, E. coli
caagcgcgtgaagtgggctataccg

SEQ ID NO: 115764 - DNA, 25 bp, E. coli
caggcagcggatattgtctatcagg

SEQ ID NO: 115765 - DNA, 25 bp, E. coli
caggcagcggattttgtctatcagg

SEQ ID NO: 115766 - DNA, 25 bp, E. coli
cagcacggcgttcggactgaaagca

SEQ ID NO: 115767 - DNA, 25 bp, E. coli
ctttccggcgaatcggtcaatgtcg

SEQ ID NO: 115768 - DNA, 25 bp, E. coli
ctttccggcgaaacggtcaatgtcg

SEQ ID NO: 115769 - DNA, 25 bp, E. coli
aaccggtttgcagcagtttacgcca

SEQ ID NO: 115770 - DNA, 25 bp, E. coli
aaccggtttgcaccagtttacgcca

SEQ ID NO: 115771 - DNA, 25 bp, E. coli
tatgcgccgcctgatgttactttcc

SEQ ID NO: 115772 - DNA, 25 bp, E. coli
tatgcgccgcctcatgttactttcc

SEQ ID NO: 115773 - DNA, 25 bp, E. coli
tccgggccttcaacaagactgacag

SEQ ID NO: 115774 - DNA, 25 bp, E. coli
tccgggccttcatcaagactgacag

SEQ ID NO: 115775 - DNA, 25 bp, E. coli
gctgaaggacctggaacaagcgcgt

SEQ ID NO: 115776 - DNA, 25 bp, E. coli
gctgaaggacctcgaacaagcgcgt

SEQ ID NO: 115777 - DNA, 25 bp, E. coli
gattaggtgtctataacgtcggtgc

SEQ ID NO: 115778 - DNA, 25 bp, E. coli
gattaggtgtctttaacgtcggtgc

SEQ ID NO: 115779 - DNA, 25 bp, E. coli
gtcaatgtcgcgatccgtaacggca

SEQ ID NO: 115780 - DNA, 25 bp, E. coli
gtcaatgtcgcgttccgtaacggca

SEQ ID NO: 115781 - DNA, 25 bp, E. coli
gatgagcatcatactgcaaaccggt

SEQ ID NO: 115782 - DNA, 25 bp, E. coli
gatgagcatcattctgcaaaccggt

SEQ ID NO: 115783 - DNA, 25 bp, E. coli
caagcccaggattatgatgtggcga

SEQ ID NO: 115784 - DNA, 25 bp, E. coli
caagcccaggataatgatgtggcga

SEQ ID NO: 115785 - DNA, 25 bp, E. coli
catggcagctccgtttcatttgaaa

SEQ ID NO: 115786 - DNA, 25 bp, E. coli
catggcagctccctttcatttgaaa

SEQ ID NO: 115787 - DNA, 25 bp, E. coli
caggctcggagagtttctgctgtca

SEQ ID NO: 115788 - DNA, 25 bp, E. coli
caggctcggagactttctgctgtca

SEQ ID NO: 115789 - DNA, 25 bp, E. coli
taaagaatcgtctggcggttgcccg

SEQ ID NO: 115790 - DNA, 25 bp, E. coli
taaagaatcgtcaggcggttgcccg

SEQ ID NO: 115791 - DNA, 25 bp, E. coli
acgaagtaaacggagcatggcagct

SEQ ID NO: 115792 - DNA, 25 bp, E. coli
acgaagtaaacgcagcatggcagct

SEQ ID NO: 115793 - DNA, 25 bp, E. coli
tgcttttgataagtgcgcgggaaca

SEQ ID NO: 115794 - DNA, 25 bp, E. coli
tgcttttgataactgcgcgggaaca

SEQ ID NO: 115795 - DNA, 25 bp, E. coli
gaatctatagcttgcatccatgcct

SEQ ID NO: 115796 - DNA, 25 bp, E. coli
gaatctatagctagcatccatgcct

SEQ ID NO: 115797 - DNA, 25 bp, E. coli
gattcgtactgtgtctcccctgtcg

SEQ ID NO: 115798 - DNA, 25 bp, E. coli
gattcgtactgtctctcccctgtcg

SEQ ID NO: 115799 - DNA, 25 bp, E. coli
tcaattattcttcagcaagcccagg

SEQ ID NO: 115800 - DNA, 25 bp, E. coli
tcaattattcttgagcaagcccagg

SEQ ID NO: 115801 - DNA, 25 bp, E. coli
gagacacattatactttcgcgacgc

SEQ ID NO: 115802 - DNA, 25 bp, E. coli
ggttgcccggaatgtaccaaatgcg

SEQ ID NO: 115803 - DNA, 25 bp, E. coli
ggttgcccggaaagtaccaaatgcg

SEQ ID NO: 115804 - DNA, 25 bp, E. coli
gagacacattattctttcgcgacgc

SEQ ID NO: 115805 - DNA, 25 bp, E. coli
aatccaggcacagatgcgcgatggt

SEQ ID NO: 115806 - DNA, 25 bp, E. coli
aatccaggcacacatgcgcgatggt

SEQ ID NO: 115807 - DNA, 25 bp, E. coli
caaatgcggcgtacagagggtatca

SEQ ID NO: 115808 - DNA, 25 bp, E. coli
caaatgcggcgttcagagggtatca

SEQ ID NO: 115809 - DNA, 25 bp, E. coli
caggtccacagatgatgaaggcggt

SEQ ID NO: 115810 - DNA, 25 bp, E. coli
cagagggtatcaggtttgagcagaa

SEQ ID NO: 115811 - DNA, 25 bp, E. coli
cagagggtatcacgtttgagcagaa

SEQ ID NO: 115812 - DNA, 25 bp, E. coli
caggtccacagaagatgaaggcggt

SEQ ID NO: 115813 - DNA, 25 bp, E. coli
agtccggcgcaaatgcggcgttcag

SEQ ID NO: 115814 - DNA, 25 bp, E. coli
agtccggcgcaattgcggcgttcag

SEQ ID NO: 115815 - DNA, 25 bp, E. coli
tgagcagaacaagaacgtggtgatt

SEQ ID NO: 115816 - DNA, 25 bp, E. coli
tgatgaaatccaggcacagatgcgc

SEQ ID NO: 115817 - DNA, 25 bp, E. coli
tgagcagaacaacaacgtggtgatt

SEQ ID NO: 115818 - DNA, 25 bp, E. coli
tgatgaaatccacgcacagatgcgc

SEQ ID NO: 115819 - DNA, 25 bp, E. coli
tcaggtttgagcagaacaacaacgt

SEQ ID NO: 115820 - DNA, 25 bp, E. coli
tcaggtttgagctgaacaacaacgt

SEQ ID NO: 115821 - DNA, 25 bp, E. coli
gaatggtctgccaggtccacagatg

SEQ ID NO: 115822 - DNA, 25 bp, E. coli
gaacgacggtacgaatggtctgcca

SEQ ID NO: 115823 - DNA, 25 bp, E. coli
gaacgacggtaccaatggtctgcca

SEQ ID NO: 115824 - DNA, 25 bp, E. coli
gaatggtctgcctggtccacagatg

SEQ ID NO: 115825 - DNA, 25 bp, E. coli
gattcagaacgagggtacgaatggt

SEQ ID NO: 115826 - DNA, 25 bp, E. coli
gattcagaacgacggtacgaatggt

SEQ ID NO: 115827 - DNA, 25 bp, E. coli
tacgtcaatgatgagcctgatgcag

SEQ ID NO: 115828 - DNA, 25 bp, E. coli
tacctacgtcaaagatgagcctgat

SEQ ID NO: 115829 - DNA, 25 bp, E. coli
tacctacgtcaatgatgagcctgat

SEQ ID NO: 115830 - DNA, 25 bp, E. coli
acgtcaatgatgagcctgatgcaga

SEQ ID NO: 115831 - DNA, 25 bp, E. coli
acgtcaatgatgtgcctgatgcaga

SEQ ID NO: 115832 - DNA, 25 bp, E. coli
acctacgtcaatgatgagcctgatg

SEQ ID NO: 115833 - DNA, 25 bp, E. coli
acctacgtcaatcatgagcctgatg

SEQ ID NO: 115834 - DNA, 25 bp, E. coli
tacgtcaatgatcagcctgatgcag

SEQ ID NO: 115835 - DNA, 25 bp, E. coli
tattgagccgcgagtggctctgttg

SEQ ID NO: 115836 - DNA, 25 bp, E. coli
tattgagccgcgtgtggctctgttg

SEQ ID NO: 115837 - DNA, 25 bp, E. coli
tgtcactcaggaccaggcgcagcgt

SEQ ID NO: 115838 - DNA, 25 bp, E. coli
tgtcactcaggagcaggcgcagcgt

SEQ ID NO: 115839 - DNA, 25 bp, E. coli
cctacgtcaatgatgagcctgatgc

SEQ ID NO: 115840 - DNA, 25 bp, E. coli
cctacgtcaatgttgagcctgatgc

SEQ ID NO: 115841 - DNA, 25 bp, E. coli
cgtcaatgatgagcctgatgcagaa

SEQ ID NO: 115842 - DNA, 25 bp, E. coli
cgtcaatgatgaccctgatgcagaa

SEQ ID NO: 115843 - DNA, 25 bp, E. coli
ctacgtcaatgatgagcctgatgca

SEQ ID NO: 115844 - DNA, 25 bp, E. coli
ctacgtcaatgaagagcctgatgca

SEQ ID NO: 115845 - DNA, 25 bp, E. coli
gtattgagccgcctgtggctctgtt

SEQ ID NO: 115846 - DNA, 25 bp, E. coli
gtattgagccgcgtgtggctctgtt

SEQ ID NO: 115847 - DNA, 25 bp, E. coli
tcaatgatgagcgtgatgcagaaga

SEQ ID NO: 115848 - DNA, 25 bp, E. coli
tcaatgatgagcctgatgcagaaga

SEQ ID NO: 115849 - DNA, 25 bp, E. coli
caaaagattttgacgttctgacggg

SEQ ID NO: 115850 - DNA, 25 bp, E. coli
caaaagattttgtcgttctgacggg

SEQ ID NO: 115851 - DNA, 25 bp, E. coli
cagaccccggcacagaagaagggta

SEQ ID NO: 115852 - DNA, 25 bp, E. coli
cacttacctggtgaaagagcagaaa

SEQ ID NO: 115853 - DNA, 25 bp, E. coli
cacttacctggtcaaagagcagaaa

SEQ ID NO: 115854 - DNA, 25 bp, E. coli
cagatgcaggactacggtaaacccg

SEQ ID NO: 115855 - DNA, 25 bp, E. coli
cagaccccggcagagaagaagggta

SEQ ID NO: 115856 - DNA, 25 bp, E. coli
caggtcgatagcaacattaagggcg

SEQ ID NO: 115857 - DNA, 25 bp, E. coli
caggtcgatagctacattaagggcg

SEQ ID NO: 115858 - DNA, 25 bp, E. coli
cagatgcaggacaacggtaaacccg

SEQ ID NO: 115859 - DNA, 25 bp, E. coli
taaaccggcaaccttctaccagatg

SEQ ID NO: 115860 - DNA, 25 bp, E. coli
taaaccggcaacgttctaccagatg

SEQ ID NO: 115861 - DNA, 25 bp, E. coli
aaatgcaggctttcagcgacaaagg

SEQ ID NO: 115862 - DNA, 25 bp, E. coli
aaatgcaggcttacagcgacaaagg

SEQ ID NO: 115863 - DNA, 25 bp, E. coli
tgattgacggctacggtaaaccggc

SEQ ID NO: 115864 - DNA, 25 bp, E. coli
tgatatgcaagggaacgtggttacc

SEQ ID NO: 115865 - DNA, 25 bp, E. coli
tgattgacggcttcggtaaaccggc

SEQ ID NO: 115866 - DNA, 25 bp, E. coli
tgatatgcaaggcaacgtggttacc

SEQ ID NO: 115867 - DNA, 25 bp, E. coli
tgaaggtcacgcatcccagatgcac

SEQ ID NO: 115868 - DNA, 25 bp, E. coli
tgaaggtcacgcttcccagatgcac

SEQ ID NO: 115869 - DNA, 25 bp, E. coli
tgccgtcgcagcagcaggacaaaaa

SEQ ID NO: 115870 - DNA, 25 bp, E. coli
tgccgtcgcagctgcaggacaaaaa

SEQ ID NO: 115871 - DNA, 25 bp, E. coli
tacattaattcgctaggaatgcgtc

SEQ ID NO: 115872 - DNA, 25 bp, E. coli
tacattaattcggtaggaatgcgtc

SEQ ID NO: 115873 - DNA, 25 bp, E. coli
agaaattctgctgactcacccacta

SEQ ID NO: 115874 - DNA, 25 bp, E. coli
agaaattctgctcactcacccacta

SEQ ID NO: 115875 - DNA, 25 bp, E. coli
cgggcgactcgatcaggctatttcc

SEQ ID NO: 115876 - DNA, 25 bp, E. coli
cgggcgactcgaacaggctatttcc

SEQ ID NO: 115877 - DNA, 25 bp, E. coli
aaagccgtctggctgatgcccgtaa

SEQ ID NO: 115878 - DNA, 25 bp, E. coli
aaagccgtctgggtgatgcccgtaa

SEQ ID NO: 115879 - DNA, 25 bp, E. coli
ttcagggcgtaagcaactcaccagt

SEQ ID NO: 115880 - DNA, 25 bp, E. coli
ttcagggcgtaaccaactcaccagt

SEQ ID NO: 115881 - DNA, 25 bp, E. coli
tgatgcccgtaaccgtgccaatcag

SEQ ID NO: 115882 - DNA, 25 bp, E. coli
tgatgcccgtaagcgtgccaatcag

SEQ ID NO: 115883 - DNA, 25 bp, E. coli
gcccgatagtggtgcaatcgtcaga

SEQ ID NO: 115884 - DNA, 25 bp, E. coli
gcccgatagtggagcaatcgtcaga

SEQ ID NO: 115885 - DNA, 25 bp, E. coli
gccaatgacgctatcaatcgcctga

SEQ ID NO: 115886 - DNA, 25 bp, E. coli
ccactaccggaatgccgtctggctg

SEQ ID NO: 115887 - DNA, 25 bp, E. coli
gccaatgacgctttcaatcgcctga

SEQ ID NO: 115888 - DNA, 25 bp, E. coli
ccactaccggaaagccgtctggctg

SEQ ID NO: 115889 - DNA, 25 bp, E. coli
gctatttccttgttgagtagcgcca

SEQ ID NO: 115890 - DNA, 25 bp, E. coli
gctatttccttgatgagtagcgcca

SEQ ID NO: 115891 - DNA, 25 bp, E. coli
gggatgtacaattcagggcgtaacc

SEQ ID NO: 115892 - DNA, 25 bp, E. coli
gggatgtacaatacagggcgtaacc

SEQ ID NO: 115893 - DNA, 25 bp, E. coli
cactgctggcgtagctgattgctgg

SEQ ID NO: 115894 - DNA, 25 bp, E. coli
cactgctggcgttgctgattgctgg

SEQ ID NO: 115895 - DNA, 25 bp, E. coli
catcattcccggtgttgctgtaccg

SEQ ID NO: 115896 - DNA, 25 bp, E. coli
catcattcccggagttgctgtaccg

SEQ ID NO: 115897 - DNA, 25 bp, E. coli
tgcacgtttacatatcaacctcaaa

SEQ ID NO: 115898 - DNA, 25 bp, E. coli
tgcacgtttacaaatcaacctcaaa

SEQ ID NO: 115899 - DNA, 25 bp, E. coli
gctgattgctggaagcgaactggat

SEQ ID NO: 115900 - DNA, 25 bp, E. coli
gcgttgctgattgctggtagcgaac

SEQ ID NO: 115901 - DNA, 25 bp, E. coli
gctgattgctggtagcgaactggat

SEQ ID NO: 115902 - DNA, 25 bp, E. coli
gcgttgctgattcctggtagcgaac

SEQ ID NO: 115903 - DNA, 25 bp, E. coli
gaaggtgacagtcctttccgatcgc

SEQ ID NO: 115904 - DNA, 25 bp, E. coli
gaaggtgacagtgctttccgatcgc

SEQ ID NO: 115905 - DNA, 25 bp, E. coli
gaacagtgcacgattacaaatcaac

SEQ ID NO: 115906 - DNA, 25 bp, E. coli
gaacagtgcacgtttacaaatcaac

SEQ ID NO: 115907 - DNA, 25 bp, E. coli
ggtgaaggtgacagtgctttccgat

SEQ ID NO: 115908 - DNA, 25 bp, E. coli
gtgacagtgcttaccgatcgcacca

SEQ ID NO: 115909 - DNA, 25 bp, E. coli
ggtgttgctgtaccgctgtcgttaa

SEQ ID NO: 115910 - DNA, 25 bp, E. coli
gtgctttccgatcgcaccaccaata

SEQ ID NO: 115911 - DNA, 25 bp, E. coli
ggtgttgctgtagcgctgtcgttaa

SEQ ID NO: 115912 - DNA, 25 bp, E. coli
gtgctttccgatggcaccaccaata

SEQ ID NO: 115913 - DNA, 25 bp, E. coli
gtgacagtgctttccgatcgcacca

SEQ ID NO: 115914 - DNA, 25 bp, E. coli
ggtgaaggtgactgtgctttccgat

SEQ ID NO: 115915 - DNA, 25 bp, E. coli
caggctaaagctcctctggagtcca

SEQ ID NO: 115916 - DNA, 25 bp, E. coli
caggctaaagctgctctggagtcca

SEQ ID NO: 115917 - DNA, 25 bp, E. coli
tactgagtctctcaaagaaggcgat

SEQ ID NO: 115918 - DNA, 25 bp, E. coli
tactgagtctctgaaagaaggcgat

SEQ ID NO: 115919 - DNA, 25 bp, E. coli
aaaattgccgcacctaacgtaccgg

SEQ ID NO: 115920 - DNA, 25 bp, E. coli
aaaattgccgcagctaacgtaccgg

SEQ ID NO: 115921 - DNA, 25 bp, E. coli
taccggcatttgattctggcaaggc

SEQ ID NO: 115922 - DNA, 25 bp, E. coli
taccggcatttgtttctggcaaggc

SEQ ID NO: 115923 - DNA, 25 bp, E. coli
tgaaccaccgcggtgagcgtactgg

SEQ ID NO: 115924 - DNA, 25 bp, E. coli
tgaaccaccgcgctgagcgtactgg

SEQ ID NO: 115925 - DNA, 25 bp, E. coli
gaaggcgatgctgtacaactggttg

SEQ ID NO: 115926 - DNA, 25 bp, E. coli
gaaggcgatgctctacaactggttg

SEQ ID NO: 115927 - DNA, 25 bp, E. coli
gaactgtccaaaacccaggctaaag

SEQ ID NO: 115928 - DNA, 25 bp, E. coli
gaactgtccaaatcccaggctaaag

SEQ ID NO: 115929 - DNA, 25 bp, E. coli
ggtaccttcaaactgaaccaccgcg

SEQ ID NO: 115930 - DNA, 25 bp, E. coli
ggtaccttcaaagtgaaccaccgcg

SEQ ID NO: 115931 - DNA, 25 bp, E. coli
ggcactgaaagaggcagttaagtaa

SEQ ID NO: 115932 - DNA, 25 bp, E. coli
ggcactgaaagacgcagttaagtaa

SEQ ID NO: 115933 - DNA, 25 bp, E. coli
tggagtccactcaggctgcaattac

SEQ ID NO: 115934 - DNA, 25 bp, E. coli
tggagtccactctggctgcaattac

SEQ ID NO: 115935 - DNA, 25 bp, E. coli
taattgcagagaaagcagaactgtc

SEQ ID NO: 115936 - DNA, 25 bp, E. coli
taattgcagagatagcagaactgtc

SEQ ID NO: 115937 - DNA, 25 bp, E. coli
tacagagctgatggtgccaggaacg

SEQ ID NO: 115938 - DNA, 25 bp, E. coli
taaacgttggtatcagtcgtggcgc

SEQ ID NO: 115939 - DNA, 25 bp, E. coli
tacagagctgatcgtgccaggaacg

SEQ ID NO: 115940 - DNA, 25 bp, E. coli
taaacgttggtaacagtcgtggcgc

SEQ ID NO: 115941 - DNA, 25 bp, E. coli
agtcacgaccggatcaggcaatgcg

SEQ ID NO: 115942 - DNA, 25 bp, E. coli
agtcacgaccggttcaggcaatgcg

SEQ ID NO: 115943 - DNA, 25 bp, E. coli
aaagtgttaccgtccagccaggctt

SEQ ID NO: 115944 - DNA, 25 bp, E. coli
aaagtgttaccgaccagccaggctt

SEQ ID NO: 115945 - DNA, 25 bp, E. coli
tttgaagtcgtaaaacgcacctcgg

SEQ ID NO: 115946 - DNA, 25 bp, E. coli
tttgactatcccgatgctgcaggcg

SEQ ID NO: 115947 - DNA, 25 bp, E. coli
tttgaagtcgtataacgcacctcgg

SEQ ID NO: 115948 - DNA, 25 bp, E. coli
tttgactatccccatgctgcaggcg

SEQ ID NO: 115949 - DNA, 25 bp, E. coli
tgagatgatcccgaaactggcgcac

SEQ ID NO: 115950 - DNA, 25 bp, E. coli
tgagatgatccccaaactggcgcac

SEQ ID NO: 115951 - DNA, 25 bp, E. coli
gcttacatgacccatatcggcgcga

SEQ ID NO: 115952 - DNA, 25 bp, E. coli
gcttacatgaccgatatcggcgcga

SEQ ID NO: 115953 - DNA, 25 bp, E. coli
gattattctcgcaccgacttcaggg

SEQ ID NO: 115954 - DNA, 25 bp, E. coli
gattattctcgctccgacttcaggg

SEQ ID NO: 115955 - DNA, 25 bp, E. coli
gatatggtggtctagctggcgtcaa

SEQ ID NO: 115956 - DNA, 25 bp, E. coli
gatatggtggtcaagctggcgtcaa

SEQ ID NO: 115957 - DNA, 25 bp, E. coli
taacgtggtgatgctgctggttgcc

SEQ ID NO: 115958 - DNA, 25 bp, E. coli
taacgtggtgatcctgctggttgcc

SEQ ID NO: 115959 - DNA, 25 bp, E. coli
catgaaaaaagcagtatgtcgcgcg

SEQ ID NO: 115960 - DNA, 25 bp, E. coli
catggagtccacgattacaggcggc

SEQ ID NO: 115961 - DNA, 25 bp, E. coli
catgaaaaaagctgtatgtcgcgcg

SEQ ID NO: 115962 - DNA, 25 bp, E. coli
catggagtccaccattacaggcggc

SEQ ID NO: 115963 - DNA, 25 bp, E. coli
tacgtgaaggcttacccatgtgcag

SEQ ID NO: 115964 - DNA, 25 bp, E. coli
tacgtgaaggctaacccatgtgcag

SEQ ID NO: 115965 - DNA, 25 bp, E. coli
tacaggcggcgatcgaaaaagcaaa

SEQ ID NO: 115966 - DNA, 25 bp, E. coli
tacaggcggcgaacgaaaaagcaaa

SEQ ID NO: 115967 - DNA, 25 bp, E. coli
tatctgtgtgcagcgagggtttccg

SEQ ID NO: 115968 - DNA, 25 bp, E. coli
tatctgtgtgcaccgagggtttccg

SEQ ID NO: 115969 - DNA, 25 bp, E. coli
tctggtcacaaatccgaagggcaag

SEQ ID NO: 115970 - DNA, 25 bp, E. coli
tctggtcacaaaaccgaagggcaag

SEQ ID NO: 115971 - DNA, 25 bp, E. coli
gcaatcgaggatcgtttagccgcat

SEQ ID NO: 115972 - DNA, 25 bp, E. coli
gcaatcgaggatggtttagccgcat

SEQ ID NO: 115973 - DNA, 25 bp, E. coli
gaaacggttaacgatcgcgatcgcg

SEQ ID NO: 115974 - DNA, 25 bp, E. coli
gaaacggttaaccatcgcgatcgcg

SEQ ID NO: 115975 - DNA, 25 bp, E. coli
gatacatggacaaaagaggcgagca

SEQ ID NO: 115976 - DNA, 25 bp, E. coli
gatacatggacataagaggcgagca

SEQ ID NO: 115977 - DNA, 25 bp, E. coli
gggaaaaatttctcgccagcgccta

SEQ ID NO: 115978 - DNA, 25 bp, E. coli
gggaaaaatttcacgccagcgccta

SEQ ID NO: 115979 - DNA, 25 bp, E. coli
tcagactatgaaggaagcagccggg

SEQ ID NO: 115980 - DNA, 25 bp, E. coli
tcagactatgaacgaagcagccggg

SEQ ID NO: 115981 - DNA, 25 bp, E. coli
aatgtcgatcgccttcctgaagcgg

SEQ ID NO: 115982 - DNA, 25 bp, E. coli
aacgattgcgttgagtgccacgcca

SEQ ID NO: 115983 - DNA, 25 bp, E. coli
aatgtcgatcgcgttcctgaagcgg

SEQ ID NO: 115984 - DNA, 25 bp, E. coli
aacgattgcgttcagtgccacgcca

SEQ ID NO: 115985 - DNA, 25 bp, E. coli
ttacactcgtaaggattgcgttcag

SEQ ID NO: 115986 - DNA, 25 bp, E. coli
ttacactcgtaacgattgcgttcag

SEQ ID NO: 115987 - DNA, 25 bp, E. coli
tgcgcattactaattacactcgtaa

SEQ ID NO: 115988 - DNA, 25 bp, E. coli
tgcgcattactatttacactcgtaa

SEQ ID NO: 115989 - DNA, 25 bp, E. coli
gcgatcttagctggtctggtttccg

SEQ ID NO: 115990 - DNA, 25 bp, E. coli
gcgatcttagctcgtctggtttccg

SEQ ID NO: 115991 - DNA, 25 bp, E. coli
gaaatgattaatgtcgatcgcgttc

SEQ ID NO: 115992 - DNA, 25 bp, E. coli
gaaatgattaatctcgatcgcgttc

SEQ ID NO: 115993 - DNA, 25 bp, E. coli
cgtgctcagggcattcgtcagttgc

SEQ ID NO: 115994 - DNA, 25 bp, E. coli
cgtaacgattgcgttcagtgccacg

SEQ ID NO: 115995 - DNA, 25 bp, E. coli
cgtaacgattgccttcagtgccacg

SEQ ID NO: 115996 - DNA, 25 bp, E. coli
ctcagggctttcgtcagttgccggt

SEQ ID NO: 115997 - DNA, 25 bp, E. coli
cgtgctcagggctttcgtcagttgc

SEQ ID NO: 115998 - DNA, 25 bp, E. coli
ctcagggctttcctcagttgccggt

SEQ ID NO: 115999 - DNA, 25 bp, E. coli
gatcgcgttcctcaagcggcagaag

SEQ ID NO: 116000 - DNA, 25 bp, E. coli
gattaatgtcgaacgcgttcctgaa

SEQ ID NO: 116001 - DNA, 25 bp, E. coli
gatcgcgttcctgaagcggcagaag

SEQ ID NO: 116002 - DNA, 25 bp, E. coli
gattaatgtcgatcgcgttcctgaa

SEQ ID NO: 116003 - DNA, 25 bp, E. coli
cagcctggacgtccgagataatatt

SEQ ID NO: 116004 - DNA, 25 bp, E. coli
cagcctggacgtgcgagataatatt

SEQ ID NO: 116005 - DNA, 25 bp, E. coli
tatcgacacagtgggaattgagctc

SEQ ID NO: 116006 - DNA, 25 bp, E. coli
tatcgacacagtcggaattgagctc

SEQ ID NO: 116007 - DNA, 25 bp, E. coli
tcgaaacgcttacgcactggatgaa

SEQ ID NO: 116008 - DNA, 25 bp, E. coli
tcgaaacgcttaggcactggatgaa

SEQ ID NO: 116009 - DNA, 25 bp, E. coli
cctttcggcgcggagatgcaacgat

SEQ ID NO: 116010 - DNA, 25 bp, E. coli
cctttcggcgcgcagatgcaacgat

SEQ ID NO: 116011 - DNA, 25 bp, E. coli
gcttatgaggctcgtaactctccgg

SEQ ID NO: 116012 - DNA, 25 bp, E. coli
gcttatgaggctggtaactctccgg

SEQ ID NO: 116013 - DNA, 25 bp, E. coli
gctataccggaaccacctttcggcg

SEQ ID NO: 116014 - DNA, 25 bp, E. coli
gctataccggaagcacctttcggcg

SEQ ID NO: 116015 - DNA, 25 bp, E. coli
gaattgatccagcaagccagactgc

SEQ ID NO: 116016 - DNA, 25 bp, E. coli
gaattgatccaggaagccagactgc

SEQ ID NO: 116017 - DNA, 25 bp, E. coli
gactgccaagctctcattccaggaa

SEQ ID NO: 116018 - DNA, 25 bp, E. coli
gactgccaagctgtcattccaggaa

SEQ ID NO: 116019 - DNA, 25 bp, E. coli
cgacaattcgatcgagccgggaaat

SEQ ID NO: 116020 - DNA, 25 bp, E. coli
cgacaattcgatggagccgggaaat

SEQ ID NO: 116021 - DNA, 25 bp, E. coli
ggttgaaccgcttatatgctccgca

SEQ ID NO: 116022 - DNA, 25 bp, E. coli
ggttgaaccgctaatatgctccgca

SEQ ID NO: 116023 - DNA, 25 bp, E. coli
tcaaagagcgaatcggcagcctgga

SEQ ID NO: 116024 - DNA, 25 bp, E. coli
tcaaagagcgaaacggcagcctgga

SEQ ID NO: 116025 - DNA, 25 bp, E. coli
caatggaagcaacgcattacaggct

SEQ ID NO: 116026 - DNA, 25 bp, E. coli
caatggaagcaaggcattacaggct

SEQ ID NO: 116027 - DNA, 25 bp, E. coli
caaaatcctaaggagaaaaacgact

SEQ ID NO: 116028 - DNA, 25 bp, E. coli
caaaatcctaagcagaaaaacgact

SEQ ID NO: 116029 - DNA, 25 bp, E. coli
catgataatattaaaaacagacttt

SEQ ID NO: 116030 - DNA, 25 bp, E. coli
catgataatatttaaaacagacttt

SEQ ID NO: 116031 - DNA, 25 bp, E. coli
taacaaaatccttagcagaaaaacg

SEQ ID NO: 116032 - DNA, 25 bp, E. coli
taacaaaatcctaagcagaaaaacg

SEQ ID NO: 116033 - DNA, 25 bp, E. coli
aaatcgcccaaacattgctgttcgg

SEQ ID NO: 116034 - DNA, 25 bp, E. coli
aaacattgctgttcgggcgatcaaa

SEQ ID NO: 116035 - DNA, 25 bp, E. coli
aaacattgctgtacgggcgatcaaa

SEQ ID NO: 116036 - DNA, 25 bp, E. coli
aaatcgcccaaagattgctgttcgg

SEQ ID NO: 116037 - DNA, 25 bp, E. coli
tattatcgtaattaaaatcgcccaa

SEQ ID NO: 116038 - DNA, 25 bp, E. coli
tattatcgtaataaaaatcgcccaa

SEQ ID NO: 116039 - DNA, 25 bp, E. coli
ccaaacattgctgttcgggcgatca

SEQ ID NO: 116040 - DNA, 25 bp, E. coli
ccaaacattgctcttcgggcgatca

SEQ ID NO: 116041 - DNA, 25 bp, E. coli
gcagaaaaacgactttttataatat

SEQ ID NO: 116042 - DNA, 25 bp, E. coli
gcagaaaaacgagtttttataatat

SEQ ID NO: 116043 - DNA, 25 bp, E. coli
ccgcaatggaagcaaggcattacag

SEQ ID NO: 116044 - DNA, 25 bp, E. coli
ccgcaatggaaggaaggcattacag

SEQ ID NO: 116045 - DNA, 25 bp, E. coli
ggcattacaggcataatttaaataa

SEQ ID NO: 116046 - DNA, 25 bp, E. coli
ggcattacaggcttaatttaaataa

SEQ ID NO: 116047 - DNA, 25 bp, E. coli
caccggatacgccacgactggatat

SEQ ID NO: 116048 - DNA, 25 bp, E. coli
caccggatacgcgacgactggatat

SEQ ID NO: 116049 - DNA, 25 bp, E. coli
agctaccacgcattttagggttaca

SEQ ID NO: 116050 - DNA, 25 bp, E. coli
agctaccacgcaatttagggttaca

SEQ ID NO: 116051 - DNA, 25 bp, E. coli
aaattcaccgattctgagcaatatg

SEQ ID NO: 116052 - DNA, 25 bp, E. coli
aaattcaccgatactgagcaatatg

SEQ ID NO: 116053 - DNA, 25 bp, E. coli
ttgttcaccggatacgcgacgactg

SEQ ID NO: 116054 - DNA, 25 bp, E. coli
ttttgttcaccgcatacgcgacgac

SEQ ID NO: 116055 - DNA, 25 bp, E. coli
ttttgatagcttcaatgaatccggg

SEQ ID NO: 116056 - DNA, 25 bp, E. coli
ttttgttcaccggatacgcgacgac

SEQ ID NO: 116057 - DNA, 25 bp, E. coli
ttttgatagcttgaatgaatccggg

SEQ ID NO: 116058 - DNA, 25 bp, E. coli
ttgttcaccggaaacgcgacgactg

SEQ ID NO: 116059 - DNA, 25 bp, E. coli
tcgtcagctacctcgcaatttaggg

SEQ ID NO: 116060 - DNA, 25 bp, E. coli
tcgtcagctaccacgcaatttaggg

SEQ ID NO: 116061 - DNA, 25 bp, E. coli
gcgcgatatcgccgaaagaatgtat

SEQ ID NO: 116062 - DNA, 25 bp, E. coli
gcgcgatatcgcggaaagaatgtat

SEQ ID NO: 116063 - DNA, 25 bp, E. coli
cgtactttataaacacatttcgaca

SEQ ID NO: 116064 - DNA, 25 bp, E. coli
cgtactttataatcacatttcgaca

SEQ ID NO: 116065 - DNA, 25 bp, E. coli
ggtaaattcaccgatactgagcaat

SEQ ID NO: 116066 - DNA, 25 bp, E. coli
ggtaaattcacccatactgagcaat

SEQ ID NO: 116067 - DNA, 25 bp, E. coli
ggatacgcgacgtctggatatcgat

SEQ ID NO: 116068 - DNA, 25 bp, E. coli
ggatacgcgacgactggatatcgat

SEQ ID NO: 116069 - DNA, 25 bp, E. coli
agctttatcgcatggcgctggagcg

SEQ ID NO: 116070 - DNA, 25 bp, E. coli
agctttatcgcaaggcgctggagcg

SEQ ID NO: 116071 - DNA, 25 bp, E. coli
tattcctgcgctaggttgcttacaa

SEQ ID NO: 116072 - DNA, 25 bp, E. coli
tattcctgcgcttggttgcttacaa

SEQ ID NO: 116073 - DNA, 25 bp, E. coli
tttattgcgtgaagccgatcgggta

SEQ ID NO: 116074 - DNA, 25 bp, E. coli
tttattgcgtgatgccgatcgggta

SEQ ID NO: 116075 - DNA, 25 bp, E. coli
tgggattacgcatacttgtgccggt

SEQ ID NO: 116076 - DNA, 25 bp, E. coli
gcgtgcgcggtttctcatcaagtga

SEQ ID NO: 116077 - DNA, 25 bp, E. coli
gcgtgcgcggttactcatcaagtga

SEQ ID NO: 116078 - DNA, 25 bp, E. coli
gcaagagtccctgaaactgtcgtgg

SEQ ID NO: 116079 - DNA, 25 bp, E. coli
gaattttgaagtcctacacgccagc

SEQ ID NO: 116080 - DNA, 25 bp, E. coli
gaattttgaagtgctacacgccagc

SEQ ID NO: 116081 - DNA, 25 bp, E. coli
gcaagagtccctcaaactgtcgtgg

SEQ ID NO: 116082 - DNA, 25 bp, E. coli
gaaatcaattgccaagcgtgcgcgg

SEQ ID NO: 116083 - DNA, 25 bp, E. coli
gaaatcaattgcgaagcgtgcgcgg

SEQ ID NO: 116084 - DNA, 25 bp, E. coli
gttgtgatgaaagcggcaagagtcc

SEQ ID NO: 116085 - DNA, 25 bp, E. coli
tgttgcccggaaacggactattcct

SEQ ID NO: 116086 - DNA, 25 bp, E. coli
tgttgcccggaatcggactattcct

SEQ ID NO: 116087 - DNA, 25 bp, E. coli
gttgtgatgaaaccggcaagagtcc

SEQ ID NO: 116088 - DNA, 25 bp, E. coli
tgggattacgcaaacttgtgccggt

SEQ ID NO: 116089 - DNA, 25 bp, E. coli
ggcaatgtcgtaaaccacaggctta

SEQ ID NO: 116090 - DNA, 25 bp, E. coli
ggcaatgtcgtataccacaggctta

SEQ ID NO: 116091 - DNA, 25 bp, E. coli
cagatgtcgcagctgacagccatga

SEQ ID NO: 116092 - DNA, 25 bp, E. coli
cagatgtcgcaggtgacagccatga

SEQ ID NO: 116093 - DNA, 25 bp, E. coli
atgtcgcagctgtcagccatgacgg

SEQ ID NO: 116094 - DNA, 25 bp, E. coli
atgtcgcagctgacagccatgacgg

SEQ ID NO: 116095 - DNA, 25 bp, E. coli
agatgtcgcagcagacagccatgac

SEQ ID NO: 116096 - DNA, 25 bp, E. coli
agatgtcgcagctgacagccatgac

SEQ ID NO: 116097 - DNA, 25 bp, E. coli
tgtcgcagctgagagccatgacggc

SEQ ID NO: 116098 - DNA, 25 bp, E. coli
tgtcgcagctgacagccatgacggc

SEQ ID NO: 116099 - DNA, 25 bp, E. coli
gcagatgtcgcacctgacagccatg

SEQ ID NO: 116100 - DNA, 25 bp, E. coli
gcagatgtcgcagctgacagccatg

SEQ ID NO: 116101 - DNA, 25 bp, E. coli
gaatttcgttgccggcaatccggag

SEQ ID NO: 116102 - DNA, 25 bp, E. coli
gaatttcgttgcgggcaatccggag

SEQ ID NO: 116103 - DNA, 25 bp, E. coli
gcagctgacagccatgacggcctcg

SEQ ID NO: 116104 - DNA, 25 bp, E. coli
gcagctgacagcgatgacggcctcg

SEQ ID NO: 116105 - DNA, 25 bp, E. coli
cgttgcgggcaatccggaggcggac

SEQ ID NO: 116106 - DNA, 25 bp, E. coli
cgttgcgggcaaaccggaggcggac

SEQ ID NO: 116107 - DNA, 25 bp, E. coli
gtcgcagctgacagccatgacggcc

SEQ ID NO: 116108 - DNA, 25 bp, E. coli
gtcgcagctgactgccatgacggcc

SEQ ID NO: 116109 - DNA, 25 bp, E. coli
gatgtcgcagctcacagccatgacg

SEQ ID NO: 116110 - DNA, 25 bp, E. coli
gagcagatgtcgcagctgacagcca

SEQ ID NO: 116111 - DNA, 25 bp, E. coli
gagcagatgtcggagctgacagcca

SEQ ID NO: 116112 - DNA, 25 bp, E. coli
gatgtcgcagctgacagccatgacg

SEQ ID NO: 116113 - DNA, 25 bp, E. coli
cagaaagtctttttggtcgatcgct

SEQ ID NO: 116114 - DNA, 25 bp, E. coli
cagaaagtctttatggtcgatcgct

SEQ ID NO: 116115 - DNA, 25 bp, E. coli
taacgatccgctctatatgggctgg

SEQ ID NO: 116116 - DNA, 25 bp, E. coli
aaaaaatcgtctaccttggcgcagg

SEQ ID NO: 116117 - DNA, 25 bp, E. coli
aactgtcgctctataccgcctgtgg

SEQ ID NO: 116118 - DNA, 25 bp, E. coli
aactgtcgctctttaccgcctgtgg

SEQ ID NO: 116119 - DNA, 25 bp, E. coli
aaaaaatcgtcttccttggcgcagg

SEQ ID NO: 116120 - DNA, 25 bp, E. coli
tatgggctggcgtaatccgcgtatc

SEQ ID NO: 116121 - DNA, 25 bp, E. coli
tatgggctggcgaaatccgcgtatc

SEQ ID NO: 116122 - DNA, 25 bp, E. coli
ttatccaggctgagaaacaacgctg

SEQ ID NO: 116123 - DNA, 25 bp, E. coli
ttatccaggctgtgaaacaacgctg

SEQ ID NO: 116124 - DNA, 25 bp, E. coli
tgagatgcataaacactgtccgcgt

SEQ ID NO: 116125 - DNA, 25 bp, E. coli
tgagatgcataatcactgtccgcgt

SEQ ID NO: 116126 - DNA, 25 bp, E. coli
gatattcagaaagtctcccgcgcaa

SEQ ID NO: 116127 - DNA, 25 bp, E. coli
gatattcagaaactctcccgcgcaa

SEQ ID NO: 116128 - DNA, 25 bp, E. coli
ggcgcgtcacgtatcaccgatgaga

SEQ ID NO: 116129 - DNA, 25 bp, E. coli
ggcgcgtcacgtttcaccgatgaga

SEQ ID NO: 116130 - DNA, 25 bp, E. coli
taacgatccgctgtatatgggctgg

SEQ ID NO: 116131 - DNA, 25 bp, E. coli
tcagcatggaagaacgccgtaactt

SEQ ID NO: 116132 - DNA, 25 bp, E. coli
tcagcatggaagtacgccgtaactt

SEQ ID NO: 116133 - DNA, 25 bp, E. coli
gaccaaactggtgcagaagcgcgaa

SEQ ID NO: 116134 - DNA, 25 bp, E. coli
gaccaaactggtccagaagcgcgaa

SEQ ID NO: 116135 - DNA, 25 bp, E. coli
cactatgggatgagttaatgaacga

SEQ ID NO: 116136 - DNA, 25 bp, E. coli
cactatgggatgtgttaatgaacga

SEQ ID NO: 116137 - DNA, 25 bp, E. coli
tatcgtgactttagccaaacctttg

SEQ ID NO: 116138 - DNA, 25 bp, E. coli
tacgcgatctcgactcactatggga

SEQ ID NO: 116139 - DNA, 25 bp, E. coli
ttgagagtcaggaggatttttatcg

SEQ ID NO: 116140 - DNA, 25 bp, E. coli
ttgagagtcaggtggatttttatcg

SEQ ID NO: 116141 - DNA, 25 bp, E. coli
tatcgtgacttttgccaaacctttg

SEQ ID NO: 116142 - DNA, 25 bp, E. coli
tacgcgatctcgtctcactatggga

SEQ ID NO: 116143 - DNA, 25 bp, E. coli
tattgctgtttgatgaggcagagga

SEQ ID NO: 116144 - DNA, 25 bp, E. coli
tattgctgtttgttgaggcagagga

SEQ ID NO: 116145 - DNA, 25 bp, E. coli
tgttaatgaacgatgtcctgccgct

SEQ ID NO: 116146 - DNA, 25 bp, E. coli
tgttaatgaacgttgtcctgccgct

SEQ ID NO: 116147 - DNA, 25 bp, E. coli
tcatctgggagagaaaacgcgtcgc

SEQ ID NO: 116148 - DNA, 25 bp, E. coli
tcatctgggagacaaaacgcgtcgc

SEQ ID NO: 116149 - DNA, 25 bp, E. coli
cctgccgctaccacttgagattgaa

SEQ ID NO: 116150 - DNA, 25 bp, E. coli
cctgccgctacctcttgagattgaa

SEQ ID NO: 116151 - DNA, 25 bp, E. coli
ccaaacctttggactggcgaaagat

SEQ ID NO: 116152 - DNA, 25 bp, E. coli
ccaaacctttggtctggcgaaagat

SEQ ID NO: 116153 - DNA, 25 bp, E. coli
ccgttttggcgccttaatattgctg

SEQ ID NO: 116154 - DNA, 25 bp, E. coli
ccgttttggcgcgttaatattgctg

SEQ ID NO: 116155 - DNA, 25 bp, E. coli
tggcgaaagataaggtacgcgatct

SEQ ID NO: 116156 - DNA, 25 bp, E. coli
tggcgaaagatatggtacgcgatct

SEQ ID NO: 116157 - DNA, 25 bp, E. coli
cagatcgaagggatggacgtcaacc

SEQ ID NO: 116158 - DNA, 25 bp, E. coli
cagatcgaagggttggacgtcaacc

SEQ ID NO: 116159 - DNA, 25 bp, E. coli
catccactgcgcgacgggaaagtta

SEQ ID NO: 116160 - DNA, 25 bp, E. coli
catccactgcgccacgggaaagtta

SEQ ID NO: 116161 - DNA, 25 bp, E. coli
tacattcaggagaacgatacgccgg

SEQ ID NO: 116162 - DNA, 25 bp, E. coli
tacattcaggagtacgatacgccgg

SEQ ID NO: 116163 - DNA, 25 bp, E. coli
aaattcgatggaagaagtcgccgcg

SEQ ID NO: 116164 - DNA, 25 bp, E. coli
aaaatacctgtggacaaacgcctcg

SEQ ID NO: 116165 - DNA, 25 bp, E. coli
aaattcgatggatgaagtcgccgcg

SEQ ID NO: 116166 - DNA, 25 bp, E. coli
aaaatacctgtgcacaaacgcctcg

SEQ ID NO: 116167 - DNA, 25 bp, E. coli
tatgaatttgataacagcccgcagg

SEQ ID NO: 116168 - DNA, 25 bp, E. coli
tatgaatttgattacagcccgcagg

SEQ ID NO: 116169 - DNA, 25 bp, E. coli
tatgtggaagaagtcaaaggcccgg

SEQ ID NO: 116170 - DNA, 25 bp, E. coli
tatgtggaagaactcaaaggcccgg

SEQ ID NO: 116171 - DNA, 25 bp, E. coli
tgatgatcccggtaacccgcgagtt

SEQ ID NO: 116172 - DNA, 25 bp, E. coli
tgatgatcccggaaacccgcgagtt

SEQ ID NO: 116173 - DNA, 25 bp, E. coli
gatttatggcaaaacagcgaaacgc

SEQ ID NO: 116174 - DNA, 25 bp, E. coli
gatttatggcaatacagcgaaacgc

SEQ ID NO: 116175 - DNA, 25 bp, E. coli
tggaactggagcttaacacctggat

SEQ ID NO: 116176 - DNA, 25 bp, E. coli
tggaactggagcataacacctggat

SEQ ID NO: 116177 - DNA, 25 bp, E. coli
taaccccggtgtgttccattcagga

SEQ ID NO: 116178 - DNA, 25 bp, E. coli
taaccccggtgtcttccattcagga

SEQ ID NO: 116179 - DNA, 25 bp, E. coli
cagcggtacaccttttgagttgggc

SEQ ID NO: 116180 - DNA, 25 bp, E. coli
cagcggtacaccatttgagttgggc

SEQ ID NO: 116181 - DNA, 25 bp, E. coli
tgtgatgttactctgtgcgggcatt

SEQ ID NO: 116182 - DNA, 25 bp, E. coli
tgattgacccggcagcggtacacct

SEQ ID NO: 116183 - DNA, 25 bp, E. coli
tgtgatgttactgtgtgcgggcatt

SEQ ID NO: 116184 - DNA, 25 bp, E. coli
tgattgacccgggagcggtacacct

SEQ ID NO: 116185 - DNA, 25 bp, E. coli
tgccctgttgctcgtctattgcgcg

SEQ ID NO: 116186 - DNA, 25 bp, E. coli
tgccctgttgctggtctattgcgcg

SEQ ID NO: 116187 - DNA, 25 bp, E. coli
tcgtgcttgccctgttgctggtcta

SEQ ID NO: 116188 - DNA, 25 bp, E. coli
tcgtgcttgcccagttgctggtcta

SEQ ID NO: 116189 - DNA, 25 bp, E. coli
cctgttgctggtctattgcgcggta

SEQ ID NO: 116190 - DNA, 25 bp, E. coli
cctgttgctggtgtattgcgcggta

SEQ ID NO: 116191 - DNA, 25 bp, E. coli
ccttagctctgcaacgtcgcatgga

SEQ ID NO: 116192 - DNA, 25 bp, E. coli
ccttagctctgctacgtcgcatgga

SEQ ID NO: 116193 - DNA, 25 bp, E. coli
gctacgtcgcatcgatttcgtcaaa

SEQ ID NO: 116194 - DNA, 25 bp, E. coli
gctacgtcgcatggatttcgtcaaa

SEQ ID NO: 116195 - DNA, 25 bp, E. coli
cgcatggatttcgtcaaagtacccg

SEQ ID NO: 116196 - DNA, 25 bp, E. coli
cgcatggatttcctcaaagtacccg

SEQ ID NO: 116197 - DNA, 25 bp, E. coli
ctgggatttttgtttgtgatgttac

SEQ ID NO: 116198 - DNA, 25 bp, E. coli
ctgggatttttgattgtgatgttac

SEQ ID NO: 116199 - DNA, 25 bp, E. coli
gacccggcagcggtacaccttttga

SEQ ID NO: 116200 - DNA, 25 bp, E. coli
gacccggcagcgctacaccttttga

SEQ ID NO: 116201 - DNA, 25 bp, E. coli
taaacgatgtgatgaccgatatgca

SEQ ID NO: 116202 - DNA, 25 bp, E. coli
taaacgatgtgaagaccgatatgca

SEQ ID NO: 116203 - DNA, 25 bp, E. coli
atgagtgcgcgtccgcaggaatcac

SEQ ID NO: 116204 - DNA, 25 bp, E. coli
atgagtgcgcgtgcgcaggaatcac

SEQ ID NO: 116205 - DNA, 25 bp, E. coli
tgatgaccgatatgcaaaaagcctc

SEQ ID NO: 116206 - DNA, 25 bp, E. coli
tgatgaccgataagcaaaaagcctc

SEQ ID NO: 116207 - DNA, 25 bp, E. coli
ccagttacaggctacggcgatgagt

SEQ ID NO: 116208 - DNA, 25 bp, E. coli
ccagttacaggcaacggcgatgagt

SEQ ID NO: 116209 - DNA, 25 bp, E. coli
gcgtgcgcaggaatcactgccgcaa

SEQ ID NO: 116210 - DNA, 25 bp, E. coli
gcgtgcgcaggattcactgccgcaa

SEQ ID NO: 116211 - DNA, 25 bp, E. coli
gcaaaaagcctctgtttctatgcaa

SEQ ID NO: 116212 - DNA, 25 bp, E. coli
gcaaaaagcctcagtttctatgcaa

SEQ ID NO: 116213 - DNA, 25 bp, E. coli
cccgcacgcaggcagaaaaattcac

SEQ ID NO: 116214 - DNA, 25 bp, E. coli
cccgcacgcagggagaaaaattcac

SEQ ID NO: 116215 - DNA, 25 bp, E. coli
cgaccattagttatgccgggcagct

SEQ ID NO: 116216 - DNA, 25 bp, E. coli
cgaccattagttttgccgggcagct

SEQ ID NO: 116217 - DNA, 25 bp, E. coli
ggttatcagccagttacaggctacg

SEQ ID NO: 116218 - DNA, 25 bp, E. coli
ggttatcagccacttacaggctacg

SEQ ID NO: 116219 - DNA, 25 bp, E. coli
tcactgccgcaaccgaccattagtt

SEQ ID NO: 116220 - DNA, 25 bp, E. coli
tcactgccgcaagcgaccattagtt

SEQ ID NO: 116221 - DNA, 25 bp, E. coli
gaccgatatgcaaaaagcctcagtt

SEQ ID NO: 116222 - DNA, 25 bp, E. coli
gaccgatatgcataaagcctcagtt

SEQ ID NO: 116223 - DNA, 25 bp, E. coli
caacttggtcatagtaattttcgcg

SEQ ID NO: 116224 - DNA, 25 bp, E. coli
caacttggtcattgtaattttcgcg

SEQ ID NO: 116225 - DNA, 25 bp, E. coli
cacttttcagctgcaaatctcatgg

SEQ ID NO: 116226 - DNA, 25 bp, E. coli
caacggatgatatgatcaaagcaaa

SEQ ID NO: 116227 - DNA, 25 bp, E. coli
cacttttcagctccaaatctcatgg

SEQ ID NO: 116228 - DNA, 25 bp, E. coli
caacggatgataagatcaaagcaaa

SEQ ID NO: 116229 - DNA, 25 bp, E. coli
catggtaaatatgcgcttttcccca

SEQ ID NO: 116230 - DNA, 25 bp, E. coli
catggtaaatatccgcttttcccca

SEQ ID NO: 116231 - DNA, 25 bp, E. coli
tattttggaatgtagatctcgatgg

SEQ ID NO: 116232 - DNA, 25 bp, E. coli
tattttggaatgaagatctcgatgg

SEQ ID NO: 116233 - DNA, 25 bp, E. coli
gcgagctcatcgaataatgaataag

SEQ ID NO: 116234 - DNA, 25 bp, E. coli
gcgagctcatcgtataatgaataag

SEQ ID NO: 116235 - DNA, 25 bp, E. coli
gaatgcgcttgctattttctgatgg

SEQ ID NO: 116236 - DNA, 25 bp, E. coli
gaatgcgcttgcaattttctgatgg

SEQ ID NO: 116237 - DNA, 25 bp, E. coli
gattgatacattcccagataatgca

SEQ ID NO: 116238 - DNA, 25 bp, E. coli
gattgatacattgccagataatgca

SEQ ID NO: 116239 - DNA, 25 bp, E. coli
gatcaggccttacgatcaacggatg

SEQ ID NO: 116240 - DNA, 25 bp, E. coli
gatcaggccttaggatcaacggatg

SEQ ID NO: 116241 - DNA, 25 bp, E. coli
ggtgaatgtgtccatttcagcaaaa

SEQ ID NO: 116242 - DNA, 25 bp, E. coli
ggtgaatgtgtcgatttcagcaaaa

SEQ ID NO: 116243 - DNA, 25 bp, E. coli
gagcagagtttcagtctgccaaaga

SEQ ID NO: 116244 - DNA, 25 bp, E. coli
gagcagagtttctgtctgccaaaga

SEQ ID NO: 116245 - DNA, 25 bp, E. coli
cacgggcagtcggttacagcacaac

SEQ ID NO: 116246 - DNA, 25 bp, E. coli
cacgggcagtcgcttacagcacaac

SEQ ID NO: 116247 - DNA, 25 bp, E. coli
atgatggccgtgtacacgggcagtc

SEQ ID NO: 116248 - DNA, 25 bp, E. coli
atggccgtgaactcgggcagtcgct

SEQ ID NO: 116249 - DNA, 25 bp, E. coli
atggccgtgaacacgggcagtcgct

SEQ ID NO: 116250 - DNA, 25 bp, E. coli
atgatggccgtgaacacgggcagtc

SEQ ID NO: 116251 - DNA, 25 bp, E. coli
aacacgggcagtcgcttacagcaca

SEQ ID NO: 116252 - DNA, 25 bp, E. coli
aacacgggcagtggcttacagcaca

SEQ ID NO: 116253 - DNA, 25 bp, E. coli
tatactaaaaaatcttatgcagcgt

SEQ ID NO: 116254 - DNA, 25 bp, E. coli
tatactaaaaaaacttatgcagcgt

SEQ ID NO: 116255 - DNA, 25 bp, E. coli
tgatggccgtgaacacgggcagtcg

SEQ ID NO: 116256 - DNA, 25 bp, E. coli
tgaacacgggcactcgcttacagca

SEQ ID NO: 116257 - DNA, 25 bp, E. coli
tgaacacgggcagtcgcttacagca

SEQ ID NO: 116258 - DNA, 25 bp, E. coli
tgatggccgtgatcacgggcagtcg

SEQ ID NO: 116259 - DNA, 25 bp, E. coli
cgggcagtcgcttacagcacaactg

SEQ ID NO: 116260 - DNA, 25 bp, E. coli
cgggcagtcgctaacagcacaactg

SEQ ID NO: 116261 - DNA, 25 bp, E. coli
gtgaacacgggcagtcgcttacagc

SEQ ID NO: 116262 - DNA, 25 bp, E. coli
gtgaacacgggctgtcgcttacagc

SEQ ID NO: 116263 - DNA, 25 bp, E. coli
ggccgtgaacaccggcagtcgctta

SEQ ID NO: 116264 - DNA, 25 bp, E. coli
ggccgtgaacacgggcagtcgctta

SEQ ID NO: 116265 - DNA, 25 bp, E. coli
gatggccgtgaagacgggcagtcgc

SEQ ID NO: 116266 - DNA, 25 bp, E. coli
gatggccgtgaacacgggcagtcgc

SEQ ID NO: 116267 - DNA, 25 bp, E. coli
caaataactgtttcggtcaggtatc

SEQ ID NO: 116268 - DNA, 25 bp, E. coli
cagacggattaatgcaggagatcga

SEQ ID NO: 116269 - DNA, 25 bp, E. coli
caaataactgttacggtcaggtatc

SEQ ID NO: 116270 - DNA, 25 bp, E. coli
cagggactgccgaattcgctcaaat

SEQ ID NO: 116271 - DNA, 25 bp, E. coli
cagggactgccgtattcgctcaaat

SEQ ID NO: 116272 - DNA, 25 bp, E. coli
cagacggattaaagcaggagatcga

SEQ ID NO: 116273 - DNA, 25 bp, E. coli
agggactgccgttttcgctcaaata

SEQ ID NO: 116274 - DNA, 25 bp, E. coli
agacggattaatgcaggagatcgaa

SEQ ID NO: 116275 - DNA, 25 bp, E. coli
gtcgacgttttacagacggattaat

SEQ ID NO: 116276 - DNA, 25 bp, E. coli
agggactgccgtattcgctcaaata

SEQ ID NO: 116277 - DNA, 25 bp, E. coli
agacggattaatccaggagatcgaa

SEQ ID NO: 116278 - DNA, 25 bp, E. coli
gtcgacgttttagagacggattaat

SEQ ID NO: 116279 - DNA, 25 bp, E. coli
tcaggtatcccgtcgtgaccaggag

SEQ ID NO: 116280 - DNA, 25 bp, E. coli
tcaggtatcccgacgtgaccaggag

SEQ ID NO: 116281 - DNA, 25 bp, E. coli
gacggattaatgcaggagatcgaaa

SEQ ID NO: 116282 - DNA, 25 bp, E. coli
gacggattaatggaggagatcgaaa

SEQ ID NO: 116283 - DNA, 25 bp, E. coli
gggactgccgtattcgctcaaataa

SEQ ID NO: 116284 - DNA, 25 bp, E. coli
ggactgccgtattcgctcaaataac

SEQ ID NO: 116285 - DNA, 25 bp, E. coli
gggactgccgtaatcgctcaaataa

SEQ ID NO: 116286 - DNA, 25 bp, E. coli
ggactgccgtatacgctcaaataac

SEQ ID NO: 116287 - DNA, 25 bp, E. coli
taactgttacggtcaggtatcccgt

SEQ ID NO: 116288 - DNA, 25 bp, E. coli
taactgttacggacaggtatcccgt

SEQ ID NO: 116289 - DNA, 25 bp, E. coli
cagaagtgttgtatcgcccgctgga

SEQ ID NO: 116290 - DNA, 25 bp, E. coli
caaaaacgcgtcgagccagtggttc

SEQ ID NO: 116291 - DNA, 25 bp, E. coli
caaaaacgcgtccagccagtggttc

SEQ ID NO: 116292 - DNA, 25 bp, E. coli
cagtgcaactctacccgtggctgga

SEQ ID NO: 116293 - DNA, 25 bp, E. coli
cagaagtgttgtttcgcccgctgga

SEQ ID NO: 116294 - DNA, 25 bp, E. coli
cagtgcaactcttcccgtggctgga

SEQ ID NO: 116295 - DNA, 25 bp, E. coli
actacgttaaactgcgcgactggcg

SEQ ID NO: 116296 - DNA, 25 bp, E. coli
actacgttaaacagcgcgactggcg

SEQ ID NO: 116297 - DNA, 25 bp, E. coli
tctgcttagctttctggcgctgggc

SEQ ID NO: 116298 - DNA, 25 bp, E. coli
tctgcttagcttactggcgctgggc

SEQ ID NO: 116299 - DNA, 25 bp, E. coli
gcctgaaaaatcttctcgccggaga

SEQ ID NO: 116300 - DNA, 25 bp, E. coli
gcctgaaaaatcatctcgccggaga

SEQ ID NO: 116301 - DNA, 25 bp, E. coli
gaaaaatccgctctgttcagccagt

SEQ ID NO: 116302 - DNA, 25 bp, E. coli
gaaaaatccgctgtgttcagccagt

SEQ ID NO: 116303 - DNA, 25 bp, E. coli
cgtggctggaaacaacgctgcgcta

SEQ ID NO: 116304 - DNA, 25 bp, E. coli
cgtggctggaaagaacgctgcgcta

SEQ ID NO: 116305 - DNA, 25 bp, E. coli
gattgggccgacgttaaccttagct

SEQ ID NO: 116306 - DNA, 25 bp, E. coli
gattgggccgaccttaaccttagct

SEQ ID NO: 116307 - DNA, 25 bp, E. coli
ggaaaatcgcctaaacatgccgcag

SEQ ID NO: 116308 - DNA, 25 bp, E. coli
ggaaaatcgccttaacatgccgcag

SEQ ID NO: 116309 - DNA, 25 bp, E. coli
gagcagggctggtatatcgacaaat

SEQ ID NO: 116310 - DNA, 25 bp, E. coli
gagcagggctggaatatcgacaaat

SEQ ID NO: 116311 - DNA, 25 bp, E. coli
atttgagtgggctaatcttcgccgt

SEQ ID NO: 116312 - DNA, 25 bp, E. coli
atttgagtgggcaaatcttcgccgt

SEQ ID NO: 116313 - DNA, 25 bp, E. coli
aaagacttcgctatttatgacggat

SEQ ID NO: 116314 - DNA, 25 bp, E. coli
aaagacttcgctttttatgacggat

SEQ ID NO: 116315 - DNA, 25 bp, E. coli
aaactgaaaagtgatttgagtgggc

SEQ ID NO: 116316 - DNA, 25 bp, E. coli
aaactgaaaagtcatttgagtgggc

SEQ ID NO: 116317 - DNA, 25 bp, E. coli
tatttcacagtaacggtcaaatgac

SEQ ID NO: 116318 - DNA, 25 bp, E. coli
tatttcacagtatcggtcaaatgac

SEQ ID NO: 116319 - DNA, 25 bp, E. coli
tttatgacggattcaggaaactgaa

SEQ ID NO: 116320 - DNA, 25 bp, E. coli
tttatgacggatacaggaaactgaa

SEQ ID NO: 116321 - DNA, 25 bp, E. coli
gaaatgtcacaataaagacttcgct

SEQ ID NO: 116322 - DNA, 25 bp, E. coli
gaaatgtcacaaaaaagacttcgct

SEQ ID NO: 116323 - DNA, 25 bp, E. coli
ccgttacactcaaaggcggcgcggt

SEQ ID NO: 116324 - DNA, 25 bp, E. coli
ccgttacactcataggcggcgcggt

SEQ ID NO: 116325 - DNA, 25 bp, E. coli
gatccgcaattgaatcgaaatgtca

SEQ ID NO: 116326 - DNA, 25 bp, E. coli
ggtcaaatgactttctccagaaata

SEQ ID NO: 116327 - DNA, 25 bp, E. coli
ggtcaaatgactatctccagaaata

SEQ ID NO: 116328 - DNA, 25 bp, E. coli
ggcgcggtgggatcgatatttcaca

SEQ ID NO: 116329 - DNA, 25 bp, E. coli
ggcgcggtgggaacgatatttcaca

SEQ ID NO: 116330 - DNA, 25 bp, E. coli
taatcttcgccgatacactcaaagg

SEQ ID NO: 116331 - DNA, 25 bp, E. coli
taatcttcgccgttacactcaaagg

SEQ ID NO: 116332 - DNA, 25 bp, E. coli
gatccgcaattgtatcgaaatgtca

SEQ ID NO: 116333 - DNA, 25 bp, E. coli
aagcgggtttgcagacacttgagga

SEQ ID NO: 116334 - DNA, 25 bp, E. coli
cacttgaggatgtttacagcaaact

SEQ ID NO: 116335 - DNA, 25 bp, E. coli
cacttgaggatgattacagcaaact

SEQ ID NO: 116336 - DNA, 25 bp, E. coli
tatcaacaaccgttcgccgggcaat

SEQ ID NO: 116337 - DNA, 25 bp, E. coli
taaagtaacggtgcatatgtctgct

SEQ ID NO: 116338 - DNA, 25 bp, E. coli
tatcaacaaccgatcgccgggcaat

SEQ ID NO: 116339 - DNA, 25 bp, E. coli
taaagtaacggtccatatgtctgct

SEQ ID NO: 116340 - DNA, 25 bp, E. coli
agcatttcctgatacggctgccgcg

SEQ ID NO: 116341 - DNA, 25 bp, E. coli
agcatttcctgaaacggctgccgcg

SEQ ID NO: 116342 - DNA, 25 bp, E. coli
acactccccgtgaatgttattaggc

SEQ ID NO: 116343 - DNA, 25 bp, E. coli
aagcgggtttgctgacacttgagga

SEQ ID NO: 116344 - DNA, 25 bp, E. coli
acactccccgtgtatgttattaggc

SEQ ID NO: 116345 - DNA, 25 bp, E. coli
tttgctcagcaacgtcgcatcgtcg

SEQ ID NO: 116346 - DNA, 25 bp, E. coli
tttgctcagcaaggtcgcatcgtcg

SEQ ID NO: 116347 - DNA, 25 bp, E. coli
tcatggcgttacagtcgtggaatac

SEQ ID NO: 116348 - DNA, 25 bp, E. coli
tcatggcgttactgtcgtggaatac

SEQ ID NO: 116349 - DNA, 25 bp, E. coli
gcctgtctcgttatgcgccgtatct

SEQ ID NO: 116350 - DNA, 25 bp, E. coli
gcctgtctcgttttgcgccgtatct

SEQ ID NO: 116351 - DNA, 25 bp, E. coli
cgcccgcatcgggtttaaagtaacg

SEQ ID NO: 116352 - DNA, 25 bp, E. coli
cgcccgcatcggctttaaagtaacg

SEQ ID NO: 116353 - DNA, 25 bp, E. coli
gatcgccgggcaattgctactaaaa

SEQ ID NO: 116354 - DNA, 25 bp, E. coli
gatcgccgggcatttgctactaaaa

SEQ ID NO: 116355 - DNA, 25 bp, E. coli
cagggtgagtaccaactgaataccg

SEQ ID NO: 116356 - DNA, 25 bp, E. coli
cagggtgagtacgaactgaataccg

SEQ ID NO: 116357 - DNA, 25 bp, E. coli
tacgaactgaataccggcaaagtaa

SEQ ID NO: 116358 - DNA, 25 bp, E. coli
tacgaactgaattccggcaaagtaa

SEQ ID NO: 116359 - DNA, 25 bp, E. coli
acatcccgtgcacgcgcggattaag

SEQ ID NO: 116360 - DNA, 25 bp, E. coli
acatcccgtgcaggcgcggattaag

SEQ ID NO: 116361 - DNA, 25 bp, E. coli
tagtattaacccacaactgaatcac

SEQ ID NO: 116362 - DNA, 25 bp, E. coli
tagtattaaccctcaactgaatcac

SEQ ID NO: 116363 - DNA, 25 bp, E. coli
tgagtacgaactcaataccggcaaa

SEQ ID NO: 116364 - DNA, 25 bp, E. coli
tgagtacgaactgaataccggcaaa

SEQ ID NO: 116365 - DNA, 25 bp, E. coli
tgcgcgtagtataaacccacaactg

SEQ ID NO: 116366 - DNA, 25 bp, E. coli
tgcgcgtagtattaacccacaactg

SEQ ID NO: 116367 - DNA, 25 bp, E. coli
gcgtagtattaagccacaactgaat

SEQ ID NO: 116368 - DNA, 25 bp, E. coli
gcgtagtattaacccacaactgaat

SEQ ID NO: 116369 - DNA, 25 bp, E. coli
tggaggcggcataatgcaaaagctg

SEQ ID NO: 116370 - DNA, 25 bp, E. coli
ggcataatgcaaaagctgaaacagc

SEQ ID NO: 116371 - DNA, 25 bp, E. coli
tggaggcggcattatgcaaaagctg

SEQ ID NO: 116372 - DNA, 25 bp, E. coli
ggcataatgcaatagctgaaacagc

SEQ ID NO: 116373 - DNA, 25 bp, E. coli
taatgcaaaagcagaaacagcaggt

SEQ ID NO: 116374 - DNA, 25 bp, E. coli
taatgcaaaagctgaaacagcaggt

SEQ ID NO: 116375 - DNA, 25 bp, E. coli
gagtatcgcccgacttctgacaccg

SEQ ID NO: 116376 - DNA, 25 bp, E. coli
gagtatcgcccgtcttctgacaccg

SEQ ID NO: 116377 - DNA, 25 bp, E. coli
caagtggatctgtccgcgaaccagt

SEQ ID NO: 116378 - DNA, 25 bp, E. coli
caagtggatctgaccgcgaaccagt

SEQ ID NO: 116379 - DNA, 25 bp, E. coli
ttgttgcgctaaccctgctgatggc

SEQ ID NO: 116380 - DNA, 25 bp, E. coli
ttgttgcgctaagcctgctgatggc

SEQ ID NO: 116381 - DNA, 25 bp, E. coli
tgacccgtatgatgtgcgctaaccc

SEQ ID NO: 116382 - DNA, 25 bp, E. coli
tgacccgtatgaagtgcgctaaccc

SEQ ID NO: 116383 - DNA, 25 bp, E. coli
tgctggaaagcgaaaacggtaagcc

SEQ ID NO: 116384 - DNA, 25 bp, E. coli
tgctggaaagcgtaaacggtaagcc

SEQ ID NO: 116385 - DNA, 25 bp, E. coli
ccaaagggctggcaatgacccgtat

SEQ ID NO: 116386 - DNA, 25 bp, E. coli
ccaaagggctgggaatgacccgtat

SEQ ID NO: 116387 - DNA, 25 bp, E. coli
gctttagcggtgtaggcaaactgtc

SEQ ID NO: 116388 - DNA, 25 bp, E. coli
gctttagcggtgaaggcaaactgtc

SEQ ID NO: 116389 - DNA, 25 bp, E. coli
gctaacccgcagcttaatgaactcg

SEQ ID NO: 116390 - DNA, 25 bp, E. coli
gctaacccgcaggttaatgaactcg

SEQ ID NO: 116391 - DNA, 25 bp, E. coli
gacattaacttaaaagctggcggat

SEQ ID NO: 116392 - DNA, 25 bp, E. coli
gacattaacttataagctggcggat

SEQ ID NO: 116393 - DNA, 25 bp, E. coli
ctgaaagaaggtccacaagtggatc

SEQ ID NO: 116394 - DNA, 25 bp, E. coli
ctgaaagaaggtgcacaagtggatc

SEQ ID NO: 116395 - DNA, 25 bp, E. coli
gatttccggcaggatgtgtaaccgc

SEQ ID NO: 116396 - DNA, 25 bp, E. coli
gatttccggcagcatgtgtaaccgc

SEQ ID NO: 116397 - DNA, 25 bp, E. coli
ggcaaactgtcttatggtgaactga

SEQ ID NO: 116398 - DNA, 25 bp, E. coli
ggcaaactgtctaatggtgaactga

SEQ ID NO: 116399 - DNA, 25 bp, E. coli
caacgagcgtttttctgcactggcg

SEQ ID NO: 116400 - DNA, 25 bp, E. coli
caacgagcgtttatctgcactggcg

SEQ ID NO: 116401 - DNA, 25 bp, E. coli
catcatcaacgaaattctggcggga

SEQ ID NO: 116402 - DNA, 25 bp, E. coli
catcatcaacgatattctggcggga

SEQ ID NO: 116403 - DNA, 25 bp, E. coli
tggtggtggattacgcgcatacgcc

SEQ ID NO: 116404 - DNA, 25 bp, E. coli
tggtggtggatttcgcgcatacgcc

SEQ ID NO: 116405 - DNA, 25 bp, E. coli
tgaactatcacgtcagcggtgcgac

SEQ ID NO: 116406 - DNA, 25 bp, E. coli
tgaactatcacgacagcggtgcgac

SEQ ID NO: 116407 - DNA, 25 bp, E. coli
gactactccgatggcgtcacggtgg

SEQ ID NO: 116408 - DNA, 25 bp, E. coli
gaactgtcacggtcgctggttgaaa

SEQ ID NO: 116409 - DNA, 25 bp, E. coli
gacttgcgccgttatgcaggctaaa

SEQ ID NO: 116410 - DNA, 25 bp, E. coli
gactactccgatcgcgtcacggtgg

SEQ ID NO: 116411 - DNA, 25 bp, E. coli
gacttgcgccgtaatgcaggctaaa

SEQ ID NO: 116412 - DNA, 25 bp, E. coli
gaactgtcacggacgctggttgaaa

SEQ ID NO: 116413 - DNA, 25 bp, E. coli
gattgttggcaaacagcgtctggac

SEQ ID NO: 116414 - DNA, 25 bp, E. coli
gattgttggcaatcagcgtctggac

SEQ ID NO: 116415 - DNA, 25 bp, E. coli
tggaaaaagccttacaggcggcgcg

SEQ ID NO: 116416 - DNA, 25 bp, E. coli
tggaaaaagcctaacaggcggcgcg

SEQ ID NO: 116417 - DNA, 25 bp, E. coli
taatttgcgcgaccttcttgctccg

SEQ ID NO: 116418 - DNA, 25 bp, E. coli
taatttgcgcgagcttcttgctccg

SEQ ID NO: 116419 - DNA, 25 bp, E. coli
gagatgacactcgacagccgtgtgg

SEQ ID NO: 116420 - DNA, 25 bp, E. coli
gagatgacactccacagccgtgtgg

SEQ ID NO: 116421 - DNA, 25 bp, E. coli
aatcaactttcggacacccgctggg

SEQ ID NO: 116422 - DNA, 25 bp, E. coli
aatcaactttcgcacacccgctggg

SEQ ID NO: 116423 - DNA, 25 bp, E. coli
aagataattttgtgcgcggacgacc

SEQ ID NO: 116424 - DNA, 25 bp, E. coli
aagataattttgagcgcggacgacc

SEQ ID NO: 116425 - DNA, 25 bp, E. coli
taaagccagcgcgatgtttgtcagc

SEQ ID NO: 116426 - DNA, 25 bp, E. coli
taaagccagcgccatgtttgtcagc

SEQ ID NO: 116427 - DNA, 25 bp, E. coli
gcttataacggcacactggctggct

SEQ ID NO: 116428 - DNA, 25 bp, E. coli
gcttataacggctcactggctggct

SEQ ID NO: 116429 - DNA, 25 bp, E. coli
cccctggctcagtggatcgaagaaa

SEQ ID NO: 116430 - DNA, 25 bp, E. coli
cccctggctcagaggatcgaagaaa

SEQ ID NO: 116431 - DNA, 25 bp, E. coli
cggttgtggaaagatctgcatcgca

SEQ ID NO: 116432 - DNA, 25 bp, E. coli
cttttcatcgcgcacaccaggctgt

SEQ ID NO: 116433 - DNA, 25 bp, E. coli
cggttgtggaaacatctgcatcgca

SEQ ID NO: 116434 - DNA, 25 bp, E. coli
cttttcatcgcggacaccaggctgt

SEQ ID NO: 116435 - DNA, 25 bp, E. coli
gtaatgttgcacaccgtaccgggca

SEQ ID NO: 116436 - DNA, 25 bp, E. coli
gtaatgttgcactccgtaccgggca

SEQ ID NO: 116437 - DNA, 25 bp, E. coli
ggtatacacacatgccaccaggagt

SEQ ID NO: 116438 - DNA, 25 bp, E. coli
ggtatacacacaagccaccaggagt

SEQ ID NO: 116439 - DNA, 25 bp, E. coli
ggcaaatcgctaaggacggttcgca

SEQ ID NO: 116440 - DNA, 25 bp, E. coli
ggcaaatcgctatggacggttcgca

SEQ ID NO: 116441 - DNA, 25 bp, E. coli
gatgccgcccactatgatcaggtaa

SEQ ID NO: 116442 - DNA, 25 bp, E. coli
gatgccgcccacaatgatcaggtaa

SEQ ID NO: 116443 - DNA, 25 bp, E. coli
caaactcattggcactgggaaccgc

SEQ ID NO: 116444 - DNA, 25 bp, E. coli
caaactcattgggactgggaaccgc

SEQ ID NO: 116445 - DNA, 25 bp, E. coli
catgggaacgtgaggacttcgctac

SEQ ID NO: 116446 - DNA, 25 bp, E. coli
catgggaacgtgtggacttcgctac

SEQ ID NO: 116447 - DNA, 25 bp, E. coli
aagaaattaccctcgctggagtggc

SEQ ID NO: 116448 - DNA, 25 bp, E. coli
aagaaattacccacgctggagtggc

SEQ ID NO: 116449 - DNA, 25 bp, E. coli
tattttgccgcatcggaactggctc

SEQ ID NO: 116450 - DNA, 25 bp, E. coli
tatatcggcgcttctgactcggcaa

SEQ ID NO: 116451 - DNA, 25 bp, E. coli
tatatcggcgctactgactcggcaa

SEQ ID NO: 116452 - DNA, 25 bp, E. coli
tattttgccgcaacggaactggctc

SEQ ID NO: 116453 - DNA, 25 bp, E. coli
tgtttaaagcccaccatgcaccgta

SEQ ID NO: 116454 - DNA, 25 bp, E. coli
tgtttaaagccctccatgcaccgta

SEQ ID NO: 116455 - DNA, 25 bp, E. coli
tcgcaaccgacagtagcagaacagg

SEQ ID NO: 116456 - DNA, 25 bp, E. coli
tcgccgctgggaatttgacacatat

SEQ ID NO: 116457 - DNA, 25 bp, E. coli
tcgcaaccgacactagcagaacagg

SEQ ID NO: 116458 - DNA, 25 bp, E. coli
tcgccgctgggattttgacacatat

SEQ ID NO: 116459 - DNA, 25 bp, E. coli
gaatttctcagctaagagccgcata

SEQ ID NO: 116460 - DNA, 25 bp, E. coli
gaatttctcagcaaagagccgcata

SEQ ID NO: 116461 - DNA, 25 bp, E. coli
gactcggcaattcacgcatgggaac

SEQ ID NO: 116462 - DNA, 25 bp, E. coli
gactcggcaattgacgcatgggaac

SEQ ID NO: 116463 - DNA, 25 bp, E. coli
gatcgaatgacgtaagcctgcgctg

SEQ ID NO: 116464 - DNA, 25 bp, E. coli
gatcgaatgacgaaagcctgcgctg

SEQ ID NO: 116465 - DNA, 25 bp, E. coli
aatgcgccgcgtacatgtcctcaaa

SEQ ID NO: 116466 - DNA, 25 bp, E. coli
aatgcgccgcgttcatgtcctcaaa

SEQ ID NO: 116467 - DNA, 25 bp, E. coli
ctaaaaggaagtatttgcctgaatt

SEQ ID NO: 116468 - DNA, 25 bp, E. coli
ctaaaaggaagtttttgcctgaatt

SEQ ID NO: 116469 - DNA, 25 bp, E. coli
taaagattcctcagtggtcgcacca

SEQ ID NO: 116470 - DNA, 25 bp, E. coli
taaagattcctctgtggtcgcacca

SEQ ID NO: 116471 - DNA, 25 bp, E. coli
ttttttgagtgatatccatacaggg

SEQ ID NO: 116472 - DNA, 25 bp, E. coli
ttttttgagtgaaatccatacaggg

SEQ ID NO: 116473 - DNA, 25 bp, E. coli
tgtcctcaaaatggcgtaacgtcct

SEQ ID NO: 116474 - DNA, 25 bp, E. coli
tgtcctcaaaatcgcgtaacgtcct

SEQ ID NO: 116475 - DNA, 25 bp, E. coli
gctcctcttagaaaaaacgggcgtg

SEQ ID NO: 116476 - DNA, 25 bp, E. coli
gctcctcttagataaaacgggcgtg

SEQ ID NO: 116477 - DNA, 25 bp, E. coli
ccgcgccgcgaatgtcactgataat

SEQ ID NO: 116478 - DNA, 25 bp, E. coli
ccgcgccgcgaaagtcactgataat

SEQ ID NO: 116479 - DNA, 25 bp, E. coli
cgggcgtgaattctaaagattcctc

SEQ ID NO: 116480 - DNA, 25 bp, E. coli
cgggcgtgaattgtaaagattcctc

SEQ ID NO: 116481 - DNA, 25 bp, E. coli
gttgcgctcctcttagaaaaaacgg

SEQ ID NO: 116482 - DNA, 25 bp, E. coli
gttgcgctcctcatagaaaaaacgg

SEQ ID NO: 116483 - DNA, 25 bp, E. coli
gtcactgataatccgccgcgttcat

SEQ ID NO: 116484 - DNA, 25 bp, E. coli
ggtcgcaccagcatcaatattacta

SEQ ID NO: 116485 - DNA, 25 bp, E. coli
gtcactgataatgcgccgcgttcat

SEQ ID NO: 116486 - DNA, 25 bp, E. coli
ggtcgcaccagcttcaatattacta

SEQ ID NO: 116487 - DNA, 25 bp, E. coli
aatcgtggcttagagcgctacatcg

SEQ ID NO: 116488 - DNA, 25 bp, E. coli
aatcgtggcttacagcgctacatcg

SEQ ID NO: 116489 - DNA, 25 bp, E. coli
caacagcgccctgttagggctacag

SEQ ID NO: 116490 - DNA, 25 bp, E. coli
caacagcgccctcttagggctacag

SEQ ID NO: 116491 - DNA, 25 bp, E. coli
aatccggaaagtgccagcccgtaca

SEQ ID NO: 116492 - DNA, 25 bp, E. coli
aatccggaaagtcccagcccgtaca

SEQ ID NO: 116493 - DNA, 25 bp, E. coli
tgatctggccgttggtgtagcagaa

SEQ ID NO: 116494 - DNA, 25 bp, E. coli
tgacaccgacgcagaatcgtggctt

SEQ ID NO: 116495 - DNA, 25 bp, E. coli
tgacaccgacgctgaatcgtggctt

SEQ ID NO: 116496 - DNA, 25 bp, E. coli
tgatctggccgtaggtgtagcagaa

SEQ ID NO: 116497 - DNA, 25 bp, E. coli
tctatctggcaaatccggaaagtgc

SEQ ID NO: 116498 - DNA, 25 bp, E. coli
tctatctggcaattccggaaagtgc

SEQ ID NO: 116499 - DNA, 25 bp, E. coli
gcagatccggtaaatattcccggca

SEQ ID NO: 116500 - DNA, 25 bp, E. coli
gctacatcgccgttagcaacagcgc

SEQ ID NO: 116501 - DNA, 25 bp, E. coli
gcagatccggtatatattcccggca

SEQ ID NO: 116502 - DNA, 25 bp, E. coli
gctacatcgccgatagcaacagcgc

SEQ ID NO: 116503 - DNA, 25 bp, E. coli
gacattccgcgctccgaaagcgtac

SEQ ID NO: 116504 - DNA, 25 bp, E. coli
gacattccgcgcaccgaaagcgtac

SEQ ID NO: 116505 - DNA, 25 bp, E. coli
cggtgaatttaggtggctgctgact

SEQ ID NO: 116506 - DNA, 25 bp, E. coli
ctggctggatatcgcagatccggta

SEQ ID NO: 116507 - DNA, 25 bp, E. coli
cggtgaatttagctggctgctgact

SEQ ID NO: 116508 - DNA, 25 bp, E. coli
ctggctggatatggcagatccggta

SEQ ID NO: 116509 - DNA, 25 bp, E. coli
caaatcccgcttgccgtagagtaca

SEQ ID NO: 116510 - DNA, 25 bp, E. coli
caaattccgcaactgggtaacagca

SEQ ID NO: 116511 - DNA, 25 bp, E. coli
caaattccgcaagtgggtaacagca

SEQ ID NO: 116512 - DNA, 25 bp, E. coli
caaatcccgcttcccgtagagtaca

SEQ ID NO: 116513 - DNA, 25 bp, E. coli
acccttggtggtgagcagaatctaa

SEQ ID NO: 116514 - DNA, 25 bp, E. coli
atacattggttcagcgctgccgcga

SEQ ID NO: 116515 - DNA, 25 bp, E. coli
acccttggtggtcagcagaatctaa

SEQ ID NO: 116516 - DNA, 25 bp, E. coli
atacattggttctgcgctgccgcga

SEQ ID NO: 116517 - DNA, 25 bp, E. coli
tttgactaactctcgcaaggcgctt

SEQ ID NO: 116518 - DNA, 25 bp, E. coli
tttgactaactcacgcaaggcgctt

SEQ ID NO: 116519 - DNA, 25 bp, E. coli
ttgaggaaagaacaccgctacgcga

SEQ ID NO: 116520 - DNA, 25 bp, E. coli
ttgaggaaagaagaccgctacgcga

SEQ ID NO: 116521 - DNA, 25 bp, E. coli
tgatatcaatgacccagacggacca

SEQ ID NO: 116522 - DNA, 25 bp, E. coli
tgatatcaatgagccagacggacca

SEQ ID NO: 116523 - DNA, 25 bp, E. coli
tgcagtcaataaaggttcagtcccg

SEQ ID NO: 116524 - DNA, 25 bp, E. coli
tgcagtcaataatggttcagtcccg

SEQ ID NO: 116525 - DNA, 25 bp, E. coli
tcatcaacaagtccggtgagccgtg

SEQ ID NO: 116526 - DNA, 25 bp, E. coli
tcatcaacaagtgcggtgagccgtg

SEQ ID NO: 116527 - DNA, 25 bp, E. coli
gaagagcaccaacgagctttccgca

SEQ ID NO: 116528 - DNA, 25 bp, E. coli
gaagagcaccaaggagctttccgca

SEQ ID NO: 116529 - DNA, 25 bp, E. coli
gaactattccgggagatgctacgac

SEQ ID NO: 116530 - DNA, 25 bp, E. coli
gaactattccggcagatgctacgac

SEQ ID NO: 116531 - DNA, 25 bp, E. coli
caaaggacagcacatccggtgtaat

SEQ ID NO: 116532 - DNA, 25 bp, E. coli
catggacccgctcacgttattttgg

SEQ ID NO: 116533 - DNA, 25 bp, E. coli
caaaggacagcagatccggtgtaat

SEQ ID NO: 116534 - DNA, 25 bp, E. coli
catggacccgctgacgttattttgg

SEQ ID NO: 116535 - DNA, 25 bp, E. coli
tatgtgaagctatgcgttgctgccg

SEQ ID NO: 116536 - DNA, 25 bp, E. coli
tatgtgaagctaagcgttgctgccg

SEQ ID NO: 116537 - DNA, 25 bp, E. coli
tatatgccgccactcctaagactgc

SEQ ID NO: 116538 - DNA, 25 bp, E. coli
tttgggtgcgaactcaaaggacagc

SEQ ID NO: 116539 - DNA, 25 bp, E. coli
tttgggtgcgaagtcaaaggacagc

SEQ ID NO: 116540 - DNA, 25 bp, E. coli
tatatgccgccagtcctaagactgc

SEQ ID NO: 116541 - DNA, 25 bp, E. coli
tgaatccgcttaatctcagggcggg

SEQ ID NO: 116542 - DNA, 25 bp, E. coli
tgaatccgcttattctcagggcggg

SEQ ID NO: 116543 - DNA, 25 bp, E. coli
tccggatgggagagagtaacgattc

SEQ ID NO: 116544 - DNA, 25 bp, E. coli
tccggatgggagtgagtaacgattc

SEQ ID NO: 116545 - DNA, 25 bp, E. coli
cccaccggcggttaatcaactcagt

SEQ ID NO: 116546 - DNA, 25 bp, E. coli
cccaccggcggtaaatcaactcagt

SEQ ID NO: 116547 - DNA, 25 bp, E. coli
gtaacgattctgtcgggcatggacc

SEQ ID NO: 116548 - DNA, 25 bp, E. coli
gtaacgattctgacgggcatggacc

SEQ ID NO: 116549 - DNA, 25 bp, E. coli
tcaactcagttgaaagcccgcgagc

SEQ ID NO: 116550 - DNA, 25 bp, E. coli
tcaactcagttgtaagcccgcgagc

SEQ ID NO: 116551 - DNA, 25 bp, E. coli
taagactgccctcattctggtaacc

SEQ ID NO: 116552 - DNA, 25 bp, E. coli
taagactgccctgattctggtaacc

SEQ ID NO: 116553 - DNA, 25 bp, E. coli
aacgccacaacgaattggaggctgg

SEQ ID NO: 116554 - DNA, 25 bp, E. coli
aacgccacaacgtattggaggctgg

SEQ ID NO: 116555 - DNA, 25 bp, E. coli
catcgctttcttaaaacgtcggcgt

SEQ ID NO: 116556 - DNA, 25 bp, E. coli
catcgctttctttaaacgtcggcgt

SEQ ID NO: 116557 - DNA, 25 bp, E. coli
tataccgctgcgatatcttctccgc

SEQ ID NO: 116558 - DNA, 25 bp, E. coli
tataccgctgcgttatcttctccgc

SEQ ID NO: 116559 - DNA, 25 bp, E. coli
tattacacactgaggttgaccatcg

SEQ ID NO: 116560 - DNA, 25 bp, E. coli
tattctggagaacctatgaccacca

SEQ ID NO: 116561 - DNA, 25 bp, E. coli
tattctggagaagctatgaccacca

SEQ ID NO: 116562 - DNA, 25 bp, E. coli
tattacacactgtggttgaccatcg

SEQ ID NO: 116563 - DNA, 25 bp, E. coli
tgttggcaaccgcattgatcgtccc

SEQ ID NO: 116564 - DNA, 25 bp, E. coli
tgttggcaaccggattgatcgtccc

SEQ ID NO: 116565 - DNA, 25 bp, E. coli
gaagatggcatacccgttcgccagt

SEQ ID NO: 116566 - DNA, 25 bp, E. coli
gcactgacgacagaaatcttatggg

SEQ ID NO: 116567 - DNA, 25 bp, E. coli
gaagatggcatagccgttcgccagt

SEQ ID NO: 116568 - DNA, 25 bp, E. coli
gcactgacgacacaaatcttatggg

SEQ ID NO: 116569 - DNA, 25 bp, E. coli
cgttggcctggcatttagtcgctct

SEQ ID NO: 116570 - DNA, 25 bp, E. coli
ccctatttcaaaggctcgtcgcggg

SEQ ID NO: 116571 - DNA, 25 bp, E. coli
ccctatttcaaacgctcgtcgcggg

SEQ ID NO: 116572 - DNA, 25 bp, E. coli
cgttggcctggcttttagtcgctct

SEQ ID NO: 116573 - DNA, 25 bp, E. coli
gacgctggcgttgttgctgtatacc

SEQ ID NO: 116574 - DNA, 25 bp, E. coli
gacgctggcgttcttgctgtatacc

SEQ ID NO: 116575 - DNA, 25 bp, E. coli
caatcagacagaaatggttaaatcg

SEQ ID NO: 116576 - DNA, 25 bp, E. coli
caatcagacagatatggttaaatcg

SEQ ID NO: 116577 - DNA, 25 bp, E. coli
cagaaatggttatatcgtcgaattc

SEQ ID NO: 116578 - DNA, 25 bp, E. coli
cagcttgaaaaggatgcatatttta

SEQ ID NO: 116579 - DNA, 25 bp, E. coli
cagaaatggttaaatcgtcgaattc

SEQ ID NO: 116580 - DNA, 25 bp, E. coli
cagcttgaaaagcatgcatatttta

SEQ ID NO: 116581 - DNA, 25 bp, E. coli
cagtgaaatgaagagtttattgccg

SEQ ID NO: 116582 - DNA, 25 bp, E. coli
cagtgaaatgaacagtttattgccg

SEQ ID NO: 116583 - DNA, 25 bp, E. coli
tacgccgctgaacagcttgaaaagg

SEQ ID NO: 116584 - DNA, 25 bp, E. coli
tacgttttcttacgccgctgaacag

SEQ ID NO: 116585 - DNA, 25 bp, E. coli
aatcgtcgaattgatatttaatacg

SEQ ID NO: 116586 - DNA, 25 bp, E. coli
aatcgtcgaattcatatttaatacg

SEQ ID NO: 116587 - DNA, 25 bp, E. coli
tacgttttcttaggccgctgaacag

SEQ ID NO: 116588 - DNA, 25 bp, E. coli
tacgccgctgaagagcttgaaaagg

SEQ ID NO: 116589 - DNA, 25 bp, E. coli
tttaatacgtttacttacgccgctg

SEQ ID NO: 116590 - DNA, 25 bp, E. coli
tttaatacgttttcttacgccgctg

SEQ ID NO: 116591 - DNA, 25 bp, E. coli
tttcttacgccgctgaacagcttga

SEQ ID NO: 116592 - DNA, 25 bp, E. coli
tttcttacgccggtgaacagcttga

SEQ ID NO: 116593 - DNA, 25 bp, E. coli
tgattaccaatctgacagaaatggt

SEQ ID NO: 116594 - DNA, 25 bp, E. coli
tgattaccaatcagacagaaatggt

SEQ ID NO: 116595 - DNA, 25 bp, E. coli
cgctgaacagctagaaaaggatgca

SEQ ID NO: 116596 - DNA, 25 bp, E. coli
cgctgaacagcttgaaaaggatgca

SEQ ID NO: 116597 - DNA, 25 bp, E. coli
cagtcgcccagtatctgacagcaaa

SEQ ID NO: 116598 - DNA, 25 bp, E. coli
cagtcgcccagtttctgacagcaaa

SEQ ID NO: 116599 - DNA, 25 bp, E. coli
tactctttctgataacagcccgggc

SEQ ID NO: 116600 - DNA, 25 bp, E. coli
tactctttctgaaaacagcccgggc

SEQ ID NO: 116601 - DNA, 25 bp, E. coli
aaaaatatgaccttacgactgcgcc

SEQ ID NO: 116602 - DNA, 25 bp, E. coli
aaaaatatgaccatacgactgcgcc

SEQ ID NO: 116603 - DNA, 25 bp, E. coli
tttcagggaaaaatgagtaccgacg

SEQ ID NO: 116604 - DNA, 25 bp, E. coli
tttcagggaaaattgagtaccgacg

SEQ ID NO: 116605 - DNA, 25 bp, E. coli
tgtatacgcgccacatcagactcag

SEQ ID NO: 116606 - DNA, 25 bp, E. coli
tgtatacgcgcctcatcagactcag

SEQ ID NO: 116607 - DNA, 25 bp, E. coli
tgcaggatcagctggaagaaacatc

SEQ ID NO: 116608 - DNA, 25 bp, E. coli
tgagttctcatgcttccgatacgga

SEQ ID NO: 116609 - DNA, 25 bp, E. coli
tgagttctcatggttccgatacgga

SEQ ID NO: 116610 - DNA, 25 bp, E. coli
tgcaggatcagcaggaagaaacatc

SEQ ID NO: 116611 - DNA, 25 bp, E. coli
tgcggcccttctactaccggagaga

SEQ ID NO: 116612 - DNA, 25 bp, E. coli
tgcggcccttcttctaccggagaga

SEQ ID NO: 116613 - DNA, 25 bp, E. coli
tcatggctggaaagcaactgagttc

SEQ ID NO: 116614 - DNA, 25 bp, E. coli
tcatggctggaatgcaactgagttc

SEQ ID NO: 116615 - DNA, 25 bp, E. coli
gcctcccggatctcagctcattaaa

SEQ ID NO: 116616 - DNA, 25 bp, E. coli
gccaccctgtacgaaaacgggctgt

SEQ ID NO: 116617 - DNA, 25 bp, E. coli
gccaccctgtaccaaaacgggctgt

SEQ ID NO: 116618 - DNA, 25 bp, E. coli
gcctcccggatcacagctcattaaa

SEQ ID NO: 116619 - DNA, 25 bp, E. coli
attggcctggatgccgcattactgc

SEQ ID NO: 116620 - DNA, 25 bp, E. coli
attggcctggatcccgcattactgc

SEQ ID NO: 116621 - DNA, 25 bp, E. coli
ttcctgattggcctggatcccgcat

SEQ ID NO: 116622 - DNA, 25 bp, E. coli
ttcctgattggcgtggatcccgcat

SEQ ID NO: 116623 - DNA, 25 bp, E. coli
tgtgttcctggtaatcaggtactgc

SEQ ID NO: 116624 - DNA, 25 bp, E. coli
tgttcctggtaatcaggtactgccg

SEQ ID NO: 116625 - DNA, 25 bp, E. coli
tgtgttcctggttatcaggtactgc

SEQ ID NO: 116626 - DNA, 25 bp, E. coli
tgattggcctggatcccgcattact

SEQ ID NO: 116627 - DNA, 25 bp, E. coli
tgattggcctggttcccgcattact

SEQ ID NO: 116628 - DNA, 25 bp, E. coli
tgtttgtgttccaggtaatcaggta

SEQ ID NO: 116629 - DNA, 25 bp, E. coli
tgtttgtgttcctggtaatcaggta

SEQ ID NO: 116630 - DNA, 25 bp, E. coli
tgttcctggtaaacaggtactgccg

SEQ ID NO: 116631 - DNA, 25 bp, E. coli
tcctggtaatcacgtactgccgttt

SEQ ID NO: 116632 - DNA, 25 bp, E. coli
tcctggtaatcaggtactgccgttt

SEQ ID NO: 116633 - DNA, 25 bp, E. coli
cctgattggcctcgatcccgcatta

SEQ ID NO: 116634 - DNA, 25 bp, E. coli
cctgattggcctggatcccgcatta

SEQ ID NO: 116635 - DNA, 25 bp, E. coli
gcctggatcccgcattactgctggg

SEQ ID NO: 116636 - DNA, 25 bp, E. coli
gcctggatcccggattactgctggg

SEQ ID NO: 116637 - DNA, 25 bp, E. coli
cgcattactgctcgggcatacggcg

SEQ ID NO: 116638 - DNA, 25 bp, E. coli
cgcattactgctggggcatacggcg

SEQ ID NO: 116639 - DNA, 25 bp, E. coli
gattggcctggaacccgcattactg

SEQ ID NO: 116640 - DNA, 25 bp, E. coli
gattggcctggatcccgcattactg

SEQ ID NO: 116641 - DNA, 25 bp, E. coli
caaatagcgtttaacctcggtagcg

SEQ ID NO: 116642 - DNA, 25 bp, E. coli
caaatagcgttttacctcggtagcg

SEQ ID NO: 116643 - DNA, 25 bp, E. coli
cattatgggcgtgctcacggagctg

SEQ ID NO: 116644 - DNA, 25 bp, E. coli
tatggtcgctataagcgccagcaag

SEQ ID NO: 116645 - DNA, 25 bp, E. coli
tatggtcgctattagcgccagcaag

SEQ ID NO: 116646 - DNA, 25 bp, E. coli
tatctttggctctgggcacgtttgg

SEQ ID NO: 116647 - DNA, 25 bp, E. coli
tatctttggctcagggcacgtttgg

SEQ ID NO: 116648 - DNA, 25 bp, E. coli
gcctggttcagctacgtaaagccat

SEQ ID NO: 116649 - DNA, 25 bp, E. coli
ccaaaggcggagtgttattaggtgc

SEQ ID NO: 116650 - DNA, 25 bp, E. coli
gcctggttcagcaacgtaaagccat

SEQ ID NO: 116651 - DNA, 25 bp, E. coli
ccaaaggcggagagttattaggtgc

SEQ ID NO: 116652 - DNA, 25 bp, E. coli
cggagctggcgcataacgtaggaat

SEQ ID NO: 116653 - DNA, 25 bp, E. coli
cggagctggcgcttaacgtaggaat

SEQ ID NO: 116654 - DNA, 25 bp, E. coli
cattatgggcgtcctcacggagctg

SEQ ID NO: 116655 - DNA, 25 bp, E. coli
ggacgttattcaccactgcgcattg

SEQ ID NO: 116656 - DNA, 25 bp, E. coli
ggcggcatgaaatcaacgtcgctta

SEQ ID NO: 116657 - DNA, 25 bp, E. coli
ggacgttattcagcactgcgcattg

SEQ ID NO: 116658 - DNA, 25 bp, E. coli
ggcggcatgaaaacaacgtcgctta

SEQ ID NO: 116659 - DNA, 25 bp, E. coli
tggtttccgggatgacagtcgccaa

SEQ ID NO: 116660 - DNA, 25 bp, E. coli
tggtttccgggaagacagtcgccaa

SEQ ID NO: 116661 - DNA, 25 bp, E. coli
taatattgcggtgatggcatcggtc

SEQ ID NO: 116662 - DNA, 25 bp, E. coli
taatattgcggtcatggcatcggtc

SEQ ID NO: 116663 - DNA, 25 bp, E. coli
caggattgcgttaacctggttgtgt

SEQ ID NO: 116664 - DNA, 25 bp, E. coli
caggattgcgtttacctggttgtgt

SEQ ID NO: 116665 - DNA, 25 bp, E. coli
acaataccgggcgacgtagaacaag

SEQ ID NO: 116666 - DNA, 25 bp, E. coli
acaataccgggccacgtagaacaag

SEQ ID NO: 116667 - DNA, 25 bp, E. coli
tagccgacctgcaggcattaaaagc

SEQ ID NO: 116668 - DNA, 25 bp, E. coli
tagccgacctgctggcattaaaagc

SEQ ID NO: 116669 - DNA, 25 bp, E. coli
tacctggttgtgttgacgcttttga

SEQ ID NO: 116670 - DNA, 25 bp, E. coli
tacctggttgtgatgacgcttttga

SEQ ID NO: 116671 - DNA, 25 bp, E. coli
tcagcggctggcagtagccgacctg

SEQ ID NO: 116672 - DNA, 25 bp, E. coli
tcagcggctggctgtagccgacctg

SEQ ID NO: 116673 - DNA, 25 bp, E. coli
ccgggcgacgtacaacaagcgatga

SEQ ID NO: 116674 - DNA, 25 bp, E. coli
ccgggcgacgtagaacaagcgatga

SEQ ID NO: 116675 - DNA, 25 bp, E. coli
gcgacgtagaacaagcgatgaaaac

SEQ ID NO: 116676 - DNA, 25 bp, E. coli
gcgacgtagaactagcgatgaaaac

SEQ ID NO: 116677 - DNA, 25 bp, E. coli
gcggccaggattccgtttacctggt

SEQ ID NO: 116678 - DNA, 25 bp, E. coli
gcggccaggattgcgtttacctggt

SEQ ID NO: 116679 - DNA, 25 bp, E. coli
cgtagaacaagccatgaaaacgctg

SEQ ID NO: 116680 - DNA, 25 bp, E. coli
cgtagaacaagcgatgaaaacgctg

SEQ ID NO: 116681 - DNA, 25 bp, E. coli
ctggttgtgttgtcgcttttgagca

SEQ ID NO: 116682 - DNA, 25 bp, E. coli
ctggttgtgttgacgcttttgagca

SEQ ID NO: 116683 - DNA, 25 bp, E. coli
ggcagtagccgacctgcaggcatta

SEQ ID NO: 116684 - DNA, 25 bp, E. coli
ggcagtagccgagctgcaggcatta

SEQ ID NO: 116685 - DNA, 25 bp, E. coli
aacgagcggacgctagcgcgcttct

SEQ ID NO: 116686 - DNA, 25 bp, E. coli
aacgagcggacggtagcgcgcttct

SEQ ID NO: 116687 - DNA, 25 bp, E. coli
tgaagccttgttggcgcaaaccctg

SEQ ID NO: 116688 - DNA, 25 bp, E. coli
tgaggtgaatcatgccatcgaggtg

SEQ ID NO: 116689 - DNA, 25 bp, E. coli
tgaagccttgttcgcgcaaaccctg

SEQ ID NO: 116690 - DNA, 25 bp, E. coli
tgaggtgaatcaagccatcgaggtg

SEQ ID NO: 116691 - DNA, 25 bp, E. coli
tccgactggtgatgaaattaactgg

SEQ ID NO: 116692 - DNA, 25 bp, E. coli
tccgactggtgaagaaattaactgg

SEQ ID NO: 116693 - DNA, 25 bp, E. coli
tcttcaatgaggagaatcatgccat

SEQ ID NO: 116694 - DNA, 25 bp, E. coli
tcatgccatcgaggtggatgaagcc

SEQ ID NO: 116695 - DNA, 25 bp, E. coli
tcatgccatcgacgtggatgaagcc

SEQ ID NO: 116696 - DNA, 25 bp, E. coli
tcttcaatgaggtgaatcatgccat

SEQ ID NO: 116697 - DNA, 25 bp, E. coli
ccatcgaggtggttgaagccttgtt

SEQ ID NO: 116698 - DNA, 25 bp, E. coli
ccatcgaggtggatgaagccttgtt

SEQ ID NO: 116699 - DNA, 25 bp, E. coli
gcaaaccctggataaactctttccg

SEQ ID NO: 116700 - DNA, 25 bp, E. coli
gcaaaccctggaaaaactctttccg

SEQ ID NO: 116701 - DNA, 25 bp, E. coli
gtagcgcgcttcttcaatgaggtga

SEQ ID NO: 116702 - DNA, 25 bp, E. coli
gataaactctttgcgactggtgatg

SEQ ID NO: 116703 - DNA, 25 bp, E. coli
gataaactctttccgactggtgatg

SEQ ID NO: 116704 - DNA, 25 bp, E. coli
gtagcgcgcttcatcaatgaggtga

SEQ ID NO: 116705 - DNA, 25 bp, E. coli
gacggtagcgcgcttcttcaatgag

SEQ ID NO: 116706 - DNA, 25 bp, E. coli
gacggtagcgcggttcttcaatgag

SEQ ID NO: 116707 - DNA, 25 bp, E. coli
cataatgcttgatgggcaggtcaaa

SEQ ID NO: 116708 - DNA, 25 bp, E. coli
cataatgcttgaagggcaggtcaaa

SEQ ID NO: 116709 - DNA, 25 bp, E. coli
ataatgcttgaagggcaggtcaaaa

SEQ ID NO: 116710 - DNA, 25 bp, E. coli
accccataatgcttgaagggcaggt

SEQ ID NO: 116711 - DNA, 25 bp, E. coli
accccataatgcatgaagggcaggt

SEQ ID NO: 116712 - DNA, 25 bp, E. coli
ataatgcttgaacggcaggtcaaaa

SEQ ID NO: 116713 - DNA, 25 bp, E. coli
taccccataatgcttgaagggcagg

SEQ ID NO: 116714 - DNA, 25 bp, E. coli
taccccataatggttgaagggcagg

SEQ ID NO: 116715 - DNA, 25 bp, E. coli
ttaccccataatgcttgaagggcag

SEQ ID NO: 116716 - DNA, 25 bp, E. coli
ttaccccataatccttgaagggcag

SEQ ID NO: 116717 - DNA, 25 bp, E. coli
tttaccccataaagcttgaagggca

SEQ ID NO: 116718 - DNA, 25 bp, E. coli
tttaccccataatgcttgaagggca

SEQ ID NO: 116719 - DNA, 25 bp, E. coli
tgcttgaagggcaggtcaaaaaatg

SEQ ID NO: 116720 - DNA, 25 bp, E. coli
tgcttgaagggctggtcaaaaaatg

SEQ ID NO: 116721 - DNA, 25 bp, E. coli
ccataatgcttgaagggcaggtcaa

SEQ ID NO: 116722 - DNA, 25 bp, E. coli
ccataatgcttgtagggcaggtcaa

SEQ ID NO: 116723 - DNA, 25 bp, E. coli
gcttgaagggcacgtcaaaaaatga

SEQ ID NO: 116724 - DNA, 25 bp, E. coli
gcttgaagggcaggtcaaaaaatga

SEQ ID NO: 116725 - DNA, 25 bp, E. coli
ccccataatgctagaagggcaggtc

SEQ ID NO: 116726 - DNA, 25 bp, E. coli
cccataatgcttgaagggcaggtca

SEQ ID NO: 116727 - DNA, 25 bp, E. coli
ccccataatgcttgaagggcaggtc

SEQ ID NO: 116728 - DNA, 25 bp, E. coli
cccataatgcttcaagggcaggtca

SEQ ID NO: 116729 - DNA, 25 bp, E. coli
taaagatccgcacaccatggtgcct

SEQ ID NO: 116730 - DNA, 25 bp, E. coli
taaagaaggcaaagcagcggatgtc

SEQ ID NO: 116731 - DNA, 25 bp, E. coli
taaagatccgcagaccatggtgcct

SEQ ID NO: 116732 - DNA, 25 bp, E. coli
taaagaaggcaatgcagcggatgtc

SEQ ID NO: 116733 - DNA, 25 bp, E. coli
tatgaacattgtggtgctgaccgct

SEQ ID NO: 116734 - DNA, 25 bp, E. coli
tatgaacattgtcgtgctgaccgct

SEQ ID NO: 116735 - DNA, 25 bp, E. coli
tattgccgtggagcgcgtatcaggc

SEQ ID NO: 116736 - DNA, 25 bp, E. coli
tattgccgtggaccgcgtatcaggc

SEQ ID NO: 116737 - DNA, 25 bp, E. coli
tgttcctcggtagtggtcagccgct

SEQ ID NO: 116738 - DNA, 25 bp, E. coli
tgttcctcggtactggtcagccgct

SEQ ID NO: 116739 - DNA, 25 bp, E. coli
tgaattcaggtctgtactgcaccgg

SEQ ID NO: 116740 - DNA, 25 bp, E. coli
tgaattcaggtcagtactgcaccgg

SEQ ID NO: 116741 - DNA, 25 bp, E. coli
tcagttttaaactgcctggcgcgcc

SEQ ID NO: 116742 - DNA, 25 bp, E. coli
tcagttttaaacagcctggcgcgcc

SEQ ID NO: 116743 - DNA, 25 bp, E. coli
gctggatggcaacaccactggcttt

SEQ ID NO: 116744 - DNA, 25 bp, E. coli
gctggatggcaagaccactggcttt

SEQ ID NO: 116745 - DNA, 25 bp, E. coli
gaaaatgagtcgacagcatgtgccg

SEQ ID NO: 116746 - DNA, 25 bp, E. coli
gaaaatgagtcgtcagcatgtgccg

SEQ ID NO: 116747 - DNA, 25 bp, E. coli
gaaattcacagctctgcgccagtcg

SEQ ID NO: 116748 - DNA, 25 bp, E. coli
gaaattcacagcactgcgccagtcg

SEQ ID NO: 116749 - DNA, 25 bp, E. coli
gattgttgatataaccgccgtcgct

SEQ ID NO: 116750 - DNA, 25 bp, E. coli
gattgttgatattaccgccgtcgct

SEQ ID NO: 116751 - DNA, 25 bp, E. coli
tattctggaagttcatggcgagcgt

SEQ ID NO: 116752 - DNA, 25 bp, E. coli
ttctgaagccctcctatttgcttca

SEQ ID NO: 116753 - DNA, 25 bp, E. coli
ttctgaagccctgctatttgcttca

SEQ ID NO: 116754 - DNA, 25 bp, E. coli
tattctggaagtacatggcgagcgt

SEQ ID NO: 116755 - DNA, 25 bp, E. coli
tgaaactgctcggcaggtaacggaa

SEQ ID NO: 116756 - DNA, 25 bp, E. coli
tgaaactgctcgccaggtaacggaa

SEQ ID NO: 116757 - DNA, 25 bp, E. coli
tgccgtcagtgtagaaactgctcgc

SEQ ID NO: 116758 - DNA, 25 bp, E. coli
tgccgtcagtgttgaaactgctcgc

SEQ ID NO: 116759 - DNA, 25 bp, E. coli
tcatggcgagcgtatgattaaacgc

SEQ ID NO: 116760 - DNA, 25 bp, E. coli
tctggaagttcatggcgagcgtatg

SEQ ID NO: 116761 - DNA, 25 bp, E. coli
tctggaagttcaaggcgagcgtatg

SEQ ID NO: 116762 - DNA, 25 bp, E. coli
tcatggcgagcgaatgattaaacgc

SEQ ID NO: 116763 - DNA, 25 bp, E. coli
gcttcaaaatcgctctgcaccagaa

SEQ ID NO: 116764 - DNA, 25 bp, E. coli
gcttcaaaatcggtctgcaccagaa

SEQ ID NO: 116765 - DNA, 25 bp, E. coli
gcggtttctgaagccctgctatttg

SEQ ID NO: 116766 - DNA, 25 bp, E. coli
gcggtttctgaacccctgctatttg

SEQ ID NO: 116767 - DNA, 25 bp, E. coli
gggtgccgtcagagttgaaactgct

SEQ ID NO: 116768 - DNA, 25 bp, E. coli
gggtgccgtcagtgttgaaactgct

SEQ ID NO: 116769 - DNA, 25 bp, E. coli
tggcgagcgtatgattaaacgcacc

SEQ ID NO: 116770 - DNA, 25 bp, E. coli
tggcgagcgtatcattaaacgcacc

SEQ ID NO: 116771 - DNA, 25 bp, E. coli
taatccgggcttgaaaatcgctctg

SEQ ID NO: 116772 - DNA, 25 bp, E. coli
taatccgggcttcaaaatcgctctg

SEQ ID NO: 116773 - DNA, 25 bp, E. coli
cagaaaaaatttctacgccaacaga

SEQ ID NO: 116774 - DNA, 25 bp, E. coli
cagaaaaaatttgtacgccaacaga

SEQ ID NO: 116775 - DNA, 25 bp, E. coli
tactgaggtcgctatttgaacggat

SEQ ID NO: 116776 - DNA, 25 bp, E. coli
tacgcaatgcacttttgagctagat

SEQ ID NO: 116777 - DNA, 25 bp, E. coli
tacgcaatgcacatttgagctagat

SEQ ID NO: 116778 - DNA, 25 bp, E. coli
tactgaggtcgcaatttgaacggat

SEQ ID NO: 116779 - DNA, 25 bp, E. coli
aacagaccattaccgattttgtacg

SEQ ID NO: 116780 - DNA, 25 bp, E. coli
aacagaccattagcgattttgtacg

SEQ ID NO: 116781 - DNA, 25 bp, E. coli
tgaacggataatagagggtgatcgc

SEQ ID NO: 116782 - DNA, 25 bp, E. coli
tgaacggataattgagggtgatcgc

SEQ ID NO: 116783 - DNA, 25 bp, E. coli
tccagaggaaaattaccgacgcgcg

SEQ ID NO: 116784 - DNA, 25 bp, E. coli
tccagaggaaaaataccgacgcgcg

SEQ ID NO: 116785 - DNA, 25 bp, E. coli
tctttctatgaaaaacttccagagg

SEQ ID NO: 116786 - DNA, 25 bp, E. coli
tctttctatgaataacttccagagg

SEQ ID NO: 116787 - DNA, 25 bp, E. coli
gacatgatatttaactgaggtcgca

SEQ ID NO: 116788 - DNA, 25 bp, E. coli
gacatgatattttactgaggtcgca

SEQ ID NO: 116789 - DNA, 25 bp, E. coli
ccgacgcgcgctctatattttatca

SEQ ID NO: 116790 - DNA, 25 bp, E. coli
ccgacgcgcgctgtatattttatca

SEQ ID NO: 116791 - DNA, 25 bp, E. coli
ggtgatcgcgttggtcaggctttaa

SEQ ID NO: 116792 - DNA, 25 bp, E. coli
ggtgatcgcgttcgtcaggctttaa

SEQ ID NO: 116793 - DNA, 25 bp, E. coli
gagagtatctgcgtcatcgaaccag

SEQ ID NO: 116794 - DNA, 25 bp, E. coli
gagagtatctgcctcatcgaaccag

SEQ ID NO: 116795 - DNA, 25 bp, E. coli
cacagcgtggaaccgaagttcaggg

SEQ ID NO: 116796 - DNA, 25 bp, E. coli
cacagcgtggaagcgaagttcaggg

SEQ ID NO: 116797 - DNA, 25 bp, E. coli
cacctcgggagctcagcgtggaagc

SEQ ID NO: 116798 - DNA, 25 bp, E. coli
cacctcgggagcacagcgtggaagc

SEQ ID NO: 116799 - DNA, 25 bp, E. coli
atgacgggggcacctgttatctctg

SEQ ID NO: 116800 - DNA, 25 bp, E. coli
atgacgggggcagctgttatctctg

SEQ ID NO: 116801 - DNA, 25 bp, E. coli
agcacagcgtggtagcgaagttcag

SEQ ID NO: 116802 - DNA, 25 bp, E. coli
agcacagcgtggaagcgaagttcag

SEQ ID NO: 116803 - DNA, 25 bp, E. coli
ttatttgtgcggacggatacggtgc

SEQ ID NO: 116804 - DNA, 25 bp, E. coli
ttatttgtgcggtcggatacggtgc

SEQ ID NO: 116805 - DNA, 25 bp, E. coli
gacggatacggtgcgtgccgtgcgg

SEQ ID NO: 116806 - DNA, 25 bp, E. coli
gacggatacggtccgtgccgtgcgg

SEQ ID NO: 116807 - DNA, 25 bp, E. coli
cgggggcagctgatatctctggctc

SEQ ID NO: 116808 - DNA, 25 bp, E. coli
cggtgcgtgccgtgcggcgtggtga

SEQ ID NO: 116809 - DNA, 25 bp, E. coli
cgggggcagctgttatctctggctc

SEQ ID NO: 116810 - DNA, 25 bp, E. coli
cggtgcgtgccgagcggcgtggtga

SEQ ID NO: 116811 - DNA, 25 bp, E. coli
gttcacctcgggagcacagcgtgga

SEQ ID NO: 116812 - DNA, 25 bp, E. coli
gttcacctcgggtgcacagcgtgga

SEQ ID NO: 116813 - DNA, 25 bp, E. coli
gagcacagcgtggaagcgaagttca

SEQ ID NO: 116814 - DNA, 25 bp, E. coli
gatggggctctgtgcgcagttcacc

SEQ ID NO: 116815 - DNA, 25 bp, E. coli
gatggggctctgagcgcagttcacc

SEQ ID NO: 116816 - DNA, 25 bp, E. coli
gagcacagcgtgcaagcgaagttca

SEQ ID NO: 116817 - DNA, 25 bp, E. coli
aaccaggatggatcgttcactgcca

SEQ ID NO: 116818 - DNA, 25 bp, E. coli
accgaaactggtgcgcgccgatggt

SEQ ID NO: 116819 - DNA, 25 bp, E. coli
accgaaactggtccgcgccgatggt

SEQ ID NO: 116820 - DNA, 25 bp, E. coli
catttaaaaccgtaactggtgcgcg

SEQ ID NO: 116821 - DNA, 25 bp, E. coli
aatcgacctcgggaacaacgaatcc

SEQ ID NO: 116822 - DNA, 25 bp, E. coli
catttaaaaccgaaactggtgcgcg

SEQ ID NO: 116823 - DNA, 25 bp, E. coli
aatcgacctcggcaacaacgaatcc

SEQ ID NO: 116824 - DNA, 25 bp, E. coli
aaccaggatggaacgttcactgcca

SEQ ID NO: 116825 - DNA, 25 bp, E. coli
ttaaaaccgaaactggtgcgcgccg

SEQ ID NO: 116826 - DNA, 25 bp, E. coli
ttaaaaccgaaagtggtgcgcgccg

SEQ ID NO: 116827 - DNA, 25 bp, E. coli
tgcaaaaaatcgtcctcggcaacaa

SEQ ID NO: 116828 - DNA, 25 bp, E. coli
tgcaaaaaatcgacctcggcaacaa

SEQ ID NO: 116829 - DNA, 25 bp, E. coli
tgcgcgccgatgcttggagaagcac

SEQ ID NO: 116830 - DNA, 25 bp, E. coli
tgcgcgccgatggttggagaagcac

SEQ ID NO: 116831 - DNA, 25 bp, E. coli
cctcggcaacaaggaatccctggtg

SEQ ID NO: 116832 - DNA, 25 bp, E. coli
cctcggcaacaacgaatccctggtg

SEQ ID NO: 116833 - DNA, 25 bp, E. coli
cccaaccaggatggaacgttcactg

SEQ ID NO: 116834 - DNA, 25 bp, E. coli
cccaaccaggatcgaacgttcactg

SEQ ID NO: 116835 - DNA, 25 bp, E. coli
ggaacgttcactgccatgacgtata

SEQ ID NO: 116836 - DNA, 25 bp, E. coli
ggaacgttcactcccatgacgtata

SEQ ID NO: 116837 - DNA, 25 bp, E. coli
gatggaacgttctctgccatgacgt

SEQ ID NO: 116838 - DNA, 25 bp, E. coli
gatggaacgttcactgccatgacgt

SEQ ID NO: 116839 - DNA, 25 bp, E. coli
caatggttatgggttttggtataga

SEQ ID NO: 116840 - DNA, 25 bp, E. coli
caatggttatggcttttggtataga

SEQ ID NO: 116841 - DNA, 25 bp, E. coli
catccggaatggtgtttaagaacct

SEQ ID NO: 116842 - DNA, 25 bp, E. coli
acaaaccaatggttatggcttttgg

SEQ ID NO: 116843 - DNA, 25 bp, E. coli
catccggaatggagtttaagaacct

SEQ ID NO: 116844 - DNA, 25 bp, E. coli
acaaaccaatggatatggcttttgg

SEQ ID NO: 116845 - DNA, 25 bp, E. coli
ttggtatagagaaaaaagttattgc

SEQ ID NO: 116846 - DNA, 25 bp, E. coli
ttggtatagagataaaagttattgc

SEQ ID NO: 116847 - DNA, 25 bp, E. coli
tgctgaatgatggacatccggaatg

SEQ ID NO: 116848 - DNA, 25 bp, E. coli
tgagcattggctaaaggtggcagaa

SEQ ID NO: 116849 - DNA, 25 bp, E. coli
tgagcattggcttaaggtggcagaa

SEQ ID NO: 116850 - DNA, 25 bp, E. coli
tgctgaatgatgcacatccggaatg

SEQ ID NO: 116851 - DNA, 25 bp, E. coli
gaatttattttgtacaaaccaatgg

SEQ ID NO: 116852 - DNA, 25 bp, E. coli
gaatttattttgaacaaaccaatgg

SEQ ID NO: 116853 - DNA, 25 bp, E. coli
gaaagacgcattcagcattggctaa

SEQ ID NO: 116854 - DNA, 25 bp, E. coli
gaacctgtgaaacacgcattgagca

SEQ ID NO: 116855 - DNA, 25 bp, E. coli
gaacctgtgaaagacgcattgagca

SEQ ID NO: 116856 - DNA, 25 bp, E. coli
gaaagacgcattgagcattggctaa

SEQ ID NO: 116857 - DNA, 25 bp, E. coli
cattggctaaaggtggcagaattta

SEQ ID NO: 116858 - DNA, 25 bp, E. coli
cattggctaaagctggcagaattta

SEQ ID NO: 116859 - DNA, 25 bp, E. coli
gagtttaagaacgtgtgaaagacgc

SEQ ID NO: 116860 - DNA, 25 bp, E. coli
gagtttaagaacctgtgaaagacgc

SEQ ID NO: 116861 - DNA, 25 bp, E. coli
aagatcctgcactggcgcggcataa

SEQ ID NO: 116862 - DNA, 25 bp, E. coli
aagatcctgcacaggcgcggcataa

SEQ ID NO: 116863 - DNA, 25 bp, E. coli
cacaggcgcggcttaaaccgcgttt

SEQ ID NO: 116864 - DNA, 25 bp, E. coli
cacaggcgcggcataaaccgcgttt

SEQ ID NO: 116865 - DNA, 25 bp, E. coli
agtgaagatcctccacaggcgcggc

SEQ ID NO: 116866 - DNA, 25 bp, E. coli
agtgaagatcctgcacaggcgcggc

SEQ ID NO: 116867 - DNA, 25 bp, E. coli
tatgctggaggcctgtagttaccat

SEQ ID NO: 116868 - DNA, 25 bp, E. coli
tatgctggaggcgtgtagttaccat

SEQ ID NO: 116869 - DNA, 25 bp, E. coli
tttagtggtatttcacgggctggaa

SEQ ID NO: 116870 - DNA, 25 bp, E. coli
tttagtggtattacacgggctggaa

SEQ ID NO: 116871 - DNA, 25 bp, E. coli
tcggatagccaaaccgacactgatt

SEQ ID NO: 116872 - DNA, 25 bp, E. coli
tcggatagccaatccgacactgatt

SEQ ID NO: 116873 - DNA, 25 bp, E. coli
cgcgtttagtggaatttcacgggct

SEQ ID NO: 116874 - DNA, 25 bp, E. coli
cgcgtttagtggtatttcacgggct

SEQ ID NO: 116875 - DNA, 25 bp, E. coli
cgccatgccgatgctcaatcggata

SEQ ID NO: 116876 - DNA, 25 bp, E. coli
cgccatgccgatcctcaatcggata

SEQ ID NO: 116877 - DNA, 25 bp, E. coli
ggcataaaccgcgtttagtggtatt

SEQ ID NO: 116878 - DNA, 25 bp, E. coli
ggcataaaccgcctttagtggtatt

SEQ ID NO: 116879 - DNA, 25 bp, E. coli
gaggcctgtagtaaccatatggaaa

SEQ ID NO: 116880 - DNA, 25 bp, E. coli
gaggcctgtagttaccatatggaaa

SEQ ID NO: 116881 - DNA, 25 bp, E. coli
gatgctcaatcggatagccaaaccg

SEQ ID NO: 116882 - DNA, 25 bp, E. coli
gatgctcaatcgcatagccaaaccg

SEQ ID NO: 116883 - DNA, 25 bp, E. coli
cagacgacggatcatgcttacattg

SEQ ID NO: 116884 - DNA, 25 bp, E. coli
cagacgacggatgatgcttacattg

SEQ ID NO: 116885 - DNA, 25 bp, E. coli
tacattggtggtaatatcaccacgg

SEQ ID NO: 116886 - DNA, 25 bp, E. coli
tacattggtggttatatcaccacgg

SEQ ID NO: 116887 - DNA, 25 bp, E. coli
aaaggaagatttatacagacgacgg

SEQ ID NO: 116888 - DNA, 25 bp, E. coli
aaaggaagatttttacagacgacgg

SEQ ID NO: 116889 - DNA, 25 bp, E. coli
tatctggtgggtaagcaaaggaaga

SEQ ID NO: 116890 - DNA, 25 bp, E. coli
tatctggtgggttagcaaaggaaga

SEQ ID NO: 116891 - DNA, 25 bp, E. coli
tattatcctgcgactcgatgatcgg

SEQ ID NO: 116892 - DNA, 25 bp, E. coli
tatatttctgctatagaggtgcgcg

SEQ ID NO: 116893 - DNA, 25 bp, E. coli
tattatcctgcgtctcgatgatcgg

SEQ ID NO: 116894 - DNA, 25 bp, E. coli
tatatttctgctttagaggtgcgcg

SEQ ID NO: 116895 - DNA, 25 bp, E. coli
ccagattagaggcatttcgcagcag

SEQ ID NO: 116896 - DNA, 25 bp, E. coli
ccagattagagggatttcgcagcag

SEQ ID NO: 116897 - DNA, 25 bp, E. coli
cgatcggtattcttttggctggcgt

SEQ ID NO: 116898 - DNA, 25 bp, E. coli
cgatcggtattcatttggctggcgt

SEQ ID NO: 116899 - DNA, 25 bp, E. coli
ggattatcgtgctaatgtcgccaga

SEQ ID NO: 116900 - DNA, 25 bp, E. coli
ggattatcgtgcaaatgtcgccaga

SEQ ID NO: 116901 - DNA, 25 bp, E. coli
tcaccacggtgggaagtaaagtttc

SEQ ID NO: 116902 - DNA, 25 bp, E. coli
tcaccacggtggcaagtaaagtttc

SEQ ID NO: 116903 - DNA, 25 bp, E. coli
gaggtgcgcgataatcagagtgtaa

SEQ ID NO: 116904 - DNA, 25 bp, E. coli
gaggtgcgcgattatcagagtgtaa

SEQ ID NO: 116905 - DNA, 25 bp, E. coli
aatgaccgttgctctctgatttctc

SEQ ID NO: 116906 - DNA, 25 bp, E. coli
aatgaccgttgcactctgatttctc

SEQ ID NO: 116907 - DNA, 25 bp, E. coli
cactgagaaccttcgatgttatggc

SEQ ID NO: 116908 - DNA, 25 bp, E. coli
cactgagaacctacgatgttatggc

SEQ ID NO: 116909 - DNA, 25 bp, E. coli
tgatttctcatttcatgctcaccca

SEQ ID NO: 116910 - DNA, 25 bp, E. coli
tgtaagactaaaatacttcttgcga

SEQ ID NO: 116911 - DNA, 25 bp, E. coli
tgatttctcattacatgctcaccca

SEQ ID NO: 116912 - DNA, 25 bp, E. coli
tgtaagactaaattacttcttgcga

SEQ ID NO: 116913 - DNA, 25 bp, E. coli
tgctcacccaatatgatggcggcgt

SEQ ID NO: 116914 - DNA, 25 bp, E. coli
tgacatctctttgtggtatataaga

SEQ ID NO: 116915 - DNA, 25 bp, E. coli
tgctcacccaatttgatggcggcgt

SEQ ID NO: 116916 - DNA, 25 bp, E. coli
tgacatctctttctggtatataaga

SEQ ID NO: 116917 - DNA, 25 bp, E. coli
tctgcgacaggatgcatattcctac

SEQ ID NO: 116918 - DNA, 25 bp, E. coli
tctgcgacaggaagcatattcctac

SEQ ID NO: 116919 - DNA, 25 bp, E. coli
cttcttgcgatattaactacaactg

SEQ ID NO: 116920 - DNA, 25 bp, E. coli
cttcttgcgataataactacaactg

SEQ ID NO: 116921 - DNA, 25 bp, E. coli
gttatcctgaaaatggttcactgag

SEQ ID NO: 116922 - DNA, 25 bp, E. coli
gttatcctgaaattggttcactgag

SEQ ID NO: 116923 - DNA, 25 bp, E. coli
taagataaccctttcaaaatgaccg

SEQ ID NO: 116924 - DNA, 25 bp, E. coli
taagaatagttctctgcgacaggaa

SEQ ID NO: 116925 - DNA, 25 bp, E. coli
taagataaccctatcaaaatgaccg

SEQ ID NO: 116926 - DNA, 25 bp, E. coli
taagaatagttcactgcgacaggaa

SEQ ID NO: 116927 - DNA, 25 bp, E. coli
cacaaatgttagtgcgcgccgatgg

SEQ ID NO: 116928 - DNA, 25 bp, E. coli
cacaaatgttagagcgcgccgatgg

SEQ ID NO: 116929 - DNA, 25 bp, E. coli
catgaaattaaaccaccgttgacgg

SEQ ID NO: 116930 - DNA, 25 bp, E. coli
catgaaattaaagcaccgttgacgg

SEQ ID NO: 116931 - DNA, 25 bp, E. coli
tatgcgatccaacgtgaaattaggc

SEQ ID NO: 116932 - DNA, 25 bp, E. coli
tatgcgatccaaggtgaaattaggc

SEQ ID NO: 116933 - DNA, 25 bp, E. coli
ttacaacataggtgcggaaacgccg

SEQ ID NO: 116934 - DNA, 25 bp, E. coli
ttacaacataggagcggaaacgccg

SEQ ID NO: 116935 - DNA, 25 bp, E. coli
tgcttgatgaacagaaaccgctttg

SEQ ID NO: 116936 - DNA, 25 bp, E. coli
tgcttgatgaactgaaaccgctttg

SEQ ID NO: 116937 - DNA, 25 bp, E. coli
tctatcgtcggttcaattggtggcg

SEQ ID NO: 116938 - DNA, 25 bp, E. coli
tctatcgtcggtacaattggtggcg

SEQ ID NO: 116939 - DNA, 25 bp, E. coli
gcgtttctgataaagcccgggcgat

SEQ ID NO: 116940 - DNA, 25 bp, E. coli
gcgtttctgatatagcccgggcgat

SEQ ID NO: 116941 - DNA, 25 bp, E. coli
gaagcactggattttcgccctgata

SEQ ID NO: 116942 - DNA, 25 bp, E. coli
gaagcactggatattcgccctgata

SEQ ID NO: 116943 - DNA, 25 bp, E. coli
gatatggcaccagtaacaatcgcgc

SEQ ID NO: 116944 - DNA, 25 bp, E. coli
gatatggcaccactaacaatcgcgc

SEQ ID NO: 116945 - DNA, 25 bp, E. coli
taattgaaacaattcgcgggcactg

SEQ ID NO: 116946 - DNA, 25 bp, E. coli
taattgaaacaaatcgcgggcactg

SEQ ID NO: 116947 - DNA, 25 bp, E. coli
taatcaggatcgtgaagccctcgac

SEQ ID NO: 116948 - DNA, 25 bp, E. coli
taatcaggatcgagaagccctcgac

SEQ ID NO: 116949 - DNA, 25 bp, E. coli
aattatgtccggtgtttatcgcccg

SEQ ID NO: 116950 - DNA, 25 bp, E. coli
aattatgtccggagtttatcgcccg

SEQ ID NO: 116951 - DNA, 25 bp, E. coli
caaaacgtttcatgccacgcgagcg

SEQ ID NO: 116952 - DNA, 25 bp, E. coli
caaaacgtttcaagccacgcgagcg

SEQ ID NO: 116953 - DNA, 25 bp, E. coli
tacgcttggtgggaaaaactggtca

SEQ ID NO: 116954 - DNA, 25 bp, E. coli
aaaactggtcaaagctgacacccgc

SEQ ID NO: 116955 - DNA, 25 bp, E. coli
aaaactggtcaatgctgacacccgc

SEQ ID NO: 116956 - DNA, 25 bp, E. coli
tacgcttggtggcaaaaactggtca

SEQ ID NO: 116957 - DNA, 25 bp, E. coli
tttatgtcgggtgaagtgcactgcc

SEQ ID NO: 116958 - DNA, 25 bp, E. coli
tttatgtcgggtcaagtgcactgcc

SEQ ID NO: 116959 - DNA, 25 bp, E. coli
tcccttcgtcatttcaacaaaacgt

SEQ ID NO: 116960 - DNA, 25 bp, E. coli
tcccttcgtcatatcaacaaaacgt

SEQ ID NO: 116961 - DNA, 25 bp, E. coli
ccttgccgggcataacggctgtggt

SEQ ID NO: 116962 - DNA, 25 bp, E. coli
ccttgccgggcaaaacggctgtggt

SEQ ID NO: 116963 - DNA, 25 bp, E. coli
cgacgttgattaaaattatgtccgg

SEQ ID NO: 116964 - DNA, 25 bp, E. coli
cggctgtggtaaatcgacgttgatt

SEQ ID NO: 116965 - DNA, 25 bp, E. coli
cgacgttgattataattatgtccgg

SEQ ID NO: 116966 - DNA, 25 bp, E. coli
cggctgtggtaattcgacgttgatt

SEQ ID NO: 116967 - DNA, 25 bp, E. coli
gatgtttctctccactttatgtcgg

SEQ ID NO: 116968 - DNA, 25 bp, E. coli
gatgtttctctcgactttatgtcgg

SEQ ID NO: 116969 - DNA, 25 bp, E. coli
gagcgctgcgcgatgtttctctcga

SEQ ID NO: 116970 - DNA, 25 bp, E. coli
gagcgctgcgcgttgtttctctcga

SEQ ID NO: 116971 - DNA, 25 bp, E. coli
aaacgctctgcttatcaacgctatg

SEQ ID NO: 116972 - DNA, 25 bp, E. coli
aaagcgattagaggccggactaaca

SEQ ID NO: 116973 - DNA, 25 bp, E. coli
aaacgctctgctaatcaacgctatg

SEQ ID NO: 116974 - DNA, 25 bp, E. coli
aaagcgattagacgccggactaaca

SEQ ID NO: 116975 - DNA, 25 bp, E. coli
tatcccgttttattaaacgctctgc

SEQ ID NO: 116976 - DNA, 25 bp, E. coli
tatcccgttttaataaacgctctgc

SEQ ID NO: 116977 - DNA, 25 bp, E. coli
tattaaacgctcagctaatcaacgc

SEQ ID NO: 116978 - DNA, 25 bp, E. coli
tattaaacgctctgctaatcaacgc

SEQ ID NO: 116979 - DNA, 25 bp, E. coli
tgggagttgaaaggcctcagcctga

SEQ ID NO: 116980 - DNA, 25 bp, E. coli
tgggagttgaaacgcctcagcctga

SEQ ID NO: 116981 - DNA, 25 bp, E. coli
tctcaaccatcactacgctatcccg

SEQ ID NO: 116982 - DNA, 25 bp, E. coli
tcacgcggtgggagttgaaacgcct

SEQ ID NO: 116983 - DNA, 25 bp, E. coli
tctcaaccatcagtacgctatcccg

SEQ ID NO: 116984 - DNA, 25 bp, E. coli
tcacgcggtgggtgttgaaacgcct

SEQ ID NO: 116985 - DNA, 25 bp, E. coli
ggactaacagaagaacaaaatcaac

SEQ ID NO: 116986 - DNA, 25 bp, E. coli
ggactaacagaacaacaaaatcaac

SEQ ID NO: 116987 - DNA, 25 bp, E. coli
gattagacgccggactaacagaaca

SEQ ID NO: 116988 - DNA, 25 bp, E. coli
tgattcacgcggtgggagttgaaac

SEQ ID NO: 116989 - DNA, 25 bp, E. coli
tgattcacgcggagggagttgaaac

SEQ ID NO: 116990 - DNA, 25 bp, E. coli
gattagacgccgcactaacagaaca

SEQ ID NO: 116991 - DNA, 25 bp, E. coli
gacgccggactatcagaacaacaaa

SEQ ID NO: 116992 - DNA, 25 bp, E. coli
gacgccggactaacagaacaacaaa

SEQ ID NO: 116993 - DNA, 25 bp, E. coli
aaggcttcggtaacggtgctgcagt

SEQ ID NO: 116994 - DNA, 25 bp, E. coli
aaggcttcggtatcggtgctgcagt

SEQ ID NO: 116995 - DNA, 25 bp, E. coli
cagtaccagggctaaaacggtagcg

SEQ ID NO: 116996 - DNA, 25 bp, E. coli
cagtaccagggcaaaaacggtagcg

SEQ ID NO: 116997 - DNA, 25 bp, E. coli
cttcggtatcggtgctgcagtttcc

SEQ ID NO: 116998 - DNA, 25 bp, E. coli
cttcggtatcggagctgcagtttcc

SEQ ID NO: 116999 - DNA, 25 bp, E. coli
tactgatgatcacaacagcccgctg

SEQ ID NO: 117000 - DNA, 25 bp, E. coli
tactgatgatcagaacagcccgctg

SEQ ID NO: 117001 - DNA, 25 bp, E. coli
aaaacctgggtgacatcaatggtcg

SEQ ID NO: 117002 - DNA, 25 bp, E. coli
acagcccgctgttcatcggtaacgg

SEQ ID NO: 117003 - DNA, 25 bp, E. coli
aaaacctgggtgtcatcaatggtcg

SEQ ID NO: 117004 - DNA, 25 bp, E. coli
acagcccgctgtacatcggtaacgg

SEQ ID NO: 117005 - DNA, 25 bp, E. coli
gcggcgaaggcatgactaacaacgg

SEQ ID NO: 117006 - DNA, 25 bp, E. coli
gcgtaagcggcgtaggcatgactaa

SEQ ID NO: 117007 - DNA, 25 bp, E. coli
gcggcgaaggcaagactaacaacgg

SEQ ID NO: 117008 - DNA, 25 bp, E. coli
gcgtaagcggcgaaggcatgactaa

SEQ ID NO: 117009 - DNA, 25 bp, E. coli
gcaaaaacggtagcgtaagcggcga

SEQ ID NO: 117010 - DNA, 25 bp, E. coli
gcaaaaacggtaccgtaagcggcga

SEQ ID NO: 117011 - DNA, 25 bp, E. coli
cgaaggcatgactaacaacggtcgt

SEQ ID NO: 117012 - DNA, 25 bp, E. coli
cgaaggcatgacaaacaacggtcgt

SEQ ID NO: 117013 - DNA, 25 bp, E. coli
gtgtcatcaatgctcgtaactacga

SEQ ID NO: 117014 - DNA, 25 bp, E. coli
gtgtcatcaatggtcgtaactacga

SEQ ID NO: 117015 - DNA, 25 bp, E. coli
aatattgccgatgcctggaaagagt

SEQ ID NO: 117016 - DNA, 25 bp, E. coli
aatattgccgatccctggaaagagt

SEQ ID NO: 117017 - DNA, 25 bp, E. coli
aacatcattgagaacggactgcggg

SEQ ID NO: 117018 - DNA, 25 bp, E. coli
aacatcattgagtacggactgcggg

SEQ ID NO: 117019 - DNA, 25 bp, E. coli
tatgcacaaattcgcgtcgaaagcg

SEQ ID NO: 117020 - DNA, 25 bp, E. coli
tatgcaggacaacaatcagcaaggc

SEQ ID NO: 117021 - DNA, 25 bp, E. coli
tatgcacaaattggcgtcgaaagcg

SEQ ID NO: 117022 - DNA, 25 bp, E. coli
tatgcaggacaagaatcagcaaggc

SEQ ID NO: 117023 - DNA, 25 bp, E. coli
ttgtcaaaagcgttcaacatcattg

SEQ ID NO: 117024 - DNA, 25 bp, E. coli
ttctttgattcaggacccagtctga

SEQ ID NO: 117025 - DNA, 25 bp, E. coli
ttctttgattcacgacccagtctga

SEQ ID NO: 117026 - DNA, 25 bp, E. coli
ttgtcaaaagcgatcaacatcattg

SEQ ID NO: 117027 - DNA, 25 bp, E. coli
tgcaagccaatttacgcaacgatgt

SEQ ID NO: 117028 - DNA, 25 bp, E. coli
tgcaagccaattaacgcaacgatgt

SEQ ID NO: 117029 - DNA, 25 bp, E. coli
tcgaaagcgccgaaatgagcgccag

SEQ ID NO: 117030 - DNA, 25 bp, E. coli
tcgaaagcgccgtaatgagcgccag

SEQ ID NO: 117031 - DNA, 25 bp, E. coli
tcttgatgaagacagcaaagacgaa

SEQ ID NO: 117032 - DNA, 25 bp, E. coli
tcttgatgaagagagcaaagacgaa

SEQ ID NO: 117033 - DNA, 25 bp, E. coli
gcaacgatgtctccgcagtcgaaga

SEQ ID NO: 117034 - DNA, 25 bp, E. coli
gcaacgatgtctgcgcagtcgaaga

SEQ ID NO: 117035 - DNA, 25 bp, E. coli
ctctttatagctttatggtcaggcg

SEQ ID NO: 117036 - DNA, 25 bp, E. coli
ctctttatagctatatggtcaggcg

SEQ ID NO: 117037 - DNA, 25 bp, E. coli
aatgtgcgaatacccagaatccccg

SEQ ID NO: 117038 - DNA, 25 bp, E. coli
aatgtgcgaatagccagaatccccg

SEQ ID NO: 117039 - DNA, 25 bp, E. coli
aaatggcgataacccaggcaaagac

SEQ ID NO: 117040 - DNA, 25 bp, E. coli
aaatggcgataagccaggcaaagac

SEQ ID NO: 117041 - DNA, 25 bp, E. coli
aatagccagaatgcccgccaacata

SEQ ID NO: 117042 - DNA, 25 bp, E. coli
aatagccagaatccccgccaacata

SEQ ID NO: 117043 - DNA, 25 bp, E. coli
gaatccccgccaacataatcaaaat

SEQ ID NO: 117044 - DNA, 25 bp, E. coli
gaatccccgccatcataatcaaaat

SEQ ID NO: 117045 - DNA, 25 bp, E. coli
ccgccaacataatcaaaatggcgat

SEQ ID NO: 117046 - DNA, 25 bp, E. coli
ccgccaacataaacaaaatggcgat

SEQ ID NO: 117047 - DNA, 25 bp, E. coli
cgcgacgggcaatgtgcgaatagcc

SEQ ID NO: 117048 - DNA, 25 bp, E. coli
cgcgacgggcaaagtgcgaatagcc

SEQ ID NO: 117049 - DNA, 25 bp, E. coli
gtgcgaatagcctgaatccccgcca

SEQ ID NO: 117050 - DNA, 25 bp, E. coli
gtgcgaatagccagaatccccgcca

SEQ ID NO: 117051 - DNA, 25 bp, E. coli
ggcgataacccacgcaaagaccggg

SEQ ID NO: 117052 - DNA, 25 bp, E. coli
ggcgataacccaggcaaagaccggg

SEQ ID NO: 117053 - DNA, 25 bp, E. coli
taacccaggcaaagaccgggcggcg

SEQ ID NO: 117054 - DNA, 25 bp, E. coli
taacccaggcaatgaccgggcggcg

SEQ ID NO: 117055 - DNA, 25 bp, E. coli
tcaaaatggcgaaaacccaggcaaa

SEQ ID NO: 117056 - DNA, 25 bp, E. coli
tcaaaatggcgataacccaggcaaa

SEQ ID NO: 117057 - DNA, 25 bp, E. coli
gacgggcaatgtccgaatagccaga

SEQ ID NO: 117058 - DNA, 25 bp, E. coli
gacgggcaatgtgcgaatagccaga

SEQ ID NO: 117059 - DNA, 25 bp, E. coli
caaattagatcagctgccacgcgat

SEQ ID NO: 117060 - DNA, 25 bp, E. coli
caaattcggcttgctctcgctgact

SEQ ID NO: 117061 - DNA, 25 bp, E. coli
caaattcggcttcctctcgctgact

SEQ ID NO: 117062 - DNA, 25 bp, E. coli
caaattagatcacctgccacgcgat

SEQ ID NO: 117063 - DNA, 25 bp, E. coli
taaaaactcagatgccggtgtctac

SEQ ID NO: 117064 - DNA, 25 bp, E. coli
taaaaactcagaagccggtgtctac

SEQ ID NO: 117065 - DNA, 25 bp, E. coli
attattaatatgtccgccgcagcgt

SEQ ID NO: 117066 - DNA, 25 bp, E. coli
attattaatatgaccgccgcagcgt

SEQ ID NO: 117067 - DNA, 25 bp, E. coli
tattgagcttggactggcctcggca

SEQ ID NO: 117068 - DNA, 25 bp, E. coli
tattccacggcaaggcggcgtattt

SEQ ID NO: 117069 - DNA, 25 bp, E. coli
tattccacggcatggcggcgtattt

SEQ ID NO: 117070 - DNA, 25 bp, E. coli
tattgagcttggtctggcctcggca

SEQ ID NO: 117071 - DNA, 25 bp, E. coli
tgctggcttacctgaatttacgcgc

SEQ ID NO: 117072 - DNA, 25 bp, E. coli
tgctggcttaccagaatttacgcgc

SEQ ID NO: 117073 - DNA, 25 bp, E. coli
gaatatattatgtcgccggttgcca

SEQ ID NO: 117074 - DNA, 25 bp, E. coli
gaatatattatgacgccggttgcca

SEQ ID NO: 117075 - DNA, 25 bp, E. coli
ggattaacggctgaagagcgccata

SEQ ID NO: 117076 - DNA, 25 bp, E. coli
ggattaacggctcaagagcgccata

SEQ ID NO: 117077 - DNA, 25 bp, E. coli
tcaacgctgatgctgctgttaacgc

SEQ ID NO: 117078 - DNA, 25 bp, E. coli
tcaacgctgatggtgctgttaacgc

SEQ ID NO: 117079 - DNA, 25 bp, E. coli
gatgatcccgaagttcaactgggcg

SEQ ID NO: 117080 - DNA, 25 bp, E. coli
gatgatcccgaacttcaactgggcg

SEQ ID NO: 117081 - DNA, 25 bp, E. coli
cactgaccgacagggtggcttttgt

SEQ ID NO: 117082 - DNA, 25 bp, E. coli
cactgaccgacacggtggcttttgt

SEQ ID NO: 117083 - DNA, 25 bp, E. coli
taccactgaccgtcacggtggcttt

SEQ ID NO: 117084 - DNA, 25 bp, E. coli
taccactgaccgacacggtggcttt

SEQ ID NO: 117085 - DNA, 25 bp, E. coli
accggaatgttgtccttgcctgcag

SEQ ID NO: 117086 - DNA, 25 bp, E. coli
agcggattttattggcacgggtatc

SEQ ID NO: 117087 - DNA, 25 bp, E. coli
accggaatgttgaccttgcctgcag

SEQ ID NO: 117088 - DNA, 25 bp, E. coli
agcggattttataggcacgggtatc

SEQ ID NO: 117089 - DNA, 25 bp, E. coli
ttcacggtgatgctcataccactga

SEQ ID NO: 117090 - DNA, 25 bp, E. coli
ttcacggtgatggtcataccactga

SEQ ID NO: 117091 - DNA, 25 bp, E. coli
tcataccactgagcgacacggtggc

SEQ ID NO: 117092 - DNA, 25 bp, E. coli
tcataccactgaccgacacggtggc

SEQ ID NO: 117093 - DNA, 25 bp, E. coli
gaatgttgacctagcctgcagcaac

SEQ ID NO: 117094 - DNA, 25 bp, E. coli
gaatgttgaccttgcctgcagcaac

SEQ ID NO: 117095 - DNA, 25 bp, E. coli
gacacggtggcttttgttttatccg

SEQ ID NO: 117096 - DNA, 25 bp, E. coli
gacacggtggctattgttttatccg

SEQ ID NO: 117097 - DNA, 25 bp, E. coli
ggtgatggtcataccactgaccgac

SEQ ID NO: 117098 - DNA, 25 bp, E. coli
ggtgatggtcattccactgaccgac

SEQ ID NO: 117099 - DNA, 25 bp, E. coli
ggaatgttgaccatgcctgcagcaa

SEQ ID NO: 117100 - DNA, 25 bp, E. coli
tggtcataccactgaccgacacggt

SEQ ID NO: 117101 - DNA, 25 bp, E. coli
tggtcataccacagaccgacacggt

SEQ ID NO: 117102 - DNA, 25 bp, E. coli
ggaatgttgaccttgcctgcagcaa

SEQ ID NO: 117103 - DNA, 25 bp, E. coli
aattatcagaaattgccgacccggc

SEQ ID NO: 117104 - DNA, 25 bp, E. coli
aattatcagaaaatgccgacccggc

SEQ ID NO: 117105 - DNA, 25 bp, E. coli
aaaagctgttgcgagaagatgcccc

SEQ ID NO: 117106 - DNA, 25 bp, E. coli
aaaagctgttgccagaagatgcccc

SEQ ID NO: 117107 - DNA, 25 bp, E. coli
tattgcagcggcagtgaaaacgcca

SEQ ID NO: 117108 - DNA, 25 bp, E. coli
tatcccagcggacgatgtgatcgcc

SEQ ID NO: 117109 - DNA, 25 bp, E. coli
tatcccagcggaggatgtgatcgcc

SEQ ID NO: 117110 - DNA, 25 bp, E. coli
tattgcagcggctgtgaaaacgcca

SEQ ID NO: 117111 - DNA, 25 bp, E. coli
tgttgtcatccatccgacagcgcgt

SEQ ID NO: 117112 - DNA, 25 bp, E. coli
tgttgtcatccaaccgacagcgcgt

SEQ ID NO: 117113 - DNA, 25 bp, E. coli
tgtgatcgccgctacggaaaagctg

SEQ ID NO: 117114 - DNA, 25 bp, E. coli
tgtgatcgccgcaacggaaaagctg

SEQ ID NO: 117115 - DNA, 25 bp, E. coli
gcaactttatggtcatcggcagcat

SEQ ID NO: 117116 - DNA, 25 bp, E. coli
gcaactttatggacatcggcagcat

SEQ ID NO: 117117 - DNA, 25 bp, E. coli
gaaaacccggaaattaatgcgctct

SEQ ID NO: 117118 - DNA, 25 bp, E. coli
gaaaacccggaatttaatgcgctct

SEQ ID NO: 117119 - DNA, 25 bp, E. coli
gatcacgtattcaggcgtccctgga

SEQ ID NO: 117120 - DNA, 25 bp, E. coli
gatcacgtattctggcgtccctgga

SEQ ID NO: 117121 - DNA, 25 bp, E. coli
gatgccctgggcgtaaaagatcatt

SEQ ID NO: 117122 - DNA, 25 bp, E. coli
gatgccctgggcctaaaagatcatt

SEQ ID NO: 117123 - DNA, 25 bp, E. coli
gatgcgccgggatttagatgccctg

SEQ ID NO: 117124 - DNA, 25 bp, E. coli
gatgcgccgggaattagatgccctg

SEQ ID NO: 117125 - DNA, 25 bp, E. coli
aagtggattactccaactttccagc

SEQ ID NO: 117126 - DNA, 25 bp, E. coli
aagtggattactgcaactttccagc

SEQ ID NO: 117127 - DNA, 25 bp, E. coli
ttactgcaacttaccagctgcaact

SEQ ID NO: 117128 - DNA, 25 bp, E. coli
ttactgcaactttccagctgcaact

SEQ ID NO: 117129 - DNA, 25 bp, E. coli
tgttggcagctttgcctgcagctta

SEQ ID NO: 117130 - DNA, 25 bp, E. coli
tgttggcagcttagcctgcagctta

SEQ ID NO: 117131 - DNA, 25 bp, E. coli
tgcggtttgttgaaagtggattact

SEQ ID NO: 117132 - DNA, 25 bp, E. coli
tgcggtttgttgtaagtggattact

SEQ ID NO: 117133 - DNA, 25 bp, E. coli
tgcctggacattggtgcggtttgtt

SEQ ID NO: 117134 - DNA, 25 bp, E. coli
tgcctggacattcgtgcggtttgtt

SEQ ID NO: 117135 - DNA, 25 bp, E. coli
gcctgttggcagctttgcctgcagc

SEQ ID NO: 117136 - DNA, 25 bp, E. coli
gcctgttggcaggtttgcctgcagc

SEQ ID NO: 117137 - DNA, 25 bp, E. coli
cctggacattggtgcggtttgttga

SEQ ID NO: 117138 - DNA, 25 bp, E. coli
cctggacattggagcggtttgttga

SEQ ID NO: 117139 - DNA, 25 bp, E. coli
gcagctttgcctccagcttatgtca

SEQ ID NO: 117140 - DNA, 25 bp, E. coli
gcagctttgcctgcagcttatgtca

SEQ ID NO: 117141 - DNA, 25 bp, E. coli
gacattggtgcgctttgttgaaagt

SEQ ID NO: 117142 - DNA, 25 bp, E. coli
gacattggtgcggtttgttgaaagt

SEQ ID NO: 117143 - DNA, 25 bp, E. coli
ggattactgcaactttccagctgca

SEQ ID NO: 117144 - DNA, 25 bp, E. coli
ggtttgttgaaagtggattactgca

SEQ ID NO: 117145 - DNA, 25 bp, E. coli
ggtttgttgaaactggattactgca

SEQ ID NO: 117146 - DNA, 25 bp, E. coli
ggattactgcaagtttccagctgca

SEQ ID NO: 117147 - DNA, 25 bp, E. coli
tatatcgggatgaacaataccagcg

SEQ ID NO: 117148 - DNA, 25 bp, E. coli
tattgaccatctccgccagtcggtg

SEQ ID NO: 117149 - DNA, 25 bp, E. coli
tatatcgggatgtacaataccagcg

SEQ ID NO: 117150 - DNA, 25 bp, E. coli
tattgaccatctgcgccagtcggtg

SEQ ID NO: 117151 - DNA, 25 bp, E. coli
tcatgtcggcagagtatgtggcgct

SEQ ID NO: 117152 - DNA, 25 bp, E. coli
tcatgtcggcagtgtatgtggcgct

SEQ ID NO: 117153 - DNA, 25 bp, E. coli
gctgtcggcgctcatagaccagcca

SEQ ID NO: 117154 - DNA, 25 bp, E. coli
gctgtcggcgctgatagaccagcca

SEQ ID NO: 117155 - DNA, 25 bp, E. coli
gaataacggtgtgcctgtgtccctt

SEQ ID NO: 117156 - DNA, 25 bp, E. coli
gaataacggtgtccctgtgtccctt

SEQ ID NO: 117157 - DNA, 25 bp, E. coli
gaatatggttccgtgctgtcggcgc

SEQ ID NO: 117158 - DNA, 25 bp, E. coli
gaatatggttccctgctgtcggcgc

SEQ ID NO: 117159 - DNA, 25 bp, E. coli
gacattctgctgacgccgcagggta

SEQ ID NO: 117160 - DNA, 25 bp, E. coli
gacattctgctgtcgccgcagggta

SEQ ID NO: 117161 - DNA, 25 bp, E. coli
gtgtccctttccctatcaacaggag

SEQ ID NO: 117162 - DNA, 25 bp, E. coli
gtgtccctttccgtatcaacaggag

SEQ ID NO: 117163 - DNA, 25 bp, E. coli
ggtagccgcattccccgtcgggaat

SEQ ID NO: 117164 - DNA, 25 bp, E. coli
ggtagccgcattgcccgtcgggaat

SEQ ID NO: 117165 - DNA, 25 bp, E. coli
ggcgttacgcctccaggtcatgtcg

SEQ ID NO: 117166 - DNA, 25 bp, E. coli
ggcgttacgcctgcaggtcatgtcg

SEQ ID NO: 117167 - DNA, 25 bp, E. coli
tcaacaggagcacagaatggcagtg

SEQ ID NO: 117168 - DNA, 25 bp, E. coli
tcaacaggagcagagaatggcagtg

SEQ ID NO: 117169 - DNA, 25 bp, E. coli
aattctcgcggccttggatggcacc

SEQ ID NO: 117170 - DNA, 25 bp, E. coli
caatgccgaagtgacgaattctgcc

SEQ ID NO: 117171 - DNA, 25 bp, E. coli
aattctcgcggcgttggatggcacc

SEQ ID NO: 117172 - DNA, 25 bp, E. coli
caatgccgaagtcacgaattctgcc

SEQ ID NO: 117173 - DNA, 25 bp, E. coli
caggagcaagatgtcgacgcgattg

SEQ ID NO: 117174 - DNA, 25 bp, E. coli
caggagcaagatctcgacgcgattg

SEQ ID NO: 117175 - DNA, 25 bp, E. coli
agcccaggagcaagatctcgacgcg

SEQ ID NO: 117176 - DNA, 25 bp, E. coli
agcccaggagcatgatctcgacgcg

SEQ ID NO: 117177 - DNA, 25 bp, E. coli
gcgttggatggcaccctggatgact

SEQ ID NO: 117178 - DNA, 25 bp, E. coli
gcgttggatggctccctggatgact

SEQ ID NO: 117179 - DNA, 25 bp, E. coli
gaagtgacgaattctgccatcgagc

SEQ ID NO: 117180 - DNA, 25 bp, E. coli
gaagtgacgaatactgccatcgagc

SEQ ID NO: 117181 - DNA, 25 bp, E. coli
cgacgcgattgctgctgaaattctc

SEQ ID NO: 117182 - DNA, 25 bp, E. coli
cgacgcgattgcagctgaaattctc

SEQ ID NO: 117183 - DNA, 25 bp, E. coli
gatctcgacgcgtttgcagctgaaa

SEQ ID NO: 117184 - DNA, 25 bp, E. coli
ggatgactttatcatcgcgcgcgaa

SEQ ID NO: 117185 - DNA, 25 bp, E. coli
ggatgactttatgatcgcgcgcgaa

SEQ ID NO: 117186 - DNA, 25 bp, E. coli
gacgaattctgcgatcgagctgaaa

SEQ ID NO: 117187 - DNA, 25 bp, E. coli
gatctcgacgcgattgcagctgaaa

SEQ ID NO: 117188 - DNA, 25 bp, E. coli
gacgaattctgccatcgagctgaaa

SEQ ID NO: 117189 - DNA, 25 bp, E. coli
gatggcaccctgcatgactttatca

SEQ ID NO: 117190 - DNA, 25 bp, E. coli
gatggcaccctggatgactttatca

SEQ ID NO: 117191 - DNA, 25 bp, E. coli
cagagtaatgttctgagtactcccc

SEQ ID NO: 117192 - DNA, 25 bp, E. coli
caactgccagaatcggtgtggcgaa

SEQ ID NO: 117193 - DNA, 25 bp, E. coli
cagagtaatgttgtgagtactcccc

SEQ ID NO: 117194 - DNA, 25 bp, E. coli
caactgccagaaacggtgtggcgaa

SEQ ID NO: 117195 - DNA, 25 bp, E. coli
catcgaatcccgaacctttttgccg

SEQ ID NO: 117196 - DNA, 25 bp, E. coli
catcgaatcccgtacctttttgccg

SEQ ID NO: 117197 - DNA, 25 bp, E. coli
atggcaactgccagaaacggtgtgg

SEQ ID NO: 117198 - DNA, 25 bp, E. coli
atggcaactgcctgaaacggtgtgg

SEQ ID NO: 117199 - DNA, 25 bp, E. coli
aaacggtgtggccaagcagagtaat

SEQ ID NO: 117200 - DNA, 25 bp, E. coli
aaacggtgtggcgaagcagagtaat

SEQ ID NO: 117201 - DNA, 25 bp, E. coli
ttatcgcccagagtaataaagccca

SEQ ID NO: 117202 - DNA, 25 bp, E. coli
ttatcgcccagactaataaagccca

SEQ ID NO: 117203 - DNA, 25 bp, E. coli
tgcttcttgtatcgcgtgatggctg

SEQ ID NO: 117204 - DNA, 25 bp, E. coli
tgcttcttgtatggcgtgatggctg

SEQ ID NO: 117205 - DNA, 25 bp, E. coli
gtaatgttgtgagtactccccagct

SEQ ID NO: 117206 - DNA, 25 bp, E. coli
gtaatgttgtgactactccccagct

SEQ ID NO: 117207 - DNA, 25 bp, E. coli
gggtaaaagcgatggcaactgccag

SEQ ID NO: 117208 - DNA, 25 bp, E. coli
gggtaaaagcgaaggcaactgccag

SEQ ID NO: 117209 - DNA, 25 bp, E. coli
tggcatcacgcatcgaatcccgaac

SEQ ID NO: 117210 - DNA, 25 bp, E. coli
tggctggttggcatcacgcatcgaa

SEQ ID NO: 117211 - DNA, 25 bp, E. coli
tggctggttggcttcacgcatcgaa

SEQ ID NO: 117212 - DNA, 25 bp, E. coli
tggcatcacgcaacgaatcccgaac

SEQ ID NO: 117213 - DNA, 25 bp, E. coli
caccgtggactgatatctctggcga

SEQ ID NO: 117214 - DNA, 25 bp, E. coli
caaaaacctacgttgccgggtgcga

SEQ ID NO: 117215 - DNA, 25 bp, E. coli
caccgtggactgttatctctggcga

SEQ ID NO: 117216 - DNA, 25 bp, E. coli
caaaaacctacgatgccgggtgcga

SEQ ID NO: 117217 - DNA, 25 bp, E. coli
cagtgagcaaaacaacctgggcgga

SEQ ID NO: 117218 - DNA, 25 bp, E. coli
cagtgagcaaaagaacctgggcgga

SEQ ID NO: 117219 - DNA, 25 bp, E. coli
ttttatggcgcgacggtgaccagcg

SEQ ID NO: 117220 - DNA, 25 bp, E. coli
ttttatggcgcgtcggtgaccagcg

SEQ ID NO: 117221 - DNA, 25 bp, E. coli
tgataaataccctctcgctggcgga

SEQ ID NO: 117222 - DNA, 25 bp, E. coli
tgataaatacccactcgctggcgga

SEQ ID NO: 117223 - DNA, 25 bp, E. coli
tctgtgaactatgacgccagcagcg

SEQ ID NO: 117224 - DNA, 25 bp, E. coli
tctgtgaactatcacgccagcagcg

SEQ ID NO: 117225 - DNA, 25 bp, E. coli
gaatatactcagtcaccgtcgcggg

SEQ ID NO: 117226 - DNA, 25 bp, E. coli
gaagtatttatcaacagcgacggag

SEQ ID NO: 117227 - DNA, 25 bp, E. coli
gaagtatttatctacagcgacggag

SEQ ID NO: 117228 - DNA, 25 bp, E. coli
gaatatactcagacaccgtcgcggg

SEQ ID NO: 117229 - DNA, 25 bp, E. coli
gacgaagtgctgttcaaggtgaccg

SEQ ID NO: 117230 - DNA, 25 bp, E. coli
gacgaagtgctgatcaaggtgaccg

SEQ ID NO: 117231 - DNA, 25 bp, E. coli
ggctatatcgtatccaccagcggta

SEQ ID NO: 117232 - DNA, 25 bp, E. coli
ggctatatcgtaaccaccagcggta

SEQ ID NO: 117233 - DNA, 25 bp, E. coli
gatgcacggcatgttgtcagacgcg

SEQ ID NO: 117234 - DNA, 25 bp, E. coli
gatgcacggcatcttgtcagacgcg

SEQ ID NO: 117235 - DNA, 25 bp, E. coli
atgaaataggccatccgcgcggcgt

SEQ ID NO: 117236 - DNA, 25 bp, E. coli
atgaaataggccttccgcgcggcgt

SEQ ID NO: 117237 - DNA, 25 bp, E. coli
tatgcatgaggatacctttggcccg

SEQ ID NO: 117238 - DNA, 25 bp, E. coli
tatgcatgaggaaacctttggcccg

SEQ ID NO: 117239 - DNA, 25 bp, E. coli
tattggcggcgcagatggtaaacat

SEQ ID NO: 117240 - DNA, 25 bp, E. coli
tattggcggcgctgatggtaaacat

SEQ ID NO: 117241 - DNA, 25 bp, E. coli
tattcaaagcgaacgtccaggagaa

SEQ ID NO: 117242 - DNA, 25 bp, E. coli
tattcaaagcgatcgtccaggagaa

SEQ ID NO: 117243 - DNA, 25 bp, E. coli
tattatccgccgacattgctgctgg

SEQ ID NO: 117244 - DNA, 25 bp, E. coli
tattatccgccgtcattgctgctgg

SEQ ID NO: 117245 - DNA, 25 bp, E. coli
ttggttgcgcaaaatctccgccggg

SEQ ID NO: 117246 - DNA, 25 bp, E. coli
ttggttgcgcaatatctccgccggg

SEQ ID NO: 117247 - DNA, 25 bp, E. coli
tgtggtaaaccctgctacagaggct

SEQ ID NO: 117248 - DNA, 25 bp, E. coli
tgtggtaaacccagctacagaggct

SEQ ID NO: 117249 - DNA, 25 bp, E. coli
tctgaacgtcgccatgaaagccatt

SEQ ID NO: 117250 - DNA, 25 bp, E. coli
tcagttcgtcaatcggctgggtgaa

SEQ ID NO: 117251 - DNA, 25 bp, E. coli
tctgaacgtcgcgatgaaagccatt

SEQ ID NO: 117252 - DNA, 25 bp, E. coli
tcagttcgtcaaacggctgggtgaa

SEQ ID NO: 117253 - DNA, 25 bp, E. coli
gcagaacgtgcagaaccagaatggg

SEQ ID NO: 117254 - DNA, 25 bp, E. coli
gcagaacgtgcacaaccagaatggg

SEQ ID NO: 117255 - DNA, 25 bp, E. coli
taatgacagtgaatacggcctgacc

SEQ ID NO: 117256 - DNA, 25 bp, E. coli
taatgacagtgattacggcctgacc

SEQ ID NO: 117257 - DNA, 25 bp, E. coli
aatgggcagcaaaaagaagaagcag

SEQ ID NO: 117258 - DNA, 25 bp, E. coli
aatgggcagcaataagaagaagcag

SEQ ID NO: 117259 - DNA, 25 bp, E. coli
cttaactgatttgaggagttgtaag

SEQ ID NO: 117260 - DNA, 25 bp, E. coli
cttaactgatttcaggagttgtaag

SEQ ID NO: 117261 - DNA, 25 bp, E. coli
tcttaccccttctctggtaagggcg

SEQ ID NO: 117262 - DNA, 25 bp, E. coli
tcttaccccttcactggtaagggcg

SEQ ID NO: 117263 - DNA, 25 bp, E. coli
taaaaagccgccagaatgggcagca

SEQ ID NO: 117264 - DNA, 25 bp, E. coli
taaaaagccgcctgaatgggcagca

SEQ ID NO: 117265 - DNA, 25 bp, E. coli
tatatgagagactaaaaagccgcct

SEQ ID NO: 117266 - DNA, 25 bp, E. coli
tatatgagagacaaaaaagccgcct

SEQ ID NO: 117267 - DNA, 25 bp, E. coli
tggtaagggcgtattccacctgcta

SEQ ID NO: 117268 - DNA, 25 bp, E. coli
tggtaagggcgttttccacctgcta

SEQ ID NO: 117269 - DNA, 25 bp, E. coli
tgctgaacagaatgtcttaactgat

SEQ ID NO: 117270 - DNA, 25 bp, E. coli
tccagtgaaaaaatagccattctta

SEQ ID NO: 117271 - DNA, 25 bp, E. coli
tccagtgaaaaattagccattctta

SEQ ID NO: 117272 - DNA, 25 bp, E. coli
tgctgaacagaaagtcttaactgat

SEQ ID NO: 117273 - DNA, 25 bp, E. coli
ccacctgctattgtgctgaacagaa

SEQ ID NO: 117274 - DNA, 25 bp, E. coli
ccacctgctattctgctgaacagaa

SEQ ID NO: 117275 - DNA, 25 bp, E. coli
gcgaggatttataaattctccagtg

SEQ ID NO: 117276 - DNA, 25 bp, E. coli
gcgaggatttattaattctccagtg

SEQ ID NO: 117277 - DNA, 25 bp, E. coli
gaaattcagtcttttgtagcgagga

SEQ ID NO: 117278 - DNA, 25 bp, E. coli
gaaattcagtctattgtagcgagga

SEQ ID NO: 117279 - DNA, 25 bp, E. coli
aaacgcatattcgactggcggcggg

SEQ ID NO: 117280 - DNA, 25 bp, E. coli
aaacgcatattccactggcggcggg

SEQ ID NO: 117281 - DNA, 25 bp, E. coli
tatcgacggcattaaaacgctacgc

SEQ ID NO: 117282 - DNA, 25 bp, E. coli
tatcgacggcataaaaacgctacgc

SEQ ID NO: 117283 - DNA, 25 bp, E. coli
ttaaagaactggagccgtatcgccc

SEQ ID NO: 117284 - DNA, 25 bp, E. coli
ttaaagaactggtgccgtatcgccc

SEQ ID NO: 117285 - DNA, 25 bp, E. coli
tgggaattcattacaacaaaggcgc

SEQ ID NO: 117286 - DNA, 25 bp, E. coli
tgggaattcatttcaacaaaggcgc

SEQ ID NO: 117287 - DNA, 25 bp, E. coli
tccatagtgaagtgatccgccgtgc

SEQ ID NO: 117288 - DNA, 25 bp, E. coli
tccatagtgaagagatccgccgtgc

SEQ ID NO: 117289 - DNA, 25 bp, E. coli
tcaaaggtaaagagctgaatgcgcc

SEQ ID NO: 117290 - DNA, 25 bp, E. coli
tcaaaggtaaagtgctgaatgcgcc

SEQ ID NO: 117291 - DNA, 25 bp, E. coli
gctaattgataagtcccgcgcggta

SEQ ID NO: 117292 - DNA, 25 bp, E. coli
gctaattgataactcccgcgcggta

SEQ ID NO: 117293 - DNA, 25 bp, E. coli
gaagacttcagcttggtcggcggct

SEQ ID NO: 117294 - DNA, 25 bp, E. coli
gaagacttcagcatggtcggcggct

SEQ ID NO: 117295 - DNA, 25 bp, E. coli
gaatgctacaaattcgccggaatgg

SEQ ID NO: 117296 - DNA, 25 bp, E. coli
gaatgctacaaaatcgccggaatgg

SEQ ID NO: 117297 - DNA, 25 bp, E. coli
gattttaaacgcctgctggaggcag

SEQ ID NO: 117298 - DNA, 25 bp, E. coli
gattttaaacgcgtgctggaggcag

SEQ ID NO: 117299 - DNA, 25 bp, E. coli
tggcaaactaaagtcccgctgatcg

SEQ ID NO: 117300 - DNA, 25 bp, E. coli
tggcaaactaaactcccgctgatcg

SEQ ID NO: 117301 - DNA, 25 bp, E. coli
cagtaattcacaacaaagattggcg

SEQ ID NO: 117302 - DNA, 25 bp, E. coli
cagtaattcacatcaaagattggcg

SEQ ID NO: 117303 - DNA, 25 bp, E. coli
atcggtaagccatccgttgcgttta

SEQ ID NO: 117304 - DNA, 25 bp, E. coli
atcggtaagccaaccgttgcgttta

SEQ ID NO: 117305 - DNA, 25 bp, E. coli
tattgcgtcaggacacttttacccc

SEQ ID NO: 117306 - DNA, 25 bp, E. coli
tattgcgtcaggtcacttttacccc

SEQ ID NO: 117307 - DNA, 25 bp, E. coli
ttaatgaatataaagctaagccagt

SEQ ID NO: 117308 - DNA, 25 bp, E. coli
ttaatgaatatatagctaagccagt

SEQ ID NO: 117309 - DNA, 25 bp, E. coli
gcgggaatatttttcagcattacct

SEQ ID NO: 117310 - DNA, 25 bp, E. coli
gcgggaatatttatcagcattacct

SEQ ID NO: 117311 - DNA, 25 bp, E. coli
gaattaccgcccacattaagagtca

SEQ ID NO: 117312 - DNA, 25 bp, E. coli
gaattaccgccctcattaagagtca

SEQ ID NO: 117313 - DNA, 25 bp, E. coli
gattggcgattctagcggtttgccg

SEQ ID NO: 117314 - DNA, 25 bp, E. coli
gtttgccgtagatttaccgccctca

SEQ ID NO: 117315 - DNA, 25 bp, E. coli
gtttgccgtagaattaccgccctca

SEQ ID NO: 117316 - DNA, 25 bp, E. coli
gattggcgattcaagcggtttgccg

SEQ ID NO: 117317 - DNA, 25 bp, E. coli
gtggttaaccacaaaccccgcatcg

SEQ ID NO: 117318 - DNA, 25 bp, E. coli
gtggttaaccactaaccccgcatcg

SEQ ID NO: 117319 - DNA, 25 bp, E. coli
taagagtcaccatggtggttaacca

SEQ ID NO: 117320 - DNA, 25 bp, E. coli
tcacttttacccctgcaagcgggaa

SEQ ID NO: 117321 - DNA, 25 bp, E. coli
tcacttttacccgtgcaagcgggaa

SEQ ID NO: 117322 - DNA, 25 bp, E. coli
taagagtcaccaaggtggttaacca

SEQ ID NO: 117323 - DNA, 25 bp, E. coli
cactaagctgtgcaacgacgaccac

SEQ ID NO: 117324 - DNA, 25 bp, E. coli
cactaagctgtggaacgacgaccac

SEQ ID NO: 117325 - DNA, 25 bp, E. coli
cagaaagtcattcgcgatctggcag

SEQ ID NO: 117326 - DNA, 25 bp, E. coli
cagaaagtcattggcgatctggcag

SEQ ID NO: 117327 - DNA, 25 bp, E. coli
tgattgatgaaactggcgtgacgcc

SEQ ID NO: 117328 - DNA, 25 bp, E. coli
tgattgatgaaagtggcgtgacgcc

SEQ ID NO: 117329 - DNA, 25 bp, E. coli
gcgtgtgcaacttccagatccatca

SEQ ID NO: 117330 - DNA, 25 bp, E. coli
gcgcagattgttttccgctggcatc

SEQ ID NO: 117331 - DNA, 25 bp, E. coli
gcgtgacgcctgagataaaccagat

SEQ ID NO: 117332 - DNA, 25 bp, E. coli
gcgtgtgcaactaccagatccatca

SEQ ID NO: 117333 - DNA, 25 bp, E. coli
gcgcagattgttatccgctggcatc

SEQ ID NO: 117334 - DNA, 25 bp, E. coli
gcgtgacgcctgtgataaaccagat

SEQ ID NO: 117335 - DNA, 25 bp, E. coli
cccattagcgcatggagggaaaggc

SEQ ID NO: 117336 - DNA, 25 bp, E. coli
cccattagcgcaaggagggaaaggc

SEQ ID NO: 117337 - DNA, 25 bp, E. coli
cgatcctgaccagttcggcggctaa

SEQ ID NO: 117338 - DNA, 25 bp, E. coli
cgatcctgaccacttcggcggctaa

SEQ ID NO: 117339 - DNA, 25 bp, E. coli
gattaatcaaaagcatcggcgtgtg

SEQ ID NO: 117340 - DNA, 25 bp, E. coli
gattaatcaaaaccatcggcgtgtg

SEQ ID NO: 117341 - DNA, 25 bp, E. coli
ggcaaagccctgaaaaatgcctcag

SEQ ID NO: 117342 - DNA, 25 bp, E. coli
ggcaaagccctgtaaaatgcctcag

SEQ ID NO: 117343 - DNA, 25 bp, E. coli
gaccgaatcctggagcccattagcg

SEQ ID NO: 117344 - DNA, 25 bp, E. coli
gaccgaatcctgcagcccattagcg

SEQ ID NO: 117345 - DNA, 25 bp, E. coli
catggctgtcctatacctcgaaaac

SEQ ID NO: 117346 - DNA, 25 bp, E. coli
catggctgtcctttacctcgaaaac

SEQ ID NO: 117347 - DNA, 25 bp, E. coli
ataggatttctgtttatggcggcga

SEQ ID NO: 117348 - DNA, 25 bp, E. coli
ataggatttctgattatggcggcga

SEQ ID NO: 117349 - DNA, 25 bp, E. coli
tatcgtcatggcagtcctttacctc

SEQ ID NO: 117350 - DNA, 25 bp, E. coli
tttacatcctgataggatttctgat

SEQ ID NO: 117351 - DNA, 25 bp, E. coli
tatcgtcatggctgtcctttacctc

SEQ ID NO: 117352 - DNA, 25 bp, E. coli
tttacatcctgaaaggatttctgat

SEQ ID NO: 117353 - DNA, 25 bp, E. coli
tcctttacctcgtaaaccactcctg

SEQ ID NO: 117354 - DNA, 25 bp, E. coli
tcctttacctcgaaaaccactcctg

SEQ ID NO: 117355 - DNA, 25 bp, E. coli
cctgataggattactgattatggcg

SEQ ID NO: 117356 - DNA, 25 bp, E. coli
cctgataggatttctgattatggcg

SEQ ID NO: 117357 - DNA, 25 bp, E. coli
gcgattatcgtcatggctgtccttt

SEQ ID NO: 117358 - DNA, 25 bp, E. coli
gctgtcctttacctcgaaaaccact

SEQ ID NO: 117359 - DNA, 25 bp, E. coli
gctgtcctttacgtcgaaaaccact

SEQ ID NO: 117360 - DNA, 25 bp, E. coli
gcgattatcgtcttggctgtccttt

SEQ ID NO: 117361 - DNA, 25 bp, E. coli
cgtcatggctgtcctttacctcgaa

SEQ ID NO: 117362 - DNA, 25 bp, E. coli
cggcgattatcgtcatggctgtcct

SEQ ID NO: 117363 - DNA, 25 bp, E. coli
cgtcatggctgtgctttacctcgaa

SEQ ID NO: 117364 - DNA, 25 bp, E. coli
cggcgattatcgacatggctgtcct

SEQ ID NO: 117365 - DNA, 25 bp, E. coli
gattatcgtcatggctgtcctttac

SEQ ID NO: 117366 - DNA, 25 bp, E. coli
gattatcgtcatcgctgtcctttac

SEQ ID NO: 117367 - DNA, 25 bp, E. coli
catgacggaaaaccgaactacccgg

SEQ ID NO: 117368 - DNA, 25 bp, E. coli
catgcttcatgcaggcggtgataac

SEQ ID NO: 117369 - DNA, 25 bp, E. coli
catgacggaaaagcgaactacccgg

SEQ ID NO: 117370 - DNA, 25 bp, E. coli
catgcttcatgctggcggtgataac

SEQ ID NO: 117371 - DNA, 25 bp, E. coli
tatcggctggcgctcactttgaccc

SEQ ID NO: 117372 - DNA, 25 bp, E. coli
tatcggctggcggtcactttgaccc

SEQ ID NO: 117373 - DNA, 25 bp, E. coli
tgataaccatcaagaccatccggag

SEQ ID NO: 117374 - DNA, 25 bp, E. coli
tgtcagtgctgagggaaaagaagtc

SEQ ID NO: 117375 - DNA, 25 bp, E. coli
tgtcagtgctgacggaaaagaagtc

SEQ ID NO: 117376 - DNA, 25 bp, E. coli
tgataaccatcatgaccatccggag

SEQ ID NO: 117377 - DNA, 25 bp, E. coli
tgcacgaaaaagcaaattgcgcccc

SEQ ID NO: 117378 - DNA, 25 bp, E. coli
tgcacgaaaaaggaaattgcgcccc

SEQ ID NO: 117379 - DNA, 25 bp, E. coli
tgcgagaatggcgtgcggcatcatt

SEQ ID NO: 117380 - DNA, 25 bp, E. coli
tgcgagaatggcctgcggcatcatt

SEQ ID NO: 117381 - DNA, 25 bp, E. coli
gcgctgttcgtgtcgcatgacggaa

SEQ ID NO: 117382 - DNA, 25 bp, E. coli
gcgctgttcgtgacgcatgacggaa

SEQ ID NO: 117383 - DNA, 25 bp, E. coli
gaagtcccaatgtaccttgtcagtg

SEQ ID NO: 117384 - DNA, 25 bp, E. coli
gaagtcccaatgaaccttgtcagtg

SEQ ID NO: 117385 - DNA, 25 bp, E. coli
gaaaaccggtcgcagcattatcggc

SEQ ID NO: 117386 - DNA, 25 bp, E. coli
gaaaaccggtcggagcattatcggc

SEQ ID NO: 117387 - DNA, 25 bp, E. coli
gaaaaacaccggcaaacatcttggc

SEQ ID NO: 117388 - DNA, 25 bp, E. coli
gaaaaacaccgggaaacatcttggc

SEQ ID NO: 117389 - DNA, 25 bp, E. coli
aacgcgtggacgatattttacatgc

SEQ ID NO: 117390 - DNA, 25 bp, E. coli
aatctgtatcctggcggatgcggac

SEQ ID NO: 117391 - DNA, 25 bp, E. coli
aatctgtatcctcgcggatgcggac

SEQ ID NO: 117392 - DNA, 25 bp, E. coli
caaaatctgtatgctcgcggatgcg

SEQ ID NO: 117393 - DNA, 25 bp, E. coli
caaaatctgtatcctcgcggatgcg

SEQ ID NO: 117394 - DNA, 25 bp, E. coli
acgtgcgccgcgatggtcaggttta

SEQ ID NO: 117395 - DNA, 25 bp, E. coli
acgtgcgccgcgttggtcaggttta

SEQ ID NO: 117396 - DNA, 25 bp, E. coli
aacgcgtggacgttattttacatgc

SEQ ID NO: 117397 - DNA, 25 bp, E. coli
tatcctcgcggatgcggactctgat

SEQ ID NO: 117398 - DNA, 25 bp, E. coli
tatggcaaaatctgtatcctcgcgg

SEQ ID NO: 117399 - DNA, 25 bp, E. coli
tatggcaaaatcagtatcctcgcgg

SEQ ID NO: 117400 - DNA, 25 bp, E. coli
tatcctcgcggaagcggactctgat

SEQ ID NO: 117401 - DNA, 25 bp, E. coli
tcgttatggcaaaatctgtatcctc

SEQ ID NO: 117402 - DNA, 25 bp, E. coli
tcgttatggcaatatctgtatcctc

SEQ ID NO: 117403 - DNA, 25 bp, E. coli
gcgccgcgatggtcaggtttataac

SEQ ID NO: 117404 - DNA, 25 bp, E. coli
gcgccgcgatggacaggtttataac

SEQ ID NO: 117405 - DNA, 25 bp, E. coli
ctggctgattgtaccgcgcaggacc

SEQ ID NO: 117406 - DNA, 25 bp, E. coli
ctggctgattgttccgcgcaggacc

SEQ ID NO: 117407 - DNA, 25 bp, E. coli
gttattttacatgctgaccagtcgt

SEQ ID NO: 117408 - DNA, 25 bp, E. coli
gttattttacatcctgaccagtcgt

SEQ ID NO: 117409 - DNA, 25 bp, E. coli
ggacgttattttacatgctgaccag

SEQ ID NO: 117410 - DNA, 25 bp, E. coli
ggacgttatttttcatgctgaccag

SEQ ID NO: 117411 - DNA, 25 bp, E. coli
caatgcagggcaaacacgaagaagc

SEQ ID NO: 117412 - DNA, 25 bp, E. coli
caatgcagggcatacacgaagaagc

SEQ ID NO: 117413 - DNA, 25 bp, E. coli
catgatgcgttattccattgcggca

SEQ ID NO: 117414 - DNA, 25 bp, E. coli
catgatgcgttaatccattgcggca

SEQ ID NO: 117415 - DNA, 25 bp, E. coli
acctcttgtggtgtgtgaaaacgca

SEQ ID NO: 117416 - DNA, 25 bp, E. coli
acctcttgtggtctgtgaaaacgca

SEQ ID NO: 117417 - DNA, 25 bp, E. coli
tattgatattcatcttcccgcgccg

SEQ ID NO: 117418 - DNA, 25 bp, E. coli
tattgatattcaacttcccgcgccg

SEQ ID NO: 117419 - DNA, 25 bp, E. coli
tgatagagcacctaagtaagccgga

SEQ ID NO: 117420 - DNA, 25 bp, E. coli
tgatagagcaccaaagtaagccgga

SEQ ID NO: 117421 - DNA, 25 bp, E. coli
tcagaaacatattcgtcagcgcgat

SEQ ID NO: 117422 - DNA, 25 bp, E. coli
gcgccgctgcgcaaactgtgtgatt

SEQ ID NO: 117423 - DNA, 25 bp, E. coli
gcgccgctgcgctaactgtgtgatt

SEQ ID NO: 117424 - DNA, 25 bp, E. coli
gaacgcgcaccagaagaaaaggaga

SEQ ID NO: 117425 - DNA, 25 bp, E. coli
gaacgcgcaccacaagaaaaggaga

SEQ ID NO: 117426 - DNA, 25 bp, E. coli
gttttattgatgtagacctgcggca

SEQ ID NO: 117427 - DNA, 25 bp, E. coli
gttttattgatgaagacctgcggca

SEQ ID NO: 117428 - DNA, 25 bp, E. coli
gattacgtgaagtaggcgcaatgca

SEQ ID NO: 117429 - DNA, 25 bp, E. coli
gattacgtgaagaaggcgcaatgca

SEQ ID NO: 117430 - DNA, 25 bp, E. coli
taatgacagacacctaaaagccctg

SEQ ID NO: 117431 - DNA, 25 bp, E. coli
tcagaaacatatacgtcagcgcgat

SEQ ID NO: 117432 - DNA, 25 bp, E. coli
taatgacagacagctaaaagccctg

SEQ ID NO: 117433 - DNA, 25 bp, E. coli
tacgatgcgtatggcccacaacaag

SEQ ID NO: 117434 - DNA, 25 bp, E. coli
tacgatgcgtatcgcccacaacaag

SEQ ID NO: 117435 - DNA, 25 bp, E. coli
ttcgatgaaatgcacgagcgctccc

SEQ ID NO: 117436 - DNA, 25 bp, E. coli
ttcgtgatgagctcgggaacatcct

SEQ ID NO: 117437 - DNA, 25 bp, E. coli
ttcgatgaaatggacgagcgctccc

SEQ ID NO: 117438 - DNA, 25 bp, E. coli
ttcgtgatgagcacgggaacatcct

SEQ ID NO: 117439 - DNA, 25 bp, E. coli
tcgaattgaaattcgcctgcgctga

SEQ ID NO: 117440 - DNA, 25 bp, E. coli
tcgaattgaaatacgcctgcgctga

SEQ ID NO: 117441 - DNA, 25 bp, E. coli
tcggtatctccaccgaatggtggca

SEQ ID NO: 117442 - DNA, 25 bp, E. coli
tcggtatctccagcgaatggtggca

SEQ ID NO: 117443 - DNA, 25 bp, E. coli
gcccagacccgctatatgttgttga

SEQ ID NO: 117444 - DNA, 25 bp, E. coli
gcccagacccgcaatatgttgttga

SEQ ID NO: 117445 - DNA, 25 bp, E. coli
gcaagcgcgttgtctgttacacaag

SEQ ID NO: 117446 - DNA, 25 bp, E. coli
gcaagcgcgttgactgttacacaag

SEQ ID NO: 117447 - DNA, 25 bp, E. coli
gttacacaaggatgcgattaccgcg

SEQ ID NO: 117448 - DNA, 25 bp, E. coli
gttacacaaggaagcgattaccgcg

SEQ ID NO: 117449 - DNA, 25 bp, E. coli
ggttctaatcacagccgtggcacgg

SEQ ID NO: 117450 - DNA, 25 bp, E. coli
ggttctaatcactgccgtggcacgg

SEQ ID NO: 117451 - DNA, 25 bp, E. coli
ggcgatcgacctcacgcttcgtgat

SEQ ID NO: 117452 - DNA, 25 bp, E. coli
tggcacttcgaattaccccaggcag

SEQ ID NO: 117453 - DNA, 25 bp, E. coli
tggcacttcgaaataccccaggcag

SEQ ID NO: 117454 - DNA, 25 bp, E. coli
ggcgatcgacctgacgcttcgtgat

SEQ ID NO: 117455 - DNA, 25 bp, E. coli
tacggtgcacaaaaagccagtcagg

SEQ ID NO: 117456 - DNA, 25 bp, E. coli
taaaatgccggaagcaatcgacgca

SEQ ID NO: 117457 - DNA, 25 bp, E. coli
taaaatgccggatgcaatcgacgca

SEQ ID NO: 117458 - DNA, 25 bp, E. coli
actgttttctcatctagcggcgcgg

SEQ ID NO: 117459 - DNA, 25 bp, E. coli
actgttttctcaactagcggcgcgg

SEQ ID NO: 117460 - DNA, 25 bp, E. coli
tacggtgcacaataagccagtcagg

SEQ ID NO: 117461 - DNA, 25 bp, E. coli
ttaatggatgctctcgacacgccgt

SEQ ID NO: 117462 - DNA, 25 bp, E. coli
ttaatggatgctgtcgacacgccgt

SEQ ID NO: 117463 - DNA, 25 bp, E. coli
tctgggccaggatagtgtacttgct

SEQ ID NO: 117464 - DNA, 25 bp, E. coli
tctgggccaggaaagtgtacttgct

SEQ ID NO: 117465 - DNA, 25 bp, E. coli
gcagtgggcgcatgaaaacggtaac

SEQ ID NO: 117466 - DNA, 25 bp, E. coli
gcgctgaccgaagaccatctggaaa

SEQ ID NO: 117467 - DNA, 25 bp, E. coli
gcagtgggcgcaagaaaacggtaac

SEQ ID NO: 117468 - DNA, 25 bp, E. coli
gcgctgaccgaacaccatctggaaa

SEQ ID NO: 117469 - DNA, 25 bp, E. coli
cgtaatgaatcaactgctggccgaa

SEQ ID NO: 117470 - DNA, 25 bp, E. coli
cgtaatgaatcatctgctggccgaa

SEQ ID NO: 117471 - DNA, 25 bp, E. coli
ggttgaagccacacagcaatcgctg

SEQ ID NO: 117472 - DNA, 25 bp, E. coli
ggttgaagccactcagcaatcgctg

SEQ ID NO: 117473 - DNA, 25 bp, E. coli
tggcagcaattcaacagcaatacgg

SEQ ID NO: 117474 - DNA, 25 bp, E. coli
tggcagcaattctacagcaatacgg

SEQ ID NO: 117475 - DNA, 25 bp, E. coli
gacgcactggtgttcagcctgaaaa

SEQ ID NO: 117476 - DNA, 25 bp, E. coli
gacgcactggtgatcagcctgaaaa

SEQ ID NO: 117477 - DNA, 25 bp, E. coli
cactctttgaagagatttgcgtcac

SEQ ID NO: 117478 - DNA, 25 bp, E. coli
cactctttgaagtgatttgcgtcac

SEQ ID NO: 117479 - DNA, 25 bp, E. coli
cagggaattcctgaatgcagcgcat

SEQ ID NO: 117480 - DNA, 25 bp, E. coli
cagggaattcctcaatgcagcgcat

SEQ ID NO: 117481 - DNA, 25 bp, E. coli
tatgtataaatcttaatcgccttgg

SEQ ID NO: 117482 - DNA, 25 bp, E. coli
tatgtataaatcataatcgccttgg

SEQ ID NO: 117483 - DNA, 25 bp, E. coli
ttaactcacatgttgatactgactg

SEQ ID NO: 117484 - DNA, 25 bp, E. coli
ttaactcacatgatgatactgactg

SEQ ID NO: 117485 - DNA, 25 bp, E. coli
tttactccatgtcgtcggtgctgcg

SEQ ID NO: 117486 - DNA, 25 bp, E. coli
tttactccatgtggtcggtgctgcg

SEQ ID NO: 117487 - DNA, 25 bp, E. coli
tgcgagtgtcgctgataaacatacc

SEQ ID NO: 117488 - DNA, 25 bp, E. coli
tgcgagtgtcgcagataaacatacc

SEQ ID NO: 117489 - DNA, 25 bp, E. coli
cgaattagcgtgttttgtaaatcag

SEQ ID NO: 117490 - DNA, 25 bp, E. coli
cgaattagcgtgatttgtaaatcag

SEQ ID NO: 117491 - DNA, 25 bp, E. coli
cgtcaggcggcgagggtttaactca

SEQ ID NO: 117492 - DNA, 25 bp, E. coli
cgtcaggcggcgtgggtttaactca

SEQ ID NO: 117493 - DNA, 25 bp, E. coli
gatttgcgtcactttcagggaattc

SEQ ID NO: 117494 - DNA, 25 bp, E. coli
gatactgactgtagctcactctttg

SEQ ID NO: 117495 - DNA, 25 bp, E. coli
gatttgcgtcacattcagggaattc

SEQ ID NO: 117496 - DNA, 25 bp, E. coli
taatcgccttggattatggaagacg

SEQ ID NO: 117497 - DNA, 25 bp, E. coli
taatcgccttggtttatggaagacg

SEQ ID NO: 117498 - DNA, 25 bp, E. coli
gatactgactgttgctcactctttg

SEQ ID NO: 117499 - DNA, 25 bp, E. coli
cacaggcggcgtatacgaaacagca

SEQ ID NO: 117500 - DNA, 25 bp, E. coli
cacaggcggcgtttacgaaacagca

SEQ ID NO: 117501 - DNA, 25 bp, E. coli
aagctaaatcggttgcacaggcggc

SEQ ID NO: 117502 - DNA, 25 bp, E. coli
aagctaaatcggatgcacaggcggc

SEQ ID NO: 117503 - DNA, 25 bp, E. coli
cacggaaggagcatgcgggtaatct

SEQ ID NO: 117504 - DNA, 25 bp, E. coli
cacggaaggagcttgcgggtaatct

SEQ ID NO: 117505 - DNA, 25 bp, E. coli
cagataagtatgttgccgggctaca

SEQ ID NO: 117506 - DNA, 25 bp, E. coli
cagataagtatgatgccgggctaca

SEQ ID NO: 117507 - DNA, 25 bp, E. coli
aacagtttggcgaagcacggaagga

SEQ ID NO: 117508 - DNA, 25 bp, E. coli
aacagtttggcgtagcacggaagga

SEQ ID NO: 117509 - DNA, 25 bp, E. coli
tatgcgatgcataaggctggcggta

SEQ ID NO: 117510 - DNA, 25 bp, E. coli
tatgcgatgcattaggctggcggta

SEQ ID NO: 117511 - DNA, 25 bp, E. coli
cctgaacagtgaccagcagtacgac

SEQ ID NO: 117512 - DNA, 25 bp, E. coli
cctgaacagtgagcagcagtacgac

SEQ ID NO: 117513 - DNA, 25 bp, E. coli
gtaaccgggcagtttgacacaacca

SEQ ID NO: 117514 - DNA, 25 bp, E. coli
gtaaccgggcagattgacacaacca

SEQ ID NO: 117515 - DNA, 25 bp, E. coli
ggtaatcttgctgagtccggcgttg

SEQ ID NO: 117516 - DNA, 25 bp, E. coli
ggtaatcttgctcagtccggcgttg

SEQ ID NO: 117517 - DNA, 25 bp, E. coli
taatgaatgcgaaccagagtgacca

SEQ ID NO: 117518 - DNA, 25 bp, E. coli
taatgaatgcgatccagagtgacca

SEQ ID NO: 117519 - DNA, 25 bp, E. coli
gattacaaaaatatcctccgcccgg

SEQ ID NO: 117520 - DNA, 25 bp, E. coli
gattacaaaaatttcctccgcccgg

SEQ ID NO: 117521 - DNA, 25 bp, E. coli
aagattactgtgctgactgggcgac

SEQ ID NO: 117522 - DNA, 25 bp, E. coli
aagattactgtggtgactgggcgac

SEQ ID NO: 117523 - DNA, 25 bp, E. coli
tatgcttattaaccgtgtcgcgacg

SEQ ID NO: 117524 - DNA, 25 bp, E. coli
tatgcttattaagcgtgtcgcgacg

SEQ ID NO: 117525 - DNA, 25 bp, E. coli
tattaggcgcagtccgcgaatggaa

SEQ ID NO: 117526 - DNA, 25 bp, E. coli
tttcgtgaactggaaactcgccgca

SEQ ID NO: 117527 - DNA, 25 bp, E. coli
tattttctcaaaaggcatcgcggca

SEQ ID NO: 117528 - DNA, 25 bp, E. coli
tattttctcaaatggcatcgcggca

SEQ ID NO: 117529 - DNA, 25 bp, E. coli
tttcgtgaactgcaaactcgccgca

SEQ ID NO: 117530 - DNA, 25 bp, E. coli
tattaggcgcagaccgcgaatggaa

SEQ ID NO: 117531 - DNA, 25 bp, E. coli
tgtcgcaagcagtagcaaaagccac

SEQ ID NO: 117532 - DNA, 25 bp, E. coli
tgtcgcaagcagaagcaaaagccac

SEQ ID NO: 117533 - DNA, 25 bp, E. coli
tgaacttaaagacccgtttgccacg

SEQ ID NO: 117534 - DNA, 25 bp, E. coli
tgaacttaaagagccgtttgccacg

SEQ ID NO: 117535 - DNA, 25 bp, E. coli
tgcgggcattaaccaccgtgactgt

SEQ ID NO: 117536 - DNA, 25 bp, E. coli
tgcgggcattaagcaccgtgactgt

SEQ ID NO: 117537 - DNA, 25 bp, E. coli
gaatgcgattcatcgactgcgggat

SEQ ID NO: 117538 - DNA, 25 bp, E. coli
gaatgcgattcaacgactgcgggat

SEQ ID NO: 117539 - DNA, 25 bp, E. coli
cgttatggcgcggtaaagatccttt

SEQ ID NO: 117540 - DNA, 25 bp, E. coli
cgttatggcgcgctaaagatccttt

SEQ ID NO: 117541 - DNA, 25 bp, E. coli
cattgcggatgcgagtattaggcgc

SEQ ID NO: 117542 - DNA, 25 bp, E. coli
cattgcggatgccagtattaggcgc

SEQ ID NO: 117543 - DNA, 25 bp, E. coli
aacgtgctgaaataggcgattgcga

SEQ ID NO: 117544 - DNA, 25 bp, E. coli
caatagatgagattatcgaacgtgc

SEQ ID NO: 117545 - DNA, 25 bp, E. coli
caatagatgagaatatcgaacgtgc

SEQ ID NO: 117546 - DNA, 25 bp, E. coli
cacgtcaagttggtgcgataattta

SEQ ID NO: 117547 - DNA, 25 bp, E. coli
cacgtcaagttgctgcgataattta

SEQ ID NO: 117548 - DNA, 25 bp, E. coli
aacgtgctgaaaaaggcgattgcga

SEQ ID NO: 117549 - DNA, 25 bp, E. coli
tattataatcgcgatagcgcaattg

SEQ ID NO: 117550 - DNA, 25 bp, E. coli
tattataatcgccatagcgcaattg

SEQ ID NO: 117551 - DNA, 25 bp, E. coli
ttatcgaacgtgctgaaaaaggcga

SEQ ID NO: 117552 - DNA, 25 bp, E. coli
ttatcgaacgtggtgaaaaaggcga

SEQ ID NO: 117553 - DNA, 25 bp, E. coli
tgattttcacgtgaagttgctgcga

SEQ ID NO: 117554 - DNA, 25 bp, E. coli
tgattttcacgtcaagttgctgcga

SEQ ID NO: 117555 - DNA, 25 bp, E. coli
tgcgaggctcaaaatattgttgggt

SEQ ID NO: 117556 - DNA, 25 bp, E. coli
tgcgaggctcaatatattgttgggt

SEQ ID NO: 117557 - DNA, 25 bp, E. coli
gctgcgataattaatcaatagatga

SEQ ID NO: 117558 - DNA, 25 bp, E. coli
gctgcgataatttatcaatagatga

SEQ ID NO: 117559 - DNA, 25 bp, E. coli
gaaaaaggcgattgcgaggctcaat

SEQ ID NO: 117560 - DNA, 25 bp, E. coli
gaaaaaggcgatagcgaggctcaat

SEQ ID NO: 117561 - DNA, 25 bp, E. coli
gataatgattttgacgtcaagttgc

SEQ ID NO: 117562 - DNA, 25 bp, E. coli
gataatgattttcacgtcaagttgc

SEQ ID NO: 117563 - DNA, 25 bp, E. coli
ggttttattataatcgcgatagcgc

SEQ ID NO: 117564 - DNA, 25 bp, E. coli
ggttttattatattcgcgatagcgc

SEQ ID NO: 117565 - DNA, 25 bp, E. coli
cattagcattaagaggaaagtcaga

SEQ ID NO: 117566 - DNA, 25 bp, E. coli
cattagcattaacaggaaagtcaga

SEQ ID NO: 117567 - DNA, 25 bp, E. coli
tactccagaaaatctcgcattagca

SEQ ID NO: 117568 - DNA, 25 bp, E. coli
tactccagaaaaactcgcattagca

SEQ ID NO: 117569 - DNA, 25 bp, E. coli
tatcaattgttcgaccaggagcatg

SEQ ID NO: 117570 - DNA, 25 bp, E. coli
tatcaattgttccaccaggagcatg

SEQ ID NO: 117571 - DNA, 25 bp, E. coli
tgaacggacaaaaatcaattgttcg

SEQ ID NO: 117572 - DNA, 25 bp, E. coli
tgaacggacaaatatcaattgttcg

SEQ ID NO: 117573 - DNA, 25 bp, E. coli
gccagtagagctaaagctgcgaaat

SEQ ID NO: 117574 - DNA, 25 bp, E. coli
gccagtagagcttaagctgcgaaat

SEQ ID NO: 117575 - DNA, 25 bp, E. coli
ccaggagcatgtcacgatcgcgaaa

SEQ ID NO: 117576 - DNA, 25 bp, E. coli
ccaggagcatgtgacgatcgcgaaa

SEQ ID NO: 117577 - DNA, 25 bp, E. coli
gctgcgaaatgtagagattaaggtg

SEQ ID NO: 117578 - DNA, 25 bp, E. coli
gctgcgaaatgttgagattaaggtg

SEQ ID NO: 117579 - DNA, 25 bp, E. coli
gaatgattattcgtctggcgatggg

SEQ ID NO: 117580 - DNA, 25 bp, E. coli
gaatgattattcctctggcgatggg

SEQ ID NO: 117581 - DNA, 25 bp, E. coli
gacgatcgcgaattacgaatgatta

SEQ ID NO: 117582 - DNA, 25 bp, E. coli
gacgatcgcgaaatacgaatgatta

SEQ ID NO: 117583 - DNA, 25 bp, E. coli
gggaaaacaatatctgctctcatta

SEQ ID NO: 117584 - DNA, 25 bp, E. coli
gggaaaacaataactgctctcatta

SEQ ID NO: 117585 - DNA, 25 bp, E. coli
ggaaagtcagacatgccagtagagc

SEQ ID NO: 117586 - DNA, 25 bp, E. coli
ggaaagtcagacttgccagtagagc

SEQ ID NO: 117587 - DNA, 25 bp, E. coli
caaaagcggcgttttaatgaagtcc

SEQ ID NO: 117588 - DNA, 25 bp, E. coli
caaaagcggcgtattaatgaagtcc

SEQ ID NO: 117589 - DNA, 25 bp, E. coli
tatgctgcacgaaatgacgggagcg

SEQ ID NO: 117590 - DNA, 25 bp, E. coli
tatgctgcacgatatgacgggagcg

SEQ ID NO: 117591 - DNA, 25 bp, E. coli
tgacctggcgctacgtatgctgcac

SEQ ID NO: 117592 - DNA, 25 bp, E. coli
tgacctggcgcttcgtatgctgcac

SEQ ID NO: 117593 - DNA, 25 bp, E. coli
tctgaaatcctacgaagcggtggtg

SEQ ID NO: 117594 - DNA, 25 bp, E. coli
tctgaaatcctaggaagcggtggtg

SEQ ID NO: 117595 - DNA, 25 bp, E. coli
gccagttcaagaccggtgatttcca

SEQ ID NO: 117596 - DNA, 25 bp, E. coli
ccggatgtcggtacaagcgtcaact

SEQ ID NO: 117597 - DNA, 25 bp, E. coli
gccagttcaagagcggtgatttcca

SEQ ID NO: 117598 - DNA, 25 bp, E. coli
ccggatgtcggttcaagcgtcaact

SEQ ID NO: 117599 - DNA, 25 bp, E. coli
gcttttaaccaacgaaaccagtgag

SEQ ID NO: 117600 - DNA, 25 bp, E. coli
gcttttaaccaaggaaaccagtgag

SEQ ID NO: 117601 - DNA, 25 bp, E. coli
gaagatctggtttcccaaacgctgg

SEQ ID NO: 117602 - DNA, 25 bp, E. coli
gaatcttgatgtacccttctcgcag

SEQ ID NO: 117603 - DNA, 25 bp, E. coli
gaatcttgatgttcccttctcgcag

SEQ ID NO: 117604 - DNA, 25 bp, E. coli
gaagatctggttacccaaacgctgg

SEQ ID NO: 117605 - DNA, 25 bp, E. coli
cattgctaacggagaacatacaggc

SEQ ID NO: 117606 - DNA, 25 bp, E. coli
cattgctaacggtgaacatacaggc

SEQ ID NO: 117607 - DNA, 25 bp, E. coli
gatgcttattggctcccactgtgaa

SEQ ID NO: 117608 - DNA, 25 bp, E. coli
gatgcttattgggtcccactgtgaa

SEQ ID NO: 117609 - DNA, 25 bp, E. coli
cactgaaacaaagatggagaccacg

SEQ ID NO: 117610 - DNA, 25 bp, E. coli
cactgaaacaaacatggagaccacg

SEQ ID NO: 117611 - DNA, 25 bp, E. coli
tattcaatgttgacagcggtgttgc

SEQ ID NO: 117612 - DNA, 25 bp, E. coli
tattcaatgttgtcagcggtgttgc

SEQ ID NO: 117613 - DNA, 25 bp, E. coli
tttgcagcaggcaacaacggtaccg

SEQ ID NO: 117614 - DNA, 25 bp, E. coli
tttgcagcaggctacaacggtaccg

SEQ ID NO: 117615 - DNA, 25 bp, E. coli
tgggtgaaaccgatgcgccggatct

SEQ ID NO: 117616 - DNA, 25 bp, E. coli
tgggtgacatcggtgcggctaaact

SEQ ID NO: 117617 - DNA, 25 bp, E. coli
tgggtgacatcgctgcggctaaact

SEQ ID NO: 117618 - DNA, 25 bp, E. coli
tgttgccatgaagcacgtgagcctg

SEQ ID NO: 117619 - DNA, 25 bp, E. coli
tgttgccatgaaccacgtgagcctg

SEQ ID NO: 117620 - DNA, 25 bp, E. coli
tgggtgaaaccgttgcgccggatct

SEQ ID NO: 117621 - DNA, 25 bp, E. coli
gcaagggtaaagacaagcaaacgct

SEQ ID NO: 117622 - DNA, 25 bp, E. coli
gcaagggtaaagtcaagcaaacgct

SEQ ID NO: 117623 - DNA, 25 bp, E. coli
gatctcggccagatcgaaaccctga

SEQ ID NO: 117624 - DNA, 25 bp, E. coli
gggccagccaacacggataactatg

SEQ ID NO: 117625 - DNA, 25 bp, E. coli
gggccagccaactcggataactatg

SEQ ID NO: 117626 - DNA, 25 bp, E. coli
taatcggcgatacccatggcaaagg

SEQ ID NO: 117627 - DNA, 25 bp, E. coli
taatcggcgatagccatggcaaagg

SEQ ID NO: 117628 - DNA, 25 bp, E. coli
gatggatacttcaaccagcaagggt

SEQ ID NO: 117629 - DNA, 25 bp, E. coli
gatggatacttctaccagcaagggt

SEQ ID NO: 117630 - DNA, 25 bp, E. coli
gatctcggccagttcgaaaccctga

SEQ ID NO: 117631 - DNA, 25 bp, E. coli
catcgtgctgttaaaagtggtgacc

SEQ ID NO: 117632 - DNA, 25 bp, E. coli
catcgtgctgtttaaagtggtgacc

SEQ ID NO: 117633 - DNA, 25 bp, E. coli
agtttgtagtgatggtaacgcagcc

SEQ ID NO: 117634 - DNA, 25 bp, E. coli
agtttgtagtgaaggtaacgcagcc

SEQ ID NO: 117635 - DNA, 25 bp, E. coli
taccatggtgctcttattacgcatc

SEQ ID NO: 117636 - DNA, 25 bp, E. coli
taccatggtgctgttattacgcatc

SEQ ID NO: 117637 - DNA, 25 bp, E. coli
ttttctgggtccagctggtgatggc

SEQ ID NO: 117638 - DNA, 25 bp, E. coli
ttttctgggtcctgctggtgatggc

SEQ ID NO: 117639 - DNA, 25 bp, E. coli
tctgctgaaaaccatcggcctgctg

SEQ ID NO: 117640 - DNA, 25 bp, E. coli
tcatcaatatggctgtcgcagaagt

SEQ ID NO: 117641 - DNA, 25 bp, E. coli
tcatcaatatgggtgtcgcagaagt

SEQ ID NO: 117642 - DNA, 25 bp, E. coli
tctgctgaaaacgatcggcctgctg

SEQ ID NO: 117643 - DNA, 25 bp, E. coli
gcctcgctgctggttgcctatattc

SEQ ID NO: 117644 - DNA, 25 bp, E. coli
gcctcgctgctgcttgcctatattc

SEQ ID NO: 117645 - DNA, 25 bp, E. coli
gaatacgtgctgtttcagctggccg

SEQ ID NO: 117646 - DNA, 25 bp, E. coli
gaatacgtgctgattcagctggccg

SEQ ID NO: 117647 - DNA, 25 bp, E. coli
cgcatctggatggagtgggctcatt

SEQ ID NO: 117648 - DNA, 25 bp, E. coli
cgatgatcctcgatctgctgctgta

SEQ ID NO: 117649 - DNA, 25 bp, E. coli
cgcatctggatgcagtgggctcatt

SEQ ID NO: 117650 - DNA, 25 bp, E. coli
cgatgatcctcgttctgctgctgta

SEQ ID NO: 117651 - DNA, 25 bp, E. coli
gtcattgagctgtataccatggtgc

SEQ ID NO: 117652 - DNA, 25 bp, E. coli
gtcattgagctgaataccatggtgc

SEQ ID NO: 117653 - DNA, 25 bp, E. coli
aagttgccgcgcaggaaaatccgac

SEQ ID NO: 117654 - DNA, 25 bp, E. coli
aagttgccgcgctggaaaatccgac

SEQ ID NO: 117655 - DNA, 25 bp, E. coli
taaactgcactatgcgctggtggac

SEQ ID NO: 117656 - DNA, 25 bp, E. coli
taaactgcactaagcgctggtggac

SEQ ID NO: 117657 - DNA, 25 bp, E. coli
tctacctgtcgaaggaagatgcgct

SEQ ID NO: 117658 - DNA, 25 bp, E. coli
tctacctgtcgatggaagatgcgct

SEQ ID NO: 117659 - DNA, 25 bp, E. coli
tcatcgttgacgaacacaccggtcg

SEQ ID NO: 117660 - DNA, 25 bp, E. coli
tcatcgttgacgtacacaccggtcg

SEQ ID NO: 117661 - DNA, 25 bp, E. coli
gaattccttggcgtgactgtcggta

SEQ ID NO: 117662 - DNA, 25 bp, E. coli
gaattccttggcctgactgtcggta

SEQ ID NO: 117663 - DNA, 25 bp, E. coli
gaatacggctttcactacctgcgcg

SEQ ID NO: 117664 - DNA, 25 bp, E. coli
gaagtgctggaaaatctgatcccgg

SEQ ID NO: 117665 - DNA, 25 bp, E. coli
gaagtgctggaatatctgatcccgg

SEQ ID NO: 117666 - DNA, 25 bp, E. coli
gaatacggctttgactacctgcgcg

SEQ ID NO: 117667 - DNA, 25 bp, E. coli
gaacaacagcgtggtatggaagccg

SEQ ID NO: 117668 - DNA, 25 bp, E. coli
gaacaacagcgtcgtatggaagccg

SEQ ID NO: 117669 - DNA, 25 bp, E. coli
taacgaacgctggatcgccgaaatg

SEQ ID NO: 117670 - DNA, 25 bp, E. coli
tcaaagaacgtactgcgaaaggcca

SEQ ID NO: 117671 - DNA, 25 bp, E. coli
tcaaagaacgtagtgcgaaaggcca

SEQ ID NO: 117672 - DNA, 25 bp, E. coli
taacgaacgctgcatcgccgaaatg

SEQ ID NO: 117673 - DNA, 25 bp, E. coli
gatgcgtatttttgcttccgaccga

SEQ ID NO: 117674 - DNA, 25 bp, E. coli
gatgcgtattttagcttccgaccga

SEQ ID NO: 117675 - DNA, 25 bp, E. coli
aatggcttgatttatcactctccgg

SEQ ID NO: 117676 - DNA, 25 bp, E. coli
aatggcttgattaatcactctccgg

SEQ ID NO: 117677 - DNA, 25 bp, E. coli
cactctccggtgaatggcaaatatg

SEQ ID NO: 117678 - DNA, 25 bp, E. coli
caccggcgaggcgttgatctctttt

SEQ ID NO: 117679 - DNA, 25 bp, E. coli
caccggcgaggccttgatctctttt

SEQ ID NO: 117680 - DNA, 25 bp, E. coli
caaaaactggcggagtcattgtcgg

SEQ ID NO: 117681 - DNA, 25 bp, E. coli
caaaaactggcgcagtcattgtcgg

SEQ ID NO: 117682 - DNA, 25 bp, E. coli
cactctccggtgtatggcaaatatg

SEQ ID NO: 117683 - DNA, 25 bp, E. coli
catgcgggccaatccggcgtttgat

SEQ ID NO: 117684 - DNA, 25 bp, E. coli
catgcgggccaaaccggcgtttgat

SEQ ID NO: 117685 - DNA, 25 bp, E. coli
tcctcagcgccgtgaaactttatca

SEQ ID NO: 117686 - DNA, 25 bp, E. coli
tcctcagcgccgagaaactttatca

SEQ ID NO: 117687 - DNA, 25 bp, E. coli
tctgatattccgcataatgtgctcg

SEQ ID NO: 117688 - DNA, 25 bp, E. coli
tctgatattccggataatgtgctcg

SEQ ID NO: 117689 - DNA, 25 bp, E. coli
gctgatgtgaaaggcgatctgaccg

SEQ ID NO: 117690 - DNA, 25 bp, E. coli
gctgatgtgaaacgcgatctgaccg

SEQ ID NO: 117691 - DNA, 25 bp, E. coli
gaaactttatcagatgccgaaactg

SEQ ID NO: 117692 - DNA, 25 bp, E. coli
gaaactttatcacatgccgaaactg

SEQ ID NO: 117693 - DNA, 25 bp, E. coli
cgaaaaggcgatacaggaactgggc

SEQ ID NO: 117694 - DNA, 25 bp, E. coli
cgaaaaggcgattcaggaactgggc

SEQ ID NO: 117695 - DNA, 25 bp, E. coli
gatctcttttctggatgcgaaagga

SEQ ID NO: 117696 - DNA, 25 bp, E. coli
gatctcttttctcgatgcgaaagga

SEQ ID NO: 117697 - DNA, 25 bp, E. coli
aaggtgctgatacgccagatgtatg

SEQ ID NO: 117698 - DNA, 25 bp, E. coli
aaggtgctgataggccagatgtatg

SEQ ID NO: 117699 - DNA, 25 bp, E. coli
aatcgcctgaagctgctgatacgcc

SEQ ID NO: 117700 - DNA, 25 bp, E. coli
aatcgcctgaaggtgctgatacgcc

SEQ ID NO: 117701 - DNA, 25 bp, E. coli
taaatcgcctgatggtgctgatacg

SEQ ID NO: 117702 - DNA, 25 bp, E. coli
taaatcgcctgaaggtgctgatacg

SEQ ID NO: 117703 - DNA, 25 bp, E. coli
aaatcgcctgaaggtgctgatacgc

SEQ ID NO: 117704 - DNA, 25 bp, E. coli
aaatcgcctgaacgtgctgatacgc

SEQ ID NO: 117705 - DNA, 25 bp, E. coli
ttgaactacttaggcggagggtaat

SEQ ID NO: 117706 - DNA, 25 bp, E. coli
ttgaactacttacgcggagggtaat

SEQ ID NO: 117707 - DNA, 25 bp, E. coli
tgaaggtgctgatacgccagatgta

SEQ ID NO: 117708 - DNA, 25 bp, E. coli
tgaaggtgctgaaacgccagatgta

SEQ ID NO: 117709 - DNA, 25 bp, E. coli
tcgcctgaaggtgctgatacgccag

SEQ ID NO: 117710 - DNA, 25 bp, E. coli
tcgcctgaaggtcctgatacgccag

SEQ ID NO: 117711 - DNA, 25 bp, E. coli
tacttaggcggacggtaatgagtcc

SEQ ID NO: 117712 - DNA, 25 bp, E. coli
tacttaggcggagggtaatgagtcc

SEQ ID NO: 117713 - DNA, 25 bp, E. coli
gcctgaaggtgcagatacgccagat

SEQ ID NO: 117714 - DNA, 25 bp, E. coli
cctgaaggtgctgatacgccagatg

SEQ ID NO: 117715 - DNA, 25 bp, E. coli
cctgaaggtgctcatacgccagatg

SEQ ID NO: 117716 - DNA, 25 bp, E. coli
gcctgaaggtgctgatacgccagat

SEQ ID NO: 117717 - DNA, 25 bp, E. coli
cgcctgaaggtgctgatacgccaga

SEQ ID NO: 117718 - DNA, 25 bp, E. coli
cgcctgaaggtggtgatacgccaga

SEQ ID NO: 117719 - DNA, 25 bp, E. coli
attgccctctcactttccatcggtg

SEQ ID NO: 117720 - DNA, 25 bp, E. coli
attgccctctcagtttccatcggtg

SEQ ID NO: 117721 - DNA, 25 bp, E. coli
tgtatatcgccataagacgaggtag

SEQ ID NO: 117722 - DNA, 25 bp, E. coli
tgtatatcgccaaaagacgaggtag

SEQ ID NO: 117723 - DNA, 25 bp, E. coli
tcgccaaaagaccaggtagaaaccg

SEQ ID NO: 117724 - DNA, 25 bp, E. coli
tcgccaaaagacgaggtagaaaccg

SEQ ID NO: 117725 - DNA, 25 bp, E. coli
gactatgagcgcctcattcaaatag

SEQ ID NO: 117726 - DNA, 25 bp, E. coli
gactatgagcgcgtcattcaaatag

SEQ ID NO: 117727 - DNA, 25 bp, E. coli
gacgaggtagaatccgtgttgaact

SEQ ID NO: 117728 - DNA, 25 bp, E. coli
gacgaggtagaaaccgtgttgaact

SEQ ID NO: 117729 - DNA, 25 bp, E. coli
ctttccatcggtcccgccatgttta

SEQ ID NO: 117730 - DNA, 25 bp, E. coli
ctttccatcggtgccgccatgttta

SEQ ID NO: 117731 - DNA, 25 bp, E. coli
gatattgccctcacactttccatcg

SEQ ID NO: 117732 - DNA, 25 bp, E. coli
gatattgccctctcactttccatcg

SEQ ID NO: 117733 - DNA, 25 bp, E. coli
gtttaaccataatggtcgacattat

SEQ ID NO: 117734 - DNA, 25 bp, E. coli
gtttaaccataaaggtcgacattat

SEQ ID NO: 117735 - DNA, 25 bp, E. coli
ggtcatcctgacaatgagcgcctca

SEQ ID NO: 117736 - DNA, 25 bp, E. coli
ggtcatcctgactatgagcgcctca

SEQ ID NO: 117737 - DNA, 25 bp, E. coli
taatggtcatccagactatgagcgc

SEQ ID NO: 117738 - DNA, 25 bp, E. coli
taatggtcatcctgactatgagcgc

SEQ ID NO: 117739 - DNA, 25 bp, E. coli
gaggtagaaaccctgttgaactctg

SEQ ID NO: 117740 - DNA, 25 bp, E. coli
gaggtagaaaccgtgttgaactctg

SEQ ID NO: 117741 - DNA, 25 bp, E. coli
cagttctcgcgtggataactacccg

SEQ ID NO: 117742 - DNA, 25 bp, E. coli
cagttctcgcgtcgataactacccg

SEQ ID NO: 117743 - DNA, 25 bp, E. coli
caggtgtggcgtaagatctccacca

SEQ ID NO: 117744 - DNA, 25 bp, E. coli
caggtgtggcgttagatctccacca

SEQ ID NO: 117745 - DNA, 25 bp, E. coli
taactacccgctgattttgtgtgag

SEQ ID NO: 117746 - DNA, 25 bp, E. coli
taactacccgctcattttgtgtgag

SEQ ID NO: 117747 - DNA, 25 bp, E. coli
aaaggcggcaaacagagcgtcagcc

SEQ ID NO: 117748 - DNA, 25 bp, E. coli
aaaggcggcaaagagagcgtcagcc

SEQ ID NO: 117749 - DNA, 25 bp, E. coli
tatccgcaggtcttcaaacatacgc

SEQ ID NO: 117750 - DNA, 25 bp, E. coli
tatccgcaggtcatcaaacatacgc

SEQ ID NO: 117751 - DNA, 25 bp, E. coli
gtcagccatcagaactatccgcagg

SEQ ID NO: 117752 - DNA, 25 bp, E. coli
ggtccagggcgttgccggattatca

SEQ ID NO: 117753 - DNA, 25 bp, E. coli
ggtccagggcgtagccggattatca

SEQ ID NO: 117754 - DNA, 25 bp, E. coli
gggctggcgtcacattttgtctacg

SEQ ID NO: 117755 - DNA, 25 bp, E. coli
ggctgccagaaatgcccgaccttaa

SEQ ID NO: 117756 - DNA, 25 bp, E. coli
gtcagccatcagtactatccgcagg

SEQ ID NO: 117757 - DNA, 25 bp, E. coli
ggctgccagaaaagcccgaccttaa

SEQ ID NO: 117758 - DNA, 25 bp, E. coli
gggctggcgtcagattttgtctacg

SEQ ID NO: 117759 - DNA, 25 bp, E. coli
ggcgtgccggtgtttgccacccata

SEQ ID NO: 117760 - DNA, 25 bp, E. coli
ggcgtgccggtgattgccacccata

SEQ ID NO: 117761 - DNA, 25 bp, E. coli
taagagcgtggtgcgcttttgcgaa

SEQ ID NO: 117762 - DNA, 25 bp, E. coli
taagagcgtggtccgcttttgcgaa

SEQ ID NO: 117763 - DNA, 25 bp, E. coli
ttaacttaacggatgtttcgcggtg

SEQ ID NO: 117764 - DNA, 25 bp, E. coli
ttaacttaacggttgtttcgcggtg

SEQ ID NO: 117765 - DNA, 25 bp, E. coli
acggtgcgtttttgctgactttaag

SEQ ID NO: 117766 - DNA, 25 bp, E. coli
acggtgcgttttagctgactttaag

SEQ ID NO: 117767 - DNA, 25 bp, E. coli
tgtctggtcaatattaacggtgcgt

SEQ ID NO: 117768 - DNA, 25 bp, E. coli
tgtcacgagcactcagacggtctta

SEQ ID NO: 117769 - DNA, 25 bp, E. coli
tgtctggtcaattttaacggtgcgt

SEQ ID NO: 117770 - DNA, 25 bp, E. coli
tgtcacgagcacacagacggtctta

SEQ ID NO: 117771 - DNA, 25 bp, E. coli
tagccattacgccacggttacttta

SEQ ID NO: 117772 - DNA, 25 bp, E. coli
tgaatgtgggctatgtcacgagcac

SEQ ID NO: 117773 - DNA, 25 bp, E. coli
tgaatgtgggctttgtcacgagcac

SEQ ID NO: 117774 - DNA, 25 bp, E. coli
tagccattacgcgacggttacttta

SEQ ID NO: 117775 - DNA, 25 bp, E. coli
tctcatttaaacctacctgcagcga

SEQ ID NO: 117776 - DNA, 25 bp, E. coli
tctcatttaaacgtacctgcagcga

SEQ ID NO: 117777 - DNA, 25 bp, E. coli
gactttaaggcactatgtaacgatg

SEQ ID NO: 117778 - DNA, 25 bp, E. coli
gactttaaggcagtatgtaacgatg

SEQ ID NO: 117779 - DNA, 25 bp, E. coli
ggttcaccggcatctcaattctcat

SEQ ID NO: 117780 - DNA, 25 bp, E. coli
ggttcaccggcaactcaattctcat

SEQ ID NO: 117781 - DNA, 25 bp, E. coli
gtgagcatgatgcttcaccggcatc

SEQ ID NO: 117782 - DNA, 25 bp, E. coli
gtgagcatgatggttcaccggcatc

SEQ ID NO: 117783 - DNA, 25 bp, E. coli
taacgatgcaacagtaagttagcct

SEQ ID NO: 117784 - DNA, 25 bp, E. coli
taacgatgcaactgtaagttagcct

SEQ ID NO: 117785 - DNA, 25 bp, E. coli
cagcgtgcggaaggtgaaattctgc

SEQ ID NO: 117786 - DNA, 25 bp, E. coli
cagcgtgcggaacgtgaaattctgc

SEQ ID NO: 117787 - DNA, 25 bp, E. coli
caaagccgcattctggaacgaaacc

SEQ ID NO: 117788 - DNA, 25 bp, E. coli
cacggcgtttatctacctgggcgaa

SEQ ID NO: 117789 - DNA, 25 bp, E. coli
cacggcgtttatgtacctgggcgaa

SEQ ID NO: 117790 - DNA, 25 bp, E. coli
caaagccgcattgtggaacgaaacc

SEQ ID NO: 117791 - DNA, 25 bp, E. coli
ttgattgagttcagcaacacggacg

SEQ ID NO: 117792 - DNA, 25 bp, E. coli
ttgattgagttctgcaacacggacg

SEQ ID NO: 117793 - DNA, 25 bp, E. coli
tgcagtgggcatagaccaaagccgc

SEQ ID NO: 117794 - DNA, 25 bp, E. coli
tgcagtgggcattgaccaaagccgc

SEQ ID NO: 117795 - DNA, 25 bp, E. coli
gaagagctgatcaccgaactgaagc

SEQ ID NO: 117796 - DNA, 25 bp, E. coli
gaagagctgatctccgaactgaagc

SEQ ID NO: 117797 - DNA, 25 bp, E. coli
gaactgaagcagcattacaccgtgg

SEQ ID NO: 117798 - DNA, 25 bp, E. coli
gaactgaagcaggattacaccgtgg

SEQ ID NO: 117799 - DNA, 25 bp, E. coli
gatctgttcaccaagccagcgaaga

SEQ ID NO: 117800 - DNA, 25 bp, E. coli
gatctgttcacctagccagcgaaga

SEQ ID NO: 117801 - DNA, 25 bp, E. coli
tggtgttccagaaaccgacgccgtt

SEQ ID NO: 117802 - DNA, 25 bp, E. coli
tggtgttccagataccgacgccgtt

SEQ ID NO: 117803 - DNA, 25 bp, E. coli
gagtatggttgatactgccccgagt

SEQ ID NO: 117804 - DNA, 25 bp, E. coli
gagtatggttgaaactgccccgagt

SEQ ID NO: 117805 - DNA, 25 bp, E. coli
gacgctgctgcgtaccttcaacaaa

SEQ ID NO: 117806 - DNA, 25 bp, E. coli
gacgctgctgcgaaccttcaacaaa

SEQ ID NO: 117807 - DNA, 25 bp, E. coli
caagtaaacagcgaagagcgcgatg

SEQ ID NO: 117808 - DNA, 25 bp, E. coli
caagtaaacagccaagagcgcgatg

SEQ ID NO: 117809 - DNA, 25 bp, E. coli
caaaacaagtaaacagcgaagagcg

SEQ ID NO: 117810 - DNA, 25 bp, E. coli
caaaacaagtaatcagcgaagagcg

SEQ ID NO: 117811 - DNA, 25 bp, E. coli
cagtgtcacaaaacaagtaaacagc

SEQ ID NO: 117812 - DNA, 25 bp, E. coli
cagtgtcacaaatcaagtaaacagc

SEQ ID NO: 117813 - DNA, 25 bp, E. coli
accgtggtacgcgttgtttgatgct

SEQ ID NO: 117814 - DNA, 25 bp, E. coli
accgtggtacgccttgtttgatgct

SEQ ID NO: 117815 - DNA, 25 bp, E. coli
aaacagcgaagaccgcgatgacacc

SEQ ID NO: 117816 - DNA, 25 bp, E. coli
aaacaagtaaacagcgaagagcgcg

SEQ ID NO: 117817 - DNA, 25 bp, E. coli
aaacaagtaaactgcgaagagcgcg

SEQ ID NO: 117818 - DNA, 25 bp, E. coli
acgcgttgtttgatgctctgctgca

SEQ ID NO: 117819 - DNA, 25 bp, E. coli
aaacagcgaagagcgcgatgacacc

SEQ ID NO: 117820 - DNA, 25 bp, E. coli
acgcgttgtttgttgctctgctgca

SEQ ID NO: 117821 - DNA, 25 bp, E. coli
tggtacgcgttgattgatgctctgc

SEQ ID NO: 117822 - DNA, 25 bp, E. coli
tggtacgcgttgtttgatgctctgc

SEQ ID NO: 117823 - DNA, 25 bp, E. coli
cgaagtgtttgaccgcgggcgcacc

SEQ ID NO: 117824 - DNA, 25 bp, E. coli
cgaagtgtttgagcgcgggcgcacc

SEQ ID NO: 117825 - DNA, 25 bp, E. coli
gtttgatgctctcctgcaactggcg

SEQ ID NO: 117826 - DNA, 25 bp, E. coli
gtttgatgctctgctgcaactggcg

SEQ ID NO: 117827 - DNA, 25 bp, E. coli
ggcgcaccacgtggctgctgctgtt

SEQ ID NO: 117828 - DNA, 25 bp, E. coli
ggcgcaccacgtcgctgctgctgtt

SEQ ID NO: 117829 - DNA, 25 bp, E. coli
aatattccgcgcgtcaacaaagagg

SEQ ID NO: 117830 - DNA, 25 bp, E. coli
aatattccgcgcctcaacaaagagg

SEQ ID NO: 117831 - DNA, 25 bp, E. coli
atgctggcgtcttcaacccggaagg

SEQ ID NO: 117832 - DNA, 25 bp, E. coli
atgctggcgtctacaacccggaagg

SEQ ID NO: 117833 - DNA, 25 bp, E. coli
ttgtgtgaaaacgtgtccgaccggg

SEQ ID NO: 117834 - DNA, 25 bp, E. coli
ttcggcaccaagaaggagatgctgg

SEQ ID NO: 117835 - DNA, 25 bp, E. coli
ttgtgtgaaaacctgtccgaccggg

SEQ ID NO: 117836 - DNA, 25 bp, E. coli
ttcggcaccaagtaggagatgctgg

SEQ ID NO: 117837 - DNA, 25 bp, E. coli
tgaaagcgcgtgcttacgaacatgc

SEQ ID NO: 117838 - DNA, 25 bp, E. coli
tgaaagcgcgtggttacgaacatgc

SEQ ID NO: 117839 - DNA, 25 bp, E. coli
gccttctcaggtccgtgattacaaa

SEQ ID NO: 117840 - DNA, 25 bp, E. coli
gccttctcaggtgcgtgattacaaa

SEQ ID NO: 117841 - DNA, 25 bp, E. coli
gcaagctggagtggctgatccgtaa

SEQ ID NO: 117842 - DNA, 25 bp, E. coli
gcaatcattcagtacgctaacggga

SEQ ID NO: 117843 - DNA, 25 bp, E. coli
gcaatcattcagaacgctaacggga

SEQ ID NO: 117844 - DNA, 25 bp, E. coli
gcaagctggagtcgctgatccgtaa

SEQ ID NO: 117845 - DNA, 25 bp, E. coli
gaaaggcgcgttcaaaccgctggca

SEQ ID NO: 117846 - DNA, 25 bp, E. coli
gaaaggcgcgttgaaaccgctggca

SEQ ID NO: 117847 - DNA, 25 bp, E. coli
cccgaataaggaagtggacgatgac

SEQ ID NO: 117848 - DNA, 25 bp, E. coli
cccgaataaggatgtggacgatgac

SEQ ID NO: 117849 - DNA, 25 bp, E. coli
taacgggattgtcgatttccagtcg

SEQ ID NO: 117850 - DNA, 25 bp, E. coli
taacgggattgtggatttccagtcg

SEQ ID NO: 117851 - DNA, 25 bp, E. coli
tattatcaccgtctggaatacgtcg

SEQ ID NO: 117852 - DNA, 25 bp, E. coli
tattatcaccgtgtggaatacgtcg

SEQ ID NO: 117853 - DNA, 25 bp, E. coli
tcgccagcgggattcaatattatca

SEQ ID NO: 117854 - DNA, 25 bp, E. coli
tcgccagcgggaatcaatattatca

SEQ ID NO: 117855 - DNA, 25 bp, E. coli
tcgtggaacattagctgacgcgccc

SEQ ID NO: 117856 - DNA, 25 bp, E. coli
tcgtggaacatttgctgacgcgccc

SEQ ID NO: 117857 - DNA, 25 bp, E. coli
cctttgtggctgaaaacggcggctg

SEQ ID NO: 117858 - DNA, 25 bp, E. coli
cctttgtggctgtaaacggcggctg

SEQ ID NO: 117859 - DNA, 25 bp, E. coli
gcaggctccaataaccgtgaaggcg

SEQ ID NO: 117860 - DNA, 25 bp, E. coli
gcaggctccaattaccgtgaaggcg

SEQ ID NO: 117861 - DNA, 25 bp, E. coli
gcagcatcgatctgattatccccgg

SEQ ID NO: 117862 - DNA, 25 bp, E. coli
gcagcatcgatcagattatccccgg

SEQ ID NO: 117863 - DNA, 25 bp, E. coli
gacgcgcccggaagtggaaattatt

SEQ ID NO: 117864 - DNA, 25 bp, E. coli
ccgtgaaggcgttctggatgtgatc

SEQ ID NO: 117865 - DNA, 25 bp, E. coli
cgatattgagatgctgcgtcaggca

SEQ ID NO: 117866 - DNA, 25 bp, E. coli
ccgtgaaggcgtactggatgtgatc

SEQ ID NO: 117867 - DNA, 25 bp, E. coli
cgatattgagatcctgcgtcaggca

SEQ ID NO: 117868 - DNA, 25 bp, E. coli
tggccttcgccatctgcagaaatta

SEQ ID NO: 117869 - DNA, 25 bp, E. coli
tggccttcgccaactgcagaaatta

SEQ ID NO: 117870 - DNA, 25 bp, E. coli
tcaaaaaacctataaccgtgagcgg

SEQ ID NO: 117871 - DNA, 25 bp, E. coli
tcaaaaaacctaaaaccgtgagcgg

SEQ ID NO: 117872 - DNA, 25 bp, E. coli
gacgcgcccggatgtggaaattatt

SEQ ID NO: 117873 - DNA, 25 bp, E. coli
ctgtccagcgttttagaacatttta

SEQ ID NO: 117874 - DNA, 25 bp, E. coli
ctgtccagcgttatagaacatttta

SEQ ID NO: 117875 - DNA, 25 bp, E. coli
taaaaacaggaattttatctgcgct

SEQ ID NO: 117876 - DNA, 25 bp, E. coli
taaaaacaggaaatttatctgcgct

SEQ ID NO: 117877 - DNA, 25 bp, E. coli
aatgaggaactcagctttaaaaaca

SEQ ID NO: 117878 - DNA, 25 bp, E. coli
aatgaggaactctgctttaaaaaca

SEQ ID NO: 117879 - DNA, 25 bp, E. coli
tagcctgattaatttctgtctgtcc

SEQ ID NO: 117880 - DNA, 25 bp, E. coli
tagcctgattaaattctgtctgtcc

SEQ ID NO: 117881 - DNA, 25 bp, E. coli
tatctgcgctaacaagaaaattacc

SEQ ID NO: 117882 - DNA, 25 bp, E. coli
tatctgcgctaagaagaaaattacc

SEQ ID NO: 117883 - DNA, 25 bp, E. coli
tgctggtcatcagccttcaggttac

SEQ ID NO: 117884 - DNA, 25 bp, E. coli
tgctggtcatcacccttcaggttac

SEQ ID NO: 117885 - DNA, 25 bp, E. coli
ccacgatggtggctgttttgaaaat

SEQ ID NO: 117886 - DNA, 25 bp, E. coli
ccacgatggtgggtgttttgaaaat

SEQ ID NO: 117887 - DNA, 25 bp, E. coli
gccttcaggttacctatcatagagg

SEQ ID NO: 117888 - DNA, 25 bp, E. coli
gccttcaggttagctatcatagagg

SEQ ID NO: 117889 - DNA, 25 bp, E. coli
gttagcgcccggaccgtccgagcga

SEQ ID NO: 117890 - DNA, 25 bp, E. coli
gttagcgcccggtccgtccgagcga

SEQ ID NO: 117891 - DNA, 25 bp, E. coli
taatgacgttaattgaggaactctg

SEQ ID NO: 117892 - DNA, 25 bp, E. coli
taatgacgttaaatgaggaactctg

SEQ ID NO: 117893 - DNA, 25 bp, E. coli
gaggtttaatccatattcagagtca

SEQ ID NO: 117894 - DNA, 25 bp, E. coli
gaggtttaatccttattcagagtca

SEQ ID NO: 117895 - DNA, 25 bp, E. coli
cacattgttgatgactccgcttaag

SEQ ID NO: 117896 - DNA, 25 bp, E. coli
cacattgttgatcactccgcttaag

SEQ ID NO: 117897 - DNA, 25 bp, E. coli
agaccgtggtaaggccacaaacgca

SEQ ID NO: 117898 - DNA, 25 bp, E. coli
agaccgtggtaacgccacaaacgca

SEQ ID NO: 117899 - DNA, 25 bp, E. coli
aaaagcctgcgtcgcggcacattgt

SEQ ID NO: 117900 - DNA, 25 bp, E. coli
aaaagcctgcgtggcggcacattgt

SEQ ID NO: 117901 - DNA, 25 bp, E. coli
tgccaaaagcctccgtggcggcaca

SEQ ID NO: 117902 - DNA, 25 bp, E. coli
tgccaaaagcctgcgtggcggcaca

SEQ ID NO: 117903 - DNA, 25 bp, E. coli
gacagaccgtggtaacgccacaaac

SEQ ID NO: 117904 - DNA, 25 bp, E. coli
gacagaccgtggaaacgccacaaac

SEQ ID NO: 117905 - DNA, 25 bp, E. coli
cgtggcggcacattgttgatgactc

SEQ ID NO: 117906 - DNA, 25 bp, E. coli
ctgcgtggcggctcattgttgatga

SEQ ID NO: 117907 - DNA, 25 bp, E. coli
cgtggtaacgccacaaacgcagatc

SEQ ID NO: 117908 - DNA, 25 bp, E. coli
cgtggcggcacaatgttgatgactc

SEQ ID NO: 117909 - DNA, 25 bp, E. coli
ctgcgtggcggcacattgttgatga

SEQ ID NO: 117910 - DNA, 25 bp, E. coli
cgtggtaacgcctcaaacgcagatc

SEQ ID NO: 117911 - DNA, 25 bp, E. coli
ggcggacagaccgtggtaacgccac

SEQ ID NO: 117912 - DNA, 25 bp, E. coli
tggcggcacattgttgatgactccg

SEQ ID NO: 117913 - DNA, 25 bp, E. coli
tggcggcacattcttgatgactccg

SEQ ID NO: 117914 - DNA, 25 bp, E. coli
ggcacattgttgatgactccgctta

SEQ ID NO: 117915 - DNA, 25 bp, E. coli
ggcacattgttgttgactccgctta

SEQ ID NO: 117916 - DNA, 25 bp, E. coli
ggcggacagaccctggtaacgccac

SEQ ID NO: 117917 - DNA, 25 bp, E. coli
atccgacttatacggcggagtgtga

SEQ ID NO: 117918 - DNA, 25 bp, E. coli
atccgacttatagggcggagtgtga

SEQ ID NO: 117919 - DNA, 25 bp, E. coli
tattccattcatccgacttataggg

SEQ ID NO: 117920 - DNA, 25 bp, E. coli
tattccattcatgcgacttataggg

SEQ ID NO: 117921 - DNA, 25 bp, E. coli
ttcggtatcaattattgcagacatt

SEQ ID NO: 117922 - DNA, 25 bp, E. coli
ttcggtatcaataattgcagacatt

SEQ ID NO: 117923 - DNA, 25 bp, E. coli
tgcattttattcgattcatccgact

SEQ ID NO: 117924 - DNA, 25 bp, E. coli
tgcattttattccattcatccgact

SEQ ID NO: 117925 - DNA, 25 bp, E. coli
tccattcatccgtcttatagggcgg

SEQ ID NO: 117926 - DNA, 25 bp, E. coli
tccattcatccgacttatagggcgg

SEQ ID NO: 117927 - DNA, 25 bp, E. coli
tcactttcacgcaatcagatatgca

SEQ ID NO: 117928 - DNA, 25 bp, E. coli
tcatccgacttatagggcggagtgt

SEQ ID NO: 117929 - DNA, 25 bp, E. coli
tcatccgacttaaagggcggagtgt

SEQ ID NO: 117930 - DNA, 25 bp, E. coli
gcaatcagatatgcattttattcca

SEQ ID NO: 117931 - DNA, 25 bp, E. coli
gcaatcagatatccattttattcca

SEQ ID NO: 117932 - DNA, 25 bp, E. coli
cattcatccgacatatagggcggag

SEQ ID NO: 117933 - DNA, 25 bp, E. coli
ctttcacgcaatgagatatgcattt

SEQ ID NO: 117934 - DNA, 25 bp, E. coli
cattcatccgacttatagggcggag

SEQ ID NO: 117935 - DNA, 25 bp, E. coli
ctttttcactttcacgcaatcagat

SEQ ID NO: 117936 - DNA, 25 bp, E. coli
ctttttcactttgacgcaatcagat

SEQ ID NO: 117937 - DNA, 25 bp, E. coli
ctttcacgcaatcagatatgcattt

SEQ ID NO: 117938 - DNA, 25 bp, E. coli
tcactttcacgctatcagatatgca

SEQ ID NO: 117939 - DNA, 25 bp, E. coli
aatccggtgttgtctggtgcagtag

SEQ ID NO: 117940 - DNA, 25 bp, E. coli
aatccggtgttgactggtgcagtag

SEQ ID NO: 117941 - DNA, 25 bp, E. coli
catcaaaaccgcagtggcttaccca

SEQ ID NO: 117942 - DNA, 25 bp, E. coli
catcaaaaccgctgtggcttaccca

SEQ ID NO: 117943 - DNA, 25 bp, E. coli
tacgctgccgacatcaaaaccgcag

SEQ ID NO: 117944 - DNA, 25 bp, E. coli
agtatgaggttgacgcaatgtcggt

SEQ ID NO: 117945 - DNA, 25 bp, E. coli
agtatgaggttgtcgcaatgtcggt

SEQ ID NO: 117946 - DNA, 25 bp, E. coli
tacgctgccgacttcaaaaccgcag

SEQ ID NO: 117947 - DNA, 25 bp, E. coli
tgagtatgaggttgtcgcaatgtcg

SEQ ID NO: 117948 - DNA, 25 bp, E. coli
tgagtatgaggtagtcgcaatgtcg

SEQ ID NO: 117949 - DNA, 25 bp, E. coli
gctgccgacatcaaaaccgcagtgg

SEQ ID NO: 117950 - DNA, 25 bp, E. coli
gctaatccggtgttgactggtgcag

SEQ ID NO: 117951 - DNA, 25 bp, E. coli
gctgccgacatctaaaccgcagtgg

SEQ ID NO: 117952 - DNA, 25 bp, E. coli
gctaatccggtgatgactggtgcag

SEQ ID NO: 117953 - DNA, 25 bp, E. coli
gaatacgctgcccacatcaaaaccg

SEQ ID NO: 117954 - DNA, 25 bp, E. coli
gaatacgctgccgacatcaaaaccg

SEQ ID NO: 117955 - DNA, 25 bp, E. coli
gactcttgagtaagaggttgtcgca

SEQ ID NO: 117956 - DNA, 25 bp, E. coli
gactcttgagtatgaggttgtcgca

SEQ ID NO: 117957 - DNA, 25 bp, E. coli
ccgacatcaaaagcgcagtggctta

SEQ ID NO: 117958 - DNA, 25 bp, E. coli
ccgacatcaaaaccgcagtggctta

SEQ ID NO: 117959 - DNA, 25 bp, E. coli
gtgttgactggtgcagtagataaag

SEQ ID NO: 117960 - DNA, 25 bp, E. coli
gtgttgactggtccagtagataaag

SEQ ID NO: 117961 - DNA, 25 bp, E. coli
caaagaacgaatgagcagcctagag

SEQ ID NO: 117962 - DNA, 25 bp, E. coli
caaagaacgaatcagcagcctagag

SEQ ID NO: 117963 - DNA, 25 bp, E. coli
catggaaaagcgtttcggtgactta

SEQ ID NO: 117964 - DNA, 25 bp, E. coli
catggaaaagcgattcggtgactta

SEQ ID NO: 117965 - DNA, 25 bp, E. coli
ttcaacaatgtctcaacaagaggtg

SEQ ID NO: 117966 - DNA, 25 bp, E. coli
ttcaacaatgtcacaacaagaggtg

SEQ ID NO: 117967 - DNA, 25 bp, E. coli
tctcggttggatgatctggcagcaa

SEQ ID NO: 117968 - DNA, 25 bp, E. coli
tctggcagcaacgagctggtatcca

SEQ ID NO: 117969 - DNA, 25 bp, E. coli
tctggcagcaaccagctggtatcca

SEQ ID NO: 117970 - DNA, 25 bp, E. coli
tctcggttggatcatctggcagcaa

SEQ ID NO: 117971 - DNA, 25 bp, E. coli
gcatgggatatgtctctcggttgga

SEQ ID NO: 117972 - DNA, 25 bp, E. coli
gcatgggatatgactctcggttgga

SEQ ID NO: 117973 - DNA, 25 bp, E. coli
gcagcctagaggttcgagacgatat

SEQ ID NO: 117974 - DNA, 25 bp, E. coli
gcagcctagaggatcgagacgatat

SEQ ID NO: 117975 - DNA, 25 bp, E. coli
gaaatcgcactcctatctctggaag

SEQ ID NO: 117976 - DNA, 25 bp, E. coli
gaaatcgcactcgtatctctggaag

SEQ ID NO: 117977 - DNA, 25 bp, E. coli
cggcgataacgaatacatggcatgg

SEQ ID NO: 117978 - DNA, 25 bp, E. coli
cggcgataacgattacatggcatgg

SEQ ID NO: 117979 - DNA, 25 bp, E. coli
gatcgtcggagaccaaaaaacggcg

SEQ ID NO: 117980 - DNA, 25 bp, E. coli
gagccagatgaacgcgaagcctatg

SEQ ID NO: 117981 - DNA, 25 bp, E. coli
gagccagatgaaggcgaagcctatg

SEQ ID NO: 117982 - DNA, 25 bp, E. coli
gatcgtcggagagcaaaaaacggcg

SEQ ID NO: 117983 - DNA, 25 bp, E. coli
caagcgccgcgtcacttattcgatg

SEQ ID NO: 117984 - DNA, 25 bp, E. coli
caagcgccgcgtgacttattcgatg

SEQ ID NO: 117985 - DNA, 25 bp, E. coli
aaaagcgagctggtccggcaattgc

SEQ ID NO: 117986 - DNA, 25 bp, E. coli
aaaagcgagctgctccggcaattgc

SEQ ID NO: 117987 - DNA, 25 bp, E. coli
tattcgatgcccatactgcgcgaag

SEQ ID NO: 117988 - DNA, 25 bp, E. coli
tattcgatgcccttactgcgcgaag

SEQ ID NO: 117989 - DNA, 25 bp, E. coli
tccgactgggattcgaacggcatcc

SEQ ID NO: 117990 - DNA, 25 bp, E. coli
tccattatgccgtagcggtggcgcg

SEQ ID NO: 117991 - DNA, 25 bp, E. coli
tccattatgccgaagcggtggcgcg

SEQ ID NO: 117992 - DNA, 25 bp, E. coli
tccgactgggatacgaacggcatcc

SEQ ID NO: 117993 - DNA, 25 bp, E. coli
gctcaggcgataaggtgatgccgca

SEQ ID NO: 117994 - DNA, 25 bp, E. coli
gctcaggcgatatggtgatgccgca

SEQ ID NO: 117995 - DNA, 25 bp, E. coli
gaatattctcgcgttcgtctcgtgg

SEQ ID NO: 117996 - DNA, 25 bp, E. coli
gaatattctcgccttcgtctcgtgg

SEQ ID NO: 117997 - DNA, 25 bp, E. coli
gactgatccccggaaaaacggcgat

SEQ ID NO: 117998 - DNA, 25 bp, E. coli
gactgatccccgcaaaaacggcgat

SEQ ID NO: 117999 - DNA, 25 bp, E. coli
gattcgccctatgaacagacgctgg

SEQ ID NO: 118000 - DNA, 25 bp, E. coli
gattcgccctatcaacagacgctgg

SEQ ID NO: 118001 - DNA, 25 bp, E. coli
ggacggaccgcacacacttgtcgat

SEQ ID NO: 118002 - DNA, 25 bp, E. coli
ggacggaccgcagacacttgtcgat

SEQ ID NO: 118003 - DNA, 25 bp, E. coli
ggaaaaatcctgtcgatcggcgccg

SEQ ID NO: 118004 - DNA, 25 bp, E. coli
ggaaaaatcctgacgatcggcgccg

SEQ ID NO: 118005 - DNA, 25 bp, E. coli
aaagcctttgcgatcgttatcacag

SEQ ID NO: 118006 - DNA, 25 bp, E. coli
aaagcctttgcgttcgttatcacag

SEQ ID NO: 118007 - DNA, 25 bp, E. coli
tatcacaggcgaacgagcgaagtac

SEQ ID NO: 118008 - DNA, 25 bp, E. coli
tatcacaggcgatcgagcgaagtac

SEQ ID NO: 118009 - DNA, 25 bp, E. coli
tatgaacgggcggaaaaagcctttg

SEQ ID NO: 118010 - DNA, 25 bp, E. coli
tatgaacgggcgcaaaaagcctttg

SEQ ID NO: 118011 - DNA, 25 bp, E. coli
tgatccgcgctgatggcctgttggt

SEQ ID NO: 118012 - DNA, 25 bp, E. coli
tgatccgcgctgttggcctgttggt

SEQ ID NO: 118013 - DNA, 25 bp, E. coli
tcgatcctgaagaagaacgacgtta

SEQ ID NO: 118014 - DNA, 25 bp, E. coli
tcgatcctgaagtagaacgacgtta

SEQ ID NO: 118015 - DNA, 25 bp, E. coli
tctcccgaactaatgaaagtgctgg

SEQ ID NO: 118016 - DNA, 25 bp, E. coli
tctcccgaactattgaaagtgctgg

SEQ ID NO: 118017 - DNA, 25 bp, E. coli
gcctgttggtgagcgacttgctcca

SEQ ID NO: 118018 - DNA, 25 bp, E. coli
gcctgttggtgaccgacttgctcca

SEQ ID NO: 118019 - DNA, 25 bp, E. coli
gaaggtgacactctcgatcctgaag

SEQ ID NO: 118020 - DNA, 25 bp, E. coli
gaaggtgacactgtcgatcctgaag

SEQ ID NO: 118021 - DNA, 25 bp, E. coli
gacatcatccgcatcaatcgttttg

SEQ ID NO: 118022 - DNA, 25 bp, E. coli
gacatcatccgcttcaatcgttttg

SEQ ID NO: 118023 - DNA, 25 bp, E. coli
cttgctccaggcgattatcccgtta

SEQ ID NO: 118024 - DNA, 25 bp, E. coli
cattcgatgggagcgcaggtgatcc

SEQ ID NO: 118025 - DNA, 25 bp, E. coli
cttgctccaggccattatcccgtta

SEQ ID NO: 118026 - DNA, 25 bp, E. coli
cattcgatgggaccgcaggtgatcc

SEQ ID NO: 118027 - DNA, 25 bp, E. coli
catctggagggtatgccggggcagc

SEQ ID NO: 118028 - DNA, 25 bp, E. coli
catctggagggtttgccggggcagc

SEQ ID NO: 118029 - DNA, 25 bp, E. coli
atctggagggtttgccggggcagca

SEQ ID NO: 118030 - DNA, 25 bp, E. coli
atctggagggttagccggggcagca

SEQ ID NO: 118031 - DNA, 25 bp, E. coli
agcatctggagggtttgccggggca

SEQ ID NO: 118032 - DNA, 25 bp, E. coli
atcagcatctggtgggtttgccggg

SEQ ID NO: 118033 - DNA, 25 bp, E. coli
agcatctggaggctttgccggggca

SEQ ID NO: 118034 - DNA, 25 bp, E. coli
atcagcatctggagggtttgccggg

SEQ ID NO: 118035 - DNA, 25 bp, E. coli
tgtgaataacgtgaatcttgaattg

SEQ ID NO: 118036 - DNA, 25 bp, E. coli
tgtgaataacgtcaatcttgaattg

SEQ ID NO: 118037 - DNA, 25 bp, E. coli
tctggagggtttgccggggcagcaa

SEQ ID NO: 118038 - DNA, 25 bp, E. coli
tctggagggtttcccggggcagcaa

SEQ ID NO: 118039 - DNA, 25 bp, E. coli
gctgtgaataacctcaatcttgaat

SEQ ID NO: 118040 - DNA, 25 bp, E. coli
gctgtgaataacgtcaatcttgaat

SEQ ID NO: 118041 - DNA, 25 bp, E. coli
ctgtgaataacgtcaatcttgaatt

SEQ ID NO: 118042 - DNA, 25 bp, E. coli
ctgtgaataacgacaatcttgaatt

SEQ ID NO: 118043 - DNA, 25 bp, E. coli
gatcagcatctggagggtttgccgg

SEQ ID NO: 118044 - DNA, 25 bp, E. coli
gatcagcatctgcagggtttgccgg

SEQ ID NO: 118045 - DNA, 25 bp, E. coli
gggtttgccgggccagcaaatcgcc

SEQ ID NO: 118046 - DNA, 25 bp, E. coli
gggtttgccggggcagcaaatcgcc

SEQ ID NO: 118047 - DNA, 25 bp, E. coli
tcagcatctggagggtttgccgggg

SEQ ID NO: 118048 - DNA, 25 bp, E. coli
tcagcatctggacggtttgccgggg

SEQ ID NO: 118049 - DNA, 25 bp, E. coli
aaggaagcagcctaggcagatgacg

SEQ ID NO: 118050 - DNA, 25 bp, E. coli
aaggaagcagccaaggcagatgacg

SEQ ID NO: 118051 - DNA, 25 bp, E. coli
cagccaaggcagatgacgcgtgtgc

SEQ ID NO: 118052 - DNA, 25 bp, E. coli
cagccaaggcagttgacgcgtgtgc

SEQ ID NO: 118053 - DNA, 25 bp, E. coli
cagatgacgcgtgtgccgggatgta

SEQ ID NO: 118054 - DNA, 25 bp, E. coli
cagatgacgcgtctgccgggatgta

SEQ ID NO: 118055 - DNA, 25 bp, E. coli
taccaggtcaggtccggaaggaagc

SEQ ID NO: 118056 - DNA, 25 bp, E. coli
taccaggtcaggaccggaaggaagc

SEQ ID NO: 118057 - DNA, 25 bp, E. coli
tgccgggatgtagctggcagggccc

SEQ ID NO: 118058 - DNA, 25 bp, E. coli
tgccgggatgtacctggcagggccc

SEQ ID NO: 118059 - DNA, 25 bp, E. coli
tctgtttaccaggtcaggtccggaa

SEQ ID NO: 118060 - DNA, 25 bp, E. coli
tctgtttaccagctcaggtccggaa

SEQ ID NO: 118061 - DNA, 25 bp, E. coli
ccggaaggaagctgccaaggcagat

SEQ ID NO: 118062 - DNA, 25 bp, E. coli
gcaacgctactcagtttaccaggtc

SEQ ID NO: 118063 - DNA, 25 bp, E. coli
gcaacgctactctgtttaccaggtc

SEQ ID NO: 118064 - DNA, 25 bp, E. coli
ccggaaggaagcagccaaggcagat

SEQ ID NO: 118065 - DNA, 25 bp, E. coli
ggttctcccgcatcgctactctgtt

SEQ ID NO: 118066 - DNA, 25 bp, E. coli
gggctctgttggatctcccgcaacg

SEQ ID NO: 118067 - DNA, 25 bp, E. coli
gggctctgttggttctcccgcaacg

SEQ ID NO: 118068 - DNA, 25 bp, E. coli
ggttctcccgcaacgctactctgtt

SEQ ID NO: 118069 - DNA, 25 bp, E. coli
gtcaggtccggaaggaagcagccaa

SEQ ID NO: 118070 - DNA, 25 bp, E. coli
gtcaggtccggatggaagcagccaa

SEQ ID NO: 118071 - DNA, 25 bp, E. coli
catgcggaatggagatgagaatgct

SEQ ID NO: 118072 - DNA, 25 bp, E. coli
cagggcgcttcagcgggacgtatac

SEQ ID NO: 118073 - DNA, 25 bp, E. coli
catgcggaatggtgatgagaatgct

SEQ ID NO: 118074 - DNA, 25 bp, E. coli
cagggcgcttcaccgggacgtatac

SEQ ID NO: 118075 - DNA, 25 bp, E. coli
tactggccgaatgaactgagtttct

SEQ ID NO: 118076 - DNA, 25 bp, E. coli
tactggccgaatcaactgagtttct

SEQ ID NO: 118077 - DNA, 25 bp, E. coli
tatcagatgattaaaatggcggaac

SEQ ID NO: 118078 - DNA, 25 bp, E. coli
tatcagatgatttaaatggcggaac

SEQ ID NO: 118079 - DNA, 25 bp, E. coli
tgatgacattgcagggcgcttcacc

SEQ ID NO: 118080 - DNA, 25 bp, E. coli
tgatgacattgctgggcgcttcacc

SEQ ID NO: 118081 - DNA, 25 bp, E. coli
gcttataatctgctgagatatcaga

SEQ ID NO: 118082 - DNA, 25 bp, E. coli
gcttataatctggtgagatatcaga

SEQ ID NO: 118083 - DNA, 25 bp, E. coli
gaacatctgaaacgttactggccga

SEQ ID NO: 118084 - DNA, 25 bp, E. coli
gcaggctgacgcagagaagtaaaaa

SEQ ID NO: 118085 - DNA, 25 bp, E. coli
gcaggctgacgctgagaagtaaaaa

SEQ ID NO: 118086 - DNA, 25 bp, E. coli
gaacatctgaaaggttactggccga

SEQ ID NO: 118087 - DNA, 25 bp, E. coli
ctgagtttctcagaatcatgcggaa

SEQ ID NO: 118088 - DNA, 25 bp, E. coli
ctgagtttctcacaatcatgcggaa

SEQ ID NO: 118089 - DNA, 25 bp, E. coli
gggtgtcttactcgcttataatctg

SEQ ID NO: 118090 - DNA, 25 bp, E. coli
gggtgtcttactggcttataatctg

SEQ ID NO: 118091 - DNA, 25 bp, E. coli
gagaatgctgatgacattgcagggc

SEQ ID NO: 118092 - DNA, 25 bp, E. coli
gagaatgctgatcacattgcagggc

SEQ ID NO: 118093 - DNA, 25 bp, E. coli
caacaactcttgcaaattatggact

SEQ ID NO: 118094 - DNA, 25 bp, E. coli
cactatcaacaacgaggagcagaaa

SEQ ID NO: 118095 - DNA, 25 bp, E. coli
caacaactcttggaaattatggact

SEQ ID NO: 118096 - DNA, 25 bp, E. coli
cactatcaacaaggaggagcagaaa

SEQ ID NO: 118097 - DNA, 25 bp, E. coli
gacttatcaaaaatacaggttaatt

SEQ ID NO: 118098 - DNA, 25 bp, E. coli
gacttatcaaaattacaggttaatt

SEQ ID NO: 118099 - DNA, 25 bp, E. coli
tacttgttagtatgatacaaaggct

SEQ ID NO: 118100 - DNA, 25 bp, E. coli
tacttgttagtaagatacaaaggct

SEQ ID NO: 118101 - DNA, 25 bp, E. coli
aatcgtacaatggtaagacttatca

SEQ ID NO: 118102 - DNA, 25 bp, E. coli
aatcgtacaatgctaagacttatca

SEQ ID NO: 118103 - DNA, 25 bp, E. coli
tgtgtaaatcgtacaatggtaagac

SEQ ID NO: 118104 - DNA, 25 bp, E. coli
tgtgtaaatcgttcaatggtaagac

SEQ ID NO: 118105 - DNA, 25 bp, E. coli
tatggactttgtcccgcggctttaa

SEQ ID NO: 118106 - DNA, 25 bp, E. coli
tatggactttgtgccgcggctttaa

SEQ ID NO: 118107 - DNA, 25 bp, E. coli
gaaattatggacattgtcccgcggc

SEQ ID NO: 118108 - DNA, 25 bp, E. coli
gaaattatggactttgtcccgcggc

SEQ ID NO: 118109 - DNA, 25 bp, E. coli
ctttccactatctacaaggaggagc

SEQ ID NO: 118110 - DNA, 25 bp, E. coli
ctttccactatcaacaaggaggagc

SEQ ID NO: 118111 - DNA, 25 bp, E. coli
gatacaaaggctatcaaaaaagctg

SEQ ID NO: 118112 - DNA, 25 bp, E. coli
gatacaaaggctttcaaaaaagctg

SEQ ID NO: 118113 - DNA, 25 bp, E. coli
ggtaagacttatgaaaaatacaggt

SEQ ID NO: 118114 - DNA, 25 bp, E. coli
ggtaagacttatcaaaaatacaggt

SEQ ID NO: 118115 - DNA, 25 bp, E. coli
caatgtatatggttctgctggctct

SEQ ID NO: 118116 - DNA, 25 bp, E. coli
caatgtatatggatctgctggctct

SEQ ID NO: 118117 - DNA, 25 bp, E. coli
caacagacgacatccgaggaagcat

SEQ ID NO: 118118 - DNA, 25 bp, E. coli
caacagacgacaaccgaggaagcat

SEQ ID NO: 118119 - DNA, 25 bp, E. coli
catgtgcgtgcggtgaaaaatccgc

SEQ ID NO: 118120 - DNA, 25 bp, E. coli
catgtgcgtgcgctgaaaaatccgc

SEQ ID NO: 118121 - DNA, 25 bp, E. coli
ttacgtcagaaaagcgccgaaacca

SEQ ID NO: 118122 - DNA, 25 bp, E. coli
ttacgtcagaaatgcgccgaaacca

SEQ ID NO: 118123 - DNA, 25 bp, E. coli
ttattgaactggtagagcatgtgcg

SEQ ID NO: 118124 - DNA, 25 bp, E. coli
ttattgaactggaagagcatgtgcg

SEQ ID NO: 118125 - DNA, 25 bp, E. coli
ttcacgcgttagcttcagccgatcg

SEQ ID NO: 118126 - DNA, 25 bp, E. coli
ttcacgcgttaggttcagccgatcg

SEQ ID NO: 118127 - DNA, 25 bp, E. coli
gcctgattatcagcggtcacatgaa

SEQ ID NO: 118128 - DNA, 25 bp, E. coli
gcctgattatcaccggtcacatgaa

SEQ ID NO: 118129 - DNA, 25 bp, E. coli
gaagagattgagtcgcacgaaagcg

SEQ ID NO: 118130 - DNA, 25 bp, E. coli
gaagagattgagacgcacgaaagcg

SEQ ID NO: 118131 - DNA, 25 bp, E. coli
cctatcgccgttgagtttggtcgca

SEQ ID NO: 118132 - DNA, 25 bp, E. coli
cctatcgccgttcagtttggtcgca

SEQ ID NO: 118133 - DNA, 25 bp, E. coli
gatattgaaaatgcccgtgagagcg

SEQ ID NO: 118134 - DNA, 25 bp, E. coli
gatattgaaaatccccgtgagagcg

SEQ ID NO: 118135 - DNA, 25 bp, E. coli
tggagcactctatcaacccgctgaa

SEQ ID NO: 118136 - DNA, 25 bp, E. coli
tggagcactctaacaacccgctgaa

SEQ ID NO: 118137 - DNA, 25 bp, E. coli
caaactgctggcttataactgctcg

SEQ ID NO: 118138 - DNA, 25 bp, E. coli
cagcggcagttcacttcgaagatca

SEQ ID NO: 118139 - DNA, 25 bp, E. coli
cagcagctgtcggatatgggctaca

SEQ ID NO: 118140 - DNA, 25 bp, E. coli
caaactgctggcatataactgctcg

SEQ ID NO: 118141 - DNA, 25 bp, E. coli
cagcggcagttctcttcgaagatca

SEQ ID NO: 118142 - DNA, 25 bp, E. coli
cagcagctgtcgcatatgggctaca

SEQ ID NO: 118143 - DNA, 25 bp, E. coli
tacagaaagagtggactcaaccgcg

SEQ ID NO: 118144 - DNA, 25 bp, E. coli
tacagaaagagtcgactcaaccgcg

SEQ ID NO: 118145 - DNA, 25 bp, E. coli
tattcagaaactcgtcgcggcgcgt

SEQ ID NO: 118146 - DNA, 25 bp, E. coli
tattcagaaactggtcgcggcgcgt

SEQ ID NO: 118147 - DNA, 25 bp, E. coli
tgaaggcttcttccgtactcatgcg

SEQ ID NO: 118148 - DNA, 25 bp, E. coli
tgaaggcttcttgcgtactcatgcg

SEQ ID NO: 118149 - DNA, 25 bp, E. coli
cccagggcgagggtatgaagcacta

SEQ ID NO: 118150 - DNA, 25 bp, E. coli
cccagggcgaggctatgaagcacta

SEQ ID NO: 118151 - DNA, 25 bp, E. coli
cctggcaggtatgcacagcatgtgg

SEQ ID NO: 118152 - DNA, 25 bp, E. coli
cctggcaggtatccacagcatgtgg

SEQ ID NO: 118153 - DNA, 25 bp, E. coli
gatcagatccaaaggtccgcgggca

SEQ ID NO: 118154 - DNA, 25 bp, E. coli
gatcagatccaatggtccgcgggca

SEQ ID NO: 118155 - DNA, 25 bp, E. coli
gggcgatccgcggtatgtcgattac

SEQ ID NO: 118156 - DNA, 25 bp, E. coli
gggcgatccgcgctatgtcgattac

SEQ ID NO: 118157 - DNA, 25 bp, E. coli
taactgctcgccctcgttcaactgg

SEQ ID NO: 118158 - DNA, 25 bp, E. coli
taactgctcgccgtcgttcaactgg

SEQ ID NO: 118159 - DNA, 25 bp, E. coli
catgttggtaatggcctcagtgttc

SEQ ID NO: 118160 - DNA, 25 bp, E. coli
catgttggtaatcgcctcagtgttc

SEQ ID NO: 118161 - DNA, 25 bp, E. coli
ttaaaacggcttctggaaaggcagc

SEQ ID NO: 118162 - DNA, 25 bp, E. coli
ttaaaacggcttgtggaaaggcagc

SEQ ID NO: 118163 - DNA, 25 bp, E. coli
aaagcatgttggaaatggcctcagt

SEQ ID NO: 118164 - DNA, 25 bp, E. coli
aaagcatgttggtaatggcctcagt

SEQ ID NO: 118165 - DNA, 25 bp, E. coli
aacggcttgtggaaaggcagctgac

SEQ ID NO: 118166 - DNA, 25 bp, E. coli
aacggcttgtggtaaggcagctgac

SEQ ID NO: 118167 - DNA, 25 bp, E. coli
cttgtggaaagggagctgacgaaat

SEQ ID NO: 118168 - DNA, 25 bp, E. coli
cttgtggaaaggcagctgacgaaat

SEQ ID NO: 118169 - DNA, 25 bp, E. coli
gttggtaatggcgtcagtgttccgc

SEQ ID NO: 118170 - DNA, 25 bp, E. coli
ggtaatggcctcagtgttccgccag

SEQ ID NO: 118171 - DNA, 25 bp, E. coli
ggtaatggcctctgtgttccgccag

SEQ ID NO: 118172 - DNA, 25 bp, E. coli
tggaaaggcagctgacgaaatgggc

SEQ ID NO: 118173 - DNA, 25 bp, E. coli
tggcagcacccatacgcccgccagg

SEQ ID NO: 118174 - DNA, 25 bp, E. coli
tggcctcagtgtaccgccagtccgg

SEQ ID NO: 118175 - DNA, 25 bp, E. coli
tggcctcagtgttccgccagtccgg

SEQ ID NO: 118176 - DNA, 25 bp, E. coli
tggaaaggcagcagacgaaatgggc

SEQ ID NO: 118177 - DNA, 25 bp, E. coli
tggcagcacccaaacgcccgccagg

SEQ ID NO: 118178 - DNA, 25 bp, E. coli
taatggcctcagtgttccgccagtc

SEQ ID NO: 118179 - DNA, 25 bp, E. coli
taatggcctcagagttccgccagtc

SEQ ID NO: 118180 - DNA, 25 bp, E. coli
gttggtaatggcctcagtgttccgc

SEQ ID NO: 118181 - DNA, 25 bp, E. coli
aatgtattgattgtgcggtttgcca

SEQ ID NO: 118182 - DNA, 25 bp, E. coli
aatgtattgattctgcggtttgcca

SEQ ID NO: 118183 - DNA, 25 bp, E. coli
tatttttgcaatcacaccctggtcg

SEQ ID NO: 118184 - DNA, 25 bp, E. coli
tatttttgcaatgacaccctggtcg

SEQ ID NO: 118185 - DNA, 25 bp, E. coli
tttcaccactatagcgccgacgctg

SEQ ID NO: 118186 - DNA, 25 bp, E. coli
tttcaccactattgcgccgacgctg

SEQ ID NO: 118187 - DNA, 25 bp, E. coli
tgcgcgcgccaacgctttcgttttg

SEQ ID NO: 118188 - DNA, 25 bp, E. coli
tgcgcgcgccaaggctttcgttttg

SEQ ID NO: 118189 - DNA, 25 bp, E. coli
ccagtttatttgtccgcaagaggct

SEQ ID NO: 118190 - DNA, 25 bp, E. coli
ccagtttatttgaccgcaagaggct

SEQ ID NO: 118191 - DNA, 25 bp, E. coli
gcaacatgtcatgcctgtgtcgagg

SEQ ID NO: 118192 - DNA, 25 bp, E. coli
gcaacatgtcatccctgtgtcgagg

SEQ ID NO: 118193 - DNA, 25 bp, E. coli
gcaagaggctattcgtggcgttaat

SEQ ID NO: 118194 - DNA, 25 bp, E. coli
gcaagaggctatacgtggcgttaat

SEQ ID NO: 118195 - DNA, 25 bp, E. coli
ctggaagaacttttgctatggcata

SEQ ID NO: 118196 - DNA, 25 bp, E. coli
cggtcgacgcggtacaatgtattga

SEQ ID NO: 118197 - DNA, 25 bp, E. coli
ctggaagaacttatgctatggcata

SEQ ID NO: 118198 - DNA, 25 bp, E. coli
cggtcgacgcggaacaatgtattga

SEQ ID NO: 118199 - DNA, 25 bp, E. coli
taacgctgacagtagagggcatagc

SEQ ID NO: 118200 - DNA, 25 bp, E. coli
taacataacgataggcgcggaatgc

SEQ ID NO: 118201 - DNA, 25 bp, E. coli
taacataacgattggcgcggaatgc

SEQ ID NO: 118202 - DNA, 25 bp, E. coli
taacgctgacagaagagggcatagc

SEQ ID NO: 118203 - DNA, 25 bp, E. coli
taggttgctaactgcctgggccttt

SEQ ID NO: 118204 - DNA, 25 bp, E. coli
taggttgctaacagcctgggccttt

SEQ ID NO: 118205 - DNA, 25 bp, E. coli
tgggaactgcctttcgttgattgaa

SEQ ID NO: 118206 - DNA, 25 bp, E. coli
tgggaactgcctatcgttgattgaa

SEQ ID NO: 118207 - DNA, 25 bp, E. coli
tcttgccgctgacgtcggctacgcg

SEQ ID NO: 118208 - DNA, 25 bp, E. coli
tcttgccgctgaggtcggctacgcg

SEQ ID NO: 118209 - DNA, 25 bp, E. coli
tctcccacctgataacggaaagatg

SEQ ID NO: 118210 - DNA, 25 bp, E. coli
tctcccacctgaaaacggaaagatg

SEQ ID NO: 118211 - DNA, 25 bp, E. coli
gcctgaagggaaaaagcgatctgca

SEQ ID NO: 118212 - DNA, 25 bp, E. coli
gcctgaagggaataagcgatctgca

SEQ ID NO: 118213 - DNA, 25 bp, E. coli
gcgcgtgtacgtgaaatctggaaaa

SEQ ID NO: 118214 - DNA, 25 bp, E. coli
gcgcgtgtacgtcaaatctggaaaa

SEQ ID NO: 118215 - DNA, 25 bp, E. coli
gctacgcgcgcgtttgtccgaaaat

SEQ ID NO: 118216 - DNA, 25 bp, E. coli
gctacgcgcgcgattgtccgaaaat

SEQ ID NO: 118217 - DNA, 25 bp, E. coli
gaattaaacaaaaatgcctgaaggg

SEQ ID NO: 118218 - DNA, 25 bp, E. coli
gaattaaacaaatatgcctgaaggg

SEQ ID NO: 118219 - DNA, 25 bp, E. coli
gtaaagccacttcccaccgtttcat

SEQ ID NO: 118220 - DNA, 25 bp, E. coli
gtaaagccacttgccaccgtttcat

SEQ ID NO: 118221 - DNA, 25 bp, E. coli
ggaaatgaccgcgagtcttgccgct

SEQ ID NO: 118222 - DNA, 25 bp, E. coli
ggaaatgaccgccagtcttgccgct

SEQ ID NO: 118223 - DNA, 25 bp, E. coli
taatcaattgtgcaacgtcggcggc

SEQ ID NO: 118224 - DNA, 25 bp, E. coli
taatcaattgtggaacgtcggcggc

SEQ ID NO: 118225 - DNA, 25 bp, E. coli
caaaaaatcgttttgctgccgtata

SEQ ID NO: 118226 - DNA, 25 bp, E. coli
caaaaaatcgttatgctgccgtata

SEQ ID NO: 118227 - DNA, 25 bp, E. coli
atgcgttgcgccatgctacgccgcg

SEQ ID NO: 118228 - DNA, 25 bp, E. coli
atgcgttgcgccttgctacgccgcg

SEQ ID NO: 118229 - DNA, 25 bp, E. coli
tagagtatggtcgagttaaacctgc

SEQ ID NO: 118230 - DNA, 25 bp, E. coli
tagagtatggtccagttaaacctgc

SEQ ID NO: 118231 - DNA, 25 bp, E. coli
ttttcaaatagcgatgcgttgcgcc

SEQ ID NO: 118232 - DNA, 25 bp, E. coli
ttttcaaatagccatgcgttgcgcc

SEQ ID NO: 118233 - DNA, 25 bp, E. coli
tgacgacaacattaaccaagagatt

SEQ ID NO: 118234 - DNA, 25 bp, E. coli
tgctctttcaaccttaactcacgat

SEQ ID NO: 118235 - DNA, 25 bp, E. coli
tgacgacaacataaaccaagagatt

SEQ ID NO: 118236 - DNA, 25 bp, E. coli
tgctctttcaacgttaactcacgat

SEQ ID NO: 118237 - DNA, 25 bp, E. coli
gccgcgccacacagcgagtatagag

SEQ ID NO: 118238 - DNA, 25 bp, E. coli
gccgcgccacactgcgagtatagag

SEQ ID NO: 118239 - DNA, 25 bp, E. coli
cggcatgagcctcacgacaacataa

SEQ ID NO: 118240 - DNA, 25 bp, E. coli
cggcatgagcctgacgacaacataa

SEQ ID NO: 118241 - DNA, 25 bp, E. coli
gtttacatgacatatatgaatgcgt

SEQ ID NO: 118242 - DNA, 25 bp, E. coli
gtttacatgacaaatatgaatgcgt

SEQ ID NO: 118243 - DNA, 25 bp, E. coli
ggtcgagttaaagctgctctttcaa

SEQ ID NO: 118244 - DNA, 25 bp, E. coli
ggtcgagttaaacctgctctttcaa

SEQ ID NO: 118245 - DNA, 25 bp, E. coli
taactcacgattacttaagcaaaaa

SEQ ID NO: 118246 - DNA, 25 bp, E. coli
taactcacgatttcttaagcaaaaa

SEQ ID NO: 118247 - DNA, 25 bp, E. coli
cagtaatcccatgacagagacagaa

SEQ ID NO: 118248 - DNA, 25 bp, E. coli
cagtaatcccatcacagagacagaa

SEQ ID NO: 118249 - DNA, 25 bp, E. coli
ttaccgtgtcgctctgacagaggcg

SEQ ID NO: 118250 - DNA, 25 bp, E. coli
ttaccgtgtcgcactgacagaggcg

SEQ ID NO: 118251 - DNA, 25 bp, E. coli
tgtgtgccacatgttaccgggcgtc

SEQ ID NO: 118252 - DNA, 25 bp, E. coli
tgtcgcactgactgaggcgcagcct

SEQ ID NO: 118253 - DNA, 25 bp, E. coli
tgtgtgccacatcttaccgggcgtc

SEQ ID NO: 118254 - DNA, 25 bp, E. coli
tgtcgcactgacagaggcgcagcct

SEQ ID NO: 118255 - DNA, 25 bp, E. coli
tcgcagtaatccgatgacagagaca

SEQ ID NO: 118256 - DNA, 25 bp, E. coli
tgccacatcttagcgggcgtcgctt

SEQ ID NO: 118257 - DNA, 25 bp, E. coli
tgccacatcttaccgggcgtcgctt

SEQ ID NO: 118258 - DNA, 25 bp, E. coli
tcgcagtaatcccatgacagagaca

SEQ ID NO: 118259 - DNA, 25 bp, E. coli
tctatcttggcattatggaggcgac

SEQ ID NO: 118260 - DNA, 25 bp, E. coli
tctatcttggcaatatggaggcgac

SEQ ID NO: 118261 - DNA, 25 bp, E. coli
gaatctctatctaggcaatatggag

SEQ ID NO: 118262 - DNA, 25 bp, E. coli
gaatctctatcttggcaatatggag

SEQ ID NO: 118263 - DNA, 25 bp, E. coli
gactggtttttagcgtgtcgcactg

SEQ ID NO: 118264 - DNA, 25 bp, E. coli
gactggtttttaccgtgtcgcactg

SEQ ID NO: 118265 - DNA, 25 bp, E. coli
ggtttttaccgtctcgcactgacag

SEQ ID NO: 118266 - DNA, 25 bp, E. coli
ggtttttaccgtgtcgcactgacag

SEQ ID NO: 118267 - DNA, 25 bp, E. coli
gaggcgcagcctggcgacgtgctgc

SEQ ID NO: 118268 - DNA, 25 bp, E. coli
gaggcgcagcctcgcgacgtgctgc

SEQ ID NO: 118269 - DNA, 25 bp, E. coli
aagtccataactggctggcgctgca

SEQ ID NO: 118270 - DNA, 25 bp, E. coli
aagtccataactcgctggcgctgca

SEQ ID NO: 118271 - DNA, 25 bp, E. coli
cagccggtgtttttggatctcgcca

SEQ ID NO: 118272 - DNA, 25 bp, E. coli
cagccggtgtttatggatctcgcca

SEQ ID NO: 118273 - DNA, 25 bp, E. coli
tacatccctggctttaaagcggcgc

SEQ ID NO: 118274 - DNA, 25 bp, E. coli
tacatccctggcattaaagcggcgc

SEQ ID NO: 118275 - DNA, 25 bp, E. coli
taactacgaaaaggtcatcgcggcg

SEQ ID NO: 118276 - DNA, 25 bp, E. coli
aaagtgtgctcgaagatcctcgacg

SEQ ID NO: 118277 - DNA, 25 bp, E. coli
aacaacggtttgtgtattcgccaca

SEQ ID NO: 118278 - DNA, 25 bp, E. coli
aacaacggtttgagtattcgccaca

SEQ ID NO: 118279 - DNA, 25 bp, E. coli
aaagtgtgctcgtagatcctcgacg

SEQ ID NO: 118280 - DNA, 25 bp, E. coli
ttgaaattgagtccgaacgcgtggc

SEQ ID NO: 118281 - DNA, 25 bp, E. coli
ttgaaattgagtgcgaacgcgtggc

SEQ ID NO: 118282 - DNA, 25 bp, E. coli
tgacagaggtgtttgcgcgcattaa

SEQ ID NO: 118283 - DNA, 25 bp, E. coli
tgacagaggtgtatgcgcgcattaa

SEQ ID NO: 118284 - DNA, 25 bp, E. coli
gcggcaaaatgatcctcgggtcaga

SEQ ID NO: 118285 - DNA, 25 bp, E. coli
gcggcaaaatgaacctcgggtcaga

SEQ ID NO: 118286 - DNA, 25 bp, E. coli
ggtaaagccaaactctcgctgctgg

SEQ ID NO: 118287 - DNA, 25 bp, E. coli
ggtaaagccaaagtctcgctgctgg

SEQ ID NO: 118288 - DNA, 25 bp, E. coli
ggcgatacgccattcaacaacggtt

SEQ ID NO: 118289 - DNA, 25 bp, E. coli
ggcgatacgccaatcaacaacggtt

SEQ ID NO: 118290 - DNA, 25 bp, E. coli
taactacgaaaacgtcatcgcggcg

SEQ ID NO: 118291 - DNA, 25 bp, E. coli
caacgttttacagcatccctgatgg

SEQ ID NO: 118292 - DNA, 25 bp, E. coli
caacgttttacaccatccctgatgg

SEQ ID NO: 118293 - DNA, 25 bp, E. coli
tactggccgttatacgaagttttcg

SEQ ID NO: 118294 - DNA, 25 bp, E. coli
tacatgctgccgatgagcggatggc

SEQ ID NO: 118295 - DNA, 25 bp, E. coli
tactggccgttaaacgaagttttcg

SEQ ID NO: 118296 - DNA, 25 bp, E. coli
tacatgctgccgttgagcggatggc

SEQ ID NO: 118297 - DNA, 25 bp, E. coli
agggcttatcactccgccatgttgg

SEQ ID NO: 118298 - DNA, 25 bp, E. coli
agggcttatcacaccgccatgttgg

SEQ ID NO: 118299 - DNA, 25 bp, E. coli
aaaatgcccgtgttgcttacacccg

SEQ ID NO: 118300 - DNA, 25 bp, E. coli
aaaatgcccgtgatgcttacacccg

SEQ ID NO: 118301 - DNA, 25 bp, E. coli
tgttgcctcgcaaccggaagaacgc

SEQ ID NO: 118302 - DNA, 25 bp, E. coli
tgttgcctcgcatccggaagaacgc

SEQ ID NO: 118303 - DNA, 25 bp, E. coli
gaattttttgatccggctgaaagca

SEQ ID NO: 118304 - DNA, 25 bp, E. coli
gaattttttgatgcggctgaaagca

SEQ ID NO: 118305 - DNA, 25 bp, E. coli
gaaagcaaggtctatcgccatccaa

SEQ ID NO: 118306 - DNA, 25 bp, E. coli
gaaagcaaggtcaatcgccatccaa

SEQ ID NO: 118307 - DNA, 25 bp, E. coli
ccctgatggcattgagcacatgtga

SEQ ID NO: 118308 - DNA, 25 bp, E. coli
ccctgatggcatagagcacatgtga

SEQ ID NO: 118309 - DNA, 25 bp, E. coli
cttacacccgtcctagcgaaggatg

SEQ ID NO: 118310 - DNA, 25 bp, E. coli
cgtgcgtggcaaacagggcttatca

SEQ ID NO: 118311 - DNA, 25 bp, E. coli
cgtgcgtggcaatcagggcttatca

SEQ ID NO: 118312 - DNA, 25 bp, E. coli
cttacacccgtcgtagcgaaggatg

SEQ ID NO: 118313 - DNA, 25 bp, E. coli
caagatgtttacgacgaactggagc

SEQ ID NO: 118314 - DNA, 25 bp, E. coli
caagatgtttaccacgaactggagc

SEQ ID NO: 118315 - DNA, 25 bp, E. coli
taaagggaaataacagcccgtcggc

SEQ ID NO: 118316 - DNA, 25 bp, E. coli
taaagaatcgactgggcagtgcggt

SEQ ID NO: 118317 - DNA, 25 bp, E. coli
taaagaatcgacagggcagtgcggt

SEQ ID NO: 118318 - DNA, 25 bp, E. coli
taaagggaaatatcagcccgtcggc

SEQ ID NO: 118319 - DNA, 25 bp, E. coli
tttattatgggtcgcgaatcgtctc

SEQ ID NO: 118320 - DNA, 25 bp, E. coli
tttattatgggtggcgaatcgtctc

SEQ ID NO: 118321 - DNA, 25 bp, E. coli
tccgatgcattaaggctggaccagg

SEQ ID NO: 118322 - DNA, 25 bp, E. coli
tccgatgcattatggctggaccagg

SEQ ID NO: 118323 - DNA, 25 bp, E. coli
tcagatggagctggcgttacgcacc

SEQ ID NO: 118324 - DNA, 25 bp, E. coli
tcagatggagctcgcgttacgcacc

SEQ ID NO: 118325 - DNA, 25 bp, E. coli
gccattgtgcgaaggcatgatcctg

SEQ ID NO: 118326 - DNA, 25 bp, E. coli
gccattgtgcgatggcatgatcctg

SEQ ID NO: 118327 - DNA, 25 bp, E. coli
gcccgtcggcggtactgttttatga

SEQ ID NO: 118328 - DNA, 25 bp, E. coli
gcccgtcggcggaactgttttatga

SEQ ID NO: 118329 - DNA, 25 bp, E. coli
gaatcgtctcgaattgccgctgctg

SEQ ID NO: 118330 - DNA, 25 bp, E. coli
gaatcgtctcgatttgccgctgctg

SEQ ID NO: 118331 - DNA, 25 bp, E. coli
cgcattgaatgtccggatggcgaaa

SEQ ID NO: 118332 - DNA, 25 bp, E. coli
cgcattgaatgtgcggatggcgaaa

SEQ ID NO: 118333 - DNA, 25 bp, E. coli
gttgaacagtgtgcggaagacccga

SEQ ID NO: 118334 - DNA, 25 bp, E. coli
gttgaacagtgtccggaagacccga

SEQ ID NO: 118335 - DNA, 25 bp, E. coli
cagctattggcaagcgggttcaaag

SEQ ID NO: 118336 - DNA, 25 bp, E. coli
cagctattggcatgcgggttcaaag

SEQ ID NO: 118337 - DNA, 25 bp, E. coli
catgttaatggtctggcaatcgaca

SEQ ID NO: 118338 - DNA, 25 bp, E. coli
catgttaatggtgtggcaatcgaca

SEQ ID NO: 118339 - DNA, 25 bp, E. coli
taaattagaagccaaggatgtactc

SEQ ID NO: 118340 - DNA, 25 bp, E. coli
taaattagaagcgaaggatgtactc

SEQ ID NO: 118341 - DNA, 25 bp, E. coli
tatcgagatcatgacagctattggc

SEQ ID NO: 118342 - DNA, 25 bp, E. coli
tatggagcgaaacaaatctatccgt

SEQ ID NO: 118343 - DNA, 25 bp, E. coli
tatggagcgaaagaaatctatccgt

SEQ ID NO: 118344 - DNA, 25 bp, E. coli
tatcgagatcatcacagctattggc

SEQ ID NO: 118345 - DNA, 25 bp, E. coli
taattgctgcgtaaagggctaaact

SEQ ID NO: 118346 - DNA, 25 bp, E. coli
taattgctgcgttaagggctaaact

SEQ ID NO: 118347 - DNA, 25 bp, E. coli
gaaaacttggcttttattggcgaac

SEQ ID NO: 118348 - DNA, 25 bp, E. coli
gaaaacttggctattattggcgaac

SEQ ID NO: 118349 - DNA, 25 bp, E. coli
gatattgcacctttgcgctcaccgt

SEQ ID NO: 118350 - DNA, 25 bp, E. coli
gatattgcacctatgcgctcaccgt

SEQ ID NO: 118351 - DNA, 25 bp, E. coli
ggctgatgtttaaagactaaccgga

SEQ ID NO: 118352 - DNA, 25 bp, E. coli
ggctgatgtttatagactaaccgga

SEQ ID NO: 118353 - DNA, 25 bp, E. coli
tcaacgaaaattgcttgctctggct

SEQ ID NO: 118354 - DNA, 25 bp, E. coli
tcaacgaaaattccttgctctggct

SEQ ID NO: 118355 - DNA, 25 bp, E. coli
tcaaagctgagatggaacaatactc

SEQ ID NO: 118356 - DNA, 25 bp, E. coli
tcaaagctgagaaggaacaatactc

SEQ ID NO: 118357 - DNA, 25 bp, E. coli
cattaacccattgaacagaactgtg

SEQ ID NO: 118358 - DNA, 25 bp, E. coli
cattaacccattcaacagaactgtg

SEQ ID NO: 118359 - DNA, 25 bp, E. coli
ttattcctccccttctggtgttacc

SEQ ID NO: 118360 - DNA, 25 bp, E. coli
ttattcctccccatctggtgttacc

SEQ ID NO: 118361 - DNA, 25 bp, E. coli
tgcccattaaccgattcaacagaac

SEQ ID NO: 118362 - DNA, 25 bp, E. coli
tgcccattaacccattcaacagaac

SEQ ID NO: 118363 - DNA, 25 bp, E. coli
tcttattattcctccccatctggtg

SEQ ID NO: 118364 - DNA, 25 bp, E. coli
tcagatggaataactgtcacattgc

SEQ ID NO: 118365 - DNA, 25 bp, E. coli
tcagatggaatatctgtcacattgc

SEQ ID NO: 118366 - DNA, 25 bp, E. coli
tcttattattccaccccatctggtg

SEQ ID NO: 118367 - DNA, 25 bp, E. coli
ccataattctttttatcagatggaa

SEQ ID NO: 118368 - DNA, 25 bp, E. coli
ccataattctttatatcagatggaa

SEQ ID NO: 118369 - DNA, 25 bp, E. coli
gcttcctgggagtgattttttctta

SEQ ID NO: 118370 - DNA, 25 bp, E. coli
gcttttcaacgaaagcttcctggga

SEQ ID NO: 118371 - DNA, 25 bp, E. coli
gcttttcaacgatagcttcctggga

SEQ ID NO: 118372 - DNA, 25 bp, E. coli
gcttcctgggagagattttttctta

SEQ ID NO: 118373 - DNA, 25 bp, E. coli
ctggtgttacccacctgcccattaa

SEQ ID NO: 118374 - DNA, 25 bp, E. coli
ctggtgttaccctcctgcccattaa

SEQ ID NO: 118375 - DNA, 25 bp, E. coli
tgtcacattgctattcaacgatagc

SEQ ID NO: 118376 - DNA, 25 bp, E. coli
tgtcacattgcttttcaacgatagc

SEQ ID NO: 118377 - DNA, 25 bp, E. coli
tcaacgatagctacctgggagagat

SEQ ID NO: 118378 - DNA, 25 bp, E. coli
tcaacgatagcttcctgggagagat

SEQ ID NO: 118379 - DNA, 25 bp, E. coli
catagcgccatggtgctgcaagcgg

SEQ ID NO: 118380 - DNA, 25 bp, E. coli
catagcgccatgctgctgcaagcgg

SEQ ID NO: 118381 - DNA, 25 bp, E. coli
taaaatagccgcctttcgccaatgg

SEQ ID NO: 118382 - DNA, 25 bp, E. coli
tacgagtttttgttgccgcagcacg

SEQ ID NO: 118383 - DNA, 25 bp, E. coli
tacgagtttttgatgccgcagcacg

SEQ ID NO: 118384 - DNA, 25 bp, E. coli
taaaatagccgcgtttcgccaatgg

SEQ ID NO: 118385 - DNA, 25 bp, E. coli
tgatcgtcaggaagataagctggcg

SEQ ID NO: 118386 - DNA, 25 bp, E. coli
tgatcgtcaggatgataagctggcg

SEQ ID NO: 118387 - DNA, 25 bp, E. coli
tgctgactggcgtaaaacccttgaa

SEQ ID NO: 118388 - DNA, 25 bp, E. coli
tgctgactggcgaaaaacccttgaa

SEQ ID NO: 118389 - DNA, 25 bp, E. coli
tcatatcaacgtacagcaagggcca

SEQ ID NO: 118390 - DNA, 25 bp, E. coli
tcatatcaacgttcagcaagggcca

SEQ ID NO: 118391 - DNA, 25 bp, E. coli
ccaatggatcctcgcgaaagccgct

SEQ ID NO: 118392 - DNA, 25 bp, E. coli
ccaatggatcctggcgaaagccgct

SEQ ID NO: 118393 - DNA, 25 bp, E. coli
gaattgacgttcgaatccaggcggt

SEQ ID NO: 118394 - DNA, 25 bp, E. coli
gaattgacgttccaatccaggcggt

SEQ ID NO: 118395 - DNA, 25 bp, E. coli
cgcaattaaccgtagcgacgcgtaa

SEQ ID NO: 118396 - DNA, 25 bp, E. coli
cgcaattaaccgaagcgacgcgtaa

SEQ ID NO: 118397 - DNA, 25 bp, E. coli
ctgaccgaggaacggcaaagctatt

SEQ ID NO: 118398 - DNA, 25 bp, E. coli
ctgaccgaggaagggcaaagctatt

SEQ ID NO: 118399 - DNA, 25 bp, E. coli
taatcgttcactgctgctgaccgag

SEQ ID NO: 118400 - DNA, 25 bp, E. coli
taatcgttcactcctgctgaccgag

SEQ ID NO: 118401 - DNA, 25 bp, E. coli
aacccgtttgctcgtcagtgaccca

SEQ ID NO: 118402 - DNA, 25 bp, E. coli
catcagcagcagtttcgtgaacgac

SEQ ID NO: 118403 - DNA, 25 bp, E. coli
catcagcagcagattcgtgaacgac

SEQ ID NO: 118404 - DNA, 25 bp, E. coli
aaactggcgtcgatgctggatcccg

SEQ ID NO: 118405 - DNA, 25 bp, E. coli
aacccgtttgctggtcagtgaccca

SEQ ID NO: 118406 - DNA, 25 bp, E. coli
aaactggcgtcgttgctggatcccg

SEQ ID NO: 118407 - DNA, 25 bp, E. coli
tataacgcctggacgttgcctgggc

SEQ ID NO: 118408 - DNA, 25 bp, E. coli
tataacgcctggtcgttgcctgggc

SEQ ID NO: 118409 - DNA, 25 bp, E. coli
tgcagcttcagagatggacgaacgg

SEQ ID NO: 118410 - DNA, 25 bp, E. coli
tgcagcttcagacatggacgaacgg

SEQ ID NO: 118411 - DNA, 25 bp, E. coli
tgagtggttttcagcccgttgtcgc

SEQ ID NO: 118412 - DNA, 25 bp, E. coli
tgagtggttttctgcccgttgtcgc

SEQ ID NO: 118413 - DNA, 25 bp, E. coli
gctggaaggaaaaggcgttaacgca

SEQ ID NO: 118414 - DNA, 25 bp, E. coli
gctgcaaaaaatcgatcaccgccag

SEQ ID NO: 118415 - DNA, 25 bp, E. coli
gctgcaaaaaatggatcaccgccag

SEQ ID NO: 118416 - DNA, 25 bp, E. coli
gctggaaggaaatggcgttaacgca

SEQ ID NO: 118417 - DNA, 25 bp, E. coli
cgtgaacgactgttgcaggaacttc

SEQ ID NO: 118418 - DNA, 25 bp, E. coli
cgtgaacgactgatgcaggaacttc

SEQ ID NO: 118419 - DNA, 25 bp, E. coli
gatgccacgactgtgttcagcgcag

SEQ ID NO: 118420 - DNA, 25 bp, E. coli
gagcaaatttttacccgctggcgtg

SEQ ID NO: 118421 - DNA, 25 bp, E. coli
gatgccacgactctgttcagcgcag

SEQ ID NO: 118422 - DNA, 25 bp, E. coli
gagcaaattttttcccgctggcgtg

SEQ ID NO: 118423 - DNA, 25 bp, E. coli
agaatatattctcctggcgcgcgcc

SEQ ID NO: 118424 - DNA, 25 bp, E. coli
agaatatattctgctggcgcgcgcc

SEQ ID NO: 118425 - DNA, 25 bp, E. coli
taggattggatcagccgttagccgt

SEQ ID NO: 118426 - DNA, 25 bp, E. coli
tacctgatgaatctggcacacggcg

SEQ ID NO: 118427 - DNA, 25 bp, E. coli
taggattggatctgccgttagccgt

SEQ ID NO: 118428 - DNA, 25 bp, E. coli
tacctgatgaatgtggcacacggcg

SEQ ID NO: 118429 - DNA, 25 bp, E. coli
tattgggcgctacctcactacagcg

SEQ ID NO: 118430 - DNA, 25 bp, E. coli
tatacatcaatggtggaaggcgcgg

SEQ ID NO: 118431 - DNA, 25 bp, E. coli
tattgggcgctagctcactacagcg

SEQ ID NO: 118432 - DNA, 25 bp, E. coli
tatacatcaatgctggaaggcgcgg

SEQ ID NO: 118433 - DNA, 25 bp, E. coli
tgttctacgccagactgcaatggag

SEQ ID NO: 118434 - DNA, 25 bp, E. coli
tgttctacgccacactgcaatggag

SEQ ID NO: 118435 - DNA, 25 bp, E. coli
ccaaaggagccaccgagatgacaat

SEQ ID NO: 118436 - DNA, 25 bp, E. coli
ccaaaggagccagcgagatgacaat

SEQ ID NO: 118437 - DNA, 25 bp, E. coli
ccattgaactggcaacgttggcgct

SEQ ID NO: 118438 - DNA, 25 bp, E. coli
ccattgaactgggaacgttggcgct

SEQ ID NO: 118439 - DNA, 25 bp, E. coli
gaaaccgtctttacatggccaggta

SEQ ID NO: 118440 - DNA, 25 bp, E. coli
gacttgctatcaccattcccggcga

SEQ ID NO: 118441 - DNA, 25 bp, E. coli
gacttgctatcagcattcccggcga

SEQ ID NO: 118442 - DNA, 25 bp, E. coli
gaaaccgtcttttcatggccaggta

SEQ ID NO: 118443 - DNA, 25 bp, E. coli
taacttaaccgacctgctggtccgg

SEQ ID NO: 118444 - DNA, 25 bp, E. coli
taacttaaccgagctgctggtccgg

SEQ ID NO: 118445 - DNA, 25 bp, E. coli
caatcgttgaagttcgccgtgagga

SEQ ID NO: 118446 - DNA, 25 bp, E. coli
aatattcgtacagttcgcgcacagg

SEQ ID NO: 118447 - DNA, 25 bp, E. coli
caatcgttgaagatcgccgtgagga

SEQ ID NO: 118448 - DNA, 25 bp, E. coli
aatattcgtacacttcgcgcacagg

SEQ ID NO: 118449 - DNA, 25 bp, E. coli
caggctcgtgaatcagatctggcaa

SEQ ID NO: 118450 - DNA, 25 bp, E. coli
cagggccgtactcctaaagcaatcg

SEQ ID NO: 118451 - DNA, 25 bp, E. coli
cagggccgtactgctaaagcaatcg

SEQ ID NO: 118452 - DNA, 25 bp, E. coli
caggctcgtgaaacagatctggcaa

SEQ ID NO: 118453 - DNA, 25 bp, E. coli
taaagaacaagatgaacgtcaggct

SEQ ID NO: 118454 - DNA, 25 bp, E. coli
taaagaacaagaagaacgtcaggct

SEQ ID NO: 118455 - DNA, 25 bp, E. coli
tagaagacggtatcgatcctacaga

SEQ ID NO: 118456 - DNA, 25 bp, E. coli
tagaagacggtaacgatcctacaga

SEQ ID NO: 118457 - DNA, 25 bp, E. coli
tgaagctcttaacgcactgaacaat

SEQ ID NO: 118458 - DNA, 25 bp, E. coli
tgaagctcttaaggcactgaacaat

SEQ ID NO: 118459 - DNA, 25 bp, E. coli
gctatcgaagctcgtaagacactgg

SEQ ID NO: 118460 - DNA, 25 bp, E. coli
gctatcgaagctggtaagacactgg

SEQ ID NO: 118461 - DNA, 25 bp, E. coli
gaagagatgctggaaaaactcacca

SEQ ID NO: 118462 - DNA, 25 bp, E. coli
gaagccttccgcgagaaattgttag

SEQ ID NO: 118463 - DNA, 25 bp, E. coli
gaagagatgctgcaaaaactcacca

SEQ ID NO: 118464 - DNA, 25 bp, E. coli
gaagccttccgccagaaattgttag

SEQ ID NO: 118465 - DNA, 25 bp, E. coli
taatgagcagacatggacgggtcag

SEQ ID NO: 118466 - DNA, 25 bp, E. coli
taatgagcagacttggacgggtcag

SEQ ID NO: 118467 - DNA, 25 bp, E. coli
cacattcccctggtttttgtggctg

SEQ ID NO: 118468 - DNA, 25 bp, E. coli
cacattcccctgctttttgtggctg

SEQ ID NO: 118469 - DNA, 25 bp, E. coli
caatatttgtttgtttgacccgata

SEQ ID NO: 118470 - DNA, 25 bp, E. coli
caatatttgtttctttgacccgata

SEQ ID NO: 118471 - DNA, 25 bp, E. coli
tttcgatgaattcagaatagcaacg

SEQ ID NO: 118472 - DNA, 25 bp, E. coli
tttcgatgaattgagaatagcaacg

SEQ ID NO: 118473 - DNA, 25 bp, E. coli
tgtggctgttttggatgaattgaga

SEQ ID NO: 118474 - DNA, 25 bp, E. coli
tgtgcggtagtggaatatttgtttc

SEQ ID NO: 118475 - DNA, 25 bp, E. coli
tgtgcggtagtgcaatatttgtttc

SEQ ID NO: 118476 - DNA, 25 bp, E. coli
tgtggctgttttcgatgaattgaga

SEQ ID NO: 118477 - DNA, 25 bp, E. coli
tgagaatagcaacgataatctgata

SEQ ID NO: 118478 - DNA, 25 bp, E. coli
tgaattgagaattgcaacgataatc

SEQ ID NO: 118479 - DNA, 25 bp, E. coli
tgagaatagcaaggataatctgata

SEQ ID NO: 118480 - DNA, 25 bp, E. coli
tgaattgagaatagcaacgataatc

SEQ ID NO: 118481 - DNA, 25 bp, E. coli
tctgataaaagatcccgcttaaatt

SEQ ID NO: 118482 - DNA, 25 bp, E. coli
tctgataaaagaacccgcttaaatt

SEQ ID NO: 118483 - DNA, 25 bp, E. coli
cctggtttttgtcgctgttttcgat

SEQ ID NO: 118484 - DNA, 25 bp, E. coli
cctggtttttgtggctgttttcgat

SEQ ID NO: 118485 - DNA, 25 bp, E. coli
gcaacgataatcagataaaagaacc

SEQ ID NO: 118486 - DNA, 25 bp, E. coli
gcaacgataatctgataaaagaacc

SEQ ID NO: 118487 - DNA, 25 bp, E. coli
gataatctgataaaagaacccgctt

SEQ ID NO: 118488 - DNA, 25 bp, E. coli
gataatctgatataagaacccgctt

SEQ ID NO: 118489 - DNA, 25 bp, E. coli
aatgctgcatggctttcgaaccctg

SEQ ID NO: 118490 - DNA, 25 bp, E. coli
aatgctgcatgggtttcgaaccctg

SEQ ID NO: 118491 - DNA, 25 bp, E. coli
cagaacaggtcaagcaatttggcgc

SEQ ID NO: 118492 - DNA, 25 bp, E. coli
catcaataccggatgcagcaggcaa

SEQ ID NO: 118493 - DNA, 25 bp, E. coli
cagaacaggtcatgcaatttggcgc

SEQ ID NO: 118494 - DNA, 25 bp, E. coli
catcaataccggttgcagcaggcaa

SEQ ID NO: 118495 - DNA, 25 bp, E. coli
tacctgaatgttcggactggcgaag

SEQ ID NO: 118496 - DNA, 25 bp, E. coli
taaaggcttaacacccgatggagat

SEQ ID NO: 118497 - DNA, 25 bp, E. coli
taaaggcttaactcccgatggagat

SEQ ID NO: 118498 - DNA, 25 bp, E. coli
tacctgaatgttgggactggcgaag

SEQ ID NO: 118499 - DNA, 25 bp, E. coli
aaagcacattgcacctgccggatag

SEQ ID NO: 118500 - DNA, 25 bp, E. coli
aaagcacattgctcctgccggatag

SEQ ID NO: 118501 - DNA, 25 bp, E. coli
tatttgttgggcaatctggcagcgc

SEQ ID NO: 118502 - DNA, 25 bp, E. coli
tatttgttgggctatctggcagcgc

SEQ ID NO: 118503 - DNA, 25 bp, E. coli
tgtgtggcgctcgaaaacgcaacgc

SEQ ID NO: 118504 - DNA, 25 bp, E. coli
tgtgtggcgctccaaaacgcaacgc

SEQ ID NO: 118505 - DNA, 25 bp, E. coli
tctgtattcagaggcgggaacattc

SEQ ID NO: 118506 - DNA, 25 bp, E. coli
tctgtattcagacgcgggaacattc

SEQ ID NO: 118507 - DNA, 25 bp, E. coli
cgtcattatctggagcgtgcgcttc

SEQ ID NO: 118508 - DNA, 25 bp, E. coli
cgtcattatctgcagcgtgcgcttc

SEQ ID NO: 118509 - DNA, 25 bp, E. coli
gatagcctcacgcaccagggattag

SEQ ID NO: 118510 - DNA, 25 bp, E. coli
gatagcctcacggaccagggattag

SEQ ID NO: 118511 - DNA, 25 bp, E. coli
caattaactattagccggatgcggc

SEQ ID NO: 118512 - DNA, 25 bp, E. coli
caataagtgccgaatgcgacctaca

SEQ ID NO: 118513 - DNA, 25 bp, E. coli
caataagtgccggatgctgcgaaaa

SEQ ID NO: 118514 - DNA, 25 bp, E. coli
caataagtgccgtatgcgacctaca

SEQ ID NO: 118515 - DNA, 25 bp, E. coli
caattaactatttgccggatgcggc

SEQ ID NO: 118516 - DNA, 25 bp, E. coli
caataagtgccgcatgctgcgaaaa

SEQ ID NO: 118517 - DNA, 25 bp, E. coli
catcgcatccgagaataagtgccgg

SEQ ID NO: 118518 - DNA, 25 bp, E. coli
catcgcatccgacaataagtgccgg

SEQ ID NO: 118519 - DNA, 25 bp, E. coli
ttcgatgcgattagtaggtcggata

SEQ ID NO: 118520 - DNA, 25 bp, E. coli
ttatctggcctacagattcgatgcg

SEQ ID NO: 118521 - DNA, 25 bp, E. coli
ttcgatgcgatttgtaggtcggata

SEQ ID NO: 118522 - DNA, 25 bp, E. coli
ttatctggcctagagattcgatgcg

SEQ ID NO: 118523 - DNA, 25 bp, E. coli
tccggcctacggatcgatgcgattt

SEQ ID NO: 118524 - DNA, 25 bp, E. coli
tccggcctacggttcgatgcgattt

SEQ ID NO: 118525 - DNA, 25 bp, E. coli
tgcgacctacatacacatggcgctt

SEQ ID NO: 118526 - DNA, 25 bp, E. coli
tgcgacctacattcacatggcgctt

SEQ ID NO: 118527 - DNA, 25 bp, E. coli
gcatcgcatccgtcaataagtgccg

SEQ ID NO: 118528 - DNA, 25 bp, E. coli
gcatcgcatccgacaataagtgccg

SEQ ID NO: 118529 - DNA, 25 bp, E. coli
gattcgatgcgattcgtaggtcgga

SEQ ID NO: 118530 - DNA, 25 bp, E. coli
gattcgatgcgaatcgtaggtcgga

SEQ ID NO: 118531 - DNA, 25 bp, E. coli
gatgctgcgaaattgccttatctgg

SEQ ID NO: 118532 - DNA, 25 bp, E. coli
gatgctgcgaaaatgccttatctgg

SEQ ID NO: 118533 - DNA, 25 bp, E. coli
caaagggcgactcattatcgacggt

SEQ ID NO: 118534 - DNA, 25 bp, E. coli
caaagggcgactgattatcgacggt

SEQ ID NO: 118535 - DNA, 25 bp, E. coli
agcgcagggctaagatgttatctac

SEQ ID NO: 118536 - DNA, 25 bp, E. coli
agcgcagggctatgatgttatctac

SEQ ID NO: 118537 - DNA, 25 bp, E. coli
tctcacgggagaaacattgcctgcc

SEQ ID NO: 118538 - DNA, 25 bp, E. coli
tcttttttgctcaggccaaagggcg

SEQ ID NO: 118539 - DNA, 25 bp, E. coli
tcttttttgctctggccaaagggcg

SEQ ID NO: 118540 - DNA, 25 bp, E. coli
tctcacgggagatacattgcctgcc

SEQ ID NO: 118541 - DNA, 25 bp, E. coli
tccttttggttaccgacggacaacg

SEQ ID NO: 118542 - DNA, 25 bp, E. coli
cctggtttgcgactcatgatcctga

SEQ ID NO: 118543 - DNA, 25 bp, E. coli
cctggtttgcgagtcatgatcctga

SEQ ID NO: 118544 - DNA, 25 bp, E. coli
tccttttggttagcgacggacaacg

SEQ ID NO: 118545 - DNA, 25 bp, E. coli
gcaaaaagcgctacgccggactgat

SEQ ID NO: 118546 - DNA, 25 bp, E. coli
gcaaaaagcgcttcgccggactgat

SEQ ID NO: 118547 - DNA, 25 bp, E. coli
cgatgaagccaaacgtcagagtaat

SEQ ID NO: 118548 - DNA, 25 bp, E. coli
cgtttcttcgatgcacgcctggcat

SEQ ID NO: 118549 - DNA, 25 bp, E. coli
cgatgaagccaatcgtcagagtaat

SEQ ID NO: 118550 - DNA, 25 bp, E. coli
cgtttcttcgatccacgcctggcat

SEQ ID NO: 118551 - DNA, 25 bp, E. coli
ggcgaactggacacgcagctggttt

SEQ ID NO: 118552 - DNA, 25 bp, E. coli
ggcgaactggactcgcagctggttt

SEQ ID NO: 118553 - DNA, 25 bp, E. coli
taataagccgctttcgcaggcgctg

SEQ ID NO: 118554 - DNA, 25 bp, E. coli
taataagccgctatcgcaggcgctg

SEQ ID NO: 118555 - DNA, 25 bp, E. coli
cacacgacaaagtccggcaaaccta

SEQ ID NO: 118556 - DNA, 25 bp, E. coli
cacacgacaaagaccggcaaaccta

SEQ ID NO: 118557 - DNA, 25 bp, E. coli
aggttcacacgacaaagtccggcaa

SEQ ID NO: 118558 - DNA, 25 bp, E. coli
aacctaccccttggaatagcctatg

SEQ ID NO: 118559 - DNA, 25 bp, E. coli
aacctaccccttcgaatagcctatg

SEQ ID NO: 118560 - DNA, 25 bp, E. coli
aggttcacacgagaaagtccggcaa

SEQ ID NO: 118561 - DNA, 25 bp, E. coli
actttcttgtaaggtggggtcgcag

SEQ ID NO: 118562 - DNA, 25 bp, E. coli
actttcttgtaacgtggggtcgcag

SEQ ID NO: 118563 - DNA, 25 bp, E. coli
tagcctatgccaccacacaaaaagt

SEQ ID NO: 118564 - DNA, 25 bp, E. coli
tatgccagcacagaaaaagttttgg

SEQ ID NO: 118565 - DNA, 25 bp, E. coli
tatgccagcacacaaaaagttttgg

SEQ ID NO: 118566 - DNA, 25 bp, E. coli
tagcctatgccagcacacaaaaagt

SEQ ID NO: 118567 - DNA, 25 bp, E. coli
tcgaatagcctatgccagcacacaa

SEQ ID NO: 118568 - DNA, 25 bp, E. coli
tcgaatagcctaagccagcacacaa

SEQ ID NO: 118569 - DNA, 25 bp, E. coli
gccagcacacaataagttttgggaa

SEQ ID NO: 118570 - DNA, 25 bp, E. coli
gccagcacacaaaaagttttgggaa

SEQ ID NO: 118571 - DNA, 25 bp, E. coli
gggtcgcaggattatagagaagtcg

SEQ ID NO: 118572 - DNA, 25 bp, E. coli
ggtcaaagatcgtcccctttttgtg

SEQ ID NO: 118573 - DNA, 25 bp, E. coli
gggtcgcaggataatagagaagtcg

SEQ ID NO: 118574 - DNA, 25 bp, E. coli
ggtcaaagatcgacccctttttgtg

SEQ ID NO: 118575 - DNA, 25 bp, E. coli
gacccctttttgtgatttgtgacag

SEQ ID NO: 118576 - DNA, 25 bp, E. coli
gacccctttttgagatttgtgacag

SEQ ID NO: 118577 - DNA, 25 bp, E. coli
caaaagtatgatagaggaagcggca

SEQ ID NO: 118578 - DNA, 25 bp, E. coli
caaaagtatgattgaggaagcggca

SEQ ID NO: 118579 - DNA, 25 bp, E. coli
caggtgaaaagcaaaaacgtgcggc

SEQ ID NO: 118580 - DNA, 25 bp, E. coli
catcggcgggtgatcctcaatgagg

SEQ ID NO: 118581 - DNA, 25 bp, E. coli
catcggcgggtgttcctcaatgagg

SEQ ID NO: 118582 - DNA, 25 bp, E. coli
caggtgaaaagctaaaacgtgcggc

SEQ ID NO: 118583 - DNA, 25 bp, E. coli
tttatgttgaactgcgcttcgcagc

SEQ ID NO: 118584 - DNA, 25 bp, E. coli
tttatgttgaacagcgcttcgcagc

SEQ ID NO: 118585 - DNA, 25 bp, E. coli
tgttaaaaagcaccgtatcgatctg

SEQ ID NO: 118586 - DNA, 25 bp, E. coli
tgttaaaaagcagcgtatcgatctg

SEQ ID NO: 118587 - DNA, 25 bp, E. coli
tctgcgtttaactgacgatgacaaa

SEQ ID NO: 118588 - DNA, 25 bp, E. coli
tctgcgtttaacagacgatgacaaa

SEQ ID NO: 118589 - DNA, 25 bp, E. coli
gctgagtaatccaccgtcaccaggt

SEQ ID NO: 118590 - DNA, 25 bp, E. coli
gctgagtaatcctccgtcaccaggt

SEQ ID NO: 118591 - DNA, 25 bp, E. coli
gcggcaaaacgtcttcagggaatgt

SEQ ID NO: 118592 - DNA, 25 bp, E. coli
gcggcaaaacgtgttcagggaatgt

SEQ ID NO: 118593 - DNA, 25 bp, E. coli
gaagcggcagcgttatctaatcagt

SEQ ID NO: 118594 - DNA, 25 bp, E. coli
gaagcggcagcgatatctaatcagt

SEQ ID NO: 118595 - DNA, 25 bp, E. coli
ctcaatgaggaaacctggacgcggg

SEQ ID NO: 118596 - DNA, 25 bp, E. coli
ctcaatgaggaatcctggacgcggg

SEQ ID NO: 118597 - DNA, 25 bp, E. coli
taatcagtccgtcagccaatttatg

SEQ ID NO: 118598 - DNA, 25 bp, E. coli
taatcagtccgtgagccaatttatg

SEQ ID NO: 118599 - DNA, 25 bp, E. coli
caattcgtctgatagcttgagtaac

SEQ ID NO: 118600 - DNA, 25 bp, E. coli
caattcgtctgaaagcttgagtaac

SEQ ID NO: 118601 - DNA, 25 bp, E. coli
aatactattgctcaggtctataccg

SEQ ID NO: 118602 - DNA, 25 bp, E. coli
aatactattgctgaggtctataccg

SEQ ID NO: 118603 - DNA, 25 bp, E. coli
taacaacggaaagcggccattgcgc

SEQ ID NO: 118604 - DNA, 25 bp, E. coli
aaaaaagtcatgatggtttcgcaag

SEQ ID NO: 118605 - DNA, 25 bp, E. coli
aaaaaagtcatgttggtttcgcaag

SEQ ID NO: 118606 - DNA, 25 bp, E. coli
taccgtatactcgtttcagccacaa

SEQ ID NO: 118607 - DNA, 25 bp, E. coli
taccgtatactcctttcagccacaa

SEQ ID NO: 118608 - DNA, 25 bp, E. coli
tatttgcccgaattgtgaagagggt

SEQ ID NO: 118609 - DNA, 25 bp, E. coli
tatttgcccgaaatgtgaagagggt

SEQ ID NO: 118610 - DNA, 25 bp, E. coli
tgtctggctgactgataatcgtcga

SEQ ID NO: 118611 - DNA, 25 bp, E. coli
tgtctggctgacagataatcgtcga

SEQ ID NO: 118612 - DNA, 25 bp, E. coli
tgaagagggtcaaaaccacaggtca

SEQ ID NO: 118613 - DNA, 25 bp, E. coli
tgaagagggtcataaccacaggtca

SEQ ID NO: 118614 - DNA, 25 bp, E. coli
ccagagcatggaagcaggttaaggc

SEQ ID NO: 118615 - DNA, 25 bp, E. coli
ccacaggtcaaggagaaacaattta

SEQ ID NO: 118616 - DNA, 25 bp, E. coli
ccacaggtcaagcagaaacaattta

SEQ ID NO: 118617 - DNA, 25 bp, E. coli
ccagagcatggatgcaggttaaggc

SEQ ID NO: 118618 - DNA, 25 bp, E. coli
gtttcgcaagttacccagagcatgg

SEQ ID NO: 118619 - DNA, 25 bp, E. coli
gtttcgcaagtttcccagagcatgg

SEQ ID NO: 118620 - DNA, 25 bp, E. coli
taacaacggaaaccggccattgcgc

SEQ ID NO: 118621 - DNA, 25 bp, E. coli
caagtgactatgatccgggtgacaa

SEQ ID NO: 118622 - DNA, 25 bp, E. coli
caagtgactatgttccgggtgacaa

SEQ ID NO: 118623 - DNA, 25 bp, E. coli
taaataacgcattcatgtcttcagg

SEQ ID NO: 118624 - DNA, 25 bp, E. coli
tacaacactgcgtagcggagagagt

SEQ ID NO: 118625 - DNA, 25 bp, E. coli
taaataacgcatacatgtcttcagg

SEQ ID NO: 118626 - DNA, 25 bp, E. coli
tacaacactgcgaagcggagagagt

SEQ ID NO: 118627 - DNA, 25 bp, E. coli
tatgcaatgtaatcaacgccagttg

SEQ ID NO: 118628 - DNA, 25 bp, E. coli
tatgcaatgtaaacaacgccagttg

SEQ ID NO: 118629 - DNA, 25 bp, E. coli
tatttaaccgccgatagcatcaacg

SEQ ID NO: 118630 - DNA, 25 bp, E. coli
tatttaaccgcccatagcatcaacg

SEQ ID NO: 118631 - DNA, 25 bp, E. coli
tttatatagcgtctggagacacgga

SEQ ID NO: 118632 - DNA, 25 bp, E. coli
tttatatagcgtgtggagacacgga

SEQ ID NO: 118633 - DNA, 25 bp, E. coli
tccttgtttcgagttaagctggcaa

SEQ ID NO: 118634 - DNA, 25 bp, E. coli
tccttgtttcgacttaagctggcaa

SEQ ID NO: 118635 - DNA, 25 bp, E. coli
gcatcaacgcttacggaactctttg

SEQ ID NO: 118636 - DNA, 25 bp, E. coli
gcatcaacgctttcggaactctttg

SEQ ID NO: 118637 - DNA, 25 bp, E. coli
gatagtgcgcaaatgatctacaaca

SEQ ID NO: 118638 - DNA, 25 bp, E. coli
gatagtgcgcaattgatctacaaca

SEQ ID NO: 118639 - DNA, 25 bp, E. coli
ggattgccagctttcttttaacgca

SEQ ID NO: 118640 - DNA, 25 bp, E. coli
ggattgccagctatcttttaacgca

SEQ ID NO: 118641 - DNA, 25 bp, E. coli
taacgtttgcggtttactgcccaag

SEQ ID NO: 118642 - DNA, 25 bp, E. coli
taacgtttgcggattactgcccaag

SEQ ID NO: 118643 - DNA, 25 bp, E. coli
cacgacggcgcttaaaaagccttca

SEQ ID NO: 118644 - DNA, 25 bp, E. coli
cacgacggcgctaaaaaagccttca

SEQ ID NO: 118645 - DNA, 25 bp, E. coli
catctattacgtggaagggttaccg

SEQ ID NO: 118646 - DNA, 25 bp, E. coli
catctattacgtcgaagggttaccg

SEQ ID NO: 118647 - DNA, 25 bp, E. coli
ttgtgctggcagatgtacgctggca

SEQ ID NO: 118648 - DNA, 25 bp, E. coli
tttcagaaccggctctggcgcgctt

SEQ ID NO: 118649 - DNA, 25 bp, E. coli
ttgtgctggcagttgtacgctggca

SEQ ID NO: 118650 - DNA, 25 bp, E. coli
tttcagaaccgggtctggcgcgctt

SEQ ID NO: 118651 - DNA, 25 bp, E. coli
ccacaggtgcgggtgatgtttttca

SEQ ID NO: 118652 - DNA, 25 bp, E. coli
cctgctggcagagctggaatcctgg

SEQ ID NO: 118653 - DNA, 25 bp, E. coli
cctgctggcagacctggaatcctgg

SEQ ID NO: 118654 - DNA, 25 bp, E. coli
ccacaggtgcggctgatgtttttca

SEQ ID NO: 118655 - DNA, 25 bp, E. coli
gcacaaacgctcacaaatggtcatg

SEQ ID NO: 118656 - DNA, 25 bp, E. coli
gcacaaacgctctcaaatggtcatg

SEQ ID NO: 118657 - DNA, 25 bp, E. coli
cttaacgggcgtcaaagagatggcc

SEQ ID NO: 118658 - DNA, 25 bp, E. coli
cttaacgggcgtgaaagagatggcc

SEQ ID NO: 118659 - DNA, 25 bp, E. coli
gataatcattaactaccccagcccg

SEQ ID NO: 118660 - DNA, 25 bp, E. coli
gataatcattaagtaccccagcccg

SEQ ID NO: 118661 - DNA, 25 bp, E. coli
gagatggccagtgcgctaaaacagg

SEQ ID NO: 118662 - DNA, 25 bp, E. coli
gatccctgactgtgatcaaacccga

SEQ ID NO: 118663 - DNA, 25 bp, E. coli
gatccctgactgagatcaaacccga

SEQ ID NO: 118664 - DNA, 25 bp, E. coli
gagatggccagtccgctaaaacagg

SEQ ID NO: 118665 - DNA, 25 bp, E. coli
caagttccggcacggttaccgatga

SEQ ID NO: 118666 - DNA, 25 bp, E. coli
caagttccggcagggttaccgatga

SEQ ID NO: 118667 - DNA, 25 bp, E. coli
caggcggtgcgcttttgggtaaaca

SEQ ID NO: 118668 - DNA, 25 bp, E. coli
caggcggtgcgcatttgggtaaaca

SEQ ID NO: 118669 - DNA, 25 bp, E. coli
ttatgcgtgaaatcagccgcggtcc

SEQ ID NO: 118670 - DNA, 25 bp, E. coli
ttatgcgtgaaaacagccgcggtcc

SEQ ID NO: 118671 - DNA, 25 bp, E. coli
tccgctggacatgcgtatggaccca

SEQ ID NO: 118672 - DNA, 25 bp, E. coli
tccgctggacatccgtatggaccca

SEQ ID NO: 118673 - DNA, 25 bp, E. coli
tcgccgttgcgaagactattgatga

SEQ ID NO: 118674 - DNA, 25 bp, E. coli
tccgcgctgggcgaatacgttgccg

SEQ ID NO: 118675 - DNA, 25 bp, E. coli
tccgcgctgggccaatacgttgccg

SEQ ID NO: 118676 - DNA, 25 bp, E. coli
tcgccgttgcgatgactattgatga

SEQ ID NO: 118677 - DNA, 25 bp, E. coli
tcttatcggcaagatcgacggcatt

SEQ ID NO: 118678 - DNA, 25 bp, E. coli
tcttatcggcaacatcgacggcatt

SEQ ID NO: 118679 - DNA, 25 bp, E. coli
gctacaaaccgctgaagaagccgat

SEQ ID NO: 118680 - DNA, 25 bp, E. coli
gctacaaaccgcagaagaagccgat

SEQ ID NO: 118681 - DNA, 25 bp, E. coli
cgtgcccgtagtacagttctgcgta

SEQ ID NO: 118682 - DNA, 25 bp, E. coli
cgtgcccgtagttcagttctgcgta

SEQ ID NO: 118683 - DNA, 25 bp, E. coli
gttaatggcctctatatccgtcctg

SEQ ID NO: 118684 - DNA, 25 bp, E. coli
gttaatggcctcaatatccgtcctg

SEQ ID NO: 118685 - DNA, 25 bp, E. coli
gatgacccgcacgaaagaactggcg

SEQ ID NO: 118686 - DNA, 25 bp, E. coli
gatgacccgcaccaaagaactggcg

SEQ ID NO: 118687 - DNA, 25 bp, E. coli
aacactgggaagtggtgcgttttgt

SEQ ID NO: 118688 - DNA, 25 bp, E. coli
aacactgggaagaggtgcgttttgt

SEQ ID NO: 118689 - DNA, 25 bp, E. coli
aagaaagcagcctgtggagtgagcc

SEQ ID NO: 118690 - DNA, 25 bp, E. coli
cgaaggtaaagacatagaaacggat

SEQ ID NO: 118691 - DNA, 25 bp, E. coli
cgaaggtaaagagatagaaacggat

SEQ ID NO: 118692 - DNA, 25 bp, E. coli
aagaaagcagccagtggagtgagcc

SEQ ID NO: 118693 - DNA, 25 bp, E. coli
tatgctggtaaatgcgatggcgaat

SEQ ID NO: 118694 - DNA, 25 bp, E. coli
tatgctggtaaaagcgatggcgaat

SEQ ID NO: 118695 - DNA, 25 bp, E. coli
tagaaacggatagcgaaggctatct

SEQ ID NO: 118696 - DNA, 25 bp, E. coli
tagaaacggataccgaaggctatct

SEQ ID NO: 118697 - DNA, 25 bp, E. coli
tgtgcgtgatttgtatctggaattc

SEQ ID NO: 118698 - DNA, 25 bp, E. coli
tgtgcgtgatttctatctggaattc

SEQ ID NO: 118699 - DNA, 25 bp, E. coli
tgctgatcttcgaaggtaaagagat

SEQ ID NO: 118700 - DNA, 25 bp, E. coli
tgctgatcttcgtaggtaaagagat

SEQ ID NO: 118701 - DNA, 25 bp, E. coli
tccggcgattcgtatgctggtaaaa

SEQ ID NO: 118702 - DNA, 25 bp, E. coli
tccggcgattcgaatgctggtaaaa

SEQ ID NO: 118703 - DNA, 25 bp, E. coli
tctggaattcaaaacttctccggcg

SEQ ID NO: 118704 - DNA, 25 bp, E. coli
tctggaattcaatacttctccggcg

SEQ ID NO: 118705 - DNA, 25 bp, E. coli
cgatggcgaataaatttggcgaaga

SEQ ID NO: 118706 - DNA, 25 bp, E. coli
cgaaggctatctgaaagaaagcagc

SEQ ID NO: 118707 - DNA, 25 bp, E. coli
cgaaggctatctcaaagaaagcagc

SEQ ID NO: 118708 - DNA, 25 bp, E. coli
cgatggcgaatatatttggcgaaga

SEQ ID NO: 118709 - DNA, 25 bp, E. coli
cttgtggttttcttttaggcgtggc

SEQ ID NO: 118710 - DNA, 25 bp, E. coli
cttgtggttttcatttaggcgtggc

SEQ ID NO: 118711 - DNA, 25 bp, E. coli
tacaatgtcccggtgttcaagtggc

SEQ ID NO: 118712 - DNA, 25 bp, E. coli
tacaatgtcccgctgttcaagtggc

SEQ ID NO: 118713 - DNA, 25 bp, E. coli
aggcgtggcaattctataatgatac

SEQ ID NO: 118714 - DNA, 25 bp, E. coli
aggcgtggcaatactataatgatac

SEQ ID NO: 118715 - DNA, 25 bp, E. coli
aacaatatttgcgagggacttgtgg

SEQ ID NO: 118716 - DNA, 25 bp, E. coli
aacaatatttgccagggacttgtgg

SEQ ID NO: 118717 - DNA, 25 bp, E. coli
tacgccgtattattagataatgcca

SEQ ID NO: 118718 - DNA, 25 bp, E. coli
tacgccgtattaatagataatgcca

SEQ ID NO: 118719 - DNA, 25 bp, E. coli
tgatacgcattaactcaagagcaaa

SEQ ID NO: 118720 - DNA, 25 bp, E. coli
tgtgatgcggcgtagactcatgtct

SEQ ID NO: 118721 - DNA, 25 bp, E. coli
tgtgatgcggcgaagactcatgtct

SEQ ID NO: 118722 - DNA, 25 bp, E. coli
tgatacgcattatctcaagagcaaa

SEQ ID NO: 118723 - DNA, 25 bp, E. coli
tcttctaatgaactgaaccgcttag

SEQ ID NO: 118724 - DNA, 25 bp, E. coli
tcttctaatgaagtgaaccgcttag

SEQ ID NO: 118725 - DNA, 25 bp, E. coli
ccgttgtaaatgaaagctgtgccac

SEQ ID NO: 118726 - DNA, 25 bp, E. coli
ccgcttagtaacaggacagattccg

SEQ ID NO: 118727 - DNA, 25 bp, E. coli
ccgttgtaaatgtaagctgtgccac

SEQ ID NO: 118728 - DNA, 25 bp, E. coli
ccgcttagtaactggacagattccg

SEQ ID NO: 118729 - DNA, 25 bp, E. coli
taacttttgctgttgtacctgtaca

SEQ ID NO: 118730 - DNA, 25 bp, E. coli
taacttttgctgatgtacctgtaca

SEQ ID NO: 118731 - DNA, 25 bp, E. coli
aatatggtcagtctgcagatcccgg

SEQ ID NO: 118732 - DNA, 25 bp, E. coli
aatatggtcagtgtgcagatcccgg

SEQ ID NO: 118733 - DNA, 25 bp, E. coli
cacctttgtactggccgtggcagca

SEQ ID NO: 118734 - DNA, 25 bp, E. coli
cacctttgtactcgccgtggcagca

SEQ ID NO: 118735 - DNA, 25 bp, E. coli
agaaatgaaatcagcgacgggcggc

SEQ ID NO: 118736 - DNA, 25 bp, E. coli
agaaatgaaatctgcgacgggcggc

SEQ ID NO: 118737 - DNA, 25 bp, E. coli
aacactgacgctcggacaactgacg

SEQ ID NO: 118738 - DNA, 25 bp, E. coli
aacactgacgctgggacaactgacg

SEQ ID NO: 118739 - DNA, 25 bp, E. coli
aaaccgtattggctctccggcgcag

SEQ ID NO: 118740 - DNA, 25 bp, E. coli
aaaccgtattgggtctccggcgcag

SEQ ID NO: 118741 - DNA, 25 bp, E. coli
tatttcgaactcgacaagagcggcc

SEQ ID NO: 118742 - DNA, 25 bp, E. coli
tatttcgaactccacaagagcggcc

SEQ ID NO: 118743 - DNA, 25 bp, E. coli
tctgcattcagatgaaggcgacgcg

SEQ ID NO: 118744 - DNA, 25 bp, E. coli
tctgcattcagaagaaggcgacgcg

SEQ ID NO: 118745 - DNA, 25 bp, E. coli
gccctgcccgcttgatgtgtatgat

SEQ ID NO: 118746 - DNA, 25 bp, E. coli
gccctgcccgctagatgtgtatgat

SEQ ID NO: 118747 - DNA, 25 bp, E. coli
ggatctgaacatccaactgtgggcg

SEQ ID NO: 118748 - DNA, 25 bp, E. coli
ggatctgaacatgcaactgtgggcg

SEQ ID NO: 118749 - DNA, 25 bp, E. coli
ggataaccagcgtttccgggccatg

SEQ ID NO: 118750 - DNA, 25 bp, E. coli
ggataaccagcgattccgggccatg

SEQ ID NO: 118751 - DNA, 25 bp, E. coli
taagatcatgattgacagcgcgtca

SEQ ID NO: 118752 - DNA, 25 bp, E. coli
taagatcatgatagacagcgcgtca

SEQ ID NO: 118753 - DNA, 25 bp, E. coli
taaccttttcccaggaacgctgaat

SEQ ID NO: 118754 - DNA, 25 bp, E. coli
taaccttttccctggaacgctgaat

SEQ ID NO: 118755 - DNA, 25 bp, E. coli
ttttcacttatcctcacactgacaa

SEQ ID NO: 118756 - DNA, 25 bp, E. coli
tttatacaccggttgaacttttcac

SEQ ID NO: 118757 - DNA, 25 bp, E. coli
tttatacaccggatgaacttttcac

SEQ ID NO: 118758 - DNA, 25 bp, E. coli
ttttcacttatcgtcacactgacaa

SEQ ID NO: 118759 - DNA, 25 bp, E. coli
ttttccctggaaggctgaatctttg

SEQ ID NO: 118760 - DNA, 25 bp, E. coli
ttttccctggaacgctgaatctttg

SEQ ID NO: 118761 - DNA, 25 bp, E. coli
tgcgtaacctttaccctggaacgct

SEQ ID NO: 118762 - DNA, 25 bp, E. coli
tgcgtaaccttttccctggaacgct

SEQ ID NO: 118763 - DNA, 25 bp, E. coli
ccagacgttgcgcaaacaacgaagt

SEQ ID NO: 118764 - DNA, 25 bp, E. coli
gcgcaaacaacgaagtttttgcgta

SEQ ID NO: 118765 - DNA, 25 bp, E. coli
ccagacgttgcggaaacaacgaagt

SEQ ID NO: 118766 - DNA, 25 bp, E. coli
gcgcaaacaacgtagtttttgcgta

SEQ ID NO: 118767 - DNA, 25 bp, E. coli
gaacttttcactaatcctcacactg

SEQ ID NO: 118768 - DNA, 25 bp, E. coli
gacgttgcgcaaacaacgaagtttt

SEQ ID NO: 118769 - DNA, 25 bp, E. coli
gaacttttcacttatcctcacactg

SEQ ID NO: 118770 - DNA, 25 bp, E. coli
gacgttgcgcaatcaacgaagtttt

SEQ ID NO: 118771 - DNA, 25 bp, E. coli
cggcaccagacgttgcgcaaacaac

SEQ ID NO: 118772 - DNA, 25 bp, E. coli
cggcaccagacgatgcgcaaacaac

SEQ ID NO: 118773 - DNA, 25 bp, E. coli
gagcgatgatgtttttatacaccgg

SEQ ID NO: 118774 - DNA, 25 bp, E. coli
gagcgatgatgtatttatacaccgg

SEQ ID NO: 118775 - DNA, 25 bp, E. coli
taaagttatctggaaccctgcgaca

SEQ ID NO: 118776 - DNA, 25 bp, E. coli
taaagttatctgcaaccctgcgaca

SEQ ID NO: 118777 - DNA, 25 bp, E. coli
tataacgtcggcgatgcactggctg

SEQ ID NO: 118778 - DNA, 25 bp, E. coli
tataacgtcggccatgcactggctg

SEQ ID NO: 118779 - DNA, 25 bp, E. coli
tgagtattgctcatggcgacaccgc

SEQ ID NO: 118780 - DNA, 25 bp, E. coli
tgagtattgctcttggcgacaccgc

SEQ ID NO: 118781 - DNA, 25 bp, E. coli
gcttgatgataaggccctgctgtgg

SEQ ID NO: 118782 - DNA, 25 bp, E. coli
gctgatgccctggtctggaacgaaa

SEQ ID NO: 118783 - DNA, 25 bp, E. coli
gctgatgccctgctctggaacgaaa

SEQ ID NO: 118784 - DNA, 25 bp, E. coli
gcttgatgataacgccctgctgtgg

SEQ ID NO: 118785 - DNA, 25 bp, E. coli
gaaaaatggcgccatcaagtctgac

SEQ ID NO: 118786 - DNA, 25 bp, E. coli
gaaaaatggcgcgatcaagtctgac

SEQ ID NO: 118787 - DNA, 25 bp, E. coli
gacttacaccattgcgaacgccgag

SEQ ID NO: 118788 - DNA, 25 bp, E. coli
gacttacaccatagcgaacgccgag

SEQ ID NO: 118789 - DNA, 25 bp, E. coli
ctatatccaagataacggtgcgggt

SEQ ID NO: 118790 - DNA, 25 bp, E. coli
ctatatccaagaaaacggtgcgggt

SEQ ID NO: 118791 - DNA, 25 bp, E. coli
ggttataactctctcgccaaaggcg

SEQ ID NO: 118792 - DNA, 25 bp, E. coli
ggtattaactctctcgcgctgggcg

SEQ ID NO: 118793 - DNA, 25 bp, E. coli
ggttataactctgtcgccaaaggcg

SEQ ID NO: 118794 - DNA, 25 bp, E. coli
ggtattaactctgtcgcgctgggcg

SEQ ID NO: 118795 - DNA, 25 bp, E. coli
taatgcaatcgccataggccagggc

SEQ ID NO: 118796 - DNA, 25 bp, E. coli
taatgcaatcgcgataggccagggc

SEQ ID NO: 118797 - DNA, 25 bp, E. coli
tactgctggttctatcgatgattgt

SEQ ID NO: 118798 - DNA, 25 bp, E. coli
tacggctgtgcgttcgacttcttca

SEQ ID NO: 118799 - DNA, 25 bp, E. coli
tacggctgtgcgatcgacttcttca

SEQ ID NO: 118800 - DNA, 25 bp, E. coli
tactgctggttcaatcgatgattgt

SEQ ID NO: 118801 - DNA, 25 bp, E. coli
accgtactgctggttctatcgatga

SEQ ID NO: 118802 - DNA, 25 bp, E. coli
accgtactgctgcttctatcgatga

SEQ ID NO: 118803 - DNA, 25 bp, E. coli
tgtttacggctgagcgttcgacttc

SEQ ID NO: 118804 - DNA, 25 bp, E. coli
tgtttacggctgtgcgttcgacttc

SEQ ID NO: 118805 - DNA, 25 bp, E. coli
tcggcaccgtactgctggttctatc

SEQ ID NO: 118806 - DNA, 25 bp, E. coli
tcggcaccgtacagctggttctatc

SEQ ID NO: 118807 - DNA, 25 bp, E. coli
gctggttctatccatgattgtttac

SEQ ID NO: 118808 - DNA, 25 bp, E. coli
gctggttctatcgatgattgtttac

SEQ ID NO: 118809 - DNA, 25 bp, E. coli
cgtactgctggtactatcgatgatt

SEQ ID NO: 118810 - DNA, 25 bp, E. coli
cgttcggcaccgtactgctggttct

SEQ ID NO: 118811 - DNA, 25 bp, E. coli
cgttcggcaccgaactgctggttct

SEQ ID NO: 118812 - DNA, 25 bp, E. coli
cgtactgctggttctatcgatgatt

SEQ ID NO: 118813 - DNA, 25 bp, E. coli
cggctgtgcgttcgacttcttcaac

SEQ ID NO: 118814 - DNA, 25 bp, E. coli
cggctgtgcgttggacttcttcaac

SEQ ID NO: 118815 - DNA, 25 bp, E. coli
gattgtttacggctgtgcgttcgac

SEQ ID NO: 118816 - DNA, 25 bp, E. coli
gattgtttacgggtgtgcgttcgac

SEQ ID NO: 118817 - DNA, 25 bp, E. coli
ggcaccgtactgctggttctatcga

SEQ ID NO: 118818 - DNA, 25 bp, E. coli
ggcaccgtactggtggttctatcga

SEQ ID NO: 118819 - DNA, 25 bp, E. coli
caagacgataaaaggctaataacgg

SEQ ID NO: 118820 - DNA, 25 bp, E. coli
caagacgataaatggctaataacgg

SEQ ID NO: 118821 - DNA, 25 bp, E. coli
caatatgttatgagttgagcggaaa

SEQ ID NO: 118822 - DNA, 25 bp, E. coli
caatatgttatgtgttgagcggaaa

SEQ ID NO: 118823 - DNA, 25 bp, E. coli
caaacggctggtgtgatcaggcgca

SEQ ID NO: 118824 - DNA, 25 bp, E. coli
caaacggctggtctgatcaggcgca

SEQ ID NO: 118825 - DNA, 25 bp, E. coli
aacgatttttcctgtattcactgcc

SEQ ID NO: 118826 - DNA, 25 bp, E. coli
aacgatttttccagtattcactgcc

SEQ ID NO: 118827 - DNA, 25 bp, E. coli
tattcactgccgttgcgcaaaattt

SEQ ID NO: 118828 - DNA, 25 bp, E. coli
tattcactgccgatgcgcaaaattt

SEQ ID NO: 118829 - DNA, 25 bp, E. coli
tgatcaggcgcacattaatgaaggc

SEQ ID NO: 118830 - DNA, 25 bp, E. coli
tgatcaggcgcagattaatgaaggc

SEQ ID NO: 118831 - DNA, 25 bp, E. coli
tgccggcccaaaaaatataaacaag

SEQ ID NO: 118832 - DNA, 25 bp, E. coli
tgccggcccaaataatataaacaag

SEQ ID NO: 118833 - DNA, 25 bp, E. coli
tcatgacacagattaataaaaaggt

SEQ ID NO: 118834 - DNA, 25 bp, E. coli
tcatgacacagaataataaaaaggt

SEQ ID NO: 118835 - DNA, 25 bp, E. coli
gcacatttggattctattctatgaa

SEQ ID NO: 118836 - DNA, 25 bp, E. coli
gcacatttggatactattctatgaa

SEQ ID NO: 118837 - DNA, 25 bp, E. coli
ctaataacggaaccatcatgacaca

SEQ ID NO: 118838 - DNA, 25 bp, E. coli
ctaataacggaagcatcatgacaca

SEQ ID NO: 118839 - DNA, 25 bp, E. coli
tcaatgattgttccgccaaacggct

SEQ ID NO: 118840 - DNA, 25 bp, E. coli
tcaatgattgttgcgccaaacggct

SEQ ID NO: 118841 - DNA, 25 bp, E. coli
ctaccaacggcaggtgaccggagat

SEQ ID NO: 118842 - DNA, 25 bp, E. coli
ctaccaacggcacgtgaccggagat

SEQ ID NO: 118843 - DNA, 25 bp, E. coli
caaatgggaagtccataattttagc

SEQ ID NO: 118844 - DNA, 25 bp, E. coli
caaatgggaagtgcataattttagc

SEQ ID NO: 118845 - DNA, 25 bp, E. coli
aacggcaggtgaccggagatactta

SEQ ID NO: 118846 - DNA, 25 bp, E. coli
aacggcaggtgagcggagatactta

SEQ ID NO: 118847 - DNA, 25 bp, E. coli
ttactacacttcgggcgatgagttc

SEQ ID NO: 118848 - DNA, 25 bp, E. coli
ttactacacttccggcgatgagttc

SEQ ID NO: 118849 - DNA, 25 bp, E. coli
tctgcatctcaatagtggttttacg

SEQ ID NO: 118850 - DNA, 25 bp, E. coli
tctgcatctcaaaagtggttttacg

SEQ ID NO: 118851 - DNA, 25 bp, E. coli
ccagattttccgatactacacttcg

SEQ ID NO: 118852 - DNA, 25 bp, E. coli
ccagattttccgttactacacttcg

SEQ ID NO: 118853 - DNA, 25 bp, E. coli
ccgtcagttgcaacgatctgggcgg

SEQ ID NO: 118854 - DNA, 25 bp, E. coli
gcggtccgttgggtctgcatctcaa

SEQ ID NO: 118855 - DNA, 25 bp, E. coli
gcggtccgttggctctgcatctcaa

SEQ ID NO: 118856 - DNA, 25 bp, E. coli
ccgtcagttgcatcgatctgggcgg

SEQ ID NO: 118857 - DNA, 25 bp, E. coli
cgctcgcggtccgttgggtctgcat

SEQ ID NO: 118858 - DNA, 25 bp, E. coli
cgctcgcggtcccttgggtctgcat

SEQ ID NO: 118859 - DNA, 25 bp, E. coli
tggccgccgtcagttgcatcgatct

SEQ ID NO: 118860 - DNA, 25 bp, E. coli
tggccgccgtcacttgcatcgatct

SEQ ID NO: 118861 - DNA, 25 bp, E. coli
gaggaatataccgtggccgccgtca

SEQ ID NO: 118862 - DNA, 25 bp, E. coli
gaggaatataccctggccgccgtca

SEQ ID NO: 118863 - DNA, 25 bp, E. coli
caagaaagtggtcgatatcctggcg

SEQ ID NO: 118864 - DNA, 25 bp, E. coli
caagaaagtggtggatatcctggcg

SEQ ID NO: 118865 - DNA, 25 bp, E. coli
tacttgcgcccaacaaaacgctggc

SEQ ID NO: 118866 - DNA, 25 bp, E. coli
tactgcgcgaagctctggatatgcc

SEQ ID NO: 118867 - DNA, 25 bp, E. coli
taaagcgattctgtacggcgataag

SEQ ID NO: 118868 - DNA, 25 bp, E. coli
tacttgcgcccatcaaaacgctggc

SEQ ID NO: 118869 - DNA, 25 bp, E. coli
tactgcgcgaaggtctggatatgcc

SEQ ID NO: 118870 - DNA, 25 bp, E. coli
taaagcgattctctacggcgataag

SEQ ID NO: 118871 - DNA, 25 bp, E. coli
aaaccatctatgattcggcgacgcc

SEQ ID NO: 118872 - DNA, 25 bp, E. coli
aaaccatctatgtttcggcgacgcc

SEQ ID NO: 118873 - DNA, 25 bp, E. coli
tttgtccgccacgaaagcgatgctg

SEQ ID NO: 118874 - DNA, 25 bp, E. coli
tttgtccgccaccaaagcgatgctg

SEQ ID NO: 118875 - DNA, 25 bp, E. coli
ttcggagattcgacagcgagcggca

SEQ ID NO: 118876 - DNA, 25 bp, E. coli
ttcggagattcgtcagcgagcggca

SEQ ID NO: 118877 - DNA, 25 bp, E. coli
gaagagttcgaaccattagcgccgc

SEQ ID NO: 118878 - DNA, 25 bp, E. coli
gaagagttcgaagcattagcgccgc

SEQ ID NO: 118879 - DNA, 25 bp, E. coli
gacactggtggactacggcttccgc

SEQ ID NO: 118880 - DNA, 25 bp, E. coli
gacactggtggagtacggcttccgc

SEQ ID NO: 118881 - DNA, 25 bp, E. coli
ggagatcaaagaagagctggccgcc

SEQ ID NO: 118882 - DNA, 25 bp, E. coli
ggctgacccagcctacccagtttga

SEQ ID NO: 118883 - DNA, 25 bp, E. coli
ggagatcaaagatgagctggccgcc

SEQ ID NO: 118884 - DNA, 25 bp, E. coli
ggctgacccagcgtacccagtttga

SEQ ID NO: 118885 - DNA, 25 bp, E. coli
aaacgtgggaaagcgccgatgactg

SEQ ID NO: 118886 - DNA, 25 bp, E. coli
aaacgtgggaaaccgccgatgactg

SEQ ID NO: 118887 - DNA, 25 bp, E. coli
tctccaggaaacgtgggaaagcgcc

SEQ ID NO: 118888 - DNA, 25 bp, E. coli
tgcgaattgaagtcaccatagcgaa

SEQ ID NO: 118889 - DNA, 25 bp, E. coli
tgcgaattgaagacaccatagcgaa

SEQ ID NO: 118890 - DNA, 25 bp, E. coli
tctccaggaaacctgggaaagcgcc

SEQ ID NO: 118891 - DNA, 25 bp, E. coli
gccgtattcagtttgcgtttcctga

SEQ ID NO: 118892 - DNA, 25 bp, E. coli
gccgtattcagtatgcgtttcctga

SEQ ID NO: 118893 - DNA, 25 bp, E. coli
gctattgacgccctggctggcgaac

SEQ ID NO: 118894 - DNA, 25 bp, E. coli
gctattgacgccgtggctggcgaac

SEQ ID NO: 118895 - DNA, 25 bp, E. coli
gaaaacttctccattgccagctggg

SEQ ID NO: 118896 - DNA, 25 bp, E. coli
gaaaacttctcctttgccagctggg

SEQ ID NO: 118897 - DNA, 25 bp, E. coli
cgtttcctgataatgaaggccacgt

SEQ ID NO: 118898 - DNA, 25 bp, E. coli
ccgatgactggtatgtcagcgaata

SEQ ID NO: 118899 - DNA, 25 bp, E. coli
cgtttcctgatattgaaggccacgt

SEQ ID NO: 118900 - DNA, 25 bp, E. coli
ccgatgactggtttgtcagcgaata

SEQ ID NO: 118901 - DNA, 25 bp, E. coli
tggcgcgacaaaagaagataaacag

SEQ ID NO: 118902 - DNA, 25 bp, E. coli
ggctggcgaactttcccgccgtatt

SEQ ID NO: 118903 - DNA, 25 bp, E. coli
tggcgcgacaaatgaagataaacag

SEQ ID NO: 118904 - DNA, 25 bp, E. coli
ggctggcgaactatcccgccgtatt

SEQ ID NO: 118905 - DNA, 25 bp, E. coli
taatttatcggttattggcgcgaca

SEQ ID NO: 118906 - DNA, 25 bp, E. coli
taatttatcggtaattggcgcgaca

SEQ ID NO: 118907 - DNA, 25 bp, E. coli
ttcgcaataataacattcagcctgt

SEQ ID NO: 118908 - DNA, 25 bp, E. coli
tttcgcaataatttcattcagcctg

SEQ ID NO: 118909 - DNA, 25 bp, E. coli
ttcgcaataatatcattcagcctgt

SEQ ID NO: 118910 - DNA, 25 bp, E. coli
tttcgcaataatatcattcagcctg

SEQ ID NO: 118911 - DNA, 25 bp, E. coli
tgtttcgcaataatatcattcagcc

SEQ ID NO: 118912 - DNA, 25 bp, E. coli
tgtttcgcaatattatcattcagcc

SEQ ID NO: 118913 - DNA, 25 bp, E. coli
tgaacctgatgtccgcggagccttt

SEQ ID NO: 118914 - DNA, 25 bp, E. coli
tgaacctgatgtgcgcggagccttt

SEQ ID NO: 118915 - DNA, 25 bp, E. coli
tcgcaataatatcattcagcctgtc

SEQ ID NO: 118916 - DNA, 25 bp, E. coli
tcgcaataatatgattcagcctgtc

SEQ ID NO: 118917 - DNA, 25 bp, E. coli
cctgaacctgatctgcgcggagcct

SEQ ID NO: 118918 - DNA, 25 bp, E. coli
cctgaacctgatgtgcgcggagcct

SEQ ID NO: 118919 - DNA, 25 bp, E. coli
cgcaataatatcattcagcctgtca

SEQ ID NO: 118920 - DNA, 25 bp, E. coli
cgcaataatatctttcagcctgtca

SEQ ID NO: 118921 - DNA, 25 bp, E. coli
ctgaacctgatgagcgcggagcctt

SEQ ID NO: 118922 - DNA, 25 bp, E. coli
ctgaacctgatgtgcgcggagcctt

SEQ ID NO: 118923 - DNA, 25 bp, E. coli
ctgatgtgcgcgcagcctttcttaa

SEQ ID NO: 118924 - DNA, 25 bp, E. coli
ctgatgtgcgcggagcctttcttaa

SEQ ID NO: 118925 - DNA, 25 bp, E. coli
gtgtttcgcaattatatcattcagc

SEQ ID NO: 118926 - DNA, 25 bp, E. coli
gtttcgcaataatatcattcagcct

SEQ ID NO: 118927 - DNA, 25 bp, E. coli
gtgtttcgcaataatatcattcagc

SEQ ID NO: 118928 - DNA, 25 bp, E. coli
gtttcgcaataaaatcattcagcct

SEQ ID NO: 118929 - DNA, 25 bp, E. coli
cagcgagaagcttaaccctgcgcac

SEQ ID NO: 118930 - DNA, 25 bp, E. coli
cagcgagaagctaaaccctgcgcac

SEQ ID NO: 118931 - DNA, 25 bp, E. coli
atcagcgagaagctaaaccctgcgc

SEQ ID NO: 118932 - DNA, 25 bp, E. coli
agcgagaagctaaaccctgcgcacc

SEQ ID NO: 118933 - DNA, 25 bp, E. coli
agaagctaaaccctgcgcaccatat

SEQ ID NO: 118934 - DNA, 25 bp, E. coli
agctaaaccctgcgcaccatatcga

SEQ ID NO: 118935 - DNA, 25 bp, E. coli
agcgagaagctataccctgcgcacc

SEQ ID NO: 118936 - DNA, 25 bp, E. coli
agctaaaccctgggcaccatatcga

SEQ ID NO: 118937 - DNA, 25 bp, E. coli
agaagctaaaccgtgcgcaccatat

SEQ ID NO: 118938 - DNA, 25 bp, E. coli
atcagcgagaaggtaaaccctgcgc

SEQ ID NO: 118939 - DNA, 25 bp, E. coli
gcgagaagctaatccctgcgcacca

SEQ ID NO: 118940 - DNA, 25 bp, E. coli
gcgagaagctaaaccctgcgcacca

SEQ ID NO: 118941 - DNA, 25 bp, E. coli
gaagctaaaccctgcgcaccatatc

SEQ ID NO: 118942 - DNA, 25 bp, E. coli
gaagctaaacccagcgcaccatatc

SEQ ID NO: 118943 - DNA, 25 bp, E. coli
cgagaagctaaaccctgcgcaccat

SEQ ID NO: 118944 - DNA, 25 bp, E. coli
cgagaagctaaagcctgcgcaccat

SEQ ID NO: 118945 - DNA, 25 bp, E. coli
gatcagcgagaacctaaaccctgcg

SEQ ID NO: 118946 - DNA, 25 bp, E. coli
gatcagcgagaagctaaaccctgcg

SEQ ID NO: 118947 - DNA, 25 bp, E. coli
ggggattcaggcgacaggcaattat

SEQ ID NO: 118948 - DNA, 25 bp, E. coli
ggggattcaggccacaggcaattat

SEQ ID NO: 118949 - DNA, 25 bp, E. coli
tcagcgagaagctaaaccctgcgca

SEQ ID NO: 118950 - DNA, 25 bp, E. coli
tcagcgagaagcaaaaccctgcgca

SEQ ID NO: 118951 - DNA, 25 bp, E. coli
catcttagagttaaaacaggcgcgg

SEQ ID NO: 118952 - DNA, 25 bp, E. coli
catcttagagtttaaacaggcgcgg

SEQ ID NO: 118953 - DNA, 25 bp, E. coli
ttttggctttgtcggtaccgtactg

SEQ ID NO: 118954 - DNA, 25 bp, E. coli
ttttggctttgtgggtaccgtactg

SEQ ID NO: 118955 - DNA, 25 bp, E. coli
tgtcggtaccgtactggattatgcc

SEQ ID NO: 118956 - DNA, 25 bp, E. coli
tgtcggtaccgttctggattatgcc

SEQ ID NO: 118957 - DNA, 25 bp, E. coli
tctgcttaacggaccaaccggcgcg

SEQ ID NO: 118958 - DNA, 25 bp, E. coli
tctgcttaacggtccaaccggcgcg

SEQ ID NO: 118959 - DNA, 25 bp, E. coli
gcgccgattctgcttaacggtccaa

SEQ ID NO: 118960 - DNA, 25 bp, E. coli
gcgccgattctggttaacggtccaa

SEQ ID NO: 118961 - DNA, 25 bp, E. coli
gcatcttagagtaaaaacaggcgcg

SEQ ID NO: 118962 - DNA, 25 bp, E. coli
gcatcttagagttaaaacaggcgcg

SEQ ID NO: 118963 - DNA, 25 bp, E. coli
ccgcgcgccgatactgcttaacggt

SEQ ID NO: 118964 - DNA, 25 bp, E. coli
ccgcgcgccgattctgcttaacggt

SEQ ID NO: 118965 - DNA, 25 bp, E. coli
cgattctgcttaacggtccaaccgg

SEQ ID NO: 118966 - DNA, 25 bp, E. coli
cggtaccgtactcgattatgccggg

SEQ ID NO: 118967 - DNA, 25 bp, E. coli
ctgcttaacggtccaaccggcgcgg

SEQ ID NO: 118968 - DNA, 25 bp, E. coli
cggtaccgtactggattatgccggg

SEQ ID NO: 118969 - DNA, 25 bp, E. coli
cgattctgcttatcggtccaaccgg

SEQ ID NO: 118970 - DNA, 25 bp, E. coli
ctgcttaacggtgcaaccggcgcgg

SEQ ID NO: 118971 - DNA, 25 bp, E. coli
gattctgcttaacggtccaaccggc

SEQ ID NO: 118972 - DNA, 25 bp, E. coli
gattctgcttaagggtccaaccggc

SEQ ID NO: 118973 - DNA, 25 bp, E. coli
cagctgttgtgaactatgaagagcc

SEQ ID NO: 118974 - DNA, 25 bp, E. coli
cagctgttgtgatctatgaagagcc

SEQ ID NO: 118975 - DNA, 25 bp, E. coli
aacgtagcagaatacaacggctttg

SEQ ID NO: 118976 - DNA, 25 bp, E. coli
aacgtagcagaaaacaacggctttg

SEQ ID NO: 118977 - DNA, 25 bp, E. coli
ttacgccactttcattaagccggac

SEQ ID NO: 118978 - DNA, 25 bp, E. coli
ttacgccactttgattaagccggac

SEQ ID NO: 118979 - DNA, 25 bp, E. coli
ttcaaacttaaaccggcagcggtca

SEQ ID NO: 118980 - DNA, 25 bp, E. coli
ttcaaacttaaagcggcagcggtca

SEQ ID NO: 118981 - DNA, 25 bp, E. coli
tcgcgactacgcttggaaacatgta

SEQ ID NO: 118982 - DNA, 25 bp, E. coli
tcgcgactacgcatggaaacatgta

SEQ ID NO: 118983 - DNA, 25 bp, E. coli
ccaactatggcgaaccaggtgaagg

SEQ ID NO: 118984 - DNA, 25 bp, E. coli
ccaactatggcgtaccaggtgaagg

SEQ ID NO: 118985 - DNA, 25 bp, E. coli
gaatgccgcaaaaataatgggtcgc

SEQ ID NO: 118986 - DNA, 25 bp, E. coli
gaatgccgcaaatataatgggtcgc

SEQ ID NO: 118987 - DNA, 25 bp, E. coli
cggtcagagaatccgccaacgtagc

SEQ ID NO: 118988 - DNA, 25 bp, E. coli
cggtcagagaatgcgccaacgtagc

SEQ ID NO: 118989 - DNA, 25 bp, E. coli
gttgccatgtctctttgccgccggg

SEQ ID NO: 118990 - DNA, 25 bp, E. coli
gttgccatgtctgtttgccgccggg

SEQ ID NO: 118991 - DNA, 25 bp, E. coli
taagccggacaacactgatccagct

SEQ ID NO: 118992 - DNA, 25 bp, E. coli
taagccggacaagactgatccagct

SEQ ID NO: 118993 - DNA, 25 bp, E. coli
gagcctttgcctatggagcttgcca

SEQ ID NO: 118994 - DNA, 25 bp, E. coli
gagcctttgcctttggagcttgcca

SEQ ID NO: 118995 - DNA, 25 bp, E. coli
aatacccttgaggtactgccggagt

SEQ ID NO: 118996 - DNA, 25 bp, E. coli
caatacccttgacctactgccggag

SEQ ID NO: 118997 - DNA, 25 bp, E. coli
caatacccttgagctactgccggag

SEQ ID NO: 118998 - DNA, 25 bp, E. coli
aatacccttgagctactgccggagt

SEQ ID NO: 118999 - DNA, 25 bp, E. coli
aggaaaaattatcgagctgctctgc

SEQ ID NO: 119000 - DNA, 25 bp, E. coli
aggaaaaattatggagctgctctgc

SEQ ID NO: 119001 - DNA, 25 bp, E. coli
agtctcaatacccttgagctactgc

SEQ ID NO: 119002 - DNA, 25 bp, E. coli
agtctcaataccgttgagctactgc

SEQ ID NO: 119003 - DNA, 25 bp, E. coli
tacccttgagctactgccggagtta

SEQ ID NO: 119004 - DNA, 25 bp, E. coli
tacccttgagcttctgccggagtta

SEQ ID NO: 119005 - DNA, 25 bp, E. coli
ttcaggaaaaattatggagctgctc

SEQ ID NO: 119006 - DNA, 25 bp, E. coli
ttcaggaaaaataatggagctgctc

SEQ ID NO: 119007 - DNA, 25 bp, E. coli
tcaggaaaaattttggagctgctct

SEQ ID NO: 119008 - DNA, 25 bp, E. coli
tcaggaaaaattatggagctgctct

SEQ ID NO: 119009 - DNA, 25 bp, E. coli
ccttcaggaaaaattatggagctgc

SEQ ID NO: 119010 - DNA, 25 bp, E. coli
ccttgagctactcccggagttaatg

SEQ ID NO: 119011 - DNA, 25 bp, E. coli
ccttgagctactgccggagttaatg

SEQ ID NO: 119012 - DNA, 25 bp, E. coli
ccttcaggaaaatttatggagctgc

SEQ ID NO: 119013 - DNA, 25 bp, E. coli
cccttgagctacagccggagttaat

SEQ ID NO: 119014 - DNA, 25 bp, E. coli
cccttgagctactgccggagttaat

SEQ ID NO: 119015 - DNA, 25 bp, E. coli
tcaatacccttgagctactgccgga

SEQ ID NO: 119016 - DNA, 25 bp, E. coli
tcaatacccttgtgctactgccgga

SEQ ID NO: 119017 - DNA, 25 bp, E. coli
caatttctcgcctgcttgccggaag

SEQ ID NO: 119018 - DNA, 25 bp, E. coli
caatttctcgccagcttgccggaag

SEQ ID NO: 119019 - DNA, 25 bp, E. coli
catggcgatccatcaggttagcccc

SEQ ID NO: 119020 - DNA, 25 bp, E. coli
catggcgatccaacaggttagcccc

SEQ ID NO: 119021 - DNA, 25 bp, E. coli
tagcccctttcgtgaagagccagtg

SEQ ID NO: 119022 - DNA, 25 bp, E. coli
tacgcgtaatcaacgcatcgccgcg

SEQ ID NO: 119023 - DNA, 25 bp, E. coli
tagcccctttcgagaagagccagtg

SEQ ID NO: 119024 - DNA, 25 bp, E. coli
tacgcgtaatcatcgcatcgccgcg

SEQ ID NO: 119025 - DNA, 25 bp, E. coli
tatttgccggtgtcctgtctggaag

SEQ ID NO: 119026 - DNA, 25 bp, E. coli
tattcgtcataatcgcgctcgtgga

SEQ ID NO: 119027 - DNA, 25 bp, E. coli
tatttgccggtgacctgtctggaag

SEQ ID NO: 119028 - DNA, 25 bp, E. coli
tattcgtcataaacgcgctcgtgga

SEQ ID NO: 119029 - DNA, 25 bp, E. coli
tgattacaacccaaacaacgtggca

SEQ ID NO: 119030 - DNA, 25 bp, E. coli
tgattacaaccctaacaacgtggca

SEQ ID NO: 119031 - DNA, 25 bp, E. coli
gcaacaacgatttacgcaggattta

SEQ ID NO: 119032 - DNA, 25 bp, E. coli
gcaacaacgattaacgcaggattta

SEQ ID NO: 119033 - DNA, 25 bp, E. coli
ccgccatgaaataggtaaaggctca

SEQ ID NO: 119034 - DNA, 25 bp, E. coli
ccgccatgaaattggtaaaggctca

SEQ ID NO: 119035 - DNA, 25 bp, E. coli
gattaatgaaatgcgcatggcgatc

SEQ ID NO: 119036 - DNA, 25 bp, E. coli
gattaatgaaatccgcatggcgatc

SEQ ID NO: 119037 - DNA, 25 bp, E. coli
tgggttaaaaacagccaacttatgc

SEQ ID NO: 119038 - DNA, 25 bp, E. coli
tgggttaaaaactgccaacttatgc

SEQ ID NO: 119039 - DNA, 25 bp, E. coli
cacgctggcagaagattacagtatc

SEQ ID NO: 119040 - DNA, 25 bp, E. coli
cacgctggcagatgattacagtatc

SEQ ID NO: 119041 - DNA, 25 bp, E. coli
tgaccgatcccgaaacgtttaatgc

SEQ ID NO: 119042 - DNA, 25 bp, E. coli
tgaccgatcccgtaacgtttaatgc

SEQ ID NO: 119043 - DNA, 25 bp, E. coli
tccgctgcccggtgcaaatcatctg

SEQ ID NO: 119044 - DNA, 25 bp, E. coli
tgcccgatagccagaaaatggtgat

SEQ ID NO: 119045 - DNA, 25 bp, E. coli
tgcccgatagcctgaaaatggtgat

SEQ ID NO: 119046 - DNA, 25 bp, E. coli
tccgctgcccggagcaaatcatctg

SEQ ID NO: 119047 - DNA, 25 bp, E. coli
gccagcctgttacatcaccgtgaag

SEQ ID NO: 119048 - DNA, 25 bp, E. coli
gccagcctgttagatcaccgtgaag

SEQ ID NO: 119049 - DNA, 25 bp, E. coli
gctctgttactcaacgggcttgcca

SEQ ID NO: 119050 - DNA, 25 bp, E. coli
gctctgttactctacgggcttgcca

SEQ ID NO: 119051 - DNA, 25 bp, E. coli
gcactggcgcattttcagggcaaaa

SEQ ID NO: 119052 - DNA, 25 bp, E. coli
gcactggcgcatattcagggcaaaa

SEQ ID NO: 119053 - DNA, 25 bp, E. coli
cccttatgctgaagcgcccgtagtg

SEQ ID NO: 119054 - DNA, 25 bp, E. coli
cccttatgctgatgcgcccgtagtg

SEQ ID NO: 119055 - DNA, 25 bp, E. coli
gtagtctgttacgaccagcgcggca

SEQ ID NO: 119056 - DNA, 25 bp, E. coli
gtagtctgttaccaccagcgcggca

SEQ ID NO: 119057 - DNA, 25 bp, E. coli
tggcagcggaacagcatcaggcgct

SEQ ID NO: 119058 - DNA, 25 bp, E. coli
tggcagcggaactgcatcaggcgct

SEQ ID NO: 119059 - DNA, 25 bp, E. coli
taacggctggcttcgaataaacgcc

SEQ ID NO: 119060 - DNA, 25 bp, E. coli
taacggctggctacgaataaacgcc

SEQ ID NO: 119061 - DNA, 25 bp, E. coli
cagtgcgcatcggagcagtgcgttt

SEQ ID NO: 119062 - DNA, 25 bp, E. coli
cagtgcgtttgaagccgggcagttt

SEQ ID NO: 119063 - DNA, 25 bp, E. coli
cagtgcgcatcgcagcagtgcgttt

SEQ ID NO: 119064 - DNA, 25 bp, E. coli
cagtgcgtttgatgccgggcagttt

SEQ ID NO: 119065 - DNA, 25 bp, E. coli
accgttctggaagcgcgaagccacg

SEQ ID NO: 119066 - DNA, 25 bp, E. coli
accgttctggaaccgcgaagccacg

SEQ ID NO: 119067 - DNA, 25 bp, E. coli
tatggattatctcaaaacccgcgca

SEQ ID NO: 119068 - DNA, 25 bp, E. coli
tatggattatctgaaaacccgcgca

SEQ ID NO: 119069 - DNA, 25 bp, E. coli
gccgggcagtttattatggattatc

SEQ ID NO: 119070 - DNA, 25 bp, E. coli
gccgggcagttttttatggattatc

SEQ ID NO: 119071 - DNA, 25 bp, E. coli
gcaaccataaccagggcgacagcgt

SEQ ID NO: 119072 - DNA, 25 bp, E. coli
gcaaccataacctgggcgacagcgt

SEQ ID NO: 119073 - DNA, 25 bp, E. coli
gacgaagacggtgcggtagtcacct

SEQ ID NO: 119074 - DNA, 25 bp, E. coli
gacgaagacggtccggtagtcacct

SEQ ID NO: 119075 - DNA, 25 bp, E. coli
cgcagccgttcagcgtaggagaaga

SEQ ID NO: 119076 - DNA, 25 bp, E. coli
cgcagccgttcaccgtaggagaaga

SEQ ID NO: 119077 - DNA, 25 bp, E. coli
cattaaccctcgaacactatccggg

SEQ ID NO: 119078 - DNA, 25 bp, E. coli
cattaaccctcgtacactatccggg

SEQ ID NO: 119079 - DNA, 25 bp, E. coli
tcagcgtaggagtagagtacccgtg

SEQ ID NO: 119080 - DNA, 25 bp, E. coli
taaggtgcgcaaccataacctgggc

SEQ ID NO: 119081 - DNA, 25 bp, E. coli
taaggtgcgcaagcataacctgggc

SEQ ID NO: 119082 - DNA, 25 bp, E. coli
tcagcgtaggagaagagtacccgtg

SEQ ID NO: 119083 - DNA, 25 bp, E. coli
caagactatgatgcgattccagagg

SEQ ID NO: 119084 - DNA, 25 bp, E. coli
aagatcgcattttggtttcacactg

SEQ ID NO: 119085 - DNA, 25 bp, E. coli
aagatcgcatttaggtttcacactg

SEQ ID NO: 119086 - DNA, 25 bp, E. coli
caagactatgatccgattccagagg

SEQ ID NO: 119087 - DNA, 25 bp, E. coli
ttcagagggatctatgactacacgc

SEQ ID NO: 119088 - DNA, 25 bp, E. coli
ttcagagggatcaatgactacacgc

SEQ ID NO: 119089 - DNA, 25 bp, E. coli
tgagcaggcggaacgctataccgac

SEQ ID NO: 119090 - DNA, 25 bp, E. coli
tgactacacgctcggaaagtttggt

SEQ ID NO: 119091 - DNA, 25 bp, E. coli
tgactacacgctgggaaagtttggt

SEQ ID NO: 119092 - DNA, 25 bp, E. coli
tgagcaggcggatcgctataccgac

SEQ ID NO: 119093 - DNA, 25 bp, E. coli
tcatcagttgatggaacctcgccgt

SEQ ID NO: 119094 - DNA, 25 bp, E. coli
tcatcagttgatcgaacctcgccgt

SEQ ID NO: 119095 - DNA, 25 bp, E. coli
gactctctcggctcttttctggata

SEQ ID NO: 119096 - DNA, 25 bp, E. coli
gactctctcggcacttttctggata

SEQ ID NO: 119097 - DNA, 25 bp, E. coli
cattgcgcgcatacttcatcagttg

SEQ ID NO: 119098 - DNA, 25 bp, E. coli
cattgcgcgcattcttcatcagttg

SEQ ID NO: 119099 - DNA, 25 bp, E. coli
gattccagaggttaagaagatcgca

SEQ ID NO: 119100 - DNA, 25 bp, E. coli
gattccagaggtaaagaagatcgca

SEQ ID NO: 119101 - DNA, 25 bp, E. coli
ggatacactctctcaaatgcccgag

SEQ ID NO: 119102 - DNA, 25 bp, E. coli
ggatacactctcacaaatgcccgag

SEQ ID NO: 119103 - DNA, 25 bp, E. coli
gagtcgatgacattctcattgcgcg

SEQ ID NO: 119104 - DNA, 25 bp, E. coli
gagtcgatgacaatctcattgcgcg

SEQ ID NO: 119105 - DNA, 25 bp, E. coli
tactcatcaaaatagccgtatcccg

SEQ ID NO: 119106 - DNA, 25 bp, E. coli
tactcatcaaaaaagccgtatcccg

SEQ ID NO: 119107 - DNA, 25 bp, E. coli
aaaaaacgctacttgcggcctgttg

SEQ ID NO: 119108 - DNA, 25 bp, E. coli
aaaaaacgctacatgcggcctgttg

SEQ ID NO: 119109 - DNA, 25 bp, E. coli
tatcccgaaaaaaacgctacttgcg

SEQ ID NO: 119110 - DNA, 25 bp, E. coli
tatcccgaaaaatacgctacttgcg

SEQ ID NO: 119111 - DNA, 25 bp, E. coli
tgttttatagcaccaacggtgctgc

SEQ ID NO: 119112 - DNA, 25 bp, E. coli
tgttttatagcagcaacggtgctgc

SEQ ID NO: 119113 - DNA, 25 bp, E. coli
tgtaccagtttactcatcaaaaaag

SEQ ID NO: 119114 - DNA, 25 bp, E. coli
tgtaccagtttagtcatcaaaaaag

SEQ ID NO: 119115 - DNA, 25 bp, E. coli
tgccctgttttatagcagcaacggt

SEQ ID NO: 119116 - DNA, 25 bp, E. coli
tgccctgttttaaagcagcaacggt

SEQ ID NO: 119117 - DNA, 25 bp, E. coli
gcctgttgtgccgtgttttatagca

SEQ ID NO: 119118 - DNA, 25 bp, E. coli
gcctgttgtgccctgttttatagca

SEQ ID NO: 119119 - DNA, 25 bp, E. coli
gctacttgcggcgtgttgtgccctg

SEQ ID NO: 119120 - DNA, 25 bp, E. coli
gctacttgcggcctgttgtgccctg

SEQ ID NO: 119121 - DNA, 25 bp, E. coli
gcggcggacaccctggaatatgaca

SEQ ID NO: 119122 - DNA, 25 bp, E. coli
gcggcggacaccgtggaatatgaca

SEQ ID NO: 119123 - DNA, 25 bp, E. coli
ctcatcaaaaaagccgtatcccgaa

SEQ ID NO: 119124 - DNA, 25 bp, E. coli
ctcatcaaaaaacccgtatcccgaa

SEQ ID NO: 119125 - DNA, 25 bp, E. coli
ggcggacaccgtcgaatatgacagt

SEQ ID NO: 119126 - DNA, 25 bp, E. coli
ggcggacaccgtggaatatgacagt

SEQ ID NO: 119127 - DNA, 25 bp, E. coli
caatcatgccgcgatatactgcggc

SEQ ID NO: 119128 - DNA, 25 bp, E. coli
caatcatgccgccatatactgcggc

SEQ ID NO: 119129 - DNA, 25 bp, E. coli
tttggcgcatcggtggccaatcatg

SEQ ID NO: 119130 - DNA, 25 bp, E. coli
tttggcgcatcgctggccaatcatg

SEQ ID NO: 119131 - DNA, 25 bp, E. coli
ttggcgcatcggaggccaatcatgc

SEQ ID NO: 119132 - DNA, 25 bp, E. coli
ttggcgcatcggtggccaatcatgc

SEQ ID NO: 119133 - DNA, 25 bp, E. coli
tgctttggcgcatcggtggccaatc

SEQ ID NO: 119134 - DNA, 25 bp, E. coli
tgctttggcgcaacggtggccaatc

SEQ ID NO: 119135 - DNA, 25 bp, E. coli
tgctgctttggcccatcggtggcca

SEQ ID NO: 119136 - DNA, 25 bp, E. coli
tgctgctttggcgcatcggtggcca

SEQ ID NO: 119137 - DNA, 25 bp, E. coli
gcgcatcggtggccaatcatgccgc

SEQ ID NO: 119138 - DNA, 25 bp, E. coli
gcgcatcggtgggcaatcatgccgc

SEQ ID NO: 119139 - DNA, 25 bp, E. coli
gctttggcgcatcggtggccaatca

SEQ ID NO: 119140 - DNA, 25 bp, E. coli
gctgctttggcgcatcggtggccaa

SEQ ID NO: 119141 - DNA, 25 bp, E. coli
gctgctttggcggatcggtggccaa

SEQ ID NO: 119142 - DNA, 25 bp, E. coli
gctttggcgcatgggtggccaatca

SEQ ID NO: 119143 - DNA, 25 bp, E. coli
ctgctttggcgcatcggtggccaat

SEQ ID NO: 119144 - DNA, 25 bp, E. coli
ctgctttggcgcttcggtggccaat

SEQ ID NO: 119145 - DNA, 25 bp, E. coli
ggcgcatcggtggccaatcatgccg

SEQ ID NO: 119146 - DNA, 25 bp, E. coli
tggcgcatcggtggccaatcatgcc

SEQ ID NO: 119147 - DNA, 25 bp, E. coli
ggcgcatcggtgcccaatcatgccg

SEQ ID NO: 119148 - DNA, 25 bp, E. coli
tggcgcatcggtcgccaatcatgcc

SEQ ID NO: 119149 - DNA, 25 bp, E. coli
aatgccgcgatgctcagcaactcct

SEQ ID NO: 119150 - DNA, 25 bp, E. coli
aatgccgcgatggtcagcaactcct

SEQ ID NO: 119151 - DNA, 25 bp, E. coli
cagaagactatgtgcgcaacctgcg

SEQ ID NO: 119152 - DNA, 25 bp, E. coli
cagaagactatgagcgcaacctgcg

SEQ ID NO: 119153 - DNA, 25 bp, E. coli
tacgcaccgacccagaaagaagtgg

SEQ ID NO: 119154 - DNA, 25 bp, E. coli
aacagctgggctatgacggcaaatc

SEQ ID NO: 119155 - DNA, 25 bp, E. coli
aacagctgggctttgacggcaaatc

SEQ ID NO: 119156 - DNA, 25 bp, E. coli
tacgcaccgaccgagaaagaagtgg

SEQ ID NO: 119157 - DNA, 25 bp, E. coli
tattccgacgcttacaacgaagccg

SEQ ID NO: 119158 - DNA, 25 bp, E. coli
tttgatcggtatggccctcggtgca

SEQ ID NO: 119159 - DNA, 25 bp, E. coli
tattccgacgctaacaacgaagccg

SEQ ID NO: 119160 - DNA, 25 bp, E. coli
tttgatcggtatcgccctcggtgca

SEQ ID NO: 119161 - DNA, 25 bp, E. coli
tccccggaaggaactgaactgctgt

SEQ ID NO: 119162 - DNA, 25 bp, E. coli
tccccggaaggatctgaactgctgt

SEQ ID NO: 119163 - DNA, 25 bp, E. coli
gccgaaaaccgataccgctcaggat

SEQ ID NO: 119164 - DNA, 25 bp, E. coli
gccgaaaaccgaaaccgctcaggat

SEQ ID NO: 119165 - DNA, 25 bp, E. coli
tcggcgtggtttccctgaacggcaa

SEQ ID NO: 119166 - DNA, 25 bp, E. coli
tcggcgtggtttgcctgaacggcaa

SEQ ID NO: 119167 - DNA, 25 bp, E. coli
gaaaaagcctgtcgtcgtgaacccg

SEQ ID NO: 119168 - DNA, 25 bp, E. coli
gaaaaagcctgtggtcgtgaacccg

SEQ ID NO: 119169 - DNA, 25 bp, E. coli
gatgccctgatgattgacctcgaag

SEQ ID NO: 119170 - DNA, 25 bp, E. coli
gatgccctgatgtttgacctcgaag

SEQ ID NO: 119171 - DNA, 25 bp, E. coli
ccgaacgcttcgctgatgagcccat

SEQ ID NO: 119172 - DNA, 25 bp, E. coli
ccgaacgcttcggtgatgagcccat

SEQ ID NO: 119173 - DNA, 25 bp, E. coli
ctaaagccggttgtcattgagatga

SEQ ID NO: 119174 - DNA, 25 bp, E. coli
ctaaagccggttctcattgagatga

SEQ ID NO: 119175 - DNA, 25 bp, E. coli
tactggccagtcatgtcagggctgg

SEQ ID NO: 119176 - DNA, 25 bp, E. coli
tactggccagtcttgtcagggctgg

SEQ ID NO: 119177 - DNA, 25 bp, E. coli
ttatgctgcacctggccctgcgtga

SEQ ID NO: 119178 - DNA, 25 bp, E. coli
ttatgctgcaccaggccctgcgtga

SEQ ID NO: 119179 - DNA, 25 bp, E. coli
tgcagccacatgaaacatttaccgg

SEQ ID NO: 119180 - DNA, 25 bp, E. coli
tgcaaaagaagtgacacagctcgct

SEQ ID NO: 119181 - DNA, 25 bp, E. coli
tgcaaaagaagtcacacagctcgct

SEQ ID NO: 119182 - DNA, 25 bp, E. coli
tgcagccacatgtaacatttaccgg

SEQ ID NO: 119183 - DNA, 25 bp, E. coli
tcttgatttgtttcaccgggcgctg

SEQ ID NO: 119184 - DNA, 25 bp, E. coli
tcttgatttgttacaccgggcgctg

SEQ ID NO: 119185 - DNA, 25 bp, E. coli
gcccggtgacgtcgaatttctgcta

SEQ ID NO: 119186 - DNA, 25 bp, E. coli
gcccggtgacgtggaatttctgcta

SEQ ID NO: 119187 - DNA, 25 bp, E. coli
cattattcggacatgctcagccagg

SEQ ID NO: 119188 - DNA, 25 bp, E. coli
cattattcggacttgctcagccagg

SEQ ID NO: 119189 - DNA, 25 bp, E. coli
gatgacgccggtagagaaaaaagaa

SEQ ID NO: 119190 - DNA, 25 bp, E. coli
gatgacgccggttgagaaaaaagaa

SEQ ID NO: 119191 - DNA, 25 bp, E. coli
tcagtccgggaacaaacattattcg

SEQ ID NO: 119192 - DNA, 25 bp, E. coli
tcagtccgggaagaaacattattcg

SEQ ID NO: 119193 - DNA, 25 bp, E. coli
cgcttcgttttggaggttgatgttt

SEQ ID NO: 119194 - DNA, 25 bp, E. coli
cgcttcgttttgcaggttgatgttt

SEQ ID NO: 119195 - DNA, 25 bp, E. coli
attggcaaaagggaaccacaggctg

SEQ ID NO: 119196 - DNA, 25 bp, E. coli
attggcaaaaggcaaccacaggctg

SEQ ID NO: 119197 - DNA, 25 bp, E. coli
aaggcaaccacacgctgcctttttc

SEQ ID NO: 119198 - DNA, 25 bp, E. coli
aaggcaaccacaggctgcctttttc

SEQ ID NO: 119199 - DNA, 25 bp, E. coli
ttggcaaaaggctaccacaggctgc

SEQ ID NO: 119200 - DNA, 25 bp, E. coli
ttggcaaaaggcaaccacaggctgc

SEQ ID NO: 119201 - DNA, 25 bp, E. coli
tgtttgttatcagcactgaacgaaa

SEQ ID NO: 119202 - DNA, 25 bp, E. coli
tgtttgttatcaccactgaacgaaa

SEQ ID NO: 119203 - DNA, 25 bp, E. coli
tgcgcttcgttttgcaggttgatgt

SEQ ID NO: 119204 - DNA, 25 bp, E. coli
tgcgcttcgtttagcaggttgatgt

SEQ ID NO: 119205 - DNA, 25 bp, E. coli
gcaaccacaggcagcctttttcttt

SEQ ID NO: 119206 - DNA, 25 bp, E. coli
gcaaccacaggctgcctttttcttt

SEQ ID NO: 119207 - DNA, 25 bp, E. coli
cgttttgcaggttgatgtttgttat

SEQ ID NO: 119208 - DNA, 25 bp, E. coli
cgttttgcaggtagatgtttgttat

SEQ ID NO: 119209 - DNA, 25 bp, E. coli
ggttgatgtttgatatcagcactga

SEQ ID NO: 119210 - DNA, 25 bp, E. coli
ggttgatgtttgttatcagcactga

SEQ ID NO: 119211 - DNA, 25 bp, E. coli
ggcaaaaggcaagcacaggctgcct

SEQ ID NO: 119212 - DNA, 25 bp, E. coli
ggcaaaaggcaaccacaggctgcct

SEQ ID NO: 119213 - DNA, 25 bp, E. coli
gatgtttgttatcagcactgaacga

SEQ ID NO: 119214 - DNA, 25 bp, E. coli
gatgtttgttatgagcactgaacga

SEQ ID NO: 119215 - DNA, 25 bp, E. coli
taactatcgccgtaatggtatgagc

SEQ ID NO: 119216 - DNA, 25 bp, E. coli
taactatcgccgaaatggtatgagc

SEQ ID NO: 119217 - DNA, 25 bp, E. coli
tattctgacgaagtacggcaagcca

SEQ ID NO: 119218 - DNA, 25 bp, E. coli
tattctgacgaactacggcaagcca

SEQ ID NO: 119219 - DNA, 25 bp, E. coli
tgtaaagcgcatcacgcatcatctg

SEQ ID NO: 119220 - DNA, 25 bp, E. coli
tgtaaagcgcatgacgcatcatctg

SEQ ID NO: 119221 - DNA, 25 bp, E. coli
gccggtgtcatcgtgccgaagatcg

SEQ ID NO: 119222 - DNA, 25 bp, E. coli
gccggtgtcatcctgccgaagatcg

SEQ ID NO: 119223 - DNA, 25 bp, E. coli
gccgaccaacgattgtccgtgaggt

SEQ ID NO: 119224 - DNA, 25 bp, E. coli
gccgaccaacgaatgtccgtgaggt

SEQ ID NO: 119225 - DNA, 25 bp, E. coli
gcgactgggttgtagagcctaacta

SEQ ID NO: 119226 - DNA, 25 bp, E. coli
gcgtcgagcgcaacggcaaaaagct

SEQ ID NO: 119227 - DNA, 25 bp, E. coli
gcgactgggttgaagagcctaacta

SEQ ID NO: 119228 - DNA, 25 bp, E. coli
gcgtcgagcgcatcggcaaaaagct

SEQ ID NO: 119229 - DNA, 25 bp, E. coli
cgacgaatttaaacactggtgggca

SEQ ID NO: 119230 - DNA, 25 bp, E. coli
cgacgaatttaatcactggtgggca

SEQ ID NO: 119231 - DNA, 25 bp, E. coli
ctggagaaaagtggtcgccgcttgc

SEQ ID NO: 119232 - DNA, 25 bp, E. coli
ctggagaaaagtcgtcgccgcttgc

SEQ ID NO: 119233 - DNA, 25 bp, E. coli
gattaatcatgagttccgccagctg

SEQ ID NO: 119234 - DNA, 25 bp, E. coli
gattaatcatgacttccgccagctg

SEQ ID NO: 119235 - DNA, 25 bp, E. coli
ggcgctggcgtttaagaaaatgcat

SEQ ID NO: 119236 - DNA, 25 bp, E. coli
ggcgctggcgttaaagaaaatgcat

SEQ ID NO: 119237 - DNA, 25 bp, E. coli
catgcgcacgttcgaatcttcagct

SEQ ID NO: 119238 - DNA, 25 bp, E. coli
catgcgcacgttggaatcttcagct

SEQ ID NO: 119239 - DNA, 25 bp, E. coli
aaatatacctccagacatgcgcacg

SEQ ID NO: 119240 - DNA, 25 bp, E. coli
aaatatacctcctgacatgcgcacg

SEQ ID NO: 119241 - DNA, 25 bp, E. coli
taggtcgggatacgcttattgcaag

SEQ ID NO: 119242 - DNA, 25 bp, E. coli
taggtcgggataggcttattgcaag

SEQ ID NO: 119243 - DNA, 25 bp, E. coli
tcgctaaacgatttggtctctgtgg

SEQ ID NO: 119244 - DNA, 25 bp, E. coli
tcgctaaacgatatggtctctgtgg

SEQ ID NO: 119245 - DNA, 25 bp, E. coli
tcagctgttgtatttggccagaggg

SEQ ID NO: 119246 - DNA, 25 bp, E. coli
tcagctgttgtaattggccagaggg

SEQ ID NO: 119247 - DNA, 25 bp, E. coli
tctcaggctggatgcatttggacgt

SEQ ID NO: 119248 - DNA, 25 bp, E. coli
tctcaggctggaagcatttggacgt

SEQ ID NO: 119249 - DNA, 25 bp, E. coli
gcgggagtaccaccaaaaatcataa

SEQ ID NO: 119250 - DNA, 25 bp, E. coli
gcgggagtaccagcaaaaatcataa

SEQ ID NO: 119251 - DNA, 25 bp, E. coli
gaatgtgacggttttgcctggaaca

SEQ ID NO: 119252 - DNA, 25 bp, E. coli
gaatgtgacggtattgcctggaaca

SEQ ID NO: 119253 - DNA, 25 bp, E. coli
tcaattgagagccttacgataggtc

SEQ ID NO: 119254 - DNA, 25 bp, E. coli
taatggagtcgttgtcggcgccaat

SEQ ID NO: 119255 - DNA, 25 bp, E. coli
tcacaagtggagacggtctcaggct

SEQ ID NO: 119256 - DNA, 25 bp, E. coli
tcaattgagagcgttacgataggtc

SEQ ID NO: 119257 - DNA, 25 bp, E. coli
taatggagtcgtagtcggcgccaat

SEQ ID NO: 119258 - DNA, 25 bp, E. coli
tcacaagtggagtcggtctcaggct

SEQ ID NO: 119259 - DNA, 25 bp, E. coli
aattcgtgatgttcgcactggaccc

SEQ ID NO: 119260 - DNA, 25 bp, E. coli
aattcgtgatgtacgcactggaccc

SEQ ID NO: 119261 - DNA, 25 bp, E. coli
caggaaaaggataatctgcgccgct

SEQ ID NO: 119262 - DNA, 25 bp, E. coli
caggaaaaggattatctgcgccgct

SEQ ID NO: 119263 - DNA, 25 bp, E. coli
tacgttctcaccgacgagtccagtg

SEQ ID NO: 119264 - DNA, 25 bp, E. coli
tacgttctcacccacgagtccagtg

SEQ ID NO: 119265 - DNA, 25 bp, E. coli
aaattacagggcaaactggtgcgtc

SEQ ID NO: 119266 - DNA, 25 bp, E. coli
aaattacagggctaactggtgcgtc

SEQ ID NO: 119267 - DNA, 25 bp, E. coli
tattttaacggacagagggcagcga

SEQ ID NO: 119268 - DNA, 25 bp, E. coli
tattttaacggagagagggcagcga

SEQ ID NO: 119269 - DNA, 25 bp, E. coli
tgatgatctctcaaaagtgaccgac

SEQ ID NO: 119270 - DNA, 25 bp, E. coli
tgctctgggcgaaaacaatcagcgc

SEQ ID NO: 119271 - DNA, 25 bp, E. coli
tgatgatctctctaaagtgaccgac

SEQ ID NO: 119272 - DNA, 25 bp, E. coli
tgctctgggcgataacaatcagcgc

SEQ ID NO: 119273 - DNA, 25 bp, E. coli
tcattgtgatgaccgtcaacggcga

SEQ ID NO: 119274 - DNA, 25 bp, E. coli
tcattgtgatgagcgtcaacggcga

SEQ ID NO: 119275 - DNA, 25 bp, E. coli
gcggcatggccttctataacagcga

SEQ ID NO: 119276 - DNA, 25 bp, E. coli
gcggcatggcctactataacagcga

SEQ ID NO: 119277 - DNA, 25 bp, E. coli
cccgcgcggtggagatgaaattaat

SEQ ID NO: 119278 - DNA, 25 bp, E. coli
cccgcgcggtggtgatgaaattaat

SEQ ID NO: 119279 - DNA, 25 bp, E. coli
gtatgttaatcactctgcgcggcgg

SEQ ID NO: 119280 - DNA, 25 bp, E. coli
gtatgttaatcagtctgcgcggcgg

SEQ ID NO: 119281 - DNA, 25 bp, E. coli
taaacacgcgccctattcggcgaac

SEQ ID NO: 119282 - DNA, 25 bp, E. coli
taaacacgcgccgtattcggcgaac

SEQ ID NO: 119283 - DNA, 25 bp, E. coli
tattgccagatataaacacgcgccg

SEQ ID NO: 119284 - DNA, 25 bp, E. coli
tattgccagataaaaacacgcgccg

SEQ ID NO: 119285 - DNA, 25 bp, E. coli
ttgttgcacggtcagccgctatggc

SEQ ID NO: 119286 - DNA, 25 bp, E. coli
ttgttgcacggtgagccgctatggc

SEQ ID NO: 119287 - DNA, 25 bp, E. coli
tgctattgccagatataaacacgcg

SEQ ID NO: 119288 - DNA, 25 bp, E. coli
tgctattgccagttataaacacgcg

SEQ ID NO: 119289 - DNA, 25 bp, E. coli
tcgggcctcattcaacgcattaatg

SEQ ID NO: 119290 - DNA, 25 bp, E. coli
tcgggcctcattgaacgcattaatg

SEQ ID NO: 119291 - DNA, 25 bp, E. coli
gcgcgctttttaaactgctattgcc

SEQ ID NO: 119292 - DNA, 25 bp, E. coli
gccgtattcggcgaacgacctataa

SEQ ID NO: 119293 - DNA, 25 bp, E. coli
gccgtattcggccaacgacctataa

SEQ ID NO: 119294 - DNA, 25 bp, E. coli
ccaaaatcgggcgtcattgaacgca

SEQ ID NO: 119295 - DNA, 25 bp, E. coli
gccagatataaagacgcgccgtatt

SEQ ID NO: 119296 - DNA, 25 bp, E. coli
gccagatataaacacgcgccgtatt

SEQ ID NO: 119297 - DNA, 25 bp, E. coli
gcgcgctttttatactgctattgcc

SEQ ID NO: 119298 - DNA, 25 bp, E. coli
ccaaaatcgggcctcattgaacgca

SEQ ID NO: 119299 - DNA, 25 bp, E. coli
cgcattaatgttgtgttgttgcacg

SEQ ID NO: 119300 - DNA, 25 bp, E. coli
cgcattaatgttctgttgttgcacg

SEQ ID NO: 119301 - DNA, 25 bp, E. coli
ggtgagccgctaaggcgcgcttttt

SEQ ID NO: 119302 - DNA, 25 bp, E. coli
ggtgagccgctatggcgcgcttttt

SEQ ID NO: 119303 - DNA, 25 bp, E. coli
aacggtgtcatgacgccagtaatgg

SEQ ID NO: 119304 - DNA, 25 bp, E. coli
aattcttcgcggttaagcagcgctg

SEQ ID NO: 119305 - DNA, 25 bp, E. coli
aattcttcgcggataagcagcgctg

SEQ ID NO: 119306 - DNA, 25 bp, E. coli
cactgattgaggtaggatatacgga

SEQ ID NO: 119307 - DNA, 25 bp, E. coli
cactgattgaggaaggatatacgga

SEQ ID NO: 119308 - DNA, 25 bp, E. coli
cagacctgcgagaatggcgtatcgg

SEQ ID NO: 119309 - DNA, 25 bp, E. coli
cagacctgcgagtatggcgtatcgg

SEQ ID NO: 119310 - DNA, 25 bp, E. coli
aaatggctggcggatgaaaacttcg

SEQ ID NO: 119311 - DNA, 25 bp, E. coli
aaatggctggcgcatgaaaacttcg

SEQ ID NO: 119312 - DNA, 25 bp, E. coli
aacggtgtcatgtcgccagtaatgg

SEQ ID NO: 119313 - DNA, 25 bp, E. coli
tttgcagtcagtttgcccgcagcga

SEQ ID NO: 119314 - DNA, 25 bp, E. coli
ttaacagtcacaatggcagctccgg

SEQ ID NO: 119315 - DNA, 25 bp, E. coli
ttaacagtcacattggcagctccgg

SEQ ID NO: 119316 - DNA, 25 bp, E. coli
tttgcagtcagtatgcccgcagcga

SEQ ID NO: 119317 - DNA, 25 bp, E. coli
tcggattgcgaataccggaatgcga

SEQ ID NO: 119318 - DNA, 25 bp, E. coli
tcatgctcgcatcggctgttgtgag

SEQ ID NO: 119319 - DNA, 25 bp, E. coli
tcatgctcgcatgggctgttgtgag

SEQ ID NO: 119320 - DNA, 25 bp, E. coli
tcggattgcgaaaaccggaatgcga

SEQ ID NO: 119321 - DNA, 25 bp, E. coli
ccagaattgccaacagcggcgacaa

SEQ ID NO: 119322 - DNA, 25 bp, E. coli
ccagaattgccatcagcggcgacaa

SEQ ID NO: 119323 - DNA, 25 bp, E. coli
taatggtgacctcgtgcaaatcgcc

SEQ ID NO: 119324 - DNA, 25 bp, E. coli
taatggtgacctggtgcaaatcgcc

SEQ ID NO: 119325 - DNA, 25 bp, E. coli
caaaacctgttgcatattgaaaact

SEQ ID NO: 119326 - DNA, 25 bp, E. coli
caaagccacaggttcagcagactga

SEQ ID NO: 119327 - DNA, 25 bp, E. coli
caaagccacaggatcagcagactga

SEQ ID NO: 119328 - DNA, 25 bp, E. coli
caaaacctgttggatattgaaaact

SEQ ID NO: 119329 - DNA, 25 bp, E. coli
agatgtgacgcaagatacgttgttc

SEQ ID NO: 119330 - DNA, 25 bp, E. coli
agatgtgacgcatgatacgttgttc

SEQ ID NO: 119331 - DNA, 25 bp, E. coli
tgaaaacttaaacgttgatgatctt

SEQ ID NO: 119332 - DNA, 25 bp, E. coli
tgaaaacttaaaggttgatgatctt

SEQ ID NO: 119333 - DNA, 25 bp, E. coli
tcgcgatagtccgaaaaaggcaatc

SEQ ID NO: 119334 - DNA, 25 bp, E. coli
tcgcgatagtcccaaaaaggcaatc

SEQ ID NO: 119335 - DNA, 25 bp, E. coli
tcagcagactgaagatgtgacgcaa

SEQ ID NO: 119336 - DNA, 25 bp, E. coli
gcagactgaagatgtgacgcaagat

SEQ ID NO: 119337 - DNA, 25 bp, E. coli
gcagactgaagaagtgacgcaagat

SEQ ID NO: 119338 - DNA, 25 bp, E. coli
gactgaagatgtcacgcaagatacg

SEQ ID NO: 119339 - DNA, 25 bp, E. coli
gactgaagatgtgacgcaagatacg

SEQ ID NO: 119340 - DNA, 25 bp, E. coli
cgcaggtggcaaagccacaggttca

SEQ ID NO: 119341 - DNA, 25 bp, E. coli
cgatagtccgaaaaaggcaatcacc

SEQ ID NO: 119342 - DNA, 25 bp, E. coli
cgatagtccgaataaggcaatcacc

SEQ ID NO: 119343 - DNA, 25 bp, E. coli
cgcaggtggcaatgccacaggttca

SEQ ID NO: 119344 - DNA, 25 bp, E. coli
tggcaaagccactggttcagcagac

SEQ ID NO: 119345 - DNA, 25 bp, E. coli
tggcaaagccacaggttcagcagac

SEQ ID NO: 119346 - DNA, 25 bp, E. coli
tcagcagactgatgatgtgacgcaa

SEQ ID NO: 119347 - DNA, 25 bp, E. coli
aaaaatacgcgttccgataggctgc

SEQ ID NO: 119348 - DNA, 25 bp, E. coli
aaaaatacgcgtaccgataggctgc

SEQ ID NO: 119349 - DNA, 25 bp, E. coli
ttacgcgacgtggaccggagttgtc

SEQ ID NO: 119350 - DNA, 25 bp, E. coli
tttttgaccttagcacgcggaattg

SEQ ID NO: 119351 - DNA, 25 bp, E. coli
ttacgcgacgtgcaccggagttgtc

SEQ ID NO: 119352 - DNA, 25 bp, E. coli
tttttgaccttaccacgcggaattg

SEQ ID NO: 119353 - DNA, 25 bp, E. coli
tgtcggcgacgttcagcatagtctg

SEQ ID NO: 119354 - DNA, 25 bp, E. coli
tgtcggcgacgtacagcatagtctg

SEQ ID NO: 119355 - DNA, 25 bp, E. coli
tcgaagcgaatgtcagaaccgtccg

SEQ ID NO: 119356 - DNA, 25 bp, E. coli
tcgaagcgaatgacagaaccgtccg

SEQ ID NO: 119357 - DNA, 25 bp, E. coli
tctggtgccagacagataattttca

SEQ ID NO: 119358 - DNA, 25 bp, E. coli
tctggtgccagagagataattttca

SEQ ID NO: 119359 - DNA, 25 bp, E. coli
gctcacgagttagcggcccaaaaat

SEQ ID NO: 119360 - DNA, 25 bp, E. coli
gctcacgagttaccggcccaaaaat

SEQ ID NO: 119361 - DNA, 25 bp, E. coli
gaaccttgatactcattacgcgacg

SEQ ID NO: 119362 - DNA, 25 bp, E. coli
gaaccttgatacacattacgcgacg

SEQ ID NO: 119363 - DNA, 25 bp, E. coli
gaacacaagcattaccatcgaagcg

SEQ ID NO: 119364 - DNA, 25 bp, E. coli
gacgaacacccttcttggtgcgcac

SEQ ID NO: 119365 - DNA, 25 bp, E. coli
gaacacaagcataaccatcgaagcg

SEQ ID NO: 119366 - DNA, 25 bp, E. coli
gatcttgatgatctcgcctacgcct

SEQ ID NO: 119367 - DNA, 25 bp, E. coli
gacgaacaccctacttggtgcgcac

SEQ ID NO: 119368 - DNA, 25 bp, E. coli
gatcttgatgatgtcgcctacgcct

SEQ ID NO: 119369 - DNA, 25 bp, E. coli
caactggtacatcgtgggcctggtc

SEQ ID NO: 119370 - DNA, 25 bp, E. coli
caactggtacatggtgggcctggtc

SEQ ID NO: 119371 - DNA, 25 bp, E. coli
aaggtcttgatatggcggctgcccg

SEQ ID NO: 119372 - DNA, 25 bp, E. coli
aaggtcttgataaggcggctgcccg

SEQ ID NO: 119373 - DNA, 25 bp, E. coli
taactacgggctcgaaagcttgcgt

SEQ ID NO: 119374 - DNA, 25 bp, E. coli
tattttgaggaggtacaaccaggcg

SEQ ID NO: 119375 - DNA, 25 bp, E. coli
tatgacctttatggaacgtgcggcg

SEQ ID NO: 119376 - DNA, 25 bp, E. coli
tatgacctttatcgaacgtgcggcg

SEQ ID NO: 119377 - DNA, 25 bp, E. coli
tagtggtcttgtacccgaaggcgca

SEQ ID NO: 119378 - DNA, 25 bp, E. coli
tagtggtcttgttcccgaaggcgca

SEQ ID NO: 119379 - DNA, 25 bp, E. coli
tattttgaggagctacaaccaggcg

SEQ ID NO: 119380 - DNA, 25 bp, E. coli
tatcagtaaacactgggtgcgcggt

SEQ ID NO: 119381 - DNA, 25 bp, E. coli
tatcagtaaacagtgggtgcgcggt

SEQ ID NO: 119382 - DNA, 25 bp, E. coli
tttatcgaacccctaaagccaggcg

SEQ ID NO: 119383 - DNA, 25 bp, E. coli
tttatcgaacccgtaaagccaggcg

SEQ ID NO: 119384 - DNA, 25 bp, E. coli
ttcaatcagcatgaaaccccggtgg

SEQ ID NO: 119385 - DNA, 25 bp, E. coli
ttcaatcagcatcaaaccccggtgg

SEQ ID NO: 119386 - DNA, 25 bp, E. coli
tgagatgaccactaaagccgggcaa

SEQ ID NO: 119387 - DNA, 25 bp, E. coli
tgagatgaccacaaaagccgggcaa

SEQ ID NO: 119388 - DNA, 25 bp, E. coli
tggaaaagctgggaccaacgtggct

SEQ ID NO: 119389 - DNA, 25 bp, E. coli
tggaaaagctggcaccaacgtggct

SEQ ID NO: 119390 - DNA, 25 bp, E. coli
taactacgggctggaaagcttgcgt

SEQ ID NO: 119391 - DNA, 25 bp, E. coli
aatggcagggcgatatcaaagcggt

SEQ ID NO: 119392 - DNA, 25 bp, E. coli
aatggcagggcgttatcaaagcggt

SEQ ID NO: 119393 - DNA, 25 bp, E. coli
caaaaccgtcgtaaatggcagggcg

SEQ ID NO: 119394 - DNA, 25 bp, E. coli
caaagcggtagacggtgaaatgatc

SEQ ID NO: 119395 - DNA, 25 bp, E. coli
caaaaccgtcgttaatggcagggcg

SEQ ID NO: 119396 - DNA, 25 bp, E. coli
caaagcggtagagggtgaaatgatc

SEQ ID NO: 119397 - DNA, 25 bp, E. coli
tataacctggaactctcctcaccgg

SEQ ID NO: 119398 - DNA, 25 bp, E. coli
tataacctggaagtctcctcaccgg

SEQ ID NO: 119399 - DNA, 25 bp, E. coli
tgttcacggctgaacactacgcccg

SEQ ID NO: 119400 - DNA, 25 bp, E. coli
tgttcacggctgtacactacgcccg

SEQ ID NO: 119401 - DNA, 25 bp, E. coli
tacgcccgttttctcggagaagagg

SEQ ID NO: 119402 - DNA, 25 bp, E. coli
tacgcccgttttgtcggagaagagg

SEQ ID NO: 119403 - DNA, 25 bp, E. coli
tccgtatggcggaacaaaaccgtcg

SEQ ID NO: 119404 - DNA, 25 bp, E. coli
tccgtatggcggtacaaaaccgtcg

SEQ ID NO: 119405 - DNA, 25 bp, E. coli
gaaatgatcacacttaccgtcgaag

SEQ ID NO: 119406 - DNA, 25 bp, E. coli
gaaatgatcacagttaccgtcgaag

SEQ ID NO: 119407 - DNA, 25 bp, E. coli
gattactgcgccagttgaggccctg

SEQ ID NO: 119408 - DNA, 25 bp, E. coli
gattgtgctgatctgagccaccagg

SEQ ID NO: 119409 - DNA, 25 bp, E. coli
gattactgcgcctgttgaggccctg

SEQ ID NO: 119410 - DNA, 25 bp, E. coli
gattgtgctgatgtgagccaccagg

SEQ ID NO: 119411 - DNA, 25 bp, E. coli
ggtgactctggtactccgtatggcg

SEQ ID NO: 119412 - DNA, 25 bp, E. coli
ggtgactctggttctccgtatggcg

SEQ ID NO: 119413 - DNA, 25 bp, E. coli
caaactgcatgatggctgggaaaac

SEQ ID NO: 119414 - DNA, 25 bp, E. coli
caaactgcatgaaggctgggaaaac

SEQ ID NO: 119415 - DNA, 25 bp, E. coli
tacaccgttcactagctggaaagcg

SEQ ID NO: 119416 - DNA, 25 bp, E. coli
tacaccgttcacaagctggaaagcg

SEQ ID NO: 119417 - DNA, 25 bp, E. coli
tttgaacccgtctggattggctgga

SEQ ID NO: 119418 - DNA, 25 bp, E. coli
tttgaacccgtcaggattggctgga

SEQ ID NO: 119419 - DNA, 25 bp, E. coli
ttatcaatggcgaactcggtggttc

SEQ ID NO: 119420 - DNA, 25 bp, E. coli
ttatcaatggcgtactcggtggttc

SEQ ID NO: 119421 - DNA, 25 bp, E. coli
tgattggcgtggacgacacgtttcc

SEQ ID NO: 119422 - DNA, 25 bp, E. coli
tgattggcgtggtcgacacgtttcc

SEQ ID NO: 119423 - DNA, 25 bp, E. coli
tgacgcgcctgaagtttatcaatgg

SEQ ID NO: 119424 - DNA, 25 bp, E. coli
tgacgcgcctgatgtttatcaatgg

SEQ ID NO: 119425 - DNA, 25 bp, E. coli
tctcgacgaacatgaagccattacc

SEQ ID NO: 119426 - DNA, 25 bp, E. coli
tctcgacgaacaagaagccattacc

SEQ ID NO: 119427 - DNA, 25 bp, E. coli
gcaacgttttctggatagtggcgcg

SEQ ID NO: 119428 - DNA, 25 bp, E. coli
gcaacgttttctcgatagtggcgcg

SEQ ID NO: 119429 - DNA, 25 bp, E. coli
gaacaagtctttgcggtcgcgcctc

SEQ ID NO: 119430 - DNA, 25 bp, E. coli
gaacaagtctttccggtcgcgcctc

SEQ ID NO: 119431 - DNA, 25 bp, E. coli
taatcgagaagaaagtggtcgccca

SEQ ID NO: 119432 - DNA, 25 bp, E. coli
taatcgagaagatagtggtcgccca

SEQ ID NO: 119433 - DNA, 25 bp, E. coli
gatgatcctcgaagccttagaaaaa

SEQ ID NO: 119434 - DNA, 25 bp, E. coli
gatgatcctcgatgccttagaaaaa

SEQ ID NO: 119435 - DNA, 25 bp, E. coli
aagcgattaacccaccgtgaccgcg

SEQ ID NO: 119436 - DNA, 25 bp, E. coli
aagcgattaaccgaccgtgaccgcg

SEQ ID NO: 119437 - DNA, 25 bp, E. coli
catggaagacacaggaaacagggca

SEQ ID NO: 119438 - DNA, 25 bp, E. coli
catggaagacactggaaacagggca

SEQ ID NO: 119439 - DNA, 25 bp, E. coli
taaagataaagcctcaggacgcgca

SEQ ID NO: 119440 - DNA, 25 bp, E. coli
taaagataaagcgtcaggacgcgca

SEQ ID NO: 119441 - DNA, 25 bp, E. coli
acgcgcagaacgcatcacagcgaag

SEQ ID NO: 119442 - DNA, 25 bp, E. coli
acgcgcagaacggatcacagcgaag

SEQ ID NO: 119443 - DNA, 25 bp, E. coli
tatggaatgtttccgcaatcgctga

SEQ ID NO: 119444 - DNA, 25 bp, E. coli
tatggaatgtttgcgcaatcgctga

SEQ ID NO: 119445 - DNA, 25 bp, E. coli
ttatccgtggacttataaggcagcg

SEQ ID NO: 119446 - DNA, 25 bp, E. coli
ttatccgtggacatataaggcagcg

SEQ ID NO: 119447 - DNA, 25 bp, E. coli
tgaatgagcgggtacaaaaccgcct

SEQ ID NO: 119448 - DNA, 25 bp, E. coli
tgaatgagcgggaacaaaaccgcct

SEQ ID NO: 119449 - DNA, 25 bp, E. coli
gacacaggaaacagggcataaagat

SEQ ID NO: 119450 - DNA, 25 bp, E. coli
gacacaggaaactgggcataaagat

SEQ ID NO: 119451 - DNA, 25 bp, E. coli
ccgtgaccgcgaggttatggaatgt

SEQ ID NO: 119452 - DNA, 25 bp, E. coli
ccgtgaccgcgacgttatggaatgt

SEQ ID NO: 119453 - DNA, 25 bp, E. coli
taaggcagcgtgtcgcatggaagac

SEQ ID NO: 119454 - DNA, 25 bp, E. coli
tcacagcgaagccattaaccgaccg

SEQ ID NO: 119455 - DNA, 25 bp, E. coli
taaggcagcgtgacgcatggaagac

SEQ ID NO: 119456 - DNA, 25 bp, E. coli
tcacagcgaagcgattaaccgaccg

SEQ ID NO: 119457 - DNA, 25 bp, E. coli
caagcaaacacaacacgcagtaaac

SEQ ID NO: 119458 - DNA, 25 bp, E. coli
caacaaaaaactcatgtgctggcag

SEQ ID NO: 119459 - DNA, 25 bp, E. coli
caacaaaaaactgatgtgctggcag

SEQ ID NO: 119460 - DNA, 25 bp, E. coli
caagcaaacacatcacgcagtaaac

SEQ ID NO: 119461 - DNA, 25 bp, E. coli
ctatacttccacaaagcgccgaacg

SEQ ID NO: 119462 - DNA, 25 bp, E. coli
ctatacttccactaagcgccgaacg

SEQ ID NO: 119463 - DNA, 25 bp, E. coli
tgtgctggcagtaaacggtgaaatc

SEQ ID NO: 119464 - DNA, 25 bp, E. coli
tgtgctggcagttaacggtgaaatc

SEQ ID NO: 119465 - DNA, 25 bp, E. coli
cccgtcaaaaattatcgatccatca

SEQ ID NO: 119466 - DNA, 25 bp, E. coli
cccgtcaaaaataatcgatccatca

SEQ ID NO: 119467 - DNA, 25 bp, E. coli
cgctaaagagttgcatgaagagacg

SEQ ID NO: 119468 - DNA, 25 bp, E. coli
cgctaaagagttccatgaagagacg

SEQ ID NO: 119469 - DNA, 25 bp, E. coli
cgcagtaaacaccaggttaacggag

SEQ ID NO: 119470 - DNA, 25 bp, E. coli
cgcagtaaacacgaggttaacggag

SEQ ID NO: 119471 - DNA, 25 bp, E. coli
tggcgttcaccagtcggcatataaa

SEQ ID NO: 119472 - DNA, 25 bp, E. coli
tggcgttcaccactcggcatataaa

SEQ ID NO: 119473 - DNA, 25 bp, E. coli
tcaatcagcaatcgccattacgttt

SEQ ID NO: 119474 - DNA, 25 bp, E. coli
tcaataaatatacccaaaagccctc

SEQ ID NO: 119475 - DNA, 25 bp, E. coli
tcaatcagcaatggccattacgttt

SEQ ID NO: 119476 - DNA, 25 bp, E. coli
tcaataaatatagccaaaagccctc

SEQ ID NO: 119477 - DNA, 25 bp, E. coli
gacgaagtgtttggcggttatctat

SEQ ID NO: 119478 - DNA, 25 bp, E. coli
gacgaagtgtttcgcggttatctat

SEQ ID NO: 119479 - DNA, 25 bp, E. coli
caatcatgctctattatggccgtaa

SEQ ID NO: 119480 - DNA, 25 bp, E. coli
caatcatgctcttttatggccgtaa

SEQ ID NO: 119481 - DNA, 25 bp, E. coli
cttcaattcgtttataaaggtgatt

SEQ ID NO: 119482 - DNA, 25 bp, E. coli
cttcaattcgttaataaaggtgatt

SEQ ID NO: 119483 - DNA, 25 bp, E. coli
actacctggtgaagcgtcgagtaac

SEQ ID NO: 119484 - DNA, 25 bp, E. coli
actacctggtgatgcgtcgagtaac

SEQ ID NO: 119485 - DNA, 25 bp, E. coli
cctggtgaagcgacgagtaactatg

SEQ ID NO: 119486 - DNA, 25 bp, E. coli
cctggtgaagcgtcgagtaactatg

SEQ ID NO: 119487 - DNA, 25 bp, E. coli
gcgtcgagtaactatgatgcttcaa

SEQ ID NO: 119488 - DNA, 25 bp, E. coli
gctgttcagctttatcacaatcatg

SEQ ID NO: 119489 - DNA, 25 bp, E. coli
gctgttcagcttaatcacaatcatg

SEQ ID NO: 119490 - DNA, 25 bp, E. coli
gcgtcgagtaacaatgatgcttcaa

SEQ ID NO: 119491 - DNA, 25 bp, E. coli
gtgaagcgtcgagtaactatgatgc

SEQ ID NO: 119492 - DNA, 25 bp, E. coli
ggtgattatacaatagctgttcagc

SEQ ID NO: 119493 - DNA, 25 bp, E. coli
ggtgattatacattagctgttcagc

SEQ ID NO: 119494 - DNA, 25 bp, E. coli
gtgaagcgtcgactaactatgatgc

SEQ ID NO: 119495 - DNA, 25 bp, E. coli
tcacaatcatgcacttttatggccg

SEQ ID NO: 119496 - DNA, 25 bp, E. coli
taatatttatggtgactacctggtg

SEQ ID NO: 119497 - DNA, 25 bp, E. coli
tcacaatcatgctcttttatggccg

SEQ ID NO: 119498 - DNA, 25 bp, E. coli
taatatttatggagactacctggtg

SEQ ID NO: 119499 - DNA, 25 bp, E. coli
gagtaactatgaagcttcaattcgt

SEQ ID NO: 119500 - DNA, 25 bp, E. coli
gagtaactatgatgcttcaattcgt

SEQ ID NO: 119501 - DNA, 25 bp, E. coli
tacactttgcgaaacgctgttgcga

SEQ ID NO: 119502 - DNA, 25 bp, E. coli
tacactttgcgatacgctgttgcga

SEQ ID NO: 119503 - DNA, 25 bp, E. coli
aaacgctgttgccattgaccgctgg

SEQ ID NO: 119504 - DNA, 25 bp, E. coli
aagagattgcaaacctttggttaca

SEQ ID NO: 119505 - DNA, 25 bp, E. coli
aagagattgcaatcctttggttaca

SEQ ID NO: 119506 - DNA, 25 bp, E. coli
aaacgctgttgcgattgaccgctgg

SEQ ID NO: 119507 - DNA, 25 bp, E. coli
tttggttacactatgcgaaacgctg

SEQ ID NO: 119508 - DNA, 25 bp, E. coli
tttggttacactttgcgaaacgctg

SEQ ID NO: 119509 - DNA, 25 bp, E. coli
ttgaccgctggtcgcgtttggcttc

SEQ ID NO: 119510 - DNA, 25 bp, E. coli
ttgaccgctggtggcgtttggcttc

SEQ ID NO: 119511 - DNA, 25 bp, E. coli
tgcgaaacgctgttgcgattgaccg

SEQ ID NO: 119512 - DNA, 25 bp, E. coli
tgcgaaacgctgatgcgattgaccg

SEQ ID NO: 119513 - DNA, 25 bp, E. coli
tcatcgtgggaatgtgagccaaacg

SEQ ID NO: 119514 - DNA, 25 bp, E. coli
tcatcgtgggaaagtgagccaaacg

SEQ ID NO: 119515 - DNA, 25 bp, E. coli
tggcgtttggcttcaggttgctaaa

SEQ ID NO: 119516 - DNA, 25 bp, E. coli
ggaatgtgagcctaacgcaaataag

SEQ ID NO: 119517 - DNA, 25 bp, E. coli
tggcttcaggttgctaaagtggtga

SEQ ID NO: 119518 - DNA, 25 bp, E. coli
tggcgtttggctacaggttgctaaa

SEQ ID NO: 119519 - DNA, 25 bp, E. coli
ggaatgtgagccaaacgcaaataag

SEQ ID NO: 119520 - DNA, 25 bp, E. coli
tggcttcaggttcctaaagtggtga

SEQ ID NO: 119521 - DNA, 25 bp, E. coli
gagccaaacgcatataagtaagaca

SEQ ID NO: 119522 - DNA, 25 bp, E. coli
gagccaaacgcaaataagtaagaca

SEQ ID NO: 119523 - DNA, 25 bp, E. coli
aaggcaaagcgcgactgtctcagca

SEQ ID NO: 119524 - DNA, 25 bp, E. coli
aagagtcagagtaactggaagcgca

SEQ ID NO: 119525 - DNA, 25 bp, E. coli
aaggcaaagcgccactgtctcagca

SEQ ID NO: 119526 - DNA, 25 bp, E. coli
aagagtcagagttactggaagcgca

SEQ ID NO: 119527 - DNA, 25 bp, E. coli
cagaaaggcaaagcgcgactgtctc

SEQ ID NO: 119528 - DNA, 25 bp, E. coli
cagaaaggcaaaccgcgactgtctc

SEQ ID NO: 119529 - DNA, 25 bp, E. coli
aaagcgcgactgactcagcaggaag

SEQ ID NO: 119530 - DNA, 25 bp, E. coli
aaagcgcgactgtctcagcaggaag

SEQ ID NO: 119531 - DNA, 25 bp, E. coli
ttgattgaagagtcagagttactgg

SEQ ID NO: 119532 - DNA, 25 bp, E. coli
ttgattgaagagacagagttactgg

SEQ ID NO: 119533 - DNA, 25 bp, E. coli
tgagctacatctgctagttgccact

SEQ ID NO: 119534 - DNA, 25 bp, E. coli
tgagctacatctcctagttgccact

SEQ ID NO: 119535 - DNA, 25 bp, E. coli
gctacatctgctagttgccactacc

SEQ ID NO: 119536 - DNA, 25 bp, E. coli
gctacatctgcttgttgccactacc

SEQ ID NO: 119537 - DNA, 25 bp, E. coli
gcaaagcgcgactgtctcagcagga

SEQ ID NO: 119538 - DNA, 25 bp, E. coli
gcaaagcgcgacagtctcagcagga

SEQ ID NO: 119539 - DNA, 25 bp, E. coli
cgcgactgtctcagcaggaagccat

SEQ ID NO: 119540 - DNA, 25 bp, E. coli
cgcgactgtctctgcaggaagccat

SEQ ID NO: 119541 - DNA, 25 bp, E. coli
cggtaagcagaatggcaaagcgcga

SEQ ID NO: 119542 - DNA, 25 bp, E. coli
cggtaagcagaaaggcaaagcgcga

SEQ ID NO: 119543 - DNA, 25 bp, E. coli
taagcagaaagggaaagcgcgactg

SEQ ID NO: 119544 - DNA, 25 bp, E. coli
taagcagaaaggcaaagcgcgactg

SEQ ID NO: 119545 - DNA, 25 bp, E. coli
cacaaggtatcgttcgcggaggctg

SEQ ID NO: 119546 - DNA, 25 bp, E. coli
cacaaggtatcgatcgcggaggctg

SEQ ID NO: 119547 - DNA, 25 bp, E. coli
tatgcaagatcctgaaattcccgcg

SEQ ID NO: 119548 - DNA, 25 bp, E. coli
tagtctgggtaatactgcggcggcc

SEQ ID NO: 119549 - DNA, 25 bp, E. coli
tacgccagacgaaaaggaacgcatt

SEQ ID NO: 119550 - DNA, 25 bp, E. coli
tatgctaacccgtggctgcaagaag

SEQ ID NO: 119551 - DNA, 25 bp, E. coli
tatgcaagatccagaaattcccgcg

SEQ ID NO: 119552 - DNA, 25 bp, E. coli
tacgccagacgataaggaacgcatt

SEQ ID NO: 119553 - DNA, 25 bp, E. coli
tagtctgggtaaaactgcggcggcc

SEQ ID NO: 119554 - DNA, 25 bp, E. coli
tagctgataaagtcgtgcccacctg

SEQ ID NO: 119555 - DNA, 25 bp, E. coli
tatgctaacccgaggctgcaagaag

SEQ ID NO: 119556 - DNA, 25 bp, E. coli
tagctgataaagacgtgcccacctg

SEQ ID NO: 119557 - DNA, 25 bp, E. coli
tatctgggagcatactcgtctggcg

SEQ ID NO: 119558 - DNA, 25 bp, E. coli
tatctgggagcaaactcgtctggcg

SEQ ID NO: 119559 - DNA, 25 bp, E. coli
tgagccggattttgaacgtcgcacc

SEQ ID NO: 119560 - DNA, 25 bp, E. coli
tgagccggatttagaacgtcgcacc

SEQ ID NO: 119561 - DNA, 25 bp, E. coli
ggtaacgtcggcttcaaaggtggct

SEQ ID NO: 119562 - DNA, 25 bp, E. coli
ggtaacgtcggcatcaaaggtggct

SEQ ID NO: 119563 - DNA, 25 bp, E. coli
gatgaaaactccatgccggaaggcg

SEQ ID NO: 119564 - DNA, 25 bp, E. coli
gatgggatacactaaacgccggaat

SEQ ID NO: 119565 - DNA, 25 bp, E. coli
gatgggatacacaaaacgccggaat

SEQ ID NO: 119566 - DNA, 25 bp, E. coli
gatgaaaactccttgccggaaggcg

SEQ ID NO: 119567 - DNA, 25 bp, E. coli
cagcaattccccttgacgaagttga

SEQ ID NO: 119568 - DNA, 25 bp, E. coli
cagcaattccccatgacgaagttga

SEQ ID NO: 119569 - DNA, 25 bp, E. coli
caccaatggtttctgaatttgaaac

SEQ ID NO: 119570 - DNA, 25 bp, E. coli
caccaatggtttgtgaatttgaaac

SEQ ID NO: 119571 - DNA, 25 bp, E. coli
agttacaacgaatggctgcgtgcga

SEQ ID NO: 119572 - DNA, 25 bp, E. coli
agttacaacgaaaggctgcgtgcga

SEQ ID NO: 119573 - DNA, 25 bp, E. coli
tagcaacgagccttgcagatccgcg

SEQ ID NO: 119574 - DNA, 25 bp, E. coli
tagcaacgagccatgcagatccgcg

SEQ ID NO: 119575 - DNA, 25 bp, E. coli
tgacgaagttgaccgcagaatggca

SEQ ID NO: 119576 - DNA, 25 bp, E. coli
tgaaaccattgaacaagaaaacagt

SEQ ID NO: 119577 - DNA, 25 bp, E. coli
tgaaaccattgatcaagaaaacagt

SEQ ID NO: 119578 - DNA, 25 bp, E. coli
tgacgaagttgagcgcagaatggca

SEQ ID NO: 119579 - DNA, 25 bp, E. coli
tgcgtgcgaaagaagcaacgagcct

SEQ ID NO: 119580 - DNA, 25 bp, E. coli
tgcgtgcgaaagtagcaacgagcct

SEQ ID NO: 119581 - DNA, 25 bp, E. coli
gcgcaaggaacggagcaagcagtaa

SEQ ID NO: 119582 - DNA, 25 bp, E. coli
gcgcaaggaacgcagcaagcagtaa

SEQ ID NO: 119583 - DNA, 25 bp, E. coli
gaatagagccctttcaccaatggtt

SEQ ID NO: 119584 - DNA, 25 bp, E. coli
gaatagagccctatcaccaatggtt

SEQ ID NO: 119585 - DNA, 25 bp, E. coli
cgcagaatggcacaacgctttgcta

SEQ ID NO: 119586 - DNA, 25 bp, E. coli
cgctttgctaagatgcgcaaggaac

SEQ ID NO: 119587 - DNA, 25 bp, E. coli
cgctttgctaagttgcgcaaggaac

SEQ ID NO: 119588 - DNA, 25 bp, E. coli
cgcagaatggcagaacgctttgcta

SEQ ID NO: 119589 - DNA, 25 bp, E. coli
cacgtgaacgtatcttcatatgtgg

SEQ ID NO: 119590 - DNA, 25 bp, E. coli
cacgtgaacgtaacttcatatgtgg

SEQ ID NO: 119591 - DNA, 25 bp, E. coli
cataaagaacacttggatgatcctc

SEQ ID NO: 119592 - DNA, 25 bp, E. coli
cataaagaacacatggatgatcctc

SEQ ID NO: 119593 - DNA, 25 bp, E. coli
taaattccctgaaggaagcacgtga

SEQ ID NO: 119594 - DNA, 25 bp, E. coli
taaattccctgatggaagcacgtga

SEQ ID NO: 119595 - DNA, 25 bp, E. coli
aaaatatgggcatcatgggcccggg

SEQ ID NO: 119596 - DNA, 25 bp, E. coli
aaaatatgggcaacatgggcccggg

SEQ ID NO: 119597 - DNA, 25 bp, E. coli
tgatttcagacctgcacgtgaacgt

SEQ ID NO: 119598 - DNA, 25 bp, E. coli
tgatttcagaccagcacgtgaacgt

SEQ ID NO: 119599 - DNA, 25 bp, E. coli
tcctgaggaatttgccaatattttt

SEQ ID NO: 119600 - DNA, 25 bp, E. coli
tcctgaggaattagccaatattttt

SEQ ID NO: 119601 - DNA, 25 bp, E. coli
tctattccatcttatccgaagcaat

SEQ ID NO: 119602 - DNA, 25 bp, E. coli
tctattccatctaatccgaagcaat

SEQ ID NO: 119603 - DNA, 25 bp, E. coli
cctcagggcttacttgttttcaact

SEQ ID NO: 119604 - DNA, 25 bp, E. coli
cctcagggcttagttgttttcaact

SEQ ID NO: 119605 - DNA, 25 bp, E. coli
gaagcaatactttgaaacccacacc

SEQ ID NO: 119606 - DNA, 25 bp, E. coli
gaagcaatacttagaaacccacacc

SEQ ID NO: 119607 - DNA, 25 bp, E. coli
gagacactcaaaggtgaagacccca

SEQ ID NO: 119608 - DNA, 25 bp, E. coli
gagacactcaaacgtgaagacccca

SEQ ID NO: 119609 - DNA, 25 bp, E. coli
gaagaccccagctaatacattagac

SEQ ID NO: 119610 - DNA, 25 bp, E. coli
gaagaccccagcaaatacattagac

SEQ ID NO: 119611 - DNA, 25 bp, E. coli
caaagaccgttatcaccggtgatgg

SEQ ID NO: 119612 - DNA, 25 bp, E. coli
caaagaccgttaacaccggtgatgg

SEQ ID NO: 119613 - DNA, 25 bp, E. coli
cagatcctgtcgatgtacgccaaag

SEQ ID NO: 119614 - DNA, 25 bp, E. coli
cagatcctgtcgttgtacgccaaag

SEQ ID NO: 119615 - DNA, 25 bp, E. coli
atgtcgtaagcgaacagcgagggcc

SEQ ID NO: 119616 - DNA, 25 bp, E. coli
atgtcgtaagcgtacagcgagggcc

SEQ ID NO: 119617 - DNA, 25 bp, E. coli
tgatggccacctggaactacgcact

SEQ ID NO: 119618 - DNA, 25 bp, E. coli
tgtgaagaaaaagcagacccggatc

SEQ ID NO: 119619 - DNA, 25 bp, E. coli
tgtgaagaaaaaccagacccggatc

SEQ ID NO: 119620 - DNA, 25 bp, E. coli
tgatggccacctcgaactacgcact

SEQ ID NO: 119621 - DNA, 25 bp, E. coli
gaagatctcagcgagttcgatcgcc

SEQ ID NO: 119622 - DNA, 25 bp, E. coli
gaagatctcagccagttcgatcgcc

SEQ ID NO: 119623 - DNA, 25 bp, E. coli
gaaatgtcccacgatctgggctacg

SEQ ID NO: 119624 - DNA, 25 bp, E. coli
gaaatgtcccaccatctgggctacg

SEQ ID NO: 119625 - DNA, 25 bp, E. coli
gaaaatcagcgttgaggcagctctc

SEQ ID NO: 119626 - DNA, 25 bp, E. coli
gaaaaacagttgcaggctctggcta

SEQ ID NO: 119627 - DNA, 25 bp, E. coli
gaaaaacagttggaggctctggcta

SEQ ID NO: 119628 - DNA, 25 bp, E. coli
gaaaatcagcgtagaggcagctctc

SEQ ID NO: 119629 - DNA, 25 bp, E. coli
cgcgatcgtgatcgctcttttgaac

SEQ ID NO: 119630 - DNA, 25 bp, E. coli
cgcgatcgtgatggctcttttgaac

SEQ ID NO: 119631 - DNA, 25 bp, E. coli
ggatcaccgggaaggataaccagat

SEQ ID NO: 119632 - DNA, 25 bp, E. coli
ggatcaccgggatggataaccagat

SEQ ID NO: 119633 - DNA, 25 bp, E. coli
taaacaatgggctggtaaagcggct

SEQ ID NO: 119634 - DNA, 25 bp, E. coli
taaacaatgggcaggtaaagcggct

SEQ ID NO: 119635 - DNA, 25 bp, E. coli
tatattgagttttccggattaccgc

SEQ ID NO: 119636 - DNA, 25 bp, E. coli
tatattgagtttaccggattaccgc

SEQ ID NO: 119637 - DNA, 25 bp, E. coli
tgaaagaggatttcacgcaagctgg

SEQ ID NO: 119638 - DNA, 25 bp, E. coli
tgaaagaggattacacgcaagctgg

SEQ ID NO: 119639 - DNA, 25 bp, E. coli
tcaggccaacgattatatgaacagt

SEQ ID NO: 119640 - DNA, 25 bp, E. coli
tctatcccttggtgatgaaagagga

SEQ ID NO: 119641 - DNA, 25 bp, E. coli
tcaggccaacgaatatatgaacagt

SEQ ID NO: 119642 - DNA, 25 bp, E. coli
tctatcccttggagatgaaagagga

SEQ ID NO: 119643 - DNA, 25 bp, E. coli
gcagcaattgattaatcaggccaac

SEQ ID NO: 119644 - DNA, 25 bp, E. coli
gcagcaattgataaatcaggccaac

SEQ ID NO: 119645 - DNA, 25 bp, E. coli
gaaaatggttttcctgcatggtctg

SEQ ID NO: 119646 - DNA, 25 bp, E. coli
gaaaaatccgtatcgctggagaaaa

SEQ ID NO: 119647 - DNA, 25 bp, E. coli
gaaaatggttttgctgcatggtctg

SEQ ID NO: 119648 - DNA, 25 bp, E. coli
gaaattccaccaccaacacatgagg

SEQ ID NO: 119649 - DNA, 25 bp, E. coli
gaaattccaccagcaacacatgagg

SEQ ID NO: 119650 - DNA, 25 bp, E. coli
gaaaaatccgtaacgctggagaaaa

SEQ ID NO: 119651 - DNA, 25 bp, E. coli
tggctcatggccagatgatgctgtt

SEQ ID NO: 119652 - DNA, 25 bp, E. coli
tggctcatggcctgatgatgctgtt

SEQ ID NO: 119653 - DNA, 25 bp, E. coli
gaggaacagattgctgcagccgaac

SEQ ID NO: 119654 - DNA, 25 bp, E. coli
gaggaacagattcctgcagccgaac

SEQ ID NO: 119655 - DNA, 25 bp, E. coli
taaacgagatgtccggattgaaggc

SEQ ID NO: 119656 - DNA, 25 bp, E. coli
taaacgagatgtgcggattgaaggc

SEQ ID NO: 119657 - DNA, 25 bp, E. coli
actgggatgtgataatgagtattca

SEQ ID NO: 119658 - DNA, 25 bp, E. coli
actgggatgtgaaaatgagtattca

SEQ ID NO: 119659 - DNA, 25 bp, E. coli
tgaatccagtaatcgagatgtgcgg

SEQ ID NO: 119660 - DNA, 25 bp, E. coli
tgaatccagtaaacgagatgtgcgg

SEQ ID NO: 119661 - DNA, 25 bp, E. coli
tcttgctgccgataaagggcgggaa

SEQ ID NO: 119662 - DNA, 25 bp, E. coli
tcttgctgccgaaaaagggcgggaa

SEQ ID NO: 119663 - DNA, 25 bp, E. coli
gactcgcggctatgaatccagtaaa

SEQ ID NO: 119664 - DNA, 25 bp, E. coli
gactcgcggctaagaatccagtaaa

SEQ ID NO: 119665 - DNA, 25 bp, E. coli
cgaagggccgtttcaagggatgaat

SEQ ID NO: 119666 - DNA, 25 bp, E. coli
cgaagggccgttacaagggatgaat

SEQ ID NO: 119667 - DNA, 25 bp, E. coli
cgggtatcttagctggtatgaacta

SEQ ID NO: 119668 - DNA, 25 bp, E. coli
cgggtatcttaggtggtatgaacta

SEQ ID NO: 119669 - DNA, 25 bp, E. coli
gatcgcctgaataactgggatgtga

SEQ ID NO: 119670 - DNA, 25 bp, E. coli
gatcgcctgaattactgggatgtga

SEQ ID NO: 119671 - DNA, 25 bp, E. coli
ggatgaatttctttcttgctgccga

SEQ ID NO: 119672 - DNA, 25 bp, E. coli
tggtatgaactatcgggtcagcgaa

SEQ ID NO: 119673 - DNA, 25 bp, E. coli
ggatgaatttctatcttgctgccga

SEQ ID NO: 119674 - DNA, 25 bp, E. coli
tggtatgaactaacgggtcagcgaa

SEQ ID NO: 119675 - DNA, 25 bp, E. coli
gagtattcagtaagactttatgctg

SEQ ID NO: 119676 - DNA, 25 bp, E. coli
gagtattcagtatgactttatgctg

SEQ ID NO: 119677 - DNA, 25 bp, E. coli
aagggcctaaaaaacattgtgtctg

SEQ ID NO: 119678 - DNA, 25 bp, E. coli
aagggcctaaaatacattgtgtctg

SEQ ID NO: 119679 - DNA, 25 bp, E. coli
cagaagaaaccttgctaaagcagga

SEQ ID NO: 119680 - DNA, 25 bp, E. coli
cagagagatcacttttcaggaatac

SEQ ID NO: 119681 - DNA, 25 bp, E. coli
cagaagaaacctagctaaagcagga

SEQ ID NO: 119682 - DNA, 25 bp, E. coli
cagagagatcacatttcaggaatac

SEQ ID NO: 119683 - DNA, 25 bp, E. coli
tactatttagcctcagagaatgttc

SEQ ID NO: 119684 - DNA, 25 bp, E. coli
tactatttagccacagagaatgttc

SEQ ID NO: 119685 - DNA, 25 bp, E. coli
tatagaaacgacctctaataagctg

SEQ ID NO: 119686 - DNA, 25 bp, E. coli
tatagaaacgacgtctaataagctg

SEQ ID NO: 119687 - DNA, 25 bp, E. coli
taatacagtgtttttaaagggccta

SEQ ID NO: 119688 - DNA, 25 bp, E. coli
taatacagtgttattaaagggccta

SEQ ID NO: 119689 - DNA, 25 bp, E. coli
tctgtcaaattttcaaaggataggc

SEQ ID NO: 119690 - DNA, 25 bp, E. coli
tcaggaatacagtagaaaccttgct

SEQ ID NO: 119691 - DNA, 25 bp, E. coli
tctgtcaaatttacaaaggataggc

SEQ ID NO: 119692 - DNA, 25 bp, E. coli
tcaggaatacagaagaaaccttgct

SEQ ID NO: 119693 - DNA, 25 bp, E. coli
gaaggtttatctatggatcaggtag

SEQ ID NO: 119694 - DNA, 25 bp, E. coli
gaaggtttatctttggatcaggtag

SEQ ID NO: 119695 - DNA, 25 bp, E. coli
ggatcaggtagtcatttttaaacaa

SEQ ID NO: 119696 - DNA, 25 bp, E. coli
ggatcaggtagtgatttttaaacaa

SEQ ID NO: 119697 - DNA, 25 bp, E. coli
taataagctgaaatccagagagatc

SEQ ID NO: 119698 - DNA, 25 bp, E. coli
taataagctgaattccagagagatc

SEQ ID NO: 119699 - DNA, 25 bp, E. coli
caaagcgaagtctatcgcgaagcgc

SEQ ID NO: 119700 - DNA, 25 bp, E. coli
caaagcgaagtcaatcgcgaagcgc

SEQ ID NO: 119701 - DNA, 25 bp, E. coli
caccatattgcgtttattgcgacgg

SEQ ID NO: 119702 - DNA, 25 bp, E. coli
caccatattgcgattattgcgacgg

SEQ ID NO: 119703 - DNA, 25 bp, E. coli
acgggctgccgtaggaactgtatga

SEQ ID NO: 119704 - DNA, 25 bp, E. coli
acgggctgccgttggaactgtatga

SEQ ID NO: 119705 - DNA, 25 bp, E. coli
tattcttggtttgacgctgcaaagc

SEQ ID NO: 119706 - DNA, 25 bp, E. coli
tattcttggtttcacgctgcaaagc

SEQ ID NO: 119707 - DNA, 25 bp, E. coli
ttctttaacgatgcggacgggctgc

SEQ ID NO: 119708 - DNA, 25 bp, E. coli
ttctttaacgatccggacgggctgc

SEQ ID NO: 119709 - DNA, 25 bp, E. coli
tgagcaaagctttctactgcgatat

SEQ ID NO: 119710 - DNA, 25 bp, E. coli
tgagcaaagcttactactgcgatat

SEQ ID NO: 119711 - DNA, 25 bp, E. coli
tgaaagccataacgtgaagtgtgaa

SEQ ID NO: 119712 - DNA, 25 bp, E. coli
tgaaagccataaggtgaagtgtgaa

SEQ ID NO: 119713 - DNA, 25 bp, E. coli
tgctgggtttaatacaggttcacca

SEQ ID NO: 119714 - DNA, 25 bp, E. coli
tgctgggtttaaaacaggttcacca

SEQ ID NO: 119715 - DNA, 25 bp, E. coli
ggcagtggcgcaccttgaaagccat

SEQ ID NO: 119716 - DNA, 25 bp, E. coli
gggatttggcgcttaatgggcaata

SEQ ID NO: 119717 - DNA, 25 bp, E. coli
ggcagtggcgcagcttgaaagccat

SEQ ID NO: 119718 - DNA, 25 bp, E. coli
gggatttggcgcataatgggcaata

SEQ ID NO: 119719 - DNA, 25 bp, E. coli
gagcttttctcatttccgttcccgc

SEQ ID NO: 119720 - DNA, 25 bp, E. coli
gagcttttctcaattccgttcccgc

SEQ ID NO: 119721 - DNA, 25 bp, E. coli
caatctcgattggatgcggcgcaaa

SEQ ID NO: 119722 - DNA, 25 bp, E. coli
caatctcgattgcatgcggcgcaaa

SEQ ID NO: 119723 - DNA, 25 bp, E. coli
catggagcactcaggcaactgggtt

SEQ ID NO: 119724 - DNA, 25 bp, E. coli
catggagcactctggcaactgggtt

SEQ ID NO: 119725 - DNA, 25 bp, E. coli
tactgaacttgataacgggcatgac

SEQ ID NO: 119726 - DNA, 25 bp, E. coli
tactgaacttgaaaacgggcatgac

SEQ ID NO: 119727 - DNA, 25 bp, E. coli
aacattacggattacagctcggcac

SEQ ID NO: 119728 - DNA, 25 bp, E. coli
aacattacggataacagctcggcac

SEQ ID NO: 119729 - DNA, 25 bp, E. coli
tgaatgccgagggatacagttaccg

SEQ ID NO: 119730 - DNA, 25 bp, E. coli
tgaatgccgaggcatacagttaccg

SEQ ID NO: 119731 - DNA, 25 bp, E. coli
tcacgagcgccgaggtaacactttc

SEQ ID NO: 119732 - DNA, 25 bp, E. coli
tcacgagcgccgtggtaacactttc

SEQ ID NO: 119733 - DNA, 25 bp, E. coli
gaatggactttcgatcgcgtactgg

SEQ ID NO: 119734 - DNA, 25 bp, E. coli
gaatggactttccatcgcgtactgg

SEQ ID NO: 119735 - DNA, 25 bp, E. coli
cgatcctaaagtgtggcgtgaagcc

SEQ ID NO: 119736 - DNA, 25 bp, E. coli
cgatcctaaagtctggcgtgaagcc

SEQ ID NO: 119737 - DNA, 25 bp, E. coli
ggatgaacgatccaaacggcctgat

SEQ ID NO: 119738 - DNA, 25 bp, E. coli
ggatgaacgatcgaaacggcctgat

SEQ ID NO: 119739 - DNA, 25 bp, E. coli
taatacccggaatgtggtcgccagg

SEQ ID NO: 119740 - DNA, 25 bp, E. coli
tcaaaacgtgaaggctgggcaggct

SEQ ID NO: 119741 - DNA, 25 bp, E. coli
tcaaaacgtgaacgctgggcaggct

SEQ ID NO: 119742 - DNA, 25 bp, E. coli
taatacccggaaagtggtcgccagg

SEQ ID NO: 119743 - DNA, 25 bp, E. coli
caaagtgatggacatttgcggtcac

SEQ ID NO: 119744 - DNA, 25 bp, E. coli
caaagtgatggagatttgcggtcac

SEQ ID NO: 119745 - DNA, 25 bp, E. coli
tattcctgacgagatcagcgaaccg

SEQ ID NO: 119746 - DNA, 25 bp, E. coli
tattcctgacgacatcagcgaaccg

SEQ ID NO: 119747 - DNA, 25 bp, E. coli
tttagtcatgaacgcgcgtatgcac

SEQ ID NO: 119748 - DNA, 25 bp, E. coli
tttagtcatgaaggcgcgtatgcac

SEQ ID NO: 119749 - DNA, 25 bp, E. coli
tgcgctaccgctcttctttgaagtg

SEQ ID NO: 119750 - DNA, 25 bp, E. coli
tgcgctaccgctgttctttgaagtg

SEQ ID NO: 119751 - DNA, 25 bp, E. coli
cctcggcttcctggcggtggttgtc

SEQ ID NO: 119752 - DNA, 25 bp, E. coli
cctcggcttcctcgcggtggttgtc

SEQ ID NO: 119753 - DNA, 25 bp, E. coli
gctggatgatccagattggcctgtg

SEQ ID NO: 119754 - DNA, 25 bp, E. coli
gctggatgatcctgattggcctgtg

SEQ ID NO: 119755 - DNA, 25 bp, E. coli
gcgtatgcacgctttcctggcttta

SEQ ID NO: 119756 - DNA, 25 bp, E. coli
gcgtatgcacgcattcctggcttta

SEQ ID NO: 119757 - DNA, 25 bp, E. coli
gaacctggtgaagctggtaatccca

SEQ ID NO: 119758 - DNA, 25 bp, E. coli
gaacctggtgaacctggtaatccca

SEQ ID NO: 119759 - DNA, 25 bp, E. coli
gttgctttctcaatggcgcgccaca

SEQ ID NO: 119760 - DNA, 25 bp, E. coli
gttgctttctcattggcgcgccaca

SEQ ID NO: 119761 - DNA, 25 bp, E. coli
ggtatgccgctcgataaaatcgcag

SEQ ID NO: 119762 - DNA, 25 bp, E. coli
ggtatgccgctccataaaatcgcag

SEQ ID NO: 119763 - DNA, 25 bp, E. coli
tcaaacaggtgcaggttgactctgg

SEQ ID NO: 119764 - DNA, 25 bp, E. coli
tcaaacaggtgctggttgactctgg

SEQ ID NO: 119765 - DNA, 25 bp, E. coli
caaaaagcttctcacgctggtcgta

SEQ ID NO: 119766 - DNA, 25 bp, E. coli
caaaaagcttctgacgctggtcgta

SEQ ID NO: 119767 - DNA, 25 bp, E. coli
taaaggcggccatcatagtggcggt

SEQ ID NO: 119768 - DNA, 25 bp, E. coli
taaaggcggccaacatagtggcggt

SEQ ID NO: 119769 - DNA, 25 bp, E. coli
ttttaaaaacgatccacaaagagca

SEQ ID NO: 119770 - DNA, 25 bp, E. coli
ttttaaaaacgaaccacaaagagca

SEQ ID NO: 119771 - DNA, 25 bp, E. coli
aaacgatccacatagagcatcagaa

SEQ ID NO: 119772 - DNA, 25 bp, E. coli
aaacgatccacaaagagcatcagaa

SEQ ID NO: 119773 - DNA, 25 bp, E. coli
tgaccgaacatcctggcggtgcagg

SEQ ID NO: 119774 - DNA, 25 bp, E. coli
tgaccgaacatcgtggcggtgcagg

SEQ ID NO: 119775 - DNA, 25 bp, E. coli
tcgctgaagatcgacaaaaagcttc

SEQ ID NO: 119776 - DNA, 25 bp, E. coli
tcgctgaagatccacaaaaagcttc

SEQ ID NO: 119777 - DNA, 25 bp, E. coli
tcagaatagccatggtggcggccgt

SEQ ID NO: 119778 - DNA, 25 bp, E. coli
tcagaatagccaaggtggcggccgt

SEQ ID NO: 119779 - DNA, 25 bp, E. coli
gcagggaaaaaaggtggtcagaata

SEQ ID NO: 119780 - DNA, 25 bp, E. coli
gcggtgcaggtaatttcgctgaaga

SEQ ID NO: 119781 - DNA, 25 bp, E. coli
gcggtgcaggtattttcgctgaaga

SEQ ID NO: 119782 - DNA, 25 bp, E. coli
gcagggaaaaaacgtggtcagaata

SEQ ID NO: 119783 - DNA, 25 bp, E. coli
ctgacgctggtcgtaaaggcggcca

SEQ ID NO: 119784 - DNA, 25 bp, E. coli
ctgacgctggtcctaaaggcggcca

SEQ ID NO: 119785 - DNA, 25 bp, E. coli
tggcggccgtaattctgactcttaa

SEQ ID NO: 119786 - DNA, 25 bp, E. coli
tggcggccgtaaatctgactcttaa

SEQ ID NO: 119787 - DNA, 25 bp, E. coli
cactggatttggtgtttctgagcaa

SEQ ID NO: 119788 - DNA, 25 bp, E. coli
cacgacaggcagagagcgcactgga

SEQ ID NO: 119789 - DNA, 25 bp, E. coli
cactggatttggagtttctgagcaa

SEQ ID NO: 119790 - DNA, 25 bp, E. coli
cacgacaggcagtgagcgcactgga

SEQ ID NO: 119791 - DNA, 25 bp, E. coli
aggatttgctttacttgaccgcggg

SEQ ID NO: 119792 - DNA, 25 bp, E. coli
aggatttgcttttcttgaccgcggg

SEQ ID NO: 119793 - DNA, 25 bp, E. coli
ttccgtaatattccgccattgctgc

SEQ ID NO: 119794 - DNA, 25 bp, E. coli
ttccgtaatattgcgccattgctgc

SEQ ID NO: 119795 - DNA, 25 bp, E. coli
tgattgattatcagcaaggcgacac

SEQ ID NO: 119796 - DNA, 25 bp, E. coli
tgattgattatctgcaaggcgacac

SEQ ID NO: 119797 - DNA, 25 bp, E. coli
tcgcggcataacatcaggatttgct

SEQ ID NO: 119798 - DNA, 25 bp, E. coli
tcgcggcataacttcaggatttgct

SEQ ID NO: 119799 - DNA, 25 bp, E. coli
gccggttttggcatcgttcagcatt

SEQ ID NO: 119800 - DNA, 25 bp, E. coli
gccggttttggcttcgttcagcatt

SEQ ID NO: 119801 - DNA, 25 bp, E. coli
gaatctcagtaatcgcggcataaca

SEQ ID NO: 119802 - DNA, 25 bp, E. coli
gaatctcagtaaacgcggcataaca

SEQ ID NO: 119803 - DNA, 25 bp, E. coli
cgccgcagctggcagataggtttct

SEQ ID NO: 119804 - DNA, 25 bp, E. coli
cgccgcagctgggagataggtttct

SEQ ID NO: 119805 - DNA, 25 bp, E. coli
gataggtttcttgcgtttatcctgg

SEQ ID NO: 119806 - DNA, 25 bp, E. coli
gataggtttcttccgtttatcctgg

SEQ ID NO: 119807 - DNA, 25 bp, E. coli
tcagcaaggcgacacttacggacgc

SEQ ID NO: 119808 - DNA, 25 bp, E. coli
tcagcaaggcgagacttacggacgc

SEQ ID NO: 119809 - DNA, 25 bp, E. coli
caaaattaaccaaagagcagcgcct

SEQ ID NO: 119810 - DNA, 25 bp, E. coli
cagaaattcgcttctacgggacgta

SEQ ID NO: 119811 - DNA, 25 bp, E. coli
caaaaacgagttaatggccggcatc

SEQ ID NO: 119812 - DNA, 25 bp, E. coli
caaaaacgagtttatggccggcatc

SEQ ID NO: 119813 - DNA, 25 bp, E. coli
caaaattaaccatagagcagcgcct

SEQ ID NO: 119814 - DNA, 25 bp, E. coli
cagaaattcgctactacgggacgta

SEQ ID NO: 119815 - DNA, 25 bp, E. coli
tattcgcaccgtaataagaccggcc

SEQ ID NO: 119816 - DNA, 25 bp, E. coli
tattcgcaccgttataagaccggcc

SEQ ID NO: 119817 - DNA, 25 bp, E. coli
tctgggtcggcaaacataaactccc

SEQ ID NO: 119818 - DNA, 25 bp, E. coli
tcaggacggtagtacggcaaatgcg

SEQ ID NO: 119819 - DNA, 25 bp, E. coli
tctgggtcggcatacataaactccc

SEQ ID NO: 119820 - DNA, 25 bp, E. coli
tcaggacggtagaacggcaaatgcg

SEQ ID NO: 119821 - DNA, 25 bp, E. coli
ccttcgcacgagtggcagacttctg

SEQ ID NO: 119822 - DNA, 25 bp, E. coli
ccttcgcacgagaggcagacttctg

SEQ ID NO: 119823 - DNA, 25 bp, E. coli
gaaaataaatatgaatcggcctcgc

SEQ ID NO: 119824 - DNA, 25 bp, E. coli
gaaatatcagcgtcatctcccgttg

SEQ ID NO: 119825 - DNA, 25 bp, E. coli
gaaaataaatatcaatcggcctcgc

SEQ ID NO: 119826 - DNA, 25 bp, E. coli
gaaatatcagcgacatctcccgttg

SEQ ID NO: 119827 - DNA, 25 bp, E. coli
ggcttataaaacgacactctggcat

SEQ ID NO: 119828 - DNA, 25 bp, E. coli
ggcttataaaaccacactctggcat

SEQ ID NO: 119829 - DNA, 25 bp, E. coli
gaccggcctggatctggaatacatg

SEQ ID NO: 119830 - DNA, 25 bp, E. coli
gaccggcctggaactggaatacatg

SEQ ID NO: 119831 - DNA, 25 bp, E. coli
aatccgcgtattgatcccaacgtcg

SEQ ID NO: 119832 - DNA, 25 bp, E. coli
aatccgcgtattcatcccaacgtcg

SEQ ID NO: 119833 - DNA, 25 bp, E. coli
atttcacatatgaatatgaaaggcg

SEQ ID NO: 119834 - DNA, 25 bp, E. coli
atttcacatatgtatatgaaaggcg

SEQ ID NO: 119835 - DNA, 25 bp, E. coli
tatgccaaagcgtaactgaacgttg

SEQ ID NO: 119836 - DNA, 25 bp, E. coli
tatgccaaagcgaaactgaacgttg

SEQ ID NO: 119837 - DNA, 25 bp, E. coli
tttgtcaccatgttttccgtcgagc

SEQ ID NO: 119838 - DNA, 25 bp, E. coli
tttgtcaccatgatttccgtcgagc

SEQ ID NO: 119839 - DNA, 25 bp, E. coli
ccgtgtttttgttgagccagcaggc

SEQ ID NO: 119840 - DNA, 25 bp, E. coli
ccgtgtttttgtagagccagcaggc

SEQ ID NO: 119841 - DNA, 25 bp, E. coli
gcaatcccgtgggaacgctatcctt

SEQ ID NO: 119842 - DNA, 25 bp, E. coli
gcaacgctatccttttgtcaccatg

SEQ ID NO: 119843 - DNA, 25 bp, E. coli
gcaacgctatccatttgtcaccatg

SEQ ID NO: 119844 - DNA, 25 bp, E. coli
gcaatcccgtggcaacgctatcctt

SEQ ID NO: 119845 - DNA, 25 bp, E. coli
cgaaactgaacgatgagcagctgct

SEQ ID NO: 119846 - DNA, 25 bp, E. coli
cgaaactgaacgttgagcagctgct

SEQ ID NO: 119847 - DNA, 25 bp, E. coli
gattttgcctgttatgccaaagcga

SEQ ID NO: 119848 - DNA, 25 bp, E. coli
gattttgcctgtaatgccaaagcga

SEQ ID NO: 119849 - DNA, 25 bp, E. coli
taattaatccgcgtattcatcccaa

SEQ ID NO: 119850 - DNA, 25 bp, E. coli
taattaatccgcctattcatcccaa

SEQ ID NO: 119851 - DNA, 25 bp, E. coli
gagcagctgctttatcttgatggca

SEQ ID NO: 119852 - DNA, 25 bp, E. coli
gagcagctgcttaatcttgatggca

SEQ ID NO: 119853 - DNA, 25 bp, E. coli
caccaaagcctattgcgatgaatta

SEQ ID NO: 119854 - DNA, 25 bp, E. coli
caccaaagcctaatgcgatgaatta

SEQ ID NO: 119855 - DNA, 25 bp, E. coli
cagggtgtcgaacttgattttatgc

SEQ ID NO: 119856 - DNA, 25 bp, E. coli
cagggtgtcgaagttgattttatgc

SEQ ID NO: 119857 - DNA, 25 bp, E. coli
tattcaggtgaatggtattgctcct

SEQ ID NO: 119858 - DNA, 25 bp, E. coli
tattcaggtgaaaggtattgctcct

SEQ ID NO: 119859 - DNA, 25 bp, E. coli
tgctcctggttaatatgcaaccgat

SEQ ID NO: 119860 - DNA, 25 bp, E. coli
tgctcctggttattatgcaaccgat

SEQ ID NO: 119861 - DNA, 25 bp, E. coli
tgcgatgaattacgccaatataata

SEQ ID NO: 119862 - DNA, 25 bp, E. coli
tgctgtgagcgcttcggtaccgtag

SEQ ID NO: 119863 - DNA, 25 bp, E. coli
tgcgatgaattaggccaatataata

SEQ ID NO: 119864 - DNA, 25 bp, E. coli
tgctgtgagcgcatcggtaccgtag

SEQ ID NO: 119865 - DNA, 25 bp, E. coli
gcttcggtaccgaagatattctggt

SEQ ID NO: 119866 - DNA, 25 bp, E. coli
gcttcggtaccgtagatattctggt

SEQ ID NO: 119867 - DNA, 25 bp, E. coli
cgaagttgattttatgcaggtggat

SEQ ID NO: 119868 - DNA, 25 bp, E. coli
cgaagttgatttaatgcaggtggat

SEQ ID NO: 119869 - DNA, 25 bp, E. coli
gtaatccagaaactaaccagcgtgt

SEQ ID NO: 119870 - DNA, 25 bp, E. coli
gtaatccagaaagtaaccagcgtgt

SEQ ID NO: 119871 - DNA, 25 bp, E. coli
ggcgacccgtagtaatccagaaact

SEQ ID NO: 119872 - DNA, 25 bp, E. coli
ggcgacccgtagaaatccagaaact

SEQ ID NO: 119873 - DNA, 25 bp, E. coli
taaccagcgtgtacttgatcatatt

SEQ ID NO: 119874 - DNA, 25 bp, E. coli
taaccagcgtgttcttgatcatatt

SEQ ID NO: 119875 - DNA, 25 bp, E. coli
caatatgggttctgttgcccgtgcc

SEQ ID NO: 119876 - DNA, 25 bp, E. coli
caatatgggttcagttgcccgtgcc

SEQ ID NO: 119877 - DNA, 25 bp, E. coli
aaattgcgccgtctgtttacccgtg

SEQ ID NO: 119878 - DNA, 25 bp, E. coli
aaattgcgccgtgtgtttacccgtg

SEQ ID NO: 119879 - DNA, 25 bp, E. coli
tatccgctggtcgatgatctggagc

SEQ ID NO: 119880 - DNA, 25 bp, E. coli
tatccgctggtccatgatctggagc

SEQ ID NO: 119881 - DNA, 25 bp, E. coli
tcctgcgcgggattctggcttctat

SEQ ID NO: 119882 - DNA, 25 bp, E. coli
tgcccgtgccatgaaaacaatggga

SEQ ID NO: 119883 - DNA, 25 bp, E. coli
tgcccgtgccatcaaaacaatggga

SEQ ID NO: 119884 - DNA, 25 bp, E. coli
tcctgcgcgggaatctggcttctat

SEQ ID NO: 119885 - DNA, 25 bp, E. coli
gaatacagctcgctgaacctggcga

SEQ ID NO: 119886 - DNA, 25 bp, E. coli
gaatacagctcggtgaacctggcga

SEQ ID NO: 119887 - DNA, 25 bp, E. coli
gctcgacgaagcgttagccggttgt

SEQ ID NO: 119888 - DNA, 25 bp, E. coli
gctcgacgaagccttagccggttgt

SEQ ID NO: 119889 - DNA, 25 bp, E. coli
cgaattgtgctggtggagacgtcac

SEQ ID NO: 119890 - DNA, 25 bp, E. coli
cgaattgtgctgctggagacgtcac

SEQ ID NO: 119891 - DNA, 25 bp, E. coli
ctgaagcggcaattaccccggtggc

SEQ ID NO: 119892 - DNA, 25 bp, E. coli
ctgaagcggcaaataccccggtggc

SEQ ID NO: 119893 - DNA, 25 bp, E. coli
tggtaatgctcacatcgtcgatacg

SEQ ID NO: 119894 - DNA, 25 bp, E. coli
tggtaatgctcagatcgtcgatacg

SEQ ID NO: 119895 - DNA, 25 bp, E. coli
gagacgtcacacaccggcaatatgg

SEQ ID NO: 119896 - DNA, 25 bp, E. coli
gagacgtcacactccggcaatatgg

SEQ ID NO: 119897 - DNA, 25 bp, E. coli
cactgtgtgtgagtgtctggtctga

SEQ ID NO: 119898 - DNA, 25 bp, E. coli
cactgtgtgtgactgtctggtctga

SEQ ID NO: 119899 - DNA, 25 bp, E. coli
caaaagtacgtgtggatggcgagca

SEQ ID NO: 119900 - DNA, 25 bp, E. coli
caaaagtacgtgaggatggcgagca

SEQ ID NO: 119901 - DNA, 25 bp, E. coli
taaaatagcctattaatccagacga

SEQ ID NO: 119902 - DNA, 25 bp, E. coli
taaaatagcctaataatccagacga

SEQ ID NO: 119903 - DNA, 25 bp, E. coli
ttgttgcaggcactttggtcacggc

SEQ ID NO: 119904 - DNA, 25 bp, E. coli
ttgttgcaggcagtttggtcacggc

SEQ ID NO: 119905 - DNA, 25 bp, E. coli
gcagcaaccggaccgtacaaaagta

SEQ ID NO: 119906 - DNA, 25 bp, E. coli
gcagcaaccggagcgtacaaaagta

SEQ ID NO: 119907 - DNA, 25 bp, E. coli
ggataaataagggtaagattccgcg

SEQ ID NO: 119908 - DNA, 25 bp, E. coli
ggataaataaggctaagattccgcg

SEQ ID NO: 119909 - DNA, 25 bp, E. coli
ggcgtaagtctgcttataaggcgtt

SEQ ID NO: 119910 - DNA, 25 bp, E. coli
ggctatacttaggacacttccactg

SEQ ID NO: 119911 - DNA, 25 bp, E. coli
ggctatacttagcacacttccactg

SEQ ID NO: 119912 - DNA, 25 bp, E. coli
ggcgtaagtctggttataaggcgtt

SEQ ID NO: 119913 - DNA, 25 bp, E. coli
tacccgtaatatctttaatcagggc

SEQ ID NO: 119914 - DNA, 25 bp, E. coli
taagattccgcgaaagtatcgcggg

SEQ ID NO: 119915 - DNA, 25 bp, E. coli
taagattccgcgtaagtatcgcggg

SEQ ID NO: 119916 - DNA, 25 bp, E. coli
tacccgtaatatgtttaatcagggc

SEQ ID NO: 119917 - DNA, 25 bp, E. coli
gagacaagttttgaaggattcgtaa

SEQ ID NO: 119918 - DNA, 25 bp, E. coli
gagacaagttttcaaggattcgtaa

SEQ ID NO: 119919 - DNA, 25 bp, E. coli
cacttcgggaagcatgggatatcag

SEQ ID NO: 119920 - DNA, 25 bp, E. coli
cacttcgggaaggatgggatatcag

SEQ ID NO: 119921 - DNA, 25 bp, E. coli
catctgtctcatcgtattcgccgga

SEQ ID NO: 119922 - DNA, 25 bp, E. coli
catctgtctcatggtattcgccgga

SEQ ID NO: 119923 - DNA, 25 bp, E. coli
tgaaagcatggtggtcagagactct

SEQ ID NO: 119924 - DNA, 25 bp, E. coli
tgaaagcatggtcgtcagagactct

SEQ ID NO: 119925 - DNA, 25 bp, E. coli
gaaaatacatcaacgccatggcagc

SEQ ID NO: 119926 - DNA, 25 bp, E. coli
gaaaatacatcatcgccatggcagc

SEQ ID NO: 119927 - DNA, 25 bp, E. coli
ggttacgtatgtactccccggacag

SEQ ID NO: 119928 - DNA, 25 bp, E. coli
gtaattgacaggtgccttgcgccgg

SEQ ID NO: 119929 - DNA, 25 bp, E. coli
ggtggatattctcaggctaagcgcc

SEQ ID NO: 119930 - DNA, 25 bp, E. coli
ggtgatcgcactgaacggcctgttt

SEQ ID NO: 119931 - DNA, 25 bp, E. coli
ggttacgtatgttctccccggacag

SEQ ID NO: 119932 - DNA, 25 bp, E. coli
gtaattgacaggagccttgcgccgg

SEQ ID NO: 119933 - DNA, 25 bp, E. coli
ggtgatcgcactcaacggcctgttt

SEQ ID NO: 119934 - DNA, 25 bp, E. coli
ggtggatattctgaggctaagcgcc

SEQ ID NO: 119935 - DNA, 25 bp, E. coli
tcactggcgctgtcactgaaagcat

SEQ ID NO: 119936 - DNA, 25 bp, E. coli
tcactggcgctgacactgaaagcat

SEQ ID NO: 119937 - DNA, 25 bp, E. coli
taagcgccaacagacgtgatacagg

SEQ ID NO: 119938 - DNA, 25 bp, E. coli
taagcgccaacacacgtgatacagg

SEQ ID NO: 119939 - DNA, 25 bp, E. coli
gagactctgtctggcaaccaaggga

SEQ ID NO: 119940 - DNA, 25 bp, E. coli
gagactctgtctcgcaaccaaggga

SEQ ID NO: 119941 - DNA, 25 bp, E. coli
catgatgccgcaaacctggaaaggt

SEQ ID NO: 119942 - DNA, 25 bp, E. coli
catgatgccgcatacctggaaaggt

SEQ ID NO: 119943 - DNA, 25 bp, E. coli
catcatgctgaaggtggcgctggca

SEQ ID NO: 119944 - DNA, 25 bp, E. coli
catcatgctgaacgtggcgctggca

SEQ ID NO: 119945 - DNA, 25 bp, E. coli
tatgaccgacttaaccgcgcaagaa

SEQ ID NO: 119946 - DNA, 25 bp, E. coli
tatgaccgactttaccgcgcaagaa

SEQ ID NO: 119947 - DNA, 25 bp, E. coli
tatcgaatacctcggcggctgcgtt

SEQ ID NO: 119948 - DNA, 25 bp, E. coli
tatcgaatacctgggcggctgcgtt

SEQ ID NO: 119949 - DNA, 25 bp, E. coli
ttacacggcatgcacgaacgtctgc

SEQ ID NO: 119950 - DNA, 25 bp, E. coli
ttacacggcatggacgaacgtctgc

SEQ ID NO: 119951 - DNA, 25 bp, E. coli
tcctcgactggaagccgaaacgtct

SEQ ID NO: 119952 - DNA, 25 bp, E. coli
tcctcgactggatgccgaaacgtct

SEQ ID NO: 119953 - DNA, 25 bp, E. coli
gaagagattgtccactgcgtaccag

SEQ ID NO: 119954 - DNA, 25 bp, E. coli
gaattctcgccgattgagctgacca

SEQ ID NO: 119955 - DNA, 25 bp, E. coli
gaattctcgccgtttgagctgacca

SEQ ID NO: 119956 - DNA, 25 bp, E. coli
gaagagattgtcgactgcgtaccag

SEQ ID NO: 119957 - DNA, 25 bp, E. coli
gatctggagatggaagccctgacct

SEQ ID NO: 119958 - DNA, 25 bp, E. coli
gatctggagatgcaagccctgacct

SEQ ID NO: 119959 - DNA, 25 bp, E. coli
ggcagacccgcgatcatcttgatga

SEQ ID NO: 119960 - DNA, 25 bp, E. coli
ggcagacccgcgttcatcttgatga

SEQ ID NO: 119961 - DNA, 25 bp, E. coli
taactggtatgagcgtgaaacctgg

SEQ ID NO: 119962 - DNA, 25 bp, E. coli
taactggtatgaccgtgaaacctgg

SEQ ID NO: 119963 - DNA, 25 bp, E. coli
caatctggctggtgtatacggtacg

SEQ ID NO: 119964 - DNA, 25 bp, E. coli
caataccctggcagataacgtcgat

SEQ ID NO: 119965 - DNA, 25 bp, E. coli
caataccctggctgataacgtcgat

SEQ ID NO: 119966 - DNA, 25 bp, E. coli
caatctggctggagtatacggtacg

SEQ ID NO: 119967 - DNA, 25 bp, E. coli
cagtaaatctcactggcgacatgcc

SEQ ID NO: 119968 - DNA, 25 bp, E. coli
cagtaaatctcagtggcgacatgcc

SEQ ID NO: 119969 - DNA, 25 bp, E. coli
aaagcgcgcgttgggataaaactgc

SEQ ID NO: 119970 - DNA, 25 bp, E. coli
aaagcgcgcgttcggataaaactgc

SEQ ID NO: 119971 - DNA, 25 bp, E. coli
tattgctcgtggaactgcacaggtc

SEQ ID NO: 119972 - DNA, 25 bp, E. coli
tatagcctgacgaaaaacgcctggc

SEQ ID NO: 119973 - DNA, 25 bp, E. coli
tattgctcgtggtactgcacaggtc

SEQ ID NO: 119974 - DNA, 25 bp, E. coli
tatagcctgacgtaaaacgcctggc

SEQ ID NO: 119975 - DNA, 25 bp, E. coli
ccaccagagagtcagcagcagttat

SEQ ID NO: 119976 - DNA, 25 bp, E. coli
ccaccagagagtgagcagcagttat

SEQ ID NO: 119977 - DNA, 25 bp, E. coli
catttatgagtaatcgcgcgcgtgg

SEQ ID NO: 119978 - DNA, 25 bp, E. coli
catttatgagtattcgcgcgcgtgg

SEQ ID NO: 119979 - DNA, 25 bp, E. coli
gtttacgcgacaataccacctggag

SEQ ID NO: 119980 - DNA, 25 bp, E. coli
gtttacgcgacattaccacctggag

SEQ ID NO: 119981 - DNA, 25 bp, E. coli
tcagcatgacggtcaatcggtgcgt

SEQ ID NO: 119982 - DNA, 25 bp, E. coli
tcagcatgacggacaatcggtgcgt

SEQ ID NO: 119983 - DNA, 25 bp, E. coli
gatggtattaacattcgcggcgcac

SEQ ID NO: 119984 - DNA, 25 bp, E. coli
gatggtattaactttcgcggcgcac

SEQ ID NO: 119985 - DNA, 25 bp, E. coli
aatctgcgatgaagactatgccggt

SEQ ID NO: 119986 - DNA, 25 bp, E. coli
aatctgcgatgatgactatgccggt

SEQ ID NO: 119987 - DNA, 25 bp, E. coli
cagagcttgttgaagatacgcaggc

SEQ ID NO: 119988 - DNA, 25 bp, E. coli
cagagcttgttgtagatacgcaggc

SEQ ID NO: 119989 - DNA, 25 bp, E. coli
ttgttgaagatacgcaggccattgc

SEQ ID NO: 119990 - DNA, 25 bp, E. coli
ttgttgaagataggcaggccattgc

SEQ ID NO: 119991 - DNA, 25 bp, E. coli
tgatgactatgccggtatcagcacc

SEQ ID NO: 119992 - DNA, 25 bp, E. coli
tgatgactatgcgggtatcagcacc

SEQ ID NO: 119993 - DNA, 25 bp, E. coli
tgcgatgatgactatgccggtatca

SEQ ID NO: 119994 - DNA, 25 bp, E. coli
tgcgatgatgacaatgccggtatca

SEQ ID NO: 119995 - DNA, 25 bp, E. coli
tctgcgatgatgactatgccggtat

SEQ ID NO: 119996 - DNA, 25 bp, E. coli
tctgcgatgatgtctatgccggtat

SEQ ID NO: 119997 - DNA, 25 bp, E. coli
gcttgttgaagaaacgcaggccatt

SEQ ID NO: 119998 - DNA, 25 bp, E. coli
gcttgttgaagatacgcaggccatt

SEQ ID NO: 119999 - DNA, 25 bp, E. coli
cgatgatgactatgccggtatcagc

SEQ ID NO: 120000 - DNA, 25 bp, E. coli
cgacagagcttgatgaagatacgca

SEQ ID NO: 120001 - DNA, 25 bp, E. coli
cgacagagcttgttgaagatacgca

SEQ ID NO: 120002 - DNA, 25 bp, E. coli
cgatgatgactaagccggtatcagc

SEQ ID NO: 120003 - DNA, 25 bp, E. coli
ggcgacagagcttgttgaagatacg

SEQ ID NO: 120004 - DNA, 25 bp, E. coli
ggcgacagagctagttgaagatacg

SEQ ID NO: 120005 - DNA, 25 bp, E. coli
gagcttgttgaagatacgcaggcca

SEQ ID NO: 120006 - DNA, 25 bp, E. coli
gagcttgttgaacatacgcaggcca

SEQ ID NO: 120007 - DNA, 25 bp, E. coli
caatcccctgatgcaggtgctagca

SEQ ID NO: 120008 - DNA, 25 bp, E. coli
caatcccctgatccaggtgctagca

SEQ ID NO: 120009 - DNA, 25 bp, E. coli
caaatggtactcaaggcagcgcact

SEQ ID NO: 120010 - DNA, 25 bp, E. coli
caaatggtactctaggcagcgcact

SEQ ID NO: 120011 - DNA, 25 bp, E. coli
tagacaccgtaggatttctgactcg

SEQ ID NO: 120012 - DNA, 25 bp, E. coli
tagacaccgtagcatttctgactcg

SEQ ID NO: 120013 - DNA, 25 bp, E. coli
tagcgtactggatcagagctctcgt

SEQ ID NO: 120014 - DNA, 25 bp, E. coli
tagcgtactggaacagagctctcgt

SEQ ID NO: 120015 - DNA, 25 bp, E. coli
ttttcacacataaggagatgaccgc

SEQ ID NO: 120016 - DNA, 25 bp, E. coli
ttttcacacatatggagatgaccgc

SEQ ID NO: 120017 - DNA, 25 bp, E. coli
gccattcgcagattatagacaccgt

SEQ ID NO: 120018 - DNA, 25 bp, E. coli
gccattcgcagaatatagacaccgt

SEQ ID NO: 120019 - DNA, 25 bp, E. coli
gcagcgcactcgatctaatattaga

SEQ ID NO: 120020 - DNA, 25 bp, E. coli
gcagcgcactcgttctaatattaga

SEQ ID NO: 120021 - DNA, 25 bp, E. coli
gacaatcgtctaactctgcaaacgg

SEQ ID NO: 120022 - DNA, 25 bp, E. coli
gacaatcgtctatctctgcaaacgg

SEQ ID NO: 120023 - DNA, 25 bp, E. coli
tcaacaagggataatgccattcgca

SEQ ID NO: 120024 - DNA, 25 bp, E. coli
tcaacaagggattatgccattcgca

SEQ ID NO: 120025 - DNA, 25 bp, E. coli
tcaatagggccacataattttgcgc

SEQ ID NO: 120026 - DNA, 25 bp, E. coli
tcaatagggccagataattttgcgc

SEQ ID NO: 120027 - DNA, 25 bp, E. coli
gagatgaccgcatagctaacgtata

SEQ ID NO: 120028 - DNA, 25 bp, E. coli
gagatgaccgcaaagctaacgtata

SEQ ID NO: 120029 - DNA, 25 bp, E. coli
aattatacgtttctcatccgtctgg

SEQ ID NO: 120030 - DNA, 25 bp, E. coli
aattatacgtttgtcatccgtctgg

SEQ ID NO: 120031 - DNA, 25 bp, E. coli
catccgtctggaaggattatcgtcc

SEQ ID NO: 120032 - DNA, 25 bp, E. coli
catccgtctggatggattatcgtcc

SEQ ID NO: 120033 - DNA, 25 bp, E. coli
tacgtttgtcatgcgtctggaagga

SEQ ID NO: 120034 - DNA, 25 bp, E. coli
tacgtttgtcatccgtctggaagga

SEQ ID NO: 120035 - DNA, 25 bp, E. coli
tatacgtttgtcatccgtctggaag

SEQ ID NO: 120036 - DNA, 25 bp, E. coli
tatacgtttgtcttccgtctggaag

SEQ ID NO: 120037 - DNA, 25 bp, E. coli
tgtcatccgtctcgaaggattatcg

SEQ ID NO: 120038 - DNA, 25 bp, E. coli
tgtcatccgtctggaaggattatcg

SEQ ID NO: 120039 - DNA, 25 bp, E. coli
tacaaagtatcggaaattcaataca

SEQ ID NO: 120040 - DNA, 25 bp, E. coli
tacaaagtatcgcaaattcaataca

SEQ ID NO: 120041 - DNA, 25 bp, E. coli
tcaggcaattattcgtttgtcatcc

SEQ ID NO: 120042 - DNA, 25 bp, E. coli
tcaggcaattatacgtttgtcatcc

SEQ ID NO: 120043 - DNA, 25 bp, E. coli
cgtttgtcatccctctggaaggatt

SEQ ID NO: 120044 - DNA, 25 bp, E. coli
cgtttgtcatccgtctggaaggatt

SEQ ID NO: 120045 - DNA, 25 bp, E. coli
cgtctggaaggaatatcgtccctga

SEQ ID NO: 120046 - DNA, 25 bp, E. coli
cgtctggaaggattatcgtccctga

SEQ ID NO: 120047 - DNA, 25 bp, E. coli
cattgcaaaaaatcacgtaggcctg

SEQ ID NO: 120048 - DNA, 25 bp, E. coli
cattgcaaaaaaacacgtaggcctg

SEQ ID NO: 120049 - DNA, 25 bp, E. coli
ggcaattatacgattgtcatccgtc

SEQ ID NO: 120050 - DNA, 25 bp, E. coli
ggcaattatacgtttgtcatccgtc

SEQ ID NO: 120051 - DNA, 25 bp, E. coli
accccatgccgaactcagaagtgaa

SEQ ID NO: 120052 - DNA, 25 bp, E. coli
accccatgccgatctcagaagtgaa

SEQ ID NO: 120053 - DNA, 25 bp, E. coli
tgaccccatgcccaactcagaagtg

SEQ ID NO: 120054 - DNA, 25 bp, E. coli
tgaccccatgccgaactcagaagtg

SEQ ID NO: 120055 - DNA, 25 bp, E. coli
gccgtagcgccgatggtagtgtggg

SEQ ID NO: 120056 - DNA, 25 bp, E. coli
gccgtagcgccgttggtagtgtggg

SEQ ID NO: 120057 - DNA, 25 bp, E. coli
ccgtagcgccgatggtagtgtgggg

SEQ ID NO: 120058 - DNA, 25 bp, E. coli
ccgtagcgccgaaggtagtgtgggg

SEQ ID NO: 120059 - DNA, 25 bp, E. coli
gcggtggtcccacctgaccccatgc

SEQ ID NO: 120060 - DNA, 25 bp, E. coli
gcggtggtcccagctgaccccatgc

SEQ ID NO: 120061 - DNA, 25 bp, E. coli
ccccatgccgaagtcagaagtgaaa

SEQ ID NO: 120062 - DNA, 25 bp, E. coli
cccatgccgaacacagaagtgaaac

SEQ ID NO: 120063 - DNA, 25 bp, E. coli
cgccgtagcgccgatggtagtgtgg

SEQ ID NO: 120064 - DNA, 25 bp, E. coli
cgccgtagcgcccatggtagtgtgg

SEQ ID NO: 120065 - DNA, 25 bp, E. coli
cccatgccgaactcagaagtgaaac

SEQ ID NO: 120066 - DNA, 25 bp, E. coli
ccccatgccgaactcagaagtgaaa

SEQ ID NO: 120067 - DNA, 25 bp, E. coli
cgcggtggtcccacctgaccccatg

SEQ ID NO: 120068 - DNA, 25 bp, E. coli
cgcggtggtccctcctgaccccatg

SEQ ID NO: 120069 - DNA, 25 bp, E. coli
ggtggtcccaccagaccccatgccg

SEQ ID NO: 120070 - DNA, 25 bp, E. coli
ggtggtcccacctgaccccatgccg

SEQ ID NO: 120071 - DNA, 25 bp, E. coli
gaccccatgccgaactcagaagtga

SEQ ID NO: 120072 - DNA, 25 bp, E. coli
gaccccatgccgtactcagaagtga

SEQ ID NO: 120073 - DNA, 25 bp, E. coli
cagcatataggaggcctcgggttga

SEQ ID NO: 120074 - DNA, 25 bp, E. coli
cagcatataggacgcctcgggttga

SEQ ID NO: 120075 - DNA, 25 bp, E. coli
ttcagcatatagcaggcctcgggtt

SEQ ID NO: 120076 - DNA, 25 bp, E. coli
ttcagcatataggaggcctcgggtt

SEQ ID NO: 120077 - DNA, 25 bp, E. coli
tcgggttgatggtaaaatatcactc

SEQ ID NO: 120078 - DNA, 25 bp, E. coli
tcagcatataggtggcctcgggttg

SEQ ID NO: 120079 - DNA, 25 bp, E. coli
tcagcatataggaggcctcgggttg

SEQ ID NO: 120080 - DNA, 25 bp, E. coli
tcgggttgatggaaaaatatcactc

SEQ ID NO: 120081 - DNA, 25 bp, E. coli
gcctcgggttgatggtaaaatatca

SEQ ID NO: 120082 - DNA, 25 bp, E. coli
cctcgggttgatcgtaaaatatcac

SEQ ID NO: 120083 - DNA, 25 bp, E. coli
gcctcgggttgaaggtaaaatatca

SEQ ID NO: 120084 - DNA, 25 bp, E. coli
cctcgggttgatggtaaaatatcac

SEQ ID NO: 120085 - DNA, 25 bp, E. coli
gttcagcatataggaggcctcgggt

SEQ ID NO: 120086 - DNA, 25 bp, E. coli
gttcagcatatacgaggcctcgggt

SEQ ID NO: 120087 - DNA, 25 bp, E. coli
ggttgatggtaaaatatcactcggg

SEQ ID NO: 120088 - DNA, 25 bp, E. coli
ggttgatggtaatatatcactcggg

SEQ ID NO: 120089 - DNA, 25 bp, E. coli
ggcctcgggttgatggtaaaatatc

SEQ ID NO: 120090 - DNA, 25 bp, E. coli
ggcctcgggttgttggtaaaatatc

SEQ ID NO: 120091 - DNA, 25 bp, E. coli
gaggcctcgggttgatggtaaaata

SEQ ID NO: 120092 - DNA, 25 bp, E. coli
gaggcctcgggtagatggtaaaata

SEQ ID NO: 120093 - DNA, 25 bp, E. coli
gatggtaaaatatcactcggggctt

SEQ ID NO: 120094 - DNA, 25 bp, E. coli
gatggtaaaataacactcggggctt

SEQ ID NO: 120095 - DNA, 25 bp, E. coli
caattgggaaaaatactacacttca

SEQ ID NO: 120096 - DNA, 25 bp, E. coli
caattactccgtactaacaattggg

SEQ ID NO: 120097 - DNA, 25 bp, E. coli
caattgggaaaattactacacttca

SEQ ID NO: 120098 - DNA, 25 bp, E. coli
caattactccgttctaacaattggg

SEQ ID NO: 120099 - DNA, 25 bp, E. coli
taaacaatgcttcttcacagaacat

SEQ ID NO: 120100 - DNA, 25 bp, E. coli
tacgtctctgagtgcatcgttgtgc

SEQ ID NO: 120101 - DNA, 25 bp, E. coli
taaacaatgcttgttcacagaacat

SEQ ID NO: 120102 - DNA, 25 bp, E. coli
actgtatcattctcaatcactcgca

SEQ ID NO: 120103 - DNA, 25 bp, E. coli
actgtatcattcacaatcactcgca

SEQ ID NO: 120104 - DNA, 25 bp, E. coli
tacgtctctgagagcatcgttgtgc

SEQ ID NO: 120105 - DNA, 25 bp, E. coli
tataaattaacatctggctgcgcca

SEQ ID NO: 120106 - DNA, 25 bp, E. coli
tataaattaacaactggctgcgcca

SEQ ID NO: 120107 - DNA, 25 bp, E. coli
ttacccagtcgatcccacgggtctg

SEQ ID NO: 120108 - DNA, 25 bp, E. coli
ttacccagtcgaacccacgggtctg

SEQ ID NO: 120109 - DNA, 25 bp, E. coli
ccacgggtctgatagcccttgcttt

SEQ ID NO: 120110 - DNA, 25 bp, E. coli
gaattgcatagatacattacccagt

SEQ ID NO: 120111 - DNA, 25 bp, E. coli
gaattgcatagaaacattacccagt

SEQ ID NO: 120112 - DNA, 25 bp, E. coli
ccacgggtctgaaagcccttgcttt

SEQ ID NO: 120113 - DNA, 25 bp, E. coli
tggctgcgccagagattacgtctct

SEQ ID NO: 120114 - DNA, 25 bp, E. coli
tggctgcgccagtgattacgtctct

SEQ ID NO: 120115 - DNA, 25 bp, E. coli
gatgcataaacatccacattacgag

SEQ ID NO: 120116 - DNA, 25 bp, E. coli
gatgcataaacaaccacattacgag

SEQ ID NO: 120117 - DNA, 25 bp, E. coli
aaagaattcaaataaccaccaggct

SEQ ID NO: 120118 - DNA, 25 bp, E. coli
aactccttaaaatttgcacccatgg

SEQ ID NO: 120119 - DNA, 25 bp, E. coli
aaagaattcaaaaaaccaccaggct

SEQ ID NO: 120120 - DNA, 25 bp, E. coli
aactccttaaaaattgcacccatgg

SEQ ID NO: 120121 - DNA, 25 bp, E. coli
tgcctgtctggatcacataatccag

SEQ ID NO: 120122 - DNA, 25 bp, E. coli
tgcctgtctggaacacataatccag

SEQ ID NO: 120123 - DNA, 25 bp, E. coli
tcaggttaaaagagagcggattatc

SEQ ID NO: 120124 - DNA, 25 bp, E. coli
tcaggttaaaagtgagcggattatc

SEQ ID NO: 120125 - DNA, 25 bp, E. coli
gcagtcatgcttcacaccgtcgtta

SEQ ID NO: 120126 - DNA, 25 bp, E. coli
gcacccatggcaattgcacgagcag

SEQ ID NO: 120127 - DNA, 25 bp, E. coli
gcagtcatgcttgacaccgtcgtta

SEQ ID NO: 120128 - DNA, 25 bp, E. coli
gcacccatggcatttgcacgagcag

SEQ ID NO: 120129 - DNA, 25 bp, E. coli
cgatgacaacgagtaaataaggtga

SEQ ID NO: 120130 - DNA, 25 bp, E. coli
cgagcagtgttaatgtggcgattac

SEQ ID NO: 120131 - DNA, 25 bp, E. coli
cgatgacaacgactaaataaggtga

SEQ ID NO: 120132 - DNA, 25 bp, E. coli
ccctgtatgttatttgcagtcatgc

SEQ ID NO: 120133 - DNA, 25 bp, E. coli
ccctgtatgttaattgcagtcatgc

SEQ ID NO: 120134 - DNA, 25 bp, E. coli
cgagcagtgttattgtggcgattac

SEQ ID NO: 120135 - DNA, 25 bp, E. coli
tggcgattacggtatcgatgacaac

SEQ ID NO: 120136 - DNA, 25 bp, E. coli
tggcgattacggaatcgatgacaac

SEQ ID NO: 120137 - DNA, 25 bp, E. coli
taaggtgatgaaaatcacacaggaa

SEQ ID NO: 120138 - DNA, 25 bp, E. coli
taaggtgatgaatatcacacaggaa

SEQ ID NO: 120139 - DNA, 25 bp, E. coli
caatgatattctatatagcgtgcga

SEQ ID NO: 120140 - DNA, 25 bp, E. coli
caagaaggctagatataaaataatt

SEQ ID NO: 120141 - DNA, 25 bp, E. coli
caagaaggctagttataaaataatt

SEQ ID NO: 120142 - DNA, 25 bp, E. coli
caatgatattctttatagcgtgcga

SEQ ID NO: 120143 - DNA, 25 bp, E. coli
aactggagaataaggagttctgcgc

SEQ ID NO: 120144 - DNA, 25 bp, E. coli
cactgtggagtggttgatataaatc

SEQ ID NO: 120145 - DNA, 25 bp, E. coli
cactgtggagtgcttgatataaatc

SEQ ID NO: 120146 - DNA, 25 bp, E. coli
cattagtaaactcgagaatatggag

SEQ ID NO: 120147 - DNA, 25 bp, E. coli
cattagtaaactggagaatatggag

SEQ ID NO: 120148 - DNA, 25 bp, E. coli
aaaatgaagtttatgactggattgg

SEQ ID NO: 120149 - DNA, 25 bp, E. coli
aaaatgaagtttttgactggattgg

SEQ ID NO: 120150 - DNA, 25 bp, E. coli
aactggagaatatggagttctgcgc

SEQ ID NO: 120151 - DNA, 25 bp, E. coli
tagcgtgcgatttaaaaacattagt

SEQ ID NO: 120152 - DNA, 25 bp, E. coli
tagcgtgcgattaaaaaacattagt

SEQ ID NO: 120153 - DNA, 25 bp, E. coli
ttagtgataaaatcaagaaggctag

SEQ ID NO: 120154 - DNA, 25 bp, E. coli
ttagtgataaaaacaagaaggctag

SEQ ID NO: 120155 - DNA, 25 bp, E. coli
tgactggattggaaaatggtcataa

SEQ ID NO: 120156 - DNA, 25 bp, E. coli
tgcgctacaaaagaacgggtgtatt

SEQ ID NO: 120157 - DNA, 25 bp, E. coli
tgactggattggtaaatggtcataa

SEQ ID NO: 120158 - DNA, 25 bp, E. coli
tgcgctacaaaacaacgggtgtatt

SEQ ID NO: 120159 - DNA, 25 bp, E. coli
gagttctgcgctacaaaacaacggg

SEQ ID NO: 120160 - DNA, 25 bp, E. coli
gagttctgcgcttcaaaacaacggg

SEQ ID NO: 120161 - DNA, 25 bp, E. coli
aaatcgcggactgtcaggagcaggt

SEQ ID NO: 120162 - DNA, 25 bp, E. coli
acaacccgggctcggaagattacag

SEQ ID NO: 120163 - DNA, 25 bp, E. coli
aaatcgcggactctcaggagcaggt

SEQ ID NO: 120164 - DNA, 25 bp, E. coli
acaacccgggctgggaagattacag

SEQ ID NO: 120165 - DNA, 25 bp, E. coli
tatccggaaaatcgcggactgtcag

SEQ ID NO: 120166 - DNA, 25 bp, E. coli
tatccggaaaatggcggactgtcag

SEQ ID NO: 120167 - DNA, 25 bp, E. coli
tatatagaggaatttgagtcaactg

SEQ ID NO: 120168 - DNA, 25 bp, E. coli
tatatagaggaaattgagtcaactg

SEQ ID NO: 120169 - DNA, 25 bp, E. coli
tgagtcaactgtgaccagcctgcac

SEQ ID NO: 120170 - DNA, 25 bp, E. coli
tgagtcaactgtcaccagcctgcac

SEQ ID NO: 120171 - DNA, 25 bp, E. coli
cctgcttgcggatatccggaaaatc

SEQ ID NO: 120172 - DNA, 25 bp, E. coli
cctgcttgcggaaatccggaaaatc

SEQ ID NO: 120173 - DNA, 25 bp, E. coli
gcaaatgttggacgaagaagacgca

SEQ ID NO: 120174 - DNA, 25 bp, E. coli
gcaaatgttggaggaagaagacgca

SEQ ID NO: 120175 - DNA, 25 bp, E. coli
gacgcagaacaaggaaggtcccggt

SEQ ID NO: 120176 - DNA, 25 bp, E. coli
gacgcagaacaacgaaggtcccggt

SEQ ID NO: 120177 - DNA, 25 bp, E. coli
tggaggaagaagtcgcagaacaacg

SEQ ID NO: 120178 - DNA, 25 bp, E. coli
tggaggaagaagacgcagaacaacg

SEQ ID NO: 120179 - DNA, 25 bp, E. coli
taatcgcagggaagcaattgaatat

SEQ ID NO: 120180 - DNA, 25 bp, E. coli
taatcgcagggatgcaattgaatat

SEQ ID NO: 120181 - DNA, 25 bp, E. coli
gagataacactatataatcgcaggg

SEQ ID NO: 120182 - DNA, 25 bp, E. coli
gagataacactaaataatcgcaggg

SEQ ID NO: 120183 - DNA, 25 bp, E. coli
cagtagcgtggaaatacggcgttga

SEQ ID NO: 120184 - DNA, 25 bp, E. coli
cagtagcgtggatatacggcgttga

SEQ ID NO: 120185 - DNA, 25 bp, E. coli
attcggtatgacagcgattgccaac

SEQ ID NO: 120186 - DNA, 25 bp, E. coli
attcggtatgactgcgattgccaac

SEQ ID NO: 120187 - DNA, 25 bp, E. coli
taccgctcgtgtagcggtggaagct

SEQ ID NO: 120188 - DNA, 25 bp, E. coli
taccgctcgtgttgcggtggaagct

SEQ ID NO: 120189 - DNA, 25 bp, E. coli
tgtacgtgaattcggtatgactgcg

SEQ ID NO: 120190 - DNA, 25 bp, E. coli
tgtacgtgaattgggtatgactgcg

SEQ ID NO: 120191 - DNA, 25 bp, E. coli
tccgcagtagcgtggaaatacggcg

SEQ ID NO: 120192 - DNA, 25 bp, E. coli
tccgcagtagcgaggaaatacggcg

SEQ ID NO: 120193 - DNA, 25 bp, E. coli
tccactacggtgaacgtgaattcgg

SEQ ID NO: 120194 - DNA, 25 bp, E. coli
tccactacggtgtacgtgaattcgg

SEQ ID NO: 120195 - DNA, 25 bp, E. coli
gccgaaagcggtaaccgctcgtgtt

SEQ ID NO: 120196 - DNA, 25 bp, E. coli
gccgaaagcggttaccgctcgtgtt

SEQ ID NO: 120197 - DNA, 25 bp, E. coli
gatctggagtcataatgtcctcacg

SEQ ID NO: 120198 - DNA, 25 bp, E. coli
gatctggagtcaaaatgtcctcacg

SEQ ID NO: 120199 - DNA, 25 bp, E. coli
ggtagaacagatcgcttctctgcgc

SEQ ID NO: 120200 - DNA, 25 bp, E. coli
ggtagaacagatggcttctctgcgc

SEQ ID NO: 120201 - DNA, 25 bp, E. coli
tggaagctggcattgctgactactg

SEQ ID NO: 120202 - DNA, 25 bp, E. coli
tggaagctggcaatgctgactactg

SEQ ID NO: 120203 - DNA, 25 bp, E. coli
tcaccagccggtagaacagatcgct

SEQ ID NO: 120204 - DNA, 25 bp, E. coli
tcaccagccggttgaacagatcgct

SEQ ID NO: 120205 - DNA, 25 bp, E. coli
atcgccgcgcgtcagcagaaagaaa

SEQ ID NO: 120206 - DNA, 25 bp, E. coli
atgacccaggcgtcgcggttgagaa

SEQ ID NO: 120207 - DNA, 25 bp, E. coli
atcgccgcgcgtgagcagaaagaaa

SEQ ID NO: 120208 - DNA, 25 bp, E. coli
atgacccaggcgacgcggttgagaa

SEQ ID NO: 120209 - DNA, 25 bp, E. coli
aaagccggtttaagagagcgtgtca

SEQ ID NO: 120210 - DNA, 25 bp, E. coli
aaagccggtttatgagagcgtgtca

SEQ ID NO: 120211 - DNA, 25 bp, E. coli
tgaattctatatggccgcgcgtgag

SEQ ID NO: 120212 - DNA, 25 bp, E. coli
tgaattctatatcgccgcgcgtgag

SEQ ID NO: 120213 - DNA, 25 bp, E. coli
tccgtcgaggagcaagatgacccag

SEQ ID NO: 120214 - DNA, 25 bp, E. coli
tccgtcgaggaggaagatgacccag

SEQ ID NO: 120215 - DNA, 25 bp, E. coli
gcttttaaacaatcaacacaacact

SEQ ID NO: 120216 - DNA, 25 bp, E. coli
gcttttaaacaaacaacacaacact

SEQ ID NO: 120217 - DNA, 25 bp, E. coli
gacaaaaacacagcaccataatata

SEQ ID NO: 120218 - DNA, 25 bp, E. coli
gacaaaaacacaccaccataatata

SEQ ID NO: 120219 - DNA, 25 bp, E. coli
ctgatttgcctgaggtttgcaggaa

SEQ ID NO: 120220 - DNA, 25 bp, E. coli
cttctgaagacgaagaaaatactgt

SEQ ID NO: 120221 - DNA, 25 bp, E. coli
ctgatttgcctgtggtttgcaggaa

SEQ ID NO: 120222 - DNA, 25 bp, E. coli
cttctgaagacgtagaaaatactgt

SEQ ID NO: 120223 - DNA, 25 bp, E. coli
gtatcttctccccacaaaaacacag

SEQ ID NO: 120224 - DNA, 25 bp, E. coli
gtatcttctcccgacaaaaacacag

SEQ ID NO: 120225 - DNA, 25 bp, E. coli
tccccgtcgtcgaatccgtcgagga

SEQ ID NO: 120226 - DNA, 25 bp, E. coli
tccccgtcgtcgtatccgtcgagga

SEQ ID NO: 120227 - DNA, 25 bp, E. coli
caagggctaagcttcgaacaaatgc

SEQ ID NO: 120228 - DNA, 25 bp, E. coli
caatgaagtggcaacagggttgttt

SEQ ID NO: 120229 - DNA, 25 bp, E. coli
caatgaagtggctacagggttgttt

SEQ ID NO: 120230 - DNA, 25 bp, E. coli
caagggctaagcatcgaacaaatgc

SEQ ID NO: 120231 - DNA, 25 bp, E. coli
ccagatccgtatccaggcgtggcag

SEQ ID NO: 120232 - DNA, 25 bp, E. coli
ccagatccgtatgcaggcgtggcag

SEQ ID NO: 120233 - DNA, 25 bp, E. coli
gcgcgattatgcgtacaccattggg

SEQ ID NO: 120234 - DNA, 25 bp, E. coli
gcgcgattatgcctacaccattggg

SEQ ID NO: 120235 - DNA, 25 bp, E. coli
gaaccgtaaaggtagcgcatcgtct

SEQ ID NO: 120236 - DNA, 25 bp, E. coli
gaaccgtaaaggaagcgcatcgtct

SEQ ID NO: 120237 - DNA, 25 bp, E. coli
gactcgctcggttcacaaattctgc

SEQ ID NO: 120238 - DNA, 25 bp, E. coli
gactcgctcggtacacaaattctgc

SEQ ID NO: 120239 - DNA, 25 bp, E. coli
ccgagcgccgcgttatcgtcaaaga

SEQ ID NO: 120240 - DNA, 25 bp, E. coli
cgatatcgtcaaagatggcatcctg

SEQ ID NO: 120241 - DNA, 25 bp, E. coli
ccgagcgccgcgatatcgtcaaaga

SEQ ID NO: 120242 - DNA, 25 bp, E. coli
cgatatcgtcaatgatggcatcctg

SEQ ID NO: 120243 - DNA, 25 bp, E. coli
ggtggtgcggtctaccgtaaatcga

SEQ ID NO: 120244 - DNA, 25 bp, E. coli
ggtggtgcggtcaaccgtaaatcga

SEQ ID NO: 120245 - DNA, 25 bp, E. coli
ggcatctacaccattcgacagcgaa

SEQ ID NO: 120246 - DNA, 25 bp, E. coli
ggcatctacacctttcgacagcgaa

SEQ ID NO: 120247 - DNA, 25 bp, E. coli
taaatcgaccttcttgctcgactcg

SEQ ID NO: 120248 - DNA, 25 bp, E. coli
taaatcgaccttgttgctcgactcg

SEQ ID NO: 120249 - DNA, 25 bp, E. coli
cattcgtaacggcatgaaggcgtac

SEQ ID NO: 120250 - DNA, 25 bp, E. coli
cagtttgccttgtccgcgatgtacc

SEQ ID NO: 120251 - DNA, 25 bp, E. coli
cagtttgccttgaccgcgatgtacc

SEQ ID NO: 120252 - DNA, 25 bp, E. coli
cattcgtaacgggatgaaggcgtac

SEQ ID NO: 120253 - DNA, 25 bp, E. coli
tgtataccctgtacctggtggcaga

SEQ ID NO: 120254 - DNA, 25 bp, E. coli
tgatgaatccggctacgaaatgggc

SEQ ID NO: 120255 - DNA, 25 bp, E. coli
tgatgaatccgggtacgaaatgggc

SEQ ID NO: 120256 - DNA, 25 bp, E. coli
tgtataccctgttcctggtggcaga

SEQ ID NO: 120257 - DNA, 25 bp, E. coli
tctccgagctggagcttaacccggt

SEQ ID NO: 120258 - DNA, 25 bp, E. coli
tctccgagctggtgcttaacccggt

SEQ ID NO: 120259 - DNA, 25 bp, E. coli
gccaaacgtggctgatgcgactgaa

SEQ ID NO: 120260 - DNA, 25 bp, E. coli
gccaaacgtggcagatgcgactgaa

SEQ ID NO: 120261 - DNA, 25 bp, E. coli
gaaaaccggtcggtatcactttgag

SEQ ID NO: 120262 - DNA, 25 bp, E. coli
gaatatggccgcgaaccgtgggcta

SEQ ID NO: 120263 - DNA, 25 bp, E. coli
gaatatggccgccaaccgtgggcta

SEQ ID NO: 120264 - DNA, 25 bp, E. coli
gaaaaccggtcgctatcactttgag

SEQ ID NO: 120265 - DNA, 25 bp, E. coli
cgaaatgggcgacgtgcagaaaacc

SEQ ID NO: 120266 - DNA, 25 bp, E. coli
cgaaatgggcgaggtgcagaaaacc

SEQ ID NO: 120267 - DNA, 25 bp, E. coli
ggctggatgcaatacccaatcgcgt

SEQ ID NO: 120268 - DNA, 25 bp, E. coli
ggctggatgcaaaacccaatcgcgt

SEQ ID NO: 120269 - DNA, 25 bp, E. coli
taatgttcaagtatgcacgcctcgg

SEQ ID NO: 120270 - DNA, 25 bp, E. coli
taatgttcaagtttgcacgcctcgg

SEQ ID NO: 120271 - DNA, 25 bp, E. coli
aatgcggaaattcgcgacaacatcc

SEQ ID NO: 120272 - DNA, 25 bp, E. coli
aatgcggaaattggcgacaacatcc

SEQ ID NO: 120273 - DNA, 25 bp, E. coli
atgaatgttggcgtgaatgcggaaa

SEQ ID NO: 120274 - DNA, 25 bp, E. coli
atgaatgttggcctgaatgcggaaa

SEQ ID NO: 120275 - DNA, 25 bp, E. coli
aaattcgcgacaacatccgcttcgg

SEQ ID NO: 120276 - DNA, 25 bp, E. coli
aaaatcggcatcaggtaagtacaac

SEQ ID NO: 120277 - DNA, 25 bp, E. coli
aaaatcggcatctggtaagtacaac

SEQ ID NO: 120278 - DNA, 25 bp, E. coli
aaattcgcgacatcatccgcttcgg

SEQ ID NO: 120279 - DNA, 25 bp, E. coli
tgttggcctgaaagcggaaattcgc

SEQ ID NO: 120280 - DNA, 25 bp, E. coli
tgttggcctgaatgcggaaattcgc

SEQ ID NO: 120281 - DNA, 25 bp, E. coli
tccgcttcggtctggagtttgaaaa

SEQ ID NO: 120282 - DNA, 25 bp, E. coli
tccgcttcggtcaggagtttgaaaa

SEQ ID NO: 120283 - DNA, 25 bp, E. coli
tctggagtttgataaatcggcatct

SEQ ID NO: 120284 - DNA, 25 bp, E. coli
tctggagtttgaaaaatcggcatct

SEQ ID NO: 120285 - DNA, 25 bp, E. coli
gcctgaatgcggtaattcgcgacaa

SEQ ID NO: 120286 - DNA, 25 bp, E. coli
gcctgaatgcggaaattcgcgacaa

SEQ ID NO: 120287 - DNA, 25 bp, E. coli
gctcatgaatgtaggcctgaatgcg

SEQ ID NO: 120288 - DNA, 25 bp, E. coli
gctcatgaatgttggcctgaatgcg

SEQ ID NO: 120289 - DNA, 25 bp, E. coli
gacaacatccgcatcggtctggagt

SEQ ID NO: 120290 - DNA, 25 bp, E. coli
gacaacatccgcttcggtctggagt

SEQ ID NO: 120291 - DNA, 25 bp, E. coli
ggagtttgaaaaatcggcatctggt

SEQ ID NO: 120292 - DNA, 25 bp, E. coli
ggagtttgaaaattcggcatctggt

SEQ ID NO: 120293 - DNA, 25 bp, E. coli
caagctggaaacctatgcgtcgcga

SEQ ID NO: 120294 - DNA, 25 bp, E. coli
caagctggaaacgtatgcgtcgcga

SEQ ID NO: 120295 - DNA, 25 bp, E. coli
tatcgctgtttggtgcgacagacca

SEQ ID NO: 120296 - DNA, 25 bp, E. coli
tatgtggttatccaacctacggcgc

SEQ ID NO: 120297 - DNA, 25 bp, E. coli
tatctttcggttattccggcggcag

SEQ ID NO: 120298 - DNA, 25 bp, E. coli
tatgaagtcgttctgacgtccggcc

SEQ ID NO: 120299 - DNA, 25 bp, E. coli
tatctttcggtttttccggcggcag

SEQ ID NO: 120300 - DNA, 25 bp, E. coli
tatgaagtcgttgtgacgtccggcc

SEQ ID NO: 120301 - DNA, 25 bp, E. coli
tatgtggttatcgaacctacggcgc

SEQ ID NO: 120302 - DNA, 25 bp, E. coli
tatcgctgtttgctgcgacagacca

SEQ ID NO: 120303 - DNA, 25 bp, E. coli
tattgccgctgcagttaatacgccg

SEQ ID NO: 120304 - DNA, 25 bp, E. coli
tattgccgctgctgttaatacgccg

SEQ ID NO: 120305 - DNA, 25 bp, E. coli
tctggcctgcgtgaatgaaattgcg

SEQ ID NO: 120306 - DNA, 25 bp, E. coli
tctggcctgcgtcaatgaaattgcg

SEQ ID NO: 120307 - DNA, 25 bp, E. coli
cctacggcgcgggaaatcttcaaat

SEQ ID NO: 120308 - DNA, 25 bp, E. coli
cctacggcgcggcaaatcttcaaat

SEQ ID NO: 120309 - DNA, 25 bp, E. coli
gacaacgccaagatttccgctgtga

SEQ ID NO: 120310 - DNA, 25 bp, E. coli
gacaacgccaagttttccgctgtga

SEQ ID NO: 120311 - DNA, 25 bp, E. coli
gagattaccgggtaatgccaacgcg

SEQ ID NO: 120312 - DNA, 25 bp, E. coli
gagattaacgcggtctacggcataa

SEQ ID NO: 120313 - DNA, 25 bp, E. coli
gagattaacgcgctctacggcataa

SEQ ID NO: 120314 - DNA, 25 bp, E. coli
gagattaccgggaaatgccaacgcg

SEQ ID NO: 120315 - DNA, 25 bp, E. coli
aatcgttatggcctgagtaatggcg

SEQ ID NO: 120316 - DNA, 25 bp, E. coli
aagcggcgaaaatatgcgcaaagcc

SEQ ID NO: 120317 - DNA, 25 bp, E. coli
aatcgttatggcgtgagtaatggcg

SEQ ID NO: 120318 - DNA, 25 bp, E. coli
agagatgacagagcggcgactggaa

SEQ ID NO: 120319 - DNA, 25 bp, E. coli
agagatgacagaccggcgactggaa

SEQ ID NO: 120320 - DNA, 25 bp, E. coli
aagcggcgaaaaaatgcgcaaagcc

SEQ ID NO: 120321 - DNA, 25 bp, E. coli
tatggcgtgagtaatggcgaactta

SEQ ID NO: 120322 - DNA, 25 bp, E. coli
taccggtgggcgatatgctgttgcc

SEQ ID NO: 120323 - DNA, 25 bp, E. coli
tatggcgtgagttatggcgaactta

SEQ ID NO: 120324 - DNA, 25 bp, E. coli
taccggtgggcgttatgctgttgcc

SEQ ID NO: 120325 - DNA, 25 bp, E. coli
tgttgcccgccatgttggcgagctg

SEQ ID NO: 120326 - DNA, 25 bp, E. coli
tgttgcccgccaagttggcgagctg

SEQ ID NO: 120327 - DNA, 25 bp, E. coli
tcttgccgaagagatgacagagcgg

SEQ ID NO: 120328 - DNA, 25 bp, E. coli
tcttgccgaagacatgacagagcgg

SEQ ID NO: 120329 - DNA, 25 bp, E. coli
gcaaagccccgatcctgtttcacta

SEQ ID NO: 120330 - DNA, 25 bp, E. coli
gcaaagccccgaacctgtttcacta

SEQ ID NO: 120331 - DNA, 25 bp, E. coli
cgaaaaaatgcggaaagccccgatc

SEQ ID NO: 120332 - DNA, 25 bp, E. coli
cgaaaaaatgcgcaaagccccgatc

SEQ ID NO: 120333 - DNA, 25 bp, E. coli
cgttatgctgttgcccgccatgttg

SEQ ID NO: 120334 - DNA, 25 bp, E. coli
cgttatgctgttccccgccatgttg

SEQ ID NO: 120335 - DNA, 25 bp, E. coli
taatggcgaacttaccggtgggcgt

SEQ ID NO: 120336 - DNA, 25 bp, E. coli
taatggcgaactaaccggtgggcgt

SEQ ID NO: 120337 - DNA, 25 bp, E. coli
caactgcggcggttcaggtatgacg

SEQ ID NO: 120338 - DNA, 25 bp, E. coli
caaaaacatgttgcagcggtgagag

SEQ ID NO: 120339 - DNA, 25 bp, E. coli
caaaaacatgttccagcggtgagag

SEQ ID NO: 120340 - DNA, 25 bp, E. coli
caactgcggcggatcaggtatgacg

SEQ ID NO: 120341 - DNA, 25 bp, E. coli
cagatgatagatgggcaggcattcc

SEQ ID NO: 120342 - DNA, 25 bp, E. coli
cagatgatagatcggcaggcattcc

SEQ ID NO: 120343 - DNA, 25 bp, E. coli
cagacgccgctctaacatatgggaa

SEQ ID NO: 120344 - DNA, 25 bp, E. coli
cagacgccgctcaaacatatgggaa

SEQ ID NO: 120345 - DNA, 25 bp, E. coli
tatcgcccgacgcttttattgccgg

SEQ ID NO: 120346 - DNA, 25 bp, E. coli
tatgattgctttgctggtcgccagg

SEQ ID NO: 120347 - DNA, 25 bp, E. coli
tatgattgctttcctggtcgccagg

SEQ ID NO: 120348 - DNA, 25 bp, E. coli
tatcgcccgacggttttattgccgg

SEQ ID NO: 120349 - DNA, 25 bp, E. coli
tattgcctgacattgatatccccgg

SEQ ID NO: 120350 - DNA, 25 bp, E. coli
tattgcctgacaatgatatccccgg

SEQ ID NO: 120351 - DNA, 25 bp, E. coli
tcaccataacgatgccggcagctgt

SEQ ID NO: 120352 - DNA, 25 bp, E. coli
gcttctaagcgtccggaataccgtg

SEQ ID NO: 120353 - DNA, 25 bp, E. coli
gcttctaagcgtgcggaataccgtg

SEQ ID NO: 120354 - DNA, 25 bp, E. coli
gacgaccaaatatctcggcgcgcag

SEQ ID NO: 120355 - DNA, 25 bp, E. coli
gacgaccaaataactcggcgcgcag

SEQ ID NO: 120356 - DNA, 25 bp, E. coli
taatgatgcattggccaactgcggc

SEQ ID NO: 120357 - DNA, 25 bp, E. coli
tcaccataacgaagccggcagctgt

SEQ ID NO: 120358 - DNA, 25 bp, E. coli
taatgatgcattcgccaactgcggc

SEQ ID NO: 120359 - DNA, 25 bp, E. coli
caacgtataagggagcggtgagata

SEQ ID NO: 120360 - DNA, 25 bp, E. coli
caacgtataaggcagcggtgagata

SEQ ID NO: 120361 - DNA, 25 bp, E. coli
gctaaatcgcaagaaacaggttcgg

SEQ ID NO: 120362 - DNA, 25 bp, E. coli
gctaaatcgcaacaaacaggttcgg

SEQ ID NO: 120363 - DNA, 25 bp, E. coli
taaacgatgggcgttacctgacgcg

SEQ ID NO: 120364 - DNA, 25 bp, E. coli
taccgtaatttgaaccggcaagata

SEQ ID NO: 120365 - DNA, 25 bp, E. coli
taaacgatgggccttacctgacgcg

SEQ ID NO: 120366 - DNA, 25 bp, E. coli
taccgtaatttgtaccggcaagata

SEQ ID NO: 120367 - DNA, 25 bp, E. coli
aaacaggttcgggacattactccga

SEQ ID NO: 120368 - DNA, 25 bp, E. coli
aaacaggttcggcacattactccga

SEQ ID NO: 120369 - DNA, 25 bp, E. coli
tgtaaataagtatagatttgcgcgc

SEQ ID NO: 120370 - DNA, 25 bp, E. coli
tgtaaataagtaaagatttgcgcgc

SEQ ID NO: 120371 - DNA, 25 bp, E. coli
tccgaaaacacacggctaagccgca

SEQ ID NO: 120372 - DNA, 25 bp, E. coli
tgcgaccgcaattataacactctgg

SEQ ID NO: 120373 - DNA, 25 bp, E. coli
tgcgaccgcaataataacactctgg

SEQ ID NO: 120374 - DNA, 25 bp, E. coli
tccgaaaacacagggctaagccgca

SEQ ID NO: 120375 - DNA, 25 bp, E. coli
cgaaaaattccttatcggcagcggg

SEQ ID NO: 120376 - DNA, 25 bp, E. coli
cgaaaaattcctaatcggcagcggg

SEQ ID NO: 120377 - DNA, 25 bp, E. coli
taatgagcgtaaccaactctgcgac

SEQ ID NO: 120378 - DNA, 25 bp, E. coli
taagccgcaccataagcgcaacgta

SEQ ID NO: 120379 - DNA, 25 bp, E. coli
taatgagcgtaagcaactctgcgac

SEQ ID NO: 120380 - DNA, 25 bp, E. coli
taagccgcaccaaaagcgcaacgta

SEQ ID NO: 120381 - DNA, 25 bp, E. coli
caatcgactttgaagagtttcggac

SEQ ID NO: 120382 - DNA, 25 bp, E. coli
caatcgactttgtagagtttcggac

SEQ ID NO: 120383 - DNA, 25 bp, E. coli
cagccacgaaggttgataatgaagc

SEQ ID NO: 120384 - DNA, 25 bp, E. coli
cagccacgaaggatgataatgaagc

SEQ ID NO: 120385 - DNA, 25 bp, E. coli
taaataagtgttcattaatgcggca

SEQ ID NO: 120386 - DNA, 25 bp, E. coli
taaataagtgttgattaatgcggca

SEQ ID NO: 120387 - DNA, 25 bp, E. coli
tgcctggatagattgagtgcataac

SEQ ID NO: 120388 - DNA, 25 bp, E. coli
tgcctggatagaatgagtgcataac

SEQ ID NO: 120389 - DNA, 25 bp, E. coli
gcatcaatgtaagatctctgcggtg

SEQ ID NO: 120390 - DNA, 25 bp, E. coli
gcatcaatgtaacatctctgcggtg

SEQ ID NO: 120391 - DNA, 25 bp, E. coli
gaagcattgcctctatgatcaatcg

SEQ ID NO: 120392 - DNA, 25 bp, E. coli
gaagcattgcctgtatgatcaatcg

SEQ ID NO: 120393 - DNA, 25 bp, E. coli
gaaggtccgcagtatattcgcagta

SEQ ID NO: 120394 - DNA, 25 bp, E. coli
gaaggtccgcagaatattcgcagta

SEQ ID NO: 120395 - DNA, 25 bp, E. coli
ccctgtagtaaaggttatgcctgga

SEQ ID NO: 120396 - DNA, 25 bp, E. coli
ccctgtagtaaacgttatgcctgga

SEQ ID NO: 120397 - DNA, 25 bp, E. coli
gtacatccactacacagccacgaag

SEQ ID NO: 120398 - DNA, 25 bp, E. coli
gtacatccactagacagccacgaag

SEQ ID NO: 120399 - DNA, 25 bp, E. coli
taatgcggcaaaaactaatacaccg

SEQ ID NO: 120400 - DNA, 25 bp, E. coli
taatgcggcaaatactaatacaccg

SEQ ID NO: 120401 - DNA, 25 bp, E. coli
gagtgcataacatactatagctgta

SEQ ID NO: 120402 - DNA, 25 bp, E. coli
gagtgcataacaaactatagctgta

SEQ ID NO: 120403 - DNA, 25 bp, E. coli
aagcccgtcgtaacatcatcactgg

SEQ ID NO: 120404 - DNA, 25 bp, E. coli
aagcccgtcgtatcatcatcactgg

SEQ ID NO: 120405 - DNA, 25 bp, E. coli
aaaagaccgtatacagtcccgactg

SEQ ID NO: 120406 - DNA, 25 bp, E. coli
aaaagaccgtattcagtcccgactg

SEQ ID NO: 120407 - DNA, 25 bp, E. coli
tatcgctggctaagatcaggttggc

SEQ ID NO: 120408 - DNA, 25 bp, E. coli
tatcgctggctatgatcaggttggc

SEQ ID NO: 120409 - DNA, 25 bp, E. coli
tgttcacccgggttgatttcaggga

SEQ ID NO: 120410 - DNA, 25 bp, E. coli
tggtgtttacacgaaagcccgtcgt

SEQ ID NO: 120411 - DNA, 25 bp, E. coli
tggtgtttacaccaaagcccgtcgt

SEQ ID NO: 120412 - DNA, 25 bp, E. coli
tgttcacccgggatgatttcaggga

SEQ ID NO: 120413 - DNA, 25 bp, E. coli
tgcagtaattactgaggccctggag

SEQ ID NO: 120414 - DNA, 25 bp, E. coli
tgcagtaattacagaggccctggag

SEQ ID NO: 120415 - DNA, 25 bp, E. coli
tctggcaggagcaacggaatgctac

SEQ ID NO: 120416 - DNA, 25 bp, E. coli
tcatcactgggaaaatcatgcccgc

SEQ ID NO: 120417 - DNA, 25 bp, E. coli
tcatcactgggataatcatgcccgc

SEQ ID NO: 120418 - DNA, 25 bp, E. coli
tctggcaggagctacggaatgctac

SEQ ID NO: 120419 - DNA, 25 bp, E. coli
tcaggttggcagtgctcttcgtaca

SEQ ID NO: 120420 - DNA, 25 bp, E. coli
tcaggttggcagagctcttcgtaca

SEQ ID NO: 120421 - DNA, 25 bp, E. coli
gccctggagcgcgtgaatatcagat

SEQ ID NO: 120422 - DNA, 25 bp, E. coli
gccctggagcgcctgaatatcagat

SEQ ID NO: 120423 - DNA, 25 bp, E. coli
gaatgctacaataaaggtcagtcca

SEQ ID NO: 120424 - DNA, 25 bp, E. coli
gaatgctacaattaaggtcagtcca

SEQ ID NO: 120425 - DNA, 25 bp, E. coli
gtaccagaatgtgccgtcaaaaccg

SEQ ID NO: 120426 - DNA, 25 bp, E. coli
gtaccagaatgtcccgtcaaaaccg

SEQ ID NO: 120427 - DNA, 25 bp, E. coli
aaaaagcgccagtgtctgtgcaaaa

SEQ ID NO: 120428 - DNA, 25 bp, E. coli
aaaaagcgccagagtctgtgcaaaa

SEQ ID NO: 120429 - DNA, 25 bp, E. coli
tgttcaaatcgaccctggcggcgat

SEQ ID NO: 120430 - DNA, 25 bp, E. coli
tgttcaaatcgagcctggcggcgat

SEQ ID NO: 120431 - DNA, 25 bp, E. coli
tctttctcccgctgcaatggcagcg

SEQ ID NO: 120432 - DNA, 25 bp, E. coli
tctttctcccgcagcaatggcagcg

SEQ ID NO: 120433 - DNA, 25 bp, E. coli
gcggtttcaccgtgcagatgcagca

SEQ ID NO: 120434 - DNA, 25 bp, E. coli
gcggtttcaccgagcagatgcagca

SEQ ID NO: 120435 - DNA, 25 bp, E. coli
gactcatgacgtaggtccgtaccag

SEQ ID NO: 120436 - DNA, 25 bp, E. coli
gactcatgacgttggtccgtaccag

SEQ ID NO: 120437 - DNA, 25 bp, E. coli
ctggtaacatcgtactggagctgga

SEQ ID NO: 120438 - DNA, 25 bp, E. coli
ctggtaacatcgaactggagctgga

SEQ ID NO: 120439 - DNA, 25 bp, E. coli
gataagatttccgaggtgccgactc

SEQ ID NO: 120440 - DNA, 25 bp, E. coli
gataagatttcccaggtgccgactc

SEQ ID NO: 120441 - DNA, 25 bp, E. coli
gggacccgcacgaattgttgacaac

SEQ ID NO: 120442 - DNA, 25 bp, E. coli
gggacccgcacgtattgttgacaac

SEQ ID NO: 120443 - DNA, 25 bp, E. coli
tggagctggataaacaaaaagcgcc

SEQ ID NO: 120444 - DNA, 25 bp, E. coli
tggagctggatatacaaaaagcgcc

SEQ ID NO: 120445 - DNA, 25 bp, E. coli
gatgcagcagaataaaccaaacccg

SEQ ID NO: 120446 - DNA, 25 bp, E. coli
gatgcagcagaaaaaaccaaacccg

SEQ ID NO: 120447 - DNA, 25 bp, E. coli
aatgggcgaatagtacaaaggcggc

SEQ ID NO: 120448 - DNA, 25 bp, E. coli
aatgggcgaatactacaaaggcggc

SEQ ID NO: 120449 - DNA, 25 bp, E. coli
caacggatgattgataacgctggcg

SEQ ID NO: 120450 - DNA, 25 bp, E. coli
caacggatgattcataacgctggcg

SEQ ID NO: 120451 - DNA, 25 bp, E. coli
taaaggtctgcgaaccattccggtg

SEQ ID NO: 120452 - DNA, 25 bp, E. coli
taaaggtctgcgtaccattccggtg

SEQ ID NO: 120453 - DNA, 25 bp, E. coli
tagtccgttggtccattccgatcgc

SEQ ID NO: 120454 - DNA, 25 bp, E. coli
tagtccgttggtgcattccgatcgc

SEQ ID NO: 120455 - DNA, 25 bp, E. coli
tataaaacgctgcatcgccgcgaag

SEQ ID NO: 120456 - DNA, 25 bp, E. coli
tattggtggcggcagcagctatacc

SEQ ID NO: 120457 - DNA, 25 bp, E. coli
tattggtggcgggagcagctatacc

SEQ ID NO: 120458 - DNA, 25 bp, E. coli
tataaaacgctggatcgccgcgaag

SEQ ID NO: 120459 - DNA, 25 bp, E. coli
tgattaacttcagtaacccggcggg

SEQ ID NO: 120460 - DNA, 25 bp, E. coli
tgattaacttcactaacccggcggg

SEQ ID NO: 120461 - DNA, 25 bp, E. coli
ctgctggcacgcgagatgattctgg

SEQ ID NO: 120462 - DNA, 25 bp, E. coli
ctgctggcacgccagatgattctgg

SEQ ID NO: 120463 - DNA, 25 bp, E. coli
gatttcgttacttcccaactgcgcg

SEQ ID NO: 120464 - DNA, 25 bp, E. coli
gatttcgttactacccaactgcgcg

SEQ ID NO: 120465 - DNA, 25 bp, E. coli
taagccgaaagatctggaacagcgc

SEQ ID NO: 120466 - DNA, 25 bp, E. coli
taagccgaaagaactggaacagcgc

SEQ ID NO: 120467 - DNA, 25 bp, E. coli
taagcgttatcaggaattgccggtc

SEQ ID NO: 120468 - DNA, 25 bp, E. coli
taagcgttatcacgaattgccggtc

SEQ ID NO: 120469 - DNA, 25 bp, E. coli
tattcgacggcggtgggattgcttc

SEQ ID NO: 120470 - DNA, 25 bp, E. coli
tattcgacggcgctgggattgcttc

SEQ ID NO: 120471 - DNA, 25 bp, E. coli
ttgtattaaccgctggcgcagcgca

SEQ ID NO: 120472 - DNA, 25 bp, E. coli
ttgtattaaccggtggcgcagcgca

SEQ ID NO: 120473 - DNA, 25 bp, E. coli
tgtgctgcatgtgatcccgcaagag

SEQ ID NO: 120474 - DNA, 25 bp, E. coli
tgtgctgcatgtcatcccgcaagag

SEQ ID NO: 120475 - DNA, 25 bp, E. coli
tgcccgtcgcgtcgtatggataaag

SEQ ID NO: 120476 - DNA, 25 bp, E. coli
tgcccgtcgcgtggtatggataaag

SEQ ID NO: 120477 - DNA, 25 bp, E. coli
gcaggaaaagctacgccaacaaggg

SEQ ID NO: 120478 - DNA, 25 bp, E. coli
gaagttctgcccgacggtatggtca

SEQ ID NO: 120479 - DNA, 25 bp, E. coli
gcaggaaaagcttcgccaacaaggg

SEQ ID NO: 120480 - DNA, 25 bp, E. coli
gaagttctgccccacggtatggtca

SEQ ID NO: 120481 - DNA, 25 bp, E. coli
gaactgggtgtcagcgtcgtcgata

SEQ ID NO: 120482 - DNA, 25 bp, E. coli
gaactgggtgtctgcgtcgtcgata

SEQ ID NO: 120483 - DNA, 25 bp, E. coli
cgaatccgtggtgaagtgcgtacaa

SEQ ID NO: 120484 - DNA, 25 bp, E. coli
cgaatccgtggtcaagtgcgtacaa

SEQ ID NO: 120485 - DNA, 25 bp, E. coli
gggcattgcgccacactaaggtaat

SEQ ID NO: 120486 - DNA, 25 bp, E. coli
gggcattgcgcctcactaaggtaat

SEQ ID NO: 120487 - DNA, 25 bp, E. coli
ggttaaacatcagctggcggcaggc

SEQ ID NO: 120488 - DNA, 25 bp, E. coli
ggttaaacatcacctggcggcaggc

SEQ ID NO: 120489 - DNA, 25 bp, E. coli
tcaaggcgacggacagaaaactggt

SEQ ID NO: 120490 - DNA, 25 bp, E. coli
tcaaggcgacggtcagaaaactggt

SEQ ID NO: 120491 - DNA, 25 bp, E. coli
aatgctgggccagcgatgtaccgga

SEQ ID NO: 120492 - DNA, 25 bp, E. coli
aatgctgggccaccgatgtaccgga

SEQ ID NO: 120493 - DNA, 25 bp, E. coli
caaaagatgatgtcggacccacgga

SEQ ID NO: 120494 - DNA, 25 bp, E. coli
caaaagatgatgacggacccacgga

SEQ ID NO: 120495 - DNA, 25 bp, E. coli
aaagtgaccgattttcgtatggcgg

SEQ ID NO: 120496 - DNA, 25 bp, E. coli
aaagtgaccgatattcgtatggcgg

SEQ ID NO: 120497 - DNA, 25 bp, E. coli
tgtctttagctgcattgaataccct

SEQ ID NO: 120498 - DNA, 25 bp, E. coli
tgtctttagctggattgaataccct

SEQ ID NO: 120499 - DNA, 25 bp, E. coli
tcgtattgtcgattgctgggccagc

SEQ ID NO: 120500 - DNA, 25 bp, E. coli
tcgtattgtcgaatgctgggccagc

SEQ ID NO: 120501 - DNA, 25 bp, E. coli
gaatacccttcaaaagaggtccgcg

SEQ ID NO: 120502 - DNA, 25 bp, E. coli
gaatacccttcataagaggtccgcg

SEQ ID NO: 120503 - DNA, 25 bp, E. coli
ccgtttgacggctagcgaatgatct

SEQ ID NO: 120504 - DNA, 25 bp, E. coli
ccgtttgacggcaagcgaatgatct

SEQ ID NO: 120505 - DNA, 25 bp, E. coli
gatgcctatcggcaaatggccgcta

SEQ ID NO: 120506 - DNA, 25 bp, E. coli
gttgccgttcctcccgataaaaagg

SEQ ID NO: 120507 - DNA, 25 bp, E. coli
gttgccgttcctgccgataaaaagg

SEQ ID NO: 120508 - DNA, 25 bp, E. coli
gacccacggatgaaagagttcggcg

SEQ ID NO: 120509 - DNA, 25 bp, E. coli
gacccacggatgtaagagttcggcg

SEQ ID NO: 120510 - DNA, 25 bp, E. coli
gagttcggcgagtccatgccgtttg

SEQ ID NO: 120511 - DNA, 25 bp, E. coli
gagttcggcgagaccatgccgtttg

SEQ ID NO: 120512 - DNA, 25 bp, E. coli
gatgcctatcgggaaatggccgcta

SEQ ID NO: 120513 - DNA, 25 bp, E. coli
caaggcgttcgtagccagatgcggt

SEQ ID NO: 120514 - DNA, 25 bp, E. coli
caaggcgttcgttgccagatgcggt

SEQ ID NO: 120515 - DNA, 25 bp, E. coli
cacttttatgtcaggcaaggcgttc

SEQ ID NO: 120516 - DNA, 25 bp, E. coli
cacttttatgtctggcaaggcgttc

SEQ ID NO: 120517 - DNA, 25 bp, E. coli
attaactggataactacctcatggg

SEQ ID NO: 120518 - DNA, 25 bp, E. coli
attaactggatatctacctcatggg

SEQ ID NO: 120519 - DNA, 25 bp, E. coli
tgcaaattcgaaccgtaggccagta

SEQ ID NO: 120520 - DNA, 25 bp, E. coli
tgcaaattcgaagcgtaggccagta

SEQ ID NO: 120521 - DNA, 25 bp, E. coli
gctgtggaataataatgccggagat

SEQ ID NO: 120522 - DNA, 25 bp, E. coli
gctgtggaataaaaatgccggagat

SEQ ID NO: 120523 - DNA, 25 bp, E. coli
gaatagtgaattacccggactggct

SEQ ID NO: 120524 - DNA, 25 bp, E. coli
gaatagtgaatttcccggactggct

SEQ ID NO: 120525 - DNA, 25 bp, E. coli
gactcaatgttgatgtggctcaagg

SEQ ID NO: 120526 - DNA, 25 bp, E. coli
gactcaatgttgttgtggctcaagg

SEQ ID NO: 120527 - DNA, 25 bp, E. coli
cgtttgacagcgacatgagaccaga

SEQ ID NO: 120528 - DNA, 25 bp, E. coli
cgtttgacagcgtcatgagaccaga

SEQ ID NO: 120529 - DNA, 25 bp, E. coli
cttatctgccctacgatttcgtgca

SEQ ID NO: 120530 - DNA, 25 bp, E. coli
cttatctgcccttcgatttcgtgca

SEQ ID NO: 120531 - DNA, 25 bp, E. coli
ggctcaaggttatatcgcagcgaaa

SEQ ID NO: 120532 - DNA, 25 bp, E. coli
ggctcaaggttaaatcgcagcgaaa

SEQ ID NO: 120533 - DNA, 25 bp, E. coli
gagaccagatgatttgccaacaaag

SEQ ID NO: 120534 - DNA, 25 bp, E. coli
gagaccagatgaattgccaacaaag

SEQ ID NO: 120535 - DNA, 25 bp, E. coli
cacgccgatctgtcaggtttaagct

SEQ ID NO: 120536 - DNA, 25 bp, E. coli
cacgccgatctgacaggtttaagct

SEQ ID NO: 120537 - DNA, 25 bp, E. coli
catttgactggatacactcatttcg

SEQ ID NO: 120538 - DNA, 25 bp, E. coli
cagtttctccgctaatagtgtatga

SEQ ID NO: 120539 - DNA, 25 bp, E. coli
cagtttctccgcaaatagtgtatga

SEQ ID NO: 120540 - DNA, 25 bp, E. coli
catttgactggaaacactcatttcg

SEQ ID NO: 120541 - DNA, 25 bp, E. coli
tatgcccggcgatcaagtcagaagt

SEQ ID NO: 120542 - DNA, 25 bp, E. coli
tatgcccggcgaacaagtcagaagt

SEQ ID NO: 120543 - DNA, 25 bp, E. coli
ttttataaatatcacgccgacttcg

SEQ ID NO: 120544 - DNA, 25 bp, E. coli
ttttataaatatgacgccgacttcg

SEQ ID NO: 120545 - DNA, 25 bp, E. coli
ttgaactggcccagatatgcccggc

SEQ ID NO: 120546 - DNA, 25 bp, E. coli
ttgaactggccctgatatgcccggc

SEQ ID NO: 120547 - DNA, 25 bp, E. coli
tgtcaggaaagctgggaattaacca

SEQ ID NO: 120548 - DNA, 25 bp, E. coli
tgtcaggaaagcagggaattaacca

SEQ ID NO: 120549 - DNA, 25 bp, E. coli
gaacattatgttattgccacgtcaa

SEQ ID NO: 120550 - DNA, 25 bp, E. coli
gaacattatgtttttgccacgtcaa

SEQ ID NO: 120551 - DNA, 25 bp, E. coli
gatctatagagttgccaattccact

SEQ ID NO: 120552 - DNA, 25 bp, E. coli
gatctatagagtagccaattccact

SEQ ID NO: 120553 - DNA, 25 bp, E. coli
gttgtcttttaaacacgccgatctg

SEQ ID NO: 120554 - DNA, 25 bp, E. coli
gttgtcttttaatcacgccgatctg

SEQ ID NO: 120555 - DNA, 25 bp, E. coli
ggtttaagctattagaatgccaggc

SEQ ID NO: 120556 - DNA, 25 bp, E. coli
ggtttaagctataagaatgccaggc

SEQ ID NO: 120557 - DNA, 25 bp, E. coli
attaaactcccatcaggacacactc

SEQ ID NO: 120558 - DNA, 25 bp, E. coli
attaaactcccaacaggacacactc

SEQ ID NO: 120559 - DNA, 25 bp, E. coli
acaggatgcggcctaaaatgcctta

SEQ ID NO: 120560 - DNA, 25 bp, E. coli
acaggatgcggcgtaaaatgcctta

SEQ ID NO: 120561 - DNA, 25 bp, E. coli
tatccggcattatactcccaacagg

SEQ ID NO: 120562 - DNA, 25 bp, E. coli
tatccggcattaaactcccaacagg

SEQ ID NO: 120563 - DNA, 25 bp, E. coli
ttatccggcctagggctcggtttgt

SEQ ID NO: 120564 - DNA, 25 bp, E. coli
ttatccggcctagggctcggatttg

SEQ ID NO: 120565 - DNA, 25 bp, E. coli
ttatccggcctacggctcggatttg

SEQ ID NO: 120566 - DNA, 25 bp, E. coli
ttatccggcctacggctcggtttgt

SEQ ID NO: 120567 - DNA, 25 bp, E. coli
tcgcatcaggctgcgggtgccggat

SEQ ID NO: 120568 - DNA, 25 bp, E. coli
tcgcatcaggctccgggtgccggat

SEQ ID NO: 120569 - DNA, 25 bp, E. coli
tcaggcacaggatgcggcgtaaaat

SEQ ID NO: 120570 - DNA, 25 bp, E. coli
tcaggcacaggaagcggcgtaaaat

SEQ ID NO: 120571 - DNA, 25 bp, E. coli
gcgtaaaatgccttatccggcatta

SEQ ID NO: 120572 - DNA, 25 bp, E. coli
gcgtaaaatgccatatccggcatta

SEQ ID NO: 120573 - DNA, 25 bp, E. coli
ccggcctacggctcggatttgtagg

SEQ ID NO: 120574 - DNA, 25 bp, E. coli
ccggcctacggcacggatttgtagg

SEQ ID NO: 120575 - DNA, 25 bp, E. coli
cggcattaaactcccaacaggacac

SEQ ID NO: 120576 - DNA, 25 bp, E. coli
ctccgggtgccggatgcagcgtgaa

SEQ ID NO: 120577 - DNA, 25 bp, E. coli
cggcattaaactgccaacaggacac

SEQ ID NO: 120578 - DNA, 25 bp, E. coli
ctccgggtgccgcatgcagcgtgaa

SEQ ID NO: 120579 - DNA, 25 bp, E. coli
caatggccatctctatcaaccggga

SEQ ID NO: 120580 - DNA, 25 bp, E. coli
caatggccatctgtatcaaccggga

SEQ ID NO: 120581 - DNA, 25 bp, E. coli
tatggttggcaacaatatccctggg

SEQ ID NO: 120582 - DNA, 25 bp, E. coli
tatggttggcaagaatatccctggg

SEQ ID NO: 120583 - DNA, 25 bp, E. coli
tatcagtgccgaatgtgtctccggg

SEQ ID NO: 120584 - DNA, 25 bp, E. coli
tatcagtgccgattgtgtctccggg

SEQ ID NO: 120585 - DNA, 25 bp, E. coli
ttcaggagtacctaccagatatcgt

SEQ ID NO: 120586 - DNA, 25 bp, E. coli
ttcaggagtaccaaccagatatcgt

SEQ ID NO: 120587 - DNA, 25 bp, E. coli
tgaaaatagcgtatatcggcgaagc

SEQ ID NO: 120588 - DNA, 25 bp, E. coli
tgaaaatagcgtttatcggcgaagc

SEQ ID NO: 120589 - DNA, 25 bp, E. coli
tgcgtcgggcgaaacatattcatgc

SEQ ID NO: 120590 - DNA, 25 bp, E. coli
tgcgtcgggcgatacatattcatgc

SEQ ID NO: 120591 - DNA, 25 bp, E. coli
tctccgggcctggtgacattattca

SEQ ID NO: 120592 - DNA, 25 bp, E. coli
tctccgggcctgctgacattattca

SEQ ID NO: 120593 - DNA, 25 bp, E. coli
gaagctgtttctggatttggcggca

SEQ ID NO: 120594 - DNA, 25 bp, E. coli
gaagctgtttctcgatttggcggca

SEQ ID NO: 120595 - DNA, 25 bp, E. coli
gaaaaaattcctgcgtcgatcgatg

SEQ ID NO: 120596 - DNA, 25 bp, E. coli
gaaaaaattcctccgtcgatcgatg

SEQ ID NO: 120597 - DNA, 25 bp, E. coli
ggctccgatttcgaaaaatgccagg

SEQ ID NO: 120598 - DNA, 25 bp, E. coli
ggctccgatttccaaaaatgccagg

SEQ ID NO: 120599 - DNA, 25 bp, E. coli
gatgtgatctccagcctgtttgccg

SEQ ID NO: 120600 - DNA, 25 bp, E. coli
gatgtgatctcctgcctgtttgccg

SEQ ID NO: 120601 - DNA, 25 bp, E. coli
caaacgttattagaccgagacagaa

SEQ ID NO: 120602 - DNA, 25 bp, E. coli
caaacgttattacaccgagacagaa

SEQ ID NO: 120603 - DNA, 25 bp, E. coli
tacatggcagcgctgatccgcacac

SEQ ID NO: 120604 - DNA, 25 bp, E. coli
tacatggcagcggtgatccgcacac

SEQ ID NO: 120605 - DNA, 25 bp, E. coli
aagactttaacacccagaatcccag

SEQ ID NO: 120606 - DNA, 25 bp, E. coli
aagactttaacagccagaatcccag

SEQ ID NO: 120607 - DNA, 25 bp, E. coli
aaaaactgcagtggctactaacggc

SEQ ID NO: 120608 - DNA, 25 bp, E. coli
aaaaactgcagtcgctactaacggc

SEQ ID NO: 120609 - DNA, 25 bp, E. coli
tgttgaaccgattaagctggcgcta

SEQ ID NO: 120610 - DNA, 25 bp, E. coli
tgttgaaccgataaagctggcgcta

SEQ ID NO: 120611 - DNA, 25 bp, E. coli
gcgcatgcacaaacaccagatacgg

SEQ ID NO: 120612 - DNA, 25 bp, E. coli
gcgcatgcacaatcaccagatacgg

SEQ ID NO: 120613 - DNA, 25 bp, E. coli
gaacgaatttcgtgccatcgacagc

SEQ ID NO: 120614 - DNA, 25 bp, E. coli
gaacgaatttcgagccatcgacagc

SEQ ID NO: 120615 - DNA, 25 bp, E. coli
cgctggagcgcggtaccttaaaaat

SEQ ID NO: 120616 - DNA, 25 bp, E. coli
cgctggagcgcgctaccttaaaaat

SEQ ID NO: 120617 - DNA, 25 bp, E. coli
gatctctccatctgccagtttcgag

SEQ ID NO: 120618 - DNA, 25 bp, E. coli
gatctctccatcagccagtttcgag

SEQ ID NO: 120619 - DNA, 25 bp, E. coli
tggctggagcccgtactttcgatct

SEQ ID NO: 120620 - DNA, 25 bp, E. coli
tggctggagcccctactttcgatct

SEQ ID NO: 120621 - DNA, 25 bp, E. coli
gaccgcgccttaactgctggctgga

SEQ ID NO: 120622 - DNA, 25 bp, E. coli
gaccgcgccttatctgctggctgga

SEQ ID NO: 120623 - DNA, 25 bp, E. coli
aatgatgtcgataccaaaaccgacg

SEQ ID NO: 120624 - DNA, 25 bp, E. coli
aatgatgtcgattccaaaaccgacg

SEQ ID NO: 120625 - DNA, 25 bp, E. coli
actggctgccgatagcggagcgcaa

SEQ ID NO: 120626 - DNA, 25 bp, E. coli
aaacgccgcagctgatgcgggccag

SEQ ID NO: 120627 - DNA, 25 bp, E. coli
aaacgccgcagcagatgcgggccag

SEQ ID NO: 120628 - DNA, 25 bp, E. coli
actggctgccgaaagcggagcgcaa

SEQ ID NO: 120629 - DNA, 25 bp, E. coli
taccaaaaccgacggtaccacgcag

SEQ ID NO: 120630 - DNA, 25 bp, E. coli
taccaaaaccgagggtaccacgcag

SEQ ID NO: 120631 - DNA, 25 bp, E. coli
tgactgccactctaagccttgccag

SEQ ID NO: 120632 - DNA, 25 bp, E. coli
tgactgccactcaaagccttgccag

SEQ ID NO: 120633 - DNA, 25 bp, E. coli
gccaaataacgtcgacaataacggg

SEQ ID NO: 120634 - DNA, 25 bp, E. coli
gcccgtgaaaatctcgcgccaaata

SEQ ID NO: 120635 - DNA, 25 bp, E. coli
gccaaataacgtggacaataacggg

SEQ ID NO: 120636 - DNA, 25 bp, E. coli
gcccgtgaaaatgtcgcgccaaata

SEQ ID NO: 120637 - DNA, 25 bp, E. coli
gaacaccatgtgcaaagatggtcgc

SEQ ID NO: 120638 - DNA, 25 bp, E. coli
gaacaccatgtggaaagatggtcgc

SEQ ID NO: 120639 - DNA, 25 bp, E. coli
ctgatgcgggcctggtagcccctga

SEQ ID NO: 120640 - DNA, 25 bp, E. coli
ctgatgcgggccaggtagcccctga

SEQ ID NO: 120641 - DNA, 25 bp, E. coli
gatggttcttcaatgaacaatgacg

SEQ ID NO: 120642 - DNA, 25 bp, E. coli
gatgaagagcactagaacaccatgt

SEQ ID NO: 120643 - DNA, 25 bp, E. coli
gatggttcttcattgaacaatgacg

SEQ ID NO: 120644 - DNA, 25 bp, E. coli
gatgaagagcacaagaacaccatgt

SEQ ID NO: 120645 - DNA, 25 bp, E. coli
caatctcattgctcgaaaaagggct

SEQ ID NO: 120646 - DNA, 25 bp, E. coli
caatctcattgcacgaaaaagggct

SEQ ID NO: 120647 - DNA, 25 bp, E. coli
taaagacagaaaagggaagccctga

SEQ ID NO: 120648 - DNA, 25 bp, E. coli
taaagacagaaatgggaagccctga

SEQ ID NO: 120649 - DNA, 25 bp, E. coli
aaagggaagcccagaagcaatctca

SEQ ID NO: 120650 - DNA, 25 bp, E. coli
aaagggaagccctgaagcaatctca

SEQ ID NO: 120651 - DNA, 25 bp, E. coli
ttgctcgaaaaagggcttcttattc

SEQ ID NO: 120652 - DNA, 25 bp, E. coli
ttgctcgaaaaacggcttcttattc

SEQ ID NO: 120653 - DNA, 25 bp, E. coli
tcattgctcgaataagggcttctta

SEQ ID NO: 120654 - DNA, 25 bp, E. coli
tctcattgctcgaaaaagggcttct

SEQ ID NO: 120655 - DNA, 25 bp, E. coli
tctcattgctcgtaaaagggcttct

SEQ ID NO: 120656 - DNA, 25 bp, E. coli
tcattgctcgaaaaagggcttctta

SEQ ID NO: 120657 - DNA, 25 bp, E. coli
gctaaagacagataagggaagccct

SEQ ID NO: 120658 - DNA, 25 bp, E. coli
gctaataaccagctaaagacagaaa

SEQ ID NO: 120659 - DNA, 25 bp, E. coli
gctaaagacagaaaagggaagccct

SEQ ID NO: 120660 - DNA, 25 bp, E. coli
gctaataaccaggtaaagacagaaa

SEQ ID NO: 120661 - DNA, 25 bp, E. coli
gacagaaaagggtagccctgaagca

SEQ ID NO: 120662 - DNA, 25 bp, E. coli
gacagaaaagggaagccctgaagca

SEQ ID NO: 120663 - DNA, 25 bp, E. coli
gggaagccctgaagcaatctcattg

SEQ ID NO: 120664 - DNA, 25 bp, E. coli
gggaagccctgatgcaatctcattg

SEQ ID NO: 120665 - DNA, 25 bp, E. coli
taaccagctaaacacagaaaaggga

SEQ ID NO: 120666 - DNA, 25 bp, E. coli
taaccagctaaagacagaaaaggga

SEQ ID NO: 120667 - DNA, 25 bp, E. coli
cagatacagcatgtgctggatgata

SEQ ID NO: 120668 - DNA, 25 bp, E. coli
cagatacagcatctgctggatgata

SEQ ID NO: 120669 - DNA, 25 bp, E. coli
agatacagcatgagctggatgataa

SEQ ID NO: 120670 - DNA, 25 bp, E. coli
agatacagcatgtgctggatgataa

SEQ ID NO: 120671 - DNA, 25 bp, E. coli
agcagatacagcatgtgctggatga

SEQ ID NO: 120672 - DNA, 25 bp, E. coli
agcagatacagcttgtgctggatga

SEQ ID NO: 120673 - DNA, 25 bp, E. coli
atacagcatgtggtggatgataacc

SEQ ID NO: 120674 - DNA, 25 bp, E. coli
atacagcatgtgctggatgataacc

SEQ ID NO: 120675 - DNA, 25 bp, E. coli
ttcaacggtctgggggagcagatac

SEQ ID NO: 120676 - DNA, 25 bp, E. coli
ttcaacggtctgcgggagcagatac

SEQ ID NO: 120677 - DNA, 25 bp, E. coli
ccgtggccgacgcggagacacgatt

SEQ ID NO: 120678 - DNA, 25 bp, E. coli
gcagatacagcaagtgctggatgat

SEQ ID NO: 120679 - DNA, 25 bp, E. coli
gcagatacagcatgtgctggatgat

SEQ ID NO: 120680 - DNA, 25 bp, E. coli
ccgtggccgacggggagacacgatt

SEQ ID NO: 120681 - DNA, 25 bp, E. coli
cttcaacggtctcggggagcagata

SEQ ID NO: 120682 - DNA, 25 bp, E. coli
cttcaacggtctgggggagcagata

SEQ ID NO: 120683 - DNA, 25 bp, E. coli
gatacagcatgtgctggatgataac

SEQ ID NO: 120684 - DNA, 25 bp, E. coli
gatacagcatgtcctggatgataac

SEQ ID NO: 120685 - DNA, 25 bp, E. coli
ggagcagatacaccatgtgctggat

SEQ ID NO: 120686 - DNA, 25 bp, E. coli
ggagcagatacagcatgtgctggat

SEQ ID NO: 120687 - DNA, 25 bp, E. coli
tcaacggtctggcggagcagataca

SEQ ID NO: 120688 - DNA, 25 bp, E. coli
tcaacggtctgggggagcagataca

SEQ ID NO: 120689 - DNA, 25 bp, E. coli
caaaaacgccgtcgatgaagagatc

SEQ ID NO: 120690 - DNA, 25 bp, E. coli
caaaaacgccgtggatgaagagatc

SEQ ID NO: 120691 - DNA, 25 bp, E. coli
tactctcagcagttgcagcgcgatg

SEQ ID NO: 120692 - DNA, 25 bp, E. coli
tactctcagcagatgcagcgcgatg

SEQ ID NO: 120693 - DNA, 25 bp, E. coli
tttcggtattgcagagcgacccgga

SEQ ID NO: 120694 - DNA, 25 bp, E. coli
tttcggtattgctgagcgacccgga

SEQ ID NO: 120695 - DNA, 25 bp, E. coli
tgttcctcgatgaagcagcgcgact

SEQ ID NO: 120696 - DNA, 25 bp, E. coli
tgttcctcgatgtagcagcgcgact

SEQ ID NO: 120697 - DNA, 25 bp, E. coli
gaaaatgataacgagcagcagcgta

SEQ ID NO: 120698 - DNA, 25 bp, E. coli
gaaaatgataaccagcagcagcgta

SEQ ID NO: 120699 - DNA, 25 bp, E. coli
cgttagcctggaagatgcgccgtac

SEQ ID NO: 120700 - DNA, 25 bp, E. coli
cgttagcctggatgatgcgccgtac

SEQ ID NO: 120701 - DNA, 25 bp, E. coli
cgaacttttgacgttgacgagctgg

SEQ ID NO: 120702 - DNA, 25 bp, E. coli
ccgcctgcgcggtaaagatatctct

SEQ ID NO: 120703 - DNA, 25 bp, E. coli
ccgcctgcgcggaaaagatatctct

SEQ ID NO: 120704 - DNA, 25 bp, E. coli
cgaacttttgaccttgacgagctgg

SEQ ID NO: 120705 - DNA, 25 bp, E. coli
gattactttgagttgcgcgagcagg

SEQ ID NO: 120706 - DNA, 25 bp, E. coli
gattactttgagatgcgcgagcagg

SEQ ID NO: 120707 - DNA, 25 bp, E. coli
taacgaacatctccgcgacgtgctg

SEQ ID NO: 120708 - DNA, 25 bp, E. coli
taacctcccgtgtacagaaactggc

SEQ ID NO: 120709 - DNA, 25 bp, E. coli
taacgaacatctgcgcgacgtgctg

SEQ ID NO: 120710 - DNA, 25 bp, E. coli
taacctcccgtgaacagaaactggc

SEQ ID NO: 120711 - DNA, 25 bp, E. coli
aatcgcgcaaaccagaagcgggaca

SEQ ID NO: 120712 - DNA, 25 bp, E. coli
aatcgcgcaaacgagaagcgggaca

SEQ ID NO: 120713 - DNA, 25 bp, E. coli
aagcggacagcgatgaattgcgtgc

SEQ ID NO: 120714 - DNA, 25 bp, E. coli
aagcggacagcgttgaattgcgtgc

SEQ ID NO: 120715 - DNA, 25 bp, E. coli
caactcatggcacggcacaaaggac

SEQ ID NO: 120716 - DNA, 25 bp, E. coli
caactcatggcagggcacaaaggac

SEQ ID NO: 120717 - DNA, 25 bp, E. coli
caaaaatcgcgctaaccagaagcgg

SEQ ID NO: 120718 - DNA, 25 bp, E. coli
caaaaatcgcgcaaaccagaagcgg

SEQ ID NO: 120719 - DNA, 25 bp, E. coli
acagcgatgaatagcgtgctgtggc

SEQ ID NO: 120720 - DNA, 25 bp, E. coli
acagcgatgaattgcgtgctgtggc

SEQ ID NO: 120721 - DNA, 25 bp, E. coli
tatcggttgtcttattaacgtgtgc

SEQ ID NO: 120722 - DNA, 25 bp, E. coli
tatcggttgtctaattaacgtgtgc

SEQ ID NO: 120723 - DNA, 25 bp, E. coli
tgtgggtaaagattgtggatcatca

SEQ ID NO: 120724 - DNA, 25 bp, E. coli
tgtgggtaaagaatgtggatcatca

SEQ ID NO: 120725 - DNA, 25 bp, E. coli
tcaggacaactcttggcagggcaca

SEQ ID NO: 120726 - DNA, 25 bp, E. coli
tcaggacaactcatggcagggcaca

SEQ ID NO: 120727 - DNA, 25 bp, E. coli
gcgcgagcatttatactggcaaaaa

SEQ ID NO: 120728 - DNA, 25 bp, E. coli
gcgcgagcatttttactggcaaaaa

SEQ ID NO: 120729 - DNA, 25 bp, E. coli
gaaggtttgcgccagcatttttact

SEQ ID NO: 120730 - DNA, 25 bp, E. coli
gaaggtttgcgcgagcatttttact

SEQ ID NO: 120731 - DNA, 25 bp, E. coli
ggcagggcacaaaggacatgaattt

SEQ ID NO: 120732 - DNA, 25 bp, E. coli
ggcagggcacaatggacatgaattt

SEQ ID NO: 120733 - DNA, 25 bp, E. coli
aataaagcggcgtccattagcgacc

SEQ ID NO: 120734 - DNA, 25 bp, E. coli
aattacaatcggtggacaggaagcc

SEQ ID NO: 120735 - DNA, 25 bp, E. coli
aataaagcggcgaccattagcgacc

SEQ ID NO: 120736 - DNA, 25 bp, E. coli
aattacaatcggaggacaggaagcc

SEQ ID NO: 120737 - DNA, 25 bp, E. coli
caggtgacggtactgctagcgcaaa

SEQ ID NO: 120738 - DNA, 25 bp, E. coli
caggtgacggtagtgctagcgcaaa

SEQ ID NO: 120739 - DNA, 25 bp, E. coli
taaagtggctactgctaaacaaggc

SEQ ID NO: 120740 - DNA, 25 bp, E. coli
taaagtggctacagctaaacaaggc

SEQ ID NO: 120741 - DNA, 25 bp, E. coli
taaaacgggtgcagatgctggtgct

SEQ ID NO: 120742 - DNA, 25 bp, E. coli
taaacaaggcacagcagttgcagct

SEQ ID NO: 120743 - DNA, 25 bp, E. coli
taaacaaggcactgcagttgcagct

SEQ ID NO: 120744 - DNA, 25 bp, E. coli
acttaactacaaacgatgctggtgg

SEQ ID NO: 120745 - DNA, 25 bp, E. coli
acttaactacaatcgatgctggtgg

SEQ ID NO: 120746 - DNA, 25 bp, E. coli
ttccggtacgattgccaataaagcg

SEQ ID NO: 120747 - DNA, 25 bp, E. coli
ttccggtacgatagccaataaagcg

SEQ ID NO: 120748 - DNA, 25 bp, E. coli
gcgttcagacgtttcaggcggtatt

SEQ ID NO: 120749 - DNA, 25 bp, E. coli
gcgttcagacgtatcaggcggtatt

SEQ ID NO: 120750 - DNA, 25 bp, E. coli
gaactggtacggctaaatatgcgcc

SEQ ID NO: 120751 - DNA, 25 bp, E. coli
gaactggtacgggtaaatatgcgcc

SEQ ID NO: 120752 - DNA, 25 bp, E. coli
taaaacgggtgctgatgctggtgct

SEQ ID NO: 120753 - DNA, 25 bp, E. coli
gatgcaactagcgaaggcacagtaa

SEQ ID NO: 120754 - DNA, 25 bp, E. coli
gatgcaactagccaaggcacagtaa

SEQ ID NO: 120755 - DNA, 25 bp, E. coli
cacagcttacgaacctgaggagtaa

SEQ ID NO: 120756 - DNA, 25 bp, E. coli
cacagcttacgatcctgaggagtaa

SEQ ID NO: 120757 - DNA, 25 bp, E. coli
aggtcgctgtcttcacagcttacga

SEQ ID NO: 120758 - DNA, 25 bp, E. coli
aggtcgctgtctacacagcttacga

SEQ ID NO: 120759 - DNA, 25 bp, E. coli
ttcacagcttacgaacctgaggagt

SEQ ID NO: 120760 - DNA, 25 bp, E. coli
ttcacagcttaccaacctgaggagt

SEQ ID NO: 120761 - DNA, 25 bp, E. coli
tgtcttcacagcatacgaacctgag

SEQ ID NO: 120762 - DNA, 25 bp, E. coli
tgtcttcacagcttacgaacctgag

SEQ ID NO: 120763 - DNA, 25 bp, E. coli
tcttcacagcttacgaacctgagga

SEQ ID NO: 120764 - DNA, 25 bp, E. coli
tcttcacagctttcgaacctgagga

SEQ ID NO: 120765 - DNA, 25 bp, E. coli
gctgtcttcacagcttacgaacctg

SEQ ID NO: 120766 - DNA, 25 bp, E. coli
gctgtcttcacaccttacgaacctg

SEQ ID NO: 120767 - DNA, 25 bp, E. coli
cttcacagcttacgaacctgaggag

SEQ ID NO: 120768 - DNA, 25 bp, E. coli
cttcacagcttaggaacctgaggag

SEQ ID NO: 120769 - DNA, 25 bp, E. coli
ggtcgctgtcttcacagcttacgaa

SEQ ID NO: 120770 - DNA, 25 bp, E. coli
gtcttcacagctaacgaacctgagg

SEQ ID NO: 120771 - DNA, 25 bp, E. coli
gtcttcacagcttacgaacctgagg

SEQ ID NO: 120772 - DNA, 25 bp, E. coli
ggtcgctgtcttgacagcttacgaa

SEQ ID NO: 120773 - DNA, 25 bp, E. coli
tcacagcttacgtacctgaggagta

SEQ ID NO: 120774 - DNA, 25 bp, E. coli
tcacagcttacgaacctgaggagta

SEQ ID NO: 120775 - DNA, 25 bp, E. coli
gaggtcgctgtcatcacagcttacg

SEQ ID NO: 120776 - DNA, 25 bp, E. coli
gaggtcgctgtcttcacagcttacg

SEQ ID NO: 120777 - DNA, 25 bp, E. coli
caagatagtgaagattacctgccgt

SEQ ID NO: 120778 - DNA, 25 bp, E. coli
caagatagtgaacattacctgccgt

SEQ ID NO: 120779 - DNA, 25 bp, E. coli
tacaaaggacttgtctgaaagtgca

SEQ ID NO: 120780 - DNA, 25 bp, E. coli
tacaaaggacttctctgaaagtgca

SEQ ID NO: 120781 - DNA, 25 bp, E. coli
tatcatcaggtaatccgtttgcgga

SEQ ID NO: 120782 - DNA, 25 bp, E. coli
tatcatcaggtattccgtttgcgga

SEQ ID NO: 120783 - DNA, 25 bp, E. coli
tatacataacgcgagaaagcacccc

SEQ ID NO: 120784 - DNA, 25 bp, E. coli
tatacataacgccagaaagcacccc

SEQ ID NO: 120785 - DNA, 25 bp, E. coli
ttgcggataaccaaaaatgcaggtt

SEQ ID NO: 120786 - DNA, 25 bp, E. coli
ttgcggataacctaaaatgcaggtt

SEQ ID NO: 120787 - DNA, 25 bp, E. coli
tcccactataacaattgcgcgtatg

SEQ ID NO: 120788 - DNA, 25 bp, E. coli
tcccactataactattgcgcgtatg

SEQ ID NO: 120789 - DNA, 25 bp, E. coli
tctcagtgcagtcaaaaaatctgcc

SEQ ID NO: 120790 - DNA, 25 bp, E. coli
tctcagtgcagtgaaaaaatctgcc

SEQ ID NO: 120791 - DNA, 25 bp, E. coli
gctggataacatatcccggaatggt

SEQ ID NO: 120792 - DNA, 25 bp, E. coli
gctaaatagcagaacatatcgccgt

SEQ ID NO: 120793 - DNA, 25 bp, E. coli
gctaaatagcagtacatatcgccgt

SEQ ID NO: 120794 - DNA, 25 bp, E. coli
gctggataacatttcccggaatggt

SEQ ID NO: 120795 - DNA, 25 bp, E. coli
gaatggttgaataccccgcctcagt

SEQ ID NO: 120796 - DNA, 25 bp, E. coli
gaatggttgaattccccgcctcagt

SEQ ID NO: 120797 - DNA, 25 bp, E. coli
cattgcttagcgttatcatcaggta

SEQ ID NO: 120798 - DNA, 25 bp, E. coli
cattgcttagcgatatcatcaggta

SEQ ID NO: 120799 - DNA, 25 bp, E. coli
cttaacccggagacgccagttgagg

SEQ ID NO: 120800 - DNA, 25 bp, E. coli
cttaacccggagtcgccagttgagg

SEQ ID NO: 120801 - DNA, 25 bp, E. coli
actggcaactaatccgctcgactgt

SEQ ID NO: 120802 - DNA, 25 bp, E. coli
aactaaaccgctggactgtcatctg

SEQ ID NO: 120803 - DNA, 25 bp, E. coli
aactaaaccgctcgactgtcatctg

SEQ ID NO: 120804 - DNA, 25 bp, E. coli
actggcaactaaaccgctcgactgt

SEQ ID NO: 120805 - DNA, 25 bp, E. coli
tcatggacggtcactttgtccccaa

SEQ ID NO: 120806 - DNA, 25 bp, E. coli
tcatggacggtctctttgtccccaa

SEQ ID NO: 120807 - DNA, 25 bp, E. coli
gacggtcactttgtccccaatctga

SEQ ID NO: 120808 - DNA, 25 bp, E. coli
gacggtcactttctccccaatctga

SEQ ID NO: 120809 - DNA, 25 bp, E. coli
gactgtcatctgttggtgacgcggc

SEQ ID NO: 120810 - DNA, 25 bp, E. coli
gactgtcatctgatggtgacgcggc

SEQ ID NO: 120811 - DNA, 25 bp, E. coli
cggtcactttgtccccaatctgaca

SEQ ID NO: 120812 - DNA, 25 bp, E. coli
cccggagacgcctgttgaggccatg

SEQ ID NO: 120813 - DNA, 25 bp, E. coli
cccggagacgccagttgaggccatg

SEQ ID NO: 120814 - DNA, 25 bp, E. coli
cggtcactttgtgcccaatctgaca

SEQ ID NO: 120815 - DNA, 25 bp, E. coli
gggctgatccttaacccggagacgc

SEQ ID NO: 120816 - DNA, 25 bp, E. coli
gtcatctgatggagacgcggccgca

SEQ ID NO: 120817 - DNA, 25 bp, E. coli
gggctgatcctttacccggagacgc

SEQ ID NO: 120818 - DNA, 25 bp, E. coli
gtcatctgatggtgacgcggccgca

SEQ ID NO: 120819 - DNA, 25 bp, E. coli
tccggaaaccatgaacggccaggcg

SEQ ID NO: 120820 - DNA, 25 bp, E. coli
tccggaaaccatcaacggccaggcg

SEQ ID NO: 120821 - DNA, 25 bp, E. coli
caatagtagatgtctttatccgcag

SEQ ID NO: 120822 - DNA, 25 bp, E. coli
caatagtagatgactttatccgcag

SEQ ID NO: 120823 - DNA, 25 bp, E. coli
aaccgtgcccttaaatattgaatct

SEQ ID NO: 120824 - DNA, 25 bp, E. coli
aaccgtgccctttaatattgaatct

SEQ ID NO: 120825 - DNA, 25 bp, E. coli
tagcgtgcacattttctgaacatac

SEQ ID NO: 120826 - DNA, 25 bp, E. coli
tagcgtgcacatattctgaacatac

SEQ ID NO: 120827 - DNA, 25 bp, E. coli
tatctgcttgtggtggtgaatgcac

SEQ ID NO: 120828 - DNA, 25 bp, E. coli
tatctgcttgtgctggtgaatgcac

SEQ ID NO: 120829 - DNA, 25 bp, E. coli
tgcactgaccggctataaggaaagg

SEQ ID NO: 120830 - DNA, 25 bp, E. coli
tgcactgaccgggtataaggaaagg

SEQ ID NO: 120831 - DNA, 25 bp, E. coli
tctgaacatacatgcagcgcgtgaa

SEQ ID NO: 120832 - DNA, 25 bp, E. coli
tctgaacatacaagcagcgcgtgaa

SEQ ID NO: 120833 - DNA, 25 bp, E. coli
gcgagcaactgttcctcaggaaagg

SEQ ID NO: 120834 - DNA, 25 bp, E. coli
gcgagcaactgtacctcaggaaagg

SEQ ID NO: 120835 - DNA, 25 bp, E. coli
gcagcgcgtgaatgtgttaaacaat

SEQ ID NO: 120836 - DNA, 25 bp, E. coli
gcagcgcgtgaaagtgttaaacaat

SEQ ID NO: 120837 - DNA, 25 bp, E. coli
gactttatccgcagtaatcaaagga

SEQ ID NO: 120838 - DNA, 25 bp, E. coli
gaaaggccaaacaagaacacggttg

SEQ ID NO: 120839 - DNA, 25 bp, E. coli
gactttatccgctgtaatcaaagga

SEQ ID NO: 120840 - DNA, 25 bp, E. coli
gaaaggccaaactagaacacggttg

SEQ ID NO: 120841 - DNA, 25 bp, E. coli
tcaaaggatttgtgcgagcaactgt

SEQ ID NO: 120842 - DNA, 25 bp, E. coli
tcaaaggatttgagcgagcaactgt

SEQ ID NO: 120843 - DNA, 25 bp, E. coli
caacacggcggtattattcgcaagg

SEQ ID NO: 120844 - DNA, 25 bp, E. coli
caacacggcggttttattcgcaagg

SEQ ID NO: 120845 - DNA, 25 bp, E. coli
atccaccgcagagtttgctattacg

SEQ ID NO: 120846 - DNA, 25 bp, E. coli
atccaccgcagactttgctattacg

SEQ ID NO: 120847 - DNA, 25 bp, E. coli
tacgccggtagttggtgccgaagtt

SEQ ID NO: 120848 - DNA, 25 bp, E. coli
tacgccggtagtaggtgccgaagtt

SEQ ID NO: 120849 - DNA, 25 bp, E. coli
tgccgggctggattacgcgcgccaa

SEQ ID NO: 120850 - DNA, 25 bp, E. coli
tgccgggctggaatacgcgcgccaa

SEQ ID NO: 120851 - DNA, 25 bp, E. coli
tcgcaaggctctcgaaaaggaataa

SEQ ID NO: 120852 - DNA, 25 bp, E. coli
tcgcaaggctctggaaaaggaataa

SEQ ID NO: 120853 - DNA, 25 bp, E. coli
ccgatgaagctaaaaaatgcctgga

SEQ ID NO: 120854 - DNA, 25 bp, E. coli
ccgatgaagctataaaatgcctgga

SEQ ID NO: 120855 - DNA, 25 bp, E. coli
cggttttattcggaaggctctggaa

SEQ ID NO: 120856 - DNA, 25 bp, E. coli
ctattacgccggaagttggtgccga

SEQ ID NO: 120857 - DNA, 25 bp, E. coli
ctattacgccggtagttggtgccga

SEQ ID NO: 120858 - DNA, 25 bp, E. coli
cggttttattcgcaaggctctggaa

SEQ ID NO: 120859 - DNA, 25 bp, E. coli
gggagtgccgtttcatccaccgcag

SEQ ID NO: 120860 - DNA, 25 bp, E. coli
gggagtgccgttacatccaccgcag

SEQ ID NO: 120861 - DNA, 25 bp, E. coli
gatgccgatgaagctaaaaaatgcc

SEQ ID NO: 120862 - DNA, 25 bp, E. coli
gatgccgatgaacctaaaaaatgcc

SEQ ID NO: 120863 - DNA, 25 bp, E. coli
gatctgaaaaatatcggcttaaccg

SEQ ID NO: 120864 - DNA, 25 bp, E. coli
gatctgaaaaatttcggcttaaccg

SEQ ID NO: 120865 - DNA, 25 bp, E. coli
taaaaacggcggtgtacggcatccg

SEQ ID NO: 120866 - DNA, 25 bp, E. coli
taaaaacggcggagtacggcatccg

SEQ ID NO: 120867 - DNA, 25 bp, E. coli
tattcagtatcaggatctgccgcag

SEQ ID NO: 120868 - DNA, 25 bp, E. coli
tatcagccagttggtcatgggcggc

SEQ ID NO: 120869 - DNA, 25 bp, E. coli
tatcagccagttcgtcatgggcggc

SEQ ID NO: 120870 - DNA, 25 bp, E. coli
tatcactgctcagctgggtcacaga

SEQ ID NO: 120871 - DNA, 25 bp, E. coli
tattcagtatcacgatctgccgcag

SEQ ID NO: 120872 - DNA, 25 bp, E. coli
tatcactgctcacctgggtcacaga

SEQ ID NO: 120873 - DNA, 25 bp, E. coli
gaatccggtgaactgcaggctgaaa

SEQ ID NO: 120874 - DNA, 25 bp, E. coli
gaatccggtgaagtgcaggctgaaa

SEQ ID NO: 120875 - DNA, 25 bp, E. coli
gacgaaactggatctactggccggg

SEQ ID NO: 120876 - DNA, 25 bp, E. coli
gactggcgtcaggtggaaaaactct

SEQ ID NO: 120877 - DNA, 25 bp, E. coli
gacgaaactggaactactggccggg

SEQ ID NO: 120878 - DNA, 25 bp, E. coli
gactggcgtcagctggaaaaactct

SEQ ID NO: 120879 - DNA, 25 bp, E. coli
gataatcctcagctcagggcgctga

SEQ ID NO: 120880 - DNA, 25 bp, E. coli
gttaaacaaattgcctgcccgctgg

SEQ ID NO: 120881 - DNA, 25 bp, E. coli
gataatcctcaggtcagggcgctga

SEQ ID NO: 120882 - DNA, 25 bp, E. coli
gttaaacaaattccctgcccgctgg

SEQ ID NO: 120883 - DNA, 25 bp, E. coli
tggctcaggacagaacaattgcggc

SEQ ID NO: 120884 - DNA, 25 bp, E. coli
tggatatactgctccagcgctgggc

SEQ ID NO: 120885 - DNA, 25 bp, E. coli
tggatatactgcaccagcgctgggc

SEQ ID NO: 120886 - DNA, 25 bp, E. coli
tggctcaggacacaacaattgcggc

SEQ ID NO: 120887 - DNA, 25 bp, E. coli
cactgccgttctacaagttgagcac

SEQ ID NO: 120888 - DNA, 25 bp, E. coli
cactgccgttcttcaagttgagcac

SEQ ID NO: 120889 - DNA, 25 bp, E. coli
tactatgccggattactgcggtgtg

SEQ ID NO: 120890 - DNA, 25 bp, E. coli
tactatgccggaatactgcggtgtg

SEQ ID NO: 120891 - DNA, 25 bp, E. coli
tatgccggaatagtgcggtgtgatc

SEQ ID NO: 120892 - DNA, 25 bp, E. coli
tatgccggaatactgcggtgtgatc

SEQ ID NO: 120893 - DNA, 25 bp, E. coli
ttcactgccgttctacaagttgagc

SEQ ID NO: 120894 - DNA, 25 bp, E. coli
ttctacaagttgagcaccaaatttg

SEQ ID NO: 120895 - DNA, 25 bp, E. coli
ttctacaagttgtgcaccaaatttg

SEQ ID NO: 120896 - DNA, 25 bp, E. coli
ttcactgccgttgtacaagttgagc

SEQ ID NO: 120897 - DNA, 25 bp, E. coli
tgtggtttcactcccgttctacaag

SEQ ID NO: 120898 - DNA, 25 bp, E. coli
tgtggtttcactgccgttctacaag

SEQ ID NO: 120899 - DNA, 25 bp, E. coli
tgcccgtactatcccggaatactgc

SEQ ID NO: 120900 - DNA, 25 bp, E. coli
tgcccgtactatgccggaatactgc

SEQ ID NO: 120901 - DNA, 25 bp, E. coli
gccgttctacaagttgagcaccaaa

SEQ ID NO: 120902 - DNA, 25 bp, E. coli
gccgttctacaacttgagcaccaaa

SEQ ID NO: 120903 - DNA, 25 bp, E. coli
cgtactatgccggaatactgcggtg

SEQ ID NO: 120904 - DNA, 25 bp, E. coli
cgtactatgccgcaatactgcggtg

SEQ ID NO: 120905 - DNA, 25 bp, E. coli
ctttgcccgtacaatgccggaatac

SEQ ID NO: 120906 - DNA, 25 bp, E. coli
ctttgcccgtactatgccggaatac

SEQ ID NO: 120907 - DNA, 25 bp, E. coli
ggtttcactgccgttctacaagttg

SEQ ID NO: 120908 - DNA, 25 bp, E. coli
ggtttcactgcccttctacaagttg

SEQ ID NO: 120909 - DNA, 25 bp, E. coli
taccccgtataaagtgaggctttta

SEQ ID NO: 120910 - DNA, 25 bp, E. coli
taccccgtataatgtgaggctttta

SEQ ID NO: 120911 - DNA, 25 bp, E. coli
agaggtccgcgtgcaatcacttact

SEQ ID NO: 120912 - DNA, 25 bp, E. coli
agaggtccgcgtccaatcacttact

SEQ ID NO: 120913 - DNA, 25 bp, E. coli
aacagggagaggtccgcgtgcaatc

SEQ ID NO: 120914 - DNA, 25 bp, E. coli
aacagggagaggaccgcgtgcaatc

SEQ ID NO: 120915 - DNA, 25 bp, E. coli
tagtaccccgtaaaatgtgaggctt

SEQ ID NO: 120916 - DNA, 25 bp, E. coli
tagtaccccgtataatgtgaggctt

SEQ ID NO: 120917 - DNA, 25 bp, E. coli
ttttaacagggacaggtccgcgtgc

SEQ ID NO: 120918 - DNA, 25 bp, E. coli
ttttaacagggagaggtccgcgtgc

SEQ ID NO: 120919 - DNA, 25 bp, E. coli
ttaacagggagaggtccgcgtgcaa

SEQ ID NO: 120920 - DNA, 25 bp, E. coli
ttaacagggagacgtccgcgtgcaa

SEQ ID NO: 120921 - DNA, 25 bp, E. coli
tgtagtaccccgaataatgtgaggc

SEQ ID NO: 120922 - DNA, 25 bp, E. coli
tgtagtaccccgtataatgtgaggc

SEQ ID NO: 120923 - DNA, 25 bp, E. coli
gcttttaacaggcagaggtccgcgt

SEQ ID NO: 120924 - DNA, 25 bp, E. coli
gcttttaacagggagaggtccgcgt

SEQ ID NO: 120925 - DNA, 25 bp, E. coli
cccgtataatgtgaggcttttaaca

SEQ ID NO: 120926 - DNA, 25 bp, E. coli
cccgtataatgtcaggcttttaaca

SEQ ID NO: 120927 - DNA, 25 bp, E. coli
ggagaggtccgcgtgcaatcactta

SEQ ID NO: 120928 - DNA, 25 bp, E. coli
ggagaggtccgcctgcaatcactta

SEQ ID NO: 120929 - DNA, 25 bp, E. coli
taatgtgaggcttttaacagggaga

SEQ ID NO: 120930 - DNA, 25 bp, E. coli
taatgtgaggctattaacagggaga

SEQ ID NO: 120931 - DNA, 25 bp, E. coli
catccggcagatctagggtctaaac

SEQ ID NO: 120932 - DNA, 25 bp, E. coli
catccggcagatgtagggtctaaac

SEQ ID NO: 120933 - DNA, 25 bp, E. coli
taaaaaagggcgattgaatgatcgc

SEQ ID NO: 120934 - DNA, 25 bp, E. coli
taaacgcgatcgtacacagcaacta

SEQ ID NO: 120935 - DNA, 25 bp, E. coli
taaaaaagggcgtttgaatgatcgc

SEQ ID NO: 120936 - DNA, 25 bp, E. coli
taaacgcgatcgaacacagcaacta

SEQ ID NO: 120937 - DNA, 25 bp, E. coli
actggaacaggaaccggcccggcct

SEQ ID NO: 120938 - DNA, 25 bp, E. coli
actggaacaggatccggcccggcct

SEQ ID NO: 120939 - DNA, 25 bp, E. coli
tagttcgttattaatgccgcatccg

SEQ ID NO: 120940 - DNA, 25 bp, E. coli
tagttcgttatttatgccgcatccg

SEQ ID NO: 120941 - DNA, 25 bp, E. coli
gccctttctgtttgttggcaaatag

SEQ ID NO: 120942 - DNA, 25 bp, E. coli
gccctttctgttagttggcaaatag

SEQ ID NO: 120943 - DNA, 25 bp, E. coli
gaatgatcgccctttctgtttgttg

SEQ ID NO: 120944 - DNA, 25 bp, E. coli
gaatgatcgcccattctgtttgttg

SEQ ID NO: 120945 - DNA, 25 bp, E. coli
ggtctaaacgcgatcgaacacagca

SEQ ID NO: 120946 - DNA, 25 bp, E. coli
ggtttatgctttgaaaaaagtggca

SEQ ID NO: 120947 - DNA, 25 bp, E. coli
ggtttatgctttcaaaaaagtggca

SEQ ID NO: 120948 - DNA, 25 bp, E. coli
ggtctaaacgcgttcgaacacagca

SEQ ID NO: 120949 - DNA, 25 bp, E. coli
ggcccggcctcgccattttattact

SEQ ID NO: 120950 - DNA, 25 bp, E. coli
ggcccggcctcggcattttattact

SEQ ID NO: 120951 - DNA, 25 bp, E. coli
gatgtagggtctaaacgcgatcgaa

SEQ ID NO: 120952 - DNA, 25 bp, E. coli
gatgtagggtcttaacgcgatcgaa

SEQ ID NO: 120953 - DNA, 25 bp, E. coli
aatgtgtccttgcagattaaccgcg

SEQ ID NO: 120954 - DNA, 25 bp, E. coli
caaccaataagtggtcgggaagcca

SEQ ID NO: 120955 - DNA, 25 bp, E. coli
aatgtgtccttggagattaaccgcg

SEQ ID NO: 120956 - DNA, 25 bp, E. coli
caaccaataagtcgtcgggaagcca

SEQ ID NO: 120957 - DNA, 25 bp, E. coli
catgatatggccctggtgtcgcaac

SEQ ID NO: 120958 - DNA, 25 bp, E. coli
catgatatggccgtggtgtcgcaac

SEQ ID NO: 120959 - DNA, 25 bp, E. coli
aaaaacagcttcctcagtggcgcgg

SEQ ID NO: 120960 - DNA, 25 bp, E. coli
aaaaacagcttcgtcagtggcgcgg

SEQ ID NO: 120961 - DNA, 25 bp, E. coli
ttcagatgatggacgtgatccgcca

SEQ ID NO: 120962 - DNA, 25 bp, E. coli
ttcagatgatggtcgtgatccgcca

SEQ ID NO: 120963 - DNA, 25 bp, E. coli
gctgcaatgcgcaccagaacatgga

SEQ ID NO: 120964 - DNA, 25 bp, E. coli
gctgcaatgcgctccagaacatgga

SEQ ID NO: 120965 - DNA, 25 bp, E. coli
gaatccggctcaggtaaatcagtca

SEQ ID NO: 120966 - DNA, 25 bp, E. coli
gaatccggctcacgtaaatcagtca

SEQ ID NO: 120967 - DNA, 25 bp, E. coli
gatctttcaggatccgatgaccgcc

SEQ ID NO: 120968 - DNA, 25 bp, E. coli
gattatgcgtctgctaccgacgggc

SEQ ID NO: 120969 - DNA, 25 bp, E. coli
gtgcacagtgtgaaaacgtcccggc

SEQ ID NO: 120970 - DNA, 25 bp, E. coli
gtgcacagtgtgtaaacgtcccggc

SEQ ID NO: 120971 - DNA, 25 bp, E. coli
gatctttcaggaaccgatgaccgcc

SEQ ID NO: 120972 - DNA, 25 bp, E. coli
gattatgcgtctcctaccgacgggc

SEQ ID NO: 120973 - DNA, 25 bp, E. coli
gagctttcaggtggtatgcgccagc

SEQ ID NO: 120974 - DNA, 25 bp, E. coli
gagctttcaggtcgtatgcgccagc

SEQ ID NO: 120975 - DNA, 25 bp, E. coli
aatttaaaggcaccgcagcttctcg

SEQ ID NO: 120976 - DNA, 25 bp, E. coli
aatttaaaggcagcgcagcttctcg

SEQ ID NO: 120977 - DNA, 25 bp, E. coli
caaatgtagctcattacgcggcagg

SEQ ID NO: 120978 - DNA, 25 bp, E. coli
caaatgtagctctttacgcggcagg

SEQ ID NO: 120979 - DNA, 25 bp, E. coli
taccgtaaatcctaacaactgacag

SEQ ID NO: 120980 - DNA, 25 bp, E. coli
taccgtaaatccaaacaactgacag

SEQ ID NO: 120981 - DNA, 25 bp, E. coli
tgcaaagtcaggtggcgattagctc

SEQ ID NO: 120982 - DNA, 25 bp, E. coli
tgcaaacgcaaagcagcaatgagag

SEQ ID NO: 120983 - DNA, 25 bp, E. coli
tgcaaagtcaggaggcgattagctc

SEQ ID NO: 120984 - DNA, 25 bp, E. coli
tgcaaacgcaaaccagcaatgagag

SEQ ID NO: 120985 - DNA, 25 bp, E. coli
gcttctcgccgtagagctcgtcgcg

SEQ ID NO: 120986 - DNA, 25 bp, E. coli
gcttctcgccgttgagctcgtcgcg

SEQ ID NO: 120987 - DNA, 25 bp, E. coli
gattagctccgagaaactacacagg

SEQ ID NO: 120988 - DNA, 25 bp, E. coli
gattagctccgacaaactacacagg

SEQ ID NO: 120989 - DNA, 25 bp, E. coli
ggctcaacttgtgttccaaatgtag

SEQ ID NO: 120990 - DNA, 25 bp, E. coli
ggctcaacttgtcttccaaatgtag

SEQ ID NO: 120991 - DNA, 25 bp, E. coli
taataacactgagaacgttgaccag

SEQ ID NO: 120992 - DNA, 25 bp, E. coli
taataacactgacaacgttgaccag

SEQ ID NO: 120993 - DNA, 25 bp, E. coli
tcacgagtggtcatacaatgcaaac

SEQ ID NO: 120994 - DNA, 25 bp, E. coli
tcacgagtggtcttacaatgcaaac

SEQ ID NO: 120995 - DNA, 25 bp, E. coli
gaccagaaaatatgaaggctcaact

SEQ ID NO: 120996 - DNA, 25 bp, E. coli
gaccagaaaataagaaggctcaact

SEQ ID NO: 120997 - DNA, 25 bp, E. coli
attgccgaagcgtctgaagcgggat

SEQ ID NO: 120998 - DNA, 25 bp, E. coli
attgccgaagcgactgaagcgggat

SEQ ID NO: 120999 - DNA, 25 bp, E. coli
tgaagcggcagtaaatctgcgccgc

SEQ ID NO: 121000 - DNA, 25 bp, E. coli
tgaagcggcagttaatctgcgccgc

SEQ ID NO: 121001 - DNA, 25 bp, E. coli
gcgggcttttcgactggcttgaagt

SEQ ID NO: 121002 - DNA, 25 bp, E. coli
gcgggcttttcgtctggcttgaagt

SEQ ID NO: 121003 - DNA, 25 bp, E. coli
gactgaagcgggattgcttggcaaa

SEQ ID NO: 121004 - DNA, 25 bp, E. coli
gaagcgactgaagcgggattgcttg

SEQ ID NO: 121005 - DNA, 25 bp, E. coli
gactgaagcgggtttgcttggcaaa

SEQ ID NO: 121006 - DNA, 25 bp, E. coli
gaagcgactgaaccgggattgcttg

SEQ ID NO: 121007 - DNA, 25 bp, E. coli
cgactgaagcggcattgcttggcaa

SEQ ID NO: 121008 - DNA, 25 bp, E. coli
cgcgggcttttccactggcttgaag

SEQ ID NO: 121009 - DNA, 25 bp, E. coli
ccgaagcgactgtagcgggattgct

SEQ ID NO: 121010 - DNA, 25 bp, E. coli
ccgaagcgactgaagcgggattgct

SEQ ID NO: 121011 - DNA, 25 bp, E. coli
cgactgaagcgggattgcttggcaa

SEQ ID NO: 121012 - DNA, 25 bp, E. coli
cgaagcgactgaagcgggattgctt

SEQ ID NO: 121013 - DNA, 25 bp, E. coli
cgaagcgactgatgcgggattgctt

SEQ ID NO: 121014 - DNA, 25 bp, E. coli
cgcgggcttttcgactggcttgaag

SEQ ID NO: 121015 - DNA, 25 bp, E. coli
cgggcttttcgactggcttgaagtg

SEQ ID NO: 121016 - DNA, 25 bp, E. coli
cgggcttttcgagtggcttgaagtg

SEQ ID NO: 121017 - DNA, 25 bp, E. coli
gggcttttcgactggcttgaagtgg

SEQ ID NO: 121018 - DNA, 25 bp, E. coli
gggcttttcgacaggcttgaagtgg

SEQ ID NO: 121019 - DNA, 25 bp, E. coli
aatgccgtgctgcaaaaagagtgcg

SEQ ID NO: 121020 - DNA, 25 bp, E. coli
aatgccgtgctggaaaaagagtgcg

SEQ ID NO: 121021 - DNA, 25 bp, E. coli
cagcgatctgatgcatcttgagcac

SEQ ID NO: 121022 - DNA, 25 bp, E. coli
cagcgatctgatccatcttgagcac

SEQ ID NO: 121023 - DNA, 25 bp, E. coli
taccgattcgaaaatacgcgccagc

SEQ ID NO: 121024 - DNA, 25 bp, E. coli
tacgctgaagcgtgaactcgccgag

SEQ ID NO: 121025 - DNA, 25 bp, E. coli
tacgctgaagcgagaactcgccgag

SEQ ID NO: 121026 - DNA, 25 bp, E. coli
taccgattcgaatatacgcgccagc

SEQ ID NO: 121027 - DNA, 25 bp, E. coli
ttgatagtgatgacgtcgaaacccg

SEQ ID NO: 121028 - DNA, 25 bp, E. coli
ttgatagtgatgtcgtcgaaacccg

SEQ ID NO: 121029 - DNA, 25 bp, E. coli
tgacacgccagtgcatccaacaggt

SEQ ID NO: 121030 - DNA, 25 bp, E. coli
tgacacgccagtccatccaacaggt

SEQ ID NO: 121031 - DNA, 25 bp, E. coli
tcgaaacccgtatgatgagcaacta

SEQ ID NO: 121032 - DNA, 25 bp, E. coli
tcgaaacccgtaagatgagcaacta

SEQ ID NO: 121033 - DNA, 25 bp, E. coli
gcatttgctgaatgacgcgccttgt

SEQ ID NO: 121034 - DNA, 25 bp, E. coli
gcatttgctgaaagacgcgccttgt

SEQ ID NO: 121035 - DNA, 25 bp, E. coli
gaagttaccattcgccaggatctca

SEQ ID NO: 121036 - DNA, 25 bp, E. coli
gaagttaccattggccaggatctca

SEQ ID NO: 121037 - DNA, 25 bp, E. coli
tgaccagggtcaggttagcgtaacc

SEQ ID NO: 121038 - DNA, 25 bp, E. coli
tgaccagggtcacgttagcgtaacc

SEQ ID NO: 121039 - DNA, 25 bp, E. coli
ggtcagcagctacatcgcgcatttg

SEQ ID NO: 121040 - DNA, 25 bp, E. coli
ggtcagcagctagatcgcgcatttg

SEQ ID NO: 121041 - DNA, 25 bp, E. coli
caatcttgcaaataaaatgcgatcg

SEQ ID NO: 121042 - DNA, 25 bp, E. coli
caatcttgcaaaaaaaatgcgatcg

SEQ ID NO: 121043 - DNA, 25 bp, E. coli
caatttgcggcaatatagttattcc

SEQ ID NO: 121044 - DNA, 25 bp, E. coli
aatgcgatcgcttaaacaaaagtgc

SEQ ID NO: 121045 - DNA, 25 bp, E. coli
caatttgcggcattatagttattcc

SEQ ID NO: 121046 - DNA, 25 bp, E. coli
aatgcgatcgctaaaacaaaagtgc

SEQ ID NO: 121047 - DNA, 25 bp, E. coli
taaaaatggcctgaaaatagtgtgc

SEQ ID NO: 121048 - DNA, 25 bp, E. coli
taaaacaaaagtgcaatttgcggca

SEQ ID NO: 121049 - DNA, 25 bp, E. coli
taaaacaaaagtccaatttgcggca

SEQ ID NO: 121050 - DNA, 25 bp, E. coli
taaaaatggcctcaaaatagtgtgc

SEQ ID NO: 121051 - DNA, 25 bp, E. coli
tgttttccttgcgaacaatcttgca

SEQ ID NO: 121052 - DNA, 25 bp, E. coli
tgttttccttgccaacaatcttgca

SEQ ID NO: 121053 - DNA, 25 bp, E. coli
tgaaaatagtgtccgatagcggtgc

SEQ ID NO: 121054 - DNA, 25 bp, E. coli
tgaaaatagtgtgcgatagcggtgc

SEQ ID NO: 121055 - DNA, 25 bp, E. coli
gggttttcgacggagcaagctgttt

SEQ ID NO: 121056 - DNA, 25 bp, E. coli
gggttttcgacgcagcaagctgttt

SEQ ID NO: 121057 - DNA, 25 bp, E. coli
tggaaggtaaaaatggcctgaaaat

SEQ ID NO: 121058 - DNA, 25 bp, E. coli
tggaaggtaaaattggcctgaaaat

SEQ ID NO: 121059 - DNA, 25 bp, E. coli
ggcaatatagttattccatgaccgt

SEQ ID NO: 121060 - DNA, 25 bp, E. coli
ggcaatatagtttttccatgaccgt

SEQ ID NO: 121061 - DNA, 25 bp, E. coli
gagcaagctgttatccttgccaaca

SEQ ID NO: 121062 - DNA, 25 bp, E. coli
gagcaagctgttttccttgccaaca

SEQ ID NO: 121063 - DNA, 25 bp, E. coli
cacgcggtgcccaacggcgttgatg

SEQ ID NO: 121064 - DNA, 25 bp, E. coli
caacagttgctgatcgtcgagcttc

SEQ ID NO: 121065 - DNA, 25 bp, E. coli
caacagttgctgttcgtcgagcttc

SEQ ID NO: 121066 - DNA, 25 bp, E. coli
cacgcggtgccctacggcgttgatg

SEQ ID NO: 121067 - DNA, 25 bp, E. coli
cactttgagcgcatgctgatggctg

SEQ ID NO: 121068 - DNA, 25 bp, E. coli
cactttgagcgcttgctgatggctg

SEQ ID NO: 121069 - DNA, 25 bp, E. coli
cagtggatttatggccgtctcggtc

SEQ ID NO: 121070 - DNA, 25 bp, E. coli
cagtggatttatcgccgtctcggtc

SEQ ID NO: 121071 - DNA, 25 bp, E. coli
tatgacagcatgttcaatacccagt

SEQ ID NO: 121072 - DNA, 25 bp, E. coli
tatgacagcatgatcaatacccagt

SEQ ID NO: 121073 - DNA, 25 bp, E. coli
tgatggctggcgacatccagcgcga

SEQ ID NO: 121074 - DNA, 25 bp, E. coli
tgatggctggcgtcatccagcgcga

SEQ ID NO: 121075 - DNA, 25 bp, E. coli
tcggtctttaaacgttatgacagca

SEQ ID NO: 121076 - DNA, 25 bp, E. coli
tcggtctttaaaggttatgacagca

SEQ ID NO: 121077 - DNA, 25 bp, E. coli
ccagcgcgacagtggatttatggcc

SEQ ID NO: 121078 - DNA, 25 bp, E. coli
ccagcgcgacagaggatttatggcc

SEQ ID NO: 121079 - DNA, 25 bp, E. coli
cgttgatggcttgcaacagttgctg

SEQ ID NO: 121080 - DNA, 25 bp, E. coli
cgttgatggcttccaacagttgctg

SEQ ID NO: 121081 - DNA, 25 bp, E. coli
gatcaatacccactcgttccgctag

SEQ ID NO: 121082 - DNA, 25 bp, E. coli
gatcaatacccagtcgttccgctag

SEQ ID NO: 121083 - DNA, 25 bp, E. coli
gagcttcgcgaacagcactttgagc

SEQ ID NO: 121084 - DNA, 25 bp, E. coli
gagcttcgcgaagagcactttgagc

SEQ ID NO: 121085 - DNA, 25 bp, E. coli
aagccgggctgcataaaagcaaacc

SEQ ID NO: 121086 - DNA, 25 bp, E. coli
aagccgggctgcttaaaagcaaacc

SEQ ID NO: 121087 - DNA, 25 bp, E. coli
cataaaagcaaacccggcctgattg

SEQ ID NO: 121088 - DNA, 25 bp, E. coli
cataaaagcaaagccggcctgattg

SEQ ID NO: 121089 - DNA, 25 bp, E. coli
cataatttcttcttaaaaaagccgg

SEQ ID NO: 121090 - DNA, 25 bp, E. coli
cataatttcttcataaaaaagccgg

SEQ ID NO: 121091 - DNA, 25 bp, E. coli
aaaaagccgggctgcataaaagcaa

SEQ ID NO: 121092 - DNA, 25 bp, E. coli
aaaaagccgggcagcataaaagcaa

SEQ ID NO: 121093 - DNA, 25 bp, E. coli
tttcttcataaaaaagccgggctgc

SEQ ID NO: 121094 - DNA, 25 bp, E. coli
tttcttcataaataagccgggctgc

SEQ ID NO: 121095 - DNA, 25 bp, E. coli
tcttcataaaaatgccgggctgcat

SEQ ID NO: 121096 - DNA, 25 bp, E. coli
tcttcataaaaaagccgggctgcat

SEQ ID NO: 121097 - DNA, 25 bp, E. coli
gcctgattgagataatgaatagatt

SEQ ID NO: 121098 - DNA, 25 bp, E. coli
gcaaacccggcctgattgagataat

SEQ ID NO: 121099 - DNA, 25 bp, E. coli
gcaaacccggccagattgagataat

SEQ ID NO: 121100 - DNA, 25 bp, E. coli
gcctgattgagaaaatgaatagatt

SEQ ID NO: 121101 - DNA, 25 bp, E. coli
gctgcataaaagcaaacccggcctg

SEQ ID NO: 121102 - DNA, 25 bp, E. coli
gctgcataaaaggaaacccggcctg

SEQ ID NO: 121103 - DNA, 25 bp, E. coli
cccggcctgattgagataatgaata

SEQ ID NO: 121104 - DNA, 25 bp, E. coli
cccggcctgattcagataatgaata

SEQ ID NO: 121105 - DNA, 25 bp, E. coli
gtcatttttctccataatttcttca

SEQ ID NO: 121106 - DNA, 25 bp, E. coli
gtcatttttctcgataatttcttca

SEQ ID NO: 121107 - DNA, 25 bp, E. coli
catgttgatcaatgagggcgcagaa

SEQ ID NO: 121108 - DNA, 25 bp, E. coli
catgttgatcaaagagggcgcagaa

SEQ ID NO: 121109 - DNA, 25 bp, E. coli
caaatatttacaagaaaagttaccg

SEQ ID NO: 121110 - DNA, 25 bp, E. coli
caaatatttacatgaaaagttaccg

SEQ ID NO: 121111 - DNA, 25 bp, E. coli
aaatagggtattccagtcgcacagc

SEQ ID NO: 121112 - DNA, 25 bp, E. coli
aaatagggtattgcagtcgcacagc

SEQ ID NO: 121113 - DNA, 25 bp, E. coli
tagacgaactgactcaggaaagcca

SEQ ID NO: 121114 - DNA, 25 bp, E. coli
tagacgaactgagtcaggaaagcca

SEQ ID NO: 121115 - DNA, 25 bp, E. coli
tcgaacagcgaagaaaatagggtat

SEQ ID NO: 121116 - DNA, 25 bp, E. coli
tcgaacagcgaacaaaatagggtat

SEQ ID NO: 121117 - DNA, 25 bp, E. coli
tctggcggcaagtacagtggcgaac

SEQ ID NO: 121118 - DNA, 25 bp, E. coli
tctggcggcaagaacagtggcgaac

SEQ ID NO: 121119 - DNA, 25 bp, E. coli
gcggaagtagaacagctggaacaca

SEQ ID NO: 121120 - DNA, 25 bp, E. coli
gcggaagtagaagagctggaacaca

SEQ ID NO: 121121 - DNA, 25 bp, E. coli
cgaactgagtcacgaaagccatggc

SEQ ID NO: 121122 - DNA, 25 bp, E. coli
cgaactgagtcaggaaagccatggc

SEQ ID NO: 121123 - DNA, 25 bp, E. coli
cggctttcgaacagcgaacaaaata

SEQ ID NO: 121124 - DNA, 25 bp, E. coli
cggctttcgaactgcgaacaaaata

SEQ ID NO: 121125 - DNA, 25 bp, E. coli
gttgatcaaagagggcgcagaaaaa

SEQ ID NO: 121126 - DNA, 25 bp, E. coli
gttgatcaaagacggcgcagaaaaa

SEQ ID NO: 121127 - DNA, 25 bp, E. coli
ggaagtagaagacctggaacacaaa

SEQ ID NO: 121128 - DNA, 25 bp, E. coli
ggaagtagaagagctggaacacaaa

SEQ ID NO: 121129 - DNA, 25 bp, E. coli
aatagcgggccgttgacattgcgac

SEQ ID NO: 121130 - DNA, 25 bp, E. coli
aatagcgggccgatgacattgcgac

SEQ ID NO: 121131 - DNA, 25 bp, E. coli
cacgtctgccggcaaatgactgtcc

SEQ ID NO: 121132 - DNA, 25 bp, E. coli
cacgtctgccgggaaatgactgtcc

SEQ ID NO: 121133 - DNA, 25 bp, E. coli
actgcggatgcgctggtaaaagaca

SEQ ID NO: 121134 - DNA, 25 bp, E. coli
actgcggatgcggtggtaaaagaca

SEQ ID NO: 121135 - DNA, 25 bp, E. coli
aaagacactgcggatgcggtggtaa

SEQ ID NO: 121136 - DNA, 25 bp, E. coli
aaagacactgcgcatgcggtggtaa

SEQ ID NO: 121137 - DNA, 25 bp, E. coli
acgtctgccgggtaatgactgtccg

SEQ ID NO: 121138 - DNA, 25 bp, E. coli
acgtctgccgggaaatgactgtccg

SEQ ID NO: 121139 - DNA, 25 bp, E. coli
tagcgggccgatgacattgcgactg

SEQ ID NO: 121140 - DNA, 25 bp, E. coli
tagcgggccgatcacattgcgactg

SEQ ID NO: 121141 - DNA, 25 bp, E. coli
tgcactgccgttatggctgaacaat

SEQ ID NO: 121142 - DNA, 25 bp, E. coli
tgcactgccgttttggctgaacaat

SEQ ID NO: 121143 - DNA, 25 bp, E. coli
tgcggatgcggtggtaaaagacaat

SEQ ID NO: 121144 - DNA, 25 bp, E. coli
tgcggatgcggtcgtaaaagacaat

SEQ ID NO: 121145 - DNA, 25 bp, E. coli
gcactgccgttaaggctgaacaatg

SEQ ID NO: 121146 - DNA, 25 bp, E. coli
gcactgccgttatggctgaacaatg

SEQ ID NO: 121147 - DNA, 25 bp, E. coli
cgggccgatgactttgcgactggat

SEQ ID NO: 121148 - DNA, 25 bp, E. coli
cgggccgatgacattgcgactggat

SEQ ID NO: 121149 - DNA, 25 bp, E. coli
gattgtgaaagaaggctggctggcg

SEQ ID NO: 121150 - DNA, 25 bp, E. coli
gattgtgaaagatggctggctggcg

SEQ ID NO: 121151 - DNA, 25 bp, E. coli
caacgcgtggtaatcctggagtagc

SEQ ID NO: 121152 - DNA, 25 bp, E. coli
caacgcgtggtattcctggagtagc

SEQ ID NO: 121153 - DNA, 25 bp, E. coli
tacatgaactagaagagaaagagcc

SEQ ID NO: 121154 - DNA, 25 bp, E. coli
tacatgaactagtagagaaagagcc

SEQ ID NO: 121155 - DNA, 25 bp, E. coli
acgtcgaccgtgttgcattatcagc

SEQ ID NO: 121156 - DNA, 25 bp, E. coli
acgtcgaccgtgatgcattatcagc

SEQ ID NO: 121157 - DNA, 25 bp, E. coli
aacaaagtttctacatgcagctgga

SEQ ID NO: 121158 - DNA, 25 bp, E. coli
aacttcagtcggtgcccgtctggca

SEQ ID NO: 121159 - DNA, 25 bp, E. coli
aacttcagtcggagcccgtctggca

SEQ ID NO: 121160 - DNA, 25 bp, E. coli
aacaaagtttcttcatgcagctgga

SEQ ID NO: 121161 - DNA, 25 bp, E. coli
taccaatgcataacgtggcccaatg

SEQ ID NO: 121162 - DNA, 25 bp, E. coli
taccaatgcatatcgtggcccaatg

SEQ ID NO: 121163 - DNA, 25 bp, E. coli
tatagtaactgatacgcgtgcagcc

SEQ ID NO: 121164 - DNA, 25 bp, E. coli
tatagtaactgaaacgcgtgcagcc

SEQ ID NO: 121165 - DNA, 25 bp, E. coli
tgttcgcatcctaggcaacgcagtt

SEQ ID NO: 121166 - DNA, 25 bp, E. coli
tgttcgcatccttggcaacgcagtt

SEQ ID NO: 121167 - DNA, 25 bp, E. coli
tctaaaccggttgcgactgctgtgt

SEQ ID NO: 121168 - DNA, 25 bp, E. coli
tctaaaccggttccgactgctgtgt

SEQ ID NO: 121169 - DNA, 25 bp, E. coli
gcgtgcagccattttagtgtttcca

SEQ ID NO: 121170 - DNA, 25 bp, E. coli
gcgtgcagccatattagtgtttcca

SEQ ID NO: 121171 - DNA, 25 bp, E. coli
gacaatcactggtaaaacgtgcgga

SEQ ID NO: 121172 - DNA, 25 bp, E. coli
gacaatcactggaaaaacgtgcgga

SEQ ID NO: 121173 - DNA, 25 bp, E. coli
aattatgcgggctatggcctgccac

SEQ ID NO: 121174 - DNA, 25 bp, E. coli
aattatgcgggcaatggcctgccac

SEQ ID NO: 121175 - DNA, 25 bp, E. coli
catcggcctgatgaaagcagtgcgc

SEQ ID NO: 121176 - DNA, 25 bp, E. coli
catcggcctgatcaaagcagtgcgc

SEQ ID NO: 121177 - DNA, 25 bp, E. coli
taaaacgctgatgctgtctcacctg

SEQ ID NO: 121178 - DNA, 25 bp, E. coli
taaaacgctgatcctgtctcacctg

SEQ ID NO: 121179 - DNA, 25 bp, E. coli
actggcgtatcgtcaaagttgcgac

SEQ ID NO: 121180 - DNA, 25 bp, E. coli
actggcgtatcgacaaagttgcgac

SEQ ID NO: 121181 - DNA, 25 bp, E. coli
tgcgtaaaaccatgcagcgtctggg

SEQ ID NO: 121182 - DNA, 25 bp, E. coli
tccacgttgcagcaactggctgacc

SEQ ID NO: 121183 - DNA, 25 bp, E. coli
tccacgttgcaggaactggctgacc

SEQ ID NO: 121184 - DNA, 25 bp, E. coli
tgcgtaaaaccaagcagcgtctggg

SEQ ID NO: 121185 - DNA, 25 bp, E. coli
ccatggcgatctggaagcagctaaa

SEQ ID NO: 121186 - DNA, 25 bp, E. coli
gccacaggcggaattgattcaggaa

SEQ ID NO: 121187 - DNA, 25 bp, E. coli
ccatggcgatctcgaagcagctaaa

SEQ ID NO: 121188 - DNA, 25 bp, E. coli
gccacaggcggatttgattcaggaa

SEQ ID NO: 121189 - DNA, 25 bp, E. coli
gaaaagctgcattaccatggcgatc

SEQ ID NO: 121190 - DNA, 25 bp, E. coli
gaaaagctgcataaccatggcgatc

SEQ ID NO: 121191 - DNA, 25 bp, E. coli
tggaatcacgtaaggcggcacagga

SEQ ID NO: 121192 - DNA, 25 bp, E. coli
tggaatcacgtatggcggcacagga

SEQ ID NO: 121193 - DNA, 25 bp, E. coli
tcaaagcagagatccacgaatacgt

SEQ ID NO: 121194 - DNA, 25 bp, E. coli
tcaaagcagagaaccacgaatacgt

SEQ ID NO: 121195 - DNA, 25 bp, E. coli
aagcgtatctgcctgcaagcgtggc

SEQ ID NO: 121196 - DNA, 25 bp, E. coli
aagcgtatctgcgtgcaagcgtggc

SEQ ID NO: 121197 - DNA, 25 bp, E. coli
atgttttgaagcctatctgcctgca

SEQ ID NO: 121198 - DNA, 25 bp, E. coli
atgttttgaagcgtatctgcctgca

SEQ ID NO: 121199 - DNA, 25 bp, E. coli
aaaaattccttgatgtggcgatgcg

SEQ ID NO: 121200 - DNA, 25 bp, E. coli
actggttcgactacgatgcggtgaa

SEQ ID NO: 121201 - DNA, 25 bp, E. coli
aaaaattccttgttgtggcgatgcg

SEQ ID NO: 121202 - DNA, 25 bp, E. coli
actggttcgacttcgatgcggtgaa

SEQ ID NO: 121203 - DNA, 25 bp, E. coli
tttgaagcgtatctgcctgcaagcg

SEQ ID NO: 121204 - DNA, 25 bp, E. coli
tttgaagcgtatgtgcctgcaagcg

SEQ ID NO: 121205 - DNA, 25 bp, E. coli
ttcgactacgatccggtgaaagata

SEQ ID NO: 121206 - DNA, 25 bp, E. coli
ttcctcgacaaataattccttgatg

SEQ ID NO: 121207 - DNA, 25 bp, E. coli
ttcgactacgatgcggtgaaagata

SEQ ID NO: 121208 - DNA, 25 bp, E. coli
ttcctcgacaaaaaattccttgatg

SEQ ID NO: 121209 - DNA, 25 bp, E. coli
gcgactggttcgtctacgatgcggt

SEQ ID NO: 121210 - DNA, 25 bp, E. coli
gcgactggttcgactacgatgcggt

SEQ ID NO: 121211 - DNA, 25 bp, E. coli
cgtgaatgttttgaagcgtatctgc

SEQ ID NO: 121212 - DNA, 25 bp, E. coli
ctacgatgcggtcaaagataacgtg

SEQ ID NO: 121213 - DNA, 25 bp, E. coli
cgtgaatgttttcaagcgtatctgc

SEQ ID NO: 121214 - DNA, 25 bp, E. coli
ctacgatgcggtgaaagataacgtg

SEQ ID NO: 121215 - DNA, 25 bp, E. coli
gtatctgcctgcaagcgtggcctgg

SEQ ID NO: 121216 - DNA, 25 bp, E. coli
gtatctgcctgctagcgtggcctgg

SEQ ID NO: 121217 - DNA, 25 bp, E. coli
aacggatgcgctacccggagaaagg

SEQ ID NO: 121218 - DNA, 25 bp, E. coli
aactgggcgccatgattatccatcg

SEQ ID NO: 121219 - DNA, 25 bp, E. coli
caaaatacgtggagctgatggaccc

SEQ ID NO: 121220 - DNA, 25 bp, E. coli
caaaatacgtggtgctgatggaccc

SEQ ID NO: 121221 - DNA, 25 bp, E. coli
caggttacgtggaatacggctcctc

SEQ ID NO: 121222 - DNA, 25 bp, E. coli
caggttacgtggtatacggctcctc

SEQ ID NO: 121223 - DNA, 25 bp, E. coli
taaagcgagcgatggcaaagagcgt

SEQ ID NO: 121224 - DNA, 25 bp, E. coli
taaagcgagcgaaggcaaagagcgt

SEQ ID NO: 121225 - DNA, 25 bp, E. coli
aactgggcgccaagattatccatcg

SEQ ID NO: 121226 - DNA, 25 bp, E. coli
aacggatgcgcttcccggagaaagg

SEQ ID NO: 121227 - DNA, 25 bp, E. coli
ttgctgtcggcattaaaactgggcg

SEQ ID NO: 121228 - DNA, 25 bp, E. coli
ttgctgtcggcaataaaactgggcg

SEQ ID NO: 121229 - DNA, 25 bp, E. coli
tgaaagccgcacagaaagcacgcga

SEQ ID NO: 121230 - DNA, 25 bp, E. coli
tgaaagccgcactgaaagcacgcga

SEQ ID NO: 121231 - DNA, 25 bp, E. coli
gaatttattgtcgaaaagcagcacg

SEQ ID NO: 121232 - DNA, 25 bp, E. coli
gaagaagatttcgtccagcctggta

SEQ ID NO: 121233 - DNA, 25 bp, E. coli
gaagaagatttcctccagcctggta

SEQ ID NO: 121234 - DNA, 25 bp, E. coli
gaatttattgtccaaaagcagcacg

SEQ ID NO: 121235 - DNA, 25 bp, E. coli
gagtgcaacccgatggcattcctgg

SEQ ID NO: 121236 - DNA, 25 bp, E. coli
gatgttaacgtcactgtcggtacca

SEQ ID NO: 121237 - DNA, 25 bp, E. coli
gatgttaacgtctctgtcggtacca

SEQ ID NO: 121238 - DNA, 25 bp, E. coli
gagtgcaacccgttggcattcctgg

SEQ ID NO: 121239 - DNA, 25 bp, E. coli
aattgcatcgcattgtgctaacgac

SEQ ID NO: 121240 - DNA, 25 bp, E. coli
aattgcatcgcaatgtgctaacgac

SEQ ID NO: 121241 - DNA, 25 bp, E. coli
caggcttcaaagttgccgttgagtt

SEQ ID NO: 121242 - DNA, 25 bp, E. coli
caggcttcaaagatgccgttgagtt

SEQ ID NO: 121243 - DNA, 25 bp, E. coli
agcgtacatcaggacgcgaccggag

SEQ ID NO: 121244 - DNA, 25 bp, E. coli
agcgtacatcagcacgcgaccggag

SEQ ID NO: 121245 - DNA, 25 bp, E. coli
ttgtgctaacgacgcggcaaaaccc

SEQ ID NO: 121246 - DNA, 25 bp, E. coli
ttgtgctaacgaggcggcaaaaccc

SEQ ID NO: 121247 - DNA, 25 bp, E. coli
tgcaaaaaggcacgcttcaaagatg

SEQ ID NO: 121248 - DNA, 25 bp, E. coli
tgcaaaaaggcaggcttcaaagatg

SEQ ID NO: 121249 - DNA, 25 bp, E. coli
tttaacacggacacatcagaacctt

SEQ ID NO: 121250 - DNA, 25 bp, E. coli
tttaacacggactcatcagaacctt

SEQ ID NO: 121251 - DNA, 25 bp, E. coli
cgtcctgaaggttcaaaagagatag

SEQ ID NO: 121252 - DNA, 25 bp, E. coli
cgtcctgaaggtacaaaagagatag

SEQ ID NO: 121253 - DNA, 25 bp, E. coli
gatagattctctaagtttaacacgg

SEQ ID NO: 121254 - DNA, 25 bp, E. coli
gatagattctcttagtttaacacgg

SEQ ID NO: 121255 - DNA, 25 bp, E. coli
gatatacactaaatcaattgcatcg

SEQ ID NO: 121256 - DNA, 25 bp, E. coli
gatatacactaattcaattgcatcg

SEQ ID NO: 121257 - DNA, 25 bp, E. coli
ggcaaaaccccgcaagcgtacatca

SEQ ID NO: 121258 - DNA, 25 bp, E. coli
ggcaaaaccccggaagcgtacatca

SEQ ID NO: 121259 - DNA, 25 bp, E. coli
gagcgagcgaggtagcctgcaaaaa

SEQ ID NO: 121260 - DNA, 25 bp, E. coli
gagcgagcgaggaagcctgcaaaaa

SEQ ID NO: 121261 - DNA, 25 bp, E. coli
caagctcgctttgtcggaatggtaa

SEQ ID NO: 121262 - DNA, 25 bp, E. coli
aagacttattctgctcactgagtgg

SEQ ID NO: 121263 - DNA, 25 bp, E. coli
aagacttattctcctcactgagtgg

SEQ ID NO: 121264 - DNA, 25 bp, E. coli
cactgagtgggctaaagaggaattc

SEQ ID NO: 121265 - DNA, 25 bp, E. coli
caagctcgctttctcggaatggtaa

SEQ ID NO: 121266 - DNA, 25 bp, E. coli
cactgagtgggcaaaagaggaattc

SEQ ID NO: 121267 - DNA, 25 bp, E. coli
caaaaaagttggaagacgctggcga

SEQ ID NO: 121268 - DNA, 25 bp, E. coli
caaaaaagttggtagacgctggcga

SEQ ID NO: 121269 - DNA, 25 bp, E. coli
tccgagtacgtttagtaaatacgct

SEQ ID NO: 121270 - DNA, 25 bp, E. coli
tccgagtacgttaagtaaatacgct

SEQ ID NO: 121271 - DNA, 25 bp, E. coli
cctgctttgaagtggatactggaag

SEQ ID NO: 121272 - DNA, 25 bp, E. coli
cctgctttgaagaggatactggaag

SEQ ID NO: 121273 - DNA, 25 bp, E. coli
gaatgatatttcgtctccccaaaaa

SEQ ID NO: 121274 - DNA, 25 bp, E. coli
gaatgatatttcctctccccaaaaa

SEQ ID NO: 121275 - DNA, 25 bp, E. coli
gatcgccacagaacaccctgctttg

SEQ ID NO: 121276 - DNA, 25 bp, E. coli
gtaaacaagccggaggtgatcgcca

SEQ ID NO: 121277 - DNA, 25 bp, E. coli
gtaaacaagccgcaggtgatcgcca

SEQ ID NO: 121278 - DNA, 25 bp, E. coli
ggaattcagtgatccggtcccaact

SEQ ID NO: 121279 - DNA, 25 bp, E. coli
ggaattcagtgaaccggtcccaact

SEQ ID NO: 121280 - DNA, 25 bp, E. coli
gagtggatccgcaagctcgctttgt

SEQ ID NO: 121281 - DNA, 25 bp, E. coli
gatcgccacagatcaccctgctttg

SEQ ID NO: 121282 - DNA, 25 bp, E. coli
gagtggatccgctagctcgctttgt

SEQ ID NO: 121283 - DNA, 25 bp, E. coli
aagagatgctgcaatccgacctgcg

SEQ ID NO: 121284 - DNA, 25 bp, E. coli
aagagatgctgctatccgacctgcg

SEQ ID NO: 121285 - DNA, 25 bp, E. coli
catgactatgttagccgcgatatga

SEQ ID NO: 121286 - DNA, 25 bp, E. coli
catgactatgtttgccgcgatatga

SEQ ID NO: 121287 - DNA, 25 bp, E. coli
tatgccgacagcgttcatgactatg

SEQ ID NO: 121288 - DNA, 25 bp, E. coli
tatgccgacagccttcatgactatg

SEQ ID NO: 121289 - DNA, 25 bp, E. coli
tgaggctatcgcgtatgccgacagc

SEQ ID NO: 121290 - DNA, 25 bp, E. coli
tgacgtcgaataccatgaatccatc

SEQ ID NO: 121291 - DNA, 25 bp, E. coli
tgaggctatcgcctatgccgacagc

SEQ ID NO: 121292 - DNA, 25 bp, E. coli
tgcgaaggatctgcgtgaggctatc

SEQ ID NO: 121293 - DNA, 25 bp, E. coli
tgacgtcgaatagcatgaatccatc

SEQ ID NO: 121294 - DNA, 25 bp, E. coli
tgcgaaggatctccgtgaggctatc

SEQ ID NO: 121295 - DNA, 25 bp, E. coli
gactgatgcgtcttaatgacgtcga

SEQ ID NO: 121296 - DNA, 25 bp, E. coli
gactgatgcgtcataatgacgtcga

SEQ ID NO: 121297 - DNA, 25 bp, E. coli
cgactggctcgatactgaactggat

SEQ ID NO: 121298 - DNA, 25 bp, E. coli
ccgacctgcgataagagctggaagg

SEQ ID NO: 121299 - DNA, 25 bp, E. coli
ccgacctgcgattagagctggaagg

SEQ ID NO: 121300 - DNA, 25 bp, E. coli
cgactggctcgaaactgaactggat

SEQ ID NO: 121301 - DNA, 25 bp, E. coli
ggatctcatcggtaaaatcggccta

SEQ ID NO: 121302 - DNA, 25 bp, E. coli
ggatctcatcggaaaaatcggccta

SEQ ID NO: 121303 - DNA, 25 bp, E. coli
gatgatcgagatccttgccgatgaa

SEQ ID NO: 121304 - DNA, 25 bp, E. coli
gatgatcgagatgcttgccgatgaa

SEQ ID NO: 121305 - DNA, 25 bp, E. coli
caatatcactggcttccagaacggg

SEQ ID NO: 121306 - DNA, 25 bp, E. coli
caatatcactgggttccagaacggg

SEQ ID NO: 121307 - DNA, 25 bp, E. coli
cactggcttccacaacgggctggcg

SEQ ID NO: 121308 - DNA, 25 bp, E. coli
cactggcttccagaacgggctggcg

SEQ ID NO: 121309 - DNA, 25 bp, E. coli
atctccgcgctcactctgggtctgg

SEQ ID NO: 121310 - DNA, 25 bp, E. coli
atctccgcgctctctctgggtctgg

SEQ ID NO: 121311 - DNA, 25 bp, E. coli
aggcggcaatatcactggcttccag

SEQ ID NO: 121312 - DNA, 25 bp, E. coli
aggcggcaatatgactggcttccag

SEQ ID NO: 121313 - DNA, 25 bp, E. coli
aaacgcgtacgttctcgtagcgact

SEQ ID NO: 121314 - DNA, 25 bp, E. coli
aaacgcgtacgtactcgtagcgact

SEQ ID NO: 121315 - DNA, 25 bp, E. coli
tatcactggcttgcagaacgggctg

SEQ ID NO: 121316 - DNA, 25 bp, E. coli
tatcactggcttccagaacgggctg

SEQ ID NO: 121317 - DNA, 25 bp, E. coli
ttctcgtagcgactactacaccgca

SEQ ID NO: 121318 - DNA, 25 bp, E. coli
ttctcgtagcgagtactacaccgca

SEQ ID NO: 121319 - DNA, 25 bp, E. coli
gctctctctgggtctgggactgatg

SEQ ID NO: 121320 - DNA, 25 bp, E. coli
gctctctctgggactgggactgatg

SEQ ID NO: 121321 - DNA, 25 bp, E. coli
gcgtacgttctcgtagcgactacta

SEQ ID NO: 121322 - DNA, 25 bp, E. coli
gcgtacgttctcctagcgactacta

SEQ ID NO: 121323 - DNA, 25 bp, E. coli
cgttcacctggccaatgcagtgggc

SEQ ID NO: 121324 - DNA, 25 bp, E. coli
cgttcacctggcgaatgcagtgggc

SEQ ID NO: 121325 - DNA, 25 bp, E. coli
cggccgttcaccaggcgaatgcagt

SEQ ID NO: 121326 - DNA, 25 bp, E. coli
cggccgttcacctggcgaatgcagt

SEQ ID NO: 121327 - DNA, 25 bp, E. coli
cacgtcaggcaggtatgagcttctc

SEQ ID NO: 121328 - DNA, 25 bp, E. coli
cacggttgcgattctcggtgaagaa

SEQ ID NO: 121329 - DNA, 25 bp, E. coli
cacggttgcgatactcggtgaagaa

SEQ ID NO: 121330 - DNA, 25 bp, E. coli
cacgtcaggcagctatgagcttctc

SEQ ID NO: 121331 - DNA, 25 bp, E. coli
tagtacgaattcaggaactggcgga

SEQ ID NO: 121332 - DNA, 25 bp, E. coli
tagtacgaattctggaactggcgga

SEQ ID NO: 121333 - DNA, 25 bp, E. coli
tctctgaattctggcgcagcggtgt

SEQ ID NO: 121334 - DNA, 25 bp, E. coli
tctctgaattctcgcgcagcggtgt

SEQ ID NO: 121335 - DNA, 25 bp, E. coli
gacagttttatcagctggaagccaa

SEQ ID NO: 121336 - DNA, 25 bp, E. coli
gactgataaaatggcggtcctgttg

SEQ ID NO: 121337 - DNA, 25 bp, E. coli
gacagttttatctgctggaagccaa

SEQ ID NO: 121338 - DNA, 25 bp, E. coli
gactgataaaatcgcggtcctgttg

SEQ ID NO: 121339 - DNA, 25 bp, E. coli
ccgctgagcgggtagtttctctgaa

SEQ ID NO: 121340 - DNA, 25 bp, E. coli
ccgctgagcgggaagtttctctgaa

SEQ ID NO: 121341 - DNA, 25 bp, E. coli
gtattgacgttatgctggacagcga

SEQ ID NO: 121342 - DNA, 25 bp, E. coli
gtattgacgttaagctggacagcga

SEQ ID NO: 121343 - DNA, 25 bp, E. coli
ggttatcgttaagccgagccgcgaa

SEQ ID NO: 121344 - DNA, 25 bp, E. coli
ggttatcgttaacccgagccgcgaa

SEQ ID NO: 121345 - DNA, 25 bp, E. coli
taagattggcatatcagcacgatga

SEQ ID NO: 121346 - DNA, 25 bp, E. coli
taagattggcatttcagcacgatga

SEQ ID NO: 121347 - DNA, 25 bp, E. coli
gagacacagtatttctgccccgcag

SEQ ID NO: 121348 - DNA, 25 bp, E. coli
gagacacagtatatctgccccgcag

SEQ ID NO: 121349 - DNA, 25 bp, E. coli
cagccagtggctcaagcaaaccgat

SEQ ID NO: 121350 - DNA, 25 bp, E. coli
cagccagtggctgaagcaaaccgat

SEQ ID NO: 121351 - DNA, 25 bp, E. coli
tgatgcgccgaaaggtgaacgcgtc

SEQ ID NO: 121352 - DNA, 25 bp, E. coli
tgatgcgccgaatggtgaacgcgtc

SEQ ID NO: 121353 - DNA, 25 bp, E. coli
tggtaacggctaagttcaactgctg

SEQ ID NO: 121354 - DNA, 25 bp, E. coli
tggtaacggctatgttcaactgctg

SEQ ID NO: 121355 - DNA, 25 bp, E. coli
tgaatgtggaagcacaaacgcgtcg

SEQ ID NO: 121356 - DNA, 25 bp, E. coli
tgaatgtggaaggacaaacgcgtcg

SEQ ID NO: 121357 - DNA, 25 bp, E. coli
tgcaagacatcaacaaactgggaag

SEQ ID NO: 121358 - DNA, 25 bp, E. coli
tgctgcgtctatgccactgaatgtg

SEQ ID NO: 121359 - DNA, 25 bp, E. coli
tgctgcgtctatcccactgaatgtg

SEQ ID NO: 121360 - DNA, 25 bp, E. coli
tgcaagacatcatcaaactgggaag

SEQ ID NO: 121361 - DNA, 25 bp, E. coli
tctggatagcgatgacgacgccgaa

SEQ ID NO: 121362 - DNA, 25 bp, E. coli
tctggatagcgaagacgacgccgaa

SEQ ID NO: 121363 - DNA, 25 bp, E. coli
ccgttgaaccgcatatcgacatggg

SEQ ID NO: 121364 - DNA, 25 bp, E. coli
ccgttgaaccgcttatcgacatggg

SEQ ID NO: 121365 - DNA, 25 bp, E. coli
gctggtcttgtcgtttatcccgaaa

SEQ ID NO: 121366 - DNA, 25 bp, E. coli
gctggtcttgtcctttatcccgaaa

SEQ ID NO: 121367 - DNA, 25 bp, E. coli
gaaactgctgaacgatgatgcgccg

SEQ ID NO: 121368 - DNA, 25 bp, E. coli
gaccaaagtggttgcaggttctaac

SEQ ID NO: 121369 - DNA, 25 bp, E. coli
gaaactgctgaaggatgatgcgccg

SEQ ID NO: 121370 - DNA, 25 bp, E. coli
gaccaaagtggtagcaggttctaac

SEQ ID NO: 121371 - DNA, 25 bp, E. coli
atgacgttaccgagtggacacccga

SEQ ID NO: 121372 - DNA, 25 bp, E. coli
atgacgttaccgtgtggacacccga

SEQ ID NO: 121373 - DNA, 25 bp, E. coli
actaggcccgtatattcgtgaaggt

SEQ ID NO: 121374 - DNA, 25 bp, E. coli
actaggcccgtaaattcgtgaaggt

SEQ ID NO: 121375 - DNA, 25 bp, E. coli
taccagtttggtgtgttcgataaag

SEQ ID NO: 121376 - DNA, 25 bp, E. coli
tatgcgtcaacgtgaaaccggcacc

SEQ ID NO: 121377 - DNA, 25 bp, E. coli
tacctacagttaccagtttggtctg

SEQ ID NO: 121378 - DNA, 25 bp, E. coli
tatgcgtcaacgagaaaccggcacc

SEQ ID NO: 121379 - DNA, 25 bp, E. coli
tacctacagttagcagtttggtctg

SEQ ID NO: 121380 - DNA, 25 bp, E. coli
taccagtttggtctgttcgataaag

SEQ ID NO: 121381 - DNA, 25 bp, E. coli
gaagcgcaggaaacccgttttacct

SEQ ID NO: 121382 - DNA, 25 bp, E. coli
gaagcgcaggaatcccgttttacct

SEQ ID NO: 121383 - DNA, 25 bp, E. coli
cccgtatattcgtgaaggtaagtgc

SEQ ID NO: 121384 - DNA, 25 bp, E. coli
cccgtatattcgagaaggtaagtgc

SEQ ID NO: 121385 - DNA, 25 bp, E. coli
gattgtctggctctatgcgtcaacg

SEQ ID NO: 121386 - DNA, 25 bp, E. coli
gattctttttcgtttgtctggctgt

SEQ ID NO: 121387 - DNA, 25 bp, E. coli
gattgtctggctgtatgcgtcaacg

SEQ ID NO: 121388 - DNA, 25 bp, E. coli
gattctttttcgattgtctggctgt

SEQ ID NO: 121389 - DNA, 25 bp, E. coli
tggacacccgaacagcagattgatc

SEQ ID NO: 121390 - DNA, 25 bp, E. coli
tggacacccgaagagcagattgatc

SEQ ID NO: 121391 - DNA, 25 bp, E. coli
gagcagattgatcaaaaaatttacc

SEQ ID NO: 121392 - DNA, 25 bp, E. coli
gagcagattgatgaaaaaatttacc

SEQ ID NO: 121393 - DNA, 25 bp, E. coli
ttatgcatggcgtcacgctgtgcac

SEQ ID NO: 121394 - DNA, 25 bp, E. coli
ttatgcatggcgacacgctgtgcac

SEQ ID NO: 121395 - DNA, 25 bp, E. coli
ttgtttgtgcgcaaacgcattgccg

SEQ ID NO: 121396 - DNA, 25 bp, E. coli
ttgtttgtgcgctaacgcattgccg

SEQ ID NO: 121397 - DNA, 25 bp, E. coli
tgttatttcattgatggcaaccgtg

SEQ ID NO: 121398 - DNA, 25 bp, E. coli
tgtgcaccgatgacgcgggttatca

SEQ ID NO: 121399 - DNA, 25 bp, E. coli
tgttatttcattcatggcaaccgtg

SEQ ID NO: 121400 - DNA, 25 bp, E. coli
tgtgcaccgatgtcgcgggttatca

SEQ ID NO: 121401 - DNA, 25 bp, E. coli
tgcaatggctgaaccacgggcatac

SEQ ID NO: 121402 - DNA, 25 bp, E. coli
tgcaatggctgatccacgggcatac

SEQ ID NO: 121403 - DNA, 25 bp, E. coli
tcgcccggcggtccatgaacttatc

SEQ ID NO: 121404 - DNA, 25 bp, E. coli
tcgcccggcggtgcatgaacttatc

SEQ ID NO: 121405 - DNA, 25 bp, E. coli
tcgctggcgatcatggacgttaacc

SEQ ID NO: 121406 - DNA, 25 bp, E. coli
tcgctggcgatcttggacgttaacc

SEQ ID NO: 121407 - DNA, 25 bp, E. coli
gcatgacgttattgccggaagaaaa

SEQ ID NO: 121408 - DNA, 25 bp, E. coli
gcatgacgttatagccggaagaaaa

SEQ ID NO: 121409 - DNA, 25 bp, E. coli
gcaaccgtgattatctgctcggcaa

SEQ ID NO: 121410 - DNA, 25 bp, E. coli
gcaaccgtgattttctgctcggcaa

SEQ ID NO: 121411 - DNA, 25 bp, E. coli
gaagccaacagctgtaaatcgctgg

SEQ ID NO: 121412 - DNA, 25 bp, E. coli
gaagccaacagcagtaaatcgctgg

SEQ ID NO: 121413 - DNA, 25 bp, E. coli
cttttcgcgtggaactgggtgcctg

SEQ ID NO: 121414 - DNA, 25 bp, E. coli
cttttcgcgtggtactgggtgcctg

SEQ ID NO: 121415 - DNA, 25 bp, E. coli
tactggtgcacaaaccttgcgtcag

SEQ ID NO: 121416 - DNA, 25 bp, E. coli
tactggtgcacataccttgcgtcag

SEQ ID NO: 121417 - DNA, 25 bp, E. coli
aaaattgccctttctcaggccagcg

SEQ ID NO: 121418 - DNA, 25 bp, E. coli
aaaattgcccttactcaggccagcg

SEQ ID NO: 121419 - DNA, 25 bp, E. coli
tatccgcatgccagagatggacggc

SEQ ID NO: 121420 - DNA, 25 bp, E. coli
tatccgcatgcctgagatggacggc

SEQ ID NO: 121421 - DNA, 25 bp, E. coli
tgagcaccgcttttgcactacaagg

SEQ ID NO: 121422 - DNA, 25 bp, E. coli
tgatggacatctgcaaagacaccgc

SEQ ID NO: 121423 - DNA, 25 bp, E. coli
tgagcaccgcttatgcactacaagg

SEQ ID NO: 121424 - DNA, 25 bp, E. coli
tgatggacatctccaaagacaccgc

SEQ ID NO: 121425 - DNA, 25 bp, E. coli
gaatttgaacggtttggcggccatc

SEQ ID NO: 121426 - DNA, 25 bp, E. coli
gaaggtactctgctcctcgacgaaa

SEQ ID NO: 121427 - DNA, 25 bp, E. coli
gaatttgaacggattggcggccatc

SEQ ID NO: 121428 - DNA, 25 bp, E. coli
gaaggtactctggtcctcgacgaaa

SEQ ID NO: 121429 - DNA, 25 bp, E. coli
cgttcattaaagtcaactgcgcggc

SEQ ID NO: 121430 - DNA, 25 bp, E. coli
cgttcattaaagacaactgcgcggc

SEQ ID NO: 121431 - DNA, 25 bp, E. coli
cgattcactacaattcgcggcgggc

SEQ ID NO: 121432 - DNA, 25 bp, E. coli
cgattcactacatttcgcggcgggc

SEQ ID NO: 121433 - DNA, 25 bp, E. coli
ggcggccatcagtccataaaagttg

SEQ ID NO: 121434 - DNA, 25 bp, E. coli
ggcggccatcagaccataaaagttg

SEQ ID NO: 121435 - DNA, 25 bp, E. coli
taatgttcgccgtatgctgagcacc

SEQ ID NO: 121436 - DNA, 25 bp, E. coli
taatgttcgccgaatgctgagcacc

SEQ ID NO: 121437 - DNA, 25 bp, E. coli
cagattaatgactgcggtgcggcgc

SEQ ID NO: 121438 - DNA, 25 bp, E. coli
cagatgaagatgctcgacacgctgc

SEQ ID NO: 121439 - DNA, 25 bp, E. coli
caggaaatttttgcccagcaggtcc

SEQ ID NO: 121440 - DNA, 25 bp, E. coli
cagatgaagatggtcgacacgctgc

SEQ ID NO: 121441 - DNA, 25 bp, E. coli
caggaaatttttccccagcaggtcc

SEQ ID NO: 121442 - DNA, 25 bp, E. coli
cagattaatgacagcggtgcggcgc

SEQ ID NO: 121443 - DNA, 25 bp, E. coli
aaaattcgtcgcatcccgtcaggcg

SEQ ID NO: 121444 - DNA, 25 bp, E. coli
aaaattcgtcgcttcccgtcaggcg

SEQ ID NO: 121445 - DNA, 25 bp, E. coli
tttcccggaattacgcccagatgag

SEQ ID NO: 121446 - DNA, 25 bp, E. coli
tttcccggaatttcgcccagatgag

SEQ ID NO: 121447 - DNA, 25 bp, E. coli
tactccgtgtttgagcagtcactgc

SEQ ID NO: 121448 - DNA, 25 bp, E. coli
tactccgtgtttcagcagtcactgc

SEQ ID NO: 121449 - DNA, 25 bp, E. coli
tggtgacgttacgttcaaaagcgcg

SEQ ID NO: 121450 - DNA, 25 bp, E. coli
tgtatgccgccaccattgagagtga

SEQ ID NO: 121451 - DNA, 25 bp, E. coli
tgtatgccgccagcattgagagtga

SEQ ID NO: 121452 - DNA, 25 bp, E. coli
tgaactgttcgtacaggccacctgg

SEQ ID NO: 121453 - DNA, 25 bp, E. coli
tgaactgttcgttcaggccacctgg

SEQ ID NO: 121454 - DNA, 25 bp, E. coli
gaactgcgactgcataggctccggt

SEQ ID NO: 121455 - DNA, 25 bp, E. coli
gaactgcgactggataggctccggt

SEQ ID NO: 121456 - DNA, 25 bp, E. coli
gatctggtacgctataacggctatg

SEQ ID NO: 121457 - DNA, 25 bp, E. coli
gatctggtacgcaataacggctatg

SEQ ID NO: 121458 - DNA, 25 bp, E. coli
tggtgacgttaccttcaaaagcgcg

SEQ ID NO: 121459 - DNA, 25 bp, E. coli
catggcaattccatgctgacaacag

SEQ ID NO: 121460 - DNA, 25 bp, E. coli
catggcaattccttgctgacaacag

SEQ ID NO: 121461 - DNA, 25 bp, E. coli
tagcgggttgttcatcaaagcatga

SEQ ID NO: 121462 - DNA, 25 bp, E. coli
tagcgggttgttgatcaaagcatga

SEQ ID NO: 121463 - DNA, 25 bp, E. coli
taggtgtgccgttgtcacctcaacg

SEQ ID NO: 121464 - DNA, 25 bp, E. coli
taggtgtgccgtagtcacctcaacg

SEQ ID NO: 121465 - DNA, 25 bp, E. coli
tattagcgggttcttcatcaaagca

SEQ ID NO: 121466 - DNA, 25 bp, E. coli
tatatcatgccgcttaggtgtgccg

SEQ ID NO: 121467 - DNA, 25 bp, E. coli
tatatcatgccggttaggtgtgccg

SEQ ID NO: 121468 - DNA, 25 bp, E. coli
tattagcgggttgttcatcaaagca

SEQ ID NO: 121469 - DNA, 25 bp, E. coli
ttgtcacctcaagggcgattccagg

SEQ ID NO: 121470 - DNA, 25 bp, E. coli
ttgtcacctcaacggcgattccagg

SEQ ID NO: 121471 - DNA, 25 bp, E. coli
gtgaaacagagagatggcaattcct

SEQ ID NO: 121472 - DNA, 25 bp, E. coli
gtgaaacagagacatggcaattcct

SEQ ID NO: 121473 - DNA, 25 bp, E. coli
gaagtgaaattgtgatggtttgcct

SEQ ID NO: 121474 - DNA, 25 bp, E. coli
gaagtgaaattgagatggtttgcct

SEQ ID NO: 121475 - DNA, 25 bp, E. coli
cctttttgattgtgttattagcggg

SEQ ID NO: 121476 - DNA, 25 bp, E. coli
cgaaatgtatatcatgccgcttagg

SEQ ID NO: 121477 - DNA, 25 bp, E. coli
cgaaatgtatatgatgccgcttagg

SEQ ID NO: 121478 - DNA, 25 bp, E. coli
cctttttgattgagttattagcggg

SEQ ID NO: 121479 - DNA, 25 bp, E. coli
tcaacggcgattccaggctataagg

SEQ ID NO: 121480 - DNA, 25 bp, E. coli
tcaacggcgattgcaggctataagg

SEQ ID NO: 121481 - DNA, 25 bp, E. coli
aattctcgagctagccgcctttctg

SEQ ID NO: 121482 - DNA, 25 bp, E. coli
aattctcgagcttgccgcctttctg

SEQ ID NO: 121483 - DNA, 25 bp, E. coli
cagatgcgttatgttcgctcgctca

SEQ ID NO: 121484 - DNA, 25 bp, E. coli
cagatgcgttatcttcgctcgctca

SEQ ID NO: 121485 - DNA, 25 bp, E. coli
catcccggtcacttactgatgtaag

SEQ ID NO: 121486 - DNA, 25 bp, E. coli
catcccggtcacatactgatgtaag

SEQ ID NO: 121487 - DNA, 25 bp, E. coli
tactgatgtaaggtcccgggaattc

SEQ ID NO: 121488 - DNA, 25 bp, E. coli
tactgatgtaagctcccgggaattc

SEQ ID NO: 121489 - DNA, 25 bp, E. coli
agcttgccgcctttctgcaactcga

SEQ ID NO: 121490 - DNA, 25 bp, E. coli
agcttgccgcctatctgcaactcga

SEQ ID NO: 121491 - DNA, 25 bp, E. coli
ttcgcgccgcagttgcgttatcttc

SEQ ID NO: 121492 - DNA, 25 bp, E. coli
ttcgcgccgcagatgcgttatcttc

SEQ ID NO: 121493 - DNA, 25 bp, E. coli
tgcaactcgaacaattttgggggag

SEQ ID NO: 121494 - DNA, 25 bp, E. coli
tgcaactcgaactattttgggggag

SEQ ID NO: 121495 - DNA, 25 bp, E. coli
tcccgggaattctcgagcttgccgc

SEQ ID NO: 121496 - DNA, 25 bp, E. coli
tcccgggaattcacgagcttgccgc

SEQ ID NO: 121497 - DNA, 25 bp, E. coli
gtctataagggctctcccccttcat

SEQ ID NO: 121498 - DNA, 25 bp, E. coli
gtaagctcccgggaattctcgagct

SEQ ID NO: 121499 - DNA, 25 bp, E. coli
gtaagctcccggcaattctcgagct

SEQ ID NO: 121500 - DNA, 25 bp, E. coli
gttatcttcgctggctcatcccggt

SEQ ID NO: 121501 - DNA, 25 bp, E. coli
gttatcttcgctcgctcatcccggt

SEQ ID NO: 121502 - DNA, 25 bp, E. coli
gtctataagggcactcccccttcat

SEQ ID NO: 121503 - DNA, 25 bp, E. coli
caaatccgcgtaacagggtgacgtc

SEQ ID NO: 121504 - DNA, 25 bp, E. coli
caaatccgcgtatcagggtgacgtc

SEQ ID NO: 121505 - DNA, 25 bp, E. coli
cagtgcattcttgggttaaccacca

SEQ ID NO: 121506 - DNA, 25 bp, E. coli
cagatggcgatgttcctcggcggaa

SEQ ID NO: 121507 - DNA, 25 bp, E. coli
cagatggcgatgatcctcggcggaa

SEQ ID NO: 121508 - DNA, 25 bp, E. coli
cagtgcattcttcggttaaccacca

SEQ ID NO: 121509 - DNA, 25 bp, E. coli
tatccttggaaggtggctgcgctac

SEQ ID NO: 121510 - DNA, 25 bp, E. coli
tatccttggaagctggctgcgctac

SEQ ID NO: 121511 - DNA, 25 bp, E. coli
tttttcagcacaacatccggacggc

SEQ ID NO: 121512 - DNA, 25 bp, E. coli
tttttcagcacatcatccggacggc

SEQ ID NO: 121513 - DNA, 25 bp, E. coli
tggtgcgtcgttaaacaaatccgcg

SEQ ID NO: 121514 - DNA, 25 bp, E. coli
tgccggtggcggaaaaacagcagat

SEQ ID NO: 121515 - DNA, 25 bp, E. coli
tccggacggcagagaaatgatgaag

SEQ ID NO: 121516 - DNA, 25 bp, E. coli
tccggacggcagtgaaatgatgaag

SEQ ID NO: 121517 - DNA, 25 bp, E. coli
tgccggtggcggtaaaacagcagat

SEQ ID NO: 121518 - DNA, 25 bp, E. coli
cattgtcactttgcagggcggtgca

SEQ ID NO: 121519 - DNA, 25 bp, E. coli
cattgtcactttccagggcggtgca

SEQ ID NO: 121520 - DNA, 25 bp, E. coli
gatatctacccgtacttgtgtggca

SEQ ID NO: 121521 - DNA, 25 bp, E. coli
gatatctacccgaacttgtgtggca

SEQ ID NO: 121522 - DNA, 25 bp, E. coli
tggtgcgtcgtttaacaaatccgcg

SEQ ID NO: 121523 - DNA, 25 bp, E. coli
gacgtcttctggtgcggatatcctg

SEQ ID NO: 121524 - DNA, 25 bp, E. coli
gacgtcttctggagcggatatcctg

SEQ ID NO: 121525 - DNA, 25 bp, E. coli
cacgttcgtttgatgcatcaggcga

SEQ ID NO: 121526 - DNA, 25 bp, E. coli
cacgttcgtttgttgcatcaggcga

SEQ ID NO: 121527 - DNA, 25 bp, E. coli
catgcggtgcgctaagagccggata

SEQ ID NO: 121528 - DNA, 25 bp, E. coli
catgcggtgcgcaaagagccggata

SEQ ID NO: 121529 - DNA, 25 bp, E. coli
tacttccggtatctataagcgcctg

SEQ ID NO: 121530 - DNA, 25 bp, E. coli
tacttccggtatgtataagcgcctg

SEQ ID NO: 121531 - DNA, 25 bp, E. coli
tatattaagatttcccgcctgctgg

SEQ ID NO: 121532 - DNA, 25 bp, E. coli
tatattaagattacccgcctgctgg

SEQ ID NO: 121533 - DNA, 25 bp, E. coli
tgtacgaaacgctgatgaccatggc

SEQ ID NO: 121534 - DNA, 25 bp, E. coli
tgattaccaatgtgcgcagcgtgaa

SEQ ID NO: 121535 - DNA, 25 bp, E. coli
tgtacgaaacgcagatgaccatggc

SEQ ID NO: 121536 - DNA, 25 bp, E. coli
tgattaccaatgagcgcagcgtgaa

SEQ ID NO: 121537 - DNA, 25 bp, E. coli
tgaccatggcgttagaggacgacct

SEQ ID NO: 121538 - DNA, 25 bp, E. coli
tgaccatggcgtaagaggacgacct

SEQ ID NO: 121539 - DNA, 25 bp, E. coli
tctttccgcttatggcaatggcgcg

SEQ ID NO: 121540 - DNA, 25 bp, E. coli
tctttccgcttaaggcaatggcgcg

SEQ ID NO: 121541 - DNA, 25 bp, E. coli
tctgcataatacgtcagtgagtcgg

SEQ ID NO: 121542 - DNA, 25 bp, E. coli
tctgcataatacctcagtgagtcgg

SEQ ID NO: 121543 - DNA, 25 bp, E. coli
gctgcgtgcgcgatataccgagcaa

SEQ ID NO: 121544 - DNA, 25 bp, E. coli
gctgcgtgcgcgttataccgagcaa

SEQ ID NO: 121545 - DNA, 25 bp, E. coli
cattgcgtgtttcccatgcggtgcg

SEQ ID NO: 121546 - DNA, 25 bp, E. coli
cattgcgtgtttgccatgcggtgcg

SEQ ID NO: 121547 - DNA, 25 bp, E. coli
caacaaggaaagtgtggtggagcca

SEQ ID NO: 121548 - DNA, 25 bp, E. coli
caacaaggaaagagtggtggagcca

SEQ ID NO: 121549 - DNA, 25 bp, E. coli
caagagtggtcttagcagtaaagga

SEQ ID NO: 121550 - DNA, 25 bp, E. coli
caagagtggtctaagcagtaaagga

SEQ ID NO: 121551 - DNA, 25 bp, E. coli
tatgatggttggaccaagagtggtc

SEQ ID NO: 121552 - DNA, 25 bp, E. coli
taggtagcggtgacatcaaaaaacg

SEQ ID NO: 121553 - DNA, 25 bp, E. coli
tatgatggttggtccaagagtggtc

SEQ ID NO: 121554 - DNA, 25 bp, E. coli
taggtagcggtgtcatcaaaaaacg

SEQ ID NO: 121555 - DNA, 25 bp, E. coli
tggtggagccagaacaattatcttt

SEQ ID NO: 121556 - DNA, 25 bp, E. coli
tggtggagccagtacaattatcttt

SEQ ID NO: 121557 - DNA, 25 bp, E. coli
tgtgtataaggcaaggcgattcagc

SEQ ID NO: 121558 - DNA, 25 bp, E. coli
tgtgtataaggctaggcgattcagc

SEQ ID NO: 121559 - DNA, 25 bp, E. coli
tgcaaggcatatcggaggctgattt

SEQ ID NO: 121560 - DNA, 25 bp, E. coli
tgcaaggcatatgggaggctgattt

SEQ ID NO: 121561 - DNA, 25 bp, E. coli
gcacgaaaaaacttggtattcacga

SEQ ID NO: 121562 - DNA, 25 bp, E. coli
gcacgaaaaaacatggtattcacga

SEQ ID NO: 121563 - DNA, 25 bp, E. coli
ccgctgaagaagtgatgcaaggcat

SEQ ID NO: 121564 - DNA, 25 bp, E. coli
ccgctgaagaagagatgcaaggcat

SEQ ID NO: 121565 - DNA, 25 bp, E. coli
gataaagttctcttggctgccgctg

SEQ ID NO: 121566 - DNA, 25 bp, E. coli
gataaagttctcatggctgccgctg

SEQ ID NO: 121567 - DNA, 25 bp, E. coli
ggcgattcagcctaagcacgaaaaa

SEQ ID NO: 121568 - DNA, 25 bp, E. coli
ggcgattcagccaaagcacgaaaaa

SEQ ID NO: 121569 - DNA, 25 bp, E. coli
aatttgctggtacatctccgagcac

SEQ ID NO: 121570 - DNA, 25 bp, E. coli
aatttgctggtagatctccgagcac

SEQ ID NO: 121571 - DNA, 25 bp, E. coli
cacaatttgctgctagatctccgag

SEQ ID NO: 121572 - DNA, 25 bp, E. coli
cacaatttgctggtagatctccgag

SEQ ID NO: 121573 - DNA, 25 bp, E. coli
taaagagggcgaatttaacccacag

SEQ ID NO: 121574 - DNA, 25 bp, E. coli
taaagagggcgattttaacccacag

SEQ ID NO: 121575 - DNA, 25 bp, E. coli
agtccctgcggccaattctgcagca

SEQ ID NO: 121576 - DNA, 25 bp, E. coli
agtccctgcggcgaattctgcagca

SEQ ID NO: 121577 - DNA, 25 bp, E. coli
tagatctccgagcacagcagattcc

SEQ ID NO: 121578 - DNA, 25 bp, E. coli
tagatctccgaggacagcagattcc

SEQ ID NO: 121579 - DNA, 25 bp, E. coli
ttaacccacaggtacgggcgcaact

SEQ ID NO: 121580 - DNA, 25 bp, E. coli
ttaacccacaggaacgggcgcaact

SEQ ID NO: 121581 - DNA, 25 bp, E. coli
cctgcggcgaattctgcagcacggg

SEQ ID NO: 121582 - DNA, 25 bp, E. coli
cctgcggcgaatactgcagcacggg

SEQ ID NO: 121583 - DNA, 25 bp, E. coli
gcggacgcttcccaactcaaaaatt

SEQ ID NO: 121584 - DNA, 25 bp, E. coli
gcggacgcttccgaactcaaaaatt

SEQ ID NO: 121585 - DNA, 25 bp, E. coli
gctgcctggcatacacaatttgctg

SEQ ID NO: 121586 - DNA, 25 bp, E. coli
gctgcctggcattcacaatttgctg

SEQ ID NO: 121587 - DNA, 25 bp, E. coli
gacgcttcccaactcaaaaattcga

SEQ ID NO: 121588 - DNA, 25 bp, E. coli
gacgcttcccaagtcaaaaattcga

SEQ ID NO: 121589 - DNA, 25 bp, E. coli
taatgctgtgctccctggcattcac

SEQ ID NO: 121590 - DNA, 25 bp, E. coli
taatgctgtgctgcctggcattcac

SEQ ID NO: 121591 - DNA, 25 bp, E. coli
cacgcacctcgtatggcgactgcat

SEQ ID NO: 121592 - DNA, 25 bp, E. coli
cacgcacctcgtttggcgactgcat

SEQ ID NO: 121593 - DNA, 25 bp, E. coli
tctgatatgtacaccgaatggcgcg

SEQ ID NO: 121594 - DNA, 25 bp, E. coli
tctgatatgtactccgaatggcgcg

SEQ ID NO: 121595 - DNA, 25 bp, E. coli
gccctgagtccgcaccgttctgaat

SEQ ID NO: 121596 - DNA, 25 bp, E. coli
gccctgagtccggaccgttctgaat

SEQ ID NO: 121597 - DNA, 25 bp, E. coli
tcgcgtaccgactttcgtttactgg

SEQ ID NO: 121598 - DNA, 25 bp, E. coli
tcgcgtaccgacattcgtttactgg

SEQ ID NO: 121599 - DNA, 25 bp, E. coli
gaacgatgtgttggctaatctgtat

SEQ ID NO: 121600 - DNA, 25 bp, E. coli
gaacgatgtgttcgctaatctgtat

SEQ ID NO: 121601 - DNA, 25 bp, E. coli
ccgaatggcgcgacgttcacgtcaa

SEQ ID NO: 121602 - DNA, 25 bp, E. coli
cgttcacgtcaaaccggaagtggcc

SEQ ID NO: 121603 - DNA, 25 bp, E. coli
cgttcacgtcaatccggaagtggcc

SEQ ID NO: 121604 - DNA, 25 bp, E. coli
cgaacaacaggcgattgccgacatt

SEQ ID NO: 121605 - DNA, 25 bp, E. coli
ccgaatggcgcgtcgttcacgtcaa

SEQ ID NO: 121606 - DNA, 25 bp, E. coli
cgaacaacaggccattgccgacatt

SEQ ID NO: 121607 - DNA, 25 bp, E. coli
gtcaatccggaagtggccctgagtc

SEQ ID NO: 121608 - DNA, 25 bp, E. coli
ggcggcgttcgcgtaccgactttcg

SEQ ID NO: 121609 - DNA, 25 bp, E. coli
gtcaatccggaactggccctgagtc

SEQ ID NO: 121610 - DNA, 25 bp, E. coli
ggcggcgttcgcctaccgactttcg

SEQ ID NO: 121611 - DNA, 25 bp, E. coli
ggaccgttctgaatacatcaagcaa

SEQ ID NO: 121612 - DNA, 25 bp, E. coli
ggaccgttctgattacatcaagcaa

SEQ ID NO: 121613 - DNA, 25 bp, E. coli
caagcggctggtaagtaaaacaatc

SEQ ID NO: 121614 - DNA, 25 bp, E. coli
cacgcaacgtattgaacgtaacaac

SEQ ID NO: 121615 - DNA, 25 bp, E. coli
cacgcaacgtatagaacgtaacaac

SEQ ID NO: 121616 - DNA, 25 bp, E. coli
caagcggctggttagtaaaacaatc

SEQ ID NO: 121617 - DNA, 25 bp, E. coli
agtcatcggttccttcattgaaaag

SEQ ID NO: 121618 - DNA, 25 bp, E. coli
agtcatcggttcgttcattgaaaag

SEQ ID NO: 121619 - DNA, 25 bp, E. coli
ttgcaatccacgaaaaagtcatcgg

SEQ ID NO: 121620 - DNA, 25 bp, E. coli
ttgcaatccacgtaaaagtcatcgg

SEQ ID NO: 121621 - DNA, 25 bp, E. coli
tgccgaaggagatatacctgaccgg

SEQ ID NO: 121622 - DNA, 25 bp, E. coli
tgccgaaggagaaatacctgaccgg

SEQ ID NO: 121623 - DNA, 25 bp, E. coli
ccggcaaaatcttcacgcaacgtat

SEQ ID NO: 121624 - DNA, 25 bp, E. coli
ccggcaaaatctacacgcaacgtat

SEQ ID NO: 121625 - DNA, 25 bp, E. coli
gcttctcgcgttgcgttgcaatcca

SEQ ID NO: 121626 - DNA, 25 bp, E. coli
gcttctcgcgttccgttgcaatcca

SEQ ID NO: 121627 - DNA, 25 bp, E. coli
gaacgtaacaacatgaccctccgca

SEQ ID NO: 121628 - DNA, 25 bp, E. coli
gaacgtaacaacttgaccctccgca

SEQ ID NO: 121629 - DNA, 25 bp, E. coli
cgcacccgcatctagcggctggtaa

SEQ ID NO: 121630 - DNA, 25 bp, E. coli
cgcacccgcatcaagcggctggtaa

SEQ ID NO: 121631 - DNA, 25 bp, E. coli
cattgaaaagcagatgttctactga

SEQ ID NO: 121632 - DNA, 25 bp, E. coli
cattgaaaagcacatgttctactga

SEQ ID NO: 121633 - DNA, 25 bp, E. coli
ggagaaatacctgaccggcaaaatc

SEQ ID NO: 121634 - DNA, 25 bp, E. coli
ggagaaatacctcaccggcaaaatc

SEQ ID NO: 121635 - DNA, 25 bp, E. coli
cataatgcttccagtgaggcgaaaa

SEQ ID NO: 121636 - DNA, 25 bp, E. coli
cataatgcttcctgtgaggcgaaaa

SEQ ID NO: 121637 - DNA, 25 bp, E. coli
taaatcagcagggaattacccagca

SEQ ID NO: 121638 - DNA, 25 bp, E. coli
taaatcagcaggcaattacccagca

SEQ ID NO: 121639 - DNA, 25 bp, E. coli
aaagtagtgccagcttttgcgcacg

SEQ ID NO: 121640 - DNA, 25 bp, E. coli
aaagtagtgccaccttttgcgcacg

SEQ ID NO: 121641 - DNA, 25 bp, E. coli
aacgtcttttacgtgtctgtggcca

SEQ ID NO: 121642 - DNA, 25 bp, E. coli
aacgtcttttacctgtctgtggcca

SEQ ID NO: 121643 - DNA, 25 bp, E. coli
tatttacgcgtgttttactaagcag

SEQ ID NO: 121644 - DNA, 25 bp, E. coli
tatttacgcgtgatttactaagcag

SEQ ID NO: 121645 - DNA, 25 bp, E. coli
tctgtggccatcgtcttataagcaa

SEQ ID NO: 121646 - DNA, 25 bp, E. coli
tctgtggccatcctcttataagcaa

SEQ ID NO: 121647 - DNA, 25 bp, E. coli
gccccgcaatggtgcgaaaatgaaa

SEQ ID NO: 121648 - DNA, 25 bp, E. coli
gcgaaataacgcgatgtaacatgct

SEQ ID NO: 121649 - DNA, 25 bp, E. coli
gccccgcaatggagcgaaaatgaaa

SEQ ID NO: 121650 - DNA, 25 bp, E. coli
gcgaaataacgccatgtaacatgct

SEQ ID NO: 121651 - DNA, 25 bp, E. coli
gaaataataaaaacagcgccccgca

SEQ ID NO: 121652 - DNA, 25 bp, E. coli
gaaataataaaatcagcgccccgca

SEQ ID NO: 121653 - DNA, 25 bp, E. coli
cgcgtcgcaatatgctgagtgtaga

SEQ ID NO: 121654 - DNA, 25 bp, E. coli
cgcgtcgcaataagctgagtgtaga

SEQ ID NO: 121655 - DNA, 25 bp, E. coli
tcgttaaaaagaccgcggaactccg

SEQ ID NO: 121656 - DNA, 25 bp, E. coli
tcgttaaaaagagcgcggaactccg

SEQ ID NO: 121657 - DNA, 25 bp, E. coli
caagatgggttttgctatcgccgcc

SEQ ID NO: 121658 - DNA, 25 bp, E. coli
aataatgtggaagaatacgcccggc

SEQ ID NO: 121659 - DNA, 25 bp, E. coli
aataatgtggaacaatacgcccggc

SEQ ID NO: 121660 - DNA, 25 bp, E. coli
caagatgggtttagctatcgccgcc

SEQ ID NO: 121661 - DNA, 25 bp, E. coli
taaaaaccccgaaatcgtcgcaggc

SEQ ID NO: 121662 - DNA, 25 bp, E. coli
taaaaaccccgatatcgtcgcaggc

SEQ ID NO: 121663 - DNA, 25 bp, E. coli
tataaaacccctgaactggtgcgtc

SEQ ID NO: 121664 - DNA, 25 bp, E. coli
tataaaacccctcaactggtgcgtc

SEQ ID NO: 121665 - DNA, 25 bp, E. coli
tatctctaatcacagctccggcaag

SEQ ID NO: 121666 - DNA, 25 bp, E. coli
tatctctaatcagagctccggcaag

SEQ ID NO: 121667 - DNA, 25 bp, E. coli
tgatttagtgattctcgcccctgcc

SEQ ID NO: 121668 - DNA, 25 bp, E. coli
tgatttagtgatactcgcccctgcc

SEQ ID NO: 121669 - DNA, 25 bp, E. coli
gaaaaatcatcaagagcctggccgg

SEQ ID NO: 121670 - DNA, 25 bp, E. coli
gacgatttgtctggctacacctgcg

SEQ ID NO: 121671 - DNA, 25 bp, E. coli
gaaaaatcatcatgagcctggccgg

SEQ ID NO: 121672 - DNA, 25 bp, E. coli
cattacacctttactggcaggacgg

SEQ ID NO: 121673 - DNA, 25 bp, E. coli
cattacaccttttctggcaggacgg

SEQ ID NO: 121674 - DNA, 25 bp, E. coli
gataaagtcttagcgcttgagcgca

SEQ ID NO: 121675 - DNA, 25 bp, E. coli
gataaagtcttaccgcttgagcgca

SEQ ID NO: 121676 - DNA, 25 bp, E. coli
ggcgttgccgcactaaaagaccatc

SEQ ID NO: 121677 - DNA, 25 bp, E. coli
ggcgttgccgcagtaaaagaccatc

SEQ ID NO: 121678 - DNA, 25 bp, E. coli
gacgatttgtctcgctacacctgcg

SEQ ID NO: 121679 - DNA, 25 bp, E. coli
cacaccgctttagccgacgatatta

SEQ ID NO: 121680 - DNA, 25 bp, E. coli
cacacaccgctttagccgacgatat

SEQ ID NO: 121681 - DNA, 25 bp, E. coli
cacacaccgcttaagccgacgatat

SEQ ID NO: 121682 - DNA, 25 bp, E. coli
cacaccgctttacccgacgatatta

SEQ ID NO: 121683 - DNA, 25 bp, E. coli
taaaggcgataacctggttggcgta

SEQ ID NO: 121684 - DNA, 25 bp, E. coli
taaaggcgataagctggttggcgta

SEQ ID NO: 121685 - DNA, 25 bp, E. coli
aggcgataagctggttggcgtagaa

SEQ ID NO: 121686 - DNA, 25 bp, E. coli
aggcgataagctcgttggcgtagaa

SEQ ID NO: 121687 - DNA, 25 bp, E. coli
accgctttagcccacgatattaaag

SEQ ID NO: 121688 - DNA, 25 bp, E. coli
accgctttagccgacgatattaaag

SEQ ID NO: 121689 - DNA, 25 bp, E. coli
tttcacacaccgctttagccgacga

SEQ ID NO: 121690 - DNA, 25 bp, E. coli
tttcacacaccggtttagccgacga

SEQ ID NO: 121691 - DNA, 25 bp, E. coli
ttcacacaccgctttagccgacgat

SEQ ID NO: 121692 - DNA, 25 bp, E. coli
ttcacacaccgcattagccgacgat

SEQ ID NO: 121693 - DNA, 25 bp, E. coli
gctttagccgacgatattaaagttg

SEQ ID NO: 121694 - DNA, 25 bp, E. coli
gctttagccgaccatattaaagttg

SEQ ID NO: 121695 - DNA, 25 bp, E. coli
ccgctttagccgtcgatattaaagt

SEQ ID NO: 121696 - DNA, 25 bp, E. coli
cgctttagccgaggatattaaagtt

SEQ ID NO: 121697 - DNA, 25 bp, E. coli
ccgctttagccgacgatattaaagt

SEQ ID NO: 121698 - DNA, 25 bp, E. coli
cgctttagccgacgatattaaagtt

SEQ ID NO: 121699 - DNA, 25 bp, E. coli
tcacacaccgctatagccgacgata

SEQ ID NO: 121700 - DNA, 25 bp, E. coli
tcacacaccgctttagccgacgata

SEQ ID NO: 121701 - DNA, 25 bp, E. coli
cagcgtggcgtttaccgattcacca

SEQ ID NO: 121702 - DNA, 25 bp, E. coli
cagcgtggcgttaaccgattcacca

SEQ ID NO: 121703 - DNA, 25 bp, E. coli
tgttgatgtatctaacccgcagaac

SEQ ID NO: 121704 - DNA, 25 bp, E. coli
tgataacgaacaacgttgacctttg

SEQ ID NO: 121705 - DNA, 25 bp, E. coli
tgataacgaacatcgttgacctttg

SEQ ID NO: 121706 - DNA, 25 bp, E. coli
tgttgatgtatcaaacccgcagaac

SEQ ID NO: 121707 - DNA, 25 bp, E. coli
tgcatcttttaataccagcgtggcg

SEQ ID NO: 121708 - DNA, 25 bp, E. coli
tgcatcttttaaaaccagcgtggcg

SEQ ID NO: 121709 - DNA, 25 bp, E. coli
gcaatgcgcctgtttgtctcgtcgg

SEQ ID NO: 121710 - DNA, 25 bp, E. coli
gcaatgcgcctgattgtctcgtcgg

SEQ ID NO: 121711 - DNA, 25 bp, E. coli
gactccacggacttgtaattttgat

SEQ ID NO: 121712 - DNA, 25 bp, E. coli
gactccacggacatgtaattttgat

SEQ ID NO: 121713 - DNA, 25 bp, E. coli
cgaaaagtataaagtgtcagcctgt

SEQ ID NO: 121714 - DNA, 25 bp, E. coli
cgaaaagtataatgtgtcagcctgt

SEQ ID NO: 121715 - DNA, 25 bp, E. coli
cattcagcaaaatcagactccacgg

SEQ ID NO: 121716 - DNA, 25 bp, E. coli
cattcagcaaaaacagactccacgg

SEQ ID NO: 121717 - DNA, 25 bp, E. coli
gatttaacagggaatagttcaggct

SEQ ID NO: 121718 - DNA, 25 bp, E. coli
gatttaacagggtatagttcaggct

SEQ ID NO: 121719 - DNA, 25 bp, E. coli
tgtctcgtcggttagcgaaaagtat

SEQ ID NO: 121720 - DNA, 25 bp, E. coli
tgtctcgtcggtaagcgaaaagtat

SEQ ID NO: 121721 - DNA, 25 bp, E. coli
tcagcctgtgtaaatcctctcgcca

SEQ ID NO: 121722 - DNA, 25 bp, E. coli
tcagcctgtgtatatcctctcgcca

SEQ ID NO: 121723 - DNA, 25 bp, E. coli
gactatgttttccataagttaaaag

SEQ ID NO: 121724 - DNA, 25 bp, E. coli
gactatgttttcgataagttaaaag

SEQ ID NO: 121725 - DNA, 25 bp, E. coli
ctcgggccgaagacgacgctacttt

SEQ ID NO: 121726 - DNA, 25 bp, E. coli
ctcgggccgaagtcgacgctacttt

SEQ ID NO: 121727 - DNA, 25 bp, E. coli
aaagaaatctttgctgatgaagcca

SEQ ID NO: 121728 - DNA, 25 bp, E. coli
aaagaaatctttcctgatgaagcca

SEQ ID NO: 121729 - DNA, 25 bp, E. coli
tatctgtctatttaagtaagcccaa

SEQ ID NO: 121730 - DNA, 25 bp, E. coli
tatctgtctattaaagtaagcccaa

SEQ ID NO: 121731 - DNA, 25 bp, E. coli
tattctttgtggaagattacgagga

SEQ ID NO: 121732 - DNA, 25 bp, E. coli
tattctttgtggtagattacgagga

SEQ ID NO: 121733 - DNA, 25 bp, E. coli
gaagacgacgcttctttgaagaagg

SEQ ID NO: 121734 - DNA, 25 bp, E. coli
gaagacgacgctactttgaagaagg

SEQ ID NO: 121735 - DNA, 25 bp, E. coli
gtagtaacggaatcatttatctgtc

SEQ ID NO: 121736 - DNA, 25 bp, E. coli
gtaagcccaaataatagaaatcatg

SEQ ID NO: 121737 - DNA, 25 bp, E. coli
gtaagcccaaattatagaaatcatg

SEQ ID NO: 121738 - DNA, 25 bp, E. coli
gggagcactcgtatagtattctttg

SEQ ID NO: 121739 - DNA, 25 bp, E. coli
gtagtaacggaaacatttatctgtc

SEQ ID NO: 121740 - DNA, 25 bp, E. coli
gggagcactcgtttagtattctttg

SEQ ID NO: 121741 - DNA, 25 bp, E. coli
tggcttctttatggaagagattgtt

SEQ ID NO: 121742 - DNA, 25 bp, E. coli
tggcttctttatcgaagagattgtt

SEQ ID NO: 121743 - DNA, 25 bp, E. coli
gagattgttttactcctcgggccga

SEQ ID NO: 121744 - DNA, 25 bp, E. coli
gagattgttttagtcctcgggccga

SEQ ID NO: 121745 - DNA, 25 bp, E. coli
caactcgaaattagtataggccgct

SEQ ID NO: 121746 - DNA, 25 bp, E. coli
cactggtcggtgttcagaaccttaa

SEQ ID NO: 121747 - DNA, 25 bp, E. coli
caactcgaaatttgtataggccgct

SEQ ID NO: 121748 - DNA, 25 bp, E. coli
cactggtcggtgatcagaaccttaa

SEQ ID NO: 121749 - DNA, 25 bp, E. coli
tagacgctttttgggctttgtgaga

SEQ ID NO: 121750 - DNA, 25 bp, E. coli
tagacgctttttcggctttgtgaga

SEQ ID NO: 121751 - DNA, 25 bp, E. coli
tagcagcctaagaataagtatatcg

SEQ ID NO: 121752 - DNA, 25 bp, E. coli
tagtgagtcgggtacgatcctgtcc

SEQ ID NO: 121753 - DNA, 25 bp, E. coli
tagcagcctaagtataagtatatcg

SEQ ID NO: 121754 - DNA, 25 bp, E. coli
tagtgagtcgggaacgatcctgtcc

SEQ ID NO: 121755 - DNA, 25 bp, E. coli
tataatccgacgtagaacagaggga

SEQ ID NO: 121756 - DNA, 25 bp, E. coli
tataatccgacgaagaacagaggga

SEQ ID NO: 121757 - DNA, 25 bp, E. coli
tgagaaatctcgcagaaaaaaccgc

SEQ ID NO: 121758 - DNA, 25 bp, E. coli
tgagaaatctcggagaaaaaaccgc

SEQ ID NO: 121759 - DNA, 25 bp, E. coli
tcagaaccttaatacagcgtagacg

SEQ ID NO: 121760 - DNA, 25 bp, E. coli
tcagaaccttaaaacagcgtagacg

SEQ ID NO: 121761 - DNA, 25 bp, E. coli
gaaaaaaccgcgagtctataatccg

SEQ ID NO: 121762 - DNA, 25 bp, E. coli
gaaaaaaccgcgtgtctataatccg

SEQ ID NO: 121763 - DNA, 25 bp, E. coli
tatttatcgtagctttaacaactcg

SEQ ID NO: 121764 - DNA, 25 bp, E. coli
tatttatcgtaggtttaacaactcg

SEQ ID NO: 121765 - DNA, 25 bp, E. coli
ggaggaacccttgccgaaatgacta

SEQ ID NO: 121766 - DNA, 25 bp, E. coli
ggaggaacccttcccgaaatgacta

SEQ ID NO: 121767 - DNA, 25 bp, E. coli
gaaattaacgttccgaaaggctatg

SEQ ID NO: 121768 - DNA, 25 bp, E. coli
caactgcagaattatcatgggctca

SEQ ID NO: 121769 - DNA, 25 bp, E. coli
gaaattaacgttgcgaaaggctatg

SEQ ID NO: 121770 - DNA, 25 bp, E. coli
caactgcagaataatcatgggctca

SEQ ID NO: 121771 - DNA, 25 bp, E. coli
catctatggtgaatctgcaaaggaa

SEQ ID NO: 121772 - DNA, 25 bp, E. coli
catctatggtgattctgcaaaggaa

SEQ ID NO: 121773 - DNA, 25 bp, E. coli
tagttgcaggttacatcggagacgg

SEQ ID NO: 121774 - DNA, 25 bp, E. coli
tagttgcaggtttcatcggagacgg

SEQ ID NO: 121775 - DNA, 25 bp, E. coli
tttcttcagaagagcaaggcactgt

SEQ ID NO: 121776 - DNA, 25 bp, E. coli
tttcttcagaagtgcaaggcactgt

SEQ ID NO: 121777 - DNA, 25 bp, E. coli
ttaagtcatggacgcgtagttgcag

SEQ ID NO: 121778 - DNA, 25 bp, E. coli
ttaagtcatggaggcgtagttgcag

SEQ ID NO: 121779 - DNA, 25 bp, E. coli
tgacggcgttgcttaccatttaagt

SEQ ID NO: 121780 - DNA, 25 bp, E. coli
tgacggcgttgcataccatttaagt

SEQ ID NO: 121781 - DNA, 25 bp, E. coli
tgcggcggctgaaagttacactgaa

SEQ ID NO: 121782 - DNA, 25 bp, E. coli
tgcggcggctgatagttacactgaa

SEQ ID NO: 121783 - DNA, 25 bp, E. coli
tcactgtcacactttgcggcggctg

SEQ ID NO: 121784 - DNA, 25 bp, E. coli
tcatgggaaatggaatgcgaaaacc

SEQ ID NO: 121785 - DNA, 25 bp, E. coli
tcatgggaaatgcaatgcgaaaacc

SEQ ID NO: 121786 - DNA, 25 bp, E. coli
cggagacggactattttcatgggaa

SEQ ID NO: 121787 - DNA, 25 bp, E. coli
cggagacggacttttttcatgggaa

SEQ ID NO: 121788 - DNA, 25 bp, E. coli
tcactgtcacacattgcggcggctg

SEQ ID NO: 121789 - DNA, 25 bp, E. coli
caatatcggcgagcggctgatggcg

SEQ ID NO: 121790 - DNA, 25 bp, E. coli
caatatcggcgaccggctgatggcg

SEQ ID NO: 121791 - DNA, 25 bp, E. coli
cggcgagcggctcatggcgaccggg

SEQ ID NO: 121792 - DNA, 25 bp, E. coli
cggcgagcggctgatggcgaccggg

SEQ ID NO: 121793 - DNA, 25 bp, E. coli
catcatccgtatacacagctgctgg

SEQ ID NO: 121794 - DNA, 25 bp, E. coli
catcatccgtattcacagctgctgg

SEQ ID NO: 121795 - DNA, 25 bp, E. coli
tacgcgccgggcaaaggctttagcg

SEQ ID NO: 121796 - DNA, 25 bp, E. coli
tacgcgccgggctaaggctttagcg

SEQ ID NO: 121797 - DNA, 25 bp, E. coli
tgtgtcggtgcacgcccgcctgctc

SEQ ID NO: 121798 - DNA, 25 bp, E. coli
tgtgtcggtgcaggcccgcctgctc

SEQ ID NO: 121799 - DNA, 25 bp, E. coli
tggtggtggagcagaacctcgcggt

SEQ ID NO: 121800 - DNA, 25 bp, E. coli
tggtggtggagctgaacctcgcggt

SEQ ID NO: 121801 - DNA, 25 bp, E. coli
tgcaggcccgcctgctcgacctgct

SEQ ID NO: 121802 - DNA, 25 bp, E. coli
tgcaggcccgccagctcgacctgct

SEQ ID NO: 121803 - DNA, 25 bp, E. coli
tcatccgtatactcagctgctggtg

SEQ ID NO: 121804 - DNA, 25 bp, E. coli
tcatccgtatacacagctgctggtg

SEQ ID NO: 121805 - DNA, 25 bp, E. coli
gcatcatccgtatacacagctgctg

SEQ ID NO: 121806 - DNA, 25 bp, E. coli
gcatcatccgtaaacacagctgctg

SEQ ID NO: 121807 - DNA, 25 bp, E. coli
cgcgccgggcaaaggctttagcgat

SEQ ID NO: 121808 - DNA, 25 bp, E. coli
cgcgccgggcaatggctttagcgat

SEQ ID NO: 121809 - DNA, 25 bp, E. coli
ctgctgcgcggcgtggtggtggagc

SEQ ID NO: 121810 - DNA, 25 bp, E. coli
ctgctgcgcggcctggtggtggagc

SEQ ID NO: 121811 - DNA, 25 bp, E. coli
cagtttatcttgattccggcgaatc

SEQ ID NO: 121812 - DNA, 25 bp, E. coli
cagtttatcttgtttccggcgaatc

SEQ ID NO: 121813 - DNA, 25 bp, E. coli
actaataataaccaaataccggcag

SEQ ID NO: 121814 - DNA, 25 bp, E. coli
actaataataacgaaataccggcag

SEQ ID NO: 121815 - DNA, 25 bp, E. coli
gctgcagcagcagaacaaaaaattc

SEQ ID NO: 121816 - DNA, 25 bp, E. coli
gctgcagcagcacaacaaaaaattc

SEQ ID NO: 121817 - DNA, 25 bp, E. coli
gataaaactactgacactaataata

SEQ ID NO: 121818 - DNA, 25 bp, E. coli
gcagcagaacaataaattcccggta

SEQ ID NO: 121819 - DNA, 25 bp, E. coli
gcagcagaacaaaaaattcccggta

SEQ ID NO: 121820 - DNA, 25 bp, E. coli
gataaaactactcacactaataata

SEQ ID NO: 121821 - DNA, 25 bp, E. coli
gaatctcttgagctggtgactggct

SEQ ID NO: 121822 - DNA, 25 bp, E. coli
gaatctcttgaggtggtgactggct

SEQ ID NO: 121823 - DNA, 25 bp, E. coli
gaaagaatgcatggctgcagcagca

SEQ ID NO: 121824 - DNA, 25 bp, E. coli
gaaagaatgcatcgctgcagcagca

SEQ ID NO: 121825 - DNA, 25 bp, E. coli
cggttcaatgaaagaatgcatggct

SEQ ID NO: 121826 - DNA, 25 bp, E. coli
cggttcaatgaatgaatgcatggct

SEQ ID NO: 121827 - DNA, 25 bp, E. coli
gtttccggcgaaactcttgagctgg

SEQ ID NO: 121828 - DNA, 25 bp, E. coli
gtttccggcgaatctcttgagctgg

SEQ ID NO: 121829 - DNA, 25 bp, E. coli
tgttatccggtacataaaactactc

SEQ ID NO: 121830 - DNA, 25 bp, E. coli
tgttatccggtagataaaactactc

SEQ ID NO: 121831 - DNA, 25 bp, E. coli
ggtgactggcttttacggttcaatg

SEQ ID NO: 121832 - DNA, 25 bp, E. coli
ggtgactggcttatacggttcaatg

SEQ ID NO: 121833 - DNA, 25 bp, E. coli
tatcagaccgtgattttatccacaa

SEQ ID NO: 121834 - DNA, 25 bp, E. coli
tatcagaccgtgtttttatccacaa

SEQ ID NO: 121835 - DNA, 25 bp, E. coli
tttatccacaagatcaatgcaagct

SEQ ID NO: 121836 - DNA, 25 bp, E. coli
tttatccacaagttcaatgcaagct

SEQ ID NO: 121837 - DNA, 25 bp, E. coli
tggtagcaacaagtgtgccagagct

SEQ ID NO: 121838 - DNA, 25 bp, E. coli
tgctacggaacccattgcagggaaa

SEQ ID NO: 121839 - DNA, 25 bp, E. coli
tgtgacatagagttgaaataccggg

SEQ ID NO: 121840 - DNA, 25 bp, E. coli
tgctacggaaccgattgcagggaaa

SEQ ID NO: 121841 - DNA, 25 bp, E. coli
tgtgacatagagatgaaataccggg

SEQ ID NO: 121842 - DNA, 25 bp, E. coli
tgaaataccgggtagagacaacggg

SEQ ID NO: 121843 - DNA, 25 bp, E. coli
tgcagggaaagactataacacgctt

SEQ ID NO: 121844 - DNA, 25 bp, E. coli
tgaaataccgggaagagacaacggg

SEQ ID NO: 121845 - DNA, 25 bp, E. coli
tgcagggaaagagtataacacgctt

SEQ ID NO: 121846 - DNA, 25 bp, E. coli
tcctctcaatcgatatcttctggcg

SEQ ID NO: 121847 - DNA, 25 bp, E. coli
tgccagagcttaagagcaacgaggt

SEQ ID NO: 121848 - DNA, 25 bp, E. coli
tcctctcaatcgttatcttctggcg

SEQ ID NO: 121849 - DNA, 25 bp, E. coli
tgccagagcttatgagcaacgaggt

SEQ ID NO: 121850 - DNA, 25 bp, E. coli
tcttctggcgctacagtggtagcaa

SEQ ID NO: 121851 - DNA, 25 bp, E. coli
tcttctggcgcttcagtggtagcaa

SEQ ID NO: 121852 - DNA, 25 bp, E. coli
tggtagcaacaactgtgccagagct

SEQ ID NO: 121853 - DNA, 25 bp, E. coli
gagcaacgaggttatcattcactgt

SEQ ID NO: 121854 - DNA, 25 bp, E. coli
gagcaacgaggtaatcattcactgt

SEQ ID NO: 121855 - DNA, 25 bp, E. coli
tattcagcttaagtctgcttgcgca

SEQ ID NO: 121856 - DNA, 25 bp, E. coli
tattcagcttaactctgcttgcgca

SEQ ID NO: 121857 - DNA, 25 bp, E. coli
ttaactctgcttgcgcaaatgaacg

SEQ ID NO: 121858 - DNA, 25 bp, E. coli
ttaactctgcttccgcaaatgaacg

SEQ ID NO: 121859 - DNA, 25 bp, E. coli
tgcttgcgcaaaagaacgcagcacg

SEQ ID NO: 121860 - DNA, 25 bp, E. coli
tgcttgcgcaaatgaacgcagcacg

SEQ ID NO: 121861 - DNA, 25 bp, E. coli
tgcgcaaatgaaggcagcacgctgg

SEQ ID NO: 121862 - DNA, 25 bp, E. coli
tgcgcaaatgaacgcagcacgctgg

SEQ ID NO: 121863 - DNA, 25 bp, E. coli
tctgcttgcgcatatgaacgcagca

SEQ ID NO: 121864 - DNA, 25 bp, E. coli
tcagcttaactcagcttgcgcaaat

SEQ ID NO: 121865 - DNA, 25 bp, E. coli
tctgcttgcgcaaatgaacgcagca

SEQ ID NO: 121866 - DNA, 25 bp, E. coli
tcagcttaactctgcttgcgcaaat

SEQ ID NO: 121867 - DNA, 25 bp, E. coli
gcttaactctgcatgcgcaaatgaa

SEQ ID NO: 121868 - DNA, 25 bp, E. coli
gcttaactctgcttgcgcaaatgaa

SEQ ID NO: 121869 - DNA, 25 bp, E. coli
cgctgccactattcgccttgtttgt

SEQ ID NO: 121870 - DNA, 25 bp, E. coli
cgctgccactatacgccttgtttgt

SEQ ID NO: 121871 - DNA, 25 bp, E. coli
ctgagtgtggcggttaatttcgttc

SEQ ID NO: 121872 - DNA, 25 bp, E. coli
ctgagtgtggcgcttaatttcgttc

SEQ ID NO: 121873 - DNA, 25 bp, E. coli
ggtatgtaaaatttttagccgtctg

SEQ ID NO: 121874 - DNA, 25 bp, E. coli
ggtatgtaaaatatttagccgtctg

SEQ ID NO: 121875 - DNA, 25 bp, E. coli
tgtggcggttaaattcgttcccacg

SEQ ID NO: 121876 - DNA, 25 bp, E. coli
tgtggcggttaatttcgttcccacg

SEQ ID NO: 121877 - DNA, 25 bp, E. coli
aataatcgcgttttactccctcttg

SEQ ID NO: 121878 - DNA, 25 bp, E. coli
aataatcgcgttatactccctcttg

SEQ ID NO: 121879 - DNA, 25 bp, E. coli
caacaaaatcaattaattagcatga

SEQ ID NO: 121880 - DNA, 25 bp, E. coli
caacaaaatcaaataattagcatga

SEQ ID NO: 121881 - DNA, 25 bp, E. coli
cacatttaagcatggcaaatgtctg

SEQ ID NO: 121882 - DNA, 25 bp, E. coli
cacatttaagcaaggcaaatgtctg

SEQ ID NO: 121883 - DNA, 25 bp, E. coli
atcgcgttatacaccctcttgctga

SEQ ID NO: 121884 - DNA, 25 bp, E. coli
atcgcgttatactccctcttgctga

SEQ ID NO: 121885 - DNA, 25 bp, E. coli
tgatgacatcacatttaagcatggc

SEQ ID NO: 121886 - DNA, 25 bp, E. coli
tgaaaaatgagcgaataatcgcgtt

SEQ ID NO: 121887 - DNA, 25 bp, E. coli
tgctaatacgtgttgacatcacatt

SEQ ID NO: 121888 - DNA, 25 bp, E. coli
tgagcgaataatggcgttatactcc

SEQ ID NO: 121889 - DNA, 25 bp, E. coli
tgatgacatcacttttaagcatggc

SEQ ID NO: 121890 - DNA, 25 bp, E. coli
tgctaatacgtgatgacatcacatt

SEQ ID NO: 121891 - DNA, 25 bp, E. coli
tgaaaaatgagccaataatcgcgtt

SEQ ID NO: 121892 - DNA, 25 bp, E. coli
tgagcgaataatcgcgttatactcc

SEQ ID NO: 121893 - DNA, 25 bp, E. coli
gacatcacatttaagcatggcaaat

SEQ ID NO: 121894 - DNA, 25 bp, E. coli
gacatcacattttagcatggcaaat

SEQ ID NO: 121895 - DNA, 25 bp, E. coli
tggcaaatgtctgaaaaatgagcga

SEQ ID NO: 121896 - DNA, 25 bp, E. coli
tggcaaatgtctcaaaaatgagcga

SEQ ID NO: 121897 - DNA, 25 bp, E. coli
taagcatggcaattgtctgaaaaat

SEQ ID NO: 121898 - DNA, 25 bp, E. coli
taagcatggcaaatgtctgaaaaat

SEQ ID NO: 121899 - DNA, 25 bp, E. coli
caacgttatcgcaagtttgccaggc

SEQ ID NO: 121900 - DNA, 25 bp, E. coli
caacgttatcgctagtttgccaggc

SEQ ID NO: 121901 - DNA, 25 bp, E. coli
cttaaagctagtgcaaaccacagga

SEQ ID NO: 121902 - DNA, 25 bp, E. coli
cataagggaaaccagtattcacgct

SEQ ID NO: 121903 - DNA, 25 bp, E. coli
cataagggaaacgagtattcacgct

SEQ ID NO: 121904 - DNA, 25 bp, E. coli
cttaaagctagtccaaaccacagga

SEQ ID NO: 121905 - DNA, 25 bp, E. coli
atgttgaccttcgtcatcctgcggg

SEQ ID NO: 121906 - DNA, 25 bp, E. coli
atgttgaccttcctcatcctgcggg

SEQ ID NO: 121907 - DNA, 25 bp, E. coli
tagtttgccaggctcgatgttgacc

SEQ ID NO: 121908 - DNA, 25 bp, E. coli
tagtttgccagggtcgatgttgacc

SEQ ID NO: 121909 - DNA, 25 bp, E. coli
tgtatctaagtgcaaaaaatggccg

SEQ ID NO: 121910 - DNA, 25 bp, E. coli
tgtgacacagtgcaaattcagacac

SEQ ID NO: 121911 - DNA, 25 bp, E. coli
tgtgacacagtggaaattcagacac

SEQ ID NO: 121912 - DNA, 25 bp, E. coli
tgtatctaagtggaaaaaatggccg

SEQ ID NO: 121913 - DNA, 25 bp, E. coli
gcattagaaaggtttctggccgacc

SEQ ID NO: 121914 - DNA, 25 bp, E. coli
gcattagaaaggattctggccgacc

SEQ ID NO: 121915 - DNA, 25 bp, E. coli
ggccgttgcgtaatttcaaaaagcg

SEQ ID NO: 121916 - DNA, 25 bp, E. coli
ggccgttgcgtattttcaaaaagcg

SEQ ID NO: 121917 - DNA, 25 bp, E. coli
tcaaatcaatgctatacagcgcaga

SEQ ID NO: 121918 - DNA, 25 bp, E. coli
tcaaatcaatgcaatacagcgcaga

SEQ ID NO: 121919 - DNA, 25 bp, E. coli
tcaaaaagcggaaggtaactctata

SEQ ID NO: 121920 - DNA, 25 bp, E. coli
tcaaaaagcggatggtaactctata

SEQ ID NO: 121921 - DNA, 25 bp, E. coli
cagggacatgctccatcagcgctgg

SEQ ID NO: 121922 - DNA, 25 bp, E. coli
cagggacatgctgcatcagcgctgg

SEQ ID NO: 121923 - DNA, 25 bp, E. coli
agggacatgctggatcagcgctggc

SEQ ID NO: 121924 - DNA, 25 bp, E. coli
acgccttcagggtcatgctgcatca

SEQ ID NO: 121925 - DNA, 25 bp, E. coli
acgccttcagggacatgctgcatca

SEQ ID NO: 121926 - DNA, 25 bp, E. coli
agggacatgctgcatcagcgctggc

SEQ ID NO: 121927 - DNA, 25 bp, E. coli
acatgctgcatcagcgctggctctc

SEQ ID NO: 121928 - DNA, 25 bp, E. coli
acatgctgcatctgcgctggctctc

SEQ ID NO: 121929 - DNA, 25 bp, E. coli
ttcagggacatgctgcatcagcgct

SEQ ID NO: 121930 - DNA, 25 bp, E. coli
ttcagggacatggtgcatcagcgct

SEQ ID NO: 121931 - DNA, 25 bp, E. coli
tcagggacatgctgcatcagcgctg

SEQ ID NO: 121932 - DNA, 25 bp, E. coli
tcagggacatgcagcatcagcgctg

SEQ ID NO: 121933 - DNA, 25 bp, E. coli
gacatgctgcatgagcgctggctct

SEQ ID NO: 121934 - DNA, 25 bp, E. coli
gacatgctgcatcagcgctggctct

SEQ ID NO: 121935 - DNA, 25 bp, E. coli
cttcagggacatcctgcatcagcgc

SEQ ID NO: 121936 - DNA, 25 bp, E. coli
cttcagggacatgctgcatcagcgc

SEQ ID NO: 121937 - DNA, 25 bp, E. coli
ggacatgctgcatcagcgctggctc

SEQ ID NO: 121938 - DNA, 25 bp, E. coli
gggacatgctgcatcagcgctggct

SEQ ID NO: 121939 - DNA, 25 bp, E. coli
gggacatgctgcttcagcgctggct

SEQ ID NO: 121940 - DNA, 25 bp, E. coli
ggacatgctgcaacagcgctggctc

SEQ ID NO: 121941 - DNA, 25 bp, E. coli
caattctctttcgttatttaccgcg

SEQ ID NO: 121942 - DNA, 25 bp, E. coli
caattctctttccttatttaccgcg

SEQ ID NO: 121943 - DNA, 25 bp, E. coli
caccagtgaaaaccagcatggcgcg

SEQ ID NO: 121944 - DNA, 25 bp, E. coli
caccagtgaaaagcagcatggcgcg

SEQ ID NO: 121945 - DNA, 25 bp, E. coli
aacgtacggcctcacaccagtgaaa

SEQ ID NO: 121946 - DNA, 25 bp, E. coli
aacgtacggcctgacaccagtgaaa

SEQ ID NO: 121947 - DNA, 25 bp, E. coli
ttatacgggctgtcgggtaaagcgc

SEQ ID NO: 121948 - DNA, 25 bp, E. coli
ttatacgggctgacgggtaaagcgc

SEQ ID NO: 121949 - DNA, 25 bp, E. coli
tgtacactccggtgtcaattctctt

SEQ ID NO: 121950 - DNA, 25 bp, E. coli
tgtacactccggagtcaattctctt

SEQ ID NO: 121951 - DNA, 25 bp, E. coli
tgaaaaccagcaaggcgcgccgggt

SEQ ID NO: 121952 - DNA, 25 bp, E. coli
tgaaaaccagcatggcgcgccgggt

SEQ ID NO: 121953 - DNA, 25 bp, E. coli
tctttattagatcgattaagccaat

SEQ ID NO: 121954 - DNA, 25 bp, E. coli
tctttattagatggattaagccaat

SEQ ID NO: 121955 - DNA, 25 bp, E. coli
gccaatttttgtctatggtcattaa

SEQ ID NO: 121956 - DNA, 25 bp, E. coli
gccaatttttgtgtatggtcattaa

SEQ ID NO: 121957 - DNA, 25 bp, E. coli
gcgcttttccgctccttttcgcggg

SEQ ID NO: 121958 - DNA, 25 bp, E. coli
gcgcttttccgcaccttttcgcggg

SEQ ID NO: 121959 - DNA, 25 bp, E. coli
gcgcaaggatcgatctggatcttta

SEQ ID NO: 121960 - DNA, 25 bp, E. coli
gcgcaaggatcgttctggatcttta

SEQ ID NO: 121961 - DNA, 25 bp, E. coli
cgggtaaagcgctaggatcgttctg

SEQ ID NO: 121962 - DNA, 25 bp, E. coli
cgggtaaagcgcaaggatcgttctg

SEQ ID NO: 121963 - DNA, 25 bp, E. coli
tagaagggacttcacgtaagagcat

SEQ ID NO: 121964 - DNA, 25 bp, E. coli
tagaagggacttgacgtaagagcat

SEQ ID NO: 121965 - DNA, 25 bp, E. coli
agggacttcacgtaagagcatcatg

SEQ ID NO: 121966 - DNA, 25 bp, E. coli
agggacttcacgaaagagcatcatg

SEQ ID NO: 121967 - DNA, 25 bp, E. coli
ccagcgcattctggtagaagggact

SEQ ID NO: 121968 - DNA, 25 bp, E. coli
ccagcgcattctcgtagaagggact

SEQ ID NO: 121969 - DNA, 25 bp, E. coli
ccgcgtggttaacttcgagggcaca

SEQ ID NO: 121970 - DNA, 25 bp, E. coli
ccgcgtggttaagttcgagggcaca

SEQ ID NO: 121971 - DNA, 25 bp, E. coli
cccggatattcacatcagctctgac

SEQ ID NO: 121972 - DNA, 25 bp, E. coli
cgcattctggtagaagggacttcac

SEQ ID NO: 121973 - DNA, 25 bp, E. coli
cgcattctggtacaagggacttcac

SEQ ID NO: 121974 - DNA, 25 bp, E. coli
cccggatattcagatcagctctgac

SEQ ID NO: 121975 - DNA, 25 bp, E. coli
cggtcgcactgataataaccgcgtg

SEQ ID NO: 121976 - DNA, 25 bp, E. coli
cggtcgcactgaaaataaccgcgtg

SEQ ID NO: 121977 - DNA, 25 bp, E. coli
ggttaacttcgacggcacaccggat

SEQ ID NO: 121978 - DNA, 25 bp, E. coli
ggttaacttcgagggcacaccggat

SEQ ID NO: 121979 - DNA, 25 bp, E. coli
ggcgcgcccggatattcagatcagc

SEQ ID NO: 121980 - DNA, 25 bp, E. coli
tggagctttccggtcgcactgaaaa

SEQ ID NO: 121981 - DNA, 25 bp, E. coli
tggagctttccgctcgcactgaaaa

SEQ ID NO: 121982 - DNA, 25 bp, E. coli
ggcgcgcccggaaattcagatcagc

SEQ ID NO: 121983 - DNA, 25 bp, E. coli
tttccggtcgcactgaaaataaccg

SEQ ID NO: 121984 - DNA, 25 bp, E. coli
tttccggtcgcagtgaaaataaccg

SEQ ID NO: 121985 - DNA, 25 bp, E. coli
tacaaaagctactgcgcggaatcgc

SEQ ID NO: 121986 - DNA, 25 bp, E. coli
tacaaaagctacagcgcggaatcgc

SEQ ID NO: 121987 - DNA, 25 bp, E. coli
tgcgggcgcaaaaagtcaacgtcgt

SEQ ID NO: 121988 - DNA, 25 bp, E. coli
tgcgggcgcaaatagtcaacgtcgt

SEQ ID NO: 121989 - DNA, 25 bp, E. coli
tgcaggaccgcatattgtgctcgac

SEQ ID NO: 121990 - DNA, 25 bp, E. coli
tgcaggaccgcaaattgtgctcgac

SEQ ID NO: 121991 - DNA, 25 bp, E. coli
tctgccgcgaagaccatggtaaaac

SEQ ID NO: 121992 - DNA, 25 bp, E. coli
tctgccgcgaagtccatggtaaaac

SEQ ID NO: 121993 - DNA, 25 bp, E. coli
cctggcaggatggaggaccgcaaat

SEQ ID NO: 121994 - DNA, 25 bp, E. coli
gctcgaccaactccgggcgcaaaaa

SEQ ID NO: 121995 - DNA, 25 bp, E. coli
cctggcaggatgcaggaccgcaaat

SEQ ID NO: 121996 - DNA, 25 bp, E. coli
gctcgaccaactgcgggcgcaaaaa

SEQ ID NO: 121997 - DNA, 25 bp, E. coli
gcggaatcgctgattgcggctaacc

SEQ ID NO: 121998 - DNA, 25 bp, E. coli
gctgattgcggcaaaccctgaagtg

SEQ ID NO: 121999 - DNA, 25 bp, E. coli
gctgattgcggctaaccctgaagtg

SEQ ID NO: 122000 - DNA, 25 bp, E. coli
gcggaatcgctgtttgcggctaacc

SEQ ID NO: 122001 - DNA, 25 bp, E. coli
gaatcgacggttctatttcatatat

SEQ ID NO: 122002 - DNA, 25 bp, E. coli
gaatcgacggttgtatttcatatat

SEQ ID NO: 122003 - DNA, 25 bp, E. coli
gtgtaccagccagccttgagcagat

SEQ ID NO: 122004 - DNA, 25 bp, E. coli
gtgtaccagccacccttgagcagat

SEQ ID NO: 122005 - DNA, 25 bp, E. coli
taagagttctcagattatgccaagg

SEQ ID NO: 122006 - DNA, 25 bp, E. coli
taagagttctcacattatgccaagg

SEQ ID NO: 122007 - DNA, 25 bp, E. coli
aatgtgccgctggataaagagacgc

SEQ ID NO: 122008 - DNA, 25 bp, E. coli
aatgtgccgctgcataaagagacgc

SEQ ID NO: 122009 - DNA, 25 bp, E. coli
aacgtccggcgttgctctgtatggc

SEQ ID NO: 122010 - DNA, 25 bp, E. coli
aacgtccggcgtagctctgtatggc

SEQ ID NO: 122011 - DNA, 25 bp, E. coli
tttgacaaggcggattacgacaccc

SEQ ID NO: 122012 - DNA, 25 bp, E. coli
ttgaactgatgagaagcgacctgcg

SEQ ID NO: 122013 - DNA, 25 bp, E. coli
ttgaactgatgacaagcgacctgcg

SEQ ID NO: 122014 - DNA, 25 bp, E. coli
tttgacaaggcgcattacgacaccc

SEQ ID NO: 122015 - DNA, 25 bp, E. coli
tgcatgtctggctactgaaaacccg

SEQ ID NO: 122016 - DNA, 25 bp, E. coli
tgcatgtctggcaactgaaaacccg

SEQ ID NO: 122017 - DNA, 25 bp, E. coli
tgaaaaaagcgacagctggcgtctg

SEQ ID NO: 122018 - DNA, 25 bp, E. coli
tgaaaaaagcgagagctggcgtctg

SEQ ID NO: 122019 - DNA, 25 bp, E. coli
tgcgactgctgcctctcaaggataa

SEQ ID NO: 122020 - DNA, 25 bp, E. coli
tgcgactgctgcgtctcaaggataa

SEQ ID NO: 122021 - DNA, 25 bp, E. coli
tctggtgatcaaaagggacgaactg

SEQ ID NO: 122022 - DNA, 25 bp, E. coli
tctggtgatcaatagggacgaactg

SEQ ID NO: 122023 - DNA, 25 bp, E. coli
gaagatacgccggtttccacgatgg

SEQ ID NO: 122024 - DNA, 25 bp, E. coli
gaagatacgccgctttccacgatgg

SEQ ID NO: 122025 - DNA, 25 bp, E. coli
ggaaggcacggcttccctgaatgtg

SEQ ID NO: 122026 - DNA, 25 bp, E. coli
ggaaggcacggcatccctgaatgtg

SEQ ID NO: 122027 - DNA, 25 bp, E. coli
gagaaggacgtactggcaaaacaca

SEQ ID NO: 122028 - DNA, 25 bp, E. coli
gagaaggacgtagtggcaaaacaca

SEQ ID NO: 122029 - DNA, 25 bp, E. coli
catcaatttcgcattcgtgcactca

SEQ ID NO: 122030 - DNA, 25 bp, E. coli
catcaatttcgctttcgtgcactca

SEQ ID NO: 122031 - DNA, 25 bp, E. coli
tacgcactaatcaatgcggcgcaag

SEQ ID NO: 122032 - DNA, 25 bp, E. coli
agtgagcgaacgtttcatcaatttc

SEQ ID NO: 122033 - DNA, 25 bp, E. coli
agtgagcgaacgattcatcaatttc

SEQ ID NO: 122034 - DNA, 25 bp, E. coli
tacgcactaatctatgcggcgcaag

SEQ ID NO: 122035 - DNA, 25 bp, E. coli
ttacctggtaaatagtgagcgaacg

SEQ ID NO: 122036 - DNA, 25 bp, E. coli
ttacctggtaaaaagtgagcgaacg

SEQ ID NO: 122037 - DNA, 25 bp, E. coli
ccagtgacgctatcatacgcactaa

SEQ ID NO: 122038 - DNA, 25 bp, E. coli
ccagtgacgctaacatacgcactaa

SEQ ID NO: 122039 - DNA, 25 bp, E. coli
gcggcgcaagactgcgaaattgtct

SEQ ID NO: 122040 - DNA, 25 bp, E. coli
gctacaatcccataaatttacctgg

SEQ ID NO: 122041 - DNA, 25 bp, E. coli
gctacaatcccaaaaatttacctgg

SEQ ID NO: 122042 - DNA, 25 bp, E. coli
gcggcgcaagacagcgaaattgtct

SEQ ID NO: 122043 - DNA, 25 bp, E. coli
cgtgcactcattattaacgttttga

SEQ ID NO: 122044 - DNA, 25 bp, E. coli
cgtgcactcatttttaacgttttga

SEQ ID NO: 122045 - DNA, 25 bp, E. coli
ggtaagagcgcaactccagtgacgc

SEQ ID NO: 122046 - DNA, 25 bp, E. coli
ggtaagagcgcatctccagtgacgc

SEQ ID NO: 122047 - DNA, 25 bp, E. coli
taatggctataagggtaagagcgca

SEQ ID NO: 122048 - DNA, 25 bp, E. coli
taatcatgatgatttcccgggaata

SEQ ID NO: 122049 - DNA, 25 bp, E. coli
taatggctataacggtaagagcgca

SEQ ID NO: 122050 - DNA, 25 bp, E. coli
taatcatgatgaattcccgggaata

SEQ ID NO: 122051 - DNA, 25 bp, E. coli
cactctgtgcgacaagctggaacgt

SEQ ID NO: 122052 - DNA, 25 bp, E. coli
cactctgtgcgagaagctggaacgt

SEQ ID NO: 122053 - DNA, 25 bp, E. coli
cagggaatgcagcttgaagcgctca

SEQ ID NO: 122054 - DNA, 25 bp, E. coli
cagggaatgcaggttgaagcgctca

SEQ ID NO: 122055 - DNA, 25 bp, E. coli
agacacgctttaccccggcatgatg

SEQ ID NO: 122056 - DNA, 25 bp, E. coli
agacacgctttagcccggcatgatg

SEQ ID NO: 122057 - DNA, 25 bp, E. coli
acacgctcgttcgttgggcattccg

SEQ ID NO: 122058 - DNA, 25 bp, E. coli
acacgctcgttccttgggcattccg

SEQ ID NO: 122059 - DNA, 25 bp, E. coli
tagcgcgcaggatctggaacgcagt

SEQ ID NO: 122060 - DNA, 25 bp, E. coli
tagcgcgcaggaactggaacgcagt

SEQ ID NO: 122061 - DNA, 25 bp, E. coli
tatcagacggccgattaagtgcggc

SEQ ID NO: 122062 - DNA, 25 bp, E. coli
tatcagacggcccattaagtgcggc

SEQ ID NO: 122063 - DNA, 25 bp, E. coli
tgtgacaacattcgcgaagcgcgtg

SEQ ID NO: 122064 - DNA, 25 bp, E. coli
tgtgacaacattggcgaagcgcgtg

SEQ ID NO: 122065 - DNA, 25 bp, E. coli
gctgctggaagtggccaatcgcgat

SEQ ID NO: 122066 - DNA, 25 bp, E. coli
gctgctggaagtcgccaatcgcgat

SEQ ID NO: 122067 - DNA, 25 bp, E. coli
tggcattctggcatcgcgtatcaaa

SEQ ID NO: 122068 - DNA, 25 bp, E. coli
tggcattctggcttcgcgtatcaaa

SEQ ID NO: 122069 - DNA, 25 bp, E. coli
taagtgcggcagagatgaccatgga

SEQ ID NO: 122070 - DNA, 25 bp, E. coli
taagtgcggcagtgatgaccatgga

SEQ ID NO: 122071 - DNA, 25 bp, E. coli
gatgcactaaaccaaacacgtaaag

SEQ ID NO: 122072 - DNA, 25 bp, E. coli
gatgcactaaacgaaacacgtaaag

SEQ ID NO: 122073 - DNA, 25 bp, E. coli
catgccgctttattaaatgaaaagg

SEQ ID NO: 122074 - DNA, 25 bp, E. coli
catgccgctttaataaatgaaaagg

SEQ ID NO: 122075 - DNA, 25 bp, E. coli
taaatgaaaagggaatgatgtgttg

SEQ ID NO: 122076 - DNA, 25 bp, E. coli
taaatgaaaaggcaatgatgtgttg

SEQ ID NO: 122077 - DNA, 25 bp, E. coli
tatattccttatatttgccgtcagg

SEQ ID NO: 122078 - DNA, 25 bp, E. coli
tatattccttatttttgccgtcagg

SEQ ID NO: 122079 - DNA, 25 bp, E. coli
tgttcactttgtttcatgccgcttt

SEQ ID NO: 122080 - DNA, 25 bp, E. coli
tgttcactttgtatcatgccgcttt

SEQ ID NO: 122081 - DNA, 25 bp, E. coli
tcttataacaaagtaatgtaccggt

SEQ ID NO: 122082 - DNA, 25 bp, E. coli
tctgaagcggtatggtggcaatgta

SEQ ID NO: 122083 - DNA, 25 bp, E. coli
tcttataacaaactaatgtaccggt

SEQ ID NO: 122084 - DNA, 25 bp, E. coli
tctgaagcggtaaggtggcaatgta

SEQ ID NO: 122085 - DNA, 25 bp, E. coli
gccgtcaggaatacacaaggcgtat

SEQ ID NO: 122086 - DNA, 25 bp, E. coli
ccacgttgttttgaattatatatca

SEQ ID NO: 122087 - DNA, 25 bp, E. coli
gccgtcaggaattcacaaggcgtat

SEQ ID NO: 122088 - DNA, 25 bp, E. coli
ccacgttgttttcaattatatatca

SEQ ID NO: 122089 - DNA, 25 bp, E. coli
tgtgttgtaagaaaccaaagcaatc

SEQ ID NO: 122090 - DNA, 25 bp, E. coli
ggtggcaatgtaaatcgaaatcatg

SEQ ID NO: 122091 - DNA, 25 bp, E. coli
ggtggcaatgtatatcgaaatcatg

SEQ ID NO: 122092 - DNA, 25 bp, E. coli
tgtgttgtaagataccaaagcaatc

SEQ ID NO: 122093 - DNA, 25 bp, E. coli
taatgtaccggtagtctgaagcggt

SEQ ID NO: 122094 - DNA, 25 bp, E. coli
taatgtaccggttgtctgaagcggt

SEQ ID NO: 122095 - DNA, 25 bp, E. coli
aagcgggctccagtgacattgtcga

SEQ ID NO: 122096 - DNA, 25 bp, E. coli
aagcgggctccactgacattgtcga

SEQ ID NO: 122097 - DNA, 25 bp, E. coli
tgtatcctgtaagcctgcaacgctg

SEQ ID NO: 122098 - DNA, 25 bp, E. coli
tgtatcctgtaaccctgcaacgctg

SEQ ID NO: 122099 - DNA, 25 bp, E. coli
tacgccggttaagcgatagcccgga

SEQ ID NO: 122100 - DNA, 25 bp, E. coli
tacgccggttaaccgatagcccgga

SEQ ID NO: 122101 - DNA, 25 bp, E. coli
tgctggatatgtacccacacacggg

SEQ ID NO: 122102 - DNA, 25 bp, E. coli
tgctggatatgttcccacacacggg

SEQ ID NO: 122103 - DNA, 25 bp, E. coli
gcttttcgcattgtgaaggcctgga

SEQ ID NO: 122104 - DNA, 25 bp, E. coli
gcttttcgcattctgaaggcctgga

SEQ ID NO: 122105 - DNA, 25 bp, E. coli
gaatcgatggtagttttctcgcgcg

SEQ ID NO: 122106 - DNA, 25 bp, E. coli
gaagatgtcacaaagcagccgtggg

SEQ ID NO: 122107 - DNA, 25 bp, E. coli
gaagatgtcacatagcagccgtggg

SEQ ID NO: 122108 - DNA, 25 bp, E. coli
gaatcgatggtacttttctcgcgcg

SEQ ID NO: 122109 - DNA, 25 bp, E. coli
gaaaccgtctctcgtgagatgccct

SEQ ID NO: 122110 - DNA, 25 bp, E. coli
gaaaccgtctctggtgagatgccct

SEQ ID NO: 122111 - DNA, 25 bp, E. coli
gataaaaaacagaatgcccgcgcta

SEQ ID NO: 122112 - DNA, 25 bp, E. coli
gataaaaaacagtatgcccgcgcta

SEQ ID NO: 122113 - DNA, 25 bp, E. coli
ggatataccattgcgcgactggcga

SEQ ID NO: 122114 - DNA, 25 bp, E. coli
ggatataccattccgcgactggcga

SEQ ID NO: 122115 - DNA, 25 bp, E. coli
tggaaaaaggcctgcagaatgcgcg

SEQ ID NO: 122116 - DNA, 25 bp, E. coli
tggaaaaaggccagcagaatgcgcg

SEQ ID NO: 122117 - DNA, 25 bp, E. coli
caatgcatcagtattaatcgccgcg

SEQ ID NO: 122118 - DNA, 25 bp, E. coli
caatgcatcagttttaatcgccgcg

SEQ ID NO: 122119 - DNA, 25 bp, E. coli
catattgattgaagcctaccaggcg

SEQ ID NO: 122120 - DNA, 25 bp, E. coli
catattgattgatgcctaccaggcg

SEQ ID NO: 122121 - DNA, 25 bp, E. coli
aaacgttatggtcttcaggctcgcg

SEQ ID NO: 122122 - DNA, 25 bp, E. coli
aaacgttatggtgttcaggctcgcg

SEQ ID NO: 122123 - DNA, 25 bp, E. coli
ttcaacgtcgaacaaaaccggcacg

SEQ ID NO: 122124 - DNA, 25 bp, E. coli
ttcaacgtcgaagaaaaccggcacg

SEQ ID NO: 122125 - DNA, 25 bp, E. coli
tattcaattagtgggccacaggacg

SEQ ID NO: 122126 - DNA, 25 bp, E. coli
tattcaattagtcggccacaggacg

SEQ ID NO: 122127 - DNA, 25 bp, E. coli
ttactggcgcgttaaccggttctgc

SEQ ID NO: 122128 - DNA, 25 bp, E. coli
ttactggcgcgtaaaccggttctgc

SEQ ID NO: 122129 - DNA, 25 bp, E. coli
tgcggcatcgggaacaacagaagcg

SEQ ID NO: 122130 - DNA, 25 bp, E. coli
tgcggcatcgggtacaacagaagcg

SEQ ID NO: 122131 - DNA, 25 bp, E. coli
gaagcgtgcgacattctgggaaaac

SEQ ID NO: 122132 - DNA, 25 bp, E. coli
gaagcgtgcgactttctgggaaaac

SEQ ID NO: 122133 - DNA, 25 bp, E. coli
cattcttggctgagtcgtggcaacc

SEQ ID NO: 122134 - DNA, 25 bp, E. coli
cattcttggctgtgtcgtggcaacc

SEQ ID NO: 122135 - DNA, 25 bp, E. coli
gattaattgggaaccactgggtgca

SEQ ID NO: 122136 - DNA, 25 bp, E. coli
gattaattgggatccactgggtgca

SEQ ID NO: 122137 - DNA, 25 bp, E. coli
tggtgaatccgcaatgtgggccgca

SEQ ID NO: 122138 - DNA, 25 bp, E. coli
tggtgaatccgctatgtgggccgca

SEQ ID NO: 122139 - DNA, 25 bp, E. coli
caccgaagcgggtctgcttggcaaa

SEQ ID NO: 122140 - DNA, 25 bp, E. coli
caccgaagcgggactgcttggcaaa

SEQ ID NO: 122141 - DNA, 25 bp, E. coli
attgccgaagcctccgaagcgggtc

SEQ ID NO: 122142 - DNA, 25 bp, E. coli
agccaccgaagccggtctgcttggc

SEQ ID NO: 122143 - DNA, 25 bp, E. coli
agccaccgaagcgggtctgcttggc

SEQ ID NO: 122144 - DNA, 25 bp, E. coli
attgccgaagccaccgaagcgggtc

SEQ ID NO: 122145 - DNA, 25 bp, E. coli
ttgccgaagccagcgaagcgggtct

SEQ ID NO: 122146 - DNA, 25 bp, E. coli
ttgccgaagccaccgaagcgggtct

SEQ ID NO: 122147 - DNA, 25 bp, E. coli
tgccattgccgatgccaccgaagcg

SEQ ID NO: 122148 - DNA, 25 bp, E. coli
tgccattgccgaagccaccgaagcg

SEQ ID NO: 122149 - DNA, 25 bp, E. coli
gccaccgaagcgggtctgcttggca

SEQ ID NO: 122150 - DNA, 25 bp, E. coli
ccaccgaagcgggtctgcttggcaa

SEQ ID NO: 122151 - DNA, 25 bp, E. coli
gccaccgaagcgcgtctgcttggca

SEQ ID NO: 122152 - DNA, 25 bp, E. coli
ccaccgaagcggctctgcttggcaa

SEQ ID NO: 122153 - DNA, 25 bp, E. coli
gaagccaccgaaccgggtctgcttg

SEQ ID NO: 122154 - DNA, 25 bp, E. coli
gaagccaccgaagcgggtctgcttg

SEQ ID NO: 122155 - DNA, 25 bp, E. coli
ccgaagccaccgtagcgggtctgct

SEQ ID NO: 122156 - DNA, 25 bp, E. coli
ccgaagccaccgaagcgggtctgct

SEQ ID NO: 122157 - DNA, 25 bp, E. coli
cgaagccaccgaagcgggtctgctt

SEQ ID NO: 122158 - DNA, 25 bp, E. coli
cgaagccaccgatgcgggtctgctt

SEQ ID NO: 122159 - DNA, 25 bp, E. coli
gtgccattgccgaagccaccgaagc

SEQ ID NO: 122160 - DNA, 25 bp, E. coli
gtgccattgccgtagccaccgaagc

SEQ ID NO: 122161 - DNA, 25 bp, E. coli
catcgacccgcctcttttttaatcg

SEQ ID NO: 122162 - DNA, 25 bp, E. coli
caggcgtagcacgtcagacggtgta

SEQ ID NO: 122163 - DNA, 25 bp, E. coli
caggagtcgaataggcctgacaggc

SEQ ID NO: 122164 - DNA, 25 bp, E. coli
caggagtcgaattggcctgacaggc

SEQ ID NO: 122165 - DNA, 25 bp, E. coli
catcgacccgccacttttttaatcg

SEQ ID NO: 122166 - DNA, 25 bp, E. coli
catattggattgtgcgaaaaagagt

SEQ ID NO: 122167 - DNA, 25 bp, E. coli
caggcgtagcacctcagacggtgta

SEQ ID NO: 122168 - DNA, 25 bp, E. coli
catattggattgagcgaaaaagagt

SEQ ID NO: 122169 - DNA, 25 bp, E. coli
agacggtgtaacgtttgtcatcgac

SEQ ID NO: 122170 - DNA, 25 bp, E. coli
agacggtgtaacctttgtcatcgac

SEQ ID NO: 122171 - DNA, 25 bp, E. coli
tagataaccagcattcggagtcaac

SEQ ID NO: 122172 - DNA, 25 bp, E. coli
tagataaccagctttcggagtcaac

SEQ ID NO: 122173 - DNA, 25 bp, E. coli
ttttaatcgcttgccgcctgttaca

SEQ ID NO: 122174 - DNA, 25 bp, E. coli
ttttaatcgcttcccgcctgttaca

SEQ ID NO: 122175 - DNA, 25 bp, E. coli
gccttattcgacgtataaaactatg

SEQ ID NO: 122176 - DNA, 25 bp, E. coli
gcctgttacactggatagataacca

SEQ ID NO: 122177 - DNA, 25 bp, E. coli
gccttattcgacctataaaactatg

SEQ ID NO: 122178 - DNA, 25 bp, E. coli
gcctgttacactcgatagataacca

SEQ ID NO: 122179 - DNA, 25 bp, E. coli
tcaatacattgcaggagtcgaatag

SEQ ID NO: 122180 - DNA, 25 bp, E. coli
tcaatacattgctggagtcgaatag

SEQ ID NO: 122181 - DNA, 25 bp, E. coli
gagtaatttgttcacgccggatgcg

SEQ ID NO: 122182 - DNA, 25 bp, E. coli
gagtaatttgttgacgccggatgcg

SEQ ID NO: 122183 - DNA, 25 bp, E. coli
cacggagctgaatgccgggatcatc

SEQ ID NO: 122184 - DNA, 25 bp, E. coli
cacggagctgaaagccgggatcatc

SEQ ID NO: 122185 - DNA, 25 bp, E. coli
accagcgaaggaaagattacgccgc

SEQ ID NO: 122186 - DNA, 25 bp, E. coli
accagcgaaggatagattacgccgc

SEQ ID NO: 122187 - DNA, 25 bp, E. coli
actggcgttgcttcaagcccacggg

SEQ ID NO: 122188 - DNA, 25 bp, E. coli
actaaccacctttattccgcaattg

SEQ ID NO: 122189 - DNA, 25 bp, E. coli
actggcgttgctacaagcccacggg

SEQ ID NO: 122190 - DNA, 25 bp, E. coli
actaaccaccttaattccgcaattg

SEQ ID NO: 122191 - DNA, 25 bp, E. coli
tatgcttgatgtaatgcgcgagacg

SEQ ID NO: 122192 - DNA, 25 bp, E. coli
tatgcttgatgttatgcgcgagacg

SEQ ID NO: 122193 - DNA, 25 bp, E. coli
tattgcgatgctacatgcgctacgc

SEQ ID NO: 122194 - DNA, 25 bp, E. coli
tattgcgatgcttcatgcgctacgc

SEQ ID NO: 122195 - DNA, 25 bp, E. coli
gctggagcaactggcgttgctacaa

SEQ ID NO: 122196 - DNA, 25 bp, E. coli
gctggagcaactcgcgttgctacaa

SEQ ID NO: 122197 - DNA, 25 bp, E. coli
gatcatcgcggacatcggcaccagc

SEQ ID NO: 122198 - DNA, 25 bp, E. coli
gatcatcgcggagatcggcaccagc

SEQ ID NO: 122199 - DNA, 25 bp, E. coli
gggatcatcgcggagatcggcacca

SEQ ID NO: 122200 - DNA, 25 bp, E. coli
gggatcatcgcgcagatcggcacca

SEQ ID NO: 122201 - DNA, 25 bp, E. coli
ggctatgactatatactaaccacct

SEQ ID NO: 122202 - DNA, 25 bp, E. coli
ggcaccagcgaacgaaagattacgc

SEQ ID NO: 122203 - DNA, 25 bp, E. coli
ggctatgactatttactaaccacct

SEQ ID NO: 122204 - DNA, 25 bp, E. coli
ggcaccagcgaaggaaagattacgc

SEQ ID NO: 122205 - DNA, 25 bp, E. coli
caaatcgtattctagcgacctgagc

SEQ ID NO: 122206 - DNA, 25 bp, E. coli
caaatcgtattcaagcgacctgagc

SEQ ID NO: 122207 - DNA, 25 bp, E. coli
atccgggagcacagccagcgagatg

SEQ ID NO: 122208 - DNA, 25 bp, E. coli
atccgggagcactgccagcgagatg

SEQ ID NO: 122209 - DNA, 25 bp, E. coli
tattcatgaaaaccggcacagcaac

SEQ ID NO: 122210 - DNA, 25 bp, E. coli
tattcatgaaaagcggcacagcaac

SEQ ID NO: 122211 - DNA, 25 bp, E. coli
tttcagaagggatctgcacaaatcg

SEQ ID NO: 122212 - DNA, 25 bp, E. coli
tttcagaagggaactgcacaaatcg

SEQ ID NO: 122213 - DNA, 25 bp, E. coli
tgttcccgacaaccgcgctgacgtt

SEQ ID NO: 122214 - DNA, 25 bp, E. coli
tgttcccgacaagcgcgctgacgtt

SEQ ID NO: 122215 - DNA, 25 bp, E. coli
tgacgttacccgacggctgggagac

SEQ ID NO: 122216 - DNA, 25 bp, E. coli
tgatgatccttgtcgggaagcctgt

SEQ ID NO: 122217 - DNA, 25 bp, E. coli
tgacgttacccgtcggctgggagac

SEQ ID NO: 122218 - DNA, 25 bp, E. coli
tgatgatccttgacgggaagcctgt

SEQ ID NO: 122219 - DNA, 25 bp, E. coli
tcggctgggagaccatattcatgaa

SEQ ID NO: 122220 - DNA, 25 bp, E. coli
tcggctgggagagcatattcatgaa

SEQ ID NO: 122221 - DNA, 25 bp, E. coli
cgacctgagctgattgataagctga

SEQ ID NO: 122222 - DNA, 25 bp, E. coli
cgacctgagctgtttgataagctga

SEQ ID NO: 122223 - DNA, 25 bp, E. coli
gataagctgaacaacatcatcgccc

SEQ ID NO: 122224 - DNA, 25 bp, E. coli
gataagctgaactacatcatcgccc

SEQ ID NO: 122225 - DNA, 25 bp, E. coli
ggcacagcaaccactatgaggatga

SEQ ID NO: 122226 - DNA, 25 bp, E. coli
ggcacagcaacctctatgaggatga

SEQ ID NO: 122227 - DNA, 25 bp, E. coli
tactgaacaagaatgacctgccggc

SEQ ID NO: 122228 - DNA, 25 bp, E. coli
tactgaacaagattgacctgccggc

SEQ ID NO: 122229 - DNA, 25 bp, E. coli
aaaacgcggcgtccagaccaatatg

SEQ ID NO: 122230 - DNA, 25 bp, E. coli
aaaacgcggcgtgcagaccaatatg

SEQ ID NO: 122231 - DNA, 25 bp, E. coli
tgagtaccgggctgacctataacgc

SEQ ID NO: 122232 - DNA, 25 bp, E. coli
tgagtaccgggcagacctataacgc

SEQ ID NO: 122233 - DNA, 25 bp, E. coli
tgacgtacgagatcccgatggcgga

SEQ ID NO: 122234 - DNA, 25 bp, E. coli
tgacgtacgagaacccgatggcgga

SEQ ID NO: 122235 - DNA, 25 bp, E. coli
tccatggatcttcagcgtgagcgtg

SEQ ID NO: 122236 - DNA, 25 bp, E. coli
tccatggatcttgagcgtgagcgtg

SEQ ID NO: 122237 - DNA, 25 bp, E. coli
gaagttatctacctcgacagcccat

SEQ ID NO: 122238 - DNA, 25 bp, E. coli
gaagttatctacgtcgacagcccat

SEQ ID NO: 122239 - DNA, 25 bp, E. coli
cgtattatccagatctgcggtggcc

SEQ ID NO: 122240 - DNA, 25 bp, E. coli
cgtattatccagttctgcggtggcc

SEQ ID NO: 122241 - DNA, 25 bp, E. coli
gattaaagatatgcacggcgctcca

SEQ ID NO: 122242 - DNA, 25 bp, E. coli
gataattcgcaataccgcggtcgcg

SEQ ID NO: 122243 - DNA, 25 bp, E. coli
gataattcgcaaaaccgcggtcgcg

SEQ ID NO: 122244 - DNA, 25 bp, E. coli
gattaaagatatccacggcgctcca

SEQ ID NO: 122245 - DNA, 25 bp, E. coli
ggcgataccttatcgctggcgcgta

SEQ ID NO: 122246 - DNA, 25 bp, E. coli
ggcgataccttaacgctggcgcgta

SEQ ID NO: 122247 - DNA, 25 bp, E. coli
gatccaccgtgatacagctgcgtaa

SEQ ID NO: 122248 - DNA, 25 bp, E. coli
gatccaccgtgaaacagctgcgtaa

SEQ ID NO: 122249 - DNA, 25 bp, E. coli
aatgaatgaattgaccgatgccacg

SEQ ID NO: 122250 - DNA, 25 bp, E. coli
aatgaatgaattcaccgatgccacg

SEQ ID NO: 122251 - DNA, 25 bp, E. coli
cagatacacaggttaacaaccacca

SEQ ID NO: 122252 - DNA, 25 bp, E. coli
cagatacacaggataacaaccacca

SEQ ID NO: 122253 - DNA, 25 bp, E. coli
tacttttcacataagttgccctggc

SEQ ID NO: 122254 - DNA, 25 bp, E. coli
tacttttcacattagttgccctggc

SEQ ID NO: 122255 - DNA, 25 bp, E. coli
tgtttaccccttatacttttcgctg

SEQ ID NO: 122256 - DNA, 25 bp, E. coli
tgtttaccccttttacttttcgctg

SEQ ID NO: 122257 - DNA, 25 bp, E. coli
tttcgctgataacccagatacacag

SEQ ID NO: 122258 - DNA, 25 bp, E. coli
tttcgctgataagccagatacacag

SEQ ID NO: 122259 - DNA, 25 bp, E. coli
tgttcaatgcgaagcaaggctagct

SEQ ID NO: 122260 - DNA, 25 bp, E. coli
tgttcaatgcgatgcaaggctagct

SEQ ID NO: 122261 - DNA, 25 bp, E. coli
tgcccaggcaagtataagtcaaatg

SEQ ID NO: 122262 - DNA, 25 bp, E. coli
tgcccaggcaagaataagtcaaatg

SEQ ID NO: 122263 - DNA, 25 bp, E. coli
tgccctggcaagaaattagttgcag

SEQ ID NO: 122264 - DNA, 25 bp, E. coli
tgccctggcaagtaattagttgcag

SEQ ID NO: 122265 - DNA, 25 bp, E. coli
gccacgttttgctaaatcggttcaa

SEQ ID NO: 122266 - DNA, 25 bp, E. coli
gccacgttttgcaaaatcggttcaa

SEQ ID NO: 122267 - DNA, 25 bp, E. coli
gcaaggctagcttaagagtgacact

SEQ ID NO: 122268 - DNA, 25 bp, E. coli
gcaaggctagctaaagagtgacact

SEQ ID NO: 122269 - DNA, 25 bp, E. coli
gagtgacactttatccttgtttacc

SEQ ID NO: 122270 - DNA, 25 bp, E. coli
gagtgacactttttccttgtttacc

SEQ ID NO: 122271 - DNA, 25 bp, E. coli
acttttttacgctgtggccgatgga

SEQ ID NO: 122272 - DNA, 25 bp, E. coli
cgtttgacgggctcttcgctgactt

SEQ ID NO: 122273 - DNA, 25 bp, E. coli
acttttttacgcagtggccgatgga

SEQ ID NO: 122274 - DNA, 25 bp, E. coli
aatcaaccgtttgacgggcacttcg

SEQ ID NO: 122275 - DNA, 25 bp, E. coli
cgtttgacgggcacttcgctgactt

SEQ ID NO: 122276 - DNA, 25 bp, E. coli
aatcaaccgtttcacgggcacttcg

SEQ ID NO: 122277 - DNA, 25 bp, E. coli
actggcgtcaacctgctcctgaatc

SEQ ID NO: 122278 - DNA, 25 bp, E. coli
actggcgtcaacgtgctcctgaatc

SEQ ID NO: 122279 - DNA, 25 bp, E. coli
tacgctgtggccgatggacaatggt

SEQ ID NO: 122280 - DNA, 25 bp, E. coli
tacgctgtggcccatggacaatggt

SEQ ID NO: 122281 - DNA, 25 bp, E. coli
tgacgggcacttggctgactttttt

SEQ ID NO: 122282 - DNA, 25 bp, E. coli
tgctcctgaatcaaccgtttgacgg

SEQ ID NO: 122283 - DNA, 25 bp, E. coli
tgacgggcacttcgctgactttttt

SEQ ID NO: 122284 - DNA, 25 bp, E. coli
tgctcctgaatctaccgtttgacgg

SEQ ID NO: 122285 - DNA, 25 bp, E. coli
tcgctgacttttatacgctgtggcc

SEQ ID NO: 122286 - DNA, 25 bp, E. coli
tcgctgacttttttacgctgtggcc

SEQ ID NO: 122287 - DNA, 25 bp, E. coli
gccgatggacaatggtgtcctgctt

SEQ ID NO: 122288 - DNA, 25 bp, E. coli
gccgatggacaaaggtgtcctgctt

SEQ ID NO: 122289 - DNA, 25 bp, E. coli
ctgtggccgatgcacaatggtgtcc

SEQ ID NO: 122290 - DNA, 25 bp, E. coli
ctgtggccgatggacaatggtgtcc

SEQ ID NO: 122291 - DNA, 25 bp, E. coli
gtgactggcgtctacctgctcctga

SEQ ID NO: 122292 - DNA, 25 bp, E. coli
gtgactggcgtcaacctgctcctga

SEQ ID NO: 122293 - DNA, 25 bp, E. coli
caggatcttgttccctgtggagata

SEQ ID NO: 122294 - DNA, 25 bp, E. coli
caggatcttgttgcctgtggagata

SEQ ID NO: 122295 - DNA, 25 bp, E. coli
atatgaccattgaccggcgtgtcgg

SEQ ID NO: 122296 - DNA, 25 bp, E. coli
atatgaccattgtccggcgtgtcgg

SEQ ID NO: 122297 - DNA, 25 bp, E. coli
tgtggagatatgaccattgtccggc

SEQ ID NO: 122298 - DNA, 25 bp, E. coli
tgtggagatatgtccattgtccggc

SEQ ID NO: 122299 - DNA, 25 bp, E. coli
tgcctgtggagatatgaccattgtc

SEQ ID NO: 122300 - DNA, 25 bp, E. coli
tgcctgtggagaaatgaccattgtc

SEQ ID NO: 122301 - DNA, 25 bp, E. coli
tcaggatcttgttgcctgtggagat

SEQ ID NO: 122302 - DNA, 25 bp, E. coli
tcttgttgcctgaggagatatgacc

SEQ ID NO: 122303 - DNA, 25 bp, E. coli
tcaggatcttgtagcctgtggagat

SEQ ID NO: 122304 - DNA, 25 bp, E. coli
tcttgttgcctgtggagatatgacc

SEQ ID NO: 122305 - DNA, 25 bp, E. coli
cttgttgcctgtcgagatatgacca

SEQ ID NO: 122306 - DNA, 25 bp, E. coli
cttgttgcctgtggagatatgacca

SEQ ID NO: 122307 - DNA, 25 bp, E. coli
gatatgaccattctccggcgtgtcg

SEQ ID NO: 122308 - DNA, 25 bp, E. coli
gatatgaccattgtccggcgtgtcg

SEQ ID NO: 122309 - DNA, 25 bp, E. coli
tggagatatgaccattgtccggcgt

SEQ ID NO: 122310 - DNA, 25 bp, E. coli
tggagatatgacgattgtccggcgt

SEQ ID NO: 122311 - DNA, 25 bp, E. coli
gagatatgaccattgtccggcgtgt

SEQ ID NO: 122312 - DNA, 25 bp, E. coli
gttgcctgtggacatatgaccattg

SEQ ID NO: 122313 - DNA, 25 bp, E. coli
gagatatgaccaatgtccggcgtgt

SEQ ID NO: 122314 - DNA, 25 bp, E. coli
gttgcctgtggagatatgaccattg

SEQ ID NO: 122315 - DNA, 25 bp, E. coli
cactattaccaatgatcgactgctg

SEQ ID NO: 122316 - DNA, 25 bp, E. coli
caaagatcgactcctgacaatccag

SEQ ID NO: 122317 - DNA, 25 bp, E. coli
cagcattggcgccaaacatacggac

SEQ ID NO: 122318 - DNA, 25 bp, E. coli
cactattaccaaagatcgactgctg

SEQ ID NO: 122319 - DNA, 25 bp, E. coli
caaagatcgactgctgacaatccag

SEQ ID NO: 122320 - DNA, 25 bp, E. coli
cagcattggcgcgaaacatacggac

SEQ ID NO: 122321 - DNA, 25 bp, E. coli
tacggaccgggttgcaacgttgtgc

SEQ ID NO: 122322 - DNA, 25 bp, E. coli
tacggaccgggtagcaacgttgtgc

SEQ ID NO: 122323 - DNA, 25 bp, E. coli
agcggaagagctggcacggattgcg

SEQ ID NO: 122324 - DNA, 25 bp, E. coli
agcggaagagctcgcacggattgcg

SEQ ID NO: 122325 - DNA, 25 bp, E. coli
ttggcgcgaaacatacggaccgggt

SEQ ID NO: 122326 - DNA, 25 bp, E. coli
ttggcgcgaaacttacggaccgggt

SEQ ID NO: 122327 - DNA, 25 bp, E. coli
tagcaacgttgtccttccagcagaa

SEQ ID NO: 122328 - DNA, 25 bp, E. coli
tagcaacgttgtgcttccagcagaa

SEQ ID NO: 122329 - DNA, 25 bp, E. coli
tgtgcttccagctgaagaagcggaa

SEQ ID NO: 122330 - DNA, 25 bp, E. coli
tgtgcttccagcagaagaagcggaa

SEQ ID NO: 122331 - DNA, 25 bp, E. coli
tccagcagaagaagcggaagagctg

SEQ ID NO: 122332 - DNA, 25 bp, E. coli
tccagcagaagatgcggaagagctg

SEQ ID NO: 122333 - DNA, 25 bp, E. coli
gctgacaatccagcattggcgcgaa

SEQ ID NO: 122334 - DNA, 25 bp, E. coli
gctgacaatccaccattggcgcgaa

SEQ ID NO: 122335 - DNA, 25 bp, E. coli
gaaacatacggaccgggtagcaacg

SEQ ID NO: 122336 - DNA, 25 bp, E. coli
gaaacatacggagcgggtagcaacg

SEQ ID NO: 122337 - DNA, 25 bp, E. coli
attattttacagtttgtgttcgctg

SEQ ID NO: 122338 - DNA, 25 bp, E. coli
attattttacagattgtgttcgctg

SEQ ID NO: 122339 - DNA, 25 bp, E. coli
atattattttacagattgtgttcgc

SEQ ID NO: 122340 - DNA, 25 bp, E. coli
atattattttactgattgtgttcgc

SEQ ID NO: 122341 - DNA, 25 bp, E. coli
aatcggggctgtatatattatttta

SEQ ID NO: 122342 - DNA, 25 bp, E. coli
aatcggggctgtttatattatttta

SEQ ID NO: 122343 - DNA, 25 bp, E. coli
tattattttacacattgtgttcgct

SEQ ID NO: 122344 - DNA, 25 bp, E. coli
tatattattttagagattgtgttcg

SEQ ID NO: 122345 - DNA, 25 bp, E. coli
tattattttacagattgtgttcgct

SEQ ID NO: 122346 - DNA, 25 bp, E. coli
tatattattttacagattgtgttcg

SEQ ID NO: 122347 - DNA, 25 bp, E. coli
ttgttatgcattccactgtaccagt

SEQ ID NO: 122348 - DNA, 25 bp, E. coli
ttgttatgcattgcactgtaccagt

SEQ ID NO: 122349 - DNA, 25 bp, E. coli
ttatgcattgcactgtaccagtaca

SEQ ID NO: 122350 - DNA, 25 bp, E. coli
ttatgcattgcagtgtaccagtaca

SEQ ID NO: 122351 - DNA, 25 bp, E. coli
tgttatgcattgcactgtaccagta

SEQ ID NO: 122352 - DNA, 25 bp, E. coli
tgttatgcattggactgtaccagta

SEQ ID NO: 122353 - DNA, 25 bp, E. coli
gttgttatgcatagcactgtaccag

SEQ ID NO: 122354 - DNA, 25 bp, E. coli
gttgttatgcattgcactgtaccag

SEQ ID NO: 122355 - DNA, 25 bp, E. coli
gattgtgttcgctgttcagcgatga

SEQ ID NO: 122356 - DNA, 25 bp, E. coli
gttatgcattgctctgtaccagtac

SEQ ID NO: 122357 - DNA, 25 bp, E. coli
gattgtgttcgcagttcagcgatga

SEQ ID NO: 122358 - DNA, 25 bp, E. coli
gttatgcattgcactgtaccagtac

SEQ ID NO: 122359 - DNA, 25 bp, E. coli
caattgtcgttgtccttcgtcagca

SEQ ID NO: 122360 - DNA, 25 bp, E. coli
caataaagtcgatctgttgccagaa

SEQ ID NO: 122361 - DNA, 25 bp, E. coli
caattgtcgttgaccttcgtcagca

SEQ ID NO: 122362 - DNA, 25 bp, E. coli
caataaagtcgaactgttgccagaa

SEQ ID NO: 122363 - DNA, 25 bp, E. coli
aacaagaggtgtttgatctcatccg

SEQ ID NO: 122364 - DNA, 25 bp, E. coli
aactcaggatgtacgtaacggtcag

SEQ ID NO: 122365 - DNA, 25 bp, E. coli
aacaagaggtgtatgatctcatccg

SEQ ID NO: 122366 - DNA, 25 bp, E. coli
aactcaggatgttcgtaacggtcag

SEQ ID NO: 122367 - DNA, 25 bp, E. coli
tgtttccggcgcatcacgcgggatt

SEQ ID NO: 122368 - DNA, 25 bp, E. coli
tgtttccggcgcttcacgcgggatt

SEQ ID NO: 122369 - DNA, 25 bp, E. coli
tgaaagcgttaacggccaggcaaca

SEQ ID NO: 122370 - DNA, 25 bp, E. coli
tgaagaacatctgaaggcgctggca

SEQ ID NO: 122371 - DNA, 25 bp, E. coli
tgaagaacatctcaaggcgctggca

SEQ ID NO: 122372 - DNA, 25 bp, E. coli
tgaaagcgttaagggccaggcaaca

SEQ ID NO: 122373 - DNA, 25 bp, E. coli
tctggcgcaacagcatattgaaggt

SEQ ID NO: 122374 - DNA, 25 bp, E. coli
tctggcgcaacaccatattgaaggt

SEQ ID NO: 122375 - DNA, 25 bp, E. coli
gctggcagtgcataaaactcaggat

SEQ ID NO: 122376 - DNA, 25 bp, E. coli
gctggcagtgcaaaaaactcaggat

SEQ ID NO: 122377 - DNA, 25 bp, E. coli
cgtgatcacatctgccagacaggta

SEQ ID NO: 122378 - DNA, 25 bp, E. coli
cgtgatcacatcagccagacaggta

SEQ ID NO: 122379 - DNA, 25 bp, E. coli
taacggtcaggtggttgtcgcacgt

SEQ ID NO: 122380 - DNA, 25 bp, E. coli
taacggtcaggtcgttgtcgcacgt

SEQ ID NO: 122381 - DNA, 25 bp, E. coli
caatgtcctgcgctgacgattccat

SEQ ID NO: 122382 - DNA, 25 bp, E. coli
aattgagcaggatctcatcgctcca

SEQ ID NO: 122383 - DNA, 25 bp, E. coli
caatgtcctgcggtgacgattccat

SEQ ID NO: 122384 - DNA, 25 bp, E. coli
caatattattcattatcaggcgcaa

SEQ ID NO: 122385 - DNA, 25 bp, E. coli
caatattattcaatatcaggcgcaa

SEQ ID NO: 122386 - DNA, 25 bp, E. coli
aattgagcaggaactcatcgctcca

SEQ ID NO: 122387 - DNA, 25 bp, E. coli
caaaatggtttaagaagcgcattcc

SEQ ID NO: 122388 - DNA, 25 bp, E. coli
caaaatggtttatgaagcgcattcc

SEQ ID NO: 122389 - DNA, 25 bp, E. coli
cagaaacggttgctgaacgtgccgc

SEQ ID NO: 122390 - DNA, 25 bp, E. coli
cagaaacggttggtgaacgtgccgc

SEQ ID NO: 122391 - DNA, 25 bp, E. coli
aaatcgtagccgatgtctggcggtg

SEQ ID NO: 122392 - DNA, 25 bp, E. coli
aaatcgtagccgttgtctggcggtg

SEQ ID NO: 122393 - DNA, 25 bp, E. coli
tcatcgctccagtaaatcgtagccg

SEQ ID NO: 122394 - DNA, 25 bp, E. coli
tcatcgctccagaaaatcgtagccg

SEQ ID NO: 122395 - DNA, 25 bp, E. coli
gcattccaccgaataccagactcag

SEQ ID NO: 122396 - DNA, 25 bp, E. coli
gcattccaccgattaccagactcag

SEQ ID NO: 122397 - DNA, 25 bp, E. coli
gaacgtgccgctgtgctttgtctgg

SEQ ID NO: 122398 - DNA, 25 bp, E. coli
gaacgtgccgctctgctttgtctgg

SEQ ID NO: 122399 - DNA, 25 bp, E. coli
cggcctatcgggaattagttcgcga

SEQ ID NO: 122400 - DNA, 25 bp, E. coli
cggcctatcgggtattagttcgcga

SEQ ID NO: 122401 - DNA, 25 bp, E. coli
gacgattccataccgttagcgccag

SEQ ID NO: 122402 - DNA, 25 bp, E. coli
gacgattccatagcgttagcgccag

SEQ ID NO: 122403 - DNA, 25 bp, E. coli
aatttgaccgtaagaaagcgctggc

SEQ ID NO: 122404 - DNA, 25 bp, E. coli
aatttgaccgtatgaaagcgctggc

SEQ ID NO: 122405 - DNA, 25 bp, E. coli
caaatttgaccgtaagaaagcgctg

SEQ ID NO: 122406 - DNA, 25 bp, E. coli
caaatttgaccgaaagaaagcgctg

SEQ ID NO: 122407 - DNA, 25 bp, E. coli
atttgaccgtaacaaagcgctggct

SEQ ID NO: 122408 - DNA, 25 bp, E. coli
atttgaccgtaagaaagcgctggct

SEQ ID NO: 122409 - DNA, 25 bp, E. coli
aaatttgaccgtaagaaagcgctgg

SEQ ID NO: 122410 - DNA, 25 bp, E. coli
acacaaatttgaccgtaagaaagcg

SEQ ID NO: 122411 - DNA, 25 bp, E. coli
acacaaatttgagcgtaagaaagcg

SEQ ID NO: 122412 - DNA, 25 bp, E. coli
aaatttgaccgttagaaagcgctgg

SEQ ID NO: 122413 - DNA, 25 bp, E. coli
acaaatttgaccgtaagaaagcgct

SEQ ID NO: 122414 - DNA, 25 bp, E. coli
acaaatttgaccctaagaaagcgct

SEQ ID NO: 122415 - DNA, 25 bp, E. coli
tttgaccgtaagtaagcgctggctt

SEQ ID NO: 122416 - DNA, 25 bp, E. coli
tttgaccgtaagaaagcgctggctt

SEQ ID NO: 122417 - DNA, 25 bp, E. coli
ttgaccgtaagaaagcgctggctta

SEQ ID NO: 122418 - DNA, 25 bp, E. coli
ttgaccgtaagatagcgctggctta

SEQ ID NO: 122419 - DNA, 25 bp, E. coli
tgaccgtaagaatgcgctggcttat

SEQ ID NO: 122420 - DNA, 25 bp, E. coli
tgaccgtaagaaagcgctggcttat

SEQ ID NO: 122421 - DNA, 25 bp, E. coli
ccgtaagaaagccctggcttatgag

SEQ ID NO: 122422 - DNA, 25 bp, E. coli
ccgtaagaaagcgctggcttatgag

SEQ ID NO: 122423 - DNA, 25 bp, E. coli
gaccgtaagaaagcgctggcttatg

SEQ ID NO: 122424 - DNA, 25 bp, E. coli
gaccgtaagaaaccgctggcttatg

SEQ ID NO: 122425 - DNA, 25 bp, E. coli
caatttttgcagatggctcccgcga

SEQ ID NO: 122426 - DNA, 25 bp, E. coli
caatttttgcagttggctcccgcga

SEQ ID NO: 122427 - DNA, 25 bp, E. coli
catcttcagttacaaggtgaccaca

SEQ ID NO: 122428 - DNA, 25 bp, E. coli
cagaaagtctctggtgagtgcaccg

SEQ ID NO: 122429 - DNA, 25 bp, E. coli
cagaaagtctctcgtgagtgcaccg

SEQ ID NO: 122430 - DNA, 25 bp, E. coli
catcttcagttagaaggtgaccaca

SEQ ID NO: 122431 - DNA, 25 bp, E. coli
tcgaactgcgagcactcatcttcag

SEQ ID NO: 122432 - DNA, 25 bp, E. coli
tcgaactgcgaggactcatcttcag

SEQ ID NO: 122433 - DNA, 25 bp, E. coli
tcagagcggtaactaagcggtatgc

SEQ ID NO: 122434 - DNA, 25 bp, E. coli
tcagagcggtaagtaagcggtatgc

SEQ ID NO: 122435 - DNA, 25 bp, E. coli
gccctgcggcttaaaggatgtgtca

SEQ ID NO: 122436 - DNA, 25 bp, E. coli
gccctgcggctttaaggatgtgtca

SEQ ID NO: 122437 - DNA, 25 bp, E. coli
gcggtatgcgcctttacttcagaaa

SEQ ID NO: 122438 - DNA, 25 bp, E. coli
gcggtatgcgccattacttcagaaa

SEQ ID NO: 122439 - DNA, 25 bp, E. coli
gacaggtaagagttatcagagcggt

SEQ ID NO: 122440 - DNA, 25 bp, E. coli
gaaactgtcagagccctgcggctta

SEQ ID NO: 122441 - DNA, 25 bp, E. coli
gaaactgtcagacccctgcggctta

SEQ ID NO: 122442 - DNA, 25 bp, E. coli
gacaggtaagagatatcagagcggt

SEQ ID NO: 122443 - DNA, 25 bp, E. coli
tcaacgatttcgtcatcgaactgcg

SEQ ID NO: 122444 - DNA, 25 bp, E. coli
tcaacgatttcgacatcgaactgcg

SEQ ID NO: 122445 - DNA, 25 bp, E. coli
gagtgcaccgaagatattgtcaacg

SEQ ID NO: 122446 - DNA, 25 bp, E. coli
gagtgcaccgaacatattgtcaacg

SEQ ID NO: 122447 - DNA, 25 bp, E. coli
tattgcgaacaacggaagtgtcagg

SEQ ID NO: 122448 - DNA, 25 bp, E. coli
tattgcgaacaagggaagtgtcagg

SEQ ID NO: 122449 - DNA, 25 bp, E. coli
ttattgctgcacttgttgaagagag

SEQ ID NO: 122450 - DNA, 25 bp, E. coli
ttattgctgcacatgttgaagagag

SEQ ID NO: 122451 - DNA, 25 bp, E. coli
tgtcgctaaataacatgacgatttc

SEQ ID NO: 122452 - DNA, 25 bp, E. coli
tgtcaggaaaggacaagagctacca

SEQ ID NO: 122453 - DNA, 25 bp, E. coli
tgtcgctaaatatcatgacgatttc

SEQ ID NO: 122454 - DNA, 25 bp, E. coli
tgtcaggaaaggtcaagagctacca

SEQ ID NO: 122455 - DNA, 25 bp, E. coli
gctctaaacagataagtgcagggtt

SEQ ID NO: 122456 - DNA, 25 bp, E. coli
gctctaaacagaaaagtgcagggtt

SEQ ID NO: 122457 - DNA, 25 bp, E. coli
ccgtgactaaacagaatattattgc

SEQ ID NO: 122458 - DNA, 25 bp, E. coli
ccgtgactaaactgaatattattgc

SEQ ID NO: 122459 - DNA, 25 bp, E. coli
ctatggttaatgattgcttgctgaa

SEQ ID NO: 122460 - DNA, 25 bp, E. coli
ctatggttaatgtttgcttgctgaa

SEQ ID NO: 122461 - DNA, 25 bp, E. coli
ggttccacaacatgtttattgctgc

SEQ ID NO: 122462 - DNA, 25 bp, E. coli
ggttccacaacaagtttattgctgc

SEQ ID NO: 122463 - DNA, 25 bp, E. coli
gggtttattaaacctgtccgacaga

SEQ ID NO: 122464 - DNA, 25 bp, E. coli
gggtttattaaagctgtccgacaga

SEQ ID NO: 122465 - DNA, 25 bp, E. coli
tgctgaaactaagaccgaattgctc

SEQ ID NO: 122466 - DNA, 25 bp, E. coli
tgctgaaactaacaccgaattgctc

SEQ ID NO: 122467 - DNA, 25 bp, E. coli
gagctaccaatgcttaatatggcta

SEQ ID NO: 122468 - DNA, 25 bp, E. coli
gagctaccaatggttaatatggcta

SEQ ID NO: 122469 - DNA, 25 bp, E. coli
aataatttccaatcgctaagccgca

SEQ ID NO: 122470 - DNA, 25 bp, E. coli
aataatttccaaacgctaagccgca

SEQ ID NO: 122471 - DNA, 25 bp, E. coli
agctgttgcaaaagggcgttataac

SEQ ID NO: 122472 - DNA, 25 bp, E. coli
agctgttgcaaatgggcgttataac

SEQ ID NO: 122473 - DNA, 25 bp, E. coli
tatcattagagtgacaactgggtga

SEQ ID NO: 122474 - DNA, 25 bp, E. coli
tatcattagagtcacaactgggtga

SEQ ID NO: 122475 - DNA, 25 bp, E. coli
ttaacgacctcaattccacgggatc

SEQ ID NO: 122476 - DNA, 25 bp, E. coli
ttaacgacctcatttccacgggatc

SEQ ID NO: 122477 - DNA, 25 bp, E. coli
tccacgggatctcgtggcgtttaaa

SEQ ID NO: 122478 - DNA, 25 bp, E. coli
tccacgggatctggtggcgtttaaa

SEQ ID NO: 122479 - DNA, 25 bp, E. coli
tcctgttacttgcatttggctgcca

SEQ ID NO: 122480 - DNA, 25 bp, E. coli
tcctgttacttggatttggctgcca

SEQ ID NO: 122481 - DNA, 25 bp, E. coli
tctgggcgggcaattggtataacca

SEQ ID NO: 122482 - DNA, 25 bp, E. coli
tctgggcgggcatttggtataacca

SEQ ID NO: 122483 - DNA, 25 bp, E. coli
gactcattagctgaatcgtgtaaga

SEQ ID NO: 122484 - DNA, 25 bp, E. coli
gactcattagctcaatcgtgtaaga

SEQ ID NO: 122485 - DNA, 25 bp, E. coli
cgctaagccgcagaaaagaacaaat

SEQ ID NO: 122486 - DNA, 25 bp, E. coli
cgctaagccgcacaaaagaacaaat

SEQ ID NO: 122487 - DNA, 25 bp, E. coli
ggctgccaggtcacatatgttgcaa

SEQ ID NO: 122488 - DNA, 25 bp, E. coli
ggctgccaggtctcatatgttgcaa

SEQ ID NO: 122489 - DNA, 25 bp, E. coli
taattacggcgactgattactacag

SEQ ID NO: 122490 - DNA, 25 bp, E. coli
taattacggcgagtgattactacag

SEQ ID NO: 122491 - DNA, 25 bp, E. coli
caagccggttcgctggatattcgca

SEQ ID NO: 122492 - DNA, 25 bp, E. coli
caagccggttcggtggatattcgca

SEQ ID NO: 122493 - DNA, 25 bp, E. coli
cataccttaaaagtggtgctgatcc

SEQ ID NO: 122494 - DNA, 25 bp, E. coli
cataccttaaaactggtgctgatcc

SEQ ID NO: 122495 - DNA, 25 bp, E. coli
taccgtgctttgtggtagtgcgacg

SEQ ID NO: 122496 - DNA, 25 bp, E. coli
taccgtgctttgaggtagtgcgacg

SEQ ID NO: 122497 - DNA, 25 bp, E. coli
ttccgtagtgctggaggccttctcc

SEQ ID NO: 122498 - DNA, 25 bp, E. coli
ttccgtagtgctcgaggccttctcc

SEQ ID NO: 122499 - DNA, 25 bp, E. coli
tgattatcgcgacggcattaagcct

SEQ ID NO: 122500 - DNA, 25 bp, E. coli
tgattatcgcgagggcattaagcct

SEQ ID NO: 122501 - DNA, 25 bp, E. coli
tctggttctgttgccgtgacacgcg

SEQ ID NO: 122502 - DNA, 25 bp, E. coli
tctggttctgttcccgtgacacgcg

SEQ ID NO: 122503 - DNA, 25 bp, E. coli
gccgtgcccggattgctgttattac

SEQ ID NO: 122504 - DNA, 25 bp, E. coli
gccgtgcccggaatgctgttattac

SEQ ID NO: 122505 - DNA, 25 bp, E. coli
cctttattggccagatgatgccgca

SEQ ID NO: 122506 - DNA, 25 bp, E. coli
cctttattggcctgatgatgccgca

SEQ ID NO: 122507 - DNA, 25 bp, E. coli
gaacaactggcgttggccttcgccg

SEQ ID NO: 122508 - DNA, 25 bp, E. coli
gaacaactggcgatggccttcgccg

SEQ ID NO: 122509 - DNA, 25 bp, E. coli
gggcgttaatgcaaaccctcacccg

SEQ ID NO: 122510 - DNA, 25 bp, E. coli
gggcgttaatgctaaccctcacccg

SEQ ID NO: 122511 - DNA, 25 bp, E. coli
ggcatcgccctggttaatcctgacg

SEQ ID NO: 122512 - DNA, 25 bp, E. coli
ggcatcgccctgcttaatcctgacg

SEQ ID NO: 122513 - DNA, 25 bp, E. coli
caccatgcgtgaagataacccgaaa

SEQ ID NO: 122514 - DNA, 25 bp, E. coli
caccatgcgtgatgataacccgaaa

SEQ ID NO: 122515 - DNA, 25 bp, E. coli
caaagaagacctgatcccgatgcgt

SEQ ID NO: 122516 - DNA, 25 bp, E. coli
caaagaagacctcatcccgatgcgt

SEQ ID NO: 122517 - DNA, 25 bp, E. coli
catgtgcaccggatcctacggcgtg

SEQ ID NO: 122518 - DNA, 25 bp, E. coli
catgtgcaccggttcctacggcgtg

SEQ ID NO: 122519 - DNA, 25 bp, E. coli
tactgacctcgaatacgtgctgcca

SEQ ID NO: 122520 - DNA, 25 bp, E. coli
tactgacctcgattacgtgctgcca

SEQ ID NO: 122521 - DNA, 25 bp, E. coli
tatgatcaagcagttcggtccgcgt

SEQ ID NO: 122522 - DNA, 25 bp, E. coli
tatgatcaagcacttcggtccgcgt

SEQ ID NO: 122523 - DNA, 25 bp, E. coli
tgtgctacaactacatgccggtgct

SEQ ID NO: 122524 - DNA, 25 bp, E. coli
tgtgctacaacttcatgccggtgct

SEQ ID NO: 122525 - DNA, 25 bp, E. coli
tgaagaagaacaccgtcgtaaagcg

SEQ ID NO: 122526 - DNA, 25 bp, E. coli
tgaagaagaacagcgtcgtaaagcg

SEQ ID NO: 122527 - DNA, 25 bp, E. coli
tgctggacgacctgaagaagaaaac

SEQ ID NO: 122528 - DNA, 25 bp, E. coli
tgctggacgaccagaagaagaaaac

SEQ ID NO: 122529 - DNA, 25 bp, E. coli
gaagatatcaaatcccacactggca

SEQ ID NO: 122530 - DNA, 25 bp, E. coli
gaagatatcaaaacccacactggca

SEQ ID NO: 122531 - DNA, 25 bp, E. coli
gaagagatcctcaaacgcaaggcga

SEQ ID NO: 122532 - DNA, 25 bp, E. coli
gaagagatcctctaacgcaaggcga

SEQ ID NO: 122533 - DNA, 25 bp, E. coli
ggttactccgcatttggtcgtctga

SEQ ID NO: 122534 - DNA, 25 bp, E. coli
ggttactccgcaattggtcgtctga

SEQ ID NO: 122535 - DNA, 25 bp, E. coli
catacatagggttagtggtagccag

SEQ ID NO: 122536 - DNA, 25 bp, E. coli
catacatagggtaagtggtagccag

SEQ ID NO: 122537 - DNA, 25 bp, E. coli
agatcctctagtagttccgctgtca

SEQ ID NO: 122538 - DNA, 25 bp, E. coli
agatcctctagttgttccgctgtca

SEQ ID NO: 122539 - DNA, 25 bp, E. coli
tattggacgcacttacattgaaacc

SEQ ID NO: 122540 - DNA, 25 bp, E. coli
tattgttgaatacgtgcgagcggaa

SEQ ID NO: 122541 - DNA, 25 bp, E. coli
tattgttgaataggtgcgagcggaa

SEQ ID NO: 122542 - DNA, 25 bp, E. coli
tattggacgcacatacattgaaacc

SEQ ID NO: 122543 - DNA, 25 bp, E. coli
tgttgacctgcatgacccgattgag

SEQ ID NO: 122544 - DNA, 25 bp, E. coli
tgttgacctgcaagacccgattgag

SEQ ID NO: 122545 - DNA, 25 bp, E. coli
tgaccgctcaactgatggacgcctg

SEQ ID NO: 122546 - DNA, 25 bp, E. coli
tgaccgctcaacagatggacgcctg

SEQ ID NO: 122547 - DNA, 25 bp, E. coli
tcttgctaaaagatctgaccgctca

SEQ ID NO: 122548 - DNA, 25 bp, E. coli
tcttcgcatctgcacatacataggg

SEQ ID NO: 122549 - DNA, 25 bp, E. coli
tcttgctaaaagttctgaccgctca

SEQ ID NO: 122550 - DNA, 25 bp, E. coli
tcttcgcatctggacatacataggg

SEQ ID NO: 122551 - DNA, 25 bp, E. coli
ccagcattgtttgcagggttagacc

SEQ ID NO: 122552 - DNA, 25 bp, E. coli
ccagcattgtttccagggttagacc

SEQ ID NO: 122553 - DNA, 25 bp, E. coli
gcagcaaagacggtacggagtcaat

SEQ ID NO: 122554 - DNA, 25 bp, E. coli
gcagcaaagacgctacggagtcaat

SEQ ID NO: 122555 - DNA, 25 bp, E. coli
tggacgcctgaagcgaaaaacggct

SEQ ID NO: 122556 - DNA, 25 bp, E. coli
tggacgcctgaaccgaaaaacggct

SEQ ID NO: 122557 - DNA, 25 bp, E. coli
cagtttacaattggtcgcaacggcg

SEQ ID NO: 122558 - DNA, 25 bp, E. coli
cagtttacaattcgtcgcaacggcg

SEQ ID NO: 122559 - DNA, 25 bp, E. coli
tacctgacatcaacaagcagcctga

SEQ ID NO: 122560 - DNA, 25 bp, E. coli
tacctgacatcatcaagcagcctga

SEQ ID NO: 122561 - DNA, 25 bp, E. coli
aaaagcgatactccctcaacgaagc

SEQ ID NO: 122562 - DNA, 25 bp, E. coli
aaaagcgatactgcctcaacgaagc

SEQ ID NO: 122563 - DNA, 25 bp, E. coli
tgtgtttgaaactcacgggcattac

SEQ ID NO: 122564 - DNA, 25 bp, E. coli
tgtgtttgaaacacacgggcattac

SEQ ID NO: 122565 - DNA, 25 bp, E. coli
tcccgtggcagtaaatcaggaaaca

SEQ ID NO: 122566 - DNA, 25 bp, E. coli
tcccgtggcagttaatcaggaaaca

SEQ ID NO: 122567 - DNA, 25 bp, E. coli
tcagcgccgggaacgtttattagaa

SEQ ID NO: 122568 - DNA, 25 bp, E. coli
tcagcgccgggatcgtttattagaa

SEQ ID NO: 122569 - DNA, 25 bp, E. coli
gctgacccaccctgatgaggtttca

SEQ ID NO: 122570 - DNA, 25 bp, E. coli
gctgacccacccagatgaggtttca

SEQ ID NO: 122571 - DNA, 25 bp, E. coli
gaaaaagtaactgtccatccagggc

SEQ ID NO: 122572 - DNA, 25 bp, E. coli
gaaaaagtaactctccatccagggc

SEQ ID NO: 122573 - DNA, 25 bp, E. coli
ggtaaaagatgctaatcccgtggca

SEQ ID NO: 122574 - DNA, 25 bp, E. coli
ggtaaaagatgcaaatcccgtggca

SEQ ID NO: 122575 - DNA, 25 bp, E. coli
gggatatcgcccacaggatcaataa

SEQ ID NO: 122576 - DNA, 25 bp, E. coli
gggatatcgccctcaggatcaataa

SEQ ID NO: 122577 - DNA, 25 bp, E. coli
ggcgtaccccgcttgataaatgttt

SEQ ID NO: 122578 - DNA, 25 bp, E. coli
ggcgtaccccgcatgataaatgttt

SEQ ID NO: 122579 - DNA, 25 bp, E. coli
caaccagcgcgaactggactcattg

SEQ ID NO: 122580 - DNA, 25 bp, E. coli
caaccagcgcgatctggactcattg

SEQ ID NO: 122581 - DNA, 25 bp, E. coli
cagcgcgaactgcactcattgtacg

SEQ ID NO: 122582 - DNA, 25 bp, E. coli
cagcgcgaactggactcattgtacg

SEQ ID NO: 122583 - DNA, 25 bp, E. coli
acggagaggcatatctgtttggcgc

SEQ ID NO: 122584 - DNA, 25 bp, E. coli
acggagaggcatttctgtttggcgc

SEQ ID NO: 122585 - DNA, 25 bp, E. coli
actggactcattctacggtcgcgtc

SEQ ID NO: 122586 - DNA, 25 bp, E. coli
actggactcattgtacggtcgcgtc

SEQ ID NO: 122587 - DNA, 25 bp, E. coli
gcgcgaactggagtcattgtacggt

SEQ ID NO: 122588 - DNA, 25 bp, E. coli
gcgcgaactggactcattgtacggt

SEQ ID NO: 122589 - DNA, 25 bp, E. coli
gcgaactggactgattgtacggtcg

SEQ ID NO: 122590 - DNA, 25 bp, E. coli
gcatttctgtttggcgctaacatca

SEQ ID NO: 122591 - DNA, 25 bp, E. coli
gcatttctgtttcgcgctaacatca

SEQ ID NO: 122592 - DNA, 25 bp, E. coli
gcgaactggactcattgtacggtcg

SEQ ID NO: 122593 - DNA, 25 bp, E. coli
gaactggactcaatgtacggtcgcg

SEQ ID NO: 122594 - DNA, 25 bp, E. coli
gaactggactcattgtacggtcgcg

SEQ ID NO: 122595 - DNA, 25 bp, E. coli
cggagaggcattactgtttggcgct

SEQ ID NO: 122596 - DNA, 25 bp, E. coli
cggagaggcatttctgtttggcgct

SEQ ID NO: 122597 - DNA, 25 bp, E. coli
gaggcatttctgtttggcgctaaca

SEQ ID NO: 122598 - DNA, 25 bp, E. coli
gaggcatttctgattggcgctaaca

SEQ ID NO: 122599 - DNA, 25 bp, E. coli
gagaggcatttctgtttggcgctaa

SEQ ID NO: 122600 - DNA, 25 bp, E. coli
gagaggcatttcagtttggcgctaa

SEQ ID NO: 122601 - DNA, 25 bp, E. coli
caatgaattccggacgctgaacgaa

SEQ ID NO: 122602 - DNA, 25 bp, E. coli
caatgaattccgcacgctgaacgaa

SEQ ID NO: 122603 - DNA, 25 bp, E. coli
aagttgaattttctattgagcaggg

SEQ ID NO: 122604 - DNA, 25 bp, E. coli
gaattccgcacggtgaacgaaaatc

SEQ ID NO: 122605 - DNA, 25 bp, E. coli
gaattccgcacgctgaacgaaaatc

SEQ ID NO: 122606 - DNA, 25 bp, E. coli
aagttgaattttgtattgagcaggg

SEQ ID NO: 122607 - DNA, 25 bp, E. coli
tatcactcctgaagatggcagcaaa

SEQ ID NO: 122608 - DNA, 25 bp, E. coli
tttggctttatcactcctgatgatg

SEQ ID NO: 122609 - DNA, 25 bp, E. coli
tttggctttatctctcctgatgatg

SEQ ID NO: 122610 - DNA, 25 bp, E. coli
tatcactcctgatgatggcagcaaa

SEQ ID NO: 122611 - DNA, 25 bp, E. coli
tccgcacgctgaacgaaaatcagaa

SEQ ID NO: 122612 - DNA, 25 bp, E. coli
tccgcacgctgatcgaaaatcagaa

SEQ ID NO: 122613 - DNA, 25 bp, E. coli
tccagagcaatgtattccgcacgct

SEQ ID NO: 122614 - DNA, 25 bp, E. coli
tccagagcaatgaattccgcacgct

SEQ ID NO: 122615 - DNA, 25 bp, E. coli
gccatccagagctatgaattccgca

SEQ ID NO: 122616 - DNA, 25 bp, E. coli
gccatccagagcaatgaattccgca

SEQ ID NO: 122617 - DNA, 25 bp, E. coli
gcaaagacgttttcgtccatttcac

SEQ ID NO: 122618 - DNA, 25 bp, E. coli
gcaaagacgtttacgtccatttcac

SEQ ID NO: 122619 - DNA, 25 bp, E. coli
cgctgaacgaaaatcagaaagttga

SEQ ID NO: 122620 - DNA, 25 bp, E. coli
cgctgaacgaaattcagaaagttga

SEQ ID NO: 122621 - DNA, 25 bp, E. coli
tggcagcaaagacgttttcgtccat

SEQ ID NO: 122622 - DNA, 25 bp, E. coli
tggcagcaaagaggttttcgtccat

SEQ ID NO: 122623 - DNA, 25 bp, E. coli
caggtagtaagactacacaatgcca

SEQ ID NO: 122624 - DNA, 25 bp, E. coli
caggtagtaagagtacacaatgcca

SEQ ID NO: 122625 - DNA, 25 bp, E. coli
tacaggcagggctattcctggtcac

SEQ ID NO: 122626 - DNA, 25 bp, E. coli
tacggacatactgatctgattacta

SEQ ID NO: 122627 - DNA, 25 bp, E. coli
tactactcttacaggtgaatacagg

SEQ ID NO: 122628 - DNA, 25 bp, E. coli
tacaggcagggcaattcctggtcac

SEQ ID NO: 122629 - DNA, 25 bp, E. coli
tactactcttactggtgaatacagg

SEQ ID NO: 122630 - DNA, 25 bp, E. coli
tacagggatgccatacaggcagggc

SEQ ID NO: 122631 - DNA, 25 bp, E. coli
tacagggatgccttacaggcagggc

SEQ ID NO: 122632 - DNA, 25 bp, E. coli
tacggacatactcatctgattacta

SEQ ID NO: 122633 - DNA, 25 bp, E. coli
tatagcagaccgaacagggatgcca

SEQ ID NO: 122634 - DNA, 25 bp, E. coli
tatttggtcctacggtctatagcag

SEQ ID NO: 122635 - DNA, 25 bp, E. coli
tatagcagaccgtacagggatgcca

SEQ ID NO: 122636 - DNA, 25 bp, E. coli
tatttggtcctagggtctatagcag

SEQ ID NO: 122637 - DNA, 25 bp, E. coli
cctggtcactgtagtcggtatatac

SEQ ID NO: 122638 - DNA, 25 bp, E. coli
cctggtcactgttgtcggtatatac

SEQ ID NO: 122639 - DNA, 25 bp, E. coli
gaaggtagcccctgcctgtgatggc

SEQ ID NO: 122640 - DNA, 25 bp, E. coli
gaaggtagccccagcctgtgatggc

SEQ ID NO: 122641 - DNA, 25 bp, E. coli
taaatttgagaccaaggtagcccca

SEQ ID NO: 122642 - DNA, 25 bp, E. coli
taaatttgagacgaaggtagcccca

SEQ ID NO: 122643 - DNA, 25 bp, E. coli
gatggctgttaataagttactctgc

SEQ ID NO: 122644 - DNA, 25 bp, E. coli
gatggctgttaaaaagttactctgc

SEQ ID NO: 122645 - DNA, 25 bp, E. coli
caataaatgaagtgggcatgcacga

SEQ ID NO: 122646 - DNA, 25 bp, E. coli
caataaatgaagagggcatgcacga

SEQ ID NO: 122647 - DNA, 25 bp, E. coli
cagtcagctgcgtgacgcggttttg

SEQ ID NO: 122648 - DNA, 25 bp, E. coli
catgcgcgatatgaccagtcagctg

SEQ ID NO: 122649 - DNA, 25 bp, E. coli
cagtcagctgcgagacgcggttttg

SEQ ID NO: 122650 - DNA, 25 bp, E. coli
catgcgcgatatcaccagtcagctg

SEQ ID NO: 122651 - DNA, 25 bp, E. coli
tatttcagggactaaaatggtctgc

SEQ ID NO: 122652 - DNA, 25 bp, E. coli
tatttcagggacaaaaatggtctgc

SEQ ID NO: 122653 - DNA, 25 bp, E. coli
ttacaggcgattcttggcggaaact

SEQ ID NO: 122654 - DNA, 25 bp, E. coli
ttacaggcgattgttggcggaaact

SEQ ID NO: 122655 - DNA, 25 bp, E. coli
tgcacgatgcaaggatcgcgcagat

SEQ ID NO: 122656 - DNA, 25 bp, E. coli
tgcacgatgcaacgatcgcgcagat

SEQ ID NO: 122657 - DNA, 25 bp, E. coli
tctgggccagcagtatgcatcagcc

SEQ ID NO: 122658 - DNA, 25 bp, E. coli
tctgggccagcactatgcatcagcc

SEQ ID NO: 122659 - DNA, 25 bp, E. coli
tctgctggaagctaccatgcgcgat

SEQ ID NO: 122660 - DNA, 25 bp, E. coli
tctgctggaagcaaccatgcgcgat

SEQ ID NO: 122661 - DNA, 25 bp, E. coli
gattacatgcacttccgcagggcag

SEQ ID NO: 122662 - DNA, 25 bp, E. coli
gattacatgcacatccgcagggcag

SEQ ID NO: 122663 - DNA, 25 bp, E. coli
gggatcatcagccactatttcaggg

SEQ ID NO: 122664 - DNA, 25 bp, E. coli
gggatcatcagcgactatttcaggg

SEQ ID NO: 122665 - DNA, 25 bp, E. coli
gatccggcgcagacaactgatcgac

SEQ ID NO: 122666 - DNA, 25 bp, E. coli
gatccggcgcagtcaactgatcgac

SEQ ID NO: 122667 - DNA, 25 bp, E. coli
caataattcacaactgacggcaggt

SEQ ID NO: 122668 - DNA, 25 bp, E. coli
caataattcacatctgacggcaggt

SEQ ID NO: 122669 - DNA, 25 bp, E. coli
tacgcccaattggtatggcttgcga

SEQ ID NO: 122670 - DNA, 25 bp, E. coli
tacgcccaattgctatggcttgcga

SEQ ID NO: 122671 - DNA, 25 bp, E. coli
aagtttctgccgtggcctgaccgat

SEQ ID NO: 122672 - DNA, 25 bp, E. coli
aagtttctgccgaggcctgaccgat

SEQ ID NO: 122673 - DNA, 25 bp, E. coli
tccggcagttcgtcagggagtgtat

SEQ ID NO: 122674 - DNA, 25 bp, E. coli
tcgataccttgcacctactgatggc

SEQ ID NO: 122675 - DNA, 25 bp, E. coli
tccggcagttcgacagggagtgtat

SEQ ID NO: 122676 - DNA, 25 bp, E. coli
tcgataccttgctcctactgatggc

SEQ ID NO: 122677 - DNA, 25 bp, E. coli
gccgaagcgggtaatccactggtga

SEQ ID NO: 122678 - DNA, 25 bp, E. coli
gccgaagcgggttatccactggtga

SEQ ID NO: 122679 - DNA, 25 bp, E. coli
gctggaagatttgcaccgcagcgcg

SEQ ID NO: 122680 - DNA, 25 bp, E. coli
gcgaaggtgataagttccgcgccac

SEQ ID NO: 122681 - DNA, 25 bp, E. coli
gctggaagatttccaccgcagcgcg

SEQ ID NO: 122682 - DNA, 25 bp, E. coli
gcgaaggtgatatgttccgcgccac

SEQ ID NO: 122683 - DNA, 25 bp, E. coli
cattaatcgatgtgtacgccctgct

SEQ ID NO: 122684 - DNA, 25 bp, E. coli
cattaatcgatgagtacgccctgct

SEQ ID NO: 122685 - DNA, 25 bp, E. coli
ggcgcgccatgctgactgaagtcaa

SEQ ID NO: 122686 - DNA, 25 bp, E. coli
ggcgcgccatgcagactgaagtcaa

SEQ ID NO: 122687 - DNA, 25 bp, E. coli
taaaaccacaaaccttgcgacgtca

SEQ ID NO: 122688 - DNA, 25 bp, E. coli
taaaaccacaaagcttgcgacgtca

SEQ ID NO: 122689 - DNA, 25 bp, E. coli
caccctggtgctcacggatgagatc

SEQ ID NO: 122690 - DNA, 25 bp, E. coli
caccctggtgctgacggatgagatc

SEQ ID NO: 122691 - DNA, 25 bp, E. coli
cagctgccgggtaatctggatatcc

SEQ ID NO: 122692 - DNA, 25 bp, E. coli
cagctgccgggttatctggatatcc

SEQ ID NO: 122693 - DNA, 25 bp, E. coli
tacacccgcaatatggcgactggcg

SEQ ID NO: 122694 - DNA, 25 bp, E. coli
tacacccgcaatttggcgactggcg

SEQ ID NO: 122695 - DNA, 25 bp, E. coli
aaagtatgccgtggtacagcggtcc

SEQ ID NO: 122696 - DNA, 25 bp, E. coli
aaagtatgccgtcgtacagcggtcc

SEQ ID NO: 122697 - DNA, 25 bp, E. coli
tctggtgtggaaacaaacgtcgcgc

SEQ ID NO: 122698 - DNA, 25 bp, E. coli
tctggtgtggaatcaaacgtcgcgc

SEQ ID NO: 122699 - DNA, 25 bp, E. coli
gaagagacgttctcccgtattcgtg

SEQ ID NO: 122700 - DNA, 25 bp, E. coli
gaagagacgttcacccgtattcgtg

SEQ ID NO: 122701 - DNA, 25 bp, E. coli
gactggcgcatccacatgtgaactg

SEQ ID NO: 122702 - DNA, 25 bp, E. coli
gactggcgcatcgacatgtgaactg

SEQ ID NO: 122703 - DNA, 25 bp, E. coli
cgaagcctggatgattgcgcaacaa

SEQ ID NO: 122704 - DNA, 25 bp, E. coli
cgaagcctggatcattgcgcaacaa

SEQ ID NO: 122705 - DNA, 25 bp, E. coli
gtaaaggcgtgctcgatcaaacccg

SEQ ID NO: 122706 - DNA, 25 bp, E. coli
gtaaaggcgtgcacgatcaaacccg

SEQ ID NO: 122707 - DNA, 25 bp, E. coli
tggtcgtggcgaacaacaaaatgga

SEQ ID NO: 122708 - DNA, 25 bp, E. coli
tggtcgtggcgatcaacaaaatgga

SEQ ID NO: 122709 - DNA, 25 bp, E. coli
tcaaaattgccggtaagaagacgcg

SEQ ID NO: 122710 - DNA, 25 bp, E. coli
tcaaaattgccgctaagaagacgcg

SEQ ID NO: 122711 - DNA, 25 bp, E. coli
caattgcgcctggacttatcggtgc

SEQ ID NO: 122712 - DNA, 25 bp, E. coli
caattgcgcctgcacttatcggtgc

SEQ ID NO: 122713 - DNA, 25 bp, E. coli
cacgtgagtctgttgcaccgggcaa

SEQ ID NO: 122714 - DNA, 25 bp, E. coli
cacgtgagtctgatgcaccgggcaa

SEQ ID NO: 122715 - DNA, 25 bp, E. coli
catggtggcggcattactttcggac

SEQ ID NO: 122716 - DNA, 25 bp, E. coli
catggtggcggctttactttcggac

SEQ ID NO: 122717 - DNA, 25 bp, E. coli
taaatcccgcatcgcagatggttcg

SEQ ID NO: 122718 - DNA, 25 bp, E. coli
tacagtcgtcggtatagccggtcag

SEQ ID NO: 122719 - DNA, 25 bp, E. coli
taaatcccgcatggcagatggttcg

SEQ ID NO: 122720 - DNA, 25 bp, E. coli
tacagtcgtcggaatagccggtcag

SEQ ID NO: 122721 - DNA, 25 bp, E. coli
tatcagcgggaacgacagcaatagc

SEQ ID NO: 122722 - DNA, 25 bp, E. coli
tattcgtagctatttgcaacgcccg

SEQ ID NO: 122723 - DNA, 25 bp, E. coli
tattcgtagctaattgcaacgcccg

SEQ ID NO: 122724 - DNA, 25 bp, E. coli
tatcagcgggaaggacagcaatagc

SEQ ID NO: 122725 - DNA, 25 bp, E. coli
tgaaatatatcacaccaccgtggct

SEQ ID NO: 122726 - DNA, 25 bp, E. coli
tgaaatatatcagaccaccgtggct

SEQ ID NO: 122727 - DNA, 25 bp, E. coli
gcttcaggtaacgtacaaggcgcga

SEQ ID NO: 122728 - DNA, 25 bp, E. coli
gcttcaggtaacctacaaggcgcga

SEQ ID NO: 122729 - DNA, 25 bp, E. coli
gtcaattgattactcgccctcgcgg

SEQ ID NO: 122730 - DNA, 25 bp, E. coli
gtcaattgattagtcgccctcgcgg

SEQ ID NO: 122731 - DNA, 25 bp, E. coli
gaccttacctgggagcacgggatga

SEQ ID NO: 122732 - DNA, 25 bp, E. coli
gaccttacctggcagcacgggatga

SEQ ID NO: 122733 - DNA, 25 bp, E. coli
aacgtgattatgagcaggcctgggc

SEQ ID NO: 122734 - DNA, 25 bp, E. coli
cacgtgagtggtatagcaaagcagc

SEQ ID NO: 122735 - DNA, 25 bp, E. coli
cacgtgagtggtttagcaaagcagc

SEQ ID NO: 122736 - DNA, 25 bp, E. coli
catctcctggtacacgaaatcggca

SEQ ID NO: 122737 - DNA, 25 bp, E. coli
catctcctggtagacgaaatcggca

SEQ ID NO: 122738 - DNA, 25 bp, E. coli
tacaccccggcagaatatgtactgg

SEQ ID NO: 122739 - DNA, 25 bp, E. coli
tacaccccggcacaatatgtactgg

SEQ ID NO: 122740 - DNA, 25 bp, E. coli
aacgtgattatgtgcaggcctgggc

SEQ ID NO: 122741 - DNA, 25 bp, E. coli
tatagaaaaatatgccccggaagcc

SEQ ID NO: 122742 - DNA, 25 bp, E. coli
tatcgaaaatcagcgacatcaggcg

SEQ ID NO: 122743 - DNA, 25 bp, E. coli
tatagaaaaataagccccggaagcc

SEQ ID NO: 122744 - DNA, 25 bp, E. coli
tatcgaaaatcaccgacatcaggcg

SEQ ID NO: 122745 - DNA, 25 bp, E. coli
ttaaaaaagatgtgcaacaggccgc

SEQ ID NO: 122746 - DNA, 25 bp, E. coli
ttaaaaaagatgagcaacaggccgc

SEQ ID NO: 122747 - DNA, 25 bp, E. coli
ttattttcccagtcggcagagcagg

SEQ ID NO: 122748 - DNA, 25 bp, E. coli
ttattttcccagacggcagagcagg

SEQ ID NO: 122749 - DNA, 25 bp, E. coli
tcaggattacacacagtcacgggta

SEQ ID NO: 122750 - DNA, 25 bp, E. coli
tcaggattacactcagtcacgggta

SEQ ID NO: 122751 - DNA, 25 bp, E. coli
cctgggcgagaaagcaaaagcttaa

SEQ ID NO: 122752 - DNA, 25 bp, E. coli
cctgggcgagaatgcaaaagcttaa

SEQ ID NO: 122753 - DNA, 25 bp, E. coli
gaaacgacaaaggatctcacccagg

SEQ ID NO: 122754 - DNA, 25 bp, E. coli
gaaacgacaaagcatctcacccagg

SEQ ID NO: 122755 - DNA, 25 bp, E. coli
catgcgacttctcatattgataacc

SEQ ID NO: 122756 - DNA, 25 bp, E. coli
catgcgacttctgatattgataacc

SEQ ID NO: 122757 - DNA, 25 bp, E. coli
tacattgcatgttgttgagtctaag

SEQ ID NO: 122758 - DNA, 25 bp, E. coli
tacattgcatgtagttgagtctaag

SEQ ID NO: 122759 - DNA, 25 bp, E. coli
aactacaggatcttctgttaaacac

SEQ ID NO: 122760 - DNA, 25 bp, E. coli
aactacaggatcatctgttaaacac

SEQ ID NO: 122761 - DNA, 25 bp, E. coli
tgataacctcagttgtggagttctg

SEQ ID NO: 122762 - DNA, 25 bp, E. coli
tgataacctcagatgtggagttctg

SEQ ID NO: 122763 - DNA, 25 bp, E. coli
tgttaaacactgaaaagccatctac

SEQ ID NO: 122764 - DNA, 25 bp, E. coli
tgttaaacactgtaaagccatctac

SEQ ID NO: 122765 - DNA, 25 bp, E. coli
gctataggcctagatatttcaggtt

SEQ ID NO: 122766 - DNA, 25 bp, E. coli
gctataggcctacatatttcaggtt

SEQ ID NO: 122767 - DNA, 25 bp, E. coli
cgcttccgggaggacgcatatcaaa

SEQ ID NO: 122768 - DNA, 25 bp, E. coli
cgcttccgggagcacgcatatcaaa

SEQ ID NO: 122769 - DNA, 25 bp, E. coli
ctattatttttgacatccatgcgac

SEQ ID NO: 122770 - DNA, 25 bp, E. coli
ctattatttttgtcatccatgcgac

SEQ ID NO: 122771 - DNA, 25 bp, E. coli
tggagttctgtctgcgcttccggga

SEQ ID NO: 122772 - DNA, 25 bp, E. coli
tggagttctgtcagcgcttccggga

SEQ ID NO: 122773 - DNA, 25 bp, E. coli
gaggacgcatatgaaaactacagga

SEQ ID NO: 122774 - DNA, 25 bp, E. coli
gatgatttatctgctataggcctag

SEQ ID NO: 122775 - DNA, 25 bp, E. coli
gaggacgcatatcaaaactacagga

SEQ ID NO: 122776 - DNA, 25 bp, E. coli
gatgatttatctcctataggcctag

SEQ ID NO: 122777 - DNA, 25 bp, E. coli
cagtttcaaacggtaaattgcctga

SEQ ID NO: 122778 - DNA, 25 bp, E. coli
caaacaatccaatacgccgcgttca

SEQ ID NO: 122779 - DNA, 25 bp, E. coli
caaacaatccaaaacgccgcgttca

SEQ ID NO: 122780 - DNA, 25 bp, E. coli
cagtttcaaacgctaaattgcctga

SEQ ID NO: 122781 - DNA, 25 bp, E. coli
aaagagattgataattcgcgtcgcg

SEQ ID NO: 122782 - DNA, 25 bp, E. coli
aaagagattgattattcgcgtcgcg

SEQ ID NO: 122783 - DNA, 25 bp, E. coli
tagtcagcgagagttttctcaacgc

SEQ ID NO: 122784 - DNA, 25 bp, E. coli
tagtcagcgagacttttctcaacgc

SEQ ID NO: 122785 - DNA, 25 bp, E. coli
tagtctgttcctctagtcagcgaga

SEQ ID NO: 122786 - DNA, 25 bp, E. coli
tagtctgttcctgtagtcagcgaga

SEQ ID NO: 122787 - DNA, 25 bp, E. coli
tttaagtttcgcaatgccggatggg

SEQ ID NO: 122788 - DNA, 25 bp, E. coli
tttaagtttcgctatgccggatggg

SEQ ID NO: 122789 - DNA, 25 bp, E. coli
tgtaaccgctttgatcttgctggaa

SEQ ID NO: 122790 - DNA, 25 bp, E. coli
tgtaaccgctttcatcttgctggaa

SEQ ID NO: 122791 - DNA, 25 bp, E. coli
tcgcgtcgcgaaaaatagtctgttc

SEQ ID NO: 122792 - DNA, 25 bp, E. coli
tccggcaagaaagagcaaacaatcc

SEQ ID NO: 122793 - DNA, 25 bp, E. coli
tcgcgtcgcgaataatagtctgttc

SEQ ID NO: 122794 - DNA, 25 bp, E. coli
tccggcaagaaacagcaaacaatcc

SEQ ID NO: 122795 - DNA, 25 bp, E. coli
tcatcaaaatatctgcggttgctca

SEQ ID NO: 122796 - DNA, 25 bp, E. coli
tcatcaaaatatgtgcggttgctca

SEQ ID NO: 122797 - DNA, 25 bp, E. coli
ggtgcagcaatttatacgtcaaaga

SEQ ID NO: 122798 - DNA, 25 bp, E. coli
ggtgcagcaattaatacgtcaaaga

SEQ ID NO: 122799 - DNA, 25 bp, E. coli
tacaggacggtaccaccattgaact

SEQ ID NO: 122800 - DNA, 25 bp, E. coli
tacaggacggtagcaccattgaact

SEQ ID NO: 122801 - DNA, 25 bp, E. coli
agaccatcctgagcggtgctgcggt

SEQ ID NO: 122802 - DNA, 25 bp, E. coli
agaccatcctgaccggtgctgcggt

SEQ ID NO: 122803 - DNA, 25 bp, E. coli
tttgccgaaggcgtgttcctgctgc

SEQ ID NO: 122804 - DNA, 25 bp, E. coli
tattcctgccggtgaggccggtgac

SEQ ID NO: 122805 - DNA, 25 bp, E. coli
tattcctgccggagaggccggtgac

SEQ ID NO: 122806 - DNA, 25 bp, E. coli
tttgccgaaggcctgttcctgctgc

SEQ ID NO: 122807 - DNA, 25 bp, E. coli
tgctgcccaaactgtctgctgacga

SEQ ID NO: 122808 - DNA, 25 bp, E. coli
tgctgcccaaacagtctgctgacga

SEQ ID NO: 122809 - DNA, 25 bp, E. coli
tgctgacgacattcagtccggcgcg

SEQ ID NO: 122810 - DNA, 25 bp, E. coli
tgctgacgacatacagtccggcgcg

SEQ ID NO: 122811 - DNA, 25 bp, E. coli
ccattgaactggtgaatgccggaga

SEQ ID NO: 122812 - DNA, 25 bp, E. coli
ccattgaactggagaatgccggaga

SEQ ID NO: 122813 - DNA, 25 bp, E. coli
gccactgtggcgctaaaaatcaatg

SEQ ID NO: 122814 - DNA, 25 bp, E. coli
gccactgtggcggtaaaaatcaatg

SEQ ID NO: 122815 - DNA, 25 bp, E. coli
cggagatcagaccatcctgagcggt

SEQ ID NO: 122816 - DNA, 25 bp, E. coli
cggagatcagacgatcctgagcggt

SEQ ID NO: 122817 - DNA, 25 bp, E. coli
gggaaaatgcccgtgcaaacagcgc

SEQ ID NO: 122818 - DNA, 25 bp, E. coli
gggaaaatgcccctgcaaacagcgc

SEQ ID NO: 122819 - DNA, 25 bp, E. coli
tggccgtggccattaccgatattcc

SEQ ID NO: 122820 - DNA, 25 bp, E. coli
tggccgtggccaataccgatattcc

SEQ ID NO: 122821 - DNA, 25 bp, E. coli
aaaatctggcaagagctgggcgtgc

SEQ ID NO: 122822 - DNA, 25 bp, E. coli
aaaatctggcaacagctgggcgtgc

SEQ ID NO: 122823 - DNA, 25 bp, E. coli
ttagcacactgtcaatcgccgcagg

SEQ ID NO: 122824 - DNA, 25 bp, E. coli
ttgttgcccggtcaagtgctggtca

SEQ ID NO: 122825 - DNA, 25 bp, E. coli
ttagcggcgggcatgactccaccgt

SEQ ID NO: 122826 - DNA, 25 bp, E. coli
ttagcacactgtgaatcgccgcagg

SEQ ID NO: 122827 - DNA, 25 bp, E. coli
ttagcggcgggcttgactccaccgt

SEQ ID NO: 122828 - DNA, 25 bp, E. coli
ttgttgcccggtgaagtgctggtca

SEQ ID NO: 122829 - DNA, 25 bp, E. coli
tcaccgggcaaaccgaaaacattgt

SEQ ID NO: 122830 - DNA, 25 bp, E. coli
tcaccgggcaaagcgaaaacattgt

SEQ ID NO: 122831 - DNA, 25 bp, E. coli
ccgttctgctgcttcagttggtgca

SEQ ID NO: 122832 - DNA, 25 bp, E. coli
gcattgcgaaaaggtctgccaacag

SEQ ID NO: 122833 - DNA, 25 bp, E. coli
gctggtggtcgaacgcgtacaactt

SEQ ID NO: 122834 - DNA, 25 bp, E. coli
gctggtggtcgatcgcgtacaactt

SEQ ID NO: 122835 - DNA, 25 bp, E. coli
gcattgcgaaaacgtctgccaacag

SEQ ID NO: 122836 - DNA, 25 bp, E. coli
gaaagtaatcaggacgactcatacg

SEQ ID NO: 122837 - DNA, 25 bp, E. coli
gaaagtaatcagcacgactcatacg

SEQ ID NO: 122838 - DNA, 25 bp, E. coli
ccgttctgctgcatcagttggtgca

SEQ ID NO: 122839 - DNA, 25 bp, E. coli
ggtttaagtgcctatgccgatgcct

SEQ ID NO: 122840 - DNA, 25 bp, E. coli
ggtttaagtgccaatgccgatgcct

SEQ ID NO: 122841 - DNA, 25 bp, E. coli
gatgcctgggttacgcattgcgaaa

SEQ ID NO: 122842 - DNA, 25 bp, E. coli
gatgcctgggtttcgcattgcgaaa

SEQ ID NO: 122843 - DNA, 25 bp, E. coli
catttgctcgaacagttgtatcacc

SEQ ID NO: 122844 - DNA, 25 bp, E. coli
catttgctcgaagagttgtatcacc

SEQ ID NO: 122845 - DNA, 25 bp, E. coli
taacggccctgtattatcgctgact

SEQ ID NO: 122846 - DNA, 25 bp, E. coli
tacttcatcagatagggtgccgtgc

SEQ ID NO: 122847 - DNA, 25 bp, E. coli
tacttcatcagaaagggtgccgtgc

SEQ ID NO: 122848 - DNA, 25 bp, E. coli
tatcggatggcggattgagacacct

SEQ ID NO: 122849 - DNA, 25 bp, E. coli
tatcggatggcgcattgagacacct

SEQ ID NO: 122850 - DNA, 25 bp, E. coli
ttcgggtattaagaaaatcagcgcg

SEQ ID NO: 122851 - DNA, 25 bp, E. coli
ttgaagcacgtaaccaaacagggct

SEQ ID NO: 122852 - DNA, 25 bp, E. coli
ttgaagcacgtatccaaacagggct

SEQ ID NO: 122853 - DNA, 25 bp, E. coli
ttcgggtattaacaaaatcagcgcg

SEQ ID NO: 122854 - DNA, 25 bp, E. coli
tgccgtgcagcaagaaacagaagac

SEQ ID NO: 122855 - DNA, 25 bp, E. coli
tgccgtgcagcatgaaacagaagac

SEQ ID NO: 122856 - DNA, 25 bp, E. coli
tcagattcagaacgtcaaaagcgcg

SEQ ID NO: 122857 - DNA, 25 bp, E. coli
gaaggagtttctttgtggcagtgcc

SEQ ID NO: 122858 - DNA, 25 bp, E. coli
gaaggagtttctatgtggcagtgcc

SEQ ID NO: 122859 - DNA, 25 bp, E. coli
cgtacagactggttgaacaagaact

SEQ ID NO: 122860 - DNA, 25 bp, E. coli
cgtacagactggatgaacaagaact

SEQ ID NO: 122861 - DNA, 25 bp, E. coli
tcagattcagaaggtcaaaagcgcg

SEQ ID NO: 122862 - DNA, 25 bp, E. coli
tcagcgcgatgatatctaagattgg

SEQ ID NO: 122863 - DNA, 25 bp, E. coli
taacggccctgttttatcgctgact

SEQ ID NO: 122864 - DNA, 25 bp, E. coli
tcagcgcgatgaaatctaagattgg

SEQ ID NO: 122865 - DNA, 25 bp, E. coli
aatcccgaaattacgctgtatggcg

SEQ ID NO: 122866 - DNA, 25 bp, E. coli
aatcccgaaatttcgctgtatggcg

SEQ ID NO: 122867 - DNA, 25 bp, E. coli
aacagtcgcgaagaggtggaaaagc

SEQ ID NO: 122868 - DNA, 25 bp, E. coli
aacagtcgcgaacaggtggaaaagc

SEQ ID NO: 122869 - DNA, 25 bp, E. coli
aaagcgcggcgtggaaattggtaat

SEQ ID NO: 122870 - DNA, 25 bp, E. coli
aaagcgcggcgtcgaaattggtaat

SEQ ID NO: 122871 - DNA, 25 bp, E. coli
tagcagcgttaataagctgtgccgc

SEQ ID NO: 122872 - DNA, 25 bp, E. coli
tagcagcgttaaaaagctgtgccgc

SEQ ID NO: 122873 - DNA, 25 bp, E. coli
tattgcagacggagaataatcccga

SEQ ID NO: 122874 - DNA, 25 bp, E. coli
tattgcagacggtgaataatcccga

SEQ ID NO: 122875 - DNA, 25 bp, E. coli
gaatgaaatcacgttcgatggtctg

SEQ ID NO: 122876 - DNA, 25 bp, E. coli
gaatgaaatcaccttcgatggtctg

SEQ ID NO: 122877 - DNA, 25 bp, E. coli
cgtcgtgatcgtcttggataccgcc

SEQ ID NO: 122878 - DNA, 25 bp, E. coli
cgtcgtgatcgtgttggataccgcc

SEQ ID NO: 122879 - DNA, 25 bp, E. coli
gttggataaccggatcggctgcgca

SEQ ID NO: 122880 - DNA, 25 bp, E. coli
gttggataaccgcatcggctgcgca

SEQ ID NO: 122881 - DNA, 25 bp, E. coli
ggaacacattaatccggacgtcgtg

SEQ ID NO: 122882 - DNA, 25 bp, E. coli
gggcgcaaacctgggcggaacacat

SEQ ID NO: 122883 - DNA, 25 bp, E. coli
ggaacacattaaaccggacgtcgtg

SEQ ID NO: 122884 - DNA, 25 bp, E. coli
gggcgcaaacctcggcggaacacat

SEQ ID NO: 122885 - DNA, 25 bp, E. coli
ggctgcgcaatgttggctgaactat

SEQ ID NO: 122886 - DNA, 25 bp, E. coli
ggctgcgcaatgatggctgaactat

SEQ ID NO: 122887 - DNA, 25 bp, E. coli
tatcagtgcctcaggacgatttctg

SEQ ID NO: 122888 - DNA, 25 bp, E. coli
tatcagtgcctctggacgatttctg

SEQ ID NO: 122889 - DNA, 25 bp, E. coli
tatttccctgcttatggacgtgaca

SEQ ID NO: 122890 - DNA, 25 bp, E. coli
tatttccctgctaatggacgtgaca

SEQ ID NO: 122891 - DNA, 25 bp, E. coli
tgagcagtatcagcgcttattggag

SEQ ID NO: 122892 - DNA, 25 bp, E. coli
tgagcagtatcaccgcttattggag

SEQ ID NO: 122893 - DNA, 25 bp, E. coli
tcatgatcctgaattccctgagcag

SEQ ID NO: 122894 - DNA, 25 bp, E. coli
tcatgatcctgatttccctgagcag

SEQ ID NO: 122895 - DNA, 25 bp, E. coli
gcttattggagcgtctggattatca

SEQ ID NO: 122896 - DNA, 25 bp, E. coli
gcttattggagcctctggattatca

SEQ ID NO: 122897 - DNA, 25 bp, E. coli
cgatttctgcatagttaatccaggg

SEQ ID NO: 122898 - DNA, 25 bp, E. coli
cgatttctgcattgttaatccaggg

SEQ ID NO: 122899 - DNA, 25 bp, E. coli
gtgtcaaccaacgatacgcgagagt

SEQ ID NO: 122900 - DNA, 25 bp, E. coli
ggtactaaagcatcaggccagcgta

SEQ ID NO: 122901 - DNA, 25 bp, E. coli
gtgtcaaccaaccatacgcgagagt

SEQ ID NO: 122902 - DNA, 25 bp, E. coli
ggattatcagaccatgcccggtact

SEQ ID NO: 122903 - DNA, 25 bp, E. coli
ggattatcagacgatgcccggtact

SEQ ID NO: 122904 - DNA, 25 bp, E. coli
ggtactaaagcaacaggccagcgta

SEQ ID NO: 122905 - DNA, 25 bp, E. coli
gagtcctctccgtatttatcagtgc

SEQ ID NO: 122906 - DNA, 25 bp, E. coli
gagtcctctccgaatttatcagtgc

SEQ ID NO: 122907 - DNA, 25 bp, E. coli
gacgtgacatcctggatattcatga

SEQ ID NO: 122908 - DNA, 25 bp, E. coli
gacgtgacatccaggatattcatga

SEQ ID NO: 122909 - DNA, 25 bp, E. coli
aaggcatcgagcattccgggcagaa

SEQ ID NO: 122910 - DNA, 25 bp, E. coli
aaggcatcgagctttccgggcagaa

SEQ ID NO: 122911 - DNA, 25 bp, E. coli
catatcgttattcgcgcggcaggta

SEQ ID NO: 122912 - DNA, 25 bp, E. coli
catatcgttattggcgcggcaggta

SEQ ID NO: 122913 - DNA, 25 bp, E. coli
tactatcgtgaaaacccgtgcgggt

SEQ ID NO: 122914 - DNA, 25 bp, E. coli
tactatcgtgaatacccgtgcgggt

SEQ ID NO: 122915 - DNA, 25 bp, E. coli
taactatgttaaagccgcaggccag

SEQ ID NO: 122916 - DNA, 25 bp, E. coli
tacgctcggtaatctggataacgcc

SEQ ID NO: 122917 - DNA, 25 bp, E. coli
tacgctcggtaaactggataacgcc

SEQ ID NO: 122918 - DNA, 25 bp, E. coli
tatgtgggtcttgaatccgctgcgc

SEQ ID NO: 122919 - DNA, 25 bp, E. coli
tatgtgggtcttcaatccgctgcgc

SEQ ID NO: 122920 - DNA, 25 bp, E. coli
tataaccgtaatgccatcgcggcgg

SEQ ID NO: 122921 - DNA, 25 bp, E. coli
tataaccgtaatcccatcgcggcgg

SEQ ID NO: 122922 - DNA, 25 bp, E. coli
tgattatcaagggaagctctctgcg

SEQ ID NO: 122923 - DNA, 25 bp, E. coli
tgattatcaaggcaagctctctgcg

SEQ ID NO: 122924 - DNA, 25 bp, E. coli
gcattattgcagttaccggcgtaga

SEQ ID NO: 122925 - DNA, 25 bp, E. coli
gcattattgcagataccggcgtaga

SEQ ID NO: 122926 - DNA, 25 bp, E. coli
gaaggatatttctgctggcggcgac

SEQ ID NO: 122927 - DNA, 25 bp, E. coli
gaaggatatttcagctggcggcgac

SEQ ID NO: 122928 - DNA, 25 bp, E. coli
taactatgttaatgccgcaggccag

SEQ ID NO: 122929 - DNA, 25 bp, E. coli
taatatgttgggacaaaccatcgcg

SEQ ID NO: 122930 - DNA, 25 bp, E. coli
taatatgttgggtcaaaccatcgcg

SEQ ID NO: 122931 - DNA, 25 bp, E. coli
tattctgccggtgagcatcttgaac

SEQ ID NO: 122932 - DNA, 25 bp, E. coli
tattctgccggtcagcatcttgaac

SEQ ID NO: 122933 - DNA, 25 bp, E. coli
tgttgcagtcctcacaggtagggct

SEQ ID NO: 122934 - DNA, 25 bp, E. coli
tgtcaaccaggtcgaaacggtaggc

SEQ ID NO: 122935 - DNA, 25 bp, E. coli
tgttgcagtcctgacaggtagggct

SEQ ID NO: 122936 - DNA, 25 bp, E. coli
tggtacgcacattcatctggaaggg

SEQ ID NO: 122937 - DNA, 25 bp, E. coli
tggtacgcacatacatctggaaggg

SEQ ID NO: 122938 - DNA, 25 bp, E. coli
tgtcaaccaggtggaaacggtaggc

SEQ ID NO: 122939 - DNA, 25 bp, E. coli
tgcgcctgtgcccaaagatttaccc

SEQ ID NO: 122940 - DNA, 25 bp, E. coli
tgcgcctgtgccgaaagatttaccc

SEQ ID NO: 122941 - DNA, 25 bp, E. coli
taggtaacaaccaggcgatcaccgt

SEQ ID NO: 122942 - DNA, 25 bp, E. coli
taggtaacaacctggcgatcaccgt

SEQ ID NO: 122943 - DNA, 25 bp, E. coli
gcaagacgatgatggaaaacaccgg

SEQ ID NO: 122944 - DNA, 25 bp, E. coli
gcaagacgatgaaggaaaacaccgg

SEQ ID NO: 122945 - DNA, 25 bp, E. coli
cggcattatgaaaacctcggtggcg

SEQ ID NO: 122946 - DNA, 25 bp, E. coli
cggcattatgaatacctcggtggcg

SEQ ID NO: 122947 - DNA, 25 bp, E. coli
tgtggtgccacacaacctgtaccgg

SEQ ID NO: 122948 - DNA, 25 bp, E. coli
tagggaataacgtcaccttctcggt

SEQ ID NO: 122949 - DNA, 25 bp, E. coli
tagggaataacgacaccttctcggt

SEQ ID NO: 122950 - DNA, 25 bp, E. coli
tgtggtgccacagaacctgtaccgg

SEQ ID NO: 122951 - DNA, 25 bp, E. coli
gatgcgccggtgtttaactggaact

SEQ ID NO: 122952 - DNA, 25 bp, E. coli
gatgcgccggtgattaactggaact

SEQ ID NO: 122953 - DNA, 25 bp, E. coli
caactgctacggacaggtttcacgg

SEQ ID NO: 122954 - DNA, 25 bp, E. coli
caactgctacggtcaggtttcacgg

SEQ ID NO: 122955 - DNA, 25 bp, E. coli
ctcaaacaactgctacggtcaggtt

SEQ ID NO: 122956 - DNA, 25 bp, E. coli
ctcaaacaactggtacggtcaggtt

SEQ ID NO: 122957 - DNA, 25 bp, E. coli
aaacaactgctacggtcaggtttca

SEQ ID NO: 122958 - DNA, 25 bp, E. coli
aaacaactgctagggtcaggtttca

SEQ ID NO: 122959 - DNA, 25 bp, E. coli
aaacctgtcgttgcgggcatgaagt

SEQ ID NO: 122960 - DNA, 25 bp, E. coli
aaacctgtcgttccgggcatgaagt

SEQ ID NO: 122961 - DNA, 25 bp, E. coli
tcgttccgggcaagaagttgtcgaa

SEQ ID NO: 122962 - DNA, 25 bp, E. coli
tcgttccgggcatgaagttgtcgaa

SEQ ID NO: 122963 - DNA, 25 bp, E. coli
gcaggggagcgtgtgaggcgattcg

SEQ ID NO: 122964 - DNA, 25 bp, E. coli
gcaggggagcgtctgaggcgattcg

SEQ ID NO: 122965 - DNA, 25 bp, E. coli
gatggtaaacctgtcgttccgggca

SEQ ID NO: 122966 - DNA, 25 bp, E. coli
cgttccgggcatgaagttgtcgaag

SEQ ID NO: 122967 - DNA, 25 bp, E. coli
gatggtaaacctctcgttccgggca

SEQ ID NO: 122968 - DNA, 25 bp, E. coli
cgttccgggcatcaagttgtcgaag

SEQ ID NO: 122969 - DNA, 25 bp, E. coli
ggtaaacctgtcgttccgggcatga

SEQ ID NO: 122970 - DNA, 25 bp, E. coli
ggtaaacctgtccttccgggcatga

SEQ ID NO: 122971 - DNA, 25 bp, E. coli
taaacctgtcgttccgggcatgaag

SEQ ID NO: 122972 - DNA, 25 bp, E. coli
taaacctgtcgtaccgggcatgaag

SEQ ID NO: 122973 - DNA, 25 bp, E. coli
taatgcaggtgatcgcaggggagcg

SEQ ID NO: 122974 - DNA, 25 bp, E. coli
taatgcaggtgaacgcaggggagcg

SEQ ID NO: 122975 - DNA, 25 bp, E. coli
catacagtgtctgtcgtgaagcgaa

SEQ ID NO: 122976 - DNA, 25 bp, E. coli
catacagtgtctctcgtgaagcgaa

SEQ ID NO: 122977 - DNA, 25 bp, E. coli
taaaattggtcactcgccatcggat

SEQ ID NO: 122978 - DNA, 25 bp, E. coli
taaaattggtcagtcgccatcggat

SEQ ID NO: 122979 - DNA, 25 bp, E. coli
tatggaatgagtaaaccgagactcg

SEQ ID NO: 122980 - DNA, 25 bp, E. coli
tatggaatgagttaaccgagactcg

SEQ ID NO: 122981 - DNA, 25 bp, E. coli
tatatacagagagcacatacagtgt

SEQ ID NO: 122982 - DNA, 25 bp, E. coli
tatatacagagaccacatacagtgt

SEQ ID NO: 122983 - DNA, 25 bp, E. coli
ttctcatggcgatatcacggatagt

SEQ ID NO: 122984 - DNA, 25 bp, E. coli
ttctcatggcgaaatcacggatagt

SEQ ID NO: 122985 - DNA, 25 bp, E. coli
gcttgctatctaaaaggaggcactc

SEQ ID NO: 122986 - DNA, 25 bp, E. coli
gcttgctatctataaggaggcactc

SEQ ID NO: 122987 - DNA, 25 bp, E. coli
gaaacagcgtttaagagccaaataa

SEQ ID NO: 122988 - DNA, 25 bp, E. coli
gaaacagcgttttagagccaaataa

SEQ ID NO: 122989 - DNA, 25 bp, E. coli
cgttgcctaagagaggatgcatcgg

SEQ ID NO: 122990 - DNA, 25 bp, E. coli
ctctctgagaaattaaaggtgcctg

SEQ ID NO: 122991 - DNA, 25 bp, E. coli
ctctctgagaaaataaaggtgcctg

SEQ ID NO: 122992 - DNA, 25 bp, E. coli
cgttgcctaagacaggatgcatcgg

SEQ ID NO: 122993 - DNA, 25 bp, E. coli
tagatcttggtcgtgctgggttagc

SEQ ID NO: 122994 - DNA, 25 bp, E. coli
tagatcttggtcctgctgggttagc

SEQ ID NO: 122995 - DNA, 25 bp, E. coli
gatgcatcggaggaaactgcgaaaa

SEQ ID NO: 122996 - DNA, 25 bp, E. coli
gatgcatcggagcaaactgcgaaaa

SEQ ID NO: 122997 - DNA, 25 bp, E. coli
caactgacatgtgatggtgaaaatc

SEQ ID NO: 122998 - DNA, 25 bp, E. coli
caccagaaaagaaaacgattgaggc

SEQ ID NO: 122999 - DNA, 25 bp, E. coli
caccagaaaagataacgattgaggc

SEQ ID NO: 123000 - DNA, 25 bp, E. coli
caactgacatgtcatggtgaaaatc

SEQ ID NO: 123001 - DNA, 25 bp, E. coli
taccgaacaactgaaatgggcatgg

SEQ ID NO: 123002 - DNA, 25 bp, E. coli
taccgaacaactcaaatgggcatgg

SEQ ID NO: 123003 - DNA, 25 bp, E. coli
tattgatgcacgaatctcacccaca

SEQ ID NO: 123004 - DNA, 25 bp, E. coli
tattgatgcacgtatctcacccaca

SEQ ID NO: 123005 - DNA, 25 bp, E. coli
tgacgccaaaagaatttcacctagg

SEQ ID NO: 123006 - DNA, 25 bp, E. coli
tgacgccaaaagtatttcacctagg

SEQ ID NO: 123007 - DNA, 25 bp, E. coli
gaacaactgattgtgtacggtagac

SEQ ID NO: 123008 - DNA, 25 bp, E. coli
gaacaactgattctgtacggtagac

SEQ ID NO: 123009 - DNA, 25 bp, E. coli
gacacaccctgtttactgacgccaa

SEQ ID NO: 123010 - DNA, 25 bp, E. coli
gacacaccctgtatactgacgccaa

SEQ ID NO: 123011 - DNA, 25 bp, E. coli
gaaaagagaaacgaagccaaatggc

SEQ ID NO: 123012 - DNA, 25 bp, E. coli
gaaaagagaaaccaagccaaatggc

SEQ ID NO: 123013 - DNA, 25 bp, E. coli
gatcgttatgaaggataaccccatg

SEQ ID NO: 123014 - DNA, 25 bp, E. coli
gatcgttatgaacgataaccccatg

SEQ ID NO: 123015 - DNA, 25 bp, E. coli
ggcagataatcacatacctgaatgg

SEQ ID NO: 123016 - DNA, 25 bp, E. coli
ggcagataatcagatacctgaatgg

SEQ ID NO: 123017 - DNA, 25 bp, E. coli
tcaaaactggctgggactcgaaaag

SEQ ID NO: 123018 - DNA, 25 bp, E. coli
tcaaaactggctcggactcgaaaag

SEQ ID NO: 123019 - DNA, 25 bp, E. coli
aatatacatggcaggcgcgcggcct

SEQ ID NO: 123020 - DNA, 25 bp, E. coli
aatatacatggctggcgcgcggcct

SEQ ID NO: 123021 - DNA, 25 bp, E. coli
caaaaaatatacatggcaggcgcgc

SEQ ID NO: 123022 - DNA, 25 bp, E. coli
caaaaaatatacttggcaggcgcgc

SEQ ID NO: 123023 - DNA, 25 bp, E. coli
atgaagacggcatagccccgctgct

SEQ ID NO: 123024 - DNA, 25 bp, E. coli
aggcgaccgtgacgattacgccgcc

SEQ ID NO: 123025 - DNA, 25 bp, E. coli
acctaccgcaaagtggcggagcacg

SEQ ID NO: 123026 - DNA, 25 bp, E. coli
atgaagacggcaaagccccgctgct

SEQ ID NO: 123027 - DNA, 25 bp, E. coli
acctaccgcaaactggcggagcacg

SEQ ID NO: 123028 - DNA, 25 bp, E. coli
aggcgaccgtgaggattacgccgcc

SEQ ID NO: 123029 - DNA, 25 bp, E. coli
aaaactgacgccttattatcagggc

SEQ ID NO: 123030 - DNA, 25 bp, E. coli
aaaactgacgccatattatcagggc

SEQ ID NO: 123031 - DNA, 25 bp, E. coli
tatccatgatgaagacggcaaagcc

SEQ ID NO: 123032 - DNA, 25 bp, E. coli
tatccatgatgatgacggcaaagcc

SEQ ID NO: 123033 - DNA, 25 bp, E. coli
tattatcagggcattggtccggcgt

SEQ ID NO: 123034 - DNA, 25 bp, E. coli
tattatcagggctttggtccggcgt

SEQ ID NO: 123035 - DNA, 25 bp, E. coli
gcgataagcgacctcggtgaagatt

SEQ ID NO: 123036 - DNA, 25 bp, E. coli
gcgataagcgacgtcggtgaagatt

SEQ ID NO: 123037 - DNA, 25 bp, E. coli
cgtgctgccgggtggtgccattgaa

SEQ ID NO: 123038 - DNA, 25 bp, E. coli
cgtgctgccgggaggtgccattgaa

SEQ ID NO: 123039 - DNA, 25 bp, E. coli
ggagcacgcgctggaaaaactgacg

SEQ ID NO: 123040 - DNA, 25 bp, E. coli
ggagcacgcgctcgaaaaactgacg

SEQ ID NO: 123041 - DNA, 25 bp, E. coli
taccctcgcgctcttgttgctggat

SEQ ID NO: 123042 - DNA, 25 bp, E. coli
taccctcgcgctgttgttgctggat

SEQ ID NO: 123043 - DNA, 25 bp, E. coli
tataccggtcagctctggcacagtg

SEQ ID NO: 123044 - DNA, 25 bp, E. coli
tattggtgtggtcaaagcgcctgaa

SEQ ID NO: 123045 - DNA, 25 bp, E. coli
tattggtgtggtgaaagcgcctgaa

SEQ ID NO: 123046 - DNA, 25 bp, E. coli
tataccggtcaggtctggcacagtg

SEQ ID NO: 123047 - DNA, 25 bp, E. coli
ttgtttttgaaacgctcaccgcgca

SEQ ID NO: 123048 - DNA, 25 bp, E. coli
ttgtttttgaaaggctcaccgcgca

SEQ ID NO: 123049 - DNA, 25 bp, E. coli
tgcttcaggcaatgataccggctgg

SEQ ID NO: 123050 - DNA, 25 bp, E. coli
tgcttcaggcaaagataccggctgg

SEQ ID NO: 123051 - DNA, 25 bp, E. coli
tgctggcgctttctgaacataccgg

SEQ ID NO: 123052 - DNA, 25 bp, E. coli
tgctggcgctttgtgaacataccgg

SEQ ID NO: 123053 - DNA, 25 bp, E. coli
gaaatgaccttatccagcaactggc

SEQ ID NO: 123054 - DNA, 25 bp, E. coli
gaaatgaccttaaccagcaactggc

SEQ ID NO: 123055 - DNA, 25 bp, E. coli
gactggtatgcgttttcactgccga

SEQ ID NO: 123056 - DNA, 25 bp, E. coli
gattttctaccacccaaacgggaag

SEQ ID NO: 123057 - DNA, 25 bp, E. coli
gatagcgcgctgttgttgggaacca

SEQ ID NO: 123058 - DNA, 25 bp, E. coli
gattttctaccagccaaacgggaag

SEQ ID NO: 123059 - DNA, 25 bp, E. coli
gatagcgcgctgatgttgggaacca

SEQ ID NO: 123060 - DNA, 25 bp, E. coli
ggccgcatcccacttttttaggtga

SEQ ID NO: 123061 - DNA, 25 bp, E. coli
ggccgcatcccagttttttaggtga

SEQ ID NO: 123062 - DNA, 25 bp, E. coli
gactggtatgcgatttcactgccga

SEQ ID NO: 123063 - DNA, 25 bp, E. coli
atcccggatggatgaatccgctgaa

SEQ ID NO: 123064 - DNA, 25 bp, E. coli
atcccggatggaagaatccgctgaa

SEQ ID NO: 123065 - DNA, 25 bp, E. coli
tatcccggatggaagaatccgctga

SEQ ID NO: 123066 - DNA, 25 bp, E. coli
tatcccggatggtagaatccgctga

SEQ ID NO: 123067 - DNA, 25 bp, E. coli
ttatcccggatggaagaatccgctg

SEQ ID NO: 123068 - DNA, 25 bp, E. coli
ttacagggattaaggcgggtcgatt

SEQ ID NO: 123069 - DNA, 25 bp, E. coli
ttatcccggatgcaagaatccgctg

SEQ ID NO: 123070 - DNA, 25 bp, E. coli
ttacagggattatggcgggtcgatt

SEQ ID NO: 123071 - DNA, 25 bp, E. coli
ttgcttacagggattatggcgggtc

SEQ ID NO: 123072 - DNA, 25 bp, E. coli
ttgcttacagggtttatggcgggtc

SEQ ID NO: 123073 - DNA, 25 bp, E. coli
tcccggatggaacaatccgctgaac

SEQ ID NO: 123074 - DNA, 25 bp, E. coli
tcccggatggaagaatccgctgaac

SEQ ID NO: 123075 - DNA, 25 bp, E. coli
tcttatcccggaaggaagaatccgc

SEQ ID NO: 123076 - DNA, 25 bp, E. coli
tcttatcccggatggaagaatccgc

SEQ ID NO: 123077 - DNA, 25 bp, E. coli
cttacagggattttggcgggtcgat

SEQ ID NO: 123078 - DNA, 25 bp, E. coli
cttcttatcccgcatggaagaatcc

SEQ ID NO: 123079 - DNA, 25 bp, E. coli
cttatcccggatggaagaatccgct

SEQ ID NO: 123080 - DNA, 25 bp, E. coli
cttacagggattatggcgggtcgat

SEQ ID NO: 123081 - DNA, 25 bp, E. coli
cttatcccggatcgaagaatccgct

SEQ ID NO: 123082 - DNA, 25 bp, E. coli
cttcttatcccggatggaagaatcc

SEQ ID NO: 123083 - DNA, 25 bp, E. coli
tttccttcttatcccggatggaaga

SEQ ID NO: 123084 - DNA, 25 bp, E. coli
tttccttcttatgccggatggaaga

SEQ ID NO: 123085 - DNA, 25 bp, E. coli
aatatgccagcgttgtcgaaggccg

SEQ ID NO: 123086 - DNA, 25 bp, E. coli
aatatgccagcgatgtcgaaggccg

SEQ ID NO: 123087 - DNA, 25 bp, E. coli
aaatccccttctgcatcggtgacgg

SEQ ID NO: 123088 - DNA, 25 bp, E. coli
aaatccccttctccatcggtgacgg

SEQ ID NO: 123089 - DNA, 25 bp, E. coli
tagcacacagcggaatgaaaccagt

SEQ ID NO: 123090 - DNA, 25 bp, E. coli
tagcacacagcgcaatgaaaccagt

SEQ ID NO: 123091 - DNA, 25 bp, E. coli
tccgatcaggatcgtggcgcaattg

SEQ ID NO: 123092 - DNA, 25 bp, E. coli
tccgatcaggatggtggcgcaattg
